United States Patent 7,314,750 (ADDRESSABLE OLIGONUCLEOTIDE ARRAY OF THE RAT GENOME) - sequence listing, part 10

SEQ ID NO: 340502 - DNA, 25 bp, Rattus norvegicus
gagccaacagctaaaaagcctccag

SEQ ID NO: 340503 - DNA, 25 bp, Rattus norvegicus
gagccaacagcttaaaagcctccag

SEQ ID NO: 340504 - DNA, 25 bp, Rattus norvegicus
gagccaacatgtcaccaggacctgt

SEQ ID NO: 340505 - DNA, 25 bp, Rattus norvegicus
gagccaacatgtgaccaggacctgt

SEQ ID NO: 340506 - DNA, 25 bp, Rattus norvegicus
gagccaacattcaggtcctcttgag

SEQ ID NO: 340507 - DNA, 25 bp, Rattus norvegicus
gagccaacattcatcccatggcaaa

SEQ ID NO: 340508 - DNA, 25 bp, Rattus norvegicus
gagccaacattctggtcctcttgag

SEQ ID NO: 340509 - DNA, 25 bp, Rattus norvegicus
gagccaacattcttcccatggcaaa

SEQ ID NO: 340510 - DNA, 25 bp, Rattus norvegicus
gagccaaccaagaagctgtcatgat

SEQ ID NO: 340511 - DNA, 25 bp, Rattus norvegicus
gagccaaccaagtagctgtcatgat

SEQ ID NO: 340512 - DNA, 25 bp, Rattus norvegicus
gagccaacctaacaaaggctgcaga

SEQ ID NO: 340513 - DNA, 25 bp, Rattus norvegicus
gagccaacctaagaaaggctgcaga

SEQ ID NO: 340514 - DNA, 25 bp, Rattus norvegicus
gagccaacctgtaaggccttttgtt

SEQ ID NO: 340515 - DNA, 25 bp, Rattus norvegicus
gagccaacctgttaggccttttgtt

SEQ ID NO: 340516 - DNA, 25 bp, Rattus norvegicus
gagccaaccttccaaaagccagata

SEQ ID NO: 340517 - DNA, 25 bp, Rattus norvegicus
gagccaaccttcgaaaagccagata

SEQ ID NO: 340518 - DNA, 25 bp, Rattus norvegicus
gagccaacgacaattgaagactttg

SEQ ID NO: 340519 - DNA, 25 bp, Rattus norvegicus
gagccaacgacatttgaagactttg

SEQ ID NO: 340520 - DNA, 25 bp, Rattus norvegicus
gagccaactgtacctgttcttcagc

SEQ ID NO: 340521 - DNA, 25 bp, Rattus norvegicus
gagccaactgtagctgttcttcagc

SEQ ID NO: 340522 - DNA, 25 bp, Rattus norvegicus
gagccaactttccaattgacacgta

SEQ ID NO: 340523 - DNA, 25 bp, Rattus norvegicus
gagccaactttcgaattgacacgta

SEQ ID NO: 340524 - DNA, 25 bp, Rattus norvegicus
gagccaagaagcacttcctgtaagt

SEQ ID NO: 340525 - DNA, 25 bp, Rattus norvegicus
gagccaagaagctcttcctgtaagt

SEQ ID NO: 340526 - DNA, 25 bp, Rattus norvegicus
gagccaagacatcaactgggagcaa

SEQ ID NO: 340527 - DNA, 25 bp, Rattus norvegicus
gagccaagacatgaactgggagcaa

SEQ ID NO: 340528 - DNA, 25 bp, Rattus norvegicus
gagccaagagacattgcttccctta

SEQ ID NO: 340529 - DNA, 25 bp, Rattus norvegicus
gagccaagagactttgcttccctta

SEQ ID NO: 340530 - DNA, 25 bp, Rattus norvegicus
gagccaagagctctaacctcatgtg

SEQ ID NO: 340531 - DNA, 25 bp, Rattus norvegicus
gagccaagagctgtaacctcatgtg

SEQ ID NO: 340532 - DNA, 25 bp, Rattus norvegicus
gagccaagattaatcctggtcagct

SEQ ID NO: 340533 - DNA, 25 bp, Rattus norvegicus
gagccaagattattcctggtcagct

SEQ ID NO: 340534 - DNA, 25 bp, Rattus norvegicus
gagccaagcaacagcaggtctgaaa

SEQ ID NO: 340535 - DNA, 25 bp, Rattus norvegicus
gagccaagcaactgcaggtctgaaa

SEQ ID NO: 340536 - DNA, 25 bp, Rattus norvegicus
gagccaagcatgatttacccacaaa

SEQ ID NO: 340537 - DNA, 25 bp, Rattus norvegicus
gagccaagcatgttttacccacaaa

SEQ ID NO: 340538 - DNA, 25 bp, Rattus norvegicus
gagccaagccggcaacgcattaatc

SEQ ID NO: 340539 - DNA, 25 bp, Rattus norvegicus
gagccaagccgggaacgcattaatc

SEQ ID NO: 340540 - DNA, 25 bp, Rattus norvegicus
gagccaagctgtaccaaggcacact

SEQ ID NO: 340541 - DNA, 25 bp, Rattus norvegicus
gagccaagctgttccaaggcacact

SEQ ID NO: 340542 - DNA, 25 bp, Rattus norvegicus
gagccaaggacaaagttgttcccct

SEQ ID NO: 340543 - DNA, 25 bp, Rattus norvegicus
gagccaaggacatagttgttcccct

SEQ ID NO: 340544 - DNA, 25 bp, Rattus norvegicus
gagccaaggataagcttacatcttt

SEQ ID NO: 340545 - DNA, 25 bp, Rattus norvegicus
gagccaaggatatgcttacatcttt

SEQ ID NO: 340546 - DNA, 25 bp, Rattus norvegicus
gagccaaggcaaacccagaaggacg

SEQ ID NO: 340547 - DNA, 25 bp, Rattus norvegicus
gagccaaggcaatcccagaaggacg

SEQ ID NO: 340548 - DNA, 25 bp, Rattus norvegicus
gagccaaggcctcgcaatcatgcag

SEQ ID NO: 340549 - DNA, 25 bp, Rattus norvegicus
gagccaaggcctggcaatcatgcag

SEQ ID NO: 340550 - DNA, 25 bp, Rattus norvegicus
gagccaaggctccaagtcgtatgta

SEQ ID NO: 340551 - DNA, 25 bp, Rattus norvegicus
gagccaaggctcgaagtcgtatgta

SEQ ID NO: 340552 - DNA, 25 bp, Rattus norvegicus
gagccaagtccacacttctgtgagc

SEQ ID NO: 340553 - DNA, 25 bp, Rattus norvegicus
gagccaagtccagacttctgtgagc

SEQ ID NO: 340554 - DNA, 25 bp, Rattus norvegicus
gagccaagtgctctctgaacaagtt

SEQ ID NO: 340555 - DNA, 25 bp, Rattus norvegicus
gagccaagtgctgtctgaacaagtt

SEQ ID NO: 340556 - DNA, 25 bp, Rattus norvegicus
gagccaagtgtccacaggtgtgttt

SEQ ID NO: 340557 - DNA, 25 bp, Rattus norvegicus
gagccaagtgtcgacaggtgtgttt

SEQ ID NO: 340558 - DNA, 25 bp, Rattus norvegicus
gagccaagtgtgcaatccgaagtcc

SEQ ID NO: 340559 - DNA, 25 bp, Rattus norvegicus
gagccaagtgtggaatccgaagtcc

SEQ ID NO: 340560 - DNA, 25 bp, Rattus norvegicus
gagccaagttgtacctgttcattaa

SEQ ID NO: 340561 - DNA, 25 bp, Rattus norvegicus
gagccaagttgttcctgttcattaa

SEQ ID NO: 340562 - DNA, 25 bp, Rattus norvegicus
gagccaataagtctatcccgcaaag

SEQ ID NO: 340563 - DNA, 25 bp, Rattus norvegicus
gagccaataagtgtatcccgcaaag

SEQ ID NO: 340564 - DNA, 25 bp, Rattus norvegicus
gagccaatacaacagcactcaggtt

SEQ ID NO: 340565 - DNA, 25 bp, Rattus norvegicus
gagccaatacaagagcactcaggtt

SEQ ID NO: 340566 - DNA, 25 bp, Rattus norvegicus
gagccaatacagcaggtcatcacca

SEQ ID NO: 340567 - DNA, 25 bp, Rattus norvegicus
gagccaatacaggaggtcatcacca

SEQ ID NO: 340568 - DNA, 25 bp, Rattus norvegicus
gagccaatacccatgagatatcccg

SEQ ID NO: 340569 - DNA, 25 bp, Rattus norvegicus
gagccaatacccttgagatatcccg

SEQ ID NO: 340570 - DNA, 25 bp, Rattus norvegicus
gagccaatacgtagcatctgtacgg

SEQ ID NO: 340571 - DNA, 25 bp, Rattus norvegicus
gagccaatacgttgcatctgtacgg

SEQ ID NO: 340572 - DNA, 25 bp, Rattus norvegicus
gagccaatcaagaactgttatgtct

SEQ ID NO: 340573 - DNA, 25 bp, Rattus norvegicus
gagccaatcaagtactgttatgtct

SEQ ID NO: 340574 - DNA, 25 bp, Rattus norvegicus
gagccaatcactacagccaatcatg

SEQ ID NO: 340575 - DNA, 25 bp, Rattus norvegicus
gagccaatcacttcagccaatcatg

SEQ ID NO: 340576 - DNA, 25 bp, Rattus norvegicus
gagccaatccaactaaacaaaccct

SEQ ID NO: 340577 - DNA, 25 bp, Rattus norvegicus
gagccaatccaagtaaacaaaccct

SEQ ID NO: 340578 - DNA, 25 bp, Rattus norvegicus
gagccaatccccacttgaatggtaa

SEQ ID NO: 340579 - DNA, 25 bp, Rattus norvegicus
gagccaatcccctcttgaatggtaa

SEQ ID NO: 340580 - DNA, 25 bp, Rattus norvegicus
gagccaatcgttatacagtctgtcc

SEQ ID NO: 340581 - DNA, 25 bp, Rattus norvegicus
gagccaatcgttttacagtctgtcc

SEQ ID NO: 340582 - DNA, 25 bp, Rattus norvegicus
gagccaatctagcttctttcagtat

SEQ ID NO: 340583 - DNA, 25 bp, Rattus norvegicus
gagccaatctaggttctttcagtat

SEQ ID NO: 340584 - DNA, 25 bp, Rattus norvegicus
gagccaatctgtcaacattcaagtg

SEQ ID NO: 340585 - DNA, 25 bp, Rattus norvegicus
gagccaatctgtctcttcactgtgt

SEQ ID NO: 340586 - DNA, 25 bp, Rattus norvegicus
gagccaatctgtgaacattcaagtg

SEQ ID NO: 340587 - DNA, 25 bp, Rattus norvegicus
gagccaatctgtgtcttcactgtgt

SEQ ID NO: 340588 - DNA, 25 bp, Rattus norvegicus
gagccaatgaagaccctttcttgtt

SEQ ID NO: 340589 - DNA, 25 bp, Rattus norvegicus
gagccaatgaagtccctttcttgtt

SEQ ID NO: 340590 - DNA, 25 bp, Rattus norvegicus
gagccaatgccactgtcagttcagt

SEQ ID NO: 340591 - DNA, 25 bp, Rattus norvegicus
gagccaatgccagtgtcagttcagt

SEQ ID NO: 340592 - DNA, 25 bp, Rattus norvegicus
gagccaatgtctcctttgtacacac

SEQ ID NO: 340593 - DNA, 25 bp, Rattus norvegicus
gagccaatgtctgctttgtacacac

SEQ ID NO: 340594 - DNA, 25 bp, Rattus norvegicus
gagccaatgttgatttcctaaggta

SEQ ID NO: 340595 - DNA, 25 bp, Rattus norvegicus
gagccaatgttgttttcctaaggta

SEQ ID NO: 340596 - DNA, 25 bp, Rattus norvegicus
gagccaattcccatagctgtacttt

SEQ ID NO: 340597 - DNA, 25 bp, Rattus norvegicus
gagccaattcccttagctgtacttt

SEQ ID NO: 340598 - DNA, 25 bp, Rattus norvegicus
gagccaattcttacagtcaggagac

SEQ ID NO: 340599 - DNA, 25 bp, Rattus norvegicus
gagccaattctttcagtcaggagac

SEQ ID NO: 340600 - DNA, 25 bp, Rattus norvegicus
gagccacaaaatcttgcctgtctag

SEQ ID NO: 340601 - DNA, 25 bp, Rattus norvegicus
gagccacaaaatgttgcctgtctag

SEQ ID NO: 340602 - DNA, 25 bp, Rattus norvegicus
gagccacaaagtatcaggagccttt

SEQ ID NO: 340603 - DNA, 25 bp, Rattus norvegicus
gagccacaaagtccttccccaaggt

SEQ ID NO: 340604 - DNA, 25 bp, Rattus norvegicus
gagccacaaagtgcttccccaaggt

SEQ ID NO: 340605 - DNA, 25 bp, Rattus norvegicus
gagccacaaagtttcaggagccttt

SEQ ID NO: 340606 - DNA, 25 bp, Rattus norvegicus
gagccacaagaccatagacctctct

SEQ ID NO: 340607 - DNA, 25 bp, Rattus norvegicus
gagccacaagacgatagacctctct

SEQ ID NO: 340608 - DNA, 25 bp, Rattus norvegicus
gagccacaagcacatcctgtagtat

SEQ ID NO: 340609 - DNA, 25 bp, Rattus norvegicus
gagccacaagcagatcctgtagtat

SEQ ID NO: 340610 - DNA, 25 bp, Rattus norvegicus
gagccacaagtaagccatggcgcgc

SEQ ID NO: 340611 - DNA, 25 bp, Rattus norvegicus
gagccacaagtatgccatggcgcgc

SEQ ID NO: 340612 - DNA, 25 bp, Rattus norvegicus
gagccacaatgtcatcttcaccttg

SEQ ID NO: 340613 - DNA, 25 bp, Rattus norvegicus
gagccacaatgtgatcttcaccttg

SEQ ID NO: 340614 - DNA, 25 bp, Rattus norvegicus
gagccacacgcgcaccgagtgtaag

SEQ ID NO: 340615 - DNA, 25 bp, Rattus norvegicus
gagccacacgcggaccgagtgtaag

SEQ ID NO: 340616 - DNA, 25 bp, Rattus norvegicus
gagccacacgctatatgaggtcttt

SEQ ID NO: 340617 - DNA, 25 bp, Rattus norvegicus
gagccacacgctttatgaggtcttt

SEQ ID NO: 340618 - DNA, 25 bp, Rattus norvegicus
gagccacactgcagtgaaagttgca

SEQ ID NO: 340619 - DNA, 25 bp, Rattus norvegicus
gagccacactgctgtgaaagttgca

SEQ ID NO: 340620 - DNA, 25 bp, Rattus norvegicus
gagccacactgtcaagtgcagtcct

SEQ ID NO: 340621 - DNA, 25 bp, Rattus norvegicus
gagccacactgtgaagtgcagtcct

SEQ ID NO: 340622 - DNA, 25 bp, Rattus norvegicus
gagccacagactaccttctgtaagg

SEQ ID NO: 340623 - DNA, 25 bp, Rattus norvegicus
gagccacagacttccttctgtaagg

SEQ ID NO: 340624 - DNA, 25 bp, Rattus norvegicus
gagccacagagcaacgggttctaaa

SEQ ID NO: 340625 - DNA, 25 bp, Rattus norvegicus
gagccacagagctacgggttctaaa

SEQ ID NO: 340626 - DNA, 25 bp, Rattus norvegicus
gagccacagagtactttaaacacag

SEQ ID NO: 340627 - DNA, 25 bp, Rattus norvegicus
gagccacagagttctttaaacacag

SEQ ID NO: 340628 - DNA, 25 bp, Rattus norvegicus
gagccacagataacctcatcctaag

SEQ ID NO: 340629 - DNA, 25 bp, Rattus norvegicus
gagccacagatatcctcatcctaag

SEQ ID NO: 340630 - DNA, 25 bp, Rattus norvegicus
gagccacagattcaaaccttgtttg

SEQ ID NO: 340631 - DNA, 25 bp, Rattus norvegicus
gagccacagattgaaaccttgtttg

SEQ ID NO: 340632 - DNA, 25 bp, Rattus norvegicus
gagccacagctcaccagaatgcaag

SEQ ID NO: 340633 - DNA, 25 bp, Rattus norvegicus
gagccacagctctccagaatgcaag

SEQ ID NO: 340634 - DNA, 25 bp, Rattus norvegicus
gagccacagcttaatggacctccac

SEQ ID NO: 340635 - DNA, 25 bp, Rattus norvegicus
gagccacagctttatggacctccac

SEQ ID NO: 340636 - DNA, 25 bp, Rattus norvegicus
gagccacagggcagcgcctcaaaga

SEQ ID NO: 340637 - DNA, 25 bp, Rattus norvegicus
gagccacagggctgcgcctcaaaga

SEQ ID NO: 340638 - DNA, 25 bp, Rattus norvegicus
gagccacaggttatgattcttgcaa

SEQ ID NO: 340639 - DNA, 25 bp, Rattus norvegicus
gagccacaggttttgattcttgcaa

SEQ ID NO: 340640 - DNA, 25 bp, Rattus norvegicus
gagccacagtctcaggatgacctct

SEQ ID NO: 340641 - DNA, 25 bp, Rattus norvegicus
gagccacagtctgaggatgacctct

SEQ ID NO: 340642 - DNA, 25 bp, Rattus norvegicus
gagccacagtggagaggtccccgct

SEQ ID NO: 340643 - DNA, 25 bp, Rattus norvegicus
gagccacagtggtgaggtccccgct

SEQ ID NO: 340644 - DNA, 25 bp, Rattus norvegicus
gagccacataaaatctcactaaaag

SEQ ID NO: 340645 - DNA, 25 bp, Rattus norvegicus
gagccacataaattctcactaaaag

SEQ ID NO: 340646 - DNA, 25 bp, Rattus norvegicus
gagccacatcaaagtgcgctgctac

SEQ ID NO: 340647 - DNA, 25 bp, Rattus norvegicus
gagccacatcaatgtgcgctgctac

SEQ ID NO: 340648 - DNA, 25 bp, Rattus norvegicus
gagccacatcacagcttttcaaggt

SEQ ID NO: 340649 - DNA, 25 bp, Rattus norvegicus
gagccacatcactgcttttcaaggt

SEQ ID NO: 340650 - DNA, 25 bp, Rattus norvegicus
gagccacatctgatctctattcgat

SEQ ID NO: 340651 - DNA, 25 bp, Rattus norvegicus
gagccacatctgttctctattcgat

SEQ ID NO: 340652 - DNA, 25 bp, Rattus norvegicus
gagccacatgagcaaggcttcttct

SEQ ID NO: 340653 - DNA, 25 bp, Rattus norvegicus
gagccacatgaggaaggcttcttct

SEQ ID NO: 340654 - DNA, 25 bp, Rattus norvegicus
gagccacatggcacaggaagtacct

SEQ ID NO: 340655 - DNA, 25 bp, Rattus norvegicus
gagccacatggccagttcaagtcca

SEQ ID NO: 340656 - DNA, 25 bp, Rattus norvegicus
gagccacatggcgagttcaagtcca

SEQ ID NO: 340657 - DNA, 25 bp, Rattus norvegicus
gagccacatggctcaggaagtacct

SEQ ID NO: 340658 - DNA, 25 bp, Rattus norvegicus
gagccaccaaagacttgatcttcct

SEQ ID NO: 340659 - DNA, 25 bp, Rattus norvegicus
gagccaccaaagtcttgatcttcct

SEQ ID NO: 340660 - DNA, 25 bp, Rattus norvegicus
gagccaccacagcttggcactgaat

SEQ ID NO: 340661 - DNA, 25 bp, Rattus norvegicus
gagccaccacaggttggcactgaat

SEQ ID NO: 340662 - DNA, 25 bp, Rattus norvegicus
gagccaccactgagtggtcctgagc

SEQ ID NO: 340663 - DNA, 25 bp, Rattus norvegicus
gagccaccactgtgtggtcctgagc

SEQ ID NO: 340664 - DNA, 25 bp, Rattus norvegicus
gagccaccatgtcggcactgtggtt

SEQ ID NO: 340665 - DNA, 25 bp, Rattus norvegicus
gagccaccatgtgggcactgtggtt

SEQ ID NO: 340666 - DNA, 25 bp, Rattus norvegicus
gagccacccaaaatgttcaagtcaa

SEQ ID NO: 340667 - DNA, 25 bp, Rattus norvegicus
gagccacccaaattgttcaagtcaa

SEQ ID NO: 340668 - DNA, 25 bp, Rattus norvegicus
gagccacccactccgtggatgaaga

SEQ ID NO: 340669 - DNA, 25 bp, Rattus norvegicus
gagccacccactgcgtggatgaaga

SEQ ID NO: 340670 - DNA, 25 bp, Rattus norvegicus
gagccacccagacaaaagccagtga

SEQ ID NO: 340671 - DNA, 25 bp, Rattus norvegicus
gagccacccagagaaaagccagtga

SEQ ID NO: 340672 - DNA, 25 bp, Rattus norvegicus
gagccacccaggaatcagcacaggt

SEQ ID NO: 340673 - DNA, 25 bp, Rattus norvegicus
gagccacccaggtatcagcacaggt

SEQ ID NO: 340674 - DNA, 25 bp, Rattus norvegicus
gagccacccctgctagctactttaa

SEQ ID NO: 340675 - DNA, 25 bp, Rattus norvegicus
gagccacccctggtagctactttaa

SEQ ID NO: 340676 - DNA, 25 bp, Rattus norvegicus
gagccaccctacactaagaggctaa

SEQ ID NO: 340677 - DNA, 25 bp, Rattus norvegicus
gagccaccctactctaagaggctaa

SEQ ID NO: 340678 - DNA, 25 bp, Rattus norvegicus
gagccaccctgaatcgttttcagag

SEQ ID NO: 340679 - DNA, 25 bp, Rattus norvegicus
gagccaccctgattcgttttcagag

SEQ ID NO: 340680 - DNA, 25 bp, Rattus norvegicus
gagccaccgaagatcttactctgga

SEQ ID NO: 340681 - DNA, 25 bp, Rattus norvegicus
gagccaccgaagttcttactctgga

SEQ ID NO: 340682 - DNA, 25 bp, Rattus norvegicus
gagccaccgatgaacagtgcaatgt

SEQ ID NO: 340683 - DNA, 25 bp, Rattus norvegicus
gagccaccgatgtacagtgcaatgt

SEQ ID NO: 340684 - DNA, 25 bp, Rattus norvegicus
gagccaccgcagattctgagtggac

SEQ ID NO: 340685 - DNA, 25 bp, Rattus norvegicus
gagccaccgcagtttctgagtggac

SEQ ID NO: 340686 - DNA, 25 bp, Rattus norvegicus
gagccacctactaggattatttttt

SEQ ID NO: 340687 - DNA, 25 bp, Rattus norvegicus
gagccacctacttggattatttttt

SEQ ID NO: 340688 - DNA, 25 bp, Rattus norvegicus
gagccacctgaaaggttagtgtcaa

SEQ ID NO: 340689 - DNA, 25 bp, Rattus norvegicus
gagccacctgaatggttagtgtcaa

SEQ ID NO: 340690 - DNA, 25 bp, Rattus norvegicus
gagccacctgtaacctaatgaactt

SEQ ID NO: 340691 - DNA, 25 bp, Rattus norvegicus
gagccacctgtatcctaatgaactt

SEQ ID NO: 340692 - DNA, 25 bp, Rattus norvegicus
gagccacgaaggctgctctgagcat

SEQ ID NO: 340693 - DNA, 25 bp, Rattus norvegicus
gagccacgaagggtgctctgagcat

SEQ ID NO: 340694 - DNA, 25 bp, Rattus norvegicus
gagccacgagctcccgtgttagatg

SEQ ID NO: 340695 - DNA, 25 bp, Rattus norvegicus
gagccacgagctgccgtgttagatg

SEQ ID NO: 340696 - DNA, 25 bp, Rattus norvegicus
gagccacgcctgagtgaagctgagt

SEQ ID NO: 340697 - DNA, 25 bp, Rattus norvegicus
gagccacgcctgtgtgaagctgagt

SEQ ID NO: 340698 - DNA, 25 bp, Rattus norvegicus
gagccacgctccattaagaggcaga

SEQ ID NO: 340699 - DNA, 25 bp, Rattus norvegicus
gagccacgctcctttaagaggcaga

SEQ ID NO: 340700 - DNA, 25 bp, Rattus norvegicus
gagccacggacacttactggcttct

SEQ ID NO: 340701 - DNA, 25 bp, Rattus norvegicus
gagccacggacagttactggcttct

SEQ ID NO: 340702 - DNA, 25 bp, Rattus norvegicus
gagccacggcgcatttgtaataata

SEQ ID NO: 340703 - DNA, 25 bp, Rattus norvegicus
gagccacggcgcttttgtaataata

SEQ ID NO: 340704 - DNA, 25 bp, Rattus norvegicus
gagccacggctaaccaagtcacaga

SEQ ID NO: 340705 - DNA, 25 bp, Rattus norvegicus
gagccacggctatccaagtcacaga

SEQ ID NO: 340706 - DNA, 25 bp, Rattus norvegicus
gagccacggtatcttcagccagact

SEQ ID NO: 340707 - DNA, 25 bp, Rattus norvegicus
gagccacggtatgttcagccagact

SEQ ID NO: 340708 - DNA, 25 bp, Rattus norvegicus
gagccacgttgaataactgcccgtc

SEQ ID NO: 340709 - DNA, 25 bp, Rattus norvegicus
gagccacgttgattaactgcccgtc

SEQ ID NO: 340710 - DNA, 25 bp, Rattus norvegicus
gagccactacgacctacgtgtacaa

SEQ ID NO: 340711 - DNA, 25 bp, Rattus norvegicus
gagccactacgagctacgtgtacaa

SEQ ID NO: 340712 - DNA, 25 bp, Rattus norvegicus
gagccactatttccattgcttgaat

SEQ ID NO: 340713 - DNA, 25 bp, Rattus norvegicus
gagccactatttgcattgcttgaat

SEQ ID NO: 340714 - DNA, 25 bp, Rattus norvegicus
gagccactcatgaagctgggccctt

SEQ ID NO: 340715 - DNA, 25 bp, Rattus norvegicus
gagccactcatgtagctgggccctt

SEQ ID NO: 340716 - DNA, 25 bp, Rattus norvegicus
gagccactccggagcagctgagaaa

SEQ ID NO: 340717 - DNA, 25 bp, Rattus norvegicus
gagccactccggtgcagctgagaaa

SEQ ID NO: 340718 - DNA, 25 bp, Rattus norvegicus
gagccactcgtacttttgcacattt

SEQ ID NO: 340719 - DNA, 25 bp, Rattus norvegicus
gagccactcgtagttttgcacattt

SEQ ID NO: 340720 - DNA, 25 bp, Rattus norvegicus
gagccactctcactatgccaaatat

SEQ ID NO: 340721 - DNA, 25 bp, Rattus norvegicus
gagccactctcagtatgccaaatat

SEQ ID NO: 340722 - DNA, 25 bp, Rattus norvegicus
gagccactctctagtcttctgtgaa

SEQ ID NO: 340723 - DNA, 25 bp, Rattus norvegicus
gagccactctcttgtcttctgtgaa

SEQ ID NO: 340724 - DNA, 25 bp, Rattus norvegicus
gagccactctgtcagttggactgca

SEQ ID NO: 340725 - DNA, 25 bp, Rattus norvegicus
gagccactctgtgagttggactgca

SEQ ID NO: 340726 - DNA, 25 bp, Rattus norvegicus
gagccactgcatatcagtagctgca

SEQ ID NO: 340727 - DNA, 25 bp, Rattus norvegicus
gagccactgcatttcagtagctgca

SEQ ID NO: 340728 - DNA, 25 bp, Rattus norvegicus
gagccactggccaccttgataggga

SEQ ID NO: 340729 - DNA, 25 bp, Rattus norvegicus
gagccactggcctccttgataggga

SEQ ID NO: 340730 - DNA, 25 bp, Rattus norvegicus
gagccactgggtaggacaagcattt

SEQ ID NO: 340731 - DNA, 25 bp, Rattus norvegicus
gagccactgggttggacaagcattt

SEQ ID NO: 340732 - DNA, 25 bp, Rattus norvegicus
gagccactgtggaccaatgacaaca

SEQ ID NO: 340733 - DNA, 25 bp, Rattus norvegicus
gagccactgtggtccaatgacaaca

SEQ ID NO: 340734 - DNA, 25 bp, Rattus norvegicus
gagccactgttcaaagcccagggaa

SEQ ID NO: 340735 - DNA, 25 bp, Rattus norvegicus
gagccactgttctaagcccagggaa

SEQ ID NO: 340736 - DNA, 25 bp, Rattus norvegicus
gagccacttactaactatgacatga

SEQ ID NO: 340737 - DNA, 25 bp, Rattus norvegicus
gagccacttacttactatgacatga

SEQ ID NO: 340738 - DNA, 25 bp, Rattus norvegicus
gagccacttattctcagggcacact

SEQ ID NO: 340739 - DNA, 25 bp, Rattus norvegicus
gagccacttattgtcagggcacact

SEQ ID NO: 340740 - DNA, 25 bp, Rattus norvegicus
gagccacttcaacgaccttctatga

SEQ ID NO: 340741 - DNA, 25 bp, Rattus norvegicus
gagccacttcaaggaccttctatga

SEQ ID NO: 340742 - DNA, 25 bp, Rattus norvegicus
gagccacttcatcactaaagagctg

SEQ ID NO: 340743 - DNA, 25 bp, Rattus norvegicus
gagccacttcatgactaaagagctg

SEQ ID NO: 340744 - DNA, 25 bp, Rattus norvegicus
gagccacttgacatgagtatcggga

SEQ ID NO: 340745 - DNA, 25 bp, Rattus norvegicus
gagccacttgacttgagtatcggga

SEQ ID NO: 340746 - DNA, 25 bp, Rattus norvegicus
gagccacttgccactcaagcaggag

SEQ ID NO: 340747 - DNA, 25 bp, Rattus norvegicus
gagccacttgcctctcaagcaggag

SEQ ID NO: 340748 - DNA, 25 bp, Rattus norvegicus
gagccactttcacgaatctccaagt

SEQ ID NO: 340749 - DNA, 25 bp, Rattus norvegicus
gagccactttcaggaatctccaagt

SEQ ID NO: 340750 - DNA, 25 bp, Rattus norvegicus
gagccagaaaagctcattgaagttt

SEQ ID NO: 340751 - DNA, 25 bp, Rattus norvegicus
gagccagaaaaggtcattgaagttt

SEQ ID NO: 340752 - DNA, 25 bp, Rattus norvegicus
gagccagaaacaaatcaacagcatc

SEQ ID NO: 340753 - DNA, 25 bp, Rattus norvegicus
gagccagaaacatatcaacagcatc

SEQ ID NO: 340754 - DNA, 25 bp, Rattus norvegicus
gagccagaaatgagggaattccctg

SEQ ID NO: 340755 - DNA, 25 bp, Rattus norvegicus
gagccagaaatgtgggaattccctg

SEQ ID NO: 340756 - DNA, 25 bp, Rattus norvegicus
gagccagaacctcacgagtggacgt

SEQ ID NO: 340757 - DNA, 25 bp, Rattus norvegicus
gagccagaacctgacgagtggacgt

SEQ ID NO: 340758 - DNA, 25 bp, Rattus norvegicus
gagccagaagccaggacaaagccct

SEQ ID NO: 340759 - DNA, 25 bp, Rattus norvegicus
gagccagaagcctggacaaagccct

SEQ ID NO: 340760 - DNA, 25 bp, Rattus norvegicus
gagccagaagctacaagacttagat

SEQ ID NO: 340761 - DNA, 25 bp, Rattus norvegicus
gagccagaagcttcaagacttagat

SEQ ID NO: 340762 - DNA, 25 bp, Rattus norvegicus
gagccagaataaaatgggtccccaa

SEQ ID NO: 340763 - DNA, 25 bp, Rattus norvegicus
gagccagaataatatgggtccccaa

SEQ ID NO: 340764 - DNA, 25 bp, Rattus norvegicus
gagccagaatcccttttggaggact

SEQ ID NO: 340765 - DNA, 25 bp, Rattus norvegicus
gagccagaatccgttttggaggact

SEQ ID NO: 340766 - DNA, 25 bp, Rattus norvegicus
gagccagaatggagacgccaccctt

SEQ ID NO: 340767 - DNA, 25 bp, Rattus norvegicus
gagccagaatggtgacgccaccctt

SEQ ID NO: 340768 - DNA, 25 bp, Rattus norvegicus
gagccagacagtaatctcccatttt

SEQ ID NO: 340769 - DNA, 25 bp, Rattus norvegicus
gagccagacagttatctcccatttt

SEQ ID NO: 340770 - DNA, 25 bp, Rattus norvegicus
gagccagacatactagcacacagat

SEQ ID NO: 340771 - DNA, 25 bp, Rattus norvegicus
gagccagacatagtagcacacagat

SEQ ID NO: 340772 - DNA, 25 bp, Rattus norvegicus
gagccagaccatctttgctgtgact

SEQ ID NO: 340773 - DNA, 25 bp, Rattus norvegicus
gagccagaccatgtttgctgtgact

SEQ ID NO: 340774 - DNA, 25 bp, Rattus norvegicus
gagccagacccactgactccaatgg

SEQ ID NO: 340775 - DNA, 25 bp, Rattus norvegicus
gagccagacccagtgactccaatgg

SEQ ID NO: 340776 - DNA, 25 bp, Rattus norvegicus
gagccagactcgatggtggatattc

SEQ ID NO: 340777 - DNA, 25 bp, Rattus norvegicus
gagccagactcgttggtggatattc

SEQ ID NO: 340778 - DNA, 25 bp, Rattus norvegicus
gagccagagaccagccgtggaagaa

SEQ ID NO: 340779 - DNA, 25 bp, Rattus norvegicus
gagccagagacctgccgtggaagaa

SEQ ID NO: 340780 - DNA, 25 bp, Rattus norvegicus
gagccagagactccagcccaaagag

SEQ ID NO: 340781 - DNA, 25 bp, Rattus norvegicus
gagccagagactgcagcccaaagag

SEQ ID NO: 340782 - DNA, 25 bp, Rattus norvegicus
gagccagagccaccagcgactaagt

SEQ ID NO: 340783 - DNA, 25 bp, Rattus norvegicus
gagccagagccagcagcgactaagt

SEQ ID NO: 340784 - DNA, 25 bp, Rattus norvegicus
gagccagaggccatgactgcattct

SEQ ID NO: 340785 - DNA, 25 bp, Rattus norvegicus
gagccagaggccttgactgcattct

SEQ ID NO: 340786 - DNA, 25 bp, Rattus norvegicus
gagccagagggaatgtctcctttgc

SEQ ID NO: 340787 - DNA, 25 bp, Rattus norvegicus
gagccagagggattgtctcctttgc

SEQ ID NO: 340788 - DNA, 25 bp, Rattus norvegicus
gagccagaggttctgtgctctctca

SEQ ID NO: 340789 - DNA, 25 bp, Rattus norvegicus
gagccagaggttgtgtgctctctca

SEQ ID NO: 340790 - DNA, 25 bp, Rattus norvegicus
gagccagagtgacatgcatccttcg

SEQ ID NO: 340791 - DNA, 25 bp, Rattus norvegicus
gagccagagtgagatgcatccttcg

SEQ ID NO: 340792 - DNA, 25 bp, Rattus norvegicus
gagccagatatcactgcccttctaa

SEQ ID NO: 340793 - DNA, 25 bp, Rattus norvegicus
gagccagatatctctgcccttctaa

SEQ ID NO: 340794 - DNA, 25 bp, Rattus norvegicus
gagccagatggtaatttcatccttg

SEQ ID NO: 340795 - DNA, 25 bp, Rattus norvegicus
gagccagatggttatttcatccttg

SEQ ID NO: 340796 - DNA, 25 bp, Rattus norvegicus
gagccagatgtcagactttgtctta

SEQ ID NO: 340797 - DNA, 25 bp, Rattus norvegicus
gagccagatgtctgactttgtctta

SEQ ID NO: 340798 - DNA, 25 bp, Rattus norvegicus
gagccagatgtgagaatccgatcct

SEQ ID NO: 340799 - DNA, 25 bp, Rattus norvegicus
gagccagatgtgtgaatccgatcct

SEQ ID NO: 340800 - DNA, 25 bp, Rattus norvegicus
gagccagatgttagccgaggccaca

SEQ ID NO: 340801 - DNA, 25 bp, Rattus norvegicus
gagccagatgtttgccgaggccaca

SEQ ID NO: 340802 - DNA, 25 bp, Rattus norvegicus
gagccagattctcagcatgttcact

SEQ ID NO: 340803 - DNA, 25 bp, Rattus norvegicus
gagccagattctgagcatgttcact

SEQ ID NO: 340804 - DNA, 25 bp, Rattus norvegicus
gagccagcaagactaagccccatct

SEQ ID NO: 340805 - DNA, 25 bp, Rattus norvegicus
gagccagcaagagtaagccccatct

SEQ ID NO: 340806 - DNA, 25 bp, Rattus norvegicus
gagccagcacacagtatatttctat

SEQ ID NO: 340807 - DNA, 25 bp, Rattus norvegicus
gagccagcacactgtatatttctat

SEQ ID NO: 340808 - DNA, 25 bp, Rattus norvegicus
gagccagcagctcaagtttcttttt

SEQ ID NO: 340809 - DNA, 25 bp, Rattus norvegicus
gagccagcagctgaagtttcttttt

SEQ ID NO: 340810 - DNA, 25 bp, Rattus norvegicus
gagccagcagtactgagcacccagg

SEQ ID NO: 340811 - DNA, 25 bp, Rattus norvegicus
gagccagcagtagtgagcacccagg

SEQ ID NO: 340812 - DNA, 25 bp, Rattus norvegicus
gagccagcatcaacacagactctga

SEQ ID NO: 340813 - DNA, 25 bp, Rattus norvegicus
gagccagcatcatcacagactctga

SEQ ID NO: 340814 - DNA, 25 bp, Rattus norvegicus
gagccagcatctccttagatcagga

SEQ ID NO: 340815 - DNA, 25 bp, Rattus norvegicus
gagccagcatctgcttagatcagga

SEQ ID NO: 340816 - DNA, 25 bp, Rattus norvegicus
gagccagccaaacacacaggtacgg

SEQ ID NO: 340817 - DNA, 25 bp, Rattus norvegicus
gagccagccaaagacacaggtacgg

SEQ ID NO: 340818 - DNA, 25 bp, Rattus norvegicus
gagccagccaaccactggctaaaat

SEQ ID NO: 340819 - DNA, 25 bp, Rattus norvegicus
gagccagccaacgactggctaaaat

SEQ ID NO: 340820 - DNA, 25 bp, Rattus norvegicus
gagccagccccgaggtttgttatgt

SEQ ID NO: 340821 - DNA, 25 bp, Rattus norvegicus
gagccagccccgtggtttgttatgt

SEQ ID NO: 340822 - DNA, 25 bp, Rattus norvegicus
gagccagccgagatgatccaggttc

SEQ ID NO: 340823 - DNA, 25 bp, Rattus norvegicus
gagccagccgagttgatccaggttc

SEQ ID NO: 340824 - DNA, 25 bp, Rattus norvegicus
gagccagccgttatgtagtagttat

SEQ ID NO: 340825 - DNA, 25 bp, Rattus norvegicus
gagccagccgttttgtagtagttat

SEQ ID NO: 340826 - DNA, 25 bp, Rattus norvegicus
gagccagcctgaacctggaaggcaa

SEQ ID NO: 340827 - DNA, 25 bp, Rattus norvegicus
gagccagcctgaccagagaagacaa

SEQ ID NO: 340828 - DNA, 25 bp, Rattus norvegicus
gagccagcctgagcagagaagacaa

SEQ ID NO: 340829 - DNA, 25 bp, Rattus norvegicus
gagccagcctgatcctggaaggcaa

SEQ ID NO: 340830 - DNA, 25 bp, Rattus norvegicus
gagccagcctgtagtctggatgctt

SEQ ID NO: 340831 - DNA, 25 bp, Rattus norvegicus
gagccagcctgtcaaaccatacaaa

SEQ ID NO: 340832 - DNA, 25 bp, Rattus norvegicus
gagccagcctgtgaaaccatacaaa

SEQ ID NO: 340833 - DNA, 25 bp, Rattus norvegicus
gagccagcctgttgtctggatgctt

SEQ ID NO: 340834 - DNA, 25 bp, Rattus norvegicus
gagccagccttccaagacacaagtg

SEQ ID NO: 340835 - DNA, 25 bp, Rattus norvegicus
gagccagccttcgaagacacaagtg

SEQ ID NO: 340836 - DNA, 25 bp, Rattus norvegicus
gagccagcgcatcagaagtttgcca

SEQ ID NO: 340837 - DNA, 25 bp, Rattus norvegicus
gagccagcgcatgagaagtttgcca

SEQ ID NO: 340838 - DNA, 25 bp, Rattus norvegicus
gagccagcgctcaggttcattgtga

SEQ ID NO: 340839 - DNA, 25 bp, Rattus norvegicus
gagccagcgctctggttcattgtga

SEQ ID NO: 340840 - DNA, 25 bp, Rattus norvegicus
gagccagcggagatgcatgtaccta

SEQ ID NO: 340841 - DNA, 25 bp, Rattus norvegicus
gagccagcggagttgcatgtaccta

SEQ ID NO: 340842 - DNA, 25 bp, Rattus norvegicus
gagccagcggctcacagggttcact

SEQ ID NO: 340843 - DNA, 25 bp, Rattus norvegicus
gagccagcggctgacagggttcact

SEQ ID NO: 340844 - DNA, 25 bp, Rattus norvegicus
gagccagcgtccaagcagttgacaa

SEQ ID NO: 340845 - DNA, 25 bp, Rattus norvegicus
gagccagcgtcctagcagttgacaa

SEQ ID NO: 340846 - DNA, 25 bp, Rattus norvegicus
gagccagctcacctgttcttctgga

SEQ ID NO: 340847 - DNA, 25 bp, Rattus norvegicus
gagccagctcacgtgttcttctgga

SEQ ID NO: 340848 - DNA, 25 bp, Rattus norvegicus
gagccagctcggattagagtccaat

SEQ ID NO: 340849 - DNA, 25 bp, Rattus norvegicus
gagccagctcggtttagagtccaat

SEQ ID NO: 340850 - DNA, 25 bp, Rattus norvegicus
gagccagctctgacattagggtcta

SEQ ID NO: 340851 - DNA, 25 bp, Rattus norvegicus
gagccagctctgtcattagggtcta

SEQ ID NO: 340852 - DNA, 25 bp, Rattus norvegicus
gagccagctgcacttgtggctgccc

SEQ ID NO: 340853 - DNA, 25 bp, Rattus norvegicus
gagccagctgcagttgtggctgccc

SEQ ID NO: 340854 - DNA, 25 bp, Rattus norvegicus
gagccagctgcgatttcagggttac

SEQ ID NO: 340855 - DNA, 25 bp, Rattus norvegicus
gagccagctgcgttttcagggttac

SEQ ID NO: 340856 - DNA, 25 bp, Rattus norvegicus
gagccagctgggagcctgacaacag

SEQ ID NO: 340857 - DNA, 25 bp, Rattus norvegicus
gagccagctgggtgcctgacaacag

SEQ ID NO: 340858 - DNA, 25 bp, Rattus norvegicus
gagccaggaaagagtcgtcatgaac

SEQ ID NO: 340859 - DNA, 25 bp, Rattus norvegicus
gagccaggaaagtgtcgtcatgaac

SEQ ID NO: 340860 - DNA, 25 bp, Rattus norvegicus
gagccaggagccagcaccacaggtg

SEQ ID NO: 340861 - DNA, 25 bp, Rattus norvegicus
gagccaggagcctgcaccacaggtg

SEQ ID NO: 340862 - DNA, 25 bp, Rattus norvegicus
gagccaggagtcagctgcaaaccag

SEQ ID NO: 340863 - DNA, 25 bp, Rattus norvegicus
gagccaggagtctgctgcaaaccag

SEQ ID NO: 340864 - DNA, 25 bp, Rattus norvegicus
gagccaggcacaagctaactgccaa

SEQ ID NO: 340865 - DNA, 25 bp, Rattus norvegicus
gagccaggcacaagtgctgcattca

SEQ ID NO: 340866 - DNA, 25 bp, Rattus norvegicus
gagccaggcacatgctaactgccaa

SEQ ID NO: 340867 - DNA, 25 bp, Rattus norvegicus
gagccaggcacatgtgctgcattca

SEQ ID NO: 340868 - DNA, 25 bp, Rattus norvegicus
gagccaggcagactctttccaaggg

SEQ ID NO: 340869 - DNA, 25 bp, Rattus norvegicus
gagccaggcagagtctttccaaggg

SEQ ID NO: 340870 - DNA, 25 bp, Rattus norvegicus
gagccaggcaggcatttgctgatta

SEQ ID NO: 340871 - DNA, 25 bp, Rattus norvegicus
gagccaggcagggatttgctgatta

SEQ ID NO: 340872 - DNA, 25 bp, Rattus norvegicus
gagccaggcccaagtcaggacacag

SEQ ID NO: 340873 - DNA, 25 bp, Rattus norvegicus
gagccaggcccatgtcaggacacag

SEQ ID NO: 340874 - DNA, 25 bp, Rattus norvegicus
gagccaggctcactgatgtcattat

SEQ ID NO: 340875 - DNA, 25 bp, Rattus norvegicus
gagccaggctcagtgatgtcattat

SEQ ID NO: 340876 - DNA, 25 bp, Rattus norvegicus
gagccaggctgacgctaccagtact

SEQ ID NO: 340877 - DNA, 25 bp, Rattus norvegicus
gagccaggctgaggctaccagtact

SEQ ID NO: 340878 - DNA, 25 bp, Rattus norvegicus
gagccagggatgcattctctccaaa

SEQ ID NO: 340879 - DNA, 25 bp, Rattus norvegicus
gagccagggatggattctctccaaa

SEQ ID NO: 340880 - DNA, 25 bp, Rattus norvegicus
gagccagggccaccagaggtcacaa

SEQ ID NO: 340881 - DNA, 25 bp, Rattus norvegicus
gagccagggccagcagaggtcacaa

SEQ ID NO: 340882 - DNA, 25 bp, Rattus norvegicus
gagccagggcgccaagcaaagcaat

SEQ ID NO: 340883 - DNA, 25 bp, Rattus norvegicus
gagccagggcgccatatacaccgtg

SEQ ID NO: 340884 - DNA, 25 bp, Rattus norvegicus
gagccagggcgcgaagcaaagcaat

SEQ ID NO: 340885 - DNA, 25 bp, Rattus norvegicus
gagccagggcgcgatatacaccgtg

SEQ ID NO: 340886 - DNA, 25 bp, Rattus norvegicus
gagccaggtgagcagtttccctgcc

SEQ ID NO: 340887 - DNA, 25 bp, Rattus norvegicus
gagccaggtgaggagtttccctgcc

SEQ ID NO: 340888 - DNA, 25 bp, Rattus norvegicus
gagccaggtgttaggccagactgtt

SEQ ID NO: 340889 - DNA, 25 bp, Rattus norvegicus
gagccaggtgtttggccagactgtt

SEQ ID NO: 340890 - DNA, 25 bp, Rattus norvegicus
gagccaggttagatttagttccttg

SEQ ID NO: 340891 - DNA, 25 bp, Rattus norvegicus
gagccaggttagttttagttccttg

SEQ ID NO: 340892 - DNA, 25 bp, Rattus norvegicus
gagccagtaccgaacagactcaaaa

SEQ ID NO: 340893 - DNA, 25 bp, Rattus norvegicus
gagccagtaccgtacagactcaaaa

SEQ ID NO: 340894 - DNA, 25 bp, Rattus norvegicus
gagccagtccccatgaattggtttg

SEQ ID NO: 340895 - DNA, 25 bp, Rattus norvegicus
gagccagtccccttgaattggtttg

SEQ ID NO: 340896 - DNA, 25 bp, Rattus norvegicus
gagccagtcctacccacattattga

SEQ ID NO: 340897 - DNA, 25 bp, Rattus norvegicus
gagccagtcctagccacattattga

SEQ ID NO: 340898 - DNA, 25 bp, Rattus norvegicus
gagccagtcgttcgaagcagttccc

SEQ ID NO: 340899 - DNA, 25 bp, Rattus norvegicus
gagccagtcgttggaagcagttccc

SEQ ID NO: 340900 - DNA, 25 bp, Rattus norvegicus
gagccagtctgcacagcagcacttg

SEQ ID NO: 340901 - DNA, 25 bp, Rattus norvegicus
gagccagtctgctcagcagcacttg

SEQ ID NO: 340902 - DNA, 25 bp, Rattus norvegicus
gagccagtctggatgagtcagttat

SEQ ID NO: 340903 - DNA, 25 bp, Rattus norvegicus
gagccagtctggcatcgtcatggac

SEQ ID NO: 340904 - DNA, 25 bp, Rattus norvegicus
gagccagtctgggatcgtcatggac

SEQ ID NO: 340905 - DNA, 25 bp, Rattus norvegicus
gagccagtctggttgagtcagttat

SEQ ID NO: 340906 - DNA, 25 bp, Rattus norvegicus
gagccagtctgtcgccgatttgcca

SEQ ID NO: 340907 - DNA, 25 bp, Rattus norvegicus
gagccagtctgtggccgatttgcca

SEQ ID NO: 340908 - DNA, 25 bp, Rattus norvegicus
gagccagtggtgaaaacatccaaga

SEQ ID NO: 340909 - DNA, 25 bp, Rattus norvegicus
gagccagtggtgtaaacatccaaga

SEQ ID NO: 340910 - DNA, 25 bp, Rattus norvegicus
gagccagtggttcccatgacagaac

SEQ ID NO: 340911 - DNA, 25 bp, Rattus norvegicus
gagccagtggttgccatgacagaac

SEQ ID NO: 340912 - DNA, 25 bp, Rattus norvegicus
gagccagtgtctaaagcctaatttt

SEQ ID NO: 340913 - DNA, 25 bp, Rattus norvegicus
gagccagtgtcttaagcctaatttt

SEQ ID NO: 340914 - DNA, 25 bp, Rattus norvegicus
gagccagtgtgtaggcactccacag

SEQ ID NO: 340915 - DNA, 25 bp, Rattus norvegicus
gagccagtgtgttggcactccacag

SEQ ID NO: 340916 - DNA, 25 bp, Rattus norvegicus
gagccagtgttaaggtgctacttca

SEQ ID NO: 340917 - DNA, 25 bp, Rattus norvegicus
gagccagtgttatggtgctacttca

SEQ ID NO: 340918 - DNA, 25 bp, Rattus norvegicus
gagccagttacacttgcctttggaa

SEQ ID NO: 340919 - DNA, 25 bp, Rattus norvegicus
gagccagttacagttgcctttggaa

SEQ ID NO: 340920 - DNA, 25 bp, Rattus norvegicus
gagccagttaccagctgatgggtca

SEQ ID NO: 340921 - DNA, 25 bp, Rattus norvegicus
gagccagttacctgctgatgggtca

SEQ ID NO: 340922 - DNA, 25 bp, Rattus norvegicus
gagccagttactcttgttaccaagg

SEQ ID NO: 340923 - DNA, 25 bp, Rattus norvegicus
gagccagttactgttgttaccaagg

SEQ ID NO: 340924 - DNA, 25 bp, Rattus norvegicus
gagccagttatcagtcttgagtatt

SEQ ID NO: 340925 - DNA, 25 bp, Rattus norvegicus
gagccagttatctgtcttgagtatt

SEQ ID NO: 340926 - DNA, 25 bp, Rattus norvegicus
gagccagttctccatctctgttcag

SEQ ID NO: 340927 - DNA, 25 bp, Rattus norvegicus
gagccagttctcgatctctgttcag

SEQ ID NO: 340928 - DNA, 25 bp, Rattus norvegicus
gagccagttgggaataccagcgaga

SEQ ID NO: 340929 - DNA, 25 bp, Rattus norvegicus
gagccagttgggtataccagcgaga

SEQ ID NO: 340930 - DNA, 25 bp, Rattus norvegicus
gagccatacacacatctattttgaa

SEQ ID NO: 340931 - DNA, 25 bp, Rattus norvegicus
gagccatacacagatctattttgaa

SEQ ID NO: 340932 - DNA, 25 bp, Rattus norvegicus
gagccatacagtcggaggtttgaac

SEQ ID NO: 340933 - DNA, 25 bp, Rattus norvegicus
gagccatacagtgggaggtttgaac

SEQ ID NO: 340934 - DNA, 25 bp, Rattus norvegicus
gagccatatatgagcccgagctgtg

SEQ ID NO: 340935 - DNA, 25 bp, Rattus norvegicus
gagccatatatgtgcccgagctgtg

SEQ ID NO: 340936 - DNA, 25 bp, Rattus norvegicus
gagccatatcaaccctgtactgtcg

SEQ ID NO: 340937 - DNA, 25 bp, Rattus norvegicus
gagccatatcaagcctgtactgtcg

SEQ ID NO: 340938 - DNA, 25 bp, Rattus norvegicus
gagccatatctcaggatcagacaat

SEQ ID NO: 340939 - DNA, 25 bp, Rattus norvegicus
gagccatatctctggatcagacaat

SEQ ID NO: 340940 - DNA, 25 bp, Rattus norvegicus
gagccatatgctccaaatacttttc

SEQ ID NO: 340941 - DNA, 25 bp, Rattus norvegicus
gagccatatgctgcaaatacttttc

SEQ ID NO: 340942 - DNA, 25 bp, Rattus norvegicus
gagccatatgtgattgcaactccaa

SEQ ID NO: 340943 - DNA, 25 bp, Rattus norvegicus
gagccatatgtgtttgcaactccaa

SEQ ID NO: 340944 - DNA, 25 bp, Rattus norvegicus
gagccatatgttccttctactgata

SEQ ID NO: 340945 - DNA, 25 bp, Rattus norvegicus
gagccatatgttgcttctactgata

SEQ ID NO: 340946 - DNA, 25 bp, Rattus norvegicus
gagccatattacactcctgatactt

SEQ ID NO: 340947 - DNA, 25 bp, Rattus norvegicus
gagccatattactctcctgatactt

SEQ ID NO: 340948 - DNA, 25 bp, Rattus norvegicus
gagccatattccatcagactgcagg

SEQ ID NO: 340949 - DNA, 25 bp, Rattus norvegicus
gagccatattccttcagactgcagg

SEQ ID NO: 340950 - DNA, 25 bp, Rattus norvegicus
gagccatcaacccagtgactgaata

SEQ ID NO: 340951 - DNA, 25 bp, Rattus norvegicus
gagccatcaaccgagtgactgaata

SEQ ID NO: 340952 - DNA, 25 bp, Rattus norvegicus
gagccatcaagaccgcttaccagac

SEQ ID NO: 340953 - DNA, 25 bp, Rattus norvegicus
gagccatcaagagcgcttaccagac

SEQ ID NO: 340954 - DNA, 25 bp, Rattus norvegicus
gagccatcagaaagactcttcctgt

SEQ ID NO: 340955 - DNA, 25 bp, Rattus norvegicus
gagccatcagaaccttacgttgctt

SEQ ID NO: 340956 - DNA, 25 bp, Rattus norvegicus
gagccatcagaacgaacagtattat

SEQ ID NO: 340957 - DNA, 25 bp, Rattus norvegicus
gagccatcagaagcttacgttgctt

SEQ ID NO: 340958 - DNA, 25 bp, Rattus norvegicus
gagccatcagaaggaacagtattat

SEQ ID NO: 340959 - DNA, 25 bp, Rattus norvegicus
gagccatcagaatgactcttcctgt

SEQ ID NO: 340960 - DNA, 25 bp, Rattus norvegicus
gagccatcatcgcgccaaattttgc

SEQ ID NO: 340961 - DNA, 25 bp, Rattus norvegicus
gagccatcatcgggccaaattttgc

SEQ ID NO: 340962 - DNA, 25 bp, Rattus norvegicus
gagccatcatgcagaaccttccaga

SEQ ID NO: 340963 - DNA, 25 bp, Rattus norvegicus
gagccatcatgctgaaccttccaga

SEQ ID NO: 340964 - DNA, 25 bp, Rattus norvegicus
gagccatcattgcaactctggccat

SEQ ID NO: 340965 - DNA, 25 bp, Rattus norvegicus
gagccatcattggaactctggccat

SEQ ID NO: 340966 - DNA, 25 bp, Rattus norvegicus
gagccatcatttcagggagcacaat

SEQ ID NO: 340967 - DNA, 25 bp, Rattus norvegicus
gagccatcatttgagggagcacaat

SEQ ID NO: 340968 - DNA, 25 bp, Rattus norvegicus
gagccatccccaataaacagagttt

SEQ ID NO: 340969 - DNA, 25 bp, Rattus norvegicus
gagccatccccattaaacagagttt

SEQ ID NO: 340970 - DNA, 25 bp, Rattus norvegicus
gagccatcccgacgcagaactgcag

SEQ ID NO: 340971 - DNA, 25 bp, Rattus norvegicus
gagccatcccgaggcagaactgcag

SEQ ID NO: 340972 - DNA, 25 bp, Rattus norvegicus
gagccatccctcatgtatgtgtaaa

SEQ ID NO: 340973 - DNA, 25 bp, Rattus norvegicus
gagccatccctcttgtatgtgtaaa

SEQ ID NO: 340974 - DNA, 25 bp, Rattus norvegicus
gagccatccttcacagagtatgcca

SEQ ID NO: 340975 - DNA, 25 bp, Rattus norvegicus
gagccatccttctcagagtatgcca

SEQ ID NO: 340976 - DNA, 25 bp, Rattus norvegicus
gagccatcgctgactgggcaagcaa

SEQ ID NO: 340977 - DNA, 25 bp, Rattus norvegicus
gagccatcgctgtctgggcaagcaa

SEQ ID NO: 340978 - DNA, 25 bp, Rattus norvegicus
gagccatcggctacagagctggagt

SEQ ID NO: 340979 - DNA, 25 bp, Rattus norvegicus
gagccatcggcttcagagctggagt

SEQ ID NO: 340980 - DNA, 25 bp, Rattus norvegicus
gagccatctactatggtcatgggag

SEQ ID NO: 340981 - DNA, 25 bp, Rattus norvegicus
gagccatctactttggtcatgggag

SEQ ID NO: 340982 - DNA, 25 bp, Rattus norvegicus
gagccatctcttaacctggttttga

SEQ ID NO: 340983 - DNA, 25 bp, Rattus norvegicus
gagccatctctttacctggttttga

SEQ ID NO: 340984 - DNA, 25 bp, Rattus norvegicus
gagccatcttggagcacatgtctga

SEQ ID NO: 340985 - DNA, 25 bp, Rattus norvegicus
gagccatcttggtgcacatgtctga

SEQ ID NO: 340986 - DNA, 25 bp, Rattus norvegicus
gagccatgaagaagttctccctgta

SEQ ID NO: 340987 - DNA, 25 bp, Rattus norvegicus
gagccatgaagatgttctccctgta

SEQ ID NO: 340988 - DNA, 25 bp, Rattus norvegicus
gagccatgacgtagtagcttctcac

SEQ ID NO: 340989 - DNA, 25 bp, Rattus norvegicus
gagccatgacgttgtagcttctcac

SEQ ID NO: 340990 - DNA, 25 bp, Rattus norvegicus
gagccatgatgcagaaagtcctcag

SEQ ID NO: 340991 - DNA, 25 bp, Rattus norvegicus
gagccatgatgctgaaagtcctcag

SEQ ID NO: 340992 - DNA, 25 bp, Rattus norvegicus
gagccatgatgtagactcacattaa

SEQ ID NO: 340993 - DNA, 25 bp, Rattus norvegicus
gagccatgatgttgactcacattaa

SEQ ID NO: 340994 - DNA, 25 bp, Rattus norvegicus
gagccatgcaacagtaaggtttttt

SEQ ID NO: 340995 - DNA, 25 bp, Rattus norvegicus
gagccatgcaactgtaaggtttttt

SEQ ID NO: 340996 - DNA, 25 bp, Rattus norvegicus
gagccatgcagccttgtatgaccac

SEQ ID NO: 340997 - DNA, 25 bp, Rattus norvegicus
gagccatgcagcgttgtatgaccac

SEQ ID NO: 340998 - DNA, 25 bp, Rattus norvegicus
gagccatgctgaagctgactctgga

SEQ ID NO: 340999 - DNA, 25 bp, Rattus norvegicus
gagccatgctgaaggtcacatctct

SEQ ID NO: 341000 - DNA, 25 bp, Rattus norvegicus
gagccatgctgatgctgactctgga

SEQ ID NO: 341001 - DNA, 25 bp, Rattus norvegicus
gagccatgctgatggtcacatctct

SEQ ID NO: 341002 - DNA, 25 bp, Rattus norvegicus
gagccatgcttgctggatcttagga

SEQ ID NO: 341003 - DNA, 25 bp, Rattus norvegicus
gagccatgcttggtggatcttagga

SEQ ID NO: 341004 - DNA, 25 bp, Rattus norvegicus
gagccatggacactctgtaggacgt

SEQ ID NO: 341005 - DNA, 25 bp, Rattus norvegicus
gagccatggacagtctgtaggacgt

SEQ ID NO: 341006 - DNA, 25 bp, Rattus norvegicus
gagccatggccccaaagatccgaat

SEQ ID NO: 341007 - DNA, 25 bp, Rattus norvegicus
gagccatggcccgaaagatccgaat

SEQ ID NO: 341008 - DNA, 25 bp, Rattus norvegicus
gagccatggcttctttgctgggtaa

SEQ ID NO: 341009 - DNA, 25 bp, Rattus norvegicus
gagccatggcttgtttgctgggtaa

SEQ ID NO: 341010 - DNA, 25 bp, Rattus norvegicus
gagccatgggcgctctgagcagccg

SEQ ID NO: 341011 - DNA, 25 bp, Rattus norvegicus
gagccatgggcggtctgagcagccg

SEQ ID NO: 341012 - DNA, 25 bp, Rattus norvegicus
gagccatgggctagttcagtgtttg

SEQ ID NO: 341013 - DNA, 25 bp, Rattus norvegicus
gagccatgggcttgttcagtgtttg

SEQ ID NO: 341014 - DNA, 25 bp, Rattus norvegicus
gagccatggtacaggcccaggaaca

SEQ ID NO: 341015 - DNA, 25 bp, Rattus norvegicus
gagccatggtactggcccaggaaca

SEQ ID NO: 341016 - DNA, 25 bp, Rattus norvegicus
gagccatgtatgcattccctcggat

SEQ ID NO: 341017 - DNA, 25 bp, Rattus norvegicus
gagccatgtatggattccctcggat

SEQ ID NO: 341018 - DNA, 25 bp, Rattus norvegicus
gagccatgtattcaacaccgagtgc

SEQ ID NO: 341019 - DNA, 25 bp, Rattus norvegicus
gagccatgtattgaacaccgagtgc

SEQ ID NO: 341020 - DNA, 25 bp, Rattus norvegicus
gagccatgttgcatagcagtgccat

SEQ ID NO: 341021 - DNA, 25 bp, Rattus norvegicus
gagccatgttgcttagcagtgccat

SEQ ID NO: 341022 - DNA, 25 bp, Rattus norvegicus
gagccatgtttgacctggccgtgga

SEQ ID NO: 341023 - DNA, 25 bp, Rattus norvegicus
gagccatgtttgtcctggccgtgga

SEQ ID NO: 341024 - DNA, 25 bp, Rattus norvegicus
gagccatgttttctaattgattgaa

SEQ ID NO: 341025 - DNA, 25 bp, Rattus norvegicus
gagccatgttttgtaattgattgaa

SEQ ID NO: 341026 - DNA, 25 bp, Rattus norvegicus
gagccattaacgaacctgatcttca

SEQ ID NO: 341027 - DNA, 25 bp, Rattus norvegicus
gagccattaacgtacctgatcttca

SEQ ID NO: 341028 - DNA, 25 bp, Rattus norvegicus
gagccattacataacattgacaact

SEQ ID NO: 341029 - DNA, 25 bp, Rattus norvegicus
gagccattacattacattgacaact

SEQ ID NO: 341030 - DNA, 25 bp, Rattus norvegicus
gagccattcacacaattcttctcca

SEQ ID NO: 341031 - DNA, 25 bp, Rattus norvegicus
gagccattcacagaattcttctcca

SEQ ID NO: 341032 - DNA, 25 bp, Rattus norvegicus
gagccattcactctggatgtttaca

SEQ ID NO: 341033 - DNA, 25 bp, Rattus norvegicus
gagccattcactgtggatgtttaca

SEQ ID NO: 341034 - DNA, 25 bp, Rattus norvegicus
gagccattcaggcttttatttcagg

SEQ ID NO: 341035 - DNA, 25 bp, Rattus norvegicus
gagccattcagggttttatttcagg

SEQ ID NO: 341036 - DNA, 25 bp, Rattus norvegicus
gagccattcatgattgtcagagtgt

SEQ ID NO: 341037 - DNA, 25 bp, Rattus norvegicus
gagccattcatgtttgtcagagtgt

SEQ ID NO: 341038 - DNA, 25 bp, Rattus norvegicus
gagccattccgactctgaggagctg

SEQ ID NO: 341039 - DNA, 25 bp, Rattus norvegicus
gagccattccgagtctgaggagctg

SEQ ID NO: 341040 - DNA, 25 bp, Rattus norvegicus
gagccattcgcccacaaacaggaaa

SEQ ID NO: 341041 - DNA, 25 bp, Rattus norvegicus
gagccattcgccgacaaacaggaaa

SEQ ID NO: 341042 - DNA, 25 bp, Rattus norvegicus
gagccattctttagtcaattctaca

SEQ ID NO: 341043 - DNA, 25 bp, Rattus norvegicus
gagccattcttttgtcaattctaca

SEQ ID NO: 341044 - DNA, 25 bp, Rattus norvegicus
gagccattgaagagctgagccctca

SEQ ID NO: 341045 - DNA, 25 bp, Rattus norvegicus
gagccattgaagtgctgagccctca

SEQ ID NO: 341046 - DNA, 25 bp, Rattus norvegicus
gagccattgcaacaatatgggaaga

SEQ ID NO: 341047 - DNA, 25 bp, Rattus norvegicus
gagccattgcaagaatatgggaaga

SEQ ID NO: 341048 - DNA, 25 bp, Rattus norvegicus
gagccattgcacagtgtcttattta

SEQ ID NO: 341049 - DNA, 25 bp, Rattus norvegicus
gagccattgcacatgcatactgttg

SEQ ID NO: 341050 - DNA, 25 bp, Rattus norvegicus
gagccattgcactgtgtcttattta

SEQ ID NO: 341051 - DNA, 25 bp, Rattus norvegicus
gagccattgcacttgcatactgttg

SEQ ID NO: 341052 - DNA, 25 bp, Rattus norvegicus
gagccattgcagagatttagaaaga

SEQ ID NO: 341053 - DNA, 25 bp, Rattus norvegicus
gagccattgcagattctaagaacct

SEQ ID NO: 341054 - DNA, 25 bp, Rattus norvegicus
gagccattgcagtgatttagaaaga

SEQ ID NO: 341055 - DNA, 25 bp, Rattus norvegicus
gagccattgcagtttctaagaacct

SEQ ID NO: 341056 - DNA, 25 bp, Rattus norvegicus
gagccattgcccatgttagagtgga

SEQ ID NO: 341057 - DNA, 25 bp, Rattus norvegicus
gagccattgcccttgttagagtgga

SEQ ID NO: 341058 - DNA, 25 bp, Rattus norvegicus
gagccattgctccagtcctaaacaa

SEQ ID NO: 341059 - DNA, 25 bp, Rattus norvegicus
gagccattgctcgagtcctaaacaa

SEQ ID NO: 341060 - DNA, 25 bp, Rattus norvegicus
gagccattggctctgaagctacaaa

SEQ ID NO: 341061 - DNA, 25 bp, Rattus norvegicus
gagccattggctgtgaagctacaaa

SEQ ID NO: 341062 - DNA, 25 bp, Rattus norvegicus
gagccattgtctcttctatttattt

SEQ ID NO: 341063 - DNA, 25 bp, Rattus norvegicus
gagccattgtctgttctatttattt

SEQ ID NO: 341064 - DNA, 25 bp, Rattus norvegicus
gagccatttagcctcagcactttag

SEQ ID NO: 341065 - DNA, 25 bp, Rattus norvegicus
gagccatttagcgtcagcactttag

SEQ ID NO: 341066 - DNA, 25 bp, Rattus norvegicus
gagccatttcaaagtcttcctaaaa

SEQ ID NO: 341067 - DNA, 25 bp, Rattus norvegicus
gagccatttcaatgtcttcctaaaa

SEQ ID NO: 341068 - DNA, 25 bp, Rattus norvegicus
gagccatttcctctgcagttaaaca

SEQ ID NO: 341069 - DNA, 25 bp, Rattus norvegicus
gagccatttcctgtgcagttaaaca

SEQ ID NO: 341070 - DNA, 25 bp, Rattus norvegicus
gagccatttgctctcttgttgagca

SEQ ID NO: 341071 - DNA, 25 bp, Rattus norvegicus
gagccatttgctgtcttgttgagca

SEQ ID NO: 341072 - DNA, 25 bp, Rattus norvegicus
gagccatttggaagtgtggtctaga

SEQ ID NO: 341073 - DNA, 25 bp, Rattus norvegicus
gagccatttggatgtgtggtctaga

SEQ ID NO: 341074 - DNA, 25 bp, Rattus norvegicus
gagccatttgttcccatccattaag

SEQ ID NO: 341075 - DNA, 25 bp, Rattus norvegicus
gagccatttgttgccatccattaag

SEQ ID NO: 341076 - DNA, 25 bp, Rattus norvegicus
gagccattttgactcctaaacttag

SEQ ID NO: 341077 - DNA, 25 bp, Rattus norvegicus
gagccattttgagtcctaaacttag

SEQ ID NO: 341078 - DNA, 25 bp, Rattus norvegicus
gagccattttggagcatttttagtt

SEQ ID NO: 341079 - DNA, 25 bp, Rattus norvegicus
gagccattttggtgcatttttagtt

SEQ ID NO: 341080 - DNA, 25 bp, Rattus norvegicus
gagccattttgtactgggtgtccaa

SEQ ID NO: 341081 - DNA, 25 bp, Rattus norvegicus
gagccattttgttctgggtgtccaa

SEQ ID NO: 341082 - DNA, 25 bp, Rattus norvegicus
gagcccaaacttccattctgttaag

SEQ ID NO: 341083 - DNA, 25 bp, Rattus norvegicus
gagcccaaacttgcattctgttaag

SEQ ID NO: 341084 - DNA, 25 bp, Rattus norvegicus
gagcccaaaggcctgagttcagctt

SEQ ID NO: 341085 - DNA, 25 bp, Rattus norvegicus
gagcccaaaggcgtgagttcagctt

SEQ ID NO: 341086 - DNA, 25 bp, Rattus norvegicus
gagcccaacagccagatggtgaaat

SEQ ID NO: 341087 - DNA, 25 bp, Rattus norvegicus
gagcccaacagcgagatggtgaaat

SEQ ID NO: 341088 - DNA, 25 bp, Rattus norvegicus
gagcccaactttagctgggctggag

SEQ ID NO: 341089 - DNA, 25 bp, Rattus norvegicus
gagcccaacttttgctgggctggag

SEQ ID NO: 341090 - DNA, 25 bp, Rattus norvegicus
gagcccaagaacacatcgacgtatc

SEQ ID NO: 341091 - DNA, 25 bp, Rattus norvegicus
gagcccaagaactcatcgacgtatc

SEQ ID NO: 341092 - DNA, 25 bp, Rattus norvegicus
gagcccaagcacaggtactctggca

SEQ ID NO: 341093 - DNA, 25 bp, Rattus norvegicus
gagcccaagcactggtactctggca

SEQ ID NO: 341094 - DNA, 25 bp, Rattus norvegicus
gagcccaagctcatcagtggacatg

SEQ ID NO: 341095 - DNA, 25 bp, Rattus norvegicus
gagcccaagctcttcagtggacatg

SEQ ID NO: 341096 - DNA, 25 bp, Rattus norvegicus
gagcccaaggaaagagctgctactt

SEQ ID NO: 341097 - DNA, 25 bp, Rattus norvegicus
gagcccaaggaatgagctgctactt

SEQ ID NO: 341098 - DNA, 25 bp, Rattus norvegicus
gagcccaaggcaatcttagcgttgt

SEQ ID NO: 341099 - DNA, 25 bp, Rattus norvegicus
gagcccaaggcattcttagcgttgt

SEQ ID NO: 341100 - DNA, 25 bp, Rattus norvegicus
gagcccaagggaaagccctcaggga

SEQ ID NO: 341101 - DNA, 25 bp, Rattus norvegicus
gagcccaagggatagccctcaggga

SEQ ID NO: 341102 - DNA, 25 bp, Rattus norvegicus
gagcccaagggtcgacttcaaattc

SEQ ID NO: 341103 - DNA, 25 bp, Rattus norvegicus
gagcccaagggtggacttcaaattc

SEQ ID NO: 341104 - DNA, 25 bp, Rattus norvegicus
gagcccaaggtactaagtctcagtg

SEQ ID NO: 341105 - DNA, 25 bp, Rattus norvegicus
gagcccaaggtagtaagtctcagtg

SEQ ID NO: 341106 - DNA, 25 bp, Rattus norvegicus
gagcccaaggtccaaagtccaagat

SEQ ID NO: 341107 - DNA, 25 bp, Rattus norvegicus
gagcccaaggtcgaaagtccaagat

SEQ ID NO: 341108 - DNA, 25 bp, Rattus norvegicus
gagcccaagtagaggcctcctatga

SEQ ID NO: 341109 - DNA, 25 bp, Rattus norvegicus
gagcccaagtagtggcctcctatga

SEQ ID NO: 341110 - DNA, 25 bp, Rattus norvegicus
gagcccaagttcaaagtcaagtcaa

SEQ ID NO: 341111 - DNA, 25 bp, Rattus norvegicus
gagcccaagttcctaataatgtatt

SEQ ID NO: 341112 - DNA, 25 bp, Rattus norvegicus
gagcccaagttcgtaataatgtatt

SEQ ID NO: 341113 - DNA, 25 bp, Rattus norvegicus
gagcccaagttctaagtcaagtcaa

SEQ ID NO: 341114 - DNA, 25 bp, Rattus norvegicus
gagcccaataggatcatggtgccaa

SEQ ID NO: 341115 - DNA, 25 bp, Rattus norvegicus
gagcccaataggttcatggtgccaa

SEQ ID NO: 341116 - DNA, 25 bp, Rattus norvegicus
gagcccaatctcagcatgaataaca

SEQ ID NO: 341117 - DNA, 25 bp, Rattus norvegicus
gagcccaatctctgcatgaataaca

SEQ ID NO: 341118 - DNA, 25 bp, Rattus norvegicus
gagcccacaactccacaagtgaaaa

SEQ ID NO: 341119 - DNA, 25 bp, Rattus norvegicus
gagcccacaactgcacaagtgaaaa

SEQ ID NO: 341120 - DNA, 25 bp, Rattus norvegicus
gagcccacacaaaactaatgctatg

SEQ ID NO: 341121 - DNA, 25 bp, Rattus norvegicus
gagcccacacaatactaatgctatg

SEQ ID NO: 341122 - DNA, 25 bp, Rattus norvegicus
gagcccacagtaacagatggtggaa

SEQ ID NO: 341123 - DNA, 25 bp, Rattus norvegicus
gagcccacagtatcagatggtggaa

SEQ ID NO: 341124 - DNA, 25 bp, Rattus norvegicus
gagcccacatttacataagcgtttt

SEQ ID NO: 341125 - DNA, 25 bp, Rattus norvegicus
gagcccacattttcataagcgtttt

SEQ ID NO: 341126 - DNA, 25 bp, Rattus norvegicus
gagcccaccccaaacatttattgta

SEQ ID NO: 341127 - DNA, 25 bp, Rattus norvegicus
gagcccaccccatacatttattgta

SEQ ID NO: 341128 - DNA, 25 bp, Rattus norvegicus
gagcccacctctagtttctgggtcc

SEQ ID NO: 341129 - DNA, 25 bp, Rattus norvegicus
gagcccacctcttgtttctgggtcc

SEQ ID NO: 341130 - DNA, 25 bp, Rattus norvegicus
gagcccacctggaacttctggaagt

SEQ ID NO: 341131 - DNA, 25 bp, Rattus norvegicus
gagcccacctggtacttctggaagt

SEQ ID NO: 341132 - DNA, 25 bp, Rattus norvegicus
gagcccacctttcatgctaacagag

SEQ ID NO: 341133 - DNA, 25 bp, Rattus norvegicus
gagcccacctttgatgctaacagag

SEQ ID NO: 341134 - DNA, 25 bp, Rattus norvegicus
gagcccacggagctctccaagaaga

SEQ ID NO: 341135 - DNA, 25 bp, Rattus norvegicus
gagcccacggaggtctccaagaaga

SEQ ID NO: 341136 - DNA, 25 bp, Rattus norvegicus
gagcccacggcaaaaaacccagaag

SEQ ID NO: 341137 - DNA, 25 bp, Rattus norvegicus
gagcccacggcataaaacccagaag

SEQ ID NO: 341138 - DNA, 25 bp, Rattus norvegicus
gagcccactcttcaaaatgttctga

SEQ ID NO: 341139 - DNA, 25 bp, Rattus norvegicus
gagcccactcttgaaaatgttctga

SEQ ID NO: 341140 - DNA, 25 bp, Rattus norvegicus
gagcccactgagatctaactgtagc

SEQ ID NO: 341141 - DNA, 25 bp, Rattus norvegicus
gagcccactgagttctaactgtagc

SEQ ID NO: 341142 - DNA, 25 bp, Rattus norvegicus
gagcccactgtaactaccagagctg

SEQ ID NO: 341143 - DNA, 25 bp, Rattus norvegicus
gagcccactgtatctaccagagctg

SEQ ID NO: 341144 - DNA, 25 bp, Rattus norvegicus
gagcccagactcatgaaagcggttt

SEQ ID NO: 341145 - DNA, 25 bp, Rattus norvegicus
gagcccagactcttgaaagcggttt

SEQ ID NO: 341146 - DNA, 25 bp, Rattus norvegicus
gagcccagatggaagttacacagaa

SEQ ID NO: 341147 - DNA, 25 bp, Rattus norvegicus
gagcccagatggtagttacacagaa

SEQ ID NO: 341148 - DNA, 25 bp, Rattus norvegicus
gagcccagatgtccttggttcaagg

SEQ ID NO: 341149 - DNA, 25 bp, Rattus norvegicus
gagcccagatgtgcttggttcaagg

SEQ ID NO: 341150 - DNA, 25 bp, Rattus norvegicus
gagcccagattgaattccgagatat

SEQ ID NO: 341151 - DNA, 25 bp, Rattus norvegicus
gagcccagattgtattccgagatat

SEQ ID NO: 341152 - DNA, 25 bp, Rattus norvegicus
gagcccagcagaaagatgtctttct

SEQ ID NO: 341153 - DNA, 25 bp, Rattus norvegicus
gagcccagcagatagatgtctttct

SEQ ID NO: 341154 - DNA, 25 bp, Rattus norvegicus
gagcccagccggaactgagcatgaa

SEQ ID NO: 341155 - DNA, 25 bp, Rattus norvegicus
gagcccagccggtactgagcatgaa

SEQ ID NO: 341156 - DNA, 25 bp, Rattus norvegicus
gagcccagcctgcacaatattgaaa

SEQ ID NO: 341157 - DNA, 25 bp, Rattus norvegicus
gagcccagcctggacaatattgaaa

SEQ ID NO: 341158 - DNA, 25 bp, Rattus norvegicus
gagcccagctcaaggacgcattgaa

SEQ ID NO: 341159 - DNA, 25 bp, Rattus norvegicus
gagcccagctcatggacgcattgaa

SEQ ID NO: 341160 - DNA, 25 bp, Rattus norvegicus
gagcccagctggatcctaagtagac

SEQ ID NO: 341161 - DNA, 25 bp, Rattus norvegicus
gagcccagctggttcctaagtagac

SEQ ID NO: 341162 - DNA, 25 bp, Rattus norvegicus
gagcccagctttagtcgtttgaaca

SEQ ID NO: 341163 - DNA, 25 bp, Rattus norvegicus
gagcccagcttttgtcgtttgaaca

SEQ ID NO: 341164 - DNA, 25 bp, Rattus norvegicus
gagcccaggagaaccctaaatgcta

SEQ ID NO: 341165 - DNA, 25 bp, Rattus norvegicus
gagcccaggagatccctaaatgcta

SEQ ID NO: 341166 - DNA, 25 bp, Rattus norvegicus
gagcccaggcttctgtttatgtatt

SEQ ID NO: 341167 - DNA, 25 bp, Rattus norvegicus
gagcccaggcttgtgtttatgtatt

SEQ ID NO: 341168 - DNA, 25 bp, Rattus norvegicus
gagcccagggctagaagtcatccaa

SEQ ID NO: 341169 - DNA, 25 bp, Rattus norvegicus
gagcccagggcttgaagtcatccaa

SEQ ID NO: 341170 - DNA, 25 bp, Rattus norvegicus
gagcccagggtaccctgacatccag

SEQ ID NO: 341171 - DNA, 25 bp, Rattus norvegicus
gagcccagggtagcctgacatccag

SEQ ID NO: 341172 - DNA, 25 bp, Rattus norvegicus
gagcccaggtccacaaagacacagg

SEQ ID NO: 341173 - DNA, 25 bp, Rattus norvegicus
gagcccaggtcctcaaagacacagg

SEQ ID NO: 341174 - DNA, 25 bp, Rattus norvegicus
gagcccaggtgtactcggtttgatc

SEQ ID NO: 341175 - DNA, 25 bp, Rattus norvegicus
gagcccaggtgtcatgacctacgta

SEQ ID NO: 341176 - DNA, 25 bp, Rattus norvegicus
gagcccaggtgtgatgacctacgta

SEQ ID NO: 341177 - DNA, 25 bp, Rattus norvegicus
gagcccaggtgttctcggtttgatc

SEQ ID NO: 341178 - DNA, 25 bp, Rattus norvegicus
gagcccagtaccactttgagagcat

SEQ ID NO: 341179 - DNA, 25 bp, Rattus norvegicus
gagcccagtacctctttgagagcat

SEQ ID NO: 341180 - DNA, 25 bp, Rattus norvegicus
gagcccagtcaacacgattcgctga

SEQ ID NO: 341181 - DNA, 25 bp, Rattus norvegicus
gagcccagtcaagacgattcgctga

SEQ ID NO: 341182 - DNA, 25 bp, Rattus norvegicus
gagcccagtccacgtattaaagaaa

SEQ ID NO: 341183 - DNA, 25 bp, Rattus norvegicus
gagcccagtccaggtattaaagaaa

SEQ ID NO: 341184 - DNA, 25 bp, Rattus norvegicus
gagcccagtcctcagacgctgaatg

SEQ ID NO: 341185 - DNA, 25 bp, Rattus norvegicus
gagcccagtcctgagacgctgaatg

SEQ ID NO: 341186 - DNA, 25 bp, Rattus norvegicus
gagcccagtctccatctaacttgac

SEQ ID NO: 341187 - DNA, 25 bp, Rattus norvegicus
gagcccagtctcgatctaacttgac

SEQ ID NO: 341188 - DNA, 25 bp, Rattus norvegicus
gagcccagtgaaaacatcaacaccc

SEQ ID NO: 341189 - DNA, 25 bp, Rattus norvegicus
gagcccagtgaatacatcaacaccc

SEQ ID NO: 341190 - DNA, 25 bp, Rattus norvegicus
gagcccagtggtatgaattgtcccc

SEQ ID NO: 341191 - DNA, 25 bp, Rattus norvegicus
gagcccagtggtttgaattgtcccc

SEQ ID NO: 341192 - DNA, 25 bp, Rattus norvegicus
gagcccataagcagttcagctgcta

SEQ ID NO: 341193 - DNA, 25 bp, Rattus norvegicus
gagcccataagctgttcagctgcta

SEQ ID NO: 341194 - DNA, 25 bp, Rattus norvegicus
gagcccatatgacctgactcagaaa

SEQ ID NO: 341195 - DNA, 25 bp, Rattus norvegicus
gagcccatatgagctgactcagaaa

SEQ ID NO: 341196 - DNA, 25 bp, Rattus norvegicus
gagcccatcagccaagttcagtgaa

SEQ ID NO: 341197 - DNA, 25 bp, Rattus norvegicus
gagcccatcagcgaagttcagtgaa

SEQ ID NO: 341198 - DNA, 25 bp, Rattus norvegicus
gagcccatcctcagaaagtcacaaa

SEQ ID NO: 341199 - DNA, 25 bp, Rattus norvegicus
gagcccatcctctgaaagtcacaaa

SEQ ID NO: 341200 - DNA, 25 bp, Rattus norvegicus
gagcccatgaacagcacactgtcag

SEQ ID NO: 341201 - DNA, 25 bp, Rattus norvegicus
gagcccatgaactgcacactgtcag

SEQ ID NO: 341202 - DNA, 25 bp, Rattus norvegicus
gagcccatgaagaagatgttccaat

SEQ ID NO: 341203 - DNA, 25 bp, Rattus norvegicus
gagcccatgaagtagatgttccaat

SEQ ID NO: 341204 - DNA, 25 bp, Rattus norvegicus
gagcccatgcttcaatgccgagaga

SEQ ID NO: 341205 - DNA, 25 bp, Rattus norvegicus
gagcccatgcttgaatgccgagaga

SEQ ID NO: 341206 - DNA, 25 bp, Rattus norvegicus
gagcccatgttaacggcagatcctt

SEQ ID NO: 341207 - DNA, 25 bp, Rattus norvegicus
gagcccatgttatcggcagatcctt

SEQ ID NO: 341208 - DNA, 25 bp, Rattus norvegicus
gagcccattctcatttaatttaagc

SEQ ID NO: 341209 - DNA, 25 bp, Rattus norvegicus
gagcccattctcttttaatttaagc

SEQ ID NO: 341210 - DNA, 25 bp, Rattus norvegicus
gagcccattggactaagcctctcaa

SEQ ID NO: 341211 - DNA, 25 bp, Rattus norvegicus
gagcccattggagtaagcctctcaa

SEQ ID NO: 341212 - DNA, 25 bp, Rattus norvegicus
gagcccatttcacagactcagttga

SEQ ID NO: 341213 - DNA, 25 bp, Rattus norvegicus
gagcccatttcagagactcagttga

SEQ ID NO: 341214 - DNA, 25 bp, Rattus norvegicus
gagccccaagtacacggagcagttt

SEQ ID NO: 341215 - DNA, 25 bp, Rattus norvegicus
gagccccaagtagacggagcagttt

SEQ ID NO: 341216 - DNA, 25 bp, Rattus norvegicus
gagccccaagttcctgctatttgtg

SEQ ID NO: 341217 - DNA, 25 bp, Rattus norvegicus
gagccccaagttgctgctatttgtg

SEQ ID NO: 341218 - DNA, 25 bp, Rattus norvegicus
gagccccaattcctactttatggat

SEQ ID NO: 341219 - DNA, 25 bp, Rattus norvegicus
gagccccaattcgtactttatggat

SEQ ID NO: 341220 - DNA, 25 bp, Rattus norvegicus
gagccccacaataaaattcttcctt

SEQ ID NO: 341221 - DNA, 25 bp, Rattus norvegicus
gagccccacaattaaattcttcctt

SEQ ID NO: 341222 - DNA, 25 bp, Rattus norvegicus
gagccccacacaaaaactgttttgc

SEQ ID NO: 341223 - DNA, 25 bp, Rattus norvegicus
gagccccacacataaactgttttgc

SEQ ID NO: 341224 - DNA, 25 bp, Rattus norvegicus
gagccccacagtaacaggccattgt

SEQ ID NO: 341225 - DNA, 25 bp, Rattus norvegicus
gagccccacagtcttacaaattcaa

SEQ ID NO: 341226 - DNA, 25 bp, Rattus norvegicus
gagccccacagtgttacaaattcaa

SEQ ID NO: 341227 - DNA, 25 bp, Rattus norvegicus
gagccccacagttacaggccattgt

SEQ ID NO: 341228 - DNA, 25 bp, Rattus norvegicus
gagccccagaacagtggtcggtaga

SEQ ID NO: 341229 - DNA, 25 bp, Rattus norvegicus
gagccccagaactgtggtcggtaga

SEQ ID NO: 341230 - DNA, 25 bp, Rattus norvegicus
gagccccagaagctgaaggtcagtt

SEQ ID NO: 341231 - DNA, 25 bp, Rattus norvegicus
gagccccagaaggtgaaggtcagtt

SEQ ID NO: 341232 - DNA, 25 bp, Rattus norvegicus
gagccccagagcaagaacagactgt

SEQ ID NO: 341233 - DNA, 25 bp, Rattus norvegicus
gagccccagagctagaacagactgt

SEQ ID NO: 341234 - DNA, 25 bp, Rattus norvegicus
gagccccagatccaccagaatattt

SEQ ID NO: 341235 - DNA, 25 bp, Rattus norvegicus
gagccccagatcgaccagaatattt

SEQ ID NO: 341236 - DNA, 25 bp, Rattus norvegicus
gagccccagcacaatagcagcctat

SEQ ID NO: 341237 - DNA, 25 bp, Rattus norvegicus
gagccccagcactatagcagcctat

SEQ ID NO: 341238 - DNA, 25 bp, Rattus norvegicus
gagccccagctgagcttagatgaca

SEQ ID NO: 341239 - DNA, 25 bp, Rattus norvegicus
gagccccagctgtgcttagatgaca

SEQ ID NO: 341240 - DNA, 25 bp, Rattus norvegicus
gagccccaggaacacttaactgctt

SEQ ID NO: 341241 - DNA, 25 bp, Rattus norvegicus
gagccccaggaacctaatgttagaa

SEQ ID NO: 341242 - DNA, 25 bp, Rattus norvegicus
gagccccaggaagacttaactgctt

SEQ ID NO: 341243 - DNA, 25 bp, Rattus norvegicus
gagccccaggaagctaatgttagaa

SEQ ID NO: 341244 - DNA, 25 bp, Rattus norvegicus
gagccccaggcaacctggataggta

SEQ ID NO: 341245 - DNA, 25 bp, Rattus norvegicus
gagccccaggcaagactgtgatggt

SEQ ID NO: 341246 - DNA, 25 bp, Rattus norvegicus
gagccccaggcatcctggataggta

SEQ ID NO: 341247 - DNA, 25 bp, Rattus norvegicus
gagccccaggcatgactgtgatggt

SEQ ID NO: 341248 - DNA, 25 bp, Rattus norvegicus
gagccccagggcatagcattctcag

SEQ ID NO: 341249 - DNA, 25 bp, Rattus norvegicus
gagccccagggcttagcattctcag

SEQ ID NO: 341250 - DNA, 25 bp, Rattus norvegicus
gagccccagggtaggtctgtactaa

SEQ ID NO: 341251 - DNA, 25 bp, Rattus norvegicus
gagccccagggttggtctgtactaa

SEQ ID NO: 341252 - DNA, 25 bp, Rattus norvegicus
gagccccaggttacatagacgtgtt

SEQ ID NO: 341253 - DNA, 25 bp, Rattus norvegicus
gagccccaggtttcatagacgtgtt

SEQ ID NO: 341254 - DNA, 25 bp, Rattus norvegicus
gagccccagtagcaaccgcttcaaa

SEQ ID NO: 341255 - DNA, 25 bp, Rattus norvegicus
gagccccagtaggaaccgcttcaaa

SEQ ID NO: 341256 - DNA, 25 bp, Rattus norvegicus
gagccccagtttagggagttctctg

SEQ ID NO: 341257 - DNA, 25 bp, Rattus norvegicus
gagccccagttttgggagttctctg

SEQ ID NO: 341258 - DNA, 25 bp, Rattus norvegicus
gagccccatcaccatcagggtatag

SEQ ID NO: 341259 - DNA, 25 bp, Rattus norvegicus
gagccccatcacgatcagggtatag

SEQ ID NO: 341260 - DNA, 25 bp, Rattus norvegicus
gagccccatcctacatctttgaaaa

SEQ ID NO: 341261 - DNA, 25 bp, Rattus norvegicus
gagccccatccttcatctttgaaaa

SEQ ID NO: 341262 - DNA, 25 bp, Rattus norvegicus
gagccccatgagaccctgaaaatat

SEQ ID NO: 341263 - DNA, 25 bp, Rattus norvegicus
gagccccatgagtccctgaaaatat

SEQ ID NO: 341264 - DNA, 25 bp, Rattus norvegicus
gagccccatggtacaaaaagccact

SEQ ID NO: 341265 - DNA, 25 bp, Rattus norvegicus
gagccccatggttcaaaaagccact

SEQ ID NO: 341266 - DNA, 25 bp, Rattus norvegicus
gagccccatttcaggactgtctaat

SEQ ID NO: 341267 - DNA, 25 bp, Rattus norvegicus
gagccccatttctggactgtctaat

SEQ ID NO: 341268 - DNA, 25 bp, Rattus norvegicus
gagcccccagtgatcccagggacta

SEQ ID NO: 341269 - DNA, 25 bp, Rattus norvegicus
gagcccccagtgttcccagggacta

SEQ ID NO: 341270 - DNA, 25 bp, Rattus norvegicus
gagccccgaaccctgcaaaatagat

SEQ ID NO: 341271 - DNA, 25 bp, Rattus norvegicus
gagccccgaaccgtgcaaaatagat

SEQ ID NO: 341272 - DNA, 25 bp, Rattus norvegicus
gagccccgagcacttaagcgagcta

SEQ ID NO: 341273 - DNA, 25 bp, Rattus norvegicus
gagccccgagcagttaagcgagcta

SEQ ID NO: 341274 - DNA, 25 bp, Rattus norvegicus
gagccccgcaggaagcacggtgtac

SEQ ID NO: 341275 - DNA, 25 bp, Rattus norvegicus
gagccccgcaggtagcacggtgtac

SEQ ID NO: 341276 - DNA, 25 bp, Rattus norvegicus
gagccccgcgcgagagaacagtgcc

SEQ ID NO: 341277 - DNA, 25 bp, Rattus norvegicus
gagccccgcgcgtgagaacagtgcc

SEQ ID NO: 341278 - DNA, 25 bp, Rattus norvegicus
gagccccgggtgctatgaattcaat

SEQ ID NO: 341279 - DNA, 25 bp, Rattus norvegicus
gagccccgggtggtatgaattcaat

SEQ ID NO: 341280 - DNA, 25 bp, Rattus norvegicus
gagccccgtcggagaacaacataat

SEQ ID NO: 341281 - DNA, 25 bp, Rattus norvegicus
gagccccgtcggtgaacaacataat

SEQ ID NO: 341282 - DNA, 25 bp, Rattus norvegicus
gagcccctatctcctctgagaagaa

SEQ ID NO: 341283 - DNA, 25 bp, Rattus norvegicus
gagcccctatctgctctgagaagaa

SEQ ID NO: 341284 - DNA, 25 bp, Rattus norvegicus
gagcccctcatcctgagatgggaaa

SEQ ID NO: 341285 - DNA, 25 bp, Rattus norvegicus
gagcccctcatcgtgagatgggaaa

SEQ ID NO: 341286 - DNA, 25 bp, Rattus norvegicus
gagcccctccaacagtctcaggaat

SEQ ID NO: 341287 - DNA, 25 bp, Rattus norvegicus
gagcccctccaagagtctcaggaat

SEQ ID NO: 341288 - DNA, 25 bp, Rattus norvegicus
gagcccctcctgacagtgttttgga

SEQ ID NO: 341289 - DNA, 25 bp, Rattus norvegicus
gagcccctcctgtcagtgttttgga

SEQ ID NO: 341290 - DNA, 25 bp, Rattus norvegicus
gagcccctcttgattacaagacata

SEQ ID NO: 341291 - DNA, 25 bp, Rattus norvegicus
gagcccctcttgtttacaagacata

SEQ ID NO: 341292 - DNA, 25 bp, Rattus norvegicus
gagcccctgaaaacctgacatttag

SEQ ID NO: 341293 - DNA, 25 bp, Rattus norvegicus
gagcccctgaaatcctgacatttag

SEQ ID NO: 341294 - DNA, 25 bp, Rattus norvegicus
gagcccctgaggagctcacatttta

SEQ ID NO: 341295 - DNA, 25 bp, Rattus norvegicus
gagcccctgaggtgctcacatttta

SEQ ID NO: 341296 - DNA, 25 bp, Rattus norvegicus
gagcccctgatgcaagagtacgcca

SEQ ID NO: 341297 - DNA, 25 bp, Rattus norvegicus
gagcccctgatggaagagtacgcca

SEQ ID NO: 341298 - DNA, 25 bp, Rattus norvegicus
gagcccctgcaactgtgcactgaga

SEQ ID NO: 341299 - DNA, 25 bp, Rattus norvegicus
gagcccctgcaagtgtgcactgaga

SEQ ID NO: 341300 - DNA, 25 bp, Rattus norvegicus
gagcccctgcagaatttttctcaag

SEQ ID NO: 341301 - DNA, 25 bp, Rattus norvegicus
gagcccctgcagtatttttctcaag

SEQ ID NO: 341302 - DNA, 25 bp, Rattus norvegicus
gagcccctgccacaaactgtaaagt

SEQ ID NO: 341303 - DNA, 25 bp, Rattus norvegicus
gagcccctgccagaaactgtaaagt

SEQ ID NO: 341304 - DNA, 25 bp, Rattus norvegicus
gagcccctggaactgaaattactgg

SEQ ID NO: 341305 - DNA, 25 bp, Rattus norvegicus
gagcccctggaagtgaaattactgg

SEQ ID NO: 341306 - DNA, 25 bp, Rattus norvegicus
gagcccctgggtcaagcaagtattt

SEQ ID NO: 341307 - DNA, 25 bp, Rattus norvegicus
gagcccctgggtgaagcaagtattt

SEQ ID NO: 341308 - DNA, 25 bp, Rattus norvegicus
gagcccctgtgcaaggaagctgtaa

SEQ ID NO: 341309 - DNA, 25 bp, Rattus norvegicus
gagcccctgtgctaggaagctgtaa

SEQ ID NO: 341310 - DNA, 25 bp, Rattus norvegicus
gagcccctgtttcctttggaattta

SEQ ID NO: 341311 - DNA, 25 bp, Rattus norvegicus
gagcccctgtttgctttggaattta

SEQ ID NO: 341312 - DNA, 25 bp, Rattus norvegicus
gagccccttcggctagctgcaggac

SEQ ID NO: 341313 - DNA, 25 bp, Rattus norvegicus
gagccccttcgggtagctgcaggac

SEQ ID NO: 341314 - DNA, 25 bp, Rattus norvegicus
gagccccttggtcctagggagactt

SEQ ID NO: 341315 - DNA, 25 bp, Rattus norvegicus
gagccccttggtgctagggagactt

SEQ ID NO: 341316 - DNA, 25 bp, Rattus norvegicus
gagcccctttgtccctgaggaaagc

SEQ ID NO: 341317 - DNA, 25 bp, Rattus norvegicus
gagcccctttgtgcctgaggaaagc

SEQ ID NO: 341318 - DNA, 25 bp, Rattus norvegicus
gagcccctttttaggatgaacgaga

SEQ ID NO: 341319 - DNA, 25 bp, Rattus norvegicus
gagccccttttttggatgaacgaga

SEQ ID NO: 341320 - DNA, 25 bp, Rattus norvegicus
gagcccgaaaggatgctgaacttct

SEQ ID NO: 341321 - DNA, 25 bp, Rattus norvegicus
gagcccgaaaggttgctgaacttct

SEQ ID NO: 341322 - DNA, 25 bp, Rattus norvegicus
gagcccgagaagacactggtatgaa

SEQ ID NO: 341323 - DNA, 25 bp, Rattus norvegicus
gagcccgagaagtcactggtatgaa

SEQ ID NO: 341324 - DNA, 25 bp, Rattus norvegicus
gagcccgagaggccccagttgttcc

SEQ ID NO: 341325 - DNA, 25 bp, Rattus norvegicus
gagcccgagagggcccagttgttcc

SEQ ID NO: 341326 - DNA, 25 bp, Rattus norvegicus
gagcccgagccaaaaataaggtcag

SEQ ID NO: 341327 - DNA, 25 bp, Rattus norvegicus
gagcccgagccataaataaggtcag

SEQ ID NO: 341328 - DNA, 25 bp, Rattus norvegicus
gagcccgagctgattgctaagctga

SEQ ID NO: 341329 - DNA, 25 bp, Rattus norvegicus
gagcccgagctgtttgctaagctga

SEQ ID NO: 341330 - DNA, 25 bp, Rattus norvegicus
gagcccgaggctaaagcctttccaa

SEQ ID NO: 341331 - DNA, 25 bp, Rattus norvegicus
gagcccgaggcttaagcctttccaa

SEQ ID NO: 341332 - DNA, 25 bp, Rattus norvegicus
gagcccgagtcccagtcacagggtt

SEQ ID NO: 341333 - DNA, 25 bp, Rattus norvegicus
gagcccgagtccgagtcacagggtt

SEQ ID NO: 341334 - DNA, 25 bp, Rattus norvegicus
gagcccgagtctcggatcaagcgac

SEQ ID NO: 341335 - DNA, 25 bp, Rattus norvegicus
gagcccgagtctgggatcaagcgac

SEQ ID NO: 341336 - DNA, 25 bp, Rattus norvegicus
gagcccgattctagtatttcccttt

SEQ ID NO: 341337 - DNA, 25 bp, Rattus norvegicus
gagcccgattcttgtatttcccttt

SEQ ID NO: 341338 - DNA, 25 bp, Rattus norvegicus
gagcccgatttgctatttagacatt

SEQ ID NO: 341339 - DNA, 25 bp, Rattus norvegicus
gagcccgatttggtatttagacatt

SEQ ID NO: 341340 - DNA, 25 bp, Rattus norvegicus
gagcccgcacccatgcaaggaggag

SEQ ID NO: 341341 - DNA, 25 bp, Rattus norvegicus
gagcccgcacccttgcaaggaggag

SEQ ID NO: 341342 - DNA, 25 bp, Rattus norvegicus
gagcccgcacctccgcaggaagtag

SEQ ID NO: 341343 - DNA, 25 bp, Rattus norvegicus
gagcccgcacctgcgcaggaagtag

SEQ ID NO: 341344 - DNA, 25 bp, Rattus norvegicus
gagcccgcacgcaagggttcaagat

SEQ ID NO: 341345 - DNA, 25 bp, Rattus norvegicus
gagcccgcacgctagggttcaagat

SEQ ID NO: 341346 - DNA, 25 bp, Rattus norvegicus
gagcccgcattgcaattccttcaga

SEQ ID NO: 341347 - DNA, 25 bp, Rattus norvegicus
gagcccgcattggaattccttcaga

SEQ ID NO: 341348 - DNA, 25 bp, Rattus norvegicus
gagcccgcgctgcaaccgggtgctt

SEQ ID NO: 341349 - DNA, 25 bp, Rattus norvegicus
gagcccgcgctggaaccgggtgctt

SEQ ID NO: 341350 - DNA, 25 bp, Rattus norvegicus
gagcccgcgtcgcaagggaggccgg

SEQ ID NO: 341351 - DNA, 25 bp, Rattus norvegicus
gagcccgcgtcggaagggaggccgg

SEQ ID NO: 341352 - DNA, 25 bp, Rattus norvegicus
gagcccggaacgatctggctgctga

SEQ ID NO: 341353 - DNA, 25 bp, Rattus norvegicus
gagcccggaacgttctggctgctga

SEQ ID NO: 341354 - DNA, 25 bp, Rattus norvegicus
gagcccggaagcaggactgacaacc

SEQ ID NO: 341355 - DNA, 25 bp, Rattus norvegicus
gagcccggaagctggactgacaacc

SEQ ID NO: 341356 - DNA, 25 bp, Rattus norvegicus
gagcccggactcacagagcagtgta

SEQ ID NO: 341357 - DNA, 25 bp, Rattus norvegicus
gagcccggactctcagagcagtgta

SEQ ID NO: 341358 - DNA, 25 bp, Rattus norvegicus
gagcccggcctcagggcacgcggag

SEQ ID NO: 341359 - DNA, 25 bp, Rattus norvegicus
gagcccggcctctgggcacgcggag

SEQ ID NO: 341360 - DNA, 25 bp, Rattus norvegicus
gagcccggctttcacagcagagaaa

SEQ ID NO: 341361 - DNA, 25 bp, Rattus norvegicus
gagcccggctttgacagcagagaaa

SEQ ID NO: 341362 - DNA, 25 bp, Rattus norvegicus
gagcccgggccgaagcagatttcga

SEQ ID NO: 341363 - DNA, 25 bp, Rattus norvegicus
gagcccgggccgtagcagatttcga

SEQ ID NO: 341364 - DNA, 25 bp, Rattus norvegicus
gagcccggtaacatctgaggctgtg

SEQ ID NO: 341365 - DNA, 25 bp, Rattus norvegicus
gagcccggtaacttctgaggctgtg

SEQ ID NO: 341366 - DNA, 25 bp, Rattus norvegicus
gagcccgtcgagcaggaccctaaag

SEQ ID NO: 341367 - DNA, 25 bp, Rattus norvegicus
gagcccgtcgaggaggaccctaaag

SEQ ID NO: 341368 - DNA, 25 bp, Rattus norvegicus
gagcccgtgagtcacagcatgcatt

SEQ ID NO: 341369 - DNA, 25 bp, Rattus norvegicus
gagcccgtgagtgacagcatgcatt

SEQ ID NO: 341370 - DNA, 25 bp, Rattus norvegicus
gagcccgtgcgcagacccttaaggc

SEQ ID NO: 341371 - DNA, 25 bp, Rattus norvegicus
gagcccgtgcgctgacccttaaggc

SEQ ID NO: 341372 - DNA, 25 bp, Rattus norvegicus
gagcccgtgggaacgcagctagctt

SEQ ID NO: 341373 - DNA, 25 bp, Rattus norvegicus
gagcccgtgggatcgcagctagctt

SEQ ID NO: 341374 - DNA, 25 bp, Rattus norvegicus
gagcccgtgggcaccaacactaaag

SEQ ID NO: 341375 - DNA, 25 bp, Rattus norvegicus
gagcccgtgggctccaacactaaag

SEQ ID NO: 341376 - DNA, 25 bp, Rattus norvegicus
gagcccgtgtgccatactgtaaatc

SEQ ID NO: 341377 - DNA, 25 bp, Rattus norvegicus
gagcccgtgtgcgatactgtaaatc

SEQ ID NO: 341378 - DNA, 25 bp, Rattus norvegicus
gagccctaagccatggctgggtctt

SEQ ID NO: 341379 - DNA, 25 bp, Rattus norvegicus
gagccctaagccttggctgggtctt

SEQ ID NO: 341380 - DNA, 25 bp, Rattus norvegicus
gagccctacctgctcttcaaggaaa

SEQ ID NO: 341381 - DNA, 25 bp, Rattus norvegicus
gagccctacctggtcttcaaggaaa

SEQ ID NO: 341382 - DNA, 25 bp, Rattus norvegicus
gagccctactcaattcagaatactg

SEQ ID NO: 341383 - DNA, 25 bp, Rattus norvegicus
gagccctactcatttcagaatactg

SEQ ID NO: 341384 - DNA, 25 bp, Rattus norvegicus
gagccctagatcctcagttatttct

SEQ ID NO: 341385 - DNA, 25 bp, Rattus norvegicus
gagccctagatcgtcagttatttct

SEQ ID NO: 341386 - DNA, 25 bp, Rattus norvegicus
gagccctagggactataaggttgaa

SEQ ID NO: 341387 - DNA, 25 bp, Rattus norvegicus
gagccctagggagtataaggttgaa

SEQ ID NO: 341388 - DNA, 25 bp, Rattus norvegicus
gagccctaggtaactggaggcactt

SEQ ID NO: 341389 - DNA, 25 bp, Rattus norvegicus
gagccctaggtatctggaggcactt

SEQ ID NO: 341390 - DNA, 25 bp, Rattus norvegicus
gagccctagtgcctgtagtcaaaga

SEQ ID NO: 341391 - DNA, 25 bp, Rattus norvegicus
gagccctagtgcgtgtagtcaaaga

SEQ ID NO: 341392 - DNA, 25 bp, Rattus norvegicus
gagccctatcaccacataaactgag

SEQ ID NO: 341393 - DNA, 25 bp, Rattus norvegicus
gagccctatcacgacataaactgag

SEQ ID NO: 341394 - DNA, 25 bp, Rattus norvegicus
gagccctatgcgcacgacatacaga

SEQ ID NO: 341395 - DNA, 25 bp, Rattus norvegicus
gagccctatgcggacgacatacaga

SEQ ID NO: 341396 - DNA, 25 bp, Rattus norvegicus
gagccctatttgcatggtatcaact

SEQ ID NO: 341397 - DNA, 25 bp, Rattus norvegicus
gagccctatttggatggtatcaact

SEQ ID NO: 341398 - DNA, 25 bp, Rattus norvegicus
gagccctcaacgaggacctcacaga

SEQ ID NO: 341399 - DNA, 25 bp, Rattus norvegicus
gagccctcaacgtggacctcacaga

SEQ ID NO: 341400 - DNA, 25 bp, Rattus norvegicus
gagccctcaatcattcattgtccag

SEQ ID NO: 341401 - DNA, 25 bp, Rattus norvegicus
gagccctcaatctttcattgtccag

SEQ ID NO: 341402 - DNA, 25 bp, Rattus norvegicus
gagccctcactgcaagatggatgca

SEQ ID NO: 341403 - DNA, 25 bp, Rattus norvegicus
gagccctcactggaagatggatgca

SEQ ID NO: 341404 - DNA, 25 bp, Rattus norvegicus
gagccctcagaaccagtctactttg

SEQ ID NO: 341405 - DNA, 25 bp, Rattus norvegicus
gagccctcagaagcagtctactttg

SEQ ID NO: 341406 - DNA, 25 bp, Rattus norvegicus
gagccctcagcgaatgatgttttcc

SEQ ID NO: 341407 - DNA, 25 bp, Rattus norvegicus
gagccctcagcgtatgatgttttcc

SEQ ID NO: 341408 - DNA, 25 bp, Rattus norvegicus
gagccctcatacacaactatctgat

SEQ ID NO: 341409 - DNA, 25 bp, Rattus norvegicus
gagccctcatactcaactatctgat

SEQ ID NO: 341410 - DNA, 25 bp, Rattus norvegicus
gagccctcatcccaggttttagagc

SEQ ID NO: 341411 - DNA, 25 bp, Rattus norvegicus
gagccctcatccgaggttttagagc

SEQ ID NO: 341412 - DNA, 25 bp, Rattus norvegicus
gagccctcatctattggattgtcac

SEQ ID NO: 341413 - DNA, 25 bp, Rattus norvegicus
gagccctcatcttttggattgtcac

SEQ ID NO: 341414 - DNA, 25 bp, Rattus norvegicus
gagccctcatgtcagagtctggttg

SEQ ID NO: 341415 - DNA, 25 bp, Rattus norvegicus
gagccctcatgtgagagtctggttg

SEQ ID NO: 341416 - DNA, 25 bp, Rattus norvegicus
gagccctcattaagaccaataatta

SEQ ID NO: 341417 - DNA, 25 bp, Rattus norvegicus
gagccctcattatgaccaataatta

SEQ ID NO: 341418 - DNA, 25 bp, Rattus norvegicus
gagccctcattgacttaaacagctg

SEQ ID NO: 341419 - DNA, 25 bp, Rattus norvegicus
gagccctcattgtcttaaacagctg

SEQ ID NO: 341420 - DNA, 25 bp, Rattus norvegicus
gagccctccaacatcagagagcgtt

SEQ ID NO: 341421 - DNA, 25 bp, Rattus norvegicus
gagccctccaacttcagagagcgtt

SEQ ID NO: 341422 - DNA, 25 bp, Rattus norvegicus
gagccctccaagatggtttggctat

SEQ ID NO: 341423 - DNA, 25 bp, Rattus norvegicus
gagccctccaagttggtttggctat

SEQ ID NO: 341424 - DNA, 25 bp, Rattus norvegicus
gagccctccccaacaggaaccaata

SEQ ID NO: 341425 - DNA, 25 bp, Rattus norvegicus
gagccctccccatcaggaaccaata

SEQ ID NO: 341426 - DNA, 25 bp, Rattus norvegicus
gagccctcctcaatcacaaattaag

SEQ ID NO: 341427 - DNA, 25 bp, Rattus norvegicus
gagccctcctcattcacaaattaag

SEQ ID NO: 341428 - DNA, 25 bp, Rattus norvegicus
gagccctcgtgtaccaaaaggcttt

SEQ ID NO: 341429 - DNA, 25 bp, Rattus norvegicus
gagccctcgtgttccaaaaggcttt

SEQ ID NO: 341430 - DNA, 25 bp, Rattus norvegicus
gagccctctacactaattgagaaca

SEQ ID NO: 341431 - DNA, 25 bp, Rattus norvegicus
gagccctctacagtaattgagaaca

SEQ ID NO: 341432 - DNA, 25 bp, Rattus norvegicus
gagccctctagaaattctggtcctg

SEQ ID NO: 341433 - DNA, 25 bp, Rattus norvegicus
gagccctctagatattctggtcctg

SEQ ID NO: 341434 - DNA, 25 bp, Rattus norvegicus
gagccctctaggacctttagtgaaa

SEQ ID NO: 341435 - DNA, 25 bp, Rattus norvegicus
gagccctctaggtcctttagtgaaa

SEQ ID NO: 341436 - DNA, 25 bp, Rattus norvegicus
gagccctctcatcagtgagttccag

SEQ ID NO: 341437 - DNA, 25 bp, Rattus norvegicus
gagccctctcatgagtgagttccag

SEQ ID NO: 341438 - DNA, 25 bp, Rattus norvegicus
gagccctctcggagtgtagggatca

SEQ ID NO: 341439 - DNA, 25 bp, Rattus norvegicus
gagccctctcggtgtgtagggatca

SEQ ID NO: 341440 - DNA, 25 bp, Rattus norvegicus
gagccctctctacggaggcttgctg

SEQ ID NO: 341441 - DNA, 25 bp, Rattus norvegicus
gagccctctctagggaggcttgctg

SEQ ID NO: 341442 - DNA, 25 bp, Rattus norvegicus
gagccctctgcaccttgtacatatg

SEQ ID NO: 341443 - DNA, 25 bp, Rattus norvegicus
gagccctctgcagcttgtacatatg

SEQ ID NO: 341444 - DNA, 25 bp, Rattus norvegicus
gagccctctggaacagttcctgaaa

SEQ ID NO: 341445 - DNA, 25 bp, Rattus norvegicus
gagccctctggatcagttcctgaaa

SEQ ID NO: 341446 - DNA, 25 bp, Rattus norvegicus
gagccctctggccaacaaagaactg

SEQ ID NO: 341447 - DNA, 25 bp, Rattus norvegicus
gagccctctggcgaacaaagaactg

SEQ ID NO: 341448 - DNA, 25 bp, Rattus norvegicus
gagccctcttctctttctaaggagg

SEQ ID NO: 341449 - DNA, 25 bp, Rattus norvegicus
gagccctcttctgtttctaaggagg

SEQ ID NO: 341450 - DNA, 25 bp, Rattus norvegicus
gagccctgaagtctgagccatctac

SEQ ID NO: 341451 - DNA, 25 bp, Rattus norvegicus
gagccctgaagtgtgagccatctac

SEQ ID NO: 341452 - DNA, 25 bp, Rattus norvegicus
gagccctgagaccacggctgtgata

SEQ ID NO: 341453 - DNA, 25 bp, Rattus norvegicus
gagccctgagacgacggctgtgata

SEQ ID NO: 341454 - DNA, 25 bp, Rattus norvegicus
gagccctgagcacgtatggcctcaa

SEQ ID NO: 341455 - DNA, 25 bp, Rattus norvegicus
gagccctgagcaggtatggcctcaa

SEQ ID NO: 341456 - DNA, 25 bp, Rattus norvegicus
gagccctgagccagatcgtttgata

SEQ ID NO: 341457 - DNA, 25 bp, Rattus norvegicus
gagccctgagcctgatcgtttgata

SEQ ID NO: 341458 - DNA, 25 bp, Rattus norvegicus
gagccctgaggtactggaactgcgt

SEQ ID NO: 341459 - DNA, 25 bp, Rattus norvegicus
gagccctgaggttctggaactgcgt

SEQ ID NO: 341460 - DNA, 25 bp, Rattus norvegicus
gagccctgattgataacctgtgtct

SEQ ID NO: 341461 - DNA, 25 bp, Rattus norvegicus
gagccctgattgttaacctgtgtct

SEQ ID NO: 341462 - DNA, 25 bp, Rattus norvegicus
gagccctgcagtcatcttgtttaac

SEQ ID NO: 341463 - DNA, 25 bp, Rattus norvegicus
gagccctgcagtcatgatcaccaat

SEQ ID NO: 341464 - DNA, 25 bp, Rattus norvegicus
gagccctgcagtgatcttgtttaac

SEQ ID NO: 341465 - DNA, 25 bp, Rattus norvegicus
gagccctgcagtgatgatcaccaat

SEQ ID NO: 341466 - DNA, 25 bp, Rattus norvegicus
gagccctgcgtcagaagtctagttt

SEQ ID NO: 341467 - DNA, 25 bp, Rattus norvegicus
gagccctgcgtctgaagtctagttt

SEQ ID NO: 341468 - DNA, 25 bp, Rattus norvegicus
gagccctgctatctgatggatgaca

SEQ ID NO: 341469 - DNA, 25 bp, Rattus norvegicus
gagccctgctatgtgatggatgaca

SEQ ID NO: 341470 - DNA, 25 bp, Rattus norvegicus
gagccctgctctatctactgttgaa

SEQ ID NO: 341471 - DNA, 25 bp, Rattus norvegicus
gagccctgctctttctactgttgaa

SEQ ID NO: 341472 - DNA, 25 bp, Rattus norvegicus
gagccctgctgtcttccggagaaga

SEQ ID NO: 341473 - DNA, 25 bp, Rattus norvegicus
gagccctgctgtgttccggagaaga

SEQ ID NO: 341474 - DNA, 25 bp, Rattus norvegicus
gagccctgctttacgaggacacaga

SEQ ID NO: 341475 - DNA, 25 bp, Rattus norvegicus
gagccctgcttttcgaggacacaga

SEQ ID NO: 341476 - DNA, 25 bp, Rattus norvegicus
gagccctggaagaccgtgtccatga

SEQ ID NO: 341477 - DNA, 25 bp, Rattus norvegicus
gagccctggaagtccgtgtccatga

SEQ ID NO: 341478 - DNA, 25 bp, Rattus norvegicus
gagccctggactcatcatcaataaa

SEQ ID NO: 341479 - DNA, 25 bp, Rattus norvegicus
gagccctggactgatcatcaataaa

SEQ ID NO: 341480 - DNA, 25 bp, Rattus norvegicus
gagccctggcaaagtcatagacaga

SEQ ID NO: 341481 - DNA, 25 bp, Rattus norvegicus
gagccctggcaatgtcatagacaga

SEQ ID NO: 341482 - DNA, 25 bp, Rattus norvegicus
gagccctggctacaaatctgaaaac

SEQ ID NO: 341483 - DNA, 25 bp, Rattus norvegicus
gagccctggctagaaatctgaaaac

SEQ ID NO: 341484 - DNA, 25 bp, Rattus norvegicus
gagccctgggaaactaatctgacac

SEQ ID NO: 341485 - DNA, 25 bp, Rattus norvegicus
gagccctgggaacccaactagtttt

SEQ ID NO: 341486 - DNA, 25 bp, Rattus norvegicus
gagccctgggaagccaactagtttt

SEQ ID NO: 341487 - DNA, 25 bp, Rattus norvegicus
gagccctgggaatctaatctgacac

SEQ ID NO: 341488 - DNA, 25 bp, Rattus norvegicus
gagccctgggctagcgttgagatcc

SEQ ID NO: 341489 - DNA, 25 bp, Rattus norvegicus
gagccctgggcttgcgttgagatcc

SEQ ID NO: 341490 - DNA, 25 bp, Rattus norvegicus
gagccctgggttccctgtgtaaata

SEQ ID NO: 341491 - DNA, 25 bp, Rattus norvegicus
gagccctgggttgcctgtgtaaata

SEQ ID NO: 341492 - DNA, 25 bp, Rattus norvegicus
gagccctgtaaaatcttccttttca

SEQ ID NO: 341493 - DNA, 25 bp, Rattus norvegicus
gagccctgtaaattcttccttttca

SEQ ID NO: 341494 - DNA, 25 bp, Rattus norvegicus
gagccctgtacactcacaaagttct

SEQ ID NO: 341495 - DNA, 25 bp, Rattus norvegicus
gagccctgtacagtcacaaagttct

SEQ ID NO: 341496 - DNA, 25 bp, Rattus norvegicus
gagccctgtataaactccagtaaca

SEQ ID NO: 341497 - DNA, 25 bp, Rattus norvegicus
gagccctgtatatactccagtaaca

SEQ ID NO: 341498 - DNA, 25 bp, Rattus norvegicus
gagccctgtatgactttgaacctga

SEQ ID NO: 341499 - DNA, 25 bp, Rattus norvegicus
gagccctgtatgtctttgaacctga

SEQ ID NO: 341500 - DNA, 25 bp, Rattus norvegicus
gagccctgtgaaactgcacatgtgt

SEQ ID NO: 341501 - DNA, 25 bp, Rattus norvegicus
gagccctgtgaactgatggtttttc

SEQ ID NO: 341502 - DNA, 25 bp, Rattus norvegicus
gagccctgtgaagtgatggtttttc

SEQ ID NO: 341503 - DNA, 25 bp, Rattus norvegicus
gagccctgtgaatctgcacatgtgt

SEQ ID NO: 341504 - DNA, 25 bp, Rattus norvegicus
gagccctgtgcgagcctgagccctt

SEQ ID NO: 341505 - DNA, 25 bp, Rattus norvegicus
gagccctgtgcgtgcctgagccctt

SEQ ID NO: 341506 - DNA, 25 bp, Rattus norvegicus
gagccctgtgctagtgctgaagaga

SEQ ID NO: 341507 - DNA, 25 bp, Rattus norvegicus
gagccctgtgcttgtgctgaagaga

SEQ ID NO: 341508 - DNA, 25 bp, Rattus norvegicus
gagccctgtgggatatagcaactgg

SEQ ID NO: 341509 - DNA, 25 bp, Rattus norvegicus
gagccctgtgggttatagcaactgg

SEQ ID NO: 341510 - DNA, 25 bp, Rattus norvegicus
gagccctgtgtcatgagtctggtga

SEQ ID NO: 341511 - DNA, 25 bp, Rattus norvegicus
gagccctgtgtcttgagtctggtga

SEQ ID NO: 341512 - DNA, 25 bp, Rattus norvegicus
gagccctgttaaactcacaagtgtt

SEQ ID NO: 341513 - DNA, 25 bp, Rattus norvegicus
gagccctgttaatctcacaagtgtt

SEQ ID NO: 341514 - DNA, 25 bp, Rattus norvegicus
gagccctgttcactgtgtttattgc

SEQ ID NO: 341515 - DNA, 25 bp, Rattus norvegicus
gagccctgttcagtgtgtttattgc

SEQ ID NO: 341516 - DNA, 25 bp, Rattus norvegicus
gagccctgttctattcagttctgtg

SEQ ID NO: 341517 - DNA, 25 bp, Rattus norvegicus
gagccctgttcttttcagttctgtg

SEQ ID NO: 341518 - DNA, 25 bp, Rattus norvegicus
gagccctgtttccatacttgaagac

SEQ ID NO: 341519 - DNA, 25 bp, Rattus norvegicus
gagccctgtttcgatacttgaagac

SEQ ID NO: 341520 - DNA, 25 bp, Rattus norvegicus
gagccctgttttactacacttgaca

SEQ ID NO: 341521 - DNA, 25 bp, Rattus norvegicus
gagccctgtttttctacacttgaca

SEQ ID NO: 341522 - DNA, 25 bp, Rattus norvegicus
gagcccttaaggactgtcaacatca

SEQ ID NO: 341523 - DNA, 25 bp, Rattus norvegicus
gagcccttaaggtctgtcaacatca

SEQ ID NO: 341524 - DNA, 25 bp, Rattus norvegicus
gagcccttacagacctgggctggaa

SEQ ID NO: 341525 - DNA, 25 bp, Rattus norvegicus
gagcccttacagtcctgggctggaa

SEQ ID NO: 341526 - DNA, 25 bp, Rattus norvegicus
gagcccttacgcatcggagccagag

SEQ ID NO: 341527 - DNA, 25 bp, Rattus norvegicus
gagcccttacgcttcggagccagag

SEQ ID NO: 341528 - DNA, 25 bp, Rattus norvegicus
gagcccttagagctgcggataaatg

SEQ ID NO: 341529 - DNA, 25 bp, Rattus norvegicus
gagcccttagaggtgcggataaatg

SEQ ID NO: 341530 - DNA, 25 bp, Rattus norvegicus
gagcccttccacaccgaggtaatgg

SEQ ID NO: 341531 - DNA, 25 bp, Rattus norvegicus
gagcccttccactccgaggtaatgg

SEQ ID NO: 341532 - DNA, 25 bp, Rattus norvegicus
gagcccttcttgacttacaaacata

SEQ ID NO: 341533 - DNA, 25 bp, Rattus norvegicus
gagcccttcttgtcttacaaacata

SEQ ID NO: 341534 - DNA, 25 bp, Rattus norvegicus
gagcccttctttctattaatccacg

SEQ ID NO: 341535 - DNA, 25 bp, Rattus norvegicus
gagcccttctttgtattaatccacg

SEQ ID NO: 341536 - DNA, 25 bp, Rattus norvegicus
gagcccttgagtcctattatgtttc

SEQ ID NO: 341537 - DNA, 25 bp, Rattus norvegicus
gagcccttgagtgctattatgtttc

SEQ ID NO: 341538 - DNA, 25 bp, Rattus norvegicus
gagcccttgcaaccattacctagag

SEQ ID NO: 341539 - DNA, 25 bp, Rattus norvegicus
gagcccttgcaagcattacctagag

SEQ ID NO: 341540 - DNA, 25 bp, Rattus norvegicus
gagcccttgggcctgtcctacacgg

SEQ ID NO: 341541 - DNA, 25 bp, Rattus norvegicus
gagcccttgggcgtgtcctacacgg

SEQ ID NO: 341542 - DNA, 25 bp, Rattus norvegicus
gagcccttgtccacgatgggcagcg

SEQ ID NO: 341543 - DNA, 25 bp, Rattus norvegicus
gagcccttgtcctcgatgggcagcg

SEQ ID NO: 341544 - DNA, 25 bp, Rattus norvegicus
gagccctttgttactacaacacagt

SEQ ID NO: 341545 - DNA, 25 bp, Rattus norvegicus
gagccctttgtttctacaacacagt

SEQ ID NO: 341546 - DNA, 25 bp, Rattus norvegicus
gagcccttttagactagagcgttga

SEQ ID NO: 341547 - DNA, 25 bp, Rattus norvegicus
gagcccttttagtctagagcgttga

SEQ ID NO: 341548 - DNA, 25 bp, Rattus norvegicus
gagccgaaagtgacatccagtctcc

SEQ ID NO: 341549 - DNA, 25 bp, Rattus norvegicus
gagccgaaagtgtcatccagtctcc

SEQ ID NO: 341550 - DNA, 25 bp, Rattus norvegicus
gagccgaaatctcatcaagtcttac

SEQ ID NO: 341551 - DNA, 25 bp, Rattus norvegicus
gagccgaaatctgatcaagtcttac

SEQ ID NO: 341552 - DNA, 25 bp, Rattus norvegicus
gagccgaacctacttttttgataag

SEQ ID NO: 341553 - DNA, 25 bp, Rattus norvegicus
gagccgaacctagttttttgataag

SEQ ID NO: 341554 - DNA, 25 bp, Rattus norvegicus
gagccgaaggctcagttgtcctact

SEQ ID NO: 341555 - DNA, 25 bp, Rattus norvegicus
gagccgaaggctgagttgtcctact

SEQ ID NO: 341556 - DNA, 25 bp, Rattus norvegicus
gagccgaaggttatgccccgcccat

SEQ ID NO: 341557 - DNA, 25 bp, Rattus norvegicus
gagccgaaggttttgccccgcccat

SEQ ID NO: 341558 - DNA, 25 bp, Rattus norvegicus
gagccgaagtttacttctcttctaa

SEQ ID NO: 341559 - DNA, 25 bp, Rattus norvegicus
gagccgaagttttcttctcttctaa

SEQ ID NO: 341560 - DNA, 25 bp, Rattus norvegicus
gagccgacatgcaagggatgcacat

SEQ ID NO: 341561 - DNA, 25 bp, Rattus norvegicus
gagccgacatgctagggatgcacat

SEQ ID NO: 341562 - DNA, 25 bp, Rattus norvegicus
gagccgacccgacgcgcacagtgaa

SEQ ID NO: 341563 - DNA, 25 bp, Rattus norvegicus
gagccgacccgaggcgcacagtgaa

SEQ ID NO: 341564 - DNA, 25 bp, Rattus norvegicus
gagccgagacacaaagaagacagat

SEQ ID NO: 341565 - DNA, 25 bp, Rattus norvegicus
gagccgagacactaagaagacagat

SEQ ID NO: 341566 - DNA, 25 bp, Rattus norvegicus
gagccgagcggtacatgaaacgtgt

SEQ ID NO: 341567 - DNA, 25 bp, Rattus norvegicus
gagccgagcggttcatgaaacgtgt

SEQ ID NO: 341568 - DNA, 25 bp, Rattus norvegicus
gagccgagctctctattaagcacca

SEQ ID NO: 341569 - DNA, 25 bp, Rattus norvegicus
gagccgagctctgtattaagcacca

SEQ ID NO: 341570 - DNA, 25 bp, Rattus norvegicus
gagccgagcttcagcggattctgga

SEQ ID NO: 341571 - DNA, 25 bp, Rattus norvegicus
gagccgagcttctgcggattctgga

SEQ ID NO: 341572 - DNA, 25 bp, Rattus norvegicus
gagccgaggatgattgcgcctttcc

SEQ ID NO: 341573 - DNA, 25 bp, Rattus norvegicus
gagccgaggatgtttgcgcctttcc

SEQ ID NO: 341574 - DNA, 25 bp, Rattus norvegicus
gagccgaggcaacatagcgcccacg

SEQ ID NO: 341575 - DNA, 25 bp, Rattus norvegicus
gagccgaggcaagatagcgcccacg

SEQ ID NO: 341576 - DNA, 25 bp, Rattus norvegicus
gagccgaggcatagtggaatcctat

SEQ ID NO: 341577 - DNA, 25 bp, Rattus norvegicus
gagccgaggcattgtggaatcctat

SEQ ID NO: 341578 - DNA, 25 bp, Rattus norvegicus
gagccgagtagcaacactgtattgt

SEQ ID NO: 341579 - DNA, 25 bp, Rattus norvegicus
gagccgagtagcatcatgtacagac

SEQ ID NO: 341580 - DNA, 25 bp, Rattus norvegicus
gagccgagtagctacactgtattgt

SEQ ID NO: 341581 - DNA, 25 bp, Rattus norvegicus
gagccgagtagcttcatgtacagac

SEQ ID NO: 341582 - DNA, 25 bp, Rattus norvegicus
gagccgatggatcactcttgattta

SEQ ID NO: 341583 - DNA, 25 bp, Rattus norvegicus
gagccgatggatgactcttgattta

SEQ ID NO: 341584 - DNA, 25 bp, Rattus norvegicus
gagccgatggctcacatatttcatg

SEQ ID NO: 341585 - DNA, 25 bp, Rattus norvegicus
gagccgatggctgacatatttcatg

SEQ ID NO: 341586 - DNA, 25 bp, Rattus norvegicus
gagccgattgcactgggcatcagtt

SEQ ID NO: 341587 - DNA, 25 bp, Rattus norvegicus
gagccgattgcagtgggcatcagtt

SEQ ID NO: 341588 - DNA, 25 bp, Rattus norvegicus
gagccgcagagaccagaggcctaca

SEQ ID NO: 341589 - DNA, 25 bp, Rattus norvegicus
gagccgcagagagcagaggcctaca

SEQ ID NO: 341590 - DNA, 25 bp, Rattus norvegicus
gagccgcagcgcatggtagcacctt

SEQ ID NO: 341591 - DNA, 25 bp, Rattus norvegicus
gagccgcagcgcttggtagcacctt

SEQ ID NO: 341592 - DNA, 25 bp, Rattus norvegicus
gagccgccacacatttggaaaactt

SEQ ID NO: 341593 - DNA, 25 bp, Rattus norvegicus
gagccgccacacttttggaaaactt

SEQ ID NO: 341594 - DNA, 25 bp, Rattus norvegicus
gagccgccagctatcaagtcatttc

SEQ ID NO: 341595 - DNA, 25 bp, Rattus norvegicus
gagccgccagctttcaagtcatttc

SEQ ID NO: 341596 - DNA, 25 bp, Rattus norvegicus
gagccgccccagctaagggaactcg

SEQ ID NO: 341597 - DNA, 25 bp, Rattus norvegicus
gagccgccccaggtaagggaactcg

SEQ ID NO: 341598 - DNA, 25 bp, Rattus norvegicus
gagccgcccctgagtgcattaggaa

SEQ ID NO: 341599 - DNA, 25 bp, Rattus norvegicus
gagccgcccctgtgtgcattaggaa

SEQ ID NO: 341600 - DNA, 25 bp, Rattus norvegicus
gagccgccgatacaggaagcccgaa

SEQ ID NO: 341601 - DNA, 25 bp, Rattus norvegicus
gagccgccgatagaggaagcccgaa

SEQ ID NO: 341602 - DNA, 25 bp, Rattus norvegicus
gagccgccgctcaaaaggaggtgcc

SEQ ID NO: 341603 - DNA, 25 bp, Rattus norvegicus
gagccgccgctctaaaggaggtgcc

SEQ ID NO: 341604 - DNA, 25 bp, Rattus norvegicus
gagccgccggcactgtatatgaaga

SEQ ID NO: 341605 - DNA, 25 bp, Rattus norvegicus
gagccgccggcagtgtatatgaaga

SEQ ID NO: 341606 - DNA, 25 bp, Rattus norvegicus
gagccgccggttagagaatcgtctt

SEQ ID NO: 341607 - DNA, 25 bp, Rattus norvegicus
gagccgccggtttgagaatcgtctt

SEQ ID NO: 341608 - DNA, 25 bp, Rattus norvegicus
gagccgcgactccaagtgcatcatt

SEQ ID NO: 341609 - DNA, 25 bp, Rattus norvegicus
gagccgcgactcgaagtgcatcatt

SEQ ID NO: 341610 - DNA, 25 bp, Rattus norvegicus
gagccgcgcgctctgtacagagtcc

SEQ ID NO: 341611 - DNA, 25 bp, Rattus norvegicus
gagccgcgcgctgtgtacagagtcc

SEQ ID NO: 341612 - DNA, 25 bp, Rattus norvegicus
gagccgctccagctagtcaaattta

SEQ ID NO: 341613 - DNA, 25 bp, Rattus norvegicus
gagccgctccaggtagtcaaattta

SEQ ID NO: 341614 - DNA, 25 bp, Rattus norvegicus
gagccgctcgacctaaagctgagca

SEQ ID NO: 341615 - DNA, 25 bp, Rattus norvegicus
gagccgctcgacgtaaagctgagca

SEQ ID NO: 341616 - DNA, 25 bp, Rattus norvegicus
gagccgctgagcatctgcagaagct

SEQ ID NO: 341617 - DNA, 25 bp, Rattus norvegicus
gagccgctgagccatgaggtcttct

SEQ ID NO: 341618 - DNA, 25 bp, Rattus norvegicus
gagccgctgagcgatgaggtcttct

SEQ ID NO: 341619 - DNA, 25 bp, Rattus norvegicus
gagccgctgagcttctgcagaagct

SEQ ID NO: 341620 - DNA, 25 bp, Rattus norvegicus
gagccgctgcggagaactccagaaa

SEQ ID NO: 341621 - DNA, 25 bp, Rattus norvegicus
gagccgctgcggtgaactccagaaa

SEQ ID NO: 341622 - DNA, 25 bp, Rattus norvegicus
gagccgctgggcacggcgtcatcca

SEQ ID NO: 341623 - DNA, 25 bp, Rattus norvegicus
gagccgctgggctcggcgtcatcca

SEQ ID NO: 341624 - DNA, 25 bp, Rattus norvegicus
gagccgctttagatcctgtttgcat

SEQ ID NO: 341625 - DNA, 25 bp, Rattus norvegicus
gagccgctttagttcctgtttgcat

SEQ ID NO: 341626 - DNA, 25 bp, Rattus norvegicus
gagccggaagctcataaaaccttta

SEQ ID NO: 341627 - DNA, 25 bp, Rattus norvegicus
gagccggaagctgataaaaccttta

SEQ ID NO: 341628 - DNA, 25 bp, Rattus norvegicus
gagccggaatgaacccaggaattta

SEQ ID NO: 341629 - DNA, 25 bp, Rattus norvegicus
gagccggaatgatcccaggaattta

SEQ ID NO: 341630 - DNA, 25 bp, Rattus norvegicus
gagccggagcaccaaaggcgccttc

SEQ ID NO: 341631 - DNA, 25 bp, Rattus norvegicus
gagccggagcacgaaaggcgccttc

SEQ ID NO: 341632 - DNA, 25 bp, Rattus norvegicus
gagccggcagccaggctggccgctt

SEQ ID NO: 341633 - DNA, 25 bp, Rattus norvegicus
gagccggcagcctggctggccgctt

SEQ ID NO: 341634 - DNA, 25 bp, Rattus norvegicus
gagccggcatacagtcctgtcacat

SEQ ID NO: 341635 - DNA, 25 bp, Rattus norvegicus
gagccggcatactgtcctgtcacat

SEQ ID NO: 341636 - DNA, 25 bp, Rattus norvegicus
gagccggcattgatatgaaccctga

SEQ ID NO: 341637 - DNA, 25 bp, Rattus norvegicus
gagccggcattgttatgaaccctga

SEQ ID NO: 341638 - DNA, 25 bp, Rattus norvegicus
gagccggccacgagcaactgactgg

SEQ ID NO: 341639 - DNA, 25 bp, Rattus norvegicus
gagccggccacgtgcaactgactgg

SEQ ID NO: 341640 - DNA, 25 bp, Rattus norvegicus
gagccggccggcacttttgcatgag

SEQ ID NO: 341641 - DNA, 25 bp, Rattus norvegicus
gagccggccggctcttttgcatgag

SEQ ID NO: 341642 - DNA, 25 bp, Rattus norvegicus
gagccggctcaaacggccgtccgta

SEQ ID NO: 341643 - DNA, 25 bp, Rattus norvegicus
gagccggctcaatcggccgtccgta

SEQ ID NO: 341644 - DNA, 25 bp, Rattus norvegicus
gagccggcttacacagcgcgaggcc

SEQ ID NO: 341645 - DNA, 25 bp, Rattus norvegicus
gagccggcttactcagcgcgaggcc

SEQ ID NO: 341646 - DNA, 25 bp, Rattus norvegicus
gagccgggaggcaactctagaccaa

SEQ ID NO: 341647 - DNA, 25 bp, Rattus norvegicus
gagccgggaggctactctagaccaa

SEQ ID NO: 341648 - DNA, 25 bp, Rattus norvegicus
gagccgggccatataaaggcgttat

SEQ ID NO: 341649 - DNA, 25 bp, Rattus norvegicus
gagccgggccatttaaaggcgttat

SEQ ID NO: 341650 - DNA, 25 bp, Rattus norvegicus
gagccgggtataatggtttatgcct

SEQ ID NO: 341651 - DNA, 25 bp, Rattus norvegicus
gagccgggtatattggtttatgcct

SEQ ID NO: 341652 - DNA, 25 bp, Rattus norvegicus
gagccgggtgctacttaaaaacaca

SEQ ID NO: 341653 - DNA, 25 bp, Rattus norvegicus
gagccgggtgcttcttaaaaacaca

SEQ ID NO: 341654 - DNA, 25 bp, Rattus norvegicus
gagccggtaaccatgtgtgtagcca

SEQ ID NO: 341655 - DNA, 25 bp, Rattus norvegicus
gagccggtaaccttgtgtgtagcca

SEQ ID NO: 341656 - DNA, 25 bp, Rattus norvegicus
gagccggtactgctctccaggacga

SEQ ID NO: 341657 - DNA, 25 bp, Rattus norvegicus
gagccggtactggtctccaggacga

SEQ ID NO: 341658 - DNA, 25 bp, Rattus norvegicus
gagccggtagggatgcagcccatcc

SEQ ID NO: 341659 - DNA, 25 bp, Rattus norvegicus
gagccggtagggttgcagcccatcc

SEQ ID NO: 341660 - DNA, 25 bp, Rattus norvegicus
gagccggtgggcagcatgtcaacac

SEQ ID NO: 341661 - DNA, 25 bp, Rattus norvegicus
gagccggtgggctgcatgtcaacac

SEQ ID NO: 341662 - DNA, 25 bp, Rattus norvegicus
gagccggtgttacttgtgaactgca

SEQ ID NO: 341663 - DNA, 25 bp, Rattus norvegicus
gagccggtgttagttgtgaactgca

SEQ ID NO: 341664 - DNA, 25 bp, Rattus norvegicus
gagccgtacaaaatctacgtcactt

SEQ ID NO: 341665 - DNA, 25 bp, Rattus norvegicus
gagccgtacaaattctacgtcactt

SEQ ID NO: 341666 - DNA, 25 bp, Rattus norvegicus
gagccgtccctgctcgactaggctg

SEQ ID NO: 341667 - DNA, 25 bp, Rattus norvegicus
gagccgtccctggtcgactaggctg

SEQ ID NO: 341668 - DNA, 25 bp, Rattus norvegicus
gagccgtccttcaagcagtttcaag

SEQ ID NO: 341669 - DNA, 25 bp, Rattus norvegicus
gagccgtccttctagcagtttcaag

SEQ ID NO: 341670 - DNA, 25 bp, Rattus norvegicus
gagccgtcgactctcagatggatga

SEQ ID NO: 341671 - DNA, 25 bp, Rattus norvegicus
gagccgtcgactgtcagatggatga

SEQ ID NO: 341672 - DNA, 25 bp, Rattus norvegicus
gagccgtctgatacaggcgacgagc

SEQ ID NO: 341673 - DNA, 25 bp, Rattus norvegicus
gagccgtctgattcaggcgacgagc

SEQ ID NO: 341674 - DNA, 25 bp, Rattus norvegicus
gagccgtcttttcgcgagaaccagg

SEQ ID NO: 341675 - DNA, 25 bp, Rattus norvegicus
gagccgtcttttggcgagaaccagg

SEQ ID NO: 341676 - DNA, 25 bp, Rattus norvegicus
gagccgtgaactaccgtgttagatg

SEQ ID NO: 341677 - DNA, 25 bp, Rattus norvegicus
gagccgtgaacttccgtgttagatg

SEQ ID NO: 341678 - DNA, 25 bp, Rattus norvegicus
gagccgtgtgctactgtatgtacca

SEQ ID NO: 341679 - DNA, 25 bp, Rattus norvegicus
gagccgtgtgcttctgtatgtacca

SEQ ID NO: 341680 - DNA, 25 bp, Rattus norvegicus
gagccgtgtttaatttcttcacaaa

SEQ ID NO: 341681 - DNA, 25 bp, Rattus norvegicus
gagccgtgtttattttcttcacaaa

SEQ ID NO: 341682 - DNA, 25 bp, Rattus norvegicus
gagccgtgtttcagggcacagctgt

SEQ ID NO: 341683 - DNA, 25 bp, Rattus norvegicus
gagccgtgtttctgggcacagctgt

SEQ ID NO: 341684 - DNA, 25 bp, Rattus norvegicus
gagccgttacagagtggcacgctat

SEQ ID NO: 341685 - DNA, 25 bp, Rattus norvegicus
gagccgttacagtgtggcacgctat

SEQ ID NO: 341686 - DNA, 25 bp, Rattus norvegicus
gagccgttagctctagagttttctt

SEQ ID NO: 341687 - DNA, 25 bp, Rattus norvegicus
gagccgttagctgtagagttttctt

SEQ ID NO: 341688 - DNA, 25 bp, Rattus norvegicus
gagccgttcacaatcgcacaaggga

SEQ ID NO: 341689 - DNA, 25 bp, Rattus norvegicus
gagccgttcacattcgcacaaggga

SEQ ID NO: 341690 - DNA, 25 bp, Rattus norvegicus
gagccgttggtgattcattgtttaa

SEQ ID NO: 341691 - DNA, 25 bp, Rattus norvegicus
gagccgttggtgtttcattgtttaa

SEQ ID NO: 341692 - DNA, 25 bp, Rattus norvegicus
gagccgtttcctaagtaacattcac

SEQ ID NO: 341693 - DNA, 25 bp, Rattus norvegicus
gagccgtttccttagtaacattcac

SEQ ID NO: 341694 - DNA, 25 bp, Rattus norvegicus
gagccgtttgagatacatagaccct

SEQ ID NO: 341695 - DNA, 25 bp, Rattus norvegicus
gagccgtttgagttacatagaccct

SEQ ID NO: 341696 - DNA, 25 bp, Rattus norvegicus
gagccgtttgccactgggaagaccg

SEQ ID NO: 341697 - DNA, 25 bp, Rattus norvegicus
gagccgtttgcctctgggaagaccg

SEQ ID NO: 341698 - DNA, 25 bp, Rattus norvegicus
gagcctaaaaccctacagacatcag

SEQ ID NO: 341699 - DNA, 25 bp, Rattus norvegicus
gagcctaaaaccgtacagacatcag

SEQ ID NO: 341700 - DNA, 25 bp, Rattus norvegicus
gagcctaaaattagtctttcccctg

SEQ ID NO: 341701 - DNA, 25 bp, Rattus norvegicus
gagcctaaaatttgtctttcccctg

SEQ ID NO: 341702 - DNA, 25 bp, Rattus norvegicus
gagcctaaacacagacttgcgagac

SEQ ID NO: 341703 - DNA, 25 bp, Rattus norvegicus
gagcctaaacactgacttgcgagac

SEQ ID NO: 341704 - DNA, 25 bp, Rattus norvegicus
gagcctaaatcacttcttaccaagc

SEQ ID NO: 341705 - DNA, 25 bp, Rattus norvegicus
gagcctaaatcagttcttaccaagc

SEQ ID NO: 341706 - DNA, 25 bp, Rattus norvegicus
gagcctaagaagaactcgcactagt

SEQ ID NO: 341707 - DNA, 25 bp, Rattus norvegicus
gagcctaagaagtactcgcactagt

SEQ ID NO: 341708 - DNA, 25 bp, Rattus norvegicus
gagcctaagcacctgctagtgatga

SEQ ID NO: 341709 - DNA, 25 bp, Rattus norvegicus
gagcctaagcacgtgctagtgatga

SEQ ID NO: 341710 - DNA, 25 bp, Rattus norvegicus
gagcctaagcctacgcagtactgag

SEQ ID NO: 341711 - DNA, 25 bp, Rattus norvegicus
gagcctaagccttcgcagtactgag

SEQ ID NO: 341712 - DNA, 25 bp, Rattus norvegicus
gagcctaaggcgagtctggagacaa

SEQ ID NO: 341713 - DNA, 25 bp, Rattus norvegicus
gagcctaaggcgtgtctggagacaa

SEQ ID NO: 341714 - DNA, 25 bp, Rattus norvegicus
gagcctaaggctcggtgccaaagct

SEQ ID NO: 341715 - DNA, 25 bp, Rattus norvegicus
gagcctaaggctgggtgccaaagct

SEQ ID NO: 341716 - DNA, 25 bp, Rattus norvegicus
gagcctaagtcaccatcctttggga

SEQ ID NO: 341717 - DNA, 25 bp, Rattus norvegicus
gagcctaagtcagcatcctttggga

SEQ ID NO: 341718 - DNA, 25 bp, Rattus norvegicus
gagcctaagtccaagtgtcctcagc

SEQ ID NO: 341719 - DNA, 25 bp, Rattus norvegicus
gagcctaagtcctagtgtcctcagc

SEQ ID NO: 341720 - DNA, 25 bp, Rattus norvegicus
gagcctaagtctactctggattcat

SEQ ID NO: 341721 - DNA, 25 bp, Rattus norvegicus
gagcctaagtcttctctggattcat

SEQ ID NO: 341722 - DNA, 25 bp, Rattus norvegicus
gagcctaatcaaccagttcttccac

SEQ ID NO: 341723 - DNA, 25 bp, Rattus norvegicus
gagcctaatcaagcagttcttccac

SEQ ID NO: 341724 - DNA, 25 bp, Rattus norvegicus
gagcctaatgacagtactctgattc

SEQ ID NO: 341725 - DNA, 25 bp, Rattus norvegicus
gagcctaatgactgtactctgattc

SEQ ID NO: 341726 - DNA, 25 bp, Rattus norvegicus
gagcctacaacaaacctggaccgag

SEQ ID NO: 341727 - DNA, 25 bp, Rattus norvegicus
gagcctacaacatacctggaccgag

SEQ ID NO: 341728 - DNA, 25 bp, Rattus norvegicus
gagcctacaagtcagacttaccttg

SEQ ID NO: 341729 - DNA, 25 bp, Rattus norvegicus
gagcctacaagtgagacttaccttg

SEQ ID NO: 341730 - DNA, 25 bp, Rattus norvegicus
gagcctacagagacttagttactga

SEQ ID NO: 341731 - DNA, 25 bp, Rattus norvegicus
gagcctacagagtcttagttactga

SEQ ID NO: 341732 - DNA, 25 bp, Rattus norvegicus
gagcctacagcacacatctctggat

SEQ ID NO: 341733 - DNA, 25 bp, Rattus norvegicus
gagcctacagcacatggactcctga

SEQ ID NO: 341734 - DNA, 25 bp, Rattus norvegicus
gagcctacagcagacatctctggat

SEQ ID NO: 341735 - DNA, 25 bp, Rattus norvegicus
gagcctacagcagatggactcctga

SEQ ID NO: 341736 - DNA, 25 bp, Rattus norvegicus
gagcctacaggaaggcctatttctt

SEQ ID NO: 341737 - DNA, 25 bp, Rattus norvegicus
gagcctacaggatggcctatttctt

SEQ ID NO: 341738 - DNA, 25 bp, Rattus norvegicus
gagcctacagtaattaaagccgtcc

SEQ ID NO: 341739 - DNA, 25 bp, Rattus norvegicus
gagcctacagtatttaaagccgtcc

SEQ ID NO: 341740 - DNA, 25 bp, Rattus norvegicus
gagcctacagtcacaggcccagaga

SEQ ID NO: 341741 - DNA, 25 bp, Rattus norvegicus
gagcctacagtcatgttttgttgtt

SEQ ID NO: 341742 - DNA, 25 bp, Rattus norvegicus
gagcctacagtctcaggcccagaga

SEQ ID NO: 341743 - DNA, 25 bp, Rattus norvegicus
gagcctacagtcttgttttgttgtt

SEQ ID NO: 341744 - DNA, 25 bp, Rattus norvegicus
gagcctacatcacaaactgggtgaa

SEQ ID NO: 341745 - DNA, 25 bp, Rattus norvegicus
gagcctacatcagaaactgggtgaa

SEQ ID NO: 341746 - DNA, 25 bp, Rattus norvegicus
gagcctacatggcaaaaggcccgtg

SEQ ID NO: 341747 - DNA, 25 bp, Rattus norvegicus
gagcctacatgggaaaaggcccgtg

SEQ ID NO: 341748 - DNA, 25 bp, Rattus norvegicus
gagcctacctatcaacattattctg

SEQ ID NO: 341749 - DNA, 25 bp, Rattus norvegicus
gagcctacctatgaacattattctg

SEQ ID NO: 341750 - DNA, 25 bp, Rattus norvegicus
gagcctacgaaacaactgctggctt

SEQ ID NO: 341751 - DNA, 25 bp, Rattus norvegicus
gagcctacgaaagaactgctggctt

SEQ ID NO: 341752 - DNA, 25 bp, Rattus norvegicus
gagcctactgtacacatttttgcct

SEQ ID NO: 341753 - DNA, 25 bp, Rattus norvegicus
gagcctactgtagacatttttgcct

SEQ ID NO: 341754 - DNA, 25 bp, Rattus norvegicus
gagcctacttttaccatgacactgc

SEQ ID NO: 341755 - DNA, 25 bp, Rattus norvegicus
gagcctactttttccatgacactgc

SEQ ID NO: 341756 - DNA, 25 bp, Rattus norvegicus
gagcctagaataaacctgttcagtg

SEQ ID NO: 341757 - DNA, 25 bp, Rattus norvegicus
gagcctagaatatacctgttcagtg

SEQ ID NO: 341758 - DNA, 25 bp, Rattus norvegicus
gagcctagatgactcatcgctgcag

SEQ ID NO: 341759 - DNA, 25 bp, Rattus norvegicus
gagcctagatgagtcatcgctgcag

SEQ ID NO: 341760 - DNA, 25 bp, Rattus norvegicus
gagcctagcaggcacagagctcttt

SEQ ID NO: 341761 - DNA, 25 bp, Rattus norvegicus
gagcctagcagggacagagctcttt

SEQ ID NO: 341762 - DNA, 25 bp, Rattus norvegicus
gagcctagcattctctaagtccaag

SEQ ID NO: 341763 - DNA, 25 bp, Rattus norvegicus
gagcctagcattgtctaagtccaag

SEQ ID NO: 341764 - DNA, 25 bp, Rattus norvegicus
gagcctagccagaaatgaagaccat

SEQ ID NO: 341765 - DNA, 25 bp, Rattus norvegicus
gagcctagccagtaatgaagaccat

SEQ ID NO: 341766 - DNA, 25 bp, Rattus norvegicus
gagcctagcccactatttaatcaac

SEQ ID NO: 341767 - DNA, 25 bp, Rattus norvegicus
gagcctagcccagtatttaatcaac

SEQ ID NO: 341768 - DNA, 25 bp, Rattus norvegicus
gagcctaggatgcatgagaccatgt

SEQ ID NO: 341769 - DNA, 25 bp, Rattus norvegicus
gagcctaggatggatgagaccatgt

SEQ ID NO: 341770 - DNA, 25 bp, Rattus norvegicus
gagcctaggcatcggtttcttatca

SEQ ID NO: 341771 - DNA, 25 bp, Rattus norvegicus
gagcctaggcatgggtttcttatca

SEQ ID NO: 341772 - DNA, 25 bp, Rattus norvegicus
gagcctaggttcattgaggccccag

SEQ ID NO: 341773 - DNA, 25 bp, Rattus norvegicus
gagcctaggttctttgaggccccag

SEQ ID NO: 341774 - DNA, 25 bp, Rattus norvegicus
gagcctagtaggaattccagactaa

SEQ ID NO: 341775 - DNA, 25 bp, Rattus norvegicus
gagcctagtaggtattccagactaa

SEQ ID NO: 341776 - DNA, 25 bp, Rattus norvegicus
gagcctagtgacagggccggacaat

SEQ ID NO: 341777 - DNA, 25 bp, Rattus norvegicus
gagcctagtgactgggccggacaat

SEQ ID NO: 341778 - DNA, 25 bp, Rattus norvegicus
gagcctataattacagctattcagg

SEQ ID NO: 341779 - DNA, 25 bp, Rattus norvegicus
gagcctataatttcagctattcagg

SEQ ID NO: 341780 - DNA, 25 bp, Rattus norvegicus
gagcctatagacagcgatgtgagca

SEQ ID NO: 341781 - DNA, 25 bp, Rattus norvegicus
gagcctatagactgcgatgtgagca

SEQ ID NO: 341782 - DNA, 25 bp, Rattus norvegicus
gagcctatagtaatgagcacaccag

SEQ ID NO: 341783 - DNA, 25 bp, Rattus norvegicus
gagcctatagtattgagcacaccag

SEQ ID NO: 341784 - DNA, 25 bp, Rattus norvegicus
gagcctatcaaaattctgcttatct

SEQ ID NO: 341785 - DNA, 25 bp, Rattus norvegicus
gagcctatcaaatttctgcttatct

SEQ ID NO: 341786 - DNA, 25 bp, Rattus norvegicus
gagcctatctttagcgatttctaaa

SEQ ID NO: 341787 - DNA, 25 bp, Rattus norvegicus
gagcctatcttttgcgatttctaaa

SEQ ID NO: 341788 - DNA, 25 bp, Rattus norvegicus
gagcctatgattctcagcttctgac

SEQ ID NO: 341789 - DNA, 25 bp, Rattus norvegicus
gagcctatgattgtcagcttctgac

SEQ ID NO: 341790 - DNA, 25 bp, Rattus norvegicus
gagcctatgccaattctaatttcta

SEQ ID NO: 341791 - DNA, 25 bp, Rattus norvegicus
gagcctatgccatttctaatttcta

SEQ ID NO: 341792 - DNA, 25 bp, Rattus norvegicus
gagcctatgcctcacttttagtata

SEQ ID NO: 341793 - DNA, 25 bp, Rattus norvegicus
gagcctatgcctgacttttagtata

SEQ ID NO: 341794 - DNA, 25 bp, Rattus norvegicus
gagcctatggagatatagcctacgg

SEQ ID NO: 341795 - DNA, 25 bp, Rattus norvegicus
gagcctatggagttatagcctacgg

SEQ ID NO: 341796 - DNA, 25 bp, Rattus norvegicus
gagcctatggctacatttggagtct

SEQ ID NO: 341797 - DNA, 25 bp, Rattus norvegicus
gagcctatggcttcatttggagtct

SEQ ID NO: 341798 - DNA, 25 bp, Rattus norvegicus
gagcctatgttgacaagaactcatc

SEQ ID NO: 341799 - DNA, 25 bp, Rattus norvegicus
gagcctatgttgtcaagaactcatc

SEQ ID NO: 341800 - DNA, 25 bp, Rattus norvegicus
gagcctattgagaggtcattggtaa

SEQ ID NO: 341801 - DNA, 25 bp, Rattus norvegicus
gagcctattgagtggtcattggtaa

SEQ ID NO: 341802 - DNA, 25 bp, Rattus norvegicus
gagcctattgccatgacagtgccta

SEQ ID NO: 341803 - DNA, 25 bp, Rattus norvegicus
gagcctattgccttgacagtgccta

SEQ ID NO: 341804 - DNA, 25 bp, Rattus norvegicus
gagcctcaaagcagagttgtacttg

SEQ ID NO: 341805 - DNA, 25 bp, Rattus norvegicus
gagcctcaaagcaggaccatggaga

SEQ ID NO: 341806 - DNA, 25 bp, Rattus norvegicus
gagcctcaaagctgagttgtacttg

SEQ ID NO: 341807 - DNA, 25 bp, Rattus norvegicus
gagcctcaaagctggaccatggaga

SEQ ID NO: 341808 - DNA, 25 bp, Rattus norvegicus
gagcctcaaaggctagtgcccagta

SEQ ID NO: 341809 - DNA, 25 bp, Rattus norvegicus
gagcctcaaagggtagtgcccagta

SEQ ID NO: 341810 - DNA, 25 bp, Rattus norvegicus
gagcctcaagccataccattatggc

SEQ ID NO: 341811 - DNA, 25 bp, Rattus norvegicus
gagcctcaagccttaccattatggc

SEQ ID NO: 341812 - DNA, 25 bp, Rattus norvegicus
gagcctcaagtcaaaaatgttcagt

SEQ ID NO: 341813 - DNA, 25 bp, Rattus norvegicus
gagcctcaagtctaaaatgttcagt

SEQ ID NO: 341814 - DNA, 25 bp, Rattus norvegicus
gagcctcacagacaatggccaagtg

SEQ ID NO: 341815 - DNA, 25 bp, Rattus norvegicus
gagcctcacagagaatggccaagtg

SEQ ID NO: 341816 - DNA, 25 bp, Rattus norvegicus
gagcctcaccaccataaactgggat

SEQ ID NO: 341817 - DNA, 25 bp, Rattus norvegicus
gagcctcaccacgataaactgggat

SEQ ID NO: 341818 - DNA, 25 bp, Rattus norvegicus
gagcctcagaatcagccattcatgt

SEQ ID NO: 341819 - DNA, 25 bp, Rattus norvegicus
gagcctcagaatcggcctggatcaa

SEQ ID NO: 341820 - DNA, 25 bp, Rattus norvegicus
gagcctcagaatgagccattcatgt

SEQ ID NO: 341821 - DNA, 25 bp, Rattus norvegicus
gagcctcagaatgggcctggatcaa

SEQ ID NO: 341822 - DNA, 25 bp, Rattus norvegicus
gagcctcagcgcaatccagaagatg

SEQ ID NO: 341823 - DNA, 25 bp, Rattus norvegicus
gagcctcagcgctatccagaagatg

SEQ ID NO: 341824 - DNA, 25 bp, Rattus norvegicus
gagcctcaggaaatgactctggtca

SEQ ID NO: 341825 - DNA, 25 bp, Rattus norvegicus
gagcctcaggaattgactctggtca

SEQ ID NO: 341826 - DNA, 25 bp, Rattus norvegicus
gagcctcaggacatgagcagcagca

SEQ ID NO: 341827 - DNA, 25 bp, Rattus norvegicus
gagcctcaggacttgagcagcagca

SEQ ID NO: 341828 - DNA, 25 bp, Rattus norvegicus
gagcctcaggatagcagcaggttca

SEQ ID NO: 341829 - DNA, 25 bp, Rattus norvegicus
gagcctcaggattgcagcaggttca

SEQ ID NO: 341830 - DNA, 25 bp, Rattus norvegicus
gagcctcagtgtccactactatgta

SEQ ID NO: 341831 - DNA, 25 bp, Rattus norvegicus
gagcctcagtgtgcactactatgta

SEQ ID NO: 341832 - DNA, 25 bp, Rattus norvegicus
gagcctcatattattgtcattttta

SEQ ID NO: 341833 - DNA, 25 bp, Rattus norvegicus
gagcctcatatttttgtcattttta

SEQ ID NO: 341834 - DNA, 25 bp, Rattus norvegicus
gagcctcatcaaaggcctatggagt

SEQ ID NO: 341835 - DNA, 25 bp, Rattus norvegicus
gagcctcatcaatggcctatggagt

SEQ ID NO: 341836 - DNA, 25 bp, Rattus norvegicus
gagcctcatcatacagatgccggag

SEQ ID NO: 341837 - DNA, 25 bp, Rattus norvegicus
gagcctcatcattcagatgccggag

SEQ ID NO: 341838 - DNA, 25 bp, Rattus norvegicus
gagcctcatctcatggtagcaggtt

SEQ ID NO: 341839 - DNA, 25 bp, Rattus norvegicus
gagcctcatctcttggtagcaggtt

SEQ ID NO: 341840 - DNA, 25 bp, Rattus norvegicus
gagcctcatcttatgctttgtatgc

SEQ ID NO: 341841 - DNA, 25 bp, Rattus norvegicus
gagcctcatcttttgctttgtatgc

SEQ ID NO: 341842 - DNA, 25 bp, Rattus norvegicus
gagcctcatgaaccctgcatggtca

SEQ ID NO: 341843 - DNA, 25 bp, Rattus norvegicus
gagcctcatgaagcctgcatggtca

SEQ ID NO: 341844 - DNA, 25 bp, Rattus norvegicus
gagcctcatgacacagggtggacct

SEQ ID NO: 341845 - DNA, 25 bp, Rattus norvegicus
gagcctcatgactcagggtggacct

SEQ ID NO: 341846 - DNA, 25 bp, Rattus norvegicus
gagcctcattatcggtttcggtgat

SEQ ID NO: 341847 - DNA, 25 bp, Rattus norvegicus
gagcctcattatgggtttcggtgat

SEQ ID NO: 341848 - DNA, 25 bp, Rattus norvegicus
gagcctcattggagtctatcctgag

SEQ ID NO: 341849 - DNA, 25 bp, Rattus norvegicus
gagcctcattggtgtctatcctgag

SEQ ID NO: 341850 - DNA, 25 bp, Rattus norvegicus
gagcctcatttccaactgcagaagg

SEQ ID NO: 341851 - DNA, 25 bp, Rattus norvegicus
gagcctcatttcgaactgcagaagg

SEQ ID NO: 341852 - DNA, 25 bp, Rattus norvegicus
gagcctcattttcagtcctagcaaa

SEQ ID NO: 341853 - DNA, 25 bp, Rattus norvegicus
gagcctcattttgagtcctagcaaa

SEQ ID NO: 341854 - DNA, 25 bp, Rattus norvegicus
gagcctccaaatcgcgtctgggaat

SEQ ID NO: 341855 - DNA, 25 bp, Rattus norvegicus
gagcctccaaatggcgtctgggaat

SEQ ID NO: 341856 - DNA, 25 bp, Rattus norvegicus
gagcctccaactcgttgcgttgttc

SEQ ID NO: 341857 - DNA, 25 bp, Rattus norvegicus
gagcctccaactggttgcgttgttc

SEQ ID NO: 341858 - DNA, 25 bp, Rattus norvegicus
gagcctccaaggagtcagtgggaac

SEQ ID NO: 341859 - DNA, 25 bp, Rattus norvegicus
gagcctccaaggtgtcagtgggaac

SEQ ID NO: 341860 - DNA, 25 bp, Rattus norvegicus
gagcctccagagctctgtttgctaa

SEQ ID NO: 341861 - DNA, 25 bp, Rattus norvegicus
gagcctccagaggtctgtttgctaa

SEQ ID NO: 341862 - DNA, 25 bp, Rattus norvegicus
gagcctccagatagcagggcaagat

SEQ ID NO: 341863 - DNA, 25 bp, Rattus norvegicus
gagcctccagattgcagggcaagat

SEQ ID NO: 341864 - DNA, 25 bp, Rattus norvegicus
gagcctccagcacacagagtcagga

SEQ ID NO: 341865 - DNA, 25 bp, Rattus norvegicus
gagcctccagcagacagagtcagga

SEQ ID NO: 341866 - DNA, 25 bp, Rattus norvegicus
gagcctccaggcagaggataactga

SEQ ID NO: 341867 - DNA, 25 bp, Rattus norvegicus
gagcctccaggctgaggataactga

SEQ ID NO: 341868 - DNA, 25 bp, Rattus norvegicus
gagcctccaggtcggcaatctccag

SEQ ID NO: 341869 - DNA, 25 bp, Rattus norvegicus
gagcctccaggtgggcaatctccag

SEQ ID NO: 341870 - DNA, 25 bp, Rattus norvegicus
gagcctccatgtcggcaggacatat

SEQ ID NO: 341871 - DNA, 25 bp, Rattus norvegicus
gagcctccatgtgggcaggacatat

SEQ ID NO: 341872 - DNA, 25 bp, Rattus norvegicus
gagcctccattaccccgtctgtaaa

SEQ ID NO: 341873 - DNA, 25 bp, Rattus norvegicus
gagcctccattagcccgtctgtaaa

SEQ ID NO: 341874 - DNA, 25 bp, Rattus norvegicus
gagcctccattcagccatatattga

SEQ ID NO: 341875 - DNA, 25 bp, Rattus norvegicus
gagcctccattctgccatatattga

SEQ ID NO: 341876 - DNA, 25 bp, Rattus norvegicus
gagcctccattgagtcttgagttag

SEQ ID NO: 341877 - DNA, 25 bp, Rattus norvegicus
gagcctccattgtgtcttgagttag

SEQ ID NO: 341878 - DNA, 25 bp, Rattus norvegicus
gagcctcccaaactgtggtcctgtg

SEQ ID NO: 341879 - DNA, 25 bp, Rattus norvegicus
gagcctcccaaagtgtggtcctgtg

SEQ ID NO: 341880 - DNA, 25 bp, Rattus norvegicus
gagcctccccggaagaacaaatact

SEQ ID NO: 341881 - DNA, 25 bp, Rattus norvegicus
gagcctccccggtagaacaaatact

SEQ ID NO: 341882 - DNA, 25 bp, Rattus norvegicus
gagcctccctatagatgtgaccttg

SEQ ID NO: 341883 - DNA, 25 bp, Rattus norvegicus
gagcctccctattgatgtgaccttg

SEQ ID NO: 341884 - DNA, 25 bp, Rattus norvegicus
gagcctccctctaacaaagctggtg

SEQ ID NO: 341885 - DNA, 25 bp, Rattus norvegicus
gagcctccctcttacaaagctggtg

SEQ ID NO: 341886 - DNA, 25 bp, Rattus norvegicus
gagcctccgagccaagcctgtgagt

SEQ ID NO: 341887 - DNA, 25 bp, Rattus norvegicus
gagcctccgagcgaagcctgtgagt

SEQ ID NO: 341888 - DNA, 25 bp, Rattus norvegicus
gagcctccgggaactatgctacagt

SEQ ID NO: 341889 - DNA, 25 bp, Rattus norvegicus
gagcctccgggatctatgctacagt

SEQ ID NO: 341890 - DNA, 25 bp, Rattus norvegicus
gagcctcctcaaactcgaattgttt

SEQ ID NO: 341891 - DNA, 25 bp, Rattus norvegicus
gagcctcctcaatctcgaattgttt

SEQ ID NO: 341892 - DNA, 25 bp, Rattus norvegicus
gagcctcctgaaaacatttccaaga

SEQ ID NO: 341893 - DNA, 25 bp, Rattus norvegicus
gagcctcctgaatacatttccaaga

SEQ ID NO: 341894 - DNA, 25 bp, Rattus norvegicus
gagcctcctgcacattgtagtgcgt

SEQ ID NO: 341895 - DNA, 25 bp, Rattus norvegicus
gagcctcctgcagattgtagtgcgt

SEQ ID NO: 341896 - DNA, 25 bp, Rattus norvegicus
gagcctcctgcgagccttcacggcg

SEQ ID NO: 341897 - DNA, 25 bp, Rattus norvegicus
gagcctcctgcgtgccttcacggcg

SEQ ID NO: 341898 - DNA, 25 bp, Rattus norvegicus
gagcctcctgtccagttagtcgtgg

SEQ ID NO: 341899 - DNA, 25 bp, Rattus norvegicus
gagcctcctgtcgagttagtcgtgg

SEQ ID NO: 341900 - DNA, 25 bp, Rattus norvegicus
gagcctcgagtacacttattctctt

SEQ ID NO: 341901 - DNA, 25 bp, Rattus norvegicus
gagcctcgagtagacttattctctt

SEQ ID NO: 341902 - DNA, 25 bp, Rattus norvegicus
gagcctcggagaccagcagaaattt

SEQ ID NO: 341903 - DNA, 25 bp, Rattus norvegicus
gagcctcggagagcagcagaaattt

SEQ ID NO: 341904 - DNA, 25 bp, Rattus norvegicus
gagcctcgtgatagtttcttttaca

SEQ ID NO: 341905 - DNA, 25 bp, Rattus norvegicus
gagcctcgtgattgtttcttttaca

SEQ ID NO: 341906 - DNA, 25 bp, Rattus norvegicus
gagcctctaagtacagttctgcaag

SEQ ID NO: 341907 - DNA, 25 bp, Rattus norvegicus
gagcctctaagttcagttctgcaag

SEQ ID NO: 341908 - DNA, 25 bp, Rattus norvegicus
gagcctctacacactgtcacgaggt

SEQ ID NO: 341909 - DNA, 25 bp, Rattus norvegicus
gagcctctacacatggaaactgaat

SEQ ID NO: 341910 - DNA, 25 bp, Rattus norvegicus
gagcctctacactctgtcacgaggt

SEQ ID NO: 341911 - DNA, 25 bp, Rattus norvegicus
gagcctctacacttggaaactgaat

SEQ ID NO: 341912 - DNA, 25 bp, Rattus norvegicus
gagcctctagcccagaaggtgcttg

SEQ ID NO: 341913 - DNA, 25 bp, Rattus norvegicus
gagcctctagccgagaaggtgcttg

SEQ ID NO: 341914 - DNA, 25 bp, Rattus norvegicus
gagcctctatggactctgggagagc

SEQ ID NO: 341915 - DNA, 25 bp, Rattus norvegicus
gagcctctatggtctctgggagagc

SEQ ID NO: 341916 - DNA, 25 bp, Rattus norvegicus
gagcctctatgtcggactttaaaaa

SEQ ID NO: 341917 - DNA, 25 bp, Rattus norvegicus
gagcctctatgtgggactttaaaaa

SEQ ID NO: 341918 - DNA, 25 bp, Rattus norvegicus
gagcctctcctgagaatgacatatt

SEQ ID NO: 341919 - DNA, 25 bp, Rattus norvegicus
gagcctctcctgtgaatgacatatt

SEQ ID NO: 341920 - DNA, 25 bp, Rattus norvegicus
gagcctctctcacggaaagattcca

SEQ ID NO: 341921 - DNA, 25 bp, Rattus norvegicus
gagcctctctcagggaaagattcca

SEQ ID NO: 341922 - DNA, 25 bp, Rattus norvegicus
gagcctctctttactaacgacaaat

SEQ ID NO: 341923 - DNA, 25 bp, Rattus norvegicus
gagcctctcttttctaacgacaaat

SEQ ID NO: 341924 - DNA, 25 bp, Rattus norvegicus
gagcctctgacacggtgtcaggaca

SEQ ID NO: 341925 - DNA, 25 bp, Rattus norvegicus
gagcctctgacagggtgtcaggaca

SEQ ID NO: 341926 - DNA, 25 bp, Rattus norvegicus
gagcctctgatccaacttgtgcaag

SEQ ID NO: 341927 - DNA, 25 bp, Rattus norvegicus
gagcctctgatcgaacttgtgcaag

SEQ ID NO: 341928 - DNA, 25 bp, Rattus norvegicus
gagcctctgatgctcacagaatacg

SEQ ID NO: 341929 - DNA, 25 bp, Rattus norvegicus
gagcctctgatggtcacagaatacg

SEQ ID NO: 341930 - DNA, 25 bp, Rattus norvegicus
gagcctctgcccctgcttaattgtt

SEQ ID NO: 341931 - DNA, 25 bp, Rattus norvegicus
gagcctctgcccgtgcttaattgtt

SEQ ID NO: 341932 - DNA, 25 bp, Rattus norvegicus
gagcctctggctaggaacgtaacaa

SEQ ID NO: 341933 - DNA, 25 bp, Rattus norvegicus
gagcctctggcttggaacgtaacaa

SEQ ID NO: 341934 - DNA, 25 bp, Rattus norvegicus
gagcctctggttcctacacagttta

SEQ ID NO: 341935 - DNA, 25 bp, Rattus norvegicus
gagcctctggttgctacacagttta

SEQ ID NO: 341936 - DNA, 25 bp, Rattus norvegicus
gagcctctgtcgatttccgtggaat

SEQ ID NO: 341937 - DNA, 25 bp, Rattus norvegicus
gagcctctgtcgttttccgtggaat

SEQ ID NO: 341938 - DNA, 25 bp, Rattus norvegicus
gagcctctgtgcactttagaagata

SEQ ID NO: 341939 - DNA, 25 bp, Rattus norvegicus
gagcctctgtgctctttagaagata

SEQ ID NO: 341940 - DNA, 25 bp, Rattus norvegicus
gagcctctgtgtagtacaagtttgc

SEQ ID NO: 341941 - DNA, 25 bp, Rattus norvegicus
gagcctctgtgttgtacaagtttgc

SEQ ID NO: 341942 - DNA, 25 bp, Rattus norvegicus
gagcctcttctaacagactgcaaag

SEQ ID NO: 341943 - DNA, 25 bp, Rattus norvegicus
gagcctcttctatcagactgcaaag

SEQ ID NO: 341944 - DNA, 25 bp, Rattus norvegicus
gagcctcttgaactgcctccaagaa

SEQ ID NO: 341945 - DNA, 25 bp, Rattus norvegicus
gagcctcttgaagtgcctccaagaa

SEQ ID NO: 341946 - DNA, 25 bp, Rattus norvegicus
gagcctcttgccctttgtaattatg

SEQ ID NO: 341947 - DNA, 25 bp, Rattus norvegicus
gagcctcttgccgtttgtaattatg

SEQ ID NO: 341948 - DNA, 25 bp, Rattus norvegicus
gagcctcttggtatctactgggttt

SEQ ID NO: 341949 - DNA, 25 bp, Rattus norvegicus
gagcctcttggtttctactgggttt

SEQ ID NO: 341950 - DNA, 25 bp, Rattus norvegicus
gagcctctttgcatgttttccagaa

SEQ ID NO: 341951 - DNA, 25 bp, Rattus norvegicus
gagcctctttgcttgttttccagaa

SEQ ID NO: 341952 - DNA, 25 bp, Rattus norvegicus
gagcctgaaagcctatcttcacctc

SEQ ID NO: 341953 - DNA, 25 bp, Rattus norvegicus
gagcctgaaagcgtatcttcacctc

SEQ ID NO: 341954 - DNA, 25 bp, Rattus norvegicus
gagcctgaaatcaacgagcccaact

SEQ ID NO: 341955 - DNA, 25 bp, Rattus norvegicus
gagcctgaaatctacgagcccaact

SEQ ID NO: 341956 - DNA, 25 bp, Rattus norvegicus
gagcctgaacatcggcattctagtg

SEQ ID NO: 341957 - DNA, 25 bp, Rattus norvegicus
gagcctgaacatgggcattctagtg

SEQ ID NO: 341958 - DNA, 25 bp, Rattus norvegicus
gagcctgaagacagatgacgttttt

SEQ ID NO: 341959 - DNA, 25 bp, Rattus norvegicus
gagcctgaagactgatgacgttttt

SEQ ID NO: 341960 - DNA, 25 bp, Rattus norvegicus
gagcctgaagctctaatgcagtgca

SEQ ID NO: 341961 - DNA, 25 bp, Rattus norvegicus
gagcctgaagctgtaatgcagtgca

SEQ ID NO: 341962 - DNA, 25 bp, Rattus norvegicus
gagcctgaaggaagccggtgtccct

SEQ ID NO: 341963 - DNA, 25 bp, Rattus norvegicus
gagcctgaaggatgccggtgtccct

SEQ ID NO: 341964 - DNA, 25 bp, Rattus norvegicus
gagcctgaaggtatcttttccagag

SEQ ID NO: 341965 - DNA, 25 bp, Rattus norvegicus
gagcctgaaggtttcttttccagag

SEQ ID NO: 341966 - DNA, 25 bp, Rattus norvegicus
gagcctgacaacaaaacagtccgtt

SEQ ID NO: 341967 - DNA, 25 bp, Rattus norvegicus
gagcctgacaactaaacagtccgtt

SEQ ID NO: 341968 - DNA, 25 bp, Rattus norvegicus
gagcctgacaagcagctgaacccta

SEQ ID NO: 341969 - DNA, 25 bp, Rattus norvegicus
gagcctgacaaggagctgaacccta

SEQ ID NO: 341970 - DNA, 25 bp, Rattus norvegicus
gagcctgacaatccgcaaagaccta

SEQ ID NO: 341971 - DNA, 25 bp, Rattus norvegicus
gagcctgacaatgcgcaaagaccta

SEQ ID NO: 341972 - DNA, 25 bp, Rattus norvegicus
gagcctgactaccagaactgtgagg

SEQ ID NO: 341973 - DNA, 25 bp, Rattus norvegicus
gagcctgactacgagaactgtgagg

SEQ ID NO: 341974 - DNA, 25 bp, Rattus norvegicus
gagcctgactccatcttggtttttg

SEQ ID NO: 341975 - DNA, 25 bp, Rattus norvegicus
gagcctgactccttcttggtttttg

SEQ ID NO: 341976 - DNA, 25 bp, Rattus norvegicus
gagcctgactctaataaggtgtcaa

SEQ ID NO: 341977 - DNA, 25 bp, Rattus norvegicus
gagcctgactcttataaggtgtcaa

SEQ ID NO: 341978 - DNA, 25 bp, Rattus norvegicus
gagcctgactggaagtgcgtgtaca

SEQ ID NO: 341979 - DNA, 25 bp, Rattus norvegicus
gagcctgactggtagtgcgtgtaca

SEQ ID NO: 341980 - DNA, 25 bp, Rattus norvegicus
gagcctgagaaaaggtcttccttat

SEQ ID NO: 341981 - DNA, 25 bp, Rattus norvegicus
gagcctgagaaatggtcttccttat

SEQ ID NO: 341982 - DNA, 25 bp, Rattus norvegicus
gagcctgagactcctgacagctgac

SEQ ID NO: 341983 - DNA, 25 bp, Rattus norvegicus
gagcctgagactctgtaactgacat

SEQ ID NO: 341984 - DNA, 25 bp, Rattus norvegicus
gagcctgagactgctgacagctgac

SEQ ID NO: 341985 - DNA, 25 bp, Rattus norvegicus
gagcctgagactgtgtaactgacat

SEQ ID NO: 341986 - DNA, 25 bp, Rattus norvegicus
gagcctgagataccccgggctacaa

SEQ ID NO: 341987 - DNA, 25 bp, Rattus norvegicus
gagcctgagatagcccgggctacaa

SEQ ID NO: 341988 - DNA, 25 bp, Rattus norvegicus
gagcctgagcagatcctgagtagat

SEQ ID NO: 341989 - DNA, 25 bp, Rattus norvegicus
gagcctgagcagttcctgagtagat

SEQ ID NO: 341990 - DNA, 25 bp, Rattus norvegicus
gagcctgagcatagtgtgcccaagg

SEQ ID NO: 341991 - DNA, 25 bp, Rattus norvegicus
gagcctgagcattgtgtgcccaagg

SEQ ID NO: 341992 - DNA, 25 bp, Rattus norvegicus
gagcctgagcctatatttttaggaa

SEQ ID NO: 341993 - DNA, 25 bp, Rattus norvegicus
gagcctgagcctcagtacagcactg

SEQ ID NO: 341994 - DNA, 25 bp, Rattus norvegicus
gagcctgagcctgagtacagcactg

SEQ ID NO: 341995 - DNA, 25 bp, Rattus norvegicus
gagcctgagcctttatttttaggaa

SEQ ID NO: 341996 - DNA, 25 bp, Rattus norvegicus
gagcctgagcggcaaccggcccgag

SEQ ID NO: 341997 - DNA, 25 bp, Rattus norvegicus
gagcctgagcgggaaccggcccgag

SEQ ID NO: 341998 - DNA, 25 bp, Rattus norvegicus
gagcctgaggacaactatttctgag

SEQ ID NO: 341999 - DNA, 25 bp, Rattus norvegicus
gagcctgaggactactatttctgag

SEQ ID NO: 342000 - DNA, 25 bp, Rattus norvegicus
gagcctgaggccatgcagttggaca

SEQ ID NO: 342001 - DNA, 25 bp, Rattus norvegicus
gagcctgaggccttgcagttggaca

SEQ ID NO: 342002 - DNA, 25 bp, Rattus norvegicus
gagcctgagtggaattgattggaaa

SEQ ID NO: 342003 - DNA, 25 bp, Rattus norvegicus
gagcctgagtggtattgattggaaa

SEQ ID NO: 342004 - DNA, 25 bp, Rattus norvegicus
gagcctgataagcactcacttctgg

SEQ ID NO: 342005 - DNA, 25 bp, Rattus norvegicus
gagcctgataaggactcacttctgg

SEQ ID NO: 342006 - DNA, 25 bp, Rattus norvegicus
gagcctgatgaacacttgttcccca

SEQ ID NO: 342007 - DNA, 25 bp, Rattus norvegicus
gagcctgatgaagacttgttcccca

SEQ ID NO: 342008 - DNA, 25 bp, Rattus norvegicus
gagcctgatgagcatgcctacgata

SEQ ID NO: 342009 - DNA, 25 bp, Rattus norvegicus
gagcctgatgaggatgcctacgata

SEQ ID NO: 342010 - DNA, 25 bp, Rattus norvegicus
gagcctgattagactcatagcattg

SEQ ID NO: 342011 - DNA, 25 bp, Rattus norvegicus
gagcctgattagtctcatagcattg

SEQ ID NO: 342012 - DNA, 25 bp, Rattus norvegicus
gagcctgattgtcctgttctctgtc

SEQ ID NO: 342013 - DNA, 25 bp, Rattus norvegicus
gagcctgattgtgctgttctctgtc

SEQ ID NO: 342014 - DNA, 25 bp, Rattus norvegicus
gagcctgcaaaaacaagggtcacct

SEQ ID NO: 342015 - DNA, 25 bp, Rattus norvegicus
gagcctgcaaaatcaagggtcacct

SEQ ID NO: 342016 - DNA, 25 bp, Rattus norvegicus
gagcctgcaagtcagctagctgctt

SEQ ID NO: 342017 - DNA, 25 bp, Rattus norvegicus
gagcctgcaagtgagctagctgctt

SEQ ID NO: 342018 - DNA, 25 bp, Rattus norvegicus
gagcctgcacttacacagattgtca

SEQ ID NO: 342019 - DNA, 25 bp, Rattus norvegicus
gagcctgcactttcacagattgtca

SEQ ID NO: 342020 - DNA, 25 bp, Rattus norvegicus
gagcctgcagaacttccgcagccag

SEQ ID NO: 342021 - DNA, 25 bp, Rattus norvegicus
gagcctgcagaagttccgcagccag

SEQ ID NO: 342022 - DNA, 25 bp, Rattus norvegicus
gagcctgcagccatgggattgaatc

SEQ ID NO: 342023 - DNA, 25 bp, Rattus norvegicus
gagcctgcagccttgggattgaatc

SEQ ID NO: 342024 - DNA, 25 bp, Rattus norvegicus
gagcctgcaggtccctggagacaac

SEQ ID NO: 342025 - DNA, 25 bp, Rattus norvegicus
gagcctgcaggtgcctggagacaac

SEQ ID NO: 342026 - DNA, 25 bp, Rattus norvegicus
gagcctgcagtaccgatacaaagga

SEQ ID NO: 342027 - DNA, 25 bp, Rattus norvegicus
gagcctgcagtagcgatacaaagga

SEQ ID NO: 342028 - DNA, 25 bp, Rattus norvegicus
gagcctgccaaacgagcacgttctt

SEQ ID NO: 342029 - DNA, 25 bp, Rattus norvegicus
gagcctgccaaaggagcacgttctt

SEQ ID NO: 342030 - DNA, 25 bp, Rattus norvegicus
gagcctgccagtaccagtaaaggtt

SEQ ID NO: 342031 - DNA, 25 bp, Rattus norvegicus
gagcctgccagttccagtaaaggtt

SEQ ID NO: 342032 - DNA, 25 bp, Rattus norvegicus
gagcctgccgagagctagcacttta

SEQ ID NO: 342033 - DNA, 25 bp, Rattus norvegicus
gagcctgccgagtgctagcacttta

SEQ ID NO: 342034 - DNA, 25 bp, Rattus norvegicus
gagcctgcctacaactgcaacgaat

SEQ ID NO: 342035 - DNA, 25 bp, Rattus norvegicus
gagcctgcctactactgcaacgaat

SEQ ID NO: 342036 - DNA, 25 bp, Rattus norvegicus
gagcctgcctgcacattgcagaaat

SEQ ID NO: 342037 - DNA, 25 bp, Rattus norvegicus
gagcctgcctgctcattgcagaaat

SEQ ID NO: 342038 - DNA, 25 bp, Rattus norvegicus
gagcctgcgctgcaaacaaagacat

SEQ ID NO: 342039 - DNA, 25 bp, Rattus norvegicus
gagcctgcgctggaaacaaagacat

SEQ ID NO: 342040 - DNA, 25 bp, Rattus norvegicus
gagcctgctaatcctagggttcaaa

SEQ ID NO: 342041 - DNA, 25 bp, Rattus norvegicus
gagcctgctaatgctagggttcaaa

SEQ ID NO: 342042 - DNA, 25 bp, Rattus norvegicus
gagcctgctagccacagactgataa

SEQ ID NO: 342043 - DNA, 25 bp, Rattus norvegicus
gagcctgctagcgacagactgataa

SEQ ID NO: 342044 - DNA, 25 bp, Rattus norvegicus
gagcctgctaggagaacccaacatc

SEQ ID NO: 342045 - DNA, 25 bp, Rattus norvegicus
gagcctgctaggtgaacccaacatc

SEQ ID NO: 342046 - DNA, 25 bp, Rattus norvegicus
gagcctgctcagaggaatctgtaca

SEQ ID NO: 342047 - DNA, 25 bp, Rattus norvegicus
gagcctgctcagtggaatctgtaca

SEQ ID NO: 342048 - DNA, 25 bp, Rattus norvegicus
gagcctgctcatagacacctgagaa

SEQ ID NO: 342049 - DNA, 25 bp, Rattus norvegicus
gagcctgctcattgacacctgagaa

SEQ ID NO: 342050 - DNA, 25 bp, Rattus norvegicus
gagcctgctcttagtctcaaaatgt

SEQ ID NO: 342051 - DNA, 25 bp, Rattus norvegicus
gagcctgctctttgtctcaaaatgt

SEQ ID NO: 342052 - DNA, 25 bp, Rattus norvegicus
gagcctgctgagcttctaacaccct

SEQ ID NO: 342053 - DNA, 25 bp, Rattus norvegicus
gagcctgctgaggttctaacaccct

SEQ ID NO: 342054 - DNA, 25 bp, Rattus norvegicus
gagcctgctgggacttgtagttgaa

SEQ ID NO: 342055 - DNA, 25 bp, Rattus norvegicus
gagcctgctgggtcttgtagttgaa

SEQ ID NO: 342056 - DNA, 25 bp, Rattus norvegicus
gagcctgctggtcagatttggtaca

SEQ ID NO: 342057 - DNA, 25 bp, Rattus norvegicus
gagcctgctggtgagatttggtaca

SEQ ID NO: 342058 - DNA, 25 bp, Rattus norvegicus
gagcctgcttctatgtttagtagtt

SEQ ID NO: 342059 - DNA, 25 bp, Rattus norvegicus
gagcctgcttctcgtagggatgcct

SEQ ID NO: 342060 - DNA, 25 bp, Rattus norvegicus
gagcctgcttctggtagggatgcct

SEQ ID NO: 342061 - DNA, 25 bp, Rattus norvegicus
gagcctgcttctttgtttagtagtt

SEQ ID NO: 342062 - DNA, 25 bp, Rattus norvegicus
gagcctggaagcaatctgttgccct

SEQ ID NO: 342063 - DNA, 25 bp, Rattus norvegicus
gagcctggaagctatctgttgccct

SEQ ID NO: 342064 - DNA, 25 bp, Rattus norvegicus
gagcctggacaaagaccaaccctga

SEQ ID NO: 342065 - DNA, 25 bp, Rattus norvegicus
gagcctggacaactgatggaccatt

SEQ ID NO: 342066 - DNA, 25 bp, Rattus norvegicus
gagcctggacaagtgatggaccatt

SEQ ID NO: 342067 - DNA, 25 bp, Rattus norvegicus
gagcctggacaatgaccaaccctga

SEQ ID NO: 342068 - DNA, 25 bp, Rattus norvegicus
gagcctggacacacagtacagcaag

SEQ ID NO: 342069 - DNA, 25 bp, Rattus norvegicus
gagcctggacactcagtacagcaag

SEQ ID NO: 342070 - DNA, 25 bp, Rattus norvegicus
gagcctggacctctgtaaagaactt

SEQ ID NO: 342071 - DNA, 25 bp, Rattus norvegicus
gagcctggacctgtgtaaagaactt

SEQ ID NO: 342072 - DNA, 25 bp, Rattus norvegicus
gagcctggagccctattttaagtca

SEQ ID NO: 342073 - DNA, 25 bp, Rattus norvegicus
gagcctggagccgtattttaagtca

SEQ ID NO: 342074 - DNA, 25 bp, Rattus norvegicus
gagcctggaggacctttgttatcac

SEQ ID NO: 342075 - DNA, 25 bp, Rattus norvegicus
gagcctggaggagctttgttatcac

SEQ ID NO: 342076 - DNA, 25 bp, Rattus norvegicus
gagcctggagtccacaaatgtcact

SEQ ID NO: 342077 - DNA, 25 bp, Rattus norvegicus
gagcctggagtcgacaaatgtcact

SEQ ID NO: 342078 - DNA, 25 bp, Rattus norvegicus
gagcctggagtgcactacgtgtaca

SEQ ID NO: 342079 - DNA, 25 bp, Rattus norvegicus
gagcctggagtggactacgtgtaca

SEQ ID NO: 342080 - DNA, 25 bp, Rattus norvegicus
gagcctggatcaaactaacactaat

SEQ ID NO: 342081 - DNA, 25 bp, Rattus norvegicus
gagcctggatcatactaacactaat

SEQ ID NO: 342082 - DNA, 25 bp, Rattus norvegicus
gagcctggatctacgtgtcaaactg

SEQ ID NO: 342083 - DNA, 25 bp, Rattus norvegicus
gagcctggatcttcgtgtcaaactg

SEQ ID NO: 342084 - DNA, 25 bp, Rattus norvegicus
gagcctggcagaacatagaacccaa

SEQ ID NO: 342085 - DNA, 25 bp, Rattus norvegicus
gagcctggcagatcatagaacccaa

SEQ ID NO: 342086 - DNA, 25 bp, Rattus norvegicus
gagcctggcagcaccacagcagcag

SEQ ID NO: 342087 - DNA, 25 bp, Rattus norvegicus
gagcctggcagctccacagcagcag

SEQ ID NO: 342088 - DNA, 25 bp, Rattus norvegicus
gagcctggcattcctgtgctagaca

SEQ ID NO: 342089 - DNA, 25 bp, Rattus norvegicus
gagcctggcattgctgtgctagaca

SEQ ID NO: 342090 - DNA, 25 bp, Rattus norvegicus
gagcctggcccaactagagaatctg

SEQ ID NO: 342091 - DNA, 25 bp, Rattus norvegicus
gagcctggcccatctagagaatctg

SEQ ID NO: 342092 - DNA, 25 bp, Rattus norvegicus
gagcctggccctatgatgataatcg

SEQ ID NO: 342093 - DNA, 25 bp, Rattus norvegicus
gagcctggccctttgatgataatcg

SEQ ID NO: 342094 - DNA, 25 bp, Rattus norvegicus
gagcctggctctcaataagtgacaa

SEQ ID NO: 342095 - DNA, 25 bp, Rattus norvegicus
gagcctggctctgaataagtgacaa

SEQ ID NO: 342096 - DNA, 25 bp, Rattus norvegicus
gagcctggctgaccagccttgatct

SEQ ID NO: 342097 - DNA, 25 bp, Rattus norvegicus
gagcctggctgagcagccttgatct

SEQ ID NO: 342098 - DNA, 25 bp, Rattus norvegicus
gagcctggctggaccaagtgcaata

SEQ ID NO: 342099 - DNA, 25 bp, Rattus norvegicus
gagcctggctggtccaagtgcaata

SEQ ID NO: 342100 - DNA, 25 bp, Rattus norvegicus
gagcctggcttgattgacctggtga

SEQ ID NO: 342101 - DNA, 25 bp, Rattus norvegicus
gagcctggcttgtttgacctggtga

SEQ ID NO: 342102 - DNA, 25 bp, Rattus norvegicus
gagcctggctttcgcatgtgagaaa

SEQ ID NO: 342103 - DNA, 25 bp, Rattus norvegicus
gagcctggctttggcatgtgagaaa

SEQ ID NO: 342104 - DNA, 25 bp, Rattus norvegicus
gagcctgggaaacgctcccatttga

SEQ ID NO: 342105 - DNA, 25 bp, Rattus norvegicus
gagcctgggaaaggctcccatttga

SEQ ID NO: 342106 - DNA, 25 bp, Rattus norvegicus
gagcctgggatcagtgcaggatcca

SEQ ID NO: 342107 - DNA, 25 bp, Rattus norvegicus
gagcctgggatctgtgcaggatcca

SEQ ID NO: 342108 - DNA, 25 bp, Rattus norvegicus
gagcctgggcagacgatgataatag

SEQ ID NO: 342109 - DNA, 25 bp, Rattus norvegicus
gagcctgggcagtcgatgataatag

SEQ ID NO: 342110 - DNA, 25 bp, Rattus norvegicus
gagcctgggtacagaggtgcaaact

SEQ ID NO: 342111 - DNA, 25 bp, Rattus norvegicus
gagcctgggtactgaggtgcaaact

SEQ ID NO: 342112 - DNA, 25 bp, Rattus norvegicus
gagcctgggtagcaaacagttcctt

SEQ ID NO: 342113 - DNA, 25 bp, Rattus norvegicus
gagcctgggtaggaaacagttcctt

SEQ ID NO: 342114 - DNA, 25 bp, Rattus norvegicus
gagcctggtaaaagacgtctctgag

SEQ ID NO: 342115 - DNA, 25 bp, Rattus norvegicus
gagcctggtaaatgacgtctctgag

SEQ ID NO: 342116 - DNA, 25 bp, Rattus norvegicus
gagcctggtgccagagctgatgtct

SEQ ID NO: 342117 - DNA, 25 bp, Rattus norvegicus
gagcctggtgcctgagctgatgtct

SEQ ID NO: 342118 - DNA, 25 bp, Rattus norvegicus
gagcctggtggtactctgattgtca

SEQ ID NO: 342119 - DNA, 25 bp, Rattus norvegicus
gagcctggtggttctctgattgtca

SEQ ID NO: 342120 - DNA, 25 bp, Rattus norvegicus
gagcctggtgttacgttttgtcaaa

SEQ ID NO: 342121 - DNA, 25 bp, Rattus norvegicus
gagcctggtgtttcgttttgtcaaa

SEQ ID NO: 342122 - DNA, 25 bp, Rattus norvegicus
gagcctggttaaaaatgggcctgta

SEQ ID NO: 342123 - DNA, 25 bp, Rattus norvegicus
gagcctggttaataatgggcctgta

SEQ ID NO: 342124 - DNA, 25 bp, Rattus norvegicus
gagcctggtttcctttttgcttcct

SEQ ID NO: 342125 - DNA, 25 bp, Rattus norvegicus
gagcctggtttcgtttttgcttcct

SEQ ID NO: 342126 - DNA, 25 bp, Rattus norvegicus
gagcctgtagcacctaccgaaccat

SEQ ID NO: 342127 - DNA, 25 bp, Rattus norvegicus
gagcctgtagcagctaccgaaccat

SEQ ID NO: 342128 - DNA, 25 bp, Rattus norvegicus
gagcctgtaggcaaagcacgtgtac

SEQ ID NO: 342129 - DNA, 25 bp, Rattus norvegicus
gagcctgtaggctaagcacgtgtac

SEQ ID NO: 342130 - DNA, 25 bp, Rattus norvegicus
gagcctgtagggatttcatagtgga

SEQ ID NO: 342131 - DNA, 25 bp, Rattus norvegicus
gagcctgtagggttttcatagtgga

SEQ ID NO: 342132 - DNA, 25 bp, Rattus norvegicus
gagcctgtattactgctgtgtaagt

SEQ ID NO: 342133 - DNA, 25 bp, Rattus norvegicus
gagcctgtattagtgctgtgtaagt

SEQ ID NO: 342134 - DNA, 25 bp, Rattus norvegicus
gagcctgtcaggagtctggagatcc

SEQ ID NO: 342135 - DNA, 25 bp, Rattus norvegicus
gagcctgtcaggtgtctggagatcc

SEQ ID NO: 342136 - DNA, 25 bp, Rattus norvegicus
gagcctgtccttagcaaagcggcgg

SEQ ID NO: 342137 - DNA, 25 bp, Rattus norvegicus
gagcctgtccttcttaggattcaaa

SEQ ID NO: 342138 - DNA, 25 bp, Rattus norvegicus
gagcctgtccttgttaggattcaaa

SEQ ID NO: 342139 - DNA, 25 bp, Rattus norvegicus
gagcctgtcctttgcaaagcggcgg

SEQ ID NO: 342140 - DNA, 25 bp, Rattus norvegicus
gagcctgtctcacccagcaaaagga

SEQ ID NO: 342141 - DNA, 25 bp, Rattus norvegicus
gagcctgtctcagccagcaaaagga

SEQ ID NO: 342142 - DNA, 25 bp, Rattus norvegicus
gagcctgtctctcaaggtaaacact

SEQ ID NO: 342143 - DNA, 25 bp, Rattus norvegicus
gagcctgtctctgaaggtaaacact

SEQ ID NO: 342144 - DNA, 25 bp, Rattus norvegicus
gagcctgtcttacttcatctaacat

SEQ ID NO: 342145 - DNA, 25 bp, Rattus norvegicus
gagcctgtcttagttcatctaacat

SEQ ID NO: 342146 - DNA, 25 bp, Rattus norvegicus
gagcctgtgcctaaaattcatctgt

SEQ ID NO: 342147 - DNA, 25 bp, Rattus norvegicus
gagcctgtgccttaaattcatctgt

SEQ ID NO: 342148 - DNA, 25 bp, Rattus norvegicus
gagcctgtggatccagagctactct

SEQ ID NO: 342149 - DNA, 25 bp, Rattus norvegicus
gagcctgtggatgcagagctactct

SEQ ID NO: 342150 - DNA, 25 bp, Rattus norvegicus
gagcctgtggtgctcatgcttcttt

SEQ ID NO: 342151 - DNA, 25 bp, Rattus norvegicus
gagcctgtggtggtcatgcttcttt

SEQ ID NO: 342152 - DNA, 25 bp, Rattus norvegicus
gagcctgtgtacattgggtcctgca

SEQ ID NO: 342153 - DNA, 25 bp, Rattus norvegicus
gagcctgtgtactttgggtcctgca

SEQ ID NO: 342154 - DNA, 25 bp, Rattus norvegicus
gagcctgtgtagctaagatccctct

SEQ ID NO: 342155 - DNA, 25 bp, Rattus norvegicus
gagcctgtgtaggtaagatccctct

SEQ ID NO: 342156 - DNA, 25 bp, Rattus norvegicus
gagcctgttaagcaacaatgccacc

SEQ ID NO: 342157 - DNA, 25 bp, Rattus norvegicus
gagcctgttaaggaacaatgccacc

SEQ ID NO: 342158 - DNA, 25 bp, Rattus norvegicus
gagcctgttagcctgaggtacacct

SEQ ID NO: 342159 - DNA, 25 bp, Rattus norvegicus
gagcctgttagcgtgaggtacacct

SEQ ID NO: 342160 - DNA, 25 bp, Rattus norvegicus
gagcctgttccacaattgctagaag

SEQ ID NO: 342161 - DNA, 25 bp, Rattus norvegicus
gagcctgttccagaattgctagaag

SEQ ID NO: 342162 - DNA, 25 bp, Rattus norvegicus
gagcctgttctaagtgttgagttta

SEQ ID NO: 342163 - DNA, 25 bp, Rattus norvegicus
gagcctgttctatgtgttgagttta

SEQ ID NO: 342164 - DNA, 25 bp, Rattus norvegicus
gagcctgttgcacagactttgccag

SEQ ID NO: 342165 - DNA, 25 bp, Rattus norvegicus
gagcctgttgcagagactttgccag

SEQ ID NO: 342166 - DNA, 25 bp, Rattus norvegicus
gagcctgtttccctgaacgaagtgg

SEQ ID NO: 342167 - DNA, 25 bp, Rattus norvegicus
gagcctgtttccgtgaacgaagtgg

SEQ ID NO: 342168 - DNA, 25 bp, Rattus norvegicus
gagcctgtttgcacagaccgagtct

SEQ ID NO: 342169 - DNA, 25 bp, Rattus norvegicus
gagcctgtttgctcagaccgagtct

SEQ ID NO: 342170 - DNA, 25 bp, Rattus norvegicus
gagcctgtttgtaaaaagtctattc

SEQ ID NO: 342171 - DNA, 25 bp, Rattus norvegicus
gagcctgtttgtcctggcagacaac

SEQ ID NO: 342172 - DNA, 25 bp, Rattus norvegicus
gagcctgtttgtgctggcagacaac

SEQ ID NO: 342173 - DNA, 25 bp, Rattus norvegicus
gagcctgtttgttaaaagtctattc

SEQ ID NO: 342174 - DNA, 25 bp, Rattus norvegicus
gagcctgttttcattacctatgtca

SEQ ID NO: 342175 - DNA, 25 bp, Rattus norvegicus
gagcctgttttctttacctatgtca

SEQ ID NO: 342176 - DNA, 25 bp, Rattus norvegicus
gagcctgtttttaacctttcattca

SEQ ID NO: 342177 - DNA, 25 bp, Rattus norvegicus
gagcctgttttttacctttcattca

SEQ ID NO: 342178 - DNA, 25 bp, Rattus norvegicus
gagccttaaatgaccatgctggtcc

SEQ ID NO: 342179 - DNA, 25 bp, Rattus norvegicus
gagccttaaatgtccatgctggtcc

SEQ ID NO: 342180 - DNA, 25 bp, Rattus norvegicus
gagccttaatatattggttcatacc

SEQ ID NO: 342181 - DNA, 25 bp, Rattus norvegicus
gagccttaatattttggttcatacc

SEQ ID NO: 342182 - DNA, 25 bp, Rattus norvegicus
gagccttaattcatccacactgtaa

SEQ ID NO: 342183 - DNA, 25 bp, Rattus norvegicus
gagccttaattcttccacactgtaa

SEQ ID NO: 342184 - DNA, 25 bp, Rattus norvegicus
gagccttacctgaatccaaatgaag

SEQ ID NO: 342185 - DNA, 25 bp, Rattus norvegicus
gagccttacctgtatccaaatgaag

SEQ ID NO: 342186 - DNA, 25 bp, Rattus norvegicus
gagccttactaaactggagcagatt

SEQ ID NO: 342187 - DNA, 25 bp, Rattus norvegicus
gagccttactaatctggagcagatt

SEQ ID NO: 342188 - DNA, 25 bp, Rattus norvegicus
gagccttactcactttaccaataat

SEQ ID NO: 342189 - DNA, 25 bp, Rattus norvegicus
gagccttactcagtttaccaataat

SEQ ID NO: 342190 - DNA, 25 bp, Rattus norvegicus
gagccttacttgactcacctgggcc

SEQ ID NO: 342191 - DNA, 25 bp, Rattus norvegicus
gagccttacttgtctcacctgggcc

SEQ ID NO: 342192 - DNA, 25 bp, Rattus norvegicus
gagccttagagcatcctttcttaac

SEQ ID NO: 342193 - DNA, 25 bp, Rattus norvegicus
gagccttagagcttcctttcttaac

SEQ ID NO: 342194 - DNA, 25 bp, Rattus norvegicus
gagccttagattctttaactgtcag

SEQ ID NO: 342195 - DNA, 25 bp, Rattus norvegicus
gagccttagattgtttaactgtcag

SEQ ID NO: 342196 - DNA, 25 bp, Rattus norvegicus
gagccttagttgacttcactgcaaa

SEQ ID NO: 342197 - DNA, 25 bp, Rattus norvegicus
gagccttagttgagaagtacctcca

SEQ ID NO: 342198 - DNA, 25 bp, Rattus norvegicus
gagccttagttgtcttcactgcaaa

SEQ ID NO: 342199 - DNA, 25 bp, Rattus norvegicus
gagccttagttgtgaagtacctcca

SEQ ID NO: 342200 - DNA, 25 bp, Rattus norvegicus
gagccttatgacacagttgctataa

SEQ ID NO: 342201 - DNA, 25 bp, Rattus norvegicus
gagccttatgactcagttgctataa

SEQ ID NO: 342202 - DNA, 25 bp, Rattus norvegicus
gagccttatgccacagcagacttta

SEQ ID NO: 342203 - DNA, 25 bp, Rattus norvegicus
gagccttatgcctcagcagacttta

SEQ ID NO: 342204 - DNA, 25 bp, Rattus norvegicus
gagccttcaacaccacttgtgtgac

SEQ ID NO: 342205 - DNA, 25 bp, Rattus norvegicus
gagccttcaacagcacttgtgtgac

SEQ ID NO: 342206 - DNA, 25 bp, Rattus norvegicus
gagccttcaaggatccaggttagtt

SEQ ID NO: 342207 - DNA, 25 bp, Rattus norvegicus
gagccttcaaggttccaggttagtt

SEQ ID NO: 342208 - DNA, 25 bp, Rattus norvegicus
gagccttcagataagactcagagga

SEQ ID NO: 342209 - DNA, 25 bp, Rattus norvegicus
gagccttcagattagactcagagga

SEQ ID NO: 342210 - DNA, 25 bp, Rattus norvegicus
gagccttcatccagacagggaacca

SEQ ID NO: 342211 - DNA, 25 bp, Rattus norvegicus
gagccttcatcctgacagggaacca

SEQ ID NO: 342212 - DNA, 25 bp, Rattus norvegicus
gagccttcatgtataaagactgacc

SEQ ID NO: 342213 - DNA, 25 bp, Rattus norvegicus
gagccttcatgtttaaagactgacc

SEQ ID NO: 342214 - DNA, 25 bp, Rattus norvegicus
gagccttcattaattgttgggattt

SEQ ID NO: 342215 - DNA, 25 bp, Rattus norvegicus
gagccttcattatttgttgggattt

SEQ ID NO: 342216 - DNA, 25 bp, Rattus norvegicus
gagccttccaggctgtctaattgcc

SEQ ID NO: 342217 - DNA, 25 bp, Rattus norvegicus
gagccttccagggtgtctaattgcc

SEQ ID NO: 342218 - DNA, 25 bp, Rattus norvegicus
gagccttccagtcccaagttgaaat

SEQ ID NO: 342219 - DNA, 25 bp, Rattus norvegicus
gagccttccagtgccaagttgaaat

SEQ ID NO: 342220 - DNA, 25 bp, Rattus norvegicus
gagccttccgcaaccagaagatgtg

SEQ ID NO: 342221 - DNA, 25 bp, Rattus norvegicus
gagccttccgcatccagaagatgtg

SEQ ID NO: 342222 - DNA, 25 bp, Rattus norvegicus
gagccttcctaaaatacatgcttgg

SEQ ID NO: 342223 - DNA, 25 bp, Rattus norvegicus
gagccttcctaatatacatgcttgg

SEQ ID NO: 342224 - DNA, 25 bp, Rattus norvegicus
gagccttcctcaatcactggcgaaa

SEQ ID NO: 342225 - DNA, 25 bp, Rattus norvegicus
gagccttcctcattcactggcgaaa

SEQ ID NO: 342226 - DNA, 25 bp, Rattus norvegicus
gagccttcctgcagacgttctgtta

SEQ ID NO: 342227 - DNA, 25 bp, Rattus norvegicus
gagccttcctgctgacgttctgtta

SEQ ID NO: 342228 - DNA, 25 bp, Rattus norvegicus
gagccttcgagccagcgatgttctc

SEQ ID NO: 342229 - DNA, 25 bp, Rattus norvegicus
gagccttcgagcgagcgatgttctc

SEQ ID NO: 342230 - DNA, 25 bp, Rattus norvegicus
gagccttcgggcactatgatcatag

SEQ ID NO: 342231 - DNA, 25 bp, Rattus norvegicus
gagccttcgggctctatgatcatag

SEQ ID NO: 342232 - DNA, 25 bp, Rattus norvegicus
gagccttcggtgctgacagctgatc

SEQ ID NO: 342233 - DNA, 25 bp, Rattus norvegicus
gagccttcggtggtgacagctgatc

SEQ ID NO: 342234 - DNA, 25 bp, Rattus norvegicus
gagccttcgtaaacagcagtgcctt

SEQ ID NO: 342235 - DNA, 25 bp, Rattus norvegicus
gagccttcgtaatcagcagtgcctt

SEQ ID NO: 342236 - DNA, 25 bp, Rattus norvegicus
gagccttctaaaactgatgagccta

SEQ ID NO: 342237 - DNA, 25 bp, Rattus norvegicus
gagccttctaaatctgatgagccta

SEQ ID NO: 342238 - DNA, 25 bp, Rattus norvegicus
gagccttctattctttgtctatttg

SEQ ID NO: 342239 - DNA, 25 bp, Rattus norvegicus
gagccttctattgtttgtctatttg

SEQ ID NO: 342240 - DNA, 25 bp, Rattus norvegicus
gagccttctccccacaggagcgtgt

SEQ ID NO: 342241 - DNA, 25 bp, Rattus norvegicus
gagccttctcccgacaggagcgtgt

SEQ ID NO: 342242 - DNA, 25 bp, Rattus norvegicus
gagccttctctcaagcctcaataaa

SEQ ID NO: 342243 - DNA, 25 bp, Rattus norvegicus
gagccttctctctagcctcaataaa

SEQ ID NO: 342244 - DNA, 25 bp, Rattus norvegicus
gagccttctgaaaagctgtttccat

SEQ ID NO: 342245 - DNA, 25 bp, Rattus norvegicus
gagccttctgaacaggacgctagac

SEQ ID NO: 342246 - DNA, 25 bp, Rattus norvegicus
gagccttctgaagaggacgctagac

SEQ ID NO: 342247 - DNA, 25 bp, Rattus norvegicus
gagccttctgaatagctgtttccat

SEQ ID NO: 342248 - DNA, 25 bp, Rattus norvegicus
gagccttctgagaagtaggagtgca

SEQ ID NO: 342249 - DNA, 25 bp, Rattus norvegicus
gagccttctgagtagtaggagtgca

SEQ ID NO: 342250 - DNA, 25 bp, Rattus norvegicus
gagccttcttgtattggacagtata

SEQ ID NO: 342251 - DNA, 25 bp, Rattus norvegicus
gagccttcttgttttggacagtata

SEQ ID NO: 342252 - DNA, 25 bp, Rattus norvegicus
gagccttctttaatgttggattctg

SEQ ID NO: 342253 - DNA, 25 bp, Rattus norvegicus
gagccttctttattgttggattctg

SEQ ID NO: 342254 - DNA, 25 bp, Rattus norvegicus
gagccttgaaacaaacggaacagca

SEQ ID NO: 342255 - DNA, 25 bp, Rattus norvegicus
gagccttgaaactaacggaacagca

SEQ ID NO: 342256 - DNA, 25 bp, Rattus norvegicus
gagccttgacagcagtgttcgctta

SEQ ID NO: 342257 - DNA, 25 bp, Rattus norvegicus
gagccttgacaggagtgttcgctta

SEQ ID NO: 342258 - DNA, 25 bp, Rattus norvegicus
gagccttgacttcctttttgagtat

SEQ ID NO: 342259 - DNA, 25 bp, Rattus norvegicus
gagccttgacttgctttttgagtat

SEQ ID NO: 342260 - DNA, 25 bp, Rattus norvegicus
gagccttgagctaggatttacactg

SEQ ID NO: 342261 - DNA, 25 bp, Rattus norvegicus
gagccttgagcttggatttacactg

SEQ ID NO: 342262 - DNA, 25 bp, Rattus norvegicus
gagccttgaggaaggagtgtactcc

SEQ ID NO: 342263 - DNA, 25 bp, Rattus norvegicus
gagccttgaggatggagtgtactcc

SEQ ID NO: 342264 - DNA, 25 bp, Rattus norvegicus
gagccttgatagctgagagccccta

SEQ ID NO: 342265 - DNA, 25 bp, Rattus norvegicus
gagccttgataggtgagagccccta

SEQ ID NO: 342266 - DNA, 25 bp, Rattus norvegicus
gagccttgatatatctcatctggag

SEQ ID NO: 342267 - DNA, 25 bp, Rattus norvegicus
gagccttgatatttctcatctggag

SEQ ID NO: 342268 - DNA, 25 bp, Rattus norvegicus
gagccttgatccagcaaagattttt

SEQ ID NO: 342269 - DNA, 25 bp, Rattus norvegicus
gagccttgatcctgcaaagattttt

SEQ ID NO: 342270 - DNA, 25 bp, Rattus norvegicus
gagccttgattcaggtaacactgca

SEQ ID NO: 342271 - DNA, 25 bp, Rattus norvegicus
gagccttgattctggtaacactgca

SEQ ID NO: 342272 - DNA, 25 bp, Rattus norvegicus
gagccttgcagacttttcatttgtg

SEQ ID NO: 342273 - DNA, 25 bp, Rattus norvegicus
gagccttgcagagttttcatttgtg

SEQ ID NO: 342274 - DNA, 25 bp, Rattus norvegicus
gagccttgcctgctgtctcaagaga

SEQ ID NO: 342275 - DNA, 25 bp, Rattus norvegicus
gagccttgcctggtgtctcaagaga

SEQ ID NO: 342276 - DNA, 25 bp, Rattus norvegicus
gagccttgcgctccttttcaaatgt

SEQ ID NO: 342277 - DNA, 25 bp, Rattus norvegicus
gagccttgcgctgcttttcaaatgt

SEQ ID NO: 342278 - DNA, 25 bp, Rattus norvegicus
gagccttgcgtcagaagattgtcat

SEQ ID NO: 342279 - DNA, 25 bp, Rattus norvegicus
gagccttgcgtctgaagattgtcat

SEQ ID NO: 342280 - DNA, 25 bp, Rattus norvegicus
gagccttgctggcatcgttttggaa

SEQ ID NO: 342281 - DNA, 25 bp, Rattus norvegicus
gagccttgctgggatcgttttggaa

SEQ ID NO: 342282 - DNA, 25 bp, Rattus norvegicus
gagccttggaacaaactgggtccca

SEQ ID NO: 342283 - DNA, 25 bp, Rattus norvegicus
gagccttggaactaactgggtccca

SEQ ID NO: 342284 - DNA, 25 bp, Rattus norvegicus
gagccttggcctcctattgtctcag

SEQ ID NO: 342285 - DNA, 25 bp, Rattus norvegicus
gagccttggcctgctattgtctcag

SEQ ID NO: 342286 - DNA, 25 bp, Rattus norvegicus
gagccttggctgagacatttcccaa

SEQ ID NO: 342287 - DNA, 25 bp, Rattus norvegicus
gagccttggctgagtataaatgcaa

SEQ ID NO: 342288 - DNA, 25 bp, Rattus norvegicus
gagccttggctgtgacatttcccaa

SEQ ID NO: 342289 - DNA, 25 bp, Rattus norvegicus
gagccttggctgtgtataaatgcaa

SEQ ID NO: 342290 - DNA, 25 bp, Rattus norvegicus
gagccttggttgaccacagtctgat

SEQ ID NO: 342291 - DNA, 25 bp, Rattus norvegicus
gagccttggttgtccacagtctgat

SEQ ID NO: 342292 - DNA, 25 bp, Rattus norvegicus
gagccttgtagacggaggccaacta

SEQ ID NO: 342293 - DNA, 25 bp, Rattus norvegicus
gagccttgtagagggaggccaacta

SEQ ID NO: 342294 - DNA, 25 bp, Rattus norvegicus
gagccttgtatgagcaggtctgtct

SEQ ID NO: 342295 - DNA, 25 bp, Rattus norvegicus
gagccttgtatgtgcaggtctgtct

SEQ ID NO: 342296 - DNA, 25 bp, Rattus norvegicus
gagccttgtcacacgagtaaagcat

SEQ ID NO: 342297 - DNA, 25 bp, Rattus norvegicus
gagccttgtcactcgagtaaagcat

SEQ ID NO: 342298 - DNA, 25 bp, Rattus norvegicus
gagccttgtgatctcagttggccag

SEQ ID NO: 342299 - DNA, 25 bp, Rattus norvegicus
gagccttgtgatgtcagttggccag

SEQ ID NO: 342300 - DNA, 25 bp, Rattus norvegicus
gagccttgttctcactagtagtagg

SEQ ID NO: 342301 - DNA, 25 bp, Rattus norvegicus
gagccttgttctctggatgccacac

SEQ ID NO: 342302 - DNA, 25 bp, Rattus norvegicus
gagccttgttctgactagtagtagg

SEQ ID NO: 342303 - DNA, 25 bp, Rattus norvegicus
gagccttgttctgtggatgccacac

SEQ ID NO: 342304 - DNA, 25 bp, Rattus norvegicus
gagccttgttgtacacttgtctagt

SEQ ID NO: 342305 - DNA, 25 bp, Rattus norvegicus
gagccttgttgttcacttgtctagt

SEQ ID NO: 342306 - DNA, 25 bp, Rattus norvegicus
gagcctttaactagctttgaaatcc

SEQ ID NO: 342307 - DNA, 25 bp, Rattus norvegicus
gagcctttaacttgctttgaaatcc

SEQ ID NO: 342308 - DNA, 25 bp, Rattus norvegicus
gagcctttaaggaacacaggcccta

SEQ ID NO: 342309 - DNA, 25 bp, Rattus norvegicus
gagcctttaaggtacacaggcccta

SEQ ID NO: 342310 - DNA, 25 bp, Rattus norvegicus
gagcctttacatatctgtgtctaca

SEQ ID NO: 342311 - DNA, 25 bp, Rattus norvegicus
gagcctttacatttctgtgtctaca

SEQ ID NO: 342312 - DNA, 25 bp, Rattus norvegicus
gagcctttacttaccaaggaagtat

SEQ ID NO: 342313 - DNA, 25 bp, Rattus norvegicus
gagcctttactttccaaggaagtat

SEQ ID NO: 342314 - DNA, 25 bp, Rattus norvegicus
gagcctttagctaggattctgtgga

SEQ ID NO: 342315 - DNA, 25 bp, Rattus norvegicus
gagcctttagcttggattctgtgga

SEQ ID NO: 342316 - DNA, 25 bp, Rattus norvegicus
gagcctttagttactgtcaagctga

SEQ ID NO: 342317 - DNA, 25 bp, Rattus norvegicus
gagcctttagtttctgtcaagctga

SEQ ID NO: 342318 - DNA, 25 bp, Rattus norvegicus
gagcctttcacgacactacaagaat

SEQ ID NO: 342319 - DNA, 25 bp, Rattus norvegicus
gagcctttcacgtcactacaagaat

SEQ ID NO: 342320 - DNA, 25 bp, Rattus norvegicus
gagcctttcagaaacttcagagtag

SEQ ID NO: 342321 - DNA, 25 bp, Rattus norvegicus
gagcctttcagatacttcagagtag

SEQ ID NO: 342322 - DNA, 25 bp, Rattus norvegicus
gagcctttcagcactccctggaaga

SEQ ID NO: 342323 - DNA, 25 bp, Rattus norvegicus
gagcctttcagctctccctggaaga

SEQ ID NO: 342324 - DNA, 25 bp, Rattus norvegicus
gagcctttcagtagttttagtgata

SEQ ID NO: 342325 - DNA, 25 bp, Rattus norvegicus
gagcctttcagttgttttagtgata

SEQ ID NO: 342326 - DNA, 25 bp, Rattus norvegicus
gagcctttcataactgttttccttc

SEQ ID NO: 342327 - DNA, 25 bp, Rattus norvegicus
gagcctttcatatctgttttccttc

SEQ ID NO: 342328 - DNA, 25 bp, Rattus norvegicus
gagcctttcctgacctgagaagtct

SEQ ID NO: 342329 - DNA, 25 bp, Rattus norvegicus
gagcctttcctgtcctgagaagtct

SEQ ID NO: 342330 - DNA, 25 bp, Rattus norvegicus
gagcctttctagattcactaatggg

SEQ ID NO: 342331 - DNA, 25 bp, Rattus norvegicus
gagcctttctagtttcactaatggg

SEQ ID NO: 342332 - DNA, 25 bp, Rattus norvegicus
gagcctttctccattttagcactta

SEQ ID NO: 342333 - DNA, 25 bp, Rattus norvegicus
gagcctttctcctttttagcactta

SEQ ID NO: 342334 - DNA, 25 bp, Rattus norvegicus
gagcctttctgcaaactgactggat

SEQ ID NO: 342335 - DNA, 25 bp, Rattus norvegicus
gagcctttctgctaactgactggat

SEQ ID NO: 342336 - DNA, 25 bp, Rattus norvegicus
gagcctttctgtcttttacagccat

SEQ ID NO: 342337 - DNA, 25 bp, Rattus norvegicus
gagcctttctgtgttttacagccat

SEQ ID NO: 342338 - DNA, 25 bp, Rattus norvegicus
gagcctttcttaccagcacagttgg

SEQ ID NO: 342339 - DNA, 25 bp, Rattus norvegicus
gagcctttcttagcagcacagttgg

SEQ ID NO: 342340 - DNA, 25 bp, Rattus norvegicus
gagcctttgaaaagccagggtccct

SEQ ID NO: 342341 - DNA, 25 bp, Rattus norvegicus
gagcctttgaaatgccagggtccct

SEQ ID NO: 342342 - DNA, 25 bp, Rattus norvegicus
gagcctttgaccaccacggagtttt

SEQ ID NO: 342343 - DNA, 25 bp, Rattus norvegicus
gagcctttgacctccacggagtttt

SEQ ID NO: 342344 - DNA, 25 bp, Rattus norvegicus
gagcctttgcacctcttagtaacaa

SEQ ID NO: 342345 - DNA, 25 bp, Rattus norvegicus
gagcctttgcacgtcttagtaacaa

SEQ ID NO: 342346 - DNA, 25 bp, Rattus norvegicus
gagcctttgcctagcatatatgagg

SEQ ID NO: 342347 - DNA, 25 bp, Rattus norvegicus
gagcctttgccttgcatatatgagg

SEQ ID NO: 342348 - DNA, 25 bp, Rattus norvegicus
gagcctttgctcacttgtaacagaa

SEQ ID NO: 342349 - DNA, 25 bp, Rattus norvegicus
gagcctttgctctcttgtaacagaa

SEQ ID NO: 342350 - DNA, 25 bp, Rattus norvegicus
gagcctttgggaatctcatatgcaa

SEQ ID NO: 342351 - DNA, 25 bp, Rattus norvegicus
gagcctttgggattctcatatgcaa

SEQ ID NO: 342352 - DNA, 25 bp, Rattus norvegicus
gagcctttgggcatttgaacaatgt

SEQ ID NO: 342353 - DNA, 25 bp, Rattus norvegicus
gagcctttgggcttttgaacaatgt

SEQ ID NO: 342354 - DNA, 25 bp, Rattus norvegicus
gagccttttaagcacattccaagac

SEQ ID NO: 342355 - DNA, 25 bp, Rattus norvegicus
gagccttttaaggacattccaagac

SEQ ID NO: 342356 - DNA, 25 bp, Rattus norvegicus
gagccttttaggaccaattgttgag

SEQ ID NO: 342357 - DNA, 25 bp, Rattus norvegicus
gagccttttaggagtttgaactgtg

SEQ ID NO: 342358 - DNA, 25 bp, Rattus norvegicus
gagccttttaggtccaattgttgag

SEQ ID NO: 342359 - DNA, 25 bp, Rattus norvegicus
gagccttttaggtgtttgaactgtg

SEQ ID NO: 342360 - DNA, 25 bp, Rattus norvegicus
gagccttttatactccaggactgtc

SEQ ID NO: 342361 - DNA, 25 bp, Rattus norvegicus
gagccttttatagtccaggactgtc

SEQ ID NO: 342362 - DNA, 25 bp, Rattus norvegicus
gagccttttgctatacctaatttca

SEQ ID NO: 342363 - DNA, 25 bp, Rattus norvegicus
gagccttttgctttacctaatttca

SEQ ID NO: 342364 - DNA, 25 bp, Rattus norvegicus
gagcgaacttgacaagtccacagca

SEQ ID NO: 342365 - DNA, 25 bp, Rattus norvegicus
gagcgaacttgagaagtccacagca

SEQ ID NO: 342366 - DNA, 25 bp, Rattus norvegicus
gagcgaagacagaaccaaggatgat

SEQ ID NO: 342367 - DNA, 25 bp, Rattus norvegicus
gagcgaagacagtaccaaggatgat

SEQ ID NO: 342368 - DNA, 25 bp, Rattus norvegicus
gagcgaagacttctgactgcccagg

SEQ ID NO: 342369 - DNA, 25 bp, Rattus norvegicus
gagcgaagacttgtgactgcccagg

SEQ ID NO: 342370 - DNA, 25 bp, Rattus norvegicus
gagcgaagcctgcatactgtgagaa

SEQ ID NO: 342371 - DNA, 25 bp, Rattus norvegicus
gagcgaagcctggatactgtgagaa

SEQ ID NO: 342372 - DNA, 25 bp, Rattus norvegicus
gagcgaagtttcaaagactcttatt

SEQ ID NO: 342373 - DNA, 25 bp, Rattus norvegicus
gagcgaagtttctaagactcttatt

SEQ ID NO: 342374 - DNA, 25 bp, Rattus norvegicus
gagcgaattcccaacttgggtttca

SEQ ID NO: 342375 - DNA, 25 bp, Rattus norvegicus
gagcgaattccctacttgggtttca

SEQ ID NO: 342376 - DNA, 25 bp, Rattus norvegicus
gagcgacaggtaaggcgtggcggcc

SEQ ID NO: 342377 - DNA, 25 bp, Rattus norvegicus
gagcgacaggtatggcgtggcggcc

SEQ ID NO: 342378 - DNA, 25 bp, Rattus norvegicus
gagcgacatgcgattgatttgtaat

SEQ ID NO: 342379 - DNA, 25 bp, Rattus norvegicus
gagcgacatgcgtttgatttgtaat

SEQ ID NO: 342380 - DNA, 25 bp, Rattus norvegicus
gagcgaccactaattcttgaggaag

SEQ ID NO: 342381 - DNA, 25 bp, Rattus norvegicus
gagcgaccactatttcttgaggaag

SEQ ID NO: 342382 - DNA, 25 bp, Rattus norvegicus
gagcgaccatatctgtgcagcaact

SEQ ID NO: 342383 - DNA, 25 bp, Rattus norvegicus
gagcgaccatatgtgtgcagcaact

SEQ ID NO: 342384 - DNA, 25 bp, Rattus norvegicus
gagcgaccgtttccacgaacaccta

SEQ ID NO: 342385 - DNA, 25 bp, Rattus norvegicus
gagcgaccgtttgcacgaacaccta

SEQ ID NO: 342386 - DNA, 25 bp, Rattus norvegicus
gagcgacctatcagaaagcattttt

SEQ ID NO: 342387 - DNA, 25 bp, Rattus norvegicus
gagcgacctatctgaaagcattttt

SEQ ID NO: 342388 - DNA, 25 bp, Rattus norvegicus
gagcgaccttcactatgacgcatta

SEQ ID NO: 342389 - DNA, 25 bp, Rattus norvegicus
gagcgaccttcagtatgacgcatta

SEQ ID NO: 342390 - DNA, 25 bp, Rattus norvegicus
gagcgacgcctgcaagtacagcacg

SEQ ID NO: 342391 - DNA, 25 bp, Rattus norvegicus
gagcgacgcctggaagtacagcacg

SEQ ID NO: 342392 - DNA, 25 bp, Rattus norvegicus
gagcgacggataatggcgagcccca

SEQ ID NO: 342393 - DNA, 25 bp, Rattus norvegicus
gagcgacggatattggcgagcccca

SEQ ID NO: 342394 - DNA, 25 bp, Rattus norvegicus
gagcgactactaccgcattagcgag

SEQ ID NO: 342395 - DNA, 25 bp, Rattus norvegicus
gagcgactactagcgcattagcgag

SEQ ID NO: 342396 - DNA, 25 bp, Rattus norvegicus
gagcgactcatccatgagcgctgaa

SEQ ID NO: 342397 - DNA, 25 bp, Rattus norvegicus
gagcgactcatcgatgagcgctgaa

SEQ ID NO: 342398 - DNA, 25 bp, Rattus norvegicus
gagcgactccctactatgagcagta

SEQ ID NO: 342399 - DNA, 25 bp, Rattus norvegicus
gagcgactcccttctatgagcagta

SEQ ID NO: 342400 - DNA, 25 bp, Rattus norvegicus
gagcgactcgcgacatcggcagcag

SEQ ID NO: 342401 - DNA, 25 bp, Rattus norvegicus
gagcgactcgcgtcatcggcagcag

SEQ ID NO: 342402 - DNA, 25 bp, Rattus norvegicus
gagcgactctacaattccatgaaag

SEQ ID NO: 342403 - DNA, 25 bp, Rattus norvegicus
gagcgactctactattccatgaaag

SEQ ID NO: 342404 - DNA, 25 bp, Rattus norvegicus
gagcgactgaggctttctttagaaa

SEQ ID NO: 342405 - DNA, 25 bp, Rattus norvegicus
gagcgactgagggtttctttagaaa

SEQ ID NO: 342406 - DNA, 25 bp, Rattus norvegicus
gagcgacttacacagccaggcagaa

SEQ ID NO: 342407 - DNA, 25 bp, Rattus norvegicus
gagcgacttacagagccaggcagaa

SEQ ID NO: 342408 - DNA, 25 bp, Rattus norvegicus
gagcgacttgctctgtagtgacatg

SEQ ID NO: 342409 - DNA, 25 bp, Rattus norvegicus
gagcgacttgctgtgtagtgacatg

SEQ ID NO: 342410 - DNA, 25 bp, Rattus norvegicus
gagcgagaaaaacagtcttccccag

SEQ ID NO: 342411 - DNA, 25 bp, Rattus norvegicus
gagcgagaaaaagagtcttccccag

SEQ ID NO: 342412 - DNA, 25 bp, Rattus norvegicus
gagcgagaatttcgttccctatgtt

SEQ ID NO: 342413 - DNA, 25 bp, Rattus norvegicus
gagcgagaatttggttccctatgtt

SEQ ID NO: 342414 - DNA, 25 bp, Rattus norvegicus
gagcgagaccgacagggccctttcc

SEQ ID NO: 342415 - DNA, 25 bp, Rattus norvegicus
gagcgagaccgagagggccctttcc

SEQ ID NO: 342416 - DNA, 25 bp, Rattus norvegicus
gagcgagactccagtagacaccaat

SEQ ID NO: 342417 - DNA, 25 bp, Rattus norvegicus
gagcgagactcctgtagacaccaat

SEQ ID NO: 342418 - DNA, 25 bp, Rattus norvegicus
gagcgagagacccagacttttgaca

SEQ ID NO: 342419 - DNA, 25 bp, Rattus norvegicus
gagcgagagaccgagacttttgaca

SEQ ID NO: 342420 - DNA, 25 bp, Rattus norvegicus
gagcgagagcaaccgactgtctgaa

SEQ ID NO: 342421 - DNA, 25 bp, Rattus norvegicus
gagcgagagcaagcgactgtctgaa

SEQ ID NO: 342422 - DNA, 25 bp, Rattus norvegicus
gagcgagaggcaactctttgttaaa

SEQ ID NO: 342423 - DNA, 25 bp, Rattus norvegicus
gagcgagaggcatctctttgttaaa

SEQ ID NO: 342424 - DNA, 25 bp, Rattus norvegicus
gagcgagaggttacaatactatcat

SEQ ID NO: 342425 - DNA, 25 bp, Rattus norvegicus
gagcgagaggtttcaatactatcat

SEQ ID NO: 342426 - DNA, 25 bp, Rattus norvegicus
gagcgagattctagcttactctctg

SEQ ID NO: 342427 - DNA, 25 bp, Rattus norvegicus
gagcgagattcttgcttactctctg

SEQ ID NO: 342428 - DNA, 25 bp, Rattus norvegicus
gagcgagatttaactttctgggcct

SEQ ID NO: 342429 - DNA, 25 bp, Rattus norvegicus
gagcgagatttatctttctgggcct

SEQ ID NO: 342430 - DNA, 25 bp, Rattus norvegicus
gagcgagcaacactcctaacaggtg

SEQ ID NO: 342431 - DNA, 25 bp, Rattus norvegicus
gagcgagcaacagtcctaacaggtg

SEQ ID NO: 342432 - DNA, 25 bp, Rattus norvegicus
gagcgagcaccacagtccctagagg

SEQ ID NO: 342433 - DNA, 25 bp, Rattus norvegicus
gagcgagcaccagagtccctagagg

SEQ ID NO: 342434 - DNA, 25 bp, Rattus norvegicus
gagcgagcagcaaagcgttaacttc

SEQ ID NO: 342435 - DNA, 25 bp, Rattus norvegicus
gagcgagcagcatagcgttaacttc

SEQ ID NO: 342436 - DNA, 25 bp, Rattus norvegicus
gagcgagccaagacacatttccttg

SEQ ID NO: 342437 - DNA, 25 bp, Rattus norvegicus
gagcgagccaagtcacatttccttg

SEQ ID NO: 342438 - DNA, 25 bp, Rattus norvegicus
gagcgagccaatcccgtaaagaatt

SEQ ID NO: 342439 - DNA, 25 bp, Rattus norvegicus
gagcgagccaatgccgtaaagaatt

SEQ ID NO: 342440 - DNA, 25 bp, Rattus norvegicus
gagcgagctcatccattctgtgtga

SEQ ID NO: 342441 - DNA, 25 bp, Rattus norvegicus
gagcgagctcatgcattctgtgtga

SEQ ID NO: 342442 - DNA, 25 bp, Rattus norvegicus
gagcgagctcctatgcatccggcgt

SEQ ID NO: 342443 - DNA, 25 bp, Rattus norvegicus
gagcgagctcctttgcatccggcgt

SEQ ID NO: 342444 - DNA, 25 bp, Rattus norvegicus
gagcgagctcgaatgaaaactgtga

SEQ ID NO: 342445 - DNA, 25 bp, Rattus norvegicus
gagcgagctcgattgaaaactgtga

SEQ ID NO: 342446 - DNA, 25 bp, Rattus norvegicus
gagcgagctcttatagagggcctat

SEQ ID NO: 342447 - DNA, 25 bp, Rattus norvegicus
gagcgagctcttttagagggcctat

SEQ ID NO: 342448 - DNA, 25 bp, Rattus norvegicus
gagcgagctgcacagggcaccacaa

SEQ ID NO: 342449 - DNA, 25 bp, Rattus norvegicus
gagcgagctgcagagggcaccacaa

SEQ ID NO: 342450 - DNA, 25 bp, Rattus norvegicus
gagcgaggagttccctttccagcgc

SEQ ID NO: 342451 - DNA, 25 bp, Rattus norvegicus
gagcgaggagttgcctttccagcgc

SEQ ID NO: 342452 - DNA, 25 bp, Rattus norvegicus
gagcgaggatagacccaggcccaag

SEQ ID NO: 342453 - DNA, 25 bp, Rattus norvegicus
gagcgaggatagtcccaggcccaag

SEQ ID NO: 342454 - DNA, 25 bp, Rattus norvegicus
gagcgaggcctgcagacagccacca

SEQ ID NO: 342455 - DNA, 25 bp, Rattus norvegicus
gagcgaggcctggagacagccacca

SEQ ID NO: 342456 - DNA, 25 bp, Rattus norvegicus
gagcgaggctatctgccaaacagaa

SEQ ID NO: 342457 - DNA, 25 bp, Rattus norvegicus
gagcgaggctatgtgccaaacagaa

SEQ ID NO: 342458 - DNA, 25 bp, Rattus norvegicus
gagcgagggcagacatccttaaact

SEQ ID NO: 342459 - DNA, 25 bp, Rattus norvegicus
gagcgagggcagtcatccttaaact

SEQ ID NO: 342460 - DNA, 25 bp, Rattus norvegicus
gagcgagggtgtctcccttttctta

SEQ ID NO: 342461 - DNA, 25 bp, Rattus norvegicus
gagcgagggtgtgtcccttttctta

SEQ ID NO: 342462 - DNA, 25 bp, Rattus norvegicus
gagcgaggtctgatgtccttctcta

SEQ ID NO: 342463 - DNA, 25 bp, Rattus norvegicus
gagcgaggtctgattaccatggcca

SEQ ID NO: 342464 - DNA, 25 bp, Rattus norvegicus
gagcgaggtctgttgtccttctcta

SEQ ID NO: 342465 - DNA, 25 bp, Rattus norvegicus
gagcgaggtctgtttaccatggcca

SEQ ID NO: 342466 - DNA, 25 bp, Rattus norvegicus
gagcgagtgttcagctgagtcagat

SEQ ID NO: 342467 - DNA, 25 bp, Rattus norvegicus
gagcgagtgttcagctgtcactacc

SEQ ID NO: 342468 - DNA, 25 bp, Rattus norvegicus
gagcgagtgttcatgctttgggaaa

SEQ ID NO: 342469 - DNA, 25 bp, Rattus norvegicus
gagcgagtgttctgctgagtcagat

SEQ ID NO: 342470 - DNA, 25 bp, Rattus norvegicus
gagcgagtgttctgctgtcactacc

SEQ ID NO: 342471 - DNA, 25 bp, Rattus norvegicus
gagcgagtgttcttgctttgggaaa

SEQ ID NO: 342472 - DNA, 25 bp, Rattus norvegicus
gagcgagtttatcacatagccctgg

SEQ ID NO: 342473 - DNA, 25 bp, Rattus norvegicus
gagcgagtttatgacatagccctgg

SEQ ID NO: 342474 - DNA, 25 bp, Rattus norvegicus
gagcgatatgaaaacgttacaggtt

SEQ ID NO: 342475 - DNA, 25 bp, Rattus norvegicus
gagcgatatgaatacgttacaggtt

SEQ ID NO: 342476 - DNA, 25 bp, Rattus norvegicus
gagcgatcgctgattcaatgttaaa

SEQ ID NO: 342477 - DNA, 25 bp, Rattus norvegicus
gagcgatcgctgtttcaatgttaaa

SEQ ID NO: 342478 - DNA, 25 bp, Rattus norvegicus
gagcgatctggcagttctccatgga

SEQ ID NO: 342479 - DNA, 25 bp, Rattus norvegicus
gagcgatctggctgttctccatgga

SEQ ID NO: 342480 - DNA, 25 bp, Rattus norvegicus
gagcgatgcccaaaagacccactga

SEQ ID NO: 342481 - DNA, 25 bp, Rattus norvegicus
gagcgatgcccataagacccactga

SEQ ID NO: 342482 - DNA, 25 bp, Rattus norvegicus
gagcgatgcggcagaaactctcgga

SEQ ID NO: 342483 - DNA, 25 bp, Rattus norvegicus
gagcgatgcggctgaaactctcgga

SEQ ID NO: 342484 - DNA, 25 bp, Rattus norvegicus
gagcgatgctcaagattttcaaggt

SEQ ID NO: 342485 - DNA, 25 bp, Rattus norvegicus
gagcgatgctcatgattttcaaggt

SEQ ID NO: 342486 - DNA, 25 bp, Rattus norvegicus
gagcgatgggaaagtaccacgtact

SEQ ID NO: 342487 - DNA, 25 bp, Rattus norvegicus
gagcgatgggaatgtaccacgtact

SEQ ID NO: 342488 - DNA, 25 bp, Rattus norvegicus
gagcgatgttgactcagattctgaa

SEQ ID NO: 342489 - DNA, 25 bp, Rattus norvegicus
gagcgatgttgagtcagattctgaa

SEQ ID NO: 342490 - DNA, 25 bp, Rattus norvegicus
gagcgattactactggattgaccct

SEQ ID NO: 342491 - DNA, 25 bp, Rattus norvegicus
gagcgattactagtggattgaccct

SEQ ID NO: 342492 - DNA, 25 bp, Rattus norvegicus
gagcgattctcaaagttctctcaaa

SEQ ID NO: 342493 - DNA, 25 bp, Rattus norvegicus
gagcgattctcatagttctctcaaa

SEQ ID NO: 342494 - DNA, 25 bp, Rattus norvegicus
gagcgattgctgacctagctggcga

SEQ ID NO: 342495 - DNA, 25 bp, Rattus norvegicus
gagcgattgctgatttgagcttttg

SEQ ID NO: 342496 - DNA, 25 bp, Rattus norvegicus
gagcgattgctgtcctagctggcga

SEQ ID NO: 342497 - DNA, 25 bp, Rattus norvegicus
gagcgattgctgttttgagcttttg

SEQ ID NO: 342498 - DNA, 25 bp, Rattus norvegicus
gagcgattgtttctcgcgcacccaa

SEQ ID NO: 342499 - DNA, 25 bp, Rattus norvegicus
gagcgattgtttgtcgcgcacccaa

SEQ ID NO: 342500 - DNA, 25 bp, Rattus norvegicus
gagcgatttccaattcagtctttca

SEQ ID NO: 342501 - DNA, 25 bp, Rattus norvegicus
gagcgatttccatttcagtctttca

SEQ ID NO: 342502 - DNA, 25 bp, Rattus norvegicus
gagcgcaaacgtcagggcagccaca

SEQ ID NO: 342503 - DNA, 25 bp, Rattus norvegicus
gagcgcaaacgtgagggcagccaca

SEQ ID NO: 342504 - DNA, 25 bp, Rattus norvegicus
gagcgcaacactcaaagcacaaggt

SEQ ID NO: 342505 - DNA, 25 bp, Rattus norvegicus
gagcgcaacactgaaagcacaaggt

SEQ ID NO: 342506 - DNA, 25 bp, Rattus norvegicus
gagcgcaacagcactgtgcaatggc

SEQ ID NO: 342507 - DNA, 25 bp, Rattus norvegicus
gagcgcaacagctctgtgcaatggc

SEQ ID NO: 342508 - DNA, 25 bp, Rattus norvegicus
gagcgcaaccccaaagagttggtaa

SEQ ID NO: 342509 - DNA, 25 bp, Rattus norvegicus
gagcgcaacccctaagagttggtaa

SEQ ID NO: 342510 - DNA, 25 bp, Rattus norvegicus
gagcgcaaccggcagatgctgcatc

SEQ ID NO: 342511 - DNA, 25 bp, Rattus norvegicus
gagcgcaaccggctcaagttggtta

SEQ ID NO: 342512 - DNA, 25 bp, Rattus norvegicus
gagcgcaaccgggagatgctgcatc

SEQ ID NO: 342513 - DNA, 25 bp, Rattus norvegicus
gagcgcaaccgggtcaagttggtta

SEQ ID NO: 342514 - DNA, 25 bp, Rattus norvegicus
gagcgcaagatgatcattctctact

SEQ ID NO: 342515 - DNA, 25 bp, Rattus norvegicus
gagcgcaagatgttcattctctact

SEQ ID NO: 342516 - DNA, 25 bp, Rattus norvegicus
gagcgcaagcctacagacgaggagt

SEQ ID NO: 342517 - DNA, 25 bp, Rattus norvegicus
gagcgcaagccttcagacgaggagt

SEQ ID NO: 342518 - DNA, 25 bp, Rattus norvegicus
gagcgcaagttcaggctcttgaaag

SEQ ID NO: 342519 - DNA, 25 bp, Rattus norvegicus
gagcgcaagttctggctcttgaaag

SEQ ID NO: 342520 - DNA, 25 bp, Rattus norvegicus
gagcgcaagtttctccatcgggact

SEQ ID NO: 342521 - DNA, 25 bp, Rattus norvegicus
gagcgcaagtttgtccatcgggact

SEQ ID NO: 342522 - DNA, 25 bp, Rattus norvegicus
gagcgcaatgaaacatccaggccaa

SEQ ID NO: 342523 - DNA, 25 bp, Rattus norvegicus
gagcgcaatgaatcatccaggccaa

SEQ ID NO: 342524 - DNA, 25 bp, Rattus norvegicus
gagcgcacactgcatgtttatgttc

SEQ ID NO: 342525 - DNA, 25 bp, Rattus norvegicus
gagcgcacactggatgtttatgttc

SEQ ID NO: 342526 - DNA, 25 bp, Rattus norvegicus
gagcgcacagtccagagaactcctt

SEQ ID NO: 342527 - DNA, 25 bp, Rattus norvegicus
gagcgcacagtcgagagaactcctt

SEQ ID NO: 342528 - DNA, 25 bp, Rattus norvegicus
gagcgcacagtgcacgtcttcaatg

SEQ ID NO: 342529 - DNA, 25 bp, Rattus norvegicus
gagcgcacagtggacgtcttcaatg

SEQ ID NO: 342530 - DNA, 25 bp, Rattus norvegicus
gagcgcactcgcagttcctgcgaag

SEQ ID NO: 342531 - DNA, 25 bp, Rattus norvegicus
gagcgcactcgctgttcctgcgaag

SEQ ID NO: 342532 - DNA, 25 bp, Rattus norvegicus
gagcgcactgttccagaggcttcaa

SEQ ID NO: 342533 - DNA, 25 bp, Rattus norvegicus
gagcgcactgttgcagaggcttcaa

SEQ ID NO: 342534 - DNA, 25 bp, Rattus norvegicus
gagcgcacttctaagatgcagaccc

SEQ ID NO: 342535 - DNA, 25 bp, Rattus norvegicus
gagcgcacttcttagatgcagaccc

SEQ ID NO: 342536 - DNA, 25 bp, Rattus norvegicus
gagcgcagaagcaaagagccggaat

SEQ ID NO: 342537 - DNA, 25 bp, Rattus norvegicus
gagcgcagaagctaagagccggaat

SEQ ID NO: 342538 - DNA, 25 bp, Rattus norvegicus
gagcgcagaggaccgctgccattca

SEQ ID NO: 342539 - DNA, 25 bp, Rattus norvegicus
gagcgcagaggagcgctgccattca

SEQ ID NO: 342540 - DNA, 25 bp, Rattus norvegicus
gagcgcagcagaacgcgcagctcta

SEQ ID NO: 342541 - DNA, 25 bp, Rattus norvegicus
gagcgcagcagatcgcgcagctcta

SEQ ID NO: 342542 - DNA, 25 bp, Rattus norvegicus
gagcgcagcgggattggtccacact

SEQ ID NO: 342543 - DNA, 25 bp, Rattus norvegicus
gagcgcagcgggtttggtccacact

SEQ ID NO: 342544 - DNA, 25 bp, Rattus norvegicus
gagcgcaggtgcagagttcatcctc

SEQ ID NO: 342545 - DNA, 25 bp, Rattus norvegicus
gagcgcaggtgctgagttcatcctc

SEQ ID NO: 342546 - DNA, 25 bp, Rattus norvegicus
gagcgcataggtcaatgttctcaaa

SEQ ID NO: 342547 - DNA, 25 bp, Rattus norvegicus
gagcgcataggtgaatgttctcaaa

SEQ ID NO: 342548 - DNA, 25 bp, Rattus norvegicus
gagcgcatccagcacacttgtcaga

SEQ ID NO: 342549 - DNA, 25 bp, Rattus norvegicus
gagcgcatccaggacacttgtcaga

SEQ ID NO: 342550 - DNA, 25 bp, Rattus norvegicus
gagcgcatctgtcgacttggctgca

SEQ ID NO: 342551 - DNA, 25 bp, Rattus norvegicus
gagcgcatctgtggacttggctgca

SEQ ID NO: 342552 - DNA, 25 bp, Rattus norvegicus
gagcgcatgaaacgacctcacttct

SEQ ID NO: 342553 - DNA, 25 bp, Rattus norvegicus
gagcgcatgaaaggacctcacttct

SEQ ID NO: 342554 - DNA, 25 bp, Rattus norvegicus
gagcgcatgcagagtttcccaaggc

SEQ ID NO: 342555 - DNA, 25 bp, Rattus norvegicus
gagcgcatgcagtgtttcccaaggc

SEQ ID NO: 342556 - DNA, 25 bp, Rattus norvegicus
gagcgccaattcatttcaagttcaa

SEQ ID NO: 342557 - DNA, 25 bp, Rattus norvegicus
gagcgccaattcttttcaagttcaa

SEQ ID NO: 342558 - DNA, 25 bp, Rattus norvegicus
gagcgccacccacgtagtttcaaat

SEQ ID NO: 342559 - DNA, 25 bp, Rattus norvegicus
gagcgccacccaggtagtttcaaat

SEQ ID NO: 342560 - DNA, 25 bp, Rattus norvegicus
gagcgccagtgcacagcagtgatga

SEQ ID NO: 342561 - DNA, 25 bp, Rattus norvegicus
gagcgccagtgctcagcagtgatga

SEQ ID NO: 342562 - DNA, 25 bp, Rattus norvegicus
gagcgccatggacttctccaagttc

SEQ ID NO: 342563 - DNA, 25 bp, Rattus norvegicus
gagcgccatggagttctccaagttc

SEQ ID NO: 342564 - DNA, 25 bp, Rattus norvegicus
gagcgcccaaaccatcacgtctgaa

SEQ ID NO: 342565 - DNA, 25 bp, Rattus norvegicus
gagcgcccaaacgatcacgtctgaa

SEQ ID NO: 342566 - DNA, 25 bp, Rattus norvegicus
gagcgcccacaactgaactgatact

SEQ ID NO: 342567 - DNA, 25 bp, Rattus norvegicus
gagcgcccacaagtgaactgatact

SEQ ID NO: 342568 - DNA, 25 bp, Rattus norvegicus
gagcgcccctgcatcaagggataag

SEQ ID NO: 342569 - DNA, 25 bp, Rattus norvegicus
gagcgcccctgcttcaagggataag

SEQ ID NO: 342570 - DNA, 25 bp, Rattus norvegicus
gagcgcccgtgtacctggcggcggt

SEQ ID NO: 342571 - DNA, 25 bp, Rattus norvegicus
gagcgcccgtgttcctggcggcggt

SEQ ID NO: 342572 - DNA, 25 bp, Rattus norvegicus
gagcgccgacagcataggcatccat

SEQ ID NO: 342573 - DNA, 25 bp, Rattus norvegicus
gagcgccgacaggataggcatccat

SEQ ID NO: 342574 - DNA, 25 bp, Rattus norvegicus
gagcgccgcaccaccacgaggagaa

SEQ ID NO: 342575 - DNA, 25 bp, Rattus norvegicus
gagcgccgcacctccacgaggagaa

SEQ ID NO: 342576 - DNA, 25 bp, Rattus norvegicus
gagcgccgcgtgatcatcgtgatct

SEQ ID NO: 342577 - DNA, 25 bp, Rattus norvegicus
gagcgccgcgtgttcatcgtgatct

SEQ ID NO: 342578 - DNA, 25 bp, Rattus norvegicus
gagcgccgcttacaaacagcagttt

SEQ ID NO: 342579 - DNA, 25 bp, Rattus norvegicus
gagcgccgcttagaaacagcagttt

SEQ ID NO: 342580 - DNA, 25 bp, Rattus norvegicus
gagcgcctagctcggccgcagggag

SEQ ID NO: 342581 - DNA, 25 bp, Rattus norvegicus
gagcgcctagctgggccgcagggag

SEQ ID NO: 342582 - DNA, 25 bp, Rattus norvegicus
gagcgcctatctcattcagaatatt

SEQ ID NO: 342583 - DNA, 25 bp, Rattus norvegicus
gagcgcctatctgattcagaatatt

SEQ ID NO: 342584 - DNA, 25 bp, Rattus norvegicus
gagcgcctgcacagctggattttga

SEQ ID NO: 342585 - DNA, 25 bp, Rattus norvegicus
gagcgcctgcactgctggattttga

SEQ ID NO: 342586 - DNA, 25 bp, Rattus norvegicus
gagcgcctgctgattgccaggcaaa

SEQ ID NO: 342587 - DNA, 25 bp, Rattus norvegicus
gagcgcctgctgtttgccaggcaaa

SEQ ID NO: 342588 - DNA, 25 bp, Rattus norvegicus
gagcgcctggaaccggtactttgtt

SEQ ID NO: 342589 - DNA, 25 bp, Rattus norvegicus
gagcgcctggaagcggtactttgtt

SEQ ID NO: 342590 - DNA, 25 bp, Rattus norvegicus
gagcgcctggacatcttgagagact

SEQ ID NO: 342591 - DNA, 25 bp, Rattus norvegicus
gagcgcctggacttcttgagagact

SEQ ID NO: 342592 - DNA, 25 bp, Rattus norvegicus
gagcgcctgggcagaaatgcacctt

SEQ ID NO: 342593 - DNA, 25 bp, Rattus norvegicus
gagcgcctgggctgaaatgcacctt

SEQ ID NO: 342594 - DNA, 25 bp, Rattus norvegicus
gagcgccttcggattgctttaagtt

SEQ ID NO: 342595 - DNA, 25 bp, Rattus norvegicus
gagcgccttcggtttgctttaagtt

SEQ ID NO: 342596 - DNA, 25 bp, Rattus norvegicus
gagcgcgaaggcaagcatcgcccaa

SEQ ID NO: 342597 - DNA, 25 bp, Rattus norvegicus
gagcgcgaaggctagcatcgcccaa

SEQ ID NO: 342598 - DNA, 25 bp, Rattus norvegicus
gagcgcgaccctcatgagttaagat

SEQ ID NO: 342599 - DNA, 25 bp, Rattus norvegicus
gagcgcgaccctgatgagttaagat

SEQ ID NO: 342600 - DNA, 25 bp, Rattus norvegicus
gagcgcgactacaccgagcatccta

SEQ ID NO: 342601 - DNA, 25 bp, Rattus norvegicus
gagcgcgactactccgagcatccta

SEQ ID NO: 342602 - DNA, 25 bp, Rattus norvegicus
gagcgcgactatcgcctgcggcctt

SEQ ID NO: 342603 - DNA, 25 bp, Rattus norvegicus
gagcgcgactatggcctgcggcctt

SEQ ID NO: 342604 - DNA, 25 bp, Rattus norvegicus
gagcgcgatgttatctagcaggtca

SEQ ID NO: 342605 - DNA, 25 bp, Rattus norvegicus
gagcgcgatgttttctagcaggtca

SEQ ID NO: 342606 - DNA, 25 bp, Rattus norvegicus
gagcgcgcagcgaccaagggcaaca

SEQ ID NO: 342607 - DNA, 25 bp, Rattus norvegicus
gagcgcgcagcgtccaagggcaaca

SEQ ID NO: 342608 - DNA, 25 bp, Rattus norvegicus
gagcgcgcgcgcatagggcacatac

SEQ ID NO: 342609 - DNA, 25 bp, Rattus norvegicus
gagcgcgcgcgcttagggcacatac

SEQ ID NO: 342610 - DNA, 25 bp, Rattus norvegicus
gagcgcgcggacactggcacttcta

SEQ ID NO: 342611 - DNA, 25 bp, Rattus norvegicus
gagcgcgcggactctggcacttcta

SEQ ID NO: 342612 - DNA, 25 bp, Rattus norvegicus
gagcgcgcttagagacagggccaca

SEQ ID NO: 342613 - DNA, 25 bp, Rattus norvegicus
gagcgcgcttagtgacagggccaca

SEQ ID NO: 342614 - DNA, 25 bp, Rattus norvegicus
gagcgcggcagtctattcgagtacc

SEQ ID NO: 342615 - DNA, 25 bp, Rattus norvegicus
gagcgcggcagtgtattcgagtacc

SEQ ID NO: 342616 - DNA, 25 bp, Rattus norvegicus
gagcgcgtcacgacccaagatggct

SEQ ID NO: 342617 - DNA, 25 bp, Rattus norvegicus
gagcgcgtcacgtcccaagatggct

SEQ ID NO: 342618 - DNA, 25 bp, Rattus norvegicus
gagcgcgttcgaagccatccggatt

SEQ ID NO: 342619 - DNA, 25 bp, Rattus norvegicus
gagcgcgttcgatgccatccggatt

SEQ ID NO: 342620 - DNA, 25 bp, Rattus norvegicus
gagcgcgtttcaaacgagcgttcct

SEQ ID NO: 342621 - DNA, 25 bp, Rattus norvegicus
gagcgcgtttcatacgagcgttcct

SEQ ID NO: 342622 - DNA, 25 bp, Rattus norvegicus
gagcgctacacaactgtggcttttg

SEQ ID NO: 342623 - DNA, 25 bp, Rattus norvegicus
gagcgctacacatctgtggcttttg

SEQ ID NO: 342624 - DNA, 25 bp, Rattus norvegicus
gagcgctacattagcactggaagaa

SEQ ID NO: 342625 - DNA, 25 bp, Rattus norvegicus
gagcgctacatttgcactggaagaa

SEQ ID NO: 342626 - DNA, 25 bp, Rattus norvegicus
gagcgctaggcaagcctccaaggga

SEQ ID NO: 342627 - DNA, 25 bp, Rattus norvegicus
gagcgctaggcatgcctccaaggga

SEQ ID NO: 342628 - DNA, 25 bp, Rattus norvegicus
gagcgctcagcacactgtaagcact

SEQ ID NO: 342629 - DNA, 25 bp, Rattus norvegicus
gagcgctcagcagactgtaagcact

SEQ ID NO: 342630 - DNA, 25 bp, Rattus norvegicus
gagcgctcgcggaatatgctataca

SEQ ID NO: 342631 - DNA, 25 bp, Rattus norvegicus
gagcgctcgcggtatatgctataca

SEQ ID NO: 342632 - DNA, 25 bp, Rattus norvegicus
gagcgctcgcttaggaacttggcaa

SEQ ID NO: 342633 - DNA, 25 bp, Rattus norvegicus
gagcgctcgctttggaacttggcaa

SEQ ID NO: 342634 - DNA, 25 bp, Rattus norvegicus
gagcgctcgtggctaagccagcact

SEQ ID NO: 342635 - DNA, 25 bp, Rattus norvegicus
gagcgctcgtgggtaagccagcact

SEQ ID NO: 342636 - DNA, 25 bp, Rattus norvegicus
gagcgctctcgtcatttatactttc

SEQ ID NO: 342637 - DNA, 25 bp, Rattus norvegicus
gagcgctctcgtgatttatactttc

SEQ ID NO: 342638 - DNA, 25 bp, Rattus norvegicus
gagcgctctgtaaatgacgtctgat

SEQ ID NO: 342639 - DNA, 25 bp, Rattus norvegicus
gagcgctctgtatatgacgtctgat

SEQ ID NO: 342640 - DNA, 25 bp, Rattus norvegicus
gagcgctctgtgaccactggaaaga

SEQ ID NO: 342641 - DNA, 25 bp, Rattus norvegicus
gagcgctctgtgtccactggaaaga

SEQ ID NO: 342642 - DNA, 25 bp, Rattus norvegicus
gagcgctcttatcagcacatcatga

SEQ ID NO: 342643 - DNA, 25 bp, Rattus norvegicus
gagcgctcttatgagcacatcatga

SEQ ID NO: 342644 - DNA, 25 bp, Rattus norvegicus
gagcgctgatctaggtgttaaaccc

SEQ ID NO: 342645 - DNA, 25 bp, Rattus norvegicus
gagcgctgatcttggtgttaaaccc

SEQ ID NO: 342646 - DNA, 25 bp, Rattus norvegicus
gagcgctgattactcttcaagagaa

SEQ ID NO: 342647 - DNA, 25 bp, Rattus norvegicus
gagcgctgattagtcttcaagagaa

SEQ ID NO: 342648 - DNA, 25 bp, Rattus norvegicus
gagcgctgcgtcaccaaaacaagag

SEQ ID NO: 342649 - DNA, 25 bp, Rattus norvegicus
gagcgctgcgtctccaaaacaagag

SEQ ID NO: 342650 - DNA, 25 bp, Rattus norvegicus
gagcgctgctccatggtggcatcaa

SEQ ID NO: 342651 - DNA, 25 bp, Rattus norvegicus
gagcgctgctccttggtggcatcaa

SEQ ID NO: 342652 - DNA, 25 bp, Rattus norvegicus
gagcgctgctttcaaaactccttca

SEQ ID NO: 342653 - DNA, 25 bp, Rattus norvegicus
gagcgctgctttgaaaactccttca

SEQ ID NO: 342654 - DNA, 25 bp, Rattus norvegicus
gagcgctgtctgaatcccagaaacg

SEQ ID NO: 342655 - DNA, 25 bp, Rattus norvegicus
gagcgctgtctgtatcccagaaacg

SEQ ID NO: 342656 - DNA, 25 bp, Rattus norvegicus
gagcgcttagaaacagcctccagat

SEQ ID NO: 342657 - DNA, 25 bp, Rattus norvegicus
gagcgcttagaaatcgctttcatga

SEQ ID NO: 342658 - DNA, 25 bp, Rattus norvegicus
gagcgcttagaatcagcctccagat

SEQ ID NO: 342659 - DNA, 25 bp, Rattus norvegicus
gagcgcttagaattcgctttcatga

SEQ ID NO: 342660 - DNA, 25 bp, Rattus norvegicus
gagcgcttcccacatgagaacttca

SEQ ID NO: 342661 - DNA, 25 bp, Rattus norvegicus
gagcgcttcccagatgagaacttca

SEQ ID NO: 342662 - DNA, 25 bp, Rattus norvegicus
gagcgcttctttataacagtaccct

SEQ ID NO: 342663 - DNA, 25 bp, Rattus norvegicus
gagcgcttctttttaacagtaccct

SEQ ID NO: 342664 - DNA, 25 bp, Rattus norvegicus
gagcgcttggaacacacggctgcaa

SEQ ID NO: 342665 - DNA, 25 bp, Rattus norvegicus
gagcgcttggaagacacggctgcaa

SEQ ID NO: 342666 - DNA, 25 bp, Rattus norvegicus
gagcgcttggccaagttggcactga

SEQ ID NO: 342667 - DNA, 25 bp, Rattus norvegicus
gagcgcttggcctagttggcactga

SEQ ID NO: 342668 - DNA, 25 bp, Rattus norvegicus
gagcgctttctcataggaactgtgg

SEQ ID NO: 342669 - DNA, 25 bp, Rattus norvegicus
gagcgctttctcttaggaactgtgg

SEQ ID NO: 342670 - DNA, 25 bp, Rattus norvegicus
gagcggaaattcaaaagatgagact

SEQ ID NO: 342671 - DNA, 25 bp, Rattus norvegicus
gagcggaaattctaaagatgagact

SEQ ID NO: 342672 - DNA, 25 bp, Rattus norvegicus
gagcggaactatcggttacggaaca

SEQ ID NO: 342673 - DNA, 25 bp, Rattus norvegicus
gagcggaactatgggttacggaaca

SEQ ID NO: 342674 - DNA, 25 bp, Rattus norvegicus
gagcggaagctaaagcccaacccaa

SEQ ID NO: 342675 - DNA, 25 bp, Rattus norvegicus
gagcggaagctatagcccaacccaa

SEQ ID NO: 342676 - DNA, 25 bp, Rattus norvegicus
gagcggacaagtaccactctgtttg

SEQ ID NO: 342677 - DNA, 25 bp, Rattus norvegicus
gagcggacaagttccactctgtttg

SEQ ID NO: 342678 - DNA, 25 bp, Rattus norvegicus
gagcggacatgcagcgcagctacga

SEQ ID NO: 342679 - DNA, 25 bp, Rattus norvegicus
gagcggacatgctgcgcagctacga

SEQ ID NO: 342680 - DNA, 25 bp, Rattus norvegicus
gagcggacctcaactacagtatttc

SEQ ID NO: 342681 - DNA, 25 bp, Rattus norvegicus
gagcggacctcaacttcacacttgc

SEQ ID NO: 342682 - DNA, 25 bp, Rattus norvegicus
gagcggacctcatctacagtatttc

SEQ ID NO: 342683 - DNA, 25 bp, Rattus norvegicus
gagcggacctcatcttcacacttgc

SEQ ID NO: 342684 - DNA, 25 bp, Rattus norvegicus
gagcggactcacaagacacctctta

SEQ ID NO: 342685 - DNA, 25 bp, Rattus norvegicus
gagcggactcactagacacctctta

SEQ ID NO: 342686 - DNA, 25 bp, Rattus norvegicus
gagcggactgctaatactaatgcgt

SEQ ID NO: 342687 - DNA, 25 bp, Rattus norvegicus
gagcggactgcttatactaatgcgt

SEQ ID NO: 342688 - DNA, 25 bp, Rattus norvegicus
gagcggagagcacccatctatgaca

SEQ ID NO: 342689 - DNA, 25 bp, Rattus norvegicus
gagcggagagcagccatctatgaca

SEQ ID NO: 342690 - DNA, 25 bp, Rattus norvegicus
gagcggagaggcacccgggccactg

SEQ ID NO: 342691 - DNA, 25 bp, Rattus norvegicus
gagcggagaggctcccgggccactg

SEQ ID NO: 342692 - DNA, 25 bp, Rattus norvegicus
gagcggagatgcatggcccctctac

SEQ ID NO: 342693 - DNA, 25 bp, Rattus norvegicus
gagcggagatgcttggcccctctac

SEQ ID NO: 342694 - DNA, 25 bp, Rattus norvegicus
gagcggagcactagttacgggacat

SEQ ID NO: 342695 - DNA, 25 bp, Rattus norvegicus
gagcggagcacttgttacgggacat

SEQ ID NO: 342696 - DNA, 25 bp, Rattus norvegicus
gagcggagcagcagcacttgcactg

SEQ ID NO: 342697 - DNA, 25 bp, Rattus norvegicus
gagcggagcagctgcacttgcactg

SEQ ID NO: 342698 - DNA, 25 bp, Rattus norvegicus
gagcggatacttaagaatggtaccc

SEQ ID NO: 342699 - DNA, 25 bp, Rattus norvegicus
gagcggatactttagaatggtaccc

SEQ ID NO: 342700 - DNA, 25 bp, Rattus norvegicus
gagcggatctcacggtgtcatcagt

SEQ ID NO: 342701 - DNA, 25 bp, Rattus norvegicus
gagcggatctcagggtgtcatcagt

SEQ ID NO: 342702 - DNA, 25 bp, Rattus norvegicus
gagcggatgatgacagccacgatct

SEQ ID NO: 342703 - DNA, 25 bp, Rattus norvegicus
gagcggatgatgtcagccacgatct

SEQ ID NO: 342704 - DNA, 25 bp, Rattus norvegicus
gagcggatgctcacagaacgaatgt

SEQ ID NO: 342705 - DNA, 25 bp, Rattus norvegicus
gagcggatgctctcagaacgaatgt

SEQ ID NO: 342706 - DNA, 25 bp, Rattus norvegicus
gagcggattatcctgactagggaca

SEQ ID NO: 342707 - DNA, 25 bp, Rattus norvegicus
gagcggattatcgtgactagggaca

SEQ ID NO: 342708 - DNA, 25 bp, Rattus norvegicus
gagcggattgctcgcccagagacca

SEQ ID NO: 342709 - DNA, 25 bp, Rattus norvegicus
gagcggattgctggcccagagacca

SEQ ID NO: 342710 - DNA, 25 bp, Rattus norvegicus
gagcggcacagacaacgacggcaca

SEQ ID NO: 342711 - DNA, 25 bp, Rattus norvegicus
gagcggcacagagaacgacggcaca

SEQ ID NO: 342712 - DNA, 25 bp, Rattus norvegicus
gagcggcaccctcacaaatggaaag

SEQ ID NO: 342713 - DNA, 25 bp, Rattus norvegicus
gagcggcaccctgacaaatggaaag

SEQ ID NO: 342714 - DNA, 25 bp, Rattus norvegicus
gagcggcacggcagtttgccatcac

SEQ ID NO: 342715 - DNA, 25 bp, Rattus norvegicus
gagcggcacggctgtttgccatcac

SEQ ID NO: 342716 - DNA, 25 bp, Rattus norvegicus
gagcggcactataaggaagtgtcat

SEQ ID NO: 342717 - DNA, 25 bp, Rattus norvegicus
gagcggcactattaggaagtgtcat

SEQ ID NO: 342718 - DNA, 25 bp, Rattus norvegicus
gagcggcagcaactatgcttacttg

SEQ ID NO: 342719 - DNA, 25 bp, Rattus norvegicus
gagcggcagcaagtatgcttacttg

SEQ ID NO: 342720 - DNA, 25 bp, Rattus norvegicus
gagcggcagcagatacatggaacca

SEQ ID NO: 342721 - DNA, 25 bp, Rattus norvegicus
gagcggcagcagttacatggaacca

SEQ ID NO: 342722 - DNA, 25 bp, Rattus norvegicus
gagcggcaggtaacatcttagtgac

SEQ ID NO: 342723 - DNA, 25 bp, Rattus norvegicus
gagcggcaggtatcatcttagtgac

SEQ ID NO: 342724 - DNA, 25 bp, Rattus norvegicus
gagcggcataagcaccctccaaagg

SEQ ID NO: 342725 - DNA, 25 bp, Rattus norvegicus
gagcggcataaggaccctccaaagg

SEQ ID NO: 342726 - DNA, 25 bp, Rattus norvegicus
gagcggcatccgaaggcatcagagt

SEQ ID NO: 342727 - DNA, 25 bp, Rattus norvegicus
gagcggcatccgtaggcatcagagt

SEQ ID NO: 342728 - DNA, 25 bp, Rattus norvegicus
gagcggccatacagcgagacttaat

SEQ ID NO: 342729 - DNA, 25 bp, Rattus norvegicus
gagcggccatactgcgagacttaat

SEQ ID NO: 342730 - DNA, 25 bp, Rattus norvegicus
gagcggccatatcagtgtgcccagt

SEQ ID NO: 342731 - DNA, 25 bp, Rattus norvegicus
gagcggccatatgagtgtgcccagt

SEQ ID NO: 342732 - DNA, 25 bp, Rattus norvegicus
gagcggccatgacgttgttcttcat

SEQ ID NO: 342733 - DNA, 25 bp, Rattus norvegicus
gagcggccatgaggttgttcttcat

SEQ ID NO: 342734 - DNA, 25 bp, Rattus norvegicus
gagcggccgttgcactggctttctc

SEQ ID NO: 342735 - DNA, 25 bp, Rattus norvegicus
gagcggccgttggactggctttctc

SEQ ID NO: 342736 - DNA, 25 bp, Rattus norvegicus
gagcggcctcatctcatgtatggac

SEQ ID NO: 342737 - DNA, 25 bp, Rattus norvegicus
gagcggcctcatgtcatgtatggac

SEQ ID NO: 342738 - DNA, 25 bp, Rattus norvegicus
gagcggcctgcaagattcacaagag

SEQ ID NO: 342739 - DNA, 25 bp, Rattus norvegicus
gagcggcctgcatgattcacaagag

SEQ ID NO: 342740 - DNA, 25 bp, Rattus norvegicus
gagcggccttacaagtgcgagctgt

SEQ ID NO: 342741 - DNA, 25 bp, Rattus norvegicus
gagcggccttactagtgcgagctgt

SEQ ID NO: 342742 - DNA, 25 bp, Rattus norvegicus
gagcggcgaactcttatacctgaga

SEQ ID NO: 342743 - DNA, 25 bp, Rattus norvegicus
gagcggcgaactgttatacctgaga

SEQ ID NO: 342744 - DNA, 25 bp, Rattus norvegicus
gagcggcgcaggactcagagcatca

SEQ ID NO: 342745 - DNA, 25 bp, Rattus norvegicus
gagcggcgcaggtctcagagcatca

SEQ ID NO: 342746 - DNA, 25 bp, Rattus norvegicus
gagcggcggagccaatactatgatt

SEQ ID NO: 342747 - DNA, 25 bp, Rattus norvegicus
gagcggcggagcgaatactatgatt

SEQ ID NO: 342748 - DNA, 25 bp, Rattus norvegicus
gagcggcggcatcaagaaatgctac

SEQ ID NO: 342749 - DNA, 25 bp, Rattus norvegicus
gagcggcggcatgaagaaatgctac

SEQ ID NO: 342750 - DNA, 25 bp, Rattus norvegicus
gagcggctaaaacctatgctcgctg

SEQ ID NO: 342751 - DNA, 25 bp, Rattus norvegicus
gagcggctaaaagctatgctcgctg

SEQ ID NO: 342752 - DNA, 25 bp, Rattus norvegicus
gagcggctgtggaaatcttgcatat

SEQ ID NO: 342753 - DNA, 25 bp, Rattus norvegicus
gagcggctgtggtaatcttgcatat

SEQ ID NO: 342754 - DNA, 25 bp, Rattus norvegicus
gagcggcttaaacatgactgtccca

SEQ ID NO: 342755 - DNA, 25 bp, Rattus norvegicus
gagcggcttaaagatgactgtccca

SEQ ID NO: 342756 - DNA, 25 bp, Rattus norvegicus
gagcggcttcggcagttattacaag

SEQ ID NO: 342757 - DNA, 25 bp, Rattus norvegicus
gagcggcttcgggagttattacaag

SEQ ID NO: 342758 - DNA, 25 bp, Rattus norvegicus
gagcggcttgttcaatggattaaga

SEQ ID NO: 342759 - DNA, 25 bp, Rattus norvegicus
gagcggcttgttgaatggattaaga

SEQ ID NO: 342760 - DNA, 25 bp, Rattus norvegicus
gagcgggaagcccagaaccggtggc

SEQ ID NO: 342761 - DNA, 25 bp, Rattus norvegicus
gagcgggaagccgagaaccggtggc

SEQ ID NO: 342762 - DNA, 25 bp, Rattus norvegicus
gagcgggaatagcacctctgagatt

SEQ ID NO: 342763 - DNA, 25 bp, Rattus norvegicus
gagcgggaataggacctctgagatt

SEQ ID NO: 342764 - DNA, 25 bp, Rattus norvegicus
gagcgggagacaaggctcccctctt

SEQ ID NO: 342765 - DNA, 25 bp, Rattus norvegicus
gagcgggagacatggctcccctctt

SEQ ID NO: 342766 - DNA, 25 bp, Rattus norvegicus
gagcgggagcacatcctaatagatc

SEQ ID NO: 342767 - DNA, 25 bp, Rattus norvegicus
gagcgggagcacttcctaatagatc

SEQ ID NO: 342768 - DNA, 25 bp, Rattus norvegicus
gagcgggaggccaacctcagccaat

SEQ ID NO: 342769 - DNA, 25 bp, Rattus norvegicus
gagcgggaggccactgaacctgaca

SEQ ID NO: 342770 - DNA, 25 bp, Rattus norvegicus
gagcgggaggcctacctcagccaat

SEQ ID NO: 342771 - DNA, 25 bp, Rattus norvegicus
gagcgggaggcctctgaacctgaca

SEQ ID NO: 342772 - DNA, 25 bp, Rattus norvegicus
gagcgggagtgcaccatggaccttt

SEQ ID NO: 342773 - DNA, 25 bp, Rattus norvegicus
gagcgggagtgctccatggaccttt

SEQ ID NO: 342774 - DNA, 25 bp, Rattus norvegicus
gagcgggcacggagagaattcatta

SEQ ID NO: 342775 - DNA, 25 bp, Rattus norvegicus
gagcgggcacggtgagaattcatta

SEQ ID NO: 342776 - DNA, 25 bp, Rattus norvegicus
gagcgggcactacacgaactgtttg

SEQ ID NO: 342777 - DNA, 25 bp, Rattus norvegicus
gagcgggcactagacgaactgtttg

SEQ ID NO: 342778 - DNA, 25 bp, Rattus norvegicus
gagcgggcatttaagcactgcgcag

SEQ ID NO: 342779 - DNA, 25 bp, Rattus norvegicus
gagcgggcattttagcactgcgcag

SEQ ID NO: 342780 - DNA, 25 bp, Rattus norvegicus
gagcgggccctgagtatatgaccca

SEQ ID NO: 342781 - DNA, 25 bp, Rattus norvegicus
gagcgggccctgtgtatatgaccca

SEQ ID NO: 342782 - DNA, 25 bp, Rattus norvegicus
gagcgggtgattaagagaccgcctt

SEQ ID NO: 342783 - DNA, 25 bp, Rattus norvegicus
gagcgggtgatttagagaccgcctt

SEQ ID NO: 342784 - DNA, 25 bp, Rattus norvegicus
gagcgggtgtgcaacccgatcatca

SEQ ID NO: 342785 - DNA, 25 bp, Rattus norvegicus
gagcgggtgtgctacccgatcatca

SEQ ID NO: 342786 - DNA, 25 bp, Rattus norvegicus
gagcggtacaacctgcccacaggag

SEQ ID NO: 342787 - DNA, 25 bp, Rattus norvegicus
gagcggtacaacgtgcccacaggag

SEQ ID NO: 342788 - DNA, 25 bp, Rattus norvegicus
gagcggtacactaggattgtgctgt

SEQ ID NO: 342789 - DNA, 25 bp, Rattus norvegicus
gagcggtacacttggattgtgctgt

SEQ ID NO: 342790 - DNA, 25 bp, Rattus norvegicus
gagcggtagcctagagagcccctag

SEQ ID NO: 342791 - DNA, 25 bp, Rattus norvegicus
gagcggtagccttgagagcccctag

SEQ ID NO: 342792 - DNA, 25 bp, Rattus norvegicus
gagcggtcctagagtgcagatgcca

SEQ ID NO: 342793 - DNA, 25 bp, Rattus norvegicus
gagcggtcctagtgtgcagatgcca

SEQ ID NO: 342794 - DNA, 25 bp, Rattus norvegicus
gagcggtcctcacagaacgggtccc

SEQ ID NO: 342795 - DNA, 25 bp, Rattus norvegicus
gagcggtcctcagagaacgggtccc

SEQ ID NO: 342796 - DNA, 25 bp, Rattus norvegicus
gagcggtcgccgcagatcccgggcg

SEQ ID NO: 342797 - DNA, 25 bp, Rattus norvegicus
gagcggtcgccggagatcccgggcg

SEQ ID NO: 342798 - DNA, 25 bp, Rattus norvegicus
gagcggtctaacagtggccaagtat

SEQ ID NO: 342799 - DNA, 25 bp, Rattus norvegicus
gagcggtctaactgtggccaagtat

SEQ ID NO: 342800 - DNA, 25 bp, Rattus norvegicus
gagcggtctttgcattcatttttga

SEQ ID NO: 342801 - DNA, 25 bp, Rattus norvegicus
gagcggtctttggattcatttttga

SEQ ID NO: 342802 - DNA, 25 bp, Rattus norvegicus
gagcggttacttatacaattccagc

SEQ ID NO: 342803 - DNA, 25 bp, Rattus norvegicus
gagcggttacttttacaattccagc

SEQ ID NO: 342804 - DNA, 25 bp, Rattus norvegicus
gagcggttatgaaggtgtccttttc

SEQ ID NO: 342805 - DNA, 25 bp, Rattus norvegicus
gagcggttatgatggtgtccttttc

SEQ ID NO: 342806 - DNA, 25 bp, Rattus norvegicus
gagcggttccgaatgtggccatatc

SEQ ID NO: 342807 - DNA, 25 bp, Rattus norvegicus
gagcggttccgattgtggccatatc

SEQ ID NO: 342808 - DNA, 25 bp, Rattus norvegicus
gagcggttgatgcaagttgaacagg

SEQ ID NO: 342809 - DNA, 25 bp, Rattus norvegicus
gagcggttgatggaagttgaacagg

SEQ ID NO: 342810 - DNA, 25 bp, Rattus norvegicus
gagcggttgcttataccagaagaag

SEQ ID NO: 342811 - DNA, 25 bp, Rattus norvegicus
gagcggttgcttttaccagaagaag

SEQ ID NO: 342812 - DNA, 25 bp, Rattus norvegicus
gagcggtttgaaagggacctgcccc

SEQ ID NO: 342813 - DNA, 25 bp, Rattus norvegicus
gagcggtttgaatgggacctgcccc

SEQ ID NO: 342814 - DNA, 25 bp, Rattus norvegicus
gagcgtaacgggatagtgcagccat

SEQ ID NO: 342815 - DNA, 25 bp, Rattus norvegicus
gagcgtaacgggttagtgcagccat

SEQ ID NO: 342816 - DNA, 25 bp, Rattus norvegicus
gagcgtactgctcgttgtattaaca

SEQ ID NO: 342817 - DNA, 25 bp, Rattus norvegicus
gagcgtactgctggttgtattaaca

SEQ ID NO: 342818 - DNA, 25 bp, Rattus norvegicus
gagcgtactttgctcacagcaatat

SEQ ID NO: 342819 - DNA, 25 bp, Rattus norvegicus
gagcgtactttggtcacagcaatat

SEQ ID NO: 342820 - DNA, 25 bp, Rattus norvegicus
gagcgtagatacctggccaatcaaa

SEQ ID NO: 342821 - DNA, 25 bp, Rattus norvegicus
gagcgtagatacgtggccaatcaaa

SEQ ID NO: 342822 - DNA, 25 bp, Rattus norvegicus
gagcgtagctatcacttagtccgga

SEQ ID NO: 342823 - DNA, 25 bp, Rattus norvegicus
gagcgtagctatgacttagtccgga

SEQ ID NO: 342824 - DNA, 25 bp, Rattus norvegicus
gagcgtatctttattccaacagtct

SEQ ID NO: 342825 - DNA, 25 bp, Rattus norvegicus
gagcgtatcttttttccaacagtct

SEQ ID NO: 342826 - DNA, 25 bp, Rattus norvegicus
gagcgtattacacggcatggcaaga

SEQ ID NO: 342827 - DNA, 25 bp, Rattus norvegicus
gagcgtattacagggcatggcaaga

SEQ ID NO: 342828 - DNA, 25 bp, Rattus norvegicus
gagcgtatttgcagtcagaacctca

SEQ ID NO: 342829 - DNA, 25 bp, Rattus norvegicus
gagcgtatttgctgtcagaacctca

SEQ ID NO: 342830 - DNA, 25 bp, Rattus norvegicus
gagcgtcacctaccagtcagtctgt

SEQ ID NO: 342831 - DNA, 25 bp, Rattus norvegicus
gagcgtcacctagcagtcagtctgt

SEQ ID NO: 342832 - DNA, 25 bp, Rattus norvegicus
gagcgtcagcacaggtgacattacc

SEQ ID NO: 342833 - DNA, 25 bp, Rattus norvegicus
gagcgtcagcactggtgacattacc

SEQ ID NO: 342834 - DNA, 25 bp, Rattus norvegicus
gagcgtcagctcaccctgcgaggag

SEQ ID NO: 342835 - DNA, 25 bp, Rattus norvegicus
gagcgtcagctctccctgcgaggag

SEQ ID NO: 342836 - DNA, 25 bp, Rattus norvegicus
gagcgtcagtcaagcttctgtgttt

SEQ ID NO: 342837 - DNA, 25 bp, Rattus norvegicus
gagcgtcagtcatgcttctgtgttt

SEQ ID NO: 342838 - DNA, 25 bp, Rattus norvegicus
gagcgtccaaatcattcaagatctg

SEQ ID NO: 342839 - DNA, 25 bp, Rattus norvegicus
gagcgtccaaatgattcaagatctg

SEQ ID NO: 342840 - DNA, 25 bp, Rattus norvegicus
gagcgtccaactctatattttttac

SEQ ID NO: 342841 - DNA, 25 bp, Rattus norvegicus
gagcgtccaactgtatattttttac

SEQ ID NO: 342842 - DNA, 25 bp, Rattus norvegicus
gagcgtccatccaagatgtagggct

SEQ ID NO: 342843 - DNA, 25 bp, Rattus norvegicus
gagcgtccatcctagatgtagggct

SEQ ID NO: 342844 - DNA, 25 bp, Rattus norvegicus
gagcgtccctacaagtgccaggtgt

SEQ ID NO: 342845 - DNA, 25 bp, Rattus norvegicus
gagcgtccctactagtgccaggtgt

SEQ ID NO: 342846 - DNA, 25 bp, Rattus norvegicus
gagcgtcgctccaggacagagccgc

SEQ ID NO: 342847 - DNA, 25 bp, Rattus norvegicus
gagcgtcgctcctggacagagccgc

SEQ ID NO: 342848 - DNA, 25 bp, Rattus norvegicus
gagcgtcgctcgctcgctcttgtag

SEQ ID NO: 342849 - DNA, 25 bp, Rattus norvegicus
gagcgtcgctcggtcgctcttgtag

SEQ ID NO: 342850 - DNA, 25 bp, Rattus norvegicus
gagcgtcgctctaggcaacagcggc

SEQ ID NO: 342851 - DNA, 25 bp, Rattus norvegicus
gagcgtcgctcttggcaacagcggc

SEQ ID NO: 342852 - DNA, 25 bp, Rattus norvegicus
gagcgtctagagattaacgactcgg

SEQ ID NO: 342853 - DNA, 25 bp, Rattus norvegicus
gagcgtctagagtttaacgactcgg

SEQ ID NO: 342854 - DNA, 25 bp, Rattus norvegicus
gagcgtctatttcttctctggagac

SEQ ID NO: 342855 - DNA, 25 bp, Rattus norvegicus
gagcgtctatttgttctctggagac

SEQ ID NO: 342856 - DNA, 25 bp, Rattus norvegicus
gagcgtctcacaataagagaggcct

SEQ ID NO: 342857 - DNA, 25 bp, Rattus norvegicus
gagcgtctcacattaagagaggcct

SEQ ID NO: 342858 - DNA, 25 bp, Rattus norvegicus
gagcgtctcagtccaacaggaaggt

SEQ ID NO: 342859 - DNA, 25 bp, Rattus norvegicus
gagcgtctcagtgcaacaggaaggt

SEQ ID NO: 342860 - DNA, 25 bp, Rattus norvegicus
gagcgtctccatcacatgaaacaaa

SEQ ID NO: 342861 - DNA, 25 bp, Rattus norvegicus
gagcgtctccatgacatgaaacaaa

SEQ ID NO: 342862 - DNA, 25 bp, Rattus norvegicus
gagcgtctctttctttacattaagg

SEQ ID NO: 342863 - DNA, 25 bp, Rattus norvegicus
gagcgtctctttgtttacattaagg

SEQ ID NO: 342864 - DNA, 25 bp, Rattus norvegicus
gagcgtctgtagagtgtcgtctatg

SEQ ID NO: 342865 - DNA, 25 bp, Rattus norvegicus
gagcgtctgtagtgtgtcgtctatg

SEQ ID NO: 342866 - DNA, 25 bp, Rattus norvegicus
gagcgtcttattatgcccttaacaa

SEQ ID NO: 342867 - DNA, 25 bp, Rattus norvegicus
gagcgtcttattttgcccttaacaa

SEQ ID NO: 342868 - DNA, 25 bp, Rattus norvegicus
gagcgtgaactgatctagccccgag

SEQ ID NO: 342869 - DNA, 25 bp, Rattus norvegicus
gagcgtgaactgttctagccccgag

SEQ ID NO: 342870 - DNA, 25 bp, Rattus norvegicus
gagcgtgaattaacaactgtcaacg

SEQ ID NO: 342871 - DNA, 25 bp, Rattus norvegicus
gagcgtgaattatcaactgtcaacg

SEQ ID NO: 342872 - DNA, 25 bp, Rattus norvegicus
gagcgtgacggacgagttctactct

SEQ ID NO: 342873 - DNA, 25 bp, Rattus norvegicus
gagcgtgacggaggagttctactct

SEQ ID NO: 342874 - DNA, 25 bp, Rattus norvegicus
gagcgtgagcttcattttgctttgt

SEQ ID NO: 342875 - DNA, 25 bp, Rattus norvegicus
gagcgtgagcttgattttgctttgt

SEQ ID NO: 342876 - DNA, 25 bp, Rattus norvegicus
gagcgtgaggatccagacctccaat

SEQ ID NO: 342877 - DNA, 25 bp, Rattus norvegicus
gagcgtgaggatgcagacctccaat

SEQ ID NO: 342878 - DNA, 25 bp, Rattus norvegicus
gagcgtgagttacacattttcccta

SEQ ID NO: 342879 - DNA, 25 bp, Rattus norvegicus
gagcgtgagttagacattttcccta

SEQ ID NO: 342880 - DNA, 25 bp, Rattus norvegicus
gagcgtgcagtcaaccagtcaagat

SEQ ID NO: 342881 - DNA, 25 bp, Rattus norvegicus
gagcgtgcagtctaccagtcaagat

SEQ ID NO: 342882 - DNA, 25 bp, Rattus norvegicus
gagcgtgcatcaaaactgggacttt

SEQ ID NO: 342883 - DNA, 25 bp, Rattus norvegicus
gagcgtgcatcataactgggacttt

SEQ ID NO: 342884 - DNA, 25 bp, Rattus norvegicus
gagcgtgccaatattgtgactgtaa

SEQ ID NO: 342885 - DNA, 25 bp, Rattus norvegicus
gagcgtgccaattttgtgactgtaa

SEQ ID NO: 342886 - DNA, 25 bp, Rattus norvegicus
gagcgtgcgcagcaaagccagacct

SEQ ID NO: 342887 - DNA, 25 bp, Rattus norvegicus
gagcgtgcgcaggaaagccagacct

SEQ ID NO: 342888 - DNA, 25 bp, Rattus norvegicus
gagcgtgctctgcattcggtcccgt

SEQ ID NO: 342889 - DNA, 25 bp, Rattus norvegicus
gagcgtgctctggattcggtcccgt

SEQ ID NO: 342890 - DNA, 25 bp, Rattus norvegicus
gagcgtggaataaaacagcactcac

SEQ ID NO: 342891 - DNA, 25 bp, Rattus norvegicus
gagcgtggaatataacagcactcac

SEQ ID NO: 342892 - DNA, 25 bp, Rattus norvegicus
gagcgtggcactagtctttggtgaa

SEQ ID NO: 342893 - DNA, 25 bp, Rattus norvegicus
gagcgtggcacttgtctttggtgaa

SEQ ID NO: 342894 - DNA, 25 bp, Rattus norvegicus
gagcgtggcatcattaacctgtcca

SEQ ID NO: 342895 - DNA, 25 bp, Rattus norvegicus
gagcgtggcatctttaacctgtcca

SEQ ID NO: 342896 - DNA, 25 bp, Rattus norvegicus
gagcgtggctcgaagcgttcatgat

SEQ ID NO: 342897 - DNA, 25 bp, Rattus norvegicus
gagcgtggctcgtagcgttcatgat

SEQ ID NO: 342898 - DNA, 25 bp, Rattus norvegicus
gagcgtgggctaaagacttctgtgt

SEQ ID NO: 342899 - DNA, 25 bp, Rattus norvegicus
gagcgtgggctatagacttctgtgt

SEQ ID NO: 342900 - DNA, 25 bp, Rattus norvegicus
gagcgtgggtaaatctcacctgcgg

SEQ ID NO: 342901 - DNA, 25 bp, Rattus norvegicus
gagcgtgggtaattctcacctgcgg

SEQ ID NO: 342902 - DNA, 25 bp, Rattus norvegicus
gagcgtgtctcgattatgcagcact

SEQ ID NO: 342903 - DNA, 25 bp, Rattus norvegicus
gagcgtgtctcgtttatgcagcact

SEQ ID NO: 342904 - DNA, 25 bp, Rattus norvegicus
gagcgtgtgatcaccatcatgcaga

SEQ ID NO: 342905 - DNA, 25 bp, Rattus norvegicus
gagcgtgtgatctccatcatgcaga

SEQ ID NO: 342906 - DNA, 25 bp, Rattus norvegicus
gagcgtgtgcaaaccatcataggca

SEQ ID NO: 342907 - DNA, 25 bp, Rattus norvegicus
gagcgtgtgcaatccatcataggca

SEQ ID NO: 342908 - DNA, 25 bp, Rattus norvegicus
gagcgtgtgctgctaggttatctcc

SEQ ID NO: 342909 - DNA, 25 bp, Rattus norvegicus
gagcgtgtgctggtaggttatctcc

SEQ ID NO: 342910 - DNA, 25 bp, Rattus norvegicus
gagcgtgttaacatcctgtttgatt

SEQ ID NO: 342911 - DNA, 25 bp, Rattus norvegicus
gagcgtgttaacttcctgtttgatt

SEQ ID NO: 342912 - DNA, 25 bp, Rattus norvegicus
gagcgtgttagtctatacaggtttc

SEQ ID NO: 342913 - DNA, 25 bp, Rattus norvegicus
gagcgtgttagtgtatacaggtttc

SEQ ID NO: 342914 - DNA, 25 bp, Rattus norvegicus
gagcgtgttcatcatgtaacttacc

SEQ ID NO: 342915 - DNA, 25 bp, Rattus norvegicus
gagcgtgttcatgatgtaacttacc

SEQ ID NO: 342916 - DNA, 25 bp, Rattus norvegicus
gagcgtgttgaccattgaacccgat

SEQ ID NO: 342917 - DNA, 25 bp, Rattus norvegicus
gagcgtgttgacgattgaacccgat

SEQ ID NO: 342918 - DNA, 25 bp, Rattus norvegicus
gagcgtgtttaacttggccatttcc

SEQ ID NO: 342919 - DNA, 25 bp, Rattus norvegicus
gagcgtgtttaagttggccatttcc

SEQ ID NO: 342920 - DNA, 25 bp, Rattus norvegicus
gagcgttaagaacccactggctagt

SEQ ID NO: 342921 - DNA, 25 bp, Rattus norvegicus
gagcgttaagaagccactggctagt

SEQ ID NO: 342922 - DNA, 25 bp, Rattus norvegicus
gagcgttacagcatctcatatggta

SEQ ID NO: 342923 - DNA, 25 bp, Rattus norvegicus
gagcgttacagcttctcatatggta

SEQ ID NO: 342924 - DNA, 25 bp, Rattus norvegicus
gagcgttactggctaaatatccctg

SEQ ID NO: 342925 - DNA, 25 bp, Rattus norvegicus
gagcgttactgggtaaatatccctg

SEQ ID NO: 342926 - DNA, 25 bp, Rattus norvegicus
gagcgttcaaggctcgtcatttact

SEQ ID NO: 342927 - DNA, 25 bp, Rattus norvegicus
gagcgttcaagggtcgtcatttact

SEQ ID NO: 342928 - DNA, 25 bp, Rattus norvegicus
gagcgttcacataaactgtgggcaa

SEQ ID NO: 342929 - DNA, 25 bp, Rattus norvegicus
gagcgttcacattaactgtgggcaa

SEQ ID NO: 342930 - DNA, 25 bp, Rattus norvegicus
gagcgttcactgaagctttctttaa

SEQ ID NO: 342931 - DNA, 25 bp, Rattus norvegicus
gagcgttcactgtagctttctttaa

SEQ ID NO: 342932 - DNA, 25 bp, Rattus norvegicus
gagcgttctcaaccacattagttaa

SEQ ID NO: 342933 - DNA, 25 bp, Rattus norvegicus
gagcgttctcaagcacattagttaa

SEQ ID NO: 342934 - DNA, 25 bp, Rattus norvegicus
gagcgttctggaagacttcttcaca

SEQ ID NO: 342935 - DNA, 25 bp, Rattus norvegicus
gagcgttctggatgacttcttcaca

SEQ ID NO: 342936 - DNA, 25 bp, Rattus norvegicus
gagcgttctggcaccttcagagaaa

SEQ ID NO: 342937 - DNA, 25 bp, Rattus norvegicus
gagcgttctggctccttcagagaaa

SEQ ID NO: 342938 - DNA, 25 bp, Rattus norvegicus
gagcgttcttccctttagagagtta

SEQ ID NO: 342939 - DNA, 25 bp, Rattus norvegicus
gagcgttcttccgtttagagagtta

SEQ ID NO: 342940 - DNA, 25 bp, Rattus norvegicus
gagcgttgaagtcaaagtgctcaca

SEQ ID NO: 342941 - DNA, 25 bp, Rattus norvegicus
gagcgttgaagtgaaagtgctcaca

SEQ ID NO: 342942 - DNA, 25 bp, Rattus norvegicus
gagcgttgagggactgtagcctcac

SEQ ID NO: 342943 - DNA, 25 bp, Rattus norvegicus
gagcgttgagggtctgtagcctcac

SEQ ID NO: 342944 - DNA, 25 bp, Rattus norvegicus
gagcgttggactacgccgtaagcga

SEQ ID NO: 342945 - DNA, 25 bp, Rattus norvegicus
gagcgttggacttcgccgtaagcga

SEQ ID NO: 342946 - DNA, 25 bp, Rattus norvegicus
gagcgttggatacagcagtagacat

SEQ ID NO: 342947 - DNA, 25 bp, Rattus norvegicus
gagcgttggatagagcagtagacat

SEQ ID NO: 342948 - DNA, 25 bp, Rattus norvegicus
gagcgttgtgcacattgttcactac

SEQ ID NO: 342949 - DNA, 25 bp, Rattus norvegicus
gagcgttgtgcagattgttcactac

SEQ ID NO: 342950 - DNA, 25 bp, Rattus norvegicus
gagcgtttgcctcgcatgctcagtg

SEQ ID NO: 342951 - DNA, 25 bp, Rattus norvegicus
gagcgtttgcctggcatgctcagtg

SEQ ID NO: 342952 - DNA, 25 bp, Rattus norvegicus
gagcgtttgtgtatgaaggatcctt

SEQ ID NO: 342953 - DNA, 25 bp, Rattus norvegicus
gagcgtttgtgtttgaaggatcctt

SEQ ID NO: 342954 - DNA, 25 bp, Rattus norvegicus
gagcgttttattatgttgccctggg

SEQ ID NO: 342955 - DNA, 25 bp, Rattus norvegicus
gagcgttttattttgttgccctggg

SEQ ID NO: 342956 - DNA, 25 bp, Rattus norvegicus
gagcgttttgttctggtcccgccag

SEQ ID NO: 342957 - DNA, 25 bp, Rattus norvegicus
gagcgttttgttgtggtcccgccag

SEQ ID NO: 342958 - DNA, 25 bp, Rattus norvegicus
gagcgtttttaaagtccgagttctg

SEQ ID NO: 342959 - DNA, 25 bp, Rattus norvegicus
gagcgtttttaatgtccgagttctg

SEQ ID NO: 342960 - DNA, 25 bp, Rattus norvegicus
gagctaaacacgcatgaccccacgg

SEQ ID NO: 342961 - DNA, 25 bp, Rattus norvegicus
gagctaaacacggatgaccccacgg

SEQ ID NO: 342962 - DNA, 25 bp, Rattus norvegicus
gagctaaaccagagagaaccccaat

SEQ ID NO: 342963 - DNA, 25 bp, Rattus norvegicus
gagctaaaccagtgagaaccccaat

SEQ ID NO: 342964 - DNA, 25 bp, Rattus norvegicus
gagctaaacggcatgcttgctttca

SEQ ID NO: 342965 - DNA, 25 bp, Rattus norvegicus
gagctaaacggcttgcttgctttca

SEQ ID NO: 342966 - DNA, 25 bp, Rattus norvegicus
gagctaaactagactctggcggctg

SEQ ID NO: 342967 - DNA, 25 bp, Rattus norvegicus
gagctaaactagtctctggcggctg

SEQ ID NO: 342968 - DNA, 25 bp, Rattus norvegicus
gagctaaacttacttctacccacct

SEQ ID NO: 342969 - DNA, 25 bp, Rattus norvegicus
gagctaaacttagttctacccacct

SEQ ID NO: 342970 - DNA, 25 bp, Rattus norvegicus
gagctaaagcctatccaggattacc

SEQ ID NO: 342971 - DNA, 25 bp, Rattus norvegicus
gagctaaagcctttccaggattacc

SEQ ID NO: 342972 - DNA, 25 bp, Rattus norvegicus
gagctaaagctgaaacccagtaatt

SEQ ID NO: 342973 - DNA, 25 bp, Rattus norvegicus
gagctaaagctgtaacccagtaatt

SEQ ID NO: 342974 - DNA, 25 bp, Rattus norvegicus
gagctaaatattctaaactggcaac

SEQ ID NO: 342975 - DNA, 25 bp, Rattus norvegicus
gagctaaatattgtaaactggcaac

SEQ ID NO: 342976 - DNA, 25 bp, Rattus norvegicus
gagctaaatcctcagcccagataga

SEQ ID NO: 342977 - DNA, 25 bp, Rattus norvegicus
gagctaaatcctgagcccagataga

SEQ ID NO: 342978 - DNA, 25 bp, Rattus norvegicus
gagctaaattcccaaccccaggaga

SEQ ID NO: 342979 - DNA, 25 bp, Rattus norvegicus
gagctaaattccgaaccccaggaga

SEQ ID NO: 342980 - DNA, 25 bp, Rattus norvegicus
gagctaacacccaattctagaagta

SEQ ID NO: 342981 - DNA, 25 bp, Rattus norvegicus
gagctaacaccctattctagaagta

SEQ ID NO: 342982 - DNA, 25 bp, Rattus norvegicus
gagctaacagccacattacagtggt

SEQ ID NO: 342983 - DNA, 25 bp, Rattus norvegicus
gagctaacagcctcattacagtggt

SEQ ID NO: 342984 - DNA, 25 bp, Rattus norvegicus
gagctaacatgaacctaatccacaa

SEQ ID NO: 342985 - DNA, 25 bp, Rattus norvegicus
gagctaacatgaactggtgcccatt

SEQ ID NO: 342986 - DNA, 25 bp, Rattus norvegicus
gagctaacatgatcctaatccacaa

SEQ ID NO: 342987 - DNA, 25 bp, Rattus norvegicus
gagctaacatgatctggtgcccatt

SEQ ID NO: 342988 - DNA, 25 bp, Rattus norvegicus
gagctaacatttcaaggtcttgtcc

SEQ ID NO: 342989 - DNA, 25 bp, Rattus norvegicus
gagctaacatttgaaggtcttgtcc

SEQ ID NO: 342990 - DNA, 25 bp, Rattus norvegicus
gagctaaccactctaagactgtttg

SEQ ID NO: 342991 - DNA, 25 bp, Rattus norvegicus
gagctaaccactgtaagactgtttg

SEQ ID NO: 342992 - DNA, 25 bp, Rattus norvegicus
gagctaaccatgagcacagtttctg

SEQ ID NO: 342993 - DNA, 25 bp, Rattus norvegicus
gagctaaccatgtgcacagtttctg

SEQ ID NO: 342994 - DNA, 25 bp, Rattus norvegicus
gagctaacctacatctgattactgc

SEQ ID NO: 342995 - DNA, 25 bp, Rattus norvegicus
gagctaacctacttctgattactgc

SEQ ID NO: 342996 - DNA, 25 bp, Rattus norvegicus
gagctaacctgcaaaattctgactt

SEQ ID NO: 342997 - DNA, 25 bp, Rattus norvegicus
gagctaacctgctaaattctgactt

SEQ ID NO: 342998 - DNA, 25 bp, Rattus norvegicus
gagctaacgagcaacttcagcagct

SEQ ID NO: 342999 - DNA, 25 bp, Rattus norvegicus
gagctaacgagctacttcagcagct

SEQ ID NO: 343000 - DNA, 25 bp, Rattus norvegicus
gagctaactcctcagcatggctgga

SEQ ID NO: 343001 - DNA, 25 bp, Rattus norvegicus
gagctaactcctgagcatggctgga

SEQ ID NO: 343002 - DNA, 25 bp, Rattus norvegicus
gagctaactcggatccattagccaa

SEQ ID NO: 343003 - DNA, 25 bp, Rattus norvegicus
gagctaactcggttccattagccaa

SEQ ID NO: 343004 - DNA, 25 bp, Rattus norvegicus
gagctaactggcatcttgtttacaa

SEQ ID NO: 343005 - DNA, 25 bp, Rattus norvegicus
gagctaactggcttcttgtttacaa

SEQ ID NO: 343006 - DNA, 25 bp, Rattus norvegicus
gagctaacttcccacctgtatcatt

SEQ ID NO: 343007 - DNA, 25 bp, Rattus norvegicus
gagctaacttccgacctgtatcatt

SEQ ID NO: 343008 - DNA, 25 bp, Rattus norvegicus
gagctaagactgatgtatctcctca

SEQ ID NO: 343009 - DNA, 25 bp, Rattus norvegicus
gagctaagactgttgtatctcctca

SEQ ID NO: 343010 - DNA, 25 bp, Rattus norvegicus
gagctaagatggagggttcctacct

SEQ ID NO: 343011 - DNA, 25 bp, Rattus norvegicus
gagctaagatggtgggttcctacct

SEQ ID NO: 343012 - DNA, 25 bp, Rattus norvegicus
gagctaagcaagagttcagccacat

SEQ ID NO: 343013 - DNA, 25 bp, Rattus norvegicus
gagctaagcaagtgttcagccacat

SEQ ID NO: 343014 - DNA, 25 bp, Rattus norvegicus
gagctaagcactcttactatattta

SEQ ID NO: 343015 - DNA, 25 bp, Rattus norvegicus
gagctaagcactgttactatattta

SEQ ID NO: 343016 - DNA, 25 bp, Rattus norvegicus
gagctaagcctgagcgcagcatcag

SEQ ID NO: 343017 - DNA, 25 bp, Rattus norvegicus
gagctaagcctgtgcgcagcatcag

SEQ ID NO: 343018 - DNA, 25 bp, Rattus norvegicus
gagctaaggcctagtgatataccag

SEQ ID NO: 343019 - DNA, 25 bp, Rattus norvegicus
gagctaaggccttgtgatataccag

SEQ ID NO: 343020 - DNA, 25 bp, Rattus norvegicus
gagctaaggctgaagggacatcccc

SEQ ID NO: 343021 - DNA, 25 bp, Rattus norvegicus
gagctaaggctgtagggacatcccc

SEQ ID NO: 343022 - DNA, 25 bp, Rattus norvegicus
gagctaagggcacactatttctagt

SEQ ID NO: 343023 - DNA, 25 bp, Rattus norvegicus
gagctaagggcagactatttctagt

SEQ ID NO: 343024 - DNA, 25 bp, Rattus norvegicus
gagctaagggtcagaaacggcttcc

SEQ ID NO: 343025 - DNA, 25 bp, Rattus norvegicus
gagctaagggtctgaaacggcttcc

SEQ ID NO: 343026 - DNA, 25 bp, Rattus norvegicus
gagctaaggtgtcctttgctgacaa

SEQ ID NO: 343027 - DNA, 25 bp, Rattus norvegicus
gagctaaggtgtgctttgctgacaa

SEQ ID NO: 343028 - DNA, 25 bp, Rattus norvegicus
gagctaagtatcacactactcctgc

SEQ ID NO: 343029 - DNA, 25 bp, Rattus norvegicus
gagctaagtatctcactactcctgc

SEQ ID NO: 343030 - DNA, 25 bp, Rattus norvegicus
gagctaagtgctcggcactgcccag

SEQ ID NO: 343031 - DNA, 25 bp, Rattus norvegicus
gagctaagtgctgggcactgcccag

SEQ ID NO: 343032 - DNA, 25 bp, Rattus norvegicus
gagctaagtgtaagcgactgccgct

SEQ ID NO: 343033 - DNA, 25 bp, Rattus norvegicus
gagctaagtgtatgcgactgccgct

SEQ ID NO: 343034 - DNA, 25 bp, Rattus norvegicus
gagctaagttacacccttgtgtgat

SEQ ID NO: 343035 - DNA, 25 bp, Rattus norvegicus
gagctaagttactcccttgtgtgat

SEQ ID NO: 343036 - DNA, 25 bp, Rattus norvegicus
gagctaagtttccacgtagttcttt

SEQ ID NO: 343037 - DNA, 25 bp, Rattus norvegicus
gagctaagtttcgacgtagttcttt

SEQ ID NO: 343038 - DNA, 25 bp, Rattus norvegicus
gagctaatacttcatgagtcctgtt

SEQ ID NO: 343039 - DNA, 25 bp, Rattus norvegicus
gagctaatacttgatgagtcctgtt

SEQ ID NO: 343040 - DNA, 25 bp, Rattus norvegicus
gagctaatagcactgggactgctga

SEQ ID NO: 343041 - DNA, 25 bp, Rattus norvegicus
gagctaatagcagtgggactgctga

SEQ ID NO: 343042 - DNA, 25 bp, Rattus norvegicus
gagctaataggaatttgtacccaga

SEQ ID NO: 343043 - DNA, 25 bp, Rattus norvegicus
gagctaataggattttgtacccaga

SEQ ID NO: 343044 - DNA, 25 bp, Rattus norvegicus
gagctaatctctcctgtgttggcac

SEQ ID NO: 343045 - DNA, 25 bp, Rattus norvegicus
gagctaatctctgctgtgttggcac

SEQ ID NO: 343046 - DNA, 25 bp, Rattus norvegicus
gagctaatcttcagtgcctgatgaa

SEQ ID NO: 343047 - DNA, 25 bp, Rattus norvegicus
gagctaatcttctgtgcctgatgaa

SEQ ID NO: 343048 - DNA, 25 bp, Rattus norvegicus
gagctaatgagcatgcacagggcta

SEQ ID NO: 343049 - DNA, 25 bp, Rattus norvegicus
gagctaatgagcttgcacagggcta

SEQ ID NO: 343050 - DNA, 25 bp, Rattus norvegicus
gagctaatgccaatgcaagtctttt

SEQ ID NO: 343051 - DNA, 25 bp, Rattus norvegicus
gagctaatgccattgcaagtctttt

SEQ ID NO: 343052 - DNA, 25 bp, Rattus norvegicus
gagctaatttcaactaaacctgtaa

SEQ ID NO: 343053 - DNA, 25 bp, Rattus norvegicus
gagctaatttcatctaaacctgtaa

SEQ ID NO: 343054 - DNA, 25 bp, Rattus norvegicus
gagctacaacagcagctgcaggaat

SEQ ID NO: 343055 - DNA, 25 bp, Rattus norvegicus
gagctacaacaggagctgcaggaat

SEQ ID NO: 343056 - DNA, 25 bp, Rattus norvegicus
gagctacaattcaaatgccttcaga

SEQ ID NO: 343057 - DNA, 25 bp, Rattus norvegicus
gagctacaattctaatgccttcaga

SEQ ID NO: 343058 - DNA, 25 bp, Rattus norvegicus
gagctacacctgacattcacgcaag

SEQ ID NO: 343059 - DNA, 25 bp, Rattus norvegicus
gagctacacctgtcattcacgcaag

SEQ ID NO: 343060 - DNA, 25 bp, Rattus norvegicus
gagctacagaatcttatccttgaat

SEQ ID NO: 343061 - DNA, 25 bp, Rattus norvegicus
gagctacagaatgttatccttgaat

SEQ ID NO: 343062 - DNA, 25 bp, Rattus norvegicus
gagctacagcaacgaaacacgcacg

SEQ ID NO: 343063 - DNA, 25 bp, Rattus norvegicus
gagctacagcaaggaaacacgcacg

SEQ ID NO: 343064 - DNA, 25 bp, Rattus norvegicus
gagctacagctgatacctgaccaac

SEQ ID NO: 343065 - DNA, 25 bp, Rattus norvegicus
gagctacagctgttacctgaccaac

SEQ ID NO: 343066 - DNA, 25 bp, Rattus norvegicus
gagctacagggcacctaaggctcag

SEQ ID NO: 343067 - DNA, 25 bp, Rattus norvegicus
gagctacagggctcctaaggctcag

SEQ ID NO: 343068 - DNA, 25 bp, Rattus norvegicus
gagctacaggtgatgttcgcagcat

SEQ ID NO: 343069 - DNA, 25 bp, Rattus norvegicus
gagctacaggtgttgttcgcagcat

SEQ ID NO: 343070 - DNA, 25 bp, Rattus norvegicus
gagctacagtgtacattctatatca

SEQ ID NO: 343071 - DNA, 25 bp, Rattus norvegicus
gagctacagtgttcattctatatca

SEQ ID NO: 343072 - DNA, 25 bp, Rattus norvegicus
gagctacataggcaggcatgatctc

SEQ ID NO: 343073 - DNA, 25 bp, Rattus norvegicus
gagctacatagggaggcatgatctc

SEQ ID NO: 343074 - DNA, 25 bp, Rattus norvegicus
gagctacatttccagaattcctatg

SEQ ID NO: 343075 - DNA, 25 bp, Rattus norvegicus
gagctacatttcgagaattcctatg

SEQ ID NO: 343076 - DNA, 25 bp, Rattus norvegicus
gagctaccaatcacaaacactgtcc

SEQ ID NO: 343077 - DNA, 25 bp, Rattus norvegicus
gagctaccaatctcaaacactgtcc

SEQ ID NO: 343078 - DNA, 25 bp, Rattus norvegicus
gagctaccaatgacaccaatcagtg

SEQ ID NO: 343079 - DNA, 25 bp, Rattus norvegicus
gagctaccaatgtcaccaatcagtg

SEQ ID NO: 343080 - DNA, 25 bp, Rattus norvegicus
gagctaccaccaagaactccagggt

SEQ ID NO: 343081 - DNA, 25 bp, Rattus norvegicus
gagctaccaccatgaactccagggt

SEQ ID NO: 343082 - DNA, 25 bp, Rattus norvegicus
gagctaccagagacctatgcgagat

SEQ ID NO: 343083 - DNA, 25 bp, Rattus norvegicus
gagctaccagagtcctatgcgagat

SEQ ID NO: 343084 - DNA, 25 bp, Rattus norvegicus
gagctaccagcacctgcggagcgaa

SEQ ID NO: 343085 - DNA, 25 bp, Rattus norvegicus
gagctaccagcagctgcggagcgaa

SEQ ID NO: 343086 - DNA, 25 bp, Rattus norvegicus
gagctaccagccaattactcttagt

SEQ ID NO: 343087 - DNA, 25 bp, Rattus norvegicus
gagctaccagcctattactcttagt

SEQ ID NO: 343088 - DNA, 25 bp, Rattus norvegicus
gagctaccatttcccacaggttaag

SEQ ID NO: 343089 - DNA, 25 bp, Rattus norvegicus
gagctaccatttgccacaggttaag

SEQ ID NO: 343090 - DNA, 25 bp, Rattus norvegicus
gagctacccttgacctgggcaggat

SEQ ID NO: 343091 - DNA, 25 bp, Rattus norvegicus
gagctacccttgtcctgggcaggat

SEQ ID NO: 343092 - DNA, 25 bp, Rattus norvegicus
gagctaccggtaagccacattacga

SEQ ID NO: 343093 - DNA, 25 bp, Rattus norvegicus
gagctaccggtatgccacattacga

SEQ ID NO: 343094 - DNA, 25 bp, Rattus norvegicus
gagctacctaagagatcctatcctg

SEQ ID NO: 343095 - DNA, 25 bp, Rattus norvegicus
gagctacctaagtgatcctatcctg

SEQ ID NO: 343096 - DNA, 25 bp, Rattus norvegicus
gagctacctgaacattgccattcta

SEQ ID NO: 343097 - DNA, 25 bp, Rattus norvegicus
gagctacctgaagattgccattcta

SEQ ID NO: 343098 - DNA, 25 bp, Rattus norvegicus
gagctacctgacaagattttgactg

SEQ ID NO: 343099 - DNA, 25 bp, Rattus norvegicus
gagctacctgactagattttgactg

SEQ ID NO: 343100 - DNA, 25 bp, Rattus norvegicus
gagctaccttccatgtgaactactt

SEQ ID NO: 343101 - DNA, 25 bp, Rattus norvegicus
gagctaccttcccaggtatattggc

SEQ ID NO: 343102 - DNA, 25 bp, Rattus norvegicus
gagctaccttccgaggtatattggc

SEQ ID NO: 343103 - DNA, 25 bp, Rattus norvegicus
gagctaccttccttgtgaactactt

SEQ ID NO: 343104 - DNA, 25 bp, Rattus norvegicus
gagctaccttctatgtattaggatg

SEQ ID NO: 343105 - DNA, 25 bp, Rattus norvegicus
gagctaccttctctagtatgtctgc

SEQ ID NO: 343106 - DNA, 25 bp, Rattus norvegicus
gagctaccttctgtagtatgtctgc

SEQ ID NO: 343107 - DNA, 25 bp, Rattus norvegicus
gagctaccttctttgtattaggatg

SEQ ID NO: 343108 - DNA, 25 bp, Rattus norvegicus
gagctaccttgaaggccttacttga

SEQ ID NO: 343109 - DNA, 25 bp, Rattus norvegicus
gagctaccttgatggccttacttga

SEQ ID NO: 343110 - DNA, 25 bp, Rattus norvegicus
gagctacctttaccctgccgggagg

SEQ ID NO: 343111 - DNA, 25 bp, Rattus norvegicus
gagctacctttagcctgccgggagg

SEQ ID NO: 343112 - DNA, 25 bp, Rattus norvegicus
gagctacgacagcaatcttgtgcat

SEQ ID NO: 343113 - DNA, 25 bp, Rattus norvegicus
gagctacgacaggaatcttgtgcat

SEQ ID NO: 343114 - DNA, 25 bp, Rattus norvegicus
gagctacgcaagatgcttctgtctt

SEQ ID NO: 343115 - DNA, 25 bp, Rattus norvegicus
gagctacgcaagttgcttctgtctt

SEQ ID NO: 343116 - DNA, 25 bp, Rattus norvegicus
gagctacgcagcacacaaacagaac

SEQ ID NO: 343117 - DNA, 25 bp, Rattus norvegicus
gagctacgcagctcacaaacagaac

SEQ ID NO: 343118 - DNA, 25 bp, Rattus norvegicus
gagctacgctggagataactttgtt

SEQ ID NO: 343119 - DNA, 25 bp, Rattus norvegicus
gagctacgctggtgataactttgtt

SEQ ID NO: 343120 - DNA, 25 bp, Rattus norvegicus
gagctacggaagcagccctgtctca

SEQ ID NO: 343121 - DNA, 25 bp, Rattus norvegicus
gagctacggaaggagccctgtctca

SEQ ID NO: 343122 - DNA, 25 bp, Rattus norvegicus
gagctacggtaaacagcttcggcaa

SEQ ID NO: 343123 - DNA, 25 bp, Rattus norvegicus
gagctacggtaatcagcttcggcaa

SEQ ID NO: 343124 - DNA, 25 bp, Rattus norvegicus
gagctacggtgaatatttccattca

SEQ ID NO: 343125 - DNA, 25 bp, Rattus norvegicus
gagctacggtgattatttccattca

SEQ ID NO: 343126 - DNA, 25 bp, Rattus norvegicus
gagctactaacaaactacaacccct

SEQ ID NO: 343127 - DNA, 25 bp, Rattus norvegicus
gagctactaacatactacaacccct

SEQ ID NO: 343128 - DNA, 25 bp, Rattus norvegicus
gagctactactgaacgcagcccaag

SEQ ID NO: 343129 - DNA, 25 bp, Rattus norvegicus
gagctactactgtacgcagcccaag

SEQ ID NO: 343130 - DNA, 25 bp, Rattus norvegicus
gagctactatggaaagtcctgggga

SEQ ID NO: 343131 - DNA, 25 bp, Rattus norvegicus
gagctactatggtaagtcctgggga

SEQ ID NO: 343132 - DNA, 25 bp, Rattus norvegicus
gagctactcatacgaagacccatag

SEQ ID NO: 343133 - DNA, 25 bp, Rattus norvegicus
gagctactcataggaagacccatag

SEQ ID NO: 343134 - DNA, 25 bp, Rattus norvegicus
gagctactccagagaagtgcttaaa

SEQ ID NO: 343135 - DNA, 25 bp, Rattus norvegicus
gagctactccagtgaagtgcttaaa

SEQ ID NO: 343136 - DNA, 25 bp, Rattus norvegicus
gagctactctccaactggcgagcaa

SEQ ID NO: 343137 - DNA, 25 bp, Rattus norvegicus
gagctactctcctactggcgagcaa

SEQ ID NO: 343138 - DNA, 25 bp, Rattus norvegicus
gagctactctgccttgggacttcgt

SEQ ID NO: 343139 - DNA, 25 bp, Rattus norvegicus
gagctactctgcgttgggacttcgt

SEQ ID NO: 343140 - DNA, 25 bp, Rattus norvegicus
gagctactgaagaagacacctaaca

SEQ ID NO: 343141 - DNA, 25 bp, Rattus norvegicus
gagctactgaagtagacacctaaca

SEQ ID NO: 343142 - DNA, 25 bp, Rattus norvegicus
gagctactgagcacagcaactctta

SEQ ID NO: 343143 - DNA, 25 bp, Rattus norvegicus
gagctactgagctcagcaactctta

SEQ ID NO: 343144 - DNA, 25 bp, Rattus norvegicus
gagctactgcatcggtcaccaaggg

SEQ ID NO: 343145 - DNA, 25 bp, Rattus norvegicus
gagctactgcatgggtcaccaaggg

SEQ ID NO: 343146 - DNA, 25 bp, Rattus norvegicus
gagctactgcggcaccctgagagac

SEQ ID NO: 343147 - DNA, 25 bp, Rattus norvegicus
gagctactgcgggaccctgagagac

SEQ ID NO: 343148 - DNA, 25 bp, Rattus norvegicus
gagctactgctcatttggacataca

SEQ ID NO: 343149 - DNA, 25 bp, Rattus norvegicus
gagctactgctcttttggacataca

SEQ ID NO: 343150 - DNA, 25 bp, Rattus norvegicus
gagctactgtatatagacttaggaa

SEQ ID NO: 343151 - DNA, 25 bp, Rattus norvegicus
gagctactgtatttagacttaggaa

SEQ ID NO: 343152 - DNA, 25 bp, Rattus norvegicus
gagctactgtggagggtcattgccc

SEQ ID NO: 343153 - DNA, 25 bp, Rattus norvegicus
gagctactgtggtgggtcattgccc

SEQ ID NO: 343154 - DNA, 25 bp, Rattus norvegicus
gagctactgttactactccagtgtt

SEQ ID NO: 343155 - DNA, 25 bp, Rattus norvegicus
gagctactgttagtactccagtgtt

SEQ ID NO: 343156 - DNA, 25 bp, Rattus norvegicus
gagctacttcctctagtaatacggt

SEQ ID NO: 343157 - DNA, 25 bp, Rattus norvegicus
gagctacttcctgtagtaatacggt

SEQ ID NO: 343158 - DNA, 25 bp, Rattus norvegicus
gagctacttctaagctacctgttaa

SEQ ID NO: 343159 - DNA, 25 bp, Rattus norvegicus
gagctacttctatgctacctgttaa

SEQ ID NO: 343160 - DNA, 25 bp, Rattus norvegicus
gagctacttgggagctatgatccac

SEQ ID NO: 343161 - DNA, 25 bp, Rattus norvegicus
gagctacttgggtgctatgatccac

SEQ ID NO: 343162 - DNA, 25 bp, Rattus norvegicus
gagctactttgtatcctcaggaaaa

SEQ ID NO: 343163 - DNA, 25 bp, Rattus norvegicus
gagctactttgtttcctcaggaaaa

SEQ ID NO: 343164 - DNA, 25 bp, Rattus norvegicus
gagctagaaaccagccacataggga

SEQ ID NO: 343165 - DNA, 25 bp, Rattus norvegicus
gagctagaaacctgccacataggga

SEQ ID NO: 343166 - DNA, 25 bp, Rattus norvegicus
gagctagaacagatcccttctgttt

SEQ ID NO: 343167 - DNA, 25 bp, Rattus norvegicus
gagctagaacagttcccttctgttt

SEQ ID NO: 343168 - DNA, 25 bp, Rattus norvegicus
gagctagaagcacggagtcctgtat

SEQ ID NO: 343169 - DNA, 25 bp, Rattus norvegicus
gagctagaagcagggagtcctgtat

SEQ ID NO: 343170 - DNA, 25 bp, Rattus norvegicus
gagctagaagccacagtggcctgaa

SEQ ID NO: 343171 - DNA, 25 bp, Rattus norvegicus
gagctagaagcctcagtggcctgaa

SEQ ID NO: 343172 - DNA, 25 bp, Rattus norvegicus
gagctagaagtcagcctaggtcgac

SEQ ID NO: 343173 - DNA, 25 bp, Rattus norvegicus
gagctagaagtcagcgtgggctata

SEQ ID NO: 343174 - DNA, 25 bp, Rattus norvegicus
gagctagaagtctgcctaggtcgac

SEQ ID NO: 343175 - DNA, 25 bp, Rattus norvegicus
gagctagaagtctgcgtgggctata

SEQ ID NO: 343176 - DNA, 25 bp, Rattus norvegicus
gagctagaagttacctctgtggtgg

SEQ ID NO: 343177 - DNA, 25 bp, Rattus norvegicus
gagctagaagtttcctctgtggtgg

SEQ ID NO: 343178 - DNA, 25 bp, Rattus norvegicus
gagctagaatgtaacgcctacgttc

SEQ ID NO: 343179 - DNA, 25 bp, Rattus norvegicus
gagctagaatgttacgcctacgttc

SEQ ID NO: 343180 - DNA, 25 bp, Rattus norvegicus
gagctagaccctcgccttggtttaa

SEQ ID NO: 343181 - DNA, 25 bp, Rattus norvegicus
gagctagaccctggccttggtttaa

SEQ ID NO: 343182 - DNA, 25 bp, Rattus norvegicus
gagctagaccttagaccaggaccca

SEQ ID NO: 343183 - DNA, 25 bp, Rattus norvegicus
gagctagacctttgaccaggaccca

SEQ ID NO: 343184 - DNA, 25 bp, Rattus norvegicus
gagctagacgttatccacagctact

SEQ ID NO: 343185 - DNA, 25 bp, Rattus norvegicus
gagctagacgttttccacagctact

SEQ ID NO: 343186 - DNA, 25 bp, Rattus norvegicus
gagctagacttcagaccatcgaggt

SEQ ID NO: 343187 - DNA, 25 bp, Rattus norvegicus
gagctagacttctgaccatcgaggt

SEQ ID NO: 343188 - DNA, 25 bp, Rattus norvegicus
gagctagactttcagcagctgcatt

SEQ ID NO: 343189 - DNA, 25 bp, Rattus norvegicus
gagctagactttgagcagctgcatt

SEQ ID NO: 343190 - DNA, 25 bp, Rattus norvegicus
gagctagaggccaggaaccacagtc

SEQ ID NO: 343191 - DNA, 25 bp, Rattus norvegicus
gagctagaggcctggaaccacagtc

SEQ ID NO: 343192 - DNA, 25 bp, Rattus norvegicus
gagctagcaaacagaaacccagttg

SEQ ID NO: 343193 - DNA, 25 bp, Rattus norvegicus
gagctagcaaactgaaacccagttg

SEQ ID NO: 343194 - DNA, 25 bp, Rattus norvegicus
gagctagcaaggcttcttcagctta

SEQ ID NO: 343195 - DNA, 25 bp, Rattus norvegicus
gagctagcaagggttcttcagctta

SEQ ID NO: 343196 - DNA, 25 bp, Rattus norvegicus
gagctagccaggacttttctgggaa

SEQ ID NO: 343197 - DNA, 25 bp, Rattus norvegicus
gagctagccaggtcttttctgggaa

SEQ ID NO: 343198 - DNA, 25 bp, Rattus norvegicus
gagctagcctaacttgtcgcttcaa

SEQ ID NO: 343199 - DNA, 25 bp, Rattus norvegicus
gagctagcctaagttgtcgcttcaa

SEQ ID NO: 343200 - DNA, 25 bp, Rattus norvegicus
gagctagcttagacgcttgcagcat

SEQ ID NO: 343201 - DNA, 25 bp, Rattus norvegicus
gagctagcttagtcgcttgcagcat

SEQ ID NO: 343202 - DNA, 25 bp, Rattus norvegicus
gagctagcttctccaagttgtcctt

SEQ ID NO: 343203 - DNA, 25 bp, Rattus norvegicus
gagctagcttctgcaagttgtcctt

SEQ ID NO: 343204 - DNA, 25 bp, Rattus norvegicus
gagctaggaaaaagcccctccctgt

SEQ ID NO: 343205 - DNA, 25 bp, Rattus norvegicus
gagctaggaaaatgcccctccctgt

SEQ ID NO: 343206 - DNA, 25 bp, Rattus norvegicus
gagctaggagccctgatatttccct

SEQ ID NO: 343207 - DNA, 25 bp, Rattus norvegicus
gagctaggagccgtgatatttccct

SEQ ID NO: 343208 - DNA, 25 bp, Rattus norvegicus
gagctaggattcacattgaattctt

SEQ ID NO: 343209 - DNA, 25 bp, Rattus norvegicus
gagctaggattctcattgaattctt

SEQ ID NO: 343210 - DNA, 25 bp, Rattus norvegicus
gagctaggcagactgatatatacct

SEQ ID NO: 343211 - DNA, 25 bp, Rattus norvegicus
gagctaggcagagtgatatatacct

SEQ ID NO: 343212 - DNA, 25 bp, Rattus norvegicus
gagctaggccttaatatgtactgag

SEQ ID NO: 343213 - DNA, 25 bp, Rattus norvegicus
gagctaggcctttatatgtactgag

SEQ ID NO: 343214 - DNA, 25 bp, Rattus norvegicus
gagctaggtagacggcaagccttcc

SEQ ID NO: 343215 - DNA, 25 bp, Rattus norvegicus
gagctaggtagagggcaagccttcc

SEQ ID NO: 343216 - DNA, 25 bp, Rattus norvegicus
gagctaggtccaagtttctgtctta

SEQ ID NO: 343217 - DNA, 25 bp, Rattus norvegicus
gagctaggtccatgtttctgtctta

SEQ ID NO: 343218 - DNA, 25 bp, Rattus norvegicus
gagctagtaacaaagcctgcaagta

SEQ ID NO: 343219 - DNA, 25 bp, Rattus norvegicus
gagctagtaacatagcctgcaagta

SEQ ID NO: 343220 - DNA, 25 bp, Rattus norvegicus
gagctagtactccataggcatgtat

SEQ ID NO: 343221 - DNA, 25 bp, Rattus norvegicus
gagctagtactcgataggcatgtat

SEQ ID NO: 343222 - DNA, 25 bp, Rattus norvegicus
gagctagtattgcagtgtcacccga

SEQ ID NO: 343223 - DNA, 25 bp, Rattus norvegicus
gagctagtattggagtgtcacccga

SEQ ID NO: 343224 - DNA, 25 bp, Rattus norvegicus
gagctagtcatcattcagccaatgt

SEQ ID NO: 343225 - DNA, 25 bp, Rattus norvegicus
gagctagtcatctttcagccaatgt

SEQ ID NO: 343226 - DNA, 25 bp, Rattus norvegicus
gagctagtcccgaggagagcaacgt

SEQ ID NO: 343227 - DNA, 25 bp, Rattus norvegicus
gagctagtcccgtggagagcaacgt

SEQ ID NO: 343228 - DNA, 25 bp, Rattus norvegicus
gagctagtcctgaccacctggtgtt

SEQ ID NO: 343229 - DNA, 25 bp, Rattus norvegicus
gagctagtcctgtccacctggtgtt

SEQ ID NO: 343230 - DNA, 25 bp, Rattus norvegicus
gagctagtgcggagtaatgttccca

SEQ ID NO: 343231 - DNA, 25 bp, Rattus norvegicus
gagctagtgcggtgtaatgttccca

SEQ ID NO: 343232 - DNA, 25 bp, Rattus norvegicus
gagctagtgtctcaggcccgaaatg

SEQ ID NO: 343233 - DNA, 25 bp, Rattus norvegicus
gagctagtgtctgaggcccgaaatg

SEQ ID NO: 343234 - DNA, 25 bp, Rattus norvegicus
gagctagttctcatgggcaaccaac

SEQ ID NO: 343235 - DNA, 25 bp, Rattus norvegicus
gagctagttctcttgggcaaccaac

SEQ ID NO: 343236 - DNA, 25 bp, Rattus norvegicus
gagctagtttgtagtgactcactgc

SEQ ID NO: 343237 - DNA, 25 bp, Rattus norvegicus
gagctagtttgttgtgactcactgc

SEQ ID NO: 343238 - DNA, 25 bp, Rattus norvegicus
gagctataactaatactggtcagga

SEQ ID NO: 343239 - DNA, 25 bp, Rattus norvegicus
gagctataactattactggtcagga

SEQ ID NO: 343240 - DNA, 25 bp, Rattus norvegicus
gagctatacctgcaggctaaccgga

SEQ ID NO: 343241 - DNA, 25 bp, Rattus norvegicus
gagctatacctggaggctaaccgga

SEQ ID NO: 343242 - DNA, 25 bp, Rattus norvegicus
gagctataccttcttcattgacatc

SEQ ID NO: 343243 - DNA, 25 bp, Rattus norvegicus
gagctataccttgttcattgacatc

SEQ ID NO: 343244 - DNA, 25 bp, Rattus norvegicus
gagctatagattccttgtcctgcct

SEQ ID NO: 343245 - DNA, 25 bp, Rattus norvegicus
gagctatagattgcttgtcctgcct

SEQ ID NO: 343246 - DNA, 25 bp, Rattus norvegicus
gagctatagcatagatttccccagg

SEQ ID NO: 343247 - DNA, 25 bp, Rattus norvegicus
gagctatagcattgatttccccagg

SEQ ID NO: 343248 - DNA, 25 bp, Rattus norvegicus
gagctatagcctcactgcagagttg

SEQ ID NO: 343249 - DNA, 25 bp, Rattus norvegicus
gagctatagcctgactgcagagttg

SEQ ID NO: 343250 - DNA, 25 bp, Rattus norvegicus
gagctatatagtactgttccacaga

SEQ ID NO: 343251 - DNA, 25 bp, Rattus norvegicus
gagctatatagttctgttccacaga

SEQ ID NO: 343252 - DNA, 25 bp, Rattus norvegicus
gagctatcacgtaggttttacacga

SEQ ID NO: 343253 - DNA, 25 bp, Rattus norvegicus
gagctatcacgttggttttacacga

SEQ ID NO: 343254 - DNA, 25 bp, Rattus norvegicus
gagctatctaggatgataccaccga

SEQ ID NO: 343255 - DNA, 25 bp, Rattus norvegicus
gagctatctaggttgataccaccga

SEQ ID NO: 343256 - DNA, 25 bp, Rattus norvegicus
gagctatctcccagaaagtggacga

SEQ ID NO: 343257 - DNA, 25 bp, Rattus norvegicus
gagctatctccctgaaagtggacga

SEQ ID NO: 343258 - DNA, 25 bp, Rattus norvegicus
gagctatctctgcttttactttaag

SEQ ID NO: 343259 - DNA, 25 bp, Rattus norvegicus
gagctatctctggttttactttaag

SEQ ID NO: 343260 - DNA, 25 bp, Rattus norvegicus
gagctatctgctactctgtttgaat

SEQ ID NO: 343261 - DNA, 25 bp, Rattus norvegicus
gagctatctgcttctctgtttgaat

SEQ ID NO: 343262 - DNA, 25 bp, Rattus norvegicus
gagctatgcaggactcatctctggg

SEQ ID NO: 343263 - DNA, 25 bp, Rattus norvegicus
gagctatgcaggtctcatctctggg

SEQ ID NO: 343264 - DNA, 25 bp, Rattus norvegicus
gagctatgcctccatcaggtcgtat

SEQ ID NO: 343265 - DNA, 25 bp, Rattus norvegicus
gagctatgcctcgatcaggtcgtat

SEQ ID NO: 343266 - DNA, 25 bp, Rattus norvegicus
gagctatgcggaatacatcagtgct

SEQ ID NO: 343267 - DNA, 25 bp, Rattus norvegicus
gagctatgcggattacatcagtgct

SEQ ID NO: 343268 - DNA, 25 bp, Rattus norvegicus
gagctatggaggaaagccgccccga

SEQ ID NO: 343269 - DNA, 25 bp, Rattus norvegicus
gagctatggaggtaagccgccccga

SEQ ID NO: 343270 - DNA, 25 bp, Rattus norvegicus
gagctatggctcactgactactgtg

SEQ ID NO: 343271 - DNA, 25 bp, Rattus norvegicus
gagctatggctctctgactactgtg

SEQ ID NO: 343272 - DNA, 25 bp, Rattus norvegicus
gagctatgggatatgccacactcaa

SEQ ID NO: 343273 - DNA, 25 bp, Rattus norvegicus
gagctatgggatttgccacactcaa

SEQ ID NO: 343274 - DNA, 25 bp, Rattus norvegicus
gagctatgtaagactcttgcctcaa

SEQ ID NO: 343275 - DNA, 25 bp, Rattus norvegicus
gagctatgtaagtctcttgcctcaa

SEQ ID NO: 343276 - DNA, 25 bp, Rattus norvegicus
gagctatgtgatatctcctctcatt

SEQ ID NO: 343277 - DNA, 25 bp, Rattus norvegicus
gagctatgtgatttctcctctcatt

SEQ ID NO: 343278 - DNA, 25 bp, Rattus norvegicus
gagctatgtgcaaccaatgacttgt

SEQ ID NO: 343279 - DNA, 25 bp, Rattus norvegicus
gagctatgtgcatccaatgacttgt

SEQ ID NO: 343280 - DNA, 25 bp, Rattus norvegicus
gagctattccaacgagcagcacagg

SEQ ID NO: 343281 - DNA, 25 bp, Rattus norvegicus
gagctattccaaggagcagcacagg

SEQ ID NO: 343282 - DNA, 25 bp, Rattus norvegicus
gagctattgactctggtgcagcgta

SEQ ID NO: 343283 - DNA, 25 bp, Rattus norvegicus
gagctattgactgtggtgcagcgta

SEQ ID NO: 343284 - DNA, 25 bp, Rattus norvegicus
gagctattgtacacagggcatcttc

SEQ ID NO: 343285 - DNA, 25 bp, Rattus norvegicus
gagctattgtactcagggcatcttc

SEQ ID NO: 343286 - DNA, 25 bp, Rattus norvegicus
gagctattgtccacttttagaagtg

SEQ ID NO: 343287 - DNA, 25 bp, Rattus norvegicus
gagctattgtcctcttttagaagtg

SEQ ID NO: 343288 - DNA, 25 bp, Rattus norvegicus
gagctcaaacatagactctcttaca

SEQ ID NO: 343289 - DNA, 25 bp, Rattus norvegicus
gagctcaaacattgactctcttaca

SEQ ID NO: 343290 - DNA, 25 bp, Rattus norvegicus
gagctcaaacggcttagtgcttttt

SEQ ID NO: 343291 - DNA, 25 bp, Rattus norvegicus
gagctcaaacgggttagtgcttttt

SEQ ID NO: 343292 - DNA, 25 bp, Rattus norvegicus
gagctcaaacgtaacagcatcccac

SEQ ID NO: 343293 - DNA, 25 bp, Rattus norvegicus
gagctcaaacgttacagcatcccac

SEQ ID NO: 343294 - DNA, 25 bp, Rattus norvegicus
gagctcaaagataacctcagccaat

SEQ ID NO: 343295 - DNA, 25 bp, Rattus norvegicus
gagctcaaagattacctcagccaat

SEQ ID NO: 343296 - DNA, 25 bp, Rattus norvegicus
gagctcaaaggcatcaccagtctta

SEQ ID NO: 343297 - DNA, 25 bp, Rattus norvegicus
gagctcaaaggcttcaccagtctta

SEQ ID NO: 343298 - DNA, 25 bp, Rattus norvegicus
gagctcaaagtgacccaggttctca

SEQ ID NO: 343299 - DNA, 25 bp, Rattus norvegicus
gagctcaaagtgtcccaggttctca

SEQ ID NO: 343300 - DNA, 25 bp, Rattus norvegicus
gagctcaaattgaccgactatcgtg

SEQ ID NO: 343301 - DNA, 25 bp, Rattus norvegicus
gagctcaaattgtccgactatcgtg

SEQ ID NO: 343302 - DNA, 25 bp, Rattus norvegicus
gagctcaacacaatgggaagaagcc

SEQ ID NO: 343303 - DNA, 25 bp, Rattus norvegicus
gagctcaacacattgggaagaagcc

SEQ ID NO: 343304 - DNA, 25 bp, Rattus norvegicus
gagctcaacaggacagagaatctct

SEQ ID NO: 343305 - DNA, 25 bp, Rattus norvegicus
gagctcaacaggtcagagaatctct

SEQ ID NO: 343306 - DNA, 25 bp, Rattus norvegicus
gagctcaagagtccctgccttatgc

SEQ ID NO: 343307 - DNA, 25 bp, Rattus norvegicus
gagctcaagagtgcctgccttatgc

SEQ ID NO: 343308 - DNA, 25 bp, Rattus norvegicus
gagctcaagatgagtggcagttttc

SEQ ID NO: 343309 - DNA, 25 bp, Rattus norvegicus
gagctcaagatgtgtggcagttttc

SEQ ID NO: 343310 - DNA, 25 bp, Rattus norvegicus
gagctcaagcaaagatccagggaac

SEQ ID NO: 343311 - DNA, 25 bp, Rattus norvegicus
gagctcaagcaatgatccagggaac

SEQ ID NO: 343312 - DNA, 25 bp, Rattus norvegicus
gagctcaaggcccaggaatccgaga

SEQ ID NO: 343313 - DNA, 25 bp, Rattus norvegicus
gagctcaaggccgaggaatccgaga

SEQ ID NO: 343314 - DNA, 25 bp, Rattus norvegicus
gagctcaagtcaagcctttaacaaa

SEQ ID NO: 343315 - DNA, 25 bp, Rattus norvegicus
gagctcaagtcatgcctttaacaaa

SEQ ID NO: 343316 - DNA, 25 bp, Rattus norvegicus
gagctcaagtctcacagggtccagc

SEQ ID NO: 343317 - DNA, 25 bp, Rattus norvegicus
gagctcaagtctgacagggtccagc

SEQ ID NO: 343318 - DNA, 25 bp, Rattus norvegicus
gagctcaagttgataccctggttct

SEQ ID NO: 343319 - DNA, 25 bp, Rattus norvegicus
gagctcaagttgttaccctggttct

SEQ ID NO: 343320 - DNA, 25 bp, Rattus norvegicus
gagctcaatagaagcagccagcaca

SEQ ID NO: 343321 - DNA, 25 bp, Rattus norvegicus
gagctcaatagatgcagccagcaca

SEQ ID NO: 343322 - DNA, 25 bp, Rattus norvegicus
gagctcaatgataatgcatcacatg

SEQ ID NO: 343323 - DNA, 25 bp, Rattus norvegicus
gagctcaatgattatgcatcacatg

SEQ ID NO: 343324 - DNA, 25 bp, Rattus norvegicus
gagctcaatgttctgatatttctaa

SEQ ID NO: 343325 - DNA, 25 bp, Rattus norvegicus
gagctcaatgttgtgatatttctaa

SEQ ID NO: 343326 - DNA, 25 bp, Rattus norvegicus
gagctcacacacattccagtggtta

SEQ ID NO: 343327 - DNA, 25 bp, Rattus norvegicus
gagctcacacactttccagtggtta

SEQ ID NO: 343328 - DNA, 25 bp, Rattus norvegicus
gagctcacacttaagacctcaaagt

SEQ ID NO: 343329 - DNA, 25 bp, Rattus norvegicus
gagctcacactttagacctcaaagt

SEQ ID NO: 343330 - DNA, 25 bp, Rattus norvegicus
gagctcacatacacagtaccatatg

SEQ ID NO: 343331 - DNA, 25 bp, Rattus norvegicus
gagctcacatactcagtaccatatg

SEQ ID NO: 343332 - DNA, 25 bp, Rattus norvegicus
gagctcacatcgacaactacaagta

SEQ ID NO: 343333 - DNA, 25 bp, Rattus norvegicus
gagctcacatcgtcaactacaagta

SEQ ID NO: 343334 - DNA, 25 bp, Rattus norvegicus
gagctcaccaagaccatcaatgaca

SEQ ID NO: 343335 - DNA, 25 bp, Rattus norvegicus
gagctcaccaagtccatcaatgaca

SEQ ID NO: 343336 - DNA, 25 bp, Rattus norvegicus
gagctcaccaccctcactaaagatg

SEQ ID NO: 343337 - DNA, 25 bp, Rattus norvegicus
gagctcaccaccgtcactaaagatg

SEQ ID NO: 343338 - DNA, 25 bp, Rattus norvegicus
gagctcaccagcagagggctgctct

SEQ ID NO: 343339 - DNA, 25 bp, Rattus norvegicus
gagctcaccagctgagggctgctct

SEQ ID NO: 343340 - DNA, 25 bp, Rattus norvegicus
gagctcacctgaatctctagagtaa

SEQ ID NO: 343341 - DNA, 25 bp, Rattus norvegicus
gagctcacctgattctctagagtaa

SEQ ID NO: 343342 - DNA, 25 bp, Rattus norvegicus
gagctcacggaacactgttcctgca

SEQ ID NO: 343343 - DNA, 25 bp, Rattus norvegicus
gagctcacggaagactgttcctgca

SEQ ID NO: 343344 - DNA, 25 bp, Rattus norvegicus
gagctcactccacttatgtgcaata

SEQ ID NO: 343345 - DNA, 25 bp, Rattus norvegicus
gagctcactccagttatgtgcaata

SEQ ID NO: 343346 - DNA, 25 bp, Rattus norvegicus
gagctcactgatccggttagtctta

SEQ ID NO: 343347 - DNA, 25 bp, Rattus norvegicus
gagctcactgatgcggttagtctta

SEQ ID NO: 343348 - DNA, 25 bp, Rattus norvegicus
gagctcagaaagatcagccgtgcct

SEQ ID NO: 343349 - DNA, 25 bp, Rattus norvegicus
gagctcagaaagttcagccgtgcct

SEQ ID NO: 343350 - DNA, 25 bp, Rattus norvegicus
gagctcagaagccatcacacaggtt

SEQ ID NO: 343351 - DNA, 25 bp, Rattus norvegicus
gagctcagaagcgatcacacaggtt

SEQ ID NO: 343352 - DNA, 25 bp, Rattus norvegicus
gagctcagaccactgcaaaccagaa

SEQ ID NO: 343353 - DNA, 25 bp, Rattus norvegicus
gagctcagaccagtgcaaaccagaa

SEQ ID NO: 343354 - DNA, 25 bp, Rattus norvegicus
gagctcagacccaagttagacctag

SEQ ID NO: 343355 - DNA, 25 bp, Rattus norvegicus
gagctcagaccctagttagacctag

SEQ ID NO: 343356 - DNA, 25 bp, Rattus norvegicus
gagctcagactgcttagtcctacag

SEQ ID NO: 343357 - DNA, 25 bp, Rattus norvegicus
gagctcagactggttagtcctacag

SEQ ID NO: 343358 - DNA, 25 bp, Rattus norvegicus
gagctcagagcaacatccttctggg

SEQ ID NO: 343359 - DNA, 25 bp, Rattus norvegicus
gagctcagagcatcatccttctggg

SEQ ID NO: 343360 - DNA, 25 bp, Rattus norvegicus
gagctcagagctcatggctagccga

SEQ ID NO: 343361 - DNA, 25 bp, Rattus norvegicus
gagctcagagctgatggctagccga

SEQ ID NO: 343362 - DNA, 25 bp, Rattus norvegicus
gagctcagcactatgactggatgga

SEQ ID NO: 343363 - DNA, 25 bp, Rattus norvegicus
gagctcagcactttgactggatgga

SEQ ID NO: 343364 - DNA, 25 bp, Rattus norvegicus
gagctcagcatgaagcgaggcttgc

SEQ ID NO: 343365 - DNA, 25 bp, Rattus norvegicus
gagctcagcatgtagcgaggcttgc

SEQ ID NO: 343366 - DNA, 25 bp, Rattus norvegicus
gagctcagccagagcccggtgtttg

SEQ ID NO: 343367 - DNA, 25 bp, Rattus norvegicus
gagctcagccagagtcagttatttg

SEQ ID NO: 343368 - DNA, 25 bp, Rattus norvegicus
gagctcagccagtgcccggtgtttg

SEQ ID NO: 343369 - DNA, 25 bp, Rattus norvegicus
gagctcagccagtgtcagttatttg

SEQ ID NO: 343370 - DNA, 25 bp, Rattus norvegicus
gagctcagccgcatgcaggacagtg

SEQ ID NO: 343371 - DNA, 25 bp, Rattus norvegicus
gagctcagccgccatctggtcaaaa

SEQ ID NO: 343372 - DNA, 25 bp, Rattus norvegicus
gagctcagccgcgatctggtcaaaa

SEQ ID NO: 343373 - DNA, 25 bp, Rattus norvegicus
gagctcagccgcttgcaggacagtg

SEQ ID NO: 343374 - DNA, 25 bp, Rattus norvegicus
gagctcagcctaagtccctataaaa

SEQ ID NO: 343375 - DNA, 25 bp, Rattus norvegicus
gagctcagcctatgtccctataaaa

SEQ ID NO: 343376 - DNA, 25 bp, Rattus norvegicus
gagctcagcggactctgtaatccac

SEQ ID NO: 343377 - DNA, 25 bp, Rattus norvegicus
gagctcagcggagtctgtaatccac

SEQ ID NO: 343378 - DNA, 25 bp, Rattus norvegicus
gagctcagctgcactatctagaggg

SEQ ID NO: 343379 - DNA, 25 bp, Rattus norvegicus
gagctcagctgctctatctagaggg

SEQ ID NO: 343380 - DNA, 25 bp, Rattus norvegicus
gagctcaggagaaggtgttcccaga

SEQ ID NO: 343381 - DNA, 25 bp, Rattus norvegicus
gagctcaggagatggtgttcccaga

SEQ ID NO: 343382 - DNA, 25 bp, Rattus norvegicus
gagctcaggagtcgactacctctgc

SEQ ID NO: 343383 - DNA, 25 bp, Rattus norvegicus
gagctcaggagtggactacctctgc

SEQ ID NO: 343384 - DNA, 25 bp, Rattus norvegicus
gagctcaggatacagagttaggaac

SEQ ID NO: 343385 - DNA, 25 bp, Rattus norvegicus
gagctcaggatagagagttaggaac

SEQ ID NO: 343386 - DNA, 25 bp, Rattus norvegicus
gagctcaggattctagcccaggctg

SEQ ID NO: 343387 - DNA, 25 bp, Rattus norvegicus
gagctcaggattgtagcccaggctg

SEQ ID NO: 343388 - DNA, 25 bp, Rattus norvegicus
gagctcaggcagatcattgcagagt

SEQ ID NO: 343389 - DNA, 25 bp, Rattus norvegicus
gagctcaggcagttcattgcagagt

SEQ ID NO: 343390 - DNA, 25 bp, Rattus norvegicus
gagctcaggctcagtgaaggcaagt

SEQ ID NO: 343391 - DNA, 25 bp, Rattus norvegicus
gagctcaggctctgtgaaggcaagt

SEQ ID NO: 343392 - DNA, 25 bp, Rattus norvegicus
gagctcaggctgaatctaaaaaaca

SEQ ID NO: 343393 - DNA, 25 bp, Rattus norvegicus
gagctcaggctgatttgcatatcgg

SEQ ID NO: 343394 - DNA, 25 bp, Rattus norvegicus
gagctcaggctgtatctaaaaaaca

SEQ ID NO: 343395 - DNA, 25 bp, Rattus norvegicus
gagctcaggctgttttgcatatcgg

SEQ ID NO: 343396 - DNA, 25 bp, Rattus norvegicus
gagctcaggtcaacagcttcatcaa

SEQ ID NO: 343397 - DNA, 25 bp, Rattus norvegicus
gagctcaggtcatcagcttcatcaa

SEQ ID NO: 343398 - DNA, 25 bp, Rattus norvegicus
gagctcaggtgaagccggccaccag

SEQ ID NO: 343399 - DNA, 25 bp, Rattus norvegicus
gagctcaggtgatgccggccaccag

SEQ ID NO: 343400 - DNA, 25 bp, Rattus norvegicus
gagctcaggtttcactcatcatcaa

SEQ ID NO: 343401 - DNA, 25 bp, Rattus norvegicus
gagctcaggtttgactcatcatcaa

SEQ ID NO: 343402 - DNA, 25 bp, Rattus norvegicus
gagctcagtaatctcctctcaggga

SEQ ID NO: 343403 - DNA, 25 bp, Rattus norvegicus
gagctcagtaatctgactgcaccca

SEQ ID NO: 343404 - DNA, 25 bp, Rattus norvegicus
gagctcagtaatgtcctctcaggga

SEQ ID NO: 343405 - DNA, 25 bp, Rattus norvegicus
gagctcagtaatgtgactgcaccca

SEQ ID NO: 343406 - DNA, 25 bp, Rattus norvegicus
gagctcagtcttaggcagtaaaacc

SEQ ID NO: 343407 - DNA, 25 bp, Rattus norvegicus
gagctcagtctttggcagtaaaacc

SEQ ID NO: 343408 - DNA, 25 bp, Rattus norvegicus
gagctcagtgaaaggtcaactcgct

SEQ ID NO: 343409 - DNA, 25 bp, Rattus norvegicus
gagctcagtgaatggtcaactcgct

SEQ ID NO: 343410 - DNA, 25 bp, Rattus norvegicus
gagctcagtgataggccttcgtata

SEQ ID NO: 343411 - DNA, 25 bp, Rattus norvegicus
gagctcagtgattggccttcgtata

SEQ ID NO: 343412 - DNA, 25 bp, Rattus norvegicus
gagctcagtgcaaacaatcttaaca

SEQ ID NO: 343413 - DNA, 25 bp, Rattus norvegicus
gagctcagtgcatacaatcttaaca

SEQ ID NO: 343414 - DNA, 25 bp, Rattus norvegicus
gagctcagtgtaccctcaggagaca

SEQ ID NO: 343415 - DNA, 25 bp, Rattus norvegicus
gagctcagtgtagcctcaggagaca

SEQ ID NO: 343416 - DNA, 25 bp, Rattus norvegicus
gagctcatccagctggtcaacaagg

SEQ ID NO: 343417 - DNA, 25 bp, Rattus norvegicus
gagctcatccaggtggtcaacaagg

SEQ ID NO: 343418 - DNA, 25 bp, Rattus norvegicus
gagctcatcgagaactttgtccatg

SEQ ID NO: 343419 - DNA, 25 bp, Rattus norvegicus
gagctcatcgagtactttgtccatg

SEQ ID NO: 343420 - DNA, 25 bp, Rattus norvegicus
gagctcatcgtacacctaggcgatt

SEQ ID NO: 343421 - DNA, 25 bp, Rattus norvegicus
gagctcatcgtagacctaggcgatt

SEQ ID NO: 343422 - DNA, 25 bp, Rattus norvegicus
gagctcatctacaaacgaggctatg

SEQ ID NO: 343423 - DNA, 25 bp, Rattus norvegicus
gagctcatctactaacgaggctatg

SEQ ID NO: 343424 - DNA, 25 bp, Rattus norvegicus
gagctcatcttcaggcaggttctag

SEQ ID NO: 343425 - DNA, 25 bp, Rattus norvegicus
gagctcatcttctggcaggttctag

SEQ ID NO: 343426 - DNA, 25 bp, Rattus norvegicus
gagctcatgaacaagacccggacag

SEQ ID NO: 343427 - DNA, 25 bp, Rattus norvegicus
gagctcatgaactagacccggacag

SEQ ID NO: 343428 - DNA, 25 bp, Rattus norvegicus
gagctcatgggacgctaacggcttc

SEQ ID NO: 343429 - DNA, 25 bp, Rattus norvegicus
gagctcatgggaggctaacggcttc

SEQ ID NO: 343430 - DNA, 25 bp, Rattus norvegicus
gagctcatgtgcacattagtccgca

SEQ ID NO: 343431 - DNA, 25 bp, Rattus norvegicus
gagctcatgtgctcattagtccgca

SEQ ID NO: 343432 - DNA, 25 bp, Rattus norvegicus
gagctcatgttcatcttgtgggcac

SEQ ID NO: 343433 - DNA, 25 bp, Rattus norvegicus
gagctcatgttcttcttgtgggcac

SEQ ID NO: 343434 - DNA, 25 bp, Rattus norvegicus
gagctcattaaaccttctattcctt

SEQ ID NO: 343435 - DNA, 25 bp, Rattus norvegicus
gagctcattaaagcttctattcctt

SEQ ID NO: 343436 - DNA, 25 bp, Rattus norvegicus
gagctcattgacaatttggtggttc

SEQ ID NO: 343437 - DNA, 25 bp, Rattus norvegicus
gagctcattgactatttggtggttc

SEQ ID NO: 343438 - DNA, 25 bp, Rattus norvegicus
gagctcattgagacccatagcttca

SEQ ID NO: 343439 - DNA, 25 bp, Rattus norvegicus
gagctcattgagtcccatagcttca

SEQ ID NO: 343440 - DNA, 25 bp, Rattus norvegicus
gagctcattggaaaccttgtcggac

SEQ ID NO: 343441 - DNA, 25 bp, Rattus norvegicus
gagctcattggataccttgtcggac

SEQ ID NO: 343442 - DNA, 25 bp, Rattus norvegicus
gagctcattgtaccccattctattc

SEQ ID NO: 343443 - DNA, 25 bp, Rattus norvegicus
gagctcattgtagcccattctattc

SEQ ID NO: 343444 - DNA, 25 bp, Rattus norvegicus
gagctcatttacacacctgaagttt

SEQ ID NO: 343445 - DNA, 25 bp, Rattus norvegicus
gagctcatttactcacctgaagttt

SEQ ID NO: 343446 - DNA, 25 bp, Rattus norvegicus
gagctcatttgtatccgtcgctttt

SEQ ID NO: 343447 - DNA, 25 bp, Rattus norvegicus
gagctcatttgtcctcaagtagaaa

SEQ ID NO: 343448 - DNA, 25 bp, Rattus norvegicus
gagctcatttgtgctcaagtagaaa

SEQ ID NO: 343449 - DNA, 25 bp, Rattus norvegicus
gagctcatttgtttccgtcgctttt

SEQ ID NO: 343450 - DNA, 25 bp, Rattus norvegicus
gagctccaaagaattcttcctagca

SEQ ID NO: 343451 - DNA, 25 bp, Rattus norvegicus
gagctccaaagatttcttcctagca

SEQ ID NO: 343452 - DNA, 25 bp, Rattus norvegicus
gagctccaagatcctgcagatcaat

SEQ ID NO: 343453 - DNA, 25 bp, Rattus norvegicus
gagctccaagatgctgcagatcaat

SEQ ID NO: 343454 - DNA, 25 bp, Rattus norvegicus
gagctccaagccagggtcagctgta

SEQ ID NO: 343455 - DNA, 25 bp, Rattus norvegicus
gagctccaagcctgggtcagctgta

SEQ ID NO: 343456 - DNA, 25 bp, Rattus norvegicus
gagctccacaagatgcagttccgcc

SEQ ID NO: 343457 - DNA, 25 bp, Rattus norvegicus
gagctccacaagttgcagttccgcc

SEQ ID NO: 343458 - DNA, 25 bp, Rattus norvegicus
gagctccacagtactgacatagggt

SEQ ID NO: 343459 - DNA, 25 bp, Rattus norvegicus
gagctccacagttctgacatagggt

SEQ ID NO: 343460 - DNA, 25 bp, Rattus norvegicus
gagctccacgttctgaccaaaaagg

SEQ ID NO: 343461 - DNA, 25 bp, Rattus norvegicus
gagctccacgttgtgaccaaaaagg

SEQ ID NO: 343462 - DNA, 25 bp, Rattus norvegicus
gagctccactgtagactgttaggtg

SEQ ID NO: 343463 - DNA, 25 bp, Rattus norvegicus
gagctccactgttgactgttaggtg

SEQ ID NO: 343464 - DNA, 25 bp, Rattus norvegicus
gagctccagcatccctcagagagaa

SEQ ID NO: 343465 - DNA, 25 bp, Rattus norvegicus
gagctccagcatgcctcagagagaa

SEQ ID NO: 343466 - DNA, 25 bp, Rattus norvegicus
gagctccagctgacatagtatatga

SEQ ID NO: 343467 - DNA, 25 bp, Rattus norvegicus
gagctccagctgtcatagtatatga

SEQ ID NO: 343468 - DNA, 25 bp, Rattus norvegicus
gagctccaggcacacagttccacgg

SEQ ID NO: 343469 - DNA, 25 bp, Rattus norvegicus
gagctccaggcagacagttccacgg

SEQ ID NO: 343470 - DNA, 25 bp, Rattus norvegicus
gagctccagtggaaagtgataaatt

SEQ ID NO: 343471 - DNA, 25 bp, Rattus norvegicus
gagctccagtggtaagtgataaatt

SEQ ID NO: 343472 - DNA, 25 bp, Rattus norvegicus
gagctccatccgctgagtgtctgtc

SEQ ID NO: 343473 - DNA, 25 bp, Rattus norvegicus
gagctccatccggtgagtgtctgtc

SEQ ID NO: 343474 - DNA, 25 bp, Rattus norvegicus
gagctccatgaacaggtgaccctga

SEQ ID NO: 343475 - DNA, 25 bp, Rattus norvegicus
gagctccatgaagaggtgaccctga

SEQ ID NO: 343476 - DNA, 25 bp, Rattus norvegicus
gagctccatgtacggttcctataac

SEQ ID NO: 343477 - DNA, 25 bp, Rattus norvegicus
gagctccatgtagggttcctataac

SEQ ID NO: 343478 - DNA, 25 bp, Rattus norvegicus
gagctcccacaaaaatgtctgccca

SEQ ID NO: 343479 - DNA, 25 bp, Rattus norvegicus
gagctcccacaataatgtctgccca

SEQ ID NO: 343480 - DNA, 25 bp, Rattus norvegicus
gagctcccaggtcatgctgttatta

SEQ ID NO: 343481 - DNA, 25 bp, Rattus norvegicus
gagctcccaggtgatgctgttatta

SEQ ID NO: 343482 - DNA, 25 bp, Rattus norvegicus
gagctcccatgtatcatcaagtgtt

SEQ ID NO: 343483 - DNA, 25 bp, Rattus norvegicus
gagctcccatgtttcatcaagtgtt

SEQ ID NO: 343484 - DNA, 25 bp, Rattus norvegicus
gagctccctctccagcaagatattt

SEQ ID NO: 343485 - DNA, 25 bp, Rattus norvegicus
gagctccctctcgagcaagatattt

SEQ ID NO: 343486 - DNA, 25 bp, Rattus norvegicus
gagctccctctgagtcaggagacat

SEQ ID NO: 343487 - DNA, 25 bp, Rattus norvegicus
gagctccctctgtgtcaggagacat

SEQ ID NO: 343488 - DNA, 25 bp, Rattus norvegicus
gagctccctgaacgatgaacgccat

SEQ ID NO: 343489 - DNA, 25 bp, Rattus norvegicus
gagctccctgaaggatgaacgccat

SEQ ID NO: 343490 - DNA, 25 bp, Rattus norvegicus
gagctcccttttcaagttatgccag

SEQ ID NO: 343491 - DNA, 25 bp, Rattus norvegicus
gagctcccttttgaagttatgccag

SEQ ID NO: 343492 - DNA, 25 bp, Rattus norvegicus
gagctccgagccctgagtaacaaga

SEQ ID NO: 343493 - DNA, 25 bp, Rattus norvegicus
gagctccgagccgtgagtaacaaga

SEQ ID NO: 343494 - DNA, 25 bp, Rattus norvegicus
gagctccgccatatggaacatcaat

SEQ ID NO: 343495 - DNA, 25 bp, Rattus norvegicus
gagctccgccatttggaacatcaat

SEQ ID NO: 343496 - DNA, 25 bp, Rattus norvegicus
gagctccgcgagagacatttgttca

SEQ ID NO: 343497 - DNA, 25 bp, Rattus norvegicus
gagctccgcgagtgacatttgttca

SEQ ID NO: 343498 - DNA, 25 bp, Rattus norvegicus
gagctccgcgatcgattccagcatg

SEQ ID NO: 343499 - DNA, 25 bp, Rattus norvegicus
gagctccgcgatggattccagcatg

SEQ ID NO: 343500 - DNA, 25 bp, Rattus norvegicus
gagctccgtttgagagctgtaccag

SEQ ID NO: 343501 - DNA, 25 bp, Rattus norvegicus
gagctccgtttgtgagctgtaccag

SEQ ID NO: 343502 - DNA, 25 bp, Rattus norvegicus
gagctcctcaaaactaagaccactg

SEQ ID NO: 343503 - DNA, 25 bp, Rattus norvegicus
gagctcctcaaaagccaaggcttga

SEQ ID NO: 343504 - DNA, 25 bp, Rattus norvegicus
gagctcctcaaatctaagaccactg

SEQ ID NO: 343505 - DNA, 25 bp, Rattus norvegicus
gagctcctcaaatgccaaggcttga

SEQ ID NO: 343506 - DNA, 25 bp, Rattus norvegicus
gagctcctcacaagggcgtcaagag

SEQ ID NO: 343507 - DNA, 25 bp, Rattus norvegicus
gagctcctcacatgggcgtcaagag

SEQ ID NO: 343508 - DNA, 25 bp, Rattus norvegicus
gagctcctcagacgcttctgtttaa

SEQ ID NO: 343509 - DNA, 25 bp, Rattus norvegicus
gagctcctcagaggcttctgtttaa

SEQ ID NO: 343510 - DNA, 25 bp, Rattus norvegicus
gagctcctccatccagaaagccaaa

SEQ ID NO: 343511 - DNA, 25 bp, Rattus norvegicus
gagctcctccatgcagaaagccaaa

SEQ ID NO: 343512 - DNA, 25 bp, Rattus norvegicus
gagctcctgaggcaaatagcgcaga

SEQ ID NO: 343513 - DNA, 25 bp, Rattus norvegicus
gagctcctgagggaaatagcgcaga

SEQ ID NO: 343514 - DNA, 25 bp, Rattus norvegicus
gagctcctgatgagctgtcacctga

SEQ ID NO: 343515 - DNA, 25 bp, Rattus norvegicus
gagctcctgatgtgctgtcacctga

SEQ ID NO: 343516 - DNA, 25 bp, Rattus norvegicus
gagctcctggcgacacagttggtga

SEQ ID NO: 343517 - DNA, 25 bp, Rattus norvegicus
gagctcctggcgtcacagttggtga

SEQ ID NO: 343518 - DNA, 25 bp, Rattus norvegicus
gagctcctggctaagataagatatt

SEQ ID NO: 343519 - DNA, 25 bp, Rattus norvegicus
gagctcctggcttagataagatatt

SEQ ID NO: 343520 - DNA, 25 bp, Rattus norvegicus
gagctcctgtcacggcatatatgca

SEQ ID NO: 343521 - DNA, 25 bp, Rattus norvegicus
gagctcctgtcagggcatatatgca

SEQ ID NO: 343522 - DNA, 25 bp, Rattus norvegicus
gagctcctgtgcagatgggccacgt

SEQ ID NO: 343523 - DNA, 25 bp, Rattus norvegicus
gagctcctgtgctgatgggccacgt

SEQ ID NO: 343524 - DNA, 25 bp, Rattus norvegicus
gagctccttagtcacctgtttggta

SEQ ID NO: 343525 - DNA, 25 bp, Rattus norvegicus
gagctccttagtgacctgtttggta

SEQ ID NO: 343526 - DNA, 25 bp, Rattus norvegicus
gagctccttattatgtattctatct

SEQ ID NO: 343527 - DNA, 25 bp, Rattus norvegicus
gagctccttattttgtattctatct

SEQ ID NO: 343528 - DNA, 25 bp, Rattus norvegicus
gagctccttgccagtgtactaagca

SEQ ID NO: 343529 - DNA, 25 bp, Rattus norvegicus
gagctccttgcctgtgtactaagca

SEQ ID NO: 343530 - DNA, 25 bp, Rattus norvegicus
gagctccttgctatcagggtttgag

SEQ ID NO: 343531 - DNA, 25 bp, Rattus norvegicus
gagctccttgctttcagggtttgag

SEQ ID NO: 343532 - DNA, 25 bp, Rattus norvegicus
gagctcgacaaaatttactcacatt

SEQ ID NO: 343533 - DNA, 25 bp, Rattus norvegicus
gagctcgacaaattttactcacatt

SEQ ID NO: 343534 - DNA, 25 bp, Rattus norvegicus
gagctcgagccaactctgaaaggaa

SEQ ID NO: 343535 - DNA, 25 bp, Rattus norvegicus
gagctcgagccatctctgaaaggaa

SEQ ID NO: 343536 - DNA, 25 bp, Rattus norvegicus
gagctcgagctcctggcaagactga

SEQ ID NO: 343537 - DNA, 25 bp, Rattus norvegicus
gagctcgagctcgtggcaagactga

SEQ ID NO: 343538 - DNA, 25 bp, Rattus norvegicus
gagctcgagttccagcgacgtcagc

SEQ ID NO: 343539 - DNA, 25 bp, Rattus norvegicus
gagctcgagttcgagcgacgtcagc

SEQ ID NO: 343540 - DNA, 25 bp, Rattus norvegicus
gagctcgcagaccatgccactgtat

SEQ ID NO: 343541 - DNA, 25 bp, Rattus norvegicus
gagctcgcagacgatgccactgtat

SEQ ID NO: 343542 - DNA, 25 bp, Rattus norvegicus
gagctcgctgaacatgtagtttaga

SEQ ID NO: 343543 - DNA, 25 bp, Rattus norvegicus
gagctcgctgaagatgtagtttaga

SEQ ID NO: 343544 - DNA, 25 bp, Rattus norvegicus
gagctcggattgatgttcacttggc

SEQ ID NO: 343545 - DNA, 25 bp, Rattus norvegicus
gagctcggattgttgttcacttggc

SEQ ID NO: 343546 - DNA, 25 bp, Rattus norvegicus
gagctcgggcacatcgggttacaga

SEQ ID NO: 343547 - DNA, 25 bp, Rattus norvegicus
gagctcgggcacttcgggttacaga

SEQ ID NO: 343548 - DNA, 25 bp, Rattus norvegicus
gagctcgggcagacaaacaacacgt

SEQ ID NO: 343549 - DNA, 25 bp, Rattus norvegicus
gagctcgggcagtcaaacaacacgt

SEQ ID NO: 343550 - DNA, 25 bp, Rattus norvegicus
gagctcgggtctctcttaaggacct

SEQ ID NO: 343551 - DNA, 25 bp, Rattus norvegicus
gagctcgggtctgtcttaaggacct

SEQ ID NO: 343552 - DNA, 25 bp, Rattus norvegicus
gagctcggttctaacaactttcttt

SEQ ID NO: 343553 - DNA, 25 bp, Rattus norvegicus
gagctcggttcttacaactttcttt

SEQ ID NO: 343554 - DNA, 25 bp, Rattus norvegicus
gagctcgtcaccattcaagttttag

SEQ ID NO: 343555 - DNA, 25 bp, Rattus norvegicus
gagctcgtcacctttcaagttttag

SEQ ID NO: 343556 - DNA, 25 bp, Rattus norvegicus
gagctcgtgctgatcctaagtggga

SEQ ID NO: 343557 - DNA, 25 bp, Rattus norvegicus
gagctcgtgctgttcctaagtggga

SEQ ID NO: 343558 - DNA, 25 bp, Rattus norvegicus
gagctcgttcttcatattttcacta

SEQ ID NO: 343559 - DNA, 25 bp, Rattus norvegicus
gagctcgttcttgatattttcacta

SEQ ID NO: 343560 - DNA, 25 bp, Rattus norvegicus
gagctcgttttaacttttgcaccat

SEQ ID NO: 343561 - DNA, 25 bp, Rattus norvegicus
gagctcgttttatcttttgcaccat

SEQ ID NO: 343562 - DNA, 25 bp, Rattus norvegicus
gagctctaacatatccacagcttgg

SEQ ID NO: 343563 - DNA, 25 bp, Rattus norvegicus
gagctctaacatttccacagcttgg

SEQ ID NO: 343564 - DNA, 25 bp, Rattus norvegicus
gagctctaacgaaatggccaccgtt

SEQ ID NO: 343565 - DNA, 25 bp, Rattus norvegicus
gagctctaacgatatggccaccgtt

SEQ ID NO: 343566 - DNA, 25 bp, Rattus norvegicus
gagctctaactcaagtaccactata

SEQ ID NO: 343567 - DNA, 25 bp, Rattus norvegicus
gagctctaactctagtaccactata

SEQ ID NO: 343568 - DNA, 25 bp, Rattus norvegicus
gagctctacacacacagcttgtgag

SEQ ID NO: 343569 - DNA, 25 bp, Rattus norvegicus
gagctctacacagacagcttgtgag

SEQ ID NO: 343570 - DNA, 25 bp, Rattus norvegicus
gagctctacagccattaagccacat

SEQ ID NO: 343571 - DNA, 25 bp, Rattus norvegicus
gagctctacagcgattaagccacat

SEQ ID NO: 343572 - DNA, 25 bp, Rattus norvegicus
gagctctactaccttaaatacgatt

SEQ ID NO: 343573 - DNA, 25 bp, Rattus norvegicus
gagctctactacgttaaatacgatt

SEQ ID NO: 343574 - DNA, 25 bp, Rattus norvegicus
gagctctactgcatcagttcatggg

SEQ ID NO: 343575 - DNA, 25 bp, Rattus norvegicus
gagctctactgcttcagttcatggg

SEQ ID NO: 343576 - DNA, 25 bp, Rattus norvegicus
gagctctagaaacattcaccaggga

SEQ ID NO: 343577 - DNA, 25 bp, Rattus norvegicus
gagctctagaaagattcaccaggga

SEQ ID NO: 343578 - DNA, 25 bp, Rattus norvegicus
gagctctagcatcgcttacatgtgt

SEQ ID NO: 343579 - DNA, 25 bp, Rattus norvegicus
gagctctagcatggcttacatgtgt

SEQ ID NO: 343580 - DNA, 25 bp, Rattus norvegicus
gagctctagccaccagtttagtgga

SEQ ID NO: 343581 - DNA, 25 bp, Rattus norvegicus
gagctctagccagcagtttagtgga

SEQ ID NO: 343582 - DNA, 25 bp, Rattus norvegicus
gagctctaggcccaaaacgacctta

SEQ ID NO: 343583 - DNA, 25 bp, Rattus norvegicus
gagctctaggccgaaaacgacctta

SEQ ID NO: 343584 - DNA, 25 bp, Rattus norvegicus
gagctctagtttctcccgtttgtaa

SEQ ID NO: 343585 - DNA, 25 bp, Rattus norvegicus
gagctctagtttgtcccgtttgtaa

SEQ ID NO: 343586 - DNA, 25 bp, Rattus norvegicus
gagctctatctcaggaacacacttg

SEQ ID NO: 343587 - DNA, 25 bp, Rattus norvegicus
gagctctatctctggaacacacttg

SEQ ID NO: 343588 - DNA, 25 bp, Rattus norvegicus
gagctctcaagcaccatactcaaag

SEQ ID NO: 343589 - DNA, 25 bp, Rattus norvegicus
gagctctcaagccagccgggatgac

SEQ ID NO: 343590 - DNA, 25 bp, Rattus norvegicus
gagctctcaagcgagccgggatgac

SEQ ID NO: 343591 - DNA, 25 bp, Rattus norvegicus
gagctctcaagctccatactcaaag

SEQ ID NO: 343592 - DNA, 25 bp, Rattus norvegicus
gagctctcagtaatcccagattaca

SEQ ID NO: 343593 - DNA, 25 bp, Rattus norvegicus
gagctctcagtattcccagattaca

SEQ ID NO: 343594 - DNA, 25 bp, Rattus norvegicus
gagctctcagttatcgctctggcat

SEQ ID NO: 343595 - DNA, 25 bp, Rattus norvegicus
gagctctcagttttcgctctggcat

SEQ ID NO: 343596 - DNA, 25 bp, Rattus norvegicus
gagctctcataacgctgtaagggca

SEQ ID NO: 343597 - DNA, 25 bp, Rattus norvegicus
gagctctcataaggctgtaagggca

SEQ ID NO: 343598 - DNA, 25 bp, Rattus norvegicus
gagctctcatttctaactcctcagc

SEQ ID NO: 343599 - DNA, 25 bp, Rattus norvegicus
gagctctcatttgtaactcctcagc

SEQ ID NO: 343600 - DNA, 25 bp, Rattus norvegicus
gagctctccagtctgtacatctgta

SEQ ID NO: 343601 - DNA, 25 bp, Rattus norvegicus
gagctctccagtgtgtacatctgta

SEQ ID NO: 343602 - DNA, 25 bp, Rattus norvegicus
gagctctccctgacagtagtggtga

SEQ ID NO: 343603 - DNA, 25 bp, Rattus norvegicus
gagctctccctgtcagtagtggtga

SEQ ID NO: 343604 - DNA, 25 bp, Rattus norvegicus
gagctctcctggaatacatacccat

SEQ ID NO: 343605 - DNA, 25 bp, Rattus norvegicus
gagctctcctggtatacatacccat

SEQ ID NO: 343606 - DNA, 25 bp, Rattus norvegicus
gagctctcgcacattttgtttatct

SEQ ID NO: 343607 - DNA, 25 bp, Rattus norvegicus
gagctctcgcactttttgtttatct

SEQ ID NO: 343608 - DNA, 25 bp, Rattus norvegicus
gagctctcgtgaactgcaatcgact

SEQ ID NO: 343609 - DNA, 25 bp, Rattus norvegicus
gagctctcgtgatctgcaatcgact

SEQ ID NO: 343610 - DNA, 25 bp, Rattus norvegicus
gagctctcgttgaaaatcagtctgt

SEQ ID NO: 343611 - DNA, 25 bp, Rattus norvegicus
gagctctcgttgtaaatcagtctgt

SEQ ID NO: 343612 - DNA, 25 bp, Rattus norvegicus
gagctctctgagactttggaccaaa

SEQ ID NO: 343613 - DNA, 25 bp, Rattus norvegicus
gagctctctgagtctttggaccaaa

SEQ ID NO: 343614 - DNA, 25 bp, Rattus norvegicus
gagctctctgatacaatcatcctgt

SEQ ID NO: 343615 - DNA, 25 bp, Rattus norvegicus
gagctctctgattcaatcatcctgt

SEQ ID NO: 343616 - DNA, 25 bp, Rattus norvegicus
gagctctcttctacgggtcattgaa

SEQ ID NO: 343617 - DNA, 25 bp, Rattus norvegicus
gagctctcttcttcgggtcattgaa

SEQ ID NO: 343618 - DNA, 25 bp, Rattus norvegicus
gagctctcttggaaggacctctagt

SEQ ID NO: 343619 - DNA, 25 bp, Rattus norvegicus
gagctctcttggtaggacctctagt

SEQ ID NO: 343620 - DNA, 25 bp, Rattus norvegicus
gagctctgaccaatgagctgccgca

SEQ ID NO: 343621 - DNA, 25 bp, Rattus norvegicus
gagctctgaccattgagctgccgca

SEQ ID NO: 343622 - DNA, 25 bp, Rattus norvegicus
gagctctgactcactagtcttcaaa

SEQ ID NO: 343623 - DNA, 25 bp, Rattus norvegicus
gagctctgactctctagtcttcaaa

SEQ ID NO: 343624 - DNA, 25 bp, Rattus norvegicus
gagctctgactgcatctatgggcga

SEQ ID NO: 343625 - DNA, 25 bp, Rattus norvegicus
gagctctgactggatctatgggcga

SEQ ID NO: 343626 - DNA, 25 bp, Rattus norvegicus
gagctctgagctacttttctagaca

SEQ ID NO: 343627 - DNA, 25 bp, Rattus norvegicus
gagctctgagcttcttttctagaca

SEQ ID NO: 343628 - DNA, 25 bp, Rattus norvegicus
gagctctgagtcaccaacaatagga

SEQ ID NO: 343629 - DNA, 25 bp, Rattus norvegicus
gagctctgagtctccaacaatagga

SEQ ID NO: 343630 - DNA, 25 bp, Rattus norvegicus
gagctctgcacaattggacttttct

SEQ ID NO: 343631 - DNA, 25 bp, Rattus norvegicus
gagctctgcacatttggacttttct

SEQ ID NO: 343632 - DNA, 25 bp, Rattus norvegicus
gagctctgcagaatatgcacacttt

SEQ ID NO: 343633 - DNA, 25 bp, Rattus norvegicus
gagctctgcagactgaccagctgga

SEQ ID NO: 343634 - DNA, 25 bp, Rattus norvegicus
gagctctgcagagtgaccagctgga

SEQ ID NO: 343635 - DNA, 25 bp, Rattus norvegicus
gagctctgcagattatgcacacttt

SEQ ID NO: 343636 - DNA, 25 bp, Rattus norvegicus
gagctctgcctccaagtcaatgtca

SEQ ID NO: 343637 - DNA, 25 bp, Rattus norvegicus
gagctctgcctccagggaaccaaaa

SEQ ID NO: 343638 - DNA, 25 bp, Rattus norvegicus
gagctctgcctcgaagtcaatgtca

SEQ ID NO: 343639 - DNA, 25 bp, Rattus norvegicus
gagctctgcctcgagggaaccaaaa

SEQ ID NO: 343640 - DNA, 25 bp, Rattus norvegicus
gagctctgctaacatgtttgtatcc

SEQ ID NO: 343641 - DNA, 25 bp, Rattus norvegicus
gagctctgctaagatgtttgtatcc

SEQ ID NO: 343642 - DNA, 25 bp, Rattus norvegicus
gagctctgctagcatggccttgtta

SEQ ID NO: 343643 - DNA, 25 bp, Rattus norvegicus
gagctctgctaggatggccttgtta

SEQ ID NO: 343644 - DNA, 25 bp, Rattus norvegicus
gagctctggagcaccgggattcaga

SEQ ID NO: 343645 - DNA, 25 bp, Rattus norvegicus
gagctctggagctccgggattcaga

SEQ ID NO: 343646 - DNA, 25 bp, Rattus norvegicus
gagctctggcagacttactaagtca

SEQ ID NO: 343647 - DNA, 25 bp, Rattus norvegicus
gagctctggcagtcttactaagtca

SEQ ID NO: 343648 - DNA, 25 bp, Rattus norvegicus
gagctctggctgagtgtaatcccaa

SEQ ID NO: 343649 - DNA, 25 bp, Rattus norvegicus
gagctctggctgtgtgtaatcccaa

SEQ ID NO: 343650 - DNA, 25 bp, Rattus norvegicus
gagctctgggcaaaatcctgcctaa

SEQ ID NO: 343651 - DNA, 25 bp, Rattus norvegicus
gagctctgggcataatcctgcctaa

SEQ ID NO: 343652 - DNA, 25 bp, Rattus norvegicus
gagctctgggtaactggctacacag

SEQ ID NO: 343653 - DNA, 25 bp, Rattus norvegicus
gagctctgggtacggctagcaacca

SEQ ID NO: 343654 - DNA, 25 bp, Rattus norvegicus
gagctctgggtagggctagcaacca

SEQ ID NO: 343655 - DNA, 25 bp, Rattus norvegicus
gagctctgggtatctggctacacag

SEQ ID NO: 343656 - DNA, 25 bp, Rattus norvegicus
gagctctggtccatgacatccgaca

SEQ ID NO: 343657 - DNA, 25 bp, Rattus norvegicus
gagctctggtccttgacatccgaca

SEQ ID NO: 343658 - DNA, 25 bp, Rattus norvegicus
gagctctggtttcaatttcacgacg

SEQ ID NO: 343659 - DNA, 25 bp, Rattus norvegicus
gagctctggtttgaatttcacgacg

SEQ ID NO: 343660 - DNA, 25 bp, Rattus norvegicus
gagctctgtagaagcttacaacgtc

SEQ ID NO: 343661 - DNA, 25 bp, Rattus norvegicus
gagctctgtagatgcttacaacgtc

SEQ ID NO: 343662 - DNA, 25 bp, Rattus norvegicus
gagctctgtcacagagtttacattc

SEQ ID NO: 343663 - DNA, 25 bp, Rattus norvegicus
gagctctgtcactgagtttacattc

SEQ ID NO: 343664 - DNA, 25 bp, Rattus norvegicus
gagctctgtcagatttctgatgtga

SEQ ID NO: 343665 - DNA, 25 bp, Rattus norvegicus
gagctctgtcagttttctgatgtga

SEQ ID NO: 343666 - DNA, 25 bp, Rattus norvegicus
gagctctgtgataccagctaaccta

SEQ ID NO: 343667 - DNA, 25 bp, Rattus norvegicus
gagctctgtgattccagctaaccta

SEQ ID NO: 343668 - DNA, 25 bp, Rattus norvegicus
gagctctgtgtacaatgaccacact

SEQ ID NO: 343669 - DNA, 25 bp, Rattus norvegicus
gagctctgtgtagaatgaccacact

SEQ ID NO: 343670 - DNA, 25 bp, Rattus norvegicus
gagctcttaatgacacaggtccctt

SEQ ID NO: 343671 - DNA, 25 bp, Rattus norvegicus
gagctcttaatgtcacaggtccctt

SEQ ID NO: 343672 - DNA, 25 bp, Rattus norvegicus
gagctcttacagctatagccagcca

SEQ ID NO: 343673 - DNA, 25 bp, Rattus norvegicus
gagctcttacaggtatagccagcca

SEQ ID NO: 343674 - DNA, 25 bp, Rattus norvegicus
gagctcttagaaacggttgcaaaca

SEQ ID NO: 343675 - DNA, 25 bp, Rattus norvegicus
gagctcttagaatcggttgcaaaca

SEQ ID NO: 343676 - DNA, 25 bp, Rattus norvegicus
gagctcttcaacctctttactgaag

SEQ ID NO: 343677 - DNA, 25 bp, Rattus norvegicus
gagctcttcaacgtctttactgaag

SEQ ID NO: 343678 - DNA, 25 bp, Rattus norvegicus
gagctcttcagccagtgcctgggaa

SEQ ID NO: 343679 - DNA, 25 bp, Rattus norvegicus
gagctcttcagcgagtgcctgggaa

SEQ ID NO: 343680 - DNA, 25 bp, Rattus norvegicus
gagctcttcattaagaaacgcgaga

SEQ ID NO: 343681 - DNA, 25 bp, Rattus norvegicus
gagctcttcatttagaaacgcgaga

SEQ ID NO: 343682 - DNA, 25 bp, Rattus norvegicus
gagctcttcctacccagctgaaaga

SEQ ID NO: 343683 - DNA, 25 bp, Rattus norvegicus
gagctcttcctagccagctgaaaga

SEQ ID NO: 343684 - DNA, 25 bp, Rattus norvegicus
gagctcttcgaacgtaacttgtatt

SEQ ID NO: 343685 - DNA, 25 bp, Rattus norvegicus
gagctcttcgaaggtaacttgtatt

SEQ ID NO: 343686 - DNA, 25 bp, Rattus norvegicus
gagctcttgaataccagatcagcca

SEQ ID NO: 343687 - DNA, 25 bp, Rattus norvegicus
gagctcttgaattccagatcagcca

SEQ ID NO: 343688 - DNA, 25 bp, Rattus norvegicus
gagctcttgcatataaataccccag

SEQ ID NO: 343689 - DNA, 25 bp, Rattus norvegicus
gagctcttgcatttaaataccccag

SEQ ID NO: 343690 - DNA, 25 bp, Rattus norvegicus
gagctcttgcctatattttataaat

SEQ ID NO: 343691 - DNA, 25 bp, Rattus norvegicus
gagctcttgcctttattttataaat

SEQ ID NO: 343692 - DNA, 25 bp, Rattus norvegicus
gagctcttgctgctaacgctaggaa

SEQ ID NO: 343693 - DNA, 25 bp, Rattus norvegicus
gagctcttgctggtaacgctaggaa

SEQ ID NO: 343694 - DNA, 25 bp, Rattus norvegicus
gagctcttggaacttgcctaggtta

SEQ ID NO: 343695 - DNA, 25 bp, Rattus norvegicus
gagctcttggaagttgcctaggtta

SEQ ID NO: 343696 - DNA, 25 bp, Rattus norvegicus
gagctcttgggaaaggctgctgtcc

SEQ ID NO: 343697 - DNA, 25 bp, Rattus norvegicus
gagctcttgggataggctgctgtcc

SEQ ID NO: 343698 - DNA, 25 bp, Rattus norvegicus
gagctcttgtttatcccagattggg

SEQ ID NO: 343699 - DNA, 25 bp, Rattus norvegicus
gagctcttgtttttcccagattggg

SEQ ID NO: 343700 - DNA, 25 bp, Rattus norvegicus
gagctctttaatcctgactgtgctg

SEQ ID NO: 343701 - DNA, 25 bp, Rattus norvegicus
gagctctttaatgctgactgtgctg

SEQ ID NO: 343702 - DNA, 25 bp, Rattus norvegicus
gagctctttacccaatactacattt

SEQ ID NO: 343703 - DNA, 25 bp, Rattus norvegicus
gagctctttaccgaatactacattt

SEQ ID NO: 343704 - DNA, 25 bp, Rattus norvegicus
gagctctttagcattcacttttgaa

SEQ ID NO: 343705 - DNA, 25 bp, Rattus norvegicus
gagctctttagctttcacttttgaa

SEQ ID NO: 343706 - DNA, 25 bp, Rattus norvegicus
gagctctttaggatgatgactgatt

SEQ ID NO: 343707 - DNA, 25 bp, Rattus norvegicus
gagctctttaggttgatgactgatt

SEQ ID NO: 343708 - DNA, 25 bp, Rattus norvegicus
gagctctttcgtacctcaaagtgag

SEQ ID NO: 343709 - DNA, 25 bp, Rattus norvegicus
gagctctttcgttcctcaaagtgag

SEQ ID NO: 343710 - DNA, 25 bp, Rattus norvegicus
gagctctttctgaggctggtaaacg

SEQ ID NO: 343711 - DNA, 25 bp, Rattus norvegicus
gagctctttctgtggctggtaaacg

SEQ ID NO: 343712 - DNA, 25 bp, Rattus norvegicus
gagctctttgatctcgctttcagaa

SEQ ID NO: 343713 - DNA, 25 bp, Rattus norvegicus
gagctctttgatctgtatttggtgt

SEQ ID NO: 343714 - DNA, 25 bp, Rattus norvegicus
gagctctttgatgtcgctttcagaa

SEQ ID NO: 343715 - DNA, 25 bp, Rattus norvegicus
gagctctttgatgtgtatttggtgt

SEQ ID NO: 343716 - DNA, 25 bp, Rattus norvegicus
gagctctttggaaaattcttaccgt

SEQ ID NO: 343717 - DNA, 25 bp, Rattus norvegicus
gagctctttggataattcttaccgt

SEQ ID NO: 343718 - DNA, 25 bp, Rattus norvegicus
gagctcttttgtcttatccaggatt

SEQ ID NO: 343719 - DNA, 25 bp, Rattus norvegicus
gagctcttttgtgttatccaggatt

SEQ ID NO: 343720 - DNA, 25 bp, Rattus norvegicus
gagctctttttgatgttgcctgttt

SEQ ID NO: 343721 - DNA, 25 bp, Rattus norvegicus
gagctctttttgttgttgcctgttt

SEQ ID NO: 343722 - DNA, 25 bp, Rattus norvegicus
gagctgaaaatgatctccgtttatg

SEQ ID NO: 343723 - DNA, 25 bp, Rattus norvegicus
gagctgaaaatgttctccgtttatg

SEQ ID NO: 343724 - DNA, 25 bp, Rattus norvegicus
gagctgaaagtcatccggattcgca

SEQ ID NO: 343725 - DNA, 25 bp, Rattus norvegicus
gagctgaaagtcttccggattcgca

SEQ ID NO: 343726 - DNA, 25 bp, Rattus norvegicus
gagctgaaagtgacccctcagttgt

SEQ ID NO: 343727 - DNA, 25 bp, Rattus norvegicus
gagctgaaagtgtcccctcagttgt

SEQ ID NO: 343728 - DNA, 25 bp, Rattus norvegicus
gagctgaacactaaattcggacatg

SEQ ID NO: 343729 - DNA, 25 bp, Rattus norvegicus
gagctgaacactactcacaattgat

SEQ ID NO: 343730 - DNA, 25 bp, Rattus norvegicus
gagctgaacacttaattcggacatg

SEQ ID NO: 343731 - DNA, 25 bp, Rattus norvegicus
gagctgaacacttctcacaattgat

SEQ ID NO: 343732 - DNA, 25 bp, Rattus norvegicus
gagctgaactacagcattcctatgg

SEQ ID NO: 343733 - DNA, 25 bp, Rattus norvegicus
gagctgaactactgcattcctatgg

SEQ ID NO: 343734 - DNA, 25 bp, Rattus norvegicus
gagctgaagactcccctagagaatg

SEQ ID NO: 343735 - DNA, 25 bp, Rattus norvegicus
gagctgaagactgccctagagaatg

SEQ ID NO: 343736 - DNA, 25 bp, Rattus norvegicus
gagctgaagcaccacgaaaaagaac

SEQ ID NO: 343737 - DNA, 25 bp, Rattus norvegicus
gagctgaagcacgacgaaaaagaac

SEQ ID NO: 343738 - DNA, 25 bp, Rattus norvegicus
gagctgaagggcagttctgatatca

SEQ ID NO: 343739 - DNA, 25 bp, Rattus norvegicus
gagctgaagggctgttctgatatca

SEQ ID NO: 343740 - DNA, 25 bp, Rattus norvegicus
gagctgaagtgcagtgttctgacaa

SEQ ID NO: 343741 - DNA, 25 bp, Rattus norvegicus
gagctgaagtgctgtgttctgacaa

SEQ ID NO: 343742 - DNA, 25 bp, Rattus norvegicus
gagctgaagtttcagccacacacat

SEQ ID NO: 343743 - DNA, 25 bp, Rattus norvegicus
gagctgaagtttgagccacacacat

SEQ ID NO: 343744 - DNA, 25 bp, Rattus norvegicus
gagctgaatatccgggtcattgcca

SEQ ID NO: 343745 - DNA, 25 bp, Rattus norvegicus
gagctgaatatcggggtcattgcca

SEQ ID NO: 343746 - DNA, 25 bp, Rattus norvegicus
gagctgaattaactttccaactatt

SEQ ID NO: 343747 - DNA, 25 bp, Rattus norvegicus
gagctgaattaagtttccaactatt

SEQ ID NO: 343748 - DNA, 25 bp, Rattus norvegicus
gagctgacacatctcgaatcttctt

SEQ ID NO: 343749 - DNA, 25 bp, Rattus norvegicus
gagctgacacatgtcgaatcttctt

SEQ ID NO: 343750 - DNA, 25 bp, Rattus norvegicus
gagctgacactgacaatggcctttt

SEQ ID NO: 343751 - DNA, 25 bp, Rattus norvegicus
gagctgacactgtcaatggcctttt

SEQ ID NO: 343752 - DNA, 25 bp, Rattus norvegicus
gagctgacagcaaacatttaatccc

SEQ ID NO: 343753 - DNA, 25 bp, Rattus norvegicus
gagctgacagcatacatttaatccc

SEQ ID NO: 343754 - DNA, 25 bp, Rattus norvegicus
gagctgacatgaagtgcccgacagt

SEQ ID NO: 343755 - DNA, 25 bp, Rattus norvegicus
gagctgacatgatgtgcccgacagt

SEQ ID NO: 343756 - DNA, 25 bp, Rattus norvegicus
gagctgaccaaccttatacgaacca

SEQ ID NO: 343757 - DNA, 25 bp, Rattus norvegicus
gagctgaccaacgttatacgaacca

SEQ ID NO: 343758 - DNA, 25 bp, Rattus norvegicus
gagctgaccaagaaacttttgaggt

SEQ ID NO: 343759 - DNA, 25 bp, Rattus norvegicus
gagctgaccaagtaacttttgaggt

SEQ ID NO: 343760 - DNA, 25 bp, Rattus norvegicus
gagctgaccagcaaagccactgcct

SEQ ID NO: 343761 - DNA, 25 bp, Rattus norvegicus
gagctgaccagctaagccactgcct

SEQ ID NO: 343762 - DNA, 25 bp, Rattus norvegicus
gagctgacccaacgttgttttccct

SEQ ID NO: 343763 - DNA, 25 bp, Rattus norvegicus
gagctgacccaaggttgttttccct

SEQ ID NO: 343764 - DNA, 25 bp, Rattus norvegicus
gagctgacccctaggttacgaatac

SEQ ID NO: 343765 - DNA, 25 bp, Rattus norvegicus
gagctgaccccttggttacgaatac

SEQ ID NO: 343766 - DNA, 25 bp, Rattus norvegicus
gagctgacccggaggagaccattct

SEQ ID NO: 343767 - DNA, 25 bp, Rattus norvegicus
gagctgacccggtggagaccattct

SEQ ID NO: 343768 - DNA, 25 bp, Rattus norvegicus
gagctgacccttcaggttctgacaa

SEQ ID NO: 343769 - DNA, 25 bp, Rattus norvegicus
gagctgacccttgaggttctgacaa

SEQ ID NO: 343770 - DNA, 25 bp, Rattus norvegicus
gagctgaccgttatggactatgaca

SEQ ID NO: 343771 - DNA, 25 bp, Rattus norvegicus
gagctgaccgttttggactatgaca

SEQ ID NO: 343772 - DNA, 25 bp, Rattus norvegicus
gagctgacctgtcccgagacaagtt

SEQ ID NO: 343773 - DNA, 25 bp, Rattus norvegicus
gagctgacctgtgccgagacaagtt

SEQ ID NO: 343774 - DNA, 25 bp, Rattus norvegicus
gagctgacgttgcattgtcgcatat

SEQ ID NO: 343775 - DNA, 25 bp, Rattus norvegicus
gagctgacgttggattgtcgcatat

SEQ ID NO: 343776 - DNA, 25 bp, Rattus norvegicus
gagctgactatgcaagccgttctcc

SEQ ID NO: 343777 - DNA, 25 bp, Rattus norvegicus
gagctgactatggaagccgttctcc

SEQ ID NO: 343778 - DNA, 25 bp, Rattus norvegicus
gagctgactctcattagacactgtc

SEQ ID NO: 343779 - DNA, 25 bp, Rattus norvegicus
gagctgactctctttagacactgtc

SEQ ID NO: 343780 - DNA, 25 bp, Rattus norvegicus
gagctgactgggaatttgatctgat

SEQ ID NO: 343781 - DNA, 25 bp, Rattus norvegicus
gagctgactgggtatttgatctgat

SEQ ID NO: 343782 - DNA, 25 bp, Rattus norvegicus
gagctgactttgcattcaccgtgaa

SEQ ID NO: 343783 - DNA, 25 bp, Rattus norvegicus
gagctgactttggattcaccgtgaa

SEQ ID NO: 343784 - DNA, 25 bp, Rattus norvegicus
gagctgagaagcacagcctcccttc

SEQ ID NO: 343785 - DNA, 25 bp, Rattus norvegicus
gagctgagaagctcagcctcccttc

SEQ ID NO: 343786 - DNA, 25 bp, Rattus norvegicus
gagctgagaaggaggaatcacaact

SEQ ID NO: 343787 - DNA, 25 bp, Rattus norvegicus
gagctgagaaggtggaatcacaact

SEQ ID NO: 343788 - DNA, 25 bp, Rattus norvegicus
gagctgagacagactcttccagctt

SEQ ID NO: 343789 - DNA, 25 bp, Rattus norvegicus
gagctgagacagtctcttccagctt

SEQ ID NO: 343790 - DNA, 25 bp, Rattus norvegicus
gagctgagcacaagcattcatcatt

SEQ ID NO: 343791 - DNA, 25 bp, Rattus norvegicus
gagctgagcacacattcattcctct

SEQ ID NO: 343792 - DNA, 25 bp, Rattus norvegicus
gagctgagcacagattcattcctct

SEQ ID NO: 343793 - DNA, 25 bp, Rattus norvegicus
gagctgagcacatgcattcatcatt

SEQ ID NO: 343794 - DNA, 25 bp, Rattus norvegicus
gagctgagccatcagcacacgcagt

SEQ ID NO: 343795 - DNA, 25 bp, Rattus norvegicus
gagctgagccatgagcacacgcagt

SEQ ID NO: 343796 - DNA, 25 bp, Rattus norvegicus
gagctgagcccacaaagccgatact

SEQ ID NO: 343797 - DNA, 25 bp, Rattus norvegicus
gagctgagcccagaaagccgatact

SEQ ID NO: 343798 - DNA, 25 bp, Rattus norvegicus
gagctgagccccaggagactttggc

SEQ ID NO: 343799 - DNA, 25 bp, Rattus norvegicus
gagctgagcccctggagactttggc

SEQ ID NO: 343800 - DNA, 25 bp, Rattus norvegicus
gagctgagcctgacaagccatcggc

SEQ ID NO: 343801 - DNA, 25 bp, Rattus norvegicus
gagctgagcctgtcaagccatcggc

SEQ ID NO: 343802 - DNA, 25 bp, Rattus norvegicus
gagctgagccttaatcatgtggaat

SEQ ID NO: 343803 - DNA, 25 bp, Rattus norvegicus
gagctgagcctttatcatgtggaat

SEQ ID NO: 343804 - DNA, 25 bp, Rattus norvegicus
gagctgagcgtcatcacgggctatt

SEQ ID NO: 343805 - DNA, 25 bp, Rattus norvegicus
gagctgagcgtcttcacgggctatt

SEQ ID NO: 343806 - DNA, 25 bp, Rattus norvegicus
gagctgagctcacggatccgacaaa

SEQ ID NO: 343807 - DNA, 25 bp, Rattus norvegicus
gagctgagctcagggatccgacaaa

SEQ ID NO: 343808 - DNA, 25 bp, Rattus norvegicus
gagctgagctccaggtgcctcatga

SEQ ID NO: 343809 - DNA, 25 bp, Rattus norvegicus
gagctgagctcctggtgcctcatga

SEQ ID NO: 343810 - DNA, 25 bp, Rattus norvegicus
gagctgagctggactctggaattca

SEQ ID NO: 343811 - DNA, 25 bp, Rattus norvegicus
gagctgagctggtctctggaattca

SEQ ID NO: 343812 - DNA, 25 bp, Rattus norvegicus
gagctgagcttcaataagtccaaga

SEQ ID NO: 343813 - DNA, 25 bp, Rattus norvegicus
gagctgagcttctataagtccaaga

SEQ ID NO: 343814 - DNA, 25 bp, Rattus norvegicus
gagctgagctttcgttctccagaat

SEQ ID NO: 343815 - DNA, 25 bp, Rattus norvegicus
gagctgagctttggttctccagaat

SEQ ID NO: 343816 - DNA, 25 bp, Rattus norvegicus
gagctgaggactcccttatattttg

SEQ ID NO: 343817 - DNA, 25 bp, Rattus norvegicus
gagctgaggactgccttatattttg

SEQ ID NO: 343818 - DNA, 25 bp, Rattus norvegicus
gagctgaggatcactctcatggtca

SEQ ID NO: 343819 - DNA, 25 bp, Rattus norvegicus
gagctgaggatctctctcatggtca

SEQ ID NO: 343820 - DNA, 25 bp, Rattus norvegicus
gagctgaggcatctgattcttcgtg

SEQ ID NO: 343821 - DNA, 25 bp, Rattus norvegicus
gagctgaggcatgtgattcttcgtg

SEQ ID NO: 343822 - DNA, 25 bp, Rattus norvegicus
gagctgaggctgaaaggcctgtttt

SEQ ID NO: 343823 - DNA, 25 bp, Rattus norvegicus
gagctgaggctgtaaggcctgtttt

SEQ ID NO: 343824 - DNA, 25 bp, Rattus norvegicus
gagctgagggctagtgccacccaac

SEQ ID NO: 343825 - DNA, 25 bp, Rattus norvegicus
gagctgagggcttgtgccacccaac

SEQ ID NO: 343826 - DNA, 25 bp, Rattus norvegicus
gagctgatagacagtggcccctgta

SEQ ID NO: 343827 - DNA, 25 bp, Rattus norvegicus
gagctgatagactgtggcccctgta

SEQ ID NO: 343828 - DNA, 25 bp, Rattus norvegicus
gagctgatcagaaccatcatgggct

SEQ ID NO: 343829 - DNA, 25 bp, Rattus norvegicus
gagctgatcagatccatcatgggct

SEQ ID NO: 343830 - DNA, 25 bp, Rattus norvegicus
gagctgatcagtatgccttagggca

SEQ ID NO: 343831 - DNA, 25 bp, Rattus norvegicus
gagctgatcagtttgccttagggca

SEQ ID NO: 343832 - DNA, 25 bp, Rattus norvegicus
gagctgatccaacacgaatgtgtgt

SEQ ID NO: 343833 - DNA, 25 bp, Rattus norvegicus
gagctgatccaagacgaatgtgtgt

SEQ ID NO: 343834 - DNA, 25 bp, Rattus norvegicus
gagctgatcgaaaatgcccatgaac

SEQ ID NO: 343835 - DNA, 25 bp, Rattus norvegicus
gagctgatcgaatatgcccatgaac

SEQ ID NO: 343836 - DNA, 25 bp, Rattus norvegicus
gagctgatctgacaaacctctgcaa

SEQ ID NO: 343837 - DNA, 25 bp, Rattus norvegicus
gagctgatctgagaaacctctgcaa

SEQ ID NO: 343838 - DNA, 25 bp, Rattus norvegicus
gagctgatgaccactagcctcttag

SEQ ID NO: 343839 - DNA, 25 bp, Rattus norvegicus
gagctgatgacctctagcctcttag

SEQ ID NO: 343840 - DNA, 25 bp, Rattus norvegicus
gagctgatgctcatgtctgtgctgg

SEQ ID NO: 343841 - DNA, 25 bp, Rattus norvegicus
gagctgatgctcttgtctgtgctgg

SEQ ID NO: 343842 - DNA, 25 bp, Rattus norvegicus
gagctgatggaacgtctaaggcaaa

SEQ ID NO: 343843 - DNA, 25 bp, Rattus norvegicus
gagctgatggaaggtctaaggcaaa

SEQ ID NO: 343844 - DNA, 25 bp, Rattus norvegicus
gagctgatggctagtgtcatgactt

SEQ ID NO: 343845 - DNA, 25 bp, Rattus norvegicus
gagctgatggcttgtgtcatgactt

SEQ ID NO: 343846 - DNA, 25 bp, Rattus norvegicus
gagctgatgggtacaatatctgtac

SEQ ID NO: 343847 - DNA, 25 bp, Rattus norvegicus
gagctgatgggttcaatatctgtac

SEQ ID NO: 343848 - DNA, 25 bp, Rattus norvegicus
gagctgatgtcaactgggtcaatgc

SEQ ID NO: 343849 - DNA, 25 bp, Rattus norvegicus
gagctgatgtcatctgggtcaatgc

SEQ ID NO: 343850 - DNA, 25 bp, Rattus norvegicus
gagctgattaaccaggtccaccggg

SEQ ID NO: 343851 - DNA, 25 bp, Rattus norvegicus
gagctgattaacgaggtccaccggg

SEQ ID NO: 343852 - DNA, 25 bp, Rattus norvegicus
gagctgattaataatgcccctgcct

SEQ ID NO: 343853 - DNA, 25 bp, Rattus norvegicus
gagctgattaattatgcccctgcct

SEQ ID NO: 343854 - DNA, 25 bp, Rattus norvegicus
gagctgattattacgggtgttctaa

SEQ ID NO: 343855 - DNA, 25 bp, Rattus norvegicus
gagctgattatttcgggtgttctaa

SEQ ID NO: 343856 - DNA, 25 bp, Rattus norvegicus
gagctgattcttatcaacatgacta

SEQ ID NO: 343857 - DNA, 25 bp, Rattus norvegicus
gagctgattcttttcaacatgacta

SEQ ID NO: 343858 - DNA, 25 bp, Rattus norvegicus
gagctgattgagcagcccggactca

SEQ ID NO: 343859 - DNA, 25 bp, Rattus norvegicus
gagctgattgaggagcccggactca

SEQ ID NO: 343860 - DNA, 25 bp, Rattus norvegicus
gagctgatttccataacacgtgaga

SEQ ID NO: 343861 - DNA, 25 bp, Rattus norvegicus
gagctgatttccttaacacgtgaga

SEQ ID NO: 343862 - DNA, 25 bp, Rattus norvegicus
gagctgatttttccatcttttgtaa

SEQ ID NO: 343863 - DNA, 25 bp, Rattus norvegicus
gagctgatttttgcatcttttgtaa

SEQ ID NO: 343864 - DNA, 25 bp, Rattus norvegicus
gagctgcaaatccatttctccttct

SEQ ID NO: 343865 - DNA, 25 bp, Rattus norvegicus
gagctgcaaatcgatttctccttct

SEQ ID NO: 343866 - DNA, 25 bp, Rattus norvegicus
gagctgcaacaacagtcacctggaa

SEQ ID NO: 343867 - DNA, 25 bp, Rattus norvegicus
gagctgcaacaagagtcacctggaa

SEQ ID NO: 343868 - DNA, 25 bp, Rattus norvegicus
gagctgcaagtgagtgctgtcctga

SEQ ID NO: 343869 - DNA, 25 bp, Rattus norvegicus
gagctgcaagtgtgtgctgtcctga

SEQ ID NO: 343870 - DNA, 25 bp, Rattus norvegicus
gagctgcacgctaggctttttaaaa

SEQ ID NO: 343871 - DNA, 25 bp, Rattus norvegicus
gagctgcacgcttggctttttaaaa

SEQ ID NO: 343872 - DNA, 25 bp, Rattus norvegicus
gagctgcacgtcaggactgacaaaa

SEQ ID NO: 343873 - DNA, 25 bp, Rattus norvegicus
gagctgcacgtctggactgacaaaa

SEQ ID NO: 343874 - DNA, 25 bp, Rattus norvegicus
gagctgcagaatcactgccctggaa

SEQ ID NO: 343875 - DNA, 25 bp, Rattus norvegicus
gagctgcagaatgactgccctggaa

SEQ ID NO: 343876 - DNA, 25 bp, Rattus norvegicus
gagctgcagatgactgtttaccaca

SEQ ID NO: 343877 - DNA, 25 bp, Rattus norvegicus
gagctgcagatgtctgtttaccaca

SEQ ID NO: 343878 - DNA, 25 bp, Rattus norvegicus
gagctgcaggagatgtttcctcccc

SEQ ID NO: 343879 - DNA, 25 bp, Rattus norvegicus
gagctgcaggagttgtttcctcccc

SEQ ID NO: 343880 - DNA, 25 bp, Rattus norvegicus
gagctgcagggactacatgtttact

SEQ ID NO: 343881 - DNA, 25 bp, Rattus norvegicus
gagctgcagggagtacatgtttact

SEQ ID NO: 343882 - DNA, 25 bp, Rattus norvegicus
gagctgcaggttactgtctctgtgg

SEQ ID NO: 343883 - DNA, 25 bp, Rattus norvegicus
gagctgcaggtttctgtctctgtgg

SEQ ID NO: 343884 - DNA, 25 bp, Rattus norvegicus
gagctgcagttcaaaagtcttccca

SEQ ID NO: 343885 - DNA, 25 bp, Rattus norvegicus
gagctgcagttctaaagtcttccca

SEQ ID NO: 343886 - DNA, 25 bp, Rattus norvegicus
gagctgcatagacccaatctcagac

SEQ ID NO: 343887 - DNA, 25 bp, Rattus norvegicus
gagctgcatagagccaatctcagac

SEQ ID NO: 343888 - DNA, 25 bp, Rattus norvegicus
gagctgcatcagacgtacatggagg

SEQ ID NO: 343889 - DNA, 25 bp, Rattus norvegicus
gagctgcatcagtcgtacatggagg

SEQ ID NO: 343890 - DNA, 25 bp, Rattus norvegicus
gagctgcatctacctgccaaagcaa

SEQ ID NO: 343891 - DNA, 25 bp, Rattus norvegicus
gagctgcatctagctgccaaagcaa

SEQ ID NO: 343892 - DNA, 25 bp, Rattus norvegicus
gagctgcatggtctcgatactgaga

SEQ ID NO: 343893 - DNA, 25 bp, Rattus norvegicus
gagctgcatggtgtcgatactgaga

SEQ ID NO: 343894 - DNA, 25 bp, Rattus norvegicus
gagctgcattgaccttttatttaga

SEQ ID NO: 343895 - DNA, 25 bp, Rattus norvegicus
gagctgcattgagcttttatttaga

SEQ ID NO: 343896 - DNA, 25 bp, Rattus norvegicus
gagctgcatttcagtagaccatgga

SEQ ID NO: 343897 - DNA, 25 bp, Rattus norvegicus
gagctgcatttctgtagaccatgga

SEQ ID NO: 343898 - DNA, 25 bp, Rattus norvegicus
gagctgccaacaatcagggtgttaa

SEQ ID NO: 343899 - DNA, 25 bp, Rattus norvegicus
gagctgccaacattcagggtgttaa

SEQ ID NO: 343900 - DNA, 25 bp, Rattus norvegicus
gagctgccaaggagccacgaaatct

SEQ ID NO: 343901 - DNA, 25 bp, Rattus norvegicus
gagctgccaaggtgccacgaaatct

SEQ ID NO: 343902 - DNA, 25 bp, Rattus norvegicus
gagctgccagcacagttcaaactat

SEQ ID NO: 343903 - DNA, 25 bp, Rattus norvegicus
gagctgccagcagagttcaaactat

SEQ ID NO: 343904 - DNA, 25 bp, Rattus norvegicus
gagctgccaggcagtggagaaattc

SEQ ID NO: 343905 - DNA, 25 bp, Rattus norvegicus
gagctgccaggctgtggagaaattc

SEQ ID NO: 343906 - DNA, 25 bp, Rattus norvegicus
gagctgccagtgaaggactcaccta

SEQ ID NO: 343907 - DNA, 25 bp, Rattus norvegicus
gagctgccagtgtaggactcaccta

SEQ ID NO: 343908 - DNA, 25 bp, Rattus norvegicus
gagctgccatccaaagactgttgaa

SEQ ID NO: 343909 - DNA, 25 bp, Rattus norvegicus
gagctgccatcctaagactgttgaa

SEQ ID NO: 343910 - DNA, 25 bp, Rattus norvegicus
gagctgccatgtacatactggcttc

SEQ ID NO: 343911 - DNA, 25 bp, Rattus norvegicus
gagctgccatgttcatactggcttc

SEQ ID NO: 343912 - DNA, 25 bp, Rattus norvegicus
gagctgcccaccaggtgctgagctg

SEQ ID NO: 343913 - DNA, 25 bp, Rattus norvegicus
gagctgcccacctggtgctgagctg

SEQ ID NO: 343914 - DNA, 25 bp, Rattus norvegicus
gagctgcccagcagactgtcaacag

SEQ ID NO: 343915 - DNA, 25 bp, Rattus norvegicus
gagctgcccagctgactgtcaacag

SEQ ID NO: 343916 - DNA, 25 bp, Rattus norvegicus
gagctgcccattaaaacctgcttga

SEQ ID NO: 343917 - DNA, 25 bp, Rattus norvegicus
gagctgcccatttaaacctgcttga

SEQ ID NO: 343918 - DNA, 25 bp, Rattus norvegicus
gagctgccccggactcagagatgaa

SEQ ID NO: 343919 - DNA, 25 bp, Rattus norvegicus
gagctgccccggtctcagagatgaa

SEQ ID NO: 343920 - DNA, 25 bp, Rattus norvegicus
gagctgcccgatcgtgaaattcaca

SEQ ID NO: 343921 - DNA, 25 bp, Rattus norvegicus
gagctgcccgatggtgaaattcaca

SEQ ID NO: 343922 - DNA, 25 bp, Rattus norvegicus
gagctgcccggcctcagaggaaaat

SEQ ID NO: 343923 - DNA, 25 bp, Rattus norvegicus
gagctgcccggcgtcagaggaaaat

SEQ ID NO: 343924 - DNA, 25 bp, Rattus norvegicus
gagctgccctatattccaggaaaaa

SEQ ID NO: 343925 - DNA, 25 bp, Rattus norvegicus
gagctgccctattttccaggaaaaa

SEQ ID NO: 343926 - DNA, 25 bp, Rattus norvegicus
gagctgccctctcgcatctgtgttt

SEQ ID NO: 343927 - DNA, 25 bp, Rattus norvegicus
gagctgccctctggcatctgtgttt

SEQ ID NO: 343928 - DNA, 25 bp, Rattus norvegicus
gagctgccgtgtacttaatgtgtaa

SEQ ID NO: 343929 - DNA, 25 bp, Rattus norvegicus
gagctgccgtgttcttaatgtgtaa

SEQ ID NO: 343930 - DNA, 25 bp, Rattus norvegicus
gagctgcctactacggagtctatga

SEQ ID NO: 343931 - DNA, 25 bp, Rattus norvegicus
gagctgcctacttcggagtctatga

SEQ ID NO: 343932 - DNA, 25 bp, Rattus norvegicus
gagctgcctcaaattcttttttctt

SEQ ID NO: 343933 - DNA, 25 bp, Rattus norvegicus
gagctgcctcaatttcttttttctt

SEQ ID NO: 343934 - DNA, 25 bp, Rattus norvegicus
gagctgcctccaatttgccatggaa

SEQ ID NO: 343935 - DNA, 25 bp, Rattus norvegicus
gagctgcctccattttgccatggaa

SEQ ID NO: 343936 - DNA, 25 bp, Rattus norvegicus
gagctgcctccccaaaaggtggaga

SEQ ID NO: 343937 - DNA, 25 bp, Rattus norvegicus
gagctgcctcccgaaaaggtggaga

SEQ ID NO: 343938 - DNA, 25 bp, Rattus norvegicus
gagctgcctgcacgatatgcttcct

SEQ ID NO: 343939 - DNA, 25 bp, Rattus norvegicus
gagctgcctgcaggatatgcttcct

SEQ ID NO: 343940 - DNA, 25 bp, Rattus norvegicus
gagctgcctgccaccgatggtgcag

SEQ ID NO: 343941 - DNA, 25 bp, Rattus norvegicus
gagctgcctgcctccgatggtgcag

SEQ ID NO: 343942 - DNA, 25 bp, Rattus norvegicus
gagctgcctgctcagaggttgaaat

SEQ ID NO: 343943 - DNA, 25 bp, Rattus norvegicus
gagctgcctgctgagaggttgaaat

SEQ ID NO: 343944 - DNA, 25 bp, Rattus norvegicus
gagctgccttcaccctaaagtagga

SEQ ID NO: 343945 - DNA, 25 bp, Rattus norvegicus
gagctgccttcagcctaaagtagga

SEQ ID NO: 343946 - DNA, 25 bp, Rattus norvegicus
gagctgcctttgagaatcagccact

SEQ ID NO: 343947 - DNA, 25 bp, Rattus norvegicus
gagctgcctttgtgaatcagccact

SEQ ID NO: 343948 - DNA, 25 bp, Rattus norvegicus
gagctgccttttcctgtgagacagg

SEQ ID NO: 343949 - DNA, 25 bp, Rattus norvegicus
gagctgccttttgctgtgagacagg

SEQ ID NO: 343950 - DNA, 25 bp, Rattus norvegicus
gagctgcgaagtcatcggaatccca

SEQ ID NO: 343951 - DNA, 25 bp, Rattus norvegicus
gagctgcgaagtgatcggaatccca

SEQ ID NO: 343952 - DNA, 25 bp, Rattus norvegicus
gagctgcgagctagaattcggatgc

SEQ ID NO: 343953 - DNA, 25 bp, Rattus norvegicus
gagctgcgagcttgaattcggatgc

SEQ ID NO: 343954 - DNA, 25 bp, Rattus norvegicus
gagctgcgcaagctttctgacatga

SEQ ID NO: 343955 - DNA, 25 bp, Rattus norvegicus
gagctgcgcaaggtttctgacatga

SEQ ID NO: 343956 - DNA, 25 bp, Rattus norvegicus
gagctgcgcgacaacacgccctgag

SEQ ID NO: 343957 - DNA, 25 bp, Rattus norvegicus
gagctgcgcgactacacgccctgag

SEQ ID NO: 343958 - DNA, 25 bp, Rattus norvegicus
gagctgcggctacaaacgagtccca

SEQ ID NO: 343959 - DNA, 25 bp, Rattus norvegicus
gagctgcggctagaaacgagtccca

SEQ ID NO: 343960 - DNA, 25 bp, Rattus norvegicus
gagctgcgtctccttattaaagaaa

SEQ ID NO: 343961 - DNA, 25 bp, Rattus norvegicus
gagctgcgtctcgttattaaagaaa

SEQ ID NO: 343962 - DNA, 25 bp, Rattus norvegicus
gagctgcgtgctcaacgtggaccac

SEQ ID NO: 343963 - DNA, 25 bp, Rattus norvegicus
gagctgcgtgctgaacgtggaccac

SEQ ID NO: 343964 - DNA, 25 bp, Rattus norvegicus
gagctgcgttagaaatccattcccc

SEQ ID NO: 343965 - DNA, 25 bp, Rattus norvegicus
gagctgcgttagtaatccattcccc

SEQ ID NO: 343966 - DNA, 25 bp, Rattus norvegicus
gagctgcgttttactctatttcaag

SEQ ID NO: 343967 - DNA, 25 bp, Rattus norvegicus
gagctgcgtttttctctatttcaag

SEQ ID NO: 343968 - DNA, 25 bp, Rattus norvegicus
gagctgctaacaagtgctggccagt

SEQ ID NO: 343969 - DNA, 25 bp, Rattus norvegicus
gagctgctaacatgtgctggccagt

SEQ ID NO: 343970 - DNA, 25 bp, Rattus norvegicus
gagctgctaattcaaggaagttctg

SEQ ID NO: 343971 - DNA, 25 bp, Rattus norvegicus
gagctgctaattgaaggaagttctg

SEQ ID NO: 343972 - DNA, 25 bp, Rattus norvegicus
gagctgctacccaaagtctggtgga

SEQ ID NO: 343973 - DNA, 25 bp, Rattus norvegicus
gagctgctaccctaagtctggtgga

SEQ ID NO: 343974 - DNA, 25 bp, Rattus norvegicus
gagctgctataacacctagtagttc

SEQ ID NO: 343975 - DNA, 25 bp, Rattus norvegicus
gagctgctataagacctagtagttc

SEQ ID NO: 343976 - DNA, 25 bp, Rattus norvegicus
gagctgctatgcatctcttgatttt

SEQ ID NO: 343977 - DNA, 25 bp, Rattus norvegicus
gagctgctatgcttctcttgatttt

SEQ ID NO: 343978 - DNA, 25 bp, Rattus norvegicus
gagctgctattcatcaggacttctg

SEQ ID NO: 343979 - DNA, 25 bp, Rattus norvegicus
gagctgctattcttcaggacttctg

SEQ ID NO: 343980 - DNA, 25 bp, Rattus norvegicus
gagctgctcacactgaaggccgtat

SEQ ID NO: 343981 - DNA, 25 bp, Rattus norvegicus
gagctgctcacagtgaaggccgtat

SEQ ID NO: 343982 - DNA, 25 bp, Rattus norvegicus
gagctgctcacgatgcgctgtgtgt

SEQ ID NO: 343983 - DNA, 25 bp, Rattus norvegicus
gagctgctcacgttgcgctgtgtgt

SEQ ID NO: 343984 - DNA, 25 bp, Rattus norvegicus
gagctgctccgtcgctgtatcgaag

SEQ ID NO: 343985 - DNA, 25 bp, Rattus norvegicus
gagctgctccgtggctgtatcgaag

SEQ ID NO: 343986 - DNA, 25 bp, Rattus norvegicus
gagctgctcgccaagggatacgtag

SEQ ID NO: 343987 - DNA, 25 bp, Rattus norvegicus
gagctgctcgcctagggatacgtag

SEQ ID NO: 343988 - DNA, 25 bp, Rattus norvegicus
gagctgctctaaatcacatgtcctg

SEQ ID NO: 343989 - DNA, 25 bp, Rattus norvegicus
gagctgctctaattcacatgtcctg

SEQ ID NO: 343990 - DNA, 25 bp, Rattus norvegicus
gagctgctctagatggagtttgtaa

SEQ ID NO: 343991 - DNA, 25 bp, Rattus norvegicus
gagctgctctagttggagtttgtaa

SEQ ID NO: 343992 - DNA, 25 bp, Rattus norvegicus
gagctgctctctcccatgatggcat

SEQ ID NO: 343993 - DNA, 25 bp, Rattus norvegicus
gagctgctctctgccatgatggcat

SEQ ID NO: 343994 - DNA, 25 bp, Rattus norvegicus
gagctgctcttcaacacggtcaaag

SEQ ID NO: 343995 - DNA, 25 bp, Rattus norvegicus
gagctgctcttctacacggtcaaag

SEQ ID NO: 343996 - DNA, 25 bp, Rattus norvegicus
gagctgctcttgaggccgcctgccg

SEQ ID NO: 343997 - DNA, 25 bp, Rattus norvegicus
gagctgctcttgctgggtatgacca

SEQ ID NO: 343998 - DNA, 25 bp, Rattus norvegicus
gagctgctcttggtgggtatgacca

SEQ ID NO: 343999 - DNA, 25 bp, Rattus norvegicus
gagctgctcttgtggccgcctgccg

SEQ ID NO: 344000 - DNA, 25 bp, Rattus norvegicus
gagctgctgaagaccctactggttc

SEQ ID NO: 344001 - DNA, 25 bp, Rattus norvegicus
gagctgctgaagtccctactggttc

SEQ ID NO: 344002 - DNA, 25 bp, Rattus norvegicus
gagctgctgacccagccggacatca

SEQ ID NO: 344003 - DNA, 25 bp, Rattus norvegicus
gagctgctgaccgagccggacatca

SEQ ID NO: 344004 - DNA, 25 bp, Rattus norvegicus
gagctgctgaggcactatctgctgc

SEQ ID NO: 344005 - DNA, 25 bp, Rattus norvegicus
gagctgctgagggactatctgctgc

SEQ ID NO: 344006 - DNA, 25 bp, Rattus norvegicus
gagctgctgatgacagttaactctg

SEQ ID NO: 344007 - DNA, 25 bp, Rattus norvegicus
gagctgctgatgtcagttaactctg

SEQ ID NO: 344008 - DNA, 25 bp, Rattus norvegicus
gagctgctgattcttacggatcaca

SEQ ID NO: 344009 - DNA, 25 bp, Rattus norvegicus
gagctgctgattgttacggatcaca

SEQ ID NO: 344010 - DNA, 25 bp, Rattus norvegicus
gagctgctgcagagaacccatgcat

SEQ ID NO: 344011 - DNA, 25 bp, Rattus norvegicus
gagctgctgcagtgaacccatgcat

SEQ ID NO: 344012 - DNA, 25 bp, Rattus norvegicus
gagctgctgctcaagaagttatcaa

SEQ ID NO: 344013 - DNA, 25 bp, Rattus norvegicus
gagctgctgctctagaagttatcaa

SEQ ID NO: 344014 - DNA, 25 bp, Rattus norvegicus
gagctgctgcttaaggacggataca

SEQ ID NO: 344015 - DNA, 25 bp, Rattus norvegicus
gagctgctgcttaggctggtacagc

SEQ ID NO: 344016 - DNA, 25 bp, Rattus norvegicus
gagctgctgcttatcctaggcaaaa

SEQ ID NO: 344017 - DNA, 25 bp, Rattus norvegicus
gagctgctgctttaggacggataca

SEQ ID NO: 344018 - DNA, 25 bp, Rattus norvegicus
gagctgctgctttggctggtacagc

SEQ ID NO: 344019 - DNA, 25 bp, Rattus norvegicus
gagctgctgcttttcctaggcaaaa

SEQ ID NO: 344020 - DNA, 25 bp, Rattus norvegicus
gagctgctggctaggcttttataaa

SEQ ID NO: 344021 - DNA, 25 bp, Rattus norvegicus
gagctgctggcttggcttttataaa

SEQ ID NO: 344022 - DNA, 25 bp, Rattus norvegicus
gagctgctgtcgctggcaaagcaac

SEQ ID NO: 344023 - DNA, 25 bp, Rattus norvegicus
gagctgctgtcggtggcaaagcaac

SEQ ID NO: 344024 - DNA, 25 bp, Rattus norvegicus
gagctgcttactcaagttttcatga

SEQ ID NO: 344025 - DNA, 25 bp, Rattus norvegicus
gagctgcttactgaagttttcatga

SEQ ID NO: 344026 - DNA, 25 bp, Rattus norvegicus
gagctgcttcatagactactgtcta

SEQ ID NO: 344027 - DNA, 25 bp, Rattus norvegicus
gagctgcttcattgactactgtcta

SEQ ID NO: 344028 - DNA, 25 bp, Rattus norvegicus
gagctgcttctgagtctactttcaa

SEQ ID NO: 344029 - DNA, 25 bp, Rattus norvegicus
gagctgcttctgtgtctactttcaa

SEQ ID NO: 344030 - DNA, 25 bp, Rattus norvegicus
gagctgctttaacttgtctgtccta

SEQ ID NO: 344031 - DNA, 25 bp, Rattus norvegicus
gagctgctttaagttgtctgtccta

SEQ ID NO: 344032 - DNA, 25 bp, Rattus norvegicus
gagctgctttacagtttttcactgc

SEQ ID NO: 344033 - DNA, 25 bp, Rattus norvegicus
gagctgctttactgtttttcactgc

SEQ ID NO: 344034 - DNA, 25 bp, Rattus norvegicus
gagctgctttccaaaatctgtctgt

SEQ ID NO: 344035 - DNA, 25 bp, Rattus norvegicus
gagctgctttcctaaatctgtctgt

SEQ ID NO: 344036 - DNA, 25 bp, Rattus norvegicus
gagctgctttctctgtttgagttta

SEQ ID NO: 344037 - DNA, 25 bp, Rattus norvegicus
gagctgctttctgtgtttgagttta

SEQ ID NO: 344038 - DNA, 25 bp, Rattus norvegicus
gagctgcttttgaacccttaggttt

SEQ ID NO: 344039 - DNA, 25 bp, Rattus norvegicus
gagctgcttttgtacccttaggttt

SEQ ID NO: 344040 - DNA, 25 bp, Rattus norvegicus
gagctggaagagctcactcctgtcc

SEQ ID NO: 344041 - DNA, 25 bp, Rattus norvegicus
gagctggaagaggtcactcctgtcc

SEQ ID NO: 344042 - DNA, 25 bp, Rattus norvegicus
gagctggaagctctgaaacaagcca

SEQ ID NO: 344043 - DNA, 25 bp, Rattus norvegicus
gagctggaagctgtgaaacaagcca

SEQ ID NO: 344044 - DNA, 25 bp, Rattus norvegicus
gagctggaatccattgatcttctag

SEQ ID NO: 344045 - DNA, 25 bp, Rattus norvegicus
gagctggaatcctttgatcttctag

SEQ ID NO: 344046 - DNA, 25 bp, Rattus norvegicus
gagctggaatgcaagaaccaccttt

SEQ ID NO: 344047 - DNA, 25 bp, Rattus norvegicus
gagctggaatgctagaaccaccttt

SEQ ID NO: 344048 - DNA, 25 bp, Rattus norvegicus
gagctggacaagaacctggagaaca

SEQ ID NO: 344049 - DNA, 25 bp, Rattus norvegicus
gagctggacaagtacctggagaaca

SEQ ID NO: 344050 - DNA, 25 bp, Rattus norvegicus
gagctggacagcaacgtggatgact

SEQ ID NO: 344051 - DNA, 25 bp, Rattus norvegicus
gagctggacagctacgtggatgact

SEQ ID NO: 344052 - DNA, 25 bp, Rattus norvegicus
gagctggacagtcaagcccaccggc

SEQ ID NO: 344053 - DNA, 25 bp, Rattus norvegicus
gagctggacagtgaagcccaccggc

SEQ ID NO: 344054 - DNA, 25 bp, Rattus norvegicus
gagctggaccggactgggtttaatc

SEQ ID NO: 344055 - DNA, 25 bp, Rattus norvegicus
gagctggaccggtctgggtttaatc

SEQ ID NO: 344056 - DNA, 25 bp, Rattus norvegicus
gagctggacctacaagcccagttcc

SEQ ID NO: 344057 - DNA, 25 bp, Rattus norvegicus
gagctggacctagaagcccagttcc

SEQ ID NO: 344058 - DNA, 25 bp, Rattus norvegicus
gagctggaccttcacatgtgcagtt

SEQ ID NO: 344059 - DNA, 25 bp, Rattus norvegicus
gagctggaccttctagagtctacct

SEQ ID NO: 344060 - DNA, 25 bp, Rattus norvegicus
gagctggaccttgacatgtgcagtt

SEQ ID NO: 344061 - DNA, 25 bp, Rattus norvegicus
gagctggaccttgtagagtctacct

SEQ ID NO: 344062 - DNA, 25 bp, Rattus norvegicus
gagctggacgagcatctgttcctac

SEQ ID NO: 344063 - DNA, 25 bp, Rattus norvegicus
gagctggacgaggatctgttcctac

SEQ ID NO: 344064 - DNA, 25 bp, Rattus norvegicus
gagctggactccagtcgagccaagt

SEQ ID NO: 344065 - DNA, 25 bp, Rattus norvegicus
gagctggactcctgtcgagccaagt

SEQ ID NO: 344066 - DNA, 25 bp, Rattus norvegicus
gagctggagaaacacacacctgaca

SEQ ID NO: 344067 - DNA, 25 bp, Rattus norvegicus
gagctggagaaagacacacctgaca

SEQ ID NO: 344068 - DNA, 25 bp, Rattus norvegicus
gagctggagactcgcagtgtcccaa

SEQ ID NO: 344069 - DNA, 25 bp, Rattus norvegicus
gagctggagactggcagtgtcccaa

SEQ ID NO: 344070 - DNA, 25 bp, Rattus norvegicus
gagctggagcctatgctgatgacat

SEQ ID NO: 344071 - DNA, 25 bp, Rattus norvegicus
gagctggagcctttgctgatgacat

SEQ ID NO: 344072 - DNA, 25 bp, Rattus norvegicus
gagctggagtccaagattttactaa

SEQ ID NO: 344073 - DNA, 25 bp, Rattus norvegicus
gagctggagtcctagattttactaa

SEQ ID NO: 344074 - DNA, 25 bp, Rattus norvegicus
gagctggagttacccatgcacgcat

SEQ ID NO: 344075 - DNA, 25 bp, Rattus norvegicus
gagctggagttagccatgcacgcat

SEQ ID NO: 344076 - DNA, 25 bp, Rattus norvegicus
gagctggagtttcgcctggcttatt

SEQ ID NO: 344077 - DNA, 25 bp, Rattus norvegicus
gagctggagtttggcctggcttatt

SEQ ID NO: 344078 - DNA, 25 bp, Rattus norvegicus
gagctggatagacttcatcaaatgc

SEQ ID NO: 344079 - DNA, 25 bp, Rattus norvegicus
gagctggatagagttcatcaaatgc

SEQ ID NO: 344080 - DNA, 25 bp, Rattus norvegicus
gagctggatcctcacagtactgtcc

SEQ ID NO: 344081 - DNA, 25 bp, Rattus norvegicus
gagctggatcctgacagtactgtcc

SEQ ID NO: 344082 - DNA, 25 bp, Rattus norvegicus
gagctggatgatctccccaaggagc

SEQ ID NO: 344083 - DNA, 25 bp, Rattus norvegicus
gagctggatgatgtccccaaggagc

SEQ ID NO: 344084 - DNA, 25 bp, Rattus norvegicus
gagctggatggtacgtctgctacac

SEQ ID NO: 344085 - DNA, 25 bp, Rattus norvegicus
gagctggatggttcgtctgctacac

SEQ ID NO: 344086 - DNA, 25 bp, Rattus norvegicus
gagctggatttcaggagacctcctt

SEQ ID NO: 344087 - DNA, 25 bp, Rattus norvegicus
gagctggatttctggagacctcctt

SEQ ID NO: 344088 - DNA, 25 bp, Rattus norvegicus
gagctggcaaagacaccaagtctgc

SEQ ID NO: 344089 - DNA, 25 bp, Rattus norvegicus
gagctggcaaagtcaccaagtctgc

SEQ ID NO: 344090 - DNA, 25 bp, Rattus norvegicus
gagctggcaacgatcgtatggactt

SEQ ID NO: 344091 - DNA, 25 bp, Rattus norvegicus
gagctggcaacgttcgtatggactt

SEQ ID NO: 344092 - DNA, 25 bp, Rattus norvegicus
gagctggcacttcctcctagtggag

SEQ ID NO: 344093 - DNA, 25 bp, Rattus norvegicus
gagctggcacttgctcctagtggag

SEQ ID NO: 344094 - DNA, 25 bp, Rattus norvegicus
gagctggcagagatccactcagaga

SEQ ID NO: 344095 - DNA, 25 bp, Rattus norvegicus
gagctggcagagttccactcagaga

SEQ ID NO: 344096 - DNA, 25 bp, Rattus norvegicus
gagctggcaggcagagcacaccgat

SEQ ID NO: 344097 - DNA, 25 bp, Rattus norvegicus
gagctggcaggctgagcacaccgat

SEQ ID NO: 344098 - DNA, 25 bp, Rattus norvegicus
gagctggcattcaccaccaaagagg

SEQ ID NO: 344099 - DNA, 25 bp, Rattus norvegicus
gagctggcattctccaccaaagagg

SEQ ID NO: 344100 - DNA, 25 bp, Rattus norvegicus
gagctggcattgacgtctgatggca

SEQ ID NO: 344101 - DNA, 25 bp, Rattus norvegicus
gagctggcattgtcgtctgatggca

SEQ ID NO: 344102 - DNA, 25 bp, Rattus norvegicus
gagctggccactagactgggacaga

SEQ ID NO: 344103 - DNA, 25 bp, Rattus norvegicus
gagctggccacttgactgggacaga

SEQ ID NO: 344104 - DNA, 25 bp, Rattus norvegicus
gagctggccagaagcttatggatct

SEQ ID NO: 344105 - DNA, 25 bp, Rattus norvegicus
gagctggccagatgcttatggatct

SEQ ID NO: 344106 - DNA, 25 bp, Rattus norvegicus
gagctggccatccataaccgaggga

SEQ ID NO: 344107 - DNA, 25 bp, Rattus norvegicus
gagctggccatcgataaccgaggga

SEQ ID NO: 344108 - DNA, 25 bp, Rattus norvegicus
gagctggcccgtattgattctgtca

SEQ ID NO: 344109 - DNA, 25 bp, Rattus norvegicus
gagctggcccgttttgattctgtca

SEQ ID NO: 344110 - DNA, 25 bp, Rattus norvegicus
gagctggccgcaactaacatgtaaa

SEQ ID NO: 344111 - DNA, 25 bp, Rattus norvegicus
gagctggccgcatctaacatgtaaa

SEQ ID NO: 344112 - DNA, 25 bp, Rattus norvegicus
gagctggcctcaattcaaggttgct

SEQ ID NO: 344113 - DNA, 25 bp, Rattus norvegicus
gagctggcctcatttcaaggttgct

SEQ ID NO: 344114 - DNA, 25 bp, Rattus norvegicus
gagctggcctgcaggacacacagac

SEQ ID NO: 344115 - DNA, 25 bp, Rattus norvegicus
gagctggcctgctggacacacagac

SEQ ID NO: 344116 - DNA, 25 bp, Rattus norvegicus
gagctggcgttccaaataaccgtat

SEQ ID NO: 344117 - DNA, 25 bp, Rattus norvegicus
gagctggcgttcgaaataaccgtat

SEQ ID NO: 344118 - DNA, 25 bp, Rattus norvegicus
gagctggctacgacaaactctggca

SEQ ID NO: 344119 - DNA, 25 bp, Rattus norvegicus
gagctggctacgtcaaactctggca

SEQ ID NO: 344120 - DNA, 25 bp, Rattus norvegicus
gagctggctcaaagcagacatctga

SEQ ID NO: 344121 - DNA, 25 bp, Rattus norvegicus
gagctggctcaatgcagacatctga

SEQ ID NO: 344122 - DNA, 25 bp, Rattus norvegicus
gagctggctcacattaaattcttgg

SEQ ID NO: 344123 - DNA, 25 bp, Rattus norvegicus
gagctggctcactttaaattcttgg

SEQ ID NO: 344124 - DNA, 25 bp, Rattus norvegicus
gagctggctcagacaaaaatggtga

SEQ ID NO: 344125 - DNA, 25 bp, Rattus norvegicus
gagctggctcagatcgggatcatct

SEQ ID NO: 344126 - DNA, 25 bp, Rattus norvegicus
gagctggctcagtcaaaaatggtga

SEQ ID NO: 344127 - DNA, 25 bp, Rattus norvegicus
gagctggctcagttcgggatcatct

SEQ ID NO: 344128 - DNA, 25 bp, Rattus norvegicus
gagctggctctgaaaagggacgata

SEQ ID NO: 344129 - DNA, 25 bp, Rattus norvegicus
gagctggctctgtaaagggacgata

SEQ ID NO: 344130 - DNA, 25 bp, Rattus norvegicus
gagctggctgatattgtcaaacccc

SEQ ID NO: 344131 - DNA, 25 bp, Rattus norvegicus
gagctggctgattttgtcaaacccc

SEQ ID NO: 344132 - DNA, 25 bp, Rattus norvegicus
gagctggctgccagagtaaggacca

SEQ ID NO: 344133 - DNA, 25 bp, Rattus norvegicus
gagctggctgcctgagtaaggacca

SEQ ID NO: 344134 - DNA, 25 bp, Rattus norvegicus
gagctggctggacatgcccctccaa

SEQ ID NO: 344135 - DNA, 25 bp, Rattus norvegicus
gagctggctggagatgcccctccaa

SEQ ID NO: 344136 - DNA, 25 bp, Rattus norvegicus
gagctggctggtagcaccctgagtc

SEQ ID NO: 344137 - DNA, 25 bp, Rattus norvegicus
gagctggctggttgcaccctgagtc

SEQ ID NO: 344138 - DNA, 25 bp, Rattus norvegicus
gagctggctgtcacagacggaagct

SEQ ID NO: 344139 - DNA, 25 bp, Rattus norvegicus
gagctggctgtctcagacggaagct

SEQ ID NO: 344140 - DNA, 25 bp, Rattus norvegicus
gagctggctgtgctatccctgaaag

SEQ ID NO: 344141 - DNA, 25 bp, Rattus norvegicus
gagctggctgtggtatccctgaaag

SEQ ID NO: 344142 - DNA, 25 bp, Rattus norvegicus
gagctggcttccatgtggttgaaga

SEQ ID NO: 344143 - DNA, 25 bp, Rattus norvegicus
gagctggcttccttgtggttgaaga

SEQ ID NO: 344144 - DNA, 25 bp, Rattus norvegicus
gagctggctttaagccctacttgta

SEQ ID NO: 344145 - DNA, 25 bp, Rattus norvegicus
gagctggctttatgccctacttgta

SEQ ID NO: 344146 - DNA, 25 bp, Rattus norvegicus
gagctgggaaaactctatccgctgg

SEQ ID NO: 344147 - DNA, 25 bp, Rattus norvegicus
gagctgggaaaagtctatccgctgg

SEQ ID NO: 344148 - DNA, 25 bp, Rattus norvegicus
gagctgggacagaatcctaactcaa

SEQ ID NO: 344149 - DNA, 25 bp, Rattus norvegicus
gagctgggacagtatcctaactcaa

SEQ ID NO: 344150 - DNA, 25 bp, Rattus norvegicus
gagctgggacccaggctgacctctg

SEQ ID NO: 344151 - DNA, 25 bp, Rattus norvegicus
gagctgggacccataacagatgcaa

SEQ ID NO: 344152 - DNA, 25 bp, Rattus norvegicus
gagctgggaccctggctgacctctg

SEQ ID NO: 344153 - DNA, 25 bp, Rattus norvegicus
gagctgggacccttaacagatgcaa

SEQ ID NO: 344154 - DNA, 25 bp, Rattus norvegicus
gagctgggactgaatcatctggatt

SEQ ID NO: 344155 - DNA, 25 bp, Rattus norvegicus
gagctgggactgtatcatctggatt

SEQ ID NO: 344156 - DNA, 25 bp, Rattus norvegicus
gagctgggagctagggctctcaccc

SEQ ID NO: 344157 - DNA, 25 bp, Rattus norvegicus
gagctgggagcttgggctctcaccc

SEQ ID NO: 344158 - DNA, 25 bp, Rattus norvegicus
gagctgggatgcctgatgttaattc

SEQ ID NO: 344159 - DNA, 25 bp, Rattus norvegicus
gagctgggatgcgtgatgttaattc

SEQ ID NO: 344160 - DNA, 25 bp, Rattus norvegicus
gagctgggcatccatgtcattacat

SEQ ID NO: 344161 - DNA, 25 bp, Rattus norvegicus
gagctgggcatcgatgtcattacat

SEQ ID NO: 344162 - DNA, 25 bp, Rattus norvegicus
gagctgggcccgcgtgcgtgcgtgc

SEQ ID NO: 344163 - DNA, 25 bp, Rattus norvegicus
gagctgggcccgggtgcgtgcgtgc

SEQ ID NO: 344164 - DNA, 25 bp, Rattus norvegicus
gagctgggctaaaacctaggcacac

SEQ ID NO: 344165 - DNA, 25 bp, Rattus norvegicus
gagctgggctaacagtcagtccaca

SEQ ID NO: 344166 - DNA, 25 bp, Rattus norvegicus
gagctgggctaagagtcagtccaca

SEQ ID NO: 344167 - DNA, 25 bp, Rattus norvegicus
gagctgggctaatacctaggcacac

SEQ ID NO: 344168 - DNA, 25 bp, Rattus norvegicus
gagctgggctccactagacctggag

SEQ ID NO: 344169 - DNA, 25 bp, Rattus norvegicus
gagctgggctcctctagacctggag

SEQ ID NO: 344170 - DNA, 25 bp, Rattus norvegicus
gagctgggcttacacaattttgtct

SEQ ID NO: 344171 - DNA, 25 bp, Rattus norvegicus
gagctgggcttagacaattttgtct

SEQ ID NO: 344172 - DNA, 25 bp, Rattus norvegicus
gagctgggtcccaaggagtacgcat

SEQ ID NO: 344173 - DNA, 25 bp, Rattus norvegicus
gagctgggtccctaggagtacgcat

SEQ ID NO: 344174 - DNA, 25 bp, Rattus norvegicus
gagctgggtgctcacagcaaccaat

SEQ ID NO: 344175 - DNA, 25 bp, Rattus norvegicus
gagctgggtgctgacagcaaccaat

SEQ ID NO: 344176 - DNA, 25 bp, Rattus norvegicus
gagctgggttccagacactgacaag

SEQ ID NO: 344177 - DNA, 25 bp, Rattus norvegicus
gagctgggttcctgacactgacaag

SEQ ID NO: 344178 - DNA, 25 bp, Rattus norvegicus
gagctgggttttaacaagattttca

SEQ ID NO: 344179 - DNA, 25 bp, Rattus norvegicus
gagctgggtttttacaagattttca

SEQ ID NO: 344180 - DNA, 25 bp, Rattus norvegicus
gagctggtaccactcggacgatcac

SEQ ID NO: 344181 - DNA, 25 bp, Rattus norvegicus
gagctggtaccagtcggacgatcac

SEQ ID NO: 344182 - DNA, 25 bp, Rattus norvegicus
gagctggtactcagcaggactccat

SEQ ID NO: 344183 - DNA, 25 bp, Rattus norvegicus
gagctggtactctgcaggactccat

SEQ ID NO: 344184 - DNA, 25 bp, Rattus norvegicus
gagctggtagccatgttgggccaac

SEQ ID NO: 344185 - DNA, 25 bp, Rattus norvegicus
gagctggtagccttgttgggccaac

SEQ ID NO: 344186 - DNA, 25 bp, Rattus norvegicus
gagctggtccaaataagtcctatcc

SEQ ID NO: 344187 - DNA, 25 bp, Rattus norvegicus
gagctggtccaaccttcaacttccg

SEQ ID NO: 344188 - DNA, 25 bp, Rattus norvegicus
gagctggtccaagcttcaacttccg

SEQ ID NO: 344189 - DNA, 25 bp, Rattus norvegicus
gagctggtccaattaagtcctatcc

SEQ ID NO: 344190 - DNA, 25 bp, Rattus norvegicus
gagctggtccccatctagactgtac

SEQ ID NO: 344191 - DNA, 25 bp, Rattus norvegicus
gagctggtccccttctagactgtac

SEQ ID NO: 344192 - DNA, 25 bp, Rattus norvegicus
gagctggtctataaggttccacctc

SEQ ID NO: 344193 - DNA, 25 bp, Rattus norvegicus
gagctggtctattaggttccacctc

SEQ ID NO: 344194 - DNA, 25 bp, Rattus norvegicus
gagctggtctgaccgctgctgcaac

SEQ ID NO: 344195 - DNA, 25 bp, Rattus norvegicus
gagctggtctgagcgctgctgcaac

SEQ ID NO: 344196 - DNA, 25 bp, Rattus norvegicus
gagctggtgaaaacccatgctacat

SEQ ID NO: 344197 - DNA, 25 bp, Rattus norvegicus
gagctggtgaaatcccatgctacat

SEQ ID NO: 344198 - DNA, 25 bp, Rattus norvegicus
gagctggtgaagattatcaacgaca

SEQ ID NO: 344199 - DNA, 25 bp, Rattus norvegicus
gagctggtgaagtttatcaacgaca

SEQ ID NO: 344200 - DNA, 25 bp, Rattus norvegicus
gagctggtgaccagtggcctctcga

SEQ ID NO: 344201 - DNA, 25 bp, Rattus norvegicus
gagctggtgacctgtggcctctcga

SEQ ID NO: 344202 - DNA, 25 bp, Rattus norvegicus
gagctggtgatacacgactcctaca

SEQ ID NO: 344203 - DNA, 25 bp, Rattus norvegicus
gagctggtgatagacgactcctaca

SEQ ID NO: 344204 - DNA, 25 bp, Rattus norvegicus
gagctggtgcccctgcgtgactcac

SEQ ID NO: 344205 - DNA, 25 bp, Rattus norvegicus
gagctggtgcccgtgcgtgactcac

SEQ ID NO: 344206 - DNA, 25 bp, Rattus norvegicus
gagctggtgctacattaccaacaca

SEQ ID NO: 344207 - DNA, 25 bp, Rattus norvegicus
gagctggtgctagattaccaacaca

SEQ ID NO: 344208 - DNA, 25 bp, Rattus norvegicus
gagctggtgtaaaccccaagttcct

SEQ ID NO: 344209 - DNA, 25 bp, Rattus norvegicus
gagctggtgtaatccccaagttcct

SEQ ID NO: 344210 - DNA, 25 bp, Rattus norvegicus
gagctggttagtaagtcctctcacc

SEQ ID NO: 344211 - DNA, 25 bp, Rattus norvegicus
gagctggttagttagtcctctcacc

SEQ ID NO: 344212 - DNA, 25 bp, Rattus norvegicus
gagctggttattccgtgagcttgcc

SEQ ID NO: 344213 - DNA, 25 bp, Rattus norvegicus
gagctggttattgcgtgagcttgcc

SEQ ID NO: 344214 - DNA, 25 bp, Rattus norvegicus
gagctggttcccctaatccctggta

SEQ ID NO: 344215 - DNA, 25 bp, Rattus norvegicus
gagctggttcccgtaatccctggta

SEQ ID NO: 344216 - DNA, 25 bp, Rattus norvegicus
gagctggttctaactggaatgcccc

SEQ ID NO: 344217 - DNA, 25 bp, Rattus norvegicus
gagctggttctatctggaatgcccc

SEQ ID NO: 344218 - DNA, 25 bp, Rattus norvegicus
gagctggttctcacatcttaaacat

SEQ ID NO: 344219 - DNA, 25 bp, Rattus norvegicus
gagctggttctctcatcttaaacat

SEQ ID NO: 344220 - DNA, 25 bp, Rattus norvegicus
gagctggttgttcgacacgtgtcac

SEQ ID NO: 344221 - DNA, 25 bp, Rattus norvegicus
gagctggttgttggacacgtgtcac

SEQ ID NO: 344222 - DNA, 25 bp, Rattus norvegicus
gagctggtttcgatttatgtctgag

SEQ ID NO: 344223 - DNA, 25 bp, Rattus norvegicus
gagctggtttcgttttatgtctgag

SEQ ID NO: 344224 - DNA, 25 bp, Rattus norvegicus
gagctgtaacccagaaagccttgga

SEQ ID NO: 344225 - DNA, 25 bp, Rattus norvegicus
gagctgtaaccctgaaagccttgga

SEQ ID NO: 344226 - DNA, 25 bp, Rattus norvegicus
gagctgtaacctcatcactgggatg

SEQ ID NO: 344227 - DNA, 25 bp, Rattus norvegicus
gagctgtaacctgatcactgggatg

SEQ ID NO: 344228 - DNA, 25 bp, Rattus norvegicus
gagctgtacaccattagtagccaac

SEQ ID NO: 344229 - DNA, 25 bp, Rattus norvegicus
gagctgtacacctttagtagccaac

SEQ ID NO: 344230 - DNA, 25 bp, Rattus norvegicus
gagctgtaccatcatattttccagc

SEQ ID NO: 344231 - DNA, 25 bp, Rattus norvegicus
gagctgtaccatgatattttccagc

SEQ ID NO: 344232 - DNA, 25 bp, Rattus norvegicus
gagctgtacggaccctttaccagtg

SEQ ID NO: 344233 - DNA, 25 bp, Rattus norvegicus
gagctgtacggagcctttaccagtg

SEQ ID NO: 344234 - DNA, 25 bp, Rattus norvegicus
gagctgtactagatcatttcataag

SEQ ID NO: 344235 - DNA, 25 bp, Rattus norvegicus
gagctgtactagttcatttcataag

SEQ ID NO: 344236 - DNA, 25 bp, Rattus norvegicus
gagctgtactcaatctccatgtgaa

SEQ ID NO: 344237 - DNA, 25 bp, Rattus norvegicus
gagctgtactcattctccatgtgaa

SEQ ID NO: 344238 - DNA, 25 bp, Rattus norvegicus
gagctgtactcgaccacctcgatga

SEQ ID NO: 344239 - DNA, 25 bp, Rattus norvegicus
gagctgtactcgtccacctcgatga

SEQ ID NO: 344240 - DNA, 25 bp, Rattus norvegicus
gagctgtactctccatattggtgga

SEQ ID NO: 344241 - DNA, 25 bp, Rattus norvegicus
gagctgtactctgcatattggtgga

SEQ ID NO: 344242 - DNA, 25 bp, Rattus norvegicus
gagctgtactttactattattataa

SEQ ID NO: 344243 - DNA, 25 bp, Rattus norvegicus
gagctgtacttttctattattataa

SEQ ID NO: 344244 - DNA, 25 bp, Rattus norvegicus
gagctgtagttacaatactcaattt

SEQ ID NO: 344245 - DNA, 25 bp, Rattus norvegicus
gagctgtagttagaatactcaattt

SEQ ID NO: 344246 - DNA, 25 bp, Rattus norvegicus
gagctgtatgaaatctgtaatccta

SEQ ID NO: 344247 - DNA, 25 bp, Rattus norvegicus
gagctgtatgaattctgtaatccta

SEQ ID NO: 344248 - DNA, 25 bp, Rattus norvegicus
gagctgtattttactctggctaaga

SEQ ID NO: 344249 - DNA, 25 bp, Rattus norvegicus
gagctgtatttttctctggctaaga

SEQ ID NO: 344250 - DNA, 25 bp, Rattus norvegicus
gagctgtcaaccatcatttgctgag

SEQ ID NO: 344251 - DNA, 25 bp, Rattus norvegicus
gagctgtcaaccttcatttgctgag

SEQ ID NO: 344252 - DNA, 25 bp, Rattus norvegicus
gagctgtcagcaatctgtgtagagc

SEQ ID NO: 344253 - DNA, 25 bp, Rattus norvegicus
gagctgtcagcattctgtgtagagc

SEQ ID NO: 344254 - DNA, 25 bp, Rattus norvegicus
gagctgtcagctaaccatggtggca

SEQ ID NO: 344255 - DNA, 25 bp, Rattus norvegicus
gagctgtcagcttaccatggtggca

SEQ ID NO: 344256 - DNA, 25 bp, Rattus norvegicus
gagctgtcaggcagtgccaggcacc

SEQ ID NO: 344257 - DNA, 25 bp, Rattus norvegicus
gagctgtcaggctgtgccaggcacc

SEQ ID NO: 344258 - DNA, 25 bp, Rattus norvegicus
gagctgtcatagagtcgctgagcaa

SEQ ID NO: 344259 - DNA, 25 bp, Rattus norvegicus
gagctgtcatagtgtcgctgagcaa

SEQ ID NO: 344260 - DNA, 25 bp, Rattus norvegicus
gagctgtccaggagcctatagtgat

SEQ ID NO: 344261 - DNA, 25 bp, Rattus norvegicus
gagctgtccaggtgcctatagtgat

SEQ ID NO: 344262 - DNA, 25 bp, Rattus norvegicus
gagctgtcccacactgattttatat

SEQ ID NO: 344263 - DNA, 25 bp, Rattus norvegicus
gagctgtcccactctgattttatat

SEQ ID NO: 344264 - DNA, 25 bp, Rattus norvegicus
gagctgtcccagcagatcaacatga

SEQ ID NO: 344265 - DNA, 25 bp, Rattus norvegicus
gagctgtcccaggagatcaacatga

SEQ ID NO: 344266 - DNA, 25 bp, Rattus norvegicus
gagctgtcctggaccccgccaggaa

SEQ ID NO: 344267 - DNA, 25 bp, Rattus norvegicus
gagctgtcctggtccccgccaggaa

SEQ ID NO: 344268 - DNA, 25 bp, Rattus norvegicus
gagctgtcgaaacccaaccatcagg

SEQ ID NO: 344269 - DNA, 25 bp, Rattus norvegicus
gagctgtcgaaagccaaccatcagg

SEQ ID NO: 344270 - DNA, 25 bp, Rattus norvegicus
gagctgtctattacctatacttcaa

SEQ ID NO: 344271 - DNA, 25 bp, Rattus norvegicus
gagctgtctatttcctatacttcaa

SEQ ID NO: 344272 - DNA, 25 bp, Rattus norvegicus
gagctgtctccaaggaagtctcaca

SEQ ID NO: 344273 - DNA, 25 bp, Rattus norvegicus
gagctgtctccatggaagtctcaca

SEQ ID NO: 344274 - DNA, 25 bp, Rattus norvegicus
gagctgtctgaaagccttttcatgt

SEQ ID NO: 344275 - DNA, 25 bp, Rattus norvegicus
gagctgtctgaatgccttttcatgt

SEQ ID NO: 344276 - DNA, 25 bp, Rattus norvegicus
gagctgtctgttaacagggccagtt

SEQ ID NO: 344277 - DNA, 25 bp, Rattus norvegicus
gagctgtctgtttacagggccagtt

SEQ ID NO: 344278 - DNA, 25 bp, Rattus norvegicus
gagctgtctttgagtggagtcctgt

SEQ ID NO: 344279 - DNA, 25 bp, Rattus norvegicus
gagctgtctttgtgtggagtcctgt

SEQ ID NO: 344280 - DNA, 25 bp, Rattus norvegicus
gagctgtgaatgcaagtctctgtca

SEQ ID NO: 344281 - DNA, 25 bp, Rattus norvegicus
gagctgtgaatgctatttcctgaga

SEQ ID NO: 344282 - DNA, 25 bp, Rattus norvegicus
gagctgtgaatgctggtgtttacaa

SEQ ID NO: 344283 - DNA, 25 bp, Rattus norvegicus
gagctgtgaatggaagtctctgtca

SEQ ID NO: 344284 - DNA, 25 bp, Rattus norvegicus
gagctgtgaatggtatttcctgaga

SEQ ID NO: 344285 - DNA, 25 bp, Rattus norvegicus
gagctgtgaatggtggtgtttacaa

SEQ ID NO: 344286 - DNA, 25 bp, Rattus norvegicus
gagctgtgactcaaaatcctctgag

SEQ ID NO: 344287 - DNA, 25 bp, Rattus norvegicus
gagctgtgactctaaatcctctgag

SEQ ID NO: 344288 - DNA, 25 bp, Rattus norvegicus
gagctgtgcaaacaccagagccacc

SEQ ID NO: 344289 - DNA, 25 bp, Rattus norvegicus
gagctgtgcaaagaccagagccacc

SEQ ID NO: 344290 - DNA, 25 bp, Rattus norvegicus
gagctgtgcacaagcagatgagcat

SEQ ID NO: 344291 - DNA, 25 bp, Rattus norvegicus
gagctgtgcacatgcagatgagcat

SEQ ID NO: 344292 - DNA, 25 bp, Rattus norvegicus
gagctgtgccatacatagcaaggtt

SEQ ID NO: 344293 - DNA, 25 bp, Rattus norvegicus
gagctgtgccattcatagcaaggtt

SEQ ID NO: 344294 - DNA, 25 bp, Rattus norvegicus
gagctgtgccgtcgtaattttggct

SEQ ID NO: 344295 - DNA, 25 bp, Rattus norvegicus
gagctgtgccgtggtaattttggct

SEQ ID NO: 344296 - DNA, 25 bp, Rattus norvegicus
gagctgtgcctaccagagaaatcct

SEQ ID NO: 344297 - DNA, 25 bp, Rattus norvegicus
gagctgtgcctagcagagaaatcct

SEQ ID NO: 344298 - DNA, 25 bp, Rattus norvegicus
gagctgtgctctcggaaggaatatc

SEQ ID NO: 344299 - DNA, 25 bp, Rattus norvegicus
gagctgtgctctgggaaggaatatc

SEQ ID NO: 344300 - DNA, 25 bp, Rattus norvegicus
gagctgtgctttctagctcactacc

SEQ ID NO: 344301 - DNA, 25 bp, Rattus norvegicus
gagctgtgctttgtagctcactacc

SEQ ID NO: 344302 - DNA, 25 bp, Rattus norvegicus
gagctgtggaagatttactggaaat

SEQ ID NO: 344303 - DNA, 25 bp, Rattus norvegicus
gagctgtggaagttttactggaaat

SEQ ID NO: 344304 - DNA, 25 bp, Rattus norvegicus
gagctgtggacaaggccttgtacat

SEQ ID NO: 344305 - DNA, 25 bp, Rattus norvegicus
gagctgtggacatggccttgtacat

SEQ ID NO: 344306 - DNA, 25 bp, Rattus norvegicus
gagctgtggcaaatggcgctctcac

SEQ ID NO: 344307 - DNA, 25 bp, Rattus norvegicus
gagctgtggcaattggcgctctcac

SEQ ID NO: 344308 - DNA, 25 bp, Rattus norvegicus
gagctgtggctcaatcatctggaga

SEQ ID NO: 344309 - DNA, 25 bp, Rattus norvegicus
gagctgtggctctatcatctggaga

SEQ ID NO: 344310 - DNA, 25 bp, Rattus norvegicus
gagctgtggtgacatccccaattga

SEQ ID NO: 344311 - DNA, 25 bp, Rattus norvegicus
gagctgtggtgagatccccaattga

SEQ ID NO: 344312 - DNA, 25 bp, Rattus norvegicus
gagctgtgtaaaagcagccgcccac

SEQ ID NO: 344313 - DNA, 25 bp, Rattus norvegicus
gagctgtgtaaatgcagccgcccac

SEQ ID NO: 344314 - DNA, 25 bp, Rattus norvegicus
gagctgtgtacacaggtttgccact

SEQ ID NO: 344315 - DNA, 25 bp, Rattus norvegicus
gagctgtgtacagaggtttgccact

SEQ ID NO: 344316 - DNA, 25 bp, Rattus norvegicus
gagctgtgtaccaagtccggcttgt

SEQ ID NO: 344317 - DNA, 25 bp, Rattus norvegicus
gagctgtgtacctagtccggcttgt

SEQ ID NO: 344318 - DNA, 25 bp, Rattus norvegicus
gagctgtgtataccgtgtgcctttc

SEQ ID NO: 344319 - DNA, 25 bp, Rattus norvegicus
gagctgtgtatagcgtgtgcctttc

SEQ ID NO: 344320 - DNA, 25 bp, Rattus norvegicus
gagctgtgtcaacaattcaaccatt

SEQ ID NO: 344321 - DNA, 25 bp, Rattus norvegicus
gagctgtgtcaagaattcaaccatt

SEQ ID NO: 344322 - DNA, 25 bp, Rattus norvegicus
gagctgtgtgtcatacgtcttagta

SEQ ID NO: 344323 - DNA, 25 bp, Rattus norvegicus
gagctgtgtgtcttacgtcttagta

SEQ ID NO: 344324 - DNA, 25 bp, Rattus norvegicus
gagctgtgttgtccttcttgttaag

SEQ ID NO: 344325 - DNA, 25 bp, Rattus norvegicus
gagctgtgttgtgcttcttgttaag

SEQ ID NO: 344326 - DNA, 25 bp, Rattus norvegicus
gagctgttaagtaacaacctaggga

SEQ ID NO: 344327 - DNA, 25 bp, Rattus norvegicus
gagctgttaagttacaacctaggga

SEQ ID NO: 344328 - DNA, 25 bp, Rattus norvegicus
gagctgttacagaacttggacacac

SEQ ID NO: 344329 - DNA, 25 bp, Rattus norvegicus
gagctgttacagtacttggacacac

SEQ ID NO: 344330 - DNA, 25 bp, Rattus norvegicus
gagctgttactgcaatgagcccttt

SEQ ID NO: 344331 - DNA, 25 bp, Rattus norvegicus
gagctgttactggaatgagcccttt

SEQ ID NO: 344332 - DNA, 25 bp, Rattus norvegicus
gagctgttagtaccatgtctacccg

SEQ ID NO: 344333 - DNA, 25 bp, Rattus norvegicus
gagctgttagtagcatgtctacccg

SEQ ID NO: 344334 - DNA, 25 bp, Rattus norvegicus
gagctgttcagacagactgctgtgt

SEQ ID NO: 344335 - DNA, 25 bp, Rattus norvegicus
gagctgttcagagagactgctgtgt

SEQ ID NO: 344336 - DNA, 25 bp, Rattus norvegicus
gagctgttcagtatgaggagccaaa

SEQ ID NO: 344337 - DNA, 25 bp, Rattus norvegicus
gagctgttcagtttgaggagccaaa

SEQ ID NO: 344338 - DNA, 25 bp, Rattus norvegicus
gagctgttccacacagcacctagtg

SEQ ID NO: 344339 - DNA, 25 bp, Rattus norvegicus
gagctgttccactcagcacctagtg

SEQ ID NO: 344340 - DNA, 25 bp, Rattus norvegicus
gagctgttccagatctttagttcca

SEQ ID NO: 344341 - DNA, 25 bp, Rattus norvegicus
gagctgttccagttctttagttcca

SEQ ID NO: 344342 - DNA, 25 bp, Rattus norvegicus
gagctgttccttactgggacaggat

SEQ ID NO: 344343 - DNA, 25 bp, Rattus norvegicus
gagctgttcctttctgggacaggat

SEQ ID NO: 344344 - DNA, 25 bp, Rattus norvegicus
gagctgttctcaaagttgaaccaca

SEQ ID NO: 344345 - DNA, 25 bp, Rattus norvegicus
gagctgttctcacccgttttcaaaa

SEQ ID NO: 344346 - DNA, 25 bp, Rattus norvegicus
gagctgttctcagccgttttcaaaa

SEQ ID NO: 344347 - DNA, 25 bp, Rattus norvegicus
gagctgttctcatagttgaaccaca

SEQ ID NO: 344348 - DNA, 25 bp, Rattus norvegicus
gagctgttctggaagcactgaccca

SEQ ID NO: 344349 - DNA, 25 bp, Rattus norvegicus
gagctgttctggtagcactgaccca

SEQ ID NO: 344350 - DNA, 25 bp, Rattus norvegicus
gagctgttcttcatcttcagtgcaa

SEQ ID NO: 344351 - DNA, 25 bp, Rattus norvegicus
gagctgttcttcttcttcagtgcaa

SEQ ID NO: 344352 - DNA, 25 bp, Rattus norvegicus
gagctgttgaatagccaggtttctg

SEQ ID NO: 344353 - DNA, 25 bp, Rattus norvegicus
gagctgttgaattgccaggtttctg

SEQ ID NO: 344354 - DNA, 25 bp, Rattus norvegicus
gagctgttggcactccggcaataac

SEQ ID NO: 344355 - DNA, 25 bp, Rattus norvegicus
gagctgttggcagtccggcaataac

SEQ ID NO: 344356 - DNA, 25 bp, Rattus norvegicus
gagctgttgtgacgcctcagtcctc

SEQ ID NO: 344357 - DNA, 25 bp, Rattus norvegicus
gagctgttgtgaggcctcagtcctc

SEQ ID NO: 344358 - DNA, 25 bp, Rattus norvegicus
gagctgtttagacataagaccctac

SEQ ID NO: 344359 - DNA, 25 bp, Rattus norvegicus
gagctgtttagaccagtcatttatc

SEQ ID NO: 344360 - DNA, 25 bp, Rattus norvegicus
gagctgtttagagataagaccctac

SEQ ID NO: 344361 - DNA, 25 bp, Rattus norvegicus
gagctgtttagagcagtcatttatc

SEQ ID NO: 344362 - DNA, 25 bp, Rattus norvegicus
gagctgtttcacatacctgaagaat

SEQ ID NO: 344363 - DNA, 25 bp, Rattus norvegicus
gagctgtttcacttacctgaagaat

SEQ ID NO: 344364 - DNA, 25 bp, Rattus norvegicus
gagctgtttccaaaatgccttcttt

SEQ ID NO: 344365 - DNA, 25 bp, Rattus norvegicus
gagctgtttccacagctgaataagg

SEQ ID NO: 344366 - DNA, 25 bp, Rattus norvegicus
gagctgtttccagagctgaataagg

SEQ ID NO: 344367 - DNA, 25 bp, Rattus norvegicus
gagctgtttccataatgccttcttt

SEQ ID NO: 344368 - DNA, 25 bp, Rattus norvegicus
gagctgtttgagaattgacttcaca

SEQ ID NO: 344369 - DNA, 25 bp, Rattus norvegicus
gagctgtttgagtattgacttcaca

SEQ ID NO: 344370 - DNA, 25 bp, Rattus norvegicus
gagctgtttgcgctttttcagatgt

SEQ ID NO: 344371 - DNA, 25 bp, Rattus norvegicus
gagctgtttgcggtttttcagatgt

SEQ ID NO: 344372 - DNA, 25 bp, Rattus norvegicus
gagctgtttgctagggatctttaaa

SEQ ID NO: 344373 - DNA, 25 bp, Rattus norvegicus
gagctgtttgcttgggatctttaaa

SEQ ID NO: 344374 - DNA, 25 bp, Rattus norvegicus
gagctgtttgtcatggcccgagaac

SEQ ID NO: 344375 - DNA, 25 bp, Rattus norvegicus
gagctgtttgtcttggcccgagaac

SEQ ID NO: 344376 - DNA, 25 bp, Rattus norvegicus
gagctgttttccaagagcttcacct

SEQ ID NO: 344377 - DNA, 25 bp, Rattus norvegicus
gagctgttttccatcatgtagctag

SEQ ID NO: 344378 - DNA, 25 bp, Rattus norvegicus
gagctgttttcctagagcttcacct

SEQ ID NO: 344379 - DNA, 25 bp, Rattus norvegicus
gagctgttttccttcatgtagctag

SEQ ID NO: 344380 - DNA, 25 bp, Rattus norvegicus
gagctgttttggaatccaggctttt

SEQ ID NO: 344381 - DNA, 25 bp, Rattus norvegicus
gagctgttttggtatccaggctttt

SEQ ID NO: 344382 - DNA, 25 bp, Rattus norvegicus
gagcttaaatccagggctttgtgca

SEQ ID NO: 344383 - DNA, 25 bp, Rattus norvegicus
gagcttaaatcccttcgtagaatta

SEQ ID NO: 344384 - DNA, 25 bp, Rattus norvegicus
gagcttaaatccgttcgtagaatta

SEQ ID NO: 344385 - DNA, 25 bp, Rattus norvegicus
gagcttaaatcctgggctttgtgca

SEQ ID NO: 344386 - DNA, 25 bp, Rattus norvegicus
gagcttaaatgtactttactgagca

SEQ ID NO: 344387 - DNA, 25 bp, Rattus norvegicus
gagcttaaatgttctttactgagca

SEQ ID NO: 344388 - DNA, 25 bp, Rattus norvegicus
gagcttaaccccattcacagagaga

SEQ ID NO: 344389 - DNA, 25 bp, Rattus norvegicus
gagcttaacccctttcacagagaga

SEQ ID NO: 344390 - DNA, 25 bp, Rattus norvegicus
gagcttaacggccatagtcttcatc

SEQ ID NO: 344391 - DNA, 25 bp, Rattus norvegicus
gagcttaacggcgatagtcttcatc

SEQ ID NO: 344392 - DNA, 25 bp, Rattus norvegicus
gagcttaagctcactttcagcattc

SEQ ID NO: 344393 - DNA, 25 bp, Rattus norvegicus
gagcttaagctctctttcagcattc

SEQ ID NO: 344394 - DNA, 25 bp, Rattus norvegicus
gagcttaagttgcactttatttgtg

SEQ ID NO: 344395 - DNA, 25 bp, Rattus norvegicus
gagcttaagttggactttatttgtg

SEQ ID NO: 344396 - DNA, 25 bp, Rattus norvegicus
gagcttaattctatcgggatgtcaa

SEQ ID NO: 344397 - DNA, 25 bp, Rattus norvegicus
gagcttaattctttcgggatgtcaa

SEQ ID NO: 344398 - DNA, 25 bp, Rattus norvegicus
gagcttacacttcatttcttcatat

SEQ ID NO: 344399 - DNA, 25 bp, Rattus norvegicus
gagcttacacttgatttcttcatat

SEQ ID NO: 344400 - DNA, 25 bp, Rattus norvegicus
gagcttaccaagcatgcaggccaag

SEQ ID NO: 344401 - DNA, 25 bp, Rattus norvegicus
gagcttaccaaggatgcaggccaag

SEQ ID NO: 344402 - DNA, 25 bp, Rattus norvegicus
gagcttaccacaatatggctgaaga

SEQ ID NO: 344403 - DNA, 25 bp, Rattus norvegicus
gagcttaccacattatggctgaaga

SEQ ID NO: 344404 - DNA, 25 bp, Rattus norvegicus
gagcttacgtgtcaattcccaaaaa

SEQ ID NO: 344405 - DNA, 25 bp, Rattus norvegicus
gagcttacgtgtgaattcccaaaaa

SEQ ID NO: 344406 - DNA, 25 bp, Rattus norvegicus
gagcttacgttgatgaagacggaga

SEQ ID NO: 344407 - DNA, 25 bp, Rattus norvegicus
gagcttacgttgttgaagacggaga

SEQ ID NO: 344408 - DNA, 25 bp, Rattus norvegicus
gagcttactcagcacccatgatcaa

SEQ ID NO: 344409 - DNA, 25 bp, Rattus norvegicus
gagcttactcaggacccatgatcaa

SEQ ID NO: 344410 - DNA, 25 bp, Rattus norvegicus
gagcttactgcaagttaggcacaca

SEQ ID NO: 344411 - DNA, 25 bp, Rattus norvegicus
gagcttactgcatgttaggcacaca

SEQ ID NO: 344412 - DNA, 25 bp, Rattus norvegicus
gagcttactgtcacctgtcagaggg

SEQ ID NO: 344413 - DNA, 25 bp, Rattus norvegicus
gagcttactgtctcctgtcagaggg

SEQ ID NO: 344414 - DNA, 25 bp, Rattus norvegicus
gagcttagaattcctgcttcagctt

SEQ ID NO: 344415 - DNA, 25 bp, Rattus norvegicus
gagcttagaattgctgcttcagctt

SEQ ID NO: 344416 - DNA, 25 bp, Rattus norvegicus
gagcttagagcccttgtatttttgt

SEQ ID NO: 344417 - DNA, 25 bp, Rattus norvegicus
gagcttagagccgttgtatttttgt

SEQ ID NO: 344418 - DNA, 25 bp, Rattus norvegicus
gagcttagctgacggttcatgccac

SEQ ID NO: 344419 - DNA, 25 bp, Rattus norvegicus
gagcttagctgagggttcatgccac

SEQ ID NO: 344420 - DNA, 25 bp, Rattus norvegicus
gagcttagggcaagtctgtcagagt

SEQ ID NO: 344421 - DNA, 25 bp, Rattus norvegicus
gagcttagggcatgtctgtcagagt

SEQ ID NO: 344422 - DNA, 25 bp, Rattus norvegicus
gagcttaggttgatgtgcgtcccca

SEQ ID NO: 344423 - DNA, 25 bp, Rattus norvegicus
gagcttaggttgttgtgcgtcccca

SEQ ID NO: 344424 - DNA, 25 bp, Rattus norvegicus
gagcttagtaacaccgctgtaacaa

SEQ ID NO: 344425 - DNA, 25 bp, Rattus norvegicus
gagcttagtaactccgctgtaacaa

SEQ ID NO: 344426 - DNA, 25 bp, Rattus norvegicus
gagcttagtagtccacccctttaat

SEQ ID NO: 344427 - DNA, 25 bp, Rattus norvegicus
gagcttagtagtgcacccctttaat

SEQ ID NO: 344428 - DNA, 25 bp, Rattus norvegicus
gagcttagttttatgccttggatct

SEQ ID NO: 344429 - DNA, 25 bp, Rattus norvegicus
gagcttagttttttgccttggatct

SEQ ID NO: 344430 - DNA, 25 bp, Rattus norvegicus
gagcttataacccacaacatccggt

SEQ ID NO: 344431 - DNA, 25 bp, Rattus norvegicus
gagcttataaccgacaacatccggt

SEQ ID NO: 344432 - DNA, 25 bp, Rattus norvegicus
gagcttatacatcgactgtcccaaa

SEQ ID NO: 344433 - DNA, 25 bp, Rattus norvegicus
gagcttatacatggactgtcccaaa

SEQ ID NO: 344434 - DNA, 25 bp, Rattus norvegicus
gagcttatcaggagacccagcctag

SEQ ID NO: 344435 - DNA, 25 bp, Rattus norvegicus
gagcttatcaggtgacccagcctag

SEQ ID NO: 344436 - DNA, 25 bp, Rattus norvegicus
gagcttatcatccagtgtgaccaac

SEQ ID NO: 344437 - DNA, 25 bp, Rattus norvegicus
gagcttatcatcgagtgtgaccaac

SEQ ID NO: 344438 - DNA, 25 bp, Rattus norvegicus
gagcttatccaactgcctagcaata

SEQ ID NO: 344439 - DNA, 25 bp, Rattus norvegicus
gagcttatccaagtgcctagcaata

SEQ ID NO: 344440 - DNA, 25 bp, Rattus norvegicus
gagcttatcccgatgacctgggaaa

SEQ ID NO: 344441 - DNA, 25 bp, Rattus norvegicus
gagcttatcccgttgacctgggaaa

SEQ ID NO: 344442 - DNA, 25 bp, Rattus norvegicus
gagcttatctacctctgggatttta

SEQ ID NO: 344443 - DNA, 25 bp, Rattus norvegicus
gagcttatctacgtctgggatttta

SEQ ID NO: 344444 - DNA, 25 bp, Rattus norvegicus
gagcttatctgaacacaccaactgc

SEQ ID NO: 344445 - DNA, 25 bp, Rattus norvegicus
gagcttatctgatcacaccaactgc

SEQ ID NO: 344446 - DNA, 25 bp, Rattus norvegicus
gagcttatgagactccggcagtttc

SEQ ID NO: 344447 - DNA, 25 bp, Rattus norvegicus
gagcttatgagagtccggcagtttc

SEQ ID NO: 344448 - DNA, 25 bp, Rattus norvegicus
gagcttattcagcaacctccaggaa

SEQ ID NO: 344449 - DNA, 25 bp, Rattus norvegicus
gagcttattcaggaacctccaggaa

SEQ ID NO: 344450 - DNA, 25 bp, Rattus norvegicus
gagcttattgtaaacgtttggttca

SEQ ID NO: 344451 - DNA, 25 bp, Rattus norvegicus
gagcttattgtatacgtttggttca

SEQ ID NO: 344452 - DNA, 25 bp, Rattus norvegicus
gagcttcaagagctcatccacactg

SEQ ID NO: 344453 - DNA, 25 bp, Rattus norvegicus
gagcttcaagaggtcatccacactg

SEQ ID NO: 344454 - DNA, 25 bp, Rattus norvegicus
gagcttcaatagcatcaccgttgtg

SEQ ID NO: 344455 - DNA, 25 bp, Rattus norvegicus
gagcttcaataggatcaccgttgtg

SEQ ID NO: 344456 - DNA, 25 bp, Rattus norvegicus
gagcttcacctgatgcctcttgtgg

SEQ ID NO: 344457 - DNA, 25 bp, Rattus norvegicus
gagcttcacctgttgcctcttgtgg

SEQ ID NO: 344458 - DNA, 25 bp, Rattus norvegicus
gagcttcacttcagaagtcccagga

SEQ ID NO: 344459 - DNA, 25 bp, Rattus norvegicus
gagcttcacttctgaagtcccagga

SEQ ID NO: 344460 - DNA, 25 bp, Rattus norvegicus
gagcttcagagcatgctatgtcatt

SEQ ID NO: 344461 - DNA, 25 bp, Rattus norvegicus
gagcttcagagcttgctatgtcatt

SEQ ID NO: 344462 - DNA, 25 bp, Rattus norvegicus
gagcttcagattcaagcttgcccaa

SEQ ID NO: 344463 - DNA, 25 bp, Rattus norvegicus
gagcttcagattgaagcttgcccaa

SEQ ID NO: 344464 - DNA, 25 bp, Rattus norvegicus
gagcttcagcagaacatacaagcca

SEQ ID NO: 344465 - DNA, 25 bp, Rattus norvegicus
gagcttcagcagcaacactgtggct

SEQ ID NO: 344466 - DNA, 25 bp, Rattus norvegicus
gagcttcagcaggaacactgtggct

SEQ ID NO: 344467 - DNA, 25 bp, Rattus norvegicus
gagcttcagcagtacatacaagcca

SEQ ID NO: 344468 - DNA, 25 bp, Rattus norvegicus
gagcttcaggaactgtctttatcca

SEQ ID NO: 344469 - DNA, 25 bp, Rattus norvegicus
gagcttcaggaagtgtctttatcca

SEQ ID NO: 344470 - DNA, 25 bp, Rattus norvegicus
gagcttcaggagctggttgtccaca

SEQ ID NO: 344471 - DNA, 25 bp, Rattus norvegicus
gagcttcaggaggtggttgtccaca

SEQ ID NO: 344472 - DNA, 25 bp, Rattus norvegicus
gagcttcaggctctccaagatgtaa

SEQ ID NO: 344473 - DNA, 25 bp, Rattus norvegicus
gagcttcaggctgtccaagatgtaa

SEQ ID NO: 344474 - DNA, 25 bp, Rattus norvegicus
gagcttcagggaattccaccttggt

SEQ ID NO: 344475 - DNA, 25 bp, Rattus norvegicus
gagcttcagggatttccaccttggt

SEQ ID NO: 344476 - DNA, 25 bp, Rattus norvegicus
gagcttcatcaaaaccactaatact

SEQ ID NO: 344477 - DNA, 25 bp, Rattus norvegicus
gagcttcatcaataccactaatact

SEQ ID NO: 344478 - DNA, 25 bp, Rattus norvegicus
gagcttcatgaacgtctctaccgcg

SEQ ID NO: 344479 - DNA, 25 bp, Rattus norvegicus
gagcttcatgaaggtctctaccgcg

SEQ ID NO: 344480 - DNA, 25 bp, Rattus norvegicus
gagcttcatgagcttcgatctcaca

SEQ ID NO: 344481 - DNA, 25 bp, Rattus norvegicus
gagcttcatgaggttcgatctcaca

SEQ ID NO: 344482 - DNA, 25 bp, Rattus norvegicus
gagcttcatgctacaggagtgttag

SEQ ID NO: 344483 - DNA, 25 bp, Rattus norvegicus
gagcttcatgcttcaggagtgttag

SEQ ID NO: 344484 - DNA, 25 bp, Rattus norvegicus
gagcttcattccctgaaaggaggat

SEQ ID NO: 344485 - DNA, 25 bp, Rattus norvegicus
gagcttcattccgtgaaaggaggat

SEQ ID NO: 344486 - DNA, 25 bp, Rattus norvegicus
gagcttccaaacagaagccgctgta

SEQ ID NO: 344487 - DNA, 25 bp, Rattus norvegicus
gagcttccaaactgaagccgctgta

SEQ ID NO: 344488 - DNA, 25 bp, Rattus norvegicus
gagcttccaaagagggacccctcag

SEQ ID NO: 344489 - DNA, 25 bp, Rattus norvegicus
gagcttccaaagtgggacccctcag

SEQ ID NO: 344490 - DNA, 25 bp, Rattus norvegicus
gagcttccaagtctcaagcattcat

SEQ ID NO: 344491 - DNA, 25 bp, Rattus norvegicus
gagcttccaagtgtcaagcattcat

SEQ ID NO: 344492 - DNA, 25 bp, Rattus norvegicus
gagcttccactgctcaggaaaggaa

SEQ ID NO: 344493 - DNA, 25 bp, Rattus norvegicus
gagcttccactggtcaggaaaggaa

SEQ ID NO: 344494 - DNA, 25 bp, Rattus norvegicus
gagcttccagggatctattctgtac

SEQ ID NO: 344495 - DNA, 25 bp, Rattus norvegicus
gagcttccagggttctattctgtac

SEQ ID NO: 344496 - DNA, 25 bp, Rattus norvegicus
gagcttccatataactccaagttta

SEQ ID NO: 344497 - DNA, 25 bp, Rattus norvegicus
gagcttccatattactccaagttta

SEQ ID NO: 344498 - DNA, 25 bp, Rattus norvegicus
gagcttcccaaaaatcttaaccaca

SEQ ID NO: 344499 - DNA, 25 bp, Rattus norvegicus
gagcttcccaaatatcttaaccaca

SEQ ID NO: 344500 - DNA, 25 bp, Rattus norvegicus
gagcttcccctgaggttctgatgag

SEQ ID NO: 344501 - DNA, 25 bp, Rattus norvegicus
gagcttcccctgtggttctgatgag

SEQ ID NO: 344502 - DNA, 25 bp, Rattus norvegicus
gagcttccccttaaaatggcttgtg

SEQ ID NO: 344503 - DNA, 25 bp, Rattus norvegicus
gagcttcccctttaaatggcttgtg

SEQ ID NO: 344504 - DNA, 25 bp, Rattus norvegicus
gagcttccctgactctgttttgtta

SEQ ID NO: 344505 - DNA, 25 bp, Rattus norvegicus
gagcttccctgagtctgttttgtta

SEQ ID NO: 344506 - DNA, 25 bp, Rattus norvegicus
gagcttccggaacgttctgtgccta

SEQ ID NO: 344507 - DNA, 25 bp, Rattus norvegicus
gagcttccggaaggttctgtgccta

SEQ ID NO: 344508 - DNA, 25 bp, Rattus norvegicus
gagcttccggcaatttgtgtctggc

SEQ ID NO: 344509 - DNA, 25 bp, Rattus norvegicus
gagcttccggcattttgtgtctggc

SEQ ID NO: 344510 - DNA, 25 bp, Rattus norvegicus
gagcttcctcagcaggtagtgcagt

SEQ ID NO: 344511 - DNA, 25 bp, Rattus norvegicus
gagcttcctcaggaggtagtgcagt

SEQ ID NO: 344512 - DNA, 25 bp, Rattus norvegicus
gagcttcctccaacaattggcagaa

SEQ ID NO: 344513 - DNA, 25 bp, Rattus norvegicus
gagcttcctccatcaattggcagaa

SEQ ID NO: 344514 - DNA, 25 bp, Rattus norvegicus
gagcttcctgatactgtgccaacca

SEQ ID NO: 344515 - DNA, 25 bp, Rattus norvegicus
gagcttcctgattctgtgccaacca

SEQ ID NO: 344516 - DNA, 25 bp, Rattus norvegicus
gagcttcctggtactgtcttgtatc

SEQ ID NO: 344517 - DNA, 25 bp, Rattus norvegicus
gagcttcctggttctgtcttgtatc

SEQ ID NO: 344518 - DNA, 25 bp, Rattus norvegicus
gagcttccttataaaaaccactatc

SEQ ID NO: 344519 - DNA, 25 bp, Rattus norvegicus
gagcttccttattaaaaccactatc

SEQ ID NO: 344520 - DNA, 25 bp, Rattus norvegicus
gagcttccttgaaactgacggcttc

SEQ ID NO: 344521 - DNA, 25 bp, Rattus norvegicus
gagcttccttgatactgacggcttc

SEQ ID NO: 344522 - DNA, 25 bp, Rattus norvegicus
gagcttcgccagcaattcatcagta

SEQ ID NO: 344523 - DNA, 25 bp, Rattus norvegicus
gagcttcgccaggaattcatcagta

SEQ ID NO: 344524 - DNA, 25 bp, Rattus norvegicus
gagcttcgcttcctggagaacggct

SEQ ID NO: 344525 - DNA, 25 bp, Rattus norvegicus
gagcttcgcttcgtggagaacggct

SEQ ID NO: 344526 - DNA, 25 bp, Rattus norvegicus
gagcttcggaatatcttttcctcaa

SEQ ID NO: 344527 - DNA, 25 bp, Rattus norvegicus
gagcttcggaatttcttttcctcaa

SEQ ID NO: 344528 - DNA, 25 bp, Rattus norvegicus
gagcttcggctcatctccccggaaa

SEQ ID NO: 344529 - DNA, 25 bp, Rattus norvegicus
gagcttcggctcttctccccggaaa

SEQ ID NO: 344530 - DNA, 25 bp, Rattus norvegicus
gagcttcgggcaaatgccgacagca

SEQ ID NO: 344531 - DNA, 25 bp, Rattus norvegicus
gagcttcgggcatatgccgacagca

SEQ ID NO: 344532 - DNA, 25 bp, Rattus norvegicus
gagcttcgttttctacacgtgtgac

SEQ ID NO: 344533 - DNA, 25 bp, Rattus norvegicus
gagcttcgttttgtacacgtgtgac

SEQ ID NO: 344534 - DNA, 25 bp, Rattus norvegicus
gagcttctaacaccctccttttggg

SEQ ID NO: 344535 - DNA, 25 bp, Rattus norvegicus
gagcttctaacagcctccttttggg

SEQ ID NO: 344536 - DNA, 25 bp, Rattus norvegicus
gagcttctatacactcaagtgctgt

SEQ ID NO: 344537 - DNA, 25 bp, Rattus norvegicus
gagcttctatactctcaagtgctgt

SEQ ID NO: 344538 - DNA, 25 bp, Rattus norvegicus
gagcttctcagcctgggttcaggaa

SEQ ID NO: 344539 - DNA, 25 bp, Rattus norvegicus
gagcttctcagcgtgggttcaggaa

SEQ ID NO: 344540 - DNA, 25 bp, Rattus norvegicus
gagcttctcattcaactctaaagca

SEQ ID NO: 344541 - DNA, 25 bp, Rattus norvegicus
gagcttctcattgaactctaaagca

SEQ ID NO: 344542 - DNA, 25 bp, Rattus norvegicus
gagcttctctcaatcaattctgtgg

SEQ ID NO: 344543 - DNA, 25 bp, Rattus norvegicus
gagcttctctcattcaattctgtgg

SEQ ID NO: 344544 - DNA, 25 bp, Rattus norvegicus
gagcttctctgcataagcgtttgca

SEQ ID NO: 344545 - DNA, 25 bp, Rattus norvegicus
gagcttctctgcttaagcgtttgca

SEQ ID NO: 344546 - DNA, 25 bp, Rattus norvegicus
gagcttctcttgacagtaccctgaa

SEQ ID NO: 344547 - DNA, 25 bp, Rattus norvegicus
gagcttctcttgtcagtaccctgaa

SEQ ID NO: 344548 - DNA, 25 bp, Rattus norvegicus
gagcttctgaagaaacgcagtgcac

SEQ ID NO: 344549 - DNA, 25 bp, Rattus norvegicus
gagcttctgaagtaacgcagtgcac

SEQ ID NO: 344550 - DNA, 25 bp, Rattus norvegicus
gagcttctgcaaaactaacctgctt

SEQ ID NO: 344551 - DNA, 25 bp, Rattus norvegicus
gagcttctgcaatactaacctgctt

SEQ ID NO: 344552 - DNA, 25 bp, Rattus norvegicus
gagcttctgcagacccgaagttggg

SEQ ID NO: 344553 - DNA, 25 bp, Rattus norvegicus
gagcttctgcagtcccgaagttggg

SEQ ID NO: 344554 - DNA, 25 bp, Rattus norvegicus
gagcttctgcatatgtgggtactgt

SEQ ID NO: 344555 - DNA, 25 bp, Rattus norvegicus
gagcttctgcatttgtgggtactgt

SEQ ID NO: 344556 - DNA, 25 bp, Rattus norvegicus
gagcttctgtccagagcgttctgtg

SEQ ID NO: 344557 - DNA, 25 bp, Rattus norvegicus
gagcttctgtccagtgcttatcctg

SEQ ID NO: 344558 - DNA, 25 bp, Rattus norvegicus
gagcttctgtcctgagcgttctgtg

SEQ ID NO: 344559 - DNA, 25 bp, Rattus norvegicus
gagcttctgtcctgtgcttatcctg

SEQ ID NO: 344560 - DNA, 25 bp, Rattus norvegicus
gagcttcttacacagcacagaggac

SEQ ID NO: 344561 - DNA, 25 bp, Rattus norvegicus
gagcttcttacagagcacagaggac

SEQ ID NO: 344562 - DNA, 25 bp, Rattus norvegicus
gagcttcttaccctgacctcaggag

SEQ ID NO: 344563 - DNA, 25 bp, Rattus norvegicus
gagcttcttaccgtgacctcaggag

SEQ ID NO: 344564 - DNA, 25 bp, Rattus norvegicus
gagcttctttgtcttgatgtactgc

SEQ ID NO: 344565 - DNA, 25 bp, Rattus norvegicus
gagcttctttgtgttgatgtactgc

SEQ ID NO: 344566 - DNA, 25 bp, Rattus norvegicus
gagcttgaaaggaccccagtgctga

SEQ ID NO: 344567 - DNA, 25 bp, Rattus norvegicus
gagcttgaaaggtccccagtgctga

SEQ ID NO: 344568 - DNA, 25 bp, Rattus norvegicus
gagcttgaacctcttgagtgtaaaa

SEQ ID NO: 344569 - DNA, 25 bp, Rattus norvegicus
gagcttgaacctgttgagtgtaaaa

SEQ ID NO: 344570 - DNA, 25 bp, Rattus norvegicus
gagcttgaacgcattctttattgat

SEQ ID NO: 344571 - DNA, 25 bp, Rattus norvegicus
gagcttgaacgctttctttattgat

SEQ ID NO: 344572 - DNA, 25 bp, Rattus norvegicus
gagcttgaagctcgacgtcattcag

SEQ ID NO: 344573 - DNA, 25 bp, Rattus norvegicus
gagcttgaagctggacgtcattcag

SEQ ID NO: 344574 - DNA, 25 bp, Rattus norvegicus
gagcttgacacccagttagtacggc

SEQ ID NO: 344575 - DNA, 25 bp, Rattus norvegicus
gagcttgacaccgagttagtacggc

SEQ ID NO: 344576 - DNA, 25 bp, Rattus norvegicus
gagcttgacctcctatgtctgaaaa

SEQ ID NO: 344577 - DNA, 25 bp, Rattus norvegicus
gagcttgacctcgtatgtctgaaaa

SEQ ID NO: 344578 - DNA, 25 bp, Rattus norvegicus
gagcttgacgccctcgggcatgtac

SEQ ID NO: 344579 - DNA, 25 bp, Rattus norvegicus
gagcttgacgccgtcgggcatgtac

SEQ ID NO: 344580 - DNA, 25 bp, Rattus norvegicus
gagcttgactctaacaaccacatga

SEQ ID NO: 344581 - DNA, 25 bp, Rattus norvegicus
gagcttgactcttacaaccacatga

SEQ ID NO: 344582 - DNA, 25 bp, Rattus norvegicus
gagcttgactggatcccaaagcgat

SEQ ID NO: 344583 - DNA, 25 bp, Rattus norvegicus
gagcttgactggttcccaaagcgat

SEQ ID NO: 344584 - DNA, 25 bp, Rattus norvegicus
gagcttgacttgaacctccagttat

SEQ ID NO: 344585 - DNA, 25 bp, Rattus norvegicus
gagcttgacttgtacctccagttat

SEQ ID NO: 344586 - DNA, 25 bp, Rattus norvegicus
gagcttgagaaaacagcggccacat

SEQ ID NO: 344587 - DNA, 25 bp, Rattus norvegicus
gagcttgagaaatcagcggccacat

SEQ ID NO: 344588 - DNA, 25 bp, Rattus norvegicus
gagcttgagatgaagcccatgcaga

SEQ ID NO: 344589 - DNA, 25 bp, Rattus norvegicus
gagcttgagatgtagcccatgcaga

SEQ ID NO: 344590 - DNA, 25 bp, Rattus norvegicus
gagcttgagcccagccggtcccgga

SEQ ID NO: 344591 - DNA, 25 bp, Rattus norvegicus
gagcttgagccctgccggtcccgga

SEQ ID NO: 344592 - DNA, 25 bp, Rattus norvegicus
gagcttgagcttcagagcccagcaa

SEQ ID NO: 344593 - DNA, 25 bp, Rattus norvegicus
gagcttgagcttgagagcccagcaa

SEQ ID NO: 344594 - DNA, 25 bp, Rattus norvegicus
gagcttgaggccacagcatccagga

SEQ ID NO: 344595 - DNA, 25 bp, Rattus norvegicus
gagcttgaggcctcagcatccagga

SEQ ID NO: 344596 - DNA, 25 bp, Rattus norvegicus
gagcttgagggcagcctgacctttg

SEQ ID NO: 344597 - DNA, 25 bp, Rattus norvegicus
gagcttgagggctgcctgacctttg

SEQ ID NO: 344598 - DNA, 25 bp, Rattus norvegicus
gagcttgaggtccaggttgtttttt

SEQ ID NO: 344599 - DNA, 25 bp, Rattus norvegicus
gagcttgaggtcgaggttgtttttt

SEQ ID NO: 344600 - DNA, 25 bp, Rattus norvegicus
gagcttgagtgtctggatttttaaa

SEQ ID NO: 344601 - DNA, 25 bp, Rattus norvegicus
gagcttgagtgtgtggatttttaaa

SEQ ID NO: 344602 - DNA, 25 bp, Rattus norvegicus
gagcttgagttcatactacttgtta

SEQ ID NO: 344603 - DNA, 25 bp, Rattus norvegicus
gagcttgagttcttactacttgtta

SEQ ID NO: 344604 - DNA, 25 bp, Rattus norvegicus
gagcttgatcctctgaatccatgat

SEQ ID NO: 344605 - DNA, 25 bp, Rattus norvegicus
gagcttgatcctgtgaatccatgat

SEQ ID NO: 344606 - DNA, 25 bp, Rattus norvegicus
gagcttgcacaacagctgcacgtct

SEQ ID NO: 344607 - DNA, 25 bp, Rattus norvegicus
gagcttgcacaagagctgcacgtct

SEQ ID NO: 344608 - DNA, 25 bp, Rattus norvegicus
gagcttgcacaccagtagcgaacaa

SEQ ID NO: 344609 - DNA, 25 bp, Rattus norvegicus
gagcttgcacacgagtagcgaacaa

SEQ ID NO: 344610 - DNA, 25 bp, Rattus norvegicus
gagcttgcagcgaccgaactagaaa

SEQ ID NO: 344611 - DNA, 25 bp, Rattus norvegicus
gagcttgcagcgtccgaactagaaa

SEQ ID NO: 344612 - DNA, 25 bp, Rattus norvegicus
gagcttgcaggtccctttttattat

SEQ ID NO: 344613 - DNA, 25 bp, Rattus norvegicus
gagcttgcaggtgcctttttattat

SEQ ID NO: 344614 - DNA, 25 bp, Rattus norvegicus
gagcttgccggaaaaaacccagatt

SEQ ID NO: 344615 - DNA, 25 bp, Rattus norvegicus
gagcttgccggataaaacccagatt

SEQ ID NO: 344616 - DNA, 25 bp, Rattus norvegicus
gagcttgccgtgatttaattttcta

SEQ ID NO: 344617 - DNA, 25 bp, Rattus norvegicus
gagcttgccgtgttttaattttcta

SEQ ID NO: 344618 - DNA, 25 bp, Rattus norvegicus
gagcttgcctatatctgtctaatca

SEQ ID NO: 344619 - DNA, 25 bp, Rattus norvegicus
gagcttgcctatttctgtctaatca

SEQ ID NO: 344620 - DNA, 25 bp, Rattus norvegicus
gagcttgcgaacagggagcctcttt

SEQ ID NO: 344621 - DNA, 25 bp, Rattus norvegicus
gagcttgcgaactgggagcctcttt

SEQ ID NO: 344622 - DNA, 25 bp, Rattus norvegicus
gagcttgctattataagtccggagg

SEQ ID NO: 344623 - DNA, 25 bp, Rattus norvegicus
gagcttgctattttaagtccggagg

SEQ ID NO: 344624 - DNA, 25 bp, Rattus norvegicus
gagcttgctcacatgttcattattt

SEQ ID NO: 344625 - DNA, 25 bp, Rattus norvegicus
gagcttgctcaccagcatggtggat

SEQ ID NO: 344626 - DNA, 25 bp, Rattus norvegicus
gagcttgctcacgagcatggtggat

SEQ ID NO: 344627 - DNA, 25 bp, Rattus norvegicus
gagcttgctcacttgttcattattt

SEQ ID NO: 344628 - DNA, 25 bp, Rattus norvegicus
gagcttgctgagaacatggattcca

SEQ ID NO: 344629 - DNA, 25 bp, Rattus norvegicus
gagcttgctgagtacatggattcca

SEQ ID NO: 344630 - DNA, 25 bp, Rattus norvegicus
gagcttgctgtgcaggtcgtatcaa

SEQ ID NO: 344631 - DNA, 25 bp, Rattus norvegicus
gagcttgctgtggaggtcgtatcaa

SEQ ID NO: 344632 - DNA, 25 bp, Rattus norvegicus
gagcttgcttacattcatgtgccac

SEQ ID NO: 344633 - DNA, 25 bp, Rattus norvegicus
gagcttgcttactttcatgtgccac

SEQ ID NO: 344634 - DNA, 25 bp, Rattus norvegicus
gagcttgcttctatagcaggcatga

SEQ ID NO: 344635 - DNA, 25 bp, Rattus norvegicus
gagcttgcttctttagcaggcatga

SEQ ID NO: 344636 - DNA, 25 bp, Rattus norvegicus
gagcttggaaacatacttttgatct

SEQ ID NO: 344637 - DNA, 25 bp, Rattus norvegicus
gagcttggaaacttacttttgatct

SEQ ID NO: 344638 - DNA, 25 bp, Rattus norvegicus
gagcttggaagaaaccaaggctgag

SEQ ID NO: 344639 - DNA, 25 bp, Rattus norvegicus
gagcttggaagataccaaggctgag

SEQ ID NO: 344640 - DNA, 25 bp, Rattus norvegicus
gagcttggagcaacagagtatccca

SEQ ID NO: 344641 - DNA, 25 bp, Rattus norvegicus
gagcttggagcatcagagtatccca

SEQ ID NO: 344642 - DNA, 25 bp, Rattus norvegicus
gagcttggagcccagttctactagc

SEQ ID NO: 344643 - DNA, 25 bp, Rattus norvegicus
gagcttggagccgagttctactagc

SEQ ID NO: 344644 - DNA, 25 bp, Rattus norvegicus
gagcttggatcaatggttctggtta

SEQ ID NO: 344645 - DNA, 25 bp, Rattus norvegicus
gagcttggatcattggttctggtta

SEQ ID NO: 344646 - DNA, 25 bp, Rattus norvegicus
gagcttggcactaatctcaacttcc

SEQ ID NO: 344647 - DNA, 25 bp, Rattus norvegicus
gagcttggcacttatctcaacttcc

SEQ ID NO: 344648 - DNA, 25 bp, Rattus norvegicus
gagcttggcagcacctcaggaggaa

SEQ ID NO: 344649 - DNA, 25 bp, Rattus norvegicus
gagcttggcagctcctcaggaggaa

SEQ ID NO: 344650 - DNA, 25 bp, Rattus norvegicus
gagcttggcatgcagtagacacact

SEQ ID NO: 344651 - DNA, 25 bp, Rattus norvegicus
gagcttggcatggagtagacacact

SEQ ID NO: 344652 - DNA, 25 bp, Rattus norvegicus
gagcttggctgtcgaatccctgaaa

SEQ ID NO: 344653 - DNA, 25 bp, Rattus norvegicus
gagcttggctgtggaatccctgaaa

SEQ ID NO: 344654 - DNA, 25 bp, Rattus norvegicus
gagcttgggctcatacttctttctt

SEQ ID NO: 344655 - DNA, 25 bp, Rattus norvegicus
gagcttgggctcttacttctttctt

SEQ ID NO: 344656 - DNA, 25 bp, Rattus norvegicus
gagcttggtaccctgtgattaacat

SEQ ID NO: 344657 - DNA, 25 bp, Rattus norvegicus
gagcttggtaccgtgtgattaacat

SEQ ID NO: 344658 - DNA, 25 bp, Rattus norvegicus
gagcttggtgttcatatgtatcttt

SEQ ID NO: 344659 - DNA, 25 bp, Rattus norvegicus
gagcttggtgttgatatgtatcttt

SEQ ID NO: 344660 - DNA, 25 bp, Rattus norvegicus
gagcttgtacagatcagcttccaac

SEQ ID NO: 344661 - DNA, 25 bp, Rattus norvegicus
gagcttgtacagttcagcttccaac

SEQ ID NO: 344662 - DNA, 25 bp, Rattus norvegicus
gagcttgtaccaactgtctactgca

SEQ ID NO: 344663 - DNA, 25 bp, Rattus norvegicus
gagcttgtaccatctgtctactgca

SEQ ID NO: 344664 - DNA, 25 bp, Rattus norvegicus
gagcttgtcaaaatgccaacagtat

SEQ ID NO: 344665 - DNA, 25 bp, Rattus norvegicus
gagcttgtcaaattgccaacagtat

SEQ ID NO: 344666 - DNA, 25 bp, Rattus norvegicus
gagcttgtctgcaaaaggacgccct

SEQ ID NO: 344667 - DNA, 25 bp, Rattus norvegicus
gagcttgtctgctaaaggacgccct

SEQ ID NO: 344668 - DNA, 25 bp, Rattus norvegicus
gagcttgtctggatctctgaaaaca

SEQ ID NO: 344669 - DNA, 25 bp, Rattus norvegicus
gagcttgtctggttctctgaaaaca

SEQ ID NO: 344670 - DNA, 25 bp, Rattus norvegicus
gagcttgtctgtcccagtgtacata

SEQ ID NO: 344671 - DNA, 25 bp, Rattus norvegicus
gagcttgtctgtgccagtgtacata

SEQ ID NO: 344672 - DNA, 25 bp, Rattus norvegicus
gagcttgtgacaagcacgtggccga

SEQ ID NO: 344673 - DNA, 25 bp, Rattus norvegicus
gagcttgtgacatgcacgtggccga

SEQ ID NO: 344674 - DNA, 25 bp, Rattus norvegicus
gagcttgtgactcatactgttttta

SEQ ID NO: 344675 - DNA, 25 bp, Rattus norvegicus
gagcttgtgactgatactgttttta

SEQ ID NO: 344676 - DNA, 25 bp, Rattus norvegicus
gagcttgtgcttagtccattttata

SEQ ID NO: 344677 - DNA, 25 bp, Rattus norvegicus
gagcttgtgctttgtccattttata

SEQ ID NO: 344678 - DNA, 25 bp, Rattus norvegicus
gagcttgtggctctattgtaatgtc

SEQ ID NO: 344679 - DNA, 25 bp, Rattus norvegicus
gagcttgtggctgtattgtaatgtc

SEQ ID NO: 344680 - DNA, 25 bp, Rattus norvegicus
gagcttgttaccatgctttggcaaa

SEQ ID NO: 344681 - DNA, 25 bp, Rattus norvegicus
gagcttgttaccttgctttggcaaa

SEQ ID NO: 344682 - DNA, 25 bp, Rattus norvegicus
gagcttgttctactgatgtcattca

SEQ ID NO: 344683 - DNA, 25 bp, Rattus norvegicus
gagcttgttctagtgatgtcattca

SEQ ID NO: 344684 - DNA, 25 bp, Rattus norvegicus
gagctttaactcagatgttcctatt

SEQ ID NO: 344685 - DNA, 25 bp, Rattus norvegicus
gagctttaactctgatgttcctatt

SEQ ID NO: 344686 - DNA, 25 bp, Rattus norvegicus
gagctttaagacacgttctcttcag

SEQ ID NO: 344687 - DNA, 25 bp, Rattus norvegicus
gagctttaagactcgttctcttcag

SEQ ID NO: 344688 - DNA, 25 bp, Rattus norvegicus
gagctttaccaacagactatctgca

SEQ ID NO: 344689 - DNA, 25 bp, Rattus norvegicus
gagctttaccaagagactatctgca

SEQ ID NO: 344690 - DNA, 25 bp, Rattus norvegicus
gagctttactccataacagattcca

SEQ ID NO: 344691 - DNA, 25 bp, Rattus norvegicus
gagctttactccttaacagattcca

SEQ ID NO: 344692 - DNA, 25 bp, Rattus norvegicus
gagctttagatgctctttcctttca

SEQ ID NO: 344693 - DNA, 25 bp, Rattus norvegicus
gagctttagatggtctttcctttca

SEQ ID NO: 344694 - DNA, 25 bp, Rattus norvegicus
gagctttaggctaaacactgattct

SEQ ID NO: 344695 - DNA, 25 bp, Rattus norvegicus
gagctttaggcttaacactgattct

SEQ ID NO: 344696 - DNA, 25 bp, Rattus norvegicus
gagctttagtcaacccacagtgtgt

SEQ ID NO: 344697 - DNA, 25 bp, Rattus norvegicus
gagctttagtcatcccacagtgtgt

SEQ ID NO: 344698 - DNA, 25 bp, Rattus norvegicus
gagctttataacatggcttttcagc

SEQ ID NO: 344699 - DNA, 25 bp, Rattus norvegicus
gagctttataaccaacttttgtaca

SEQ ID NO: 344700 - DNA, 25 bp, Rattus norvegicus
gagctttataacgaacttttgtaca

SEQ ID NO: 344701 - DNA, 25 bp, Rattus norvegicus
gagctttataacttggcttttcagc

SEQ ID NO: 344702 - DNA, 25 bp, Rattus norvegicus
gagctttatcttcatgacagtcgtg

SEQ ID NO: 344703 - DNA, 25 bp, Rattus norvegicus
gagctttatcttgatgacagtcgtg

SEQ ID NO: 344704 - DNA, 25 bp, Rattus norvegicus
gagctttcaagtccctttactgcag

SEQ ID NO: 344705 - DNA, 25 bp, Rattus norvegicus
gagctttcaagtgcctttactgcag

SEQ ID NO: 344706 - DNA, 25 bp, Rattus norvegicus
gagctttcaataaaccccactagtg

SEQ ID NO: 344707 - DNA, 25 bp, Rattus norvegicus
gagctttcaatataccccactagtg

SEQ ID NO: 344708 - DNA, 25 bp, Rattus norvegicus
gagctttcactaaacgctttccctt

SEQ ID NO: 344709 - DNA, 25 bp, Rattus norvegicus
gagctttcactatacgctttccctt

SEQ ID NO: 344710 - DNA, 25 bp, Rattus norvegicus
gagctttcagttccaaacaaggtgt

SEQ ID NO: 344711 - DNA, 25 bp, Rattus norvegicus
gagctttcagttgcaaacaaggtgt

SEQ ID NO: 344712 - DNA, 25 bp, Rattus norvegicus
gagctttcatatattggccagtcat

SEQ ID NO: 344713 - DNA, 25 bp, Rattus norvegicus
gagctttcatattttggccagtcat

SEQ ID NO: 344714 - DNA, 25 bp, Rattus norvegicus
gagctttcccatagtgttgctgcat

SEQ ID NO: 344715 - DNA, 25 bp, Rattus norvegicus
gagctttcccattgtgttgctgcat

SEQ ID NO: 344716 - DNA, 25 bp, Rattus norvegicus
gagctttcccttaatcagattggca

SEQ ID NO: 344717 - DNA, 25 bp, Rattus norvegicus
gagctttcccttcttcctacaatgc

SEQ ID NO: 344718 - DNA, 25 bp, Rattus norvegicus
gagctttcccttgttcctacaatgc

SEQ ID NO: 344719 - DNA, 25 bp, Rattus norvegicus
gagctttccctttatcagattggca

SEQ ID NO: 344720 - DNA, 25 bp, Rattus norvegicus
gagctttcctgacatcattgtgcat

SEQ ID NO: 344721 - DNA, 25 bp, Rattus norvegicus
gagctttcctgaccaagagtgctgt

SEQ ID NO: 344722 - DNA, 25 bp, Rattus norvegicus
gagctttcctgagatcattgtgcat

SEQ ID NO: 344723 - DNA, 25 bp, Rattus norvegicus
gagctttcctgagcaagagtgctgt

SEQ ID NO: 344724 - DNA, 25 bp, Rattus norvegicus
gagctttctacaatccctaatcagt

SEQ ID NO: 344725 - DNA, 25 bp, Rattus norvegicus
gagctttctacattccctaatcagt

SEQ ID NO: 344726 - DNA, 25 bp, Rattus norvegicus
gagctttctaggcttatctagacct

SEQ ID NO: 344727 - DNA, 25 bp, Rattus norvegicus
gagctttctagggttatctagacct

SEQ ID NO: 344728 - DNA, 25 bp, Rattus norvegicus
gagctttctcaaactgcttccaata

SEQ ID NO: 344729 - DNA, 25 bp, Rattus norvegicus
gagctttctcaatctgcttccaata

SEQ ID NO: 344730 - DNA, 25 bp, Rattus norvegicus
gagctttctttcagtcagctacaaa

SEQ ID NO: 344731 - DNA, 25 bp, Rattus norvegicus
gagctttctttctgtcagctacaaa

SEQ ID NO: 344732 - DNA, 25 bp, Rattus norvegicus
gagctttgaagcatgcaacctggac

SEQ ID NO: 344733 - DNA, 25 bp, Rattus norvegicus
gagctttgaagcttgcaacctggac

SEQ ID NO: 344734 - DNA, 25 bp, Rattus norvegicus
gagctttgactgactgaggtgtgat

SEQ ID NO: 344735 - DNA, 25 bp, Rattus norvegicus
gagctttgactgtctgaggtgtgat

SEQ ID NO: 344736 - DNA, 25 bp, Rattus norvegicus
gagctttgagatatttctgccttct

SEQ ID NO: 344737 - DNA, 25 bp, Rattus norvegicus
gagctttgagatttttctgccttct

SEQ ID NO: 344738 - DNA, 25 bp, Rattus norvegicus
gagctttgagctagcagtttcgagt

SEQ ID NO: 344739 - DNA, 25 bp, Rattus norvegicus
gagctttgagcttgcagtttcgagt

SEQ ID NO: 344740 - DNA, 25 bp, Rattus norvegicus
gagctttgaggcatctggctatgta

SEQ ID NO: 344741 - DNA, 25 bp, Rattus norvegicus
gagctttgaggcttctggctatgta

SEQ ID NO: 344742 - DNA, 25 bp, Rattus norvegicus
gagctttgagtgacacacacgtgct

SEQ ID NO: 344743 - DNA, 25 bp, Rattus norvegicus
gagctttgagtgtcacacacgtgct

SEQ ID NO: 344744 - DNA, 25 bp, Rattus norvegicus
gagctttgattcagtgcccaactat

SEQ ID NO: 344745 - DNA, 25 bp, Rattus norvegicus
gagctttgattctgtgcccaactat

SEQ ID NO: 344746 - DNA, 25 bp, Rattus norvegicus
gagctttgctcaccctgctcggagt

SEQ ID NO: 344747 - DNA, 25 bp, Rattus norvegicus
gagctttgctcagcctgctcggagt

SEQ ID NO: 344748 - DNA, 25 bp, Rattus norvegicus
gagctttggctcagagctgtcagtt

SEQ ID NO: 344749 - DNA, 25 bp, Rattus norvegicus
gagctttggctctgagctgtcagtt

SEQ ID NO: 344750 - DNA, 25 bp, Rattus norvegicus
gagctttggctgactttgtagtttt

SEQ ID NO: 344751 - DNA, 25 bp, Rattus norvegicus
gagctttggctgtctttgtagtttt

SEQ ID NO: 344752 - DNA, 25 bp, Rattus norvegicus
gagctttgggacacattaaactttt

SEQ ID NO: 344753 - DNA, 25 bp, Rattus norvegicus
gagctttgggactcattaaactttt

SEQ ID NO: 344754 - DNA, 25 bp, Rattus norvegicus
gagctttgggatagtgatgcttcac

SEQ ID NO: 344755 - DNA, 25 bp, Rattus norvegicus
gagctttgggattgtgatgcttcac

SEQ ID NO: 344756 - DNA, 25 bp, Rattus norvegicus
gagctttgggcaagacagttctaac

SEQ ID NO: 344757 - DNA, 25 bp, Rattus norvegicus
gagctttgggcatgacagttctaac

SEQ ID NO: 344758 - DNA, 25 bp, Rattus norvegicus
gagctttgtcagcttttagtcaact

SEQ ID NO: 344759 - DNA, 25 bp, Rattus norvegicus
gagctttgtcaggttttagtcaact

SEQ ID NO: 344760 - DNA, 25 bp, Rattus norvegicus
gagctttgtctgatcgctgtagcaa

SEQ ID NO: 344761 - DNA, 25 bp, Rattus norvegicus
gagctttgtctgttcgctgtagcaa

SEQ ID NO: 344762 - DNA, 25 bp, Rattus norvegicus
gagctttgtgacatccaagaccagt

SEQ ID NO: 344763 - DNA, 25 bp, Rattus norvegicus
gagctttgtgacttccaagaccagt

SEQ ID NO: 344764 - DNA, 25 bp, Rattus norvegicus
gagcttttaggacgcattttgtaga

SEQ ID NO: 344765 - DNA, 25 bp, Rattus norvegicus
gagcttttaggaggcattttgtaga

SEQ ID NO: 344766 - DNA, 25 bp, Rattus norvegicus
gagcttttagttctttcttcctttg

SEQ ID NO: 344767 - DNA, 25 bp, Rattus norvegicus
gagcttttagttgtttcttcctttg

SEQ ID NO: 344768 - DNA, 25 bp, Rattus norvegicus
gagcttttatatcgcctccagatat

SEQ ID NO: 344769 - DNA, 25 bp, Rattus norvegicus
gagcttttatatggcctccagatat

SEQ ID NO: 344770 - DNA, 25 bp, Rattus norvegicus
gagcttttatttagaccgtgattta

SEQ ID NO: 344771 - DNA, 25 bp, Rattus norvegicus
gagcttttattttgaccgtgattta

SEQ ID NO: 344772 - DNA, 25 bp, Rattus norvegicus
gagcttttcagcatttcaagtccct

SEQ ID NO: 344773 - DNA, 25 bp, Rattus norvegicus
gagcttttcagcttttcaagtccct

SEQ ID NO: 344774 - DNA, 25 bp, Rattus norvegicus
gagcttttcattctcgtgctccaga

SEQ ID NO: 344775 - DNA, 25 bp, Rattus norvegicus
gagcttttcattgtcgtgctccaga

SEQ ID NO: 344776 - DNA, 25 bp, Rattus norvegicus
gagcttttccagctgctattggatt

SEQ ID NO: 344777 - DNA, 25 bp, Rattus norvegicus
gagcttttccaggtgctattggatt

SEQ ID NO: 344778 - DNA, 25 bp, Rattus norvegicus
gagcttttctagacagttgccagga

SEQ ID NO: 344779 - DNA, 25 bp, Rattus norvegicus
gagcttttctagtcagttgccagga

SEQ ID NO: 344780 - DNA, 25 bp, Rattus norvegicus
gagcttttctgacagaccctgatac

SEQ ID NO: 344781 - DNA, 25 bp, Rattus norvegicus
gagcttttctgagagaccctgatac

SEQ ID NO: 344782 - DNA, 25 bp, Rattus norvegicus
gagcttttctgcatcctctattaac

SEQ ID NO: 344783 - DNA, 25 bp, Rattus norvegicus
gagcttttctgcttcctctattaac

SEQ ID NO: 344784 - DNA, 25 bp, Rattus norvegicus
gagcttttcttgaatggtcagacca

SEQ ID NO: 344785 - DNA, 25 bp, Rattus norvegicus
gagcttttcttgtatggtcagacca

SEQ ID NO: 344786 - DNA, 25 bp, Rattus norvegicus
gagcttttgagcatggccctgactt

SEQ ID NO: 344787 - DNA, 25 bp, Rattus norvegicus
gagcttttgagcttggccctgactt

SEQ ID NO: 344788 - DNA, 25 bp, Rattus norvegicus
gagcttttgataatcagtctcctgt

SEQ ID NO: 344789 - DNA, 25 bp, Rattus norvegicus
gagcttttgatattcagtctcctgt

SEQ ID NO: 344790 - DNA, 25 bp, Rattus norvegicus
gagcttttgattctatggccacatt

SEQ ID NO: 344791 - DNA, 25 bp, Rattus norvegicus
gagcttttgattgtatggccacatt

SEQ ID NO: 344792 - DNA, 25 bp, Rattus norvegicus
gagcttttgctcagtagaatctagg

SEQ ID NO: 344793 - DNA, 25 bp, Rattus norvegicus
gagcttttgctctgtagaatctagg

SEQ ID NO: 344794 - DNA, 25 bp, Rattus norvegicus
gagctttttcacaggtcatccaggg

SEQ ID NO: 344795 - DNA, 25 bp, Rattus norvegicus
gagctttttcactggtcatccaggg

SEQ ID NO: 344796 - DNA, 25 bp, Rattus norvegicus
gagctttttctcctgacaggaggac

SEQ ID NO: 344797 - DNA, 25 bp, Rattus norvegicus
gagctttttctcgtgacaggaggac

SEQ ID NO: 344798 - DNA, 25 bp, Rattus norvegicus
gagcttttttctagctggcttccag

SEQ ID NO: 344799 - DNA, 25 bp, Rattus norvegicus
gagcttttttcttgctggcttccag

SEQ ID NO: 344800 - DNA, 25 bp, Rattus norvegicus
gagcttttttggcacctacacctga

SEQ ID NO: 344801 - DNA, 25 bp, Rattus norvegicus
gagcttttttgggacctacacctga

SEQ ID NO: 344802 - DNA, 25 bp, Rattus norvegicus
gagcttttttgtaaggccttggaag

SEQ ID NO: 344803 - DNA, 25 bp, Rattus norvegicus
gagcttttttgttaggccttggaag

SEQ ID NO: 344804 - DNA, 25 bp, Rattus norvegicus
gaggaaaaaccccactgcatgcagt

SEQ ID NO: 344805 - DNA, 25 bp, Rattus norvegicus
gaggaaaaacccgactgcatgcagt

SEQ ID NO: 344806 - DNA, 25 bp, Rattus norvegicus
gaggaaaaatctaggcctgatattt

SEQ ID NO: 344807 - DNA, 25 bp, Rattus norvegicus
gaggaaaaatcttggcctgatattt

SEQ ID NO: 344808 - DNA, 25 bp, Rattus norvegicus
gaggaaaacagcaggccccagccat

SEQ ID NO: 344809 - DNA, 25 bp, Rattus norvegicus
gaggaaaacagctggccccagccat

SEQ ID NO: 344810 - DNA, 25 bp, Rattus norvegicus
gaggaaaaccctcgagtctcagcac

SEQ ID NO: 344811 - DNA, 25 bp, Rattus norvegicus
gaggaaaaccctggagtctcagcac

SEQ ID NO: 344812 - DNA, 25 bp, Rattus norvegicus
gaggaaaactggcaaccactgaata

SEQ ID NO: 344813 - DNA, 25 bp, Rattus norvegicus
gaggaaaactgggaaccactgaata

SEQ ID NO: 344814 - DNA, 25 bp, Rattus norvegicus
gaggaaaaggcaaacctggtctcta

SEQ ID NO: 344815 - DNA, 25 bp, Rattus norvegicus
gaggaaaaggcatacctggtctcta

SEQ ID NO: 344816 - DNA, 25 bp, Rattus norvegicus
gaggaaaagtttcacgcatgggttt

SEQ ID NO: 344817 - DNA, 25 bp, Rattus norvegicus
gaggaaaagtttgacgcatgggttt

SEQ ID NO: 344818 - DNA, 25 bp, Rattus norvegicus
gaggaaaatactattgggctctact

SEQ ID NO: 344819 - DNA, 25 bp, Rattus norvegicus
gaggaaaatacttttgggctctact

SEQ ID NO: 344820 - DNA, 25 bp, Rattus norvegicus
gaggaaaatgcacccaccatactgg

SEQ ID NO: 344821 - DNA, 25 bp, Rattus norvegicus
gaggaaaatgcagccaccatactgg

SEQ ID NO: 344822 - DNA, 25 bp, Rattus norvegicus
gaggaaaatgctccccttatgaagg

SEQ ID NO: 344823 - DNA, 25 bp, Rattus norvegicus
gaggaaaatgctgcccttatgaagg

SEQ ID NO: 344824 - DNA, 25 bp, Rattus norvegicus
gaggaaaattttcactcgattttgt

SEQ ID NO: 344825 - DNA, 25 bp, Rattus norvegicus
gaggaaaattttgactcgattttgt

SEQ ID NO: 344826 - DNA, 25 bp, Rattus norvegicus
gaggaaacaaacaccagtccctgac

SEQ ID NO: 344827 - DNA, 25 bp, Rattus norvegicus
gaggaaacaaactccagtccctgac

SEQ ID NO: 344828 - DNA, 25 bp, Rattus norvegicus
gaggaaacaactatggaacgtctag

SEQ ID NO: 344829 - DNA, 25 bp, Rattus norvegicus
gaggaaacaactttggaacgtctag

SEQ ID NO: 344830 - DNA, 25 bp, Rattus norvegicus
gaggaaacactcaatcagacggaca

SEQ ID NO: 344831 - DNA, 25 bp, Rattus norvegicus
gaggaaacactctatcagacggaca

SEQ ID NO: 344832 - DNA, 25 bp, Rattus norvegicus
gaggaaacagcaatctcttgatttg

SEQ ID NO: 344833 - DNA, 25 bp, Rattus norvegicus
gaggaaacagcattctcttgatttg

SEQ ID NO: 344834 - DNA, 25 bp, Rattus norvegicus
gaggaaacagctctgcagcctcaga

SEQ ID NO: 344835 - DNA, 25 bp, Rattus norvegicus
gaggaaacagctgtgcagcctcaga

SEQ ID NO: 344836 - DNA, 25 bp, Rattus norvegicus
gaggaaaccaaaatgcacgtatggg

SEQ ID NO: 344837 - DNA, 25 bp, Rattus norvegicus
gaggaaaccaaattgcacgtatggg

SEQ ID NO: 344838 - DNA, 25 bp, Rattus norvegicus
gaggaaaccactaattctgctttgt

SEQ ID NO: 344839 - DNA, 25 bp, Rattus norvegicus
gaggaaaccacttattctgctttgt

SEQ ID NO: 344840 - DNA, 25 bp, Rattus norvegicus
gaggaaaccatccagcaactccgcg

SEQ ID NO: 344841 - DNA, 25 bp, Rattus norvegicus
gaggaaaccatcgagcaactccgcg

SEQ ID NO: 344842 - DNA, 25 bp, Rattus norvegicus
gaggaaacccaacattctgctatat

SEQ ID NO: 344843 - DNA, 25 bp, Rattus norvegicus
gaggaaacccaagattctgctatat

SEQ ID NO: 344844 - DNA, 25 bp, Rattus norvegicus
gaggaaacccagaaccagattgcca

SEQ ID NO: 344845 - DNA, 25 bp, Rattus norvegicus
gaggaaacccagtaccagattgcca

SEQ ID NO: 344846 - DNA, 25 bp, Rattus norvegicus
gaggaaacccatatagtgcccagat

SEQ ID NO: 344847 - DNA, 25 bp, Rattus norvegicus
gaggaaacccatttagtgcccagat

SEQ ID NO: 344848 - DNA, 25 bp, Rattus norvegicus
gaggaaacccctagctaggcatttc

SEQ ID NO: 344849 - DNA, 25 bp, Rattus norvegicus
gaggaaaccccttgctaggcatttc

SEQ ID NO: 344850 - DNA, 25 bp, Rattus norvegicus
gaggaaaccctgagcttgccctgcg

SEQ ID NO: 344851 - DNA, 25 bp, Rattus norvegicus
gaggaaaccctgtgcttgccctgcg

SEQ ID NO: 344852 - DNA, 25 bp, Rattus norvegicus
gaggaaaccgttaccattactgagt

SEQ ID NO: 344853 - DNA, 25 bp, Rattus norvegicus
gaggaaaccgtttccattactgagt

SEQ ID NO: 344854 - DNA, 25 bp, Rattus norvegicus
gaggaaactcttagcctgggacaac

SEQ ID NO: 344855 - DNA, 25 bp, Rattus norvegicus
gaggaaactctttgcctgggacaac

SEQ ID NO: 344856 - DNA, 25 bp, Rattus norvegicus
gaggaaactgatcgccttcacactt

SEQ ID NO: 344857 - DNA, 25 bp, Rattus norvegicus
gaggaaactgatggccttcacactt

SEQ ID NO: 344858 - DNA, 25 bp, Rattus norvegicus
gaggaaactgcactctgagcccagc

SEQ ID NO: 344859 - DNA, 25 bp, Rattus norvegicus
gaggaaactgcagtctgagcccagc

SEQ ID NO: 344860 - DNA, 25 bp, Rattus norvegicus
gaggaaactgctacaggtgccattt

SEQ ID NO: 344861 - DNA, 25 bp, Rattus norvegicus
gaggaaactgcttcaggtgccattt

SEQ ID NO: 344862 - DNA, 25 bp, Rattus norvegicus
gaggaaactggtctcatgccctgtc

SEQ ID NO: 344863 - DNA, 25 bp, Rattus norvegicus
gaggaaactggtgtcatgccctgtc

SEQ ID NO: 344864 - DNA, 25 bp, Rattus norvegicus
gaggaaacttgcagcccggagagat

SEQ ID NO: 344865 - DNA, 25 bp, Rattus norvegicus
gaggaaacttgctgcccggagagat

SEQ ID NO: 344866 - DNA, 25 bp, Rattus norvegicus
gaggaaacttggcttcatgttatgt

SEQ ID NO: 344867 - DNA, 25 bp, Rattus norvegicus
gaggaaacttgggttcatgttatgt

SEQ ID NO: 344868 - DNA, 25 bp, Rattus norvegicus
gaggaaactttcagagacttctccc

SEQ ID NO: 344869 - DNA, 25 bp, Rattus norvegicus
gaggaaactttctgagacttctccc

SEQ ID NO: 344870 - DNA, 25 bp, Rattus norvegicus
gaggaaagaataagcagcccctatt

SEQ ID NO: 344871 - DNA, 25 bp, Rattus norvegicus
gaggaaagaatatgcagcccctatt

SEQ ID NO: 344872 - DNA, 25 bp, Rattus norvegicus
gaggaaagacgcacctgacttcaca

SEQ ID NO: 344873 - DNA, 25 bp, Rattus norvegicus
gaggaaagacgctcctgacttcaca

SEQ ID NO: 344874 - DNA, 25 bp, Rattus norvegicus
gaggaaagagctcctggacccgcaa

SEQ ID NO: 344875 - DNA, 25 bp, Rattus norvegicus
gaggaaagagctgctggacccgcaa

SEQ ID NO: 344876 - DNA, 25 bp, Rattus norvegicus
gaggaaagatccagctgttttgttt

SEQ ID NO: 344877 - DNA, 25 bp, Rattus norvegicus
gaggaaagatcctgctgttttgttt

SEQ ID NO: 344878 - DNA, 25 bp, Rattus norvegicus
gaggaaagcatccactcacggcaga

SEQ ID NO: 344879 - DNA, 25 bp, Rattus norvegicus
gaggaaagcatcgactcacggcaga

SEQ ID NO: 344880 - DNA, 25 bp, Rattus norvegicus
gaggaaagccaactcccggcaagta

SEQ ID NO: 344881 - DNA, 25 bp, Rattus norvegicus
gaggaaagccaagtcccggcaagta

SEQ ID NO: 344882 - DNA, 25 bp, Rattus norvegicus
gaggaaagccatctgtctgccggtt

SEQ ID NO: 344883 - DNA, 25 bp, Rattus norvegicus
gaggaaagccatgtgtctgccggtt

SEQ ID NO: 344884 - DNA, 25 bp, Rattus norvegicus
gaggaaagcctcagccagagaagaa

SEQ ID NO: 344885 - DNA, 25 bp, Rattus norvegicus
gaggaaagcctctgccagagaagaa

SEQ ID NO: 344886 - DNA, 25 bp, Rattus norvegicus
gaggaaagccttacttcatggaagt

SEQ ID NO: 344887 - DNA, 25 bp, Rattus norvegicus
gaggaaagccttcgcatttcaaaga

SEQ ID NO: 344888 - DNA, 25 bp, Rattus norvegicus
gaggaaagccttggcatttcaaaga

SEQ ID NO: 344889 - DNA, 25 bp, Rattus norvegicus
gaggaaagcctttcttcatggaagt

SEQ ID NO: 344890 - DNA, 25 bp, Rattus norvegicus
gaggaaagcgatactctcactctgg

SEQ ID NO: 344891 - DNA, 25 bp, Rattus norvegicus
gaggaaagcgattctctcactctgg

SEQ ID NO: 344892 - DNA, 25 bp, Rattus norvegicus
gaggaaagcgcgagggcttcttttt

SEQ ID NO: 344893 - DNA, 25 bp, Rattus norvegicus
gaggaaagcgcgtgggcttcttttt

SEQ ID NO: 344894 - DNA, 25 bp, Rattus norvegicus
gaggaaagctcccatcttgtaacta

SEQ ID NO: 344895 - DNA, 25 bp, Rattus norvegicus
gaggaaagctccgatcttgtaacta

SEQ ID NO: 344896 - DNA, 25 bp, Rattus norvegicus
gaggaaagctctctcctggctgtgt

SEQ ID NO: 344897 - DNA, 25 bp, Rattus norvegicus
gaggaaagctctgtcctggctgtgt

SEQ ID NO: 344898 - DNA, 25 bp, Rattus norvegicus
gaggaaagctttaactgcaaatata

SEQ ID NO: 344899 - DNA, 25 bp, Rattus norvegicus
gaggaaagcttttactgcaaatata

SEQ ID NO: 344900 - DNA, 25 bp, Rattus norvegicus
gaggaaaggccgatctgtctagatt

SEQ ID NO: 344901 - DNA, 25 bp, Rattus norvegicus
gaggaaaggccgttctgtctagatt

SEQ ID NO: 344902 - DNA, 25 bp, Rattus norvegicus
gaggaaaggctccacctgcccttag

SEQ ID NO: 344903 - DNA, 25 bp, Rattus norvegicus
gaggaaaggctcgacctgcccttag

SEQ ID NO: 344904 - DNA, 25 bp, Rattus norvegicus
gaggaaagtggaagcattgcacacc

SEQ ID NO: 344905 - DNA, 25 bp, Rattus norvegicus
gaggaaagtggatgcattgcacacc

SEQ ID NO: 344906 - DNA, 25 bp, Rattus norvegicus
gaggaaagtggcacagcttgctgaa

SEQ ID NO: 344907 - DNA, 25 bp, Rattus norvegicus
gaggaaagtggctcagcttgctgaa

SEQ ID NO: 344908 - DNA, 25 bp, Rattus norvegicus
gaggaaatacaactgatgccatatc

SEQ ID NO: 344909 - DNA, 25 bp, Rattus norvegicus
gaggaaatacaagtgatgccatatc

SEQ ID NO: 344910 - DNA, 25 bp, Rattus norvegicus
gaggaaatactgcttcccactgtac

SEQ ID NO: 344911 - DNA, 25 bp, Rattus norvegicus
gaggaaatactggttcccactgtac

SEQ ID NO: 344912 - DNA, 25 bp, Rattus norvegicus
gaggaaatagctactctcctacctc

SEQ ID NO: 344913 - DNA, 25 bp, Rattus norvegicus
gaggaaatagcttctctcctacctc

SEQ ID NO: 344914 - DNA, 25 bp, Rattus norvegicus
gaggaaatcagaagtccctgggagt

SEQ ID NO: 344915 - DNA, 25 bp, Rattus norvegicus
gaggaaatcagatgtccctgggagt

SEQ ID NO: 344916 - DNA, 25 bp, Rattus norvegicus
gaggaaatcccaagcccaaaatcac

SEQ ID NO: 344917 - DNA, 25 bp, Rattus norvegicus
gaggaaatcccatgcccaaaatcac

SEQ ID NO: 344918 - DNA, 25 bp, Rattus norvegicus
gaggaaatccccatcaaggctagtc

SEQ ID NO: 344919 - DNA, 25 bp, Rattus norvegicus
gaggaaatccccttcaaggctagtc

SEQ ID NO: 344920 - DNA, 25 bp, Rattus norvegicus
gaggaaatcctcagtctgacagaga

SEQ ID NO: 344921 - DNA, 25 bp, Rattus norvegicus
gaggaaatcctctgtctgacagaga

SEQ ID NO: 344922 - DNA, 25 bp, Rattus norvegicus
gaggaaatccttaacatttatgcca

SEQ ID NO: 344923 - DNA, 25 bp, Rattus norvegicus
gaggaaatcctttacatttatgcca

SEQ ID NO: 344924 - DNA, 25 bp, Rattus norvegicus
gaggaaatctatcaccaagggcagc

SEQ ID NO: 344925 - DNA, 25 bp, Rattus norvegicus
gaggaaatctatgaccaagggcagc

SEQ ID NO: 344926 - DNA, 25 bp, Rattus norvegicus
gaggaaatcttcatgtatactagct

SEQ ID NO: 344927 - DNA, 25 bp, Rattus norvegicus
gaggaaatcttcttgtatactagct

SEQ ID NO: 344928 - DNA, 25 bp, Rattus norvegicus
gaggaaatgccactgttaggcccct

SEQ ID NO: 344929 - DNA, 25 bp, Rattus norvegicus
gaggaaatgccagtgttaggcccct

SEQ ID NO: 344930 - DNA, 25 bp, Rattus norvegicus
gaggaaatgctgaaaggatgcttag

SEQ ID NO: 344931 - DNA, 25 bp, Rattus norvegicus
gaggaaatgctgtaaggatgcttag

SEQ ID NO: 344932 - DNA, 25 bp, Rattus norvegicus
gaggaaattgggacctggtctccct

SEQ ID NO: 344933 - DNA, 25 bp, Rattus norvegicus
gaggaaattgggtcctggtctccct

SEQ ID NO: 344934 - DNA, 25 bp, Rattus norvegicus
gaggaaattggtcctctcttcacac

SEQ ID NO: 344935 - DNA, 25 bp, Rattus norvegicus
gaggaaattggtgctctcttcacac

SEQ ID NO: 344936 - DNA, 25 bp, Rattus norvegicus
gaggaaatttcaccacccaaatctt

SEQ ID NO: 344937 - DNA, 25 bp, Rattus norvegicus
gaggaaatttcagcacccaaatctt

SEQ ID NO: 344938 - DNA, 25 bp, Rattus norvegicus
gaggaacaactgcatcacacctgga

SEQ ID NO: 344939 - DNA, 25 bp, Rattus norvegicus
gaggaacaactggatcacacctgga

SEQ ID NO: 344940 - DNA, 25 bp, Rattus norvegicus
gaggaacaaggaatacacagaaatt

SEQ ID NO: 344941 - DNA, 25 bp, Rattus norvegicus
gaggaacaaggattacacagaaatt

SEQ ID NO: 344942 - DNA, 25 bp, Rattus norvegicus
gaggaacaatccaacacaaatctat

SEQ ID NO: 344943 - DNA, 25 bp, Rattus norvegicus
gaggaacaatcctacacaaatctat

SEQ ID NO: 344944 - DNA, 25 bp, Rattus norvegicus
gaggaacactagaaaccactgtctc

SEQ ID NO: 344945 - DNA, 25 bp, Rattus norvegicus
gaggaacactagtaaccactgtctc

SEQ ID NO: 344946 - DNA, 25 bp, Rattus norvegicus
gaggaacactcaccagagacagaca

SEQ ID NO: 344947 - DNA, 25 bp, Rattus norvegicus
gaggaacactcagcagagacagaca

SEQ ID NO: 344948 - DNA, 25 bp, Rattus norvegicus
gaggaacactgaagttccgccttct

SEQ ID NO: 344949 - DNA, 25 bp, Rattus norvegicus
gaggaacactgatgttccgccttct

SEQ ID NO: 344950 - DNA, 25 bp, Rattus norvegicus
gaggaacactttccaaaccctgagg

SEQ ID NO: 344951 - DNA, 25 bp, Rattus norvegicus
gaggaacactttgcaaaccctgagg

SEQ ID NO: 344952 - DNA, 25 bp, Rattus norvegicus
gaggaacagcgcatattggcctgct

SEQ ID NO: 344953 - DNA, 25 bp, Rattus norvegicus
gaggaacagcgcttattggcctgct

SEQ ID NO: 344954 - DNA, 25 bp, Rattus norvegicus
gaggaacagctgagtgagcctgccc

SEQ ID NO: 344955 - DNA, 25 bp, Rattus norvegicus
gaggaacagctgtgtgagcctgccc

SEQ ID NO: 344956 - DNA, 25 bp, Rattus norvegicus
gaggaacagcttccgaaaagtcagg

SEQ ID NO: 344957 - DNA, 25 bp, Rattus norvegicus
gaggaacagcttgcgaaaagtcagg

SEQ ID NO: 344958 - DNA, 25 bp, Rattus norvegicus
gaggaacaggaacttggtccaccca

SEQ ID NO: 344959 - DNA, 25 bp, Rattus norvegicus
gaggaacaggaagttggtccaccca

SEQ ID NO: 344960 - DNA, 25 bp, Rattus norvegicus
gaggaacagttaactgcccctctaa

SEQ ID NO: 344961 - DNA, 25 bp, Rattus norvegicus
gaggaacagttatctgcccctctaa

SEQ ID NO: 344962 - DNA, 25 bp, Rattus norvegicus
gaggaacagtttatagttacactct

SEQ ID NO: 344963 - DNA, 25 bp, Rattus norvegicus
gaggaacagtttttagttacactct

SEQ ID NO: 344964 - DNA, 25 bp, Rattus norvegicus
gaggaacataggaagttcggtgtta

SEQ ID NO: 344965 - DNA, 25 bp, Rattus norvegicus
gaggaacataggtagttcggtgtta

SEQ ID NO: 344966 - DNA, 25 bp, Rattus norvegicus
gaggaacatcatacacagacatgct

SEQ ID NO: 344967 - DNA, 25 bp, Rattus norvegicus
gaggaacatcattcacagacatgct

SEQ ID NO: 344968 - DNA, 25 bp, Rattus norvegicus
gaggaacatggacgctacactggaa

SEQ ID NO: 344969 - DNA, 25 bp, Rattus norvegicus
gaggaacatggaggctacactggaa

SEQ ID NO: 344970 - DNA, 25 bp, Rattus norvegicus
gaggaaccaactagtggctccagac

SEQ ID NO: 344971 - DNA, 25 bp, Rattus norvegicus
gaggaaccaacttgtggctccagac

SEQ ID NO: 344972 - DNA, 25 bp, Rattus norvegicus
gaggaaccacttaacctacttactg

SEQ ID NO: 344973 - DNA, 25 bp, Rattus norvegicus
gaggaaccactttacctacttactg

SEQ ID NO: 344974 - DNA, 25 bp, Rattus norvegicus
gaggaaccagaaagcttcgttctga

SEQ ID NO: 344975 - DNA, 25 bp, Rattus norvegicus
gaggaaccagaatgcttcgttctga

SEQ ID NO: 344976 - DNA, 25 bp, Rattus norvegicus
gaggaaccaggtccaaccaatgttt

SEQ ID NO: 344977 - DNA, 25 bp, Rattus norvegicus
gaggaaccaggtcccaacagtcaat

SEQ ID NO: 344978 - DNA, 25 bp, Rattus norvegicus
gaggaaccaggtgcaaccaatgttt

SEQ ID NO: 344979 - DNA, 25 bp, Rattus norvegicus
gaggaaccaggtgccaacagtcaat

SEQ ID NO: 344980 - DNA, 25 bp, Rattus norvegicus
gaggaaccatgtctgcagcctgtga

SEQ ID NO: 344981 - DNA, 25 bp, Rattus norvegicus
gaggaaccatgtgtgcagcctgtga

SEQ ID NO: 344982 - DNA, 25 bp, Rattus norvegicus
gaggaaccatttccacttgtgactc

SEQ ID NO: 344983 - DNA, 25 bp, Rattus norvegicus
gaggaaccatttgcacttgtgactc

SEQ ID NO: 344984 - DNA, 25 bp, Rattus norvegicus
gaggaacccaaacttcactggagca

SEQ ID NO: 344985 - DNA, 25 bp, Rattus norvegicus
gaggaacccaaagttcactggagca

SEQ ID NO: 344986 - DNA, 25 bp, Rattus norvegicus
gaggaacccaagatcaagccaggct

SEQ ID NO: 344987 - DNA, 25 bp, Rattus norvegicus
gaggaacccaagttcaagccaggct

SEQ ID NO: 344988 - DNA, 25 bp, Rattus norvegicus
gaggaacccacccaatgtgtacaag

SEQ ID NO: 344989 - DNA, 25 bp, Rattus norvegicus
gaggaacccaccgaatgtgtacaag

SEQ ID NO: 344990 - DNA, 25 bp, Rattus norvegicus
gaggaacccactaccaaatcaataa

SEQ ID NO: 344991 - DNA, 25 bp, Rattus norvegicus
gaggaacccacttccaaatcaataa

SEQ ID NO: 344992 - DNA, 25 bp, Rattus norvegicus
gaggaacccgagactccagctgtat

SEQ ID NO: 344993 - DNA, 25 bp, Rattus norvegicus
gaggaacccgagtctccagctgtat

SEQ ID NO: 344994 - DNA, 25 bp, Rattus norvegicus
gaggaaccctaactgattcctgagg

SEQ ID NO: 344995 - DNA, 25 bp, Rattus norvegicus
gaggaaccctaagtgattcctgagg

SEQ ID NO: 344996 - DNA, 25 bp, Rattus norvegicus
gaggaaccctacctgagtcttgtca

SEQ ID NO: 344997 - DNA, 25 bp, Rattus norvegicus
gaggaaccctacgtgagtcttgtca

SEQ ID NO: 344998 - DNA, 25 bp, Rattus norvegicus
gaggaaccctgtccagaccgcggcg

SEQ ID NO: 344999 - DNA, 25 bp, Rattus norvegicus
gaggaaccctgtgcagaccgcggcg

SEQ ID NO: 345000 - DNA, 25 bp, Rattus norvegicus
gaggaaccgccgagcctttaaatgg

SEQ ID NO: 345001 - DNA, 25 bp, Rattus norvegicus
gaggaaccgccgtgcctttaaatgg

SEQ ID NO: 345002 - DNA, 25 bp, Rattus norvegicus
gaggaaccgctaatatgttgctata

SEQ ID NO: 345003 - DNA, 25 bp, Rattus norvegicus
gaggaaccgctattatgttgctata

SEQ ID NO: 345004 - DNA, 25 bp, Rattus norvegicus
gaggaaccgtttcctgactcagaag

SEQ ID NO: 345005 - DNA, 25 bp, Rattus norvegicus
gaggaaccgtttgctgactcagaag

SEQ ID NO: 345006 - DNA, 25 bp, Rattus norvegicus
gaggaacctagtagaactcccagcc

SEQ ID NO: 345007 - DNA, 25 bp, Rattus norvegicus
gaggaacctagttgaactcccagcc

SEQ ID NO: 345008 - DNA, 25 bp, Rattus norvegicus
gaggaacctatcataccggctggaa

SEQ ID NO: 345009 - DNA, 25 bp, Rattus norvegicus
gaggaacctatcttaccggctggaa

SEQ ID NO: 345010 - DNA, 25 bp, Rattus norvegicus
gaggaacctcagctaatcagtgtta

SEQ ID NO: 345011 - DNA, 25 bp, Rattus norvegicus
gaggaacctcaggtaatcagtgtta

SEQ ID NO: 345012 - DNA, 25 bp, Rattus norvegicus
gaggaacctcataatcctgaaagga

SEQ ID NO: 345013 - DNA, 25 bp, Rattus norvegicus
gaggaacctcattatcctgaaagga

SEQ ID NO: 345014 - DNA, 25 bp, Rattus norvegicus
gaggaacctctaaagcaccgcatga

SEQ ID NO: 345015 - DNA, 25 bp, Rattus norvegicus
gaggaacctctatagcaccgcatga

SEQ ID NO: 345016 - DNA, 25 bp, Rattus norvegicus
gaggaacctctgagtctgcagagat

SEQ ID NO: 345017 - DNA, 25 bp, Rattus norvegicus
gaggaacctctgtgtctgcagagat

SEQ ID NO: 345018 - DNA, 25 bp, Rattus norvegicus
gaggaacctgaaacccatcttcaat

SEQ ID NO: 345019 - DNA, 25 bp, Rattus norvegicus
gaggaacctgaatcccatcttcaat

SEQ ID NO: 345020 - DNA, 25 bp, Rattus norvegicus
gaggaacctttccacataggaagct

SEQ ID NO: 345021 - DNA, 25 bp, Rattus norvegicus
gaggaacctttccacctacaaatag

SEQ ID NO: 345022 - DNA, 25 bp, Rattus norvegicus
gaggaacctttcgacataggaagct

SEQ ID NO: 345023 - DNA, 25 bp, Rattus norvegicus
gaggaacctttcgacctacaaatag

SEQ ID NO: 345024 - DNA, 25 bp, Rattus norvegicus
gaggaacgacgacgcctctttttgc

SEQ ID NO: 345025 - DNA, 25 bp, Rattus norvegicus
gaggaacgacgaggcctctttttgc

SEQ ID NO: 345026 - DNA, 25 bp, Rattus norvegicus
gaggaacgcatcctatcggttcaga

SEQ ID NO: 345027 - DNA, 25 bp, Rattus norvegicus
gaggaacgcatcgtatcggttcaga

SEQ ID NO: 345028 - DNA, 25 bp, Rattus norvegicus
gaggaacgctagattgccaccgtgc

SEQ ID NO: 345029 - DNA, 25 bp, Rattus norvegicus
gaggaacgctagtttgccaccgtgc

SEQ ID NO: 345030 - DNA, 25 bp, Rattus norvegicus
gaggaacgctttcccagagtaggat

SEQ ID NO: 345031 - DNA, 25 bp, Rattus norvegicus
gaggaacgctttgccagagtaggat

SEQ ID NO: 345032 - DNA, 25 bp, Rattus norvegicus
gaggaacggcccactttcgaataca

SEQ ID NO: 345033 - DNA, 25 bp, Rattus norvegicus
gaggaacggccctctttcgaataca

SEQ ID NO: 345034 - DNA, 25 bp, Rattus norvegicus
gaggaacgggccagaatctactcct

SEQ ID NO: 345035 - DNA, 25 bp, Rattus norvegicus
gaggaacgggcctgaatctactcct

SEQ ID NO: 345036 - DNA, 25 bp, Rattus norvegicus
gaggaacgtcaaatgcttatgctaa

SEQ ID NO: 345037 - DNA, 25 bp, Rattus norvegicus
gaggaacgtcaattgcttatgctaa

SEQ ID NO: 345038 - DNA, 25 bp, Rattus norvegicus
gaggaacgtccgcagtgccttcacg

SEQ ID NO: 345039 - DNA, 25 bp, Rattus norvegicus
gaggaacgtccggagtgccttcacg

SEQ ID NO: 345040 - DNA, 25 bp, Rattus norvegicus
gaggaacgtgcaatgcttgttgtcc

SEQ ID NO: 345041 - DNA, 25 bp, Rattus norvegicus
gaggaacgtgcattgcttgttgtcc

SEQ ID NO: 345042 - DNA, 25 bp, Rattus norvegicus
gaggaacgtgcgactcaagacacca

SEQ ID NO: 345043 - DNA, 25 bp, Rattus norvegicus
gaggaacgtgcgtctcaagacacca

SEQ ID NO: 345044 - DNA, 25 bp, Rattus norvegicus
gaggaacgtggcacccagaaagaga

SEQ ID NO: 345045 - DNA, 25 bp, Rattus norvegicus
gaggaacgtggctcccagaaagaga

SEQ ID NO: 345046 - DNA, 25 bp, Rattus norvegicus
gaggaacgtttccaccagcagggaa

SEQ ID NO: 345047 - DNA, 25 bp, Rattus norvegicus
gaggaacgtttcgaccagcagggaa

SEQ ID NO: 345048 - DNA, 25 bp, Rattus norvegicus
gaggaactaagtcacccgcaaggat

SEQ ID NO: 345049 - DNA, 25 bp, Rattus norvegicus
gaggaactaagtgacccgcaaggat

SEQ ID NO: 345050 - DNA, 25 bp, Rattus norvegicus
gaggaactagtaactcttgttttga

SEQ ID NO: 345051 - DNA, 25 bp, Rattus norvegicus
gaggaactagtaccataaacgctgc

SEQ ID NO: 345052 - DNA, 25 bp, Rattus norvegicus
gaggaactagtagcataaacgctgc

SEQ ID NO: 345053 - DNA, 25 bp, Rattus norvegicus
gaggaactagtatctcttgttttga

SEQ ID NO: 345054 - DNA, 25 bp, Rattus norvegicus
gaggaactatatcccagagtccaga

SEQ ID NO: 345055 - DNA, 25 bp, Rattus norvegicus
gaggaactatatgccagagtccaga

SEQ ID NO: 345056 - DNA, 25 bp, Rattus norvegicus
gaggaactcccgagaccaggtagaa

SEQ ID NO: 345057 - DNA, 25 bp, Rattus norvegicus
gaggaactcccgtgaccaggtagaa

SEQ ID NO: 345058 - DNA, 25 bp, Rattus norvegicus
gaggaactcgaaccccaaactgctg

SEQ ID NO: 345059 - DNA, 25 bp, Rattus norvegicus
gaggaactcgaagcccaaactgctg

SEQ ID NO: 345060 - DNA, 25 bp, Rattus norvegicus
gaggaactgaccctaacagaagcac

SEQ ID NO: 345061 - DNA, 25 bp, Rattus norvegicus
gaggaactgaccgtaacagaagcac

SEQ ID NO: 345062 - DNA, 25 bp, Rattus norvegicus
gaggaactgatgagtctgcttttaa

SEQ ID NO: 345063 - DNA, 25 bp, Rattus norvegicus
gaggaactgatgtgtctgcttttaa

SEQ ID NO: 345064 - DNA, 25 bp, Rattus norvegicus
gaggaactgcttatacactggatgt

SEQ ID NO: 345065 - DNA, 25 bp, Rattus norvegicus
gaggaactgcttttacactggatgt

SEQ ID NO: 345066 - DNA, 25 bp, Rattus norvegicus
gaggaactggccaaagttgctttaa

SEQ ID NO: 345067 - DNA, 25 bp, Rattus norvegicus
gaggaactggcctaagttgctttaa

SEQ ID NO: 345068 - DNA, 25 bp, Rattus norvegicus
gaggaactgggtatggactctttca

SEQ ID NO: 345069 - DNA, 25 bp, Rattus norvegicus
gaggaactgggtttggactctttca

SEQ ID NO: 345070 - DNA, 25 bp, Rattus norvegicus
gaggaactggtccaagccaggcccc

SEQ ID NO: 345071 - DNA, 25 bp, Rattus norvegicus
gaggaactggtcgaagccaggcccc

SEQ ID NO: 345072 - DNA, 25 bp, Rattus norvegicus
gaggaactgtatatcaaacaatcaa

SEQ ID NO: 345073 - DNA, 25 bp, Rattus norvegicus
gaggaactgtatttcaaacaatcaa

SEQ ID NO: 345074 - DNA, 25 bp, Rattus norvegicus
gaggaacttctcaacatacgcagag

SEQ ID NO: 345075 - DNA, 25 bp, Rattus norvegicus
gaggaacttctctacatacgcagag

SEQ ID NO: 345076 - DNA, 25 bp, Rattus norvegicus
gaggaacttcttcatttagtactct

SEQ ID NO: 345077 - DNA, 25 bp, Rattus norvegicus
gaggaacttcttgatttagtactct

SEQ ID NO: 345078 - DNA, 25 bp, Rattus norvegicus
gaggaacttgtcagcccaccggaag

SEQ ID NO: 345079 - DNA, 25 bp, Rattus norvegicus
gaggaacttgtctgcccaccggaag

SEQ ID NO: 345080 - DNA, 25 bp, Rattus norvegicus
gaggaagaaaacacccatgttctgg

SEQ ID NO: 345081 - DNA, 25 bp, Rattus norvegicus
gaggaagaaaactcccatgttctgg

SEQ ID NO: 345082 - DNA, 25 bp, Rattus norvegicus
gaggaagaacttctcagtgtataca

SEQ ID NO: 345083 - DNA, 25 bp, Rattus norvegicus
gaggaagaacttgtcagtgtataca

SEQ ID NO: 345084 - DNA, 25 bp, Rattus norvegicus
gaggaagaatatccaccatcgtccc

SEQ ID NO: 345085 - DNA, 25 bp, Rattus norvegicus
gaggaagaatatgcaccatcgtccc

SEQ ID NO: 345086 - DNA, 25 bp, Rattus norvegicus
gaggaagacaacacagattgcccga

SEQ ID NO: 345087 - DNA, 25 bp, Rattus norvegicus
gaggaagacaactcagattgcccga

SEQ ID NO: 345088 - DNA, 25 bp, Rattus norvegicus
gaggaagacaatctttctcataaaa

SEQ ID NO: 345089 - DNA, 25 bp, Rattus norvegicus
gaggaagacaatgtttctcataaaa

SEQ ID NO: 345090 - DNA, 25 bp, Rattus norvegicus
gaggaagacacccagaggtccacca

SEQ ID NO: 345091 - DNA, 25 bp, Rattus norvegicus
gaggaagacaccgagaggtccacca

SEQ ID NO: 345092 - DNA, 25 bp, Rattus norvegicus
gaggaagaccagcacgaatttacaa

SEQ ID NO: 345093 - DNA, 25 bp, Rattus norvegicus
gaggaagaccaggacgaatttacaa

SEQ ID NO: 345094 - DNA, 25 bp, Rattus norvegicus
gaggaagaccgcaagaacgttctca

SEQ ID NO: 345095 - DNA, 25 bp, Rattus norvegicus
gaggaagaccgctagaacgttctca

SEQ ID NO: 345096 - DNA, 25 bp, Rattus norvegicus
gaggaagactatcgaccggccgaca

SEQ ID NO: 345097 - DNA, 25 bp, Rattus norvegicus
gaggaagactatggaccggccgaca

SEQ ID NO: 345098 - DNA, 25 bp, Rattus norvegicus
gaggaagactccagaggtcagccac

SEQ ID NO: 345099 - DNA, 25 bp, Rattus norvegicus
gaggaagactcccatttattccctc

SEQ ID NO: 345100 - DNA, 25 bp, Rattus norvegicus
gaggaagactccgatttattccctc

SEQ ID NO: 345101 - DNA, 25 bp, Rattus norvegicus
gaggaagactcctgaggtcagccac

SEQ ID NO: 345102 - DNA, 25 bp, Rattus norvegicus
gaggaagacttaacccaatttggac

SEQ ID NO: 345103 - DNA, 25 bp, Rattus norvegicus
gaggaagacttatcccaatttggac

SEQ ID NO: 345104 - DNA, 25 bp, Rattus norvegicus
gaggaagagaatacctgcccttgcc

SEQ ID NO: 345105 - DNA, 25 bp, Rattus norvegicus
gaggaagagaattcctgcccttgcc

SEQ ID NO: 345106 - DNA, 25 bp, Rattus norvegicus
gaggaagagaccagttttcttggtt

SEQ ID NO: 345107 - DNA, 25 bp, Rattus norvegicus
gaggaagagacctgttttcttggtt

SEQ ID NO: 345108 - DNA, 25 bp, Rattus norvegicus
gaggaagagcctatcatctctgcgg

SEQ ID NO: 345109 - DNA, 25 bp, Rattus norvegicus
gaggaagagcctttcatctctgcgg

SEQ ID NO: 345110 - DNA, 25 bp, Rattus norvegicus
gaggaagaggtcatgatagcccacg

SEQ ID NO: 345111 - DNA, 25 bp, Rattus norvegicus
gaggaagaggtcttgatagcccacg

SEQ ID NO: 345112 - DNA, 25 bp, Rattus norvegicus
gaggaagagtccaggagcccctctc

SEQ ID NO: 345113 - DNA, 25 bp, Rattus norvegicus
gaggaagagtccattgttcatgatt

SEQ ID NO: 345114 - DNA, 25 bp, Rattus norvegicus
gaggaagagtcctggagcccctctc

SEQ ID NO: 345115 - DNA, 25 bp, Rattus norvegicus
gaggaagagtcctttgttcatgatt

SEQ ID NO: 345116 - DNA, 25 bp, Rattus norvegicus
gaggaagagtgtacccgagacacgc

SEQ ID NO: 345117 - DNA, 25 bp, Rattus norvegicus
gaggaagagtgttcccgagacacgc

SEQ ID NO: 345118 - DNA, 25 bp, Rattus norvegicus
gaggaagatacacacaggagcagaa

SEQ ID NO: 345119 - DNA, 25 bp, Rattus norvegicus
gaggaagatacagacaggagcagaa

SEQ ID NO: 345120 - DNA, 25 bp, Rattus norvegicus
gaggaagatcatctcttctccgctt

SEQ ID NO: 345121 - DNA, 25 bp, Rattus norvegicus
gaggaagatcatgtcttctccgctt

SEQ ID NO: 345122 - DNA, 25 bp, Rattus norvegicus
gaggaagatccgctgttaacagtgt

SEQ ID NO: 345123 - DNA, 25 bp, Rattus norvegicus
gaggaagatccggtgttaacagtgt

SEQ ID NO: 345124 - DNA, 25 bp, Rattus norvegicus
gaggaagatctcaccttaccaactg

SEQ ID NO: 345125 - DNA, 25 bp, Rattus norvegicus
gaggaagatctctccttaccaactg

SEQ ID NO: 345126 - DNA, 25 bp, Rattus norvegicus
gaggaagcacaacactggccctcct

SEQ ID NO: 345127 - DNA, 25 bp, Rattus norvegicus
gaggaagcacaagactggccctcct

SEQ ID NO: 345128 - DNA, 25 bp, Rattus norvegicus
gaggaagcagctatggacaccccgt

SEQ ID NO: 345129 - DNA, 25 bp, Rattus norvegicus
gaggaagcagctttggacaccccgt

SEQ ID NO: 345130 - DNA, 25 bp, Rattus norvegicus
gaggaagcaggtaagcaacaagccc

SEQ ID NO: 345131 - DNA, 25 bp, Rattus norvegicus
gaggaagcaggttagcaacaagccc

SEQ ID NO: 345132 - DNA, 25 bp, Rattus norvegicus
gaggaagccactactaaccgggagt

SEQ ID NO: 345133 - DNA, 25 bp, Rattus norvegicus
gaggaagccacttctaaccgggagt

SEQ ID NO: 345134 - DNA, 25 bp, Rattus norvegicus
gaggaagccatacgcagctgcccta

SEQ ID NO: 345135 - DNA, 25 bp, Rattus norvegicus
gaggaagccataggcagctgcccta

SEQ ID NO: 345136 - DNA, 25 bp, Rattus norvegicus
gaggaagcccaaacctccatttatg

SEQ ID NO: 345137 - DNA, 25 bp, Rattus norvegicus
gaggaagcccaatcctccatttatg

SEQ ID NO: 345138 - DNA, 25 bp, Rattus norvegicus
gaggaagccccacttttacagaaag

SEQ ID NO: 345139 - DNA, 25 bp, Rattus norvegicus
gaggaagccccagttttacagaaag

SEQ ID NO: 345140 - DNA, 25 bp, Rattus norvegicus
gaggaagccctaatcaactgcaggt

SEQ ID NO: 345141 - DNA, 25 bp, Rattus norvegicus
gaggaagccctattcaactgcaggt

SEQ ID NO: 345142 - DNA, 25 bp, Rattus norvegicus
gaggaagccgagacccagcagcagt

SEQ ID NO: 345143 - DNA, 25 bp, Rattus norvegicus
gaggaagccgagtcccagcagcagt

SEQ ID NO: 345144 - DNA, 25 bp, Rattus norvegicus
gaggaagccgctagtttcaaagaac

SEQ ID NO: 345145 - DNA, 25 bp, Rattus norvegicus
gaggaagccgcttgtttcaaagaac

SEQ ID NO: 345146 - DNA, 25 bp, Rattus norvegicus
gaggaagcctagacacttgtctgca

SEQ ID NO: 345147 - DNA, 25 bp, Rattus norvegicus
gaggaagcctagtcacttgtctgca

SEQ ID NO: 345148 - DNA, 25 bp, Rattus norvegicus
gaggaagcctccaaagctcggtgtc

SEQ ID NO: 345149 - DNA, 25 bp, Rattus norvegicus
gaggaagcctccacagcagaggtgt

SEQ ID NO: 345150 - DNA, 25 bp, Rattus norvegicus
gaggaagcctccattggatgagcaa

SEQ ID NO: 345151 - DNA, 25 bp, Rattus norvegicus
gaggaagcctccctttcacggaaga

SEQ ID NO: 345152 - DNA, 25 bp, Rattus norvegicus
gaggaagcctccgtttcacggaaga

SEQ ID NO: 345153 - DNA, 25 bp, Rattus norvegicus
gaggaagcctcctaagctcggtgtc

SEQ ID NO: 345154 - DNA, 25 bp, Rattus norvegicus
gaggaagcctcctcagcagaggtgt

SEQ ID NO: 345155 - DNA, 25 bp, Rattus norvegicus
gaggaagcctcctttggatgagcaa

SEQ ID NO: 345156 - DNA, 25 bp, Rattus norvegicus
gaggaagcctctcatttcttgctgt

SEQ ID NO: 345157 - DNA, 25 bp, Rattus norvegicus
gaggaagcctctgatttcttgctgt

SEQ ID NO: 345158 - DNA, 25 bp, Rattus norvegicus
gaggaagcctggaattcttgcccgc

SEQ ID NO: 345159 - DNA, 25 bp, Rattus norvegicus
gaggaagcctggtattcttgcccgc

SEQ ID NO: 345160 - DNA, 25 bp, Rattus norvegicus
gaggaagcctgtagcgtcccaagga

SEQ ID NO: 345161 - DNA, 25 bp, Rattus norvegicus
gaggaagcctgttgcgtcccaagga

SEQ ID NO: 345162 - DNA, 25 bp, Rattus norvegicus
gaggaagccttcagctcaggaagaa

SEQ ID NO: 345163 - DNA, 25 bp, Rattus norvegicus
gaggaagccttctgctcaggaagaa

SEQ ID NO: 345164 - DNA, 25 bp, Rattus norvegicus
gaggaagcgctgaccgcggcggctg

SEQ ID NO: 345165 - DNA, 25 bp, Rattus norvegicus
gaggaagcgctgtccgcggcggctg

SEQ ID NO: 345166 - DNA, 25 bp, Rattus norvegicus
gaggaagcgttccaaaccccagaga

SEQ ID NO: 345167 - DNA, 25 bp, Rattus norvegicus
gaggaagcgttcgaaaccccagaga

SEQ ID NO: 345168 - DNA, 25 bp, Rattus norvegicus
gaggaagctactcggctccaagcca

SEQ ID NO: 345169 - DNA, 25 bp, Rattus norvegicus
gaggaagctactgggctccaagcca

SEQ ID NO: 345170 - DNA, 25 bp, Rattus norvegicus
gaggaagctagcaggcttggctcct

SEQ ID NO: 345171 - DNA, 25 bp, Rattus norvegicus
gaggaagctagctggcttggctcct

SEQ ID NO: 345172 - DNA, 25 bp, Rattus norvegicus
gaggaagctcaaactgggaccttta

SEQ ID NO: 345173 - DNA, 25 bp, Rattus norvegicus
gaggaagctcaatctgggaccttta

SEQ ID NO: 345174 - DNA, 25 bp, Rattus norvegicus
gaggaagctccgcattacatgtatc

SEQ ID NO: 345175 - DNA, 25 bp, Rattus norvegicus
gaggaagctccggattacatgtatc

SEQ ID NO: 345176 - DNA, 25 bp, Rattus norvegicus
gaggaagctcttctttcagccacaa

SEQ ID NO: 345177 - DNA, 25 bp, Rattus norvegicus
gaggaagctcttgtttcagccacaa

SEQ ID NO: 345178 - DNA, 25 bp, Rattus norvegicus
gaggaagctgaacggcctctgtcct

SEQ ID NO: 345179 - DNA, 25 bp, Rattus norvegicus
gaggaagctgaagggcctctgtcct

SEQ ID NO: 345180 - DNA, 25 bp, Rattus norvegicus
gaggaagctgcacttctggtacaaa

SEQ ID NO: 345181 - DNA, 25 bp, Rattus norvegicus
gaggaagctgcagttctggtacaaa

SEQ ID NO: 345182 - DNA, 25 bp, Rattus norvegicus
gaggaagctgtacccgcataacgta

SEQ ID NO: 345183 - DNA, 25 bp, Rattus norvegicus
gaggaagctgtagccgcataacgta

SEQ ID NO: 345184 - DNA, 25 bp, Rattus norvegicus
gaggaaggaattccagactgctgcc

SEQ ID NO: 345185 - DNA, 25 bp, Rattus norvegicus
gaggaaggaattgcagactgctgcc

SEQ ID NO: 345186 - DNA, 25 bp, Rattus norvegicus
gaggaaggactgagtgcctcccaca

SEQ ID NO: 345187 - DNA, 25 bp, Rattus norvegicus
gaggaaggactgtgtgcctcccaca

SEQ ID NO: 345188 - DNA, 25 bp, Rattus norvegicus
gaggaaggagggacattcactatcc

SEQ ID NO: 345189 - DNA, 25 bp, Rattus norvegicus
gaggaaggagggtcattcactatcc

SEQ ID NO: 345190 - DNA, 25 bp, Rattus norvegicus
gaggaaggcagacttcataccaact

SEQ ID NO: 345191 - DNA, 25 bp, Rattus norvegicus
gaggaaggcagagttcataccaact

SEQ ID NO: 345192 - DNA, 25 bp, Rattus norvegicus
gaggaaggccgtcaaaacgctgttt

SEQ ID NO: 345193 - DNA, 25 bp, Rattus norvegicus
gaggaaggccgtgaaaacgctgttt

SEQ ID NO: 345194 - DNA, 25 bp, Rattus norvegicus
gaggaaggcctgactacttgaatcc

SEQ ID NO: 345195 - DNA, 25 bp, Rattus norvegicus
gaggaaggcctgtctacttgaatcc

SEQ ID NO: 345196 - DNA, 25 bp, Rattus norvegicus
gaggaaggctatctttctaacaatg

SEQ ID NO: 345197 - DNA, 25 bp, Rattus norvegicus
gaggaaggctatgtttctaacaatg

SEQ ID NO: 345198 - DNA, 25 bp, Rattus norvegicus
gaggaaggctcacagatcagtcagt

SEQ ID NO: 345199 - DNA, 25 bp, Rattus norvegicus
gaggaaggctcagagatcagtcagt

SEQ ID NO: 345200 - DNA, 25 bp, Rattus norvegicus
gaggaaggctctaggacagacttga

SEQ ID NO: 345201 - DNA, 25 bp, Rattus norvegicus
gaggaaggctctatgtttaggttct

SEQ ID NO: 345202 - DNA, 25 bp, Rattus norvegicus
gaggaaggctcttggacagacttga

SEQ ID NO: 345203 - DNA, 25 bp, Rattus norvegicus
gaggaaggctctttgtttaggttct

SEQ ID NO: 345204 - DNA, 25 bp, Rattus norvegicus
gaggaaggctgcattctgtgaaatt

SEQ ID NO: 345205 - DNA, 25 bp, Rattus norvegicus
gaggaaggctgctttctgtgaaatt

SEQ ID NO: 345206 - DNA, 25 bp, Rattus norvegicus
gaggaaggctggaggtccaacccca

SEQ ID NO: 345207 - DNA, 25 bp, Rattus norvegicus
gaggaaggctggtggtccaacccca

SEQ ID NO: 345208 - DNA, 25 bp, Rattus norvegicus
gaggaagggaatcgtctctcctgcc

SEQ ID NO: 345209 - DNA, 25 bp, Rattus norvegicus
gaggaagggaatggtctctcctgcc

SEQ ID NO: 345210 - DNA, 25 bp, Rattus norvegicus
gaggaagggataatcccagccaccc

SEQ ID NO: 345211 - DNA, 25 bp, Rattus norvegicus
gaggaagggatattcccagccaccc

SEQ ID NO: 345212 - DNA, 25 bp, Rattus norvegicus
gaggaagggcttcttccctacagta

SEQ ID NO: 345213 - DNA, 25 bp, Rattus norvegicus
gaggaagggcttgttccctacagta

SEQ ID NO: 345214 - DNA, 25 bp, Rattus norvegicus
gaggaaggtcccctagggcacacat

SEQ ID NO: 345215 - DNA, 25 bp, Rattus norvegicus
gaggaaggtcccgtagggcacacat

SEQ ID NO: 345216 - DNA, 25 bp, Rattus norvegicus
gaggaaggtctcacctatacactct

SEQ ID NO: 345217 - DNA, 25 bp, Rattus norvegicus
gaggaaggtctctcctatacactct

SEQ ID NO: 345218 - DNA, 25 bp, Rattus norvegicus
gaggaaggtctgcttcacctacgac

SEQ ID NO: 345219 - DNA, 25 bp, Rattus norvegicus
gaggaaggtctggttcacctacgac

SEQ ID NO: 345220 - DNA, 25 bp, Rattus norvegicus
gaggaaggtgagagcgcgacccgcg

SEQ ID NO: 345221 - DNA, 25 bp, Rattus norvegicus
gaggaaggtgagtgcgcgacccgcg

SEQ ID NO: 345222 - DNA, 25 bp, Rattus norvegicus
gaggaaggtggaaattttgcacttt

SEQ ID NO: 345223 - DNA, 25 bp, Rattus norvegicus
gaggaaggtggatattttgcacttt

SEQ ID NO: 345224 - DNA, 25 bp, Rattus norvegicus
gaggaagtcagccattcctggctag

SEQ ID NO: 345225 - DNA, 25 bp, Rattus norvegicus
gaggaagtcagcgattcctggctag

SEQ ID NO: 345226 - DNA, 25 bp, Rattus norvegicus
gaggaagtcatcagcatacatcaaa

SEQ ID NO: 345227 - DNA, 25 bp, Rattus norvegicus
gaggaagtcatctgcatacatcaaa

SEQ ID NO: 345228 - DNA, 25 bp, Rattus norvegicus
gaggaagtcccaaatctcacatcga

SEQ ID NO: 345229 - DNA, 25 bp, Rattus norvegicus
gaggaagtcccaattgcacacatta

SEQ ID NO: 345230 - DNA, 25 bp, Rattus norvegicus
gaggaagtcccatatctcacatcga

SEQ ID NO: 345231 - DNA, 25 bp, Rattus norvegicus
gaggaagtcccatttgcacacatta

SEQ ID NO: 345232 - DNA, 25 bp, Rattus norvegicus
gaggaagtcttaacttttctggaag

SEQ ID NO: 345233 - DNA, 25 bp, Rattus norvegicus
gaggaagtcttatcttttctggaag

SEQ ID NO: 345234 - DNA, 25 bp, Rattus norvegicus
gaggaagtcttccatttcccaggga

SEQ ID NO: 345235 - DNA, 25 bp, Rattus norvegicus
gaggaagtcttcgatttcccaggga

SEQ ID NO: 345236 - DNA, 25 bp, Rattus norvegicus
gaggaagtgcacatgagacctgaca

SEQ ID NO: 345237 - DNA, 25 bp, Rattus norvegicus
gaggaagtgcacttgagacctgaca

SEQ ID NO: 345238 - DNA, 25 bp, Rattus norvegicus
gaggaagtgccccatgatgttgccc

SEQ ID NO: 345239 - DNA, 25 bp, Rattus norvegicus
gaggaagtgcccgatgatgttgccc

SEQ ID NO: 345240 - DNA, 25 bp, Rattus norvegicus
gaggaagtgcctagctggcatttaa

SEQ ID NO: 345241 - DNA, 25 bp, Rattus norvegicus
gaggaagtgccttgctggcatttaa

SEQ ID NO: 345242 - DNA, 25 bp, Rattus norvegicus
gaggaagtgctgatgaccgtattaa

SEQ ID NO: 345243 - DNA, 25 bp, Rattus norvegicus
gaggaagtgctgttgaccgtattaa

SEQ ID NO: 345244 - DNA, 25 bp, Rattus norvegicus
gaggaagtggacaacctggttgcct

SEQ ID NO: 345245 - DNA, 25 bp, Rattus norvegicus
gaggaagtggactacctggttgcct

SEQ ID NO: 345246 - DNA, 25 bp, Rattus norvegicus
gaggaagtggctatttggacacagt

SEQ ID NO: 345247 - DNA, 25 bp, Rattus norvegicus
gaggaagtggctttttggacacagt

SEQ ID NO: 345248 - DNA, 25 bp, Rattus norvegicus
gaggaagtgttccacaccactggac

SEQ ID NO: 345249 - DNA, 25 bp, Rattus norvegicus
gaggaagtgttcgacaccactggac

SEQ ID NO: 345250 - DNA, 25 bp, Rattus norvegicus
gaggaagttatcagggacatccctt

SEQ ID NO: 345251 - DNA, 25 bp, Rattus norvegicus
gaggaagttatctgggacatccctt

SEQ ID NO: 345252 - DNA, 25 bp, Rattus norvegicus
gaggaagttattcgtgccttttgtt

SEQ ID NO: 345253 - DNA, 25 bp, Rattus norvegicus
gaggaagttattggtgccttttgtt

SEQ ID NO: 345254 - DNA, 25 bp, Rattus norvegicus
gaggaagttcctccaagctattcac

SEQ ID NO: 345255 - DNA, 25 bp, Rattus norvegicus
gaggaagttcctcctgttaataaaa

SEQ ID NO: 345256 - DNA, 25 bp, Rattus norvegicus
gaggaagttcctgcaagctattcac

SEQ ID NO: 345257 - DNA, 25 bp, Rattus norvegicus
gaggaagttcctgctgttaataaaa

SEQ ID NO: 345258 - DNA, 25 bp, Rattus norvegicus
gaggaataaatgaccactgcttttg

SEQ ID NO: 345259 - DNA, 25 bp, Rattus norvegicus
gaggaataaatgtccactgcttttg

SEQ ID NO: 345260 - DNA, 25 bp, Rattus norvegicus
gaggaataacatagccctggccttg

SEQ ID NO: 345261 - DNA, 25 bp, Rattus norvegicus
gaggaataacattgccctggccttg

SEQ ID NO: 345262 - DNA, 25 bp, Rattus norvegicus
gaggaatacaacacactgttccctg

SEQ ID NO: 345263 - DNA, 25 bp, Rattus norvegicus
gaggaatacaactcactgttccctg

SEQ ID NO: 345264 - DNA, 25 bp, Rattus norvegicus
gaggaatatccaatttcatacacaa

SEQ ID NO: 345265 - DNA, 25 bp, Rattus norvegicus
gaggaatatccattttcatacacaa

SEQ ID NO: 345266 - DNA, 25 bp, Rattus norvegicus
gaggaatatgcacccttcaggtata

SEQ ID NO: 345267 - DNA, 25 bp, Rattus norvegicus
gaggaatatgcagccttcaggtata

SEQ ID NO: 345268 - DNA, 25 bp, Rattus norvegicus
gaggaatattaaagcctatgttggt

SEQ ID NO: 345269 - DNA, 25 bp, Rattus norvegicus
gaggaatattaatgcctatgttggt

SEQ ID NO: 345270 - DNA, 25 bp, Rattus norvegicus
gaggaatattctatcctgttctccc

SEQ ID NO: 345271 - DNA, 25 bp, Rattus norvegicus
gaggaatattctttcctgttctccc

SEQ ID NO: 345272 - DNA, 25 bp, Rattus norvegicus
gaggaatcaacacaggcgtcggcat

SEQ ID NO: 345273 - DNA, 25 bp, Rattus norvegicus
gaggaatcaacagaggcgtcggcat

SEQ ID NO: 345274 - DNA, 25 bp, Rattus norvegicus
gaggaatcaaggatctcccatttaa

SEQ ID NO: 345275 - DNA, 25 bp, Rattus norvegicus
gaggaatcaaggttctcccatttaa

SEQ ID NO: 345276 - DNA, 25 bp, Rattus norvegicus
gaggaatcacaactggatctctcca

SEQ ID NO: 345277 - DNA, 25 bp, Rattus norvegicus
gaggaatcacaagtggatctctcca

SEQ ID NO: 345278 - DNA, 25 bp, Rattus norvegicus
gaggaatcagcaaacctttcccatt

SEQ ID NO: 345279 - DNA, 25 bp, Rattus norvegicus
gaggaatcagcatacctttcccatt

SEQ ID NO: 345280 - DNA, 25 bp, Rattus norvegicus
gaggaatcagctatcagtacgtaag

SEQ ID NO: 345281 - DNA, 25 bp, Rattus norvegicus
gaggaatcagctttcagtacgtaag

SEQ ID NO: 345282 - DNA, 25 bp, Rattus norvegicus
gaggaatcatctcgcacgctattat

SEQ ID NO: 345283 - DNA, 25 bp, Rattus norvegicus
gaggaatcatctggcacgctattat

SEQ ID NO: 345284 - DNA, 25 bp, Rattus norvegicus
gaggaatcatgtcgccctggcttgc

SEQ ID NO: 345285 - DNA, 25 bp, Rattus norvegicus
gaggaatcatgtggccctggcttgc

SEQ ID NO: 345286 - DNA, 25 bp, Rattus norvegicus
gaggaatccaaaaccctctcttggg

SEQ ID NO: 345287 - DNA, 25 bp, Rattus norvegicus
gaggaatccaaatccctctcttggg

SEQ ID NO: 345288 - DNA, 25 bp, Rattus norvegicus
gaggaatccatactccagcttgcaa

SEQ ID NO: 345289 - DNA, 25 bp, Rattus norvegicus
gaggaatccatagtccagcttgcaa

SEQ ID NO: 345290 - DNA, 25 bp, Rattus norvegicus
gaggaatccctgagctagagaacat

SEQ ID NO: 345291 - DNA, 25 bp, Rattus norvegicus
gaggaatccctgtgctagagaacat

SEQ ID NO: 345292 - DNA, 25 bp, Rattus norvegicus
gaggaatcctccattagtgcagttc

SEQ ID NO: 345293 - DNA, 25 bp, Rattus norvegicus
gaggaatcctcctttagtgcagttc

SEQ ID NO: 345294 - DNA, 25 bp, Rattus norvegicus
gaggaatcctcgctgctatgcaacc

SEQ ID NO: 345295 - DNA, 25 bp, Rattus norvegicus
gaggaatcctcggtgctatgcaacc

SEQ ID NO: 345296 - DNA, 25 bp, Rattus norvegicus
gaggaatcctttctttcatccctga

SEQ ID NO: 345297 - DNA, 25 bp, Rattus norvegicus
gaggaatcctttgtttcatccctga

SEQ ID NO: 345298 - DNA, 25 bp, Rattus norvegicus
gaggaatcgaatacttctcagcctt

SEQ ID NO: 345299 - DNA, 25 bp, Rattus norvegicus
gaggaatcgaattcttctcagcctt

SEQ ID NO: 345300 - DNA, 25 bp, Rattus norvegicus
gaggaatcgctcagatcttgtccat

SEQ ID NO: 345301 - DNA, 25 bp, Rattus norvegicus
gaggaatcgctctgatcttgtccat

SEQ ID NO: 345302 - DNA, 25 bp, Rattus norvegicus
gaggaatctaagacaatactcgcta

SEQ ID NO: 345303 - DNA, 25 bp, Rattus norvegicus
gaggaatctaagtcaatactcgcta

SEQ ID NO: 345304 - DNA, 25 bp, Rattus norvegicus
gaggaatctcatcgaatggctgaac

SEQ ID NO: 345305 - DNA, 25 bp, Rattus norvegicus
gaggaatctcatggaatggctgaac

SEQ ID NO: 345306 - DNA, 25 bp, Rattus norvegicus
gaggaatctctaaatctactttacc

SEQ ID NO: 345307 - DNA, 25 bp, Rattus norvegicus
gaggaatctctatatctactttacc

SEQ ID NO: 345308 - DNA, 25 bp, Rattus norvegicus
gaggaatctctgaccgagacctgga

SEQ ID NO: 345309 - DNA, 25 bp, Rattus norvegicus
gaggaatctctgtccgagacctgga

SEQ ID NO: 345310 - DNA, 25 bp, Rattus norvegicus
gaggaatctgcacatcgggcactta

SEQ ID NO: 345311 - DNA, 25 bp, Rattus norvegicus
gaggaatctgcagatcgggcactta

SEQ ID NO: 345312 - DNA, 25 bp, Rattus norvegicus
gaggaatgacccctgtatgtctaga

SEQ ID NO: 345313 - DNA, 25 bp, Rattus norvegicus
gaggaatgacccgtgtatgtctaga

SEQ ID NO: 345314 - DNA, 25 bp, Rattus norvegicus
gaggaatgatcccttgctgactgtc

SEQ ID NO: 345315 - DNA, 25 bp, Rattus norvegicus
gaggaatgatccgttgctgactgtc

SEQ ID NO: 345316 - DNA, 25 bp, Rattus norvegicus
gaggaatgccacaggtcgtgttgaa

SEQ ID NO: 345317 - DNA, 25 bp, Rattus norvegicus
gaggaatgccactggtcgtgttgaa

SEQ ID NO: 345318 - DNA, 25 bp, Rattus norvegicus
gaggaatgcgttactatctgggcac

SEQ ID NO: 345319 - DNA, 25 bp, Rattus norvegicus
gaggaatgcgttctacccaaggagc

SEQ ID NO: 345320 - DNA, 25 bp, Rattus norvegicus
gaggaatgcgttgtacccaaggagc

SEQ ID NO: 345321 - DNA, 25 bp, Rattus norvegicus
gaggaatgcgtttctatctgggcac

SEQ ID NO: 345322 - DNA, 25 bp, Rattus norvegicus
gaggaatgctcccagcaccagaagc

SEQ ID NO: 345323 - DNA, 25 bp, Rattus norvegicus
gaggaatgctccgagcaccagaagc

SEQ ID NO: 345324 - DNA, 25 bp, Rattus norvegicus
gaggaatggaagactctcccttctt

SEQ ID NO: 345325 - DNA, 25 bp, Rattus norvegicus
gaggaatggaagtctctcccttctt

SEQ ID NO: 345326 - DNA, 25 bp, Rattus norvegicus
gaggaatgtgctccgctgtcagtat

SEQ ID NO: 345327 - DNA, 25 bp, Rattus norvegicus
gaggaatgtgctgcgctgtcagtat

SEQ ID NO: 345328 - DNA, 25 bp, Rattus norvegicus
gaggaatgtggtactcatccagcaa

SEQ ID NO: 345329 - DNA, 25 bp, Rattus norvegicus
gaggaatgtggttctcatccagcaa

SEQ ID NO: 345330 - DNA, 25 bp, Rattus norvegicus
gaggaattactgacttgccaaatat

SEQ ID NO: 345331 - DNA, 25 bp, Rattus norvegicus
gaggaattactgtcttgccaaatat

SEQ ID NO: 345332 - DNA, 25 bp, Rattus norvegicus
gaggaattcaacacaggtcccctct

SEQ ID NO: 345333 - DNA, 25 bp, Rattus norvegicus
gaggaattcaacatctaggacacgg

SEQ ID NO: 345334 - DNA, 25 bp, Rattus norvegicus
gaggaattcaactcaggtcccctct

SEQ ID NO: 345335 - DNA, 25 bp, Rattus norvegicus
gaggaattcaacttctaggacacgg

SEQ ID NO: 345336 - DNA, 25 bp, Rattus norvegicus
gaggaattcagtactacagtcagag

SEQ ID NO: 345337 - DNA, 25 bp, Rattus norvegicus
gaggaattcagttctacagtcagag

SEQ ID NO: 345338 - DNA, 25 bp, Rattus norvegicus
gaggaattccacactgtggtccaca

SEQ ID NO: 345339 - DNA, 25 bp, Rattus norvegicus
gaggaattccactctgtggtccaca

SEQ ID NO: 345340 - DNA, 25 bp, Rattus norvegicus
gaggaattctccaacattcgcaggc

SEQ ID NO: 345341 - DNA, 25 bp, Rattus norvegicus
gaggaattctcctacattcgcaggc

SEQ ID NO: 345342 - DNA, 25 bp, Rattus norvegicus
gaggaattctgaatcaacatatgaa

SEQ ID NO: 345343 - DNA, 25 bp, Rattus norvegicus
gaggaattctgattcaacatatgaa

SEQ ID NO: 345344 - DNA, 25 bp, Rattus norvegicus
gaggaattgatccaccagctgagga

SEQ ID NO: 345345 - DNA, 25 bp, Rattus norvegicus
gaggaattgatcgaccagctgagga

SEQ ID NO: 345346 - DNA, 25 bp, Rattus norvegicus
gaggaattgcctctgtccatggacc

SEQ ID NO: 345347 - DNA, 25 bp, Rattus norvegicus
gaggaattgcctgtgtccatggacc

SEQ ID NO: 345348 - DNA, 25 bp, Rattus norvegicus
gaggaattgcttacacttcaagact

SEQ ID NO: 345349 - DNA, 25 bp, Rattus norvegicus
gaggaattgctttcacttcaagact

SEQ ID NO: 345350 - DNA, 25 bp, Rattus norvegicus
gaggaattgggcatgtcaactcaat

SEQ ID NO: 345351 - DNA, 25 bp, Rattus norvegicus
gaggaattgggcttgtcaactcaat

SEQ ID NO: 345352 - DNA, 25 bp, Rattus norvegicus
gaggaattgtacagcacccagccgg

SEQ ID NO: 345353 - DNA, 25 bp, Rattus norvegicus
gaggaattgtactgcacccagccgg

SEQ ID NO: 345354 - DNA, 25 bp, Rattus norvegicus
gaggaatttaggagtctctccaaca

SEQ ID NO: 345355 - DNA, 25 bp, Rattus norvegicus
gaggaatttaggtgtctctccaaca

SEQ ID NO: 345356 - DNA, 25 bp, Rattus norvegicus
gaggaatttatcagagagctgctct

SEQ ID NO: 345357 - DNA, 25 bp, Rattus norvegicus
gaggaatttatctgagagctgctct

SEQ ID NO: 345358 - DNA, 25 bp, Rattus norvegicus
gaggaatttccaccacagatactgt

SEQ ID NO: 345359 - DNA, 25 bp, Rattus norvegicus
gaggaatttccagcacagatactgt

SEQ ID NO: 345360 - DNA, 25 bp, Rattus norvegicus
gaggaatttcctagcattcccatga

SEQ ID NO: 345361 - DNA, 25 bp, Rattus norvegicus
gaggaatttccttgcattcccatga

SEQ ID NO: 345362 - DNA, 25 bp, Rattus norvegicus
gaggaatttggcctccccaagtgag

SEQ ID NO: 345363 - DNA, 25 bp, Rattus norvegicus
gaggaatttggcgtccccaagtgag

SEQ ID NO: 345364 - DNA, 25 bp, Rattus norvegicus
gaggaattttgtcgcctaagaccct

SEQ ID NO: 345365 - DNA, 25 bp, Rattus norvegicus
gaggaattttgtggcctaagaccct

SEQ ID NO: 345366 - DNA, 25 bp, Rattus norvegicus
gaggacaaaacccactcaagcccgt

SEQ ID NO: 345367 - DNA, 25 bp, Rattus norvegicus
gaggacaaaaccgactcaagcccgt

SEQ ID NO: 345368 - DNA, 25 bp, Rattus norvegicus
gaggacaaagacagcctgccttgga

SEQ ID NO: 345369 - DNA, 25 bp, Rattus norvegicus
gaggacaaagactgcctgccttgga

SEQ ID NO: 345370 - DNA, 25 bp, Rattus norvegicus
gaggacaaagctccaattattgaca

SEQ ID NO: 345371 - DNA, 25 bp, Rattus norvegicus
gaggacaaagctgcaattattgaca

SEQ ID NO: 345372 - DNA, 25 bp, Rattus norvegicus
gaggacaaattcagctggttctgct

SEQ ID NO: 345373 - DNA, 25 bp, Rattus norvegicus
gaggacaaattctgctggttctgct

SEQ ID NO: 345374 - DNA, 25 bp, Rattus norvegicus
gaggacaacaagagaccagctaccc

SEQ ID NO: 345375 - DNA, 25 bp, Rattus norvegicus
gaggacaacaagtgaccagctaccc

SEQ ID NO: 345376 - DNA, 25 bp, Rattus norvegicus
gaggacaacacactatttttcaaaa

SEQ ID NO: 345377 - DNA, 25 bp, Rattus norvegicus
gaggacaacacagtatttttcaaaa

SEQ ID NO: 345378 - DNA, 25 bp, Rattus norvegicus
gaggacaacaggctcccatgtcact

SEQ ID NO: 345379 - DNA, 25 bp, Rattus norvegicus
gaggacaacagggtcccatgtcact

SEQ ID NO: 345380 - DNA, 25 bp, Rattus norvegicus
gaggacaacctgatactggacatgt

SEQ ID NO: 345381 - DNA, 25 bp, Rattus norvegicus
gaggacaacctgttactggacatgt

SEQ ID NO: 345382 - DNA, 25 bp, Rattus norvegicus
gaggacaacgcgctcagcagacagc

SEQ ID NO: 345383 - DNA, 25 bp, Rattus norvegicus
gaggacaacgcggtcagcagacagc

SEQ ID NO: 345384 - DNA, 25 bp, Rattus norvegicus
gaggacaactggcatccaagcgacc

SEQ ID NO: 345385 - DNA, 25 bp, Rattus norvegicus
gaggacaactgggatccaagcgacc

SEQ ID NO: 345386 - DNA, 25 bp, Rattus norvegicus
gaggacaactttctgtagccacttc

SEQ ID NO: 345387 - DNA, 25 bp, Rattus norvegicus
gaggacaactttgtgtagccacttc

SEQ ID NO: 345388 - DNA, 25 bp, Rattus norvegicus
gaggacaagagtctctgtgcctgtc

SEQ ID NO: 345389 - DNA, 25 bp, Rattus norvegicus
gaggacaagagtgtctgtgcctgtc

SEQ ID NO: 345390 - DNA, 25 bp, Rattus norvegicus
gaggacaagatgctcggcccctagc

SEQ ID NO: 345391 - DNA, 25 bp, Rattus norvegicus
gaggacaagatggtcggcccctagc

SEQ ID NO: 345392 - DNA, 25 bp, Rattus norvegicus
gaggacaagcacatactgggtcaga

SEQ ID NO: 345393 - DNA, 25 bp, Rattus norvegicus
gaggacaagcacttactgggtcaga

SEQ ID NO: 345394 - DNA, 25 bp, Rattus norvegicus
gaggacaagcgcacagacctcggcg

SEQ ID NO: 345395 - DNA, 25 bp, Rattus norvegicus
gaggacaagcgctcagacctcggcg

SEQ ID NO: 345396 - DNA, 25 bp, Rattus norvegicus
gaggacaagctcaatcaggctcact

SEQ ID NO: 345397 - DNA, 25 bp, Rattus norvegicus
gaggacaagctctatcaggctcact

SEQ ID NO: 345398 - DNA, 25 bp, Rattus norvegicus
gaggacaagtccatagccatgctgt

SEQ ID NO: 345399 - DNA, 25 bp, Rattus norvegicus
gaggacaagtccttagccatgctgt

SEQ ID NO: 345400 - DNA, 25 bp, Rattus norvegicus
gaggacaatcaacccctatttccct

SEQ ID NO: 345401 - DNA, 25 bp, Rattus norvegicus
gaggacaatcaagccctatttccct

SEQ ID NO: 345402 - DNA, 25 bp, Rattus norvegicus
gaggacaatcccaagtccctgaagt

SEQ ID NO: 345403 - DNA, 25 bp, Rattus norvegicus
gaggacaatccctagtccctgaagt

SEQ ID NO: 345404 - DNA, 25 bp, Rattus norvegicus
gaggacaatgaccttgctgctactg

SEQ ID NO: 345405 - DNA, 25 bp, Rattus norvegicus
gaggacaatgacgttgctgctactg

SEQ ID NO: 345406 - DNA, 25 bp, Rattus norvegicus
gaggacacacagactacaatactat

SEQ ID NO: 345407 - DNA, 25 bp, Rattus norvegicus
gaggacacacagtctacaatactat

SEQ ID NO: 345408 - DNA, 25 bp, Rattus norvegicus
gaggacacacgtactacgccatgta

SEQ ID NO: 345409 - DNA, 25 bp, Rattus norvegicus
gaggacacacgttctacgccatgta

SEQ ID NO: 345410 - DNA, 25 bp, Rattus norvegicus
gaggacacacttatgacacagatct

SEQ ID NO: 345411 - DNA, 25 bp, Rattus norvegicus
gaggacacacttttgacacagatct

SEQ ID NO: 345412 - DNA, 25 bp, Rattus norvegicus
gaggacacagatctgtcactcctag

SEQ ID NO: 345413 - DNA, 25 bp, Rattus norvegicus
gaggacacagatcttccagagccta

SEQ ID NO: 345414 - DNA, 25 bp, Rattus norvegicus
gaggacacagatgtgtcactcctag

SEQ ID NO: 345415 - DNA, 25 bp, Rattus norvegicus
gaggacacagatgttccagagccta

SEQ ID NO: 345416 - DNA, 25 bp, Rattus norvegicus
gaggacacaggacagttcacagact

SEQ ID NO: 345417 - DNA, 25 bp, Rattus norvegicus
gaggacacaggagagttcacagact

SEQ ID NO: 345418 - DNA, 25 bp, Rattus norvegicus
gaggacacagtacccctgagctgaa

SEQ ID NO: 345419 - DNA, 25 bp, Rattus norvegicus
gaggacacagtagccctgagctgaa

SEQ ID NO: 345420 - DNA, 25 bp, Rattus norvegicus
gaggacacatccagacctagagctc

SEQ ID NO: 345421 - DNA, 25 bp, Rattus norvegicus
gaggacacatcctgacctagagctc

SEQ ID NO: 345422 - DNA, 25 bp, Rattus norvegicus
gaggacaccatcagtacaaccgtac

SEQ ID NO: 345423 - DNA, 25 bp, Rattus norvegicus
gaggacaccatctgtacaaccgtac

SEQ ID NO: 345424 - DNA, 25 bp, Rattus norvegicus
gaggacacctagctcctgtgcatca

SEQ ID NO: 345425 - DNA, 25 bp, Rattus norvegicus
gaggacacctaggtcctgtgcatca

SEQ ID NO: 345426 - DNA, 25 bp, Rattus norvegicus
gaggacacctgcaagtgaacgtcac

SEQ ID NO: 345427 - DNA, 25 bp, Rattus norvegicus
gaggacacctgctagtgaacgtcac

SEQ ID NO: 345428 - DNA, 25 bp, Rattus norvegicus
gaggacaccttcatcggtatctgga

SEQ ID NO: 345429 - DNA, 25 bp, Rattus norvegicus
gaggacaccttcttcggtatctgga

SEQ ID NO: 345430 - DNA, 25 bp, Rattus norvegicus
gaggacacgggaattcccggctgaa

SEQ ID NO: 345431 - DNA, 25 bp, Rattus norvegicus
gaggacacgggatttcccggctgaa

SEQ ID NO: 345432 - DNA, 25 bp, Rattus norvegicus
gaggacacgtccctcacgtggctat

SEQ ID NO: 345433 - DNA, 25 bp, Rattus norvegicus
gaggacacgtccgtcacgtggctat

SEQ ID NO: 345434 - DNA, 25 bp, Rattus norvegicus
gaggacacgtgcctagtactctagc

SEQ ID NO: 345435 - DNA, 25 bp, Rattus norvegicus
gaggacacgtgcgtagtactctagc

SEQ ID NO: 345436 - DNA, 25 bp, Rattus norvegicus
gaggacactcctcatggttttcatc

SEQ ID NO: 345437 - DNA, 25 bp, Rattus norvegicus
gaggacactcctgatggttttcatc

SEQ ID NO: 345438 - DNA, 25 bp, Rattus norvegicus
gaggacactcgtatgcaccaagtat

SEQ ID NO: 345439 - DNA, 25 bp, Rattus norvegicus
gaggacactcgtttgcaccaagtat

SEQ ID NO: 345440 - DNA, 25 bp, Rattus norvegicus
gaggacactgccatataccgggagt

SEQ ID NO: 345441 - DNA, 25 bp, Rattus norvegicus
gaggacactgccttataccgggagt

SEQ ID NO: 345442 - DNA, 25 bp, Rattus norvegicus
gaggacactggcactaccaatggga

SEQ ID NO: 345443 - DNA, 25 bp, Rattus norvegicus
gaggacactggcagtgtgttcattt

SEQ ID NO: 345444 - DNA, 25 bp, Rattus norvegicus
gaggacactggccatgctttgtaaa

SEQ ID NO: 345445 - DNA, 25 bp, Rattus norvegicus
gaggacactggcgatgctttgtaaa

SEQ ID NO: 345446 - DNA, 25 bp, Rattus norvegicus
gaggacactggctctaccaatggga

SEQ ID NO: 345447 - DNA, 25 bp, Rattus norvegicus
gaggacactggctgtgtgttcattt

SEQ ID NO: 345448 - DNA, 25 bp, Rattus norvegicus
gaggacactgtcatttccatcccca

SEQ ID NO: 345449 - DNA, 25 bp, Rattus norvegicus
gaggacactgtcttttccatcccca

SEQ ID NO: 345450 - DNA, 25 bp, Rattus norvegicus
gaggacactgtgactacatccaaaa

SEQ ID NO: 345451 - DNA, 25 bp, Rattus norvegicus
gaggacactgtgtctacatccaaaa

SEQ ID NO: 345452 - DNA, 25 bp, Rattus norvegicus
gaggacacttgcattagccaaatct

SEQ ID NO: 345453 - DNA, 25 bp, Rattus norvegicus
gaggacacttgctttagccaaatct

SEQ ID NO: 345454 - DNA, 25 bp, Rattus norvegicus
gaggacagaacgcatgcatctcaag

SEQ ID NO: 345455 - DNA, 25 bp, Rattus norvegicus
gaggacagaacggatgcatctcaag

SEQ ID NO: 345456 - DNA, 25 bp, Rattus norvegicus
gaggacagacatccgggcaatccaa

SEQ ID NO: 345457 - DNA, 25 bp, Rattus norvegicus
gaggacagacatgcgggcaatccaa

SEQ ID NO: 345458 - DNA, 25 bp, Rattus norvegicus
gaggacagacgtcccatgcaggaca

SEQ ID NO: 345459 - DNA, 25 bp, Rattus norvegicus
gaggacagacgtgccatgcaggaca

SEQ ID NO: 345460 - DNA, 25 bp, Rattus norvegicus
gaggacagacttaggcatcttcagg

SEQ ID NO: 345461 - DNA, 25 bp, Rattus norvegicus
gaggacagactttggcatcttcagg

SEQ ID NO: 345462 - DNA, 25 bp, Rattus norvegicus
gaggacagaggtacatttccccggg

SEQ ID NO: 345463 - DNA, 25 bp, Rattus norvegicus
gaggacagaggttcatttccccggg

SEQ ID NO: 345464 - DNA, 25 bp, Rattus norvegicus
gaggacagatgtcaggagtctctat

SEQ ID NO: 345465 - DNA, 25 bp, Rattus norvegicus
gaggacagatgtgaggagtctctat

SEQ ID NO: 345466 - DNA, 25 bp, Rattus norvegicus
gaggacagcacacacttctttgaga

SEQ ID NO: 345467 - DNA, 25 bp, Rattus norvegicus
gaggacagcacagacttctttgaga

SEQ ID NO: 345468 - DNA, 25 bp, Rattus norvegicus
gaggacagcagtagaccacgccaag

SEQ ID NO: 345469 - DNA, 25 bp, Rattus norvegicus
gaggacagcagttgaccacgccaag

SEQ ID NO: 345470 - DNA, 25 bp, Rattus norvegicus
gaggacagccataccaggtgtctgt

SEQ ID NO: 345471 - DNA, 25 bp, Rattus norvegicus
gaggacagccattccaggtgtctgt

SEQ ID NO: 345472 - DNA, 25 bp, Rattus norvegicus
gaggacagccccattgtggaaataa

SEQ ID NO: 345473 - DNA, 25 bp, Rattus norvegicus
gaggacagcccctttgtggaaataa

SEQ ID NO: 345474 - DNA, 25 bp, Rattus norvegicus
gaggacagcggcaacaaacccatgt

SEQ ID NO: 345475 - DNA, 25 bp, Rattus norvegicus
gaggacagcggctacaaacccatgt

SEQ ID NO: 345476 - DNA, 25 bp, Rattus norvegicus
gaggacagctgacctggcaccagaa

SEQ ID NO: 345477 - DNA, 25 bp, Rattus norvegicus
gaggacagctgagctggcaccagaa

SEQ ID NO: 345478 - DNA, 25 bp, Rattus norvegicus
gaggacaggagaaagtggtgcaacc

SEQ ID NO: 345479 - DNA, 25 bp, Rattus norvegicus
gaggacaggagatagtggtgcaacc

SEQ ID NO: 345480 - DNA, 25 bp, Rattus norvegicus
gaggacaggcatattttctagtttt

SEQ ID NO: 345481 - DNA, 25 bp, Rattus norvegicus
gaggacaggcattttttctagtttt

SEQ ID NO: 345482 - DNA, 25 bp, Rattus norvegicus
gaggacaggccgcagcatgtctcca

SEQ ID NO: 345483 - DNA, 25 bp, Rattus norvegicus
gaggacaggccggagcatgtctcca

SEQ ID NO: 345484 - DNA, 25 bp, Rattus norvegicus
gaggacaggcctcggttgcacccca

SEQ ID NO: 345485 - DNA, 25 bp, Rattus norvegicus
gaggacaggcctgggttgcacccca

SEQ ID NO: 345486 - DNA, 25 bp, Rattus norvegicus
gaggacaggctgaagctgagccctc

SEQ ID NO: 345487 - DNA, 25 bp, Rattus norvegicus
gaggacaggctgtagctgagccctc

SEQ ID NO: 345488 - DNA, 25 bp, Rattus norvegicus
gaggacaggtctctgttcttgagaa

SEQ ID NO: 345489 - DNA, 25 bp, Rattus norvegicus
gaggacaggtctgtgttcttgagaa

SEQ ID NO: 345490 - DNA, 25 bp, Rattus norvegicus
gaggacagtaaacacggccttctgc

SEQ ID NO: 345491 - DNA, 25 bp, Rattus norvegicus
gaggacagtaaagacggccttctgc

SEQ ID NO: 345492 - DNA, 25 bp, Rattus norvegicus
gaggacagtcacaattcaatgtcta

SEQ ID NO: 345493 - DNA, 25 bp, Rattus norvegicus
gaggacagtcactattcaatgtcta

SEQ ID NO: 345494 - DNA, 25 bp, Rattus norvegicus
gaggacagtccaccacagacattag

SEQ ID NO: 345495 - DNA, 25 bp, Rattus norvegicus
gaggacagtccagcacagacattag

SEQ ID NO: 345496 - DNA, 25 bp, Rattus norvegicus
gaggacagtgtaccgcttagcattt

SEQ ID NO: 345497 - DNA, 25 bp, Rattus norvegicus
gaggacagtgtagcgcttagcattt

SEQ ID NO: 345498 - DNA, 25 bp, Rattus norvegicus
gaggacagtgtgacttgttgacaac

SEQ ID NO: 345499 - DNA, 25 bp, Rattus norvegicus
gaggacagtgtgtcttgttgacaac

SEQ ID NO: 345500 - DNA, 25 bp, Rattus norvegicus
gaggacagtgttcccgaaactcgtt

SEQ ID NO: 345501 - DNA, 25 bp, Rattus norvegicus
gaggacagtgttgccgaaactcgtt

SEQ ID NO: 345502 - DNA, 25 bp, Rattus norvegicus
gaggacagttagcacagcactcact

SEQ ID NO: 345503 - DNA, 25 bp, Rattus norvegicus
gaggacagttaggacagcactcact

SEQ ID NO: 345504 - DNA, 25 bp, Rattus norvegicus
gaggacagttatctttcttctgcca

SEQ ID NO: 345505 - DNA, 25 bp, Rattus norvegicus
gaggacagttatgtttcttctgcca

SEQ ID NO: 345506 - DNA, 25 bp, Rattus norvegicus
gaggacagtttccagcatgctgcta

SEQ ID NO: 345507 - DNA, 25 bp, Rattus norvegicus
gaggacagtttcgagcatgctgcta

SEQ ID NO: 345508 - DNA, 25 bp, Rattus norvegicus
gaggacatagctcctcttgtatttc

SEQ ID NO: 345509 - DNA, 25 bp, Rattus norvegicus
gaggacatagctgctcttgtatttc

SEQ ID NO: 345510 - DNA, 25 bp, Rattus norvegicus
gaggacatcaagaggctgcgcctgt

SEQ ID NO: 345511 - DNA, 25 bp, Rattus norvegicus
gaggacatcaagtggctgcgcctgt

SEQ ID NO: 345512 - DNA, 25 bp, Rattus norvegicus
gaggacatcaccaccgtgggctcta

SEQ ID NO: 345513 - DNA, 25 bp, Rattus norvegicus
gaggacatcacctccgtgggctcta

SEQ ID NO: 345514 - DNA, 25 bp, Rattus norvegicus
gaggacatcattaagcccttgtgta

SEQ ID NO: 345515 - DNA, 25 bp, Rattus norvegicus
gaggacatcatttagcccttgtgta

SEQ ID NO: 345516 - DNA, 25 bp, Rattus norvegicus
gaggacatccaactggtatgttctt

SEQ ID NO: 345517 - DNA, 25 bp, Rattus norvegicus
gaggacatccaagtggtatgttctt

SEQ ID NO: 345518 - DNA, 25 bp, Rattus norvegicus
gaggacatccacattgaacccatag

SEQ ID NO: 345519 - DNA, 25 bp, Rattus norvegicus
gaggacatccactttgaacccatag

SEQ ID NO: 345520 - DNA, 25 bp, Rattus norvegicus
gaggacatccccatcatgctggtgg

SEQ ID NO: 345521 - DNA, 25 bp, Rattus norvegicus
gaggacatccccttcatgctggtgg

SEQ ID NO: 345522 - DNA, 25 bp, Rattus norvegicus
gaggacatgaggacaactccctgaa

SEQ ID NO: 345523 - DNA, 25 bp, Rattus norvegicus
gaggacatgaggactcttcctctaa

SEQ ID NO: 345524 - DNA, 25 bp, Rattus norvegicus
gaggacatgaggtcaactccctgaa

SEQ ID NO: 345525 - DNA, 25 bp, Rattus norvegicus
gaggacatgaggtctcttcctctaa

SEQ ID NO: 345526 - DNA, 25 bp, Rattus norvegicus
gaggacatgagtccatgaccttttt

SEQ ID NO: 345527 - DNA, 25 bp, Rattus norvegicus
gaggacatgagtgcatgaccttttt

SEQ ID NO: 345528 - DNA, 25 bp, Rattus norvegicus
gaggacatgcctcatatcgaccgaa

SEQ ID NO: 345529 - DNA, 25 bp, Rattus norvegicus
gaggacatgcctgatatcgaccgaa

SEQ ID NO: 345530 - DNA, 25 bp, Rattus norvegicus
gaggacatggagaccctagcaccaa

SEQ ID NO: 345531 - DNA, 25 bp, Rattus norvegicus
gaggacatggagtccctagcaccaa

SEQ ID NO: 345532 - DNA, 25 bp, Rattus norvegicus
gaggacatggcactgcgtaacctac

SEQ ID NO: 345533 - DNA, 25 bp, Rattus norvegicus
gaggacatggcagtgcgtaacctac

SEQ ID NO: 345534 - DNA, 25 bp, Rattus norvegicus
gaggacatgggaatcagcattttta

SEQ ID NO: 345535 - DNA, 25 bp, Rattus norvegicus
gaggacatgggattcagcattttta

SEQ ID NO: 345536 - DNA, 25 bp, Rattus norvegicus
gaggacattaaaattcattacagat

SEQ ID NO: 345537 - DNA, 25 bp, Rattus norvegicus
gaggacattaaatttcattacagat

SEQ ID NO: 345538 - DNA, 25 bp, Rattus norvegicus
gaggacattacaccggaccagacca

SEQ ID NO: 345539 - DNA, 25 bp, Rattus norvegicus
gaggacattacagcggaccagacca

SEQ ID NO: 345540 - DNA, 25 bp, Rattus norvegicus
gaggacattagaccctctggaactg

SEQ ID NO: 345541 - DNA, 25 bp, Rattus norvegicus
gaggacattagagcctctggaactg

SEQ ID NO: 345542 - DNA, 25 bp, Rattus norvegicus
gaggacattcaacttccttgtggaa

SEQ ID NO: 345543 - DNA, 25 bp, Rattus norvegicus
gaggacattcaagttccttgtggaa

SEQ ID NO: 345544 - DNA, 25 bp, Rattus norvegicus
gaggacattgatacctccatgtatg

SEQ ID NO: 345545 - DNA, 25 bp, Rattus norvegicus
gaggacattgattcctccatgtatg

SEQ ID NO: 345546 - DNA, 25 bp, Rattus norvegicus
gaggacattgtaccttcaactagaa

SEQ ID NO: 345547 - DNA, 25 bp, Rattus norvegicus
gaggacattgtagcttcaactagaa

SEQ ID NO: 345548 - DNA, 25 bp, Rattus norvegicus
gaggacatttaccagctgctttaca

SEQ ID NO: 345549 - DNA, 25 bp, Rattus norvegicus
gaggacatttacctgtctcgagcct

SEQ ID NO: 345550 - DNA, 25 bp, Rattus norvegicus
gaggacatttacgagctgctttaca

SEQ ID NO: 345551 - DNA, 25 bp, Rattus norvegicus
gaggacatttacgtgtctcgagcct

SEQ ID NO: 345552 - DNA, 25 bp, Rattus norvegicus
gaggacatttgacctcttgattaat

SEQ ID NO: 345553 - DNA, 25 bp, Rattus norvegicus
gaggacatttgagctcttgattaat

SEQ ID NO: 345554 - DNA, 25 bp, Rattus norvegicus
gaggacatttgtatcacttagcttt

SEQ ID NO: 345555 - DNA, 25 bp, Rattus norvegicus
gaggacatttgtttcacttagcttt

SEQ ID NO: 345556 - DNA, 25 bp, Rattus norvegicus
gaggaccaaaatacagctttcagca

SEQ ID NO: 345557 - DNA, 25 bp, Rattus norvegicus
gaggaccaaaattcagctttcagca

SEQ ID NO: 345558 - DNA, 25 bp, Rattus norvegicus
gaggaccaaacacactccagcacag

SEQ ID NO: 345559 - DNA, 25 bp, Rattus norvegicus
gaggaccaaacagactccagcacag

SEQ ID NO: 345560 - DNA, 25 bp, Rattus norvegicus
gaggaccaaagaccaggcccagacc

SEQ ID NO: 345561 - DNA, 25 bp, Rattus norvegicus
gaggaccaaagagcaggcccagacc

SEQ ID NO: 345562 - DNA, 25 bp, Rattus norvegicus
gaggaccaacttccagtattgctgt

SEQ ID NO: 345563 - DNA, 25 bp, Rattus norvegicus
gaggaccaacttgcagtattgctgt

SEQ ID NO: 345564 - DNA, 25 bp, Rattus norvegicus
gaggaccacaccaatgagggcttga

SEQ ID NO: 345565 - DNA, 25 bp, Rattus norvegicus
gaggaccacacctatgagggcttga

SEQ ID NO: 345566 - DNA, 25 bp, Rattus norvegicus
gaggaccacatgaacatcgctaagg

SEQ ID NO: 345567 - DNA, 25 bp, Rattus norvegicus
gaggaccacatgtacatcgctaagg

SEQ ID NO: 345568 - DNA, 25 bp, Rattus norvegicus
gaggaccaccacagacgaggagctg

SEQ ID NO: 345569 - DNA, 25 bp, Rattus norvegicus
gaggaccaccactgacgaggagctg

SEQ ID NO: 345570 - DNA, 25 bp, Rattus norvegicus
gaggaccaccatatgctcataagaa

SEQ ID NO: 345571 - DNA, 25 bp, Rattus norvegicus
gaggaccaccatttgctcataagaa

SEQ ID NO: 345572 - DNA, 25 bp, Rattus norvegicus
gaggaccacccgagccagaagtgtg

SEQ ID NO: 345573 - DNA, 25 bp, Rattus norvegicus
gaggaccacccgtgccagaagtgtg

SEQ ID NO: 345574 - DNA, 25 bp, Rattus norvegicus
gaggaccacgtcaccatgggaggat

SEQ ID NO: 345575 - DNA, 25 bp, Rattus norvegicus
gaggaccacgtctccatgggaggat

SEQ ID NO: 345576 - DNA, 25 bp, Rattus norvegicus
gaggaccactgcactagcgcattta

SEQ ID NO: 345577 - DNA, 25 bp, Rattus norvegicus
gaggaccactgctctagcgcattta

SEQ ID NO: 345578 - DNA, 25 bp, Rattus norvegicus
gaggaccagatcctcattccggtac

SEQ ID NO: 345579 - DNA, 25 bp, Rattus norvegicus
gaggaccagatcgtcattccggtac

SEQ ID NO: 345580 - DNA, 25 bp, Rattus norvegicus
gaggaccagatgaatgaacaccgga

SEQ ID NO: 345581 - DNA, 25 bp, Rattus norvegicus
gaggaccagatgtatgaacaccgga

SEQ ID NO: 345582 - DNA, 25 bp, Rattus norvegicus
gaggaccaggaaagcgaaaaaattt

SEQ ID NO: 345583 - DNA, 25 bp, Rattus norvegicus
gaggaccaggaatgcgaaaaaattt

SEQ ID NO: 345584 - DNA, 25 bp, Rattus norvegicus
gaggaccaggacactgtagctgaga

SEQ ID NO: 345585 - DNA, 25 bp, Rattus norvegicus
gaggaccaggactctgtagctgaga

SEQ ID NO: 345586 - DNA, 25 bp, Rattus norvegicus
gaggaccagggcactgtttccagca

SEQ ID NO: 345587 - DNA, 25 bp, Rattus norvegicus
gaggaccagggctctgtttccagca

SEQ ID NO: 345588 - DNA, 25 bp, Rattus norvegicus
gaggaccagtctctggatctgcaaa

SEQ ID NO: 345589 - DNA, 25 bp, Rattus norvegicus
gaggaccagtctgtggatctgcaaa

SEQ ID NO: 345590 - DNA, 25 bp, Rattus norvegicus
gaggaccagttccaccatatgaatc

SEQ ID NO: 345591 - DNA, 25 bp, Rattus norvegicus
gaggaccagttcgaccatatgaatc

SEQ ID NO: 345592 - DNA, 25 bp, Rattus norvegicus
gaggaccatactatgactcagaaat

SEQ ID NO: 345593 - DNA, 25 bp, Rattus norvegicus
gaggaccatactttgactcagaaat

SEQ ID NO: 345594 - DNA, 25 bp, Rattus norvegicus
gaggaccatatgacgtggccaactt

SEQ ID NO: 345595 - DNA, 25 bp, Rattus norvegicus
gaggaccatatgtcgtggccaactt

SEQ ID NO: 345596 - DNA, 25 bp, Rattus norvegicus
gaggaccatggtcgcaccgttgtca

SEQ ID NO: 345597 - DNA, 25 bp, Rattus norvegicus
gaggaccatggtggcaccgttgtca

SEQ ID NO: 345598 - DNA, 25 bp, Rattus norvegicus
gaggaccattcactgctggtgaact

SEQ ID NO: 345599 - DNA, 25 bp, Rattus norvegicus
gaggaccattcagtgctggtgaact

SEQ ID NO: 345600 - DNA, 25 bp, Rattus norvegicus
gaggacccaaatcctttggtccctg

SEQ ID NO: 345601 - DNA, 25 bp, Rattus norvegicus
gaggacccaaatgctttggtccctg

SEQ ID NO: 345602 - DNA, 25 bp, Rattus norvegicus
gaggacccaagaagaaaacccagta

SEQ ID NO: 345603 - DNA, 25 bp, Rattus norvegicus
gaggacccaagatgaaaacccagta

SEQ ID NO: 345604 - DNA, 25 bp, Rattus norvegicus
gaggacccaaggacagttcccaata

SEQ ID NO: 345605 - DNA, 25 bp, Rattus norvegicus
gaggacccaaggtcagttcccaata

SEQ ID NO: 345606 - DNA, 25 bp, Rattus norvegicus
gaggacccacatatggctcgtatgt

SEQ ID NO: 345607 - DNA, 25 bp, Rattus norvegicus
gaggacccacatttggctcgtatgt

SEQ ID NO: 345608 - DNA, 25 bp, Rattus norvegicus
gaggacccagaaataagccccagat

SEQ ID NO: 345609 - DNA, 25 bp, Rattus norvegicus
gaggacccagaattaagccccagat

SEQ ID NO: 345610 - DNA, 25 bp, Rattus norvegicus
gaggacccaggaactccaagcttct

SEQ ID NO: 345611 - DNA, 25 bp, Rattus norvegicus
gaggacccaggatctccaagcttct

SEQ ID NO: 345612 - DNA, 25 bp, Rattus norvegicus
gaggacccagtactcacgtgaccag

SEQ ID NO: 345613 - DNA, 25 bp, Rattus norvegicus
gaggacccagtagtcacgtgaccag

SEQ ID NO: 345614 - DNA, 25 bp, Rattus norvegicus
gaggacccatatcctcaactatatc

SEQ ID NO: 345615 - DNA, 25 bp, Rattus norvegicus
gaggacccatatgctcaactatatc

SEQ ID NO: 345616 - DNA, 25 bp, Rattus norvegicus
gaggaccccagacaacttcagctga

SEQ ID NO: 345617 - DNA, 25 bp, Rattus norvegicus
gaggaccccagagaacttcagctga

SEQ ID NO: 345618 - DNA, 25 bp, Rattus norvegicus
gaggaccccagtacatttcccagaa

SEQ ID NO: 345619 - DNA, 25 bp, Rattus norvegicus
gaggaccccagttcatttcccagaa

SEQ ID NO: 345620 - DNA, 25 bp, Rattus norvegicus
gaggacccctgcatgggccctagga

SEQ ID NO: 345621 - DNA, 25 bp, Rattus norvegicus
gaggacccctgccttttaagaggca

SEQ ID NO: 345622 - DNA, 25 bp, Rattus norvegicus
gaggacccctgcgttttaagaggca

SEQ ID NO: 345623 - DNA, 25 bp, Rattus norvegicus
gaggacccctgcttgggccctagga

SEQ ID NO: 345624 - DNA, 25 bp, Rattus norvegicus
gaggacccgagtatgtgcactgtct

SEQ ID NO: 345625 - DNA, 25 bp, Rattus norvegicus
gaggacccgagtttgtgcactgtct

SEQ ID NO: 345626 - DNA, 25 bp, Rattus norvegicus
gaggaccctcagattgactgcagtg

SEQ ID NO: 345627 - DNA, 25 bp, Rattus norvegicus
gaggaccctcagtttgactgcagtg

SEQ ID NO: 345628 - DNA, 25 bp, Rattus norvegicus
gaggaccctggaaagtatatgttat

SEQ ID NO: 345629 - DNA, 25 bp, Rattus norvegicus
gaggaccctggatagtatatgttat

SEQ ID NO: 345630 - DNA, 25 bp, Rattus norvegicus
gaggaccctggcagcccagatgcag

SEQ ID NO: 345631 - DNA, 25 bp, Rattus norvegicus
gaggaccctggctgcccagatgcag

SEQ ID NO: 345632 - DNA, 25 bp, Rattus norvegicus
gaggacccttttcctctaaggacat

SEQ ID NO: 345633 - DNA, 25 bp, Rattus norvegicus
gaggacccttttgctctaaggacat

SEQ ID NO: 345634 - DNA, 25 bp, Rattus norvegicus
gaggaccgcaacacagccttggaaa

SEQ ID NO: 345635 - DNA, 25 bp, Rattus norvegicus
gaggaccgcaactcagccttggaaa

SEQ ID NO: 345636 - DNA, 25 bp, Rattus norvegicus
gaggaccgctacaaagttaaagcca

SEQ ID NO: 345637 - DNA, 25 bp, Rattus norvegicus
gaggaccgctactaagttaaagcca

SEQ ID NO: 345638 - DNA, 25 bp, Rattus norvegicus
gaggaccggattcctggcgcattcc

SEQ ID NO: 345639 - DNA, 25 bp, Rattus norvegicus
gaggaccggattgctggcgcattcc

SEQ ID NO: 345640 - DNA, 25 bp, Rattus norvegicus
gaggacctaaatctgcccaacgccg

SEQ ID NO: 345641 - DNA, 25 bp, Rattus norvegicus
gaggacctaaatgtgcccaacgccg

SEQ ID NO: 345642 - DNA, 25 bp, Rattus norvegicus
gaggacctactgacagagttcggac

SEQ ID NO: 345643 - DNA, 25 bp, Rattus norvegicus
gaggacctactgtcagagttcggac

SEQ ID NO: 345644 - DNA, 25 bp, Rattus norvegicus
gaggacctagcacaactcattagaa

SEQ ID NO: 345645 - DNA, 25 bp, Rattus norvegicus
gaggacctagcagaactcattagaa

SEQ ID NO: 345646 - DNA, 25 bp, Rattus norvegicus
gaggacctaggaacgtagctcagtg

SEQ ID NO: 345647 - DNA, 25 bp, Rattus norvegicus
gaggacctaggatcgtagctcagtg

SEQ ID NO: 345648 - DNA, 25 bp, Rattus norvegicus
gaggacctagttactctgaagtcag

SEQ ID NO: 345649 - DNA, 25 bp, Rattus norvegicus
gaggacctagtttctctgaagtcag

SEQ ID NO: 345650 - DNA, 25 bp, Rattus norvegicus
gaggacctcaagacagtgatccaaa

SEQ ID NO: 345651 - DNA, 25 bp, Rattus norvegicus
gaggacctcaagtcagtgatccaaa

SEQ ID NO: 345652 - DNA, 25 bp, Rattus norvegicus
gaggacctcagaaaggagctctatg

SEQ ID NO: 345653 - DNA, 25 bp, Rattus norvegicus
gaggacctcagaattacttgtaaac

SEQ ID NO: 345654 - DNA, 25 bp, Rattus norvegicus
gaggacctcagataggagctctatg

SEQ ID NO: 345655 - DNA, 25 bp, Rattus norvegicus
gaggacctcagatttacttgtaaac

SEQ ID NO: 345656 - DNA, 25 bp, Rattus norvegicus
gaggacctcatgcaggacctgttaa

SEQ ID NO: 345657 - DNA, 25 bp, Rattus norvegicus
gaggacctcatggaggacctgttaa

SEQ ID NO: 345658 - DNA, 25 bp, Rattus norvegicus
gaggacctcctaaccagtcctggga

SEQ ID NO: 345659 - DNA, 25 bp, Rattus norvegicus
gaggacctcctatccagtcctggga

SEQ ID NO: 345660 - DNA, 25 bp, Rattus norvegicus
gaggacctctggactgcaaggttga

SEQ ID NO: 345661 - DNA, 25 bp, Rattus norvegicus
gaggacctctggtctgcaaggttga

SEQ ID NO: 345662 - DNA, 25 bp, Rattus norvegicus
gaggacctgatgataggcttaatta

SEQ ID NO: 345663 - DNA, 25 bp, Rattus norvegicus
gaggacctgatgttaggcttaatta

SEQ ID NO: 345664 - DNA, 25 bp, Rattus norvegicus
gaggacctgcctctcatgtctgagg

SEQ ID NO: 345665 - DNA, 25 bp, Rattus norvegicus
gaggacctgcctgtcatgtctgagg

SEQ ID NO: 345666 - DNA, 25 bp, Rattus norvegicus
gaggacctgcgccatagtctgatgc

SEQ ID NO: 345667 - DNA, 25 bp, Rattus norvegicus
gaggacctgcgcgatagtctgatgc

SEQ ID NO: 345668 - DNA, 25 bp, Rattus norvegicus
gaggacctgcttacaatggcatgta

SEQ ID NO: 345669 - DNA, 25 bp, Rattus norvegicus
gaggacctgctttcaatggcatgta

SEQ ID NO: 345670 - DNA, 25 bp, Rattus norvegicus
gaggacctggagctgttcaatacat

SEQ ID NO: 345671 - DNA, 25 bp, Rattus norvegicus
gaggacctggaggtgttcaatacat

SEQ ID NO: 345672 - DNA, 25 bp, Rattus norvegicus
gaggacctggctcaggctacagaat

SEQ ID NO: 345673 - DNA, 25 bp, Rattus norvegicus
gaggacctggctgaggctacagaat

SEQ ID NO: 345674 - DNA, 25 bp, Rattus norvegicus
gaggacctgtccacattggatcctg

SEQ ID NO: 345675 - DNA, 25 bp, Rattus norvegicus
gaggacctgtcctcattggatcctg

SEQ ID NO: 345676 - DNA, 25 bp, Rattus norvegicus
gaggacctgtgcaccaagtttggca

SEQ ID NO: 345677 - DNA, 25 bp, Rattus norvegicus
gaggacctgtgctccaagtttggca

SEQ ID NO: 345678 - DNA, 25 bp, Rattus norvegicus
gaggacctgttcacacttgtaactt

SEQ ID NO: 345679 - DNA, 25 bp, Rattus norvegicus
gaggacctgttctcacttgtaactt

SEQ ID NO: 345680 - DNA, 25 bp, Rattus norvegicus
gaggaccttgacattttgctacagt

SEQ ID NO: 345681 - DNA, 25 bp, Rattus norvegicus
gaggaccttgactttttgctacagt

SEQ ID NO: 345682 - DNA, 25 bp, Rattus norvegicus
gaggaccttgagatctccaatcatg

SEQ ID NO: 345683 - DNA, 25 bp, Rattus norvegicus
gaggaccttgagttctccaatcatg

SEQ ID NO: 345684 - DNA, 25 bp, Rattus norvegicus
gaggaccttgtcaaaccgtacgttg

SEQ ID NO: 345685 - DNA, 25 bp, Rattus norvegicus
gaggaccttgtctaaccgtacgttg

SEQ ID NO: 345686 - DNA, 25 bp, Rattus norvegicus
gaggacctttacactggcagtgacc

SEQ ID NO: 345687 - DNA, 25 bp, Rattus norvegicus
gaggacctttactctggcagtgacc

SEQ ID NO: 345688 - DNA, 25 bp, Rattus norvegicus
gaggacctttgtagggatcacagca

SEQ ID NO: 345689 - DNA, 25 bp, Rattus norvegicus
gaggacctttgttgggatcacagca

SEQ ID NO: 345690 - DNA, 25 bp, Rattus norvegicus
gaggaccttttgcattctcttcaga

SEQ ID NO: 345691 - DNA, 25 bp, Rattus norvegicus
gaggaccttttggattctcttcaga

SEQ ID NO: 345692 - DNA, 25 bp, Rattus norvegicus
gaggacgacacgctcccaacacgag

SEQ ID NO: 345693 - DNA, 25 bp, Rattus norvegicus
gaggacgacacggtcccaacacgag

SEQ ID NO: 345694 - DNA, 25 bp, Rattus norvegicus
gaggacgacatacacacgatgccaa

SEQ ID NO: 345695 - DNA, 25 bp, Rattus norvegicus
gaggacgacatagacacgatgccaa

SEQ ID NO: 345696 - DNA, 25 bp, Rattus norvegicus
gaggacgacattccttcctaagtta

SEQ ID NO: 345697 - DNA, 25 bp, Rattus norvegicus
gaggacgacattgcttcctaagtta

SEQ ID NO: 345698 - DNA, 25 bp, Rattus norvegicus
gaggacgaccctcgaatctcggagc

SEQ ID NO: 345699 - DNA, 25 bp, Rattus norvegicus
gaggacgaccctggaatctcggagc

SEQ ID NO: 345700 - DNA, 25 bp, Rattus norvegicus
gaggacgaccttctgaagtttgaca

SEQ ID NO: 345701 - DNA, 25 bp, Rattus norvegicus
gaggacgaccttgtgaagtttgaca

SEQ ID NO: 345702 - DNA, 25 bp, Rattus norvegicus
gaggacgacgtgctcttgcacatgc

SEQ ID NO: 345703 - DNA, 25 bp, Rattus norvegicus
gaggacgacgtggtcttgcacatgc

SEQ ID NO: 345704 - DNA, 25 bp, Rattus norvegicus
gaggacgacttcagactgcttgaga

SEQ ID NO: 345705 - DNA, 25 bp, Rattus norvegicus
gaggacgacttctgactgcttgaga

SEQ ID NO: 345706 - DNA, 25 bp, Rattus norvegicus
gaggacgactttcaataccctggtt

SEQ ID NO: 345707 - DNA, 25 bp, Rattus norvegicus
gaggacgactttgaataccctggtt

SEQ ID NO: 345708 - DNA, 25 bp, Rattus norvegicus
gaggacgaggtcaccttccaggatg

SEQ ID NO: 345709 - DNA, 25 bp, Rattus norvegicus
gaggacgaggtctccttccaggatg

SEQ ID NO: 345710 - DNA, 25 bp, Rattus norvegicus
gaggacgcacctagttttactgtag

SEQ ID NO: 345711 - DNA, 25 bp, Rattus norvegicus
gaggacgcaccttgttttactgtag

SEQ ID NO: 345712 - DNA, 25 bp, Rattus norvegicus
gaggacgcagctagcatcgcctaca

SEQ ID NO: 345713 - DNA, 25 bp, Rattus norvegicus
gaggacgcagcttgcatcgcctaca

SEQ ID NO: 345714 - DNA, 25 bp, Rattus norvegicus
gaggacgcccatctgtaggtttttg

SEQ ID NO: 345715 - DNA, 25 bp, Rattus norvegicus
gaggacgcccatgtgtaggtttttg

SEQ ID NO: 345716 - DNA, 25 bp, Rattus norvegicus
gaggacgccttcatcaacatcaaat

SEQ ID NO: 345717 - DNA, 25 bp, Rattus norvegicus
gaggacgccttcttcaacatcaaat

SEQ ID NO: 345718 - DNA, 25 bp, Rattus norvegicus
gaggacgctgcacaggactatgcca

SEQ ID NO: 345719 - DNA, 25 bp, Rattus norvegicus
gaggacgctgcagaggactatgcca

SEQ ID NO: 345720 - DNA, 25 bp, Rattus norvegicus
gaggacgctggaaccttggaactaa

SEQ ID NO: 345721 - DNA, 25 bp, Rattus norvegicus
gaggacgctggatccttggaactaa

SEQ ID NO: 345722 - DNA, 25 bp, Rattus norvegicus
gaggacgctggtacaattcccaaac

SEQ ID NO: 345723 - DNA, 25 bp, Rattus norvegicus
gaggacgctggttcaattcccaaac

SEQ ID NO: 345724 - DNA, 25 bp, Rattus norvegicus
gaggacggactgagacactgccttc

SEQ ID NO: 345725 - DNA, 25 bp, Rattus norvegicus
gaggacggactgtgacactgccttc

SEQ ID NO: 345726 - DNA, 25 bp, Rattus norvegicus
gaggacggctaaccagtgaacccca

SEQ ID NO: 345727 - DNA, 25 bp, Rattus norvegicus
gaggacggctaagcagtgaacccca

SEQ ID NO: 345728 - DNA, 25 bp, Rattus norvegicus
gaggacgggcccaacgcctgacacg

SEQ ID NO: 345729 - DNA, 25 bp, Rattus norvegicus
gaggacgggccctacgcctgacacg

SEQ ID NO: 345730 - DNA, 25 bp, Rattus norvegicus
gaggacggtcatatctgatcctttt

SEQ ID NO: 345731 - DNA, 25 bp, Rattus norvegicus
gaggacggtcatttctgatcctttt

SEQ ID NO: 345732 - DNA, 25 bp, Rattus norvegicus
gaggacgtctctcctcaactctgag

SEQ ID NO: 345733 - DNA, 25 bp, Rattus norvegicus
gaggacgtctctgctcaactctgag

SEQ ID NO: 345734 - DNA, 25 bp, Rattus norvegicus
gaggacgtcttactgctgtggctac

SEQ ID NO: 345735 - DNA, 25 bp, Rattus norvegicus
gaggacgtcttagtgctgtggctac

SEQ ID NO: 345736 - DNA, 25 bp, Rattus norvegicus
gaggacgtgaatacattcgggccga

SEQ ID NO: 345737 - DNA, 25 bp, Rattus norvegicus
gaggacgtgaattcattcgggccga

SEQ ID NO: 345738 - DNA, 25 bp, Rattus norvegicus
gaggacgtggttaacaggctaccca

SEQ ID NO: 345739 - DNA, 25 bp, Rattus norvegicus
gaggacgtggtttacaggctaccca

SEQ ID NO: 345740 - DNA, 25 bp, Rattus norvegicus
gaggacgttaccatgttacaaaaca

SEQ ID NO: 345741 - DNA, 25 bp, Rattus norvegicus
gaggacgttaccttgttacaaaaca

SEQ ID NO: 345742 - DNA, 25 bp, Rattus norvegicus
gaggacgttcatacacgctttcaaa

SEQ ID NO: 345743 - DNA, 25 bp, Rattus norvegicus
gaggacgttcattcacgctttcaaa

SEQ ID NO: 345744 - DNA, 25 bp, Rattus norvegicus
gaggactacaaacccctgcagaagt

SEQ ID NO: 345745 - DNA, 25 bp, Rattus norvegicus
gaggactacaaagccctgcagaagt

SEQ ID NO: 345746 - DNA, 25 bp, Rattus norvegicus
gaggactacctccatgatgaagact

SEQ ID NO: 345747 - DNA, 25 bp, Rattus norvegicus
gaggactacctcgatgatgaagact

SEQ ID NO: 345748 - DNA, 25 bp, Rattus norvegicus
gaggactactaacttgcctgcatct

SEQ ID NO: 345749 - DNA, 25 bp, Rattus norvegicus
gaggactactaagttgcctgcatct

SEQ ID NO: 345750 - DNA, 25 bp, Rattus norvegicus
gaggactactttacgtccacggagc

SEQ ID NO: 345751 - DNA, 25 bp, Rattus norvegicus
gaggactactttccagagttcgctc

SEQ ID NO: 345752 - DNA, 25 bp, Rattus norvegicus
gaggactactttgcagagttcgctc

SEQ ID NO: 345753 - DNA, 25 bp, Rattus norvegicus
gaggactacttttcgtccacggagc

SEQ ID NO: 345754 - DNA, 25 bp, Rattus norvegicus
gaggactagtggatttctgtcttca

SEQ ID NO: 345755 - DNA, 25 bp, Rattus norvegicus
gaggactagtggttttctgtcttca

SEQ ID NO: 345756 - DNA, 25 bp, Rattus norvegicus
gaggactatcagaactaggacacta

SEQ ID NO: 345757 - DNA, 25 bp, Rattus norvegicus
gaggactatcagtactaggacacta

SEQ ID NO: 345758 - DNA, 25 bp, Rattus norvegicus
gaggactatgaactcattagcacca

SEQ ID NO: 345759 - DNA, 25 bp, Rattus norvegicus
gaggactatgaagtcattagcacca

SEQ ID NO: 345760 - DNA, 25 bp, Rattus norvegicus
gaggactatggcctttactggcccc

SEQ ID NO: 345761 - DNA, 25 bp, Rattus norvegicus
gaggactatggcgtttactggcccc

SEQ ID NO: 345762 - DNA, 25 bp, Rattus norvegicus
gaggactatttcactatcaagtgta

SEQ ID NO: 345763 - DNA, 25 bp, Rattus norvegicus
gaggactatttctctatcaagtgta

SEQ ID NO: 345764 - DNA, 25 bp, Rattus norvegicus
gaggactatttgagcccaaggacat

SEQ ID NO: 345765 - DNA, 25 bp, Rattus norvegicus
gaggactatttgtgcccaaggacat

SEQ ID NO: 345766 - DNA, 25 bp, Rattus norvegicus
gaggactcaagtatctttgctgtca

SEQ ID NO: 345767 - DNA, 25 bp, Rattus norvegicus
gaggactcaagtttctttgctgtca

SEQ ID NO: 345768 - DNA, 25 bp, Rattus norvegicus
gaggactcacgacgccaagctgaag

SEQ ID NO: 345769 - DNA, 25 bp, Rattus norvegicus
gaggactcacgaggccaagctgaag

SEQ ID NO: 345770 - DNA, 25 bp, Rattus norvegicus
gaggactcacgtaaccgattttcat

SEQ ID NO: 345771 - DNA, 25 bp, Rattus norvegicus
gaggactcacgttaccgattttcat

SEQ ID NO: 345772 - DNA, 25 bp, Rattus norvegicus
gaggactcagacaaaccctttggga

SEQ ID NO: 345773 - DNA, 25 bp, Rattus norvegicus
gaggactcagactaaccctttggga

SEQ ID NO: 345774 - DNA, 25 bp, Rattus norvegicus
gaggactcaggaacttactgggttt

SEQ ID NO: 345775 - DNA, 25 bp, Rattus norvegicus
gaggactcaggatcttactgggttt

SEQ ID NO: 345776 - DNA, 25 bp, Rattus norvegicus
gaggactcaggcagacatctgggat

SEQ ID NO: 345777 - DNA, 25 bp, Rattus norvegicus
gaggactcaggcaggcgatccacgc

SEQ ID NO: 345778 - DNA, 25 bp, Rattus norvegicus
gaggactcaggctgacatctgggat

SEQ ID NO: 345779 - DNA, 25 bp, Rattus norvegicus
gaggactcaggctggcgatccacgc

SEQ ID NO: 345780 - DNA, 25 bp, Rattus norvegicus
gaggactcaggtatgggccccagca

SEQ ID NO: 345781 - DNA, 25 bp, Rattus norvegicus
gaggactcaggtttgggccccagca

SEQ ID NO: 345782 - DNA, 25 bp, Rattus norvegicus
gaggactcatgtatacacccaccgt

SEQ ID NO: 345783 - DNA, 25 bp, Rattus norvegicus
gaggactcatgtttacacccaccgt

SEQ ID NO: 345784 - DNA, 25 bp, Rattus norvegicus
gaggactccacactagacatttcag

SEQ ID NO: 345785 - DNA, 25 bp, Rattus norvegicus
gaggactccacagtagacatttcag

SEQ ID NO: 345786 - DNA, 25 bp, Rattus norvegicus
gaggactccactatatagcctaaac

SEQ ID NO: 345787 - DNA, 25 bp, Rattus norvegicus
gaggactccactttatagcctaaac

SEQ ID NO: 345788 - DNA, 25 bp, Rattus norvegicus
gaggactccagtaacatcaatgcca

SEQ ID NO: 345789 - DNA, 25 bp, Rattus norvegicus
gaggactccagtatatgtcaagttg

SEQ ID NO: 345790 - DNA, 25 bp, Rattus norvegicus
gaggactccagttacatcaatgcca

SEQ ID NO: 345791 - DNA, 25 bp, Rattus norvegicus
gaggactccagtttatgtcaagttg

SEQ ID NO: 345792 - DNA, 25 bp, Rattus norvegicus
gaggactccatgcagcaatggcaga

SEQ ID NO: 345793 - DNA, 25 bp, Rattus norvegicus
gaggactccatggagcaatggcaga

SEQ ID NO: 345794 - DNA, 25 bp, Rattus norvegicus
gaggactccgatcgagatgtctcat

SEQ ID NO: 345795 - DNA, 25 bp, Rattus norvegicus
gaggactccgatggagatgtctcat

SEQ ID NO: 345796 - DNA, 25 bp, Rattus norvegicus
gaggactcctccattatgcaaagtg

SEQ ID NO: 345797 - DNA, 25 bp, Rattus norvegicus
gaggactcctcctttatgcaaagtg

SEQ ID NO: 345798 - DNA, 25 bp, Rattus norvegicus
gaggactctaagagcctacagcttt

SEQ ID NO: 345799 - DNA, 25 bp, Rattus norvegicus
gaggactctaagtgcctacagcttt

SEQ ID NO: 345800 - DNA, 25 bp, Rattus norvegicus
gaggactctgacacctggcaagctc

SEQ ID NO: 345801 - DNA, 25 bp, Rattus norvegicus
gaggactctgactcctggcaagctc

SEQ ID NO: 345802 - DNA, 25 bp, Rattus norvegicus
gaggactctggccaagagccatcta

SEQ ID NO: 345803 - DNA, 25 bp, Rattus norvegicus
gaggactctggcgaagagccatcta

SEQ ID NO: 345804 - DNA, 25 bp, Rattus norvegicus
gaggactctgggattaatgccaatt

SEQ ID NO: 345805 - DNA, 25 bp, Rattus norvegicus
gaggactctgggtttaatgccaatt

SEQ ID NO: 345806 - DNA, 25 bp, Rattus norvegicus
gaggactcttaaacttttgcaattc

SEQ ID NO: 345807 - DNA, 25 bp, Rattus norvegicus
gaggactcttaatcttttgcaattc

SEQ ID NO: 345808 - DNA, 25 bp, Rattus norvegicus
gaggactcttataaggttgtcagat

SEQ ID NO: 345809 - DNA, 25 bp, Rattus norvegicus
gaggactcttattaggttgtcagat

SEQ ID NO: 345810 - DNA, 25 bp, Rattus norvegicus
gaggactcttcactacggtggtgat

SEQ ID NO: 345811 - DNA, 25 bp, Rattus norvegicus
gaggactcttcagtacggtggtgat

SEQ ID NO: 345812 - DNA, 25 bp, Rattus norvegicus
gaggactcttcgagacattgagact

SEQ ID NO: 345813 - DNA, 25 bp, Rattus norvegicus
gaggactcttcgtgacattgagact

SEQ ID NO: 345814 - DNA, 25 bp, Rattus norvegicus
gaggactcttggacttaggcacact

SEQ ID NO: 345815 - DNA, 25 bp, Rattus norvegicus
gaggactcttggtcttaggcacact

SEQ ID NO: 345816 - DNA, 25 bp, Rattus norvegicus
gaggactgaagtacaatccacagga

SEQ ID NO: 345817 - DNA, 25 bp, Rattus norvegicus
gaggactgaagttcaatccacagga

SEQ ID NO: 345818 - DNA, 25 bp, Rattus norvegicus
gaggactgaatgctagcccaagcca

SEQ ID NO: 345819 - DNA, 25 bp, Rattus norvegicus
gaggactgaatggtagcccaagcca

SEQ ID NO: 345820 - DNA, 25 bp, Rattus norvegicus
gaggactgacagcacatttggtatt

SEQ ID NO: 345821 - DNA, 25 bp, Rattus norvegicus
gaggactgacaggacatttggtatt

SEQ ID NO: 345822 - DNA, 25 bp, Rattus norvegicus
gaggactgaggactttcttgccacg

SEQ ID NO: 345823 - DNA, 25 bp, Rattus norvegicus
gaggactgaggagtttcttgccacg

SEQ ID NO: 345824 - DNA, 25 bp, Rattus norvegicus
gaggactgagtacctgctacaggac

SEQ ID NO: 345825 - DNA, 25 bp, Rattus norvegicus
gaggactgagtagctgctacaggac

SEQ ID NO: 345826 - DNA, 25 bp, Rattus norvegicus
gaggactgcaaactccaggagagct

SEQ ID NO: 345827 - DNA, 25 bp, Rattus norvegicus
gaggactgcaaagtccaggagagct

SEQ ID NO: 345828 - DNA, 25 bp, Rattus norvegicus
gaggactgccagctctgcgtacagt

SEQ ID NO: 345829 - DNA, 25 bp, Rattus norvegicus
gaggactgccaggtctgcgtacagt

SEQ ID NO: 345830 - DNA, 25 bp, Rattus norvegicus
gaggactgctggagattttcttttg

SEQ ID NO: 345831 - DNA, 25 bp, Rattus norvegicus
gaggactgctggtgattttcttttg

SEQ ID NO: 345832 - DNA, 25 bp, Rattus norvegicus
gaggactggaagctctcacagaatt

SEQ ID NO: 345833 - DNA, 25 bp, Rattus norvegicus
gaggactggaaggtctcacagaatt

SEQ ID NO: 345834 - DNA, 25 bp, Rattus norvegicus
gaggactggactaaagcagcggctt

SEQ ID NO: 345835 - DNA, 25 bp, Rattus norvegicus
gaggactggacttaagcagcggctt

SEQ ID NO: 345836 - DNA, 25 bp, Rattus norvegicus
gaggactggccaaagttcctgtgac

SEQ ID NO: 345837 - DNA, 25 bp, Rattus norvegicus
gaggactggccatagttcctgtgac

SEQ ID NO: 345838 - DNA, 25 bp, Rattus norvegicus
gaggactgggaactgtatgtacata

SEQ ID NO: 345839 - DNA, 25 bp, Rattus norvegicus
gaggactgggaagtgtatgtacata

SEQ ID NO: 345840 - DNA, 25 bp, Rattus norvegicus
gaggactgtcacctatttgccacaa

SEQ ID NO: 345841 - DNA, 25 bp, Rattus norvegicus
gaggactgtcacgtatttgccacaa

SEQ ID NO: 345842 - DNA, 25 bp, Rattus norvegicus
gaggactgtcgtctgagttctatat

SEQ ID NO: 345843 - DNA, 25 bp, Rattus norvegicus
gaggactgtcgtgtgagttctatat

SEQ ID NO: 345844 - DNA, 25 bp, Rattus norvegicus
gaggactgtcttatcaagatcactg

SEQ ID NO: 345845 - DNA, 25 bp, Rattus norvegicus
gaggactgtcttttcaagatcactg

SEQ ID NO: 345846 - DNA, 25 bp, Rattus norvegicus
gaggactgttaaaatccaggccggg

SEQ ID NO: 345847 - DNA, 25 bp, Rattus norvegicus
gaggactgttaaacgttcccattat

SEQ ID NO: 345848 - DNA, 25 bp, Rattus norvegicus
gaggactgttaatatccaggccggg

SEQ ID NO: 345849 - DNA, 25 bp, Rattus norvegicus
gaggactgttaatcgttcccattat

SEQ ID NO: 345850 - DNA, 25 bp, Rattus norvegicus
gaggactgttacagaagctgtctat

SEQ ID NO: 345851 - DNA, 25 bp, Rattus norvegicus
gaggactgttactgaagctgtctat

SEQ ID NO: 345852 - DNA, 25 bp, Rattus norvegicus
gaggactgttttactggttgtttct

SEQ ID NO: 345853 - DNA, 25 bp, Rattus norvegicus
gaggactgtttttctggttgtttct

SEQ ID NO: 345854 - DNA, 25 bp, Rattus norvegicus
gaggacttaaacctctataactcca

SEQ ID NO: 345855 - DNA, 25 bp, Rattus norvegicus
gaggacttaaacgtctataactcca

SEQ ID NO: 345856 - DNA, 25 bp, Rattus norvegicus
gaggacttaattcagcggatggcaa

SEQ ID NO: 345857 - DNA, 25 bp, Rattus norvegicus
gaggacttaattgagcggatggcaa

SEQ ID NO: 345858 - DNA, 25 bp, Rattus norvegicus
gaggacttacgacaatgcctcaagt

SEQ ID NO: 345859 - DNA, 25 bp, Rattus norvegicus
gaggacttacgagaatgcctcaagt

SEQ ID NO: 345860 - DNA, 25 bp, Rattus norvegicus
gaggacttactcagctagtgtctaa

SEQ ID NO: 345861 - DNA, 25 bp, Rattus norvegicus
gaggacttactctgctagtgtctaa

SEQ ID NO: 345862 - DNA, 25 bp, Rattus norvegicus
gaggacttcattagaaactaaggca

SEQ ID NO: 345863 - DNA, 25 bp, Rattus norvegicus
gaggacttcattctgatcatttcta

SEQ ID NO: 345864 - DNA, 25 bp, Rattus norvegicus
gaggacttcattgtgatcatttcta

SEQ ID NO: 345865 - DNA, 25 bp, Rattus norvegicus
gaggacttcatttgaaactaaggca

SEQ ID NO: 345866 - DNA, 25 bp, Rattus norvegicus
gaggacttccatatacattgctgct

SEQ ID NO: 345867 - DNA, 25 bp, Rattus norvegicus
gaggacttccatcagggacagagca

SEQ ID NO: 345868 - DNA, 25 bp, Rattus norvegicus
gaggacttccatgagggacagagca

SEQ ID NO: 345869 - DNA, 25 bp, Rattus norvegicus
gaggacttccatttacattgctgct

SEQ ID NO: 345870 - DNA, 25 bp, Rattus norvegicus
gaggacttccctcggaaaggccatt

SEQ ID NO: 345871 - DNA, 25 bp, Rattus norvegicus
gaggacttccctgggaaaggccatt

SEQ ID NO: 345872 - DNA, 25 bp, Rattus norvegicus
gaggacttcctaccaattattcact

SEQ ID NO: 345873 - DNA, 25 bp, Rattus norvegicus
gaggacttcctagcaattattcact

SEQ ID NO: 345874 - DNA, 25 bp, Rattus norvegicus
gaggacttcctgactgtatcagata

SEQ ID NO: 345875 - DNA, 25 bp, Rattus norvegicus
gaggacttcctgtctgtatcagata

SEQ ID NO: 345876 - DNA, 25 bp, Rattus norvegicus
gaggacttcgtgcagatctgcaaac

SEQ ID NO: 345877 - DNA, 25 bp, Rattus norvegicus
gaggacttcgtggagatctgcaaac

SEQ ID NO: 345878 - DNA, 25 bp, Rattus norvegicus
gaggacttctcactagttgtatgca

SEQ ID NO: 345879 - DNA, 25 bp, Rattus norvegicus
gaggacttctcagtagttgtatgca

SEQ ID NO: 345880 - DNA, 25 bp, Rattus norvegicus
gaggacttcttcatggaacatgaaa

SEQ ID NO: 345881 - DNA, 25 bp, Rattus norvegicus
gaggacttcttcttggaacatgaaa

SEQ ID NO: 345882 - DNA, 25 bp, Rattus norvegicus
gaggacttctttcctaactgaaaga

SEQ ID NO: 345883 - DNA, 25 bp, Rattus norvegicus
gaggacttctttcctggactgagct

SEQ ID NO: 345884 - DNA, 25 bp, Rattus norvegicus
gaggacttctttgctaactgaaaga

SEQ ID NO: 345885 - DNA, 25 bp, Rattus norvegicus
gaggacttctttgctggactgagct

SEQ ID NO: 345886 - DNA, 25 bp, Rattus norvegicus
gaggacttgcctagcatgtataaaa

SEQ ID NO: 345887 - DNA, 25 bp, Rattus norvegicus
gaggacttgccttgcatgtataaaa

SEQ ID NO: 345888 - DNA, 25 bp, Rattus norvegicus
gaggacttgctccacttaaagagga

SEQ ID NO: 345889 - DNA, 25 bp, Rattus norvegicus
gaggacttgctcgacttaaagagga

SEQ ID NO: 345890 - DNA, 25 bp, Rattus norvegicus
gaggacttgcttagcaatcctgctg

SEQ ID NO: 345891 - DNA, 25 bp, Rattus norvegicus
gaggacttgctttgcaatcctgctg

SEQ ID NO: 345892 - DNA, 25 bp, Rattus norvegicus
gaggacttgggcaaacatcaataaa

SEQ ID NO: 345893 - DNA, 25 bp, Rattus norvegicus
gaggacttgggctaacatcaataaa

SEQ ID NO: 345894 - DNA, 25 bp, Rattus norvegicus
gaggacttggttaccatgcagacta

SEQ ID NO: 345895 - DNA, 25 bp, Rattus norvegicus
gaggacttggtttccatgcagacta

SEQ ID NO: 345896 - DNA, 25 bp, Rattus norvegicus
gaggacttgtcgcagcaagcacagt

SEQ ID NO: 345897 - DNA, 25 bp, Rattus norvegicus
gaggacttgtcggagcaagcacagt

SEQ ID NO: 345898 - DNA, 25 bp, Rattus norvegicus
gaggacttgttccagctcagtcagg

SEQ ID NO: 345899 - DNA, 25 bp, Rattus norvegicus
gaggacttgttcgagctcagtcagg

SEQ ID NO: 345900 - DNA, 25 bp, Rattus norvegicus
gaggactttaaaattcccctggatg

SEQ ID NO: 345901 - DNA, 25 bp, Rattus norvegicus
gaggactttaaatttcccctggatg

SEQ ID NO: 345902 - DNA, 25 bp, Rattus norvegicus
gaggactttccacgcatgaacatgc

SEQ ID NO: 345903 - DNA, 25 bp, Rattus norvegicus
gaggactttccaggcatgaacatgc

SEQ ID NO: 345904 - DNA, 25 bp, Rattus norvegicus
gaggactttcctcggagcagcaagt

SEQ ID NO: 345905 - DNA, 25 bp, Rattus norvegicus
gaggactttcctgggagcagcaagt

SEQ ID NO: 345906 - DNA, 25 bp, Rattus norvegicus
gaggactttgtgattttataatggg

SEQ ID NO: 345907 - DNA, 25 bp, Rattus norvegicus
gaggactttgtgtttttataatggg

SEQ ID NO: 345908 - DNA, 25 bp, Rattus norvegicus
gaggacttttctaatatgtacccag

SEQ ID NO: 345909 - DNA, 25 bp, Rattus norvegicus
gaggacttttctccagagagactct

SEQ ID NO: 345910 - DNA, 25 bp, Rattus norvegicus
gaggacttttctgcagagagactct

SEQ ID NO: 345911 - DNA, 25 bp, Rattus norvegicus
gaggacttttcttatatgtacccag

SEQ ID NO: 345912 - DNA, 25 bp, Rattus norvegicus
gaggagaaaatgagccatcccctgc

SEQ ID NO: 345913 - DNA, 25 bp, Rattus norvegicus
gaggagaaaatgcaactgtttaaat

SEQ ID NO: 345914 - DNA, 25 bp, Rattus norvegicus
gaggagaaaatggaactgtttaaat

SEQ ID NO: 345915 - DNA, 25 bp, Rattus norvegicus
gaggagaaaatgtgccatcccctgc

SEQ ID NO: 345916 - DNA, 25 bp, Rattus norvegicus
gaggagaaacacaggcaggtacagc

SEQ ID NO: 345917 - DNA, 25 bp, Rattus norvegicus
gaggagaaacactggcaggtacagc

SEQ ID NO: 345918 - DNA, 25 bp, Rattus norvegicus
gaggagaaacagcaactactggtaa

SEQ ID NO: 345919 - DNA, 25 bp, Rattus norvegicus
gaggagaaacaggaactactggtaa

SEQ ID NO: 345920 - DNA, 25 bp, Rattus norvegicus
gaggagaaacccctaccatcatgaa

SEQ ID NO: 345921 - DNA, 25 bp, Rattus norvegicus
gaggagaaacccgtaccatcatgaa

SEQ ID NO: 345922 - DNA, 25 bp, Rattus norvegicus
gaggagaaactaactcatcccgtct

SEQ ID NO: 345923 - DNA, 25 bp, Rattus norvegicus
gaggagaaactatctcatcccgtct

SEQ ID NO: 345924 - DNA, 25 bp, Rattus norvegicus
gaggagaaacttactgcctgtattt

SEQ ID NO: 345925 - DNA, 25 bp, Rattus norvegicus
gaggagaaactttctgcctgtattt

SEQ ID NO: 345926 - DNA, 25 bp, Rattus norvegicus
gaggagaacccactacccttgctgg

SEQ ID NO: 345927 - DNA, 25 bp, Rattus norvegicus
gaggagaacccagtacccttgctgg

SEQ ID NO: 345928 - DNA, 25 bp, Rattus norvegicus
gaggagaaccccaatttccacggct

SEQ ID NO: 345929 - DNA, 25 bp, Rattus norvegicus
gaggagaacccctatttccacggct

SEQ ID NO: 345930 - DNA, 25 bp, Rattus norvegicus
gaggagaaccgcatcttctacctac

SEQ ID NO: 345931 - DNA, 25 bp, Rattus norvegicus
gaggagaaccgcttcttctacctac

SEQ ID NO: 345932 - DNA, 25 bp, Rattus norvegicus
gaggagaacgccagatcattcccag

SEQ ID NO: 345933 - DNA, 25 bp, Rattus norvegicus
gaggagaacgcctgatcattcccag

SEQ ID NO: 345934 - DNA, 25 bp, Rattus norvegicus
gaggagaacggtctccccgcacctt

SEQ ID NO: 345935 - DNA, 25 bp, Rattus norvegicus
gaggagaacggtgtccccgcacctt

SEQ ID NO: 345936 - DNA, 25 bp, Rattus norvegicus
gaggagaactacctcccagcaggac

SEQ ID NO: 345937 - DNA, 25 bp, Rattus norvegicus
gaggagaactacgtcccagcaggac

SEQ ID NO: 345938 - DNA, 25 bp, Rattus norvegicus
gaggagaactctcgacacacgcatt

SEQ ID NO: 345939 - DNA, 25 bp, Rattus norvegicus
gaggagaactctggacacacgcatt

SEQ ID NO: 345940 - DNA, 25 bp, Rattus norvegicus
gaggagaagaaccaccacctccatg

SEQ ID NO: 345941 - DNA, 25 bp, Rattus norvegicus
gaggagaagaacgaccacctccatg

SEQ ID NO: 345942 - DNA, 25 bp, Rattus norvegicus
gaggagaagaagctccctccgccga

SEQ ID NO: 345943 - DNA, 25 bp, Rattus norvegicus
gaggagaagaaggtccctccgccga

SEQ ID NO: 345944 - DNA, 25 bp, Rattus norvegicus
gaggagaagaccacactcatgttca

SEQ ID NO: 345945 - DNA, 25 bp, Rattus norvegicus
gaggagaagacctcactcatgttca

SEQ ID NO: 345946 - DNA, 25 bp, Rattus norvegicus
gaggagaagcacattggcccacgcc

SEQ ID NO: 345947 - DNA, 25 bp, Rattus norvegicus
gaggagaagcactttggcccacgcc

SEQ ID NO: 345948 - DNA, 25 bp, Rattus norvegicus
gaggagaagctgaccttagtgtttg

SEQ ID NO: 345949 - DNA, 25 bp, Rattus norvegicus
gaggagaagctgtccttagtgtttg

SEQ ID NO: 345950 - DNA, 25 bp, Rattus norvegicus
gaggagaaggatcctctcacccagc

SEQ ID NO: 345951 - DNA, 25 bp, Rattus norvegicus
gaggagaaggatgctctcacccagc

SEQ ID NO: 345952 - DNA, 25 bp, Rattus norvegicus
gaggagaatgacatgcactatgcag

SEQ ID NO: 345953 - DNA, 25 bp, Rattus norvegicus
gaggagaatgaccagctgatccgct

SEQ ID NO: 345954 - DNA, 25 bp, Rattus norvegicus
gaggagaatgacgagctgatccgct

SEQ ID NO: 345955 - DNA, 25 bp, Rattus norvegicus
gaggagaatgacttgcactatgcag

SEQ ID NO: 345956 - DNA, 25 bp, Rattus norvegicus
gaggagacaaacagtccgccacact

SEQ ID NO: 345957 - DNA, 25 bp, Rattus norvegicus
gaggagacaaactgtccgccacact

SEQ ID NO: 345958 - DNA, 25 bp, Rattus norvegicus
gaggagacacgactacttctactta

SEQ ID NO: 345959 - DNA, 25 bp, Rattus norvegicus
gaggagacacgagtacttctactta

SEQ ID NO: 345960 - DNA, 25 bp, Rattus norvegicus
gaggagacaggccatgcctttcaaa

SEQ ID NO: 345961 - DNA, 25 bp, Rattus norvegicus
gaggagacaggcgatgcctttcaaa

SEQ ID NO: 345962 - DNA, 25 bp, Rattus norvegicus
gaggagacatctccactcatgcgtt

SEQ ID NO: 345963 - DNA, 25 bp, Rattus norvegicus
gaggagacatctgcactcatgcgtt

SEQ ID NO: 345964 - DNA, 25 bp, Rattus norvegicus
gaggagaccaaactacggctgtagc

SEQ ID NO: 345965 - DNA, 25 bp, Rattus norvegicus
gaggagaccaaagtacggctgtagc

SEQ ID NO: 345966 - DNA, 25 bp, Rattus norvegicus
gaggagaccacccatgaccctgaat

SEQ ID NO: 345967 - DNA, 25 bp, Rattus norvegicus
gaggagaccaccgatgaccctgaat

SEQ ID NO: 345968 - DNA, 25 bp, Rattus norvegicus
gaggagaccagtagctatcagtgaa

SEQ ID NO: 345969 - DNA, 25 bp, Rattus norvegicus
gaggagaccagttgctatcagtgaa

SEQ ID NO: 345970 - DNA, 25 bp, Rattus norvegicus
gaggagaccataagcacctgccagt

SEQ ID NO: 345971 - DNA, 25 bp, Rattus norvegicus
gaggagaccatatgcacctgccagt

SEQ ID NO: 345972 - DNA, 25 bp, Rattus norvegicus
gaggagacccaactctacggcagga

SEQ ID NO: 345973 - DNA, 25 bp, Rattus norvegicus
gaggagacccaagtctacggcagga

SEQ ID NO: 345974 - DNA, 25 bp, Rattus norvegicus
gaggagacctggacctatctgaaca

SEQ ID NO: 345975 - DNA, 25 bp, Rattus norvegicus
gaggagacctggtcctatctgaaca

SEQ ID NO: 345976 - DNA, 25 bp, Rattus norvegicus
gaggagactctgagcctttattcaa

SEQ ID NO: 345977 - DNA, 25 bp, Rattus norvegicus
gaggagactctgaggccattctaat

SEQ ID NO: 345978 - DNA, 25 bp, Rattus norvegicus
gaggagactctgtgcctttattcaa

SEQ ID NO: 345979 - DNA, 25 bp, Rattus norvegicus
gaggagactctgtggccattctaat

SEQ ID NO: 345980 - DNA, 25 bp, Rattus norvegicus
gaggagactgccagctgcggacatc

SEQ ID NO: 345981 - DNA, 25 bp, Rattus norvegicus
gaggagactgcctgctgcggacatc

SEQ ID NO: 345982 - DNA, 25 bp, Rattus norvegicus
gaggagagacaacccctgatgagca

SEQ ID NO: 345983 - DNA, 25 bp, Rattus norvegicus
gaggagagacaagccctgatgagca

SEQ ID NO: 345984 - DNA, 25 bp, Rattus norvegicus
gaggagagacagactcaccttctcc

SEQ ID NO: 345985 - DNA, 25 bp, Rattus norvegicus
gaggagagacagtctcaccttctcc

SEQ ID NO: 345986 - DNA, 25 bp, Rattus norvegicus
gaggagagcatccactggaccaaga

SEQ ID NO: 345987 - DNA, 25 bp, Rattus norvegicus
gaggagagcatcgactggaccaaga

SEQ ID NO: 345988 - DNA, 25 bp, Rattus norvegicus
gaggagagccatcatcacctttcta

SEQ ID NO: 345989 - DNA, 25 bp, Rattus norvegicus
gaggagagccatgatcacctttcta

SEQ ID NO: 345990 - DNA, 25 bp, Rattus norvegicus
gaggagagcctcaatgctataggtt

SEQ ID NO: 345991 - DNA, 25 bp, Rattus norvegicus
gaggagagcctctatgctataggtt

SEQ ID NO: 345992 - DNA, 25 bp, Rattus norvegicus
gaggagagcgaaatattttccctta

SEQ ID NO: 345993 - DNA, 25 bp, Rattus norvegicus
gaggagagcgaattattttccctta

SEQ ID NO: 345994 - DNA, 25 bp, Rattus norvegicus
gaggagagctgaatcatttcacatt

SEQ ID NO: 345995 - DNA, 25 bp, Rattus norvegicus
gaggagagctgattcatttcacatt

SEQ ID NO: 345996 - DNA, 25 bp, Rattus norvegicus
gaggagagctggacaagcacacctt

SEQ ID NO: 345997 - DNA, 25 bp, Rattus norvegicus
gaggagagctggtcaagcacacctt

SEQ ID NO: 345998 - DNA, 25 bp, Rattus norvegicus
gaggagagggcactttgctcattct

SEQ ID NO: 345999 - DNA, 25 bp, Rattus norvegicus
gaggagagggcagtttgctcattct

SEQ ID NO: 346000 - DNA, 25 bp, Rattus norvegicus
gaggagaggtcaccgtatcttcacc

SEQ ID NO: 346001 - DNA, 25 bp, Rattus norvegicus
gaggagaggtcagcgtatcttcacc

SEQ ID NO: 346002 - DNA, 25 bp, Rattus norvegicus
gaggagaggtccacagtcctgtgaa

SEQ ID NO: 346003 - DNA, 25 bp, Rattus norvegicus
gaggagaggtcctcagtcctgtgaa

SEQ ID NO: 346004 - DNA, 25 bp, Rattus norvegicus
gaggagagtcatcgatttctattaa

SEQ ID NO: 346005 - DNA, 25 bp, Rattus norvegicus
gaggagagtcatggatttctattaa

SEQ ID NO: 346006 - DNA, 25 bp, Rattus norvegicus
gaggagagtcctcatgttcttcccc

SEQ ID NO: 346007 - DNA, 25 bp, Rattus norvegicus
gaggagagtcctgatgttcttcccc

SEQ ID NO: 346008 - DNA, 25 bp, Rattus norvegicus
gaggagataacccaggcccagcgac

SEQ ID NO: 346009 - DNA, 25 bp, Rattus norvegicus
gaggagataaccgaggcccagcgac

SEQ ID NO: 346010 - DNA, 25 bp, Rattus norvegicus
gaggagataatgcacccctttaatc

SEQ ID NO: 346011 - DNA, 25 bp, Rattus norvegicus
gaggagataatggacccctttaatc

SEQ ID NO: 346012 - DNA, 25 bp, Rattus norvegicus
gaggagatacccaactctgaggact

SEQ ID NO: 346013 - DNA, 25 bp, Rattus norvegicus
gaggagataccctactctgaggact

SEQ ID NO: 346014 - DNA, 25 bp, Rattus norvegicus
gaggagatagacatataggcaggca

SEQ ID NO: 346015 - DNA, 25 bp, Rattus norvegicus
gaggagatagacttataggcaggca

SEQ ID NO: 346016 - DNA, 25 bp, Rattus norvegicus
gaggagatcccaagcaacgtcaaac

SEQ ID NO: 346017 - DNA, 25 bp, Rattus norvegicus
gaggagatcccatgcaacgtcaaac

SEQ ID NO: 346018 - DNA, 25 bp, Rattus norvegicus
gaggagatgataccatgcccacacc

SEQ ID NO: 346019 - DNA, 25 bp, Rattus norvegicus
gaggagatgatagcatgcccacacc

SEQ ID NO: 346020 - DNA, 25 bp, Rattus norvegicus
gaggagatgctgactgcttcgagct

SEQ ID NO: 346021 - DNA, 25 bp, Rattus norvegicus
gaggagatgctgtctgcttcgagct

SEQ ID NO: 346022 - DNA, 25 bp, Rattus norvegicus
gaggagatggtccagcttccaaacc

SEQ ID NO: 346023 - DNA, 25 bp, Rattus norvegicus
gaggagatggtcgagcttccaaacc

SEQ ID NO: 346024 - DNA, 25 bp, Rattus norvegicus
gaggagatgtctaactttctcccca

SEQ ID NO: 346025 - DNA, 25 bp, Rattus norvegicus
gaggagatgtcttactttctcccca

SEQ ID NO: 346026 - DNA, 25 bp, Rattus norvegicus
gaggagatgtgtcacccattctgaa

SEQ ID NO: 346027 - DNA, 25 bp, Rattus norvegicus
gaggagatgtgtgacccattctgaa

SEQ ID NO: 346028 - DNA, 25 bp, Rattus norvegicus
gaggagattcgtatccaaaccgaag

SEQ ID NO: 346029 - DNA, 25 bp, Rattus norvegicus
gaggagattcgtttccaaaccgaag

SEQ ID NO: 346030 - DNA, 25 bp, Rattus norvegicus
gaggagatttccagattagcgcgtg

SEQ ID NO: 346031 - DNA, 25 bp, Rattus norvegicus
gaggagatttcctgattagcgcgtg

SEQ ID NO: 346032 - DNA, 25 bp, Rattus norvegicus
gaggagcaacaaccactttctctgc

SEQ ID NO: 346033 - DNA, 25 bp, Rattus norvegicus
gaggagcaacaagcactttctctgc

SEQ ID NO: 346034 - DNA, 25 bp, Rattus norvegicus
gaggagcaacgacgccatggcttcc

SEQ ID NO: 346035 - DNA, 25 bp, Rattus norvegicus
gaggagcaacgaggccatggcttcc

SEQ ID NO: 346036 - DNA, 25 bp, Rattus norvegicus
gaggagcaagccaacacacagctat

SEQ ID NO: 346037 - DNA, 25 bp, Rattus norvegicus
gaggagcaagcctacacacagctat

SEQ ID NO: 346038 - DNA, 25 bp, Rattus norvegicus
gaggagcaagctcgcaccgacaaga

SEQ ID NO: 346039 - DNA, 25 bp, Rattus norvegicus
gaggagcaagctggcaccgacaaga

SEQ ID NO: 346040 - DNA, 25 bp, Rattus norvegicus
gaggagcaagtcactcttgccagac

SEQ ID NO: 346041 - DNA, 25 bp, Rattus norvegicus
gaggagcaagtctctcttgccagac

SEQ ID NO: 346042 - DNA, 25 bp, Rattus norvegicus
gaggagcacacgaccaacagaggca

SEQ ID NO: 346043 - DNA, 25 bp, Rattus norvegicus
gaggagcacacgtccaacagaggca

SEQ ID NO: 346044 - DNA, 25 bp, Rattus norvegicus
gaggagcacatcaatcgggaaatta

SEQ ID NO: 346045 - DNA, 25 bp, Rattus norvegicus
gaggagcacatcagcgcgcaccacg

SEQ ID NO: 346046 - DNA, 25 bp, Rattus norvegicus
gaggagcacatctatcgggaaatta

SEQ ID NO: 346047 - DNA, 25 bp, Rattus norvegicus
gaggagcacatctgcgcgcaccacg

SEQ ID NO: 346048 - DNA, 25 bp, Rattus norvegicus
gaggagcacgtgactgatgagaacc

SEQ ID NO: 346049 - DNA, 25 bp, Rattus norvegicus
gaggagcacgtgtctgatgagaacc

SEQ ID NO: 346050 - DNA, 25 bp, Rattus norvegicus
gaggagcactaccagcagcaaatga

SEQ ID NO: 346051 - DNA, 25 bp, Rattus norvegicus
gaggagcactacgagcagcaaatga

SEQ ID NO: 346052 - DNA, 25 bp, Rattus norvegicus
gaggagcactcaaggcctgccatgg

SEQ ID NO: 346053 - DNA, 25 bp, Rattus norvegicus
gaggagcactcatggcctgccatgg

SEQ ID NO: 346054 - DNA, 25 bp, Rattus norvegicus
gaggagcagctcctctcagaggaac

SEQ ID NO: 346055 - DNA, 25 bp, Rattus norvegicus
gaggagcagctcgtctcagaggaac

SEQ ID NO: 346056 - DNA, 25 bp, Rattus norvegicus
gaggagcaggacactttccccagtg

SEQ ID NO: 346057 - DNA, 25 bp, Rattus norvegicus
gaggagcaggactctttccccagtg

SEQ ID NO: 346058 - DNA, 25 bp, Rattus norvegicus
gaggagcaggctcgtcctttgccaa

SEQ ID NO: 346059 - DNA, 25 bp, Rattus norvegicus
gaggagcaggctggtcctttgccaa

SEQ ID NO: 346060 - DNA, 25 bp, Rattus norvegicus
gaggagcaggttatgccaagacata

SEQ ID NO: 346061 - DNA, 25 bp, Rattus norvegicus
gaggagcaggttttgccaagacata

SEQ ID NO: 346062 - DNA, 25 bp, Rattus norvegicus
gaggagcagtctcaagcatcttctg

SEQ ID NO: 346063 - DNA, 25 bp, Rattus norvegicus
gaggagcagtctgaagcatcttctg

SEQ ID NO: 346064 - DNA, 25 bp, Rattus norvegicus
gaggagcataccatcactgtgcatg

SEQ ID NO: 346065 - DNA, 25 bp, Rattus norvegicus
gaggagcataccttcactgtgcatg

SEQ ID NO: 346066 - DNA, 25 bp, Rattus norvegicus
gaggagcatcacatggcttcatcca

SEQ ID NO: 346067 - DNA, 25 bp, Rattus norvegicus
gaggagcatcacttggcttcatcca

SEQ ID NO: 346068 - DNA, 25 bp, Rattus norvegicus
gaggagcatctcagtacacaaagga

SEQ ID NO: 346069 - DNA, 25 bp, Rattus norvegicus
gaggagcatctctgtacacaaagga

SEQ ID NO: 346070 - DNA, 25 bp, Rattus norvegicus
gaggagccaaccagatatattcatt

SEQ ID NO: 346071 - DNA, 25 bp, Rattus norvegicus
gaggagccaacctgatatattcatt

SEQ ID NO: 346072 - DNA, 25 bp, Rattus norvegicus
gaggagccacacatctttatttttt

SEQ ID NO: 346073 - DNA, 25 bp, Rattus norvegicus
gaggagccacacttctttatttttt

SEQ ID NO: 346074 - DNA, 25 bp, Rattus norvegicus
gaggagccacagatgtgattttcaa

SEQ ID NO: 346075 - DNA, 25 bp, Rattus norvegicus
gaggagccacagttgtgattttcaa

SEQ ID NO: 346076 - DNA, 25 bp, Rattus norvegicus
gaggagccacgaatgctggtgccca

SEQ ID NO: 346077 - DNA, 25 bp, Rattus norvegicus
gaggagccacgattgctggtgccca

SEQ ID NO: 346078 - DNA, 25 bp, Rattus norvegicus
gaggagccagcaaaaccagtactta

SEQ ID NO: 346079 - DNA, 25 bp, Rattus norvegicus
gaggagccagcataaccagtactta

SEQ ID NO: 346080 - DNA, 25 bp, Rattus norvegicus
gaggagccaggcctgtccaagtaat

SEQ ID NO: 346081 - DNA, 25 bp, Rattus norvegicus
gaggagccaggcgtgtccaagtaat

SEQ ID NO: 346082 - DNA, 25 bp, Rattus norvegicus
gaggagccatccatatgctgacaca

SEQ ID NO: 346083 - DNA, 25 bp, Rattus norvegicus
gaggagccatccttatgctgacaca

SEQ ID NO: 346084 - DNA, 25 bp, Rattus norvegicus
gaggagcccaaacacctggcagcat

SEQ ID NO: 346085 - DNA, 25 bp, Rattus norvegicus
gaggagcccaaagacctggcagcat

SEQ ID NO: 346086 - DNA, 25 bp, Rattus norvegicus
gaggagcccagcaagctgctgagaa

SEQ ID NO: 346087 - DNA, 25 bp, Rattus norvegicus
gaggagcccagctagctgctgagaa

SEQ ID NO: 346088 - DNA, 25 bp, Rattus norvegicus
gaggagcccattctctgtagactgc

SEQ ID NO: 346089 - DNA, 25 bp, Rattus norvegicus
gaggagcccattgtctgtagactgc

SEQ ID NO: 346090 - DNA, 25 bp, Rattus norvegicus
gaggagccccagcagagagtacttt

SEQ ID NO: 346091 - DNA, 25 bp, Rattus norvegicus
gaggagccccaggagagagtacttt

SEQ ID NO: 346092 - DNA, 25 bp, Rattus norvegicus
gaggagcccctgcatcttataagac

SEQ ID NO: 346093 - DNA, 25 bp, Rattus norvegicus
gaggagcccctggatcttataagac

SEQ ID NO: 346094 - DNA, 25 bp, Rattus norvegicus
gaggagccctacaacattcacggtg

SEQ ID NO: 346095 - DNA, 25 bp, Rattus norvegicus
gaggagccctacagaaactcttctc

SEQ ID NO: 346096 - DNA, 25 bp, Rattus norvegicus
gaggagccctactacattcacggtg

SEQ ID NO: 346097 - DNA, 25 bp, Rattus norvegicus
gaggagccctactgaaactcttctc

SEQ ID NO: 346098 - DNA, 25 bp, Rattus norvegicus
gaggagccgttccagcttcaggaac

SEQ ID NO: 346099 - DNA, 25 bp, Rattus norvegicus
gaggagccgttcgagcttcaggaac

SEQ ID NO: 346100 - DNA, 25 bp, Rattus norvegicus
gaggagcctaaaattccactctcga

SEQ ID NO: 346101 - DNA, 25 bp, Rattus norvegicus
gaggagcctaaatttccactctcga

SEQ ID NO: 346102 - DNA, 25 bp, Rattus norvegicus
gaggagcctagcaccgggatcccgc

SEQ ID NO: 346103 - DNA, 25 bp, Rattus norvegicus
gaggagcctagctccgggatcccgc

SEQ ID NO: 346104 - DNA, 25 bp, Rattus norvegicus
gaggagcctccccaggaacagaaaa

SEQ ID NO: 346105 - DNA, 25 bp, Rattus norvegicus
gaggagcctcccgaggaacagaaaa

SEQ ID NO: 346106 - DNA, 25 bp, Rattus norvegicus
gaggagcctctaatgtgctcagcat

SEQ ID NO: 346107 - DNA, 25 bp, Rattus norvegicus
gaggagcctctattgtgctcagcat

SEQ ID NO: 346108 - DNA, 25 bp, Rattus norvegicus
gaggagcctctgatgcgctttggaa

SEQ ID NO: 346109 - DNA, 25 bp, Rattus norvegicus
gaggagcctctgttgcgctttggaa

SEQ ID NO: 346110 - DNA, 25 bp, Rattus norvegicus
gaggagcctgaacacaccacagaag

SEQ ID NO: 346111 - DNA, 25 bp, Rattus norvegicus
gaggagcctgaagacaccacagaag

SEQ ID NO: 346112 - DNA, 25 bp, Rattus norvegicus
gaggagcctggtaaacttatattgt

SEQ ID NO: 346113 - DNA, 25 bp, Rattus norvegicus
gaggagcctggttaacttatattgt

SEQ ID NO: 346114 - DNA, 25 bp, Rattus norvegicus
gaggagcctgttccagaattgctag

SEQ ID NO: 346115 - DNA, 25 bp, Rattus norvegicus
gaggagcctgttgcagaattgctag

SEQ ID NO: 346116 - DNA, 25 bp, Rattus norvegicus
gaggagccttctcgagtcgacatac

SEQ ID NO: 346117 - DNA, 25 bp, Rattus norvegicus
gaggagccttctggagtcgacatac

SEQ ID NO: 346118 - DNA, 25 bp, Rattus norvegicus
gaggagcctttcataatgttttcag

SEQ ID NO: 346119 - DNA, 25 bp, Rattus norvegicus
gaggagcctttcttaatgttttcag

SEQ ID NO: 346120 - DNA, 25 bp, Rattus norvegicus
gaggagcgcggcaggcaacctaaaa

SEQ ID NO: 346121 - DNA, 25 bp, Rattus norvegicus
gaggagcgcggctggcaacctaaaa

SEQ ID NO: 346122 - DNA, 25 bp, Rattus norvegicus
gaggagcggccaaactgtgagatct

SEQ ID NO: 346123 - DNA, 25 bp, Rattus norvegicus
gaggagcggccatactgtgagatct

SEQ ID NO: 346124 - DNA, 25 bp, Rattus norvegicus
gaggagcgtctgacggagctcacca

SEQ ID NO: 346125 - DNA, 25 bp, Rattus norvegicus
gaggagcgtctgtcggagctcacca

SEQ ID NO: 346126 - DNA, 25 bp, Rattus norvegicus
gaggagctaattctgcataaactga

SEQ ID NO: 346127 - DNA, 25 bp, Rattus norvegicus
gaggagctaattgtgcataaactga

SEQ ID NO: 346128 - DNA, 25 bp, Rattus norvegicus
gaggagctaccccagcagaggcaaa

SEQ ID NO: 346129 - DNA, 25 bp, Rattus norvegicus
gaggagctacccgagcagaggcaaa

SEQ ID NO: 346130 - DNA, 25 bp, Rattus norvegicus
gaggagctaccgctgaggacaaata

SEQ ID NO: 346131 - DNA, 25 bp, Rattus norvegicus
gaggagctaccggtgaggacaaata

SEQ ID NO: 346132 - DNA, 25 bp, Rattus norvegicus
gaggagctagcccagttcagaattg

SEQ ID NO: 346133 - DNA, 25 bp, Rattus norvegicus
gaggagctagccgagttcagaattg

SEQ ID NO: 346134 - DNA, 25 bp, Rattus norvegicus
gaggagctatgcagactctggccca

SEQ ID NO: 346135 - DNA, 25 bp, Rattus norvegicus
gaggagctatgctgactctggccca

SEQ ID NO: 346136 - DNA, 25 bp, Rattus norvegicus
gaggagctcacacttaagaccaagg

SEQ ID NO: 346137 - DNA, 25 bp, Rattus norvegicus
gaggagctcacagttaagaccaagg

SEQ ID NO: 346138 - DNA, 25 bp, Rattus norvegicus
gaggagctcaggaagatgtattctt

SEQ ID NO: 346139 - DNA, 25 bp, Rattus norvegicus
gaggagctcaggtagatgtattctt

SEQ ID NO: 346140 - DNA, 25 bp, Rattus norvegicus
gaggagctccagactgaactctatg

SEQ ID NO: 346141 - DNA, 25 bp, Rattus norvegicus
gaggagctccagtctgaactctatg

SEQ ID NO: 346142 - DNA, 25 bp, Rattus norvegicus
gaggagctccctcaacattttgtgc

SEQ ID NO: 346143 - DNA, 25 bp, Rattus norvegicus
gaggagctccctgaacattttgtgc

SEQ ID NO: 346144 - DNA, 25 bp, Rattus norvegicus
gaggagctcctgagtccaactctaa

SEQ ID NO: 346145 - DNA, 25 bp, Rattus norvegicus
gaggagctcctgcaacacactgaca

SEQ ID NO: 346146 - DNA, 25 bp, Rattus norvegicus
gaggagctcctggaacacactgaca

SEQ ID NO: 346147 - DNA, 25 bp, Rattus norvegicus
gaggagctcctgtgtccaactctaa

SEQ ID NO: 346148 - DNA, 25 bp, Rattus norvegicus
gaggagctctccacacgagggctga

SEQ ID NO: 346149 - DNA, 25 bp, Rattus norvegicus
gaggagctctcctcacgagggctga

SEQ ID NO: 346150 - DNA, 25 bp, Rattus norvegicus
gaggagctctgcaggagttcacgca

SEQ ID NO: 346151 - DNA, 25 bp, Rattus norvegicus
gaggagctctgctggagttcacgca

SEQ ID NO: 346152 - DNA, 25 bp, Rattus norvegicus
gaggagctgaagatcggcacttcca

SEQ ID NO: 346153 - DNA, 25 bp, Rattus norvegicus
gaggagctgaagttcggcacttcca

SEQ ID NO: 346154 - DNA, 25 bp, Rattus norvegicus
gaggagctgagcaacatcacacaag

SEQ ID NO: 346155 - DNA, 25 bp, Rattus norvegicus
gaggagctgagctacatcacacaag

SEQ ID NO: 346156 - DNA, 25 bp, Rattus norvegicus
gaggagctgcaaatactctgaagga

SEQ ID NO: 346157 - DNA, 25 bp, Rattus norvegicus
gaggagctgcaattactctgaagga

SEQ ID NO: 346158 - DNA, 25 bp, Rattus norvegicus
gaggagctgcagatgcctgtcacca

SEQ ID NO: 346159 - DNA, 25 bp, Rattus norvegicus
gaggagctgcagttgcctgtcacca

SEQ ID NO: 346160 - DNA, 25 bp, Rattus norvegicus
gaggagctgcccatgaattctttgg

SEQ ID NO: 346161 - DNA, 25 bp, Rattus norvegicus
gaggagctgcccttgaattctttgg

SEQ ID NO: 346162 - DNA, 25 bp, Rattus norvegicus
gaggagctgcgtcgcgcctgggtgt

SEQ ID NO: 346163 - DNA, 25 bp, Rattus norvegicus
gaggagctgcgtggcgcctgggtgt

SEQ ID NO: 346164 - DNA, 25 bp, Rattus norvegicus
gaggagctgcttaaccatagtgcca

SEQ ID NO: 346165 - DNA, 25 bp, Rattus norvegicus
gaggagctgctttaccatagtgcca

SEQ ID NO: 346166 - DNA, 25 bp, Rattus norvegicus
gaggagctggaccactttgttctgc

SEQ ID NO: 346167 - DNA, 25 bp, Rattus norvegicus
gaggagctggacgactttgttctgc

SEQ ID NO: 346168 - DNA, 25 bp, Rattus norvegicus
gaggagctggcgctcaatatcatct

SEQ ID NO: 346169 - DNA, 25 bp, Rattus norvegicus
gaggagctggcggtcaatatcatct

SEQ ID NO: 346170 - DNA, 25 bp, Rattus norvegicus
gaggagctgggcatagttcccacca

SEQ ID NO: 346171 - DNA, 25 bp, Rattus norvegicus
gaggagctgggcttagttcccacca

SEQ ID NO: 346172 - DNA, 25 bp, Rattus norvegicus
gaggagctggtgacctgttctgact

SEQ ID NO: 346173 - DNA, 25 bp, Rattus norvegicus
gaggagctggtgtcctgttctgact

SEQ ID NO: 346174 - DNA, 25 bp, Rattus norvegicus
gaggagctgtgtatgggctcccacc

SEQ ID NO: 346175 - DNA, 25 bp, Rattus norvegicus
gaggagctgtgtccctctccaaaga

SEQ ID NO: 346176 - DNA, 25 bp, Rattus norvegicus
gaggagctgtgtgcctctccaaaga

SEQ ID NO: 346177 - DNA, 25 bp, Rattus norvegicus
gaggagctgtgtttgggctcccacc

SEQ ID NO: 346178 - DNA, 25 bp, Rattus norvegicus
gaggagcttacgaggcttccgaaca

SEQ ID NO: 346179 - DNA, 25 bp, Rattus norvegicus
gaggagcttacgtggcttccgaaca

SEQ ID NO: 346180 - DNA, 25 bp, Rattus norvegicus
gaggagcttcccctggccatgtgat

SEQ ID NO: 346181 - DNA, 25 bp, Rattus norvegicus
gaggagcttcccgtggccatgtgat

SEQ ID NO: 346182 - DNA, 25 bp, Rattus norvegicus
gaggagcttcctaggcacatcaaaa

SEQ ID NO: 346183 - DNA, 25 bp, Rattus norvegicus
gaggagcttcctctaattccgaagg

SEQ ID NO: 346184 - DNA, 25 bp, Rattus norvegicus
gaggagcttcctgtaattccgaagg

SEQ ID NO: 346185 - DNA, 25 bp, Rattus norvegicus
gaggagcttccttggcacatcaaaa

SEQ ID NO: 346186 - DNA, 25 bp, Rattus norvegicus
gaggagctttctctaacttgtttta

SEQ ID NO: 346187 - DNA, 25 bp, Rattus norvegicus
gaggagctttctgtaacttgtttta

SEQ ID NO: 346188 - DNA, 25 bp, Rattus norvegicus
gaggaggaaaagcacatggtccaca

SEQ ID NO: 346189 - DNA, 25 bp, Rattus norvegicus
gaggaggaaaaggacatggtccaca

SEQ ID NO: 346190 - DNA, 25 bp, Rattus norvegicus
gaggaggaacatactgtgcagagat

SEQ ID NO: 346191 - DNA, 25 bp, Rattus norvegicus
gaggaggaacattctgtgcagagat

SEQ ID NO: 346192 - DNA, 25 bp, Rattus norvegicus
gaggaggaacccactgatcacagaa

SEQ ID NO: 346193 - DNA, 25 bp, Rattus norvegicus
gaggaggaaccctctgatcacagaa

SEQ ID NO: 346194 - DNA, 25 bp, Rattus norvegicus
gaggaggaacttcgtcttccagtct

SEQ ID NO: 346195 - DNA, 25 bp, Rattus norvegicus
gaggaggaacttggtcttccagtct

SEQ ID NO: 346196 - DNA, 25 bp, Rattus norvegicus
gaggaggaagataccagccagagtt

SEQ ID NO: 346197 - DNA, 25 bp, Rattus norvegicus
gaggaggaagattccagccagagtt

SEQ ID NO: 346198 - DNA, 25 bp, Rattus norvegicus
gaggaggaagcaacggccgcatcca

SEQ ID NO: 346199 - DNA, 25 bp, Rattus norvegicus
gaggaggaagcatcggccgcatcca

SEQ ID NO: 346200 - DNA, 25 bp, Rattus norvegicus
gaggaggaagccaccagcttcatta

SEQ ID NO: 346201 - DNA, 25 bp, Rattus norvegicus
gaggaggaagcctccagcttcatta

SEQ ID NO: 346202 - DNA, 25 bp, Rattus norvegicus
gaggaggaagtcaccggccctgtta

SEQ ID NO: 346203 - DNA, 25 bp, Rattus norvegicus
gaggaggaagtctccggccctgtta

SEQ ID NO: 346204 - DNA, 25 bp, Rattus norvegicus
gaggaggacatcattaattccatga

SEQ ID NO: 346205 - DNA, 25 bp, Rattus norvegicus
gaggaggacatctttaattccatga

SEQ ID NO: 346206 - DNA, 25 bp, Rattus norvegicus
gaggaggaccatcgcatctttccat

SEQ ID NO: 346207 - DNA, 25 bp, Rattus norvegicus
gaggaggaccatggcatctttccat

SEQ ID NO: 346208 - DNA, 25 bp, Rattus norvegicus
gaggaggacgctcgtgtattcatca

SEQ ID NO: 346209 - DNA, 25 bp, Rattus norvegicus
gaggaggacgctggtgtattcatca

SEQ ID NO: 346210 - DNA, 25 bp, Rattus norvegicus
gaggaggactggctctctatcactc

SEQ ID NO: 346211 - DNA, 25 bp, Rattus norvegicus
gaggaggactgggtctctatcactc

SEQ ID NO: 346212 - DNA, 25 bp, Rattus norvegicus
gaggaggagatgaatcgcccgcacc

SEQ ID NO: 346213 - DNA, 25 bp, Rattus norvegicus
gaggaggagatgtatcgcccgcacc

SEQ ID NO: 346214 - DNA, 25 bp, Rattus norvegicus
gaggaggagccccaaccactagtca

SEQ ID NO: 346215 - DNA, 25 bp, Rattus norvegicus
gaggaggagcccgaaccactagtca

SEQ ID NO: 346216 - DNA, 25 bp, Rattus norvegicus
gaggaggagctcagccgtctcaagc

SEQ ID NO: 346217 - DNA, 25 bp, Rattus norvegicus
gaggaggagctctgccgtctcaagc

SEQ ID NO: 346218 - DNA, 25 bp, Rattus norvegicus
gaggaggagctgacggatctcttcc

SEQ ID NO: 346219 - DNA, 25 bp, Rattus norvegicus
gaggaggagctgtcggatctcttcc

SEQ ID NO: 346220 - DNA, 25 bp, Rattus norvegicus
gaggaggagtccacgcccacaaagc

SEQ ID NO: 346221 - DNA, 25 bp, Rattus norvegicus
gaggaggagtcctcgcccacaaagc

SEQ ID NO: 346222 - DNA, 25 bp, Rattus norvegicus
gaggaggatcaaatggcagaacccc

SEQ ID NO: 346223 - DNA, 25 bp, Rattus norvegicus
gaggaggatcaattggcagaacccc

SEQ ID NO: 346224 - DNA, 25 bp, Rattus norvegicus
gaggaggcacaacgagccacagaaa

SEQ ID NO: 346225 - DNA, 25 bp, Rattus norvegicus
gaggaggcacaaggagccacagaaa

SEQ ID NO: 346226 - DNA, 25 bp, Rattus norvegicus
gaggaggcacctcctgaaacactgt

SEQ ID NO: 346227 - DNA, 25 bp, Rattus norvegicus
gaggaggcacctgctgaaacactgt

SEQ ID NO: 346228 - DNA, 25 bp, Rattus norvegicus
gaggaggcagaacccattttgaaaa

SEQ ID NO: 346229 - DNA, 25 bp, Rattus norvegicus
gaggaggcagaagccattttgaaaa

SEQ ID NO: 346230 - DNA, 25 bp, Rattus norvegicus
gaggaggcagacacctcagagccag

SEQ ID NO: 346231 - DNA, 25 bp, Rattus norvegicus
gaggaggcagactcctcagagccag

SEQ ID NO: 346232 - DNA, 25 bp, Rattus norvegicus
gaggaggcagctcgcaaacctgtat

SEQ ID NO: 346233 - DNA, 25 bp, Rattus norvegicus
gaggaggcagctggcaaacctgtat

SEQ ID NO: 346234 - DNA, 25 bp, Rattus norvegicus
gaggaggcagtgctgtgggtccagg

SEQ ID NO: 346235 - DNA, 25 bp, Rattus norvegicus
gaggaggcagtggtgtgggtccagg

SEQ ID NO: 346236 - DNA, 25 bp, Rattus norvegicus
gaggaggcatttattaacacagcaa

SEQ ID NO: 346237 - DNA, 25 bp, Rattus norvegicus
gaggaggcattttttaacacagcaa

SEQ ID NO: 346238 - DNA, 25 bp, Rattus norvegicus
gaggaggccatgagatcctagccaa

SEQ ID NO: 346239 - DNA, 25 bp, Rattus norvegicus
gaggaggccatgtgatcctagccaa

SEQ ID NO: 346240 - DNA, 25 bp, Rattus norvegicus
gaggaggccattcgctgtcaccctg

SEQ ID NO: 346241 - DNA, 25 bp, Rattus norvegicus
gaggaggccattggctgtcaccctg

SEQ ID NO: 346242 - DNA, 25 bp, Rattus norvegicus
gaggaggccgccatcatcatcgaaa

SEQ ID NO: 346243 - DNA, 25 bp, Rattus norvegicus
gaggaggccgccttcatcatcgaaa

SEQ ID NO: 346244 - DNA, 25 bp, Rattus norvegicus
gaggaggcctcgcagcactccatct

SEQ ID NO: 346245 - DNA, 25 bp, Rattus norvegicus
gaggaggcctcggagcactccatct

SEQ ID NO: 346246 - DNA, 25 bp, Rattus norvegicus
gaggaggccttgatgcccagtagac

SEQ ID NO: 346247 - DNA, 25 bp, Rattus norvegicus
gaggaggccttgttgcccagtagac

SEQ ID NO: 346248 - DNA, 25 bp, Rattus norvegicus
gaggaggcgtttcagatacccgaat

SEQ ID NO: 346249 - DNA, 25 bp, Rattus norvegicus
gaggaggcgtttgagatacccgaat

SEQ ID NO: 346250 - DNA, 25 bp, Rattus norvegicus
gaggaggcttacaccatggacacca

SEQ ID NO: 346251 - DNA, 25 bp, Rattus norvegicus
gaggaggcttactccatggacacca

SEQ ID NO: 346252 - DNA, 25 bp, Rattus norvegicus
gaggaggcttctcagccaccaaagg

SEQ ID NO: 346253 - DNA, 25 bp, Rattus norvegicus
gaggaggcttctgagccaccaaagg

SEQ ID NO: 346254 - DNA, 25 bp, Rattus norvegicus
gaggagggctgtcggtatactcaaa

SEQ ID NO: 346255 - DNA, 25 bp, Rattus norvegicus
gaggagggctgtgggtatactcaaa

SEQ ID NO: 346256 - DNA, 25 bp, Rattus norvegicus
gaggaggtacagatcctagctccta

SEQ ID NO: 346257 - DNA, 25 bp, Rattus norvegicus
gaggaggtacagttcctagctccta

SEQ ID NO: 346258 - DNA, 25 bp, Rattus norvegicus
gaggaggtctggacgatatatgtct

SEQ ID NO: 346259 - DNA, 25 bp, Rattus norvegicus
gaggaggtctggtcgatatatgtct

SEQ ID NO: 346260 - DNA, 25 bp, Rattus norvegicus
gaggaggtcttaccacactggctgt

SEQ ID NO: 346261 - DNA, 25 bp, Rattus norvegicus
gaggaggtcttagcacactggctgt

SEQ ID NO: 346262 - DNA, 25 bp, Rattus norvegicus
gaggaggtgcacatctcccatgtgg

SEQ ID NO: 346263 - DNA, 25 bp, Rattus norvegicus
gaggaggtgcacttctcccatgtgg

SEQ ID NO: 346264 - DNA, 25 bp, Rattus norvegicus
gaggaggtgcctctgttaaactctt

SEQ ID NO: 346265 - DNA, 25 bp, Rattus norvegicus
gaggaggtgcctgtgttaaactctt

SEQ ID NO: 346266 - DNA, 25 bp, Rattus norvegicus
gaggaggtggtcatgatctttcaat

SEQ ID NO: 346267 - DNA, 25 bp, Rattus norvegicus
gaggaggtggtcttgatctttcaat

SEQ ID NO: 346268 - DNA, 25 bp, Rattus norvegicus
gaggaggtgtccatctacggcttct

SEQ ID NO: 346269 - DNA, 25 bp, Rattus norvegicus
gaggaggtgtccttctacggcttct

SEQ ID NO: 346270 - DNA, 25 bp, Rattus norvegicus
gaggaggttaccagcacttacgaat

SEQ ID NO: 346271 - DNA, 25 bp, Rattus norvegicus
gaggaggttacctgcacttacgaat

SEQ ID NO: 346272 - DNA, 25 bp, Rattus norvegicus
gaggaggttcccagagacctgcgct

SEQ ID NO: 346273 - DNA, 25 bp, Rattus norvegicus
gaggaggttccctgagacctgcgct

SEQ ID NO: 346274 - DNA, 25 bp, Rattus norvegicus
gaggaggttctgcattaatctttta

SEQ ID NO: 346275 - DNA, 25 bp, Rattus norvegicus
gaggaggttctggattaatctttta

SEQ ID NO: 346276 - DNA, 25 bp, Rattus norvegicus
gaggaggtttttcttcagttcacca

SEQ ID NO: 346277 - DNA, 25 bp, Rattus norvegicus
gaggaggtttttgttcagttcacca

SEQ ID NO: 346278 - DNA, 25 bp, Rattus norvegicus
gaggagtaacccaacaactgtatgt

SEQ ID NO: 346279 - DNA, 25 bp, Rattus norvegicus
gaggagtaaccctacaactgtatgt

SEQ ID NO: 346280 - DNA, 25 bp, Rattus norvegicus
gaggagtaccaaatccccattgctt

SEQ ID NO: 346281 - DNA, 25 bp, Rattus norvegicus
gaggagtaccaattccccattgctt

SEQ ID NO: 346282 - DNA, 25 bp, Rattus norvegicus
gaggagtactatatctggaggccag

SEQ ID NO: 346283 - DNA, 25 bp, Rattus norvegicus
gaggagtactatttctggaggccag

SEQ ID NO: 346284 - DNA, 25 bp, Rattus norvegicus
gaggagtactttctgccgattgtct

SEQ ID NO: 346285 - DNA, 25 bp, Rattus norvegicus
gaggagtactttgtgccgattgtct

SEQ ID NO: 346286 - DNA, 25 bp, Rattus norvegicus
gaggagtagagacttatacagtatt

SEQ ID NO: 346287 - DNA, 25 bp, Rattus norvegicus
gaggagtagagagttatacagtatt

SEQ ID NO: 346288 - DNA, 25 bp, Rattus norvegicus
gaggagtagatcagccagtggtttt

SEQ ID NO: 346289 - DNA, 25 bp, Rattus norvegicus
gaggagtagatctgccagtggtttt

SEQ ID NO: 346290 - DNA, 25 bp, Rattus norvegicus
gaggagtaggttatagcctgtacca

SEQ ID NO: 346291 - DNA, 25 bp, Rattus norvegicus
gaggagtaggttttagcctgtacca

SEQ ID NO: 346292 - DNA, 25 bp, Rattus norvegicus
gaggagtatctcagctcagaagcat

SEQ ID NO: 346293 - DNA, 25 bp, Rattus norvegicus
gaggagtatctctgctcagaagcat

SEQ ID NO: 346294 - DNA, 25 bp, Rattus norvegicus
gaggagtcacagagccttagacgtg

SEQ ID NO: 346295 - DNA, 25 bp, Rattus norvegicus
gaggagtcacagtgccttagacgtg

SEQ ID NO: 346296 - DNA, 25 bp, Rattus norvegicus
gaggagtcagatagtctgtccgcct

SEQ ID NO: 346297 - DNA, 25 bp, Rattus norvegicus
gaggagtcagattgtctgtccgcct

SEQ ID NO: 346298 - DNA, 25 bp, Rattus norvegicus
gaggagtcccagaatgcctcggaca

SEQ ID NO: 346299 - DNA, 25 bp, Rattus norvegicus
gaggagtcccagtatgcctcggaca

SEQ ID NO: 346300 - DNA, 25 bp, Rattus norvegicus
gaggagtcctagaacacacggagaa

SEQ ID NO: 346301 - DNA, 25 bp, Rattus norvegicus
gaggagtcctagtacacacggagaa

SEQ ID NO: 346302 - DNA, 25 bp, Rattus norvegicus
gaggagtcgcgtacccacttgtgcg

SEQ ID NO: 346303 - DNA, 25 bp, Rattus norvegicus
gaggagtcgcgttcccacttgtgcg

SEQ ID NO: 346304 - DNA, 25 bp, Rattus norvegicus
gaggagtcgctacacttacctagaa

SEQ ID NO: 346305 - DNA, 25 bp, Rattus norvegicus
gaggagtcgctagacttacctagaa

SEQ ID NO: 346306 - DNA, 25 bp, Rattus norvegicus
gaggagtcgtgtattcttttatttc

SEQ ID NO: 346307 - DNA, 25 bp, Rattus norvegicus
gaggagtcgtgttttcttttatttc

SEQ ID NO: 346308 - DNA, 25 bp, Rattus norvegicus
gaggagtctgacaaccaggcacttt

SEQ ID NO: 346309 - DNA, 25 bp, Rattus norvegicus
gaggagtctgaccatgaaattccag

SEQ ID NO: 346310 - DNA, 25 bp, Rattus norvegicus
gaggagtctgacgatgaaattccag

SEQ ID NO: 346311 - DNA, 25 bp, Rattus norvegicus
gaggagtctgactaccaggcacttt

SEQ ID NO: 346312 - DNA, 25 bp, Rattus norvegicus
gaggagtgaagccaagccaaacaga

SEQ ID NO: 346313 - DNA, 25 bp, Rattus norvegicus
gaggagtgaagcgaagccaaacaga

SEQ ID NO: 346314 - DNA, 25 bp, Rattus norvegicus
gaggagtgacatcagcttcaatgaa

SEQ ID NO: 346315 - DNA, 25 bp, Rattus norvegicus
gaggagtgacatgagcttcaatgaa

SEQ ID NO: 346316 - DNA, 25 bp, Rattus norvegicus
gaggagtgactaacaagccaacaat

SEQ ID NO: 346317 - DNA, 25 bp, Rattus norvegicus
gaggagtgactatcaagccaacaat

SEQ ID NO: 346318 - DNA, 25 bp, Rattus norvegicus
gaggagtgcactactttacgagcaa

SEQ ID NO: 346319 - DNA, 25 bp, Rattus norvegicus
gaggagtgcacttctttacgagcaa

SEQ ID NO: 346320 - DNA, 25 bp, Rattus norvegicus
gaggagtgcagccacttccgatctc

SEQ ID NO: 346321 - DNA, 25 bp, Rattus norvegicus
gaggagtgcagcgacttccgatctc

SEQ ID NO: 346322 - DNA, 25 bp, Rattus norvegicus
gaggagtgctggcaactgttaccct

SEQ ID NO: 346323 - DNA, 25 bp, Rattus norvegicus
gaggagtgctgggaactgttaccct

SEQ ID NO: 346324 - DNA, 25 bp, Rattus norvegicus
gaggagtgtattctgctgtcttgca

SEQ ID NO: 346325 - DNA, 25 bp, Rattus norvegicus
gaggagtgtattgtgctgtcttgca

SEQ ID NO: 346326 - DNA, 25 bp, Rattus norvegicus
gaggagtgtcaaaccctatctacaa

SEQ ID NO: 346327 - DNA, 25 bp, Rattus norvegicus
gaggagtgtcaatccctatctacaa

SEQ ID NO: 346328 - DNA, 25 bp, Rattus norvegicus
gaggagtgtgccatgtgccccatac

SEQ ID NO: 346329 - DNA, 25 bp, Rattus norvegicus
gaggagtgtgccttgtgccccatac

SEQ ID NO: 346330 - DNA, 25 bp, Rattus norvegicus
gaggagtgttttctgtcaccacatt

SEQ ID NO: 346331 - DNA, 25 bp, Rattus norvegicus
gaggagtgttttgtgtcaccacatt

SEQ ID NO: 346332 - DNA, 25 bp, Rattus norvegicus
gaggagttactcactacaatttcgc

SEQ ID NO: 346333 - DNA, 25 bp, Rattus norvegicus
gaggagttactctctacaatttcgc

SEQ ID NO: 346334 - DNA, 25 bp, Rattus norvegicus
gaggagttacttacttaggacattt

SEQ ID NO: 346335 - DNA, 25 bp, Rattus norvegicus
gaggagttactttcttaggacattt

SEQ ID NO: 346336 - DNA, 25 bp, Rattus norvegicus
gaggagttatgccatgttctgtcat

SEQ ID NO: 346337 - DNA, 25 bp, Rattus norvegicus
gaggagttatgcgatgttctgtcat

SEQ ID NO: 346338 - DNA, 25 bp, Rattus norvegicus
gaggagttcaagatggagcgccatt

SEQ ID NO: 346339 - DNA, 25 bp, Rattus norvegicus
gaggagttcaagttggagcgccatt

SEQ ID NO: 346340 - DNA, 25 bp, Rattus norvegicus
gaggagttcaccacacaatacaaaa

SEQ ID NO: 346341 - DNA, 25 bp, Rattus norvegicus
gaggagttcacctcacaatacaaaa

SEQ ID NO: 346342 - DNA, 25 bp, Rattus norvegicus
gaggagttcctgatttcaatgattc

SEQ ID NO: 346343 - DNA, 25 bp, Rattus norvegicus
gaggagttcctgttttcaatgattc

SEQ ID NO: 346344 - DNA, 25 bp, Rattus norvegicus
gaggagttctacaaattcaaggaca

SEQ ID NO: 346345 - DNA, 25 bp, Rattus norvegicus
gaggagttctaccaagtcttcggca

SEQ ID NO: 346346 - DNA, 25 bp, Rattus norvegicus
gaggagttctacgaagtcttcggca

SEQ ID NO: 346347 - DNA, 25 bp, Rattus norvegicus
gaggagttctactaattcaaggaca

SEQ ID NO: 346348 - DNA, 25 bp, Rattus norvegicus
gaggagttctgaagggttccctgaa

SEQ ID NO: 346349 - DNA, 25 bp, Rattus norvegicus
gaggagttctgatgggttccctgaa

SEQ ID NO: 346350 - DNA, 25 bp, Rattus norvegicus
gaggagttctgcagagtcccaggaa

SEQ ID NO: 346351 - DNA, 25 bp, Rattus norvegicus
gaggagttctgctgagtcccaggaa

SEQ ID NO: 346352 - DNA, 25 bp, Rattus norvegicus
gaggagttcttcaacctgtcacact

SEQ ID NO: 346353 - DNA, 25 bp, Rattus norvegicus
gaggagttcttctacctgtcacact

SEQ ID NO: 346354 - DNA, 25 bp, Rattus norvegicus
gaggagttgagaccttcctgctgtt

SEQ ID NO: 346355 - DNA, 25 bp, Rattus norvegicus
gaggagttgagagcttcctgctgtt

SEQ ID NO: 346356 - DNA, 25 bp, Rattus norvegicus
gaggagtttagcaggatctgccgcc

SEQ ID NO: 346357 - DNA, 25 bp, Rattus norvegicus
gaggagtttagctggatctgccgcc

SEQ ID NO: 346358 - DNA, 25 bp, Rattus norvegicus
gaggagtttattctgggcgtttcta

SEQ ID NO: 346359 - DNA, 25 bp, Rattus norvegicus
gaggagtttattgtgggcgtttcta

SEQ ID NO: 346360 - DNA, 25 bp, Rattus norvegicus
gaggagtttcatcggtcacagagac

SEQ ID NO: 346361 - DNA, 25 bp, Rattus norvegicus
gaggagtttcatgggtcacagagac

SEQ ID NO: 346362 - DNA, 25 bp, Rattus norvegicus
gaggagtttgaacttgaaccaagaa

SEQ ID NO: 346363 - DNA, 25 bp, Rattus norvegicus
gaggagtttgaagttgaaccaagaa

SEQ ID NO: 346364 - DNA, 25 bp, Rattus norvegicus
gaggagtttgaccactacgtctact

SEQ ID NO: 346365 - DNA, 25 bp, Rattus norvegicus
gaggagtttgacgactacgtctact

SEQ ID NO: 346366 - DNA, 25 bp, Rattus norvegicus
gaggataaacttcggcctcagctca

SEQ ID NO: 346367 - DNA, 25 bp, Rattus norvegicus
gaggataaacttgggcctcagctca

SEQ ID NO: 346368 - DNA, 25 bp, Rattus norvegicus
gaggataacaacagattatgtgtcc

SEQ ID NO: 346369 - DNA, 25 bp, Rattus norvegicus
gaggataacaactgattatgtgtcc

SEQ ID NO: 346370 - DNA, 25 bp, Rattus norvegicus
gaggataacagtagtggtggcacat

SEQ ID NO: 346371 - DNA, 25 bp, Rattus norvegicus
gaggataacagttgtggtggcacat

SEQ ID NO: 346372 - DNA, 25 bp, Rattus norvegicus
gaggataaccctagggactgcacct

SEQ ID NO: 346373 - DNA, 25 bp, Rattus norvegicus
gaggataacccttgggactgcacct

SEQ ID NO: 346374 - DNA, 25 bp, Rattus norvegicus
gaggataaccttacatcttggcgaa

SEQ ID NO: 346375 - DNA, 25 bp, Rattus norvegicus
gaggataacctttcatcttggcgaa

SEQ ID NO: 346376 - DNA, 25 bp, Rattus norvegicus
gaggataagcagatgccactccgcc

SEQ ID NO: 346377 - DNA, 25 bp, Rattus norvegicus
gaggataagcagttgccactccgcc

SEQ ID NO: 346378 - DNA, 25 bp, Rattus norvegicus
gaggataagccaaaaccttccacac

SEQ ID NO: 346379 - DNA, 25 bp, Rattus norvegicus
gaggataagccataaccttccacac

SEQ ID NO: 346380 - DNA, 25 bp, Rattus norvegicus
gaggataatacaccccaatcccgtg

SEQ ID NO: 346381 - DNA, 25 bp, Rattus norvegicus
gaggataatacagcccaatcccgtg

SEQ ID NO: 346382 - DNA, 25 bp, Rattus norvegicus
gaggatacaggtctcgttctcgatc

SEQ ID NO: 346383 - DNA, 25 bp, Rattus norvegicus
gaggatacaggtgtcgttctcgatc

SEQ ID NO: 346384 - DNA, 25 bp, Rattus norvegicus
gaggatacatcccagctgcagagtc

SEQ ID NO: 346385 - DNA, 25 bp, Rattus norvegicus
gaggatacatccgagctgcagagtc

SEQ ID NO: 346386 - DNA, 25 bp, Rattus norvegicus
gaggatacccacatcaggttgctaa

SEQ ID NO: 346387 - DNA, 25 bp, Rattus norvegicus
gaggatacccacttcaggttgctaa

SEQ ID NO: 346388 - DNA, 25 bp, Rattus norvegicus
gaggatacctctattctcagctctt

SEQ ID NO: 346389 - DNA, 25 bp, Rattus norvegicus
gaggatacctcttttctcagctctt

SEQ ID NO: 346390 - DNA, 25 bp, Rattus norvegicus
gaggatacgaaaccccttgctctgg

SEQ ID NO: 346391 - DNA, 25 bp, Rattus norvegicus
gaggatacgaaagcccttgctctgg

SEQ ID NO: 346392 - DNA, 25 bp, Rattus norvegicus
gaggatactctaaaaccagaagcta

SEQ ID NO: 346393 - DNA, 25 bp, Rattus norvegicus
gaggatactctataaccagaagcta

SEQ ID NO: 346394 - DNA, 25 bp, Rattus norvegicus
gaggatactctcaagtttactttag

SEQ ID NO: 346395 - DNA, 25 bp, Rattus norvegicus
gaggatactctctagtttactttag

SEQ ID NO: 346396 - DNA, 25 bp, Rattus norvegicus
gaggatactcttattgagacaacaa

SEQ ID NO: 346397 - DNA, 25 bp, Rattus norvegicus
gaggatactctttttgagacaacaa

SEQ ID NO: 346398 - DNA, 25 bp, Rattus norvegicus
gaggatactgtcactgctgtcttca

SEQ ID NO: 346399 - DNA, 25 bp, Rattus norvegicus
gaggatactgtctctgctgtcttca

SEQ ID NO: 346400 - DNA, 25 bp, Rattus norvegicus
gaggatagaggcacctctcaccagg

SEQ ID NO: 346401 - DNA, 25 bp, Rattus norvegicus
gaggatagaggctcctctcaccagg

SEQ ID NO: 346402 - DNA, 25 bp, Rattus norvegicus
gaggatagcttaactgcatctcaga

SEQ ID NO: 346403 - DNA, 25 bp, Rattus norvegicus
gaggatagcttatctgcatctcaga

SEQ ID NO: 346404 - DNA, 25 bp, Rattus norvegicus
gaggatataaagctgcagtggccaa

SEQ ID NO: 346405 - DNA, 25 bp, Rattus norvegicus
gaggatataaaggtgcagtggccaa

SEQ ID NO: 346406 - DNA, 25 bp, Rattus norvegicus
gaggatatatacatcatattgacaa

SEQ ID NO: 346407 - DNA, 25 bp, Rattus norvegicus
gaggatatatacttcatattgacaa

SEQ ID NO: 346408 - DNA, 25 bp, Rattus norvegicus
gaggatatcctaacaggccttggcc

SEQ ID NO: 346409 - DNA, 25 bp, Rattus norvegicus
gaggatatcctatcaggccttggcc

SEQ ID NO: 346410 - DNA, 25 bp, Rattus norvegicus
gaggatatcctgcagcttctaattc

SEQ ID NO: 346411 - DNA, 25 bp, Rattus norvegicus
gaggatatcctggagcttctaattc

SEQ ID NO: 346412 - DNA, 25 bp, Rattus norvegicus
gaggatatccttccgtactgtaggc

SEQ ID NO: 346413 - DNA, 25 bp, Rattus norvegicus
gaggatatccttgcgtactgtaggc

SEQ ID NO: 346414 - DNA, 25 bp, Rattus norvegicus
gaggatatcttcaggagcgtgttaa

SEQ ID NO: 346415 - DNA, 25 bp, Rattus norvegicus
gaggatatcttctggagcgtgttaa

SEQ ID NO: 346416 - DNA, 25 bp, Rattus norvegicus
gaggatatgggaaggctaacgtaat

SEQ ID NO: 346417 - DNA, 25 bp, Rattus norvegicus
gaggatatgggatggctaacgtaat

SEQ ID NO: 346418 - DNA, 25 bp, Rattus norvegicus
gaggatatgtttacagctactgtct

SEQ ID NO: 346419 - DNA, 25 bp, Rattus norvegicus
gaggatatgttttcagctactgtct

SEQ ID NO: 346420 - DNA, 25 bp, Rattus norvegicus
gaggatattcccctgcaagttaata

SEQ ID NO: 346421 - DNA, 25 bp, Rattus norvegicus
gaggatattcccgtgcaagttaata

SEQ ID NO: 346422 - DNA, 25 bp, Rattus norvegicus
gaggatattgggactcagccctagg

SEQ ID NO: 346423 - DNA, 25 bp, Rattus norvegicus
gaggatattgggtctcagccctagg

SEQ ID NO: 346424 - DNA, 25 bp, Rattus norvegicus
gaggatcaaacccatgaccttaggt

SEQ ID NO: 346425 - DNA, 25 bp, Rattus norvegicus
gaggatcaaaccgatgaccttaggt

SEQ ID NO: 346426 - DNA, 25 bp, Rattus norvegicus
gaggatcaacatactctcttggtaa

SEQ ID NO: 346427 - DNA, 25 bp, Rattus norvegicus
gaggatcaacattctctcttggtaa

SEQ ID NO: 346428 - DNA, 25 bp, Rattus norvegicus
gaggatcacaccaaccacaaaggga

SEQ ID NO: 346429 - DNA, 25 bp, Rattus norvegicus
gaggatcacacctaccacaaaggga

SEQ ID NO: 346430 - DNA, 25 bp, Rattus norvegicus
gaggatcaccaaaggctgcccgggt

SEQ ID NO: 346431 - DNA, 25 bp, Rattus norvegicus
gaggatcaccaatggctgcccgggt

SEQ ID NO: 346432 - DNA, 25 bp, Rattus norvegicus
gaggatcaccacagggagactcaac

SEQ ID NO: 346433 - DNA, 25 bp, Rattus norvegicus
gaggatcaccactgggagactcaac

SEQ ID NO: 346434 - DNA, 25 bp, Rattus norvegicus
gaggatcacctaatgcaagaagcca

SEQ ID NO: 346435 - DNA, 25 bp, Rattus norvegicus
gaggatcacctattgcaagaagcca

SEQ ID NO: 346436 - DNA, 25 bp, Rattus norvegicus
gaggatcacgcccagcttcagagga

SEQ ID NO: 346437 - DNA, 25 bp, Rattus norvegicus
gaggatcacgccgagcttcagagga

SEQ ID NO: 346438 - DNA, 25 bp, Rattus norvegicus
gaggatcacgtgagcctgagtttcc

SEQ ID NO: 346439 - DNA, 25 bp, Rattus norvegicus
gaggatcacgtgtgcctgagtttcc

SEQ ID NO: 346440 - DNA, 25 bp, Rattus norvegicus
gaggatcactaaccaggtccatggt

SEQ ID NO: 346441 - DNA, 25 bp, Rattus norvegicus
gaggatcactaagcaggtccatggt

SEQ ID NO: 346442 - DNA, 25 bp, Rattus norvegicus
gaggatcactctacatggtgctggt

SEQ ID NO: 346443 - DNA, 25 bp, Rattus norvegicus
gaggatcactcttcatggtgctggt

SEQ ID NO: 346444 - DNA, 25 bp, Rattus norvegicus
gaggatcactttcttcaggagttcg

SEQ ID NO: 346445 - DNA, 25 bp, Rattus norvegicus
gaggatcactttgttcaggagttcg

SEQ ID NO: 346446 - DNA, 25 bp, Rattus norvegicus
gaggatcagaatcctaccgaactaa

SEQ ID NO: 346447 - DNA, 25 bp, Rattus norvegicus
gaggatcagaatgctaccgaactaa

SEQ ID NO: 346448 - DNA, 25 bp, Rattus norvegicus
gaggatcaggaaagcccatctcaga

SEQ ID NO: 346449 - DNA, 25 bp, Rattus norvegicus
gaggatcaggaatgcccatctcaga

SEQ ID NO: 346450 - DNA, 25 bp, Rattus norvegicus
gaggatcaggagatccctctcatcc

SEQ ID NO: 346451 - DNA, 25 bp, Rattus norvegicus
gaggatcaggagttccctctcatcc

SEQ ID NO: 346452 - DNA, 25 bp, Rattus norvegicus
gaggatcagtagatcaaagctagcc

SEQ ID NO: 346453 - DNA, 25 bp, Rattus norvegicus
gaggatcagtagttcaaagctagcc

SEQ ID NO: 346454 - DNA, 25 bp, Rattus norvegicus
gaggatcagtcccaggctacatgag

SEQ ID NO: 346455 - DNA, 25 bp, Rattus norvegicus
gaggatcagtccgaggctacatgag

SEQ ID NO: 346456 - DNA, 25 bp, Rattus norvegicus
gaggatcagttcagagtcatctttt

SEQ ID NO: 346457 - DNA, 25 bp, Rattus norvegicus
gaggatcagttctgagtcatctttt

SEQ ID NO: 346458 - DNA, 25 bp, Rattus norvegicus
gaggatcagttgcagcccgttacca

SEQ ID NO: 346459 - DNA, 25 bp, Rattus norvegicus
gaggatcagttggagcccgttacca

SEQ ID NO: 346460 - DNA, 25 bp, Rattus norvegicus
gaggatcatcgaatccgctttcgta

SEQ ID NO: 346461 - DNA, 25 bp, Rattus norvegicus
gaggatcatcgattccgctttcgta

SEQ ID NO: 346462 - DNA, 25 bp, Rattus norvegicus
gaggatcatttcatactgcacagca

SEQ ID NO: 346463 - DNA, 25 bp, Rattus norvegicus
gaggatcatttcctggacaagtcaa

SEQ ID NO: 346464 - DNA, 25 bp, Rattus norvegicus
gaggatcatttcgtggacaagtcaa

SEQ ID NO: 346465 - DNA, 25 bp, Rattus norvegicus
gaggatcatttcttactgcacagca

SEQ ID NO: 346466 - DNA, 25 bp, Rattus norvegicus
gaggatccagtgaactagacttaca

SEQ ID NO: 346467 - DNA, 25 bp, Rattus norvegicus
gaggatccagtgtactagacttaca

SEQ ID NO: 346468 - DNA, 25 bp, Rattus norvegicus
gaggatcccatcagagctggtgaaa

SEQ ID NO: 346469 - DNA, 25 bp, Rattus norvegicus
gaggatcccatctgagctggtgaaa

SEQ ID NO: 346470 - DNA, 25 bp, Rattus norvegicus
gaggatccctgaactgttttccaat

SEQ ID NO: 346471 - DNA, 25 bp, Rattus norvegicus
gaggatccctgatctgttttccaat

SEQ ID NO: 346472 - DNA, 25 bp, Rattus norvegicus
gaggatccgattatggctctcagca

SEQ ID NO: 346473 - DNA, 25 bp, Rattus norvegicus
gaggatccgattttggctctcagca

SEQ ID NO: 346474 - DNA, 25 bp, Rattus norvegicus
gaggatccggaaatcaaagtcaggt

SEQ ID NO: 346475 - DNA, 25 bp, Rattus norvegicus
gaggatccggaattcaaagtcaggt

SEQ ID NO: 346476 - DNA, 25 bp, Rattus norvegicus
gaggatcctaacatcaacgggaccg

SEQ ID NO: 346477 - DNA, 25 bp, Rattus norvegicus
gaggatcctaacttcaacgggaccg

SEQ ID NO: 346478 - DNA, 25 bp, Rattus norvegicus
gaggatcctaggcaagttcactgtt

SEQ ID NO: 346479 - DNA, 25 bp, Rattus norvegicus
gaggatcctagggaagttcactgtt

SEQ ID NO: 346480 - DNA, 25 bp, Rattus norvegicus
gaggatcctcaaattgcagcacatg

SEQ ID NO: 346481 - DNA, 25 bp, Rattus norvegicus
gaggatcctcaatttgcagcacatg

SEQ ID NO: 346482 - DNA, 25 bp, Rattus norvegicus
gaggatcctcgtctgatgacaagtc

SEQ ID NO: 346483 - DNA, 25 bp, Rattus norvegicus
gaggatcctcgtgtgatgacaagtc

SEQ ID NO: 346484 - DNA, 25 bp, Rattus norvegicus
gaggatcctctgagagttccgggat

SEQ ID NO: 346485 - DNA, 25 bp, Rattus norvegicus
gaggatcctctgtgagttccgggat

SEQ ID NO: 346486 - DNA, 25 bp, Rattus norvegicus
gaggatcctgaaaccagtagccaca

SEQ ID NO: 346487 - DNA, 25 bp, Rattus norvegicus
gaggatcctgaactatctgaactca

SEQ ID NO: 346488 - DNA, 25 bp, Rattus norvegicus
gaggatcctgaagtatctgaactca

SEQ ID NO: 346489 - DNA, 25 bp, Rattus norvegicus
gaggatcctgaatccagtagccaca

SEQ ID NO: 346490 - DNA, 25 bp, Rattus norvegicus
gaggatcctgctcgagctactgaat

SEQ ID NO: 346491 - DNA, 25 bp, Rattus norvegicus
gaggatcctgctggagctactgaat

SEQ ID NO: 346492 - DNA, 25 bp, Rattus norvegicus
gaggatccttacagtcttagagagc

SEQ ID NO: 346493 - DNA, 25 bp, Rattus norvegicus
gaggatccttactgtcttagagagc

SEQ ID NO: 346494 - DNA, 25 bp, Rattus norvegicus
gaggatccttctataacagctttaa

SEQ ID NO: 346495 - DNA, 25 bp, Rattus norvegicus
gaggatccttctttaacagctttaa

SEQ ID NO: 346496 - DNA, 25 bp, Rattus norvegicus
gaggatcgcttaccactgtaaactt

SEQ ID NO: 346497 - DNA, 25 bp, Rattus norvegicus
gaggatcgcttagcactgtaaactt

SEQ ID NO: 346498 - DNA, 25 bp, Rattus norvegicus
gaggatcgggtaaccaacattggct

SEQ ID NO: 346499 - DNA, 25 bp, Rattus norvegicus
gaggatcgggtatccaacattggct

SEQ ID NO: 346500 - DNA, 25 bp, Rattus norvegicus
gaggatctacatccttctcagtcag

SEQ ID NO: 346501 - DNA, 25 bp, Rattus norvegicus
gaggatctacatgcttctcagtcag

SEQ ID NO: 346502 - DNA, 25 bp, Rattus norvegicus
gaggatctactgaatgagtgcatgc

SEQ ID NO: 346503 - DNA, 25 bp, Rattus norvegicus
gaggatctactgaggtctgaagacc

SEQ ID NO: 346504 - DNA, 25 bp, Rattus norvegicus
gaggatctactgtatgagtgcatgc

SEQ ID NO: 346505 - DNA, 25 bp, Rattus norvegicus
gaggatctactgtggtctgaagacc

SEQ ID NO: 346506 - DNA, 25 bp, Rattus norvegicus
gaggatctagataccagtgcacact

SEQ ID NO: 346507 - DNA, 25 bp, Rattus norvegicus
gaggatctagattccagtgcacact

SEQ ID NO: 346508 - DNA, 25 bp, Rattus norvegicus
gaggatctatgtcaggctacacttc

SEQ ID NO: 346509 - DNA, 25 bp, Rattus norvegicus
gaggatctatgtgaggctacacttc

SEQ ID NO: 346510 - DNA, 25 bp, Rattus norvegicus
gaggatctcacactttgtaaagcac

SEQ ID NO: 346511 - DNA, 25 bp, Rattus norvegicus
gaggatctcacagtttgtaaagcac

SEQ ID NO: 346512 - DNA, 25 bp, Rattus norvegicus
gaggatctcagcaaatgctctccga

SEQ ID NO: 346513 - DNA, 25 bp, Rattus norvegicus
gaggatctcagcaggagtcccaaga

SEQ ID NO: 346514 - DNA, 25 bp, Rattus norvegicus
gaggatctcagctaatgctctccga

SEQ ID NO: 346515 - DNA, 25 bp, Rattus norvegicus
gaggatctcagctggagtcccaaga

SEQ ID NO: 346516 - DNA, 25 bp, Rattus norvegicus
gaggatctcataccccagactagaa

SEQ ID NO: 346517 - DNA, 25 bp, Rattus norvegicus
gaggatctcatagcccagactagaa

SEQ ID NO: 346518 - DNA, 25 bp, Rattus norvegicus
gaggatctccttatatagcagccaa

SEQ ID NO: 346519 - DNA, 25 bp, Rattus norvegicus
gaggatctccttttatagcagccaa

SEQ ID NO: 346520 - DNA, 25 bp, Rattus norvegicus
gaggatctgaacacacgcctgatat

SEQ ID NO: 346521 - DNA, 25 bp, Rattus norvegicus
gaggatctgaactcacgcctgatat

SEQ ID NO: 346522 - DNA, 25 bp, Rattus norvegicus
gaggatctgatacccacctatgtgg

SEQ ID NO: 346523 - DNA, 25 bp, Rattus norvegicus
gaggatctgatagccacctatgtgg

SEQ ID NO: 346524 - DNA, 25 bp, Rattus norvegicus
gaggatctgattaataccctcttct

SEQ ID NO: 346525 - DNA, 25 bp, Rattus norvegicus
gaggatctgatttataccctcttct

SEQ ID NO: 346526 - DNA, 25 bp, Rattus norvegicus
gaggatctgcctctattctggagaa

SEQ ID NO: 346527 - DNA, 25 bp, Rattus norvegicus
gaggatctgcctgtattctggagaa

SEQ ID NO: 346528 - DNA, 25 bp, Rattus norvegicus
gaggatctgcgcagagaccatcgcg

SEQ ID NO: 346529 - DNA, 25 bp, Rattus norvegicus
gaggatctgcgctgagaccatcgcg

SEQ ID NO: 346530 - DNA, 25 bp, Rattus norvegicus
gaggatctgtttaactgtcacccag

SEQ ID NO: 346531 - DNA, 25 bp, Rattus norvegicus
gaggatctgttttactgtcacccag

SEQ ID NO: 346532 - DNA, 25 bp, Rattus norvegicus
gaggatcttcagagagtgggctaaa

SEQ ID NO: 346533 - DNA, 25 bp, Rattus norvegicus
gaggatcttcagtgagtgggctaaa

SEQ ID NO: 346534 - DNA, 25 bp, Rattus norvegicus
gaggatcttcggcacacctttgcgg

SEQ ID NO: 346535 - DNA, 25 bp, Rattus norvegicus
gaggatcttcgggacacctttgcgg

SEQ ID NO: 346536 - DNA, 25 bp, Rattus norvegicus
gaggatcttgagatggagcccagcc

SEQ ID NO: 346537 - DNA, 25 bp, Rattus norvegicus
gaggatcttgagttggagcccagcc

SEQ ID NO: 346538 - DNA, 25 bp, Rattus norvegicus
gaggatcttgggattgttgcagaca

SEQ ID NO: 346539 - DNA, 25 bp, Rattus norvegicus
gaggatcttgggtttgttgcagaca

SEQ ID NO: 346540 - DNA, 25 bp, Rattus norvegicus
gaggatctttccagagctgtgcaca

SEQ ID NO: 346541 - DNA, 25 bp, Rattus norvegicus
gaggatctttcctgagctgtgcaca

SEQ ID NO: 346542 - DNA, 25 bp, Rattus norvegicus
gaggatctttcgactgctagggaca

SEQ ID NO: 346543 - DNA, 25 bp, Rattus norvegicus
gaggatctttcgtctgctagggaca

SEQ ID NO: 346544 - DNA, 25 bp, Rattus norvegicus
gaggatgaaactcctatttgtcttt

SEQ ID NO: 346545 - DNA, 25 bp, Rattus norvegicus
gaggatgaaactgctatttgtcttt

SEQ ID NO: 346546 - DNA, 25 bp, Rattus norvegicus
gaggatgaacctcaagttactctca

SEQ ID NO: 346547 - DNA, 25 bp, Rattus norvegicus
gaggatgaacctgaagttactctca

SEQ ID NO: 346548 - DNA, 25 bp, Rattus norvegicus
gaggatgaactcagttgcttttcaa

SEQ ID NO: 346549 - DNA, 25 bp, Rattus norvegicus
gaggatgaactcatccagtcaatca

SEQ ID NO: 346550 - DNA, 25 bp, Rattus norvegicus
gaggatgaactctgttgcttttcaa

SEQ ID NO: 346551 - DNA, 25 bp, Rattus norvegicus
gaggatgaactcttccagtcaatca

SEQ ID NO: 346552 - DNA, 25 bp, Rattus norvegicus
gaggatgaagacaaagcagtgacca

SEQ ID NO: 346553 - DNA, 25 bp, Rattus norvegicus
gaggatgaagactaagcagtgacca

SEQ ID NO: 346554 - DNA, 25 bp, Rattus norvegicus
gaggatgaagcaccacagacccaga

SEQ ID NO: 346555 - DNA, 25 bp, Rattus norvegicus
gaggatgaagcagcacagacccaga

SEQ ID NO: 346556 - DNA, 25 bp, Rattus norvegicus
gaggatgaagcccttagtctgctct

SEQ ID NO: 346557 - DNA, 25 bp, Rattus norvegicus
gaggatgaagccgttagtctgctct

SEQ ID NO: 346558 - DNA, 25 bp, Rattus norvegicus
gaggatgaagtcagccgctttctgg

SEQ ID NO: 346559 - DNA, 25 bp, Rattus norvegicus
gaggatgaagtctgccgctttctgg

SEQ ID NO: 346560 - DNA, 25 bp, Rattus norvegicus
gaggatgaatggagccttgctcatt

SEQ ID NO: 346561 - DNA, 25 bp, Rattus norvegicus
gaggatgaatggtgccttgctcatt

SEQ ID NO: 346562 - DNA, 25 bp, Rattus norvegicus
gaggatgacatgatttaggccagcc

SEQ ID NO: 346563 - DNA, 25 bp, Rattus norvegicus
gaggatgacatgttttaggccagcc

SEQ ID NO: 346564 - DNA, 25 bp, Rattus norvegicus
gaggatgacccacactactgcgtat

SEQ ID NO: 346565 - DNA, 25 bp, Rattus norvegicus
gaggatgacccagactactgcgtat

SEQ ID NO: 346566 - DNA, 25 bp, Rattus norvegicus
gaggatgaccctatagcaagaccag

SEQ ID NO: 346567 - DNA, 25 bp, Rattus norvegicus
gaggatgaccctttagcaagaccag

SEQ ID NO: 346568 - DNA, 25 bp, Rattus norvegicus
gaggatgacctcatcaggctgagta

SEQ ID NO: 346569 - DNA, 25 bp, Rattus norvegicus
gaggatgacctccagtttaaagaca

SEQ ID NO: 346570 - DNA, 25 bp, Rattus norvegicus
gaggatgacctcgagtttaaagaca

SEQ ID NO: 346571 - DNA, 25 bp, Rattus norvegicus
gaggatgacctcttcaggctgagta

SEQ ID NO: 346572 - DNA, 25 bp, Rattus norvegicus
gaggatgaccttctgggcaatgcaa

SEQ ID NO: 346573 - DNA, 25 bp, Rattus norvegicus
gaggatgaccttgtgggcaatgcaa

SEQ ID NO: 346574 - DNA, 25 bp, Rattus norvegicus
gaggatgacgagcagacattgcccc

SEQ ID NO: 346575 - DNA, 25 bp, Rattus norvegicus
gaggatgacgaggagacattgcccc

SEQ ID NO: 346576 - DNA, 25 bp, Rattus norvegicus
gaggatgactgtatgagtctagcct

SEQ ID NO: 346577 - DNA, 25 bp, Rattus norvegicus
gaggatgactgtttgagtctagcct

SEQ ID NO: 346578 - DNA, 25 bp, Rattus norvegicus
gaggatgactttaaacttggtccaa

SEQ ID NO: 346579 - DNA, 25 bp, Rattus norvegicus
gaggatgacttttaacttggtccaa

SEQ ID NO: 346580 - DNA, 25 bp, Rattus norvegicus
gaggatgagatcagcacacttcatt

SEQ ID NO: 346581 - DNA, 25 bp, Rattus norvegicus
gaggatgagatctgcacacttcatt

SEQ ID NO: 346582 - DNA, 25 bp, Rattus norvegicus
gaggatgagcaaccccatgcgcatg

SEQ ID NO: 346583 - DNA, 25 bp, Rattus norvegicus
gaggatgagcaagcccatgcgcatg

SEQ ID NO: 346584 - DNA, 25 bp, Rattus norvegicus
gaggatgagcccagcactgatcggt

SEQ ID NO: 346585 - DNA, 25 bp, Rattus norvegicus
gaggatgagccctgcactgatcggt

SEQ ID NO: 346586 - DNA, 25 bp, Rattus norvegicus
gaggatgagctcactccgaatgctg

SEQ ID NO: 346587 - DNA, 25 bp, Rattus norvegicus
gaggatgagctctctccgaatgctg

SEQ ID NO: 346588 - DNA, 25 bp, Rattus norvegicus
gaggatgaggccagcatagtctaca

SEQ ID NO: 346589 - DNA, 25 bp, Rattus norvegicus
gaggatgaggcctgcatagtctaca

SEQ ID NO: 346590 - DNA, 25 bp, Rattus norvegicus
gaggatgagtccatgttgcctccac

SEQ ID NO: 346591 - DNA, 25 bp, Rattus norvegicus
gaggatgagtccttgttgcctccac

SEQ ID NO: 346592 - DNA, 25 bp, Rattus norvegicus
gaggatgatgtcatcacctcgcctt

SEQ ID NO: 346593 - DNA, 25 bp, Rattus norvegicus
gaggatgatgtcttcacctcgcctt

SEQ ID NO: 346594 - DNA, 25 bp, Rattus norvegicus
gaggatgcaacaacaccctaatggc

SEQ ID NO: 346595 - DNA, 25 bp, Rattus norvegicus
gaggatgcaacatcaccctaatggc

SEQ ID NO: 346596 - DNA, 25 bp, Rattus norvegicus
gaggatgcagacagcactgccaacc

SEQ ID NO: 346597 - DNA, 25 bp, Rattus norvegicus
gaggatgcagactgcactgccaacc

SEQ ID NO: 346598 - DNA, 25 bp, Rattus norvegicus
gaggatgcagtgacccaacctggga

SEQ ID NO: 346599 - DNA, 25 bp, Rattus norvegicus
gaggatgcagtgtcccaacctggga

SEQ ID NO: 346600 - DNA, 25 bp, Rattus norvegicus
gaggatgcagttcgcctctgagtct

SEQ ID NO: 346601 - DNA, 25 bp, Rattus norvegicus
gaggatgcagttggcctctgagtct

SEQ ID NO: 346602 - DNA, 25 bp, Rattus norvegicus
gaggatgcattcctaggcatagatt

SEQ ID NO: 346603 - DNA, 25 bp, Rattus norvegicus
gaggatgcattcgtaggcatagatt

SEQ ID NO: 346604 - DNA, 25 bp, Rattus norvegicus
gaggatgccaacctgtatctggcca

SEQ ID NO: 346605 - DNA, 25 bp, Rattus norvegicus
gaggatgccaacgtgtatctggcca

SEQ ID NO: 346606 - DNA, 25 bp, Rattus norvegicus
gaggatgccagaactctctaggaga

SEQ ID NO: 346607 - DNA, 25 bp, Rattus norvegicus
gaggatgccagatctctctaggaga

SEQ ID NO: 346608 - DNA, 25 bp, Rattus norvegicus
gaggatgccattccaaatgtcccag

SEQ ID NO: 346609 - DNA, 25 bp, Rattus norvegicus
gaggatgccattgcaaatgtcccag

SEQ ID NO: 346610 - DNA, 25 bp, Rattus norvegicus
gaggatgcccaacgtatggactcat

SEQ ID NO: 346611 - DNA, 25 bp, Rattus norvegicus
gaggatgcccaaggtatggactcat

SEQ ID NO: 346612 - DNA, 25 bp, Rattus norvegicus
gaggatgcctttccacatgtggcca

SEQ ID NO: 346613 - DNA, 25 bp, Rattus norvegicus
gaggatgcctttgcacatgtggcca

SEQ ID NO: 346614 - DNA, 25 bp, Rattus norvegicus
gaggatgctcacctaacaggcactg

SEQ ID NO: 346615 - DNA, 25 bp, Rattus norvegicus
gaggatgctcacgtaacaggcactg

SEQ ID NO: 346616 - DNA, 25 bp, Rattus norvegicus
gaggatgctcggctgatacttcaca

SEQ ID NO: 346617 - DNA, 25 bp, Rattus norvegicus
gaggatgctcgggtgatacttcaca

SEQ ID NO: 346618 - DNA, 25 bp, Rattus norvegicus
gaggatgctctcatgttacaaataa

SEQ ID NO: 346619 - DNA, 25 bp, Rattus norvegicus
gaggatgctctcttgttacaaataa

SEQ ID NO: 346620 - DNA, 25 bp, Rattus norvegicus
gaggatgctggcaccgtagtgataa

SEQ ID NO: 346621 - DNA, 25 bp, Rattus norvegicus
gaggatgctggctccgtagtgataa

SEQ ID NO: 346622 - DNA, 25 bp, Rattus norvegicus
gaggatgctgtcatgttgttactga

SEQ ID NO: 346623 - DNA, 25 bp, Rattus norvegicus
gaggatgctgtcttgttgttactga

SEQ ID NO: 346624 - DNA, 25 bp, Rattus norvegicus
gaggatgcttaaatctacaatgcat

SEQ ID NO: 346625 - DNA, 25 bp, Rattus norvegicus
gaggatgcttaattctacaatgcat

SEQ ID NO: 346626 - DNA, 25 bp, Rattus norvegicus
gaggatgcttgcactgaggtccaga

SEQ ID NO: 346627 - DNA, 25 bp, Rattus norvegicus
gaggatgcttgctctgaggtccaga

SEQ ID NO: 346628 - DNA, 25 bp, Rattus norvegicus
gaggatgctttccaagcacggtgct

SEQ ID NO: 346629 - DNA, 25 bp, Rattus norvegicus
gaggatgctttcgaagcacggtgct

SEQ ID NO: 346630 - DNA, 25 bp, Rattus norvegicus
gaggatggcccgaaagcctttaata

SEQ ID NO: 346631 - DNA, 25 bp, Rattus norvegicus
gaggatggcccgtaagcctttaata

SEQ ID NO: 346632 - DNA, 25 bp, Rattus norvegicus
gaggatggccctagtcagactcaat

SEQ ID NO: 346633 - DNA, 25 bp, Rattus norvegicus
gaggatggcccttgtcagactcaat

SEQ ID NO: 346634 - DNA, 25 bp, Rattus norvegicus
gaggatggctccattatcggacaat

SEQ ID NO: 346635 - DNA, 25 bp, Rattus norvegicus
gaggatggctcctttatcggacaat

SEQ ID NO: 346636 - DNA, 25 bp, Rattus norvegicus
gaggatggctggatccgtgtctcca

SEQ ID NO: 346637 - DNA, 25 bp, Rattus norvegicus
gaggatggctggttccgtgtctcca

SEQ ID NO: 346638 - DNA, 25 bp, Rattus norvegicus
gaggatgggactatctacctcccaa

SEQ ID NO: 346639 - DNA, 25 bp, Rattus norvegicus
gaggatgggactttctacctcccaa

SEQ ID NO: 346640 - DNA, 25 bp, Rattus norvegicus
gaggatgggagcacaaccactttat

SEQ ID NO: 346641 - DNA, 25 bp, Rattus norvegicus
gaggatgggagctcaaccactttat

SEQ ID NO: 346642 - DNA, 25 bp, Rattus norvegicus
gaggatgggctcaggcattcagtat

SEQ ID NO: 346643 - DNA, 25 bp, Rattus norvegicus
gaggatgggctctggcattcagtat

SEQ ID NO: 346644 - DNA, 25 bp, Rattus norvegicus
gaggatggtagtaggttccctgtca

SEQ ID NO: 346645 - DNA, 25 bp, Rattus norvegicus
gaggatggtagttggttccctgtca

SEQ ID NO: 346646 - DNA, 25 bp, Rattus norvegicus
gaggatgtaagaatcccctatagct

SEQ ID NO: 346647 - DNA, 25 bp, Rattus norvegicus
gaggatgtaagattcccctatagct

SEQ ID NO: 346648 - DNA, 25 bp, Rattus norvegicus
gaggatgtcacccatgtaccagaac

SEQ ID NO: 346649 - DNA, 25 bp, Rattus norvegicus
gaggatgtcaccgatgtaccagaac

SEQ ID NO: 346650 - DNA, 25 bp, Rattus norvegicus
gaggatgtccacagaagacccgtat

SEQ ID NO: 346651 - DNA, 25 bp, Rattus norvegicus
gaggatgtccactgaagacccgtat

SEQ ID NO: 346652 - DNA, 25 bp, Rattus norvegicus
gaggatgtccgcacacggagcaagt

SEQ ID NO: 346653 - DNA, 25 bp, Rattus norvegicus
gaggatgtccgctcacggagcaagt

SEQ ID NO: 346654 - DNA, 25 bp, Rattus norvegicus
gaggatgtcgctcggtttctgatct

SEQ ID NO: 346655 - DNA, 25 bp, Rattus norvegicus
gaggatgtcgctgggtttctgatct

SEQ ID NO: 346656 - DNA, 25 bp, Rattus norvegicus
gaggatgtctcgcttactttaatac

SEQ ID NO: 346657 - DNA, 25 bp, Rattus norvegicus
gaggatgtctcggttactttaatac

SEQ ID NO: 346658 - DNA, 25 bp, Rattus norvegicus
gaggatgtctgtcccttgatgtaac

SEQ ID NO: 346659 - DNA, 25 bp, Rattus norvegicus
gaggatgtctgtgccttgatgtaac

SEQ ID NO: 346660 - DNA, 25 bp, Rattus norvegicus
gaggatgtcttcacttctaatctgt

SEQ ID NO: 346661 - DNA, 25 bp, Rattus norvegicus
gaggatgtcttctcttctaatctgt

SEQ ID NO: 346662 - DNA, 25 bp, Rattus norvegicus
gaggatgtgctaagaggttgcaaac

SEQ ID NO: 346663 - DNA, 25 bp, Rattus norvegicus
gaggatgtgctatgaggttgcaaac

SEQ ID NO: 346664 - DNA, 25 bp, Rattus norvegicus
gaggatgtgtaacctgtcacgctca

SEQ ID NO: 346665 - DNA, 25 bp, Rattus norvegicus
gaggatgtgtaagctgtcacgctca

SEQ ID NO: 346666 - DNA, 25 bp, Rattus norvegicus
gaggatgtgtctctggacttcacct

SEQ ID NO: 346667 - DNA, 25 bp, Rattus norvegicus
gaggatgtgtctgtggacttcacct

SEQ ID NO: 346668 - DNA, 25 bp, Rattus norvegicus
gaggatgttcaaaacctgggccatg

SEQ ID NO: 346669 - DNA, 25 bp, Rattus norvegicus
gaggatgttcaatacctgggccatg

SEQ ID NO: 346670 - DNA, 25 bp, Rattus norvegicus
gaggatgttcagctggacccacgca

SEQ ID NO: 346671 - DNA, 25 bp, Rattus norvegicus
gaggatgttcaggtggacccacgca

SEQ ID NO: 346672 - DNA, 25 bp, Rattus norvegicus
gaggatgttggcctcactgaatcat

SEQ ID NO: 346673 - DNA, 25 bp, Rattus norvegicus
gaggatgttggcgtcactgaatcat

SEQ ID NO: 346674 - DNA, 25 bp, Rattus norvegicus
gaggatgttttcacagacctcctga

SEQ ID NO: 346675 - DNA, 25 bp, Rattus norvegicus
gaggatgttttcagtacccaggtta

SEQ ID NO: 346676 - DNA, 25 bp, Rattus norvegicus
gaggatgttttctcagacctcctga

SEQ ID NO: 346677 - DNA, 25 bp, Rattus norvegicus
gaggatgttttctgtacccaggtta

SEQ ID NO: 346678 - DNA, 25 bp, Rattus norvegicus
gaggattaacttcttacgatgagga

SEQ ID NO: 346679 - DNA, 25 bp, Rattus norvegicus
gaggattaacttgttacgatgagga

SEQ ID NO: 346680 - DNA, 25 bp, Rattus norvegicus
gaggattaattgaagcatttcactg

SEQ ID NO: 346681 - DNA, 25 bp, Rattus norvegicus
gaggattaattgtagcatttcactg

SEQ ID NO: 346682 - DNA, 25 bp, Rattus norvegicus
gaggattacatcaacgaccggcagt

SEQ ID NO: 346683 - DNA, 25 bp, Rattus norvegicus
gaggattacatctacgaccggcagt

SEQ ID NO: 346684 - DNA, 25 bp, Rattus norvegicus
gaggattaccatatgccagtgacca

SEQ ID NO: 346685 - DNA, 25 bp, Rattus norvegicus
gaggattaccatttgccagtgacca

SEQ ID NO: 346686 - DNA, 25 bp, Rattus norvegicus
gaggattacgtcagtgtggctgctt

SEQ ID NO: 346687 - DNA, 25 bp, Rattus norvegicus
gaggattacgtctgtgtggctgctt

SEQ ID NO: 346688 - DNA, 25 bp, Rattus norvegicus
gaggattacttacgccatgagatca

SEQ ID NO: 346689 - DNA, 25 bp, Rattus norvegicus
gaggattacttaggccatgagatca

SEQ ID NO: 346690 - DNA, 25 bp, Rattus norvegicus
gaggattacttcatccagctcaaga

SEQ ID NO: 346691 - DNA, 25 bp, Rattus norvegicus
gaggattacttcttccagctcaaga

SEQ ID NO: 346692 - DNA, 25 bp, Rattus norvegicus
gaggattagcagctctttgcaccaa

SEQ ID NO: 346693 - DNA, 25 bp, Rattus norvegicus
gaggattagcaggtctttgcaccaa

SEQ ID NO: 346694 - DNA, 25 bp, Rattus norvegicus
gaggattatcacacctgtagcaatt

SEQ ID NO: 346695 - DNA, 25 bp, Rattus norvegicus
gaggattatcactcctgtagcaatt

SEQ ID NO: 346696 - DNA, 25 bp, Rattus norvegicus
gaggattatcagcagaacgcacttt

SEQ ID NO: 346697 - DNA, 25 bp, Rattus norvegicus
gaggattatcaggagaacgcacttt

SEQ ID NO: 346698 - DNA, 25 bp, Rattus norvegicus
gaggattcaactacaaaaggtggca

SEQ ID NO: 346699 - DNA, 25 bp, Rattus norvegicus
gaggattcaacttcaaaaggtggca

SEQ ID NO: 346700 - DNA, 25 bp, Rattus norvegicus
gaggattcacacagcacggtcaaga

SEQ ID NO: 346701 - DNA, 25 bp, Rattus norvegicus
gaggattcacacagtaatattcaca

SEQ ID NO: 346702 - DNA, 25 bp, Rattus norvegicus
gaggattcacactgcacggtcaaga

SEQ ID NO: 346703 - DNA, 25 bp, Rattus norvegicus
gaggattcacactgtaatattcaca

SEQ ID NO: 346704 - DNA, 25 bp, Rattus norvegicus
gaggattcactgctttcttttcata

SEQ ID NO: 346705 - DNA, 25 bp, Rattus norvegicus
gaggattcactggtttcttttcata

SEQ ID NO: 346706 - DNA, 25 bp, Rattus norvegicus
gaggattcagtaagatgccccatgt

SEQ ID NO: 346707 - DNA, 25 bp, Rattus norvegicus
gaggattcagtatgatgccccatgt

SEQ ID NO: 346708 - DNA, 25 bp, Rattus norvegicus
gaggattcctctctaaaaatttaca

SEQ ID NO: 346709 - DNA, 25 bp, Rattus norvegicus
gaggattcctctgtaaaaatttaca

SEQ ID NO: 346710 - DNA, 25 bp, Rattus norvegicus
gaggattcctgccaattgtgcagtc

SEQ ID NO: 346711 - DNA, 25 bp, Rattus norvegicus
gaggattcctgcgaattgtgcagtc

SEQ ID NO: 346712 - DNA, 25 bp, Rattus norvegicus
gaggattcctggagtgtgttgctcc

SEQ ID NO: 346713 - DNA, 25 bp, Rattus norvegicus
gaggattcctggtgtgtgttgctcc

SEQ ID NO: 346714 - DNA, 25 bp, Rattus norvegicus
gaggattccttgagtctacaacttc

SEQ ID NO: 346715 - DNA, 25 bp, Rattus norvegicus
gaggattccttgtgtctacaacttc

SEQ ID NO: 346716 - DNA, 25 bp, Rattus norvegicus
gaggattcgataactgttcttcaac

SEQ ID NO: 346717 - DNA, 25 bp, Rattus norvegicus
gaggattcgatatctgttcttcaac

SEQ ID NO: 346718 - DNA, 25 bp, Rattus norvegicus
gaggattcgcatagtgcaattgctt

SEQ ID NO: 346719 - DNA, 25 bp, Rattus norvegicus
gaggattcgcattgtgcaattgctt

SEQ ID NO: 346720 - DNA, 25 bp, Rattus norvegicus
gaggattcggagacgcctggaacac

SEQ ID NO: 346721 - DNA, 25 bp, Rattus norvegicus
gaggattcggagtcgcctggaacac

SEQ ID NO: 346722 - DNA, 25 bp, Rattus norvegicus
gaggattctataactgtgccagaga

SEQ ID NO: 346723 - DNA, 25 bp, Rattus norvegicus
gaggattctatatctgtgccagaga

SEQ ID NO: 346724 - DNA, 25 bp, Rattus norvegicus
gaggattcttgaacctgtacacaat

SEQ ID NO: 346725 - DNA, 25 bp, Rattus norvegicus
gaggattcttgatcctgtacacaat

SEQ ID NO: 346726 - DNA, 25 bp, Rattus norvegicus
gaggattcttgtctcactgttacta

SEQ ID NO: 346727 - DNA, 25 bp, Rattus norvegicus
gaggattcttgtgtcactgttacta

SEQ ID NO: 346728 - DNA, 25 bp, Rattus norvegicus
gaggattgccagagattcgaggtaa

SEQ ID NO: 346729 - DNA, 25 bp, Rattus norvegicus
gaggattgccagtgattcgaggtaa

SEQ ID NO: 346730 - DNA, 25 bp, Rattus norvegicus
gaggattgctgccagcttgcacttt

SEQ ID NO: 346731 - DNA, 25 bp, Rattus norvegicus
gaggattgctgcgagcttgcacttt

SEQ ID NO: 346732 - DNA, 25 bp, Rattus norvegicus
gaggattggccaactaaacatcaag

SEQ ID NO: 346733 - DNA, 25 bp, Rattus norvegicus
gaggattggccatctaaacatcaag

SEQ ID NO: 346734 - DNA, 25 bp, Rattus norvegicus
gaggattgtcctagtcacggcccgg

SEQ ID NO: 346735 - DNA, 25 bp, Rattus norvegicus
gaggattgtccttgtcacggcccgg

SEQ ID NO: 346736 - DNA, 25 bp, Rattus norvegicus
gaggattgtgtaacagtgtccagaa

SEQ ID NO: 346737 - DNA, 25 bp, Rattus norvegicus
gaggattgtgtatcagtgtccagaa

SEQ ID NO: 346738 - DNA, 25 bp, Rattus norvegicus
gaggatttaatgctctccggaacat

SEQ ID NO: 346739 - DNA, 25 bp, Rattus norvegicus
gaggatttaatggtctccggaacat

SEQ ID NO: 346740 - DNA, 25 bp, Rattus norvegicus
gaggatttacatcaagcacccacac

SEQ ID NO: 346741 - DNA, 25 bp, Rattus norvegicus
gaggatttacatgaagcacccacac

SEQ ID NO: 346742 - DNA, 25 bp, Rattus norvegicus
gaggatttagttaaaccgactctga

SEQ ID NO: 346743 - DNA, 25 bp, Rattus norvegicus
gaggatttagtttaaccgactctga

SEQ ID NO: 346744 - DNA, 25 bp, Rattus norvegicus
gaggatttcagaccctgcctcattt

SEQ ID NO: 346745 - DNA, 25 bp, Rattus norvegicus
gaggatttcagagcctgcctcattt

SEQ ID NO: 346746 - DNA, 25 bp, Rattus norvegicus
gaggatttcaggatcaaggctatat

SEQ ID NO: 346747 - DNA, 25 bp, Rattus norvegicus
gaggatttcaggctgtcttccaact

SEQ ID NO: 346748 - DNA, 25 bp, Rattus norvegicus
gaggatttcagggtgtcttccaact

SEQ ID NO: 346749 - DNA, 25 bp, Rattus norvegicus
gaggatttcaggttcaaggctatat

SEQ ID NO: 346750 - DNA, 25 bp, Rattus norvegicus
gaggatttccaaagtgtctaccatt

SEQ ID NO: 346751 - DNA, 25 bp, Rattus norvegicus
gaggatttccaatgtgtctaccatt

SEQ ID NO: 346752 - DNA, 25 bp, Rattus norvegicus
gaggatttcccacttttgacacatg

SEQ ID NO: 346753 - DNA, 25 bp, Rattus norvegicus
gaggatttcccagttttgacacatg

SEQ ID NO: 346754 - DNA, 25 bp, Rattus norvegicus
gaggatttcctgatgccactagaac

SEQ ID NO: 346755 - DNA, 25 bp, Rattus norvegicus
gaggatttcctgttgccactagaac

SEQ ID NO: 346756 - DNA, 25 bp, Rattus norvegicus
gaggatttctctaaagccattgctt

SEQ ID NO: 346757 - DNA, 25 bp, Rattus norvegicus
gaggatttctcttaagccattgctt

SEQ ID NO: 346758 - DNA, 25 bp, Rattus norvegicus
gaggatttgacaaagtgagccacaa

SEQ ID NO: 346759 - DNA, 25 bp, Rattus norvegicus
gaggatttgacatagtgagccacaa

SEQ ID NO: 346760 - DNA, 25 bp, Rattus norvegicus
gaggatttgagcagtcggtctccca

SEQ ID NO: 346761 - DNA, 25 bp, Rattus norvegicus
gaggatttgagctgtcggtctccca

SEQ ID NO: 346762 - DNA, 25 bp, Rattus norvegicus
gaggattttaccagacggtcaactg

SEQ ID NO: 346763 - DNA, 25 bp, Rattus norvegicus
gaggattttacctgacggtcaactg

SEQ ID NO: 346764 - DNA, 25 bp, Rattus norvegicus
gaggattttatgcttcccatgtctg

SEQ ID NO: 346765 - DNA, 25 bp, Rattus norvegicus
gaggattttatggttcccatgtctg

SEQ ID NO: 346766 - DNA, 25 bp, Rattus norvegicus
gaggattttcacattgcatctagat

SEQ ID NO: 346767 - DNA, 25 bp, Rattus norvegicus
gaggattttcactttgcatctagat

SEQ ID NO: 346768 - DNA, 25 bp, Rattus norvegicus
gaggattttggaactctatgctaat

SEQ ID NO: 346769 - DNA, 25 bp, Rattus norvegicus
gaggattttggatctctatgctaat

SEQ ID NO: 346770 - DNA, 25 bp, Rattus norvegicus
gaggatttttcaagctccgggctgg

SEQ ID NO: 346771 - DNA, 25 bp, Rattus norvegicus
gaggatttttcactatgtgcctagc

SEQ ID NO: 346772 - DNA, 25 bp, Rattus norvegicus
gaggatttttcagtatgtgcctagc

SEQ ID NO: 346773 - DNA, 25 bp, Rattus norvegicus
gaggatttttcatgctccgggctgg

SEQ ID NO: 346774 - DNA, 25 bp, Rattus norvegicus
gaggcaaaaatgatggtcgctaaca

SEQ ID NO: 346775 - DNA, 25 bp, Rattus norvegicus
gaggcaaaaatgttggtcgctaaca

SEQ ID NO: 346776 - DNA, 25 bp, Rattus norvegicus
gaggcaaaaccactcaggtctcctg

SEQ ID NO: 346777 - DNA, 25 bp, Rattus norvegicus
gaggcaaaaccagtcaggtctcctg

SEQ ID NO: 346778 - DNA, 25 bp, Rattus norvegicus
gaggcaaaaccccagccgcggcgcc

SEQ ID NO: 346779 - DNA, 25 bp, Rattus norvegicus
gaggcaaaacccgagccgcggcgcc

SEQ ID NO: 346780 - DNA, 25 bp, Rattus norvegicus
gaggcaaacagacccctgagttcaa

SEQ ID NO: 346781 - DNA, 25 bp, Rattus norvegicus
gaggcaaacagagccctgagttcaa

SEQ ID NO: 346782 - DNA, 25 bp, Rattus norvegicus
gaggcaaaccccaagaccatgaatg

SEQ ID NO: 346783 - DNA, 25 bp, Rattus norvegicus
gaggcaaacccctagaccatgaatg

SEQ ID NO: 346784 - DNA, 25 bp, Rattus norvegicus
gaggcaaagccaaggagctgacact

SEQ ID NO: 346785 - DNA, 25 bp, Rattus norvegicus
gaggcaaagccatggagctgacact

SEQ ID NO: 346786 - DNA, 25 bp, Rattus norvegicus
gaggcaaagcggaccctgtttacag

SEQ ID NO: 346787 - DNA, 25 bp, Rattus norvegicus
gaggcaaagcggtccctgtttacag

SEQ ID NO: 346788 - DNA, 25 bp, Rattus norvegicus
gaggcaaaggctacggtggccactt

SEQ ID NO: 346789 - DNA, 25 bp, Rattus norvegicus
gaggcaaaggcttcggtggccactt

SEQ ID NO: 346790 - DNA, 25 bp, Rattus norvegicus
gaggcaaagtcactccacaatacaa

SEQ ID NO: 346791 - DNA, 25 bp, Rattus norvegicus
gaggcaaagtcagtccacaatacaa

SEQ ID NO: 346792 - DNA, 25 bp, Rattus norvegicus
gaggcaaataggagtttcctctatt

SEQ ID NO: 346793 - DNA, 25 bp, Rattus norvegicus
gaggcaaataggtgtttcctctatt

SEQ ID NO: 346794 - DNA, 25 bp, Rattus norvegicus
gaggcaaatccacagagaagtctcc

SEQ ID NO: 346795 - DNA, 25 bp, Rattus norvegicus
gaggcaaatccagagagaagtctcc

SEQ ID NO: 346796 - DNA, 25 bp, Rattus norvegicus
gaggcaacaaatatacccaattaat

SEQ ID NO: 346797 - DNA, 25 bp, Rattus norvegicus
gaggcaacaaatttacccaattaat

SEQ ID NO: 346798 - DNA, 25 bp, Rattus norvegicus
gaggcaacacggacacaaatctaca

SEQ ID NO: 346799 - DNA, 25 bp, Rattus norvegicus
gaggcaacacggtcacaaatctaca

SEQ ID NO: 346800 - DNA, 25 bp, Rattus norvegicus
gaggcaacactgctgaccactgtga

SEQ ID NO: 346801 - DNA, 25 bp, Rattus norvegicus
gaggcaacactggtgaccactgtga

SEQ ID NO: 346802 - DNA, 25 bp, Rattus norvegicus
gaggcaacagtaccagagcagtcca

SEQ ID NO: 346803 - DNA, 25 bp, Rattus norvegicus
gaggcaacagtagcagagcagtcca

SEQ ID NO: 346804 - DNA, 25 bp, Rattus norvegicus
gaggcaacattaatcacgggagctg

SEQ ID NO: 346805 - DNA, 25 bp, Rattus norvegicus
gaggcaacattattcacgggagctg

SEQ ID NO: 346806 - DNA, 25 bp, Rattus norvegicus
gaggcaacattccttattcaccaac

SEQ ID NO: 346807 - DNA, 25 bp, Rattus norvegicus
gaggcaacattcgttattcaccaac

SEQ ID NO: 346808 - DNA, 25 bp, Rattus norvegicus
gaggcaacattgctgtcccgaggac

SEQ ID NO: 346809 - DNA, 25 bp, Rattus norvegicus
gaggcaacattggtgtcccgaggac

SEQ ID NO: 346810 - DNA, 25 bp, Rattus norvegicus
gaggcaaccatgcaccctttttggc

SEQ ID NO: 346811 - DNA, 25 bp, Rattus norvegicus
gaggcaaccatggaccctttttggc

SEQ ID NO: 346812 - DNA, 25 bp, Rattus norvegicus
gaggcaaccggacaacactgggaaa

SEQ ID NO: 346813 - DNA, 25 bp, Rattus norvegicus
gaggcaaccggagaacactgggaaa

SEQ ID NO: 346814 - DNA, 25 bp, Rattus norvegicus
gaggcaacgagtccagcatctactt

SEQ ID NO: 346815 - DNA, 25 bp, Rattus norvegicus
gaggcaacgagtgcagcatctactt

SEQ ID NO: 346816 - DNA, 25 bp, Rattus norvegicus
gaggcaacgtccagggtcctaagtc

SEQ ID NO: 346817 - DNA, 25 bp, Rattus norvegicus
gaggcaacgtcctgggtcctaagtc

SEQ ID NO: 346818 - DNA, 25 bp, Rattus norvegicus
gaggcaactaagaccattaacccaa

SEQ ID NO: 346819 - DNA, 25 bp, Rattus norvegicus
gaggcaactaagtccattaacccaa

SEQ ID NO: 346820 - DNA, 25 bp, Rattus norvegicus
gaggcaactgacagtaatcccagga

SEQ ID NO: 346821 - DNA, 25 bp, Rattus norvegicus
gaggcaactgaccttcccagaggaa

SEQ ID NO: 346822 - DNA, 25 bp, Rattus norvegicus
gaggcaactgacgttcccagaggaa

SEQ ID NO: 346823 - DNA, 25 bp, Rattus norvegicus
gaggcaactgactgtaatcccagga

SEQ ID NO: 346824 - DNA, 25 bp, Rattus norvegicus
gaggcaagaactcagccatgcagat

SEQ ID NO: 346825 - DNA, 25 bp, Rattus norvegicus
gaggcaagaactgagccatgcagat

SEQ ID NO: 346826 - DNA, 25 bp, Rattus norvegicus
gaggcaagaaggacccttttcattt

SEQ ID NO: 346827 - DNA, 25 bp, Rattus norvegicus
gaggcaagaaggtcccttttcattt

SEQ ID NO: 346828 - DNA, 25 bp, Rattus norvegicus
gaggcaagaccgaggcagcacacca

SEQ ID NO: 346829 - DNA, 25 bp, Rattus norvegicus
gaggcaagaccgtggcagcacacca

SEQ ID NO: 346830 - DNA, 25 bp, Rattus norvegicus
gaggcaagccagatgtgtcacagtt

SEQ ID NO: 346831 - DNA, 25 bp, Rattus norvegicus
gaggcaagccagttgtgtcacagtt

SEQ ID NO: 346832 - DNA, 25 bp, Rattus norvegicus
gaggcaagcctgagttttactctcc

SEQ ID NO: 346833 - DNA, 25 bp, Rattus norvegicus
gaggcaagcctgtgttttactctcc

SEQ ID NO: 346834 - DNA, 25 bp, Rattus norvegicus
gaggcaaggatgctcgctcatgtta

SEQ ID NO: 346835 - DNA, 25 bp, Rattus norvegicus
gaggcaaggatggtcgctcatgtta

SEQ ID NO: 346836 - DNA, 25 bp, Rattus norvegicus
gaggcaaggcatatctctccagtgt

SEQ ID NO: 346837 - DNA, 25 bp, Rattus norvegicus
gaggcaaggcatcccgactgcttta

SEQ ID NO: 346838 - DNA, 25 bp, Rattus norvegicus
gaggcaaggcatgccgactgcttta

SEQ ID NO: 346839 - DNA, 25 bp, Rattus norvegicus
gaggcaaggcatttctctccagtgt

SEQ ID NO: 346840 - DNA, 25 bp, Rattus norvegicus
gaggcaaggccaatctctggacagt

SEQ ID NO: 346841 - DNA, 25 bp, Rattus norvegicus
gaggcaaggccattctctggacagt

SEQ ID NO: 346842 - DNA, 25 bp, Rattus norvegicus
gaggcaagggacagcagtgaactta

SEQ ID NO: 346843 - DNA, 25 bp, Rattus norvegicus
gaggcaagggactgcagtgaactta

SEQ ID NO: 346844 - DNA, 25 bp, Rattus norvegicus
gaggcaagggtcaactgtcatttgt

SEQ ID NO: 346845 - DNA, 25 bp, Rattus norvegicus
gaggcaagggtctactgtcatttgt

SEQ ID NO: 346846 - DNA, 25 bp, Rattus norvegicus
gaggcaaggtctaactactatgtaa

SEQ ID NO: 346847 - DNA, 25 bp, Rattus norvegicus
gaggcaaggtcttactactatgtaa

SEQ ID NO: 346848 - DNA, 25 bp, Rattus norvegicus
gaggcaagtcccagccagcagatga

SEQ ID NO: 346849 - DNA, 25 bp, Rattus norvegicus
gaggcaagtccctgccagcagatga

SEQ ID NO: 346850 - DNA, 25 bp, Rattus norvegicus
gaggcaagtgtcaactcactgggcc

SEQ ID NO: 346851 - DNA, 25 bp, Rattus norvegicus
gaggcaagtgtctactcactgggcc

SEQ ID NO: 346852 - DNA, 25 bp, Rattus norvegicus
gaggcaagttagctacttaccctcc

SEQ ID NO: 346853 - DNA, 25 bp, Rattus norvegicus
gaggcaagttaggtacttaccctcc

SEQ ID NO: 346854 - DNA, 25 bp, Rattus norvegicus
gaggcaagttatcccctggaagcaa

SEQ ID NO: 346855 - DNA, 25 bp, Rattus norvegicus
gaggcaagttatgccctggaagcaa

SEQ ID NO: 346856 - DNA, 25 bp, Rattus norvegicus
gaggcaagtttcacttaccttggac

SEQ ID NO: 346857 - DNA, 25 bp, Rattus norvegicus
gaggcaagtttctcttaccttggac

SEQ ID NO: 346858 - DNA, 25 bp, Rattus norvegicus
gaggcaatcaccatgataagcatgt

SEQ ID NO: 346859 - DNA, 25 bp, Rattus norvegicus
gaggcaatcaccttgataagcatgt

SEQ ID NO: 346860 - DNA, 25 bp, Rattus norvegicus
gaggcaatcatcaagttgtcaagta

SEQ ID NO: 346861 - DNA, 25 bp, Rattus norvegicus
gaggcaatcatctagttgtcaagta

SEQ ID NO: 346862 - DNA, 25 bp, Rattus norvegicus
gaggcaatccctaattacttatgaa

SEQ ID NO: 346863 - DNA, 25 bp, Rattus norvegicus
gaggcaatcccttattacttatgaa

SEQ ID NO: 346864 - DNA, 25 bp, Rattus norvegicus
gaggcaatctctcaagtcctgtacc

SEQ ID NO: 346865 - DNA, 25 bp, Rattus norvegicus
gaggcaatctctgaagtcctgtacc

SEQ ID NO: 346866 - DNA, 25 bp, Rattus norvegicus
gaggcaattcctcaagggcacgagc

SEQ ID NO: 346867 - DNA, 25 bp, Rattus norvegicus
gaggcaattcctgaagggcacgagc

SEQ ID NO: 346868 - DNA, 25 bp, Rattus norvegicus
gaggcaattctcacatattcagtaa

SEQ ID NO: 346869 - DNA, 25 bp, Rattus norvegicus
gaggcaattctctcatattcagtaa

SEQ ID NO: 346870 - DNA, 25 bp, Rattus norvegicus
gaggcaattctgcagaccactggaa

SEQ ID NO: 346871 - DNA, 25 bp, Rattus norvegicus
gaggcaattctggagaccactggaa

SEQ ID NO: 346872 - DNA, 25 bp, Rattus norvegicus
gaggcaatttcaagactccagtcat

SEQ ID NO: 346873 - DNA, 25 bp, Rattus norvegicus
gaggcaatttcatgactccagtcat

SEQ ID NO: 346874 - DNA, 25 bp, Rattus norvegicus
gaggcaatttgaatctgtgtttcca

SEQ ID NO: 346875 - DNA, 25 bp, Rattus norvegicus
gaggcaatttgattctgtgtttcca

SEQ ID NO: 346876 - DNA, 25 bp, Rattus norvegicus
gaggcacaagcaactgaggctccag

SEQ ID NO: 346877 - DNA, 25 bp, Rattus norvegicus
gaggcacaagcatctgaggctccag

SEQ ID NO: 346878 - DNA, 25 bp, Rattus norvegicus
gaggcacaagcccataattccaatt

SEQ ID NO: 346879 - DNA, 25 bp, Rattus norvegicus
gaggcacaagccgataattccaatt

SEQ ID NO: 346880 - DNA, 25 bp, Rattus norvegicus
gaggcacaatccaggtcctgatgcc

SEQ ID NO: 346881 - DNA, 25 bp, Rattus norvegicus
gaggcacaatcctggtcctgatgcc

SEQ ID NO: 346882 - DNA, 25 bp, Rattus norvegicus
gaggcacacagcacgaaagagtcag

SEQ ID NO: 346883 - DNA, 25 bp, Rattus norvegicus
gaggcacacagctcgaaagagtcag

SEQ ID NO: 346884 - DNA, 25 bp, Rattus norvegicus
gaggcacaccaaaggctcttgcaga

SEQ ID NO: 346885 - DNA, 25 bp, Rattus norvegicus
gaggcacaccaatggctcttgcaga

SEQ ID NO: 346886 - DNA, 25 bp, Rattus norvegicus
gaggcacacgaaagcacatctgtag

SEQ ID NO: 346887 - DNA, 25 bp, Rattus norvegicus
gaggcacacgaatgcacatctgtag

SEQ ID NO: 346888 - DNA, 25 bp, Rattus norvegicus
gaggcacacgccattatatattggt

SEQ ID NO: 346889 - DNA, 25 bp, Rattus norvegicus
gaggcacacgcctttatatattggt

SEQ ID NO: 346890 - DNA, 25 bp, Rattus norvegicus
gaggcacactgcatcatagctgtca

SEQ ID NO: 346891 - DNA, 25 bp, Rattus norvegicus
gaggcacactgccaatcacgctcgg

SEQ ID NO: 346892 - DNA, 25 bp, Rattus norvegicus
gaggcacactgcgaatcacgctcgg

SEQ ID NO: 346893 - DNA, 25 bp, Rattus norvegicus
gaggcacactgcttcatagctgtca

SEQ ID NO: 346894 - DNA, 25 bp, Rattus norvegicus
gaggcacagaagacttaccacccag

SEQ ID NO: 346895 - DNA, 25 bp, Rattus norvegicus
gaggcacagaagtcttaccacccag

SEQ ID NO: 346896 - DNA, 25 bp, Rattus norvegicus
gaggcacagacacagaacgtcaaac

SEQ ID NO: 346897 - DNA, 25 bp, Rattus norvegicus
gaggcacagacagagaacgtcaaac

SEQ ID NO: 346898 - DNA, 25 bp, Rattus norvegicus
gaggcacagcatctcactcactgtg

SEQ ID NO: 346899 - DNA, 25 bp, Rattus norvegicus
gaggcacagcatgtcactcactgtg

SEQ ID NO: 346900 - DNA, 25 bp, Rattus norvegicus
gaggcacagcctcatggtctcggca

SEQ ID NO: 346901 - DNA, 25 bp, Rattus norvegicus
gaggcacagcctgatggtctcggca

SEQ ID NO: 346902 - DNA, 25 bp, Rattus norvegicus
gaggcacagggcaaacgaggaccaa

SEQ ID NO: 346903 - DNA, 25 bp, Rattus norvegicus
gaggcacagggctaacgaggaccaa

SEQ ID NO: 346904 - DNA, 25 bp, Rattus norvegicus
gaggcacatattatgcatgcgcaaa

SEQ ID NO: 346905 - DNA, 25 bp, Rattus norvegicus
gaggcacatattttgcatgcgcaaa

SEQ ID NO: 346906 - DNA, 25 bp, Rattus norvegicus
gaggcacatgccagggtctttccag

SEQ ID NO: 346907 - DNA, 25 bp, Rattus norvegicus
gaggcacatgcctgggtctttccag

SEQ ID NO: 346908 - DNA, 25 bp, Rattus norvegicus
gaggcaccaaagcaagaggcacctg

SEQ ID NO: 346909 - DNA, 25 bp, Rattus norvegicus
gaggcaccaaaggaagaggcacctg

SEQ ID NO: 346910 - DNA, 25 bp, Rattus norvegicus
gaggcaccagaactgagtcacatca

SEQ ID NO: 346911 - DNA, 25 bp, Rattus norvegicus
gaggcaccagaagtgagtcacatca

SEQ ID NO: 346912 - DNA, 25 bp, Rattus norvegicus
gaggcaccagcaacagagcgcgcaa

SEQ ID NO: 346913 - DNA, 25 bp, Rattus norvegicus
gaggcaccagcaatcactgaggaga

SEQ ID NO: 346914 - DNA, 25 bp, Rattus norvegicus
gaggcaccagcatcagagcgcgcaa

SEQ ID NO: 346915 - DNA, 25 bp, Rattus norvegicus
gaggcaccagcattcactgaggaga

SEQ ID NO: 346916 - DNA, 25 bp, Rattus norvegicus
gaggcaccaggaacatctacgacag

SEQ ID NO: 346917 - DNA, 25 bp, Rattus norvegicus
gaggcaccaggatcatctacgacag

SEQ ID NO: 346918 - DNA, 25 bp, Rattus norvegicus
gaggcaccaggtcagaacagaacac

SEQ ID NO: 346919 - DNA, 25 bp, Rattus norvegicus
gaggcaccaggtgagaacagaacac

SEQ ID NO: 346920 - DNA, 25 bp, Rattus norvegicus
gaggcaccagtaagctgccttggat

SEQ ID NO: 346921 - DNA, 25 bp, Rattus norvegicus
gaggcaccagtatgctgccttggat

SEQ ID NO: 346922 - DNA, 25 bp, Rattus norvegicus
gaggcaccccatcatctaaggttag

SEQ ID NO: 346923 - DNA, 25 bp, Rattus norvegicus
gaggcaccccatgatctaaggttag

SEQ ID NO: 346924 - DNA, 25 bp, Rattus norvegicus
gaggcacccctcagggacattaagg

SEQ ID NO: 346925 - DNA, 25 bp, Rattus norvegicus
gaggcacccctctgggacattaagg

SEQ ID NO: 346926 - DNA, 25 bp, Rattus norvegicus
gaggcaccgaggagatcgcacccct

SEQ ID NO: 346927 - DNA, 25 bp, Rattus norvegicus
gaggcaccgaggtgatcgcacccct

SEQ ID NO: 346928 - DNA, 25 bp, Rattus norvegicus
gaggcaccggaacggctgccttttt

SEQ ID NO: 346929 - DNA, 25 bp, Rattus norvegicus
gaggcaccggaagggctgccttttt

SEQ ID NO: 346930 - DNA, 25 bp, Rattus norvegicus
gaggcaccggcacaggcagctacaa

SEQ ID NO: 346931 - DNA, 25 bp, Rattus norvegicus
gaggcaccggcagaggcagctacaa

SEQ ID NO: 346932 - DNA, 25 bp, Rattus norvegicus
gaggcacctgaaagcatccatctgg

SEQ ID NO: 346933 - DNA, 25 bp, Rattus norvegicus
gaggcacctgaatgcatccatctgg

SEQ ID NO: 346934 - DNA, 25 bp, Rattus norvegicus
gaggcacctgcaaacctgttaatat

SEQ ID NO: 346935 - DNA, 25 bp, Rattus norvegicus
gaggcacctgcatacctgttaatat

SEQ ID NO: 346936 - DNA, 25 bp, Rattus norvegicus
gaggcaccttaaagaggctctccct

SEQ ID NO: 346937 - DNA, 25 bp, Rattus norvegicus
gaggcaccttaactcaacatggcag

SEQ ID NO: 346938 - DNA, 25 bp, Rattus norvegicus
gaggcaccttaagtcaacatggcag

SEQ ID NO: 346939 - DNA, 25 bp, Rattus norvegicus
gaggcaccttaatgaggctctccct

SEQ ID NO: 346940 - DNA, 25 bp, Rattus norvegicus
gaggcacgaacaatggacacccaga

SEQ ID NO: 346941 - DNA, 25 bp, Rattus norvegicus
gaggcacgaacattggacacccaga

SEQ ID NO: 346942 - DNA, 25 bp, Rattus norvegicus
gaggcacgagaaccagaaatccaag

SEQ ID NO: 346943 - DNA, 25 bp, Rattus norvegicus
gaggcacgagaagcagaaatccaag

SEQ ID NO: 346944 - DNA, 25 bp, Rattus norvegicus
gaggcacgagacaactcgccggcgt

SEQ ID NO: 346945 - DNA, 25 bp, Rattus norvegicus
gaggcacgagactactcgccggcgt

SEQ ID NO: 346946 - DNA, 25 bp, Rattus norvegicus
gaggcacgcagacaactgactcaga

SEQ ID NO: 346947 - DNA, 25 bp, Rattus norvegicus
gaggcacgcagagaactgactcaga

SEQ ID NO: 346948 - DNA, 25 bp, Rattus norvegicus
gaggcacgccctacatgggaggatc

SEQ ID NO: 346949 - DNA, 25 bp, Rattus norvegicus
gaggcacgcccttcatgggaggatc

SEQ ID NO: 346950 - DNA, 25 bp, Rattus norvegicus
gaggcacgctacaagggcatgatag

SEQ ID NO: 346951 - DNA, 25 bp, Rattus norvegicus
gaggcacgctactagggcatgatag

SEQ ID NO: 346952 - DNA, 25 bp, Rattus norvegicus
gaggcacggactagcactgagagat

SEQ ID NO: 346953 - DNA, 25 bp, Rattus norvegicus
gaggcacggacttgcactgagagat

SEQ ID NO: 346954 - DNA, 25 bp, Rattus norvegicus
gaggcacggtccacctgttgaaggc

SEQ ID NO: 346955 - DNA, 25 bp, Rattus norvegicus
gaggcacggtcctcctgttgaaggc

SEQ ID NO: 346956 - DNA, 25 bp, Rattus norvegicus
gaggcacgtagcacctcatctggaa

SEQ ID NO: 346957 - DNA, 25 bp, Rattus norvegicus
gaggcacgtagctcctcatctggaa

SEQ ID NO: 346958 - DNA, 25 bp, Rattus norvegicus
gaggcactaaagcaaggcctgccca

SEQ ID NO: 346959 - DNA, 25 bp, Rattus norvegicus
gaggcactaaaggaaggcctgccca

SEQ ID NO: 346960 - DNA, 25 bp, Rattus norvegicus
gaggcactaaggaaggatgctcttt

SEQ ID NO: 346961 - DNA, 25 bp, Rattus norvegicus
gaggcactaaggtaggatgctcttt

SEQ ID NO: 346962 - DNA, 25 bp, Rattus norvegicus
gaggcactcactaatgggagttcat

SEQ ID NO: 346963 - DNA, 25 bp, Rattus norvegicus
gaggcactcacttatgggagttcat

SEQ ID NO: 346964 - DNA, 25 bp, Rattus norvegicus
gaggcactcagacacacggcagaga

SEQ ID NO: 346965 - DNA, 25 bp, Rattus norvegicus
gaggcactcagagacacggcagaga

SEQ ID NO: 346966 - DNA, 25 bp, Rattus norvegicus
gaggcactcgatccaaccatacagt

SEQ ID NO: 346967 - DNA, 25 bp, Rattus norvegicus
gaggcactcgatgcaaccatacagt

SEQ ID NO: 346968 - DNA, 25 bp, Rattus norvegicus
gaggcactctgacctccagaagcag

SEQ ID NO: 346969 - DNA, 25 bp, Rattus norvegicus
gaggcactctgagctccagaagcag

SEQ ID NO: 346970 - DNA, 25 bp, Rattus norvegicus
gaggcactgcaaattgtaaccttgg

SEQ ID NO: 346971 - DNA, 25 bp, Rattus norvegicus
gaggcactgcaatttgtaaccttgg

SEQ ID NO: 346972 - DNA, 25 bp, Rattus norvegicus
gaggcactgcctcagaagtaataag

SEQ ID NO: 346973 - DNA, 25 bp, Rattus norvegicus
gaggcactgcctgagaagtaataag

SEQ ID NO: 346974 - DNA, 25 bp, Rattus norvegicus
gaggcactggcaatgcctgttcagt

SEQ ID NO: 346975 - DNA, 25 bp, Rattus norvegicus
gaggcactggcaatgtctctgctcc

SEQ ID NO: 346976 - DNA, 25 bp, Rattus norvegicus
gaggcactggcattgcctgttcagt

SEQ ID NO: 346977 - DNA, 25 bp, Rattus norvegicus
gaggcactggcattgtctctgctcc

SEQ ID NO: 346978 - DNA, 25 bp, Rattus norvegicus
gaggcactgtggagcttctctgcaa

SEQ ID NO: 346979 - DNA, 25 bp, Rattus norvegicus
gaggcactgtggctatccccaagaa

SEQ ID NO: 346980 - DNA, 25 bp, Rattus norvegicus
gaggcactgtgggtatccccaagaa

SEQ ID NO: 346981 - DNA, 25 bp, Rattus norvegicus
gaggcactgtggtgcttctctgcaa

SEQ ID NO: 346982 - DNA, 25 bp, Rattus norvegicus
gaggcacttcctagagatccaggct

SEQ ID NO: 346983 - DNA, 25 bp, Rattus norvegicus
gaggcacttccttgagatccaggct

SEQ ID NO: 346984 - DNA, 25 bp, Rattus norvegicus
gaggcacttcggctctaccagcatg

SEQ ID NO: 346985 - DNA, 25 bp, Rattus norvegicus
gaggcacttcgggtctaccagcatg

SEQ ID NO: 346986 - DNA, 25 bp, Rattus norvegicus
gaggcacttgccagtaataacccac

SEQ ID NO: 346987 - DNA, 25 bp, Rattus norvegicus
gaggcacttgcctgtaataacccac

SEQ ID NO: 346988 - DNA, 25 bp, Rattus norvegicus
gaggcacttgctctagaacgtcaat

SEQ ID NO: 346989 - DNA, 25 bp, Rattus norvegicus
gaggcacttgctgtagaacgtcaat

SEQ ID NO: 346990 - DNA, 25 bp, Rattus norvegicus
gaggcacttggcacagctaagcagc

SEQ ID NO: 346991 - DNA, 25 bp, Rattus norvegicus
gaggcacttggctcagctaagcagc

SEQ ID NO: 346992 - DNA, 25 bp, Rattus norvegicus
gaggcacttgtgacttgctttccag

SEQ ID NO: 346993 - DNA, 25 bp, Rattus norvegicus
gaggcacttgtgtcttgctttccag

SEQ ID NO: 346994 - DNA, 25 bp, Rattus norvegicus
gaggcactttcaaatatctaatctt

SEQ ID NO: 346995 - DNA, 25 bp, Rattus norvegicus
gaggcactttcatatatctaatctt

SEQ ID NO: 346996 - DNA, 25 bp, Rattus norvegicus
gaggcactttttagctggtttggaa

SEQ ID NO: 346997 - DNA, 25 bp, Rattus norvegicus
gaggcacttttttgctggtttggaa

SEQ ID NO: 346998 - DNA, 25 bp, Rattus norvegicus
gaggcagaaaacatccttcccaggg

SEQ ID NO: 346999 - DNA, 25 bp, Rattus norvegicus
gaggcagaaaacttccttcccaggg

SEQ ID NO: 347000 - DNA, 25 bp, Rattus norvegicus
gaggcagaaaatcggtggttttcac

SEQ ID NO: 347001 - DNA, 25 bp, Rattus norvegicus
gaggcagaaaatgggtggttttcac

SEQ ID NO: 347002 - DNA, 25 bp, Rattus norvegicus
gaggcagaaagaacactacaagttt

SEQ ID NO: 347003 - DNA, 25 bp, Rattus norvegicus
gaggcagaaagatcactacaagttt

SEQ ID NO: 347004 - DNA, 25 bp, Rattus norvegicus
gaggcagaaagtaccctgtcagcag

SEQ ID NO: 347005 - DNA, 25 bp, Rattus norvegicus
gaggcagaaagttccctgtcagcag

SEQ ID NO: 347006 - DNA, 25 bp, Rattus norvegicus
gaggcagaacagcacccggaccagt

SEQ ID NO: 347007 - DNA, 25 bp, Rattus norvegicus
gaggcagaacaggacccggaccagt

SEQ ID NO: 347008 - DNA, 25 bp, Rattus norvegicus
gaggcagaacgaaaacaaatcaact

SEQ ID NO: 347009 - DNA, 25 bp, Rattus norvegicus
gaggcagaacgataacaaatcaact

SEQ ID NO: 347010 - DNA, 25 bp, Rattus norvegicus
gaggcagaagctacagctgaagtct

SEQ ID NO: 347011 - DNA, 25 bp, Rattus norvegicus
gaggcagaagctctcccttcagatg

SEQ ID NO: 347012 - DNA, 25 bp, Rattus norvegicus
gaggcagaagctgtcccttcagatg

SEQ ID NO: 347013 - DNA, 25 bp, Rattus norvegicus
gaggcagaagcttcagctgaagtct

SEQ ID NO: 347014 - DNA, 25 bp, Rattus norvegicus
gaggcagaataacttacccactctc

SEQ ID NO: 347015 - DNA, 25 bp, Rattus norvegicus
gaggcagaataagttacccactctc

SEQ ID NO: 347016 - DNA, 25 bp, Rattus norvegicus
gaggcagaccaaatgtaagatagct

SEQ ID NO: 347017 - DNA, 25 bp, Rattus norvegicus
gaggcagaccaattgtaagatagct

SEQ ID NO: 347018 - DNA, 25 bp, Rattus norvegicus
gaggcagaccagatgggctcaccta

SEQ ID NO: 347019 - DNA, 25 bp, Rattus norvegicus
gaggcagaccagttgggctcaccta

SEQ ID NO: 347020 - DNA, 25 bp, Rattus norvegicus
gaggcagactgactgactattcaac

SEQ ID NO: 347021 - DNA, 25 bp, Rattus norvegicus
gaggcagactgagtgactattcaac

SEQ ID NO: 347022 - DNA, 25 bp, Rattus norvegicus
gaggcagactgtagatctggtctcc

SEQ ID NO: 347023 - DNA, 25 bp, Rattus norvegicus
gaggcagactgttgatctggtctcc

SEQ ID NO: 347024 - DNA, 25 bp, Rattus norvegicus
gaggcagacttgcactttttatgtt

SEQ ID NO: 347025 - DNA, 25 bp, Rattus norvegicus
gaggcagacttggactttttatgtt

SEQ ID NO: 347026 - DNA, 25 bp, Rattus norvegicus
gaggcagagagtaggtacagcatct

SEQ ID NO: 347027 - DNA, 25 bp, Rattus norvegicus
gaggcagagagttggtacagcatct

SEQ ID NO: 347028 - DNA, 25 bp, Rattus norvegicus
gaggcagagatcaccccagagttag

SEQ ID NO: 347029 - DNA, 25 bp, Rattus norvegicus
gaggcagagatctccccagagttag

SEQ ID NO: 347030 - DNA, 25 bp, Rattus norvegicus
gaggcagagcaaacgctgcgtttcc

SEQ ID NO: 347031 - DNA, 25 bp, Rattus norvegicus
gaggcagagcaatcgctgcgtttcc

SEQ ID NO: 347032 - DNA, 25 bp, Rattus norvegicus
gaggcagagcagagcagttcagtta

SEQ ID NO: 347033 - DNA, 25 bp, Rattus norvegicus
gaggcagagcagtgcagttcagtta

SEQ ID NO: 347034 - DNA, 25 bp, Rattus norvegicus
gaggcagagctaatatttactgtaa

SEQ ID NO: 347035 - DNA, 25 bp, Rattus norvegicus
gaggcagagctattatttactgtaa

SEQ ID NO: 347036 - DNA, 25 bp, Rattus norvegicus
gaggcagagctccagttcttaaaac

SEQ ID NO: 347037 - DNA, 25 bp, Rattus norvegicus
gaggcagagctcgagttcttaaaac

SEQ ID NO: 347038 - DNA, 25 bp, Rattus norvegicus
gaggcagaggcgactccaagtatag

SEQ ID NO: 347039 - DNA, 25 bp, Rattus norvegicus
gaggcagaggcgtctccaagtatag

SEQ ID NO: 347040 - DNA, 25 bp, Rattus norvegicus
gaggcagaggtcaatcccacaggta

SEQ ID NO: 347041 - DNA, 25 bp, Rattus norvegicus
gaggcagaggtctatcccacaggta

SEQ ID NO: 347042 - DNA, 25 bp, Rattus norvegicus
gaggcagagttgctttgctcctttc

SEQ ID NO: 347043 - DNA, 25 bp, Rattus norvegicus
gaggcagagttggtttgctcctttc

SEQ ID NO: 347044 - DNA, 25 bp, Rattus norvegicus
gaggcagataacatcaggtcattcc

SEQ ID NO: 347045 - DNA, 25 bp, Rattus norvegicus
gaggcagataacttcaggtcattcc

SEQ ID NO: 347046 - DNA, 25 bp, Rattus norvegicus
gaggcagatctacccaaaccagaga

SEQ ID NO: 347047 - DNA, 25 bp, Rattus norvegicus
gaggcagatctagccaaaccagaga

SEQ ID NO: 347048 - DNA, 25 bp, Rattus norvegicus
gaggcagatctcaaggtgcccaccg

SEQ ID NO: 347049 - DNA, 25 bp, Rattus norvegicus
gaggcagatctctaggtgcccaccg

SEQ ID NO: 347050 - DNA, 25 bp, Rattus norvegicus
gaggcagatggacttaccacagatc

SEQ ID NO: 347051 - DNA, 25 bp, Rattus norvegicus
gaggcagatggagttaccacagatc

SEQ ID NO: 347052 - DNA, 25 bp, Rattus norvegicus
gaggcagatgtcactttttaagttc

SEQ ID NO: 347053 - DNA, 25 bp, Rattus norvegicus
gaggcagatgtctctttttaagttc

SEQ ID NO: 347054 - DNA, 25 bp, Rattus norvegicus
gaggcagatgtgacacaccctccat

SEQ ID NO: 347055 - DNA, 25 bp, Rattus norvegicus
gaggcagatgtgtcacaccctccat

SEQ ID NO: 347056 - DNA, 25 bp, Rattus norvegicus
gaggcagattacaggagcaaccaca

SEQ ID NO: 347057 - DNA, 25 bp, Rattus norvegicus
gaggcagattactggagcaaccaca

SEQ ID NO: 347058 - DNA, 25 bp, Rattus norvegicus
gaggcagcaacacttctacccaaga

SEQ ID NO: 347059 - DNA, 25 bp, Rattus norvegicus
gaggcagcaacagttctacccaaga

SEQ ID NO: 347060 - DNA, 25 bp, Rattus norvegicus
gaggcagcaaccaatgttccctttt

SEQ ID NO: 347061 - DNA, 25 bp, Rattus norvegicus
gaggcagcaacctatgttccctttt

SEQ ID NO: 347062 - DNA, 25 bp, Rattus norvegicus
gaggcagcacacaggttgcttcttg

SEQ ID NO: 347063 - DNA, 25 bp, Rattus norvegicus
gaggcagcacactggttgcttcttg

SEQ ID NO: 347064 - DNA, 25 bp, Rattus norvegicus
gaggcagcacctaacacatgtagaa

SEQ ID NO: 347065 - DNA, 25 bp, Rattus norvegicus
gaggcagcacctctgggacaaaatg

SEQ ID NO: 347066 - DNA, 25 bp, Rattus norvegicus
gaggcagcacctgtgggacaaaatg

SEQ ID NO: 347067 - DNA, 25 bp, Rattus norvegicus
gaggcagcaccttacacatgtagaa

SEQ ID NO: 347068 - DNA, 25 bp, Rattus norvegicus
gaggcagcacttaatccaagaggaa

SEQ ID NO: 347069 - DNA, 25 bp, Rattus norvegicus
gaggcagcactttatccaagaggaa

SEQ ID NO: 347070 - DNA, 25 bp, Rattus norvegicus
gaggcagcagcaatccggatgcatt

SEQ ID NO: 347071 - DNA, 25 bp, Rattus norvegicus
gaggcagcagcacacattcaggtag

SEQ ID NO: 347072 - DNA, 25 bp, Rattus norvegicus
gaggcagcagcacctaccagacaaa

SEQ ID NO: 347073 - DNA, 25 bp, Rattus norvegicus
gaggcagcagcagacattcaggtag

SEQ ID NO: 347074 - DNA, 25 bp, Rattus norvegicus
gaggcagcagcagctaccagacaaa

SEQ ID NO: 347075 - DNA, 25 bp, Rattus norvegicus
gaggcagcagcattccggatgcatt

SEQ ID NO: 347076 - DNA, 25 bp, Rattus norvegicus
gaggcagcagctaatagaagtagaa

SEQ ID NO: 347077 - DNA, 25 bp, Rattus norvegicus
gaggcagcagctcctcggatgctct

SEQ ID NO: 347078 - DNA, 25 bp, Rattus norvegicus
gaggcagcagctgctcggatgctct

SEQ ID NO: 347079 - DNA, 25 bp, Rattus norvegicus
gaggcagcagcttatagaagtagaa

SEQ ID NO: 347080 - DNA, 25 bp, Rattus norvegicus
gaggcagcaggaatcatgtttgcat

SEQ ID NO: 347081 - DNA, 25 bp, Rattus norvegicus
gaggcagcaggattcatgtttgcat

SEQ ID NO: 347082 - DNA, 25 bp, Rattus norvegicus
gaggcagcagggaattgacagcaaa

SEQ ID NO: 347083 - DNA, 25 bp, Rattus norvegicus
gaggcagcagggtattgacagcaaa

SEQ ID NO: 347084 - DNA, 25 bp, Rattus norvegicus
gaggcagcagtgacagtcacatgaa

SEQ ID NO: 347085 - DNA, 25 bp, Rattus norvegicus
gaggcagcagtgtcagtcacatgaa

SEQ ID NO: 347086 - DNA, 25 bp, Rattus norvegicus
gaggcagcatccacgaggcagcatc

SEQ ID NO: 347087 - DNA, 25 bp, Rattus norvegicus
gaggcagcatcctcgaggcagcatc

SEQ ID NO: 347088 - DNA, 25 bp, Rattus norvegicus
gaggcagcatgcacagtgtcagcta

SEQ ID NO: 347089 - DNA, 25 bp, Rattus norvegicus
gaggcagcatgctcagtgtcagcta

SEQ ID NO: 347090 - DNA, 25 bp, Rattus norvegicus
gaggcagcattcctgggtcccttgt

SEQ ID NO: 347091 - DNA, 25 bp, Rattus norvegicus
gaggcagcattcgtgggtcccttgt

SEQ ID NO: 347092 - DNA, 25 bp, Rattus norvegicus
gaggcagcatttaccagagcattaa

SEQ ID NO: 347093 - DNA, 25 bp, Rattus norvegicus
gaggcagcattttccagagcattaa

SEQ ID NO: 347094 - DNA, 25 bp, Rattus norvegicus
gaggcagccattcaagttcatctct

SEQ ID NO: 347095 - DNA, 25 bp, Rattus norvegicus
gaggcagccattgaagttcatctct

SEQ ID NO: 347096 - DNA, 25 bp, Rattus norvegicus
gaggcagcccctaaagctacctctt

SEQ ID NO: 347097 - DNA, 25 bp, Rattus norvegicus
gaggcagccccttaagctacctctt

SEQ ID NO: 347098 - DNA, 25 bp, Rattus norvegicus
gaggcagcccgacctcagcgctaag

SEQ ID NO: 347099 - DNA, 25 bp, Rattus norvegicus
gaggcagcccgagctcagcgctaag

SEQ ID NO: 347100 - DNA, 25 bp, Rattus norvegicus
gaggcagccgacaggacccagtgct

SEQ ID NO: 347101 - DNA, 25 bp, Rattus norvegicus
gaggcagccgactggacccagtgct

SEQ ID NO: 347102 - DNA, 25 bp, Rattus norvegicus
gaggcagcctctcgtgtggcttttt

SEQ ID NO: 347103 - DNA, 25 bp, Rattus norvegicus
gaggcagcctctggtgtggcttttt

SEQ ID NO: 347104 - DNA, 25 bp, Rattus norvegicus
gaggcagcctgtagtattcacacat

SEQ ID NO: 347105 - DNA, 25 bp, Rattus norvegicus
gaggcagcctgtatttctcagttaa

SEQ ID NO: 347106 - DNA, 25 bp, Rattus norvegicus
gaggcagcctgtccccagctttttt

SEQ ID NO: 347107 - DNA, 25 bp, Rattus norvegicus
gaggcagcctgtgcccagctttttt

SEQ ID NO: 347108 - DNA, 25 bp, Rattus norvegicus
gaggcagcctgttgtattcacacat

SEQ ID NO: 347109 - DNA, 25 bp, Rattus norvegicus
gaggcagcctgtttttctcagttaa

SEQ ID NO: 347110 - DNA, 25 bp, Rattus norvegicus
gaggcagccttacctgttcttggaa

SEQ ID NO: 347111 - DNA, 25 bp, Rattus norvegicus
gaggcagccttagctgttcttggaa

SEQ ID NO: 347112 - DNA, 25 bp, Rattus norvegicus
gaggcagccttgctctgagtttcag

SEQ ID NO: 347113 - DNA, 25 bp, Rattus norvegicus
gaggcagccttggtctgagtttcag

SEQ ID NO: 347114 - DNA, 25 bp, Rattus norvegicus
gaggcagcgctgcagactacacctg

SEQ ID NO: 347115 - DNA, 25 bp, Rattus norvegicus
gaggcagcgctgctttaagtttgat

SEQ ID NO: 347116 - DNA, 25 bp, Rattus norvegicus
gaggcagcgctggagactacacctg

SEQ ID NO: 347117 - DNA, 25 bp, Rattus norvegicus
gaggcagcgctggtttaagtttgat

SEQ ID NO: 347118 - DNA, 25 bp, Rattus norvegicus
gaggcagcggccagcactgactctt

SEQ ID NO: 347119 - DNA, 25 bp, Rattus norvegicus
gaggcagcggcctgcactgactctt

SEQ ID NO: 347120 - DNA, 25 bp, Rattus norvegicus
gaggcagcgtaccacgtcctggctt

SEQ ID NO: 347121 - DNA, 25 bp, Rattus norvegicus
gaggcagcgtacgacgtcctggctt

SEQ ID NO: 347122 - DNA, 25 bp, Rattus norvegicus
gaggcagctaggaaatttctctcca

SEQ ID NO: 347123 - DNA, 25 bp, Rattus norvegicus
gaggcagctaggtaatttctctcca

SEQ ID NO: 347124 - DNA, 25 bp, Rattus norvegicus
gaggcagctatcacaaggctttgcg

SEQ ID NO: 347125 - DNA, 25 bp, Rattus norvegicus
gaggcagctatctcaaggctttgcg

SEQ ID NO: 347126 - DNA, 25 bp, Rattus norvegicus
gaggcagctcggacgcgtgctccga

SEQ ID NO: 347127 - DNA, 25 bp, Rattus norvegicus
gaggcagctcggtcgcgtgctccga

SEQ ID NO: 347128 - DNA, 25 bp, Rattus norvegicus
gaggcagctgatcccagaagccaga

SEQ ID NO: 347129 - DNA, 25 bp, Rattus norvegicus
gaggcagctgatgccagaagccaga

SEQ ID NO: 347130 - DNA, 25 bp, Rattus norvegicus
gaggcagctgcccaccctgaagaag

SEQ ID NO: 347131 - DNA, 25 bp, Rattus norvegicus
gaggcagctgccgaccctgaagaag

SEQ ID NO: 347132 - DNA, 25 bp, Rattus norvegicus
gaggcagctggaaaagtgtcacata

SEQ ID NO: 347133 - DNA, 25 bp, Rattus norvegicus
gaggcagctggataagtgtcacata

SEQ ID NO: 347134 - DNA, 25 bp, Rattus norvegicus
gaggcagctggtcacactcttctca

SEQ ID NO: 347135 - DNA, 25 bp, Rattus norvegicus
gaggcagctggtgacactcttctca

SEQ ID NO: 347136 - DNA, 25 bp, Rattus norvegicus
gaggcagcttcaccacctatagtgg

SEQ ID NO: 347137 - DNA, 25 bp, Rattus norvegicus
gaggcagcttcagcacctatagtgg

SEQ ID NO: 347138 - DNA, 25 bp, Rattus norvegicus
gaggcagcttccaaacaggtgacat

SEQ ID NO: 347139 - DNA, 25 bp, Rattus norvegicus
gaggcagcttcctaacaggtgacat

SEQ ID NO: 347140 - DNA, 25 bp, Rattus norvegicus
gaggcaggaacgctgcgctttacct

SEQ ID NO: 347141 - DNA, 25 bp, Rattus norvegicus
gaggcaggaacggtgcgctttacct

SEQ ID NO: 347142 - DNA, 25 bp, Rattus norvegicus
gaggcaggaagcactacagactttc

SEQ ID NO: 347143 - DNA, 25 bp, Rattus norvegicus
gaggcaggaagctctacagactttc

SEQ ID NO: 347144 - DNA, 25 bp, Rattus norvegicus
gaggcaggaatgagctctccagaat

SEQ ID NO: 347145 - DNA, 25 bp, Rattus norvegicus
gaggcaggaatgtgctctccagaat

SEQ ID NO: 347146 - DNA, 25 bp, Rattus norvegicus
gaggcaggacataccatgcagagcc

SEQ ID NO: 347147 - DNA, 25 bp, Rattus norvegicus
gaggcaggacattccatgcagagcc

SEQ ID NO: 347148 - DNA, 25 bp, Rattus norvegicus
gaggcaggactacctgggcacaatc

SEQ ID NO: 347149 - DNA, 25 bp, Rattus norvegicus
gaggcaggactagctgggcacaatc

SEQ ID NO: 347150 - DNA, 25 bp, Rattus norvegicus
gaggcaggagatcagcagcttataa

SEQ ID NO: 347151 - DNA, 25 bp, Rattus norvegicus
gaggcaggagatgagcagcttataa

SEQ ID NO: 347152 - DNA, 25 bp, Rattus norvegicus
gaggcaggaggacacctacatccgt

SEQ ID NO: 347153 - DNA, 25 bp, Rattus norvegicus
gaggcaggaggagacctacatccgt

SEQ ID NO: 347154 - DNA, 25 bp, Rattus norvegicus
gaggcaggaggcattcaagttcact

SEQ ID NO: 347155 - DNA, 25 bp, Rattus norvegicus
gaggcaggaggctttcaagttcact

SEQ ID NO: 347156 - DNA, 25 bp, Rattus norvegicus
gaggcaggatcactttctttttgtg

SEQ ID NO: 347157 - DNA, 25 bp, Rattus norvegicus
gaggcaggatcagtttctttttgtg

SEQ ID NO: 347158 - DNA, 25 bp, Rattus norvegicus
gaggcaggattcactgaggtcagac

SEQ ID NO: 347159 - DNA, 25 bp, Rattus norvegicus
gaggcaggattctctgaggtcagac

SEQ ID NO: 347160 - DNA, 25 bp, Rattus norvegicus
gaggcaggcaaaatcagacttatga

SEQ ID NO: 347161 - DNA, 25 bp, Rattus norvegicus
gaggcaggcaaattcagacttatga

SEQ ID NO: 347162 - DNA, 25 bp, Rattus norvegicus
gaggcaggcccactgatttatgata

SEQ ID NO: 347163 - DNA, 25 bp, Rattus norvegicus
gaggcaggcccagtgatttatgata

SEQ ID NO: 347164 - DNA, 25 bp, Rattus norvegicus
gaggcaggcctccaacttgcttagc

SEQ ID NO: 347165 - DNA, 25 bp, Rattus norvegicus
gaggcaggcctcgaacttgcttagc

SEQ ID NO: 347166 - DNA, 25 bp, Rattus norvegicus
gaggcaggccttccaaggagacact

SEQ ID NO: 347167 - DNA, 25 bp, Rattus norvegicus
gaggcaggccttcctccaaaaaaga

SEQ ID NO: 347168 - DNA, 25 bp, Rattus norvegicus
gaggcaggccttgcaaggagacact

SEQ ID NO: 347169 - DNA, 25 bp, Rattus norvegicus
gaggcaggccttgctccaaaaaaga

SEQ ID NO: 347170 - DNA, 25 bp, Rattus norvegicus
gaggcaggcgctcctcacaagccga

SEQ ID NO: 347171 - DNA, 25 bp, Rattus norvegicus
gaggcaggcgctgctcacaagccga

SEQ ID NO: 347172 - DNA, 25 bp, Rattus norvegicus
gaggcaggctcgatatcagcttcgg

SEQ ID NO: 347173 - DNA, 25 bp, Rattus norvegicus
gaggcaggctcgttatcagcttcgg

SEQ ID NO: 347174 - DNA, 25 bp, Rattus norvegicus
gaggcaggctgaactctcaccaaaa

SEQ ID NO: 347175 - DNA, 25 bp, Rattus norvegicus
gaggcaggctgactactgtcaatgc

SEQ ID NO: 347176 - DNA, 25 bp, Rattus norvegicus
gaggcaggctgagtactgtcaatgc

SEQ ID NO: 347177 - DNA, 25 bp, Rattus norvegicus
gaggcaggctgatctctcaccaaaa

SEQ ID NO: 347178 - DNA, 25 bp, Rattus norvegicus
gaggcaggcttactggccctgtttc

SEQ ID NO: 347179 - DNA, 25 bp, Rattus norvegicus
gaggcaggcttagtggccctgtttc

SEQ ID NO: 347180 - DNA, 25 bp, Rattus norvegicus
gaggcagggcccaagcctgaccaga

SEQ ID NO: 347181 - DNA, 25 bp, Rattus norvegicus
gaggcagggccctagcctgaccaga

SEQ ID NO: 347182 - DNA, 25 bp, Rattus norvegicus
gaggcagggccgcaaagctccccaa

SEQ ID NO: 347183 - DNA, 25 bp, Rattus norvegicus
gaggcagggccggaaagctccccaa

SEQ ID NO: 347184 - DNA, 25 bp, Rattus norvegicus
gaggcagggcctcacagagcatcca

SEQ ID NO: 347185 - DNA, 25 bp, Rattus norvegicus
gaggcagggcctgacagagcatcca

SEQ ID NO: 347186 - DNA, 25 bp, Rattus norvegicus
gaggcagggtgaactccagtttgaa

SEQ ID NO: 347187 - DNA, 25 bp, Rattus norvegicus
gaggcagggtgatctccagtttgaa

SEQ ID NO: 347188 - DNA, 25 bp, Rattus norvegicus
gaggcaggtcatcctcggatttgat

SEQ ID NO: 347189 - DNA, 25 bp, Rattus norvegicus
gaggcaggtcatgctcggatttgat

SEQ ID NO: 347190 - DNA, 25 bp, Rattus norvegicus
gaggcaggtgtcattgtgatcttga

SEQ ID NO: 347191 - DNA, 25 bp, Rattus norvegicus
gaggcaggtgtctttgtgatcttga

SEQ ID NO: 347192 - DNA, 25 bp, Rattus norvegicus
gaggcaggtgttcgctacacattca

SEQ ID NO: 347193 - DNA, 25 bp, Rattus norvegicus
gaggcaggtgttggctacacattca

SEQ ID NO: 347194 - DNA, 25 bp, Rattus norvegicus
gaggcagtacacagctagtttagaa

SEQ ID NO: 347195 - DNA, 25 bp, Rattus norvegicus
gaggcagtacactgctagtttagaa

SEQ ID NO: 347196 - DNA, 25 bp, Rattus norvegicus
gaggcagtaccaacatccatattat

SEQ ID NO: 347197 - DNA, 25 bp, Rattus norvegicus
gaggcagtaccaagggttcctgtag

SEQ ID NO: 347198 - DNA, 25 bp, Rattus norvegicus
gaggcagtaccatcatccatattat

SEQ ID NO: 347199 - DNA, 25 bp, Rattus norvegicus
gaggcagtaccatgggttcctgtag

SEQ ID NO: 347200 - DNA, 25 bp, Rattus norvegicus
gaggcagtagctaattttctactaa

SEQ ID NO: 347201 - DNA, 25 bp, Rattus norvegicus
gaggcagtagctcaattgttgcaca

SEQ ID NO: 347202 - DNA, 25 bp, Rattus norvegicus
gaggcagtagctgaattgttgcaca

SEQ ID NO: 347203 - DNA, 25 bp, Rattus norvegicus
gaggcagtagcttattttctactaa

SEQ ID NO: 347204 - DNA, 25 bp, Rattus norvegicus
gaggcagtatggctcccggcacaaa

SEQ ID NO: 347205 - DNA, 25 bp, Rattus norvegicus
gaggcagtatgggtcccggcacaaa

SEQ ID NO: 347206 - DNA, 25 bp, Rattus norvegicus
gaggcagtcagaccactcactgtga

SEQ ID NO: 347207 - DNA, 25 bp, Rattus norvegicus
gaggcagtcagagcactcactgtga

SEQ ID NO: 347208 - DNA, 25 bp, Rattus norvegicus
gaggcagtcagcatcttagtcttaa

SEQ ID NO: 347209 - DNA, 25 bp, Rattus norvegicus
gaggcagtcagcttcttagtcttaa

SEQ ID NO: 347210 - DNA, 25 bp, Rattus norvegicus
gaggcagtcattcatttcacatgta

SEQ ID NO: 347211 - DNA, 25 bp, Rattus norvegicus
gaggcagtcattgatttcacatgta

SEQ ID NO: 347212 - DNA, 25 bp, Rattus norvegicus
gaggcagtccctcagtgtgtgacac

SEQ ID NO: 347213 - DNA, 25 bp, Rattus norvegicus
gaggcagtccctgagtgtgtgacac

SEQ ID NO: 347214 - DNA, 25 bp, Rattus norvegicus
gaggcagtcctacgtcaagttgacc

SEQ ID NO: 347215 - DNA, 25 bp, Rattus norvegicus
gaggcagtcctaggtcaagttgacc

SEQ ID NO: 347216 - DNA, 25 bp, Rattus norvegicus
gaggcagtcgctcgcttttcagttt

SEQ ID NO: 347217 - DNA, 25 bp, Rattus norvegicus
gaggcagtcgctggcttttcagttt

SEQ ID NO: 347218 - DNA, 25 bp, Rattus norvegicus
gaggcagtctatagcaaggaccttc

SEQ ID NO: 347219 - DNA, 25 bp, Rattus norvegicus
gaggcagtctattgcaaggaccttc

SEQ ID NO: 347220 - DNA, 25 bp, Rattus norvegicus
gaggcagtctgtcatggtccagtcc

SEQ ID NO: 347221 - DNA, 25 bp, Rattus norvegicus
gaggcagtctgtgatggtccagtcc

SEQ ID NO: 347222 - DNA, 25 bp, Rattus norvegicus
gaggcagtcttcactggtggtcgca

SEQ ID NO: 347223 - DNA, 25 bp, Rattus norvegicus
gaggcagtcttctctggtggtcgca

SEQ ID NO: 347224 - DNA, 25 bp, Rattus norvegicus
gaggcagtgccactagcagttccaa

SEQ ID NO: 347225 - DNA, 25 bp, Rattus norvegicus
gaggcagtgccagtagcagttccaa

SEQ ID NO: 347226 - DNA, 25 bp, Rattus norvegicus
gaggcagtgcctatactacacattt

SEQ ID NO: 347227 - DNA, 25 bp, Rattus norvegicus
gaggcagtgcctttactacacattt

SEQ ID NO: 347228 - DNA, 25 bp, Rattus norvegicus
gaggcagtggcaaccctaggaattc

SEQ ID NO: 347229 - DNA, 25 bp, Rattus norvegicus
gaggcagtggcatccctaggaattc

SEQ ID NO: 347230 - DNA, 25 bp, Rattus norvegicus
gaggcagtgttgaaaaccctactct

SEQ ID NO: 347231 - DNA, 25 bp, Rattus norvegicus
gaggcagtgttgtaaaccctactct

SEQ ID NO: 347232 - DNA, 25 bp, Rattus norvegicus
gaggcagttaaaattcatggtgtac

SEQ ID NO: 347233 - DNA, 25 bp, Rattus norvegicus
gaggcagttaaatttcatggtgtac

SEQ ID NO: 347234 - DNA, 25 bp, Rattus norvegicus
gaggcagttattaaaagtttaccag

SEQ ID NO: 347235 - DNA, 25 bp, Rattus norvegicus
gaggcagttatttaaagtttaccag

SEQ ID NO: 347236 - DNA, 25 bp, Rattus norvegicus
gaggcagttcctaaatccagctttc

SEQ ID NO: 347237 - DNA, 25 bp, Rattus norvegicus
gaggcagttccttaatccagctttc

SEQ ID NO: 347238 - DNA, 25 bp, Rattus norvegicus
gaggcagttctgctgtacctgtgcc

SEQ ID NO: 347239 - DNA, 25 bp, Rattus norvegicus
gaggcagttctggtgtacctgtgcc

SEQ ID NO: 347240 - DNA, 25 bp, Rattus norvegicus
gaggcagttggaatgccagctaact

SEQ ID NO: 347241 - DNA, 25 bp, Rattus norvegicus
gaggcagttggattgccagctaact

SEQ ID NO: 347242 - DNA, 25 bp, Rattus norvegicus
gaggcagtttctcaaggtccccagc

SEQ ID NO: 347243 - DNA, 25 bp, Rattus norvegicus
gaggcagtttctgaaggtccccagc

SEQ ID NO: 347244 - DNA, 25 bp, Rattus norvegicus
gaggcagttttcagtttagatgacc

SEQ ID NO: 347245 - DNA, 25 bp, Rattus norvegicus
gaggcagttttctgtttagatgacc

SEQ ID NO: 347246 - DNA, 25 bp, Rattus norvegicus
gaggcatacactacacctgtctcta

SEQ ID NO: 347247 - DNA, 25 bp, Rattus norvegicus
gaggcatacacttcacctgtctcta

SEQ ID NO: 347248 - DNA, 25 bp, Rattus norvegicus
gaggcataccccacgaagaggctaa

SEQ ID NO: 347249 - DNA, 25 bp, Rattus norvegicus
gaggcatacccctcgaagaggctaa

SEQ ID NO: 347250 - DNA, 25 bp, Rattus norvegicus
gaggcatactccaagtagagaaccg

SEQ ID NO: 347251 - DNA, 25 bp, Rattus norvegicus
gaggcatactcctagtagagaaccg

SEQ ID NO: 347252 - DNA, 25 bp, Rattus norvegicus
gaggcatagacaatccctggtgtac

SEQ ID NO: 347253 - DNA, 25 bp, Rattus norvegicus
gaggcatagacattccctggtgtac

SEQ ID NO: 347254 - DNA, 25 bp, Rattus norvegicus
gaggcatagagccaaccctgctgtg

SEQ ID NO: 347255 - DNA, 25 bp, Rattus norvegicus
gaggcatagagcgaaccctgctgtg

SEQ ID NO: 347256 - DNA, 25 bp, Rattus norvegicus
gaggcatagatcacactaaatagct

SEQ ID NO: 347257 - DNA, 25 bp, Rattus norvegicus
gaggcatagatctcactaaatagct

SEQ ID NO: 347258 - DNA, 25 bp, Rattus norvegicus
gaggcatagctcaagctcgctggtg

SEQ ID NO: 347259 - DNA, 25 bp, Rattus norvegicus
gaggcatagctctagctcgctggtg

SEQ ID NO: 347260 - DNA, 25 bp, Rattus norvegicus
gaggcatagtttatactgaacaatc

SEQ ID NO: 347261 - DNA, 25 bp, Rattus norvegicus
gaggcatagtttttactgaacaatc

SEQ ID NO: 347262 - DNA, 25 bp, Rattus norvegicus
gaggcatatctgacatcccaaagga

SEQ ID NO: 347263 - DNA, 25 bp, Rattus norvegicus
gaggcatatctgtcatcccaaagga

SEQ ID NO: 347264 - DNA, 25 bp, Rattus norvegicus
gaggcatattcaaatgttccacgaa

SEQ ID NO: 347265 - DNA, 25 bp, Rattus norvegicus
gaggcatattcatatgttccacgaa

SEQ ID NO: 347266 - DNA, 25 bp, Rattus norvegicus
gaggcatcaatcagggcgacagaga

SEQ ID NO: 347267 - DNA, 25 bp, Rattus norvegicus
gaggcatcaatctgggcgacagaga

SEQ ID NO: 347268 - DNA, 25 bp, Rattus norvegicus
gaggcatcacagatgggagctccaa

SEQ ID NO: 347269 - DNA, 25 bp, Rattus norvegicus
gaggcatcacagttgggagctccaa

SEQ ID NO: 347270 - DNA, 25 bp, Rattus norvegicus
gaggcatcacgaatctgctttctac

SEQ ID NO: 347271 - DNA, 25 bp, Rattus norvegicus
gaggcatcacgattctgctttctac

SEQ ID NO: 347272 - DNA, 25 bp, Rattus norvegicus
gaggcatcataaattttgccccttt

SEQ ID NO: 347273 - DNA, 25 bp, Rattus norvegicus
gaggcatcataatttttgccccttt

SEQ ID NO: 347274 - DNA, 25 bp, Rattus norvegicus
gaggcatccaagaagggcccagcca

SEQ ID NO: 347275 - DNA, 25 bp, Rattus norvegicus
gaggcatccaagtagggcccagcca

SEQ ID NO: 347276 - DNA, 25 bp, Rattus norvegicus
gaggcatccagtcaaccgagagtta

SEQ ID NO: 347277 - DNA, 25 bp, Rattus norvegicus
gaggcatccagtgaaccgagagtta

SEQ ID NO: 347278 - DNA, 25 bp, Rattus norvegicus
gaggcatcccaactttcatatacta

SEQ ID NO: 347279 - DNA, 25 bp, Rattus norvegicus
gaggcatcccaagtttcatatacta

SEQ ID NO: 347280 - DNA, 25 bp, Rattus norvegicus
gaggcatccgatatcttgaaggctt

SEQ ID NO: 347281 - DNA, 25 bp, Rattus norvegicus
gaggcatccgatttcttgaaggctt

SEQ ID NO: 347282 - DNA, 25 bp, Rattus norvegicus
gaggcatccgctaggcgcactcctg

SEQ ID NO: 347283 - DNA, 25 bp, Rattus norvegicus
gaggcatccgcttggcgcactcctg

SEQ ID NO: 347284 - DNA, 25 bp, Rattus norvegicus
gaggcatccggtctacatgcacata

SEQ ID NO: 347285 - DNA, 25 bp, Rattus norvegicus
gaggcatccggtgtacatgcacata

SEQ ID NO: 347286 - DNA, 25 bp, Rattus norvegicus
gaggcatcgataacacacatacatt

SEQ ID NO: 347287 - DNA, 25 bp, Rattus norvegicus
gaggcatcgatatcacacatacatt

SEQ ID NO: 347288 - DNA, 25 bp, Rattus norvegicus
gaggcatcggcaaggaacttggacc

SEQ ID NO: 347289 - DNA, 25 bp, Rattus norvegicus
gaggcatcggcatggaacttggacc

SEQ ID NO: 347290 - DNA, 25 bp, Rattus norvegicus
gaggcatctactatgccttttggta

SEQ ID NO: 347291 - DNA, 25 bp, Rattus norvegicus
gaggcatctactttgccttttggta

SEQ ID NO: 347292 - DNA, 25 bp, Rattus norvegicus
gaggcatctccaaaatgggctactt

SEQ ID NO: 347293 - DNA, 25 bp, Rattus norvegicus
gaggcatctccaacaagttgcagga

SEQ ID NO: 347294 - DNA, 25 bp, Rattus norvegicus
gaggcatctccataatgggctactt

SEQ ID NO: 347295 - DNA, 25 bp, Rattus norvegicus
gaggcatctccatcaagttgcagga

SEQ ID NO: 347296 - DNA, 25 bp, Rattus norvegicus
gaggcatctctgcaccatggaagct

SEQ ID NO: 347297 - DNA, 25 bp, Rattus norvegicus
gaggcatctctggaccatggaagct

SEQ ID NO: 347298 - DNA, 25 bp, Rattus norvegicus
gaggcatctgatagggatcttggtt

SEQ ID NO: 347299 - DNA, 25 bp, Rattus norvegicus
gaggcatctgattgggatcttggtt

SEQ ID NO: 347300 - DNA, 25 bp, Rattus norvegicus
gaggcatctgggacattgtcattca

SEQ ID NO: 347301 - DNA, 25 bp, Rattus norvegicus
gaggcatctgggtcattgtcattca

SEQ ID NO: 347302 - DNA, 25 bp, Rattus norvegicus
gaggcatcttggaagcctggtcagc

SEQ ID NO: 347303 - DNA, 25 bp, Rattus norvegicus
gaggcatcttggtagcctggtcagc

SEQ ID NO: 347304 - DNA, 25 bp, Rattus norvegicus
gaggcatctttgagggacaccttcc

SEQ ID NO: 347305 - DNA, 25 bp, Rattus norvegicus
gaggcatctttgtgggacaccttcc

SEQ ID NO: 347306 - DNA, 25 bp, Rattus norvegicus
gaggcatgaggccatcatactttcc

SEQ ID NO: 347307 - DNA, 25 bp, Rattus norvegicus
gaggcatgaggcgatcatactttcc

SEQ ID NO: 347308 - DNA, 25 bp, Rattus norvegicus
gaggcatgaggtacctggacagaca

SEQ ID NO: 347309 - DNA, 25 bp, Rattus norvegicus
gaggcatgaggttcctggacagaca

SEQ ID NO: 347310 - DNA, 25 bp, Rattus norvegicus
gaggcatgcaaaatgttcctgaagt

SEQ ID NO: 347311 - DNA, 25 bp, Rattus norvegicus
gaggcatgcaaattgttcctgaagt

SEQ ID NO: 347312 - DNA, 25 bp, Rattus norvegicus
gaggcatgccttaagtaattagttt

SEQ ID NO: 347313 - DNA, 25 bp, Rattus norvegicus
gaggcatgcctttagtaattagttt

SEQ ID NO: 347314 - DNA, 25 bp, Rattus norvegicus
gaggcatggcggctcttcctggagg

SEQ ID NO: 347315 - DNA, 25 bp, Rattus norvegicus
gaggcatggcgggtcttcctggagg

SEQ ID NO: 347316 - DNA, 25 bp, Rattus norvegicus
gaggcatggctaagagaaccccacc

SEQ ID NO: 347317 - DNA, 25 bp, Rattus norvegicus
gaggcatggctatgagaaccccacc

SEQ ID NO: 347318 - DNA, 25 bp, Rattus norvegicus
gaggcatggcttacataccttgaag

SEQ ID NO: 347319 - DNA, 25 bp, Rattus norvegicus
gaggcatggctttcataccttgaag

SEQ ID NO: 347320 - DNA, 25 bp, Rattus norvegicus
gaggcatgtccaatgatcaggcttt

SEQ ID NO: 347321 - DNA, 25 bp, Rattus norvegicus
gaggcatgtccattgatcaggcttt

SEQ ID NO: 347322 - DNA, 25 bp, Rattus norvegicus
gaggcatgtggactcttccagttcc

SEQ ID NO: 347323 - DNA, 25 bp, Rattus norvegicus
gaggcatgtggagtcttccagttcc

SEQ ID NO: 347324 - DNA, 25 bp, Rattus norvegicus
gaggcatgttttctttactgggtat

SEQ ID NO: 347325 - DNA, 25 bp, Rattus norvegicus
gaggcatgttttgtttactgggtat

SEQ ID NO: 347326 - DNA, 25 bp, Rattus norvegicus
gaggcattaaacacaccacactgac

SEQ ID NO: 347327 - DNA, 25 bp, Rattus norvegicus
gaggcattaaactcaccacactgac

SEQ ID NO: 347328 - DNA, 25 bp, Rattus norvegicus
gaggcattaaggaagctaactttat

SEQ ID NO: 347329 - DNA, 25 bp, Rattus norvegicus
gaggcattaaggtagctaactttat

SEQ ID NO: 347330 - DNA, 25 bp, Rattus norvegicus
gaggcattatccatcctggttccgt

SEQ ID NO: 347331 - DNA, 25 bp, Rattus norvegicus
gaggcattatccttcctggttccgt

SEQ ID NO: 347332 - DNA, 25 bp, Rattus norvegicus
gaggcattatgtcaaggtaccgagt

SEQ ID NO: 347333 - DNA, 25 bp, Rattus norvegicus
gaggcattatgtgaaggtaccgagt

SEQ ID NO: 347334 - DNA, 25 bp, Rattus norvegicus
gaggcattcaaaaaggacaccaaag

SEQ ID NO: 347335 - DNA, 25 bp, Rattus norvegicus
gaggcattcaaataggacaccaaag

SEQ ID NO: 347336 - DNA, 25 bp, Rattus norvegicus
gaggcattcaagcagctcggccgaa

SEQ ID NO: 347337 - DNA, 25 bp, Rattus norvegicus
gaggcattcaaggagctcggccgaa

SEQ ID NO: 347338 - DNA, 25 bp, Rattus norvegicus
gaggcattcaatatctgctcacatt

SEQ ID NO: 347339 - DNA, 25 bp, Rattus norvegicus
gaggcattcaatttctgctcacatt

SEQ ID NO: 347340 - DNA, 25 bp, Rattus norvegicus
gaggcattcagtatcagattgacta

SEQ ID NO: 347341 - DNA, 25 bp, Rattus norvegicus
gaggcattcagtttcagattgacta

SEQ ID NO: 347342 - DNA, 25 bp, Rattus norvegicus
gaggcattccaaagtagttctacca

SEQ ID NO: 347343 - DNA, 25 bp, Rattus norvegicus
gaggcattccaatgtagttctacca

SEQ ID NO: 347344 - DNA, 25 bp, Rattus norvegicus
gaggcattcccaatactgtagtcag

SEQ ID NO: 347345 - DNA, 25 bp, Rattus norvegicus
gaggcattcccattactgtagtcag

SEQ ID NO: 347346 - DNA, 25 bp, Rattus norvegicus
gaggcattcctgagatcctgggata

SEQ ID NO: 347347 - DNA, 25 bp, Rattus norvegicus
gaggcattcctgtgatcctgggata

SEQ ID NO: 347348 - DNA, 25 bp, Rattus norvegicus
gaggcattctcaaagacgctacacg

SEQ ID NO: 347349 - DNA, 25 bp, Rattus norvegicus
gaggcattctcatagacgctacacg

SEQ ID NO: 347350 - DNA, 25 bp, Rattus norvegicus
gaggcattctctacatagggcacag

SEQ ID NO: 347351 - DNA, 25 bp, Rattus norvegicus
gaggcattctcttcatagggcacag

SEQ ID NO: 347352 - DNA, 25 bp, Rattus norvegicus
gaggcattctgaccagtggtgacca

SEQ ID NO: 347353 - DNA, 25 bp, Rattus norvegicus
gaggcattctgagcagtggtgacca

SEQ ID NO: 347354 - DNA, 25 bp, Rattus norvegicus
gaggcattcttcaaccaaatggagc

SEQ ID NO: 347355 - DNA, 25 bp, Rattus norvegicus
gaggcattcttctaccaaatggagc

SEQ ID NO: 347356 - DNA, 25 bp, Rattus norvegicus
gaggcattgaatagttcccaacaag

SEQ ID NO: 347357 - DNA, 25 bp, Rattus norvegicus
gaggcattgaattgttcccaacaag

SEQ ID NO: 347358 - DNA, 25 bp, Rattus norvegicus
gaggcattgagtcctctcttctggc

SEQ ID NO: 347359 - DNA, 25 bp, Rattus norvegicus
gaggcattgagtgctctcttctggc

SEQ ID NO: 347360 - DNA, 25 bp, Rattus norvegicus
gaggcattgtctcatgttcaggtca

SEQ ID NO: 347361 - DNA, 25 bp, Rattus norvegicus
gaggcattgtctgatgttcaggtca

SEQ ID NO: 347362 - DNA, 25 bp, Rattus norvegicus
gaggcatttcaaaatctcctgtttt

SEQ ID NO: 347363 - DNA, 25 bp, Rattus norvegicus
gaggcatttcaatatctcctgtttt

SEQ ID NO: 347364 - DNA, 25 bp, Rattus norvegicus
gaggcatttcagcactacttacgta

SEQ ID NO: 347365 - DNA, 25 bp, Rattus norvegicus
gaggcatttcaggactacttacgta

SEQ ID NO: 347366 - DNA, 25 bp, Rattus norvegicus
gaggcatttcttcttggcaaccaac

SEQ ID NO: 347367 - DNA, 25 bp, Rattus norvegicus
gaggcatttcttgttggcaaccaac

SEQ ID NO: 347368 - DNA, 25 bp, Rattus norvegicus
gaggcatttgcgctttatataaaaa

SEQ ID NO: 347369 - DNA, 25 bp, Rattus norvegicus
gaggcatttgcggtttatataaaaa

SEQ ID NO: 347370 - DNA, 25 bp, Rattus norvegicus
gaggcatttgtgacatctgcttata

SEQ ID NO: 347371 - DNA, 25 bp, Rattus norvegicus
gaggcatttgtgtcatctgcttata

SEQ ID NO: 347372 - DNA, 25 bp, Rattus norvegicus
gaggccaaaactagcacacagctat

SEQ ID NO: 347373 - DNA, 25 bp, Rattus norvegicus
gaggccaaaacttgcacacagctat

SEQ ID NO: 347374 - DNA, 25 bp, Rattus norvegicus
gaggccaaacatcgtcaccgacttg

SEQ ID NO: 347375 - DNA, 25 bp, Rattus norvegicus
gaggccaaacatggtcaccgacttg

SEQ ID NO: 347376 - DNA, 25 bp, Rattus norvegicus
gaggccaaactccataggtgaagtt

SEQ ID NO: 347377 - DNA, 25 bp, Rattus norvegicus
gaggccaaactcgataggtgaagtt

SEQ ID NO: 347378 - DNA, 25 bp, Rattus norvegicus
gaggccaaactgctccaagttcgtg

SEQ ID NO: 347379 - DNA, 25 bp, Rattus norvegicus
gaggccaaactggtccaagttcgtg

SEQ ID NO: 347380 - DNA, 25 bp, Rattus norvegicus
gaggccaaaggtcctcatcgttaca

SEQ ID NO: 347381 - DNA, 25 bp, Rattus norvegicus
gaggccaaaggtgctcatcgttaca

SEQ ID NO: 347382 - DNA, 25 bp, Rattus norvegicus
gaggccaaatctcttagccacgaac

SEQ ID NO: 347383 - DNA, 25 bp, Rattus norvegicus
gaggccaaatctcttcaaggtttat

SEQ ID NO: 347384 - DNA, 25 bp, Rattus norvegicus
gaggccaaatctgttagccacgaac

SEQ ID NO: 347385 - DNA, 25 bp, Rattus norvegicus
gaggccaaatctgttcaaggtttat

SEQ ID NO: 347386 - DNA, 25 bp, Rattus norvegicus
gaggccaaattgaatcttccagaag

SEQ ID NO: 347387 - DNA, 25 bp, Rattus norvegicus
gaggccaaattgtatcttccagaag

SEQ ID NO: 347388 - DNA, 25 bp, Rattus norvegicus
gaggccaacagaagctttaactttt

SEQ ID NO: 347389 - DNA, 25 bp, Rattus norvegicus
gaggccaacagatgctttaactttt

SEQ ID NO: 347390 - DNA, 25 bp, Rattus norvegicus
gaggccaacatgaacccagaagtct

SEQ ID NO: 347391 - DNA, 25 bp, Rattus norvegicus
gaggccaacatgtacccagaagtct

SEQ ID NO: 347392 - DNA, 25 bp, Rattus norvegicus
gaggccaaccagaagaacacccatt

SEQ ID NO: 347393 - DNA, 25 bp, Rattus norvegicus
gaggccaaccagtagaacacccatt

SEQ ID NO: 347394 - DNA, 25 bp, Rattus norvegicus
gaggccaaccgtctgctgctgaaat

SEQ ID NO: 347395 - DNA, 25 bp, Rattus norvegicus
gaggccaaccgtgtgctgctgaaat

SEQ ID NO: 347396 - DNA, 25 bp, Rattus norvegicus
gaggccaacgagactacaggaatca

SEQ ID NO: 347397 - DNA, 25 bp, Rattus norvegicus
gaggccaacgagtctacaggaatca

SEQ ID NO: 347398 - DNA, 25 bp, Rattus norvegicus
gaggccaagaaactttctggttacg

SEQ ID NO: 347399 - DNA, 25 bp, Rattus norvegicus
gaggccaagaaagtttctggttacg

SEQ ID NO: 347400 - DNA, 25 bp, Rattus norvegicus
gaggccaagaagctttttctcccag

SEQ ID NO: 347401 - DNA, 25 bp, Rattus norvegicus
gaggccaagaaggtttttctcccag

SEQ ID NO: 347402 - DNA, 25 bp, Rattus norvegicus
gaggccaagccaatttgtaactaga

SEQ ID NO: 347403 - DNA, 25 bp, Rattus norvegicus
gaggccaagccattttgtaactaga

SEQ ID NO: 347404 - DNA, 25 bp, Rattus norvegicus
gaggccaaggagcaagcactcgatt

SEQ ID NO: 347405 - DNA, 25 bp, Rattus norvegicus
gaggccaaggaggaagcactcgatt

SEQ ID NO: 347406 - DNA, 25 bp, Rattus norvegicus
gaggccaagtagctgctttactctg

SEQ ID NO: 347407 - DNA, 25 bp, Rattus norvegicus
gaggccaagtaggtgctttactctg

SEQ ID NO: 347408 - DNA, 25 bp, Rattus norvegicus
gaggccaagtcacagtccagaactg

SEQ ID NO: 347409 - DNA, 25 bp, Rattus norvegicus
gaggccaagtcagagtccagaactg

SEQ ID NO: 347410 - DNA, 25 bp, Rattus norvegicus
gaggccaagtccatggttgacatca

SEQ ID NO: 347411 - DNA, 25 bp, Rattus norvegicus
gaggccaagtccttggttgacatca

SEQ ID NO: 347412 - DNA, 25 bp, Rattus norvegicus
gaggccaagtggagctttctttgtc

SEQ ID NO: 347413 - DNA, 25 bp, Rattus norvegicus
gaggccaagtggtgctttctttgtc

SEQ ID NO: 347414 - DNA, 25 bp, Rattus norvegicus
gaggccaagttcaaggtctttcctt

SEQ ID NO: 347415 - DNA, 25 bp, Rattus norvegicus
gaggccaagttcatgaaatcctttc

SEQ ID NO: 347416 - DNA, 25 bp, Rattus norvegicus
gaggccaagttctaggtctttcctt

SEQ ID NO: 347417 - DNA, 25 bp, Rattus norvegicus
gaggccaagttcttgaaatcctttc

SEQ ID NO: 347418 - DNA, 25 bp, Rattus norvegicus
gaggccacaatgctgtttgctgaac

SEQ ID NO: 347419 - DNA, 25 bp, Rattus norvegicus
gaggccacaatggtgtttgctgaac

SEQ ID NO: 347420 - DNA, 25 bp, Rattus norvegicus
gaggccacactgactgtaactgtac

SEQ ID NO: 347421 - DNA, 25 bp, Rattus norvegicus
gaggccacactgtctgtaactgtac

SEQ ID NO: 347422 - DNA, 25 bp, Rattus norvegicus
gaggccacacttaccaacatttaat

SEQ ID NO: 347423 - DNA, 25 bp, Rattus norvegicus
gaggccacactttccaacatttaat

SEQ ID NO: 347424 - DNA, 25 bp, Rattus norvegicus
gaggccacagagactcggctcaaag

SEQ ID NO: 347425 - DNA, 25 bp, Rattus norvegicus
gaggccacagagtctcggctcaaag

SEQ ID NO: 347426 - DNA, 25 bp, Rattus norvegicus
gaggccacagcaaccatcaggctaa

SEQ ID NO: 347427 - DNA, 25 bp, Rattus norvegicus
gaggccacagcatccatcaggctaa

SEQ ID NO: 347428 - DNA, 25 bp, Rattus norvegicus
gaggccacagtgaagtagtagcaat

SEQ ID NO: 347429 - DNA, 25 bp, Rattus norvegicus
gaggccacagtgtagtagtagcaat

SEQ ID NO: 347430 - DNA, 25 bp, Rattus norvegicus
gaggccacatgacacaacacgtttt

SEQ ID NO: 347431 - DNA, 25 bp, Rattus norvegicus
gaggccacatgagacaacacgtttt

SEQ ID NO: 347432 - DNA, 25 bp, Rattus norvegicus
gaggccacatggacgtgcactgtgc

SEQ ID NO: 347433 - DNA, 25 bp, Rattus norvegicus
gaggccacatggtcgtgcactgtgc

SEQ ID NO: 347434 - DNA, 25 bp, Rattus norvegicus
gaggccacatgtccagtttcataaa

SEQ ID NO: 347435 - DNA, 25 bp, Rattus norvegicus
gaggccacatgtgcagtttcataaa

SEQ ID NO: 347436 - DNA, 25 bp, Rattus norvegicus
gaggccaccaccagcagagatgaaa

SEQ ID NO: 347437 - DNA, 25 bp, Rattus norvegicus
gaggccaccacctgcagagatgaaa

SEQ ID NO: 347438 - DNA, 25 bp, Rattus norvegicus
gaggccaccccaaaggattgatgca

SEQ ID NO: 347439 - DNA, 25 bp, Rattus norvegicus
gaggccaccccacaagtcttcaagg

SEQ ID NO: 347440 - DNA, 25 bp, Rattus norvegicus
gaggccaccccagaagtcttcaagg

SEQ ID NO: 347441 - DNA, 25 bp, Rattus norvegicus
gaggccaccccataggattgatgca

SEQ ID NO: 347442 - DNA, 25 bp, Rattus norvegicus
gaggccacccgaagtttcaaagtga

SEQ ID NO: 347443 - DNA, 25 bp, Rattus norvegicus
gaggccacccgatgtttcaaagtga

SEQ ID NO: 347444 - DNA, 25 bp, Rattus norvegicus
gaggccaccctgaaactgtgactgg

SEQ ID NO: 347445 - DNA, 25 bp, Rattus norvegicus
gaggccaccctgtaactgtgactgg

SEQ ID NO: 347446 - DNA, 25 bp, Rattus norvegicus
gaggccaccgatcctgatgttgatg

SEQ ID NO: 347447 - DNA, 25 bp, Rattus norvegicus
gaggccaccgatgctgatgttgatg

SEQ ID NO: 347448 - DNA, 25 bp, Rattus norvegicus
gaggccaccgtcctcttgggaaaag

SEQ ID NO: 347449 - DNA, 25 bp, Rattus norvegicus
gaggccaccgtcgtcttgggaaaag

SEQ ID NO: 347450 - DNA, 25 bp, Rattus norvegicus
gaggccacctcaagggtaaaggcac

SEQ ID NO: 347451 - DNA, 25 bp, Rattus norvegicus
gaggccacctcatgggtaaaggcac

SEQ ID NO: 347452 - DNA, 25 bp, Rattus norvegicus
gaggccacctgaagtatctccagag

SEQ ID NO: 347453 - DNA, 25 bp, Rattus norvegicus
gaggccacctgatgtatctccagag

SEQ ID NO: 347454 - DNA, 25 bp, Rattus norvegicus
gaggccacctttatagccaaacaca

SEQ ID NO: 347455 - DNA, 25 bp, Rattus norvegicus
gaggccacctttttagccaaacaca

SEQ ID NO: 347456 - DNA, 25 bp, Rattus norvegicus
gaggccacgagcaaggtaccatcta

SEQ ID NO: 347457 - DNA, 25 bp, Rattus norvegicus
gaggccacgagctaggtaccatcta

SEQ ID NO: 347458 - DNA, 25 bp, Rattus norvegicus
gaggccacgcctcccaatagtgcta

SEQ ID NO: 347459 - DNA, 25 bp, Rattus norvegicus
gaggccacgcctgccaatagtgcta

SEQ ID NO: 347460 - DNA, 25 bp, Rattus norvegicus
gaggccactcggcttaatcgaagga

SEQ ID NO: 347461 - DNA, 25 bp, Rattus norvegicus
gaggccactcgggttaatcgaagga

SEQ ID NO: 347462 - DNA, 25 bp, Rattus norvegicus
gaggccactgcaaaatacttagacg

SEQ ID NO: 347463 - DNA, 25 bp, Rattus norvegicus
gaggccactgcataatacttagacg

SEQ ID NO: 347464 - DNA, 25 bp, Rattus norvegicus
gaggccactggcatgattcaacata

SEQ ID NO: 347465 - DNA, 25 bp, Rattus norvegicus
gaggccactggcttgattcaacata

SEQ ID NO: 347466 - DNA, 25 bp, Rattus norvegicus
gaggccactggtccacagaacaaca

SEQ ID NO: 347467 - DNA, 25 bp, Rattus norvegicus
gaggccactggtgcacagaacaaca

SEQ ID NO: 347468 - DNA, 25 bp, Rattus norvegicus
gaggccactgtacaagataccttgt

SEQ ID NO: 347469 - DNA, 25 bp, Rattus norvegicus
gaggccactgtagaagataccttgt

SEQ ID NO: 347470 - DNA, 25 bp, Rattus norvegicus
gaggccactgtgagacaactccaca

SEQ ID NO: 347471 - DNA, 25 bp, Rattus norvegicus
gaggccactgtgtgacaactccaca

SEQ ID NO: 347472 - DNA, 25 bp, Rattus norvegicus
gaggccacttggatgttgtatgatt

SEQ ID NO: 347473 - DNA, 25 bp, Rattus norvegicus
gaggccacttggttgttgtatgatt

SEQ ID NO: 347474 - DNA, 25 bp, Rattus norvegicus
gaggccactttcagtgctactgtga

SEQ ID NO: 347475 - DNA, 25 bp, Rattus norvegicus
gaggccactttctgtgctactgtga

SEQ ID NO: 347476 - DNA, 25 bp, Rattus norvegicus
gaggccagaagacatgtccagacta

SEQ ID NO: 347477 - DNA, 25 bp, Rattus norvegicus
gaggccagaagagatgtccagacta

SEQ ID NO: 347478 - DNA, 25 bp, Rattus norvegicus
gaggccagaccaccaaatagatcca

SEQ ID NO: 347479 - DNA, 25 bp, Rattus norvegicus
gaggccagaccagcaaatagatcca

SEQ ID NO: 347480 - DNA, 25 bp, Rattus norvegicus
gaggccagacccagaaccatgattt

SEQ ID NO: 347481 - DNA, 25 bp, Rattus norvegicus
gaggccagaccctgaaccatgattt

SEQ ID NO: 347482 - DNA, 25 bp, Rattus norvegicus
gaggccagagaactgctcgaacaga

SEQ ID NO: 347483 - DNA, 25 bp, Rattus norvegicus
gaggccagagaagtgctcgaacaga

SEQ ID NO: 347484 - DNA, 25 bp, Rattus norvegicus
gaggccagagacaaaaggtgacccg

SEQ ID NO: 347485 - DNA, 25 bp, Rattus norvegicus
gaggccagagactaaaggtgacccg

SEQ ID NO: 347486 - DNA, 25 bp, Rattus norvegicus
gaggccagagagagaatccaggtat

SEQ ID NO: 347487 - DNA, 25 bp, Rattus norvegicus
gaggccagagagtgaatccaggtat

SEQ ID NO: 347488 - DNA, 25 bp, Rattus norvegicus
gaggccagagatcacagagccacct

SEQ ID NO: 347489 - DNA, 25 bp, Rattus norvegicus
gaggccagagatgacagagccacct

SEQ ID NO: 347490 - DNA, 25 bp, Rattus norvegicus
gaggccagaggcagccattatcact

SEQ ID NO: 347491 - DNA, 25 bp, Rattus norvegicus
gaggccagaggctgccattatcact

SEQ ID NO: 347492 - DNA, 25 bp, Rattus norvegicus
gaggccagagtgagtcacacacaac

SEQ ID NO: 347493 - DNA, 25 bp, Rattus norvegicus
gaggccagagtgtgtcacacacaac

SEQ ID NO: 347494 - DNA, 25 bp, Rattus norvegicus
gaggccagatctcttacttaatgac

SEQ ID NO: 347495 - DNA, 25 bp, Rattus norvegicus
gaggccagatctgttacttaatgac

SEQ ID NO: 347496 - DNA, 25 bp, Rattus norvegicus
gaggccagcacacaagccagggtat

SEQ ID NO: 347497 - DNA, 25 bp, Rattus norvegicus
gaggccagcacagaagccagggtat

SEQ ID NO: 347498 - DNA, 25 bp, Rattus norvegicus
gaggccagcagaacagaaggtcaga

SEQ ID NO: 347499 - DNA, 25 bp, Rattus norvegicus
gaggccagcagatcagaaggtcaga

SEQ ID NO: 347500 - DNA, 25 bp, Rattus norvegicus
gaggccagcagccatcttgagcacc

SEQ ID NO: 347501 - DNA, 25 bp, Rattus norvegicus
gaggccagcagccttactgctgtgt

SEQ ID NO: 347502 - DNA, 25 bp, Rattus norvegicus
gaggccagcagcgatcttgagcacc

SEQ ID NO: 347503 - DNA, 25 bp, Rattus norvegicus
gaggccagcagcgttactgctgtgt

SEQ ID NO: 347504 - DNA, 25 bp, Rattus norvegicus
gaggccagccaaaggtgttccaggt

SEQ ID NO: 347505 - DNA, 25 bp, Rattus norvegicus
gaggccagccaatggtgttccaggt

SEQ ID NO: 347506 - DNA, 25 bp, Rattus norvegicus
gaggccagcctgatcaatgtagtgt

SEQ ID NO: 347507 - DNA, 25 bp, Rattus norvegicus
gaggccagcctgattatgtgagatt

SEQ ID NO: 347508 - DNA, 25 bp, Rattus norvegicus
gaggccagcctgttcaatgtagtgt

SEQ ID NO: 347509 - DNA, 25 bp, Rattus norvegicus
gaggccagcctgtttatgtgagatt

SEQ ID NO: 347510 - DNA, 25 bp, Rattus norvegicus
gaggccagcggaacagttttaattt

SEQ ID NO: 347511 - DNA, 25 bp, Rattus norvegicus
gaggccagcggatcagttttaattt

SEQ ID NO: 347512 - DNA, 25 bp, Rattus norvegicus
gaggccagcgttatctgtctcgatt

SEQ ID NO: 347513 - DNA, 25 bp, Rattus norvegicus
gaggccagcgttttctgtctcgatt

SEQ ID NO: 347514 - DNA, 25 bp, Rattus norvegicus
gaggccagctcccaggaaatgtttg

SEQ ID NO: 347515 - DNA, 25 bp, Rattus norvegicus
gaggccagctccgaggaaatgtttg

SEQ ID NO: 347516 - DNA, 25 bp, Rattus norvegicus
gaggccagcttacatacttctctat

SEQ ID NO: 347517 - DNA, 25 bp, Rattus norvegicus
gaggccagcttagatacttctctat

SEQ ID NO: 347518 - DNA, 25 bp, Rattus norvegicus
gaggccaggactaagattgtactat

SEQ ID NO: 347519 - DNA, 25 bp, Rattus norvegicus
gaggccaggacttagattgtactat

SEQ ID NO: 347520 - DNA, 25 bp, Rattus norvegicus
gaggccaggatcagtcagggtcact

SEQ ID NO: 347521 - DNA, 25 bp, Rattus norvegicus
gaggccaggatctgtcagggtcact

SEQ ID NO: 347522 - DNA, 25 bp, Rattus norvegicus
gaggccaggctaactgtggttccag

SEQ ID NO: 347523 - DNA, 25 bp, Rattus norvegicus
gaggccaggctatctgtggttccag

SEQ ID NO: 347524 - DNA, 25 bp, Rattus norvegicus
gaggccaggtacatctggcgcaaga

SEQ ID NO: 347525 - DNA, 25 bp, Rattus norvegicus
gaggccaggtacttctggcgcaaga

SEQ ID NO: 347526 - DNA, 25 bp, Rattus norvegicus
gaggccagtatcctgggtcagcaca

SEQ ID NO: 347527 - DNA, 25 bp, Rattus norvegicus
gaggccagtatcgtgggtcagcaca

SEQ ID NO: 347528 - DNA, 25 bp, Rattus norvegicus
gaggccagtcaaaggacagccacta

SEQ ID NO: 347529 - DNA, 25 bp, Rattus norvegicus
gaggccagtcaatggacagccacta

SEQ ID NO: 347530 - DNA, 25 bp, Rattus norvegicus
gaggccagtcataaagatcaccact

SEQ ID NO: 347531 - DNA, 25 bp, Rattus norvegicus
gaggccagtcattaagatcaccact

SEQ ID NO: 347532 - DNA, 25 bp, Rattus norvegicus
gaggccagtctgctgaccatgcgct

SEQ ID NO: 347533 - DNA, 25 bp, Rattus norvegicus
gaggccagtctggtgaccatgcgct

SEQ ID NO: 347534 - DNA, 25 bp, Rattus norvegicus
gaggccagtggtaactgagacccat

SEQ ID NO: 347535 - DNA, 25 bp, Rattus norvegicus
gaggccagtggttactgagacccat

SEQ ID NO: 347536 - DNA, 25 bp, Rattus norvegicus
gaggccagtgtaattgaagcatcca

SEQ ID NO: 347537 - DNA, 25 bp, Rattus norvegicus
gaggccagtgtatttgaagcatcca

SEQ ID NO: 347538 - DNA, 25 bp, Rattus norvegicus
gaggccagttataatacagccatag

SEQ ID NO: 347539 - DNA, 25 bp, Rattus norvegicus
gaggccagttattatacagccatag

SEQ ID NO: 347540 - DNA, 25 bp, Rattus norvegicus
gaggccataaagctgtgccacacaa

SEQ ID NO: 347541 - DNA, 25 bp, Rattus norvegicus
gaggccataaaggtgtgccacacaa

SEQ ID NO: 347542 - DNA, 25 bp, Rattus norvegicus
gaggccatacagactcgttcacgaa

SEQ ID NO: 347543 - DNA, 25 bp, Rattus norvegicus
gaggccatacagctgaccggaagct

SEQ ID NO: 347544 - DNA, 25 bp, Rattus norvegicus
gaggccatacaggtgaccggaagct

SEQ ID NO: 347545 - DNA, 25 bp, Rattus norvegicus
gaggccatacagtctcgttcacgaa

SEQ ID NO: 347546 - DNA, 25 bp, Rattus norvegicus
gaggccatattaccctgactcctga

SEQ ID NO: 347547 - DNA, 25 bp, Rattus norvegicus
gaggccatattagcctgactcctga

SEQ ID NO: 347548 - DNA, 25 bp, Rattus norvegicus
gaggccatccccagagagcagcaat

SEQ ID NO: 347549 - DNA, 25 bp, Rattus norvegicus
gaggccatccccaggaagatataaa

SEQ ID NO: 347550 - DNA, 25 bp, Rattus norvegicus
gaggccatcccctgagagcagcaat

SEQ ID NO: 347551 - DNA, 25 bp, Rattus norvegicus
gaggccatcccctggaagatataaa

SEQ ID NO: 347552 - DNA, 25 bp, Rattus norvegicus
gaggccatccctcaagaagtatacc

SEQ ID NO: 347553 - DNA, 25 bp, Rattus norvegicus
gaggccatccctgaagaagtatacc

SEQ ID NO: 347554 - DNA, 25 bp, Rattus norvegicus
gaggccatcgccacttgtgcactaa

SEQ ID NO: 347555 - DNA, 25 bp, Rattus norvegicus
gaggccatcgcctcttgtgcactaa

SEQ ID NO: 347556 - DNA, 25 bp, Rattus norvegicus
gaggccatctaaaggcaccaggctt

SEQ ID NO: 347557 - DNA, 25 bp, Rattus norvegicus
gaggccatctaatggcaccaggctt

SEQ ID NO: 347558 - DNA, 25 bp, Rattus norvegicus
gaggccatctatatggcttttttaa

SEQ ID NO: 347559 - DNA, 25 bp, Rattus norvegicus
gaggccatctatttggcttttttaa

SEQ ID NO: 347560 - DNA, 25 bp, Rattus norvegicus
gaggccatctgcagacatctgtaga

SEQ ID NO: 347561 - DNA, 25 bp, Rattus norvegicus
gaggccatctgcagatacgagccat

SEQ ID NO: 347562 - DNA, 25 bp, Rattus norvegicus
gaggccatctgctgacatctgtaga

SEQ ID NO: 347563 - DNA, 25 bp, Rattus norvegicus
gaggccatctgctgatacgagccat

SEQ ID NO: 347564 - DNA, 25 bp, Rattus norvegicus
gaggccatcttacaccaagttgttc

SEQ ID NO: 347565 - DNA, 25 bp, Rattus norvegicus
gaggccatcttagaccaagttgttc

SEQ ID NO: 347566 - DNA, 25 bp, Rattus norvegicus
gaggccatctttcaggtcatattga

SEQ ID NO: 347567 - DNA, 25 bp, Rattus norvegicus
gaggccatctttgaggtcatattga

SEQ ID NO: 347568 - DNA, 25 bp, Rattus norvegicus
gaggccatgacgcaggtgacctaac

SEQ ID NO: 347569 - DNA, 25 bp, Rattus norvegicus
gaggccatgacggaggtgacctaac

SEQ ID NO: 347570 - DNA, 25 bp, Rattus norvegicus
gaggccatgcggagctttttgagta

SEQ ID NO: 347571 - DNA, 25 bp, Rattus norvegicus
gaggccatgcggcttcagaatcaga

SEQ ID NO: 347572 - DNA, 25 bp, Rattus norvegicus
gaggccatgcgggttcagaatcaga

SEQ ID NO: 347573 - DNA, 25 bp, Rattus norvegicus
gaggccatgcggtgctttttgagta

SEQ ID NO: 347574 - DNA, 25 bp, Rattus norvegicus
gaggccatggccaccattgggacag

SEQ ID NO: 347575 - DNA, 25 bp, Rattus norvegicus
gaggccatggcctccattgggacag

SEQ ID NO: 347576 - DNA, 25 bp, Rattus norvegicus
gaggccatggctaaaacacagacgt

SEQ ID NO: 347577 - DNA, 25 bp, Rattus norvegicus
gaggccatggcttaaacacagacgt

SEQ ID NO: 347578 - DNA, 25 bp, Rattus norvegicus
gaggccatgtctacagtggttattg

SEQ ID NO: 347579 - DNA, 25 bp, Rattus norvegicus
gaggccatgtcttcagtggttattg

SEQ ID NO: 347580 - DNA, 25 bp, Rattus norvegicus
gaggccatgtgcatattgaaccaga

SEQ ID NO: 347581 - DNA, 25 bp, Rattus norvegicus
gaggccatgtgcttattgaaccaga

SEQ ID NO: 347582 - DNA, 25 bp, Rattus norvegicus
gaggccattctcaaacctggtggag

SEQ ID NO: 347583 - DNA, 25 bp, Rattus norvegicus
gaggccattctctaacctggtggag

SEQ ID NO: 347584 - DNA, 25 bp, Rattus norvegicus
gaggccattggactttcctggtttt

SEQ ID NO: 347585 - DNA, 25 bp, Rattus norvegicus
gaggccattggagtttcctggtttt

SEQ ID NO: 347586 - DNA, 25 bp, Rattus norvegicus
gaggccattgttctgtgtcggaaac

SEQ ID NO: 347587 - DNA, 25 bp, Rattus norvegicus
gaggccattgttgtgtgtcggaaac

SEQ ID NO: 347588 - DNA, 25 bp, Rattus norvegicus
gaggccatttgaccttgacaagctt

SEQ ID NO: 347589 - DNA, 25 bp, Rattus norvegicus
gaggccatttgagcttgacaagctt

SEQ ID NO: 347590 - DNA, 25 bp, Rattus norvegicus
gaggcccaactgatgcagatccgga

SEQ ID NO: 347591 - DNA, 25 bp, Rattus norvegicus
gaggcccaactgttgcagatccgga

SEQ ID NO: 347592 - DNA, 25 bp, Rattus norvegicus
gaggcccaattcactggatctttca

SEQ ID NO: 347593 - DNA, 25 bp, Rattus norvegicus
gaggcccaattctctggatctttca

SEQ ID NO: 347594 - DNA, 25 bp, Rattus norvegicus
gaggcccacaagatggcttggtgct

SEQ ID NO: 347595 - DNA, 25 bp, Rattus norvegicus
gaggcccacaagttggcttggtgct

SEQ ID NO: 347596 - DNA, 25 bp, Rattus norvegicus
gaggcccacagaagaaagtgacttt

SEQ ID NO: 347597 - DNA, 25 bp, Rattus norvegicus
gaggcccacagatgaaagtgacttt

SEQ ID NO: 347598 - DNA, 25 bp, Rattus norvegicus
gaggcccagaaaacacacttactgt

SEQ ID NO: 347599 - DNA, 25 bp, Rattus norvegicus
gaggcccagaaatcacacttactgt

SEQ ID NO: 347600 - DNA, 25 bp, Rattus norvegicus
gaggcccagacactgacagtattta

SEQ ID NO: 347601 - DNA, 25 bp, Rattus norvegicus
gaggcccagacagtgacagtattta

SEQ ID NO: 347602 - DNA, 25 bp, Rattus norvegicus
gaggcccagcggaaaccacaaagtt

SEQ ID NO: 347603 - DNA, 25 bp, Rattus norvegicus
gaggcccagcggtaaccacaaagtt

SEQ ID NO: 347604 - DNA, 25 bp, Rattus norvegicus
gaggcccaggcaattttccttttat

SEQ ID NO: 347605 - DNA, 25 bp, Rattus norvegicus
gaggcccaggcatttttccttttat

SEQ ID NO: 347606 - DNA, 25 bp, Rattus norvegicus
gaggcccaggccagatctgatctgt

SEQ ID NO: 347607 - DNA, 25 bp, Rattus norvegicus
gaggcccaggcctgatctgatctgt

SEQ ID NO: 347608 - DNA, 25 bp, Rattus norvegicus
gaggcccaggcgagcacccgagtta

SEQ ID NO: 347609 - DNA, 25 bp, Rattus norvegicus
gaggcccaggcgtgcacccgagtta

SEQ ID NO: 347610 - DNA, 25 bp, Rattus norvegicus
gaggcccaggctagacgaggtacca

SEQ ID NO: 347611 - DNA, 25 bp, Rattus norvegicus
gaggcccaggcttgacgaggtacca

SEQ ID NO: 347612 - DNA, 25 bp, Rattus norvegicus
gaggcccaggtgatattagtccgct

SEQ ID NO: 347613 - DNA, 25 bp, Rattus norvegicus
gaggcccaggtgatctattccatag

SEQ ID NO: 347614 - DNA, 25 bp, Rattus norvegicus
gaggcccaggtgttattagtccgct

SEQ ID NO: 347615 - DNA, 25 bp, Rattus norvegicus
gaggcccaggtgttctattccatag

SEQ ID NO: 347616 - DNA, 25 bp, Rattus norvegicus
gaggcccagttacgctcgttgctct

SEQ ID NO: 347617 - DNA, 25 bp, Rattus norvegicus
gaggcccagttaggctcgttgctct

SEQ ID NO: 347618 - DNA, 25 bp, Rattus norvegicus
gaggcccatagacacctaccaggtc

SEQ ID NO: 347619 - DNA, 25 bp, Rattus norvegicus
gaggcccatagagacctaccaggtc

SEQ ID NO: 347620 - DNA, 25 bp, Rattus norvegicus
gaggcccatccaaggctgtgtaaga

SEQ ID NO: 347621 - DNA, 25 bp, Rattus norvegicus
gaggcccatccatggctgtgtaaga

SEQ ID NO: 347622 - DNA, 25 bp, Rattus norvegicus
gaggcccatgacaccggtcacatga

SEQ ID NO: 347623 - DNA, 25 bp, Rattus norvegicus
gaggcccatgactccggtcacatga

SEQ ID NO: 347624 - DNA, 25 bp, Rattus norvegicus
gaggcccatggtacaaatatcagca

SEQ ID NO: 347625 - DNA, 25 bp, Rattus norvegicus
gaggcccatggttcaaatatcagca

SEQ ID NO: 347626 - DNA, 25 bp, Rattus norvegicus
gaggcccatgttcagagcacaccta

SEQ ID NO: 347627 - DNA, 25 bp, Rattus norvegicus
gaggcccatgttgagagcacaccta

SEQ ID NO: 347628 - DNA, 25 bp, Rattus norvegicus
gaggccccaacccaatagaaatcac

SEQ ID NO: 347629 - DNA, 25 bp, Rattus norvegicus
gaggccccaaccgaatagaaatcac

SEQ ID NO: 347630 - DNA, 25 bp, Rattus norvegicus
gaggccccaaggagcctgataggct

SEQ ID NO: 347631 - DNA, 25 bp, Rattus norvegicus
gaggccccaaggtgcctgataggct

SEQ ID NO: 347632 - DNA, 25 bp, Rattus norvegicus
gaggccccagaaaccttgggctaca

SEQ ID NO: 347633 - DNA, 25 bp, Rattus norvegicus
gaggccccagaaagatgggacttaa

SEQ ID NO: 347634 - DNA, 25 bp, Rattus norvegicus
gaggccccagaatccttgggctaca

SEQ ID NO: 347635 - DNA, 25 bp, Rattus norvegicus
gaggccccagaatgatgggacttaa

SEQ ID NO: 347636 - DNA, 25 bp, Rattus norvegicus
gaggccccagctcaagaactcctta

SEQ ID NO: 347637 - DNA, 25 bp, Rattus norvegicus
gaggccccagctgaagaactcctta

SEQ ID NO: 347638 - DNA, 25 bp, Rattus norvegicus
gaggccccagggagctgtaagctat

SEQ ID NO: 347639 - DNA, 25 bp, Rattus norvegicus
gaggccccagggtgctgtaagctat

SEQ ID NO: 347640 - DNA, 25 bp, Rattus norvegicus
gaggccccgggaacagatagctatt

SEQ ID NO: 347641 - DNA, 25 bp, Rattus norvegicus
gaggccccgggatcagatagctatt

SEQ ID NO: 347642 - DNA, 25 bp, Rattus norvegicus
gaggcccctgacactgatgttgagg

SEQ ID NO: 347643 - DNA, 25 bp, Rattus norvegicus
gaggcccctgactctgatgttgagg

SEQ ID NO: 347644 - DNA, 25 bp, Rattus norvegicus
gaggcccctggcacatatagagcag

SEQ ID NO: 347645 - DNA, 25 bp, Rattus norvegicus
gaggcccctggctcatatagagcag

SEQ ID NO: 347646 - DNA, 25 bp, Rattus norvegicus
gaggcccctggtctttagagcaaag

SEQ ID NO: 347647 - DNA, 25 bp, Rattus norvegicus
gaggcccctggtgtttagagcaaag

SEQ ID NO: 347648 - DNA, 25 bp, Rattus norvegicus
gaggccccttcaaaaacacttgttg

SEQ ID NO: 347649 - DNA, 25 bp, Rattus norvegicus
gaggccccttcataaacacttgttg

SEQ ID NO: 347650 - DNA, 25 bp, Rattus norvegicus
gaggccccttccagtgtactgagaa

SEQ ID NO: 347651 - DNA, 25 bp, Rattus norvegicus
gaggccccttcctgtgtactgagaa

SEQ ID NO: 347652 - DNA, 25 bp, Rattus norvegicus
gaggccccttggagtctagatgcag

SEQ ID NO: 347653 - DNA, 25 bp, Rattus norvegicus
gaggccccttggtgtctagatgcag

SEQ ID NO: 347654 - DNA, 25 bp, Rattus norvegicus
gaggcccgacatcaggtaatgcact

SEQ ID NO: 347655 - DNA, 25 bp, Rattus norvegicus
gaggcccgacatgaggtaatgcact

SEQ ID NO: 347656 - DNA, 25 bp, Rattus norvegicus
gaggcccgagccagaattatgcaga

SEQ ID NO: 347657 - DNA, 25 bp, Rattus norvegicus
gaggcccgagcctgaattatgcaga

SEQ ID NO: 347658 - DNA, 25 bp, Rattus norvegicus
gaggcccgagctcagagagtacttc

SEQ ID NO: 347659 - DNA, 25 bp, Rattus norvegicus
gaggcccgagctgagagagtacttc

SEQ ID NO: 347660 - DNA, 25 bp, Rattus norvegicus
gaggcccgcatcaagccgtggacca

SEQ ID NO: 347661 - DNA, 25 bp, Rattus norvegicus
gaggcccgcatctagccgtggacca

SEQ ID NO: 347662 - DNA, 25 bp, Rattus norvegicus
gaggcccggaatatctccttcatct

SEQ ID NO: 347663 - DNA, 25 bp, Rattus norvegicus
gaggcccggaatttctccttcatct

SEQ ID NO: 347664 - DNA, 25 bp, Rattus norvegicus
gaggcccggctgcacattttgaaaa

SEQ ID NO: 347665 - DNA, 25 bp, Rattus norvegicus
gaggcccggctggacattttgaaaa

SEQ ID NO: 347666 - DNA, 25 bp, Rattus norvegicus
gaggcccgggtcaacagctttaaag

SEQ ID NO: 347667 - DNA, 25 bp, Rattus norvegicus
gaggcccgggtctacagctttaaag

SEQ ID NO: 347668 - DNA, 25 bp, Rattus norvegicus
gaggcccgtgaacggtttccaccag

SEQ ID NO: 347669 - DNA, 25 bp, Rattus norvegicus
gaggcccgtgaagggtttccaccag

SEQ ID NO: 347670 - DNA, 25 bp, Rattus norvegicus
gaggcccgtgccatggtggactcca

SEQ ID NO: 347671 - DNA, 25 bp, Rattus norvegicus
gaggcccgtgccattgcagaaaaga

SEQ ID NO: 347672 - DNA, 25 bp, Rattus norvegicus
gaggcccgtgccttggtggactcca

SEQ ID NO: 347673 - DNA, 25 bp, Rattus norvegicus
gaggcccgtgcctttgcagaaaaga

SEQ ID NO: 347674 - DNA, 25 bp, Rattus norvegicus
gaggccctaaagagccgtatcattc

SEQ ID NO: 347675 - DNA, 25 bp, Rattus norvegicus
gaggccctaaagtgccgtatcattc

SEQ ID NO: 347676 - DNA, 25 bp, Rattus norvegicus
gaggccctaagccaggacaactttg

SEQ ID NO: 347677 - DNA, 25 bp, Rattus norvegicus
gaggccctaagcgaggacaactttg

SEQ ID NO: 347678 - DNA, 25 bp, Rattus norvegicus
gaggccctaatcaccatcgacaagt

SEQ ID NO: 347679 - DNA, 25 bp, Rattus norvegicus
gaggccctaatctccatcgacaagt

SEQ ID NO: 347680 - DNA, 25 bp, Rattus norvegicus
gaggccctacatccagaagtcatct

SEQ ID NO: 347681 - DNA, 25 bp, Rattus norvegicus
gaggccctacatgcagaagtcatct

SEQ ID NO: 347682 - DNA, 25 bp, Rattus norvegicus
gaggccctaggacggtgccagctcc

SEQ ID NO: 347683 - DNA, 25 bp, Rattus norvegicus
gaggccctaggagggtgccagctcc

SEQ ID NO: 347684 - DNA, 25 bp, Rattus norvegicus
gaggccctagtgagatccttggtag

SEQ ID NO: 347685 - DNA, 25 bp, Rattus norvegicus
gaggccctagtgtgatccttggtag

SEQ ID NO: 347686 - DNA, 25 bp, Rattus norvegicus
gaggccctatcaagcattaatcacc

SEQ ID NO: 347687 - DNA, 25 bp, Rattus norvegicus
gaggccctatcatgcattaatcacc

SEQ ID NO: 347688 - DNA, 25 bp, Rattus norvegicus
gaggccctcaaacagtgcaaataca

SEQ ID NO: 347689 - DNA, 25 bp, Rattus norvegicus
gaggccctcaaagagtgcaaataca

SEQ ID NO: 347690 - DNA, 25 bp, Rattus norvegicus
gaggccctcactcagagttcacagg

SEQ ID NO: 347691 - DNA, 25 bp, Rattus norvegicus
gaggccctcactgagagttcacagg

SEQ ID NO: 347692 - DNA, 25 bp, Rattus norvegicus
gaggccctcagtatattcctgtaga

SEQ ID NO: 347693 - DNA, 25 bp, Rattus norvegicus
gaggccctcagtttattcctgtaga

SEQ ID NO: 347694 - DNA, 25 bp, Rattus norvegicus
gaggccctcctacaggtcaagaagt

SEQ ID NO: 347695 - DNA, 25 bp, Rattus norvegicus
gaggccctcctagaggtcaagaagt

SEQ ID NO: 347696 - DNA, 25 bp, Rattus norvegicus
gaggccctcgctccaataggaaagg

SEQ ID NO: 347697 - DNA, 25 bp, Rattus norvegicus
gaggccctcgctgcaataggaaagg

SEQ ID NO: 347698 - DNA, 25 bp, Rattus norvegicus
gaggccctctaaactggtatcgaaa

SEQ ID NO: 347699 - DNA, 25 bp, Rattus norvegicus
gaggccctctaatctggtatcgaaa

SEQ ID NO: 347700 - DNA, 25 bp, Rattus norvegicus
gaggccctctagagtttgggttttg

SEQ ID NO: 347701 - DNA, 25 bp, Rattus norvegicus
gaggccctctagtgtttgggttttg

SEQ ID NO: 347702 - DNA, 25 bp, Rattus norvegicus
gaggccctgaagatgctcatacaca

SEQ ID NO: 347703 - DNA, 25 bp, Rattus norvegicus
gaggccctgaagcactggctgcaat

SEQ ID NO: 347704 - DNA, 25 bp, Rattus norvegicus
gaggccctgaaggactggctgcaat

SEQ ID NO: 347705 - DNA, 25 bp, Rattus norvegicus
gaggccctgaagttgctcatacaca

SEQ ID NO: 347706 - DNA, 25 bp, Rattus norvegicus
gaggccctgaggctaacagatacac

SEQ ID NO: 347707 - DNA, 25 bp, Rattus norvegicus
gaggccctgagggtaacagatacac

SEQ ID NO: 347708 - DNA, 25 bp, Rattus norvegicus
gaggccctgcaaaaggtgtctgatc

SEQ ID NO: 347709 - DNA, 25 bp, Rattus norvegicus
gaggccctgcaataggtgtctgatc

SEQ ID NO: 347710 - DNA, 25 bp, Rattus norvegicus
gaggccctgcaccttcaagctgatg

SEQ ID NO: 347711 - DNA, 25 bp, Rattus norvegicus
gaggccctgcacgttcaagctgatg

SEQ ID NO: 347712 - DNA, 25 bp, Rattus norvegicus
gaggccctgcagaactttgccagga

SEQ ID NO: 347713 - DNA, 25 bp, Rattus norvegicus
gaggccctgcagtactttgccagga

SEQ ID NO: 347714 - DNA, 25 bp, Rattus norvegicus
gaggccctgctactgcgaatataaa

SEQ ID NO: 347715 - DNA, 25 bp, Rattus norvegicus
gaggccctgctagtgcgaatataaa

SEQ ID NO: 347716 - DNA, 25 bp, Rattus norvegicus
gaggccctgctgctcgttagagcaa

SEQ ID NO: 347717 - DNA, 25 bp, Rattus norvegicus
gaggccctgctggtcgttagagcaa

SEQ ID NO: 347718 - DNA, 25 bp, Rattus norvegicus
gaggccctggacatccttcaggaag

SEQ ID NO: 347719 - DNA, 25 bp, Rattus norvegicus
gaggccctggacttccttcaggaag

SEQ ID NO: 347720 - DNA, 25 bp, Rattus norvegicus
gaggccctggagactggtatttaaa

SEQ ID NO: 347721 - DNA, 25 bp, Rattus norvegicus
gaggccctggagtctggtatttaaa

SEQ ID NO: 347722 - DNA, 25 bp, Rattus norvegicus
gaggccctgggaagtatactttgtt

SEQ ID NO: 347723 - DNA, 25 bp, Rattus norvegicus
gaggccctgggatgtatactttgtt

SEQ ID NO: 347724 - DNA, 25 bp, Rattus norvegicus
gaggccctgggcatgttttaacatc

SEQ ID NO: 347725 - DNA, 25 bp, Rattus norvegicus
gaggccctgggcttgttttaacatc

SEQ ID NO: 347726 - DNA, 25 bp, Rattus norvegicus
gaggccctggtgaaatcctagggta

SEQ ID NO: 347727 - DNA, 25 bp, Rattus norvegicus
gaggccctggtgtaatcctagggta

SEQ ID NO: 347728 - DNA, 25 bp, Rattus norvegicus
gaggccctggttaaactcagtggct

SEQ ID NO: 347729 - DNA, 25 bp, Rattus norvegicus
gaggccctggtttaactcagtggct

SEQ ID NO: 347730 - DNA, 25 bp, Rattus norvegicus
gaggccctgtcacatgtgtactgtg

SEQ ID NO: 347731 - DNA, 25 bp, Rattus norvegicus
gaggccctgtcagatgtgtactgtg

SEQ ID NO: 347732 - DNA, 25 bp, Rattus norvegicus
gaggccctgttcaggctaagtacta

SEQ ID NO: 347733 - DNA, 25 bp, Rattus norvegicus
gaggccctgttcatgattctggcta

SEQ ID NO: 347734 - DNA, 25 bp, Rattus norvegicus
gaggccctgttctggctaagtacta

SEQ ID NO: 347735 - DNA, 25 bp, Rattus norvegicus
gaggccctgttcttgattctggcta

SEQ ID NO: 347736 - DNA, 25 bp, Rattus norvegicus
gaggcccttaggaaggctgcaacag

SEQ ID NO: 347737 - DNA, 25 bp, Rattus norvegicus
gaggcccttaggtaggctgcaacag

SEQ ID NO: 347738 - DNA, 25 bp, Rattus norvegicus
gaggcccttatcacaaagcagttgc

SEQ ID NO: 347739 - DNA, 25 bp, Rattus norvegicus
gaggcccttatctcaaagcagttgc

SEQ ID NO: 347740 - DNA, 25 bp, Rattus norvegicus
gaggcccttcataattgctgcagaa

SEQ ID NO: 347741 - DNA, 25 bp, Rattus norvegicus
gaggcccttcattattgctgcagaa

SEQ ID NO: 347742 - DNA, 25 bp, Rattus norvegicus
gaggcccttctaaaggtatctgttt

SEQ ID NO: 347743 - DNA, 25 bp, Rattus norvegicus
gaggcccttctataggtatctgttt

SEQ ID NO: 347744 - DNA, 25 bp, Rattus norvegicus
gaggcccttgctacagtattgggca

SEQ ID NO: 347745 - DNA, 25 bp, Rattus norvegicus
gaggcccttgcttcagtattgggca

SEQ ID NO: 347746 - DNA, 25 bp, Rattus norvegicus
gaggcccttggcattggacattcat

SEQ ID NO: 347747 - DNA, 25 bp, Rattus norvegicus
gaggcccttggctttggacattcat

SEQ ID NO: 347748 - DNA, 25 bp, Rattus norvegicus
gaggcccttttactgcatcatctaa

SEQ ID NO: 347749 - DNA, 25 bp, Rattus norvegicus
gaggcccttttagtgcatcatctaa

SEQ ID NO: 347750 - DNA, 25 bp, Rattus norvegicus
gaggccgaacatagagctgtgcaga

SEQ ID NO: 347751 - DNA, 25 bp, Rattus norvegicus
gaggccgaacattgagctgtgcaga

SEQ ID NO: 347752 - DNA, 25 bp, Rattus norvegicus
gaggccgaactccagagtgcaaaga

SEQ ID NO: 347753 - DNA, 25 bp, Rattus norvegicus
gaggccgaactcgagagtgcaaaga

SEQ ID NO: 347754 - DNA, 25 bp, Rattus norvegicus
gaggccgacattcctgccttgaaga

SEQ ID NO: 347755 - DNA, 25 bp, Rattus norvegicus
gaggccgacattgctgccttgaaga

SEQ ID NO: 347756 - DNA, 25 bp, Rattus norvegicus
gaggccgaccttcccatgggtctaa

SEQ ID NO: 347757 - DNA, 25 bp, Rattus norvegicus
gaggccgaccttgccatgggtctaa

SEQ ID NO: 347758 - DNA, 25 bp, Rattus norvegicus
gaggccgacgaactgaagttacaac

SEQ ID NO: 347759 - DNA, 25 bp, Rattus norvegicus
gaggccgacgaagtgaagttacaac

SEQ ID NO: 347760 - DNA, 25 bp, Rattus norvegicus
gaggccgactttcgctcagaggaaa

SEQ ID NO: 347761 - DNA, 25 bp, Rattus norvegicus
gaggccgactttggctcagaggaaa

SEQ ID NO: 347762 - DNA, 25 bp, Rattus norvegicus
gaggccgagaaccactactggctga

SEQ ID NO: 347763 - DNA, 25 bp, Rattus norvegicus
gaggccgagaacgactactggctga

SEQ ID NO: 347764 - DNA, 25 bp, Rattus norvegicus
gaggccgagtccatgcagcacaaga

SEQ ID NO: 347765 - DNA, 25 bp, Rattus norvegicus
gaggccgagtccttgcagcacaaga

SEQ ID NO: 347766 - DNA, 25 bp, Rattus norvegicus
gaggccgatgaccaccaaacatggg

SEQ ID NO: 347767 - DNA, 25 bp, Rattus norvegicus
gaggccgatgacgaccaaacatggg

SEQ ID NO: 347768 - DNA, 25 bp, Rattus norvegicus
gaggccgatgttatacctgaggtct

SEQ ID NO: 347769 - DNA, 25 bp, Rattus norvegicus
gaggccgatgttttacctgaggtct

SEQ ID NO: 347770 - DNA, 25 bp, Rattus norvegicus
gaggccgattcccataacctgaaga

SEQ ID NO: 347771 - DNA, 25 bp, Rattus norvegicus
gaggccgattccgataacctgaaga

SEQ ID NO: 347772 - DNA, 25 bp, Rattus norvegicus
gaggccgcaaaactcacctgtgaga

SEQ ID NO: 347773 - DNA, 25 bp, Rattus norvegicus
gaggccgcaaaagtcacctgtgaga

SEQ ID NO: 347774 - DNA, 25 bp, Rattus norvegicus
gaggccgcagacaaaggcatcctac

SEQ ID NO: 347775 - DNA, 25 bp, Rattus norvegicus
gaggccgcagactaaggcatcctac

SEQ ID NO: 347776 - DNA, 25 bp, Rattus norvegicus
gaggccgcagcaagaagaccctaca

SEQ ID NO: 347777 - DNA, 25 bp, Rattus norvegicus
gaggccgcagcatgaagaccctaca

SEQ ID NO: 347778 - DNA, 25 bp, Rattus norvegicus
gaggccgcatgaacaaatctttatt

SEQ ID NO: 347779 - DNA, 25 bp, Rattus norvegicus
gaggccgcatgatcaaatctttatt

SEQ ID NO: 347780 - DNA, 25 bp, Rattus norvegicus
gaggccgccacgagcgcccggaagg

SEQ ID NO: 347781 - DNA, 25 bp, Rattus norvegicus
gaggccgccacgtgcgcccggaagg

SEQ ID NO: 347782 - DNA, 25 bp, Rattus norvegicus
gaggccgccagcatagcaccatagg

SEQ ID NO: 347783 - DNA, 25 bp, Rattus norvegicus
gaggccgccagcttagcaccatagg

SEQ ID NO: 347784 - DNA, 25 bp, Rattus norvegicus
gaggccgcctggacttggtacagct

SEQ ID NO: 347785 - DNA, 25 bp, Rattus norvegicus
gaggccgcctggtcttggtacagct

SEQ ID NO: 347786 - DNA, 25 bp, Rattus norvegicus
gaggccgctgtcagaatatattcaa

SEQ ID NO: 347787 - DNA, 25 bp, Rattus norvegicus
gaggccgctgtctgaatatattcaa

SEQ ID NO: 347788 - DNA, 25 bp, Rattus norvegicus
gaggccggagagatcactacaagac

SEQ ID NO: 347789 - DNA, 25 bp, Rattus norvegicus
gaggccggagagttcactacaagac

SEQ ID NO: 347790 - DNA, 25 bp, Rattus norvegicus
gaggccggcaaaccaaggctgaaat

SEQ ID NO: 347791 - DNA, 25 bp, Rattus norvegicus
gaggccggcaaagcaaggctgaaat

SEQ ID NO: 347792 - DNA, 25 bp, Rattus norvegicus
gaggccggcaagagacaattgttta

SEQ ID NO: 347793 - DNA, 25 bp, Rattus norvegicus
gaggccggcaagtgacaattgttta

SEQ ID NO: 347794 - DNA, 25 bp, Rattus norvegicus
gaggccggccaaagtcaagtttact

SEQ ID NO: 347795 - DNA, 25 bp, Rattus norvegicus
gaggccggccaatgtcaagtttact

SEQ ID NO: 347796 - DNA, 25 bp, Rattus norvegicus
gaggccggcctgaggctaggtggca

SEQ ID NO: 347797 - DNA, 25 bp, Rattus norvegicus
gaggccggcctgtggctaggtggca

SEQ ID NO: 347798 - DNA, 25 bp, Rattus norvegicus
gaggccgggaccatagtactccaac

SEQ ID NO: 347799 - DNA, 25 bp, Rattus norvegicus
gaggccgggaccttagtactccaac

SEQ ID NO: 347800 - DNA, 25 bp, Rattus norvegicus
gaggccgtccagaataaagttcaag

SEQ ID NO: 347801 - DNA, 25 bp, Rattus norvegicus
gaggccgtccagtataaagttcaag

SEQ ID NO: 347802 - DNA, 25 bp, Rattus norvegicus
gaggccgtcctgatactgaacaatg

SEQ ID NO: 347803 - DNA, 25 bp, Rattus norvegicus
gaggccgtcctgttactgaacaatg

SEQ ID NO: 347804 - DNA, 25 bp, Rattus norvegicus
gaggccgtctggaaagcgagtcgct

SEQ ID NO: 347805 - DNA, 25 bp, Rattus norvegicus
gaggccgtctggtaagcgagtcgct

SEQ ID NO: 347806 - DNA, 25 bp, Rattus norvegicus
gaggccgttaccctgaattctatca

SEQ ID NO: 347807 - DNA, 25 bp, Rattus norvegicus
gaggccgttaccgtgaattctatca

SEQ ID NO: 347808 - DNA, 25 bp, Rattus norvegicus
gaggccgttcggcataacaacctgg

SEQ ID NO: 347809 - DNA, 25 bp, Rattus norvegicus
gaggccgttcgggataacaacctgg

SEQ ID NO: 347810 - DNA, 25 bp, Rattus norvegicus
gaggcctaaaacctactctgcagga

SEQ ID NO: 347811 - DNA, 25 bp, Rattus norvegicus
gaggcctaaaacgtactctgcagga

SEQ ID NO: 347812 - DNA, 25 bp, Rattus norvegicus
gaggcctaaatcacccactaagaat

SEQ ID NO: 347813 - DNA, 25 bp, Rattus norvegicus
gaggcctaaatctcccactaagaat

SEQ ID NO: 347814 - DNA, 25 bp, Rattus norvegicus
gaggcctaacctagttgtcttaact

SEQ ID NO: 347815 - DNA, 25 bp, Rattus norvegicus
gaggcctaaccttgttgtcttaact

SEQ ID NO: 347816 - DNA, 25 bp, Rattus norvegicus
gaggcctacaacattctgaagtccc

SEQ ID NO: 347817 - DNA, 25 bp, Rattus norvegicus
gaggcctacaactttctgaagtccc

SEQ ID NO: 347818 - DNA, 25 bp, Rattus norvegicus
gaggcctacacacaggaacttttca

SEQ ID NO: 347819 - DNA, 25 bp, Rattus norvegicus
gaggcctacacacatgatcttccac

SEQ ID NO: 347820 - DNA, 25 bp, Rattus norvegicus
gaggcctacacagaggaacttttca

SEQ ID NO: 347821 - DNA, 25 bp, Rattus norvegicus
gaggcctacacagatgatcttccac

SEQ ID NO: 347822 - DNA, 25 bp, Rattus norvegicus
gaggcctactgtctcaacgatggtt

SEQ ID NO: 347823 - DNA, 25 bp, Rattus norvegicus
gaggcctactgtgtcaacgatggtt

SEQ ID NO: 347824 - DNA, 25 bp, Rattus norvegicus
gaggcctacttcaccacaattggtg

SEQ ID NO: 347825 - DNA, 25 bp, Rattus norvegicus
gaggcctacttctccacaattggtg

SEQ ID NO: 347826 - DNA, 25 bp, Rattus norvegicus
gaggcctagagacagaggtactcac

SEQ ID NO: 347827 - DNA, 25 bp, Rattus norvegicus
gaggcctagagagagaggtactcac

SEQ ID NO: 347828 - DNA, 25 bp, Rattus norvegicus
gaggcctaggtcatttgtcacacag

SEQ ID NO: 347829 - DNA, 25 bp, Rattus norvegicus
gaggcctaggtcttttgtcacacag

SEQ ID NO: 347830 - DNA, 25 bp, Rattus norvegicus
gaggcctagttacccagtgttaacc

SEQ ID NO: 347831 - DNA, 25 bp, Rattus norvegicus
gaggcctagttagccagtgttaacc

SEQ ID NO: 347832 - DNA, 25 bp, Rattus norvegicus
gaggcctataatccgacagtgagaa

SEQ ID NO: 347833 - DNA, 25 bp, Rattus norvegicus
gaggcctataatgcgacagtgagaa

SEQ ID NO: 347834 - DNA, 25 bp, Rattus norvegicus
gaggcctatgcaactgaatcctaaa

SEQ ID NO: 347835 - DNA, 25 bp, Rattus norvegicus
gaggcctatgcatctgaatcctaaa

SEQ ID NO: 347836 - DNA, 25 bp, Rattus norvegicus
gaggcctatggaatcgacttctata

SEQ ID NO: 347837 - DNA, 25 bp, Rattus norvegicus
gaggcctatggattcgacttctata

SEQ ID NO: 347838 - DNA, 25 bp, Rattus norvegicus
gaggcctcaagaaggcagtcacctt

SEQ ID NO: 347839 - DNA, 25 bp, Rattus norvegicus
gaggcctcaagatggcagtcacctt

SEQ ID NO: 347840 - DNA, 25 bp, Rattus norvegicus
gaggcctcacagaccaagcttaatg

SEQ ID NO: 347841 - DNA, 25 bp, Rattus norvegicus
gaggcctcacagtccaagcttaatg

SEQ ID NO: 347842 - DNA, 25 bp, Rattus norvegicus
gaggcctcacctagcagctcagtag

SEQ ID NO: 347843 - DNA, 25 bp, Rattus norvegicus
gaggcctcaccttgcagctcagtag

SEQ ID NO: 347844 - DNA, 25 bp, Rattus norvegicus
gaggcctcactgaaactgaagtcca

SEQ ID NO: 347845 - DNA, 25 bp, Rattus norvegicus
gaggcctcactgtaactgaagtcca

SEQ ID NO: 347846 - DNA, 25 bp, Rattus norvegicus
gaggcctcacttatactgtgtgact

SEQ ID NO: 347847 - DNA, 25 bp, Rattus norvegicus
gaggcctcacttttactgtgtgact

SEQ ID NO: 347848 - DNA, 25 bp, Rattus norvegicus
gaggcctcagaactggtttaacaag

SEQ ID NO: 347849 - DNA, 25 bp, Rattus norvegicus
gaggcctcagaagtggtttaacaag

SEQ ID NO: 347850 - DNA, 25 bp, Rattus norvegicus
gaggcctcagcccttagtgaagtgc

SEQ ID NO: 347851 - DNA, 25 bp, Rattus norvegicus
gaggcctcagccgttagtgaagtgc

SEQ ID NO: 347852 - DNA, 25 bp, Rattus norvegicus
gaggcctcaggaagactactcagtc

SEQ ID NO: 347853 - DNA, 25 bp, Rattus norvegicus
gaggcctcaggatgactactcagtc

SEQ ID NO: 347854 - DNA, 25 bp, Rattus norvegicus
gaggcctcaggtacaaatgatgctt

SEQ ID NO: 347855 - DNA, 25 bp, Rattus norvegicus
gaggcctcaggttcaaatgatgctt

SEQ ID NO: 347856 - DNA, 25 bp, Rattus norvegicus
gaggcctcatgcaataagaggatct

SEQ ID NO: 347857 - DNA, 25 bp, Rattus norvegicus
gaggcctcatgctataagaggatct

SEQ ID NO: 347858 - DNA, 25 bp, Rattus norvegicus
gaggcctccaatccttcaagataaa

SEQ ID NO: 347859 - DNA, 25 bp, Rattus norvegicus
gaggcctccaatgcttcaagataaa

SEQ ID NO: 347860 - DNA, 25 bp, Rattus norvegicus
gaggcctccacactatgtcgtagga

SEQ ID NO: 347861 - DNA, 25 bp, Rattus norvegicus
gaggcctccacagtatgtcgtagga

SEQ ID NO: 347862 - DNA, 25 bp, Rattus norvegicus
gaggcctccactatcatatgggtga

SEQ ID NO: 347863 - DNA, 25 bp, Rattus norvegicus
gaggcctccactttcatatgggtga

SEQ ID NO: 347864 - DNA, 25 bp, Rattus norvegicus
gaggcctccaggatttaaatgtgac

SEQ ID NO: 347865 - DNA, 25 bp, Rattus norvegicus
gaggcctccaggttttaaatgtgac

SEQ ID NO: 347866 - DNA, 25 bp, Rattus norvegicus
gaggcctccttgagattagtgtccc

SEQ ID NO: 347867 - DNA, 25 bp, Rattus norvegicus
gaggcctccttgtgattagtgtccc

SEQ ID NO: 347868 - DNA, 25 bp, Rattus norvegicus
gaggcctcgaagatgcagttcatct

SEQ ID NO: 347869 - DNA, 25 bp, Rattus norvegicus
gaggcctcgaagttgcagttcatct

SEQ ID NO: 347870 - DNA, 25 bp, Rattus norvegicus
gaggcctcgagactgcatactgcat

SEQ ID NO: 347871 - DNA, 25 bp, Rattus norvegicus
gaggcctcgagagtgcatactgcat

SEQ ID NO: 347872 - DNA, 25 bp, Rattus norvegicus
gaggcctcggaaacattcattcgtg

SEQ ID NO: 347873 - DNA, 25 bp, Rattus norvegicus
gaggcctcggaatcattcattcgtg

SEQ ID NO: 347874 - DNA, 25 bp, Rattus norvegicus
gaggcctcggatactgaagattact

SEQ ID NO: 347875 - DNA, 25 bp, Rattus norvegicus
gaggcctcggattctgaagattact

SEQ ID NO: 347876 - DNA, 25 bp, Rattus norvegicus
gaggcctcggctcttaatgaacagc

SEQ ID NO: 347877 - DNA, 25 bp, Rattus norvegicus
gaggcctcggctgttaatgaacagc

SEQ ID NO: 347878 - DNA, 25 bp, Rattus norvegicus
gaggcctcggttcctgagaatacaa

SEQ ID NO: 347879 - DNA, 25 bp, Rattus norvegicus
gaggcctcggttgctgagaatacaa

SEQ ID NO: 347880 - DNA, 25 bp, Rattus norvegicus
gaggcctctctactagttttgatag

SEQ ID NO: 347881 - DNA, 25 bp, Rattus norvegicus
gaggcctctctagtagttttgatag

SEQ ID NO: 347882 - DNA, 25 bp, Rattus norvegicus
gaggcctctggacatccgcttagct

SEQ ID NO: 347883 - DNA, 25 bp, Rattus norvegicus
gaggcctctggagatccgcttagct

SEQ ID NO: 347884 - DNA, 25 bp, Rattus norvegicus
gaggcctctggcagttctgatatta

SEQ ID NO: 347885 - DNA, 25 bp, Rattus norvegicus
gaggcctctggctgttctgatatta

SEQ ID NO: 347886 - DNA, 25 bp, Rattus norvegicus
gaggcctctgtgagtcttttaagat

SEQ ID NO: 347887 - DNA, 25 bp, Rattus norvegicus
gaggcctctgtgtgtcttttaagat

SEQ ID NO: 347888 - DNA, 25 bp, Rattus norvegicus
gaggcctcttcacaatgttgactat

SEQ ID NO: 347889 - DNA, 25 bp, Rattus norvegicus
gaggcctcttcagaatgttgactat

SEQ ID NO: 347890 - DNA, 25 bp, Rattus norvegicus
gaggcctcttttcagctgcctgggt

SEQ ID NO: 347891 - DNA, 25 bp, Rattus norvegicus
gaggcctcttttgagctgcctgggt

SEQ ID NO: 347892 - DNA, 25 bp, Rattus norvegicus
gaggcctgaaggagtttgatcctat

SEQ ID NO: 347893 - DNA, 25 bp, Rattus norvegicus
gaggcctgaaggtgtttgatcctat

SEQ ID NO: 347894 - DNA, 25 bp, Rattus norvegicus
gaggcctgacacagggagcacgaac

SEQ ID NO: 347895 - DNA, 25 bp, Rattus norvegicus
gaggcctgacactgggagcacgaac

SEQ ID NO: 347896 - DNA, 25 bp, Rattus norvegicus
gaggcctgagctaggcaccgtgtca

SEQ ID NO: 347897 - DNA, 25 bp, Rattus norvegicus
gaggcctgagcttggcaccgtgtca

SEQ ID NO: 347898 - DNA, 25 bp, Rattus norvegicus
gaggcctgccagaattacaaagtga

SEQ ID NO: 347899 - DNA, 25 bp, Rattus norvegicus
gaggcctgccagtattacaaagtga

SEQ ID NO: 347900 - DNA, 25 bp, Rattus norvegicus
gaggcctgcttaccaggatgtacta

SEQ ID NO: 347901 - DNA, 25 bp, Rattus norvegicus
gaggcctgcttagcaggatgtacta

SEQ ID NO: 347902 - DNA, 25 bp, Rattus norvegicus
gaggcctggacgagttgcgcactta

SEQ ID NO: 347903 - DNA, 25 bp, Rattus norvegicus
gaggcctggacgtgttgcgcactta

SEQ ID NO: 347904 - DNA, 25 bp, Rattus norvegicus
gaggcctggagcatttcaaacacta

SEQ ID NO: 347905 - DNA, 25 bp, Rattus norvegicus
gaggcctggagcttttcaaacacta

SEQ ID NO: 347906 - DNA, 25 bp, Rattus norvegicus
gaggcctggcaaagccatagacagt

SEQ ID NO: 347907 - DNA, 25 bp, Rattus norvegicus
gaggcctggcaatgccatagacagt

SEQ ID NO: 347908 - DNA, 25 bp, Rattus norvegicus
gaggcctggcagatgggtacctaac

SEQ ID NO: 347909 - DNA, 25 bp, Rattus norvegicus
gaggcctggcagttgggtacctaac

SEQ ID NO: 347910 - DNA, 25 bp, Rattus norvegicus
gaggcctggctaatgcaatatttac

SEQ ID NO: 347911 - DNA, 25 bp, Rattus norvegicus
gaggcctggctattgcaatatttac

SEQ ID NO: 347912 - DNA, 25 bp, Rattus norvegicus
gaggcctgggataccaaacttgatt

SEQ ID NO: 347913 - DNA, 25 bp, Rattus norvegicus
gaggcctgggattccaaacttgatt

SEQ ID NO: 347914 - DNA, 25 bp, Rattus norvegicus
gaggcctgggcaagaccctaagcta

SEQ ID NO: 347915 - DNA, 25 bp, Rattus norvegicus
gaggcctgggcatgaccctaagcta

SEQ ID NO: 347916 - DNA, 25 bp, Rattus norvegicus
gaggcctgtaaaaactattttcatt

SEQ ID NO: 347917 - DNA, 25 bp, Rattus norvegicus
gaggcctgtaaatactattttcatt

SEQ ID NO: 347918 - DNA, 25 bp, Rattus norvegicus
gaggcctgtaacaccaagtggtttc

SEQ ID NO: 347919 - DNA, 25 bp, Rattus norvegicus
gaggcctgtaactccaagtggtttc

SEQ ID NO: 347920 - DNA, 25 bp, Rattus norvegicus
gaggcctgtcagacatactgtcgta

SEQ ID NO: 347921 - DNA, 25 bp, Rattus norvegicus
gaggcctgtcagtcatactgtcgta

SEQ ID NO: 347922 - DNA, 25 bp, Rattus norvegicus
gaggcctgtctcaaataagtatgtc

SEQ ID NO: 347923 - DNA, 25 bp, Rattus norvegicus
gaggcctgtctctaataagtatgtc

SEQ ID NO: 347924 - DNA, 25 bp, Rattus norvegicus
gaggcctgtctgaatctgattggtc

SEQ ID NO: 347925 - DNA, 25 bp, Rattus norvegicus
gaggcctgtctgtatctgattggtc

SEQ ID NO: 347926 - DNA, 25 bp, Rattus norvegicus
gaggcctgtgcactctctaaccaca

SEQ ID NO: 347927 - DNA, 25 bp, Rattus norvegicus
gaggcctgtgcagtctctaaccaca

SEQ ID NO: 347928 - DNA, 25 bp, Rattus norvegicus
gaggcctgttacaactaaggcttct

SEQ ID NO: 347929 - DNA, 25 bp, Rattus norvegicus
gaggcctgttactactaaggcttct

SEQ ID NO: 347930 - DNA, 25 bp, Rattus norvegicus
gaggccttaagacagcagttcccgg

SEQ ID NO: 347931 - DNA, 25 bp, Rattus norvegicus
gaggccttaagacctgtccatgcag

SEQ ID NO: 347932 - DNA, 25 bp, Rattus norvegicus
gaggccttaagagagcagttcccgg

SEQ ID NO: 347933 - DNA, 25 bp, Rattus norvegicus
gaggccttaagagctgtccatgcag

SEQ ID NO: 347934 - DNA, 25 bp, Rattus norvegicus
gaggccttaagtcacaactcaactt

SEQ ID NO: 347935 - DNA, 25 bp, Rattus norvegicus
gaggccttaagtgacaactcaactt

SEQ ID NO: 347936 - DNA, 25 bp, Rattus norvegicus
gaggccttactgagatcagcattct

SEQ ID NO: 347937 - DNA, 25 bp, Rattus norvegicus
gaggccttactgtgatcagcattct

SEQ ID NO: 347938 - DNA, 25 bp, Rattus norvegicus
gaggccttaggactacctgaacagt

SEQ ID NO: 347939 - DNA, 25 bp, Rattus norvegicus
gaggccttaggagtacctgaacagt

SEQ ID NO: 347940 - DNA, 25 bp, Rattus norvegicus
gaggccttaggcacctttaaggtct

SEQ ID NO: 347941 - DNA, 25 bp, Rattus norvegicus
gaggccttaggctcctttaaggtct

SEQ ID NO: 347942 - DNA, 25 bp, Rattus norvegicus
gaggccttaggtacgattctcaaca

SEQ ID NO: 347943 - DNA, 25 bp, Rattus norvegicus
gaggccttaggttcgattctcaaca

SEQ ID NO: 347944 - DNA, 25 bp, Rattus norvegicus
gaggccttatacaacctggaagaca

SEQ ID NO: 347945 - DNA, 25 bp, Rattus norvegicus
gaggccttatactacctggaagaca

SEQ ID NO: 347946 - DNA, 25 bp, Rattus norvegicus
gaggccttattaccaattatttcag

SEQ ID NO: 347947 - DNA, 25 bp, Rattus norvegicus
gaggccttattagcaattatttcag

SEQ ID NO: 347948 - DNA, 25 bp, Rattus norvegicus
gaggccttcaaaacaggtcttaagt

SEQ ID NO: 347949 - DNA, 25 bp, Rattus norvegicus
gaggccttcaaatcaggtcttaagt

SEQ ID NO: 347950 - DNA, 25 bp, Rattus norvegicus
gaggccttcaacattgtttccagga

SEQ ID NO: 347951 - DNA, 25 bp, Rattus norvegicus
gaggccttcaactttgtttccagga

SEQ ID NO: 347952 - DNA, 25 bp, Rattus norvegicus
gaggccttcaatacacaggtccagt

SEQ ID NO: 347953 - DNA, 25 bp, Rattus norvegicus
gaggccttcaattcacaggtccagt

SEQ ID NO: 347954 - DNA, 25 bp, Rattus norvegicus
gaggccttcacaatcatggaccaga

SEQ ID NO: 347955 - DNA, 25 bp, Rattus norvegicus
gaggccttcacattcatggaccaga

SEQ ID NO: 347956 - DNA, 25 bp, Rattus norvegicus
gaggccttcatacatccagacttgg

SEQ ID NO: 347957 - DNA, 25 bp, Rattus norvegicus
gaggccttcatagatccagacttgg

SEQ ID NO: 347958 - DNA, 25 bp, Rattus norvegicus
gaggccttcatccagttacactgag

SEQ ID NO: 347959 - DNA, 25 bp, Rattus norvegicus
gaggccttcatcgagttacactgag

SEQ ID NO: 347960 - DNA, 25 bp, Rattus norvegicus
gaggccttccacatttttggatgct

SEQ ID NO: 347961 - DNA, 25 bp, Rattus norvegicus
gaggccttccacttttttggatgct

SEQ ID NO: 347962 - DNA, 25 bp, Rattus norvegicus
gaggccttccatagccgtttgaaag

SEQ ID NO: 347963 - DNA, 25 bp, Rattus norvegicus
gaggccttccattgccgtttgaaag

SEQ ID NO: 347964 - DNA, 25 bp, Rattus norvegicus
gaggccttccgaatttggcttcctt

SEQ ID NO: 347965 - DNA, 25 bp, Rattus norvegicus
gaggccttccgattttggcttcctt

SEQ ID NO: 347966 - DNA, 25 bp, Rattus norvegicus
gaggccttcttcaggtaagtagctt

SEQ ID NO: 347967 - DNA, 25 bp, Rattus norvegicus
gaggccttcttctggtaagtagctt

SEQ ID NO: 347968 - DNA, 25 bp, Rattus norvegicus
gaggccttgacaccattacctggac

SEQ ID NO: 347969 - DNA, 25 bp, Rattus norvegicus
gaggccttgacagcattacctggac

SEQ ID NO: 347970 - DNA, 25 bp, Rattus norvegicus
gaggccttgactatactgtggctgt

SEQ ID NO: 347971 - DNA, 25 bp, Rattus norvegicus
gaggccttgactttactgtggctgt

SEQ ID NO: 347972 - DNA, 25 bp, Rattus norvegicus
gaggccttgaggacaacaactgttt

SEQ ID NO: 347973 - DNA, 25 bp, Rattus norvegicus
gaggccttgaggtcaacaactgttt

SEQ ID NO: 347974 - DNA, 25 bp, Rattus norvegicus
gaggccttgcttcagttggaattgc

SEQ ID NO: 347975 - DNA, 25 bp, Rattus norvegicus
gaggccttgcttgagttggaattgc

SEQ ID NO: 347976 - DNA, 25 bp, Rattus norvegicus
gaggccttggtcatcgaatcactga

SEQ ID NO: 347977 - DNA, 25 bp, Rattus norvegicus
gaggccttggtcttcgaatcactga

SEQ ID NO: 347978 - DNA, 25 bp, Rattus norvegicus
gaggccttgtagagttacagttgca

SEQ ID NO: 347979 - DNA, 25 bp, Rattus norvegicus
gaggccttgtagtgttacagttgca

SEQ ID NO: 347980 - DNA, 25 bp, Rattus norvegicus
gaggccttgtctcctgaaactaaaa

SEQ ID NO: 347981 - DNA, 25 bp, Rattus norvegicus
gaggccttgtctgctgaaactaaaa

SEQ ID NO: 347982 - DNA, 25 bp, Rattus norvegicus
gaggcctttaaactgtatgggttct

SEQ ID NO: 347983 - DNA, 25 bp, Rattus norvegicus
gaggcctttaaagtgtatgggttct

SEQ ID NO: 347984 - DNA, 25 bp, Rattus norvegicus
gaggcctttatgagctacacatcat

SEQ ID NO: 347985 - DNA, 25 bp, Rattus norvegicus
gaggcctttatgtgctacacatcat

SEQ ID NO: 347986 - DNA, 25 bp, Rattus norvegicus
gaggcctttattccgtggattcata

SEQ ID NO: 347987 - DNA, 25 bp, Rattus norvegicus
gaggcctttattgcgtggattcata

SEQ ID NO: 347988 - DNA, 25 bp, Rattus norvegicus
gaggcctttcctcgtaatttgatat

SEQ ID NO: 347989 - DNA, 25 bp, Rattus norvegicus
gaggcctttcctggtaatttgatat

SEQ ID NO: 347990 - DNA, 25 bp, Rattus norvegicus
gaggcctttgcgattttacaagaac

SEQ ID NO: 347991 - DNA, 25 bp, Rattus norvegicus
gaggcctttgcgtttttacaagaac

SEQ ID NO: 347992 - DNA, 25 bp, Rattus norvegicus
gaggccttttgcagagtaaatacct

SEQ ID NO: 347993 - DNA, 25 bp, Rattus norvegicus
gaggccttttgctgagtaaatacct

SEQ ID NO: 347994 - DNA, 25 bp, Rattus norvegicus
gaggcgaaacaaatccacggagtca

SEQ ID NO: 347995 - DNA, 25 bp, Rattus norvegicus
gaggcgaaacaattccacggagtca

SEQ ID NO: 347996 - DNA, 25 bp, Rattus norvegicus
gaggcgaaactactttgataaatct

SEQ ID NO: 347997 - DNA, 25 bp, Rattus norvegicus
gaggcgaaactagtttgataaatct

SEQ ID NO: 347998 - DNA, 25 bp, Rattus norvegicus
gaggcgaatgctctgtctggattca

SEQ ID NO: 347999 - DNA, 25 bp, Rattus norvegicus
gaggcgaatgctgtgtctggattca

SEQ ID NO: 348000 - DNA, 25 bp, Rattus norvegicus
gaggcgaatgtcatcagcacagatt

SEQ ID NO: 348001 - DNA, 25 bp, Rattus norvegicus
gaggcgaatgtcttcagcacagatt

SEQ ID NO: 348002 - DNA, 25 bp, Rattus norvegicus
gaggcgaattttaatcttaactagc

SEQ ID NO: 348003 - DNA, 25 bp, Rattus norvegicus
gaggcgaatttttatcttaactagc

SEQ ID NO: 348004 - DNA, 25 bp, Rattus norvegicus
gaggcgacacgaacggcgtggacaa

SEQ ID NO: 348005 - DNA, 25 bp, Rattus norvegicus
gaggcgacacgatcggcgtggacaa

SEQ ID NO: 348006 - DNA, 25 bp, Rattus norvegicus
gaggcgaccaagattgcagctgatc

SEQ ID NO: 348007 - DNA, 25 bp, Rattus norvegicus
gaggcgaccaagtttgcagctgatc

SEQ ID NO: 348008 - DNA, 25 bp, Rattus norvegicus
gaggcgaccaccacacgaaaagcag

SEQ ID NO: 348009 - DNA, 25 bp, Rattus norvegicus
gaggcgaccacctcacgaaaagcag

SEQ ID NO: 348010 - DNA, 25 bp, Rattus norvegicus
gaggcgactccgacccggcttgtaa

SEQ ID NO: 348011 - DNA, 25 bp, Rattus norvegicus
gaggcgactccgtcccggcttgtaa

SEQ ID NO: 348012 - DNA, 25 bp, Rattus norvegicus
gaggcgagaagaccctaccaagtgt

SEQ ID NO: 348013 - DNA, 25 bp, Rattus norvegicus
gaggcgagaagagcctaccaagtgt

SEQ ID NO: 348014 - DNA, 25 bp, Rattus norvegicus
gaggcgagaattccagcacacttaa

SEQ ID NO: 348015 - DNA, 25 bp, Rattus norvegicus
gaggcgagaattgcagcacacttaa

SEQ ID NO: 348016 - DNA, 25 bp, Rattus norvegicus
gaggcgagtccgaggcccgcgccat

SEQ ID NO: 348017 - DNA, 25 bp, Rattus norvegicus
gaggcgagtccgtggcccgcgccat

SEQ ID NO: 348018 - DNA, 25 bp, Rattus norvegicus
gaggcgatagtcacagggccacaga

SEQ ID NO: 348019 - DNA, 25 bp, Rattus norvegicus
gaggcgatagtctcagggccacaga

SEQ ID NO: 348020 - DNA, 25 bp, Rattus norvegicus
gaggcgatggctataacagctgaca

SEQ ID NO: 348021 - DNA, 25 bp, Rattus norvegicus
gaggcgatggctttaacagctgaca

SEQ ID NO: 348022 - DNA, 25 bp, Rattus norvegicus
gaggcgattagaactccctgaaact

SEQ ID NO: 348023 - DNA, 25 bp, Rattus norvegicus
gaggcgattagatctccctgaaact

SEQ ID NO: 348024 - DNA, 25 bp, Rattus norvegicus
gaggcgcaaacaagccaatcccagg

SEQ ID NO: 348025 - DNA, 25 bp, Rattus norvegicus
gaggcgcaaacatgccaatcccagg

SEQ ID NO: 348026 - DNA, 25 bp, Rattus norvegicus
gaggcgcagcttatattcagacatc

SEQ ID NO: 348027 - DNA, 25 bp, Rattus norvegicus
gaggcgcagcttttattcagacatc

SEQ ID NO: 348028 - DNA, 25 bp, Rattus norvegicus
gaggcgcataccacaggtgttttct

SEQ ID NO: 348029 - DNA, 25 bp, Rattus norvegicus
gaggcgcatacctcaggtgttttct

SEQ ID NO: 348030 - DNA, 25 bp, Rattus norvegicus
gaggcgcatgccagttttggtgccc

SEQ ID NO: 348031 - DNA, 25 bp, Rattus norvegicus
gaggcgcatgcctgttttggtgccc

SEQ ID NO: 348032 - DNA, 25 bp, Rattus norvegicus
gaggcgccaaacagcagagagcttt

SEQ ID NO: 348033 - DNA, 25 bp, Rattus norvegicus
gaggcgccaaactgcagagagcttt

SEQ ID NO: 348034 - DNA, 25 bp, Rattus norvegicus
gaggcgcctggccaacacacagaga

SEQ ID NO: 348035 - DNA, 25 bp, Rattus norvegicus
gaggcgcctggcgaacacacagaga

SEQ ID NO: 348036 - DNA, 25 bp, Rattus norvegicus
gaggcgcgagttcaacctaatccat

SEQ ID NO: 348037 - DNA, 25 bp, Rattus norvegicus
gaggcgcgagttgaacctaatccat

SEQ ID NO: 348038 - DNA, 25 bp, Rattus norvegicus
gaggcgcgcacgctcgcttgtttcc

SEQ ID NO: 348039 - DNA, 25 bp, Rattus norvegicus
gaggcgcgcacggtcgcttgtttcc

SEQ ID NO: 348040 - DNA, 25 bp, Rattus norvegicus
gaggcgcggaccacatcgagaatca

SEQ ID NO: 348041 - DNA, 25 bp, Rattus norvegicus
gaggcgcggacctcatcgagaatca

SEQ ID NO: 348042 - DNA, 25 bp, Rattus norvegicus
gaggcgcgtccgcagcgcagaagcg

SEQ ID NO: 348043 - DNA, 25 bp, Rattus norvegicus
gaggcgcgtccggagcgcagaagcg

SEQ ID NO: 348044 - DNA, 25 bp, Rattus norvegicus
gaggcgctacagaacgactggctgc

SEQ ID NO: 348045 - DNA, 25 bp, Rattus norvegicus
gaggcgctacagtacgactggctgc

SEQ ID NO: 348046 - DNA, 25 bp, Rattus norvegicus
gaggcgctacgcagacagtcctgct

SEQ ID NO: 348047 - DNA, 25 bp, Rattus norvegicus
gaggcgctacgctgacagtcctgct

SEQ ID NO: 348048 - DNA, 25 bp, Rattus norvegicus
gaggcgctctctcagtttttgagtc

SEQ ID NO: 348049 - DNA, 25 bp, Rattus norvegicus
gaggcgctctctgagtttttgagtc

SEQ ID NO: 348050 - DNA, 25 bp, Rattus norvegicus
gaggcgctgaataagctgctactga

SEQ ID NO: 348051 - DNA, 25 bp, Rattus norvegicus
gaggcgctgaattagctgctactga

SEQ ID NO: 348052 - DNA, 25 bp, Rattus norvegicus
gaggcgctggcaagcccgaatcggt

SEQ ID NO: 348053 - DNA, 25 bp, Rattus norvegicus
gaggcgctggcatgcccgaatcggt

SEQ ID NO: 348054 - DNA, 25 bp, Rattus norvegicus
gaggcgctgtgcatgaaaagcccca

SEQ ID NO: 348055 - DNA, 25 bp, Rattus norvegicus
gaggcgctgtgcttgaaaagcccca

SEQ ID NO: 348056 - DNA, 25 bp, Rattus norvegicus
gaggcgctgtttatggagcattgca

SEQ ID NO: 348057 - DNA, 25 bp, Rattus norvegicus
gaggcgctgtttttggagcattgca

SEQ ID NO: 348058 - DNA, 25 bp, Rattus norvegicus
gaggcgcttttaagaagattaccaa

SEQ ID NO: 348059 - DNA, 25 bp, Rattus norvegicus
gaggcgcttttatgaagattaccaa

SEQ ID NO: 348060 - DNA, 25 bp, Rattus norvegicus
gaggcggaaatactctttcgaatgc

SEQ ID NO: 348061 - DNA, 25 bp, Rattus norvegicus
gaggcggaaatagtctttcgaatgc

SEQ ID NO: 348062 - DNA, 25 bp, Rattus norvegicus
gaggcggagatcatcaaggctttta

SEQ ID NO: 348063 - DNA, 25 bp, Rattus norvegicus
gaggcggagatcttcaaggctttta

SEQ ID NO: 348064 - DNA, 25 bp, Rattus norvegicus
gaggcggagggaactgcttttcctt

SEQ ID NO: 348065 - DNA, 25 bp, Rattus norvegicus
gaggcggagggatctgcttttcctt

SEQ ID NO: 348066 - DNA, 25 bp, Rattus norvegicus
gaggcggatggacacgtttactact

SEQ ID NO: 348067 - DNA, 25 bp, Rattus norvegicus
gaggcggatggagacgtttactact

SEQ ID NO: 348068 - DNA, 25 bp, Rattus norvegicus
gaggcggcaggaacccttccaggca

SEQ ID NO: 348069 - DNA, 25 bp, Rattus norvegicus
gaggcggcaggatcccttccaggca

SEQ ID NO: 348070 - DNA, 25 bp, Rattus norvegicus
gaggcggcagggaaattacagttac

SEQ ID NO: 348071 - DNA, 25 bp, Rattus norvegicus
gaggcggcagggtaattacagttac

SEQ ID NO: 348072 - DNA, 25 bp, Rattus norvegicus
gaggcggcatttctaaccttaggtt

SEQ ID NO: 348073 - DNA, 25 bp, Rattus norvegicus
gaggcggcatttgtaaccttaggtt

SEQ ID NO: 348074 - DNA, 25 bp, Rattus norvegicus
gaggcggccaagagtgacccgtcca

SEQ ID NO: 348075 - DNA, 25 bp, Rattus norvegicus
gaggcggccaagtgtgacccgtcca

SEQ ID NO: 348076 - DNA, 25 bp, Rattus norvegicus
gaggcggccttaaaagtgcagacat

SEQ ID NO: 348077 - DNA, 25 bp, Rattus norvegicus
gaggcggccttataagtgcagacat

SEQ ID NO: 348078 - DNA, 25 bp, Rattus norvegicus
gaggcggcgacaattcagttatcat

SEQ ID NO: 348079 - DNA, 25 bp, Rattus norvegicus
gaggcggcgacatttcagttatcat

SEQ ID NO: 348080 - DNA, 25 bp, Rattus norvegicus
gaggcggcgccacgaaggcgaggcc

SEQ ID NO: 348081 - DNA, 25 bp, Rattus norvegicus
gaggcggcgccaggaaggcgaggcc

SEQ ID NO: 348082 - DNA, 25 bp, Rattus norvegicus
gaggcggcgccgagggctggagccc

SEQ ID NO: 348083 - DNA, 25 bp, Rattus norvegicus
gaggcggcgccgtgggctggagccc

SEQ ID NO: 348084 - DNA, 25 bp, Rattus norvegicus
gaggcggctatgcaaaactggcaca

SEQ ID NO: 348085 - DNA, 25 bp, Rattus norvegicus
gaggcggctatggaaaactggcaca

SEQ ID NO: 348086 - DNA, 25 bp, Rattus norvegicus
gaggcggctccacagctttggaaaa

SEQ ID NO: 348087 - DNA, 25 bp, Rattus norvegicus
gaggcggctccagagctttggaaaa

SEQ ID NO: 348088 - DNA, 25 bp, Rattus norvegicus
gaggcggctctacgcgcatttgctt

SEQ ID NO: 348089 - DNA, 25 bp, Rattus norvegicus
gaggcggctctaggcgcatttgctt

SEQ ID NO: 348090 - DNA, 25 bp, Rattus norvegicus
gaggcgggagccaatatccttgaag

SEQ ID NO: 348091 - DNA, 25 bp, Rattus norvegicus
gaggcgggagcctatatccttgaag

SEQ ID NO: 348092 - DNA, 25 bp, Rattus norvegicus
gaggcgggccaaagcactgtgaact

SEQ ID NO: 348093 - DNA, 25 bp, Rattus norvegicus
gaggcgggccaatgcactgtgaact

SEQ ID NO: 348094 - DNA, 25 bp, Rattus norvegicus
gaggcgggtcccaggccaatgaaca

SEQ ID NO: 348095 - DNA, 25 bp, Rattus norvegicus
gaggcgggtccctggccaatgaaca

SEQ ID NO: 348096 - DNA, 25 bp, Rattus norvegicus
gaggcgggtttactgccaaacgtct

SEQ ID NO: 348097 - DNA, 25 bp, Rattus norvegicus
gaggcgggtttagtgccaaacgtct

SEQ ID NO: 348098 - DNA, 25 bp, Rattus norvegicus
gaggcggttaccatacactcaggac

SEQ ID NO: 348099 - DNA, 25 bp, Rattus norvegicus
gaggcggttaccttacactcaggac

SEQ ID NO: 348100 - DNA, 25 bp, Rattus norvegicus
gaggcgtagctcaggacgaagatac

SEQ ID NO: 348101 - DNA, 25 bp, Rattus norvegicus
gaggcgtagctctggacgaagatac

SEQ ID NO: 348102 - DNA, 25 bp, Rattus norvegicus
gaggcgtatgtaaattttgagaacc

SEQ ID NO: 348103 - DNA, 25 bp, Rattus norvegicus
gaggcgtatgtatattttgagaacc

SEQ ID NO: 348104 - DNA, 25 bp, Rattus norvegicus
gaggcgtcaagtatccgattaaagc

SEQ ID NO: 348105 - DNA, 25 bp, Rattus norvegicus
gaggcgtcaagtttccgattaaagc

SEQ ID NO: 348106 - DNA, 25 bp, Rattus norvegicus
gaggcgtccaggctgcttcttgcta

SEQ ID NO: 348107 - DNA, 25 bp, Rattus norvegicus
gaggcgtccagggtgcttcttgcta

SEQ ID NO: 348108 - DNA, 25 bp, Rattus norvegicus
gaggcgtcctcaaacctgagtgcaa

SEQ ID NO: 348109 - DNA, 25 bp, Rattus norvegicus
gaggcgtcctcatacctgagtgcaa

SEQ ID NO: 348110 - DNA, 25 bp, Rattus norvegicus
gaggcgtcttcaaggttcatatgta

SEQ ID NO: 348111 - DNA, 25 bp, Rattus norvegicus
gaggcgtcttcatggttcatatgta

SEQ ID NO: 348112 - DNA, 25 bp, Rattus norvegicus
gaggcgtgcatgattgctgagaaca

SEQ ID NO: 348113 - DNA, 25 bp, Rattus norvegicus
gaggcgtgcatgtttgctgagaaca

SEQ ID NO: 348114 - DNA, 25 bp, Rattus norvegicus
gaggcgtgtgaaatcctgtgctcaa

SEQ ID NO: 348115 - DNA, 25 bp, Rattus norvegicus
gaggcgtgtgaattcctgtgctcaa

SEQ ID NO: 348116 - DNA, 25 bp, Rattus norvegicus
gaggcgttggaaatttcctcttcct

SEQ ID NO: 348117 - DNA, 25 bp, Rattus norvegicus
gaggcgttggaattttcctcttcct

SEQ ID NO: 348118 - DNA, 25 bp, Rattus norvegicus
gaggcgtttattatacccaagcaga

SEQ ID NO: 348119 - DNA, 25 bp, Rattus norvegicus
gaggcgtttattttacccaagcaga

SEQ ID NO: 348120 - DNA, 25 bp, Rattus norvegicus
gaggcgttttccctaatggcacctg

SEQ ID NO: 348121 - DNA, 25 bp, Rattus norvegicus
gaggcgttttccgtaatggcacctg

SEQ ID NO: 348122 - DNA, 25 bp, Rattus norvegicus
gaggctaaaaggatgtcagatcacc

SEQ ID NO: 348123 - DNA, 25 bp, Rattus norvegicus
gaggctaaaaggttgtcagatcacc

SEQ ID NO: 348124 - DNA, 25 bp, Rattus norvegicus
gaggctaaaccccagatcccaagtt

SEQ ID NO: 348125 - DNA, 25 bp, Rattus norvegicus
gaggctaaacccgagatcccaagtt

SEQ ID NO: 348126 - DNA, 25 bp, Rattus norvegicus
gaggctaaactgctcccttaggatt

SEQ ID NO: 348127 - DNA, 25 bp, Rattus norvegicus
gaggctaaactggtcccttaggatt

SEQ ID NO: 348128 - DNA, 25 bp, Rattus norvegicus
gaggctaaagaaacccctgctctga

SEQ ID NO: 348129 - DNA, 25 bp, Rattus norvegicus
gaggctaaagaatcccctgctctga

SEQ ID NO: 348130 - DNA, 25 bp, Rattus norvegicus
gaggctaaagaccattgaacaactg

SEQ ID NO: 348131 - DNA, 25 bp, Rattus norvegicus
gaggctaaagaccttgacaggacca

SEQ ID NO: 348132 - DNA, 25 bp, Rattus norvegicus
gaggctaaagacgattgaacaactg

SEQ ID NO: 348133 - DNA, 25 bp, Rattus norvegicus
gaggctaaagacgttgacaggacca

SEQ ID NO: 348134 - DNA, 25 bp, Rattus norvegicus
gaggctaaatataggcctgtccctt

SEQ ID NO: 348135 - DNA, 25 bp, Rattus norvegicus
gaggctaaatattggcctgtccctt

SEQ ID NO: 348136 - DNA, 25 bp, Rattus norvegicus
gaggctaaatggcacctgggcacct

SEQ ID NO: 348137 - DNA, 25 bp, Rattus norvegicus
gaggctaaatgggacctgggcacct

SEQ ID NO: 348138 - DNA, 25 bp, Rattus norvegicus
gaggctaagactacactgatctccc

SEQ ID NO: 348139 - DNA, 25 bp, Rattus norvegicus
gaggctaagacttcactgatctccc

SEQ ID NO: 348140 - DNA, 25 bp, Rattus norvegicus
gaggctaagcctcttattggatcca

SEQ ID NO: 348141 - DNA, 25 bp, Rattus norvegicus
gaggctaagcctgttattggatcca

SEQ ID NO: 348142 - DNA, 25 bp, Rattus norvegicus
gaggctaatcctctgaccaaacatg

SEQ ID NO: 348143 - DNA, 25 bp, Rattus norvegicus
gaggctaatcctgtgaccaaacatg

SEQ ID NO: 348144 - DNA, 25 bp, Rattus norvegicus
gaggctaatgcccaaggtcacagtt

SEQ ID NO: 348145 - DNA, 25 bp, Rattus norvegicus
gaggctaatgccgaaggtcacagtt

SEQ ID NO: 348146 - DNA, 25 bp, Rattus norvegicus
gaggctacaattcgtcgacatgttt

SEQ ID NO: 348147 - DNA, 25 bp, Rattus norvegicus
gaggctacaattggtcgacatgttt

SEQ ID NO: 348148 - DNA, 25 bp, Rattus norvegicus
gaggctacagatctggctagactct

SEQ ID NO: 348149 - DNA, 25 bp, Rattus norvegicus
gaggctacagatgtggctagactct

SEQ ID NO: 348150 - DNA, 25 bp, Rattus norvegicus
gaggctacaggcacaagagcgccaa

SEQ ID NO: 348151 - DNA, 25 bp, Rattus norvegicus
gaggctacaggctcaagagcgccaa

SEQ ID NO: 348152 - DNA, 25 bp, Rattus norvegicus
gaggctacagggatgcacttcttag

SEQ ID NO: 348153 - DNA, 25 bp, Rattus norvegicus
gaggctacagggttgcacttcttag

SEQ ID NO: 348154 - DNA, 25 bp, Rattus norvegicus
gaggctacaggtctcccgagaggat

SEQ ID NO: 348155 - DNA, 25 bp, Rattus norvegicus
gaggctacaggtgtcccgagaggat

SEQ ID NO: 348156 - DNA, 25 bp, Rattus norvegicus
gaggctacagtaccagtgcgattca

SEQ ID NO: 348157 - DNA, 25 bp, Rattus norvegicus
gaggctacagtagcagtgcgattca

SEQ ID NO: 348158 - DNA, 25 bp, Rattus norvegicus
gaggctacattcataacccaattaa

SEQ ID NO: 348159 - DNA, 25 bp, Rattus norvegicus
gaggctacattcttaacccaattaa

SEQ ID NO: 348160 - DNA, 25 bp, Rattus norvegicus
gaggctaccaatattcctcctgttc

SEQ ID NO: 348161 - DNA, 25 bp, Rattus norvegicus
gaggctaccaattttcctcctgttc

SEQ ID NO: 348162 - DNA, 25 bp, Rattus norvegicus
gaggctaccagaagttgctttcctt

SEQ ID NO: 348163 - DNA, 25 bp, Rattus norvegicus
gaggctaccagatgttgctttcctt

SEQ ID NO: 348164 - DNA, 25 bp, Rattus norvegicus
gaggctaccagtaatatttgctgtt

SEQ ID NO: 348165 - DNA, 25 bp, Rattus norvegicus
gaggctaccagttatatttgctgtt

SEQ ID NO: 348166 - DNA, 25 bp, Rattus norvegicus
gaggctaccgggagatctgcaaaat

SEQ ID NO: 348167 - DNA, 25 bp, Rattus norvegicus
gaggctaccgggtgatctgcaaaat

SEQ ID NO: 348168 - DNA, 25 bp, Rattus norvegicus
gaggctaccttcagagaaacccgtg

SEQ ID NO: 348169 - DNA, 25 bp, Rattus norvegicus
gaggctaccttctgagaaacccgtg

SEQ ID NO: 348170 - DNA, 25 bp, Rattus norvegicus
gaggctacgaccctgttgatgactg

SEQ ID NO: 348171 - DNA, 25 bp, Rattus norvegicus
gaggctacgaccgtgttgatgactg

SEQ ID NO: 348172 - DNA, 25 bp, Rattus norvegicus
gaggctacgcgcatgtcaacggctg

SEQ ID NO: 348173 - DNA, 25 bp, Rattus norvegicus
gaggctacgcgcttgtcaacggctg

SEQ ID NO: 348174 - DNA, 25 bp, Rattus norvegicus
gaggctacggatctgttgggaggat

SEQ ID NO: 348175 - DNA, 25 bp, Rattus norvegicus
gaggctacggatgtgttgggaggat

SEQ ID NO: 348176 - DNA, 25 bp, Rattus norvegicus
gaggctactaatcccacaggccaaa

SEQ ID NO: 348177 - DNA, 25 bp, Rattus norvegicus
gaggctactaatgccacaggccaaa

SEQ ID NO: 348178 - DNA, 25 bp, Rattus norvegicus
gaggctactgagattttttccagag

SEQ ID NO: 348179 - DNA, 25 bp, Rattus norvegicus
gaggctactgagtttttttccagag

SEQ ID NO: 348180 - DNA, 25 bp, Rattus norvegicus
gaggctacttcccaatggtgataaa

SEQ ID NO: 348181 - DNA, 25 bp, Rattus norvegicus
gaggctacttccgaatggtgataaa

SEQ ID NO: 348182 - DNA, 25 bp, Rattus norvegicus
gaggctagaactctttgtaaaacaa

SEQ ID NO: 348183 - DNA, 25 bp, Rattus norvegicus
gaggctagaactgtttgtaaaacaa

SEQ ID NO: 348184 - DNA, 25 bp, Rattus norvegicus
gaggctagaagcatcacccgggttg

SEQ ID NO: 348185 - DNA, 25 bp, Rattus norvegicus
gaggctagaagcttcacccgggttg

SEQ ID NO: 348186 - DNA, 25 bp, Rattus norvegicus
gaggctagacctatattctgttgta

SEQ ID NO: 348187 - DNA, 25 bp, Rattus norvegicus
gaggctagacctttattctgttgta

SEQ ID NO: 348188 - DNA, 25 bp, Rattus norvegicus
gaggctagactacatcacagcggaa

SEQ ID NO: 348189 - DNA, 25 bp, Rattus norvegicus
gaggctagactagatcacagcggaa

SEQ ID NO: 348190 - DNA, 25 bp, Rattus norvegicus
gaggctagactcaattttcttctcc

SEQ ID NO: 348191 - DNA, 25 bp, Rattus norvegicus
gaggctagactctattttcttctcc

SEQ ID NO: 348192 - DNA, 25 bp, Rattus norvegicus
gaggctagagagagactcccggaaa

SEQ ID NO: 348193 - DNA, 25 bp, Rattus norvegicus
gaggctagagagtgactcccggaaa

SEQ ID NO: 348194 - DNA, 25 bp, Rattus norvegicus
gaggctagcactattacatgtgagc

SEQ ID NO: 348195 - DNA, 25 bp, Rattus norvegicus
gaggctagcacttttacatgtgagc

SEQ ID NO: 348196 - DNA, 25 bp, Rattus norvegicus
gaggctagccaactctcgtcggtag

SEQ ID NO: 348197 - DNA, 25 bp, Rattus norvegicus
gaggctagccaagtctcgtcggtag

SEQ ID NO: 348198 - DNA, 25 bp, Rattus norvegicus
gaggctagcctgaactgtattgtga

SEQ ID NO: 348199 - DNA, 25 bp, Rattus norvegicus
gaggctagcctgagaggtcagtcca

SEQ ID NO: 348200 - DNA, 25 bp, Rattus norvegicus
gaggctagcctgtactgtattgtga

SEQ ID NO: 348201 - DNA, 25 bp, Rattus norvegicus
gaggctagcctgtgaggtcagtcca

SEQ ID NO: 348202 - DNA, 25 bp, Rattus norvegicus
gaggctagctcactctacatagagt

SEQ ID NO: 348203 - DNA, 25 bp, Rattus norvegicus
gaggctagctcagtctacatagagt

SEQ ID NO: 348204 - DNA, 25 bp, Rattus norvegicus
gaggctagctgaactacacacacac

SEQ ID NO: 348205 - DNA, 25 bp, Rattus norvegicus
gaggctagctgatctacacacacac

SEQ ID NO: 348206 - DNA, 25 bp, Rattus norvegicus
gaggctaggcccagcgaacgagcta

SEQ ID NO: 348207 - DNA, 25 bp, Rattus norvegicus
gaggctaggccctgcgaacgagcta

SEQ ID NO: 348208 - DNA, 25 bp, Rattus norvegicus
gaggctagtaccattttctgtcact

SEQ ID NO: 348209 - DNA, 25 bp, Rattus norvegicus
gaggctagtacctttttctgtcact

SEQ ID NO: 348210 - DNA, 25 bp, Rattus norvegicus
gaggctagtcaactcaatgcattaa

SEQ ID NO: 348211 - DNA, 25 bp, Rattus norvegicus
gaggctagtcaagtcaatgcattaa

SEQ ID NO: 348212 - DNA, 25 bp, Rattus norvegicus
gaggctagtgtcatctacagagaga

SEQ ID NO: 348213 - DNA, 25 bp, Rattus norvegicus
gaggctagtgtcttctacagagaga

SEQ ID NO: 348214 - DNA, 25 bp, Rattus norvegicus
gaggctagtttcatcagtgagtctt

SEQ ID NO: 348215 - DNA, 25 bp, Rattus norvegicus
gaggctagtttcttcagtgagtctt

SEQ ID NO: 348216 - DNA, 25 bp, Rattus norvegicus
gaggctatacaaatcccacacaaat

SEQ ID NO: 348217 - DNA, 25 bp, Rattus norvegicus
gaggctatacaacgtttagctgcat

SEQ ID NO: 348218 - DNA, 25 bp, Rattus norvegicus
gaggctatacaaggtttagctgcat

SEQ ID NO: 348219 - DNA, 25 bp, Rattus norvegicus
gaggctatacaattcccacacaaat

SEQ ID NO: 348220 - DNA, 25 bp, Rattus norvegicus
gaggctatagtaacatgtcttggtc

SEQ ID NO: 348221 - DNA, 25 bp, Rattus norvegicus
gaggctatagtatcatgtcttggtc

SEQ ID NO: 348222 - DNA, 25 bp, Rattus norvegicus
gaggctatcaagatcttttcccgac

SEQ ID NO: 348223 - DNA, 25 bp, Rattus norvegicus
gaggctatcaagttcttttcccgac

SEQ ID NO: 348224 - DNA, 25 bp, Rattus norvegicus
gaggctatcctgaagtgacgttaat

SEQ ID NO: 348225 - DNA, 25 bp, Rattus norvegicus
gaggctatcctgtagtgacgttaat

SEQ ID NO: 348226 - DNA, 25 bp, Rattus norvegicus
gaggctatgacaatcacgtgcagac

SEQ ID NO: 348227 - DNA, 25 bp, Rattus norvegicus
gaggctatgacattcacgtgcagac

SEQ ID NO: 348228 - DNA, 25 bp, Rattus norvegicus
gaggctatgcctccttcaggaagag

SEQ ID NO: 348229 - DNA, 25 bp, Rattus norvegicus
gaggctatgcctgcttcaggaagag

SEQ ID NO: 348230 - DNA, 25 bp, Rattus norvegicus
gaggctatgctcatcgtactggaga

SEQ ID NO: 348231 - DNA, 25 bp, Rattus norvegicus
gaggctatgctcttcgtactggaga

SEQ ID NO: 348232 - DNA, 25 bp, Rattus norvegicus
gaggctatggaacctaacagtccta

SEQ ID NO: 348233 - DNA, 25 bp, Rattus norvegicus
gaggctatggaagctaacagtccta

SEQ ID NO: 348234 - DNA, 25 bp, Rattus norvegicus
gaggctattagcagcctgctgaggc

SEQ ID NO: 348235 - DNA, 25 bp, Rattus norvegicus
gaggctattagctgcctgctgaggc

SEQ ID NO: 348236 - DNA, 25 bp, Rattus norvegicus
gaggctattgtcataatattctgtc

SEQ ID NO: 348237 - DNA, 25 bp, Rattus norvegicus
gaggctattgtcttaatattctgtc

SEQ ID NO: 348238 - DNA, 25 bp, Rattus norvegicus
gaggctatttagagtctttgcattc

SEQ ID NO: 348239 - DNA, 25 bp, Rattus norvegicus
gaggctatttagtgtctttgcattc

SEQ ID NO: 348240 - DNA, 25 bp, Rattus norvegicus
gaggctcaaactcggttttctcatg

SEQ ID NO: 348241 - DNA, 25 bp, Rattus norvegicus
gaggctcaaactgggttttctcatg

SEQ ID NO: 348242 - DNA, 25 bp, Rattus norvegicus
gaggctcaacaaacagcatggagga

SEQ ID NO: 348243 - DNA, 25 bp, Rattus norvegicus
gaggctcaacaatcagcatggagga

SEQ ID NO: 348244 - DNA, 25 bp, Rattus norvegicus
gaggctcaacgtccgtgacaagctt

SEQ ID NO: 348245 - DNA, 25 bp, Rattus norvegicus
gaggctcaacgtgcgtgacaagctt

SEQ ID NO: 348246 - DNA, 25 bp, Rattus norvegicus
gaggctcaactcctagtgcagagtc

SEQ ID NO: 348247 - DNA, 25 bp, Rattus norvegicus
gaggctcaactcgtagtgcagagtc

SEQ ID NO: 348248 - DNA, 25 bp, Rattus norvegicus
gaggctcaagaaccttcgcagggac

SEQ ID NO: 348249 - DNA, 25 bp, Rattus norvegicus
gaggctcaagaagcttcgcagggac

SEQ ID NO: 348250 - DNA, 25 bp, Rattus norvegicus
gaggctcaatcaagaacacgctgac

SEQ ID NO: 348251 - DNA, 25 bp, Rattus norvegicus
gaggctcaatcatgaacacgctgac

SEQ ID NO: 348252 - DNA, 25 bp, Rattus norvegicus
gaggctcacagcctatcacggaata

SEQ ID NO: 348253 - DNA, 25 bp, Rattus norvegicus
gaggctcacagcgtatcacggaata

SEQ ID NO: 348254 - DNA, 25 bp, Rattus norvegicus
gaggctcacaggagcaatccttgga

SEQ ID NO: 348255 - DNA, 25 bp, Rattus norvegicus
gaggctcacaggtgcaatccttgga

SEQ ID NO: 348256 - DNA, 25 bp, Rattus norvegicus
gaggctcacagtcgcttacagcaga

SEQ ID NO: 348257 - DNA, 25 bp, Rattus norvegicus
gaggctcacagtggcttacagcaga

SEQ ID NO: 348258 - DNA, 25 bp, Rattus norvegicus
gaggctcacctacagcaactggaaa

SEQ ID NO: 348259 - DNA, 25 bp, Rattus norvegicus
gaggctcacctagagcaactggaaa

SEQ ID NO: 348260 - DNA, 25 bp, Rattus norvegicus
gaggctcacctgaactggagaccat

SEQ ID NO: 348261 - DNA, 25 bp, Rattus norvegicus
gaggctcacctgtactggagaccat

SEQ ID NO: 348262 - DNA, 25 bp, Rattus norvegicus
gaggctcacgccatggtttgggacc

SEQ ID NO: 348263 - DNA, 25 bp, Rattus norvegicus
gaggctcacgccttggtttgggacc

SEQ ID NO: 348264 - DNA, 25 bp, Rattus norvegicus
gaggctcactcaattcctataagga

SEQ ID NO: 348265 - DNA, 25 bp, Rattus norvegicus
gaggctcactcatttcctataagga

SEQ ID NO: 348266 - DNA, 25 bp, Rattus norvegicus
gaggctcacttgcatttctttttgt

SEQ ID NO: 348267 - DNA, 25 bp, Rattus norvegicus
gaggctcacttggatttctttttgt

SEQ ID NO: 348268 - DNA, 25 bp, Rattus norvegicus
gaggctcagaccattgaggcttgaa

SEQ ID NO: 348269 - DNA, 25 bp, Rattus norvegicus
gaggctcagacctttgaggcttgaa

SEQ ID NO: 348270 - DNA, 25 bp, Rattus norvegicus
gaggctcagagacggcaaatcgcta

SEQ ID NO: 348271 - DNA, 25 bp, Rattus norvegicus
gaggctcagagagggcaaatcgcta

SEQ ID NO: 348272 - DNA, 25 bp, Rattus norvegicus
gaggctcagagcatctttgatggca

SEQ ID NO: 348273 - DNA, 25 bp, Rattus norvegicus
gaggctcagagcttctttgatggca

SEQ ID NO: 348274 - DNA, 25 bp, Rattus norvegicus
gaggctcagcaaacagctttaacat

SEQ ID NO: 348275 - DNA, 25 bp, Rattus norvegicus
gaggctcagcaactgccatgctgca

SEQ ID NO: 348276 - DNA, 25 bp, Rattus norvegicus
gaggctcagcaagtgccatgctgca

SEQ ID NO: 348277 - DNA, 25 bp, Rattus norvegicus
gaggctcagcaatcagctttaacat

SEQ ID NO: 348278 - DNA, 25 bp, Rattus norvegicus
gaggctcagctcacctagtcaatgt

SEQ ID NO: 348279 - DNA, 25 bp, Rattus norvegicus
gaggctcagctctcctagtcaatgt

SEQ ID NO: 348280 - DNA, 25 bp, Rattus norvegicus
gaggctcagctgcttgtataaaaat

SEQ ID NO: 348281 - DNA, 25 bp, Rattus norvegicus
gaggctcagctggttgtataaaaat

SEQ ID NO: 348282 - DNA, 25 bp, Rattus norvegicus
gaggctcagcttcagttactctgca

SEQ ID NO: 348283 - DNA, 25 bp, Rattus norvegicus
gaggctcagcttgagttactctgca

SEQ ID NO: 348284 - DNA, 25 bp, Rattus norvegicus
gaggctcaggctaccagctttggga

SEQ ID NO: 348285 - DNA, 25 bp, Rattus norvegicus
gaggctcaggctattttggccaaca

SEQ ID NO: 348286 - DNA, 25 bp, Rattus norvegicus
gaggctcaggcttccagctttggga

SEQ ID NO: 348287 - DNA, 25 bp, Rattus norvegicus
gaggctcaggcttttttggccaaca

SEQ ID NO: 348288 - DNA, 25 bp, Rattus norvegicus
gaggctcagtagacaaggtgcttgc

SEQ ID NO: 348289 - DNA, 25 bp, Rattus norvegicus
gaggctcagtagtcaaggtgcttgc

SEQ ID NO: 348290 - DNA, 25 bp, Rattus norvegicus
gaggctcagtcacactctgcagaca

SEQ ID NO: 348291 - DNA, 25 bp, Rattus norvegicus
gaggctcagtcagactctgcagaca

SEQ ID NO: 348292 - DNA, 25 bp, Rattus norvegicus
gaggctcatagcatccaactggaaa

SEQ ID NO: 348293 - DNA, 25 bp, Rattus norvegicus
gaggctcatagcttccaactggaaa

SEQ ID NO: 348294 - DNA, 25 bp, Rattus norvegicus
gaggctcatcatccttcacgatgtg

SEQ ID NO: 348295 - DNA, 25 bp, Rattus norvegicus
gaggctcatcatgcttcacgatgtg

SEQ ID NO: 348296 - DNA, 25 bp, Rattus norvegicus
gaggctcatgcgcaagattcagtta

SEQ ID NO: 348297 - DNA, 25 bp, Rattus norvegicus
gaggctcatgcggaagattcagtta

SEQ ID NO: 348298 - DNA, 25 bp, Rattus norvegicus
gaggctcattggacagtcaactaag

SEQ ID NO: 348299 - DNA, 25 bp, Rattus norvegicus
gaggctcattggtcagtcaactaag

SEQ ID NO: 348300 - DNA, 25 bp, Rattus norvegicus
gaggctcatttcactacttggttaa

SEQ ID NO: 348301 - DNA, 25 bp, Rattus norvegicus
gaggctcatttctctacttggttaa

SEQ ID NO: 348302 - DNA, 25 bp, Rattus norvegicus
gaggctccagccagtttagtgcatg

SEQ ID NO: 348303 - DNA, 25 bp, Rattus norvegicus
gaggctccagcctgtttagtgcatg

SEQ ID NO: 348304 - DNA, 25 bp, Rattus norvegicus
gaggctccaggtccaattaacttca

SEQ ID NO: 348305 - DNA, 25 bp, Rattus norvegicus
gaggctccaggtgcaattaacttca

SEQ ID NO: 348306 - DNA, 25 bp, Rattus norvegicus
gaggctccatacacagaagtcgcga

SEQ ID NO: 348307 - DNA, 25 bp, Rattus norvegicus
gaggctccatactcagaagtcgcga

SEQ ID NO: 348308 - DNA, 25 bp, Rattus norvegicus
gaggctccatgcagtcttcagagtc

SEQ ID NO: 348309 - DNA, 25 bp, Rattus norvegicus
gaggctccatgctgtcttcagagtc

SEQ ID NO: 348310 - DNA, 25 bp, Rattus norvegicus
gaggctccatttctgatgacttcaa

SEQ ID NO: 348311 - DNA, 25 bp, Rattus norvegicus
gaggctccatttgtgatgacttcaa

SEQ ID NO: 348312 - DNA, 25 bp, Rattus norvegicus
gaggctcccaacatggagaaatgta

SEQ ID NO: 348313 - DNA, 25 bp, Rattus norvegicus
gaggctcccaacttggagaaatgta

SEQ ID NO: 348314 - DNA, 25 bp, Rattus norvegicus
gaggctccccacacaacagggacag

SEQ ID NO: 348315 - DNA, 25 bp, Rattus norvegicus
gaggctccccactcaacagggacag

SEQ ID NO: 348316 - DNA, 25 bp, Rattus norvegicus
gaggctccctcaactgtaagagctt

SEQ ID NO: 348317 - DNA, 25 bp, Rattus norvegicus
gaggctccctcatctgtaagagctt

SEQ ID NO: 348318 - DNA, 25 bp, Rattus norvegicus
gaggctccctctcgtcctgagaaag

SEQ ID NO: 348319 - DNA, 25 bp, Rattus norvegicus
gaggctccctctggtcctgagaaag

SEQ ID NO: 348320 - DNA, 25 bp, Rattus norvegicus
gaggctccgaacctcaggaggtaaa

SEQ ID NO: 348321 - DNA, 25 bp, Rattus norvegicus
gaggctccgaacgtcaggaggtaaa

SEQ ID NO: 348322 - DNA, 25 bp, Rattus norvegicus
gaggctcctcagaaattactgtaca

SEQ ID NO: 348323 - DNA, 25 bp, Rattus norvegicus
gaggctcctcagtaattactgtaca

SEQ ID NO: 348324 - DNA, 25 bp, Rattus norvegicus
gaggctcctgagatacatgatatgg

SEQ ID NO: 348325 - DNA, 25 bp, Rattus norvegicus
gaggctcctgagttacatgatatgg

SEQ ID NO: 348326 - DNA, 25 bp, Rattus norvegicus
gaggctcctgcaacccaaatgtacc

SEQ ID NO: 348327 - DNA, 25 bp, Rattus norvegicus
gaggctcctgcatcccaaatgtacc

SEQ ID NO: 348328 - DNA, 25 bp, Rattus norvegicus
gaggctccttagaacacagacgtaa

SEQ ID NO: 348329 - DNA, 25 bp, Rattus norvegicus
gaggctccttagtacacagacgtaa

SEQ ID NO: 348330 - DNA, 25 bp, Rattus norvegicus
gaggctcgaattctgttcatgacca

SEQ ID NO: 348331 - DNA, 25 bp, Rattus norvegicus
gaggctcgaattgtgttcatgacca

SEQ ID NO: 348332 - DNA, 25 bp, Rattus norvegicus
gaggctcgaccccaagtatgaccct

SEQ ID NO: 348333 - DNA, 25 bp, Rattus norvegicus
gaggctcgacccgaagtatgaccct

SEQ ID NO: 348334 - DNA, 25 bp, Rattus norvegicus
gaggctcgacctctggcggaggttt

SEQ ID NO: 348335 - DNA, 25 bp, Rattus norvegicus
gaggctcgacctgtggcggaggttt

SEQ ID NO: 348336 - DNA, 25 bp, Rattus norvegicus
gaggctcgagctattgatccagtct

SEQ ID NO: 348337 - DNA, 25 bp, Rattus norvegicus
gaggctcgagcttttgatccagtct

SEQ ID NO: 348338 - DNA, 25 bp, Rattus norvegicus
gaggctcgccagactaaatcagcag

SEQ ID NO: 348339 - DNA, 25 bp, Rattus norvegicus
gaggctcgccagtctaaatcagcag

SEQ ID NO: 348340 - DNA, 25 bp, Rattus norvegicus
gaggctcgctacagcaccggattag

SEQ ID NO: 348341 - DNA, 25 bp, Rattus norvegicus
gaggctcgctactgcaccggattag

SEQ ID NO: 348342 - DNA, 25 bp, Rattus norvegicus
gaggctcggtggcaaccctgttaac

SEQ ID NO: 348343 - DNA, 25 bp, Rattus norvegicus
gaggctcggtgggaaccctgttaac

SEQ ID NO: 348344 - DNA, 25 bp, Rattus norvegicus
gaggctcgtaagacatttaccagag

SEQ ID NO: 348345 - DNA, 25 bp, Rattus norvegicus
gaggctcgtaagtcatttaccagag

SEQ ID NO: 348346 - DNA, 25 bp, Rattus norvegicus
gaggctcgtgaaaacgatcaatttt

SEQ ID NO: 348347 - DNA, 25 bp, Rattus norvegicus
gaggctcgtgaatacgatcaatttt

SEQ ID NO: 348348 - DNA, 25 bp, Rattus norvegicus
gaggctcgtggaaacagttgttcag

SEQ ID NO: 348349 - DNA, 25 bp, Rattus norvegicus
gaggctcgtggatacagttgttcag

SEQ ID NO: 348350 - DNA, 25 bp, Rattus norvegicus
gaggctctaaggacctccagggcat

SEQ ID NO: 348351 - DNA, 25 bp, Rattus norvegicus
gaggctctaaggtcctccagggcat

SEQ ID NO: 348352 - DNA, 25 bp, Rattus norvegicus
gaggctctagctctaatccttagtt

SEQ ID NO: 348353 - DNA, 25 bp, Rattus norvegicus
gaggctctagctgtaatccttagtt

SEQ ID NO: 348354 - DNA, 25 bp, Rattus norvegicus
gaggctctattacaatctggacgat

SEQ ID NO: 348355 - DNA, 25 bp, Rattus norvegicus
gaggctctattagaatctggacgat

SEQ ID NO: 348356 - DNA, 25 bp, Rattus norvegicus
gaggctctcaagattgttcccagga

SEQ ID NO: 348357 - DNA, 25 bp, Rattus norvegicus
gaggctctcaagtttgttcccagga

SEQ ID NO: 348358 - DNA, 25 bp, Rattus norvegicus
gaggctctcacacagcccagaggca

SEQ ID NO: 348359 - DNA, 25 bp, Rattus norvegicus
gaggctctcacagagcccagaggca

SEQ ID NO: 348360 - DNA, 25 bp, Rattus norvegicus
gaggctctcagcagacacttggaga

SEQ ID NO: 348361 - DNA, 25 bp, Rattus norvegicus
gaggctctcagctgacacttggaga

SEQ ID NO: 348362 - DNA, 25 bp, Rattus norvegicus
gaggctctcattctttttggtttag

SEQ ID NO: 348363 - DNA, 25 bp, Rattus norvegicus
gaggctctcattgtttttggtttag

SEQ ID NO: 348364 - DNA, 25 bp, Rattus norvegicus
gaggctctccgaatccacaaacctt

SEQ ID NO: 348365 - DNA, 25 bp, Rattus norvegicus
gaggctctccgattccacaaacctt

SEQ ID NO: 348366 - DNA, 25 bp, Rattus norvegicus
gaggctctctgtaaaggccttcaaa

SEQ ID NO: 348367 - DNA, 25 bp, Rattus norvegicus
gaggctctctgttaaggccttcaaa

SEQ ID NO: 348368 - DNA, 25 bp, Rattus norvegicus
gaggctctcttcctgacacagatgg

SEQ ID NO: 348369 - DNA, 25 bp, Rattus norvegicus
gaggctctcttcgtgacacagatgg

SEQ ID NO: 348370 - DNA, 25 bp, Rattus norvegicus
gaggctctgaacagccctgacagaa

SEQ ID NO: 348371 - DNA, 25 bp, Rattus norvegicus
gaggctctgaactgccctgacagaa

SEQ ID NO: 348372 - DNA, 25 bp, Rattus norvegicus
gaggctctgaccaatgggcctgaag

SEQ ID NO: 348373 - DNA, 25 bp, Rattus norvegicus
gaggctctgacctatgggcctgaag

SEQ ID NO: 348374 - DNA, 25 bp, Rattus norvegicus
gaggctctgagaacacgtcgctgtt

SEQ ID NO: 348375 - DNA, 25 bp, Rattus norvegicus
gaggctctgagatcacgtcgctgtt

SEQ ID NO: 348376 - DNA, 25 bp, Rattus norvegicus
gaggctctgcagcaaacactcatcc

SEQ ID NO: 348377 - DNA, 25 bp, Rattus norvegicus
gaggctctgcaggaaacactcatcc

SEQ ID NO: 348378 - DNA, 25 bp, Rattus norvegicus
gaggctctgctcaaagagtccagga

SEQ ID NO: 348379 - DNA, 25 bp, Rattus norvegicus
gaggctctgctctaagagtccagga

SEQ ID NO: 348380 - DNA, 25 bp, Rattus norvegicus
gaggctctggttctttgctgaccta

SEQ ID NO: 348381 - DNA, 25 bp, Rattus norvegicus
gaggctctggttgtttgctgaccta

SEQ ID NO: 348382 - DNA, 25 bp, Rattus norvegicus
gaggctctgtatatgctcctgtgga

SEQ ID NO: 348383 - DNA, 25 bp, Rattus norvegicus
gaggctctgtatttgctcctgtgga

SEQ ID NO: 348384 - DNA, 25 bp, Rattus norvegicus
gaggctctgtcaagcagcggtgcaa

SEQ ID NO: 348385 - DNA, 25 bp, Rattus norvegicus
gaggctctgtcacgtgaaactgtca

SEQ ID NO: 348386 - DNA, 25 bp, Rattus norvegicus
gaggctctgtcaggtgaaactgtca

SEQ ID NO: 348387 - DNA, 25 bp, Rattus norvegicus
gaggctctgtcatgcagcggtgcaa

SEQ ID NO: 348388 - DNA, 25 bp, Rattus norvegicus
gaggctctgttcatgaagtaccact

SEQ ID NO: 348389 - DNA, 25 bp, Rattus norvegicus
gaggctctgttcttgaagtaccact

SEQ ID NO: 348390 - DNA, 25 bp, Rattus norvegicus
gaggctcttcacaactagacttttt

SEQ ID NO: 348391 - DNA, 25 bp, Rattus norvegicus
gaggctcttcactactagacttttt

SEQ ID NO: 348392 - DNA, 25 bp, Rattus norvegicus
gaggctcttccacaacacgggaaga

SEQ ID NO: 348393 - DNA, 25 bp, Rattus norvegicus
gaggctcttccagaacacgggaaga

SEQ ID NO: 348394 - DNA, 25 bp, Rattus norvegicus
gaggctcttcccctatgggttaact

SEQ ID NO: 348395 - DNA, 25 bp, Rattus norvegicus
gaggctcttcccgtatgggttaact

SEQ ID NO: 348396 - DNA, 25 bp, Rattus norvegicus
gaggctcttgacaaaggcttgcaga

SEQ ID NO: 348397 - DNA, 25 bp, Rattus norvegicus
gaggctcttgactaaggcttgcaga

SEQ ID NO: 348398 - DNA, 25 bp, Rattus norvegicus
gaggctcttgagaattgcatgtgtg

SEQ ID NO: 348399 - DNA, 25 bp, Rattus norvegicus
gaggctcttgagtattgcatgtgtg

SEQ ID NO: 348400 - DNA, 25 bp, Rattus norvegicus
gaggctcttgcaatgtgcttagaag

SEQ ID NO: 348401 - DNA, 25 bp, Rattus norvegicus
gaggctcttgcattgtgcttagaag

SEQ ID NO: 348402 - DNA, 25 bp, Rattus norvegicus
gaggctcttggtaccatacccagaa

SEQ ID NO: 348403 - DNA, 25 bp, Rattus norvegicus
gaggctcttggttccatacccagaa

SEQ ID NO: 348404 - DNA, 25 bp, Rattus norvegicus
gaggctctttgtctgaaacattgca

SEQ ID NO: 348405 - DNA, 25 bp, Rattus norvegicus
gaggctctttgtgtgaaacattgca

SEQ ID NO: 348406 - DNA, 25 bp, Rattus norvegicus
gaggctcttttgcaactgccatttt

SEQ ID NO: 348407 - DNA, 25 bp, Rattus norvegicus
gaggctcttttggaactgccatttt

SEQ ID NO: 348408 - DNA, 25 bp, Rattus norvegicus
gaggctgaacagagtacaggcccaa

SEQ ID NO: 348409 - DNA, 25 bp, Rattus norvegicus
gaggctgaacagtgtacaggcccaa

SEQ ID NO: 348410 - DNA, 25 bp, Rattus norvegicus
gaggctgaagccaaggtccccacag

SEQ ID NO: 348411 - DNA, 25 bp, Rattus norvegicus
gaggctgaagcctaggtccccacag

SEQ ID NO: 348412 - DNA, 25 bp, Rattus norvegicus
gaggctgaccataatctaagagctt

SEQ ID NO: 348413 - DNA, 25 bp, Rattus norvegicus
gaggctgaccattatctaagagctt

SEQ ID NO: 348414 - DNA, 25 bp, Rattus norvegicus
gaggctgaccctctgtggacactgt

SEQ ID NO: 348415 - DNA, 25 bp, Rattus norvegicus
gaggctgaccctgtgtggacactgt

SEQ ID NO: 348416 - DNA, 25 bp, Rattus norvegicus
gaggctgacctccaattaaaggcaa

SEQ ID NO: 348417 - DNA, 25 bp, Rattus norvegicus
gaggctgacctcgaattaaaggcaa

SEQ ID NO: 348418 - DNA, 25 bp, Rattus norvegicus
gaggctgacctgaggcgtttattca

SEQ ID NO: 348419 - DNA, 25 bp, Rattus norvegicus
gaggctgacctgtggcgtttattca

SEQ ID NO: 348420 - DNA, 25 bp, Rattus norvegicus
gaggctgacgatccaggtgtcttcc

SEQ ID NO: 348421 - DNA, 25 bp, Rattus norvegicus
gaggctgacgatgcaggtgtcttcc

SEQ ID NO: 348422 - DNA, 25 bp, Rattus norvegicus
gaggctgactcacgaaccttcttac

SEQ ID NO: 348423 - DNA, 25 bp, Rattus norvegicus
gaggctgactcaggaaccttcttac

SEQ ID NO: 348424 - DNA, 25 bp, Rattus norvegicus
gaggctgagaaccaacggatccgcc

SEQ ID NO: 348425 - DNA, 25 bp, Rattus norvegicus
gaggctgagaacgaacggatccgcc

SEQ ID NO: 348426 - DNA, 25 bp, Rattus norvegicus
gaggctgagactcccaagactggaa

SEQ ID NO: 348427 - DNA, 25 bp, Rattus norvegicus
gaggctgagactgccaagactggaa

SEQ ID NO: 348428 - DNA, 25 bp, Rattus norvegicus
gaggctgagcacagaccccatagga

SEQ ID NO: 348429 - DNA, 25 bp, Rattus norvegicus
gaggctgagcactgaccccatagga

SEQ ID NO: 348430 - DNA, 25 bp, Rattus norvegicus
gaggctgagcccaggagaaactcca

SEQ ID NO: 348431 - DNA, 25 bp, Rattus norvegicus
gaggctgagccctggagaaactcca

SEQ ID NO: 348432 - DNA, 25 bp, Rattus norvegicus
gaggctgagctcaatactgtgagaa

SEQ ID NO: 348433 - DNA, 25 bp, Rattus norvegicus
gaggctgagctctatactgtgagaa

SEQ ID NO: 348434 - DNA, 25 bp, Rattus norvegicus
gaggctgaggacacaccaaggacaa

SEQ ID NO: 348435 - DNA, 25 bp, Rattus norvegicus
gaggctgaggactcaccaaggacaa

SEQ ID NO: 348436 - DNA, 25 bp, Rattus norvegicus
gaggctgaggatattccatctttaa

SEQ ID NO: 348437 - DNA, 25 bp, Rattus norvegicus
gaggctgaggatcctggtcctccaa

SEQ ID NO: 348438 - DNA, 25 bp, Rattus norvegicus
gaggctgaggatgctggtcctccaa

SEQ ID NO: 348439 - DNA, 25 bp, Rattus norvegicus
gaggctgaggattttccatctttaa

SEQ ID NO: 348440 - DNA, 25 bp, Rattus norvegicus
gaggctgagggcatgaccctttacc

SEQ ID NO: 348441 - DNA, 25 bp, Rattus norvegicus
gaggctgagggcttgaccctttacc

SEQ ID NO: 348442 - DNA, 25 bp, Rattus norvegicus
gaggctgagggtaattctcctctta

SEQ ID NO: 348443 - DNA, 25 bp, Rattus norvegicus
gaggctgagggttattctcctctta

SEQ ID NO: 348444 - DNA, 25 bp, Rattus norvegicus
gaggctgagtatatttagtgcacaa

SEQ ID NO: 348445 - DNA, 25 bp, Rattus norvegicus
gaggctgagtatttttagtgcacaa

SEQ ID NO: 348446 - DNA, 25 bp, Rattus norvegicus
gaggctgatcaaactcactggagag

SEQ ID NO: 348447 - DNA, 25 bp, Rattus norvegicus
gaggctgatcaatctcactggagag

SEQ ID NO: 348448 - DNA, 25 bp, Rattus norvegicus
gaggctgatcccatgagtaaagtgc

SEQ ID NO: 348449 - DNA, 25 bp, Rattus norvegicus
gaggctgatcccttgagtaaagtgc

SEQ ID NO: 348450 - DNA, 25 bp, Rattus norvegicus
gaggctgatgacaggtgtatcccaa

SEQ ID NO: 348451 - DNA, 25 bp, Rattus norvegicus
gaggctgatgactggtgtatcccaa

SEQ ID NO: 348452 - DNA, 25 bp, Rattus norvegicus
gaggctgatgagaatcttccgaatt

SEQ ID NO: 348453 - DNA, 25 bp, Rattus norvegicus
gaggctgatgagtatcttccgaatt

SEQ ID NO: 348454 - DNA, 25 bp, Rattus norvegicus
gaggctgatgcaatcccacgctggg

SEQ ID NO: 348455 - DNA, 25 bp, Rattus norvegicus
gaggctgatgcactacccggaagca

SEQ ID NO: 348456 - DNA, 25 bp, Rattus norvegicus
gaggctgatgcagtacccggaagca

SEQ ID NO: 348457 - DNA, 25 bp, Rattus norvegicus
gaggctgatgcattcccacgctggg

SEQ ID NO: 348458 - DNA, 25 bp, Rattus norvegicus
gaggctgattcactctcttcaggat

SEQ ID NO: 348459 - DNA, 25 bp, Rattus norvegicus
gaggctgattcagtctcttcaggat

SEQ ID NO: 348460 - DNA, 25 bp, Rattus norvegicus
gaggctgcaatcaccatacttcgga

SEQ ID NO: 348461 - DNA, 25 bp, Rattus norvegicus
gaggctgcaatctccatacttcgga

SEQ ID NO: 348462 - DNA, 25 bp, Rattus norvegicus
gaggctgcacgcacatccgcgtgtg

SEQ ID NO: 348463 - DNA, 25 bp, Rattus norvegicus
gaggctgcacgctcatccgcgtgtg

SEQ ID NO: 348464 - DNA, 25 bp, Rattus norvegicus
gaggctgcactaacctctgacatct

SEQ ID NO: 348465 - DNA, 25 bp, Rattus norvegicus
gaggctgcactatcctctgacatct

SEQ ID NO: 348466 - DNA, 25 bp, Rattus norvegicus
gaggctgcagagaacccacttagag

SEQ ID NO: 348467 - DNA, 25 bp, Rattus norvegicus
gaggctgcagagtacccacttagag

SEQ ID NO: 348468 - DNA, 25 bp, Rattus norvegicus
gaggctgcagcaacagctaacccag

SEQ ID NO: 348469 - DNA, 25 bp, Rattus norvegicus
gaggctgcagcatcagctaacccag

SEQ ID NO: 348470 - DNA, 25 bp, Rattus norvegicus
gaggctgcagtacctagtgctgaca

SEQ ID NO: 348471 - DNA, 25 bp, Rattus norvegicus
gaggctgcagtagctagtgctgaca

SEQ ID NO: 348472 - DNA, 25 bp, Rattus norvegicus
gaggctgcatcccatctctgaagct

SEQ ID NO: 348473 - DNA, 25 bp, Rattus norvegicus
gaggctgcatccgatctctgaagct

SEQ ID NO: 348474 - DNA, 25 bp, Rattus norvegicus
gaggctgcattcatcatctttattt

SEQ ID NO: 348475 - DNA, 25 bp, Rattus norvegicus
gaggctgcattcttcatctttattt

SEQ ID NO: 348476 - DNA, 25 bp, Rattus norvegicus
gaggctgccacaccagatactggaa

SEQ ID NO: 348477 - DNA, 25 bp, Rattus norvegicus
gaggctgccacagcagatactggaa

SEQ ID NO: 348478 - DNA, 25 bp, Rattus norvegicus
gaggctgccagtattcaataagtct

SEQ ID NO: 348479 - DNA, 25 bp, Rattus norvegicus
gaggctgccagttttcaataagtct

SEQ ID NO: 348480 - DNA, 25 bp, Rattus norvegicus
gaggctgcccacaagttcacctggg

SEQ ID NO: 348481 - DNA, 25 bp, Rattus norvegicus
gaggctgcccactagttcacctggg

SEQ ID NO: 348482 - DNA, 25 bp, Rattus norvegicus
gaggctgccgaaaggaaactggaat

SEQ ID NO: 348483 - DNA, 25 bp, Rattus norvegicus
gaggctgccgaatggaaactggaat

SEQ ID NO: 348484 - DNA, 25 bp, Rattus norvegicus
gaggctgccgagaaagctcccttct

SEQ ID NO: 348485 - DNA, 25 bp, Rattus norvegicus
gaggctgccgagtaagctcccttct

SEQ ID NO: 348486 - DNA, 25 bp, Rattus norvegicus
gaggctgcctgaaattttgtggtaa

SEQ ID NO: 348487 - DNA, 25 bp, Rattus norvegicus
gaggctgcctgatattttgtggtaa

SEQ ID NO: 348488 - DNA, 25 bp, Rattus norvegicus
gaggctgcctggactgactagtgaa

SEQ ID NO: 348489 - DNA, 25 bp, Rattus norvegicus
gaggctgcctggtctgactagtgaa

SEQ ID NO: 348490 - DNA, 25 bp, Rattus norvegicus
gaggctgctaaaacacaccctggag

SEQ ID NO: 348491 - DNA, 25 bp, Rattus norvegicus
gaggctgctaaatcacaccctggag

SEQ ID NO: 348492 - DNA, 25 bp, Rattus norvegicus
gaggctgctactaggctgcttttat

SEQ ID NO: 348493 - DNA, 25 bp, Rattus norvegicus
gaggctgctacttggctgcttttat

SEQ ID NO: 348494 - DNA, 25 bp, Rattus norvegicus
gaggctgctagcactcttaaaatgc

SEQ ID NO: 348495 - DNA, 25 bp, Rattus norvegicus
gaggctgctagctctcttaaaatgc

SEQ ID NO: 348496 - DNA, 25 bp, Rattus norvegicus
gaggctgctcacaactgatatgtca

SEQ ID NO: 348497 - DNA, 25 bp, Rattus norvegicus
gaggctgctcactactgatatgtca

SEQ ID NO: 348498 - DNA, 25 bp, Rattus norvegicus
gaggctgctccaacccagagtggga

SEQ ID NO: 348499 - DNA, 25 bp, Rattus norvegicus
gaggctgctccatcccagagtggga

SEQ ID NO: 348500 - DNA, 25 bp, Rattus norvegicus
gaggctgctcccagcttgaggaaag

SEQ ID NO: 348501 - DNA, 25 bp, Rattus norvegicus
gaggctgctccctgcttgaggaaag

SEQ ID NO: 348502 - DNA, 25 bp, Rattus norvegicus
gaggctgctctccagctgcggttca

SEQ ID NO: 348503 - DNA, 25 bp, Rattus norvegicus
gaggctgctctcgagctgcggttca

SEQ ID NO: 348504 - DNA, 25 bp, Rattus norvegicus
gaggctgctgccactgagcaagcca

SEQ ID NO: 348505 - DNA, 25 bp, Rattus norvegicus
gaggctgctgcctctgagcaagcca

SEQ ID NO: 348506 - DNA, 25 bp, Rattus norvegicus
gaggctgctgctaataggcccagat

SEQ ID NO: 348507 - DNA, 25 bp, Rattus norvegicus
gaggctgctgcttataggcccagat

SEQ ID NO: 348508 - DNA, 25 bp, Rattus norvegicus
gaggctgctggcaccggtcctgtct

SEQ ID NO: 348509 - DNA, 25 bp, Rattus norvegicus
gaggctgctggctccggtcctgtct

SEQ ID NO: 348510 - DNA, 25 bp, Rattus norvegicus
gaggctgctgtaaacatgcccagtt

SEQ ID NO: 348511 - DNA, 25 bp, Rattus norvegicus
gaggctgctgtatacatgcccagtt

SEQ ID NO: 348512 - DNA, 25 bp, Rattus norvegicus
gaggctggaatactcatggaataac

SEQ ID NO: 348513 - DNA, 25 bp, Rattus norvegicus
gaggctggaatagtcatggaataac

SEQ ID NO: 348514 - DNA, 25 bp, Rattus norvegicus
gaggctggacagatattgtattcta

SEQ ID NO: 348515 - DNA, 25 bp, Rattus norvegicus
gaggctggacagttattgtattcta

SEQ ID NO: 348516 - DNA, 25 bp, Rattus norvegicus
gaggctggactaatatatttattta

SEQ ID NO: 348517 - DNA, 25 bp, Rattus norvegicus
gaggctggactattatatttattta

SEQ ID NO: 348518 - DNA, 25 bp, Rattus norvegicus
gaggctggagtcatcgacattcatc

SEQ ID NO: 348519 - DNA, 25 bp, Rattus norvegicus
gaggctggagtcttcgacattcatc

SEQ ID NO: 348520 - DNA, 25 bp, Rattus norvegicus
gaggctggcagaagttaccttgtgt

SEQ ID NO: 348521 - DNA, 25 bp, Rattus norvegicus
gaggctggcagatgttaccttgtgt

SEQ ID NO: 348522 - DNA, 25 bp, Rattus norvegicus
gaggctggcggtaatcagaaaccat

SEQ ID NO: 348523 - DNA, 25 bp, Rattus norvegicus
gaggctggcggttatcagaaaccat

SEQ ID NO: 348524 - DNA, 25 bp, Rattus norvegicus
gaggctggctccagtcaggttcttc

SEQ ID NO: 348525 - DNA, 25 bp, Rattus norvegicus
gaggctggctcctgtcaggttcttc

SEQ ID NO: 348526 - DNA, 25 bp, Rattus norvegicus
gaggctgggatcagaagtctctcct

SEQ ID NO: 348527 - DNA, 25 bp, Rattus norvegicus
gaggctgggatctgaagtctctcct

SEQ ID NO: 348528 - DNA, 25 bp, Rattus norvegicus
gaggctgggcacagcggaaaccata

SEQ ID NO: 348529 - DNA, 25 bp, Rattus norvegicus
gaggctgggcactgcggaaaccata

SEQ ID NO: 348530 - DNA, 25 bp, Rattus norvegicus
gaggctgggccacactggttataca

SEQ ID NO: 348531 - DNA, 25 bp, Rattus norvegicus
gaggctgggccagactggttataca

SEQ ID NO: 348532 - DNA, 25 bp, Rattus norvegicus
gaggctgggtacaccatcgagcagt

SEQ ID NO: 348533 - DNA, 25 bp, Rattus norvegicus
gaggctgggtactccatcgagcagt

SEQ ID NO: 348534 - DNA, 25 bp, Rattus norvegicus
gaggctggtaagcttagccctcttt

SEQ ID NO: 348535 - DNA, 25 bp, Rattus norvegicus
gaggctggtaaggttagccctcttt

SEQ ID NO: 348536 - DNA, 25 bp, Rattus norvegicus
gaggctggtcttaaataacaacaaa

SEQ ID NO: 348537 - DNA, 25 bp, Rattus norvegicus
gaggctggtctttaataacaacaaa

SEQ ID NO: 348538 - DNA, 25 bp, Rattus norvegicus
gaggctggtgggagtgcggcagacc

SEQ ID NO: 348539 - DNA, 25 bp, Rattus norvegicus
gaggctggtgggtgtgcggcagacc

SEQ ID NO: 348540 - DNA, 25 bp, Rattus norvegicus
gaggctggtggtcaccactcagaac

SEQ ID NO: 348541 - DNA, 25 bp, Rattus norvegicus
gaggctggtggtgaccactcagaac

SEQ ID NO: 348542 - DNA, 25 bp, Rattus norvegicus
gaggctggtgtcaatgtcctgcgct

SEQ ID NO: 348543 - DNA, 25 bp, Rattus norvegicus
gaggctggtgtctatgtcctgcgct

SEQ ID NO: 348544 - DNA, 25 bp, Rattus norvegicus
gaggctggtgttatgcatctgttct

SEQ ID NO: 348545 - DNA, 25 bp, Rattus norvegicus
gaggctggtgttttgcatctgttct

SEQ ID NO: 348546 - DNA, 25 bp, Rattus norvegicus
gaggctgtaagcagggacctcagct

SEQ ID NO: 348547 - DNA, 25 bp, Rattus norvegicus
gaggctgtaagctgggacctcagct

SEQ ID NO: 348548 - DNA, 25 bp, Rattus norvegicus
gaggctgtacagaagtgtccccata

SEQ ID NO: 348549 - DNA, 25 bp, Rattus norvegicus
gaggctgtacagtagtgtccccata

SEQ ID NO: 348550 - DNA, 25 bp, Rattus norvegicus
gaggctgtacctatttgttattttt

SEQ ID NO: 348551 - DNA, 25 bp, Rattus norvegicus
gaggctgtacctttttgttattttt

SEQ ID NO: 348552 - DNA, 25 bp, Rattus norvegicus
gaggctgtacgtacatctacagaaa

SEQ ID NO: 348553 - DNA, 25 bp, Rattus norvegicus
gaggctgtacgttcatctacagaaa

SEQ ID NO: 348554 - DNA, 25 bp, Rattus norvegicus
gaggctgtactgacaaagccaacct

SEQ ID NO: 348555 - DNA, 25 bp, Rattus norvegicus
gaggctgtactgattgtctcagtga

SEQ ID NO: 348556 - DNA, 25 bp, Rattus norvegicus
gaggctgtactgtcaaagccaacct

SEQ ID NO: 348557 - DNA, 25 bp, Rattus norvegicus
gaggctgtactgtttgtctcagtga

SEQ ID NO: 348558 - DNA, 25 bp, Rattus norvegicus
gaggctgtatgcactcagaacacgg

SEQ ID NO: 348559 - DNA, 25 bp, Rattus norvegicus
gaggctgtatgctctcagaacacgg

SEQ ID NO: 348560 - DNA, 25 bp, Rattus norvegicus
gaggctgtattgagctatgtttaaa

SEQ ID NO: 348561 - DNA, 25 bp, Rattus norvegicus
gaggctgtattgtgctatgtttaaa

SEQ ID NO: 348562 - DNA, 25 bp, Rattus norvegicus
gaggctgtcaaaaccaactactgca

SEQ ID NO: 348563 - DNA, 25 bp, Rattus norvegicus
gaggctgtcaaacggcttcgaaaac

SEQ ID NO: 348564 - DNA, 25 bp, Rattus norvegicus
gaggctgtcaaagggcttcgaaaac

SEQ ID NO: 348565 - DNA, 25 bp, Rattus norvegicus
gaggctgtcaaatccaactactgca

SEQ ID NO: 348566 - DNA, 25 bp, Rattus norvegicus
gaggctgtccagacctttaacattg

SEQ ID NO: 348567 - DNA, 25 bp, Rattus norvegicus
gaggctgtccagtcctttaacattg

SEQ ID NO: 348568 - DNA, 25 bp, Rattus norvegicus
gaggctgtctcaattgggcagtcct

SEQ ID NO: 348569 - DNA, 25 bp, Rattus norvegicus
gaggctgtctcatttgggcagtcct

SEQ ID NO: 348570 - DNA, 25 bp, Rattus norvegicus
gaggctgtctttctaacactttgta

SEQ ID NO: 348571 - DNA, 25 bp, Rattus norvegicus
gaggctgtctttgtaacactttgta

SEQ ID NO: 348572 - DNA, 25 bp, Rattus norvegicus
gaggctgtgactcacactctcgctc

SEQ ID NO: 348573 - DNA, 25 bp, Rattus norvegicus
gaggctgtgactcctatcgagaagt

SEQ ID NO: 348574 - DNA, 25 bp, Rattus norvegicus
gaggctgtgactgacactctcgctc

SEQ ID NO: 348575 - DNA, 25 bp, Rattus norvegicus
gaggctgtgactgctatcgagaagt

SEQ ID NO: 348576 - DNA, 25 bp, Rattus norvegicus
gaggctgtgagtatctgtcaggcac

SEQ ID NO: 348577 - DNA, 25 bp, Rattus norvegicus
gaggctgtgagtttctgtcaggcac

SEQ ID NO: 348578 - DNA, 25 bp, Rattus norvegicus
gaggctgtgcctatgactttaaaat

SEQ ID NO: 348579 - DNA, 25 bp, Rattus norvegicus
gaggctgtgcctttgactttaaaat

SEQ ID NO: 348580 - DNA, 25 bp, Rattus norvegicus
gaggctgtgctcctaacaggaacct

SEQ ID NO: 348581 - DNA, 25 bp, Rattus norvegicus
gaggctgtgctcgtaacaggaacct

SEQ ID NO: 348582 - DNA, 25 bp, Rattus norvegicus
gaggctgtgcttatctccgaaggcc

SEQ ID NO: 348583 - DNA, 25 bp, Rattus norvegicus
gaggctgtgcttttctccgaaggcc

SEQ ID NO: 348584 - DNA, 25 bp, Rattus norvegicus
gaggctgtgtaaagaccattggaga

SEQ ID NO: 348585 - DNA, 25 bp, Rattus norvegicus
gaggctgtgtaatgaccattggaga

SEQ ID NO: 348586 - DNA, 25 bp, Rattus norvegicus
gaggctgtgtatcagctcaccaaga

SEQ ID NO: 348587 - DNA, 25 bp, Rattus norvegicus
gaggctgtgtatgagctcaccaaga

SEQ ID NO: 348588 - DNA, 25 bp, Rattus norvegicus
gaggctgtgtctatgtatgttgtac

SEQ ID NO: 348589 - DNA, 25 bp, Rattus norvegicus
gaggctgtgtctttgtatgttgtac

SEQ ID NO: 348590 - DNA, 25 bp, Rattus norvegicus
gaggctgtgtttcaagtgtctgaca

SEQ ID NO: 348591 - DNA, 25 bp, Rattus norvegicus
gaggctgtgtttgaagtgtctgaca

SEQ ID NO: 348592 - DNA, 25 bp, Rattus norvegicus
gaggctgttgaaaggagtcccttcc

SEQ ID NO: 348593 - DNA, 25 bp, Rattus norvegicus
gaggctgttgaatggagtcccttcc

SEQ ID NO: 348594 - DNA, 25 bp, Rattus norvegicus
gaggctgttgtgcttcttattttga

SEQ ID NO: 348595 - DNA, 25 bp, Rattus norvegicus
gaggctgttgtggttcttattttga

SEQ ID NO: 348596 - DNA, 25 bp, Rattus norvegicus
gaggctgtttacagactccggcaac

SEQ ID NO: 348597 - DNA, 25 bp, Rattus norvegicus
gaggctgtttactgactccggcaac

SEQ ID NO: 348598 - DNA, 25 bp, Rattus norvegicus
gaggctgtttcactaacagtgcaga

SEQ ID NO: 348599 - DNA, 25 bp, Rattus norvegicus
gaggctgtttcagtaacagtgcaga

SEQ ID NO: 348600 - DNA, 25 bp, Rattus norvegicus
gaggctgtttccaacattcaggaga

SEQ ID NO: 348601 - DNA, 25 bp, Rattus norvegicus
gaggctgtttcctacattcaggaga

SEQ ID NO: 348602 - DNA, 25 bp, Rattus norvegicus
gaggcttaaaccaacagacggtgta

SEQ ID NO: 348603 - DNA, 25 bp, Rattus norvegicus
gaggcttaaacctacagacggtgta

SEQ ID NO: 348604 - DNA, 25 bp, Rattus norvegicus
gaggcttaacctaaacgccacacac

SEQ ID NO: 348605 - DNA, 25 bp, Rattus norvegicus
gaggcttaaccttaacgccacacac

SEQ ID NO: 348606 - DNA, 25 bp, Rattus norvegicus
gaggcttaactgctatttcttgtat

SEQ ID NO: 348607 - DNA, 25 bp, Rattus norvegicus
gaggcttaactgctgtcataaaatt

SEQ ID NO: 348608 - DNA, 25 bp, Rattus norvegicus
gaggcttaactggtatttcttgtat

SEQ ID NO: 348609 - DNA, 25 bp, Rattus norvegicus
gaggcttaactggtgtcataaaatt

SEQ ID NO: 348610 - DNA, 25 bp, Rattus norvegicus
gaggcttaagtacctgtcccactag

SEQ ID NO: 348611 - DNA, 25 bp, Rattus norvegicus
gaggcttaagtagctgtcccactag

SEQ ID NO: 348612 - DNA, 25 bp, Rattus norvegicus
gaggcttaagtgattttctgactat

SEQ ID NO: 348613 - DNA, 25 bp, Rattus norvegicus
gaggcttaagtgtttttctgactat

SEQ ID NO: 348614 - DNA, 25 bp, Rattus norvegicus
gaggcttactaaccagtgtgtcacc

SEQ ID NO: 348615 - DNA, 25 bp, Rattus norvegicus
gaggcttactaagcagtgtgtcacc

SEQ ID NO: 348616 - DNA, 25 bp, Rattus norvegicus
gaggcttactcactaatcttctgaa

SEQ ID NO: 348617 - DNA, 25 bp, Rattus norvegicus
gaggcttactcagtaatcttctgaa

SEQ ID NO: 348618 - DNA, 25 bp, Rattus norvegicus
gaggcttacttaacagctgtttgca

SEQ ID NO: 348619 - DNA, 25 bp, Rattus norvegicus
gaggcttacttatcagctgtttgca

SEQ ID NO: 348620 - DNA, 25 bp, Rattus norvegicus
gaggcttactttcatcttcactgat

SEQ ID NO: 348621 - DNA, 25 bp, Rattus norvegicus
gaggcttactttgatcttcactgat

SEQ ID NO: 348622 - DNA, 25 bp, Rattus norvegicus
gaggcttagaatcccaagatcctat

SEQ ID NO: 348623 - DNA, 25 bp, Rattus norvegicus
gaggcttagaatgccaagatcctat

SEQ ID NO: 348624 - DNA, 25 bp, Rattus norvegicus
gaggcttagatgcaccagtcagtct

SEQ ID NO: 348625 - DNA, 25 bp, Rattus norvegicus
gaggcttagatggaccagtcagtct

SEQ ID NO: 348626 - DNA, 25 bp, Rattus norvegicus
gaggcttagccactagcacagcaga

SEQ ID NO: 348627 - DNA, 25 bp, Rattus norvegicus
gaggcttagccagtagcacagcaga

SEQ ID NO: 348628 - DNA, 25 bp, Rattus norvegicus
gaggcttagcctcttgagattgaag

SEQ ID NO: 348629 - DNA, 25 bp, Rattus norvegicus
gaggcttagcctgttgagattgaag

SEQ ID NO: 348630 - DNA, 25 bp, Rattus norvegicus
gaggcttagggactttgacttttat

SEQ ID NO: 348631 - DNA, 25 bp, Rattus norvegicus
gaggcttagggagtttgacttttat

SEQ ID NO: 348632 - DNA, 25 bp, Rattus norvegicus
gaggcttatagcagagaccttcctg

SEQ ID NO: 348633 - DNA, 25 bp, Rattus norvegicus
gaggcttatagctgagaccttcctg

SEQ ID NO: 348634 - DNA, 25 bp, Rattus norvegicus
gaggcttcaaggatatgtcaccgga

SEQ ID NO: 348635 - DNA, 25 bp, Rattus norvegicus
gaggcttcaaggttatgtcaccgga

SEQ ID NO: 348636 - DNA, 25 bp, Rattus norvegicus
gaggcttcacatcgaatcgtatctg

SEQ ID NO: 348637 - DNA, 25 bp, Rattus norvegicus
gaggcttcacatggaatcgtatctg

SEQ ID NO: 348638 - DNA, 25 bp, Rattus norvegicus
gaggcttcaccaaagaggtacttgt

SEQ ID NO: 348639 - DNA, 25 bp, Rattus norvegicus
gaggcttcaccatagaggtacttgt

SEQ ID NO: 348640 - DNA, 25 bp, Rattus norvegicus
gaggcttcagccaggcaaaacccaa

SEQ ID NO: 348641 - DNA, 25 bp, Rattus norvegicus
gaggcttcagcccatggttattcat

SEQ ID NO: 348642 - DNA, 25 bp, Rattus norvegicus
gaggcttcagccgatggttattcat

SEQ ID NO: 348643 - DNA, 25 bp, Rattus norvegicus
gaggcttcagcctggcaaaacccaa

SEQ ID NO: 348644 - DNA, 25 bp, Rattus norvegicus
gaggcttcagtacccgggttccagc

SEQ ID NO: 348645 - DNA, 25 bp, Rattus norvegicus
gaggcttcagtagccgggttccagc

SEQ ID NO: 348646 - DNA, 25 bp, Rattus norvegicus
gaggcttcagttcttagatcgcttt

SEQ ID NO: 348647 - DNA, 25 bp, Rattus norvegicus
gaggcttcagttgttagatcgcttt

SEQ ID NO: 348648 - DNA, 25 bp, Rattus norvegicus
gaggcttcatctcaacgccatgttc

SEQ ID NO: 348649 - DNA, 25 bp, Rattus norvegicus
gaggcttcatctgaacgccatgttc

SEQ ID NO: 348650 - DNA, 25 bp, Rattus norvegicus
gaggcttcatgaccgagcagctaat

SEQ ID NO: 348651 - DNA, 25 bp, Rattus norvegicus
gaggcttcatgagcgagcagctaat

SEQ ID NO: 348652 - DNA, 25 bp, Rattus norvegicus
gaggcttcatttcgagacacattca

SEQ ID NO: 348653 - DNA, 25 bp, Rattus norvegicus
gaggcttcatttggagacacattca

SEQ ID NO: 348654 - DNA, 25 bp, Rattus norvegicus
gaggcttccaacattgtggtcgatc

SEQ ID NO: 348655 - DNA, 25 bp, Rattus norvegicus
gaggcttccaactttgtggtcgatc

SEQ ID NO: 348656 - DNA, 25 bp, Rattus norvegicus
gaggcttcccacagatgtcaaccag

SEQ ID NO: 348657 - DNA, 25 bp, Rattus norvegicus
gaggcttcccactgatgtcaaccag

SEQ ID NO: 348658 - DNA, 25 bp, Rattus norvegicus
gaggcttccctactggcagcgagca

SEQ ID NO: 348659 - DNA, 25 bp, Rattus norvegicus
gaggcttccctagtggcagcgagca

SEQ ID NO: 348660 - DNA, 25 bp, Rattus norvegicus
gaggcttccgtaccacagccagtat

SEQ ID NO: 348661 - DNA, 25 bp, Rattus norvegicus
gaggcttccgtagcacagccagtat

SEQ ID NO: 348662 - DNA, 25 bp, Rattus norvegicus
gaggcttcctacagccatgctgttc

SEQ ID NO: 348663 - DNA, 25 bp, Rattus norvegicus
gaggcttcctactgccatgctgttc

SEQ ID NO: 348664 - DNA, 25 bp, Rattus norvegicus
gaggcttccttcaaagtctgttggc

SEQ ID NO: 348665 - DNA, 25 bp, Rattus norvegicus
gaggcttccttctaagtctgttggc

SEQ ID NO: 348666 - DNA, 25 bp, Rattus norvegicus
gaggcttcgaacacctaaacggtgt

SEQ ID NO: 348667 - DNA, 25 bp, Rattus norvegicus
gaggcttcgaactcctaaacggtgt

SEQ ID NO: 348668 - DNA, 25 bp, Rattus norvegicus
gaggcttcgggtatgtcacctttga

SEQ ID NO: 348669 - DNA, 25 bp, Rattus norvegicus
gaggcttcgggtttgtcacctttga

SEQ ID NO: 348670 - DNA, 25 bp, Rattus norvegicus
gaggcttcgtgaagacttcttttcc

SEQ ID NO: 348671 - DNA, 25 bp, Rattus norvegicus
gaggcttcgtgatgacttcttttcc

SEQ ID NO: 348672 - DNA, 25 bp, Rattus norvegicus
gaggcttctaagaccgtacgtaatg

SEQ ID NO: 348673 - DNA, 25 bp, Rattus norvegicus
gaggcttctaagtccgtacgtaatg

SEQ ID NO: 348674 - DNA, 25 bp, Rattus norvegicus
gaggcttctagaactgttggcagca

SEQ ID NO: 348675 - DNA, 25 bp, Rattus norvegicus
gaggcttctagatctgttggcagca

SEQ ID NO: 348676 - DNA, 25 bp, Rattus norvegicus
gaggcttctagtactgaagatgcaa

SEQ ID NO: 348677 - DNA, 25 bp, Rattus norvegicus
gaggcttctagttctgaagatgcaa

SEQ ID NO: 348678 - DNA, 25 bp, Rattus norvegicus
gaggcttctcagaagtcactgtttg

SEQ ID NO: 348679 - DNA, 25 bp, Rattus norvegicus
gaggcttctcagtagtcactgtttg

SEQ ID NO: 348680 - DNA, 25 bp, Rattus norvegicus
gaggcttctgggactctaattcaaa

SEQ ID NO: 348681 - DNA, 25 bp, Rattus norvegicus
gaggcttctgggtctctaattcaaa

SEQ ID NO: 348682 - DNA, 25 bp, Rattus norvegicus
gaggcttcttatcaccatgatgcag

SEQ ID NO: 348683 - DNA, 25 bp, Rattus norvegicus
gaggcttcttatgaccatgatgcag

SEQ ID NO: 348684 - DNA, 25 bp, Rattus norvegicus
gaggcttcttggaggaaatggatct

SEQ ID NO: 348685 - DNA, 25 bp, Rattus norvegicus
gaggcttcttggtggaaatggatct

SEQ ID NO: 348686 - DNA, 25 bp, Rattus norvegicus
gaggcttctttaaattacgttgcaa

SEQ ID NO: 348687 - DNA, 25 bp, Rattus norvegicus
gaggcttctttatattacgttgcaa

SEQ ID NO: 348688 - DNA, 25 bp, Rattus norvegicus
gaggcttgaaaacccctccttcgtg

SEQ ID NO: 348689 - DNA, 25 bp, Rattus norvegicus
gaggcttgaaaagccctccttcgtg

SEQ ID NO: 348690 - DNA, 25 bp, Rattus norvegicus
gaggcttgagctcactgctttagaa

SEQ ID NO: 348691 - DNA, 25 bp, Rattus norvegicus
gaggcttgagctgactgctttagaa

SEQ ID NO: 348692 - DNA, 25 bp, Rattus norvegicus
gaggcttgcataattactatgtatt

SEQ ID NO: 348693 - DNA, 25 bp, Rattus norvegicus
gaggcttgcatatttactatgtatt

SEQ ID NO: 348694 - DNA, 25 bp, Rattus norvegicus
gaggcttgcatcatgtactttctag

SEQ ID NO: 348695 - DNA, 25 bp, Rattus norvegicus
gaggcttgcatcttgtactttctag

SEQ ID NO: 348696 - DNA, 25 bp, Rattus norvegicus
gaggcttgggctaacgtgatcatgt

SEQ ID NO: 348697 - DNA, 25 bp, Rattus norvegicus
gaggcttgggcttacgtgatcatgt

SEQ ID NO: 348698 - DNA, 25 bp, Rattus norvegicus
gaggcttggtgcagacttctccact

SEQ ID NO: 348699 - DNA, 25 bp, Rattus norvegicus
gaggcttggtgctgacttctccact

SEQ ID NO: 348700 - DNA, 25 bp, Rattus norvegicus
gaggcttgtcaaagccaacactgtg

SEQ ID NO: 348701 - DNA, 25 bp, Rattus norvegicus
gaggcttgtcaatgccaacactgtg

SEQ ID NO: 348702 - DNA, 25 bp, Rattus norvegicus
gaggcttgtcataagctctggcgcc

SEQ ID NO: 348703 - DNA, 25 bp, Rattus norvegicus
gaggcttgtcattagctctggcgcc

SEQ ID NO: 348704 - DNA, 25 bp, Rattus norvegicus
gaggcttgtgagaaccaggctagat

SEQ ID NO: 348705 - DNA, 25 bp, Rattus norvegicus
gaggcttgtgagtaccaggctagat

SEQ ID NO: 348706 - DNA, 25 bp, Rattus norvegicus
gaggcttgtgccctgcagacctgcc

SEQ ID NO: 348707 - DNA, 25 bp, Rattus norvegicus
gaggcttgtgccgtgcagacctgcc

SEQ ID NO: 348708 - DNA, 25 bp, Rattus norvegicus
gaggcttgtttaccgccagacctgg

SEQ ID NO: 348709 - DNA, 25 bp, Rattus norvegicus
gaggcttgtttagcgccagacctgg

SEQ ID NO: 348710 - DNA, 25 bp, Rattus norvegicus
gaggctttactcagagttacctaat

SEQ ID NO: 348711 - DNA, 25 bp, Rattus norvegicus
gaggctttactctgagttacctaat

SEQ ID NO: 348712 - DNA, 25 bp, Rattus norvegicus
gaggctttagctatttaggtcactt

SEQ ID NO: 348713 - DNA, 25 bp, Rattus norvegicus
gaggctttagctttttaggtcactt

SEQ ID NO: 348714 - DNA, 25 bp, Rattus norvegicus
gaggctttatggattgttctgtatt

SEQ ID NO: 348715 - DNA, 25 bp, Rattus norvegicus
gaggctttatggtttgttctgtatt

SEQ ID NO: 348716 - DNA, 25 bp, Rattus norvegicus
gaggctttattacagctggtttcca

SEQ ID NO: 348717 - DNA, 25 bp, Rattus norvegicus
gaggctttattagagctggtttcca

SEQ ID NO: 348718 - DNA, 25 bp, Rattus norvegicus
gaggctttcacaccttggactggat

SEQ ID NO: 348719 - DNA, 25 bp, Rattus norvegicus
gaggctttcacagcttggactggat

SEQ ID NO: 348720 - DNA, 25 bp, Rattus norvegicus
gaggctttcaccattctgtgctaat

SEQ ID NO: 348721 - DNA, 25 bp, Rattus norvegicus
gaggctttcacctttctgtgctaat

SEQ ID NO: 348722 - DNA, 25 bp, Rattus norvegicus
gaggctttcatacttcagatgtcat

SEQ ID NO: 348723 - DNA, 25 bp, Rattus norvegicus
gaggctttcatagttcagatgtcat

SEQ ID NO: 348724 - DNA, 25 bp, Rattus norvegicus
gaggctttccagctgtttgaccgaa

SEQ ID NO: 348725 - DNA, 25 bp, Rattus norvegicus
gaggctttccaggtgtttgaccgaa

SEQ ID NO: 348726 - DNA, 25 bp, Rattus norvegicus
gaggctttccatcacccaggagaga

SEQ ID NO: 348727 - DNA, 25 bp, Rattus norvegicus
gaggctttccatgacccaggagaga

SEQ ID NO: 348728 - DNA, 25 bp, Rattus norvegicus
gaggctttcctgctcaagcttgtgc

SEQ ID NO: 348729 - DNA, 25 bp, Rattus norvegicus
gaggctttcctggtcaagcttgtgc

SEQ ID NO: 348730 - DNA, 25 bp, Rattus norvegicus
gaggctttcggaagatccttgggca

SEQ ID NO: 348731 - DNA, 25 bp, Rattus norvegicus
gaggctttcggatgatccttgggca

SEQ ID NO: 348732 - DNA, 25 bp, Rattus norvegicus
gaggctttcgtaataggaggctttt

SEQ ID NO: 348733 - DNA, 25 bp, Rattus norvegicus
gaggctttcgtattaggaggctttt

SEQ ID NO: 348734 - DNA, 25 bp, Rattus norvegicus
gaggctttctctcacagcatggcaa

SEQ ID NO: 348735 - DNA, 25 bp, Rattus norvegicus
gaggctttctctgacagcatggcaa

SEQ ID NO: 348736 - DNA, 25 bp, Rattus norvegicus
gaggctttgagcagacaatcttgaa

SEQ ID NO: 348737 - DNA, 25 bp, Rattus norvegicus
gaggctttgagctgacaatcttgaa

SEQ ID NO: 348738 - DNA, 25 bp, Rattus norvegicus
gaggctttggctagtgatgctgata

SEQ ID NO: 348739 - DNA, 25 bp, Rattus norvegicus
gaggctttggctcgactcagttaca

SEQ ID NO: 348740 - DNA, 25 bp, Rattus norvegicus
gaggctttggctggactcagttaca

SEQ ID NO: 348741 - DNA, 25 bp, Rattus norvegicus
gaggctttggcttgtgatgctgata

SEQ ID NO: 348742 - DNA, 25 bp, Rattus norvegicus
gaggctttgtatattataaccgcac

SEQ ID NO: 348743 - DNA, 25 bp, Rattus norvegicus
gaggctttgtattttataaccgcac

SEQ ID NO: 348744 - DNA, 25 bp, Rattus norvegicus
gaggctttgtgtccaggactgccca

SEQ ID NO: 348745 - DNA, 25 bp, Rattus norvegicus
gaggctttgtgtgcaggactgccca

SEQ ID NO: 348746 - DNA, 25 bp, Rattus norvegicus
gaggcttttcacaaagcactcccac

SEQ ID NO: 348747 - DNA, 25 bp, Rattus norvegicus
gaggcttttcaccaacttctcaggg

SEQ ID NO: 348748 - DNA, 25 bp, Rattus norvegicus
gaggcttttcacgaacttctcaggg

SEQ ID NO: 348749 - DNA, 25 bp, Rattus norvegicus
gaggcttttcactaagcactcccac

SEQ ID NO: 348750 - DNA, 25 bp, Rattus norvegicus
gaggcttttgccatctttggaacaa

SEQ ID NO: 348751 - DNA, 25 bp, Rattus norvegicus
gaggcttttgccttctttggaacaa

SEQ ID NO: 348752 - DNA, 25 bp, Rattus norvegicus
gaggcttttgttattctcaagattt

SEQ ID NO: 348753 - DNA, 25 bp, Rattus norvegicus
gaggcttttgtttttctcaagattt

SEQ ID NO: 348754 - DNA, 25 bp, Rattus norvegicus
gagggaaaacgcacaagttctactg

SEQ ID NO: 348755 - DNA, 25 bp, Rattus norvegicus
gagggaaaacgctcaagttctactg

SEQ ID NO: 348756 - DNA, 25 bp, Rattus norvegicus
gagggaaaaggcacatacacaacat

SEQ ID NO: 348757 - DNA, 25 bp, Rattus norvegicus
gagggaaaaggctcatacacaacat

SEQ ID NO: 348758 - DNA, 25 bp, Rattus norvegicus
gagggaaacccaccctctacaagca

SEQ ID NO: 348759 - DNA, 25 bp, Rattus norvegicus
gagggaaacccagcctctacaagca

SEQ ID NO: 348760 - DNA, 25 bp, Rattus norvegicus
gagggaaactaaacttactgctaag

SEQ ID NO: 348761 - DNA, 25 bp, Rattus norvegicus
gagggaaactaatcttactgctaag

SEQ ID NO: 348762 - DNA, 25 bp, Rattus norvegicus
gagggaaactaccacctagaaagca

SEQ ID NO: 348763 - DNA, 25 bp, Rattus norvegicus
gagggaaactacgacctagaaagca

SEQ ID NO: 348764 - DNA, 25 bp, Rattus norvegicus
gagggaaactctaacgcatttgaat

SEQ ID NO: 348765 - DNA, 25 bp, Rattus norvegicus
gagggaaactctagcactttatctc

SEQ ID NO: 348766 - DNA, 25 bp, Rattus norvegicus
gagggaaactcttacgcatttgaat

SEQ ID NO: 348767 - DNA, 25 bp, Rattus norvegicus
gagggaaactcttgcactttatctc

SEQ ID NO: 348768 - DNA, 25 bp, Rattus norvegicus
gagggaaagactcgcagcacgcaca

SEQ ID NO: 348769 - DNA, 25 bp, Rattus norvegicus
gagggaaagactggcagcacgcaca

SEQ ID NO: 348770 - DNA, 25 bp, Rattus norvegicus
gagggaaagccactgctccagagac

SEQ ID NO: 348771 - DNA, 25 bp, Rattus norvegicus
gagggaaagccagtgctccagagac

SEQ ID NO: 348772 - DNA, 25 bp, Rattus norvegicus
gagggaaagctgcaacctgcacttc

SEQ ID NO: 348773 - DNA, 25 bp, Rattus norvegicus
gagggaaagctggaacctgcacttc

SEQ ID NO: 348774 - DNA, 25 bp, Rattus norvegicus
gagggaaagtagatctcccgcccac

SEQ ID NO: 348775 - DNA, 25 bp, Rattus norvegicus
gagggaaagtagttctcccgcccac

SEQ ID NO: 348776 - DNA, 25 bp, Rattus norvegicus
gagggaaagttgctccagctcagcc

SEQ ID NO: 348777 - DNA, 25 bp, Rattus norvegicus
gagggaaagttggtccagctcagcc

SEQ ID NO: 348778 - DNA, 25 bp, Rattus norvegicus
gagggaaatctactccaatgaattg

SEQ ID NO: 348779 - DNA, 25 bp, Rattus norvegicus
gagggaaatctagtccaatgaattg

SEQ ID NO: 348780 - DNA, 25 bp, Rattus norvegicus
gagggaaatttcctttctcggaatg

SEQ ID NO: 348781 - DNA, 25 bp, Rattus norvegicus
gagggaaatttcgtttctcggaatg

SEQ ID NO: 348782 - DNA, 25 bp, Rattus norvegicus
gagggaacagcaagatgctccttaa

SEQ ID NO: 348783 - DNA, 25 bp, Rattus norvegicus
gagggaacagcatgatgctccttaa

SEQ ID NO: 348784 - DNA, 25 bp, Rattus norvegicus
gagggaacagccagctccgctctga

SEQ ID NO: 348785 - DNA, 25 bp, Rattus norvegicus
gagggaacagcctgctccgctctga

SEQ ID NO: 348786 - DNA, 25 bp, Rattus norvegicus
gagggaaccacaacagcgactgaat

SEQ ID NO: 348787 - DNA, 25 bp, Rattus norvegicus
gagggaaccacatcagcgactgaat

SEQ ID NO: 348788 - DNA, 25 bp, Rattus norvegicus
gagggaaccctgcagctccgacaag

SEQ ID NO: 348789 - DNA, 25 bp, Rattus norvegicus
gagggaaccctggagctccgacaag

SEQ ID NO: 348790 - DNA, 25 bp, Rattus norvegicus
gagggaacctgaactcttctcagta

SEQ ID NO: 348791 - DNA, 25 bp, Rattus norvegicus
gagggaacctgatctcttctcagta

SEQ ID NO: 348792 - DNA, 25 bp, Rattus norvegicus
gagggaaccttgctgcttccattaa

SEQ ID NO: 348793 - DNA, 25 bp, Rattus norvegicus
gagggaaccttggtgcttccattaa

SEQ ID NO: 348794 - DNA, 25 bp, Rattus norvegicus
gagggaactcaacgcagcaggcaac

SEQ ID NO: 348795 - DNA, 25 bp, Rattus norvegicus
gagggaactcaaggcagcaggcaac

SEQ ID NO: 348796 - DNA, 25 bp, Rattus norvegicus
gagggaactcacatccgagtgaact

SEQ ID NO: 348797 - DNA, 25 bp, Rattus norvegicus
gagggaactcacttccgagtgaact

SEQ ID NO: 348798 - DNA, 25 bp, Rattus norvegicus
gagggaactccaagcgtgccagtgt

SEQ ID NO: 348799 - DNA, 25 bp, Rattus norvegicus
gagggaactccatgcgtgccagtgt

SEQ ID NO: 348800 - DNA, 25 bp, Rattus norvegicus
gagggaactctcatgctgctagcca

SEQ ID NO: 348801 - DNA, 25 bp, Rattus norvegicus
gagggaactctcttgctgctagcca

SEQ ID NO: 348802 - DNA, 25 bp, Rattus norvegicus
gagggaactctgattctgtttgcct

SEQ ID NO: 348803 - DNA, 25 bp, Rattus norvegicus
gagggaactctgtttctgtttgcct

SEQ ID NO: 348804 - DNA, 25 bp, Rattus norvegicus
gagggaactgacaagccattgcttc

SEQ ID NO: 348805 - DNA, 25 bp, Rattus norvegicus
gagggaactgactagccattgcttc

SEQ ID NO: 348806 - DNA, 25 bp, Rattus norvegicus
gagggaactttcacatattttcaca

SEQ ID NO: 348807 - DNA, 25 bp, Rattus norvegicus
gagggaactttctcatattttcaca

SEQ ID NO: 348808 - DNA, 25 bp, Rattus norvegicus
gagggaagaaggacccttgcagtcc

SEQ ID NO: 348809 - DNA, 25 bp, Rattus norvegicus
gagggaagaaggtcccttgcagtcc

SEQ ID NO: 348810 - DNA, 25 bp, Rattus norvegicus
gagggaagaatcaggacatagtcac

SEQ ID NO: 348811 - DNA, 25 bp, Rattus norvegicus
gagggaagaatctggacatagtcac

SEQ ID NO: 348812 - DNA, 25 bp, Rattus norvegicus
gagggaagaccaagacctccagcta

SEQ ID NO: 348813 - DNA, 25 bp, Rattus norvegicus
gagggaagaccatgacctccagcta

SEQ ID NO: 348814 - DNA, 25 bp, Rattus norvegicus
gagggaagactgactgtaatatgca

SEQ ID NO: 348815 - DNA, 25 bp, Rattus norvegicus
gagggaagactgtctgtaatatgca

SEQ ID NO: 348816 - DNA, 25 bp, Rattus norvegicus
gagggaagagccatccccgacctga

SEQ ID NO: 348817 - DNA, 25 bp, Rattus norvegicus
gagggaagagcccttcagacctaat

SEQ ID NO: 348818 - DNA, 25 bp, Rattus norvegicus
gagggaagagccgttcagacctaat

SEQ ID NO: 348819 - DNA, 25 bp, Rattus norvegicus
gagggaagagccttccccgacctga

SEQ ID NO: 348820 - DNA, 25 bp, Rattus norvegicus
gagggaagcaccagagttcaaccca

SEQ ID NO: 348821 - DNA, 25 bp, Rattus norvegicus
gagggaagcacctgagttcaaccca

SEQ ID NO: 348822 - DNA, 25 bp, Rattus norvegicus
gagggaagcccaagctgttcttcat

SEQ ID NO: 348823 - DNA, 25 bp, Rattus norvegicus
gagggaagcccatgctgttcttcat

SEQ ID NO: 348824 - DNA, 25 bp, Rattus norvegicus
gagggaagccctctcaggaaagcat

SEQ ID NO: 348825 - DNA, 25 bp, Rattus norvegicus
gagggaagccctgtcaggaaagcat

SEQ ID NO: 348826 - DNA, 25 bp, Rattus norvegicus
gagggaagcctcactgtatggccca

SEQ ID NO: 348827 - DNA, 25 bp, Rattus norvegicus
gagggaagcctctctgtatggccca

SEQ ID NO: 348828 - DNA, 25 bp, Rattus norvegicus
gagggaagcctgaccagacccaaga

SEQ ID NO: 348829 - DNA, 25 bp, Rattus norvegicus
gagggaagcctgtccagacccaaga

SEQ ID NO: 348830 - DNA, 25 bp, Rattus norvegicus
gagggaagccttaactctcctggaa

SEQ ID NO: 348831 - DNA, 25 bp, Rattus norvegicus
gagggaagcctttactctcctggaa

SEQ ID NO: 348832 - DNA, 25 bp, Rattus norvegicus
gagggaagcttgacactcttcggga

SEQ ID NO: 348833 - DNA, 25 bp, Rattus norvegicus
gagggaagcttgtcactcttcggga

SEQ ID NO: 348834 - DNA, 25 bp, Rattus norvegicus
gagggaaggcgacaagactcccctt

SEQ ID NO: 348835 - DNA, 25 bp, Rattus norvegicus
gagggaaggcgagaagactcccctt

SEQ ID NO: 348836 - DNA, 25 bp, Rattus norvegicus
gagggaaggctgaccccactccact

SEQ ID NO: 348837 - DNA, 25 bp, Rattus norvegicus
gagggaaggctgtccccactccact

SEQ ID NO: 348838 - DNA, 25 bp, Rattus norvegicus
gagggaagggctagtgttcaaacac

SEQ ID NO: 348839 - DNA, 25 bp, Rattus norvegicus
gagggaagggcttgtgttcaaacac

SEQ ID NO: 348840 - DNA, 25 bp, Rattus norvegicus
gagggaagtagcacgtttcgcccag

SEQ ID NO: 348841 - DNA, 25 bp, Rattus norvegicus
gagggaagtagctcgtttcgcccag

SEQ ID NO: 348842 - DNA, 25 bp, Rattus norvegicus
gagggaagtcctacgttgcttctca

SEQ ID NO: 348843 - DNA, 25 bp, Rattus norvegicus
gagggaagtccttcgttgcttctca

SEQ ID NO: 348844 - DNA, 25 bp, Rattus norvegicus
gagggaagtcgaatcttttagcaat

SEQ ID NO: 348845 - DNA, 25 bp, Rattus norvegicus
gagggaagtcgattcttttagcaat

SEQ ID NO: 348846 - DNA, 25 bp, Rattus norvegicus
gagggaagtctacacccatgctggt

SEQ ID NO: 348847 - DNA, 25 bp, Rattus norvegicus
gagggaagtctagacccatgctggt

SEQ ID NO: 348848 - DNA, 25 bp, Rattus norvegicus
gagggaagttctatttcccatcttg

SEQ ID NO: 348849 - DNA, 25 bp, Rattus norvegicus
gagggaagttctttttcccatcttg

SEQ ID NO: 348850 - DNA, 25 bp, Rattus norvegicus
gagggaagtttccacacctggcctg

SEQ ID NO: 348851 - DNA, 25 bp, Rattus norvegicus
gagggaagtttcgacacctggcctg

SEQ ID NO: 348852 - DNA, 25 bp, Rattus norvegicus
gagggaataaaaactcctggaactg

SEQ ID NO: 348853 - DNA, 25 bp, Rattus norvegicus
gagggaataaaatctcctggaactg

SEQ ID NO: 348854 - DNA, 25 bp, Rattus norvegicus
gagggaatcacacagtcaaagtcaa

SEQ ID NO: 348855 - DNA, 25 bp, Rattus norvegicus
gagggaatcacagagtcaaagtcaa

SEQ ID NO: 348856 - DNA, 25 bp, Rattus norvegicus
gagggaatcactaagccccaagtcc

SEQ ID NO: 348857 - DNA, 25 bp, Rattus norvegicus
gagggaatcacttagccccaagtcc

SEQ ID NO: 348858 - DNA, 25 bp, Rattus norvegicus
gagggaatcctaatacgtaagacgg

SEQ ID NO: 348859 - DNA, 25 bp, Rattus norvegicus
gagggaatcctattacgtaagacgg

SEQ ID NO: 348860 - DNA, 25 bp, Rattus norvegicus
gagggaatgtttccatgtgtcagaa

SEQ ID NO: 348861 - DNA, 25 bp, Rattus norvegicus
gagggaatgtttgcatgtgtcagaa

SEQ ID NO: 348862 - DNA, 25 bp, Rattus norvegicus
gagggaattctaaaacctaaagcgg

SEQ ID NO: 348863 - DNA, 25 bp, Rattus norvegicus
gagggaattctataacctaaagcgg

SEQ ID NO: 348864 - DNA, 25 bp, Rattus norvegicus
gagggaattctcaacttgtttttgt

SEQ ID NO: 348865 - DNA, 25 bp, Rattus norvegicus
gagggaattctcacttcgacgcggt

SEQ ID NO: 348866 - DNA, 25 bp, Rattus norvegicus
gagggaattctctacttgtttttgt

SEQ ID NO: 348867 - DNA, 25 bp, Rattus norvegicus
gagggaattctctcttcgacgcggt

SEQ ID NO: 348868 - DNA, 25 bp, Rattus norvegicus
gagggacaaagcacatgttccgcca

SEQ ID NO: 348869 - DNA, 25 bp, Rattus norvegicus
gagggacaaagctcatgttccgcca

SEQ ID NO: 348870 - DNA, 25 bp, Rattus norvegicus
gagggacaacaaagcccggccgagc

SEQ ID NO: 348871 - DNA, 25 bp, Rattus norvegicus
gagggacaacaatgcccggccgagc

SEQ ID NO: 348872 - DNA, 25 bp, Rattus norvegicus
gagggacaacacagggtttctgaaa

SEQ ID NO: 348873 - DNA, 25 bp, Rattus norvegicus
gagggacaacactgggtttctgaaa

SEQ ID NO: 348874 - DNA, 25 bp, Rattus norvegicus
gagggacaaggacatatcctccctt

SEQ ID NO: 348875 - DNA, 25 bp, Rattus norvegicus
gagggacaaggagatatcctccctt

SEQ ID NO: 348876 - DNA, 25 bp, Rattus norvegicus
gagggacaagtaacactgagctcaa

SEQ ID NO: 348877 - DNA, 25 bp, Rattus norvegicus
gagggacaagtatcactgagctcaa

SEQ ID NO: 348878 - DNA, 25 bp, Rattus norvegicus
gagggacaatgaccaaaccacactt

SEQ ID NO: 348879 - DNA, 25 bp, Rattus norvegicus
gagggacaatgagcaaaccacactt

SEQ ID NO: 348880 - DNA, 25 bp, Rattus norvegicus
gagggacacactatagcagaatgta

SEQ ID NO: 348881 - DNA, 25 bp, Rattus norvegicus
gagggacacactttagcagaatgta

SEQ ID NO: 348882 - DNA, 25 bp, Rattus norvegicus
gagggacacaggacactgcaagtgt

SEQ ID NO: 348883 - DNA, 25 bp, Rattus norvegicus
gagggacacaggattctatggcttc

SEQ ID NO: 348884 - DNA, 25 bp, Rattus norvegicus
gagggacacaggtcactgcaagtgt

SEQ ID NO: 348885 - DNA, 25 bp, Rattus norvegicus
gagggacacaggtttctatggcttc

SEQ ID NO: 348886 - DNA, 25 bp, Rattus norvegicus
gagggacacctcctcagcggagaca

SEQ ID NO: 348887 - DNA, 25 bp, Rattus norvegicus
gagggacacctcgtcagcggagaca

SEQ ID NO: 348888 - DNA, 25 bp, Rattus norvegicus
gagggacactgtagcacttttacca

SEQ ID NO: 348889 - DNA, 25 bp, Rattus norvegicus
gagggacactgttgcacttttacca

SEQ ID NO: 348890 - DNA, 25 bp, Rattus norvegicus
gagggacagaaaagtctccgcgccc

SEQ ID NO: 348891 - DNA, 25 bp, Rattus norvegicus
gagggacagaaatgtctccgcgccc

SEQ ID NO: 348892 - DNA, 25 bp, Rattus norvegicus
gagggacagccacagaagactagaa

SEQ ID NO: 348893 - DNA, 25 bp, Rattus norvegicus
gagggacagccagagaagactagaa

SEQ ID NO: 348894 - DNA, 25 bp, Rattus norvegicus
gagggacagctaagccaagggcact

SEQ ID NO: 348895 - DNA, 25 bp, Rattus norvegicus
gagggacagctatgccaagggcact

SEQ ID NO: 348896 - DNA, 25 bp, Rattus norvegicus
gagggacagctgaatttctgccaga

SEQ ID NO: 348897 - DNA, 25 bp, Rattus norvegicus
gagggacagctgtatttctgccaga

SEQ ID NO: 348898 - DNA, 25 bp, Rattus norvegicus
gagggacagcttcaagagcctgata

SEQ ID NO: 348899 - DNA, 25 bp, Rattus norvegicus
gagggacagcttgaagagcctgata

SEQ ID NO: 348900 - DNA, 25 bp, Rattus norvegicus
gagggacaggacaagccctgactga

SEQ ID NO: 348901 - DNA, 25 bp, Rattus norvegicus
gagggacaggactagccctgactga

SEQ ID NO: 348902 - DNA, 25 bp, Rattus norvegicus
gagggacaggccatctgcttcacca

SEQ ID NO: 348903 - DNA, 25 bp, Rattus norvegicus
gagggacaggccttctgcttcacca

SEQ ID NO: 348904 - DNA, 25 bp, Rattus norvegicus
gagggacatccacatcaccaggtta

SEQ ID NO: 348905 - DNA, 25 bp, Rattus norvegicus
gagggacatccagatcaccaggtta

SEQ ID NO: 348906 - DNA, 25 bp, Rattus norvegicus
gagggacatcttactagctagcaag

SEQ ID NO: 348907 - DNA, 25 bp, Rattus norvegicus
gagggacatctttctagctagcaag

SEQ ID NO: 348908 - DNA, 25 bp, Rattus norvegicus
gagggacattacagagaccaaacat

SEQ ID NO: 348909 - DNA, 25 bp, Rattus norvegicus
gagggacattactgagaccaaacat

SEQ ID NO: 348910 - DNA, 25 bp, Rattus norvegicus
gagggacattcgcatggcagccact

SEQ ID NO: 348911 - DNA, 25 bp, Rattus norvegicus
gagggacattcggatggcagccact

SEQ ID NO: 348912 - DNA, 25 bp, Rattus norvegicus
gagggaccaaataggcccagtcaca

SEQ ID NO: 348913 - DNA, 25 bp, Rattus norvegicus
gagggaccaaattggcccagtcaca

SEQ ID NO: 348914 - DNA, 25 bp, Rattus norvegicus
gagggaccagctctgcaatcaacaa

SEQ ID NO: 348915 - DNA, 25 bp, Rattus norvegicus
gagggaccagctgtgcaatcaacaa

SEQ ID NO: 348916 - DNA, 25 bp, Rattus norvegicus
gagggaccaggcaagaacacttgaa

SEQ ID NO: 348917 - DNA, 25 bp, Rattus norvegicus
gagggaccaggctagaacacttgaa

SEQ ID NO: 348918 - DNA, 25 bp, Rattus norvegicus
gagggaccattgagcagctggagct

SEQ ID NO: 348919 - DNA, 25 bp, Rattus norvegicus
gagggaccattgtgcagctggagct

SEQ ID NO: 348920 - DNA, 25 bp, Rattus norvegicus
gagggacccagaccaccttagacaa

SEQ ID NO: 348921 - DNA, 25 bp, Rattus norvegicus
gagggacccagagcaccttagacaa

SEQ ID NO: 348922 - DNA, 25 bp, Rattus norvegicus
gagggacccagtcgctgttcacgca

SEQ ID NO: 348923 - DNA, 25 bp, Rattus norvegicus
gagggacccagtggctgttcacgca

SEQ ID NO: 348924 - DNA, 25 bp, Rattus norvegicus
gagggaccccaacgataaatctgaa

SEQ ID NO: 348925 - DNA, 25 bp, Rattus norvegicus
gagggaccccaaggataaatctgaa

SEQ ID NO: 348926 - DNA, 25 bp, Rattus norvegicus
gagggaccccacaggtgcgtaaagt

SEQ ID NO: 348927 - DNA, 25 bp, Rattus norvegicus
gagggaccccactggtgcgtaaagt

SEQ ID NO: 348928 - DNA, 25 bp, Rattus norvegicus
gagggacccctaatgcagggacctg

SEQ ID NO: 348929 - DNA, 25 bp, Rattus norvegicus
gagggacccctattgcagggacctg

SEQ ID NO: 348930 - DNA, 25 bp, Rattus norvegicus
gagggaccctggctggaacaccaca

SEQ ID NO: 348931 - DNA, 25 bp, Rattus norvegicus
gagggaccctgggtggaacaccaca

SEQ ID NO: 348932 - DNA, 25 bp, Rattus norvegicus
gagggaccgacaatcttgggttaat

SEQ ID NO: 348933 - DNA, 25 bp, Rattus norvegicus
gagggaccgacattcttgggttaat

SEQ ID NO: 348934 - DNA, 25 bp, Rattus norvegicus
gagggaccgacgctcgggagccagg

SEQ ID NO: 348935 - DNA, 25 bp, Rattus norvegicus
gagggaccgacggtcgggagccagg

SEQ ID NO: 348936 - DNA, 25 bp, Rattus norvegicus
gagggacctcgtcctgacagacaga

SEQ ID NO: 348937 - DNA, 25 bp, Rattus norvegicus
gagggacctcgtgctgacagacaga

SEQ ID NO: 348938 - DNA, 25 bp, Rattus norvegicus
gagggacctcttaatacccggattg

SEQ ID NO: 348939 - DNA, 25 bp, Rattus norvegicus
gagggacctctttatacccggattg

SEQ ID NO: 348940 - DNA, 25 bp, Rattus norvegicus
gagggacctgaaccttttgaggcca

SEQ ID NO: 348941 - DNA, 25 bp, Rattus norvegicus
gagggacctgaagcttttgaggcca

SEQ ID NO: 348942 - DNA, 25 bp, Rattus norvegicus
gagggacctgccaagagcgtctttg

SEQ ID NO: 348943 - DNA, 25 bp, Rattus norvegicus
gagggacctgcctagagcgtctttg

SEQ ID NO: 348944 - DNA, 25 bp, Rattus norvegicus
gagggacctggcacaatgcagctct

SEQ ID NO: 348945 - DNA, 25 bp, Rattus norvegicus
gagggacctggctcaatgcagctct

SEQ ID NO: 348946 - DNA, 25 bp, Rattus norvegicus
gagggacctgtgagctcactgcgca

SEQ ID NO: 348947 - DNA, 25 bp, Rattus norvegicus
gagggacctgtgtgctcactgcgca

SEQ ID NO: 348948 - DNA, 25 bp, Rattus norvegicus
gagggaccttccaatcacagaggct

SEQ ID NO: 348949 - DNA, 25 bp, Rattus norvegicus
gagggaccttcctatcacagaggct

SEQ ID NO: 348950 - DNA, 25 bp, Rattus norvegicus
gagggacctttaactcactattttg

SEQ ID NO: 348951 - DNA, 25 bp, Rattus norvegicus
gagggacctttatctcactattttg

SEQ ID NO: 348952 - DNA, 25 bp, Rattus norvegicus
gagggacgacacagttgcaacactg

SEQ ID NO: 348953 - DNA, 25 bp, Rattus norvegicus
gagggacgacactgttgcaacactg

SEQ ID NO: 348954 - DNA, 25 bp, Rattus norvegicus
gagggacgaccaaatttatttcagt

SEQ ID NO: 348955 - DNA, 25 bp, Rattus norvegicus
gagggacgaccatatttatttcagt

SEQ ID NO: 348956 - DNA, 25 bp, Rattus norvegicus
gagggacgagctaagcaccagatta

SEQ ID NO: 348957 - DNA, 25 bp, Rattus norvegicus
gagggacgagctatcccaatgccag

SEQ ID NO: 348958 - DNA, 25 bp, Rattus norvegicus
gagggacgagcttagcaccagatta

SEQ ID NO: 348959 - DNA, 25 bp, Rattus norvegicus
gagggacgagctttcccaatgccag

SEQ ID NO: 348960 - DNA, 25 bp, Rattus norvegicus
gagggacggcccagcctgtaaaata

SEQ ID NO: 348961 - DNA, 25 bp, Rattus norvegicus
gagggacggccctgcctgtaaaata

SEQ ID NO: 348962 - DNA, 25 bp, Rattus norvegicus
gagggacgtatgacctgctctgtgt

SEQ ID NO: 348963 - DNA, 25 bp, Rattus norvegicus
gagggacgtatgtcctgctctgtgt

SEQ ID NO: 348964 - DNA, 25 bp, Rattus norvegicus
gagggacgttggaaactggatctaa

SEQ ID NO: 348965 - DNA, 25 bp, Rattus norvegicus
gagggacgttggtaactggatctaa

SEQ ID NO: 348966 - DNA, 25 bp, Rattus norvegicus
gagggactaacaccatctacaggaa

SEQ ID NO: 348967 - DNA, 25 bp, Rattus norvegicus
gagggactaacagcatctacaggaa

SEQ ID NO: 348968 - DNA, 25 bp, Rattus norvegicus
gagggactcattacattgacgactt

SEQ ID NO: 348969 - DNA, 25 bp, Rattus norvegicus
gagggactcatttcattgacgactt

SEQ ID NO: 348970 - DNA, 25 bp, Rattus norvegicus
gagggactccagaatgagagccata

SEQ ID NO: 348971 - DNA, 25 bp, Rattus norvegicus
gagggactccagatgaccagtttac

SEQ ID NO: 348972 - DNA, 25 bp, Rattus norvegicus
gagggactccagtatgagagccata

SEQ ID NO: 348973 - DNA, 25 bp, Rattus norvegicus
gagggactccagttgaccagtttac

SEQ ID NO: 348974 - DNA, 25 bp, Rattus norvegicus
gagggactcccgacattggcagctg

SEQ ID NO: 348975 - DNA, 25 bp, Rattus norvegicus
gagggactcccgtcattggcagctg

SEQ ID NO: 348976 - DNA, 25 bp, Rattus norvegicus
gagggactcgagatgcaccattgtc

SEQ ID NO: 348977 - DNA, 25 bp, Rattus norvegicus
gagggactcgagttgcaccattgtc

SEQ ID NO: 348978 - DNA, 25 bp, Rattus norvegicus
gagggactcgccaagattcagacct

SEQ ID NO: 348979 - DNA, 25 bp, Rattus norvegicus
gagggactcgcctagattcagacct

SEQ ID NO: 348980 - DNA, 25 bp, Rattus norvegicus
gagggactctccacacaggtcagag

SEQ ID NO: 348981 - DNA, 25 bp, Rattus norvegicus
gagggactctcctcacaggtcagag

SEQ ID NO: 348982 - DNA, 25 bp, Rattus norvegicus
gagggactctggcactctccaggtt

SEQ ID NO: 348983 - DNA, 25 bp, Rattus norvegicus
gagggactctgggactctccaggtt

SEQ ID NO: 348984 - DNA, 25 bp, Rattus norvegicus
gagggactctgtaccatggtcacgg

SEQ ID NO: 348985 - DNA, 25 bp, Rattus norvegicus
gagggactctgttccatggtcacgg

SEQ ID NO: 348986 - DNA, 25 bp, Rattus norvegicus
gagggactcttgagtttccctgaaa

SEQ ID NO: 348987 - DNA, 25 bp, Rattus norvegicus
gagggactcttgtgtttccctgaaa

SEQ ID NO: 348988 - DNA, 25 bp, Rattus norvegicus
gagggactctttcatttctgttttc

SEQ ID NO: 348989 - DNA, 25 bp, Rattus norvegicus
gagggactctttgatttctgttttc

SEQ ID NO: 348990 - DNA, 25 bp, Rattus norvegicus
gagggactgaggaccagcactgccc

SEQ ID NO: 348991 - DNA, 25 bp, Rattus norvegicus
gagggactgaggctcgtattcctaa

SEQ ID NO: 348992 - DNA, 25 bp, Rattus norvegicus
gagggactgagggtcgtattcctaa

SEQ ID NO: 348993 - DNA, 25 bp, Rattus norvegicus
gagggactgaggtccagcactgccc

SEQ ID NO: 348994 - DNA, 25 bp, Rattus norvegicus
gagggactgatgctaccaccagcat

SEQ ID NO: 348995 - DNA, 25 bp, Rattus norvegicus
gagggactgatggtaccaccagcat

SEQ ID NO: 348996 - DNA, 25 bp, Rattus norvegicus
gagggactgcaaacatgtccccgtt

SEQ ID NO: 348997 - DNA, 25 bp, Rattus norvegicus
gagggactgcaatcatgtccccgtt

SEQ ID NO: 348998 - DNA, 25 bp, Rattus norvegicus
gagggactgccaccccaggtagaca

SEQ ID NO: 348999 - DNA, 25 bp, Rattus norvegicus
gagggactgccagcccaggtagaca

SEQ ID NO: 349000 - DNA, 25 bp, Rattus norvegicus
gagggactggcccacatttacattg

SEQ ID NO: 349001 - DNA, 25 bp, Rattus norvegicus
gagggactggccgacatttacattg

SEQ ID NO: 349002 - DNA, 25 bp, Rattus norvegicus
gagggactgtgtactgttccgcatc

SEQ ID NO: 349003 - DNA, 25 bp, Rattus norvegicus
gagggactgtgtcaggtgggtacca

SEQ ID NO: 349004 - DNA, 25 bp, Rattus norvegicus
gagggactgtgtgaggtgggtacca

SEQ ID NO: 349005 - DNA, 25 bp, Rattus norvegicus
gagggactgtgttctgttccgcatc

SEQ ID NO: 349006 - DNA, 25 bp, Rattus norvegicus
gagggacttagcatccaaatctggt

SEQ ID NO: 349007 - DNA, 25 bp, Rattus norvegicus
gagggacttagcttccaaatctggt

SEQ ID NO: 349008 - DNA, 25 bp, Rattus norvegicus
gagggacttcagaccttatacaaca

SEQ ID NO: 349009 - DNA, 25 bp, Rattus norvegicus
gagggacttcagtccttatacaaca

SEQ ID NO: 349010 - DNA, 25 bp, Rattus norvegicus
gagggacttcatcaaccaacaggct

SEQ ID NO: 349011 - DNA, 25 bp, Rattus norvegicus
gagggacttcatgaaccaacaggct

SEQ ID NO: 349012 - DNA, 25 bp, Rattus norvegicus
gagggacttccaagatcgcagcttt

SEQ ID NO: 349013 - DNA, 25 bp, Rattus norvegicus
gagggacttccatgatcgcagcttt

SEQ ID NO: 349014 - DNA, 25 bp, Rattus norvegicus
gagggacttcctactgtattagaga

SEQ ID NO: 349015 - DNA, 25 bp, Rattus norvegicus
gagggacttccttctgtattagaga

SEQ ID NO: 349016 - DNA, 25 bp, Rattus norvegicus
gagggacttggtactgcagcttccc

SEQ ID NO: 349017 - DNA, 25 bp, Rattus norvegicus
gagggacttggttctgcagcttccc

SEQ ID NO: 349018 - DNA, 25 bp, Rattus norvegicus
gagggacttttccatgactgtcatt

SEQ ID NO: 349019 - DNA, 25 bp, Rattus norvegicus
gagggacttttcgatgactgtcatt

SEQ ID NO: 349020 - DNA, 25 bp, Rattus norvegicus
gagggagaaacgcttgctcctccca

SEQ ID NO: 349021 - DNA, 25 bp, Rattus norvegicus
gagggagaaacggttgctcctccca

SEQ ID NO: 349022 - DNA, 25 bp, Rattus norvegicus
gagggagaacacaccagcagcatgg

SEQ ID NO: 349023 - DNA, 25 bp, Rattus norvegicus
gagggagaacactccagcagcatgg

SEQ ID NO: 349024 - DNA, 25 bp, Rattus norvegicus
gagggagaagccacatcactctgaa

SEQ ID NO: 349025 - DNA, 25 bp, Rattus norvegicus
gagggagaagcctcatcactctgaa

SEQ ID NO: 349026 - DNA, 25 bp, Rattus norvegicus
gagggagaagctccctactctgaaa

SEQ ID NO: 349027 - DNA, 25 bp, Rattus norvegicus
gagggagaagctgcctactctgaaa

SEQ ID NO: 349028 - DNA, 25 bp, Rattus norvegicus
gagggagaaggcactaactttctaa

SEQ ID NO: 349029 - DNA, 25 bp, Rattus norvegicus
gagggagaaggctctaactttctaa

SEQ ID NO: 349030 - DNA, 25 bp, Rattus norvegicus
gagggagaagttcccgtccaagctc

SEQ ID NO: 349031 - DNA, 25 bp, Rattus norvegicus
gagggagaagttgccgtccaagctc

SEQ ID NO: 349032 - DNA, 25 bp, Rattus norvegicus
gagggagacaccatagccttcagaa

SEQ ID NO: 349033 - DNA, 25 bp, Rattus norvegicus
gagggagacaccttagccttcagaa

SEQ ID NO: 349034 - DNA, 25 bp, Rattus norvegicus
gagggagacactaatggccaccact

SEQ ID NO: 349035 - DNA, 25 bp, Rattus norvegicus
gagggagacacttatggccaccact

SEQ ID NO: 349036 - DNA, 25 bp, Rattus norvegicus
gagggagacagccttggacatccta

SEQ ID NO: 349037 - DNA, 25 bp, Rattus norvegicus
gagggagacagcgttggacatccta

SEQ ID NO: 349038 - DNA, 25 bp, Rattus norvegicus
gagggagaccacatgctgacaacat

SEQ ID NO: 349039 - DNA, 25 bp, Rattus norvegicus
gagggagaccacttgctgacaacat

SEQ ID NO: 349040 - DNA, 25 bp, Rattus norvegicus
gagggagaccatctgctgagaacta

SEQ ID NO: 349041 - DNA, 25 bp, Rattus norvegicus
gagggagaccatgtgctgagaacta

SEQ ID NO: 349042 - DNA, 25 bp, Rattus norvegicus
gagggagacccaaaactgagcgatt

SEQ ID NO: 349043 - DNA, 25 bp, Rattus norvegicus
gagggagacccataactgagcgatt

SEQ ID NO: 349044 - DNA, 25 bp, Rattus norvegicus
gagggagaccccagcggcaccagta

SEQ ID NO: 349045 - DNA, 25 bp, Rattus norvegicus
gagggagacccctgcggcaccagta

SEQ ID NO: 349046 - DNA, 25 bp, Rattus norvegicus
gagggagactatcttccttctacca

SEQ ID NO: 349047 - DNA, 25 bp, Rattus norvegicus
gagggagactatgttccttctacca

SEQ ID NO: 349048 - DNA, 25 bp, Rattus norvegicus
gagggagactcccttctggacacaa

SEQ ID NO: 349049 - DNA, 25 bp, Rattus norvegicus
gagggagactccgttctggacacaa

SEQ ID NO: 349050 - DNA, 25 bp, Rattus norvegicus
gagggagagattaccacaattcaca

SEQ ID NO: 349051 - DNA, 25 bp, Rattus norvegicus
gagggagagatttccacaattcaca

SEQ ID NO: 349052 - DNA, 25 bp, Rattus norvegicus
gagggagagcctatgcttctgacag

SEQ ID NO: 349053 - DNA, 25 bp, Rattus norvegicus
gagggagagcctttgcttctgacag

SEQ ID NO: 349054 - DNA, 25 bp, Rattus norvegicus
gagggagagctccttgtttcctaaa

SEQ ID NO: 349055 - DNA, 25 bp, Rattus norvegicus
gagggagagctcgttgtttcctaaa

SEQ ID NO: 349056 - DNA, 25 bp, Rattus norvegicus
gagggagagtcaaaccagccactgc

SEQ ID NO: 349057 - DNA, 25 bp, Rattus norvegicus
gagggagagtcataccagccactgc

SEQ ID NO: 349058 - DNA, 25 bp, Rattus norvegicus
gagggagatcagcagcacctctcag

SEQ ID NO: 349059 - DNA, 25 bp, Rattus norvegicus
gagggagatcaggagcacctctcag

SEQ ID NO: 349060 - DNA, 25 bp, Rattus norvegicus
gagggagatcctatacagtgtttat

SEQ ID NO: 349061 - DNA, 25 bp, Rattus norvegicus
gagggagatcctttacagtgtttat

SEQ ID NO: 349062 - DNA, 25 bp, Rattus norvegicus
gagggagatctccaacaccaactac

SEQ ID NO: 349063 - DNA, 25 bp, Rattus norvegicus
gagggagatctcgaacaccaactac

SEQ ID NO: 349064 - DNA, 25 bp, Rattus norvegicus
gagggagatcttctggatccttcta

SEQ ID NO: 349065 - DNA, 25 bp, Rattus norvegicus
gagggagatcttgtggatccttcta

SEQ ID NO: 349066 - DNA, 25 bp, Rattus norvegicus
gagggagcaaaacccacctgcatgc

SEQ ID NO: 349067 - DNA, 25 bp, Rattus norvegicus
gagggagcaaaagccacctgcatgc

SEQ ID NO: 349068 - DNA, 25 bp, Rattus norvegicus
gagggagcaacaacacactccgatt

SEQ ID NO: 349069 - DNA, 25 bp, Rattus norvegicus
gagggagcaacatcacactccgatt

SEQ ID NO: 349070 - DNA, 25 bp, Rattus norvegicus
gagggagcacatctatcagcagcca

SEQ ID NO: 349071 - DNA, 25 bp, Rattus norvegicus
gagggagcacatgtatcagcagcca

SEQ ID NO: 349072 - DNA, 25 bp, Rattus norvegicus
gagggagcaccaacactggtttctg

SEQ ID NO: 349073 - DNA, 25 bp, Rattus norvegicus
gagggagcaccatcactggtttctg

SEQ ID NO: 349074 - DNA, 25 bp, Rattus norvegicus
gagggagcactcacattcaaaccaa

SEQ ID NO: 349075 - DNA, 25 bp, Rattus norvegicus
gagggagcactctcattcaaaccaa

SEQ ID NO: 349076 - DNA, 25 bp, Rattus norvegicus
gagggagcaggcactactcagccaa

SEQ ID NO: 349077 - DNA, 25 bp, Rattus norvegicus
gagggagcaggctctactcagccaa

SEQ ID NO: 349078 - DNA, 25 bp, Rattus norvegicus
gagggagcaggtatctgtcccgtcc

SEQ ID NO: 349079 - DNA, 25 bp, Rattus norvegicus
gagggagcaggtttctgtcccgtcc

SEQ ID NO: 349080 - DNA, 25 bp, Rattus norvegicus
gagggagcattcagcaagtcagttt

SEQ ID NO: 349081 - DNA, 25 bp, Rattus norvegicus
gagggagcattctgcaagtcagttt

SEQ ID NO: 349082 - DNA, 25 bp, Rattus norvegicus
gagggagcatttccttcgtgcatga

SEQ ID NO: 349083 - DNA, 25 bp, Rattus norvegicus
gagggagcatttgcttcgtgcatga

SEQ ID NO: 349084 - DNA, 25 bp, Rattus norvegicus
gagggagccagcagcatcacatctg

SEQ ID NO: 349085 - DNA, 25 bp, Rattus norvegicus
gagggagccagctgcatcacatctg

SEQ ID NO: 349086 - DNA, 25 bp, Rattus norvegicus
gagggagccatcacttagccaactc

SEQ ID NO: 349087 - DNA, 25 bp, Rattus norvegicus
gagggagccatctcttagccaactc

SEQ ID NO: 349088 - DNA, 25 bp, Rattus norvegicus
gagggagcccagaataagaagaaat

SEQ ID NO: 349089 - DNA, 25 bp, Rattus norvegicus
gagggagcccagtataagaagaaat

SEQ ID NO: 349090 - DNA, 25 bp, Rattus norvegicus
gagggagccccaaatcaaggcaaaa

SEQ ID NO: 349091 - DNA, 25 bp, Rattus norvegicus
gagggagccccatatcaaggcaaaa

SEQ ID NO: 349092 - DNA, 25 bp, Rattus norvegicus
gagggagccggtacaatctcttctt

SEQ ID NO: 349093 - DNA, 25 bp, Rattus norvegicus
gagggagccggttcaatctcttctt

SEQ ID NO: 349094 - DNA, 25 bp, Rattus norvegicus
gagggagccttcaaaaccagttctg

SEQ ID NO: 349095 - DNA, 25 bp, Rattus norvegicus
gagggagccttctaaaccagttctg

SEQ ID NO: 349096 - DNA, 25 bp, Rattus norvegicus
gagggagcgatcacacagcgcctgc

SEQ ID NO: 349097 - DNA, 25 bp, Rattus norvegicus
gagggagcgatctcacagcgcctgc

SEQ ID NO: 349098 - DNA, 25 bp, Rattus norvegicus
gagggagcggttacatcttaagaga

SEQ ID NO: 349099 - DNA, 25 bp, Rattus norvegicus
gagggagcggtttcatcttaagaga

SEQ ID NO: 349100 - DNA, 25 bp, Rattus norvegicus
gagggagctacaagtcctttaccga

SEQ ID NO: 349101 - DNA, 25 bp, Rattus norvegicus
gagggagctacatgtcctttaccga

SEQ ID NO: 349102 - DNA, 25 bp, Rattus norvegicus
gagggagctcccatgttgaatttat

SEQ ID NO: 349103 - DNA, 25 bp, Rattus norvegicus
gagggagctcccttgttgaatttat

SEQ ID NO: 349104 - DNA, 25 bp, Rattus norvegicus
gagggagctctaatacacggaacat

SEQ ID NO: 349105 - DNA, 25 bp, Rattus norvegicus
gagggagctctattacacggaacat

SEQ ID NO: 349106 - DNA, 25 bp, Rattus norvegicus
gagggagctcttatcaatggatgtc

SEQ ID NO: 349107 - DNA, 25 bp, Rattus norvegicus
gagggagctcttttcaatggatgtc

SEQ ID NO: 349108 - DNA, 25 bp, Rattus norvegicus
gagggagctgagactcctgtgccca

SEQ ID NO: 349109 - DNA, 25 bp, Rattus norvegicus
gagggagctgagtctcctgtgccca

SEQ ID NO: 349110 - DNA, 25 bp, Rattus norvegicus
gagggagctggcatggcaccacccc

SEQ ID NO: 349111 - DNA, 25 bp, Rattus norvegicus
gagggagctggcttggcaccacccc

SEQ ID NO: 349112 - DNA, 25 bp, Rattus norvegicus
gagggagctgtcaccttgacaaata

SEQ ID NO: 349113 - DNA, 25 bp, Rattus norvegicus
gagggagctgtctccttgacaaata

SEQ ID NO: 349114 - DNA, 25 bp, Rattus norvegicus
gagggaggacacctcatctcttctc

SEQ ID NO: 349115 - DNA, 25 bp, Rattus norvegicus
gagggaggacacgtcatctcttctc

SEQ ID NO: 349116 - DNA, 25 bp, Rattus norvegicus
gagggaggacagaatcatcttcttt

SEQ ID NO: 349117 - DNA, 25 bp, Rattus norvegicus
gagggaggacagtatcatcttcttt

SEQ ID NO: 349118 - DNA, 25 bp, Rattus norvegicus
gagggaggagctaccaccaaacttc

SEQ ID NO: 349119 - DNA, 25 bp, Rattus norvegicus
gagggaggagctccttccatacaca

SEQ ID NO: 349120 - DNA, 25 bp, Rattus norvegicus
gagggaggagctgcttccatacaca

SEQ ID NO: 349121 - DNA, 25 bp, Rattus norvegicus
gagggaggagcttccaccaaacttc

SEQ ID NO: 349122 - DNA, 25 bp, Rattus norvegicus
gagggaggcagtaacagttttttat

SEQ ID NO: 349123 - DNA, 25 bp, Rattus norvegicus
gagggaggcagttacagttttttat

SEQ ID NO: 349124 - DNA, 25 bp, Rattus norvegicus
gagggaggccctcgtctcaaaaaag

SEQ ID NO: 349125 - DNA, 25 bp, Rattus norvegicus
gagggaggccctggtctcaaaaaag

SEQ ID NO: 349126 - DNA, 25 bp, Rattus norvegicus
gagggaggcctgaaacccagagaca

SEQ ID NO: 349127 - DNA, 25 bp, Rattus norvegicus
gagggaggcctgtaacccagagaca

SEQ ID NO: 349128 - DNA, 25 bp, Rattus norvegicus
gagggaggcgttagattctgcccac

SEQ ID NO: 349129 - DNA, 25 bp, Rattus norvegicus
gagggaggcgtttgattctgcccac

SEQ ID NO: 349130 - DNA, 25 bp, Rattus norvegicus
gagggaggctatactaccacaaatt

SEQ ID NO: 349131 - DNA, 25 bp, Rattus norvegicus
gagggaggctattctaccacaaatt

SEQ ID NO: 349132 - DNA, 25 bp, Rattus norvegicus
gagggaggctttatctcaccaataa

SEQ ID NO: 349133 - DNA, 25 bp, Rattus norvegicus
gagggaggctttttctcaccaataa

SEQ ID NO: 349134 - DNA, 25 bp, Rattus norvegicus
gagggagggattcccgggttcgcgt

SEQ ID NO: 349135 - DNA, 25 bp, Rattus norvegicus
gagggagggattgccgggttcgcgt

SEQ ID NO: 349136 - DNA, 25 bp, Rattus norvegicus
gagggaggtcacaatacgctattaa

SEQ ID NO: 349137 - DNA, 25 bp, Rattus norvegicus
gagggaggtcactatacgctattaa

SEQ ID NO: 349138 - DNA, 25 bp, Rattus norvegicus
gagggaggtcagactgtctgacaca

SEQ ID NO: 349139 - DNA, 25 bp, Rattus norvegicus
gagggaggtcagtctgtctgacaca

SEQ ID NO: 349140 - DNA, 25 bp, Rattus norvegicus
gagggaggtgccatcaagctcctcc

SEQ ID NO: 349141 - DNA, 25 bp, Rattus norvegicus
gagggaggtgccttcaagctcctcc

SEQ ID NO: 349142 - DNA, 25 bp, Rattus norvegicus
gagggaggtttaatctgccatatca

SEQ ID NO: 349143 - DNA, 25 bp, Rattus norvegicus
gagggaggtttattctgccatatca

SEQ ID NO: 349144 - DNA, 25 bp, Rattus norvegicus
gagggagtatcccttgcgctttaaa

SEQ ID NO: 349145 - DNA, 25 bp, Rattus norvegicus
gagggagtatccgttgcgctttaaa

SEQ ID NO: 349146 - DNA, 25 bp, Rattus norvegicus
gagggagtctctcaaacttctctca

SEQ ID NO: 349147 - DNA, 25 bp, Rattus norvegicus
gagggagtctctgaaacttctctca

SEQ ID NO: 349148 - DNA, 25 bp, Rattus norvegicus
gagggagtcttgaacttgctcatga

SEQ ID NO: 349149 - DNA, 25 bp, Rattus norvegicus
gagggagtcttgtacttgctcatga

SEQ ID NO: 349150 - DNA, 25 bp, Rattus norvegicus
gagggagtgaatagcattgtctgca

SEQ ID NO: 349151 - DNA, 25 bp, Rattus norvegicus
gagggagtgaattgcattgtctgca

SEQ ID NO: 349152 - DNA, 25 bp, Rattus norvegicus
gagggagtggaaagactcagttcta

SEQ ID NO: 349153 - DNA, 25 bp, Rattus norvegicus
gagggagtggaatgactcagttcta

SEQ ID NO: 349154 - DNA, 25 bp, Rattus norvegicus
gagggagtgtctccgctgctactcc

SEQ ID NO: 349155 - DNA, 25 bp, Rattus norvegicus
gagggagtgtctgcgctgctactcc

SEQ ID NO: 349156 - DNA, 25 bp, Rattus norvegicus
gagggagttcaacaacgaggaaaca

SEQ ID NO: 349157 - DNA, 25 bp, Rattus norvegicus
gagggagttcaagaacgaggaaaca

SEQ ID NO: 349158 - DNA, 25 bp, Rattus norvegicus
gagggagttctcatccctgagagga

SEQ ID NO: 349159 - DNA, 25 bp, Rattus norvegicus
gagggagttctcttccctgagagga

SEQ ID NO: 349160 - DNA, 25 bp, Rattus norvegicus
gagggagttctgctttactgctttc

SEQ ID NO: 349161 - DNA, 25 bp, Rattus norvegicus
gagggagttctggtttactgctttc

SEQ ID NO: 349162 - DNA, 25 bp, Rattus norvegicus
gagggagttgacactgttcttctag

SEQ ID NO: 349163 - DNA, 25 bp, Rattus norvegicus
gagggagttgactctgttcttctag

SEQ ID NO: 349164 - DNA, 25 bp, Rattus norvegicus
gagggagtttccatctgctgtgtga

SEQ ID NO: 349165 - DNA, 25 bp, Rattus norvegicus
gagggagtttccttctgctgtgtga

SEQ ID NO: 349166 - DNA, 25 bp, Rattus norvegicus
gagggagtttgacctattgcttcat

SEQ ID NO: 349167 - DNA, 25 bp, Rattus norvegicus
gagggagtttgagctattgcttcat

SEQ ID NO: 349168 - DNA, 25 bp, Rattus norvegicus
gagggataccctccaaatgtaacca

SEQ ID NO: 349169 - DNA, 25 bp, Rattus norvegicus
gagggataccctgcaaatgtaacca

SEQ ID NO: 349170 - DNA, 25 bp, Rattus norvegicus
gagggatacggcatttacaccaagt

SEQ ID NO: 349171 - DNA, 25 bp, Rattus norvegicus
gagggatacggcttttacaccaagt

SEQ ID NO: 349172 - DNA, 25 bp, Rattus norvegicus
gagggatagacgacaggcttctttg

SEQ ID NO: 349173 - DNA, 25 bp, Rattus norvegicus
gagggatagacgtcaggcttctttg

SEQ ID NO: 349174 - DNA, 25 bp, Rattus norvegicus
gagggatagcacacatcttcaactt

SEQ ID NO: 349175 - DNA, 25 bp, Rattus norvegicus
gagggatagcactcatcttcaactt

SEQ ID NO: 349176 - DNA, 25 bp, Rattus norvegicus
gagggatccatacagcattttgcgt

SEQ ID NO: 349177 - DNA, 25 bp, Rattus norvegicus
gagggatccatagagcattttgcgt

SEQ ID NO: 349178 - DNA, 25 bp, Rattus norvegicus
gagggatcctctagcgggacagtcc

SEQ ID NO: 349179 - DNA, 25 bp, Rattus norvegicus
gagggatcctcttgcgggacagtcc

SEQ ID NO: 349180 - DNA, 25 bp, Rattus norvegicus
gagggatctccccaaaaatctgaaa

SEQ ID NO: 349181 - DNA, 25 bp, Rattus norvegicus
gagggatctcccgaaaaatctgaaa

SEQ ID NO: 349182 - DNA, 25 bp, Rattus norvegicus
gagggatctgcaactgcggagacaa

SEQ ID NO: 349183 - DNA, 25 bp, Rattus norvegicus
gagggatctgcacttttgtttgttt

SEQ ID NO: 349184 - DNA, 25 bp, Rattus norvegicus
gagggatctgcagttttgtttgttt

SEQ ID NO: 349185 - DNA, 25 bp, Rattus norvegicus
gagggatctgcatctgcggagacaa

SEQ ID NO: 349186 - DNA, 25 bp, Rattus norvegicus
gagggatctgttagcgaaaatcatt

SEQ ID NO: 349187 - DNA, 25 bp, Rattus norvegicus
gagggatctgtttgcgaaaatcatt

SEQ ID NO: 349188 - DNA, 25 bp, Rattus norvegicus
gagggatcttcaccaagaccatgtt

SEQ ID NO: 349189 - DNA, 25 bp, Rattus norvegicus
gagggatcttcagcaagaccatgtt

SEQ ID NO: 349190 - DNA, 25 bp, Rattus norvegicus
gagggatcttctaataccctgccaa

SEQ ID NO: 349191 - DNA, 25 bp, Rattus norvegicus
gagggatcttcttataccctgccaa

SEQ ID NO: 349192 - DNA, 25 bp, Rattus norvegicus
gagggatgacacatttctgtgaaat

SEQ ID NO: 349193 - DNA, 25 bp, Rattus norvegicus
gagggatgacacttttctgtgaaat

SEQ ID NO: 349194 - DNA, 25 bp, Rattus norvegicus
gagggatgatgcagtccttatacaa

SEQ ID NO: 349195 - DNA, 25 bp, Rattus norvegicus
gagggatgatgctgtccttatacaa

SEQ ID NO: 349196 - DNA, 25 bp, Rattus norvegicus
gagggatgcacaattccttcatgaa

SEQ ID NO: 349197 - DNA, 25 bp, Rattus norvegicus
gagggatgcacatttccttcatgaa

SEQ ID NO: 349198 - DNA, 25 bp, Rattus norvegicus
gagggatgcaggatttggcccacaa

SEQ ID NO: 349199 - DNA, 25 bp, Rattus norvegicus
gagggatgcaggttttggcccacaa

SEQ ID NO: 349200 - DNA, 25 bp, Rattus norvegicus
gagggatgcattacttggcactcac

SEQ ID NO: 349201 - DNA, 25 bp, Rattus norvegicus
gagggatgcatttcttggcactcac

SEQ ID NO: 349202 - DNA, 25 bp, Rattus norvegicus
gagggatgccctcaagactgagttc

SEQ ID NO: 349203 - DNA, 25 bp, Rattus norvegicus
gagggatgccctgaagactgagttc

SEQ ID NO: 349204 - DNA, 25 bp, Rattus norvegicus
gagggatgctggaaccagttacgac

SEQ ID NO: 349205 - DNA, 25 bp, Rattus norvegicus
gagggatgctggtaccagttacgac

SEQ ID NO: 349206 - DNA, 25 bp, Rattus norvegicus
gagggatggctaaatgtccactagt

SEQ ID NO: 349207 - DNA, 25 bp, Rattus norvegicus
gagggatggctatatgtccactagt

SEQ ID NO: 349208 - DNA, 25 bp, Rattus norvegicus
gagggatggctcagtgcaaccttct

SEQ ID NO: 349209 - DNA, 25 bp, Rattus norvegicus
gagggatggctctgtgcaaccttct

SEQ ID NO: 349210 - DNA, 25 bp, Rattus norvegicus
gagggatggttactattatctatat

SEQ ID NO: 349211 - DNA, 25 bp, Rattus norvegicus
gagggatggttagtattatctatat

SEQ ID NO: 349212 - DNA, 25 bp, Rattus norvegicus
gagggatgtataccccatacgtcct

SEQ ID NO: 349213 - DNA, 25 bp, Rattus norvegicus
gagggatgtatagcccatacgtcct

SEQ ID NO: 349214 - DNA, 25 bp, Rattus norvegicus
gagggatgtcctagtctgtcacctt

SEQ ID NO: 349215 - DNA, 25 bp, Rattus norvegicus
gagggatgtccttgtctgtcacctt

SEQ ID NO: 349216 - DNA, 25 bp, Rattus norvegicus
gagggatgtgtaattcattccttcc

SEQ ID NO: 349217 - DNA, 25 bp, Rattus norvegicus
gagggatgtgtatttcattccttcc

SEQ ID NO: 349218 - DNA, 25 bp, Rattus norvegicus
gagggatgttacagtggccaccttc

SEQ ID NO: 349219 - DNA, 25 bp, Rattus norvegicus
gagggatgttactgtggccaccttc

SEQ ID NO: 349220 - DNA, 25 bp, Rattus norvegicus
gagggatgtttgaaaccaacagcca

SEQ ID NO: 349221 - DNA, 25 bp, Rattus norvegicus
gagggatgtttgtaaccaacagcca

SEQ ID NO: 349222 - DNA, 25 bp, Rattus norvegicus
gagggattcagacatcatgcaacaa

SEQ ID NO: 349223 - DNA, 25 bp, Rattus norvegicus
gagggattcagagatcatgcaacaa

SEQ ID NO: 349224 - DNA, 25 bp, Rattus norvegicus
gagggatttcaccacagaccggtgt

SEQ ID NO: 349225 - DNA, 25 bp, Rattus norvegicus
gagggatttcacgacagaccggtgt

SEQ ID NO: 349226 - DNA, 25 bp, Rattus norvegicus
gagggatttgatccgctctgtatca

SEQ ID NO: 349227 - DNA, 25 bp, Rattus norvegicus
gagggatttgatgcgctctgtatca

SEQ ID NO: 349228 - DNA, 25 bp, Rattus norvegicus
gagggatttggaatgctgactttta

SEQ ID NO: 349229 - DNA, 25 bp, Rattus norvegicus
gagggatttggattgctgactttta

SEQ ID NO: 349230 - DNA, 25 bp, Rattus norvegicus
gagggatttttcacctttggagctc

SEQ ID NO: 349231 - DNA, 25 bp, Rattus norvegicus
gagggatttttctcctttggagctc

SEQ ID NO: 349232 - DNA, 25 bp, Rattus norvegicus
gagggcaaaatacacagacatcatt

SEQ ID NO: 349233 - DNA, 25 bp, Rattus norvegicus
gagggcaaaatagacagacatcatt

SEQ ID NO: 349234 - DNA, 25 bp, Rattus norvegicus
gagggcaaactaattcagatggcgt

SEQ ID NO: 349235 - DNA, 25 bp, Rattus norvegicus
gagggcaaactatttcagatggcgt

SEQ ID NO: 349236 - DNA, 25 bp, Rattus norvegicus
gagggcaaagcacatccagaatact

SEQ ID NO: 349237 - DNA, 25 bp, Rattus norvegicus
gagggcaaagcactcatcttggaga

SEQ ID NO: 349238 - DNA, 25 bp, Rattus norvegicus
gagggcaaagcagatccagaatact

SEQ ID NO: 349239 - DNA, 25 bp, Rattus norvegicus
gagggcaaagcagtcatcttggaga

SEQ ID NO: 349240 - DNA, 25 bp, Rattus norvegicus
gagggcaaagtaaaggctggcttct

SEQ ID NO: 349241 - DNA, 25 bp, Rattus norvegicus
gagggcaaagtataggctggcttct

SEQ ID NO: 349242 - DNA, 25 bp, Rattus norvegicus
gagggcaaatgcattcccgaccaga

SEQ ID NO: 349243 - DNA, 25 bp, Rattus norvegicus
gagggcaaatgctttcccgaccaga

SEQ ID NO: 349244 - DNA, 25 bp, Rattus norvegicus
gagggcaagaagacgaagaacatgt

SEQ ID NO: 349245 - DNA, 25 bp, Rattus norvegicus
gagggcaagaagcacttcgtcccgt

SEQ ID NO: 349246 - DNA, 25 bp, Rattus norvegicus
gagggcaagaaggacttcgtcccgt

SEQ ID NO: 349247 - DNA, 25 bp, Rattus norvegicus
gagggcaagaagtcgaagaacatgt

SEQ ID NO: 349248 - DNA, 25 bp, Rattus norvegicus
gagggcaagaggcacgaggaaccct

SEQ ID NO: 349249 - DNA, 25 bp, Rattus norvegicus
gagggcaagagggacgaggaaccct

SEQ ID NO: 349250 - DNA, 25 bp, Rattus norvegicus
gagggcaagcctaccactgttctaa

SEQ ID NO: 349251 - DNA, 25 bp, Rattus norvegicus
gagggcaagcctatgtgagccacct

SEQ ID NO: 349252 - DNA, 25 bp, Rattus norvegicus
gagggcaagccttccactgttctaa

SEQ ID NO: 349253 - DNA, 25 bp, Rattus norvegicus
gagggcaagcctttgtgagccacct

SEQ ID NO: 349254 - DNA, 25 bp, Rattus norvegicus
gagggcaagcttcctgcaaaacgct

SEQ ID NO: 349255 - DNA, 25 bp, Rattus norvegicus
gagggcaagcttgctgcaaaacgct

SEQ ID NO: 349256 - DNA, 25 bp, Rattus norvegicus
gagggcaaggacagtctgcagacat

SEQ ID NO: 349257 - DNA, 25 bp, Rattus norvegicus
gagggcaaggactgtctgcagacat

SEQ ID NO: 349258 - DNA, 25 bp, Rattus norvegicus
gagggcaagggcacccgtcccaaga

SEQ ID NO: 349259 - DNA, 25 bp, Rattus norvegicus
gagggcaagggctcccgtcccaaga

SEQ ID NO: 349260 - DNA, 25 bp, Rattus norvegicus
gagggcaatcctatagttactttgg

SEQ ID NO: 349261 - DNA, 25 bp, Rattus norvegicus
gagggcaatcctttagttactttgg

SEQ ID NO: 349262 - DNA, 25 bp, Rattus norvegicus
gagggcaatgctagagcctcccatg

SEQ ID NO: 349263 - DNA, 25 bp, Rattus norvegicus
gagggcaatgcttgagcctcccatg

SEQ ID NO: 349264 - DNA, 25 bp, Rattus norvegicus
gagggcacaaccctactgcaatatg

SEQ ID NO: 349265 - DNA, 25 bp, Rattus norvegicus
gagggcacaaccgtactgcaatatg

SEQ ID NO: 349266 - DNA, 25 bp, Rattus norvegicus
gagggcacaatgatccactttaatt

SEQ ID NO: 349267 - DNA, 25 bp, Rattus norvegicus
gagggcacaatgttccactttaatt

SEQ ID NO: 349268 - DNA, 25 bp, Rattus norvegicus
gagggcacagaactctacccagagt

SEQ ID NO: 349269 - DNA, 25 bp, Rattus norvegicus
gagggcacagaagtctacccagagt

SEQ ID NO: 349270 - DNA, 25 bp, Rattus norvegicus
gagggcacagtaatatagccacact

SEQ ID NO: 349271 - DNA, 25 bp, Rattus norvegicus
gagggcacagtattatagccacact

SEQ ID NO: 349272 - DNA, 25 bp, Rattus norvegicus
gagggcacattcctcgtgcgagaca

SEQ ID NO: 349273 - DNA, 25 bp, Rattus norvegicus
gagggcacattcgtcgtgcgagaca

SEQ ID NO: 349274 - DNA, 25 bp, Rattus norvegicus
gagggcacccgtcgaacccagaact

SEQ ID NO: 349275 - DNA, 25 bp, Rattus norvegicus
gagggcacccgtggaacccagaact

SEQ ID NO: 349276 - DNA, 25 bp, Rattus norvegicus
gagggcaccctaatctactaaaata

SEQ ID NO: 349277 - DNA, 25 bp, Rattus norvegicus
gagggcaccctactcgctgaccgga

SEQ ID NO: 349278 - DNA, 25 bp, Rattus norvegicus
gagggcaccctagtcgctgaccgga

SEQ ID NO: 349279 - DNA, 25 bp, Rattus norvegicus
gagggcaccctattctactaaaata

SEQ ID NO: 349280 - DNA, 25 bp, Rattus norvegicus
gagggcaccgctctcagtagcgtca

SEQ ID NO: 349281 - DNA, 25 bp, Rattus norvegicus
gagggcaccgctgtcagtagcgtca

SEQ ID NO: 349282 - DNA, 25 bp, Rattus norvegicus
gagggcacctatcatttccggatga

SEQ ID NO: 349283 - DNA, 25 bp, Rattus norvegicus
gagggcacctatgatttccggatga

SEQ ID NO: 349284 - DNA, 25 bp, Rattus norvegicus
gagggcacctctagagtccgtgatg

SEQ ID NO: 349285 - DNA, 25 bp, Rattus norvegicus
gagggcacctcttgagtccgtgatg

SEQ ID NO: 349286 - DNA, 25 bp, Rattus norvegicus
gagggcacctgacaaggactttctc

SEQ ID NO: 349287 - DNA, 25 bp, Rattus norvegicus
gagggcacctgagaaggactttctc

SEQ ID NO: 349288 - DNA, 25 bp, Rattus norvegicus
gagggcactcaaatttttctttctt

SEQ ID NO: 349289 - DNA, 25 bp, Rattus norvegicus
gagggcactcaattttttctttctt

SEQ ID NO: 349290 - DNA, 25 bp, Rattus norvegicus
gagggcactggtagttcctgctgtc

SEQ ID NO: 349291 - DNA, 25 bp, Rattus norvegicus
gagggcactggttgttcctgctgtc

SEQ ID NO: 349292 - DNA, 25 bp, Rattus norvegicus
gagggcactgtactagagaaatgtt

SEQ ID NO: 349293 - DNA, 25 bp, Rattus norvegicus
gagggcactgtagtagagaaatgtt

SEQ ID NO: 349294 - DNA, 25 bp, Rattus norvegicus
gagggcacttatctggtgtccagtc

SEQ ID NO: 349295 - DNA, 25 bp, Rattus norvegicus
gagggcacttatgtggtgtccagtc

SEQ ID NO: 349296 - DNA, 25 bp, Rattus norvegicus
gagggcacttggagaattccggcta

SEQ ID NO: 349297 - DNA, 25 bp, Rattus norvegicus
gagggcacttggtgaattccggcta

SEQ ID NO: 349298 - DNA, 25 bp, Rattus norvegicus
gagggcagacatcaccggaagatac

SEQ ID NO: 349299 - DNA, 25 bp, Rattus norvegicus
gagggcagacatgaccggaagatac

SEQ ID NO: 349300 - DNA, 25 bp, Rattus norvegicus
gagggcagagcaactgctccaccag

SEQ ID NO: 349301 - DNA, 25 bp, Rattus norvegicus
gagggcagagcatctgctccaccag

SEQ ID NO: 349302 - DNA, 25 bp, Rattus norvegicus
gagggcagatatcgctgagtctcaa

SEQ ID NO: 349303 - DNA, 25 bp, Rattus norvegicus
gagggcagatatggctgagtctcaa

SEQ ID NO: 349304 - DNA, 25 bp, Rattus norvegicus
gagggcagcaaacgttcatttttcc

SEQ ID NO: 349305 - DNA, 25 bp, Rattus norvegicus
gagggcagcaaaggttcatttttcc

SEQ ID NO: 349306 - DNA, 25 bp, Rattus norvegicus
gagggcagcatcactcatggacctg

SEQ ID NO: 349307 - DNA, 25 bp, Rattus norvegicus
gagggcagcatctctcatggacctg

SEQ ID NO: 349308 - DNA, 25 bp, Rattus norvegicus
gagggcagccacaaggaaccagaaa

SEQ ID NO: 349309 - DNA, 25 bp, Rattus norvegicus
gagggcagccactaggaaccagaaa

SEQ ID NO: 349310 - DNA, 25 bp, Rattus norvegicus
gagggcagccagacttcaacggaga

SEQ ID NO: 349311 - DNA, 25 bp, Rattus norvegicus
gagggcagccagtcttcaacggaga

SEQ ID NO: 349312 - DNA, 25 bp, Rattus norvegicus
gagggcagccatacgaccaagatat

SEQ ID NO: 349313 - DNA, 25 bp, Rattus norvegicus
gagggcagccattcgaccaagatat

SEQ ID NO: 349314 - DNA, 25 bp, Rattus norvegicus
gagggcagccccatagtaaaactag

SEQ ID NO: 349315 - DNA, 25 bp, Rattus norvegicus
gagggcagccccttagtaaaactag

SEQ ID NO: 349316 - DNA, 25 bp, Rattus norvegicus
gagggcagccctcagctcgtcatga

SEQ ID NO: 349317 - DNA, 25 bp, Rattus norvegicus
gagggcagccctgagctcgtcatga

SEQ ID NO: 349318 - DNA, 25 bp, Rattus norvegicus
gagggcagcctgaaatacatagcaa

SEQ ID NO: 349319 - DNA, 25 bp, Rattus norvegicus
gagggcagcctgtaatacatagcaa

SEQ ID NO: 349320 - DNA, 25 bp, Rattus norvegicus
gagggcagctgaaggttacccagac

SEQ ID NO: 349321 - DNA, 25 bp, Rattus norvegicus
gagggcagctgacaacaacggtata

SEQ ID NO: 349322 - DNA, 25 bp, Rattus norvegicus
gagggcagctgagaacaacggtata

SEQ ID NO: 349323 - DNA, 25 bp, Rattus norvegicus
gagggcagctgatggttacccagac

SEQ ID NO: 349324 - DNA, 25 bp, Rattus norvegicus
gagggcagcttcctgaggtccactc

SEQ ID NO: 349325 - DNA, 25 bp, Rattus norvegicus
gagggcagcttcgtgaggtccactc

SEQ ID NO: 349326 - DNA, 25 bp, Rattus norvegicus
gagggcagctttataaagttaccaa

SEQ ID NO: 349327 - DNA, 25 bp, Rattus norvegicus
gagggcagctttttaaagttaccaa

SEQ ID NO: 349328 - DNA, 25 bp, Rattus norvegicus
gagggcaggcatactccagagacct

SEQ ID NO: 349329 - DNA, 25 bp, Rattus norvegicus
gagggcaggcattctccagagacct

SEQ ID NO: 349330 - DNA, 25 bp, Rattus norvegicus
gagggcaggctgattttgcctaaat

SEQ ID NO: 349331 - DNA, 25 bp, Rattus norvegicus
gagggcaggctgtttttgcctaaat

SEQ ID NO: 349332 - DNA, 25 bp, Rattus norvegicus
gagggcagtcaaatcctgcctgaaa

SEQ ID NO: 349333 - DNA, 25 bp, Rattus norvegicus
gagggcagtcaattcctgcctgaaa

SEQ ID NO: 349334 - DNA, 25 bp, Rattus norvegicus
gagggcagtcagcactttctgttga

SEQ ID NO: 349335 - DNA, 25 bp, Rattus norvegicus
gagggcagtcaggactttctgttga

SEQ ID NO: 349336 - DNA, 25 bp, Rattus norvegicus
gagggcagtgggaagtcaccacttt

SEQ ID NO: 349337 - DNA, 25 bp, Rattus norvegicus
gagggcagtgggtagtcaccacttt

SEQ ID NO: 349338 - DNA, 25 bp, Rattus norvegicus
gagggcagtgtcaccaagccacaga

SEQ ID NO: 349339 - DNA, 25 bp, Rattus norvegicus
gagggcagtgtctccaagccacaga

SEQ ID NO: 349340 - DNA, 25 bp, Rattus norvegicus
gagggcagttatacccagaacaact

SEQ ID NO: 349341 - DNA, 25 bp, Rattus norvegicus
gagggcagttattcccagaacaact

SEQ ID NO: 349342 - DNA, 25 bp, Rattus norvegicus
gagggcatacaaccatttgcaacaa

SEQ ID NO: 349343 - DNA, 25 bp, Rattus norvegicus
gagggcatacaagcatttgcaacaa

SEQ ID NO: 349344 - DNA, 25 bp, Rattus norvegicus
gagggcatagccacagcagatactg

SEQ ID NO: 349345 - DNA, 25 bp, Rattus norvegicus
gagggcatagcctcagcagatactg

SEQ ID NO: 349346 - DNA, 25 bp, Rattus norvegicus
gagggcatatcaccttcaaaactct

SEQ ID NO: 349347 - DNA, 25 bp, Rattus norvegicus
gagggcatatcagcttcaaaactct

SEQ ID NO: 349348 - DNA, 25 bp, Rattus norvegicus
gagggcatcaaacagacctttggct

SEQ ID NO: 349349 - DNA, 25 bp, Rattus norvegicus
gagggcatcaaagagacctttggct

SEQ ID NO: 349350 - DNA, 25 bp, Rattus norvegicus
gagggcatcagtacacaagttgtga

SEQ ID NO: 349351 - DNA, 25 bp, Rattus norvegicus
gagggcatcagtagcctttgtccta

SEQ ID NO: 349352 - DNA, 25 bp, Rattus norvegicus
gagggcatcagttcacaagttgtga

SEQ ID NO: 349353 - DNA, 25 bp, Rattus norvegicus
gagggcatcagttgcctttgtccta

SEQ ID NO: 349354 - DNA, 25 bp, Rattus norvegicus
gagggcatcgagaccgcaggaccct

SEQ ID NO: 349355 - DNA, 25 bp, Rattus norvegicus
gagggcatcgagtccgcaggaccct

SEQ ID NO: 349356 - DNA, 25 bp, Rattus norvegicus
gagggcatcgtaactgttcactgca

SEQ ID NO: 349357 - DNA, 25 bp, Rattus norvegicus
gagggcatcgtatctgttcactgca

SEQ ID NO: 349358 - DNA, 25 bp, Rattus norvegicus
gagggcatctaactagatctctctg

SEQ ID NO: 349359 - DNA, 25 bp, Rattus norvegicus
gagggcatctaagtagatctctctg

SEQ ID NO: 349360 - DNA, 25 bp, Rattus norvegicus
gagggcatctgccttactgattaaa

SEQ ID NO: 349361 - DNA, 25 bp, Rattus norvegicus
gagggcatctgcgttactgattaaa

SEQ ID NO: 349362 - DNA, 25 bp, Rattus norvegicus
gagggcatctggataccttggttac

SEQ ID NO: 349363 - DNA, 25 bp, Rattus norvegicus
gagggcatctggttaccttggttac

SEQ ID NO: 349364 - DNA, 25 bp, Rattus norvegicus
gagggcatctttaatacttgagcaa

SEQ ID NO: 349365 - DNA, 25 bp, Rattus norvegicus
gagggcatcttttatacttgagcaa

SEQ ID NO: 349366 - DNA, 25 bp, Rattus norvegicus
gagggcatgctgcacactggatctc

SEQ ID NO: 349367 - DNA, 25 bp, Rattus norvegicus
gagggcatgctggacactggatctc

SEQ ID NO: 349368 - DNA, 25 bp, Rattus norvegicus
gagggcatggcacttatgccttcca

SEQ ID NO: 349369 - DNA, 25 bp, Rattus norvegicus
gagggcatggcagttatgccttcca

SEQ ID NO: 349370 - DNA, 25 bp, Rattus norvegicus
gagggcatgtataagttattggaaa

SEQ ID NO: 349371 - DNA, 25 bp, Rattus norvegicus
gagggcatgtattagttattggaaa

SEQ ID NO: 349372 - DNA, 25 bp, Rattus norvegicus
gagggcatgtttagttttctatgaa

SEQ ID NO: 349373 - DNA, 25 bp, Rattus norvegicus
gagggcatgttttgttttctatgaa

SEQ ID NO: 349374 - DNA, 25 bp, Rattus norvegicus
gagggcattccaatggtcagcagat

SEQ ID NO: 349375 - DNA, 25 bp, Rattus norvegicus
gagggcattccattggtcagcagat

SEQ ID NO: 349376 - DNA, 25 bp, Rattus norvegicus
gagggcattctaataaacatggttc

SEQ ID NO: 349377 - DNA, 25 bp, Rattus norvegicus
gagggcattctacgttcaggcaata

SEQ ID NO: 349378 - DNA, 25 bp, Rattus norvegicus
gagggcattctaggttcaggcaata

SEQ ID NO: 349379 - DNA, 25 bp, Rattus norvegicus
gagggcattctattaaacatggttc

SEQ ID NO: 349380 - DNA, 25 bp, Rattus norvegicus
gagggcattgttacataggccatta

SEQ ID NO: 349381 - DNA, 25 bp, Rattus norvegicus
gagggcattgttagtccaagtactt

SEQ ID NO: 349382 - DNA, 25 bp, Rattus norvegicus
gagggcattgtttcataggccatta

SEQ ID NO: 349383 - DNA, 25 bp, Rattus norvegicus
gagggcattgtttgtccaagtactt

SEQ ID NO: 349384 - DNA, 25 bp, Rattus norvegicus
gagggcatttcgatggccttgtagt

SEQ ID NO: 349385 - DNA, 25 bp, Rattus norvegicus
gagggcatttcgttggccttgtagt

SEQ ID NO: 349386 - DNA, 25 bp, Rattus norvegicus
gagggcattttgctcttcagttcaa

SEQ ID NO: 349387 - DNA, 25 bp, Rattus norvegicus
gagggcattttggtcttcagttcaa

SEQ ID NO: 349388 - DNA, 25 bp, Rattus norvegicus
gagggccaagcgaagtcccaagcat

SEQ ID NO: 349389 - DNA, 25 bp, Rattus norvegicus
gagggccaagcgtagtcccaagcat

SEQ ID NO: 349390 - DNA, 25 bp, Rattus norvegicus
gagggccacaaacatcacttgggaa

SEQ ID NO: 349391 - DNA, 25 bp, Rattus norvegicus
gagggccacaaagatcacttgggaa

SEQ ID NO: 349392 - DNA, 25 bp, Rattus norvegicus
gagggccacagcagtgactggcaca

SEQ ID NO: 349393 - DNA, 25 bp, Rattus norvegicus
gagggccacagctgtgactggcaca

SEQ ID NO: 349394 - DNA, 25 bp, Rattus norvegicus
gagggccacaggaaaaccgtgacaa

SEQ ID NO: 349395 - DNA, 25 bp, Rattus norvegicus
gagggccacaggtaaaccgtgacaa

SEQ ID NO: 349396 - DNA, 25 bp, Rattus norvegicus
gagggccacatgaattcactattca

SEQ ID NO: 349397 - DNA, 25 bp, Rattus norvegicus
gagggccacatgagtgtccacaact

SEQ ID NO: 349398 - DNA, 25 bp, Rattus norvegicus
gagggccacatgtattcactattca

SEQ ID NO: 349399 - DNA, 25 bp, Rattus norvegicus
gagggccacatgtgtgtccacaact

SEQ ID NO: 349400 - DNA, 25 bp, Rattus norvegicus
gagggccaccagattcatcaatttt

SEQ ID NO: 349401 - DNA, 25 bp, Rattus norvegicus
gagggccaccagtttcatcaatttt

SEQ ID NO: 349402 - DNA, 25 bp, Rattus norvegicus
gagggccaccataaagaatgttcta

SEQ ID NO: 349403 - DNA, 25 bp, Rattus norvegicus
gagggccaccattaagaatgttcta

SEQ ID NO: 349404 - DNA, 25 bp, Rattus norvegicus
gagggccagctacgagtttgactct

SEQ ID NO: 349405 - DNA, 25 bp, Rattus norvegicus
gagggccagctaggagtttgactct

SEQ ID NO: 349406 - DNA, 25 bp, Rattus norvegicus
gagggccagggaattttacaatttg

SEQ ID NO: 349407 - DNA, 25 bp, Rattus norvegicus
gagggccagggatttttacaatttg

SEQ ID NO: 349408 - DNA, 25 bp, Rattus norvegicus
gagggccaggttagaagtcattgta

SEQ ID NO: 349409 - DNA, 25 bp, Rattus norvegicus
gagggccaggtttgaagtcattgta

SEQ ID NO: 349410 - DNA, 25 bp, Rattus norvegicus
gagggccatattctacttgaacttg

SEQ ID NO: 349411 - DNA, 25 bp, Rattus norvegicus
gagggccatattgtacttgaacttg

SEQ ID NO: 349412 - DNA, 25 bp, Rattus norvegicus
gagggccatctgacccggcagctct

SEQ ID NO: 349413 - DNA, 25 bp, Rattus norvegicus
gagggccatctgtcccggcagctct

SEQ ID NO: 349414 - DNA, 25 bp, Rattus norvegicus
gagggccatgctaagtatatctgct

SEQ ID NO: 349415 - DNA, 25 bp, Rattus norvegicus
gagggccatgcttagtatatctgct

SEQ ID NO: 349416 - DNA, 25 bp, Rattus norvegicus
gagggccattagagttaagcagtca

SEQ ID NO: 349417 - DNA, 25 bp, Rattus norvegicus
gagggccattagatgatctgtcgct

SEQ ID NO: 349418 - DNA, 25 bp, Rattus norvegicus
gagggccattagtgttaagcagtca

SEQ ID NO: 349419 - DNA, 25 bp, Rattus norvegicus
gagggccattagttgatctgtcgct

SEQ ID NO: 349420 - DNA, 25 bp, Rattus norvegicus
gagggcccaaaaccacttgtaactt

SEQ ID NO: 349421 - DNA, 25 bp, Rattus norvegicus
gagggcccaaaagcacttgtaactt

SEQ ID NO: 349422 - DNA, 25 bp, Rattus norvegicus
gagggcccaaagaaaggcgtgttct

SEQ ID NO: 349423 - DNA, 25 bp, Rattus norvegicus
gagggcccaaagtaaggcgtgttct

SEQ ID NO: 349424 - DNA, 25 bp, Rattus norvegicus
gagggcccaatacagtcaatcccag

SEQ ID NO: 349425 - DNA, 25 bp, Rattus norvegicus
gagggcccaatagagtcaatcccag

SEQ ID NO: 349426 - DNA, 25 bp, Rattus norvegicus
gagggcccactccacgtactgaaga

SEQ ID NO: 349427 - DNA, 25 bp, Rattus norvegicus
gagggcccactcgacgtactgaaga

SEQ ID NO: 349428 - DNA, 25 bp, Rattus norvegicus
gagggcccagagcatgtttagaacc

SEQ ID NO: 349429 - DNA, 25 bp, Rattus norvegicus
gagggcccagaggatgtttagaacc

SEQ ID NO: 349430 - DNA, 25 bp, Rattus norvegicus
gagggcccagccctatacatactgg

SEQ ID NO: 349431 - DNA, 25 bp, Rattus norvegicus
gagggcccagccgtatacatactgg

SEQ ID NO: 349432 - DNA, 25 bp, Rattus norvegicus
gagggcccagttagatcgacgtacg

SEQ ID NO: 349433 - DNA, 25 bp, Rattus norvegicus
gagggcccagtttgatcgacgtacg

SEQ ID NO: 349434 - DNA, 25 bp, Rattus norvegicus
gagggcccatgaagatgtttcggaa

SEQ ID NO: 349435 - DNA, 25 bp, Rattus norvegicus
gagggcccatgatgatgtttcggaa

SEQ ID NO: 349436 - DNA, 25 bp, Rattus norvegicus
gagggcccatgtagtgacgcagact

SEQ ID NO: 349437 - DNA, 25 bp, Rattus norvegicus
gagggcccatgttgtgacgcagact

SEQ ID NO: 349438 - DNA, 25 bp, Rattus norvegicus
gagggccccgagcatatccgccaag

SEQ ID NO: 349439 - DNA, 25 bp, Rattus norvegicus
gagggccccgaggatatccgccaag

SEQ ID NO: 349440 - DNA, 25 bp, Rattus norvegicus
gagggcccctgcagttgaacacgaa

SEQ ID NO: 349441 - DNA, 25 bp, Rattus norvegicus
gagggcccctgctgttgaacacgaa

SEQ ID NO: 349442 - DNA, 25 bp, Rattus norvegicus
gagggcccgaatcgtctttttcatc

SEQ ID NO: 349443 - DNA, 25 bp, Rattus norvegicus
gagggcccgaatggtctttttcatc

SEQ ID NO: 349444 - DNA, 25 bp, Rattus norvegicus
gagggcccgtggaagatgacaccaa

SEQ ID NO: 349445 - DNA, 25 bp, Rattus norvegicus
gagggcccgtggtagatgacaccaa

SEQ ID NO: 349446 - DNA, 25 bp, Rattus norvegicus
gagggccctgcgagaagactcagtc

SEQ ID NO: 349447 - DNA, 25 bp, Rattus norvegicus
gagggccctgcgtgaagactcagtc

SEQ ID NO: 349448 - DNA, 25 bp, Rattus norvegicus
gagggccctgctacaagagtagcca

SEQ ID NO: 349449 - DNA, 25 bp, Rattus norvegicus
gagggccctgcttcaagagtagcca

SEQ ID NO: 349450 - DNA, 25 bp, Rattus norvegicus
gagggcctaaggaacgtgcattgtt

SEQ ID NO: 349451 - DNA, 25 bp, Rattus norvegicus
gagggcctaaggtacgtgcattgtt

SEQ ID NO: 349452 - DNA, 25 bp, Rattus norvegicus
gagggcctagagagacttaaccatt

SEQ ID NO: 349453 - DNA, 25 bp, Rattus norvegicus
gagggcctagagtgacttaaccatt

SEQ ID NO: 349454 - DNA, 25 bp, Rattus norvegicus
gagggcctagtgataatggacacaa

SEQ ID NO: 349455 - DNA, 25 bp, Rattus norvegicus
gagggcctagtgttaatggacacaa

SEQ ID NO: 349456 - DNA, 25 bp, Rattus norvegicus
gagggcctatatctgcaatctgtaa

SEQ ID NO: 349457 - DNA, 25 bp, Rattus norvegicus
gagggcctatatgtgcaatctgtaa

SEQ ID NO: 349458 - DNA, 25 bp, Rattus norvegicus
gagggcctatctaaggataaccttt

SEQ ID NO: 349459 - DNA, 25 bp, Rattus norvegicus
gagggcctatcttaggataaccttt

SEQ ID NO: 349460 - DNA, 25 bp, Rattus norvegicus
gagggcctcagcattaaaatagttt

SEQ ID NO: 349461 - DNA, 25 bp, Rattus norvegicus
gagggcctcagctttaaaatagttt

SEQ ID NO: 349462 - DNA, 25 bp, Rattus norvegicus
gagggcctcctcatagattccaaaa

SEQ ID NO: 349463 - DNA, 25 bp, Rattus norvegicus
gagggcctcctcttagattccaaaa

SEQ ID NO: 349464 - DNA, 25 bp, Rattus norvegicus
gagggcctccttcaagtaaggctct

SEQ ID NO: 349465 - DNA, 25 bp, Rattus norvegicus
gagggcctccttgaagtaaggctct

SEQ ID NO: 349466 - DNA, 25 bp, Rattus norvegicus
gagggcctgaccaccagagtccagt

SEQ ID NO: 349467 - DNA, 25 bp, Rattus norvegicus
gagggcctgacctccagagtccagt

SEQ ID NO: 349468 - DNA, 25 bp, Rattus norvegicus
gagggcctgtagacagtactctttc

SEQ ID NO: 349469 - DNA, 25 bp, Rattus norvegicus
gagggcctgtagtcagtactctttc

SEQ ID NO: 349470 - DNA, 25 bp, Rattus norvegicus
gagggcctgttgaagaattctctcc

SEQ ID NO: 349471 - DNA, 25 bp, Rattus norvegicus
gagggcctgttgtagaattctctcc

SEQ ID NO: 349472 - DNA, 25 bp, Rattus norvegicus
gagggccttaaacacttggaacagc

SEQ ID NO: 349473 - DNA, 25 bp, Rattus norvegicus
gagggccttaaagacttggaacagc

SEQ ID NO: 349474 - DNA, 25 bp, Rattus norvegicus
gagggccttggaatcaatatcatgg

SEQ ID NO: 349475 - DNA, 25 bp, Rattus norvegicus
gagggccttggattcaatatcatgg

SEQ ID NO: 349476 - DNA, 25 bp, Rattus norvegicus
gagggccttttccaatacagcaact

SEQ ID NO: 349477 - DNA, 25 bp, Rattus norvegicus
gagggccttttcgaatacagcaact

SEQ ID NO: 349478 - DNA, 25 bp, Rattus norvegicus
gagggcgaccttcagtgcctccctg

SEQ ID NO: 349479 - DNA, 25 bp, Rattus norvegicus
gagggcgaccttgagtgcctccctg

SEQ ID NO: 349480 - DNA, 25 bp, Rattus norvegicus
gagggcgacgctcacgttgtcttct

SEQ ID NO: 349481 - DNA, 25 bp, Rattus norvegicus
gagggcgacgctgacgttgtcttct

SEQ ID NO: 349482 - DNA, 25 bp, Rattus norvegicus
gagggcgagagcacccctggaacca

SEQ ID NO: 349483 - DNA, 25 bp, Rattus norvegicus
gagggcgagagctcccctggaacca

SEQ ID NO: 349484 - DNA, 25 bp, Rattus norvegicus
gagggcgaggatcctcacctttcat

SEQ ID NO: 349485 - DNA, 25 bp, Rattus norvegicus
gagggcgaggatgctcacctttcat

SEQ ID NO: 349486 - DNA, 25 bp, Rattus norvegicus
gagggcgataacaacagcagcttca

SEQ ID NO: 349487 - DNA, 25 bp, Rattus norvegicus
gagggcgataactacagcagcttca

SEQ ID NO: 349488 - DNA, 25 bp, Rattus norvegicus
gagggcgccaccaaagacctttgag

SEQ ID NO: 349489 - DNA, 25 bp, Rattus norvegicus
gagggcgccacctaagacctttgag

SEQ ID NO: 349490 - DNA, 25 bp, Rattus norvegicus
gagggcgccataccaataagctccg

SEQ ID NO: 349491 - DNA, 25 bp, Rattus norvegicus
gagggcgccatagcaataagctccg

SEQ ID NO: 349492 - DNA, 25 bp, Rattus norvegicus
gagggcgccccaactgcatgaatct

SEQ ID NO: 349493 - DNA, 25 bp, Rattus norvegicus
gagggcgccccatctgcatgaatct

SEQ ID NO: 349494 - DNA, 25 bp, Rattus norvegicus
gagggcgccctacagaaatggactt

SEQ ID NO: 349495 - DNA, 25 bp, Rattus norvegicus
gagggcgccctagagaaatggactt

SEQ ID NO: 349496 - DNA, 25 bp, Rattus norvegicus
gagggcgccttccagagcaagacat

SEQ ID NO: 349497 - DNA, 25 bp, Rattus norvegicus
gagggcgccttcgagagcaagacat

SEQ ID NO: 349498 - DNA, 25 bp, Rattus norvegicus
gagggcgcgcaacaccagaaacata

SEQ ID NO: 349499 - DNA, 25 bp, Rattus norvegicus
gagggcgcgcaagaccagaaacata

SEQ ID NO: 349500 - DNA, 25 bp, Rattus norvegicus
gagggcgcggaactaccacagctta

SEQ ID NO: 349501 - DNA, 25 bp, Rattus norvegicus
gagggcgcggaagtaccacagctta

SEQ ID NO: 349502 - DNA, 25 bp, Rattus norvegicus
gagggcgcgtatagtttgttatata

SEQ ID NO: 349503 - DNA, 25 bp, Rattus norvegicus
gagggcgcgtattgtttgttatata

SEQ ID NO: 349504 - DNA, 25 bp, Rattus norvegicus
gagggcgctgtgattgctcacttat

SEQ ID NO: 349505 - DNA, 25 bp, Rattus norvegicus
gagggcgctgtgtttgctcacttat

SEQ ID NO: 349506 - DNA, 25 bp, Rattus norvegicus
gagggcgcttctcagaagtctcgct

SEQ ID NO: 349507 - DNA, 25 bp, Rattus norvegicus
gagggcgcttctgagaagtctcgct

SEQ ID NO: 349508 - DNA, 25 bp, Rattus norvegicus
gagggcggccgtcaatatcgaattc

SEQ ID NO: 349509 - DNA, 25 bp, Rattus norvegicus
gagggcggccgtgaatatcgaattc

SEQ ID NO: 349510 - DNA, 25 bp, Rattus norvegicus
gagggcggcttactcaccagtgact

SEQ ID NO: 349511 - DNA, 25 bp, Rattus norvegicus
gagggcggcttagtcaccagtgact

SEQ ID NO: 349512 - DNA, 25 bp, Rattus norvegicus
gagggcggttacattaatgcttgca

SEQ ID NO: 349513 - DNA, 25 bp, Rattus norvegicus
gagggcggttactttaatgcttgca

SEQ ID NO: 349514 - DNA, 25 bp, Rattus norvegicus
gagggcgtagttaaatatctgctta

SEQ ID NO: 349515 - DNA, 25 bp, Rattus norvegicus
gagggcgtagtttaatatctgctta

SEQ ID NO: 349516 - DNA, 25 bp, Rattus norvegicus
gagggcgtcggcaccacagcctaag

SEQ ID NO: 349517 - DNA, 25 bp, Rattus norvegicus
gagggcgtcggctccacagcctaag

SEQ ID NO: 349518 - DNA, 25 bp, Rattus norvegicus
gagggcgtgagacttccctgtcctt

SEQ ID NO: 349519 - DNA, 25 bp, Rattus norvegicus
gagggcgtgagagttccctgtcctt

SEQ ID NO: 349520 - DNA, 25 bp, Rattus norvegicus
gagggcgtgcatagccatcttaaca

SEQ ID NO: 349521 - DNA, 25 bp, Rattus norvegicus
gagggcgtgcattgccatcttaaca

SEQ ID NO: 349522 - DNA, 25 bp, Rattus norvegicus
gagggcgtggccctattttagaata

SEQ ID NO: 349523 - DNA, 25 bp, Rattus norvegicus
gagggcgtggccgtattttagaata

SEQ ID NO: 349524 - DNA, 25 bp, Rattus norvegicus
gagggctaatatccaatacatatat

SEQ ID NO: 349525 - DNA, 25 bp, Rattus norvegicus
gagggctaatatgcaatacatatat

SEQ ID NO: 349526 - DNA, 25 bp, Rattus norvegicus
gagggctacaatctgttttacaaat

SEQ ID NO: 349527 - DNA, 25 bp, Rattus norvegicus
gagggctacaatgtgttttacaaat

SEQ ID NO: 349528 - DNA, 25 bp, Rattus norvegicus
gagggctacctgaggagatccatgt

SEQ ID NO: 349529 - DNA, 25 bp, Rattus norvegicus
gagggctacctgtggagatccatgt

SEQ ID NO: 349530 - DNA, 25 bp, Rattus norvegicus
gagggctacgatacatcttcagttg

SEQ ID NO: 349531 - DNA, 25 bp, Rattus norvegicus
gagggctacgattcatcttcagttg

SEQ ID NO: 349532 - DNA, 25 bp, Rattus norvegicus
gagggctactgcaaaacagctctgg

SEQ ID NO: 349533 - DNA, 25 bp, Rattus norvegicus
gagggctactgctaaacagctctgg

SEQ ID NO: 349534 - DNA, 25 bp, Rattus norvegicus
gagggctaggtgattaggcttcctt

SEQ ID NO: 349535 - DNA, 25 bp, Rattus norvegicus
gagggctaggtgtttaggcttcctt

SEQ ID NO: 349536 - DNA, 25 bp, Rattus norvegicus
gagggctatctgcttcagttggcca

SEQ ID NO: 349537 - DNA, 25 bp, Rattus norvegicus
gagggctatctggttcagttggcca

SEQ ID NO: 349538 - DNA, 25 bp, Rattus norvegicus
gagggctcaagacgacattccgtcc

SEQ ID NO: 349539 - DNA, 25 bp, Rattus norvegicus
gagggctcaagaggacattccgtcc

SEQ ID NO: 349540 - DNA, 25 bp, Rattus norvegicus
gagggctcactgcttcgtgtgattc

SEQ ID NO: 349541 - DNA, 25 bp, Rattus norvegicus
gagggctcactggttcgtgtgattc

SEQ ID NO: 349542 - DNA, 25 bp, Rattus norvegicus
gagggctcagaaaagtcagcagtaa

SEQ ID NO: 349543 - DNA, 25 bp, Rattus norvegicus
gagggctcagaatagtcagcagtaa

SEQ ID NO: 349544 - DNA, 25 bp, Rattus norvegicus
gagggctcagagctcatcaacagca

SEQ ID NO: 349545 - DNA, 25 bp, Rattus norvegicus
gagggctcagaggtcatcaacagca

SEQ ID NO: 349546 - DNA, 25 bp, Rattus norvegicus
gagggctcctatcggcatcttctca

SEQ ID NO: 349547 - DNA, 25 bp, Rattus norvegicus
gagggctcctatgggcatcttctca

SEQ ID NO: 349548 - DNA, 25 bp, Rattus norvegicus
gagggctcctgcagtacagacggtc

SEQ ID NO: 349549 - DNA, 25 bp, Rattus norvegicus
gagggctcctgctgtacagacggtc

SEQ ID NO: 349550 - DNA, 25 bp, Rattus norvegicus
gagggctctcttattaacatgtaat

SEQ ID NO: 349551 - DNA, 25 bp, Rattus norvegicus
gagggctctctttttaacatgtaat

SEQ ID NO: 349552 - DNA, 25 bp, Rattus norvegicus
gagggctctgttccgtcacactcta

SEQ ID NO: 349553 - DNA, 25 bp, Rattus norvegicus
gagggctctgttgcgtcacactcta

SEQ ID NO: 349554 - DNA, 25 bp, Rattus norvegicus
gagggctcttcaccgtcacaagcca

SEQ ID NO: 349555 - DNA, 25 bp, Rattus norvegicus
gagggctcttcagcgtcacaagcca

SEQ ID NO: 349556 - DNA, 25 bp, Rattus norvegicus
gagggctcttcccacataaagattt

SEQ ID NO: 349557 - DNA, 25 bp, Rattus norvegicus
gagggctcttccgacataaagattt

SEQ ID NO: 349558 - DNA, 25 bp, Rattus norvegicus
gagggctcttgacaacttacacaaa

SEQ ID NO: 349559 - DNA, 25 bp, Rattus norvegicus
gagggctcttgagaacttacacaaa

SEQ ID NO: 349560 - DNA, 25 bp, Rattus norvegicus
gagggctcttgcatgtacatggtgc

SEQ ID NO: 349561 - DNA, 25 bp, Rattus norvegicus
gagggctcttgcttgtacatggtgc

SEQ ID NO: 349562 - DNA, 25 bp, Rattus norvegicus
gagggctctttaatatcgatgacaa

SEQ ID NO: 349563 - DNA, 25 bp, Rattus norvegicus
gagggctctttattatcgatgacaa

SEQ ID NO: 349564 - DNA, 25 bp, Rattus norvegicus
gagggctgaagaaactccattctag

SEQ ID NO: 349565 - DNA, 25 bp, Rattus norvegicus
gagggctgaagatactccattctag

SEQ ID NO: 349566 - DNA, 25 bp, Rattus norvegicus
gagggctgaattacctgcatttagg

SEQ ID NO: 349567 - DNA, 25 bp, Rattus norvegicus
gagggctgaatttcctgcatttagg

SEQ ID NO: 349568 - DNA, 25 bp, Rattus norvegicus
gagggctgacccacaagaccacgag

SEQ ID NO: 349569 - DNA, 25 bp, Rattus norvegicus
gagggctgaccctcaagaccacgag

SEQ ID NO: 349570 - DNA, 25 bp, Rattus norvegicus
gagggctgagaacttcaatgttcaa

SEQ ID NO: 349571 - DNA, 25 bp, Rattus norvegicus
gagggctgagaagttcaatgttcaa

SEQ ID NO: 349572 - DNA, 25 bp, Rattus norvegicus
gagggctgcaatccaccatgggtca

SEQ ID NO: 349573 - DNA, 25 bp, Rattus norvegicus
gagggctgcaatgcaccatgggtca

SEQ ID NO: 349574 - DNA, 25 bp, Rattus norvegicus
gagggctgcaccaataaagtcccag

SEQ ID NO: 349575 - DNA, 25 bp, Rattus norvegicus
gagggctgcaccctgatgatcacat

SEQ ID NO: 349576 - DNA, 25 bp, Rattus norvegicus
gagggctgcaccgtgatgatcacat

SEQ ID NO: 349577 - DNA, 25 bp, Rattus norvegicus
gagggctgcacctataaagtcccag

SEQ ID NO: 349578 - DNA, 25 bp, Rattus norvegicus
gagggctgcagccttctccaagaac

SEQ ID NO: 349579 - DNA, 25 bp, Rattus norvegicus
gagggctgcagcgttctccaagaac

SEQ ID NO: 349580 - DNA, 25 bp, Rattus norvegicus
gagggctgccctacaaagcaacgga

SEQ ID NO: 349581 - DNA, 25 bp, Rattus norvegicus
gagggctgcccttcaaagcaacgga

SEQ ID NO: 349582 - DNA, 25 bp, Rattus norvegicus
gagggctgccttaaactccgagggt

SEQ ID NO: 349583 - DNA, 25 bp, Rattus norvegicus
gagggctgcctttaactccgagggt

SEQ ID NO: 349584 - DNA, 25 bp, Rattus norvegicus
gagggctggctcaaggaagctaaac

SEQ ID NO: 349585 - DNA, 25 bp, Rattus norvegicus
gagggctggctctaggaagctaaac

SEQ ID NO: 349586 - DNA, 25 bp, Rattus norvegicus
gagggctggtcccagtacacacaaa

SEQ ID NO: 349587 - DNA, 25 bp, Rattus norvegicus
gagggctggtccgagtacacacaaa

SEQ ID NO: 349588 - DNA, 25 bp, Rattus norvegicus
gagggctgtcctaatgattacaaac

SEQ ID NO: 349589 - DNA, 25 bp, Rattus norvegicus
gagggctgtccttatgattacaaac

SEQ ID NO: 349590 - DNA, 25 bp, Rattus norvegicus
gagggctgtgtgagatcttgaactt

SEQ ID NO: 349591 - DNA, 25 bp, Rattus norvegicus
gagggctgtgtgtgatcttgaactt

SEQ ID NO: 349592 - DNA, 25 bp, Rattus norvegicus
gagggcttaactattctttgagaga

SEQ ID NO: 349593 - DNA, 25 bp, Rattus norvegicus
gagggcttaacttttctttgagaga

SEQ ID NO: 349594 - DNA, 25 bp, Rattus norvegicus
gagggcttaggtactcagcctgtct

SEQ ID NO: 349595 - DNA, 25 bp, Rattus norvegicus
gagggcttaggttctcagcctgtct

SEQ ID NO: 349596 - DNA, 25 bp, Rattus norvegicus
gagggcttcaaaaaatccccaagat

SEQ ID NO: 349597 - DNA, 25 bp, Rattus norvegicus
gagggcttcaaataatccccaagat

SEQ ID NO: 349598 - DNA, 25 bp, Rattus norvegicus
gagggcttccaacacagggtgaaac

SEQ ID NO: 349599 - DNA, 25 bp, Rattus norvegicus
gagggcttccaagacagggtgaaac

SEQ ID NO: 349600 - DNA, 25 bp, Rattus norvegicus
gagggcttccggcagcttgatcctc

SEQ ID NO: 349601 - DNA, 25 bp, Rattus norvegicus
gagggcttccgggagcttgatcctc

SEQ ID NO: 349602 - DNA, 25 bp, Rattus norvegicus
gagggcttcctgagatctaactatg

SEQ ID NO: 349603 - DNA, 25 bp, Rattus norvegicus
gagggcttcctgtgatctaactatg

SEQ ID NO: 349604 - DNA, 25 bp, Rattus norvegicus
gagggcttcggacgtgaggatgtga

SEQ ID NO: 349605 - DNA, 25 bp, Rattus norvegicus
gagggcttcggaggtgaggatgtga

SEQ ID NO: 349606 - DNA, 25 bp, Rattus norvegicus
gagggcttctatcccatggtgacct

SEQ ID NO: 349607 - DNA, 25 bp, Rattus norvegicus
gagggcttctatgccatggtgacct

SEQ ID NO: 349608 - DNA, 25 bp, Rattus norvegicus
gagggcttcttaatcccttatgagg

SEQ ID NO: 349609 - DNA, 25 bp, Rattus norvegicus
gagggcttcttacactgcagcaaag

SEQ ID NO: 349610 - DNA, 25 bp, Rattus norvegicus
gagggcttcttagactgcagcaaag

SEQ ID NO: 349611 - DNA, 25 bp, Rattus norvegicus
gagggcttcttattcccttatgagg

SEQ ID NO: 349612 - DNA, 25 bp, Rattus norvegicus
gagggcttgagaccagtctctccaa

SEQ ID NO: 349613 - DNA, 25 bp, Rattus norvegicus
gagggcttgagagcagtctctccaa

SEQ ID NO: 349614 - DNA, 25 bp, Rattus norvegicus
gagggcttgcctcagatgagccaaa

SEQ ID NO: 349615 - DNA, 25 bp, Rattus norvegicus
gagggcttgcctgagatgagccaaa

SEQ ID NO: 349616 - DNA, 25 bp, Rattus norvegicus
gagggcttgctaaagcaccatctgc

SEQ ID NO: 349617 - DNA, 25 bp, Rattus norvegicus
gagggcttgctatagcaccatctgc

SEQ ID NO: 349618 - DNA, 25 bp, Rattus norvegicus
gagggcttgggaatcatgagctatt

SEQ ID NO: 349619 - DNA, 25 bp, Rattus norvegicus
gagggcttgggattcatgagctatt

SEQ ID NO: 349620 - DNA, 25 bp, Rattus norvegicus
gagggcttgtgaagccaccgcatga

SEQ ID NO: 349621 - DNA, 25 bp, Rattus norvegicus
gagggcttgtgatgccaccgcatga

SEQ ID NO: 349622 - DNA, 25 bp, Rattus norvegicus
gagggctttacacatgctaaccact

SEQ ID NO: 349623 - DNA, 25 bp, Rattus norvegicus
gagggctttacagatgctaaccact

SEQ ID NO: 349624 - DNA, 25 bp, Rattus norvegicus
gagggctttcaacatccagcactgt

SEQ ID NO: 349625 - DNA, 25 bp, Rattus norvegicus
gagggctttcaagatccagcactgt

SEQ ID NO: 349626 - DNA, 25 bp, Rattus norvegicus
gagggctttcatagtcttgactcat

SEQ ID NO: 349627 - DNA, 25 bp, Rattus norvegicus
gagggctttcattgtcttgactcat

SEQ ID NO: 349628 - DNA, 25 bp, Rattus norvegicus
gagggctttcctaggtaaccgcttg

SEQ ID NO: 349629 - DNA, 25 bp, Rattus norvegicus
gagggctttccttggtaaccgcttg

SEQ ID NO: 349630 - DNA, 25 bp, Rattus norvegicus
gagggctttgagaacttagagcaag

SEQ ID NO: 349631 - DNA, 25 bp, Rattus norvegicus
gagggctttgagtacttagagcaag

SEQ ID NO: 349632 - DNA, 25 bp, Rattus norvegicus
gagggctttgcacacaaatgtaact

SEQ ID NO: 349633 - DNA, 25 bp, Rattus norvegicus
gagggctttgcagacaaatgtaact

SEQ ID NO: 349634 - DNA, 25 bp, Rattus norvegicus
gagggctttggaaagccttccagat

SEQ ID NO: 349635 - DNA, 25 bp, Rattus norvegicus
gagggctttggatagccttccagat

SEQ ID NO: 349636 - DNA, 25 bp, Rattus norvegicus
gagggcttttctactgtgcctaaaa

SEQ ID NO: 349637 - DNA, 25 bp, Rattus norvegicus
gagggcttttcttctgtgcctaaaa

SEQ ID NO: 349638 - DNA, 25 bp, Rattus norvegicus
gagggcttttgtccgctcctcggat

SEQ ID NO: 349639 - DNA, 25 bp, Rattus norvegicus
gagggcttttgtgcgctcctcggat

SEQ ID NO: 349640 - DNA, 25 bp, Rattus norvegicus
gagggctttttcaccattaagattc

SEQ ID NO: 349641 - DNA, 25 bp, Rattus norvegicus
gagggctttttctccattaagattc

SEQ ID NO: 349642 - DNA, 20 bp, Rattus norvegicus
gaggggcatcctcagcaatg

SEQ ID NO: 349643 - DNA, 20 bp, Rattus norvegicus
gaggggcctcctcagcaatg

SEQ ID NO: 349644 - DNA, 20 bp, Rattus norvegicus
gaggggcgtcctcagcaatg

SEQ ID NO: 349645 - DNA, 20 bp, Rattus norvegicus
gaggggcttcctcagcaatg

SEQ ID NO: 349646 - DNA, 25 bp, Rattus norvegicus
gagggtaaactcatcttttgcaatg

SEQ ID NO: 349647 - DNA, 25 bp, Rattus norvegicus
gagggtaaactcttcttttgcaatg

SEQ ID NO: 349648 - DNA, 25 bp, Rattus norvegicus
gagggtaaatccaccacccaaagat

SEQ ID NO: 349649 - DNA, 25 bp, Rattus norvegicus
gagggtaaatcctccacccaaagat

SEQ ID NO: 349650 - DNA, 25 bp, Rattus norvegicus
gagggtaacatgacccaatgtttct

SEQ ID NO: 349651 - DNA, 25 bp, Rattus norvegicus
gagggtaacatgtcccaatgtttct

SEQ ID NO: 349652 - DNA, 25 bp, Rattus norvegicus
gagggtaacgctatagagggcacat

SEQ ID NO: 349653 - DNA, 25 bp, Rattus norvegicus
gagggtaacgctttagagggcacat

SEQ ID NO: 349654 - DNA, 25 bp, Rattus norvegicus
gagggtaaggccattgccacacaag

SEQ ID NO: 349655 - DNA, 25 bp, Rattus norvegicus
gagggtaaggcctttgccacacaag

SEQ ID NO: 349656 - DNA, 25 bp, Rattus norvegicus
gagggtaatccactcttcaaactga

SEQ ID NO: 349657 - DNA, 25 bp, Rattus norvegicus
gagggtaatccagtcttcaaactga

SEQ ID NO: 349658 - DNA, 25 bp, Rattus norvegicus
gagggtacagctcctatgacaggaa

SEQ ID NO: 349659 - DNA, 25 bp, Rattus norvegicus
gagggtacagctcgcttctcaggct

SEQ ID NO: 349660 - DNA, 25 bp, Rattus norvegicus
gagggtacagctgctatgacaggaa

SEQ ID NO: 349661 - DNA, 25 bp, Rattus norvegicus
gagggtacagctggcttctcaggct

SEQ ID NO: 349662 - DNA, 25 bp, Rattus norvegicus
gagggtacccatatacatgtgttat

SEQ ID NO: 349663 - DNA, 25 bp, Rattus norvegicus
gagggtacccatttacatgtgttat

SEQ ID NO: 349664 - DNA, 25 bp, Rattus norvegicus
gagggtaccgttacattgcagagaa

SEQ ID NO: 349665 - DNA, 25 bp, Rattus norvegicus
gagggtaccgtttcattgcagagaa

SEQ ID NO: 349666 - DNA, 25 bp, Rattus norvegicus
gagggtacctgtcaactaggagacc

SEQ ID NO: 349667 - DNA, 25 bp, Rattus norvegicus
gagggtacctgtgaactaggagacc

SEQ ID NO: 349668 - DNA, 25 bp, Rattus norvegicus
gagggtactccacagagatccatct

SEQ ID NO: 349669 - DNA, 25 bp, Rattus norvegicus
gagggtactccagagagatccatct

SEQ ID NO: 349670 - DNA, 25 bp, Rattus norvegicus
gagggtacttcaccaaatactcaga

SEQ ID NO: 349671 - DNA, 25 bp, Rattus norvegicus
gagggtacttcagcaaatactcaga

SEQ ID NO: 349672 - DNA, 25 bp, Rattus norvegicus
gagggtagaacccactcagttgttc

SEQ ID NO: 349673 - DNA, 25 bp, Rattus norvegicus
gagggtagaaccgactcagttgttc

SEQ ID NO: 349674 - DNA, 25 bp, Rattus norvegicus
gagggtagacccagtatcaaccatt

SEQ ID NO: 349675 - DNA, 25 bp, Rattus norvegicus
gagggtagaccctgtatcaaccatt

SEQ ID NO: 349676 - DNA, 25 bp, Rattus norvegicus
gagggtagagcccacttgctcaaag

SEQ ID NO: 349677 - DNA, 25 bp, Rattus norvegicus
gagggtagagccgacttgctcaaag

SEQ ID NO: 349678 - DNA, 25 bp, Rattus norvegicus
gagggtagcaggaccttctgttgaa

SEQ ID NO: 349679 - DNA, 25 bp, Rattus norvegicus
gagggtagcaggtccttctgttgaa

SEQ ID NO: 349680 - DNA, 25 bp, Rattus norvegicus
gagggtagccgtcgagcgcgggtgc

SEQ ID NO: 349681 - DNA, 25 bp, Rattus norvegicus
gagggtagccgtggagcgcgggtgc

SEQ ID NO: 349682 - DNA, 25 bp, Rattus norvegicus
gagggtagctgaattcctgcgtaca

SEQ ID NO: 349683 - DNA, 25 bp, Rattus norvegicus
gagggtagctgatttcctgcgtaca

SEQ ID NO: 349684 - DNA, 25 bp, Rattus norvegicus
gagggtagtgctattcttggtagat

SEQ ID NO: 349685 - DNA, 25 bp, Rattus norvegicus
gagggtagtgcttttcttggtagat

SEQ ID NO: 349686 - DNA, 25 bp, Rattus norvegicus
gagggtatcatgattattgtttcca

SEQ ID NO: 349687 - DNA, 25 bp, Rattus norvegicus
gagggtatcatgtttattgtttcca

SEQ ID NO: 349688 - DNA, 25 bp, Rattus norvegicus
gagggtatcctcaggtatcgcctag

SEQ ID NO: 349689 - DNA, 25 bp, Rattus norvegicus
gagggtatcctctggtatcgcctag

SEQ ID NO: 349690 - DNA, 25 bp, Rattus norvegicus
gagggtatctacaccagccacagaa

SEQ ID NO: 349691 - DNA, 25 bp, Rattus norvegicus
gagggtatctactccagccacagaa

SEQ ID NO: 349692 - DNA, 25 bp, Rattus norvegicus
gagggtatctttcccactgggtagc

SEQ ID NO: 349693 - DNA, 25 bp, Rattus norvegicus
gagggtatctttgccactgggtagc

SEQ ID NO: 349694 - DNA, 25 bp, Rattus norvegicus
gagggtatgagtctggcattcccat

SEQ ID NO: 349695 - DNA, 25 bp, Rattus norvegicus
gagggtatgagtgtggcattcccat

SEQ ID NO: 349696 - DNA, 25 bp, Rattus norvegicus
gagggtatgatgaacacgggctatt

SEQ ID NO: 349697 - DNA, 25 bp, Rattus norvegicus
gagggtatgatgtacacgggctatt

SEQ ID NO: 349698 - DNA, 25 bp, Rattus norvegicus
gagggtatgtctacttgataatgca

SEQ ID NO: 349699 - DNA, 25 bp, Rattus norvegicus
gagggtatgtcttcttgataatgca

SEQ ID NO: 349700 - DNA, 25 bp, Rattus norvegicus
gagggtcaaggcctttgcagaaaat

SEQ ID NO: 349701 - DNA, 25 bp, Rattus norvegicus
gagggtcaaggcgtttgcagaaaat

SEQ ID NO: 349702 - DNA, 25 bp, Rattus norvegicus
gagggtcaagttatccagctgggca

SEQ ID NO: 349703 - DNA, 25 bp, Rattus norvegicus
gagggtcaagttttccagctgggca

SEQ ID NO: 349704 - DNA, 25 bp, Rattus norvegicus
gagggtcactcacgttaactctgca

SEQ ID NO: 349705 - DNA, 25 bp, Rattus norvegicus
gagggtcactcaggttaactctgca

SEQ ID NO: 349706 - DNA, 25 bp, Rattus norvegicus
gagggtcagacccagagctgccaca

SEQ ID NO: 349707 - DNA, 25 bp, Rattus norvegicus
gagggtcagaccgagagctgccaca

SEQ ID NO: 349708 - DNA, 25 bp, Rattus norvegicus
gagggtcagagcatagtcctagtgt

SEQ ID NO: 349709 - DNA, 25 bp, Rattus norvegicus
gagggtcagagcttagtcctagtgt

SEQ ID NO: 349710 - DNA, 25 bp, Rattus norvegicus
gagggtcaggatacagctagattca

SEQ ID NO: 349711 - DNA, 25 bp, Rattus norvegicus
gagggtcaggattcagctagattca

SEQ ID NO: 349712 - DNA, 25 bp, Rattus norvegicus
gagggtcagtagacacgatccaggt

SEQ ID NO: 349713 - DNA, 25 bp, Rattus norvegicus
gagggtcagtagtcacgatccaggt

SEQ ID NO: 349714 - DNA, 25 bp, Rattus norvegicus
gagggtcatgccacacttggtgtca

SEQ ID NO: 349715 - DNA, 25 bp, Rattus norvegicus
gagggtcatgcctcacttggtgtca

SEQ ID NO: 349716 - DNA, 25 bp, Rattus norvegicus
gagggtcatggaatgtcgcacccac

SEQ ID NO: 349717 - DNA, 25 bp, Rattus norvegicus
gagggtcatggattgtcgcacccac

SEQ ID NO: 349718 - DNA, 25 bp, Rattus norvegicus
gagggtcatgtaatactgagctcat

SEQ ID NO: 349719 - DNA, 25 bp, Rattus norvegicus
gagggtcatgtattactgagctcat

SEQ ID NO: 349720 - DNA, 25 bp, Rattus norvegicus
gagggtcatgttctaggcttagcta

SEQ ID NO: 349721 - DNA, 25 bp, Rattus norvegicus
gagggtcatgttgtaggcttagcta

SEQ ID NO: 349722 - DNA, 25 bp, Rattus norvegicus
gagggtcattgtcagtccctggcca

SEQ ID NO: 349723 - DNA, 25 bp, Rattus norvegicus
gagggtcattgtgagtccctggcca

SEQ ID NO: 349724 - DNA, 25 bp, Rattus norvegicus
gagggtccacagattgattcccagc

SEQ ID NO: 349725 - DNA, 25 bp, Rattus norvegicus
gagggtccacagtttgattcccagc

SEQ ID NO: 349726 - DNA, 25 bp, Rattus norvegicus
gagggtccacctcctaaagatactg

SEQ ID NO: 349727 - DNA, 25 bp, Rattus norvegicus
gagggtccacctgctaaagatactg

SEQ ID NO: 349728 - DNA, 25 bp, Rattus norvegicus
gagggtccactcatggtcatttgaa

SEQ ID NO: 349729 - DNA, 25 bp, Rattus norvegicus
gagggtccactcttggtcatttgaa

SEQ ID NO: 349730 - DNA, 25 bp, Rattus norvegicus
gagggtccagctccttgtgggtggt

SEQ ID NO: 349731 - DNA, 25 bp, Rattus norvegicus
gagggtccagctgcttgtgggtggt

SEQ ID NO: 349732 - DNA, 25 bp, Rattus norvegicus
gagggtcccacacagagcgaattca

SEQ ID NO: 349733 - DNA, 25 bp, Rattus norvegicus
gagggtcccacagagagcgaattca

SEQ ID NO: 349734 - DNA, 25 bp, Rattus norvegicus
gagggtcccagaatcctgaatctat

SEQ ID NO: 349735 - DNA, 25 bp, Rattus norvegicus
gagggtcccagattcctgaatctat

SEQ ID NO: 349736 - DNA, 25 bp, Rattus norvegicus
gagggtcccagtaaacttgcaacat

SEQ ID NO: 349737 - DNA, 25 bp, Rattus norvegicus
gagggtcccagttaacttgcaacat

SEQ ID NO: 349738 - DNA, 25 bp, Rattus norvegicus
gagggtcctcacaaggttcaggctg

SEQ ID NO: 349739 - DNA, 25 bp, Rattus norvegicus
gagggtcctcactaggttcaggctg

SEQ ID NO: 349740 - DNA, 25 bp, Rattus norvegicus
gagggtcctgcaaactattggcgag

SEQ ID NO: 349741 - DNA, 25 bp, Rattus norvegicus
gagggtcctgcacaaactccagaag

SEQ ID NO: 349742 - DNA, 25 bp, Rattus norvegicus
gagggtcctgcagaaactccagaag

SEQ ID NO: 349743 - DNA, 25 bp, Rattus norvegicus
gagggtcctgcatactattggcgag

SEQ ID NO: 349744 - DNA, 25 bp, Rattus norvegicus
gagggtcctgggaacccaacctgag

SEQ ID NO: 349745 - DNA, 25 bp, Rattus norvegicus
gagggtcctgggtacccaacctgag

SEQ ID NO: 349746 - DNA, 25 bp, Rattus norvegicus
gagggtcgagccacataatgattac

SEQ ID NO: 349747 - DNA, 25 bp, Rattus norvegicus
gagggtcgagcctcataatgattac

SEQ ID NO: 349748 - DNA, 25 bp, Rattus norvegicus
gagggtcgatgtattggactcacca

SEQ ID NO: 349749 - DNA, 25 bp, Rattus norvegicus
gagggtcgatgttttggactcacca

SEQ ID NO: 349750 - DNA, 25 bp, Rattus norvegicus
gagggtctaaggacattgcatccat

SEQ ID NO: 349751 - DNA, 25 bp, Rattus norvegicus
gagggtctaaggtcattgcatccat

SEQ ID NO: 349752 - DNA, 25 bp, Rattus norvegicus
gagggtctagagcagccattaccaa

SEQ ID NO: 349753 - DNA, 25 bp, Rattus norvegicus
gagggtctagaggagccattaccaa

SEQ ID NO: 349754 - DNA, 25 bp, Rattus norvegicus
gagggtctagcactcctagaagcac

SEQ ID NO: 349755 - DNA, 25 bp, Rattus norvegicus
gagggtctagcagtcctagaagcac

SEQ ID NO: 349756 - DNA, 25 bp, Rattus norvegicus
gagggtctattaaatttgctttttc

SEQ ID NO: 349757 - DNA, 25 bp, Rattus norvegicus
gagggtctattatatttgctttttc

SEQ ID NO: 349758 - DNA, 25 bp, Rattus norvegicus
gagggtctcaccacgcagaagcagt

SEQ ID NO: 349759 - DNA, 25 bp, Rattus norvegicus
gagggtctcacctcgcagaagcagt

SEQ ID NO: 349760 - DNA, 25 bp, Rattus norvegicus
gagggtctccaaaccttgtttatgc

SEQ ID NO: 349761 - DNA, 25 bp, Rattus norvegicus
gagggtctccaatccttgtttatgc

SEQ ID NO: 349762 - DNA, 25 bp, Rattus norvegicus
gagggtctctgtaatcaccatctac

SEQ ID NO: 349763 - DNA, 25 bp, Rattus norvegicus
gagggtctctgttatcaccatctac

SEQ ID NO: 349764 - DNA, 25 bp, Rattus norvegicus
gagggtctgcacacgcaggtgccca

SEQ ID NO: 349765 - DNA, 25 bp, Rattus norvegicus
gagggtctgcactcgcaggtgccca

SEQ ID NO: 349766 - DNA, 25 bp, Rattus norvegicus
gagggtctgctcatcattgaggctc

SEQ ID NO: 349767 - DNA, 25 bp, Rattus norvegicus
gagggtctgctcttcattgaggctc

SEQ ID NO: 349768 - DNA, 25 bp, Rattus norvegicus
gagggtctggcaaggttttctgatc

SEQ ID NO: 349769 - DNA, 25 bp, Rattus norvegicus
gagggtctggcatggttttctgatc

SEQ ID NO: 349770 - DNA, 25 bp, Rattus norvegicus
gagggtctggctacacacgaaactc

SEQ ID NO: 349771 - DNA, 25 bp, Rattus norvegicus
gagggtctggcttcacacgaaactc

SEQ ID NO: 349772 - DNA, 25 bp, Rattus norvegicus
gagggtcttaaaaccaaatgcctgt

SEQ ID NO: 349773 - DNA, 25 bp, Rattus norvegicus
gagggtcttaaatccaaatgcctgt

SEQ ID NO: 349774 - DNA, 25 bp, Rattus norvegicus
gagggtcttattagttttcccagct

SEQ ID NO: 349775 - DNA, 25 bp, Rattus norvegicus
gagggtcttatttgttttcccagct

SEQ ID NO: 349776 - DNA, 25 bp, Rattus norvegicus
gagggtcttcatatactgtcttgcc

SEQ ID NO: 349777 - DNA, 25 bp, Rattus norvegicus
gagggtcttcatttactgtcttgcc

SEQ ID NO: 349778 - DNA, 25 bp, Rattus norvegicus
gagggtcttccaatccaagatggct

SEQ ID NO: 349779 - DNA, 25 bp, Rattus norvegicus
gagggtcttccattccaagatggct

SEQ ID NO: 349780 - DNA, 25 bp, Rattus norvegicus
gagggtcttcctcagagaactacga

SEQ ID NO: 349781 - DNA, 25 bp, Rattus norvegicus
gagggtcttcctgagagaactacga

SEQ ID NO: 349782 - DNA, 25 bp, Rattus norvegicus
gagggtcttctaactatgtctggaa

SEQ ID NO: 349783 - DNA, 25 bp, Rattus norvegicus
gagggtcttctacgtcatttgggct

SEQ ID NO: 349784 - DNA, 25 bp, Rattus norvegicus
gagggtcttctaggtcatttgggct

SEQ ID NO: 349785 - DNA, 25 bp, Rattus norvegicus
gagggtcttctatctatgtctggaa

SEQ ID NO: 349786 - DNA, 25 bp, Rattus norvegicus
gagggtcttgatcccaggccagcaa

SEQ ID NO: 349787 - DNA, 25 bp, Rattus norvegicus
gagggtcttgatgccaggccagcaa

SEQ ID NO: 349788 - DNA, 25 bp, Rattus norvegicus
gagggtcttgtaatcagatccttaa

SEQ ID NO: 349789 - DNA, 25 bp, Rattus norvegicus
gagggtcttgtattcagatccttaa

SEQ ID NO: 349790 - DNA, 25 bp, Rattus norvegicus
gagggtcttttgatcctcgtctaca

SEQ ID NO: 349791 - DNA, 25 bp, Rattus norvegicus
gagggtcttttgttcctcgtctaca

SEQ ID NO: 349792 - DNA, 25 bp, Rattus norvegicus
gagggtgaaacccaggcccctacat

SEQ ID NO: 349793 - DNA, 25 bp, Rattus norvegicus
gagggtgaaaccgaggcccctacat

SEQ ID NO: 349794 - DNA, 25 bp, Rattus norvegicus
gagggtgaacatcaccccgtggcca

SEQ ID NO: 349795 - DNA, 25 bp, Rattus norvegicus
gagggtgaacatgaccccgtggcca

SEQ ID NO: 349796 - DNA, 25 bp, Rattus norvegicus
gagggtgaactaacacattcacagg

SEQ ID NO: 349797 - DNA, 25 bp, Rattus norvegicus
gagggtgaactatcacattcacagg

SEQ ID NO: 349798 - DNA, 25 bp, Rattus norvegicus
gagggtgaagccatcgaggtcattc

SEQ ID NO: 349799 - DNA, 25 bp, Rattus norvegicus
gagggtgaagccttcgaggtcattc

SEQ ID NO: 349800 - DNA, 25 bp, Rattus norvegicus
gagggtgaagtacctgtgttttagc

SEQ ID NO: 349801 - DNA, 25 bp, Rattus norvegicus
gagggtgaagtagctgtgttttagc

SEQ ID NO: 349802 - DNA, 25 bp, Rattus norvegicus
gagggtgactcaatggaagaccagc

SEQ ID NO: 349803 - DNA, 25 bp, Rattus norvegicus
gagggtgactcattggaagaccagc

SEQ ID NO: 349804 - DNA, 25 bp, Rattus norvegicus
gagggtgactgtagtcccgagccct

SEQ ID NO: 349805 - DNA, 25 bp, Rattus norvegicus
gagggtgactgttgtcccgagccct

SEQ ID NO: 349806 - DNA, 25 bp, Rattus norvegicus
gagggtgacttcaccgacccgtgtg

SEQ ID NO: 349807 - DNA, 25 bp, Rattus norvegicus
gagggtgacttctccgacccgtgtg

SEQ ID NO: 349808 - DNA, 25 bp, Rattus norvegicus
gagggtgagaacaggtccttcccca

SEQ ID NO: 349809 - DNA, 25 bp, Rattus norvegicus
gagggtgagaactggtccttcccca

SEQ ID NO: 349810 - DNA, 25 bp, Rattus norvegicus
gagggtgagcccatgaccgtcatga

SEQ ID NO: 349811 - DNA, 25 bp, Rattus norvegicus
gagggtgagcccttgaccgtcatga

SEQ ID NO: 349812 - DNA, 25 bp, Rattus norvegicus
gagggtgcatccattttcacacagc

SEQ ID NO: 349813 - DNA, 25 bp, Rattus norvegicus
gagggtgcatcctttttcacacagc

SEQ ID NO: 349814 - DNA, 25 bp, Rattus norvegicus
gagggtgcatcgctcctagtagctc

SEQ ID NO: 349815 - DNA, 25 bp, Rattus norvegicus
gagggtgcatcggtcctagtagctc

SEQ ID NO: 349816 - DNA, 25 bp, Rattus norvegicus
gagggtgcatctattcagtagatca

SEQ ID NO: 349817 - DNA, 25 bp, Rattus norvegicus
gagggtgcatcttttcagtagatca

SEQ ID NO: 349818 - DNA, 25 bp, Rattus norvegicus
gagggtgccaaaccctgagctaaac

SEQ ID NO: 349819 - DNA, 25 bp, Rattus norvegicus
gagggtgccaaagcctgagctaaac

SEQ ID NO: 349820 - DNA, 25 bp, Rattus norvegicus
gagggtgccagaatcacctgtaact

SEQ ID NO: 349821 - DNA, 25 bp, Rattus norvegicus
gagggtgccagattcacctgtaact

SEQ ID NO: 349822 - DNA, 25 bp, Rattus norvegicus
gagggtgcccatcacagaaactata

SEQ ID NO: 349823 - DNA, 25 bp, Rattus norvegicus
gagggtgcccatgacagaaactata

SEQ ID NO: 349824 - DNA, 25 bp, Rattus norvegicus
gagggtgcctctcttgagttccaca

SEQ ID NO: 349825 - DNA, 25 bp, Rattus norvegicus
gagggtgcctctgttgagttccaca

SEQ ID NO: 349826 - DNA, 25 bp, Rattus norvegicus
gagggtgctaatcctaatccacaga

SEQ ID NO: 349827 - DNA, 25 bp, Rattus norvegicus
gagggtgctaatgctaatccacaga

SEQ ID NO: 349828 - DNA, 25 bp, Rattus norvegicus
gagggtgctagtcatatctgtccac

SEQ ID NO: 349829 - DNA, 25 bp, Rattus norvegicus
gagggtgctagtcccagtcaaccat

SEQ ID NO: 349830 - DNA, 25 bp, Rattus norvegicus
gagggtgctagtgatatctgtccac

SEQ ID NO: 349831 - DNA, 25 bp, Rattus norvegicus
gagggtgctagtgccagtcaaccat

SEQ ID NO: 349832 - DNA, 25 bp, Rattus norvegicus
gagggtgcttttctatactttcaat

SEQ ID NO: 349833 - DNA, 25 bp, Rattus norvegicus
gagggtgcttttgtatactttcaat

SEQ ID NO: 349834 - DNA, 25 bp, Rattus norvegicus
gagggtggacctcggtactatactt

SEQ ID NO: 349835 - DNA, 25 bp, Rattus norvegicus
gagggtggacctctgaacctccatg

SEQ ID NO: 349836 - DNA, 25 bp, Rattus norvegicus
gagggtggacctgggtactatactt

SEQ ID NO: 349837 - DNA, 25 bp, Rattus norvegicus
gagggtggacctgtgaacctccatg

SEQ ID NO: 349838 - DNA, 25 bp, Rattus norvegicus
gagggtggaggcaacaaatgtctaa

SEQ ID NO: 349839 - DNA, 25 bp, Rattus norvegicus
gagggtggaggctacaaatgtctaa

SEQ ID NO: 349840 - DNA, 25 bp, Rattus norvegicus
gagggtggcccacaacctgttgctt

SEQ ID NO: 349841 - DNA, 25 bp, Rattus norvegicus
gagggtggcccagaacctgttgctt

SEQ ID NO: 349842 - DNA, 25 bp, Rattus norvegicus
gagggtggctctcaagatgttcaaa

SEQ ID NO: 349843 - DNA, 25 bp, Rattus norvegicus
gagggtggctctgaagatgttcaaa

SEQ ID NO: 349844 - DNA, 25 bp, Rattus norvegicus
gagggtgggataatccatcctttta

SEQ ID NO: 349845 - DNA, 25 bp, Rattus norvegicus
gagggtgggatattccatcctttta

SEQ ID NO: 349846 - DNA, 25 bp, Rattus norvegicus
gagggtgggcagagcttcccttcat

SEQ ID NO: 349847 - DNA, 25 bp, Rattus norvegicus
gagggtgggcagtgcttcccttcat

SEQ ID NO: 349848 - DNA, 25 bp, Rattus norvegicus
gagggtggtcccatcctacctttga

SEQ ID NO: 349849 - DNA, 25 bp, Rattus norvegicus
gagggtggtcccttcctacctttga

SEQ ID NO: 349850 - DNA, 25 bp, Rattus norvegicus
gagggtgtattcatactcttccaaa

SEQ ID NO: 349851 - DNA, 25 bp, Rattus norvegicus
gagggtgtattcttactcttccaaa

SEQ ID NO: 349852 - DNA, 25 bp, Rattus norvegicus
gagggtgtcataacacatctgctaa

SEQ ID NO: 349853 - DNA, 25 bp, Rattus norvegicus
gagggtgtcatatcacatctgctaa

SEQ ID NO: 349854 - DNA, 25 bp, Rattus norvegicus
gagggtgtccctatcaagtttgaga

SEQ ID NO: 349855 - DNA, 25 bp, Rattus norvegicus
gagggtgtccctttcaagtttgaga

SEQ ID NO: 349856 - DNA, 25 bp, Rattus norvegicus
gagggtgtctaaaacctgcccatct

SEQ ID NO: 349857 - DNA, 25 bp, Rattus norvegicus
gagggtgtctaatacctgcccatct

SEQ ID NO: 349858 - DNA, 25 bp, Rattus norvegicus
gagggtgtcttcacaaaactggccc

SEQ ID NO: 349859 - DNA, 25 bp, Rattus norvegicus
gagggtgtcttcagatcgtcaactt

SEQ ID NO: 349860 - DNA, 25 bp, Rattus norvegicus
gagggtgtcttctcaaaactggccc

SEQ ID NO: 349861 - DNA, 25 bp, Rattus norvegicus
gagggtgtcttctgatcgtcaactt

SEQ ID NO: 349862 - DNA, 25 bp, Rattus norvegicus
gagggtgtgcatctatgtatagtcc

SEQ ID NO: 349863 - DNA, 25 bp, Rattus norvegicus
gagggtgtgcatgtatgtatagtcc

SEQ ID NO: 349864 - DNA, 25 bp, Rattus norvegicus
gagggtgtggctctcaaagttcttt

SEQ ID NO: 349865 - DNA, 25 bp, Rattus norvegicus
gagggtgtggctgtcaaagttcttt

SEQ ID NO: 349866 - DNA, 25 bp, Rattus norvegicus
gagggtgttacaactcctggaacta

SEQ ID NO: 349867 - DNA, 25 bp, Rattus norvegicus
gagggtgttacatctcctggaacta

SEQ ID NO: 349868 - DNA, 25 bp, Rattus norvegicus
gagggtgttcttcaacttggtcagt

SEQ ID NO: 349869 - DNA, 25 bp, Rattus norvegicus
gagggtgttcttgaacttggtcagt

SEQ ID NO: 349870 - DNA, 25 bp, Rattus norvegicus
gagggtgttggtcttctgtctaaac

SEQ ID NO: 349871 - DNA, 25 bp, Rattus norvegicus
gagggtgttggtgttctgtctaaac

SEQ ID NO: 349872 - DNA, 25 bp, Rattus norvegicus
gagggttaagagactgtccccatca

SEQ ID NO: 349873 - DNA, 25 bp, Rattus norvegicus
gagggttaagagtctgtccccatca

SEQ ID NO: 349874 - DNA, 25 bp, Rattus norvegicus
gagggttacagaatatgacagcata

SEQ ID NO: 349875 - DNA, 25 bp, Rattus norvegicus
gagggttacagattatgacagcata

SEQ ID NO: 349876 - DNA, 25 bp, Rattus norvegicus
gagggttacagtagcctacttctta

SEQ ID NO: 349877 - DNA, 25 bp, Rattus norvegicus
gagggttacagttgcctacttctta

SEQ ID NO: 349878 - DNA, 25 bp, Rattus norvegicus
gagggttacgggatctactgccttc

SEQ ID NO: 349879 - DNA, 25 bp, Rattus norvegicus
gagggttacgggttctactgccttc

SEQ ID NO: 349880 - DNA, 25 bp, Rattus norvegicus
gagggttactctattgctgactccc

SEQ ID NO: 349881 - DNA, 25 bp, Rattus norvegicus
gagggttactcttttgctgactccc

SEQ ID NO: 349882 - DNA, 25 bp, Rattus norvegicus
gagggttagaagacggcccactgcc

SEQ ID NO: 349883 - DNA, 25 bp, Rattus norvegicus
gagggttagaagtcggcccactgcc

SEQ ID NO: 349884 - DNA, 25 bp, Rattus norvegicus
gagggttataggcttccagcgccca

SEQ ID NO: 349885 - DNA, 25 bp, Rattus norvegicus
gagggttatagggttccagcgccca

SEQ ID NO: 349886 - DNA, 25 bp, Rattus norvegicus
gagggttatcagcttcatggagtca

SEQ ID NO: 349887 - DNA, 25 bp, Rattus norvegicus
gagggttatcaggttcatggagtca

SEQ ID NO: 349888 - DNA, 25 bp, Rattus norvegicus
gagggttatctccatgtccacatgc

SEQ ID NO: 349889 - DNA, 25 bp, Rattus norvegicus
gagggttatctcgatgtccacatgc

SEQ ID NO: 349890 - DNA, 25 bp, Rattus norvegicus
gagggttcaggacactccttcgcaa

SEQ ID NO: 349891 - DNA, 25 bp, Rattus norvegicus
gagggttcaggagactccttcgcaa

SEQ ID NO: 349892 - DNA, 25 bp, Rattus norvegicus
gagggttcatatacctgattgtttg

SEQ ID NO: 349893 - DNA, 25 bp, Rattus norvegicus
gagggttcatattcctgattgtttg

SEQ ID NO: 349894 - DNA, 25 bp, Rattus norvegicus
gagggttcatctctgtgtcaggatt

SEQ ID NO: 349895 - DNA, 25 bp, Rattus norvegicus
gagggttcatctgtgtgtcaggatt

SEQ ID NO: 349896 - DNA, 25 bp, Rattus norvegicus
gagggttccaagatcaggactctct

SEQ ID NO: 349897 - DNA, 25 bp, Rattus norvegicus
gagggttccaagttcaggactctct

SEQ ID NO: 349898 - DNA, 25 bp, Rattus norvegicus
gagggttccatcatcttgcaaggac

SEQ ID NO: 349899 - DNA, 25 bp, Rattus norvegicus
gagggttccatcttcttgcaaggac

SEQ ID NO: 349900 - DNA, 25 bp, Rattus norvegicus
gagggttcccaaaaaaccatctatt

SEQ ID NO: 349901 - DNA, 25 bp, Rattus norvegicus
gagggttcccaataaaccatctatt

SEQ ID NO: 349902 - DNA, 25 bp, Rattus norvegicus
gagggttccgacctctctttcagct

SEQ ID NO: 349903 - DNA, 25 bp, Rattus norvegicus
gagggttccgacgtctctttcagct

SEQ ID NO: 349904 - DNA, 25 bp, Rattus norvegicus
gagggttcctgtatgtttgaggcta

SEQ ID NO: 349905 - DNA, 25 bp, Rattus norvegicus
gagggttcctgtttgtttgaggcta

SEQ ID NO: 349906 - DNA, 25 bp, Rattus norvegicus
gagggttctagtacatcctgggcag

SEQ ID NO: 349907 - DNA, 25 bp, Rattus norvegicus
gagggttctagttcatcctgggcag

SEQ ID NO: 349908 - DNA, 25 bp, Rattus norvegicus
gagggttctcagcaagtgcctaaag

SEQ ID NO: 349909 - DNA, 25 bp, Rattus norvegicus
gagggttctcaggaagtgcctaaag

SEQ ID NO: 349910 - DNA, 25 bp, Rattus norvegicus
gagggttctgaactaagccactgaa

SEQ ID NO: 349911 - DNA, 25 bp, Rattus norvegicus
gagggttctgaagtaagccactgaa

SEQ ID NO: 349912 - DNA, 25 bp, Rattus norvegicus
gagggttctgggaatctcagatacc

SEQ ID NO: 349913 - DNA, 25 bp, Rattus norvegicus
gagggttctgggtatctcagatacc

SEQ ID NO: 349914 - DNA, 25 bp, Rattus norvegicus
gagggttcttacacaactctgggca

SEQ ID NO: 349915 - DNA, 25 bp, Rattus norvegicus
gagggttcttactcaactctgggca

SEQ ID NO: 349916 - DNA, 25 bp, Rattus norvegicus
gagggttcttagactgtttctgaca

SEQ ID NO: 349917 - DNA, 25 bp, Rattus norvegicus
gagggttcttagtctgtttctgaca

SEQ ID NO: 349918 - DNA, 25 bp, Rattus norvegicus
gagggttcttccacccaaagcacca

SEQ ID NO: 349919 - DNA, 25 bp, Rattus norvegicus
gagggttcttcctcccaaagcacca

SEQ ID NO: 349920 - DNA, 25 bp, Rattus norvegicus
gagggttgacaacaaaacactcagt

SEQ ID NO: 349921 - DNA, 25 bp, Rattus norvegicus
gagggttgacaagaaaacactcagt

SEQ ID NO: 349922 - DNA, 25 bp, Rattus norvegicus
gagggttgacagaattctaacacaa

SEQ ID NO: 349923 - DNA, 25 bp, Rattus norvegicus
gagggttgacagtattctaacacaa

SEQ ID NO: 349924 - DNA, 25 bp, Rattus norvegicus
gagggttgagttaagccacagagcc

SEQ ID NO: 349925 - DNA, 25 bp, Rattus norvegicus
gagggttgagttccttcatgtcact

SEQ ID NO: 349926 - DNA, 25 bp, Rattus norvegicus
gagggttgagttgcttcatgtcact

SEQ ID NO: 349927 - DNA, 25 bp, Rattus norvegicus
gagggttgagtttagccacagagcc

SEQ ID NO: 349928 - DNA, 25 bp, Rattus norvegicus
gagggttgcctgcagccagtcacaa

SEQ ID NO: 349929 - DNA, 25 bp, Rattus norvegicus
gagggttgcctggagccagtcacaa

SEQ ID NO: 349930 - DNA, 25 bp, Rattus norvegicus
gagggttgcttccaagatgctccga

SEQ ID NO: 349931 - DNA, 25 bp, Rattus norvegicus
gagggttgcttcgaagatgctccga

SEQ ID NO: 349932 - DNA, 25 bp, Rattus norvegicus
gagggttgggtcacactcaaaggcc

SEQ ID NO: 349933 - DNA, 25 bp, Rattus norvegicus
gagggttgggtctcactcaaaggcc

SEQ ID NO: 349934 - DNA, 25 bp, Rattus norvegicus
gagggttggttgaagctcccgttat

SEQ ID NO: 349935 - DNA, 25 bp, Rattus norvegicus
gagggttggttgtagctcccgttat

SEQ ID NO: 349936 - DNA, 25 bp, Rattus norvegicus
gagggttggtttaccatcattccct

SEQ ID NO: 349937 - DNA, 25 bp, Rattus norvegicus
gagggttggttttccatcattccct

SEQ ID NO: 349938 - DNA, 25 bp, Rattus norvegicus
gagggttgtcagacctgttccgtgc

SEQ ID NO: 349939 - DNA, 25 bp, Rattus norvegicus
gagggttgtcagtcctgttccgtgc

SEQ ID NO: 349940 - DNA, 25 bp, Rattus norvegicus
gagggttgtgacacaacatggtctt

SEQ ID NO: 349941 - DNA, 25 bp, Rattus norvegicus
gagggttgtgactcaacatggtctt

SEQ ID NO: 349942 - DNA, 25 bp, Rattus norvegicus
gagggtttaggtcttgcaacctcta

SEQ ID NO: 349943 - DNA, 25 bp, Rattus norvegicus
gagggtttaggtgttgcaacctcta

SEQ ID NO: 349944 - DNA, 25 bp, Rattus norvegicus
gagggtttagtcattagaacaatct

SEQ ID NO: 349945 - DNA, 25 bp, Rattus norvegicus
gagggtttagtctttagaacaatct

SEQ ID NO: 349946 - DNA, 25 bp, Rattus norvegicus
gagggtttcagtacaaatgctgctg

SEQ ID NO: 349947 - DNA, 25 bp, Rattus norvegicus
gagggtttcagttcaaatgctgctg

SEQ ID NO: 349948 - DNA, 25 bp, Rattus norvegicus
gagggtttcattactggcaaattcc

SEQ ID NO: 349949 - DNA, 25 bp, Rattus norvegicus
gagggtttcatttctggcaaattcc

SEQ ID NO: 349950 - DNA, 25 bp, Rattus norvegicus
gagggtttcctactgtacagctaca

SEQ ID NO: 349951 - DNA, 25 bp, Rattus norvegicus
gagggtttcctagtgtacagctaca

SEQ ID NO: 349952 - DNA, 25 bp, Rattus norvegicus
gagggtttcctgcagtggccatata

SEQ ID NO: 349953 - DNA, 25 bp, Rattus norvegicus
gagggtttcctggagtggccatata

SEQ ID NO: 349954 - DNA, 25 bp, Rattus norvegicus
gagggtttctcaagggcaaagacaa

SEQ ID NO: 349955 - DNA, 25 bp, Rattus norvegicus
gagggtttctcatgggcaaagacaa

SEQ ID NO: 349956 - DNA, 25 bp, Rattus norvegicus
gagggtttctgaccttcatcttggg

SEQ ID NO: 349957 - DNA, 25 bp, Rattus norvegicus
gagggtttctgagcttcatcttggg

SEQ ID NO: 349958 - DNA, 25 bp, Rattus norvegicus
gagggtttcttcatgtttagacaca

SEQ ID NO: 349959 - DNA, 25 bp, Rattus norvegicus
gagggtttcttcttgtttagacaca

SEQ ID NO: 349960 - DNA, 25 bp, Rattus norvegicus
gagggtttcttgattttggttgtct

SEQ ID NO: 349961 - DNA, 25 bp, Rattus norvegicus
gagggtttcttgtttttggttgtct

SEQ ID NO: 349962 - DNA, 25 bp, Rattus norvegicus
gagggtttggtcagtactaacacac

SEQ ID NO: 349963 - DNA, 25 bp, Rattus norvegicus
gagggtttggtctgtactaacacac

SEQ ID NO: 349964 - DNA, 25 bp, Rattus norvegicus
gagggtttgtctcaacttcttccag

SEQ ID NO: 349965 - DNA, 25 bp, Rattus norvegicus
gagggtttgtctgaacttcttccag

SEQ ID NO: 349966 - DNA, 25 bp, Rattus norvegicus
gagggtttgtgacctgtcagcttaa

SEQ ID NO: 349967 - DNA, 25 bp, Rattus norvegicus
gagggtttgtgagctgtcagcttaa

SEQ ID NO: 349968 - DNA, 25 bp, Rattus norvegicus
gagggttttatcctgatccataggc

SEQ ID NO: 349969 - DNA, 25 bp, Rattus norvegicus
gagggttttatcgtgatccataggc

SEQ ID NO: 349970 - DNA, 25 bp, Rattus norvegicus
gagggttttatgatctgcatcactt

SEQ ID NO: 349971 - DNA, 25 bp, Rattus norvegicus
gagggttttatgttctgcatcactt

SEQ ID NO: 349972 - DNA, 25 bp, Rattus norvegicus
gagggttttccaagatctattcttg

SEQ ID NO: 349973 - DNA, 25 bp, Rattus norvegicus
gagggttttccatgatctattcttg

SEQ ID NO: 349974 - DNA, 25 bp, Rattus norvegicus
gagggttttcccaaggtgctacatc

SEQ ID NO: 349975 - DNA, 25 bp, Rattus norvegicus
gagggttttcccaatcagaacgtgt

SEQ ID NO: 349976 - DNA, 25 bp, Rattus norvegicus
gagggttttccctaggtgctacatc

SEQ ID NO: 349977 - DNA, 25 bp, Rattus norvegicus
gagggttttccctatcagaacgtgt

SEQ ID NO: 349978 - DNA, 25 bp, Rattus norvegicus
gaggtaaaagccaccctgtcagcct

SEQ ID NO: 349979 - DNA, 25 bp, Rattus norvegicus
gaggtaaaagcctccctgtcagcct

SEQ ID NO: 349980 - DNA, 25 bp, Rattus norvegicus
gaggtaaacacacttactttgctac

SEQ ID NO: 349981 - DNA, 25 bp, Rattus norvegicus
gaggtaaacacagttactttgctac

SEQ ID NO: 349982 - DNA, 25 bp, Rattus norvegicus
gaggtaaagctgattcctgccctta

SEQ ID NO: 349983 - DNA, 25 bp, Rattus norvegicus
gaggtaaagctgtttcctgccctta

SEQ ID NO: 349984 - DNA, 25 bp, Rattus norvegicus
gaggtaaatctcagctgacatgcgt

SEQ ID NO: 349985 - DNA, 25 bp, Rattus norvegicus
gaggtaaatctctgctgacatgcgt

SEQ ID NO: 349986 - DNA, 25 bp, Rattus norvegicus
gaggtaacagacacctcccaatgta

SEQ ID NO: 349987 - DNA, 25 bp, Rattus norvegicus
gaggtaacagactcctcccaatgta

SEQ ID NO: 349988 - DNA, 25 bp, Rattus norvegicus
gaggtaaccttacagacttgcagga

SEQ ID NO: 349989 - DNA, 25 bp, Rattus norvegicus
gaggtaaccttagagacttgcagga

SEQ ID NO: 349990 - DNA, 25 bp, Rattus norvegicus
gaggtaactacactcctttacttag

SEQ ID NO: 349991 - DNA, 25 bp, Rattus norvegicus
gaggtaactacagtcctttacttag

SEQ ID NO: 349992 - DNA, 25 bp, Rattus norvegicus
gaggtaactgagctggcttgcccac

SEQ ID NO: 349993 - DNA, 25 bp, Rattus norvegicus
gaggtaactgaggtggcttgcccac

SEQ ID NO: 349994 - DNA, 25 bp, Rattus norvegicus
gaggtaacttagcacttgttcttgt

SEQ ID NO: 349995 - DNA, 25 bp, Rattus norvegicus
gaggtaacttaggacttgttcttgt

SEQ ID NO: 349996 - DNA, 25 bp, Rattus norvegicus
gaggtaagagtaactgctctttaga

SEQ ID NO: 349997 - DNA, 25 bp, Rattus norvegicus
gaggtaagagtatctgctctttaga

SEQ ID NO: 349998 - DNA, 25 bp, Rattus norvegicus
gaggtaagcctgagctgcttcagaa

SEQ ID NO: 349999 - DNA, 25 bp, Rattus norvegicus
gaggtaagcctgtgctgcttcagaa

SEQ ID NO: 350000 - DNA, 25 bp, Rattus norvegicus
gaggtaagctctatgagttctatct

SEQ ID NO: 350001 - DNA, 25 bp, Rattus norvegicus
gaggtaagctctttgagttctatct

SEQ ID NO: 350002 - DNA, 25 bp, Rattus norvegicus
gaggtaagctgtctcctgaagataa

SEQ ID NO: 350003 - DNA, 25 bp, Rattus norvegicus
gaggtaagctgtgtcctgaagataa

SEQ ID NO: 350004 - DNA, 25 bp, Rattus norvegicus
gaggtaagtatacctggcagccgct

SEQ ID NO: 350005 - DNA, 25 bp, Rattus norvegicus
gaggtaagtatagctggcagccgct

SEQ ID NO: 350006 - DNA, 25 bp, Rattus norvegicus
gaggtaatacacacccttcatttat

SEQ ID NO: 350007 - DNA, 25 bp, Rattus norvegicus
gaggtaatacactcccttcatttat

SEQ ID NO: 350008 - DNA, 25 bp, Rattus norvegicus
gaggtaatccctagacatgcttgtt

SEQ ID NO: 350009 - DNA, 25 bp, Rattus norvegicus
gaggtaatcccttgacatgcttgtt

SEQ ID NO: 350010 - DNA, 25 bp, Rattus norvegicus
gaggtaatgcctctggtcgttgtac

SEQ ID NO: 350011 - DNA, 25 bp, Rattus norvegicus
gaggtaatgcctgtggtcgttgtac

SEQ ID NO: 350012 - DNA, 25 bp, Rattus norvegicus
gaggtaattcatagtatcctgtaat

SEQ ID NO: 350013 - DNA, 25 bp, Rattus norvegicus
gaggtaattcattgtatcctgtaat

SEQ ID NO: 350014 - DNA, 25 bp, Rattus norvegicus
gaggtaattctcctgcgctagagtt

SEQ ID NO: 350015 - DNA, 25 bp, Rattus norvegicus
gaggtaattctcgtgcgctagagtt

SEQ ID NO: 350016 - DNA, 25 bp, Rattus norvegicus
gaggtacaaaacatagcactttcta

SEQ ID NO: 350017 - DNA, 25 bp, Rattus norvegicus
gaggtacaaaacttagcactttcta

SEQ ID NO: 350018 - DNA, 25 bp, Rattus norvegicus
gaggtacaaaccactgtgtaaacag

SEQ ID NO: 350019 - DNA, 25 bp, Rattus norvegicus
gaggtacaaacctctgtgtaaacag

SEQ ID NO: 350020 - DNA, 25 bp, Rattus norvegicus
gaggtacaatcacccttctctatgc

SEQ ID NO: 350021 - DNA, 25 bp, Rattus norvegicus
gaggtacaatcagccttctctatgc

SEQ ID NO: 350022 - DNA, 25 bp, Rattus norvegicus
gaggtacaatctaatctgtggctat

SEQ ID NO: 350023 - DNA, 25 bp, Rattus norvegicus
gaggtacaatctatccatcgtttca

SEQ ID NO: 350024 - DNA, 25 bp, Rattus norvegicus
gaggtacaatcttatctgtggctat

SEQ ID NO: 350025 - DNA, 25 bp, Rattus norvegicus
gaggtacaatctttccatcgtttca

SEQ ID NO: 350026 - DNA, 25 bp, Rattus norvegicus
gaggtacaatgaccaatctaggcat

SEQ ID NO: 350027 - DNA, 25 bp, Rattus norvegicus
gaggtacaatgagcaatctaggcat

SEQ ID NO: 350028 - DNA, 25 bp, Rattus norvegicus
gaggtacaatttaccagacttccag

SEQ ID NO: 350029 - DNA, 25 bp, Rattus norvegicus
gaggtacaattttccagacttccag

SEQ ID NO: 350030 - DNA, 25 bp, Rattus norvegicus
gaggtacacgaaatattttccctgt

SEQ ID NO: 350031 - DNA, 25 bp, Rattus norvegicus
gaggtacacgaattattttccctgt

SEQ ID NO: 350032 - DNA, 25 bp, Rattus norvegicus
gaggtacactatagcctgacgcaga

SEQ ID NO: 350033 - DNA, 25 bp, Rattus norvegicus
gaggtacactattgcctgacgcaga

SEQ ID NO: 350034 - DNA, 25 bp, Rattus norvegicus
gaggtacactctcactgcttgcggt

SEQ ID NO: 350035 - DNA, 25 bp, Rattus norvegicus
gaggtacactctgactgcttgcggt

SEQ ID NO: 350036 - DNA, 25 bp, Rattus norvegicus
gaggtacatccccaaatgtctttca

SEQ ID NO: 350037 - DNA, 25 bp, Rattus norvegicus
gaggtacatcccgaaatgtctttca

SEQ ID NO: 350038 - DNA, 25 bp, Rattus norvegicus
gaggtacatgctaataacagatttt

SEQ ID NO: 350039 - DNA, 25 bp, Rattus norvegicus
gaggtacatgcttataacagatttt

SEQ ID NO: 350040 - DNA, 25 bp, Rattus norvegicus
gaggtaccaaaacgcctgaaggctt

SEQ ID NO: 350041 - DNA, 25 bp, Rattus norvegicus
gaggtaccaaaaggcctgaaggctt

SEQ ID NO: 350042 - DNA, 25 bp, Rattus norvegicus
gaggtaccacacagttcgggtgcta

SEQ ID NO: 350043 - DNA, 25 bp, Rattus norvegicus
gaggtaccacactgttcgggtgcta

SEQ ID NO: 350044 - DNA, 25 bp, Rattus norvegicus
gaggtaccacatccttgttaatgct

SEQ ID NO: 350045 - DNA, 25 bp, Rattus norvegicus
gaggtaccacatgcttgttaatgct

SEQ ID NO: 350046 - DNA, 25 bp, Rattus norvegicus
gaggtaccagaccacgagaccctga

SEQ ID NO: 350047 - DNA, 25 bp, Rattus norvegicus
gaggtaccagacgacgagaccctga

SEQ ID NO: 350048 - DNA, 25 bp, Rattus norvegicus
gaggtaccattcaccactgagcaga

SEQ ID NO: 350049 - DNA, 25 bp, Rattus norvegicus
gaggtaccattctccactgagcaga

SEQ ID NO: 350050 - DNA, 25 bp, Rattus norvegicus
gaggtaccatttccgtcctgttgaa

SEQ ID NO: 350051 - DNA, 25 bp, Rattus norvegicus
gaggtaccatttgcgtcctgttgaa

SEQ ID NO: 350052 - DNA, 25 bp, Rattus norvegicus
gaggtacccaaacagccgactgaag

SEQ ID NO: 350053 - DNA, 25 bp, Rattus norvegicus
gaggtacccaaagagccgactgaag

SEQ ID NO: 350054 - DNA, 25 bp, Rattus norvegicus
gaggtaccccgcatgtccttgaaag

SEQ ID NO: 350055 - DNA, 25 bp, Rattus norvegicus
gaggtaccccgcttgtccttgaaag

SEQ ID NO: 350056 - DNA, 25 bp, Rattus norvegicus
gaggtaccctgacagtgttcagcca

SEQ ID NO: 350057 - DNA, 25 bp, Rattus norvegicus
gaggtaccctgagagtgttcagcca

SEQ ID NO: 350058 - DNA, 25 bp, Rattus norvegicus
gaggtaccctgtagcaatagccact

SEQ ID NO: 350059 - DNA, 25 bp, Rattus norvegicus
gaggtaccctgtagttttctggcta

SEQ ID NO: 350060 - DNA, 25 bp, Rattus norvegicus
gaggtaccctgttgcaatagccact

SEQ ID NO: 350061 - DNA, 25 bp, Rattus norvegicus
gaggtaccctgttgttttctggcta

SEQ ID NO: 350062 - DNA, 25 bp, Rattus norvegicus
gaggtacctagactatgccatccag

SEQ ID NO: 350063 - DNA, 25 bp, Rattus norvegicus
gaggtacctagagtatgccatccag

SEQ ID NO: 350064 - DNA, 25 bp, Rattus norvegicus
gaggtacctgaacatgtgcttcgag

SEQ ID NO: 350065 - DNA, 25 bp, Rattus norvegicus
gaggtacctgaagatgtgcttcgag

SEQ ID NO: 350066 - DNA, 25 bp, Rattus norvegicus
gaggtacctggaaatttagctgatg

SEQ ID NO: 350067 - DNA, 25 bp, Rattus norvegicus
gaggtacctggatatttagctgatg

SEQ ID NO: 350068 - DNA, 25 bp, Rattus norvegicus
gaggtaccttcactggactcaccaa

SEQ ID NO: 350069 - DNA, 25 bp, Rattus norvegicus
gaggtaccttcagtggactcaccaa

SEQ ID NO: 350070 - DNA, 25 bp, Rattus norvegicus
gaggtacctttaacaacagggcaca

SEQ ID NO: 350071 - DNA, 25 bp, Rattus norvegicus
gaggtacctttatcaacagggcaca

SEQ ID NO: 350072 - DNA, 25 bp, Rattus norvegicus
gaggtacggcgacactcatccgtga

SEQ ID NO: 350073 - DNA, 25 bp, Rattus norvegicus
gaggtacggcgagactcatccgtga

SEQ ID NO: 350074 - DNA, 25 bp, Rattus norvegicus
gaggtacgtgtcagccctgaccacg

SEQ ID NO: 350075 - DNA, 25 bp, Rattus norvegicus
gaggtacgtgtctgccctgaccacg

SEQ ID NO: 350076 - DNA, 25 bp, Rattus norvegicus
gaggtacgttttcaccacatcagac

SEQ ID NO: 350077 - DNA, 25 bp, Rattus norvegicus
gaggtacgttttgaccacatcagac

SEQ ID NO: 350078 - DNA, 25 bp, Rattus norvegicus
gaggtactacaaactttatgcataa

SEQ ID NO: 350079 - DNA, 25 bp, Rattus norvegicus
gaggtactacaatctttatgcataa

SEQ ID NO: 350080 - DNA, 25 bp, Rattus norvegicus
gaggtactatttctcattcctgtga

SEQ ID NO: 350081 - DNA, 25 bp, Rattus norvegicus
gaggtactatttgtcattcctgtga

SEQ ID NO: 350082 - DNA, 25 bp, Rattus norvegicus
gaggtactccctctgttgaaagact

SEQ ID NO: 350083 - DNA, 25 bp, Rattus norvegicus
gaggtactccctgtgttgaaagact

SEQ ID NO: 350084 - DNA, 25 bp, Rattus norvegicus
gaggtactcggtaaatgtttgctga

SEQ ID NO: 350085 - DNA, 25 bp, Rattus norvegicus
gaggtactcggttaatgtttgctga

SEQ ID NO: 350086 - DNA, 25 bp, Rattus norvegicus
gaggtactgagtatccttttggcat

SEQ ID NO: 350087 - DNA, 25 bp, Rattus norvegicus
gaggtactgagtttccttttggcat

SEQ ID NO: 350088 - DNA, 25 bp, Rattus norvegicus
gaggtactgcctattgttttgcatt

SEQ ID NO: 350089 - DNA, 25 bp, Rattus norvegicus
gaggtactgccttttgttttgcatt

SEQ ID NO: 350090 - DNA, 25 bp, Rattus norvegicus
gaggtactgctgaagcttttactaa

SEQ ID NO: 350091 - DNA, 25 bp, Rattus norvegicus
gaggtactgctgtagcttttactaa

SEQ ID NO: 350092 - DNA, 25 bp, Rattus norvegicus
gaggtactgtatcacactgaggaga

SEQ ID NO: 350093 - DNA, 25 bp, Rattus norvegicus
gaggtactgtatgacactgaggaga

SEQ ID NO: 350094 - DNA, 25 bp, Rattus norvegicus
gaggtactgtgaatcaaacccaggt

SEQ ID NO: 350095 - DNA, 25 bp, Rattus norvegicus
gaggtactgtgattcaaacccaggt

SEQ ID NO: 350096 - DNA, 25 bp, Rattus norvegicus
gaggtactgtgtaccgcactgcccg

SEQ ID NO: 350097 - DNA, 25 bp, Rattus norvegicus
gaggtactgtgttccgcactgcccg

SEQ ID NO: 350098 - DNA, 25 bp, Rattus norvegicus
gaggtacttgttatgctttcgacac

SEQ ID NO: 350099 - DNA, 25 bp, Rattus norvegicus
gaggtacttgttcgctcctgagatc

SEQ ID NO: 350100 - DNA, 25 bp, Rattus norvegicus
gaggtacttgttggctcctgagatc

SEQ ID NO: 350101 - DNA, 25 bp, Rattus norvegicus
gaggtacttgttttgctttcgacac

SEQ ID NO: 350102 - DNA, 25 bp, Rattus norvegicus
gaggtactttggaatcccagcatca

SEQ ID NO: 350103 - DNA, 25 bp, Rattus norvegicus
gaggtactttggtatcccagcatca

SEQ ID NO: 350104 - DNA, 25 bp, Rattus norvegicus
gaggtagaaactccggctcacgtcc

SEQ ID NO: 350105 - DNA, 25 bp, Rattus norvegicus
gaggtagaaactgcggctcacgtcc

SEQ ID NO: 350106 - DNA, 25 bp, Rattus norvegicus
gaggtagaacttacagagcctaaat

SEQ ID NO: 350107 - DNA, 25 bp, Rattus norvegicus
gaggtagaactttcagagcctaaat

SEQ ID NO: 350108 - DNA, 25 bp, Rattus norvegicus
gaggtagactacagcgactcactga

SEQ ID NO: 350109 - DNA, 25 bp, Rattus norvegicus
gaggtagactactgcgactcactga

SEQ ID NO: 350110 - DNA, 25 bp, Rattus norvegicus
gaggtagactgtccatgctactcga

SEQ ID NO: 350111 - DNA, 25 bp, Rattus norvegicus
gaggtagactgtgcatgctactcga

SEQ ID NO: 350112 - DNA, 25 bp, Rattus norvegicus
gaggtagacttgaggccagagcttt

SEQ ID NO: 350113 - DNA, 25 bp, Rattus norvegicus
gaggtagacttgtggccagagcttt

SEQ ID NO: 350114 - DNA, 25 bp, Rattus norvegicus
gaggtagagacaaaggtgagttcaa

SEQ ID NO: 350115 - DNA, 25 bp, Rattus norvegicus
gaggtagagacataggtgagttcaa

SEQ ID NO: 350116 - DNA, 25 bp, Rattus norvegicus
gaggtagagcttcacttgctggtac

SEQ ID NO: 350117 - DNA, 25 bp, Rattus norvegicus
gaggtagagcttgacttgctggtac

SEQ ID NO: 350118 - DNA, 25 bp, Rattus norvegicus
gaggtagagtggctcactcctttac

SEQ ID NO: 350119 - DNA, 25 bp, Rattus norvegicus
gaggtagagtgggtcactcctttac

SEQ ID NO: 350120 - DNA, 25 bp, Rattus norvegicus
gaggtagatactaaactggacaatt

SEQ ID NO: 350121 - DNA, 25 bp, Rattus norvegicus
gaggtagatacttaactggacaatt

SEQ ID NO: 350122 - DNA, 25 bp, Rattus norvegicus
gaggtagcacgcatctcgcctctgc

SEQ ID NO: 350123 - DNA, 25 bp, Rattus norvegicus
gaggtagcacgcttctcgcctctgc

SEQ ID NO: 350124 - DNA, 25 bp, Rattus norvegicus
gaggtagcatgtacttttctgtttg

SEQ ID NO: 350125 - DNA, 25 bp, Rattus norvegicus
gaggtagcatgttcttttctgtttg

SEQ ID NO: 350126 - DNA, 25 bp, Rattus norvegicus
gaggtagccactctctttaatttta

SEQ ID NO: 350127 - DNA, 25 bp, Rattus norvegicus
gaggtagccactgtctttaatttta

SEQ ID NO: 350128 - DNA, 25 bp, Rattus norvegicus
gaggtagccaggataacaaccaaga

SEQ ID NO: 350129 - DNA, 25 bp, Rattus norvegicus
gaggtagccaggttaacaaccaaga

SEQ ID NO: 350130 - DNA, 25 bp, Rattus norvegicus
gaggtagcccttcgatctagcagca

SEQ ID NO: 350131 - DNA, 25 bp, Rattus norvegicus
gaggtagcccttggatctagcagca

SEQ ID NO: 350132 - DNA, 25 bp, Rattus norvegicus
gaggtagccttaacttcagaacatt

SEQ ID NO: 350133 - DNA, 25 bp, Rattus norvegicus
gaggtagccttatcttcagaacatt

SEQ ID NO: 350134 - DNA, 25 bp, Rattus norvegicus
gaggtagccttgcagtttgtccaca

SEQ ID NO: 350135 - DNA, 25 bp, Rattus norvegicus
gaggtagccttggagtttgtccaca

SEQ ID NO: 350136 - DNA, 25 bp, Rattus norvegicus
gaggtagcggcacctttctttgttg

SEQ ID NO: 350137 - DNA, 25 bp, Rattus norvegicus
gaggtagcggcagctttctttgttg

SEQ ID NO: 350138 - DNA, 25 bp, Rattus norvegicus
gaggtagctaatctttgcaagacca

SEQ ID NO: 350139 - DNA, 25 bp, Rattus norvegicus
gaggtagctaatgtttgcaagacca

SEQ ID NO: 350140 - DNA, 25 bp, Rattus norvegicus
gaggtagctcctcttttacaactct

SEQ ID NO: 350141 - DNA, 25 bp, Rattus norvegicus
gaggtagctcctgttttacaactct

SEQ ID NO: 350142 - DNA, 25 bp, Rattus norvegicus
gaggtagctgagatcctgagcctta

SEQ ID NO: 350143 - DNA, 25 bp, Rattus norvegicus
gaggtagctgagttcctgagcctta

SEQ ID NO: 350144 - DNA, 25 bp, Rattus norvegicus
gaggtagctgctatcagctgtctgg

SEQ ID NO: 350145 - DNA, 25 bp, Rattus norvegicus
gaggtagctgctttcagctgtctgg

SEQ ID NO: 350146 - DNA, 25 bp, Rattus norvegicus
gaggtagcttcgaggccttggttcc

SEQ ID NO: 350147 - DNA, 25 bp, Rattus norvegicus
gaggtagcttcgtggccttggttcc

SEQ ID NO: 350148 - DNA, 25 bp, Rattus norvegicus
gaggtagctttaacttcgttctgta

SEQ ID NO: 350149 - DNA, 25 bp, Rattus norvegicus
gaggtagctttatcttcgttctgta

SEQ ID NO: 350150 - DNA, 25 bp, Rattus norvegicus
gaggtaggacacagcgtaggacaaa

SEQ ID NO: 350151 - DNA, 25 bp, Rattus norvegicus
gaggtaggacactgcgtaggacaaa

SEQ ID NO: 350152 - DNA, 25 bp, Rattus norvegicus
gaggtaggccgcatttgagtttcct

SEQ ID NO: 350153 - DNA, 25 bp, Rattus norvegicus
gaggtaggccgcttttgagtttcct

SEQ ID NO: 350154 - DNA, 25 bp, Rattus norvegicus
gaggtaggcggcactctaaagtttg

SEQ ID NO: 350155 - DNA, 25 bp, Rattus norvegicus
gaggtaggcggctctctaaagtttg

SEQ ID NO: 350156 - DNA, 25 bp, Rattus norvegicus
gaggtaggctgcagacatccctgtg

SEQ ID NO: 350157 - DNA, 25 bp, Rattus norvegicus
gaggtaggctgctgacatccctgtg

SEQ ID NO: 350158 - DNA, 25 bp, Rattus norvegicus
gaggtaggctgtattgttgtttctt

SEQ ID NO: 350159 - DNA, 25 bp, Rattus norvegicus
gaggtaggctgttttgttgtttctt

SEQ ID NO: 350160 - DNA, 25 bp, Rattus norvegicus
gaggtaggcttcaaatcccaacttt

SEQ ID NO: 350161 - DNA, 25 bp, Rattus norvegicus
gaggtaggcttctaatcccaacttt

SEQ ID NO: 350162 - DNA, 25 bp, Rattus norvegicus
gaggtagtcagtccctggttacaca

SEQ ID NO: 350163 - DNA, 25 bp, Rattus norvegicus
gaggtagtcagtgcctggttacaca

SEQ ID NO: 350164 - DNA, 25 bp, Rattus norvegicus
gaggtagtccacagtctgattggaa

SEQ ID NO: 350165 - DNA, 25 bp, Rattus norvegicus
gaggtagtccactgtctgattggaa

SEQ ID NO: 350166 - DNA, 25 bp, Rattus norvegicus
gaggtagtcttcatgtctgtgccca

SEQ ID NO: 350167 - DNA, 25 bp, Rattus norvegicus
gaggtagtcttcttgtctgtgccca

SEQ ID NO: 350168 - DNA, 25 bp, Rattus norvegicus
gaggtagtgaccacagacaatgctg

SEQ ID NO: 350169 - DNA, 25 bp, Rattus norvegicus
gaggtagtgacctcagacaatgctg

SEQ ID NO: 350170 - DNA, 25 bp, Rattus norvegicus
gaggtagtgtgccatgcttatgcat

SEQ ID NO: 350171 - DNA, 25 bp, Rattus norvegicus
gaggtagtgtgcgatgcttatgcat

SEQ ID NO: 350172 - DNA, 25 bp, Rattus norvegicus
gaggtagttcccaccattcttgact

SEQ ID NO: 350173 - DNA, 25 bp, Rattus norvegicus
gaggtagttccctccattcttgact

SEQ ID NO: 350174 - DNA, 25 bp, Rattus norvegicus
gaggtagttctccaggatgcataga

SEQ ID NO: 350175 - DNA, 25 bp, Rattus norvegicus
gaggtagttctcgaggatgcataga

SEQ ID NO: 350176 - DNA, 25 bp, Rattus norvegicus
gaggtagttgttagccctcatccac

SEQ ID NO: 350177 - DNA, 25 bp, Rattus norvegicus
gaggtagttgtttgccctcatccac

SEQ ID NO: 350178 - DNA, 25 bp, Rattus norvegicus
gaggtagtttctcaggttcagactg

SEQ ID NO: 350179 - DNA, 25 bp, Rattus norvegicus
gaggtagtttctgaggttcagactg

SEQ ID NO: 350180 - DNA, 25 bp, Rattus norvegicus
gaggtataggttcggtcctctgcct

SEQ ID NO: 350181 - DNA, 25 bp, Rattus norvegicus
gaggtataggttgggtcctctgcct

SEQ ID NO: 350182 - DNA, 25 bp, Rattus norvegicus
gaggtatatctactgttgctgtttt

SEQ ID NO: 350183 - DNA, 25 bp, Rattus norvegicus
gaggtatatctagtgttgctgtttt

SEQ ID NO: 350184 - DNA, 25 bp, Rattus norvegicus
gaggtatatgtcacctacttgttgc

SEQ ID NO: 350185 - DNA, 25 bp, Rattus norvegicus
gaggtatatgtctcctacttgttgc

SEQ ID NO: 350186 - DNA, 25 bp, Rattus norvegicus
gaggtatcacctattactggaagga

SEQ ID NO: 350187 - DNA, 25 bp, Rattus norvegicus
gaggtatcaccttttactggaagga

SEQ ID NO: 350188 - DNA, 25 bp, Rattus norvegicus
gaggtatcctgtcgcgccttctaga

SEQ ID NO: 350189 - DNA, 25 bp, Rattus norvegicus
gaggtatcctgtggcgccttctaga

SEQ ID NO: 350190 - DNA, 25 bp, Rattus norvegicus
gaggtatcgctcagccatgggatga

SEQ ID NO: 350191 - DNA, 25 bp, Rattus norvegicus
gaggtatcgctctgccatgggatga

SEQ ID NO: 350192 - DNA, 25 bp, Rattus norvegicus
gaggtatctcaaagcatttgccagg

SEQ ID NO: 350193 - DNA, 25 bp, Rattus norvegicus
gaggtatctcaaatccactgacaga

SEQ ID NO: 350194 - DNA, 25 bp, Rattus norvegicus
gaggtatctcaatgcatttgccagg

SEQ ID NO: 350195 - DNA, 25 bp, Rattus norvegicus
gaggtatctcaattccactgacaga

SEQ ID NO: 350196 - DNA, 25 bp, Rattus norvegicus
gaggtatctcagagaccaagtagaa

SEQ ID NO: 350197 - DNA, 25 bp, Rattus norvegicus
gaggtatctcagtgaccaagtagaa

SEQ ID NO: 350198 - DNA, 25 bp, Rattus norvegicus
gaggtatcttttccagctacacatc

SEQ ID NO: 350199 - DNA, 25 bp, Rattus norvegicus
gaggtatcttttgcagctacacatc

SEQ ID NO: 350200 - DNA, 25 bp, Rattus norvegicus
gaggtatgaacaaaggccccagctt

SEQ ID NO: 350201 - DNA, 25 bp, Rattus norvegicus
gaggtatgaacataggccccagctt

SEQ ID NO: 350202 - DNA, 25 bp, Rattus norvegicus
gaggtatgaagcctgccttttgtgt

SEQ ID NO: 350203 - DNA, 25 bp, Rattus norvegicus
gaggtatgaagcgtgccttttgtgt

SEQ ID NO: 350204 - DNA, 25 bp, Rattus norvegicus
gaggtatgactaaagctgggaagat

SEQ ID NO: 350205 - DNA, 25 bp, Rattus norvegicus
gaggtatgactatagctgggaagat

SEQ ID NO: 350206 - DNA, 25 bp, Rattus norvegicus
gaggtatggcttctaagtcacttgc

SEQ ID NO: 350207 - DNA, 25 bp, Rattus norvegicus
gaggtatggcttgtaagtcacttgc

SEQ ID NO: 350208 - DNA, 25 bp, Rattus norvegicus
gaggtatggtagacagctgcaataa

SEQ ID NO: 350209 - DNA, 25 bp, Rattus norvegicus
gaggtatggtagtcagctgcaataa

SEQ ID NO: 350210 - DNA, 25 bp, Rattus norvegicus
gaggtatgtctccatggtgattcta

SEQ ID NO: 350211 - DNA, 25 bp, Rattus norvegicus
gaggtatgtctcgatggtgattcta

SEQ ID NO: 350212 - DNA, 25 bp, Rattus norvegicus
gaggtattacctcacacttaggcta

SEQ ID NO: 350213 - DNA, 25 bp, Rattus norvegicus
gaggtattacctgacacttaggcta

SEQ ID NO: 350214 - DNA, 25 bp, Rattus norvegicus
gaggtattcaaactcgcatgtttac

SEQ ID NO: 350215 - DNA, 25 bp, Rattus norvegicus
gaggtattcaaagtcgcatgtttac

SEQ ID NO: 350216 - DNA, 25 bp, Rattus norvegicus
gaggtattcagaacacccatgtccc

SEQ ID NO: 350217 - DNA, 25 bp, Rattus norvegicus
gaggtattcagatcacccatgtccc

SEQ ID NO: 350218 - DNA, 25 bp, Rattus norvegicus
gaggtattcagtcgaccttagtcca

SEQ ID NO: 350219 - DNA, 25 bp, Rattus norvegicus
gaggtattcagtggaccttagtcca

SEQ ID NO: 350220 - DNA, 25 bp, Rattus norvegicus
gaggtattctgaagtccacgcttta

SEQ ID NO: 350221 - DNA, 25 bp, Rattus norvegicus
gaggtattctgatgtccacgcttta

SEQ ID NO: 350222 - DNA, 25 bp, Rattus norvegicus
gaggtattgcatacatgtggccata

SEQ ID NO: 350223 - DNA, 25 bp, Rattus norvegicus
gaggtattgcattcatgtggccata

SEQ ID NO: 350224 - DNA, 25 bp, Rattus norvegicus
gaggtatttcagatccggtgtctcc

SEQ ID NO: 350225 - DNA, 25 bp, Rattus norvegicus
gaggtatttcagttccggtgtctcc

SEQ ID NO: 350226 - DNA, 25 bp, Rattus norvegicus
gaggtatttctgcacttggctcaat

SEQ ID NO: 350227 - DNA, 25 bp, Rattus norvegicus
gaggtatttctggacttggctcaat

SEQ ID NO: 350228 - DNA, 25 bp, Rattus norvegicus
gaggtattttatctgttcaattcct

SEQ ID NO: 350229 - DNA, 25 bp, Rattus norvegicus
gaggtattttatgtgttcaattcct

SEQ ID NO: 350230 - DNA, 25 bp, Rattus norvegicus
gaggtcaaaacccttaccatgttga

SEQ ID NO: 350231 - DNA, 25 bp, Rattus norvegicus
gaggtcaaaaccgttaccatgttga

SEQ ID NO: 350232 - DNA, 25 bp, Rattus norvegicus
gaggtcaaaacgcttctcatttcca

SEQ ID NO: 350233 - DNA, 25 bp, Rattus norvegicus
gaggtcaaaacggttctcatttcca

SEQ ID NO: 350234 - DNA, 25 bp, Rattus norvegicus
gaggtcaaaagccatcctaggaggt

SEQ ID NO: 350235 - DNA, 25 bp, Rattus norvegicus
gaggtcaaaagcgatcctaggaggt

SEQ ID NO: 350236 - DNA, 25 bp, Rattus norvegicus
gaggtcaaagccaagctcagctact

SEQ ID NO: 350237 - DNA, 25 bp, Rattus norvegicus
gaggtcaaagcctagctcagctact

SEQ ID NO: 350238 - DNA, 25 bp, Rattus norvegicus
gaggtcaacatgatcttctcttatg

SEQ ID NO: 350239 - DNA, 25 bp, Rattus norvegicus
gaggtcaacatgttcttctcttatg

SEQ ID NO: 350240 - DNA, 25 bp, Rattus norvegicus
gaggtcaaccatactccaaaacggt

SEQ ID NO: 350241 - DNA, 25 bp, Rattus norvegicus
gaggtcaaccattctccaaaacggt

SEQ ID NO: 350242 - DNA, 25 bp, Rattus norvegicus
gaggtcaacctcaacaacattaaga

SEQ ID NO: 350243 - DNA, 25 bp, Rattus norvegicus
gaggtcaacctctacaacattaaga

SEQ ID NO: 350244 - DNA, 25 bp, Rattus norvegicus
gaggtcaaggacattgcccacatga

SEQ ID NO: 350245 - DNA, 25 bp, Rattus norvegicus
gaggtcaaggactttgcccacatga

SEQ ID NO: 350246 - DNA, 25 bp, Rattus norvegicus
gaggtcaatgctctagaataggtct

SEQ ID NO: 350247 - DNA, 25 bp, Rattus norvegicus
gaggtcaatgctgtagaataggtct

SEQ ID NO: 350248 - DNA, 25 bp, Rattus norvegicus
gaggtcacaaacagctggccagggt

SEQ ID NO: 350249 - DNA, 25 bp, Rattus norvegicus
gaggtcacaaactgctggccagggt

SEQ ID NO: 350250 - DNA, 25 bp, Rattus norvegicus
gaggtcacaagtagccatctacctt

SEQ ID NO: 350251 - DNA, 25 bp, Rattus norvegicus
gaggtcacaagttgccatctacctt

SEQ ID NO: 350252 - DNA, 25 bp, Rattus norvegicus
gaggtcacagacatggaataaacta

SEQ ID NO: 350253 - DNA, 25 bp, Rattus norvegicus
gaggtcacagacttggaataaacta

SEQ ID NO: 350254 - DNA, 25 bp, Rattus norvegicus
gaggtcacagagcaaccctacccat

SEQ ID NO: 350255 - DNA, 25 bp, Rattus norvegicus
gaggtcacagaggaaccctacccat

SEQ ID NO: 350256 - DNA, 25 bp, Rattus norvegicus
gaggtcacaggcacttgagaacaac

SEQ ID NO: 350257 - DNA, 25 bp, Rattus norvegicus
gaggtcacaggctcttgagaacaac

SEQ ID NO: 350258 - DNA, 25 bp, Rattus norvegicus
gaggtcacagttcagctgggcttcc

SEQ ID NO: 350259 - DNA, 25 bp, Rattus norvegicus
gaggtcacagttgagctgggcttcc

SEQ ID NO: 350260 - DNA, 25 bp, Rattus norvegicus
gaggtcacatagacttgattttgca

SEQ ID NO: 350261 - DNA, 25 bp, Rattus norvegicus
gaggtcacatagtcttgattttgca

SEQ ID NO: 350262 - DNA, 25 bp, Rattus norvegicus
gaggtcacatgcagctagaggaaca

SEQ ID NO: 350263 - DNA, 25 bp, Rattus norvegicus
gaggtcacatgctgctagaggaaca

SEQ ID NO: 350264 - DNA, 25 bp, Rattus norvegicus
gaggtcacattgctggcccaacaca

SEQ ID NO: 350265 - DNA, 25 bp, Rattus norvegicus
gaggtcacattggtggcccaacaca

SEQ ID NO: 350266 - DNA, 25 bp, Rattus norvegicus
gaggtcaccagcactgaggatacta

SEQ ID NO: 350267 - DNA, 25 bp, Rattus norvegicus
gaggtcaccagctctgaggatacta

SEQ ID NO: 350268 - DNA, 25 bp, Rattus norvegicus
gaggtcacctttcgaggactatgta

SEQ ID NO: 350269 - DNA, 25 bp, Rattus norvegicus
gaggtcacctttggaggactatgta

SEQ ID NO: 350270 - DNA, 25 bp, Rattus norvegicus
gaggtcactacaatgcatacttcaa

SEQ ID NO: 350271 - DNA, 25 bp, Rattus norvegicus
gaggtcactacattgcatacttcaa

SEQ ID NO: 350272 - DNA, 25 bp, Rattus norvegicus
gaggtcactcacagatagcaccaga

SEQ ID NO: 350273 - DNA, 25 bp, Rattus norvegicus
gaggtcactcactgatagcaccaga

SEQ ID NO: 350274 - DNA, 25 bp, Rattus norvegicus
gaggtcactggtccatagtaagaat

SEQ ID NO: 350275 - DNA, 25 bp, Rattus norvegicus
gaggtcactggtgcatagtaagaat

SEQ ID NO: 350276 - DNA, 25 bp, Rattus norvegicus
gaggtcagaaccaatcaggcatcac

SEQ ID NO: 350277 - DNA, 25 bp, Rattus norvegicus
gaggtcagaacccaacaagcacaag

SEQ ID NO: 350278 - DNA, 25 bp, Rattus norvegicus
gaggtcagaaccgaacaagcacaag

SEQ ID NO: 350279 - DNA, 25 bp, Rattus norvegicus
gaggtcagaacctatcaggcatcac

SEQ ID NO: 350280 - DNA, 25 bp, Rattus norvegicus
gaggtcagaagtcgcccttgattga

SEQ ID NO: 350281 - DNA, 25 bp, Rattus norvegicus
gaggtcagaagtggcccttgattga

SEQ ID NO: 350282 - DNA, 25 bp, Rattus norvegicus
gaggtcagaccaaattgccttctca

SEQ ID NO: 350283 - DNA, 25 bp, Rattus norvegicus
gaggtcagaccatattgccttctca

SEQ ID NO: 350284 - DNA, 25 bp, Rattus norvegicus
gaggtcagacctcacgtggaacccg

SEQ ID NO: 350285 - DNA, 25 bp, Rattus norvegicus
gaggtcagacctgacgtggaacccg

SEQ ID NO: 350286 - DNA, 25 bp, Rattus norvegicus
gaggtcagatgcagaaaccgttcga

SEQ ID NO: 350287 - DNA, 25 bp, Rattus norvegicus
gaggtcagatgctgaaaccgttcga

SEQ ID NO: 350288 - DNA, 25 bp, Rattus norvegicus
gaggtcagcaataatctgtcactgt

SEQ ID NO: 350289 - DNA, 25 bp, Rattus norvegicus
gaggtcagcaattatctgtcactgt

SEQ ID NO: 350290 - DNA, 25 bp, Rattus norvegicus
gaggtcagcaccatcttcgaggctt

SEQ ID NO: 350291 - DNA, 25 bp, Rattus norvegicus
gaggtcagcaccttcttcgaggctt

SEQ ID NO: 350292 - DNA, 25 bp, Rattus norvegicus
gaggtcagcactacattttgacact

SEQ ID NO: 350293 - DNA, 25 bp, Rattus norvegicus
gaggtcagcacttcattttgacact

SEQ ID NO: 350294 - DNA, 25 bp, Rattus norvegicus
gaggtcagcatcactccagaaagga

SEQ ID NO: 350295 - DNA, 25 bp, Rattus norvegicus
gaggtcagcatctctccagaaagga

SEQ ID NO: 350296 - DNA, 25 bp, Rattus norvegicus
gaggtcagccatctaacatctgccc

SEQ ID NO: 350297 - DNA, 25 bp, Rattus norvegicus
gaggtcagccatgtaacatctgccc

SEQ ID NO: 350298 - DNA, 25 bp, Rattus norvegicus
gaggtcagcccacgcggcataacta

SEQ ID NO: 350299 - DNA, 25 bp, Rattus norvegicus
gaggtcagcccaggcggcataacta

SEQ ID NO: 350300 - DNA, 25 bp, Rattus norvegicus
gaggtcagctgactgttgagtccat

SEQ ID NO: 350301 - DNA, 25 bp, Rattus norvegicus
gaggtcagctgagtgttgagtccat

SEQ ID NO: 350302 - DNA, 25 bp, Rattus norvegicus
gaggtcagctttaccttagggtcat

SEQ ID NO: 350303 - DNA, 25 bp, Rattus norvegicus
gaggtcagcttttccttagggtcat

SEQ ID NO: 350304 - DNA, 25 bp, Rattus norvegicus
gaggtcaggactcagactcttcaaa

SEQ ID NO: 350305 - DNA, 25 bp, Rattus norvegicus
gaggtcaggactgagactcttcaaa

SEQ ID NO: 350306 - DNA, 25 bp, Rattus norvegicus
gaggtcaggagcaacctaccctgta

SEQ ID NO: 350307 - DNA, 25 bp, Rattus norvegicus
gaggtcaggagctacctaccctgta

SEQ ID NO: 350308 - DNA, 25 bp, Rattus norvegicus
gaggtcaggagtcaccaggcattat

SEQ ID NO: 350309 - DNA, 25 bp, Rattus norvegicus
gaggtcaggagtgaccaggcattat

SEQ ID NO: 350310 - DNA, 25 bp, Rattus norvegicus
gaggtcaggtgcctataggatcttt

SEQ ID NO: 350311 - DNA, 25 bp, Rattus norvegicus
gaggtcaggtgcgtataggatcttt

SEQ ID NO: 350312 - DNA, 25 bp, Rattus norvegicus
gaggtcagtcagaattgctttgtat

SEQ ID NO: 350313 - DNA, 25 bp, Rattus norvegicus
gaggtcagtcagtattgctttgtat

SEQ ID NO: 350314 - DNA, 25 bp, Rattus norvegicus
gaggtcagtgtcatttacttcggca

SEQ ID NO: 350315 - DNA, 25 bp, Rattus norvegicus
gaggtcagtgtcttttacttcggca

SEQ ID NO: 350316 - DNA, 25 bp, Rattus norvegicus
gaggtcagttttagctttcgatccc

SEQ ID NO: 350317 - DNA, 25 bp, Rattus norvegicus
gaggtcagtttttgctttcgatccc

SEQ ID NO: 350318 - DNA, 25 bp, Rattus norvegicus
gaggtcataaacagccttcatggct

SEQ ID NO: 350319 - DNA, 25 bp, Rattus norvegicus
gaggtcataaactgccttcatggct

SEQ ID NO: 350320 - DNA, 25 bp, Rattus norvegicus
gaggtcataataagctttcccatca

SEQ ID NO: 350321 - DNA, 25 bp, Rattus norvegicus
gaggtcataatatgctttcccatca

SEQ ID NO: 350322 - DNA, 25 bp, Rattus norvegicus
gaggtcatacacacatgattcgcaa

SEQ ID NO: 350323 - DNA, 25 bp, Rattus norvegicus
gaggtcatacacatctgcacgcaca

SEQ ID NO: 350324 - DNA, 25 bp, Rattus norvegicus
gaggtcatacactcatgattcgcaa

SEQ ID NO: 350325 - DNA, 25 bp, Rattus norvegicus
gaggtcatacacttctgcacgcaca

SEQ ID NO: 350326 - DNA, 25 bp, Rattus norvegicus
gaggtcatagccatattcaacagca

SEQ ID NO: 350327 - DNA, 25 bp, Rattus norvegicus
gaggtcatagccctgtcagcactga

SEQ ID NO: 350328 - DNA, 25 bp, Rattus norvegicus
gaggtcatagccgtgtcagcactga

SEQ ID NO: 350329 - DNA, 25 bp, Rattus norvegicus
gaggtcatagccttattcaacagca

SEQ ID NO: 350330 - DNA, 25 bp, Rattus norvegicus
gaggtcatagtgcttccaaatcgtt

SEQ ID NO: 350331 - DNA, 25 bp, Rattus norvegicus
gaggtcatagtggttccaaatcgtt

SEQ ID NO: 350332 - DNA, 25 bp, Rattus norvegicus
gaggtcatatgtattggcggttgta

SEQ ID NO: 350333 - DNA, 25 bp, Rattus norvegicus
gaggtcatatgttttggcggttgta

SEQ ID NO: 350334 - DNA, 25 bp, Rattus norvegicus
gaggtcatattgctacaaggttcag

SEQ ID NO: 350335 - DNA, 25 bp, Rattus norvegicus
gaggtcatattggtacaaggttcag

SEQ ID NO: 350336 - DNA, 25 bp, Rattus norvegicus
gaggtcatcaacatcatcaagcggg

SEQ ID NO: 350337 - DNA, 25 bp, Rattus norvegicus
gaggtcatcaacttcatcaagcggg

SEQ ID NO: 350338 - DNA, 25 bp, Rattus norvegicus
gaggtcatcaccagtgccattaaag

SEQ ID NO: 350339 - DNA, 25 bp, Rattus norvegicus
gaggtcatcacctgtgccattaaag

SEQ ID NO: 350340 - DNA, 25 bp, Rattus norvegicus
gaggtcatcattccttctggaactt

SEQ ID NO: 350341 - DNA, 25 bp, Rattus norvegicus
gaggtcatcattgcttctggaactt

SEQ ID NO: 350342 - DNA, 25 bp, Rattus norvegicus
gaggtcatcctgaagctcagtctga

SEQ ID NO: 350343 - DNA, 25 bp, Rattus norvegicus
gaggtcatcctgagtctgaggcaag

SEQ ID NO: 350344 - DNA, 25 bp, Rattus norvegicus
gaggtcatcctgtagctcagtctga

SEQ ID NO: 350345 - DNA, 25 bp, Rattus norvegicus
gaggtcatcctgtgtctgaggcaag

SEQ ID NO: 350346 - DNA, 25 bp, Rattus norvegicus
gaggtcatccttcacaaccagcaag

SEQ ID NO: 350347 - DNA, 25 bp, Rattus norvegicus
gaggtcatccttcactagatggtga

SEQ ID NO: 350348 - DNA, 25 bp, Rattus norvegicus
gaggtcatccttgacaaccagcaag

SEQ ID NO: 350349 - DNA, 25 bp, Rattus norvegicus
gaggtcatccttgactagatggtga

SEQ ID NO: 350350 - DNA, 25 bp, Rattus norvegicus
gaggtcatctgcaaaatagccattt

SEQ ID NO: 350351 - DNA, 25 bp, Rattus norvegicus
gaggtcatctgctaaatagccattt

SEQ ID NO: 350352 - DNA, 25 bp, Rattus norvegicus
gaggtcatgatcagtcttgatattg

SEQ ID NO: 350353 - DNA, 25 bp, Rattus norvegicus
gaggtcatgatctgtcttgatattg

SEQ ID NO: 350354 - DNA, 25 bp, Rattus norvegicus
gaggtcatgcttctggtccacgtgc

SEQ ID NO: 350355 - DNA, 25 bp, Rattus norvegicus
gaggtcatgcttgtggtccacgtgc

SEQ ID NO: 350356 - DNA, 25 bp, Rattus norvegicus
gaggtcatggatccatagccaccac

SEQ ID NO: 350357 - DNA, 25 bp, Rattus norvegicus
gaggtcatggatgcatagccaccac

SEQ ID NO: 350358 - DNA, 25 bp, Rattus norvegicus
gaggtcatgggtattcacttccaaa

SEQ ID NO: 350359 - DNA, 25 bp, Rattus norvegicus
gaggtcatgggttttcacttccaaa

SEQ ID NO: 350360 - DNA, 25 bp, Rattus norvegicus
gaggtcatgtcccagtacaacgcca

SEQ ID NO: 350361 - DNA, 25 bp, Rattus norvegicus
gaggtcatgtccgagtacaacgcca

SEQ ID NO: 350362 - DNA, 25 bp, Rattus norvegicus
gaggtcatgtgacttgttagccact

SEQ ID NO: 350363 - DNA, 25 bp, Rattus norvegicus
gaggtcatgtgagttgttagccact

SEQ ID NO: 350364 - DNA, 25 bp, Rattus norvegicus
gaggtcattaagaggcccttagggt

SEQ ID NO: 350365 - DNA, 25 bp, Rattus norvegicus
gaggtcattaagctcacggacccgt

SEQ ID NO: 350366 - DNA, 25 bp, Rattus norvegicus
gaggtcattaaggtcacggacccgt

SEQ ID NO: 350367 - DNA, 25 bp, Rattus norvegicus
gaggtcattaagtggcccttagggt

SEQ ID NO: 350368 - DNA, 25 bp, Rattus norvegicus
gaggtcattcagcttttcagctgtt

SEQ ID NO: 350369 - DNA, 25 bp, Rattus norvegicus
gaggtcattcaggttttcagctgtt

SEQ ID NO: 350370 - DNA, 25 bp, Rattus norvegicus
gaggtcattcataagctcctagatg

SEQ ID NO: 350371 - DNA, 25 bp, Rattus norvegicus
gaggtcattcattagctcctagatg

SEQ ID NO: 350372 - DNA, 25 bp, Rattus norvegicus
gaggtcattcttatgctctttgaag

SEQ ID NO: 350373 - DNA, 25 bp, Rattus norvegicus
gaggtcattcttttgctctttgaag

SEQ ID NO: 350374 - DNA, 25 bp, Rattus norvegicus
gaggtcattggcctttataatctcc

SEQ ID NO: 350375 - DNA, 25 bp, Rattus norvegicus
gaggtcattggcgtttataatctcc

SEQ ID NO: 350376 - DNA, 25 bp, Rattus norvegicus
gaggtcatttacagagtccgctctc

SEQ ID NO: 350377 - DNA, 25 bp, Rattus norvegicus
gaggtcatttactgagtccgctctc

SEQ ID NO: 350378 - DNA, 25 bp, Rattus norvegicus
gaggtcatttgaacttttggtaaaa

SEQ ID NO: 350379 - DNA, 25 bp, Rattus norvegicus
gaggtcatttgatcttttggtaaaa

SEQ ID NO: 350380 - DNA, 25 bp, Rattus norvegicus
gaggtcattttgaagactccacatg

SEQ ID NO: 350381 - DNA, 25 bp, Rattus norvegicus
gaggtcattttgcagactcaggata

SEQ ID NO: 350382 - DNA, 25 bp, Rattus norvegicus
gaggtcattttggagactcaggata

SEQ ID NO: 350383 - DNA, 25 bp, Rattus norvegicus
gaggtcattttgtagactccacatg

SEQ ID NO: 350384 - DNA, 25 bp, Rattus norvegicus
gaggtccaaacccacccaggaagct

SEQ ID NO: 350385 - DNA, 25 bp, Rattus norvegicus
gaggtccaaaccgacccaggaagct

SEQ ID NO: 350386 - DNA, 25 bp, Rattus norvegicus
gaggtccaagaaagctggccgccat

SEQ ID NO: 350387 - DNA, 25 bp, Rattus norvegicus
gaggtccaagaatgctggccgccat

SEQ ID NO: 350388 - DNA, 25 bp, Rattus norvegicus
gaggtccaagccaagtgccttccag

SEQ ID NO: 350389 - DNA, 25 bp, Rattus norvegicus
gaggtccaagcccattttcaaaaca

SEQ ID NO: 350390 - DNA, 25 bp, Rattus norvegicus
gaggtccaagccgattttcaaaaca

SEQ ID NO: 350391 - DNA, 25 bp, Rattus norvegicus
gaggtccaagcctagtgccttccag

SEQ ID NO: 350392 - DNA, 25 bp, Rattus norvegicus
gaggtccaaggccagtagatttaaa

SEQ ID NO: 350393 - DNA, 25 bp, Rattus norvegicus
gaggtccaaggcgagtagatttaaa

SEQ ID NO: 350394 - DNA, 25 bp, Rattus norvegicus
gaggtccaatgacagttctcccaac

SEQ ID NO: 350395 - DNA, 25 bp, Rattus norvegicus
gaggtccaatgagagttctcccaac

SEQ ID NO: 350396 - DNA, 25 bp, Rattus norvegicus
gaggtccaattcattacctggagca

SEQ ID NO: 350397 - DNA, 25 bp, Rattus norvegicus
gaggtccaattctttacctggagca

SEQ ID NO: 350398 - DNA, 25 bp, Rattus norvegicus
gaggtccacagaattttaggtacgc

SEQ ID NO: 350399 - DNA, 25 bp, Rattus norvegicus
gaggtccacagatttttaggtacgc

SEQ ID NO: 350400 - DNA, 25 bp, Rattus norvegicus
gaggtccacaggaatacaccatggc

SEQ ID NO: 350401 - DNA, 25 bp, Rattus norvegicus
gaggtccacaggtatacaccatggc

SEQ ID NO: 350402 - DNA, 25 bp, Rattus norvegicus
gaggtccactagagatttattactt

SEQ ID NO: 350403 - DNA, 25 bp, Rattus norvegicus
gaggtccactagtgatttattactt

SEQ ID NO: 350404 - DNA, 25 bp, Rattus norvegicus
gaggtccactggaactgcagttagt

SEQ ID NO: 350405 - DNA, 25 bp, Rattus norvegicus
gaggtccactggtactgcagttagt

SEQ ID NO: 350406 - DNA, 25 bp, Rattus norvegicus
gaggtccagagtccctctgcttgga

SEQ ID NO: 350407 - DNA, 25 bp, Rattus norvegicus
gaggtccagagtgcctctgcttgga

SEQ ID NO: 350408 - DNA, 25 bp, Rattus norvegicus
gaggtccagcagaaggtccagtcac

SEQ ID NO: 350409 - DNA, 25 bp, Rattus norvegicus
gaggtccagcagtaggtccagtcac

SEQ ID NO: 350410 - DNA, 25 bp, Rattus norvegicus
gaggtccagctgatcttcgaactgg

SEQ ID NO: 350411 - DNA, 25 bp, Rattus norvegicus
gaggtccagctgttcttcgaactgg

SEQ ID NO: 350412 - DNA, 25 bp, Rattus norvegicus
gaggtccaggatcgcaaggtcatct

SEQ ID NO: 350413 - DNA, 25 bp, Rattus norvegicus
gaggtccaggatggcaaggtcatct

SEQ ID NO: 350414 - DNA, 25 bp, Rattus norvegicus
gaggtccagtttctgtttgtatctt

SEQ ID NO: 350415 - DNA, 25 bp, Rattus norvegicus
gaggtccagtttgtgtttgtatctt

SEQ ID NO: 350416 - DNA, 25 bp, Rattus norvegicus
gaggtccatcaactccaacaagcaa

SEQ ID NO: 350417 - DNA, 25 bp, Rattus norvegicus
gaggtccatcaagtccaacaagcaa

SEQ ID NO: 350418 - DNA, 25 bp, Rattus norvegicus
gaggtccatcacactaaaggagcat

SEQ ID NO: 350419 - DNA, 25 bp, Rattus norvegicus
gaggtccatcactctaaaggagcat

SEQ ID NO: 350420 - DNA, 25 bp, Rattus norvegicus
gaggtccatgatcgaggtgctcaac

SEQ ID NO: 350421 - DNA, 25 bp, Rattus norvegicus
gaggtccatgatggaggtgctcaac

SEQ ID NO: 350422 - DNA, 25 bp, Rattus norvegicus
gaggtcccaagtcttagcatttcca

SEQ ID NO: 350423 - DNA, 25 bp, Rattus norvegicus
gaggtcccaagtgttagcatttcca

SEQ ID NO: 350424 - DNA, 25 bp, Rattus norvegicus
gaggtcccacgtcatcattgcaaat

SEQ ID NO: 350425 - DNA, 25 bp, Rattus norvegicus
gaggtcccacgtgatcattgcaaat

SEQ ID NO: 350426 - DNA, 25 bp, Rattus norvegicus
gaggtcccagtgcactttgacagat

SEQ ID NO: 350427 - DNA, 25 bp, Rattus norvegicus
gaggtcccagtggactttgacagat

SEQ ID NO: 350428 - DNA, 25 bp, Rattus norvegicus
gaggtccccagccagaactggttat

SEQ ID NO: 350429 - DNA, 25 bp, Rattus norvegicus
gaggtccccagcgagaactggttat

SEQ ID NO: 350430 - DNA, 25 bp, Rattus norvegicus
gaggtcccctcactttctggacaga

SEQ ID NO: 350431 - DNA, 25 bp, Rattus norvegicus
gaggtcccctcagtttctggacaga

SEQ ID NO: 350432 - DNA, 25 bp, Rattus norvegicus
gaggtcccgatccttgcggctgcta

SEQ ID NO: 350433 - DNA, 25 bp, Rattus norvegicus
gaggtcccgatcgttgcggctgcta

SEQ ID NO: 350434 - DNA, 25 bp, Rattus norvegicus
gaggtcccgcaacgcatgggatgcg

SEQ ID NO: 350435 - DNA, 25 bp, Rattus norvegicus
gaggtcccgcaaggcatgggatgcg

SEQ ID NO: 350436 - DNA, 25 bp, Rattus norvegicus
gaggtccctaaactataaacatcca

SEQ ID NO: 350437 - DNA, 25 bp, Rattus norvegicus
gaggtccctaaagtataaacatcca

SEQ ID NO: 350438 - DNA, 25 bp, Rattus norvegicus
gaggtccctcaacgtagactcccaa

SEQ ID NO: 350439 - DNA, 25 bp, Rattus norvegicus
gaggtccctcaaggtagactcccaa

SEQ ID NO: 350440 - DNA, 25 bp, Rattus norvegicus
gaggtccctgtcatcattaggtaaa

SEQ ID NO: 350441 - DNA, 25 bp, Rattus norvegicus
gaggtccctgtcttcattaggtaaa

SEQ ID NO: 350442 - DNA, 25 bp, Rattus norvegicus
gaggtcccttggaaagccttagtgt

SEQ ID NO: 350443 - DNA, 25 bp, Rattus norvegicus
gaggtcccttggtaagccttagtgt

SEQ ID NO: 350444 - DNA, 25 bp, Rattus norvegicus
gaggtcctagataatgctccacagg

SEQ ID NO: 350445 - DNA, 25 bp, Rattus norvegicus
gaggtcctagattatgctccacagg

SEQ ID NO: 350446 - DNA, 25 bp, Rattus norvegicus
gaggtcctagctcagacgccatgta

SEQ ID NO: 350447 - DNA, 25 bp, Rattus norvegicus
gaggtcctagctgagacgccatgta

SEQ ID NO: 350448 - DNA, 25 bp, Rattus norvegicus
gaggtcctatacagatctcactgat

SEQ ID NO: 350449 - DNA, 25 bp, Rattus norvegicus
gaggtcctatactgatctcactgat

SEQ ID NO: 350450 - DNA, 25 bp, Rattus norvegicus
gaggtcctcaagaccaatggactct

SEQ ID NO: 350451 - DNA, 25 bp, Rattus norvegicus
gaggtcctcaagtccaatggactct

SEQ ID NO: 350452 - DNA, 25 bp, Rattus norvegicus
gaggtcctccatcaagtgttcatct

SEQ ID NO: 350453 - DNA, 25 bp, Rattus norvegicus
gaggtcctccatcatttattacatt

SEQ ID NO: 350454 - DNA, 25 bp, Rattus norvegicus
gaggtcctccatgaagtgttcatct

SEQ ID NO: 350455 - DNA, 25 bp, Rattus norvegicus
gaggtcctccatgatttattacatt

SEQ ID NO: 350456 - DNA, 25 bp, Rattus norvegicus
gaggtcctcctgactttgatgacca

SEQ ID NO: 350457 - DNA, 25 bp, Rattus norvegicus
gaggtcctcctgtctttgatgacca

SEQ ID NO: 350458 - DNA, 25 bp, Rattus norvegicus
gaggtcctctagagtacctgggtac

SEQ ID NO: 350459 - DNA, 25 bp, Rattus norvegicus
gaggtcctctagtgtacctgggtac

SEQ ID NO: 350460 - DNA, 25 bp, Rattus norvegicus
gaggtcctctcccagattgaacaag

SEQ ID NO: 350461 - DNA, 25 bp, Rattus norvegicus
gaggtcctctccgagattgaacaag

SEQ ID NO: 350462 - DNA, 25 bp, Rattus norvegicus
gaggtcctctgccaagaacttacag

SEQ ID NO: 350463 - DNA, 25 bp, Rattus norvegicus
gaggtcctctgcgaagaacttacag

SEQ ID NO: 350464 - DNA, 25 bp, Rattus norvegicus
gaggtcctgagaaccacatggtggc

SEQ ID NO: 350465 - DNA, 25 bp, Rattus norvegicus
gaggtcctgagatccacatggtggc

SEQ ID NO: 350466 - DNA, 25 bp, Rattus norvegicus
gaggtcctgattattcatcgtttta

SEQ ID NO: 350467 - DNA, 25 bp, Rattus norvegicus
gaggtcctgatttttcatcgtttta

SEQ ID NO: 350468 - DNA, 25 bp, Rattus norvegicus
gaggtcctgcatctgagaacgtatt

SEQ ID NO: 350469 - DNA, 25 bp, Rattus norvegicus
gaggtcctgcatgtgagaacgtatt

SEQ ID NO: 350470 - DNA, 25 bp, Rattus norvegicus
gaggtcctggagatcctgtcagtgt

SEQ ID NO: 350471 - DNA, 25 bp, Rattus norvegicus
gaggtcctggagttcctgtcagtgt

SEQ ID NO: 350472 - DNA, 25 bp, Rattus norvegicus
gaggtcctggctccagcatcttgtc

SEQ ID NO: 350473 - DNA, 25 bp, Rattus norvegicus
gaggtcctggctgcagcatcttgtc

SEQ ID NO: 350474 - DNA, 25 bp, Rattus norvegicus
gaggtcctgggtccaccaataaata

SEQ ID NO: 350475 - DNA, 25 bp, Rattus norvegicus
gaggtcctgggtgcaccaataaata

SEQ ID NO: 350476 - DNA, 25 bp, Rattus norvegicus
gaggtcctggtgatggtcaccatca

SEQ ID NO: 350477 - DNA, 25 bp, Rattus norvegicus
gaggtcctggtgttggtcaccatca

SEQ ID NO: 350478 - DNA, 25 bp, Rattus norvegicus
gaggtcctgttgcaaccgtgtgaca

SEQ ID NO: 350479 - DNA, 25 bp, Rattus norvegicus
gaggtcctgttggaaccgtgtgaca

SEQ ID NO: 350480 - DNA, 25 bp, Rattus norvegicus
gaggtccttaccaccgatccagtta

SEQ ID NO: 350481 - DNA, 25 bp, Rattus norvegicus
gaggtccttacctccgatccagtta

SEQ ID NO: 350482 - DNA, 25 bp, Rattus norvegicus
gaggtccttcacatgagacttgctg

SEQ ID NO: 350483 - DNA, 25 bp, Rattus norvegicus
gaggtccttcacttgagacttgctg

SEQ ID NO: 350484 - DNA, 25 bp, Rattus norvegicus
gaggtccttctaacccaagagtcat

SEQ ID NO: 350485 - DNA, 25 bp, Rattus norvegicus
gaggtccttctatcccaagagtcat

SEQ ID NO: 350486 - DNA, 25 bp, Rattus norvegicus
gaggtccttctgcacagaaagccaa

SEQ ID NO: 350487 - DNA, 25 bp, Rattus norvegicus
gaggtccttctggacagaaagccaa

SEQ ID NO: 350488 - DNA, 25 bp, Rattus norvegicus
gaggtcgaagcacaagaggttccca

SEQ ID NO: 350489 - DNA, 25 bp, Rattus norvegicus
gaggtcgaagcagaagaggttccca

SEQ ID NO: 350490 - DNA, 25 bp, Rattus norvegicus
gaggtcgaccagcagttcatcaata

SEQ ID NO: 350491 - DNA, 25 bp, Rattus norvegicus
gaggtcgaccaggagttcatcaata

SEQ ID NO: 350492 - DNA, 25 bp, Rattus norvegicus
gaggtcgaccttcagtgtcattcct

SEQ ID NO: 350493 - DNA, 25 bp, Rattus norvegicus
gaggtcgaccttgagtgtcattcct

SEQ ID NO: 350494 - DNA, 25 bp, Rattus norvegicus
gaggtcgatgttactggtccaataa

SEQ ID NO: 350495 - DNA, 25 bp, Rattus norvegicus
gaggtcgatgtttctggtccaataa

SEQ ID NO: 350496 - DNA, 25 bp, Rattus norvegicus
gaggtcgcgacaaaacgtgggaaaa

SEQ ID NO: 350497 - DNA, 25 bp, Rattus norvegicus
gaggtcgcgacataacgtgggaaaa

SEQ ID NO: 350498 - DNA, 25 bp, Rattus norvegicus
gaggtcggagacacactgttgattg

SEQ ID NO: 350499 - DNA, 25 bp, Rattus norvegicus
gaggtcggagactcactgttgattg

SEQ ID NO: 350500 - DNA, 25 bp, Rattus norvegicus
gaggtcgggcataaccaccttcaga

SEQ ID NO: 350501 - DNA, 25 bp, Rattus norvegicus
gaggtcgggcattaccaccttcaga

SEQ ID NO: 350502 - DNA, 25 bp, Rattus norvegicus
gaggtcggtctgctctgcagatcca

SEQ ID NO: 350503 - DNA, 25 bp, Rattus norvegicus
gaggtcggtctggtctgcagatcca

SEQ ID NO: 350504 - DNA, 25 bp, Rattus norvegicus
gaggtcggttgcatgcagccatttc

SEQ ID NO: 350505 - DNA, 25 bp, Rattus norvegicus
gaggtcggttgcttgcagccatttc

SEQ ID NO: 350506 - DNA, 25 bp, Rattus norvegicus
gaggtcgtagtcaaggtgcgtccca

SEQ ID NO: 350507 - DNA, 25 bp, Rattus norvegicus
gaggtcgtagtctaggtgcgtccca

SEQ ID NO: 350508 - DNA, 25 bp, Rattus norvegicus
gaggtcgtcagcagcttatatcctg

SEQ ID NO: 350509 - DNA, 25 bp, Rattus norvegicus
gaggtcgtcagctgcttatatcctg

SEQ ID NO: 350510 - DNA, 25 bp, Rattus norvegicus
gaggtcgtcctccaaagaagatttt

SEQ ID NO: 350511 - DNA, 25 bp, Rattus norvegicus
gaggtcgtcctcgaaagaagatttt

SEQ ID NO: 350512 - DNA, 25 bp, Rattus norvegicus
gaggtcgtgcccaatgtaaatgcat

SEQ ID NO: 350513 - DNA, 25 bp, Rattus norvegicus
gaggtcgtgccctatgtaaatgcat

SEQ ID NO: 350514 - DNA, 25 bp, Rattus norvegicus
gaggtcgttctgagaattgcatgtt

SEQ ID NO: 350515 - DNA, 25 bp, Rattus norvegicus
gaggtcgttctgtgaattgcatgtt

SEQ ID NO: 350516 - DNA, 25 bp, Rattus norvegicus
gaggtctaatcacaccctgggctca

SEQ ID NO: 350517 - DNA, 25 bp, Rattus norvegicus
gaggtctaatcagaccctgggctca

SEQ ID NO: 350518 - DNA, 25 bp, Rattus norvegicus
gaggtctacagtattgccagtgagc

SEQ ID NO: 350519 - DNA, 25 bp, Rattus norvegicus
gaggtctacagttttgccagtgagc

SEQ ID NO: 350520 - DNA, 25 bp, Rattus norvegicus
gaggtctaccatatcaccttggaga

SEQ ID NO: 350521 - DNA, 25 bp, Rattus norvegicus
gaggtctaccatttcaccttggaga

SEQ ID NO: 350522 - DNA, 25 bp, Rattus norvegicus
gaggtctaccctacttttgcagtga

SEQ ID NO: 350523 - DNA, 25 bp, Rattus norvegicus
gaggtctacccttcttttgcagtga

SEQ ID NO: 350524 - DNA, 25 bp, Rattus norvegicus
gaggtctacggcaatggtccataca

SEQ ID NO: 350525 - DNA, 25 bp, Rattus norvegicus
gaggtctacggctatggtccataca

SEQ ID NO: 350526 - DNA, 25 bp, Rattus norvegicus
gaggtctacgttactattaccgccg

SEQ ID NO: 350527 - DNA, 25 bp, Rattus norvegicus
gaggtctacgtttctattaccgccg

SEQ ID NO: 350528 - DNA, 25 bp, Rattus norvegicus
gaggtctactgtaacaaaatccaag

SEQ ID NO: 350529 - DNA, 25 bp, Rattus norvegicus
gaggtctactgttacaaaatccaag

SEQ ID NO: 350530 - DNA, 25 bp, Rattus norvegicus
gaggtctagacaatcagggctatgt

SEQ ID NO: 350531 - DNA, 25 bp, Rattus norvegicus
gaggtctagacattcagggctatgt

SEQ ID NO: 350532 - DNA, 25 bp, Rattus norvegicus
gaggtctagctgacagtctctgagt

SEQ ID NO: 350533 - DNA, 25 bp, Rattus norvegicus
gaggtctagctgtcagtctctgagt

SEQ ID NO: 350534 - DNA, 25 bp, Rattus norvegicus
gaggtctaggaaaatgcatctgtct

SEQ ID NO: 350535 - DNA, 25 bp, Rattus norvegicus
gaggtctaggaatatgcatctgtct

SEQ ID NO: 350536 - DNA, 25 bp, Rattus norvegicus
gaggtctagtcacgatcaagacaaa

SEQ ID NO: 350537 - DNA, 25 bp, Rattus norvegicus
gaggtctagtcaggatcaagacaaa

SEQ ID NO: 350538 - DNA, 25 bp, Rattus norvegicus
gaggtctatagcacatctctgggct

SEQ ID NO: 350539 - DNA, 25 bp, Rattus norvegicus
gaggtctatagctcatctctgggct

SEQ ID NO: 350540 - DNA, 25 bp, Rattus norvegicus
gaggtctatctaccaagctgctgag

SEQ ID NO: 350541 - DNA, 25 bp, Rattus norvegicus
gaggtctatctagcaagctgctgag

SEQ ID NO: 350542 - DNA, 25 bp, Rattus norvegicus
gaggtctatctgatagccacacagt

SEQ ID NO: 350543 - DNA, 25 bp, Rattus norvegicus
gaggtctatctgttagccacacagt

SEQ ID NO: 350544 - DNA, 25 bp, Rattus norvegicus
gaggtctatgtgaccttttatggaa

SEQ ID NO: 350545 - DNA, 25 bp, Rattus norvegicus
gaggtctatgtgcaatctctagtac

SEQ ID NO: 350546 - DNA, 25 bp, Rattus norvegicus
gaggtctatgtggaatctctagtac

SEQ ID NO: 350547 - DNA, 25 bp, Rattus norvegicus
gaggtctatgtgtccttttatggaa

SEQ ID NO: 350548 - DNA, 25 bp, Rattus norvegicus
gaggtctcaaatcctcaacctgtac

SEQ ID NO: 350549 - DNA, 25 bp, Rattus norvegicus
gaggtctcaaatgctcaacctgtac

SEQ ID NO: 350550 - DNA, 25 bp, Rattus norvegicus
gaggtctcaacaacatggttctcaa

SEQ ID NO: 350551 - DNA, 25 bp, Rattus norvegicus
gaggtctcaacatcatggttctcaa

SEQ ID NO: 350552 - DNA, 25 bp, Rattus norvegicus
gaggtctcaaccacataagtcgtgt

SEQ ID NO: 350553 - DNA, 25 bp, Rattus norvegicus
gaggtctcaacctcataagtcgtgt

SEQ ID NO: 350554 - DNA, 25 bp, Rattus norvegicus
gaggtctcaagtacgcagtgggaaa

SEQ ID NO: 350555 - DNA, 25 bp, Rattus norvegicus
gaggtctcaagttcgcagtgggaaa

SEQ ID NO: 350556 - DNA, 25 bp, Rattus norvegicus
gaggtctcacagaatttcgcatgct

SEQ ID NO: 350557 - DNA, 25 bp, Rattus norvegicus
gaggtctcacagtatttcgcatgct

SEQ ID NO: 350558 - DNA, 25 bp, Rattus norvegicus
gaggtctcactgagtgactgtatct

SEQ ID NO: 350559 - DNA, 25 bp, Rattus norvegicus
gaggtctcactgtgtgactgtatct

SEQ ID NO: 350560 - DNA, 25 bp, Rattus norvegicus
gaggtctcagccctagatcaggaga

SEQ ID NO: 350561 - DNA, 25 bp, Rattus norvegicus
gaggtctcagccgtagatcaggaga

SEQ ID NO: 350562 - DNA, 25 bp, Rattus norvegicus
gaggtctcagcgatctgttcctgag

SEQ ID NO: 350563 - DNA, 25 bp, Rattus norvegicus
gaggtctcagcgttctgttcctgag

SEQ ID NO: 350564 - DNA, 25 bp, Rattus norvegicus
gaggtctcagctacgacaccaatga

SEQ ID NO: 350565 - DNA, 25 bp, Rattus norvegicus
gaggtctcagcttcgacaccaatga

SEQ ID NO: 350566 - DNA, 25 bp, Rattus norvegicus
gaggtctcatgaacccaggcaaagt

SEQ ID NO: 350567 - DNA, 25 bp, Rattus norvegicus
gaggtctcatgatcccaggcaaagt

SEQ ID NO: 350568 - DNA, 25 bp, Rattus norvegicus
gaggtctcattcatttgcagctcct

SEQ ID NO: 350569 - DNA, 25 bp, Rattus norvegicus
gaggtctcattcttttgcagctcct

SEQ ID NO: 350570 - DNA, 25 bp, Rattus norvegicus
gaggtctccaccactgaagacattg

SEQ ID NO: 350571 - DNA, 25 bp, Rattus norvegicus
gaggtctccaccctttgaaggcaaa

SEQ ID NO: 350572 - DNA, 25 bp, Rattus norvegicus
gaggtctccaccgtttgaaggcaaa

SEQ ID NO: 350573 - DNA, 25 bp, Rattus norvegicus
gaggtctccacctctgaagacattg

SEQ ID NO: 350574 - DNA, 25 bp, Rattus norvegicus
gaggtctccagaaagcctacaggct

SEQ ID NO: 350575 - DNA, 25 bp, Rattus norvegicus
gaggtctccagatagcctacaggct

SEQ ID NO: 350576 - DNA, 25 bp, Rattus norvegicus
gaggtctccaggattgaaatcgcga

SEQ ID NO: 350577 - DNA, 25 bp, Rattus norvegicus
gaggtctccaggtttgaaatcgcga

SEQ ID NO: 350578 - DNA, 25 bp, Rattus norvegicus
gaggtctcgcagcagcccagtgaat

SEQ ID NO: 350579 - DNA, 25 bp, Rattus norvegicus
gaggtctcgcaggagcccagtgaat

SEQ ID NO: 350580 - DNA, 25 bp, Rattus norvegicus
gaggtctctattacataggtcaaat

SEQ ID NO: 350581 - DNA, 25 bp, Rattus norvegicus
gaggtctctattaggtcccttgagg

SEQ ID NO: 350582 - DNA, 25 bp, Rattus norvegicus
gaggtctctatttcataggtcaaat

SEQ ID NO: 350583 - DNA, 25 bp, Rattus norvegicus
gaggtctctatttggtcccttgagg

SEQ ID NO: 350584 - DNA, 25 bp, Rattus norvegicus
gaggtctctgaaccaccaggaggcc

SEQ ID NO: 350585 - DNA, 25 bp, Rattus norvegicus
gaggtctctgaagcaccaggaggcc

SEQ ID NO: 350586 - DNA, 25 bp, Rattus norvegicus
gaggtctctgcccatgtgtttgcag

SEQ ID NO: 350587 - DNA, 25 bp, Rattus norvegicus
gaggtctctgccgatgtgtttgcag

SEQ ID NO: 350588 - DNA, 25 bp, Rattus norvegicus
gaggtctgaaggaaccccacgaagg

SEQ ID NO: 350589 - DNA, 25 bp, Rattus norvegicus
gaggtctgaaggtaccccacgaagg

SEQ ID NO: 350590 - DNA, 25 bp, Rattus norvegicus
gaggtctgaattaattcccaccagt

SEQ ID NO: 350591 - DNA, 25 bp, Rattus norvegicus
gaggtctgaatttattcccaccagt

SEQ ID NO: 350592 - DNA, 25 bp, Rattus norvegicus
gaggtctgaggacacggccacttat

SEQ ID NO: 350593 - DNA, 25 bp, Rattus norvegicus
gaggtctgaggagacggccacttat

SEQ ID NO: 350594 - DNA, 25 bp, Rattus norvegicus
gaggtctgcagccacatctgtgaaa

SEQ ID NO: 350595 - DNA, 25 bp, Rattus norvegicus
gaggtctgcagcgacatctgtgaaa

SEQ ID NO: 350596 - DNA, 25 bp, Rattus norvegicus
gaggtctgcgagaccttgaggccaa

SEQ ID NO: 350597 - DNA, 25 bp, Rattus norvegicus
gaggtctgcgagtccttgaggccaa

SEQ ID NO: 350598 - DNA, 25 bp, Rattus norvegicus
gaggtctgctctactgtggagagaa

SEQ ID NO: 350599 - DNA, 25 bp, Rattus norvegicus
gaggtctgctcttctgtggagagaa

SEQ ID NO: 350600 - DNA, 25 bp, Rattus norvegicus
gaggtctgctgcaaactggaaaact

SEQ ID NO: 350601 - DNA, 25 bp, Rattus norvegicus
gaggtctgctgctaactggaaaact

SEQ ID NO: 350602 - DNA, 25 bp, Rattus norvegicus
gaggtctggactaggcatcagtgca

SEQ ID NO: 350603 - DNA, 25 bp, Rattus norvegicus
gaggtctggacttggcatcagtgca

SEQ ID NO: 350604 - DNA, 25 bp, Rattus norvegicus
gaggtctggtttctaactttccttg

SEQ ID NO: 350605 - DNA, 25 bp, Rattus norvegicus
gaggtctggtttgtaactttccttg

SEQ ID NO: 350606 - DNA, 25 bp, Rattus norvegicus
gaggtctgtgatcatgcactcaagc

SEQ ID NO: 350607 - DNA, 25 bp, Rattus norvegicus
gaggtctgtgatgatgcactcaagc

SEQ ID NO: 350608 - DNA, 25 bp, Rattus norvegicus
gaggtctgtgtgctagtttcattct

SEQ ID NO: 350609 - DNA, 25 bp, Rattus norvegicus
gaggtctgtgtggtagtttcattct

SEQ ID NO: 350610 - DNA, 25 bp, Rattus norvegicus
gaggtctgtttcaattccgtatgta

SEQ ID NO: 350611 - DNA, 25 bp, Rattus norvegicus
gaggtctgtttctattccgtatgta

SEQ ID NO: 350612 - DNA, 25 bp, Rattus norvegicus
gaggtcttaaaacccctgctgttca

SEQ ID NO: 350613 - DNA, 25 bp, Rattus norvegicus
gaggtcttaaaagccctgctgttca

SEQ ID NO: 350614 - DNA, 25 bp, Rattus norvegicus
gaggtcttaagcacactcatgtggt

SEQ ID NO: 350615 - DNA, 25 bp, Rattus norvegicus
gaggtcttaagctcactcatgtggt

SEQ ID NO: 350616 - DNA, 25 bp, Rattus norvegicus
gaggtcttagacaggcatctacttc

SEQ ID NO: 350617 - DNA, 25 bp, Rattus norvegicus
gaggtcttagactggcatctacttc

SEQ ID NO: 350618 - DNA, 25 bp, Rattus norvegicus
gaggtcttagcactttgggtatttt

SEQ ID NO: 350619 - DNA, 25 bp, Rattus norvegicus
gaggtcttagcagtttgggtatttt

SEQ ID NO: 350620 - DNA, 25 bp, Rattus norvegicus
gaggtcttatgactgcagtacttgt

SEQ ID NO: 350621 - DNA, 25 bp, Rattus norvegicus
gaggtcttatgagtgcagtacttgt

SEQ ID NO: 350622 - DNA, 25 bp, Rattus norvegicus
gaggtcttatggactgcttttccaa

SEQ ID NO: 350623 - DNA, 25 bp, Rattus norvegicus
gaggtcttatggtctgcttttccaa

SEQ ID NO: 350624 - DNA, 25 bp, Rattus norvegicus
gaggtcttcaccagggactagagaa

SEQ ID NO: 350625 - DNA, 25 bp, Rattus norvegicus
gaggtcttcacctgggactagagaa

SEQ ID NO: 350626 - DNA, 25 bp, Rattus norvegicus
gaggtcttcattactcatgtttgac

SEQ ID NO: 350627 - DNA, 25 bp, Rattus norvegicus
gaggtcttcatttctcatgtttgac

SEQ ID NO: 350628 - DNA, 25 bp, Rattus norvegicus
gaggtcttccaacaaaaaggcttcg

SEQ ID NO: 350629 - DNA, 25 bp, Rattus norvegicus
gaggtcttccaagaaaaaggcttcg

SEQ ID NO: 350630 - DNA, 25 bp, Rattus norvegicus
gaggtcttcctgatgtcccaaacag

SEQ ID NO: 350631 - DNA, 25 bp, Rattus norvegicus
gaggtcttcctgttgtcccaaacag

SEQ ID NO: 350632 - DNA, 25 bp, Rattus norvegicus
gaggtcttcgctaatgttcgagttt

SEQ ID NO: 350633 - DNA, 25 bp, Rattus norvegicus
gaggtcttcgcttatgttcgagttt

SEQ ID NO: 350634 - DNA, 25 bp, Rattus norvegicus
gaggtcttctcgctgtctaattaat

SEQ ID NO: 350635 - DNA, 25 bp, Rattus norvegicus
gaggtcttctcggtgtctaattaat

SEQ ID NO: 350636 - DNA, 25 bp, Rattus norvegicus
gaggtcttgaatactcggtggactt

SEQ ID NO: 350637 - DNA, 25 bp, Rattus norvegicus
gaggtcttgaattctcggtggactt

SEQ ID NO: 350638 - DNA, 25 bp, Rattus norvegicus
gaggtcttgatgatagccacacagt

SEQ ID NO: 350639 - DNA, 25 bp, Rattus norvegicus
gaggtcttgatgttagccacacagt

SEQ ID NO: 350640 - DNA, 25 bp, Rattus norvegicus
gaggtcttgggcagacaatatgtca

SEQ ID NO: 350641 - DNA, 25 bp, Rattus norvegicus
gaggtcttgggctgacaatatgtca

SEQ ID NO: 350642 - DNA, 25 bp, Rattus norvegicus
gaggtctttagactttgtgtcccct

SEQ ID NO: 350643 - DNA, 25 bp, Rattus norvegicus
gaggtctttagagtttgtgtcccct

SEQ ID NO: 350644 - DNA, 25 bp, Rattus norvegicus
gaggtctttatgacatagcacttgc

SEQ ID NO: 350645 - DNA, 25 bp, Rattus norvegicus
gaggtctttatgtcatagcacttgc

SEQ ID NO: 350646 - DNA, 25 bp, Rattus norvegicus
gaggtctttcagattctggccaggc

SEQ ID NO: 350647 - DNA, 25 bp, Rattus norvegicus
gaggtctttcagtttctggccaggc

SEQ ID NO: 350648 - DNA, 25 bp, Rattus norvegicus
gaggtctttctacaacacgcacata

SEQ ID NO: 350649 - DNA, 25 bp, Rattus norvegicus
gaggtctttctagaacacgcacata

SEQ ID NO: 350650 - DNA, 25 bp, Rattus norvegicus
gaggtctttgacaggcttcatttaa

SEQ ID NO: 350651 - DNA, 25 bp, Rattus norvegicus
gaggtctttgactggcttcatttaa

SEQ ID NO: 350652 - DNA, 25 bp, Rattus norvegicus
gaggtctttgagcatcaggaagtct

SEQ ID NO: 350653 - DNA, 25 bp, Rattus norvegicus
gaggtctttgaggatcaggaagtct

SEQ ID NO: 350654 - DNA, 25 bp, Rattus norvegicus
gaggtctttgtacatcgactttaag

SEQ ID NO: 350655 - DNA, 25 bp, Rattus norvegicus
gaggtctttgtagatcgactttaag

SEQ ID NO: 350656 - DNA, 25 bp, Rattus norvegicus
gaggtctttgtcacgtgtatcagat

SEQ ID NO: 350657 - DNA, 25 bp, Rattus norvegicus
gaggtctttgtctcgtgtatcagat

SEQ ID NO: 350658 - DNA, 25 bp, Rattus norvegicus
gaggtctttgtgatacttcggttat

SEQ ID NO: 350659 - DNA, 25 bp, Rattus norvegicus
gaggtctttgtgttacttcggttat

SEQ ID NO: 350660 - DNA, 25 bp, Rattus norvegicus
gaggtgaaacagcaactgctctcta

SEQ ID NO: 350661 - DNA, 25 bp, Rattus norvegicus
gaggtgaaacaggaactgctctcta

SEQ ID NO: 350662 - DNA, 25 bp, Rattus norvegicus
gaggtgaaactcaatcttctgtccc

SEQ ID NO: 350663 - DNA, 25 bp, Rattus norvegicus
gaggtgaaactctatcttctgtccc

SEQ ID NO: 350664 - DNA, 25 bp, Rattus norvegicus
gaggtgaaccagattctcatcaagt

SEQ ID NO: 350665 - DNA, 25 bp, Rattus norvegicus
gaggtgaaccagtttctcatcaagt

SEQ ID NO: 350666 - DNA, 25 bp, Rattus norvegicus
gaggtgaagtgcactctcgaggctc

SEQ ID NO: 350667 - DNA, 25 bp, Rattus norvegicus
gaggtgaagtgctctctcgaggctc

SEQ ID NO: 350668 - DNA, 25 bp, Rattus norvegicus
gaggtgaagttcctgctatgctgcc

SEQ ID NO: 350669 - DNA, 25 bp, Rattus norvegicus
gaggtgaagttcgtgctatgctgcc

SEQ ID NO: 350670 - DNA, 25 bp, Rattus norvegicus
gaggtgaatctcattccgtgtgaat

SEQ ID NO: 350671 - DNA, 25 bp, Rattus norvegicus
gaggtgaatctctttccgtgtgaat

SEQ ID NO: 350672 - DNA, 25 bp, Rattus norvegicus
gaggtgaatggaaaaacgcctaatt

SEQ ID NO: 350673 - DNA, 25 bp, Rattus norvegicus
gaggtgaatggataaacgcctaatt

SEQ ID NO: 350674 - DNA, 25 bp, Rattus norvegicus
gaggtgacaccacttaaccccagta

SEQ ID NO: 350675 - DNA, 25 bp, Rattus norvegicus
gaggtgacaccagttaaccccagta

SEQ ID NO: 350676 - DNA, 25 bp, Rattus norvegicus
gaggtgacacctaagggttctgaga

SEQ ID NO: 350677 - DNA, 25 bp, Rattus norvegicus
gaggtgacaccttagggttctgaga

SEQ ID NO: 350678 - DNA, 25 bp, Rattus norvegicus
gaggtgacactactgctgacattag

SEQ ID NO: 350679 - DNA, 25 bp, Rattus norvegicus
gaggtgacactagtgctgacattag

SEQ ID NO: 350680 - DNA, 25 bp, Rattus norvegicus
gaggtgacagtcagccatcgattca

SEQ ID NO: 350681 - DNA, 25 bp, Rattus norvegicus
gaggtgacagtctgccatcgattca

SEQ ID NO: 350682 - DNA, 25 bp, Rattus norvegicus
gaggtgacatcaacgtcctggtaat

SEQ ID NO: 350683 - DNA, 25 bp, Rattus norvegicus
gaggtgacatcatcgtcctggtaat

SEQ ID NO: 350684 - DNA, 25 bp, Rattus norvegicus
gaggtgacatttatctcctttcaat

SEQ ID NO: 350685 - DNA, 25 bp, Rattus norvegicus
gaggtgacatttttctcctttcaat

SEQ ID NO: 350686 - DNA, 25 bp, Rattus norvegicus
gaggtgaccaaaaatgcattgcagt

SEQ ID NO: 350687 - DNA, 25 bp, Rattus norvegicus
gaggtgaccaaatatgcattgcagt

SEQ ID NO: 350688 - DNA, 25 bp, Rattus norvegicus
gaggtgacccaactctcctgggaaa

SEQ ID NO: 350689 - DNA, 25 bp, Rattus norvegicus
gaggtgacccaagtctcctgggaaa

SEQ ID NO: 350690 - DNA, 25 bp, Rattus norvegicus
gaggtgacctatcccatgtggacgt

SEQ ID NO: 350691 - DNA, 25 bp, Rattus norvegicus
gaggtgacctatgccatgtggacgt

SEQ ID NO: 350692 - DNA, 25 bp, Rattus norvegicus
gaggtgacctgcctatttccttgtc

SEQ ID NO: 350693 - DNA, 25 bp, Rattus norvegicus
gaggtgacctgcgtatttccttgtc

SEQ ID NO: 350694 - DNA, 25 bp, Rattus norvegicus
gaggtgacctgtagctttggcacat

SEQ ID NO: 350695 - DNA, 25 bp, Rattus norvegicus
gaggtgacctgttgctttggcacat

SEQ ID NO: 350696 - DNA, 25 bp, Rattus norvegicus
gaggtgacctttactcagagaccaa

SEQ ID NO: 350697 - DNA, 25 bp, Rattus norvegicus
gaggtgaccttttctcagagaccaa

SEQ ID NO: 350698 - DNA, 25 bp, Rattus norvegicus
gaggtgacgaaaccattcctccagc

SEQ ID NO: 350699 - DNA, 25 bp, Rattus norvegicus
gaggtgacgaaagcattcctccagc

SEQ ID NO: 350700 - DNA, 25 bp, Rattus norvegicus
gaggtgactaatacagtctccataa

SEQ ID NO: 350701 - DNA, 25 bp, Rattus norvegicus
gaggtgactaattcagtctccataa

SEQ ID NO: 350702 - DNA, 25 bp, Rattus norvegicus
gaggtgactactacagtctctgtag

SEQ ID NO: 350703 - DNA, 25 bp, Rattus norvegicus
gaggtgactacttcagtctctgtag

SEQ ID NO: 350704 - DNA, 25 bp, Rattus norvegicus
gaggtgactctaaatttgcacttaa

SEQ ID NO: 350705 - DNA, 25 bp, Rattus norvegicus
gaggtgactctatatttgcacttaa

SEQ ID NO: 350706 - DNA, 25 bp, Rattus norvegicus
gaggtgactctgattgcctgaggtc

SEQ ID NO: 350707 - DNA, 25 bp, Rattus norvegicus
gaggtgactctgtttgcctgaggtc

SEQ ID NO: 350708 - DNA, 25 bp, Rattus norvegicus
gaggtgactgcacgttttggatttt

SEQ ID NO: 350709 - DNA, 25 bp, Rattus norvegicus
gaggtgactgcaggttttggatttt

SEQ ID NO: 350710 - DNA, 25 bp, Rattus norvegicus
gaggtgactgtgaattctggtctca

SEQ ID NO: 350711 - DNA, 25 bp, Rattus norvegicus
gaggtgactgtgtattctggtctca

SEQ ID NO: 350712 - DNA, 25 bp, Rattus norvegicus
gaggtgagaaccctcaggtaccctc

SEQ ID NO: 350713 - DNA, 25 bp, Rattus norvegicus
gaggtgagaaccgtcaggtaccctc

SEQ ID NO: 350714 - DNA, 25 bp, Rattus norvegicus
gaggtgagaattagtcatactgtta

SEQ ID NO: 350715 - DNA, 25 bp, Rattus norvegicus
gaggtgagaatttgtcatactgtta

SEQ ID NO: 350716 - DNA, 25 bp, Rattus norvegicus
gaggtgagatggctgctcttttatt

SEQ ID NO: 350717 - DNA, 25 bp, Rattus norvegicus
gaggtgagatgggtgctcttttatt

SEQ ID NO: 350718 - DNA, 25 bp, Rattus norvegicus
gaggtgagcgacatcagatttcatt

SEQ ID NO: 350719 - DNA, 25 bp, Rattus norvegicus
gaggtgagcgacttcagatttcatt

SEQ ID NO: 350720 - DNA, 25 bp, Rattus norvegicus
gaggtgagcgtcatcaggccgttcc

SEQ ID NO: 350721 - DNA, 25 bp, Rattus norvegicus
gaggtgagcgtcttcaggccgttcc

SEQ ID NO: 350722 - DNA, 25 bp, Rattus norvegicus
gaggtgagctcaaaggctgcgccca

SEQ ID NO: 350723 - DNA, 25 bp, Rattus norvegicus
gaggtgagctcataggctgcgccca

SEQ ID NO: 350724 - DNA, 25 bp, Rattus norvegicus
gaggtgagcttcctaagattccgcc

SEQ ID NO: 350725 - DNA, 25 bp, Rattus norvegicus
gaggtgagcttcgtaagattccgcc

SEQ ID NO: 350726 - DNA, 25 bp, Rattus norvegicus
gaggtgaggcccaatcccaagtaaa

SEQ ID NO: 350727 - DNA, 25 bp, Rattus norvegicus
gaggtgaggccctatcccaagtaaa

SEQ ID NO: 350728 - DNA, 25 bp, Rattus norvegicus
gaggtgagtgccaactgccggcatc

SEQ ID NO: 350729 - DNA, 25 bp, Rattus norvegicus
gaggtgagtgcctactgccggcatc

SEQ ID NO: 350730 - DNA, 25 bp, Rattus norvegicus
gaggtgagtgctagtatcccaaatt

SEQ ID NO: 350731 - DNA, 25 bp, Rattus norvegicus
gaggtgagtgcttgtatcccaaatt

SEQ ID NO: 350732 - DNA, 25 bp, Rattus norvegicus
gaggtgagttctccccaatgatctg

SEQ ID NO: 350733 - DNA, 25 bp, Rattus norvegicus
gaggtgagttctgcccaatgatctg

SEQ ID NO: 350734 - DNA, 25 bp, Rattus norvegicus
gaggtgatcaacaggcttgaccgaa

SEQ ID NO: 350735 - DNA, 25 bp, Rattus norvegicus
gaggtgatcaactggcttgaccgaa

SEQ ID NO: 350736 - DNA, 25 bp, Rattus norvegicus
gaggtgatcatgcacccagcattag

SEQ ID NO: 350737 - DNA, 25 bp, Rattus norvegicus
gaggtgatcatggacccagcattag

SEQ ID NO: 350738 - DNA, 25 bp, Rattus norvegicus
gaggtgatcgacatctcacacgggc

SEQ ID NO: 350739 - DNA, 25 bp, Rattus norvegicus
gaggtgatcgacttctcacacgggc

SEQ ID NO: 350740 - DNA, 25 bp, Rattus norvegicus
gaggtgatctggatgctctgtaatc

SEQ ID NO: 350741 - DNA, 25 bp, Rattus norvegicus
gaggtgatctggttgctctgtaatc

SEQ ID NO: 350742 - DNA, 25 bp, Rattus norvegicus
gaggtgatggccacatttgactccc

SEQ ID NO: 350743 - DNA, 25 bp, Rattus norvegicus
gaggtgatggcctcatttgactccc

SEQ ID NO: 350744 - DNA, 25 bp, Rattus norvegicus
gaggtgatggttacctagacagcac

SEQ ID NO: 350745 - DNA, 25 bp, Rattus norvegicus
gaggtgatggtttcctagacagcac

SEQ ID NO: 350746 - DNA, 25 bp, Rattus norvegicus
gaggtgatgtctccctagcaactga

SEQ ID NO: 350747 - DNA, 25 bp, Rattus norvegicus
gaggtgatgtctgcctagcaactga

SEQ ID NO: 350748 - DNA, 25 bp, Rattus norvegicus
gaggtgatgttcatggcaacccaag

SEQ ID NO: 350749 - DNA, 25 bp, Rattus norvegicus
gaggtgatgttcttggcaacccaag

SEQ ID NO: 350750 - DNA, 25 bp, Rattus norvegicus
gaggtgattcttcgcttttctatca

SEQ ID NO: 350751 - DNA, 25 bp, Rattus norvegicus
gaggtgattcttggcttttctatca

SEQ ID NO: 350752 - DNA, 25 bp, Rattus norvegicus
gaggtgcaactgaattccaaaaggg

SEQ ID NO: 350753 - DNA, 25 bp, Rattus norvegicus
gaggtgcaactgtattccaaaaggg

SEQ ID NO: 350754 - DNA, 25 bp, Rattus norvegicus
gaggtgcaagttcccattgtagaaa

SEQ ID NO: 350755 - DNA, 25 bp, Rattus norvegicus
gaggtgcaagttgccattgtagaaa

SEQ ID NO: 350756 - DNA, 25 bp, Rattus norvegicus
gaggtgcacaagcagatccttgcta

SEQ ID NO: 350757 - DNA, 25 bp, Rattus norvegicus
gaggtgcacaaggagatccttgcta

SEQ ID NO: 350758 - DNA, 25 bp, Rattus norvegicus
gaggtgcacactcctcatgtgtcag

SEQ ID NO: 350759 - DNA, 25 bp, Rattus norvegicus
gaggtgcacactgctcatgtgtcag

SEQ ID NO: 350760 - DNA, 25 bp, Rattus norvegicus
gaggtgcacatcagaatcaccaccg

SEQ ID NO: 350761 - DNA, 25 bp, Rattus norvegicus
gaggtgcacatctgaatcaccaccg

SEQ ID NO: 350762 - DNA, 25 bp, Rattus norvegicus
gaggtgcaccgaccggagatctcac

SEQ ID NO: 350763 - DNA, 25 bp, Rattus norvegicus
gaggtgcaccgagcggagatctcac

SEQ ID NO: 350764 - DNA, 25 bp, Rattus norvegicus
gaggtgcacctcagaattaagccag

SEQ ID NO: 350765 - DNA, 25 bp, Rattus norvegicus
gaggtgcacctctgaattaagccag

SEQ ID NO: 350766 - DNA, 25 bp, Rattus norvegicus
gaggtgcacgcacttgctattctgt

SEQ ID NO: 350767 - DNA, 25 bp, Rattus norvegicus
gaggtgcacgcagttgctattctgt

SEQ ID NO: 350768 - DNA, 25 bp, Rattus norvegicus
gaggtgcacttgcagttcttgcagc

SEQ ID NO: 350769 - DNA, 25 bp, Rattus norvegicus
gaggtgcacttggagttcttgcagc

SEQ ID NO: 350770 - DNA, 25 bp, Rattus norvegicus
gaggtgcagactctcagtaggtctt

SEQ ID NO: 350771 - DNA, 25 bp, Rattus norvegicus
gaggtgcagactgtcagtaggtctt

SEQ ID NO: 350772 - DNA, 25 bp, Rattus norvegicus
gaggtgcagcagacagaagcccaga

SEQ ID NO: 350773 - DNA, 25 bp, Rattus norvegicus
gaggtgcagcagtcagaagcccaga

SEQ ID NO: 350774 - DNA, 25 bp, Rattus norvegicus
gaggtgcagcgtacggccattagaa

SEQ ID NO: 350775 - DNA, 25 bp, Rattus norvegicus
gaggtgcagcgttcggccattagaa

SEQ ID NO: 350776 - DNA, 25 bp, Rattus norvegicus
gaggtgcaggcccacagccactaca

SEQ ID NO: 350777 - DNA, 25 bp, Rattus norvegicus
gaggtgcaggccgacagccactaca

SEQ ID NO: 350778 - DNA, 25 bp, Rattus norvegicus
gaggtgcatcctatgtggactttct

SEQ ID NO: 350779 - DNA, 25 bp, Rattus norvegicus
gaggtgcatcctttgtggactttct

SEQ ID NO: 350780 - DNA, 25 bp, Rattus norvegicus
gaggtgcatttaattcatctgatag

SEQ ID NO: 350781 - DNA, 25 bp, Rattus norvegicus
gaggtgcatttatttcatctgatag

SEQ ID NO: 350782 - DNA, 25 bp, Rattus norvegicus
gaggtgccatgaatccaaggcagaa

SEQ ID NO: 350783 - DNA, 25 bp, Rattus norvegicus
gaggtgccatgattccaaggcagaa

SEQ ID NO: 350784 - DNA, 25 bp, Rattus norvegicus
gaggtgcccatacccaaatttcagg

SEQ ID NO: 350785 - DNA, 25 bp, Rattus norvegicus
gaggtgcccatagccaaatttcagg

SEQ ID NO: 350786 - DNA, 25 bp, Rattus norvegicus
gaggtgcccttgcagacattcttag

SEQ ID NO: 350787 - DNA, 25 bp, Rattus norvegicus
gaggtgcccttggagacattcttag

SEQ ID NO: 350788 - DNA, 25 bp, Rattus norvegicus
gaggtgcctcagagttcacagccag

SEQ ID NO: 350789 - DNA, 25 bp, Rattus norvegicus
gaggtgcctcagtgttcacagccag

SEQ ID NO: 350790 - DNA, 25 bp, Rattus norvegicus
gaggtgcctcctcagaacgtactgg

SEQ ID NO: 350791 - DNA, 25 bp, Rattus norvegicus
gaggtgcctcctgagaacgtactgg

SEQ ID NO: 350792 - DNA, 25 bp, Rattus norvegicus
gaggtgcctgagagcaacctatcct

SEQ ID NO: 350793 - DNA, 25 bp, Rattus norvegicus
gaggtgcctgagtgcaacctatcct

SEQ ID NO: 350794 - DNA, 25 bp, Rattus norvegicus
gaggtgcggccgacactcacaggct

SEQ ID NO: 350795 - DNA, 25 bp, Rattus norvegicus
gaggtgcggccgtcactcacaggct

SEQ ID NO: 350796 - DNA, 25 bp, Rattus norvegicus
gaggtgcgtttgctgatgtcaccaa

SEQ ID NO: 350797 - DNA, 25 bp, Rattus norvegicus
gaggtgcgtttggtgatgtcaccaa

SEQ ID NO: 350798 - DNA, 25 bp, Rattus norvegicus
gaggtgctacttaaatccaggctga

SEQ ID NO: 350799 - DNA, 25 bp, Rattus norvegicus
gaggtgctactttaatccaggctga

SEQ ID NO: 350800 - DNA, 25 bp, Rattus norvegicus
gaggtgctcaatacatcttaagtct

SEQ ID NO: 350801 - DNA, 25 bp, Rattus norvegicus
gaggtgctcaattcatcttaagtct

SEQ ID NO: 350802 - DNA, 25 bp, Rattus norvegicus
gaggtgctcacacctggactgcaga

SEQ ID NO: 350803 - DNA, 25 bp, Rattus norvegicus
gaggtgctcacagctggactgcaga

SEQ ID NO: 350804 - DNA, 25 bp, Rattus norvegicus
gaggtgctcatactgcttggcagac

SEQ ID NO: 350805 - DNA, 25 bp, Rattus norvegicus
gaggtgctcatagtgcttggcagac

SEQ ID NO: 350806 - DNA, 25 bp, Rattus norvegicus
gaggtgctccatcctacgtcagaga

SEQ ID NO: 350807 - DNA, 25 bp, Rattus norvegicus
gaggtgctccatgctacgtcagaga

SEQ ID NO: 350808 - DNA, 25 bp, Rattus norvegicus
gaggtgctcgatattgactccacag

SEQ ID NO: 350809 - DNA, 25 bp, Rattus norvegicus
gaggtgctcgattttgactccacag

SEQ ID NO: 350810 - DNA, 25 bp, Rattus norvegicus
gaggtgctcttgaattatcatcttt

SEQ ID NO: 350811 - DNA, 25 bp, Rattus norvegicus
gaggtgctcttgtattatcatcttt

SEQ ID NO: 350812 - DNA, 25 bp, Rattus norvegicus
gaggtgctctttccatggaaacaag

SEQ ID NO: 350813 - DNA, 25 bp, Rattus norvegicus
gaggtgctctttgcatggaaacaag

SEQ ID NO: 350814 - DNA, 25 bp, Rattus norvegicus
gaggtgctgccaagggaagacttaa

SEQ ID NO: 350815 - DNA, 25 bp, Rattus norvegicus
gaggtgctgccatgggaagacttaa

SEQ ID NO: 350816 - DNA, 25 bp, Rattus norvegicus
gaggtgctgctccagagttgacccc

SEQ ID NO: 350817 - DNA, 25 bp, Rattus norvegicus
gaggtgctgctcgagagttgacccc

SEQ ID NO: 350818 - DNA, 25 bp, Rattus norvegicus
gaggtgctggctctcacttgagaaa

SEQ ID NO: 350819 - DNA, 25 bp, Rattus norvegicus
gaggtgctggctgtcacttgagaaa

SEQ ID NO: 350820 - DNA, 25 bp, Rattus norvegicus
gaggtgcttcctcatgaagggactt

SEQ ID NO: 350821 - DNA, 25 bp, Rattus norvegicus
gaggtgcttcctgatgaagggactt

SEQ ID NO: 350822 - DNA, 25 bp, Rattus norvegicus
gaggtgcttcggatccagagcattt

SEQ ID NO: 350823 - DNA, 25 bp, Rattus norvegicus
gaggtgcttcggttccagagcattt

SEQ ID NO: 350824 - DNA, 25 bp, Rattus norvegicus
gaggtgcttcttaaaatcgttcata

SEQ ID NO: 350825 - DNA, 25 bp, Rattus norvegicus
gaggtgcttctttaaatcgttcata

SEQ ID NO: 350826 - DNA, 25 bp, Rattus norvegicus
gaggtggaacacagccatggcgaat

SEQ ID NO: 350827 - DNA, 25 bp, Rattus norvegicus
gaggtggaacactgccatggcgaat

SEQ ID NO: 350828 - DNA, 25 bp, Rattus norvegicus
gaggtggaactcagctgcctggttc

SEQ ID NO: 350829 - DNA, 25 bp, Rattus norvegicus
gaggtggaactctgctgcctggttc

SEQ ID NO: 350830 - DNA, 25 bp, Rattus norvegicus
gaggtggaagtcatacgccctccat

SEQ ID NO: 350831 - DNA, 25 bp, Rattus norvegicus
gaggtggaagtcttacgccctccat

SEQ ID NO: 350832 - DNA, 25 bp, Rattus norvegicus
gaggtggaattcacagtgatcctta

SEQ ID NO: 350833 - DNA, 25 bp, Rattus norvegicus
gaggtggaattctcagtgatcctta

SEQ ID NO: 350834 - DNA, 25 bp, Rattus norvegicus
gaggtggacatcactcacagtctca

SEQ ID NO: 350835 - DNA, 25 bp, Rattus norvegicus
gaggtggacatctctcacagtctca

SEQ ID NO: 350836 - DNA, 25 bp, Rattus norvegicus
gaggtggaccatcagagcactcatg

SEQ ID NO: 350837 - DNA, 25 bp, Rattus norvegicus
gaggtggaccatgagagcactcatg

SEQ ID NO: 350838 - DNA, 25 bp, Rattus norvegicus
gaggtggacccaactctagaaccag

SEQ ID NO: 350839 - DNA, 25 bp, Rattus norvegicus
gaggtggacccatctctagaaccag

SEQ ID NO: 350840 - DNA, 25 bp, Rattus norvegicus
gaggtggactcaacttgaattcaga

SEQ ID NO: 350841 - DNA, 25 bp, Rattus norvegicus
gaggtggactcatcttgaattcaga

SEQ ID NO: 350842 - DNA, 25 bp, Rattus norvegicus
gaggtggagaacaacagccttcccc

SEQ ID NO: 350843 - DNA, 25 bp, Rattus norvegicus
gaggtggagaactacagccttcccc

SEQ ID NO: 350844 - DNA, 25 bp, Rattus norvegicus
gaggtggagaccatgctccatcgat

SEQ ID NO: 350845 - DNA, 25 bp, Rattus norvegicus
gaggtggagaccttgctccatcgat

SEQ ID NO: 350846 - DNA, 25 bp, Rattus norvegicus
gaggtggagctgcaccccgacatcc

SEQ ID NO: 350847 - DNA, 25 bp, Rattus norvegicus
gaggtggagctggaccccgacatcc

SEQ ID NO: 350848 - DNA, 25 bp, Rattus norvegicus
gaggtggaggcacccactcctgaca

SEQ ID NO: 350849 - DNA, 25 bp, Rattus norvegicus
gaggtggaggcagccactcctgaca

SEQ ID NO: 350850 - DNA, 25 bp, Rattus norvegicus
gaggtggagtctactgagcaccccg

SEQ ID NO: 350851 - DNA, 25 bp, Rattus norvegicus
gaggtggagtcttctgagcaccccg

SEQ ID NO: 350852 - DNA, 25 bp, Rattus norvegicus
gaggtggatacccagaaccttggtt

SEQ ID NO: 350853 - DNA, 25 bp, Rattus norvegicus
gaggtggataccgagaaccttggtt

SEQ ID NO: 350854 - DNA, 25 bp, Rattus norvegicus
gaggtggatactagtctgagagaac

SEQ ID NO: 350855 - DNA, 25 bp, Rattus norvegicus
gaggtggatacttgtctgagagaac

SEQ ID NO: 350856 - DNA, 25 bp, Rattus norvegicus
gaggtggcacttcctacgcttgtca

SEQ ID NO: 350857 - DNA, 25 bp, Rattus norvegicus
gaggtggcacttgctacgcttgtca

SEQ ID NO: 350858 - DNA, 25 bp, Rattus norvegicus
gaggtggcaggtatcagcccaaagc

SEQ ID NO: 350859 - DNA, 25 bp, Rattus norvegicus
gaggtggcaggtttcagcccaaagc

SEQ ID NO: 350860 - DNA, 25 bp, Rattus norvegicus
gaggtggcatgtactaactcctaga

SEQ ID NO: 350861 - DNA, 25 bp, Rattus norvegicus
gaggtggcatgttctaactcctaga

SEQ ID NO: 350862 - DNA, 25 bp, Rattus norvegicus
gaggtggcccgtcttctcaatctca

SEQ ID NO: 350863 - DNA, 25 bp, Rattus norvegicus
gaggtggcccgtgttctcaatctca

SEQ ID NO: 350864 - DNA, 25 bp, Rattus norvegicus
gaggtggccctgagatgttatgcca

SEQ ID NO: 350865 - DNA, 25 bp, Rattus norvegicus
gaggtggccctgtgatgttatgcca

SEQ ID NO: 350866 - DNA, 25 bp, Rattus norvegicus
gaggtggccgccagacactgctagt

SEQ ID NO: 350867 - DNA, 25 bp, Rattus norvegicus
gaggtggccgcctgacactgctagt

SEQ ID NO: 350868 - DNA, 25 bp, Rattus norvegicus
gaggtggcctgcctcaacaacacaa

SEQ ID NO: 350869 - DNA, 25 bp, Rattus norvegicus
gaggtggcctgcgtcaacaacacaa

SEQ ID NO: 350870 - DNA, 25 bp, Rattus norvegicus
gaggtggcggccatcgcagctttct

SEQ ID NO: 350871 - DNA, 25 bp, Rattus norvegicus
gaggtggcggccttcgcagctttct

SEQ ID NO: 350872 - DNA, 25 bp, Rattus norvegicus
gaggtggctaagacactcagacatt

SEQ ID NO: 350873 - DNA, 25 bp, Rattus norvegicus
gaggtggctaagtcactcagacatt

SEQ ID NO: 350874 - DNA, 25 bp, Rattus norvegicus
gaggtggctccaagagtaagagtac

SEQ ID NO: 350875 - DNA, 25 bp, Rattus norvegicus
gaggtggctccatgagtaagagtac

SEQ ID NO: 350876 - DNA, 25 bp, Rattus norvegicus
gaggtggctgctcccttacagagac

SEQ ID NO: 350877 - DNA, 25 bp, Rattus norvegicus
gaggtggctgctgccttacagagac

SEQ ID NO: 350878 - DNA, 25 bp, Rattus norvegicus
gaggtgggactcaagtctcattctt

SEQ ID NO: 350879 - DNA, 25 bp, Rattus norvegicus
gaggtgggactctagtctcattctt

SEQ ID NO: 350880 - DNA, 25 bp, Rattus norvegicus
gaggtgggagccagccttcactcat

SEQ ID NO: 350881 - DNA, 25 bp, Rattus norvegicus
gaggtgggagcctgccttcactcat

SEQ ID NO: 350882 - DNA, 25 bp, Rattus norvegicus
gaggtgggcacaacaactggaatgt

SEQ ID NO: 350883 - DNA, 25 bp, Rattus norvegicus
gaggtgggcacatcaactggaatgt

SEQ ID NO: 350884 - DNA, 25 bp, Rattus norvegicus
gaggtgggcaccctaaccctgtcag

SEQ ID NO: 350885 - DNA, 25 bp, Rattus norvegicus
gaggtgggcaccgtaaccctgtcag

SEQ ID NO: 350886 - DNA, 25 bp, Rattus norvegicus
gaggtgggcagaatcctttactcct

SEQ ID NO: 350887 - DNA, 25 bp, Rattus norvegicus
gaggtgggcagattcctttactcct

SEQ ID NO: 350888 - DNA, 25 bp, Rattus norvegicus
gaggtgggcgtcaactagtgaaaaa

SEQ ID NO: 350889 - DNA, 25 bp, Rattus norvegicus
gaggtgggcgtctactagtgaaaaa

SEQ ID NO: 350890 - DNA, 25 bp, Rattus norvegicus
gaggtgggcgttactttcttacaga

SEQ ID NO: 350891 - DNA, 25 bp, Rattus norvegicus
gaggtgggcgtttctttcttacaga

SEQ ID NO: 350892 - DNA, 25 bp, Rattus norvegicus
gaggtgggtgccaggctcgggtttg

SEQ ID NO: 350893 - DNA, 25 bp, Rattus norvegicus
gaggtgggtgcctggctcgggtttg

SEQ ID NO: 350894 - DNA, 25 bp, Rattus norvegicus
gaggtggtacctctcagaaactcac

SEQ ID NO: 350895 - DNA, 25 bp, Rattus norvegicus
gaggtggtacctgtcagaaactcac

SEQ ID NO: 350896 - DNA, 25 bp, Rattus norvegicus
gaggtggtacggacatttcttctgc

SEQ ID NO: 350897 - DNA, 25 bp, Rattus norvegicus
gaggtggtacggtcatttcttctgc

SEQ ID NO: 350898 - DNA, 25 bp, Rattus norvegicus
gaggtggtagctcattacttttctg

SEQ ID NO: 350899 - DNA, 25 bp, Rattus norvegicus
gaggtggtagctgattacttttctg

SEQ ID NO: 350900 - DNA, 25 bp, Rattus norvegicus
gaggtggtatacagcgcccatgcct

SEQ ID NO: 350901 - DNA, 25 bp, Rattus norvegicus
gaggtggtatactgcgcccatgcct

SEQ ID NO: 350902 - DNA, 25 bp, Rattus norvegicus
gaggtggtatcgattttgctttata

SEQ ID NO: 350903 - DNA, 25 bp, Rattus norvegicus
gaggtggtatcgtttttgctttata

SEQ ID NO: 350904 - DNA, 25 bp, Rattus norvegicus
gaggtggtcatcaaaatagctacaa

SEQ ID NO: 350905 - DNA, 25 bp, Rattus norvegicus
gaggtggtcatctaaatagctacaa

SEQ ID NO: 350906 - DNA, 25 bp, Rattus norvegicus
gaggtggtcattcttgtgtcctaac

SEQ ID NO: 350907 - DNA, 25 bp, Rattus norvegicus
gaggtggtcattgttgtgtcctaac

SEQ ID NO: 350908 - DNA, 25 bp, Rattus norvegicus
gaggtggtctgaatgttctgacatt

SEQ ID NO: 350909 - DNA, 25 bp, Rattus norvegicus
gaggtggtctgattgttctgacatt

SEQ ID NO: 350910 - DNA, 25 bp, Rattus norvegicus
gaggtggtctgtacagtccatatgt

SEQ ID NO: 350911 - DNA, 25 bp, Rattus norvegicus
gaggtggtctgttcagtccatatgt

SEQ ID NO: 350912 - DNA, 25 bp, Rattus norvegicus
gaggtggtcttcagtacactttggc

SEQ ID NO: 350913 - DNA, 25 bp, Rattus norvegicus
gaggtggtcttctgtacactttggc

SEQ ID NO: 350914 - DNA, 25 bp, Rattus norvegicus
gaggtggtgctgatgaatttttatg

SEQ ID NO: 350915 - DNA, 25 bp, Rattus norvegicus
gaggtggtgctgttgaatttttatg

SEQ ID NO: 350916 - DNA, 25 bp, Rattus norvegicus
gaggtggtggcacccgaaggccggg

SEQ ID NO: 350917 - DNA, 25 bp, Rattus norvegicus
gaggtggtggcagccgaaggccggg

SEQ ID NO: 350918 - DNA, 25 bp, Rattus norvegicus
gaggtggttaagctgcacatctcca

SEQ ID NO: 350919 - DNA, 25 bp, Rattus norvegicus
gaggtggttaaggtgcacatctcca

SEQ ID NO: 350920 - DNA, 25 bp, Rattus norvegicus
gaggtggttacgcaatacccacttc

SEQ ID NO: 350921 - DNA, 25 bp, Rattus norvegicus
gaggtggttacggaatacccacttc

SEQ ID NO: 350922 - DNA, 25 bp, Rattus norvegicus
gaggtggttatgctttctcacagct

SEQ ID NO: 350923 - DNA, 25 bp, Rattus norvegicus
gaggtggttatggtttctcacagct

SEQ ID NO: 350924 - DNA, 25 bp, Rattus norvegicus
gaggtggttgccaagcaatggcctt

SEQ ID NO: 350925 - DNA, 25 bp, Rattus norvegicus
gaggtggttgcctagcaatggcctt

SEQ ID NO: 350926 - DNA, 25 bp, Rattus norvegicus
gaggtggtttacagtccagtctgcc

SEQ ID NO: 350927 - DNA, 25 bp, Rattus norvegicus
gaggtggtttactgtccagtctgcc

SEQ ID NO: 350928 - DNA, 25 bp, Rattus norvegicus
gaggtgtacacactcctatgtgttt

SEQ ID NO: 350929 - DNA, 25 bp, Rattus norvegicus
gaggtgtacacagtcctatgtgttt

SEQ ID NO: 350930 - DNA, 25 bp, Rattus norvegicus
gaggtgtaccagagagcctgctgcc

SEQ ID NO: 350931 - DNA, 25 bp, Rattus norvegicus
gaggtgtaccagtgagcctgctgcc

SEQ ID NO: 350932 - DNA, 25 bp, Rattus norvegicus
gaggtgtactttatcctcctgggag

SEQ ID NO: 350933 - DNA, 25 bp, Rattus norvegicus
gaggtgtactttttcctcctgggag

SEQ ID NO: 350934 - DNA, 25 bp, Rattus norvegicus
gaggtgtagcacattgccctgggat

SEQ ID NO: 350935 - DNA, 25 bp, Rattus norvegicus
gaggtgtagcactttgccctgggat

SEQ ID NO: 350936 - DNA, 25 bp, Rattus norvegicus
gaggtgtatacaattaagcgttttc

SEQ ID NO: 350937 - DNA, 25 bp, Rattus norvegicus
gaggtgtatacatttaagcgttttc

SEQ ID NO: 350938 - DNA, 25 bp, Rattus norvegicus
gaggtgtatggtcccgacatcagcc

SEQ ID NO: 350939 - DNA, 25 bp, Rattus norvegicus
gaggtgtatggtgccgacatcagcc

SEQ ID NO: 350940 - DNA, 25 bp, Rattus norvegicus
gaggtgtattttcattacttgacaa

SEQ ID NO: 350941 - DNA, 25 bp, Rattus norvegicus
gaggtgtattttgattacttgacaa

SEQ ID NO: 350942 - DNA, 25 bp, Rattus norvegicus
gaggtgtcaccacaaacaagggcaa

SEQ ID NO: 350943 - DNA, 25 bp, Rattus norvegicus
gaggtgtcaccagaaacaagggcaa

SEQ ID NO: 350944 - DNA, 25 bp, Rattus norvegicus
gaggtgtcacctaaacattcagaag

SEQ ID NO: 350945 - DNA, 25 bp, Rattus norvegicus
gaggtgtcaccttaacattcagaag

SEQ ID NO: 350946 - DNA, 25 bp, Rattus norvegicus
gaggtgtcatcaacccttacagaag

SEQ ID NO: 350947 - DNA, 25 bp, Rattus norvegicus
gaggtgtcatcatcccttacagaag

SEQ ID NO: 350948 - DNA, 25 bp, Rattus norvegicus
gaggtgtcatttccctctgtggaac

SEQ ID NO: 350949 - DNA, 25 bp, Rattus norvegicus
gaggtgtcatttgcctctgtggaac

SEQ ID NO: 350950 - DNA, 25 bp, Rattus norvegicus
gaggtgtccacgcacagcaagcgtc

SEQ ID NO: 350951 - DNA, 25 bp, Rattus norvegicus
gaggtgtccacggacagcaagcgtc

SEQ ID NO: 350952 - DNA, 25 bp, Rattus norvegicus
gaggtgtccagccttttgaatacag

SEQ ID NO: 350953 - DNA, 25 bp, Rattus norvegicus
gaggtgtccagcgttttgaatacag

SEQ ID NO: 350954 - DNA, 25 bp, Rattus norvegicus
gaggtgtccatgaccttcaaggcta

SEQ ID NO: 350955 - DNA, 25 bp, Rattus norvegicus
gaggtgtccatgtccttcaaggcta

SEQ ID NO: 350956 - DNA, 25 bp, Rattus norvegicus
gaggtgtccttcctggacgtacaca

SEQ ID NO: 350957 - DNA, 25 bp, Rattus norvegicus
gaggtgtccttcgtggacgtacaca

SEQ ID NO: 350958 - DNA, 25 bp, Rattus norvegicus
gaggtgtctaagcacttggagaaaa

SEQ ID NO: 350959 - DNA, 25 bp, Rattus norvegicus
gaggtgtctaaggacttggagaaaa

SEQ ID NO: 350960 - DNA, 25 bp, Rattus norvegicus
gaggtgtctattatcatactgtggg

SEQ ID NO: 350961 - DNA, 25 bp, Rattus norvegicus
gaggtgtctattttcatactgtggg

SEQ ID NO: 350962 - DNA, 25 bp, Rattus norvegicus
gaggtgtctcttcgaccaggtaccc

SEQ ID NO: 350963 - DNA, 25 bp, Rattus norvegicus
gaggtgtctcttggaccaggtaccc

SEQ ID NO: 350964 - DNA, 25 bp, Rattus norvegicus
gaggtgtctgccaggattgccagca

SEQ ID NO: 350965 - DNA, 25 bp, Rattus norvegicus
gaggtgtctgcctggattgccagca

SEQ ID NO: 350966 - DNA, 25 bp, Rattus norvegicus
gaggtgtgacctctcaatcactgat

SEQ ID NO: 350967 - DNA, 25 bp, Rattus norvegicus
gaggtgtgacctgtcaatcactgat

SEQ ID NO: 350968 - DNA, 25 bp, Rattus norvegicus
gaggtgtgcacccataactcacagg

SEQ ID NO: 350969 - DNA, 25 bp, Rattus norvegicus
gaggtgtgcaccgataactcacagg

SEQ ID NO: 350970 - DNA, 25 bp, Rattus norvegicus
gaggtgtgcagtattatatccaata

SEQ ID NO: 350971 - DNA, 25 bp, Rattus norvegicus
gaggtgtgcagttttatatccaata

SEQ ID NO: 350972 - DNA, 25 bp, Rattus norvegicus
gaggtgtgccagatagtcatttcaa

SEQ ID NO: 350973 - DNA, 25 bp, Rattus norvegicus
gaggtgtgccagttagtcatttcaa

SEQ ID NO: 350974 - DNA, 25 bp, Rattus norvegicus
gaggtgtgccggaatagacaatgac

SEQ ID NO: 350975 - DNA, 25 bp, Rattus norvegicus
gaggtgtgccggtatagacaatgac

SEQ ID NO: 350976 - DNA, 25 bp, Rattus norvegicus
gaggtgtgctgcatcacttcatatc

SEQ ID NO: 350977 - DNA, 25 bp, Rattus norvegicus
gaggtgtgctgcttcacttcatatc

SEQ ID NO: 350978 - DNA, 25 bp, Rattus norvegicus
gaggtgtggaacacaccattccatg

SEQ ID NO: 350979 - DNA, 25 bp, Rattus norvegicus
gaggtgtggaactcaccattccatg

SEQ ID NO: 350980 - DNA, 25 bp, Rattus norvegicus
gaggtgtggtttatagccatgccta

SEQ ID NO: 350981 - DNA, 25 bp, Rattus norvegicus
gaggtgtggtttttagccatgccta

SEQ ID NO: 350982 - DNA, 25 bp, Rattus norvegicus
gaggtgtgtatacatttccccagat

SEQ ID NO: 350983 - DNA, 25 bp, Rattus norvegicus
gaggtgtgtatagatttccccagat

SEQ ID NO: 350984 - DNA, 25 bp, Rattus norvegicus
gaggtgtgtcatatctttattcaaa

SEQ ID NO: 350985 - DNA, 25 bp, Rattus norvegicus
gaggtgtgtcatttctttattcaaa

SEQ ID NO: 350986 - DNA, 25 bp, Rattus norvegicus
gaggtgttaaccatttctaacataa

SEQ ID NO: 350987 - DNA, 25 bp, Rattus norvegicus
gaggtgttaaccttttctaacataa

SEQ ID NO: 350988 - DNA, 25 bp, Rattus norvegicus
gaggtgttactgcttgcttctgtca

SEQ ID NO: 350989 - DNA, 25 bp, Rattus norvegicus
gaggtgttactggttgcttctgtca

SEQ ID NO: 350990 - DNA, 25 bp, Rattus norvegicus
gaggtgttacttaccgggatcagcc

SEQ ID NO: 350991 - DNA, 25 bp, Rattus norvegicus
gaggtgttactttccgggatcagcc

SEQ ID NO: 350992 - DNA, 25 bp, Rattus norvegicus
gaggtgttcctcagggctgttgcta

SEQ ID NO: 350993 - DNA, 25 bp, Rattus norvegicus
gaggtgttcctctgggctgttgcta

SEQ ID NO: 350994 - DNA, 25 bp, Rattus norvegicus
gaggtgttctacattccagaggatg

SEQ ID NO: 350995 - DNA, 25 bp, Rattus norvegicus
gaggtgttctactttccagaggatg

SEQ ID NO: 350996 - DNA, 25 bp, Rattus norvegicus
gaggtgttctccagcaagctccaag

SEQ ID NO: 350997 - DNA, 25 bp, Rattus norvegicus
gaggtgttctcctgcaagctccaag

SEQ ID NO: 350998 - DNA, 25 bp, Rattus norvegicus
gaggtgttctctcaatcattctcaa

SEQ ID NO: 350999 - DNA, 25 bp, Rattus norvegicus
gaggtgttctctgaatcattctcaa

SEQ ID NO: 351000 - DNA, 25 bp, Rattus norvegicus
gaggtgttgctcactgaggcagttc

SEQ ID NO: 351001 - DNA, 25 bp, Rattus norvegicus
gaggtgttgctctctgaggcagttc

SEQ ID NO: 351002 - DNA, 25 bp, Rattus norvegicus
gaggtgttggagagctttcatgttc

SEQ ID NO: 351003 - DNA, 25 bp, Rattus norvegicus
gaggtgttggagtgctttcatgttc

SEQ ID NO: 351004 - DNA, 25 bp, Rattus norvegicus
gaggtgttgtcacaagagatctcaa

SEQ ID NO: 351005 - DNA, 25 bp, Rattus norvegicus
gaggtgttgtcagaagagatctcaa

SEQ ID NO: 351006 - DNA, 25 bp, Rattus norvegicus
gaggtgtttactattggctatccca

SEQ ID NO: 351007 - DNA, 25 bp, Rattus norvegicus
gaggtgtttacttttggctatccca

SEQ ID NO: 351008 - DNA, 25 bp, Rattus norvegicus
gaggtgtttatcatcctatcaggag

SEQ ID NO: 351009 - DNA, 25 bp, Rattus norvegicus
gaggtgtttatcttcctatcaggag

SEQ ID NO: 351010 - DNA, 25 bp, Rattus norvegicus
gaggtgtttcacaaagggcttagga

SEQ ID NO: 351011 - DNA, 25 bp, Rattus norvegicus
gaggtgtttcactaagggcttagga

SEQ ID NO: 351012 - DNA, 25 bp, Rattus norvegicus
gaggtgtttccgcaactgagatccg

SEQ ID NO: 351013 - DNA, 25 bp, Rattus norvegicus
gaggtgtttccggaactgagatccg

SEQ ID NO: 351014 - DNA, 25 bp, Rattus norvegicus
gaggtgtttcctcacatgaatttgc

SEQ ID NO: 351015 - DNA, 25 bp, Rattus norvegicus
gaggtgtttcctcgacctagggcac

SEQ ID NO: 351016 - DNA, 25 bp, Rattus norvegicus
gaggtgtttcctgacatgaatttgc

SEQ ID NO: 351017 - DNA, 25 bp, Rattus norvegicus
gaggtgtttcctggacctagggcac

SEQ ID NO: 351018 - DNA, 25 bp, Rattus norvegicus
gaggtgtttctactttgtccatcaa

SEQ ID NO: 351019 - DNA, 25 bp, Rattus norvegicus
gaggtgtttctagtttgtccatcaa

SEQ ID NO: 351020 - DNA, 25 bp, Rattus norvegicus
gaggtgtttgcactactaacagcat

SEQ ID NO: 351021 - DNA, 25 bp, Rattus norvegicus
gaggtgtttgcagtactaacagcat

SEQ ID NO: 351022 - DNA, 25 bp, Rattus norvegicus
gaggtgtttgccaggatgaaatatt

SEQ ID NO: 351023 - DNA, 25 bp, Rattus norvegicus
gaggtgtttgcctggatgaaatatt

SEQ ID NO: 351024 - DNA, 25 bp, Rattus norvegicus
gaggtgtttggcatcccaggcgccc

SEQ ID NO: 351025 - DNA, 25 bp, Rattus norvegicus
gaggtgtttggcttcccaggcgccc

SEQ ID NO: 351026 - DNA, 25 bp, Rattus norvegicus
gaggtgtttgtgagactcctaacgt

SEQ ID NO: 351027 - DNA, 25 bp, Rattus norvegicus
gaggtgtttgtgtgactcctaacgt

SEQ ID NO: 351028 - DNA, 25 bp, Rattus norvegicus
gaggttaaaaacattggctgccctt

SEQ ID NO: 351029 - DNA, 25 bp, Rattus norvegicus
gaggttaaaaactttggctgccctt

SEQ ID NO: 351030 - DNA, 25 bp, Rattus norvegicus
gaggttaaacaccaatccctggctg

SEQ ID NO: 351031 - DNA, 25 bp, Rattus norvegicus
gaggttaaacacgaatccctggctg

SEQ ID NO: 351032 - DNA, 25 bp, Rattus norvegicus
gaggttaaacctcttgaatcaacag

SEQ ID NO: 351033 - DNA, 25 bp, Rattus norvegicus
gaggttaaacctgttgaatcaacag

SEQ ID NO: 351034 - DNA, 25 bp, Rattus norvegicus
gaggttaaacgccttctcgatcacc

SEQ ID NO: 351035 - DNA, 25 bp, Rattus norvegicus
gaggttaaacgcgttctcgatcacc

SEQ ID NO: 351036 - DNA, 25 bp, Rattus norvegicus
gaggttaacctaagtggcagtcgtt

SEQ ID NO: 351037 - DNA, 25 bp, Rattus norvegicus
gaggttaacctatgtggcagtcgtt

SEQ ID NO: 351038 - DNA, 25 bp, Rattus norvegicus
gaggttaacgtgcttcagctctgtt

SEQ ID NO: 351039 - DNA, 25 bp, Rattus norvegicus
gaggttaacgtggttcagctctgtt

SEQ ID NO: 351040 - DNA, 25 bp, Rattus norvegicus
gaggttaagttaccatccctgctga

SEQ ID NO: 351041 - DNA, 25 bp, Rattus norvegicus
gaggttaagttagcatccctgctga

SEQ ID NO: 351042 - DNA, 25 bp, Rattus norvegicus
gaggttaatattatgtctgcacttg

SEQ ID NO: 351043 - DNA, 25 bp, Rattus norvegicus
gaggttaatattttgtctgcacttg

SEQ ID NO: 351044 - DNA, 25 bp, Rattus norvegicus
gaggttaatggcagactgcaccaca

SEQ ID NO: 351045 - DNA, 25 bp, Rattus norvegicus
gaggttaatggctgactgcaccaca

SEQ ID NO: 351046 - DNA, 25 bp, Rattus norvegicus
gaggttacaactcgttcattctgaa

SEQ ID NO: 351047 - DNA, 25 bp, Rattus norvegicus
gaggttacaactggttcattctgaa

SEQ ID NO: 351048 - DNA, 25 bp, Rattus norvegicus
gaggttacatccatcaagagcttct

SEQ ID NO: 351049 - DNA, 25 bp, Rattus norvegicus
gaggttacatccttcaagagcttct

SEQ ID NO: 351050 - DNA, 25 bp, Rattus norvegicus
gaggttacatgtatgtgtctgcaat

SEQ ID NO: 351051 - DNA, 25 bp, Rattus norvegicus
gaggttacatgtttgtgtctgcaat

SEQ ID NO: 351052 - DNA, 25 bp, Rattus norvegicus
gaggttacctccaagggctcatttt

SEQ ID NO: 351053 - DNA, 25 bp, Rattus norvegicus
gaggttacctcctagggctcatttt

SEQ ID NO: 351054 - DNA, 25 bp, Rattus norvegicus
gaggttactgtaattgctttcaagg

SEQ ID NO: 351055 - DNA, 25 bp, Rattus norvegicus
gaggttactgtatttgctttcaagg

SEQ ID NO: 351056 - DNA, 25 bp, Rattus norvegicus
gaggttacttagacccatacatact

SEQ ID NO: 351057 - DNA, 25 bp, Rattus norvegicus
gaggttacttagtcccatacatact

SEQ ID NO: 351058 - DNA, 25 bp, Rattus norvegicus
gaggttacttgaagctactgtttta

SEQ ID NO: 351059 - DNA, 25 bp, Rattus norvegicus
gaggttacttgatgctactgtttta

SEQ ID NO: 351060 - DNA, 25 bp, Rattus norvegicus
gaggttacttgcataggtctgcatt

SEQ ID NO: 351061 - DNA, 25 bp, Rattus norvegicus
gaggttacttgcttaggtctgcatt

SEQ ID NO: 351062 - DNA, 25 bp, Rattus norvegicus
gaggttagcttcatgggttctttat

SEQ ID NO: 351063 - DNA, 25 bp, Rattus norvegicus
gaggttagcttcttgggttctttat

SEQ ID NO: 351064 - DNA, 25 bp, Rattus norvegicus
gaggttaggtagctcttcagcattt

SEQ ID NO: 351065 - DNA, 25 bp, Rattus norvegicus
gaggttaggtaggtcttcagcattt

SEQ ID NO: 351066 - DNA, 25 bp, Rattus norvegicus
gaggttatcctcattgatccattcc

SEQ ID NO: 351067 - DNA, 25 bp, Rattus norvegicus
gaggttatcctctttgatccattcc

SEQ ID NO: 351068 - DNA, 25 bp, Rattus norvegicus
gaggttatgaggattttccctcaga

SEQ ID NO: 351069 - DNA, 25 bp, Rattus norvegicus
gaggttatgaggtttttccctcaga

SEQ ID NO: 351070 - DNA, 25 bp, Rattus norvegicus
gaggttatgcaaacagtgttctata

SEQ ID NO: 351071 - DNA, 25 bp, Rattus norvegicus
gaggttatgcaatcagtgttctata

SEQ ID NO: 351072 - DNA, 25 bp, Rattus norvegicus
gaggttattcttaacacgagtacaa

SEQ ID NO: 351073 - DNA, 25 bp, Rattus norvegicus
gaggttattctttacacgagtacaa

SEQ ID NO: 351074 - DNA, 25 bp, Rattus norvegicus
gaggttcaaaacacataagacttaa

SEQ ID NO: 351075 - DNA, 25 bp, Rattus norvegicus
gaggttcaaaactcataagacttaa

SEQ ID NO: 351076 - DNA, 25 bp, Rattus norvegicus
gaggttcaaaggacatcacgagcag

SEQ ID NO: 351077 - DNA, 25 bp, Rattus norvegicus
gaggttcaaaggtcatcacgagcag

SEQ ID NO: 351078 - DNA, 25 bp, Rattus norvegicus
gaggttcaactgagacctttgtccc

SEQ ID NO: 351079 - DNA, 25 bp, Rattus norvegicus
gaggttcaactgtgacctttgtccc

SEQ ID NO: 351080 - DNA, 25 bp, Rattus norvegicus
gaggttcaagagctcatgcagctgt

SEQ ID NO: 351081 - DNA, 25 bp, Rattus norvegicus
gaggttcaagaggtcatgcagctgt

SEQ ID NO: 351082 - DNA, 25 bp, Rattus norvegicus
gaggttcacgctaccatcagaaagt

SEQ ID NO: 351083 - DNA, 25 bp, Rattus norvegicus
gaggttcacgcttccatcagaaagt

SEQ ID NO: 351084 - DNA, 25 bp, Rattus norvegicus
gaggttcactaaactggtggtggct

SEQ ID NO: 351085 - DNA, 25 bp, Rattus norvegicus
gaggttcactaatctggtggtggct

SEQ ID NO: 351086 - DNA, 25 bp, Rattus norvegicus
gaggttcactccatgttgattgtga

SEQ ID NO: 351087 - DNA, 25 bp, Rattus norvegicus
gaggttcactccttgttgattgtga

SEQ ID NO: 351088 - DNA, 25 bp, Rattus norvegicus
gaggttcactctctatcttatcaag

SEQ ID NO: 351089 - DNA, 25 bp, Rattus norvegicus
gaggttcactctgtatcttatcaag

SEQ ID NO: 351090 - DNA, 25 bp, Rattus norvegicus
gaggttcacttcattacaaactaca

SEQ ID NO: 351091 - DNA, 25 bp, Rattus norvegicus
gaggttcacttctttacaaactaca

SEQ ID NO: 351092 - DNA, 25 bp, Rattus norvegicus
gaggttcagattcatccttggctac

SEQ ID NO: 351093 - DNA, 25 bp, Rattus norvegicus
gaggttcagattgatccttggctac

SEQ ID NO: 351094 - DNA, 25 bp, Rattus norvegicus
gaggttcagcgaagccagtgtctta

SEQ ID NO: 351095 - DNA, 25 bp, Rattus norvegicus
gaggttcagcgatgccagtgtctta

SEQ ID NO: 351096 - DNA, 25 bp, Rattus norvegicus
gaggttcaggagagtggtgcttgca

SEQ ID NO: 351097 - DNA, 25 bp, Rattus norvegicus
gaggttcaggagtgtggtgcttgca

SEQ ID NO: 351098 - DNA, 25 bp, Rattus norvegicus
gaggttcatcacattataggagcat

SEQ ID NO: 351099 - DNA, 25 bp, Rattus norvegicus
gaggttcatcactttataggagcat

SEQ ID NO: 351100 - DNA, 25 bp, Rattus norvegicus
gaggttcatctcatggtcattttag

SEQ ID NO: 351101 - DNA, 25 bp, Rattus norvegicus
gaggttcatctcttggtcattttag

SEQ ID NO: 351102 - DNA, 25 bp, Rattus norvegicus
gaggttccaattcccaactctaatg

SEQ ID NO: 351103 - DNA, 25 bp, Rattus norvegicus
gaggttccaattgccaactctaatg

SEQ ID NO: 351104 - DNA, 25 bp, Rattus norvegicus
gaggttccacctcaaggaccttagc

SEQ ID NO: 351105 - DNA, 25 bp, Rattus norvegicus
gaggttccacctgaaggaccttagc

SEQ ID NO: 351106 - DNA, 25 bp, Rattus norvegicus
gaggttccatttcttattctcactg

SEQ ID NO: 351107 - DNA, 25 bp, Rattus norvegicus
gaggttccatttgttattctcactg

SEQ ID NO: 351108 - DNA, 25 bp, Rattus norvegicus
gaggttcccaaaaggatagccacag

SEQ ID NO: 351109 - DNA, 25 bp, Rattus norvegicus
gaggttcccaaatggatagccacag

SEQ ID NO: 351110 - DNA, 25 bp, Rattus norvegicus
gaggttcccggaacggtcctgcggg

SEQ ID NO: 351111 - DNA, 25 bp, Rattus norvegicus
gaggttcccggatcggtcctgcggg

SEQ ID NO: 351112 - DNA, 25 bp, Rattus norvegicus
gaggttccctccatttagataactg

SEQ ID NO: 351113 - DNA, 25 bp, Rattus norvegicus
gaggttccctccttttagataactg

SEQ ID NO: 351114 - DNA, 25 bp, Rattus norvegicus
gaggttccgattacatttgtggatc

SEQ ID NO: 351115 - DNA, 25 bp, Rattus norvegicus
gaggttccgattatgctcagggaga

SEQ ID NO: 351116 - DNA, 25 bp, Rattus norvegicus
gaggttccgatttcatttgtggatc

SEQ ID NO: 351117 - DNA, 25 bp, Rattus norvegicus
gaggttccgattttgctcagggaga

SEQ ID NO: 351118 - DNA, 25 bp, Rattus norvegicus
gaggttcctatcctgtgagaagcca

SEQ ID NO: 351119 - DNA, 25 bp, Rattus norvegicus
gaggttcctatcgtgtgagaagcca

SEQ ID NO: 351120 - DNA, 25 bp, Rattus norvegicus
gaggttcctcacagaagccatggaa

SEQ ID NO: 351121 - DNA, 25 bp, Rattus norvegicus
gaggttcctcactgaagccatggaa

SEQ ID NO: 351122 - DNA, 25 bp, Rattus norvegicus
gaggttcctgccaagaccagcaggg

SEQ ID NO: 351123 - DNA, 25 bp, Rattus norvegicus
gaggttcctgcctagaccagcaggg

SEQ ID NO: 351124 - DNA, 25 bp, Rattus norvegicus
gaggttcctggaatcatttgatact

SEQ ID NO: 351125 - DNA, 25 bp, Rattus norvegicus
gaggttcctggacctacatctgtag

SEQ ID NO: 351126 - DNA, 25 bp, Rattus norvegicus
gaggttcctggagctacatctgtag

SEQ ID NO: 351127 - DNA, 25 bp, Rattus norvegicus
gaggttcctggattcatttgatact

SEQ ID NO: 351128 - DNA, 25 bp, Rattus norvegicus
gaggttccttttatggagcactgac

SEQ ID NO: 351129 - DNA, 25 bp, Rattus norvegicus
gaggttccttttttggagcactgac

SEQ ID NO: 351130 - DNA, 25 bp, Rattus norvegicus
gaggttcggagaagtttctttgcaa

SEQ ID NO: 351131 - DNA, 25 bp, Rattus norvegicus
gaggttcggagatgtttctttgcaa

SEQ ID NO: 351132 - DNA, 25 bp, Rattus norvegicus
gaggttctacggatccaaactcgga

SEQ ID NO: 351133 - DNA, 25 bp, Rattus norvegicus
gaggttctacggttccaaactcgga

SEQ ID NO: 351134 - DNA, 25 bp, Rattus norvegicus
gaggttctacgtaaaactctagtca

SEQ ID NO: 351135 - DNA, 25 bp, Rattus norvegicus
gaggttctacgttaaactctagtca

SEQ ID NO: 351136 - DNA, 25 bp, Rattus norvegicus
gaggttctatccaggacaagcgcct

SEQ ID NO: 351137 - DNA, 25 bp, Rattus norvegicus
gaggttctatcctggacaagcgcct

SEQ ID NO: 351138 - DNA, 25 bp, Rattus norvegicus
gaggttctcatgatacctgtctgca

SEQ ID NO: 351139 - DNA, 25 bp, Rattus norvegicus
gaggttctcatgttacctgtctgca

SEQ ID NO: 351140 - DNA, 25 bp, Rattus norvegicus
gaggttctccagcaagtcggatgtc

SEQ ID NO: 351141 - DNA, 25 bp, Rattus norvegicus
gaggttctccaggaagtcggatgtc

SEQ ID NO: 351142 - DNA, 25 bp, Rattus norvegicus
gaggttctccttaatgatttcacac

SEQ ID NO: 351143 - DNA, 25 bp, Rattus norvegicus
gaggttctcctttatgatttcacac

SEQ ID NO: 351144 - DNA, 25 bp, Rattus norvegicus
gaggttctcgaaagtttgctccccg

SEQ ID NO: 351145 - DNA, 25 bp, Rattus norvegicus
gaggttctcgaatgtttgctccccg

SEQ ID NO: 351146 - DNA, 25 bp, Rattus norvegicus
gaggttctgaccatcggaggcttct

SEQ ID NO: 351147 - DNA, 25 bp, Rattus norvegicus
gaggttctgaccttcggaggcttct

SEQ ID NO: 351148 - DNA, 25 bp, Rattus norvegicus
gaggttctgagtctccagcacaggc

SEQ ID NO: 351149 - DNA, 25 bp, Rattus norvegicus
gaggttctgagtgtccagcacaggc

SEQ ID NO: 351150 - DNA, 25 bp, Rattus norvegicus
gaggttctggtaattgtaggtcact

SEQ ID NO: 351151 - DNA, 25 bp, Rattus norvegicus
gaggttctggtatttgtaggtcact

SEQ ID NO: 351152 - DNA, 25 bp, Rattus norvegicus
gaggttctgtacagcattgccgaaa

SEQ ID NO: 351153 - DNA, 25 bp, Rattus norvegicus
gaggttctgtactgcattgccgaaa

SEQ ID NO: 351154 - DNA, 25 bp, Rattus norvegicus
gaggttctgtctctcataggaaatg

SEQ ID NO: 351155 - DNA, 25 bp, Rattus norvegicus
gaggttctgtctgtcataggaaatg

SEQ ID NO: 351156 - DNA, 25 bp, Rattus norvegicus
gaggttcttattcccttggttgact

SEQ ID NO: 351157 - DNA, 25 bp, Rattus norvegicus
gaggttcttattgccttggttgact

SEQ ID NO: 351158 - DNA, 25 bp, Rattus norvegicus
gaggttcttcaactactgtggactt

SEQ ID NO: 351159 - DNA, 25 bp, Rattus norvegicus
gaggttcttcaagtactgtggactt

SEQ ID NO: 351160 - DNA, 25 bp, Rattus norvegicus
gaggttcttgcacccatgcaggatc

SEQ ID NO: 351161 - DNA, 25 bp, Rattus norvegicus
gaggttcttgcagccatgcaggatc

SEQ ID NO: 351162 - DNA, 25 bp, Rattus norvegicus
gaggttcttggcaggtccatggcac

SEQ ID NO: 351163 - DNA, 25 bp, Rattus norvegicus
gaggttcttggctggtccatggcac

SEQ ID NO: 351164 - DNA, 25 bp, Rattus norvegicus
gaggttcttgttcactgacgtgcca

SEQ ID NO: 351165 - DNA, 25 bp, Rattus norvegicus
gaggttcttgttgactgacgtgcca

SEQ ID NO: 351166 - DNA, 25 bp, Rattus norvegicus
gaggttctttctacagtgttagctg

SEQ ID NO: 351167 - DNA, 25 bp, Rattus norvegicus
gaggttctttcttcagtgttagctg

SEQ ID NO: 351168 - DNA, 25 bp, Rattus norvegicus
gaggttgaaaaacctccttgaacaa

SEQ ID NO: 351169 - DNA, 25 bp, Rattus norvegicus
gaggttgaaaaagctccttgaacaa

SEQ ID NO: 351170 - DNA, 25 bp, Rattus norvegicus
gaggttgaagacagcctggcgtcca

SEQ ID NO: 351171 - DNA, 25 bp, Rattus norvegicus
gaggttgaagactgcctggcgtcca

SEQ ID NO: 351172 - DNA, 25 bp, Rattus norvegicus
gaggttgaagttcctattgctgaac

SEQ ID NO: 351173 - DNA, 25 bp, Rattus norvegicus
gaggttgaagttgctattgctgaac

SEQ ID NO: 351174 - DNA, 25 bp, Rattus norvegicus
gaggttgacactagctttctttttt

SEQ ID NO: 351175 - DNA, 25 bp, Rattus norvegicus
gaggttgacacttgctttctttttt

SEQ ID NO: 351176 - DNA, 25 bp, Rattus norvegicus
gaggttgaccatcaagacgctgata

SEQ ID NO: 351177 - DNA, 25 bp, Rattus norvegicus
gaggttgaccatgaagacgctgata

SEQ ID NO: 351178 - DNA, 25 bp, Rattus norvegicus
gaggttgactaccaagctcctatcc

SEQ ID NO: 351179 - DNA, 25 bp, Rattus norvegicus
gaggttgactacgaagctcctatcc

SEQ ID NO: 351180 - DNA, 25 bp, Rattus norvegicus
gaggttgagacgcagcacagccact

SEQ ID NO: 351181 - DNA, 25 bp, Rattus norvegicus
gaggttgagacggagcacagccact

SEQ ID NO: 351182 - DNA, 25 bp, Rattus norvegicus
gaggttgagcaacttcgcaaagaag

SEQ ID NO: 351183 - DNA, 25 bp, Rattus norvegicus
gaggttgagcaagttcgcaaagaag

SEQ ID NO: 351184 - DNA, 25 bp, Rattus norvegicus
gaggttgagcctcccctgttgtgct

SEQ ID NO: 351185 - DNA, 25 bp, Rattus norvegicus
gaggttgagcctgccctgttgtgct

SEQ ID NO: 351186 - DNA, 25 bp, Rattus norvegicus
gaggttgaggtgatccctaacctgt

SEQ ID NO: 351187 - DNA, 25 bp, Rattus norvegicus
gaggttgaggtgttccctaacctgt

SEQ ID NO: 351188 - DNA, 25 bp, Rattus norvegicus
gaggttgagtataagattctgagct

SEQ ID NO: 351189 - DNA, 25 bp, Rattus norvegicus
gaggttgagtattagattctgagct

SEQ ID NO: 351190 - DNA, 25 bp, Rattus norvegicus
gaggttgatggtctgactcagctct

SEQ ID NO: 351191 - DNA, 25 bp, Rattus norvegicus
gaggttgatggtgtgactcagctct

SEQ ID NO: 351192 - DNA, 25 bp, Rattus norvegicus
gaggttgattacagtggtctcacta

SEQ ID NO: 351193 - DNA, 25 bp, Rattus norvegicus
gaggttgattactgtggtctcacta

SEQ ID NO: 351194 - DNA, 25 bp, Rattus norvegicus
gaggttgcactgaaactgggcagca

SEQ ID NO: 351195 - DNA, 25 bp, Rattus norvegicus
gaggttgcactgtaactgggcagca

SEQ ID NO: 351196 - DNA, 25 bp, Rattus norvegicus
gaggttgcagcacacattacgtact

SEQ ID NO: 351197 - DNA, 25 bp, Rattus norvegicus
gaggttgcagcagacattacgtact

SEQ ID NO: 351198 - DNA, 25 bp, Rattus norvegicus
gaggttgcaggtcagtccttttaaa

SEQ ID NO: 351199 - DNA, 25 bp, Rattus norvegicus
gaggttgcaggtgagtccttttaaa

SEQ ID NO: 351200 - DNA, 25 bp, Rattus norvegicus
gaggttgcagtcatgggtgcccact

SEQ ID NO: 351201 - DNA, 25 bp, Rattus norvegicus
gaggttgcagtcttgggtgcccact

SEQ ID NO: 351202 - DNA, 25 bp, Rattus norvegicus
gaggttgcatacacgcattgggagc

SEQ ID NO: 351203 - DNA, 25 bp, Rattus norvegicus
gaggttgcatactcgcattgggagc

SEQ ID NO: 351204 - DNA, 25 bp, Rattus norvegicus
gaggttgccagtattagcactccaa

SEQ ID NO: 351205 - DNA, 25 bp, Rattus norvegicus
gaggttgccagttttagcactccaa

SEQ ID NO: 351206 - DNA, 25 bp, Rattus norvegicus
gaggttgcccataagcacactgtta

SEQ ID NO: 351207 - DNA, 25 bp, Rattus norvegicus
gaggttgcccattagcacactgtta

SEQ ID NO: 351208 - DNA, 25 bp, Rattus norvegicus
gaggttgcctgcatgccagtttaaa

SEQ ID NO: 351209 - DNA, 25 bp, Rattus norvegicus
gaggttgcctgcttgccagtttaaa

SEQ ID NO: 351210 - DNA, 25 bp, Rattus norvegicus
gaggttgcctggatccgtgtcgcca

SEQ ID NO: 351211 - DNA, 25 bp, Rattus norvegicus
gaggttgcctggttccgtgtcgcca

SEQ ID NO: 351212 - DNA, 25 bp, Rattus norvegicus
gaggttgctcgtaagttggtcatcc

SEQ ID NO: 351213 - DNA, 25 bp, Rattus norvegicus
gaggttgctcgttagttggtcatcc

SEQ ID NO: 351214 - DNA, 25 bp, Rattus norvegicus
gaggttgcttccattaactgggctc

SEQ ID NO: 351215 - DNA, 25 bp, Rattus norvegicus
gaggttgcttcctttaactgggctc

SEQ ID NO: 351216 - DNA, 25 bp, Rattus norvegicus
gaggttggaagacttctccttgata

SEQ ID NO: 351217 - DNA, 25 bp, Rattus norvegicus
gaggttggaagagttctccttgata

SEQ ID NO: 351218 - DNA, 25 bp, Rattus norvegicus
gaggttggaccgagtctcaaattcc

SEQ ID NO: 351219 - DNA, 25 bp, Rattus norvegicus
gaggttggaccgtgtctcaaattcc

SEQ ID NO: 351220 - DNA, 25 bp, Rattus norvegicus
gaggttggcccactcactacaggca

SEQ ID NO: 351221 - DNA, 25 bp, Rattus norvegicus
gaggttggcccagtcactacaggca

SEQ ID NO: 351222 - DNA, 25 bp, Rattus norvegicus
gaggttggccttaaactctacaaat

SEQ ID NO: 351223 - DNA, 25 bp, Rattus norvegicus
gaggttggcctttaactctacaaat

SEQ ID NO: 351224 - DNA, 25 bp, Rattus norvegicus
gaggttggcttgctcttcatgaaac

SEQ ID NO: 351225 - DNA, 25 bp, Rattus norvegicus
gaggttggcttggtcttcatgaaac

SEQ ID NO: 351226 - DNA, 25 bp, Rattus norvegicus
gaggttgggtataccatttgcagat

SEQ ID NO: 351227 - DNA, 25 bp, Rattus norvegicus
gaggttgggtattccatttgcagat

SEQ ID NO: 351228 - DNA, 25 bp, Rattus norvegicus
gaggttgggttgacgtacatgcaat

SEQ ID NO: 351229 - DNA, 25 bp, Rattus norvegicus
gaggttgggttgtcgtacatgcaat

SEQ ID NO: 351230 - DNA, 25 bp, Rattus norvegicus
gaggttggtgatactgctttttgcc

SEQ ID NO: 351231 - DNA, 25 bp, Rattus norvegicus
gaggttggtgattctgctttttgcc

SEQ ID NO: 351232 - DNA, 25 bp, Rattus norvegicus
gaggttggtgttactcaaatgtatc

SEQ ID NO: 351233 - DNA, 25 bp, Rattus norvegicus
gaggttggtgtttctcaaatgtatc

SEQ ID NO: 351234 - DNA, 25 bp, Rattus norvegicus
gaggttggttctaagccagagctac

SEQ ID NO: 351235 - DNA, 25 bp, Rattus norvegicus
gaggttggttcttagccagagctac

SEQ ID NO: 351236 - DNA, 25 bp, Rattus norvegicus
gaggttggtttaaaagtccacataa

SEQ ID NO: 351237 - DNA, 25 bp, Rattus norvegicus
gaggttggtttataagtccacataa

SEQ ID NO: 351238 - DNA, 25 bp, Rattus norvegicus
gaggttgtccaactctcagagacca

SEQ ID NO: 351239 - DNA, 25 bp, Rattus norvegicus
gaggttgtccaagtctcagagacca

SEQ ID NO: 351240 - DNA, 25 bp, Rattus norvegicus
gaggttgtcctgcatctctatgatg

SEQ ID NO: 351241 - DNA, 25 bp, Rattus norvegicus
gaggttgtcctggatctctatgatg

SEQ ID NO: 351242 - DNA, 25 bp, Rattus norvegicus
gaggttgtctagcaaactctctaca

SEQ ID NO: 351243 - DNA, 25 bp, Rattus norvegicus
gaggttgtctaggaaactctctaca

SEQ ID NO: 351244 - DNA, 25 bp, Rattus norvegicus
gaggttgtgcacctgaatcagccag

SEQ ID NO: 351245 - DNA, 25 bp, Rattus norvegicus
gaggttgtgcacgtgaatcagccag

SEQ ID NO: 351246 - DNA, 25 bp, Rattus norvegicus
gaggttgtgcttatagttactcacc

SEQ ID NO: 351247 - DNA, 25 bp, Rattus norvegicus
gaggttgtgcttttagttactcacc

SEQ ID NO: 351248 - DNA, 25 bp, Rattus norvegicus
gaggttgtggcaactgaccaccttg

SEQ ID NO: 351249 - DNA, 25 bp, Rattus norvegicus
gaggttgtggcacctgtcttgaaac

SEQ ID NO: 351250 - DNA, 25 bp, Rattus norvegicus
gaggttgtggcagctgtcttgaaac

SEQ ID NO: 351251 - DNA, 25 bp, Rattus norvegicus
gaggttgtggcatctgaccaccttg

SEQ ID NO: 351252 - DNA, 25 bp, Rattus norvegicus
gaggttgtgggcctcctcagctcac

SEQ ID NO: 351253 - DNA, 25 bp, Rattus norvegicus
gaggttgtgggcgtcctcagctcac

SEQ ID NO: 351254 - DNA, 25 bp, Rattus norvegicus
gaggttgttcagattagactttcca

SEQ ID NO: 351255 - DNA, 25 bp, Rattus norvegicus
gaggttgttcagtttagactttcca

SEQ ID NO: 351256 - DNA, 25 bp, Rattus norvegicus
gaggttgttcatacttcgtagtgta

SEQ ID NO: 351257 - DNA, 25 bp, Rattus norvegicus
gaggttgttcattcttcgtagtgta

SEQ ID NO: 351258 - DNA, 25 bp, Rattus norvegicus
gaggttgttctcactcgctaggcgg

SEQ ID NO: 351259 - DNA, 25 bp, Rattus norvegicus
gaggttgttctctctcgctaggcgg

SEQ ID NO: 351260 - DNA, 25 bp, Rattus norvegicus
gaggttgttctgacttctgtatgta

SEQ ID NO: 351261 - DNA, 25 bp, Rattus norvegicus
gaggttgttctgtcttctgtatgta

SEQ ID NO: 351262 - DNA, 25 bp, Rattus norvegicus
gaggttgttggtcacattcttcagc

SEQ ID NO: 351263 - DNA, 25 bp, Rattus norvegicus
gaggttgttggtgacattcttcagc

SEQ ID NO: 351264 - DNA, 25 bp, Rattus norvegicus
gaggttgtttccatgacatcttttt

SEQ ID NO: 351265 - DNA, 25 bp, Rattus norvegicus
gaggttgtttccttgacatcttttt

SEQ ID NO: 351266 - DNA, 25 bp, Rattus norvegicus
gaggtttacattaacaactgaaaag

SEQ ID NO: 351267 - DNA, 25 bp, Rattus norvegicus
gaggtttacatttacaactgaaaag

SEQ ID NO: 351268 - DNA, 25 bp, Rattus norvegicus
gaggtttagctgcagttttaacatt

SEQ ID NO: 351269 - DNA, 25 bp, Rattus norvegicus
gaggtttagctggagttttaacatt

SEQ ID NO: 351270 - DNA, 25 bp, Rattus norvegicus
gaggtttaggcactgcagccttgta

SEQ ID NO: 351271 - DNA, 25 bp, Rattus norvegicus
gaggtttaggcagtgcagccttgta

SEQ ID NO: 351272 - DNA, 25 bp, Rattus norvegicus
gaggtttataccaattcccacataa

SEQ ID NO: 351273 - DNA, 25 bp, Rattus norvegicus
gaggtttatacctattcccacataa

SEQ ID NO: 351274 - DNA, 25 bp, Rattus norvegicus
gaggtttatatccttatcagttggc

SEQ ID NO: 351275 - DNA, 25 bp, Rattus norvegicus
gaggtttatatcgttatcagttggc

SEQ ID NO: 351276 - DNA, 25 bp, Rattus norvegicus
gaggtttcaaaaacccatgccatac

SEQ ID NO: 351277 - DNA, 25 bp, Rattus norvegicus
gaggtttcaaaatcccatgccatac

SEQ ID NO: 351278 - DNA, 25 bp, Rattus norvegicus
gaggtttcaaagagcagccatcggt

SEQ ID NO: 351279 - DNA, 25 bp, Rattus norvegicus
gaggtttcaaagtgcagccatcggt

SEQ ID NO: 351280 - DNA, 25 bp, Rattus norvegicus
gaggtttcaggactgaacccgttct

SEQ ID NO: 351281 - DNA, 25 bp, Rattus norvegicus
gaggtttcaggagtgaacccgttct

SEQ ID NO: 351282 - DNA, 25 bp, Rattus norvegicus
gaggtttcatcgacttattctacac

SEQ ID NO: 351283 - DNA, 25 bp, Rattus norvegicus
gaggtttcatcgtcttattctacac

SEQ ID NO: 351284 - DNA, 25 bp, Rattus norvegicus
gaggtttccaagaggccctccaggg

SEQ ID NO: 351285 - DNA, 25 bp, Rattus norvegicus
gaggtttccaagtggccctccaggg

SEQ ID NO: 351286 - DNA, 25 bp, Rattus norvegicus
gaggtttcccagagtaagtcagtga

SEQ ID NO: 351287 - DNA, 25 bp, Rattus norvegicus
gaggtttcccagtgtaagtcagtga

SEQ ID NO: 351288 - DNA, 25 bp, Rattus norvegicus
gaggtttccggcatgagatgtgaat

SEQ ID NO: 351289 - DNA, 25 bp, Rattus norvegicus
gaggtttccggcttgagatgtgaat

SEQ ID NO: 351290 - DNA, 25 bp, Rattus norvegicus
gaggtttcctagcatttgcattcca

SEQ ID NO: 351291 - DNA, 25 bp, Rattus norvegicus
gaggtttcctaggatttgcattcca

SEQ ID NO: 351292 - DNA, 25 bp, Rattus norvegicus
gaggtttcctgccacaggagaactt

SEQ ID NO: 351293 - DNA, 25 bp, Rattus norvegicus
gaggtttcctgcgacaggagaactt

SEQ ID NO: 351294 - DNA, 25 bp, Rattus norvegicus
gaggtttcctttaagctggttctag

SEQ ID NO: 351295 - DNA, 25 bp, Rattus norvegicus
gaggtttcctttatcaagaagctta

SEQ ID NO: 351296 - DNA, 25 bp, Rattus norvegicus
gaggtttcctttcacatctccttgc

SEQ ID NO: 351297 - DNA, 25 bp, Rattus norvegicus
gaggtttcctttgacatctccttgc

SEQ ID NO: 351298 - DNA, 25 bp, Rattus norvegicus
gaggtttccttttagctggttctag

SEQ ID NO: 351299 - DNA, 25 bp, Rattus norvegicus
gaggtttcctttttcaagaagctta

SEQ ID NO: 351300 - DNA, 25 bp, Rattus norvegicus
gaggtttcgggaacagagtcattta

SEQ ID NO: 351301 - DNA, 25 bp, Rattus norvegicus
gaggtttcgggatcagagtcattta

SEQ ID NO: 351302 - DNA, 25 bp, Rattus norvegicus
gaggtttcgtcacatattgtgcatc

SEQ ID NO: 351303 - DNA, 25 bp, Rattus norvegicus
gaggtttcgtcagatattgtgcatc

SEQ ID NO: 351304 - DNA, 25 bp, Rattus norvegicus
gaggtttctcaaactacttttcatg

SEQ ID NO: 351305 - DNA, 25 bp, Rattus norvegicus
gaggtttctcaatctacttttcatg

SEQ ID NO: 351306 - DNA, 25 bp, Rattus norvegicus
gaggtttctcgaaggcatggatgca

SEQ ID NO: 351307 - DNA, 25 bp, Rattus norvegicus
gaggtttctcgatggcatggatgca

SEQ ID NO: 351308 - DNA, 25 bp, Rattus norvegicus
gaggtttctgtcctctgctaagaga

SEQ ID NO: 351309 - DNA, 25 bp, Rattus norvegicus
gaggtttctgtcgtctgctaagaga

SEQ ID NO: 351310 - DNA, 25 bp, Rattus norvegicus
gaggtttcttcaaatcgtcttgctt

SEQ ID NO: 351311 - DNA, 25 bp, Rattus norvegicus
gaggtttcttcatatcgtcttgctt

SEQ ID NO: 351312 - DNA, 25 bp, Rattus norvegicus
gaggtttgaaagaagcttcacaccc

SEQ ID NO: 351313 - DNA, 25 bp, Rattus norvegicus
gaggtttgaaagtagcttcacaccc

SEQ ID NO: 351314 - DNA, 25 bp, Rattus norvegicus
gaggtttgaacacggctctcagtca

SEQ ID NO: 351315 - DNA, 25 bp, Rattus norvegicus
gaggtttgaacagggctctcagtca

SEQ ID NO: 351316 - DNA, 25 bp, Rattus norvegicus
gaggtttgcacacggctatctccaa

SEQ ID NO: 351317 - DNA, 25 bp, Rattus norvegicus
gaggtttgcacagggctatctccaa

SEQ ID NO: 351318 - DNA, 25 bp, Rattus norvegicus
gaggtttgccaaatctaggacattt

SEQ ID NO: 351319 - DNA, 25 bp, Rattus norvegicus
gaggtttgccaattctaggacattt

SEQ ID NO: 351320 - DNA, 25 bp, Rattus norvegicus
gaggtttgccctccaatggaagaaa

SEQ ID NO: 351321 - DNA, 25 bp, Rattus norvegicus
gaggtttgccctgcaatggaagaaa

SEQ ID NO: 351322 - DNA, 25 bp, Rattus norvegicus
gaggtttgcgtcaatcactacctgc

SEQ ID NO: 351323 - DNA, 25 bp, Rattus norvegicus
gaggtttgcgtctatcactacctgc

SEQ ID NO: 351324 - DNA, 25 bp, Rattus norvegicus
gaggtttgctcacaaactgctagct

SEQ ID NO: 351325 - DNA, 25 bp, Rattus norvegicus
gaggtttgctcagaaactgctagct

SEQ ID NO: 351326 - DNA, 25 bp, Rattus norvegicus
gaggtttggtctcactttgatttaa

SEQ ID NO: 351327 - DNA, 25 bp, Rattus norvegicus
gaggtttggtctgactttgatttaa

SEQ ID NO: 351328 - DNA, 25 bp, Rattus norvegicus
gaggtttgtagaccccaagacagga

SEQ ID NO: 351329 - DNA, 25 bp, Rattus norvegicus
gaggtttgtagagcccaagacagga

SEQ ID NO: 351330 - DNA, 25 bp, Rattus norvegicus
gaggtttgtatcaagcgcttatttt

SEQ ID NO: 351331 - DNA, 25 bp, Rattus norvegicus
gaggtttgtatctagcgcttatttt

SEQ ID NO: 351332 - DNA, 25 bp, Rattus norvegicus
gaggtttgtcgccatgaaagttgta

SEQ ID NO: 351333 - DNA, 25 bp, Rattus norvegicus
gaggtttgtcgcgatgaaagttgta

SEQ ID NO: 351334 - DNA, 25 bp, Rattus norvegicus
gaggtttgtgttattccagatctaa

SEQ ID NO: 351335 - DNA, 25 bp, Rattus norvegicus
gaggtttgtgtttttccagatctaa

SEQ ID NO: 351336 - DNA, 25 bp, Rattus norvegicus
gaggttttacacacagacatcatga

SEQ ID NO: 351337 - DNA, 25 bp, Rattus norvegicus
gaggttttacactcagacatcatga

SEQ ID NO: 351338 - DNA, 25 bp, Rattus norvegicus
gaggttttactgctctttttgtgtt

SEQ ID NO: 351339 - DNA, 25 bp, Rattus norvegicus
gaggttttactggtctttttgtgtt

SEQ ID NO: 351340 - DNA, 25 bp, Rattus norvegicus
gaggttttagataccggagcagttt

SEQ ID NO: 351341 - DNA, 25 bp, Rattus norvegicus
gaggttttagattccggagcagttt

SEQ ID NO: 351342 - DNA, 25 bp, Rattus norvegicus
gaggttttcaccacaggcttgagac

SEQ ID NO: 351343 - DNA, 25 bp, Rattus norvegicus
gaggttttcacctcaggcttgagac

SEQ ID NO: 351344 - DNA, 25 bp, Rattus norvegicus
gaggttttcacgctcagatgagttg

SEQ ID NO: 351345 - DNA, 25 bp, Rattus norvegicus
gaggttttcacggtcagatgagttg

SEQ ID NO: 351346 - DNA, 25 bp, Rattus norvegicus
gaggttttcagcacctaactggatc

SEQ ID NO: 351347 - DNA, 25 bp, Rattus norvegicus
gaggttttcagctcctaactggatc

SEQ ID NO: 351348 - DNA, 25 bp, Rattus norvegicus
gaggttttccaacaagcacatttta

SEQ ID NO: 351349 - DNA, 25 bp, Rattus norvegicus
gaggttttccaagaagcacatttta

SEQ ID NO: 351350 - DNA, 25 bp, Rattus norvegicus
gaggttttcccaatcgaaggccaag

SEQ ID NO: 351351 - DNA, 25 bp, Rattus norvegicus
gaggttttcccattcgaaggccaag

SEQ ID NO: 351352 - DNA, 25 bp, Rattus norvegicus
gaggttttcctcagatttctaggtt

SEQ ID NO: 351353 - DNA, 25 bp, Rattus norvegicus
gaggttttcctcatgcatatactgg

SEQ ID NO: 351354 - DNA, 25 bp, Rattus norvegicus
gaggttttcctctgatttctaggtt

SEQ ID NO: 351355 - DNA, 25 bp, Rattus norvegicus
gaggttttcctcttgcatatactgg

SEQ ID NO: 351356 - DNA, 25 bp, Rattus norvegicus
gaggttttcctgagagcgattgtgt

SEQ ID NO: 351357 - DNA, 25 bp, Rattus norvegicus
gaggttttcctgtgagcgattgtgt

SEQ ID NO: 351358 - DNA, 25 bp, Rattus norvegicus
gaggttttctatattgtcctgtcct

SEQ ID NO: 351359 - DNA, 25 bp, Rattus norvegicus
gaggttttctatcgatttctggcaa

SEQ ID NO: 351360 - DNA, 25 bp, Rattus norvegicus
gaggttttctatggatttctggcaa

SEQ ID NO: 351361 - DNA, 25 bp, Rattus norvegicus
gaggttttctattttgtcctgtcct

SEQ ID NO: 351362 - DNA, 25 bp, Rattus norvegicus
gaggttttgaacaccattccatttg

SEQ ID NO: 351363 - DNA, 25 bp, Rattus norvegicus
gaggttttgaactccattccatttg

SEQ ID NO: 351364 - DNA, 25 bp, Rattus norvegicus
gaggttttgaccataaaggagcttc

SEQ ID NO: 351365 - DNA, 25 bp, Rattus norvegicus
gaggttttgaccttaaaggagcttc

SEQ ID NO: 351366 - DNA, 25 bp, Rattus norvegicus
gaggttttgactctcaatctgaaac

SEQ ID NO: 351367 - DNA, 25 bp, Rattus norvegicus
gaggttttgactgtcaatctgaaac

SEQ ID NO: 351368 - DNA, 25 bp, Rattus norvegicus
gaggttttgatgatcagtttcttct

SEQ ID NO: 351369 - DNA, 25 bp, Rattus norvegicus
gaggttttgatgttcagtttcttct

SEQ ID NO: 351370 - DNA, 25 bp, Rattus norvegicus
gaggttttgtctcaaggcattatct

SEQ ID NO: 351371 - DNA, 25 bp, Rattus norvegicus
gaggttttgtctgaaggcattatct

SEQ ID NO: 351372 - DNA, 25 bp, Rattus norvegicus
gaggttttgttaacatgcacagcta

SEQ ID NO: 351373 - DNA, 25 bp, Rattus norvegicus
gaggttttgttatcatgcacagcta

SEQ ID NO: 351374 - DNA, 25 bp, Rattus norvegicus
gaggtttttaccacagactgtttct

SEQ ID NO: 351375 - DNA, 25 bp, Rattus norvegicus
gaggtttttacctcagactgtttct

SEQ ID NO: 351376 - DNA, 25 bp, Rattus norvegicus
gaggtttttctactgctcaatgcag

SEQ ID NO: 351377 - DNA, 25 bp, Rattus norvegicus
gaggtttttctagtgctcaatgcag

SEQ ID NO: 351378 - DNA, 25 bp, Rattus norvegicus
gaggtttttctgctgtctgaggaca

SEQ ID NO: 351379 - DNA, 25 bp, Rattus norvegicus
gaggtttttctggtgtctgaggaca

SEQ ID NO: 351380 - DNA, 25 bp, Rattus norvegicus
gaggtttttgatccttgggccccag

SEQ ID NO: 351381 - DNA, 25 bp, Rattus norvegicus
gaggtttttgatgcttgggccccag

SEQ ID NO: 351382 - DNA, 25 bp, Rattus norvegicus
gagtaaaagactcagccgttgggct

SEQ ID NO: 351383 - DNA, 25 bp, Rattus norvegicus
gagtaaaagactgagccgttgggct

SEQ ID NO: 351384 - DNA, 25 bp, Rattus norvegicus
gagtaaaagcttactgcttgctctt

SEQ ID NO: 351385 - DNA, 25 bp, Rattus norvegicus
gagtaaaagctttctgcttgctctt

SEQ ID NO: 351386 - DNA, 25 bp, Rattus norvegicus
gagtaaaatctcagcggactggaaa

SEQ ID NO: 351387 - DNA, 25 bp, Rattus norvegicus
gagtaaaatctctgcggactggaaa

SEQ ID NO: 351388 - DNA, 25 bp, Rattus norvegicus
gagtaaacaagtcccttgggcggct

SEQ ID NO: 351389 - DNA, 25 bp, Rattus norvegicus
gagtaaacaagtgccttgggcggct

SEQ ID NO: 351390 - DNA, 25 bp, Rattus norvegicus
gagtaaacaattcctccttctcgag

SEQ ID NO: 351391 - DNA, 25 bp, Rattus norvegicus
gagtaaacaattgctccttctcgag

SEQ ID NO: 351392 - DNA, 25 bp, Rattus norvegicus
gagtaaacactcctgaggacctgcc

SEQ ID NO: 351393 - DNA, 25 bp, Rattus norvegicus
gagtaaacactcgtgaggacctgcc

SEQ ID NO: 351394 - DNA, 25 bp, Rattus norvegicus
gagtaaacactgacacaacctgagg

SEQ ID NO: 351395 - DNA, 25 bp, Rattus norvegicus
gagtaaacactgtcacaacctgagg

SEQ ID NO: 351396 - DNA, 25 bp, Rattus norvegicus
gagtaaacagcaatgcctgggagga

SEQ ID NO: 351397 - DNA, 25 bp, Rattus norvegicus
gagtaaacagcattgcctgggagga

SEQ ID NO: 351398 - DNA, 25 bp, Rattus norvegicus
gagtaaaccagcaaccctcagggtc

SEQ ID NO: 351399 - DNA, 25 bp, Rattus norvegicus
gagtaaaccagctaccctcagggtc

SEQ ID NO: 351400 - DNA, 25 bp, Rattus norvegicus
gagtaaaccccaccataggaagact

SEQ ID NO: 351401 - DNA, 25 bp, Rattus norvegicus
gagtaaaccccagcataggaagact

SEQ ID NO: 351402 - DNA, 25 bp, Rattus norvegicus
gagtaaacgagactctcagctccac

SEQ ID NO: 351403 - DNA, 25 bp, Rattus norvegicus
gagtaaacgagagtctcagctccac

SEQ ID NO: 351404 - DNA, 25 bp, Rattus norvegicus
gagtaaacgcataccgatctatgag

SEQ ID NO: 351405 - DNA, 25 bp, Rattus norvegicus
gagtaaacgcattccgatctatgag

SEQ ID NO: 351406 - DNA, 25 bp, Rattus norvegicus
gagtaaactaaaagcactgtattct

SEQ ID NO: 351407 - DNA, 25 bp, Rattus norvegicus
gagtaaactaaatgcactgtattct

SEQ ID NO: 351408 - DNA, 25 bp, Rattus norvegicus
gagtaaactcacatcagggcatttc

SEQ ID NO: 351409 - DNA, 25 bp, Rattus norvegicus
gagtaaactcacttcagggcatttc

SEQ ID NO: 351410 - DNA, 25 bp, Rattus norvegicus
gagtaaactcctaagacgaatctac

SEQ ID NO: 351411 - DNA, 25 bp, Rattus norvegicus
gagtaaactccttagacgaatctac

SEQ ID NO: 351412 - DNA, 25 bp, Rattus norvegicus
gagtaaacttcaaagccagctacgt

SEQ ID NO: 351413 - DNA, 25 bp, Rattus norvegicus
gagtaaacttcatagccagctacgt

SEQ ID NO: 351414 - DNA, 25 bp, Rattus norvegicus
gagtaaacttttaatgtcatcttat

SEQ ID NO: 351415 - DNA, 25 bp, Rattus norvegicus
gagtaaactttttatgtcatcttat

SEQ ID NO: 351416 - DNA, 25 bp, Rattus norvegicus
gagtaaagagtacctactgcctgaa

SEQ ID NO: 351417 - DNA, 25 bp, Rattus norvegicus
gagtaaagagtagctactgcctgaa

SEQ ID NO: 351418 - DNA, 25 bp, Rattus norvegicus
gagtaaaggtcactcactctgcctt

SEQ ID NO: 351419 - DNA, 25 bp, Rattus norvegicus
gagtaaaggtcagtcactctgcctt

SEQ ID NO: 351420 - DNA, 25 bp, Rattus norvegicus
gagtaaatagttatgatcccttcgg

SEQ ID NO: 351421 - DNA, 25 bp, Rattus norvegicus
gagtaaatagttttgatcccttcgg

SEQ ID NO: 351422 - DNA, 25 bp, Rattus norvegicus
gagtaaatcagcagtgctccccaga

SEQ ID NO: 351423 - DNA, 25 bp, Rattus norvegicus
gagtaaatcagctgtgctccccaga

SEQ ID NO: 351424 - DNA, 25 bp, Rattus norvegicus
gagtaaatcgccaactttgctctcc

SEQ ID NO: 351425 - DNA, 25 bp, Rattus norvegicus
gagtaaatcgcctactttgctctcc

SEQ ID NO: 351426 - DNA, 25 bp, Rattus norvegicus
gagtaaatcttcaaaaagcgcttgc

SEQ ID NO: 351427 - DNA, 25 bp, Rattus norvegicus
gagtaaatcttctaaaagcgcttgc

SEQ ID NO: 351428 - DNA, 25 bp, Rattus norvegicus
gagtaaattttgatttcgaagagta

SEQ ID NO: 351429 - DNA, 25 bp, Rattus norvegicus
gagtaaattttgttttcgaagagta

SEQ ID NO: 351430 - DNA, 25 bp, Rattus norvegicus
gagtaacaagatcgcggcatcggcg

SEQ ID NO: 351431 - DNA, 25 bp, Rattus norvegicus
gagtaacaagatggcggcatcggcg

SEQ ID NO: 351432 - DNA, 25 bp, Rattus norvegicus
gagtaacacctccaaagctctctgg

SEQ ID NO: 351433 - DNA, 25 bp, Rattus norvegicus
gagtaacacctcgaaagctctctgg

SEQ ID NO: 351434 - DNA, 25 bp, Rattus norvegicus
gagtaacacggaccaaggcttcttt

SEQ ID NO: 351435 - DNA, 25 bp, Rattus norvegicus
gagtaacacggagcaaggcttcttt

SEQ ID NO: 351436 - DNA, 25 bp, Rattus norvegicus
gagtaacagaaccagacccagcgtt

SEQ ID NO: 351437 - DNA, 25 bp, Rattus norvegicus
gagtaacagaacgagacccagcgtt

SEQ ID NO: 351438 - DNA, 25 bp, Rattus norvegicus
gagtaacagagtaacagggccagct

SEQ ID NO: 351439 - DNA, 25 bp, Rattus norvegicus
gagtaacagagttacagggccagct

SEQ ID NO: 351440 - DNA, 25 bp, Rattus norvegicus
gagtaacattggcttccttagggca

SEQ ID NO: 351441 - DNA, 25 bp, Rattus norvegicus
gagtaacattgggttccttagggca

SEQ ID NO: 351442 - DNA, 25 bp, Rattus norvegicus
gagtaacattttactcatgagaccc

SEQ ID NO: 351443 - DNA, 25 bp, Rattus norvegicus
gagtaacatttttctcatgagaccc

SEQ ID NO: 351444 - DNA, 25 bp, Rattus norvegicus
gagtaaccagagatagcccagcaga

SEQ ID NO: 351445 - DNA, 25 bp, Rattus norvegicus
gagtaaccagagttagcccagcaga

SEQ ID NO: 351446 - DNA, 25 bp, Rattus norvegicus
gagtaaccccagaacttttgtactg

SEQ ID NO: 351447 - DNA, 25 bp, Rattus norvegicus
gagtaaccccagtacttttgtactg

SEQ ID NO: 351448 - DNA, 25 bp, Rattus norvegicus
gagtaacctaaaactgtgtttccag

SEQ ID NO: 351449 - DNA, 25 bp, Rattus norvegicus
gagtaacctaaatctgtgtttccag

SEQ ID NO: 351450 - DNA, 25 bp, Rattus norvegicus
gagtaacctttcctagtctatgctg

SEQ ID NO: 351451 - DNA, 25 bp, Rattus norvegicus
gagtaacctttcgtagtctatgctg

SEQ ID NO: 351452 - DNA, 25 bp, Rattus norvegicus
gagtaacgacaacaaggccccagca

SEQ ID NO: 351453 - DNA, 25 bp, Rattus norvegicus
gagtaacgacaagaaggccccagca

SEQ ID NO: 351454 - DNA, 25 bp, Rattus norvegicus
gagtaacgccatcttgcggtacatc

SEQ ID NO: 351455 - DNA, 25 bp, Rattus norvegicus
gagtaacgccatgttgcggtacatc

SEQ ID NO: 351456 - DNA, 25 bp, Rattus norvegicus
gagtaacgttagattacctcagaga

SEQ ID NO: 351457 - DNA, 25 bp, Rattus norvegicus
gagtaacgttagtttacctcagaga

SEQ ID NO: 351458 - DNA, 25 bp, Rattus norvegicus
gagtaactaaccagtacaacaagca

SEQ ID NO: 351459 - DNA, 25 bp, Rattus norvegicus
gagtaactaacctgtacaacaagca

SEQ ID NO: 351460 - DNA, 25 bp, Rattus norvegicus
gagtaactacatccattcacagtgt

SEQ ID NO: 351461 - DNA, 25 bp, Rattus norvegicus
gagtaactacatgcattcacagtgt

SEQ ID NO: 351462 - DNA, 25 bp, Rattus norvegicus
gagtaactcatcactagagcccaga

SEQ ID NO: 351463 - DNA, 25 bp, Rattus norvegicus
gagtaactcatctctagagcccaga

SEQ ID NO: 351464 - DNA, 25 bp, Rattus norvegicus
gagtaactgtgtatgacttggacct

SEQ ID NO: 351465 - DNA, 25 bp, Rattus norvegicus
gagtaactgtgtttgacttggacct

SEQ ID NO: 351466 - DNA, 25 bp, Rattus norvegicus
gagtaactgttaccaactgccttct

SEQ ID NO: 351467 - DNA, 25 bp, Rattus norvegicus
gagtaactgttagcaactgccttct

SEQ ID NO: 351468 - DNA, 25 bp, Rattus norvegicus
gagtaactgttccacaatcccatgt

SEQ ID NO: 351469 - DNA, 25 bp, Rattus norvegicus
gagtaactgttcgacaatcccatgt

SEQ ID NO: 351470 - DNA, 25 bp, Rattus norvegicus
gagtaacttatgcaagcctttgtgt

SEQ ID NO: 351471 - DNA, 25 bp, Rattus norvegicus
gagtaacttatggaagcctttgtgt

SEQ ID NO: 351472 - DNA, 25 bp, Rattus norvegicus
gagtaacttccacacacttgtgtag

SEQ ID NO: 351473 - DNA, 25 bp, Rattus norvegicus
gagtaacttccagacacttgtgtag

SEQ ID NO: 351474 - DNA, 25 bp, Rattus norvegicus
gagtaacttgctagccatcctttga

SEQ ID NO: 351475 - DNA, 25 bp, Rattus norvegicus
gagtaacttgcttgccatcctttga

SEQ ID NO: 351476 - DNA, 25 bp, Rattus norvegicus
gagtaactttccactgggtcacagc

SEQ ID NO: 351477 - DNA, 25 bp, Rattus norvegicus
gagtaactttcctctgggtcacagc

SEQ ID NO: 351478 - DNA, 25 bp, Rattus norvegicus
gagtaactttctcagtacactaaca

SEQ ID NO: 351479 - DNA, 25 bp, Rattus norvegicus
gagtaactttctgagtacactaaca

SEQ ID NO: 351480 - DNA, 25 bp, Rattus norvegicus
gagtaactttgacaccgttgattat

SEQ ID NO: 351481 - DNA, 25 bp, Rattus norvegicus
gagtaactttgagaccgttgattat

SEQ ID NO: 351482 - DNA, 25 bp, Rattus norvegicus
gagtaacttttgcaaaacgctgtcg

SEQ ID NO: 351483 - DNA, 25 bp, Rattus norvegicus
gagtaacttttggaaaacgctgtcg

SEQ ID NO: 351484 - DNA, 25 bp, Rattus norvegicus
gagtaagaacaacctggtccagacc

SEQ ID NO: 351485 - DNA, 25 bp, Rattus norvegicus
gagtaagaacaagctggtccagacc

SEQ ID NO: 351486 - DNA, 25 bp, Rattus norvegicus
gagtaagaactacctctagattgtg

SEQ ID NO: 351487 - DNA, 25 bp, Rattus norvegicus
gagtaagaactagctctagattgtg

SEQ ID NO: 351488 - DNA, 25 bp, Rattus norvegicus
gagtaagaagctcaacttggctatt

SEQ ID NO: 351489 - DNA, 25 bp, Rattus norvegicus
gagtaagaagctgaacttggctatt

SEQ ID NO: 351490 - DNA, 25 bp, Rattus norvegicus
gagtaagaagtgcagctcccagcct

SEQ ID NO: 351491 - DNA, 25 bp, Rattus norvegicus
gagtaagaagtggagctcccagcct

SEQ ID NO: 351492 - DNA, 25 bp, Rattus norvegicus
gagtaagaatcgattcatctgcccc

SEQ ID NO: 351493 - DNA, 25 bp, Rattus norvegicus
gagtaagaatcgtttcatctgcccc

SEQ ID NO: 351494 - DNA, 25 bp, Rattus norvegicus
gagtaagacagactttttgtagccc

SEQ ID NO: 351495 - DNA, 25 bp, Rattus norvegicus
gagtaagacagagtttttgtagccc

SEQ ID NO: 351496 - DNA, 25 bp, Rattus norvegicus
gagtaagaccttcctgactatttta

SEQ ID NO: 351497 - DNA, 25 bp, Rattus norvegicus
gagtaagaccttgctgactatttta

SEQ ID NO: 351498 - DNA, 25 bp, Rattus norvegicus
gagtaagactcgcacaggtgctatg

SEQ ID NO: 351499 - DNA, 25 bp, Rattus norvegicus
gagtaagactcggacaggtgctatg

SEQ ID NO: 351500 - DNA, 25 bp, Rattus norvegicus
gagtaagcactgagcacctctgcaa

SEQ ID NO: 351501 - DNA, 25 bp, Rattus norvegicus
gagtaagcactgtgcacctctgcaa

SEQ ID NO: 351502 - DNA, 25 bp, Rattus norvegicus
gagtaagcacttctaaactttcttg

SEQ ID NO: 351503 - DNA, 25 bp, Rattus norvegicus
gagtaagcacttgtaaactttcttg

SEQ ID NO: 351504 - DNA, 25 bp, Rattus norvegicus
gagtaagcatttaatgtcaccagct

SEQ ID NO: 351505 - DNA, 25 bp, Rattus norvegicus
gagtaagcattttatgtcaccagct

SEQ ID NO: 351506 - DNA, 25 bp, Rattus norvegicus
gagtaagccgctatcacgggcatga

SEQ ID NO: 351507 - DNA, 25 bp, Rattus norvegicus
gagtaagccgctttcacgggcatga

SEQ ID NO: 351508 - DNA, 25 bp, Rattus norvegicus
gagtaagccggactcactttgaccc

SEQ ID NO: 351509 - DNA, 25 bp, Rattus norvegicus
gagtaagccggagtcactttgaccc

SEQ ID NO: 351510 - DNA, 25 bp, Rattus norvegicus
gagtaaggaccacagctaccaatgt

SEQ ID NO: 351511 - DNA, 25 bp, Rattus norvegicus
gagtaaggaccagagctaccaatgt

SEQ ID NO: 351512 - DNA, 25 bp, Rattus norvegicus
gagtaaggacctatgcaatgctaca

SEQ ID NO: 351513 - DNA, 25 bp, Rattus norvegicus
gagtaaggacctttgcaatgctaca

SEQ ID NO: 351514 - DNA, 25 bp, Rattus norvegicus
gagtaaggatggctcttcctcctca

SEQ ID NO: 351515 - DNA, 25 bp, Rattus norvegicus
gagtaaggatgggtcttcctcctca

SEQ ID NO: 351516 - DNA, 25 bp, Rattus norvegicus
gagtaaggcccgcatggtctgcctt

SEQ ID NO: 351517 - DNA, 25 bp, Rattus norvegicus
gagtaaggcccggatggtctgcctt

SEQ ID NO: 351518 - DNA, 25 bp, Rattus norvegicus
gagtaagtagctcttggtaagccaa

SEQ ID NO: 351519 - DNA, 25 bp, Rattus norvegicus
gagtaagtagctgttggtaagccaa

SEQ ID NO: 351520 - DNA, 25 bp, Rattus norvegicus
gagtaagtcatccaagccctcagaa

SEQ ID NO: 351521 - DNA, 25 bp, Rattus norvegicus
gagtaagtcatcgaagccctcagaa

SEQ ID NO: 351522 - DNA, 25 bp, Rattus norvegicus
gagtaagtcatgacttggcctagaa

SEQ ID NO: 351523 - DNA, 25 bp, Rattus norvegicus
gagtaagtcatgtcttggcctagaa

SEQ ID NO: 351524 - DNA, 25 bp, Rattus norvegicus
gagtaagtcattaacttccgctgtg

SEQ ID NO: 351525 - DNA, 25 bp, Rattus norvegicus
gagtaagtcatttacttccgctgtg

SEQ ID NO: 351526 - DNA, 25 bp, Rattus norvegicus
gagtaagtccaaagccaaggccctg

SEQ ID NO: 351527 - DNA, 25 bp, Rattus norvegicus
gagtaagtccaatgccaaggccctg

SEQ ID NO: 351528 - DNA, 25 bp, Rattus norvegicus
gagtaagtcctcaagcagccttcag

SEQ ID NO: 351529 - DNA, 25 bp, Rattus norvegicus
gagtaagtcctctagcagccttcag

SEQ ID NO: 351530 - DNA, 25 bp, Rattus norvegicus
gagtaagtgcctcctaggcatcaag

SEQ ID NO: 351531 - DNA, 25 bp, Rattus norvegicus
gagtaagtgcctgctaggcatcaag

SEQ ID NO: 351532 - DNA, 25 bp, Rattus norvegicus
gagtaagttagcctcgtgccgaatt

SEQ ID NO: 351533 - DNA, 25 bp, Rattus norvegicus
gagtaagttagcgtcgtgccgaatt

SEQ ID NO: 351534 - DNA, 25 bp, Rattus norvegicus
gagtaagttcctagctcagcggtaa

SEQ ID NO: 351535 - DNA, 25 bp, Rattus norvegicus
gagtaagttccttgctcagcggtaa

SEQ ID NO: 351536 - DNA, 25 bp, Rattus norvegicus
gagtaagtttttctgccaaatcaag

SEQ ID NO: 351537 - DNA, 25 bp, Rattus norvegicus
gagtaagtttttgtgccaaatcaag

SEQ ID NO: 351538 - DNA, 25 bp, Rattus norvegicus
gagtaatacctcctgttccgttttg

SEQ ID NO: 351539 - DNA, 25 bp, Rattus norvegicus
gagtaatacctcgtgttccgttttg

SEQ ID NO: 351540 - DNA, 25 bp, Rattus norvegicus
gagtaatagaccaggatgtgttcct

SEQ ID NO: 351541 - DNA, 25 bp, Rattus norvegicus
gagtaatagacctggatgtgttcct

SEQ ID NO: 351542 - DNA, 25 bp, Rattus norvegicus
gagtaatcaactaggtcttcccttt

SEQ ID NO: 351543 - DNA, 25 bp, Rattus norvegicus
gagtaatcaacttggtcttcccttt

SEQ ID NO: 351544 - DNA, 25 bp, Rattus norvegicus
gagtaatccatgagtgtagccaaac

SEQ ID NO: 351545 - DNA, 25 bp, Rattus norvegicus
gagtaatccatgtgtgtagccaaac

SEQ ID NO: 351546 - DNA, 25 bp, Rattus norvegicus
gagtaatcctaaattctgttgcctt

SEQ ID NO: 351547 - DNA, 25 bp, Rattus norvegicus
gagtaatcctaatttctgttgcctt

SEQ ID NO: 351548 - DNA, 25 bp, Rattus norvegicus
gagtaatcctgcagtggccttttca

SEQ ID NO: 351549 - DNA, 25 bp, Rattus norvegicus
gagtaatcctgctgtggccttttca

SEQ ID NO: 351550 - DNA, 25 bp, Rattus norvegicus
gagtaatccttcatggctctattga

SEQ ID NO: 351551 - DNA, 25 bp, Rattus norvegicus
gagtaatccttcttggctctattga

SEQ ID NO: 351552 - DNA, 25 bp, Rattus norvegicus
gagtaatcctttcgcgtgggctaaa

SEQ ID NO: 351553 - DNA, 25 bp, Rattus norvegicus
gagtaatcctttggcgtgggctaaa

SEQ ID NO: 351554 - DNA, 25 bp, Rattus norvegicus
gagtaatgaggcaccatcaagctgt

SEQ ID NO: 351555 - DNA, 25 bp, Rattus norvegicus
gagtaatgaggctccatcaagctgt

SEQ ID NO: 351556 - DNA, 25 bp, Rattus norvegicus
gagtaatgataacccctcaaccctc

SEQ ID NO: 351557 - DNA, 25 bp, Rattus norvegicus
gagtaatgataagccctcaaccctc

SEQ ID NO: 351558 - DNA, 25 bp, Rattus norvegicus
gagtaatgcaggactaccctctcat

SEQ ID NO: 351559 - DNA, 25 bp, Rattus norvegicus
gagtaatgcaggtctaccctctcat

SEQ ID NO: 351560 - DNA, 25 bp, Rattus norvegicus
gagtaatgcatgaccatgcctcgtg

SEQ ID NO: 351561 - DNA, 25 bp, Rattus norvegicus
gagtaatgcatgtccatgcctcgtg

SEQ ID NO: 351562 - DNA, 25 bp, Rattus norvegicus
gagtaatgtcaacttaccgaaggac

SEQ ID NO: 351563 - DNA, 25 bp, Rattus norvegicus
gagtaatgtcaagttaccgaaggac

SEQ ID NO: 351564 - DNA, 25 bp, Rattus norvegicus
gagtaattatgtatccctgctgcca

SEQ ID NO: 351565 - DNA, 25 bp, Rattus norvegicus
gagtaattatgtttccctgctgcca

SEQ ID NO: 351566 - DNA, 25 bp, Rattus norvegicus
gagtaattcaggagttttctacaat

SEQ ID NO: 351567 - DNA, 25 bp, Rattus norvegicus
gagtaattcaggtgttttctacaat

SEQ ID NO: 351568 - DNA, 25 bp, Rattus norvegicus
gagtaattccttatccaggtctatt

SEQ ID NO: 351569 - DNA, 25 bp, Rattus norvegicus
gagtaattccttttccaggtctatt

SEQ ID NO: 351570 - DNA, 25 bp, Rattus norvegicus
gagtaattgccccattgagtttccc

SEQ ID NO: 351571 - DNA, 25 bp, Rattus norvegicus
gagtaattgcccgattgagtttccc

SEQ ID NO: 351572 - DNA, 25 bp, Rattus norvegicus
gagtaattgctgacttgatgttcac

SEQ ID NO: 351573 - DNA, 25 bp, Rattus norvegicus
gagtaattgctgtcttgatgttcac

SEQ ID NO: 351574 - DNA, 25 bp, Rattus norvegicus
gagtaattgcttaagtacttggcat

SEQ ID NO: 351575 - DNA, 25 bp, Rattus norvegicus
gagtaattgctttagtacttggcat

SEQ ID NO: 351576 - DNA, 25 bp, Rattus norvegicus
gagtaattttgcctcctggacatgt

SEQ ID NO: 351577 - DNA, 25 bp, Rattus norvegicus
gagtaattttgcgtcctggacatgt

SEQ ID NO: 351578 - DNA, 25 bp, Rattus norvegicus
gagtacaaaagcctaccaggctcat

SEQ ID NO: 351579 - DNA, 25 bp, Rattus norvegicus
gagtacaaaagcgtaccaggctcat

SEQ ID NO: 351580 - DNA, 25 bp, Rattus norvegicus
gagtacaaactcatcttcaccgtgt

SEQ ID NO: 351581 - DNA, 25 bp, Rattus norvegicus
gagtacaaactcttcttcaccgtgt

SEQ ID NO: 351582 - DNA, 25 bp, Rattus norvegicus
gagtacaagatacagcttttctggt

SEQ ID NO: 351583 - DNA, 25 bp, Rattus norvegicus
gagtacaagatagagcttttctggt

SEQ ID NO: 351584 - DNA, 25 bp, Rattus norvegicus
gagtacaagcgaagcgtgctgctaa

SEQ ID NO: 351585 - DNA, 25 bp, Rattus norvegicus
gagtacaagcgatgcgtgctgctaa

SEQ ID NO: 351586 - DNA, 25 bp, Rattus norvegicus
gagtacaagggcaacctggtctccg

SEQ ID NO: 351587 - DNA, 25 bp, Rattus norvegicus
gagtacaagggcaccatctggcata

SEQ ID NO: 351588 - DNA, 25 bp, Rattus norvegicus
gagtacaagggctacctggtctccg

SEQ ID NO: 351589 - DNA, 25 bp, Rattus norvegicus
gagtacaagggctccatctggcata

SEQ ID NO: 351590 - DNA, 25 bp, Rattus norvegicus
gagtacaatatcctccttgacataa

SEQ ID NO: 351591 - DNA, 25 bp, Rattus norvegicus
gagtacaatatcgtccttgacataa

SEQ ID NO: 351592 - DNA, 25 bp, Rattus norvegicus
gagtacaatcctaatgaagtattaa

SEQ ID NO: 351593 - DNA, 25 bp, Rattus norvegicus
gagtacaatccttatgaagtattaa

SEQ ID NO: 351594 - DNA, 25 bp, Rattus norvegicus
gagtacaatgccatggctgcccggg

SEQ ID NO: 351595 - DNA, 25 bp, Rattus norvegicus
gagtacaatgccttggctgcccggg

SEQ ID NO: 351596 - DNA, 25 bp, Rattus norvegicus
gagtacacaagacacccagcggctg

SEQ ID NO: 351597 - DNA, 25 bp, Rattus norvegicus
gagtacacaagagacccagcggctg

SEQ ID NO: 351598 - DNA, 25 bp, Rattus norvegicus
gagtacacatggaggaacccgagac

SEQ ID NO: 351599 - DNA, 25 bp, Rattus norvegicus
gagtacacatggtggaacccgagac

SEQ ID NO: 351600 - DNA, 25 bp, Rattus norvegicus
gagtacacggacagtctgacctcca

SEQ ID NO: 351601 - DNA, 25 bp, Rattus norvegicus
gagtacacggactgtctgacctcca

SEQ ID NO: 351602 - DNA, 25 bp, Rattus norvegicus
gagtacacgttccacaaaatctgat

SEQ ID NO: 351603 - DNA, 25 bp, Rattus norvegicus
gagtacacgttcgacaaaatctgat

SEQ ID NO: 351604 - DNA, 25 bp, Rattus norvegicus
gagtacactgtgctcactaatccct

SEQ ID NO: 351605 - DNA, 25 bp, Rattus norvegicus
gagtacactgtggtcactaatccct

SEQ ID NO: 351606 - DNA, 25 bp, Rattus norvegicus
gagtacagaattctgggctcctctc

SEQ ID NO: 351607 - DNA, 25 bp, Rattus norvegicus
gagtacagaattgtgggctcctctc

SEQ ID NO: 351608 - DNA, 25 bp, Rattus norvegicus
gagtacagagtcagccttgagtcct

SEQ ID NO: 351609 - DNA, 25 bp, Rattus norvegicus
gagtacagagtctgccttgagtcct

SEQ ID NO: 351610 - DNA, 25 bp, Rattus norvegicus
gagtacagcctgagttcttacaaac

SEQ ID NO: 351611 - DNA, 25 bp, Rattus norvegicus
gagtacagcctgtgttcttacaaac

SEQ ID NO: 351612 - DNA, 25 bp, Rattus norvegicus
gagtacagctcaactttgtaaggac

SEQ ID NO: 351613 - DNA, 25 bp, Rattus norvegicus
gagtacagctcatctttgtaaggac

SEQ ID NO: 351614 - DNA, 25 bp, Rattus norvegicus
gagtacagtgatagtgtcctgcctg

SEQ ID NO: 351615 - DNA, 25 bp, Rattus norvegicus
gagtacagtgattgtgtcctgcctg

SEQ ID NO: 351616 - DNA, 25 bp, Rattus norvegicus
gagtacatcatgaccatcgagcagg

SEQ ID NO: 351617 - DNA, 25 bp, Rattus norvegicus
gagtacatcatgtccatcgagcagg

SEQ ID NO: 351618 - DNA, 25 bp, Rattus norvegicus
gagtacatccttctatttgtatttg

SEQ ID NO: 351619 - DNA, 25 bp, Rattus norvegicus
gagtacatccttgtatttgtatttg

SEQ ID NO: 351620 - DNA, 25 bp, Rattus norvegicus
gagtacatctcgcattttcctctta

SEQ ID NO: 351621 - DNA, 25 bp, Rattus norvegicus
gagtacatctcggattttcctctta

SEQ ID NO: 351622 - DNA, 25 bp, Rattus norvegicus
gagtacatgagaacccattcctaaa

SEQ ID NO: 351623 - DNA, 25 bp, Rattus norvegicus
gagtacatgagatcccattcctaaa

SEQ ID NO: 351624 - DNA, 25 bp, Rattus norvegicus
gagtacatggctcctgctgatgaat

SEQ ID NO: 351625 - DNA, 25 bp, Rattus norvegicus
gagtacatggctgctgctgatgaat

SEQ ID NO: 351626 - DNA, 25 bp, Rattus norvegicus
gagtacatgggtctggcaatcaaaa

SEQ ID NO: 351627 - DNA, 25 bp, Rattus norvegicus
gagtacatgggtgtggcaatcaaaa

SEQ ID NO: 351628 - DNA, 25 bp, Rattus norvegicus
gagtacatggtcaacttcaacttct

SEQ ID NO: 351629 - DNA, 25 bp, Rattus norvegicus
gagtacatggtctacttcaacttct

SEQ ID NO: 351630 - DNA, 25 bp, Rattus norvegicus
gagtacatgtccctgaagtccctgg

SEQ ID NO: 351631 - DNA, 25 bp, Rattus norvegicus
gagtacatgtccgtgaagtccctgg

SEQ ID NO: 351632 - DNA, 25 bp, Rattus norvegicus
gagtacatgtgacgctctgctcatc

SEQ ID NO: 351633 - DNA, 25 bp, Rattus norvegicus
gagtacatgtgaggctctgctcatc

SEQ ID NO: 351634 - DNA, 25 bp, Rattus norvegicus
gagtacattcttagctagcagacag

SEQ ID NO: 351635 - DNA, 25 bp, Rattus norvegicus
gagtacattctttgctagcagacag

SEQ ID NO: 351636 - DNA, 25 bp, Rattus norvegicus
gagtacattgcactgtaaatccctg

SEQ ID NO: 351637 - DNA, 25 bp, Rattus norvegicus
gagtacattgcagtgtaaatccctg

SEQ ID NO: 351638 - DNA, 25 bp, Rattus norvegicus
gagtaccaagacaaccacaggacta

SEQ ID NO: 351639 - DNA, 25 bp, Rattus norvegicus
gagtaccaagactaccacaggacta

SEQ ID NO: 351640 - DNA, 25 bp, Rattus norvegicus
gagtaccaccggcaggatgtcacta

SEQ ID NO: 351641 - DNA, 25 bp, Rattus norvegicus
gagtaccaccgggaggatgtcacta

SEQ ID NO: 351642 - DNA, 25 bp, Rattus norvegicus
gagtaccacctacctgtgatggcag

SEQ ID NO: 351643 - DNA, 25 bp, Rattus norvegicus
gagtaccacctagctgtgatggcag

SEQ ID NO: 351644 - DNA, 25 bp, Rattus norvegicus
gagtaccacctgaaatacctcttct

SEQ ID NO: 351645 - DNA, 25 bp, Rattus norvegicus
gagtaccacctgtaatacctcttct

SEQ ID NO: 351646 - DNA, 25 bp, Rattus norvegicus
gagtaccactccacagttcgattta

SEQ ID NO: 351647 - DNA, 25 bp, Rattus norvegicus
gagtaccactcctcagttcgattta

SEQ ID NO: 351648 - DNA, 25 bp, Rattus norvegicus
gagtaccagaaccaggccattatca

SEQ ID NO: 351649 - DNA, 25 bp, Rattus norvegicus
gagtaccagaacgaggccattatca

SEQ ID NO: 351650 - DNA, 25 bp, Rattus norvegicus
gagtaccagcaaacaagtctagatg

SEQ ID NO: 351651 - DNA, 25 bp, Rattus norvegicus
gagtaccagcaatcaagtctagatg

SEQ ID NO: 351652 - DNA, 25 bp, Rattus norvegicus
gagtaccaggagaccattgaccaga

SEQ ID NO: 351653 - DNA, 25 bp, Rattus norvegicus
gagtaccaggagtccattgaccaga

SEQ ID NO: 351654 - DNA, 25 bp, Rattus norvegicus
gagtaccaggtcatagatttttatc

SEQ ID NO: 351655 - DNA, 25 bp, Rattus norvegicus
gagtaccaggtcttagatttttatc

SEQ ID NO: 351656 - DNA, 25 bp, Rattus norvegicus
gagtaccagttcatcagccgcagga

SEQ ID NO: 351657 - DNA, 25 bp, Rattus norvegicus
gagtaccagttcttcagccgcagga

SEQ ID NO: 351658 - DNA, 25 bp, Rattus norvegicus
gagtaccataggacttgaggtcaaa

SEQ ID NO: 351659 - DNA, 25 bp, Rattus norvegicus
gagtaccataggtcttgaggtcaaa

SEQ ID NO: 351660 - DNA, 25 bp, Rattus norvegicus
gagtaccatgcaagctgtatgtcta

SEQ ID NO: 351661 - DNA, 25 bp, Rattus norvegicus
gagtaccatgcatgctgtatgtcta

SEQ ID NO: 351662 - DNA, 25 bp, Rattus norvegicus
gagtaccatgtcatttcagctccat

SEQ ID NO: 351663 - DNA, 25 bp, Rattus norvegicus
gagtaccatgtcttttcagctccat

SEQ ID NO: 351664 - DNA, 25 bp, Rattus norvegicus
gagtaccatgtgatccggcatgcta

SEQ ID NO: 351665 - DNA, 25 bp, Rattus norvegicus
gagtaccatgtgttccggcatgcta

SEQ ID NO: 351666 - DNA, 25 bp, Rattus norvegicus
gagtacccaaagagatctgattatt

SEQ ID NO: 351667 - DNA, 25 bp, Rattus norvegicus
gagtacccaaagtgatctgattatt

SEQ ID NO: 351668 - DNA, 25 bp, Rattus norvegicus
gagtacccagcaagtggcaagtgta

SEQ ID NO: 351669 - DNA, 25 bp, Rattus norvegicus
gagtacccagcatgtggcaagtgta

SEQ ID NO: 351670 - DNA, 25 bp, Rattus norvegicus
gagtacccaggccactacggcgaag

SEQ ID NO: 351671 - DNA, 25 bp, Rattus norvegicus
gagtacccaggcgactacggcgaag

SEQ ID NO: 351672 - DNA, 25 bp, Rattus norvegicus
gagtacccctcaagtggcagagcct

SEQ ID NO: 351673 - DNA, 25 bp, Rattus norvegicus
gagtacccctcatgtggcagagcct

SEQ ID NO: 351674 - DNA, 25 bp, Rattus norvegicus
gagtacccctttctgaaactctgta

SEQ ID NO: 351675 - DNA, 25 bp, Rattus norvegicus
gagtacccctttgtgaaactctgta

SEQ ID NO: 351676 - DNA, 25 bp, Rattus norvegicus
gagtaccctgcaaaccagaaacggt

SEQ ID NO: 351677 - DNA, 25 bp, Rattus norvegicus
gagtaccctgcataccagaaacggt

SEQ ID NO: 351678 - DNA, 25 bp, Rattus norvegicus
gagtaccctgtcatgtacagcacag

SEQ ID NO: 351679 - DNA, 25 bp, Rattus norvegicus
gagtaccctgtcttgtacagcacag

SEQ ID NO: 351680 - DNA, 25 bp, Rattus norvegicus
gagtaccgagataaaatgtgtgcac

SEQ ID NO: 351681 - DNA, 25 bp, Rattus norvegicus
gagtaccgagattaaatgtgtgcac

SEQ ID NO: 351682 - DNA, 25 bp, Rattus norvegicus
gagtaccggaccagggccaagtgac

SEQ ID NO: 351683 - DNA, 25 bp, Rattus norvegicus
gagtaccggacctgggccaagtgac

SEQ ID NO: 351684 - DNA, 25 bp, Rattus norvegicus
gagtacctaaacatgcagcaacatt

SEQ ID NO: 351685 - DNA, 25 bp, Rattus norvegicus
gagtacctaaacttgcagcaacatt

SEQ ID NO: 351686 - DNA, 25 bp, Rattus norvegicus
gagtacctatgacatttctcactaa

SEQ ID NO: 351687 - DNA, 25 bp, Rattus norvegicus
gagtacctatgagatttctcactaa

SEQ ID NO: 351688 - DNA, 25 bp, Rattus norvegicus
gagtacctcagtaagtgaataccag

SEQ ID NO: 351689 - DNA, 25 bp, Rattus norvegicus
gagtacctcagttagtgaataccag

SEQ ID NO: 351690 - DNA, 25 bp, Rattus norvegicus
gagtacctctatacttggcaaattc

SEQ ID NO: 351691 - DNA, 25 bp, Rattus norvegicus
gagtacctctattcttggcaaattc

SEQ ID NO: 351692 - DNA, 25 bp, Rattus norvegicus
gagtacctgattatcctcttaaaat

SEQ ID NO: 351693 - DNA, 25 bp, Rattus norvegicus
gagtacctgattttcctcttaaaat

SEQ ID NO: 351694 - DNA, 25 bp, Rattus norvegicus
gagtacctggacaaagccttaaaca

SEQ ID NO: 351695 - DNA, 25 bp, Rattus norvegicus
gagtacctggactaagccttaaaca

SEQ ID NO: 351696 - DNA, 25 bp, Rattus norvegicus
gagtacctggcaagaatacctgctt

SEQ ID NO: 351697 - DNA, 25 bp, Rattus norvegicus
gagtacctggcatgaatacctgctt

SEQ ID NO: 351698 - DNA, 25 bp, Rattus norvegicus
gagtacctggccaccttgggcagga

SEQ ID NO: 351699 - DNA, 25 bp, Rattus norvegicus
gagtacctggcctccttgggcagga

SEQ ID NO: 351700 - DNA, 25 bp, Rattus norvegicus
gagtacctggctacaatttctagaa

SEQ ID NO: 351701 - DNA, 25 bp, Rattus norvegicus
gagtacctggcttcaatttctagaa

SEQ ID NO: 351702 - DNA, 25 bp, Rattus norvegicus
gagtacctgggacttacacctccta

SEQ ID NO: 351703 - DNA, 25 bp, Rattus norvegicus
gagtacctgggagttacacctccta

SEQ ID NO: 351704 - DNA, 25 bp, Rattus norvegicus
gagtacctggtactgagtaactata

SEQ ID NO: 351705 - DNA, 25 bp, Rattus norvegicus
gagtacctggtagtgagtaactata

SEQ ID NO: 351706 - DNA, 25 bp, Rattus norvegicus
gagtacctgtatacttaccattgaa

SEQ ID NO: 351707 - DNA, 25 bp, Rattus norvegicus
gagtacctgtattcttaccattgaa

SEQ ID NO: 351708 - DNA, 25 bp, Rattus norvegicus
gagtacctgtcgatcacatcatttg

SEQ ID NO: 351709 - DNA, 25 bp, Rattus norvegicus
gagtacctgtcgttcacatcatttg

SEQ ID NO: 351710 - DNA, 25 bp, Rattus norvegicus
gagtaccttctaccaccataaacac

SEQ ID NO: 351711 - DNA, 25 bp, Rattus norvegicus
gagtaccttctagcaccataaacac

SEQ ID NO: 351712 - DNA, 25 bp, Rattus norvegicus
gagtacgaacctatggcttcccaga

SEQ ID NO: 351713 - DNA, 25 bp, Rattus norvegicus
gagtacgaacctttggcttcccaga

SEQ ID NO: 351714 - DNA, 25 bp, Rattus norvegicus
gagtacgagacccaatctagtgcag

SEQ ID NO: 351715 - DNA, 25 bp, Rattus norvegicus
gagtacgagaccgaatctagtgcag

SEQ ID NO: 351716 - DNA, 25 bp, Rattus norvegicus
gagtacggctcaaacagcacttgga

SEQ ID NO: 351717 - DNA, 25 bp, Rattus norvegicus
gagtacggctcatacagcacttgga

SEQ ID NO: 351718 - DNA, 25 bp, Rattus norvegicus
gagtacgtgctgatgcaggccatct

SEQ ID NO: 351719 - DNA, 25 bp, Rattus norvegicus
gagtacgtgctgttgcaggccatct

SEQ ID NO: 351720 - DNA, 25 bp, Rattus norvegicus
gagtacgtgtcgcttaaaaatcata

SEQ ID NO: 351721 - DNA, 25 bp, Rattus norvegicus
gagtacgtgtcggttaaaaatcata

SEQ ID NO: 351722 - DNA, 25 bp, Rattus norvegicus
gagtacgtgttactttcctacaaag

SEQ ID NO: 351723 - DNA, 25 bp, Rattus norvegicus
gagtacgtgttagtttcctacaaag

SEQ ID NO: 351724 - DNA, 25 bp, Rattus norvegicus
gagtactaaacactcttccagcatg

SEQ ID NO: 351725 - DNA, 25 bp, Rattus norvegicus
gagtactaaacagtcttccagcatg

SEQ ID NO: 351726 - DNA, 25 bp, Rattus norvegicus
gagtactaatctcacccaaggtgca

SEQ ID NO: 351727 - DNA, 25 bp, Rattus norvegicus
gagtactaatctgacccaaggtgca

SEQ ID NO: 351728 - DNA, 25 bp, Rattus norvegicus
gagtactaccgcaaacacatggagg

SEQ ID NO: 351729 - DNA, 25 bp, Rattus norvegicus
gagtactaccgctaacacatggagg

SEQ ID NO: 351730 - DNA, 25 bp, Rattus norvegicus
gagtactacttgattgcacaggaga

SEQ ID NO: 351731 - DNA, 25 bp, Rattus norvegicus
gagtactacttgtttgcacaggaga

SEQ ID NO: 351732 - DNA, 25 bp, Rattus norvegicus
gagtactagcccatggactttgacc

SEQ ID NO: 351733 - DNA, 25 bp, Rattus norvegicus
gagtactagcccttggactttgacc

SEQ ID NO: 351734 - DNA, 25 bp, Rattus norvegicus
gagtactatgacaacatctttccag

SEQ ID NO: 351735 - DNA, 25 bp, Rattus norvegicus
gagtactatgactacatctttccag

SEQ ID NO: 351736 - DNA, 25 bp, Rattus norvegicus
gagtactcaagccatgaaaccgtat

SEQ ID NO: 351737 - DNA, 25 bp, Rattus norvegicus
gagtactcaagcgatgaaaccgtat

SEQ ID NO: 351738 - DNA, 25 bp, Rattus norvegicus
gagtactcacggcaaagtcacagag

SEQ ID NO: 351739 - DNA, 25 bp, Rattus norvegicus
gagtactcacgggaaagtcacagag

SEQ ID NO: 351740 - DNA, 25 bp, Rattus norvegicus
gagtactcagtaatggagccgcaat

SEQ ID NO: 351741 - DNA, 25 bp, Rattus norvegicus
gagtactcagtattggagccgcaat

SEQ ID NO: 351742 - DNA, 25 bp, Rattus norvegicus
gagtactccactattgactaggcac

SEQ ID NO: 351743 - DNA, 25 bp, Rattus norvegicus
gagtactccacttttgactaggcac

SEQ ID NO: 351744 - DNA, 25 bp, Rattus norvegicus
gagtactccatcacaaagcacacat

SEQ ID NO: 351745 - DNA, 25 bp, Rattus norvegicus
gagtactccatctcaaagcacacat

SEQ ID NO: 351746 - DNA, 25 bp, Rattus norvegicus
gagtactcccggacactgagtggca

SEQ ID NO: 351747 - DNA, 25 bp, Rattus norvegicus
gagtactcccggtcactgagtggca

SEQ ID NO: 351748 - DNA, 25 bp, Rattus norvegicus
gagtactccttgacactaacctttt

SEQ ID NO: 351749 - DNA, 25 bp, Rattus norvegicus
gagtactccttgagaccaaggtctt

SEQ ID NO: 351750 - DNA, 25 bp, Rattus norvegicus
gagtactccttgtcactaacctttt

SEQ ID NO: 351751 - DNA, 25 bp, Rattus norvegicus
gagtactccttgtgaccaaggtctt

SEQ ID NO: 351752 - DNA, 25 bp, Rattus norvegicus
gagtactcgcctcgtgcacgtgaga

SEQ ID NO: 351753 - DNA, 25 bp, Rattus norvegicus
gagtactcgcctggtgcacgtgaga

SEQ ID NO: 351754 - DNA, 25 bp, Rattus norvegicus
gagtactcgtccaagtgccaggagt

SEQ ID NO: 351755 - DNA, 25 bp, Rattus norvegicus
gagtactcgtcctagtgccaggagt

SEQ ID NO: 351756 - DNA, 25 bp, Rattus norvegicus
gagtactctcgtctggaggactagt

SEQ ID NO: 351757 - DNA, 25 bp, Rattus norvegicus
gagtactctcgtgtggaggactagt

SEQ ID NO: 351758 - DNA, 25 bp, Rattus norvegicus
gagtactctgtgatctttgcagcac

SEQ ID NO: 351759 - DNA, 25 bp, Rattus norvegicus
gagtactctgtgttctttgcagcac

SEQ ID NO: 351760 - DNA, 25 bp, Rattus norvegicus
gagtactcttctcgccaaagtttaa

SEQ ID NO: 351761 - DNA, 25 bp, Rattus norvegicus
gagtactcttctggccaaagtttaa

SEQ ID NO: 351762 - DNA, 25 bp, Rattus norvegicus
gagtactgacggaccgctgatcctg

SEQ ID NO: 351763 - DNA, 25 bp, Rattus norvegicus
gagtactgacggtccgctgatcctg

SEQ ID NO: 351764 - DNA, 25 bp, Rattus norvegicus
gagtactgagctctatgaccccact

SEQ ID NO: 351765 - DNA, 25 bp, Rattus norvegicus
gagtactgagctgtatgaccccact

SEQ ID NO: 351766 - DNA, 25 bp, Rattus norvegicus
gagtactgagtgattctctatatga

SEQ ID NO: 351767 - DNA, 25 bp, Rattus norvegicus
gagtactgagtgtttctctatatga

SEQ ID NO: 351768 - DNA, 25 bp, Rattus norvegicus
gagtactgatgcaggcgtgtagcct

SEQ ID NO: 351769 - DNA, 25 bp, Rattus norvegicus
gagtactgatgctggcgtgtagcct

SEQ ID NO: 351770 - DNA, 25 bp, Rattus norvegicus
gagtactgcattctagtctccatat

SEQ ID NO: 351771 - DNA, 25 bp, Rattus norvegicus
gagtactgcattgtagtctccatat

SEQ ID NO: 351772 - DNA, 25 bp, Rattus norvegicus
gagtactgcctaactgtcagtatat

SEQ ID NO: 351773 - DNA, 25 bp, Rattus norvegicus
gagtactgcctatctgtcagtatat

SEQ ID NO: 351774 - DNA, 25 bp, Rattus norvegicus
gagtactgcgaccacagatgtgcac

SEQ ID NO: 351775 - DNA, 25 bp, Rattus norvegicus
gagtactgcgacgacagatgtgcac

SEQ ID NO: 351776 - DNA, 25 bp, Rattus norvegicus
gagtactggatacttctggtcccct

SEQ ID NO: 351777 - DNA, 25 bp, Rattus norvegicus
gagtactggatagttctggtcccct

SEQ ID NO: 351778 - DNA, 25 bp, Rattus norvegicus
gagtactggccaattacggtgatga

SEQ ID NO: 351779 - DNA, 25 bp, Rattus norvegicus
gagtactggccatttacggtgatga

SEQ ID NO: 351780 - DNA, 25 bp, Rattus norvegicus
gagtactgggtcagagcaatgcaac

SEQ ID NO: 351781 - DNA, 25 bp, Rattus norvegicus
gagtactgggtctgagcaatgcaac

SEQ ID NO: 351782 - DNA, 25 bp, Rattus norvegicus
gagtactgggtgctcatgctcaagt

SEQ ID NO: 351783 - DNA, 25 bp, Rattus norvegicus
gagtactgggtggtcatgctcaagt

SEQ ID NO: 351784 - DNA, 25 bp, Rattus norvegicus
gagtactgtagaatttctcaggcat

SEQ ID NO: 351785 - DNA, 25 bp, Rattus norvegicus
gagtactgtagattttctcaggcat

SEQ ID NO: 351786 - DNA, 25 bp, Rattus norvegicus
gagtactgtctcaaggtgctggaga

SEQ ID NO: 351787 - DNA, 25 bp, Rattus norvegicus
gagtactgtctctaggtgctggaga

SEQ ID NO: 351788 - DNA, 25 bp, Rattus norvegicus
gagtactgtgtaactggactgagca

SEQ ID NO: 351789 - DNA, 25 bp, Rattus norvegicus
gagtactgtgtatctggactgagca

SEQ ID NO: 351790 - DNA, 25 bp, Rattus norvegicus
gagtacttacgtagtcataggtcat

SEQ ID NO: 351791 - DNA, 25 bp, Rattus norvegicus
gagtacttacgtcatcactcacgtt

SEQ ID NO: 351792 - DNA, 25 bp, Rattus norvegicus
gagtacttacgtgatcactcacgtt

SEQ ID NO: 351793 - DNA, 25 bp, Rattus norvegicus
gagtacttacgttgtcataggtcat

SEQ ID NO: 351794 - DNA, 25 bp, Rattus norvegicus
gagtacttactacaagacctgcagt

SEQ ID NO: 351795 - DNA, 25 bp, Rattus norvegicus
gagtacttactagaagacctgcagt

SEQ ID NO: 351796 - DNA, 25 bp, Rattus norvegicus
gagtacttatttcaacgcccagctt

SEQ ID NO: 351797 - DNA, 25 bp, Rattus norvegicus
gagtacttatttgaacgcccagctt

SEQ ID NO: 351798 - DNA, 25 bp, Rattus norvegicus
gagtacttcatcaaatgatccccag

SEQ ID NO: 351799 - DNA, 25 bp, Rattus norvegicus
gagtacttcatcaagatcagccttt

SEQ ID NO: 351800 - DNA, 25 bp, Rattus norvegicus
gagtacttcatctaatgatccccag

SEQ ID NO: 351801 - DNA, 25 bp, Rattus norvegicus
gagtacttcatctagatcagccttt

SEQ ID NO: 351802 - DNA, 25 bp, Rattus norvegicus
gagtacttcatgcatatttattcct

SEQ ID NO: 351803 - DNA, 25 bp, Rattus norvegicus
gagtacttcatggatatttattcct

SEQ ID NO: 351804 - DNA, 25 bp, Rattus norvegicus
gagtacttcattattagctctcatg

SEQ ID NO: 351805 - DNA, 25 bp, Rattus norvegicus
gagtacttcatttttagctctcatg

SEQ ID NO: 351806 - DNA, 25 bp, Rattus norvegicus
gagtacttccgacaccttaatcaca

SEQ ID NO: 351807 - DNA, 25 bp, Rattus norvegicus
gagtacttccgagaccttaatcaca

SEQ ID NO: 351808 - DNA, 25 bp, Rattus norvegicus
gagtacttcctgctcctgcaaaaga

SEQ ID NO: 351809 - DNA, 25 bp, Rattus norvegicus
gagtacttcctggtcctgcaaaaga

SEQ ID NO: 351810 - DNA, 25 bp, Rattus norvegicus
gagtacttctccaaagtgttgcttt

SEQ ID NO: 351811 - DNA, 25 bp, Rattus norvegicus
gagtacttctcctaagtgttgcttt

SEQ ID NO: 351812 - DNA, 25 bp, Rattus norvegicus
gagtacttcttgattgtgaccttta

SEQ ID NO: 351813 - DNA, 25 bp, Rattus norvegicus
gagtacttcttgtttgtgaccttta

SEQ ID NO: 351814 - DNA, 25 bp, Rattus norvegicus
gagtacttgagcagctgttcctcca

SEQ ID NO: 351815 - DNA, 25 bp, Rattus norvegicus
gagtacttgagctgctgttcctcca

SEQ ID NO: 351816 - DNA, 25 bp, Rattus norvegicus
gagtacttgatcacattgaatgtgt

SEQ ID NO: 351817 - DNA, 25 bp, Rattus norvegicus
gagtacttgatctcattgaatgtgt

SEQ ID NO: 351818 - DNA, 25 bp, Rattus norvegicus
gagtacttgcaacctgttggaaaca

SEQ ID NO: 351819 - DNA, 25 bp, Rattus norvegicus
gagtacttgcaagctgttggaaaca

SEQ ID NO: 351820 - DNA, 25 bp, Rattus norvegicus
gagtacttgctgaagctcaccagac

SEQ ID NO: 351821 - DNA, 25 bp, Rattus norvegicus
gagtacttgctgtagctcaccagac

SEQ ID NO: 351822 - DNA, 25 bp, Rattus norvegicus
gagtacttgcttagattgatccaac

SEQ ID NO: 351823 - DNA, 25 bp, Rattus norvegicus
gagtacttgctttgattgatccaac

SEQ ID NO: 351824 - DNA, 25 bp, Rattus norvegicus
gagtacttgtcactcactagtattt

SEQ ID NO: 351825 - DNA, 25 bp, Rattus norvegicus
gagtacttgtcagtcactagtattt

SEQ ID NO: 351826 - DNA, 25 bp, Rattus norvegicus
gagtactttagaaccccagaggaag

SEQ ID NO: 351827 - DNA, 25 bp, Rattus norvegicus
gagtactttagatccccagaggaag

SEQ ID NO: 351828 - DNA, 25 bp, Rattus norvegicus
gagtactttgtacagtgtgtcagca

SEQ ID NO: 351829 - DNA, 25 bp, Rattus norvegicus
gagtactttgtagagtgtgtcagca

SEQ ID NO: 351830 - DNA, 25 bp, Rattus norvegicus
gagtagaaagcaaccgtgtgacatt

SEQ ID NO: 351831 - DNA, 25 bp, Rattus norvegicus
gagtagaaagcatccgtgtgacatt

SEQ ID NO: 351832 - DNA, 25 bp, Rattus norvegicus
gagtagaaccttaggcatgagcaat

SEQ ID NO: 351833 - DNA, 25 bp, Rattus norvegicus
gagtagaacctttggcatgagcaat

SEQ ID NO: 351834 - DNA, 25 bp, Rattus norvegicus
gagtagaactctctggatgtgttca

SEQ ID NO: 351835 - DNA, 25 bp, Rattus norvegicus
gagtagaactctgtggatgtgttca

SEQ ID NO: 351836 - DNA, 25 bp, Rattus norvegicus
gagtagaacttcctagctgtagatt

SEQ ID NO: 351837 - DNA, 25 bp, Rattus norvegicus
gagtagaacttcgtagctgtagatt

SEQ ID NO: 351838 - DNA, 25 bp, Rattus norvegicus
gagtagaagcccaggcccttgaggc

SEQ ID NO: 351839 - DNA, 25 bp, Rattus norvegicus
gagtagaagccctggcccttgaggc

SEQ ID NO: 351840 - DNA, 25 bp, Rattus norvegicus
gagtagaaggagctaccccttgtct

SEQ ID NO: 351841 - DNA, 25 bp, Rattus norvegicus
gagtagaaggaggtaccccttgtct

SEQ ID NO: 351842 - DNA, 25 bp, Rattus norvegicus
gagtagaatactatgagtcctgtaa

SEQ ID NO: 351843 - DNA, 25 bp, Rattus norvegicus
gagtagaatactttgagtcctgtaa

SEQ ID NO: 351844 - DNA, 25 bp, Rattus norvegicus
gagtagaatctaagccttccactag

SEQ ID NO: 351845 - DNA, 25 bp, Rattus norvegicus
gagtagaatctatgccttccactag

SEQ ID NO: 351846 - DNA, 25 bp, Rattus norvegicus
gagtagacagcactggacccctagc

SEQ ID NO: 351847 - DNA, 25 bp, Rattus norvegicus
gagtagacagcagtggacccctagc

SEQ ID NO: 351848 - DNA, 25 bp, Rattus norvegicus
gagtagacagcgcacagatgcccct

SEQ ID NO: 351849 - DNA, 25 bp, Rattus norvegicus
gagtagacagcggacagatgcccct

SEQ ID NO: 351850 - DNA, 25 bp, Rattus norvegicus
gagtagaccagacgctccatctaaa

SEQ ID NO: 351851 - DNA, 25 bp, Rattus norvegicus
gagtagaccagaggctccatctaaa

SEQ ID NO: 351852 - DNA, 25 bp, Rattus norvegicus
gagtagaccttgcactcctctgaac

SEQ ID NO: 351853 - DNA, 25 bp, Rattus norvegicus
gagtagaccttggactcctctgaac

SEQ ID NO: 351854 - DNA, 25 bp, Rattus norvegicus
gagtagacgctaaccgagtggcccg

SEQ ID NO: 351855 - DNA, 25 bp, Rattus norvegicus
gagtagacgctatccgagtggcccg

SEQ ID NO: 351856 - DNA, 25 bp, Rattus norvegicus
gagtagacgtctataccaacctggg

SEQ ID NO: 351857 - DNA, 25 bp, Rattus norvegicus
gagtagacgtctttaccaacctggg

SEQ ID NO: 351858 - DNA, 25 bp, Rattus norvegicus
gagtagactgtcacacacggtcagg

SEQ ID NO: 351859 - DNA, 25 bp, Rattus norvegicus
gagtagactgtctcacacggtcagg

SEQ ID NO: 351860 - DNA, 25 bp, Rattus norvegicus
gagtagactgtgagttgcgaataca

SEQ ID NO: 351861 - DNA, 25 bp, Rattus norvegicus
gagtagactgtgtgttgcgaataca

SEQ ID NO: 351862 - DNA, 25 bp, Rattus norvegicus
gagtagacttaccattttacctaga

SEQ ID NO: 351863 - DNA, 25 bp, Rattus norvegicus
gagtagacttacgattttacctaga

SEQ ID NO: 351864 - DNA, 25 bp, Rattus norvegicus
gagtagacttggcttttacgcccct

SEQ ID NO: 351865 - DNA, 25 bp, Rattus norvegicus
gagtagacttgggttttacgcccct

SEQ ID NO: 351866 - DNA, 25 bp, Rattus norvegicus
gagtagactttaatgtgctccattt

SEQ ID NO: 351867 - DNA, 25 bp, Rattus norvegicus
gagtagactttattgtgctccattt

SEQ ID NO: 351868 - DNA, 25 bp, Rattus norvegicus
gagtagagactgagccacacgaatt

SEQ ID NO: 351869 - DNA, 25 bp, Rattus norvegicus
gagtagagactgtgccacacgaatt

SEQ ID NO: 351870 - DNA, 25 bp, Rattus norvegicus
gagtagagatttactgccaagcctg

SEQ ID NO: 351871 - DNA, 25 bp, Rattus norvegicus
gagtagagattttctgccaagcctg

SEQ ID NO: 351872 - DNA, 25 bp, Rattus norvegicus
gagtagagggacaggaccatccaaa

SEQ ID NO: 351873 - DNA, 25 bp, Rattus norvegicus
gagtagagggactggaccatccaaa

SEQ ID NO: 351874 - DNA, 25 bp, Rattus norvegicus
gagtagagtcttcgttctttccttc

SEQ ID NO: 351875 - DNA, 25 bp, Rattus norvegicus
gagtagagtcttggttctttccttc

SEQ ID NO: 351876 - DNA, 25 bp, Rattus norvegicus
gagtagataagcagtgtcttgcaca

SEQ ID NO: 351877 - DNA, 25 bp, Rattus norvegicus
gagtagataagctgtgtcttgcaca

SEQ ID NO: 351878 - DNA, 25 bp, Rattus norvegicus
gagtagatacccaccatttcaacaa

SEQ ID NO: 351879 - DNA, 25 bp, Rattus norvegicus
gagtagataccctccatttcaacaa

SEQ ID NO: 351880 - DNA, 25 bp, Rattus norvegicus
gagtagatactgagctcctggccag

SEQ ID NO: 351881 - DNA, 25 bp, Rattus norvegicus
gagtagatactgtgctcctggccag

SEQ ID NO: 351882 - DNA, 25 bp, Rattus norvegicus
gagtagatcagcatttgcttaaaat

SEQ ID NO: 351883 - DNA, 25 bp, Rattus norvegicus
gagtagatcagcttttgcttaaaat

SEQ ID NO: 351884 - DNA, 25 bp, Rattus norvegicus
gagtagatctaaatctccagcatct

SEQ ID NO: 351885 - DNA, 25 bp, Rattus norvegicus
gagtagatctaattctccagcatct

SEQ ID NO: 351886 - DNA, 25 bp, Rattus norvegicus
gagtagatcttcattggctgtttaa

SEQ ID NO: 351887 - DNA, 25 bp, Rattus norvegicus
gagtagatcttctttggctgtttaa

SEQ ID NO: 351888 - DNA, 25 bp, Rattus norvegicus
gagtagatgtctctcttgttgcttt

SEQ ID NO: 351889 - DNA, 25 bp, Rattus norvegicus
gagtagatgtctgtcttgttgcttt

SEQ ID NO: 351890 - DNA, 25 bp, Rattus norvegicus
gagtagcaagcccacgagcaatcgt

SEQ ID NO: 351891 - DNA, 25 bp, Rattus norvegicus
gagtagcaagccgacgagcaatcgt

SEQ ID NO: 351892 - DNA, 25 bp, Rattus norvegicus
gagtagcaccatcggcgtgacgtta

SEQ ID NO: 351893 - DNA, 25 bp, Rattus norvegicus
gagtagcaccatgggcgtgacgtta

SEQ ID NO: 351894 - DNA, 25 bp, Rattus norvegicus
gagtagcacctgagacttggagttg

SEQ ID NO: 351895 - DNA, 25 bp, Rattus norvegicus
gagtagcacctgtgacttggagttg

SEQ ID NO: 351896 - DNA, 25 bp, Rattus norvegicus
gagtagcagggaatccacaggccca

SEQ ID NO: 351897 - DNA, 25 bp, Rattus norvegicus
gagtagcagggattccacaggccca

SEQ ID NO: 351898 - DNA, 25 bp, Rattus norvegicus
gagtagcagggcagaacccatcaga

SEQ ID NO: 351899 - DNA, 25 bp, Rattus norvegicus
gagtagcagggctgaacccatcaga

SEQ ID NO: 351900 - DNA, 25 bp, Rattus norvegicus
gagtagcatctaccttgccaatggc

SEQ ID NO: 351901 - DNA, 25 bp, Rattus norvegicus
gagtagcatctagcttgccaatggc

SEQ ID NO: 351902 - DNA, 25 bp, Rattus norvegicus
gagtagcatgttcagagctcagccc

SEQ ID NO: 351903 - DNA, 25 bp, Rattus norvegicus
gagtagcatgttgagagctcagccc

SEQ ID NO: 351904 - DNA, 25 bp, Rattus norvegicus
gagtagcatttcagagccgggctct

SEQ ID NO: 351905 - DNA, 25 bp, Rattus norvegicus
gagtagcatttctgagccgggctct

SEQ ID NO: 351906 - DNA, 25 bp, Rattus norvegicus
gagtagccaagcctctgtacatata

SEQ ID NO: 351907 - DNA, 25 bp, Rattus norvegicus
gagtagccaagcgtctgtacatata

SEQ ID NO: 351908 - DNA, 25 bp, Rattus norvegicus
gagtagccaatcacaggacgacctg

SEQ ID NO: 351909 - DNA, 25 bp, Rattus norvegicus
gagtagccaatctcaggacgacctg

SEQ ID NO: 351910 - DNA, 25 bp, Rattus norvegicus
gagtagccactgcacctgggctgaa

SEQ ID NO: 351911 - DNA, 25 bp, Rattus norvegicus
gagtagccactggacctgggctgaa

SEQ ID NO: 351912 - DNA, 25 bp, Rattus norvegicus
gagtagccagcaagcatgggccctg

SEQ ID NO: 351913 - DNA, 25 bp, Rattus norvegicus
gagtagccagcatgcatgggccctg

SEQ ID NO: 351914 - DNA, 25 bp, Rattus norvegicus
gagtagccagtacgcttggcctggg

SEQ ID NO: 351915 - DNA, 25 bp, Rattus norvegicus
gagtagccagtaggcttggcctggg

SEQ ID NO: 351916 - DNA, 25 bp, Rattus norvegicus
gagtagccagtgaggttttccattc

SEQ ID NO: 351917 - DNA, 25 bp, Rattus norvegicus
gagtagccagtgtggttttccattc

SEQ ID NO: 351918 - DNA, 25 bp, Rattus norvegicus
gagtagccatatcaaccaatcagtt

SEQ ID NO: 351919 - DNA, 25 bp, Rattus norvegicus
gagtagccatatgaaccaatcagtt

SEQ ID NO: 351920 - DNA, 25 bp, Rattus norvegicus
gagtagcccacaaaggagtcccacg

SEQ ID NO: 351921 - DNA, 25 bp, Rattus norvegicus
gagtagcccacataggagtcccacg

SEQ ID NO: 351922 - DNA, 25 bp, Rattus norvegicus
gagtagcccttccttcagactgtta

SEQ ID NO: 351923 - DNA, 25 bp, Rattus norvegicus
gagtagcccttcgttcagactgtta

SEQ ID NO: 351924 - DNA, 25 bp, Rattus norvegicus
gagtagccgttcacagcagtcgctg

SEQ ID NO: 351925 - DNA, 25 bp, Rattus norvegicus
gagtagccgttctcagcagtcgctg

SEQ ID NO: 351926 - DNA, 25 bp, Rattus norvegicus
gagtagccttttctaactgttggac

SEQ ID NO: 351927 - DNA, 25 bp, Rattus norvegicus
gagtagccttttgtaactgttggac

SEQ ID NO: 351928 - DNA, 25 bp, Rattus norvegicus
gagtagcgatatagtcagccttcta

SEQ ID NO: 351929 - DNA, 25 bp, Rattus norvegicus
gagtagcgatattgtcagccttcta

SEQ ID NO: 351930 - DNA, 25 bp, Rattus norvegicus
gagtagctcaagactcctgtgaggc

SEQ ID NO: 351931 - DNA, 25 bp, Rattus norvegicus
gagtagctcaagtctcctgtgaggc

SEQ ID NO: 351932 - DNA, 25 bp, Rattus norvegicus
gagtagctctcgattatgttgcttc

SEQ ID NO: 351933 - DNA, 25 bp, Rattus norvegicus
gagtagctctcgtttatgttgcttc

SEQ ID NO: 351934 - DNA, 25 bp, Rattus norvegicus
gagtagctgagcctgtagcaatgac

SEQ ID NO: 351935 - DNA, 25 bp, Rattus norvegicus
gagtagctgagcgtgtagcaatgac

SEQ ID NO: 351936 - DNA, 25 bp, Rattus norvegicus
gagtagctgctccatcaaagaacca

SEQ ID NO: 351937 - DNA, 25 bp, Rattus norvegicus
gagtagctgctcgatcaaagaacca

SEQ ID NO: 351938 - DNA, 25 bp, Rattus norvegicus
gagtagctgcttcttctcatatgaa

SEQ ID NO: 351939 - DNA, 25 bp, Rattus norvegicus
gagtagctgcttgttctcatatgaa

SEQ ID NO: 351940 - DNA, 25 bp, Rattus norvegicus
gagtagctgtggaaacctcacccat

SEQ ID NO: 351941 - DNA, 25 bp, Rattus norvegicus
gagtagctgtggtaacctcacccat

SEQ ID NO: 351942 - DNA, 25 bp, Rattus norvegicus
gagtagcttcatcgtgtgtggctca

SEQ ID NO: 351943 - DNA, 25 bp, Rattus norvegicus
gagtagcttcatggtgtgtggctca

SEQ ID NO: 351944 - DNA, 25 bp, Rattus norvegicus
gagtagcttcctatttgacatgtac

SEQ ID NO: 351945 - DNA, 25 bp, Rattus norvegicus
gagtagcttcctttttgacatgtac

SEQ ID NO: 351946 - DNA, 25 bp, Rattus norvegicus
gagtagcttcttccctgctgactgt

SEQ ID NO: 351947 - DNA, 25 bp, Rattus norvegicus
gagtagcttcttgcctgctgactgt

SEQ ID NO: 351948 - DNA, 25 bp, Rattus norvegicus
gagtagcttttcagagaccctgaag

SEQ ID NO: 351949 - DNA, 25 bp, Rattus norvegicus
gagtagcttttctgagaccctgaag

SEQ ID NO: 351950 - DNA, 25 bp, Rattus norvegicus
gagtagcttttgaagattatcaggg

SEQ ID NO: 351951 - DNA, 25 bp, Rattus norvegicus
gagtagcttttgagctctcacataa

SEQ ID NO: 351952 - DNA, 25 bp, Rattus norvegicus
gagtagcttttgtagattatcaggg

SEQ ID NO: 351953 - DNA, 25 bp, Rattus norvegicus
gagtagcttttgtgctctcacataa

SEQ ID NO: 351954 - DNA, 25 bp, Rattus norvegicus
gagtaggaatttaaccagtcataat

SEQ ID NO: 351955 - DNA, 25 bp, Rattus norvegicus
gagtaggaattttaccagtcataat

SEQ ID NO: 351956 - DNA, 25 bp, Rattus norvegicus
gagtaggactttcttgcactcgttc

SEQ ID NO: 351957 - DNA, 25 bp, Rattus norvegicus
gagtaggactttgttgcactcgttc

SEQ ID NO: 351958 - DNA, 25 bp, Rattus norvegicus
gagtaggagacaaatcgccacccca

SEQ ID NO: 351959 - DNA, 25 bp, Rattus norvegicus
gagtaggagacatatcgccacccca

SEQ ID NO: 351960 - DNA, 25 bp, Rattus norvegicus
gagtaggatgtcctcacctagtgtt

SEQ ID NO: 351961 - DNA, 25 bp, Rattus norvegicus
gagtaggatgtcgtcacctagtgtt

SEQ ID NO: 351962 - DNA, 25 bp, Rattus norvegicus
gagtaggattctaatcaatcgtcgc

SEQ ID NO: 351963 - DNA, 25 bp, Rattus norvegicus
gagtaggattcttatcaatcgtcgc

SEQ ID NO: 351964 - DNA, 25 bp, Rattus norvegicus
gagtaggcaactctttaccaatcca

SEQ ID NO: 351965 - DNA, 25 bp, Rattus norvegicus
gagtaggcaactgtttaccaatcca

SEQ ID NO: 351966 - DNA, 25 bp, Rattus norvegicus
gagtaggcagctaatgtctttctga

SEQ ID NO: 351967 - DNA, 25 bp, Rattus norvegicus
gagtaggcagcttatgtctttctga

SEQ ID NO: 351968 - DNA, 25 bp, Rattus norvegicus
gagtaggcccagaatgtacagaata

SEQ ID NO: 351969 - DNA, 25 bp, Rattus norvegicus
gagtaggcccagtatgtacagaata

SEQ ID NO: 351970 - DNA, 25 bp, Rattus norvegicus
gagtaggcgccacctcttatgtacg

SEQ ID NO: 351971 - DNA, 25 bp, Rattus norvegicus
gagtaggcgccagctcttatgtacg

SEQ ID NO: 351972 - DNA, 25 bp, Rattus norvegicus
gagtaggcggtgcagcgacaggtat

SEQ ID NO: 351973 - DNA, 25 bp, Rattus norvegicus
gagtaggcggtggagcgacaggtat

SEQ ID NO: 351974 - DNA, 25 bp, Rattus norvegicus
gagtaggcgtacattgtctgtcacc

SEQ ID NO: 351975 - DNA, 25 bp, Rattus norvegicus
gagtaggcgtactttgtctgtcacc

SEQ ID NO: 351976 - DNA, 25 bp, Rattus norvegicus
gagtagggacttagagcacctccac

SEQ ID NO: 351977 - DNA, 25 bp, Rattus norvegicus
gagtagggacttctgctacccaaga

SEQ ID NO: 351978 - DNA, 25 bp, Rattus norvegicus
gagtagggacttgtgctacccaaga

SEQ ID NO: 351979 - DNA, 25 bp, Rattus norvegicus
gagtagggactttgagcacctccac

SEQ ID NO: 351980 - DNA, 25 bp, Rattus norvegicus
gagtagggcttcctcaagtatagga

SEQ ID NO: 351981 - DNA, 25 bp, Rattus norvegicus
gagtagggcttcgtcaagtatagga

SEQ ID NO: 351982 - DNA, 25 bp, Rattus norvegicus
gagtagggttggatacctctgcttc

SEQ ID NO: 351983 - DNA, 25 bp, Rattus norvegicus
gagtagggttggttacctctgcttc

SEQ ID NO: 351984 - DNA, 25 bp, Rattus norvegicus
gagtaggttcatcgcttcttgtcac

SEQ ID NO: 351985 - DNA, 25 bp, Rattus norvegicus
gagtaggttcatggcttcttgtcac

SEQ ID NO: 351986 - DNA, 25 bp, Rattus norvegicus
gagtagtaactcagaccaactgtcc

SEQ ID NO: 351987 - DNA, 25 bp, Rattus norvegicus
gagtagtaactctgaccaactgtcc

SEQ ID NO: 351988 - DNA, 25 bp, Rattus norvegicus
gagtagtaagtcctgctgtccgccg

SEQ ID NO: 351989 - DNA, 25 bp, Rattus norvegicus
gagtagtaagtcgtgctgtccgccg

SEQ ID NO: 351990 - DNA, 25 bp, Rattus norvegicus
gagtagtacatacctcactgccagt

SEQ ID NO: 351991 - DNA, 25 bp, Rattus norvegicus
gagtagtacatagctcactgccagt

SEQ ID NO: 351992 - DNA, 25 bp, Rattus norvegicus
gagtagtagatgacctttcctgcca

SEQ ID NO: 351993 - DNA, 25 bp, Rattus norvegicus
gagtagtagatgtcctttcctgcca

SEQ ID NO: 351994 - DNA, 25 bp, Rattus norvegicus
gagtagtattacagcctgcatactt

SEQ ID NO: 351995 - DNA, 25 bp, Rattus norvegicus
gagtagtattactgcctgcatactt

SEQ ID NO: 351996 - DNA, 25 bp, Rattus norvegicus
gagtagtatttcagctcggcgtcgc

SEQ ID NO: 351997 - DNA, 25 bp, Rattus norvegicus
gagtagtatttctgctcggcgtcgc

SEQ ID NO: 351998 - DNA, 25 bp, Rattus norvegicus
gagtagtcagcaactgctgtgccat

SEQ ID NO: 351999 - DNA, 25 bp, Rattus norvegicus
gagtagtcagcatctgctgtgccat

SEQ ID NO: 352000 - DNA, 25 bp, Rattus norvegicus
gagtagtcatagcagtcgtcagcca

SEQ ID NO: 352001 - DNA, 25 bp, Rattus norvegicus
gagtagtcataggagtcgtcagcca

SEQ ID NO: 352002 - DNA, 25 bp, Rattus norvegicus
gagtagtcatctcctatggtcacct

SEQ ID NO: 352003 - DNA, 25 bp, Rattus norvegicus
gagtagtcatctgctatggtcacct

SEQ ID NO: 352004 - DNA, 25 bp, Rattus norvegicus
gagtagtctggaatcttttgcttag

SEQ ID NO: 352005 - DNA, 25 bp, Rattus norvegicus
gagtagtctggattcttttgcttag

SEQ ID NO: 352006 - DNA, 25 bp, Rattus norvegicus
gagtagtcttacataggatcccact

SEQ ID NO: 352007 - DNA, 25 bp, Rattus norvegicus
gagtagtcttacttaggatcccact

SEQ ID NO: 352008 - DNA, 25 bp, Rattus norvegicus
gagtagtgaaacagtgcatcccaaa

SEQ ID NO: 352009 - DNA, 25 bp, Rattus norvegicus
gagtagtgaaactgtgcatcccaaa

SEQ ID NO: 352010 - DNA, 25 bp, Rattus norvegicus
gagtagtgagtgacagccctgcctg

SEQ ID NO: 352011 - DNA, 25 bp, Rattus norvegicus
gagtagtgagtgtcagccctgcctg

SEQ ID NO: 352012 - DNA, 25 bp, Rattus norvegicus
gagtagtggacgaacagccctcgca

SEQ ID NO: 352013 - DNA, 25 bp, Rattus norvegicus
gagtagtggacgtacagccctcgca

SEQ ID NO: 352014 - DNA, 25 bp, Rattus norvegicus
gagtagtgtttccagatgtacctcg

SEQ ID NO: 352015 - DNA, 25 bp, Rattus norvegicus
gagtagtgtttcgagatgtacctcg

SEQ ID NO: 352016 - DNA, 25 bp, Rattus norvegicus
gagtagttaagtcctctgtataaca

SEQ ID NO: 352017 - DNA, 25 bp, Rattus norvegicus
gagtagttaagtgctctgtataaca

SEQ ID NO: 352018 - DNA, 25 bp, Rattus norvegicus
gagtagttatgaatcgcagacgcaa

SEQ ID NO: 352019 - DNA, 25 bp, Rattus norvegicus
gagtagttatgattcgcagacgcaa

SEQ ID NO: 352020 - DNA, 25 bp, Rattus norvegicus
gagtagttgtttctgcctgtggtca

SEQ ID NO: 352021 - DNA, 25 bp, Rattus norvegicus
gagtagttgtttgtgcctgtggtca

SEQ ID NO: 352022 - DNA, 25 bp, Rattus norvegicus
gagtagtttaccaaggctgtttagt

SEQ ID NO: 352023 - DNA, 25 bp, Rattus norvegicus
gagtagtttacctaggctgtttagt

SEQ ID NO: 352024 - DNA, 25 bp, Rattus norvegicus
gagtagttttacctttgagccccag

SEQ ID NO: 352025 - DNA, 25 bp, Rattus norvegicus
gagtagttttacgtttgagccccag

SEQ ID NO: 352026 - DNA, 25 bp, Rattus norvegicus
gagtataaacggaccgctctccata

SEQ ID NO: 352027 - DNA, 25 bp, Rattus norvegicus
gagtataaacggtccgctctccata

SEQ ID NO: 352028 - DNA, 25 bp, Rattus norvegicus
gagtataaagttctcacccgtcaat

SEQ ID NO: 352029 - DNA, 25 bp, Rattus norvegicus
gagtataaagttgtcacccgtcaat

SEQ ID NO: 352030 - DNA, 25 bp, Rattus norvegicus
gagtataacctgagtcgttacccac

SEQ ID NO: 352031 - DNA, 25 bp, Rattus norvegicus
gagtataacctgtgtcgttacccac

SEQ ID NO: 352032 - DNA, 25 bp, Rattus norvegicus
gagtataaggcaacgttctccgtag

SEQ ID NO: 352033 - DNA, 25 bp, Rattus norvegicus
gagtataaggcatcgttctccgtag

SEQ ID NO: 352034 - DNA, 25 bp, Rattus norvegicus
gagtataaggtgcaaccccaaccct

SEQ ID NO: 352035 - DNA, 25 bp, Rattus norvegicus
gagtataaggtggaaccccaaccct

SEQ ID NO: 352036 - DNA, 25 bp, Rattus norvegicus
gagtataatcctatctgtgcttcac

SEQ ID NO: 352037 - DNA, 25 bp, Rattus norvegicus
gagtataatcctttctgtgcttcac

SEQ ID NO: 352038 - DNA, 25 bp, Rattus norvegicus
gagtatacacccacattactggact

SEQ ID NO: 352039 - DNA, 25 bp, Rattus norvegicus
gagtatacaccctcattactggact

SEQ ID NO: 352040 - DNA, 25 bp, Rattus norvegicus
gagtatacattcagcatcatggatg

SEQ ID NO: 352041 - DNA, 25 bp, Rattus norvegicus
gagtatacattctgcatcatggatg

SEQ ID NO: 352042 - DNA, 25 bp, Rattus norvegicus
gagtatacatttaccacaagctttt

SEQ ID NO: 352043 - DNA, 25 bp, Rattus norvegicus
gagtatacattttccacaagctttt

SEQ ID NO: 352044 - DNA, 25 bp, Rattus norvegicus
gagtatactcaaccgaagcagaggt

SEQ ID NO: 352045 - DNA, 25 bp, Rattus norvegicus
gagtatactcaagcgaagcagaggt

SEQ ID NO: 352046 - DNA, 25 bp, Rattus norvegicus
gagtatactcgcagttggtttacaa

SEQ ID NO: 352047 - DNA, 25 bp, Rattus norvegicus
gagtatactcgctgttggtttacaa

SEQ ID NO: 352048 - DNA, 25 bp, Rattus norvegicus
gagtatagacttacaccacttcaca

SEQ ID NO: 352049 - DNA, 25 bp, Rattus norvegicus
gagtatagactttcaccacttcaca

SEQ ID NO: 352050 - DNA, 25 bp, Rattus norvegicus
gagtatagcacaagattcccctccg

SEQ ID NO: 352051 - DNA, 25 bp, Rattus norvegicus
gagtatagcacatgattcccctccg

SEQ ID NO: 352052 - DNA, 25 bp, Rattus norvegicus
gagtatagcagtacactatccaaag

SEQ ID NO: 352053 - DNA, 25 bp, Rattus norvegicus
gagtatagcagttcactatccaaag

SEQ ID NO: 352054 - DNA, 25 bp, Rattus norvegicus
gagtataggtctcaaccggccacat

SEQ ID NO: 352055 - DNA, 25 bp, Rattus norvegicus
gagtataggtctgaaccggccacat

SEQ ID NO: 352056 - DNA, 25 bp, Rattus norvegicus
gagtatagtcagacacgccagcaag

SEQ ID NO: 352057 - DNA, 25 bp, Rattus norvegicus
gagtatagtcagtcacgccagcaag

SEQ ID NO: 352058 - DNA, 25 bp, Rattus norvegicus
gagtatatacatcccactccaggag

SEQ ID NO: 352059 - DNA, 25 bp, Rattus norvegicus
gagtatatacatgccactccaggag

SEQ ID NO: 352060 - DNA, 25 bp, Rattus norvegicus
gagtatatagatagcccaggtctgg

SEQ ID NO: 352061 - DNA, 25 bp, Rattus norvegicus
gagtatatagattgcccaggtctgg

SEQ ID NO: 352062 - DNA, 25 bp, Rattus norvegicus
gagtatatcactaatgtgctcataa

SEQ ID NO: 352063 - DNA, 25 bp, Rattus norvegicus
gagtatatcacttatgtgctcataa

SEQ ID NO: 352064 - DNA, 25 bp, Rattus norvegicus
gagtatatccaacgagcctagagtt

SEQ ID NO: 352065 - DNA, 25 bp, Rattus norvegicus
gagtatatccaaggagcctagagtt

SEQ ID NO: 352066 - DNA, 25 bp, Rattus norvegicus
gagtatatggttctctcttgctctc

SEQ ID NO: 352067 - DNA, 25 bp, Rattus norvegicus
gagtatatggttgtctcttgctctc

SEQ ID NO: 352068 - DNA, 25 bp, Rattus norvegicus
gagtatattcgcaacaagcctcagc

SEQ ID NO: 352069 - DNA, 25 bp, Rattus norvegicus
gagtatattcgctacaagcctcagc

SEQ ID NO: 352070 - DNA, 25 bp, Rattus norvegicus
gagtatcagcggattttatcctttt

SEQ ID NO: 352071 - DNA, 25 bp, Rattus norvegicus
gagtatcagcggtttttatcctttt

SEQ ID NO: 352072 - DNA, 25 bp, Rattus norvegicus
gagtatcagcttagtttagtgacta

SEQ ID NO: 352073 - DNA, 25 bp, Rattus norvegicus
gagtatcagctttgtttagtgacta

SEQ ID NO: 352074 - DNA, 25 bp, Rattus norvegicus
gagtatcaggctaggcagccatcac

SEQ ID NO: 352075 - DNA, 25 bp, Rattus norvegicus
gagtatcaggcttggcagccatcac

SEQ ID NO: 352076 - DNA, 25 bp, Rattus norvegicus
gagtatccaaaacctgacggacaga

SEQ ID NO: 352077 - DNA, 25 bp, Rattus norvegicus
gagtatccaaaagctgacggacaga

SEQ ID NO: 352078 - DNA, 25 bp, Rattus norvegicus
gagtatcccagaatcatagtgcagt

SEQ ID NO: 352079 - DNA, 25 bp, Rattus norvegicus
gagtatcccagattcatagtgcagt

SEQ ID NO: 352080 - DNA, 25 bp, Rattus norvegicus
gagtatcccatgatttcagtgcata

SEQ ID NO: 352081 - DNA, 25 bp, Rattus norvegicus
gagtatcccatgttttcagtgcata

SEQ ID NO: 352082 - DNA, 25 bp, Rattus norvegicus
gagtatcccgtcaatatctgaatgc

SEQ ID NO: 352083 - DNA, 25 bp, Rattus norvegicus
gagtatcccgtctatatctgaatgc

SEQ ID NO: 352084 - DNA, 25 bp, Rattus norvegicus
gagtatcccgtgatcttaaacactg

SEQ ID NO: 352085 - DNA, 25 bp, Rattus norvegicus
gagtatcccgtgttcttaaacactg

SEQ ID NO: 352086 - DNA, 25 bp, Rattus norvegicus
gagtatccctctcagtacataggta

SEQ ID NO: 352087 - DNA, 25 bp, Rattus norvegicus
gagtatccctctgagtacataggta

SEQ ID NO: 352088 - DNA, 25 bp, Rattus norvegicus
gagtatcctgagatctgtagctaga

SEQ ID NO: 352089 - DNA, 25 bp, Rattus norvegicus
gagtatcctgagttctgtagctaga

SEQ ID NO: 352090 - DNA, 25 bp, Rattus norvegicus
gagtatccttgaatggccttgaagt

SEQ ID NO: 352091 - DNA, 25 bp, Rattus norvegicus
gagtatccttgattggccttgaagt

SEQ ID NO: 352092 - DNA, 25 bp, Rattus norvegicus
gagtatcggcctcaaactggttctt

SEQ ID NO: 352093 - DNA, 25 bp, Rattus norvegicus
gagtatcggcctgaaactggttctt

SEQ ID NO: 352094 - DNA, 25 bp, Rattus norvegicus
gagtatcggtgcatcttgcctaaca

SEQ ID NO: 352095 - DNA, 25 bp, Rattus norvegicus
gagtatcggtgcttcttgcctaaca

SEQ ID NO: 352096 - DNA, 25 bp, Rattus norvegicus
gagtatcgtgtgagcttcatttctt

SEQ ID NO: 352097 - DNA, 25 bp, Rattus norvegicus
gagtatcgtgtgtgcttcatttctt

SEQ ID NO: 352098 - DNA, 25 bp, Rattus norvegicus
gagtatcgttggctacaactcattt

SEQ ID NO: 352099 - DNA, 25 bp, Rattus norvegicus
gagtatcgttgggtacaactcattt

SEQ ID NO: 352100 - DNA, 25 bp, Rattus norvegicus
gagtatctacttatccaattctgca

SEQ ID NO: 352101 - DNA, 25 bp, Rattus norvegicus
gagtatctacttttccaattctgca

SEQ ID NO: 352102 - DNA, 25 bp, Rattus norvegicus
gagtatctagataccaccacgtgag

SEQ ID NO: 352103 - DNA, 25 bp, Rattus norvegicus
gagtatctagattccaccacgtgag

SEQ ID NO: 352104 - DNA, 25 bp, Rattus norvegicus
gagtatctctcaagttaccagggta

SEQ ID NO: 352105 - DNA, 25 bp, Rattus norvegicus
gagtatctctcatgttaccagggta

SEQ ID NO: 352106 - DNA, 25 bp, Rattus norvegicus
gagtatctctgtctgaaggccatga

SEQ ID NO: 352107 - DNA, 25 bp, Rattus norvegicus
gagtatctctgtgtgaaggccatga

SEQ ID NO: 352108 - DNA, 25 bp, Rattus norvegicus
gagtatctgactacgctcagtgatg

SEQ ID NO: 352109 - DNA, 25 bp, Rattus norvegicus
gagtatctgacttcgctcagtgatg

SEQ ID NO: 352110 - DNA, 25 bp, Rattus norvegicus
gagtatctgagtaatttgcttccca

SEQ ID NO: 352111 - DNA, 25 bp, Rattus norvegicus
gagtatctgagtctagatccctagc

SEQ ID NO: 352112 - DNA, 25 bp, Rattus norvegicus
gagtatctgagtgtagatccctagc

SEQ ID NO: 352113 - DNA, 25 bp, Rattus norvegicus
gagtatctgagttatttgcttccca

SEQ ID NO: 352114 - DNA, 25 bp, Rattus norvegicus
gagtatctgcaacgagggagctaca

SEQ ID NO: 352115 - DNA, 25 bp, Rattus norvegicus
gagtatctgcaaggagggagctaca

SEQ ID NO: 352116 - DNA, 25 bp, Rattus norvegicus
gagtatctggacattaaacgccggg

SEQ ID NO: 352117 - DNA, 25 bp, Rattus norvegicus
gagtatctggactttaaacgccggg

SEQ ID NO: 352118 - DNA, 25 bp, Rattus norvegicus
gagtatctgggaatctccttcaagc

SEQ ID NO: 352119 - DNA, 25 bp, Rattus norvegicus
gagtatctgggattctccttcaagc

SEQ ID NO: 352120 - DNA, 25 bp, Rattus norvegicus
gagtatctggtcatctgagtagcac

SEQ ID NO: 352121 - DNA, 25 bp, Rattus norvegicus
gagtatctggtcttctgagtagcac

SEQ ID NO: 352122 - DNA, 25 bp, Rattus norvegicus
gagtatctgtctcctgtaggttgta

SEQ ID NO: 352123 - DNA, 25 bp, Rattus norvegicus
gagtatctgtctgctgtaggttgta

SEQ ID NO: 352124 - DNA, 25 bp, Rattus norvegicus
gagtatctgtgccttctctaagaag

SEQ ID NO: 352125 - DNA, 25 bp, Rattus norvegicus
gagtatctgtgcgttctctaagaag

SEQ ID NO: 352126 - DNA, 25 bp, Rattus norvegicus
gagtatctgttcactactctgtgga

SEQ ID NO: 352127 - DNA, 25 bp, Rattus norvegicus
gagtatctgttctctactctgtgga

SEQ ID NO: 352128 - DNA, 25 bp, Rattus norvegicus
gagtatctgtttatcctcaggcaca

SEQ ID NO: 352129 - DNA, 25 bp, Rattus norvegicus
gagtatctgtttttcctcaggcaca

SEQ ID NO: 352130 - DNA, 25 bp, Rattus norvegicus
gagtatcttacaccttgccttttta

SEQ ID NO: 352131 - DNA, 25 bp, Rattus norvegicus
gagtatcttacagcttgccttttta

SEQ ID NO: 352132 - DNA, 25 bp, Rattus norvegicus
gagtatcttactacataatgtcatt

SEQ ID NO: 352133 - DNA, 25 bp, Rattus norvegicus
gagtatcttacttcataatgtcatt

SEQ ID NO: 352134 - DNA, 25 bp, Rattus norvegicus
gagtatcttccacagctctttgtac

SEQ ID NO: 352135 - DNA, 25 bp, Rattus norvegicus
gagtatcttccagagctctttgtac

SEQ ID NO: 352136 - DNA, 25 bp, Rattus norvegicus
gagtatcttctgaatgtatcccaca

SEQ ID NO: 352137 - DNA, 25 bp, Rattus norvegicus
gagtatcttctgtatgtatcccaca

SEQ ID NO: 352138 - DNA, 25 bp, Rattus norvegicus
gagtatgaaataccccttggataga

SEQ ID NO: 352139 - DNA, 25 bp, Rattus norvegicus
gagtatgaaatagcccttggataga

SEQ ID NO: 352140 - DNA, 25 bp, Rattus norvegicus
gagtatgaagctatggctgccattt

SEQ ID NO: 352141 - DNA, 25 bp, Rattus norvegicus
gagtatgaagctttggctgccattt

SEQ ID NO: 352142 - DNA, 25 bp, Rattus norvegicus
gagtatgacagacgtcttccctgtt

SEQ ID NO: 352143 - DNA, 25 bp, Rattus norvegicus
gagtatgacagaggtcttccctgtt

SEQ ID NO: 352144 - DNA, 25 bp, Rattus norvegicus
gagtatgaccttagcccattttcta

SEQ ID NO: 352145 - DNA, 25 bp, Rattus norvegicus
gagtatgacctttgcccattttcta

SEQ ID NO: 352146 - DNA, 25 bp, Rattus norvegicus
gagtatgacgaactgcccatgcctg

SEQ ID NO: 352147 - DNA, 25 bp, Rattus norvegicus
gagtatgacgaagtgcccatgcctg

SEQ ID NO: 352148 - DNA, 25 bp, Rattus norvegicus
gagtatgacgatcgtaccccagcta

SEQ ID NO: 352149 - DNA, 25 bp, Rattus norvegicus
gagtatgacgatggtaccccagcta

SEQ ID NO: 352150 - DNA, 25 bp, Rattus norvegicus
gagtatgactatcaaaccgtccgca

SEQ ID NO: 352151 - DNA, 25 bp, Rattus norvegicus
gagtatgactatgaaaccgtccgca

SEQ ID NO: 352152 - DNA, 25 bp, Rattus norvegicus
gagtatgatgaacacagcccaggag

SEQ ID NO: 352153 - DNA, 25 bp, Rattus norvegicus
gagtatgatgaagacagcccaggag

SEQ ID NO: 352154 - DNA, 25 bp, Rattus norvegicus
gagtatgatgtgatctccatgccac

SEQ ID NO: 352155 - DNA, 25 bp, Rattus norvegicus
gagtatgatgtgttctccatgccac

SEQ ID NO: 352156 - DNA, 25 bp, Rattus norvegicus
gagtatgcaagaacggttgctcctt

SEQ ID NO: 352157 - DNA, 25 bp, Rattus norvegicus
gagtatgcaagatcggttgctcctt

SEQ ID NO: 352158 - DNA, 25 bp, Rattus norvegicus
gagtatgcagttcctcactacagct

SEQ ID NO: 352159 - DNA, 25 bp, Rattus norvegicus
gagtatgcagttgctcactacagct

SEQ ID NO: 352160 - DNA, 25 bp, Rattus norvegicus
gagtatgcatggattttccgtgttg

SEQ ID NO: 352161 - DNA, 25 bp, Rattus norvegicus
gagtatgcatggtttttccgtgttg

SEQ ID NO: 352162 - DNA, 25 bp, Rattus norvegicus
gagtatgcatttccccacttcaatg

SEQ ID NO: 352163 - DNA, 25 bp, Rattus norvegicus
gagtatgcatttgcccacttcaatg

SEQ ID NO: 352164 - DNA, 25 bp, Rattus norvegicus
gagtatgccagtatcttattgttaa

SEQ ID NO: 352165 - DNA, 25 bp, Rattus norvegicus
gagtatgccagtattgatgccattg

SEQ ID NO: 352166 - DNA, 25 bp, Rattus norvegicus
gagtatgccagtttcttattgttaa

SEQ ID NO: 352167 - DNA, 25 bp, Rattus norvegicus
gagtatgccagttttgatgccattg

SEQ ID NO: 352168 - DNA, 25 bp, Rattus norvegicus
gagtatgccggtataatcctaagaa

SEQ ID NO: 352169 - DNA, 25 bp, Rattus norvegicus
gagtatgccggtttaatcctaagaa

SEQ ID NO: 352170 - DNA, 25 bp, Rattus norvegicus
gagtatgcctgcatccagaagcaca

SEQ ID NO: 352171 - DNA, 25 bp, Rattus norvegicus
gagtatgcctgcttccagaagcaca

SEQ ID NO: 352172 - DNA, 25 bp, Rattus norvegicus
gagtatgcgtctctgtgacgtcaca

SEQ ID NO: 352173 - DNA, 25 bp, Rattus norvegicus
gagtatgcgtctgtgtgacgtcaca

SEQ ID NO: 352174 - DNA, 25 bp, Rattus norvegicus
gagtatgctctcaatatatcctgta

SEQ ID NO: 352175 - DNA, 25 bp, Rattus norvegicus
gagtatgctctctatatatcctgta

SEQ ID NO: 352176 - DNA, 25 bp, Rattus norvegicus
gagtatgctgtaaatgacctcaaca

SEQ ID NO: 352177 - DNA, 25 bp, Rattus norvegicus
gagtatgctgtatatgacctcaaca

SEQ ID NO: 352178 - DNA, 25 bp, Rattus norvegicus
gagtatggaagaccccaccacaagt

SEQ ID NO: 352179 - DNA, 25 bp, Rattus norvegicus
gagtatggaagagcccaccacaagt

SEQ ID NO: 352180 - DNA, 25 bp, Rattus norvegicus
gagtatggacatagccactttcaag

SEQ ID NO: 352181 - DNA, 25 bp, Rattus norvegicus
gagtatggacattgccactttcaag

SEQ ID NO: 352182 - DNA, 25 bp, Rattus norvegicus
gagtatggcaggacctgagcttcat

SEQ ID NO: 352183 - DNA, 25 bp, Rattus norvegicus
gagtatggcaggtcctgagcttcat

SEQ ID NO: 352184 - DNA, 25 bp, Rattus norvegicus
gagtatgggaacatcacctaccctc

SEQ ID NO: 352185 - DNA, 25 bp, Rattus norvegicus
gagtatgggaacttcacctaccctc

SEQ ID NO: 352186 - DNA, 25 bp, Rattus norvegicus
gagtatgggcccagaaatccttaga

SEQ ID NO: 352187 - DNA, 25 bp, Rattus norvegicus
gagtatgggccctgaaatccttaga

SEQ ID NO: 352188 - DNA, 25 bp, Rattus norvegicus
gagtatggtctcctgcatattctat

SEQ ID NO: 352189 - DNA, 25 bp, Rattus norvegicus
gagtatggtctcgtgcatattctat

SEQ ID NO: 352190 - DNA, 25 bp, Rattus norvegicus
gagtatgtcagaatccttggaacct

SEQ ID NO: 352191 - DNA, 25 bp, Rattus norvegicus
gagtatgtcagattccttggaacct

SEQ ID NO: 352192 - DNA, 25 bp, Rattus norvegicus
gagtatgtctgtacaagtcttctat

SEQ ID NO: 352193 - DNA, 25 bp, Rattus norvegicus
gagtatgtctgttcaagtcttctat

SEQ ID NO: 352194 - DNA, 25 bp, Rattus norvegicus
gagtatgtcttcatggttttgttaa

SEQ ID NO: 352195 - DNA, 25 bp, Rattus norvegicus
gagtatgtcttcttggttttgttaa

SEQ ID NO: 352196 - DNA, 25 bp, Rattus norvegicus
gagtatgtgaagatgttccagtcaa

SEQ ID NO: 352197 - DNA, 25 bp, Rattus norvegicus
gagtatgtgaagttgttccagtcaa

SEQ ID NO: 352198 - DNA, 25 bp, Rattus norvegicus
gagtatgtgctcatggtctgtgacg

SEQ ID NO: 352199 - DNA, 25 bp, Rattus norvegicus
gagtatgtgctcttggtctgtgacg

SEQ ID NO: 352200 - DNA, 25 bp, Rattus norvegicus
gagtatgtggccaacctcacagagc

SEQ ID NO: 352201 - DNA, 25 bp, Rattus norvegicus
gagtatgtggcctacctcacagagc

SEQ ID NO: 352202 - DNA, 25 bp, Rattus norvegicus
gagtatgtgggcaactgctcacact

SEQ ID NO: 352203 - DNA, 25 bp, Rattus norvegicus
gagtatgtgggctactgctcacact

SEQ ID NO: 352204 - DNA, 25 bp, Rattus norvegicus
gagtatgttaccaatcattttttcc

SEQ ID NO: 352205 - DNA, 25 bp, Rattus norvegicus
gagtatgttacctatcattttttcc

SEQ ID NO: 352206 - DNA, 25 bp, Rattus norvegicus
gagtatgttcgtacatgtgcaattc

SEQ ID NO: 352207 - DNA, 25 bp, Rattus norvegicus
gagtatgttcgttcatgtgcaattc

SEQ ID NO: 352208 - DNA, 25 bp, Rattus norvegicus
gagtatgttggaaccatattgcaat

SEQ ID NO: 352209 - DNA, 25 bp, Rattus norvegicus
gagtatgttggatccatattgcaat

SEQ ID NO: 352210 - DNA, 25 bp, Rattus norvegicus
gagtatgtttgtagctacttacaat

SEQ ID NO: 352211 - DNA, 25 bp, Rattus norvegicus
gagtatgtttgttgctacttacaat

SEQ ID NO: 352212 - DNA, 25 bp, Rattus norvegicus
gagtattaacgcaattctgcacaat

SEQ ID NO: 352213 - DNA, 25 bp, Rattus norvegicus
gagtattaacgctattctgcacaat

SEQ ID NO: 352214 - DNA, 25 bp, Rattus norvegicus
gagtattaagttcccatgtgacttt

SEQ ID NO: 352215 - DNA, 25 bp, Rattus norvegicus
gagtattaagttgccatgtgacttt

SEQ ID NO: 352216 - DNA, 25 bp, Rattus norvegicus
gagtattacagacagcaggctgctt

SEQ ID NO: 352217 - DNA, 25 bp, Rattus norvegicus
gagtattacagagagcaggctgctt

SEQ ID NO: 352218 - DNA, 25 bp, Rattus norvegicus
gagtattacagtcgttctttgaaga

SEQ ID NO: 352219 - DNA, 25 bp, Rattus norvegicus
gagtattacagtggttctttgaaga

SEQ ID NO: 352220 - DNA, 25 bp, Rattus norvegicus
gagtattatgtaaagtgtgccactg

SEQ ID NO: 352221 - DNA, 25 bp, Rattus norvegicus
gagtattatgtatagtgtgccactg

SEQ ID NO: 352222 - DNA, 25 bp, Rattus norvegicus
gagtattattttcccacctatgaga

SEQ ID NO: 352223 - DNA, 25 bp, Rattus norvegicus
gagtattattttgccacctatgaga

SEQ ID NO: 352224 - DNA, 25 bp, Rattus norvegicus
gagtattcaacactggaggagttac

SEQ ID NO: 352225 - DNA, 25 bp, Rattus norvegicus
gagtattcaacagtggaggagttac

SEQ ID NO: 352226 - DNA, 25 bp, Rattus norvegicus
gagtattcactgctgtttggtgatc

SEQ ID NO: 352227 - DNA, 25 bp, Rattus norvegicus
gagtattcactggtgtttggtgatc

SEQ ID NO: 352228 - DNA, 25 bp, Rattus norvegicus
gagtattcacttacaggccattgat

SEQ ID NO: 352229 - DNA, 25 bp, Rattus norvegicus
gagtattcacttctaaagttgtcct

SEQ ID NO: 352230 - DNA, 25 bp, Rattus norvegicus
gagtattcacttgtaaagttgtcct

SEQ ID NO: 352231 - DNA, 25 bp, Rattus norvegicus
gagtattcactttcaggccattgat

SEQ ID NO: 352232 - DNA, 25 bp, Rattus norvegicus
gagtattcagccatcatgaatggaa

SEQ ID NO: 352233 - DNA, 25 bp, Rattus norvegicus
gagtattcagccttcatgaatggaa

SEQ ID NO: 352234 - DNA, 25 bp, Rattus norvegicus
gagtattctaacaatgagagtctta

SEQ ID NO: 352235 - DNA, 25 bp, Rattus norvegicus
gagtattctaactatgagagtctta

SEQ ID NO: 352236 - DNA, 25 bp, Rattus norvegicus
gagtattctactaatcagtttctgt

SEQ ID NO: 352237 - DNA, 25 bp, Rattus norvegicus
gagtattctacttatcagtttctgt

SEQ ID NO: 352238 - DNA, 25 bp, Rattus norvegicus
gagtattctagccagctcagggtag

SEQ ID NO: 352239 - DNA, 25 bp, Rattus norvegicus
gagtattctagcgagctcagggtag

SEQ ID NO: 352240 - DNA, 25 bp, Rattus norvegicus
gagtattctgaaaggcctatgtctt

SEQ ID NO: 352241 - DNA, 25 bp, Rattus norvegicus
gagtattctgaatggcctatgtctt

SEQ ID NO: 352242 - DNA, 25 bp, Rattus norvegicus
gagtattctgacatgcttgcaccta

SEQ ID NO: 352243 - DNA, 25 bp, Rattus norvegicus
gagtattctgacttgcttgcaccta

SEQ ID NO: 352244 - DNA, 25 bp, Rattus norvegicus
gagtattgcaacaccagctggtgac

SEQ ID NO: 352245 - DNA, 25 bp, Rattus norvegicus
gagtattgcaactccagctggtgac

SEQ ID NO: 352246 - DNA, 25 bp, Rattus norvegicus
gagtattgcctcctgacgccgaaat

SEQ ID NO: 352247 - DNA, 25 bp, Rattus norvegicus
gagtattgcctcgtgacgccgaaat

SEQ ID NO: 352248 - DNA, 25 bp, Rattus norvegicus
gagtattgcgaactcctacccaatt

SEQ ID NO: 352249 - DNA, 25 bp, Rattus norvegicus
gagtattgcgaagtcctacccaatt

SEQ ID NO: 352250 - DNA, 25 bp, Rattus norvegicus
gagtattgctggaccttcaggagca

SEQ ID NO: 352251 - DNA, 25 bp, Rattus norvegicus
gagtattgctggtccttcaggagca

SEQ ID NO: 352252 - DNA, 25 bp, Rattus norvegicus
gagtattggaccagaatttaacgtt

SEQ ID NO: 352253 - DNA, 25 bp, Rattus norvegicus
gagtattggacctgaatttaacgtt

SEQ ID NO: 352254 - DNA, 25 bp, Rattus norvegicus
gagtattggcccacggactgtgcca

SEQ ID NO: 352255 - DNA, 25 bp, Rattus norvegicus
gagtattggccctcggactgtgcca

SEQ ID NO: 352256 - DNA, 25 bp, Rattus norvegicus
gagtattgtactacgtttcatcaag

SEQ ID NO: 352257 - DNA, 25 bp, Rattus norvegicus
gagtattgtacttcgtttcatcaag

SEQ ID NO: 352258 - DNA, 25 bp, Rattus norvegicus
gagtattgttacaaattcaaggcca

SEQ ID NO: 352259 - DNA, 25 bp, Rattus norvegicus
gagtattgttactaattcaaggcca

SEQ ID NO: 352260 - DNA, 25 bp, Rattus norvegicus
gagtatttaattctccagcctagag

SEQ ID NO: 352261 - DNA, 25 bp, Rattus norvegicus
gagtatttaattgtccagcctagag

SEQ ID NO: 352262 - DNA, 25 bp, Rattus norvegicus
gagtatttccccagggtcctctgtg

SEQ ID NO: 352263 - DNA, 25 bp, Rattus norvegicus
gagtatttccccatagtattagcct

SEQ ID NO: 352264 - DNA, 25 bp, Rattus norvegicus
gagtatttcccctgggtcctctgtg

SEQ ID NO: 352265 - DNA, 25 bp, Rattus norvegicus
gagtatttccccttagtattagcct

SEQ ID NO: 352266 - DNA, 25 bp, Rattus norvegicus
gagtatttcctgacttcccatgagg

SEQ ID NO: 352267 - DNA, 25 bp, Rattus norvegicus
gagtatttcctgtcttcccatgagg

SEQ ID NO: 352268 - DNA, 25 bp, Rattus norvegicus
gagtatttctcgctcctggtcaata

SEQ ID NO: 352269 - DNA, 25 bp, Rattus norvegicus
gagtatttctcggtcctggtcaata

SEQ ID NO: 352270 - DNA, 25 bp, Rattus norvegicus
gagtatttctgcacacgaagcttag

SEQ ID NO: 352271 - DNA, 25 bp, Rattus norvegicus
gagtatttctgctcacgaagcttag

SEQ ID NO: 352272 - DNA, 25 bp, Rattus norvegicus
gagtatttgctgaagtaccctcctt

SEQ ID NO: 352273 - DNA, 25 bp, Rattus norvegicus
gagtatttgctgtagtaccctcctt

SEQ ID NO: 352274 - DNA, 25 bp, Rattus norvegicus
gagtatttggtcacatgccatgcct

SEQ ID NO: 352275 - DNA, 25 bp, Rattus norvegicus
gagtatttggtctcatgccatgcct

SEQ ID NO: 352276 - DNA, 25 bp, Rattus norvegicus
gagtattttcttacgctagcttaaa

SEQ ID NO: 352277 - DNA, 25 bp, Rattus norvegicus
gagtattttctttcgctagcttaaa

SEQ ID NO: 352278 - DNA, 25 bp, Rattus norvegicus
gagtattttgtcattcacttatgtt

SEQ ID NO: 352279 - DNA, 25 bp, Rattus norvegicus
gagtattttgtccatctgagattct

SEQ ID NO: 352280 - DNA, 25 bp, Rattus norvegicus
gagtattttgtcgatctgagattct

SEQ ID NO: 352281 - DNA, 25 bp, Rattus norvegicus
gagtattttgtctttcacttatgtt

SEQ ID NO: 352282 - DNA, 25 bp, Rattus norvegicus
gagtatttttacaccagcagcaagt

SEQ ID NO: 352283 - DNA, 25 bp, Rattus norvegicus
gagtatttttactccagcagcaagt

SEQ ID NO: 352284 - DNA, 25 bp, Rattus norvegicus
gagtatttttatcttccattttatt

SEQ ID NO: 352285 - DNA, 25 bp, Rattus norvegicus
gagtatttttatgttccattttatt

SEQ ID NO: 352286 - DNA, 25 bp, Rattus norvegicus
gagtatttttgtacaagatccagat

SEQ ID NO: 352287 - DNA, 25 bp, Rattus norvegicus
gagtatttttgttcaagatccagat

SEQ ID NO: 352288 - DNA, 25 bp, Rattus norvegicus
gagtcaaaaactaccatctctcctg

SEQ ID NO: 352289 - DNA, 25 bp, Rattus norvegicus
gagtcaaaaacttccatctctcctg

SEQ ID NO: 352290 - DNA, 25 bp, Rattus norvegicus
gagtcaaaactgattccagccatag

SEQ ID NO: 352291 - DNA, 25 bp, Rattus norvegicus
gagtcaaaactgtttccagccatag

SEQ ID NO: 352292 - DNA, 25 bp, Rattus norvegicus
gagtcaaacatcaagtcccggtggc

SEQ ID NO: 352293 - DNA, 25 bp, Rattus norvegicus
gagtcaaacatctagtcccggtggc

SEQ ID NO: 352294 - DNA, 25 bp, Rattus norvegicus
gagtcaaacctcctggctcttctgg

SEQ ID NO: 352295 - DNA, 25 bp, Rattus norvegicus
gagtcaaacctcgtggctcttctgg

SEQ ID NO: 352296 - DNA, 25 bp, Rattus norvegicus
gagtcaaagacacagggcccagaga

SEQ ID NO: 352297 - DNA, 25 bp, Rattus norvegicus
gagtcaaagacagagggcccagaga

SEQ ID NO: 352298 - DNA, 25 bp, Rattus norvegicus
gagtcaaagacgcacaaccagtact

SEQ ID NO: 352299 - DNA, 25 bp, Rattus norvegicus
gagtcaaagacggacaaccagtact

SEQ ID NO: 352300 - DNA, 25 bp, Rattus norvegicus
gagtcaaagagcatccacattttaa

SEQ ID NO: 352301 - DNA, 25 bp, Rattus norvegicus
gagtcaaagagcttccacattttaa

SEQ ID NO: 352302 - DNA, 25 bp, Rattus norvegicus
gagtcaaaggtaagccagcaggctc

SEQ ID NO: 352303 - DNA, 25 bp, Rattus norvegicus
gagtcaaaggtatgccagcaggctc

SEQ ID NO: 352304 - DNA, 25 bp, Rattus norvegicus
gagtcaaaggtgagcccctccatat

SEQ ID NO: 352305 - DNA, 25 bp, Rattus norvegicus
gagtcaaaggtgtgcccctccatat

SEQ ID NO: 352306 - DNA, 25 bp, Rattus norvegicus
gagtcaaatcatattcagagtcaaa

SEQ ID NO: 352307 - DNA, 25 bp, Rattus norvegicus
gagtcaaatcattttcagagtcaaa

SEQ ID NO: 352308 - DNA, 25 bp, Rattus norvegicus
gagtcaaatcgacaagcgggtctaa

SEQ ID NO: 352309 - DNA, 25 bp, Rattus norvegicus
gagtcaaatcgagaagcgggtctaa

SEQ ID NO: 352310 - DNA, 25 bp, Rattus norvegicus
gagtcaacatacatactgaggcagg

SEQ ID NO: 352311 - DNA, 25 bp, Rattus norvegicus
gagtcaacatacttactgaggcagg

SEQ ID NO: 352312 - DNA, 25 bp, Rattus norvegicus
gagtcaacatcaaagtcttccctgt

SEQ ID NO: 352313 - DNA, 25 bp, Rattus norvegicus
gagtcaacatcatagtcttccctgt

SEQ ID NO: 352314 - DNA, 25 bp, Rattus norvegicus
gagtcaacatgcagttttcccgttt

SEQ ID NO: 352315 - DNA, 25 bp, Rattus norvegicus
gagtcaacatgctgttttcccgttt

SEQ ID NO: 352316 - DNA, 25 bp, Rattus norvegicus
gagtcaacatttatctttatcactg

SEQ ID NO: 352317 - DNA, 25 bp, Rattus norvegicus
gagtcaacatttttctttatcactg

SEQ ID NO: 352318 - DNA, 25 bp, Rattus norvegicus
gagtcaaccagcatcctcgaaaaaa

SEQ ID NO: 352319 - DNA, 25 bp, Rattus norvegicus
gagtcaaccagcttcctcgaaaaaa

SEQ ID NO: 352320 - DNA, 25 bp, Rattus norvegicus
gagtcaacccagctgagaaggcccg

SEQ ID NO: 352321 - DNA, 25 bp, Rattus norvegicus
gagtcaacccaggtgagaaggcccg

SEQ ID NO: 352322 - DNA, 25 bp, Rattus norvegicus
gagtcaaccttcaaaacctcagagc

SEQ ID NO: 352323 - DNA, 25 bp, Rattus norvegicus
gagtcaaccttctaaacctcagagc

SEQ ID NO: 352324 - DNA, 25 bp, Rattus norvegicus
gagtcaacggatcttttgattgcta

SEQ ID NO: 352325 - DNA, 25 bp, Rattus norvegicus
gagtcaacggatgttttgattgcta

SEQ ID NO: 352326 - DNA, 25 bp, Rattus norvegicus
gagtcaactcagcattcacccgctg

SEQ ID NO: 352327 - DNA, 25 bp, Rattus norvegicus
gagtcaactcaggattcacccgctg

SEQ ID NO: 352328 - DNA, 25 bp, Rattus norvegicus
gagtcaactcttcgtgtgcacatct

SEQ ID NO: 352329 - DNA, 25 bp, Rattus norvegicus
gagtcaactcttggtgtgcacatct

SEQ ID NO: 352330 - DNA, 25 bp, Rattus norvegicus
gagtcaactgacaaagcctggagta

SEQ ID NO: 352331 - DNA, 25 bp, Rattus norvegicus
gagtcaactgactaagcctggagta

SEQ ID NO: 352332 - DNA, 25 bp, Rattus norvegicus
gagtcaactgtacagtgcctcagga

SEQ ID NO: 352333 - DNA, 25 bp, Rattus norvegicus
gagtcaactgtagagtgcctcagga

SEQ ID NO: 352334 - DNA, 25 bp, Rattus norvegicus
gagtcaactttcatcagtcagcagg

SEQ ID NO: 352335 - DNA, 25 bp, Rattus norvegicus
gagtcaactttcttcagtcagcagg

SEQ ID NO: 352336 - DNA, 25 bp, Rattus norvegicus
gagtcaagacaacgccacatctatg

SEQ ID NO: 352337 - DNA, 25 bp, Rattus norvegicus
gagtcaagacaaggccacatctatg

SEQ ID NO: 352338 - DNA, 25 bp, Rattus norvegicus
gagtcaagatgaaggccgccagcga

SEQ ID NO: 352339 - DNA, 25 bp, Rattus norvegicus
gagtcaagatgatggccgccagcga

SEQ ID NO: 352340 - DNA, 25 bp, Rattus norvegicus
gagtcaagcaagcttaaagccactt

SEQ ID NO: 352341 - DNA, 25 bp, Rattus norvegicus
gagtcaagcaaggttaaagccactt

SEQ ID NO: 352342 - DNA, 25 bp, Rattus norvegicus
gagtcaagccagaacagcctcatct

SEQ ID NO: 352343 - DNA, 25 bp, Rattus norvegicus
gagtcaagccagtacagcctcatct

SEQ ID NO: 352344 - DNA, 25 bp, Rattus norvegicus
gagtcaagctctccggatggcaaaa

SEQ ID NO: 352345 - DNA, 25 bp, Rattus norvegicus
gagtcaagctctgcggatggcaaaa

SEQ ID NO: 352346 - DNA, 25 bp, Rattus norvegicus
gagtcaaggctcctttcccagagaa

SEQ ID NO: 352347 - DNA, 25 bp, Rattus norvegicus
gagtcaaggctcgtttcccagagaa

SEQ ID NO: 352348 - DNA, 25 bp, Rattus norvegicus
gagtcaagggcaccctgatctacaa

SEQ ID NO: 352349 - DNA, 25 bp, Rattus norvegicus
gagtcaagggcagcctgatctacaa

SEQ ID NO: 352350 - DNA, 25 bp, Rattus norvegicus
gagtcaaggtgcaaccagtagtcct

SEQ ID NO: 352351 - DNA, 25 bp, Rattus norvegicus
gagtcaaggtgctaccagtagtcct

SEQ ID NO: 352352 - DNA, 25 bp, Rattus norvegicus
gagtcaagtacaacttccgtgtaag

SEQ ID NO: 352353 - DNA, 25 bp, Rattus norvegicus
gagtcaagtacatcttccgtgtaag

SEQ ID NO: 352354 - DNA, 25 bp, Rattus norvegicus
gagtcaagtccgcatcaagggcaaa

SEQ ID NO: 352355 - DNA, 25 bp, Rattus norvegicus
gagtcaagtccggatcaagggcaaa

SEQ ID NO: 352356 - DNA, 25 bp, Rattus norvegicus
gagtcaagtctcaagctcgctgtag

SEQ ID NO: 352357 - DNA, 25 bp, Rattus norvegicus
gagtcaagtctctagctcgctgtag

SEQ ID NO: 352358 - DNA, 25 bp, Rattus norvegicus
gagtcaagtcttacaccatgtgggt

SEQ ID NO: 352359 - DNA, 25 bp, Rattus norvegicus
gagtcaagtctttcaccatgtgggt

SEQ ID NO: 352360 - DNA, 25 bp, Rattus norvegicus
gagtcaagtgaaagtctcgctcctc

SEQ ID NO: 352361 - DNA, 25 bp, Rattus norvegicus
gagtcaagtgaatgtctcgctcctc

SEQ ID NO: 352362 - DNA, 25 bp, Rattus norvegicus
gagtcaagtgatcaccagtccccgg

SEQ ID NO: 352363 - DNA, 25 bp, Rattus norvegicus
gagtcaagtgatgaccagtccccgg

SEQ ID NO: 352364 - DNA, 25 bp, Rattus norvegicus
gagtcaagttgactctgcatacttg

SEQ ID NO: 352365 - DNA, 25 bp, Rattus norvegicus
gagtcaagttgagtctgcatacttg

SEQ ID NO: 352366 - DNA, 25 bp, Rattus norvegicus
gagtcaagttgcctcaagcagccag

SEQ ID NO: 352367 - DNA, 25 bp, Rattus norvegicus
gagtcaagttgcgtcaagcagccag

SEQ ID NO: 352368 - DNA, 25 bp, Rattus norvegicus
gagtcaatagtccatgtcttcataa

SEQ ID NO: 352369 - DNA, 25 bp, Rattus norvegicus
gagtcaatagtcgatgtcttcataa

SEQ ID NO: 352370 - DNA, 25 bp, Rattus norvegicus
gagtcaatatagcatgcgtccccag

SEQ ID NO: 352371 - DNA, 25 bp, Rattus norvegicus
gagtcaatataggatgcgtccccag

SEQ ID NO: 352372 - DNA, 25 bp, Rattus norvegicus
gagtcaatatttaatcaccctaaat

SEQ ID NO: 352373 - DNA, 25 bp, Rattus norvegicus
gagtcaatattttatcaccctaaat

SEQ ID NO: 352374 - DNA, 25 bp, Rattus norvegicus
gagtcaatcagcctttgggtcttta

SEQ ID NO: 352375 - DNA, 25 bp, Rattus norvegicus
gagtcaatcagcgtttgggtcttta

SEQ ID NO: 352376 - DNA, 25 bp, Rattus norvegicus
gagtcaatcattctggtctatgtat

SEQ ID NO: 352377 - DNA, 25 bp, Rattus norvegicus
gagtcaatcattgtggtctatgtat

SEQ ID NO: 352378 - DNA, 25 bp, Rattus norvegicus
gagtcaatcctaacagagtctgcag

SEQ ID NO: 352379 - DNA, 25 bp, Rattus norvegicus
gagtcaatcctatcagagtctgcag

SEQ ID NO: 352380 - DNA, 25 bp, Rattus norvegicus
gagtcaatgagccagattctttatt

SEQ ID NO: 352381 - DNA, 25 bp, Rattus norvegicus
gagtcaatgagcgagattctttatt

SEQ ID NO: 352382 - DNA, 25 bp, Rattus norvegicus
gagtcaatgatcacccagggtactg

SEQ ID NO: 352383 - DNA, 25 bp, Rattus norvegicus
gagtcaatgatctcccagggtactg

SEQ ID NO: 352384 - DNA, 25 bp, Rattus norvegicus
gagtcaatgcctcagatgccctcta

SEQ ID NO: 352385 - DNA, 25 bp, Rattus norvegicus
gagtcaatgcctgagatgccctcta

SEQ ID NO: 352386 - DNA, 25 bp, Rattus norvegicus
gagtcaatgtagatctgcctggatg

SEQ ID NO: 352387 - DNA, 25 bp, Rattus norvegicus
gagtcaatgtagttctgcctggatg

SEQ ID NO: 352388 - DNA, 25 bp, Rattus norvegicus
gagtcaattcctactgggaaatggg

SEQ ID NO: 352389 - DNA, 25 bp, Rattus norvegicus
gagtcaattccttctgggaaatggg

SEQ ID NO: 352390 - DNA, 25 bp, Rattus norvegicus
gagtcaatttttctgattagtggtt

SEQ ID NO: 352391 - DNA, 25 bp, Rattus norvegicus
gagtcaatttttgtgattagtggtt

SEQ ID NO: 352392 - DNA, 25 bp, Rattus norvegicus
gagtcacaaaggcacaatgccagct

SEQ ID NO: 352393 - DNA, 25 bp, Rattus norvegicus
gagtcacaaagggacaatgccagct

SEQ ID NO: 352394 - DNA, 25 bp, Rattus norvegicus
gagtcacaagctatccaggtatggt

SEQ ID NO: 352395 - DNA, 25 bp, Rattus norvegicus
gagtcacaagctttccaggtatggt

SEQ ID NO: 352396 - DNA, 25 bp, Rattus norvegicus
gagtcacacacactgtcctcattgg

SEQ ID NO: 352397 - DNA, 25 bp, Rattus norvegicus
gagtcacacacagtgtcctcattgg

SEQ ID NO: 352398 - DNA, 25 bp, Rattus norvegicus
gagtcacacatcagatatcccgcat

SEQ ID NO: 352399 - DNA, 25 bp, Rattus norvegicus
gagtcacacatctgatatcccgcat

SEQ ID NO: 352400 - DNA, 25 bp, Rattus norvegicus
gagtcacacattatctagaaccctt

SEQ ID NO: 352401 - DNA, 25 bp, Rattus norvegicus
gagtcacacattttctagaaccctt

SEQ ID NO: 352402 - DNA, 25 bp, Rattus norvegicus
gagtcacactacatgctcctgtgaa

SEQ ID NO: 352403 - DNA, 25 bp, Rattus norvegicus
gagtcacactacttgctcctgtgaa

SEQ ID NO: 352404 - DNA, 25 bp, Rattus norvegicus
gagtcacactcaaagttttcagcga

SEQ ID NO: 352405 - DNA, 25 bp, Rattus norvegicus
gagtcacactcatagttttcagcga

SEQ ID NO: 352406 - DNA, 25 bp, Rattus norvegicus
gagtcacagacacaactggcatctt

SEQ ID NO: 352407 - DNA, 25 bp, Rattus norvegicus
gagtcacagacagaactggcatctt

SEQ ID NO: 352408 - DNA, 25 bp, Rattus norvegicus
gagtcacagatgatctctcaaactt

SEQ ID NO: 352409 - DNA, 25 bp, Rattus norvegicus
gagtcacagatgttctctcaaactt

SEQ ID NO: 352410 - DNA, 25 bp, Rattus norvegicus
gagtcacagcagaggccggatcctg

SEQ ID NO: 352411 - DNA, 25 bp, Rattus norvegicus
gagtcacagcagtggccggatcctg

SEQ ID NO: 352412 - DNA, 25 bp, Rattus norvegicus
gagtcacagccacctcagttgtcat

SEQ ID NO: 352413 - DNA, 25 bp, Rattus norvegicus
gagtcacagccagctcagttgtcat

SEQ ID NO: 352414 - DNA, 25 bp, Rattus norvegicus
gagtcacagctcaaatatcacagta

SEQ ID NO: 352415 - DNA, 25 bp, Rattus norvegicus
gagtcacagctctaatatcacagta

SEQ ID NO: 352416 - DNA, 25 bp, Rattus norvegicus
gagtcacaggagaacgcctcacgca

SEQ ID NO: 352417 - DNA, 25 bp, Rattus norvegicus
gagtcacaggagtacgcctcacgca

SEQ ID NO: 352418 - DNA, 25 bp, Rattus norvegicus
gagtcacaggccagtagcattacat

SEQ ID NO: 352419 - DNA, 25 bp, Rattus norvegicus
gagtcacaggcctgtagcattacat

SEQ ID NO: 352420 - DNA, 25 bp, Rattus norvegicus
gagtcacatcagctggtgttacgac

SEQ ID NO: 352421 - DNA, 25 bp, Rattus norvegicus
gagtcacatcaggtggtgttacgac

SEQ ID NO: 352422 - DNA, 25 bp, Rattus norvegicus
gagtcacatgagctgttcagtcagt

SEQ ID NO: 352423 - DNA, 25 bp, Rattus norvegicus
gagtcacatgaggtgttcagtcagt

SEQ ID NO: 352424 - DNA, 25 bp, Rattus norvegicus
gagtcacatgcccagcctaagaaga

SEQ ID NO: 352425 - DNA, 25 bp, Rattus norvegicus
gagtcacatgccgagcctaagaaga

SEQ ID NO: 352426 - DNA, 25 bp, Rattus norvegicus
gagtcacatttgctttctgtcagaa

SEQ ID NO: 352427 - DNA, 25 bp, Rattus norvegicus
gagtcacatttggtttctgtcagaa

SEQ ID NO: 352428 - DNA, 25 bp, Rattus norvegicus
gagtcaccagagcaccttgctgtag

SEQ ID NO: 352429 - DNA, 25 bp, Rattus norvegicus
gagtcaccagaggaccttgctgtag

SEQ ID NO: 352430 - DNA, 25 bp, Rattus norvegicus
gagtcaccagtcattcaaacacgtt

SEQ ID NO: 352431 - DNA, 25 bp, Rattus norvegicus
gagtcaccagtctttcaaacacgtt

SEQ ID NO: 352432 - DNA, 25 bp, Rattus norvegicus
gagtcaccagtgacctcaagggaga

SEQ ID NO: 352433 - DNA, 25 bp, Rattus norvegicus
gagtcaccagtgtcctcaagggaga

SEQ ID NO: 352434 - DNA, 25 bp, Rattus norvegicus
gagtcaccatacatcacaggacatg

SEQ ID NO: 352435 - DNA, 25 bp, Rattus norvegicus
gagtcaccatacttcacaggacatg

SEQ ID NO: 352436 - DNA, 25 bp, Rattus norvegicus
gagtcaccatgacaggatgttaatt

SEQ ID NO: 352437 - DNA, 25 bp, Rattus norvegicus
gagtcaccatgagaggatgttaatt

SEQ ID NO: 352438 - DNA, 25 bp, Rattus norvegicus
gagtcaccattactgggtgcaccgt

SEQ ID NO: 352439 - DNA, 25 bp, Rattus norvegicus
gagtcaccattagtgggtgcaccgt

SEQ ID NO: 352440 - DNA, 25 bp, Rattus norvegicus
gagtcacccatcaccgaatgagaaa

SEQ ID NO: 352441 - DNA, 25 bp, Rattus norvegicus
gagtcacccatctccgaatgagaaa

SEQ ID NO: 352442 - DNA, 25 bp, Rattus norvegicus
gagtcaccccaacgacatgaacaat

SEQ ID NO: 352443 - DNA, 25 bp, Rattus norvegicus
gagtcaccccaaggacatgaacaat

SEQ ID NO: 352444 - DNA, 25 bp, Rattus norvegicus
gagtcacccgaacgtctcaaggacc

SEQ ID NO: 352445 - DNA, 25 bp, Rattus norvegicus
gagtcacccgaaggtctcaaggacc

SEQ ID NO: 352446 - DNA, 25 bp, Rattus norvegicus
gagtcaccctctacgggctgatggt

SEQ ID NO: 352447 - DNA, 25 bp, Rattus norvegicus
gagtcaccctcttcgggctgatggt

SEQ ID NO: 352448 - DNA, 25 bp, Rattus norvegicus
gagtcacccttaatcctgtaagtaa

SEQ ID NO: 352449 - DNA, 25 bp, Rattus norvegicus
gagtcacccttattcctgtaagtaa

SEQ ID NO: 352450 - DNA, 25 bp, Rattus norvegicus
gagtcaccctttcaagcatcctgta

SEQ ID NO: 352451 - DNA, 25 bp, Rattus norvegicus
gagtcaccctttgaagcatcctgta

SEQ ID NO: 352452 - DNA, 25 bp, Rattus norvegicus
gagtcaccgtgtaatgcaccttcat

SEQ ID NO: 352453 - DNA, 25 bp, Rattus norvegicus
gagtcaccgtgttatgcaccttcat

SEQ ID NO: 352454 - DNA, 25 bp, Rattus norvegicus
gagtcaccgttactttcctcggccg

SEQ ID NO: 352455 - DNA, 25 bp, Rattus norvegicus
gagtcaccgttagtttcctcggccg

SEQ ID NO: 352456 - DNA, 25 bp, Rattus norvegicus
gagtcacctgaacccgtggaatcca

SEQ ID NO: 352457 - DNA, 25 bp, Rattus norvegicus
gagtcacctgaagccgtggaatcca

SEQ ID NO: 352458 - DNA, 25 bp, Rattus norvegicus
gagtcacctgacagtgggttcccag

SEQ ID NO: 352459 - DNA, 25 bp, Rattus norvegicus
gagtcacctgactgtgggttcccag

SEQ ID NO: 352460 - DNA, 25 bp, Rattus norvegicus
gagtcacctgcaattttcattcctt

SEQ ID NO: 352461 - DNA, 25 bp, Rattus norvegicus
gagtcacctgcatttttcattcctt

SEQ ID NO: 352462 - DNA, 25 bp, Rattus norvegicus
gagtcaccttatcaggagcttcagg

SEQ ID NO: 352463 - DNA, 25 bp, Rattus norvegicus
gagtcaccttatgaggagcttcagg

SEQ ID NO: 352464 - DNA, 25 bp, Rattus norvegicus
gagtcacctttaataccacgtagtc

SEQ ID NO: 352465 - DNA, 25 bp, Rattus norvegicus
gagtcacctttattaccacgtagtc

SEQ ID NO: 352466 - DNA, 25 bp, Rattus norvegicus
gagtcacgagacatttcttgagaat

SEQ ID NO: 352467 - DNA, 25 bp, Rattus norvegicus
gagtcacgagacttttcttgagaat

SEQ ID NO: 352468 - DNA, 25 bp, Rattus norvegicus
gagtcacgagcccagttctctgcca

SEQ ID NO: 352469 - DNA, 25 bp, Rattus norvegicus
gagtcacgagccgagttctctgcca

SEQ ID NO: 352470 - DNA, 25 bp, Rattus norvegicus
gagtcacgatgtcaggtagccgcca

SEQ ID NO: 352471 - DNA, 25 bp, Rattus norvegicus
gagtcacgatgtgaggtagccgcca

SEQ ID NO: 352472 - DNA, 25 bp, Rattus norvegicus
gagtcacggacaacatcggatacct

SEQ ID NO: 352473 - DNA, 25 bp, Rattus norvegicus
gagtcacggacatcatcggatacct

SEQ ID NO: 352474 - DNA, 25 bp, Rattus norvegicus
gagtcacggatgaccccaatgtgta

SEQ ID NO: 352475 - DNA, 25 bp, Rattus norvegicus
gagtcacggatgtccccaatgtgta

SEQ ID NO: 352476 - DNA, 25 bp, Rattus norvegicus
gagtcacggtaacttgtatgccaca

SEQ ID NO: 352477 - DNA, 25 bp, Rattus norvegicus
gagtcacggtaagttgtatgccaca

SEQ ID NO: 352478 - DNA, 25 bp, Rattus norvegicus
gagtcacgtccgactaaaaccggat

SEQ ID NO: 352479 - DNA, 25 bp, Rattus norvegicus
gagtcacgtccgtctaaaaccggat

SEQ ID NO: 352480 - DNA, 25 bp, Rattus norvegicus
gagtcacgtctgcattttctgttga

SEQ ID NO: 352481 - DNA, 25 bp, Rattus norvegicus
gagtcacgtctggattttctgttga

SEQ ID NO: 352482 - DNA, 25 bp, Rattus norvegicus
gagtcacgtgacagtaaagacagca

SEQ ID NO: 352483 - DNA, 25 bp, Rattus norvegicus
gagtcacgtgactgtaaagacagca

SEQ ID NO: 352484 - DNA, 25 bp, Rattus norvegicus
gagtcacgtgcactgtttagctctc

SEQ ID NO: 352485 - DNA, 25 bp, Rattus norvegicus
gagtcacgtgcagtgtttagctctc

SEQ ID NO: 352486 - DNA, 25 bp, Rattus norvegicus
gagtcacgtggaagaacattagcat

SEQ ID NO: 352487 - DNA, 25 bp, Rattus norvegicus
gagtcacgtggatgaacattagcat

SEQ ID NO: 352488 - DNA, 25 bp, Rattus norvegicus
gagtcactaaacatcaccacacggt

SEQ ID NO: 352489 - DNA, 25 bp, Rattus norvegicus
gagtcactaaacttcaccacacggt

SEQ ID NO: 352490 - DNA, 25 bp, Rattus norvegicus
gagtcactacacctcacagtaagag

SEQ ID NO: 352491 - DNA, 25 bp, Rattus norvegicus
gagtcactacacgtcacagtaagag

SEQ ID NO: 352492 - DNA, 25 bp, Rattus norvegicus
gagtcactaccaccaattctttgga

SEQ ID NO: 352493 - DNA, 25 bp, Rattus norvegicus
gagtcactaccagcaattctttgga

SEQ ID NO: 352494 - DNA, 25 bp, Rattus norvegicus
gagtcactactcaaaaaccccggct

SEQ ID NO: 352495 - DNA, 25 bp, Rattus norvegicus
gagtcactactctaaaaccccggct

SEQ ID NO: 352496 - DNA, 25 bp, Rattus norvegicus
gagtcactagaaactttgttccttc

SEQ ID NO: 352497 - DNA, 25 bp, Rattus norvegicus
gagtcactagaatctttgttccttc

SEQ ID NO: 352498 - DNA, 25 bp, Rattus norvegicus
gagtcactaggacaaatgccccagt

SEQ ID NO: 352499 - DNA, 25 bp, Rattus norvegicus
gagtcactaggagaaatgccccagt

SEQ ID NO: 352500 - DNA, 25 bp, Rattus norvegicus
gagtcactatcgaggagcaggaaga

SEQ ID NO: 352501 - DNA, 25 bp, Rattus norvegicus
gagtcactatcgtggagcaggaaga

SEQ ID NO: 352502 - DNA, 25 bp, Rattus norvegicus
gagtcactatgaaccagggtcagcc

SEQ ID NO: 352503 - DNA, 25 bp, Rattus norvegicus
gagtcactatgatccagggtcagcc

SEQ ID NO: 352504 - DNA, 25 bp, Rattus norvegicus
gagtcactattgagtttgccaaacg

SEQ ID NO: 352505 - DNA, 25 bp, Rattus norvegicus
gagtcactattgtgtttgccaaacg

SEQ ID NO: 352506 - DNA, 25 bp, Rattus norvegicus
gagtcactcagtctggttcagggac

SEQ ID NO: 352507 - DNA, 25 bp, Rattus norvegicus
gagtcactcagtgtggttcagggac

SEQ ID NO: 352508 - DNA, 25 bp, Rattus norvegicus
gagtcactcattccttatgcggtca

SEQ ID NO: 352509 - DNA, 25 bp, Rattus norvegicus
gagtcactcattgcttatgcggtca

SEQ ID NO: 352510 - DNA, 25 bp, Rattus norvegicus
gagtcactccatcatccattacaac

SEQ ID NO: 352511 - DNA, 25 bp, Rattus norvegicus
gagtcactccatgatccattacaac

SEQ ID NO: 352512 - DNA, 25 bp, Rattus norvegicus
gagtcactccccagctgggtcaagg

SEQ ID NO: 352513 - DNA, 25 bp, Rattus norvegicus
gagtcactcccctgctgggtcaagg

SEQ ID NO: 352514 - DNA, 25 bp, Rattus norvegicus
gagtcactcctcaaagctgattcga

SEQ ID NO: 352515 - DNA, 25 bp, Rattus norvegicus
gagtcactcctctaagctgattcga

SEQ ID NO: 352516 - DNA, 25 bp, Rattus norvegicus
gagtcactcggcagagcatcctgga

SEQ ID NO: 352517 - DNA, 25 bp, Rattus norvegicus
gagtcactcggctgagcatcctgga

SEQ ID NO: 352518 - DNA, 25 bp, Rattus norvegicus
gagtcactgcccatcggtgatgctg

SEQ ID NO: 352519 - DNA, 25 bp, Rattus norvegicus
gagtcactgcccttcggtgatgctg

SEQ ID NO: 352520 - DNA, 25 bp, Rattus norvegicus
gagtcactggctcaactgagaacat

SEQ ID NO: 352521 - DNA, 25 bp, Rattus norvegicus
gagtcactggctgaactgagaacat

SEQ ID NO: 352522 - DNA, 25 bp, Rattus norvegicus
gagtcactggtgaacatgtgctcag

SEQ ID NO: 352523 - DNA, 25 bp, Rattus norvegicus
gagtcactggtgtacatgtgctcag

SEQ ID NO: 352524 - DNA, 25 bp, Rattus norvegicus
gagtcactgtcaacaatgctttttt

SEQ ID NO: 352525 - DNA, 25 bp, Rattus norvegicus
gagtcactgtcatcaatgctttttt

SEQ ID NO: 352526 - DNA, 25 bp, Rattus norvegicus
gagtcacttcctacatgactgcaga

SEQ ID NO: 352527 - DNA, 25 bp, Rattus norvegicus
gagtcacttccttcatgactgcaga

SEQ ID NO: 352528 - DNA, 25 bp, Rattus norvegicus
gagtcacttctgatgtctgtatact

SEQ ID NO: 352529 - DNA, 25 bp, Rattus norvegicus
gagtcacttctgttgtctgtatact

SEQ ID NO: 352530 - DNA, 25 bp, Rattus norvegicus
gagtcactttgcacctgtgggacag

SEQ ID NO: 352531 - DNA, 25 bp, Rattus norvegicus
gagtcactttgctcctgtgggacag

SEQ ID NO: 352532 - DNA, 25 bp, Rattus norvegicus
gagtcactttggacaatgaacctaa

SEQ ID NO: 352533 - DNA, 25 bp, Rattus norvegicus
gagtcactttggtcaatgaacctaa

SEQ ID NO: 352534 - DNA, 25 bp, Rattus norvegicus
gagtcagaaactatccagttgccat

SEQ ID NO: 352535 - DNA, 25 bp, Rattus norvegicus
gagtcagaaactttccagttgccat

SEQ ID NO: 352536 - DNA, 25 bp, Rattus norvegicus
gagtcagaaatccaggtgttacctt

SEQ ID NO: 352537 - DNA, 25 bp, Rattus norvegicus
gagtcagaaatcgaggtgttacctt

SEQ ID NO: 352538 - DNA, 25 bp, Rattus norvegicus
gagtcagaacacctctttaaagcca

SEQ ID NO: 352539 - DNA, 25 bp, Rattus norvegicus
gagtcagaacacgtctttaaagcca

SEQ ID NO: 352540 - DNA, 25 bp, Rattus norvegicus
gagtcagaatgccacagctcagagt

SEQ ID NO: 352541 - DNA, 25 bp, Rattus norvegicus
gagtcagaatgcgacagctcagagt

SEQ ID NO: 352542 - DNA, 25 bp, Rattus norvegicus
gagtcagaatgtagaagtccagcat

SEQ ID NO: 352543 - DNA, 25 bp, Rattus norvegicus
gagtcagaatgtcgcctggacagct

SEQ ID NO: 352544 - DNA, 25 bp, Rattus norvegicus
gagtcagaatgtggcctggacagct

SEQ ID NO: 352545 - DNA, 25 bp, Rattus norvegicus
gagtcagaatgttgaagtccagcat

SEQ ID NO: 352546 - DNA, 25 bp, Rattus norvegicus
gagtcagacaaaagtgggccatact

SEQ ID NO: 352547 - DNA, 25 bp, Rattus norvegicus
gagtcagacaaatgtgggccatact

SEQ ID NO: 352548 - DNA, 25 bp, Rattus norvegicus
gagtcagacagccacgagtcctgga

SEQ ID NO: 352549 - DNA, 25 bp, Rattus norvegicus
gagtcagacagcgacgagtcctgga

SEQ ID NO: 352550 - DNA, 25 bp, Rattus norvegicus
gagtcagaccgcattagcacagagc

SEQ ID NO: 352551 - DNA, 25 bp, Rattus norvegicus
gagtcagaccgctttagcacagagc

SEQ ID NO: 352552 - DNA, 25 bp, Rattus norvegicus
gagtcagacctgcaactgagcgcaa

SEQ ID NO: 352553 - DNA, 25 bp, Rattus norvegicus
gagtcagacctggaactgagcgcaa

SEQ ID NO: 352554 - DNA, 25 bp, Rattus norvegicus
gagtcagacgagaggattttggtta

SEQ ID NO: 352555 - DNA, 25 bp, Rattus norvegicus
gagtcagacgagtggattttggtta

SEQ ID NO: 352556 - DNA, 25 bp, Rattus norvegicus
gagtcagactaccatggcatcgcag

SEQ ID NO: 352557 - DNA, 25 bp, Rattus norvegicus
gagtcagactacgatggcatcgcag

SEQ ID NO: 352558 - DNA, 25 bp, Rattus norvegicus
gagtcagactgtatcattagtgccc

SEQ ID NO: 352559 - DNA, 25 bp, Rattus norvegicus
gagtcagactgtttcattagtgccc

SEQ ID NO: 352560 - DNA, 25 bp, Rattus norvegicus
gagtcagacttacagattagcctct

SEQ ID NO: 352561 - DNA, 25 bp, Rattus norvegicus
gagtcagacttagagattagcctct

SEQ ID NO: 352562 - DNA, 25 bp, Rattus norvegicus
gagtcagagaaaacaccctcgtcct

SEQ ID NO: 352563 - DNA, 25 bp, Rattus norvegicus
gagtcagagaaatcaccctcgtcct

SEQ ID NO: 352564 - DNA, 25 bp, Rattus norvegicus
gagtcagagacacatcttctccacg

SEQ ID NO: 352565 - DNA, 25 bp, Rattus norvegicus
gagtcagagacagatcttctccacg

SEQ ID NO: 352566 - DNA, 25 bp, Rattus norvegicus
gagtcagagcctagtaagcacccga

SEQ ID NO: 352567 - DNA, 25 bp, Rattus norvegicus
gagtcagagcctcgaatcgatccct

SEQ ID NO: 352568 - DNA, 25 bp, Rattus norvegicus
gagtcagagcctggaatcgatccct

SEQ ID NO: 352569 - DNA, 25 bp, Rattus norvegicus
gagtcagagccttgtaagcacccga

SEQ ID NO: 352570 - DNA, 25 bp, Rattus norvegicus
gagtcagaggatcccaaatcagaaa

SEQ ID NO: 352571 - DNA, 25 bp, Rattus norvegicus
gagtcagaggatgccaaatcagaaa

SEQ ID NO: 352572 - DNA, 25 bp, Rattus norvegicus
gagtcagagtcacatacccctgatt

SEQ ID NO: 352573 - DNA, 25 bp, Rattus norvegicus
gagtcagagtcaccactggcaagta

SEQ ID NO: 352574 - DNA, 25 bp, Rattus norvegicus
gagtcagagtcagatacccctgatt

SEQ ID NO: 352575 - DNA, 25 bp, Rattus norvegicus
gagtcagagtcagcactggcaagta

SEQ ID NO: 352576 - DNA, 25 bp, Rattus norvegicus
gagtcagatgacacccatctgtcaa

SEQ ID NO: 352577 - DNA, 25 bp, Rattus norvegicus
gagtcagatgactcccatctgtcaa

SEQ ID NO: 352578 - DNA, 25 bp, Rattus norvegicus
gagtcagatggccttgatgcccttt

SEQ ID NO: 352579 - DNA, 25 bp, Rattus norvegicus
gagtcagatggcgttgatgcccttt

SEQ ID NO: 352580 - DNA, 25 bp, Rattus norvegicus
gagtcagatgttcgaggcccctctg

SEQ ID NO: 352581 - DNA, 25 bp, Rattus norvegicus
gagtcagatgttggaggcccctctg

SEQ ID NO: 352582 - DNA, 25 bp, Rattus norvegicus
gagtcagcaaatatgggccacaccc

SEQ ID NO: 352583 - DNA, 25 bp, Rattus norvegicus
gagtcagcaaatttgggccacaccc

SEQ ID NO: 352584 - DNA, 25 bp, Rattus norvegicus
gagtcagcaagaatactacccctat

SEQ ID NO: 352585 - DNA, 25 bp, Rattus norvegicus
gagtcagcaagattactacccctat

SEQ ID NO: 352586 - DNA, 25 bp, Rattus norvegicus
gagtcagcacagcacagccacttca

SEQ ID NO: 352587 - DNA, 25 bp, Rattus norvegicus
gagtcagcacaggacagccacttca

SEQ ID NO: 352588 - DNA, 25 bp, Rattus norvegicus
gagtcagcaccaactttgaatactt

SEQ ID NO: 352589 - DNA, 25 bp, Rattus norvegicus
gagtcagcaccatctttgaatactt

SEQ ID NO: 352590 - DNA, 25 bp, Rattus norvegicus
gagtcagcactacagttgcccaagt

SEQ ID NO: 352591 - DNA, 25 bp, Rattus norvegicus
gagtcagcactagagttgcccaagt

SEQ ID NO: 352592 - DNA, 25 bp, Rattus norvegicus
gagtcagcactcaaaacttgggatg

SEQ ID NO: 352593 - DNA, 25 bp, Rattus norvegicus
gagtcagcactctaaacttgggatg

SEQ ID NO: 352594 - DNA, 25 bp, Rattus norvegicus
gagtcagcactgacatcatcttcct

SEQ ID NO: 352595 - DNA, 25 bp, Rattus norvegicus
gagtcagcactgtcatcatcttcct

SEQ ID NO: 352596 - DNA, 25 bp, Rattus norvegicus
gagtcagcagtaccttatgtgggat

SEQ ID NO: 352597 - DNA, 25 bp, Rattus norvegicus
gagtcagcagtagcttatgtgggat

SEQ ID NO: 352598 - DNA, 25 bp, Rattus norvegicus
gagtcagcagttaaaggcagagcct

SEQ ID NO: 352599 - DNA, 25 bp, Rattus norvegicus
gagtcagcagttctccattctggaa

SEQ ID NO: 352600 - DNA, 25 bp, Rattus norvegicus
gagtcagcagttgtccattctggaa

SEQ ID NO: 352601 - DNA, 25 bp, Rattus norvegicus
gagtcagcagtttaaggcagagcct

SEQ ID NO: 352602 - DNA, 25 bp, Rattus norvegicus
gagtcagcatccacactcagatcag

SEQ ID NO: 352603 - DNA, 25 bp, Rattus norvegicus
gagtcagcatcctcactcagatcag

SEQ ID NO: 352604 - DNA, 25 bp, Rattus norvegicus
gagtcagcattacagcaagcataat

SEQ ID NO: 352605 - DNA, 25 bp, Rattus norvegicus
gagtcagcattagagcaagcataat

SEQ ID NO: 352606 - DNA, 25 bp, Rattus norvegicus
gagtcagccaatcggcaaatagtct

SEQ ID NO: 352607 - DNA, 25 bp, Rattus norvegicus
gagtcagccaatgggcaaatagtct

SEQ ID NO: 352608 - DNA, 25 bp, Rattus norvegicus
gagtcagccagcaggagtcatatta

SEQ ID NO: 352609 - DNA, 25 bp, Rattus norvegicus
gagtcagccagctggagtcatatta

SEQ ID NO: 352610 - DNA, 25 bp, Rattus norvegicus
gagtcagccatcagggagcatcctg

SEQ ID NO: 352611 - DNA, 25 bp, Rattus norvegicus
gagtcagccatctgggagcatcctg

SEQ ID NO: 352612 - DNA, 25 bp, Rattus norvegicus
gagtcagccgtgagcaacatcttta

SEQ ID NO: 352613 - DNA, 25 bp, Rattus norvegicus
gagtcagccgtgtgcaacatcttta

SEQ ID NO: 352614 - DNA, 25 bp, Rattus norvegicus
gagtcagcctaaattgacctgccca

SEQ ID NO: 352615 - DNA, 25 bp, Rattus norvegicus
gagtcagcctaatttgacctgccca

SEQ ID NO: 352616 - DNA, 25 bp, Rattus norvegicus
gagtcagcctgaagctaaattgaag

SEQ ID NO: 352617 - DNA, 25 bp, Rattus norvegicus
gagtcagcctgatgctaaattgaag

SEQ ID NO: 352618 - DNA, 25 bp, Rattus norvegicus
gagtcagccttcctgtatgccctgt

SEQ ID NO: 352619 - DNA, 25 bp, Rattus norvegicus
gagtcagccttcgtgtatgccctgt

SEQ ID NO: 352620 - DNA, 25 bp, Rattus norvegicus
gagtcagcgactacacatttaaaat

SEQ ID NO: 352621 - DNA, 25 bp, Rattus norvegicus
gagtcagcgacttcacatttaaaat

SEQ ID NO: 352622 - DNA, 25 bp, Rattus norvegicus
gagtcagcgctcatttacatatgca

SEQ ID NO: 352623 - DNA, 25 bp, Rattus norvegicus
gagtcagcgctcttttacatatgca

SEQ ID NO: 352624 - DNA, 25 bp, Rattus norvegicus
gagtcagcgctgacagtgatgtccc

SEQ ID NO: 352625 - DNA, 25 bp, Rattus norvegicus
gagtcagcgctgtcagtgatgtccc

SEQ ID NO: 352626 - DNA, 25 bp, Rattus norvegicus
gagtcagcggcaatcagtaccatca

SEQ ID NO: 352627 - DNA, 25 bp, Rattus norvegicus
gagtcagcggcattcagtaccatca

SEQ ID NO: 352628 - DNA, 25 bp, Rattus norvegicus
gagtcagctcagaaagtacgccaag

SEQ ID NO: 352629 - DNA, 25 bp, Rattus norvegicus
gagtcagctcagcaaccacagctct

SEQ ID NO: 352630 - DNA, 25 bp, Rattus norvegicus
gagtcagctcaggaaccacagctct

SEQ ID NO: 352631 - DNA, 25 bp, Rattus norvegicus
gagtcagctcagtaagtacgccaag

SEQ ID NO: 352632 - DNA, 25 bp, Rattus norvegicus
gagtcagctcatcgttgctgagata

SEQ ID NO: 352633 - DNA, 25 bp, Rattus norvegicus
gagtcagctcatggttgctgagata

SEQ ID NO: 352634 - DNA, 25 bp, Rattus norvegicus
gagtcagctcgcaggccgagaagtt

SEQ ID NO: 352635 - DNA, 25 bp, Rattus norvegicus
gagtcagctcgctggccgagaagtt

SEQ ID NO: 352636 - DNA, 25 bp, Rattus norvegicus
gagtcagctggacagagcctgcaat

SEQ ID NO: 352637 - DNA, 25 bp, Rattus norvegicus
gagtcagctggagagagcctgcaat

SEQ ID NO: 352638 - DNA, 25 bp, Rattus norvegicus
gagtcagctgtacagggccttctga

SEQ ID NO: 352639 - DNA, 25 bp, Rattus norvegicus
gagtcagctgtagagggccttctga

SEQ ID NO: 352640 - DNA, 25 bp, Rattus norvegicus
gagtcagctgtgctatccatgctaa

SEQ ID NO: 352641 - DNA, 25 bp, Rattus norvegicus
gagtcagctgtggtatccatgctaa

SEQ ID NO: 352642 - DNA, 25 bp, Rattus norvegicus
gagtcagcttatctccccgtggtgg

SEQ ID NO: 352643 - DNA, 25 bp, Rattus norvegicus
gagtcagcttatgtccccgtggtgg

SEQ ID NO: 352644 - DNA, 25 bp, Rattus norvegicus
gagtcagcttgtcagatgctccact

SEQ ID NO: 352645 - DNA, 25 bp, Rattus norvegicus
gagtcagcttgtgagatgctccact

SEQ ID NO: 352646 - DNA, 25 bp, Rattus norvegicus
gagtcaggagtcagccagtgttcat

SEQ ID NO: 352647 - DNA, 25 bp, Rattus norvegicus
gagtcaggagtctgccagtgttcat

SEQ ID NO: 352648 - DNA, 25 bp, Rattus norvegicus
gagtcaggatctaactcctatgccc

SEQ ID NO: 352649 - DNA, 25 bp, Rattus norvegicus
gagtcaggatcttactcctatgccc

SEQ ID NO: 352650 - DNA, 25 bp, Rattus norvegicus
gagtcaggatgtcagccatagctta

SEQ ID NO: 352651 - DNA, 25 bp, Rattus norvegicus
gagtcaggatgtgagccatagctta

SEQ ID NO: 352652 - DNA, 25 bp, Rattus norvegicus
gagtcaggattcaccattctcagtg

SEQ ID NO: 352653 - DNA, 25 bp, Rattus norvegicus
gagtcaggattctccattctcagtg

SEQ ID NO: 352654 - DNA, 25 bp, Rattus norvegicus
gagtcaggcactcagcatggtgata

SEQ ID NO: 352655 - DNA, 25 bp, Rattus norvegicus
gagtcaggcactgagcatggtgata

SEQ ID NO: 352656 - DNA, 25 bp, Rattus norvegicus
gagtcaggctgcataattgctaacg

SEQ ID NO: 352657 - DNA, 25 bp, Rattus norvegicus
gagtcaggctgcttaattgctaacg

SEQ ID NO: 352658 - DNA, 25 bp, Rattus norvegicus
gagtcaggctgtctgggttctaatc

SEQ ID NO: 352659 - DNA, 25 bp, Rattus norvegicus
gagtcaggctgtgtgggttctaatc

SEQ ID NO: 352660 - DNA, 25 bp, Rattus norvegicus
gagtcagggactctttcacatgctg

SEQ ID NO: 352661 - DNA, 25 bp, Rattus norvegicus
gagtcagggactgtttcacatgctg

SEQ ID NO: 352662 - DNA, 25 bp, Rattus norvegicus
gagtcagggagtagaacagcagcaa

SEQ ID NO: 352663 - DNA, 25 bp, Rattus norvegicus
gagtcagggagttgaacagcagcaa

SEQ ID NO: 352664 - DNA, 25 bp, Rattus norvegicus
gagtcagggcaaacatcgccactgt

SEQ ID NO: 352665 - DNA, 25 bp, Rattus norvegicus
gagtcagggcaatcatcgccactgt

SEQ ID NO: 352666 - DNA, 25 bp, Rattus norvegicus
gagtcagggcagctcttcatctgca

SEQ ID NO: 352667 - DNA, 25 bp, Rattus norvegicus
gagtcagggcaggtcttcatctgca

SEQ ID NO: 352668 - DNA, 25 bp, Rattus norvegicus
gagtcagggcttatacttacgtcca

SEQ ID NO: 352669 - DNA, 25 bp, Rattus norvegicus
gagtcagggcttttacttacgtcca

SEQ ID NO: 352670 - DNA, 25 bp, Rattus norvegicus
gagtcagggtatctttctgaaattc

SEQ ID NO: 352671 - DNA, 25 bp, Rattus norvegicus
gagtcagggtatgtttctgaaattc

SEQ ID NO: 352672 - DNA, 25 bp, Rattus norvegicus
gagtcaggtaaaatcaagcccggct

SEQ ID NO: 352673 - DNA, 25 bp, Rattus norvegicus
gagtcaggtaaattcaagcccggct

SEQ ID NO: 352674 - DNA, 25 bp, Rattus norvegicus
gagtcaggtctgagtaccagtcaca

SEQ ID NO: 352675 - DNA, 25 bp, Rattus norvegicus
gagtcaggtctgtgtaccagtcaca

SEQ ID NO: 352676 - DNA, 25 bp, Rattus norvegicus
gagtcaggtgataactctcccaacc

SEQ ID NO: 352677 - DNA, 25 bp, Rattus norvegicus
gagtcaggtgattactctcccaacc

SEQ ID NO: 352678 - DNA, 25 bp, Rattus norvegicus
gagtcaggtttcctgtactgcctgc

SEQ ID NO: 352679 - DNA, 25 bp, Rattus norvegicus
gagtcaggtttcgtgtactgcctgc

SEQ ID NO: 352680 - DNA, 25 bp, Rattus norvegicus
gagtcaggttttcactgtgtagctc

SEQ ID NO: 352681 - DNA, 25 bp, Rattus norvegicus
gagtcaggttttgactgtgtagctc

SEQ ID NO: 352682 - DNA, 25 bp, Rattus norvegicus
gagtcagtagtgcacactctagtta

SEQ ID NO: 352683 - DNA, 25 bp, Rattus norvegicus
gagtcagtagtggacactctagtta

SEQ ID NO: 352684 - DNA, 25 bp, Rattus norvegicus
gagtcagtcaccaggattgtgcaca

SEQ ID NO: 352685 - DNA, 25 bp, Rattus norvegicus
gagtcagtcaccagggtctcaaggg

SEQ ID NO: 352686 - DNA, 25 bp, Rattus norvegicus
gagtcagtcacctggattgtgcaca

SEQ ID NO: 352687 - DNA, 25 bp, Rattus norvegicus
gagtcagtcacctgggtctcaaggg

SEQ ID NO: 352688 - DNA, 25 bp, Rattus norvegicus
gagtcagtcattatccagaccataa

SEQ ID NO: 352689 - DNA, 25 bp, Rattus norvegicus
gagtcagtcattttccagaccataa

SEQ ID NO: 352690 - DNA, 25 bp, Rattus norvegicus
gagtcagtcgcaaggcatccagcag

SEQ ID NO: 352691 - DNA, 25 bp, Rattus norvegicus
gagtcagtcgcatggcatccagcag

SEQ ID NO: 352692 - DNA, 25 bp, Rattus norvegicus
gagtcagtctgtctgtcgagcccgc

SEQ ID NO: 352693 - DNA, 25 bp, Rattus norvegicus
gagtcagtctgtgtgtcgagcccgc

SEQ ID NO: 352694 - DNA, 25 bp, Rattus norvegicus
gagtcagtgcttaggttcgagagta

SEQ ID NO: 352695 - DNA, 25 bp, Rattus norvegicus
gagtcagtgctttggttcgagagta

SEQ ID NO: 352696 - DNA, 25 bp, Rattus norvegicus
gagtcagtgtcaatacctggaatgc

SEQ ID NO: 352697 - DNA, 25 bp, Rattus norvegicus
gagtcagtgtcattacctggaatgc

SEQ ID NO: 352698 - DNA, 25 bp, Rattus norvegicus
gagtcagtgtgtcatttcagtttaa

SEQ ID NO: 352699 - DNA, 25 bp, Rattus norvegicus
gagtcagtgtgtgatttcagtttaa

SEQ ID NO: 352700 - DNA, 25 bp, Rattus norvegicus
gagtcagttaaaagagagatcctaa

SEQ ID NO: 352701 - DNA, 25 bp, Rattus norvegicus
gagtcagttaaatgagagatcctaa

SEQ ID NO: 352702 - DNA, 25 bp, Rattus norvegicus
gagtcagttcatcatctgtgtttca

SEQ ID NO: 352703 - DNA, 25 bp, Rattus norvegicus
gagtcagttcatgatctgtgtttca

SEQ ID NO: 352704 - DNA, 25 bp, Rattus norvegicus
gagtcagtttctaccacagcaggcc

SEQ ID NO: 352705 - DNA, 25 bp, Rattus norvegicus
gagtcagtttcttccacagcaggcc

SEQ ID NO: 352706 - DNA, 25 bp, Rattus norvegicus
gagtcagtttttccggaaccctcct

SEQ ID NO: 352707 - DNA, 25 bp, Rattus norvegicus
gagtcagtttttgcggaaccctcct

SEQ ID NO: 352708 - DNA, 25 bp, Rattus norvegicus
gagtcataaaagaggctgggctagc

SEQ ID NO: 352709 - DNA, 25 bp, Rattus norvegicus
gagtcataaaagtggctgggctagc

SEQ ID NO: 352710 - DNA, 25 bp, Rattus norvegicus
gagtcataactcaggtggcctctat

SEQ ID NO: 352711 - DNA, 25 bp, Rattus norvegicus
gagtcataactctggtggcctctat

SEQ ID NO: 352712 - DNA, 25 bp, Rattus norvegicus
gagtcataagcaacctagcatctat

SEQ ID NO: 352713 - DNA, 25 bp, Rattus norvegicus
gagtcataagcatcctagcatctat

SEQ ID NO: 352714 - DNA, 25 bp, Rattus norvegicus
gagtcataccagcacctggtgcagc

SEQ ID NO: 352715 - DNA, 25 bp, Rattus norvegicus
gagtcataccaggacctggtgcagc

SEQ ID NO: 352716 - DNA, 25 bp, Rattus norvegicus
gagtcatactgcctgagagtcttgg

SEQ ID NO: 352717 - DNA, 25 bp, Rattus norvegicus
gagtcatactgcgtgagagtcttgg

SEQ ID NO: 352718 - DNA, 25 bp, Rattus norvegicus
gagtcatactgtagctactggccca

SEQ ID NO: 352719 - DNA, 25 bp, Rattus norvegicus
gagtcatactgttgctactggccca

SEQ ID NO: 352720 - DNA, 25 bp, Rattus norvegicus
gagtcatagaatcttaccactttaa

SEQ ID NO: 352721 - DNA, 25 bp, Rattus norvegicus
gagtcatagaatgttaccactttaa

SEQ ID NO: 352722 - DNA, 25 bp, Rattus norvegicus
gagtcatagactaggttcttctgtt

SEQ ID NO: 352723 - DNA, 25 bp, Rattus norvegicus
gagtcatagacttggttcttctgtt

SEQ ID NO: 352724 - DNA, 25 bp, Rattus norvegicus
gagtcatagctgctggtgtccacac

SEQ ID NO: 352725 - DNA, 25 bp, Rattus norvegicus
gagtcatagctggtggtgtccacac

SEQ ID NO: 352726 - DNA, 25 bp, Rattus norvegicus
gagtcatatgataacagattgctta

SEQ ID NO: 352727 - DNA, 25 bp, Rattus norvegicus
gagtcatatgattacagattgctta

SEQ ID NO: 352728 - DNA, 25 bp, Rattus norvegicus
gagtcatatgttagaacaagcttat

SEQ ID NO: 352729 - DNA, 25 bp, Rattus norvegicus
gagtcatatgtttgaacaagcttat

SEQ ID NO: 352730 - DNA, 25 bp, Rattus norvegicus
gagtcatcaatcattctggtaaatt

SEQ ID NO: 352731 - DNA, 25 bp, Rattus norvegicus
gagtcatcaatctttctggtaaatt

SEQ ID NO: 352732 - DNA, 25 bp, Rattus norvegicus
gagtcatcagttataccacatctat

SEQ ID NO: 352733 - DNA, 25 bp, Rattus norvegicus
gagtcatcagttttaccacatctat

SEQ ID NO: 352734 - DNA, 25 bp, Rattus norvegicus
gagtcatccacgctctggccatgta

SEQ ID NO: 352735 - DNA, 25 bp, Rattus norvegicus
gagtcatccacggtctggccatgta

SEQ ID NO: 352736 - DNA, 25 bp, Rattus norvegicus
gagtcatccagacatcttcattgag

SEQ ID NO: 352737 - DNA, 25 bp, Rattus norvegicus
gagtcatccagagatcttcattgag

SEQ ID NO: 352738 - DNA, 25 bp, Rattus norvegicus
gagtcatcccaaactcttgtttaat

SEQ ID NO: 352739 - DNA, 25 bp, Rattus norvegicus
gagtcatcccaatctcttgtttaat

SEQ ID NO: 352740 - DNA, 25 bp, Rattus norvegicus
gagtcatcccttctcaggagagtat

SEQ ID NO: 352741 - DNA, 25 bp, Rattus norvegicus
gagtcatcccttgtcaggagagtat

SEQ ID NO: 352742 - DNA, 25 bp, Rattus norvegicus
gagtcatccgggactggtttcaaaa

SEQ ID NO: 352743 - DNA, 25 bp, Rattus norvegicus
gagtcatccgggtctggtttcaaaa

SEQ ID NO: 352744 - DNA, 25 bp, Rattus norvegicus
gagtcatcctaacccctgcagaaga

SEQ ID NO: 352745 - DNA, 25 bp, Rattus norvegicus
gagtcatcctaagccctgcagaaga

SEQ ID NO: 352746 - DNA, 25 bp, Rattus norvegicus
gagtcatccttgcacggcctgcaga

SEQ ID NO: 352747 - DNA, 25 bp, Rattus norvegicus
gagtcatccttggacggcctgcaga

SEQ ID NO: 352748 - DNA, 25 bp, Rattus norvegicus
gagtcatcctttattctaggtttca

SEQ ID NO: 352749 - DNA, 25 bp, Rattus norvegicus
gagtcatccttttttctaggtttca

SEQ ID NO: 352750 - DNA, 25 bp, Rattus norvegicus
gagtcatcggaaatttttccctgaa

SEQ ID NO: 352751 - DNA, 25 bp, Rattus norvegicus
gagtcatcggaacacagctttctaa

SEQ ID NO: 352752 - DNA, 25 bp, Rattus norvegicus
gagtcatcggaagacagctttctaa

SEQ ID NO: 352753 - DNA, 25 bp, Rattus norvegicus
gagtcatcggaattttttccctgaa

SEQ ID NO: 352754 - DNA, 25 bp, Rattus norvegicus
gagtcatcgggaattgtgttgcatg

SEQ ID NO: 352755 - DNA, 25 bp, Rattus norvegicus
gagtcatcgggatttgtgttgcatg

SEQ ID NO: 352756 - DNA, 25 bp, Rattus norvegicus
gagtcatcggttaaagtctattcag

SEQ ID NO: 352757 - DNA, 25 bp, Rattus norvegicus
gagtcatcggtttaagtctattcag

SEQ ID NO: 352758 - DNA, 25 bp, Rattus norvegicus
gagtcatcgtctcggttatatgcaa

SEQ ID NO: 352759 - DNA, 25 bp, Rattus norvegicus
gagtcatcgtctgggttatatgcaa

SEQ ID NO: 352760 - DNA, 25 bp, Rattus norvegicus
gagtcatgaatacaggatcccagtt

SEQ ID NO: 352761 - DNA, 25 bp, Rattus norvegicus
gagtcatgaatagaggatcccagtt

SEQ ID NO: 352762 - DNA, 25 bp, Rattus norvegicus
gagtcatgacagatagaacagcaat

SEQ ID NO: 352763 - DNA, 25 bp, Rattus norvegicus
gagtcatgacagttagaacagcaat

SEQ ID NO: 352764 - DNA, 25 bp, Rattus norvegicus
gagtcatgagttagaagcaaccttg

SEQ ID NO: 352765 - DNA, 25 bp, Rattus norvegicus
gagtcatgagtttgaagcaaccttg

SEQ ID NO: 352766 - DNA, 25 bp, Rattus norvegicus
gagtcatgatagagcacctcagttg

SEQ ID NO: 352767 - DNA, 25 bp, Rattus norvegicus
gagtcatgatagtgcacctcagttg

SEQ ID NO: 352768 - DNA, 25 bp, Rattus norvegicus
gagtcatgatctcctcaggatcctc

SEQ ID NO: 352769 - DNA, 25 bp, Rattus norvegicus
gagtcatgatctgctcaggatcctc

SEQ ID NO: 352770 - DNA, 25 bp, Rattus norvegicus
gagtcatgattacctcaccaggtct

SEQ ID NO: 352771 - DNA, 25 bp, Rattus norvegicus
gagtcatgattagctcaccaggtct

SEQ ID NO: 352772 - DNA, 25 bp, Rattus norvegicus
gagtcatgccccacagataaatgag

SEQ ID NO: 352773 - DNA, 25 bp, Rattus norvegicus
gagtcatgcccctcagataaatgag

SEQ ID NO: 352774 - DNA, 25 bp, Rattus norvegicus
gagtcatggaatccatcgccgttaa

SEQ ID NO: 352775 - DNA, 25 bp, Rattus norvegicus
gagtcatggaatgcatcgccgttaa

SEQ ID NO: 352776 - DNA, 25 bp, Rattus norvegicus
gagtcatggcatccctggcacacaa

SEQ ID NO: 352777 - DNA, 25 bp, Rattus norvegicus
gagtcatggcatgcctggcacacaa

SEQ ID NO: 352778 - DNA, 25 bp, Rattus norvegicus
gagtcatggcgtactgaccgtcaat

SEQ ID NO: 352779 - DNA, 25 bp, Rattus norvegicus
gagtcatggcgttctgaccgtcaat

SEQ ID NO: 352780 - DNA, 25 bp, Rattus norvegicus
gagtcatggctgagtccaggttaca

SEQ ID NO: 352781 - DNA, 25 bp, Rattus norvegicus
gagtcatggctgtgtccaggttaca

SEQ ID NO: 352782 - DNA, 25 bp, Rattus norvegicus
gagtcatgtactactcaggcaccat

SEQ ID NO: 352783 - DNA, 25 bp, Rattus norvegicus
gagtcatgtacttctcaggcaccat

SEQ ID NO: 352784 - DNA, 25 bp, Rattus norvegicus
gagtcatgtagacgccagtgttctc

SEQ ID NO: 352785 - DNA, 25 bp, Rattus norvegicus
gagtcatgtagaggccagtgttctc

SEQ ID NO: 352786 - DNA, 25 bp, Rattus norvegicus
gagtcatgtattctccaactcacat

SEQ ID NO: 352787 - DNA, 25 bp, Rattus norvegicus
gagtcatgtattgtccaactcacat

SEQ ID NO: 352788 - DNA, 25 bp, Rattus norvegicus
gagtcatgtcccatgacaggttttt

SEQ ID NO: 352789 - DNA, 25 bp, Rattus norvegicus
gagtcatgtcccttgacaggttttt

SEQ ID NO: 352790 - DNA, 25 bp, Rattus norvegicus
gagtcatgtcttacacttttaagtt

SEQ ID NO: 352791 - DNA, 25 bp, Rattus norvegicus
gagtcatgtctttcacttttaagtt

SEQ ID NO: 352792 - DNA, 25 bp, Rattus norvegicus
gagtcatgttcgagcctagttatca

SEQ ID NO: 352793 - DNA, 25 bp, Rattus norvegicus
gagtcatgttcgtgcctagttatca

SEQ ID NO: 352794 - DNA, 25 bp, Rattus norvegicus
gagtcattaagtccaaccccagaac

SEQ ID NO: 352795 - DNA, 25 bp, Rattus norvegicus
gagtcattaagtgcaaccccagaac

SEQ ID NO: 352796 - DNA, 25 bp, Rattus norvegicus
gagtcattcaccatgaacatatggg

SEQ ID NO: 352797 - DNA, 25 bp, Rattus norvegicus
gagtcattcaccttgaacatatggg

SEQ ID NO: 352798 - DNA, 25 bp, Rattus norvegicus
gagtcattccaacgaattcccttta

SEQ ID NO: 352799 - DNA, 25 bp, Rattus norvegicus
gagtcattccaaggaattcccttta

SEQ ID NO: 352800 - DNA, 25 bp, Rattus norvegicus
gagtcattccagctttgctagtcca

SEQ ID NO: 352801 - DNA, 25 bp, Rattus norvegicus
gagtcattccaggtttgctagtcca

SEQ ID NO: 352802 - DNA, 25 bp, Rattus norvegicus
gagtcattcccacgagtctgttgag

SEQ ID NO: 352803 - DNA, 25 bp, Rattus norvegicus
gagtcattcccaggagtctgttgag

SEQ ID NO: 352804 - DNA, 25 bp, Rattus norvegicus
gagtcattcctacgccctaatgcag

SEQ ID NO: 352805 - DNA, 25 bp, Rattus norvegicus
gagtcattcctaggccctaatgcag

SEQ ID NO: 352806 - DNA, 25 bp, Rattus norvegicus
gagtcattcctgagcccttggagga

SEQ ID NO: 352807 - DNA, 25 bp, Rattus norvegicus
gagtcattcctgtgcccttggagga

SEQ ID NO: 352808 - DNA, 25 bp, Rattus norvegicus
gagtcattctcgatgccagcaatct

SEQ ID NO: 352809 - DNA, 25 bp, Rattus norvegicus
gagtcattctcgttgccagcaatct

SEQ ID NO: 352810 - DNA, 25 bp, Rattus norvegicus
gagtcattgactatgatggcggccg

SEQ ID NO: 352811 - DNA, 25 bp, Rattus norvegicus
gagtcattgactttgatggcggccg

SEQ ID NO: 352812 - DNA, 25 bp, Rattus norvegicus
gagtcattgcaccttaaccatatta

SEQ ID NO: 352813 - DNA, 25 bp, Rattus norvegicus
gagtcattgcacgttaaccatatta

SEQ ID NO: 352814 - DNA, 25 bp, Rattus norvegicus
gagtcattgccaataccgaggctat

SEQ ID NO: 352815 - DNA, 25 bp, Rattus norvegicus
gagtcattgccattaccgaggctat

SEQ ID NO: 352816 - DNA, 25 bp, Rattus norvegicus
gagtcattgctgctagaatcggtct

SEQ ID NO: 352817 - DNA, 25 bp, Rattus norvegicus
gagtcattgctggtagaatcggtct

SEQ ID NO: 352818 - DNA, 25 bp, Rattus norvegicus
gagtcattggcaaagcactgctcct

SEQ ID NO: 352819 - DNA, 25 bp, Rattus norvegicus
gagtcattggcatagcactgctcct

SEQ ID NO: 352820 - DNA, 25 bp, Rattus norvegicus
gagtcattgtgcctagtccaggctg

SEQ ID NO: 352821 - DNA, 25 bp, Rattus norvegicus
gagtcattgtgcgtagtccaggctg

SEQ ID NO: 352822 - DNA, 25 bp, Rattus norvegicus
gagtcatttagtcaagaccaccatt

SEQ ID NO: 352823 - DNA, 25 bp, Rattus norvegicus
gagtcatttagtgaagaccaccatt

SEQ ID NO: 352824 - DNA, 25 bp, Rattus norvegicus
gagtcatttcacctggcttgcattc

SEQ ID NO: 352825 - DNA, 25 bp, Rattus norvegicus
gagtcatttcacgtggcttgcattc

SEQ ID NO: 352826 - DNA, 25 bp, Rattus norvegicus
gagtcatttccgcatccacacagag

SEQ ID NO: 352827 - DNA, 25 bp, Rattus norvegicus
gagtcatttccggatccacacagag

SEQ ID NO: 352828 - DNA, 25 bp, Rattus norvegicus
gagtcatttcctctgctcgtgagac

SEQ ID NO: 352829 - DNA, 25 bp, Rattus norvegicus
gagtcatttcctgtgctcgtgagac

SEQ ID NO: 352830 - DNA, 25 bp, Rattus norvegicus
gagtcatttcggaggcctctgtata

SEQ ID NO: 352831 - DNA, 25 bp, Rattus norvegicus
gagtcatttcggtggcctctgtata

SEQ ID NO: 352832 - DNA, 25 bp, Rattus norvegicus
gagtcatttctgcacctctaaataa

SEQ ID NO: 352833 - DNA, 25 bp, Rattus norvegicus
gagtcatttctggacctctaaataa

SEQ ID NO: 352834 - DNA, 25 bp, Rattus norvegicus
gagtcatttgacagacaatttcgaa

SEQ ID NO: 352835 - DNA, 25 bp, Rattus norvegicus
gagtcatttgactgacaatttcgaa

SEQ ID NO: 352836 - DNA, 25 bp, Rattus norvegicus
gagtcattttcactgtcatatttaa

SEQ ID NO: 352837 - DNA, 25 bp, Rattus norvegicus
gagtcattttcagtgtcatatttaa

SEQ ID NO: 352838 - DNA, 25 bp, Rattus norvegicus
gagtcattttccagtcatatctatg

SEQ ID NO: 352839 - DNA, 25 bp, Rattus norvegicus
gagtcattttcctgtcatatctatg

SEQ ID NO: 352840 - DNA, 25 bp, Rattus norvegicus
gagtccaaagtaccctgctgctgaa

SEQ ID NO: 352841 - DNA, 25 bp, Rattus norvegicus
gagtccaaagtagcctgctgctgaa

SEQ ID NO: 352842 - DNA, 25 bp, Rattus norvegicus
gagtccaaatagacatgcacacaca

SEQ ID NO: 352843 - DNA, 25 bp, Rattus norvegicus
gagtccaaatagtcatgcacacaca

SEQ ID NO: 352844 - DNA, 25 bp, Rattus norvegicus
gagtccaaccatcagcttgtacaaa

SEQ ID NO: 352845 - DNA, 25 bp, Rattus norvegicus
gagtccaaccatgagcttgtacaaa

SEQ ID NO: 352846 - DNA, 25 bp, Rattus norvegicus
gagtccaaccggctgtgaactgcac

SEQ ID NO: 352847 - DNA, 25 bp, Rattus norvegicus
gagtccaaccgggtgtgaactgcac

SEQ ID NO: 352848 - DNA, 25 bp, Rattus norvegicus
gagtccaagacacaatgttcgaaca

SEQ ID NO: 352849 - DNA, 25 bp, Rattus norvegicus
gagtccaagacagaatgttcgaaca

SEQ ID NO: 352850 - DNA, 25 bp, Rattus norvegicus
gagtccaaggacagcaaatgtctat

SEQ ID NO: 352851 - DNA, 25 bp, Rattus norvegicus
gagtccaaggactgcaaatgtctat

SEQ ID NO: 352852 - DNA, 25 bp, Rattus norvegicus
gagtccaagttaccattcctgtatc

SEQ ID NO: 352853 - DNA, 25 bp, Rattus norvegicus
gagtccaagttagcattcctgtatc

SEQ ID NO: 352854 - DNA, 25 bp, Rattus norvegicus
gagtccaatcccagggactgacatg

SEQ ID NO: 352855 - DNA, 25 bp, Rattus norvegicus
gagtccaatccctgggactgacatg

SEQ ID NO: 352856 - DNA, 25 bp, Rattus norvegicus
gagtccaatggaaaccagtccactg

SEQ ID NO: 352857 - DNA, 25 bp, Rattus norvegicus
gagtccaatggataccagtccactg

SEQ ID NO: 352858 - DNA, 25 bp, Rattus norvegicus
gagtccacacacattcgttttagac

SEQ ID NO: 352859 - DNA, 25 bp, Rattus norvegicus
gagtccacacactttcgttttagac

SEQ ID NO: 352860 - DNA, 25 bp, Rattus norvegicus
gagtccacagtacgtcgcttgtcaa

SEQ ID NO: 352861 - DNA, 25 bp, Rattus norvegicus
gagtccacagtaggtcgcttgtcaa

SEQ ID NO: 352862 - DNA, 25 bp, Rattus norvegicus
gagtccaccaccagctgatgaaaaa

SEQ ID NO: 352863 - DNA, 25 bp, Rattus norvegicus
gagtccaccacctgctgatgaaaaa

SEQ ID NO: 352864 - DNA, 25 bp, Rattus norvegicus
gagtccacccatcaagctgactaaa

SEQ ID NO: 352865 - DNA, 25 bp, Rattus norvegicus
gagtccacccatgaagctgactaaa

SEQ ID NO: 352866 - DNA, 25 bp, Rattus norvegicus
gagtccaccgcacttaagccagagg

SEQ ID NO: 352867 - DNA, 25 bp, Rattus norvegicus
gagtccaccgcagttaagccagagg

SEQ ID NO: 352868 - DNA, 25 bp, Rattus norvegicus
gagtccacggtgcaccgagcccaag

SEQ ID NO: 352869 - DNA, 25 bp, Rattus norvegicus
gagtccacggtggaccgagcccaag

SEQ ID NO: 352870 - DNA, 25 bp, Rattus norvegicus
gagtccacgtgcacgccgaaaatta

SEQ ID NO: 352871 - DNA, 25 bp, Rattus norvegicus
gagtccacgtgctcgccgaaaatta

SEQ ID NO: 352872 - DNA, 25 bp, Rattus norvegicus
gagtccactatcatggatttggatt

SEQ ID NO: 352873 - DNA, 25 bp, Rattus norvegicus
gagtccactatcttggatttggatt

SEQ ID NO: 352874 - DNA, 25 bp, Rattus norvegicus
gagtccagaaatacaagacccgcct

SEQ ID NO: 352875 - DNA, 25 bp, Rattus norvegicus
gagtccagaaattcaagacccgcct

SEQ ID NO: 352876 - DNA, 25 bp, Rattus norvegicus
gagtccagaacacctgttcactgat

SEQ ID NO: 352877 - DNA, 25 bp, Rattus norvegicus
gagtccagaacagctgttcactgat

SEQ ID NO: 352878 - DNA, 25 bp, Rattus norvegicus
gagtccagaatgacactcttgtgtt

SEQ ID NO: 352879 - DNA, 25 bp, Rattus norvegicus
gagtccagaatgtcactcttgtgtt

SEQ ID NO: 352880 - DNA, 25 bp, Rattus norvegicus
gagtccagaccgaagacgccgatga

SEQ ID NO: 352881 - DNA, 25 bp, Rattus norvegicus
gagtccagaccgtagacgccgatga

SEQ ID NO: 352882 - DNA, 25 bp, Rattus norvegicus
gagtccagacttcaacaaatcagag

SEQ ID NO: 352883 - DNA, 25 bp, Rattus norvegicus
gagtccagacttgaacaaatcagag

SEQ ID NO: 352884 - DNA, 25 bp, Rattus norvegicus
gagtccagagacctaactttatacc

SEQ ID NO: 352885 - DNA, 25 bp, Rattus norvegicus
gagtccagagacctgattggcagca

SEQ ID NO: 352886 - DNA, 25 bp, Rattus norvegicus
gagtccagagacgtaactttatacc

SEQ ID NO: 352887 - DNA, 25 bp, Rattus norvegicus
gagtccagagacgtgattggcagca

SEQ ID NO: 352888 - DNA, 25 bp, Rattus norvegicus
gagtccagatccacaaaatggcagt

SEQ ID NO: 352889 - DNA, 25 bp, Rattus norvegicus
gagtccagatcctcaaaatggcagt

SEQ ID NO: 352890 - DNA, 25 bp, Rattus norvegicus
gagtccagatctctatccaaagcta

SEQ ID NO: 352891 - DNA, 25 bp, Rattus norvegicus
gagtccagatctgtatccaaagcta

SEQ ID NO: 352892 - DNA, 25 bp, Rattus norvegicus
gagtccagcaagaggctgtttctaa

SEQ ID NO: 352893 - DNA, 25 bp, Rattus norvegicus
gagtccagcaagtggctgtttctaa

SEQ ID NO: 352894 - DNA, 25 bp, Rattus norvegicus
gagtccagcaatatgtgggttcccg

SEQ ID NO: 352895 - DNA, 25 bp, Rattus norvegicus
gagtccagcaatttgtgggttcccg

SEQ ID NO: 352896 - DNA, 25 bp, Rattus norvegicus
gagtccagccaaagggtccagaata

SEQ ID NO: 352897 - DNA, 25 bp, Rattus norvegicus
gagtccagccaatgggtccagaata

SEQ ID NO: 352898 - DNA, 25 bp, Rattus norvegicus
gagtccagccccaagtcatggatag

SEQ ID NO: 352899 - DNA, 25 bp, Rattus norvegicus
gagtccagcccctagtcatggatag

SEQ ID NO: 352900 - DNA, 25 bp, Rattus norvegicus
gagtccagccttaccaacatggtat

SEQ ID NO: 352901 - DNA, 25 bp, Rattus norvegicus
gagtccagcctttccaacatggtat

SEQ ID NO: 352902 - DNA, 25 bp, Rattus norvegicus
gagtccagcgttaatcggtgacccc

SEQ ID NO: 352903 - DNA, 25 bp, Rattus norvegicus
gagtccagcgtttatcggtgacccc

SEQ ID NO: 352904 - DNA, 25 bp, Rattus norvegicus
gagtccagctctatcatgtttcaaa

SEQ ID NO: 352905 - DNA, 25 bp, Rattus norvegicus
gagtccagctctttcatgtttcaaa

SEQ ID NO: 352906 - DNA, 25 bp, Rattus norvegicus
gagtccagggctctcagaccagaag

SEQ ID NO: 352907 - DNA, 25 bp, Rattus norvegicus
gagtccagggctgtcagaccagaag

SEQ ID NO: 352908 - DNA, 25 bp, Rattus norvegicus
gagtccaggtctcctttcacaaaaa

SEQ ID NO: 352909 - DNA, 25 bp, Rattus norvegicus
gagtccaggtctgctttcacaaaaa

SEQ ID NO: 352910 - DNA, 25 bp, Rattus norvegicus
gagtccagtaagaccgtagccccat

SEQ ID NO: 352911 - DNA, 25 bp, Rattus norvegicus
gagtccagtaagtccgtagccccat

SEQ ID NO: 352912 - DNA, 25 bp, Rattus norvegicus
gagtccagtcgaagatgtattctat

SEQ ID NO: 352913 - DNA, 25 bp, Rattus norvegicus
gagtccagtcgaagattggctcctt

SEQ ID NO: 352914 - DNA, 25 bp, Rattus norvegicus
gagtccagtcgatgatgtattctat

SEQ ID NO: 352915 - DNA, 25 bp, Rattus norvegicus
gagtccagtcgatgattggctcctt

SEQ ID NO: 352916 - DNA, 25 bp, Rattus norvegicus
gagtccagtgtactatccgtccgtg

SEQ ID NO: 352917 - DNA, 25 bp, Rattus norvegicus
gagtccagtgtagtatccgtccgtg

SEQ ID NO: 352918 - DNA, 25 bp, Rattus norvegicus
gagtccagttggcataatcccagct

SEQ ID NO: 352919 - DNA, 25 bp, Rattus norvegicus
gagtccagttgggataatcccagct

SEQ ID NO: 352920 - DNA, 25 bp, Rattus norvegicus
gagtccagtttcctacatgtctgag

SEQ ID NO: 352921 - DNA, 25 bp, Rattus norvegicus
gagtccagtttcgtacatgtctgag

SEQ ID NO: 352922 - DNA, 25 bp, Rattus norvegicus
gagtccatagcaattgtctgctccc

SEQ ID NO: 352923 - DNA, 25 bp, Rattus norvegicus
gagtccatagcatttgtctgctccc

SEQ ID NO: 352924 - DNA, 25 bp, Rattus norvegicus
gagtccatatcacttaggtccagga

SEQ ID NO: 352925 - DNA, 25 bp, Rattus norvegicus
gagtccatatcagttaggtccagga

SEQ ID NO: 352926 - DNA, 25 bp, Rattus norvegicus
gagtccatcaatcactgtaacacaa

SEQ ID NO: 352927 - DNA, 25 bp, Rattus norvegicus
gagtccatcaatgactgtaacacaa

SEQ ID NO: 352928 - DNA, 25 bp, Rattus norvegicus
gagtccatccaaaactaaccctggg

SEQ ID NO: 352929 - DNA, 25 bp, Rattus norvegicus
gagtccatccaatactaaccctggg

SEQ ID NO: 352930 - DNA, 25 bp, Rattus norvegicus
gagtccatccacatgcaggacaagg

SEQ ID NO: 352931 - DNA, 25 bp, Rattus norvegicus
gagtccatccacttgcaggacaagg

SEQ ID NO: 352932 - DNA, 25 bp, Rattus norvegicus
gagtccatccctctgtgatatacta

SEQ ID NO: 352933 - DNA, 25 bp, Rattus norvegicus
gagtccatccctgtgtgatatacta

SEQ ID NO: 352934 - DNA, 25 bp, Rattus norvegicus
gagtccatcctgaggaagctccagt

SEQ ID NO: 352935 - DNA, 25 bp, Rattus norvegicus
gagtccatcctgtggaagctccagt

SEQ ID NO: 352936 - DNA, 25 bp, Rattus norvegicus
gagtccatgcgaactgccatctgat

SEQ ID NO: 352937 - DNA, 25 bp, Rattus norvegicus
gagtccatgcgatctgccatctgat

SEQ ID NO: 352938 - DNA, 25 bp, Rattus norvegicus
gagtccatgctgctttgacctgatg

SEQ ID NO: 352939 - DNA, 25 bp, Rattus norvegicus
gagtccatgctggtttgacctgatg

SEQ ID NO: 352940 - DNA, 25 bp, Rattus norvegicus
gagtccatgtgtctgctcaggcctg

SEQ ID NO: 352941 - DNA, 25 bp, Rattus norvegicus
gagtccatgtgtgtgctcaggcctg

SEQ ID NO: 352942 - DNA, 25 bp, Rattus norvegicus
gagtccatgtttaggattctcttga

SEQ ID NO: 352943 - DNA, 25 bp, Rattus norvegicus
gagtccatgttttggattctcttga

SEQ ID NO: 352944 - DNA, 25 bp, Rattus norvegicus
gagtccattaatacctatcttcaga

SEQ ID NO: 352945 - DNA, 25 bp, Rattus norvegicus
gagtccattaattcctatcttcaga

SEQ ID NO: 352946 - DNA, 25 bp, Rattus norvegicus
gagtccattcagaacatccgacaga

SEQ ID NO: 352947 - DNA, 25 bp, Rattus norvegicus
gagtccattcagtacatccgacaga

SEQ ID NO: 352948 - DNA, 25 bp, Rattus norvegicus
gagtccattcctctgtaggttgtgc

SEQ ID NO: 352949 - DNA, 25 bp, Rattus norvegicus
gagtccattcctgtgtaggttgtgc

SEQ ID NO: 352950 - DNA, 25 bp, Rattus norvegicus
gagtccattgcaatactgtcttaaa

SEQ ID NO: 352951 - DNA, 25 bp, Rattus norvegicus
gagtccattgcattactgtcttaaa

SEQ ID NO: 352952 - DNA, 25 bp, Rattus norvegicus
gagtccattgtactggctgcacata

SEQ ID NO: 352953 - DNA, 25 bp, Rattus norvegicus
gagtccattgtagtggctgcacata

SEQ ID NO: 352954 - DNA, 25 bp, Rattus norvegicus
gagtcccaagtgaactggttctgta

SEQ ID NO: 352955 - DNA, 25 bp, Rattus norvegicus
gagtcccaagtgtactggttctgta

SEQ ID NO: 352956 - DNA, 25 bp, Rattus norvegicus
gagtcccaatgacgaattccctgaa

SEQ ID NO: 352957 - DNA, 25 bp, Rattus norvegicus
gagtcccaatgaggaattccctgaa

SEQ ID NO: 352958 - DNA, 25 bp, Rattus norvegicus
gagtcccacgcaagaggaagaggct

SEQ ID NO: 352959 - DNA, 25 bp, Rattus norvegicus
gagtcccacgcatgaggaagaggct

SEQ ID NO: 352960 - DNA, 25 bp, Rattus norvegicus
gagtcccacgttaataggcgtctct

SEQ ID NO: 352961 - DNA, 25 bp, Rattus norvegicus
gagtcccacgtttataggcgtctct

SEQ ID NO: 352962 - DNA, 25 bp, Rattus norvegicus
gagtcccactcaaacacactgagga

SEQ ID NO: 352963 - DNA, 25 bp, Rattus norvegicus
gagtcccactcatacacactgagga

SEQ ID NO: 352964 - DNA, 25 bp, Rattus norvegicus
gagtcccacttgaacgtagtgtctt

SEQ ID NO: 352965 - DNA, 25 bp, Rattus norvegicus
gagtcccacttgtacgtagtgtctt

SEQ ID NO: 352966 - DNA, 25 bp, Rattus norvegicus
gagtcccagacacgctttttaccag

SEQ ID NO: 352967 - DNA, 25 bp, Rattus norvegicus
gagtcccagacaggctttttaccag

SEQ ID NO: 352968 - DNA, 25 bp, Rattus norvegicus
gagtcccagcagcagtgggatactt

SEQ ID NO: 352969 - DNA, 25 bp, Rattus norvegicus
gagtcccagcaggagtgggatactt

SEQ ID NO: 352970 - DNA, 25 bp, Rattus norvegicus
gagtcccaggacagcagtgttcttg

SEQ ID NO: 352971 - DNA, 25 bp, Rattus norvegicus
gagtcccaggactgcagtgttcttg

SEQ ID NO: 352972 - DNA, 25 bp, Rattus norvegicus
gagtcccaggatcttggagttgcta

SEQ ID NO: 352973 - DNA, 25 bp, Rattus norvegicus
gagtcccaggatgttggagttgcta

SEQ ID NO: 352974 - DNA, 25 bp, Rattus norvegicus
gagtcccagggaaccaatatcctca

SEQ ID NO: 352975 - DNA, 25 bp, Rattus norvegicus
gagtcccagggatccaatatcctca

SEQ ID NO: 352976 - DNA, 25 bp, Rattus norvegicus
gagtcccagttaatcttctaaatag

SEQ ID NO: 352977 - DNA, 25 bp, Rattus norvegicus
gagtcccagttattcttctaaatag

SEQ ID NO: 352978 - DNA, 25 bp, Rattus norvegicus
gagtcccagttcagttctgtggaaa

SEQ ID NO: 352979 - DNA, 25 bp, Rattus norvegicus
gagtcccagttctgttctgtggaaa

SEQ ID NO: 352980 - DNA, 25 bp, Rattus norvegicus
gagtcccatcccatctttagaactt

SEQ ID NO: 352981 - DNA, 25 bp, Rattus norvegicus
gagtcccatcccttctttagaactt

SEQ ID NO: 352982 - DNA, 25 bp, Rattus norvegicus
gagtcccatcctcgtagacaagaca

SEQ ID NO: 352983 - DNA, 25 bp, Rattus norvegicus
gagtcccatcctggtagacaagaca

SEQ ID NO: 352984 - DNA, 25 bp, Rattus norvegicus
gagtcccatttcatctaggtagtgt

SEQ ID NO: 352985 - DNA, 25 bp, Rattus norvegicus
gagtcccatttcttctaggtagtgt

SEQ ID NO: 352986 - DNA, 25 bp, Rattus norvegicus
gagtcccattttcaacgttatcttt

SEQ ID NO: 352987 - DNA, 25 bp, Rattus norvegicus
gagtcccattttgaacgttatcttt

SEQ ID NO: 352988 - DNA, 25 bp, Rattus norvegicus
gagtccccaaagacaccagaaattt

SEQ ID NO: 352989 - DNA, 25 bp, Rattus norvegicus
gagtccccaaagatgtaccatgatg

SEQ ID NO: 352990 - DNA, 25 bp, Rattus norvegicus
gagtccccaaagtcaccagaaattt

SEQ ID NO: 352991 - DNA, 25 bp, Rattus norvegicus
gagtccccaaagttgtaccatgatg

SEQ ID NO: 352992 - DNA, 25 bp, Rattus norvegicus
gagtccccaagaacacagccaaaag

SEQ ID NO: 352993 - DNA, 25 bp, Rattus norvegicus
gagtccccaagatcacagccaaaag

SEQ ID NO: 352994 - DNA, 25 bp, Rattus norvegicus
gagtccccaagtagaacgcacatgt

SEQ ID NO: 352995 - DNA, 25 bp, Rattus norvegicus
gagtccccaagttgaacgcacatgt

SEQ ID NO: 352996 - DNA, 25 bp, Rattus norvegicus
gagtccccatacctacttgcaggag

SEQ ID NO: 352997 - DNA, 25 bp, Rattus norvegicus
gagtccccatacgtacttgcaggag

SEQ ID NO: 352998 - DNA, 25 bp, Rattus norvegicus
gagtccccatgtagactggacggtt

SEQ ID NO: 352999 - DNA, 25 bp, Rattus norvegicus
gagtccccatgttgactggacggtt

SEQ ID NO: 353000 - DNA, 25 bp, Rattus norvegicus
gagtccccattcaacaaacggagaa

SEQ ID NO: 353001 - DNA, 25 bp, Rattus norvegicus
gagtccccattctacaaacggagaa

SEQ ID NO: 353002 - DNA, 25 bp, Rattus norvegicus
gagtccccggcgaatcgtggtccct

SEQ ID NO: 353003 - DNA, 25 bp, Rattus norvegicus
gagtccccggcgtatcgtggtccct

SEQ ID NO: 353004 - DNA, 25 bp, Rattus norvegicus
gagtccccggtgcagtcctgttgtt

SEQ ID NO: 353005 - DNA, 25 bp, Rattus norvegicus
gagtccccggtggagtcctgttgtt

SEQ ID NO: 353006 - DNA, 25 bp, Rattus norvegicus
gagtcccctagcaaagttttctgag

SEQ ID NO: 353007 - DNA, 25 bp, Rattus norvegicus
gagtcccctagctaagttttctgag

SEQ ID NO: 353008 - DNA, 25 bp, Rattus norvegicus
gagtcccctctgagttcatataatg

SEQ ID NO: 353009 - DNA, 25 bp, Rattus norvegicus
gagtcccctctgtgttcatataatg

SEQ ID NO: 353010 - DNA, 25 bp, Rattus norvegicus
gagtcccctcttacaatccaaacta

SEQ ID NO: 353011 - DNA, 25 bp, Rattus norvegicus
gagtcccctctttcaatccaaacta

SEQ ID NO: 353012 - DNA, 25 bp, Rattus norvegicus
gagtcccctgacatcagcaagatta

SEQ ID NO: 353013 - DNA, 25 bp, Rattus norvegicus
gagtcccctgacttcagcaagatta

SEQ ID NO: 353014 - DNA, 25 bp, Rattus norvegicus
gagtcccctttaacttttcaggtca

SEQ ID NO: 353015 - DNA, 25 bp, Rattus norvegicus
gagtcccctttatcttttcaggtca

SEQ ID NO: 353016 - DNA, 25 bp, Rattus norvegicus
gagtcccgagccctttcgaagaagg

SEQ ID NO: 353017 - DNA, 25 bp, Rattus norvegicus
gagtcccgagccgtttcgaagaagg

SEQ ID NO: 353018 - DNA, 25 bp, Rattus norvegicus
gagtcccgaggtcagaccccctgtt

SEQ ID NO: 353019 - DNA, 25 bp, Rattus norvegicus
gagtcccgaggtgagaccccctgtt

SEQ ID NO: 353020 - DNA, 25 bp, Rattus norvegicus
gagtcccggagaccagcacacgtga

SEQ ID NO: 353021 - DNA, 25 bp, Rattus norvegicus
gagtcccggagagcagcacacgtga

SEQ ID NO: 353022 - DNA, 25 bp, Rattus norvegicus
gagtcccggcccacagagacagaaa

SEQ ID NO: 353023 - DNA, 25 bp, Rattus norvegicus
gagtcccggccctcagagacagaaa

SEQ ID NO: 353024 - DNA, 25 bp, Rattus norvegicus
gagtccctagatactgcagaccttg

SEQ ID NO: 353025 - DNA, 25 bp, Rattus norvegicus
gagtccctagattctgcagaccttg

SEQ ID NO: 353026 - DNA, 25 bp, Rattus norvegicus
gagtccctatgccacaggcttgaaa

SEQ ID NO: 353027 - DNA, 25 bp, Rattus norvegicus
gagtccctatgcgacaggcttgaaa

SEQ ID NO: 353028 - DNA, 25 bp, Rattus norvegicus
gagtccctatgtcaatcttgagtct

SEQ ID NO: 353029 - DNA, 25 bp, Rattus norvegicus
gagtccctatgtgaatcttgagtct

SEQ ID NO: 353030 - DNA, 25 bp, Rattus norvegicus
gagtccctcacaaggtgtatgacag

SEQ ID NO: 353031 - DNA, 25 bp, Rattus norvegicus
gagtccctcacatggtgtatgacag

SEQ ID NO: 353032 - DNA, 25 bp, Rattus norvegicus
gagtccctcactaagagtaacatca

SEQ ID NO: 353033 - DNA, 25 bp, Rattus norvegicus
gagtccctcacttagagtaacatca

SEQ ID NO: 353034 - DNA, 25 bp, Rattus norvegicus
gagtccctcagcacttgtttaaagg

SEQ ID NO: 353035 - DNA, 25 bp, Rattus norvegicus
gagtccctcagctcttgtttaaagg

SEQ ID NO: 353036 - DNA, 25 bp, Rattus norvegicus
gagtccctccaacctgttatagatg

SEQ ID NO: 353037 - DNA, 25 bp, Rattus norvegicus
gagtccctccaagctgttatagatg

SEQ ID NO: 353038 - DNA, 25 bp, Rattus norvegicus
gagtccctccacatttgtaagcaga

SEQ ID NO: 353039 - DNA, 25 bp, Rattus norvegicus
gagtccctccacttttgtaagcaga

SEQ ID NO: 353040 - DNA, 25 bp, Rattus norvegicus
gagtccctccatcgctggaacaaag

SEQ ID NO: 353041 - DNA, 25 bp, Rattus norvegicus
gagtccctccatggctggaacaaag

SEQ ID NO: 353042 - DNA, 25 bp, Rattus norvegicus
gagtccctctgcatggacagattca

SEQ ID NO: 353043 - DNA, 25 bp, Rattus norvegicus
gagtccctctgcttggacagattca

SEQ ID NO: 353044 - DNA, 25 bp, Rattus norvegicus
gagtccctctggaagtggagctgtt

SEQ ID NO: 353045 - DNA, 25 bp, Rattus norvegicus
gagtccctctggtagtggagctgtt

SEQ ID NO: 353046 - DNA, 25 bp, Rattus norvegicus
gagtccctgaacacacgtacagagg

SEQ ID NO: 353047 - DNA, 25 bp, Rattus norvegicus
gagtccctgaactcacgtacagagg

SEQ ID NO: 353048 - DNA, 25 bp, Rattus norvegicus
gagtccctgaatcaatctcatccta

SEQ ID NO: 353049 - DNA, 25 bp, Rattus norvegicus
gagtccctgaatgaatctcatccta

SEQ ID NO: 353050 - DNA, 25 bp, Rattus norvegicus
gagtccctgacgagattaaggaaca

SEQ ID NO: 353051 - DNA, 25 bp, Rattus norvegicus
gagtccctgacgtgattaaggaaca

SEQ ID NO: 353052 - DNA, 25 bp, Rattus norvegicus
gagtccctgagccaagcaagcttac

SEQ ID NO: 353053 - DNA, 25 bp, Rattus norvegicus
gagtccctgagcgaagcaagcttac

SEQ ID NO: 353054 - DNA, 25 bp, Rattus norvegicus
gagtccctgccaagcattgaagggt

SEQ ID NO: 353055 - DNA, 25 bp, Rattus norvegicus
gagtccctgccatgcattgaagggt

SEQ ID NO: 353056 - DNA, 25 bp, Rattus norvegicus
gagtccctgctcaaggtctaaaact

SEQ ID NO: 353057 - DNA, 25 bp, Rattus norvegicus
gagtccctgctcagaaacttactgt

SEQ ID NO: 353058 - DNA, 25 bp, Rattus norvegicus
gagtccctgctctaggtctaaaact

SEQ ID NO: 353059 - DNA, 25 bp, Rattus norvegicus
gagtccctgctctgaaacttactgt

SEQ ID NO: 353060 - DNA, 25 bp, Rattus norvegicus
gagtccctggaactgtagttacaca

SEQ ID NO: 353061 - DNA, 25 bp, Rattus norvegicus
gagtccctggaagtgtagttacaca

SEQ ID NO: 353062 - DNA, 25 bp, Rattus norvegicus
gagtccctgtgtatgagcctccagg

SEQ ID NO: 353063 - DNA, 25 bp, Rattus norvegicus
gagtccctgtgtttgagcctccagg

SEQ ID NO: 353064 - DNA, 25 bp, Rattus norvegicus
gagtcccttacaactaacatcaata

SEQ ID NO: 353065 - DNA, 25 bp, Rattus norvegicus
gagtcccttacatctaacatcaata

SEQ ID NO: 353066 - DNA, 25 bp, Rattus norvegicus
gagtcccttagcaacccaggctgac

SEQ ID NO: 353067 - DNA, 25 bp, Rattus norvegicus
gagtcccttagctacccaggctgac

SEQ ID NO: 353068 - DNA, 25 bp, Rattus norvegicus
gagtcccttccactattttgtgtaa

SEQ ID NO: 353069 - DNA, 25 bp, Rattus norvegicus
gagtcccttccagtattttgtgtaa

SEQ ID NO: 353070 - DNA, 25 bp, Rattus norvegicus
gagtcccttgatatttacctatgca

SEQ ID NO: 353071 - DNA, 25 bp, Rattus norvegicus
gagtcccttgatttttacctatgca

SEQ ID NO: 353072 - DNA, 25 bp, Rattus norvegicus
gagtcccttgtaacttaggaccaga

SEQ ID NO: 353073 - DNA, 25 bp, Rattus norvegicus
gagtcccttgtatcttaggaccaga

SEQ ID NO: 353074 - DNA, 25 bp, Rattus norvegicus
gagtccctttgccataacgacatag

SEQ ID NO: 353075 - DNA, 25 bp, Rattus norvegicus
gagtccctttgcgataacgacatag

SEQ ID NO: 353076 - DNA, 25 bp, Rattus norvegicus
gagtccctttggagatgacatacca

SEQ ID NO: 353077 - DNA, 25 bp, Rattus norvegicus
gagtccctttggtgatgacatacca

SEQ ID NO: 353078 - DNA, 25 bp, Rattus norvegicus
gagtccgacgtgcatgaagccccga

SEQ ID NO: 353079 - DNA, 25 bp, Rattus norvegicus
gagtccgacgtggatgaagccccga

SEQ ID NO: 353080 - DNA, 25 bp, Rattus norvegicus
gagtccgaggtgatccatgcgtgca

SEQ ID NO: 353081 - DNA, 25 bp, Rattus norvegicus
gagtccgaggtgttccatgcgtgca

SEQ ID NO: 353082 - DNA, 25 bp, Rattus norvegicus
gagtccgagtccagctccaggagga

SEQ ID NO: 353083 - DNA, 25 bp, Rattus norvegicus
gagtccgagtcctgctccaggagga

SEQ ID NO: 353084 - DNA, 25 bp, Rattus norvegicus
gagtccgatcctcaaactagttcga

SEQ ID NO: 353085 - DNA, 25 bp, Rattus norvegicus
gagtccgatcctgaaactagttcga

SEQ ID NO: 353086 - DNA, 25 bp, Rattus norvegicus
gagtccgcattcctttccaaaagga

SEQ ID NO: 353087 - DNA, 25 bp, Rattus norvegicus
gagtccgcattcgtttccaaaagga

SEQ ID NO: 353088 - DNA, 25 bp, Rattus norvegicus
gagtccgcgactccagtgtatacaa

SEQ ID NO: 353089 - DNA, 25 bp, Rattus norvegicus
gagtccgcgactgcagtgtatacaa

SEQ ID NO: 353090 - DNA, 25 bp, Rattus norvegicus
gagtccggaactccaacgagcttct

SEQ ID NO: 353091 - DNA, 25 bp, Rattus norvegicus
gagtccggaactgcaacgagcttct

SEQ ID NO: 353092 - DNA, 25 bp, Rattus norvegicus
gagtccggctaccactaagggacaa

SEQ ID NO: 353093 - DNA, 25 bp, Rattus norvegicus
gagtccggctacgactaagggacaa

SEQ ID NO: 353094 - DNA, 25 bp, Rattus norvegicus
gagtccgggaacacaacaagcctgc

SEQ ID NO: 353095 - DNA, 25 bp, Rattus norvegicus
gagtccgggaactcaacaagcctgc

SEQ ID NO: 353096 - DNA, 25 bp, Rattus norvegicus
gagtccgggacgagatccgcatgac

SEQ ID NO: 353097 - DNA, 25 bp, Rattus norvegicus
gagtccgggacgtgatccgcatgac

SEQ ID NO: 353098 - DNA, 25 bp, Rattus norvegicus
gagtccgtagagaaatctatgcaat

SEQ ID NO: 353099 - DNA, 25 bp, Rattus norvegicus
gagtccgtagagtaatctatgcaat

SEQ ID NO: 353100 - DNA, 25 bp, Rattus norvegicus
gagtccgtatgtacaagcgtctgct

SEQ ID NO: 353101 - DNA, 25 bp, Rattus norvegicus
gagtccgtatgttcaagcgtctgct

SEQ ID NO: 353102 - DNA, 25 bp, Rattus norvegicus
gagtccgtcggacaattcagcttct

SEQ ID NO: 353103 - DNA, 25 bp, Rattus norvegicus
gagtccgtcggagaattcagcttct

SEQ ID NO: 353104 - DNA, 25 bp, Rattus norvegicus
gagtccgtggctaacatataacaaa

SEQ ID NO: 353105 - DNA, 25 bp, Rattus norvegicus
gagtccgtggcttacatataacaaa

SEQ ID NO: 353106 - DNA, 25 bp, Rattus norvegicus
gagtccgtgtggcattgaaagcttt

SEQ ID NO: 353107 - DNA, 25 bp, Rattus norvegicus
gagtccgtgtgggattgaaagcttt

SEQ ID NO: 353108 - DNA, 25 bp, Rattus norvegicus
gagtcctaacttaccttcatgatat

SEQ ID NO: 353109 - DNA, 25 bp, Rattus norvegicus
gagtcctaactttccttcatgatat

SEQ ID NO: 353110 - DNA, 25 bp, Rattus norvegicus
gagtcctaagagagctttggccctt

SEQ ID NO: 353111 - DNA, 25 bp, Rattus norvegicus
gagtcctaagagtgctttggccctt

SEQ ID NO: 353112 - DNA, 25 bp, Rattus norvegicus
gagtcctagaatacataattccacc

SEQ ID NO: 353113 - DNA, 25 bp, Rattus norvegicus
gagtcctagaattcataattccacc

SEQ ID NO: 353114 - DNA, 25 bp, Rattus norvegicus
gagtcctaggagacaatgcctggta

SEQ ID NO: 353115 - DNA, 25 bp, Rattus norvegicus
gagtcctaggagtcaatgcctggta

SEQ ID NO: 353116 - DNA, 25 bp, Rattus norvegicus
gagtcctaggatatctagtctctag

SEQ ID NO: 353117 - DNA, 25 bp, Rattus norvegicus
gagtcctaggatttctagtctctag

SEQ ID NO: 353118 - DNA, 25 bp, Rattus norvegicus
gagtcctcacagagtgacgtcggct

SEQ ID NO: 353119 - DNA, 25 bp, Rattus norvegicus
gagtcctcacagtgtgacgtcggct

SEQ ID NO: 353120 - DNA, 25 bp, Rattus norvegicus
gagtcctcactacacttgcaggttt

SEQ ID NO: 353121 - DNA, 25 bp, Rattus norvegicus
gagtcctcactagacttgcaggttt

SEQ ID NO: 353122 - DNA, 25 bp, Rattus norvegicus
gagtcctcagaacttattccatcaa

SEQ ID NO: 353123 - DNA, 25 bp, Rattus norvegicus
gagtcctcagaagttattccatcaa

SEQ ID NO: 353124 - DNA, 25 bp, Rattus norvegicus
gagtcctcagctatgtaacttacca

SEQ ID NO: 353125 - DNA, 25 bp, Rattus norvegicus
gagtcctcagctttgtaacttacca

SEQ ID NO: 353126 - DNA, 25 bp, Rattus norvegicus
gagtcctcaggcagaagacgttcaa

SEQ ID NO: 353127 - DNA, 25 bp, Rattus norvegicus
gagtcctcaggctgaagacgttcaa

SEQ ID NO: 353128 - DNA, 25 bp, Rattus norvegicus
gagtcctcagggacacttggttggc

SEQ ID NO: 353129 - DNA, 25 bp, Rattus norvegicus
gagtcctcagggtcacttggttggc

SEQ ID NO: 353130 - DNA, 25 bp, Rattus norvegicus
gagtcctcagtacactaaatggcag

SEQ ID NO: 353131 - DNA, 25 bp, Rattus norvegicus
gagtcctcagtagactaaatggcag

SEQ ID NO: 353132 - DNA, 25 bp, Rattus norvegicus
gagtcctcagtgaaggctctttgtt

SEQ ID NO: 353133 - DNA, 25 bp, Rattus norvegicus
gagtcctcagtgtaggctctttgtt

SEQ ID NO: 353134 - DNA, 25 bp, Rattus norvegicus
gagtcctcatatcctgtttttgcta

SEQ ID NO: 353135 - DNA, 25 bp, Rattus norvegicus
gagtcctcatatgctgtttttgcta

SEQ ID NO: 353136 - DNA, 25 bp, Rattus norvegicus
gagtcctcattgctacttactacga

SEQ ID NO: 353137 - DNA, 25 bp, Rattus norvegicus
gagtcctcattggtacttactacga

SEQ ID NO: 353138 - DNA, 25 bp, Rattus norvegicus
gagtcctccacaagaccttgtgaat

SEQ ID NO: 353139 - DNA, 25 bp, Rattus norvegicus
gagtcctccacatgaccttgtgaat

SEQ ID NO: 353140 - DNA, 25 bp, Rattus norvegicus
gagtcctccagacagagcaggcagt

SEQ ID NO: 353141 - DNA, 25 bp, Rattus norvegicus
gagtcctccagactgagttctgcaa

SEQ ID NO: 353142 - DNA, 25 bp, Rattus norvegicus
gagtcctccagagagagcaggcagt

SEQ ID NO: 353143 - DNA, 25 bp, Rattus norvegicus
gagtcctccagagtgagttctgcaa

SEQ ID NO: 353144 - DNA, 25 bp, Rattus norvegicus
gagtcctccataccatcatatgcag

SEQ ID NO: 353145 - DNA, 25 bp, Rattus norvegicus
gagtcctccatagcatcatatgcag

SEQ ID NO: 353146 - DNA, 25 bp, Rattus norvegicus
gagtcctccccacagtgttcatggc

SEQ ID NO: 353147 - DNA, 25 bp, Rattus norvegicus
gagtcctccccagagtgttcatggc

SEQ ID NO: 353148 - DNA, 25 bp, Rattus norvegicus
gagtcctccggtatagccttaaatg

SEQ ID NO: 353149 - DNA, 25 bp, Rattus norvegicus
gagtcctccggtttagccttaaatg

SEQ ID NO: 353150 - DNA, 25 bp, Rattus norvegicus
gagtcctccgtgagcaattgcttag

SEQ ID NO: 353151 - DNA, 25 bp, Rattus norvegicus
gagtcctccgtgtgcaattgcttag

SEQ ID NO: 353152 - DNA, 25 bp, Rattus norvegicus
gagtcctcctctcgtattgctgaat

SEQ ID NO: 353153 - DNA, 25 bp, Rattus norvegicus
gagtcctcctctggtattgctgaat

SEQ ID NO: 353154 - DNA, 25 bp, Rattus norvegicus
gagtcctcggagagcaatgcggcct

SEQ ID NO: 353155 - DNA, 25 bp, Rattus norvegicus
gagtcctcggagtgcaatgcggcct

SEQ ID NO: 353156 - DNA, 25 bp, Rattus norvegicus
gagtcctcggtgcacatggttctga

SEQ ID NO: 353157 - DNA, 25 bp, Rattus norvegicus
gagtcctcggtggacatggttctga

SEQ ID NO: 353158 - DNA, 25 bp, Rattus norvegicus
gagtcctctagaatgaggctcccaa

SEQ ID NO: 353159 - DNA, 25 bp, Rattus norvegicus
gagtcctctagattgaggctcccaa

SEQ ID NO: 353160 - DNA, 25 bp, Rattus norvegicus
gagtcctctcaaaatgaccctgaag

SEQ ID NO: 353161 - DNA, 25 bp, Rattus norvegicus
gagtcctctcaatatgaccctgaag

SEQ ID NO: 353162 - DNA, 25 bp, Rattus norvegicus
gagtcctctgacatcagggtcttag

SEQ ID NO: 353163 - DNA, 25 bp, Rattus norvegicus
gagtcctctgacttcagggtcttag

SEQ ID NO: 353164 - DNA, 25 bp, Rattus norvegicus
gagtcctctgtactagtagcatgca

SEQ ID NO: 353165 - DNA, 25 bp, Rattus norvegicus
gagtcctctgtagtagtagcatgca

SEQ ID NO: 353166 - DNA, 25 bp, Rattus norvegicus
gagtcctcttaaatgttaaagcttt

SEQ ID NO: 353167 - DNA, 25 bp, Rattus norvegicus
gagtcctcttaattgttaaagcttt

SEQ ID NO: 353168 - DNA, 25 bp, Rattus norvegicus
gagtcctcttgacgtctgattgtga

SEQ ID NO: 353169 - DNA, 25 bp, Rattus norvegicus
gagtcctcttgaggtctgattgtga

SEQ ID NO: 353170 - DNA, 25 bp, Rattus norvegicus
gagtcctgaaggaagcttattatca

SEQ ID NO: 353171 - DNA, 25 bp, Rattus norvegicus
gagtcctgaaggaagttgtccccaa

SEQ ID NO: 353172 - DNA, 25 bp, Rattus norvegicus
gagtcctgaaggagcagcaccggct

SEQ ID NO: 353173 - DNA, 25 bp, Rattus norvegicus
gagtcctgaaggtagcttattatca

SEQ ID NO: 353174 - DNA, 25 bp, Rattus norvegicus
gagtcctgaaggtagttgtccccaa

SEQ ID NO: 353175 - DNA, 25 bp, Rattus norvegicus
gagtcctgaaggtgcagcaccggct

SEQ ID NO: 353176 - DNA, 25 bp, Rattus norvegicus
gagtcctgactcacattgatcacag

SEQ ID NO: 353177 - DNA, 25 bp, Rattus norvegicus
gagtcctgactctcattgatcacag

SEQ ID NO: 353178 - DNA, 25 bp, Rattus norvegicus
gagtcctgagagacagcgggctctt

SEQ ID NO: 353179 - DNA, 25 bp, Rattus norvegicus
gagtcctgagagtcagcgggctctt

SEQ ID NO: 353180 - DNA, 25 bp, Rattus norvegicus
gagtcctgagggactcctggcacct

SEQ ID NO: 353181 - DNA, 25 bp, Rattus norvegicus
gagtcctgagggtctcctggcacct

SEQ ID NO: 353182 - DNA, 25 bp, Rattus norvegicus
gagtcctgatgacacttccaagtct

SEQ ID NO: 353183 - DNA, 25 bp, Rattus norvegicus
gagtcctgatgagacttccaagtct

SEQ ID NO: 353184 - DNA, 25 bp, Rattus norvegicus
gagtcctgcacaacatcctaaaagt

SEQ ID NO: 353185 - DNA, 25 bp, Rattus norvegicus
gagtcctgcacatcatcctaaaagt

SEQ ID NO: 353186 - DNA, 25 bp, Rattus norvegicus
gagtcctgcatgattccgttagttc

SEQ ID NO: 353187 - DNA, 25 bp, Rattus norvegicus
gagtcctgcatgtttccgttagttc

SEQ ID NO: 353188 - DNA, 25 bp, Rattus norvegicus
gagtcctgccaacatgtctatcggt

SEQ ID NO: 353189 - DNA, 25 bp, Rattus norvegicus
gagtcctgccaagatgtctatcggt

SEQ ID NO: 353190 - DNA, 25 bp, Rattus norvegicus
gagtcctgcctgaaacacaaaattt

SEQ ID NO: 353191 - DNA, 25 bp, Rattus norvegicus
gagtcctgcctgtaacacaaaattt

SEQ ID NO: 353192 - DNA, 25 bp, Rattus norvegicus
gagtcctgcgaaactgaaatgtcat

SEQ ID NO: 353193 - DNA, 25 bp, Rattus norvegicus
gagtcctgcgaatctgaaatgtcat

SEQ ID NO: 353194 - DNA, 25 bp, Rattus norvegicus
gagtcctgcttcatatcatgatgta

SEQ ID NO: 353195 - DNA, 25 bp, Rattus norvegicus
gagtcctgcttcttatcatgatgta

SEQ ID NO: 353196 - DNA, 25 bp, Rattus norvegicus
gagtcctgctttaacagagttcata

SEQ ID NO: 353197 - DNA, 25 bp, Rattus norvegicus
gagtcctgctttaagtcaagtccat

SEQ ID NO: 353198 - DNA, 25 bp, Rattus norvegicus
gagtcctgctttcgtagccatgctg

SEQ ID NO: 353199 - DNA, 25 bp, Rattus norvegicus
gagtcctgctttggtagccatgctg

SEQ ID NO: 353200 - DNA, 25 bp, Rattus norvegicus
gagtcctgcttttacagagttcata

SEQ ID NO: 353201 - DNA, 25 bp, Rattus norvegicus
gagtcctgcttttagtcaagtccat

SEQ ID NO: 353202 - DNA, 25 bp, Rattus norvegicus
gagtcctggagaccgtcatttgtga

SEQ ID NO: 353203 - DNA, 25 bp, Rattus norvegicus
gagtcctggagagcgtcatttgtga

SEQ ID NO: 353204 - DNA, 25 bp, Rattus norvegicus
gagtcctggctaatatttggttcat

SEQ ID NO: 353205 - DNA, 25 bp, Rattus norvegicus
gagtcctggctacattatcatttag

SEQ ID NO: 353206 - DNA, 25 bp, Rattus norvegicus
gagtcctggctagattatcatttag

SEQ ID NO: 353207 - DNA, 25 bp, Rattus norvegicus
gagtcctggctattatttggttcat

SEQ ID NO: 353208 - DNA, 25 bp, Rattus norvegicus
gagtcctgggaactctggcttacaa

SEQ ID NO: 353209 - DNA, 25 bp, Rattus norvegicus
gagtcctgggaagtctggcttacaa

SEQ ID NO: 353210 - DNA, 25 bp, Rattus norvegicus
gagtcctgggatcgcctgaaactta

SEQ ID NO: 353211 - DNA, 25 bp, Rattus norvegicus
gagtcctgggatggcctgaaactta

SEQ ID NO: 353212 - DNA, 25 bp, Rattus norvegicus
gagtcctggtataccaagggatgga

SEQ ID NO: 353213 - DNA, 25 bp, Rattus norvegicus
gagtcctggtattccaagggatgga

SEQ ID NO: 353214 - DNA, 25 bp, Rattus norvegicus
gagtcctgtctgatttacatagtaa

SEQ ID NO: 353215 - DNA, 25 bp, Rattus norvegicus
gagtcctgtctgttttacatagtaa

SEQ ID NO: 353216 - DNA, 25 bp, Rattus norvegicus
gagtcctgtgatagagatcttctta

SEQ ID NO: 353217 - DNA, 25 bp, Rattus norvegicus
gagtcctgtgatagataccagccct

SEQ ID NO: 353218 - DNA, 25 bp, Rattus norvegicus
gagtcctgtgattgagatcttctta

SEQ ID NO: 353219 - DNA, 25 bp, Rattus norvegicus
gagtcctgtgattgataccagccct

SEQ ID NO: 353220 - DNA, 25 bp, Rattus norvegicus
gagtcctgttatcgacaccctccag

SEQ ID NO: 353221 - DNA, 25 bp, Rattus norvegicus
gagtcctgttatggacaccctccag

SEQ ID NO: 353222 - DNA, 25 bp, Rattus norvegicus
gagtcctgttttatattcctccaga

SEQ ID NO: 353223 - DNA, 25 bp, Rattus norvegicus
gagtcctgttttttattcctccaga

SEQ ID NO: 353224 - DNA, 25 bp, Rattus norvegicus
gagtccttaggaactggtgtcatct

SEQ ID NO: 353225 - DNA, 25 bp, Rattus norvegicus
gagtccttaggatctggtgtcatct

SEQ ID NO: 353226 - DNA, 25 bp, Rattus norvegicus
gagtccttattacctaactgcttaa

SEQ ID NO: 353227 - DNA, 25 bp, Rattus norvegicus
gagtccttattagctaactgcttaa

SEQ ID NO: 353228 - DNA, 25 bp, Rattus norvegicus
gagtccttattgacgctgtgcggtc

SEQ ID NO: 353229 - DNA, 25 bp, Rattus norvegicus
gagtccttattgtcgctgtgcggtc

SEQ ID NO: 353230 - DNA, 25 bp, Rattus norvegicus
gagtccttcactcgagcggatctga

SEQ ID NO: 353231 - DNA, 25 bp, Rattus norvegicus
gagtccttcactggagcggatctga

SEQ ID NO: 353232 - DNA, 25 bp, Rattus norvegicus
gagtccttcagcctcgggcagaatg

SEQ ID NO: 353233 - DNA, 25 bp, Rattus norvegicus
gagtccttcagcgtcgggcagaatg

SEQ ID NO: 353234 - DNA, 25 bp, Rattus norvegicus
gagtccttccagactagggagccaa

SEQ ID NO: 353235 - DNA, 25 bp, Rattus norvegicus
gagtccttccagtctagggagccaa

SEQ ID NO: 353236 - DNA, 25 bp, Rattus norvegicus
gagtccttccataacttacatcatg

SEQ ID NO: 353237 - DNA, 25 bp, Rattus norvegicus
gagtccttccattacttacatcatg

SEQ ID NO: 353238 - DNA, 25 bp, Rattus norvegicus
gagtccttcctcaatttaaaacata

SEQ ID NO: 353239 - DNA, 25 bp, Rattus norvegicus
gagtccttcctctatttaaaacata

SEQ ID NO: 353240 - DNA, 25 bp, Rattus norvegicus
gagtccttctctctattggtcagca

SEQ ID NO: 353241 - DNA, 25 bp, Rattus norvegicus
gagtccttctctgtattggtcagca

SEQ ID NO: 353242 - DNA, 25 bp, Rattus norvegicus
gagtccttctttaacacactgatgt

SEQ ID NO: 353243 - DNA, 25 bp, Rattus norvegicus
gagtccttcttttacacactgatgt

SEQ ID NO: 353244 - DNA, 25 bp, Rattus norvegicus
gagtccttgaatcttcctgtttacc

SEQ ID NO: 353245 - DNA, 25 bp, Rattus norvegicus
gagtccttgaatgttcctgtttacc

SEQ ID NO: 353246 - DNA, 25 bp, Rattus norvegicus
gagtccttgagaaagcagcctccgt

SEQ ID NO: 353247 - DNA, 25 bp, Rattus norvegicus
gagtccttgagatagcagcctccgt

SEQ ID NO: 353248 - DNA, 25 bp, Rattus norvegicus
gagtccttggatcagcttcgaaaga

SEQ ID NO: 353249 - DNA, 25 bp, Rattus norvegicus
gagtccttggatgagcttcgaaaga

SEQ ID NO: 353250 - DNA, 25 bp, Rattus norvegicus
gagtccttggctctagctaaccatt

SEQ ID NO: 353251 - DNA, 25 bp, Rattus norvegicus
gagtccttggctgtagctaaccatt

SEQ ID NO: 353252 - DNA, 25 bp, Rattus norvegicus
gagtccttgtaacctcggtgaactt

SEQ ID NO: 353253 - DNA, 25 bp, Rattus norvegicus
gagtccttgtaagctcggtgaactt

SEQ ID NO: 353254 - DNA, 25 bp, Rattus norvegicus
gagtccttgtacacagagctcggaa

SEQ ID NO: 353255 - DNA, 25 bp, Rattus norvegicus
gagtccttgtacagatgtagccctg

SEQ ID NO: 353256 - DNA, 25 bp, Rattus norvegicus
gagtccttgtactcagagctcggaa

SEQ ID NO: 353257 - DNA, 25 bp, Rattus norvegicus
gagtccttgtactgatgtagccctg

SEQ ID NO: 353258 - DNA, 25 bp, Rattus norvegicus
gagtcctttaaacattcattacaaa

SEQ ID NO: 353259 - DNA, 25 bp, Rattus norvegicus
gagtcctttaaagattcattacaaa

SEQ ID NO: 353260 - DNA, 25 bp, Rattus norvegicus
gagtcctttaagaacgtcacagaga

SEQ ID NO: 353261 - DNA, 25 bp, Rattus norvegicus
gagtcctttaagtacgtcacagaga

SEQ ID NO: 353262 - DNA, 25 bp, Rattus norvegicus
gagtcctttactccaaaaagctgca

SEQ ID NO: 353263 - DNA, 25 bp, Rattus norvegicus
gagtcctttactgcaaaaagctgca

SEQ ID NO: 353264 - DNA, 25 bp, Rattus norvegicus
gagtcctttagtcctatgaacttga

SEQ ID NO: 353265 - DNA, 25 bp, Rattus norvegicus
gagtcctttagtgctatgaacttga

SEQ ID NO: 353266 - DNA, 25 bp, Rattus norvegicus
gagtcctttatcacacacatcgtgg

SEQ ID NO: 353267 - DNA, 25 bp, Rattus norvegicus
gagtcctttatctcacacatcgtgg

SEQ ID NO: 353268 - DNA, 25 bp, Rattus norvegicus
gagtcctttcagcaagaacttagcc

SEQ ID NO: 353269 - DNA, 25 bp, Rattus norvegicus
gagtcctttcaggaagaacttagcc

SEQ ID NO: 353270 - DNA, 25 bp, Rattus norvegicus
gagtcctttccaagtgttgcacata

SEQ ID NO: 353271 - DNA, 25 bp, Rattus norvegicus
gagtcctttccatgtgttgcacata

SEQ ID NO: 353272 - DNA, 25 bp, Rattus norvegicus
gagtcctttcgtctatgattgaatc

SEQ ID NO: 353273 - DNA, 25 bp, Rattus norvegicus
gagtcctttcgtgtatgattgaatc

SEQ ID NO: 353274 - DNA, 25 bp, Rattus norvegicus
gagtcctttctgagtgggtgacctg

SEQ ID NO: 353275 - DNA, 25 bp, Rattus norvegicus
gagtcctttctgtgtgggtgacctg

SEQ ID NO: 353276 - DNA, 25 bp, Rattus norvegicus
gagtcctttcttcagctaatgcttg

SEQ ID NO: 353277 - DNA, 25 bp, Rattus norvegicus
gagtcctttcttgagctaatgcttg

SEQ ID NO: 353278 - DNA, 25 bp, Rattus norvegicus
gagtcctttgttatcctacacgaga

SEQ ID NO: 353279 - DNA, 25 bp, Rattus norvegicus
gagtcctttgttttcctacacgaga

SEQ ID NO: 353280 - DNA, 25 bp, Rattus norvegicus
gagtccttttacagtgacagaccac

SEQ ID NO: 353281 - DNA, 25 bp, Rattus norvegicus
gagtccttttactgtgacagaccac

SEQ ID NO: 353282 - DNA, 25 bp, Rattus norvegicus
gagtccttttccattccaacaggca

SEQ ID NO: 353283 - DNA, 25 bp, Rattus norvegicus
gagtccttttcctttccaacaggca

SEQ ID NO: 353284 - DNA, 25 bp, Rattus norvegicus
gagtccttttgccatagatttccca

SEQ ID NO: 353285 - DNA, 25 bp, Rattus norvegicus
gagtccttttgcgatagatttccca

SEQ ID NO: 353286 - DNA, 25 bp, Rattus norvegicus
gagtccttttgtagaccatgagaaa

SEQ ID NO: 353287 - DNA, 25 bp, Rattus norvegicus
gagtccttttgttgaccatgagaaa

SEQ ID NO: 353288 - DNA, 25 bp, Rattus norvegicus
gagtcgaactccatacaatgcacag

SEQ ID NO: 353289 - DNA, 25 bp, Rattus norvegicus
gagtcgaactccttacaatgcacag

SEQ ID NO: 353290 - DNA, 25 bp, Rattus norvegicus
gagtcgaagcacattattttggttg

SEQ ID NO: 353291 - DNA, 25 bp, Rattus norvegicus
gagtcgaagcactttattttggttg

SEQ ID NO: 353292 - DNA, 25 bp, Rattus norvegicus
gagtcgaatcggcaattaaagctgt

SEQ ID NO: 353293 - DNA, 25 bp, Rattus norvegicus
gagtcgaatcgggaattaaagctgt

SEQ ID NO: 353294 - DNA, 25 bp, Rattus norvegicus
gagtcgacactacttcttattcacg

SEQ ID NO: 353295 - DNA, 25 bp, Rattus norvegicus
gagtcgacactagttcttattcacg

SEQ ID NO: 353296 - DNA, 25 bp, Rattus norvegicus
gagtcgacagcgctctgaacctaga

SEQ ID NO: 353297 - DNA, 25 bp, Rattus norvegicus
gagtcgacagcggtctgaacctaga

SEQ ID NO: 353298 - DNA, 25 bp, Rattus norvegicus
gagtcgagatctacggccggatgat

SEQ ID NO: 353299 - DNA, 25 bp, Rattus norvegicus
gagtcgagatcttcggccggatgat

SEQ ID NO: 353300 - DNA, 25 bp, Rattus norvegicus
gagtcgagcccgagcggcgactaca

SEQ ID NO: 353301 - DNA, 25 bp, Rattus norvegicus
gagtcgagcccgtgcggcgactaca

SEQ ID NO: 353302 - DNA, 25 bp, Rattus norvegicus
gagtcgaggcttagcaggtctccat

SEQ ID NO: 353303 - DNA, 25 bp, Rattus norvegicus
gagtcgaggctttgcaggtctccat

SEQ ID NO: 353304 - DNA, 25 bp, Rattus norvegicus
gagtcgatccctagcaaattcatta

SEQ ID NO: 353305 - DNA, 25 bp, Rattus norvegicus
gagtcgatcccttgcaaattcatta

SEQ ID NO: 353306 - DNA, 25 bp, Rattus norvegicus
gagtcgatcgcaacctgagagttta

SEQ ID NO: 353307 - DNA, 25 bp, Rattus norvegicus
gagtcgatcgcatcctgagagttta

SEQ ID NO: 353308 - DNA, 25 bp, Rattus norvegicus
gagtcgatcttcaacatcttgtctt

SEQ ID NO: 353309 - DNA, 25 bp, Rattus norvegicus
gagtcgatcttctacatcttgtctt

SEQ ID NO: 353310 - DNA, 25 bp, Rattus norvegicus
gagtcgatgtacaggcattttcttg

SEQ ID NO: 353311 - DNA, 25 bp, Rattus norvegicus
gagtcgatgtactggcattttcttg

SEQ ID NO: 353312 - DNA, 25 bp, Rattus norvegicus
gagtcgattgagctccgtgttttct

SEQ ID NO: 353313 - DNA, 25 bp, Rattus norvegicus
gagtcgattgaggtccgtgttttct

SEQ ID NO: 353314 - DNA, 25 bp, Rattus norvegicus
gagtcgcaaactaggcctggcatgt

SEQ ID NO: 353315 - DNA, 25 bp, Rattus norvegicus
gagtcgcaaacttggcctggcatgt

SEQ ID NO: 353316 - DNA, 25 bp, Rattus norvegicus
gagtcgcagatgcttctgatccaac

SEQ ID NO: 353317 - DNA, 25 bp, Rattus norvegicus
gagtcgcagatggttctgatccaac

SEQ ID NO: 353318 - DNA, 25 bp, Rattus norvegicus
gagtcgcagtgaagcttgatccaag

SEQ ID NO: 353319 - DNA, 25 bp, Rattus norvegicus
gagtcgcagtgatgcttgatccaag

SEQ ID NO: 353320 - DNA, 25 bp, Rattus norvegicus
gagtcgcattccaagcttagttatt

SEQ ID NO: 353321 - DNA, 25 bp, Rattus norvegicus
gagtcgcattcctagcttagttatt

SEQ ID NO: 353322 - DNA, 25 bp, Rattus norvegicus
gagtcgccacagatttcttgggctg

SEQ ID NO: 353323 - DNA, 25 bp, Rattus norvegicus
gagtcgccacagttttcttgggctg

SEQ ID NO: 353324 - DNA, 25 bp, Rattus norvegicus
gagtcgccactgatttgttagcaac

SEQ ID NO: 353325 - DNA, 25 bp, Rattus norvegicus
gagtcgccactgttttgttagcaac

SEQ ID NO: 353326 - DNA, 25 bp, Rattus norvegicus
gagtcgcccaagcaaccacacaaag

SEQ ID NO: 353327 - DNA, 25 bp, Rattus norvegicus
gagtcgcccaaggaaccacacaaag

SEQ ID NO: 353328 - DNA, 25 bp, Rattus norvegicus
gagtcgccctgacgataggtagccc

SEQ ID NO: 353329 - DNA, 25 bp, Rattus norvegicus
gagtcgccctgaggataggtagccc

SEQ ID NO: 353330 - DNA, 25 bp, Rattus norvegicus
gagtcgcctagacaggaaacctttc

SEQ ID NO: 353331 - DNA, 25 bp, Rattus norvegicus
gagtcgcctagagaggaaacctttc

SEQ ID NO: 353332 - DNA, 25 bp, Rattus norvegicus
gagtcgctcaagatgtatcttgttc

SEQ ID NO: 353333 - DNA, 25 bp, Rattus norvegicus
gagtcgctcaagttgtatcttgttc

SEQ ID NO: 353334 - DNA, 25 bp, Rattus norvegicus
gagtcgctcacgattgacatggatc

SEQ ID NO: 353335 - DNA, 25 bp, Rattus norvegicus
gagtcgctcacgtttgacatggatc

SEQ ID NO: 353336 - DNA, 25 bp, Rattus norvegicus
gagtcgctcagcacgttcgtgactc

SEQ ID NO: 353337 - DNA, 25 bp, Rattus norvegicus
gagtcgctcagctcgttcgtgactc

SEQ ID NO: 353338 - DNA, 25 bp, Rattus norvegicus
gagtcgctgattacaagtccagcct

SEQ ID NO: 353339 - DNA, 25 bp, Rattus norvegicus
gagtcgctgatttcaagtccagcct

SEQ ID NO: 353340 - DNA, 25 bp, Rattus norvegicus
gagtcgctggacacttagcattgtt

SEQ ID NO: 353341 - DNA, 25 bp, Rattus norvegicus
gagtcgctggactcttagcattgtt

SEQ ID NO: 353342 - DNA, 25 bp, Rattus norvegicus
gagtcgctgtgcctgaccgtgaata

SEQ ID NO: 353343 - DNA, 25 bp, Rattus norvegicus
gagtcgctgtgcgtgaccgtgaata

SEQ ID NO: 353344 - DNA, 25 bp, Rattus norvegicus
gagtcgctttcgagatggccctcct

SEQ ID NO: 353345 - DNA, 25 bp, Rattus norvegicus
gagtcgctttcgtgatggccctcct

SEQ ID NO: 353346 - DNA, 25 bp, Rattus norvegicus
gagtcggaagcacctgcgcttgtac

SEQ ID NO: 353347 - DNA, 25 bp, Rattus norvegicus
gagtcggaagcagctgcgcttgtac

SEQ ID NO: 353348 - DNA, 25 bp, Rattus norvegicus
gagtcggaccccatatcatgtgaac

SEQ ID NO: 353349 - DNA, 25 bp, Rattus norvegicus
gagtcggaccccttatcatgtgaac

SEQ ID NO: 353350 - DNA, 25 bp, Rattus norvegicus
gagtcggccaccctatcatcgagat

SEQ ID NO: 353351 - DNA, 25 bp, Rattus norvegicus
gagtcggccaccgtatcatcgagat

SEQ ID NO: 353352 - DNA, 25 bp, Rattus norvegicus
gagtcggcccctaaaggagctaatt

SEQ ID NO: 353353 - DNA, 25 bp, Rattus norvegicus
gagtcggccccttaaggagctaatt

SEQ ID NO: 353354 - DNA, 25 bp, Rattus norvegicus
gagtcggcgagcagctgtctatgta

SEQ ID NO: 353355 - DNA, 25 bp, Rattus norvegicus
gagtcggcgagctgctgtctatgta

SEQ ID NO: 353356 - DNA, 25 bp, Rattus norvegicus
gagtcgggaagacgctgcaccccat

SEQ ID NO: 353357 - DNA, 25 bp, Rattus norvegicus
gagtcgggaagaggctgcaccccat

SEQ ID NO: 353358 - DNA, 25 bp, Rattus norvegicus
gagtcggtcaaaacctgcagaagcc

SEQ ID NO: 353359 - DNA, 25 bp, Rattus norvegicus
gagtcggtcaaatcctgcagaagcc

SEQ ID NO: 353360 - DNA, 25 bp, Rattus norvegicus
gagtcggtcaccaaggaagctttaa

SEQ ID NO: 353361 - DNA, 25 bp, Rattus norvegicus
gagtcggtcacctaggaagctttaa

SEQ ID NO: 353362 - DNA, 25 bp, Rattus norvegicus
gagtcggtccgcctgtgccgggagc

SEQ ID NO: 353363 - DNA, 25 bp, Rattus norvegicus
gagtcggtccgcgtgtgccgggagc

SEQ ID NO: 353364 - DNA, 25 bp, Rattus norvegicus
gagtcggtgggcctctcagcacaaa

SEQ ID NO: 353365 - DNA, 25 bp, Rattus norvegicus
gagtcggtgggcgtctcagcacaaa

SEQ ID NO: 353366 - DNA, 25 bp, Rattus norvegicus
gagtcgtcacccagcagtaatggga

SEQ ID NO: 353367 - DNA, 25 bp, Rattus norvegicus
gagtcgtcaccctgcagtaatggga

SEQ ID NO: 353368 - DNA, 25 bp, Rattus norvegicus
gagtcgtcaggcaaacggtccttca

SEQ ID NO: 353369 - DNA, 25 bp, Rattus norvegicus
gagtcgtcaggctaacggtccttca

SEQ ID NO: 353370 - DNA, 25 bp, Rattus norvegicus
gagtcgtccgaaagcctttctaaag

SEQ ID NO: 353371 - DNA, 25 bp, Rattus norvegicus
gagtcgtccgaatgcctttctaaag

SEQ ID NO: 353372 - DNA, 25 bp, Rattus norvegicus
gagtcgtctgaaacatgcatgatga

SEQ ID NO: 353373 - DNA, 25 bp, Rattus norvegicus
gagtcgtctgaatcatgcatgatga

SEQ ID NO: 353374 - DNA, 25 bp, Rattus norvegicus
gagtcgtctgtgacaagcgagaacc

SEQ ID NO: 353375 - DNA, 25 bp, Rattus norvegicus
gagtcgtctgtgtcaagcgagaacc

SEQ ID NO: 353376 - DNA, 25 bp, Rattus norvegicus
gagtcgtcttcaattttggcagtta

SEQ ID NO: 353377 - DNA, 25 bp, Rattus norvegicus
gagtcgtcttcatttttggcagtta

SEQ ID NO: 353378 - DNA, 25 bp, Rattus norvegicus
gagtcgtcttgacagactcaagagt

SEQ ID NO: 353379 - DNA, 25 bp, Rattus norvegicus
gagtcgtcttgagagactcaagagt

SEQ ID NO: 353380 - DNA, 25 bp, Rattus norvegicus
gagtcgtgacatcttccttcagttc

SEQ ID NO: 353381 - DNA, 25 bp, Rattus norvegicus
gagtcgtgacatgttccttcagttc

SEQ ID NO: 353382 - DNA, 25 bp, Rattus norvegicus
gagtcgtgacttcagtgcgactgaa

SEQ ID NO: 353383 - DNA, 25 bp, Rattus norvegicus
gagtcgtgacttgagtgcgactgaa

SEQ ID NO: 353384 - DNA, 25 bp, Rattus norvegicus
gagtcgtgcttgctgaactgaccag

SEQ ID NO: 353385 - DNA, 25 bp, Rattus norvegicus
gagtcgtgcttggtgaactgaccag

SEQ ID NO: 353386 - DNA, 25 bp, Rattus norvegicus
gagtcgtgggttatcagtcagttga

SEQ ID NO: 353387 - DNA, 25 bp, Rattus norvegicus
gagtcgtgggttttcagtcagttga

SEQ ID NO: 353388 - DNA, 25 bp, Rattus norvegicus
gagtcgtggtatccagacttcagcc

SEQ ID NO: 353389 - DNA, 25 bp, Rattus norvegicus
gagtcgtggtatgcagacttcagcc

SEQ ID NO: 353390 - DNA, 25 bp, Rattus norvegicus
gagtcgtgtggaaaccataccctat

SEQ ID NO: 353391 - DNA, 25 bp, Rattus norvegicus
gagtcgtgtggataccataccctat

SEQ ID NO: 353392 - DNA, 25 bp, Rattus norvegicus
gagtcgtgtttgaattcattctctt

SEQ ID NO: 353393 - DNA, 25 bp, Rattus norvegicus
gagtcgtgtttgtattcattctctt

SEQ ID NO: 353394 - DNA, 25 bp, Rattus norvegicus
gagtcgttcaggaagtcggcaagac

SEQ ID NO: 353395 - DNA, 25 bp, Rattus norvegicus
gagtcgttcaggtagtcggcaagac

SEQ ID NO: 353396 - DNA, 25 bp, Rattus norvegicus
gagtcgttctgactggatcgcctgc

SEQ ID NO: 353397 - DNA, 25 bp, Rattus norvegicus
gagtcgttctgagtggatcgcctgc

SEQ ID NO: 353398 - DNA, 25 bp, Rattus norvegicus
gagtcgttgcataacaatccggcca

SEQ ID NO: 353399 - DNA, 25 bp, Rattus norvegicus
gagtcgttgcattacaatccggcca

SEQ ID NO: 353400 - DNA, 25 bp, Rattus norvegicus
gagtcgttgccacaaagcagccaat

SEQ ID NO: 353401 - DNA, 25 bp, Rattus norvegicus
gagtcgttgccagaaagcagccaat

SEQ ID NO: 353402 - DNA, 25 bp, Rattus norvegicus
gagtcgtttctgctctaagtaacct

SEQ ID NO: 353403 - DNA, 25 bp, Rattus norvegicus
gagtcgtttctggtctaagtaacct

SEQ ID NO: 353404 - DNA, 25 bp, Rattus norvegicus
gagtcgtttttcattcctagggaga

SEQ ID NO: 353405 - DNA, 25 bp, Rattus norvegicus
gagtcgtttttctttcctagggaga

SEQ ID NO: 353406 - DNA, 25 bp, Rattus norvegicus
gagtctaaacaaccatccttgcagt

SEQ ID NO: 353407 - DNA, 25 bp, Rattus norvegicus
gagtctaaacaagcatccttgcagt

SEQ ID NO: 353408 - DNA, 25 bp, Rattus norvegicus
gagtctaaacatatctccctctatc

SEQ ID NO: 353409 - DNA, 25 bp, Rattus norvegicus
gagtctaaacatttctccctctatc

SEQ ID NO: 353410 - DNA, 25 bp, Rattus norvegicus
gagtctaaccagagttcagcagtgt

SEQ ID NO: 353411 - DNA, 25 bp, Rattus norvegicus
gagtctaaccagtgttcagcagtgt

SEQ ID NO: 353412 - DNA, 25 bp, Rattus norvegicus
gagtctaagcctccctgatctgcca

SEQ ID NO: 353413 - DNA, 25 bp, Rattus norvegicus
gagtctaagcctgcctgatctgcca

SEQ ID NO: 353414 - DNA, 25 bp, Rattus norvegicus
gagtctaatctgcaacgtgaggcct

SEQ ID NO: 353415 - DNA, 25 bp, Rattus norvegicus
gagtctaatctggaacgtgaggcct

SEQ ID NO: 353416 - DNA, 25 bp, Rattus norvegicus
gagtctaatggcactgttctttaaa

SEQ ID NO: 353417 - DNA, 25 bp, Rattus norvegicus
gagtctaatggctctgttctttaaa

SEQ ID NO: 353418 - DNA, 25 bp, Rattus norvegicus
gagtctaattatcaggcagccctga

SEQ ID NO: 353419 - DNA, 25 bp, Rattus norvegicus
gagtctaattatgaggcagccctga

SEQ ID NO: 353420 - DNA, 25 bp, Rattus norvegicus
gagtctacaattactgctgcctact

SEQ ID NO: 353421 - DNA, 25 bp, Rattus norvegicus
gagtctacaatttctgctgcctact

SEQ ID NO: 353422 - DNA, 25 bp, Rattus norvegicus
gagtctacagagctctatgccgaag

SEQ ID NO: 353423 - DNA, 25 bp, Rattus norvegicus
gagtctacagaggtctatgccgaag

SEQ ID NO: 353424 - DNA, 25 bp, Rattus norvegicus
gagtctacagctagcctgatggcac

SEQ ID NO: 353425 - DNA, 25 bp, Rattus norvegicus
gagtctacagctataccaagtggat

SEQ ID NO: 353426 - DNA, 25 bp, Rattus norvegicus
gagtctacagcttgcctgatggcac

SEQ ID NO: 353427 - DNA, 25 bp, Rattus norvegicus
gagtctacagctttaccaagtggat

SEQ ID NO: 353428 - DNA, 25 bp, Rattus norvegicus
gagtctacagtaactgtcctgaatt

SEQ ID NO: 353429 - DNA, 25 bp, Rattus norvegicus
gagtctacagtatctgtcctgaatt

SEQ ID NO: 353430 - DNA, 25 bp, Rattus norvegicus
gagtctacagtgatggttctccgaa

SEQ ID NO: 353431 - DNA, 25 bp, Rattus norvegicus
gagtctacagtgttggttctccgaa

SEQ ID NO: 353432 - DNA, 25 bp, Rattus norvegicus
gagtctacagttaaaccaagtggtc

SEQ ID NO: 353433 - DNA, 25 bp, Rattus norvegicus
gagtctacagtttaaccaagtggtc

SEQ ID NO: 353434 - DNA, 25 bp, Rattus norvegicus
gagtctaccaaaatctgccttcagt

SEQ ID NO: 353435 - DNA, 25 bp, Rattus norvegicus
gagtctaccaaattctgccttcagt

SEQ ID NO: 353436 - DNA, 25 bp, Rattus norvegicus
gagtctaccgctctggaaggcaaga

SEQ ID NO: 353437 - DNA, 25 bp, Rattus norvegicus
gagtctaccgctgtggaaggcaaga

SEQ ID NO: 353438 - DNA, 25 bp, Rattus norvegicus
gagtctacctcacgtcgaggccagt

SEQ ID NO: 353439 - DNA, 25 bp, Rattus norvegicus
gagtctacctcaggtcgaggccagt

SEQ ID NO: 353440 - DNA, 25 bp, Rattus norvegicus
gagtctaccttcctttttgtaacat

SEQ ID NO: 353441 - DNA, 25 bp, Rattus norvegicus
gagtctaccttcgtttttgtaacat

SEQ ID NO: 353442 - DNA, 25 bp, Rattus norvegicus
gagtctacgacaactgtgtggccag

SEQ ID NO: 353443 - DNA, 25 bp, Rattus norvegicus
gagtctacgacatctgtgtggccag

SEQ ID NO: 353444 - DNA, 25 bp, Rattus norvegicus
gagtctacggataagcaaccttcca

SEQ ID NO: 353445 - DNA, 25 bp, Rattus norvegicus
gagtctacggattagcaaccttcca

SEQ ID NO: 353446 - DNA, 25 bp, Rattus norvegicus
gagtctactcatacaatacacgcct

SEQ ID NO: 353447 - DNA, 25 bp, Rattus norvegicus
gagtctactcattcaatacacgcct

SEQ ID NO: 353448 - DNA, 25 bp, Rattus norvegicus
gagtctactctgacgtggaaattgt

SEQ ID NO: 353449 - DNA, 25 bp, Rattus norvegicus
gagtctactctgtcgtggaaattgt

SEQ ID NO: 353450 - DNA, 25 bp, Rattus norvegicus
gagtctagaataattccagcctttt

SEQ ID NO: 353451 - DNA, 25 bp, Rattus norvegicus
gagtctagaatatttccagcctttt

SEQ ID NO: 353452 - DNA, 25 bp, Rattus norvegicus
gagtctagactgcaagctgcaagca

SEQ ID NO: 353453 - DNA, 25 bp, Rattus norvegicus
gagtctagactggaagctgcaagca

SEQ ID NO: 353454 - DNA, 25 bp, Rattus norvegicus
gagtctagcaatcatgaagtcatat

SEQ ID NO: 353455 - DNA, 25 bp, Rattus norvegicus
gagtctagcaatgatgaagtcatat

SEQ ID NO: 353456 - DNA, 25 bp, Rattus norvegicus
gagtctagcattccctcaggaaata

SEQ ID NO: 353457 - DNA, 25 bp, Rattus norvegicus
gagtctagcattgcctcaggaaata

SEQ ID NO: 353458 - DNA, 25 bp, Rattus norvegicus
gagtctaggacaaatgcttgtgaaa

SEQ ID NO: 353459 - DNA, 25 bp, Rattus norvegicus
gagtctaggacatatgcttgtgaaa

SEQ ID NO: 353460 - DNA, 25 bp, Rattus norvegicus
gagtctaggatcaaagtgtctgcac

SEQ ID NO: 353461 - DNA, 25 bp, Rattus norvegicus
gagtctaggatctaagtgtctgcac

SEQ ID NO: 353462 - DNA, 25 bp, Rattus norvegicus
gagtctaggcagcatggacacacta

SEQ ID NO: 353463 - DNA, 25 bp, Rattus norvegicus
gagtctaggcaggatggacacacta

SEQ ID NO: 353464 - DNA, 25 bp, Rattus norvegicus
gagtctagtagcacctgaccattgt

SEQ ID NO: 353465 - DNA, 25 bp, Rattus norvegicus
gagtctagtagctcctgaccattgt

SEQ ID NO: 353466 - DNA, 25 bp, Rattus norvegicus
gagtctagtgcaccaatgctgatgt

SEQ ID NO: 353467 - DNA, 25 bp, Rattus norvegicus
gagtctagtgcagcaatgctgatgt

SEQ ID NO: 353468 - DNA, 25 bp, Rattus norvegicus
gagtctagttataaacacccagtca

SEQ ID NO: 353469 - DNA, 25 bp, Rattus norvegicus
gagtctagttattaacacccagtca

SEQ ID NO: 353470 - DNA, 25 bp, Rattus norvegicus
gagtctatacagattgaagccttct

SEQ ID NO: 353471 - DNA, 25 bp, Rattus norvegicus
gagtctatacagtttgaagccttct

SEQ ID NO: 353472 - DNA, 25 bp, Rattus norvegicus
gagtctatatttcctttctcagagc

SEQ ID NO: 353473 - DNA, 25 bp, Rattus norvegicus
gagtctatatttgctttctcagagc

SEQ ID NO: 353474 - DNA, 25 bp, Rattus norvegicus
gagtctatcactaagcagcacgtct

SEQ ID NO: 353475 - DNA, 25 bp, Rattus norvegicus
gagtctatcacttagcagcacgtct

SEQ ID NO: 353476 - DNA, 25 bp, Rattus norvegicus
gagtctatcagaaggccacagcatt

SEQ ID NO: 353477 - DNA, 25 bp, Rattus norvegicus
gagtctatcagatggccacagcatt

SEQ ID NO: 353478 - DNA, 25 bp, Rattus norvegicus
gagtctatcctaattactgcttctg

SEQ ID NO: 353479 - DNA, 25 bp, Rattus norvegicus
gagtctatcctatttactgcttctg

SEQ ID NO: 353480 - DNA, 25 bp, Rattus norvegicus
gagtctatctagaagcccaccaaga

SEQ ID NO: 353481 - DNA, 25 bp, Rattus norvegicus
gagtctatctagtagcccaccaaga

SEQ ID NO: 353482 - DNA, 25 bp, Rattus norvegicus
gagtctatgacgaacctcatctcta

SEQ ID NO: 353483 - DNA, 25 bp, Rattus norvegicus
gagtctatgacgacagctgcaaatc

SEQ ID NO: 353484 - DNA, 25 bp, Rattus norvegicus
gagtctatgacgtacctcatctcta

SEQ ID NO: 353485 - DNA, 25 bp, Rattus norvegicus
gagtctatgacgtcagctgcaaatc

SEQ ID NO: 353486 - DNA, 25 bp, Rattus norvegicus
gagtctatgccccaccaatgctggt

SEQ ID NO: 353487 - DNA, 25 bp, Rattus norvegicus
gagtctatgcccgaccaatgctggt

SEQ ID NO: 353488 - DNA, 25 bp, Rattus norvegicus
gagtctatggaaaggtcctccgacc

SEQ ID NO: 353489 - DNA, 25 bp, Rattus norvegicus
gagtctatggaatggtcctccgacc

SEQ ID NO: 353490 - DNA, 25 bp, Rattus norvegicus
gagtctatggcgagcagtcatcagt

SEQ ID NO: 353491 - DNA, 25 bp, Rattus norvegicus
gagtctatggcgtgcagtcatcagt

SEQ ID NO: 353492 - DNA, 25 bp, Rattus norvegicus
gagtctatgtctctttttacctttc

SEQ ID NO: 353493 - DNA, 25 bp, Rattus norvegicus
gagtctatgtctgtttttacctttc

SEQ ID NO: 353494 - DNA, 25 bp, Rattus norvegicus
gagtctatgttaacctcgtttctag

SEQ ID NO: 353495 - DNA, 25 bp, Rattus norvegicus
gagtctatgttaactaactttcaat

SEQ ID NO: 353496 - DNA, 25 bp, Rattus norvegicus
gagtctatgttatcctcgtttctag

SEQ ID NO: 353497 - DNA, 25 bp, Rattus norvegicus
gagtctatgttatctaactttcaat

SEQ ID NO: 353498 - DNA, 25 bp, Rattus norvegicus
gagtctattggccttttacagggta

SEQ ID NO: 353499 - DNA, 25 bp, Rattus norvegicus
gagtctattggcgttttacagggta

SEQ ID NO: 353500 - DNA, 25 bp, Rattus norvegicus
gagtctattgtccacaaggtcacgg

SEQ ID NO: 353501 - DNA, 25 bp, Rattus norvegicus
gagtctattgtcgacaaggtcacgg

SEQ ID NO: 353502 - DNA, 25 bp, Rattus norvegicus
gagtctattgtgagagtgcttgccg

SEQ ID NO: 353503 - DNA, 25 bp, Rattus norvegicus
gagtctattgtgtgagtgcttgccg

SEQ ID NO: 353504 - DNA, 25 bp, Rattus norvegicus
gagtctatttttctatccacgtggg

SEQ ID NO: 353505 - DNA, 25 bp, Rattus norvegicus
gagtctatttttgtatccacgtggg

SEQ ID NO: 353506 - DNA, 25 bp, Rattus norvegicus
gagtctcaacgtcgtatgggctaca

SEQ ID NO: 353507 - DNA, 25 bp, Rattus norvegicus
gagtctcaacgtggtatgggctaca

SEQ ID NO: 353508 - DNA, 25 bp, Rattus norvegicus
gagtctcaactgagcgacggtacaa

SEQ ID NO: 353509 - DNA, 25 bp, Rattus norvegicus
gagtctcaactgtgcgacggtacaa

SEQ ID NO: 353510 - DNA, 25 bp, Rattus norvegicus
gagtctcaagtcaacaagctaaggg

SEQ ID NO: 353511 - DNA, 25 bp, Rattus norvegicus
gagtctcaagtctacaagctaaggg

SEQ ID NO: 353512 - DNA, 25 bp, Rattus norvegicus
gagtctcacactctgttgaccatgt

SEQ ID NO: 353513 - DNA, 25 bp, Rattus norvegicus
gagtctcacactgtgttgaccatgt

SEQ ID NO: 353514 - DNA, 25 bp, Rattus norvegicus
gagtctcacattagaggttctccat

SEQ ID NO: 353515 - DNA, 25 bp, Rattus norvegicus
gagtctcacatttgaggttctccat

SEQ ID NO: 353516 - DNA, 25 bp, Rattus norvegicus
gagtctcaccggaaccctagaagca

SEQ ID NO: 353517 - DNA, 25 bp, Rattus norvegicus
gagtctcaccggtaccctagaagca

SEQ ID NO: 353518 - DNA, 25 bp, Rattus norvegicus
gagtctcacttgagctcttggctga

SEQ ID NO: 353519 - DNA, 25 bp, Rattus norvegicus
gagtctcacttgtgctcttggctga

SEQ ID NO: 353520 - DNA, 25 bp, Rattus norvegicus
gagtctcagacaagtctcacagcga

SEQ ID NO: 353521 - DNA, 25 bp, Rattus norvegicus
gagtctcagacatgtctcacagcga

SEQ ID NO: 353522 - DNA, 25 bp, Rattus norvegicus
gagtctcagaccctttcagtcaaaa

SEQ ID NO: 353523 - DNA, 25 bp, Rattus norvegicus
gagtctcagaccgtttcagtcaaaa

SEQ ID NO: 353524 - DNA, 25 bp, Rattus norvegicus
gagtctcagataaccctgacacggg

SEQ ID NO: 353525 - DNA, 25 bp, Rattus norvegicus
gagtctcagatacctgggactgcta

SEQ ID NO: 353526 - DNA, 25 bp, Rattus norvegicus
gagtctcagatagctgggactgcta

SEQ ID NO: 353527 - DNA, 25 bp, Rattus norvegicus
gagtctcagatatccctgacacggg

SEQ ID NO: 353528 - DNA, 25 bp, Rattus norvegicus
gagtctcagcctcccgaaagcatga

SEQ ID NO: 353529 - DNA, 25 bp, Rattus norvegicus
gagtctcagcctgccgaaagcatga

SEQ ID NO: 353530 - DNA, 25 bp, Rattus norvegicus
gagtctcagctcaggcatggaggca

SEQ ID NO: 353531 - DNA, 25 bp, Rattus norvegicus
gagtctcagctctggcatggaggca

SEQ ID NO: 353532 - DNA, 25 bp, Rattus norvegicus
gagtctcaggccctgctcttgggat

SEQ ID NO: 353533 - DNA, 25 bp, Rattus norvegicus
gagtctcaggccgtgctcttgggat

SEQ ID NO: 353534 - DNA, 25 bp, Rattus norvegicus
gagtctcagtagaataggtttcaat

SEQ ID NO: 353535 - DNA, 25 bp, Rattus norvegicus
gagtctcagtagtataggtttcaat

SEQ ID NO: 353536 - DNA, 25 bp, Rattus norvegicus
gagtctcagtccaatcactctaatc

SEQ ID NO: 353537 - DNA, 25 bp, Rattus norvegicus
gagtctcagtccacgtggagcacgt

SEQ ID NO: 353538 - DNA, 25 bp, Rattus norvegicus
gagtctcagtcctatcactctaatc

SEQ ID NO: 353539 - DNA, 25 bp, Rattus norvegicus
gagtctcagtcctcgtggagcacgt

SEQ ID NO: 353540 - DNA, 25 bp, Rattus norvegicus
gagtctcatcttctacacctttgaa

SEQ ID NO: 353541 - DNA, 25 bp, Rattus norvegicus
gagtctcatcttgtacacctttgaa

SEQ ID NO: 353542 - DNA, 25 bp, Rattus norvegicus
gagtctcatggtcagtttcttttgt

SEQ ID NO: 353543 - DNA, 25 bp, Rattus norvegicus
gagtctcatggtgagtttcttttgt

SEQ ID NO: 353544 - DNA, 25 bp, Rattus norvegicus
gagtctcattacattgatccaaacc

SEQ ID NO: 353545 - DNA, 25 bp, Rattus norvegicus
gagtctcattactttgatccaaacc

SEQ ID NO: 353546 - DNA, 25 bp, Rattus norvegicus
gagtctcattggctttcatgggaag

SEQ ID NO: 353547 - DNA, 25 bp, Rattus norvegicus
gagtctcattgggtttcatgggaag

SEQ ID NO: 353548 - DNA, 25 bp, Rattus norvegicus
gagtctccacttacactatacaatg

SEQ ID NO: 353549 - DNA, 25 bp, Rattus norvegicus
gagtctccactttcactatacaatg

SEQ ID NO: 353550 - DNA, 25 bp, Rattus norvegicus
gagtctccagacaaagcccgagatg

SEQ ID NO: 353551 - DNA, 25 bp, Rattus norvegicus
gagtctccagactaagcccgagatg

SEQ ID NO: 353552 - DNA, 25 bp, Rattus norvegicus
gagtctccagggatgggaattactt

SEQ ID NO: 353553 - DNA, 25 bp, Rattus norvegicus
gagtctccagggttgggaattactt

SEQ ID NO: 353554 - DNA, 25 bp, Rattus norvegicus
gagtctccatacacagggatacgta

SEQ ID NO: 353555 - DNA, 25 bp, Rattus norvegicus
gagtctccatactcagggatacgta

SEQ ID NO: 353556 - DNA, 25 bp, Rattus norvegicus
gagtctccatcacgaccctgttgtg

SEQ ID NO: 353557 - DNA, 25 bp, Rattus norvegicus
gagtctccatcaggaccctgttgtg

SEQ ID NO: 353558 - DNA, 25 bp, Rattus norvegicus
gagtctccatctagtacacgggcag

SEQ ID NO: 353559 - DNA, 25 bp, Rattus norvegicus
gagtctccatcttgtacacgggcag

SEQ ID NO: 353560 - DNA, 25 bp, Rattus norvegicus
gagtctccattcagggatgacattt

SEQ ID NO: 353561 - DNA, 25 bp, Rattus norvegicus
gagtctccattctgggatgacattt

SEQ ID NO: 353562 - DNA, 25 bp, Rattus norvegicus
gagtctcccaatatgtattatcctg

SEQ ID NO: 353563 - DNA, 25 bp, Rattus norvegicus
gagtctcccaatttgtattatcctg

SEQ ID NO: 353564 - DNA, 25 bp, Rattus norvegicus
gagtctccctcacatatttttgatg

SEQ ID NO: 353565 - DNA, 25 bp, Rattus norvegicus
gagtctccctcagatatttttgatg

SEQ ID NO: 353566 - DNA, 25 bp, Rattus norvegicus
gagtctcccttgaggaagtgacact

SEQ ID NO: 353567 - DNA, 25 bp, Rattus norvegicus
gagtctcccttgtggaagtgacact

SEQ ID NO: 353568 - DNA, 25 bp, Rattus norvegicus
gagtctccgggaagacagacctgtc

SEQ ID NO: 353569 - DNA, 25 bp, Rattus norvegicus
gagtctccgggatgacagacctgtc

SEQ ID NO: 353570 - DNA, 25 bp, Rattus norvegicus
gagtctccgtgtacgatttggtgaa

SEQ ID NO: 353571 - DNA, 25 bp, Rattus norvegicus
gagtctccgtgttcgatttggtgaa

SEQ ID NO: 353572 - DNA, 25 bp, Rattus norvegicus
gagtctcctcatccttgatttctaa

SEQ ID NO: 353573 - DNA, 25 bp, Rattus norvegicus
gagtctcctcatgcttgatttctaa

SEQ ID NO: 353574 - DNA, 25 bp, Rattus norvegicus
gagtctcctcttcactgcaaggcgg

SEQ ID NO: 353575 - DNA, 25 bp, Rattus norvegicus
gagtctcctcttgactgcaaggcgg

SEQ ID NO: 353576 - DNA, 25 bp, Rattus norvegicus
gagtctcctgagcatgtgaaccgtc

SEQ ID NO: 353577 - DNA, 25 bp, Rattus norvegicus
gagtctcctgaggatgtgaaccgtc

SEQ ID NO: 353578 - DNA, 25 bp, Rattus norvegicus
gagtctcctggtccttattttagaa

SEQ ID NO: 353579 - DNA, 25 bp, Rattus norvegicus
gagtctcctggtgcttattttagaa

SEQ ID NO: 353580 - DNA, 25 bp, Rattus norvegicus
gagtctcctgtgacagatgctagcc

SEQ ID NO: 353581 - DNA, 25 bp, Rattus norvegicus
gagtctcctgtgtcagatgctagcc

SEQ ID NO: 353582 - DNA, 25 bp, Rattus norvegicus
gagtctccttctctcacgatggtca

SEQ ID NO: 353583 - DNA, 25 bp, Rattus norvegicus
gagtctccttctgtcacgatggtca

SEQ ID NO: 353584 - DNA, 25 bp, Rattus norvegicus
gagtctccttgccagaagtaatcac

SEQ ID NO: 353585 - DNA, 25 bp, Rattus norvegicus
gagtctccttgcgagaagtaatcac

SEQ ID NO: 353586 - DNA, 25 bp, Rattus norvegicus
gagtctccttgtaagtccagttagc

SEQ ID NO: 353587 - DNA, 25 bp, Rattus norvegicus
gagtctccttgttagtccagttagc

SEQ ID NO: 353588 - DNA, 25 bp, Rattus norvegicus
gagtctcctttccagagttgatgca

SEQ ID NO: 353589 - DNA, 25 bp, Rattus norvegicus
gagtctcctttcgagagttgatgca

SEQ ID NO: 353590 - DNA, 25 bp, Rattus norvegicus
gagtctcgagaaccacgacccggag

SEQ ID NO: 353591 - DNA, 25 bp, Rattus norvegicus
gagtctcgagaagcacgacccggag

SEQ ID NO: 353592 - DNA, 25 bp, Rattus norvegicus
gagtctcgagtaatgcatgctggcc

SEQ ID NO: 353593 - DNA, 25 bp, Rattus norvegicus
gagtctcgagtattgcatgctggcc

SEQ ID NO: 353594 - DNA, 25 bp, Rattus norvegicus
gagtctcggacacaactggttcctc

SEQ ID NO: 353595 - DNA, 25 bp, Rattus norvegicus
gagtctcggacagaactggttcctc

SEQ ID NO: 353596 - DNA, 25 bp, Rattus norvegicus
gagtctcgtctacatgaaccttcct

SEQ ID NO: 353597 - DNA, 25 bp, Rattus norvegicus
gagtctcgtctagatgaaccttcct

SEQ ID NO: 353598 - DNA, 25 bp, Rattus norvegicus
gagtctctaactcagcaccatttga

SEQ ID NO: 353599 - DNA, 25 bp, Rattus norvegicus
gagtctctaactgagcaccatttga

SEQ ID NO: 353600 - DNA, 25 bp, Rattus norvegicus
gagtctctacataatacacagtttt

SEQ ID NO: 353601 - DNA, 25 bp, Rattus norvegicus
gagtctctacattatacacagtttt

SEQ ID NO: 353602 - DNA, 25 bp, Rattus norvegicus
gagtctctacccacggatgaagaag

SEQ ID NO: 353603 - DNA, 25 bp, Rattus norvegicus
gagtctctaccctcggatgaagaag

SEQ ID NO: 353604 - DNA, 25 bp, Rattus norvegicus
gagtctctaggtattcagatatttc

SEQ ID NO: 353605 - DNA, 25 bp, Rattus norvegicus
gagtctctaggttttcagatatttc

SEQ ID NO: 353606 - DNA, 25 bp, Rattus norvegicus
gagtctctcaaacttctctcaacag

SEQ ID NO: 353607 - DNA, 25 bp, Rattus norvegicus
gagtctctcaaagttctctcaacag

SEQ ID NO: 353608 - DNA, 25 bp, Rattus norvegicus
gagtctctccggagctcagctgaga

SEQ ID NO: 353609 - DNA, 25 bp, Rattus norvegicus
gagtctctccggtgctcagctgaga

SEQ ID NO: 353610 - DNA, 25 bp, Rattus norvegicus
gagtctctctagataaagggcccct

SEQ ID NO: 353611 - DNA, 25 bp, Rattus norvegicus
gagtctctctagttaaagggcccct

SEQ ID NO: 353612 - DNA, 25 bp, Rattus norvegicus
gagtctctctctctgacatgtgatt

SEQ ID NO: 353613 - DNA, 25 bp, Rattus norvegicus
gagtctctctctgtgacatgtgatt

SEQ ID NO: 353614 - DNA, 25 bp, Rattus norvegicus
gagtctctctgtaccacatgaataa

SEQ ID NO: 353615 - DNA, 25 bp, Rattus norvegicus
gagtctctctgttccacatgaataa

SEQ ID NO: 353616 - DNA, 25 bp, Rattus norvegicus
gagtctctgactccaagtccaaagg

SEQ ID NO: 353617 - DNA, 25 bp, Rattus norvegicus
gagtctctgactgcaagtccaaagg

SEQ ID NO: 353618 - DNA, 25 bp, Rattus norvegicus
gagtctctgatcaaaagcctgctaa

SEQ ID NO: 353619 - DNA, 25 bp, Rattus norvegicus
gagtctctgatctaaagcctgctaa

SEQ ID NO: 353620 - DNA, 25 bp, Rattus norvegicus
gagtctctgcttacatttcctggat

SEQ ID NO: 353621 - DNA, 25 bp, Rattus norvegicus
gagtctctgctttcatttcctggat

SEQ ID NO: 353622 - DNA, 25 bp, Rattus norvegicus
gagtctctggaccaatttgactgca

SEQ ID NO: 353623 - DNA, 25 bp, Rattus norvegicus
gagtctctggacgaatttgactgca

SEQ ID NO: 353624 - DNA, 25 bp, Rattus norvegicus
gagtctctgggtacacagaacacat

SEQ ID NO: 353625 - DNA, 25 bp, Rattus norvegicus
gagtctctgggttcacagaacacat

SEQ ID NO: 353626 - DNA, 25 bp, Rattus norvegicus
gagtctctggtgcatcatttaatct

SEQ ID NO: 353627 - DNA, 25 bp, Rattus norvegicus
gagtctctggtggatcatttaatct

SEQ ID NO: 353628 - DNA, 25 bp, Rattus norvegicus
gagtctctgtcaaccatcgggaaat

SEQ ID NO: 353629 - DNA, 25 bp, Rattus norvegicus
gagtctctgtcatccatcgggaaat

SEQ ID NO: 353630 - DNA, 25 bp, Rattus norvegicus
gagtctctgttcactctagtagatt

SEQ ID NO: 353631 - DNA, 25 bp, Rattus norvegicus
gagtctctgttctctctagtagatt

SEQ ID NO: 353632 - DNA, 25 bp, Rattus norvegicus
gagtctcttagacaaaggccctctg

SEQ ID NO: 353633 - DNA, 25 bp, Rattus norvegicus
gagtctcttagagaaaggccctctg

SEQ ID NO: 353634 - DNA, 25 bp, Rattus norvegicus
gagtctcttccaagcgactatggag

SEQ ID NO: 353635 - DNA, 25 bp, Rattus norvegicus
gagtctcttccatgcgactatggag

SEQ ID NO: 353636 - DNA, 25 bp, Rattus norvegicus
gagtctcttctactttatttgcgta

SEQ ID NO: 353637 - DNA, 25 bp, Rattus norvegicus
gagtctcttctagtttatttgcgta

SEQ ID NO: 353638 - DNA, 25 bp, Rattus norvegicus
gagtctcttcttatcggaatcctgt

SEQ ID NO: 353639 - DNA, 25 bp, Rattus norvegicus
gagtctcttcttttcggaatcctgt

SEQ ID NO: 353640 - DNA, 25 bp, Rattus norvegicus
gagtctcttgatcgtccaaggctct

SEQ ID NO: 353641 - DNA, 25 bp, Rattus norvegicus
gagtctcttgatggtccaaggctct

SEQ ID NO: 353642 - DNA, 25 bp, Rattus norvegicus
gagtctctttcacctttctagaggt

SEQ ID NO: 353643 - DNA, 25 bp, Rattus norvegicus
gagtctctttcagctttctagaggt

SEQ ID NO: 353644 - DNA, 25 bp, Rattus norvegicus
gagtctctttggctgaatcctgcca

SEQ ID NO: 353645 - DNA, 25 bp, Rattus norvegicus
gagtctctttgggtgaatcctgcca

SEQ ID NO: 353646 - DNA, 25 bp, Rattus norvegicus
gagtctgaaactagtcatccagtca

SEQ ID NO: 353647 - DNA, 25 bp, Rattus norvegicus
gagtctgaaactccacctgtatgta

SEQ ID NO: 353648 - DNA, 25 bp, Rattus norvegicus
gagtctgaaactgcacctgtatgta

SEQ ID NO: 353649 - DNA, 25 bp, Rattus norvegicus
gagtctgaaacttgtcatccagtca

SEQ ID NO: 353650 - DNA, 25 bp, Rattus norvegicus
gagtctgaaaggcagtattccacta

SEQ ID NO: 353651 - DNA, 25 bp, Rattus norvegicus
gagtctgaaagggagtattccacta

SEQ ID NO: 353652 - DNA, 25 bp, Rattus norvegicus
gagtctgaagtacacgtcgccaatg

SEQ ID NO: 353653 - DNA, 25 bp, Rattus norvegicus
gagtctgaagtagacgtcgccaatg

SEQ ID NO: 353654 - DNA, 25 bp, Rattus norvegicus
gagtctgaatctatgtgaagcctat

SEQ ID NO: 353655 - DNA, 25 bp, Rattus norvegicus
gagtctgaatctttgtgaagcctat

SEQ ID NO: 353656 - DNA, 25 bp, Rattus norvegicus
gagtctgaattcatgctgtaactta

SEQ ID NO: 353657 - DNA, 25 bp, Rattus norvegicus
gagtctgaattcttgctgtaactta

SEQ ID NO: 353658 - DNA, 25 bp, Rattus norvegicus
gagtctgacacgcatctcagccaaa

SEQ ID NO: 353659 - DNA, 25 bp, Rattus norvegicus
gagtctgacacggatctcagccaaa

SEQ ID NO: 353660 - DNA, 25 bp, Rattus norvegicus
gagtctgaccctcctgtgaaagaag

SEQ ID NO: 353661 - DNA, 25 bp, Rattus norvegicus
gagtctgaccctgctgtgaaagaag

SEQ ID NO: 353662 - DNA, 25 bp, Rattus norvegicus
gagtctgacgatctttaacgggctt

SEQ ID NO: 353663 - DNA, 25 bp, Rattus norvegicus
gagtctgacgatgtttaacgggctt

SEQ ID NO: 353664 - DNA, 25 bp, Rattus norvegicus
gagtctgactgccacgagcagctgc

SEQ ID NO: 353665 - DNA, 25 bp, Rattus norvegicus
gagtctgactgcgacgagcagctgc

SEQ ID NO: 353666 - DNA, 25 bp, Rattus norvegicus
gagtctgactggctgttagccatct

SEQ ID NO: 353667 - DNA, 25 bp, Rattus norvegicus
gagtctgactgggtgttagccatct

SEQ ID NO: 353668 - DNA, 25 bp, Rattus norvegicus
gagtctgagacaccgaaccaatgta

SEQ ID NO: 353669 - DNA, 25 bp, Rattus norvegicus
gagtctgagacagcgaaccaatgta

SEQ ID NO: 353670 - DNA, 25 bp, Rattus norvegicus
gagtctgagactacccaggacgaca

SEQ ID NO: 353671 - DNA, 25 bp, Rattus norvegicus
gagtctgagacttcccaggacgaca

SEQ ID NO: 353672 - DNA, 25 bp, Rattus norvegicus
gagtctgagcttaaggactggccct

SEQ ID NO: 353673 - DNA, 25 bp, Rattus norvegicus
gagtctgagctttaggactggccct

SEQ ID NO: 353674 - DNA, 25 bp, Rattus norvegicus
gagtctgaggccagcttaagctaca

SEQ ID NO: 353675 - DNA, 25 bp, Rattus norvegicus
gagtctgaggcccagttctatgaac

SEQ ID NO: 353676 - DNA, 25 bp, Rattus norvegicus
gagtctgaggccgagttctatgaac

SEQ ID NO: 353677 - DNA, 25 bp, Rattus norvegicus
gagtctgaggcctgcttaagctaca

SEQ ID NO: 353678 - DNA, 25 bp, Rattus norvegicus
gagtctgaggcgcttcaaggcacca

SEQ ID NO: 353679 - DNA, 25 bp, Rattus norvegicus
gagtctgaggcggttcaaggcacca

SEQ ID NO: 353680 - DNA, 25 bp, Rattus norvegicus
gagtctgagtctcccgggttacaat

SEQ ID NO: 353681 - DNA, 25 bp, Rattus norvegicus
gagtctgagtctgccgggttacaat

SEQ ID NO: 353682 - DNA, 25 bp, Rattus norvegicus
gagtctgagttcatcttatttggaa

SEQ ID NO: 353683 - DNA, 25 bp, Rattus norvegicus
gagtctgagttcttcttatttggaa

SEQ ID NO: 353684 - DNA, 25 bp, Rattus norvegicus
gagtctgatgtcatggttgggccct

SEQ ID NO: 353685 - DNA, 25 bp, Rattus norvegicus
gagtctgatgtccaggccacctgga

SEQ ID NO: 353686 - DNA, 25 bp, Rattus norvegicus
gagtctgatgtcgaggccacctgga

SEQ ID NO: 353687 - DNA, 25 bp, Rattus norvegicus
gagtctgatgtcttggttgggccct

SEQ ID NO: 353688 - DNA, 25 bp, Rattus norvegicus
gagtctgcaacacttgttcctagga

SEQ ID NO: 353689 - DNA, 25 bp, Rattus norvegicus
gagtctgcaacagttgttcctagga

SEQ ID NO: 353690 - DNA, 25 bp, Rattus norvegicus
gagtctgcaacccttgagttttgaa

SEQ ID NO: 353691 - DNA, 25 bp, Rattus norvegicus
gagtctgcaaccgttgagttttgaa

SEQ ID NO: 353692 - DNA, 25 bp, Rattus norvegicus
gagtctgcacgactcagagtctcca

SEQ ID NO: 353693 - DNA, 25 bp, Rattus norvegicus
gagtctgcacgagtcagagtctcca

SEQ ID NO: 353694 - DNA, 25 bp, Rattus norvegicus
gagtctgcagacagcgagcctgagt

SEQ ID NO: 353695 - DNA, 25 bp, Rattus norvegicus
gagtctgcagactgcgagcctgagt

SEQ ID NO: 353696 - DNA, 25 bp, Rattus norvegicus
gagtctgcagatacttggtttttca

SEQ ID NO: 353697 - DNA, 25 bp, Rattus norvegicus
gagtctgcagattcttggtttttca

SEQ ID NO: 353698 - DNA, 25 bp, Rattus norvegicus
gagtctgcagtcatacctgtcggag

SEQ ID NO: 353699 - DNA, 25 bp, Rattus norvegicus
gagtctgcagtcttacctgtcggag

SEQ ID NO: 353700 - DNA, 25 bp, Rattus norvegicus
gagtctgcagttatctgacctttta

SEQ ID NO: 353701 - DNA, 25 bp, Rattus norvegicus
gagtctgcagttttctgacctttta

SEQ ID NO: 353702 - DNA, 25 bp, Rattus norvegicus
gagtctgcatttatagtgtcatctt

SEQ ID NO: 353703 - DNA, 25 bp, Rattus norvegicus
gagtctgcatttttagtgtcatctt

SEQ ID NO: 353704 - DNA, 25 bp, Rattus norvegicus
gagtctgccagactatcttgaaaac

SEQ ID NO: 353705 - DNA, 25 bp, Rattus norvegicus
gagtctgccagagtatcttgaaaac

SEQ ID NO: 353706 - DNA, 25 bp, Rattus norvegicus
gagtctgcccacagtcgagatcgat

SEQ ID NO: 353707 - DNA, 25 bp, Rattus norvegicus
gagtctgcccactgtcgagatcgat

SEQ ID NO: 353708 - DNA, 25 bp, Rattus norvegicus
gagtctgcccagagaggccttctaa

SEQ ID NO: 353709 - DNA, 25 bp, Rattus norvegicus
gagtctgcccagtgaggccttctaa

SEQ ID NO: 353710 - DNA, 25 bp, Rattus norvegicus
gagtctgccctgcatttgtttaata

SEQ ID NO: 353711 - DNA, 25 bp, Rattus norvegicus
gagtctgccctggatttgtttaata

SEQ ID NO: 353712 - DNA, 25 bp, Rattus norvegicus
gagtctgccgtgcaggttcacagca

SEQ ID NO: 353713 - DNA, 25 bp, Rattus norvegicus
gagtctgccgtggaggttcacagca

SEQ ID NO: 353714 - DNA, 25 bp, Rattus norvegicus
gagtctgcctatcggacacagttta

SEQ ID NO: 353715 - DNA, 25 bp, Rattus norvegicus
gagtctgcctatgggacacagttta

SEQ ID NO: 353716 - DNA, 25 bp, Rattus norvegicus
gagtctgccttactgcatctgatca

SEQ ID NO: 353717 - DNA, 25 bp, Rattus norvegicus
gagtctgccttagtgcatctgatca

SEQ ID NO: 353718 - DNA, 25 bp, Rattus norvegicus
gagtctgccttgctgtgggttctca

SEQ ID NO: 353719 - DNA, 25 bp, Rattus norvegicus
gagtctgccttggtgtgggttctca

SEQ ID NO: 353720 - DNA, 25 bp, Rattus norvegicus
gagtctgcctttcagaactgttcaa

SEQ ID NO: 353721 - DNA, 25 bp, Rattus norvegicus
gagtctgcctttgagaactgttcaa

SEQ ID NO: 353722 - DNA, 25 bp, Rattus norvegicus
gagtctgcgcatacatgtctcaggt

SEQ ID NO: 353723 - DNA, 25 bp, Rattus norvegicus
gagtctgcgcattcatgtctcaggt

SEQ ID NO: 353724 - DNA, 25 bp, Rattus norvegicus
gagtctgcgggaaagtctcaggcta

SEQ ID NO: 353725 - DNA, 25 bp, Rattus norvegicus
gagtctgcgggatagtctcaggcta

SEQ ID NO: 353726 - DNA, 25 bp, Rattus norvegicus
gagtctgctcatatccagaggagga

SEQ ID NO: 353727 - DNA, 25 bp, Rattus norvegicus
gagtctgctcatttccagaggagga

SEQ ID NO: 353728 - DNA, 25 bp, Rattus norvegicus
gagtctgctccccttgaagtgggaa

SEQ ID NO: 353729 - DNA, 25 bp, Rattus norvegicus
gagtctgctcccgttgaagtgggaa

SEQ ID NO: 353730 - DNA, 25 bp, Rattus norvegicus
gagtctgctcctcttaaggtagggc

SEQ ID NO: 353731 - DNA, 25 bp, Rattus norvegicus
gagtctgctcctgttaaggtagggc

SEQ ID NO: 353732 - DNA, 25 bp, Rattus norvegicus
gagtctgctgcccactatgaatcca

SEQ ID NO: 353733 - DNA, 25 bp, Rattus norvegicus
gagtctgctgccgactatgaatcca

SEQ ID NO: 353734 - DNA, 25 bp, Rattus norvegicus
gagtctgcttccaggtcacaaagag

SEQ ID NO: 353735 - DNA, 25 bp, Rattus norvegicus
gagtctgcttcctggtcacaaagag

SEQ ID NO: 353736 - DNA, 25 bp, Rattus norvegicus
gagtctgcttgacatgctacacgtt

SEQ ID NO: 353737 - DNA, 25 bp, Rattus norvegicus
gagtctgcttgagatgctacacgtt

SEQ ID NO: 353738 - DNA, 25 bp, Rattus norvegicus
gagtctggacttaggtgctgatgca

SEQ ID NO: 353739 - DNA, 25 bp, Rattus norvegicus
gagtctggactttggtgctgatgca

SEQ ID NO: 353740 - DNA, 25 bp, Rattus norvegicus
gagtctggagcaactatcaaaattg

SEQ ID NO: 353741 - DNA, 25 bp, Rattus norvegicus
gagtctggagcatctatcaaaattg

SEQ ID NO: 353742 - DNA, 25 bp, Rattus norvegicus
gagtctggagctctggctactgcaa

SEQ ID NO: 353743 - DNA, 25 bp, Rattus norvegicus
gagtctggagctgtggctactgcaa

SEQ ID NO: 353744 - DNA, 25 bp, Rattus norvegicus
gagtctggagtcaacaactctgact

SEQ ID NO: 353745 - DNA, 25 bp, Rattus norvegicus
gagtctggagtctacaactctgact

SEQ ID NO: 353746 - DNA, 25 bp, Rattus norvegicus
gagtctggccctcaggaccaactaa

SEQ ID NO: 353747 - DNA, 25 bp, Rattus norvegicus
gagtctggccctgaggaccaactaa

SEQ ID NO: 353748 - DNA, 25 bp, Rattus norvegicus
gagtctggcctcatcagagtggtaa

SEQ ID NO: 353749 - DNA, 25 bp, Rattus norvegicus
gagtctggcctcttcagagtggtaa

SEQ ID NO: 353750 - DNA, 25 bp, Rattus norvegicus
gagtctggcctgaagctggtgacaa

SEQ ID NO: 353751 - DNA, 25 bp, Rattus norvegicus
gagtctggcctgagcatgagctctg

SEQ ID NO: 353752 - DNA, 25 bp, Rattus norvegicus
gagtctggcctgtagctggtgacaa

SEQ ID NO: 353753 - DNA, 25 bp, Rattus norvegicus
gagtctggcctgtgcatgagctctg

SEQ ID NO: 353754 - DNA, 25 bp, Rattus norvegicus
gagtctggctagctatcatgtgtct

SEQ ID NO: 353755 - DNA, 25 bp, Rattus norvegicus
gagtctggctaggtatcatgtgtct

SEQ ID NO: 353756 - DNA, 25 bp, Rattus norvegicus
gagtctggctttattatttccatct

SEQ ID NO: 353757 - DNA, 25 bp, Rattus norvegicus
gagtctggcttttttatttccatct

SEQ ID NO: 353758 - DNA, 25 bp, Rattus norvegicus
gagtctgggactacatccctgacaa

SEQ ID NO: 353759 - DNA, 25 bp, Rattus norvegicus
gagtctgggacttcatccctgacaa

SEQ ID NO: 353760 - DNA, 25 bp, Rattus norvegicus
gagtctgggatcctgttttgtgtta

SEQ ID NO: 353761 - DNA, 25 bp, Rattus norvegicus
gagtctgggatcgtgttttgtgtta

SEQ ID NO: 353762 - DNA, 25 bp, Rattus norvegicus
gagtctgggcctacagtactaacat

SEQ ID NO: 353763 - DNA, 25 bp, Rattus norvegicus
gagtctgggccttcagtactaacat

SEQ ID NO: 353764 - DNA, 25 bp, Rattus norvegicus
gagtctgggctgattttagacattt

SEQ ID NO: 353765 - DNA, 25 bp, Rattus norvegicus
gagtctgggctgtttttagacattt

SEQ ID NO: 353766 - DNA, 25 bp, Rattus norvegicus
gagtctggtaatcaacaccacttgt

SEQ ID NO: 353767 - DNA, 25 bp, Rattus norvegicus
gagtctggtaatgaacaccacttgt

SEQ ID NO: 353768 - DNA, 25 bp, Rattus norvegicus
gagtctggtagacgtctatcccgaa

SEQ ID NO: 353769 - DNA, 25 bp, Rattus norvegicus
gagtctggtagaggtctatcccgaa

SEQ ID NO: 353770 - DNA, 25 bp, Rattus norvegicus
gagtctggtcccaataaccatggaa

SEQ ID NO: 353771 - DNA, 25 bp, Rattus norvegicus
gagtctggtccctataaccatggaa

SEQ ID NO: 353772 - DNA, 25 bp, Rattus norvegicus
gagtctggtgaactggcccttctta

SEQ ID NO: 353773 - DNA, 25 bp, Rattus norvegicus
gagtctggtgaagtggcccttctta

SEQ ID NO: 353774 - DNA, 25 bp, Rattus norvegicus
gagtctggtgacattagcactgcgc

SEQ ID NO: 353775 - DNA, 25 bp, Rattus norvegicus
gagtctggtgactttagcactgcgc

SEQ ID NO: 353776 - DNA, 25 bp, Rattus norvegicus
gagtctggtggtaggcatctttcat

SEQ ID NO: 353777 - DNA, 25 bp, Rattus norvegicus
gagtctggtggttggcatctttcat

SEQ ID NO: 353778 - DNA, 25 bp, Rattus norvegicus
gagtctggtttaacctcacaggtca

SEQ ID NO: 353779 - DNA, 25 bp, Rattus norvegicus
gagtctggtttatcctcacaggtca

SEQ ID NO: 353780 - DNA, 25 bp, Rattus norvegicus
gagtctgtacccaggagatccgtaa

SEQ ID NO: 353781 - DNA, 25 bp, Rattus norvegicus
gagtctgtaccctggagatccgtaa

SEQ ID NO: 353782 - DNA, 25 bp, Rattus norvegicus
gagtctgtagcccactcagattgga

SEQ ID NO: 353783 - DNA, 25 bp, Rattus norvegicus
gagtctgtagccgactcagattgga

SEQ ID NO: 353784 - DNA, 25 bp, Rattus norvegicus
gagtctgtagggatggccacttttc

SEQ ID NO: 353785 - DNA, 25 bp, Rattus norvegicus
gagtctgtagggttggccacttttc

SEQ ID NO: 353786 - DNA, 25 bp, Rattus norvegicus
gagtctgtagtcactgaccctaaat

SEQ ID NO: 353787 - DNA, 25 bp, Rattus norvegicus
gagtctgtagtctctgaccctaaat

SEQ ID NO: 353788 - DNA, 25 bp, Rattus norvegicus
gagtctgtatcccttttgtattttt

SEQ ID NO: 353789 - DNA, 25 bp, Rattus norvegicus
gagtctgtatccgttttgtattttt

SEQ ID NO: 353790 - DNA, 25 bp, Rattus norvegicus
gagtctgtccacatcagagtacaag

SEQ ID NO: 353791 - DNA, 25 bp, Rattus norvegicus
gagtctgtccacttcagagtacaag

SEQ ID NO: 353792 - DNA, 25 bp, Rattus norvegicus
gagtctgtcctgacttggttgcttc

SEQ ID NO: 353793 - DNA, 25 bp, Rattus norvegicus
gagtctgtcctgtcttggttgcttc

SEQ ID NO: 353794 - DNA, 25 bp, Rattus norvegicus
gagtctgtccttatgtggatgtgtg

SEQ ID NO: 353795 - DNA, 25 bp, Rattus norvegicus
gagtctgtccttttgtggatgtgtg

SEQ ID NO: 353796 - DNA, 25 bp, Rattus norvegicus
gagtctgtcggactagtttgagtat

SEQ ID NO: 353797 - DNA, 25 bp, Rattus norvegicus
gagtctgtcggagtagtttgagtat

SEQ ID NO: 353798 - DNA, 25 bp, Rattus norvegicus
gagtctgtgcagagtgcgctccaga

SEQ ID NO: 353799 - DNA, 25 bp, Rattus norvegicus
gagtctgtgcagcagctgctccgaa

SEQ ID NO: 353800 - DNA, 25 bp, Rattus norvegicus
gagtctgtgcaggagctgctccgaa

SEQ ID NO: 353801 - DNA, 25 bp, Rattus norvegicus
gagtctgtgcagtgtgcgctccaga

SEQ ID NO: 353802 - DNA, 25 bp, Rattus norvegicus
gagtctgtgcgcaggccgagttctc

SEQ ID NO: 353803 - DNA, 25 bp, Rattus norvegicus
gagtctgtgcgctggccgagttctc

SEQ ID NO: 353804 - DNA, 25 bp, Rattus norvegicus
gagtctgtgcggatcctgaagagca

SEQ ID NO: 353805 - DNA, 25 bp, Rattus norvegicus
gagtctgtgcggttcctgaagagca

SEQ ID NO: 353806 - DNA, 25 bp, Rattus norvegicus
gagtctgtgctacgaccttaaccac

SEQ ID NO: 353807 - DNA, 25 bp, Rattus norvegicus
gagtctgtgctaggaccttaaccac

SEQ ID NO: 353808 - DNA, 25 bp, Rattus norvegicus
gagtctgtggagctgttcaaataat

SEQ ID NO: 353809 - DNA, 25 bp, Rattus norvegicus
gagtctgtggaggtgttcaaataat

SEQ ID NO: 353810 - DNA, 25 bp, Rattus norvegicus
gagtctgtggccagtcccatgagag

SEQ ID NO: 353811 - DNA, 25 bp, Rattus norvegicus
gagtctgtggcctgtcccatgagag

SEQ ID NO: 353812 - DNA, 25 bp, Rattus norvegicus
gagtctgtgtcaattgtgacctttt

SEQ ID NO: 353813 - DNA, 25 bp, Rattus norvegicus
gagtctgtgtcaccacttgcttcat

SEQ ID NO: 353814 - DNA, 25 bp, Rattus norvegicus
gagtctgtgtcagcacttgcttcat

SEQ ID NO: 353815 - DNA, 25 bp, Rattus norvegicus
gagtctgtgtcatttgtgacctttt

SEQ ID NO: 353816 - DNA, 25 bp, Rattus norvegicus
gagtctgttaccaaggaccatttgt

SEQ ID NO: 353817 - DNA, 25 bp, Rattus norvegicus
gagtctgttacctaggaccatttgt

SEQ ID NO: 353818 - DNA, 25 bp, Rattus norvegicus
gagtctgttaggatactccctcctt

SEQ ID NO: 353819 - DNA, 25 bp, Rattus norvegicus
gagtctgttaggttactccctcctt

SEQ ID NO: 353820 - DNA, 25 bp, Rattus norvegicus
gagtctgttcctaatacaaatcatt

SEQ ID NO: 353821 - DNA, 25 bp, Rattus norvegicus
gagtctgttccttatacaaatcatt

SEQ ID NO: 353822 - DNA, 25 bp, Rattus norvegicus
gagtctgttgccctcaaaggcaagg

SEQ ID NO: 353823 - DNA, 25 bp, Rattus norvegicus
gagtctgttgccgtcaaaggcaagg

SEQ ID NO: 353824 - DNA, 25 bp, Rattus norvegicus
gagtctgttggaattgcacctgcca

SEQ ID NO: 353825 - DNA, 25 bp, Rattus norvegicus
gagtctgttggatttgcacctgcca

SEQ ID NO: 353826 - DNA, 25 bp, Rattus norvegicus
gagtctgtttctaccatagtcactg

SEQ ID NO: 353827 - DNA, 25 bp, Rattus norvegicus
gagtctgtttcttccatagtcactg

SEQ ID NO: 353828 - DNA, 25 bp, Rattus norvegicus
gagtctgtttgcaattcccggaatc

SEQ ID NO: 353829 - DNA, 25 bp, Rattus norvegicus
gagtctgtttgctattcccggaatc

SEQ ID NO: 353830 - DNA, 25 bp, Rattus norvegicus
gagtctgtttggaacaacctctggt

SEQ ID NO: 353831 - DNA, 25 bp, Rattus norvegicus
gagtctgtttggtacaacctctggt

SEQ ID NO: 353832 - DNA, 25 bp, Rattus norvegicus
gagtctgtttttctctagcaccatt

SEQ ID NO: 353833 - DNA, 25 bp, Rattus norvegicus
gagtctgtttttgtctagcaccatt

SEQ ID NO: 353834 - DNA, 25 bp, Rattus norvegicus
gagtcttaagtcacagagctcattc

SEQ ID NO: 353835 - DNA, 25 bp, Rattus norvegicus
gagtcttaagtctcagagctcattc

SEQ ID NO: 353836 - DNA, 25 bp, Rattus norvegicus
gagtcttaatcactctcttgtaatt

SEQ ID NO: 353837 - DNA, 25 bp, Rattus norvegicus
gagtcttaatcagtctcttgtaatt

SEQ ID NO: 353838 - DNA, 25 bp, Rattus norvegicus
gagtcttacaacaaagagggttctt

SEQ ID NO: 353839 - DNA, 25 bp, Rattus norvegicus
gagtcttacaactaagagggttctt

SEQ ID NO: 353840 - DNA, 25 bp, Rattus norvegicus
gagtcttaccataagtctttcagaa

SEQ ID NO: 353841 - DNA, 25 bp, Rattus norvegicus
gagtcttaccattagtctttcagaa

SEQ ID NO: 353842 - DNA, 25 bp, Rattus norvegicus
gagtcttactctatggccaagctgg

SEQ ID NO: 353843 - DNA, 25 bp, Rattus norvegicus
gagtcttactctattttagtggctg

SEQ ID NO: 353844 - DNA, 25 bp, Rattus norvegicus
gagtcttactctttggccaagctgg

SEQ ID NO: 353845 - DNA, 25 bp, Rattus norvegicus
gagtcttactcttttttagtggctg

SEQ ID NO: 353846 - DNA, 25 bp, Rattus norvegicus
gagtcttactggagcgtctggtttc

SEQ ID NO: 353847 - DNA, 25 bp, Rattus norvegicus
gagtcttactggtgcgtctggtttc

SEQ ID NO: 353848 - DNA, 25 bp, Rattus norvegicus
gagtcttagcctatcaagccttgaa

SEQ ID NO: 353849 - DNA, 25 bp, Rattus norvegicus
gagtcttagcctttcaagccttgaa

SEQ ID NO: 353850 - DNA, 25 bp, Rattus norvegicus
gagtcttaggcaaatgaccatttat

SEQ ID NO: 353851 - DNA, 25 bp, Rattus norvegicus
gagtcttaggcatatgaccatttat

SEQ ID NO: 353852 - DNA, 25 bp, Rattus norvegicus
gagtcttagggaccatgccactctc

SEQ ID NO: 353853 - DNA, 25 bp, Rattus norvegicus
gagtcttagggagcatgccactctc

SEQ ID NO: 353854 - DNA, 25 bp, Rattus norvegicus
gagtcttatactccgttctatgata

SEQ ID NO: 353855 - DNA, 25 bp, Rattus norvegicus
gagtcttatactgcgttctatgata

SEQ ID NO: 353856 - DNA, 25 bp, Rattus norvegicus
gagtcttatctccaaccagttttac

SEQ ID NO: 353857 - DNA, 25 bp, Rattus norvegicus
gagtcttatctcgaaccagttttac

SEQ ID NO: 353858 - DNA, 25 bp, Rattus norvegicus
gagtcttatggtctcaatcctccaa

SEQ ID NO: 353859 - DNA, 25 bp, Rattus norvegicus
gagtcttatggtgtcaatcctccaa

SEQ ID NO: 353860 - DNA, 25 bp, Rattus norvegicus
gagtcttatttacctcaactgtgaa

SEQ ID NO: 353861 - DNA, 25 bp, Rattus norvegicus
gagtcttatttagctcaactgtgaa

SEQ ID NO: 353862 - DNA, 25 bp, Rattus norvegicus
gagtcttattttctaaagtctgcag

SEQ ID NO: 353863 - DNA, 25 bp, Rattus norvegicus
gagtcttattttgtaaagtctgcag

SEQ ID NO: 353864 - DNA, 25 bp, Rattus norvegicus
gagtcttcaaagagaacagcccagt

SEQ ID NO: 353865 - DNA, 25 bp, Rattus norvegicus
gagtcttcaaagatccgtggcagtc

SEQ ID NO: 353866 - DNA, 25 bp, Rattus norvegicus
gagtcttcaaagtgaacagcccagt

SEQ ID NO: 353867 - DNA, 25 bp, Rattus norvegicus
gagtcttcaaagttccgtggcagtc

SEQ ID NO: 353868 - DNA, 25 bp, Rattus norvegicus
gagtcttcacttctcatgatagcca

SEQ ID NO: 353869 - DNA, 25 bp, Rattus norvegicus
gagtcttcacttgtcatgatagcca

SEQ ID NO: 353870 - DNA, 25 bp, Rattus norvegicus
gagtcttcagagactttgtaattaa

SEQ ID NO: 353871 - DNA, 25 bp, Rattus norvegicus
gagtcttcagagtctttgtaattaa

SEQ ID NO: 353872 - DNA, 25 bp, Rattus norvegicus
gagtcttcagctatcaataggccat

SEQ ID NO: 353873 - DNA, 25 bp, Rattus norvegicus
gagtcttcagctttcaataggccat

SEQ ID NO: 353874 - DNA, 25 bp, Rattus norvegicus
gagtcttcatgaaccagaactgcac

SEQ ID NO: 353875 - DNA, 25 bp, Rattus norvegicus
gagtcttcatgatccagaactgcac

SEQ ID NO: 353876 - DNA, 25 bp, Rattus norvegicus
gagtcttcattgaggaatcccagaa

SEQ ID NO: 353877 - DNA, 25 bp, Rattus norvegicus
gagtcttcattgtggaatcccagaa

SEQ ID NO: 353878 - DNA, 25 bp, Rattus norvegicus
gagtcttccaaaaagaacatccatg

SEQ ID NO: 353879 - DNA, 25 bp, Rattus norvegicus
gagtcttccaaatagaacatccatg

SEQ ID NO: 353880 - DNA, 25 bp, Rattus norvegicus
gagtcttccagcatgtccattaagg

SEQ ID NO: 353881 - DNA, 25 bp, Rattus norvegicus
gagtcttccagcttgtccattaagg

SEQ ID NO: 353882 - DNA, 25 bp, Rattus norvegicus
gagtcttcccgccaattcttactag

SEQ ID NO: 353883 - DNA, 25 bp, Rattus norvegicus
gagtcttcccgcgaattcttactag

SEQ ID NO: 353884 - DNA, 25 bp, Rattus norvegicus
gagtcttcgtggatcagcctttctg

SEQ ID NO: 353885 - DNA, 25 bp, Rattus norvegicus
gagtcttcgtggttcagcctttctg

SEQ ID NO: 353886 - DNA, 25 bp, Rattus norvegicus
gagtcttcgttgagtagatgtaaac

SEQ ID NO: 353887 - DNA, 25 bp, Rattus norvegicus
gagtcttcgttgtgtagatgtaaac

SEQ ID NO: 353888 - DNA, 25 bp, Rattus norvegicus
gagtcttctaatctcctttatttct

SEQ ID NO: 353889 - DNA, 25 bp, Rattus norvegicus
gagtcttctaatgtcctttatttct

SEQ ID NO: 353890 - DNA, 25 bp, Rattus norvegicus
gagtcttctatgaacagccatgctg

SEQ ID NO: 353891 - DNA, 25 bp, Rattus norvegicus
gagtcttctatgtacagccatgctg

SEQ ID NO: 353892 - DNA, 25 bp, Rattus norvegicus
gagtcttctctactagattctcagc

SEQ ID NO: 353893 - DNA, 25 bp, Rattus norvegicus
gagtcttctctagtagattctcagc

SEQ ID NO: 353894 - DNA, 25 bp, Rattus norvegicus
gagtcttctcttcagtttgcaccca

SEQ ID NO: 353895 - DNA, 25 bp, Rattus norvegicus
gagtcttctcttgagtttgcaccca

SEQ ID NO: 353896 - DNA, 25 bp, Rattus norvegicus
gagtcttctgaaaccactcctaagg

SEQ ID NO: 353897 - DNA, 25 bp, Rattus norvegicus
gagtcttctgaatccactcctaagg

SEQ ID NO: 353898 - DNA, 25 bp, Rattus norvegicus
gagtcttctgctcgtggatccttca

SEQ ID NO: 353899 - DNA, 25 bp, Rattus norvegicus
gagtcttctgctggtggatccttca

SEQ ID NO: 353900 - DNA, 25 bp, Rattus norvegicus
gagtcttctgtgactgaactgtttc

SEQ ID NO: 353901 - DNA, 25 bp, Rattus norvegicus
gagtcttctgtgtctgaactgtttc

SEQ ID NO: 353902 - DNA, 25 bp, Rattus norvegicus
gagtcttcttaactattcatgaggg

SEQ ID NO: 353903 - DNA, 25 bp, Rattus norvegicus
gagtcttcttaagtattcatgaggg

SEQ ID NO: 353904 - DNA, 25 bp, Rattus norvegicus
gagtcttcttacactgatgctatct

SEQ ID NO: 353905 - DNA, 25 bp, Rattus norvegicus
gagtcttcttactctgatgctatct

SEQ ID NO: 353906 - DNA, 25 bp, Rattus norvegicus
gagtcttctttgctgaccagtgtac

SEQ ID NO: 353907 - DNA, 25 bp, Rattus norvegicus
gagtcttctttggtgaccagtgtac

SEQ ID NO: 353908 - DNA, 25 bp, Rattus norvegicus
gagtcttgaaaccaacacgtcttct

SEQ ID NO: 353909 - DNA, 25 bp, Rattus norvegicus
gagtcttgaaacgaacacgtcttct

SEQ ID NO: 353910 - DNA, 25 bp, Rattus norvegicus
gagtcttgacctagtaacttgcctt

SEQ ID NO: 353911 - DNA, 25 bp, Rattus norvegicus
gagtcttgaccttgtaacttgcctt

SEQ ID NO: 353912 - DNA, 25 bp, Rattus norvegicus
gagtcttgaggaccctaagccttgg

SEQ ID NO: 353913 - DNA, 25 bp, Rattus norvegicus
gagtcttgaggagcctaagccttgg

SEQ ID NO: 353914 - DNA, 25 bp, Rattus norvegicus
gagtcttgagtcaggccacctctga

SEQ ID NO: 353915 - DNA, 25 bp, Rattus norvegicus
gagtcttgagtctggccacctctga

SEQ ID NO: 353916 - DNA, 25 bp, Rattus norvegicus
gagtcttgagttaactgggtacagt

SEQ ID NO: 353917 - DNA, 25 bp, Rattus norvegicus
gagtcttgagtttactgggtacagt

SEQ ID NO: 353918 - DNA, 25 bp, Rattus norvegicus
gagtcttgcccaatgatgtgcacaa

SEQ ID NO: 353919 - DNA, 25 bp, Rattus norvegicus
gagtcttgcccattgatgtgcacaa

SEQ ID NO: 353920 - DNA, 25 bp, Rattus norvegicus
gagtcttgcctgaggatcaaggcct

SEQ ID NO: 353921 - DNA, 25 bp, Rattus norvegicus
gagtcttgcctgtggatcaaggcct

SEQ ID NO: 353922 - DNA, 25 bp, Rattus norvegicus
gagtcttgcggtctttccagagatt

SEQ ID NO: 353923 - DNA, 25 bp, Rattus norvegicus
gagtcttgcggtgtttccagagatt

SEQ ID NO: 353924 - DNA, 25 bp, Rattus norvegicus
gagtcttgcttaactcctagcactg

SEQ ID NO: 353925 - DNA, 25 bp, Rattus norvegicus
gagtcttgcttatctcctagcactg

SEQ ID NO: 353926 - DNA, 25 bp, Rattus norvegicus
gagtcttggactcaaaggctaaacc

SEQ ID NO: 353927 - DNA, 25 bp, Rattus norvegicus
gagtcttggactgaaaggctaaacc

SEQ ID NO: 353928 - DNA, 25 bp, Rattus norvegicus
gagtcttggagaccgcataagctac

SEQ ID NO: 353929 - DNA, 25 bp, Rattus norvegicus
gagtcttggagagcgcataagctac

SEQ ID NO: 353930 - DNA, 25 bp, Rattus norvegicus
gagtcttggcacattccttcaagaa

SEQ ID NO: 353931 - DNA, 25 bp, Rattus norvegicus
gagtcttggcactttccttcaagaa

SEQ ID NO: 353932 - DNA, 25 bp, Rattus norvegicus
gagtcttggcagagcgtgaccatcc

SEQ ID NO: 353933 - DNA, 25 bp, Rattus norvegicus
gagtcttggcagtgcgtgaccatcc

SEQ ID NO: 353934 - DNA, 25 bp, Rattus norvegicus
gagtcttgggacagcctgtggaaca

SEQ ID NO: 353935 - DNA, 25 bp, Rattus norvegicus
gagtcttgggactgcctgtggaaca

SEQ ID NO: 353936 - DNA, 25 bp, Rattus norvegicus
gagtcttgggttccgtgtaaagcaa

SEQ ID NO: 353937 - DNA, 25 bp, Rattus norvegicus
gagtcttgggttgcgtgtaaagcaa

SEQ ID NO: 353938 - DNA, 25 bp, Rattus norvegicus
gagtcttggtggagggtctacatca

SEQ ID NO: 353939 - DNA, 25 bp, Rattus norvegicus
gagtcttggtggtgggtctacatca

SEQ ID NO: 353940 - DNA, 25 bp, Rattus norvegicus
gagtcttggttccttagatggtgta

SEQ ID NO: 353941 - DNA, 25 bp, Rattus norvegicus
gagtcttggttcgttagatggtgta

SEQ ID NO: 353942 - DNA, 25 bp, Rattus norvegicus
gagtcttgtacaaacattcacatgt

SEQ ID NO: 353943 - DNA, 25 bp, Rattus norvegicus
gagtcttgtacatacattcacatgt

SEQ ID NO: 353944 - DNA, 25 bp, Rattus norvegicus
gagtcttgtcataaaacagccacct

SEQ ID NO: 353945 - DNA, 25 bp, Rattus norvegicus
gagtcttgtcattaaacagccacct

SEQ ID NO: 353946 - DNA, 25 bp, Rattus norvegicus
gagtcttgtcgcatggacctcagaa

SEQ ID NO: 353947 - DNA, 25 bp, Rattus norvegicus
gagtcttgtcgcttggacctcagaa

SEQ ID NO: 353948 - DNA, 25 bp, Rattus norvegicus
gagtcttgtgcaaaactacgtgtaa

SEQ ID NO: 353949 - DNA, 25 bp, Rattus norvegicus
gagtcttgtgcataactacgtgtaa

SEQ ID NO: 353950 - DNA, 25 bp, Rattus norvegicus
gagtctttacaaagtctctcacact

SEQ ID NO: 353951 - DNA, 25 bp, Rattus norvegicus
gagtctttacaatgtctctcacact

SEQ ID NO: 353952 - DNA, 25 bp, Rattus norvegicus
gagtctttatgaaccagaactgcac

SEQ ID NO: 353953 - DNA, 25 bp, Rattus norvegicus
gagtctttatgatccagaactgcac

SEQ ID NO: 353954 - DNA, 25 bp, Rattus norvegicus
gagtctttatttatcacatcactga

SEQ ID NO: 353955 - DNA, 25 bp, Rattus norvegicus
gagtctttatttttcacatcactga

SEQ ID NO: 353956 - DNA, 25 bp, Rattus norvegicus
gagtctttccacaaactacaagccc

SEQ ID NO: 353957 - DNA, 25 bp, Rattus norvegicus
gagtctttccactaactacaagccc

SEQ ID NO: 353958 - DNA, 25 bp, Rattus norvegicus
gagtctttccttcatagtttactat

SEQ ID NO: 353959 - DNA, 25 bp, Rattus norvegicus
gagtctttccttgatagtttactat

SEQ ID NO: 353960 - DNA, 25 bp, Rattus norvegicus
gagtctttcgacaagtttgtttcct

SEQ ID NO: 353961 - DNA, 25 bp, Rattus norvegicus
gagtctttcgactagtttgtttcct

SEQ ID NO: 353962 - DNA, 25 bp, Rattus norvegicus
gagtctttctgcaggctccaagtca

SEQ ID NO: 353963 - DNA, 25 bp, Rattus norvegicus
gagtctttctgctggctccaagtca

SEQ ID NO: 353964 - DNA, 25 bp, Rattus norvegicus
gagtctttcttgatcttcaacttgg

SEQ ID NO: 353965 - DNA, 25 bp, Rattus norvegicus
gagtctttcttgttcttcaacttgg

SEQ ID NO: 353966 - DNA, 25 bp, Rattus norvegicus
gagtctttgaaaccatcttccccag

SEQ ID NO: 353967 - DNA, 25 bp, Rattus norvegicus
gagtctttgaaagcatcttccccag

SEQ ID NO: 353968 - DNA, 25 bp, Rattus norvegicus
gagtctttgaagagcttactggtct

SEQ ID NO: 353969 - DNA, 25 bp, Rattus norvegicus
gagtctttgaagtgcttactggtct

SEQ ID NO: 353970 - DNA, 25 bp, Rattus norvegicus
gagtctttgagaaccttgcttttca

SEQ ID NO: 353971 - DNA, 25 bp, Rattus norvegicus
gagtctttgagatccttgcttttca

SEQ ID NO: 353972 - DNA, 25 bp, Rattus norvegicus
gagtctttgctaaagcttaggcaga

SEQ ID NO: 353973 - DNA, 25 bp, Rattus norvegicus
gagtctttgctatagcttaggcaga

SEQ ID NO: 353974 - DNA, 25 bp, Rattus norvegicus
gagtctttggacacaaggtcctgga

SEQ ID NO: 353975 - DNA, 25 bp, Rattus norvegicus
gagtctttggactcaaggtcctgga

SEQ ID NO: 353976 - DNA, 25 bp, Rattus norvegicus
gagtctttgtttacacgctgttcct

SEQ ID NO: 353977 - DNA, 25 bp, Rattus norvegicus
gagtctttgttttcacgctgttcct

SEQ ID NO: 353978 - DNA, 25 bp, Rattus norvegicus
gagtcttttaggacccagtgttcca

SEQ ID NO: 353979 - DNA, 25 bp, Rattus norvegicus
gagtcttttaggtcccagtgttcca

SEQ ID NO: 353980 - DNA, 25 bp, Rattus norvegicus
gagtcttttatactgtctctacttg

SEQ ID NO: 353981 - DNA, 25 bp, Rattus norvegicus
gagtcttttatagtgtctctacttg

SEQ ID NO: 353982 - DNA, 25 bp, Rattus norvegicus
gagtcttttattaccattaccccat

SEQ ID NO: 353983 - DNA, 25 bp, Rattus norvegicus
gagtcttttatttccattaccccat

SEQ ID NO: 353984 - DNA, 25 bp, Rattus norvegicus
gagtcttttctcatgccagctaaaa

SEQ ID NO: 353985 - DNA, 25 bp, Rattus norvegicus
gagtcttttctcttgccagctaaaa

SEQ ID NO: 353986 - DNA, 25 bp, Rattus norvegicus
gagtgaaaactacctcggttccagc

SEQ ID NO: 353987 - DNA, 25 bp, Rattus norvegicus
gagtgaaaactacttcccttctaca

SEQ ID NO: 353988 - DNA, 25 bp, Rattus norvegicus
gagtgaaaactagctcggttccagc

SEQ ID NO: 353989 - DNA, 25 bp, Rattus norvegicus
gagtgaaaactagttcccttctaca

SEQ ID NO: 353990 - DNA, 25 bp, Rattus norvegicus
gagtgaaaactcactactttattat

SEQ ID NO: 353991 - DNA, 25 bp, Rattus norvegicus
gagtgaaaactctctactttattat

SEQ ID NO: 353992 - DNA, 25 bp, Rattus norvegicus
gagtgaaaatgtccagccacgccag

SEQ ID NO: 353993 - DNA, 25 bp, Rattus norvegicus
gagtgaaaatgtgcagccacgccag

SEQ ID NO: 353994 - DNA, 25 bp, Rattus norvegicus
gagtgaaacggcctgctttctcaca

SEQ ID NO: 353995 - DNA, 25 bp, Rattus norvegicus
gagtgaaacggcgtgctttctcaca

SEQ ID NO: 353996 - DNA, 25 bp, Rattus norvegicus
gagtgaaagactccgccattggacc

SEQ ID NO: 353997 - DNA, 25 bp, Rattus norvegicus
gagtgaaagactgcgccattggacc

SEQ ID NO: 353998 - DNA, 25 bp, Rattus norvegicus
gagtgaaagcagctccagtgacagt

SEQ ID NO: 353999 - DNA, 25 bp, Rattus norvegicus
gagtgaaagcaggtccagtgacagt

SEQ ID NO: 354000 - DNA, 25 bp, Rattus norvegicus
gagtgaaaggtaccccattccatcc

SEQ ID NO: 354001 - DNA, 25 bp, Rattus norvegicus
gagtgaaaggtagcccattccatcc

SEQ ID NO: 354002 - DNA, 25 bp, Rattus norvegicus
gagtgaaagtaacctcatgccgatt

SEQ ID NO: 354003 - DNA, 25 bp, Rattus norvegicus
gagtgaaagtaagctcatgccgatt

SEQ ID NO: 354004 - DNA, 25 bp, Rattus norvegicus
gagtgaaatcaccagcagctatgcc

SEQ ID NO: 354005 - DNA, 25 bp, Rattus norvegicus
gagtgaaatcacgagcagctatgcc

SEQ ID NO: 354006 - DNA, 25 bp, Rattus norvegicus
gagtgaaatcatccatgctcgattt

SEQ ID NO: 354007 - DNA, 25 bp, Rattus norvegicus
gagtgaaatcatgcatgctcgattt

SEQ ID NO: 354008 - DNA, 25 bp, Rattus norvegicus
gagtgaaatcttccctctttggaaa

SEQ ID NO: 354009 - DNA, 25 bp, Rattus norvegicus
gagtgaaatcttgcctctttggaaa

SEQ ID NO: 354010 - DNA, 25 bp, Rattus norvegicus
gagtgaaatggaaactacaccttta

SEQ ID NO: 354011 - DNA, 25 bp, Rattus norvegicus
gagtgaaatggatactacaccttta

SEQ ID NO: 354012 - DNA, 25 bp, Rattus norvegicus
gagtgaaattctcctactttctgga

SEQ ID NO: 354013 - DNA, 25 bp, Rattus norvegicus
gagtgaaattctgctactttctgga

SEQ ID NO: 354014 - DNA, 25 bp, Rattus norvegicus
gagtgaacagtaacagccctggttc

SEQ ID NO: 354015 - DNA, 25 bp, Rattus norvegicus
gagtgaacagtatcagccctggttc

SEQ ID NO: 354016 - DNA, 25 bp, Rattus norvegicus
gagtgaacatggaccaaacccacag

SEQ ID NO: 354017 - DNA, 25 bp, Rattus norvegicus
gagtgaacatggtccaaacccacag

SEQ ID NO: 354018 - DNA, 25 bp, Rattus norvegicus
gagtgaaccacgatggcccttttct

SEQ ID NO: 354019 - DNA, 25 bp, Rattus norvegicus
gagtgaaccacgttggcccttttct

SEQ ID NO: 354020 - DNA, 25 bp, Rattus norvegicus
gagtgaaccagccttagttgtgttt

SEQ ID NO: 354021 - DNA, 25 bp, Rattus norvegicus
gagtgaaccagcgttagttgtgttt

SEQ ID NO: 354022 - DNA, 25 bp, Rattus norvegicus
gagtgaaccctacagcaggtttcgg

SEQ ID NO: 354023 - DNA, 25 bp, Rattus norvegicus
gagtgaaccctagagcaggtttcgg

SEQ ID NO: 354024 - DNA, 25 bp, Rattus norvegicus
gagtgaaccctcagttagccagcaa

SEQ ID NO: 354025 - DNA, 25 bp, Rattus norvegicus
gagtgaaccctctgttagccagcaa

SEQ ID NO: 354026 - DNA, 25 bp, Rattus norvegicus
gagtgaacgtggacacacatttcca

SEQ ID NO: 354027 - DNA, 25 bp, Rattus norvegicus
gagtgaacgtggtcacacatttcca

SEQ ID NO: 354028 - DNA, 25 bp, Rattus norvegicus
gagtgaactcaaaaaaccttgggtt

SEQ ID NO: 354029 - DNA, 25 bp, Rattus norvegicus
gagtgaactcaataaaccttgggtt

SEQ ID NO: 354030 - DNA, 25 bp, Rattus norvegicus
gagtgaactcccatgctgagcgggt

SEQ ID NO: 354031 - DNA, 25 bp, Rattus norvegicus
gagtgaactcccttgctgagcgggt

SEQ ID NO: 354032 - DNA, 25 bp, Rattus norvegicus
gagtgaactctccagaaataccagt

SEQ ID NO: 354033 - DNA, 25 bp, Rattus norvegicus
gagtgaactctcgagaaataccagt

SEQ ID NO: 354034 - DNA, 25 bp, Rattus norvegicus
gagtgaactcttcctctcttcagct

SEQ ID NO: 354035 - DNA, 25 bp, Rattus norvegicus
gagtgaactcttgctctcttcagct

SEQ ID NO: 354036 - DNA, 25 bp, Rattus norvegicus
gagtgaagactaagctctcccatct

SEQ ID NO: 354037 - DNA, 25 bp, Rattus norvegicus
gagtgaagactatgctctcccatct

SEQ ID NO: 354038 - DNA, 25 bp, Rattus norvegicus
gagtgaagattgactcagctctgac

SEQ ID NO: 354039 - DNA, 25 bp, Rattus norvegicus
gagtgaagattgtctcagctctgac

SEQ ID NO: 354040 - DNA, 25 bp, Rattus norvegicus
gagtgaagcaagctccgtccctaaa

SEQ ID NO: 354041 - DNA, 25 bp, Rattus norvegicus
gagtgaagcaaggtccgtccctaaa

SEQ ID NO: 354042 - DNA, 25 bp, Rattus norvegicus
gagtgaagccacacccaggctgatg

SEQ ID NO: 354043 - DNA, 25 bp, Rattus norvegicus
gagtgaagccactcccaggctgatg

SEQ ID NO: 354044 - DNA, 25 bp, Rattus norvegicus
gagtgaagctctctaagtctcttag

SEQ ID NO: 354045 - DNA, 25 bp, Rattus norvegicus
gagtgaagctctgtaagtctcttag

SEQ ID NO: 354046 - DNA, 25 bp, Rattus norvegicus
gagtgaagtagcatcctgttcccag

SEQ ID NO: 354047 - DNA, 25 bp, Rattus norvegicus
gagtgaagtagcttcctgttcccag

SEQ ID NO: 354048 - DNA, 25 bp, Rattus norvegicus
gagtgaagtcagactccttgagtct

SEQ ID NO: 354049 - DNA, 25 bp, Rattus norvegicus
gagtgaagtcagtctccttgagtct

SEQ ID NO: 354050 - DNA, 25 bp, Rattus norvegicus
gagtgaagtcccatctgaaagaaaa

SEQ ID NO: 354051 - DNA, 25 bp, Rattus norvegicus
gagtgaagtcccttctgaaagaaaa

SEQ ID NO: 354052 - DNA, 25 bp, Rattus norvegicus
gagtgaagtcctctcatccataaaa

SEQ ID NO: 354053 - DNA, 25 bp, Rattus norvegicus
gagtgaagtcctgtcatccataaaa

SEQ ID NO: 354054 - DNA, 25 bp, Rattus norvegicus
gagtgaagtgacagtgcccttagct

SEQ ID NO: 354055 - DNA, 25 bp, Rattus norvegicus
gagtgaagtgactgtgcccttagct

SEQ ID NO: 354056 - DNA, 25 bp, Rattus norvegicus
gagtgaatacccacttcaggaagca

SEQ ID NO: 354057 - DNA, 25 bp, Rattus norvegicus
gagtgaataccctcttcaggaagca

SEQ ID NO: 354058 - DNA, 25 bp, Rattus norvegicus
gagtgaatatccaacctaccacact

SEQ ID NO: 354059 - DNA, 25 bp, Rattus norvegicus
gagtgaatatcctacctaccacact

SEQ ID NO: 354060 - DNA, 25 bp, Rattus norvegicus
gagtgaatcctccagacagccaaga

SEQ ID NO: 354061 - DNA, 25 bp, Rattus norvegicus
gagtgaatcctcgagacagccaaga

SEQ ID NO: 354062 - DNA, 25 bp, Rattus norvegicus
gagtgaatctgaaattgtgccaaaa

SEQ ID NO: 354063 - DNA, 25 bp, Rattus norvegicus
gagtgaatctgatattgtgccaaaa

SEQ ID NO: 354064 - DNA, 25 bp, Rattus norvegicus
gagtgaatctgcatgttaaaatgac

SEQ ID NO: 354065 - DNA, 25 bp, Rattus norvegicus
gagtgaatctgcttgttaaaatgac

SEQ ID NO: 354066 - DNA, 25 bp, Rattus norvegicus
gagtgaatgtatacatgctacaatt

SEQ ID NO: 354067 - DNA, 25 bp, Rattus norvegicus
gagtgaatgtattcatgctacaatt

SEQ ID NO: 354068 - DNA, 25 bp, Rattus norvegicus
gagtgaattctgagtgtttttgctg

SEQ ID NO: 354069 - DNA, 25 bp, Rattus norvegicus
gagtgaattctgtgtgtttttgctg

SEQ ID NO: 354070 - DNA, 25 bp, Rattus norvegicus
gagtgaatttagcagcagcgctgct

SEQ ID NO: 354071 - DNA, 25 bp, Rattus norvegicus
gagtgaatttaggagcagcgctgct

SEQ ID NO: 354072 - DNA, 25 bp, Rattus norvegicus
gagtgaatttatattcccctcagtt

SEQ ID NO: 354073 - DNA, 25 bp, Rattus norvegicus
gagtgaatttattttcccctcagtt

SEQ ID NO: 354074 - DNA, 25 bp, Rattus norvegicus
gagtgacaacgcagacccgagtggc

SEQ ID NO: 354075 - DNA, 25 bp, Rattus norvegicus
gagtgacaacgctgacccgagtggc

SEQ ID NO: 354076 - DNA, 25 bp, Rattus norvegicus
gagtgacaatgacttctgaccttct

SEQ ID NO: 354077 - DNA, 25 bp, Rattus norvegicus
gagtgacaatgagttctgaccttct

SEQ ID NO: 354078 - DNA, 25 bp, Rattus norvegicus
gagtgacaattcagaccgtgttcct

SEQ ID NO: 354079 - DNA, 25 bp, Rattus norvegicus
gagtgacaattctgaccgtgttcct

SEQ ID NO: 354080 - DNA, 25 bp, Rattus norvegicus
gagtgacaccaccacctacaagaac

SEQ ID NO: 354081 - DNA, 25 bp, Rattus norvegicus
gagtgacaccacgacctacaagaac

SEQ ID NO: 354082 - DNA, 25 bp, Rattus norvegicus
gagtgacacctacgaacctgcaggt

SEQ ID NO: 354083 - DNA, 25 bp, Rattus norvegicus
gagtgacacctaggaacctgcaggt

SEQ ID NO: 354084 - DNA, 25 bp, Rattus norvegicus
gagtgacactcacttctgccaccag

SEQ ID NO: 354085 - DNA, 25 bp, Rattus norvegicus
gagtgacactcagttctgccaccag

SEQ ID NO: 354086 - DNA, 25 bp, Rattus norvegicus
gagtgacactcgctatttcttcaag

SEQ ID NO: 354087 - DNA, 25 bp, Rattus norvegicus
gagtgacactcggtatttcttcaag

SEQ ID NO: 354088 - DNA, 25 bp, Rattus norvegicus
gagtgacactttcatcctctcacaa

SEQ ID NO: 354089 - DNA, 25 bp, Rattus norvegicus
gagtgacactttccggattcattcg

SEQ ID NO: 354090 - DNA, 25 bp, Rattus norvegicus
gagtgacactttgatcctctcacaa

SEQ ID NO: 354091 - DNA, 25 bp, Rattus norvegicus
gagtgacactttgcggattcattcg

SEQ ID NO: 354092 - DNA, 25 bp, Rattus norvegicus
gagtgacagaaacatgccggcttct

SEQ ID NO: 354093 - DNA, 25 bp, Rattus norvegicus
gagtgacagaaagatgccggcttct

SEQ ID NO: 354094 - DNA, 25 bp, Rattus norvegicus
gagtgacagaagagtaccctttcca

SEQ ID NO: 354095 - DNA, 25 bp, Rattus norvegicus
gagtgacagaagtgtaccctttcca

SEQ ID NO: 354096 - DNA, 25 bp, Rattus norvegicus
gagtgacagactattcagcagagca

SEQ ID NO: 354097 - DNA, 25 bp, Rattus norvegicus
gagtgacagacttttcagcagagca

SEQ ID NO: 354098 - DNA, 25 bp, Rattus norvegicus
gagtgacagcctaagctgtgctcat

SEQ ID NO: 354099 - DNA, 25 bp, Rattus norvegicus
gagtgacagccttagctgtgctcat

SEQ ID NO: 354100 - DNA, 25 bp, Rattus norvegicus
gagtgacagctacgaaccccggaac

SEQ ID NO: 354101 - DNA, 25 bp, Rattus norvegicus
gagtgacagctaggaaccccggaac

SEQ ID NO: 354102 - DNA, 25 bp, Rattus norvegicus
gagtgacagctgaggtaccctggct

SEQ ID NO: 354103 - DNA, 25 bp, Rattus norvegicus
gagtgacagctgtggtaccctggct

SEQ ID NO: 354104 - DNA, 25 bp, Rattus norvegicus
gagtgacaggatccaagctgcgatc

SEQ ID NO: 354105 - DNA, 25 bp, Rattus norvegicus
gagtgacaggatgcaagctgcgatc

SEQ ID NO: 354106 - DNA, 25 bp, Rattus norvegicus
gagtgacatcatatatctactgttg

SEQ ID NO: 354107 - DNA, 25 bp, Rattus norvegicus
gagtgacatcatttatctactgttg

SEQ ID NO: 354108 - DNA, 25 bp, Rattus norvegicus
gagtgacatcccaggtacgacataa

SEQ ID NO: 354109 - DNA, 25 bp, Rattus norvegicus
gagtgacatccctggtacgacataa

SEQ ID NO: 354110 - DNA, 25 bp, Rattus norvegicus
gagtgacattcaaatggctgtccac

SEQ ID NO: 354111 - DNA, 25 bp, Rattus norvegicus
gagtgacattcatatggctgtccac

SEQ ID NO: 354112 - DNA, 25 bp, Rattus norvegicus
gagtgacattctaagtttcgtgttt

SEQ ID NO: 354113 - DNA, 25 bp, Rattus norvegicus
gagtgacattctagctcctggactt

SEQ ID NO: 354114 - DNA, 25 bp, Rattus norvegicus
gagtgacattcttagtttcgtgttt

SEQ ID NO: 354115 - DNA, 25 bp, Rattus norvegicus
gagtgacattcttgctcctggactt

SEQ ID NO: 354116 - DNA, 25 bp, Rattus norvegicus
gagtgaccaacccatttgtagcgat

SEQ ID NO: 354117 - DNA, 25 bp, Rattus norvegicus
gagtgaccaaccgatttgtagcgat

SEQ ID NO: 354118 - DNA, 25 bp, Rattus norvegicus
gagtgaccaagcaagcattcttact

SEQ ID NO: 354119 - DNA, 25 bp, Rattus norvegicus
gagtgaccaagccaacaccctggtg

SEQ ID NO: 354120 - DNA, 25 bp, Rattus norvegicus
gagtgaccaagcgaacaccctggtg

SEQ ID NO: 354121 - DNA, 25 bp, Rattus norvegicus
gagtgaccaagctagcattcttact

SEQ ID NO: 354122 - DNA, 25 bp, Rattus norvegicus
gagtgaccagaaatctcgctgcaaa

SEQ ID NO: 354123 - DNA, 25 bp, Rattus norvegicus
gagtgaccagaattctcgctgcaaa

SEQ ID NO: 354124 - DNA, 25 bp, Rattus norvegicus
gagtgaccagacagcaggctacctg

SEQ ID NO: 354125 - DNA, 25 bp, Rattus norvegicus
gagtgaccagactgcaggctacctg

SEQ ID NO: 354126 - DNA, 25 bp, Rattus norvegicus
gagtgaccagccacagtgcacagca

SEQ ID NO: 354127 - DNA, 25 bp, Rattus norvegicus
gagtgaccagccagctatgacagca

SEQ ID NO: 354128 - DNA, 25 bp, Rattus norvegicus
gagtgaccagcctcagtgcacagca

SEQ ID NO: 354129 - DNA, 25 bp, Rattus norvegicus
gagtgaccagcctgctatgacagca

SEQ ID NO: 354130 - DNA, 25 bp, Rattus norvegicus
gagtgaccagctatgtgtccagtat

SEQ ID NO: 354131 - DNA, 25 bp, Rattus norvegicus
gagtgaccagctcaacatcagcagt

SEQ ID NO: 354132 - DNA, 25 bp, Rattus norvegicus
gagtgaccagctgaacatcagcagt

SEQ ID NO: 354133 - DNA, 25 bp, Rattus norvegicus
gagtgaccagctttgtgtccagtat

SEQ ID NO: 354134 - DNA, 25 bp, Rattus norvegicus
gagtgaccaggaactcagctacctt

SEQ ID NO: 354135 - DNA, 25 bp, Rattus norvegicus
gagtgaccaggaactgatccttttc

SEQ ID NO: 354136 - DNA, 25 bp, Rattus norvegicus
gagtgaccaggatctcagctacctt

SEQ ID NO: 354137 - DNA, 25 bp, Rattus norvegicus
gagtgaccaggatctgatccttttc

SEQ ID NO: 354138 - DNA, 25 bp, Rattus norvegicus
gagtgaccatcacacatcggaggag

SEQ ID NO: 354139 - DNA, 25 bp, Rattus norvegicus
gagtgaccatcagacatcggaggag

SEQ ID NO: 354140 - DNA, 25 bp, Rattus norvegicus
gagtgaccattaacgggacctgaaa

SEQ ID NO: 354141 - DNA, 25 bp, Rattus norvegicus
gagtgaccattatcgggacctgaaa

SEQ ID NO: 354142 - DNA, 25 bp, Rattus norvegicus
gagtgaccatttaacgtatacctag

SEQ ID NO: 354143 - DNA, 25 bp, Rattus norvegicus
gagtgaccattttacgtatacctag

SEQ ID NO: 354144 - DNA, 25 bp, Rattus norvegicus
gagtgaccctataatgcttctcaag

SEQ ID NO: 354145 - DNA, 25 bp, Rattus norvegicus
gagtgaccctattatgcttctcaag

SEQ ID NO: 354146 - DNA, 25 bp, Rattus norvegicus
gagtgaccctgaacaccaaccggag

SEQ ID NO: 354147 - DNA, 25 bp, Rattus norvegicus
gagtgaccctgatcaccaaccggag

SEQ ID NO: 354148 - DNA, 25 bp, Rattus norvegicus
gagtgaccctgtcacgcacatgata

SEQ ID NO: 354149 - DNA, 25 bp, Rattus norvegicus
gagtgaccctgtgacgcacatgata

SEQ ID NO: 354150 - DNA, 25 bp, Rattus norvegicus
gagtgaccgaagactgcctggagca

SEQ ID NO: 354151 - DNA, 25 bp, Rattus norvegicus
gagtgaccgaagtctgcctggagca

SEQ ID NO: 354152 - DNA, 25 bp, Rattus norvegicus
gagtgaccgggccaacattaaccca

SEQ ID NO: 354153 - DNA, 25 bp, Rattus norvegicus
gagtgaccgggcgaacattaaccca

SEQ ID NO: 354154 - DNA, 25 bp, Rattus norvegicus
gagtgaccgtccctaaagttcttgg

SEQ ID NO: 354155 - DNA, 25 bp, Rattus norvegicus
gagtgaccgtccgtaaagttcttgg

SEQ ID NO: 354156 - DNA, 25 bp, Rattus norvegicus
gagtgacctcagacccttgacacat

SEQ ID NO: 354157 - DNA, 25 bp, Rattus norvegicus
gagtgacctcagtcccttgacacat

SEQ ID NO: 354158 - DNA, 25 bp, Rattus norvegicus
gagtgacctctgacattcttagtgg

SEQ ID NO: 354159 - DNA, 25 bp, Rattus norvegicus
gagtgacctctgtcattcttagtgg

SEQ ID NO: 354160 - DNA, 25 bp, Rattus norvegicus
gagtgaccttggagctttgagataa

SEQ ID NO: 354161 - DNA, 25 bp, Rattus norvegicus
gagtgaccttggtgctttgagataa

SEQ ID NO: 354162 - DNA, 25 bp, Rattus norvegicus
gagtgacctttactacttgcagttt

SEQ ID NO: 354163 - DNA, 25 bp, Rattus norvegicus
gagtgacctttagtacttgcagttt

SEQ ID NO: 354164 - DNA, 25 bp, Rattus norvegicus
gagtgacgaaccctctagaaatcag

SEQ ID NO: 354165 - DNA, 25 bp, Rattus norvegicus
gagtgacgaaccgtctagaaatcag

SEQ ID NO: 354166 - DNA, 25 bp, Rattus norvegicus
gagtgacgcagacaaatactttgaa

SEQ ID NO: 354167 - DNA, 25 bp, Rattus norvegicus
gagtgacgcagagaaatactttgaa

SEQ ID NO: 354168 - DNA, 25 bp, Rattus norvegicus
gagtgactacttaatgccattctca

SEQ ID NO: 354169 - DNA, 25 bp, Rattus norvegicus
gagtgactactttatgccattctca

SEQ ID NO: 354170 - DNA, 25 bp, Rattus norvegicus
gagtgactagacagtccgtgaactc

SEQ ID NO: 354171 - DNA, 25 bp, Rattus norvegicus
gagtgactagactgtccgtgaactc

SEQ ID NO: 354172 - DNA, 25 bp, Rattus norvegicus
gagtgactagatcgctgtctccctg

SEQ ID NO: 354173 - DNA, 25 bp, Rattus norvegicus
gagtgactagatggctgtctccctg

SEQ ID NO: 354174 - DNA, 25 bp, Rattus norvegicus
gagtgactatcccacttgatgtcct

SEQ ID NO: 354175 - DNA, 25 bp, Rattus norvegicus
gagtgactatccgacttgatgtcct

SEQ ID NO: 354176 - DNA, 25 bp, Rattus norvegicus
gagtgactattcattgcctgttata

SEQ ID NO: 354177 - DNA, 25 bp, Rattus norvegicus
gagtgactattctttgcctgttata

SEQ ID NO: 354178 - DNA, 25 bp, Rattus norvegicus
gagtgactcacacacactggaccac

SEQ ID NO: 354179 - DNA, 25 bp, Rattus norvegicus
gagtgactcacagacactggaccac

SEQ ID NO: 354180 - DNA, 25 bp, Rattus norvegicus
gagtgactcccgaacactgaaatgt

SEQ ID NO: 354181 - DNA, 25 bp, Rattus norvegicus
gagtgactcccgtacactgaaatgt

SEQ ID NO: 354182 - DNA, 25 bp, Rattus norvegicus
gagtgactccggaacacaagtataa

SEQ ID NO: 354183 - DNA, 25 bp, Rattus norvegicus
gagtgactccggctggccggctcct

SEQ ID NO: 354184 - DNA, 25 bp, Rattus norvegicus
gagtgactccgggtggccggctcct

SEQ ID NO: 354185 - DNA, 25 bp, Rattus norvegicus
gagtgactccggtacacaagtataa

SEQ ID NO: 354186 - DNA, 25 bp, Rattus norvegicus
gagtgactcgcactttcagatgata

SEQ ID NO: 354187 - DNA, 25 bp, Rattus norvegicus
gagtgactcgcagtttcagatgata

SEQ ID NO: 354188 - DNA, 25 bp, Rattus norvegicus
gagtgactgctgatgctaacccgac

SEQ ID NO: 354189 - DNA, 25 bp, Rattus norvegicus
gagtgactgctgttgctaacccgac

SEQ ID NO: 354190 - DNA, 25 bp, Rattus norvegicus
gagtgactggcaaagccttctttat

SEQ ID NO: 354191 - DNA, 25 bp, Rattus norvegicus
gagtgactggcatagccttctttat

SEQ ID NO: 354192 - DNA, 25 bp, Rattus norvegicus
gagtgactgtagacaccactgttta

SEQ ID NO: 354193 - DNA, 25 bp, Rattus norvegicus
gagtgactgtagtcaccactgttta

SEQ ID NO: 354194 - DNA, 25 bp, Rattus norvegicus
gagtgactgtgtattccatgggtgt

SEQ ID NO: 354195 - DNA, 25 bp, Rattus norvegicus
gagtgactgtgttttccatgggtgt

SEQ ID NO: 354196 - DNA, 25 bp, Rattus norvegicus
gagtgactgtttcggaaaccctcta

SEQ ID NO: 354197 - DNA, 25 bp, Rattus norvegicus
gagtgactgtttgggaaaccctcta

SEQ ID NO: 354198 - DNA, 25 bp, Rattus norvegicus
gagtgacttcataagaccctagtta

SEQ ID NO: 354199 - DNA, 25 bp, Rattus norvegicus
gagtgacttcatcggttttgtcctt

SEQ ID NO: 354200 - DNA, 25 bp, Rattus norvegicus
gagtgacttcatgggttttgtcctt

SEQ ID NO: 354201 - DNA, 25 bp, Rattus norvegicus
gagtgacttcattagaccctagtta

SEQ ID NO: 354202 - DNA, 25 bp, Rattus norvegicus
gagtgacttctgagcctgagatacc

SEQ ID NO: 354203 - DNA, 25 bp, Rattus norvegicus
gagtgacttctgcttaagttcccaa

SEQ ID NO: 354204 - DNA, 25 bp, Rattus norvegicus
gagtgacttctggttaagttcccaa

SEQ ID NO: 354205 - DNA, 25 bp, Rattus norvegicus
gagtgacttctgtgcctgagatacc

SEQ ID NO: 354206 - DNA, 25 bp, Rattus norvegicus
gagtgacttcttatgttggctgtaa

SEQ ID NO: 354207 - DNA, 25 bp, Rattus norvegicus
gagtgacttcttttgttggctgtaa

SEQ ID NO: 354208 - DNA, 25 bp, Rattus norvegicus
gagtgacttgcacggtgacaccgta

SEQ ID NO: 354209 - DNA, 25 bp, Rattus norvegicus
gagtgacttgcagggtgacaccgta

SEQ ID NO: 354210 - DNA, 25 bp, Rattus norvegicus
gagtgacttggccacatttcatgtg

SEQ ID NO: 354211 - DNA, 25 bp, Rattus norvegicus
gagtgacttggcgacatttcatgtg

SEQ ID NO: 354212 - DNA, 25 bp, Rattus norvegicus
gagtgacttgtcatattctgttgaa

SEQ ID NO: 354213 - DNA, 25 bp, Rattus norvegicus
gagtgacttgtcttattctgttgaa

SEQ ID NO: 354214 - DNA, 25 bp, Rattus norvegicus
gagtgactttcaatctgagtgcttt

SEQ ID NO: 354215 - DNA, 25 bp, Rattus norvegicus
gagtgactttcattctgagtgcttt

SEQ ID NO: 354216 - DNA, 25 bp, Rattus norvegicus
gagtgactttgaagcccgtctgggc

SEQ ID NO: 354217 - DNA, 25 bp, Rattus norvegicus
gagtgactttgatgcccgtctgggc

SEQ ID NO: 354218 - DNA, 25 bp, Rattus norvegicus
gagtgagaacgtaatcaccttgtga

SEQ ID NO: 354219 - DNA, 25 bp, Rattus norvegicus
gagtgagaacgttatcaccttgtga

SEQ ID NO: 354220 - DNA, 25 bp, Rattus norvegicus
gagtgagaccaaatttacatacaaa

SEQ ID NO: 354221 - DNA, 25 bp, Rattus norvegicus
gagtgagaccaattttacatacaaa

SEQ ID NO: 354222 - DNA, 25 bp, Rattus norvegicus
gagtgagactcaatgttagccagaa

SEQ ID NO: 354223 - DNA, 25 bp, Rattus norvegicus
gagtgagactcattgttagccagaa

SEQ ID NO: 354224 - DNA, 25 bp, Rattus norvegicus
gagtgagactctctccaaataagaa

SEQ ID NO: 354225 - DNA, 25 bp, Rattus norvegicus
gagtgagactctgtccaaataagaa

SEQ ID NO: 354226 - DNA, 25 bp, Rattus norvegicus
gagtgagagagtccatccctgtgca

SEQ ID NO: 354227 - DNA, 25 bp, Rattus norvegicus
gagtgagagagtgcatccctgtgca

SEQ ID NO: 354228 - DNA, 25 bp, Rattus norvegicus
gagtgagagccgcagccaagaccct

SEQ ID NO: 354229 - DNA, 25 bp, Rattus norvegicus
gagtgagagccggagccaagaccct

SEQ ID NO: 354230 - DNA, 25 bp, Rattus norvegicus
gagtgagagcttcctgaacccagag

SEQ ID NO: 354231 - DNA, 25 bp, Rattus norvegicus
gagtgagagcttgctgaacccagag

SEQ ID NO: 354232 - DNA, 25 bp, Rattus norvegicus
gagtgagagtctattgcttttggca

SEQ ID NO: 354233 - DNA, 25 bp, Rattus norvegicus
gagtgagagtcttttgcttttggca

SEQ ID NO: 354234 - DNA, 25 bp, Rattus norvegicus
gagtgagattgacctcgttcagata

SEQ ID NO: 354235 - DNA, 25 bp, Rattus norvegicus
gagtgagattgagctcgttcagata

SEQ ID NO: 354236 - DNA, 25 bp, Rattus norvegicus
gagtgagcatccattccaaagcttt

SEQ ID NO: 354237 - DNA, 25 bp, Rattus norvegicus
gagtgagcatccctataatcccagc

SEQ ID NO: 354238 - DNA, 25 bp, Rattus norvegicus
gagtgagcatccgtataatcccagc

SEQ ID NO: 354239 - DNA, 25 bp, Rattus norvegicus
gagtgagcatcctttccaaagcttt

SEQ ID NO: 354240 - DNA, 25 bp, Rattus norvegicus
gagtgagcatgacatttccgaaatt

SEQ ID NO: 354241 - DNA, 25 bp, Rattus norvegicus
gagtgagcatgagatttccgaaatt

SEQ ID NO: 354242 - DNA, 25 bp, Rattus norvegicus
gagtgagcatgccttggacctagca

SEQ ID NO: 354243 - DNA, 25 bp, Rattus norvegicus
gagtgagcatgcgttggacctagca

SEQ ID NO: 354244 - DNA, 25 bp, Rattus norvegicus
gagtgagcatgtcttctgttcccgc

SEQ ID NO: 354245 - DNA, 25 bp, Rattus norvegicus
gagtgagcatgtgttctgttcccgc

SEQ ID NO: 354246 - DNA, 25 bp, Rattus norvegicus
gagtgagccaccaggtaccgtgaag

SEQ ID NO: 354247 - DNA, 25 bp, Rattus norvegicus
gagtgagccacctggtaccgtgaag

SEQ ID NO: 354248 - DNA, 25 bp, Rattus norvegicus
gagtgagccactaatcatcgattat

SEQ ID NO: 354249 - DNA, 25 bp, Rattus norvegicus
gagtgagccacttatcatcgattat

SEQ ID NO: 354250 - DNA, 25 bp, Rattus norvegicus
gagtgagccctcaagcttgtgggtc

SEQ ID NO: 354251 - DNA, 25 bp, Rattus norvegicus
gagtgagccctctagcttgtgggtc

SEQ ID NO: 354252 - DNA, 25 bp, Rattus norvegicus
gagtgagccggacccggcggactgc

SEQ ID NO: 354253 - DNA, 25 bp, Rattus norvegicus
gagtgagccggagccggcggactgc

SEQ ID NO: 354254 - DNA, 25 bp, Rattus norvegicus
gagtgagcctcactgcagtgcagac

SEQ ID NO: 354255 - DNA, 25 bp, Rattus norvegicus
gagtgagcctcagtgcagtgcagac

SEQ ID NO: 354256 - DNA, 25 bp, Rattus norvegicus
gagtgagcgcacatctgttagacag

SEQ ID NO: 354257 - DNA, 25 bp, Rattus norvegicus
gagtgagcgcacttctgttagacag

SEQ ID NO: 354258 - DNA, 25 bp, Rattus norvegicus
gagtgagcgcgtaggcctgatctaa

SEQ ID NO: 354259 - DNA, 25 bp, Rattus norvegicus
gagtgagcgcgttggcctgatctaa

SEQ ID NO: 354260 - DNA, 25 bp, Rattus norvegicus
gagtgagcggccatgtcttcctggc

SEQ ID NO: 354261 - DNA, 25 bp, Rattus norvegicus
gagtgagcggccttgtcttcctggc

SEQ ID NO: 354262 - DNA, 25 bp, Rattus norvegicus
gagtgagctaacaaccctattggtt

SEQ ID NO: 354263 - DNA, 25 bp, Rattus norvegicus
gagtgagctaactaccctattggtt

SEQ ID NO: 354264 - DNA, 25 bp, Rattus norvegicus
gagtgagctcaacatttaccccttc

SEQ ID NO: 354265 - DNA, 25 bp, Rattus norvegicus
gagtgagctcaacccaaggcagatt

SEQ ID NO: 354266 - DNA, 25 bp, Rattus norvegicus
gagtgagctcaagatttaccccttc

SEQ ID NO: 354267 - DNA, 25 bp, Rattus norvegicus
gagtgagctcaagccaaggcagatt

SEQ ID NO: 354268 - DNA, 25 bp, Rattus norvegicus
gagtgagctctaccgaattggccag

SEQ ID NO: 354269 - DNA, 25 bp, Rattus norvegicus
gagtgagctctacctacaaacgccc

SEQ ID NO: 354270 - DNA, 25 bp, Rattus norvegicus
gagtgagctctagcgaattggccag

SEQ ID NO: 354271 - DNA, 25 bp, Rattus norvegicus
gagtgagctctagctacaaacgccc

SEQ ID NO: 354272 - DNA, 25 bp, Rattus norvegicus
gagtgagctgctccttctcaaaaaa

SEQ ID NO: 354273 - DNA, 25 bp, Rattus norvegicus
gagtgagctgctgcttctcaaaaaa

SEQ ID NO: 354274 - DNA, 25 bp, Rattus norvegicus
gagtgagctgggactctaaacacaa

SEQ ID NO: 354275 - DNA, 25 bp, Rattus norvegicus
gagtgagctgggtctctaaacacaa

SEQ ID NO: 354276 - DNA, 25 bp, Rattus norvegicus
gagtgagctgtcctttgcagaatcc

SEQ ID NO: 354277 - DNA, 25 bp, Rattus norvegicus
gagtgagctgtcgtttgcagaatcc

SEQ ID NO: 354278 - DNA, 25 bp, Rattus norvegicus
gagtgagcttccagaggctgactta

SEQ ID NO: 354279 - DNA, 25 bp, Rattus norvegicus
gagtgagcttcctgaggctgactta

SEQ ID NO: 354280 - DNA, 25 bp, Rattus norvegicus
gagtgagcttgcatgtaagccacat

SEQ ID NO: 354281 - DNA, 25 bp, Rattus norvegicus
gagtgagcttgcttgtaagccacat

SEQ ID NO: 354282 - DNA, 25 bp, Rattus norvegicus
gagtgaggactgattcttgcattaa

SEQ ID NO: 354283 - DNA, 25 bp, Rattus norvegicus
gagtgaggactgtttcttgcattaa

SEQ ID NO: 354284 - DNA, 25 bp, Rattus norvegicus
gagtgaggagtaacaccatcaccac

SEQ ID NO: 354285 - DNA, 25 bp, Rattus norvegicus
gagtgaggagtatcaccatcaccac

SEQ ID NO: 354286 - DNA, 25 bp, Rattus norvegicus
gagtgaggatgtccctcttctgcag

SEQ ID NO: 354287 - DNA, 25 bp, Rattus norvegicus
gagtgaggatgtctccatttggacc

SEQ ID NO: 354288 - DNA, 25 bp, Rattus norvegicus
gagtgaggatgtgcctcttctgcag

SEQ ID NO: 354289 - DNA, 25 bp, Rattus norvegicus
gagtgaggatgtgtccatttggacc

SEQ ID NO: 354290 - DNA, 25 bp, Rattus norvegicus
gagtgaggcacgcacagcactatac

SEQ ID NO: 354291 - DNA, 25 bp, Rattus norvegicus
gagtgaggcacggacagcactatac

SEQ ID NO: 354292 - DNA, 25 bp, Rattus norvegicus
gagtgaggcccacttggatctccta

SEQ ID NO: 354293 - DNA, 25 bp, Rattus norvegicus
gagtgaggcccagttggatctccta

SEQ ID NO: 354294 - DNA, 25 bp, Rattus norvegicus
gagtgaggctctcattctttttggt

SEQ ID NO: 354295 - DNA, 25 bp, Rattus norvegicus
gagtgaggctctgattctttttggt

SEQ ID NO: 354296 - DNA, 25 bp, Rattus norvegicus
gagtgaggcttcacacttccgttga

SEQ ID NO: 354297 - DNA, 25 bp, Rattus norvegicus
gagtgaggcttctcacttccgttga

SEQ ID NO: 354298 - DNA, 25 bp, Rattus norvegicus
gagtgagggctgagtccaatgtaaa

SEQ ID NO: 354299 - DNA, 25 bp, Rattus norvegicus
gagtgagggctgtgtccaatgtaaa

SEQ ID NO: 354300 - DNA, 25 bp, Rattus norvegicus
gagtgagggtatcacttcgtgtccc

SEQ ID NO: 354301 - DNA, 25 bp, Rattus norvegicus
gagtgagggtatgacttcgtgtccc

SEQ ID NO: 354302 - DNA, 25 bp, Rattus norvegicus
gagtgagggtctcccaaaacaaaca

SEQ ID NO: 354303 - DNA, 25 bp, Rattus norvegicus
gagtgagggtctgccaaaacaaaca

SEQ ID NO: 354304 - DNA, 25 bp, Rattus norvegicus
gagtgagggtttccaggccctttct

SEQ ID NO: 354305 - DNA, 25 bp, Rattus norvegicus
gagtgagggtttgcaggccctttct

SEQ ID NO: 354306 - DNA, 25 bp, Rattus norvegicus
gagtgaggtctacagccgcatctaa

SEQ ID NO: 354307 - DNA, 25 bp, Rattus norvegicus
gagtgaggtctagagccgcatctaa

SEQ ID NO: 354308 - DNA, 25 bp, Rattus norvegicus
gagtgaggtgctatcacatacacat

SEQ ID NO: 354309 - DNA, 25 bp, Rattus norvegicus
gagtgaggtgctttcacatacacat

SEQ ID NO: 354310 - DNA, 25 bp, Rattus norvegicus
gagtgagtctccctttactcacaaa

SEQ ID NO: 354311 - DNA, 25 bp, Rattus norvegicus
gagtgagtctccgtttactcacaaa

SEQ ID NO: 354312 - DNA, 25 bp, Rattus norvegicus
gagtgagtcttccttcagtgactaa

SEQ ID NO: 354313 - DNA, 25 bp, Rattus norvegicus
gagtgagtcttcgttcagtgactaa

SEQ ID NO: 354314 - DNA, 25 bp, Rattus norvegicus
gagtgagtgcttacctactatgact

SEQ ID NO: 354315 - DNA, 25 bp, Rattus norvegicus
gagtgagtgctttcctactatgact

SEQ ID NO: 354316 - DNA, 25 bp, Rattus norvegicus
gagtgagtggccagtcctcaatcaa

SEQ ID NO: 354317 - DNA, 25 bp, Rattus norvegicus
gagtgagtggcctgtcctcaatcaa

SEQ ID NO: 354318 - DNA, 25 bp, Rattus norvegicus
gagtgagtggctaatattctaccaa

SEQ ID NO: 354319 - DNA, 25 bp, Rattus norvegicus
gagtgagtggcttatattctaccaa

SEQ ID NO: 354320 - DNA, 25 bp, Rattus norvegicus
gagtgagttcatcccaggtacatat

SEQ ID NO: 354321 - DNA, 25 bp, Rattus norvegicus
gagtgagttcatgccaggtacatat

SEQ ID NO: 354322 - DNA, 25 bp, Rattus norvegicus
gagtgagttcgtactccatgattgt

SEQ ID NO: 354323 - DNA, 25 bp, Rattus norvegicus
gagtgagttcgttctccatgattgt

SEQ ID NO: 354324 - DNA, 25 bp, Rattus norvegicus
gagtgagtttagacttctcctcctc

SEQ ID NO: 354325 - DNA, 25 bp, Rattus norvegicus
gagtgagtttagtcttctcctcctc

SEQ ID NO: 354326 - DNA, 25 bp, Rattus norvegicus
gagtgataacctcatgactttggaa

SEQ ID NO: 354327 - DNA, 25 bp, Rattus norvegicus
gagtgataacctgatgactttggaa

SEQ ID NO: 354328 - DNA, 25 bp, Rattus norvegicus
gagtgatacccaacaatctttagga

SEQ ID NO: 354329 - DNA, 25 bp, Rattus norvegicus
gagtgatacccaatctctacaagaa

SEQ ID NO: 354330 - DNA, 25 bp, Rattus norvegicus
gagtgatacccatcaatctttagga

SEQ ID NO: 354331 - DNA, 25 bp, Rattus norvegicus
gagtgatacccattctctacaagaa

SEQ ID NO: 354332 - DNA, 25 bp, Rattus norvegicus
gagtgatagcaaagacatccaacat

SEQ ID NO: 354333 - DNA, 25 bp, Rattus norvegicus
gagtgatagcaatgacatccaacat

SEQ ID NO: 354334 - DNA, 25 bp, Rattus norvegicus
gagtgataggttcttgcatctgtaa

SEQ ID NO: 354335 - DNA, 25 bp, Rattus norvegicus
gagtgataggttgttgcatctgtaa

SEQ ID NO: 354336 - DNA, 25 bp, Rattus norvegicus
gagtgatagtaaatccagttccggg

SEQ ID NO: 354337 - DNA, 25 bp, Rattus norvegicus
gagtgatagtaattccagttccggg

SEQ ID NO: 354338 - DNA, 25 bp, Rattus norvegicus
gagtgatagttgactttcccaggaa

SEQ ID NO: 354339 - DNA, 25 bp, Rattus norvegicus
gagtgatagttgtctttcccaggaa

SEQ ID NO: 354340 - DNA, 25 bp, Rattus norvegicus
gagtgatcaccgagaagctccccat

SEQ ID NO: 354341 - DNA, 25 bp, Rattus norvegicus
gagtgatcaccgtgaagctccccat

SEQ ID NO: 354342 - DNA, 25 bp, Rattus norvegicus
gagtgatcacctaccgcagagataa

SEQ ID NO: 354343 - DNA, 25 bp, Rattus norvegicus
gagtgatcaccttccgcagagataa

SEQ ID NO: 354344 - DNA, 25 bp, Rattus norvegicus
gagtgatcatgccttctgtaaagcc

SEQ ID NO: 354345 - DNA, 25 bp, Rattus norvegicus
gagtgatcatgcgttctgtaaagcc

SEQ ID NO: 354346 - DNA, 25 bp, Rattus norvegicus
gagtgatccacgactgaactgttcc

SEQ ID NO: 354347 - DNA, 25 bp, Rattus norvegicus
gagtgatccacgtctgaactgttcc

SEQ ID NO: 354348 - DNA, 25 bp, Rattus norvegicus
gagtgatcccatcgatcctgtacac

SEQ ID NO: 354349 - DNA, 25 bp, Rattus norvegicus
gagtgatcccatggatcctgtacac

SEQ ID NO: 354350 - DNA, 25 bp, Rattus norvegicus
gagtgatcctaaacattggactttt

SEQ ID NO: 354351 - DNA, 25 bp, Rattus norvegicus
gagtgatcctaatcattggactttt

SEQ ID NO: 354352 - DNA, 25 bp, Rattus norvegicus
gagtgatcggcacgttttaccttta

SEQ ID NO: 354353 - DNA, 25 bp, Rattus norvegicus
gagtgatcggcaggttttaccttta

SEQ ID NO: 354354 - DNA, 25 bp, Rattus norvegicus
gagtgatctcaccttttggtgtatt

SEQ ID NO: 354355 - DNA, 25 bp, Rattus norvegicus
gagtgatctcacgttttggtgtatt

SEQ ID NO: 354356 - DNA, 25 bp, Rattus norvegicus
gagtgatctgctagcgaaaccttca

SEQ ID NO: 354357 - DNA, 25 bp, Rattus norvegicus
gagtgatctgcttgcgaaaccttca

SEQ ID NO: 354358 - DNA, 25 bp, Rattus norvegicus
gagtgatctgtcatgcagttttgca

SEQ ID NO: 354359 - DNA, 25 bp, Rattus norvegicus
gagtgatctgtcttgcagttttgca

SEQ ID NO: 354360 - DNA, 25 bp, Rattus norvegicus
gagtgatgaaaaccacccgcctgaa

SEQ ID NO: 354361 - DNA, 25 bp, Rattus norvegicus
gagtgatgaaaagcacccgcctgaa

SEQ ID NO: 354362 - DNA, 25 bp, Rattus norvegicus
gagtgatgaggtacgcaagaacctg

SEQ ID NO: 354363 - DNA, 25 bp, Rattus norvegicus
gagtgatgaggttcgcaagaacctg

SEQ ID NO: 354364 - DNA, 25 bp, Rattus norvegicus
gagtgatgataccttcgttcttacc

SEQ ID NO: 354365 - DNA, 25 bp, Rattus norvegicus
gagtgatgatacgttcgttcttacc

SEQ ID NO: 354366 - DNA, 25 bp, Rattus norvegicus
gagtgatgcctacctcagtggcatg

SEQ ID NO: 354367 - DNA, 25 bp, Rattus norvegicus
gagtgatgcctagctcagtggcatg

SEQ ID NO: 354368 - DNA, 25 bp, Rattus norvegicus
gagtgatgggacctatgccccagac

SEQ ID NO: 354369 - DNA, 25 bp, Rattus norvegicus
gagtgatgggacgtatgccccagac

SEQ ID NO: 354370 - DNA, 25 bp, Rattus norvegicus
gagtgatggtatactttttcattaa

SEQ ID NO: 354371 - DNA, 25 bp, Rattus norvegicus
gagtgatggtattctttttcattaa

SEQ ID NO: 354372 - DNA, 25 bp, Rattus norvegicus
gagtgatggtttccaaatgttgtga

SEQ ID NO: 354373 - DNA, 25 bp, Rattus norvegicus
gagtgatggtttgcaaatgttgtga

SEQ ID NO: 354374 - DNA, 25 bp, Rattus norvegicus
gagtgattatctatcaactccagct

SEQ ID NO: 354375 - DNA, 25 bp, Rattus norvegicus
gagtgattatctttcaactccagct

SEQ ID NO: 354376 - DNA, 25 bp, Rattus norvegicus
gagtgattcatcacctgcttggcaa

SEQ ID NO: 354377 - DNA, 25 bp, Rattus norvegicus
gagtgattcatctcctgcttggcaa

SEQ ID NO: 354378 - DNA, 25 bp, Rattus norvegicus
gagtgattgctgagtctcaccatgc

SEQ ID NO: 354379 - DNA, 25 bp, Rattus norvegicus
gagtgattgctgtgtctcaccatgc

SEQ ID NO: 354380 - DNA, 25 bp, Rattus norvegicus
gagtgattggccacatttttgccta

SEQ ID NO: 354381 - DNA, 25 bp, Rattus norvegicus
gagtgattggcctcatttttgccta

SEQ ID NO: 354382 - DNA, 25 bp, Rattus norvegicus
gagtgattgtctcatgacacatcct

SEQ ID NO: 354383 - DNA, 25 bp, Rattus norvegicus
gagtgattgtctgatgacacatcct

SEQ ID NO: 354384 - DNA, 25 bp, Rattus norvegicus
gagtgatttatcctctcctcgaagg

SEQ ID NO: 354385 - DNA, 25 bp, Rattus norvegicus
gagtgatttatcgtctcctcgaagg

SEQ ID NO: 354386 - DNA, 25 bp, Rattus norvegicus
gagtgattttctacatcaacccaca

SEQ ID NO: 354387 - DNA, 25 bp, Rattus norvegicus
gagtgattttcttcatcaacccaca

SEQ ID NO: 354388 - DNA, 25 bp, Rattus norvegicus
gagtgcaaccccaaatattctttcc

SEQ ID NO: 354389 - DNA, 25 bp, Rattus norvegicus
gagtgcaacccctaatattctttcc

SEQ ID NO: 354390 - DNA, 25 bp, Rattus norvegicus
gagtgcaactcaataggccttctaa

SEQ ID NO: 354391 - DNA, 25 bp, Rattus norvegicus
gagtgcaactcattaggccttctaa

SEQ ID NO: 354392 - DNA, 25 bp, Rattus norvegicus
gagtgcaagatcctaggccattctg

SEQ ID NO: 354393 - DNA, 25 bp, Rattus norvegicus
gagtgcaagatcgtaggccattctg

SEQ ID NO: 354394 - DNA, 25 bp, Rattus norvegicus
gagtgcaaggctcccaacgaggtct

SEQ ID NO: 354395 - DNA, 25 bp, Rattus norvegicus
gagtgcaaggctgccaacgaggtct

SEQ ID NO: 354396 - DNA, 25 bp, Rattus norvegicus
gagtgcaagtgaattgtccttccca

SEQ ID NO: 354397 - DNA, 25 bp, Rattus norvegicus
gagtgcaagtgatttgtccttccca

SEQ ID NO: 354398 - DNA, 25 bp, Rattus norvegicus
gagtgcaagtgcagcaacctctgcg

SEQ ID NO: 354399 - DNA, 25 bp, Rattus norvegicus
gagtgcaagtgctgcaacctctgcg

SEQ ID NO: 354400 - DNA, 25 bp, Rattus norvegicus
gagtgcaatggcagacagggaacca

SEQ ID NO: 354401 - DNA, 25 bp, Rattus norvegicus
gagtgcaatggctgacagggaacca

SEQ ID NO: 354402 - DNA, 25 bp, Rattus norvegicus
gagtgcaatgtgactgattcaccaa

SEQ ID NO: 354403 - DNA, 25 bp, Rattus norvegicus
gagtgcaatgtgtctgattcaccaa

SEQ ID NO: 354404 - DNA, 25 bp, Rattus norvegicus
gagtgcaatttcctatgcgctacta

SEQ ID NO: 354405 - DNA, 25 bp, Rattus norvegicus
gagtgcaatttcgtatgcgctacta

SEQ ID NO: 354406 - DNA, 25 bp, Rattus norvegicus
gagtgcacacacaaggaaaccaacc

SEQ ID NO: 354407 - DNA, 25 bp, Rattus norvegicus
gagtgcacacacctagatatttctg

SEQ ID NO: 354408 - DNA, 25 bp, Rattus norvegicus
gagtgcacacacgtagatatttctg

SEQ ID NO: 354409 - DNA, 25 bp, Rattus norvegicus
gagtgcacacactaggaaaccaacc

SEQ ID NO: 354410 - DNA, 25 bp, Rattus norvegicus
gagtgcacacttcctttgagatctg

SEQ ID NO: 354411 - DNA, 25 bp, Rattus norvegicus
gagtgcacacttgctttgagatctg

SEQ ID NO: 354412 - DNA, 25 bp, Rattus norvegicus
gagtgcacaggcaaagaggccaaga

SEQ ID NO: 354413 - DNA, 25 bp, Rattus norvegicus
gagtgcacaggctaagaggccaaga

SEQ ID NO: 354414 - DNA, 25 bp, Rattus norvegicus
gagtgcacagggagttctgcctaca

SEQ ID NO: 354415 - DNA, 25 bp, Rattus norvegicus
gagtgcacagggtgttctgcctaca

SEQ ID NO: 354416 - DNA, 25 bp, Rattus norvegicus
gagtgcacagtgctccagggatata

SEQ ID NO: 354417 - DNA, 25 bp, Rattus norvegicus
gagtgcacagtggtccagggatata

SEQ ID NO: 354418 - DNA, 25 bp, Rattus norvegicus
gagtgcaccaggatgtacccattag

SEQ ID NO: 354419 - DNA, 25 bp, Rattus norvegicus
gagtgcaccaggttgtacccattag

SEQ ID NO: 354420 - DNA, 25 bp, Rattus norvegicus
gagtgcaccatgaacaatgttgtca

SEQ ID NO: 354421 - DNA, 25 bp, Rattus norvegicus
gagtgcaccatgtacaatgttgtca

SEQ ID NO: 354422 - DNA, 25 bp, Rattus norvegicus
gagtgcacccagaatgtgactctga

SEQ ID NO: 354423 - DNA, 25 bp, Rattus norvegicus
gagtgcacccagtatgtgactctga

SEQ ID NO: 354424 - DNA, 25 bp, Rattus norvegicus
gagtgcaccctaccatacagtttga

SEQ ID NO: 354425 - DNA, 25 bp, Rattus norvegicus
gagtgcaccctagcatacagtttga

SEQ ID NO: 354426 - DNA, 25 bp, Rattus norvegicus
gagtgcacctttacatcataccatt

SEQ ID NO: 354427 - DNA, 25 bp, Rattus norvegicus
gagtgcaccttttcatcataccatt

SEQ ID NO: 354428 - DNA, 25 bp, Rattus norvegicus
gagtgcacgcttattggtttcgaat

SEQ ID NO: 354429 - DNA, 25 bp, Rattus norvegicus
gagtgcacgctttttggtttcgaat

SEQ ID NO: 354430 - DNA, 25 bp, Rattus norvegicus
gagtgcacggtgaccagagaccata

SEQ ID NO: 354431 - DNA, 25 bp, Rattus norvegicus
gagtgcacggtgtccagagaccata

SEQ ID NO: 354432 - DNA, 25 bp, Rattus norvegicus
gagtgcactataacctggttccttc

SEQ ID NO: 354433 - DNA, 25 bp, Rattus norvegicus
gagtgcactatatcctggttccttc

SEQ ID NO: 354434 - DNA, 25 bp, Rattus norvegicus
gagtgcactctgcactactttgaca

SEQ ID NO: 354435 - DNA, 25 bp, Rattus norvegicus
gagtgcactctggactactttgaca

SEQ ID NO: 354436 - DNA, 25 bp, Rattus norvegicus
gagtgcagaagccaccttcaatcac

SEQ ID NO: 354437 - DNA, 25 bp, Rattus norvegicus
gagtgcagaagcgaccttcaatcac

SEQ ID NO: 354438 - DNA, 25 bp, Rattus norvegicus
gagtgcagacatatctccacgagtt

SEQ ID NO: 354439 - DNA, 25 bp, Rattus norvegicus
gagtgcagacatccctgaagccaca

SEQ ID NO: 354440 - DNA, 25 bp, Rattus norvegicus
gagtgcagacatgcctgaagccaca

SEQ ID NO: 354441 - DNA, 25 bp, Rattus norvegicus
gagtgcagacatttctccacgagtt

SEQ ID NO: 354442 - DNA, 25 bp, Rattus norvegicus
gagtgcagcaagaggcgcccgccat

SEQ ID NO: 354443 - DNA, 25 bp, Rattus norvegicus
gagtgcagcaagtggcgcccgccat

SEQ ID NO: 354444 - DNA, 25 bp, Rattus norvegicus
gagtgcagcactaacatccaaataa

SEQ ID NO: 354445 - DNA, 25 bp, Rattus norvegicus
gagtgcagcacttacatccaaataa

SEQ ID NO: 354446 - DNA, 25 bp, Rattus norvegicus
gagtgcagcagtctggcataaacta

SEQ ID NO: 354447 - DNA, 25 bp, Rattus norvegicus
gagtgcagcagtgtggcataaacta

SEQ ID NO: 354448 - DNA, 25 bp, Rattus norvegicus
gagtgcagcatactgtggattgtct

SEQ ID NO: 354449 - DNA, 25 bp, Rattus norvegicus
gagtgcagcatagtgtggattgtct

SEQ ID NO: 354450 - DNA, 25 bp, Rattus norvegicus
gagtgcagcatgagcccatcaacta

SEQ ID NO: 354451 - DNA, 25 bp, Rattus norvegicus
gagtgcagcatgtgcccatcaacta

SEQ ID NO: 354452 - DNA, 25 bp, Rattus norvegicus
gagtgcagccagctaaagcctcttc

SEQ ID NO: 354453 - DNA, 25 bp, Rattus norvegicus
gagtgcagccaggtaaagcctcttc

SEQ ID NO: 354454 - DNA, 25 bp, Rattus norvegicus
gagtgcagccatcaaccgagagtac

SEQ ID NO: 354455 - DNA, 25 bp, Rattus norvegicus
gagtgcagccatgaaccgagagtac

SEQ ID NO: 354456 - DNA, 25 bp, Rattus norvegicus
gagtgcagcctccatgttcactgtg

SEQ ID NO: 354457 - DNA, 25 bp, Rattus norvegicus
gagtgcagcctcgatgttcactgtg

SEQ ID NO: 354458 - DNA, 25 bp, Rattus norvegicus
gagtgcagcggcatccagaagcaaa

SEQ ID NO: 354459 - DNA, 25 bp, Rattus norvegicus
gagtgcagcggcttccagaagcaaa

SEQ ID NO: 354460 - DNA, 25 bp, Rattus norvegicus
gagtgcagctctagtgtatgatccc

SEQ ID NO: 354461 - DNA, 25 bp, Rattus norvegicus
gagtgcagctcttgtgtatgatccc

SEQ ID NO: 354462 - DNA, 25 bp, Rattus norvegicus
gagtgcaggtgcatctttctgttcc

SEQ ID NO: 354463 - DNA, 25 bp, Rattus norvegicus
gagtgcaggtgcttctttctgttcc

SEQ ID NO: 354464 - DNA, 25 bp, Rattus norvegicus
gagtgcaggtgtataggctcacgcc

SEQ ID NO: 354465 - DNA, 25 bp, Rattus norvegicus
gagtgcaggtgtttaggctcacgcc

SEQ ID NO: 354466 - DNA, 25 bp, Rattus norvegicus
gagtgcagtaataatgtggcccata

SEQ ID NO: 354467 - DNA, 25 bp, Rattus norvegicus
gagtgcagtaattatgtggcccata

SEQ ID NO: 354468 - DNA, 25 bp, Rattus norvegicus
gagtgcagtcaacaccagctatgag

SEQ ID NO: 354469 - DNA, 25 bp, Rattus norvegicus
gagtgcagtcaagaccagctatgag

SEQ ID NO: 354470 - DNA, 25 bp, Rattus norvegicus
gagtgcagtcagagccctgtacctg

SEQ ID NO: 354471 - DNA, 25 bp, Rattus norvegicus
gagtgcagtcagtgccctgtacctg

SEQ ID NO: 354472 - DNA, 25 bp, Rattus norvegicus
gagtgcagtgttagcctacgagtcc

SEQ ID NO: 354473 - DNA, 25 bp, Rattus norvegicus
gagtgcagtgtttgcctacgagtcc

SEQ ID NO: 354474 - DNA, 25 bp, Rattus norvegicus
gagtgcatcacgatcctgaaggact

SEQ ID NO: 354475 - DNA, 25 bp, Rattus norvegicus
gagtgcatcacgttcctgaaggact

SEQ ID NO: 354476 - DNA, 25 bp, Rattus norvegicus
gagtgcatcactacttcaagttgtg

SEQ ID NO: 354477 - DNA, 25 bp, Rattus norvegicus
gagtgcatcacttcttcaagttgtg

SEQ ID NO: 354478 - DNA, 25 bp, Rattus norvegicus
gagtgcatgcatatgaatcgtgtga

SEQ ID NO: 354479 - DNA, 25 bp, Rattus norvegicus
gagtgcatgcatttgaatcgtgtga

SEQ ID NO: 354480 - DNA, 25 bp, Rattus norvegicus
gagtgcattcataccacggtggcaa

SEQ ID NO: 354481 - DNA, 25 bp, Rattus norvegicus
gagtgcattcatatcccagggaaga

SEQ ID NO: 354482 - DNA, 25 bp, Rattus norvegicus
gagtgcattcattccacggtggcaa

SEQ ID NO: 354483 - DNA, 25 bp, Rattus norvegicus
gagtgcattcatttcccagggaaga

SEQ ID NO: 354484 - DNA, 25 bp, Rattus norvegicus
gagtgcattctgcagctcagcatgg

SEQ ID NO: 354485 - DNA, 25 bp, Rattus norvegicus
gagtgcattctggagctcagcatgg

SEQ ID NO: 354486 - DNA, 25 bp, Rattus norvegicus
gagtgcattgtaaggtttgaaacca

SEQ ID NO: 354487 - DNA, 25 bp, Rattus norvegicus
gagtgcattgtatggtttgaaacca

SEQ ID NO: 354488 - DNA, 25 bp, Rattus norvegicus
gagtgcattgtgaggctgctactga

SEQ ID NO: 354489 - DNA, 25 bp, Rattus norvegicus
gagtgcattgtgtggctgctactga

SEQ ID NO: 354490 - DNA, 25 bp, Rattus norvegicus
gagtgcattgttcgcctctatgaca

SEQ ID NO: 354491 - DNA, 25 bp, Rattus norvegicus
gagtgcattgttggcctctatgaca

SEQ ID NO: 354492 - DNA, 25 bp, Rattus norvegicus
gagtgcatttatccagcctctgcga

SEQ ID NO: 354493 - DNA, 25 bp, Rattus norvegicus
gagtgcatttatgcagcctctgcga

SEQ ID NO: 354494 - DNA, 25 bp, Rattus norvegicus
gagtgcatttcactgctgactgcaa

SEQ ID NO: 354495 - DNA, 25 bp, Rattus norvegicus
gagtgcatttcagtgctgactgcaa

SEQ ID NO: 354496 - DNA, 25 bp, Rattus norvegicus
gagtgccaaacccagcagatagaaa

SEQ ID NO: 354497 - DNA, 25 bp, Rattus norvegicus
gagtgccaaaccgagcagatagaaa

SEQ ID NO: 354498 - DNA, 25 bp, Rattus norvegicus
gagtgccaaacgagacgggaccttc

SEQ ID NO: 354499 - DNA, 25 bp, Rattus norvegicus
gagtgccaaacgtgacgggaccttc

SEQ ID NO: 354500 - DNA, 25 bp, Rattus norvegicus
gagtgccaaataacttgaaacgcca

SEQ ID NO: 354501 - DNA, 25 bp, Rattus norvegicus
gagtgccaaatatcttgaaacgcca

SEQ ID NO: 354502 - DNA, 25 bp, Rattus norvegicus
gagtgccaattccatgatgagccag

SEQ ID NO: 354503 - DNA, 25 bp, Rattus norvegicus
gagtgccaattcgatgatgagccag

SEQ ID NO: 354504 - DNA, 25 bp, Rattus norvegicus
gagtgccaatttcttactagtgcta

SEQ ID NO: 354505 - DNA, 25 bp, Rattus norvegicus
gagtgccaatttgttactagtgcta

SEQ ID NO: 354506 - DNA, 25 bp, Rattus norvegicus
gagtgccactatcatgtgtattcct

SEQ ID NO: 354507 - DNA, 25 bp, Rattus norvegicus
gagtgccactatcccttttattatt

SEQ ID NO: 354508 - DNA, 25 bp, Rattus norvegicus
gagtgccactatgatgtgtattcct

SEQ ID NO: 354509 - DNA, 25 bp, Rattus norvegicus
gagtgccactatgccttttattatt

SEQ ID NO: 354510 - DNA, 25 bp, Rattus norvegicus
gagtgccagaatacaaaccaatcat

SEQ ID NO: 354511 - DNA, 25 bp, Rattus norvegicus
gagtgccagaattcaaaccaatcat

SEQ ID NO: 354512 - DNA, 25 bp, Rattus norvegicus
gagtgccagcagcacagaccaaact

SEQ ID NO: 354513 - DNA, 25 bp, Rattus norvegicus
gagtgccagcaggacagaccaaact

SEQ ID NO: 354514 - DNA, 25 bp, Rattus norvegicus
gagtgccagcatattcacaaggacg

SEQ ID NO: 354515 - DNA, 25 bp, Rattus norvegicus
gagtgccagcattttcacaaggacg

SEQ ID NO: 354516 - DNA, 25 bp, Rattus norvegicus
gagtgccagcttcggaggaatccat

SEQ ID NO: 354517 - DNA, 25 bp, Rattus norvegicus
gagtgccagcttgggaggaatccat

SEQ ID NO: 354518 - DNA, 25 bp, Rattus norvegicus
gagtgccatctcctgaatgtcacat

SEQ ID NO: 354519 - DNA, 25 bp, Rattus norvegicus
gagtgccatctcgtgaatgtcacat

SEQ ID NO: 354520 - DNA, 25 bp, Rattus norvegicus
gagtgccatggtctcatctatgtca

SEQ ID NO: 354521 - DNA, 25 bp, Rattus norvegicus
gagtgccatggtgtcatctatgtca

SEQ ID NO: 354522 - DNA, 25 bp, Rattus norvegicus
gagtgccatttcaagttctcttcct

SEQ ID NO: 354523 - DNA, 25 bp, Rattus norvegicus
gagtgccatttctagttctcttcct

SEQ ID NO: 354524 - DNA, 25 bp, Rattus norvegicus
gagtgcccacacaaactagaggtac

SEQ ID NO: 354525 - DNA, 25 bp, Rattus norvegicus
gagtgcccacactaactagaggtac

SEQ ID NO: 354526 - DNA, 25 bp, Rattus norvegicus
gagtgcccactaatgagtctgaaca

SEQ ID NO: 354527 - DNA, 25 bp, Rattus norvegicus
gagtgcccactattgagtctgaaca

SEQ ID NO: 354528 - DNA, 25 bp, Rattus norvegicus
gagtgcccactgcacaggattctac

SEQ ID NO: 354529 - DNA, 25 bp, Rattus norvegicus
gagtgcccactggacaggattctac

SEQ ID NO: 354530 - DNA, 25 bp, Rattus norvegicus
gagtgcccagacagtaactgtgtaa

SEQ ID NO: 354531 - DNA, 25 bp, Rattus norvegicus
gagtgcccagactgtaactgtgtaa

SEQ ID NO: 354532 - DNA, 25 bp, Rattus norvegicus
gagtgcccagcactggctattagat

SEQ ID NO: 354533 - DNA, 25 bp, Rattus norvegicus
gagtgcccagcagtggctattagat

SEQ ID NO: 354534 - DNA, 25 bp, Rattus norvegicus
gagtgcccagggagtctacatcaag

SEQ ID NO: 354535 - DNA, 25 bp, Rattus norvegicus
gagtgcccagggtgtctacatcaag

SEQ ID NO: 354536 - DNA, 25 bp, Rattus norvegicus
gagtgcccagtgctttgtcgcatag

SEQ ID NO: 354537 - DNA, 25 bp, Rattus norvegicus
gagtgcccagtggtttgtcgcatag

SEQ ID NO: 354538 - DNA, 25 bp, Rattus norvegicus
gagtgccccacaataaagatccttt

SEQ ID NO: 354539 - DNA, 25 bp, Rattus norvegicus
gagtgccccacattaaagatccttt

SEQ ID NO: 354540 - DNA, 25 bp, Rattus norvegicus
gagtgccccatgacttgtgtcagga

SEQ ID NO: 354541 - DNA, 25 bp, Rattus norvegicus
gagtgccccatgtcttgtgtcagga

SEQ ID NO: 354542 - DNA, 25 bp, Rattus norvegicus
gagtgccccgctaatagaacaggct

SEQ ID NO: 354543 - DNA, 25 bp, Rattus norvegicus
gagtgccccgcttatagaacaggct

SEQ ID NO: 354544 - DNA, 25 bp, Rattus norvegicus
gagtgccccgtgactggtgatttaa

SEQ ID NO: 354545 - DNA, 25 bp, Rattus norvegicus
gagtgccccgtgtctggtgatttaa

SEQ ID NO: 354546 - DNA, 25 bp, Rattus norvegicus
gagtgcccctgaatggaatggagta

SEQ ID NO: 354547 - DNA, 25 bp, Rattus norvegicus
gagtgcccctgattggaatggagta

SEQ ID NO: 354548 - DNA, 25 bp, Rattus norvegicus
gagtgcccgcgcaataaaggctgtg

SEQ ID NO: 354549 - DNA, 25 bp, Rattus norvegicus
gagtgcccgcgctataaaggctgtg

SEQ ID NO: 354550 - DNA, 25 bp, Rattus norvegicus
gagtgccctcaaaaatgtgtagaat

SEQ ID NO: 354551 - DNA, 25 bp, Rattus norvegicus
gagtgccctcaataatgtgtagaat

SEQ ID NO: 354552 - DNA, 25 bp, Rattus norvegicus
gagtgccctcagattgtgcagaata

SEQ ID NO: 354553 - DNA, 25 bp, Rattus norvegicus
gagtgccctcagtttgtgcagaata

SEQ ID NO: 354554 - DNA, 25 bp, Rattus norvegicus
gagtgccctgtgatcaagagctttt

SEQ ID NO: 354555 - DNA, 25 bp, Rattus norvegicus
gagtgccctgtgttcaagagctttt

SEQ ID NO: 354556 - DNA, 25 bp, Rattus norvegicus
gagtgccgaggtataagctcacaca

SEQ ID NO: 354557 - DNA, 25 bp, Rattus norvegicus
gagtgccgaggtctgcaagcttcac

SEQ ID NO: 354558 - DNA, 25 bp, Rattus norvegicus
gagtgccgaggtgtgcaagcttcac

SEQ ID NO: 354559 - DNA, 25 bp, Rattus norvegicus
gagtgccgaggtttaagctcacaca

SEQ ID NO: 354560 - DNA, 25 bp, Rattus norvegicus
gagtgccgcaggatacgtgcagaat

SEQ ID NO: 354561 - DNA, 25 bp, Rattus norvegicus
gagtgccgcaggttacgtgcagaat

SEQ ID NO: 354562 - DNA, 25 bp, Rattus norvegicus
gagtgccgcccaatgacattaggag

SEQ ID NO: 354563 - DNA, 25 bp, Rattus norvegicus
gagtgccgcccattgacattaggag

SEQ ID NO: 354564 - DNA, 25 bp, Rattus norvegicus
gagtgccggcttagcggaaacatca

SEQ ID NO: 354565 - DNA, 25 bp, Rattus norvegicus
gagtgccggctttgcggaaacatca

SEQ ID NO: 354566 - DNA, 25 bp, Rattus norvegicus
gagtgcctacaaacttcctgtggaa

SEQ ID NO: 354567 - DNA, 25 bp, Rattus norvegicus
gagtgcctacaatcttcctgtggaa

SEQ ID NO: 354568 - DNA, 25 bp, Rattus norvegicus
gagtgcctactcctagaagctgaag

SEQ ID NO: 354569 - DNA, 25 bp, Rattus norvegicus
gagtgcctactcgtagaagctgaag

SEQ ID NO: 354570 - DNA, 25 bp, Rattus norvegicus
gagtgcctcattatgtaatcatgac

SEQ ID NO: 354571 - DNA, 25 bp, Rattus norvegicus
gagtgcctcattttgtaatcatgac

SEQ ID NO: 354572 - DNA, 25 bp, Rattus norvegicus
gagtgcctccagaatgcaggccctg

SEQ ID NO: 354573 - DNA, 25 bp, Rattus norvegicus
gagtgcctccagtatgcaggccctg

SEQ ID NO: 354574 - DNA, 25 bp, Rattus norvegicus
gagtgcctccctctggaaaagatgg

SEQ ID NO: 354575 - DNA, 25 bp, Rattus norvegicus
gagtgcctccctgtggaaaagatgg

SEQ ID NO: 354576 - DNA, 25 bp, Rattus norvegicus
gagtgcctctgcataaaccctggct

SEQ ID NO: 354577 - DNA, 25 bp, Rattus norvegicus
gagtgcctctgcttaaaccctggct

SEQ ID NO: 354578 - DNA, 25 bp, Rattus norvegicus
gagtgcctgccgctgtgtatcattc

SEQ ID NO: 354579 - DNA, 25 bp, Rattus norvegicus
gagtgcctgccggtgtgtatcattc

SEQ ID NO: 354580 - DNA, 25 bp, Rattus norvegicus
gagtgcctgctcatggagggtcctc

SEQ ID NO: 354581 - DNA, 25 bp, Rattus norvegicus
gagtgcctgctccagagaagctcta

SEQ ID NO: 354582 - DNA, 25 bp, Rattus norvegicus
gagtgcctgctcgagagaagctcta

SEQ ID NO: 354583 - DNA, 25 bp, Rattus norvegicus
gagtgcctgctcttggagggtcctc

SEQ ID NO: 354584 - DNA, 25 bp, Rattus norvegicus
gagtgcctggccaatgggatctcca

SEQ ID NO: 354585 - DNA, 25 bp, Rattus norvegicus
gagtgcctggcctatgggatctcca

SEQ ID NO: 354586 - DNA, 25 bp, Rattus norvegicus
gagtgcctgggcaattccaagctgg

SEQ ID NO: 354587 - DNA, 25 bp, Rattus norvegicus
gagtgcctgggctattccaagctgg

SEQ ID NO: 354588 - DNA, 25 bp, Rattus norvegicus
gagtgcctggtccataagaaacatg

SEQ ID NO: 354589 - DNA, 25 bp, Rattus norvegicus
gagtgcctggtcgataagaaacatg

SEQ ID NO: 354590 - DNA, 25 bp, Rattus norvegicus
gagtgcctgtccaatcagagtcggc

SEQ ID NO: 354591 - DNA, 25 bp, Rattus norvegicus
gagtgcctgtcctatcagagtcggc

SEQ ID NO: 354592 - DNA, 25 bp, Rattus norvegicus
gagtgcctgtctactggacaacaga

SEQ ID NO: 354593 - DNA, 25 bp, Rattus norvegicus
gagtgcctgtcttctggacaacaga

SEQ ID NO: 354594 - DNA, 25 bp, Rattus norvegicus
gagtgcctgtgcaatgcgggattcc

SEQ ID NO: 354595 - DNA, 25 bp, Rattus norvegicus
gagtgcctgtgctatgcgggattcc

SEQ ID NO: 354596 - DNA, 25 bp, Rattus norvegicus
gagtgccttaaaaagctttcttagc

SEQ ID NO: 354597 - DNA, 25 bp, Rattus norvegicus
gagtgccttaaatagctttcttagc

SEQ ID NO: 354598 - DNA, 25 bp, Rattus norvegicus
gagtgccttcacaaaagcagatgtt

SEQ ID NO: 354599 - DNA, 25 bp, Rattus norvegicus
gagtgccttcactaaagcagatgtt

SEQ ID NO: 354600 - DNA, 25 bp, Rattus norvegicus
gagtgccttccgaagatgacccact

SEQ ID NO: 354601 - DNA, 25 bp, Rattus norvegicus
gagtgccttccgtagatgacccact

SEQ ID NO: 354602 - DNA, 25 bp, Rattus norvegicus
gagtgccttcgtattagtgtaccct

SEQ ID NO: 354603 - DNA, 25 bp, Rattus norvegicus
gagtgccttcgttttagtgtaccct

SEQ ID NO: 354604 - DNA, 25 bp, Rattus norvegicus
gagtgccttgatctggaacgttcga

SEQ ID NO: 354605 - DNA, 25 bp, Rattus norvegicus
gagtgccttgatgtggaacgttcga

SEQ ID NO: 354606 - DNA, 25 bp, Rattus norvegicus
gagtgccttgcaaatactactgtat

SEQ ID NO: 354607 - DNA, 25 bp, Rattus norvegicus
gagtgccttgcatatactactgtat

SEQ ID NO: 354608 - DNA, 25 bp, Rattus norvegicus
gagtgccttgcccagcttagggaac

SEQ ID NO: 354609 - DNA, 25 bp, Rattus norvegicus
gagtgccttgccgagcttagggaac

SEQ ID NO: 354610 - DNA, 25 bp, Rattus norvegicus
gagtgccttgctccaaggtaataat

SEQ ID NO: 354611 - DNA, 25 bp, Rattus norvegicus
gagtgccttgctgcaaggtaataat

SEQ ID NO: 354612 - DNA, 25 bp, Rattus norvegicus
gagtgcctttatagaactgaatctg

SEQ ID NO: 354613 - DNA, 25 bp, Rattus norvegicus
gagtgcctttattgaactgaatctg

SEQ ID NO: 354614 - DNA, 25 bp, Rattus norvegicus
gagtgcctttgactcacatacgcaa

SEQ ID NO: 354615 - DNA, 25 bp, Rattus norvegicus
gagtgcctttgagtcacatacgcaa

SEQ ID NO: 354616 - DNA, 25 bp, Rattus norvegicus
gagtgcgaactgcagaccatgactg

SEQ ID NO: 354617 - DNA, 25 bp, Rattus norvegicus
gagtgcgaactggagaccatgactg

SEQ ID NO: 354618 - DNA, 25 bp, Rattus norvegicus
gagtgcgaagcacccgtcgtatgca

SEQ ID NO: 354619 - DNA, 25 bp, Rattus norvegicus
gagtgcgaagcagccgtcgtatgca

SEQ ID NO: 354620 - DNA, 25 bp, Rattus norvegicus
gagtgcgaagtgcttttacctgtag

SEQ ID NO: 354621 - DNA, 25 bp, Rattus norvegicus
gagtgcgaagtggttttacctgtag

SEQ ID NO: 354622 - DNA, 25 bp, Rattus norvegicus
gagtgcgactcgatgttcgaagcct

SEQ ID NO: 354623 - DNA, 25 bp, Rattus norvegicus
gagtgcgactcgttgttcgaagcct

SEQ ID NO: 354624 - DNA, 25 bp, Rattus norvegicus
gagtgcgagcatcctgaacgttcaa

SEQ ID NO: 354625 - DNA, 25 bp, Rattus norvegicus
gagtgcgagcatgctgaacgttcaa

SEQ ID NO: 354626 - DNA, 25 bp, Rattus norvegicus
gagtgcgaggacacctttgacaacc

SEQ ID NO: 354627 - DNA, 25 bp, Rattus norvegicus
gagtgcgaggactcctttgacaacc

SEQ ID NO: 354628 - DNA, 25 bp, Rattus norvegicus
gagtgcgagtgcacagtgaccatcg

SEQ ID NO: 354629 - DNA, 25 bp, Rattus norvegicus
gagtgcgagtgctcagtgaccatcg

SEQ ID NO: 354630 - DNA, 25 bp, Rattus norvegicus
gagtgcgatggcagcttagaaacca

SEQ ID NO: 354631 - DNA, 25 bp, Rattus norvegicus
gagtgcgatggctgcttagaaacca

SEQ ID NO: 354632 - DNA, 25 bp, Rattus norvegicus
gagtgcgcactgacagcactggttc

SEQ ID NO: 354633 - DNA, 25 bp, Rattus norvegicus
gagtgcgcactgtcagcactggttc

SEQ ID NO: 354634 - DNA, 25 bp, Rattus norvegicus
gagtgcgcagttagagccttaggct

SEQ ID NO: 354635 - DNA, 25 bp, Rattus norvegicus
gagtgcgcagtttgagccttaggct

SEQ ID NO: 354636 - DNA, 25 bp, Rattus norvegicus
gagtgcgcatcacgctctcagacgc

SEQ ID NO: 354637 - DNA, 25 bp, Rattus norvegicus
gagtgcgcatcaggctctcagacgc

SEQ ID NO: 354638 - DNA, 25 bp, Rattus norvegicus
gagtgcgccagcagcagtgtgataa

SEQ ID NO: 354639 - DNA, 25 bp, Rattus norvegicus
gagtgcgccagctgcagtgtgataa

SEQ ID NO: 354640 - DNA, 25 bp, Rattus norvegicus
gagtgcgctgtgaccttggaactct

SEQ ID NO: 354641 - DNA, 25 bp, Rattus norvegicus
gagtgcgctgtgtccttggaactct

SEQ ID NO: 354642 - DNA, 25 bp, Rattus norvegicus
gagtgcggcaagacttttagacttt

SEQ ID NO: 354643 - DNA, 25 bp, Rattus norvegicus
gagtgcggcaagtcttttagacttt

SEQ ID NO: 354644 - DNA, 25 bp, Rattus norvegicus
gagtgcggccggctgggttacaggc

SEQ ID NO: 354645 - DNA, 25 bp, Rattus norvegicus
gagtgcggccgggtgggttacaggc

SEQ ID NO: 354646 - DNA, 25 bp, Rattus norvegicus
gagtgcggctagaacttggcgccca

SEQ ID NO: 354647 - DNA, 25 bp, Rattus norvegicus
gagtgcggctagtacttggcgccca

SEQ ID NO: 354648 - DNA, 25 bp, Rattus norvegicus
gagtgcgtcactaggttgttttatt

SEQ ID NO: 354649 - DNA, 25 bp, Rattus norvegicus
gagtgcgtcacttggttgttttatt

SEQ ID NO: 354650 - DNA, 25 bp, Rattus norvegicus
gagtgcgtcatgaacaatgccatct

SEQ ID NO: 354651 - DNA, 25 bp, Rattus norvegicus
gagtgcgtcatgtacaatgccatct

SEQ ID NO: 354652 - DNA, 25 bp, Rattus norvegicus
gagtgcgtccaaacaaacgtctcac

SEQ ID NO: 354653 - DNA, 25 bp, Rattus norvegicus
gagtgcgtccaatcaaacgtctcac

SEQ ID NO: 354654 - DNA, 25 bp, Rattus norvegicus
gagtgcgtccatccttaacatgaat

SEQ ID NO: 354655 - DNA, 25 bp, Rattus norvegicus
gagtgcgtccatgcttaacatgaat

SEQ ID NO: 354656 - DNA, 25 bp, Rattus norvegicus
gagtgcgtctgcagctcgccacgct

SEQ ID NO: 354657 - DNA, 25 bp, Rattus norvegicus
gagtgcgtctgctgctcgccacgct

SEQ ID NO: 354658 - DNA, 25 bp, Rattus norvegicus
gagtgcgtgaatatcatgtccagta

SEQ ID NO: 354659 - DNA, 25 bp, Rattus norvegicus
gagtgcgtgaatttcatgtccagta

SEQ ID NO: 354660 - DNA, 25 bp, Rattus norvegicus
gagtgcgtgcctatatcagcgggac

SEQ ID NO: 354661 - DNA, 25 bp, Rattus norvegicus
gagtgcgtgcctttatcagcgggac

SEQ ID NO: 354662 - DNA, 25 bp, Rattus norvegicus
gagtgcgtggacagacggctccggg

SEQ ID NO: 354663 - DNA, 25 bp, Rattus norvegicus
gagtgcgtggactgacggctccggg

SEQ ID NO: 354664 - DNA, 25 bp, Rattus norvegicus
gagtgcgtggagactctccgcagat

SEQ ID NO: 354665 - DNA, 25 bp, Rattus norvegicus
gagtgcgtggagtctctccgcagat

SEQ ID NO: 354666 - DNA, 25 bp, Rattus norvegicus
gagtgcgtggtcattcacgccatgc

SEQ ID NO: 354667 - DNA, 25 bp, Rattus norvegicus
gagtgcgtggtctttcacgccatgc

SEQ ID NO: 354668 - DNA, 25 bp, Rattus norvegicus
gagtgcgttgatagctacggagcct

SEQ ID NO: 354669 - DNA, 25 bp, Rattus norvegicus
gagtgcgttgattgctacggagcct

SEQ ID NO: 354670 - DNA, 25 bp, Rattus norvegicus
gagtgcgttgtgatatcctgaagag

SEQ ID NO: 354671 - DNA, 25 bp, Rattus norvegicus
gagtgcgttgtgttatcctgaagag

SEQ ID NO: 354672 - DNA, 25 bp, Rattus norvegicus
gagtgctaaactctggacttaaaag

SEQ ID NO: 354673 - DNA, 25 bp, Rattus norvegicus
gagtgctaaactgtggacttaaaag

SEQ ID NO: 354674 - DNA, 25 bp, Rattus norvegicus
gagtgctaaatgacagactgctatt

SEQ ID NO: 354675 - DNA, 25 bp, Rattus norvegicus
gagtgctaaatgtcagactgctatt

SEQ ID NO: 354676 - DNA, 25 bp, Rattus norvegicus
gagtgctaacacagttgtaccctgg

SEQ ID NO: 354677 - DNA, 25 bp, Rattus norvegicus
gagtgctaacactgttgtaccctgg

SEQ ID NO: 354678 - DNA, 25 bp, Rattus norvegicus
gagtgctaagtgaggtcagaacaat

SEQ ID NO: 354679 - DNA, 25 bp, Rattus norvegicus
gagtgctaagtgtggtcagaacaat

SEQ ID NO: 354680 - DNA, 25 bp, Rattus norvegicus
gagtgctatagcctgctgtgcagac

SEQ ID NO: 354681 - DNA, 25 bp, Rattus norvegicus
gagtgctatagcgtgctgtgcagac

SEQ ID NO: 354682 - DNA, 25 bp, Rattus norvegicus
gagtgctatatcaacggtgccttcc

SEQ ID NO: 354683 - DNA, 25 bp, Rattus norvegicus
gagtgctatatctacggtgccttcc

SEQ ID NO: 354684 - DNA, 25 bp, Rattus norvegicus
gagtgctatattcccaacattgcta

SEQ ID NO: 354685 - DNA, 25 bp, Rattus norvegicus
gagtgctatattgccaacattgcta

SEQ ID NO: 354686 - DNA, 25 bp, Rattus norvegicus
gagtgctatgccagatcacagacag

SEQ ID NO: 354687 - DNA, 25 bp, Rattus norvegicus
gagtgctatgcctgatcacagacag

SEQ ID NO: 354688 - DNA, 25 bp, Rattus norvegicus
gagtgctattttctcacgtagacac

SEQ ID NO: 354689 - DNA, 25 bp, Rattus norvegicus
gagtgctattttgtcacgtagacac

SEQ ID NO: 354690 - DNA, 25 bp, Rattus norvegicus
gagtgctcaactcaagtggctgtct

SEQ ID NO: 354691 - DNA, 25 bp, Rattus norvegicus
gagtgctcaactgaagtggctgtct

SEQ ID NO: 354692 - DNA, 25 bp, Rattus norvegicus
gagtgctcacaaatgggccctgggt

SEQ ID NO: 354693 - DNA, 25 bp, Rattus norvegicus
gagtgctcacaattgggccctgggt

SEQ ID NO: 354694 - DNA, 25 bp, Rattus norvegicus
gagtgctcagccatgacgcagaaga

SEQ ID NO: 354695 - DNA, 25 bp, Rattus norvegicus
gagtgctcagccctttgtggaacac

SEQ ID NO: 354696 - DNA, 25 bp, Rattus norvegicus
gagtgctcagccgtttgtggaacac

SEQ ID NO: 354697 - DNA, 25 bp, Rattus norvegicus
gagtgctcagccttgacgcagaaga

SEQ ID NO: 354698 - DNA, 25 bp, Rattus norvegicus
gagtgctcaggcaaaacttcttgca

SEQ ID NO: 354699 - DNA, 25 bp, Rattus norvegicus
gagtgctcaggctaaacttcttgca

SEQ ID NO: 354700 - DNA, 25 bp, Rattus norvegicus
gagtgctccaaacggagtgctccca

SEQ ID NO: 354701 - DNA, 25 bp, Rattus norvegicus
gagtgctccaaagggagtgctccca

SEQ ID NO: 354702 - DNA, 25 bp, Rattus norvegicus
gagtgctccaccagttttctgggac

SEQ ID NO: 354703 - DNA, 25 bp, Rattus norvegicus
gagtgctccacctgttttctgggac

SEQ ID NO: 354704 - DNA, 25 bp, Rattus norvegicus
gagtgctcccatctgtgttagaagt

SEQ ID NO: 354705 - DNA, 25 bp, Rattus norvegicus
gagtgctcccatgtgtgttagaagt

SEQ ID NO: 354706 - DNA, 25 bp, Rattus norvegicus
gagtgctccctaccagtggtaattt

SEQ ID NO: 354707 - DNA, 25 bp, Rattus norvegicus
gagtgctccctagcagtggtaattt

SEQ ID NO: 354708 - DNA, 25 bp, Rattus norvegicus
gagtgctcccttatccgcatgggat

SEQ ID NO: 354709 - DNA, 25 bp, Rattus norvegicus
gagtgctcccttttccgcatgggat

SEQ ID NO: 354710 - DNA, 25 bp, Rattus norvegicus
gagtgctccgttcgaaagatgtctt

SEQ ID NO: 354711 - DNA, 25 bp, Rattus norvegicus
gagtgctccgttggaaagatgtctt

SEQ ID NO: 354712 - DNA, 25 bp, Rattus norvegicus
gagtgctcctaacactgatgcttga

SEQ ID NO: 354713 - DNA, 25 bp, Rattus norvegicus
gagtgctcctaactcttaaggctca

SEQ ID NO: 354714 - DNA, 25 bp, Rattus norvegicus
gagtgctcctaagactgatgcttga

SEQ ID NO: 354715 - DNA, 25 bp, Rattus norvegicus
gagtgctcctaagtcttaaggctca

SEQ ID NO: 354716 - DNA, 25 bp, Rattus norvegicus
gagtgctccttacgctcagccaaga

SEQ ID NO: 354717 - DNA, 25 bp, Rattus norvegicus
gagtgctccttaggctcagccaaga

SEQ ID NO: 354718 - DNA, 25 bp, Rattus norvegicus
gagtgctcggcacaaaattgccaaa

SEQ ID NO: 354719 - DNA, 25 bp, Rattus norvegicus
gagtgctcggcagaaaattgccaaa

SEQ ID NO: 354720 - DNA, 25 bp, Rattus norvegicus
gagtgctctacacctggcttctagc

SEQ ID NO: 354721 - DNA, 25 bp, Rattus norvegicus
gagtgctctacagctggcttctagc

SEQ ID NO: 354722 - DNA, 25 bp, Rattus norvegicus
gagtgctctcacacacagtatacac

SEQ ID NO: 354723 - DNA, 25 bp, Rattus norvegicus
gagtgctctcactcacagtatacac

SEQ ID NO: 354724 - DNA, 25 bp, Rattus norvegicus
gagtgctctctgcttttaatcatta

SEQ ID NO: 354725 - DNA, 25 bp, Rattus norvegicus
gagtgctctctggttttaatcatta

SEQ ID NO: 354726 - DNA, 25 bp, Rattus norvegicus
gagtgctctgaactgggtaaatcat

SEQ ID NO: 354727 - DNA, 25 bp, Rattus norvegicus
gagtgctctgaagtgggtaaatcat

SEQ ID NO: 354728 - DNA, 25 bp, Rattus norvegicus
gagtgctcttccactctgtctgagg

SEQ ID NO: 354729 - DNA, 25 bp, Rattus norvegicus
gagtgctcttcctctctgtctgagg

SEQ ID NO: 354730 - DNA, 25 bp, Rattus norvegicus
gagtgctgaaggaacatctggacaa

SEQ ID NO: 354731 - DNA, 25 bp, Rattus norvegicus
gagtgctgaaggtacatctggacaa

SEQ ID NO: 354732 - DNA, 25 bp, Rattus norvegicus
gagtgctgacgccttactggcaatg

SEQ ID NO: 354733 - DNA, 25 bp, Rattus norvegicus
gagtgctgacgcgttactggcaatg

SEQ ID NO: 354734 - DNA, 25 bp, Rattus norvegicus
gagtgctgagatatttgtaagtgtt

SEQ ID NO: 354735 - DNA, 25 bp, Rattus norvegicus
gagtgctgagatttttgtaagtgtt

SEQ ID NO: 354736 - DNA, 25 bp, Rattus norvegicus
gagtgctgagcgcaatctacttcct

SEQ ID NO: 354737 - DNA, 25 bp, Rattus norvegicus
gagtgctgagcggaatctacttcct

SEQ ID NO: 354738 - DNA, 25 bp, Rattus norvegicus
gagtgctgagctaaacgtgcctatc

SEQ ID NO: 354739 - DNA, 25 bp, Rattus norvegicus
gagtgctgagcttaacgtgcctatc

SEQ ID NO: 354740 - DNA, 25 bp, Rattus norvegicus
gagtgctgaggcaggaatctccgca

SEQ ID NO: 354741 - DNA, 25 bp, Rattus norvegicus
gagtgctgaggctggaatctccgca

SEQ ID NO: 354742 - DNA, 25 bp, Rattus norvegicus
gagtgctgcaagctaccagtgttta

SEQ ID NO: 354743 - DNA, 25 bp, Rattus norvegicus
gagtgctgcaaggtaccagtgttta

SEQ ID NO: 354744 - DNA, 25 bp, Rattus norvegicus
gagtgctgcgagaccttcgagaagc

SEQ ID NO: 354745 - DNA, 25 bp, Rattus norvegicus
gagtgctgcgagtccttcgagaagc

SEQ ID NO: 354746 - DNA, 25 bp, Rattus norvegicus
gagtgctgctctcccattaatccca

SEQ ID NO: 354747 - DNA, 25 bp, Rattus norvegicus
gagtgctgctctgccattaatccca

SEQ ID NO: 354748 - DNA, 25 bp, Rattus norvegicus
gagtgctgctgcattgcagtgtgaa

SEQ ID NO: 354749 - DNA, 25 bp, Rattus norvegicus
gagtgctgctgctttgcagtgtgaa

SEQ ID NO: 354750 - DNA, 25 bp, Rattus norvegicus
gagtgctgctggatccacgagagca

SEQ ID NO: 354751 - DNA, 25 bp, Rattus norvegicus
gagtgctgctggttccacgagagca

SEQ ID NO: 354752 - DNA, 25 bp, Rattus norvegicus
gagtgctgctgtcaacccagtagct

SEQ ID NO: 354753 - DNA, 25 bp, Rattus norvegicus
gagtgctgctgtgaacccagtagct

SEQ ID NO: 354754 - DNA, 25 bp, Rattus norvegicus
gagtgctggaccagacagtagaaca

SEQ ID NO: 354755 - DNA, 25 bp, Rattus norvegicus
gagtgctggacctgacagtagaaca

SEQ ID NO: 354756 - DNA, 25 bp, Rattus norvegicus
gagtgctggagtatccatgtgcgaa

SEQ ID NO: 354757 - DNA, 25 bp, Rattus norvegicus
gagtgctggagtttccatgtgcgaa

SEQ ID NO: 354758 - DNA, 25 bp, Rattus norvegicus
gagtgctggcacacggcaggcaaca

SEQ ID NO: 354759 - DNA, 25 bp, Rattus norvegicus
gagtgctggcactcggcaggcaaca

SEQ ID NO: 354760 - DNA, 25 bp, Rattus norvegicus
gagtgctggcatcaaatgctgttct

SEQ ID NO: 354761 - DNA, 25 bp, Rattus norvegicus
gagtgctggcatgaaatgctgttct

SEQ ID NO: 354762 - DNA, 25 bp, Rattus norvegicus
gagtgctggtaactgattgtgtcta

SEQ ID NO: 354763 - DNA, 25 bp, Rattus norvegicus
gagtgctggtaagtgattgtgtcta

SEQ ID NO: 354764 - DNA, 25 bp, Rattus norvegicus
gagtgctggtgtctgaaccccaata

SEQ ID NO: 354765 - DNA, 25 bp, Rattus norvegicus
gagtgctggtgtgtgaaccccaata

SEQ ID NO: 354766 - DNA, 25 bp, Rattus norvegicus
gagtgctgtactcctttttcatatg

SEQ ID NO: 354767 - DNA, 25 bp, Rattus norvegicus
gagtgctgtactgctttttcatatg

SEQ ID NO: 354768 - DNA, 25 bp, Rattus norvegicus
gagtgctgtcatatctacatttgat

SEQ ID NO: 354769 - DNA, 25 bp, Rattus norvegicus
gagtgctgtcatttctacatttgat

SEQ ID NO: 354770 - DNA, 25 bp, Rattus norvegicus
gagtgctgtcccaagcaatggtgat

SEQ ID NO: 354771 - DNA, 25 bp, Rattus norvegicus
gagtgctgtccctagcaatggtgat

SEQ ID NO: 354772 - DNA, 25 bp, Rattus norvegicus
gagtgctgtctaaaactgttgtgct

SEQ ID NO: 354773 - DNA, 25 bp, Rattus norvegicus
gagtgctgtctataactgttgtgct

SEQ ID NO: 354774 - DNA, 25 bp, Rattus norvegicus
gagtgctgtctcagggcacaattgt

SEQ ID NO: 354775 - DNA, 25 bp, Rattus norvegicus
gagtgctgtctctgggcacaattgt

SEQ ID NO: 354776 - DNA, 25 bp, Rattus norvegicus
gagtgctgtgaaagcctagactgaa

SEQ ID NO: 354777 - DNA, 25 bp, Rattus norvegicus
gagtgctgtgaatgcctagactgaa

SEQ ID NO: 354778 - DNA, 25 bp, Rattus norvegicus
gagtgctgtgcacgcaatccaatgt

SEQ ID NO: 354779 - DNA, 25 bp, Rattus norvegicus
gagtgctgtgcaggcaatccaatgt

SEQ ID NO: 354780 - DNA, 25 bp, Rattus norvegicus
gagtgctgtgtaagtaacagaccaa

SEQ ID NO: 354781 - DNA, 25 bp, Rattus norvegicus
gagtgctgtgtatgtaacagaccaa

SEQ ID NO: 354782 - DNA, 25 bp, Rattus norvegicus
gagtgctgttaccttggatcttttt

SEQ ID NO: 354783 - DNA, 25 bp, Rattus norvegicus
gagtgctgttacgttggatcttttt

SEQ ID NO: 354784 - DNA, 25 bp, Rattus norvegicus
gagtgcttagaactgtaatcctttg

SEQ ID NO: 354785 - DNA, 25 bp, Rattus norvegicus
gagtgcttagaagtgtaatcctttg

SEQ ID NO: 354786 - DNA, 25 bp, Rattus norvegicus
gagtgcttagcccaagagctcccgc

SEQ ID NO: 354787 - DNA, 25 bp, Rattus norvegicus
gagtgcttagccgaagagctcccgc

SEQ ID NO: 354788 - DNA, 25 bp, Rattus norvegicus
gagtgcttatcgacctcagaatagc

SEQ ID NO: 354789 - DNA, 25 bp, Rattus norvegicus
gagtgcttatcgtcctcagaatagc

SEQ ID NO: 354790 - DNA, 25 bp, Rattus norvegicus
gagtgcttatctaggcattgcctca

SEQ ID NO: 354791 - DNA, 25 bp, Rattus norvegicus
gagtgcttatcttggcattgcctca

SEQ ID NO: 354792 - DNA, 25 bp, Rattus norvegicus
gagtgcttcagaagggttttctttt

SEQ ID NO: 354793 - DNA, 25 bp, Rattus norvegicus
gagtgcttcagatgggttttctttt

SEQ ID NO: 354794 - DNA, 25 bp, Rattus norvegicus
gagtgcttcctgagcgaagtgacgc

SEQ ID NO: 354795 - DNA, 25 bp, Rattus norvegicus
gagtgcttcctgtgcgaagtgacgc

SEQ ID NO: 354796 - DNA, 25 bp, Rattus norvegicus
gagtgcttcgtaaatggtgtttgtt

SEQ ID NO: 354797 - DNA, 25 bp, Rattus norvegicus
gagtgcttcgtatatggtgtttgtt

SEQ ID NO: 354798 - DNA, 25 bp, Rattus norvegicus
gagtgcttctgtccatgttactgtt

SEQ ID NO: 354799 - DNA, 25 bp, Rattus norvegicus
gagtgcttctgtgcatgttactgtt

SEQ ID NO: 354800 - DNA, 25 bp, Rattus norvegicus
gagtgcttcttacactccctgagca

SEQ ID NO: 354801 - DNA, 25 bp, Rattus norvegicus
gagtgcttcttagactccctgagca

SEQ ID NO: 354802 - DNA, 25 bp, Rattus norvegicus
gagtgcttgataagctgctcctcac

SEQ ID NO: 354803 - DNA, 25 bp, Rattus norvegicus
gagtgcttgatatgctgctcctcac

SEQ ID NO: 354804 - DNA, 25 bp, Rattus norvegicus
gagtgcttgcctaacttgagggata

SEQ ID NO: 354805 - DNA, 25 bp, Rattus norvegicus
gagtgcttgcctcgtaaatccttag

SEQ ID NO: 354806 - DNA, 25 bp, Rattus norvegicus
gagtgcttgcctggtaaatccttag

SEQ ID NO: 354807 - DNA, 25 bp, Rattus norvegicus
gagtgcttgccttacttgagggata

SEQ ID NO: 354808 - DNA, 25 bp, Rattus norvegicus
gagtgcttgctgatgagaaggttct

SEQ ID NO: 354809 - DNA, 25 bp, Rattus norvegicus
gagtgcttgctgttgagaaggttct

SEQ ID NO: 354810 - DNA, 25 bp, Rattus norvegicus
gagtgcttgggtcttcattgaactg

SEQ ID NO: 354811 - DNA, 25 bp, Rattus norvegicus
gagtgcttgggtgttcattgaactg

SEQ ID NO: 354812 - DNA, 25 bp, Rattus norvegicus
gagtgcttggttagcttgtttatga

SEQ ID NO: 354813 - DNA, 25 bp, Rattus norvegicus
gagtgcttggtttgcttgtttatga

SEQ ID NO: 354814 - DNA, 25 bp, Rattus norvegicus
gagtgctttgatctatacatccgta

SEQ ID NO: 354815 - DNA, 25 bp, Rattus norvegicus
gagtgctttgatgtatacatccgta

SEQ ID NO: 354816 - DNA, 25 bp, Rattus norvegicus
gagtgctttgccaacttgtatgtat

SEQ ID NO: 354817 - DNA, 25 bp, Rattus norvegicus
gagtgctttgccctctgtaaataac

SEQ ID NO: 354818 - DNA, 25 bp, Rattus norvegicus
gagtgctttgccgtctgtaaataac

SEQ ID NO: 354819 - DNA, 25 bp, Rattus norvegicus
gagtgctttgcctacttgtatgtat

SEQ ID NO: 354820 - DNA, 25 bp, Rattus norvegicus
gagtgctttgtaccaggcattacaa

SEQ ID NO: 354821 - DNA, 25 bp, Rattus norvegicus
gagtgctttgtagcaggcattacaa

SEQ ID NO: 354822 - DNA, 25 bp, Rattus norvegicus
gagtgcttttaaacctgatgatagt

SEQ ID NO: 354823 - DNA, 25 bp, Rattus norvegicus
gagtgcttttaatcctgatgatagt

SEQ ID NO: 354824 - DNA, 25 bp, Rattus norvegicus
gagtgcttttcgctttgtgatattt

SEQ ID NO: 354825 - DNA, 25 bp, Rattus norvegicus
gagtgcttttcggtttgtgatattt

SEQ ID NO: 354826 - DNA, 25 bp, Rattus norvegicus
gagtggaaaattacgccaaggacaa

SEQ ID NO: 354827 - DNA, 25 bp, Rattus norvegicus
gagtggaaaatttcgccaaggacaa

SEQ ID NO: 354828 - DNA, 25 bp, Rattus norvegicus
gagtggaaagggacgaatcttttca

SEQ ID NO: 354829 - DNA, 25 bp, Rattus norvegicus
gagtggaaagggtcgaatcttttca

SEQ ID NO: 354830 - DNA, 25 bp, Rattus norvegicus
gagtggaaatagatcccgggtcact

SEQ ID NO: 354831 - DNA, 25 bp, Rattus norvegicus
gagtggaaatagttcccgggtcact

SEQ ID NO: 354832 - DNA, 25 bp, Rattus norvegicus
gagtggaaatcacccatttgggctc

SEQ ID NO: 354833 - DNA, 25 bp, Rattus norvegicus
gagtggaaatcagccatttgggctc

SEQ ID NO: 354834 - DNA, 25 bp, Rattus norvegicus
gagtggaaccctacaaagccaggag

SEQ ID NO: 354835 - DNA, 25 bp, Rattus norvegicus
gagtggaacccttcaaagccaggag

SEQ ID NO: 354836 - DNA, 25 bp, Rattus norvegicus
gagtggaactgtccttgacctcaca

SEQ ID NO: 354837 - DNA, 25 bp, Rattus norvegicus
gagtggaactgtgcttgacctcaca

SEQ ID NO: 354838 - DNA, 25 bp, Rattus norvegicus
gagtggaactttaaactcaggcctt

SEQ ID NO: 354839 - DNA, 25 bp, Rattus norvegicus
gagtggaacttttaactcaggcctt

SEQ ID NO: 354840 - DNA, 25 bp, Rattus norvegicus
gagtggaatcttcatcatgccaaat

SEQ ID NO: 354841 - DNA, 25 bp, Rattus norvegicus
gagtggaatcttgatcatgccaaat

SEQ ID NO: 354842 - DNA, 25 bp, Rattus norvegicus
gagtggacaccaatatgctaacaga

SEQ ID NO: 354843 - DNA, 25 bp, Rattus norvegicus
gagtggacaccattatgctaacaga

SEQ ID NO: 354844 - DNA, 25 bp, Rattus norvegicus
gagtggacagccaagagctctttgc

SEQ ID NO: 354845 - DNA, 25 bp, Rattus norvegicus
gagtggacagcctagagctctttgc

SEQ ID NO: 354846 - DNA, 25 bp, Rattus norvegicus
gagtggacatttaaaagcctcctcc

SEQ ID NO: 354847 - DNA, 25 bp, Rattus norvegicus
gagtggacattttaaagcctcctcc

SEQ ID NO: 354848 - DNA, 25 bp, Rattus norvegicus
gagtggacccacaacagcatgaagc

SEQ ID NO: 354849 - DNA, 25 bp, Rattus norvegicus
gagtggacccacagcaggctaggta

SEQ ID NO: 354850 - DNA, 25 bp, Rattus norvegicus
gagtggacccactacagcatgaagc

SEQ ID NO: 354851 - DNA, 25 bp, Rattus norvegicus
gagtggacccactgcaggctaggta

SEQ ID NO: 354852 - DNA, 25 bp, Rattus norvegicus
gagtggacgtctacttcaagtgttt

SEQ ID NO: 354853 - DNA, 25 bp, Rattus norvegicus
gagtggacgtcttcttcaagtgttt

SEQ ID NO: 354854 - DNA, 25 bp, Rattus norvegicus
gagtggactatcaagtgagcctaaa

SEQ ID NO: 354855 - DNA, 25 bp, Rattus norvegicus
gagtggactatctagtgagcctaaa

SEQ ID NO: 354856 - DNA, 25 bp, Rattus norvegicus
gagtggactcatattgtggacccaa

SEQ ID NO: 354857 - DNA, 25 bp, Rattus norvegicus
gagtggactcattttgtggacccaa

SEQ ID NO: 354858 - DNA, 25 bp, Rattus norvegicus
gagtggactctgagaatcctcccta

SEQ ID NO: 354859 - DNA, 25 bp, Rattus norvegicus
gagtggactctgtgaatcctcccta

SEQ ID NO: 354860 - DNA, 25 bp, Rattus norvegicus
gagtggacttcgagacatctgcgca

SEQ ID NO: 354861 - DNA, 25 bp, Rattus norvegicus
gagtggacttcgtgacatctgcgca

SEQ ID NO: 354862 - DNA, 25 bp, Rattus norvegicus
gagtggactttaaccttggctacac

SEQ ID NO: 354863 - DNA, 25 bp, Rattus norvegicus
gagtggactttatccttggctacac

SEQ ID NO: 354864 - DNA, 25 bp, Rattus norvegicus
gagtggagacacacgcagtctcaga

SEQ ID NO: 354865 - DNA, 25 bp, Rattus norvegicus
gagtggagacaccatctatgcgtat

SEQ ID NO: 354866 - DNA, 25 bp, Rattus norvegicus
gagtggagacacgatctatgcgtat

SEQ ID NO: 354867 - DNA, 25 bp, Rattus norvegicus
gagtggagacactcgcagtctcaga

SEQ ID NO: 354868 - DNA, 25 bp, Rattus norvegicus
gagtggagaccgaaactccggttct

SEQ ID NO: 354869 - DNA, 25 bp, Rattus norvegicus
gagtggagaccgtaactccggttct

SEQ ID NO: 354870 - DNA, 25 bp, Rattus norvegicus
gagtggagagcgagctctctgcacc

SEQ ID NO: 354871 - DNA, 25 bp, Rattus norvegicus
gagtggagagcgtgctctctgcacc

SEQ ID NO: 354872 - DNA, 25 bp, Rattus norvegicus
gagtggagcagtactagcataacaa

SEQ ID NO: 354873 - DNA, 25 bp, Rattus norvegicus
gagtggagcagttctagcataacaa

SEQ ID NO: 354874 - DNA, 25 bp, Rattus norvegicus
gagtggaggaaaatctgcacattta

SEQ ID NO: 354875 - DNA, 25 bp, Rattus norvegicus
gagtggaggaaattctgcacattta

SEQ ID NO: 354876 - DNA, 25 bp, Rattus norvegicus
gagtggaggctaagtttcaccctga

SEQ ID NO: 354877 - DNA, 25 bp, Rattus norvegicus
gagtggaggctatgtttcaccctga

SEQ ID NO: 354878 - DNA, 25 bp, Rattus norvegicus
gagtggagtatcagcagcaccaact

SEQ ID NO: 354879 - DNA, 25 bp, Rattus norvegicus
gagtggagtatctgcagcaccaact

SEQ ID NO: 354880 - DNA, 25 bp, Rattus norvegicus
gagtggagtcaaaagtacagtgcct

SEQ ID NO: 354881 - DNA, 25 bp, Rattus norvegicus
gagtggagtcaatagtacagtgcct

SEQ ID NO: 354882 - DNA, 25 bp, Rattus norvegicus
gagtggagtcgaagcgtctcttcca

SEQ ID NO: 354883 - DNA, 25 bp, Rattus norvegicus
gagtggagtcgatgcgtctcttcca

SEQ ID NO: 354884 - DNA, 25 bp, Rattus norvegicus
gagtggagtgggatccttagactaa

SEQ ID NO: 354885 - DNA, 25 bp, Rattus norvegicus
gagtggagtgggttccttagactaa

SEQ ID NO: 354886 - DNA, 25 bp, Rattus norvegicus
gagtggatacagacaggcagcttgc

SEQ ID NO: 354887 - DNA, 25 bp, Rattus norvegicus
gagtggatacagtcaggcagcttgc

SEQ ID NO: 354888 - DNA, 25 bp, Rattus norvegicus
gagtggatacatctttctgctttaa

SEQ ID NO: 354889 - DNA, 25 bp, Rattus norvegicus
gagtggatacatgtttctgctttaa

SEQ ID NO: 354890 - DNA, 25 bp, Rattus norvegicus
gagtggatactgctcccagtttgct

SEQ ID NO: 354891 - DNA, 25 bp, Rattus norvegicus
gagtggatactggtcccagtttgct

SEQ ID NO: 354892 - DNA, 25 bp, Rattus norvegicus
gagtggatatctaccctcatgtatg

SEQ ID NO: 354893 - DNA, 25 bp, Rattus norvegicus
gagtggatatcttccctcatgtatg

SEQ ID NO: 354894 - DNA, 25 bp, Rattus norvegicus
gagtggatcctgatgcttccatagc

SEQ ID NO: 354895 - DNA, 25 bp, Rattus norvegicus
gagtggatcctgttgcttccatagc

SEQ ID NO: 354896 - DNA, 25 bp, Rattus norvegicus
gagtggatctacctcagagttctgc

SEQ ID NO: 354897 - DNA, 25 bp, Rattus norvegicus
gagtggatctacgtcagagttctgc

SEQ ID NO: 354898 - DNA, 25 bp, Rattus norvegicus
gagtggatgatcaccctggacagga

SEQ ID NO: 354899 - DNA, 25 bp, Rattus norvegicus
gagtggatgatctccctggacagga

SEQ ID NO: 354900 - DNA, 25 bp, Rattus norvegicus
gagtggatgttaagtcacaatccta

SEQ ID NO: 354901 - DNA, 25 bp, Rattus norvegicus
gagtggatgttatgtcacaatccta

SEQ ID NO: 354902 - DNA, 25 bp, Rattus norvegicus
gagtggattcgtcacaaatttacca

SEQ ID NO: 354903 - DNA, 25 bp, Rattus norvegicus
gagtggattcgtgacaaatttacca

SEQ ID NO: 354904 - DNA, 25 bp, Rattus norvegicus
gagtggattcttcttgacttcatag

SEQ ID NO: 354905 - DNA, 25 bp, Rattus norvegicus
gagtggattcttgttgacttcatag

SEQ ID NO: 354906 - DNA, 25 bp, Rattus norvegicus
gagtggattgctagctttatctaag

SEQ ID NO: 354907 - DNA, 25 bp, Rattus norvegicus
gagtggattgcttgctttatctaag

SEQ ID NO: 354908 - DNA, 25 bp, Rattus norvegicus
gagtggatttagacccacccttgag

SEQ ID NO: 354909 - DNA, 25 bp, Rattus norvegicus
gagtggatttagtcccacccttgag

SEQ ID NO: 354910 - DNA, 25 bp, Rattus norvegicus
gagtggatttccatgacttatgctg

SEQ ID NO: 354911 - DNA, 25 bp, Rattus norvegicus
gagtggatttccttgacttatgctg

SEQ ID NO: 354912 - DNA, 25 bp, Rattus norvegicus
gagtggcaaagcagcgtcctcacct

SEQ ID NO: 354913 - DNA, 25 bp, Rattus norvegicus
gagtggcaaagctgcgtcctcacct

SEQ ID NO: 354914 - DNA, 25 bp, Rattus norvegicus
gagtggcaacgcattggtgtccgaa

SEQ ID NO: 354915 - DNA, 25 bp, Rattus norvegicus
gagtggcaacgctttggtgtccgaa

SEQ ID NO: 354916 - DNA, 25 bp, Rattus norvegicus
gagtggcaagcgaccaactgtcatc

SEQ ID NO: 354917 - DNA, 25 bp, Rattus norvegicus
gagtggcaagcgtccaactgtcatc

SEQ ID NO: 354918 - DNA, 25 bp, Rattus norvegicus
gagtggcactgcaaaccctaaggca

SEQ ID NO: 354919 - DNA, 25 bp, Rattus norvegicus
gagtggcactgctaaccctaaggca

SEQ ID NO: 354920 - DNA, 25 bp, Rattus norvegicus
gagtggcagcccacccagggaatca

SEQ ID NO: 354921 - DNA, 25 bp, Rattus norvegicus
gagtggcagccctcccagggaatca

SEQ ID NO: 354922 - DNA, 25 bp, Rattus norvegicus
gagtggcagcctcgagttcagcatt

SEQ ID NO: 354923 - DNA, 25 bp, Rattus norvegicus
gagtggcagcctggagttcagcatt

SEQ ID NO: 354924 - DNA, 25 bp, Rattus norvegicus
gagtggcaggccatctttggacgca

SEQ ID NO: 354925 - DNA, 25 bp, Rattus norvegicus
gagtggcaggccttctttggacgca

SEQ ID NO: 354926 - DNA, 25 bp, Rattus norvegicus
gagtggcagtcacgcaagtttgcaa

SEQ ID NO: 354927 - DNA, 25 bp, Rattus norvegicus
gagtggcagtcaggcaagtttgcaa

SEQ ID NO: 354928 - DNA, 25 bp, Rattus norvegicus
gagtggcagtgaagcatcatgcctt

SEQ ID NO: 354929 - DNA, 25 bp, Rattus norvegicus
gagtggcagtgatgcatcatgcctt

SEQ ID NO: 354930 - DNA, 25 bp, Rattus norvegicus
gagtggccaacgaagaaacccaggg

SEQ ID NO: 354931 - DNA, 25 bp, Rattus norvegicus
gagtggccaacgtagaaacccaggg

SEQ ID NO: 354932 - DNA, 25 bp, Rattus norvegicus
gagtggccagttagattttcgatat

SEQ ID NO: 354933 - DNA, 25 bp, Rattus norvegicus
gagtggccagtttgattttcgatat

SEQ ID NO: 354934 - DNA, 25 bp, Rattus norvegicus
gagtggccatagagttctgtcaaac

SEQ ID NO: 354935 - DNA, 25 bp, Rattus norvegicus
gagtggccatagtgttctgtcaaac

SEQ ID NO: 354936 - DNA, 25 bp, Rattus norvegicus
gagtggccatcacacagtattatca

SEQ ID NO: 354937 - DNA, 25 bp, Rattus norvegicus
gagtggccatcagacagtattatca

SEQ ID NO: 354938 - DNA, 25 bp, Rattus norvegicus
gagtggccatccaagctgggattga

SEQ ID NO: 354939 - DNA, 25 bp, Rattus norvegicus
gagtggccatcctagctgggattga

SEQ ID NO: 354940 - DNA, 25 bp, Rattus norvegicus
gagtggccatggaacctccttactg

SEQ ID NO: 354941 - DNA, 25 bp, Rattus norvegicus
gagtggccatggaagcacctgactt

SEQ ID NO: 354942 - DNA, 25 bp, Rattus norvegicus
gagtggccatggtacctccttactg

SEQ ID NO: 354943 - DNA, 25 bp, Rattus norvegicus
gagtggccatggtagcacctgactt

SEQ ID NO: 354944 - DNA, 25 bp, Rattus norvegicus
gagtggccattaccagataatctcg

SEQ ID NO: 354945 - DNA, 25 bp, Rattus norvegicus
gagtggccattagcagataatctcg

SEQ ID NO: 354946 - DNA, 25 bp, Rattus norvegicus
gagtggcccaatcttgctttttgaa

SEQ ID NO: 354947 - DNA, 25 bp, Rattus norvegicus
gagtggcccaatgttgctttttgaa

SEQ ID NO: 354948 - DNA, 25 bp, Rattus norvegicus
gagtggcccagcagatagagctcta

SEQ ID NO: 354949 - DNA, 25 bp, Rattus norvegicus
gagtggcccagctgatagagctcta

SEQ ID NO: 354950 - DNA, 25 bp, Rattus norvegicus
gagtggccccagacttcaaaaagag

SEQ ID NO: 354951 - DNA, 25 bp, Rattus norvegicus
gagtggccccagtcttcaaaaagag

SEQ ID NO: 354952 - DNA, 25 bp, Rattus norvegicus
gagtggccccgtaatcagttggttg

SEQ ID NO: 354953 - DNA, 25 bp, Rattus norvegicus
gagtggccccgttatcagttggttg

SEQ ID NO: 354954 - DNA, 25 bp, Rattus norvegicus
gagtggcccggacacttagctatag

SEQ ID NO: 354955 - DNA, 25 bp, Rattus norvegicus
gagtggcccggagacttagctatag

SEQ ID NO: 354956 - DNA, 25 bp, Rattus norvegicus
gagtggccgaccagatggctccgca

SEQ ID NO: 354957 - DNA, 25 bp, Rattus norvegicus
gagtggccgacctgatggctccgca

SEQ ID NO: 354958 - DNA, 25 bp, Rattus norvegicus
gagtggccggatatctttgtgcgtc

SEQ ID NO: 354959 - DNA, 25 bp, Rattus norvegicus
gagtggccggatttctttgtgcgtc

SEQ ID NO: 354960 - DNA, 25 bp, Rattus norvegicus
gagtggccggcgaggcacactgcgg

SEQ ID NO: 354961 - DNA, 25 bp, Rattus norvegicus
gagtggccggcgtggcacactgcgg

SEQ ID NO: 354962 - DNA, 25 bp, Rattus norvegicus
gagtggccggtgaatgacagatcaa

SEQ ID NO: 354963 - DNA, 25 bp, Rattus norvegicus
gagtggccggtgtatgacagatcaa

SEQ ID NO: 354964 - DNA, 25 bp, Rattus norvegicus
gagtggccgtgcagtgtgttcctaa

SEQ ID NO: 354965 - DNA, 25 bp, Rattus norvegicus
gagtggccgtgctgtgtgttcctaa

SEQ ID NO: 354966 - DNA, 25 bp, Rattus norvegicus
gagtggcctttaccttgctggagaa

SEQ ID NO: 354967 - DNA, 25 bp, Rattus norvegicus
gagtggcctttagcttgctggagaa

SEQ ID NO: 354968 - DNA, 25 bp, Rattus norvegicus
gagtggcgatggagctgaccctttt

SEQ ID NO: 354969 - DNA, 25 bp, Rattus norvegicus
gagtggcgatggtgctgaccctttt

SEQ ID NO: 354970 - DNA, 25 bp, Rattus norvegicus
gagtggcgtataacctgtcattcag

SEQ ID NO: 354971 - DNA, 25 bp, Rattus norvegicus
gagtggcgtatatcctgtcattcag

SEQ ID NO: 354972 - DNA, 25 bp, Rattus norvegicus
gagtggcgtgtcagaaccagttatc

SEQ ID NO: 354973 - DNA, 25 bp, Rattus norvegicus
gagtggcgtgtctgaaccagttatc

SEQ ID NO: 354974 - DNA, 25 bp, Rattus norvegicus
gagtggctagacctctcattttcag

SEQ ID NO: 354975 - DNA, 25 bp, Rattus norvegicus
gagtggctagacgtctcattttcag

SEQ ID NO: 354976 - DNA, 25 bp, Rattus norvegicus
gagtggctatatacagatttactga

SEQ ID NO: 354977 - DNA, 25 bp, Rattus norvegicus
gagtggctatattcagatttactga

SEQ ID NO: 354978 - DNA, 25 bp, Rattus norvegicus
gagtggctatcgaatcctgattatt

SEQ ID NO: 354979 - DNA, 25 bp, Rattus norvegicus
gagtggctatcgtatcctgattatt

SEQ ID NO: 354980 - DNA, 25 bp, Rattus norvegicus
gagtggctatctatggataatatta

SEQ ID NO: 354981 - DNA, 25 bp, Rattus norvegicus
gagtggctatctttggataatatta

SEQ ID NO: 354982 - DNA, 25 bp, Rattus norvegicus
gagtggctcagcacactgctgcaca

SEQ ID NO: 354983 - DNA, 25 bp, Rattus norvegicus
gagtggctcagctcactgctgcaca

SEQ ID NO: 354984 - DNA, 25 bp, Rattus norvegicus
gagtggctcattccttgtacgacat

SEQ ID NO: 354985 - DNA, 25 bp, Rattus norvegicus
gagtggctcattgcttgtacgacat

SEQ ID NO: 354986 - DNA, 25 bp, Rattus norvegicus
gagtggctctgaagttgcaaataaa

SEQ ID NO: 354987 - DNA, 25 bp, Rattus norvegicus
gagtggctctgatgttgcaaataaa

SEQ ID NO: 354988 - DNA, 25 bp, Rattus norvegicus
gagtggctcttcctgataagtctaa

SEQ ID NO: 354989 - DNA, 25 bp, Rattus norvegicus
gagtggctcttcgtgataagtctaa

SEQ ID NO: 354990 - DNA, 25 bp, Rattus norvegicus
gagtggctgaacaggaccagctcct

SEQ ID NO: 354991 - DNA, 25 bp, Rattus norvegicus
gagtggctgaactggaccagctcct

SEQ ID NO: 354992 - DNA, 25 bp, Rattus norvegicus
gagtggctgacaagttatcttccaa

SEQ ID NO: 354993 - DNA, 25 bp, Rattus norvegicus
gagtggctgacatgttatcttccaa

SEQ ID NO: 354994 - DNA, 25 bp, Rattus norvegicus
gagtggctgccaagtgagctctgca

SEQ ID NO: 354995 - DNA, 25 bp, Rattus norvegicus
gagtggctgccatgtgagctctgca

SEQ ID NO: 354996 - DNA, 25 bp, Rattus norvegicus
gagtggctgctcatattagctttta

SEQ ID NO: 354997 - DNA, 25 bp, Rattus norvegicus
gagtggctgctcttattagctttta

SEQ ID NO: 354998 - DNA, 25 bp, Rattus norvegicus
gagtggctgtgaacttacaatcttc

SEQ ID NO: 354999 - DNA, 25 bp, Rattus norvegicus
gagtggctgtgatcttacaatcttc

SEQ ID NO: 355000 - DNA, 25 bp, Rattus norvegicus
gagtggcttataaacaccctcaaaa

SEQ ID NO: 355001 - DNA, 25 bp, Rattus norvegicus
gagtggcttatatacaccctcaaaa

SEQ ID NO: 355002 - DNA, 25 bp, Rattus norvegicus
gagtggcttgaacagtgtgtcccca

SEQ ID NO: 355003 - DNA, 25 bp, Rattus norvegicus
gagtggcttgaagagtgtgtcccca

SEQ ID NO: 355004 - DNA, 25 bp, Rattus norvegicus
gagtggcttggcacacgggcataaa

SEQ ID NO: 355005 - DNA, 25 bp, Rattus norvegicus
gagtggcttggctcacgggcataaa

SEQ ID NO: 355006 - DNA, 25 bp, Rattus norvegicus
gagtggctttctcgcttgctgccaa

SEQ ID NO: 355007 - DNA, 25 bp, Rattus norvegicus
gagtggctttctggcttgctgccaa

SEQ ID NO: 355008 - DNA, 25 bp, Rattus norvegicus
gagtggctttgcatgctcacggact

SEQ ID NO: 355009 - DNA, 25 bp, Rattus norvegicus
gagtggctttgcttgctcacggact

SEQ ID NO: 355010 - DNA, 25 bp, Rattus norvegicus
gagtgggaacccacagatgctgcac

SEQ ID NO: 355011 - DNA, 25 bp, Rattus norvegicus
gagtgggaaccctcagatgctgcac

SEQ ID NO: 355012 - DNA, 25 bp, Rattus norvegicus
gagtgggaacttccagtctgttcct

SEQ ID NO: 355013 - DNA, 25 bp, Rattus norvegicus
gagtgggaacttgcagtctgttcct

SEQ ID NO: 355014 - DNA, 25 bp, Rattus norvegicus
gagtgggacatccaccagcctcggc

SEQ ID NO: 355015 - DNA, 25 bp, Rattus norvegicus
gagtgggacatcgaccagcctcggc

SEQ ID NO: 355016 - DNA, 25 bp, Rattus norvegicus
gagtgggacattcctctctcaggtt

SEQ ID NO: 355017 - DNA, 25 bp, Rattus norvegicus
gagtgggacattgctctctcaggtt

SEQ ID NO: 355018 - DNA, 25 bp, Rattus norvegicus
gagtgggaccagaactgtttcttcc

SEQ ID NO: 355019 - DNA, 25 bp, Rattus norvegicus
gagtgggaccagtactgtttcttcc

SEQ ID NO: 355020 - DNA, 25 bp, Rattus norvegicus
gagtgggaccctactgaaatagata

SEQ ID NO: 355021 - DNA, 25 bp, Rattus norvegicus
gagtgggacccttctgaaatagata

SEQ ID NO: 355022 - DNA, 25 bp, Rattus norvegicus
gagtgggacctccagaggctcttcc

SEQ ID NO: 355023 - DNA, 25 bp, Rattus norvegicus
gagtgggacctcgagaggctcttcc

SEQ ID NO: 355024 - DNA, 25 bp, Rattus norvegicus
gagtgggattccattttctcagaat

SEQ ID NO: 355025 - DNA, 25 bp, Rattus norvegicus
gagtgggattcctttttctcagaat

SEQ ID NO: 355026 - DNA, 25 bp, Rattus norvegicus
gagtgggcaagcaatacccacccag

SEQ ID NO: 355027 - DNA, 25 bp, Rattus norvegicus
gagtgggcaagctatacccacccag

SEQ ID NO: 355028 - DNA, 25 bp, Rattus norvegicus
gagtgggcactgatctctgtgacat

SEQ ID NO: 355029 - DNA, 25 bp, Rattus norvegicus
gagtgggcactgttctctgtgacat

SEQ ID NO: 355030 - DNA, 25 bp, Rattus norvegicus
gagtgggcatccatcatcagagtgg

SEQ ID NO: 355031 - DNA, 25 bp, Rattus norvegicus
gagtgggcatccttcatcagagtgg

SEQ ID NO: 355032 - DNA, 25 bp, Rattus norvegicus
gagtgggcatctagggccatcagca

SEQ ID NO: 355033 - DNA, 25 bp, Rattus norvegicus
gagtgggcatcttgggccatcagca

SEQ ID NO: 355034 - DNA, 25 bp, Rattus norvegicus
gagtgggcatttaagcaactatgaa

SEQ ID NO: 355035 - DNA, 25 bp, Rattus norvegicus
gagtgggcattttagcaactatgaa

SEQ ID NO: 355036 - DNA, 25 bp, Rattus norvegicus
gagtgggccaaactcatgtgttcat

SEQ ID NO: 355037 - DNA, 25 bp, Rattus norvegicus
gagtgggccaaagtcatgtgttcat

SEQ ID NO: 355038 - DNA, 25 bp, Rattus norvegicus
gagtgggcctcgagtagctcacaga

SEQ ID NO: 355039 - DNA, 25 bp, Rattus norvegicus
gagtgggcctcgtgtagctcacaga

SEQ ID NO: 355040 - DNA, 25 bp, Rattus norvegicus
gagtgggctcacagtctagcagaaa

SEQ ID NO: 355041 - DNA, 25 bp, Rattus norvegicus
gagtgggctcactgtctagcagaaa

SEQ ID NO: 355042 - DNA, 25 bp, Rattus norvegicus
gagtgggtagttctgacccatccac

SEQ ID NO: 355043 - DNA, 25 bp, Rattus norvegicus
gagtgggtagttgtgacccatccac

SEQ ID NO: 355044 - DNA, 25 bp, Rattus norvegicus
gagtgggtcataatgcattctacaa

SEQ ID NO: 355045 - DNA, 25 bp, Rattus norvegicus
gagtgggtcatattgcattctacaa

SEQ ID NO: 355046 - DNA, 25 bp, Rattus norvegicus
gagtgggtctgcagaagcctgcata

SEQ ID NO: 355047 - DNA, 25 bp, Rattus norvegicus
gagtgggtctgctgaagcctgcata

SEQ ID NO: 355048 - DNA, 25 bp, Rattus norvegicus
gagtgggtgaccacatattgtcctc

SEQ ID NO: 355049 - DNA, 25 bp, Rattus norvegicus
gagtgggtgacctcatattgtcctc

SEQ ID NO: 355050 - DNA, 25 bp, Rattus norvegicus
gagtgggtgcttcaccagctagtat

SEQ ID NO: 355051 - DNA, 25 bp, Rattus norvegicus
gagtgggtgcttgaccagctagtat

SEQ ID NO: 355052 - DNA, 25 bp, Rattus norvegicus
gagtgggtgtctctgattcatactg

SEQ ID NO: 355053 - DNA, 25 bp, Rattus norvegicus
gagtgggtgtctgtgattcatactg

SEQ ID NO: 355054 - DNA, 25 bp, Rattus norvegicus
gagtgggttcttaggtcatatgtga

SEQ ID NO: 355055 - DNA, 25 bp, Rattus norvegicus
gagtgggttctttggtcatatgtga

SEQ ID NO: 355056 - DNA, 25 bp, Rattus norvegicus
gagtgggttttcacaatttccttgg

SEQ ID NO: 355057 - DNA, 25 bp, Rattus norvegicus
gagtgggttttctcaatttccttgg

SEQ ID NO: 355058 - DNA, 25 bp, Rattus norvegicus
gagtggtaactcacttttacttcta

SEQ ID NO: 355059 - DNA, 25 bp, Rattus norvegicus
gagtggtaactctcttttacttcta

SEQ ID NO: 355060 - DNA, 25 bp, Rattus norvegicus
gagtggtaagccataacacccctgg

SEQ ID NO: 355061 - DNA, 25 bp, Rattus norvegicus
gagtggtaagccttaacacccctgg

SEQ ID NO: 355062 - DNA, 25 bp, Rattus norvegicus
gagtggtacagaacgctgtagtgcc

SEQ ID NO: 355063 - DNA, 25 bp, Rattus norvegicus
gagtggtacagatcgctgtagtgcc

SEQ ID NO: 355064 - DNA, 25 bp, Rattus norvegicus
gagtggtacagtatcaaactccaaa

SEQ ID NO: 355065 - DNA, 25 bp, Rattus norvegicus
gagtggtacagtttcaaactccaaa

SEQ ID NO: 355066 - DNA, 25 bp, Rattus norvegicus
gagtggtacccaacagtttgtttca

SEQ ID NO: 355067 - DNA, 25 bp, Rattus norvegicus
gagtggtacccatcagtttgtttca

SEQ ID NO: 355068 - DNA, 25 bp, Rattus norvegicus
gagtggtactctattctaacttact

SEQ ID NO: 355069 - DNA, 25 bp, Rattus norvegicus
gagtggtactcttttctaacttact

SEQ ID NO: 355070 - DNA, 25 bp, Rattus norvegicus
gagtggtagtttcctctttctcaca

SEQ ID NO: 355071 - DNA, 25 bp, Rattus norvegicus
gagtggtagtttgctctttctcaca

SEQ ID NO: 355072 - DNA, 25 bp, Rattus norvegicus
gagtggtcaactccaaaattggtct

SEQ ID NO: 355073 - DNA, 25 bp, Rattus norvegicus
gagtggtcaactgcaaaattggtct

SEQ ID NO: 355074 - DNA, 25 bp, Rattus norvegicus
gagtggtcaggcactgtggcatcct

SEQ ID NO: 355075 - DNA, 25 bp, Rattus norvegicus
gagtggtcaggctctgtggcatcct

SEQ ID NO: 355076 - DNA, 25 bp, Rattus norvegicus
gagtggtcatcgaattcacctcacc

SEQ ID NO: 355077 - DNA, 25 bp, Rattus norvegicus
gagtggtcatcgtattcacctcacc

SEQ ID NO: 355078 - DNA, 25 bp, Rattus norvegicus
gagtggtccaagacggctttgtttc

SEQ ID NO: 355079 - DNA, 25 bp, Rattus norvegicus
gagtggtccaagtcggctttgtttc

SEQ ID NO: 355080 - DNA, 25 bp, Rattus norvegicus
gagtggtccaatatgaacctctttt

SEQ ID NO: 355081 - DNA, 25 bp, Rattus norvegicus
gagtggtccaatttgaacctctttt

SEQ ID NO: 355082 - DNA, 25 bp, Rattus norvegicus
gagtggtcctttcctgatccatcat

SEQ ID NO: 355083 - DNA, 25 bp, Rattus norvegicus
gagtggtcctttgctgatccatcat

SEQ ID NO: 355084 - DNA, 25 bp, Rattus norvegicus
gagtggtcgtctcttttctgggaca

SEQ ID NO: 355085 - DNA, 25 bp, Rattus norvegicus
gagtggtcgtctgttttctgggaca

SEQ ID NO: 355086 - DNA, 25 bp, Rattus norvegicus
gagtggtctccccatagagcaaaga

SEQ ID NO: 355087 - DNA, 25 bp, Rattus norvegicus
gagtggtctcccgatagagcaaaga

SEQ ID NO: 355088 - DNA, 25 bp, Rattus norvegicus
gagtggtctctcagctgggaatcct

SEQ ID NO: 355089 - DNA, 25 bp, Rattus norvegicus
gagtggtctctctgctgggaatcct

SEQ ID NO: 355090 - DNA, 25 bp, Rattus norvegicus
gagtggtctgacctatccttgccaa

SEQ ID NO: 355091 - DNA, 25 bp, Rattus norvegicus
gagtggtctgacgtatccttgccaa

SEQ ID NO: 355092 - DNA, 25 bp, Rattus norvegicus
gagtggtcttaaagttcccctgagg

SEQ ID NO: 355093 - DNA, 25 bp, Rattus norvegicus
gagtggtcttaatgttcccctgagg

SEQ ID NO: 355094 - DNA, 25 bp, Rattus norvegicus
gagtggtcttagaaggcccgccaag

SEQ ID NO: 355095 - DNA, 25 bp, Rattus norvegicus
gagtggtcttagtaggcccgccaag

SEQ ID NO: 355096 - DNA, 25 bp, Rattus norvegicus
gagtggtcttcaccaaaccagtgcg

SEQ ID NO: 355097 - DNA, 25 bp, Rattus norvegicus
gagtggtcttcagcaaaccagtgcg

SEQ ID NO: 355098 - DNA, 25 bp, Rattus norvegicus
gagtggtgcagcagccagaactaca

SEQ ID NO: 355099 - DNA, 25 bp, Rattus norvegicus
gagtggtgcagctgccagaactaca

SEQ ID NO: 355100 - DNA, 25 bp, Rattus norvegicus
gagtggtgctgcacatacggacaga

SEQ ID NO: 355101 - DNA, 25 bp, Rattus norvegicus
gagtggtgctgctcatacggacaga

SEQ ID NO: 355102 - DNA, 25 bp, Rattus norvegicus
gagtggtgggccctgttcccatctc

SEQ ID NO: 355103 - DNA, 25 bp, Rattus norvegicus
gagtggtgggccgtgttcccatctc

SEQ ID NO: 355104 - DNA, 25 bp, Rattus norvegicus
gagtggtgtcacatgcttttaatac

SEQ ID NO: 355105 - DNA, 25 bp, Rattus norvegicus
gagtggtgtcacttgcttttaatac

SEQ ID NO: 355106 - DNA, 25 bp, Rattus norvegicus
gagtggttaccacactggttactat

SEQ ID NO: 355107 - DNA, 25 bp, Rattus norvegicus
gagtggttaccagactggttactat

SEQ ID NO: 355108 - DNA, 25 bp, Rattus norvegicus
gagtggttatgcattctaacccaaa

SEQ ID NO: 355109 - DNA, 25 bp, Rattus norvegicus
gagtggttatgctttctaacccaaa

SEQ ID NO: 355110 - DNA, 25 bp, Rattus norvegicus
gagtggttcatcagttttactagca

SEQ ID NO: 355111 - DNA, 25 bp, Rattus norvegicus
gagtggttcatctgttttactagca

SEQ ID NO: 355112 - DNA, 25 bp, Rattus norvegicus
gagtggttctgtagagcaatataac

SEQ ID NO: 355113 - DNA, 25 bp, Rattus norvegicus
gagtggttctgttgagcaatataac

SEQ ID NO: 355114 - DNA, 25 bp, Rattus norvegicus
gagtggttgaccacctggtcattaa

SEQ ID NO: 355115 - DNA, 25 bp, Rattus norvegicus
gagtggttgacctcctggtcattaa

SEQ ID NO: 355116 - DNA, 25 bp, Rattus norvegicus
gagtggtttctacatccatgtgcaa

SEQ ID NO: 355117 - DNA, 25 bp, Rattus norvegicus
gagtggtttctagatccatgtgcaa

SEQ ID NO: 355118 - DNA, 25 bp, Rattus norvegicus
gagtggtttcttaccactaggagtc

SEQ ID NO: 355119 - DNA, 25 bp, Rattus norvegicus
gagtggtttctttccactaggagtc

SEQ ID NO: 355120 - DNA, 25 bp, Rattus norvegicus
gagtggtttttactggtctgttcac

SEQ ID NO: 355121 - DNA, 25 bp, Rattus norvegicus
gagtggtttttagtggtctgttcac

SEQ ID NO: 355122 - DNA, 25 bp, Rattus norvegicus
gagtgtaaacaaccgctccagagca

SEQ ID NO: 355123 - DNA, 25 bp, Rattus norvegicus
gagtgtaaacaagcgctccagagca

SEQ ID NO: 355124 - DNA, 25 bp, Rattus norvegicus
gagtgtaaacttaggctggacccaa

SEQ ID NO: 355125 - DNA, 25 bp, Rattus norvegicus
gagtgtaaactttggctggacccaa

SEQ ID NO: 355126 - DNA, 25 bp, Rattus norvegicus
gagtgtaaaggcctggccctttcca

SEQ ID NO: 355127 - DNA, 25 bp, Rattus norvegicus
gagtgtaaaggcgtggccctttcca

SEQ ID NO: 355128 - DNA, 25 bp, Rattus norvegicus
gagtgtaaatttatatctcagttgc

SEQ ID NO: 355129 - DNA, 25 bp, Rattus norvegicus
gagtgtaaatttttatctcagttgc

SEQ ID NO: 355130 - DNA, 25 bp, Rattus norvegicus
gagtgtaacctcaatacctttctgt

SEQ ID NO: 355131 - DNA, 25 bp, Rattus norvegicus
gagtgtaacctctatacctttctgt

SEQ ID NO: 355132 - DNA, 25 bp, Rattus norvegicus
gagtgtaaggagctcccctatcaga

SEQ ID NO: 355133 - DNA, 25 bp, Rattus norvegicus
gagtgtaaggaggtcccctatcaga

SEQ ID NO: 355134 - DNA, 25 bp, Rattus norvegicus
gagtgtaagttgacgcagatctgct

SEQ ID NO: 355135 - DNA, 25 bp, Rattus norvegicus
gagtgtaagttgtcgcagatctgct

SEQ ID NO: 355136 - DNA, 25 bp, Rattus norvegicus
gagtgtaatgtaatcccagcaatca

SEQ ID NO: 355137 - DNA, 25 bp, Rattus norvegicus
gagtgtaatgtattcccagcaatca

SEQ ID NO: 355138 - DNA, 25 bp, Rattus norvegicus
gagtgtacaagaaactatgcccaac

SEQ ID NO: 355139 - DNA, 25 bp, Rattus norvegicus
gagtgtacaagatactatgcccaac

SEQ ID NO: 355140 - DNA, 25 bp, Rattus norvegicus
gagtgtacacaacagaccatgtcct

SEQ ID NO: 355141 - DNA, 25 bp, Rattus norvegicus
gagtgtacacaagagaccatgtcct

SEQ ID NO: 355142 - DNA, 25 bp, Rattus norvegicus
gagtgtacactgacatgggcaggat

SEQ ID NO: 355143 - DNA, 25 bp, Rattus norvegicus
gagtgtacactgtcatgggcaggat

SEQ ID NO: 355144 - DNA, 25 bp, Rattus norvegicus
gagtgtacagacagcagcagcccat

SEQ ID NO: 355145 - DNA, 25 bp, Rattus norvegicus
gagtgtacagactgcagcagcccat

SEQ ID NO: 355146 - DNA, 25 bp, Rattus norvegicus
gagtgtacatgcatttcattacgga

SEQ ID NO: 355147 - DNA, 25 bp, Rattus norvegicus
gagtgtacatgcttttcattacgga

SEQ ID NO: 355148 - DNA, 25 bp, Rattus norvegicus
gagtgtacatggacttctctcatca

SEQ ID NO: 355149 - DNA, 25 bp, Rattus norvegicus
gagtgtacatggtcttctctcatca

SEQ ID NO: 355150 - DNA, 25 bp, Rattus norvegicus
gagtgtaccaggagactgcgcaaca

SEQ ID NO: 355151 - DNA, 25 bp, Rattus norvegicus
gagtgtaccaggtgactgcgcaaca

SEQ ID NO: 355152 - DNA, 25 bp, Rattus norvegicus
gagtgtaccgttagacagagatgca

SEQ ID NO: 355153 - DNA, 25 bp, Rattus norvegicus
gagtgtaccgtttgacagagatgca

SEQ ID NO: 355154 - DNA, 25 bp, Rattus norvegicus
gagtgtacctctcatttgtatctgt

SEQ ID NO: 355155 - DNA, 25 bp, Rattus norvegicus
gagtgtacctctctttggatgtagc

SEQ ID NO: 355156 - DNA, 25 bp, Rattus norvegicus
gagtgtacctctgatttgtatctgt

SEQ ID NO: 355157 - DNA, 25 bp, Rattus norvegicus
gagtgtacctctgtttggatgtagc

SEQ ID NO: 355158 - DNA, 25 bp, Rattus norvegicus
gagtgtacctgtccggattgcatca

SEQ ID NO: 355159 - DNA, 25 bp, Rattus norvegicus
gagtgtacctgtgcggattgcatca

SEQ ID NO: 355160 - DNA, 25 bp, Rattus norvegicus
gagtgtaccttcagtcaaacctgga

SEQ ID NO: 355161 - DNA, 25 bp, Rattus norvegicus
gagtgtaccttctgtcaaacctgga

SEQ ID NO: 355162 - DNA, 25 bp, Rattus norvegicus
gagtgtactccaccaggctagagca

SEQ ID NO: 355163 - DNA, 25 bp, Rattus norvegicus
gagtgtactccagcaggctagagca

SEQ ID NO: 355164 - DNA, 25 bp, Rattus norvegicus
gagtgtactccgctggcaatgaagt

SEQ ID NO: 355165 - DNA, 25 bp, Rattus norvegicus
gagtgtactccggtggcaatgaagt

SEQ ID NO: 355166 - DNA, 25 bp, Rattus norvegicus
gagtgtactctgaggactattctaa

SEQ ID NO: 355167 - DNA, 25 bp, Rattus norvegicus
gagtgtactctgtggactattctaa

SEQ ID NO: 355168 - DNA, 25 bp, Rattus norvegicus
gagtgtacttaccactgagcccaaa

SEQ ID NO: 355169 - DNA, 25 bp, Rattus norvegicus
gagtgtacttacgactgagcccaaa

SEQ ID NO: 355170 - DNA, 25 bp, Rattus norvegicus
gagtgtagacccattgagcctggct

SEQ ID NO: 355171 - DNA, 25 bp, Rattus norvegicus
gagtgtagaccctttgagcctggct

SEQ ID NO: 355172 - DNA, 25 bp, Rattus norvegicus
gagtgtagactccaaagacatccaa

SEQ ID NO: 355173 - DNA, 25 bp, Rattus norvegicus
gagtgtagactcgaaagacatccaa

SEQ ID NO: 355174 - DNA, 25 bp, Rattus norvegicus
gagtgtagatccatatgtcttccag

SEQ ID NO: 355175 - DNA, 25 bp, Rattus norvegicus
gagtgtagatccttatgtcttccag

SEQ ID NO: 355176 - DNA, 25 bp, Rattus norvegicus
gagtgtagccatcctatctccatgg

SEQ ID NO: 355177 - DNA, 25 bp, Rattus norvegicus
gagtgtagccatgctatctccatgg

SEQ ID NO: 355178 - DNA, 25 bp, Rattus norvegicus
gagtgtagccctatgtatcaatact

SEQ ID NO: 355179 - DNA, 25 bp, Rattus norvegicus
gagtgtagccctttgtatcaatact

SEQ ID NO: 355180 - DNA, 25 bp, Rattus norvegicus
gagtgtagcctcatattattcagat

SEQ ID NO: 355181 - DNA, 25 bp, Rattus norvegicus
gagtgtagcctcttattattcagat

SEQ ID NO: 355182 - DNA, 25 bp, Rattus norvegicus
gagtgtagcctgaccactgtgatgc

SEQ ID NO: 355183 - DNA, 25 bp, Rattus norvegicus
gagtgtagcctgtccactgtgatgc

SEQ ID NO: 355184 - DNA, 25 bp, Rattus norvegicus
gagtgtagcttgacaggtgtataac

SEQ ID NO: 355185 - DNA, 25 bp, Rattus norvegicus
gagtgtagcttgtcaggtgtataac

SEQ ID NO: 355186 - DNA, 25 bp, Rattus norvegicus
gagtgtaggccacaggcttcattta

SEQ ID NO: 355187 - DNA, 25 bp, Rattus norvegicus
gagtgtaggccagaggcttcattta

SEQ ID NO: 355188 - DNA, 25 bp, Rattus norvegicus
gagtgtataaggctagtctttccta

SEQ ID NO: 355189 - DNA, 25 bp, Rattus norvegicus
gagtgtataagggtagtctttccta

SEQ ID NO: 355190 - DNA, 25 bp, Rattus norvegicus
gagtgtatcaacatccatgtctagt

SEQ ID NO: 355191 - DNA, 25 bp, Rattus norvegicus
gagtgtatcaacttccatgtctagt

SEQ ID NO: 355192 - DNA, 25 bp, Rattus norvegicus
gagtgtatcaagaaatcaactggca

SEQ ID NO: 355193 - DNA, 25 bp, Rattus norvegicus
gagtgtatcaagtaatcaactggca

SEQ ID NO: 355194 - DNA, 25 bp, Rattus norvegicus
gagtgtatcttaattcttaacccat

SEQ ID NO: 355195 - DNA, 25 bp, Rattus norvegicus
gagtgtatcttatttcttaacccat

SEQ ID NO: 355196 - DNA, 25 bp, Rattus norvegicus
gagtgtatcttgaagtggcagagct

SEQ ID NO: 355197 - DNA, 25 bp, Rattus norvegicus
gagtgtatcttgtagtggcagagct

SEQ ID NO: 355198 - DNA, 25 bp, Rattus norvegicus
gagtgtatgaatccttgtgcccaca

SEQ ID NO: 355199 - DNA, 25 bp, Rattus norvegicus
gagtgtatgaatgcttgtgcccaca

SEQ ID NO: 355200 - DNA, 25 bp, Rattus norvegicus
gagtgtatgcaactggtccaagatc

SEQ ID NO: 355201 - DNA, 25 bp, Rattus norvegicus
gagtgtatgcaagtggtccaagatc

SEQ ID NO: 355202 - DNA, 25 bp, Rattus norvegicus
gagtgtatgtgcacccaaatctact

SEQ ID NO: 355203 - DNA, 25 bp, Rattus norvegicus
gagtgtatgtgcatccgggtatcat

SEQ ID NO: 355204 - DNA, 25 bp, Rattus norvegicus
gagtgtatgtgctcccaaatctact

SEQ ID NO: 355205 - DNA, 25 bp, Rattus norvegicus
gagtgtatgtgcttccgggtatcat

SEQ ID NO: 355206 - DNA, 25 bp, Rattus norvegicus
gagtgtatgtttacatggcgacaag

SEQ ID NO: 355207 - DNA, 25 bp, Rattus norvegicus
gagtgtatgttttcatggcgacaag

SEQ ID NO: 355208 - DNA, 25 bp, Rattus norvegicus
gagtgtattcacacacctacagaaa

SEQ ID NO: 355209 - DNA, 25 bp, Rattus norvegicus
gagtgtattcactcacctacagaaa

SEQ ID NO: 355210 - DNA, 25 bp, Rattus norvegicus
gagtgtattgtgatgatttacctgt

SEQ ID NO: 355211 - DNA, 25 bp, Rattus norvegicus
gagtgtattgtgttgatttacctgt

SEQ ID NO: 355212 - DNA, 25 bp, Rattus norvegicus
gagtgtatttcacctcgttttgttt

SEQ ID NO: 355213 - DNA, 25 bp, Rattus norvegicus
gagtgtatttcagctcgttttgttt

SEQ ID NO: 355214 - DNA, 25 bp, Rattus norvegicus
gagtgtcaagctctgtgacccagga

SEQ ID NO: 355215 - DNA, 25 bp, Rattus norvegicus
gagtgtcaagctgtgtgacccagga

SEQ ID NO: 355216 - DNA, 25 bp, Rattus norvegicus
gagtgtcaagtgatattgatcgact

SEQ ID NO: 355217 - DNA, 25 bp, Rattus norvegicus
gagtgtcaagtgttattgatcgact

SEQ ID NO: 355218 - DNA, 25 bp, Rattus norvegicus
gagtgtcaccaaccataaagcattc

SEQ ID NO: 355219 - DNA, 25 bp, Rattus norvegicus
gagtgtcaccaagcataaagcattc

SEQ ID NO: 355220 - DNA, 25 bp, Rattus norvegicus
gagtgtcacctcaaatgcaatacgt

SEQ ID NO: 355221 - DNA, 25 bp, Rattus norvegicus
gagtgtcacctctaatgcaatacgt

SEQ ID NO: 355222 - DNA, 25 bp, Rattus norvegicus
gagtgtcacctgaaggagttttaac

SEQ ID NO: 355223 - DNA, 25 bp, Rattus norvegicus
gagtgtcacctgtaggagttttaac

SEQ ID NO: 355224 - DNA, 25 bp, Rattus norvegicus
gagtgtcactgtcatcttcagctct

SEQ ID NO: 355225 - DNA, 25 bp, Rattus norvegicus
gagtgtcactgtgatcttcagctct

SEQ ID NO: 355226 - DNA, 25 bp, Rattus norvegicus
gagtgtcagagtcaaccctcagtta

SEQ ID NO: 355227 - DNA, 25 bp, Rattus norvegicus
gagtgtcagagtctgtgttacttct

SEQ ID NO: 355228 - DNA, 25 bp, Rattus norvegicus
gagtgtcagagtgaaccctcagtta

SEQ ID NO: 355229 - DNA, 25 bp, Rattus norvegicus
gagtgtcagagtgtgtgttacttct

SEQ ID NO: 355230 - DNA, 25 bp, Rattus norvegicus
gagtgtcagcacacgtcactaggct

SEQ ID NO: 355231 - DNA, 25 bp, Rattus norvegicus
gagtgtcagcactcgtcactaggct

SEQ ID NO: 355232 - DNA, 25 bp, Rattus norvegicus
gagtgtcaggagactgttctcccgg

SEQ ID NO: 355233 - DNA, 25 bp, Rattus norvegicus
gagtgtcaggagtctgttctcccgg

SEQ ID NO: 355234 - DNA, 25 bp, Rattus norvegicus
gagtgtcagtccactgcactgcact

SEQ ID NO: 355235 - DNA, 25 bp, Rattus norvegicus
gagtgtcagtcctctgcactgcact

SEQ ID NO: 355236 - DNA, 25 bp, Rattus norvegicus
gagtgtcagttaactctttttgagc

SEQ ID NO: 355237 - DNA, 25 bp, Rattus norvegicus
gagtgtcagttatctctttttgagc

SEQ ID NO: 355238 - DNA, 25 bp, Rattus norvegicus
gagtgtcagtttagtcacagatctc

SEQ ID NO: 355239 - DNA, 25 bp, Rattus norvegicus
gagtgtcagttttgtcacagatctc

SEQ ID NO: 355240 - DNA, 25 bp, Rattus norvegicus
gagtgtcattccaccaggacagttg

SEQ ID NO: 355241 - DNA, 25 bp, Rattus norvegicus
gagtgtcattcctccaggacagttg

SEQ ID NO: 355242 - DNA, 25 bp, Rattus norvegicus
gagtgtcattttcaggctgacttca

SEQ ID NO: 355243 - DNA, 25 bp, Rattus norvegicus
gagtgtcattttgaggctgacttca

SEQ ID NO: 355244 - DNA, 25 bp, Rattus norvegicus
gagtgtccaaaaaagtcccacccag

SEQ ID NO: 355245 - DNA, 25 bp, Rattus norvegicus
gagtgtccaaaatagtcccacccag

SEQ ID NO: 355246 - DNA, 25 bp, Rattus norvegicus
gagtgtccacatcttacagttagaa

SEQ ID NO: 355247 - DNA, 25 bp, Rattus norvegicus
gagtgtccacatgttacagttagaa

SEQ ID NO: 355248 - DNA, 25 bp, Rattus norvegicus
gagtgtccactgactctcttatgat

SEQ ID NO: 355249 - DNA, 25 bp, Rattus norvegicus
gagtgtccactgtctctcttatgat

SEQ ID NO: 355250 - DNA, 25 bp, Rattus norvegicus
gagtgtcccaacaacttcagataga

SEQ ID NO: 355251 - DNA, 25 bp, Rattus norvegicus
gagtgtcccaactacttcagataga

SEQ ID NO: 355252 - DNA, 25 bp, Rattus norvegicus
gagtgtcccagactactgaatttta

SEQ ID NO: 355253 - DNA, 25 bp, Rattus norvegicus
gagtgtcccagagtactgaatttta

SEQ ID NO: 355254 - DNA, 25 bp, Rattus norvegicus
gagtgtcccaggacaaggcacccta

SEQ ID NO: 355255 - DNA, 25 bp, Rattus norvegicus
gagtgtcccaggtcaaggcacccta

SEQ ID NO: 355256 - DNA, 25 bp, Rattus norvegicus
gagtgtcccatcagtctcaatgtca

SEQ ID NO: 355257 - DNA, 25 bp, Rattus norvegicus
gagtgtcccatctgtctcaatgtca

SEQ ID NO: 355258 - DNA, 25 bp, Rattus norvegicus
gagtgtcccctacagggccaataaa

SEQ ID NO: 355259 - DNA, 25 bp, Rattus norvegicus
gagtgtcccctagagggccaataaa

SEQ ID NO: 355260 - DNA, 25 bp, Rattus norvegicus
gagtgtccgagtaggtgcaccagtc

SEQ ID NO: 355261 - DNA, 25 bp, Rattus norvegicus
gagtgtccgagttggtgcaccagtc

SEQ ID NO: 355262 - DNA, 25 bp, Rattus norvegicus
gagtgtccgccccaaatgtacgcgc

SEQ ID NO: 355263 - DNA, 25 bp, Rattus norvegicus
gagtgtccgcccgaaatgtacgcgc

SEQ ID NO: 355264 - DNA, 25 bp, Rattus norvegicus
gagtgtccggtcatcgagcccagct

SEQ ID NO: 355265 - DNA, 25 bp, Rattus norvegicus
gagtgtccggtcttcgagcccagct

SEQ ID NO: 355266 - DNA, 25 bp, Rattus norvegicus
gagtgtcctagacatcctgggcttc

SEQ ID NO: 355267 - DNA, 25 bp, Rattus norvegicus
gagtgtcctagagatcctgggcttc

SEQ ID NO: 355268 - DNA, 25 bp, Rattus norvegicus
gagtgtcctattagtagcctccaac

SEQ ID NO: 355269 - DNA, 25 bp, Rattus norvegicus
gagtgtcctatttgtagcctccaac

SEQ ID NO: 355270 - DNA, 25 bp, Rattus norvegicus
gagtgtcctcaacgctatcgagcag

SEQ ID NO: 355271 - DNA, 25 bp, Rattus norvegicus
gagtgtcctcaaggctatcgagcag

SEQ ID NO: 355272 - DNA, 25 bp, Rattus norvegicus
gagtgtcctgacagcaccgtgttag

SEQ ID NO: 355273 - DNA, 25 bp, Rattus norvegicus
gagtgtcctgactgcaccgtgttag

SEQ ID NO: 355274 - DNA, 25 bp, Rattus norvegicus
gagtgtcctgagattgtctgctgcc

SEQ ID NO: 355275 - DNA, 25 bp, Rattus norvegicus
gagtgtcctgagtttgtctgctgcc

SEQ ID NO: 355276 - DNA, 25 bp, Rattus norvegicus
gagtgtcctgggatttctgattcca

SEQ ID NO: 355277 - DNA, 25 bp, Rattus norvegicus
gagtgtcctgggttttctgattcca

SEQ ID NO: 355278 - DNA, 25 bp, Rattus norvegicus
gagtgtcctggtccgtaagcctcta

SEQ ID NO: 355279 - DNA, 25 bp, Rattus norvegicus
gagtgtcctggtgcgtaagcctcta

SEQ ID NO: 355280 - DNA, 25 bp, Rattus norvegicus
gagtgtcctgtaaccttcacaataa

SEQ ID NO: 355281 - DNA, 25 bp, Rattus norvegicus
gagtgtcctgtatccttcacaataa

SEQ ID NO: 355282 - DNA, 25 bp, Rattus norvegicus
gagtgtccttcaaaaaccctttgtg

SEQ ID NO: 355283 - DNA, 25 bp, Rattus norvegicus
gagtgtccttcataaaccctttgtg

SEQ ID NO: 355284 - DNA, 25 bp, Rattus norvegicus
gagtgtccttgcaaactaagtccta

SEQ ID NO: 355285 - DNA, 25 bp, Rattus norvegicus
gagtgtccttgctaactaagtccta

SEQ ID NO: 355286 - DNA, 25 bp, Rattus norvegicus
gagtgtcgccccatgtgacggttat

SEQ ID NO: 355287 - DNA, 25 bp, Rattus norvegicus
gagtgtcgccccttgtgacggttat

SEQ ID NO: 355288 - DNA, 25 bp, Rattus norvegicus
gagtgtctaatgaaggtgctgtcct

SEQ ID NO: 355289 - DNA, 25 bp, Rattus norvegicus
gagtgtctaatgtaggtgctgtcct

SEQ ID NO: 355290 - DNA, 25 bp, Rattus norvegicus
gagtgtctactgagaagctcttaca

SEQ ID NO: 355291 - DNA, 25 bp, Rattus norvegicus
gagtgtctactgtgaagctcttaca

SEQ ID NO: 355292 - DNA, 25 bp, Rattus norvegicus
gagtgtctagtgacatcggactgcc

SEQ ID NO: 355293 - DNA, 25 bp, Rattus norvegicus
gagtgtctagtgtcatcggactgcc

SEQ ID NO: 355294 - DNA, 25 bp, Rattus norvegicus
gagtgtctatgtacatttcttgaca

SEQ ID NO: 355295 - DNA, 25 bp, Rattus norvegicus
gagtgtctatgttcatttcttgaca

SEQ ID NO: 355296 - DNA, 25 bp, Rattus norvegicus
gagtgtctcaaaatctaaaggtcca

SEQ ID NO: 355297 - DNA, 25 bp, Rattus norvegicus
gagtgtctcaaattctaaaggtcca

SEQ ID NO: 355298 - DNA, 25 bp, Rattus norvegicus
gagtgtctcagacccagaccatcaa

SEQ ID NO: 355299 - DNA, 25 bp, Rattus norvegicus
gagtgtctcagagccagaccatcaa

SEQ ID NO: 355300 - DNA, 25 bp, Rattus norvegicus
gagtgtctccctctgatgttagtga

SEQ ID NO: 355301 - DNA, 25 bp, Rattus norvegicus
gagtgtctccctgtgatgttagtga

SEQ ID NO: 355302 - DNA, 25 bp, Rattus norvegicus
gagtgtctcctcagcagtgctcaga

SEQ ID NO: 355303 - DNA, 25 bp, Rattus norvegicus
gagtgtctcctctgcagtgctcaga

SEQ ID NO: 355304 - DNA, 25 bp, Rattus norvegicus
gagtgtctctgactacagcctatgt

SEQ ID NO: 355305 - DNA, 25 bp, Rattus norvegicus
gagtgtctctgagtacagcctatgt

SEQ ID NO: 355306 - DNA, 25 bp, Rattus norvegicus
gagtgtctgacgatattgatgtttc

SEQ ID NO: 355307 - DNA, 25 bp, Rattus norvegicus
gagtgtctgacgttattgatgtttc

SEQ ID NO: 355308 - DNA, 25 bp, Rattus norvegicus
gagtgtctgcaaccaatccctttta

SEQ ID NO: 355309 - DNA, 25 bp, Rattus norvegicus
gagtgtctgcaagcaatccctttta

SEQ ID NO: 355310 - DNA, 25 bp, Rattus norvegicus
gagtgtctgccccaatgcacagatt

SEQ ID NO: 355311 - DNA, 25 bp, Rattus norvegicus
gagtgtctgcccgaatgcacagatt

SEQ ID NO: 355312 - DNA, 25 bp, Rattus norvegicus
gagtgtctgccgcacaccagagatg

SEQ ID NO: 355313 - DNA, 25 bp, Rattus norvegicus
gagtgtctgccggacaccagagatg

SEQ ID NO: 355314 - DNA, 25 bp, Rattus norvegicus
gagtgtctgcctacaatgactggat

SEQ ID NO: 355315 - DNA, 25 bp, Rattus norvegicus
gagtgtctgccttcaatgactggat

SEQ ID NO: 355316 - DNA, 25 bp, Rattus norvegicus
gagtgtctgctaccttgattctggc

SEQ ID NO: 355317 - DNA, 25 bp, Rattus norvegicus
gagtgtctgctagcttgattctggc

SEQ ID NO: 355318 - DNA, 25 bp, Rattus norvegicus
gagtgtctggaaaaaacccaccttg

SEQ ID NO: 355319 - DNA, 25 bp, Rattus norvegicus
gagtgtctggaataaacccaccttg

SEQ ID NO: 355320 - DNA, 25 bp, Rattus norvegicus
gagtgtctgggaagttagatagtat

SEQ ID NO: 355321 - DNA, 25 bp, Rattus norvegicus
gagtgtctgggatgttagatagtat

SEQ ID NO: 355322 - DNA, 25 bp, Rattus norvegicus
gagtgtctgtacagtgtgtagcttt

SEQ ID NO: 355323 - DNA, 25 bp, Rattus norvegicus
gagtgtctgtactgtgtgtagcttt

SEQ ID NO: 355324 - DNA, 25 bp, Rattus norvegicus
gagtgtcttagaaaccttacctaga

SEQ ID NO: 355325 - DNA, 25 bp, Rattus norvegicus
gagtgtcttagataccttacctaga

SEQ ID NO: 355326 - DNA, 25 bp, Rattus norvegicus
gagtgtcttgccaggaatgctctgt

SEQ ID NO: 355327 - DNA, 25 bp, Rattus norvegicus
gagtgtcttgccagtttcagtgtgc

SEQ ID NO: 355328 - DNA, 25 bp, Rattus norvegicus
gagtgtcttgcctggaatgctctgt

SEQ ID NO: 355329 - DNA, 25 bp, Rattus norvegicus
gagtgtcttgcctgtttcagtgtgc

SEQ ID NO: 355330 - DNA, 25 bp, Rattus norvegicus
gagtgtcttgtaactgttgcctata

SEQ ID NO: 355331 - DNA, 25 bp, Rattus norvegicus
gagtgtcttgtatctgttgcctata

SEQ ID NO: 355332 - DNA, 25 bp, Rattus norvegicus
gagtgtcttgtgaagtcatcgatct

SEQ ID NO: 355333 - DNA, 25 bp, Rattus norvegicus
gagtgtcttgtgtagtcatcgatct

SEQ ID NO: 355334 - DNA, 25 bp, Rattus norvegicus
gagtgtctttccatttatttaggtt

SEQ ID NO: 355335 - DNA, 25 bp, Rattus norvegicus
gagtgtctttccttttatttaggtt

SEQ ID NO: 355336 - DNA, 25 bp, Rattus norvegicus
gagtgtgaaatgcatagtccctttt

SEQ ID NO: 355337 - DNA, 25 bp, Rattus norvegicus
gagtgtgaaatggatagtccctttt

SEQ ID NO: 355338 - DNA, 25 bp, Rattus norvegicus
gagtgtgaacatagcgttgacatat

SEQ ID NO: 355339 - DNA, 25 bp, Rattus norvegicus
gagtgtgaacattgcgttgacatat

SEQ ID NO: 355340 - DNA, 25 bp, Rattus norvegicus
gagtgtgaacctacgatgtcgcaag

SEQ ID NO: 355341 - DNA, 25 bp, Rattus norvegicus
gagtgtgaaccttcgatgtcgcaag

SEQ ID NO: 355342 - DNA, 25 bp, Rattus norvegicus
gagtgtgaagaacccctgcgctgct

SEQ ID NO: 355343 - DNA, 25 bp, Rattus norvegicus
gagtgtgaagaagccctgcgctgct

SEQ ID NO: 355344 - DNA, 25 bp, Rattus norvegicus
gagtgtgaagtcatggacaccaggg

SEQ ID NO: 355345 - DNA, 25 bp, Rattus norvegicus
gagtgtgaagtcttggacaccaggg

SEQ ID NO: 355346 - DNA, 25 bp, Rattus norvegicus
gagtgtgaataaccatcttctgctt

SEQ ID NO: 355347 - DNA, 25 bp, Rattus norvegicus
gagtgtgaataagcatcttctgctt

SEQ ID NO: 355348 - DNA, 25 bp, Rattus norvegicus
gagtgtgaatccaggttctctgcaa

SEQ ID NO: 355349 - DNA, 25 bp, Rattus norvegicus
gagtgtgaatcctggttctctgcaa

SEQ ID NO: 355350 - DNA, 25 bp, Rattus norvegicus
gagtgtgacatccagaccttcgtgc

SEQ ID NO: 355351 - DNA, 25 bp, Rattus norvegicus
gagtgtgacatcgagaccttcgtgc

SEQ ID NO: 355352 - DNA, 25 bp, Rattus norvegicus
gagtgtgacggtatatcacagccac

SEQ ID NO: 355353 - DNA, 25 bp, Rattus norvegicus
gagtgtgacggtttatcacagccac

SEQ ID NO: 355354 - DNA, 25 bp, Rattus norvegicus
gagtgtgactagcttgtgcttctgt

SEQ ID NO: 355355 - DNA, 25 bp, Rattus norvegicus
gagtgtgactaggttgtgcttctgt

SEQ ID NO: 355356 - DNA, 25 bp, Rattus norvegicus
gagtgtgacttccagaaacattctt

SEQ ID NO: 355357 - DNA, 25 bp, Rattus norvegicus
gagtgtgacttcgagaaacattctt

SEQ ID NO: 355358 - DNA, 25 bp, Rattus norvegicus
gagtgtgacttgaggttagcgaacc

SEQ ID NO: 355359 - DNA, 25 bp, Rattus norvegicus
gagtgtgacttgtggttagcgaacc

SEQ ID NO: 355360 - DNA, 25 bp, Rattus norvegicus
gagtgtgagcatcgccagcacccag

SEQ ID NO: 355361 - DNA, 25 bp, Rattus norvegicus
gagtgtgagcatggccagcacccag

SEQ ID NO: 355362 - DNA, 25 bp, Rattus norvegicus
gagtgtgagctgatgtatgtccctt

SEQ ID NO: 355363 - DNA, 25 bp, Rattus norvegicus
gagtgtgagctgttgtatgtccctt

SEQ ID NO: 355364 - DNA, 25 bp, Rattus norvegicus
gagtgtgagcttatgcaggctcctg

SEQ ID NO: 355365 - DNA, 25 bp, Rattus norvegicus
gagtgtgagcttttgcaggctcctg

SEQ ID NO: 355366 - DNA, 25 bp, Rattus norvegicus
gagtgtgagtgcactgtttccaaca

SEQ ID NO: 355367 - DNA, 25 bp, Rattus norvegicus
gagtgtgagtgctctgtttccaaca

SEQ ID NO: 355368 - DNA, 25 bp, Rattus norvegicus
gagtgtgatctccatcaaggcagga

SEQ ID NO: 355369 - DNA, 25 bp, Rattus norvegicus
gagtgtgatctcgatcaaggcagga

SEQ ID NO: 355370 - DNA, 25 bp, Rattus norvegicus
gagtgtgattctccggaaacagcga

SEQ ID NO: 355371 - DNA, 25 bp, Rattus norvegicus
gagtgtgattctgcggaaacagcga

SEQ ID NO: 355372 - DNA, 25 bp, Rattus norvegicus
gagtgtgcaaaccaaagctgatcaa

SEQ ID NO: 355373 - DNA, 25 bp, Rattus norvegicus
gagtgtgcaaacgaaagctgatcaa

SEQ ID NO: 355374 - DNA, 25 bp, Rattus norvegicus
gagtgtgcagcaaggtttccaaggc

SEQ ID NO: 355375 - DNA, 25 bp, Rattus norvegicus
gagtgtgcagcatggtttccaaggc

SEQ ID NO: 355376 - DNA, 25 bp, Rattus norvegicus
gagtgtgcatatccagaagcttttg

SEQ ID NO: 355377 - DNA, 25 bp, Rattus norvegicus
gagtgtgcatatgcagaagcttttg

SEQ ID NO: 355378 - DNA, 25 bp, Rattus norvegicus
gagtgtgcatgcactgtcactaaaa

SEQ ID NO: 355379 - DNA, 25 bp, Rattus norvegicus
gagtgtgcatgctctgtcactaaaa

SEQ ID NO: 355380 - DNA, 25 bp, Rattus norvegicus
gagtgtgccaacagacagcttcagt

SEQ ID NO: 355381 - DNA, 25 bp, Rattus norvegicus
gagtgtgccaacatcggagaacaag

SEQ ID NO: 355382 - DNA, 25 bp, Rattus norvegicus
gagtgtgccaactgacagcttcagt

SEQ ID NO: 355383 - DNA, 25 bp, Rattus norvegicus
gagtgtgccaacttcggagaacaag

SEQ ID NO: 355384 - DNA, 25 bp, Rattus norvegicus
gagtgtgccagacattctggaactg

SEQ ID NO: 355385 - DNA, 25 bp, Rattus norvegicus
gagtgtgccagagattctggaactg

SEQ ID NO: 355386 - DNA, 25 bp, Rattus norvegicus
gagtgtgcccaactatgcggttgca

SEQ ID NO: 355387 - DNA, 25 bp, Rattus norvegicus
gagtgtgcccaagtatgcggttgca

SEQ ID NO: 355388 - DNA, 25 bp, Rattus norvegicus
gagtgtgccccacataactgtgtct

SEQ ID NO: 355389 - DNA, 25 bp, Rattus norvegicus
gagtgtgccccagataactgtgtct

SEQ ID NO: 355390 - DNA, 25 bp, Rattus norvegicus
gagtgtgcccgacttacttgcagat

SEQ ID NO: 355391 - DNA, 25 bp, Rattus norvegicus
gagtgtgcccgagttacttgcagat

SEQ ID NO: 355392 - DNA, 25 bp, Rattus norvegicus
gagtgtgcccgtaataggtcatgtt

SEQ ID NO: 355393 - DNA, 25 bp, Rattus norvegicus
gagtgtgcccgttataggtcatgtt

SEQ ID NO: 355394 - DNA, 25 bp, Rattus norvegicus
gagtgtgccgctagaactctgaaag

SEQ ID NO: 355395 - DNA, 25 bp, Rattus norvegicus
gagtgtgccgcttgaactctgaaag

SEQ ID NO: 355396 - DNA, 25 bp, Rattus norvegicus
gagtgtgccttgcactgattacctc

SEQ ID NO: 355397 - DNA, 25 bp, Rattus norvegicus
gagtgtgccttggactgattacctc

SEQ ID NO: 355398 - DNA, 25 bp, Rattus norvegicus
gagtgtgcgaatccgctgtatccag

SEQ ID NO: 355399 - DNA, 25 bp, Rattus norvegicus
gagtgtgcgaatgcgctgtatccag

SEQ ID NO: 355400 - DNA, 25 bp, Rattus norvegicus
gagtgtgcgtatcctacaaagccaa

SEQ ID NO: 355401 - DNA, 25 bp, Rattus norvegicus
gagtgtgcgtatgctacaaagccaa

SEQ ID NO: 355402 - DNA, 25 bp, Rattus norvegicus
gagtgtgctataactaccttgtaca

SEQ ID NO: 355403 - DNA, 25 bp, Rattus norvegicus
gagtgtgctatatctaccttgtaca

SEQ ID NO: 355404 - DNA, 25 bp, Rattus norvegicus
gagtgtgctcagaccagacaaatga

SEQ ID NO: 355405 - DNA, 25 bp, Rattus norvegicus
gagtgtgctcagtccagacaaatga

SEQ ID NO: 355406 - DNA, 25 bp, Rattus norvegicus
gagtgtgcttctctctgaattccta

SEQ ID NO: 355407 - DNA, 25 bp, Rattus norvegicus
gagtgtgcttctgtctgaattccta

SEQ ID NO: 355408 - DNA, 25 bp, Rattus norvegicus
gagtgtggaactacacctttgccag

SEQ ID NO: 355409 - DNA, 25 bp, Rattus norvegicus
gagtgtggaacttcacctttgccag

SEQ ID NO: 355410 - DNA, 25 bp, Rattus norvegicus
gagtgtggaagtctcttggttccct

SEQ ID NO: 355411 - DNA, 25 bp, Rattus norvegicus
gagtgtggaagtgtcttggttccct

SEQ ID NO: 355412 - DNA, 25 bp, Rattus norvegicus
gagtgtggacacaaagctgcttgta

SEQ ID NO: 355413 - DNA, 25 bp, Rattus norvegicus
gagtgtggacactaagctgcttgta

SEQ ID NO: 355414 - DNA, 25 bp, Rattus norvegicus
gagtgtggacataaggctcctgcct

SEQ ID NO: 355415 - DNA, 25 bp, Rattus norvegicus
gagtgtggacattaggctcctgcct

SEQ ID NO: 355416 - DNA, 25 bp, Rattus norvegicus
gagtgtggaccaagttagctgaatt

SEQ ID NO: 355417 - DNA, 25 bp, Rattus norvegicus
gagtgtggaccatgttagctgaatt

SEQ ID NO: 355418 - DNA, 25 bp, Rattus norvegicus
gagtgtggactgcaccattctatat

SEQ ID NO: 355419 - DNA, 25 bp, Rattus norvegicus
gagtgtggactggaccattctatat

SEQ ID NO: 355420 - DNA, 25 bp, Rattus norvegicus
gagtgtggagaaagtcccctgcatt

SEQ ID NO: 355421 - DNA, 25 bp, Rattus norvegicus
gagtgtggagaatgtcccctgcatt

SEQ ID NO: 355422 - DNA, 25 bp, Rattus norvegicus
gagtgtggagttcccaggataccct

SEQ ID NO: 355423 - DNA, 25 bp, Rattus norvegicus
gagtgtggagttgccaggataccct

SEQ ID NO: 355424 - DNA, 25 bp, Rattus norvegicus
gagtgtggcaaccagttcgcctatt

SEQ ID NO: 355425 - DNA, 25 bp, Rattus norvegicus
gagtgtggcaacgagttcgcctatt

SEQ ID NO: 355426 - DNA, 25 bp, Rattus norvegicus
gagtgtggcaagactcccctaaagc

SEQ ID NO: 355427 - DNA, 25 bp, Rattus norvegicus
gagtgtggcaagtctcccctaaagc

SEQ ID NO: 355428 - DNA, 25 bp, Rattus norvegicus
gagtgtggcatgaatatgcattgtg

SEQ ID NO: 355429 - DNA, 25 bp, Rattus norvegicus
gagtgtggcatgtatatgcattgtg

SEQ ID NO: 355430 - DNA, 25 bp, Rattus norvegicus
gagtgtggcctaacacatactgata

SEQ ID NO: 355431 - DNA, 25 bp, Rattus norvegicus
gagtgtggcctatcacatactgata

SEQ ID NO: 355432 - DNA, 25 bp, Rattus norvegicus
gagtgtggctgtcgctgaccaccca

SEQ ID NO: 355433 - DNA, 25 bp, Rattus norvegicus
gagtgtggctgtggctgaccaccca

SEQ ID NO: 355434 - DNA, 25 bp, Rattus norvegicus
gagtgtgggtttccttcagaacgca

SEQ ID NO: 355435 - DNA, 25 bp, Rattus norvegicus
gagtgtgggtttgcttcagaacgca

SEQ ID NO: 355436 - DNA, 25 bp, Rattus norvegicus
gagtgtggtcgcagaccagttgaaa

SEQ ID NO: 355437 - DNA, 25 bp, Rattus norvegicus
gagtgtggtcgctgaccagttgaaa

SEQ ID NO: 355438 - DNA, 25 bp, Rattus norvegicus
gagtgtgtaactcgaaatcatatac

SEQ ID NO: 355439 - DNA, 25 bp, Rattus norvegicus
gagtgtgtaactggaaatcatatac

SEQ ID NO: 355440 - DNA, 25 bp, Rattus norvegicus
gagtgtgtacacatgcttgcatgca

SEQ ID NO: 355441 - DNA, 25 bp, Rattus norvegicus
gagtgtgtacacctcccagtcacat

SEQ ID NO: 355442 - DNA, 25 bp, Rattus norvegicus
gagtgtgtacacgtcccagtcacat

SEQ ID NO: 355443 - DNA, 25 bp, Rattus norvegicus
gagtgtgtacacttgcttgcatgca

SEQ ID NO: 355444 - DNA, 25 bp, Rattus norvegicus
gagtgtgtcagtaagcacccaaggg

SEQ ID NO: 355445 - DNA, 25 bp, Rattus norvegicus
gagtgtgtcagttagcacccaaggg

SEQ ID NO: 355446 - DNA, 25 bp, Rattus norvegicus
gagtgtgtccagattatttttcata

SEQ ID NO: 355447 - DNA, 25 bp, Rattus norvegicus
gagtgtgtccagtttatttttcata

SEQ ID NO: 355448 - DNA, 25 bp, Rattus norvegicus
gagtgtgtcctgactactggtccta

SEQ ID NO: 355449 - DNA, 25 bp, Rattus norvegicus
gagtgtgtcctgtctactggtccta

SEQ ID NO: 355450 - DNA, 25 bp, Rattus norvegicus
gagtgtgtctgaatctgcttactgc

SEQ ID NO: 355451 - DNA, 25 bp, Rattus norvegicus
gagtgtgtctgattctgcttactgc

SEQ ID NO: 355452 - DNA, 25 bp, Rattus norvegicus
gagtgtgtcttaataagcccattgc

SEQ ID NO: 355453 - DNA, 25 bp, Rattus norvegicus
gagtgtgtcttattaagcccattgc

SEQ ID NO: 355454 - DNA, 25 bp, Rattus norvegicus
gagtgtgtgacacgccacagatttt

SEQ ID NO: 355455 - DNA, 25 bp, Rattus norvegicus
gagtgtgtgacaggccacagatttt

SEQ ID NO: 355456 - DNA, 25 bp, Rattus norvegicus
gagtgtgtgctaacagagtgccctg

SEQ ID NO: 355457 - DNA, 25 bp, Rattus norvegicus
gagtgtgtgctatcagagtgccctg

SEQ ID NO: 355458 - DNA, 25 bp, Rattus norvegicus
gagtgtgtgtcaaacagaacctaac

SEQ ID NO: 355459 - DNA, 25 bp, Rattus norvegicus
gagtgtgtgtcatacagaacctaac

SEQ ID NO: 355460 - DNA, 25 bp, Rattus norvegicus
gagtgtgtgtgaacgtgtccgacaa

SEQ ID NO: 355461 - DNA, 25 bp, Rattus norvegicus
gagtgtgtgtgatcgtgtccgacaa

SEQ ID NO: 355462 - DNA, 25 bp, Rattus norvegicus
gagtgtgtgtgcacagggtcatact

SEQ ID NO: 355463 - DNA, 25 bp, Rattus norvegicus
gagtgtgtgtgctcagggtcatact

SEQ ID NO: 355464 - DNA, 25 bp, Rattus norvegicus
gagtgtgtgttgatcactgccagtc

SEQ ID NO: 355465 - DNA, 25 bp, Rattus norvegicus
gagtgtgtgttgttcactgccagtc

SEQ ID NO: 355466 - DNA, 25 bp, Rattus norvegicus
gagtgtgttacccagacctgttgcg

SEQ ID NO: 355467 - DNA, 25 bp, Rattus norvegicus
gagtgtgttaccgagacctgttgcg

SEQ ID NO: 355468 - DNA, 25 bp, Rattus norvegicus
gagtgtgttactctgtttttcaaaa

SEQ ID NO: 355469 - DNA, 25 bp, Rattus norvegicus
gagtgtgttactgtgtttttcaaaa

SEQ ID NO: 355470 - DNA, 25 bp, Rattus norvegicus
gagtgtgttcccatgtaggaggtaa

SEQ ID NO: 355471 - DNA, 25 bp, Rattus norvegicus
gagtgtgttcccttgtaggaggtaa

SEQ ID NO: 355472 - DNA, 25 bp, Rattus norvegicus
gagtgtgtttcgaagtgctgcgtcc

SEQ ID NO: 355473 - DNA, 25 bp, Rattus norvegicus
gagtgtgtttcgtagtgctgcgtcc

SEQ ID NO: 355474 - DNA, 25 bp, Rattus norvegicus
gagtgtgtttctctgagctgtcatt

SEQ ID NO: 355475 - DNA, 25 bp, Rattus norvegicus
gagtgtgtttctgtgagctgtcatt

SEQ ID NO: 355476 - DNA, 25 bp, Rattus norvegicus
gagtgttaacttcctaggccgagca

SEQ ID NO: 355477 - DNA, 25 bp, Rattus norvegicus
gagtgttaacttgctaggccgagca

SEQ ID NO: 355478 - DNA, 25 bp, Rattus norvegicus
gagtgttacgtcaaccggcagtgtc

SEQ ID NO: 355479 - DNA, 25 bp, Rattus norvegicus
gagtgttacgtctaccggcagtgtc

SEQ ID NO: 355480 - DNA, 25 bp, Rattus norvegicus
gagtgttacgttactgactacttaa

SEQ ID NO: 355481 - DNA, 25 bp, Rattus norvegicus
gagtgttacgtttctgactacttaa

SEQ ID NO: 355482 - DNA, 25 bp, Rattus norvegicus
gagtgttacttaacaagttgatgct

SEQ ID NO: 355483 - DNA, 25 bp, Rattus norvegicus
gagtgttacttatcaagttgatgct

SEQ ID NO: 355484 - DNA, 25 bp, Rattus norvegicus
gagtgttaggtgctgagccacaccc

SEQ ID NO: 355485 - DNA, 25 bp, Rattus norvegicus
gagtgttaggtggtgagccacaccc

SEQ ID NO: 355486 - DNA, 25 bp, Rattus norvegicus
gagtgttataccagcttgtatggat

SEQ ID NO: 355487 - DNA, 25 bp, Rattus norvegicus
gagtgttatacctgcttgtatggat

SEQ ID NO: 355488 - DNA, 25 bp, Rattus norvegicus
gagtgttatcagaaaagtgccccat

SEQ ID NO: 355489 - DNA, 25 bp, Rattus norvegicus
gagtgttatcagtaaagtgccccat

SEQ ID NO: 355490 - DNA, 25 bp, Rattus norvegicus
gagtgttcaagcagttccgggctct

SEQ ID NO: 355491 - DNA, 25 bp, Rattus norvegicus
gagtgttcaagctgttccgggctct

SEQ ID NO: 355492 - DNA, 25 bp, Rattus norvegicus
gagtgttcacaaacctccagatggt

SEQ ID NO: 355493 - DNA, 25 bp, Rattus norvegicus
gagtgttcacaatcctccagatggt

SEQ ID NO: 355494 - DNA, 25 bp, Rattus norvegicus
gagtgttcactgatgtttacgattt

SEQ ID NO: 355495 - DNA, 25 bp, Rattus norvegicus
gagtgttcactgttgtttacgattt

SEQ ID NO: 355496 - DNA, 25 bp, Rattus norvegicus
gagtgttcacttaagacagcgcttt

SEQ ID NO: 355497 - DNA, 25 bp, Rattus norvegicus
gagtgttcactttagacagcgcttt

SEQ ID NO: 355498 - DNA, 25 bp, Rattus norvegicus
gagtgttcataaagtgtcgtccaca

SEQ ID NO: 355499 - DNA, 25 bp, Rattus norvegicus
gagtgttcataatgtgtcgtccaca

SEQ ID NO: 355500 - DNA, 25 bp, Rattus norvegicus
gagtgttccacaatttcatgtcaaa

SEQ ID NO: 355501 - DNA, 25 bp, Rattus norvegicus
gagtgttccacacaagtaccagaca

SEQ ID NO: 355502 - DNA, 25 bp, Rattus norvegicus
gagtgttccacagaagtaccagaca

SEQ ID NO: 355503 - DNA, 25 bp, Rattus norvegicus
gagtgttccacattttcatgtcaaa

SEQ ID NO: 355504 - DNA, 25 bp, Rattus norvegicus
gagtgttccagaagcttctactgtt

SEQ ID NO: 355505 - DNA, 25 bp, Rattus norvegicus
gagtgttccagatgcttctactgtt

SEQ ID NO: 355506 - DNA, 25 bp, Rattus norvegicus
gagtgttccccgacagtagctgcag

SEQ ID NO: 355507 - DNA, 25 bp, Rattus norvegicus
gagtgttccccgtcagtagctgcag

SEQ ID NO: 355508 - DNA, 25 bp, Rattus norvegicus
gagtgttcggagagttcttcctaat

SEQ ID NO: 355509 - DNA, 25 bp, Rattus norvegicus
gagtgttcggagtgttcttcctaat

SEQ ID NO: 355510 - DNA, 25 bp, Rattus norvegicus
gagtgttctaccacaccagaagacc

SEQ ID NO: 355511 - DNA, 25 bp, Rattus norvegicus
gagtgttctacctcaccagaagacc

SEQ ID NO: 355512 - DNA, 25 bp, Rattus norvegicus
gagtgttctcagactttcctatcat

SEQ ID NO: 355513 - DNA, 25 bp, Rattus norvegicus
gagtgttctcagtctttcctatcat

SEQ ID NO: 355514 - DNA, 25 bp, Rattus norvegicus
gagtgttctgctcgtctccaattac

SEQ ID NO: 355515 - DNA, 25 bp, Rattus norvegicus
gagtgttctgctggtctccaattac

SEQ ID NO: 355516 - DNA, 25 bp, Rattus norvegicus
gagtgttctgggaccacagtcagga

SEQ ID NO: 355517 - DNA, 25 bp, Rattus norvegicus
gagtgttctgggtccacagtcagga

SEQ ID NO: 355518 - DNA, 25 bp, Rattus norvegicus
gagtgttctgttatagcatttggtt

SEQ ID NO: 355519 - DNA, 25 bp, Rattus norvegicus
gagtgttctgttttagcatttggtt

SEQ ID NO: 355520 - DNA, 25 bp, Rattus norvegicus
gagtgttcttcacatgcagcagaca

SEQ ID NO: 355521 - DNA, 25 bp, Rattus norvegicus
gagtgttcttcagatgcagcagaca

SEQ ID NO: 355522 - DNA, 25 bp, Rattus norvegicus
gagtgttcttccatactctttacac

SEQ ID NO: 355523 - DNA, 25 bp, Rattus norvegicus
gagtgttcttccttactctttacac

SEQ ID NO: 355524 - DNA, 25 bp, Rattus norvegicus
gagtgttgaaccagcttatcctcat

SEQ ID NO: 355525 - DNA, 25 bp, Rattus norvegicus
gagtgttgaacctgcttatcctcat

SEQ ID NO: 355526 - DNA, 25 bp, Rattus norvegicus
gagtgttgatggctgcccagccata

SEQ ID NO: 355527 - DNA, 25 bp, Rattus norvegicus
gagtgttgatgggtgcccagccata

SEQ ID NO: 355528 - DNA, 25 bp, Rattus norvegicus
gagtgttgcaagaaggaacccctgt

SEQ ID NO: 355529 - DNA, 25 bp, Rattus norvegicus
gagtgttgcaagtaggaacccctgt

SEQ ID NO: 355530 - DNA, 25 bp, Rattus norvegicus
gagtgttgcacccaagctgaaggaa

SEQ ID NO: 355531 - DNA, 25 bp, Rattus norvegicus
gagtgttgcaccgaagctgaaggaa

SEQ ID NO: 355532 - DNA, 25 bp, Rattus norvegicus
gagtgttgctttactacaatgtaca

SEQ ID NO: 355533 - DNA, 25 bp, Rattus norvegicus
gagtgttgctttagtttcagccgac

SEQ ID NO: 355534 - DNA, 25 bp, Rattus norvegicus
gagtgttgcttttctacaatgtaca

SEQ ID NO: 355535 - DNA, 25 bp, Rattus norvegicus
gagtgttgcttttgtttcagccgac

SEQ ID NO: 355536 - DNA, 25 bp, Rattus norvegicus
gagtgttgggataccctcaccccga

SEQ ID NO: 355537 - DNA, 25 bp, Rattus norvegicus
gagtgttgggattccctcaccccga

SEQ ID NO: 355538 - DNA, 25 bp, Rattus norvegicus
gagtgttgtagtctgtcatggccac

SEQ ID NO: 355539 - DNA, 25 bp, Rattus norvegicus
gagtgttgtagtgtgtcatggccac

SEQ ID NO: 355540 - DNA, 25 bp, Rattus norvegicus
gagtgttgtccaatcttagacagga

SEQ ID NO: 355541 - DNA, 25 bp, Rattus norvegicus
gagtgttgtccattcttagacagga

SEQ ID NO: 355542 - DNA, 25 bp, Rattus norvegicus
gagtgttgtgtcagtacaaatcctt

SEQ ID NO: 355543 - DNA, 25 bp, Rattus norvegicus
gagtgttgtgtctgtacaaatcctt

SEQ ID NO: 355544 - DNA, 25 bp, Rattus norvegicus
gagtgtttaatcatccacatcagag

SEQ ID NO: 355545 - DNA, 25 bp, Rattus norvegicus
gagtgtttaatcttccacatcagag

SEQ ID NO: 355546 - DNA, 25 bp, Rattus norvegicus
gagtgtttacagactccttctctaa

SEQ ID NO: 355547 - DNA, 25 bp, Rattus norvegicus
gagtgtttacagtctccttctctaa

SEQ ID NO: 355548 - DNA, 25 bp, Rattus norvegicus
gagtgtttcaacatctgtccatgtt

SEQ ID NO: 355549 - DNA, 25 bp, Rattus norvegicus
gagtgtttcaacttctgtccatgtt

SEQ ID NO: 355550 - DNA, 25 bp, Rattus norvegicus
gagtgtttccatcacacctcttcag

SEQ ID NO: 355551 - DNA, 25 bp, Rattus norvegicus
gagtgtttccatgacacctcttcag

SEQ ID NO: 355552 - DNA, 25 bp, Rattus norvegicus
gagtgtttcctcacgattcaaaatg

SEQ ID NO: 355553 - DNA, 25 bp, Rattus norvegicus
gagtgtttcctctcgattcaaaatg

SEQ ID NO: 355554 - DNA, 25 bp, Rattus norvegicus
gagtgtttcctgcagttctcggctg

SEQ ID NO: 355555 - DNA, 25 bp, Rattus norvegicus
gagtgtttcctggagttctcggctg

SEQ ID NO: 355556 - DNA, 25 bp, Rattus norvegicus
gagtgtttcgagcacgccatatagc

SEQ ID NO: 355557 - DNA, 25 bp, Rattus norvegicus
gagtgtttcgaggacgccatatagc

SEQ ID NO: 355558 - DNA, 25 bp, Rattus norvegicus
gagtgtttctgaatgagtctaatat

SEQ ID NO: 355559 - DNA, 25 bp, Rattus norvegicus
gagtgtttctgattgagtctaatat

SEQ ID NO: 355560 - DNA, 25 bp, Rattus norvegicus
gagtgtttcttcaccattctaatcc

SEQ ID NO: 355561 - DNA, 25 bp, Rattus norvegicus
gagtgtttcttcagcatgactctgc

SEQ ID NO: 355562 - DNA, 25 bp, Rattus norvegicus
gagtgtttcttctccattctaatcc

SEQ ID NO: 355563 - DNA, 25 bp, Rattus norvegicus
gagtgtttcttctgcatgactctgc

SEQ ID NO: 355564 - DNA, 25 bp, Rattus norvegicus
gagtgtttgagcaagaggcagtatc

SEQ ID NO: 355565 - DNA, 25 bp, Rattus norvegicus
gagtgtttgagctagaggcagtatc

SEQ ID NO: 355566 - DNA, 25 bp, Rattus norvegicus
gagtgtttgataaccccatcagagc

SEQ ID NO: 355567 - DNA, 25 bp, Rattus norvegicus
gagtgtttgatacttaatcttccag

SEQ ID NO: 355568 - DNA, 25 bp, Rattus norvegicus
gagtgtttgatagttaatcttccag

SEQ ID NO: 355569 - DNA, 25 bp, Rattus norvegicus
gagtgtttgatatccccatcagagc

SEQ ID NO: 355570 - DNA, 25 bp, Rattus norvegicus
gagtgtttgcacaatactctctggg

SEQ ID NO: 355571 - DNA, 25 bp, Rattus norvegicus
gagtgtttgcactatactctctggg

SEQ ID NO: 355572 - DNA, 25 bp, Rattus norvegicus
gagtgtttgctgattgtcagccact

SEQ ID NO: 355573 - DNA, 25 bp, Rattus norvegicus
gagtgtttgctgtttgtcagccact

SEQ ID NO: 355574 - DNA, 25 bp, Rattus norvegicus
gagtgtttggcaccgcctggctcca

SEQ ID NO: 355575 - DNA, 25 bp, Rattus norvegicus
gagtgtttggcagcgcctggctcca

SEQ ID NO: 355576 - DNA, 25 bp, Rattus norvegicus
gagtgtttgtgaaagcctgcgctgt

SEQ ID NO: 355577 - DNA, 25 bp, Rattus norvegicus
gagtgtttgtgatagcctgcgctgt

SEQ ID NO: 355578 - DNA, 25 bp, Rattus norvegicus
gagtgtttgtgcattagatttgtct

SEQ ID NO: 355579 - DNA, 25 bp, Rattus norvegicus
gagtgtttgtgctttagatttgtct

SEQ ID NO: 355580 - DNA, 25 bp, Rattus norvegicus
gagtgtttgtttagccttggaactt

SEQ ID NO: 355581 - DNA, 25 bp, Rattus norvegicus
gagtgtttgttttgccttggaactt

SEQ ID NO: 355582 - DNA, 25 bp, Rattus norvegicus
gagtgttttaatcagacttcctagg

SEQ ID NO: 355583 - DNA, 25 bp, Rattus norvegicus
gagtgttttaatgagacttcctagg

SEQ ID NO: 355584 - DNA, 25 bp, Rattus norvegicus
gagtgttttacgagtcccattttga

SEQ ID NO: 355585 - DNA, 25 bp, Rattus norvegicus
gagtgttttacgtgtcccattttga

SEQ ID NO: 355586 - DNA, 25 bp, Rattus norvegicus
gagtgttttcagaaggcccataggc

SEQ ID NO: 355587 - DNA, 25 bp, Rattus norvegicus
gagtgttttcagtaggcccataggc

SEQ ID NO: 355588 - DNA, 25 bp, Rattus norvegicus
gagtgttttccccatttgttacaga

SEQ ID NO: 355589 - DNA, 25 bp, Rattus norvegicus
gagtgttttcccgatttgttacaga

SEQ ID NO: 355590 - DNA, 25 bp, Rattus norvegicus
gagtgttttctgaacttcatggttt

SEQ ID NO: 355591 - DNA, 25 bp, Rattus norvegicus
gagtgttttctgtacttcatggttt

SEQ ID NO: 355592 - DNA, 25 bp, Rattus norvegicus
gagtgttttcttaaaggcatttcta

SEQ ID NO: 355593 - DNA, 25 bp, Rattus norvegicus
gagtgttttctttaaggcatttcta

SEQ ID NO: 355594 - DNA, 25 bp, Rattus norvegicus
gagtgttttgctcacaaatcttttt

SEQ ID NO: 355595 - DNA, 25 bp, Rattus norvegicus
gagtgttttgctgacaaatcttttt

SEQ ID NO: 355596 - DNA, 25 bp, Rattus norvegicus
gagtgttttgttactgcatagcaac

SEQ ID NO: 355597 - DNA, 25 bp, Rattus norvegicus
gagtgttttgtttctgcatagcaac

SEQ ID NO: 355598 - DNA, 25 bp, Rattus norvegicus
gagtgtttttctactcaactgatct

SEQ ID NO: 355599 - DNA, 25 bp, Rattus norvegicus
gagtgtttttctcagccatgcaaaa

SEQ ID NO: 355600 - DNA, 25 bp, Rattus norvegicus
gagtgtttttctgagccatgcaaaa

SEQ ID NO: 355601 - DNA, 25 bp, Rattus norvegicus
gagtgtttttcttctcaactgatct

SEQ ID NO: 355602 - DNA, 25 bp, Rattus norvegicus
gagtgttttttgagcccacaccaat

SEQ ID NO: 355603 - DNA, 25 bp, Rattus norvegicus
gagtgttttttgtgcccacaccaat

SEQ ID NO: 355604 - DNA, 25 bp, Rattus norvegicus
gagttaaaagtacacatgctggatc

SEQ ID NO: 355605 - DNA, 25 bp, Rattus norvegicus
gagttaaaagtagacatgctggatc

SEQ ID NO: 355606 - DNA, 25 bp, Rattus norvegicus
gagttaaaagtcatccccagataca

SEQ ID NO: 355607 - DNA, 25 bp, Rattus norvegicus
gagttaaaagtcttccccagataca

SEQ ID NO: 355608 - DNA, 25 bp, Rattus norvegicus
gagttaaaattcagcttaggcccca

SEQ ID NO: 355609 - DNA, 25 bp, Rattus norvegicus
gagttaaaattctgcttaggcccca

SEQ ID NO: 355610 - DNA, 25 bp, Rattus norvegicus
gagttaaagcacctatccacccaga

SEQ ID NO: 355611 - DNA, 25 bp, Rattus norvegicus
gagttaaagcacgtatccacccaga

SEQ ID NO: 355612 - DNA, 25 bp, Rattus norvegicus
gagttaaagcgaccacagatgccca

SEQ ID NO: 355613 - DNA, 25 bp, Rattus norvegicus
gagttaaagcgagcacagatgccca

SEQ ID NO: 355614 - DNA, 25 bp, Rattus norvegicus
gagttaaatacccagcatccacaag

SEQ ID NO: 355615 - DNA, 25 bp, Rattus norvegicus
gagttaaataccgagcatccacaag

SEQ ID NO: 355616 - DNA, 25 bp, Rattus norvegicus
gagttaacaacaatccctaccatac

SEQ ID NO: 355617 - DNA, 25 bp, Rattus norvegicus
gagttaacaacattccctaccatac

SEQ ID NO: 355618 - DNA, 25 bp, Rattus norvegicus
gagttaacaccgccggagaggcaca

SEQ ID NO: 355619 - DNA, 25 bp, Rattus norvegicus
gagttaacaccggcggagaggcaca

SEQ ID NO: 355620 - DNA, 25 bp, Rattus norvegicus
gagttaacatctcttgaagccaaac

SEQ ID NO: 355621 - DNA, 25 bp, Rattus norvegicus
gagttaacatctgttgaagccaaac

SEQ ID NO: 355622 - DNA, 25 bp, Rattus norvegicus
gagttaacattcctagtctgcacca

SEQ ID NO: 355623 - DNA, 25 bp, Rattus norvegicus
gagttaacattcgtagtctgcacca

SEQ ID NO: 355624 - DNA, 25 bp, Rattus norvegicus
gagttaaccaaactgctcttctgga

SEQ ID NO: 355625 - DNA, 25 bp, Rattus norvegicus
gagttaaccaaagtgctcttctgga

SEQ ID NO: 355626 - DNA, 25 bp, Rattus norvegicus
gagttaacgcctacaatatatttct

SEQ ID NO: 355627 - DNA, 25 bp, Rattus norvegicus
gagttaacgccttcaatatatttct

SEQ ID NO: 355628 - DNA, 25 bp, Rattus norvegicus
gagttaacttctatgctggaaacat

SEQ ID NO: 355629 - DNA, 25 bp, Rattus norvegicus
gagttaacttctttgctggaaacat

SEQ ID NO: 355630 - DNA, 25 bp, Rattus norvegicus
gagttaagacttccctaacattcct

SEQ ID NO: 355631 - DNA, 25 bp, Rattus norvegicus
gagttaagacttgcctaacattcct

SEQ ID NO: 355632 - DNA, 25 bp, Rattus norvegicus
gagttaagcctaaagttctacaaat

SEQ ID NO: 355633 - DNA, 25 bp, Rattus norvegicus
gagttaagcctatagttctacaaat

SEQ ID NO: 355634 - DNA, 25 bp, Rattus norvegicus
gagttaagcctgctcctgtaggaca

SEQ ID NO: 355635 - DNA, 25 bp, Rattus norvegicus
gagttaagcctggtcctgtaggaca

SEQ ID NO: 355636 - DNA, 25 bp, Rattus norvegicus
gagttaagtcttccactacagtcac

SEQ ID NO: 355637 - DNA, 25 bp, Rattus norvegicus
gagttaagtcttgcactacagtcac

SEQ ID NO: 355638 - DNA, 25 bp, Rattus norvegicus
gagttaagttgcagtggcccatcat

SEQ ID NO: 355639 - DNA, 25 bp, Rattus norvegicus
gagttaagttgctgtggcccatcat

SEQ ID NO: 355640 - DNA, 25 bp, Rattus norvegicus
gagttaataaacatcgccagattct

SEQ ID NO: 355641 - DNA, 25 bp, Rattus norvegicus
gagttaataaacttcgccagattct

SEQ ID NO: 355642 - DNA, 25 bp, Rattus norvegicus
gagttaataccacggcttcagcatt

SEQ ID NO: 355643 - DNA, 25 bp, Rattus norvegicus
gagttaataccagggcttcagcatt

SEQ ID NO: 355644 - DNA, 25 bp, Rattus norvegicus
gagttaatcactaaggagcatgcac

SEQ ID NO: 355645 - DNA, 25 bp, Rattus norvegicus
gagttaatcacttaggagcatgcac

SEQ ID NO: 355646 - DNA, 25 bp, Rattus norvegicus
gagttaatctagaaccatccccaga

SEQ ID NO: 355647 - DNA, 25 bp, Rattus norvegicus
gagttaatctagtaccatccccaga

SEQ ID NO: 355648 - DNA, 25 bp, Rattus norvegicus
gagttaatgcacagccccactgttg

SEQ ID NO: 355649 - DNA, 25 bp, Rattus norvegicus
gagttaatgcactgccccactgttg

SEQ ID NO: 355650 - DNA, 25 bp, Rattus norvegicus
gagttaatgtcaaacccatcgccat

SEQ ID NO: 355651 - DNA, 25 bp, Rattus norvegicus
gagttaatgtcatacccatcgccat

SEQ ID NO: 355652 - DNA, 25 bp, Rattus norvegicus
gagttaattcagacgcttcacacaa

SEQ ID NO: 355653 - DNA, 25 bp, Rattus norvegicus
gagttaattcagtcgcttcacacaa

SEQ ID NO: 355654 - DNA, 25 bp, Rattus norvegicus
gagttaatttttctgcactacaaag

SEQ ID NO: 355655 - DNA, 25 bp, Rattus norvegicus
gagttaatttttgtgcactacaaag

SEQ ID NO: 355656 - DNA, 25 bp, Rattus norvegicus
gagttacaatcccagctatggctat

SEQ ID NO: 355657 - DNA, 25 bp, Rattus norvegicus
gagttacaatccgagctatggctat

SEQ ID NO: 355658 - DNA, 25 bp, Rattus norvegicus
gagttacaatcgcaggttcccgcgg

SEQ ID NO: 355659 - DNA, 25 bp, Rattus norvegicus
gagttacaatcggaggttcccgcgg

SEQ ID NO: 355660 - DNA, 25 bp, Rattus norvegicus
gagttacacaacacttaagcagcag

SEQ ID NO: 355661 - DNA, 25 bp, Rattus norvegicus
gagttacacaactcttaagcagcag

SEQ ID NO: 355662 - DNA, 25 bp, Rattus norvegicus
gagttacacagcattctcatcttga

SEQ ID NO: 355663 - DNA, 25 bp, Rattus norvegicus
gagttacacagctttctcatcttga

SEQ ID NO: 355664 - DNA, 25 bp, Rattus norvegicus
gagttacaggccattcatttctgtc

SEQ ID NO: 355665 - DNA, 25 bp, Rattus norvegicus
gagttacaggcctttcatttctgtc

SEQ ID NO: 355666 - DNA, 25 bp, Rattus norvegicus
gagttacaggtcacttgatgccctc

SEQ ID NO: 355667 - DNA, 25 bp, Rattus norvegicus
gagttacaggtcctaggtgctgcct

SEQ ID NO: 355668 - DNA, 25 bp, Rattus norvegicus
gagttacaggtcgtaggtgctgcct

SEQ ID NO: 355669 - DNA, 25 bp, Rattus norvegicus
gagttacaggtctcttgatgccctc

SEQ ID NO: 355670 - DNA, 25 bp, Rattus norvegicus
gagttacaggtgacggcgtaccatc

SEQ ID NO: 355671 - DNA, 25 bp, Rattus norvegicus
gagttacaggtgtcggcgtaccatc

SEQ ID NO: 355672 - DNA, 25 bp, Rattus norvegicus
gagttacagtatagcctgcgtctat

SEQ ID NO: 355673 - DNA, 25 bp, Rattus norvegicus
gagttacagtattgcctgcgtctat

SEQ ID NO: 355674 - DNA, 25 bp, Rattus norvegicus
gagttacatcagagcaccactgtgc

SEQ ID NO: 355675 - DNA, 25 bp, Rattus norvegicus
gagttacatcagtgcaccactgtgc

SEQ ID NO: 355676 - DNA, 25 bp, Rattus norvegicus
gagttacatctcaactgactacaac

SEQ ID NO: 355677 - DNA, 25 bp, Rattus norvegicus
gagttacatctctactgactacaac

SEQ ID NO: 355678 - DNA, 25 bp, Rattus norvegicus
gagttacatgacacccatctcagaa

SEQ ID NO: 355679 - DNA, 25 bp, Rattus norvegicus
gagttacatgactcccatctcagaa

SEQ ID NO: 355680 - DNA, 25 bp, Rattus norvegicus
gagttacatttaagtcttgtttgta

SEQ ID NO: 355681 - DNA, 25 bp, Rattus norvegicus
gagttacatttatgtcttgtttgta

SEQ ID NO: 355682 - DNA, 25 bp, Rattus norvegicus
gagttacccaaaatccttcagtgtt

SEQ ID NO: 355683 - DNA, 25 bp, Rattus norvegicus
gagttacccaaactgtgatccctga

SEQ ID NO: 355684 - DNA, 25 bp, Rattus norvegicus
gagttacccaaagtgtgatccctga

SEQ ID NO: 355685 - DNA, 25 bp, Rattus norvegicus
gagttacccaaattccttcagtgtt

SEQ ID NO: 355686 - DNA, 25 bp, Rattus norvegicus
gagttaccgaccatgcctccatctg

SEQ ID NO: 355687 - DNA, 25 bp, Rattus norvegicus
gagttaccgaccttgcctccatctg

SEQ ID NO: 355688 - DNA, 25 bp, Rattus norvegicus
gagttacctctgcatttgtgactat

SEQ ID NO: 355689 - DNA, 25 bp, Rattus norvegicus
gagttacctctggatttgtgactat

SEQ ID NO: 355690 - DNA, 25 bp, Rattus norvegicus
gagttacgggaaaccttctgcagga

SEQ ID NO: 355691 - DNA, 25 bp, Rattus norvegicus
gagttacgggaatccttctgcagga

SEQ ID NO: 355692 - DNA, 25 bp, Rattus norvegicus
gagttactacctcgaccgtgaagct

SEQ ID NO: 355693 - DNA, 25 bp, Rattus norvegicus
gagttactacctggaccgtgaagct

SEQ ID NO: 355694 - DNA, 25 bp, Rattus norvegicus
gagttactactgagtgcctgcctac

SEQ ID NO: 355695 - DNA, 25 bp, Rattus norvegicus
gagttactactgtgtgcctgcctac

SEQ ID NO: 355696 - DNA, 25 bp, Rattus norvegicus
gagttactacttagatcccatggtt

SEQ ID NO: 355697 - DNA, 25 bp, Rattus norvegicus
gagttactactttgatcccatggtt

SEQ ID NO: 355698 - DNA, 25 bp, Rattus norvegicus
gagttactagctcaaagctcttgaa

SEQ ID NO: 355699 - DNA, 25 bp, Rattus norvegicus
gagttactagctgaaagctcttgaa

SEQ ID NO: 355700 - DNA, 25 bp, Rattus norvegicus
gagttactatcacaagtgcctcaga

SEQ ID NO: 355701 - DNA, 25 bp, Rattus norvegicus
gagttactatcagaagtgcctcaga

SEQ ID NO: 355702 - DNA, 25 bp, Rattus norvegicus
gagttactattgaccttgaccttct

SEQ ID NO: 355703 - DNA, 25 bp, Rattus norvegicus
gagttactattgtccttgaccttct

SEQ ID NO: 355704 - DNA, 25 bp, Rattus norvegicus
gagttactcatgaaaccagtgcaca

SEQ ID NO: 355705 - DNA, 25 bp, Rattus norvegicus
gagttactcatgtaaccagtgcaca

SEQ ID NO: 355706 - DNA, 25 bp, Rattus norvegicus
gagttactgatgaggctgctggcaa

SEQ ID NO: 355707 - DNA, 25 bp, Rattus norvegicus
gagttactgatgtggctgctggcaa

SEQ ID NO: 355708 - DNA, 25 bp, Rattus norvegicus
gagttactgcatagactattggaaa

SEQ ID NO: 355709 - DNA, 25 bp, Rattus norvegicus
gagttactgcattgactattggaaa

SEQ ID NO: 355710 - DNA, 25 bp, Rattus norvegicus
gagttactgctgagcccacgaggaa

SEQ ID NO: 355711 - DNA, 25 bp, Rattus norvegicus
gagttactgctgtgcccacgaggaa

SEQ ID NO: 355712 - DNA, 25 bp, Rattus norvegicus
gagttactggccagggcttttgaac

SEQ ID NO: 355713 - DNA, 25 bp, Rattus norvegicus
gagttactggcctgggcttttgaac

SEQ ID NO: 355714 - DNA, 25 bp, Rattus norvegicus
gagttactgggaaagccggcattct

SEQ ID NO: 355715 - DNA, 25 bp, Rattus norvegicus
gagttactgggatagccggcattct

SEQ ID NO: 355716 - DNA, 25 bp, Rattus norvegicus
gagttactggttactttgatccaaa

SEQ ID NO: 355717 - DNA, 25 bp, Rattus norvegicus
gagttactggtttctttgatccaaa

SEQ ID NO: 355718 - DNA, 25 bp, Rattus norvegicus
gagttactgtcacaatggcggccaa

SEQ ID NO: 355719 - DNA, 25 bp, Rattus norvegicus
gagttactgtcagaatggcggccaa

SEQ ID NO: 355720 - DNA, 25 bp, Rattus norvegicus
gagttacttcttctcatcttacaaa

SEQ ID NO: 355721 - DNA, 25 bp, Rattus norvegicus
gagttacttcttgtcatcttacaaa

SEQ ID NO: 355722 - DNA, 25 bp, Rattus norvegicus
gagttacttgccatgttgctgagaa

SEQ ID NO: 355723 - DNA, 25 bp, Rattus norvegicus
gagttacttgccttgttgctgagaa

SEQ ID NO: 355724 - DNA, 25 bp, Rattus norvegicus
gagttactttagcacagttactgtt

SEQ ID NO: 355725 - DNA, 25 bp, Rattus norvegicus
gagttactttaggacagttactgtt

SEQ ID NO: 355726 - DNA, 25 bp, Rattus norvegicus
gagttagaagccatcctagtacagt

SEQ ID NO: 355727 - DNA, 25 bp, Rattus norvegicus
gagttagaagcccagcaaagcaaac

SEQ ID NO: 355728 - DNA, 25 bp, Rattus norvegicus
gagttagaagccgagcaaagcaaac

SEQ ID NO: 355729 - DNA, 25 bp, Rattus norvegicus
gagttagaagccttcctagtacagt

SEQ ID NO: 355730 - DNA, 25 bp, Rattus norvegicus
gagttagacactacagccaggccac

SEQ ID NO: 355731 - DNA, 25 bp, Rattus norvegicus
gagttagacacttcagccaggccac

SEQ ID NO: 355732 - DNA, 25 bp, Rattus norvegicus
gagttagacagtcatgagccatcat

SEQ ID NO: 355733 - DNA, 25 bp, Rattus norvegicus
gagttagacagtgatgagccatcat

SEQ ID NO: 355734 - DNA, 25 bp, Rattus norvegicus
gagttagaccctcagaaggcagcct

SEQ ID NO: 355735 - DNA, 25 bp, Rattus norvegicus
gagttagaccctgagaaggcagcct

SEQ ID NO: 355736 - DNA, 25 bp, Rattus norvegicus
gagttagagaacaacccttgggagt

SEQ ID NO: 355737 - DNA, 25 bp, Rattus norvegicus
gagttagagaactacccttgggagt

SEQ ID NO: 355738 - DNA, 25 bp, Rattus norvegicus
gagttagaggtcagccagttctctt

SEQ ID NO: 355739 - DNA, 25 bp, Rattus norvegicus
gagttagaggtctgccagttctctt

SEQ ID NO: 355740 - DNA, 25 bp, Rattus norvegicus
gagttagagtccacattcatccaag

SEQ ID NO: 355741 - DNA, 25 bp, Rattus norvegicus
gagttagagtcctcattcatccaag

SEQ ID NO: 355742 - DNA, 25 bp, Rattus norvegicus
gagttagagttcagcctgggttaca

SEQ ID NO: 355743 - DNA, 25 bp, Rattus norvegicus
gagttagagttctgcctgggttaca

SEQ ID NO: 355744 - DNA, 25 bp, Rattus norvegicus
gagttagatgagcagacacccattc

SEQ ID NO: 355745 - DNA, 25 bp, Rattus norvegicus
gagttagatgaggagacacccattc

SEQ ID NO: 355746 - DNA, 25 bp, Rattus norvegicus
gagttagcagcaccgtggatgtcac

SEQ ID NO: 355747 - DNA, 25 bp, Rattus norvegicus
gagttagcagcagcgtggatgtcac

SEQ ID NO: 355748 - DNA, 25 bp, Rattus norvegicus
gagttagcagggatcaacagcattt

SEQ ID NO: 355749 - DNA, 25 bp, Rattus norvegicus
gagttagcagggttcaacagcattt

SEQ ID NO: 355750 - DNA, 25 bp, Rattus norvegicus
gagttagccactacgagatcatcag

SEQ ID NO: 355751 - DNA, 25 bp, Rattus norvegicus
gagttagccacttcgagatcatcag

SEQ ID NO: 355752 - DNA, 25 bp, Rattus norvegicus
gagttagccccaaggatcatatccc

SEQ ID NO: 355753 - DNA, 25 bp, Rattus norvegicus
gagttagccccatggatcatatccc

SEQ ID NO: 355754 - DNA, 25 bp, Rattus norvegicus
gagttagctcccagatccaaagtga

SEQ ID NO: 355755 - DNA, 25 bp, Rattus norvegicus
gagttagctccctgatccaaagtga

SEQ ID NO: 355756 - DNA, 25 bp, Rattus norvegicus
gagttaggaagtcccctacgcatgt

SEQ ID NO: 355757 - DNA, 25 bp, Rattus norvegicus
gagttaggaagtgccctacgcatgt

SEQ ID NO: 355758 - DNA, 25 bp, Rattus norvegicus
gagttaggaatcaagcacagtaaga

SEQ ID NO: 355759 - DNA, 25 bp, Rattus norvegicus
gagttaggaatctagcacagtaaga

SEQ ID NO: 355760 - DNA, 25 bp, Rattus norvegicus
gagttaggctctcgctcagttccca

SEQ ID NO: 355761 - DNA, 25 bp, Rattus norvegicus
gagttaggctctggctcagttccca

SEQ ID NO: 355762 - DNA, 25 bp, Rattus norvegicus
gagttaggctggacgattgcccgcc

SEQ ID NO: 355763 - DNA, 25 bp, Rattus norvegicus
gagttaggctggtcgattgcccgcc

SEQ ID NO: 355764 - DNA, 25 bp, Rattus norvegicus
gagttagggagcacccagactgcta

SEQ ID NO: 355765 - DNA, 25 bp, Rattus norvegicus
gagttagggagctcccagactgcta

SEQ ID NO: 355766 - DNA, 25 bp, Rattus norvegicus
gagttagtccccatgtgagcctcaa

SEQ ID NO: 355767 - DNA, 25 bp, Rattus norvegicus
gagttagtccccttgtgagcctcaa

SEQ ID NO: 355768 - DNA, 25 bp, Rattus norvegicus
gagttagtctatccttgttcatgaa

SEQ ID NO: 355769 - DNA, 25 bp, Rattus norvegicus
gagttagtctatgcttgttcatgaa

SEQ ID NO: 355770 - DNA, 25 bp, Rattus norvegicus
gagttagtctgcatgtctgtaggct

SEQ ID NO: 355771 - DNA, 25 bp, Rattus norvegicus
gagttagtctgcttgtctgtaggct

SEQ ID NO: 355772 - DNA, 25 bp, Rattus norvegicus
gagttagtgaccatcacttcggttt

SEQ ID NO: 355773 - DNA, 25 bp, Rattus norvegicus
gagttagtgaccttcacttcggttt

SEQ ID NO: 355774 - DNA, 25 bp, Rattus norvegicus
gagttagtgcacaaacatcgctagc

SEQ ID NO: 355775 - DNA, 25 bp, Rattus norvegicus
gagttagtgcactaacatcgctagc

SEQ ID NO: 355776 - DNA, 25 bp, Rattus norvegicus
gagttagttgtaagcaccgatatca

SEQ ID NO: 355777 - DNA, 25 bp, Rattus norvegicus
gagttagttgtatgcaccgatatca

SEQ ID NO: 355778 - DNA, 25 bp, Rattus norvegicus
gagttataaaggatcagccccgcct

SEQ ID NO: 355779 - DNA, 25 bp, Rattus norvegicus
gagttataaaggttcagccccgcct

SEQ ID NO: 355780 - DNA, 25 bp, Rattus norvegicus
gagttatagcagctcatctgccata

SEQ ID NO: 355781 - DNA, 25 bp, Rattus norvegicus
gagttatagcaggtcatctgccata

SEQ ID NO: 355782 - DNA, 25 bp, Rattus norvegicus
gagttatagctgctcttgccttgta

SEQ ID NO: 355783 - DNA, 25 bp, Rattus norvegicus
gagttatagctggtcttgccttgta

SEQ ID NO: 355784 - DNA, 25 bp, Rattus norvegicus
gagttatagtatatcaagtgttgca

SEQ ID NO: 355785 - DNA, 25 bp, Rattus norvegicus
gagttatagtatttcaagtgttgca

SEQ ID NO: 355786 - DNA, 25 bp, Rattus norvegicus
gagttatcatgtctttccctcttgc

SEQ ID NO: 355787 - DNA, 25 bp, Rattus norvegicus
gagttatcatgtgtttccctcttgc

SEQ ID NO: 355788 - DNA, 25 bp, Rattus norvegicus
gagttatccctgctatatattgcaa

SEQ ID NO: 355789 - DNA, 25 bp, Rattus norvegicus
gagttatccctggtatatattgcaa

SEQ ID NO: 355790 - DNA, 25 bp, Rattus norvegicus
gagttatcctcacaatcacctagtg

SEQ ID NO: 355791 - DNA, 25 bp, Rattus norvegicus
gagttatcctcagaatcacctagtg

SEQ ID NO: 355792 - DNA, 25 bp, Rattus norvegicus
gagttatctaccactggagctggga

SEQ ID NO: 355793 - DNA, 25 bp, Rattus norvegicus
gagttatctacctctggagctggga

SEQ ID NO: 355794 - DNA, 25 bp, Rattus norvegicus
gagttatctatgcaacctatgtcac

SEQ ID NO: 355795 - DNA, 25 bp, Rattus norvegicus
gagttatctatggaacctatgtcac

SEQ ID NO: 355796 - DNA, 25 bp, Rattus norvegicus
gagttatctgtgacctccaagtcat

SEQ ID NO: 355797 - DNA, 25 bp, Rattus norvegicus
gagttatctgtgtcctccaagtcat

SEQ ID NO: 355798 - DNA, 25 bp, Rattus norvegicus
gagttatgctcccaggtctgtaatc

SEQ ID NO: 355799 - DNA, 25 bp, Rattus norvegicus
gagttatgctccgaggtctgtaatc

SEQ ID NO: 355800 - DNA, 25 bp, Rattus norvegicus
gagttatgctttagtattttcagaa

SEQ ID NO: 355801 - DNA, 25 bp, Rattus norvegicus
gagttatgcttttgtattttcagaa

SEQ ID NO: 355802 - DNA, 25 bp, Rattus norvegicus
gagttatggcggatctccttgcaca

SEQ ID NO: 355803 - DNA, 25 bp, Rattus norvegicus
gagttatggcggttctccttgcaca

SEQ ID NO: 355804 - DNA, 25 bp, Rattus norvegicus
gagttatggctcaccaaacggcttt

SEQ ID NO: 355805 - DNA, 25 bp, Rattus norvegicus
gagttatggctctccaaacggcttt

SEQ ID NO: 355806 - DNA, 25 bp, Rattus norvegicus
gagttatggctgagaccggctccca

SEQ ID NO: 355807 - DNA, 25 bp, Rattus norvegicus
gagttatggctgtgaccggctccca

SEQ ID NO: 355808 - DNA, 25 bp, Rattus norvegicus
gagttatggtatatctgtatcagtg

SEQ ID NO: 355809 - DNA, 25 bp, Rattus norvegicus
gagttatggtatttctgtatcagtg

SEQ ID NO: 355810 - DNA, 25 bp, Rattus norvegicus
gagttatgttcacctgaatcccaca

SEQ ID NO: 355811 - DNA, 25 bp, Rattus norvegicus
gagttatgttcagctgaatcccaca

SEQ ID NO: 355812 - DNA, 25 bp, Rattus norvegicus
gagttatgttttccaatctctaaga

SEQ ID NO: 355813 - DNA, 25 bp, Rattus norvegicus
gagttatgttttgcaatctctaaga

SEQ ID NO: 355814 - DNA, 25 bp, Rattus norvegicus
gagttattcagcagcacggacggct

SEQ ID NO: 355815 - DNA, 25 bp, Rattus norvegicus
gagttattcagctgcacggacggct

SEQ ID NO: 355816 - DNA, 25 bp, Rattus norvegicus
gagttattcgtcactctgaggaagg

SEQ ID NO: 355817 - DNA, 25 bp, Rattus norvegicus
gagttattcgtctctctgaggaagg

SEQ ID NO: 355818 - DNA, 25 bp, Rattus norvegicus
gagttattggtcacttctcatcaac

SEQ ID NO: 355819 - DNA, 25 bp, Rattus norvegicus
gagttattggtctcttctcatcaac

SEQ ID NO: 355820 - DNA, 25 bp, Rattus norvegicus
gagttatttacacacatccggagaa

SEQ ID NO: 355821 - DNA, 25 bp, Rattus norvegicus
gagttatttacagacatccggagaa

SEQ ID NO: 355822 - DNA, 25 bp, Rattus norvegicus
gagttatttcttaagttctgcactt

SEQ ID NO: 355823 - DNA, 25 bp, Rattus norvegicus
gagttatttcttatagtctcttcct

SEQ ID NO: 355824 - DNA, 25 bp, Rattus norvegicus
gagttatttctttagttctgcactt

SEQ ID NO: 355825 - DNA, 25 bp, Rattus norvegicus
gagttatttcttttagtctcttcct

SEQ ID NO: 355826 - DNA, 25 bp, Rattus norvegicus
gagttattttcgacttggtctgtgt

SEQ ID NO: 355827 - DNA, 25 bp, Rattus norvegicus
gagttattttcgtcttggtctgtgt

SEQ ID NO: 355828 - DNA, 25 bp, Rattus norvegicus
gagttattttgacattggcacttac

SEQ ID NO: 355829 - DNA, 25 bp, Rattus norvegicus
gagttattttgagattggcacttac

SEQ ID NO: 355830 - DNA, 25 bp, Rattus norvegicus
gagttatttttaatcctgaccacga

SEQ ID NO: 355831 - DNA, 25 bp, Rattus norvegicus
gagttatttttattcctgaccacga

SEQ ID NO: 355832 - DNA, 25 bp, Rattus norvegicus
gagttcaaacctacagataacccta

SEQ ID NO: 355833 - DNA, 25 bp, Rattus norvegicus
gagttcaaaccttcagataacccta

SEQ ID NO: 355834 - DNA, 25 bp, Rattus norvegicus
gagttcaaaggccttttctacttgt

SEQ ID NO: 355835 - DNA, 25 bp, Rattus norvegicus
gagttcaaaggcgttttctacttgt

SEQ ID NO: 355836 - DNA, 25 bp, Rattus norvegicus
gagttcaacaagagttcccttacct

SEQ ID NO: 355837 - DNA, 25 bp, Rattus norvegicus
gagttcaacaagtgttcccttacct

SEQ ID NO: 355838 - DNA, 25 bp, Rattus norvegicus
gagttcaacagcaacagagtctgct

SEQ ID NO: 355839 - DNA, 25 bp, Rattus norvegicus
gagttcaacagctacagagtctgct

SEQ ID NO: 355840 - DNA, 25 bp, Rattus norvegicus
gagttcaaccgaccgatcgatgcat

SEQ ID NO: 355841 - DNA, 25 bp, Rattus norvegicus
gagttcaaccgagcgatcgatgcat

SEQ ID NO: 355842 - DNA, 25 bp, Rattus norvegicus
gagttcaagatcatcagctgcgtag

SEQ ID NO: 355843 - DNA, 25 bp, Rattus norvegicus
gagttcaagatcttcagctgcgtag

SEQ ID NO: 355844 - DNA, 25 bp, Rattus norvegicus
gagttcaaggacagcgagagtaata

SEQ ID NO: 355845 - DNA, 25 bp, Rattus norvegicus
gagttcaaggactgcgagagtaata

SEQ ID NO: 355846 - DNA, 25 bp, Rattus norvegicus
gagttcaagtacacgtgtccacaca

SEQ ID NO: 355847 - DNA, 25 bp, Rattus norvegicus
gagttcaagtactcgtgtccacaca

SEQ ID NO: 355848 - DNA, 25 bp, Rattus norvegicus
gagttcaagtcacgattggaagcat

SEQ ID NO: 355849 - DNA, 25 bp, Rattus norvegicus
gagttcaagtcaggattggaagcat

SEQ ID NO: 355850 - DNA, 25 bp, Rattus norvegicus
gagttcaagtccaccactagagcag

SEQ ID NO: 355851 - DNA, 25 bp, Rattus norvegicus
gagttcaagtcctccactagagcag

SEQ ID NO: 355852 - DNA, 25 bp, Rattus norvegicus
gagttcaagtctcaagcagcctttg

SEQ ID NO: 355853 - DNA, 25 bp, Rattus norvegicus
gagttcaagtctgaagcagcctttg

SEQ ID NO: 355854 - DNA, 25 bp, Rattus norvegicus
gagttcaatccaagaaacccacaga

SEQ ID NO: 355855 - DNA, 25 bp, Rattus norvegicus
gagttcaatccatgaaacccacaga

SEQ ID NO: 355856 - DNA, 25 bp, Rattus norvegicus
gagttcaatcttcatatcacacgtt

SEQ ID NO: 355857 - DNA, 25 bp, Rattus norvegicus
gagttcaatcttgatatcacacgtt

SEQ ID NO: 355858 - DNA, 25 bp, Rattus norvegicus
gagttcaatgttagtcaccacctgt

SEQ ID NO: 355859 - DNA, 25 bp, Rattus norvegicus
gagttcaatgtttgtcaccacctgt

SEQ ID NO: 355860 - DNA, 25 bp, Rattus norvegicus
gagttcacacatccacaggctcatg

SEQ ID NO: 355861 - DNA, 25 bp, Rattus norvegicus
gagttcacacatgcacaggctcatg

SEQ ID NO: 355862 - DNA, 25 bp, Rattus norvegicus
gagttcacagacagagccaaagctt

SEQ ID NO: 355863 - DNA, 25 bp, Rattus norvegicus
gagttcacagactgagccaaagctt

SEQ ID NO: 355864 - DNA, 25 bp, Rattus norvegicus
gagttcacatacacagcaaagctaa

SEQ ID NO: 355865 - DNA, 25 bp, Rattus norvegicus
gagttcacatactcagcaaagctaa

SEQ ID NO: 355866 - DNA, 25 bp, Rattus norvegicus
gagttcacatgtattctcatgtttt

SEQ ID NO: 355867 - DNA, 25 bp, Rattus norvegicus
gagttcacatgttttctcatgtttt

SEQ ID NO: 355868 - DNA, 25 bp, Rattus norvegicus
gagttcaccaagatgctccctagaa

SEQ ID NO: 355869 - DNA, 25 bp, Rattus norvegicus
gagttcaccaagttgctccctagaa

SEQ ID NO: 355870 - DNA, 25 bp, Rattus norvegicus
gagttcaccaccctggcaagaagtg

SEQ ID NO: 355871 - DNA, 25 bp, Rattus norvegicus
gagttcaccaccgtggcaagaagtg

SEQ ID NO: 355872 - DNA, 25 bp, Rattus norvegicus
gagttcaccatgcttgcattagtta

SEQ ID NO: 355873 - DNA, 25 bp, Rattus norvegicus
gagttcaccatggttgcattagtta

SEQ ID NO: 355874 - DNA, 25 bp, Rattus norvegicus
gagttcacccacaaaggagcagaaa

SEQ ID NO: 355875 - DNA, 25 bp, Rattus norvegicus
gagttcacccactaaggagcagaaa

SEQ ID NO: 355876 - DNA, 25 bp, Rattus norvegicus
gagttcaccccacttctctgtgaat

SEQ ID NO: 355877 - DNA, 25 bp, Rattus norvegicus
gagttcaccccagttctctgtgaat

SEQ ID NO: 355878 - DNA, 25 bp, Rattus norvegicus
gagttcacccgaagccacaagagga

SEQ ID NO: 355879 - DNA, 25 bp, Rattus norvegicus
gagttcacccgatgccacaagagga

SEQ ID NO: 355880 - DNA, 25 bp, Rattus norvegicus
gagttcacctagaaaaccatctgtt

SEQ ID NO: 355881 - DNA, 25 bp, Rattus norvegicus
gagttcacctagtaaaccatctgtt

SEQ ID NO: 355882 - DNA, 25 bp, Rattus norvegicus
gagttcacctcaaacgggttgacct

SEQ ID NO: 355883 - DNA, 25 bp, Rattus norvegicus
gagttcacctcatacgggttgacct

SEQ ID NO: 355884 - DNA, 25 bp, Rattus norvegicus
gagttcaccttgcatggccgggcta

SEQ ID NO: 355885 - DNA, 25 bp, Rattus norvegicus
gagttcaccttggatggccgggcta

SEQ ID NO: 355886 - DNA, 25 bp, Rattus norvegicus
gagttcactcctaggataaggttgt

SEQ ID NO: 355887 - DNA, 25 bp, Rattus norvegicus
gagttcactccttggataaggttgt

SEQ ID NO: 355888 - DNA, 25 bp, Rattus norvegicus
gagttcactgaacatatcgacacaa

SEQ ID NO: 355889 - DNA, 25 bp, Rattus norvegicus
gagttcactgaagatatcgacacaa

SEQ ID NO: 355890 - DNA, 25 bp, Rattus norvegicus
gagttcactgacacagagggccacc

SEQ ID NO: 355891 - DNA, 25 bp, Rattus norvegicus
gagttcactgactcagagggccacc

SEQ ID NO: 355892 - DNA, 25 bp, Rattus norvegicus
gagttcactgagacgttgcagttac

SEQ ID NO: 355893 - DNA, 25 bp, Rattus norvegicus
gagttcactgagtcgttgcagttac

SEQ ID NO: 355894 - DNA, 25 bp, Rattus norvegicus
gagttcactgtactggctttcattt

SEQ ID NO: 355895 - DNA, 25 bp, Rattus norvegicus
gagttcactgtagtggctttcattt

SEQ ID NO: 355896 - DNA, 25 bp, Rattus norvegicus
gagttcactgttaaatctcttcagt

SEQ ID NO: 355897 - DNA, 25 bp, Rattus norvegicus
gagttcactgtttaatctcttcagt

SEQ ID NO: 355898 - DNA, 25 bp, Rattus norvegicus
gagttcacttggcaggcatgcgtac

SEQ ID NO: 355899 - DNA, 25 bp, Rattus norvegicus
gagttcacttgggaggcatgcgtac

SEQ ID NO: 355900 - DNA, 25 bp, Rattus norvegicus
gagttcagacagagtagccccagtg

SEQ ID NO: 355901 - DNA, 25 bp, Rattus norvegicus
gagttcagacagtgtagccccagtg

SEQ ID NO: 355902 - DNA, 25 bp, Rattus norvegicus
gagttcagaccccaggcaggaagat

SEQ ID NO: 355903 - DNA, 25 bp, Rattus norvegicus
gagttcagacccgaggcaggaagat

SEQ ID NO: 355904 - DNA, 25 bp, Rattus norvegicus
gagttcagaggaaaccacattccca

SEQ ID NO: 355905 - DNA, 25 bp, Rattus norvegicus
gagttcagaggataccacattccca

SEQ ID NO: 355906 - DNA, 25 bp, Rattus norvegicus
gagttcagaggcattgggccactta

SEQ ID NO: 355907 - DNA, 25 bp, Rattus norvegicus
gagttcagaggctttgggccactta

SEQ ID NO: 355908 - DNA, 25 bp, Rattus norvegicus
gagttcagccgaactacggtggtac

SEQ ID NO: 355909 - DNA, 25 bp, Rattus norvegicus
gagttcagccgatctacggtggtac

SEQ ID NO: 355910 - DNA, 25 bp, Rattus norvegicus
gagttcaggaagattgttcttttct

SEQ ID NO: 355911 - DNA, 25 bp, Rattus norvegicus
gagttcaggaagtttgttcttttct

SEQ ID NO: 355912 - DNA, 25 bp, Rattus norvegicus
gagttcaggactctggcaagccttc

SEQ ID NO: 355913 - DNA, 25 bp, Rattus norvegicus
gagttcaggactgtggcaagccttc

SEQ ID NO: 355914 - DNA, 25 bp, Rattus norvegicus
gagttcagggctatcctgggctata

SEQ ID NO: 355915 - DNA, 25 bp, Rattus norvegicus
gagttcagggctttcctgggctata

SEQ ID NO: 355916 - DNA, 25 bp, Rattus norvegicus
gagttcaggtccagagtgagttcca

SEQ ID NO: 355917 - DNA, 25 bp, Rattus norvegicus
gagttcaggtcctgagtgagttcca

SEQ ID NO: 355918 - DNA, 25 bp, Rattus norvegicus
gagttcaggtcgacagacttgtgca

SEQ ID NO: 355919 - DNA, 25 bp, Rattus norvegicus
gagttcaggtcgtcagacttgtgca

SEQ ID NO: 355920 - DNA, 25 bp, Rattus norvegicus
gagttcaggtgtatccaacacttag

SEQ ID NO: 355921 - DNA, 25 bp, Rattus norvegicus
gagttcaggtgtttccaacacttag

SEQ ID NO: 355922 - DNA, 25 bp, Rattus norvegicus
gagttcagtcatatagaagtcacct

SEQ ID NO: 355923 - DNA, 25 bp, Rattus norvegicus
gagttcagtcatcacttgctgttgt

SEQ ID NO: 355924 - DNA, 25 bp, Rattus norvegicus
gagttcagtcatgacttgctgttgt

SEQ ID NO: 355925 - DNA, 25 bp, Rattus norvegicus
gagttcagtcatttagaagtcacct

SEQ ID NO: 355926 - DNA, 25 bp, Rattus norvegicus
gagttcagtgctagcctggatggca

SEQ ID NO: 355927 - DNA, 25 bp, Rattus norvegicus
gagttcagtgcttgcctggatggca

SEQ ID NO: 355928 - DNA, 25 bp, Rattus norvegicus
gagttcagttctccccgtttgagaa

SEQ ID NO: 355929 - DNA, 25 bp, Rattus norvegicus
gagttcagttctgcccgtttgagaa

SEQ ID NO: 355930 - DNA, 25 bp, Rattus norvegicus
gagttcatactgagtgtcctgtgga

SEQ ID NO: 355931 - DNA, 25 bp, Rattus norvegicus
gagttcatactgtgtgtcctgtgga

SEQ ID NO: 355932 - DNA, 25 bp, Rattus norvegicus
gagttcatagcaaccaagagtcagg

SEQ ID NO: 355933 - DNA, 25 bp, Rattus norvegicus
gagttcatagcatccaagagtcagg

SEQ ID NO: 355934 - DNA, 25 bp, Rattus norvegicus
gagttcatccaaatgtcagtcacgt

SEQ ID NO: 355935 - DNA, 25 bp, Rattus norvegicus
gagttcatccaattgtcagtcacgt

SEQ ID NO: 355936 - DNA, 25 bp, Rattus norvegicus
gagttcatcccacctaaaggcctgt

SEQ ID NO: 355937 - DNA, 25 bp, Rattus norvegicus
gagttcatcccagctaaaggcctgt

SEQ ID NO: 355938 - DNA, 25 bp, Rattus norvegicus
gagttcatccgacacattctcctga

SEQ ID NO: 355939 - DNA, 25 bp, Rattus norvegicus
gagttcatccgagacattctcctga

SEQ ID NO: 355940 - DNA, 25 bp, Rattus norvegicus
gagttcatcctgatatacaatggaa

SEQ ID NO: 355941 - DNA, 25 bp, Rattus norvegicus
gagttcatcctgttatacaatggaa

SEQ ID NO: 355942 - DNA, 25 bp, Rattus norvegicus
gagttcatccttatcacactggtaa

SEQ ID NO: 355943 - DNA, 25 bp, Rattus norvegicus
gagttcatccttttcacactggtaa

SEQ ID NO: 355944 - DNA, 25 bp, Rattus norvegicus
gagttcatcgtgaacctgctgggag

SEQ ID NO: 355945 - DNA, 25 bp, Rattus norvegicus
gagttcatcgtgtacctgctgggag

SEQ ID NO: 355946 - DNA, 25 bp, Rattus norvegicus
gagttcatgaaacacctcagcaaag

SEQ ID NO: 355947 - DNA, 25 bp, Rattus norvegicus
gagttcatgaaagacctcagcaaag

SEQ ID NO: 355948 - DNA, 25 bp, Rattus norvegicus
gagttcatgactatacttctgtttg

SEQ ID NO: 355949 - DNA, 25 bp, Rattus norvegicus
gagttcatgactttacttctgtttg

SEQ ID NO: 355950 - DNA, 25 bp, Rattus norvegicus
gagttcatgatccttgcttgatatc

SEQ ID NO: 355951 - DNA, 25 bp, Rattus norvegicus
gagttcatgatcgttgcttgatatc

SEQ ID NO: 355952 - DNA, 25 bp, Rattus norvegicus
gagttcatgccactggagaccttct

SEQ ID NO: 355953 - DNA, 25 bp, Rattus norvegicus
gagttcatgccagtggagaccttct

SEQ ID NO: 355954 - DNA, 25 bp, Rattus norvegicus
gagttcatgcctaacgtggtgttta

SEQ ID NO: 355955 - DNA, 25 bp, Rattus norvegicus
gagttcatgccttacgtggtgttta

SEQ ID NO: 355956 - DNA, 25 bp, Rattus norvegicus
gagttcatgtagatcaggtggttgt

SEQ ID NO: 355957 - DNA, 25 bp, Rattus norvegicus
gagttcatgtagttcaggtggttgt

SEQ ID NO: 355958 - DNA, 25 bp, Rattus norvegicus
gagttcatgttcatctaggcaagca

SEQ ID NO: 355959 - DNA, 25 bp, Rattus norvegicus
gagttcatgttcttctaggcaagca

SEQ ID NO: 355960 - DNA, 25 bp, Rattus norvegicus
gagttcattattagtttccacacac

SEQ ID NO: 355961 - DNA, 25 bp, Rattus norvegicus
gagttcattatttgtttccacacac

SEQ ID NO: 355962 - DNA, 25 bp, Rattus norvegicus
gagttcattcaaaccaagatgctgt

SEQ ID NO: 355963 - DNA, 25 bp, Rattus norvegicus
gagttcattcaatccaagatgctgt

SEQ ID NO: 355964 - DNA, 25 bp, Rattus norvegicus
gagttcattcctagagagtcacata

SEQ ID NO: 355965 - DNA, 25 bp, Rattus norvegicus
gagttcattcctcgtggaaaccctt

SEQ ID NO: 355966 - DNA, 25 bp, Rattus norvegicus
gagttcattcctggtggaaaccctt

SEQ ID NO: 355967 - DNA, 25 bp, Rattus norvegicus
gagttcattccttgagagtcacata

SEQ ID NO: 355968 - DNA, 25 bp, Rattus norvegicus
gagttcattgataattctccaaaat

SEQ ID NO: 355969 - DNA, 25 bp, Rattus norvegicus
gagttcattgattattctccaaaat

SEQ ID NO: 355970 - DNA, 25 bp, Rattus norvegicus
gagttcatttataccctgattcctc

SEQ ID NO: 355971 - DNA, 25 bp, Rattus norvegicus
gagttcatttattccctgattcctc

SEQ ID NO: 355972 - DNA, 25 bp, Rattus norvegicus
gagttcatttctacaggacagattc

SEQ ID NO: 355973 - DNA, 25 bp, Rattus norvegicus
gagttcatttcttcaggacagattc

SEQ ID NO: 355974 - DNA, 25 bp, Rattus norvegicus
gagttcatttgcacttctgaggaaa

SEQ ID NO: 355975 - DNA, 25 bp, Rattus norvegicus
gagttcatttgctcttctgaggaaa

SEQ ID NO: 355976 - DNA, 25 bp, Rattus norvegicus
gagttcattttgaatagctcaaaca

SEQ ID NO: 355977 - DNA, 25 bp, Rattus norvegicus
gagttcattttgtatagctcaaaca

SEQ ID NO: 355978 - DNA, 25 bp, Rattus norvegicus
gagttcatttttcttgctgcaacca

SEQ ID NO: 355979 - DNA, 25 bp, Rattus norvegicus
gagttcatttttgttgctgcaacca

SEQ ID NO: 355980 - DNA, 25 bp, Rattus norvegicus
gagttccaaaatagccactgtagca

SEQ ID NO: 355981 - DNA, 25 bp, Rattus norvegicus
gagttccaaaattgccactgtagca

SEQ ID NO: 355982 - DNA, 25 bp, Rattus norvegicus
gagttccaacttagcttgggctgca

SEQ ID NO: 355983 - DNA, 25 bp, Rattus norvegicus
gagttccaactttgcttgggctgca

SEQ ID NO: 355984 - DNA, 25 bp, Rattus norvegicus
gagttccaaggtcaaacctcctttg

SEQ ID NO: 355985 - DNA, 25 bp, Rattus norvegicus
gagttccaaggtgaaacctcctttg

SEQ ID NO: 355986 - DNA, 25 bp, Rattus norvegicus
gagttccacaggcacacatccacaa

SEQ ID NO: 355987 - DNA, 25 bp, Rattus norvegicus
gagttccacagggacacatccacaa

SEQ ID NO: 355988 - DNA, 25 bp, Rattus norvegicus
gagttccacagtattacaccaccaa

SEQ ID NO: 355989 - DNA, 25 bp, Rattus norvegicus
gagttccacagtcgcgtggagtata

SEQ ID NO: 355990 - DNA, 25 bp, Rattus norvegicus
gagttccacagtggcgtggagtata

SEQ ID NO: 355991 - DNA, 25 bp, Rattus norvegicus
gagttccacagttttacaccaccaa

SEQ ID NO: 355992 - DNA, 25 bp, Rattus norvegicus
gagttccacattctggtgtcatcag

SEQ ID NO: 355993 - DNA, 25 bp, Rattus norvegicus
gagttccacattgtggtgtcatcag

SEQ ID NO: 355994 - DNA, 25 bp, Rattus norvegicus
gagttccaccacatttgctaaagta

SEQ ID NO: 355995 - DNA, 25 bp, Rattus norvegicus
gagttccaccacttttgctaaagta

SEQ ID NO: 355996 - DNA, 25 bp, Rattus norvegicus
gagttccacccactatggagtgttt

SEQ ID NO: 355997 - DNA, 25 bp, Rattus norvegicus
gagttccacccagtatggagtgttt

SEQ ID NO: 355998 - DNA, 25 bp, Rattus norvegicus
gagttccaccgcagtaggcacagtg

SEQ ID NO: 355999 - DNA, 25 bp, Rattus norvegicus
gagttccaccgctgtaggcacagtg

SEQ ID NO: 356000 - DNA, 25 bp, Rattus norvegicus
gagttccacttcaacaagtacctaa

SEQ ID NO: 356001 - DNA, 25 bp, Rattus norvegicus
gagttccacttctacaagtacctaa

SEQ ID NO: 356002 - DNA, 25 bp, Rattus norvegicus
gagttccagacaaattttccgatca

SEQ ID NO: 356003 - DNA, 25 bp, Rattus norvegicus
gagttccagacatattttccgatca

SEQ ID NO: 356004 - DNA, 25 bp, Rattus norvegicus
gagttccagcacacttaggactgta

SEQ ID NO: 356005 - DNA, 25 bp, Rattus norvegicus
gagttccagcactcttaggactgta

SEQ ID NO: 356006 - DNA, 25 bp, Rattus norvegicus
gagttccagcagactcttctgacat

SEQ ID NO: 356007 - DNA, 25 bp, Rattus norvegicus
gagttccagcagtctcttctgacat

SEQ ID NO: 356008 - DNA, 25 bp, Rattus norvegicus
gagttccagcctagtagccagcaag

SEQ ID NO: 356009 - DNA, 25 bp, Rattus norvegicus
gagttccagccttgtagccagcaag

SEQ ID NO: 356010 - DNA, 25 bp, Rattus norvegicus
gagttccaggatatgacggcggtcc

SEQ ID NO: 356011 - DNA, 25 bp, Rattus norvegicus
gagttccaggatttgacggcggtcc

SEQ ID NO: 356012 - DNA, 25 bp, Rattus norvegicus
gagttccaggctaatgcgacctctc

SEQ ID NO: 356013 - DNA, 25 bp, Rattus norvegicus
gagttccaggcttatgcgacctctc

SEQ ID NO: 356014 - DNA, 25 bp, Rattus norvegicus
gagttccagggaagctcccagctga

SEQ ID NO: 356015 - DNA, 25 bp, Rattus norvegicus
gagttccagggatgctcccagctga

SEQ ID NO: 356016 - DNA, 25 bp, Rattus norvegicus
gagttccatatgcacaacattgaat

SEQ ID NO: 356017 - DNA, 25 bp, Rattus norvegicus
gagttccatatggacaacattgaat

SEQ ID NO: 356018 - DNA, 25 bp, Rattus norvegicus
gagttccatccccagaactgtatga

SEQ ID NO: 356019 - DNA, 25 bp, Rattus norvegicus
gagttccatcccgagaactgtatga

SEQ ID NO: 356020 - DNA, 25 bp, Rattus norvegicus
gagttccatctcactcatcaaagga

SEQ ID NO: 356021 - DNA, 25 bp, Rattus norvegicus
gagttccatctcatttgttggctta

SEQ ID NO: 356022 - DNA, 25 bp, Rattus norvegicus
gagttccatctctctcatcaaagga

SEQ ID NO: 356023 - DNA, 25 bp, Rattus norvegicus
gagttccatctcttttgttggctta

SEQ ID NO: 356024 - DNA, 25 bp, Rattus norvegicus
gagttccatcttcgcgtggcctctg

SEQ ID NO: 356025 - DNA, 25 bp, Rattus norvegicus
gagttccatcttggcgtggcctctg

SEQ ID NO: 356026 - DNA, 25 bp, Rattus norvegicus
gagttccatgtccaatcagagtcct

SEQ ID NO: 356027 - DNA, 25 bp, Rattus norvegicus
gagttccatgtcgaatcagagtcct

SEQ ID NO: 356028 - DNA, 25 bp, Rattus norvegicus
gagttccatgtgctctcttgaaggt

SEQ ID NO: 356029 - DNA, 25 bp, Rattus norvegicus
gagttccatgtggtctcttgaaggt

SEQ ID NO: 356030 - DNA, 25 bp, Rattus norvegicus
gagttccattccacttgttaacgac

SEQ ID NO: 356031 - DNA, 25 bp, Rattus norvegicus
gagttccattcctcttgttaacgac

SEQ ID NO: 356032 - DNA, 25 bp, Rattus norvegicus
gagttccattgcaactgcagcagtc

SEQ ID NO: 356033 - DNA, 25 bp, Rattus norvegicus
gagttccattgctactgcagcagtc

SEQ ID NO: 356034 - DNA, 25 bp, Rattus norvegicus
gagttccattgtcttttctttccga

SEQ ID NO: 356035 - DNA, 25 bp, Rattus norvegicus
gagttccattgtgttttctttccga

SEQ ID NO: 356036 - DNA, 25 bp, Rattus norvegicus
gagttccatttaaccttacatatag

SEQ ID NO: 356037 - DNA, 25 bp, Rattus norvegicus
gagttccatttatccttacatatag

SEQ ID NO: 356038 - DNA, 25 bp, Rattus norvegicus
gagttcccaacgaggacggtctact

SEQ ID NO: 356039 - DNA, 25 bp, Rattus norvegicus
gagttcccaacgtggacggtctact

SEQ ID NO: 356040 - DNA, 25 bp, Rattus norvegicus
gagttcccagaactgtaccggtttg

SEQ ID NO: 356041 - DNA, 25 bp, Rattus norvegicus
gagttcccagaagtgtaccggtttg

SEQ ID NO: 356042 - DNA, 25 bp, Rattus norvegicus
gagttcccagcactggcttggccag

SEQ ID NO: 356043 - DNA, 25 bp, Rattus norvegicus
gagttcccagcagtggcttggccag

SEQ ID NO: 356044 - DNA, 25 bp, Rattus norvegicus
gagttcccaggtaacccagcagata

SEQ ID NO: 356045 - DNA, 25 bp, Rattus norvegicus
gagttcccaggttacccagcagata

SEQ ID NO: 356046 - DNA, 25 bp, Rattus norvegicus
gagttccccaaacttatcaactgta

SEQ ID NO: 356047 - DNA, 25 bp, Rattus norvegicus
gagttccccaaagttatcaactgta

SEQ ID NO: 356048 - DNA, 25 bp, Rattus norvegicus
gagttccctgaacaaaagatgccat

SEQ ID NO: 356049 - DNA, 25 bp, Rattus norvegicus
gagttccctgaagaaaagatgccat

SEQ ID NO: 356050 - DNA, 25 bp, Rattus norvegicus
gagttccctggacccatggaggcat

SEQ ID NO: 356051 - DNA, 25 bp, Rattus norvegicus
gagttccctggaccttagtgatggc

SEQ ID NO: 356052 - DNA, 25 bp, Rattus norvegicus
gagttccctggagccatggaggcat

SEQ ID NO: 356053 - DNA, 25 bp, Rattus norvegicus
gagttccctggagcttagtgatggc

SEQ ID NO: 356054 - DNA, 25 bp, Rattus norvegicus
gagttccctggcaccagcgggagtt

SEQ ID NO: 356055 - DNA, 25 bp, Rattus norvegicus
gagttccctggctccagcgggagtt

SEQ ID NO: 356056 - DNA, 25 bp, Rattus norvegicus
gagttccgctgaatcccagtaattg

SEQ ID NO: 356057 - DNA, 25 bp, Rattus norvegicus
gagttccgctgattcccagtaattg

SEQ ID NO: 356058 - DNA, 25 bp, Rattus norvegicus
gagttccggaacatcaagatcatct

SEQ ID NO: 356059 - DNA, 25 bp, Rattus norvegicus
gagttccggaacttcaagatcatct

SEQ ID NO: 356060 - DNA, 25 bp, Rattus norvegicus
gagttccggccacatagacgtgttc

SEQ ID NO: 356061 - DNA, 25 bp, Rattus norvegicus
gagttccggccagatagacgtgttc

SEQ ID NO: 356062 - DNA, 25 bp, Rattus norvegicus
gagttccggcggagttctaaatggc

SEQ ID NO: 356063 - DNA, 25 bp, Rattus norvegicus
gagttccggcggtgttctaaatggc

SEQ ID NO: 356064 - DNA, 25 bp, Rattus norvegicus
gagttccgggatagtctaccatagc

SEQ ID NO: 356065 - DNA, 25 bp, Rattus norvegicus
gagttccgggattgtctaccatagc

SEQ ID NO: 356066 - DNA, 25 bp, Rattus norvegicus
gagttccgggtcatggagtagcctc

SEQ ID NO: 356067 - DNA, 25 bp, Rattus norvegicus
gagttccgggtcttggagtagcctc

SEQ ID NO: 356068 - DNA, 25 bp, Rattus norvegicus
gagttccgtgacctgatgaaagcct

SEQ ID NO: 356069 - DNA, 25 bp, Rattus norvegicus
gagttccgtgacgtgatgaaagcct

SEQ ID NO: 356070 - DNA, 25 bp, Rattus norvegicus
gagttcctaatgaagcacacagcct

SEQ ID NO: 356071 - DNA, 25 bp, Rattus norvegicus
gagttcctaatgtagcacacagcct

SEQ ID NO: 356072 - DNA, 25 bp, Rattus norvegicus
gagttcctacagcacctgagggagt

SEQ ID NO: 356073 - DNA, 25 bp, Rattus norvegicus
gagttcctacaggacctgagggagt

SEQ ID NO: 356074 - DNA, 25 bp, Rattus norvegicus
gagttcctaccgcaccagatggaag

SEQ ID NO: 356075 - DNA, 25 bp, Rattus norvegicus
gagttcctaccggaccagatggaag

SEQ ID NO: 356076 - DNA, 25 bp, Rattus norvegicus
gagttcctacttctggtgactggca

SEQ ID NO: 356077 - DNA, 25 bp, Rattus norvegicus
gagttcctacttgtggtgactggca

SEQ ID NO: 356078 - DNA, 25 bp, Rattus norvegicus
gagttcctaggaagtttttcttcac

SEQ ID NO: 356079 - DNA, 25 bp, Rattus norvegicus
gagttcctaggatgtttttcttcac

SEQ ID NO: 356080 - DNA, 25 bp, Rattus norvegicus
gagttcctagtgagccatgtgtgga

SEQ ID NO: 356081 - DNA, 25 bp, Rattus norvegicus
gagttcctagtgtgccatgtgtgga

SEQ ID NO: 356082 - DNA, 25 bp, Rattus norvegicus
gagttcctatccacccaaggagttt

SEQ ID NO: 356083 - DNA, 25 bp, Rattus norvegicus
gagttcctatcctcccaaggagttt

SEQ ID NO: 356084 - DNA, 25 bp, Rattus norvegicus
gagttcctatgcacagctacagtgt

SEQ ID NO: 356085 - DNA, 25 bp, Rattus norvegicus
gagttcctatgctcagctacagtgt

SEQ ID NO: 356086 - DNA, 25 bp, Rattus norvegicus
gagttcctatggaaacctttcattg

SEQ ID NO: 356087 - DNA, 25 bp, Rattus norvegicus
gagttcctatggtaacctttcattg

SEQ ID NO: 356088 - DNA, 25 bp, Rattus norvegicus
gagttcctcagactctaactctgtg

SEQ ID NO: 356089 - DNA, 25 bp, Rattus norvegicus
gagttcctcagagtctaactctgtg

SEQ ID NO: 356090 - DNA, 25 bp, Rattus norvegicus
gagttcctccttctctttgaagttc

SEQ ID NO: 356091 - DNA, 25 bp, Rattus norvegicus
gagttcctccttgtctttgaagttc

SEQ ID NO: 356092 - DNA, 25 bp, Rattus norvegicus
gagttcctctatacgtatttatctg

SEQ ID NO: 356093 - DNA, 25 bp, Rattus norvegicus
gagttcctctattcgtatttatctg

SEQ ID NO: 356094 - DNA, 25 bp, Rattus norvegicus
gagttcctctcgaatggccagttac

SEQ ID NO: 356095 - DNA, 25 bp, Rattus norvegicus
gagttcctctcgtatggccagttac

SEQ ID NO: 356096 - DNA, 25 bp, Rattus norvegicus
gagttcctgaacagtctggtctaca

SEQ ID NO: 356097 - DNA, 25 bp, Rattus norvegicus
gagttcctgaactgtctggtctaca

SEQ ID NO: 356098 - DNA, 25 bp, Rattus norvegicus
gagttcctgaagctagcctgagtca

SEQ ID NO: 356099 - DNA, 25 bp, Rattus norvegicus
gagttcctgaaggtagcctgagtca

SEQ ID NO: 356100 - DNA, 25 bp, Rattus norvegicus
gagttcctgatacttctgcttctgc

SEQ ID NO: 356101 - DNA, 25 bp, Rattus norvegicus
gagttcctgatagttctgcttctgc

SEQ ID NO: 356102 - DNA, 25 bp, Rattus norvegicus
gagttcctgcacaacgtcattgctg

SEQ ID NO: 356103 - DNA, 25 bp, Rattus norvegicus
gagttcctgcactacgtcattgctg

SEQ ID NO: 356104 - DNA, 25 bp, Rattus norvegicus
gagttcctgcgcatcatgaagaaga

SEQ ID NO: 356105 - DNA, 25 bp, Rattus norvegicus
gagttcctgcgcttcatgaagaaga

SEQ ID NO: 356106 - DNA, 25 bp, Rattus norvegicus
gagttcctgcttagggagaagacta

SEQ ID NO: 356107 - DNA, 25 bp, Rattus norvegicus
gagttcctgctttgggagaagacta

SEQ ID NO: 356108 - DNA, 25 bp, Rattus norvegicus
gagttcctgtttaactgtcccttat

SEQ ID NO: 356109 - DNA, 25 bp, Rattus norvegicus
gagttcctgttttactgtcccttat

SEQ ID NO: 356110 - DNA, 25 bp, Rattus norvegicus
gagttccttacaacgttcctggaat

SEQ ID NO: 356111 - DNA, 25 bp, Rattus norvegicus
gagttccttacatcgttcctggaat

SEQ ID NO: 356112 - DNA, 25 bp, Rattus norvegicus
gagttccttagacgaggaccctgca

SEQ ID NO: 356113 - DNA, 25 bp, Rattus norvegicus
gagttccttagaggaggaccctgca

SEQ ID NO: 356114 - DNA, 25 bp, Rattus norvegicus
gagttccttatacgcgtcatgcgtt

SEQ ID NO: 356115 - DNA, 25 bp, Rattus norvegicus
gagttccttataggcgtcatgcgtt

SEQ ID NO: 356116 - DNA, 25 bp, Rattus norvegicus
gagttccttatgatactacggtgaa

SEQ ID NO: 356117 - DNA, 25 bp, Rattus norvegicus
gagttccttatgttactacggtgaa

SEQ ID NO: 356118 - DNA, 25 bp, Rattus norvegicus
gagttccttcctcagagcggcagag

SEQ ID NO: 356119 - DNA, 25 bp, Rattus norvegicus
gagttccttcctgagagcggcagag

SEQ ID NO: 356120 - DNA, 25 bp, Rattus norvegicus
gagttccttgaaccaaatctgatct

SEQ ID NO: 356121 - DNA, 25 bp, Rattus norvegicus
gagttccttgaagcaaatctgatct

SEQ ID NO: 356122 - DNA, 25 bp, Rattus norvegicus
gagttccttgggacagcacgtggac

SEQ ID NO: 356123 - DNA, 25 bp, Rattus norvegicus
gagttccttgggtcagcacgtggac

SEQ ID NO: 356124 - DNA, 25 bp, Rattus norvegicus
gagttcctttatcgttctgcacaat

SEQ ID NO: 356125 - DNA, 25 bp, Rattus norvegicus
gagttcctttatggttctgcacaat

SEQ ID NO: 356126 - DNA, 25 bp, Rattus norvegicus
gagttcctttgtatctgtgagattt

SEQ ID NO: 356127 - DNA, 25 bp, Rattus norvegicus
gagttcctttgtttctgtgagattt

SEQ ID NO: 356128 - DNA, 25 bp, Rattus norvegicus
gagttcgaaagtccattcctgttgc

SEQ ID NO: 356129 - DNA, 25 bp, Rattus norvegicus
gagttcgaaagtgcattcctgttgc

SEQ ID NO: 356130 - DNA, 25 bp, Rattus norvegicus
gagttcgaagatccagctccgtggc

SEQ ID NO: 356131 - DNA, 25 bp, Rattus norvegicus
gagttcgaagatgcagctccgtggc

SEQ ID NO: 356132 - DNA, 25 bp, Rattus norvegicus
gagttcgaagctctttacgaccagc

SEQ ID NO: 356133 - DNA, 25 bp, Rattus norvegicus
gagttcgaagctgtttacgaccagc

SEQ ID NO: 356134 - DNA, 25 bp, Rattus norvegicus
gagttcgacacgatcgtcagacata

SEQ ID NO: 356135 - DNA, 25 bp, Rattus norvegicus
gagttcgacacgttcgtcagacata

SEQ ID NO: 356136 - DNA, 25 bp, Rattus norvegicus
gagttcgacataactgctgctgaca

SEQ ID NO: 356137 - DNA, 25 bp, Rattus norvegicus
gagttcgacatatctgctgctgaca

SEQ ID NO: 356138 - DNA, 25 bp, Rattus norvegicus
gagttcgacatcatgacctaaagag

SEQ ID NO: 356139 - DNA, 25 bp, Rattus norvegicus
gagttcgacatcttgacctaaagag

SEQ ID NO: 356140 - DNA, 25 bp, Rattus norvegicus
gagttcgagaccaatctgagcgcca

SEQ ID NO: 356141 - DNA, 25 bp, Rattus norvegicus
gagttcgagacctatctgagcgcca

SEQ ID NO: 356142 - DNA, 25 bp, Rattus norvegicus
gagttcgaggacagtctgagctata

SEQ ID NO: 356143 - DNA, 25 bp, Rattus norvegicus
gagttcgaggactgtctgagctata

SEQ ID NO: 356144 - DNA, 25 bp, Rattus norvegicus
gagttcgaggctcacttcaggacag

SEQ ID NO: 356145 - DNA, 25 bp, Rattus norvegicus
gagttcgaggctgacttcaggacag

SEQ ID NO: 356146 - DNA, 25 bp, Rattus norvegicus
gagttcgagttcatctttggtcaca

SEQ ID NO: 356147 - DNA, 25 bp, Rattus norvegicus
gagttcgagttcttctttggtcaca

SEQ ID NO: 356148 - DNA, 25 bp, Rattus norvegicus
gagttcgcacctaaaggcgcatctg

SEQ ID NO: 356149 - DNA, 25 bp, Rattus norvegicus
gagttcgcaccttaaggcgcatctg

SEQ ID NO: 356150 - DNA, 25 bp, Rattus norvegicus
gagttcgccatccagtccatcaaga

SEQ ID NO: 356151 - DNA, 25 bp, Rattus norvegicus
gagttcgccatcgagtccatcaaga

SEQ ID NO: 356152 - DNA, 25 bp, Rattus norvegicus
gagttcgcctaccttggctaacttg

SEQ ID NO: 356153 - DNA, 25 bp, Rattus norvegicus
gagttcgcctacgttggctaacttg

SEQ ID NO: 356154 - DNA, 25 bp, Rattus norvegicus
gagttcgctctcaaagctcaactta

SEQ ID NO: 356155 - DNA, 25 bp, Rattus norvegicus
gagttcgctctctaagctcaactta

SEQ ID NO: 356156 - DNA, 25 bp, Rattus norvegicus
gagttcggatctccgtgactggtca

SEQ ID NO: 356157 - DNA, 25 bp, Rattus norvegicus
gagttcggatctgcgtgactggtca

SEQ ID NO: 356158 - DNA, 25 bp, Rattus norvegicus
gagttcggctgtacctggaggacct

SEQ ID NO: 356159 - DNA, 25 bp, Rattus norvegicus
gagttcggctgttcctggaggacct

SEQ ID NO: 356160 - DNA, 25 bp, Rattus norvegicus
gagttcgggtctacagactctgatc

SEQ ID NO: 356161 - DNA, 25 bp, Rattus norvegicus
gagttcgggtcttcagactctgatc

SEQ ID NO: 356162 - DNA, 25 bp, Rattus norvegicus
gagttcgtcaagcagcgccgtagca

SEQ ID NO: 356163 - DNA, 25 bp, Rattus norvegicus
gagttcgtcaagctcaagtccgaca

SEQ ID NO: 356164 - DNA, 25 bp, Rattus norvegicus
gagttcgtcaaggagcgccgtagca

SEQ ID NO: 356165 - DNA, 25 bp, Rattus norvegicus
gagttcgtcaaggtcaagtccgaca

SEQ ID NO: 356166 - DNA, 25 bp, Rattus norvegicus
gagttcgtcacaagagtcacatatg

SEQ ID NO: 356167 - DNA, 25 bp, Rattus norvegicus
gagttcgtcacatgagtcacatatg

SEQ ID NO: 356168 - DNA, 25 bp, Rattus norvegicus
gagttcgtctcaattatgcacttat

SEQ ID NO: 356169 - DNA, 25 bp, Rattus norvegicus
gagttcgtctcatttatgcacttat

SEQ ID NO: 356170 - DNA, 25 bp, Rattus norvegicus
gagttcgtgggtcctgtaatcgcca

SEQ ID NO: 356171 - DNA, 25 bp, Rattus norvegicus
gagttcgtgggtgctgtaatcgcca

SEQ ID NO: 356172 - DNA, 25 bp, Rattus norvegicus
gagttcgtttagatgccactttttt

SEQ ID NO: 356173 - DNA, 25 bp, Rattus norvegicus
gagttcgtttagttgccactttttt

SEQ ID NO: 356174 - DNA, 25 bp, Rattus norvegicus
gagttctaacatcgtgcatctctgc

SEQ ID NO: 356175 - DNA, 25 bp, Rattus norvegicus
gagttctaacatggtgcatctctgc

SEQ ID NO: 356176 - DNA, 25 bp, Rattus norvegicus
gagttctaacgccaggtttgttcag

SEQ ID NO: 356177 - DNA, 25 bp, Rattus norvegicus
gagttctaacgcgaggtttgttcag

SEQ ID NO: 356178 - DNA, 25 bp, Rattus norvegicus
gagttctaatatatttcatttctgt

SEQ ID NO: 356179 - DNA, 25 bp, Rattus norvegicus
gagttctaatatttttcatttctgt

SEQ ID NO: 356180 - DNA, 25 bp, Rattus norvegicus
gagttctaatgaagccacccatggg

SEQ ID NO: 356181 - DNA, 25 bp, Rattus norvegicus
gagttctaatgatgccacccatggg

SEQ ID NO: 356182 - DNA, 25 bp, Rattus norvegicus
gagttctacaaccttcagggccctg

SEQ ID NO: 356183 - DNA, 25 bp, Rattus norvegicus
gagttctacaacgttcagggccctg

SEQ ID NO: 356184 - DNA, 25 bp, Rattus norvegicus
gagttctacgctcatgacattgccc

SEQ ID NO: 356185 - DNA, 25 bp, Rattus norvegicus
gagttctacgctgatgacattgccc

SEQ ID NO: 356186 - DNA, 25 bp, Rattus norvegicus
gagttctactgaagtcaatacgtgt

SEQ ID NO: 356187 - DNA, 25 bp, Rattus norvegicus
gagttctactgatgtcaatacgtgt

SEQ ID NO: 356188 - DNA, 25 bp, Rattus norvegicus
gagttctactgtagggaggtcctaa

SEQ ID NO: 356189 - DNA, 25 bp, Rattus norvegicus
gagttctactgttgggaggtcctaa

SEQ ID NO: 356190 - DNA, 25 bp, Rattus norvegicus
gagttctagaagctccaggatgcat

SEQ ID NO: 356191 - DNA, 25 bp, Rattus norvegicus
gagttctagaaggtccaggatgcat

SEQ ID NO: 356192 - DNA, 25 bp, Rattus norvegicus
gagttctagaatcagcctttagctt

SEQ ID NO: 356193 - DNA, 25 bp, Rattus norvegicus
gagttctagaatgagcctttagctt

SEQ ID NO: 356194 - DNA, 25 bp, Rattus norvegicus
gagttctaggaaacgactacccggc

SEQ ID NO: 356195 - DNA, 25 bp, Rattus norvegicus
gagttctaggaatcgactacccggc

SEQ ID NO: 356196 - DNA, 25 bp, Rattus norvegicus
gagttctaggacagttaggtccact

SEQ ID NO: 356197 - DNA, 25 bp, Rattus norvegicus
gagttctaggactgttaggtccact

SEQ ID NO: 356198 - DNA, 25 bp, Rattus norvegicus
gagttctaggcaaccctggacatca

SEQ ID NO: 356199 - DNA, 25 bp, Rattus norvegicus
gagttctaggcatccctggacatca

SEQ ID NO: 356200 - DNA, 25 bp, Rattus norvegicus
gagttctaggctcgccaaggcaaca

SEQ ID NO: 356201 - DNA, 25 bp, Rattus norvegicus
gagttctaggctggccaaggcaaca

SEQ ID NO: 356202 - DNA, 25 bp, Rattus norvegicus
gagttctaggtcatatccagagcat

SEQ ID NO: 356203 - DNA, 25 bp, Rattus norvegicus
gagttctaggtcttatccagagcat

SEQ ID NO: 356204 - DNA, 25 bp, Rattus norvegicus
gagttctatcttacttccagtctaa

SEQ ID NO: 356205 - DNA, 25 bp, Rattus norvegicus
gagttctatctttcttccagtctaa

SEQ ID NO: 356206 - DNA, 25 bp, Rattus norvegicus
gagttctatgacagcagttgtatca

SEQ ID NO: 356207 - DNA, 25 bp, Rattus norvegicus
gagttctatgactgcagttgtatca

SEQ ID NO: 356208 - DNA, 25 bp, Rattus norvegicus
gagttctatgatctggtctctgaaa

SEQ ID NO: 356209 - DNA, 25 bp, Rattus norvegicus
gagttctatgatgtggtctctgaaa

SEQ ID NO: 356210 - DNA, 25 bp, Rattus norvegicus
gagttctatgccaatgagatctcca

SEQ ID NO: 356211 - DNA, 25 bp, Rattus norvegicus
gagttctatgcctatgagatctcca

SEQ ID NO: 356212 - DNA, 25 bp, Rattus norvegicus
gagttctattctaggagcccagtga

SEQ ID NO: 356213 - DNA, 25 bp, Rattus norvegicus
gagttctattcttggagcccagtga

SEQ ID NO: 356214 - DNA, 25 bp, Rattus norvegicus
gagttctattttcgaattgtaccca

SEQ ID NO: 356215 - DNA, 25 bp, Rattus norvegicus
gagttctattttggaattgtaccca

SEQ ID NO: 356216 - DNA, 25 bp, Rattus norvegicus
gagttctcaaataccgacgtgcttt

SEQ ID NO: 356217 - DNA, 25 bp, Rattus norvegicus
gagttctcaaattccgacgtgcttt

SEQ ID NO: 356218 - DNA, 25 bp, Rattus norvegicus
gagttctcaagtacctctgcgatca

SEQ ID NO: 356219 - DNA, 25 bp, Rattus norvegicus
gagttctcaagttcctctgcgatca

SEQ ID NO: 356220 - DNA, 25 bp, Rattus norvegicus
gagttctcacatcctgtgtactggt

SEQ ID NO: 356221 - DNA, 25 bp, Rattus norvegicus
gagttctcacatgctgtgtactggt

SEQ ID NO: 356222 - DNA, 25 bp, Rattus norvegicus
gagttctcagacctgaccctaaggt

SEQ ID NO: 356223 - DNA, 25 bp, Rattus norvegicus
gagttctcagacgtgaccctaaggt

SEQ ID NO: 356224 - DNA, 25 bp, Rattus norvegicus
gagttctcagagaccgtgctgtata

SEQ ID NO: 356225 - DNA, 25 bp, Rattus norvegicus
gagttctcagagtccgtgctgtata

SEQ ID NO: 356226 - DNA, 25 bp, Rattus norvegicus
gagttctcagtgataactgccatga

SEQ ID NO: 356227 - DNA, 25 bp, Rattus norvegicus
gagttctcagtgttaactgccatga

SEQ ID NO: 356228 - DNA, 25 bp, Rattus norvegicus
gagttctcattgattctgttttaag

SEQ ID NO: 356229 - DNA, 25 bp, Rattus norvegicus
gagttctcattgtttctgttttaag

SEQ ID NO: 356230 - DNA, 25 bp, Rattus norvegicus
gagttctccacacttattttggacg

SEQ ID NO: 356231 - DNA, 25 bp, Rattus norvegicus
gagttctccacagttattttggacg

SEQ ID NO: 356232 - DNA, 25 bp, Rattus norvegicus
gagttctcccaacagctttgtgaat

SEQ ID NO: 356233 - DNA, 25 bp, Rattus norvegicus
gagttctcccaagagctttgtgaat

SEQ ID NO: 356234 - DNA, 25 bp, Rattus norvegicus
gagttctccccactgaagaatgctg

SEQ ID NO: 356235 - DNA, 25 bp, Rattus norvegicus
gagttctccccagtgaagaatgctg

SEQ ID NO: 356236 - DNA, 25 bp, Rattus norvegicus
gagttctcctcaatttattactaga

SEQ ID NO: 356237 - DNA, 25 bp, Rattus norvegicus
gagttctcctcattttattactaga

SEQ ID NO: 356238 - DNA, 25 bp, Rattus norvegicus
gagttctcctgacagtatgccttta

SEQ ID NO: 356239 - DNA, 25 bp, Rattus norvegicus
gagttctcctgagagtatgccttta

SEQ ID NO: 356240 - DNA, 25 bp, Rattus norvegicus
gagttctcgcttcctacagtgtcag

SEQ ID NO: 356241 - DNA, 25 bp, Rattus norvegicus
gagttctcgcttgctacagtgtcag

SEQ ID NO: 356242 - DNA, 25 bp, Rattus norvegicus
gagttctcggcaagatccaagtgac

SEQ ID NO: 356243 - DNA, 25 bp, Rattus norvegicus
gagttctcggcatgatccaagtgac

SEQ ID NO: 356244 - DNA, 25 bp, Rattus norvegicus
gagttctcggtgacatgtactgaca

SEQ ID NO: 356245 - DNA, 25 bp, Rattus norvegicus
gagttctcggtgtcatgtactgaca

SEQ ID NO: 356246 - DNA, 25 bp, Rattus norvegicus
gagttctctaggcttaatatccaca

SEQ ID NO: 356247 - DNA, 25 bp, Rattus norvegicus
gagttctctagggttaatatccaca

SEQ ID NO: 356248 - DNA, 25 bp, Rattus norvegicus
gagttctctctgcactgttgaatca

SEQ ID NO: 356249 - DNA, 25 bp, Rattus norvegicus
gagttctctctggactgttgaatca

SEQ ID NO: 356250 - DNA, 25 bp, Rattus norvegicus
gagttctctgacaaagcgacacaca

SEQ ID NO: 356251 - DNA, 25 bp, Rattus norvegicus
gagttctctgactaagcgacacaca

SEQ ID NO: 356252 - DNA, 25 bp, Rattus norvegicus
gagttctctgatcccctgtgtgcat

SEQ ID NO: 356253 - DNA, 25 bp, Rattus norvegicus
gagttctctgatgccctgtgtgcat

SEQ ID NO: 356254 - DNA, 25 bp, Rattus norvegicus
gagttctctgttcatttctggttta

SEQ ID NO: 356255 - DNA, 25 bp, Rattus norvegicus
gagttctctgttgatttctggttta

SEQ ID NO: 356256 - DNA, 25 bp, Rattus norvegicus
gagttctcttctccaaaatgtcgat

SEQ ID NO: 356257 - DNA, 25 bp, Rattus norvegicus
gagttctcttctgcaaaatgtcgat

SEQ ID NO: 356258 - DNA, 25 bp, Rattus norvegicus
gagttctgaactcgactggtcaatt

SEQ ID NO: 356259 - DNA, 25 bp, Rattus norvegicus
gagttctgaactggactggtcaatt

SEQ ID NO: 356260 - DNA, 25 bp, Rattus norvegicus
gagttctgaccgcttatggtgacat

SEQ ID NO: 356261 - DNA, 25 bp, Rattus norvegicus
gagttctgaccggttatggtgacat

SEQ ID NO: 356262 - DNA, 25 bp, Rattus norvegicus
gagttctgacttactgtttagtgca

SEQ ID NO: 356263 - DNA, 25 bp, Rattus norvegicus
gagttctgactttctgtttagtgca

SEQ ID NO: 356264 - DNA, 25 bp, Rattus norvegicus
gagttctgagaacgcagctaaggct

SEQ ID NO: 356265 - DNA, 25 bp, Rattus norvegicus
gagttctgagaaggcagctaaggct

SEQ ID NO: 356266 - DNA, 25 bp, Rattus norvegicus
gagttctgagtgctccttgcaagta

SEQ ID NO: 356267 - DNA, 25 bp, Rattus norvegicus
gagttctgagtggtccttgcaagta

SEQ ID NO: 356268 - DNA, 25 bp, Rattus norvegicus
gagttctgagttcctgcgcttcaaa

SEQ ID NO: 356269 - DNA, 25 bp, Rattus norvegicus
gagttctgagttctcctcaaacaga

SEQ ID NO: 356270 - DNA, 25 bp, Rattus norvegicus
gagttctgagttgctgcgcttcaaa

SEQ ID NO: 356271 - DNA, 25 bp, Rattus norvegicus
gagttctgagttgtcctcaaacaga

SEQ ID NO: 356272 - DNA, 25 bp, Rattus norvegicus
gagttctgcagcacagtatactgga

SEQ ID NO: 356273 - DNA, 25 bp, Rattus norvegicus
gagttctgcagctcagtatactgga

SEQ ID NO: 356274 - DNA, 25 bp, Rattus norvegicus
gagttctgcatcaaacttaaggcta

SEQ ID NO: 356275 - DNA, 25 bp, Rattus norvegicus
gagttctgcatctaacttaaggcta

SEQ ID NO: 356276 - DNA, 25 bp, Rattus norvegicus
gagttctgccaaccagacatgtctt

SEQ ID NO: 356277 - DNA, 25 bp, Rattus norvegicus
gagttctgccaagcagacatgtctt

SEQ ID NO: 356278 - DNA, 25 bp, Rattus norvegicus
gagttctgctatactcaccacacat

SEQ ID NO: 356279 - DNA, 25 bp, Rattus norvegicus
gagttctgctattctcaccacacat

SEQ ID NO: 356280 - DNA, 25 bp, Rattus norvegicus
gagttctggaatccgagtctgcgtc

SEQ ID NO: 356281 - DNA, 25 bp, Rattus norvegicus
gagttctggaatgcgagtctgcgtc

SEQ ID NO: 356282 - DNA, 25 bp, Rattus norvegicus
gagttctggtggaacatccaactga

SEQ ID NO: 356283 - DNA, 25 bp, Rattus norvegicus
gagttctggtggtacatccaactga

SEQ ID NO: 356284 - DNA, 25 bp, Rattus norvegicus
gagttctgtcaacagcttttcccac

SEQ ID NO: 356285 - DNA, 25 bp, Rattus norvegicus
gagttctgtcaagagcttttcccac

SEQ ID NO: 356286 - DNA, 25 bp, Rattus norvegicus
gagttctgtcagatgtccatgggtg

SEQ ID NO: 356287 - DNA, 25 bp, Rattus norvegicus
gagttctgtcagttgtccatgggtg

SEQ ID NO: 356288 - DNA, 25 bp, Rattus norvegicus
gagttctgtcatatccttagctatt

SEQ ID NO: 356289 - DNA, 25 bp, Rattus norvegicus
gagttctgtcatttccttagctatt

SEQ ID NO: 356290 - DNA, 25 bp, Rattus norvegicus
gagttctgtcctatctgtactttac

SEQ ID NO: 356291 - DNA, 25 bp, Rattus norvegicus
gagttctgtcctttctgtactttac

SEQ ID NO: 356292 - DNA, 25 bp, Rattus norvegicus
gagttctgtctccaggtgaatttta

SEQ ID NO: 356293 - DNA, 25 bp, Rattus norvegicus
gagttctgtctcgaggtgaatttta

SEQ ID NO: 356294 - DNA, 25 bp, Rattus norvegicus
gagttctgtctgattaggagttcaa

SEQ ID NO: 356295 - DNA, 25 bp, Rattus norvegicus
gagttctgtctgtttaggagttcaa

SEQ ID NO: 356296 - DNA, 25 bp, Rattus norvegicus
gagttctgtcttccatcttttgaaa

SEQ ID NO: 356297 - DNA, 25 bp, Rattus norvegicus
gagttctgtcttgcatcttttgaaa

SEQ ID NO: 356298 - DNA, 25 bp, Rattus norvegicus
gagttctgtgcaatattttccatta

SEQ ID NO: 356299 - DNA, 25 bp, Rattus norvegicus
gagttctgtgcattattttccatta

SEQ ID NO: 356300 - DNA, 25 bp, Rattus norvegicus
gagttctgtggtctcataggttttt

SEQ ID NO: 356301 - DNA, 25 bp, Rattus norvegicus
gagttctgtggtgtcataggttttt

SEQ ID NO: 356302 - DNA, 25 bp, Rattus norvegicus
gagttctgtgttacttcatttgttg

SEQ ID NO: 356303 - DNA, 25 bp, Rattus norvegicus
gagttctgtgtttcttcatttgttg

SEQ ID NO: 356304 - DNA, 25 bp, Rattus norvegicus
gagttctgttacagacagttctcat

SEQ ID NO: 356305 - DNA, 25 bp, Rattus norvegicus
gagttctgttactgacagttctcat

SEQ ID NO: 356306 - DNA, 25 bp, Rattus norvegicus
gagttctgttcgaatttctgactaa

SEQ ID NO: 356307 - DNA, 25 bp, Rattus norvegicus
gagttctgttcgtatttctgactaa

SEQ ID NO: 356308 - DNA, 25 bp, Rattus norvegicus
gagttctgtttcaatgcagaccctg

SEQ ID NO: 356309 - DNA, 25 bp, Rattus norvegicus
gagttctgtttctatgcagaccctg

SEQ ID NO: 356310 - DNA, 25 bp, Rattus norvegicus
gagttctgttttaaactctgtcact

SEQ ID NO: 356311 - DNA, 25 bp, Rattus norvegicus
gagttctgtttttaactctgtcact

SEQ ID NO: 356312 - DNA, 25 bp, Rattus norvegicus
gagttcttatctagtcaccaaccag

SEQ ID NO: 356313 - DNA, 25 bp, Rattus norvegicus
gagttcttatcttgtcaccaaccag

SEQ ID NO: 356314 - DNA, 25 bp, Rattus norvegicus
gagttcttcaagactcaggactgtt

SEQ ID NO: 356315 - DNA, 25 bp, Rattus norvegicus
gagttcttcaagtctcaggactgtt

SEQ ID NO: 356316 - DNA, 25 bp, Rattus norvegicus
gagttcttcaatcacctggatttgc

SEQ ID NO: 356317 - DNA, 25 bp, Rattus norvegicus
gagttcttcaatgacctggatttgc

SEQ ID NO: 356318 - DNA, 25 bp, Rattus norvegicus
gagttcttcacaaccagcctaaaac

SEQ ID NO: 356319 - DNA, 25 bp, Rattus norvegicus
gagttcttcacatccagcctaaaac

SEQ ID NO: 356320 - DNA, 25 bp, Rattus norvegicus
gagttcttcactattcttggtcatt

SEQ ID NO: 356321 - DNA, 25 bp, Rattus norvegicus
gagttcttcacttttcttggtcatt

SEQ ID NO: 356322 - DNA, 25 bp, Rattus norvegicus
gagttcttcagacaccttgactttg

SEQ ID NO: 356323 - DNA, 25 bp, Rattus norvegicus
gagttcttcagagaccttgactttg

SEQ ID NO: 356324 - DNA, 25 bp, Rattus norvegicus
gagttcttcagcaagccttcaaaca

SEQ ID NO: 356325 - DNA, 25 bp, Rattus norvegicus
gagttcttcagctagccttcaaaca

SEQ ID NO: 356326 - DNA, 25 bp, Rattus norvegicus
gagttcttcaggcacagaccagtat

SEQ ID NO: 356327 - DNA, 25 bp, Rattus norvegicus
gagttcttcagggacagaccagtat

SEQ ID NO: 356328 - DNA, 25 bp, Rattus norvegicus
gagttcttcagtacagaaagcggaa

SEQ ID NO: 356329 - DNA, 25 bp, Rattus norvegicus
gagttcttcagttcagaaagcggaa

SEQ ID NO: 356330 - DNA, 25 bp, Rattus norvegicus
gagttcttcataaaatggccgccta

SEQ ID NO: 356331 - DNA, 25 bp, Rattus norvegicus
gagttcttcatataatggccgccta

SEQ ID NO: 356332 - DNA, 25 bp, Rattus norvegicus
gagttcttcatcattgaatgttttc

SEQ ID NO: 356333 - DNA, 25 bp, Rattus norvegicus
gagttcttcatctttgaatgttttc

SEQ ID NO: 356334 - DNA, 25 bp, Rattus norvegicus
gagttcttctctacctgttctagaa

SEQ ID NO: 356335 - DNA, 25 bp, Rattus norvegicus
gagttcttctcttcctgttctagaa

SEQ ID NO: 356336 - DNA, 25 bp, Rattus norvegicus
gagttcttctgaacatcagtccagg

SEQ ID NO: 356337 - DNA, 25 bp, Rattus norvegicus
gagttcttctgatcatcagtccagg

SEQ ID NO: 356338 - DNA, 25 bp, Rattus norvegicus
gagttcttgagtatgttccagttga

SEQ ID NO: 356339 - DNA, 25 bp, Rattus norvegicus
gagttcttgagtttgttccagttga

SEQ ID NO: 356340 - DNA, 25 bp, Rattus norvegicus
gagttcttgggaacacaccgttttc

SEQ ID NO: 356341 - DNA, 25 bp, Rattus norvegicus
gagttcttgggatcacaccgttttc

SEQ ID NO: 356342 - DNA, 25 bp, Rattus norvegicus
gagttcttggtacttactcagtaaa

SEQ ID NO: 356343 - DNA, 25 bp, Rattus norvegicus
gagttcttggtagttactcagtaaa

SEQ ID NO: 356344 - DNA, 25 bp, Rattus norvegicus
gagttcttgtttcaagactctaaag

SEQ ID NO: 356345 - DNA, 25 bp, Rattus norvegicus
gagttcttgtttgaagactctaaag

SEQ ID NO: 356346 - DNA, 25 bp, Rattus norvegicus
gagttctttccacataagcagacac

SEQ ID NO: 356347 - DNA, 25 bp, Rattus norvegicus
gagttctttccagataagcagacac

SEQ ID NO: 356348 - DNA, 25 bp, Rattus norvegicus
gagttctttccgaaggctatttcaa

SEQ ID NO: 356349 - DNA, 25 bp, Rattus norvegicus
gagttctttccgtaggctatttcaa

SEQ ID NO: 356350 - DNA, 25 bp, Rattus norvegicus
gagttctttctgagtgatctatttt

SEQ ID NO: 356351 - DNA, 25 bp, Rattus norvegicus
gagttctttctgtgtgatctatttt

SEQ ID NO: 356352 - DNA, 25 bp, Rattus norvegicus
gagttctttcttcccatgagagact

SEQ ID NO: 356353 - DNA, 25 bp, Rattus norvegicus
gagttctttcttctgatttgcctga

SEQ ID NO: 356354 - DNA, 25 bp, Rattus norvegicus
gagttctttcttgccatgagagact

SEQ ID NO: 356355 - DNA, 25 bp, Rattus norvegicus
gagttctttcttgtgatttgcctga

SEQ ID NO: 356356 - DNA, 25 bp, Rattus norvegicus
gagttctttgacacctactatgtcc

SEQ ID NO: 356357 - DNA, 25 bp, Rattus norvegicus
gagttctttgactcctactatgtcc

SEQ ID NO: 356358 - DNA, 25 bp, Rattus norvegicus
gagttctttgagatctactttgtat

SEQ ID NO: 356359 - DNA, 25 bp, Rattus norvegicus
gagttctttgagttctactttgtat

SEQ ID NO: 356360 - DNA, 25 bp, Rattus norvegicus
gagttctttgggatttgacactgga

SEQ ID NO: 356361 - DNA, 25 bp, Rattus norvegicus
gagttctttgggttttgacactgga

SEQ ID NO: 356362 - DNA, 25 bp, Rattus norvegicus
gagttcttttgccatatcctactta

SEQ ID NO: 356363 - DNA, 25 bp, Rattus norvegicus
gagttcttttgcgatatcctactta

SEQ ID NO: 356364 - DNA, 25 bp, Rattus norvegicus
gagttgaacactactgtgctgatct

SEQ ID NO: 356365 - DNA, 25 bp, Rattus norvegicus
gagttgaacacttctgtgctgatct

SEQ ID NO: 356366 - DNA, 25 bp, Rattus norvegicus
gagttgaactcacgcgccaggtttt

SEQ ID NO: 356367 - DNA, 25 bp, Rattus norvegicus
gagttgaactcaggcgccaggtttt

SEQ ID NO: 356368 - DNA, 25 bp, Rattus norvegicus
gagttgaactggaaaattctctgag

SEQ ID NO: 356369 - DNA, 25 bp, Rattus norvegicus
gagttgaactggtaaattctctgag

SEQ ID NO: 356370 - DNA, 25 bp, Rattus norvegicus
gagttgaagccaccatttctagcat

SEQ ID NO: 356371 - DNA, 25 bp, Rattus norvegicus
gagttgaagccagcatttctagcat

SEQ ID NO: 356372 - DNA, 25 bp, Rattus norvegicus
gagttgaatctgatcagctgttatt

SEQ ID NO: 356373 - DNA, 25 bp, Rattus norvegicus
gagttgaatctgttcagctgttatt

SEQ ID NO: 356374 - DNA, 25 bp, Rattus norvegicus
gagttgaattaacccggcgtggatc

SEQ ID NO: 356375 - DNA, 25 bp, Rattus norvegicus
gagttgaattaagccggcgtggatc

SEQ ID NO: 356376 - DNA, 25 bp, Rattus norvegicus
gagttgaattctaccttcatgagaa

SEQ ID NO: 356377 - DNA, 25 bp, Rattus norvegicus
gagttgaattcttccttcatgagaa

SEQ ID NO: 356378 - DNA, 25 bp, Rattus norvegicus
gagttgacaactccattttcacatt

SEQ ID NO: 356379 - DNA, 25 bp, Rattus norvegicus
gagttgacaactgcattttcacatt

SEQ ID NO: 356380 - DNA, 25 bp, Rattus norvegicus
gagttgacatgtacctttactgtta

SEQ ID NO: 356381 - DNA, 25 bp, Rattus norvegicus
gagttgacatgttcctttactgtta

SEQ ID NO: 356382 - DNA, 25 bp, Rattus norvegicus
gagttgaccatcctgaacaacataa

SEQ ID NO: 356383 - DNA, 25 bp, Rattus norvegicus
gagttgaccatcgtgaacaacataa

SEQ ID NO: 356384 - DNA, 25 bp, Rattus norvegicus
gagttgaccattcctgagaagtttc

SEQ ID NO: 356385 - DNA, 25 bp, Rattus norvegicus
gagttgaccattgctgagaagtttc

SEQ ID NO: 356386 - DNA, 25 bp, Rattus norvegicus
gagttgaccccgaaaaatgccctca

SEQ ID NO: 356387 - DNA, 25 bp, Rattus norvegicus
gagttgaccccgtaaaatgccctca

SEQ ID NO: 356388 - DNA, 25 bp, Rattus norvegicus
gagttgacctacatctaaacagcaa

SEQ ID NO: 356389 - DNA, 25 bp, Rattus norvegicus
gagttgacctacttctaaacagcaa

SEQ ID NO: 356390 - DNA, 25 bp, Rattus norvegicus
gagttgaccttacattcttcccttg

SEQ ID NO: 356391 - DNA, 25 bp, Rattus norvegicus
gagttgaccttagattcttcccttg

SEQ ID NO: 356392 - DNA, 25 bp, Rattus norvegicus
gagttgactcatcgcactattgcta

SEQ ID NO: 356393 - DNA, 25 bp, Rattus norvegicus
gagttgactcatctttctctcatag

SEQ ID NO: 356394 - DNA, 25 bp, Rattus norvegicus
gagttgactcatggcactattgcta

SEQ ID NO: 356395 - DNA, 25 bp, Rattus norvegicus
gagttgactcatgtttctctcatag

SEQ ID NO: 356396 - DNA, 25 bp, Rattus norvegicus
gagttgactgaaccgcccacaggtg

SEQ ID NO: 356397 - DNA, 25 bp, Rattus norvegicus
gagttgactgaagcgcccacaggtg

SEQ ID NO: 356398 - DNA, 25 bp, Rattus norvegicus
gagttgagaaaaactctcttcagag

SEQ ID NO: 356399 - DNA, 25 bp, Rattus norvegicus
gagttgagaaaatctctcttcagag

SEQ ID NO: 356400 - DNA, 25 bp, Rattus norvegicus
gagttgagatgtctctttctggcat

SEQ ID NO: 356401 - DNA, 25 bp, Rattus norvegicus
gagttgagatgtgtctttctggcat

SEQ ID NO: 356402 - DNA, 25 bp, Rattus norvegicus
gagttgagcagtatatccagagtta

SEQ ID NO: 356403 - DNA, 25 bp, Rattus norvegicus
gagttgagcagtttatccagagtta

SEQ ID NO: 356404 - DNA, 25 bp, Rattus norvegicus
gagttgaggactccagttcatccct

SEQ ID NO: 356405 - DNA, 25 bp, Rattus norvegicus
gagttgaggactgcagttcatccct

SEQ ID NO: 356406 - DNA, 25 bp, Rattus norvegicus
gagttgaggtcaccaatcctgacat

SEQ ID NO: 356407 - DNA, 25 bp, Rattus norvegicus
gagttgaggtcagcaatcctgacat

SEQ ID NO: 356408 - DNA, 25 bp, Rattus norvegicus
gagttgatccggcaggtcaccatca

SEQ ID NO: 356409 - DNA, 25 bp, Rattus norvegicus
gagttgatccgggaggtcaccatca

SEQ ID NO: 356410 - DNA, 25 bp, Rattus norvegicus
gagttgatgtttcacctctgtcggt

SEQ ID NO: 356411 - DNA, 25 bp, Rattus norvegicus
gagttgatgtttgacctctgtcggt

SEQ ID NO: 356412 - DNA, 25 bp, Rattus norvegicus
gagttgattcccatgctgattttta

SEQ ID NO: 356413 - DNA, 25 bp, Rattus norvegicus
gagttgattcccttgctgattttta

SEQ ID NO: 356414 - DNA, 25 bp, Rattus norvegicus
gagttgattctgacgctgattcttt

SEQ ID NO: 356415 - DNA, 25 bp, Rattus norvegicus
gagttgattctgtcgctgattcttt

SEQ ID NO: 356416 - DNA, 25 bp, Rattus norvegicus
gagttgattgatcgcctgatcctgc

SEQ ID NO: 356417 - DNA, 25 bp, Rattus norvegicus
gagttgattgatggcctgatcctgc

SEQ ID NO: 356418 - DNA, 25 bp, Rattus norvegicus
gagttgatttccatcatgagttcat

SEQ ID NO: 356419 - DNA, 25 bp, Rattus norvegicus
gagttgatttccttcatgagttcat

SEQ ID NO: 356420 - DNA, 25 bp, Rattus norvegicus
gagttgcaagcaagtctgtgtatga

SEQ ID NO: 356421 - DNA, 25 bp, Rattus norvegicus
gagttgcaagcatgtctgtgtatga

SEQ ID NO: 356422 - DNA, 25 bp, Rattus norvegicus
gagttgcaaggacccagaggatcac

SEQ ID NO: 356423 - DNA, 25 bp, Rattus norvegicus
gagttgcaaggagccagaggatcac

SEQ ID NO: 356424 - DNA, 25 bp, Rattus norvegicus
gagttgcacacaattcaaatctaag

SEQ ID NO: 356425 - DNA, 25 bp, Rattus norvegicus
gagttgcacacatttcaaatctaag

SEQ ID NO: 356426 - DNA, 25 bp, Rattus norvegicus
gagttgcacttaaccaaaactattg

SEQ ID NO: 356427 - DNA, 25 bp, Rattus norvegicus
gagttgcacttatccaaaactattg

SEQ ID NO: 356428 - DNA, 25 bp, Rattus norvegicus
gagttgcactttacatgttaccagc

SEQ ID NO: 356429 - DNA, 25 bp, Rattus norvegicus
gagttgcactttactcctaactaaa

SEQ ID NO: 356430 - DNA, 25 bp, Rattus norvegicus
gagttgcacttttcatgttaccagc

SEQ ID NO: 356431 - DNA, 25 bp, Rattus norvegicus
gagttgcacttttctcctaactaaa

SEQ ID NO: 356432 - DNA, 25 bp, Rattus norvegicus
gagttgcagcaacttatcagccagc

SEQ ID NO: 356433 - DNA, 25 bp, Rattus norvegicus
gagttgcagcaagttatcagccagc

SEQ ID NO: 356434 - DNA, 25 bp, Rattus norvegicus
gagttgcaggagattataagctact

SEQ ID NO: 356435 - DNA, 25 bp, Rattus norvegicus
gagttgcaggagtttataagctact

SEQ ID NO: 356436 - DNA, 25 bp, Rattus norvegicus
gagttgcagtccatgaacatcatcc

SEQ ID NO: 356437 - DNA, 25 bp, Rattus norvegicus
gagttgcagtccttgaacatcatcc

SEQ ID NO: 356438 - DNA, 25 bp, Rattus norvegicus
gagttgcagttcagtgcactgagta

SEQ ID NO: 356439 - DNA, 25 bp, Rattus norvegicus
gagttgcagttctgtgcactgagta

SEQ ID NO: 356440 - DNA, 25 bp, Rattus norvegicus
gagttgcagtttacatcattacttt

SEQ ID NO: 356441 - DNA, 25 bp, Rattus norvegicus
gagttgcagttttcatcattacttt

SEQ ID NO: 356442 - DNA, 25 bp, Rattus norvegicus
gagttgcatattacttaagtgattg

SEQ ID NO: 356443 - DNA, 25 bp, Rattus norvegicus
gagttgcatatttcttaagtgattg

SEQ ID NO: 356444 - DNA, 25 bp, Rattus norvegicus
gagttgcatcccaaaagttcttgtg

SEQ ID NO: 356445 - DNA, 25 bp, Rattus norvegicus
gagttgcatccctaaagttcttgtg

SEQ ID NO: 356446 - DNA, 25 bp, Rattus norvegicus
gagttgcatctacatttcctgtttt

SEQ ID NO: 356447 - DNA, 25 bp, Rattus norvegicus
gagttgcatctagatttcctgtttt

SEQ ID NO: 356448 - DNA, 25 bp, Rattus norvegicus
gagttgcatgaaccatccttagtag

SEQ ID NO: 356449 - DNA, 25 bp, Rattus norvegicus
gagttgcatgaagcatccttagtag

SEQ ID NO: 356450 - DNA, 25 bp, Rattus norvegicus
gagttgcattctaccagatcttaat

SEQ ID NO: 356451 - DNA, 25 bp, Rattus norvegicus
gagttgcattcttccagatcttaat

SEQ ID NO: 356452 - DNA, 25 bp, Rattus norvegicus
gagttgccagttaccaagtctgctt

SEQ ID NO: 356453 - DNA, 25 bp, Rattus norvegicus
gagttgccagtttccaagtctgctt

SEQ ID NO: 356454 - DNA, 25 bp, Rattus norvegicus
gagttgcccaaacaaggtcccaagt

SEQ ID NO: 356455 - DNA, 25 bp, Rattus norvegicus
gagttgcccaaagaaggtcccaagt

SEQ ID NO: 356456 - DNA, 25 bp, Rattus norvegicus
gagttgcccaataccagggtcctgg

SEQ ID NO: 356457 - DNA, 25 bp, Rattus norvegicus
gagttgcccaattccagggtcctgg

SEQ ID NO: 356458 - DNA, 25 bp, Rattus norvegicus
gagttgccgccaacagactggcctt

SEQ ID NO: 356459 - DNA, 25 bp, Rattus norvegicus
gagttgccgccatcagactggcctt

SEQ ID NO: 356460 - DNA, 25 bp, Rattus norvegicus
gagttgcctgatcctcagagctttt

SEQ ID NO: 356461 - DNA, 25 bp, Rattus norvegicus
gagttgcctgatgctcagagctttt

SEQ ID NO: 356462 - DNA, 25 bp, Rattus norvegicus
gagttgcgactgaaactcttgccgc

SEQ ID NO: 356463 - DNA, 25 bp, Rattus norvegicus
gagttgcgactgtaactcttgccgc

SEQ ID NO: 356464 - DNA, 25 bp, Rattus norvegicus
gagttgctaactagactacccaaag

SEQ ID NO: 356465 - DNA, 25 bp, Rattus norvegicus
gagttgctaacttgactacccaaag

SEQ ID NO: 356466 - DNA, 25 bp, Rattus norvegicus
gagttgctaattctatggaaaccat

SEQ ID NO: 356467 - DNA, 25 bp, Rattus norvegicus
gagttgctaattgtatggaaaccat

SEQ ID NO: 356468 - DNA, 25 bp, Rattus norvegicus
gagttgctatcaaggctatcttata

SEQ ID NO: 356469 - DNA, 25 bp, Rattus norvegicus
gagttgctatcatggctatcttata

SEQ ID NO: 356470 - DNA, 25 bp, Rattus norvegicus
gagttgctcacgaactgtgactcag

SEQ ID NO: 356471 - DNA, 25 bp, Rattus norvegicus
gagttgctcacgtactgtgactcag

SEQ ID NO: 356472 - DNA, 25 bp, Rattus norvegicus
gagttgctccctatgaaggacgtca

SEQ ID NO: 356473 - DNA, 25 bp, Rattus norvegicus
gagttgctccctttgaaggacgtca

SEQ ID NO: 356474 - DNA, 25 bp, Rattus norvegicus
gagttgctcctgactcttgagacct

SEQ ID NO: 356475 - DNA, 25 bp, Rattus norvegicus
gagttgctcctgtctcttgagacct

SEQ ID NO: 356476 - DNA, 25 bp, Rattus norvegicus
gagttgctgaacagacgatatgcca

SEQ ID NO: 356477 - DNA, 25 bp, Rattus norvegicus
gagttgctgaactgacgatatgcca

SEQ ID NO: 356478 - DNA, 25 bp, Rattus norvegicus
gagttgctgactattgctgggaaat

SEQ ID NO: 356479 - DNA, 25 bp, Rattus norvegicus
gagttgctgacttttgctgggaaat

SEQ ID NO: 356480 - DNA, 25 bp, Rattus norvegicus
gagttgctggtcaccaatcatgtat

SEQ ID NO: 356481 - DNA, 25 bp, Rattus norvegicus
gagttgctggtctccaatcatgtat

SEQ ID NO: 356482 - DNA, 25 bp, Rattus norvegicus
gagttgcttctgcatccaacagcta

SEQ ID NO: 356483 - DNA, 25 bp, Rattus norvegicus
gagttgcttctggatccaacagcta

SEQ ID NO: 356484 - DNA, 25 bp, Rattus norvegicus
gagttgcttgctatgtctgagacct

SEQ ID NO: 356485 - DNA, 25 bp, Rattus norvegicus
gagttgcttgctttgtctgagacct

SEQ ID NO: 356486 - DNA, 25 bp, Rattus norvegicus
gagttgcttttgaacagtggccttc

SEQ ID NO: 356487 - DNA, 25 bp, Rattus norvegicus
gagttgcttttgtacagtggccttc

SEQ ID NO: 356488 - DNA, 25 bp, Rattus norvegicus
gagttggaaataatcgcctgtggaa

SEQ ID NO: 356489 - DNA, 25 bp, Rattus norvegicus
gagttggaaatattcgcctgtggaa

SEQ ID NO: 356490 - DNA, 25 bp, Rattus norvegicus
gagttggaaccaattgctctcgtct

SEQ ID NO: 356491 - DNA, 25 bp, Rattus norvegicus
gagttggaaccatttgctctcgtct

SEQ ID NO: 356492 - DNA, 25 bp, Rattus norvegicus
gagttggaacctaggcacagcctca

SEQ ID NO: 356493 - DNA, 25 bp, Rattus norvegicus
gagttggaaccttggcacagcctca

SEQ ID NO: 356494 - DNA, 25 bp, Rattus norvegicus
gagttggaacttcatggttaccaga

SEQ ID NO: 356495 - DNA, 25 bp, Rattus norvegicus
gagttggaacttgatggttaccaga

SEQ ID NO: 356496 - DNA, 25 bp, Rattus norvegicus
gagttggaagctactctgagctaca

SEQ ID NO: 356497 - DNA, 25 bp, Rattus norvegicus
gagttggaagcttctctgagctaca

SEQ ID NO: 356498 - DNA, 25 bp, Rattus norvegicus
gagttggaatttcgcctagcaaggc

SEQ ID NO: 356499 - DNA, 25 bp, Rattus norvegicus
gagttggaatttggcctagcaaggc

SEQ ID NO: 356500 - DNA, 25 bp, Rattus norvegicus
gagttggaccttcttctttgacata

SEQ ID NO: 356501 - DNA, 25 bp, Rattus norvegicus
gagttggaccttgttctttgacata

SEQ ID NO: 356502 - DNA, 25 bp, Rattus norvegicus
gagttggagatcacagctgtcccta

SEQ ID NO: 356503 - DNA, 25 bp, Rattus norvegicus
gagttggagatctcagctgtcccta

SEQ ID NO: 356504 - DNA, 25 bp, Rattus norvegicus
gagttggagcatagaaccacttcat

SEQ ID NO: 356505 - DNA, 25 bp, Rattus norvegicus
gagttggagcattgaaccacttcat

SEQ ID NO: 356506 - DNA, 25 bp, Rattus norvegicus
gagttggagcgaaatgtcacctcct

SEQ ID NO: 356507 - DNA, 25 bp, Rattus norvegicus
gagttggagcgatatgtcacctcct

SEQ ID NO: 356508 - DNA, 25 bp, Rattus norvegicus
gagttggaggatcctcggttccctc

SEQ ID NO: 356509 - DNA, 25 bp, Rattus norvegicus
gagttggaggatgctcggttccctc

SEQ ID NO: 356510 - DNA, 25 bp, Rattus norvegicus
gagttggagttgcaccccatggcca

SEQ ID NO: 356511 - DNA, 25 bp, Rattus norvegicus
gagttggagttggaccccatggcca

SEQ ID NO: 356512 - DNA, 25 bp, Rattus norvegicus
gagttggatgaccttttcgtgacag

SEQ ID NO: 356513 - DNA, 25 bp, Rattus norvegicus
gagttggatgacgttttcgtgacag

SEQ ID NO: 356514 - DNA, 25 bp, Rattus norvegicus
gagttggatgctcaggcaaacctcc

SEQ ID NO: 356515 - DNA, 25 bp, Rattus norvegicus
gagttggatgctgaggcaaacctcc

SEQ ID NO: 356516 - DNA, 25 bp, Rattus norvegicus
gagttggatggtccagttcctccga

SEQ ID NO: 356517 - DNA, 25 bp, Rattus norvegicus
gagttggatggtgcagttcctccga

SEQ ID NO: 356518 - DNA, 25 bp, Rattus norvegicus
gagttggatttgaagcaagcccaaa

SEQ ID NO: 356519 - DNA, 25 bp, Rattus norvegicus
gagttggatttgtagcaagcccaaa

SEQ ID NO: 356520 - DNA, 25 bp, Rattus norvegicus
gagttggcaaagaccttctttctaa

SEQ ID NO: 356521 - DNA, 25 bp, Rattus norvegicus
gagttggcaaagtccttctttctaa

SEQ ID NO: 356522 - DNA, 25 bp, Rattus norvegicus
gagttggcaatcacctgacacctgt

SEQ ID NO: 356523 - DNA, 25 bp, Rattus norvegicus
gagttggcaatctcctgacacctgt

SEQ ID NO: 356524 - DNA, 25 bp, Rattus norvegicus
gagttggcacacatgctcgcggatg

SEQ ID NO: 356525 - DNA, 25 bp, Rattus norvegicus
gagttggcacacttgctcgcggatg

SEQ ID NO: 356526 - DNA, 25 bp, Rattus norvegicus
gagttggcacctatttgtttataga

SEQ ID NO: 356527 - DNA, 25 bp, Rattus norvegicus
gagttggcacctttttgtttataga

SEQ ID NO: 356528 - DNA, 25 bp, Rattus norvegicus
gagttggcacgactgtaggttttaa

SEQ ID NO: 356529 - DNA, 25 bp, Rattus norvegicus
gagttggcacgagtgtaggttttaa

SEQ ID NO: 356530 - DNA, 25 bp, Rattus norvegicus
gagttggcatggacatacaccaggt

SEQ ID NO: 356531 - DNA, 25 bp, Rattus norvegicus
gagttggcatggtcatacaccaggt

SEQ ID NO: 356532 - DNA, 25 bp, Rattus norvegicus
gagttggcatgtcaggtacatcatt

SEQ ID NO: 356533 - DNA, 25 bp, Rattus norvegicus
gagttggcatgtgaggtacatcatt

SEQ ID NO: 356534 - DNA, 25 bp, Rattus norvegicus
gagttggccatgaagtattgccttc

SEQ ID NO: 356535 - DNA, 25 bp, Rattus norvegicus
gagttggccatgtagtattgccttc

SEQ ID NO: 356536 - DNA, 25 bp, Rattus norvegicus
gagttggcccaacagcccctaaaat

SEQ ID NO: 356537 - DNA, 25 bp, Rattus norvegicus
gagttggcccaagagcccctaaaat

SEQ ID NO: 356538 - DNA, 25 bp, Rattus norvegicus
gagttggcccaccaagtgacttgtg

SEQ ID NO: 356539 - DNA, 25 bp, Rattus norvegicus
gagttggcccacgaagtgacttgtg

SEQ ID NO: 356540 - DNA, 25 bp, Rattus norvegicus
gagttggccgttatgtcttgtacct

SEQ ID NO: 356541 - DNA, 25 bp, Rattus norvegicus
gagttggccgttttgtcttgtacct

SEQ ID NO: 356542 - DNA, 25 bp, Rattus norvegicus
gagttggcctgaatcttgttcctca

SEQ ID NO: 356543 - DNA, 25 bp, Rattus norvegicus
gagttggcctgattcttgttcctca

SEQ ID NO: 356544 - DNA, 25 bp, Rattus norvegicus
gagttggcgcctcctgagctgaatc

SEQ ID NO: 356545 - DNA, 25 bp, Rattus norvegicus
gagttggcgcctgctgagctgaatc

SEQ ID NO: 356546 - DNA, 25 bp, Rattus norvegicus
gagttggctctgaacatcactttgt

SEQ ID NO: 356547 - DNA, 25 bp, Rattus norvegicus
gagttggctctgtacatcactttgt

SEQ ID NO: 356548 - DNA, 25 bp, Rattus norvegicus
gagttggctgtaaatgtctgatcat

SEQ ID NO: 356549 - DNA, 25 bp, Rattus norvegicus
gagttggctgtatatgtctgatcat

SEQ ID NO: 356550 - DNA, 25 bp, Rattus norvegicus
gagttgggacttcagcactgtttct

SEQ ID NO: 356551 - DNA, 25 bp, Rattus norvegicus
gagttgggacttgagcactgtttct

SEQ ID NO: 356552 - DNA, 25 bp, Rattus norvegicus
gagttgggcactatggttaccatga

SEQ ID NO: 356553 - DNA, 25 bp, Rattus norvegicus
gagttgggcactttggttaccatga

SEQ ID NO: 356554 - DNA, 25 bp, Rattus norvegicus
gagttgggcatcacagcagcatctt

SEQ ID NO: 356555 - DNA, 25 bp, Rattus norvegicus
gagttgggcatctcagcagcatctt

SEQ ID NO: 356556 - DNA, 25 bp, Rattus norvegicus
gagttgggtactcactacaccacct

SEQ ID NO: 356557 - DNA, 25 bp, Rattus norvegicus
gagttgggtactgactacaccacct

SEQ ID NO: 356558 - DNA, 25 bp, Rattus norvegicus
gagttggtacctagttgacgtcttc

SEQ ID NO: 356559 - DNA, 25 bp, Rattus norvegicus
gagttggtacctatcgtacatccac

SEQ ID NO: 356560 - DNA, 25 bp, Rattus norvegicus
gagttggtaccttgttgacgtcttc

SEQ ID NO: 356561 - DNA, 25 bp, Rattus norvegicus
gagttggtacctttcgtacatccac

SEQ ID NO: 356562 - DNA, 25 bp, Rattus norvegicus
gagttggtatatcccgtcaccgggt

SEQ ID NO: 356563 - DNA, 25 bp, Rattus norvegicus
gagttggtatatgccgtcaccgggt

SEQ ID NO: 356564 - DNA, 25 bp, Rattus norvegicus
gagttggtatgtcctactaagccca

SEQ ID NO: 356565 - DNA, 25 bp, Rattus norvegicus
gagttggtatgtgctactaagccca

SEQ ID NO: 356566 - DNA, 25 bp, Rattus norvegicus
gagttggtccaaccttaatgtgcaa

SEQ ID NO: 356567 - DNA, 25 bp, Rattus norvegicus
gagttggtccaagcttaatgtgcaa

SEQ ID NO: 356568 - DNA, 25 bp, Rattus norvegicus
gagttggtctttcgttaaatggtca

SEQ ID NO: 356569 - DNA, 25 bp, Rattus norvegicus
gagttggtctttggttaaatggtca

SEQ ID NO: 356570 - DNA, 25 bp, Rattus norvegicus
gagttggtgcacactgttttttcca

SEQ ID NO: 356571 - DNA, 25 bp, Rattus norvegicus
gagttggtgcactctgttttttcca

SEQ ID NO: 356572 - DNA, 25 bp, Rattus norvegicus
gagttggtgttcatttcttagcttt

SEQ ID NO: 356573 - DNA, 25 bp, Rattus norvegicus
gagttggtgttcttttcttagcttt

SEQ ID NO: 356574 - DNA, 25 bp, Rattus norvegicus
gagttggttgtaaaccctttacatt

SEQ ID NO: 356575 - DNA, 25 bp, Rattus norvegicus
gagttggttgtataccctttacatt

SEQ ID NO: 356576 - DNA, 25 bp, Rattus norvegicus
gagttgtacgcaagagcagctgcta

SEQ ID NO: 356577 - DNA, 25 bp, Rattus norvegicus
gagttgtacgcatgagcagctgcta

SEQ ID NO: 356578 - DNA, 25 bp, Rattus norvegicus
gagttgtactaactcacagctgtga

SEQ ID NO: 356579 - DNA, 25 bp, Rattus norvegicus
gagttgtactaagtcacagctgtga

SEQ ID NO: 356580 - DNA, 25 bp, Rattus norvegicus
gagttgtactctaggtgttggaagc

SEQ ID NO: 356581 - DNA, 25 bp, Rattus norvegicus
gagttgtactcttggtgttggaagc

SEQ ID NO: 356582 - DNA, 25 bp, Rattus norvegicus
gagttgtactttactcacaggtctg

SEQ ID NO: 356583 - DNA, 25 bp, Rattus norvegicus
gagttgtacttttctcacaggtctg

SEQ ID NO: 356584 - DNA, 25 bp, Rattus norvegicus
gagttgtagagaaccagcatgaaga

SEQ ID NO: 356585 - DNA, 25 bp, Rattus norvegicus
gagttgtagagatccagcatgaaga

SEQ ID NO: 356586 - DNA, 25 bp, Rattus norvegicus
gagttgtagtttaccccgagcagac

SEQ ID NO: 356587 - DNA, 25 bp, Rattus norvegicus
gagttgtagttttccccgagcagac

SEQ ID NO: 356588 - DNA, 25 bp, Rattus norvegicus
gagttgtatacacggcttcatgcag

SEQ ID NO: 356589 - DNA, 25 bp, Rattus norvegicus
gagttgtatacagggcttcatgcag

SEQ ID NO: 356590 - DNA, 25 bp, Rattus norvegicus
gagttgtatccaagttacctcaaaa

SEQ ID NO: 356591 - DNA, 25 bp, Rattus norvegicus
gagttgtatccatgttacctcaaaa

SEQ ID NO: 356592 - DNA, 25 bp, Rattus norvegicus
gagttgtatctgagttactgtttga

SEQ ID NO: 356593 - DNA, 25 bp, Rattus norvegicus
gagttgtatctgtgttactgtttga

SEQ ID NO: 356594 - DNA, 25 bp, Rattus norvegicus
gagttgtcaataatgtcctccaaac

SEQ ID NO: 356595 - DNA, 25 bp, Rattus norvegicus
gagttgtcaatattgtcctccaaac

SEQ ID NO: 356596 - DNA, 25 bp, Rattus norvegicus
gagttgtcaattcgctggctaccgt

SEQ ID NO: 356597 - DNA, 25 bp, Rattus norvegicus
gagttgtcaattggctggctaccgt

SEQ ID NO: 356598 - DNA, 25 bp, Rattus norvegicus
gagttgtcacagactactcttgtca

SEQ ID NO: 356599 - DNA, 25 bp, Rattus norvegicus
gagttgtcacagtctactcttgtca

SEQ ID NO: 356600 - DNA, 25 bp, Rattus norvegicus
gagttgtcacatcactccttcataa

SEQ ID NO: 356601 - DNA, 25 bp, Rattus norvegicus
gagttgtcacatgactccttcataa

SEQ ID NO: 356602 - DNA, 25 bp, Rattus norvegicus
gagttgtcactgctccacagagaat

SEQ ID NO: 356603 - DNA, 25 bp, Rattus norvegicus
gagttgtcactggtccacagagaat

SEQ ID NO: 356604 - DNA, 25 bp, Rattus norvegicus
gagttgtcacttaactgtcaggctt

SEQ ID NO: 356605 - DNA, 25 bp, Rattus norvegicus
gagttgtcactttactgtcaggctt

SEQ ID NO: 356606 - DNA, 25 bp, Rattus norvegicus
gagttgtccaggacctacgaggccg

SEQ ID NO: 356607 - DNA, 25 bp, Rattus norvegicus
gagttgtccaggtcctacgaggccg

SEQ ID NO: 356608 - DNA, 25 bp, Rattus norvegicus
gagttgtccccgaacaggagaccct

SEQ ID NO: 356609 - DNA, 25 bp, Rattus norvegicus
gagttgtccccgtacaggagaccct

SEQ ID NO: 356610 - DNA, 25 bp, Rattus norvegicus
gagttgtccctgctagtgctagcac

SEQ ID NO: 356611 - DNA, 25 bp, Rattus norvegicus
gagttgtccctggtagtgctagcac

SEQ ID NO: 356612 - DNA, 25 bp, Rattus norvegicus
gagttgtcctcgaggattgtgtgcc

SEQ ID NO: 356613 - DNA, 25 bp, Rattus norvegicus
gagttgtcctcgtggattgtgtgcc

SEQ ID NO: 356614 - DNA, 25 bp, Rattus norvegicus
gagttgtcgagtctaggcacctgaa

SEQ ID NO: 356615 - DNA, 25 bp, Rattus norvegicus
gagttgtcgagtgtaggcacctgaa

SEQ ID NO: 356616 - DNA, 25 bp, Rattus norvegicus
gagttgtctaagcttggctggatct

SEQ ID NO: 356617 - DNA, 25 bp, Rattus norvegicus
gagttgtctaaggttggctggatct

SEQ ID NO: 356618 - DNA, 25 bp, Rattus norvegicus
gagttgtctaatcaagccctgagga

SEQ ID NO: 356619 - DNA, 25 bp, Rattus norvegicus
gagttgtctaatgaagccctgagga

SEQ ID NO: 356620 - DNA, 25 bp, Rattus norvegicus
gagttgtcttacagtcactttgttt

SEQ ID NO: 356621 - DNA, 25 bp, Rattus norvegicus
gagttgtcttactgtcactttgttt

SEQ ID NO: 356622 - DNA, 25 bp, Rattus norvegicus
gagttgtcttttcaatttgccaaat

SEQ ID NO: 356623 - DNA, 25 bp, Rattus norvegicus
gagttgtcttttgaatttgccaaat

SEQ ID NO: 356624 - DNA, 25 bp, Rattus norvegicus
gagttgtgacttacattgtagcagc

SEQ ID NO: 356625 - DNA, 25 bp, Rattus norvegicus
gagttgtgactttcattgtagcagc

SEQ ID NO: 356626 - DNA, 25 bp, Rattus norvegicus
gagttgtgaggaacgtaccccagca

SEQ ID NO: 356627 - DNA, 25 bp, Rattus norvegicus
gagttgtgaggatcgtaccccagca

SEQ ID NO: 356628 - DNA, 25 bp, Rattus norvegicus
gagttgtgatttacctccattaaaa

SEQ ID NO: 356629 - DNA, 25 bp, Rattus norvegicus
gagttgtgattttcctccattaaaa

SEQ ID NO: 356630 - DNA, 25 bp, Rattus norvegicus
gagttgtgccttctggatcaccaga

SEQ ID NO: 356631 - DNA, 25 bp, Rattus norvegicus
gagttgtgccttgtggatcaccaga

SEQ ID NO: 356632 - DNA, 25 bp, Rattus norvegicus
gagttgtgctctcgatctgaatatt

SEQ ID NO: 356633 - DNA, 25 bp, Rattus norvegicus
gagttgtgctctggatctgaatatt

SEQ ID NO: 356634 - DNA, 25 bp, Rattus norvegicus
gagttgtggagacctcactggcctc

SEQ ID NO: 356635 - DNA, 25 bp, Rattus norvegicus
gagttgtggagagctcactggcctc

SEQ ID NO: 356636 - DNA, 25 bp, Rattus norvegicus
gagttgtgtattctgttgttgttgt

SEQ ID NO: 356637 - DNA, 25 bp, Rattus norvegicus
gagttgtgtattgtgttgttgttgt

SEQ ID NO: 356638 - DNA, 25 bp, Rattus norvegicus
gagttgttagaacccattgagtctg

SEQ ID NO: 356639 - DNA, 25 bp, Rattus norvegicus
gagttgttagaagccattgagtctg

SEQ ID NO: 356640 - DNA, 25 bp, Rattus norvegicus
gagttgttatgcaatacttgctggt

SEQ ID NO: 356641 - DNA, 25 bp, Rattus norvegicus
gagttgttatgctatacttgctggt

SEQ ID NO: 356642 - DNA, 25 bp, Rattus norvegicus
gagttgttatttctttatgtcccta

SEQ ID NO: 356643 - DNA, 25 bp, Rattus norvegicus
gagttgttatttgtttatgtcccta

SEQ ID NO: 356644 - DNA, 25 bp, Rattus norvegicus
gagttgttcacaaactgcagttatt

SEQ ID NO: 356645 - DNA, 25 bp, Rattus norvegicus
gagttgttcacatactgcagttatt

SEQ ID NO: 356646 - DNA, 25 bp, Rattus norvegicus
gagttgttcactatttcatagctac

SEQ ID NO: 356647 - DNA, 25 bp, Rattus norvegicus
gagttgttcactttttcatagctac

SEQ ID NO: 356648 - DNA, 25 bp, Rattus norvegicus
gagttgttcctaagctttgacatgt

SEQ ID NO: 356649 - DNA, 25 bp, Rattus norvegicus
gagttgttcctatgctttgacatgt

SEQ ID NO: 356650 - DNA, 25 bp, Rattus norvegicus
gagttgttcggcagagtcacttcaa

SEQ ID NO: 356651 - DNA, 25 bp, Rattus norvegicus
gagttgttcggctgagtcacttcaa

SEQ ID NO: 356652 - DNA, 25 bp, Rattus norvegicus
gagttgttctaaagctctgtgacaa

SEQ ID NO: 356653 - DNA, 25 bp, Rattus norvegicus
gagttgttctaatgctctgtgacaa

SEQ ID NO: 356654 - DNA, 25 bp, Rattus norvegicus
gagttgtttcaaattaggccaagta

SEQ ID NO: 356655 - DNA, 25 bp, Rattus norvegicus
gagttgtttcaatttaggccaagta

SEQ ID NO: 356656 - DNA, 25 bp, Rattus norvegicus
gagttgtttctaagttcatccccag

SEQ ID NO: 356657 - DNA, 25 bp, Rattus norvegicus
gagttgtttctatgttcatccccag

SEQ ID NO: 356658 - DNA, 25 bp, Rattus norvegicus
gagttgtttgagaagcactttgctt

SEQ ID NO: 356659 - DNA, 25 bp, Rattus norvegicus
gagttgtttgagtagcactttgctt

SEQ ID NO: 356660 - DNA, 25 bp, Rattus norvegicus
gagttgttttcgacaatcctgacct

SEQ ID NO: 356661 - DNA, 25 bp, Rattus norvegicus
gagttgttttcgtcaatcctgacct

SEQ ID NO: 356662 - DNA, 25 bp, Rattus norvegicus
gagtttaaatatatcacccctgatg

SEQ ID NO: 356663 - DNA, 25 bp, Rattus norvegicus
gagtttaaatatttcacccctgatg

SEQ ID NO: 356664 - DNA, 25 bp, Rattus norvegicus
gagtttaacagccagcagacgcagc

SEQ ID NO: 356665 - DNA, 25 bp, Rattus norvegicus
gagtttaacagcgagcagacgcagc

SEQ ID NO: 356666 - DNA, 25 bp, Rattus norvegicus
gagtttaaccagaccaactcgacca

SEQ ID NO: 356667 - DNA, 25 bp, Rattus norvegicus
gagtttaaccagtccaactcgacca

SEQ ID NO: 356668 - DNA, 25 bp, Rattus norvegicus
gagtttaacctacctgatcgacata

SEQ ID NO: 356669 - DNA, 25 bp, Rattus norvegicus
gagtttaacctagctgatcgacata

SEQ ID NO: 356670 - DNA, 25 bp, Rattus norvegicus
gagtttaaccttagtgacccacaag

SEQ ID NO: 356671 - DNA, 25 bp, Rattus norvegicus
gagtttaacctttgtgacccacaag

SEQ ID NO: 356672 - DNA, 25 bp, Rattus norvegicus
gagtttaactgtaccattagctcag

SEQ ID NO: 356673 - DNA, 25 bp, Rattus norvegicus
gagtttaactgttccattagctcag

SEQ ID NO: 356674 - DNA, 25 bp, Rattus norvegicus
gagtttaagaccagtctgagtacat

SEQ ID NO: 356675 - DNA, 25 bp, Rattus norvegicus
gagtttaagacctgtctgagtacat

SEQ ID NO: 356676 - DNA, 25 bp, Rattus norvegicus
gagtttaagactaccccaaggcata

SEQ ID NO: 356677 - DNA, 25 bp, Rattus norvegicus
gagtttaagacttccccaaggcata

SEQ ID NO: 356678 - DNA, 25 bp, Rattus norvegicus
gagtttaagatgctcacctgccctg

SEQ ID NO: 356679 - DNA, 25 bp, Rattus norvegicus
gagtttaagatggtcacctgccctg

SEQ ID NO: 356680 - DNA, 25 bp, Rattus norvegicus
gagtttaagcgtagcccagcatttg

SEQ ID NO: 356681 - DNA, 25 bp, Rattus norvegicus
gagtttaagcgttgcccagcatttg

SEQ ID NO: 356682 - DNA, 25 bp, Rattus norvegicus
gagtttaataccagtctctccatgg

SEQ ID NO: 356683 - DNA, 25 bp, Rattus norvegicus
gagtttaatacctgtctctccatgg

SEQ ID NO: 356684 - DNA, 25 bp, Rattus norvegicus
gagtttaatcagatctgcccggaag

SEQ ID NO: 356685 - DNA, 25 bp, Rattus norvegicus
gagtttaatcagttctgcccggaag

SEQ ID NO: 356686 - DNA, 25 bp, Rattus norvegicus
gagtttaattatagtgctgagtcaa

SEQ ID NO: 356687 - DNA, 25 bp, Rattus norvegicus
gagtttaattattgtgctgagtcaa

SEQ ID NO: 356688 - DNA, 25 bp, Rattus norvegicus
gagtttacaaacaggctcaacaaga

SEQ ID NO: 356689 - DNA, 25 bp, Rattus norvegicus
gagtttacaaactggctcaacaaga

SEQ ID NO: 356690 - DNA, 25 bp, Rattus norvegicus
gagtttacaactccatattttaaag

SEQ ID NO: 356691 - DNA, 25 bp, Rattus norvegicus
gagtttacaactgcatattttaaag

SEQ ID NO: 356692 - DNA, 25 bp, Rattus norvegicus
gagtttacagatcgctttgctgcat

SEQ ID NO: 356693 - DNA, 25 bp, Rattus norvegicus
gagtttacagatggctttgctgcat

SEQ ID NO: 356694 - DNA, 25 bp, Rattus norvegicus
gagtttacagggactggactcagat

SEQ ID NO: 356695 - DNA, 25 bp, Rattus norvegicus
gagtttacagggtctggactcagat

SEQ ID NO: 356696 - DNA, 25 bp, Rattus norvegicus
gagtttaccaacatagtaatgctgt

SEQ ID NO: 356697 - DNA, 25 bp, Rattus norvegicus
gagtttaccaacttagtaatgctgt

SEQ ID NO: 356698 - DNA, 25 bp, Rattus norvegicus
gagtttaccacactctgggacccga

SEQ ID NO: 356699 - DNA, 25 bp, Rattus norvegicus
gagtttaccacagtctgggacccga

SEQ ID NO: 356700 - DNA, 25 bp, Rattus norvegicus
gagtttaccagcctgttcattgaaa

SEQ ID NO: 356701 - DNA, 25 bp, Rattus norvegicus
gagtttaccagcgtgttcattgaaa

SEQ ID NO: 356702 - DNA, 25 bp, Rattus norvegicus
gagtttaccctacttgaacaagcta

SEQ ID NO: 356703 - DNA, 25 bp, Rattus norvegicus
gagtttaccctagttgaacaagcta

SEQ ID NO: 356704 - DNA, 25 bp, Rattus norvegicus
gagtttacgaccaacctgatagaca

SEQ ID NO: 356705 - DNA, 25 bp, Rattus norvegicus
gagtttacgacctacctgatagaca

SEQ ID NO: 356706 - DNA, 25 bp, Rattus norvegicus
gagtttactacaaagctggcttctt

SEQ ID NO: 356707 - DNA, 25 bp, Rattus norvegicus
gagtttactacatagctggcttctt

SEQ ID NO: 356708 - DNA, 25 bp, Rattus norvegicus
gagtttactacgatgaaaccagcaa

SEQ ID NO: 356709 - DNA, 25 bp, Rattus norvegicus
gagtttactacgttgaaaccagcaa

SEQ ID NO: 356710 - DNA, 25 bp, Rattus norvegicus
gagtttactactattgcttcagctg

SEQ ID NO: 356711 - DNA, 25 bp, Rattus norvegicus
gagtttactacttttgcttcagctg

SEQ ID NO: 356712 - DNA, 25 bp, Rattus norvegicus
gagtttactcctctgaccatggaat

SEQ ID NO: 356713 - DNA, 25 bp, Rattus norvegicus
gagtttactcctgtgaccatggaat

SEQ ID NO: 356714 - DNA, 25 bp, Rattus norvegicus
gagtttactgggatggcctccagga

SEQ ID NO: 356715 - DNA, 25 bp, Rattus norvegicus
gagtttactgggttggcctccagga

SEQ ID NO: 356716 - DNA, 25 bp, Rattus norvegicus
gagtttactggtcatcgttgccaaa

SEQ ID NO: 356717 - DNA, 25 bp, Rattus norvegicus
gagtttactggtgatcgttgccaaa

SEQ ID NO: 356718 - DNA, 25 bp, Rattus norvegicus
gagtttacttctctatggtgctgaa

SEQ ID NO: 356719 - DNA, 25 bp, Rattus norvegicus
gagtttacttctgtatggtgctgaa

SEQ ID NO: 356720 - DNA, 25 bp, Rattus norvegicus
gagtttagatgaaagcccttgtgct

SEQ ID NO: 356721 - DNA, 25 bp, Rattus norvegicus
gagtttagatgatagcccttgtgct

SEQ ID NO: 356722 - DNA, 25 bp, Rattus norvegicus
gagtttagcattacctacttcagaa

SEQ ID NO: 356723 - DNA, 25 bp, Rattus norvegicus
gagtttagcatttcctacttcagaa

SEQ ID NO: 356724 - DNA, 25 bp, Rattus norvegicus
gagtttagctttaccagtaggtgaa

SEQ ID NO: 356725 - DNA, 25 bp, Rattus norvegicus
gagtttagcttttccagtaggtgaa

SEQ ID NO: 356726 - DNA, 25 bp, Rattus norvegicus
gagtttaggcccaggctttgtaaca

SEQ ID NO: 356727 - DNA, 25 bp, Rattus norvegicus
gagtttaggccctggctttgtaaca

SEQ ID NO: 356728 - DNA, 25 bp, Rattus norvegicus
gagtttaggcttaacagagctcttc

SEQ ID NO: 356729 - DNA, 25 bp, Rattus norvegicus
gagtttaggcttcctgtttgtgtac

SEQ ID NO: 356730 - DNA, 25 bp, Rattus norvegicus
gagtttaggcttgctgtttgtgtac

SEQ ID NO: 356731 - DNA, 25 bp, Rattus norvegicus
gagtttaggctttacagagctcttc

SEQ ID NO: 356732 - DNA, 25 bp, Rattus norvegicus
gagtttagggtcaagctgagcttta

SEQ ID NO: 356733 - DNA, 25 bp, Rattus norvegicus
gagtttagggtctagctgagcttta

SEQ ID NO: 356734 - DNA, 25 bp, Rattus norvegicus
gagtttagtaaccagctttagccaa

SEQ ID NO: 356735 - DNA, 25 bp, Rattus norvegicus
gagtttagtaacgagctttagccaa

SEQ ID NO: 356736 - DNA, 25 bp, Rattus norvegicus
gagtttagtattcaaaccctgccgt

SEQ ID NO: 356737 - DNA, 25 bp, Rattus norvegicus
gagtttagtattgaaaccctgccgt

SEQ ID NO: 356738 - DNA, 25 bp, Rattus norvegicus
gagtttagtcttaatgtgggtcaca

SEQ ID NO: 356739 - DNA, 25 bp, Rattus norvegicus
gagtttagtctttatgtgggtcaca

SEQ ID NO: 356740 - DNA, 25 bp, Rattus norvegicus
gagtttagtgtcagaagtcttccca

SEQ ID NO: 356741 - DNA, 25 bp, Rattus norvegicus
gagtttagtgtctgaagtcttccca

SEQ ID NO: 356742 - DNA, 25 bp, Rattus norvegicus
gagtttagttcacattgtgccctta

SEQ ID NO: 356743 - DNA, 25 bp, Rattus norvegicus
gagtttagttcagattgtgccctta

SEQ ID NO: 356744 - DNA, 25 bp, Rattus norvegicus
gagtttagtttcaccaagtccttgg

SEQ ID NO: 356745 - DNA, 25 bp, Rattus norvegicus
gagtttagtttctccaagtccttgg

SEQ ID NO: 356746 - DNA, 25 bp, Rattus norvegicus
gagtttataagcatcataacatctg

SEQ ID NO: 356747 - DNA, 25 bp, Rattus norvegicus
gagtttataagcttcataacatctg

SEQ ID NO: 356748 - DNA, 25 bp, Rattus norvegicus
gagtttatacagacgttgccttcta

SEQ ID NO: 356749 - DNA, 25 bp, Rattus norvegicus
gagtttatacagtcgttgccttcta

SEQ ID NO: 356750 - DNA, 25 bp, Rattus norvegicus
gagtttatcacaaatgccggtacat

SEQ ID NO: 356751 - DNA, 25 bp, Rattus norvegicus
gagtttatcacatatgccggtacat

SEQ ID NO: 356752 - DNA, 25 bp, Rattus norvegicus
gagtttatcagcatctacagtacta

SEQ ID NO: 356753 - DNA, 25 bp, Rattus norvegicus
gagtttatcagcttctacagtacta

SEQ ID NO: 356754 - DNA, 25 bp, Rattus norvegicus
gagtttatgtagctaatcctggaaa

SEQ ID NO: 356755 - DNA, 25 bp, Rattus norvegicus
gagtttatgtaggtaatcctggaaa

SEQ ID NO: 356756 - DNA, 25 bp, Rattus norvegicus
gagtttattcacagtcttatctgca

SEQ ID NO: 356757 - DNA, 25 bp, Rattus norvegicus
gagtttattcactgtcttatctgca

SEQ ID NO: 356758 - DNA, 25 bp, Rattus norvegicus
gagtttattcgaaatacccgccgag

SEQ ID NO: 356759 - DNA, 25 bp, Rattus norvegicus
gagtttattcgatatacccgccgag

SEQ ID NO: 356760 - DNA, 25 bp, Rattus norvegicus
gagtttattctgctgctgctaagta

SEQ ID NO: 356761 - DNA, 25 bp, Rattus norvegicus
gagtttattctggtgctgctaagta

SEQ ID NO: 356762 - DNA, 25 bp, Rattus norvegicus
gagtttattcttatatctatcccaa

SEQ ID NO: 356763 - DNA, 25 bp, Rattus norvegicus
gagtttattcttttatctatcccaa

SEQ ID NO: 356764 - DNA, 25 bp, Rattus norvegicus
gagtttattgcaaaccatcctgact

SEQ ID NO: 356765 - DNA, 25 bp, Rattus norvegicus
gagtttattgcataccatcctgact

SEQ ID NO: 356766 - DNA, 25 bp, Rattus norvegicus
gagtttattgctctatcacattgtg

SEQ ID NO: 356767 - DNA, 25 bp, Rattus norvegicus
gagtttattgctgtatcacattgtg

SEQ ID NO: 356768 - DNA, 25 bp, Rattus norvegicus
gagtttatttaacgttctggaagca

SEQ ID NO: 356769 - DNA, 25 bp, Rattus norvegicus
gagtttatttaaggttctggaagca

SEQ ID NO: 356770 - DNA, 25 bp, Rattus norvegicus
gagtttatttctctctgtgttgtca

SEQ ID NO: 356771 - DNA, 25 bp, Rattus norvegicus
gagtttatttctgtctgtgttgtca

SEQ ID NO: 356772 - DNA, 25 bp, Rattus norvegicus
gagtttcaacaaaaccgctctgtct

SEQ ID NO: 356773 - DNA, 25 bp, Rattus norvegicus
gagtttcaacaataccgctctgtct

SEQ ID NO: 356774 - DNA, 25 bp, Rattus norvegicus
gagtttcaacagaggaatcttataa

SEQ ID NO: 356775 - DNA, 25 bp, Rattus norvegicus
gagtttcaacagctgtgtacaccat

SEQ ID NO: 356776 - DNA, 25 bp, Rattus norvegicus
gagtttcaacaggtgtgtacaccat

SEQ ID NO: 356777 - DNA, 25 bp, Rattus norvegicus
gagtttcaacagtggaatcttataa

SEQ ID NO: 356778 - DNA, 25 bp, Rattus norvegicus
gagtttcaactcctaattagtgcgg

SEQ ID NO: 356779 - DNA, 25 bp, Rattus norvegicus
gagtttcaactcgtaattagtgcgg

SEQ ID NO: 356780 - DNA, 25 bp, Rattus norvegicus
gagtttcaagcacaagaaataccat

SEQ ID NO: 356781 - DNA, 25 bp, Rattus norvegicus
gagtttcaagcagaagaaataccat

SEQ ID NO: 356782 - DNA, 25 bp, Rattus norvegicus
gagtttcaagccagttagctagaca

SEQ ID NO: 356783 - DNA, 25 bp, Rattus norvegicus
gagtttcaagcctgttagctagaca

SEQ ID NO: 356784 - DNA, 25 bp, Rattus norvegicus
gagtttcaaggacatcaatccagaa

SEQ ID NO: 356785 - DNA, 25 bp, Rattus norvegicus
gagtttcaaggagatcaatccagaa

SEQ ID NO: 356786 - DNA, 25 bp, Rattus norvegicus
gagtttcaagtaaagatcacagcca

SEQ ID NO: 356787 - DNA, 25 bp, Rattus norvegicus
gagtttcaagtatagatcacagcca

SEQ ID NO: 356788 - DNA, 25 bp, Rattus norvegicus
gagtttcaagttaccacgcgcgggg

SEQ ID NO: 356789 - DNA, 25 bp, Rattus norvegicus
gagtttcaagttagtcccaaccaag

SEQ ID NO: 356790 - DNA, 25 bp, Rattus norvegicus
gagtttcaagtttccacgcgcgggg

SEQ ID NO: 356791 - DNA, 25 bp, Rattus norvegicus
gagtttcaagtttgtcccaaccaag

SEQ ID NO: 356792 - DNA, 25 bp, Rattus norvegicus
gagtttcaattcaaggctcaaaagt

SEQ ID NO: 356793 - DNA, 25 bp, Rattus norvegicus
gagtttcaattcaccgccggaaggg

SEQ ID NO: 356794 - DNA, 25 bp, Rattus norvegicus
gagtttcaattcaggctctgagccg

SEQ ID NO: 356795 - DNA, 25 bp, Rattus norvegicus
gagtttcaattctaggctcaaaagt

SEQ ID NO: 356796 - DNA, 25 bp, Rattus norvegicus
gagtttcaattctccgccggaaggg

SEQ ID NO: 356797 - DNA, 25 bp, Rattus norvegicus
gagtttcaattctggctctgagccg

SEQ ID NO: 356798 - DNA, 25 bp, Rattus norvegicus
gagtttcacctacgaattcaaagcg

SEQ ID NO: 356799 - DNA, 25 bp, Rattus norvegicus
gagtttcacctaggaattcaaagcg

SEQ ID NO: 356800 - DNA, 25 bp, Rattus norvegicus
gagtttcacgtgattgtttctcaca

SEQ ID NO: 356801 - DNA, 25 bp, Rattus norvegicus
gagtttcacgtgtttgtttctcaca

SEQ ID NO: 356802 - DNA, 25 bp, Rattus norvegicus
gagtttcactcaattgctaagcatt

SEQ ID NO: 356803 - DNA, 25 bp, Rattus norvegicus
gagtttcactcacgcaggtttccaa

SEQ ID NO: 356804 - DNA, 25 bp, Rattus norvegicus
gagtttcactcaggcaggtttccaa

SEQ ID NO: 356805 - DNA, 25 bp, Rattus norvegicus
gagtttcactcatttgctaagcatt

SEQ ID NO: 356806 - DNA, 25 bp, Rattus norvegicus
gagtttcacttaaatgcagtctatt

SEQ ID NO: 356807 - DNA, 25 bp, Rattus norvegicus
gagtttcacttatatgcagtctatt

SEQ ID NO: 356808 - DNA, 25 bp, Rattus norvegicus
gagtttcaggcacctgggactgtat

SEQ ID NO: 356809 - DNA, 25 bp, Rattus norvegicus
gagtttcaggcagctgggactgtat

SEQ ID NO: 356810 - DNA, 25 bp, Rattus norvegicus
gagtttcaggttcttcttcacatgg

SEQ ID NO: 356811 - DNA, 25 bp, Rattus norvegicus
gagtttcaggttgttcttcacatgg

SEQ ID NO: 356812 - DNA, 25 bp, Rattus norvegicus
gagtttcagtcgcaactcccacctg

SEQ ID NO: 356813 - DNA, 25 bp, Rattus norvegicus
gagtttcagtcggaactcccacctg

SEQ ID NO: 356814 - DNA, 25 bp, Rattus norvegicus
gagtttcagtctaaattgcagtgtt

SEQ ID NO: 356815 - DNA, 25 bp, Rattus norvegicus
gagtttcagtcttaattgcagtgtt

SEQ ID NO: 356816 - DNA, 25 bp, Rattus norvegicus
gagtttcatcatctgcaactgtcac

SEQ ID NO: 356817 - DNA, 25 bp, Rattus norvegicus
gagtttcatcatgtgcaactgtcac

SEQ ID NO: 356818 - DNA, 25 bp, Rattus norvegicus
gagtttcatcttcgctacaagagga

SEQ ID NO: 356819 - DNA, 25 bp, Rattus norvegicus
gagtttcatcttggctacaagagga

SEQ ID NO: 356820 - DNA, 25 bp, Rattus norvegicus
gagtttcatgccattaagctttcta

SEQ ID NO: 356821 - DNA, 25 bp, Rattus norvegicus
gagtttcatgcctttaagctttcta

SEQ ID NO: 356822 - DNA, 25 bp, Rattus norvegicus
gagtttcatggtccctctcaagcca

SEQ ID NO: 356823 - DNA, 25 bp, Rattus norvegicus
gagtttcatggtgcctctcaagcca

SEQ ID NO: 356824 - DNA, 25 bp, Rattus norvegicus
gagtttcatgtaatcatcaccccta

SEQ ID NO: 356825 - DNA, 25 bp, Rattus norvegicus
gagtttcatgtattcatcaccccta

SEQ ID NO: 356826 - DNA, 25 bp, Rattus norvegicus
gagtttcatgttcccatttcctggt

SEQ ID NO: 356827 - DNA, 25 bp, Rattus norvegicus
gagtttcatgttcgagctgcaggct

SEQ ID NO: 356828 - DNA, 25 bp, Rattus norvegicus
gagtttcatgttgccatttcctggt

SEQ ID NO: 356829 - DNA, 25 bp, Rattus norvegicus
gagtttcatgttggagctgcaggct

SEQ ID NO: 356830 - DNA, 25 bp, Rattus norvegicus
gagtttcattcaccccagtaatcaa

SEQ ID NO: 356831 - DNA, 25 bp, Rattus norvegicus
gagtttcattcagcccagtaatcaa

SEQ ID NO: 356832 - DNA, 25 bp, Rattus norvegicus
gagtttcattgccagcagccacatc

SEQ ID NO: 356833 - DNA, 25 bp, Rattus norvegicus
gagtttcattgcgagcagccacatc

SEQ ID NO: 356834 - DNA, 25 bp, Rattus norvegicus
gagtttcattttcaccttttctcac

SEQ ID NO: 356835 - DNA, 25 bp, Rattus norvegicus
gagtttcattttgaccttttctcac

SEQ ID NO: 356836 - DNA, 25 bp, Rattus norvegicus
gagtttccaatgagacctggccaag

SEQ ID NO: 356837 - DNA, 25 bp, Rattus norvegicus
gagtttccaatgtgacctggccaag

SEQ ID NO: 356838 - DNA, 25 bp, Rattus norvegicus
gagtttccacaaccgggtgaaccag

SEQ ID NO: 356839 - DNA, 25 bp, Rattus norvegicus
gagtttccacaagcgggtgaaccag

SEQ ID NO: 356840 - DNA, 25 bp, Rattus norvegicus
gagtttccactcctgcgtaggatac

SEQ ID NO: 356841 - DNA, 25 bp, Rattus norvegicus
gagtttccactcgtgcgtaggatac

SEQ ID NO: 356842 - DNA, 25 bp, Rattus norvegicus
gagtttccagacacaacttgggcaa

SEQ ID NO: 356843 - DNA, 25 bp, Rattus norvegicus
gagtttccagactcaacttgggcaa

SEQ ID NO: 356844 - DNA, 25 bp, Rattus norvegicus
gagtttccaggcaaaccaggcccgt

SEQ ID NO: 356845 - DNA, 25 bp, Rattus norvegicus
gagtttccaggctaaccaggcccgt

SEQ ID NO: 356846 - DNA, 25 bp, Rattus norvegicus
gagtttccatgaacttagtgttcca

SEQ ID NO: 356847 - DNA, 25 bp, Rattus norvegicus
gagtttccatgatcttagtgttcca

SEQ ID NO: 356848 - DNA, 25 bp, Rattus norvegicus
gagtttccattacatgtaccgtata

SEQ ID NO: 356849 - DNA, 25 bp, Rattus norvegicus
gagtttccattagatgtaccgtata

SEQ ID NO: 356850 - DNA, 25 bp, Rattus norvegicus
gagtttcccataacctcagagttat

SEQ ID NO: 356851 - DNA, 25 bp, Rattus norvegicus
gagtttcccatatcctcagagttat

SEQ ID NO: 356852 - DNA, 25 bp, Rattus norvegicus
gagtttccccacaaaagccaggtat

SEQ ID NO: 356853 - DNA, 25 bp, Rattus norvegicus
gagtttccccactaaagccaggtat

SEQ ID NO: 356854 - DNA, 25 bp, Rattus norvegicus
gagtttccctctagtacctattaag

SEQ ID NO: 356855 - DNA, 25 bp, Rattus norvegicus
gagtttccctcttgtacctattaag

SEQ ID NO: 356856 - DNA, 25 bp, Rattus norvegicus
gagtttccgggtcgccgatacctca

SEQ ID NO: 356857 - DNA, 25 bp, Rattus norvegicus
gagtttccgggtggccgatacctca

SEQ ID NO: 356858 - DNA, 25 bp, Rattus norvegicus
gagtttccgttcacacaagcttgag

SEQ ID NO: 356859 - DNA, 25 bp, Rattus norvegicus
gagtttccgttctcacaagcttgag

SEQ ID NO: 356860 - DNA, 25 bp, Rattus norvegicus
gagtttccgttgcttaagtgaattc

SEQ ID NO: 356861 - DNA, 25 bp, Rattus norvegicus
gagtttccgttggttaagtgaattc

SEQ ID NO: 356862 - DNA, 25 bp, Rattus norvegicus
gagtttcctgaaactgcagtttctg

SEQ ID NO: 356863 - DNA, 25 bp, Rattus norvegicus
gagtttcctgaatctgcagtttctg

SEQ ID NO: 356864 - DNA, 25 bp, Rattus norvegicus
gagtttcctggtagttaggcatact

SEQ ID NO: 356865 - DNA, 25 bp, Rattus norvegicus
gagtttcctggttgttaggcatact

SEQ ID NO: 356866 - DNA, 25 bp, Rattus norvegicus
gagtttcggtagaggatctgcagat

SEQ ID NO: 356867 - DNA, 25 bp, Rattus norvegicus
gagtttcggtagtggatctgcagat

SEQ ID NO: 356868 - DNA, 25 bp, Rattus norvegicus
gagtttctacccatagaatctatgt

SEQ ID NO: 356869 - DNA, 25 bp, Rattus norvegicus
gagtttctacccttagaatctatgt

SEQ ID NO: 356870 - DNA, 25 bp, Rattus norvegicus
gagtttctacggacagatctgggct

SEQ ID NO: 356871 - DNA, 25 bp, Rattus norvegicus
gagtttctacggtcagatctgggct

SEQ ID NO: 356872 - DNA, 25 bp, Rattus norvegicus
gagtttctagatatctgcccaagcc

SEQ ID NO: 356873 - DNA, 25 bp, Rattus norvegicus
gagtttctagatttctgcccaagcc

SEQ ID NO: 356874 - DNA, 25 bp, Rattus norvegicus
gagtttctatacattacagtcctat

SEQ ID NO: 356875 - DNA, 25 bp, Rattus norvegicus
gagtttctatactttacagtcctat

SEQ ID NO: 356876 - DNA, 25 bp, Rattus norvegicus
gagtttctccaacgacctcagataa

SEQ ID NO: 356877 - DNA, 25 bp, Rattus norvegicus
gagtttctccaaggacctcagataa

SEQ ID NO: 356878 - DNA, 25 bp, Rattus norvegicus
gagtttctcctccagtacatatcaa

SEQ ID NO: 356879 - DNA, 25 bp, Rattus norvegicus
gagtttctcctcgagtacatatcaa

SEQ ID NO: 356880 - DNA, 25 bp, Rattus norvegicus
gagtttctcggaacaggagcctcag

SEQ ID NO: 356881 - DNA, 25 bp, Rattus norvegicus
gagtttctcggatcaggagcctcag

SEQ ID NO: 356882 - DNA, 25 bp, Rattus norvegicus
gagtttctcggcatgaaaggcttta

SEQ ID NO: 356883 - DNA, 25 bp, Rattus norvegicus
gagtttctcggcttgaaaggcttta

SEQ ID NO: 356884 - DNA, 25 bp, Rattus norvegicus
gagtttctcttaataaagctgcatt

SEQ ID NO: 356885 - DNA, 25 bp, Rattus norvegicus
gagtttctcttattaaagctgcatt

SEQ ID NO: 356886 - DNA, 25 bp, Rattus norvegicus
gagtttctcttcctcttaaggattt

SEQ ID NO: 356887 - DNA, 25 bp, Rattus norvegicus
gagtttctcttcgtcttaaggattt

SEQ ID NO: 356888 - DNA, 25 bp, Rattus norvegicus
gagtttctctttaatccttatttga

SEQ ID NO: 356889 - DNA, 25 bp, Rattus norvegicus
gagtttctcttttatccttatttga

SEQ ID NO: 356890 - DNA, 25 bp, Rattus norvegicus
gagtttctgaacagttcttcctagc

SEQ ID NO: 356891 - DNA, 25 bp, Rattus norvegicus
gagtttctgaactgttcttcctagc

SEQ ID NO: 356892 - DNA, 25 bp, Rattus norvegicus
gagtttctgatgagctccctgttca

SEQ ID NO: 356893 - DNA, 25 bp, Rattus norvegicus
gagtttctgatgtgctccctgttca

SEQ ID NO: 356894 - DNA, 25 bp, Rattus norvegicus
gagtttctgcagaggccttgccagg

SEQ ID NO: 356895 - DNA, 25 bp, Rattus norvegicus
gagtttctgcagtggccttgccagg

SEQ ID NO: 356896 - DNA, 25 bp, Rattus norvegicus
gagtttctgtgtatcacagccctga

SEQ ID NO: 356897 - DNA, 25 bp, Rattus norvegicus
gagtttctgtgtttcacagccctga

SEQ ID NO: 356898 - DNA, 25 bp, Rattus norvegicus
gagtttctgttccattctttgcttt

SEQ ID NO: 356899 - DNA, 25 bp, Rattus norvegicus
gagtttctgttcgattctttgcttt

SEQ ID NO: 356900 - DNA, 25 bp, Rattus norvegicus
gagtttcttcacatgaccccaggag

SEQ ID NO: 356901 - DNA, 25 bp, Rattus norvegicus
gagtttcttcacttgaccccaggag

SEQ ID NO: 356902 - DNA, 25 bp, Rattus norvegicus
gagtttcttcctctagtgctcacag

SEQ ID NO: 356903 - DNA, 25 bp, Rattus norvegicus
gagtttcttcctgtagtgctcacag

SEQ ID NO: 356904 - DNA, 25 bp, Rattus norvegicus
gagtttcttgacatcgaggacccgt

SEQ ID NO: 356905 - DNA, 25 bp, Rattus norvegicus
gagtttcttgacttcgaggacccgt

SEQ ID NO: 356906 - DNA, 25 bp, Rattus norvegicus
gagtttcttgccagtcatatattca

SEQ ID NO: 356907 - DNA, 25 bp, Rattus norvegicus
gagtttcttgcctgtcatatattca

SEQ ID NO: 356908 - DNA, 25 bp, Rattus norvegicus
gagtttcttggcctgaccatcagag

SEQ ID NO: 356909 - DNA, 25 bp, Rattus norvegicus
gagtttcttggcgtgaccatcagag

SEQ ID NO: 356910 - DNA, 25 bp, Rattus norvegicus
gagtttcttgtgagtagcatcatac

SEQ ID NO: 356911 - DNA, 25 bp, Rattus norvegicus
gagtttcttgtgtgtagcatcatac

SEQ ID NO: 356912 - DNA, 25 bp, Rattus norvegicus
gagtttctttgcctttgttgtgtta

SEQ ID NO: 356913 - DNA, 25 bp, Rattus norvegicus
gagtttctttgcgtttgttgtgtta

SEQ ID NO: 356914 - DNA, 25 bp, Rattus norvegicus
gagtttgaaacacgttctctcctga

SEQ ID NO: 356915 - DNA, 25 bp, Rattus norvegicus
gagtttgaaacaggttctctcctga

SEQ ID NO: 356916 - DNA, 25 bp, Rattus norvegicus
gagtttgaaatgatgcccttgggag

SEQ ID NO: 356917 - DNA, 25 bp, Rattus norvegicus
gagtttgaaatgttgcccttgggag

SEQ ID NO: 356918 - DNA, 25 bp, Rattus norvegicus
gagtttgaaattccgccgatcacgc

SEQ ID NO: 356919 - DNA, 25 bp, Rattus norvegicus
gagtttgaaattgcgccgatcacgc

SEQ ID NO: 356920 - DNA, 25 bp, Rattus norvegicus
gagtttgaactcaccatccttgtgc

SEQ ID NO: 356921 - DNA, 25 bp, Rattus norvegicus
gagtttgaactctccatccttgtgc

SEQ ID NO: 356922 - DNA, 25 bp, Rattus norvegicus
gagtttgaatcccagtggtccactt

SEQ ID NO: 356923 - DNA, 25 bp, Rattus norvegicus
gagtttgaatccgagtggtccactt

SEQ ID NO: 356924 - DNA, 25 bp, Rattus norvegicus
gagtttgaatctctgtcctgagact

SEQ ID NO: 356925 - DNA, 25 bp, Rattus norvegicus
gagtttgaatctgtgtcctgagact

SEQ ID NO: 356926 - DNA, 25 bp, Rattus norvegicus
gagtttgaatgcaagtttcagctta

SEQ ID NO: 356927 - DNA, 25 bp, Rattus norvegicus
gagtttgaatgctagtttcagctta

SEQ ID NO: 356928 - DNA, 25 bp, Rattus norvegicus
gagtttgacatcatcatcaactgca

SEQ ID NO: 356929 - DNA, 25 bp, Rattus norvegicus
gagtttgacatcttcatcaactgca

SEQ ID NO: 356930 - DNA, 25 bp, Rattus norvegicus
gagtttgacattatgctggaggcat

SEQ ID NO: 356931 - DNA, 25 bp, Rattus norvegicus
gagtttgacattttgctggaggcat

SEQ ID NO: 356932 - DNA, 25 bp, Rattus norvegicus
gagtttgaccatacctagtgacttg

SEQ ID NO: 356933 - DNA, 25 bp, Rattus norvegicus
gagtttgaccattcctagtgacttg

SEQ ID NO: 356934 - DNA, 25 bp, Rattus norvegicus
gagtttgacccactgttgattaacc

SEQ ID NO: 356935 - DNA, 25 bp, Rattus norvegicus
gagtttgacccagtgttgattaacc

SEQ ID NO: 356936 - DNA, 25 bp, Rattus norvegicus
gagtttgacctaacttgaagttctt

SEQ ID NO: 356937 - DNA, 25 bp, Rattus norvegicus
gagtttgacctatcttgaagttctt

SEQ ID NO: 356938 - DNA, 25 bp, Rattus norvegicus
gagtttgacctgcagctcattgagg

SEQ ID NO: 356939 - DNA, 25 bp, Rattus norvegicus
gagtttgacctggagctcattgagg

SEQ ID NO: 356940 - DNA, 25 bp, Rattus norvegicus
gagtttgacgccaaatccagtgcta

SEQ ID NO: 356941 - DNA, 25 bp, Rattus norvegicus
gagtttgacgcctaatccagtgcta

SEQ ID NO: 356942 - DNA, 25 bp, Rattus norvegicus
gagtttgactctacactctggaaga

SEQ ID NO: 356943 - DNA, 25 bp, Rattus norvegicus
gagtttgactctataggacccatgt

SEQ ID NO: 356944 - DNA, 25 bp, Rattus norvegicus
gagtttgactcttcactctggaaga

SEQ ID NO: 356945 - DNA, 25 bp, Rattus norvegicus
gagtttgactctttaggacccatgt

SEQ ID NO: 356946 - DNA, 25 bp, Rattus norvegicus
gagtttgactgtaggcttgaagctt

SEQ ID NO: 356947 - DNA, 25 bp, Rattus norvegicus
gagtttgactgttggcttgaagctt

SEQ ID NO: 356948 - DNA, 25 bp, Rattus norvegicus
gagtttgactttattcccttgctca

SEQ ID NO: 356949 - DNA, 25 bp, Rattus norvegicus
gagtttgacttttttcccttgctca

SEQ ID NO: 356950 - DNA, 25 bp, Rattus norvegicus
gagtttgagccactttctaccactg

SEQ ID NO: 356951 - DNA, 25 bp, Rattus norvegicus
gagtttgagccagtttctaccactg

SEQ ID NO: 356952 - DNA, 25 bp, Rattus norvegicus
gagtttgaggctattccagaacaag

SEQ ID NO: 356953 - DNA, 25 bp, Rattus norvegicus
gagtttgaggcttttccagaacaag

SEQ ID NO: 356954 - DNA, 25 bp, Rattus norvegicus
gagtttgaggtcaatctggcctcca

SEQ ID NO: 356955 - DNA, 25 bp, Rattus norvegicus
gagtttgaggtctatctggcctcca

SEQ ID NO: 356956 - DNA, 25 bp, Rattus norvegicus
gagtttgatacccagggcccatgta

SEQ ID NO: 356957 - DNA, 25 bp, Rattus norvegicus
gagtttgataccgagggcccatgta

SEQ ID NO: 356958 - DNA, 25 bp, Rattus norvegicus
gagtttgatcccacagatccacata

SEQ ID NO: 356959 - DNA, 25 bp, Rattus norvegicus
gagtttgatccctcagatccacata

SEQ ID NO: 356960 - DNA, 25 bp, Rattus norvegicus
gagtttgatcgtaatggtaagccat

SEQ ID NO: 356961 - DNA, 25 bp, Rattus norvegicus
gagtttgatcgttatggtaagccat

SEQ ID NO: 356962 - DNA, 25 bp, Rattus norvegicus
gagtttgatgtccacaacccatagg

SEQ ID NO: 356963 - DNA, 25 bp, Rattus norvegicus
gagtttgatgtcgacaacccatagg

SEQ ID NO: 356964 - DNA, 25 bp, Rattus norvegicus
gagtttgattccaaaggcccggcaa

SEQ ID NO: 356965 - DNA, 25 bp, Rattus norvegicus
gagtttgattccaagttctcacaca

SEQ ID NO: 356966 - DNA, 25 bp, Rattus norvegicus
gagtttgattcctaaggcccggcaa

SEQ ID NO: 356967 - DNA, 25 bp, Rattus norvegicus
gagtttgattcctagttctcacaca

SEQ ID NO: 356968 - DNA, 25 bp, Rattus norvegicus
gagtttgcaaatcctggcagccagc

SEQ ID NO: 356969 - DNA, 25 bp, Rattus norvegicus
gagtttgcaaatgctggcagccagc

SEQ ID NO: 356970 - DNA, 25 bp, Rattus norvegicus
gagtttgcacaaagtcccccataat

SEQ ID NO: 356971 - DNA, 25 bp, Rattus norvegicus
gagtttgcacaatgtcccccataat

SEQ ID NO: 356972 - DNA, 25 bp, Rattus norvegicus
gagtttgcactaaggtcatgagctg

SEQ ID NO: 356973 - DNA, 25 bp, Rattus norvegicus
gagtttgcactatggtcatgagctg

SEQ ID NO: 356974 - DNA, 25 bp, Rattus norvegicus
gagtttgcagcaagccaggcagccg

SEQ ID NO: 356975 - DNA, 25 bp, Rattus norvegicus
gagtttgcagcatgccaggcagccg

SEQ ID NO: 356976 - DNA, 25 bp, Rattus norvegicus
gagtttgcagccagtaagtgcctga

SEQ ID NO: 356977 - DNA, 25 bp, Rattus norvegicus
gagtttgcagcctgtaagtgcctga

SEQ ID NO: 356978 - DNA, 25 bp, Rattus norvegicus
gagtttgcatgaacctgagcgtgat

SEQ ID NO: 356979 - DNA, 25 bp, Rattus norvegicus
gagtttgcatgatcctgagcgtgat

SEQ ID NO: 356980 - DNA, 25 bp, Rattus norvegicus
gagtttgccagacttatagtacaga

SEQ ID NO: 356981 - DNA, 25 bp, Rattus norvegicus
gagtttgccagagttatagtacaga

SEQ ID NO: 356982 - DNA, 25 bp, Rattus norvegicus
gagtttgcccgcatgcaggaccagc

SEQ ID NO: 356983 - DNA, 25 bp, Rattus norvegicus
gagtttgcccgcttgcaggaccagc

SEQ ID NO: 356984 - DNA, 25 bp, Rattus norvegicus
gagtttgcctaaacatgctctgaaa

SEQ ID NO: 356985 - DNA, 25 bp, Rattus norvegicus
gagtttgcctaatcatgctctgaaa

SEQ ID NO: 356986 - DNA, 25 bp, Rattus norvegicus
gagtttgcctcacaagactgctaaa

SEQ ID NO: 356987 - DNA, 25 bp, Rattus norvegicus
gagtttgcctcagaagactgctaaa

SEQ ID NO: 356988 - DNA, 25 bp, Rattus norvegicus
gagtttgcctgtacctttcactgta

SEQ ID NO: 356989 - DNA, 25 bp, Rattus norvegicus
gagtttgcctgttcctttcactgta

SEQ ID NO: 356990 - DNA, 25 bp, Rattus norvegicus
gagtttgccttgaatgaagctattg

SEQ ID NO: 356991 - DNA, 25 bp, Rattus norvegicus
gagtttgccttgtatgaagctattg

SEQ ID NO: 356992 - DNA, 25 bp, Rattus norvegicus
gagtttgcgtacagaggcctcttga

SEQ ID NO: 356993 - DNA, 25 bp, Rattus norvegicus
gagtttgcgtactgaggcctcttga

SEQ ID NO: 356994 - DNA, 25 bp, Rattus norvegicus
gagtttgctaccaacagcctaagaa

SEQ ID NO: 356995 - DNA, 25 bp, Rattus norvegicus
gagtttgctacctacagcctaagaa

SEQ ID NO: 356996 - DNA, 25 bp, Rattus norvegicus
gagtttgctcccagctggcatcggc

SEQ ID NO: 356997 - DNA, 25 bp, Rattus norvegicus
gagtttgctccctgctggcatcggc

SEQ ID NO: 356998 - DNA, 25 bp, Rattus norvegicus
gagtttgctcttcgtttggttgcaa

SEQ ID NO: 356999 - DNA, 25 bp, Rattus norvegicus
gagtttgctcttggtttggttgcaa

SEQ ID NO: 357000 - DNA, 25 bp, Rattus norvegicus
gagtttgctgagatgcattcacccc

SEQ ID NO: 357001 - DNA, 25 bp, Rattus norvegicus
gagtttgctgagttgcattcacccc

SEQ ID NO: 357002 - DNA, 25 bp, Rattus norvegicus
gagtttgctgccccctatgaatccc

SEQ ID NO: 357003 - DNA, 25 bp, Rattus norvegicus
gagtttgctgccgcctatgaatccc

SEQ ID NO: 357004 - DNA, 25 bp, Rattus norvegicus
gagtttgcttagcatcctgacacgc

SEQ ID NO: 357005 - DNA, 25 bp, Rattus norvegicus
gagtttgcttaggatcctgacacgc

SEQ ID NO: 357006 - DNA, 25 bp, Rattus norvegicus
gagtttgctttcactgccaattaaa

SEQ ID NO: 357007 - DNA, 25 bp, Rattus norvegicus
gagtttgctttctctgccaattaaa

SEQ ID NO: 357008 - DNA, 25 bp, Rattus norvegicus
gagtttggaattccttaaatgaggt

SEQ ID NO: 357009 - DNA, 25 bp, Rattus norvegicus
gagtttggaattgcttaaatgaggt

SEQ ID NO: 357010 - DNA, 25 bp, Rattus norvegicus
gagtttggatgcatggctcccattc

SEQ ID NO: 357011 - DNA, 25 bp, Rattus norvegicus
gagtttggatgcttggctcccattc

SEQ ID NO: 357012 - DNA, 25 bp, Rattus norvegicus
gagtttggcaacaccattcatgaat

SEQ ID NO: 357013 - DNA, 25 bp, Rattus norvegicus
gagtttggcaactccattcatgaat

SEQ ID NO: 357014 - DNA, 25 bp, Rattus norvegicus
gagtttggcacaactttgctgtagt

SEQ ID NO: 357015 - DNA, 25 bp, Rattus norvegicus
gagtttggcacatctttgctgtagt

SEQ ID NO: 357016 - DNA, 25 bp, Rattus norvegicus
gagtttggcatgagaacacctgatg

SEQ ID NO: 357017 - DNA, 25 bp, Rattus norvegicus
gagtttggcatgtgaacacctgatg

SEQ ID NO: 357018 - DNA, 25 bp, Rattus norvegicus
gagtttgggcatagcctgtgctaca

SEQ ID NO: 357019 - DNA, 25 bp, Rattus norvegicus
gagtttgggcattgcctgtgctaca

SEQ ID NO: 357020 - DNA, 25 bp, Rattus norvegicus
gagtttgggcttaacgtatcaccgc

SEQ ID NO: 357021 - DNA, 25 bp, Rattus norvegicus
gagtttgggctttacgtatcaccgc

SEQ ID NO: 357022 - DNA, 25 bp, Rattus norvegicus
gagtttgggtcaatttaaggccagt

SEQ ID NO: 357023 - DNA, 25 bp, Rattus norvegicus
gagtttgggtcattttaaggccagt

SEQ ID NO: 357024 - DNA, 25 bp, Rattus norvegicus
gagtttgggtccacagtaaaccaga

SEQ ID NO: 357025 - DNA, 25 bp, Rattus norvegicus
gagtttgggtcctcagtaaaccaga

SEQ ID NO: 357026 - DNA, 25 bp, Rattus norvegicus
gagtttgggttccaggtctgtcata

SEQ ID NO: 357027 - DNA, 25 bp, Rattus norvegicus
gagtttgggttcgaggtctgtcata

SEQ ID NO: 357028 - DNA, 25 bp, Rattus norvegicus
gagtttggtctgatttccttatttg

SEQ ID NO: 357029 - DNA, 25 bp, Rattus norvegicus
gagtttggtctgttttccttatttg

SEQ ID NO: 357030 - DNA, 25 bp, Rattus norvegicus
gagtttggtggcaccatttaccaga

SEQ ID NO: 357031 - DNA, 25 bp, Rattus norvegicus
gagtttggtggctccatttaccaga

SEQ ID NO: 357032 - DNA, 25 bp, Rattus norvegicus
gagtttgtactgacaggccacctga

SEQ ID NO: 357033 - DNA, 25 bp, Rattus norvegicus
gagtttgtactgtcaggccacctga

SEQ ID NO: 357034 - DNA, 25 bp, Rattus norvegicus
gagtttgtatacctcaggcaccagc

SEQ ID NO: 357035 - DNA, 25 bp, Rattus norvegicus
gagtttgtatacgtcaggcaccagc

SEQ ID NO: 357036 - DNA, 25 bp, Rattus norvegicus
gagtttgtatttacatggagtgctt

SEQ ID NO: 357037 - DNA, 25 bp, Rattus norvegicus
gagtttgtatttctagcaccctgga

SEQ ID NO: 357038 - DNA, 25 bp, Rattus norvegicus
gagtttgtatttctgactgtcatct

SEQ ID NO: 357039 - DNA, 25 bp, Rattus norvegicus
gagtttgtatttgtagcaccctgga

SEQ ID NO: 357040 - DNA, 25 bp, Rattus norvegicus
gagtttgtatttgtgactgtcatct

SEQ ID NO: 357041 - DNA, 25 bp, Rattus norvegicus
gagtttgtattttcatggagtgctt

SEQ ID NO: 357042 - DNA, 25 bp, Rattus norvegicus
gagtttgtcagcatactttgcctac

SEQ ID NO: 357043 - DNA, 25 bp, Rattus norvegicus
gagtttgtcagcttactttgcctac

SEQ ID NO: 357044 - DNA, 25 bp, Rattus norvegicus
gagtttgtcagtcagtttacagctt

SEQ ID NO: 357045 - DNA, 25 bp, Rattus norvegicus
gagtttgtcagtgagtttacagctt

SEQ ID NO: 357046 - DNA, 25 bp, Rattus norvegicus
gagtttgtctttagtttacatttag

SEQ ID NO: 357047 - DNA, 25 bp, Rattus norvegicus
gagtttgtcttttgtttacatttag

SEQ ID NO: 357048 - DNA, 25 bp, Rattus norvegicus
gagtttgtgattactgcagtgatct

SEQ ID NO: 357049 - DNA, 25 bp, Rattus norvegicus
gagtttgtgatttctgcagtgatct

SEQ ID NO: 357050 - DNA, 25 bp, Rattus norvegicus
gagtttgtgcaacgtgcagaccacc

SEQ ID NO: 357051 - DNA, 25 bp, Rattus norvegicus
gagtttgtgcaaggtgcagaccacc

SEQ ID NO: 357052 - DNA, 25 bp, Rattus norvegicus
gagtttgtgcatatatagattttta

SEQ ID NO: 357053 - DNA, 25 bp, Rattus norvegicus
gagtttgtgcatttatagattttta

SEQ ID NO: 357054 - DNA, 25 bp, Rattus norvegicus
gagtttgtgctgctgacactacgtg

SEQ ID NO: 357055 - DNA, 25 bp, Rattus norvegicus
gagtttgtgctggtgacactacgtg

SEQ ID NO: 357056 - DNA, 25 bp, Rattus norvegicus
gagtttgtggctcacatcttccgca

SEQ ID NO: 357057 - DNA, 25 bp, Rattus norvegicus
gagtttgtggctgacatcttccgca

SEQ ID NO: 357058 - DNA, 25 bp, Rattus norvegicus
gagtttgtgggaagagcctcacctt

SEQ ID NO: 357059 - DNA, 25 bp, Rattus norvegicus
gagtttgtgggatgagcctcacctt

SEQ ID NO: 357060 - DNA, 25 bp, Rattus norvegicus
gagtttgtgtttaacagtcctgcaa

SEQ ID NO: 357061 - DNA, 25 bp, Rattus norvegicus
gagtttgtgttttacagtcctgcaa

SEQ ID NO: 357062 - DNA, 25 bp, Rattus norvegicus
gagtttgtttatatgctgtattcca

SEQ ID NO: 357063 - DNA, 25 bp, Rattus norvegicus
gagtttgtttatttgctgtattcca

SEQ ID NO: 357064 - DNA, 25 bp, Rattus norvegicus
gagtttgtttccatcactattggaa

SEQ ID NO: 357065 - DNA, 25 bp, Rattus norvegicus
gagtttgtttccttcactattggaa

SEQ ID NO: 357066 - DNA, 25 bp, Rattus norvegicus
gagttttaatacatattcctctgga

SEQ ID NO: 357067 - DNA, 25 bp, Rattus norvegicus
gagttttaatacttattcctctgga

SEQ ID NO: 357068 - DNA, 25 bp, Rattus norvegicus
gagttttaatttcaaggccagctta

SEQ ID NO: 357069 - DNA, 25 bp, Rattus norvegicus
gagttttaatttgaaggccagctta

SEQ ID NO: 357070 - DNA, 25 bp, Rattus norvegicus
gagttttacactaagtattcatgtt

SEQ ID NO: 357071 - DNA, 25 bp, Rattus norvegicus
gagttttacacttagtattcatgtt

SEQ ID NO: 357072 - DNA, 25 bp, Rattus norvegicus
gagttttacattagccaatggccag

SEQ ID NO: 357073 - DNA, 25 bp, Rattus norvegicus
gagttttacatttgccaatggccag

SEQ ID NO: 357074 - DNA, 25 bp, Rattus norvegicus
gagttttactccagagctgatgcac

SEQ ID NO: 357075 - DNA, 25 bp, Rattus norvegicus
gagttttactcctgagctgatgcac

SEQ ID NO: 357076 - DNA, 25 bp, Rattus norvegicus
gagttttagcacacgtctcacacac

SEQ ID NO: 357077 - DNA, 25 bp, Rattus norvegicus
gagttttagcactcgtctcacacac

SEQ ID NO: 357078 - DNA, 25 bp, Rattus norvegicus
gagttttagcttccatttgtattta

SEQ ID NO: 357079 - DNA, 25 bp, Rattus norvegicus
gagttttagcttgcatttgtattta

SEQ ID NO: 357080 - DNA, 25 bp, Rattus norvegicus
gagttttaggcaaagctcctccctt

SEQ ID NO: 357081 - DNA, 25 bp, Rattus norvegicus
gagttttaggcatagctcctccctt

SEQ ID NO: 357082 - DNA, 25 bp, Rattus norvegicus
gagttttagtcacatagggctgaac

SEQ ID NO: 357083 - DNA, 25 bp, Rattus norvegicus
gagttttagtcagatagggctgaac

SEQ ID NO: 357084 - DNA, 25 bp, Rattus norvegicus
gagttttagtgtaggccatcagcga

SEQ ID NO: 357085 - DNA, 25 bp, Rattus norvegicus
gagttttagtgttggccatcagcga

SEQ ID NO: 357086 - DNA, 25 bp, Rattus norvegicus
gagttttatatgcttccctaggcct

SEQ ID NO: 357087 - DNA, 25 bp, Rattus norvegicus
gagttttatatggttccctaggcct

SEQ ID NO: 357088 - DNA, 25 bp, Rattus norvegicus
gagttttatattacgaagttgccct

SEQ ID NO: 357089 - DNA, 25 bp, Rattus norvegicus
gagttttatatttcgaagttgccct

SEQ ID NO: 357090 - DNA, 25 bp, Rattus norvegicus
gagttttatcagcagaattccctaa

SEQ ID NO: 357091 - DNA, 25 bp, Rattus norvegicus
gagttttatcaggagaattccctaa

SEQ ID NO: 357092 - DNA, 25 bp, Rattus norvegicus
gagttttatcatattgacaatccaa

SEQ ID NO: 357093 - DNA, 25 bp, Rattus norvegicus
gagttttatcattttgacaatccaa

SEQ ID NO: 357094 - DNA, 25 bp, Rattus norvegicus
gagttttcaaaacctcctgccattc

SEQ ID NO: 357095 - DNA, 25 bp, Rattus norvegicus
gagttttcaaaagctcctgccattc

SEQ ID NO: 357096 - DNA, 25 bp, Rattus norvegicus
gagttttcatcaattcctccaactt

SEQ ID NO: 357097 - DNA, 25 bp, Rattus norvegicus
gagttttcatcatttcctccaactt

SEQ ID NO: 357098 - DNA, 25 bp, Rattus norvegicus
gagttttcatctatccccttgaaat

SEQ ID NO: 357099 - DNA, 25 bp, Rattus norvegicus
gagttttcatctttccccttgaaat

SEQ ID NO: 357100 - DNA, 25 bp, Rattus norvegicus
gagttttccacaccacaggtgttct

SEQ ID NO: 357101 - DNA, 25 bp, Rattus norvegicus
gagttttccacagcacaggtgttct

SEQ ID NO: 357102 - DNA, 25 bp, Rattus norvegicus
gagttttccagcatttataccaatg

SEQ ID NO: 357103 - DNA, 25 bp, Rattus norvegicus
gagttttccagcttttataccaatg

SEQ ID NO: 357104 - DNA, 25 bp, Rattus norvegicus
gagttttccctcaagcacagttgga

SEQ ID NO: 357105 - DNA, 25 bp, Rattus norvegicus
gagttttccctctagcacagttgga

SEQ ID NO: 357106 - DNA, 25 bp, Rattus norvegicus
gagttttcctaacaacatggtggct

SEQ ID NO: 357107 - DNA, 25 bp, Rattus norvegicus
gagttttcctaagaacatggtggct

SEQ ID NO: 357108 - DNA, 25 bp, Rattus norvegicus
gagttttcctggcactctggtgact

SEQ ID NO: 357109 - DNA, 25 bp, Rattus norvegicus
gagttttcctgggactctggtgact

SEQ ID NO: 357110 - DNA, 25 bp, Rattus norvegicus
gagttttcgtttatggtggctagca

SEQ ID NO: 357111 - DNA, 25 bp, Rattus norvegicus
gagttttcgtttttggtggctagca

SEQ ID NO: 357112 - DNA, 25 bp, Rattus norvegicus
gagttttctaaacttttctgcctga

SEQ ID NO: 357113 - DNA, 25 bp, Rattus norvegicus
gagttttctaaagttttctgcctga

SEQ ID NO: 357114 - DNA, 25 bp, Rattus norvegicus
gagttttctcagacttatggcctag

SEQ ID NO: 357115 - DNA, 25 bp, Rattus norvegicus
gagttttctcagtcttatggcctag

SEQ ID NO: 357116 - DNA, 25 bp, Rattus norvegicus
gagttttctcttaccaaaatacaag

SEQ ID NO: 357117 - DNA, 25 bp, Rattus norvegicus
gagttttctctttccaaaatacaag

SEQ ID NO: 357118 - DNA, 25 bp, Rattus norvegicus
gagttttctggaacctgcaagtatc

SEQ ID NO: 357119 - DNA, 25 bp, Rattus norvegicus
gagttttctggatcctgcaagtatc

SEQ ID NO: 357120 - DNA, 25 bp, Rattus norvegicus
gagttttcttaacgaggctggctga

SEQ ID NO: 357121 - DNA, 25 bp, Rattus norvegicus
gagttttcttaaggaggctggctga

SEQ ID NO: 357122 - DNA, 25 bp, Rattus norvegicus
gagttttcttcaagggaggatgatt

SEQ ID NO: 357123 - DNA, 25 bp, Rattus norvegicus
gagttttcttcatgggaggatgatt

SEQ ID NO: 357124 - DNA, 25 bp, Rattus norvegicus
gagttttcttctagattcttatgtc

SEQ ID NO: 357125 - DNA, 25 bp, Rattus norvegicus
gagttttcttcttgattcttatgtc

SEQ ID NO: 357126 - DNA, 25 bp, Rattus norvegicus
gagttttcttggaacgggatagtca

SEQ ID NO: 357127 - DNA, 25 bp, Rattus norvegicus
gagttttcttggtacgggatagtca

SEQ ID NO: 357128 - DNA, 25 bp, Rattus norvegicus
gagttttgaaccacgtagggtccag

SEQ ID NO: 357129 - DNA, 25 bp, Rattus norvegicus
gagttttgaacctcgtagggtccag

SEQ ID NO: 357130 - DNA, 25 bp, Rattus norvegicus
gagttttgagtcagccagggctaca

SEQ ID NO: 357131 - DNA, 25 bp, Rattus norvegicus
gagttttgagtctgccagggctaca

SEQ ID NO: 357132 - DNA, 25 bp, Rattus norvegicus
gagttttgatgtatcctttctgtcc

SEQ ID NO: 357133 - DNA, 25 bp, Rattus norvegicus
gagttttgatgtttcctttctgtcc

SEQ ID NO: 357134 - DNA, 25 bp, Rattus norvegicus
gagttttgcaaaaagccaccctaga

SEQ ID NO: 357135 - DNA, 25 bp, Rattus norvegicus
gagttttgcaaatagccaccctaga

SEQ ID NO: 357136 - DNA, 25 bp, Rattus norvegicus
gagttttggactctgactcaaatac

SEQ ID NO: 357137 - DNA, 25 bp, Rattus norvegicus
gagttttggactgtgactcaaatac

SEQ ID NO: 357138 - DNA, 25 bp, Rattus norvegicus
gagttttggcacctttctttattag

SEQ ID NO: 357139 - DNA, 25 bp, Rattus norvegicus
gagttttggcacgtttctttattag

SEQ ID NO: 357140 - DNA, 25 bp, Rattus norvegicus
gagttttggctgactgccttagcag

SEQ ID NO: 357141 - DNA, 25 bp, Rattus norvegicus
gagttttggctgtctgccttagcag

SEQ ID NO: 357142 - DNA, 25 bp, Rattus norvegicus
gagttttgtaacaccctgctacatt

SEQ ID NO: 357143 - DNA, 25 bp, Rattus norvegicus
gagttttgtaactccctgctacatt

SEQ ID NO: 357144 - DNA, 25 bp, Rattus norvegicus
gagttttgtctcacaagtccaatgg

SEQ ID NO: 357145 - DNA, 25 bp, Rattus norvegicus
gagttttgtctctcaagtccaatgg

SEQ ID NO: 357146 - DNA, 25 bp, Rattus norvegicus
gagttttgtgctactcagaattcca

SEQ ID NO: 357147 - DNA, 25 bp, Rattus norvegicus
gagttttgtgcttctcagaattcca

SEQ ID NO: 357148 - DNA, 25 bp, Rattus norvegicus
gagttttgttagctgttcttgccaa

SEQ ID NO: 357149 - DNA, 25 bp, Rattus norvegicus
gagttttgttaggtgttcttgccaa

SEQ ID NO: 357150 - DNA, 25 bp, Rattus norvegicus
gagttttgtttcaccgtcatgacat

SEQ ID NO: 357151 - DNA, 25 bp, Rattus norvegicus
gagttttgtttctccgtcatgacat

SEQ ID NO: 357152 - DNA, 25 bp, Rattus norvegicus
gagtttttactcagttacctgttga

SEQ ID NO: 357153 - DNA, 25 bp, Rattus norvegicus
gagtttttactctgttacctgttga

SEQ ID NO: 357154 - DNA, 25 bp, Rattus norvegicus
gagtttttaggcacccacttgagtt

SEQ ID NO: 357155 - DNA, 25 bp, Rattus norvegicus
gagtttttaggctcccacttgagtt

SEQ ID NO: 357156 - DNA, 25 bp, Rattus norvegicus
gagtttttagtcacttgttttcgat

SEQ ID NO: 357157 - DNA, 25 bp, Rattus norvegicus
gagtttttagtctcttgttttcgat

SEQ ID NO: 357158 - DNA, 25 bp, Rattus norvegicus
gagtttttccctagagtgaatgctt

SEQ ID NO: 357159 - DNA, 25 bp, Rattus norvegicus
gagtttttcccttgagtgaatgctt

SEQ ID NO: 357160 - DNA, 25 bp, Rattus norvegicus
gagtttttcctacccattgagtcta

SEQ ID NO: 357161 - DNA, 25 bp, Rattus norvegicus
gagtttttcctagccattgagtcta

SEQ ID NO: 357162 - DNA, 25 bp, Rattus norvegicus
gagtttttctgactataaccgtatt

SEQ ID NO: 357163 - DNA, 25 bp, Rattus norvegicus
gagtttttctgagtataaccgtatt

SEQ ID NO: 357164 - DNA, 25 bp, Rattus norvegicus
gagtttttctgcagctttttgtgaa

SEQ ID NO: 357165 - DNA, 25 bp, Rattus norvegicus
gagtttttctgctgctttttgtgaa

SEQ ID NO: 357166 - DNA, 25 bp, Rattus norvegicus
gagtttttcttaagcctaaatccaa

SEQ ID NO: 357167 - DNA, 25 bp, Rattus norvegicus
gagtttttcttatgcctaaatccaa

SEQ ID NO: 357168 - DNA, 25 bp, Rattus norvegicus
gagtttttgagtacttgtgtgtgga

SEQ ID NO: 357169 - DNA, 25 bp, Rattus norvegicus
gagtttttgagttcttgtgtgtgga

SEQ ID NO: 357170 - DNA, 25 bp, Rattus norvegicus
gagtttttggcaaagttccgtcatc

SEQ ID NO: 357171 - DNA, 25 bp, Rattus norvegicus
gagtttttggcacctgacctcaata

SEQ ID NO: 357172 - DNA, 25 bp, Rattus norvegicus
gagtttttggcagctgacctcaata

SEQ ID NO: 357173 - DNA, 25 bp, Rattus norvegicus
gagtttttggcatagttccgtcatc

SEQ ID NO: 357174 - DNA, 25 bp, Rattus norvegicus
gagtttttgtccacgtcaattgctc

SEQ ID NO: 357175 - DNA, 25 bp, Rattus norvegicus
gagtttttgtcctcgtcaattgctc

SEQ ID NO: 357176 - DNA, 25 bp, Rattus norvegicus
gagttttttcaaagcgccagtgact

SEQ ID NO: 357177 - DNA, 25 bp, Rattus norvegicus
gagttttttcaatgcgccagtgact

SEQ ID NO: 357178 - DNA, 25 bp, Rattus norvegicus
gagttttttcaccttgtaggactag

SEQ ID NO: 357179 - DNA, 25 bp, Rattus norvegicus
gagttttttcacgttgtaggactag

SEQ ID NO: 357180 - DNA, 25 bp, Rattus norvegicus
gagttttttcatcacaacttgcagg

SEQ ID NO: 357181 - DNA, 25 bp, Rattus norvegicus
gagttttttcatgacaacttgcagg

SEQ ID NO: 357182 - DNA, 25 bp, Rattus norvegicus
gagttttttctcagctggatgctaa

SEQ ID NO: 357183 - DNA, 25 bp, Rattus norvegicus
gagttttttctctgctggatgctaa

SEQ ID NO: 357184 - DNA, 25 bp, Rattus norvegicus
gagttttttgcacagctgtgtgact

SEQ ID NO: 357185 - DNA, 25 bp, Rattus norvegicus
gagttttttgcagagctgtgtgact

SEQ ID NO: 357186 - DNA, 25 bp, Rattus norvegicus
gataaaaacacccaaggccaagcag

SEQ ID NO: 357187 - DNA, 25 bp, Rattus norvegicus
gataaaaacaccgaaggccaagcag

SEQ ID NO: 357188 - DNA, 25 bp, Rattus norvegicus
gataaaaagcccagcaagaacttct

SEQ ID NO: 357189 - DNA, 25 bp, Rattus norvegicus
gataaaaagccctgcaagaacttct

SEQ ID NO: 357190 - DNA, 25 bp, Rattus norvegicus
gataaaaatgcaagtccccgttgta

SEQ ID NO: 357191 - DNA, 25 bp, Rattus norvegicus
gataaaaatgcatgtccccgttgta

SEQ ID NO: 357192 - DNA, 25 bp, Rattus norvegicus
gataaaacactgaagtgcctcgttt

SEQ ID NO: 357193 - DNA, 25 bp, Rattus norvegicus
gataaaacactgtagtgcctcgttt

SEQ ID NO: 357194 - DNA, 25 bp, Rattus norvegicus
gataaaacaggacttcttccacctt

SEQ ID NO: 357195 - DNA, 25 bp, Rattus norvegicus
gataaaacaggagttcttccacctt

SEQ ID NO: 357196 - DNA, 25 bp, Rattus norvegicus
gataaaaccaacagaacttgccgtt

SEQ ID NO: 357197 - DNA, 25 bp, Rattus norvegicus
gataaaaccaactgaacttgccgtt

SEQ ID NO: 357198 - DNA, 25 bp, Rattus norvegicus
gataaaaccatcagaggtatgtcct

SEQ ID NO: 357199 - DNA, 25 bp, Rattus norvegicus
gataaaaccatctgaggtatgtcct

SEQ ID NO: 357200 - DNA, 25 bp, Rattus norvegicus
gataaaacccatacttgtgctcata

SEQ ID NO: 357201 - DNA, 25 bp, Rattus norvegicus
gataaaacccattcttgtgctcata

SEQ ID NO: 357202 - DNA, 25 bp, Rattus norvegicus
gataaaactgtgcatacttcattca

SEQ ID NO: 357203 - DNA, 25 bp, Rattus norvegicus
gataaaactgtggatacttcattca

SEQ ID NO: 357204 - DNA, 25 bp, Rattus norvegicus
gataaaagaccactgctgccaccat

SEQ ID NO: 357205 - DNA, 25 bp, Rattus norvegicus
gataaaagaccagtgctgccaccat

SEQ ID NO: 357206 - DNA, 25 bp, Rattus norvegicus
gataaaagcagcctgggtcacccag

SEQ ID NO: 357207 - DNA, 25 bp, Rattus norvegicus
gataaaagcagcgtgggtcacccag

SEQ ID NO: 357208 - DNA, 25 bp, Rattus norvegicus
gataaaagtggtaccagactgccag

SEQ ID NO: 357209 - DNA, 25 bp, Rattus norvegicus
gataaaagtggttccagactgccag

SEQ ID NO: 357210 - DNA, 25 bp, Rattus norvegicus
gataaaagttgcagcgtcccaccat

SEQ ID NO: 357211 - DNA, 25 bp, Rattus norvegicus
gataaaagttgctgcgtcccaccat

SEQ ID NO: 357212 - DNA, 25 bp, Rattus norvegicus
gataaaataactcctgacagaaact

SEQ ID NO: 357213 - DNA, 25 bp, Rattus norvegicus
gataaaataactgctgacagaaact

SEQ ID NO: 357214 - DNA, 25 bp, Rattus norvegicus
gataaaatagacagcctcctagaag

SEQ ID NO: 357215 - DNA, 25 bp, Rattus norvegicus
gataaaatagactgcctcctagaag

SEQ ID NO: 357216 - DNA, 25 bp, Rattus norvegicus
gataaaatccctataatggcccagt

SEQ ID NO: 357217 - DNA, 25 bp, Rattus norvegicus
gataaaatccctttaatggcccagt

SEQ ID NO: 357218 - DNA, 25 bp, Rattus norvegicus
gataaaatgacccactgctggcacc

SEQ ID NO: 357219 - DNA, 25 bp, Rattus norvegicus
gataaaatgaccgactgctggcacc

SEQ ID NO: 357220 - DNA, 25 bp, Rattus norvegicus
gataaaatgcagatcttacccaaga

SEQ ID NO: 357221 - DNA, 25 bp, Rattus norvegicus
gataaaatgcagttcttacccaaga

SEQ ID NO: 357222 - DNA, 25 bp, Rattus norvegicus
gataaaatggccctcgtgggtctca

SEQ ID NO: 357223 - DNA, 25 bp, Rattus norvegicus
gataaaatggccgtcgtgggtctca

SEQ ID NO: 357224 - DNA, 25 bp, Rattus norvegicus
gataaaattattaggcgtgccactt

SEQ ID NO: 357225 - DNA, 25 bp, Rattus norvegicus
gataaaattatttggcgtgccactt

SEQ ID NO: 357226 - DNA, 25 bp, Rattus norvegicus
gataaaattcctatcttacattctg

SEQ ID NO: 357227 - DNA, 25 bp, Rattus norvegicus
gataaaattcctttcttacattctg

SEQ ID NO: 357228 - DNA, 25 bp, Rattus norvegicus
gataaaattgtcagcgtctatgaat

SEQ ID NO: 357229 - DNA, 25 bp, Rattus norvegicus
gataaaattgtctgcgtctatgaat

SEQ ID NO: 357230 - DNA, 25 bp, Rattus norvegicus
gataaacacagtctgctgacctcta

SEQ ID NO: 357231 - DNA, 25 bp, Rattus norvegicus
gataaacacagtgtgctgacctcta

SEQ ID NO: 357232 - DNA, 25 bp, Rattus norvegicus
gataaacacatcacagcttcaaact

SEQ ID NO: 357233 - DNA, 25 bp, Rattus norvegicus
gataaacacatctcagcttcaaact

SEQ ID NO: 357234 - DNA, 25 bp, Rattus norvegicus
gataaacagaggaggcgatgcagct

SEQ ID NO: 357235 - DNA, 25 bp, Rattus norvegicus
gataaacagaggtggcgatgcagct

SEQ ID NO: 357236 - DNA, 25 bp, Rattus norvegicus
gataaacagcgtattcacctgcgcc

SEQ ID NO: 357237 - DNA, 25 bp, Rattus norvegicus
gataaacagcgttttcacctgcgcc

SEQ ID NO: 357238 - DNA, 25 bp, Rattus norvegicus
gataaacatgatcggcacacttctt

SEQ ID NO: 357239 - DNA, 25 bp, Rattus norvegicus
gataaacatgatgggcacacttctt

SEQ ID NO: 357240 - DNA, 25 bp, Rattus norvegicus
gataaacatgcaacgagggcccagg

SEQ ID NO: 357241 - DNA, 25 bp, Rattus norvegicus
gataaacatgcatcgagggcccagg

SEQ ID NO: 357242 - DNA, 25 bp, Rattus norvegicus
gataaaccacacaactggaaaccag

SEQ ID NO: 357243 - DNA, 25 bp, Rattus norvegicus
gataaaccacactactggaaaccag

SEQ ID NO: 357244 - DNA, 25 bp, Rattus norvegicus
gataaaccactcatgtgtctataac

SEQ ID NO: 357245 - DNA, 25 bp, Rattus norvegicus
gataaaccactcttgtgtctataac

SEQ ID NO: 357246 - DNA, 25 bp, Rattus norvegicus
gataaaccatgtaccggcagaaact

SEQ ID NO: 357247 - DNA, 25 bp, Rattus norvegicus
gataaaccatgttccggcagaaact

SEQ ID NO: 357248 - DNA, 25 bp, Rattus norvegicus
gataaaccatttctacttatatcag

SEQ ID NO: 357249 - DNA, 25 bp, Rattus norvegicus
gataaaccatttgtacttatatcag

SEQ ID NO: 357250 - DNA, 25 bp, Rattus norvegicus
gataaacccacgcaccatcaggatg

SEQ ID NO: 357251 - DNA, 25 bp, Rattus norvegicus
gataaacccacggaccatcaggatg

SEQ ID NO: 357252 - DNA, 25 bp, Rattus norvegicus
gataaacccattacctagcatgatt

SEQ ID NO: 357253 - DNA, 25 bp, Rattus norvegicus
gataaacccatttcctagcatgatt

SEQ ID NO: 357254 - DNA, 25 bp, Rattus norvegicus
gataaacccctgatgtcgaagaaga

SEQ ID NO: 357255 - DNA, 25 bp, Rattus norvegicus
gataaacccctgttgtcgaagaaga

SEQ ID NO: 357256 - DNA, 25 bp, Rattus norvegicus
gataaaccggtccatggacacctat

SEQ ID NO: 357257 - DNA, 25 bp, Rattus norvegicus
gataaaccggtcgatggacacctat

SEQ ID NO: 357258 - DNA, 25 bp, Rattus norvegicus
gataaacctgaaccacttgctgccc

SEQ ID NO: 357259 - DNA, 25 bp, Rattus norvegicus
gataaacctgaagcacttgctgccc

SEQ ID NO: 357260 - DNA, 25 bp, Rattus norvegicus
gataaacctggtctgctgtataaca

SEQ ID NO: 357261 - DNA, 25 bp, Rattus norvegicus
gataaacctggtgtgctgtataaca

SEQ ID NO: 357262 - DNA, 25 bp, Rattus norvegicus
gataaaccttctaccttgtgggttg

SEQ ID NO: 357263 - DNA, 25 bp, Rattus norvegicus
gataaaccttcttccttgtgggttg

SEQ ID NO: 357264 - DNA, 25 bp, Rattus norvegicus
gataaaccttttcaaccagcagcaa

SEQ ID NO: 357265 - DNA, 25 bp, Rattus norvegicus
gataaaccttttgaaccagcagcaa

SEQ ID NO: 357266 - DNA, 25 bp, Rattus norvegicus
gataaacgcatcagaacttcaccct

SEQ ID NO: 357267 - DNA, 25 bp, Rattus norvegicus
gataaacgcatctgaacttcaccct

SEQ ID NO: 357268 - DNA, 25 bp, Rattus norvegicus
gataaactcaggctcattggataag

SEQ ID NO: 357269 - DNA, 25 bp, Rattus norvegicus
gataaactcagggtcattggataag

SEQ ID NO: 357270 - DNA, 25 bp, Rattus norvegicus
gataaactcatactcataaactcaa

SEQ ID NO: 357271 - DNA, 25 bp, Rattus norvegicus
gataaactcatagtcataaactcaa

SEQ ID NO: 357272 - DNA, 25 bp, Rattus norvegicus
gataaactcttcacctcagaggcaa

SEQ ID NO: 357273 - DNA, 25 bp, Rattus norvegicus
gataaactcttctcctcagaggcaa

SEQ ID NO: 357274 - DNA, 25 bp, Rattus norvegicus
gataaactgaccacgcggcggccag

SEQ ID NO: 357275 - DNA, 25 bp, Rattus norvegicus
gataaactgaccatgagatctttct

SEQ ID NO: 357276 - DNA, 25 bp, Rattus norvegicus
gataaactgacctcgcggcggccag

SEQ ID NO: 357277 - DNA, 25 bp, Rattus norvegicus
gataaactgaccttgagatctttct

SEQ ID NO: 357278 - DNA, 25 bp, Rattus norvegicus
gataaactggacactgtgttccaat

SEQ ID NO: 357279 - DNA, 25 bp, Rattus norvegicus
gataaactggactctgtgttccaat

SEQ ID NO: 357280 - DNA, 25 bp, Rattus norvegicus
gataaactgtgaaacctcctgacca

SEQ ID NO: 357281 - DNA, 25 bp, Rattus norvegicus
gataaactgtgatacctcctgacca

SEQ ID NO: 357282 - DNA, 25 bp, Rattus norvegicus
gataaacttgatacacccggttgcc

SEQ ID NO: 357283 - DNA, 25 bp, Rattus norvegicus
gataaacttgattcacccggttgcc

SEQ ID NO: 357284 - DNA, 25 bp, Rattus norvegicus
gataaagaaatgatagcagctccag

SEQ ID NO: 357285 - DNA, 25 bp, Rattus norvegicus
gataaagaaatgttagcagctccag

SEQ ID NO: 357286 - DNA, 25 bp, Rattus norvegicus
gataaagaagctcggctcccgttcc

SEQ ID NO: 357287 - DNA, 25 bp, Rattus norvegicus
gataaagaagctgggctcccgttcc

SEQ ID NO: 357288 - DNA, 25 bp, Rattus norvegicus
gataaagacattagagggcctgacc

SEQ ID NO: 357289 - DNA, 25 bp, Rattus norvegicus
gataaagacatttgagggcctgacc

SEQ ID NO: 357290 - DNA, 25 bp, Rattus norvegicus
gataaagactccatgcagctggtga

SEQ ID NO: 357291 - DNA, 25 bp, Rattus norvegicus
gataaagactccttgcagctggtga

SEQ ID NO: 357292 - DNA, 25 bp, Rattus norvegicus
gataaagactgcagggtttgtccca

SEQ ID NO: 357293 - DNA, 25 bp, Rattus norvegicus
gataaagactgctgggtttgtccca

SEQ ID NO: 357294 - DNA, 25 bp, Rattus norvegicus
gataaagactttcggttgtgtttct

SEQ ID NO: 357295 - DNA, 25 bp, Rattus norvegicus
gataaagactttgggttgtgtttct

SEQ ID NO: 357296 - DNA, 25 bp, Rattus norvegicus
gataaagagctgaccgctggagctg

SEQ ID NO: 357297 - DNA, 25 bp, Rattus norvegicus
gataaagagctgtccgctggagctg

SEQ ID NO: 357298 - DNA, 25 bp, Rattus norvegicus
gataaagagtaccttgccgaagtct

SEQ ID NO: 357299 - DNA, 25 bp, Rattus norvegicus
gataaagagtacgttgccgaagtct

SEQ ID NO: 357300 - DNA, 25 bp, Rattus norvegicus
gataaagattggcaccctttggact

SEQ ID NO: 357301 - DNA, 25 bp, Rattus norvegicus
gataaagattgggaccctttggact

SEQ ID NO: 357302 - DNA, 25 bp, Rattus norvegicus
gataaagcacaacccagtctcttag

SEQ ID NO: 357303 - DNA, 25 bp, Rattus norvegicus
gataaagcacaagccagtctcttag

SEQ ID NO: 357304 - DNA, 25 bp, Rattus norvegicus
gataaagcactgacatttccttcct

SEQ ID NO: 357305 - DNA, 25 bp, Rattus norvegicus
gataaagcactgtcatttccttcct

SEQ ID NO: 357306 - DNA, 25 bp, Rattus norvegicus
gataaagcccaaagttatagctatg

SEQ ID NO: 357307 - DNA, 25 bp, Rattus norvegicus
gataaagcccaatgttatagctatg

SEQ ID NO: 357308 - DNA, 25 bp, Rattus norvegicus
gataaagccctacttatgtcttgaa

SEQ ID NO: 357309 - DNA, 25 bp, Rattus norvegicus
gataaagccctagttatgtcttgaa

SEQ ID NO: 357310 - DNA, 25 bp, Rattus norvegicus
gataaagcctgacgcgcacagcgca

SEQ ID NO: 357311 - DNA, 25 bp, Rattus norvegicus
gataaagcctgaggcgcacagcgca

SEQ ID NO: 357312 - DNA, 25 bp, Rattus norvegicus
gataaagctctccttgatctagaga

SEQ ID NO: 357313 - DNA, 25 bp, Rattus norvegicus
gataaagctctcgttgatctagaga

SEQ ID NO: 357314 - DNA, 25 bp, Rattus norvegicus
gataaagctgtgaccttgtttagaa

SEQ ID NO: 357315 - DNA, 25 bp, Rattus norvegicus
gataaagctgtgtccttgtttagaa

SEQ ID NO: 357316 - DNA, 25 bp, Rattus norvegicus
gataaaggacatcgcctcatcctcc

SEQ ID NO: 357317 - DNA, 25 bp, Rattus norvegicus
gataaaggacatggcctcatcctcc

SEQ ID NO: 357318 - DNA, 25 bp, Rattus norvegicus
gataaaggagccacggttctcatct

SEQ ID NO: 357319 - DNA, 25 bp, Rattus norvegicus
gataaaggagcctcggttctcatct

SEQ ID NO: 357320 - DNA, 25 bp, Rattus norvegicus
gataaaggccagctgccaccaagac

SEQ ID NO: 357321 - DNA, 25 bp, Rattus norvegicus
gataaaggccaggtgccaccaagac

SEQ ID NO: 357322 - DNA, 25 bp, Rattus norvegicus
gataaaggctgcaggtgcctaccag

SEQ ID NO: 357323 - DNA, 25 bp, Rattus norvegicus
gataaaggctgctggtgcctaccag

SEQ ID NO: 357324 - DNA, 25 bp, Rattus norvegicus
gataaaggtactagcccaccaagtt

SEQ ID NO: 357325 - DNA, 25 bp, Rattus norvegicus
gataaaggtactagctcctgtgcct

SEQ ID NO: 357326 - DNA, 25 bp, Rattus norvegicus
gataaaggtacttgcccaccaagtt

SEQ ID NO: 357327 - DNA, 25 bp, Rattus norvegicus
gataaaggtacttgctcctgtgcct

SEQ ID NO: 357328 - DNA, 25 bp, Rattus norvegicus
gataaaggtctgacaccacttgaaa

SEQ ID NO: 357329 - DNA, 25 bp, Rattus norvegicus
gataaaggtctgtcaccacttgaaa

SEQ ID NO: 357330 - DNA, 25 bp, Rattus norvegicus
gataaagtctgaatgccactgtgca

SEQ ID NO: 357331 - DNA, 25 bp, Rattus norvegicus
gataaagtctgattgccactgtgca

SEQ ID NO: 357332 - DNA, 25 bp, Rattus norvegicus
gataaagtgctgcttacatggtaac

SEQ ID NO: 357333 - DNA, 25 bp, Rattus norvegicus
gataaagtgctggttacatggtaac

SEQ ID NO: 357334 - DNA, 25 bp, Rattus norvegicus
gataaagtggccagcaaccagccct

SEQ ID NO: 357335 - DNA, 25 bp, Rattus norvegicus
gataaagtggcctgcaaccagccct

SEQ ID NO: 357336 - DNA, 25 bp, Rattus norvegicus
gataaagttcctacctcttctacca

SEQ ID NO: 357337 - DNA, 25 bp, Rattus norvegicus
gataaagttccttcctcttctacca

SEQ ID NO: 357338 - DNA, 25 bp, Rattus norvegicus
gataaagtttcacttctcccaaagt

SEQ ID NO: 357339 - DNA, 25 bp, Rattus norvegicus
gataaagtttcagttctcccaaagt

SEQ ID NO: 357340 - DNA, 25 bp, Rattus norvegicus
gataaataatggaggtaagccccgg

SEQ ID NO: 357341 - DNA, 25 bp, Rattus norvegicus
gataaataatggtggtaagccccgg

SEQ ID NO: 357342 - DNA, 25 bp, Rattus norvegicus
gataaataatttaccttgtgataga

SEQ ID NO: 357343 - DNA, 25 bp, Rattus norvegicus
gataaataattttccttgtgataga

SEQ ID NO: 357344 - DNA, 25 bp, Rattus norvegicus
gataaatatggacgtcattattcat

SEQ ID NO: 357345 - DNA, 25 bp, Rattus norvegicus
gataaatatggaggtcattattcat

SEQ ID NO: 357346 - DNA, 25 bp, Rattus norvegicus
gataaatcccgcaaccgcaaagatg

SEQ ID NO: 357347 - DNA, 25 bp, Rattus norvegicus
gataaatcccgctaccgcaaagatg

SEQ ID NO: 357348 - DNA, 25 bp, Rattus norvegicus
gataaatcgtctcaggtccggagca

SEQ ID NO: 357349 - DNA, 25 bp, Rattus norvegicus
gataaatcgtctgaggtccggagca

SEQ ID NO: 357350 - DNA, 25 bp, Rattus norvegicus
gataaatcttccaggcttcatcaag

SEQ ID NO: 357351 - DNA, 25 bp, Rattus norvegicus
gataaatcttcctggcttcatcaag

SEQ ID NO: 357352 - DNA, 25 bp, Rattus norvegicus
gataaatgactacttagcatcctaa

SEQ ID NO: 357353 - DNA, 25 bp, Rattus norvegicus
gataaatgactagttagcatcctaa

SEQ ID NO: 357354 - DNA, 25 bp, Rattus norvegicus
gataaatgccttactgtgtttctga

SEQ ID NO: 357355 - DNA, 25 bp, Rattus norvegicus
gataaatgccttctccaattacctc

SEQ ID NO: 357356 - DNA, 25 bp, Rattus norvegicus
gataaatgccttgtccaattacctc

SEQ ID NO: 357357 - DNA, 25 bp, Rattus norvegicus
gataaatgcctttctgtgtttctga

SEQ ID NO: 357358 - DNA, 25 bp, Rattus norvegicus
gataaatgctgcatcttctagaaca

SEQ ID NO: 357359 - DNA, 25 bp, Rattus norvegicus
gataaatgctgcttcttctagaaca

SEQ ID NO: 357360 - DNA, 25 bp, Rattus norvegicus
gataaatggctaccccgtactacga

SEQ ID NO: 357361 - DNA, 25 bp, Rattus norvegicus
gataaatggctacggacactctggg

SEQ ID NO: 357362 - DNA, 25 bp, Rattus norvegicus
gataaatggctagcccgtactacga

SEQ ID NO: 357363 - DNA, 25 bp, Rattus norvegicus
gataaatggctagggacactctggg

SEQ ID NO: 357364 - DNA, 25 bp, Rattus norvegicus
gataaatggtgaaggcgccctccag

SEQ ID NO: 357365 - DNA, 25 bp, Rattus norvegicus
gataaatggtgatggcgccctccag

SEQ ID NO: 357366 - DNA, 25 bp, Rattus norvegicus
gataaatggtttacatcagccggat

SEQ ID NO: 357367 - DNA, 25 bp, Rattus norvegicus
gataaatggttttcatcagccggat

SEQ ID NO: 357368 - DNA, 25 bp, Rattus norvegicus
gataaatgtcataatctctctgaag

SEQ ID NO: 357369 - DNA, 25 bp, Rattus norvegicus
gataaatgtcattatctctctgaag

SEQ ID NO: 357370 - DNA, 25 bp, Rattus norvegicus
gataaatgtctcactttgcccatgc

SEQ ID NO: 357371 - DNA, 25 bp, Rattus norvegicus
gataaatgtctctctttgcccatgc

SEQ ID NO: 357372 - DNA, 25 bp, Rattus norvegicus
gataaatgtgtaaactgccctcctc

SEQ ID NO: 357373 - DNA, 25 bp, Rattus norvegicus
gataaatgtgtatactgccctcctc

SEQ ID NO: 357374 - DNA, 25 bp, Rattus norvegicus
gataaattactgaaggacctcctcc

SEQ ID NO: 357375 - DNA, 25 bp, Rattus norvegicus
gataaattactgtaggacctcctcc

SEQ ID NO: 357376 - DNA, 25 bp, Rattus norvegicus
gataaattacttcctggctgtttcc

SEQ ID NO: 357377 - DNA, 25 bp, Rattus norvegicus
gataaattacttgctggctgtttcc

SEQ ID NO: 357378 - DNA, 25 bp, Rattus norvegicus
gataaattatttcaacccaggaact

SEQ ID NO: 357379 - DNA, 25 bp, Rattus norvegicus
gataaattatttgaacccaggaact

SEQ ID NO: 357380 - DNA, 25 bp, Rattus norvegicus
gataaattcagccttaccctgtgga

SEQ ID NO: 357381 - DNA, 25 bp, Rattus norvegicus
gataaattcagcgttaccctgtgga

SEQ ID NO: 357382 - DNA, 25 bp, Rattus norvegicus
gataaattccatcttctccatagaa

SEQ ID NO: 357383 - DNA, 25 bp, Rattus norvegicus
gataaattccatgttctccatagaa

SEQ ID NO: 357384 - DNA, 25 bp, Rattus norvegicus
gataaattccctcactgacaatcca

SEQ ID NO: 357385 - DNA, 25 bp, Rattus norvegicus
gataaattccctgactgacaatcca

SEQ ID NO: 357386 - DNA, 25 bp, Rattus norvegicus
gataaattcggccttggagccgctg

SEQ ID NO: 357387 - DNA, 25 bp, Rattus norvegicus
gataaattcggcgttggagccgctg

SEQ ID NO: 357388 - DNA, 25 bp, Rattus norvegicus
gataaattgtcgaatcctgctgatt

SEQ ID NO: 357389 - DNA, 25 bp, Rattus norvegicus
gataaattgtcgtatcctgctgatt

SEQ ID NO: 357390 - DNA, 25 bp, Rattus norvegicus
gataaatttaagatcaaaggcacta

SEQ ID NO: 357391 - DNA, 25 bp, Rattus norvegicus
gataaatttaagttcaaaggcacta

SEQ ID NO: 357392 - DNA, 25 bp, Rattus norvegicus
gataaatttctccatactgtcctct

SEQ ID NO: 357393 - DNA, 25 bp, Rattus norvegicus
gataaatttctcgatactgtcctct

SEQ ID NO: 357394 - DNA, 25 bp, Rattus norvegicus
gataaattttcccaaaagcgaccat

SEQ ID NO: 357395 - DNA, 25 bp, Rattus norvegicus
gataaattttccgaaaagcgaccat

SEQ ID NO: 357396 - DNA, 25 bp, Rattus norvegicus
gataacacacatcaaaccactaaat

SEQ ID NO: 357397 - DNA, 25 bp, Rattus norvegicus
gataacacacatgaaaccactaaat

SEQ ID NO: 357398 - DNA, 25 bp, Rattus norvegicus
gataacacctgccacctagaaatgt

SEQ ID NO: 357399 - DNA, 25 bp, Rattus norvegicus
gataacacctgcgacctagaaatgt

SEQ ID NO: 357400 - DNA, 25 bp, Rattus norvegicus
gataacacgctaagacctgtaccac

SEQ ID NO: 357401 - DNA, 25 bp, Rattus norvegicus
gataacacgctatgacctgtaccac

SEQ ID NO: 357402 - DNA, 25 bp, Rattus norvegicus
gataacacggtgcactttctgaaga

SEQ ID NO: 357403 - DNA, 25 bp, Rattus norvegicus
gataacacggtggactttctgaaga

SEQ ID NO: 357404 - DNA, 25 bp, Rattus norvegicus
gataacactcgtatggacctcatca

SEQ ID NO: 357405 - DNA, 25 bp, Rattus norvegicus
gataacactcgtttggacctcatca

SEQ ID NO: 357406 - DNA, 25 bp, Rattus norvegicus
gataacactggcacatgtcacgatc

SEQ ID NO: 357407 - DNA, 25 bp, Rattus norvegicus
gataacactggctcatgtcacgatc

SEQ ID NO: 357408 - DNA, 25 bp, Rattus norvegicus
gataacagaattccagctcttcaag

SEQ ID NO: 357409 - DNA, 25 bp, Rattus norvegicus
gataacagaattgcagctcttcaag

SEQ ID NO: 357410 - DNA, 25 bp, Rattus norvegicus
gataacagataacgttcagcttgac

SEQ ID NO: 357411 - DNA, 25 bp, Rattus norvegicus
gataacagataaggttcagcttgac

SEQ ID NO: 357412 - DNA, 25 bp, Rattus norvegicus
gataacagatgacttcccaggaatt

SEQ ID NO: 357413 - DNA, 25 bp, Rattus norvegicus
gataacagatgagttcccaggaatt

SEQ ID NO: 357414 - DNA, 25 bp, Rattus norvegicus
gataacagcacacgattcctgcttt

SEQ ID NO: 357415 - DNA, 25 bp, Rattus norvegicus
gataacagcacaggattcctgcttt

SEQ ID NO: 357416 - DNA, 25 bp, Rattus norvegicus
gataacagcctgatcccagagatga

SEQ ID NO: 357417 - DNA, 25 bp, Rattus norvegicus
gataacagcctgttcccagagatga

SEQ ID NO: 357418 - DNA, 25 bp, Rattus norvegicus
gataacagtgtaagccaagagtggt

SEQ ID NO: 357419 - DNA, 25 bp, Rattus norvegicus
gataacagtgtatgccaagagtggt

SEQ ID NO: 357420 - DNA, 25 bp, Rattus norvegicus
gataacatccccattcattgctaga

SEQ ID NO: 357421 - DNA, 25 bp, Rattus norvegicus
gataacatcccctttcattgctaga

SEQ ID NO: 357422 - DNA, 25 bp, Rattus norvegicus
gataacatgcttaggcacgcctgat

SEQ ID NO: 357423 - DNA, 25 bp, Rattus norvegicus
gataacatgctttggcacgcctgat

SEQ ID NO: 357424 - DNA, 25 bp, Rattus norvegicus
gataacatgttcatttgccacttca

SEQ ID NO: 357425 - DNA, 25 bp, Rattus norvegicus
gataacatgttcttttgccacttca

SEQ ID NO: 357426 - DNA, 25 bp, Rattus norvegicus
gataacattgtgaacctgagggctg

SEQ ID NO: 357427 - DNA, 25 bp, Rattus norvegicus
gataacattgtgtacctgagggctg

SEQ ID NO: 357428 - DNA, 25 bp, Rattus norvegicus
gataacatttggcttctgccttttt

SEQ ID NO: 357429 - DNA, 25 bp, Rattus norvegicus
gataacatttgggttctgccttttt

SEQ ID NO: 357430 - DNA, 25 bp, Rattus norvegicus
gataaccaaagtagccgttccagta

SEQ ID NO: 357431 - DNA, 25 bp, Rattus norvegicus
gataaccaaagttgccgttccagta

SEQ ID NO: 357432 - DNA, 25 bp, Rattus norvegicus
gataaccaagacctttttaatgaag

SEQ ID NO: 357433 - DNA, 25 bp, Rattus norvegicus
gataaccaagacgtttttaatgaag

SEQ ID NO: 357434 - DNA, 25 bp, Rattus norvegicus
gataaccaccacacccaaaataaga

SEQ ID NO: 357435 - DNA, 25 bp, Rattus norvegicus
gataaccaccactcccaaaataaga

SEQ ID NO: 357436 - DNA, 25 bp, Rattus norvegicus
gataaccacccaattctctttctta

SEQ ID NO: 357437 - DNA, 25 bp, Rattus norvegicus
gataaccacccatttctctttctta

SEQ ID NO: 357438 - DNA, 25 bp, Rattus norvegicus
gataaccactcgcaaataaaaattc

SEQ ID NO: 357439 - DNA, 25 bp, Rattus norvegicus
gataaccactcggaaataaaaattc

SEQ ID NO: 357440 - DNA, 25 bp, Rattus norvegicus
gataaccagaagcacaagccaccca

SEQ ID NO: 357441 - DNA, 25 bp, Rattus norvegicus
gataaccagaaggacaagccaccca

SEQ ID NO: 357442 - DNA, 25 bp, Rattus norvegicus
gataaccagagccatttgcacacag

SEQ ID NO: 357443 - DNA, 25 bp, Rattus norvegicus
gataaccagagcgatttgcacacag

SEQ ID NO: 357444 - DNA, 25 bp, Rattus norvegicus
gataaccagattccttgaaacagtg

SEQ ID NO: 357445 - DNA, 25 bp, Rattus norvegicus
gataaccagattgcttgaaacagtg

SEQ ID NO: 357446 - DNA, 25 bp, Rattus norvegicus
gataaccagggtcaccacagctatt

SEQ ID NO: 357447 - DNA, 25 bp, Rattus norvegicus
gataaccagggtgaccacagctatt

SEQ ID NO: 357448 - DNA, 25 bp, Rattus norvegicus
gataaccagtggaccctttgagccc

SEQ ID NO: 357449 - DNA, 25 bp, Rattus norvegicus
gataaccagtggtccctttgagccc

SEQ ID NO: 357450 - DNA, 25 bp, Rattus norvegicus
gataaccagtgtacagtcctgtcat

SEQ ID NO: 357451 - DNA, 25 bp, Rattus norvegicus
gataaccagtgttcagtcctgtcat

SEQ ID NO: 357452 - DNA, 25 bp, Rattus norvegicus
gataacccaacccaagagcacttaa

SEQ ID NO: 357453 - DNA, 25 bp, Rattus norvegicus
gataacccaaccgaagagcacttaa

SEQ ID NO: 357454 - DNA, 25 bp, Rattus norvegicus
gataacccaattcgtggctggtccc

SEQ ID NO: 357455 - DNA, 25 bp, Rattus norvegicus
gataacccaattggtggctggtccc

SEQ ID NO: 357456 - DNA, 25 bp, Rattus norvegicus
gataacccagaaactttgcgagcat

SEQ ID NO: 357457 - DNA, 25 bp, Rattus norvegicus
gataacccagaatctttgcgagcat

SEQ ID NO: 357458 - DNA, 25 bp, Rattus norvegicus
gataacccgtgaatgtattcctgga

SEQ ID NO: 357459 - DNA, 25 bp, Rattus norvegicus
gataacccgtgattgtattcctgga

SEQ ID NO: 357460 - DNA, 25 bp, Rattus norvegicus
gataacccgtttccagagtcttggt

SEQ ID NO: 357461 - DNA, 25 bp, Rattus norvegicus
gataacccgtttgcagagtcttggt

SEQ ID NO: 357462 - DNA, 25 bp, Rattus norvegicus
gataaccctaaacaagctggcagtt

SEQ ID NO: 357463 - DNA, 25 bp, Rattus norvegicus
gataaccctaaagaagctggcagtt

SEQ ID NO: 357464 - DNA, 25 bp, Rattus norvegicus
gataaccctagacatggctcaagtg

SEQ ID NO: 357465 - DNA, 25 bp, Rattus norvegicus
gataaccctagagatggctcaagtg

SEQ ID NO: 357466 - DNA, 25 bp, Rattus norvegicus
gataaccctattaataccagctaca

SEQ ID NO: 357467 - DNA, 25 bp, Rattus norvegicus
gataaccctatttataccagctaca

SEQ ID NO: 357468 - DNA, 25 bp, Rattus norvegicus
gataaccctctacaaccttagcaga

SEQ ID NO: 357469 - DNA, 25 bp, Rattus norvegicus
gataaccctctagaaccttagcaga

SEQ ID NO: 357470 - DNA, 25 bp, Rattus norvegicus
gataaccctgataagccaggaccac

SEQ ID NO: 357471 - DNA, 25 bp, Rattus norvegicus
gataaccctgattagccaggaccac

SEQ ID NO: 357472 - DNA, 25 bp, Rattus norvegicus
gataacctaagcctttccaacaaca

SEQ ID NO: 357473 - DNA, 25 bp, Rattus norvegicus
gataacctaagcgtttccaacaaca

SEQ ID NO: 357474 - DNA, 25 bp, Rattus norvegicus
gataacctagggaaccccaactgtg

SEQ ID NO: 357475 - DNA, 25 bp, Rattus norvegicus
gataacctagggtaccccaactgtg

SEQ ID NO: 357476 - DNA, 25 bp, Rattus norvegicus
gataacctcaggatccatttcaggt

SEQ ID NO: 357477 - DNA, 25 bp, Rattus norvegicus
gataacctcaggttccatttcaggt

SEQ ID NO: 357478 - DNA, 25 bp, Rattus norvegicus
gataacctccttagcattagtttgg

SEQ ID NO: 357479 - DNA, 25 bp, Rattus norvegicus
gataacctcctttgcattagtttgg

SEQ ID NO: 357480 - DNA, 25 bp, Rattus norvegicus
gataacctctcaagacctgtttcta

SEQ ID NO: 357481 - DNA, 25 bp, Rattus norvegicus
gataacctctcatgacctgtttcta

SEQ ID NO: 357482 - DNA, 25 bp, Rattus norvegicus
gataacctctctcctaaagcaagtg

SEQ ID NO: 357483 - DNA, 25 bp, Rattus norvegicus
gataacctctctgctaaagcaagtg

SEQ ID NO: 357484 - DNA, 25 bp, Rattus norvegicus
gataacctgatcaaccaagtggcta

SEQ ID NO: 357485 - DNA, 25 bp, Rattus norvegicus
gataacctgatctaccaagtggcta

SEQ ID NO: 357486 - DNA, 25 bp, Rattus norvegicus
gataacctggagatctcttccaatt

SEQ ID NO: 357487 - DNA, 25 bp, Rattus norvegicus
gataacctggagttctcttccaatt

SEQ ID NO: 357488 - DNA, 25 bp, Rattus norvegicus
gataacctggcacgcggcaccatga

SEQ ID NO: 357489 - DNA, 25 bp, Rattus norvegicus
gataacctggcaggcggcaccatga

SEQ ID NO: 357490 - DNA, 25 bp, Rattus norvegicus
gataacctgtcaatccactgtgaag

SEQ ID NO: 357491 - DNA, 25 bp, Rattus norvegicus
gataacctgtcattccactgtgaag

SEQ ID NO: 357492 - DNA, 25 bp, Rattus norvegicus
gataacgcaaagcactttctctgac

SEQ ID NO: 357493 - DNA, 25 bp, Rattus norvegicus
gataacgcaaaggactttctctgac

SEQ ID NO: 357494 - DNA, 25 bp, Rattus norvegicus
gataacgccaaacccagcattcgtc

SEQ ID NO: 357495 - DNA, 25 bp, Rattus norvegicus
gataacgccaaagccagcattcgtc

SEQ ID NO: 357496 - DNA, 25 bp, Rattus norvegicus
gataacggagagactgccttctgat

SEQ ID NO: 357497 - DNA, 25 bp, Rattus norvegicus
gataacggagagtctgccttctgat

SEQ ID NO: 357498 - DNA, 25 bp, Rattus norvegicus
gataacggccacagctgcagctgcg

SEQ ID NO: 357499 - DNA, 25 bp, Rattus norvegicus
gataacggccactgctgcagctgcg

SEQ ID NO: 357500 - DNA, 25 bp, Rattus norvegicus
gataacggcctcaaattctgggcat

SEQ ID NO: 357501 - DNA, 25 bp, Rattus norvegicus
gataacggcctctaattctgggcat

SEQ ID NO: 357502 - DNA, 25 bp, Rattus norvegicus
gataacggctacaaaactcggttca

SEQ ID NO: 357503 - DNA, 25 bp, Rattus norvegicus
gataacggctactaaactcggttca

SEQ ID NO: 357504 - DNA, 25 bp, Rattus norvegicus
gataacgtccttcgtgtgacatctg

SEQ ID NO: 357505 - DNA, 25 bp, Rattus norvegicus
gataacgtccttggtgtgacatctg

SEQ ID NO: 357506 - DNA, 25 bp, Rattus norvegicus
gataacgttcttacagcagactcct

SEQ ID NO: 357507 - DNA, 25 bp, Rattus norvegicus
gataacgttctttcagcagactcct

SEQ ID NO: 357508 - DNA, 25 bp, Rattus norvegicus
gataactaacatcacattaccattc

SEQ ID NO: 357509 - DNA, 25 bp, Rattus norvegicus
gataactaacatgacattaccattc

SEQ ID NO: 357510 - DNA, 25 bp, Rattus norvegicus
gataactaatatctgcagggcccca

SEQ ID NO: 357511 - DNA, 25 bp, Rattus norvegicus
gataactaatatgtgcagggcccca

SEQ ID NO: 357512 - DNA, 25 bp, Rattus norvegicus
gataactaccgtagcttcttagaga

SEQ ID NO: 357513 - DNA, 25 bp, Rattus norvegicus
gataactaccgttgcttcttagaga

SEQ ID NO: 357514 - DNA, 25 bp, Rattus norvegicus
gataactactttaacgctaaccaag

SEQ ID NO: 357515 - DNA, 25 bp, Rattus norvegicus
gataactacttttacgctaaccaag

SEQ ID NO: 357516 - DNA, 25 bp, Rattus norvegicus
gataactagcaacaccatatgtgga

SEQ ID NO: 357517 - DNA, 25 bp, Rattus norvegicus
gataactagcaagaccatatgtgga

SEQ ID NO: 357518 - DNA, 25 bp, Rattus norvegicus
gataactagctgagtgaacctctgt

SEQ ID NO: 357519 - DNA, 25 bp, Rattus norvegicus
gataactagctgtgtgaacctctgt

SEQ ID NO: 357520 - DNA, 25 bp, Rattus norvegicus
gataactatcagactaccatgggag

SEQ ID NO: 357521 - DNA, 25 bp, Rattus norvegicus
gataactatcagtctaccatgggag

SEQ ID NO: 357522 - DNA, 25 bp, Rattus norvegicus
gataactatcccactgctgtaagga

SEQ ID NO: 357523 - DNA, 25 bp, Rattus norvegicus
gataactatccctctgctgtaagga

SEQ ID NO: 357524 - DNA, 25 bp, Rattus norvegicus
gataactatcgtatgctttaagtag

SEQ ID NO: 357525 - DNA, 25 bp, Rattus norvegicus
gataactatcgtttgctttaagtag

SEQ ID NO: 357526 - DNA, 25 bp, Rattus norvegicus
gataactatgtaaacacactttggg

SEQ ID NO: 357527 - DNA, 25 bp, Rattus norvegicus
gataactatgtatacacactttggg

SEQ ID NO: 357528 - DNA, 25 bp, Rattus norvegicus
gataactatgtccttccccttggaa

SEQ ID NO: 357529 - DNA, 25 bp, Rattus norvegicus
gataactatgtcgttccccttggaa

SEQ ID NO: 357530 - DNA, 25 bp, Rattus norvegicus
gataactcagatcccaattggtgga

SEQ ID NO: 357531 - DNA, 25 bp, Rattus norvegicus
gataactcagatgccaattggtgga

SEQ ID NO: 357532 - DNA, 25 bp, Rattus norvegicus
gataactcagtccagtttgctaccg

SEQ ID NO: 357533 - DNA, 25 bp, Rattus norvegicus
gataactcagtcgagtttgctaccg

SEQ ID NO: 357534 - DNA, 25 bp, Rattus norvegicus
gataactcatgcatactgtacatat

SEQ ID NO: 357535 - DNA, 25 bp, Rattus norvegicus
gataactcatgcttactgtacatat

SEQ ID NO: 357536 - DNA, 25 bp, Rattus norvegicus
gataactctctgcacgtggcaaaca

SEQ ID NO: 357537 - DNA, 25 bp, Rattus norvegicus
gataactctctggacgtggcaaaca

SEQ ID NO: 357538 - DNA, 25 bp, Rattus norvegicus
gataactctgctaaacctcaagcgg

SEQ ID NO: 357539 - DNA, 25 bp, Rattus norvegicus
gataactctgcttaacctcaagcgg

SEQ ID NO: 357540 - DNA, 25 bp, Rattus norvegicus
gataactgaatcaccgtgtgcattt

SEQ ID NO: 357541 - DNA, 25 bp, Rattus norvegicus
gataactgaatctccgtgtgcattt

SEQ ID NO: 357542 - DNA, 25 bp, Rattus norvegicus
gataactgcataaagcttcctcctc

SEQ ID NO: 357543 - DNA, 25 bp, Rattus norvegicus
gataactgcatatagcttcctcctc

SEQ ID NO: 357544 - DNA, 25 bp, Rattus norvegicus
gataactgctacactgtcatttgta

SEQ ID NO: 357545 - DNA, 25 bp, Rattus norvegicus
gataactgctactctgtcatttgta

SEQ ID NO: 357546 - DNA, 25 bp, Rattus norvegicus
gataactgctcaaaccatacactct

SEQ ID NO: 357547 - DNA, 25 bp, Rattus norvegicus
gataactgctcataccatacactct

SEQ ID NO: 357548 - DNA, 25 bp, Rattus norvegicus
gataactgggatcccaagttcatat

SEQ ID NO: 357549 - DNA, 25 bp, Rattus norvegicus
gataactgggatgccaagttcatat

SEQ ID NO: 357550 - DNA, 25 bp, Rattus norvegicus
gataactgggtcagtcttttgccct

SEQ ID NO: 357551 - DNA, 25 bp, Rattus norvegicus
gataactgggtctgtcttttgccct

SEQ ID NO: 357552 - DNA, 25 bp, Rattus norvegicus
gataactggtctctaattctaaaat

SEQ ID NO: 357553 - DNA, 25 bp, Rattus norvegicus
gataactggtctgtaattctaaaat

SEQ ID NO: 357554 - DNA, 25 bp, Rattus norvegicus
gataacttatggctatattgtaacc

SEQ ID NO: 357555 - DNA, 25 bp, Rattus norvegicus
gataacttatgggtatattgtaacc

SEQ ID NO: 357556 - DNA, 25 bp, Rattus norvegicus
gataacttccataacactacacatt

SEQ ID NO: 357557 - DNA, 25 bp, Rattus norvegicus
gataacttccattacactacacatt

SEQ ID NO: 357558 - DNA, 25 bp, Rattus norvegicus
gataacttctagatctctgggtttt

SEQ ID NO: 357559 - DNA, 25 bp, Rattus norvegicus
gataacttctagttctctgggtttt

SEQ ID NO: 357560 - DNA, 25 bp, Rattus norvegicus
gataacttctctagatttgcatgtg

SEQ ID NO: 357561 - DNA, 25 bp, Rattus norvegicus
gataacttctcttgatttgcatgtg

SEQ ID NO: 357562 - DNA, 25 bp, Rattus norvegicus
gataacttgtctcgtttgtccttaa

SEQ ID NO: 357563 - DNA, 25 bp, Rattus norvegicus
gataacttgtctggtttgtccttaa

SEQ ID NO: 357564 - DNA, 25 bp, Rattus norvegicus
gataacttgtgaaagccaacccttc

SEQ ID NO: 357565 - DNA, 25 bp, Rattus norvegicus
gataacttgtgatagccaacccttc

SEQ ID NO: 357566 - DNA, 25 bp, Rattus norvegicus
gataactttcaaacaccttgctaca

SEQ ID NO: 357567 - DNA, 25 bp, Rattus norvegicus
gataactttcaatcaccttgctaca

SEQ ID NO: 357568 - DNA, 25 bp, Rattus norvegicus
gataactttgtgacatccattcagc

SEQ ID NO: 357569 - DNA, 25 bp, Rattus norvegicus
gataactttgtgtcatccattcagc

SEQ ID NO: 357570 - DNA, 25 bp, Rattus norvegicus
gataacttttccacttgagaactac

SEQ ID NO: 357571 - DNA, 25 bp, Rattus norvegicus
gataacttttcctcttgagaactac

SEQ ID NO: 357572 - DNA, 25 bp, Rattus norvegicus
gataagaatcctctgctcagcagat

SEQ ID NO: 357573 - DNA, 25 bp, Rattus norvegicus
gataagaatcctgtgctcagcagat

SEQ ID NO: 357574 - DNA, 25 bp, Rattus norvegicus
gataagaatctgctgtttctgtatt

SEQ ID NO: 357575 - DNA, 25 bp, Rattus norvegicus
gataagaatctggtgtttctgtatt

SEQ ID NO: 357576 - DNA, 25 bp, Rattus norvegicus
gataagacctgccatctgaccaatc

SEQ ID NO: 357577 - DNA, 25 bp, Rattus norvegicus
gataagacctgcgatctgaccaatc

SEQ ID NO: 357578 - DNA, 25 bp, Rattus norvegicus
gataagacgggtatctgtgttcaga

SEQ ID NO: 357579 - DNA, 25 bp, Rattus norvegicus
gataagacgggtttctgtgttcaga

SEQ ID NO: 357580 - DNA, 25 bp, Rattus norvegicus
gataagagaatcaccctggcagctt

SEQ ID NO: 357581 - DNA, 25 bp, Rattus norvegicus
gataagagaatctccctggcagctt

SEQ ID NO: 357582 - DNA, 25 bp, Rattus norvegicus
gataagagcctcacagatatgtctg

SEQ ID NO: 357583 - DNA, 25 bp, Rattus norvegicus
gataagagcctctcagatatgtctg

SEQ ID NO: 357584 - DNA, 25 bp, Rattus norvegicus
gataagagggtcatcaccttccagc

SEQ ID NO: 357585 - DNA, 25 bp, Rattus norvegicus
gataagagggtcttcaccttccagc

SEQ ID NO: 357586 - DNA, 25 bp, Rattus norvegicus
gataagagttccatggtcccaaggt

SEQ ID NO: 357587 - DNA, 25 bp, Rattus norvegicus
gataagagttccttggtcccaaggt

SEQ ID NO: 357588 - DNA, 25 bp, Rattus norvegicus
gataagatctttcaccattaatggg

SEQ ID NO: 357589 - DNA, 25 bp, Rattus norvegicus
gataagatctttgaccattaatggg

SEQ ID NO: 357590 - DNA, 25 bp, Rattus norvegicus
gataagatttgcactcggaataatg

SEQ ID NO: 357591 - DNA, 25 bp, Rattus norvegicus
gataagatttgctctcggaataatg

SEQ ID NO: 357592 - DNA, 25 bp, Rattus norvegicus
gataagcaaaccaatagactccaag

SEQ ID NO: 357593 - DNA, 25 bp, Rattus norvegicus
gataagcaaacctatagactccaag

SEQ ID NO: 357594 - DNA, 25 bp, Rattus norvegicus
gataagcacaaacgcactctccgga

SEQ ID NO: 357595 - DNA, 25 bp, Rattus norvegicus
gataagcacaaaggcactctccgga

SEQ ID NO: 357596 - DNA, 25 bp, Rattus norvegicus
gataagcactacctttctcatatta

SEQ ID NO: 357597 - DNA, 25 bp, Rattus norvegicus
gataagcactacgtttctcatatta

SEQ ID NO: 357598 - DNA, 25 bp, Rattus norvegicus
gataagcactgcaagatctaacaga

SEQ ID NO: 357599 - DNA, 25 bp, Rattus norvegicus
gataagcactgctagatctaacaga

SEQ ID NO: 357600 - DNA, 25 bp, Rattus norvegicus
gataagcagccacagcaggccacta

SEQ ID NO: 357601 - DNA, 25 bp, Rattus norvegicus
gataagcagccagagcaggccacta

SEQ ID NO: 357602 - DNA, 25 bp, Rattus norvegicus
gataagcagttcagttctgtcccac

SEQ ID NO: 357603 - DNA, 25 bp, Rattus norvegicus
gataagcagttctgttctgtcccac

SEQ ID NO: 357604 - DNA, 25 bp, Rattus norvegicus
gataagcatagccacatacaactct

SEQ ID NO: 357605 - DNA, 25 bp, Rattus norvegicus
gataagcatagcgacatacaactct

SEQ ID NO: 357606 - DNA, 25 bp, Rattus norvegicus
gataagcattgacttgctgtcccct

SEQ ID NO: 357607 - DNA, 25 bp, Rattus norvegicus
gataagcattgagttgctgtcccct

SEQ ID NO: 357608 - DNA, 25 bp, Rattus norvegicus
gataagccagacacaaaaggttgtg

SEQ ID NO: 357609 - DNA, 25 bp, Rattus norvegicus
gataagccagactcaaaaggttgtg

SEQ ID NO: 357610 - DNA, 25 bp, Rattus norvegicus
gataagcccaacagttgcaggagtt

SEQ ID NO: 357611 - DNA, 25 bp, Rattus norvegicus
gataagcccaactgttgcaggagtt

SEQ ID NO: 357612 - DNA, 25 bp, Rattus norvegicus
gataagcccttaaagtcatctcagg

SEQ ID NO: 357613 - DNA, 25 bp, Rattus norvegicus
gataagcccttatagtcatctcagg

SEQ ID NO: 357614 - DNA, 25 bp, Rattus norvegicus
gataagccctttaagcagaacgcgg

SEQ ID NO: 357615 - DNA, 25 bp, Rattus norvegicus
gataagcccttttagcagaacgcgg

SEQ ID NO: 357616 - DNA, 25 bp, Rattus norvegicus
gataagcctccaattgtgattagac

SEQ ID NO: 357617 - DNA, 25 bp, Rattus norvegicus
gataagcctccatttgtgattagac

SEQ ID NO: 357618 - DNA, 25 bp, Rattus norvegicus
gataagcctggtactttagatcctg

SEQ ID NO: 357619 - DNA, 25 bp, Rattus norvegicus
gataagcctggttctttagatcctg

SEQ ID NO: 357620 - DNA, 25 bp, Rattus norvegicus
gataagccttacatcttggcagagg

SEQ ID NO: 357621 - DNA, 25 bp, Rattus norvegicus
gataagccttacttcttggcagagg

SEQ ID NO: 357622 - DNA, 25 bp, Rattus norvegicus
gataagccttccagcttcagaagag

SEQ ID NO: 357623 - DNA, 25 bp, Rattus norvegicus
gataagccttcctgcttcagaagag

SEQ ID NO: 357624 - DNA, 25 bp, Rattus norvegicus
gataagcgcacaagcagcactgttg

SEQ ID NO: 357625 - DNA, 25 bp, Rattus norvegicus
gataagcgcacatgcagcactgttg

SEQ ID NO: 357626 - DNA, 25 bp, Rattus norvegicus
gataagcggacacacttgtaattct

SEQ ID NO: 357627 - DNA, 25 bp, Rattus norvegicus
gataagcggacagacttgtaattct

SEQ ID NO: 357628 - DNA, 25 bp, Rattus norvegicus
gataagcggtttcttgggattttgt

SEQ ID NO: 357629 - DNA, 25 bp, Rattus norvegicus
gataagcggtttgttgggattttgt

SEQ ID NO: 357630 - DNA, 25 bp, Rattus norvegicus
gataagcgttgtacttgtttctcaa

SEQ ID NO: 357631 - DNA, 25 bp, Rattus norvegicus
gataagcgttgttcttgtttctcaa

SEQ ID NO: 357632 - DNA, 25 bp, Rattus norvegicus
gataagctatagacaccctggcagg

SEQ ID NO: 357633 - DNA, 25 bp, Rattus norvegicus
gataagctatagtcaccctggcagg

SEQ ID NO: 357634 - DNA, 25 bp, Rattus norvegicus
gataagctccagctgtcacaatata

SEQ ID NO: 357635 - DNA, 25 bp, Rattus norvegicus
gataagctccaggtgtcacaatata

SEQ ID NO: 357636 - DNA, 25 bp, Rattus norvegicus
gataagctgacacgccaaccaggct

SEQ ID NO: 357637 - DNA, 25 bp, Rattus norvegicus
gataagctgacaggccaaccaggct

SEQ ID NO: 357638 - DNA, 25 bp, Rattus norvegicus
gataagctggacattcctgtctgac

SEQ ID NO: 357639 - DNA, 25 bp, Rattus norvegicus
gataagctggactttcctgtctgac

SEQ ID NO: 357640 - DNA, 25 bp, Rattus norvegicus
gataagctgtatctctgtgacctca

SEQ ID NO: 357641 - DNA, 25 bp, Rattus norvegicus
gataagctgtatgtctgtgacctca

SEQ ID NO: 357642 - DNA, 25 bp, Rattus norvegicus
gataagctgtgtatcctacagggtt

SEQ ID NO: 357643 - DNA, 25 bp, Rattus norvegicus
gataagctgtgtttcctacagggtt

SEQ ID NO: 357644 - DNA, 25 bp, Rattus norvegicus
gataagcttagactccacacatgag

SEQ ID NO: 357645 - DNA, 25 bp, Rattus norvegicus
gataagcttagagtccacacatgag

SEQ ID NO: 357646 - DNA, 25 bp, Rattus norvegicus
gataagcttcggagatgcgcgtgaa

SEQ ID NO: 357647 - DNA, 25 bp, Rattus norvegicus
gataagcttcggtgatgcgcgtgaa

SEQ ID NO: 357648 - DNA, 25 bp, Rattus norvegicus
gataagcttgagcaacttgcgccgt

SEQ ID NO: 357649 - DNA, 25 bp, Rattus norvegicus
gataagcttgaggaacttgcgccgt

SEQ ID NO: 357650 - DNA, 25 bp, Rattus norvegicus
gataaggaacccaactcacctatgc

SEQ ID NO: 357651 - DNA, 25 bp, Rattus norvegicus
gataaggaaccctactcacctatgc

SEQ ID NO: 357652 - DNA, 25 bp, Rattus norvegicus
gataaggaataaagctccccaccct

SEQ ID NO: 357653 - DNA, 25 bp, Rattus norvegicus
gataaggaataatgctccccaccct

SEQ ID NO: 357654 - DNA, 25 bp, Rattus norvegicus
gataaggaccatacacaacgatgtg

SEQ ID NO: 357655 - DNA, 25 bp, Rattus norvegicus
gataaggaccattcacaacgatgtg

SEQ ID NO: 357656 - DNA, 25 bp, Rattus norvegicus
gataaggactatcctcccatgaaga

SEQ ID NO: 357657 - DNA, 25 bp, Rattus norvegicus
gataaggactatgctcccatgaaga

SEQ ID NO: 357658 - DNA, 25 bp, Rattus norvegicus
gataaggcacggattcttttgaaca

SEQ ID NO: 357659 - DNA, 25 bp, Rattus norvegicus
gataaggcacggtttcttttgaaca

SEQ ID NO: 357660 - DNA, 25 bp, Rattus norvegicus
gataaggcagcaagtgtcctacccc

SEQ ID NO: 357661 - DNA, 25 bp, Rattus norvegicus
gataaggcagcatgtgtcctacccc

SEQ ID NO: 357662 - DNA, 25 bp, Rattus norvegicus
gataaggccagaagcagtagctcat

SEQ ID NO: 357663 - DNA, 25 bp, Rattus norvegicus
gataaggccagatgcagtagctcat

SEQ ID NO: 357664 - DNA, 25 bp, Rattus norvegicus
gataaggcccacacttcaggtccat

SEQ ID NO: 357665 - DNA, 25 bp, Rattus norvegicus
gataaggcccactcttcaggtccat

SEQ ID NO: 357666 - DNA, 25 bp, Rattus norvegicus
gataaggccttaaacccacagtaat

SEQ ID NO: 357667 - DNA, 25 bp, Rattus norvegicus
gataaggccttatacccacagtaat

SEQ ID NO: 357668 - DNA, 25 bp, Rattus norvegicus
gataaggcctttattgtcaacatca

SEQ ID NO: 357669 - DNA, 25 bp, Rattus norvegicus
gataaggccttttttgtcaacatca

SEQ ID NO: 357670 - DNA, 25 bp, Rattus norvegicus
gataaggcttccctaggtgtacagg

SEQ ID NO: 357671 - DNA, 25 bp, Rattus norvegicus
gataaggcttccgtaggtgtacagg

SEQ ID NO: 357672 - DNA, 25 bp, Rattus norvegicus
gataagggacctagctcttctggat

SEQ ID NO: 357673 - DNA, 25 bp, Rattus norvegicus
gataagggaccttgctcttctggat

SEQ ID NO: 357674 - DNA, 25 bp, Rattus norvegicus
gataagggtcccacagagcctggtc

SEQ ID NO: 357675 - DNA, 25 bp, Rattus norvegicus
gataagggtccctcagagcctggtc

SEQ ID NO: 357676 - DNA, 25 bp, Rattus norvegicus
gataagggtgcgctaacccaggttc

SEQ ID NO: 357677 - DNA, 25 bp, Rattus norvegicus
gataagggtgcggtaacccaggttc

SEQ ID NO: 357678 - DNA, 25 bp, Rattus norvegicus
gataaggtcctgctgtgaacataga

SEQ ID NO: 357679 - DNA, 25 bp, Rattus norvegicus
gataaggtcctggtgtgaacataga

SEQ ID NO: 357680 - DNA, 25 bp, Rattus norvegicus
gataaggtggctaacctgggttctt

SEQ ID NO: 357681 - DNA, 25 bp, Rattus norvegicus
gataaggtggcttacctgggttctt

SEQ ID NO: 357682 - DNA, 25 bp, Rattus norvegicus
gataaggtgtggctaggaaattcct

SEQ ID NO: 357683 - DNA, 25 bp, Rattus norvegicus
gataaggtgtgggtaggaaattcct

SEQ ID NO: 357684 - DNA, 25 bp, Rattus norvegicus
gataaggttccaagccggcatcaaa

SEQ ID NO: 357685 - DNA, 25 bp, Rattus norvegicus
gataaggttccatgccggcatcaaa

SEQ ID NO: 357686 - DNA, 25 bp, Rattus norvegicus
gataaggtttgtacttagcccctat

SEQ ID NO: 357687 - DNA, 25 bp, Rattus norvegicus
gataaggtttgttcttagcccctat

SEQ ID NO: 357688 - DNA, 25 bp, Rattus norvegicus
gataaggttttcacaaggtcagcaa

SEQ ID NO: 357689 - DNA, 25 bp, Rattus norvegicus
gataaggttttctcaaggtcagcaa

SEQ ID NO: 357690 - DNA, 25 bp, Rattus norvegicus
gataagtactcaattcttcctcctg

SEQ ID NO: 357691 - DNA, 25 bp, Rattus norvegicus
gataagtactcatttcttcctcctg

SEQ ID NO: 357692 - DNA, 25 bp, Rattus norvegicus
gataagtattatcgcgcccagaccg

SEQ ID NO: 357693 - DNA, 25 bp, Rattus norvegicus
gataagtattatggcgcccagaccg

SEQ ID NO: 357694 - DNA, 25 bp, Rattus norvegicus
gataagtattggctcttgcaagcaa

SEQ ID NO: 357695 - DNA, 25 bp, Rattus norvegicus
gataagtattgggtcttgcaagcaa

SEQ ID NO: 357696 - DNA, 25 bp, Rattus norvegicus
gataagtcaacccttcaagatcccg

SEQ ID NO: 357697 - DNA, 25 bp, Rattus norvegicus
gataagtcaaccgttcaagatcccg

SEQ ID NO: 357698 - DNA, 25 bp, Rattus norvegicus
gataagtcacagattttcacatgtc

SEQ ID NO: 357699 - DNA, 25 bp, Rattus norvegicus
gataagtcacagtttttcacatgtc

SEQ ID NO: 357700 - DNA, 25 bp, Rattus norvegicus
gataagtcatctagagggccaccat

SEQ ID NO: 357701 - DNA, 25 bp, Rattus norvegicus
gataagtcatcttgagggccaccat

SEQ ID NO: 357702 - DNA, 25 bp, Rattus norvegicus
gataagtcccatctgtgacaagcac

SEQ ID NO: 357703 - DNA, 25 bp, Rattus norvegicus
gataagtcccatgtgtgacaagcac

SEQ ID NO: 357704 - DNA, 25 bp, Rattus norvegicus
gataagtctgccatcatcactgtga

SEQ ID NO: 357705 - DNA, 25 bp, Rattus norvegicus
gataagtctgccttcatcactgtga

SEQ ID NO: 357706 - DNA, 25 bp, Rattus norvegicus
gataagtcttatcccatttctgaaa

SEQ ID NO: 357707 - DNA, 25 bp, Rattus norvegicus
gataagtcttatgccatttctgaaa

SEQ ID NO: 357708 - DNA, 25 bp, Rattus norvegicus
gataagtgcgttacttgcttcatgg

SEQ ID NO: 357709 - DNA, 25 bp, Rattus norvegicus
gataagtgcgtttcttgcttcatgg

SEQ ID NO: 357710 - DNA, 25 bp, Rattus norvegicus
gataagtggatgcaaaaccttcgaa

SEQ ID NO: 357711 - DNA, 25 bp, Rattus norvegicus
gataagtggatggaaaaccttcgaa

SEQ ID NO: 357712 - DNA, 25 bp, Rattus norvegicus
gataagtggattagggtcaggtcct

SEQ ID NO: 357713 - DNA, 25 bp, Rattus norvegicus
gataagtggatttgggtcaggtcct

SEQ ID NO: 357714 - DNA, 25 bp, Rattus norvegicus
gataagtggctaactacctggtttt

SEQ ID NO: 357715 - DNA, 25 bp, Rattus norvegicus
gataagtggctatctacctggtttt

SEQ ID NO: 357716 - DNA, 25 bp, Rattus norvegicus
gataagtgtgctcgattttctttat

SEQ ID NO: 357717 - DNA, 25 bp, Rattus norvegicus
gataagtgtgctggattttctttat

SEQ ID NO: 357718 - DNA, 25 bp, Rattus norvegicus
gataagttactcacagctggtgcca

SEQ ID NO: 357719 - DNA, 25 bp, Rattus norvegicus
gataagttactctcagctggtgcca

SEQ ID NO: 357720 - DNA, 25 bp, Rattus norvegicus
gataagttcacgagagctccagact

SEQ ID NO: 357721 - DNA, 25 bp, Rattus norvegicus
gataagttcacgtgagctccagact

SEQ ID NO: 357722 - DNA, 25 bp, Rattus norvegicus
gataagttcttactccttcctgcca

SEQ ID NO: 357723 - DNA, 25 bp, Rattus norvegicus
gataagttcttagtccttcctgcca

SEQ ID NO: 357724 - DNA, 25 bp, Rattus norvegicus
gataagttcttcaaactgtccgaaa

SEQ ID NO: 357725 - DNA, 25 bp, Rattus norvegicus
gataagttcttctaactgtccgaaa

SEQ ID NO: 357726 - DNA, 25 bp, Rattus norvegicus
gataagttgtttacagtctttgttt

SEQ ID NO: 357727 - DNA, 25 bp, Rattus norvegicus
gataagttgtttatgttagcataag

SEQ ID NO: 357728 - DNA, 25 bp, Rattus norvegicus
gataagttgttttcagtctttgttt

SEQ ID NO: 357729 - DNA, 25 bp, Rattus norvegicus
gataagttgtttttgttagcataag

SEQ ID NO: 357730 - DNA, 25 bp, Rattus norvegicus
gataagtttcctaccttcaattttg

SEQ ID NO: 357731 - DNA, 25 bp, Rattus norvegicus
gataagtttccttccttcaattttg

SEQ ID NO: 357732 - DNA, 25 bp, Rattus norvegicus
gataataaacagaggccgccgccaa

SEQ ID NO: 357733 - DNA, 25 bp, Rattus norvegicus
gataataaacagtggccgccgccaa

SEQ ID NO: 357734 - DNA, 25 bp, Rattus norvegicus
gataataacagtatccttctgcctt

SEQ ID NO: 357735 - DNA, 25 bp, Rattus norvegicus
gataataacagtttccttctgcctt

SEQ ID NO: 357736 - DNA, 25 bp, Rattus norvegicus
gataataaccttaggtggcttctaa

SEQ ID NO: 357737 - DNA, 25 bp, Rattus norvegicus
gataataacctttggtggcttctaa

SEQ ID NO: 357738 - DNA, 25 bp, Rattus norvegicus
gataataagcacacgaggagtccgc

SEQ ID NO: 357739 - DNA, 25 bp, Rattus norvegicus
gataataagcactcgaggagtccgc

SEQ ID NO: 357740 - DNA, 25 bp, Rattus norvegicus
gataatacattcagtagtgcgaaga

SEQ ID NO: 357741 - DNA, 25 bp, Rattus norvegicus
gataatacattctgtagtgcgaaga

SEQ ID NO: 357742 - DNA, 25 bp, Rattus norvegicus
gataataccactagcagacctagcc

SEQ ID NO: 357743 - DNA, 25 bp, Rattus norvegicus
gataataccactatgcatttctaca

SEQ ID NO: 357744 - DNA, 25 bp, Rattus norvegicus
gataataccacttgcagacctagcc

SEQ ID NO: 357745 - DNA, 25 bp, Rattus norvegicus
gataataccactttgcatttctaca

SEQ ID NO: 357746 - DNA, 25 bp, Rattus norvegicus
gataatagatgaccaggcgtctaca

SEQ ID NO: 357747 - DNA, 25 bp, Rattus norvegicus
gataatagatgagcaggcgtctaca

SEQ ID NO: 357748 - DNA, 25 bp, Rattus norvegicus
gataatagtcttagtctatcccaga

SEQ ID NO: 357749 - DNA, 25 bp, Rattus norvegicus
gataatagtctttgtctatcccaga

SEQ ID NO: 357750 - DNA, 25 bp, Rattus norvegicus
gataatatcaaaccatggcccctct

SEQ ID NO: 357751 - DNA, 25 bp, Rattus norvegicus
gataatatcaaagcatggcccctct

SEQ ID NO: 357752 - DNA, 25 bp, Rattus norvegicus
gataatatccggatttttctagatt

SEQ ID NO: 357753 - DNA, 25 bp, Rattus norvegicus
gataatatccggttttttctagatt

SEQ ID NO: 357754 - DNA, 25 bp, Rattus norvegicus
gataatatgattataacacgtgcta

SEQ ID NO: 357755 - DNA, 25 bp, Rattus norvegicus
gataatatgattttaacacgtgcta

SEQ ID NO: 357756 - DNA, 25 bp, Rattus norvegicus
gataatatgttgatcttcgttctcc

SEQ ID NO: 357757 - DNA, 25 bp, Rattus norvegicus
gataatatgttgttcttcgttctcc

SEQ ID NO: 357758 - DNA, 25 bp, Rattus norvegicus
gataatattactctgctccaaagcg

SEQ ID NO: 357759 - DNA, 25 bp, Rattus norvegicus
gataatattactgtgctccaaagcg

SEQ ID NO: 357760 - DNA, 25 bp, Rattus norvegicus
gataatattgagctctactggctta

SEQ ID NO: 357761 - DNA, 25 bp, Rattus norvegicus
gataatattgaggtctactggctta

SEQ ID NO: 357762 - DNA, 25 bp, Rattus norvegicus
gataatatttaaactccctttacct

SEQ ID NO: 357763 - DNA, 25 bp, Rattus norvegicus
gataatatttaatctccctttacct

SEQ ID NO: 357764 - DNA, 25 bp, Rattus norvegicus
gataatcacatcctagtgccgttag

SEQ ID NO: 357765 - DNA, 25 bp, Rattus norvegicus
gataatcacatcgtagtgccgttag

SEQ ID NO: 357766 - DNA, 25 bp, Rattus norvegicus
gataatcacctgcatgacattcgga

SEQ ID NO: 357767 - DNA, 25 bp, Rattus norvegicus
gataatcacctggatgacattcgga

SEQ ID NO: 357768 - DNA, 25 bp, Rattus norvegicus
gataatcaccttcgactgtctttaa

SEQ ID NO: 357769 - DNA, 25 bp, Rattus norvegicus
gataatcaccttggactgtctttaa

SEQ ID NO: 357770 - DNA, 25 bp, Rattus norvegicus
gataatcagctcctagacctagact

SEQ ID NO: 357771 - DNA, 25 bp, Rattus norvegicus
gataatcagctcgtagacctagact

SEQ ID NO: 357772 - DNA, 25 bp, Rattus norvegicus
gataatcatcatcggcacagtcttg

SEQ ID NO: 357773 - DNA, 25 bp, Rattus norvegicus
gataatcatcatgggcacagtcttg

SEQ ID NO: 357774 - DNA, 25 bp, Rattus norvegicus
gataatccatctaaggtcaccttca

SEQ ID NO: 357775 - DNA, 25 bp, Rattus norvegicus
gataatccatcttaggtcaccttca

SEQ ID NO: 357776 - DNA, 25 bp, Rattus norvegicus
gataatcccacactctgcattgtat

SEQ ID NO: 357777 - DNA, 25 bp, Rattus norvegicus
gataatcccacagtctgcattgtat

SEQ ID NO: 357778 - DNA, 25 bp, Rattus norvegicus
gataatcccagacccaatgaatgta

SEQ ID NO: 357779 - DNA, 25 bp, Rattus norvegicus
gataatcccagagccaatgaatgta

SEQ ID NO: 357780 - DNA, 25 bp, Rattus norvegicus
gataatcccatccaagtacaagcag

SEQ ID NO: 357781 - DNA, 25 bp, Rattus norvegicus
gataatcccatcgaagtacaagcag

SEQ ID NO: 357782 - DNA, 25 bp, Rattus norvegicus
gataatcccatgcacacaggacact

SEQ ID NO: 357783 - DNA, 25 bp, Rattus norvegicus
gataatcccatggacacaggacact

SEQ ID NO: 357784 - DNA, 25 bp, Rattus norvegicus
gataatcccctgcaggacagtcaga

SEQ ID NO: 357785 - DNA, 25 bp, Rattus norvegicus
gataatcccctggaggacagtcaga

SEQ ID NO: 357786 - DNA, 25 bp, Rattus norvegicus
gataatccctatcttcatcactata

SEQ ID NO: 357787 - DNA, 25 bp, Rattus norvegicus
gataatccctatgttcatcactata

SEQ ID NO: 357788 - DNA, 25 bp, Rattus norvegicus
gataatccctgaaacaccaacttgc

SEQ ID NO: 357789 - DNA, 25 bp, Rattus norvegicus
gataatccctgatacaccaacttgc

SEQ ID NO: 357790 - DNA, 25 bp, Rattus norvegicus
gataatccctgccaatttcatctgt

SEQ ID NO: 357791 - DNA, 25 bp, Rattus norvegicus
gataatccctgcgaatttcatctgt

SEQ ID NO: 357792 - DNA, 25 bp, Rattus norvegicus
gataatcctgcaatcacatctgacc

SEQ ID NO: 357793 - DNA, 25 bp, Rattus norvegicus
gataatcctgcattcacatctgacc

SEQ ID NO: 357794 - DNA, 25 bp, Rattus norvegicus
gataatcctgtactgttgtttttca

SEQ ID NO: 357795 - DNA, 25 bp, Rattus norvegicus
gataatcctgtagtgttgtttttca

SEQ ID NO: 357796 - DNA, 25 bp, Rattus norvegicus
gataatccttcgaaaacagcttcaa

SEQ ID NO: 357797 - DNA, 25 bp, Rattus norvegicus
gataatccttcgtaaacagcttcaa

SEQ ID NO: 357798 - DNA, 25 bp, Rattus norvegicus
gataatctaacaaaagtccctcttt

SEQ ID NO: 357799 - DNA, 25 bp, Rattus norvegicus
gataatctaacataagtccctcttt

SEQ ID NO: 357800 - DNA, 25 bp, Rattus norvegicus
gataatctattacggatttcccgag

SEQ ID NO: 357801 - DNA, 25 bp, Rattus norvegicus
gataatctattagggatttcccgag

SEQ ID NO: 357802 - DNA, 25 bp, Rattus norvegicus
gataatctcaagaccatgtaccacc

SEQ ID NO: 357803 - DNA, 25 bp, Rattus norvegicus
gataatctcaagtccatgtaccacc

SEQ ID NO: 357804 - DNA, 25 bp, Rattus norvegicus
gataatctccttatgtagtccttga

SEQ ID NO: 357805 - DNA, 25 bp, Rattus norvegicus
gataatctccttttgtagtccttga

SEQ ID NO: 357806 - DNA, 25 bp, Rattus norvegicus
gataatctcgacagttaacacctat

SEQ ID NO: 357807 - DNA, 25 bp, Rattus norvegicus
gataatctcgactgttaacacctat

SEQ ID NO: 357808 - DNA, 25 bp, Rattus norvegicus
gataatctctgtatctcccaagagg

SEQ ID NO: 357809 - DNA, 25 bp, Rattus norvegicus
gataatctctgtttctcccaagagg

SEQ ID NO: 357810 - DNA, 25 bp, Rattus norvegicus
gataatctggccctttcatcaaaac

SEQ ID NO: 357811 - DNA, 25 bp, Rattus norvegicus
gataatctggccgtttcatcaaaac

SEQ ID NO: 357812 - DNA, 25 bp, Rattus norvegicus
gataatctgtttatatccttttgta

SEQ ID NO: 357813 - DNA, 25 bp, Rattus norvegicus
gataatctgtttcctcatgatcttg

SEQ ID NO: 357814 - DNA, 25 bp, Rattus norvegicus
gataatctgtttgctcatgatcttg

SEQ ID NO: 357815 - DNA, 25 bp, Rattus norvegicus
gataatctgtttttatccttttgta

SEQ ID NO: 357816 - DNA, 25 bp, Rattus norvegicus
gataatcttacaacttacctaaatc

SEQ ID NO: 357817 - DNA, 25 bp, Rattus norvegicus
gataatcttacatcttacctaaatc

SEQ ID NO: 357818 - DNA, 25 bp, Rattus norvegicus
gataatcttaccctaatgtcttcat

SEQ ID NO: 357819 - DNA, 25 bp, Rattus norvegicus
gataatcttaccgtaatgtcttcat

SEQ ID NO: 357820 - DNA, 25 bp, Rattus norvegicus
gataatctttacagtcctggcagct

SEQ ID NO: 357821 - DNA, 25 bp, Rattus norvegicus
gataatctttactgtcctggcagct

SEQ ID NO: 357822 - DNA, 25 bp, Rattus norvegicus
gataatctttatagtcctgttcttt

SEQ ID NO: 357823 - DNA, 25 bp, Rattus norvegicus
gataatctttattgtcctgttcttt

SEQ ID NO: 357824 - DNA, 25 bp, Rattus norvegicus
gataatgaacctacacaatgttttg

SEQ ID NO: 357825 - DNA, 25 bp, Rattus norvegicus
gataatgaaccttcacaatgttttg

SEQ ID NO: 357826 - DNA, 25 bp, Rattus norvegicus
gataatgaactaacctctgaaattg

SEQ ID NO: 357827 - DNA, 25 bp, Rattus norvegicus
gataatgaactatcctctgaaattg

SEQ ID NO: 357828 - DNA, 25 bp, Rattus norvegicus
gataatgaccatcctgttggccaaa

SEQ ID NO: 357829 - DNA, 25 bp, Rattus norvegicus
gataatgaccatgctgttggccaaa

SEQ ID NO: 357830 - DNA, 25 bp, Rattus norvegicus
gataatgactttcctcttttccctc

SEQ ID NO: 357831 - DNA, 25 bp, Rattus norvegicus
gataatgactttgctcttttccctc

SEQ ID NO: 357832 - DNA, 25 bp, Rattus norvegicus
gataatgagcagatccccttacact

SEQ ID NO: 357833 - DNA, 25 bp, Rattus norvegicus
gataatgagcagttccccttacact

SEQ ID NO: 357834 - DNA, 25 bp, Rattus norvegicus
gataatgagccgaaggacccacact

SEQ ID NO: 357835 - DNA, 25 bp, Rattus norvegicus
gataatgagccgtaggacccacact

SEQ ID NO: 357836 - DNA, 25 bp, Rattus norvegicus
gataatgaggaaatgtttccccaaa

SEQ ID NO: 357837 - DNA, 25 bp, Rattus norvegicus
gataatgaggaattgtttccccaaa

SEQ ID NO: 357838 - DNA, 25 bp, Rattus norvegicus
gataatgaggcacagtttcttttct

SEQ ID NO: 357839 - DNA, 25 bp, Rattus norvegicus
gataatgaggcagagtttcttttct

SEQ ID NO: 357840 - DNA, 25 bp, Rattus norvegicus
gataatgagttacaacagccgagca

SEQ ID NO: 357841 - DNA, 25 bp, Rattus norvegicus
gataatgagttagaacagccgagca

SEQ ID NO: 357842 - DNA, 25 bp, Rattus norvegicus
gataatgatgaaaaacttaaccagc

SEQ ID NO: 357843 - DNA, 25 bp, Rattus norvegicus
gataatgatgaataacttaaccagc

SEQ ID NO: 357844 - DNA, 25 bp, Rattus norvegicus
gataatgcaaaaagcaccctatacc

SEQ ID NO: 357845 - DNA, 25 bp, Rattus norvegicus
gataatgcaaaatgcaccctatacc

SEQ ID NO: 357846 - DNA, 25 bp, Rattus norvegicus
gataatgcaatcacctattgtcaca

SEQ ID NO: 357847 - DNA, 25 bp, Rattus norvegicus
gataatgcaatctcctattgtcaca

SEQ ID NO: 357848 - DNA, 25 bp, Rattus norvegicus
gataatgcacacatgatttctgaat

SEQ ID NO: 357849 - DNA, 25 bp, Rattus norvegicus
gataatgcacacttgatttctgaat

SEQ ID NO: 357850 - DNA, 25 bp, Rattus norvegicus
gataatgcacctaaacagcagacat

SEQ ID NO: 357851 - DNA, 25 bp, Rattus norvegicus
gataatgcaccttaacagcagacat

SEQ ID NO: 357852 - DNA, 25 bp, Rattus norvegicus
gataatgcacgtattctggttaagt

SEQ ID NO: 357853 - DNA, 25 bp, Rattus norvegicus
gataatgcacgttttctggttaagt

SEQ ID NO: 357854 - DNA, 25 bp, Rattus norvegicus
gataatgccgcaccacagtcttgag

SEQ ID NO: 357855 - DNA, 25 bp, Rattus norvegicus
gataatgccgcagcacagtcttgag

SEQ ID NO: 357856 - DNA, 25 bp, Rattus norvegicus
gataatgcctggctctcaagactct

SEQ ID NO: 357857 - DNA, 25 bp, Rattus norvegicus
gataatgcctgggtctcaagactct

SEQ ID NO: 357858 - DNA, 25 bp, Rattus norvegicus
gataatgccttgagtaggttcagat

SEQ ID NO: 357859 - DNA, 25 bp, Rattus norvegicus
gataatgccttgtgtaggttcagat

SEQ ID NO: 357860 - DNA, 25 bp, Rattus norvegicus
gataatgctaatcagacccagggaa

SEQ ID NO: 357861 - DNA, 25 bp, Rattus norvegicus
gataatgctaatgagacccagggaa

SEQ ID NO: 357862 - DNA, 25 bp, Rattus norvegicus
gataatgctcggcatatttttcaat

SEQ ID NO: 357863 - DNA, 25 bp, Rattus norvegicus
gataatgctcgggatatttttcaat

SEQ ID NO: 357864 - DNA, 25 bp, Rattus norvegicus
gataatgctgttacctttctcatgg

SEQ ID NO: 357865 - DNA, 25 bp, Rattus norvegicus
gataatgctgtttcctttctcatgg

SEQ ID NO: 357866 - DNA, 25 bp, Rattus norvegicus
gataatggacttccgcatgcagctg

SEQ ID NO: 357867 - DNA, 25 bp, Rattus norvegicus
gataatggacttgcgcatgcagctg

SEQ ID NO: 357868 - DNA, 25 bp, Rattus norvegicus
gataatggcagccttcagaagtcct

SEQ ID NO: 357869 - DNA, 25 bp, Rattus norvegicus
gataatggcagcgttcagaagtcct

SEQ ID NO: 357870 - DNA, 25 bp, Rattus norvegicus
gataatggccaaagagcatcttatt

SEQ ID NO: 357871 - DNA, 25 bp, Rattus norvegicus
gataatggccaatgagcatcttatt

SEQ ID NO: 357872 - DNA, 25 bp, Rattus norvegicus
gataatggctgtctcacccgggtca

SEQ ID NO: 357873 - DNA, 25 bp, Rattus norvegicus
gataatggctgtgtcacccgggtca

SEQ ID NO: 357874 - DNA, 25 bp, Rattus norvegicus
gataatgggcttctgtcttttctta

SEQ ID NO: 357875 - DNA, 25 bp, Rattus norvegicus
gataatgggcttgtgtcttttctta

SEQ ID NO: 357876 - DNA, 25 bp, Rattus norvegicus
gataatgggtgcagtttttgagcaa

SEQ ID NO: 357877 - DNA, 25 bp, Rattus norvegicus
gataatgggtgctgtttttgagcaa

SEQ ID NO: 357878 - DNA, 25 bp, Rattus norvegicus
gataatggtatcacagtctgtgaca

SEQ ID NO: 357879 - DNA, 25 bp, Rattus norvegicus
gataatggtatctcagtctgtgaca

SEQ ID NO: 357880 - DNA, 25 bp, Rattus norvegicus
gataatggtctccttgcatctgtag

SEQ ID NO: 357881 - DNA, 25 bp, Rattus norvegicus
gataatggtctcgttgcatctgtag

SEQ ID NO: 357882 - DNA, 25 bp, Rattus norvegicus
gataatggtgatactgctcttcctt

SEQ ID NO: 357883 - DNA, 25 bp, Rattus norvegicus
gataatggtgattctgctcttcctt

SEQ ID NO: 357884 - DNA, 25 bp, Rattus norvegicus
gataatgtacccatggagactagca

SEQ ID NO: 357885 - DNA, 25 bp, Rattus norvegicus
gataatgtacccttggagactagca

SEQ ID NO: 357886 - DNA, 25 bp, Rattus norvegicus
gataatgtcacaagttcttggcact

SEQ ID NO: 357887 - DNA, 25 bp, Rattus norvegicus
gataatgtcacatgttcttggcact

SEQ ID NO: 357888 - DNA, 25 bp, Rattus norvegicus
gataatgtctgcagatttcccctat

SEQ ID NO: 357889 - DNA, 25 bp, Rattus norvegicus
gataatgtctgctgatttcccctat

SEQ ID NO: 357890 - DNA, 25 bp, Rattus norvegicus
gataatgtgagtctgtccttgttct

SEQ ID NO: 357891 - DNA, 25 bp, Rattus norvegicus
gataatgtgagtgtgtccttgttct

SEQ ID NO: 357892 - DNA, 25 bp, Rattus norvegicus
gataatgtgcacattcagaactcag

SEQ ID NO: 357893 - DNA, 25 bp, Rattus norvegicus
gataatgtgcactttcagaactcag

SEQ ID NO: 357894 - DNA, 25 bp, Rattus norvegicus
gataatgtgtctaaattctctgtac

SEQ ID NO: 357895 - DNA, 25 bp, Rattus norvegicus
gataatgtgtcttaattctctgtac

SEQ ID NO: 357896 - DNA, 25 bp, Rattus norvegicus
gataatgtgtgtcttgtccctataa

SEQ ID NO: 357897 - DNA, 25 bp, Rattus norvegicus
gataatgtgtgtgttgtccctataa

SEQ ID NO: 357898 - DNA, 25 bp, Rattus norvegicus
gataattaactcaatcctgtgtata

SEQ ID NO: 357899 - DNA, 25 bp, Rattus norvegicus
gataattaactctatcctgtgtata

SEQ ID NO: 357900 - DNA, 25 bp, Rattus norvegicus
gataattacatcacttgttccactg

SEQ ID NO: 357901 - DNA, 25 bp, Rattus norvegicus
gataattacatctcttgttccactg

SEQ ID NO: 357902 - DNA, 25 bp, Rattus norvegicus
gataattacgagcacaacaccagcg

SEQ ID NO: 357903 - DNA, 25 bp, Rattus norvegicus
gataattacgaggacaacaccagcg

SEQ ID NO: 357904 - DNA, 25 bp, Rattus norvegicus
gataattacgttagggtgctaccta

SEQ ID NO: 357905 - DNA, 25 bp, Rattus norvegicus
gataattacgtttgggtgctaccta

SEQ ID NO: 357906 - DNA, 25 bp, Rattus norvegicus
gataattagagcaggcctggaggcc

SEQ ID NO: 357907 - DNA, 25 bp, Rattus norvegicus
gataattagagctggcctggaggcc

SEQ ID NO: 357908 - DNA, 25 bp, Rattus norvegicus
gataattcacctaagagcatttaaa

SEQ ID NO: 357909 - DNA, 25 bp, Rattus norvegicus
gataattcaccttagagcatttaaa

SEQ ID NO: 357910 - DNA, 25 bp, Rattus norvegicus
gataattcaggcacataagtcacaa

SEQ ID NO: 357911 - DNA, 25 bp, Rattus norvegicus
gataattcaggctcataagtcacaa

SEQ ID NO: 357912 - DNA, 25 bp, Rattus norvegicus
gataattcccgtatccaggaggata

SEQ ID NO: 357913 - DNA, 25 bp, Rattus norvegicus
gataattcccgtttccaggaggata

SEQ ID NO: 357914 - DNA, 25 bp, Rattus norvegicus
gataattccgacataacagcagcct

SEQ ID NO: 357915 - DNA, 25 bp, Rattus norvegicus
gataattccgacttaacagcagcct

SEQ ID NO: 357916 - DNA, 25 bp, Rattus norvegicus
gataattcctttaccctgatgagac

SEQ ID NO: 357917 - DNA, 25 bp, Rattus norvegicus
gataattccttttccctgatgagac

SEQ ID NO: 357918 - DNA, 25 bp, Rattus norvegicus
gataattctagaccctgttaccata

SEQ ID NO: 357919 - DNA, 25 bp, Rattus norvegicus
gataattctagagcctgttaccata

SEQ ID NO: 357920 - DNA, 25 bp, Rattus norvegicus
gataattctagtaggccaccattag

SEQ ID NO: 357921 - DNA, 25 bp, Rattus norvegicus
gataattctagttggccaccattag

SEQ ID NO: 357922 - DNA, 25 bp, Rattus norvegicus
gataattctccaccaccaaatgacc

SEQ ID NO: 357923 - DNA, 25 bp, Rattus norvegicus
gataattctccagcaccaaatgacc

SEQ ID NO: 357924 - DNA, 25 bp, Rattus norvegicus
gataattctgtcattcatggaacca

SEQ ID NO: 357925 - DNA, 25 bp, Rattus norvegicus
gataattctgtctttcatggaacca

SEQ ID NO: 357926 - DNA, 25 bp, Rattus norvegicus
gataattcttgtacattttctcgaa

SEQ ID NO: 357927 - DNA, 25 bp, Rattus norvegicus
gataattcttgttcattttctcgaa

SEQ ID NO: 357928 - DNA, 25 bp, Rattus norvegicus
gataattgcttgattctcttcggaa

SEQ ID NO: 357929 - DNA, 25 bp, Rattus norvegicus
gataattgcttgtttctcttcggaa

SEQ ID NO: 357930 - DNA, 25 bp, Rattus norvegicus
gataattggaccacagtgctggcta

SEQ ID NO: 357931 - DNA, 25 bp, Rattus norvegicus
gataattggacctcagtgctggcta

SEQ ID NO: 357932 - DNA, 25 bp, Rattus norvegicus
gataattgggacagctttacctctc

SEQ ID NO: 357933 - DNA, 25 bp, Rattus norvegicus
gataattgggactgctttacctctc

SEQ ID NO: 357934 - DNA, 25 bp, Rattus norvegicus
gataattgtcacagcttttccaaag

SEQ ID NO: 357935 - DNA, 25 bp, Rattus norvegicus
gataattgtcactgcttttccaaag

SEQ ID NO: 357936 - DNA, 25 bp, Rattus norvegicus
gataattgttccatttaccgtctgt

SEQ ID NO: 357937 - DNA, 25 bp, Rattus norvegicus
gataattgttccttttaccgtctgt

SEQ ID NO: 357938 - DNA, 25 bp, Rattus norvegicus
gataatttataacaccccggtatgt

SEQ ID NO: 357939 - DNA, 25 bp, Rattus norvegicus
gataatttataagaccccggtatgt

SEQ ID NO: 357940 - DNA, 25 bp, Rattus norvegicus
gataatttctagagtctcctgacag

SEQ ID NO: 357941 - DNA, 25 bp, Rattus norvegicus
gataatttctagtgtctcctgacag

SEQ ID NO: 357942 - DNA, 25 bp, Rattus norvegicus
gataatttctgaaccagtgtttgtc

SEQ ID NO: 357943 - DNA, 25 bp, Rattus norvegicus
gataatttctgatccagtgtttgtc

SEQ ID NO: 357944 - DNA, 25 bp, Rattus norvegicus
gataatttctttagtcttggtgtca

SEQ ID NO: 357945 - DNA, 25 bp, Rattus norvegicus
gataatttcttttgtcttggtgtca

SEQ ID NO: 357946 - DNA, 25 bp, Rattus norvegicus
gatacaaaaacacactgagcacgga

SEQ ID NO: 357947 - DNA, 25 bp, Rattus norvegicus
gatacaaaaacagactgagcacgga

SEQ ID NO: 357948 - DNA, 25 bp, Rattus norvegicus
gatacaaaaccccacagatcatctt

SEQ ID NO: 357949 - DNA, 25 bp, Rattus norvegicus
gatacaaaacccgacagatcatctt

SEQ ID NO: 357950 - DNA, 25 bp, Rattus norvegicus
gatacaaacacaattacacacccac

SEQ ID NO: 357951 - DNA, 25 bp, Rattus norvegicus
gatacaaacacatttacacacccac

SEQ ID NO: 357952 - DNA, 25 bp, Rattus norvegicus
gatacaaactgcaggtcccatacac

SEQ ID NO: 357953 - DNA, 25 bp, Rattus norvegicus
gatacaaactgccttggaccttcat

SEQ ID NO: 357954 - DNA, 25 bp, Rattus norvegicus
gatacaaactgcgttggaccttcat

SEQ ID NO: 357955 - DNA, 25 bp, Rattus norvegicus
gatacaaactgctggtcccatacac

SEQ ID NO: 357956 - DNA, 25 bp, Rattus norvegicus
gatacaaagtcaagagctctcctcc

SEQ ID NO: 357957 - DNA, 25 bp, Rattus norvegicus
gatacaaagtcaatccagaggaagt

SEQ ID NO: 357958 - DNA, 25 bp, Rattus norvegicus
gatacaaagtcatgagctctcctcc

SEQ ID NO: 357959 - DNA, 25 bp, Rattus norvegicus
gatacaaagtcattccagaggaagt

SEQ ID NO: 357960 - DNA, 25 bp, Rattus norvegicus
gatacaaatcataccttcttaagca

SEQ ID NO: 357961 - DNA, 25 bp, Rattus norvegicus
gatacaaatcattccttcttaagca

SEQ ID NO: 357962 - DNA, 25 bp, Rattus norvegicus
gatacaaatcccctacatactaata

SEQ ID NO: 357963 - DNA, 25 bp, Rattus norvegicus
gatacaaatcccgtacatactaata

SEQ ID NO: 357964 - DNA, 25 bp, Rattus norvegicus
gatacaaattctacagtctccgaag

SEQ ID NO: 357965 - DNA, 25 bp, Rattus norvegicus
gatacaaattcttcagtctccgaag

SEQ ID NO: 357966 - DNA, 25 bp, Rattus norvegicus
gatacaacaccaataaggtctttag

SEQ ID NO: 357967 - DNA, 25 bp, Rattus norvegicus
gatacaacaccattaaggtctttag

SEQ ID NO: 357968 - DNA, 25 bp, Rattus norvegicus
gatacaacaggcaacctacagtcca

SEQ ID NO: 357969 - DNA, 25 bp, Rattus norvegicus
gatacaacaggctacctacagtcca

SEQ ID NO: 357970 - DNA, 25 bp, Rattus norvegicus
gatacaacatggatataagctgcca

SEQ ID NO: 357971 - DNA, 25 bp, Rattus norvegicus
gatacaacatggttataagctgcca

SEQ ID NO: 357972 - DNA, 25 bp, Rattus norvegicus
gatacaacgcataccatgaacacta

SEQ ID NO: 357973 - DNA, 25 bp, Rattus norvegicus
gatacaacgcattccatgaacacta

SEQ ID NO: 357974 - DNA, 25 bp, Rattus norvegicus
gatacaactatcagagtctggactc

SEQ ID NO: 357975 - DNA, 25 bp, Rattus norvegicus
gatacaactatctgagtctggactc

SEQ ID NO: 357976 - DNA, 25 bp, Rattus norvegicus
gatacaagaatcagctgaggcaagc

SEQ ID NO: 357977 - DNA, 25 bp, Rattus norvegicus
gatacaagaatctgctgaggcaagc

SEQ ID NO: 357978 - DNA, 25 bp, Rattus norvegicus
gatacaagattgctcactggacctg

SEQ ID NO: 357979 - DNA, 25 bp, Rattus norvegicus
gatacaagattggtcactggacctg

SEQ ID NO: 357980 - DNA, 25 bp, Rattus norvegicus
gatacaagccccaggcatgtattta

SEQ ID NO: 357981 - DNA, 25 bp, Rattus norvegicus
gatacaagcccctggcatgtattta

SEQ ID NO: 357982 - DNA, 25 bp, Rattus norvegicus
gatacaagctacattgcattatatt

SEQ ID NO: 357983 - DNA, 25 bp, Rattus norvegicus
gatacaagctactttgcattatatt

SEQ ID NO: 357984 - DNA, 25 bp, Rattus norvegicus
gatacaagcttcctgtctacatggc

SEQ ID NO: 357985 - DNA, 25 bp, Rattus norvegicus
gatacaagcttcgtgtctacatggc

SEQ ID NO: 357986 - DNA, 25 bp, Rattus norvegicus
gatacaagttctactgggcatccca

SEQ ID NO: 357987 - DNA, 25 bp, Rattus norvegicus
gatacaagttcttctgggcatccca

SEQ ID NO: 357988 - DNA, 25 bp, Rattus norvegicus
gatacaatacctagcgcttggatag

SEQ ID NO: 357989 - DNA, 25 bp, Rattus norvegicus
gatacaataccttgcgcttggatag

SEQ ID NO: 357990 - DNA, 25 bp, Rattus norvegicus
gatacaatactcagaatgtcaagaa

SEQ ID NO: 357991 - DNA, 25 bp, Rattus norvegicus
gatacaatactctgaatgtcaagaa

SEQ ID NO: 357992 - DNA, 25 bp, Rattus norvegicus
gatacaatcctgaactctaaccaca

SEQ ID NO: 357993 - DNA, 25 bp, Rattus norvegicus
gatacaatcctgtactctaaccaca

SEQ ID NO: 357994 - DNA, 25 bp, Rattus norvegicus
gatacaatcgatcacttttcctgca

SEQ ID NO: 357995 - DNA, 25 bp, Rattus norvegicus
gatacaatcgatgacttttcctgca

SEQ ID NO: 357996 - DNA, 25 bp, Rattus norvegicus
gatacaatttccaatcttctcacca

SEQ ID NO: 357997 - DNA, 25 bp, Rattus norvegicus
gatacaatttcctatcttctcacca

SEQ ID NO: 357998 - DNA, 25 bp, Rattus norvegicus
gatacaatttgtcccaaagcaccca

SEQ ID NO: 357999 - DNA, 25 bp, Rattus norvegicus
gatacaatttgtgccaaagcaccca

SEQ ID NO: 358000 - DNA, 25 bp, Rattus norvegicus
gatacaattttcatatgtttctgtg

SEQ ID NO: 358001 - DNA, 25 bp, Rattus norvegicus
gatacaattttcttatgtttctgtg

SEQ ID NO: 358002 - DNA, 25 bp, Rattus norvegicus
gatacacaaactcgagctacttcta

SEQ ID NO: 358003 - DNA, 25 bp, Rattus norvegicus
gatacacaaactggagctacttcta

SEQ ID NO: 358004 - DNA, 25 bp, Rattus norvegicus
gatacacaacgaagacctgcacaga

SEQ ID NO: 358005 - DNA, 25 bp, Rattus norvegicus
gatacacaacgatgacctgcacaga

SEQ ID NO: 358006 - DNA, 25 bp, Rattus norvegicus
gatacacaaggtcctgcacatggaa

SEQ ID NO: 358007 - DNA, 25 bp, Rattus norvegicus
gatacacaaggtgctgcacatggaa

SEQ ID NO: 358008 - DNA, 25 bp, Rattus norvegicus
gatacacaatacctaaatgtcccca

SEQ ID NO: 358009 - DNA, 25 bp, Rattus norvegicus
gatacacaatacgtaaatgtcccca

SEQ ID NO: 358010 - DNA, 25 bp, Rattus norvegicus
gatacacacacactgatcataatat

SEQ ID NO: 358011 - DNA, 25 bp, Rattus norvegicus
gatacacacacagtgatcataatat

SEQ ID NO: 358012 - DNA, 25 bp, Rattus norvegicus
gatacacactggcattttggctaac

SEQ ID NO: 358013 - DNA, 25 bp, Rattus norvegicus
gatacacactgggattttggctaac

SEQ ID NO: 358014 - DNA, 25 bp, Rattus norvegicus
gatacacacttgacagtcacttcag

SEQ ID NO: 358015 - DNA, 25 bp, Rattus norvegicus
gatacacacttgtcagtcacttcag

SEQ ID NO: 358016 - DNA, 25 bp, Rattus norvegicus
gatacacagacaaaccagccgtata

SEQ ID NO: 358017 - DNA, 25 bp, Rattus norvegicus
gatacacagacataccagccgtata

SEQ ID NO: 358018 - DNA, 25 bp, Rattus norvegicus
gatacacagagtatccaccaggaag

SEQ ID NO: 358019 - DNA, 25 bp, Rattus norvegicus
gatacacagagtttccaccaggaag

SEQ ID NO: 358020 - DNA, 25 bp, Rattus norvegicus
gatacacagcacctctggacattcc

SEQ ID NO: 358021 - DNA, 25 bp, Rattus norvegicus
gatacacagcacgtctggacattcc

SEQ ID NO: 358022 - DNA, 25 bp, Rattus norvegicus
gatacacagcagaccagttcggtag

SEQ ID NO: 358023 - DNA, 25 bp, Rattus norvegicus
gatacacagcagtccagttcggtag

SEQ ID NO: 358024 - DNA, 25 bp, Rattus norvegicus
gatacacaggcgacaccatttcaat

SEQ ID NO: 358025 - DNA, 25 bp, Rattus norvegicus
gatacacaggcgtcaccatttcaat

SEQ ID NO: 358026 - DNA, 25 bp, Rattus norvegicus
gatacacagtccaggcctaaaggct

SEQ ID NO: 358027 - DNA, 25 bp, Rattus norvegicus
gatacacagtcccactattctctat

SEQ ID NO: 358028 - DNA, 25 bp, Rattus norvegicus
gatacacagtccgactattctctat

SEQ ID NO: 358029 - DNA, 25 bp, Rattus norvegicus
gatacacagtcctggcctaaaggct

SEQ ID NO: 358030 - DNA, 25 bp, Rattus norvegicus
gatacacagtctattcaccctctaa

SEQ ID NO: 358031 - DNA, 25 bp, Rattus norvegicus
gatacacagtcttttcaccctctaa

SEQ ID NO: 358032 - DNA, 25 bp, Rattus norvegicus
gatacacattctacacctagagcaa

SEQ ID NO: 358033 - DNA, 25 bp, Rattus norvegicus
gatacacattctccatatgtactga

SEQ ID NO: 358034 - DNA, 25 bp, Rattus norvegicus
gatacacattctgcatatgtactga

SEQ ID NO: 358035 - DNA, 25 bp, Rattus norvegicus
gatacacattcttcacctagagcaa

SEQ ID NO: 358036 - DNA, 25 bp, Rattus norvegicus
gatacacatttacttacatgctgtc

SEQ ID NO: 358037 - DNA, 25 bp, Rattus norvegicus
gatacacatttagttacatgctgtc

SEQ ID NO: 358038 - DNA, 25 bp, Rattus norvegicus
gatacaccaagaaacctgaccaggg

SEQ ID NO: 358039 - DNA, 25 bp, Rattus norvegicus
gatacaccaagatacctgaccaggg

SEQ ID NO: 358040 - DNA, 25 bp, Rattus norvegicus
gatacaccaggtattagactgtagt

SEQ ID NO: 358041 - DNA, 25 bp, Rattus norvegicus
gatacaccaggttttagactgtagt

SEQ ID NO: 358042 - DNA, 25 bp, Rattus norvegicus
gatacaccggccaaagagtctaact

SEQ ID NO: 358043 - DNA, 25 bp, Rattus norvegicus
gatacaccggcctaagagtctaact

SEQ ID NO: 358044 - DNA, 25 bp, Rattus norvegicus
gatacacctctaaggttagacacag

SEQ ID NO: 358045 - DNA, 25 bp, Rattus norvegicus
gatacacctctaccctaaacggcag

SEQ ID NO: 358046 - DNA, 25 bp, Rattus norvegicus
gatacacctctagcctaaacggcag

SEQ ID NO: 358047 - DNA, 25 bp, Rattus norvegicus
gatacacctctatggttagacacag

SEQ ID NO: 358048 - DNA, 25 bp, Rattus norvegicus
gatacacctgcgagaaagccctcag

SEQ ID NO: 358049 - DNA, 25 bp, Rattus norvegicus
gatacacctgcgtgaaagccctcag

SEQ ID NO: 358050 - DNA, 25 bp, Rattus norvegicus
gatacacgcgcgacacgggccagcg

SEQ ID NO: 358051 - DNA, 25 bp, Rattus norvegicus
gatacacgcgcgtcacgggccagcg

SEQ ID NO: 358052 - DNA, 25 bp, Rattus norvegicus
gatacacgggacatcattctccata

SEQ ID NO: 358053 - DNA, 25 bp, Rattus norvegicus
gatacacgggacttcattctccata

SEQ ID NO: 358054 - DNA, 25 bp, Rattus norvegicus
gatacacggtacaggcagtgacata

SEQ ID NO: 358055 - DNA, 25 bp, Rattus norvegicus
gatacacggtactggcagtgacata

SEQ ID NO: 358056 - DNA, 25 bp, Rattus norvegicus
gatacacgttacactactattagct

SEQ ID NO: 358057 - DNA, 25 bp, Rattus norvegicus
gatacacgttactctactattagct

SEQ ID NO: 358058 - DNA, 25 bp, Rattus norvegicus
gatacactaccaaacataccacctt

SEQ ID NO: 358059 - DNA, 25 bp, Rattus norvegicus
gatacactaccatacataccacctt

SEQ ID NO: 358060 - DNA, 25 bp, Rattus norvegicus
gatacactatttacactccatgggt

SEQ ID NO: 358061 - DNA, 25 bp, Rattus norvegicus
gatacactattttcactccatgggt

SEQ ID NO: 358062 - DNA, 25 bp, Rattus norvegicus
gatacactcaaaagtcactcctcaa

SEQ ID NO: 358063 - DNA, 25 bp, Rattus norvegicus
gatacactcaaatgtcactcctcaa

SEQ ID NO: 358064 - DNA, 25 bp, Rattus norvegicus
gatacactcagtaatcctcattgtc

SEQ ID NO: 358065 - DNA, 25 bp, Rattus norvegicus
gatacactcagttatcctcattgtc

SEQ ID NO: 358066 - DNA, 25 bp, Rattus norvegicus
gatacactctatcagctgtcactca

SEQ ID NO: 358067 - DNA, 25 bp, Rattus norvegicus
gatacactctatgagctgtcactca

SEQ ID NO: 358068 - DNA, 25 bp, Rattus norvegicus
gatacactgagacattaaatagcat

SEQ ID NO: 358069 - DNA, 25 bp, Rattus norvegicus
gatacactgagagattaaatagcat

SEQ ID NO: 358070 - DNA, 25 bp, Rattus norvegicus
gatacactgtaccaaaacgttaact

SEQ ID NO: 358071 - DNA, 25 bp, Rattus norvegicus
gatacactgtacgaaaacgttaact

SEQ ID NO: 358072 - DNA, 25 bp, Rattus norvegicus
gatacacttcatccaaaaaggccaa

SEQ ID NO: 358073 - DNA, 25 bp, Rattus norvegicus
gatacacttcatgcaaaaaggccaa

SEQ ID NO: 358074 - DNA, 25 bp, Rattus norvegicus
gatacacttctcaattaagctcatc

SEQ ID NO: 358075 - DNA, 25 bp, Rattus norvegicus
gatacacttctctattaagctcatc

SEQ ID NO: 358076 - DNA, 25 bp, Rattus norvegicus
gatacacttctgaaagcctgcatcc

SEQ ID NO: 358077 - DNA, 25 bp, Rattus norvegicus
gatacacttctgtaagcctgcatcc

SEQ ID NO: 358078 - DNA, 25 bp, Rattus norvegicus
gatacacttgtcacttggtcttaga

SEQ ID NO: 358079 - DNA, 25 bp, Rattus norvegicus
gatacacttgtctcttggtcttaga

SEQ ID NO: 358080 - DNA, 25 bp, Rattus norvegicus
gatacagaaatgcagctctcacctc

SEQ ID NO: 358081 - DNA, 25 bp, Rattus norvegicus
gatacagaaatggagctctcacctc

SEQ ID NO: 358082 - DNA, 25 bp, Rattus norvegicus
gatacagaagtgagtctccgttttc

SEQ ID NO: 358083 - DNA, 25 bp, Rattus norvegicus
gatacagaagtgtgtctccgttttc

SEQ ID NO: 358084 - DNA, 25 bp, Rattus norvegicus
gatacagaattcagaaggaacctaa

SEQ ID NO: 358085 - DNA, 25 bp, Rattus norvegicus
gatacagaattctgaaggaacctaa

SEQ ID NO: 358086 - DNA, 25 bp, Rattus norvegicus
gatacagacacactctttcctgctg

SEQ ID NO: 358087 - DNA, 25 bp, Rattus norvegicus
gatacagacacagtctttcctgctg

SEQ ID NO: 358088 - DNA, 25 bp, Rattus norvegicus
gatacagactccacagagctggcca

SEQ ID NO: 358089 - DNA, 25 bp, Rattus norvegicus
gatacagactcctcagagctggcca

SEQ ID NO: 358090 - DNA, 25 bp, Rattus norvegicus
gatacagactgcaggcataggtcgt

SEQ ID NO: 358091 - DNA, 25 bp, Rattus norvegicus
gatacagactgctggcataggtcgt

SEQ ID NO: 358092 - DNA, 25 bp, Rattus norvegicus
gatacagagacaaaggcgccaggga

SEQ ID NO: 358093 - DNA, 25 bp, Rattus norvegicus
gatacagagacataggcgccaggga

SEQ ID NO: 358094 - DNA, 25 bp, Rattus norvegicus
gatacagagcatatctgcacagcag

SEQ ID NO: 358095 - DNA, 25 bp, Rattus norvegicus
gatacagagcatttctgcacagcag

SEQ ID NO: 358096 - DNA, 25 bp, Rattus norvegicus
gatacagaggcccatgagctgccat

SEQ ID NO: 358097 - DNA, 25 bp, Rattus norvegicus
gatacagaggccgatgagctgccat

SEQ ID NO: 358098 - DNA, 25 bp, Rattus norvegicus
gatacagatagtatcgtggcgattg

SEQ ID NO: 358099 - DNA, 25 bp, Rattus norvegicus
gatacagatagtttcgtggcgattg

SEQ ID NO: 358100 - DNA, 25 bp, Rattus norvegicus
gatacagatgtcaatctctcctgga

SEQ ID NO: 358101 - DNA, 25 bp, Rattus norvegicus
gatacagatgtcagctctcgagctt

SEQ ID NO: 358102 - DNA, 25 bp, Rattus norvegicus
gatacagatgtctatctctcctgga

SEQ ID NO: 358103 - DNA, 25 bp, Rattus norvegicus
gatacagatgtctgctctcgagctt

SEQ ID NO: 358104 - DNA, 25 bp, Rattus norvegicus
gatacagattacagtggcggcataa

SEQ ID NO: 358105 - DNA, 25 bp, Rattus norvegicus
gatacagattacctggattctatat

SEQ ID NO: 358106 - DNA, 25 bp, Rattus norvegicus
gatacagattacgtggattctatat

SEQ ID NO: 358107 - DNA, 25 bp, Rattus norvegicus
gatacagattactgtggcggcataa

SEQ ID NO: 358108 - DNA, 25 bp, Rattus norvegicus
gatacagattttcttctaccggcgc

SEQ ID NO: 358109 - DNA, 25 bp, Rattus norvegicus
gatacagattttgttctaccggcgc

SEQ ID NO: 358110 - DNA, 25 bp, Rattus norvegicus
gatacagcaaagctcgccaagccca

SEQ ID NO: 358111 - DNA, 25 bp, Rattus norvegicus
gatacagcaaaggtcgccaagccca

SEQ ID NO: 358112 - DNA, 25 bp, Rattus norvegicus
gatacagcagcgagttttcaaacag

SEQ ID NO: 358113 - DNA, 25 bp, Rattus norvegicus
gatacagcagcgtgttttcaaacag

SEQ ID NO: 358114 - DNA, 25 bp, Rattus norvegicus
gatacagcagggatccacacactga

SEQ ID NO: 358115 - DNA, 25 bp, Rattus norvegicus
gatacagcagggttccacacactga

SEQ ID NO: 358116 - DNA, 25 bp, Rattus norvegicus
gatacagcataaactcagactctta

SEQ ID NO: 358117 - DNA, 25 bp, Rattus norvegicus
gatacagcataatctcagactctta

SEQ ID NO: 358118 - DNA, 25 bp, Rattus norvegicus
gatacagccatcattctcaggttaa

SEQ ID NO: 358119 - DNA, 25 bp, Rattus norvegicus
gatacagccatctttctcaggttaa

SEQ ID NO: 358120 - DNA, 25 bp, Rattus norvegicus
gatacagccctgatttgtagaagct

SEQ ID NO: 358121 - DNA, 25 bp, Rattus norvegicus
gatacagccctgttttgtagaagct

SEQ ID NO: 358122 - DNA, 25 bp, Rattus norvegicus
gatacagcctgcctgtgtgtgctca

SEQ ID NO: 358123 - DNA, 25 bp, Rattus norvegicus
gatacagcctgcgtgtgtgtgctca

SEQ ID NO: 358124 - DNA, 25 bp, Rattus norvegicus
gatacagcctgtactctgtctaatg

SEQ ID NO: 358125 - DNA, 25 bp, Rattus norvegicus
gatacagcctgttctctgtctaatg

SEQ ID NO: 358126 - DNA, 25 bp, Rattus norvegicus
gatacagcggaaaccagggcaggaa

SEQ ID NO: 358127 - DNA, 25 bp, Rattus norvegicus
gatacagcggaatccagggcaggaa

SEQ ID NO: 358128 - DNA, 25 bp, Rattus norvegicus
gatacagcgggcacgtgagcgactc

SEQ ID NO: 358129 - DNA, 25 bp, Rattus norvegicus
gatacagcgggctcgtgagcgactc

SEQ ID NO: 358130 - DNA, 25 bp, Rattus norvegicus
gatacagctcagaggaagcacggta

SEQ ID NO: 358131 - DNA, 25 bp, Rattus norvegicus
gatacagctcagtggaagcacggta

SEQ ID NO: 358132 - DNA, 25 bp, Rattus norvegicus
gatacagctctcatctctgaggaaa

SEQ ID NO: 358133 - DNA, 25 bp, Rattus norvegicus
gatacagctctcttctctgaggaaa

SEQ ID NO: 358134 - DNA, 25 bp, Rattus norvegicus
gatacagctctgacactttaactta

SEQ ID NO: 358135 - DNA, 25 bp, Rattus norvegicus
gatacagctctgtcactttaactta

SEQ ID NO: 358136 - DNA, 25 bp, Rattus norvegicus
gatacaggacatatatgagactctt

SEQ ID NO: 358137 - DNA, 25 bp, Rattus norvegicus
gatacaggacatttatgagactctt

SEQ ID NO: 358138 - DNA, 25 bp, Rattus norvegicus
gatacaggactgatgccttcattga

SEQ ID NO: 358139 - DNA, 25 bp, Rattus norvegicus
gatacaggactgttgccttcattga

SEQ ID NO: 358140 - DNA, 25 bp, Rattus norvegicus
gatacaggcaaaatcactcacctcc

SEQ ID NO: 358141 - DNA, 25 bp, Rattus norvegicus
gatacaggcaaattcactcacctcc

SEQ ID NO: 358142 - DNA, 25 bp, Rattus norvegicus
gatacaggcaagaccaggcgggtca

SEQ ID NO: 358143 - DNA, 25 bp, Rattus norvegicus
gatacaggcaagtccaggcgggtca

SEQ ID NO: 358144 - DNA, 25 bp, Rattus norvegicus
gatacaggcactatatgttcccagt

SEQ ID NO: 358145 - DNA, 25 bp, Rattus norvegicus
gatacaggcactttatgttcccagt

SEQ ID NO: 358146 - DNA, 25 bp, Rattus norvegicus
gatacaggcatgatcacttgctagg

SEQ ID NO: 358147 - DNA, 25 bp, Rattus norvegicus
gatacaggcatgttcacttgctagg

SEQ ID NO: 358148 - DNA, 25 bp, Rattus norvegicus
gatacaggctacatgctatctgacc

SEQ ID NO: 358149 - DNA, 25 bp, Rattus norvegicus
gatacaggctacttgctatctgacc

SEQ ID NO: 358150 - DNA, 25 bp, Rattus norvegicus
gatacagggataagccgctgtgctt

SEQ ID NO: 358151 - DNA, 25 bp, Rattus norvegicus
gatacagggatatgccgctgtgctt

SEQ ID NO: 358152 - DNA, 25 bp, Rattus norvegicus
gatacagggatgcagcttctcgcag

SEQ ID NO: 358153 - DNA, 25 bp, Rattus norvegicus
gatacagggatggagcttctcgcag

SEQ ID NO: 358154 - DNA, 25 bp, Rattus norvegicus
gatacagggtacagcccactaaaaa

SEQ ID NO: 358155 - DNA, 25 bp, Rattus norvegicus
gatacagggtactgcccactaaaaa

SEQ ID NO: 358156 - DNA, 25 bp, Rattus norvegicus
gatacagggtttaggaattcttcag

SEQ ID NO: 358157 - DNA, 25 bp, Rattus norvegicus
gatacagggttttggaattcttcag

SEQ ID NO: 358158 - DNA, 25 bp, Rattus norvegicus
gatacaggtatgagaggcaacaact

SEQ ID NO: 358159 - DNA, 25 bp, Rattus norvegicus
gatacaggtatgtgaggcaacaact

SEQ ID NO: 358160 - DNA, 25 bp, Rattus norvegicus
gatacaggtgatccaagcaggcccc

SEQ ID NO: 358161 - DNA, 25 bp, Rattus norvegicus
gatacaggtgatgcaagcaggcccc

SEQ ID NO: 358162 - DNA, 25 bp, Rattus norvegicus
gatacagtactgcagtgggactcct

SEQ ID NO: 358163 - DNA, 25 bp, Rattus norvegicus
gatacagtactggagtgggactcct

SEQ ID NO: 358164 - DNA, 25 bp, Rattus norvegicus
gatacagtagcacaacacctcgtgt

SEQ ID NO: 358165 - DNA, 25 bp, Rattus norvegicus
gatacagtagcagaacacctcgtgt

SEQ ID NO: 358166 - DNA, 25 bp, Rattus norvegicus
gatacagtagccactttttctttaa

SEQ ID NO: 358167 - DNA, 25 bp, Rattus norvegicus
gatacagtagcctctttttctttaa

SEQ ID NO: 358168 - DNA, 25 bp, Rattus norvegicus
gatacagtatcacccattgttgaat

SEQ ID NO: 358169 - DNA, 25 bp, Rattus norvegicus
gatacagtatcagccattgttgaat

SEQ ID NO: 358170 - DNA, 25 bp, Rattus norvegicus
gatacagtatccacctgatggtcac

SEQ ID NO: 358171 - DNA, 25 bp, Rattus norvegicus
gatacagtatcctcctgatggtcac

SEQ ID NO: 358172 - DNA, 25 bp, Rattus norvegicus
gatacagtattcaaatttgatcaca

SEQ ID NO: 358173 - DNA, 25 bp, Rattus norvegicus
gatacagtattctaatttgatcaca

SEQ ID NO: 358174 - DNA, 25 bp, Rattus norvegicus
gatacagtccaaagaatgcagtcac

SEQ ID NO: 358175 - DNA, 25 bp, Rattus norvegicus
gatacagtccaatgaatgcagtcac

SEQ ID NO: 358176 - DNA, 25 bp, Rattus norvegicus
gatacagtcctgaaacacaccttcc

SEQ ID NO: 358177 - DNA, 25 bp, Rattus norvegicus
gatacagtcctgtaacacaccttcc

SEQ ID NO: 358178 - DNA, 25 bp, Rattus norvegicus
gatacagtctgcctcatagttctat

SEQ ID NO: 358179 - DNA, 25 bp, Rattus norvegicus
gatacagtctgcgtcatagttctat

SEQ ID NO: 358180 - DNA, 25 bp, Rattus norvegicus
gatacagtctttatagttggtgcct

SEQ ID NO: 358181 - DNA, 25 bp, Rattus norvegicus
gatacagtctttttagttggtgcct

SEQ ID NO: 358182 - DNA, 25 bp, Rattus norvegicus
gatacagtgcaaagtcttcgactcc

SEQ ID NO: 358183 - DNA, 25 bp, Rattus norvegicus
gatacagtgcaatgtcttcgactcc

SEQ ID NO: 358184 - DNA, 25 bp, Rattus norvegicus
gatacagtgccaccttctggagaaa

SEQ ID NO: 358185 - DNA, 25 bp, Rattus norvegicus
gatacagtgccagcttctggagaaa

SEQ ID NO: 358186 - DNA, 25 bp, Rattus norvegicus
gatacagttctacattgcctcagcc

SEQ ID NO: 358187 - DNA, 25 bp, Rattus norvegicus
gatacagttctagattgcctcagcc

SEQ ID NO: 358188 - DNA, 25 bp, Rattus norvegicus
gatacagtttcacccagctcttttt

SEQ ID NO: 358189 - DNA, 25 bp, Rattus norvegicus
gatacagtttcagccagctcttttt

SEQ ID NO: 358190 - DNA, 25 bp, Rattus norvegicus
gatacataatctacagtgagggtct

SEQ ID NO: 358191 - DNA, 25 bp, Rattus norvegicus
gatacataatcttcagtgagggtct

SEQ ID NO: 358192 - DNA, 25 bp, Rattus norvegicus
gatacatacagtcgctacatttcat

SEQ ID NO: 358193 - DNA, 25 bp, Rattus norvegicus
gatacatacagtggctacatttcat

SEQ ID NO: 358194 - DNA, 25 bp, Rattus norvegicus
gatacataggaccaccagggacctg

SEQ ID NO: 358195 - DNA, 25 bp, Rattus norvegicus
gatacataggacgaccagggacctg

SEQ ID NO: 358196 - DNA, 25 bp, Rattus norvegicus
gatacatatcacaccatctttccat

SEQ ID NO: 358197 - DNA, 25 bp, Rattus norvegicus
gatacatatcactccatctttccat

SEQ ID NO: 358198 - DNA, 25 bp, Rattus norvegicus
gatacatattgacatcaccattcat

SEQ ID NO: 358199 - DNA, 25 bp, Rattus norvegicus
gatacatattgagatcaccattcat

SEQ ID NO: 358200 - DNA, 25 bp, Rattus norvegicus
gatacatatttcaccaaaaccttca

SEQ ID NO: 358201 - DNA, 25 bp, Rattus norvegicus
gatacatatttctccaaaaccttca

SEQ ID NO: 358202 - DNA, 25 bp, Rattus norvegicus
gatacatcaatgagacttctctaaa

SEQ ID NO: 358203 - DNA, 25 bp, Rattus norvegicus
gatacatcaatgtgacttctctaaa

SEQ ID NO: 358204 - DNA, 25 bp, Rattus norvegicus
gatacatcatacctgtaatcttagc

SEQ ID NO: 358205 - DNA, 25 bp, Rattus norvegicus
gatacatcatacgtgtaatcttagc

SEQ ID NO: 358206 - DNA, 25 bp, Rattus norvegicus
gatacatcatggagtccttcgttga

SEQ ID NO: 358207 - DNA, 25 bp, Rattus norvegicus
gatacatcatggtgtccttcgttga

SEQ ID NO: 358208 - DNA, 25 bp, Rattus norvegicus
gatacatccactattcctcaggaac

SEQ ID NO: 358209 - DNA, 25 bp, Rattus norvegicus
gatacatccacttttcctcaggaac

SEQ ID NO: 358210 - DNA, 25 bp, Rattus norvegicus
gatacatccagcaggtccgcaaagc

SEQ ID NO: 358211 - DNA, 25 bp, Rattus norvegicus
gatacatccagctggtccgcaaagc

SEQ ID NO: 358212 - DNA, 25 bp, Rattus norvegicus
gatacatccgtaaaagtaactccta

SEQ ID NO: 358213 - DNA, 25 bp, Rattus norvegicus
gatacatccgtataagtaactccta

SEQ ID NO: 358214 - DNA, 25 bp, Rattus norvegicus
gatacatctacaagctagtacagac

SEQ ID NO: 358215 - DNA, 25 bp, Rattus norvegicus
gatacatctacatgctagtacagac

SEQ ID NO: 358216 - DNA, 25 bp, Rattus norvegicus
gatacatcttatatcttggtgatct

SEQ ID NO: 358217 - DNA, 25 bp, Rattus norvegicus
gatacatcttatttcttggtgatct

SEQ ID NO: 358218 - DNA, 25 bp, Rattus norvegicus
gatacatctttacagtcctttgttt

SEQ ID NO: 358219 - DNA, 25 bp, Rattus norvegicus
gatacatctttagagtcctttgttt

SEQ ID NO: 358220 - DNA, 25 bp, Rattus norvegicus
gatacatgatctcagctggtgggaa

SEQ ID NO: 358221 - DNA, 25 bp, Rattus norvegicus
gatacatgatctgagctggtgggaa

SEQ ID NO: 358222 - DNA, 25 bp, Rattus norvegicus
gatacatgatttccctgattgctct

SEQ ID NO: 358223 - DNA, 25 bp, Rattus norvegicus
gatacatgatttgcctgattgctct

SEQ ID NO: 358224 - DNA, 25 bp, Rattus norvegicus
gatacatgctgcagaatttgcctgg

SEQ ID NO: 358225 - DNA, 25 bp, Rattus norvegicus
gatacatgctgctgaatttgcctgg

SEQ ID NO: 358226 - DNA, 25 bp, Rattus norvegicus
gatacatgctttctttggctccaat

SEQ ID NO: 358227 - DNA, 25 bp, Rattus norvegicus
gatacatgctttgtttggctccaat

SEQ ID NO: 358228 - DNA, 25 bp, Rattus norvegicus
gatacatggttaattctcctgagta

SEQ ID NO: 358229 - DNA, 25 bp, Rattus norvegicus
gatacatggttatttctcctgagta

SEQ ID NO: 358230 - DNA, 25 bp, Rattus norvegicus
gatacatgtgtgctattctgagaaa

SEQ ID NO: 358231 - DNA, 25 bp, Rattus norvegicus
gatacatgtgtggtattctgagaaa

SEQ ID NO: 358232 - DNA, 25 bp, Rattus norvegicus
gatacattaaataccgccgttgtct

SEQ ID NO: 358233 - DNA, 25 bp, Rattus norvegicus
gatacattaaattccgccgttgtct

SEQ ID NO: 358234 - DNA, 25 bp, Rattus norvegicus
gatacattagagcaggcttctgtaa

SEQ ID NO: 358235 - DNA, 25 bp, Rattus norvegicus
gatacattagaggaggcttctgtaa

SEQ ID NO: 358236 - DNA, 25 bp, Rattus norvegicus
gatacattagcaacgccaatggcct

SEQ ID NO: 358237 - DNA, 25 bp, Rattus norvegicus
gatacattagcatcgccaatggcct

SEQ ID NO: 358238 - DNA, 25 bp, Rattus norvegicus
gatacattcctaattcttgtgttta

SEQ ID NO: 358239 - DNA, 25 bp, Rattus norvegicus
gatacattcctatttcttgtgttta

SEQ ID NO: 358240 - DNA, 25 bp, Rattus norvegicus
gatacattctcaataagccacattg

SEQ ID NO: 358241 - DNA, 25 bp, Rattus norvegicus
gatacattctcattaagccacattg

SEQ ID NO: 358242 - DNA, 25 bp, Rattus norvegicus
gatacattctttactccaggatcgt

SEQ ID NO: 358243 - DNA, 25 bp, Rattus norvegicus
gatacattcttttctccaggatcgt

SEQ ID NO: 358244 - DNA, 25 bp, Rattus norvegicus
gatacattgcaacaactccagcgtg

SEQ ID NO: 358245 - DNA, 25 bp, Rattus norvegicus
gatacattgcaagaactccagcgtg

SEQ ID NO: 358246 - DNA, 25 bp, Rattus norvegicus
gatacattgttgaagctaaccactt

SEQ ID NO: 358247 - DNA, 25 bp, Rattus norvegicus
gatacattgttgtagctaaccactt

SEQ ID NO: 358248 - DNA, 25 bp, Rattus norvegicus
gatacatttccaaacaagccaactt

SEQ ID NO: 358249 - DNA, 25 bp, Rattus norvegicus
gatacatttccatacaagccaactt

SEQ ID NO: 358250 - DNA, 25 bp, Rattus norvegicus
gatacatttccccaaaatggtggga

SEQ ID NO: 358251 - DNA, 25 bp, Rattus norvegicus
gatacatttcccgaaaatggtggga

SEQ ID NO: 358252 - DNA, 25 bp, Rattus norvegicus
gatacatttgctcacctgtgtgcag

SEQ ID NO: 358253 - DNA, 25 bp, Rattus norvegicus
gatacatttgctgacctgtgtgcag

SEQ ID NO: 358254 - DNA, 25 bp, Rattus norvegicus
gatacatttggcaactccagtgctc

SEQ ID NO: 358255 - DNA, 25 bp, Rattus norvegicus
gatacatttggctactccagtgctc

SEQ ID NO: 358256 - DNA, 25 bp, Rattus norvegicus
gatacattttccattagcacatagt

SEQ ID NO: 358257 - DNA, 25 bp, Rattus norvegicus
gatacattttcctttagcacatagt

SEQ ID NO: 358258 - DNA, 25 bp, Rattus norvegicus
gataccaaaggtatctattctccct

SEQ ID NO: 358259 - DNA, 25 bp, Rattus norvegicus
gataccaaaggtttctattctccct

SEQ ID NO: 358260 - DNA, 25 bp, Rattus norvegicus
gataccaaatctcctgggtttgcca

SEQ ID NO: 358261 - DNA, 25 bp, Rattus norvegicus
gataccaaatctgctgggtttgcca

SEQ ID NO: 358262 - DNA, 25 bp, Rattus norvegicus
gataccaacaccagttccaagcaat

SEQ ID NO: 358263 - DNA, 25 bp, Rattus norvegicus
gataccaacacctgttccaagcaat

SEQ ID NO: 358264 - DNA, 25 bp, Rattus norvegicus
gataccaacctgagtgctatccatg

SEQ ID NO: 358265 - DNA, 25 bp, Rattus norvegicus
gataccaacctgtgtgctatccatg

SEQ ID NO: 358266 - DNA, 25 bp, Rattus norvegicus
gataccaactatcacggcagtctgc

SEQ ID NO: 358267 - DNA, 25 bp, Rattus norvegicus
gataccaactatgacggcagtctgc

SEQ ID NO: 358268 - DNA, 25 bp, Rattus norvegicus
gataccaactccactccagagagtg

SEQ ID NO: 358269 - DNA, 25 bp, Rattus norvegicus
gataccaactcctctccagagagtg

SEQ ID NO: 358270 - DNA, 25 bp, Rattus norvegicus
gataccaagaatctgcgcactgcag

SEQ ID NO: 358271 - DNA, 25 bp, Rattus norvegicus
gataccaagaatgtgcgcactgcag

SEQ ID NO: 358272 - DNA, 25 bp, Rattus norvegicus
gataccaagggtcccataatgggct

SEQ ID NO: 358273 - DNA, 25 bp, Rattus norvegicus
gataccaagggtgccataatgggct

SEQ ID NO: 358274 - DNA, 25 bp, Rattus norvegicus
gataccaagttcatttcctgcatta

SEQ ID NO: 358275 - DNA, 25 bp, Rattus norvegicus
gataccaagttcttttcctgcatta

SEQ ID NO: 358276 - DNA, 25 bp, Rattus norvegicus
gataccaatagccaactttgttgtc

SEQ ID NO: 358277 - DNA, 25 bp, Rattus norvegicus
gataccaatagcgaactttgttgtc

SEQ ID NO: 358278 - DNA, 25 bp, Rattus norvegicus
gataccaatcaactataaggctgaa

SEQ ID NO: 358279 - DNA, 25 bp, Rattus norvegicus
gataccaatcaagtataaggctgaa

SEQ ID NO: 358280 - DNA, 25 bp, Rattus norvegicus
gataccaatgaccagctatgcactt

SEQ ID NO: 358281 - DNA, 25 bp, Rattus norvegicus
gataccaatgacgagctatgcactt

SEQ ID NO: 358282 - DNA, 25 bp, Rattus norvegicus
gataccaatttactttatgcagaaa

SEQ ID NO: 358283 - DNA, 25 bp, Rattus norvegicus
gataccaatttagtttatgcagaaa

SEQ ID NO: 358284 - DNA, 25 bp, Rattus norvegicus
gataccaatttcaacttcccattca

SEQ ID NO: 358285 - DNA, 25 bp, Rattus norvegicus
gataccaatttctacttcccattca

SEQ ID NO: 358286 - DNA, 25 bp, Rattus norvegicus
gataccacaggaccttgaccgagga

SEQ ID NO: 358287 - DNA, 25 bp, Rattus norvegicus
gataccacaggagcttgaccgagga

SEQ ID NO: 358288 - DNA, 25 bp, Rattus norvegicus
gataccacatccattcaacaagaaa

SEQ ID NO: 358289 - DNA, 25 bp, Rattus norvegicus
gataccacatcctttcaacaagaaa

SEQ ID NO: 358290 - DNA, 25 bp, Rattus norvegicus
gataccacatttcgactattgtccc

SEQ ID NO: 358291 - DNA, 25 bp, Rattus norvegicus
gataccacatttggactattgtccc

SEQ ID NO: 358292 - DNA, 25 bp, Rattus norvegicus
gataccacccttcaattacaaacaa

SEQ ID NO: 358293 - DNA, 25 bp, Rattus norvegicus
gataccacccttgaattacaaacaa

SEQ ID NO: 358294 - DNA, 25 bp, Rattus norvegicus
gataccaccgagaactgcatcagtg

SEQ ID NO: 358295 - DNA, 25 bp, Rattus norvegicus
gataccaccgagtactgcatcagtg

SEQ ID NO: 358296 - DNA, 25 bp, Rattus norvegicus
gataccaccttccttatcttgaaag

SEQ ID NO: 358297 - DNA, 25 bp, Rattus norvegicus
gataccaccttcgttatcttgaaag

SEQ ID NO: 358298 - DNA, 25 bp, Rattus norvegicus
gataccacgaaacaatctggatgtc

SEQ ID NO: 358299 - DNA, 25 bp, Rattus norvegicus
gataccacgaaagaatctggatgtc

SEQ ID NO: 358300 - DNA, 25 bp, Rattus norvegicus
gataccacgactcacctatacagag

SEQ ID NO: 358301 - DNA, 25 bp, Rattus norvegicus
gataccacgactgacctatacagag

SEQ ID NO: 358302 - DNA, 25 bp, Rattus norvegicus
gataccacggcacaaactgagtcca

SEQ ID NO: 358303 - DNA, 25 bp, Rattus norvegicus
gataccacggcagaaactgagtcca

SEQ ID NO: 358304 - DNA, 25 bp, Rattus norvegicus
gataccacgtcaagtctgcctgtta

SEQ ID NO: 358305 - DNA, 25 bp, Rattus norvegicus
gataccacgtcatgtctgcctgtta

SEQ ID NO: 358306 - DNA, 25 bp, Rattus norvegicus
gataccactattaagactgggtgtt

SEQ ID NO: 358307 - DNA, 25 bp, Rattus norvegicus
gataccactatttagactgggtgtt

SEQ ID NO: 358308 - DNA, 25 bp, Rattus norvegicus
gataccactgacatacgcacttggg

SEQ ID NO: 358309 - DNA, 25 bp, Rattus norvegicus
gataccactgacttacgcacttggg

SEQ ID NO: 358310 - DNA, 25 bp, Rattus norvegicus
gataccactgggatttgtccatttt

SEQ ID NO: 358311 - DNA, 25 bp, Rattus norvegicus
gataccactgggttttgtccatttt

SEQ ID NO: 358312 - DNA, 25 bp, Rattus norvegicus
gataccactgtgattggcatgccca

SEQ ID NO: 358313 - DNA, 25 bp, Rattus norvegicus
gataccactgtgtttggcatgccca

SEQ ID NO: 358314 - DNA, 25 bp, Rattus norvegicus
gataccacttaaattcttggcattt

SEQ ID NO: 358315 - DNA, 25 bp, Rattus norvegicus
gataccacttaatttcttggcattt

SEQ ID NO: 358316 - DNA, 25 bp, Rattus norvegicus
gataccacttgtacctgtatgtctt

SEQ ID NO: 358317 - DNA, 25 bp, Rattus norvegicus
gataccacttgttcctgtatgtctt

SEQ ID NO: 358318 - DNA, 25 bp, Rattus norvegicus
gataccagaagcagcaggtctacta

SEQ ID NO: 358319 - DNA, 25 bp, Rattus norvegicus
gataccagaagctgcaggtctacta

SEQ ID NO: 358320 - DNA, 25 bp, Rattus norvegicus
gataccagacggatagtgcgggtca

SEQ ID NO: 358321 - DNA, 25 bp, Rattus norvegicus
gataccagacggttagtgcgggtca

SEQ ID NO: 358322 - DNA, 25 bp, Rattus norvegicus
gataccagactcaccatgtatggaa

SEQ ID NO: 358323 - DNA, 25 bp, Rattus norvegicus
gataccagactctccatgtatggaa

SEQ ID NO: 358324 - DNA, 25 bp, Rattus norvegicus
gataccagactgagagcttcagcct

SEQ ID NO: 358325 - DNA, 25 bp, Rattus norvegicus
gataccagactgaggaacacatgtt

SEQ ID NO: 358326 - DNA, 25 bp, Rattus norvegicus
gataccagactgtgagcttcagcct

SEQ ID NO: 358327 - DNA, 25 bp, Rattus norvegicus
gataccagactgtggaacacatgtt

SEQ ID NO: 358328 - DNA, 25 bp, Rattus norvegicus
gataccagagatccaaggaggttca

SEQ ID NO: 358329 - DNA, 25 bp, Rattus norvegicus
gataccagagatgcaaggaggttca

SEQ ID NO: 358330 - DNA, 25 bp, Rattus norvegicus
gataccagagtgatcggcagcccca

SEQ ID NO: 358331 - DNA, 25 bp, Rattus norvegicus
gataccagagtgttcggcagcccca

SEQ ID NO: 358332 - DNA, 25 bp, Rattus norvegicus
gataccagagttcaaaatttggctc

SEQ ID NO: 358333 - DNA, 25 bp, Rattus norvegicus
gataccagagttgaaaatttggctc

SEQ ID NO: 358334 - DNA, 25 bp, Rattus norvegicus
gataccagataccactggaacattt

SEQ ID NO: 358335 - DNA, 25 bp, Rattus norvegicus
gataccagatacgactggaacattt

SEQ ID NO: 358336 - DNA, 25 bp, Rattus norvegicus
gataccagcaacatcgatgactatg

SEQ ID NO: 358337 - DNA, 25 bp, Rattus norvegicus
gataccagcaacttcgatgactatg

SEQ ID NO: 358338 - DNA, 25 bp, Rattus norvegicus
gataccagcatgaaactttacctat

SEQ ID NO: 358339 - DNA, 25 bp, Rattus norvegicus
gataccagcatgatggagctctctc

SEQ ID NO: 358340 - DNA, 25 bp, Rattus norvegicus
gataccagcatgtaactttacctat

SEQ ID NO: 358341 - DNA, 25 bp, Rattus norvegicus
gataccagcatgttggagctctctc

SEQ ID NO: 358342 - DNA, 25 bp, Rattus norvegicus
gataccagccacattaggatccaat

SEQ ID NO: 358343 - DNA, 25 bp, Rattus norvegicus
gataccagccacattgaattatttt

SEQ ID NO: 358344 - DNA, 25 bp, Rattus norvegicus
gataccagccactttaggatccaat

SEQ ID NO: 358345 - DNA, 25 bp, Rattus norvegicus
gataccagccactttgaattatttt

SEQ ID NO: 358346 - DNA, 25 bp, Rattus norvegicus
gataccagcgttacaggacaagccc

SEQ ID NO: 358347 - DNA, 25 bp, Rattus norvegicus
gataccagcgtttcaggacaagccc

SEQ ID NO: 358348 - DNA, 25 bp, Rattus norvegicus
gataccaggagcaaattgaactttt

SEQ ID NO: 358349 - DNA, 25 bp, Rattus norvegicus
gataccaggagctaattgaactttt

SEQ ID NO: 358350 - DNA, 25 bp, Rattus norvegicus
gataccaggcgcagagctcaacaga

SEQ ID NO: 358351 - DNA, 25 bp, Rattus norvegicus
gataccaggcgctgagctcaacaga

SEQ ID NO: 358352 - DNA, 25 bp, Rattus norvegicus
gataccagtgaaccaattctctccc

SEQ ID NO: 358353 - DNA, 25 bp, Rattus norvegicus
gataccagtgaagcaattctctccc

SEQ ID NO: 358354 - DNA, 25 bp, Rattus norvegicus
gataccagtggcatgctgttctgtc

SEQ ID NO: 358355 - DNA, 25 bp, Rattus norvegicus
gataccagtggcttgctgttctgtc

SEQ ID NO: 358356 - DNA, 25 bp, Rattus norvegicus
gataccagtgtactccagatacctc

SEQ ID NO: 358357 - DNA, 25 bp, Rattus norvegicus
gataccagtgtagtccagatacctc

SEQ ID NO: 358358 - DNA, 25 bp, Rattus norvegicus
gataccagtgtgaccagatttgcct

SEQ ID NO: 358359 - DNA, 25 bp, Rattus norvegicus
gataccagtgtgtccagatttgcct

SEQ ID NO: 358360 - DNA, 25 bp, Rattus norvegicus
gataccagttatccatctttaccgg

SEQ ID NO: 358361 - DNA, 25 bp, Rattus norvegicus
gataccagttatgcatctttaccgg

SEQ ID NO: 358362 - DNA, 25 bp, Rattus norvegicus
gataccagttgacttgtgacttaca

SEQ ID NO: 358363 - DNA, 25 bp, Rattus norvegicus
gataccagttgagttgtgacttaca

SEQ ID NO: 358364 - DNA, 25 bp, Rattus norvegicus
gataccatacaccattgaggttgga

SEQ ID NO: 358365 - DNA, 25 bp, Rattus norvegicus
gataccatacacgattgaggttgga

SEQ ID NO: 358366 - DNA, 25 bp, Rattus norvegicus
gataccatacggatcaccacggcag

SEQ ID NO: 358367 - DNA, 25 bp, Rattus norvegicus
gataccatacggttcaccacggcag

SEQ ID NO: 358368 - DNA, 25 bp, Rattus norvegicus
gataccatactcattattcttgaat

SEQ ID NO: 358369 - DNA, 25 bp, Rattus norvegicus
gataccatactctttattcttgaat

SEQ ID NO: 358370 - DNA, 25 bp, Rattus norvegicus
gataccatacttagaaggatttgtc

SEQ ID NO: 358371 - DNA, 25 bp, Rattus norvegicus
gataccatactttgaaggatttgtc

SEQ ID NO: 358372 - DNA, 25 bp, Rattus norvegicus
gataccatagatccagccttttcct

SEQ ID NO: 358373 - DNA, 25 bp, Rattus norvegicus
gataccatagatgcagccttttcct

SEQ ID NO: 358374 - DNA, 25 bp, Rattus norvegicus
gataccatatccattgcctccagga

SEQ ID NO: 358375 - DNA, 25 bp, Rattus norvegicus
gataccatatcctttgcctccagga

SEQ ID NO: 358376 - DNA, 25 bp, Rattus norvegicus
gataccatctcaagacaggactggg

SEQ ID NO: 358377 - DNA, 25 bp, Rattus norvegicus
gataccatctcatgacaggactggg

SEQ ID NO: 358378 - DNA, 25 bp, Rattus norvegicus
gataccatctgcctgacaaaagact

SEQ ID NO: 358379 - DNA, 25 bp, Rattus norvegicus
gataccatctgcgtgacaaaagact

SEQ ID NO: 358380 - DNA, 25 bp, Rattus norvegicus
gataccatgaagaagattgcctttg

SEQ ID NO: 358381 - DNA, 25 bp, Rattus norvegicus
gataccatgaagtagattgcctttg

SEQ ID NO: 358382 - DNA, 25 bp, Rattus norvegicus
gataccatgacaaaaatctttcctg

SEQ ID NO: 358383 - DNA, 25 bp, Rattus norvegicus
gataccatgacataaatctttcctg

SEQ ID NO: 358384 - DNA, 25 bp, Rattus norvegicus
gataccatgttccttcatcatgttt

SEQ ID NO: 358385 - DNA, 25 bp, Rattus norvegicus
gataccatgttcgttcatcatgttt

SEQ ID NO: 358386 - DNA, 25 bp, Rattus norvegicus
gataccattgagatcaccgggactt

SEQ ID NO: 358387 - DNA, 25 bp, Rattus norvegicus
gataccattgagttcaccgggactt

SEQ ID NO: 358388 - DNA, 25 bp, Rattus norvegicus
gataccattttcagatttgtccttc

SEQ ID NO: 358389 - DNA, 25 bp, Rattus norvegicus
gataccattttctgatttgtccttc

SEQ ID NO: 358390 - DNA, 25 bp, Rattus norvegicus
gatacccaagcaagaaactgacact

SEQ ID NO: 358391 - DNA, 25 bp, Rattus norvegicus
gatacccaagcatgaaactgacact

SEQ ID NO: 358392 - DNA, 25 bp, Rattus norvegicus
gatacccacatcatggtcatcacag

SEQ ID NO: 358393 - DNA, 25 bp, Rattus norvegicus
gatacccacatcttggtcatcacag

SEQ ID NO: 358394 - DNA, 25 bp, Rattus norvegicus
gatacccacctcagatccatgatta

SEQ ID NO: 358395 - DNA, 25 bp, Rattus norvegicus
gatacccacctctgatccatgatta

SEQ ID NO: 358396 - DNA, 25 bp, Rattus norvegicus
gatacccacgatatcaagttatgta

SEQ ID NO: 358397 - DNA, 25 bp, Rattus norvegicus
gatacccacgatttcaagttatgta

SEQ ID NO: 358398 - DNA, 25 bp, Rattus norvegicus
gatacccagcaacaagggcttacat

SEQ ID NO: 358399 - DNA, 25 bp, Rattus norvegicus
gatacccagcaagaagggcttacat

SEQ ID NO: 358400 - DNA, 25 bp, Rattus norvegicus
gatacccagccacagtcagcagttg

SEQ ID NO: 358401 - DNA, 25 bp, Rattus norvegicus
gatacccagccagagtcagcagttg

SEQ ID NO: 358402 - DNA, 25 bp, Rattus norvegicus
gatacccaggttccactgctaggaa

SEQ ID NO: 358403 - DNA, 25 bp, Rattus norvegicus
gatacccaggttgcactgctaggaa

SEQ ID NO: 358404 - DNA, 25 bp, Rattus norvegicus
gatacccagtacagacactcttttc

SEQ ID NO: 358405 - DNA, 25 bp, Rattus norvegicus
gatacccagtactgacactcttttc

SEQ ID NO: 358406 - DNA, 25 bp, Rattus norvegicus
gatacccagttgatattttaacttc

SEQ ID NO: 358407 - DNA, 25 bp, Rattus norvegicus
gatacccagttgttattttaacttc

SEQ ID NO: 358408 - DNA, 25 bp, Rattus norvegicus
gatacccatggaccaaggttactct

SEQ ID NO: 358409 - DNA, 25 bp, Rattus norvegicus
gatacccatggagcaaggttactct

SEQ ID NO: 358410 - DNA, 25 bp, Rattus norvegicus
gatacccattcacatacagtacagt

SEQ ID NO: 358411 - DNA, 25 bp, Rattus norvegicus
gatacccattcagatacagtacagt

SEQ ID NO: 358412 - DNA, 25 bp, Rattus norvegicus
gatacccattgtaggctgttcttta

SEQ ID NO: 358413 - DNA, 25 bp, Rattus norvegicus
gatacccattgttggctgttcttta

SEQ ID NO: 358414 - DNA, 25 bp, Rattus norvegicus
gataccccaaggacaaaccactcaa

SEQ ID NO: 358415 - DNA, 25 bp, Rattus norvegicus
gataccccaaggtcaaaccactcaa

SEQ ID NO: 358416 - DNA, 25 bp, Rattus norvegicus
gataccccacttagcttttcttttg

SEQ ID NO: 358417 - DNA, 25 bp, Rattus norvegicus
gataccccactttgcttttcttttg

SEQ ID NO: 358418 - DNA, 25 bp, Rattus norvegicus
gataccccaggtccttgatggtctc

SEQ ID NO: 358419 - DNA, 25 bp, Rattus norvegicus
gataccccaggtgcttgatggtctc

SEQ ID NO: 358420 - DNA, 25 bp, Rattus norvegicus
gataccccggagaagctggaagccc

SEQ ID NO: 358421 - DNA, 25 bp, Rattus norvegicus
gataccccggagtagctggaagccc

SEQ ID NO: 358422 - DNA, 25 bp, Rattus norvegicus
gatacccctcagagtgtcatgggag

SEQ ID NO: 358423 - DNA, 25 bp, Rattus norvegicus
gatacccctcagtgtgtcatgggag

SEQ ID NO: 358424 - DNA, 25 bp, Rattus norvegicus
gatacccctctgctacaaggcattg

SEQ ID NO: 358425 - DNA, 25 bp, Rattus norvegicus
gatacccctctggtacaaggcattg

SEQ ID NO: 358426 - DNA, 25 bp, Rattus norvegicus
gatacccctgagctggatagtctgg

SEQ ID NO: 358427 - DNA, 25 bp, Rattus norvegicus
gatacccctgaggtggatagtctgg

SEQ ID NO: 358428 - DNA, 25 bp, Rattus norvegicus
gatacccgatgacttctgatttttg

SEQ ID NO: 358429 - DNA, 25 bp, Rattus norvegicus
gatacccgatgagttctgatttttg

SEQ ID NO: 358430 - DNA, 25 bp, Rattus norvegicus
gatacccgcagaaggctggattgca

SEQ ID NO: 358431 - DNA, 25 bp, Rattus norvegicus
gatacccgcagatggctggattgca

SEQ ID NO: 358432 - DNA, 25 bp, Rattus norvegicus
gatacccggagaccaggctagctgc

SEQ ID NO: 358433 - DNA, 25 bp, Rattus norvegicus
gatacccggagagcaggctagctgc

SEQ ID NO: 358434 - DNA, 25 bp, Rattus norvegicus
gatacccgtaccatgatgtgttatg

SEQ ID NO: 358435 - DNA, 25 bp, Rattus norvegicus
gatacccgtaccttgatgtgttatg

SEQ ID NO: 358436 - DNA, 25 bp, Rattus norvegicus
gatacccgtgctaagcgacttgtgt

SEQ ID NO: 358437 - DNA, 25 bp, Rattus norvegicus
gatacccgtgcttagcgacttgtgt

SEQ ID NO: 358438 - DNA, 25 bp, Rattus norvegicus
gatacccgtgttcatgttttgttta

SEQ ID NO: 358439 - DNA, 25 bp, Rattus norvegicus
gatacccgtgttgatgttttgttta

SEQ ID NO: 358440 - DNA, 25 bp, Rattus norvegicus
gataccctacaaatgcctctgctgg

SEQ ID NO: 358441 - DNA, 25 bp, Rattus norvegicus
gataccctacaattgcctctgctgg

SEQ ID NO: 358442 - DNA, 25 bp, Rattus norvegicus
gataccctctgaactaaacctgtgg

SEQ ID NO: 358443 - DNA, 25 bp, Rattus norvegicus
gataccctctgatctaaacctgtgg

SEQ ID NO: 358444 - DNA, 25 bp, Rattus norvegicus
gataccctgaggaggcattttccag

SEQ ID NO: 358445 - DNA, 25 bp, Rattus norvegicus
gataccctgaggtggcattttccag

SEQ ID NO: 358446 - DNA, 25 bp, Rattus norvegicus
gataccctggaacgtacctcagcag

SEQ ID NO: 358447 - DNA, 25 bp, Rattus norvegicus
gataccctggaaggtacctcagcag

SEQ ID NO: 358448 - DNA, 25 bp, Rattus norvegicus
gataccctggtaccttattctagtt

SEQ ID NO: 358449 - DNA, 25 bp, Rattus norvegicus
gataccctggtagcttattctagtt

SEQ ID NO: 358450 - DNA, 25 bp, Rattus norvegicus
gataccctggtgaaatttggatcat

SEQ ID NO: 358451 - DNA, 25 bp, Rattus norvegicus
gataccctggtgtaatttggatcat

SEQ ID NO: 358452 - DNA, 25 bp, Rattus norvegicus
gataccctgtatctggcagtgagct

SEQ ID NO: 358453 - DNA, 25 bp, Rattus norvegicus
gataccctgtatgtggcagtgagct

SEQ ID NO: 358454 - DNA, 25 bp, Rattus norvegicus
gataccctgtcacagactgtgctac

SEQ ID NO: 358455 - DNA, 25 bp, Rattus norvegicus
gataccctgtcagagactgtgctac

SEQ ID NO: 358456 - DNA, 25 bp, Rattus norvegicus
gatacccttcttactgtggttgtgt

SEQ ID NO: 358457 - DNA, 25 bp, Rattus norvegicus
gatacccttctttctgtggttgtgt

SEQ ID NO: 358458 - DNA, 25 bp, Rattus norvegicus
gatacccttgagaagtgtcacctgt

SEQ ID NO: 358459 - DNA, 25 bp, Rattus norvegicus
gatacccttgagtagtgtcacctgt

SEQ ID NO: 358460 - DNA, 25 bp, Rattus norvegicus
gatacccttggtcaacacgcagcat

SEQ ID NO: 358461 - DNA, 25 bp, Rattus norvegicus
gatacccttggtgaacacgcagcat

SEQ ID NO: 358462 - DNA, 25 bp, Rattus norvegicus
gatacccttttgactggaatagact

SEQ ID NO: 358463 - DNA, 25 bp, Rattus norvegicus
gatacccttttgtctggaatagact

SEQ ID NO: 358464 - DNA, 25 bp, Rattus norvegicus
gataccgaagaacgtgtcctcgcca

SEQ ID NO: 358465 - DNA, 25 bp, Rattus norvegicus
gataccgaagaaggtgtcctcgcca

SEQ ID NO: 358466 - DNA, 25 bp, Rattus norvegicus
gataccgactgcattgttggagaaa

SEQ ID NO: 358467 - DNA, 25 bp, Rattus norvegicus
gataccgactgctttgttggagaaa

SEQ ID NO: 358468 - DNA, 25 bp, Rattus norvegicus
gataccgcacagagaagccctccaa

SEQ ID NO: 358469 - DNA, 25 bp, Rattus norvegicus
gataccgcacagtgaagccctccaa

SEQ ID NO: 358470 - DNA, 25 bp, Rattus norvegicus
gataccgccgatatagaaactgtag

SEQ ID NO: 358471 - DNA, 25 bp, Rattus norvegicus
gataccgccgatttagaaactgtag

SEQ ID NO: 358472 - DNA, 25 bp, Rattus norvegicus
gataccgctctcatcagagtaactg

SEQ ID NO: 358473 - DNA, 25 bp, Rattus norvegicus
gataccgctctcttcagagtaactg

SEQ ID NO: 358474 - DNA, 25 bp, Rattus norvegicus
gataccgctgacacatacttcaaga

SEQ ID NO: 358475 - DNA, 25 bp, Rattus norvegicus
gataccgctgactcatacttcaaga

SEQ ID NO: 358476 - DNA, 25 bp, Rattus norvegicus
gataccggatctaaatactcaacca

SEQ ID NO: 358477 - DNA, 25 bp, Rattus norvegicus
gataccggatcttaatactcaacca

SEQ ID NO: 358478 - DNA, 25 bp, Rattus norvegicus
gataccggcaacctgtgcatggtaa

SEQ ID NO: 358479 - DNA, 25 bp, Rattus norvegicus
gataccggcaacgtgtgcatggtaa

SEQ ID NO: 358480 - DNA, 25 bp, Rattus norvegicus
gataccgggcatccttgtgtttgat

SEQ ID NO: 358481 - DNA, 25 bp, Rattus norvegicus
gataccgggcatgcttgtgtttgat

SEQ ID NO: 358482 - DNA, 25 bp, Rattus norvegicus
gataccgggcgccacctctggaggt

SEQ ID NO: 358483 - DNA, 25 bp, Rattus norvegicus
gataccgggcgcgacctctggaggt

SEQ ID NO: 358484 - DNA, 25 bp, Rattus norvegicus
gataccgggtcaccggctgctcatg

SEQ ID NO: 358485 - DNA, 25 bp, Rattus norvegicus
gataccgggtcagcggctgctcatg

SEQ ID NO: 358486 - DNA, 25 bp, Rattus norvegicus
gataccggtgtcaattattagttac

SEQ ID NO: 358487 - DNA, 25 bp, Rattus norvegicus
gataccggtgtctattattagttac

SEQ ID NO: 358488 - DNA, 25 bp, Rattus norvegicus
gataccgtcaacctcgaagtacgtg

SEQ ID NO: 358489 - DNA, 25 bp, Rattus norvegicus
gataccgtcaacgtcgaagtacgtg

SEQ ID NO: 358490 - DNA, 25 bp, Rattus norvegicus
gataccgtcaggatgtagtcaccca

SEQ ID NO: 358491 - DNA, 25 bp, Rattus norvegicus
gataccgtcaggttgtagtcaccca

SEQ ID NO: 358492 - DNA, 25 bp, Rattus norvegicus
gataccgtcatcatttcatcttacc

SEQ ID NO: 358493 - DNA, 25 bp, Rattus norvegicus
gataccgtcatcttttcatcttacc

SEQ ID NO: 358494 - DNA, 25 bp, Rattus norvegicus
gataccgtgtcaacagagatccccg

SEQ ID NO: 358495 - DNA, 25 bp, Rattus norvegicus
gataccgtgtcatcagagatccccg

SEQ ID NO: 358496 - DNA, 25 bp, Rattus norvegicus
gataccgttcccctgatttagaaat

SEQ ID NO: 358497 - DNA, 25 bp, Rattus norvegicus
gataccgttcccgtgatttagaaat

SEQ ID NO: 358498 - DNA, 25 bp, Rattus norvegicus
gatacctactatacaaccatgcact

SEQ ID NO: 358499 - DNA, 25 bp, Rattus norvegicus
gatacctactattcaaccatgcact

SEQ ID NO: 358500 - DNA, 25 bp, Rattus norvegicus
gatacctactcaaagtggccacgga

SEQ ID NO: 358501 - DNA, 25 bp, Rattus norvegicus
gatacctactcatagtggccacgga

SEQ ID NO: 358502 - DNA, 25 bp, Rattus norvegicus
gatacctactgcaccataaccgaag

SEQ ID NO: 358503 - DNA, 25 bp, Rattus norvegicus
gatacctactgctccataaccgaag

SEQ ID NO: 358504 - DNA, 25 bp, Rattus norvegicus
gatacctaggttatacttctcattt

SEQ ID NO: 358505 - DNA, 25 bp, Rattus norvegicus
gatacctaggttttacttctcattt

SEQ ID NO: 358506 - DNA, 25 bp, Rattus norvegicus
gatacctagttgattgcatgagttt

SEQ ID NO: 358507 - DNA, 25 bp, Rattus norvegicus
gatacctagttgtttgcatgagttt

SEQ ID NO: 358508 - DNA, 25 bp, Rattus norvegicus
gatacctatccaacctgagaagaga

SEQ ID NO: 358509 - DNA, 25 bp, Rattus norvegicus
gatacctatccatcctgagaagaga

SEQ ID NO: 358510 - DNA, 25 bp, Rattus norvegicus
gatacctatttaactctttcttaag

SEQ ID NO: 358511 - DNA, 25 bp, Rattus norvegicus
gatacctatttatctctttcttaag

SEQ ID NO: 358512 - DNA, 25 bp, Rattus norvegicus
gatacctattttcttctttctgaat

SEQ ID NO: 358513 - DNA, 25 bp, Rattus norvegicus
gatacctattttgttctttctgaat

SEQ ID NO: 358514 - DNA, 25 bp, Rattus norvegicus
gatacctcacacacacgaaaaagcg

SEQ ID NO: 358515 - DNA, 25 bp, Rattus norvegicus
gatacctcacactcacgaaaaagcg

SEQ ID NO: 358516 - DNA, 25 bp, Rattus norvegicus
gatacctcagagatgacatttaaaa

SEQ ID NO: 358517 - DNA, 25 bp, Rattus norvegicus
gatacctcagagttgacatttaaaa

SEQ ID NO: 358518 - DNA, 25 bp, Rattus norvegicus
gatacctcatctatccgagagttca

SEQ ID NO: 358519 - DNA, 25 bp, Rattus norvegicus
gatacctcatctttccgagagttca

SEQ ID NO: 358520 - DNA, 25 bp, Rattus norvegicus
gatacctcattgaatagctcccagc

SEQ ID NO: 358521 - DNA, 25 bp, Rattus norvegicus
gatacctcattgtatagctcccagc

SEQ ID NO: 358522 - DNA, 25 bp, Rattus norvegicus
gatacctccagacacagagcagcgt

SEQ ID NO: 358523 - DNA, 25 bp, Rattus norvegicus
gatacctccagagacagagcagcgt

SEQ ID NO: 358524 - DNA, 25 bp, Rattus norvegicus
gatacctccagtagctgcacaaggg

SEQ ID NO: 358525 - DNA, 25 bp, Rattus norvegicus
gatacctccagttgctgcacaaggg

SEQ ID NO: 358526 - DNA, 25 bp, Rattus norvegicus
gatacctcggatactgatgacaaag

SEQ ID NO: 358527 - DNA, 25 bp, Rattus norvegicus
gatacctcggattctgatgacaaag

SEQ ID NO: 358528 - DNA, 25 bp, Rattus norvegicus
gatacctcgtcgatactctgattat

SEQ ID NO: 358529 - DNA, 25 bp, Rattus norvegicus
gatacctcgtcgttactctgattat

SEQ ID NO: 358530 - DNA, 25 bp, Rattus norvegicus
gatacctctgacatccaaggagaag

SEQ ID NO: 358531 - DNA, 25 bp, Rattus norvegicus
gatacctctgacttccaaggagaag

SEQ ID NO: 358532 - DNA, 25 bp, Rattus norvegicus
gatacctctgatcagggaggctgca

SEQ ID NO: 358533 - DNA, 25 bp, Rattus norvegicus
gatacctctgatgagggaggctgca

SEQ ID NO: 358534 - DNA, 25 bp, Rattus norvegicus
gatacctctggaaatttgtgccaat

SEQ ID NO: 358535 - DNA, 25 bp, Rattus norvegicus
gatacctctggaacttttccacagt

SEQ ID NO: 358536 - DNA, 25 bp, Rattus norvegicus
gatacctctggatatttgtgccaat

SEQ ID NO: 358537 - DNA, 25 bp, Rattus norvegicus
gatacctctggatcttttccacagt

SEQ ID NO: 358538 - DNA, 25 bp, Rattus norvegicus
gatacctgaaaacctggagcactat

SEQ ID NO: 358539 - DNA, 25 bp, Rattus norvegicus
gatacctgaaaagctggagcactat

SEQ ID NO: 358540 - DNA, 25 bp, Rattus norvegicus
gatacctgacacaatcttgctgaca

SEQ ID NO: 358541 - DNA, 25 bp, Rattus norvegicus
gatacctgacactatcttgctgaca

SEQ ID NO: 358542 - DNA, 25 bp, Rattus norvegicus
gatacctgaccacttgctaggttgc

SEQ ID NO: 358543 - DNA, 25 bp, Rattus norvegicus
gatacctgaccagttgctaggttgc

SEQ ID NO: 358544 - DNA, 25 bp, Rattus norvegicus
gatacctgatttccttccagatgga

SEQ ID NO: 358545 - DNA, 25 bp, Rattus norvegicus
gatacctgatttgcttccagatgga

SEQ ID NO: 358546 - DNA, 25 bp, Rattus norvegicus
gatacctgcacaatttttacaaccg

SEQ ID NO: 358547 - DNA, 25 bp, Rattus norvegicus
gatacctgcacattttttacaaccg

SEQ ID NO: 358548 - DNA, 25 bp, Rattus norvegicus
gatacctgcatgcagaccatgggac

SEQ ID NO: 358549 - DNA, 25 bp, Rattus norvegicus
gatacctgcatggagaccatgggac

SEQ ID NO: 358550 - DNA, 25 bp, Rattus norvegicus
gatacctgctacctctgctactgca

SEQ ID NO: 358551 - DNA, 25 bp, Rattus norvegicus
gatacctgctacgtctgctactgca

SEQ ID NO: 358552 - DNA, 25 bp, Rattus norvegicus
gatacctggaagagggtcctagcct

SEQ ID NO: 358553 - DNA, 25 bp, Rattus norvegicus
gatacctggaagtgggtcctagcct

SEQ ID NO: 358554 - DNA, 25 bp, Rattus norvegicus
gatacctggaccaccaagtgaactg

SEQ ID NO: 358555 - DNA, 25 bp, Rattus norvegicus
gatacctggacctccaagtgaactg

SEQ ID NO: 358556 - DNA, 25 bp, Rattus norvegicus
gatacctgggagaagaacctctgat

SEQ ID NO: 358557 - DNA, 25 bp, Rattus norvegicus
gatacctgggagtagaacctctgat

SEQ ID NO: 358558 - DNA, 25 bp, Rattus norvegicus
gatacctgtcatcttctctttttac

SEQ ID NO: 358559 - DNA, 25 bp, Rattus norvegicus
gatacctgtcatgttctctttttac

SEQ ID NO: 358560 - DNA, 25 bp, Rattus norvegicus
gatacctgtggtatcaaatgcctga

SEQ ID NO: 358561 - DNA, 25 bp, Rattus norvegicus
gatacctgtggtttcaaatgcctga

SEQ ID NO: 358562 - DNA, 25 bp, Rattus norvegicus
gatacctgtttacatacctcaacgc

SEQ ID NO: 358563 - DNA, 25 bp, Rattus norvegicus
gatacctgtttagatacctcaacgc

SEQ ID NO: 358564 - DNA, 25 bp, Rattus norvegicus
gataccttactcatctcaaagctga

SEQ ID NO: 358565 - DNA, 25 bp, Rattus norvegicus
gataccttactcttctcaaagctga

SEQ ID NO: 358566 - DNA, 25 bp, Rattus norvegicus
gataccttatctctcattgtgcttt

SEQ ID NO: 358567 - DNA, 25 bp, Rattus norvegicus
gataccttatctgtcattgtgcttt

SEQ ID NO: 358568 - DNA, 25 bp, Rattus norvegicus
gataccttcaatctttttgcttctg

SEQ ID NO: 358569 - DNA, 25 bp, Rattus norvegicus
gataccttcaatgtttttgcttctg

SEQ ID NO: 358570 - DNA, 25 bp, Rattus norvegicus
gataccttcctcctctttaagttgt

SEQ ID NO: 358571 - DNA, 25 bp, Rattus norvegicus
gataccttcctcgtctttaagttgt

SEQ ID NO: 358572 - DNA, 25 bp, Rattus norvegicus
gataccttctatattagttgctaat

SEQ ID NO: 358573 - DNA, 25 bp, Rattus norvegicus
gataccttctattttagttgctaat

SEQ ID NO: 358574 - DNA, 25 bp, Rattus norvegicus
gataccttgaatcattttagcctaa

SEQ ID NO: 358575 - DNA, 25 bp, Rattus norvegicus
gataccttgaatgattttagcctaa

SEQ ID NO: 358576 - DNA, 25 bp, Rattus norvegicus
gataccttgagacctccatcaggtg

SEQ ID NO: 358577 - DNA, 25 bp, Rattus norvegicus
gataccttgagagctccatcaggtg

SEQ ID NO: 358578 - DNA, 25 bp, Rattus norvegicus
gataccttgataagacggactgctt

SEQ ID NO: 358579 - DNA, 25 bp, Rattus norvegicus
gataccttgatatgacggactgctt

SEQ ID NO: 358580 - DNA, 25 bp, Rattus norvegicus
gataccttgattagtttctgtcttt

SEQ ID NO: 358581 - DNA, 25 bp, Rattus norvegicus
gataccttgatttgtttctgtcttt

SEQ ID NO: 358582 - DNA, 25 bp, Rattus norvegicus
gataccttggcgagggtgtttgccc

SEQ ID NO: 358583 - DNA, 25 bp, Rattus norvegicus
gataccttggcgtgggtgtttgccc

SEQ ID NO: 358584 - DNA, 25 bp, Rattus norvegicus
gataccttgtcaagtgcggacccaa

SEQ ID NO: 358585 - DNA, 25 bp, Rattus norvegicus
gataccttgtcatgtgcggacccaa

SEQ ID NO: 358586 - DNA, 25 bp, Rattus norvegicus
gataccttgtgtcccatgattgatt

SEQ ID NO: 358587 - DNA, 25 bp, Rattus norvegicus
gataccttgtgtgccatgattgatt

SEQ ID NO: 358588 - DNA, 25 bp, Rattus norvegicus
gatacctttgtaaactgaaaggtca

SEQ ID NO: 358589 - DNA, 25 bp, Rattus norvegicus
gatacctttgtatactgaaaggtca

SEQ ID NO: 358590 - DNA, 25 bp, Rattus norvegicus
gatacctttgtccatgttactgatc

SEQ ID NO: 358591 - DNA, 25 bp, Rattus norvegicus
gatacctttgtcgatgttactgatc

SEQ ID NO: 358592 - DNA, 25 bp, Rattus norvegicus
gataccttttgtcttctttggataa

SEQ ID NO: 358593 - DNA, 25 bp, Rattus norvegicus
gataccttttgtgttctttggataa

SEQ ID NO: 358594 - DNA, 25 bp, Rattus norvegicus
gatacgaacacacatgcaggacttg

SEQ ID NO: 358595 - DNA, 25 bp, Rattus norvegicus
gatacgaacacagatgcaggacttg

SEQ ID NO: 358596 - DNA, 25 bp, Rattus norvegicus
gatacgaagcccactcttggcttag

SEQ ID NO: 358597 - DNA, 25 bp, Rattus norvegicus
gatacgaagccctctcttggcttag

SEQ ID NO: 358598 - DNA, 25 bp, Rattus norvegicus
gatacgaattctctcactatctgaa

SEQ ID NO: 358599 - DNA, 25 bp, Rattus norvegicus
gatacgaattctgtcactatctgaa

SEQ ID NO: 358600 - DNA, 25 bp, Rattus norvegicus
gatacgagccatacagatccttatt

SEQ ID NO: 358601 - DNA, 25 bp, Rattus norvegicus
gatacgagccattcagatccttatt

SEQ ID NO: 358602 - DNA, 25 bp, Rattus norvegicus
gatacgagtcgtacgcaaatccatc

SEQ ID NO: 358603 - DNA, 25 bp, Rattus norvegicus
gatacgagtcgttcgcaaatccatc

SEQ ID NO: 358604 - DNA, 25 bp, Rattus norvegicus
gatacgatcaccagacagaagcagt

SEQ ID NO: 358605 - DNA, 25 bp, Rattus norvegicus
gatacgatcacctgacagaagcagt

SEQ ID NO: 358606 - DNA, 25 bp, Rattus norvegicus
gatacgatgggaagagtcaactcca

SEQ ID NO: 358607 - DNA, 25 bp, Rattus norvegicus
gatacgatgggatgagtcaactcca

SEQ ID NO: 358608 - DNA, 25 bp, Rattus norvegicus
gatacgattttcattagtcttcaag

SEQ ID NO: 358609 - DNA, 25 bp, Rattus norvegicus
gatacgattttctttagtcttcaag

SEQ ID NO: 358610 - DNA, 25 bp, Rattus norvegicus
gatacgcagtgcattgtgacctgac

SEQ ID NO: 358611 - DNA, 25 bp, Rattus norvegicus
gatacgcagtgctttgtgacctgac

SEQ ID NO: 358612 - DNA, 25 bp, Rattus norvegicus
gatacgcagttcagttctcatgttt

SEQ ID NO: 358613 - DNA, 25 bp, Rattus norvegicus
gatacgcagttctgttctcatgttt

SEQ ID NO: 358614 - DNA, 25 bp, Rattus norvegicus
gatacgccattaacaactgccgttc

SEQ ID NO: 358615 - DNA, 25 bp, Rattus norvegicus
gatacgccattatcaactgccgttc

SEQ ID NO: 358616 - DNA, 25 bp, Rattus norvegicus
gatacgccctgcacaggtgaaagtg

SEQ ID NO: 358617 - DNA, 25 bp, Rattus norvegicus
gatacgccctgctcaggtgaaagtg

SEQ ID NO: 358618 - DNA, 25 bp, Rattus norvegicus
gatacgcctgcgcagggacagcaaa

SEQ ID NO: 358619 - DNA, 25 bp, Rattus norvegicus
gatacgcctgcggagggacagcaaa

SEQ ID NO: 358620 - DNA, 25 bp, Rattus norvegicus
gatacgctactacattactttgttt

SEQ ID NO: 358621 - DNA, 25 bp, Rattus norvegicus
gatacgctactagattactttgttt

SEQ ID NO: 358622 - DNA, 25 bp, Rattus norvegicus
gatacgctcacaaggtcaacggctt

SEQ ID NO: 358623 - DNA, 25 bp, Rattus norvegicus
gatacgctcacatggtcaacggctt

SEQ ID NO: 358624 - DNA, 25 bp, Rattus norvegicus
gatacgctctacacagagaacaaag

SEQ ID NO: 358625 - DNA, 25 bp, Rattus norvegicus
gatacgctctactcagagaacaaag

SEQ ID NO: 358626 - DNA, 25 bp, Rattus norvegicus
gatacgctctgtcgaaactggtcat

SEQ ID NO: 358627 - DNA, 25 bp, Rattus norvegicus
gatacgctctgtggaaactggtcat

SEQ ID NO: 358628 - DNA, 25 bp, Rattus norvegicus
gatacgctgaggacaggagcagaca

SEQ ID NO: 358629 - DNA, 25 bp, Rattus norvegicus
gatacgctgaggtcaggagcagaca

SEQ ID NO: 358630 - DNA, 25 bp, Rattus norvegicus
gatacgctgcgaactgaatttcaca

SEQ ID NO: 358631 - DNA, 25 bp, Rattus norvegicus
gatacgctgcgatctgaatttcaca

SEQ ID NO: 358632 - DNA, 25 bp, Rattus norvegicus
gatacgctgtcccatagcagatcat

SEQ ID NO: 358633 - DNA, 25 bp, Rattus norvegicus
gatacgctgtccgatagcagatcat

SEQ ID NO: 358634 - DNA, 25 bp, Rattus norvegicus
gatacgctgtggagggcaacatatt

SEQ ID NO: 358635 - DNA, 25 bp, Rattus norvegicus
gatacgctgtggtgggcaacatatt

SEQ ID NO: 358636 - DNA, 25 bp, Rattus norvegicus
gatacgcttttcactggagctacca

SEQ ID NO: 358637 - DNA, 25 bp, Rattus norvegicus
gatacgcttttctctggagctacca

SEQ ID NO: 358638 - DNA, 25 bp, Rattus norvegicus
gatacggaaatgctcctcaggatca

SEQ ID NO: 358639 - DNA, 25 bp, Rattus norvegicus
gatacggaaatggtcctcaggatca

SEQ ID NO: 358640 - DNA, 25 bp, Rattus norvegicus
gatacggaacacacactgacattgg

SEQ ID NO: 358641 - DNA, 25 bp, Rattus norvegicus
gatacggaacactcactgacattgg

SEQ ID NO: 358642 - DNA, 25 bp, Rattus norvegicus
gatacggaacatccttcctgaacaa

SEQ ID NO: 358643 - DNA, 25 bp, Rattus norvegicus
gatacggaacatgcttcctgaacaa

SEQ ID NO: 358644 - DNA, 25 bp, Rattus norvegicus
gatacggaattcaaagctctaatgg

SEQ ID NO: 358645 - DNA, 25 bp, Rattus norvegicus
gatacggaattctaagctctaatgg

SEQ ID NO: 358646 - DNA, 25 bp, Rattus norvegicus
gatacggagacaccgagttcacagt

SEQ ID NO: 358647 - DNA, 25 bp, Rattus norvegicus
gatacggagacagcgagttcacagt

SEQ ID NO: 358648 - DNA, 25 bp, Rattus norvegicus
gatacggatcttaccagtcctatca

SEQ ID NO: 358649 - DNA, 25 bp, Rattus norvegicus
gatacggatctttccagtcctatca

SEQ ID NO: 358650 - DNA, 25 bp, Rattus norvegicus
gatacggcacctccttgaagcgtaa

SEQ ID NO: 358651 - DNA, 25 bp, Rattus norvegicus
gatacggcacctgcttgaagcgtaa

SEQ ID NO: 358652 - DNA, 25 bp, Rattus norvegicus
gatacggcattcctgggtctatttg

SEQ ID NO: 358653 - DNA, 25 bp, Rattus norvegicus
gatacggcattcgtgggtctatttg

SEQ ID NO: 358654 - DNA, 25 bp, Rattus norvegicus
gatacggccatcatcaacgcagaag

SEQ ID NO: 358655 - DNA, 25 bp, Rattus norvegicus
gatacggccatcttcaacgcagaag

SEQ ID NO: 358656 - DNA, 25 bp, Rattus norvegicus
gatacggcgatcattgtcgggctca

SEQ ID NO: 358657 - DNA, 25 bp, Rattus norvegicus
gatacggcgatctttgtcgggctca

SEQ ID NO: 358658 - DNA, 25 bp, Rattus norvegicus
gatacggcggttaatcctgacaaaa

SEQ ID NO: 358659 - DNA, 25 bp, Rattus norvegicus
gatacggcggtttatcctgacaaaa

SEQ ID NO: 358660 - DNA, 25 bp, Rattus norvegicus
gatacggctctgatatttgatgctt

SEQ ID NO: 358661 - DNA, 25 bp, Rattus norvegicus
gatacggctctgttatttgatgctt

SEQ ID NO: 358662 - DNA, 25 bp, Rattus norvegicus
gatacggctgtgagagaatgctctg

SEQ ID NO: 358663 - DNA, 25 bp, Rattus norvegicus
gatacggctgtgtgagaatgctctg

SEQ ID NO: 358664 - DNA, 25 bp, Rattus norvegicus
gatacgggagttactccaacgacct

SEQ ID NO: 358665 - DNA, 25 bp, Rattus norvegicus
gatacgggagtttctccaacgacct

SEQ ID NO: 358666 - DNA, 25 bp, Rattus norvegicus
gatacgggcatactgtttatcccat

SEQ ID NO: 358667 - DNA, 25 bp, Rattus norvegicus
gatacgggcatagtgtttatcccat

SEQ ID NO: 358668 - DNA, 25 bp, Rattus norvegicus
gatacgggtatacgttgttcagtta

SEQ ID NO: 358669 - DNA, 25 bp, Rattus norvegicus
gatacgggtataggttgttcagtta

SEQ ID NO: 358670 - DNA, 25 bp, Rattus norvegicus
gatacggtacggctgtccttcatcc

SEQ ID NO: 358671 - DNA, 25 bp, Rattus norvegicus
gatacggtacgggtgtccttcatcc

SEQ ID NO: 358672 - DNA, 25 bp, Rattus norvegicus
gatacggtccaacagcgagccaggt

SEQ ID NO: 358673 - DNA, 25 bp, Rattus norvegicus
gatacggtccaagagcgagccaggt

SEQ ID NO: 358674 - DNA, 25 bp, Rattus norvegicus
gatacggtcctgaaattatgtgaag

SEQ ID NO: 358675 - DNA, 25 bp, Rattus norvegicus
gatacggtcctgtaattatgtgaag

SEQ ID NO: 358676 - DNA, 25 bp, Rattus norvegicus
gatacgtacgtcatacctggtggtt

SEQ ID NO: 358677 - DNA, 25 bp, Rattus norvegicus
gatacgtacgtcttacctggtggtt

SEQ ID NO: 358678 - DNA, 25 bp, Rattus norvegicus
gatacgtagatcaagggaccagtgg

SEQ ID NO: 358679 - DNA, 25 bp, Rattus norvegicus
gatacgtagatctagggaccagtgg

SEQ ID NO: 358680 - DNA, 25 bp, Rattus norvegicus
gatacgtagtagagaccgtgcttta

SEQ ID NO: 358681 - DNA, 25 bp, Rattus norvegicus
gatacgtagtagtgaccgtgcttta

SEQ ID NO: 358682 - DNA, 25 bp, Rattus norvegicus
gatacgtataaacaacatgttccta

SEQ ID NO: 358683 - DNA, 25 bp, Rattus norvegicus
gatacgtataaagaacatgttccta

SEQ ID NO: 358684 - DNA, 25 bp, Rattus norvegicus
gatacgtcagtaaacttcggagcaa

SEQ ID NO: 358685 - DNA, 25 bp, Rattus norvegicus
gatacgtcagtatacttcggagcaa

SEQ ID NO: 358686 - DNA, 25 bp, Rattus norvegicus
gatacgtgaagtactatttttgcag

SEQ ID NO: 358687 - DNA, 25 bp, Rattus norvegicus
gatacgtgaagttctatttttgcag

SEQ ID NO: 358688 - DNA, 25 bp, Rattus norvegicus
gatacgtgattgcaccacagagagt

SEQ ID NO: 358689 - DNA, 25 bp, Rattus norvegicus
gatacgtgattggaccacagagagt

SEQ ID NO: 358690 - DNA, 25 bp, Rattus norvegicus
gatacgtgcgtgataggcagagtct

SEQ ID NO: 358691 - DNA, 25 bp, Rattus norvegicus
gatacgtgcgtgttaggcagagtct

SEQ ID NO: 358692 - DNA, 25 bp, Rattus norvegicus
gatacgtgtaacattctttccaggg

SEQ ID NO: 358693 - DNA, 25 bp, Rattus norvegicus
gatacgtgtaactttctttccaggg

SEQ ID NO: 358694 - DNA, 25 bp, Rattus norvegicus
gatacgtgttttctttgcgcaatat

SEQ ID NO: 358695 - DNA, 25 bp, Rattus norvegicus
gatacgtgttttgtttgcgcaatat

SEQ ID NO: 358696 - DNA, 25 bp, Rattus norvegicus
gatacgttacatagtcctcttgtgg

SEQ ID NO: 358697 - DNA, 25 bp, Rattus norvegicus
gatacgttacattgtcctcttgtgg

SEQ ID NO: 358698 - DNA, 25 bp, Rattus norvegicus
gatacgttctcaaatcatctgaaat

SEQ ID NO: 358699 - DNA, 25 bp, Rattus norvegicus
gatacgttctcatatcatctgaaat

SEQ ID NO: 358700 - DNA, 25 bp, Rattus norvegicus
gatacgttgtgtcatgatcagtact

SEQ ID NO: 358701 - DNA, 25 bp, Rattus norvegicus
gatacgttgtgtgatgatcagtact

SEQ ID NO: 358702 - DNA, 25 bp, Rattus norvegicus
gatactaacattagaagaccccttt

SEQ ID NO: 358703 - DNA, 25 bp, Rattus norvegicus
gatactaacatttgaagaccccttt

SEQ ID NO: 358704 - DNA, 25 bp, Rattus norvegicus
gatactaaccatcagattgtacagt

SEQ ID NO: 358705 - DNA, 25 bp, Rattus norvegicus
gatactaaccatgagattgtacagt

SEQ ID NO: 358706 - DNA, 25 bp, Rattus norvegicus
gatactaacggacgacactggtgtg

SEQ ID NO: 358707 - DNA, 25 bp, Rattus norvegicus
gatactaacggaggacactggtgtg

SEQ ID NO: 358708 - DNA, 25 bp, Rattus norvegicus
gatactaacgtcatgctgttccaac

SEQ ID NO: 358709 - DNA, 25 bp, Rattus norvegicus
gatactaacgtcttgctgttccaac

SEQ ID NO: 358710 - DNA, 25 bp, Rattus norvegicus
gatactacaaacaacgattcggctt

SEQ ID NO: 358711 - DNA, 25 bp, Rattus norvegicus
gatactacaaactacgattcggctt

SEQ ID NO: 358712 - DNA, 25 bp, Rattus norvegicus
gatactacaaatacagggtaaacta

SEQ ID NO: 358713 - DNA, 25 bp, Rattus norvegicus
gatactacaaattcagggtaaacta

SEQ ID NO: 358714 - DNA, 25 bp, Rattus norvegicus
gatactacagagattcagcaagaag

SEQ ID NO: 358715 - DNA, 25 bp, Rattus norvegicus
gatactacagagtttcagcaagaag

SEQ ID NO: 358716 - DNA, 25 bp, Rattus norvegicus
gatactacatttcttgcatatacaa

SEQ ID NO: 358717 - DNA, 25 bp, Rattus norvegicus
gatactacatttgttgcatatacaa

SEQ ID NO: 358718 - DNA, 25 bp, Rattus norvegicus
gatactaccattatatcccttttaa

SEQ ID NO: 358719 - DNA, 25 bp, Rattus norvegicus
gatactaccattttatcccttttaa

SEQ ID NO: 358720 - DNA, 25 bp, Rattus norvegicus
gatactaccccaagtcaattaactg

SEQ ID NO: 358721 - DNA, 25 bp, Rattus norvegicus
gatactaccccatgtcaattaactg

SEQ ID NO: 358722 - DNA, 25 bp, Rattus norvegicus
gatactacctcacacccagtaggac

SEQ ID NO: 358723 - DNA, 25 bp, Rattus norvegicus
gatactacctcagacccagtaggac

SEQ ID NO: 358724 - DNA, 25 bp, Rattus norvegicus
gatactacgatgaggaagagaactc

SEQ ID NO: 358725 - DNA, 25 bp, Rattus norvegicus
gatactacgatgtggaagagaactc

SEQ ID NO: 358726 - DNA, 25 bp, Rattus norvegicus
gatactacgttcattttagctcaaa

SEQ ID NO: 358727 - DNA, 25 bp, Rattus norvegicus
gatactacgttctttttagctcaaa

SEQ ID NO: 358728 - DNA, 25 bp, Rattus norvegicus
gatactactctaaacactgacagtg

SEQ ID NO: 358729 - DNA, 25 bp, Rattus norvegicus
gatactactctatacactgacagtg

SEQ ID NO: 358730 - DNA, 25 bp, Rattus norvegicus
gatactactgtgatctgagtgttga

SEQ ID NO: 358731 - DNA, 25 bp, Rattus norvegicus
gatactactgtgttctgagtgttga

SEQ ID NO: 358732 - DNA, 25 bp, Rattus norvegicus
gatactacttctccagaacttcgag

SEQ ID NO: 358733 - DNA, 25 bp, Rattus norvegicus
gatactacttctgcagaacttcgag

SEQ ID NO: 358734 - DNA, 25 bp, Rattus norvegicus
gatactagatatcccactgtggagt

SEQ ID NO: 358735 - DNA, 25 bp, Rattus norvegicus
gatactagatatgccactgtggagt

SEQ ID NO: 358736 - DNA, 25 bp, Rattus norvegicus
gatactaggatgagggattttcccc

SEQ ID NO: 358737 - DNA, 25 bp, Rattus norvegicus
gatactaggatgtgggattttcccc

SEQ ID NO: 358738 - DNA, 25 bp, Rattus norvegicus
gatactatactcaattactttggga

SEQ ID NO: 358739 - DNA, 25 bp, Rattus norvegicus
gatactatactctattactttggga

SEQ ID NO: 358740 - DNA, 25 bp, Rattus norvegicus
gatactatattcagtccccaggact

SEQ ID NO: 358741 - DNA, 25 bp, Rattus norvegicus
gatactatattctgtccccaggact

SEQ ID NO: 358742 - DNA, 25 bp, Rattus norvegicus
gatactatccagactcatggtgctt

SEQ ID NO: 358743 - DNA, 25 bp, Rattus norvegicus
gatactatccagtctcatggtgctt

SEQ ID NO: 358744 - DNA, 25 bp, Rattus norvegicus
gatactatggccaaagcaattctta

SEQ ID NO: 358745 - DNA, 25 bp, Rattus norvegicus
gatactatggcctaagcaattctta

SEQ ID NO: 358746 - DNA, 25 bp, Rattus norvegicus
gatactattgatctattctggtgaa

SEQ ID NO: 358747 - DNA, 25 bp, Rattus norvegicus
gatactattgatgtattctggtgaa

SEQ ID NO: 358748 - DNA, 25 bp, Rattus norvegicus
gatactattgttccaatcatggcag

SEQ ID NO: 358749 - DNA, 25 bp, Rattus norvegicus
gatactattgttgcaatcatggcag

SEQ ID NO: 358750 - DNA, 25 bp, Rattus norvegicus
gatactcaattacgttaagccaaga

SEQ ID NO: 358751 - DNA, 25 bp, Rattus norvegicus
gatactcaattaggttaagccaaga

SEQ ID NO: 358752 - DNA, 25 bp, Rattus norvegicus
gatactcacacacccatggtgggat

SEQ ID NO: 358753 - DNA, 25 bp, Rattus norvegicus
gatactcacacagccatggtgggat

SEQ ID NO: 358754 - DNA, 25 bp, Rattus norvegicus
gatactcacggtacatgaatacact

SEQ ID NO: 358755 - DNA, 25 bp, Rattus norvegicus
gatactcacggttcatgaatacact

SEQ ID NO: 358756 - DNA, 25 bp, Rattus norvegicus
gatactcacgtcagaaactcgggat

SEQ ID NO: 358757 - DNA, 25 bp, Rattus norvegicus
gatactcacgtctgaaactcgggat

SEQ ID NO: 358758 - DNA, 25 bp, Rattus norvegicus
gatactcagtgtctgctggcagcag

SEQ ID NO: 358759 - DNA, 25 bp, Rattus norvegicus
gatactcagtgtgtgctggcagcag

SEQ ID NO: 358760 - DNA, 25 bp, Rattus norvegicus
gatactcatggactacccgaagaac

SEQ ID NO: 358761 - DNA, 25 bp, Rattus norvegicus
gatactcatggagtacccgaagaac

SEQ ID NO: 358762 - DNA, 25 bp, Rattus norvegicus
gatactccgagtcattgggaatcag

SEQ ID NO: 358763 - DNA, 25 bp, Rattus norvegicus
gatactccgagtgattgggaatcag

SEQ ID NO: 358764 - DNA, 25 bp, Rattus norvegicus
gatactccgtagcatcacactgtag

SEQ ID NO: 358765 - DNA, 25 bp, Rattus norvegicus
gatactccgtaggatcacactgtag

SEQ ID NO: 358766 - DNA, 25 bp, Rattus norvegicus
gatactcctgcgactggattgggaa

SEQ ID NO: 358767 - DNA, 25 bp, Rattus norvegicus
gatactcctgcgtctggattgggaa

SEQ ID NO: 358768 - DNA, 25 bp, Rattus norvegicus
gatactcctgtgacactgagtggct

SEQ ID NO: 358769 - DNA, 25 bp, Rattus norvegicus
gatactcctgtgtcactgagtggct

SEQ ID NO: 358770 - DNA, 25 bp, Rattus norvegicus
gatactccttccaggagctaagagt

SEQ ID NO: 358771 - DNA, 25 bp, Rattus norvegicus
gatactccttcctggagctaagagt

SEQ ID NO: 358772 - DNA, 25 bp, Rattus norvegicus
gatactccttctagaagccagtcac

SEQ ID NO: 358773 - DNA, 25 bp, Rattus norvegicus
gatactccttcttgaagccagtcac

SEQ ID NO: 358774 - DNA, 25 bp, Rattus norvegicus
gatactcgcggtcgtactcacgcag

SEQ ID NO: 358775 - DNA, 25 bp, Rattus norvegicus
gatactcgcggtggtactcacgcag

SEQ ID NO: 358776 - DNA, 25 bp, Rattus norvegicus
gatactcggctgaaattactatact

SEQ ID NO: 358777 - DNA, 25 bp, Rattus norvegicus
gatactcggctgtaattactatact

SEQ ID NO: 358778 - DNA, 25 bp, Rattus norvegicus
gatactcggtggacattggaataca

SEQ ID NO: 358779 - DNA, 25 bp, Rattus norvegicus
gatactcggtggtcattggaataca

SEQ ID NO: 358780 - DNA, 25 bp, Rattus norvegicus
gatactcgtgttagtcagttccttt

SEQ ID NO: 358781 - DNA, 25 bp, Rattus norvegicus
gatactcgtgtttgtcagttccttt

SEQ ID NO: 358782 - DNA, 25 bp, Rattus norvegicus
gatactctatagacctgacggccaa

SEQ ID NO: 358783 - DNA, 25 bp, Rattus norvegicus
gatactctatagtcctgacggccaa

SEQ ID NO: 358784 - DNA, 25 bp, Rattus norvegicus
gatactctcatgatcagtgacagct

SEQ ID NO: 358785 - DNA, 25 bp, Rattus norvegicus
gatactctcatgttcagtgacagct

SEQ ID NO: 358786 - DNA, 25 bp, Rattus norvegicus
gatactctccaaaaatagctttggc

SEQ ID NO: 358787 - DNA, 25 bp, Rattus norvegicus
gatactctccaaattattcatcctg

SEQ ID NO: 358788 - DNA, 25 bp, Rattus norvegicus
gatactctccaataatagctttggc

SEQ ID NO: 358789 - DNA, 25 bp, Rattus norvegicus
gatactctccaatttattcatcctg

SEQ ID NO: 358790 - DNA, 25 bp, Rattus norvegicus
gatactctctacagacggacactgt

SEQ ID NO: 358791 - DNA, 25 bp, Rattus norvegicus
gatactctctactgacggacactgt

SEQ ID NO: 358792 - DNA, 25 bp, Rattus norvegicus
gatactctgagtacacttagtccca

SEQ ID NO: 358793 - DNA, 25 bp, Rattus norvegicus
gatactctgagttcacttagtccca

SEQ ID NO: 358794 - DNA, 25 bp, Rattus norvegicus
gatactctgatgactggagattagc

SEQ ID NO: 358795 - DNA, 25 bp, Rattus norvegicus
gatactctgatgtctggagattagc

SEQ ID NO: 358796 - DNA, 25 bp, Rattus norvegicus
gatactctgattatgaacatgtgga

SEQ ID NO: 358797 - DNA, 25 bp, Rattus norvegicus
gatactctgattttgaacatgtgga

SEQ ID NO: 358798 - DNA, 25 bp, Rattus norvegicus
gatactctggaactctactcataac

SEQ ID NO: 358799 - DNA, 25 bp, Rattus norvegicus
gatactctggaagtctactcataac

SEQ ID NO: 358800 - DNA, 25 bp, Rattus norvegicus
gatactctggtcaacaaatagtggt

SEQ ID NO: 358801 - DNA, 25 bp, Rattus norvegicus
gatactctggtctacaaatagtggt

SEQ ID NO: 358802 - DNA, 25 bp, Rattus norvegicus
gatactctgtgtcctaaggcggcag

SEQ ID NO: 358803 - DNA, 25 bp, Rattus norvegicus
gatactctgtgtgctaaggcggcag

SEQ ID NO: 358804 - DNA, 25 bp, Rattus norvegicus
gatactcttaacagtgaactttgca

SEQ ID NO: 358805 - DNA, 25 bp, Rattus norvegicus
gatactcttaactgtgaactttgca

SEQ ID NO: 358806 - DNA, 25 bp, Rattus norvegicus
gatactcttcaaaggcatctggttt

SEQ ID NO: 358807 - DNA, 25 bp, Rattus norvegicus
gatactcttcaatggcatctggttt

SEQ ID NO: 358808 - DNA, 25 bp, Rattus norvegicus
gatactctttacacatgacacattt

SEQ ID NO: 358809 - DNA, 25 bp, Rattus norvegicus
gatactctttactcatgacacattt

SEQ ID NO: 358810 - DNA, 25 bp, Rattus norvegicus
gatactctttccagcaggtttctct

SEQ ID NO: 358811 - DNA, 25 bp, Rattus norvegicus
gatactctttcctgcaggtttctct

SEQ ID NO: 358812 - DNA, 25 bp, Rattus norvegicus
gatactgaaaagacctttagggaat

SEQ ID NO: 358813 - DNA, 25 bp, Rattus norvegicus
gatactgaaaagtcctttagggaat

SEQ ID NO: 358814 - DNA, 25 bp, Rattus norvegicus
gatactgaacatccttggagccgtt

SEQ ID NO: 358815 - DNA, 25 bp, Rattus norvegicus
gatactgaacatgcttggagccgtt

SEQ ID NO: 358816 - DNA, 25 bp, Rattus norvegicus
gatactgaactccattcttagagaa

SEQ ID NO: 358817 - DNA, 25 bp, Rattus norvegicus
gatactgaactcgattcttagagaa

SEQ ID NO: 358818 - DNA, 25 bp, Rattus norvegicus
gatactgaactgaacaccaacagtg

SEQ ID NO: 358819 - DNA, 25 bp, Rattus norvegicus
gatactgaactgtacaccaacagtg

SEQ ID NO: 358820 - DNA, 25 bp, Rattus norvegicus
gatactgaaggtctctgcttactta

SEQ ID NO: 358821 - DNA, 25 bp, Rattus norvegicus
gatactgaaggtgtctgcttactta

SEQ ID NO: 358822 - DNA, 25 bp, Rattus norvegicus
gatactgaagtcatcttttcccttc

SEQ ID NO: 358823 - DNA, 25 bp, Rattus norvegicus
gatactgaagtcttcttttcccttc

SEQ ID NO: 358824 - DNA, 25 bp, Rattus norvegicus
gatactgaatatctactttcctggg

SEQ ID NO: 358825 - DNA, 25 bp, Rattus norvegicus
gatactgaatatgtactttcctggg

SEQ ID NO: 358826 - DNA, 25 bp, Rattus norvegicus
gatactgacagtcgatacgcttaag

SEQ ID NO: 358827 - DNA, 25 bp, Rattus norvegicus
gatactgacagtggatacgcttaag

SEQ ID NO: 358828 - DNA, 25 bp, Rattus norvegicus
gatactgactctagtacattgacac

SEQ ID NO: 358829 - DNA, 25 bp, Rattus norvegicus
gatactgactcttgtacattgacac

SEQ ID NO: 358830 - DNA, 25 bp, Rattus norvegicus
gatactgagcttattcctatgattg

SEQ ID NO: 358831 - DNA, 25 bp, Rattus norvegicus
gatactgagctttttcctatgattg

SEQ ID NO: 358832 - DNA, 25 bp, Rattus norvegicus
gatactgaggccaagccggagtcat

SEQ ID NO: 358833 - DNA, 25 bp, Rattus norvegicus
gatactgaggcctagccggagtcat

SEQ ID NO: 358834 - DNA, 25 bp, Rattus norvegicus
gatactgatacccttcattaccaag

SEQ ID NO: 358835 - DNA, 25 bp, Rattus norvegicus
gatactgataccgttcattaccaag

SEQ ID NO: 358836 - DNA, 25 bp, Rattus norvegicus
gatactgatattatcctatgccgga

SEQ ID NO: 358837 - DNA, 25 bp, Rattus norvegicus
gatactgatattttcctatgccgga

SEQ ID NO: 358838 - DNA, 25 bp, Rattus norvegicus
gatactgcaacacgtggccgatggc

SEQ ID NO: 358839 - DNA, 25 bp, Rattus norvegicus
gatactgcaacaggtggccgatggc

SEQ ID NO: 358840 - DNA, 25 bp, Rattus norvegicus
gatactgcaaccacctcaaatatta

SEQ ID NO: 358841 - DNA, 25 bp, Rattus norvegicus
gatactgcaacctcctcaaatatta

SEQ ID NO: 358842 - DNA, 25 bp, Rattus norvegicus
gatactgcactaaaaatcttccttt

SEQ ID NO: 358843 - DNA, 25 bp, Rattus norvegicus
gatactgcactataaatcttccttt

SEQ ID NO: 358844 - DNA, 25 bp, Rattus norvegicus
gatactgcacttaatcaactgctat

SEQ ID NO: 358845 - DNA, 25 bp, Rattus norvegicus
gatactgcactttatcaactgctat

SEQ ID NO: 358846 - DNA, 25 bp, Rattus norvegicus
gatactgcagacctcaagtttctag

SEQ ID NO: 358847 - DNA, 25 bp, Rattus norvegicus
gatactgcagacgtcaagtttctag

SEQ ID NO: 358848 - DNA, 25 bp, Rattus norvegicus
gatactgcagcgatcacaagcccaa

SEQ ID NO: 358849 - DNA, 25 bp, Rattus norvegicus
gatactgcagcgttcacaagcccaa

SEQ ID NO: 358850 - DNA, 25 bp, Rattus norvegicus
gatactgcatgaagtgaaccatggt

SEQ ID NO: 358851 - DNA, 25 bp, Rattus norvegicus
gatactgcatgatgtgaaccatggt

SEQ ID NO: 358852 - DNA, 25 bp, Rattus norvegicus
gatactgccctgaaaactgtgcttt

SEQ ID NO: 358853 - DNA, 25 bp, Rattus norvegicus
gatactgccctgtaaactgtgcttt

SEQ ID NO: 358854 - DNA, 25 bp, Rattus norvegicus
gatactgccgcaccaaccatgaagt

SEQ ID NO: 358855 - DNA, 25 bp, Rattus norvegicus
gatactgccgcagcaaccatgaagt

SEQ ID NO: 358856 - DNA, 25 bp, Rattus norvegicus
gatactgcctaacaggagccctgaa

SEQ ID NO: 358857 - DNA, 25 bp, Rattus norvegicus
gatactgcctaagaggagccctgaa

SEQ ID NO: 358858 - DNA, 25 bp, Rattus norvegicus
gatactgcgaatcgccgctgctccg

SEQ ID NO: 358859 - DNA, 25 bp, Rattus norvegicus
gatactgcgaatggccgctgctccg

SEQ ID NO: 358860 - DNA, 25 bp, Rattus norvegicus
gatactgcggtgatgaacttccaga

SEQ ID NO: 358861 - DNA, 25 bp, Rattus norvegicus
gatactgcggtgttgaacttccaga

SEQ ID NO: 358862 - DNA, 25 bp, Rattus norvegicus
gatactgctgatccaatatgcgctc

SEQ ID NO: 358863 - DNA, 25 bp, Rattus norvegicus
gatactgctgatgcaatatgcgctc

SEQ ID NO: 358864 - DNA, 25 bp, Rattus norvegicus
gatactggacacagcctggaggaat

SEQ ID NO: 358865 - DNA, 25 bp, Rattus norvegicus
gatactggacactgcctggaggaat

SEQ ID NO: 358866 - DNA, 25 bp, Rattus norvegicus
gatactggatgcaaacttgatacta

SEQ ID NO: 358867 - DNA, 25 bp, Rattus norvegicus
gatactggatgctaacttgatacta

SEQ ID NO: 358868 - DNA, 25 bp, Rattus norvegicus
gatactggcagtctcagaaggcccc

SEQ ID NO: 358869 - DNA, 25 bp, Rattus norvegicus
gatactggcagtgtcagaaggcccc

SEQ ID NO: 358870 - DNA, 25 bp, Rattus norvegicus
gatactggctatcactaggtgctga

SEQ ID NO: 358871 - DNA, 25 bp, Rattus norvegicus
gatactggctatgactaggtgctga

SEQ ID NO: 358872 - DNA, 25 bp, Rattus norvegicus
gatactgggatcctggtcctgcttg

SEQ ID NO: 358873 - DNA, 25 bp, Rattus norvegicus
gatactgggatcgtggtcctgcttg

SEQ ID NO: 358874 - DNA, 25 bp, Rattus norvegicus
gatactggtcccagagtacagcctg

SEQ ID NO: 358875 - DNA, 25 bp, Rattus norvegicus
gatactggtccctgagtacagcctg

SEQ ID NO: 358876 - DNA, 25 bp, Rattus norvegicus
gatactggtcctcaagtctaccaaa

SEQ ID NO: 358877 - DNA, 25 bp, Rattus norvegicus
gatactggtcctgaagtctaccaaa

SEQ ID NO: 358878 - DNA, 25 bp, Rattus norvegicus
gatactggtgagaccagccagactt

SEQ ID NO: 358879 - DNA, 25 bp, Rattus norvegicus
gatactggtgagtccagccagactt

SEQ ID NO: 358880 - DNA, 25 bp, Rattus norvegicus
gatactggtgtcacttctggtggga

SEQ ID NO: 358881 - DNA, 25 bp, Rattus norvegicus
gatactggtgtctcttctggtggga

SEQ ID NO: 358882 - DNA, 25 bp, Rattus norvegicus
gatactggtgttctccaaatctctt

SEQ ID NO: 358883 - DNA, 25 bp, Rattus norvegicus
gatactggtgttgtccaaatctctt

SEQ ID NO: 358884 - DNA, 25 bp, Rattus norvegicus
gatactggttacacttcagactccc

SEQ ID NO: 358885 - DNA, 25 bp, Rattus norvegicus
gatactggttacattgccaccactt

SEQ ID NO: 358886 - DNA, 25 bp, Rattus norvegicus
gatactggttactcttcagactccc

SEQ ID NO: 358887 - DNA, 25 bp, Rattus norvegicus
gatactggttactttgccaccactt

SEQ ID NO: 358888 - DNA, 25 bp, Rattus norvegicus
gatactggttcgaaataccctcttg

SEQ ID NO: 358889 - DNA, 25 bp, Rattus norvegicus
gatactggttcgtaataccctcttg

SEQ ID NO: 358890 - DNA, 25 bp, Rattus norvegicus
gatactggttggacacttagccatt

SEQ ID NO: 358891 - DNA, 25 bp, Rattus norvegicus
gatactggttggtcacttagccatt

SEQ ID NO: 358892 - DNA, 25 bp, Rattus norvegicus
gatactgtaaacaccttccctttct

SEQ ID NO: 358893 - DNA, 25 bp, Rattus norvegicus
gatactgtaaactccttccctttct

SEQ ID NO: 358894 - DNA, 25 bp, Rattus norvegicus
gatactgtaattctatttttagcca

SEQ ID NO: 358895 - DNA, 25 bp, Rattus norvegicus
gatactgtaattgtatttttagcca

SEQ ID NO: 358896 - DNA, 25 bp, Rattus norvegicus
gatactgtacagaaagttcctcaga

SEQ ID NO: 358897 - DNA, 25 bp, Rattus norvegicus
gatactgtacagtaagttcctcaga

SEQ ID NO: 358898 - DNA, 25 bp, Rattus norvegicus
gatactgtacatacctagtgctatt

SEQ ID NO: 358899 - DNA, 25 bp, Rattus norvegicus
gatactgtacattcctagtgctatt

SEQ ID NO: 358900 - DNA, 25 bp, Rattus norvegicus
gatactgtactaagctctggtgcca

SEQ ID NO: 358901 - DNA, 25 bp, Rattus norvegicus
gatactgtactatgctctggtgcca

SEQ ID NO: 358902 - DNA, 25 bp, Rattus norvegicus
gatactgtagccacaactattaaat

SEQ ID NO: 358903 - DNA, 25 bp, Rattus norvegicus
gatactgtagcctcaactattaaat

SEQ ID NO: 358904 - DNA, 25 bp, Rattus norvegicus
gatactgtagtcagtgaatgctcaa

SEQ ID NO: 358905 - DNA, 25 bp, Rattus norvegicus
gatactgtagtctgtgaatgctcaa

SEQ ID NO: 358906 - DNA, 25 bp, Rattus norvegicus
gatactgtatatactaccatggtgc

SEQ ID NO: 358907 - DNA, 25 bp, Rattus norvegicus
gatactgtatattctaccatggtgc

SEQ ID NO: 358908 - DNA, 25 bp, Rattus norvegicus
gatactgtatcccacccagagaaga

SEQ ID NO: 358909 - DNA, 25 bp, Rattus norvegicus
gatactgtatccgacccagagaaga

SEQ ID NO: 358910 - DNA, 25 bp, Rattus norvegicus
gatactgtcactaagtcctcattgc

SEQ ID NO: 358911 - DNA, 25 bp, Rattus norvegicus
gatactgtcacttagtcctcattgc

SEQ ID NO: 358912 - DNA, 25 bp, Rattus norvegicus
gatactgtcattaactgttgccaga

SEQ ID NO: 358913 - DNA, 25 bp, Rattus norvegicus
gatactgtcatttactgttgccaga

SEQ ID NO: 358914 - DNA, 25 bp, Rattus norvegicus
gatactgtccctctctgaattttca

SEQ ID NO: 358915 - DNA, 25 bp, Rattus norvegicus
gatactgtccctgtctgaattttca

SEQ ID NO: 358916 - DNA, 25 bp, Rattus norvegicus
gatactgtcctgcttgcctggaatc

SEQ ID NO: 358917 - DNA, 25 bp, Rattus norvegicus
gatactgtcctggttgcctggaatc

SEQ ID NO: 358918 - DNA, 25 bp, Rattus norvegicus
gatactgtcgtgatcaggtcactca

SEQ ID NO: 358919 - DNA, 25 bp, Rattus norvegicus
gatactgtcgtgttcaggtcactca

SEQ ID NO: 358920 - DNA, 25 bp, Rattus norvegicus
gatactgtctcaaaggagttgtact

SEQ ID NO: 358921 - DNA, 25 bp, Rattus norvegicus
gatactgtctcataggagttgtact

SEQ ID NO: 358922 - DNA, 25 bp, Rattus norvegicus
gatactgtgaatatctttcatgcag

SEQ ID NO: 358923 - DNA, 25 bp, Rattus norvegicus
gatactgtgaatttctttcatgcag

SEQ ID NO: 358924 - DNA, 25 bp, Rattus norvegicus
gatactgtgacaagttcccttgatt

SEQ ID NO: 358925 - DNA, 25 bp, Rattus norvegicus
gatactgtgacatgttcccttgatt

SEQ ID NO: 358926 - DNA, 25 bp, Rattus norvegicus
gatactgtgaccacgacggaggcac

SEQ ID NO: 358927 - DNA, 25 bp, Rattus norvegicus
gatactgtgacctcgacggaggcac

SEQ ID NO: 358928 - DNA, 25 bp, Rattus norvegicus
gatactgtgataaggtgcggctgca

SEQ ID NO: 358929 - DNA, 25 bp, Rattus norvegicus
gatactgtgatatggtgcggctgca

SEQ ID NO: 358930 - DNA, 25 bp, Rattus norvegicus
gatactgtgctaaaggcaacatctc

SEQ ID NO: 358931 - DNA, 25 bp, Rattus norvegicus
gatactgtgctataggcaacatctc

SEQ ID NO: 358932 - DNA, 25 bp, Rattus norvegicus
gatactgtggtaagcttccttagac

SEQ ID NO: 358933 - DNA, 25 bp, Rattus norvegicus
gatactgtggtatgcttccttagac

SEQ ID NO: 358934 - DNA, 25 bp, Rattus norvegicus
gatactgtgtctattctcatgagga

SEQ ID NO: 358935 - DNA, 25 bp, Rattus norvegicus
gatactgtgtcttttctcatgagga

SEQ ID NO: 358936 - DNA, 25 bp, Rattus norvegicus
gatactgtgtttcaaactgggcaaa

SEQ ID NO: 358937 - DNA, 25 bp, Rattus norvegicus
gatactgtgtttgaaactgggcaaa

SEQ ID NO: 358938 - DNA, 25 bp, Rattus norvegicus
gatactgttcataaaccattccctt

SEQ ID NO: 358939 - DNA, 25 bp, Rattus norvegicus
gatactgttcattaaccattccctt

SEQ ID NO: 358940 - DNA, 25 bp, Rattus norvegicus
gatactgttccaaattgctttcgac

SEQ ID NO: 358941 - DNA, 25 bp, Rattus norvegicus
gatactgttccatattgctttcgac

SEQ ID NO: 358942 - DNA, 25 bp, Rattus norvegicus
gatactgttcttaaagcaccttgac

SEQ ID NO: 358943 - DNA, 25 bp, Rattus norvegicus
gatactgttctttaagcaccttgac

SEQ ID NO: 358944 - DNA, 25 bp, Rattus norvegicus
gatactgttgacattataccccgaa

SEQ ID NO: 358945 - DNA, 25 bp, Rattus norvegicus
gatactgttgactttataccccgaa

SEQ ID NO: 358946 - DNA, 25 bp, Rattus norvegicus
gatactgttgcaattgcttggataa

SEQ ID NO: 358947 - DNA, 25 bp, Rattus norvegicus
gatactgttgcatttgcttggataa

SEQ ID NO: 358948 - DNA, 25 bp, Rattus norvegicus
gatactgttggaagagcccctgcat

SEQ ID NO: 358949 - DNA, 25 bp, Rattus norvegicus
gatactgttggatgagcccctgcat

SEQ ID NO: 358950 - DNA, 25 bp, Rattus norvegicus
gatactgttggtagaactatgctga

SEQ ID NO: 358951 - DNA, 25 bp, Rattus norvegicus
gatactgttggttgaactatgctga

SEQ ID NO: 358952 - DNA, 25 bp, Rattus norvegicus
gatactgtttgtacctgtgtcatct

SEQ ID NO: 358953 - DNA, 25 bp, Rattus norvegicus
gatactgtttgttcctgtgtcatct

SEQ ID NO: 358954 - DNA, 25 bp, Rattus norvegicus
gatacttacactaaaccactggctc

SEQ ID NO: 358955 - DNA, 25 bp, Rattus norvegicus
gatacttacacttaaccactggctc

SEQ ID NO: 358956 - DNA, 25 bp, Rattus norvegicus
gatacttaccacagcgtgtgacgct

SEQ ID NO: 358957 - DNA, 25 bp, Rattus norvegicus
gatacttaccactgcgtgtgacgct

SEQ ID NO: 358958 - DNA, 25 bp, Rattus norvegicus
gatacttactgtatcaccctgttca

SEQ ID NO: 358959 - DNA, 25 bp, Rattus norvegicus
gatacttactgtttcaccctgttca

SEQ ID NO: 358960 - DNA, 25 bp, Rattus norvegicus
gatacttacttgctcactcatttac

SEQ ID NO: 358961 - DNA, 25 bp, Rattus norvegicus
gatacttacttggtcactcatttac

SEQ ID NO: 358962 - DNA, 25 bp, Rattus norvegicus
gatacttagattatgttgcttttac

SEQ ID NO: 358963 - DNA, 25 bp, Rattus norvegicus
gatacttagattttgttgcttttac

SEQ ID NO: 358964 - DNA, 25 bp, Rattus norvegicus
gatacttatgaaatcactcctctca

SEQ ID NO: 358965 - DNA, 25 bp, Rattus norvegicus
gatacttatgaattcactcctctca

SEQ ID NO: 358966 - DNA, 25 bp, Rattus norvegicus
gatacttcaaagagtgtccgctctc

SEQ ID NO: 358967 - DNA, 25 bp, Rattus norvegicus
gatacttcaaagtgtgtccgctctc

SEQ ID NO: 358968 - DNA, 25 bp, Rattus norvegicus
gatacttcacagctctcagttttat

SEQ ID NO: 358969 - DNA, 25 bp, Rattus norvegicus
gatacttcacaggtctcagttttat

SEQ ID NO: 358970 - DNA, 25 bp, Rattus norvegicus
gatacttcactgcagttcctacagg

SEQ ID NO: 358971 - DNA, 25 bp, Rattus norvegicus
gatacttcactggagttcctacagg

SEQ ID NO: 358972 - DNA, 25 bp, Rattus norvegicus
gatacttcagaacgcgctcgtggga

SEQ ID NO: 358973 - DNA, 25 bp, Rattus norvegicus
gatacttcagaaggcgctcgtggga

SEQ ID NO: 358974 - DNA, 25 bp, Rattus norvegicus
gatacttcaggacttgggacctagt

SEQ ID NO: 358975 - DNA, 25 bp, Rattus norvegicus
gatacttcaggagttgggacctagt

SEQ ID NO: 358976 - DNA, 25 bp, Rattus norvegicus
gatacttcagtccagatgtccgcaa

SEQ ID NO: 358977 - DNA, 25 bp, Rattus norvegicus
gatacttcagtcgagatgtccgcaa

SEQ ID NO: 358978 - DNA, 25 bp, Rattus norvegicus
gatacttcatatccctcgtaacaag

SEQ ID NO: 358979 - DNA, 25 bp, Rattus norvegicus
gatacttcatatgcctcgtaacaag

SEQ ID NO: 358980 - DNA, 25 bp, Rattus norvegicus
gatacttcatggatgttgacttctg

SEQ ID NO: 358981 - DNA, 25 bp, Rattus norvegicus
gatacttcatggttgttgacttctg

SEQ ID NO: 358982 - DNA, 25 bp, Rattus norvegicus
gatacttcgataccgttgtgaatag

SEQ ID NO: 358983 - DNA, 25 bp, Rattus norvegicus
gatacttcgatagcgttgtgaatag

SEQ ID NO: 358984 - DNA, 25 bp, Rattus norvegicus
gatacttcgtttcgtacatttacct

SEQ ID NO: 358985 - DNA, 25 bp, Rattus norvegicus
gatacttcgtttggtacatttacct

SEQ ID NO: 358986 - DNA, 25 bp, Rattus norvegicus
gatacttctggtacgtttatgcagt

SEQ ID NO: 358987 - DNA, 25 bp, Rattus norvegicus
gatacttctggttcgtttatgcagt

SEQ ID NO: 358988 - DNA, 25 bp, Rattus norvegicus
gatacttcttgcatctcatgatgca

SEQ ID NO: 358989 - DNA, 25 bp, Rattus norvegicus
gatacttcttgcttctcatgatgca

SEQ ID NO: 358990 - DNA, 25 bp, Rattus norvegicus
gatacttctttgacttcaagttcac

SEQ ID NO: 358991 - DNA, 25 bp, Rattus norvegicus
gatacttctttgtcttcaagttcac

SEQ ID NO: 358992 - DNA, 25 bp, Rattus norvegicus
gatacttgcattccgattcgtaaca

SEQ ID NO: 358993 - DNA, 25 bp, Rattus norvegicus
gatacttgcattctctggattttgt

SEQ ID NO: 358994 - DNA, 25 bp, Rattus norvegicus
gatacttgcattgcgattcgtaaca

SEQ ID NO: 358995 - DNA, 25 bp, Rattus norvegicus
gatacttgcattgtctggattttgt

SEQ ID NO: 358996 - DNA, 25 bp, Rattus norvegicus
gatacttgctacagtccttttctta

SEQ ID NO: 358997 - DNA, 25 bp, Rattus norvegicus
gatacttgctactgtccttttctta

SEQ ID NO: 358998 - DNA, 25 bp, Rattus norvegicus
gatacttgctgccttcatgttcatg

SEQ ID NO: 358999 - DNA, 25 bp, Rattus norvegicus
gatacttgctgcgttcatgttcatg

SEQ ID NO: 359000 - DNA, 25 bp, Rattus norvegicus
gatacttggatgatccttctccgct

SEQ ID NO: 359001 - DNA, 25 bp, Rattus norvegicus
gatacttggatgttccttctccgct

SEQ ID NO: 359002 - DNA, 25 bp, Rattus norvegicus
gatactttatttactgttcttacaa

SEQ ID NO: 359003 - DNA, 25 bp, Rattus norvegicus
gatactttatttcccgaataagata

SEQ ID NO: 359004 - DNA, 25 bp, Rattus norvegicus
gatactttatttgccgaataagata

SEQ ID NO: 359005 - DNA, 25 bp, Rattus norvegicus
gatactttattttctgttcttacaa

SEQ ID NO: 359006 - DNA, 25 bp, Rattus norvegicus
gatactttcaagagcttcctgtaag

SEQ ID NO: 359007 - DNA, 25 bp, Rattus norvegicus
gatactttcaagtgcttcctgtaag

SEQ ID NO: 359008 - DNA, 25 bp, Rattus norvegicus
gatactttcaataccgagtaactgg

SEQ ID NO: 359009 - DNA, 25 bp, Rattus norvegicus
gatactttcaattccgagtaactgg

SEQ ID NO: 359010 - DNA, 25 bp, Rattus norvegicus
gatactttcatcattgggtctgttg

SEQ ID NO: 359011 - DNA, 25 bp, Rattus norvegicus
gatactttcatctttgggtctgttg

SEQ ID NO: 359012 - DNA, 25 bp, Rattus norvegicus
gatactttccatatgtctagacaca

SEQ ID NO: 359013 - DNA, 25 bp, Rattus norvegicus
gatactttccatttgtctagacaca

SEQ ID NO: 359014 - DNA, 25 bp, Rattus norvegicus
gatactttgaacatggtctcctgat

SEQ ID NO: 359015 - DNA, 25 bp, Rattus norvegicus
gatactttgaacttggtctcctgat

SEQ ID NO: 359016 - DNA, 25 bp, Rattus norvegicus
gatactttgaggaaaacatgtccca

SEQ ID NO: 359017 - DNA, 25 bp, Rattus norvegicus
gatactttgaggtaaacatgtccca

SEQ ID NO: 359018 - DNA, 25 bp, Rattus norvegicus
gatactttgattacgctgcttccta

SEQ ID NO: 359019 - DNA, 25 bp, Rattus norvegicus
gatactttgatttcgctgcttccta

SEQ ID NO: 359020 - DNA, 25 bp, Rattus norvegicus
gatactttgccaacatgctttagac

SEQ ID NO: 359021 - DNA, 25 bp, Rattus norvegicus
gatactttgccatcatgctttagac

SEQ ID NO: 359022 - DNA, 25 bp, Rattus norvegicus
gatactttgcctattcttaaaactg

SEQ ID NO: 359023 - DNA, 25 bp, Rattus norvegicus
gatactttgccttttcttaaaactg

SEQ ID NO: 359024 - DNA, 25 bp, Rattus norvegicus
gatactttggtaaacagctgtcttt

SEQ ID NO: 359025 - DNA, 25 bp, Rattus norvegicus
gatactttggtatacagctgtcttt

SEQ ID NO: 359026 - DNA, 25 bp, Rattus norvegicus
gatactttggtgaaacttctcaata

SEQ ID NO: 359027 - DNA, 25 bp, Rattus norvegicus
gatactttggtgtaacttctcaata

SEQ ID NO: 359028 - DNA, 25 bp, Rattus norvegicus
gatactttgtaccaagaccgcctat

SEQ ID NO: 359029 - DNA, 25 bp, Rattus norvegicus
gatactttgtacgaagaccgcctat

SEQ ID NO: 359030 - DNA, 25 bp, Rattus norvegicus
gatactttgtccagggtaccgtggc

SEQ ID NO: 359031 - DNA, 25 bp, Rattus norvegicus
gatactttgtcctgggtaccgtggc

SEQ ID NO: 359032 - DNA, 25 bp, Rattus norvegicus
gatactttgttgaaacaggcccaga

SEQ ID NO: 359033 - DNA, 25 bp, Rattus norvegicus
gatactttgttgtaacaggcccaga

SEQ ID NO: 359034 - DNA, 25 bp, Rattus norvegicus
gatactttgtttatacattccaact

SEQ ID NO: 359035 - DNA, 25 bp, Rattus norvegicus
gatactttgtttttacattccaact

SEQ ID NO: 359036 - DNA, 25 bp, Rattus norvegicus
gatacttttctgaatccaatcctat

SEQ ID NO: 359037 - DNA, 25 bp, Rattus norvegicus
gatacttttctgtatccaatcctat

SEQ ID NO: 359038 - DNA, 25 bp, Rattus norvegicus
gatactttttataattattccattg

SEQ ID NO: 359039 - DNA, 25 bp, Rattus norvegicus
gatactttttattattattccattg

SEQ ID NO: 359040 - DNA, 25 bp, Rattus norvegicus
gatactttttctccttagtgcacag

SEQ ID NO: 359041 - DNA, 25 bp, Rattus norvegicus
gatactttttctgcttagtgcacag

SEQ ID NO: 359042 - DNA, 25 bp, Rattus norvegicus
gatagaaaccagacctaagagacaa

SEQ ID NO: 359043 - DNA, 25 bp, Rattus norvegicus
gatagaaaccagtcctaagagacaa

SEQ ID NO: 359044 - DNA, 25 bp, Rattus norvegicus
gatagaaactagaagggccccaggg

SEQ ID NO: 359045 - DNA, 25 bp, Rattus norvegicus
gatagaaactagtagggccccaggg

SEQ ID NO: 359046 - DNA, 25 bp, Rattus norvegicus
gatagaaactgtctctctcatcact

SEQ ID NO: 359047 - DNA, 25 bp, Rattus norvegicus
gatagaaactgtgtctctcatcact

SEQ ID NO: 359048 - DNA, 25 bp, Rattus norvegicus
gatagaaacttgatgctctgggaaa

SEQ ID NO: 359049 - DNA, 25 bp, Rattus norvegicus
gatagaaacttgttgctctgggaaa

SEQ ID NO: 359050 - DNA, 25 bp, Rattus norvegicus
gatagaaagcccacaggccgggcat

SEQ ID NO: 359051 - DNA, 25 bp, Rattus norvegicus
gatagaaagccctcaggccgggcat

SEQ ID NO: 359052 - DNA, 25 bp, Rattus norvegicus
gatagaaaggatcctccgcctcagc

SEQ ID NO: 359053 - DNA, 25 bp, Rattus norvegicus
gatagaaaggatgctccgcctcagc

SEQ ID NO: 359054 - DNA, 25 bp, Rattus norvegicus
gatagaaaggttatagagctacatt

SEQ ID NO: 359055 - DNA, 25 bp, Rattus norvegicus
gatagaaaggttttagagctacatt

SEQ ID NO: 359056 - DNA, 25 bp, Rattus norvegicus
gatagaacattccagacagacgcag

SEQ ID NO: 359057 - DNA, 25 bp, Rattus norvegicus
gatagaacattcgagacagacgcag

SEQ ID NO: 359058 - DNA, 25 bp, Rattus norvegicus
gatagaaccgccacagggtacctga

SEQ ID NO: 359059 - DNA, 25 bp, Rattus norvegicus
gatagaaccgcctcagggtacctga

SEQ ID NO: 359060 - DNA, 25 bp, Rattus norvegicus
gatagaacctaacgccctgtggatg

SEQ ID NO: 359061 - DNA, 25 bp, Rattus norvegicus
gatagaacctaaggccctgtggatg

SEQ ID NO: 359062 - DNA, 25 bp, Rattus norvegicus
gatagaacgcttctcaggtgagcct

SEQ ID NO: 359063 - DNA, 25 bp, Rattus norvegicus
gatagaacgcttgtcaggtgagcct

SEQ ID NO: 359064 - DNA, 25 bp, Rattus norvegicus
gatagaactatacggctgcagattt

SEQ ID NO: 359065 - DNA, 25 bp, Rattus norvegicus
gatagaactatagggctgcagattt

SEQ ID NO: 359066 - DNA, 25 bp, Rattus norvegicus
gatagaactggcactcgaaataggt

SEQ ID NO: 359067 - DNA, 25 bp, Rattus norvegicus
gatagaactggctctcgaaataggt

SEQ ID NO: 359068 - DNA, 25 bp, Rattus norvegicus
gatagaactttaatttccggtagat

SEQ ID NO: 359069 - DNA, 25 bp, Rattus norvegicus
gatagaactttattttccggtagat

SEQ ID NO: 359070 - DNA, 25 bp, Rattus norvegicus
gatagaagaagtaaggccttgatct

SEQ ID NO: 359071 - DNA, 25 bp, Rattus norvegicus
gatagaagaagttaggccttgatct

SEQ ID NO: 359072 - DNA, 25 bp, Rattus norvegicus
gatagaagacccaagaaactaccca

SEQ ID NO: 359073 - DNA, 25 bp, Rattus norvegicus
gatagaagaccctagaaactaccca

SEQ ID NO: 359074 - DNA, 25 bp, Rattus norvegicus
gatagaagcatgaagatttctgagt

SEQ ID NO: 359075 - DNA, 25 bp, Rattus norvegicus
gatagaagcatgtagatttctgagt

SEQ ID NO: 359076 - DNA, 25 bp, Rattus norvegicus
gatagaagcgtcattaaccaccctc

SEQ ID NO: 359077 - DNA, 25 bp, Rattus norvegicus
gatagaagcgtctttaaccaccctc

SEQ ID NO: 359078 - DNA, 25 bp, Rattus norvegicus
gatagaatcagtatgctttaggcag

SEQ ID NO: 359079 - DNA, 25 bp, Rattus norvegicus
gatagaatcagtttgctttaggcag

SEQ ID NO: 359080 - DNA, 25 bp, Rattus norvegicus
gatagaatgcgcacatgggatcggt

SEQ ID NO: 359081 - DNA, 25 bp, Rattus norvegicus
gatagaatgcgctcatgggatcggt

SEQ ID NO: 359082 - DNA, 25 bp, Rattus norvegicus
gatagaatgtctccctagcacctgg

SEQ ID NO: 359083 - DNA, 25 bp, Rattus norvegicus
gatagaatgtctgcctagcacctgg

SEQ ID NO: 359084 - DNA, 25 bp, Rattus norvegicus
gatagaatgttaatggtttaccaga

SEQ ID NO: 359085 - DNA, 25 bp, Rattus norvegicus
gatagaatgttattggtttaccaga

SEQ ID NO: 359086 - DNA, 25 bp, Rattus norvegicus
gatagaattcgcatcaccctgagta

SEQ ID NO: 359087 - DNA, 25 bp, Rattus norvegicus
gatagaattcgcttcaccctgagta

SEQ ID NO: 359088 - DNA, 25 bp, Rattus norvegicus
gatagacaacctcaaccaaagccat

SEQ ID NO: 359089 - DNA, 25 bp, Rattus norvegicus
gatagacaacctgaaccaaagccat

SEQ ID NO: 359090 - DNA, 25 bp, Rattus norvegicus
gatagacacatcacctcgaataaat

SEQ ID NO: 359091 - DNA, 25 bp, Rattus norvegicus
gatagacacatctcctcgaataaat

SEQ ID NO: 359092 - DNA, 25 bp, Rattus norvegicus
gatagacaccatcatcgcatagcta

SEQ ID NO: 359093 - DNA, 25 bp, Rattus norvegicus
gatagacaccatgatcgcatagcta

SEQ ID NO: 359094 - DNA, 25 bp, Rattus norvegicus
gatagacacgccagtgggtcctagg

SEQ ID NO: 359095 - DNA, 25 bp, Rattus norvegicus
gatagacacgcctgtgggtcctagg

SEQ ID NO: 359096 - DNA, 25 bp, Rattus norvegicus
gatagacagttccagctctgctaag

SEQ ID NO: 359097 - DNA, 25 bp, Rattus norvegicus
gatagacagttcgagctctgctaag

SEQ ID NO: 359098 - DNA, 25 bp, Rattus norvegicus
gatagacatccaaggtccactgcgt

SEQ ID NO: 359099 - DNA, 25 bp, Rattus norvegicus
gatagacatccatggtccactgcgt

SEQ ID NO: 359100 - DNA, 25 bp, Rattus norvegicus
gatagacatgacagacttttagctg

SEQ ID NO: 359101 - DNA, 25 bp, Rattus norvegicus
gatagacatgactgacttttagctg

SEQ ID NO: 359102 - DNA, 25 bp, Rattus norvegicus
gatagaccaatgctaccaactagag

SEQ ID NO: 359103 - DNA, 25 bp, Rattus norvegicus
gatagaccaatggtaccaactagag

SEQ ID NO: 359104 - DNA, 25 bp, Rattus norvegicus
gatagacccacgctcacagagactc

SEQ ID NO: 359105 - DNA, 25 bp, Rattus norvegicus
gatagacccacggtcacagagactc

SEQ ID NO: 359106 - DNA, 25 bp, Rattus norvegicus
gatagacgagtccagcttagacact

SEQ ID NO: 359107 - DNA, 25 bp, Rattus norvegicus
gatagacgagtcgagcttagacact

SEQ ID NO: 359108 - DNA, 25 bp, Rattus norvegicus
gatagacgataacttctttcttctt

SEQ ID NO: 359109 - DNA, 25 bp, Rattus norvegicus
gatagacgataagttctttcttctt

SEQ ID NO: 359110 - DNA, 25 bp, Rattus norvegicus
gatagacgccaccacaaggctgtgt

SEQ ID NO: 359111 - DNA, 25 bp, Rattus norvegicus
gatagacgccacgacaaggctgtgt

SEQ ID NO: 359112 - DNA, 25 bp, Rattus norvegicus
gatagacgcgtcactttcaaatgag

SEQ ID NO: 359113 - DNA, 25 bp, Rattus norvegicus
gatagacgcgtctctttcaaatgag

SEQ ID NO: 359114 - DNA, 25 bp, Rattus norvegicus
gatagacggaatcccagaaaccctt

SEQ ID NO: 359115 - DNA, 25 bp, Rattus norvegicus
gatagacggaatgccagaaaccctt

SEQ ID NO: 359116 - DNA, 25 bp, Rattus norvegicus
gatagacgtgctcttgggaacaccc

SEQ ID NO: 359117 - DNA, 25 bp, Rattus norvegicus
gatagacgtgctgttgggaacaccc

SEQ ID NO: 359118 - DNA, 25 bp, Rattus norvegicus
gatagactatttagaagaatggatt

SEQ ID NO: 359119 - DNA, 25 bp, Rattus norvegicus
gatagactattttgaagaatggatt

SEQ ID NO: 359120 - DNA, 25 bp, Rattus norvegicus
gatagactgattaagggacttcctg

SEQ ID NO: 359121 - DNA, 25 bp, Rattus norvegicus
gatagactgatttagggacttcctg

SEQ ID NO: 359122 - DNA, 25 bp, Rattus norvegicus
gatagactggaactctgtgccatgt

SEQ ID NO: 359123 - DNA, 25 bp, Rattus norvegicus
gatagactggaagtctgtgccatgt

SEQ ID NO: 359124 - DNA, 25 bp, Rattus norvegicus
gatagactgggaagtgcaattcaaa

SEQ ID NO: 359125 - DNA, 25 bp, Rattus norvegicus
gatagactgggatgtgcaattcaaa

SEQ ID NO: 359126 - DNA, 25 bp, Rattus norvegicus
gatagactggtcatccaagtaccca

SEQ ID NO: 359127 - DNA, 25 bp, Rattus norvegicus
gatagactggtcttccaagtaccca

SEQ ID NO: 359128 - DNA, 25 bp, Rattus norvegicus
gatagactgtgcacaatttctgcca

SEQ ID NO: 359129 - DNA, 25 bp, Rattus norvegicus
gatagactgtgctcaatttctgcca

SEQ ID NO: 359130 - DNA, 25 bp, Rattus norvegicus
gatagacttcccagaactagggctt

SEQ ID NO: 359131 - DNA, 25 bp, Rattus norvegicus
gatagacttccctgaactagggctt

SEQ ID NO: 359132 - DNA, 25 bp, Rattus norvegicus
gatagacttgttattatataccaga

SEQ ID NO: 359133 - DNA, 25 bp, Rattus norvegicus
gatagacttgtttttatataccaga

SEQ ID NO: 359134 - DNA, 25 bp, Rattus norvegicus
gatagagaacctcatgagccctgca

SEQ ID NO: 359135 - DNA, 25 bp, Rattus norvegicus
gatagagaacctgatgagccctgca

SEQ ID NO: 359136 - DNA, 25 bp, Rattus norvegicus
gatagagaatctcaggcctgcctca

SEQ ID NO: 359137 - DNA, 25 bp, Rattus norvegicus
gatagagaatctgaggcctgcctca

SEQ ID NO: 359138 - DNA, 25 bp, Rattus norvegicus
gatagagaattcctcagatgcatat

SEQ ID NO: 359139 - DNA, 25 bp, Rattus norvegicus
gatagagaattcgtcagatgcatat

SEQ ID NO: 359140 - DNA, 25 bp, Rattus norvegicus
gatagagatgttatcccctatcccc

SEQ ID NO: 359141 - DNA, 25 bp, Rattus norvegicus
gatagagatgttttcccctatcccc

SEQ ID NO: 359142 - DNA, 25 bp, Rattus norvegicus
gatagagcaagacctcctcaggatg

SEQ ID NO: 359143 - DNA, 25 bp, Rattus norvegicus
gatagagcaagagctcctcaggatg

SEQ ID NO: 359144 - DNA, 25 bp, Rattus norvegicus
gatagagccataactctgttagttc

SEQ ID NO: 359145 - DNA, 25 bp, Rattus norvegicus
gatagagccatatctctgttagttc

SEQ ID NO: 359146 - DNA, 25 bp, Rattus norvegicus
gatagagccctaaagcctactctaa

SEQ ID NO: 359147 - DNA, 25 bp, Rattus norvegicus
gatagagccctatagcctactctaa

SEQ ID NO: 359148 - DNA, 25 bp, Rattus norvegicus
gatagagccgtgctattttcacagt

SEQ ID NO: 359149 - DNA, 25 bp, Rattus norvegicus
gatagagccgtggtattttcacagt

SEQ ID NO: 359150 - DNA, 25 bp, Rattus norvegicus
gatagagctgtgcttcaccaaggag

SEQ ID NO: 359151 - DNA, 25 bp, Rattus norvegicus
gatagagctgtgcttgtgcttccgc

SEQ ID NO: 359152 - DNA, 25 bp, Rattus norvegicus
gatagagctgtggttcaccaaggag

SEQ ID NO: 359153 - DNA, 25 bp, Rattus norvegicus
gatagagctgtggttgtgcttccgc

SEQ ID NO: 359154 - DNA, 25 bp, Rattus norvegicus
gatagaggaaagacccagccctgga

SEQ ID NO: 359155 - DNA, 25 bp, Rattus norvegicus
gatagaggaaagtcccagccctgga

SEQ ID NO: 359156 - DNA, 25 bp, Rattus norvegicus
gatagaggacccctatgccattagc

SEQ ID NO: 359157 - DNA, 25 bp, Rattus norvegicus
gatagaggacccgtatgccattagc

SEQ ID NO: 359158 - DNA, 25 bp, Rattus norvegicus
gatagaggcgctatagccgccgctg

SEQ ID NO: 359159 - DNA, 25 bp, Rattus norvegicus
gatagaggcgctttagccgccgctg

SEQ ID NO: 359160 - DNA, 25 bp, Rattus norvegicus
gatagaggctctagactcttcagtt

SEQ ID NO: 359161 - DNA, 25 bp, Rattus norvegicus
gatagaggctcttgactcttcagtt

SEQ ID NO: 359162 - DNA, 25 bp, Rattus norvegicus
gatagaggctgaaccatatcccttt

SEQ ID NO: 359163 - DNA, 25 bp, Rattus norvegicus
gatagaggctgatccatatcccttt

SEQ ID NO: 359164 - DNA, 25 bp, Rattus norvegicus
gatagagggagcactggccactcag

SEQ ID NO: 359165 - DNA, 25 bp, Rattus norvegicus
gatagagggagctctggccactcag

SEQ ID NO: 359166 - DNA, 25 bp, Rattus norvegicus
gatagagggcatctctcccaggtga

SEQ ID NO: 359167 - DNA, 25 bp, Rattus norvegicus
gatagagggcatgtctcccaggtga

SEQ ID NO: 359168 - DNA, 25 bp, Rattus norvegicus
gatagagtacttcctgtcagagtca

SEQ ID NO: 359169 - DNA, 25 bp, Rattus norvegicus
gatagagtacttgctgtcagagtca

SEQ ID NO: 359170 - DNA, 25 bp, Rattus norvegicus
gatagagtaggcctcatagtgtcag

SEQ ID NO: 359171 - DNA, 25 bp, Rattus norvegicus
gatagagtaggcgtcatagtgtcag

SEQ ID NO: 359172 - DNA, 25 bp, Rattus norvegicus
gatagagtcaatatctggtctgtgg

SEQ ID NO: 359173 - DNA, 25 bp, Rattus norvegicus
gatagagtcaatttctggtctgtgg

SEQ ID NO: 359174 - DNA, 25 bp, Rattus norvegicus
gatagagtcagacccacgtttgctg

SEQ ID NO: 359175 - DNA, 25 bp, Rattus norvegicus
gatagagtcagagccacgtttgctg

SEQ ID NO: 359176 - DNA, 25 bp, Rattus norvegicus
gatagagtcctacgtctgcatgagt

SEQ ID NO: 359177 - DNA, 25 bp, Rattus norvegicus
gatagagtcctaggtctgcatgagt

SEQ ID NO: 359178 - DNA, 25 bp, Rattus norvegicus
gatagagtcctgattcctatgtatt

SEQ ID NO: 359179 - DNA, 25 bp, Rattus norvegicus
gatagagtcctgtttcctatgtatt

SEQ ID NO: 359180 - DNA, 25 bp, Rattus norvegicus
gatagagtgcagaccaaccttccgt

SEQ ID NO: 359181 - DNA, 25 bp, Rattus norvegicus
gatagagtgcagtccaaccttccgt

SEQ ID NO: 359182 - DNA, 25 bp, Rattus norvegicus
gatagagttctaagccactcacact

SEQ ID NO: 359183 - DNA, 25 bp, Rattus norvegicus
gatagagttctatgccactcacact

SEQ ID NO: 359184 - DNA, 25 bp, Rattus norvegicus
gatagagttcttactgctgctgaat

SEQ ID NO: 359185 - DNA, 25 bp, Rattus norvegicus
gatagagttctttctgctgctgaat

SEQ ID NO: 359186 - DNA, 25 bp, Rattus norvegicus
gatagagttgctcatcctgccctaa

SEQ ID NO: 359187 - DNA, 25 bp, Rattus norvegicus
gatagagttgctcttgatgccgtat

SEQ ID NO: 359188 - DNA, 25 bp, Rattus norvegicus
gatagagttgctgatcctgccctaa

SEQ ID NO: 359189 - DNA, 25 bp, Rattus norvegicus
gatagagttgctgttgatgccgtat

SEQ ID NO: 359190 - DNA, 25 bp, Rattus norvegicus
gatagagtttatcatcaagcagctg

SEQ ID NO: 359191 - DNA, 25 bp, Rattus norvegicus
gatagagtttatgatcaagcagctg

SEQ ID NO: 359192 - DNA, 25 bp, Rattus norvegicus
gatagagtttgtaaggtgggctttt

SEQ ID NO: 359193 - DNA, 25 bp, Rattus norvegicus
gatagagtttgttaggtgggctttt

SEQ ID NO: 359194 - DNA, 25 bp, Rattus norvegicus
gatagatagccacggcctcctggaa

SEQ ID NO: 359195 - DNA, 25 bp, Rattus norvegicus
gatagatagccagggcctcctggaa

SEQ ID NO: 359196 - DNA, 25 bp, Rattus norvegicus
gatagatagcgaatgtgacaccctt

SEQ ID NO: 359197 - DNA, 25 bp, Rattus norvegicus
gatagatagcgattgtgacaccctt

SEQ ID NO: 359198 - DNA, 25 bp, Rattus norvegicus
gatagatcacggacagttaccttgt

SEQ ID NO: 359199 - DNA, 25 bp, Rattus norvegicus
gatagatcacggtcagttaccttgt

SEQ ID NO: 359200 - DNA, 25 bp, Rattus norvegicus
gatagatcacttaggctctcagact

SEQ ID NO: 359201 - DNA, 25 bp, Rattus norvegicus
gatagatcactttggctctcagact

SEQ ID NO: 359202 - DNA, 25 bp, Rattus norvegicus
gatagatcagcaagatttcccaaga

SEQ ID NO: 359203 - DNA, 25 bp, Rattus norvegicus
gatagatcagcacagacagcctcct

SEQ ID NO: 359204 - DNA, 25 bp, Rattus norvegicus
gatagatcagcagagacagcctcct

SEQ ID NO: 359205 - DNA, 25 bp, Rattus norvegicus
gatagatcagcatgatttcccaaga

SEQ ID NO: 359206 - DNA, 25 bp, Rattus norvegicus
gatagatcatggatcagctttttaa

SEQ ID NO: 359207 - DNA, 25 bp, Rattus norvegicus
gatagatcatggttcagctttttaa

SEQ ID NO: 359208 - DNA, 25 bp, Rattus norvegicus
gatagatcccacacttttattgtct

SEQ ID NO: 359209 - DNA, 25 bp, Rattus norvegicus
gatagatcccactcttttattgtct

SEQ ID NO: 359210 - DNA, 25 bp, Rattus norvegicus
gatagatcgtccagctgtggtaccg

SEQ ID NO: 359211 - DNA, 25 bp, Rattus norvegicus
gatagatcgtcctgctgtggtaccg

SEQ ID NO: 359212 - DNA, 25 bp, Rattus norvegicus
gatagatctattagacagttataat

SEQ ID NO: 359213 - DNA, 25 bp, Rattus norvegicus
gatagatctatttgacagttataat

SEQ ID NO: 359214 - DNA, 25 bp, Rattus norvegicus
gatagatgatgaaccgtctcctgct

SEQ ID NO: 359215 - DNA, 25 bp, Rattus norvegicus
gatagatgatgatccgtctcctgct

SEQ ID NO: 359216 - DNA, 25 bp, Rattus norvegicus
gatagatgcattcagggcctagctt

SEQ ID NO: 359217 - DNA, 25 bp, Rattus norvegicus
gatagatgcattgagggcctagctt

SEQ ID NO: 359218 - DNA, 25 bp, Rattus norvegicus
gatagatgccatcacagcacctcag

SEQ ID NO: 359219 - DNA, 25 bp, Rattus norvegicus
gatagatgccatgacagcacctcag

SEQ ID NO: 359220 - DNA, 25 bp, Rattus norvegicus
gatagatgcccgcttcgggtaccgg

SEQ ID NO: 359221 - DNA, 25 bp, Rattus norvegicus
gatagatgcccggttcgggtaccgg

SEQ ID NO: 359222 - DNA, 25 bp, Rattus norvegicus
gatagatgtcctcctgacttcagag

SEQ ID NO: 359223 - DNA, 25 bp, Rattus norvegicus
gatagatgtcctgctgacttcagag

SEQ ID NO: 359224 - DNA, 25 bp, Rattus norvegicus
gatagatgtcttactcctgagatgt

SEQ ID NO: 359225 - DNA, 25 bp, Rattus norvegicus
gatagatgtctttctcctgagatgt

SEQ ID NO: 359226 - DNA, 25 bp, Rattus norvegicus
gatagatgttcccaatttcctgttt

SEQ ID NO: 359227 - DNA, 25 bp, Rattus norvegicus
gatagatgttccgaatttcctgttt

SEQ ID NO: 359228 - DNA, 25 bp, Rattus norvegicus
gatagattcagcatcctggtacacc

SEQ ID NO: 359229 - DNA, 25 bp, Rattus norvegicus
gatagattcagcttcctggtacacc

SEQ ID NO: 359230 - DNA, 25 bp, Rattus norvegicus
gatagattccagacctcagacctag

SEQ ID NO: 359231 - DNA, 25 bp, Rattus norvegicus
gatagattccagtcctcagacctag

SEQ ID NO: 359232 - DNA, 25 bp, Rattus norvegicus
gatagattctctaccaacgacttcc

SEQ ID NO: 359233 - DNA, 25 bp, Rattus norvegicus
gatagattctcttccaacgacttcc

SEQ ID NO: 359234 - DNA, 25 bp, Rattus norvegicus
gatagattgctgctgcatgctacaa

SEQ ID NO: 359235 - DNA, 25 bp, Rattus norvegicus
gatagattgctggtgcatgctacaa

SEQ ID NO: 359236 - DNA, 25 bp, Rattus norvegicus
gatagattttcacctagactttttt

SEQ ID NO: 359237 - DNA, 25 bp, Rattus norvegicus
gatagattttcagctagactttttt

SEQ ID NO: 359238 - DNA, 25 bp, Rattus norvegicus
gatagcaaaacacagacagcccctc

SEQ ID NO: 359239 - DNA, 25 bp, Rattus norvegicus
gatagcaaaacagagacagcccctc

SEQ ID NO: 359240 - DNA, 25 bp, Rattus norvegicus
gatagcaaactgatccctggtataa

SEQ ID NO: 359241 - DNA, 25 bp, Rattus norvegicus
gatagcaaactgttccctggtataa

SEQ ID NO: 359242 - DNA, 25 bp, Rattus norvegicus
gatagcaaccttccctattggcagt

SEQ ID NO: 359243 - DNA, 25 bp, Rattus norvegicus
gatagcaaccttgcctattggcagt

SEQ ID NO: 359244 - DNA, 25 bp, Rattus norvegicus
gatagcaacgggaccttctgaactc

SEQ ID NO: 359245 - DNA, 25 bp, Rattus norvegicus
gatagcaacgggtccttctgaactc

SEQ ID NO: 359246 - DNA, 25 bp, Rattus norvegicus
gatagcaagagaagaggcttccttc

SEQ ID NO: 359247 - DNA, 25 bp, Rattus norvegicus
gatagcaagagatgaggcttccttc

SEQ ID NO: 359248 - DNA, 25 bp, Rattus norvegicus
gatagcaagataccctgaacagact

SEQ ID NO: 359249 - DNA, 25 bp, Rattus norvegicus
gatagcaagatagcctgaacagact

SEQ ID NO: 359250 - DNA, 25 bp, Rattus norvegicus
gatagcaagtccaccaaaactcctg

SEQ ID NO: 359251 - DNA, 25 bp, Rattus norvegicus
gatagcaagtcctccaaaactcctg

SEQ ID NO: 359252 - DNA, 25 bp, Rattus norvegicus
gatagcaatcaaagccgaaattcct

SEQ ID NO: 359253 - DNA, 25 bp, Rattus norvegicus
gatagcaatcaatgccgaaattcct

SEQ ID NO: 359254 - DNA, 25 bp, Rattus norvegicus
gatagcaatttgacttttgacccaa

SEQ ID NO: 359255 - DNA, 25 bp, Rattus norvegicus
gatagcaatttgtcttttgacccaa

SEQ ID NO: 359256 - DNA, 25 bp, Rattus norvegicus
gatagcacacctctgaaatggcagt

SEQ ID NO: 359257 - DNA, 25 bp, Rattus norvegicus
gatagcacacctgtgaaatggcagt

SEQ ID NO: 359258 - DNA, 25 bp, Rattus norvegicus
gatagcacaggtatgtaaccctcct

SEQ ID NO: 359259 - DNA, 25 bp, Rattus norvegicus
gatagcacaggtttgtaaccctcct

SEQ ID NO: 359260 - DNA, 25 bp, Rattus norvegicus
gatagcacatggaagcctaggccgt

SEQ ID NO: 359261 - DNA, 25 bp, Rattus norvegicus
gatagcacatggagcggacttacca

SEQ ID NO: 359262 - DNA, 25 bp, Rattus norvegicus
gatagcacatggtagcctaggccgt

SEQ ID NO: 359263 - DNA, 25 bp, Rattus norvegicus
gatagcacatggtgcggacttacca

SEQ ID NO: 359264 - DNA, 25 bp, Rattus norvegicus
gatagcaccctgcattagagctttc

SEQ ID NO: 359265 - DNA, 25 bp, Rattus norvegicus
gatagcaccctggattagagctttc

SEQ ID NO: 359266 - DNA, 25 bp, Rattus norvegicus
gatagcacctatatttagaccacgt

SEQ ID NO: 359267 - DNA, 25 bp, Rattus norvegicus
gatagcacctatttttagaccacgt

SEQ ID NO: 359268 - DNA, 25 bp, Rattus norvegicus
gatagcacttgacttggtttgcccc

SEQ ID NO: 359269 - DNA, 25 bp, Rattus norvegicus
gatagcacttgagttggtttgcccc

SEQ ID NO: 359270 - DNA, 25 bp, Rattus norvegicus
gatagcagagctacagacccttttg

SEQ ID NO: 359271 - DNA, 25 bp, Rattus norvegicus
gatagcagagcttcagacccttttg

SEQ ID NO: 359272 - DNA, 25 bp, Rattus norvegicus
gatagcagatgccttaccaaagccc

SEQ ID NO: 359273 - DNA, 25 bp, Rattus norvegicus
gatagcagatgcgttaccaaagccc

SEQ ID NO: 359274 - DNA, 25 bp, Rattus norvegicus
gatagcagccttcttggcagagact

SEQ ID NO: 359275 - DNA, 25 bp, Rattus norvegicus
gatagcagccttgttggcagagact

SEQ ID NO: 359276 - DNA, 25 bp, Rattus norvegicus
gatagcagtagcacagatttttggg

SEQ ID NO: 359277 - DNA, 25 bp, Rattus norvegicus
gatagcagtagctcagatttttggg

SEQ ID NO: 359278 - DNA, 25 bp, Rattus norvegicus
gatagcataagacccaaacccataa

SEQ ID NO: 359279 - DNA, 25 bp, Rattus norvegicus
gatagcataagagccaaacccataa

SEQ ID NO: 359280 - DNA, 25 bp, Rattus norvegicus
gatagcatagatccccttgagcaga

SEQ ID NO: 359281 - DNA, 25 bp, Rattus norvegicus
gatagcatagatgcccttgagcaga

SEQ ID NO: 359282 - DNA, 25 bp, Rattus norvegicus
gatagcatagttctgtctgcaagag

SEQ ID NO: 359283 - DNA, 25 bp, Rattus norvegicus
gatagcatagttgtgtctgcaagag

SEQ ID NO: 359284 - DNA, 25 bp, Rattus norvegicus
gatagcatcctcacggtatgggcag

SEQ ID NO: 359285 - DNA, 25 bp, Rattus norvegicus
gatagcatcctctcggtatgggcag

SEQ ID NO: 359286 - DNA, 25 bp, Rattus norvegicus
gatagcatctcgactcctggagtga

SEQ ID NO: 359287 - DNA, 25 bp, Rattus norvegicus
gatagcatctcgtctcctggagtga

SEQ ID NO: 359288 - DNA, 25 bp, Rattus norvegicus
gatagcatgtgactggttctgaaaa

SEQ ID NO: 359289 - DNA, 25 bp, Rattus norvegicus
gatagcatgtgagtggttctgaaaa

SEQ ID NO: 359290 - DNA, 25 bp, Rattus norvegicus
gatagcattctcatcagggacccag

SEQ ID NO: 359291 - DNA, 25 bp, Rattus norvegicus
gatagcattctcttcagggacccag

SEQ ID NO: 359292 - DNA, 25 bp, Rattus norvegicus
gatagccaacttcgtgcacaccttt

SEQ ID NO: 359293 - DNA, 25 bp, Rattus norvegicus
gatagccaacttggtgcacaccttt

SEQ ID NO: 359294 - DNA, 25 bp, Rattus norvegicus
gatagccaagacctcacttcagaat

SEQ ID NO: 359295 - DNA, 25 bp, Rattus norvegicus
gatagccaagacgtcacttcagaat

SEQ ID NO: 359296 - DNA, 25 bp, Rattus norvegicus
gatagccaaggcacttaggcgctgc

SEQ ID NO: 359297 - DNA, 25 bp, Rattus norvegicus
gatagccaaggctcttaggcgctgc

SEQ ID NO: 359298 - DNA, 25 bp, Rattus norvegicus
gatagccaatgtaagcatctcttct

SEQ ID NO: 359299 - DNA, 25 bp, Rattus norvegicus
gatagccaatgttagcatctcttct

SEQ ID NO: 359300 - DNA, 25 bp, Rattus norvegicus
gatagccactgtaattggtgtcctt

SEQ ID NO: 359301 - DNA, 25 bp, Rattus norvegicus
gatagccactgtattatgtttctac

SEQ ID NO: 359302 - DNA, 25 bp, Rattus norvegicus
gatagccactgttattggtgtcctt

SEQ ID NO: 359303 - DNA, 25 bp, Rattus norvegicus
gatagccactgttttatgtttctac

SEQ ID NO: 359304 - DNA, 25 bp, Rattus norvegicus
gatagccagccaaacaaaccaggtt

SEQ ID NO: 359305 - DNA, 25 bp, Rattus norvegicus
gatagccagccatacaaaccaggtt

SEQ ID NO: 359306 - DNA, 25 bp, Rattus norvegicus
gatagccagcttcagaaccagccag

SEQ ID NO: 359307 - DNA, 25 bp, Rattus norvegicus
gatagccagcttgagaaccagccag

SEQ ID NO: 359308 - DNA, 25 bp, Rattus norvegicus
gatagccagggcagttaaaccaaca

SEQ ID NO: 359309 - DNA, 25 bp, Rattus norvegicus
gatagccagggctgttaaaccaaca

SEQ ID NO: 359310 - DNA, 25 bp, Rattus norvegicus
gatagccatctaatcatctggatca

SEQ ID NO: 359311 - DNA, 25 bp, Rattus norvegicus
gatagccatctattcatctggatca

SEQ ID NO: 359312 - DNA, 25 bp, Rattus norvegicus
gatagccatttgagatctcagtgtg

SEQ ID NO: 359313 - DNA, 25 bp, Rattus norvegicus
gatagccatttgtgatctcagtgtg

SEQ ID NO: 359314 - DNA, 25 bp, Rattus norvegicus
gatagcccaagaaagcctaagccgc

SEQ ID NO: 359315 - DNA, 25 bp, Rattus norvegicus
gatagcccaagatagcctaagccgc

SEQ ID NO: 359316 - DNA, 25 bp, Rattus norvegicus
gatagcccagtacacacccaagagt

SEQ ID NO: 359317 - DNA, 25 bp, Rattus norvegicus
gatagcccagtagacacccaagagt

SEQ ID NO: 359318 - DNA, 25 bp, Rattus norvegicus
gatagcccatgtcttctcaattgaa

SEQ ID NO: 359319 - DNA, 25 bp, Rattus norvegicus
gatagcccatgtgttctcaattgaa

SEQ ID NO: 359320 - DNA, 25 bp, Rattus norvegicus
gatagccctagtattgcaccagatt

SEQ ID NO: 359321 - DNA, 25 bp, Rattus norvegicus
gatagccctagttttgcaccagatt

SEQ ID NO: 359322 - DNA, 25 bp, Rattus norvegicus
gatagccctgagaacaagaccttgc

SEQ ID NO: 359323 - DNA, 25 bp, Rattus norvegicus
gatagccctgagtacaagaccttgc

SEQ ID NO: 359324 - DNA, 25 bp, Rattus norvegicus
gatagccctgctagtaggaggcact

SEQ ID NO: 359325 - DNA, 25 bp, Rattus norvegicus
gatagccctgcttgtaggaggcact

SEQ ID NO: 359326 - DNA, 25 bp, Rattus norvegicus
gatagccctgtccaacaagctgaag

SEQ ID NO: 359327 - DNA, 25 bp, Rattus norvegicus
gatagccctgtcgaacaagctgaag

SEQ ID NO: 359328 - DNA, 25 bp, Rattus norvegicus
gatagccctgtgcaccagcttcata

SEQ ID NO: 359329 - DNA, 25 bp, Rattus norvegicus
gatagccctgtggaccagcttcata

SEQ ID NO: 359330 - DNA, 25 bp, Rattus norvegicus
gatagccctttcaactatgattggc

SEQ ID NO: 359331 - DNA, 25 bp, Rattus norvegicus
gatagccctttctactatgattggc

SEQ ID NO: 359332 - DNA, 25 bp, Rattus norvegicus
gatagcccttttagacttcacaatt

SEQ ID NO: 359333 - DNA, 25 bp, Rattus norvegicus
gatagccctttttgacttcacaatt

SEQ ID NO: 359334 - DNA, 25 bp, Rattus norvegicus
gatagccgggatatgaagctttcta

SEQ ID NO: 359335 - DNA, 25 bp, Rattus norvegicus
gatagccgggatttgaagctttcta

SEQ ID NO: 359336 - DNA, 25 bp, Rattus norvegicus
gatagccggtcaaagtctctaccag

SEQ ID NO: 359337 - DNA, 25 bp, Rattus norvegicus
gatagccggtcatagtctctaccag

SEQ ID NO: 359338 - DNA, 25 bp, Rattus norvegicus
gatagccgtctacagcaatagtatt

SEQ ID NO: 359339 - DNA, 25 bp, Rattus norvegicus
gatagccgtctagagcaatagtatt

SEQ ID NO: 359340 - DNA, 25 bp, Rattus norvegicus
gatagcctacacagagaatccaaac

SEQ ID NO: 359341 - DNA, 25 bp, Rattus norvegicus
gatagcctacactgagaatccaaac

SEQ ID NO: 359342 - DNA, 25 bp, Rattus norvegicus
gatagcctataccttgactcggact

SEQ ID NO: 359343 - DNA, 25 bp, Rattus norvegicus
gatagcctatacgttgactcggact

SEQ ID NO: 359344 - DNA, 25 bp, Rattus norvegicus
gatagcctatttagacttctaatgt

SEQ ID NO: 359345 - DNA, 25 bp, Rattus norvegicus
gatagcctattttgacttctaatgt

SEQ ID NO: 359346 - DNA, 25 bp, Rattus norvegicus
gatagcctgaacacagtgctcgaga

SEQ ID NO: 359347 - DNA, 25 bp, Rattus norvegicus
gatagcctgaactcagtgctcgaga

SEQ ID NO: 359348 - DNA, 25 bp, Rattus norvegicus
gatagcctgcacctgagatgttgag

SEQ ID NO: 359349 - DNA, 25 bp, Rattus norvegicus
gatagcctgcacgtgagatgttgag

SEQ ID NO: 359350 - DNA, 25 bp, Rattus norvegicus
gatagcctggctaggaatcctagca

SEQ ID NO: 359351 - DNA, 25 bp, Rattus norvegicus
gatagcctggcttggaatcctagca

SEQ ID NO: 359352 - DNA, 25 bp, Rattus norvegicus
gatagcctggttaggatctctgcca

SEQ ID NO: 359353 - DNA, 25 bp, Rattus norvegicus
gatagcctggtttggatctctgcca

SEQ ID NO: 359354 - DNA, 25 bp, Rattus norvegicus
gatagcctgtatattctcatttata

SEQ ID NO: 359355 - DNA, 25 bp, Rattus norvegicus
gatagcctgtattttctcatttata

SEQ ID NO: 359356 - DNA, 25 bp, Rattus norvegicus
gatagcctgtggataacttagccag

SEQ ID NO: 359357 - DNA, 25 bp, Rattus norvegicus
gatagcctgtggttaacttagccag

SEQ ID NO: 359358 - DNA, 25 bp, Rattus norvegicus
gatagccttactactttttatctgt

SEQ ID NO: 359359 - DNA, 25 bp, Rattus norvegicus
gatagccttacttctttttatctgt

SEQ ID NO: 359360 - DNA, 25 bp, Rattus norvegicus
gatagccttcatagtgaccacattc

SEQ ID NO: 359361 - DNA, 25 bp, Rattus norvegicus
gatagccttcattgtgaccacattc

SEQ ID NO: 359362 - DNA, 25 bp, Rattus norvegicus
gatagccttcccacctaatacctaa

SEQ ID NO: 359363 - DNA, 25 bp, Rattus norvegicus
gatagccttccctcctaatacctaa

SEQ ID NO: 359364 - DNA, 25 bp, Rattus norvegicus
gatagccttggcactaatctggtca

SEQ ID NO: 359365 - DNA, 25 bp, Rattus norvegicus
gatagccttggctctaatctggtca

SEQ ID NO: 359366 - DNA, 25 bp, Rattus norvegicus
gatagccttgtcagatcagcactag

SEQ ID NO: 359367 - DNA, 25 bp, Rattus norvegicus
gatagccttgtcctttagatgaaac

SEQ ID NO: 359368 - DNA, 25 bp, Rattus norvegicus
gatagccttgtcgtttagatgaaac

SEQ ID NO: 359369 - DNA, 25 bp, Rattus norvegicus
gatagccttgtctgatcagcactag

SEQ ID NO: 359370 - DNA, 25 bp, Rattus norvegicus
gatagcctttctctctagatttcat

SEQ ID NO: 359371 - DNA, 25 bp, Rattus norvegicus
gatagcctttctgtctagatttcat

SEQ ID NO: 359372 - DNA, 25 bp, Rattus norvegicus
gatagcctttggattcagtcatttc

SEQ ID NO: 359373 - DNA, 25 bp, Rattus norvegicus
gatagcctttggtttcagtcatttc

SEQ ID NO: 359374 - DNA, 25 bp, Rattus norvegicus
gatagcgagataaagatgaactagc

SEQ ID NO: 359375 - DNA, 25 bp, Rattus norvegicus
gatagcgagatatagatgaactagc

SEQ ID NO: 359376 - DNA, 25 bp, Rattus norvegicus
gatagcgatagaccgatccgtattt

SEQ ID NO: 359377 - DNA, 25 bp, Rattus norvegicus
gatagcgatagagcgatccgtattt

SEQ ID NO: 359378 - DNA, 25 bp, Rattus norvegicus
gatagcgctggtctaatattcgaga

SEQ ID NO: 359379 - DNA, 25 bp, Rattus norvegicus
gatagcgctggtgtaatattcgaga

SEQ ID NO: 359380 - DNA, 25 bp, Rattus norvegicus
gatagcggacccaggcgacaacgaa

SEQ ID NO: 359381 - DNA, 25 bp, Rattus norvegicus
gatagcggaccctggcgacaacgaa

SEQ ID NO: 359382 - DNA, 25 bp, Rattus norvegicus
gatagcggcataactgttggccctt

SEQ ID NO: 359383 - DNA, 25 bp, Rattus norvegicus
gatagcggcatatctgttggccctt

SEQ ID NO: 359384 - DNA, 25 bp, Rattus norvegicus
gatagcgtcatgcatgtgcgatcca

SEQ ID NO: 359385 - DNA, 25 bp, Rattus norvegicus
gatagcgtcatggatgtgcgatcca

SEQ ID NO: 359386 - DNA, 25 bp, Rattus norvegicus
gatagcgtctatcaaccaaagttat

SEQ ID NO: 359387 - DNA, 25 bp, Rattus norvegicus
gatagcgtctatgaaccaaagttat

SEQ ID NO: 359388 - DNA, 25 bp, Rattus norvegicus
gatagcgtgaagagcttttctcatt

SEQ ID NO: 359389 - DNA, 25 bp, Rattus norvegicus
gatagcgtgaagtgcttttctcatt

SEQ ID NO: 359390 - DNA, 25 bp, Rattus norvegicus
gatagcgtgcccattgtatgtagtt

SEQ ID NO: 359391 - DNA, 25 bp, Rattus norvegicus
gatagcgtgccctttgtatgtagtt

SEQ ID NO: 359392 - DNA, 25 bp, Rattus norvegicus
gatagcgtgtcaatcgttcaagtct

SEQ ID NO: 359393 - DNA, 25 bp, Rattus norvegicus
gatagcgtgtcattcgttcaagtct

SEQ ID NO: 359394 - DNA, 25 bp, Rattus norvegicus
gatagcgttcatcgaagagactcta

SEQ ID NO: 359395 - DNA, 25 bp, Rattus norvegicus
gatagcgttcatggaagagactcta

SEQ ID NO: 359396 - DNA, 25 bp, Rattus norvegicus
gatagctaacatcttaatgcaactc

SEQ ID NO: 359397 - DNA, 25 bp, Rattus norvegicus
gatagctaacatgttaatgcaactc

SEQ ID NO: 359398 - DNA, 25 bp, Rattus norvegicus
gatagctaagccattgaccaaacta

SEQ ID NO: 359399 - DNA, 25 bp, Rattus norvegicus
gatagctaagcctttgaccaaacta

SEQ ID NO: 359400 - DNA, 25 bp, Rattus norvegicus
gatagctaccacatcaccatatgac

SEQ ID NO: 359401 - DNA, 25 bp, Rattus norvegicus
gatagctaccacttcaccatatgac

SEQ ID NO: 359402 - DNA, 25 bp, Rattus norvegicus
gatagctacgagaaggacgctgcca

SEQ ID NO: 359403 - DNA, 25 bp, Rattus norvegicus
gatagctacgagacagaactggacc

SEQ ID NO: 359404 - DNA, 25 bp, Rattus norvegicus
gatagctacgagtaggacgctgcca

SEQ ID NO: 359405 - DNA, 25 bp, Rattus norvegicus
gatagctacgagtcagaactggacc

SEQ ID NO: 359406 - DNA, 25 bp, Rattus norvegicus
gatagctacgataattagttttaac

SEQ ID NO: 359407 - DNA, 25 bp, Rattus norvegicus
gatagctacgattattagttttaac

SEQ ID NO: 359408 - DNA, 25 bp, Rattus norvegicus
gatagctaggctcttcttttgaaca

SEQ ID NO: 359409 - DNA, 25 bp, Rattus norvegicus
gatagctaggctgttcttttgaaca

SEQ ID NO: 359410 - DNA, 25 bp, Rattus norvegicus
gatagctatcatcaggccaccgtga

SEQ ID NO: 359411 - DNA, 25 bp, Rattus norvegicus
gatagctatcatgaggccaccgtga

SEQ ID NO: 359412 - DNA, 25 bp, Rattus norvegicus
gatagctatccaagtggcccaacac

SEQ ID NO: 359413 - DNA, 25 bp, Rattus norvegicus
gatagctatccatgtggcccaacac

SEQ ID NO: 359414 - DNA, 25 bp, Rattus norvegicus
gatagctatctaagccccattggtg

SEQ ID NO: 359415 - DNA, 25 bp, Rattus norvegicus
gatagctatctatgccccattggtg

SEQ ID NO: 359416 - DNA, 25 bp, Rattus norvegicus
gatagctcaaccagtgtaccatgtg

SEQ ID NO: 359417 - DNA, 25 bp, Rattus norvegicus
gatagctcaacctgtgtaccatgtg

SEQ ID NO: 359418 - DNA, 25 bp, Rattus norvegicus
gatagctcactgcatttgaaacctc

SEQ ID NO: 359419 - DNA, 25 bp, Rattus norvegicus
gatagctcactggatttgaaacctc

SEQ ID NO: 359420 - DNA, 25 bp, Rattus norvegicus
gatagctcagccattgagaacactg

SEQ ID NO: 359421 - DNA, 25 bp, Rattus norvegicus
gatagctcagcctttgagaacactg

SEQ ID NO: 359422 - DNA, 25 bp, Rattus norvegicus
gatagctccactaaactctcagagt

SEQ ID NO: 359423 - DNA, 25 bp, Rattus norvegicus
gatagctccacttaactctcagagt

SEQ ID NO: 359424 - DNA, 25 bp, Rattus norvegicus
gatagctcggatagaaagaactttt

SEQ ID NO: 359425 - DNA, 25 bp, Rattus norvegicus
gatagctcggattgaaagaactttt

SEQ ID NO: 359426 - DNA, 25 bp, Rattus norvegicus
gatagctctatgataaccttgccaa

SEQ ID NO: 359427 - DNA, 25 bp, Rattus norvegicus
gatagctctatgttaaccttgccaa

SEQ ID NO: 359428 - DNA, 25 bp, Rattus norvegicus
gatagctctcaacgacaactgccaa

SEQ ID NO: 359429 - DNA, 25 bp, Rattus norvegicus
gatagctctcaaggacaactgccaa

SEQ ID NO: 359430 - DNA, 25 bp, Rattus norvegicus
gatagctctgccaattgcaggacaa

SEQ ID NO: 359431 - DNA, 25 bp, Rattus norvegicus
gatagctctgcctattgcaggacaa

SEQ ID NO: 359432 - DNA, 25 bp, Rattus norvegicus
gatagctctgtgatttgtggtctcc

SEQ ID NO: 359433 - DNA, 25 bp, Rattus norvegicus
gatagctctgtgttttgtggtctcc

SEQ ID NO: 359434 - DNA, 25 bp, Rattus norvegicus
gatagctcttacaattcactactgt

SEQ ID NO: 359435 - DNA, 25 bp, Rattus norvegicus
gatagctcttactattcactactgt

SEQ ID NO: 359436 - DNA, 25 bp, Rattus norvegicus
gatagctgatgcacacagtgtctgc

SEQ ID NO: 359437 - DNA, 25 bp, Rattus norvegicus
gatagctgatgctcacagtgtctgc

SEQ ID NO: 359438 - DNA, 25 bp, Rattus norvegicus
gatagctgcatgattactttctaat

SEQ ID NO: 359439 - DNA, 25 bp, Rattus norvegicus
gatagctgcatgtttactttctaat

SEQ ID NO: 359440 - DNA, 25 bp, Rattus norvegicus
gatagctgctataacatccatttat

SEQ ID NO: 359441 - DNA, 25 bp, Rattus norvegicus
gatagctgctattacatccatttat

SEQ ID NO: 359442 - DNA, 25 bp, Rattus norvegicus
gatagctgggtgactgcgatcatgt

SEQ ID NO: 359443 - DNA, 25 bp, Rattus norvegicus
gatagctgggtgtctgcgatcatgt

SEQ ID NO: 359444 - DNA, 25 bp, Rattus norvegicus
gatagctgtacaactcttgggcttc

SEQ ID NO: 359445 - DNA, 25 bp, Rattus norvegicus
gatagctgtacatctcttgggcttc

SEQ ID NO: 359446 - DNA, 25 bp, Rattus norvegicus
gatagctgtacgaagccatggcaga

SEQ ID NO: 359447 - DNA, 25 bp, Rattus norvegicus
gatagctgtacgtagccatggcaga

SEQ ID NO: 359448 - DNA, 25 bp, Rattus norvegicus
gatagctgtagaacccagtttggtg

SEQ ID NO: 359449 - DNA, 25 bp, Rattus norvegicus
gatagctgtagatcccagtttggtg

SEQ ID NO: 359450 - DNA, 25 bp, Rattus norvegicus
gatagctgtaggaagatcaaacaca

SEQ ID NO: 359451 - DNA, 25 bp, Rattus norvegicus
gatagctgtaggtagatcaaacaca

SEQ ID NO: 359452 - DNA, 25 bp, Rattus norvegicus
gatagctgtatgatattttccttgg

SEQ ID NO: 359453 - DNA, 25 bp, Rattus norvegicus
gatagctgtatgttattttccttgg

SEQ ID NO: 359454 - DNA, 25 bp, Rattus norvegicus
gatagctgtgtcaggctcgtgtctg

SEQ ID NO: 359455 - DNA, 25 bp, Rattus norvegicus
gatagctgtgtctggctcgtgtctg

SEQ ID NO: 359456 - DNA, 25 bp, Rattus norvegicus
gatagcttaccgcatcgaaaggctg

SEQ ID NO: 359457 - DNA, 25 bp, Rattus norvegicus
gatagcttaccggatcgaaaggctg

SEQ ID NO: 359458 - DNA, 25 bp, Rattus norvegicus
gatagcttagtgattcgttttcctg

SEQ ID NO: 359459 - DNA, 25 bp, Rattus norvegicus
gatagcttagtgtttcgttttcctg

SEQ ID NO: 359460 - DNA, 25 bp, Rattus norvegicus
gatagcttagttcagggccatccat

SEQ ID NO: 359461 - DNA, 25 bp, Rattus norvegicus
gatagcttagttgagggccatccat

SEQ ID NO: 359462 - DNA, 25 bp, Rattus norvegicus
gatagcttatcgaagccgaacgtga

SEQ ID NO: 359463 - DNA, 25 bp, Rattus norvegicus
gatagcttatcgtagccgaacgtga

SEQ ID NO: 359464 - DNA, 25 bp, Rattus norvegicus
gatagcttcaatctagcctctgcaa

SEQ ID NO: 359465 - DNA, 25 bp, Rattus norvegicus
gatagcttcaatgtagcctctgcaa

SEQ ID NO: 359466 - DNA, 25 bp, Rattus norvegicus
gatagcttccacattttgttacttt

SEQ ID NO: 359467 - DNA, 25 bp, Rattus norvegicus
gatagcttccactttttgttacttt

SEQ ID NO: 359468 - DNA, 25 bp, Rattus norvegicus
gatagcttccgtccctgagaatcat

SEQ ID NO: 359469 - DNA, 25 bp, Rattus norvegicus
gatagcttccgtgcctgagaatcat

SEQ ID NO: 359470 - DNA, 25 bp, Rattus norvegicus
gatagcttcctgaccaacgatgttc

SEQ ID NO: 359471 - DNA, 25 bp, Rattus norvegicus
gatagcttcctgtccaacgatgttc

SEQ ID NO: 359472 - DNA, 25 bp, Rattus norvegicus
gatagcttcgatagaactgtctaaa

SEQ ID NO: 359473 - DNA, 25 bp, Rattus norvegicus
gatagcttcgattgaactgtctaaa

SEQ ID NO: 359474 - DNA, 25 bp, Rattus norvegicus
gatagcttctttcgccttatgttaa

SEQ ID NO: 359475 - DNA, 25 bp, Rattus norvegicus
gatagcttctttggccttatgttaa

SEQ ID NO: 359476 - DNA, 25 bp, Rattus norvegicus
gatagcttgcacactctatgggatt

SEQ ID NO: 359477 - DNA, 25 bp, Rattus norvegicus
gatagcttgcactctctatgggatt

SEQ ID NO: 359478 - DNA, 25 bp, Rattus norvegicus
gatagcttgcatctttctttacttt

SEQ ID NO: 359479 - DNA, 25 bp, Rattus norvegicus
gatagcttgcatgtttctttacttt

SEQ ID NO: 359480 - DNA, 25 bp, Rattus norvegicus
gatagcttgtacacttatccaatag

SEQ ID NO: 359481 - DNA, 25 bp, Rattus norvegicus
gatagcttgtactcttatccaatag

SEQ ID NO: 359482 - DNA, 25 bp, Rattus norvegicus
gatagcttgtgtaagtttcagggag

SEQ ID NO: 359483 - DNA, 25 bp, Rattus norvegicus
gatagcttgtgttagtttcagggag

SEQ ID NO: 359484 - DNA, 25 bp, Rattus norvegicus
gatagcttttaaattcccttttcat

SEQ ID NO: 359485 - DNA, 25 bp, Rattus norvegicus
gatagcttttaatttcccttttcat

SEQ ID NO: 359486 - DNA, 25 bp, Rattus norvegicus
gatagctttttgacctgtaaggtga

SEQ ID NO: 359487 - DNA, 25 bp, Rattus norvegicus
gatagctttttgtcctgtaaggtga

SEQ ID NO: 359488 - DNA, 25 bp, Rattus norvegicus
gataggaactggaatccttcatctt

SEQ ID NO: 359489 - DNA, 25 bp, Rattus norvegicus
gataggaactggtatccttcatctt

SEQ ID NO: 359490 - DNA, 25 bp, Rattus norvegicus
gataggacactaaactttatttaaa

SEQ ID NO: 359491 - DNA, 25 bp, Rattus norvegicus
gataggacactatactttatttaaa

SEQ ID NO: 359492 - DNA, 25 bp, Rattus norvegicus
gataggacactgaggccgcacactg

SEQ ID NO: 359493 - DNA, 25 bp, Rattus norvegicus
gataggacactgtggccgcacactg

SEQ ID NO: 359494 - DNA, 25 bp, Rattus norvegicus
gataggacagctccagaggtctgct

SEQ ID NO: 359495 - DNA, 25 bp, Rattus norvegicus
gataggacagctgcagaggtctgct

SEQ ID NO: 359496 - DNA, 25 bp, Rattus norvegicus
gataggacatgtactgacccctggt

SEQ ID NO: 359497 - DNA, 25 bp, Rattus norvegicus
gataggacatgttctgacccctggt

SEQ ID NO: 359498 - DNA, 25 bp, Rattus norvegicus
gataggacccatacttgataacagc

SEQ ID NO: 359499 - DNA, 25 bp, Rattus norvegicus
gataggacccattcttgataacagc

SEQ ID NO: 359500 - DNA, 25 bp, Rattus norvegicus
gataggaccctacctgagaacaaca

SEQ ID NO: 359501 - DNA, 25 bp, Rattus norvegicus
gataggaccctagctgagaacaaca

SEQ ID NO: 359502 - DNA, 25 bp, Rattus norvegicus
gataggacctctcagcagcaaccta

SEQ ID NO: 359503 - DNA, 25 bp, Rattus norvegicus
gataggacctctgagcagcaaccta

SEQ ID NO: 359504 - DNA, 25 bp, Rattus norvegicus
gataggagagtcacatacaggcagt

SEQ ID NO: 359505 - DNA, 25 bp, Rattus norvegicus
gataggagagtctcatacaggcagt

SEQ ID NO: 359506 - DNA, 25 bp, Rattus norvegicus
gataggagatggacacagcaacaca

SEQ ID NO: 359507 - DNA, 25 bp, Rattus norvegicus
gataggagatggtcacagcaacaca

SEQ ID NO: 359508 - DNA, 25 bp, Rattus norvegicus
gataggagccataagctctccttca

SEQ ID NO: 359509 - DNA, 25 bp, Rattus norvegicus
gataggagccattagctctccttca

SEQ ID NO: 359510 - DNA, 25 bp, Rattus norvegicus
gataggaggattcctggtgctcact

SEQ ID NO: 359511 - DNA, 25 bp, Rattus norvegicus
gataggaggattgctggtgctcact

SEQ ID NO: 359512 - DNA, 25 bp, Rattus norvegicus
gataggaggcagacgcgcctgctct

SEQ ID NO: 359513 - DNA, 25 bp, Rattus norvegicus
gataggaggcagtcgcgcctgctct

SEQ ID NO: 359514 - DNA, 25 bp, Rattus norvegicus
gataggagttgaactcactgtagta

SEQ ID NO: 359515 - DNA, 25 bp, Rattus norvegicus
gataggagttgatctcactgtagta

SEQ ID NO: 359516 - DNA, 25 bp, Rattus norvegicus
gataggatacatcctctccgacaga

SEQ ID NO: 359517 - DNA, 25 bp, Rattus norvegicus
gataggatacatgctctccgacaga

SEQ ID NO: 359518 - DNA, 25 bp, Rattus norvegicus
gataggatagacagagcccacctct

SEQ ID NO: 359519 - DNA, 25 bp, Rattus norvegicus
gataggatagactgagcccacctct

SEQ ID NO: 359520 - DNA, 25 bp, Rattus norvegicus
gataggatccctcagaaacacagca

SEQ ID NO: 359521 - DNA, 25 bp, Rattus norvegicus
gataggatccctgagaaacacagca

SEQ ID NO: 359522 - DNA, 25 bp, Rattus norvegicus
gataggatctcaccatgtatcccta

SEQ ID NO: 359523 - DNA, 25 bp, Rattus norvegicus
gataggatctcagcatgtatcccta

SEQ ID NO: 359524 - DNA, 25 bp, Rattus norvegicus
gataggatctctaaggtagctctgc

SEQ ID NO: 359525 - DNA, 25 bp, Rattus norvegicus
gataggatctcttaggtagctctgc

SEQ ID NO: 359526 - DNA, 25 bp, Rattus norvegicus
gataggatgctacaggcgcaccgtt

SEQ ID NO: 359527 - DNA, 25 bp, Rattus norvegicus
gataggatgctagaggcgcaccgtt

SEQ ID NO: 359528 - DNA, 25 bp, Rattus norvegicus
gataggattactcctaaccctgggc

SEQ ID NO: 359529 - DNA, 25 bp, Rattus norvegicus
gataggattactgctaaccctgggc

SEQ ID NO: 359530 - DNA, 25 bp, Rattus norvegicus
gataggattcttactgcatctccaa

SEQ ID NO: 359531 - DNA, 25 bp, Rattus norvegicus
gataggattctttctgcatctccaa

SEQ ID NO: 359532 - DNA, 25 bp, Rattus norvegicus
gataggattttcacctccaaagcct

SEQ ID NO: 359533 - DNA, 25 bp, Rattus norvegicus
gataggattttctcctccaaagcct

SEQ ID NO: 359534 - DNA, 25 bp, Rattus norvegicus
gataggcacagtactcacaaaacca

SEQ ID NO: 359535 - DNA, 25 bp, Rattus norvegicus
gataggcacagttctcacaaaacca

SEQ ID NO: 359536 - DNA, 25 bp, Rattus norvegicus
gataggcacctgagtgacagcggca

SEQ ID NO: 359537 - DNA, 25 bp, Rattus norvegicus
gataggcacctgtgtgacagcggca

SEQ ID NO: 359538 - DNA, 25 bp, Rattus norvegicus
gataggcagtttatatcaatatcaa

SEQ ID NO: 359539 - DNA, 25 bp, Rattus norvegicus
gataggcagtttttatcaatatcaa

SEQ ID NO: 359540 - DNA, 25 bp, Rattus norvegicus
gataggccctatctttgaagtttct

SEQ ID NO: 359541 - DNA, 25 bp, Rattus norvegicus
gataggccctatgtttgaagtttct

SEQ ID NO: 359542 - DNA, 25 bp, Rattus norvegicus
gataggccctccctatcttagttta

SEQ ID NO: 359543 - DNA, 25 bp, Rattus norvegicus
gataggccctccgtatcttagttta

SEQ ID NO: 359544 - DNA, 25 bp, Rattus norvegicus
gataggccgggacaaccctcagttg

SEQ ID NO: 359545 - DNA, 25 bp, Rattus norvegicus
gataggccgggagaaccctcagttg

SEQ ID NO: 359546 - DNA, 25 bp, Rattus norvegicus
gataggcctacgattgcccatatta

SEQ ID NO: 359547 - DNA, 25 bp, Rattus norvegicus
gataggcctacgtttgcccatatta

SEQ ID NO: 359548 - DNA, 25 bp, Rattus norvegicus
gataggcctagtacaatcttgggaa

SEQ ID NO: 359549 - DNA, 25 bp, Rattus norvegicus
gataggcctagttcaatcttgggaa

SEQ ID NO: 359550 - DNA, 25 bp, Rattus norvegicus
gataggcctttgatttcactttcat

SEQ ID NO: 359551 - DNA, 25 bp, Rattus norvegicus
gataggcctttgttttcactttcat

SEQ ID NO: 359552 - DNA, 25 bp, Rattus norvegicus
gataggcgtgagatggcaccacttc

SEQ ID NO: 359553 - DNA, 25 bp, Rattus norvegicus
gataggcgtgagttggcaccacttc

SEQ ID NO: 359554 - DNA, 25 bp, Rattus norvegicus
gataggctacataccacatgctctt

SEQ ID NO: 359555 - DNA, 25 bp, Rattus norvegicus
gataggctacattccacatgctctt

SEQ ID NO: 359556 - DNA, 25 bp, Rattus norvegicus
gataggctagggagctgtcgtactc

SEQ ID NO: 359557 - DNA, 25 bp, Rattus norvegicus
gataggctagggtgctgtcgtactc

SEQ ID NO: 359558 - DNA, 25 bp, Rattus norvegicus
gataggctccgcaatagcggactac

SEQ ID NO: 359559 - DNA, 25 bp, Rattus norvegicus
gataggctccgctatagcggactac

SEQ ID NO: 359560 - DNA, 25 bp, Rattus norvegicus
gataggctggctatcagctggctaa

SEQ ID NO: 359561 - DNA, 25 bp, Rattus norvegicus
gataggctggctttcagctggctaa

SEQ ID NO: 359562 - DNA, 25 bp, Rattus norvegicus
gataggctggtcctggacgttaaat

SEQ ID NO: 359563 - DNA, 25 bp, Rattus norvegicus
gataggctggtcgtggacgttaaat

SEQ ID NO: 359564 - DNA, 25 bp, Rattus norvegicus
gataggcttctcatacttcatttaa

SEQ ID NO: 359565 - DNA, 25 bp, Rattus norvegicus
gataggcttctcttacttcatttaa

SEQ ID NO: 359566 - DNA, 25 bp, Rattus norvegicus
gataggcttgatatctattacaaat

SEQ ID NO: 359567 - DNA, 25 bp, Rattus norvegicus
gataggcttgatttctattacaaat

SEQ ID NO: 359568 - DNA, 25 bp, Rattus norvegicus
gataggcttttaatggcgcttgtta

SEQ ID NO: 359569 - DNA, 25 bp, Rattus norvegicus
gataggcttttattggcgcttgtta

SEQ ID NO: 359570 - DNA, 25 bp, Rattus norvegicus
gatagggaaggccttcaccacattg

SEQ ID NO: 359571 - DNA, 25 bp, Rattus norvegicus
gatagggaaggcgttcaccacattg

SEQ ID NO: 359572 - DNA, 25 bp, Rattus norvegicus
gatagggaccacacctacggttgat

SEQ ID NO: 359573 - DNA, 25 bp, Rattus norvegicus
gatagggaccactcctacggttgat

SEQ ID NO: 359574 - DNA, 25 bp, Rattus norvegicus
gatagggagcccagagtccagcaag

SEQ ID NO: 359575 - DNA, 25 bp, Rattus norvegicus
gatagggagccctgagtccagcaag

SEQ ID NO: 359576 - DNA, 25 bp, Rattus norvegicus
gatagggagcttacctggcaagcat

SEQ ID NO: 359577 - DNA, 25 bp, Rattus norvegicus
gatagggagctttcctggcaagcat

SEQ ID NO: 359578 - DNA, 25 bp, Rattus norvegicus
gatagggcacatcacattcctagcc

SEQ ID NO: 359579 - DNA, 25 bp, Rattus norvegicus
gatagggcacatgacattcctagcc

SEQ ID NO: 359580 - DNA, 25 bp, Rattus norvegicus
gatagggcccatctttactgtcaag

SEQ ID NO: 359581 - DNA, 25 bp, Rattus norvegicus
gatagggcccatgtttactgtcaag

SEQ ID NO: 359582 - DNA, 25 bp, Rattus norvegicus
gatagggctaagacctccactgcag

SEQ ID NO: 359583 - DNA, 25 bp, Rattus norvegicus
gatagggctaagtcctccactgcag

SEQ ID NO: 359584 - DNA, 25 bp, Rattus norvegicus
gatagggtccctaggtgtacagaga

SEQ ID NO: 359585 - DNA, 25 bp, Rattus norvegicus
gatagggtcccttggtgtacagaga

SEQ ID NO: 359586 - DNA, 25 bp, Rattus norvegicus
gatagggtccttaacttcacaaaga

SEQ ID NO: 359587 - DNA, 25 bp, Rattus norvegicus
gatagggtcctttacttcacaaaga

SEQ ID NO: 359588 - DNA, 25 bp, Rattus norvegicus
gatagggtgacacttctcagtgtag

SEQ ID NO: 359589 - DNA, 25 bp, Rattus norvegicus
gatagggtgacagttctcagtgtag

SEQ ID NO: 359590 - DNA, 25 bp, Rattus norvegicus
gatagggtgctcattatcctgtaaa

SEQ ID NO: 359591 - DNA, 25 bp, Rattus norvegicus
gatagggtgctctttatcctgtaaa

SEQ ID NO: 359592 - DNA, 25 bp, Rattus norvegicus
gatagggtggatcctctcctcacag

SEQ ID NO: 359593 - DNA, 25 bp, Rattus norvegicus
gatagggtggatgctctcctcacag

SEQ ID NO: 359594 - DNA, 25 bp, Rattus norvegicus
gataggtcagatcacctgattcaaa

SEQ ID NO: 359595 - DNA, 25 bp, Rattus norvegicus
gataggtcagatgacctgattcaaa

SEQ ID NO: 359596 - DNA, 25 bp, Rattus norvegicus
gataggtcattcaggcttctggtag

SEQ ID NO: 359597 - DNA, 25 bp, Rattus norvegicus
gataggtcattctggcttctggtag

SEQ ID NO: 359598 - DNA, 25 bp, Rattus norvegicus
gataggtcccaacgcaacgagagca

SEQ ID NO: 359599 - DNA, 25 bp, Rattus norvegicus
gataggtcccaaggcaacgagagca

SEQ ID NO: 359600 - DNA, 25 bp, Rattus norvegicus
gataggtctttcagtcttacataac

SEQ ID NO: 359601 - DNA, 25 bp, Rattus norvegicus
gataggtctttctgtcttacataac

SEQ ID NO: 359602 - DNA, 25 bp, Rattus norvegicus
gataggtgcattacaggctctcact

SEQ ID NO: 359603 - DNA, 25 bp, Rattus norvegicus
gataggtgcatttcaggctctcact

SEQ ID NO: 359604 - DNA, 25 bp, Rattus norvegicus
gataggtgctttctgtcgtagctcc

SEQ ID NO: 359605 - DNA, 25 bp, Rattus norvegicus
gataggtgctttgtgtcgtagctcc

SEQ ID NO: 359606 - DNA, 25 bp, Rattus norvegicus
gataggtgtcagatcctcgagagcc

SEQ ID NO: 359607 - DNA, 25 bp, Rattus norvegicus
gataggtgtcagttcctcgagagcc

SEQ ID NO: 359608 - DNA, 25 bp, Rattus norvegicus
gataggttcaatctccaagtgagta

SEQ ID NO: 359609 - DNA, 25 bp, Rattus norvegicus
gataggttcaatgtccaagtgagta

SEQ ID NO: 359610 - DNA, 25 bp, Rattus norvegicus
gataggttctagcaattcccttagg

SEQ ID NO: 359611 - DNA, 25 bp, Rattus norvegicus
gataggttctaggaattcccttagg

SEQ ID NO: 359612 - DNA, 25 bp, Rattus norvegicus
gataggtttcgcacttattgctgtt

SEQ ID NO: 359613 - DNA, 25 bp, Rattus norvegicus
gataggtttcgctcttattgctgtt

SEQ ID NO: 359614 - DNA, 25 bp, Rattus norvegicus
gataggttttcacctactccagtaa

SEQ ID NO: 359615 - DNA, 25 bp, Rattus norvegicus
gataggttttcagctactccagtaa

SEQ ID NO: 359616 - DNA, 25 bp, Rattus norvegicus
gatagtaaaaatacccctccttctg

SEQ ID NO: 359617 - DNA, 25 bp, Rattus norvegicus
gatagtaaaaattcccctccttctg

SEQ ID NO: 359618 - DNA, 25 bp, Rattus norvegicus
gatagtaaactcaagccttctaccc

SEQ ID NO: 359619 - DNA, 25 bp, Rattus norvegicus
gatagtaaactctagccttctaccc

SEQ ID NO: 359620 - DNA, 25 bp, Rattus norvegicus
gatagtaaccagattttctcccacc

SEQ ID NO: 359621 - DNA, 25 bp, Rattus norvegicus
gatagtaaccagtttttctcccacc

SEQ ID NO: 359622 - DNA, 25 bp, Rattus norvegicus
gatagtaaccttctctctgtgtaat

SEQ ID NO: 359623 - DNA, 25 bp, Rattus norvegicus
gatagtaaccttgtctctgtgtaat

SEQ ID NO: 359624 - DNA, 25 bp, Rattus norvegicus
gatagtaatggcctggtgcctacca

SEQ ID NO: 359625 - DNA, 25 bp, Rattus norvegicus
gatagtaatggcgtggtgcctacca

SEQ ID NO: 359626 - DNA, 25 bp, Rattus norvegicus
gatagtacaacaaatcatccaacgt

SEQ ID NO: 359627 - DNA, 25 bp, Rattus norvegicus
gatagtacaacatatcatccaacgt

SEQ ID NO: 359628 - DNA, 25 bp, Rattus norvegicus
gatagtacatcacctctgttggcaa

SEQ ID NO: 359629 - DNA, 25 bp, Rattus norvegicus
gatagtacatcagctctgttggcaa

SEQ ID NO: 359630 - DNA, 25 bp, Rattus norvegicus
gatagtacccaacgggtctccccat

SEQ ID NO: 359631 - DNA, 25 bp, Rattus norvegicus
gatagtacccaaggggtctccccat

SEQ ID NO: 359632 - DNA, 25 bp, Rattus norvegicus
gatagtacccgtctaatattatcca

SEQ ID NO: 359633 - DNA, 25 bp, Rattus norvegicus
gatagtacccgtgtaatattatcca

SEQ ID NO: 359634 - DNA, 25 bp, Rattus norvegicus
gatagtacctgcatggatttccaag

SEQ ID NO: 359635 - DNA, 25 bp, Rattus norvegicus
gatagtacctgcttggatttccaag

SEQ ID NO: 359636 - DNA, 25 bp, Rattus norvegicus
gatagtactgtaatgttcccaataa

SEQ ID NO: 359637 - DNA, 25 bp, Rattus norvegicus
gatagtactgtattgttcccaataa

SEQ ID NO: 359638 - DNA, 25 bp, Rattus norvegicus
gatagtactgttcttcttaagagct

SEQ ID NO: 359639 - DNA, 25 bp, Rattus norvegicus
gatagtactgttgttcttaagagct

SEQ ID NO: 359640 - DNA, 25 bp, Rattus norvegicus
gatagtactttgaccccatagcagt

SEQ ID NO: 359641 - DNA, 25 bp, Rattus norvegicus
gatagtactttgtccccatagcagt

SEQ ID NO: 359642 - DNA, 25 bp, Rattus norvegicus
gatagtagacctcaactgaatccca

SEQ ID NO: 359643 - DNA, 25 bp, Rattus norvegicus
gatagtagacctgaactgaatccca

SEQ ID NO: 359644 - DNA, 25 bp, Rattus norvegicus
gatagtatctctatcctaactggtg

SEQ ID NO: 359645 - DNA, 25 bp, Rattus norvegicus
gatagtatctctttcctaactggtg

SEQ ID NO: 359646 - DNA, 25 bp, Rattus norvegicus
gatagtatctgcctatttagcccag

SEQ ID NO: 359647 - DNA, 25 bp, Rattus norvegicus
gatagtatctgcgtatttagcccag

SEQ ID NO: 359648 - DNA, 25 bp, Rattus norvegicus
gatagtatctttatccctaagtact

SEQ ID NO: 359649 - DNA, 25 bp, Rattus norvegicus
gatagtatctttttccctaagtact

SEQ ID NO: 359650 - DNA, 25 bp, Rattus norvegicus
gatagtcactggagacctcagcgat

SEQ ID NO: 359651 - DNA, 25 bp, Rattus norvegicus
gatagtcactggtgacctcagcgat

SEQ ID NO: 359652 - DNA, 25 bp, Rattus norvegicus
gatagtcacttaagacaacctggat

SEQ ID NO: 359653 - DNA, 25 bp, Rattus norvegicus
gatagtcacttatgacaacctggat

SEQ ID NO: 359654 - DNA, 25 bp, Rattus norvegicus
gatagtcatcatcagaacacattga

SEQ ID NO: 359655 - DNA, 25 bp, Rattus norvegicus
gatagtcatcatgagaacacattga

SEQ ID NO: 359656 - DNA, 25 bp, Rattus norvegicus
gatagtcattttctcctgggtctcc

SEQ ID NO: 359657 - DNA, 25 bp, Rattus norvegicus
gatagtcattttgtcctgggtctcc

SEQ ID NO: 359658 - DNA, 25 bp, Rattus norvegicus
gatagtccagtaatttgaggtccat

SEQ ID NO: 359659 - DNA, 25 bp, Rattus norvegicus
gatagtccagtattttgaggtccat

SEQ ID NO: 359660 - DNA, 25 bp, Rattus norvegicus
gatagtccctttagcaatcgtacct

SEQ ID NO: 359661 - DNA, 25 bp, Rattus norvegicus
gatagtcccttttgcaatcgtacct

SEQ ID NO: 359662 - DNA, 25 bp, Rattus norvegicus
gatagtccgcatccaacaggctctt

SEQ ID NO: 359663 - DNA, 25 bp, Rattus norvegicus
gatagtccgcatgcaacaggctctt

SEQ ID NO: 359664 - DNA, 25 bp, Rattus norvegicus
gatagtcctaccacccagctatgat

SEQ ID NO: 359665 - DNA, 25 bp, Rattus norvegicus
gatagtcctacctcccagctatgat

SEQ ID NO: 359666 - DNA, 25 bp, Rattus norvegicus
gatagtcgctttaccattttggttt

SEQ ID NO: 359667 - DNA, 25 bp, Rattus norvegicus
gatagtcgcttttccattttggttt

SEQ ID NO: 359668 - DNA, 25 bp, Rattus norvegicus
gatagtcgtcaaaggctctgggcac

SEQ ID NO: 359669 - DNA, 25 bp, Rattus norvegicus
gatagtcgtcaatggctctgggcac

SEQ ID NO: 359670 - DNA, 25 bp, Rattus norvegicus
gatagtctcattatacccatcagga

SEQ ID NO: 359671 - DNA, 25 bp, Rattus norvegicus
gatagtctcattttacccatcagga

SEQ ID NO: 359672 - DNA, 25 bp, Rattus norvegicus
gatagtctccagcatttggaaacac

SEQ ID NO: 359673 - DNA, 25 bp, Rattus norvegicus
gatagtctccaggatttggaaacac

SEQ ID NO: 359674 - DNA, 25 bp, Rattus norvegicus
gatagtctcttcataaactgcacat

SEQ ID NO: 359675 - DNA, 25 bp, Rattus norvegicus
gatagtctcttcttaaactgcacat

SEQ ID NO: 359676 - DNA, 25 bp, Rattus norvegicus
gatagtctgattctcctgtgtgccc

SEQ ID NO: 359677 - DNA, 25 bp, Rattus norvegicus
gatagtctgattgtcctgtgtgccc

SEQ ID NO: 359678 - DNA, 25 bp, Rattus norvegicus
gatagtctgcttctactacatagat

SEQ ID NO: 359679 - DNA, 25 bp, Rattus norvegicus
gatagtctgcttgtactacatagat

SEQ ID NO: 359680 - DNA, 25 bp, Rattus norvegicus
gatagtcttctacatgtggcatccc

SEQ ID NO: 359681 - DNA, 25 bp, Rattus norvegicus
gatagtcttctagatgtggcatccc

SEQ ID NO: 359682 - DNA, 25 bp, Rattus norvegicus
gatagtcttcttattggtgtcctga

SEQ ID NO: 359683 - DNA, 25 bp, Rattus norvegicus
gatagtcttctttttggtgtcctga

SEQ ID NO: 359684 - DNA, 25 bp, Rattus norvegicus
gatagtctttgccttcacactgaac

SEQ ID NO: 359685 - DNA, 25 bp, Rattus norvegicus
gatagtctttgcgttcacactgaac

SEQ ID NO: 359686 - DNA, 25 bp, Rattus norvegicus
gatagtgaacatcctcccatgattc

SEQ ID NO: 359687 - DNA, 25 bp, Rattus norvegicus
gatagtgaacatgctcccatgattc

SEQ ID NO: 359688 - DNA, 25 bp, Rattus norvegicus
gatagtgacagaagtaccccgcttg

SEQ ID NO: 359689 - DNA, 25 bp, Rattus norvegicus
gatagtgacagatgtaccccgcttg

SEQ ID NO: 359690 - DNA, 25 bp, Rattus norvegicus
gatagtgacatcatagcttatggta

SEQ ID NO: 359691 - DNA, 25 bp, Rattus norvegicus
gatagtgacatcttagcttatggta

SEQ ID NO: 359692 - DNA, 25 bp, Rattus norvegicus
gatagtgcctataccagtggtattg

SEQ ID NO: 359693 - DNA, 25 bp, Rattus norvegicus
gatagtgcctattccagtggtattg

SEQ ID NO: 359694 - DNA, 25 bp, Rattus norvegicus
gatagtggaaaacagtccttttacg

SEQ ID NO: 359695 - DNA, 25 bp, Rattus norvegicus
gatagtggaaaagagtccttttacg

SEQ ID NO: 359696 - DNA, 25 bp, Rattus norvegicus
gatagtggcagaactcagctcattt

SEQ ID NO: 359697 - DNA, 25 bp, Rattus norvegicus
gatagtggcagatctcagctcattt

SEQ ID NO: 359698 - DNA, 25 bp, Rattus norvegicus
gatagtgggacccttttatgacatt

SEQ ID NO: 359699 - DNA, 25 bp, Rattus norvegicus
gatagtgggaccgttttatgacatt

SEQ ID NO: 359700 - DNA, 25 bp, Rattus norvegicus
gatagtgggttcactgtgtgcaatt

SEQ ID NO: 359701 - DNA, 25 bp, Rattus norvegicus
gatagtgggttctctgtgtgcaatt

SEQ ID NO: 359702 - DNA, 25 bp, Rattus norvegicus
gatagtggtaggagcttccatcggt

SEQ ID NO: 359703 - DNA, 25 bp, Rattus norvegicus
gatagtggtaggtgcttccatcggt

SEQ ID NO: 359704 - DNA, 25 bp, Rattus norvegicus
gatagtggttgcagcctgagaccct

SEQ ID NO: 359705 - DNA, 25 bp, Rattus norvegicus
gatagtggttgctgcctgagaccct

SEQ ID NO: 359706 - DNA, 25 bp, Rattus norvegicus
gatagtgtaaatagccctacctacc

SEQ ID NO: 359707 - DNA, 25 bp, Rattus norvegicus
gatagtgtaaattgccctacctacc

SEQ ID NO: 359708 - DNA, 25 bp, Rattus norvegicus
gatagtgtcctaccatcattcacct

SEQ ID NO: 359709 - DNA, 25 bp, Rattus norvegicus
gatagtgtcctagcatcattcacct

SEQ ID NO: 359710 - DNA, 25 bp, Rattus norvegicus
gatagtgtcgaactcttgtgtacct

SEQ ID NO: 359711 - DNA, 25 bp, Rattus norvegicus
gatagtgtcgaagtcttgtgtacct

SEQ ID NO: 359712 - DNA, 25 bp, Rattus norvegicus
gatagtgtgtgccaatatagccaag

SEQ ID NO: 359713 - DNA, 25 bp, Rattus norvegicus
gatagtgtgtgcgaatatagccaag

SEQ ID NO: 359714 - DNA, 25 bp, Rattus norvegicus
gatagtgtgttaaacctgttggcct

SEQ ID NO: 359715 - DNA, 25 bp, Rattus norvegicus
gatagtgtgttatacctgttggcct

SEQ ID NO: 359716 - DNA, 25 bp, Rattus norvegicus
gatagtgtgttgaattcttctccag

SEQ ID NO: 359717 - DNA, 25 bp, Rattus norvegicus
gatagtgtgttgtattcttctccag

SEQ ID NO: 359718 - DNA, 25 bp, Rattus norvegicus
gatagtgttccaccagtgtttagtt

SEQ ID NO: 359719 - DNA, 25 bp, Rattus norvegicus
gatagtgttccagcagtgtttagtt

SEQ ID NO: 359720 - DNA, 25 bp, Rattus norvegicus
gatagttaccctctctgtaatacat

SEQ ID NO: 359721 - DNA, 25 bp, Rattus norvegicus
gatagttaccctgtctgtaatacat

SEQ ID NO: 359722 - DNA, 25 bp, Rattus norvegicus
gatagttaccgcagtgattaccagg

SEQ ID NO: 359723 - DNA, 25 bp, Rattus norvegicus
gatagttaccgctgtgattaccagg

SEQ ID NO: 359724 - DNA, 25 bp, Rattus norvegicus
gatagttacctcagatctgcaaacc

SEQ ID NO: 359725 - DNA, 25 bp, Rattus norvegicus
gatagttacctctgatctgcaaacc

SEQ ID NO: 359726 - DNA, 25 bp, Rattus norvegicus
gatagttaggtcatactcacttgaa

SEQ ID NO: 359727 - DNA, 25 bp, Rattus norvegicus
gatagttaggtcttactcacttgaa

SEQ ID NO: 359728 - DNA, 25 bp, Rattus norvegicus
gatagttataaaaactggcgatctg

SEQ ID NO: 359729 - DNA, 25 bp, Rattus norvegicus
gatagttataaatactggcgatctg

SEQ ID NO: 359730 - DNA, 25 bp, Rattus norvegicus
gatagttcaaagcagcgcgtgtgct

SEQ ID NO: 359731 - DNA, 25 bp, Rattus norvegicus
gatagttcaaaggagcgcgtgtgct

SEQ ID NO: 359732 - DNA, 25 bp, Rattus norvegicus
gatagttcaaatacagacactgtcc

SEQ ID NO: 359733 - DNA, 25 bp, Rattus norvegicus
gatagttcaaattcagacactgtcc

SEQ ID NO: 359734 - DNA, 25 bp, Rattus norvegicus
gatagttcacagctcttgagcagcc

SEQ ID NO: 359735 - DNA, 25 bp, Rattus norvegicus
gatagttcacaggtcttgagcagcc

SEQ ID NO: 359736 - DNA, 25 bp, Rattus norvegicus
gatagttcagatcacagtgatttta

SEQ ID NO: 359737 - DNA, 25 bp, Rattus norvegicus
gatagttcagatgacagtgatttta

SEQ ID NO: 359738 - DNA, 25 bp, Rattus norvegicus
gatagttcagctaaccctaaggttt

SEQ ID NO: 359739 - DNA, 25 bp, Rattus norvegicus
gatagttcagcttaccctaaggttt

SEQ ID NO: 359740 - DNA, 25 bp, Rattus norvegicus
gatagttcagtcaagttctctcttc

SEQ ID NO: 359741 - DNA, 25 bp, Rattus norvegicus
gatagttcagtctagttctctcttc

SEQ ID NO: 359742 - DNA, 25 bp, Rattus norvegicus
gatagttccaaaaccacatctaaat

SEQ ID NO: 359743 - DNA, 25 bp, Rattus norvegicus
gatagttccaaatccacatctaaat

SEQ ID NO: 359744 - DNA, 25 bp, Rattus norvegicus
gatagttccagaattctcttaaaag

SEQ ID NO: 359745 - DNA, 25 bp, Rattus norvegicus
gatagttccagatttctcttaaaag

SEQ ID NO: 359746 - DNA, 25 bp, Rattus norvegicus
gatagttcccagcttgtgtattatg

SEQ ID NO: 359747 - DNA, 25 bp, Rattus norvegicus
gatagttcccaggttgtgtattatg

SEQ ID NO: 359748 - DNA, 25 bp, Rattus norvegicus
gatagttccctgagctcatgcttac

SEQ ID NO: 359749 - DNA, 25 bp, Rattus norvegicus
gatagttccctgtgctcatgcttac

SEQ ID NO: 359750 - DNA, 25 bp, Rattus norvegicus
gatagttccgctctgtcggtgtcag

SEQ ID NO: 359751 - DNA, 25 bp, Rattus norvegicus
gatagttccgctgtgtcggtgtcag

SEQ ID NO: 359752 - DNA, 25 bp, Rattus norvegicus
gatagttcgactagtaattataaga

SEQ ID NO: 359753 - DNA, 25 bp, Rattus norvegicus
gatagttcgacttgtaattataaga

SEQ ID NO: 359754 - DNA, 25 bp, Rattus norvegicus
gatagttctcccataagcaacctca

SEQ ID NO: 359755 - DNA, 25 bp, Rattus norvegicus
gatagttctcccttaagcaacctca

SEQ ID NO: 359756 - DNA, 25 bp, Rattus norvegicus
gatagttgtgagactgtgtttactc

SEQ ID NO: 359757 - DNA, 25 bp, Rattus norvegicus
gatagttgtgagtctgtgtttactc

SEQ ID NO: 359758 - DNA, 25 bp, Rattus norvegicus
gatagtttaaccctgtacaaatgca

SEQ ID NO: 359759 - DNA, 25 bp, Rattus norvegicus
gatagtttaaccgtgtacaaatgca

SEQ ID NO: 359760 - DNA, 25 bp, Rattus norvegicus
gatagtttcggtattttgacattga

SEQ ID NO: 359761 - DNA, 25 bp, Rattus norvegicus
gatagtttcggttttttgacattga

SEQ ID NO: 359762 - DNA, 25 bp, Rattus norvegicus
gatagtttctccacgtttgataccc

SEQ ID NO: 359763 - DNA, 25 bp, Rattus norvegicus
gatagtttctcctcgtttgataccc

SEQ ID NO: 359764 - DNA, 25 bp, Rattus norvegicus
gatagtttctgaattctagctgctt

SEQ ID NO: 359765 - DNA, 25 bp, Rattus norvegicus
gatagtttctgatttctagctgctt

SEQ ID NO: 359766 - DNA, 25 bp, Rattus norvegicus
gatagtttgcatagaactctggttt

SEQ ID NO: 359767 - DNA, 25 bp, Rattus norvegicus
gatagtttgcattgaactctggttt

SEQ ID NO: 359768 - DNA, 25 bp, Rattus norvegicus
gatagtttgtctcgattaccaaaat

SEQ ID NO: 359769 - DNA, 25 bp, Rattus norvegicus
gatagtttgtctggattaccaaaat

SEQ ID NO: 359770 - DNA, 25 bp, Rattus norvegicus
gatagttttctcaaggcttattctg

SEQ ID NO: 359771 - DNA, 25 bp, Rattus norvegicus
gatagttttctctaggcttattctg

SEQ ID NO: 359772 - DNA, 25 bp, Rattus norvegicus
gatagttttgctctatttgtgttca

SEQ ID NO: 359773 - DNA, 25 bp, Rattus norvegicus
gatagttttgctgtatttgtgttca

SEQ ID NO: 359774 - DNA, 25 bp, Rattus norvegicus
gatagtttttccaagcatcttcttc

SEQ ID NO: 359775 - DNA, 25 bp, Rattus norvegicus
gatagtttttcctagcatcttcttc

SEQ ID NO: 359776 - DNA, 25 bp, Rattus norvegicus
gatagtttttctcagatcttcgatg

SEQ ID NO: 359777 - DNA, 25 bp, Rattus norvegicus
gatagtttttctgagatcttcgatg

SEQ ID NO: 359778 - DNA, 25 bp, Rattus norvegicus
gatataaaccttaccgaagcgccac

SEQ ID NO: 359779 - DNA, 25 bp, Rattus norvegicus
gatataaacctttccgaagcgccac

SEQ ID NO: 359780 - DNA, 25 bp, Rattus norvegicus
gatataaatcgcctaatgtctacaa

SEQ ID NO: 359781 - DNA, 25 bp, Rattus norvegicus
gatataaatcgcgtaatgtctacaa

SEQ ID NO: 359782 - DNA, 25 bp, Rattus norvegicus
gatataaatttcatcactttaaaat

SEQ ID NO: 359783 - DNA, 25 bp, Rattus norvegicus
gatataaatttcttcactttaaaat

SEQ ID NO: 359784 - DNA, 25 bp, Rattus norvegicus
gatataagcagcagctcaattccat

SEQ ID NO: 359785 - DNA, 25 bp, Rattus norvegicus
gatataagcagctgctcaattccat

SEQ ID NO: 359786 - DNA, 25 bp, Rattus norvegicus
gatataagccctacaactcagtcct

SEQ ID NO: 359787 - DNA, 25 bp, Rattus norvegicus
gatataagcccttcaactcagtcct

SEQ ID NO: 359788 - DNA, 25 bp, Rattus norvegicus
gatataatactgaccctgctgagaa

SEQ ID NO: 359789 - DNA, 25 bp, Rattus norvegicus
gatataatactgtccctgctgagaa

SEQ ID NO: 359790 - DNA, 25 bp, Rattus norvegicus
gatataatgtgcatctgcctgtcag

SEQ ID NO: 359791 - DNA, 25 bp, Rattus norvegicus
gatataatgtgcttctgcctgtcag

SEQ ID NO: 359792 - DNA, 25 bp, Rattus norvegicus
gatataatttccagccttcaagtca

SEQ ID NO: 359793 - DNA, 25 bp, Rattus norvegicus
gatataatttcctgccttcaagtca

SEQ ID NO: 359794 - DNA, 25 bp, Rattus norvegicus
gatatacaattcacagctgcctaac

SEQ ID NO: 359795 - DNA, 25 bp, Rattus norvegicus
gatatacaattctcagctgcctaac

SEQ ID NO: 359796 - DNA, 25 bp, Rattus norvegicus
gatatacacgtgctacaggactgag

SEQ ID NO: 359797 - DNA, 25 bp, Rattus norvegicus
gatatacacgtggtacaggactgag

SEQ ID NO: 359798 - DNA, 25 bp, Rattus norvegicus
gatatacagattccagactcgccgg

SEQ ID NO: 359799 - DNA, 25 bp, Rattus norvegicus
gatatacagattgcagactcgccgg

SEQ ID NO: 359800 - DNA, 25 bp, Rattus norvegicus
gatatacatccaattttctaagcta

SEQ ID NO: 359801 - DNA, 25 bp, Rattus norvegicus
gatatacatccacgtgagctttcaa

SEQ ID NO: 359802 - DNA, 25 bp, Rattus norvegicus
gatatacatccaggtgagctttcaa

SEQ ID NO: 359803 - DNA, 25 bp, Rattus norvegicus
gatatacatccatttttctaagcta

SEQ ID NO: 359804 - DNA, 25 bp, Rattus norvegicus
gatatacatctcaatttccagaaca

SEQ ID NO: 359805 - DNA, 25 bp, Rattus norvegicus
gatatacatctctatttccagaaca

SEQ ID NO: 359806 - DNA, 25 bp, Rattus norvegicus
gatataccatcaaacctgactcctt

SEQ ID NO: 359807 - DNA, 25 bp, Rattus norvegicus
gatataccatcacagccagcacact

SEQ ID NO: 359808 - DNA, 25 bp, Rattus norvegicus
gatataccatcagagccagcacact

SEQ ID NO: 359809 - DNA, 25 bp, Rattus norvegicus
gatataccatcatacctgactcctt

SEQ ID NO: 359810 - DNA, 25 bp, Rattus norvegicus
gatatacccaccaggaccaggatga

SEQ ID NO: 359811 - DNA, 25 bp, Rattus norvegicus
gatatacccacctggaccaggatga

SEQ ID NO: 359812 - DNA, 25 bp, Rattus norvegicus
gatatacctaacatttgctttagag

SEQ ID NO: 359813 - DNA, 25 bp, Rattus norvegicus
gatatacctaacttttgctttagag

SEQ ID NO: 359814 - DNA, 25 bp, Rattus norvegicus
gatatacctatccatttgtcttcag

SEQ ID NO: 359815 - DNA, 25 bp, Rattus norvegicus
gatatacctatcgatttgtcttcag

SEQ ID NO: 359816 - DNA, 25 bp, Rattus norvegicus
gatatacctgcgaagtagctctgtc

SEQ ID NO: 359817 - DNA, 25 bp, Rattus norvegicus
gatatacctgcgtagtagctctgtc

SEQ ID NO: 359818 - DNA, 25 bp, Rattus norvegicus
gatataccttcacaaatgtccccag

SEQ ID NO: 359819 - DNA, 25 bp, Rattus norvegicus
gatataccttcagaaatgtccccag

SEQ ID NO: 359820 - DNA, 25 bp, Rattus norvegicus
gatatacgttttctttggagccaat

SEQ ID NO: 359821 - DNA, 25 bp, Rattus norvegicus
gatatacgttttgtttggagccaat

SEQ ID NO: 359822 - DNA, 25 bp, Rattus norvegicus
gatatactcctgaacagtccatctc

SEQ ID NO: 359823 - DNA, 25 bp, Rattus norvegicus
gatatactcctgtacagtccatctc

SEQ ID NO: 359824 - DNA, 25 bp, Rattus norvegicus
gatatactgacgagttccttttaat

SEQ ID NO: 359825 - DNA, 25 bp, Rattus norvegicus
gatatactgacgtgttccttttaat

SEQ ID NO: 359826 - DNA, 25 bp, Rattus norvegicus
gatatacttccgctgaactcatgtg

SEQ ID NO: 359827 - DNA, 25 bp, Rattus norvegicus
gatatacttccggtgaactcatgtg

SEQ ID NO: 359828 - DNA, 25 bp, Rattus norvegicus
gatatactttgcatgtgatcccgta

SEQ ID NO: 359829 - DNA, 25 bp, Rattus norvegicus
gatatactttgcttgtgatcccgta

SEQ ID NO: 359830 - DNA, 25 bp, Rattus norvegicus
gatatagaaaccagaggacctgagt

SEQ ID NO: 359831 - DNA, 25 bp, Rattus norvegicus
gatatagaaacctgaggacctgagt

SEQ ID NO: 359832 - DNA, 25 bp, Rattus norvegicus
gatatagaagagagcacttttgtat

SEQ ID NO: 359833 - DNA, 25 bp, Rattus norvegicus
gatatagaagagtgcacttttgtat

SEQ ID NO: 359834 - DNA, 25 bp, Rattus norvegicus
gatatagaaggtcacttacggccag

SEQ ID NO: 359835 - DNA, 25 bp, Rattus norvegicus
gatatagaaggtgacttacggccag

SEQ ID NO: 359836 - DNA, 25 bp, Rattus norvegicus
gatatagaatgaacatccctcggtg

SEQ ID NO: 359837 - DNA, 25 bp, Rattus norvegicus
gatatagaatgatcatccctcggtg

SEQ ID NO: 359838 - DNA, 25 bp, Rattus norvegicus
gatatagacattcccagactggcag

SEQ ID NO: 359839 - DNA, 25 bp, Rattus norvegicus
gatatagacattgccagactggcag

SEQ ID NO: 359840 - DNA, 25 bp, Rattus norvegicus
gatatagaccttcacacagaaacag

SEQ ID NO: 359841 - DNA, 25 bp, Rattus norvegicus
gatatagaccttgacacagaaacag

SEQ ID NO: 359842 - DNA, 25 bp, Rattus norvegicus
gatatagattgtatctggaccagtt

SEQ ID NO: 359843 - DNA, 25 bp, Rattus norvegicus
gatatagattgtttctggaccagtt

SEQ ID NO: 359844 - DNA, 25 bp, Rattus norvegicus
gatatagcagagactacccttccag

SEQ ID NO: 359845 - DNA, 25 bp, Rattus norvegicus
gatatagcagagtctacccttccag

SEQ ID NO: 359846 - DNA, 25 bp, Rattus norvegicus
gatatagcaggtcccgccttcggaa

SEQ ID NO: 359847 - DNA, 25 bp, Rattus norvegicus
gatatagcaggtgccgccttcggaa

SEQ ID NO: 359848 - DNA, 25 bp, Rattus norvegicus
gatatagctcagcttagtctttttt

SEQ ID NO: 359849 - DNA, 25 bp, Rattus norvegicus
gatatagctcaggttagtctttttt

SEQ ID NO: 359850 - DNA, 25 bp, Rattus norvegicus
gatatagctgccagtttcctctgca

SEQ ID NO: 359851 - DNA, 25 bp, Rattus norvegicus
gatatagctgcctgtttcctctgca

SEQ ID NO: 359852 - DNA, 25 bp, Rattus norvegicus
gatatagctgtgaaccgtgtgactg

SEQ ID NO: 359853 - DNA, 25 bp, Rattus norvegicus
gatatagctgtgtaccgtgtgactg

SEQ ID NO: 359854 - DNA, 25 bp, Rattus norvegicus
gatatagtaaccagttgtgtccttt

SEQ ID NO: 359855 - DNA, 25 bp, Rattus norvegicus
gatatagtaacctgttgtgtccttt

SEQ ID NO: 359856 - DNA, 25 bp, Rattus norvegicus
gatatagtataacacttcccttttt

SEQ ID NO: 359857 - DNA, 25 bp, Rattus norvegicus
gatatagtataagacttcccttttt

SEQ ID NO: 359858 - DNA, 25 bp, Rattus norvegicus
gatatagtcaagataaactccgaaa

SEQ ID NO: 359859 - DNA, 25 bp, Rattus norvegicus
gatatagtcaagttaaactccgaaa

SEQ ID NO: 359860 - DNA, 25 bp, Rattus norvegicus
gatatagtccaaattcaacaaggag

SEQ ID NO: 359861 - DNA, 25 bp, Rattus norvegicus
gatatagtccaatttcaacaaggag

SEQ ID NO: 359862 - DNA, 25 bp, Rattus norvegicus
gatatagttttaattcagaacccag

SEQ ID NO: 359863 - DNA, 25 bp, Rattus norvegicus
gatatagttttatttcagaacccag

SEQ ID NO: 359864 - DNA, 25 bp, Rattus norvegicus
gatatataaacgataaggcctgcta

SEQ ID NO: 359865 - DNA, 25 bp, Rattus norvegicus
gatatataaacgttaaggcctgcta

SEQ ID NO: 359866 - DNA, 25 bp, Rattus norvegicus
gatatataccatatctcccaaaagg

SEQ ID NO: 359867 - DNA, 25 bp, Rattus norvegicus
gatatataccatttctcccaaaagg

SEQ ID NO: 359868 - DNA, 25 bp, Rattus norvegicus
gatatatagcttccttctgttctct

SEQ ID NO: 359869 - DNA, 25 bp, Rattus norvegicus
gatatatagcttgcttctgttctct

SEQ ID NO: 359870 - DNA, 25 bp, Rattus norvegicus
gatatatagggccacctggagctga

SEQ ID NO: 359871 - DNA, 25 bp, Rattus norvegicus
gatatatagggcgacctggagctga

SEQ ID NO: 359872 - DNA, 25 bp, Rattus norvegicus
gatatatatctcatgtattgcataa

SEQ ID NO: 359873 - DNA, 25 bp, Rattus norvegicus
gatatatatctcttgtattgcataa

SEQ ID NO: 359874 - DNA, 25 bp, Rattus norvegicus
gatatatatctgcactctcctgtat

SEQ ID NO: 359875 - DNA, 25 bp, Rattus norvegicus
gatatatatctggactctcctgtat

SEQ ID NO: 359876 - DNA, 25 bp, Rattus norvegicus
gatatatcagccactttaacactta

SEQ ID NO: 359877 - DNA, 25 bp, Rattus norvegicus
gatatatcagcctctttaacactta

SEQ ID NO: 359878 - DNA, 25 bp, Rattus norvegicus
gatatatcatgtagggtatactcct

SEQ ID NO: 359879 - DNA, 25 bp, Rattus norvegicus
gatatatcatgttgggtatactcct

SEQ ID NO: 359880 - DNA, 25 bp, Rattus norvegicus
gatatatcatttagtttaacctttt

SEQ ID NO: 359881 - DNA, 25 bp, Rattus norvegicus
gatatatcattttgtttaacctttt

SEQ ID NO: 359882 - DNA, 25 bp, Rattus norvegicus
gatatatccagcactgtgcttgtct

SEQ ID NO: 359883 - DNA, 25 bp, Rattus norvegicus
gatatatccagctctgtgcttgtct

SEQ ID NO: 359884 - DNA, 25 bp, Rattus norvegicus
gatatatcccttcatgtgatactca

SEQ ID NO: 359885 - DNA, 25 bp, Rattus norvegicus
gatatatcccttgatgtgatactca

SEQ ID NO: 359886 - DNA, 25 bp, Rattus norvegicus
gatatatctaccagtttgcttgcct

SEQ ID NO: 359887 - DNA, 25 bp, Rattus norvegicus
gatatatctacctgtttgcttgcct

SEQ ID NO: 359888 - DNA, 25 bp, Rattus norvegicus
gatatatggctcaattctccgtagg

SEQ ID NO: 359889 - DNA, 25 bp, Rattus norvegicus
gatatatggctctattctccgtagg

SEQ ID NO: 359890 - DNA, 25 bp, Rattus norvegicus
gatatatgtgtcaggtaagagaaca

SEQ ID NO: 359891 - DNA, 25 bp, Rattus norvegicus
gatatatgtgtctggtaagagaaca

SEQ ID NO: 359892 - DNA, 25 bp, Rattus norvegicus
gatatatgttcaaactctgaagcaa

SEQ ID NO: 359893 - DNA, 25 bp, Rattus norvegicus
gatatatgttcatactctgaagcaa

SEQ ID NO: 359894 - DNA, 25 bp, Rattus norvegicus
gatatattaatgatcctctgagtgg

SEQ ID NO: 359895 - DNA, 25 bp, Rattus norvegicus
gatatattaatgttcctctgagtgg

SEQ ID NO: 359896 - DNA, 25 bp, Rattus norvegicus
gatatattacatcacctgctcggtg

SEQ ID NO: 359897 - DNA, 25 bp, Rattus norvegicus
gatatattacatgacctgctcggtg

SEQ ID NO: 359898 - DNA, 25 bp, Rattus norvegicus
gatatattaccgaattgcttccaaa

SEQ ID NO: 359899 - DNA, 25 bp, Rattus norvegicus
gatatattaccgtattgcttccaaa

SEQ ID NO: 359900 - DNA, 25 bp, Rattus norvegicus
gatatattatatagccaactctgtt

SEQ ID NO: 359901 - DNA, 25 bp, Rattus norvegicus
gatatattatattgccaactctgtt

SEQ ID NO: 359902 - DNA, 25 bp, Rattus norvegicus
gatatattctctatcggatgcctta

SEQ ID NO: 359903 - DNA, 25 bp, Rattus norvegicus
gatatattctctttcggatgcctta

SEQ ID NO: 359904 - DNA, 25 bp, Rattus norvegicus
gatatattggtgaaggcggatctcc

SEQ ID NO: 359905 - DNA, 25 bp, Rattus norvegicus
gatatattggtgtaggcggatctcc

SEQ ID NO: 359906 - DNA, 25 bp, Rattus norvegicus
gatatattgtgtcgccagaccctaa

SEQ ID NO: 359907 - DNA, 25 bp, Rattus norvegicus
gatatattgtgtctggctttcccgg

SEQ ID NO: 359908 - DNA, 25 bp, Rattus norvegicus
gatatattgtgtggccagaccctaa

SEQ ID NO: 359909 - DNA, 25 bp, Rattus norvegicus
gatatattgtgtgtggctttcccgg

SEQ ID NO: 359910 - DNA, 25 bp, Rattus norvegicus
gatatatttaccacccaatctgggt

SEQ ID NO: 359911 - DNA, 25 bp, Rattus norvegicus
gatatatttacctcccaatctgggt

SEQ ID NO: 359912 - DNA, 25 bp, Rattus norvegicus
gatatcaaaactaggctacgcagca

SEQ ID NO: 359913 - DNA, 25 bp, Rattus norvegicus
gatatcaaaacttggctacgcagca

SEQ ID NO: 359914 - DNA, 25 bp, Rattus norvegicus
gatatcaaccagaacattcaccaac

SEQ ID NO: 359915 - DNA, 25 bp, Rattus norvegicus
gatatcaaccagtacattcaccaac

SEQ ID NO: 359916 - DNA, 25 bp, Rattus norvegicus
gatatcaaccctattcagctacagt

SEQ ID NO: 359917 - DNA, 25 bp, Rattus norvegicus
gatatcaacccttttcagctacagt

SEQ ID NO: 359918 - DNA, 25 bp, Rattus norvegicus
gatatcaacctgaccgttgctttga

SEQ ID NO: 359919 - DNA, 25 bp, Rattus norvegicus
gatatcaacctgtccgttgctttga

SEQ ID NO: 359920 - DNA, 25 bp, Rattus norvegicus
gatatcaagccaagtgctgctgccc

SEQ ID NO: 359921 - DNA, 25 bp, Rattus norvegicus
gatatcaagccatgtgctgctgccc

SEQ ID NO: 359922 - DNA, 25 bp, Rattus norvegicus
gatatcacaactaactgatcagtta

SEQ ID NO: 359923 - DNA, 25 bp, Rattus norvegicus
gatatcacaactagagcacgggcgt

SEQ ID NO: 359924 - DNA, 25 bp, Rattus norvegicus
gatatcacaacttactgatcagtta

SEQ ID NO: 359925 - DNA, 25 bp, Rattus norvegicus
gatatcacaacttgagcacgggcgt

SEQ ID NO: 359926 - DNA, 25 bp, Rattus norvegicus
gatatcacacttcagaactgagaac

SEQ ID NO: 359927 - DNA, 25 bp, Rattus norvegicus
gatatcacacttgagaactgagaac

SEQ ID NO: 359928 - DNA, 25 bp, Rattus norvegicus
gatatcaccaccctatactgcaaaa

SEQ ID NO: 359929 - DNA, 25 bp, Rattus norvegicus
gatatcaccaccgtatactgcaaaa

SEQ ID NO: 359930 - DNA, 25 bp, Rattus norvegicus
gatatcacccttctactgaagactt

SEQ ID NO: 359931 - DNA, 25 bp, Rattus norvegicus
gatatcacccttgtactgaagactt

SEQ ID NO: 359932 - DNA, 25 bp, Rattus norvegicus
gatatcacgagtctcactttcatta

SEQ ID NO: 359933 - DNA, 25 bp, Rattus norvegicus
gatatcacgagtgtcactttcatta

SEQ ID NO: 359934 - DNA, 25 bp, Rattus norvegicus
gatatcactcctccaaggctagaga

SEQ ID NO: 359935 - DNA, 25 bp, Rattus norvegicus
gatatcactcctgcaaggctagaga

SEQ ID NO: 359936 - DNA, 25 bp, Rattus norvegicus
gatatcactgatatccactcctctt

SEQ ID NO: 359937 - DNA, 25 bp, Rattus norvegicus
gatatcactgatttccactcctctt

SEQ ID NO: 359938 - DNA, 25 bp, Rattus norvegicus
gatatcactttaattgaacaccaca

SEQ ID NO: 359939 - DNA, 25 bp, Rattus norvegicus
gatatcactttatttgaacaccaca

SEQ ID NO: 359940 - DNA, 25 bp, Rattus norvegicus
gatatcactttcagaacttcagggt

SEQ ID NO: 359941 - DNA, 25 bp, Rattus norvegicus
gatatcactttctgaacttcagggt

SEQ ID NO: 359942 - DNA, 25 bp, Rattus norvegicus
gatatcagaactcacacaattgcac

SEQ ID NO: 359943 - DNA, 25 bp, Rattus norvegicus
gatatcagaactgacacaattgcac

SEQ ID NO: 359944 - DNA, 25 bp, Rattus norvegicus
gatatcagcaacactacttgtcaac

SEQ ID NO: 359945 - DNA, 25 bp, Rattus norvegicus
gatatcagcaactctacttgtcaac

SEQ ID NO: 359946 - DNA, 25 bp, Rattus norvegicus
gatatcagctaccaaacttccagag

SEQ ID NO: 359947 - DNA, 25 bp, Rattus norvegicus
gatatcagctacgaaacttccagag

SEQ ID NO: 359948 - DNA, 25 bp, Rattus norvegicus
gatatcaggctgatctagagtcaaa

SEQ ID NO: 359949 - DNA, 25 bp, Rattus norvegicus
gatatcaggctgttctagagtcaaa

SEQ ID NO: 359950 - DNA, 25 bp, Rattus norvegicus
gatatcagtccacgctttacatttt

SEQ ID NO: 359951 - DNA, 25 bp, Rattus norvegicus
gatatcagtccaggctttacatttt

SEQ ID NO: 359952 - DNA, 25 bp, Rattus norvegicus
gatatcagtgccactgacatcagtg

SEQ ID NO: 359953 - DNA, 25 bp, Rattus norvegicus
gatatcagtgcctctgacatcagtg

SEQ ID NO: 359954 - DNA, 25 bp, Rattus norvegicus
gatatcagtgtgaccagagtgcagg

SEQ ID NO: 359955 - DNA, 25 bp, Rattus norvegicus
gatatcagtgtgtccagagtgcagg

SEQ ID NO: 359956 - DNA, 25 bp, Rattus norvegicus
gatatcagtgttcgagtgctgcact

SEQ ID NO: 359957 - DNA, 25 bp, Rattus norvegicus
gatatcagtgttggagtgctgcact

SEQ ID NO: 359958 - DNA, 25 bp, Rattus norvegicus
gatatcagttctcatcaaataggta

SEQ ID NO: 359959 - DNA, 25 bp, Rattus norvegicus
gatatcagttctgatcaaataggta

SEQ ID NO: 359960 - DNA, 25 bp, Rattus norvegicus
gatatcatacatcgtcagcagcctt

SEQ ID NO: 359961 - DNA, 25 bp, Rattus norvegicus
gatatcatacatggtcagcagcctt

SEQ ID NO: 359962 - DNA, 25 bp, Rattus norvegicus
gatatcatagttctgtggtagccat

SEQ ID NO: 359963 - DNA, 25 bp, Rattus norvegicus
gatatcatagttgtgtggtagccat

SEQ ID NO: 359964 - DNA, 25 bp, Rattus norvegicus
gatatcatcagcagtgtcatacgcc

SEQ ID NO: 359965 - DNA, 25 bp, Rattus norvegicus
gatatcatcagctgtgtcatacgcc

SEQ ID NO: 359966 - DNA, 25 bp, Rattus norvegicus
gatatcatctgacgtgtttcttctt

SEQ ID NO: 359967 - DNA, 25 bp, Rattus norvegicus
gatatcatctgaggtgtttcttctt

SEQ ID NO: 359968 - DNA, 25 bp, Rattus norvegicus
gatatcatgatccacagtcccaggg

SEQ ID NO: 359969 - DNA, 25 bp, Rattus norvegicus
gatatcatgatcgacagtcccaggg

SEQ ID NO: 359970 - DNA, 25 bp, Rattus norvegicus
gatatcatgctcaatcatcagaaga

SEQ ID NO: 359971 - DNA, 25 bp, Rattus norvegicus
gatatcatgctctatcatcagaaga

SEQ ID NO: 359972 - DNA, 25 bp, Rattus norvegicus
gatatcatgcttcgtacttggaatt

SEQ ID NO: 359973 - DNA, 25 bp, Rattus norvegicus
gatatcatgcttggtacttggaatt

SEQ ID NO: 359974 - DNA, 25 bp, Rattus norvegicus
gatatcatggtaagttcctcacaag

SEQ ID NO: 359975 - DNA, 25 bp, Rattus norvegicus
gatatcatggtatgttcctcacaag

SEQ ID NO: 359976 - DNA, 25 bp, Rattus norvegicus
gatatcatgtacatgtctggctatt

SEQ ID NO: 359977 - DNA, 25 bp, Rattus norvegicus
gatatcatgtacttgtctggctatt

SEQ ID NO: 359978 - DNA, 25 bp, Rattus norvegicus
gatatcattggtatagctggcgaat

SEQ ID NO: 359979 - DNA, 25 bp, Rattus norvegicus
gatatcattggtttagctggcgaat

SEQ ID NO: 359980 - DNA, 25 bp, Rattus norvegicus
gatatcattgtgcagaggtggtcta

SEQ ID NO: 359981 - DNA, 25 bp, Rattus norvegicus
gatatcattgtggagaggtggtcta

SEQ ID NO: 359982 - DNA, 25 bp, Rattus norvegicus
gatatcatttccagttctttctata

SEQ ID NO: 359983 - DNA, 25 bp, Rattus norvegicus
gatatcatttcctgttctttctata

SEQ ID NO: 359984 - DNA, 25 bp, Rattus norvegicus
gatatcatttctctgtgggcttctg

SEQ ID NO: 359985 - DNA, 25 bp, Rattus norvegicus
gatatcatttctgtgtgggcttctg

SEQ ID NO: 359986 - DNA, 25 bp, Rattus norvegicus
gatatccaaccacggaagccaagag

SEQ ID NO: 359987 - DNA, 25 bp, Rattus norvegicus
gatatccaaccagggaagccaagag

SEQ ID NO: 359988 - DNA, 25 bp, Rattus norvegicus
gatatccaactcatcttttgagcat

SEQ ID NO: 359989 - DNA, 25 bp, Rattus norvegicus
gatatccaactcttcttttgagcat

SEQ ID NO: 359990 - DNA, 25 bp, Rattus norvegicus
gatatccaagtcaatatgcctgaag

SEQ ID NO: 359991 - DNA, 25 bp, Rattus norvegicus
gatatccaagtctatatgcctgaag

SEQ ID NO: 359992 - DNA, 25 bp, Rattus norvegicus
gatatccaatatagccagcctggga

SEQ ID NO: 359993 - DNA, 25 bp, Rattus norvegicus
gatatccaatattgccagcctggga

SEQ ID NO: 359994 - DNA, 25 bp, Rattus norvegicus
gatatccacggacaccactttcact

SEQ ID NO: 359995 - DNA, 25 bp, Rattus norvegicus
gatatccacggagaccactttcact

SEQ ID NO: 359996 - DNA, 25 bp, Rattus norvegicus
gatatccactgactcctgccaaggt

SEQ ID NO: 359997 - DNA, 25 bp, Rattus norvegicus
gatatccactgagtcctgccaaggt

SEQ ID NO: 359998 - DNA, 25 bp, Rattus norvegicus
gatatccacttacctcttgtactgt

SEQ ID NO: 359999 - DNA, 25 bp, Rattus norvegicus
gatatccacttagctcttgtactgt

SEQ ID NO: 360000 - DNA, 25 bp, Rattus norvegicus
gatatccagaatcctgcatgggccc

SEQ ID NO: 360001 - DNA, 25 bp, Rattus norvegicus
gatatccagaatgctgcatgggccc

SEQ ID NO: 360002 - DNA, 25 bp, Rattus norvegicus
gatatccagagtattgtgcgatcct

SEQ ID NO: 360003 - DNA, 25 bp, Rattus norvegicus
gatatccagagttttgtgcgatcct

SEQ ID NO: 360004 - DNA, 25 bp, Rattus norvegicus
gatatccagatgcttcagggtacct

SEQ ID NO: 360005 - DNA, 25 bp, Rattus norvegicus
gatatccagatggttcagggtacct

SEQ ID NO: 360006 - DNA, 25 bp, Rattus norvegicus
gatatccagcaaagagcgcaacact

SEQ ID NO: 360007 - DNA, 25 bp, Rattus norvegicus
gatatccagcaatgagcgcaacact

SEQ ID NO: 360008 - DNA, 25 bp, Rattus norvegicus
gatatccagggcattcttttctcac

SEQ ID NO: 360009 - DNA, 25 bp, Rattus norvegicus
gatatccagggctttcttttctcac

SEQ ID NO: 360010 - DNA, 25 bp, Rattus norvegicus
gatatccagtgacgacctagatttt

SEQ ID NO: 360011 - DNA, 25 bp, Rattus norvegicus
gatatccagtgaggacctagatttt

SEQ ID NO: 360012 - DNA, 25 bp, Rattus norvegicus
gatatccagtttaggtggctctaag

SEQ ID NO: 360013 - DNA, 25 bp, Rattus norvegicus
gatatccagttttggtggctctaag

SEQ ID NO: 360014 - DNA, 25 bp, Rattus norvegicus
gatatccataccaaaagactgccct

SEQ ID NO: 360015 - DNA, 25 bp, Rattus norvegicus
gatatccatacctaaagactgccct

SEQ ID NO: 360016 - DNA, 25 bp, Rattus norvegicus
gatatccatgacaagttcgctgaat

SEQ ID NO: 360017 - DNA, 25 bp, Rattus norvegicus
gatatccatgactagttcgctgaat

SEQ ID NO: 360018 - DNA, 25 bp, Rattus norvegicus
gatatccatgccagttttacagaaa

SEQ ID NO: 360019 - DNA, 25 bp, Rattus norvegicus
gatatccatgcctgttttacagaaa

SEQ ID NO: 360020 - DNA, 25 bp, Rattus norvegicus
gatatccatggtatgtttccagcca

SEQ ID NO: 360021 - DNA, 25 bp, Rattus norvegicus
gatatccatggtttgtttccagcca

SEQ ID NO: 360022 - DNA, 25 bp, Rattus norvegicus
gatatcccaatacaaaaggtctata

SEQ ID NO: 360023 - DNA, 25 bp, Rattus norvegicus
gatatcccaatagaaaaggtctata

SEQ ID NO: 360024 - DNA, 25 bp, Rattus norvegicus
gatatcccaatgagagctgagagct

SEQ ID NO: 360025 - DNA, 25 bp, Rattus norvegicus
gatatcccaatgtgagctgagagct

SEQ ID NO: 360026 - DNA, 25 bp, Rattus norvegicus
gatatcccagacatcctagattctg

SEQ ID NO: 360027 - DNA, 25 bp, Rattus norvegicus
gatatcccagacttcctagattctg

SEQ ID NO: 360028 - DNA, 25 bp, Rattus norvegicus
gatatcccagtgattaagcaggcag

SEQ ID NO: 360029 - DNA, 25 bp, Rattus norvegicus
gatatcccagtgtttaagcaggcag

SEQ ID NO: 360030 - DNA, 25 bp, Rattus norvegicus
gatatccccgttactctgaacctgg

SEQ ID NO: 360031 - DNA, 25 bp, Rattus norvegicus
gatatccccgtttctctgaacctgg

SEQ ID NO: 360032 - DNA, 25 bp, Rattus norvegicus
gatatcccctcaaatcagcatttaa

SEQ ID NO: 360033 - DNA, 25 bp, Rattus norvegicus
gatatcccctcatatcagcatttaa

SEQ ID NO: 360034 - DNA, 25 bp, Rattus norvegicus
gatatccccttgcacaaaactgttg

SEQ ID NO: 360035 - DNA, 25 bp, Rattus norvegicus
gatatccccttggacaaaactgttg

SEQ ID NO: 360036 - DNA, 25 bp, Rattus norvegicus
gatatcccgagacatcagcaagttc

SEQ ID NO: 360037 - DNA, 25 bp, Rattus norvegicus
gatatcccgagagatcagcaagttc

SEQ ID NO: 360038 - DNA, 25 bp, Rattus norvegicus
gatatccctcaactctaaggaccct

SEQ ID NO: 360039 - DNA, 25 bp, Rattus norvegicus
gatatccctcaagtctaaggaccct

SEQ ID NO: 360040 - DNA, 25 bp, Rattus norvegicus
gatatccctgcccaaattcgtgatc

SEQ ID NO: 360041 - DNA, 25 bp, Rattus norvegicus
gatatccctgccgaaattcgtgatc

SEQ ID NO: 360042 - DNA, 25 bp, Rattus norvegicus
gatatccgagtcaatgaactgtagg

SEQ ID NO: 360043 - DNA, 25 bp, Rattus norvegicus
gatatccgagtctatgaactgtagg

SEQ ID NO: 360044 - DNA, 25 bp, Rattus norvegicus
gatatccggaacaatgtgctcaact

SEQ ID NO: 360045 - DNA, 25 bp, Rattus norvegicus
gatatccggaactatgtgctcaact

SEQ ID NO: 360046 - DNA, 25 bp, Rattus norvegicus
gatatccgtgcaacagtctctttga

SEQ ID NO: 360047 - DNA, 25 bp, Rattus norvegicus
gatatccgtgcatcagtctctttga

SEQ ID NO: 360048 - DNA, 25 bp, Rattus norvegicus
gatatcctaacactccagtcagtct

SEQ ID NO: 360049 - DNA, 25 bp, Rattus norvegicus
gatatcctaacagtccagtcagtct

SEQ ID NO: 360050 - DNA, 25 bp, Rattus norvegicus
gatatcctatatatttcccctgggt

SEQ ID NO: 360051 - DNA, 25 bp, Rattus norvegicus
gatatcctatatttttcccctgggt

SEQ ID NO: 360052 - DNA, 25 bp, Rattus norvegicus
gatatcctatgtaacacgatcctgt

SEQ ID NO: 360053 - DNA, 25 bp, Rattus norvegicus
gatatcctatgttacacgatcctgt

SEQ ID NO: 360054 - DNA, 25 bp, Rattus norvegicus
gatatcctcaaaacatttctacatg

SEQ ID NO: 360055 - DNA, 25 bp, Rattus norvegicus
gatatcctcaaatcatttctacatg

SEQ ID NO: 360056 - DNA, 25 bp, Rattus norvegicus
gatatcctccagaacggcatgttgt

SEQ ID NO: 360057 - DNA, 25 bp, Rattus norvegicus
gatatcctccagtacggcatgttgt

SEQ ID NO: 360058 - DNA, 25 bp, Rattus norvegicus
gatatcctgaatctgcattttccca

SEQ ID NO: 360059 - DNA, 25 bp, Rattus norvegicus
gatatcctgaatgtgcattttccca

SEQ ID NO: 360060 - DNA, 25 bp, Rattus norvegicus
gatatcctgagaaacatgagaccct

SEQ ID NO: 360061 - DNA, 25 bp, Rattus norvegicus
gatatcctgagatacatgagaccct

SEQ ID NO: 360062 - DNA, 25 bp, Rattus norvegicus
gatatcctgtgacaataccgtgtta

SEQ ID NO: 360063 - DNA, 25 bp, Rattus norvegicus
gatatcctgtgagaataccgtgtta

SEQ ID NO: 360064 - DNA, 25 bp, Rattus norvegicus
gatatcctgtgtctacatcagccat

SEQ ID NO: 360065 - DNA, 25 bp, Rattus norvegicus
gatatcctgtgtgtacatcagccat

SEQ ID NO: 360066 - DNA, 25 bp, Rattus norvegicus
gatatcctgttgcacatcaagctgc

SEQ ID NO: 360067 - DNA, 25 bp, Rattus norvegicus
gatatcctgttggacatcaagctgc

SEQ ID NO: 360068 - DNA, 25 bp, Rattus norvegicus
gatatccttctgaggatgcacttca

SEQ ID NO: 360069 - DNA, 25 bp, Rattus norvegicus
gatatccttctgtggatgcacttca

SEQ ID NO: 360070 - DNA, 25 bp, Rattus norvegicus
gatatcgaagccaaatgcctccaca

SEQ ID NO: 360071 - DNA, 25 bp, Rattus norvegicus
gatatcgaagcctaatgcctccaca

SEQ ID NO: 360072 - DNA, 25 bp, Rattus norvegicus
gatatcgagtaaccacgcacggtgc

SEQ ID NO: 360073 - DNA, 25 bp, Rattus norvegicus
gatatcgagtaagcacgcacggtgc

SEQ ID NO: 360074 - DNA, 25 bp, Rattus norvegicus
gatatcgatagaccctcctttctgt

SEQ ID NO: 360075 - DNA, 25 bp, Rattus norvegicus
gatatcgatagagcctcctttctgt

SEQ ID NO: 360076 - DNA, 25 bp, Rattus norvegicus
gatatcgatttgcaccctgaaactg

SEQ ID NO: 360077 - DNA, 25 bp, Rattus norvegicus
gatatcgatttggaccctgaaactg

SEQ ID NO: 360078 - DNA, 25 bp, Rattus norvegicus
gatatcgccgaccttttcaaaattt

SEQ ID NO: 360079 - DNA, 25 bp, Rattus norvegicus
gatatcgccgacgttttcaaaattt

SEQ ID NO: 360080 - DNA, 25 bp, Rattus norvegicus
gatatcgctttgagtcgactcctaa

SEQ ID NO: 360081 - DNA, 25 bp, Rattus norvegicus
gatatcgctttgtgtcgactcctaa

SEQ ID NO: 360082 - DNA, 25 bp, Rattus norvegicus
gatatcggatgtacaaggcttggct

SEQ ID NO: 360083 - DNA, 25 bp, Rattus norvegicus
gatatcggatgttcaaggcttggct

SEQ ID NO: 360084 - DNA, 25 bp, Rattus norvegicus
gatatcgtcagcctttattaatata

SEQ ID NO: 360085 - DNA, 25 bp, Rattus norvegicus
gatatcgtcagcgtttattaatata

SEQ ID NO: 360086 - DNA, 25 bp, Rattus norvegicus
gatatcgtggccctcgtgcagagca

SEQ ID NO: 360087 - DNA, 25 bp, Rattus norvegicus
gatatcgtggccgtcgtgcagagca

SEQ ID NO: 360088 - DNA, 25 bp, Rattus norvegicus
gatatcgtgggtatagttcagctcc

SEQ ID NO: 360089 - DNA, 25 bp, Rattus norvegicus
gatatcgtgggtttagttcagctcc

SEQ ID NO: 360090 - DNA, 25 bp, Rattus norvegicus
gatatcgttgttctcctacgaaaaa

SEQ ID NO: 360091 - DNA, 25 bp, Rattus norvegicus
gatatcgttgttgtcctacgaaaaa

SEQ ID NO: 360092 - DNA, 25 bp, Rattus norvegicus
gatatctaacctcacctaagcacgt

SEQ ID NO: 360093 - DNA, 25 bp, Rattus norvegicus
gatatctaacctgacctaagcacgt

SEQ ID NO: 360094 - DNA, 25 bp, Rattus norvegicus
gatatctaagagcttcccaaggtaa

SEQ ID NO: 360095 - DNA, 25 bp, Rattus norvegicus
gatatctaagaggttcccaaggtaa

SEQ ID NO: 360096 - DNA, 25 bp, Rattus norvegicus
gatatctaaggtccctcttggactt

SEQ ID NO: 360097 - DNA, 25 bp, Rattus norvegicus
gatatctaaggtgcctcttggactt

SEQ ID NO: 360098 - DNA, 25 bp, Rattus norvegicus
gatatctaattcacttgaagcactt

SEQ ID NO: 360099 - DNA, 25 bp, Rattus norvegicus
gatatctaattctcttgaagcactt

SEQ ID NO: 360100 - DNA, 25 bp, Rattus norvegicus
gatatctagagtcataattcccaaa

SEQ ID NO: 360101 - DNA, 25 bp, Rattus norvegicus
gatatctagagtgataattcccaaa

SEQ ID NO: 360102 - DNA, 25 bp, Rattus norvegicus
gatatctagatgactgtagcctgtg

SEQ ID NO: 360103 - DNA, 25 bp, Rattus norvegicus
gatatctagatgtctgtagcctgtg

SEQ ID NO: 360104 - DNA, 25 bp, Rattus norvegicus
gatatctcaacaaccctgatctgga

SEQ ID NO: 360105 - DNA, 25 bp, Rattus norvegicus
gatatctcaacatccctgatctgga

SEQ ID NO: 360106 - DNA, 25 bp, Rattus norvegicus
gatatctcaatcagcagccattctt

SEQ ID NO: 360107 - DNA, 25 bp, Rattus norvegicus
gatatctcaatctgcagccattctt

SEQ ID NO: 360108 - DNA, 25 bp, Rattus norvegicus
gatatctcaatgattttacttggaa

SEQ ID NO: 360109 - DNA, 25 bp, Rattus norvegicus
gatatctcaatgtttttacttggaa

SEQ ID NO: 360110 - DNA, 25 bp, Rattus norvegicus
gatatctccaataatgttgaacaca

SEQ ID NO: 360111 - DNA, 25 bp, Rattus norvegicus
gatatctccaattatgttgaacaca

SEQ ID NO: 360112 - DNA, 25 bp, Rattus norvegicus
gatatctcgagacacgatccagaag

SEQ ID NO: 360113 - DNA, 25 bp, Rattus norvegicus
gatatctcgagagacgatccagaag

SEQ ID NO: 360114 - DNA, 25 bp, Rattus norvegicus
gatatctcggataccaggagctccc

SEQ ID NO: 360115 - DNA, 25 bp, Rattus norvegicus
gatatctcggattccaggagctccc

SEQ ID NO: 360116 - DNA, 25 bp, Rattus norvegicus
gatatctctcagattcttacagaat

SEQ ID NO: 360117 - DNA, 25 bp, Rattus norvegicus
gatatctctcagtttcttacagaat

SEQ ID NO: 360118 - DNA, 25 bp, Rattus norvegicus
gatatctcttggaatattctgtaaa

SEQ ID NO: 360119 - DNA, 25 bp, Rattus norvegicus
gatatctcttggtatattctgtaaa

SEQ ID NO: 360120 - DNA, 25 bp, Rattus norvegicus
gatatctgacaactggctaacctcc

SEQ ID NO: 360121 - DNA, 25 bp, Rattus norvegicus
gatatctgacaagtggctaacctcc

SEQ ID NO: 360122 - DNA, 25 bp, Rattus norvegicus
gatatctgcaatcgcttcctccaga

SEQ ID NO: 360123 - DNA, 25 bp, Rattus norvegicus
gatatctgcaatggcttcctccaga

SEQ ID NO: 360124 - DNA, 25 bp, Rattus norvegicus
gatatctgctggcattgaactcata

SEQ ID NO: 360125 - DNA, 25 bp, Rattus norvegicus
gatatctgctgggattgaactcata

SEQ ID NO: 360126 - DNA, 25 bp, Rattus norvegicus
gatatctgctttctgccaactaggc

SEQ ID NO: 360127 - DNA, 25 bp, Rattus norvegicus
gatatctgctttgtgccaactaggc

SEQ ID NO: 360128 - DNA, 25 bp, Rattus norvegicus
gatatctggacacttcataagctta

SEQ ID NO: 360129 - DNA, 25 bp, Rattus norvegicus
gatatctggacagttcataagctta

SEQ ID NO: 360130 - DNA, 25 bp, Rattus norvegicus
gatatctggcttacatacccaacga

SEQ ID NO: 360131 - DNA, 25 bp, Rattus norvegicus
gatatctggctttcatacccaacga

SEQ ID NO: 360132 - DNA, 25 bp, Rattus norvegicus
gatatctggtatactcggtcacttg

SEQ ID NO: 360133 - DNA, 25 bp, Rattus norvegicus
gatatctggtattctcggtcacttg

SEQ ID NO: 360134 - DNA, 25 bp, Rattus norvegicus
gatatctgtggcatattgtaaactc

SEQ ID NO: 360135 - DNA, 25 bp, Rattus norvegicus
gatatctgtggcttattgtaaactc

SEQ ID NO: 360136 - DNA, 25 bp, Rattus norvegicus
gatatcttaagactagggagccagt

SEQ ID NO: 360137 - DNA, 25 bp, Rattus norvegicus
gatatcttaagacttcctactcacc

SEQ ID NO: 360138 - DNA, 25 bp, Rattus norvegicus
gatatcttaagagtagggagccagt

SEQ ID NO: 360139 - DNA, 25 bp, Rattus norvegicus
gatatcttaagagttcctactcacc

SEQ ID NO: 360140 - DNA, 25 bp, Rattus norvegicus
gatatcttcaacactggattccata

SEQ ID NO: 360141 - DNA, 25 bp, Rattus norvegicus
gatatcttcaactctggattccata

SEQ ID NO: 360142 - DNA, 25 bp, Rattus norvegicus
gatatcttcaagaagctttaaagcc

SEQ ID NO: 360143 - DNA, 25 bp, Rattus norvegicus
gatatcttcaagtagctttaaagcc

SEQ ID NO: 360144 - DNA, 25 bp, Rattus norvegicus
gatatcttcatgagtcaaccctgac

SEQ ID NO: 360145 - DNA, 25 bp, Rattus norvegicus
gatatcttcatgtgtcaaccctgac

SEQ ID NO: 360146 - DNA, 25 bp, Rattus norvegicus
gatatcttccggaatagcagcatgg

SEQ ID NO: 360147 - DNA, 25 bp, Rattus norvegicus
gatatcttccggtatagcagcatgg

SEQ ID NO: 360148 - DNA, 25 bp, Rattus norvegicus
gatatcttcgctcacttgactgtga

SEQ ID NO: 360149 - DNA, 25 bp, Rattus norvegicus
gatatcttcgctgacttgactgtga

SEQ ID NO: 360150 - DNA, 25 bp, Rattus norvegicus
gatatcttgataatccgctgtacca

SEQ ID NO: 360151 - DNA, 25 bp, Rattus norvegicus
gatatcttgatattccgctgtacca

SEQ ID NO: 360152 - DNA, 25 bp, Rattus norvegicus
gatatcttgatcaattttcctatgg

SEQ ID NO: 360153 - DNA, 25 bp, Rattus norvegicus
gatatcttgatctattttcctatgg

SEQ ID NO: 360154 - DNA, 25 bp, Rattus norvegicus
gatatcttggatactggtgactgaa

SEQ ID NO: 360155 - DNA, 25 bp, Rattus norvegicus
gatatcttggattctggtgactgaa

SEQ ID NO: 360156 - DNA, 25 bp, Rattus norvegicus
gatatctttactaaacagcctatag

SEQ ID NO: 360157 - DNA, 25 bp, Rattus norvegicus
gatatctttacttaacagcctatag

SEQ ID NO: 360158 - DNA, 25 bp, Rattus norvegicus
gatatcttttatccagcgttgtatt

SEQ ID NO: 360159 - DNA, 25 bp, Rattus norvegicus
gatatcttttatgcagcgttgtatt

SEQ ID NO: 360160 - DNA, 25 bp, Rattus norvegicus
gatatcttttcgaggatcaagcttg

SEQ ID NO: 360161 - DNA, 25 bp, Rattus norvegicus
gatatcttttcgtggatcaagcttg

SEQ ID NO: 360162 - DNA, 25 bp, Rattus norvegicus
gatatgaaaccaaccagtcctcttt

SEQ ID NO: 360163 - DNA, 25 bp, Rattus norvegicus
gatatgaaaccatccagtcctcttt

SEQ ID NO: 360164 - DNA, 25 bp, Rattus norvegicus
gatatgaaccacacagcatgtgatg

SEQ ID NO: 360165 - DNA, 25 bp, Rattus norvegicus
gatatgaaccactcagcatgtgatg

SEQ ID NO: 360166 - DNA, 25 bp, Rattus norvegicus
gatatgaagcttctttatcctaaca

SEQ ID NO: 360167 - DNA, 25 bp, Rattus norvegicus
gatatgaagcttgtttatcctaaca

SEQ ID NO: 360168 - DNA, 25 bp, Rattus norvegicus
gatatgacagccacagttacctcca

SEQ ID NO: 360169 - DNA, 25 bp, Rattus norvegicus
gatatgacagcctcagttacctcca

SEQ ID NO: 360170 - DNA, 25 bp, Rattus norvegicus
gatatgacatcgagctcatggacat

SEQ ID NO: 360171 - DNA, 25 bp, Rattus norvegicus
gatatgacatcgtgctcatggacat

SEQ ID NO: 360172 - DNA, 25 bp, Rattus norvegicus
gatatgacatgaaccatccagttca

SEQ ID NO: 360173 - DNA, 25 bp, Rattus norvegicus
gatatgacatgatccatccagttca

SEQ ID NO: 360174 - DNA, 25 bp, Rattus norvegicus
gatatgacattgcttgtccacctgc

SEQ ID NO: 360175 - DNA, 25 bp, Rattus norvegicus
gatatgacattggttgtccacctgc

SEQ ID NO: 360176 - DNA, 25 bp, Rattus norvegicus
gatatgaccaacaaatgcacctcct

SEQ ID NO: 360177 - DNA, 25 bp, Rattus norvegicus
gatatgaccaactaatgcacctcct

SEQ ID NO: 360178 - DNA, 25 bp, Rattus norvegicus
gatatgaccagacacatcctaagat

SEQ ID NO: 360179 - DNA, 25 bp, Rattus norvegicus
gatatgaccagagacatcctaagat

SEQ ID NO: 360180 - DNA, 25 bp, Rattus norvegicus
gatatgacccataggctactgtggt

SEQ ID NO: 360181 - DNA, 25 bp, Rattus norvegicus
gatatgacccattggctactgtggt

SEQ ID NO: 360182 - DNA, 25 bp, Rattus norvegicus
gatatgaccttaccttgaaacagaa

SEQ ID NO: 360183 - DNA, 25 bp, Rattus norvegicus
gatatgaccttagcttgaaacagaa

SEQ ID NO: 360184 - DNA, 25 bp, Rattus norvegicus
gatatgactggtcagttcctctctc

SEQ ID NO: 360185 - DNA, 25 bp, Rattus norvegicus
gatatgactggtgagttcctctctc

SEQ ID NO: 360186 - DNA, 25 bp, Rattus norvegicus
gatatgacttccatagaaagtggca

SEQ ID NO: 360187 - DNA, 25 bp, Rattus norvegicus
gatatgacttccttagaaagtggca

SEQ ID NO: 360188 - DNA, 25 bp, Rattus norvegicus
gatatgactttcatgtccctttaga

SEQ ID NO: 360189 - DNA, 25 bp, Rattus norvegicus
gatatgactttcttgtccctttaga

SEQ ID NO: 360190 - DNA, 25 bp, Rattus norvegicus
gatatgagaaggagagtcacgactt

SEQ ID NO: 360191 - DNA, 25 bp, Rattus norvegicus
gatatgagaaggtgagtcacgactt

SEQ ID NO: 360192 - DNA, 25 bp, Rattus norvegicus
gatatgagacacctcatgggcaagt

SEQ ID NO: 360193 - DNA, 25 bp, Rattus norvegicus
gatatgagacacgtcatgggcaagt

SEQ ID NO: 360194 - DNA, 25 bp, Rattus norvegicus
gatatgagagccacttctgagattt

SEQ ID NO: 360195 - DNA, 25 bp, Rattus norvegicus
gatatgagagcctcttctgagattt

SEQ ID NO: 360196 - DNA, 25 bp, Rattus norvegicus
gatatgagcatgatctggaggcatt

SEQ ID NO: 360197 - DNA, 25 bp, Rattus norvegicus
gatatgagcatgttctggaggcatt

SEQ ID NO: 360198 - DNA, 25 bp, Rattus norvegicus
gatatgagctatcagttggccatgg

SEQ ID NO: 360199 - DNA, 25 bp, Rattus norvegicus
gatatgagctatgagttggccatgg

SEQ ID NO: 360200 - DNA, 25 bp, Rattus norvegicus
gatatgatgctcataaacctgtaga

SEQ ID NO: 360201 - DNA, 25 bp, Rattus norvegicus
gatatgatgctcttaaacctgtaga

SEQ ID NO: 360202 - DNA, 25 bp, Rattus norvegicus
gatatgatttctccactgttagtga

SEQ ID NO: 360203 - DNA, 25 bp, Rattus norvegicus
gatatgatttctgcactgttagtga

SEQ ID NO: 360204 - DNA, 25 bp, Rattus norvegicus
gatatgcaagtacctcactttgtta

SEQ ID NO: 360205 - DNA, 25 bp, Rattus norvegicus
gatatgcaagtagctcactttgtta

SEQ ID NO: 360206 - DNA, 25 bp, Rattus norvegicus
gatatgcaatagcacactgcctgtt

SEQ ID NO: 360207 - DNA, 25 bp, Rattus norvegicus
gatatgcaataggacactgcctgtt

SEQ ID NO: 360208 - DNA, 25 bp, Rattus norvegicus
gatatgcacttaaacatgcagacaa

SEQ ID NO: 360209 - DNA, 25 bp, Rattus norvegicus
gatatgcacttatacatgcagacaa

SEQ ID NO: 360210 - DNA, 25 bp, Rattus norvegicus
gatatgcagatgctttttcgctttc

SEQ ID NO: 360211 - DNA, 25 bp, Rattus norvegicus
gatatgcagatggtttttcgctttc

SEQ ID NO: 360212 - DNA, 25 bp, Rattus norvegicus
gatatgcagttgcatggtcaggctc

SEQ ID NO: 360213 - DNA, 25 bp, Rattus norvegicus
gatatgcagttggatggtcaggctc

SEQ ID NO: 360214 - DNA, 25 bp, Rattus norvegicus
gatatgcatacccttgatggcctgg

SEQ ID NO: 360215 - DNA, 25 bp, Rattus norvegicus
gatatgcataccgttgatggcctgg

SEQ ID NO: 360216 - DNA, 25 bp, Rattus norvegicus
gatatgccagtcactatttctgctg

SEQ ID NO: 360217 - DNA, 25 bp, Rattus norvegicus
gatatgccagtctctatttctgctg

SEQ ID NO: 360218 - DNA, 25 bp, Rattus norvegicus
gatatgccagtgattttctacattg

SEQ ID NO: 360219 - DNA, 25 bp, Rattus norvegicus
gatatgccagtgtttttctacattg

SEQ ID NO: 360220 - DNA, 25 bp, Rattus norvegicus
gatatgcccactacttatttttatg

SEQ ID NO: 360221 - DNA, 25 bp, Rattus norvegicus
gatatgcccacttcttatttttatg

SEQ ID NO: 360222 - DNA, 25 bp, Rattus norvegicus
gatatgcccaggaactccagaagca

SEQ ID NO: 360223 - DNA, 25 bp, Rattus norvegicus
gatatgcccaggtactccagaagca

SEQ ID NO: 360224 - DNA, 25 bp, Rattus norvegicus
gatatgccgtgtccctgagagtgca

SEQ ID NO: 360225 - DNA, 25 bp, Rattus norvegicus
gatatgccgtgtgcctgagagtgca

SEQ ID NO: 360226 - DNA, 25 bp, Rattus norvegicus
gatatgcctgttcatgtctcttata

SEQ ID NO: 360227 - DNA, 25 bp, Rattus norvegicus
gatatgcctgttgatgtctcttata

SEQ ID NO: 360228 - DNA, 25 bp, Rattus norvegicus
gatatgctaaccaaattataccttc

SEQ ID NO: 360229 - DNA, 25 bp, Rattus norvegicus
gatatgctaacctaattataccttc

SEQ ID NO: 360230 - DNA, 25 bp, Rattus norvegicus
gatatgctagttactgtgtgtggtt

SEQ ID NO: 360231 - DNA, 25 bp, Rattus norvegicus
gatatgctagtttctgtgtgtggtt

SEQ ID NO: 360232 - DNA, 25 bp, Rattus norvegicus
gatatgctcataagctcttctaatt

SEQ ID NO: 360233 - DNA, 25 bp, Rattus norvegicus
gatatgctcatatgctcttctaatt

SEQ ID NO: 360234 - DNA, 25 bp, Rattus norvegicus
gatatgctcttacgccagtgaccac

SEQ ID NO: 360235 - DNA, 25 bp, Rattus norvegicus
gatatgctcttaggccagtgaccac

SEQ ID NO: 360236 - DNA, 25 bp, Rattus norvegicus
gatatgctgagcaccagactgactg

SEQ ID NO: 360237 - DNA, 25 bp, Rattus norvegicus
gatatgctgagctccagactgactg

SEQ ID NO: 360238 - DNA, 25 bp, Rattus norvegicus
gatatgctgatgagccttgagactt

SEQ ID NO: 360239 - DNA, 25 bp, Rattus norvegicus
gatatgctgatgtgccttgagactt

SEQ ID NO: 360240 - DNA, 25 bp, Rattus norvegicus
gatatgcttccaagtctatgactgt

SEQ ID NO: 360241 - DNA, 25 bp, Rattus norvegicus
gatatgcttccatgtctatgactgt

SEQ ID NO: 360242 - DNA, 25 bp, Rattus norvegicus
gatatggaatgaccccttcctcaac

SEQ ID NO: 360243 - DNA, 25 bp, Rattus norvegicus
gatatggaatgagcccttcctcaac

SEQ ID NO: 360244 - DNA, 25 bp, Rattus norvegicus
gatatggacgaaagtcacccagcat

SEQ ID NO: 360245 - DNA, 25 bp, Rattus norvegicus
gatatggacgaatgtcacccagcat

SEQ ID NO: 360246 - DNA, 25 bp, Rattus norvegicus
gatatggatcttcgtgtcaccttcc

SEQ ID NO: 360247 - DNA, 25 bp, Rattus norvegicus
gatatggatcttggtgtcaccttcc

SEQ ID NO: 360248 - DNA, 25 bp, Rattus norvegicus
gatatggcacaaagactctgagcac

SEQ ID NO: 360249 - DNA, 25 bp, Rattus norvegicus
gatatggcacaatgactctgagcac

SEQ ID NO: 360250 - DNA, 25 bp, Rattus norvegicus
gatatggcagatccccatcatcttg

SEQ ID NO: 360251 - DNA, 25 bp, Rattus norvegicus
gatatggcagatgcccatcatcttg

SEQ ID NO: 360252 - DNA, 25 bp, Rattus norvegicus
gatatggcctcaaactaactttggc

SEQ ID NO: 360253 - DNA, 25 bp, Rattus norvegicus
gatatggcctcatactaactttggc

SEQ ID NO: 360254 - DNA, 25 bp, Rattus norvegicus
gatatggctgagatcgagaaattcg

SEQ ID NO: 360255 - DNA, 25 bp, Rattus norvegicus
gatatggctgagttcgagaaattcg

SEQ ID NO: 360256 - DNA, 25 bp, Rattus norvegicus
gatatggcttcaatctgtagactat

SEQ ID NO: 360257 - DNA, 25 bp, Rattus norvegicus
gatatggcttcattctgtagactat

SEQ ID NO: 360258 - DNA, 25 bp, Rattus norvegicus
gatatggcttttctgaagactgctt

SEQ ID NO: 360259 - DNA, 25 bp, Rattus norvegicus
gatatggcttttgtgaagactgctt

SEQ ID NO: 360260 - DNA, 25 bp, Rattus norvegicus
gatatgggcacaaaaaagcacagat

SEQ ID NO: 360261 - DNA, 25 bp, Rattus norvegicus
gatatgggcacataaaagcacagat

SEQ ID NO: 360262 - DNA, 25 bp, Rattus norvegicus
gatatggtaaataagttgccttgtc

SEQ ID NO: 360263 - DNA, 25 bp, Rattus norvegicus
gatatggtaaattagttgccttgtc

SEQ ID NO: 360264 - DNA, 25 bp, Rattus norvegicus
gatatggtaggtactcagtccccag

SEQ ID NO: 360265 - DNA, 25 bp, Rattus norvegicus
gatatggtaggttctcagtccccag

SEQ ID NO: 360266 - DNA, 25 bp, Rattus norvegicus
gatatggtcatgcagtcctaaggaa

SEQ ID NO: 360267 - DNA, 25 bp, Rattus norvegicus
gatatggtcatggagtcctaaggaa

SEQ ID NO: 360268 - DNA, 25 bp, Rattus norvegicus
gatatggtccatcgaaactttcaga

SEQ ID NO: 360269 - DNA, 25 bp, Rattus norvegicus
gatatggtccatggaaactttcaga

SEQ ID NO: 360270 - DNA, 25 bp, Rattus norvegicus
gatatgtaaactatccatgtgcaat

SEQ ID NO: 360271 - DNA, 25 bp, Rattus norvegicus
gatatgtaaactttccatgtgcaat

SEQ ID NO: 360272 - DNA, 25 bp, Rattus norvegicus
gatatgtaaaggacccttctcccca

SEQ ID NO: 360273 - DNA, 25 bp, Rattus norvegicus
gatatgtaaaggtcccttctcccca

SEQ ID NO: 360274 - DNA, 25 bp, Rattus norvegicus
gatatgtaactaatgccacagggtt

SEQ ID NO: 360275 - DNA, 25 bp, Rattus norvegicus
gatatgtaactattgccacagggtt

SEQ ID NO: 360276 - DNA, 25 bp, Rattus norvegicus
gatatgtaatatcagcaccagacca

SEQ ID NO: 360277 - DNA, 25 bp, Rattus norvegicus
gatatgtaatatgagcaccagacca

SEQ ID NO: 360278 - DNA, 25 bp, Rattus norvegicus
gatatgtaattcctagacagtctta

SEQ ID NO: 360279 - DNA, 25 bp, Rattus norvegicus
gatatgtaattcgtagacagtctta

SEQ ID NO: 360280 - DNA, 25 bp, Rattus norvegicus
gatatgtacataattcccgaggcaa

SEQ ID NO: 360281 - DNA, 25 bp, Rattus norvegicus
gatatgtacatatttcccgaggcaa

SEQ ID NO: 360282 - DNA, 25 bp, Rattus norvegicus
gatatgtacattccttcctttcctt

SEQ ID NO: 360283 - DNA, 25 bp, Rattus norvegicus
gatatgtacattgcttcctttcctt

SEQ ID NO: 360284 - DNA, 25 bp, Rattus norvegicus
gatatgtatatacccactctttttc

SEQ ID NO: 360285 - DNA, 25 bp, Rattus norvegicus
gatatgtatatagccactctttttc

SEQ ID NO: 360286 - DNA, 25 bp, Rattus norvegicus
gatatgtatctccagctagactcac

SEQ ID NO: 360287 - DNA, 25 bp, Rattus norvegicus
gatatgtatctcgagctagactcac

SEQ ID NO: 360288 - DNA, 25 bp, Rattus norvegicus
gatatgtatctgattccacgtgact

SEQ ID NO: 360289 - DNA, 25 bp, Rattus norvegicus
gatatgtatctgtttccacgtgact

SEQ ID NO: 360290 - DNA, 25 bp, Rattus norvegicus
gatatgtcacctcagagaatccggt

SEQ ID NO: 360291 - DNA, 25 bp, Rattus norvegicus
gatatgtcacctgagagaatccggt

SEQ ID NO: 360292 - DNA, 25 bp, Rattus norvegicus
gatatgtcagagaactcaggtttcc

SEQ ID NO: 360293 - DNA, 25 bp, Rattus norvegicus
gatatgtcagagtactcaggtttcc

SEQ ID NO: 360294 - DNA, 25 bp, Rattus norvegicus
gatatgtcagtgatcgggactttaa

SEQ ID NO: 360295 - DNA, 25 bp, Rattus norvegicus
gatatgtcagtgttcgggactttaa

SEQ ID NO: 360296 - DNA, 25 bp, Rattus norvegicus
gatatgtccacaagtcccagaaccg

SEQ ID NO: 360297 - DNA, 25 bp, Rattus norvegicus
gatatgtccacatgtcccagaaccg

SEQ ID NO: 360298 - DNA, 25 bp, Rattus norvegicus
gatatgtccataacccagacggtgt

SEQ ID NO: 360299 - DNA, 25 bp, Rattus norvegicus
gatatgtccatatcccagacggtgt

SEQ ID NO: 360300 - DNA, 25 bp, Rattus norvegicus
gatatgtcccctaagctaatggcaa

SEQ ID NO: 360301 - DNA, 25 bp, Rattus norvegicus
gatatgtccccttagctaatggcaa

SEQ ID NO: 360302 - DNA, 25 bp, Rattus norvegicus
gatatgtctgtcagtgagttcttgc

SEQ ID NO: 360303 - DNA, 25 bp, Rattus norvegicus
gatatgtctgtctgtgagttcttgc

SEQ ID NO: 360304 - DNA, 25 bp, Rattus norvegicus
gatatgtcttaaactaacccatagg

SEQ ID NO: 360305 - DNA, 25 bp, Rattus norvegicus
gatatgtcttaatctaacccatagg

SEQ ID NO: 360306 - DNA, 25 bp, Rattus norvegicus
gatatgtcttttcccagttggacgc

SEQ ID NO: 360307 - DNA, 25 bp, Rattus norvegicus
gatatgtcttttgccagttggacgc

SEQ ID NO: 360308 - DNA, 25 bp, Rattus norvegicus
gatatgtgagacatagctccctccc

SEQ ID NO: 360309 - DNA, 25 bp, Rattus norvegicus
gatatgtgagacttagctccctccc

SEQ ID NO: 360310 - DNA, 25 bp, Rattus norvegicus
gatatgtgatagatgcccagcgaga

SEQ ID NO: 360311 - DNA, 25 bp, Rattus norvegicus
gatatgtgatagttgcccagcgaga

SEQ ID NO: 360312 - DNA, 25 bp, Rattus norvegicus
gatatgtgatctcattacttctgaa

SEQ ID NO: 360313 - DNA, 25 bp, Rattus norvegicus
gatatgtgatctgattacttctgaa

SEQ ID NO: 360314 - DNA, 25 bp, Rattus norvegicus
gatatgtgcagacgtgtgcccctaa

SEQ ID NO: 360315 - DNA, 25 bp, Rattus norvegicus
gatatgtgcagaggtgtgcccctaa

SEQ ID NO: 360316 - DNA, 25 bp, Rattus norvegicus
gatatgtgccacagtttccaacttt

SEQ ID NO: 360317 - DNA, 25 bp, Rattus norvegicus
gatatgtgccaccattgcattgagg

SEQ ID NO: 360318 - DNA, 25 bp, Rattus norvegicus
gatatgtgccacgattgcattgagg

SEQ ID NO: 360319 - DNA, 25 bp, Rattus norvegicus
gatatgtgccactgtttccaacttt

SEQ ID NO: 360320 - DNA, 25 bp, Rattus norvegicus
gatatgtgtgttccacggtgccaat

SEQ ID NO: 360321 - DNA, 25 bp, Rattus norvegicus
gatatgtgtgttgcacggtgccaat

SEQ ID NO: 360322 - DNA, 25 bp, Rattus norvegicus
gatatgttaaacaattggccaagag

SEQ ID NO: 360323 - DNA, 25 bp, Rattus norvegicus
gatatgttaaactattggccaagag

SEQ ID NO: 360324 - DNA, 25 bp, Rattus norvegicus
gatatgttaatccatgttcagaaga

SEQ ID NO: 360325 - DNA, 25 bp, Rattus norvegicus
gatatgttaatcgatgttcagaaga

SEQ ID NO: 360326 - DNA, 25 bp, Rattus norvegicus
gatatgttactgaccggcagcagtt

SEQ ID NO: 360327 - DNA, 25 bp, Rattus norvegicus
gatatgttactgtccggcagcagtt

SEQ ID NO: 360328 - DNA, 25 bp, Rattus norvegicus
gatatgttcaccctttgaacttctg

SEQ ID NO: 360329 - DNA, 25 bp, Rattus norvegicus
gatatgttcaccgtttgaacttctg

SEQ ID NO: 360330 - DNA, 25 bp, Rattus norvegicus
gatatgttcatgactgttgcaacaa

SEQ ID NO: 360331 - DNA, 25 bp, Rattus norvegicus
gatatgttcatgtctgttgcaacaa

SEQ ID NO: 360332 - DNA, 25 bp, Rattus norvegicus
gatatgttcctgaattcttagacca

SEQ ID NO: 360333 - DNA, 25 bp, Rattus norvegicus
gatatgttcctgtattcttagacca

SEQ ID NO: 360334 - DNA, 25 bp, Rattus norvegicus
gatatgttcgtcatttgtctccagc

SEQ ID NO: 360335 - DNA, 25 bp, Rattus norvegicus
gatatgttcgtcttttgtctccagc

SEQ ID NO: 360336 - DNA, 25 bp, Rattus norvegicus
gatatgttgtgtatgcagcagggac

SEQ ID NO: 360337 - DNA, 25 bp, Rattus norvegicus
gatatgttgtgtttgcagcagggac

SEQ ID NO: 360338 - DNA, 25 bp, Rattus norvegicus
gatatgtttgagctggatctgccca

SEQ ID NO: 360339 - DNA, 25 bp, Rattus norvegicus
gatatgtttgaggtggatctgccca

SEQ ID NO: 360340 - DNA, 25 bp, Rattus norvegicus
gatatgttttacatcttgcttccca

SEQ ID NO: 360341 - DNA, 25 bp, Rattus norvegicus
gatatgttttacttcttgcttccca

SEQ ID NO: 360342 - DNA, 25 bp, Rattus norvegicus
gatatgtttttaatcccagaggcat

SEQ ID NO: 360343 - DNA, 25 bp, Rattus norvegicus
gatatgtttttattcccagaggcat

SEQ ID NO: 360344 - DNA, 25 bp, Rattus norvegicus
gatattaacgtcacgaagtagccat

SEQ ID NO: 360345 - DNA, 25 bp, Rattus norvegicus
gatattaacgtctcgaagtagccat

SEQ ID NO: 360346 - DNA, 25 bp, Rattus norvegicus
gatattaatgccaccactcagttcg

SEQ ID NO: 360347 - DNA, 25 bp, Rattus norvegicus
gatattaatgcctccactcagttcg

SEQ ID NO: 360348 - DNA, 25 bp, Rattus norvegicus
gatattaattctcgatggttttgtt

SEQ ID NO: 360349 - DNA, 25 bp, Rattus norvegicus
gatattaattctggatggttttgtt

SEQ ID NO: 360350 - DNA, 25 bp, Rattus norvegicus
gatattaatttcaacttcctcaccc

SEQ ID NO: 360351 - DNA, 25 bp, Rattus norvegicus
gatattaatttctacttcctcaccc

SEQ ID NO: 360352 - DNA, 25 bp, Rattus norvegicus
gatattacaagacttctccgtgaaa

SEQ ID NO: 360353 - DNA, 25 bp, Rattus norvegicus
gatattacaagagttctccgtgaaa

SEQ ID NO: 360354 - DNA, 25 bp, Rattus norvegicus
gatattacagttagctgccacaata

SEQ ID NO: 360355 - DNA, 25 bp, Rattus norvegicus
gatattacagtttgctgccacaata

SEQ ID NO: 360356 - DNA, 25 bp, Rattus norvegicus
gatattaccgttctgtaccattggg

SEQ ID NO: 360357 - DNA, 25 bp, Rattus norvegicus
gatattaccgttgtgtaccattggg

SEQ ID NO: 360358 - DNA, 25 bp, Rattus norvegicus
gatattacctttcatgatgagccca

SEQ ID NO: 360359 - DNA, 25 bp, Rattus norvegicus
gatattacctttgatgatgagccca

SEQ ID NO: 360360 - DNA, 25 bp, Rattus norvegicus
gatattacgtgactttgacacacaa

SEQ ID NO: 360361 - DNA, 25 bp, Rattus norvegicus
gatattacgtgagtttgacacacaa

SEQ ID NO: 360362 - DNA, 25 bp, Rattus norvegicus
gatattactatcacactgacaaaat

SEQ ID NO: 360363 - DNA, 25 bp, Rattus norvegicus
gatattactatctcactgacaaaat

SEQ ID NO: 360364 - DNA, 25 bp, Rattus norvegicus
gatattagactcatggtgatcacac

SEQ ID NO: 360365 - DNA, 25 bp, Rattus norvegicus
gatattagactcttggtgatcacac

SEQ ID NO: 360366 - DNA, 25 bp, Rattus norvegicus
gatattagatatagtccaatttcaa

SEQ ID NO: 360367 - DNA, 25 bp, Rattus norvegicus
gatattagatattgtccaatttcaa

SEQ ID NO: 360368 - DNA, 25 bp, Rattus norvegicus
gatattagatgtccccgtcttgctg

SEQ ID NO: 360369 - DNA, 25 bp, Rattus norvegicus
gatattagatgtgcccgtcttgctg

SEQ ID NO: 360370 - DNA, 25 bp, Rattus norvegicus
gatattagcgatcagtctgatgaca

SEQ ID NO: 360371 - DNA, 25 bp, Rattus norvegicus
gatattagcgatgagtctgatgaca

SEQ ID NO: 360372 - DNA, 25 bp, Rattus norvegicus
gatattaggagccagcccatgtaat

SEQ ID NO: 360373 - DNA, 25 bp, Rattus norvegicus
gatattaggagcgagcccatgtaat

SEQ ID NO: 360374 - DNA, 25 bp, Rattus norvegicus
gatattatcataatgccttgtgcat

SEQ ID NO: 360375 - DNA, 25 bp, Rattus norvegicus
gatattatcatattgccttgtgcat

SEQ ID NO: 360376 - DNA, 25 bp, Rattus norvegicus
gatattattgatagttgttcttcct

SEQ ID NO: 360377 - DNA, 25 bp, Rattus norvegicus
gatattattgattgttgttcttcct

SEQ ID NO: 360378 - DNA, 25 bp, Rattus norvegicus
gatattcaaacccaagaggctctga

SEQ ID NO: 360379 - DNA, 25 bp, Rattus norvegicus
gatattcaaaccgaagaggctctga

SEQ ID NO: 360380 - DNA, 25 bp, Rattus norvegicus
gatattcaaaggatatccctctccc

SEQ ID NO: 360381 - DNA, 25 bp, Rattus norvegicus
gatattcaaaggttatccctctccc

SEQ ID NO: 360382 - DNA, 25 bp, Rattus norvegicus
gatattcaccttcttgcagcaggaa

SEQ ID NO: 360383 - DNA, 25 bp, Rattus norvegicus
gatattcaccttgttgcagcaggaa

SEQ ID NO: 360384 - DNA, 25 bp, Rattus norvegicus
gatattcacgatcgtctcacagttt

SEQ ID NO: 360385 - DNA, 25 bp, Rattus norvegicus
gatattcacgatggtctcacagttt

SEQ ID NO: 360386 - DNA, 25 bp, Rattus norvegicus
gatattcagcggcatggacctctgc

SEQ ID NO: 360387 - DNA, 25 bp, Rattus norvegicus
gatattcagcgggatggacctctgc

SEQ ID NO: 360388 - DNA, 25 bp, Rattus norvegicus
gatattcagctgagaccctgggaat

SEQ ID NO: 360389 - DNA, 25 bp, Rattus norvegicus
gatattcagctgtgaccctgggaat

SEQ ID NO: 360390 - DNA, 25 bp, Rattus norvegicus
gatattcatactatcttctgtagtt

SEQ ID NO: 360391 - DNA, 25 bp, Rattus norvegicus
gatattcatactttcttctgtagtt

SEQ ID NO: 360392 - DNA, 25 bp, Rattus norvegicus
gatattcatcatcatgcttttgcac

SEQ ID NO: 360393 - DNA, 25 bp, Rattus norvegicus
gatattcatcatgatgcttttgcac

SEQ ID NO: 360394 - DNA, 25 bp, Rattus norvegicus
gatattcatgcaactcctcatgtga

SEQ ID NO: 360395 - DNA, 25 bp, Rattus norvegicus
gatattcatgcatctcctcatgtga

SEQ ID NO: 360396 - DNA, 25 bp, Rattus norvegicus
gatattcattacatcctctcattgt

SEQ ID NO: 360397 - DNA, 25 bp, Rattus norvegicus
gatattcattacttcctctcattgt

SEQ ID NO: 360398 - DNA, 25 bp, Rattus norvegicus
gatattcatttgcagatggctggac

SEQ ID NO: 360399 - DNA, 25 bp, Rattus norvegicus
gatattcatttggagatggctggac

SEQ ID NO: 360400 - DNA, 25 bp, Rattus norvegicus
gatattcattttcggctgttgctga

SEQ ID NO: 360401 - DNA, 25 bp, Rattus norvegicus
gatattcattttgggctgttgctga

SEQ ID NO: 360402 - DNA, 25 bp, Rattus norvegicus
gatattccaagtacaatgcctcatg

SEQ ID NO: 360403 - DNA, 25 bp, Rattus norvegicus
gatattccaagttcaatgcctcatg

SEQ ID NO: 360404 - DNA, 25 bp, Rattus norvegicus
gatattccactcaacattgcttctg

SEQ ID NO: 360405 - DNA, 25 bp, Rattus norvegicus
gatattccactctacattgcttctg

SEQ ID NO: 360406 - DNA, 25 bp, Rattus norvegicus
gatattccagcacgagtgacctctg

SEQ ID NO: 360407 - DNA, 25 bp, Rattus norvegicus
gatattccagcaggagtgacctctg

SEQ ID NO: 360408 - DNA, 25 bp, Rattus norvegicus
gatattccagttcagtttcccagtt

SEQ ID NO: 360409 - DNA, 25 bp, Rattus norvegicus
gatattccagttgagtttcccagtt

SEQ ID NO: 360410 - DNA, 25 bp, Rattus norvegicus
gatattccccaaacactcaggtgga

SEQ ID NO: 360411 - DNA, 25 bp, Rattus norvegicus
gatattccccaatcactcaggtgga

SEQ ID NO: 360412 - DNA, 25 bp, Rattus norvegicus
gatattcctattatccttccaaaga

SEQ ID NO: 360413 - DNA, 25 bp, Rattus norvegicus
gatattcctattttccttccaaaga

SEQ ID NO: 360414 - DNA, 25 bp, Rattus norvegicus
gatattcctgctattgtctggttct

SEQ ID NO: 360415 - DNA, 25 bp, Rattus norvegicus
gatattcctgcttttgtctggttct

SEQ ID NO: 360416 - DNA, 25 bp, Rattus norvegicus
gatattctacaccaccacatttagg

SEQ ID NO: 360417 - DNA, 25 bp, Rattus norvegicus
gatattctacacgaccacatttagg

SEQ ID NO: 360418 - DNA, 25 bp, Rattus norvegicus
gatattctacgcatcattcagatat

SEQ ID NO: 360419 - DNA, 25 bp, Rattus norvegicus
gatattctacgcttcattcagatat

SEQ ID NO: 360420 - DNA, 25 bp, Rattus norvegicus
gatattctattgcactctcagtaag

SEQ ID NO: 360421 - DNA, 25 bp, Rattus norvegicus
gatattctattggactctcagtaag

SEQ ID NO: 360422 - DNA, 25 bp, Rattus norvegicus
gatattctcaggaccgaatcctcat

SEQ ID NO: 360423 - DNA, 25 bp, Rattus norvegicus
gatattctcaggtccgaatcctcat

SEQ ID NO: 360424 - DNA, 25 bp, Rattus norvegicus
gatattctccctcctcacaaagaag

SEQ ID NO: 360425 - DNA, 25 bp, Rattus norvegicus
gatattctccctgctcacaaagaag

SEQ ID NO: 360426 - DNA, 25 bp, Rattus norvegicus
gatattctcttaattcagttcctta

SEQ ID NO: 360427 - DNA, 25 bp, Rattus norvegicus
gatattctcttatttcagttcctta

SEQ ID NO: 360428 - DNA, 25 bp, Rattus norvegicus
gatattctgcagctttaattcccaa

SEQ ID NO: 360429 - DNA, 25 bp, Rattus norvegicus
gatattctgcaggtttaattcccaa

SEQ ID NO: 360430 - DNA, 25 bp, Rattus norvegicus
gatattctgtgtcgctcatgtctga

SEQ ID NO: 360431 - DNA, 25 bp, Rattus norvegicus
gatattctgtgtggctcatgtctga

SEQ ID NO: 360432 - DNA, 25 bp, Rattus norvegicus
gatattctgttactctcttgtccat

SEQ ID NO: 360433 - DNA, 25 bp, Rattus norvegicus
gatattctgttagtctcttgtccat

SEQ ID NO: 360434 - DNA, 25 bp, Rattus norvegicus
gatattcttctaactgtaagatcaa

SEQ ID NO: 360435 - DNA, 25 bp, Rattus norvegicus
gatattcttctatctgtaagatcaa

SEQ ID NO: 360436 - DNA, 25 bp, Rattus norvegicus
gatattcttgaacttcctttcgttg

SEQ ID NO: 360437 - DNA, 25 bp, Rattus norvegicus
gatattcttgaagttcctttcgttg

SEQ ID NO: 360438 - DNA, 25 bp, Rattus norvegicus
gatattcttgtcaatctttgcagtg

SEQ ID NO: 360439 - DNA, 25 bp, Rattus norvegicus
gatattcttgtctatctttgcagtg

SEQ ID NO: 360440 - DNA, 25 bp, Rattus norvegicus
gatattcttttacgtgagtctcatg

SEQ ID NO: 360441 - DNA, 25 bp, Rattus norvegicus
gatattcttttaggtgagtctcatg

SEQ ID NO: 360442 - DNA, 25 bp, Rattus norvegicus
gatattgaattcacagaaagcctgt

SEQ ID NO: 360443 - DNA, 25 bp, Rattus norvegicus
gatattgaattctcagaaagcctgt

SEQ ID NO: 360444 - DNA, 25 bp, Rattus norvegicus
gatattgactgaaaccaccagtaca

SEQ ID NO: 360445 - DNA, 25 bp, Rattus norvegicus
gatattgactgataccaccagtaca

SEQ ID NO: 360446 - DNA, 25 bp, Rattus norvegicus
gatattgagataagtagcttcctgg

SEQ ID NO: 360447 - DNA, 25 bp, Rattus norvegicus
gatattgagatatgtagcttcctgg

SEQ ID NO: 360448 - DNA, 25 bp, Rattus norvegicus
gatattgaggcaaagaagcggaagc

SEQ ID NO: 360449 - DNA, 25 bp, Rattus norvegicus
gatattgaggcatagaagcggaagc

SEQ ID NO: 360450 - DNA, 25 bp, Rattus norvegicus
gatattgaggtcatcctagtgttac

SEQ ID NO: 360451 - DNA, 25 bp, Rattus norvegicus
gatattgaggtcttcctagtgttac

SEQ ID NO: 360452 - DNA, 25 bp, Rattus norvegicus
gatattgcaaacatttctggtcaaa

SEQ ID NO: 360453 - DNA, 25 bp, Rattus norvegicus
gatattgcaaacttttctggtcaaa

SEQ ID NO: 360454 - DNA, 25 bp, Rattus norvegicus
gatattgcaacaaccatactggctt

SEQ ID NO: 360455 - DNA, 25 bp, Rattus norvegicus
gatattgcaacatccatactggctt

SEQ ID NO: 360456 - DNA, 25 bp, Rattus norvegicus
gatattgcaactaagtcttgtcaca

SEQ ID NO: 360457 - DNA, 25 bp, Rattus norvegicus
gatattgcaacttagtcttgtcaca

SEQ ID NO: 360458 - DNA, 25 bp, Rattus norvegicus
gatattgcacctaaaaacctctgta

SEQ ID NO: 360459 - DNA, 25 bp, Rattus norvegicus
gatattgcaccttaaaacctctgta

SEQ ID NO: 360460 - DNA, 25 bp, Rattus norvegicus
gatattgcagacactctctgtctgg

SEQ ID NO: 360461 - DNA, 25 bp, Rattus norvegicus
gatattgcagactctctctgtctgg

SEQ ID NO: 360462 - DNA, 25 bp, Rattus norvegicus
gatattgcaggcacccttggaggag

SEQ ID NO: 360463 - DNA, 25 bp, Rattus norvegicus
gatattgcaggctcccttggaggag

SEQ ID NO: 360464 - DNA, 25 bp, Rattus norvegicus
gatattgcagttacttttcactatg

SEQ ID NO: 360465 - DNA, 25 bp, Rattus norvegicus
gatattgcagtttcttttcactatg

SEQ ID NO: 360466 - DNA, 25 bp, Rattus norvegicus
gatattgcatctaatactgggacat

SEQ ID NO: 360467 - DNA, 25 bp, Rattus norvegicus
gatattgcatcttatactgggacat

SEQ ID NO: 360468 - DNA, 25 bp, Rattus norvegicus
gatattgcattgagtgtgtcctgat

SEQ ID NO: 360469 - DNA, 25 bp, Rattus norvegicus
gatattgcattgtgtgtgtcctgat

SEQ ID NO: 360470 - DNA, 25 bp, Rattus norvegicus
gatattgcctgtctattccatttaa

SEQ ID NO: 360471 - DNA, 25 bp, Rattus norvegicus
gatattgcctgtgtattccatttaa

SEQ ID NO: 360472 - DNA, 25 bp, Rattus norvegicus
gatattgcgaggaatctgcacgctg

SEQ ID NO: 360473 - DNA, 25 bp, Rattus norvegicus
gatattgcgaggtatctgcacgctg

SEQ ID NO: 360474 - DNA, 25 bp, Rattus norvegicus
gatattgctgggaaccgtgacaagt

SEQ ID NO: 360475 - DNA, 25 bp, Rattus norvegicus
gatattgctgggtaccgtgacaagt

SEQ ID NO: 360476 - DNA, 25 bp, Rattus norvegicus
gatattgctgttcctagattggtaa

SEQ ID NO: 360477 - DNA, 25 bp, Rattus norvegicus
gatattgctgttgctagattggtaa

SEQ ID NO: 360478 - DNA, 25 bp, Rattus norvegicus
gatattggacacatgggacagactt

SEQ ID NO: 360479 - DNA, 25 bp, Rattus norvegicus
gatattggacacttgggacagactt

SEQ ID NO: 360480 - DNA, 25 bp, Rattus norvegicus
gatattggccaaaagtctaagctga

SEQ ID NO: 360481 - DNA, 25 bp, Rattus norvegicus
gatattggccaatagtctaagctga

SEQ ID NO: 360482 - DNA, 25 bp, Rattus norvegicus
gatattggctttatcagctgacaag

SEQ ID NO: 360483 - DNA, 25 bp, Rattus norvegicus
gatattggctttttcagctgacaag

SEQ ID NO: 360484 - DNA, 25 bp, Rattus norvegicus
gatattgggagccaaggtgccccta

SEQ ID NO: 360485 - DNA, 25 bp, Rattus norvegicus
gatattgggagcgaaggtgccccta

SEQ ID NO: 360486 - DNA, 25 bp, Rattus norvegicus
gatattgggccaatgtatgtgtttt

SEQ ID NO: 360487 - DNA, 25 bp, Rattus norvegicus
gatattgggccattgtatgtgtttt

SEQ ID NO: 360488 - DNA, 25 bp, Rattus norvegicus
gatattggttctaatcatccctacc

SEQ ID NO: 360489 - DNA, 25 bp, Rattus norvegicus
gatattggttcttatcatccctacc

SEQ ID NO: 360490 - DNA, 25 bp, Rattus norvegicus
gatattgtcaagatagtcttccttt

SEQ ID NO: 360491 - DNA, 25 bp, Rattus norvegicus
gatattgtcaagttagtcttccttt

SEQ ID NO: 360492 - DNA, 25 bp, Rattus norvegicus
gatattgtcaatacttgctcatcgg

SEQ ID NO: 360493 - DNA, 25 bp, Rattus norvegicus
gatattgtcaattcttgctcatcgg

SEQ ID NO: 360494 - DNA, 25 bp, Rattus norvegicus
gatattgtcatcacacagcgggtcg

SEQ ID NO: 360495 - DNA, 25 bp, Rattus norvegicus
gatattgtcatctcacagcgggtcg

SEQ ID NO: 360496 - DNA, 25 bp, Rattus norvegicus
gatattgtgctcattttcttagact

SEQ ID NO: 360497 - DNA, 25 bp, Rattus norvegicus
gatattgtgctctttttcttagact

SEQ ID NO: 360498 - DNA, 25 bp, Rattus norvegicus
gatattgtgtttagtgggactgtat

SEQ ID NO: 360499 - DNA, 25 bp, Rattus norvegicus
gatattgtgttttgtgggactgtat

SEQ ID NO: 360500 - DNA, 25 bp, Rattus norvegicus
gatattgttcatcattgtgttctga

SEQ ID NO: 360501 - DNA, 25 bp, Rattus norvegicus
gatattgttcatgattgtgttctga

SEQ ID NO: 360502 - DNA, 25 bp, Rattus norvegicus
gatattgttggaccgatgcctgcga

SEQ ID NO: 360503 - DNA, 25 bp, Rattus norvegicus
gatattgttggagcgatgcctgcga

SEQ ID NO: 360504 - DNA, 25 bp, Rattus norvegicus
gatatttaaactatgctcctgtagc

SEQ ID NO: 360505 - DNA, 25 bp, Rattus norvegicus
gatatttaaactttgctcctgtagc

SEQ ID NO: 360506 - DNA, 25 bp, Rattus norvegicus
gatatttaactacggtctgaggcgg

SEQ ID NO: 360507 - DNA, 25 bp, Rattus norvegicus
gatatttaactagggtctgaggcgg

SEQ ID NO: 360508 - DNA, 25 bp, Rattus norvegicus
gatatttaagttcctacttccacct

SEQ ID NO: 360509 - DNA, 25 bp, Rattus norvegicus
gatatttaagttgctacttccacct

SEQ ID NO: 360510 - DNA, 25 bp, Rattus norvegicus
gatatttacatcagggcacccttgg

SEQ ID NO: 360511 - DNA, 25 bp, Rattus norvegicus
gatatttacatctgggcacccttgg

SEQ ID NO: 360512 - DNA, 25 bp, Rattus norvegicus
gatatttagagaacaccctggaact

SEQ ID NO: 360513 - DNA, 25 bp, Rattus norvegicus
gatatttagagatcaccctggaact

SEQ ID NO: 360514 - DNA, 25 bp, Rattus norvegicus
gatatttataacacttctcccaaac

SEQ ID NO: 360515 - DNA, 25 bp, Rattus norvegicus
gatatttataacctagacaccgtga

SEQ ID NO: 360516 - DNA, 25 bp, Rattus norvegicus
gatatttataacgtagacaccgtga

SEQ ID NO: 360517 - DNA, 25 bp, Rattus norvegicus
gatatttataactcttctcccaaac

SEQ ID NO: 360518 - DNA, 25 bp, Rattus norvegicus
gatatttatctaacccagttgtctt

SEQ ID NO: 360519 - DNA, 25 bp, Rattus norvegicus
gatatttatctatcccagttgtctt

SEQ ID NO: 360520 - DNA, 25 bp, Rattus norvegicus
gatatttatcttccaaacatcaaca

SEQ ID NO: 360521 - DNA, 25 bp, Rattus norvegicus
gatatttatcttcccattgcaaatg

SEQ ID NO: 360522 - DNA, 25 bp, Rattus norvegicus
gatatttatcttccttgagcactgc

SEQ ID NO: 360523 - DNA, 25 bp, Rattus norvegicus
gatatttatcttgcaaacatcaaca

SEQ ID NO: 360524 - DNA, 25 bp, Rattus norvegicus
gatatttatcttgccattgcaaatg

SEQ ID NO: 360525 - DNA, 25 bp, Rattus norvegicus
gatatttatcttgcttgagcactgc

SEQ ID NO: 360526 - DNA, 25 bp, Rattus norvegicus
gatatttattatacagcagcagtct

SEQ ID NO: 360527 - DNA, 25 bp, Rattus norvegicus
gatatttattattcagcagcagtct

SEQ ID NO: 360528 - DNA, 25 bp, Rattus norvegicus
gatatttattttcagccttggcttg

SEQ ID NO: 360529 - DNA, 25 bp, Rattus norvegicus
gatatttattttgagccttggcttg

SEQ ID NO: 360530 - DNA, 25 bp, Rattus norvegicus
gatatttcaaggaatttggctgtaa

SEQ ID NO: 360531 - DNA, 25 bp, Rattus norvegicus
gatatttcaaggtatttggctgtaa

SEQ ID NO: 360532 - DNA, 25 bp, Rattus norvegicus
gatatttcacccacactgtgtgatt

SEQ ID NO: 360533 - DNA, 25 bp, Rattus norvegicus
gatatttcaccctcactgtgtgatt

SEQ ID NO: 360534 - DNA, 25 bp, Rattus norvegicus
gatatttcagacatgcttgctaggt

SEQ ID NO: 360535 - DNA, 25 bp, Rattus norvegicus
gatatttcagacttgcttgctaggt

SEQ ID NO: 360536 - DNA, 25 bp, Rattus norvegicus
gatatttcatagctgttcattctaa

SEQ ID NO: 360537 - DNA, 25 bp, Rattus norvegicus
gatatttcataggtgttcattctaa

SEQ ID NO: 360538 - DNA, 25 bp, Rattus norvegicus
gatatttcattgagacttgtggtct

SEQ ID NO: 360539 - DNA, 25 bp, Rattus norvegicus
gatatttcattgtgacttgtggtct

SEQ ID NO: 360540 - DNA, 25 bp, Rattus norvegicus
gatatttcatttcaaagggaagctt

SEQ ID NO: 360541 - DNA, 25 bp, Rattus norvegicus
gatatttcatttgaaagggaagctt

SEQ ID NO: 360542 - DNA, 25 bp, Rattus norvegicus
gatatttccaatatacccatctccc

SEQ ID NO: 360543 - DNA, 25 bp, Rattus norvegicus
gatatttccaatttacccatctccc

SEQ ID NO: 360544 - DNA, 25 bp, Rattus norvegicus
gatatttccactacgatacacaaca

SEQ ID NO: 360545 - DNA, 25 bp, Rattus norvegicus
gatatttccacttcgatacacaaca

SEQ ID NO: 360546 - DNA, 25 bp, Rattus norvegicus
gatatttcccaacattctctgcaag

SEQ ID NO: 360547 - DNA, 25 bp, Rattus norvegicus
gatatttcccaagattctctgcaag

SEQ ID NO: 360548 - DNA, 25 bp, Rattus norvegicus
gatatttcctaaaaccatgcactga

SEQ ID NO: 360549 - DNA, 25 bp, Rattus norvegicus
gatatttcctaataccatgcactga

SEQ ID NO: 360550 - DNA, 25 bp, Rattus norvegicus
gatatttcctctagatttcccatta

SEQ ID NO: 360551 - DNA, 25 bp, Rattus norvegicus
gatatttcctcttgatttcccatta

SEQ ID NO: 360552 - DNA, 25 bp, Rattus norvegicus
gatatttcctgaagactgtctctga

SEQ ID NO: 360553 - DNA, 25 bp, Rattus norvegicus
gatatttcctgatgactgtctctga

SEQ ID NO: 360554 - DNA, 25 bp, Rattus norvegicus
gatatttcctgtagaatcctccaaa

SEQ ID NO: 360555 - DNA, 25 bp, Rattus norvegicus
gatatttcctgttgaatcctccaaa

SEQ ID NO: 360556 - DNA, 25 bp, Rattus norvegicus
gatatttctaatcaccaaacctgca

SEQ ID NO: 360557 - DNA, 25 bp, Rattus norvegicus
gatatttctaatgaccaaacctgca

SEQ ID NO: 360558 - DNA, 25 bp, Rattus norvegicus
gatatttctattaatcgcagttcaa

SEQ ID NO: 360559 - DNA, 25 bp, Rattus norvegicus
gatatttctatttatcgcagttcaa

SEQ ID NO: 360560 - DNA, 25 bp, Rattus norvegicus
gatatttctgcccaagatgtgcctt

SEQ ID NO: 360561 - DNA, 25 bp, Rattus norvegicus
gatatttctgccgaagatgtgcctt

SEQ ID NO: 360562 - DNA, 25 bp, Rattus norvegicus
gatatttctgctagggacatccttg

SEQ ID NO: 360563 - DNA, 25 bp, Rattus norvegicus
gatatttctgcttgggacatccttg

SEQ ID NO: 360564 - DNA, 25 bp, Rattus norvegicus
gatatttcttcaaatgtgccacatt

SEQ ID NO: 360565 - DNA, 25 bp, Rattus norvegicus
gatatttcttcatatgtgccacatt

SEQ ID NO: 360566 - DNA, 25 bp, Rattus norvegicus
gatatttcttggcagtctgccacag

SEQ ID NO: 360567 - DNA, 25 bp, Rattus norvegicus
gatatttcttggctcgctttttaat

SEQ ID NO: 360568 - DNA, 25 bp, Rattus norvegicus
gatatttcttgggagtctgccacag

SEQ ID NO: 360569 - DNA, 25 bp, Rattus norvegicus
gatatttcttgggtcgctttttaat

SEQ ID NO: 360570 - DNA, 25 bp, Rattus norvegicus
gatatttgaattatgctaccagggt

SEQ ID NO: 360571 - DNA, 25 bp, Rattus norvegicus
gatatttgaattttgctaccagggt

SEQ ID NO: 360572 - DNA, 25 bp, Rattus norvegicus
gatatttgacacaatccttctcgtc

SEQ ID NO: 360573 - DNA, 25 bp, Rattus norvegicus
gatatttgacactatccttctcgtc

SEQ ID NO: 360574 - DNA, 25 bp, Rattus norvegicus
gatatttgagccattcctaaagatt

SEQ ID NO: 360575 - DNA, 25 bp, Rattus norvegicus
gatatttgagcctttcctaaagatt

SEQ ID NO: 360576 - DNA, 25 bp, Rattus norvegicus
gatatttgattcactgtgattctgc

SEQ ID NO: 360577 - DNA, 25 bp, Rattus norvegicus
gatatttgattctctgtgattctgc

SEQ ID NO: 360578 - DNA, 25 bp, Rattus norvegicus
gatatttgattgaaccctgcgggtc

SEQ ID NO: 360579 - DNA, 25 bp, Rattus norvegicus
gatatttgattgtaccctgcgggtc

SEQ ID NO: 360580 - DNA, 25 bp, Rattus norvegicus
gatatttgctgacatggtccctcag

SEQ ID NO: 360581 - DNA, 25 bp, Rattus norvegicus
gatatttgctgagatggtccctcag

SEQ ID NO: 360582 - DNA, 25 bp, Rattus norvegicus
gatatttggatcaagtttctaagtt

SEQ ID NO: 360583 - DNA, 25 bp, Rattus norvegicus
gatatttggatctagtttctaagtt

SEQ ID NO: 360584 - DNA, 25 bp, Rattus norvegicus
gatatttggtctccttaagtcctag

SEQ ID NO: 360585 - DNA, 25 bp, Rattus norvegicus
gatatttggtctgcttaagtcctag

SEQ ID NO: 360586 - DNA, 25 bp, Rattus norvegicus
gatatttgtcacacagggcctatgg

SEQ ID NO: 360587 - DNA, 25 bp, Rattus norvegicus
gatatttgtcactcagggcctatgg

SEQ ID NO: 360588 - DNA, 25 bp, Rattus norvegicus
gatatttgtgctcggaaacctgaaa

SEQ ID NO: 360589 - DNA, 25 bp, Rattus norvegicus
gatatttgtgctgggaaacctgaaa

SEQ ID NO: 360590 - DNA, 25 bp, Rattus norvegicus
gatatttgttttactgaccgactta

SEQ ID NO: 360591 - DNA, 25 bp, Rattus norvegicus
gatatttgtttttctgaccgactta

SEQ ID NO: 360592 - DNA, 25 bp, Rattus norvegicus
gatattttaaaactctgaatctcga

SEQ ID NO: 360593 - DNA, 25 bp, Rattus norvegicus
gatattttaaaagtctgaatctcga

SEQ ID NO: 360594 - DNA, 25 bp, Rattus norvegicus
gatattttaaccaaagcctgtgtgc

SEQ ID NO: 360595 - DNA, 25 bp, Rattus norvegicus
gatattttaacctaagcctgtgtgc

SEQ ID NO: 360596 - DNA, 25 bp, Rattus norvegicus
gatattttaagtagttccagcccaa

SEQ ID NO: 360597 - DNA, 25 bp, Rattus norvegicus
gatattttaagttgttccagcccaa

SEQ ID NO: 360598 - DNA, 25 bp, Rattus norvegicus
gatattttaattctcttcccctcat

SEQ ID NO: 360599 - DNA, 25 bp, Rattus norvegicus
gatattttaattgtcttcccctcat

SEQ ID NO: 360600 - DNA, 25 bp, Rattus norvegicus
gatattttagaacctctggcgtaca

SEQ ID NO: 360601 - DNA, 25 bp, Rattus norvegicus
gatattttagaagctctggcgtaca

SEQ ID NO: 360602 - DNA, 25 bp, Rattus norvegicus
gatattttatgcctagtgcccacac

SEQ ID NO: 360603 - DNA, 25 bp, Rattus norvegicus
gatattttatgcgtagtgcccacac

SEQ ID NO: 360604 - DNA, 25 bp, Rattus norvegicus
gatattttcagtagatgctcaggca

SEQ ID NO: 360605 - DNA, 25 bp, Rattus norvegicus
gatattttcagttgatgctcaggca

SEQ ID NO: 360606 - DNA, 25 bp, Rattus norvegicus
gatattttccagcatcttcgggatg

SEQ ID NO: 360607 - DNA, 25 bp, Rattus norvegicus
gatattttccaggatcttcgggatg

SEQ ID NO: 360608 - DNA, 25 bp, Rattus norvegicus
gatattttcggcacaagtagtttgc

SEQ ID NO: 360609 - DNA, 25 bp, Rattus norvegicus
gatattttcggctcaagtagtttgc

SEQ ID NO: 360610 - DNA, 25 bp, Rattus norvegicus
gatattttctgtactgccatccata

SEQ ID NO: 360611 - DNA, 25 bp, Rattus norvegicus
gatattttctgttctgccatccata

SEQ ID NO: 360612 - DNA, 25 bp, Rattus norvegicus
gatattttcttacagtcatcacaag

SEQ ID NO: 360613 - DNA, 25 bp, Rattus norvegicus
gatattttcttagagtcatcacaag

SEQ ID NO: 360614 - DNA, 25 bp, Rattus norvegicus
gatattttcttcactactttttcta

SEQ ID NO: 360615 - DNA, 25 bp, Rattus norvegicus
gatattttcttctctactttttcta

SEQ ID NO: 360616 - DNA, 25 bp, Rattus norvegicus
gatattttcttgagtagtccctgat

SEQ ID NO: 360617 - DNA, 25 bp, Rattus norvegicus
gatattttcttgtgtagtccctgat

SEQ ID NO: 360618 - DNA, 25 bp, Rattus norvegicus
gatattttgaatccctcagctgaag

SEQ ID NO: 360619 - DNA, 25 bp, Rattus norvegicus
gatattttgaatgcctcagctgaag

SEQ ID NO: 360620 - DNA, 25 bp, Rattus norvegicus
gatattttgccgattttagaaatca

SEQ ID NO: 360621 - DNA, 25 bp, Rattus norvegicus
gatattttgccgtttttagaaatca

SEQ ID NO: 360622 - DNA, 25 bp, Rattus norvegicus
gatattttgtccactgcagactgaa

SEQ ID NO: 360623 - DNA, 25 bp, Rattus norvegicus
gatattttgtcctctgcagactgaa

SEQ ID NO: 360624 - DNA, 25 bp, Rattus norvegicus
gatattttgttcatccattcgaaaa

SEQ ID NO: 360625 - DNA, 25 bp, Rattus norvegicus
gatattttgttcttccattcgaaaa

SEQ ID NO: 360626 - DNA, 25 bp, Rattus norvegicus
gatatttttagtctctcaaggcctg

SEQ ID NO: 360627 - DNA, 25 bp, Rattus norvegicus
gatatttttagtgtctcaaggcctg

SEQ ID NO: 360628 - DNA, 25 bp, Rattus norvegicus
gatatttttgttcctcatcttaact

SEQ ID NO: 360629 - DNA, 25 bp, Rattus norvegicus
gatatttttgttgctcatcttaact

SEQ ID NO: 360630 - DNA, 25 bp, Rattus norvegicus
gatcaaaagtgccacaccagaggtt

SEQ ID NO: 360631 - DNA, 25 bp, Rattus norvegicus
gatcaaaagtgcgacaccagaggtt

SEQ ID NO: 360632 - DNA, 25 bp, Rattus norvegicus
gatcaaaatacacatctccatttcc

SEQ ID NO: 360633 - DNA, 25 bp, Rattus norvegicus
gatcaaaatacagatctccatttcc

SEQ ID NO: 360634 - DNA, 25 bp, Rattus norvegicus
gatcaaaatccccaagccgaactgt

SEQ ID NO: 360635 - DNA, 25 bp, Rattus norvegicus
gatcaaaatcccgaagccgaactgt

SEQ ID NO: 360636 - DNA, 25 bp, Rattus norvegicus
gatcaaaatgtcactgctcagggat

SEQ ID NO: 360637 - DNA, 25 bp, Rattus norvegicus
gatcaaaatgtctctgctcagggat

SEQ ID NO: 360638 - DNA, 25 bp, Rattus norvegicus
gatcaaacatctagcaacaaaagtg

SEQ ID NO: 360639 - DNA, 25 bp, Rattus norvegicus
gatcaaacatcttgcaacaaaagtg

SEQ ID NO: 360640 - DNA, 25 bp, Rattus norvegicus
gatcaaaccttcaaaagagcactat

SEQ ID NO: 360641 - DNA, 25 bp, Rattus norvegicus
gatcaaaccttctaaagagcactat

SEQ ID NO: 360642 - DNA, 25 bp, Rattus norvegicus
gatcaaacgcagagtgagtcctcag

SEQ ID NO: 360643 - DNA, 25 bp, Rattus norvegicus
gatcaaacgcagtgtgagtcctcag

SEQ ID NO: 360644 - DNA, 25 bp, Rattus norvegicus
gatcaaactcaaactgccaggacaa

SEQ ID NO: 360645 - DNA, 25 bp, Rattus norvegicus
gatcaaactcaatctgccaggacaa

SEQ ID NO: 360646 - DNA, 25 bp, Rattus norvegicus
gatcaaacttggactctcatatgct

SEQ ID NO: 360647 - DNA, 25 bp, Rattus norvegicus
gatcaaacttggtctctcatatgct

SEQ ID NO: 360648 - DNA, 25 bp, Rattus norvegicus
gatcaaagaccaagctcacctattc

SEQ ID NO: 360649 - DNA, 25 bp, Rattus norvegicus
gatcaaagaccatgctcacctattc

SEQ ID NO: 360650 - DNA, 25 bp, Rattus norvegicus
gatcaaagactgattagacgcctaa

SEQ ID NO: 360651 - DNA, 25 bp, Rattus norvegicus
gatcaaagactgtttagacgcctaa

SEQ ID NO: 360652 - DNA, 25 bp, Rattus norvegicus
gatcaaagccggagttctatgctct

SEQ ID NO: 360653 - DNA, 25 bp, Rattus norvegicus
gatcaaagccggtgttctatgctct

SEQ ID NO: 360654 - DNA, 25 bp, Rattus norvegicus
gatcaaagctagcagcatgcctgat

SEQ ID NO: 360655 - DNA, 25 bp, Rattus norvegicus
gatcaaagctaggagcatgcctgat

SEQ ID NO: 360656 - DNA, 25 bp, Rattus norvegicus
gatcaaagctcaagtggcctcactg

SEQ ID NO: 360657 - DNA, 25 bp, Rattus norvegicus
gatcaaagctcatgtggcctcactg

SEQ ID NO: 360658 - DNA, 25 bp, Rattus norvegicus
gatcaaaggcatctgtcatccctgc

SEQ ID NO: 360659 - DNA, 25 bp, Rattus norvegicus
gatcaaaggcatgtgtcatccctgc

SEQ ID NO: 360660 - DNA, 25 bp, Rattus norvegicus
gatcaaagtggccatacctcacatc

SEQ ID NO: 360661 - DNA, 25 bp, Rattus norvegicus
gatcaaagtggcgatacctcacatc

SEQ ID NO: 360662 - DNA, 25 bp, Rattus norvegicus
gatcaaagttctccagaatgcagga

SEQ ID NO: 360663 - DNA, 25 bp, Rattus norvegicus
gatcaaagttctgcagaatgcagga

SEQ ID NO: 360664 - DNA, 25 bp, Rattus norvegicus
gatcaaatacctcatgacgctcatc

SEQ ID NO: 360665 - DNA, 25 bp, Rattus norvegicus
gatcaaatacctgatgacgctcatc

SEQ ID NO: 360666 - DNA, 25 bp, Rattus norvegicus
gatcaaatcaatacacatgtacaag

SEQ ID NO: 360667 - DNA, 25 bp, Rattus norvegicus
gatcaaatcaattcacatgtacaag

SEQ ID NO: 360668 - DNA, 25 bp, Rattus norvegicus
gatcaaatcatgactggattacctg

SEQ ID NO: 360669 - DNA, 25 bp, Rattus norvegicus
gatcaaatcatgcttatacataaca

SEQ ID NO: 360670 - DNA, 25 bp, Rattus norvegicus
gatcaaatcatggttatacataaca

SEQ ID NO: 360671 - DNA, 25 bp, Rattus norvegicus
gatcaaatcatgtctggattacctg

SEQ ID NO: 360672 - DNA, 25 bp, Rattus norvegicus
gatcaaatcccacagaggccacttg

SEQ ID NO: 360673 - DNA, 25 bp, Rattus norvegicus
gatcaaatcccagagaggccacttg

SEQ ID NO: 360674 - DNA, 25 bp, Rattus norvegicus
gatcaaatcctactgggcctgagct

SEQ ID NO: 360675 - DNA, 25 bp, Rattus norvegicus
gatcaaatcctagtgggcctgagct

SEQ ID NO: 360676 - DNA, 25 bp, Rattus norvegicus
gatcaaatccttaacctccaagagg

SEQ ID NO: 360677 - DNA, 25 bp, Rattus norvegicus
gatcaaatcctttacctccaagagg

SEQ ID NO: 360678 - DNA, 25 bp, Rattus norvegicus
gatcaaatcttcacttctgtgtgta

SEQ ID NO: 360679 - DNA, 25 bp, Rattus norvegicus
gatcaaatcttctcttctgtgtgta

SEQ ID NO: 360680 - DNA, 25 bp, Rattus norvegicus
gatcaaatctttactggtcagttat

SEQ ID NO: 360681 - DNA, 25 bp, Rattus norvegicus
gatcaaatcttttctggtcagttat

SEQ ID NO: 360682 - DNA, 25 bp, Rattus norvegicus
gatcaaatttttagcatccagctga

SEQ ID NO: 360683 - DNA, 25 bp, Rattus norvegicus
gatcaaattttttgcatccagctga

SEQ ID NO: 360684 - DNA, 25 bp, Rattus norvegicus
gatcaacaactcacagtctactggg

SEQ ID NO: 360685 - DNA, 25 bp, Rattus norvegicus
gatcaacaactctcagtctactggg

SEQ ID NO: 360686 - DNA, 25 bp, Rattus norvegicus
gatcaacaacttctgacctgtggag

SEQ ID NO: 360687 - DNA, 25 bp, Rattus norvegicus
gatcaacaacttgtgacctgtggag

SEQ ID NO: 360688 - DNA, 25 bp, Rattus norvegicus
gatcaacaagaaacccaactgtcct

SEQ ID NO: 360689 - DNA, 25 bp, Rattus norvegicus
gatcaacaagaatcccaactgtcct

SEQ ID NO: 360690 - DNA, 25 bp, Rattus norvegicus
gatcaacaagttctgtgactgaagc

SEQ ID NO: 360691 - DNA, 25 bp, Rattus norvegicus
gatcaacaagttgtgtgactgaagc

SEQ ID NO: 360692 - DNA, 25 bp, Rattus norvegicus
gatcaacactacctttgctggtcaa

SEQ ID NO: 360693 - DNA, 25 bp, Rattus norvegicus
gatcaacactacgtttgctggtcaa

SEQ ID NO: 360694 - DNA, 25 bp, Rattus norvegicus
gatcaacagactctaccagtacacg

SEQ ID NO: 360695 - DNA, 25 bp, Rattus norvegicus
gatcaacagactgtaccagtacacg

SEQ ID NO: 360696 - DNA, 25 bp, Rattus norvegicus
gatcaacagcatacccatgtgagaa

SEQ ID NO: 360697 - DNA, 25 bp, Rattus norvegicus
gatcaacagcattcccatgtgagaa

SEQ ID NO: 360698 - DNA, 25 bp, Rattus norvegicus
gatcaacatctaactgctatgcgtg

SEQ ID NO: 360699 - DNA, 25 bp, Rattus norvegicus
gatcaacatctatctgctatgcgtg

SEQ ID NO: 360700 - DNA, 25 bp, Rattus norvegicus
gatcaacattgcctccatgatgggc

SEQ ID NO: 360701 - DNA, 25 bp, Rattus norvegicus
gatcaacattgcgtccatgatgggc

SEQ ID NO: 360702 - DNA, 25 bp, Rattus norvegicus
gatcaaccaggcctggaacaccagt

SEQ ID NO: 360703 - DNA, 25 bp, Rattus norvegicus
gatcaaccaggcgtggaacaccagt

SEQ ID NO: 360704 - DNA, 25 bp, Rattus norvegicus
gatcaaccctgtccttggcagatga

SEQ ID NO: 360705 - DNA, 25 bp, Rattus norvegicus
gatcaaccctgtgcttggcagatga

SEQ ID NO: 360706 - DNA, 25 bp, Rattus norvegicus
gatcaacctaaacttccagagccat

SEQ ID NO: 360707 - DNA, 25 bp, Rattus norvegicus
gatcaacctaaagttccagagccat

SEQ ID NO: 360708 - DNA, 25 bp, Rattus norvegicus
gatcaacctatccctgagtctatat

SEQ ID NO: 360709 - DNA, 25 bp, Rattus norvegicus
gatcaacctatcgctgagtctatat

SEQ ID NO: 360710 - DNA, 25 bp, Rattus norvegicus
gatcaacctccacggatcgtccaaa

SEQ ID NO: 360711 - DNA, 25 bp, Rattus norvegicus
gatcaacctccagggatcgtccaaa

SEQ ID NO: 360712 - DNA, 25 bp, Rattus norvegicus
gatcaacctttacaagttggagttt

SEQ ID NO: 360713 - DNA, 25 bp, Rattus norvegicus
gatcaacctttagaagttggagttt

SEQ ID NO: 360714 - DNA, 25 bp, Rattus norvegicus
gatcaacgaatacggagccataaga

SEQ ID NO: 360715 - DNA, 25 bp, Rattus norvegicus
gatcaacgaatagggagccataaga

SEQ ID NO: 360716 - DNA, 25 bp, Rattus norvegicus
gatcaacgagtcataatgtcttaaa

SEQ ID NO: 360717 - DNA, 25 bp, Rattus norvegicus
gatcaacgagtcttaatgtcttaaa

SEQ ID NO: 360718 - DNA, 25 bp, Rattus norvegicus
gatcaactactgaacaccaaccaga

SEQ ID NO: 360719 - DNA, 25 bp, Rattus norvegicus
gatcaactactgtacaccaaccaga

SEQ ID NO: 360720 - DNA, 25 bp, Rattus norvegicus
gatcaactagacctgtaccaacctg

SEQ ID NO: 360721 - DNA, 25 bp, Rattus norvegicus
gatcaactagacgtgtaccaacctg

SEQ ID NO: 360722 - DNA, 25 bp, Rattus norvegicus
gatcaactcaccataaggacagcag

SEQ ID NO: 360723 - DNA, 25 bp, Rattus norvegicus
gatcaactcaccttaaggacagcag

SEQ ID NO: 360724 - DNA, 25 bp, Rattus norvegicus
gatcaactctaccatacttggcttg

SEQ ID NO: 360725 - DNA, 25 bp, Rattus norvegicus
gatcaactctacgatacttggcttg

SEQ ID NO: 360726 - DNA, 25 bp, Rattus norvegicus
gatcaactcttgcttttatgggata

SEQ ID NO: 360727 - DNA, 25 bp, Rattus norvegicus
gatcaactcttggttttatgggata

SEQ ID NO: 360728 - DNA, 25 bp, Rattus norvegicus
gatcaactgaaccattggccactgg

SEQ ID NO: 360729 - DNA, 25 bp, Rattus norvegicus
gatcaactgaacgattggccactgg

SEQ ID NO: 360730 - DNA, 25 bp, Rattus norvegicus
gatcaactgctgactaccactaatt

SEQ ID NO: 360731 - DNA, 25 bp, Rattus norvegicus
gatcaactgctgtctaccactaatt

SEQ ID NO: 360732 - DNA, 25 bp, Rattus norvegicus
gatcaactggcacatatgacatctt

SEQ ID NO: 360733 - DNA, 25 bp, Rattus norvegicus
gatcaactggcagatatgacatctt

SEQ ID NO: 360734 - DNA, 25 bp, Rattus norvegicus
gatcaactgtccctaagatgctttc

SEQ ID NO: 360735 - DNA, 25 bp, Rattus norvegicus
gatcaactgtccgtaagatgctttc

SEQ ID NO: 360736 - DNA, 25 bp, Rattus norvegicus
gatcaactgtttatatggcctaaga

SEQ ID NO: 360737 - DNA, 25 bp, Rattus norvegicus
gatcaactgtttttatggcctaaga

SEQ ID NO: 360738 - DNA, 25 bp, Rattus norvegicus
gatcaacttcatcgcatcacttgct

SEQ ID NO: 360739 - DNA, 25 bp, Rattus norvegicus
gatcaacttcatggcatcacttgct

SEQ ID NO: 360740 - DNA, 25 bp, Rattus norvegicus
gatcaacttgataatgacgttccag

SEQ ID NO: 360741 - DNA, 25 bp, Rattus norvegicus
gatcaacttgattatgacgttccag

SEQ ID NO: 360742 - DNA, 25 bp, Rattus norvegicus
gatcaacttggcatgacttggtcca

SEQ ID NO: 360743 - DNA, 25 bp, Rattus norvegicus
gatcaacttggcttgacttggtcca

SEQ ID NO: 360744 - DNA, 25 bp, Rattus norvegicus
gatcaacttggtcttcatagagagc

SEQ ID NO: 360745 - DNA, 25 bp, Rattus norvegicus
gatcaacttggtgttcatagagagc

SEQ ID NO: 360746 - DNA, 25 bp, Rattus norvegicus
gatcaagaaacccttccgtcattaa

SEQ ID NO: 360747 - DNA, 25 bp, Rattus norvegicus
gatcaagaaaccgttccgtcattaa

SEQ ID NO: 360748 - DNA, 25 bp, Rattus norvegicus
gatcaagaaggcctatcggaagctg

SEQ ID NO: 360749 - DNA, 25 bp, Rattus norvegicus
gatcaagaaggcgtatcggaagctg

SEQ ID NO: 360750 - DNA, 25 bp, Rattus norvegicus
gatcaagactccacaagcaaagact

SEQ ID NO: 360751 - DNA, 25 bp, Rattus norvegicus
gatcaagactcctcaagcaaagact

SEQ ID NO: 360752 - DNA, 25 bp, Rattus norvegicus
gatcaagagatcctcactaacccgc

SEQ ID NO: 360753 - DNA, 25 bp, Rattus norvegicus
gatcaagagatcgtcactaacccgc

SEQ ID NO: 360754 - DNA, 25 bp, Rattus norvegicus
gatcaagagtgcacctgtctgctga

SEQ ID NO: 360755 - DNA, 25 bp, Rattus norvegicus
gatcaagagtgctcctgtctgctga

SEQ ID NO: 360756 - DNA, 25 bp, Rattus norvegicus
gatcaagagttcagagtcatcctta

SEQ ID NO: 360757 - DNA, 25 bp, Rattus norvegicus
gatcaagagttctgagtcatcctta

SEQ ID NO: 360758 - DNA, 25 bp, Rattus norvegicus
gatcaagatcatagctcctcctgag

SEQ ID NO: 360759 - DNA, 25 bp, Rattus norvegicus
gatcaagatcattgctcctcctgag

SEQ ID NO: 360760 - DNA, 25 bp, Rattus norvegicus
gatcaagatggtaactgcccggcag

SEQ ID NO: 360761 - DNA, 25 bp, Rattus norvegicus
gatcaagatggttactgcccggcag

SEQ ID NO: 360762 - DNA, 25 bp, Rattus norvegicus
gatcaagattctaaacctccgcttc

SEQ ID NO: 360763 - DNA, 25 bp, Rattus norvegicus
gatcaagattcttaacctccgcttc

SEQ ID NO: 360764 - DNA, 25 bp, Rattus norvegicus
gatcaagatttcactcaggtgtgcc

SEQ ID NO: 360765 - DNA, 25 bp, Rattus norvegicus
gatcaagatttctctcaggtgtgcc

SEQ ID NO: 360766 - DNA, 25 bp, Rattus norvegicus
gatcaagcaaatcccacgtatcctg

SEQ ID NO: 360767 - DNA, 25 bp, Rattus norvegicus
gatcaagcaaatgccacgtatcctg

SEQ ID NO: 360768 - DNA, 25 bp, Rattus norvegicus
gatcaagcacacattttcctattaa

SEQ ID NO: 360769 - DNA, 25 bp, Rattus norvegicus
gatcaagcacactttttcctattaa

SEQ ID NO: 360770 - DNA, 25 bp, Rattus norvegicus
gatcaagcaggtagtatacacctga

SEQ ID NO: 360771 - DNA, 25 bp, Rattus norvegicus
gatcaagcaggttgtatacacctga

SEQ ID NO: 360772 - DNA, 25 bp, Rattus norvegicus
gatcaagccagtaaacattgcagca

SEQ ID NO: 360773 - DNA, 25 bp, Rattus norvegicus
gatcaagccagttaacattgcagca

SEQ ID NO: 360774 - DNA, 25 bp, Rattus norvegicus
gatcaagccccgaattacagagcag

SEQ ID NO: 360775 - DNA, 25 bp, Rattus norvegicus
gatcaagccccgtattacagagcag

SEQ ID NO: 360776 - DNA, 25 bp, Rattus norvegicus
gatcaagccctaattacggacaaag

SEQ ID NO: 360777 - DNA, 25 bp, Rattus norvegicus
gatcaagccctatttacggacaaag

SEQ ID NO: 360778 - DNA, 25 bp, Rattus norvegicus
gatcaagccggaagccaaaaccata

SEQ ID NO: 360779 - DNA, 25 bp, Rattus norvegicus
gatcaagccggatgccaaaaccata

SEQ ID NO: 360780 - DNA, 25 bp, Rattus norvegicus
gatcaagccgtcagtaaagtttcaa

SEQ ID NO: 360781 - DNA, 25 bp, Rattus norvegicus
gatcaagccgtctgtaaagtttcaa

SEQ ID NO: 360782 - DNA, 25 bp, Rattus norvegicus
gatcaagcctatctcagttcagagt

SEQ ID NO: 360783 - DNA, 25 bp, Rattus norvegicus
gatcaagcctatgtcagttcagagt

SEQ ID NO: 360784 - DNA, 25 bp, Rattus norvegicus
gatcaagcgctcaacgccgaggagg

SEQ ID NO: 360785 - DNA, 25 bp, Rattus norvegicus
gatcaagcgctctacgccgaggagg

SEQ ID NO: 360786 - DNA, 25 bp, Rattus norvegicus
gatcaagctaagaatactccttact

SEQ ID NO: 360787 - DNA, 25 bp, Rattus norvegicus
gatcaagctaagtatactccttact

SEQ ID NO: 360788 - DNA, 25 bp, Rattus norvegicus
gatcaagctattaccaagctctgcc

SEQ ID NO: 360789 - DNA, 25 bp, Rattus norvegicus
gatcaagctatttccaagctctgcc

SEQ ID NO: 360790 - DNA, 25 bp, Rattus norvegicus
gatcaagctgcacctctacaaccag

SEQ ID NO: 360791 - DNA, 25 bp, Rattus norvegicus
gatcaagctgcagctctacaaccag

SEQ ID NO: 360792 - DNA, 25 bp, Rattus norvegicus
gatcaaggacgaatctgggacccag

SEQ ID NO: 360793 - DNA, 25 bp, Rattus norvegicus
gatcaaggacgattctgggacccag

SEQ ID NO: 360794 - DNA, 25 bp, Rattus norvegicus
gatcaaggcctcagtttgccaccaa

SEQ ID NO: 360795 - DNA, 25 bp, Rattus norvegicus
gatcaaggcctctgtttgccaccaa

SEQ ID NO: 360796 - DNA, 25 bp, Rattus norvegicus
gatcaagggcgacacatctggagac

SEQ ID NO: 360797 - DNA, 25 bp, Rattus norvegicus
gatcaagggcgagacatctggagac

SEQ ID NO: 360798 - DNA, 25 bp, Rattus norvegicus
gatcaaggtcgtctcttttaagagt

SEQ ID NO: 360799 - DNA, 25 bp, Rattus norvegicus
gatcaaggtcgtgtcttttaagagt

SEQ ID NO: 360800 - DNA, 25 bp, Rattus norvegicus
gatcaaggtttccactcagtcataa

SEQ ID NO: 360801 - DNA, 25 bp, Rattus norvegicus
gatcaaggtttcgactcagtcataa

SEQ ID NO: 360802 - DNA, 25 bp, Rattus norvegicus
gatcaagtacctcgagacactcctg

SEQ ID NO: 360803 - DNA, 25 bp, Rattus norvegicus
gatcaagtacctggagacactcctg

SEQ ID NO: 360804 - DNA, 25 bp, Rattus norvegicus
gatcaagtcattacttttgcctctg

SEQ ID NO: 360805 - DNA, 25 bp, Rattus norvegicus
gatcaagtcatttcttttgcctctg

SEQ ID NO: 360806 - DNA, 25 bp, Rattus norvegicus
gatcaagtccctctcttagagtcaa

SEQ ID NO: 360807 - DNA, 25 bp, Rattus norvegicus
gatcaagtccctgtcttagagtcaa

SEQ ID NO: 360808 - DNA, 25 bp, Rattus norvegicus
gatcaagtctatcaacacctggaat

SEQ ID NO: 360809 - DNA, 25 bp, Rattus norvegicus
gatcaagtctatgaacacctggaat

SEQ ID NO: 360810 - DNA, 25 bp, Rattus norvegicus
gatcaagtgagaaccactggagcct

SEQ ID NO: 360811 - DNA, 25 bp, Rattus norvegicus
gatcaagtgagatccactggagcct

SEQ ID NO: 360812 - DNA, 25 bp, Rattus norvegicus
gatcaagtgcagatgctgtaccaca

SEQ ID NO: 360813 - DNA, 25 bp, Rattus norvegicus
gatcaagtgcagttgctgtaccaca

SEQ ID NO: 360814 - DNA, 25 bp, Rattus norvegicus
gatcaagtgcccaactgcagaccaa

SEQ ID NO: 360815 - DNA, 25 bp, Rattus norvegicus
gatcaagtgccctactgcagaccaa

SEQ ID NO: 360816 - DNA, 25 bp, Rattus norvegicus
gatcaagtgggtacgctggattcaa

SEQ ID NO: 360817 - DNA, 25 bp, Rattus norvegicus
gatcaagtgggttcgctggattcaa

SEQ ID NO: 360818 - DNA, 25 bp, Rattus norvegicus
gatcaagttcagagctgtaggacat

SEQ ID NO: 360819 - DNA, 25 bp, Rattus norvegicus
gatcaagttcagtgctgtaggacat

SEQ ID NO: 360820 - DNA, 25 bp, Rattus norvegicus
gatcaagttctacagtgttcccagc

SEQ ID NO: 360821 - DNA, 25 bp, Rattus norvegicus
gatcaagttctagagtgttcccagc

SEQ ID NO: 360822 - DNA, 25 bp, Rattus norvegicus
gatcaagttcttctggagtcagaca

SEQ ID NO: 360823 - DNA, 25 bp, Rattus norvegicus
gatcaagttcttgtggagtcagaca

SEQ ID NO: 360824 - DNA, 25 bp, Rattus norvegicus
gatcaagttgataaaggcccttcat

SEQ ID NO: 360825 - DNA, 25 bp, Rattus norvegicus
gatcaagttgattaaggcccttcat

SEQ ID NO: 360826 - DNA, 25 bp, Rattus norvegicus
gatcaagttttacatccttctctct

SEQ ID NO: 360827 - DNA, 25 bp, Rattus norvegicus
gatcaagttttagatccttctctct

SEQ ID NO: 360828 - DNA, 25 bp, Rattus norvegicus
gatcaataaacacttgtggaataca

SEQ ID NO: 360829 - DNA, 25 bp, Rattus norvegicus
gatcaataaacagttgtggaataca

SEQ ID NO: 360830 - DNA, 25 bp, Rattus norvegicus
gatcaataaagtattctctgcttct

SEQ ID NO: 360831 - DNA, 25 bp, Rattus norvegicus
gatcaataaagttttctctgcttct

SEQ ID NO: 360832 - DNA, 25 bp, Rattus norvegicus
gatcaataccgaagcctccaaaatg

SEQ ID NO: 360833 - DNA, 25 bp, Rattus norvegicus
gatcaataccgatgcctccaaaatg

SEQ ID NO: 360834 - DNA, 25 bp, Rattus norvegicus
gatcaatagcgccactcttattttt

SEQ ID NO: 360835 - DNA, 25 bp, Rattus norvegicus
gatcaatagcgcgactcttattttt

SEQ ID NO: 360836 - DNA, 25 bp, Rattus norvegicus
gatcaatcagtcacatctgcctttt

SEQ ID NO: 360837 - DNA, 25 bp, Rattus norvegicus
gatcaatcagtctcatctgcctttt

SEQ ID NO: 360838 - DNA, 25 bp, Rattus norvegicus
gatcaatcattgagtccgtgtggaa

SEQ ID NO: 360839 - DNA, 25 bp, Rattus norvegicus
gatcaatcattgtgtccgtgtggaa

SEQ ID NO: 360840 - DNA, 25 bp, Rattus norvegicus
gatcaatcctgtcaaaacatcccga

SEQ ID NO: 360841 - DNA, 25 bp, Rattus norvegicus
gatcaatcctgtgaaaacatcccga

SEQ ID NO: 360842 - DNA, 25 bp, Rattus norvegicus
gatcaatctggacggctcagcaact

SEQ ID NO: 360843 - DNA, 25 bp, Rattus norvegicus
gatcaatctggagggctcagcaact

SEQ ID NO: 360844 - DNA, 25 bp, Rattus norvegicus
gatcaatcttgtattttctgaccac

SEQ ID NO: 360845 - DNA, 25 bp, Rattus norvegicus
gatcaatcttgttttttctgaccac

SEQ ID NO: 360846 - DNA, 25 bp, Rattus norvegicus
gatcaatgacagcaaccctgcaggg

SEQ ID NO: 360847 - DNA, 25 bp, Rattus norvegicus
gatcaatgacaggaaccctgcaggg

SEQ ID NO: 360848 - DNA, 25 bp, Rattus norvegicus
gatcaatgaggcctttgcaagtcag

SEQ ID NO: 360849 - DNA, 25 bp, Rattus norvegicus
gatcaatgaggcgtttgcaagtcag

SEQ ID NO: 360850 - DNA, 25 bp, Rattus norvegicus
gatcaatgatttctctctaatctgt

SEQ ID NO: 360851 - DNA, 25 bp, Rattus norvegicus
gatcaatgatttgtctctaatctgt

SEQ ID NO: 360852 - DNA, 25 bp, Rattus norvegicus
gatcaatgcaaaagtcaccagtctg

SEQ ID NO: 360853 - DNA, 25 bp, Rattus norvegicus
gatcaatgcaaatgtcaccagtctg

SEQ ID NO: 360854 - DNA, 25 bp, Rattus norvegicus
gatcaatgcttgcttgcactcatgt

SEQ ID NO: 360855 - DNA, 25 bp, Rattus norvegicus
gatcaatgcttggttgcactcatgt

SEQ ID NO: 360856 - DNA, 25 bp, Rattus norvegicus
gatcaatggattctttactgagtga

SEQ ID NO: 360857 - DNA, 25 bp, Rattus norvegicus
gatcaatggattgtttactgagtga

SEQ ID NO: 360858 - DNA, 25 bp, Rattus norvegicus
gatcaatggttgagtagaggctctg

SEQ ID NO: 360859 - DNA, 25 bp, Rattus norvegicus
gatcaatggttgtgtagaggctctg

SEQ ID NO: 360860 - DNA, 25 bp, Rattus norvegicus
gatcaatgtgctctacaaccgcatc

SEQ ID NO: 360861 - DNA, 25 bp, Rattus norvegicus
gatcaatgtgctgtacaaccgcatc

SEQ ID NO: 360862 - DNA, 25 bp, Rattus norvegicus
gatcaatgtggacccaagccgagca

SEQ ID NO: 360863 - DNA, 25 bp, Rattus norvegicus
gatcaatgtggagccaagccgagca

SEQ ID NO: 360864 - DNA, 25 bp, Rattus norvegicus
gatcaatgttgaaccttggctgaac

SEQ ID NO: 360865 - DNA, 25 bp, Rattus norvegicus
gatcaatgttgatccttggctgaac

SEQ ID NO: 360866 - DNA, 25 bp, Rattus norvegicus
gatcaatgtttacttcctcttagac

SEQ ID NO: 360867 - DNA, 25 bp, Rattus norvegicus
gatcaatgtttagttcctcttagac

SEQ ID NO: 360868 - DNA, 25 bp, Rattus norvegicus
gatcaattctttctggcctgttatg

SEQ ID NO: 360869 - DNA, 25 bp, Rattus norvegicus
gatcaattctttctttcttgcacac

SEQ ID NO: 360870 - DNA, 25 bp, Rattus norvegicus
gatcaattctttgtggcctgttatg

SEQ ID NO: 360871 - DNA, 25 bp, Rattus norvegicus
gatcaattctttgtttcttgcacac

SEQ ID NO: 360872 - DNA, 25 bp, Rattus norvegicus
gatcaattgattcttccctgcccct

SEQ ID NO: 360873 - DNA, 25 bp, Rattus norvegicus
gatcaattgattgttccctgcccct

SEQ ID NO: 360874 - DNA, 25 bp, Rattus norvegicus
gatcaattggatcttttcctgtcat

SEQ ID NO: 360875 - DNA, 25 bp, Rattus norvegicus
gatcaattggatgttttcctgtcat

SEQ ID NO: 360876 - DNA, 25 bp, Rattus norvegicus
gatcaattgttaacattcactgtag

SEQ ID NO: 360877 - DNA, 25 bp, Rattus norvegicus
gatcaattgttacctgagccttgct

SEQ ID NO: 360878 - DNA, 25 bp, Rattus norvegicus
gatcaattgttagctgagccttgct

SEQ ID NO: 360879 - DNA, 25 bp, Rattus norvegicus
gatcaattgttatcattcactgtag

SEQ ID NO: 360880 - DNA, 25 bp, Rattus norvegicus
gatcaatttcaacccctgcttatga

SEQ ID NO: 360881 - DNA, 25 bp, Rattus norvegicus
gatcaatttcaagccctgcttatga

SEQ ID NO: 360882 - DNA, 25 bp, Rattus norvegicus
gatcaattttccaagactagtcata

SEQ ID NO: 360883 - DNA, 25 bp, Rattus norvegicus
gatcaattttcctagactagtcata

SEQ ID NO: 360884 - DNA, 25 bp, Rattus norvegicus
gatcacaaaaccaacaggctgtctt

SEQ ID NO: 360885 - DNA, 25 bp, Rattus norvegicus
gatcacaaaacctacaggctgtctt

SEQ ID NO: 360886 - DNA, 25 bp, Rattus norvegicus
gatcacaaacgtcgagtcccagctg

SEQ ID NO: 360887 - DNA, 25 bp, Rattus norvegicus
gatcacaaacgtggagtcccagctg

SEQ ID NO: 360888 - DNA, 25 bp, Rattus norvegicus
gatcacaacctcaatggaaggagga

SEQ ID NO: 360889 - DNA, 25 bp, Rattus norvegicus
gatcacaacctctatggaaggagga

SEQ ID NO: 360890 - DNA, 25 bp, Rattus norvegicus
gatcacaactgactgcgtggttcct

SEQ ID NO: 360891 - DNA, 25 bp, Rattus norvegicus
gatcacaactgagtgcgtggttcct

SEQ ID NO: 360892 - DNA, 25 bp, Rattus norvegicus
gatcacaaggacaccggtgcgcgtc

SEQ ID NO: 360893 - DNA, 25 bp, Rattus norvegicus
gatcacaaggactccggtgcgcgtc

SEQ ID NO: 360894 - DNA, 25 bp, Rattus norvegicus
gatcacaagttcaaagttggccctg

SEQ ID NO: 360895 - DNA, 25 bp, Rattus norvegicus
gatcacaagttcagtcattcatatt

SEQ ID NO: 360896 - DNA, 25 bp, Rattus norvegicus
gatcacaagttctaagttggccctg

SEQ ID NO: 360897 - DNA, 25 bp, Rattus norvegicus
gatcacaagttctgtcattcatatt

SEQ ID NO: 360898 - DNA, 25 bp, Rattus norvegicus
gatcacaatacaactttatgccaat

SEQ ID NO: 360899 - DNA, 25 bp, Rattus norvegicus
gatcacaatacatctttatgccaat

SEQ ID NO: 360900 - DNA, 25 bp, Rattus norvegicus
gatcacaatgccagtcatctttaat

SEQ ID NO: 360901 - DNA, 25 bp, Rattus norvegicus
gatcacaatgcctgtcatctttaat

SEQ ID NO: 360902 - DNA, 25 bp, Rattus norvegicus
gatcacaatttaattcttcagcttt

SEQ ID NO: 360903 - DNA, 25 bp, Rattus norvegicus
gatcacaatttatttcttcagcttt

SEQ ID NO: 360904 - DNA, 25 bp, Rattus norvegicus
gatcacacacagatgtaattcagtt

SEQ ID NO: 360905 - DNA, 25 bp, Rattus norvegicus
gatcacacacagttgtaattcagtt

SEQ ID NO: 360906 - DNA, 25 bp, Rattus norvegicus
gatcacaccattcagttccggagag

SEQ ID NO: 360907 - DNA, 25 bp, Rattus norvegicus
gatcacaccattcgtaaatccagag

SEQ ID NO: 360908 - DNA, 25 bp, Rattus norvegicus
gatcacaccattgagttccggagag

SEQ ID NO: 360909 - DNA, 25 bp, Rattus norvegicus
gatcacaccattggtaaatccagag

SEQ ID NO: 360910 - DNA, 25 bp, Rattus norvegicus
gatcacacccatacaatccaaagaa

SEQ ID NO: 360911 - DNA, 25 bp, Rattus norvegicus
gatcacacccattcaatccaaagaa

SEQ ID NO: 360912 - DNA, 25 bp, Rattus norvegicus
gatcacaccctcatcagagtcatag

SEQ ID NO: 360913 - DNA, 25 bp, Rattus norvegicus
gatcacaccctcttcagagtcatag

SEQ ID NO: 360914 - DNA, 25 bp, Rattus norvegicus
gatcacacgtagcttcgattcgctg

SEQ ID NO: 360915 - DNA, 25 bp, Rattus norvegicus
gatcacacgtaggttcgattcgctg

SEQ ID NO: 360916 - DNA, 25 bp, Rattus norvegicus
gatcacacgtgaaggactagccctt

SEQ ID NO: 360917 - DNA, 25 bp, Rattus norvegicus
gatcacacgtgatggactagccctt

SEQ ID NO: 360918 - DNA, 25 bp, Rattus norvegicus
gatcacagacgaacatatccggaat

SEQ ID NO: 360919 - DNA, 25 bp, Rattus norvegicus
gatcacagacgatcatatccggaat

SEQ ID NO: 360920 - DNA, 25 bp, Rattus norvegicus
gatcacagaggaactcgccaagatt

SEQ ID NO: 360921 - DNA, 25 bp, Rattus norvegicus
gatcacagaggatctcgccaagatt

SEQ ID NO: 360922 - DNA, 25 bp, Rattus norvegicus
gatcacagatctccagatgactacc

SEQ ID NO: 360923 - DNA, 25 bp, Rattus norvegicus
gatcacagatctgcagatgactacc

SEQ ID NO: 360924 - DNA, 25 bp, Rattus norvegicus
gatcacagcatccacctaaagtttg

SEQ ID NO: 360925 - DNA, 25 bp, Rattus norvegicus
gatcacagcatcgacctaaagtttg

SEQ ID NO: 360926 - DNA, 25 bp, Rattus norvegicus
gatcacagccaaaggagacatcaac

SEQ ID NO: 360927 - DNA, 25 bp, Rattus norvegicus
gatcacagccaatggagacatcaac

SEQ ID NO: 360928 - DNA, 25 bp, Rattus norvegicus
gatcacagcgaaatcacgacatgaa

SEQ ID NO: 360929 - DNA, 25 bp, Rattus norvegicus
gatcacagcgaattcacgacatgaa

SEQ ID NO: 360930 - DNA, 25 bp, Rattus norvegicus
gatcacagctagaacaggtcaccct

SEQ ID NO: 360931 - DNA, 25 bp, Rattus norvegicus
gatcacagctagtacaggtcaccct

SEQ ID NO: 360932 - DNA, 25 bp, Rattus norvegicus
gatcacagcttcagtcttggcacta

SEQ ID NO: 360933 - DNA, 25 bp, Rattus norvegicus
gatcacagcttctgtcttggcacta

SEQ ID NO: 360934 - DNA, 25 bp, Rattus norvegicus
gatcacagcttgagtcggcaaaact

SEQ ID NO: 360935 - DNA, 25 bp, Rattus norvegicus
gatcacagcttgtgtcggcaaaact

SEQ ID NO: 360936 - DNA, 25 bp, Rattus norvegicus
gatcacagtattcttgcccactttg

SEQ ID NO: 360937 - DNA, 25 bp, Rattus norvegicus
gatcacagtattgttgcccactttg

SEQ ID NO: 360938 - DNA, 25 bp, Rattus norvegicus
gatcacagtcacacagtacatccta

SEQ ID NO: 360939 - DNA, 25 bp, Rattus norvegicus
gatcacagtcactcagtacatccta

SEQ ID NO: 360940 - DNA, 25 bp, Rattus norvegicus
gatcacagtcatcttcctgaaggag

SEQ ID NO: 360941 - DNA, 25 bp, Rattus norvegicus
gatcacagtcatgttcctgaaggag

SEQ ID NO: 360942 - DNA, 25 bp, Rattus norvegicus
gatcacagtggccaaaacccctttt

SEQ ID NO: 360943 - DNA, 25 bp, Rattus norvegicus
gatcacagtggcgaaaacccctttt

SEQ ID NO: 360944 - DNA, 25 bp, Rattus norvegicus
gatcacagtgtaagacctcagtcag

SEQ ID NO: 360945 - DNA, 25 bp, Rattus norvegicus
gatcacagtgtatgacctcagtcag

SEQ ID NO: 360946 - DNA, 25 bp, Rattus norvegicus
gatcacatacatattctcataacaa

SEQ ID NO: 360947 - DNA, 25 bp, Rattus norvegicus
gatcacatacattttctcataacaa

SEQ ID NO: 360948 - DNA, 25 bp, Rattus norvegicus
gatcacatatttatctctggatgct

SEQ ID NO: 360949 - DNA, 25 bp, Rattus norvegicus
gatcacatatttttctctggatgct

SEQ ID NO: 360950 - DNA, 25 bp, Rattus norvegicus
gatcacatcatcacattcctggaag

SEQ ID NO: 360951 - DNA, 25 bp, Rattus norvegicus
gatcacatcatctcattcctggaag

SEQ ID NO: 360952 - DNA, 25 bp, Rattus norvegicus
gatcacatctataggagtcaacaca

SEQ ID NO: 360953 - DNA, 25 bp, Rattus norvegicus
gatcacatctattggagtcaacaca

SEQ ID NO: 360954 - DNA, 25 bp, Rattus norvegicus
gatcacatgacccatttttggtgta

SEQ ID NO: 360955 - DNA, 25 bp, Rattus norvegicus
gatcacatgaccgatttttggtgta

SEQ ID NO: 360956 - DNA, 25 bp, Rattus norvegicus
gatcacatgagaccgaggactaaat

SEQ ID NO: 360957 - DNA, 25 bp, Rattus norvegicus
gatcacatgagagcgaggactaaat

SEQ ID NO: 360958 - DNA, 25 bp, Rattus norvegicus
gatcacatggagcaacacagcagaa

SEQ ID NO: 360959 - DNA, 25 bp, Rattus norvegicus
gatcacatggaggaacacagcagaa

SEQ ID NO: 360960 - DNA, 25 bp, Rattus norvegicus
gatcacatggccagacagacacacg

SEQ ID NO: 360961 - DNA, 25 bp, Rattus norvegicus
gatcacatggcctgacagacacacg

SEQ ID NO: 360962 - DNA, 25 bp, Rattus norvegicus
gatcacatgtatatgtcttccctgc

SEQ ID NO: 360963 - DNA, 25 bp, Rattus norvegicus
gatcacatgtatttgtcttccctgc

SEQ ID NO: 360964 - DNA, 25 bp, Rattus norvegicus
gatcacattggccagatttaagcat

SEQ ID NO: 360965 - DNA, 25 bp, Rattus norvegicus
gatcacattggcgagatttaagcat

SEQ ID NO: 360966 - DNA, 25 bp, Rattus norvegicus
gatcacatttttcggtggcttaaaa

SEQ ID NO: 360967 - DNA, 25 bp, Rattus norvegicus
gatcacatttttgggtggcttaaaa

SEQ ID NO: 360968 - DNA, 25 bp, Rattus norvegicus
gatcaccactcgagtatagcagcac

SEQ ID NO: 360969 - DNA, 25 bp, Rattus norvegicus
gatcaccactcgtgtatagcagcac

SEQ ID NO: 360970 - DNA, 25 bp, Rattus norvegicus
gatcaccactgcagtttcctatgtg

SEQ ID NO: 360971 - DNA, 25 bp, Rattus norvegicus
gatcaccactgctgtttcctatgtg

SEQ ID NO: 360972 - DNA, 25 bp, Rattus norvegicus
gatcaccactggaagaggcatgagc

SEQ ID NO: 360973 - DNA, 25 bp, Rattus norvegicus
gatcaccactggtagaggcatgagc

SEQ ID NO: 360974 - DNA, 25 bp, Rattus norvegicus
gatcaccactgtctaaacatcactt

SEQ ID NO: 360975 - DNA, 25 bp, Rattus norvegicus
gatcaccactgtgtaaacatcactt

SEQ ID NO: 360976 - DNA, 25 bp, Rattus norvegicus
gatcaccagatgctgaggctgcttt

SEQ ID NO: 360977 - DNA, 25 bp, Rattus norvegicus
gatcaccagatggtgaggctgcttt

SEQ ID NO: 360978 - DNA, 25 bp, Rattus norvegicus
gatcaccaggtgcagtattgctact

SEQ ID NO: 360979 - DNA, 25 bp, Rattus norvegicus
gatcaccaggtggagtattgctact

SEQ ID NO: 360980 - DNA, 25 bp, Rattus norvegicus
gatcaccagtgccttcctaaataaa

SEQ ID NO: 360981 - DNA, 25 bp, Rattus norvegicus
gatcaccagtgcgttcctaaataaa

SEQ ID NO: 360982 - DNA, 25 bp, Rattus norvegicus
gatcaccatttcatcaagacggact

SEQ ID NO: 360983 - DNA, 25 bp, Rattus norvegicus
gatcaccatttcttcaagacggact

SEQ ID NO: 360984 - DNA, 25 bp, Rattus norvegicus
gatcacccacagcagcaaatctctg

SEQ ID NO: 360985 - DNA, 25 bp, Rattus norvegicus
gatcacccacaggagcaaatctctg

SEQ ID NO: 360986 - DNA, 25 bp, Rattus norvegicus
gatcacccagcgagcattccaaaag

SEQ ID NO: 360987 - DNA, 25 bp, Rattus norvegicus
gatcacccagcgtgcattccaaaag

SEQ ID NO: 360988 - DNA, 25 bp, Rattus norvegicus
gatcaccccatgacatctattgtga

SEQ ID NO: 360989 - DNA, 25 bp, Rattus norvegicus
gatcaccccatgtcatctattgtga

SEQ ID NO: 360990 - DNA, 25 bp, Rattus norvegicus
gatcacccgactcgatccagttgga

SEQ ID NO: 360991 - DNA, 25 bp, Rattus norvegicus
gatcacccgactggatccagttgga

SEQ ID NO: 360992 - DNA, 25 bp, Rattus norvegicus
gatcacccgggcaggcatcaagaga

SEQ ID NO: 360993 - DNA, 25 bp, Rattus norvegicus
gatcacccgggctggcatcaagaga

SEQ ID NO: 360994 - DNA, 25 bp, Rattus norvegicus
gatcacccgttaactgtgattacag

SEQ ID NO: 360995 - DNA, 25 bp, Rattus norvegicus
gatcacccgttatctgtgattacag

SEQ ID NO: 360996 - DNA, 25 bp, Rattus norvegicus
gatcaccctgaaagctcctaataaa

SEQ ID NO: 360997 - DNA, 25 bp, Rattus norvegicus
gatcaccctgaatgctcctaataaa

SEQ ID NO: 360998 - DNA, 25 bp, Rattus norvegicus
gatcaccgagggaatggtctgtgct

SEQ ID NO: 360999 - DNA, 25 bp, Rattus norvegicus
gatcaccgagggtatggtctgtgct

SEQ ID NO: 361000 - DNA, 25 bp, Rattus norvegicus
gatcacctaggtagggcttttcctc

SEQ ID NO: 361001 - DNA, 25 bp, Rattus norvegicus
gatcacctaggttgggcttttcctc

SEQ ID NO: 361002 - DNA, 25 bp, Rattus norvegicus
gatcacctcagaagccctggctgtg

SEQ ID NO: 361003 - DNA, 25 bp, Rattus norvegicus
gatcacctcagatgccctggctgtg

SEQ ID NO: 361004 - DNA, 25 bp, Rattus norvegicus
gatcacctcggccttaaacagaagt

SEQ ID NO: 361005 - DNA, 25 bp, Rattus norvegicus
gatcacctcggcgttaaacagaagt

SEQ ID NO: 361006 - DNA, 25 bp, Rattus norvegicus
gatcacctgagtataaacgtttaga

SEQ ID NO: 361007 - DNA, 25 bp, Rattus norvegicus
gatcacctgagtttaaacgtttaga

SEQ ID NO: 361008 - DNA, 25 bp, Rattus norvegicus
gatcacctgctacatatgttcgtct

SEQ ID NO: 361009 - DNA, 25 bp, Rattus norvegicus
gatcacctgctagatatgttcgtct

SEQ ID NO: 361010 - DNA, 25 bp, Rattus norvegicus
gatcacctggagcttaagttacttg

SEQ ID NO: 361011 - DNA, 25 bp, Rattus norvegicus
gatcacctggaggttaagttacttg

SEQ ID NO: 361012 - DNA, 25 bp, Rattus norvegicus
gatcacctggtcactgagttattct

SEQ ID NO: 361013 - DNA, 25 bp, Rattus norvegicus
gatcacctggtctctgagttattct

SEQ ID NO: 361014 - DNA, 25 bp, Rattus norvegicus
gatcacctggttatcatatcattaa

SEQ ID NO: 361015 - DNA, 25 bp, Rattus norvegicus
gatcacctggttttcatatcattaa

SEQ ID NO: 361016 - DNA, 25 bp, Rattus norvegicus
gatcacctgtgaaggcgcatgtggt

SEQ ID NO: 361017 - DNA, 25 bp, Rattus norvegicus
gatcacctgtgatggcgcatgtggt

SEQ ID NO: 361018 - DNA, 25 bp, Rattus norvegicus
gatcacctgttcattaaatcctatg

SEQ ID NO: 361019 - DNA, 25 bp, Rattus norvegicus
gatcacctgttctttaaatcctatg

SEQ ID NO: 361020 - DNA, 25 bp, Rattus norvegicus
gatcaccttactattcctttcaatt

SEQ ID NO: 361021 - DNA, 25 bp, Rattus norvegicus
gatcaccttacttttcctttcaatt

SEQ ID NO: 361022 - DNA, 25 bp, Rattus norvegicus
gatcaccttggccagcagtacaata

SEQ ID NO: 361023 - DNA, 25 bp, Rattus norvegicus
gatcaccttggcgagcagtacaata

SEQ ID NO: 361024 - DNA, 25 bp, Rattus norvegicus
gatcacgagaaacaataaggcgcct

SEQ ID NO: 361025 - DNA, 25 bp, Rattus norvegicus
gatcacgagaaagaataaggcgcct

SEQ ID NO: 361026 - DNA, 25 bp, Rattus norvegicus
gatcacgagacccaattaaacttca

SEQ ID NO: 361027 - DNA, 25 bp, Rattus norvegicus
gatcacgagaccgaattaaacttca

SEQ ID NO: 361028 - DNA, 25 bp, Rattus norvegicus
gatcacgataaacctgcaacttatg

SEQ ID NO: 361029 - DNA, 25 bp, Rattus norvegicus
gatcacgataaagctgcaacttatg

SEQ ID NO: 361030 - DNA, 25 bp, Rattus norvegicus
gatcacgcacctcgttgatgacata

SEQ ID NO: 361031 - DNA, 25 bp, Rattus norvegicus
gatcacgcacctggttgatgacata

SEQ ID NO: 361032 - DNA, 25 bp, Rattus norvegicus
gatcacgcccggagtagaagcgcat

SEQ ID NO: 361033 - DNA, 25 bp, Rattus norvegicus
gatcacgcccggtgtagaagcgcat

SEQ ID NO: 361034 - DNA, 25 bp, Rattus norvegicus
gatcacgccttaaaatgacccgaag

SEQ ID NO: 361035 - DNA, 25 bp, Rattus norvegicus
gatcacgccttataatgacccgaag

SEQ ID NO: 361036 - DNA, 25 bp, Rattus norvegicus
gatcacgcggaaattcaggctgaat

SEQ ID NO: 361037 - DNA, 25 bp, Rattus norvegicus
gatcacgcggaatttcaggctgaat

SEQ ID NO: 361038 - DNA, 25 bp, Rattus norvegicus
gatcacggagacaacttcccatttg

SEQ ID NO: 361039 - DNA, 25 bp, Rattus norvegicus
gatcacggagactacttcccatttg

SEQ ID NO: 361040 - DNA, 25 bp, Rattus norvegicus
gatcacggccaaattctttaactgc

SEQ ID NO: 361041 - DNA, 25 bp, Rattus norvegicus
gatcacggccaatttctttaactgc

SEQ ID NO: 361042 - DNA, 25 bp, Rattus norvegicus
gatcacggtcccaggctgcaaagca

SEQ ID NO: 361043 - DNA, 25 bp, Rattus norvegicus
gatcacggtccctggctgcaaagca

SEQ ID NO: 361044 - DNA, 25 bp, Rattus norvegicus
gatcacggttttcatgcttgtttta

SEQ ID NO: 361045 - DNA, 25 bp, Rattus norvegicus
gatcacggttttgatgcttgtttta

SEQ ID NO: 361046 - DNA, 25 bp, Rattus norvegicus
gatcacgtattaacagtcctctgga

SEQ ID NO: 361047 - DNA, 25 bp, Rattus norvegicus
gatcacgtattatcagtcctctgga

SEQ ID NO: 361048 - DNA, 25 bp, Rattus norvegicus
gatcacgtcaccagtgaattgccaa

SEQ ID NO: 361049 - DNA, 25 bp, Rattus norvegicus
gatcacgtcacctgtgaattgccaa

SEQ ID NO: 361050 - DNA, 25 bp, Rattus norvegicus
gatcacgtctaactctagagtgctt

SEQ ID NO: 361051 - DNA, 25 bp, Rattus norvegicus
gatcacgtctaagtctagagtgctt

SEQ ID NO: 361052 - DNA, 25 bp, Rattus norvegicus
gatcacgtgaacaactgaaccagca

SEQ ID NO: 361053 - DNA, 25 bp, Rattus norvegicus
gatcacgtgaactactgaaccagca

SEQ ID NO: 361054 - DNA, 25 bp, Rattus norvegicus
gatcacgtgaatatgagcgaactca

SEQ ID NO: 361055 - DNA, 25 bp, Rattus norvegicus
gatcacgtgaatttgagcgaactca

SEQ ID NO: 361056 - DNA, 25 bp, Rattus norvegicus
gatcacgtgcacatcggccatggct

SEQ ID NO: 361057 - DNA, 25 bp, Rattus norvegicus
gatcacgtgcacttcggccatggct

SEQ ID NO: 361058 - DNA, 25 bp, Rattus norvegicus
gatcacgtggaacgtccactgccat

SEQ ID NO: 361059 - DNA, 25 bp, Rattus norvegicus
gatcacgtggaaggtccactgccat

SEQ ID NO: 361060 - DNA, 25 bp, Rattus norvegicus
gatcacgttctcagtttttaaatta

SEQ ID NO: 361061 - DNA, 25 bp, Rattus norvegicus
gatcacgttctctgtttttaaatta

SEQ ID NO: 361062 - DNA, 25 bp, Rattus norvegicus
gatcactaaccacagcaggccacaa

SEQ ID NO: 361063 - DNA, 25 bp, Rattus norvegicus
gatcactaaccagagcaggccacaa

SEQ ID NO: 361064 - DNA, 25 bp, Rattus norvegicus
gatcactaacttcttcagcaacagt

SEQ ID NO: 361065 - DNA, 25 bp, Rattus norvegicus
gatcactaacttgttcagcaacagt

SEQ ID NO: 361066 - DNA, 25 bp, Rattus norvegicus
gatcactaaggaagtggtgctccaa

SEQ ID NO: 361067 - DNA, 25 bp, Rattus norvegicus
gatcactaaggatgtggtgctccaa

SEQ ID NO: 361068 - DNA, 25 bp, Rattus norvegicus
gatcactacattctccttaactctc

SEQ ID NO: 361069 - DNA, 25 bp, Rattus norvegicus
gatcactacattgtccttaactctc

SEQ ID NO: 361070 - DNA, 25 bp, Rattus norvegicus
gatcactagatcaactgactgcaag

SEQ ID NO: 361071 - DNA, 25 bp, Rattus norvegicus
gatcactagatctactgactgcaag

SEQ ID NO: 361072 - DNA, 25 bp, Rattus norvegicus
gatcactcaaggaaaattttttctg

SEQ ID NO: 361073 - DNA, 25 bp, Rattus norvegicus
gatcactcaaggtaaattttttctg

SEQ ID NO: 361074 - DNA, 25 bp, Rattus norvegicus
gatcactcagcaaacacatgtgcag

SEQ ID NO: 361075 - DNA, 25 bp, Rattus norvegicus
gatcactcagcatacacatgtgcag

SEQ ID NO: 361076 - DNA, 25 bp, Rattus norvegicus
gatcactcaggaaatgtccggccag

SEQ ID NO: 361077 - DNA, 25 bp, Rattus norvegicus
gatcactcaggatatgtccggccag

SEQ ID NO: 361078 - DNA, 25 bp, Rattus norvegicus
gatcactcagtcataaggtttcagg

SEQ ID NO: 361079 - DNA, 25 bp, Rattus norvegicus
gatcactcagtcttaaggtttcagg

SEQ ID NO: 361080 - DNA, 25 bp, Rattus norvegicus
gatcactccgacatgttctatggaa

SEQ ID NO: 361081 - DNA, 25 bp, Rattus norvegicus
gatcactccgacttgttctatggaa

SEQ ID NO: 361082 - DNA, 25 bp, Rattus norvegicus
gatcactctacacgagacattctca

SEQ ID NO: 361083 - DNA, 25 bp, Rattus norvegicus
gatcactctacaggagacattctca

SEQ ID NO: 361084 - DNA, 25 bp, Rattus norvegicus
gatcactctcagcaaagccaggaac

SEQ ID NO: 361085 - DNA, 25 bp, Rattus norvegicus
gatcactctcaggaaagccaggaac

SEQ ID NO: 361086 - DNA, 25 bp, Rattus norvegicus
gatcactctggaagtttgtgttgta

SEQ ID NO: 361087 - DNA, 25 bp, Rattus norvegicus
gatcactctggatgtttgtgttgta

SEQ ID NO: 361088 - DNA, 25 bp, Rattus norvegicus
gatcactctggtatattgcttctta

SEQ ID NO: 361089 - DNA, 25 bp, Rattus norvegicus
gatcactctggtttattgcttctta

SEQ ID NO: 361090 - DNA, 25 bp, Rattus norvegicus
gatcactgaagacagattccgtgca

SEQ ID NO: 361091 - DNA, 25 bp, Rattus norvegicus
gatcactgaagagagattccgtgca

SEQ ID NO: 361092 - DNA, 25 bp, Rattus norvegicus
gatcactgacaacatggtctgtgtt

SEQ ID NO: 361093 - DNA, 25 bp, Rattus norvegicus
gatcactgacaagatggtctgtgtt

SEQ ID NO: 361094 - DNA, 25 bp, Rattus norvegicus
gatcactgaggactccaaggctctc

SEQ ID NO: 361095 - DNA, 25 bp, Rattus norvegicus
gatcactgaggagtccaaggctctc

SEQ ID NO: 361096 - DNA, 25 bp, Rattus norvegicus
gatcactgatgcatggtagacccac

SEQ ID NO: 361097 - DNA, 25 bp, Rattus norvegicus
gatcactgatgcttggtagacccac

SEQ ID NO: 361098 - DNA, 25 bp, Rattus norvegicus
gatcactgatgtatattggctggca

SEQ ID NO: 361099 - DNA, 25 bp, Rattus norvegicus
gatcactgatgtttattggctggca

SEQ ID NO: 361100 - DNA, 25 bp, Rattus norvegicus
gatcactgcaaaacccaacatgtcg

SEQ ID NO: 361101 - DNA, 25 bp, Rattus norvegicus
gatcactgcaaatcccaacatgtcg

SEQ ID NO: 361102 - DNA, 25 bp, Rattus norvegicus
gatcactgcggtcttggttatttat

SEQ ID NO: 361103 - DNA, 25 bp, Rattus norvegicus
gatcactgcggtgttggttatttat

SEQ ID NO: 361104 - DNA, 25 bp, Rattus norvegicus
gatcactgtatccagatgacgtctt

SEQ ID NO: 361105 - DNA, 25 bp, Rattus norvegicus
gatcactgtatcgagatgacgtctt

SEQ ID NO: 361106 - DNA, 25 bp, Rattus norvegicus
gatcactgtatgaagaacctatgtt

SEQ ID NO: 361107 - DNA, 25 bp, Rattus norvegicus
gatcactgtatgtagaacctatgtt

SEQ ID NO: 361108 - DNA, 25 bp, Rattus norvegicus
gatcactgtcccatcaagtctagaa

SEQ ID NO: 361109 - DNA, 25 bp, Rattus norvegicus
gatcactgtcccttcaagtctagaa

SEQ ID NO: 361110 - DNA, 25 bp, Rattus norvegicus
gatcactgtctaagctcaggtccag

SEQ ID NO: 361111 - DNA, 25 bp, Rattus norvegicus
gatcactgtctatgctcaggtccag

SEQ ID NO: 361112 - DNA, 25 bp, Rattus norvegicus
gatcactgtgagaacttgtctacat

SEQ ID NO: 361113 - DNA, 25 bp, Rattus norvegicus
gatcactgtgagtacttgtctacat

SEQ ID NO: 361114 - DNA, 25 bp, Rattus norvegicus
gatcactgtgtaattgtcactgcag

SEQ ID NO: 361115 - DNA, 25 bp, Rattus norvegicus
gatcactgtgtatttgtcactgcag

SEQ ID NO: 361116 - DNA, 25 bp, Rattus norvegicus
gatcactgtgtgctacagcttccca

SEQ ID NO: 361117 - DNA, 25 bp, Rattus norvegicus
gatcactgtgtgcttgattaccctg

SEQ ID NO: 361118 - DNA, 25 bp, Rattus norvegicus
gatcactgtgtggtacagcttccca

SEQ ID NO: 361119 - DNA, 25 bp, Rattus norvegicus
gatcactgtgtggttgattaccctg

SEQ ID NO: 361120 - DNA, 25 bp, Rattus norvegicus
gatcactgttccctgaagctgtcag

SEQ ID NO: 361121 - DNA, 25 bp, Rattus norvegicus
gatcactgttccgtgaagctgtcag

SEQ ID NO: 361122 - DNA, 25 bp, Rattus norvegicus
gatcacttactcaagtcacataaca

SEQ ID NO: 361123 - DNA, 25 bp, Rattus norvegicus
gatcacttactctagtcacataaca

SEQ ID NO: 361124 - DNA, 25 bp, Rattus norvegicus
gatcacttccggaagagtcactatt

SEQ ID NO: 361125 - DNA, 25 bp, Rattus norvegicus
gatcacttccggtagagtcactatt

SEQ ID NO: 361126 - DNA, 25 bp, Rattus norvegicus
gatcacttcctgaacttgaagcctg

SEQ ID NO: 361127 - DNA, 25 bp, Rattus norvegicus
gatcacttcctgtacttgaagcctg

SEQ ID NO: 361128 - DNA, 25 bp, Rattus norvegicus
gatcacttgaggacttcacaccatg

SEQ ID NO: 361129 - DNA, 25 bp, Rattus norvegicus
gatcacttgaggtcttcacaccatg

SEQ ID NO: 361130 - DNA, 25 bp, Rattus norvegicus
gatcacttgattacttgtgcacctg

SEQ ID NO: 361131 - DNA, 25 bp, Rattus norvegicus
gatcacttgatttcttgtgcacctg

SEQ ID NO: 361132 - DNA, 25 bp, Rattus norvegicus
gatcacttgctcactcatttcaggc

SEQ ID NO: 361133 - DNA, 25 bp, Rattus norvegicus
gatcacttgctctctcatttcaggc

SEQ ID NO: 361134 - DNA, 25 bp, Rattus norvegicus
gatcacttgtgccatggccatgtag

SEQ ID NO: 361135 - DNA, 25 bp, Rattus norvegicus
gatcacttgtgcgatggccatgtag

SEQ ID NO: 361136 - DNA, 25 bp, Rattus norvegicus
gatcactttgagctacatctggatg

SEQ ID NO: 361137 - DNA, 25 bp, Rattus norvegicus
gatcactttgaggtacatctggatg

SEQ ID NO: 361138 - DNA, 25 bp, Rattus norvegicus
gatcactttgatcccattgaacatg

SEQ ID NO: 361139 - DNA, 25 bp, Rattus norvegicus
gatcactttgatgccattgaacatg

SEQ ID NO: 361140 - DNA, 25 bp, Rattus norvegicus
gatcactttgggaaggaagccacat

SEQ ID NO: 361141 - DNA, 25 bp, Rattus norvegicus
gatcactttgggatcctgcaagtct

SEQ ID NO: 361142 - DNA, 25 bp, Rattus norvegicus
gatcactttgggtaggaagccacat

SEQ ID NO: 361143 - DNA, 25 bp, Rattus norvegicus
gatcactttgggttcctgcaagtct

SEQ ID NO: 361144 - DNA, 25 bp, Rattus norvegicus
gatcactttgtgactgtactttact

SEQ ID NO: 361145 - DNA, 25 bp, Rattus norvegicus
gatcactttgtgtctgtactttact

SEQ ID NO: 361146 - DNA, 25 bp, Rattus norvegicus
gatcacttttaacgcttgcttttaa

SEQ ID NO: 361147 - DNA, 25 bp, Rattus norvegicus
gatcacttttaaggcttgcttttaa

SEQ ID NO: 361148 - DNA, 25 bp, Rattus norvegicus
gatcagaaaacccaaggattacttt

SEQ ID NO: 361149 - DNA, 25 bp, Rattus norvegicus
gatcagaaaaccgaaggattacttt

SEQ ID NO: 361150 - DNA, 25 bp, Rattus norvegicus
gatcagaacagtacgctctgctgcc

SEQ ID NO: 361151 - DNA, 25 bp, Rattus norvegicus
gatcagaacagttcgctctgctgcc

SEQ ID NO: 361152 - DNA, 25 bp, Rattus norvegicus
gatcagaacttcagggtctttctca

SEQ ID NO: 361153 - DNA, 25 bp, Rattus norvegicus
gatcagaacttctgggtctttctca

SEQ ID NO: 361154 - DNA, 25 bp, Rattus norvegicus
gatcagaacttgagttaagcagcct

SEQ ID NO: 361155 - DNA, 25 bp, Rattus norvegicus
gatcagaacttgtgttaagcagcct

SEQ ID NO: 361156 - DNA, 25 bp, Rattus norvegicus
gatcagaagctcaggtgcgcagtga

SEQ ID NO: 361157 - DNA, 25 bp, Rattus norvegicus
gatcagaagctctggtgcgcagtga

SEQ ID NO: 361158 - DNA, 25 bp, Rattus norvegicus
gatcagaagtctctcatccttggtc

SEQ ID NO: 361159 - DNA, 25 bp, Rattus norvegicus
gatcagaagtctgtcatccttggtc

SEQ ID NO: 361160 - DNA, 25 bp, Rattus norvegicus
gatcagaattttcctgagcctgtac

SEQ ID NO: 361161 - DNA, 25 bp, Rattus norvegicus
gatcagaattttgctgagcctgtac

SEQ ID NO: 361162 - DNA, 25 bp, Rattus norvegicus
gatcagacagatcacggccactgtg

SEQ ID NO: 361163 - DNA, 25 bp, Rattus norvegicus
gatcagacagatgacggccactgtg

SEQ ID NO: 361164 - DNA, 25 bp, Rattus norvegicus
gatcagacatgccatcgggagcaac

SEQ ID NO: 361165 - DNA, 25 bp, Rattus norvegicus
gatcagacatgcgatcgggagcaac

SEQ ID NO: 361166 - DNA, 25 bp, Rattus norvegicus
gatcagacctggagaaacacctgtc

SEQ ID NO: 361167 - DNA, 25 bp, Rattus norvegicus
gatcagacctggtgaaacacctgtc

SEQ ID NO: 361168 - DNA, 25 bp, Rattus norvegicus
gatcagacgttcatatctgttccac

SEQ ID NO: 361169 - DNA, 25 bp, Rattus norvegicus
gatcagacgttcttatctgttccac

SEQ ID NO: 361170 - DNA, 25 bp, Rattus norvegicus
gatcagactgatcgaccagaacctg

SEQ ID NO: 361171 - DNA, 25 bp, Rattus norvegicus
gatcagactgatggaccagaacctg

SEQ ID NO: 361172 - DNA, 25 bp, Rattus norvegicus
gatcagacttggaaccgtctttgcc

SEQ ID NO: 361173 - DNA, 25 bp, Rattus norvegicus
gatcagacttggtaccgtctttgcc

SEQ ID NO: 361174 - DNA, 25 bp, Rattus norvegicus
gatcagagcatcacagagcagtgcc

SEQ ID NO: 361175 - DNA, 25 bp, Rattus norvegicus
gatcagagcatctcagagcagtgcc

SEQ ID NO: 361176 - DNA, 25 bp, Rattus norvegicus
gatcagagctggaggctgtttcact

SEQ ID NO: 361177 - DNA, 25 bp, Rattus norvegicus
gatcagagctggtggctgtttcact

SEQ ID NO: 361178 - DNA, 25 bp, Rattus norvegicus
gatcagagctttcggatatctacaa

SEQ ID NO: 361179 - DNA, 25 bp, Rattus norvegicus
gatcagagctttgggatatctacaa

SEQ ID NO: 361180 - DNA, 25 bp, Rattus norvegicus
gatcagagtcacatcagacccaaga

SEQ ID NO: 361181 - DNA, 25 bp, Rattus norvegicus
gatcagagtcacttcagacccaaga

SEQ ID NO: 361182 - DNA, 25 bp, Rattus norvegicus
gatcagagttatcgctcatgacata

SEQ ID NO: 361183 - DNA, 25 bp, Rattus norvegicus
gatcagagttatggctcatgacata

SEQ ID NO: 361184 - DNA, 25 bp, Rattus norvegicus
gatcagagttctattgtacctatgt

SEQ ID NO: 361185 - DNA, 25 bp, Rattus norvegicus
gatcagagttcttttgtacctatgt

SEQ ID NO: 361186 - DNA, 25 bp, Rattus norvegicus
gatcagatactgagcggccccgagc

SEQ ID NO: 361187 - DNA, 25 bp, Rattus norvegicus
gatcagatactgataccgtcacttt

SEQ ID NO: 361188 - DNA, 25 bp, Rattus norvegicus
gatcagatactgtgcggccccgagc

SEQ ID NO: 361189 - DNA, 25 bp, Rattus norvegicus
gatcagatactgttaccgtcacttt

SEQ ID NO: 361190 - DNA, 25 bp, Rattus norvegicus
gatcagatatggatgcgcttacaca

SEQ ID NO: 361191 - DNA, 25 bp, Rattus norvegicus
gatcagatatggttgcgcttacaca

SEQ ID NO: 361192 - DNA, 25 bp, Rattus norvegicus
gatcagatcactcctacagacagag

SEQ ID NO: 361193 - DNA, 25 bp, Rattus norvegicus
gatcagatcactgctacagacagag

SEQ ID NO: 361194 - DNA, 25 bp, Rattus norvegicus
gatcagatcagcatgacttgtgttt

SEQ ID NO: 361195 - DNA, 25 bp, Rattus norvegicus
gatcagatcagcttgacttgtgttt

SEQ ID NO: 361196 - DNA, 25 bp, Rattus norvegicus
gatcagatcagtacctagtttggca

SEQ ID NO: 361197 - DNA, 25 bp, Rattus norvegicus
gatcagatcagttcctagtttggca

SEQ ID NO: 361198 - DNA, 25 bp, Rattus norvegicus
gatcagatcccaaggccatgacata

SEQ ID NO: 361199 - DNA, 25 bp, Rattus norvegicus
gatcagatcccatggccatgacata

SEQ ID NO: 361200 - DNA, 25 bp, Rattus norvegicus
gatcagatgcacacactgtagccaa

SEQ ID NO: 361201 - DNA, 25 bp, Rattus norvegicus
gatcagatgcactcactgtagccaa

SEQ ID NO: 361202 - DNA, 25 bp, Rattus norvegicus
gatcagatgcgtcctgcgtaggtaa

SEQ ID NO: 361203 - DNA, 25 bp, Rattus norvegicus
gatcagatgcgtgctgcgtaggtaa

SEQ ID NO: 361204 - DNA, 25 bp, Rattus norvegicus
gatcagatgctgcatgtgctattac

SEQ ID NO: 361205 - DNA, 25 bp, Rattus norvegicus
gatcagatgctggatgtgctattac

SEQ ID NO: 361206 - DNA, 25 bp, Rattus norvegicus
gatcagatgtctacttgtgcttcca

SEQ ID NO: 361207 - DNA, 25 bp, Rattus norvegicus
gatcagatgtcttcttgtgcttcca

SEQ ID NO: 361208 - DNA, 25 bp, Rattus norvegicus
gatcagatttgcaatgtccatgcta

SEQ ID NO: 361209 - DNA, 25 bp, Rattus norvegicus
gatcagatttgctatgtccatgcta

SEQ ID NO: 361210 - DNA, 25 bp, Rattus norvegicus
gatcagcaacctccctttttcaagt

SEQ ID NO: 361211 - DNA, 25 bp, Rattus norvegicus
gatcagcaacctgcctttttcaagt

SEQ ID NO: 361212 - DNA, 25 bp, Rattus norvegicus
gatcagcaagcacgagtacgatgag

SEQ ID NO: 361213 - DNA, 25 bp, Rattus norvegicus
gatcagcaagcaggagtacgatgag

SEQ ID NO: 361214 - DNA, 25 bp, Rattus norvegicus
gatcagcaagtgaattctccttata

SEQ ID NO: 361215 - DNA, 25 bp, Rattus norvegicus
gatcagcaagtgtattctccttata

SEQ ID NO: 361216 - DNA, 25 bp, Rattus norvegicus
gatcagcaccaaaatgtagcattat

SEQ ID NO: 361217 - DNA, 25 bp, Rattus norvegicus
gatcagcaccaatatgtagcattat

SEQ ID NO: 361218 - DNA, 25 bp, Rattus norvegicus
gatcagcacggcataggcccggtcg

SEQ ID NO: 361219 - DNA, 25 bp, Rattus norvegicus
gatcagcacggcttaggcccggtcg

SEQ ID NO: 361220 - DNA, 25 bp, Rattus norvegicus
gatcagcagatgcttctcatcactt

SEQ ID NO: 361221 - DNA, 25 bp, Rattus norvegicus
gatcagcagatggttctcatcactt

SEQ ID NO: 361222 - DNA, 25 bp, Rattus norvegicus
gatcagcagcacctctgtccaaaaa

SEQ ID NO: 361223 - DNA, 25 bp, Rattus norvegicus
gatcagcagcacgtctgtccaaaaa

SEQ ID NO: 361224 - DNA, 25 bp, Rattus norvegicus
gatcagcagctacggacctggcgcc

SEQ ID NO: 361225 - DNA, 25 bp, Rattus norvegicus
gatcagcagctagggacctggcgcc

SEQ ID NO: 361226 - DNA, 25 bp, Rattus norvegicus
gatcagcagtgcctagtgttccgag

SEQ ID NO: 361227 - DNA, 25 bp, Rattus norvegicus
gatcagcagtgcgtagtgttccgag

SEQ ID NO: 361228 - DNA, 25 bp, Rattus norvegicus
gatcagcagttcaactacaggtcct

SEQ ID NO: 361229 - DNA, 25 bp, Rattus norvegicus
gatcagcagttctactacaggtcct

SEQ ID NO: 361230 - DNA, 25 bp, Rattus norvegicus
gatcagcatcgtcatggtgtacttc

SEQ ID NO: 361231 - DNA, 25 bp, Rattus norvegicus
gatcagcatcgtgatggtgtacttc

SEQ ID NO: 361232 - DNA, 25 bp, Rattus norvegicus
gatcagcattttacactctctgaag

SEQ ID NO: 361233 - DNA, 25 bp, Rattus norvegicus
gatcagcatttttcactctctgaag

SEQ ID NO: 361234 - DNA, 25 bp, Rattus norvegicus
gatcagccagtcagtgatagcctgt

SEQ ID NO: 361235 - DNA, 25 bp, Rattus norvegicus
gatcagccagtctgtgatagcctgt

SEQ ID NO: 361236 - DNA, 25 bp, Rattus norvegicus
gatcagccagtgcattacaacacag

SEQ ID NO: 361237 - DNA, 25 bp, Rattus norvegicus
gatcagccagtggattacaacacag

SEQ ID NO: 361238 - DNA, 25 bp, Rattus norvegicus
gatcagccagttacatggtccagct

SEQ ID NO: 361239 - DNA, 25 bp, Rattus norvegicus
gatcagccagttcaattggaaacaa

SEQ ID NO: 361240 - DNA, 25 bp, Rattus norvegicus
gatcagccagttgaattggaaacaa

SEQ ID NO: 361241 - DNA, 25 bp, Rattus norvegicus
gatcagccagtttcatggtccagct

SEQ ID NO: 361242 - DNA, 25 bp, Rattus norvegicus
gatcagccatttataccacagtgcg

SEQ ID NO: 361243 - DNA, 25 bp, Rattus norvegicus
gatcagccatttttaccacagtgcg

SEQ ID NO: 361244 - DNA, 25 bp, Rattus norvegicus
gatcagcccaaaccgttacagctta

SEQ ID NO: 361245 - DNA, 25 bp, Rattus norvegicus
gatcagcccaaagcgttacagctta

SEQ ID NO: 361246 - DNA, 25 bp, Rattus norvegicus
gatcagccccatccttgctttgctt

SEQ ID NO: 361247 - DNA, 25 bp, Rattus norvegicus
gatcagccccatgcttgctttgctt

SEQ ID NO: 361248 - DNA, 25 bp, Rattus norvegicus
gatcagccccttaggtagggactgt

SEQ ID NO: 361249 - DNA, 25 bp, Rattus norvegicus
gatcagcccctttggtagggactgt

SEQ ID NO: 361250 - DNA, 25 bp, Rattus norvegicus
gatcagcccgtgatcaaacgtctaa

SEQ ID NO: 361251 - DNA, 25 bp, Rattus norvegicus
gatcagcccgtgttcaaacgtctaa

SEQ ID NO: 361252 - DNA, 25 bp, Rattus norvegicus
gatcagccctttacaaacttacaag

SEQ ID NO: 361253 - DNA, 25 bp, Rattus norvegicus
gatcagcccttttcaaacttacaag

SEQ ID NO: 361254 - DNA, 25 bp, Rattus norvegicus
gatcagccggatcactgttgtgaat

SEQ ID NO: 361255 - DNA, 25 bp, Rattus norvegicus
gatcagccggatgactgttgtgaat

SEQ ID NO: 361256 - DNA, 25 bp, Rattus norvegicus
gatcagcctaaactactatgtcagt

SEQ ID NO: 361257 - DNA, 25 bp, Rattus norvegicus
gatcagcctaaagtactatgtcagt

SEQ ID NO: 361258 - DNA, 25 bp, Rattus norvegicus
gatcagcctaagacagaatacattt

SEQ ID NO: 361259 - DNA, 25 bp, Rattus norvegicus
gatcagcctaagtcagaatacattt

SEQ ID NO: 361260 - DNA, 25 bp, Rattus norvegicus
gatcagcctcagagatcgcatatta

SEQ ID NO: 361261 - DNA, 25 bp, Rattus norvegicus
gatcagcctcagtgatcgcatatta

SEQ ID NO: 361262 - DNA, 25 bp, Rattus norvegicus
gatcagcctgaacaactacgaccct

SEQ ID NO: 361263 - DNA, 25 bp, Rattus norvegicus
gatcagcctgaagaactacgaccct

SEQ ID NO: 361264 - DNA, 25 bp, Rattus norvegicus
gatcagcctgctattatgccaatac

SEQ ID NO: 361265 - DNA, 25 bp, Rattus norvegicus
gatcagcctgcttttatgccaatac

SEQ ID NO: 361266 - DNA, 25 bp, Rattus norvegicus
gatcagccttagctacatagggaat

SEQ ID NO: 361267 - DNA, 25 bp, Rattus norvegicus
gatcagccttaggtacatagggaat

SEQ ID NO: 361268 - DNA, 25 bp, Rattus norvegicus
gatcagcgaagaccggagacccaca

SEQ ID NO: 361269 - DNA, 25 bp, Rattus norvegicus
gatcagcgaagagcggagacccaca

SEQ ID NO: 361270 - DNA, 25 bp, Rattus norvegicus
gatcagctctgtaccaagcaggaga

SEQ ID NO: 361271 - DNA, 25 bp, Rattus norvegicus
gatcagctctgttccaagcaggaga

SEQ ID NO: 361272 - DNA, 25 bp, Rattus norvegicus
gatcagctgaatctcggcgcaaggc

SEQ ID NO: 361273 - DNA, 25 bp, Rattus norvegicus
gatcagctgaatgtcggcgcaaggc

SEQ ID NO: 361274 - DNA, 25 bp, Rattus norvegicus
gatcagctgtataggtgcttctttg

SEQ ID NO: 361275 - DNA, 25 bp, Rattus norvegicus
gatcagctgtatcaccagaacaaag

SEQ ID NO: 361276 - DNA, 25 bp, Rattus norvegicus
gatcagctgtatgaccagaacaaag

SEQ ID NO: 361277 - DNA, 25 bp, Rattus norvegicus
gatcagctgtattggtgcttctttg

SEQ ID NO: 361278 - DNA, 25 bp, Rattus norvegicus
gatcagctgtgaacatttgcagcac

SEQ ID NO: 361279 - DNA, 25 bp, Rattus norvegicus
gatcagctgtgatcatttgcagcac

SEQ ID NO: 361280 - DNA, 25 bp, Rattus norvegicus
gatcagctgttcactctatatgcca

SEQ ID NO: 361281 - DNA, 25 bp, Rattus norvegicus
gatcagctgttctctctatatgcca

SEQ ID NO: 361282 - DNA, 25 bp, Rattus norvegicus
gatcagcttgcaatggaggtggcca

SEQ ID NO: 361283 - DNA, 25 bp, Rattus norvegicus
gatcagcttgcattggaggtggcca

SEQ ID NO: 361284 - DNA, 25 bp, Rattus norvegicus
gatcagctttacatggttagacgaa

SEQ ID NO: 361285 - DNA, 25 bp, Rattus norvegicus
gatcagctttacttggttagacgaa

SEQ ID NO: 361286 - DNA, 25 bp, Rattus norvegicus
gatcagcttttacgtcagggtctca

SEQ ID NO: 361287 - DNA, 25 bp, Rattus norvegicus
gatcagcttttaggtcagggtctca

SEQ ID NO: 361288 - DNA, 25 bp, Rattus norvegicus
gatcaggaagaaaaacccattcacc

SEQ ID NO: 361289 - DNA, 25 bp, Rattus norvegicus
gatcaggaagaataacccattcacc

SEQ ID NO: 361290 - DNA, 25 bp, Rattus norvegicus
gatcaggacagcaaagacagcacgt

SEQ ID NO: 361291 - DNA, 25 bp, Rattus norvegicus
gatcaggacagctaagacagcacgt

SEQ ID NO: 361292 - DNA, 25 bp, Rattus norvegicus
gatcaggacctcaactgctcatgaa

SEQ ID NO: 361293 - DNA, 25 bp, Rattus norvegicus
gatcaggacctctactgctcatgaa

SEQ ID NO: 361294 - DNA, 25 bp, Rattus norvegicus
gatcaggacttgaggagacctctgc

SEQ ID NO: 361295 - DNA, 25 bp, Rattus norvegicus
gatcaggacttgtggagacctctgc

SEQ ID NO: 361296 - DNA, 25 bp, Rattus norvegicus
gatcaggagacacacatagagcagt

SEQ ID NO: 361297 - DNA, 25 bp, Rattus norvegicus
gatcaggagacagacatagagcagt

SEQ ID NO: 361298 - DNA, 25 bp, Rattus norvegicus
gatcaggcacagctgactagtccaa

SEQ ID NO: 361299 - DNA, 25 bp, Rattus norvegicus
gatcaggcacaggtgactagtccaa

SEQ ID NO: 361300 - DNA, 25 bp, Rattus norvegicus
gatcaggcagcacgttaaggacaat

SEQ ID NO: 361301 - DNA, 25 bp, Rattus norvegicus
gatcaggcagcaggttaaggacaat

SEQ ID NO: 361302 - DNA, 25 bp, Rattus norvegicus
gatcaggcatttaggcttctactgt

SEQ ID NO: 361303 - DNA, 25 bp, Rattus norvegicus
gatcaggcattttggcttctactgt

SEQ ID NO: 361304 - DNA, 25 bp, Rattus norvegicus
gatcaggcccagaactgcatcaaga

SEQ ID NO: 361305 - DNA, 25 bp, Rattus norvegicus
gatcaggcccagtactgcatcaaga

SEQ ID NO: 361306 - DNA, 25 bp, Rattus norvegicus
gatcaggcccggacgagggagaaga

SEQ ID NO: 361307 - DNA, 25 bp, Rattus norvegicus
gatcaggcccggtcgagggagaaga

SEQ ID NO: 361308 - DNA, 25 bp, Rattus norvegicus
gatcaggccctaaagcattgttgtg

SEQ ID NO: 361309 - DNA, 25 bp, Rattus norvegicus
gatcaggccctatagcattgttgtg

SEQ ID NO: 361310 - DNA, 25 bp, Rattus norvegicus
gatcaggccctcaagcccttgggag

SEQ ID NO: 361311 - DNA, 25 bp, Rattus norvegicus
gatcaggccctctagcccttgggag

SEQ ID NO: 361312 - DNA, 25 bp, Rattus norvegicus
gatcaggctaaacttgggctctcag

SEQ ID NO: 361313 - DNA, 25 bp, Rattus norvegicus
gatcaggctaaagttgggctctcag

SEQ ID NO: 361314 - DNA, 25 bp, Rattus norvegicus
gatcagggcaccctctgagaaggaa

SEQ ID NO: 361315 - DNA, 25 bp, Rattus norvegicus
gatcagggcaccgtctgagaaggaa

SEQ ID NO: 361316 - DNA, 25 bp, Rattus norvegicus
gatcagggcagtcactttcacagca

SEQ ID NO: 361317 - DNA, 25 bp, Rattus norvegicus
gatcagggcagtgactttcacagca

SEQ ID NO: 361318 - DNA, 25 bp, Rattus norvegicus
gatcagggccaaaaaatgttgaaat

SEQ ID NO: 361319 - DNA, 25 bp, Rattus norvegicus
gatcagggccaataaatgttgaaat

SEQ ID NO: 361320 - DNA, 25 bp, Rattus norvegicus
gatcagggtcatccagtcctcaggt

SEQ ID NO: 361321 - DNA, 25 bp, Rattus norvegicus
gatcagggtcatgcagtcctcaggt

SEQ ID NO: 361322 - DNA, 25 bp, Rattus norvegicus
gatcagggtctcactttaattcaag

SEQ ID NO: 361323 - DNA, 25 bp, Rattus norvegicus
gatcagggtctctctttaattcaag

SEQ ID NO: 361324 - DNA, 25 bp, Rattus norvegicus
gatcagggttacaggcaacctcagt

SEQ ID NO: 361325 - DNA, 25 bp, Rattus norvegicus
gatcagggttactggcaacctcagt

SEQ ID NO: 361326 - DNA, 25 bp, Rattus norvegicus
gatcaggtacttatgctcccaaatt

SEQ ID NO: 361327 - DNA, 25 bp, Rattus norvegicus
gatcaggtacttttgctcccaaatt

SEQ ID NO: 361328 - DNA, 25 bp, Rattus norvegicus
gatcaggtattgaccgtcagatgca

SEQ ID NO: 361329 - DNA, 25 bp, Rattus norvegicus
gatcaggtattgtccgtcagatgca

SEQ ID NO: 361330 - DNA, 25 bp, Rattus norvegicus
gatcaggtctagagcactcctgcat

SEQ ID NO: 361331 - DNA, 25 bp, Rattus norvegicus
gatcaggtctagtgcactcctgcat

SEQ ID NO: 361332 - DNA, 25 bp, Rattus norvegicus
gatcaggtctgccatcaggaggaaa

SEQ ID NO: 361333 - DNA, 25 bp, Rattus norvegicus
gatcaggtctgcgatcaggaggaaa

SEQ ID NO: 361334 - DNA, 25 bp, Rattus norvegicus
gatcaggtgagcatgtcccacaggc

SEQ ID NO: 361335 - DNA, 25 bp, Rattus norvegicus
gatcaggtgagcttgtcccacaggc

SEQ ID NO: 361336 - DNA, 25 bp, Rattus norvegicus
gatcaggtggccctctgccacttgt

SEQ ID NO: 361337 - DNA, 25 bp, Rattus norvegicus
gatcaggtggccgtctgccacttgt

SEQ ID NO: 361338 - DNA, 25 bp, Rattus norvegicus
gatcaggttaaacacgtccgttgga

SEQ ID NO: 361339 - DNA, 25 bp, Rattus norvegicus
gatcaggttaaagacgtccgttgga

SEQ ID NO: 361340 - DNA, 25 bp, Rattus norvegicus
gatcaggtttgcacactgtcttgag

SEQ ID NO: 361341 - DNA, 25 bp, Rattus norvegicus
gatcaggtttgctcactgtcttgag

SEQ ID NO: 361342 - DNA, 25 bp, Rattus norvegicus
gatcagtaaagcatacatcccctgc

SEQ ID NO: 361343 - DNA, 25 bp, Rattus norvegicus
gatcagtaaagcttacatcccctgc

SEQ ID NO: 361344 - DNA, 25 bp, Rattus norvegicus
gatcagtaaataactcctttcctat

SEQ ID NO: 361345 - DNA, 25 bp, Rattus norvegicus
gatcagtaaatatctcctttcctat

SEQ ID NO: 361346 - DNA, 25 bp, Rattus norvegicus
gatcagtaccatctcatatgccaat

SEQ ID NO: 361347 - DNA, 25 bp, Rattus norvegicus
gatcagtaccatgtcatatgccaat

SEQ ID NO: 361348 - DNA, 25 bp, Rattus norvegicus
gatcagtatagcatcatccacgagg

SEQ ID NO: 361349 - DNA, 25 bp, Rattus norvegicus
gatcagtatagcttcatccacgagg

SEQ ID NO: 361350 - DNA, 25 bp, Rattus norvegicus
gatcagtatctcaattgcagccgga

SEQ ID NO: 361351 - DNA, 25 bp, Rattus norvegicus
gatcagtatctctattgcagccgga

SEQ ID NO: 361352 - DNA, 25 bp, Rattus norvegicus
gatcagtatggaccgcttgcaaccg

SEQ ID NO: 361353 - DNA, 25 bp, Rattus norvegicus
gatcagtatggagcgcttgcaaccg

SEQ ID NO: 361354 - DNA, 25 bp, Rattus norvegicus
gatcagtattttatatgacacccaa

SEQ ID NO: 361355 - DNA, 25 bp, Rattus norvegicus
gatcagtattttttatgacacccaa

SEQ ID NO: 361356 - DNA, 25 bp, Rattus norvegicus
gatcagtcactcatgattttccgag

SEQ ID NO: 361357 - DNA, 25 bp, Rattus norvegicus
gatcagtcactcttgattttccgag

SEQ ID NO: 361358 - DNA, 25 bp, Rattus norvegicus
gatcagtcccagatgattcgagaag

SEQ ID NO: 361359 - DNA, 25 bp, Rattus norvegicus
gatcagtcccagttgattcgagaag

SEQ ID NO: 361360 - DNA, 25 bp, Rattus norvegicus
gatcagtccccgaggtccgaaaagg

SEQ ID NO: 361361 - DNA, 25 bp, Rattus norvegicus
gatcagtccccgtggtccgaaaagg

SEQ ID NO: 361362 - DNA, 25 bp, Rattus norvegicus
gatcagtccttcatagcatgtttcg

SEQ ID NO: 361363 - DNA, 25 bp, Rattus norvegicus
gatcagtccttcttagcatgtttcg

SEQ ID NO: 361364 - DNA, 25 bp, Rattus norvegicus
gatcagtcgcttatctacgtgagat

SEQ ID NO: 361365 - DNA, 25 bp, Rattus norvegicus
gatcagtcgcttttctacgtgagat

SEQ ID NO: 361366 - DNA, 25 bp, Rattus norvegicus
gatcagtctccaaagggcaggttgt

SEQ ID NO: 361367 - DNA, 25 bp, Rattus norvegicus
gatcagtctccatagggcaggttgt

SEQ ID NO: 361368 - DNA, 25 bp, Rattus norvegicus
gatcagtctgaacccacaataacta

SEQ ID NO: 361369 - DNA, 25 bp, Rattus norvegicus
gatcagtctgaagccacaataacta

SEQ ID NO: 361370 - DNA, 25 bp, Rattus norvegicus
gatcagtctgggagccaacttgcct

SEQ ID NO: 361371 - DNA, 25 bp, Rattus norvegicus
gatcagtctgggtgccaacttgcct

SEQ ID NO: 361372 - DNA, 25 bp, Rattus norvegicus
gatcagtcttgcaatctggtcattt

SEQ ID NO: 361373 - DNA, 25 bp, Rattus norvegicus
gatcagtcttgctatctggtcattt

SEQ ID NO: 361374 - DNA, 25 bp, Rattus norvegicus
gatcagtcttggctgcagcctataa

SEQ ID NO: 361375 - DNA, 25 bp, Rattus norvegicus
gatcagtcttgggtgcagcctataa

SEQ ID NO: 361376 - DNA, 25 bp, Rattus norvegicus
gatcagtgcctgacctgtaaatatg

SEQ ID NO: 361377 - DNA, 25 bp, Rattus norvegicus
gatcagtgcctgtcctgtaaatatg

SEQ ID NO: 361378 - DNA, 25 bp, Rattus norvegicus
gatcagtggcatctctactgcttga

SEQ ID NO: 361379 - DNA, 25 bp, Rattus norvegicus
gatcagtggcatgtctactgcttga

SEQ ID NO: 361380 - DNA, 25 bp, Rattus norvegicus
gatcagtgtacaccatcttccacag

SEQ ID NO: 361381 - DNA, 25 bp, Rattus norvegicus
gatcagtgtacagcatcttccacag

SEQ ID NO: 361382 - DNA, 25 bp, Rattus norvegicus
gatcagtgtagacgtttatatggac

SEQ ID NO: 361383 - DNA, 25 bp, Rattus norvegicus
gatcagtgtagaggtttatatggac

SEQ ID NO: 361384 - DNA, 25 bp, Rattus norvegicus
gatcagtgtcatctggatttggtca

SEQ ID NO: 361385 - DNA, 25 bp, Rattus norvegicus
gatcagtgtcatgtggatttggtca

SEQ ID NO: 361386 - DNA, 25 bp, Rattus norvegicus
gatcagttaaatctccctccatatc

SEQ ID NO: 361387 - DNA, 25 bp, Rattus norvegicus
gatcagttaaatgtccctccatatc

SEQ ID NO: 361388 - DNA, 25 bp, Rattus norvegicus
gatcagttagaccactggcactaca

SEQ ID NO: 361389 - DNA, 25 bp, Rattus norvegicus
gatcagttagacgactggcactaca

SEQ ID NO: 361390 - DNA, 25 bp, Rattus norvegicus
gatcagttaggcactgtgcataaaa

SEQ ID NO: 361391 - DNA, 25 bp, Rattus norvegicus
gatcagttaggctctgtgcataaaa

SEQ ID NO: 361392 - DNA, 25 bp, Rattus norvegicus
gatcagttatacatttgttgctaat

SEQ ID NO: 361393 - DNA, 25 bp, Rattus norvegicus
gatcagttatacttttgttgctaat

SEQ ID NO: 361394 - DNA, 25 bp, Rattus norvegicus
gatcagttattccttagctgtgcct

SEQ ID NO: 361395 - DNA, 25 bp, Rattus norvegicus
gatcagttattcgttagctgtgcct

SEQ ID NO: 361396 - DNA, 25 bp, Rattus norvegicus
gatcagttcatcatctaattcgaag

SEQ ID NO: 361397 - DNA, 25 bp, Rattus norvegicus
gatcagttcatcttctaattcgaag

SEQ ID NO: 361398 - DNA, 25 bp, Rattus norvegicus
gatcagttcccaataaattgcaaag

SEQ ID NO: 361399 - DNA, 25 bp, Rattus norvegicus
gatcagttcccattaaattgcaaag

SEQ ID NO: 361400 - DNA, 25 bp, Rattus norvegicus
gatcagttccccatcagaatttttt

SEQ ID NO: 361401 - DNA, 25 bp, Rattus norvegicus
gatcagttccccttcagaatttttt

SEQ ID NO: 361402 - DNA, 25 bp, Rattus norvegicus
gatcagttctgcactttttaatccc

SEQ ID NO: 361403 - DNA, 25 bp, Rattus norvegicus
gatcagttctgctctttttaatccc

SEQ ID NO: 361404 - DNA, 25 bp, Rattus norvegicus
gatcagttctgtatatgtgctggca

SEQ ID NO: 361405 - DNA, 25 bp, Rattus norvegicus
gatcagttctgtttatgtgctggca

SEQ ID NO: 361406 - DNA, 25 bp, Rattus norvegicus
gatcagttctttcttcctgtgaatt

SEQ ID NO: 361407 - DNA, 25 bp, Rattus norvegicus
gatcagttctttgttcctgtgaatt

SEQ ID NO: 361408 - DNA, 25 bp, Rattus norvegicus
gatcagttgaacaccggttggttcg

SEQ ID NO: 361409 - DNA, 25 bp, Rattus norvegicus
gatcagttgaactccggttggttcg

SEQ ID NO: 361410 - DNA, 25 bp, Rattus norvegicus
gatcagttgactcgagctgctctta

SEQ ID NO: 361411 - DNA, 25 bp, Rattus norvegicus
gatcagttgactggagctgctctta

SEQ ID NO: 361412 - DNA, 25 bp, Rattus norvegicus
gatcagttgctgagacaacagttaa

SEQ ID NO: 361413 - DNA, 25 bp, Rattus norvegicus
gatcagttgctgtgacaacagttaa

SEQ ID NO: 361414 - DNA, 25 bp, Rattus norvegicus
gatcagttggccattgttctcattg

SEQ ID NO: 361415 - DNA, 25 bp, Rattus norvegicus
gatcagttggcctttgttctcattg

SEQ ID NO: 361416 - DNA, 25 bp, Rattus norvegicus
gatcagtttcaaagacttcttggct

SEQ ID NO: 361417 - DNA, 25 bp, Rattus norvegicus
gatcagtttcaatgacttcttggct

SEQ ID NO: 361418 - DNA, 25 bp, Rattus norvegicus
gatcagtttcttcaggctgtgacag

SEQ ID NO: 361419 - DNA, 25 bp, Rattus norvegicus
gatcagtttcttgaggctgtgacag

SEQ ID NO: 361420 - DNA, 25 bp, Rattus norvegicus
gatcagtttggacttcacatttttg

SEQ ID NO: 361421 - DNA, 25 bp, Rattus norvegicus
gatcagtttggagttcacatttttg

SEQ ID NO: 361422 - DNA, 25 bp, Rattus norvegicus
gatcagtttgggagtcttgtaccac

SEQ ID NO: 361423 - DNA, 25 bp, Rattus norvegicus
gatcagtttgggtgtcttgtaccac

SEQ ID NO: 361424 - DNA, 25 bp, Rattus norvegicus
gatcagtttggtcttcttgtaccac

SEQ ID NO: 361425 - DNA, 25 bp, Rattus norvegicus
gatcagtttggtgttcttgtaccac

SEQ ID NO: 361426 - DNA, 25 bp, Rattus norvegicus
gatcataaagtgagactcctcccca

SEQ ID NO: 361427 - DNA, 25 bp, Rattus norvegicus
gatcataaagtgtgactcctcccca

SEQ ID NO: 361428 - DNA, 25 bp, Rattus norvegicus
gatcataacaatagcccttggcgtc

SEQ ID NO: 361429 - DNA, 25 bp, Rattus norvegicus
gatcataacaattgcccttggcgtc

SEQ ID NO: 361430 - DNA, 25 bp, Rattus norvegicus
gatcataatcatcccttctttacac

SEQ ID NO: 361431 - DNA, 25 bp, Rattus norvegicus
gatcataatcatgccttctttacac

SEQ ID NO: 361432 - DNA, 25 bp, Rattus norvegicus
gatcatacagatatcagcccagact

SEQ ID NO: 361433 - DNA, 25 bp, Rattus norvegicus
gatcatacagatttcagcccagact

SEQ ID NO: 361434 - DNA, 25 bp, Rattus norvegicus
gatcataccatgatgcagcttcctg

SEQ ID NO: 361435 - DNA, 25 bp, Rattus norvegicus
gatcataccatgttgcagcttcctg

SEQ ID NO: 361436 - DNA, 25 bp, Rattus norvegicus
gatcatacgatgctcccgcagccgg

SEQ ID NO: 361437 - DNA, 25 bp, Rattus norvegicus
gatcatacgatggtcccgcagccgg

SEQ ID NO: 361438 - DNA, 25 bp, Rattus norvegicus
gatcatacgtggacttattaaaact

SEQ ID NO: 361439 - DNA, 25 bp, Rattus norvegicus
gatcatacgtggtcttattaaaact

SEQ ID NO: 361440 - DNA, 25 bp, Rattus norvegicus
gatcatactgatactggttccattg

SEQ ID NO: 361441 - DNA, 25 bp, Rattus norvegicus
gatcatactgattctggttccattg

SEQ ID NO: 361442 - DNA, 25 bp, Rattus norvegicus
gatcatagaatccaaccctctttac

SEQ ID NO: 361443 - DNA, 25 bp, Rattus norvegicus
gatcatagaatcgaaccctctttac

SEQ ID NO: 361444 - DNA, 25 bp, Rattus norvegicus
gatcatagctgcagtgtgcttccaa

SEQ ID NO: 361445 - DNA, 25 bp, Rattus norvegicus
gatcatagctgctgtgtgcttccaa

SEQ ID NO: 361446 - DNA, 25 bp, Rattus norvegicus
gatcatagttgtcacagctgccttt

SEQ ID NO: 361447 - DNA, 25 bp, Rattus norvegicus
gatcatagttgtgacagctgccttt

SEQ ID NO: 361448 - DNA, 25 bp, Rattus norvegicus
gatcatagtttgaacggtcttttta

SEQ ID NO: 361449 - DNA, 25 bp, Rattus norvegicus
gatcatagtttgtacggtcttttta

SEQ ID NO: 361450 - DNA, 25 bp, Rattus norvegicus
gatcatatacccattagaacccctg

SEQ ID NO: 361451 - DNA, 25 bp, Rattus norvegicus
gatcatataccctttagaacccctg

SEQ ID NO: 361452 - DNA, 25 bp, Rattus norvegicus
gatcatatcctaagactgagacctg

SEQ ID NO: 361453 - DNA, 25 bp, Rattus norvegicus
gatcatatcctaatctgtgatgcta

SEQ ID NO: 361454 - DNA, 25 bp, Rattus norvegicus
gatcatatcctatgactgagacctg

SEQ ID NO: 361455 - DNA, 25 bp, Rattus norvegicus
gatcatatcctattctgtgatgcta

SEQ ID NO: 361456 - DNA, 25 bp, Rattus norvegicus
gatcatatcttcctatttgctgcaa

SEQ ID NO: 361457 - DNA, 25 bp, Rattus norvegicus
gatcatatcttcgtatttgctgcaa

SEQ ID NO: 361458 - DNA, 25 bp, Rattus norvegicus
gatcatatggtgaacattttctttg

SEQ ID NO: 361459 - DNA, 25 bp, Rattus norvegicus
gatcatatggtgtacattttctttg

SEQ ID NO: 361460 - DNA, 25 bp, Rattus norvegicus
gatcatattccgagcggtagcggct

SEQ ID NO: 361461 - DNA, 25 bp, Rattus norvegicus
gatcatattccgtgcggtagcggct

SEQ ID NO: 361462 - DNA, 25 bp, Rattus norvegicus
gatcatattgacatcttacttcctt

SEQ ID NO: 361463 - DNA, 25 bp, Rattus norvegicus
gatcatattgacttcttacttcctt

SEQ ID NO: 361464 - DNA, 25 bp, Rattus norvegicus
gatcatattggaaactggcccagag

SEQ ID NO: 361465 - DNA, 25 bp, Rattus norvegicus
gatcatattggatactggcccagag

SEQ ID NO: 361466 - DNA, 25 bp, Rattus norvegicus
gatcatcaaaataaaggctattgcc

SEQ ID NO: 361467 - DNA, 25 bp, Rattus norvegicus
gatcatcaaaattaaggctattgcc

SEQ ID NO: 361468 - DNA, 25 bp, Rattus norvegicus
gatcatcaaagtcactgagcagctg

SEQ ID NO: 361469 - DNA, 25 bp, Rattus norvegicus
gatcatcaaagtgactgagcagctg

SEQ ID NO: 361470 - DNA, 25 bp, Rattus norvegicus
gatcatcagagcagactggagcaga

SEQ ID NO: 361471 - DNA, 25 bp, Rattus norvegicus
gatcatcagagccacagctagcttg

SEQ ID NO: 361472 - DNA, 25 bp, Rattus norvegicus
gatcatcagagcgacagctagcttg

SEQ ID NO: 361473 - DNA, 25 bp, Rattus norvegicus
gatcatcagagctgactggagcaga

SEQ ID NO: 361474 - DNA, 25 bp, Rattus norvegicus
gatcatcagaggcaaccagcttcaa

SEQ ID NO: 361475 - DNA, 25 bp, Rattus norvegicus
gatcatcagagggaaccagcttcaa

SEQ ID NO: 361476 - DNA, 25 bp, Rattus norvegicus
gatcatcagtttactttggaacgga

SEQ ID NO: 361477 - DNA, 25 bp, Rattus norvegicus
gatcatcagttttctttggaacgga

SEQ ID NO: 361478 - DNA, 25 bp, Rattus norvegicus
gatcatcattccattggcaattcca

SEQ ID NO: 361479 - DNA, 25 bp, Rattus norvegicus
gatcatcattcctttggcaattcca

SEQ ID NO: 361480 - DNA, 25 bp, Rattus norvegicus
gatcatcattggctgctttgtggca

SEQ ID NO: 361481 - DNA, 25 bp, Rattus norvegicus
gatcatcattgggtgctttgtggca

SEQ ID NO: 361482 - DNA, 25 bp, Rattus norvegicus
gatcatcatttcattttgatgggca

SEQ ID NO: 361483 - DNA, 25 bp, Rattus norvegicus
gatcatcatttctttttgatgggca

SEQ ID NO: 361484 - DNA, 25 bp, Rattus norvegicus
gatcatccatctatgagtttcaatt

SEQ ID NO: 361485 - DNA, 25 bp, Rattus norvegicus
gatcatccatctttgagtttcaatt

SEQ ID NO: 361486 - DNA, 25 bp, Rattus norvegicus
gatcatccccgcaacatagaaaggt

SEQ ID NO: 361487 - DNA, 25 bp, Rattus norvegicus
gatcatccccgctacatagaaaggt

SEQ ID NO: 361488 - DNA, 25 bp, Rattus norvegicus
gatcatcccctacaacctcaatgaa

SEQ ID NO: 361489 - DNA, 25 bp, Rattus norvegicus
gatcatcccctagaacctcaatgaa

SEQ ID NO: 361490 - DNA, 25 bp, Rattus norvegicus
gatcatccgagtactgcaagaagca

SEQ ID NO: 361491 - DNA, 25 bp, Rattus norvegicus
gatcatccgagttctgcaagaagca

SEQ ID NO: 361492 - DNA, 25 bp, Rattus norvegicus
gatcatccgcgtcaaacggtacgag

SEQ ID NO: 361493 - DNA, 25 bp, Rattus norvegicus
gatcatccgcgtcaagcggtgagca

SEQ ID NO: 361494 - DNA, 25 bp, Rattus norvegicus
gatcatccgcgtgaaacggtacgag

SEQ ID NO: 361495 - DNA, 25 bp, Rattus norvegicus
gatcatccgcgtgaagcggtgagca

SEQ ID NO: 361496 - DNA, 25 bp, Rattus norvegicus
gatcatcctaccaccctttactgga

SEQ ID NO: 361497 - DNA, 25 bp, Rattus norvegicus
gatcatcctacctccctttactgga

SEQ ID NO: 361498 - DNA, 25 bp, Rattus norvegicus
gatcatcctattcttgttcctcatg

SEQ ID NO: 361499 - DNA, 25 bp, Rattus norvegicus
gatcatcctattgttgttcctcatg

SEQ ID NO: 361500 - DNA, 25 bp, Rattus norvegicus
gatcatcctgtcagagtagcagagt

SEQ ID NO: 361501 - DNA, 25 bp, Rattus norvegicus
gatcatcctgtctgagtagcagagt

SEQ ID NO: 361502 - DNA, 25 bp, Rattus norvegicus
gatcatcgttgccaaatgacgttct

SEQ ID NO: 361503 - DNA, 25 bp, Rattus norvegicus
gatcatcgttgcgaaatgacgttct

SEQ ID NO: 361504 - DNA, 25 bp, Rattus norvegicus
gatcatctagttcatcctggattat

SEQ ID NO: 361505 - DNA, 25 bp, Rattus norvegicus
gatcatctagttgatcctggattat

SEQ ID NO: 361506 - DNA, 25 bp, Rattus norvegicus
gatcatctatctctgtagcagcctc

SEQ ID NO: 361507 - DNA, 25 bp, Rattus norvegicus
gatcatctatctgtgtagcagcctc

SEQ ID NO: 361508 - DNA, 25 bp, Rattus norvegicus
gatcatctcagcaggatgctctgaa

SEQ ID NO: 361509 - DNA, 25 bp, Rattus norvegicus
gatcatctcagcagtgtggaccaca

SEQ ID NO: 361510 - DNA, 25 bp, Rattus norvegicus
gatcatctcagctggatgctctgaa

SEQ ID NO: 361511 - DNA, 25 bp, Rattus norvegicus
gatcatctcagctgtgtggaccaca

SEQ ID NO: 361512 - DNA, 25 bp, Rattus norvegicus
gatcatctcatgctaaagcctcaga

SEQ ID NO: 361513 - DNA, 25 bp, Rattus norvegicus
gatcatctcatggtaaagcctcaga

SEQ ID NO: 361514 - DNA, 25 bp, Rattus norvegicus
gatcatctccatctcttaataacct

SEQ ID NO: 361515 - DNA, 25 bp, Rattus norvegicus
gatcatctccatgtcttaataacct

SEQ ID NO: 361516 - DNA, 25 bp, Rattus norvegicus
gatcatctcccaccagtacaattat

SEQ ID NO: 361517 - DNA, 25 bp, Rattus norvegicus
gatcatctcccagcagtacaattat

SEQ ID NO: 361518 - DNA, 25 bp, Rattus norvegicus
gatcatctccggaaggatccatatg

SEQ ID NO: 361519 - DNA, 25 bp, Rattus norvegicus
gatcatctccggtaggatccatatg

SEQ ID NO: 361520 - DNA, 25 bp, Rattus norvegicus
gatcatctcctgaattagtgtgagc

SEQ ID NO: 361521 - DNA, 25 bp, Rattus norvegicus
gatcatctcctgtattagtgtgagc

SEQ ID NO: 361522 - DNA, 25 bp, Rattus norvegicus
gatcatctcgagaaacgttttctga

SEQ ID NO: 361523 - DNA, 25 bp, Rattus norvegicus
gatcatctcgagtaacgttttctga

SEQ ID NO: 361524 - DNA, 25 bp, Rattus norvegicus
gatcatctcggacaatgccgttgac

SEQ ID NO: 361525 - DNA, 25 bp, Rattus norvegicus
gatcatctcggagaatgccgttgac

SEQ ID NO: 361526 - DNA, 25 bp, Rattus norvegicus
gatcatctgattccctgtaatagca

SEQ ID NO: 361527 - DNA, 25 bp, Rattus norvegicus
gatcatctgattgcctgtaatagca

SEQ ID NO: 361528 - DNA, 25 bp, Rattus norvegicus
gatcatctgcccaatgagtgggatt

SEQ ID NO: 361529 - DNA, 25 bp, Rattus norvegicus
gatcatctgccccaagaacggcagc

SEQ ID NO: 361530 - DNA, 25 bp, Rattus norvegicus
gatcatctgcccgaagaacggcagc

SEQ ID NO: 361531 - DNA, 25 bp, Rattus norvegicus
gatcatctgccctatgagtgggatt

SEQ ID NO: 361532 - DNA, 25 bp, Rattus norvegicus
gatcatctgtccatgtattttgtac

SEQ ID NO: 361533 - DNA, 25 bp, Rattus norvegicus
gatcatctgtccttgtattttgtac

SEQ ID NO: 361534 - DNA, 25 bp, Rattus norvegicus
gatcatctgttacccagagacaggc

SEQ ID NO: 361535 - DNA, 25 bp, Rattus norvegicus
gatcatctgttagccagagacaggc

SEQ ID NO: 361536 - DNA, 25 bp, Rattus norvegicus
gatcatcttcaaagtgggccgagtt

SEQ ID NO: 361537 - DNA, 25 bp, Rattus norvegicus
gatcatcttcaatgtgggccgagtt

SEQ ID NO: 361538 - DNA, 25 bp, Rattus norvegicus
gatcatcttctaatattcatcagga

SEQ ID NO: 361539 - DNA, 25 bp, Rattus norvegicus
gatcatcttctattattcatcagga

SEQ ID NO: 361540 - DNA, 25 bp, Rattus norvegicus
gatcatcttgagagttgcccacgat

SEQ ID NO: 361541 - DNA, 25 bp, Rattus norvegicus
gatcatcttgagtgttgcccacgat

SEQ ID NO: 361542 - DNA, 25 bp, Rattus norvegicus
gatcatcttgccaaattgtttgctg

SEQ ID NO: 361543 - DNA, 25 bp, Rattus norvegicus
gatcatcttgcctaattgtttgctg

SEQ ID NO: 361544 - DNA, 25 bp, Rattus norvegicus
gatcatctttagaagtttctgccat

SEQ ID NO: 361545 - DNA, 25 bp, Rattus norvegicus
gatcatctttagtagtttctgccat

SEQ ID NO: 361546 - DNA, 25 bp, Rattus norvegicus
gatcatctttcactcttgcagtgga

SEQ ID NO: 361547 - DNA, 25 bp, Rattus norvegicus
gatcatctttcagtcttgcagtgga

SEQ ID NO: 361548 - DNA, 25 bp, Rattus norvegicus
gatcatcttttcagtgtttcctcaa

SEQ ID NO: 361549 - DNA, 25 bp, Rattus norvegicus
gatcatcttttctgtgtttcctcaa

SEQ ID NO: 361550 - DNA, 25 bp, Rattus norvegicus
gatcatgaagccactgacactgtca

SEQ ID NO: 361551 - DNA, 25 bp, Rattus norvegicus
gatcatgaagcctctgacactgtca

SEQ ID NO: 361552 - DNA, 25 bp, Rattus norvegicus
gatcatgaccatcccaagattctcc

SEQ ID NO: 361553 - DNA, 25 bp, Rattus norvegicus
gatcatgaccatcggctacgagcgg

SEQ ID NO: 361554 - DNA, 25 bp, Rattus norvegicus
gatcatgaccatgccaagattctcc

SEQ ID NO: 361555 - DNA, 25 bp, Rattus norvegicus
gatcatgaccatgggctacgagcgg

SEQ ID NO: 361556 - DNA, 25 bp, Rattus norvegicus
gatcatgacccgagaagtgcagaca

SEQ ID NO: 361557 - DNA, 25 bp, Rattus norvegicus
gatcatgacccgtgaagtgcagaca

SEQ ID NO: 361558 - DNA, 25 bp, Rattus norvegicus
gatcatgagagcagggatgtcctct

SEQ ID NO: 361559 - DNA, 25 bp, Rattus norvegicus
gatcatgagagctgggatgtcctct

SEQ ID NO: 361560 - DNA, 25 bp, Rattus norvegicus
gatcatgagtcacggcaactccccg

SEQ ID NO: 361561 - DNA, 25 bp, Rattus norvegicus
gatcatgagtcagggcaactccccg

SEQ ID NO: 361562 - DNA, 25 bp, Rattus norvegicus
gatcatgatcaaatgaactcacatc

SEQ ID NO: 361563 - DNA, 25 bp, Rattus norvegicus
gatcatgatcaattgaactcacatc

SEQ ID NO: 361564 - DNA, 25 bp, Rattus norvegicus
gatcatgatggcaatggcgcctaca

SEQ ID NO: 361565 - DNA, 25 bp, Rattus norvegicus
gatcatgatggctatggcgcctaca

SEQ ID NO: 361566 - DNA, 25 bp, Rattus norvegicus
gatcatgatttcctgtgttctacat

SEQ ID NO: 361567 - DNA, 25 bp, Rattus norvegicus
gatcatgatttcgtgtgttctacat

SEQ ID NO: 361568 - DNA, 25 bp, Rattus norvegicus
gatcatgcagagcttcggtcgcaaa

SEQ ID NO: 361569 - DNA, 25 bp, Rattus norvegicus
gatcatgcagaggttcggtcgcaaa

SEQ ID NO: 361570 - DNA, 25 bp, Rattus norvegicus
gatcatgcagatcctgaccagggtg

SEQ ID NO: 361571 - DNA, 25 bp, Rattus norvegicus
gatcatgcagatgctgaccagggtg

SEQ ID NO: 361572 - DNA, 25 bp, Rattus norvegicus
gatcatgcagcaaggttctcagctt

SEQ ID NO: 361573 - DNA, 25 bp, Rattus norvegicus
gatcatgcagcatggttctcagctt

SEQ ID NO: 361574 - DNA, 25 bp, Rattus norvegicus
gatcatgcagtacttcacagacaga

SEQ ID NO: 361575 - DNA, 25 bp, Rattus norvegicus
gatcatgcagtagttcacagacaga

SEQ ID NO: 361576 - DNA, 25 bp, Rattus norvegicus
gatcatgcatatctactcacacctt

SEQ ID NO: 361577 - DNA, 25 bp, Rattus norvegicus
gatcatgcatatgtactcacacctt

SEQ ID NO: 361578 - DNA, 25 bp, Rattus norvegicus
gatcatgcatcacgcttgagtttaa

SEQ ID NO: 361579 - DNA, 25 bp, Rattus norvegicus
gatcatgcatcaggcttgagtttaa

SEQ ID NO: 361580 - DNA, 25 bp, Rattus norvegicus
gatcatgccaagcagtgcctgtcaa

SEQ ID NO: 361581 - DNA, 25 bp, Rattus norvegicus
gatcatgccaaggagtgcctgtcaa

SEQ ID NO: 361582 - DNA, 25 bp, Rattus norvegicus
gatcatgccaataccatatcaggtt

SEQ ID NO: 361583 - DNA, 25 bp, Rattus norvegicus
gatcatgccaattccatatcaggtt

SEQ ID NO: 361584 - DNA, 25 bp, Rattus norvegicus
gatcatgccctcatcctttaaatta

SEQ ID NO: 361585 - DNA, 25 bp, Rattus norvegicus
gatcatgccctcttcctttaaatta

SEQ ID NO: 361586 - DNA, 25 bp, Rattus norvegicus
gatcatgcctttatgagcactgtca

SEQ ID NO: 361587 - DNA, 25 bp, Rattus norvegicus
gatcatgcctttttgagcactgtca

SEQ ID NO: 361588 - DNA, 25 bp, Rattus norvegicus
gatcatgcgggaactatttctcaaa

SEQ ID NO: 361589 - DNA, 25 bp, Rattus norvegicus
gatcatgcgggatctatttctcaaa

SEQ ID NO: 361590 - DNA, 25 bp, Rattus norvegicus
gatcatgctcaacttcaagtgggaa

SEQ ID NO: 361591 - DNA, 25 bp, Rattus norvegicus
gatcatgctcaagttcaagtgggaa

SEQ ID NO: 361592 - DNA, 25 bp, Rattus norvegicus
gatcatgctcccaggctaggcgctc

SEQ ID NO: 361593 - DNA, 25 bp, Rattus norvegicus
gatcatgctccctggctaggcgctc

SEQ ID NO: 361594 - DNA, 25 bp, Rattus norvegicus
gatcatgcttgtctcgaggcagctt

SEQ ID NO: 361595 - DNA, 25 bp, Rattus norvegicus
gatcatgcttgtgtcgaggcagctt

SEQ ID NO: 361596 - DNA, 25 bp, Rattus norvegicus
gatcatggacctatttctactcaat

SEQ ID NO: 361597 - DNA, 25 bp, Rattus norvegicus
gatcatggacctttttctactcaat

SEQ ID NO: 361598 - DNA, 25 bp, Rattus norvegicus
gatcatggagcaccagcttttacca

SEQ ID NO: 361599 - DNA, 25 bp, Rattus norvegicus
gatcatggagcagcagcttttacca

SEQ ID NO: 361600 - DNA, 25 bp, Rattus norvegicus
gatcatggcagaatcagaaccacct

SEQ ID NO: 361601 - DNA, 25 bp, Rattus norvegicus
gatcatggcagattcagaaccacct

SEQ ID NO: 361602 - DNA, 25 bp, Rattus norvegicus
gatcatggccaacgtgtagacacta

SEQ ID NO: 361603 - DNA, 25 bp, Rattus norvegicus
gatcatggccaaggtgtagacacta

SEQ ID NO: 361604 - DNA, 25 bp, Rattus norvegicus
gatcatggccgactacaacatcaag

SEQ ID NO: 361605 - DNA, 25 bp, Rattus norvegicus
gatcatggccgagtacaacatcaag

SEQ ID NO: 361606 - DNA, 25 bp, Rattus norvegicus
gatcatggcggcagcttccagggta

SEQ ID NO: 361607 - DNA, 25 bp, Rattus norvegicus
gatcatggcggctgcttccagggta

SEQ ID NO: 361608 - DNA, 25 bp, Rattus norvegicus
gatcatgggaccctctctaatcctt

SEQ ID NO: 361609 - DNA, 25 bp, Rattus norvegicus
gatcatgggaccgtctctaatcctt

SEQ ID NO: 361610 - DNA, 25 bp, Rattus norvegicus
gatcatgggcgaagggctgcacaat

SEQ ID NO: 361611 - DNA, 25 bp, Rattus norvegicus
gatcatgggcgatgggctgcacaat

SEQ ID NO: 361612 - DNA, 25 bp, Rattus norvegicus
gatcatgggcttaccgctatttgga

SEQ ID NO: 361613 - DNA, 25 bp, Rattus norvegicus
gatcatgggctttccgctatttgga

SEQ ID NO: 361614 - DNA, 25 bp, Rattus norvegicus
gatcatggtaggatcaacgtcctct

SEQ ID NO: 361615 - DNA, 25 bp, Rattus norvegicus
gatcatggtaggttcaacgtcctct

SEQ ID NO: 361616 - DNA, 25 bp, Rattus norvegicus
gatcatggtctcataatgttaagtc

SEQ ID NO: 361617 - DNA, 25 bp, Rattus norvegicus
gatcatggtctcatatttggaggtt

SEQ ID NO: 361618 - DNA, 25 bp, Rattus norvegicus
gatcatggtctcttaatgttaagtc

SEQ ID NO: 361619 - DNA, 25 bp, Rattus norvegicus
gatcatggtctcttatttggaggtt

SEQ ID NO: 361620 - DNA, 25 bp, Rattus norvegicus
gatcatggtgttctcatgcctcatc

SEQ ID NO: 361621 - DNA, 25 bp, Rattus norvegicus
gatcatggtgttgtcatgcctcatc

SEQ ID NO: 361622 - DNA, 25 bp, Rattus norvegicus
gatcatggtttgaatcttactgttc

SEQ ID NO: 361623 - DNA, 25 bp, Rattus norvegicus
gatcatggtttgtatcttactgttc

SEQ ID NO: 361624 - DNA, 25 bp, Rattus norvegicus
gatcatgtacaacgccatttggtat

SEQ ID NO: 361625 - DNA, 25 bp, Rattus norvegicus
gatcatgtacaaggccatttggtat

SEQ ID NO: 361626 - DNA, 25 bp, Rattus norvegicus
gatcatgtacgcctactacaaggat

SEQ ID NO: 361627 - DNA, 25 bp, Rattus norvegicus
gatcatgtacgcgtactacaaggat

SEQ ID NO: 361628 - DNA, 25 bp, Rattus norvegicus
gatcatgtatttagtctgtttcaga

SEQ ID NO: 361629 - DNA, 25 bp, Rattus norvegicus
gatcatgtattttgtctgtttcaga

SEQ ID NO: 361630 - DNA, 25 bp, Rattus norvegicus
gatcatgtcagccatgaccaaccag

SEQ ID NO: 361631 - DNA, 25 bp, Rattus norvegicus
gatcatgtcagcgatgaccaaccag

SEQ ID NO: 361632 - DNA, 25 bp, Rattus norvegicus
gatcatgtcagtcgacacgcacttg

SEQ ID NO: 361633 - DNA, 25 bp, Rattus norvegicus
gatcatgtcagtggacacgcacttg

SEQ ID NO: 361634 - DNA, 25 bp, Rattus norvegicus
gatcatgtctacctgcagaaggcct

SEQ ID NO: 361635 - DNA, 25 bp, Rattus norvegicus
gatcatgtctacgtgcagaaggcct

SEQ ID NO: 361636 - DNA, 25 bp, Rattus norvegicus
gatcatgtctctcctactagaattt

SEQ ID NO: 361637 - DNA, 25 bp, Rattus norvegicus
gatcatgtctctgctactagaattt

SEQ ID NO: 361638 - DNA, 25 bp, Rattus norvegicus
gatcatgtctgtacacgattctttt

SEQ ID NO: 361639 - DNA, 25 bp, Rattus norvegicus
gatcatgtctgttcacgattctttt

SEQ ID NO: 361640 - DNA, 25 bp, Rattus norvegicus
gatcatgtgaccctccgggaagagt

SEQ ID NO: 361641 - DNA, 25 bp, Rattus norvegicus
gatcatgtgaccgtccgggaagagt

SEQ ID NO: 361642 - DNA, 25 bp, Rattus norvegicus
gatcatgtgcatatcatcccattgt

SEQ ID NO: 361643 - DNA, 25 bp, Rattus norvegicus
gatcatgtgcatttcatcccattgt

SEQ ID NO: 361644 - DNA, 25 bp, Rattus norvegicus
gatcatgtgctacacaggtgtcctt

SEQ ID NO: 361645 - DNA, 25 bp, Rattus norvegicus
gatcatgtgctagacaggtgtcctt

SEQ ID NO: 361646 - DNA, 25 bp, Rattus norvegicus
gatcatgtggagatgatgctcacag

SEQ ID NO: 361647 - DNA, 25 bp, Rattus norvegicus
gatcatgtggagttgatgctcacag

SEQ ID NO: 361648 - DNA, 25 bp, Rattus norvegicus
gatcatgtgggaccatcctgagcta

SEQ ID NO: 361649 - DNA, 25 bp, Rattus norvegicus
gatcatgtgggagcatcctgagcta

SEQ ID NO: 361650 - DNA, 25 bp, Rattus norvegicus
gatcatgttaatacctacctcacag

SEQ ID NO: 361651 - DNA, 25 bp, Rattus norvegicus
gatcatgttaattcctacctcacag

SEQ ID NO: 361652 - DNA, 25 bp, Rattus norvegicus
gatcatgttattcaattccagtcac

SEQ ID NO: 361653 - DNA, 25 bp, Rattus norvegicus
gatcatgttattgaattccagtcac

SEQ ID NO: 361654 - DNA, 25 bp, Rattus norvegicus
gatcatgttgcaccagcagtcctga

SEQ ID NO: 361655 - DNA, 25 bp, Rattus norvegicus
gatcatgttgcagcagcagtcctga

SEQ ID NO: 361656 - DNA, 25 bp, Rattus norvegicus
gatcatgttgtaaactcccgcataa

SEQ ID NO: 361657 - DNA, 25 bp, Rattus norvegicus
gatcatgttgtatactcccgcataa

SEQ ID NO: 361658 - DNA, 25 bp, Rattus norvegicus
gatcatgttgtcattcaatacaggc

SEQ ID NO: 361659 - DNA, 25 bp, Rattus norvegicus
gatcatgttgtctttcaatacaggc

SEQ ID NO: 361660 - DNA, 25 bp, Rattus norvegicus
gatcatgtttccaccagactcacaa

SEQ ID NO: 361661 - DNA, 25 bp, Rattus norvegicus
gatcatgtttcctccagactcacaa

SEQ ID NO: 361662 - DNA, 25 bp, Rattus norvegicus
gatcatgtttctccgccaagcagaa

SEQ ID NO: 361663 - DNA, 25 bp, Rattus norvegicus
gatcatgtttctcgtagcgcttagc

SEQ ID NO: 361664 - DNA, 25 bp, Rattus norvegicus
gatcatgtttctgcgccaagcagaa

SEQ ID NO: 361665 - DNA, 25 bp, Rattus norvegicus
gatcatgtttctggtagcgcttagc

SEQ ID NO: 361666 - DNA, 25 bp, Rattus norvegicus
gatcatgtttggcaagcggcgcaaa

SEQ ID NO: 361667 - DNA, 25 bp, Rattus norvegicus
gatcatgtttgggaagcggcgcaaa

SEQ ID NO: 361668 - DNA, 25 bp, Rattus norvegicus
gatcatgttttgctacagtttgcag

SEQ ID NO: 361669 - DNA, 25 bp, Rattus norvegicus
gatcatgttttggtacagtttgcag

SEQ ID NO: 361670 - DNA, 25 bp, Rattus norvegicus
gatcatgtttttctacttaagtcaa

SEQ ID NO: 361671 - DNA, 25 bp, Rattus norvegicus
gatcatgtttttgtacttaagtcaa

SEQ ID NO: 361672 - DNA, 25 bp, Rattus norvegicus
gatcattaagaaagtgcccctgaag

SEQ ID NO: 361673 - DNA, 25 bp, Rattus norvegicus
gatcattaagaatgtgcccctgaag

SEQ ID NO: 361674 - DNA, 25 bp, Rattus norvegicus
gatcattaagatccgagcccagacg

SEQ ID NO: 361675 - DNA, 25 bp, Rattus norvegicus
gatcattaagatgcgagcccagacg

SEQ ID NO: 361676 - DNA, 25 bp, Rattus norvegicus
gatcattaatcgactggcgggcatt

SEQ ID NO: 361677 - DNA, 25 bp, Rattus norvegicus
gatcattaatcgtctggcgggcatt

SEQ ID NO: 361678 - DNA, 25 bp, Rattus norvegicus
gatcattagtctacagcaggtttta

SEQ ID NO: 361679 - DNA, 25 bp, Rattus norvegicus
gatcattagtcttcagcaggtttta

SEQ ID NO: 361680 - DNA, 25 bp, Rattus norvegicus
gatcattatcttcctcacaattgcc

SEQ ID NO: 361681 - DNA, 25 bp, Rattus norvegicus
gatcattatcttgctcacaattgcc

SEQ ID NO: 361682 - DNA, 25 bp, Rattus norvegicus
gatcattatgttactctaactctga

SEQ ID NO: 361683 - DNA, 25 bp, Rattus norvegicus
gatcattatgtttctctaactctga

SEQ ID NO: 361684 - DNA, 25 bp, Rattus norvegicus
gatcattcagcccatagtcacggaa

SEQ ID NO: 361685 - DNA, 25 bp, Rattus norvegicus
gatcattcagccgatagtcacggaa

SEQ ID NO: 361686 - DNA, 25 bp, Rattus norvegicus
gatcattcagttactaccgttctta

SEQ ID NO: 361687 - DNA, 25 bp, Rattus norvegicus
gatcattcagtttctaccgttctta

SEQ ID NO: 361688 - DNA, 25 bp, Rattus norvegicus
gatcattcatgtcttcaggtgtctt

SEQ ID NO: 361689 - DNA, 25 bp, Rattus norvegicus
gatcattcatgtgttcaggtgtctt

SEQ ID NO: 361690 - DNA, 25 bp, Rattus norvegicus
gatcattcgcatcctggtcgtcgac

SEQ ID NO: 361691 - DNA, 25 bp, Rattus norvegicus
gatcattcgcatgctggtcgtcgac

SEQ ID NO: 361692 - DNA, 25 bp, Rattus norvegicus
gatcattctacaacagtgggcggct

SEQ ID NO: 361693 - DNA, 25 bp, Rattus norvegicus
gatcattctacatcagtgggcggct

SEQ ID NO: 361694 - DNA, 25 bp, Rattus norvegicus
gatcattctctgcatttcattttct

SEQ ID NO: 361695 - DNA, 25 bp, Rattus norvegicus
gatcattctctggatttcattttct

SEQ ID NO: 361696 - DNA, 25 bp, Rattus norvegicus
gatcattctgaaattttcttgacat

SEQ ID NO: 361697 - DNA, 25 bp, Rattus norvegicus
gatcattctgaatttttcttgacat

SEQ ID NO: 361698 - DNA, 25 bp, Rattus norvegicus
gatcattctggaaactgctgctcta

SEQ ID NO: 361699 - DNA, 25 bp, Rattus norvegicus
gatcattctggatactgctgctcta

SEQ ID NO: 361700 - DNA, 25 bp, Rattus norvegicus
gatcattctggccaagtgagcagca

SEQ ID NO: 361701 - DNA, 25 bp, Rattus norvegicus
gatcattctggcgaagtgagcagca

SEQ ID NO: 361702 - DNA, 25 bp, Rattus norvegicus
gatcattgagctaatccctgtggat

SEQ ID NO: 361703 - DNA, 25 bp, Rattus norvegicus
gatcattgagcttatccctgtggat

SEQ ID NO: 361704 - DNA, 25 bp, Rattus norvegicus
gatcattgatccctctaaacaccta

SEQ ID NO: 361705 - DNA, 25 bp, Rattus norvegicus
gatcattgatccgtctaaacaccta

SEQ ID NO: 361706 - DNA, 25 bp, Rattus norvegicus
gatcattgcctcataatggccatgt

SEQ ID NO: 361707 - DNA, 25 bp, Rattus norvegicus
gatcattgcctcatctgtggaataa

SEQ ID NO: 361708 - DNA, 25 bp, Rattus norvegicus
gatcattgcctcttaatggccatgt

SEQ ID NO: 361709 - DNA, 25 bp, Rattus norvegicus
gatcattgcctcttctgtggaataa

SEQ ID NO: 361710 - DNA, 25 bp, Rattus norvegicus
gatcattgctccacaggaactcatg

SEQ ID NO: 361711 - DNA, 25 bp, Rattus norvegicus
gatcattgctccacctgagcgcaag

SEQ ID NO: 361712 - DNA, 25 bp, Rattus norvegicus
gatcattgctcctcaggaactcatg

SEQ ID NO: 361713 - DNA, 25 bp, Rattus norvegicus
gatcattgctcctcctgagcgcaag

SEQ ID NO: 361714 - DNA, 25 bp, Rattus norvegicus
gatcattgcttcatgtttagtttag

SEQ ID NO: 361715 - DNA, 25 bp, Rattus norvegicus
gatcattgcttcttgtttagtttag

SEQ ID NO: 361716 - DNA, 25 bp, Rattus norvegicus
gatcattggcacaggcaccaatgct

SEQ ID NO: 361717 - DNA, 25 bp, Rattus norvegicus
gatcattggcactggcaccaatgct

SEQ ID NO: 361718 - DNA, 25 bp, Rattus norvegicus
gatcattggccacgaagacctggaa

SEQ ID NO: 361719 - DNA, 25 bp, Rattus norvegicus
gatcattggccaggaagacctggaa

SEQ ID NO: 361720 - DNA, 25 bp, Rattus norvegicus
gatcattgtcatctatctgttttga

SEQ ID NO: 361721 - DNA, 25 bp, Rattus norvegicus
gatcattgtcatgtatctgttttga

SEQ ID NO: 361722 - DNA, 25 bp, Rattus norvegicus
gatcattgtggcatggacttcctga

SEQ ID NO: 361723 - DNA, 25 bp, Rattus norvegicus
gatcattgtggcttggacttcctga

SEQ ID NO: 361724 - DNA, 25 bp, Rattus norvegicus
gatcattgttgaatcttgttcctta

SEQ ID NO: 361725 - DNA, 25 bp, Rattus norvegicus
gatcattgttgattcttgttcctta

SEQ ID NO: 361726 - DNA, 25 bp, Rattus norvegicus
gatcattgtttcatcaatccaagaa

SEQ ID NO: 361727 - DNA, 25 bp, Rattus norvegicus
gatcattgtttcttcaatccaagaa

SEQ ID NO: 361728 - DNA, 25 bp, Rattus norvegicus
gatcattgtttgagtgctaaccact

SEQ ID NO: 361729 - DNA, 25 bp, Rattus norvegicus
gatcattgtttgtgtgctaaccact

SEQ ID NO: 361730 - DNA, 25 bp, Rattus norvegicus
gatcatttagctatccatctgtggt

SEQ ID NO: 361731 - DNA, 25 bp, Rattus norvegicus
gatcatttagctttccatctgtggt

SEQ ID NO: 361732 - DNA, 25 bp, Rattus norvegicus
gatcatttaggtaggcctttctcaa

SEQ ID NO: 361733 - DNA, 25 bp, Rattus norvegicus
gatcatttaggttggcctttctcaa

SEQ ID NO: 361734 - DNA, 25 bp, Rattus norvegicus
gatcatttctcaactgtagtgtgcc

SEQ ID NO: 361735 - DNA, 25 bp, Rattus norvegicus
gatcatttctcatctgtagtgtgcc

SEQ ID NO: 361736 - DNA, 25 bp, Rattus norvegicus
gatcatttgcagagtgggttttcct

SEQ ID NO: 361737 - DNA, 25 bp, Rattus norvegicus
gatcatttgcagtgtgggttttcct

SEQ ID NO: 361738 - DNA, 25 bp, Rattus norvegicus
gatcatttgccacaactctagacat

SEQ ID NO: 361739 - DNA, 25 bp, Rattus norvegicus
gatcatttgccagaactctagacat

SEQ ID NO: 361740 - DNA, 25 bp, Rattus norvegicus
gatcatttgctaaacctgactgtga

SEQ ID NO: 361741 - DNA, 25 bp, Rattus norvegicus
gatcatttgctatacctgactgtga

SEQ ID NO: 361742 - DNA, 25 bp, Rattus norvegicus
gatcatttggatattcagtctggtt

SEQ ID NO: 361743 - DNA, 25 bp, Rattus norvegicus
gatcatttggatcattgtctgccca

SEQ ID NO: 361744 - DNA, 25 bp, Rattus norvegicus
gatcatttggatgattgtctgccca

SEQ ID NO: 361745 - DNA, 25 bp, Rattus norvegicus
gatcatttggattttcagtctggtt

SEQ ID NO: 361746 - DNA, 25 bp, Rattus norvegicus
gatcatttgtaaatcccaaggcctg

SEQ ID NO: 361747 - DNA, 25 bp, Rattus norvegicus
gatcatttgtaattcccaaggcctg

SEQ ID NO: 361748 - DNA, 25 bp, Rattus norvegicus
gatcattttataacttattcgggaa

SEQ ID NO: 361749 - DNA, 25 bp, Rattus norvegicus
gatcattttatatcttattcgggaa

SEQ ID NO: 361750 - DNA, 25 bp, Rattus norvegicus
gatcattttcgacttttttggacaa

SEQ ID NO: 361751 - DNA, 25 bp, Rattus norvegicus
gatcattttcgagttttttggacaa

SEQ ID NO: 361752 - DNA, 25 bp, Rattus norvegicus
gatcattttctcaattccttcttca

SEQ ID NO: 361753 - DNA, 25 bp, Rattus norvegicus
gatcattttctctattccttcttca

SEQ ID NO: 361754 - DNA, 25 bp, Rattus norvegicus
gatcattttgctaagtcaacctaca

SEQ ID NO: 361755 - DNA, 25 bp, Rattus norvegicus
gatcattttgcttagtcaacctaca

SEQ ID NO: 361756 - DNA, 25 bp, Rattus norvegicus
gatcattttggaagcttatgcaaca

SEQ ID NO: 361757 - DNA, 25 bp, Rattus norvegicus
gatcattttggatgcttatgcaaca

SEQ ID NO: 361758 - DNA, 25 bp, Rattus norvegicus
gatcatttttatcctgtcacgttta

SEQ ID NO: 361759 - DNA, 25 bp, Rattus norvegicus
gatcatttttatgctgtcacgttta

SEQ ID NO: 361760 - DNA, 25 bp, Rattus norvegicus
gatcatttttggattatttgggaat

SEQ ID NO: 361761 - DNA, 25 bp, Rattus norvegicus
gatcatttttggtttatttgggaat

SEQ ID NO: 361762 - DNA, 25 bp, Rattus norvegicus
gatccaaaaataaggcctgtcaccc

SEQ ID NO: 361763 - DNA, 25 bp, Rattus norvegicus
gatccaaaaatatggcctgtcaccc

SEQ ID NO: 361764 - DNA, 25 bp, Rattus norvegicus
gatccaaaagatcggcttgcagacc

SEQ ID NO: 361765 - DNA, 25 bp, Rattus norvegicus
gatccaaaagatgggcttgcagacc

SEQ ID NO: 361766 - DNA, 25 bp, Rattus norvegicus
gatccaaacatacgagcaggtgact

SEQ ID NO: 361767 - DNA, 25 bp, Rattus norvegicus
gatccaaacataggagcaggtgact

SEQ ID NO: 361768 - DNA, 25 bp, Rattus norvegicus
gatccaaaccagctgtccaaggagg

SEQ ID NO: 361769 - DNA, 25 bp, Rattus norvegicus
gatccaaaccaggtgtccaaggagg

SEQ ID NO: 361770 - DNA, 25 bp, Rattus norvegicus
gatccaaacttacagagtctccatg

SEQ ID NO: 361771 - DNA, 25 bp, Rattus norvegicus
gatccaaacttagagagtctccatg

SEQ ID NO: 361772 - DNA, 25 bp, Rattus norvegicus
gatccaaaggccagggtgatcccca

SEQ ID NO: 361773 - DNA, 25 bp, Rattus norvegicus
gatccaaaggcctgggtgatcccca

SEQ ID NO: 361774 - DNA, 25 bp, Rattus norvegicus
gatccaaagtaccttgcattgctgt

SEQ ID NO: 361775 - DNA, 25 bp, Rattus norvegicus
gatccaaagtacgttgcattgctgt

SEQ ID NO: 361776 - DNA, 25 bp, Rattus norvegicus
gatccaaagtgcacttgctgacatt

SEQ ID NO: 361777 - DNA, 25 bp, Rattus norvegicus
gatccaaagtgctcttgctgacatt

SEQ ID NO: 361778 - DNA, 25 bp, Rattus norvegicus
gatccaaatcgtctgtgctttcgtt

SEQ ID NO: 361779 - DNA, 25 bp, Rattus norvegicus
gatccaaatcgtgtgtgctttcgtt

SEQ ID NO: 361780 - DNA, 25 bp, Rattus norvegicus
gatccaaatgatagtgctcacgtac

SEQ ID NO: 361781 - DNA, 25 bp, Rattus norvegicus
gatccaaatgattgtgctcacgtac

SEQ ID NO: 361782 - DNA, 25 bp, Rattus norvegicus
gatccaaattaacactgcccactca

SEQ ID NO: 361783 - DNA, 25 bp, Rattus norvegicus
gatccaaattaagactgcccactca

SEQ ID NO: 361784 - DNA, 25 bp, Rattus norvegicus
gatccaacacccattgatgaccagt

SEQ ID NO: 361785 - DNA, 25 bp, Rattus norvegicus
gatccaacaccctttgatgaccagt

SEQ ID NO: 361786 - DNA, 25 bp, Rattus norvegicus
gatccaacagaaatacacaaccggg

SEQ ID NO: 361787 - DNA, 25 bp, Rattus norvegicus
gatccaacagaattacacaaccggg

SEQ ID NO: 361788 - DNA, 25 bp, Rattus norvegicus
gatccaacaggacttctggtcttag

SEQ ID NO: 361789 - DNA, 25 bp, Rattus norvegicus
gatccaacaggagttctggtcttag

SEQ ID NO: 361790 - DNA, 25 bp, Rattus norvegicus
gatccaacatctaactatattcaaa

SEQ ID NO: 361791 - DNA, 25 bp, Rattus norvegicus
gatccaacatcttactatattcaaa

SEQ ID NO: 361792 - DNA, 25 bp, Rattus norvegicus
gatccaaccggaacctgtggtgggt

SEQ ID NO: 361793 - DNA, 25 bp, Rattus norvegicus
gatccaaccggatcctgtggtgggt

SEQ ID NO: 361794 - DNA, 25 bp, Rattus norvegicus
gatccaacctggagagactcagctt

SEQ ID NO: 361795 - DNA, 25 bp, Rattus norvegicus
gatccaacctggtgagactcagctt

SEQ ID NO: 361796 - DNA, 25 bp, Rattus norvegicus
gatccaacgggaagccatctcatta

SEQ ID NO: 361797 - DNA, 25 bp, Rattus norvegicus
gatccaacgggatgccatctcatta

SEQ ID NO: 361798 - DNA, 25 bp, Rattus norvegicus
gatccaacgtctaattctattcaac

SEQ ID NO: 361799 - DNA, 25 bp, Rattus norvegicus
gatccaacgtcttattctattcaac

SEQ ID NO: 361800 - DNA, 25 bp, Rattus norvegicus
gatccaacgtggactttaagcttct

SEQ ID NO: 361801 - DNA, 25 bp, Rattus norvegicus
gatccaacgtggtctttaagcttct

SEQ ID NO: 361802 - DNA, 25 bp, Rattus norvegicus
gatccaactccaaggtgctgtttta

SEQ ID NO: 361803 - DNA, 25 bp, Rattus norvegicus
gatccaactccatggtgctgtttta

SEQ ID NO: 361804 - DNA, 25 bp, Rattus norvegicus
gatccaactgatcgaaggtcttcat

SEQ ID NO: 361805 - DNA, 25 bp, Rattus norvegicus
gatccaactgatggaaggtcttcat

SEQ ID NO: 361806 - DNA, 25 bp, Rattus norvegicus
gatccaactgtgattgtgtgacctt

SEQ ID NO: 361807 - DNA, 25 bp, Rattus norvegicus
gatccaactgtgtttgtgtgacctt

SEQ ID NO: 361808 - DNA, 25 bp, Rattus norvegicus
gatccaacttgtaatccggacacta

SEQ ID NO: 361809 - DNA, 25 bp, Rattus norvegicus
gatccaacttgttatccggacacta

SEQ ID NO: 361810 - DNA, 25 bp, Rattus norvegicus
gatccaagacctcatcaactactgt

SEQ ID NO: 361811 - DNA, 25 bp, Rattus norvegicus
gatccaagacctgatcaactactgt

SEQ ID NO: 361812 - DNA, 25 bp, Rattus norvegicus
gatccaagacgaatgtgtgtcagag

SEQ ID NO: 361813 - DNA, 25 bp, Rattus norvegicus
gatccaagacgattgtgtgtcagag

SEQ ID NO: 361814 - DNA, 25 bp, Rattus norvegicus
gatccaagactgacagcatctctga

SEQ ID NO: 361815 - DNA, 25 bp, Rattus norvegicus
gatccaagactgtcagcatctctga

SEQ ID NO: 361816 - DNA, 25 bp, Rattus norvegicus
gatccaagacttcccaacaaaattc

SEQ ID NO: 361817 - DNA, 25 bp, Rattus norvegicus
gatccaagacttgccaacaaaattc

SEQ ID NO: 361818 - DNA, 25 bp, Rattus norvegicus
gatccaagcgggaatgctcacaagt

SEQ ID NO: 361819 - DNA, 25 bp, Rattus norvegicus
gatccaagcgggtatgctcacaagt

SEQ ID NO: 361820 - DNA, 25 bp, Rattus norvegicus
gatccaagcttgaatccagttgaca

SEQ ID NO: 361821 - DNA, 25 bp, Rattus norvegicus
gatccaagcttgtatccagttgaca

SEQ ID NO: 361822 - DNA, 25 bp, Rattus norvegicus
gatccaaggctcaaatttctgttag

SEQ ID NO: 361823 - DNA, 25 bp, Rattus norvegicus
gatccaaggctctaatttctgttag

SEQ ID NO: 361824 - DNA, 25 bp, Rattus norvegicus
gatccaagtcttagtctcacgaaac

SEQ ID NO: 361825 - DNA, 25 bp, Rattus norvegicus
gatccaagtctttgtctcacgaaac

SEQ ID NO: 361826 - DNA, 25 bp, Rattus norvegicus
gatccaagtgatccgccaggagctg

SEQ ID NO: 361827 - DNA, 25 bp, Rattus norvegicus
gatccaagtgatgcgccaggagctg

SEQ ID NO: 361828 - DNA, 25 bp, Rattus norvegicus
gatccaagtggtcttgaattgccaa

SEQ ID NO: 361829 - DNA, 25 bp, Rattus norvegicus
gatccaagtggtgttgaattgccaa

SEQ ID NO: 361830 - DNA, 25 bp, Rattus norvegicus
gatccaagtgtgctctcactttcct

SEQ ID NO: 361831 - DNA, 25 bp, Rattus norvegicus
gatccaagtgtggtctcactttcct

SEQ ID NO: 361832 - DNA, 25 bp, Rattus norvegicus
gatccaatacagagacctcctgtgg

SEQ ID NO: 361833 - DNA, 25 bp, Rattus norvegicus
gatccaatacagtgacctcctgtgg

SEQ ID NO: 361834 - DNA, 25 bp, Rattus norvegicus
gatccaatactgacttctagcatcc

SEQ ID NO: 361835 - DNA, 25 bp, Rattus norvegicus
gatccaatactgtcttctagcatcc

SEQ ID NO: 361836 - DNA, 25 bp, Rattus norvegicus
gatccaatccaaagctggctacaag

SEQ ID NO: 361837 - DNA, 25 bp, Rattus norvegicus
gatccaatccaatgctggctacaag

SEQ ID NO: 361838 - DNA, 25 bp, Rattus norvegicus
gatccaatcccaagcaaactcaaga

SEQ ID NO: 361839 - DNA, 25 bp, Rattus norvegicus
gatccaatcccatgcaaactcaaga

SEQ ID NO: 361840 - DNA, 25 bp, Rattus norvegicus
gatccaatcgacagggtttctgtcc

SEQ ID NO: 361841 - DNA, 25 bp, Rattus norvegicus
gatccaatcgactgggtttctgtcc

SEQ ID NO: 361842 - DNA, 25 bp, Rattus norvegicus
gatccaatgcatccaagctttttct

SEQ ID NO: 361843 - DNA, 25 bp, Rattus norvegicus
gatccaatgcatgcaagctttttct

SEQ ID NO: 361844 - DNA, 25 bp, Rattus norvegicus
gatccaattaacagccatcagtcca

SEQ ID NO: 361845 - DNA, 25 bp, Rattus norvegicus
gatccaattaactgccatcagtcca

SEQ ID NO: 361846 - DNA, 25 bp, Rattus norvegicus
gatccacaaagtctgcctattcctt

SEQ ID NO: 361847 - DNA, 25 bp, Rattus norvegicus
gatccacaaagtgtgcctattcctt

SEQ ID NO: 361848 - DNA, 25 bp, Rattus norvegicus
gatccacaagttatagctgttgctg

SEQ ID NO: 361849 - DNA, 25 bp, Rattus norvegicus
gatccacaagttttagctgttgctg

SEQ ID NO: 361850 - DNA, 25 bp, Rattus norvegicus
gatccacacttaaccctgggtaaaa

SEQ ID NO: 361851 - DNA, 25 bp, Rattus norvegicus
gatccacacttatccctgggtaaaa

SEQ ID NO: 361852 - DNA, 25 bp, Rattus norvegicus
gatccacagagactcggtttcagtt

SEQ ID NO: 361853 - DNA, 25 bp, Rattus norvegicus
gatccacagagagtcggtttcagtt

SEQ ID NO: 361854 - DNA, 25 bp, Rattus norvegicus
gatccacagcgtctgtacacaggca

SEQ ID NO: 361855 - DNA, 25 bp, Rattus norvegicus
gatccacagcgtgtgtacacaggca

SEQ ID NO: 361856 - DNA, 25 bp, Rattus norvegicus
gatccacagggtagcatgaggtcat

SEQ ID NO: 361857 - DNA, 25 bp, Rattus norvegicus
gatccacagggttgcatgaggtcat

SEQ ID NO: 361858 - DNA, 25 bp, Rattus norvegicus
gatccacagtggaacctgacgagcc

SEQ ID NO: 361859 - DNA, 25 bp, Rattus norvegicus
gatccacagtggtacctgacgagcc

SEQ ID NO: 361860 - DNA, 25 bp, Rattus norvegicus
gatccacagtgtcctcgttgtacag

SEQ ID NO: 361861 - DNA, 25 bp, Rattus norvegicus
gatccacagtgtgctcgttgtacag

SEQ ID NO: 361862 - DNA, 25 bp, Rattus norvegicus
gatccaccaagccagtatttacctc

SEQ ID NO: 361863 - DNA, 25 bp, Rattus norvegicus
gatccaccaagcgagtatttacctc

SEQ ID NO: 361864 - DNA, 25 bp, Rattus norvegicus
gatccaccagctcagaattcgtccg

SEQ ID NO: 361865 - DNA, 25 bp, Rattus norvegicus
gatccaccagctgagaattcgtccg

SEQ ID NO: 361866 - DNA, 25 bp, Rattus norvegicus
gatccaccagttactcagtgcaggg

SEQ ID NO: 361867 - DNA, 25 bp, Rattus norvegicus
gatccaccagtttctcagtgcaggg

SEQ ID NO: 361868 - DNA, 25 bp, Rattus norvegicus
gatccaccattcagaagtgtctaga

SEQ ID NO: 361869 - DNA, 25 bp, Rattus norvegicus
gatccaccattctgaagtgtctaga

SEQ ID NO: 361870 - DNA, 25 bp, Rattus norvegicus
gatccacccaggagggagtgagcca

SEQ ID NO: 361871 - DNA, 25 bp, Rattus norvegicus
gatccacccaggtgggagtgagcca

SEQ ID NO: 361872 - DNA, 25 bp, Rattus norvegicus
gatccacccctgagagagcaagtca

SEQ ID NO: 361873 - DNA, 25 bp, Rattus norvegicus
gatccacccctgtgagagcaagtca

SEQ ID NO: 361874 - DNA, 25 bp, Rattus norvegicus
gatccaccgggtcgagcctgaagat

SEQ ID NO: 361875 - DNA, 25 bp, Rattus norvegicus
gatccaccgggtggagcctgaagat

SEQ ID NO: 361876 - DNA, 25 bp, Rattus norvegicus
gatccacctacaattatcttcagtc

SEQ ID NO: 361877 - DNA, 25 bp, Rattus norvegicus
gatccacctacatttatcttcagtc

SEQ ID NO: 361878 - DNA, 25 bp, Rattus norvegicus
gatccacctgttagtcattatgaca

SEQ ID NO: 361879 - DNA, 25 bp, Rattus norvegicus
gatccacctgtttgtcattatgaca

SEQ ID NO: 361880 - DNA, 25 bp, Rattus norvegicus
gatccacgggctcgaatctgacgag

SEQ ID NO: 361881 - DNA, 25 bp, Rattus norvegicus
gatccacgggctggaatctgacgag

SEQ ID NO: 361882 - DNA, 25 bp, Rattus norvegicus
gatccacggtggcagagctccagtc

SEQ ID NO: 361883 - DNA, 25 bp, Rattus norvegicus
gatccacggtgggagagctccagtc

SEQ ID NO: 361884 - DNA, 25 bp, Rattus norvegicus
gatccacgtgatcaaagagaaccaa

SEQ ID NO: 361885 - DNA, 25 bp, Rattus norvegicus
gatccacgtgatgaaagagaaccaa

SEQ ID NO: 361886 - DNA, 25 bp, Rattus norvegicus
gatccacgtggtaccaaggttactt

SEQ ID NO: 361887 - DNA, 25 bp, Rattus norvegicus
gatccacgtggttccaaggttactt

SEQ ID NO: 361888 - DNA, 25 bp, Rattus norvegicus
gatccacgttttagcatgggactga

SEQ ID NO: 361889 - DNA, 25 bp, Rattus norvegicus
gatccacgttttctatgtagctttt

SEQ ID NO: 361890 - DNA, 25 bp, Rattus norvegicus
gatccacgttttgtatgtagctttt

SEQ ID NO: 361891 - DNA, 25 bp, Rattus norvegicus
gatccacgtttttgcatgggactga

SEQ ID NO: 361892 - DNA, 25 bp, Rattus norvegicus
gatccactagaactgtctgcattat

SEQ ID NO: 361893 - DNA, 25 bp, Rattus norvegicus
gatccactagaagtgtctgcattat

SEQ ID NO: 361894 - DNA, 25 bp, Rattus norvegicus
gatccactgataatgtttgctccca

SEQ ID NO: 361895 - DNA, 25 bp, Rattus norvegicus
gatccactgatattgtttgctccca

SEQ ID NO: 361896 - DNA, 25 bp, Rattus norvegicus
gatccactgggaattgaaccttcaa

SEQ ID NO: 361897 - DNA, 25 bp, Rattus norvegicus
gatccactgggatttgaaccttcaa

SEQ ID NO: 361898 - DNA, 25 bp, Rattus norvegicus
gatccactgggcatttgctggcaca

SEQ ID NO: 361899 - DNA, 25 bp, Rattus norvegicus
gatccactgggcttttgctggcaca

SEQ ID NO: 361900 - DNA, 25 bp, Rattus norvegicus
gatccactgtgtacagagtaccttg

SEQ ID NO: 361901 - DNA, 25 bp, Rattus norvegicus
gatccactgtgttcagagtaccttg

SEQ ID NO: 361902 - DNA, 25 bp, Rattus norvegicus
gatccacttcacaggctttattggg

SEQ ID NO: 361903 - DNA, 25 bp, Rattus norvegicus
gatccacttcactggctttattggg

SEQ ID NO: 361904 - DNA, 25 bp, Rattus norvegicus
gatccacttcgccaaaaggtctatt

SEQ ID NO: 361905 - DNA, 25 bp, Rattus norvegicus
gatccacttcgcgaaaaggtctatt

SEQ ID NO: 361906 - DNA, 25 bp, Rattus norvegicus
gatccacttgaaatccagaggccag

SEQ ID NO: 361907 - DNA, 25 bp, Rattus norvegicus
gatccacttgaattccagaggccag

SEQ ID NO: 361908 - DNA, 25 bp, Rattus norvegicus
gatccacttgatcgccaaagctggc

SEQ ID NO: 361909 - DNA, 25 bp, Rattus norvegicus
gatccacttgatggccaaagctggc

SEQ ID NO: 361910 - DNA, 25 bp, Rattus norvegicus
gatccacttgggacacaaacacagc

SEQ ID NO: 361911 - DNA, 25 bp, Rattus norvegicus
gatccacttgggtcacaaacacagc

SEQ ID NO: 361912 - DNA, 25 bp, Rattus norvegicus
gatccagaaagacctacggctccat

SEQ ID NO: 361913 - DNA, 25 bp, Rattus norvegicus
gatccagaaagagctacggctccat

SEQ ID NO: 361914 - DNA, 25 bp, Rattus norvegicus
gatccagaagcaaccgtgtgtatct

SEQ ID NO: 361915 - DNA, 25 bp, Rattus norvegicus
gatccagaagcatccgtgtgtatct

SEQ ID NO: 361916 - DNA, 25 bp, Rattus norvegicus
gatccagaagctaagggcctgtgtt

SEQ ID NO: 361917 - DNA, 25 bp, Rattus norvegicus
gatccagaagcttagggcctgtgtt

SEQ ID NO: 361918 - DNA, 25 bp, Rattus norvegicus
gatccagaaggcacaagctatccct

SEQ ID NO: 361919 - DNA, 25 bp, Rattus norvegicus
gatccagaaggcatgcgagtgtttt

SEQ ID NO: 361920 - DNA, 25 bp, Rattus norvegicus
gatccagaaggctcaagctatccct

SEQ ID NO: 361921 - DNA, 25 bp, Rattus norvegicus
gatccagaaggcttgcgagtgtttt

SEQ ID NO: 361922 - DNA, 25 bp, Rattus norvegicus
gatccagaagtcatggtggctttcc

SEQ ID NO: 361923 - DNA, 25 bp, Rattus norvegicus
gatccagaagtcttggtggctttcc

SEQ ID NO: 361924 - DNA, 25 bp, Rattus norvegicus
gatccagacacacgtgtgttgggac

SEQ ID NO: 361925 - DNA, 25 bp, Rattus norvegicus
gatccagacacaggtgtgttgggac

SEQ ID NO: 361926 - DNA, 25 bp, Rattus norvegicus
gatccagacatgaactctctgctag

SEQ ID NO: 361927 - DNA, 25 bp, Rattus norvegicus
gatccagacatgtactctctgctag

SEQ ID NO: 361928 - DNA, 25 bp, Rattus norvegicus
gatccagacccaacccgtggtggag

SEQ ID NO: 361929 - DNA, 25 bp, Rattus norvegicus
gatccagacccatcccgtggtggag

SEQ ID NO: 361930 - DNA, 25 bp, Rattus norvegicus
gatccagactaacagctgccattga

SEQ ID NO: 361931 - DNA, 25 bp, Rattus norvegicus
gatccagactaagagctgccattga

SEQ ID NO: 361932 - DNA, 25 bp, Rattus norvegicus
gatccagactccaagctatgctgag

SEQ ID NO: 361933 - DNA, 25 bp, Rattus norvegicus
gatccagactccacaggacaacttg

SEQ ID NO: 361934 - DNA, 25 bp, Rattus norvegicus
gatccagactcctagctatgctgag

SEQ ID NO: 361935 - DNA, 25 bp, Rattus norvegicus
gatccagactcctcaggacaacttg

SEQ ID NO: 361936 - DNA, 25 bp, Rattus norvegicus
gatccagagccaactcattcagagt

SEQ ID NO: 361937 - DNA, 25 bp, Rattus norvegicus
gatccagagccatctcattcagagt

SEQ ID NO: 361938 - DNA, 25 bp, Rattus norvegicus
gatccagagggaagttctccacgga

SEQ ID NO: 361939 - DNA, 25 bp, Rattus norvegicus
gatccagagggatgttctccacgga

SEQ ID NO: 361940 - DNA, 25 bp, Rattus norvegicus
gatccagatcagctggcagttttta

SEQ ID NO: 361941 - DNA, 25 bp, Rattus norvegicus
gatccagatcaggtggcagttttta

SEQ ID NO: 361942 - DNA, 25 bp, Rattus norvegicus
gatccagatccacgaagaatgtctc

SEQ ID NO: 361943 - DNA, 25 bp, Rattus norvegicus
gatccagatccaggaagaatgtctc

SEQ ID NO: 361944 - DNA, 25 bp, Rattus norvegicus
gatccagatgatcgttcttttacag

SEQ ID NO: 361945 - DNA, 25 bp, Rattus norvegicus
gatccagatgatggttcttttacag

SEQ ID NO: 361946 - DNA, 25 bp, Rattus norvegicus
gatccagattgcaggtcccagttca

SEQ ID NO: 361947 - DNA, 25 bp, Rattus norvegicus
gatccagattgctggtcccagttca

SEQ ID NO: 361948 - DNA, 25 bp, Rattus norvegicus
gatccagcaaagaagcagtcaacag

SEQ ID NO: 361949 - DNA, 25 bp, Rattus norvegicus
gatccagcaaagtagcagtcaacag

SEQ ID NO: 361950 - DNA, 25 bp, Rattus norvegicus
gatccagcaagcactagccaggaga

SEQ ID NO: 361951 - DNA, 25 bp, Rattus norvegicus
gatccagcaagctctagccaggaga

SEQ ID NO: 361952 - DNA, 25 bp, Rattus norvegicus
gatccagcagtcatacttctgggta

SEQ ID NO: 361953 - DNA, 25 bp, Rattus norvegicus
gatccagcagtcttacttctgggta

SEQ ID NO: 361954 - DNA, 25 bp, Rattus norvegicus
gatccagcatctacaagggaccaac

SEQ ID NO: 361955 - DNA, 25 bp, Rattus norvegicus
gatccagcatcttcaagggaccaac

SEQ ID NO: 361956 - DNA, 25 bp, Rattus norvegicus
gatccagccaaacatttcttagaca

SEQ ID NO: 361957 - DNA, 25 bp, Rattus norvegicus
gatccagccaaagatttcttagaca

SEQ ID NO: 361958 - DNA, 25 bp, Rattus norvegicus
gatccagccgtaaggcagaaagcaa

SEQ ID NO: 361959 - DNA, 25 bp, Rattus norvegicus
gatccagccgtatggcagaaagcaa

SEQ ID NO: 361960 - DNA, 25 bp, Rattus norvegicus
gatccagcctctcctaagagtggga

SEQ ID NO: 361961 - DNA, 25 bp, Rattus norvegicus
gatccagcctctgctaagagtggga

SEQ ID NO: 361962 - DNA, 25 bp, Rattus norvegicus
gatccagcgactaagctactcaatt

SEQ ID NO: 361963 - DNA, 25 bp, Rattus norvegicus
gatccagcgacttagctactcaatt

SEQ ID NO: 361964 - DNA, 25 bp, Rattus norvegicus
gatccagctccgctggcggcgttaa

SEQ ID NO: 361965 - DNA, 25 bp, Rattus norvegicus
gatccagctccggtggcggcgttaa

SEQ ID NO: 361966 - DNA, 25 bp, Rattus norvegicus
gatccagctggcctctgttactaca

SEQ ID NO: 361967 - DNA, 25 bp, Rattus norvegicus
gatccagctggcgtctgttactaca

SEQ ID NO: 361968 - DNA, 25 bp, Rattus norvegicus
gatccaggacatatgaagttttaac

SEQ ID NO: 361969 - DNA, 25 bp, Rattus norvegicus
gatccaggacatttgaagttttaac

SEQ ID NO: 361970 - DNA, 25 bp, Rattus norvegicus
gatccaggactgaattgacccaccc

SEQ ID NO: 361971 - DNA, 25 bp, Rattus norvegicus
gatccaggactgtattgacccaccc

SEQ ID NO: 361972 - DNA, 25 bp, Rattus norvegicus
gatccaggagttccattatagccaa

SEQ ID NO: 361973 - DNA, 25 bp, Rattus norvegicus
gatccaggagttccgcaaggtttgc

SEQ ID NO: 361974 - DNA, 25 bp, Rattus norvegicus
gatccaggagttgcattatagccaa

SEQ ID NO: 361975 - DNA, 25 bp, Rattus norvegicus
gatccaggagttgcgcaaggtttgc

SEQ ID NO: 361976 - DNA, 25 bp, Rattus norvegicus
gatccaggatttcacttgacctcct

SEQ ID NO: 361977 - DNA, 25 bp, Rattus norvegicus
gatccaggatttgacttgacctcct

SEQ ID NO: 361978 - DNA, 25 bp, Rattus norvegicus
gatccaggcagaccctgtaaccaca

SEQ ID NO: 361979 - DNA, 25 bp, Rattus norvegicus
gatccaggcagagcctgtaaccaca

SEQ ID NO: 361980 - DNA, 25 bp, Rattus norvegicus
gatccaggcaggacgatctctgagt

SEQ ID NO: 361981 - DNA, 25 bp, Rattus norvegicus
gatccaggcaggtcgatctctgagt

SEQ ID NO: 361982 - DNA, 25 bp, Rattus norvegicus
gatccaggccaacctttcactgtga

SEQ ID NO: 361983 - DNA, 25 bp, Rattus norvegicus
gatccaggccaagctttcactgtga

SEQ ID NO: 361984 - DNA, 25 bp, Rattus norvegicus
gatccaggccctaatgtttctaaaa

SEQ ID NO: 361985 - DNA, 25 bp, Rattus norvegicus
gatccaggcccttatgtttctaaaa

SEQ ID NO: 361986 - DNA, 25 bp, Rattus norvegicus
gatccaggctgcctgtctcctgctt

SEQ ID NO: 361987 - DNA, 25 bp, Rattus norvegicus
gatccaggctgcgtgtctcctgctt

SEQ ID NO: 361988 - DNA, 25 bp, Rattus norvegicus
gatccagggatcagttatcgtacac

SEQ ID NO: 361989 - DNA, 25 bp, Rattus norvegicus
gatccagggatctgttatcgtacac

SEQ ID NO: 361990 - DNA, 25 bp, Rattus norvegicus
gatccagggattacaacaccttctt

SEQ ID NO: 361991 - DNA, 25 bp, Rattus norvegicus
gatccagggatttcaacaccttctt

SEQ ID NO: 361992 - DNA, 25 bp, Rattus norvegicus
gatccagggccgctgaaacagttcc

SEQ ID NO: 361993 - DNA, 25 bp, Rattus norvegicus
gatccagggccggtgaaacagttcc

SEQ ID NO: 361994 - DNA, 25 bp, Rattus norvegicus
gatccagggtgaattccagactctt

SEQ ID NO: 361995 - DNA, 25 bp, Rattus norvegicus
gatccagggtgatttccagactctt

SEQ ID NO: 361996 - DNA, 25 bp, Rattus norvegicus
gatccaggtctaagttgattttctt

SEQ ID NO: 361997 - DNA, 25 bp, Rattus norvegicus
gatccaggtctatgttgattttctt

SEQ ID NO: 361998 - DNA, 25 bp, Rattus norvegicus
gatccaggttgacacctttaagcag

SEQ ID NO: 361999 - DNA, 25 bp, Rattus norvegicus
gatccaggttgagacctttaagcag

SEQ ID NO: 362000 - DNA, 25 bp, Rattus norvegicus
gatccagtaatacttctttcccagg

SEQ ID NO: 362001 - DNA, 25 bp, Rattus norvegicus
gatccagtaatagttctttcccagg

SEQ ID NO: 362002 - DNA, 25 bp, Rattus norvegicus
gatccagtacacatttcctgttgat

SEQ ID NO: 362003 - DNA, 25 bp, Rattus norvegicus
gatccagtacacttttcctgttgat

SEQ ID NO: 362004 - DNA, 25 bp, Rattus norvegicus
gatccagtcactcggttagactact

SEQ ID NO: 362005 - DNA, 25 bp, Rattus norvegicus
gatccagtcactgggttagactact

SEQ ID NO: 362006 - DNA, 25 bp, Rattus norvegicus
gatccagtccctagagacctcagag

SEQ ID NO: 362007 - DNA, 25 bp, Rattus norvegicus
gatccagtcccttgagacctcagag

SEQ ID NO: 362008 - DNA, 25 bp, Rattus norvegicus
gatccagtccttccagcaggaacat

SEQ ID NO: 362009 - DNA, 25 bp, Rattus norvegicus
gatccagtccttgcagcaggaacat

SEQ ID NO: 362010 - DNA, 25 bp, Rattus norvegicus
gatccagtgaccaagcagttaagtg

SEQ ID NO: 362011 - DNA, 25 bp, Rattus norvegicus
gatccagtgacctagcagttaagtg

SEQ ID NO: 362012 - DNA, 25 bp, Rattus norvegicus
gatccagtgacgagcaacttcaagc

SEQ ID NO: 362013 - DNA, 25 bp, Rattus norvegicus
gatccagtgacgtgcaacttcaagc

SEQ ID NO: 362014 - DNA, 25 bp, Rattus norvegicus
gatccagtgactctatttgcctcac

SEQ ID NO: 362015 - DNA, 25 bp, Rattus norvegicus
gatccagtgactgtatttgcctcac

SEQ ID NO: 362016 - DNA, 25 bp, Rattus norvegicus
gatccagtgcaaagtggttagcctt

SEQ ID NO: 362017 - DNA, 25 bp, Rattus norvegicus
gatccagtgcaatgtggttagcctt

SEQ ID NO: 362018 - DNA, 25 bp, Rattus norvegicus
gatccagtgcacatagtatgtcaca

SEQ ID NO: 362019 - DNA, 25 bp, Rattus norvegicus
gatccagtgcacttagtatgtcaca

SEQ ID NO: 362020 - DNA, 25 bp, Rattus norvegicus
gatccagtggttaaaacggcacgtt

SEQ ID NO: 362021 - DNA, 25 bp, Rattus norvegicus
gatccagtggtttaaacggcacgtt

SEQ ID NO: 362022 - DNA, 25 bp, Rattus norvegicus
gatccagttcaacatgattcagcga

SEQ ID NO: 362023 - DNA, 25 bp, Rattus norvegicus
gatccagttcaagatgattcagcga

SEQ ID NO: 362024 - DNA, 25 bp, Rattus norvegicus
gatccagttcatcaagctctttggc

SEQ ID NO: 362025 - DNA, 25 bp, Rattus norvegicus
gatccagttcatgaagctctttggc

SEQ ID NO: 362026 - DNA, 25 bp, Rattus norvegicus
gatccagttctgctcaactatgtag

SEQ ID NO: 362027 - DNA, 25 bp, Rattus norvegicus
gatccagttctggtcaactatgtag

SEQ ID NO: 362028 - DNA, 25 bp, Rattus norvegicus
gatccagtttgtagtcataatccca

SEQ ID NO: 362029 - DNA, 25 bp, Rattus norvegicus
gatccagtttgttgtcataatccca

SEQ ID NO: 362030 - DNA, 25 bp, Rattus norvegicus
gatccatacatgctccagaactttt

SEQ ID NO: 362031 - DNA, 25 bp, Rattus norvegicus
gatccatacatggtccagaactttt

SEQ ID NO: 362032 - DNA, 25 bp, Rattus norvegicus
gatccatagctaacacatttccata

SEQ ID NO: 362033 - DNA, 25 bp, Rattus norvegicus
gatccatagctatcacatttccata

SEQ ID NO: 362034 - DNA, 25 bp, Rattus norvegicus
gatccataggcaagaacaccaccat

SEQ ID NO: 362035 - DNA, 25 bp, Rattus norvegicus
gatccataggcatgaacaccaccat

SEQ ID NO: 362036 - DNA, 25 bp, Rattus norvegicus
gatccatagtggagggtttcatgaa

SEQ ID NO: 362037 - DNA, 25 bp, Rattus norvegicus
gatccatagtggtgggtttcatgaa

SEQ ID NO: 362038 - DNA, 25 bp, Rattus norvegicus
gatccatagtgtcttcatctacagg

SEQ ID NO: 362039 - DNA, 25 bp, Rattus norvegicus
gatccatagtgtgttcatctacagg

SEQ ID NO: 362040 - DNA, 25 bp, Rattus norvegicus
gatccatatcataccaagctgcagc

SEQ ID NO: 362041 - DNA, 25 bp, Rattus norvegicus
gatccatatcattccaagctgcagc

SEQ ID NO: 362042 - DNA, 25 bp, Rattus norvegicus
gatccatatgtgacatcctctttga

SEQ ID NO: 362043 - DNA, 25 bp, Rattus norvegicus
gatccatatgtgtcatcctctttga

SEQ ID NO: 362044 - DNA, 25 bp, Rattus norvegicus
gatccatattctacctcggaggcca

SEQ ID NO: 362045 - DNA, 25 bp, Rattus norvegicus
gatccatattcttcctcggaggcca

SEQ ID NO: 362046 - DNA, 25 bp, Rattus norvegicus
gatccatcatatacagtacctcaca

SEQ ID NO: 362047 - DNA, 25 bp, Rattus norvegicus
gatccatcatattcagtacctcaca

SEQ ID NO: 362048 - DNA, 25 bp, Rattus norvegicus
gatccatccaatatcccacggagag

SEQ ID NO: 362049 - DNA, 25 bp, Rattus norvegicus
gatccatccaatttcccacggagag

SEQ ID NO: 362050 - DNA, 25 bp, Rattus norvegicus
gatccatccagtcggaggtccttga

SEQ ID NO: 362051 - DNA, 25 bp, Rattus norvegicus
gatccatccagtgggaggtccttga

SEQ ID NO: 362052 - DNA, 25 bp, Rattus norvegicus
gatccatcccctattgttgacctaa

SEQ ID NO: 362053 - DNA, 25 bp, Rattus norvegicus
gatccatccccttttgttgacctaa

SEQ ID NO: 362054 - DNA, 25 bp, Rattus norvegicus
gatccatcctcaaaaatactgtaga

SEQ ID NO: 362055 - DNA, 25 bp, Rattus norvegicus
gatccatcctcaccagttgtgagca

SEQ ID NO: 362056 - DNA, 25 bp, Rattus norvegicus
gatccatcctcagcagttgtgagca

SEQ ID NO: 362057 - DNA, 25 bp, Rattus norvegicus
gatccatcctcataaatactgtaga

SEQ ID NO: 362058 - DNA, 25 bp, Rattus norvegicus
gatccatcctgtaacacagacctta

SEQ ID NO: 362059 - DNA, 25 bp, Rattus norvegicus
gatccatcctgttacacagacctta

SEQ ID NO: 362060 - DNA, 25 bp, Rattus norvegicus
gatccatctgcgagctgtatgagga

SEQ ID NO: 362061 - DNA, 25 bp, Rattus norvegicus
gatccatctgcgtgctgtatgagga

SEQ ID NO: 362062 - DNA, 25 bp, Rattus norvegicus
gatccatcttgcattttgccttata

SEQ ID NO: 362063 - DNA, 25 bp, Rattus norvegicus
gatccatcttgctttttgccttata

SEQ ID NO: 362064 - DNA, 25 bp, Rattus norvegicus
gatccatcttggagggctggacatg

SEQ ID NO: 362065 - DNA, 25 bp, Rattus norvegicus
gatccatcttggtgggctggacatg

SEQ ID NO: 362066 - DNA, 25 bp, Rattus norvegicus
gatccatcttgtatgtttccttgta

SEQ ID NO: 362067 - DNA, 25 bp, Rattus norvegicus
gatccatcttgtttgtttccttgta

SEQ ID NO: 362068 - DNA, 25 bp, Rattus norvegicus
gatccatgagccaacagaggcccct

SEQ ID NO: 362069 - DNA, 25 bp, Rattus norvegicus
gatccatgagcctacagaggcccct

SEQ ID NO: 362070 - DNA, 25 bp, Rattus norvegicus
gatccatgcaaactgtcgtatccga

SEQ ID NO: 362071 - DNA, 25 bp, Rattus norvegicus
gatccatgcaaagtgtcgtatccga

SEQ ID NO: 362072 - DNA, 25 bp, Rattus norvegicus
gatccatgcagtagtcagtccaaga

SEQ ID NO: 362073 - DNA, 25 bp, Rattus norvegicus
gatccatgcagttgtcagtccaaga

SEQ ID NO: 362074 - DNA, 25 bp, Rattus norvegicus
gatccatgccagcttaaggtccagg

SEQ ID NO: 362075 - DNA, 25 bp, Rattus norvegicus
gatccatgccaggttaaggtccagg

SEQ ID NO: 362076 - DNA, 25 bp, Rattus norvegicus
gatccatgctgactaaacacctgac

SEQ ID NO: 362077 - DNA, 25 bp, Rattus norvegicus
gatccatgctgagtaaacacctgac

SEQ ID NO: 362078 - DNA, 25 bp, Rattus norvegicus
gatccatggcttccaaatcgctaag

SEQ ID NO: 362079 - DNA, 25 bp, Rattus norvegicus
gatccatggcttgcaaatcgctaag

SEQ ID NO: 362080 - DNA, 25 bp, Rattus norvegicus
gatccatgggctcgcaatgaggctt

SEQ ID NO: 362081 - DNA, 25 bp, Rattus norvegicus
gatccatgggctggcaatgaggctt

SEQ ID NO: 362082 - DNA, 25 bp, Rattus norvegicus
gatccatggtgcatgggaatgccct

SEQ ID NO: 362083 - DNA, 25 bp, Rattus norvegicus
gatccatggtgcttgggaatgccct

SEQ ID NO: 362084 - DNA, 25 bp, Rattus norvegicus
gatccatgtcttcatccaactgttg

SEQ ID NO: 362085 - DNA, 25 bp, Rattus norvegicus
gatccatgtcttgatccaactgttg

SEQ ID NO: 362086 - DNA, 25 bp, Rattus norvegicus
gatccatgtgatagccattccagtg

SEQ ID NO: 362087 - DNA, 25 bp, Rattus norvegicus
gatccatgtgattgccattccagtg

SEQ ID NO: 362088 - DNA, 25 bp, Rattus norvegicus
gatccattacaccatcaccatttaa

SEQ ID NO: 362089 - DNA, 25 bp, Rattus norvegicus
gatccattacacgatcaccatttaa

SEQ ID NO: 362090 - DNA, 25 bp, Rattus norvegicus
gatccattaccgcaagaagaagcag

SEQ ID NO: 362091 - DNA, 25 bp, Rattus norvegicus
gatccattaccggaagaagaagcag

SEQ ID NO: 362092 - DNA, 25 bp, Rattus norvegicus
gatccattacttactcctgttgaaa

SEQ ID NO: 362093 - DNA, 25 bp, Rattus norvegicus
gatccattactttctcctgttgaaa

SEQ ID NO: 362094 - DNA, 25 bp, Rattus norvegicus
gatccattcagacatagatactaat

SEQ ID NO: 362095 - DNA, 25 bp, Rattus norvegicus
gatccattcagagatagatactaat

SEQ ID NO: 362096 - DNA, 25 bp, Rattus norvegicus
gatccattcagtcaaggttcctgca

SEQ ID NO: 362097 - DNA, 25 bp, Rattus norvegicus
gatccattcagtgaaggttcctgca

SEQ ID NO: 362098 - DNA, 25 bp, Rattus norvegicus
gatccattccacattctcacttttc

SEQ ID NO: 362099 - DNA, 25 bp, Rattus norvegicus
gatccattccactttctcacttttc

SEQ ID NO: 362100 - DNA, 25 bp, Rattus norvegicus
gatccattctgcctggagctaagga

SEQ ID NO: 362101 - DNA, 25 bp, Rattus norvegicus
gatccattctgcgtggagctaagga

SEQ ID NO: 362102 - DNA, 25 bp, Rattus norvegicus
gatccattgcttctttttgaaattc

SEQ ID NO: 362103 - DNA, 25 bp, Rattus norvegicus
gatccattgcttgtttttgaaattc

SEQ ID NO: 362104 - DNA, 25 bp, Rattus norvegicus
gatccatttataccagtgcttttct

SEQ ID NO: 362105 - DNA, 25 bp, Rattus norvegicus
gatccatttatagcagtgcttttct

SEQ ID NO: 362106 - DNA, 25 bp, Rattus norvegicus
gatccatttcctctttggtcatgta

SEQ ID NO: 362107 - DNA, 25 bp, Rattus norvegicus
gatccatttcctgtttggtcatgta

SEQ ID NO: 362108 - DNA, 25 bp, Rattus norvegicus
gatccatttggcagttccaggcaaa

SEQ ID NO: 362109 - DNA, 25 bp, Rattus norvegicus
gatccatttggctgttccaggcaaa

SEQ ID NO: 362110 - DNA, 25 bp, Rattus norvegicus
gatccattttgcacaattagtgctc

SEQ ID NO: 362111 - DNA, 25 bp, Rattus norvegicus
gatccattttgctcaattagtgctc

SEQ ID NO: 362112 - DNA, 25 bp, Rattus norvegicus
gatcccaaatcacactatagcagcg

SEQ ID NO: 362113 - DNA, 25 bp, Rattus norvegicus
gatcccaaatcagactatagcagcg

SEQ ID NO: 362114 - DNA, 25 bp, Rattus norvegicus
gatcccaaatttcaagtcctcgaca

SEQ ID NO: 362115 - DNA, 25 bp, Rattus norvegicus
gatcccaaatttgaagtcctcgaca

SEQ ID NO: 362116 - DNA, 25 bp, Rattus norvegicus
gatcccaacatcaagctggttttag

SEQ ID NO: 362117 - DNA, 25 bp, Rattus norvegicus
gatcccaacatctagctggttttag

SEQ ID NO: 362118 - DNA, 25 bp, Rattus norvegicus
gatcccaacctcagtcatcaaatga

SEQ ID NO: 362119 - DNA, 25 bp, Rattus norvegicus
gatcccaacctctgtcatcaaatga

SEQ ID NO: 362120 - DNA, 25 bp, Rattus norvegicus
gatcccaactttcaggaggccctga

SEQ ID NO: 362121 - DNA, 25 bp, Rattus norvegicus
gatcccaactttgaggaggccctga

SEQ ID NO: 362122 - DNA, 25 bp, Rattus norvegicus
gatcccaagaggcagaagacagaaa

SEQ ID NO: 362123 - DNA, 25 bp, Rattus norvegicus
gatcccaagagggagaagacagaaa

SEQ ID NO: 362124 - DNA, 25 bp, Rattus norvegicus
gatcccaaggacacgagataccaga

SEQ ID NO: 362125 - DNA, 25 bp, Rattus norvegicus
gatcccaaggactcgagataccaga

SEQ ID NO: 362126 - DNA, 25 bp, Rattus norvegicus
gatcccaaggcaatgcagtgctgat

SEQ ID NO: 362127 - DNA, 25 bp, Rattus norvegicus
gatcccaaggcattgcagtgctgat

SEQ ID NO: 362128 - DNA, 25 bp, Rattus norvegicus
gatcccaagtggctgtgagcttttt

SEQ ID NO: 362129 - DNA, 25 bp, Rattus norvegicus
gatcccaagtgggtgtgagcttttt

SEQ ID NO: 362130 - DNA, 25 bp, Rattus norvegicus
gatcccaagttcaaggtttccattt

SEQ ID NO: 362131 - DNA, 25 bp, Rattus norvegicus
gatcccaagttctaggtttccattt

SEQ ID NO: 362132 - DNA, 25 bp, Rattus norvegicus
gatcccaagttgatatgaatgttta

SEQ ID NO: 362133 - DNA, 25 bp, Rattus norvegicus
gatcccaagttgttatgaatgttta

SEQ ID NO: 362134 - DNA, 25 bp, Rattus norvegicus
gatcccaatggcaccacggtaagag

SEQ ID NO: 362135 - DNA, 25 bp, Rattus norvegicus
gatcccaatggctccacggtaagag

SEQ ID NO: 362136 - DNA, 25 bp, Rattus norvegicus
gatcccacacttcgcttagcttggt

SEQ ID NO: 362137 - DNA, 25 bp, Rattus norvegicus
gatcccacacttggcttagcttggt

SEQ ID NO: 362138 - DNA, 25 bp, Rattus norvegicus
gatcccacagagaaccccaaggata

SEQ ID NO: 362139 - DNA, 25 bp, Rattus norvegicus
gatcccacagagtaccccaaggata

SEQ ID NO: 362140 - DNA, 25 bp, Rattus norvegicus
gatcccacattcattatgctgcagc

SEQ ID NO: 362141 - DNA, 25 bp, Rattus norvegicus
gatcccacattctttatgctgcagc

SEQ ID NO: 362142 - DNA, 25 bp, Rattus norvegicus
gatcccacgaagaacacacacattg

SEQ ID NO: 362143 - DNA, 25 bp, Rattus norvegicus
gatcccacgaagtacacacacattg

SEQ ID NO: 362144 - DNA, 25 bp, Rattus norvegicus
gatcccacgatgatagatatagcca

SEQ ID NO: 362145 - DNA, 25 bp, Rattus norvegicus
gatcccacgatgttagatatagcca

SEQ ID NO: 362146 - DNA, 25 bp, Rattus norvegicus
gatcccacttgtaatgcggcaatga

SEQ ID NO: 362147 - DNA, 25 bp, Rattus norvegicus
gatcccacttgttatgcggcaatga

SEQ ID NO: 362148 - DNA, 25 bp, Rattus norvegicus
gatcccagaactacaattcctcatt

SEQ ID NO: 362149 - DNA, 25 bp, Rattus norvegicus
gatcccagaacttcaattcctcatt

SEQ ID NO: 362150 - DNA, 25 bp, Rattus norvegicus
gatcccagaagacagtaagcctaac

SEQ ID NO: 362151 - DNA, 25 bp, Rattus norvegicus
gatcccagaagagagtaagcctaac

SEQ ID NO: 362152 - DNA, 25 bp, Rattus norvegicus
gatcccagaagtccacaagctccag

SEQ ID NO: 362153 - DNA, 25 bp, Rattus norvegicus
gatcccagaagtgcacaagctccag

SEQ ID NO: 362154 - DNA, 25 bp, Rattus norvegicus
gatcccagagatcctgtcttgattt

SEQ ID NO: 362155 - DNA, 25 bp, Rattus norvegicus
gatcccagagatgctgtcttgattt

SEQ ID NO: 362156 - DNA, 25 bp, Rattus norvegicus
gatcccagatctacgaagactccat

SEQ ID NO: 362157 - DNA, 25 bp, Rattus norvegicus
gatcccagatcttcgaagactccat

SEQ ID NO: 362158 - DNA, 25 bp, Rattus norvegicus
gatcccagatgactaaccgcgtaaa

SEQ ID NO: 362159 - DNA, 25 bp, Rattus norvegicus
gatcccagatgagtaaccgcgtaaa

SEQ ID NO: 362160 - DNA, 25 bp, Rattus norvegicus
gatcccagcagtaccaacagtggat

SEQ ID NO: 362161 - DNA, 25 bp, Rattus norvegicus
gatcccagcagttccaacagtggat

SEQ ID NO: 362162 - DNA, 25 bp, Rattus norvegicus
gatcccagccaccatgtcgtgagga

SEQ ID NO: 362163 - DNA, 25 bp, Rattus norvegicus
gatcccagccacgatgtcgtgagga

SEQ ID NO: 362164 - DNA, 25 bp, Rattus norvegicus
gatcccagctccaacaaggtcaaaa

SEQ ID NO: 362165 - DNA, 25 bp, Rattus norvegicus
gatcccagctcctacaaggtcaaaa

SEQ ID NO: 362166 - DNA, 25 bp, Rattus norvegicus
gatcccagctgaaggtgagacactg

SEQ ID NO: 362167 - DNA, 25 bp, Rattus norvegicus
gatcccagctgatggtgagacactg

SEQ ID NO: 362168 - DNA, 25 bp, Rattus norvegicus
gatcccagggaaagtgccatgccta

SEQ ID NO: 362169 - DNA, 25 bp, Rattus norvegicus
gatcccagggaatgtgccatgccta

SEQ ID NO: 362170 - DNA, 25 bp, Rattus norvegicus
gatcccagggacaactcatgtttgc

SEQ ID NO: 362171 - DNA, 25 bp, Rattus norvegicus
gatcccagggactactcatgtttgc

SEQ ID NO: 362172 - DNA, 25 bp, Rattus norvegicus
gatcccagggctaagtgtgagcctt

SEQ ID NO: 362173 - DNA, 25 bp, Rattus norvegicus
gatcccagggcttagtgtgagcctt

SEQ ID NO: 362174 - DNA, 25 bp, Rattus norvegicus
gatcccaggtcgcacagggctgaat

SEQ ID NO: 362175 - DNA, 25 bp, Rattus norvegicus
gatcccaggtcggacagggctgaat

SEQ ID NO: 362176 - DNA, 25 bp, Rattus norvegicus
gatcccagtcacatgaaggctatcc

SEQ ID NO: 362177 - DNA, 25 bp, Rattus norvegicus
gatcccagtcacttgaaggctatcc

SEQ ID NO: 362178 - DNA, 25 bp, Rattus norvegicus
gatcccagtgaacctgactcagtaa

SEQ ID NO: 362179 - DNA, 25 bp, Rattus norvegicus
gatcccagtgaagctgactcagtaa

SEQ ID NO: 362180 - DNA, 25 bp, Rattus norvegicus
gatcccagtgatcgtatacttggac

SEQ ID NO: 362181 - DNA, 25 bp, Rattus norvegicus
gatcccagtgatggtatacttggac

SEQ ID NO: 362182 - DNA, 25 bp, Rattus norvegicus
gatcccagtggaagagcacgacatg

SEQ ID NO: 362183 - DNA, 25 bp, Rattus norvegicus
gatcccagtggatgagcacgacatg

SEQ ID NO: 362184 - DNA, 25 bp, Rattus norvegicus
gatcccagttctacaagctcaatgt

SEQ ID NO: 362185 - DNA, 25 bp, Rattus norvegicus
gatcccagttcttcaagctcaatgt

SEQ ID NO: 362186 - DNA, 25 bp, Rattus norvegicus
gatcccagttggcatgtcgaacaat

SEQ ID NO: 362187 - DNA, 25 bp, Rattus norvegicus
gatcccagttgggatgtcgaacaat

SEQ ID NO: 362188 - DNA, 25 bp, Rattus norvegicus
gatcccatagatcagagccgaacct

SEQ ID NO: 362189 - DNA, 25 bp, Rattus norvegicus
gatcccatagatgagagccgaacct

SEQ ID NO: 362190 - DNA, 25 bp, Rattus norvegicus
gatcccatagtcagcggaccaatgc

SEQ ID NO: 362191 - DNA, 25 bp, Rattus norvegicus
gatcccatagtctgcggaccaatgc

SEQ ID NO: 362192 - DNA, 25 bp, Rattus norvegicus
gatcccatatatactaacgtttgcc

SEQ ID NO: 362193 - DNA, 25 bp, Rattus norvegicus
gatcccatatattctaacgtttgcc

SEQ ID NO: 362194 - DNA, 25 bp, Rattus norvegicus
gatcccatcttcaaagtgtcaaggt

SEQ ID NO: 362195 - DNA, 25 bp, Rattus norvegicus
gatcccatcttctaagtgtcaaggt

SEQ ID NO: 362196 - DNA, 25 bp, Rattus norvegicus
gatcccatgacactcttcttttgga

SEQ ID NO: 362197 - DNA, 25 bp, Rattus norvegicus
gatcccatgacagtcttcttttgga

SEQ ID NO: 362198 - DNA, 25 bp, Rattus norvegicus
gatcccatgactagggagaccctat

SEQ ID NO: 362199 - DNA, 25 bp, Rattus norvegicus
gatcccatgacttgggagaccctat

SEQ ID NO: 362200 - DNA, 25 bp, Rattus norvegicus
gatcccatgcatcgcagcttaactg

SEQ ID NO: 362201 - DNA, 25 bp, Rattus norvegicus
gatcccatgcatggcagcttaactg

SEQ ID NO: 362202 - DNA, 25 bp, Rattus norvegicus
gatcccatgctaaatttgctggccc

SEQ ID NO: 362203 - DNA, 25 bp, Rattus norvegicus
gatcccatgctatatttgctggccc

SEQ ID NO: 362204 - DNA, 25 bp, Rattus norvegicus
gatcccatggttccctcggtaaata

SEQ ID NO: 362205 - DNA, 25 bp, Rattus norvegicus
gatcccatggttgcctcggtaaata

SEQ ID NO: 362206 - DNA, 25 bp, Rattus norvegicus
gatcccattcttatgtaaatctgaa

SEQ ID NO: 362207 - DNA, 25 bp, Rattus norvegicus
gatcccattcttttgtaaatctgaa

SEQ ID NO: 362208 - DNA, 25 bp, Rattus norvegicus
gatccccaacatagagtgtgcagct

SEQ ID NO: 362209 - DNA, 25 bp, Rattus norvegicus
gatccccaacattgagtgtgcagct

SEQ ID NO: 362210 - DNA, 25 bp, Rattus norvegicus
gatccccaaggacagaaatatgccc

SEQ ID NO: 362211 - DNA, 25 bp, Rattus norvegicus
gatccccaaggagagaaatatgccc

SEQ ID NO: 362212 - DNA, 25 bp, Rattus norvegicus
gatccccaaggtctttgcactggaa

SEQ ID NO: 362213 - DNA, 25 bp, Rattus norvegicus
gatccccaaggtgtttgcactggaa

SEQ ID NO: 362214 - DNA, 25 bp, Rattus norvegicus
gatccccacacaccacaagaggttt

SEQ ID NO: 362215 - DNA, 25 bp, Rattus norvegicus
gatccccacacagcacaagaggttt

SEQ ID NO: 362216 - DNA, 25 bp, Rattus norvegicus
gatccccacttaagtgacttcattg

SEQ ID NO: 362217 - DNA, 25 bp, Rattus norvegicus
gatccccacttatgtgacttcattg

SEQ ID NO: 362218 - DNA, 25 bp, Rattus norvegicus
gatccccagattcaactctgagagg

SEQ ID NO: 362219 - DNA, 25 bp, Rattus norvegicus
gatccccagattgaactctgagagg

SEQ ID NO: 362220 - DNA, 25 bp, Rattus norvegicus
gatccccagctcaagggcatagtga

SEQ ID NO: 362221 - DNA, 25 bp, Rattus norvegicus
gatccccagctctagggcatagtga

SEQ ID NO: 362222 - DNA, 25 bp, Rattus norvegicus
gatccccaggatccgcatggtggaa

SEQ ID NO: 362223 - DNA, 25 bp, Rattus norvegicus
gatccccaggatgcgcatggtggaa

SEQ ID NO: 362224 - DNA, 25 bp, Rattus norvegicus
gatccccaggtcatagctgttatat

SEQ ID NO: 362225 - DNA, 25 bp, Rattus norvegicus
gatccccaggtcttagctgttatat

SEQ ID NO: 362226 - DNA, 25 bp, Rattus norvegicus
gatccccataggacctgacagtaga

SEQ ID NO: 362227 - DNA, 25 bp, Rattus norvegicus
gatccccataggtcctgacagtaga

SEQ ID NO: 362228 - DNA, 25 bp, Rattus norvegicus
gatccccattccagtgtggattttt

SEQ ID NO: 362229 - DNA, 25 bp, Rattus norvegicus
gatccccattcctgtgtggattttt

SEQ ID NO: 362230 - DNA, 25 bp, Rattus norvegicus
gatccccggcacaacctaaacggag

SEQ ID NO: 362231 - DNA, 25 bp, Rattus norvegicus
gatccccggcactacctaaacggag

SEQ ID NO: 362232 - DNA, 25 bp, Rattus norvegicus
gatccccgtattcgaactggccata

SEQ ID NO: 362233 - DNA, 25 bp, Rattus norvegicus
gatccccgtattggaactggccata

SEQ ID NO: 362234 - DNA, 25 bp, Rattus norvegicus
gatccccgttcacccgagtgcggtg

SEQ ID NO: 362235 - DNA, 25 bp, Rattus norvegicus
gatccccgttcagccgagtgcggtg

SEQ ID NO: 362236 - DNA, 25 bp, Rattus norvegicus
gatcccctagacctgtagtctcgga

SEQ ID NO: 362237 - DNA, 25 bp, Rattus norvegicus
gatcccctagacgtgtagtctcgga

SEQ ID NO: 362238 - DNA, 25 bp, Rattus norvegicus
gatcccctcagaacctttatttatt

SEQ ID NO: 362239 - DNA, 25 bp, Rattus norvegicus
gatcccctcagatcctttatttatt

SEQ ID NO: 362240 - DNA, 25 bp, Rattus norvegicus
gatcccctcataccagagctgatag

SEQ ID NO: 362241 - DNA, 25 bp, Rattus norvegicus
gatcccctcatagcagagctgatag

SEQ ID NO: 362242 - DNA, 25 bp, Rattus norvegicus
gatcccctgactactttgcaatgag

SEQ ID NO: 362243 - DNA, 25 bp, Rattus norvegicus
gatcccctgacttctttgcaatgag

SEQ ID NO: 362244 - DNA, 25 bp, Rattus norvegicus
gatcccctgatcagccaatgtttgg

SEQ ID NO: 362245 - DNA, 25 bp, Rattus norvegicus
gatcccctgatctgccaatgtttgg

SEQ ID NO: 362246 - DNA, 25 bp, Rattus norvegicus
gatcccctgcataaaatttcttcct

SEQ ID NO: 362247 - DNA, 25 bp, Rattus norvegicus
gatcccctgcattaaatttcttcct

SEQ ID NO: 362248 - DNA, 25 bp, Rattus norvegicus
gatcccctgcctagggttttcaaga

SEQ ID NO: 362249 - DNA, 25 bp, Rattus norvegicus
gatcccctgccttgggttttcaaga

SEQ ID NO: 362250 - DNA, 25 bp, Rattus norvegicus
gatcccctgttgacttactaaattg

SEQ ID NO: 362251 - DNA, 25 bp, Rattus norvegicus
gatcccctgttgtcttactaaattg

SEQ ID NO: 362252 - DNA, 25 bp, Rattus norvegicus
gatccccttctcaagggaagacctg

SEQ ID NO: 362253 - DNA, 25 bp, Rattus norvegicus
gatccccttctctagggaagacctg

SEQ ID NO: 362254 - DNA, 25 bp, Rattus norvegicus
gatccccttgaaaggctggaaagga

SEQ ID NO: 362255 - DNA, 25 bp, Rattus norvegicus
gatccccttgaatggctggaaagga

SEQ ID NO: 362256 - DNA, 25 bp, Rattus norvegicus
gatccccttggccaagacagttgga

SEQ ID NO: 362257 - DNA, 25 bp, Rattus norvegicus
gatccccttggcgaagacagttgga

SEQ ID NO: 362258 - DNA, 25 bp, Rattus norvegicus
gatcccgaaagcacttgcagttttt

SEQ ID NO: 362259 - DNA, 25 bp, Rattus norvegicus
gatcccgaaagctcttgcagttttt

SEQ ID NO: 362260 - DNA, 25 bp, Rattus norvegicus
gatcccgaaatacagccgtgctaat

SEQ ID NO: 362261 - DNA, 25 bp, Rattus norvegicus
gatcccgaaatagagccgtgctaat

SEQ ID NO: 362262 - DNA, 25 bp, Rattus norvegicus
gatcccgaagggagagcaacgctca

SEQ ID NO: 362263 - DNA, 25 bp, Rattus norvegicus
gatcccgaagggtgagcaacgctca

SEQ ID NO: 362264 - DNA, 25 bp, Rattus norvegicus
gatcccgactttccatctgatattg

SEQ ID NO: 362265 - DNA, 25 bp, Rattus norvegicus
gatcccgactttgcatctgatattg

SEQ ID NO: 362266 - DNA, 25 bp, Rattus norvegicus
gatcccgccatgaagcagtttttgc

SEQ ID NO: 362267 - DNA, 25 bp, Rattus norvegicus
gatcccgccatgtagcagtttttgc

SEQ ID NO: 362268 - DNA, 25 bp, Rattus norvegicus
gatcccgccctcctctgaaataaaa

SEQ ID NO: 362269 - DNA, 25 bp, Rattus norvegicus
gatcccgccctcgtctgaaataaaa

SEQ ID NO: 362270 - DNA, 25 bp, Rattus norvegicus
gatcccgctataccttcatacaggc

SEQ ID NO: 362271 - DNA, 25 bp, Rattus norvegicus
gatcccgctatagcttcatacaggc

SEQ ID NO: 362272 - DNA, 25 bp, Rattus norvegicus
gatcccgctgagatgcttcaaagct

SEQ ID NO: 362273 - DNA, 25 bp, Rattus norvegicus
gatcccgctgagttgcttcaaagct

SEQ ID NO: 362274 - DNA, 25 bp, Rattus norvegicus
gatcccgggacaccaactttctgaa

SEQ ID NO: 362275 - DNA, 25 bp, Rattus norvegicus
gatcccgggacagcaactttctgaa

SEQ ID NO: 362276 - DNA, 25 bp, Rattus norvegicus
gatcccggtggtccagtccaactga

SEQ ID NO: 362277 - DNA, 25 bp, Rattus norvegicus
gatcccggtggtgcagtccaactga

SEQ ID NO: 362278 - DNA, 25 bp, Rattus norvegicus
gatcccgtccataccttagtacaaa

SEQ ID NO: 362279 - DNA, 25 bp, Rattus norvegicus
gatcccgtccattccttagtacaaa

SEQ ID NO: 362280 - DNA, 25 bp, Rattus norvegicus
gatcccgtggacagtgctagtcaaa

SEQ ID NO: 362281 - DNA, 25 bp, Rattus norvegicus
gatcccgtggactgtgctagtcaaa

SEQ ID NO: 362282 - DNA, 25 bp, Rattus norvegicus
gatcccgtggcacagtttgtacata

SEQ ID NO: 362283 - DNA, 25 bp, Rattus norvegicus
gatcccgtggcagagtttgtacata

SEQ ID NO: 362284 - DNA, 25 bp, Rattus norvegicus
gatccctaaataccattgcagcatg

SEQ ID NO: 362285 - DNA, 25 bp, Rattus norvegicus
gatccctaaatagcattgcagcatg

SEQ ID NO: 362286 - DNA, 25 bp, Rattus norvegicus
gatccctaagctaaatatgcccttt

SEQ ID NO: 362287 - DNA, 25 bp, Rattus norvegicus
gatccctaagcttaatatgcccttt

SEQ ID NO: 362288 - DNA, 25 bp, Rattus norvegicus
gatccctaatacctaatgcagtcta

SEQ ID NO: 362289 - DNA, 25 bp, Rattus norvegicus
gatccctaatacgtaatgcagtcta

SEQ ID NO: 362290 - DNA, 25 bp, Rattus norvegicus
gatccctaatccctcactgaagaac

SEQ ID NO: 362291 - DNA, 25 bp, Rattus norvegicus
gatccctaatccgtcactgaagaac

SEQ ID NO: 362292 - DNA, 25 bp, Rattus norvegicus
gatccctaatctcaagtctggctat

SEQ ID NO: 362293 - DNA, 25 bp, Rattus norvegicus
gatccctaatctgaagtctggctat

SEQ ID NO: 362294 - DNA, 25 bp, Rattus norvegicus
gatccctacaaaccttgatggcttg

SEQ ID NO: 362295 - DNA, 25 bp, Rattus norvegicus
gatccctacaaagcttgatggcttg

SEQ ID NO: 362296 - DNA, 25 bp, Rattus norvegicus
gatccctaccccatcagaggagaag

SEQ ID NO: 362297 - DNA, 25 bp, Rattus norvegicus
gatccctaccccttcagaggagaag

SEQ ID NO: 362298 - DNA, 25 bp, Rattus norvegicus
gatccctacctgactgaggcaaagt

SEQ ID NO: 362299 - DNA, 25 bp, Rattus norvegicus
gatccctacctgagagatcagtgaa

SEQ ID NO: 362300 - DNA, 25 bp, Rattus norvegicus
gatccctacctgcagtgaagagacc

SEQ ID NO: 362301 - DNA, 25 bp, Rattus norvegicus
gatccctacctggagtgaagagacc

SEQ ID NO: 362302 - DNA, 25 bp, Rattus norvegicus
gatccctacctgtctgaggcaaagt

SEQ ID NO: 362303 - DNA, 25 bp, Rattus norvegicus
gatccctacctgtgagatcagtgaa

SEQ ID NO: 362304 - DNA, 25 bp, Rattus norvegicus
gatccctacgacatcgcagatgaca

SEQ ID NO: 362305 - DNA, 25 bp, Rattus norvegicus
gatccctacgacttcgcagatgaca

SEQ ID NO: 362306 - DNA, 25 bp, Rattus norvegicus
gatccctagcacctatgtaagcaga

SEQ ID NO: 362307 - DNA, 25 bp, Rattus norvegicus
gatccctagcacgtatgtaagcaga

SEQ ID NO: 362308 - DNA, 25 bp, Rattus norvegicus
gatccctaggcaaaagacttaagtt

SEQ ID NO: 362309 - DNA, 25 bp, Rattus norvegicus
gatccctaggcataagacttaagtt

SEQ ID NO: 362310 - DNA, 25 bp, Rattus norvegicus
gatccctatattaataagtcctgta

SEQ ID NO: 362311 - DNA, 25 bp, Rattus norvegicus
gatccctatatttataagtcctgta

SEQ ID NO: 362312 - DNA, 25 bp, Rattus norvegicus
gatccctatgtgatggcttgtttcc

SEQ ID NO: 362313 - DNA, 25 bp, Rattus norvegicus
gatccctatgtgttggcttgtttcc

SEQ ID NO: 362314 - DNA, 25 bp, Rattus norvegicus
gatccctattatcgcaatgactctg

SEQ ID NO: 362315 - DNA, 25 bp, Rattus norvegicus
gatccctattatggcaatgactctg

SEQ ID NO: 362316 - DNA, 25 bp, Rattus norvegicus
gatccctcacagactggttatggtt

SEQ ID NO: 362317 - DNA, 25 bp, Rattus norvegicus
gatccctcacagtctggttatggtt

SEQ ID NO: 362318 - DNA, 25 bp, Rattus norvegicus
gatccctcagtcacacgtggtgata

SEQ ID NO: 362319 - DNA, 25 bp, Rattus norvegicus
gatccctcagtctcacgtggtgata

SEQ ID NO: 362320 - DNA, 25 bp, Rattus norvegicus
gatccctcgggtcctggaaagttat

SEQ ID NO: 362321 - DNA, 25 bp, Rattus norvegicus
gatccctcgggtgctggaaagttat

SEQ ID NO: 362322 - DNA, 25 bp, Rattus norvegicus
gatccctcgtgaagtagcctgggca

SEQ ID NO: 362323 - DNA, 25 bp, Rattus norvegicus
gatccctcgtgatgtagcctgggca

SEQ ID NO: 362324 - DNA, 25 bp, Rattus norvegicus
gatccctctcttcgtgtttattgga

SEQ ID NO: 362325 - DNA, 25 bp, Rattus norvegicus
gatccctctcttggtgtttattgga

SEQ ID NO: 362326 - DNA, 25 bp, Rattus norvegicus
gatccctcttacagataccgcagta

SEQ ID NO: 362327 - DNA, 25 bp, Rattus norvegicus
gatccctcttactgataccgcagta

SEQ ID NO: 362328 - DNA, 25 bp, Rattus norvegicus
gatccctcttcaatgagtcactcat

SEQ ID NO: 362329 - DNA, 25 bp, Rattus norvegicus
gatccctcttcattgagtcactcat

SEQ ID NO: 362330 - DNA, 25 bp, Rattus norvegicus
gatccctcttttccataagtgtctg

SEQ ID NO: 362331 - DNA, 25 bp, Rattus norvegicus
gatccctcttttgcataagtgtctg

SEQ ID NO: 362332 - DNA, 25 bp, Rattus norvegicus
gatccctgactgcttcttgaacaga

SEQ ID NO: 362333 - DNA, 25 bp, Rattus norvegicus
gatccctgactggttcttgaacaga

SEQ ID NO: 362334 - DNA, 25 bp, Rattus norvegicus
gatccctgatatccatgtacaacca

SEQ ID NO: 362335 - DNA, 25 bp, Rattus norvegicus
gatccctgatatgcatgtacaacca

SEQ ID NO: 362336 - DNA, 25 bp, Rattus norvegicus
gatccctgatggaactgggctgtct

SEQ ID NO: 362337 - DNA, 25 bp, Rattus norvegicus
gatccctgatggtactgggctgtct

SEQ ID NO: 362338 - DNA, 25 bp, Rattus norvegicus
gatccctgcaggacactttagtcaa

SEQ ID NO: 362339 - DNA, 25 bp, Rattus norvegicus
gatccctgcaggtcactttagtcaa

SEQ ID NO: 362340 - DNA, 25 bp, Rattus norvegicus
gatccctgctctctctgaggtaggc

SEQ ID NO: 362341 - DNA, 25 bp, Rattus norvegicus
gatccctgctctgtctgaggtaggc

SEQ ID NO: 362342 - DNA, 25 bp, Rattus norvegicus
gatccctgcttaagaagagaacctt

SEQ ID NO: 362343 - DNA, 25 bp, Rattus norvegicus
gatccctgcttatgaagagaacctt

SEQ ID NO: 362344 - DNA, 25 bp, Rattus norvegicus
gatccctggaaacttgtgtcacttc

SEQ ID NO: 362345 - DNA, 25 bp, Rattus norvegicus
gatccctggaaagttgtgtcacttc

SEQ ID NO: 362346 - DNA, 25 bp, Rattus norvegicus
gatccctggtctctggagtcttaaa

SEQ ID NO: 362347 - DNA, 25 bp, Rattus norvegicus
gatccctggtctgtggagtcttaaa

SEQ ID NO: 362348 - DNA, 25 bp, Rattus norvegicus
gatccctggtggagactggattcta

SEQ ID NO: 362349 - DNA, 25 bp, Rattus norvegicus
gatccctggtggtgactggattcta

SEQ ID NO: 362350 - DNA, 25 bp, Rattus norvegicus
gatccctgtatgacctgtctagagt

SEQ ID NO: 362351 - DNA, 25 bp, Rattus norvegicus
gatccctgtatgtcctgtctagagt

SEQ ID NO: 362352 - DNA, 25 bp, Rattus norvegicus
gatcccttaatcatttcctaagcaa

SEQ ID NO: 362353 - DNA, 25 bp, Rattus norvegicus
gatcccttaatcttttcctaagcaa

SEQ ID NO: 362354 - DNA, 25 bp, Rattus norvegicus
gatcccttatccatttaacagtcag

SEQ ID NO: 362355 - DNA, 25 bp, Rattus norvegicus
gatcccttatccttttaacagtcag

SEQ ID NO: 362356 - DNA, 25 bp, Rattus norvegicus
gatcccttcaagattctagttacag

SEQ ID NO: 362357 - DNA, 25 bp, Rattus norvegicus
gatcccttcaagcacacagtctgtg

SEQ ID NO: 362358 - DNA, 25 bp, Rattus norvegicus
gatcccttcaaggacacagtctgtg

SEQ ID NO: 362359 - DNA, 25 bp, Rattus norvegicus
gatcccttcaagtttctagttacag

SEQ ID NO: 362360 - DNA, 25 bp, Rattus norvegicus
gatcccttcaataacagagacaacc

SEQ ID NO: 362361 - DNA, 25 bp, Rattus norvegicus
gatcccttcaattacagagacaacc

SEQ ID NO: 362362 - DNA, 25 bp, Rattus norvegicus
gatcccttcacaagtgctatcgaaa

SEQ ID NO: 362363 - DNA, 25 bp, Rattus norvegicus
gatcccttcacatgtgctatcgaaa

SEQ ID NO: 362364 - DNA, 25 bp, Rattus norvegicus
gatcccttgggcacttagaattttt

SEQ ID NO: 362365 - DNA, 25 bp, Rattus norvegicus
gatcccttgggctcttagaattttt

SEQ ID NO: 362366 - DNA, 25 bp, Rattus norvegicus
gatcccttggtgctgactttgtaga

SEQ ID NO: 362367 - DNA, 25 bp, Rattus norvegicus
gatcccttggtggtgactttgtaga

SEQ ID NO: 362368 - DNA, 25 bp, Rattus norvegicus
gatcccttggttacctttgagtagt

SEQ ID NO: 362369 - DNA, 25 bp, Rattus norvegicus
gatcccttggtttcctttgagtagt

SEQ ID NO: 362370 - DNA, 25 bp, Rattus norvegicus
gatcccttgttcagaacgtaacaca

SEQ ID NO: 362371 - DNA, 25 bp, Rattus norvegicus
gatcccttgttctgaacgtaacaca

SEQ ID NO: 362372 - DNA, 25 bp, Rattus norvegicus
gatccgaagcctagagttcagactt

SEQ ID NO: 362373 - DNA, 25 bp, Rattus norvegicus
gatccgaagccttgagttcagactt

SEQ ID NO: 362374 - DNA, 25 bp, Rattus norvegicus
gatccgactcctaaaggcagggtct

SEQ ID NO: 362375 - DNA, 25 bp, Rattus norvegicus
gatccgactccttaaggcagggtct

SEQ ID NO: 362376 - DNA, 25 bp, Rattus norvegicus
gatccgagagagaactgctcagaca

SEQ ID NO: 362377 - DNA, 25 bp, Rattus norvegicus
gatccgagagagtactgctcagaca

SEQ ID NO: 362378 - DNA, 25 bp, Rattus norvegicus
gatccgagatgcatatcagatgctg

SEQ ID NO: 362379 - DNA, 25 bp, Rattus norvegicus
gatccgagatgcttatcagatgctg

SEQ ID NO: 362380 - DNA, 25 bp, Rattus norvegicus
gatccgagccatacatgtttgtcag

SEQ ID NO: 362381 - DNA, 25 bp, Rattus norvegicus
gatccgagccattcatgtttgtcag

SEQ ID NO: 362382 - DNA, 25 bp, Rattus norvegicus
gatccgaggataagctccatcgtag

SEQ ID NO: 362383 - DNA, 25 bp, Rattus norvegicus
gatccgaggatatgctccatcgtag

SEQ ID NO: 362384 - DNA, 25 bp, Rattus norvegicus
gatccgagttccaggtgctttttca

SEQ ID NO: 362385 - DNA, 25 bp, Rattus norvegicus
gatccgagttcctggtgctttttca

SEQ ID NO: 362386 - DNA, 25 bp, Rattus norvegicus
gatccgcaagcaagggtccgttggg

SEQ ID NO: 362387 - DNA, 25 bp, Rattus norvegicus
gatccgcaagcatgggtccgttggg

SEQ ID NO: 362388 - DNA, 25 bp, Rattus norvegicus
gatccgcaatccacgagggctagag

SEQ ID NO: 362389 - DNA, 25 bp, Rattus norvegicus
gatccgcaatcctcgagggctagag

SEQ ID NO: 362390 - DNA, 25 bp, Rattus norvegicus
gatccgcataggaggctagaatcct

SEQ ID NO: 362391 - DNA, 25 bp, Rattus norvegicus
gatccgcataggtggctagaatcct

SEQ ID NO: 362392 - DNA, 25 bp, Rattus norvegicus
gatccgcatcatcaacacagaacag

SEQ ID NO: 362393 - DNA, 25 bp, Rattus norvegicus
gatccgcatcatgaacacagaacag

SEQ ID NO: 362394 - DNA, 25 bp, Rattus norvegicus
gatccgcatgccaatctgatttttc

SEQ ID NO: 362395 - DNA, 25 bp, Rattus norvegicus
gatccgcatgcctatctgatttttc

SEQ ID NO: 362396 - DNA, 25 bp, Rattus norvegicus
gatccgcatggaacctgatgagacg

SEQ ID NO: 362397 - DNA, 25 bp, Rattus norvegicus
gatccgcatggatcctgatgagacg

SEQ ID NO: 362398 - DNA, 25 bp, Rattus norvegicus
gatccgccaaggactggtgttttat

SEQ ID NO: 362399 - DNA, 25 bp, Rattus norvegicus
gatccgccaaggtctggtgttttat

SEQ ID NO: 362400 - DNA, 25 bp, Rattus norvegicus
gatccgccatgcagtgaaaacacta

SEQ ID NO: 362401 - DNA, 25 bp, Rattus norvegicus
gatccgccatgctgtgaaaacacta

SEQ ID NO: 362402 - DNA, 25 bp, Rattus norvegicus
gatccgccttggctaaatgttcagt

SEQ ID NO: 362403 - DNA, 25 bp, Rattus norvegicus
gatccgccttgggtaaatgttcagt

SEQ ID NO: 362404 - DNA, 25 bp, Rattus norvegicus
gatccgctgagactcgaacatttcc

SEQ ID NO: 362405 - DNA, 25 bp, Rattus norvegicus
gatccgctgagagtcgaacatttcc

SEQ ID NO: 362406 - DNA, 25 bp, Rattus norvegicus
gatccgcttagcattaggaagtcac

SEQ ID NO: 362407 - DNA, 25 bp, Rattus norvegicus
gatccgcttagctttaggaagtcac

SEQ ID NO: 362408 - DNA, 25 bp, Rattus norvegicus
gatccggactgcaggcctgaatgtt

SEQ ID NO: 362409 - DNA, 25 bp, Rattus norvegicus
gatccggactgctggcctgaatgtt

SEQ ID NO: 362410 - DNA, 25 bp, Rattus norvegicus
gatccggatcaacatgcgacgtact

SEQ ID NO: 362411 - DNA, 25 bp, Rattus norvegicus
gatccggatcaagatgcgacgtact

SEQ ID NO: 362412 - DNA, 25 bp, Rattus norvegicus
gatccggatggaagcacagccagta

SEQ ID NO: 362413 - DNA, 25 bp, Rattus norvegicus
gatccggatggatgcacagccagta

SEQ ID NO: 362414 - DNA, 25 bp, Rattus norvegicus
gatccggatttaccatgtccctgaa

SEQ ID NO: 362415 - DNA, 25 bp, Rattus norvegicus
gatccggatttagcatgtccctgaa

SEQ ID NO: 362416 - DNA, 25 bp, Rattus norvegicus
gatccggcaagcatggtcactagtc

SEQ ID NO: 362417 - DNA, 25 bp, Rattus norvegicus
gatccggcaagcttggtcactagtc

SEQ ID NO: 362418 - DNA, 25 bp, Rattus norvegicus
gatccgggacaaatttgagatgtga

SEQ ID NO: 362419 - DNA, 25 bp, Rattus norvegicus
gatccgggacaattttgagatgtga

SEQ ID NO: 362420 - DNA, 25 bp, Rattus norvegicus
gatccgggcttaccctggctgcaga

SEQ ID NO: 362421 - DNA, 25 bp, Rattus norvegicus
gatccgggcttagcctggctgcaga

SEQ ID NO: 362422 - DNA, 25 bp, Rattus norvegicus
gatccgggcttgacgggtcaactag

SEQ ID NO: 362423 - DNA, 25 bp, Rattus norvegicus
gatccgggcttgtcgggtcaactag

SEQ ID NO: 362424 - DNA, 25 bp, Rattus norvegicus
gatccggtaccaaagtgccacaaga

SEQ ID NO: 362425 - DNA, 25 bp, Rattus norvegicus
gatccggtaccatagtgccacaaga

SEQ ID NO: 362426 - DNA, 25 bp, Rattus norvegicus
gatccggtatctattgtcctcataa

SEQ ID NO: 362427 - DNA, 25 bp, Rattus norvegicus
gatccggtatcttttgtcctcataa

SEQ ID NO: 362428 - DNA, 25 bp, Rattus norvegicus
gatccggtattgaacatgtatcagc

SEQ ID NO: 362429 - DNA, 25 bp, Rattus norvegicus
gatccggtattgtacatgtatcagc

SEQ ID NO: 362430 - DNA, 25 bp, Rattus norvegicus
gatccggtgtctaaatgcattcata

SEQ ID NO: 362431 - DNA, 25 bp, Rattus norvegicus
gatccggtgtcttaatgcattcata

SEQ ID NO: 362432 - DNA, 25 bp, Rattus norvegicus
gatccgtatcagcttcacgtttgta

SEQ ID NO: 362433 - DNA, 25 bp, Rattus norvegicus
gatccgtatcaggttcacgtttgta

SEQ ID NO: 362434 - DNA, 25 bp, Rattus norvegicus
gatccgtcctggacgttaagcctgc

SEQ ID NO: 362435 - DNA, 25 bp, Rattus norvegicus
gatccgtcctggtcgttaagcctgc

SEQ ID NO: 362436 - DNA, 25 bp, Rattus norvegicus
gatccgtctgttagggctctaaatc

SEQ ID NO: 362437 - DNA, 25 bp, Rattus norvegicus
gatccgtctgtttgggctctaaatc

SEQ ID NO: 362438 - DNA, 25 bp, Rattus norvegicus
gatccgtcttctacttttggtatgc

SEQ ID NO: 362439 - DNA, 25 bp, Rattus norvegicus
gatccgtcttcttcttttggtatgc

SEQ ID NO: 362440 - DNA, 25 bp, Rattus norvegicus
gatccgtgacgtaggcgctgtgcat

SEQ ID NO: 362441 - DNA, 25 bp, Rattus norvegicus
gatccgtgacgttggcgctgtgcat

SEQ ID NO: 362442 - DNA, 25 bp, Rattus norvegicus
gatccgtgaggtcagagctgaacat

SEQ ID NO: 362443 - DNA, 25 bp, Rattus norvegicus
gatccgtgaggtgagagctgaacat

SEQ ID NO: 362444 - DNA, 25 bp, Rattus norvegicus
gatccgtgcattctatggtgtcaac

SEQ ID NO: 362445 - DNA, 25 bp, Rattus norvegicus
gatccgtgcattgtatggtgtcaac

SEQ ID NO: 362446 - DNA, 25 bp, Rattus norvegicus
gatccgtgccacatggaagtctgta

SEQ ID NO: 362447 - DNA, 25 bp, Rattus norvegicus
gatccgtgccacttggaagtctgta

SEQ ID NO: 362448 - DNA, 25 bp, Rattus norvegicus
gatccgtgccataagtctacatgtt

SEQ ID NO: 362449 - DNA, 25 bp, Rattus norvegicus
gatccgtgccattagtctacatgtt

SEQ ID NO: 362450 - DNA, 25 bp, Rattus norvegicus
gatccgtggattcgctatagggtcc

SEQ ID NO: 362451 - DNA, 25 bp, Rattus norvegicus
gatccgtggattggctatagggtcc

SEQ ID NO: 362452 - DNA, 25 bp, Rattus norvegicus
gatccgtgggagactgtcagaatga

SEQ ID NO: 362453 - DNA, 25 bp, Rattus norvegicus
gatccgtgggagtctgtcagaatga

SEQ ID NO: 362454 - DNA, 25 bp, Rattus norvegicus
gatccgtgtgagaccaggccctgat

SEQ ID NO: 362455 - DNA, 25 bp, Rattus norvegicus
gatccgtgtgagtccaggccctgat

SEQ ID NO: 362456 - DNA, 25 bp, Rattus norvegicus
gatccgtgtgtcctatctgatgtca

SEQ ID NO: 362457 - DNA, 25 bp, Rattus norvegicus
gatccgtgtgtcgtatctgatgtca

SEQ ID NO: 362458 - DNA, 25 bp, Rattus norvegicus
gatccgttagtactcctcgtacagg

SEQ ID NO: 362459 - DNA, 25 bp, Rattus norvegicus
gatccgttagtagtcctcgtacagg

SEQ ID NO: 362460 - DNA, 25 bp, Rattus norvegicus
gatccgttcggaccccatctggcaa

SEQ ID NO: 362461 - DNA, 25 bp, Rattus norvegicus
gatccgttcggagcccatctggcaa

SEQ ID NO: 362462 - DNA, 25 bp, Rattus norvegicus
gatccgttgttgacattgtttggct

SEQ ID NO: 362463 - DNA, 25 bp, Rattus norvegicus
gatccgttgttgtcattgtttggct

SEQ ID NO: 362464 - DNA, 25 bp, Rattus norvegicus
gatccgtttgaccaatttgcaccag

SEQ ID NO: 362465 - DNA, 25 bp, Rattus norvegicus
gatccgtttgacgaatttgcaccag

SEQ ID NO: 362466 - DNA, 25 bp, Rattus norvegicus
gatcctaaactaatttgcatgcttc

SEQ ID NO: 362467 - DNA, 25 bp, Rattus norvegicus
gatcctaaactattttgcatgcttc

SEQ ID NO: 362468 - DNA, 25 bp, Rattus norvegicus
gatcctaaagacatgtggctgttca

SEQ ID NO: 362469 - DNA, 25 bp, Rattus norvegicus
gatcctaaagacttgtggctgttca

SEQ ID NO: 362470 - DNA, 25 bp, Rattus norvegicus
gatcctaaatcgcacctgtttggtt

SEQ ID NO: 362471 - DNA, 25 bp, Rattus norvegicus
gatcctaaatcggacctgtttggtt

SEQ ID NO: 362472 - DNA, 25 bp, Rattus norvegicus
gatcctaacagtaggttgctgacct

SEQ ID NO: 362473 - DNA, 25 bp, Rattus norvegicus
gatcctaacagttggttgctgacct

SEQ ID NO: 362474 - DNA, 25 bp, Rattus norvegicus
gatcctaagagaaggcgtccatctt

SEQ ID NO: 362475 - DNA, 25 bp, Rattus norvegicus
gatcctaagagatggcgtccatctt

SEQ ID NO: 362476 - DNA, 25 bp, Rattus norvegicus
gatcctaagcgcaataaagcctcct

SEQ ID NO: 362477 - DNA, 25 bp, Rattus norvegicus
gatcctaagcgctataaagcctcct

SEQ ID NO: 362478 - DNA, 25 bp, Rattus norvegicus
gatcctaagtttagagacctccaag

SEQ ID NO: 362479 - DNA, 25 bp, Rattus norvegicus
gatcctaagttttgagacctccaag

SEQ ID NO: 362480 - DNA, 25 bp, Rattus norvegicus
gatcctaatatactggcggctggga

SEQ ID NO: 362481 - DNA, 25 bp, Rattus norvegicus
gatcctaatatagtggcggctggga

SEQ ID NO: 362482 - DNA, 25 bp, Rattus norvegicus
gatcctaatgtgaatattgtgccta

SEQ ID NO: 362483 - DNA, 25 bp, Rattus norvegicus
gatcctaatgtgtatattgtgccta

SEQ ID NO: 362484 - DNA, 25 bp, Rattus norvegicus
gatcctacaataacaagtattcagc

SEQ ID NO: 362485 - DNA, 25 bp, Rattus norvegicus
gatcctacaatatcaagtattcagc

SEQ ID NO: 362486 - DNA, 25 bp, Rattus norvegicus
gatcctacacaacaaaggcaaagta

SEQ ID NO: 362487 - DNA, 25 bp, Rattus norvegicus
gatcctacacaagaaaggcaaagta

SEQ ID NO: 362488 - DNA, 25 bp, Rattus norvegicus
gatcctacagttatgaagccttcac

SEQ ID NO: 362489 - DNA, 25 bp, Rattus norvegicus
gatcctacagttttgaagccttcac

SEQ ID NO: 362490 - DNA, 25 bp, Rattus norvegicus
gatcctacccagatggcagaaatag

SEQ ID NO: 362491 - DNA, 25 bp, Rattus norvegicus
gatcctacccagttggcagaaatag

SEQ ID NO: 362492 - DNA, 25 bp, Rattus norvegicus
gatcctaccggaccttcattttgaa

SEQ ID NO: 362493 - DNA, 25 bp, Rattus norvegicus
gatcctaccggagcttcattttgaa

SEQ ID NO: 362494 - DNA, 25 bp, Rattus norvegicus
gatcctacctttatgtaaggctctt

SEQ ID NO: 362495 - DNA, 25 bp, Rattus norvegicus
gatcctacctttttgtaaggctctt

SEQ ID NO: 362496 - DNA, 25 bp, Rattus norvegicus
gatcctacttctatgaccgggctgg

SEQ ID NO: 362497 - DNA, 25 bp, Rattus norvegicus
gatcctacttctttgaccgggctgg

SEQ ID NO: 362498 - DNA, 25 bp, Rattus norvegicus
gatcctagacaaactcttggaccga

SEQ ID NO: 362499 - DNA, 25 bp, Rattus norvegicus
gatcctagacaatctcttggaccga

SEQ ID NO: 362500 - DNA, 25 bp, Rattus norvegicus
gatcctagatctacttatctgtgtt

SEQ ID NO: 362501 - DNA, 25 bp, Rattus norvegicus
gatcctagatcttcttatctgtgtt

SEQ ID NO: 362502 - DNA, 25 bp, Rattus norvegicus
gatcctaggctacttctcggagtaa

SEQ ID NO: 362503 - DNA, 25 bp, Rattus norvegicus
gatcctaggctagttctcggagtaa

SEQ ID NO: 362504 - DNA, 25 bp, Rattus norvegicus
gatcctagtgaacaccatgattcgg

SEQ ID NO: 362505 - DNA, 25 bp, Rattus norvegicus
gatcctagtgaagaccatgattcgg

SEQ ID NO: 362506 - DNA, 25 bp, Rattus norvegicus
gatcctagtgtaaagtttgttagct

SEQ ID NO: 362507 - DNA, 25 bp, Rattus norvegicus
gatcctagtgtatagtttgttagct

SEQ ID NO: 362508 - DNA, 25 bp, Rattus norvegicus
gatcctataatcagaaatgcagcac

SEQ ID NO: 362509 - DNA, 25 bp, Rattus norvegicus
gatcctataatctgaaatgcagcac

SEQ ID NO: 362510 - DNA, 25 bp, Rattus norvegicus
gatcctatccgtcagcagcaatgtt

SEQ ID NO: 362511 - DNA, 25 bp, Rattus norvegicus
gatcctatccgtgagcagcaatgtt

SEQ ID NO: 362512 - DNA, 25 bp, Rattus norvegicus
gatcctatcctgaacacaaccaaaa

SEQ ID NO: 362513 - DNA, 25 bp, Rattus norvegicus
gatcctatcctgtacacaaccaaaa

SEQ ID NO: 362514 - DNA, 25 bp, Rattus norvegicus
gatcctatgtatcctgagtcctgta

SEQ ID NO: 362515 - DNA, 25 bp, Rattus norvegicus
gatcctatgtatgctgagtcctgta

SEQ ID NO: 362516 - DNA, 25 bp, Rattus norvegicus
gatcctatgtctaccatactgttta

SEQ ID NO: 362517 - DNA, 25 bp, Rattus norvegicus
gatcctatgtcttccatactgttta

SEQ ID NO: 362518 - DNA, 25 bp, Rattus norvegicus
gatcctatttaaatccacatgcata

SEQ ID NO: 362519 - DNA, 25 bp, Rattus norvegicus
gatcctatttaattccacatgcata

SEQ ID NO: 362520 - DNA, 25 bp, Rattus norvegicus
gatcctcaaaatcgcagtacaggga

SEQ ID NO: 362521 - DNA, 25 bp, Rattus norvegicus
gatcctcaaaatggcagtacaggga

SEQ ID NO: 362522 - DNA, 25 bp, Rattus norvegicus
gatcctcaaacaaaccgggctaatt

SEQ ID NO: 362523 - DNA, 25 bp, Rattus norvegicus
gatcctcaaacataccgggctaatt

SEQ ID NO: 362524 - DNA, 25 bp, Rattus norvegicus
gatcctcaactcaccattgttaagg

SEQ ID NO: 362525 - DNA, 25 bp, Rattus norvegicus
gatcctcaactctccattgttaagg

SEQ ID NO: 362526 - DNA, 25 bp, Rattus norvegicus
gatcctcaagagcaccagaagttca

SEQ ID NO: 362527 - DNA, 25 bp, Rattus norvegicus
gatcctcaagaggaccagaagttca

SEQ ID NO: 362528 - DNA, 25 bp, Rattus norvegicus
gatcctcaagataaacctctccagt

SEQ ID NO: 362529 - DNA, 25 bp, Rattus norvegicus
gatcctcaagattaacctctccagt

SEQ ID NO: 362530 - DNA, 25 bp, Rattus norvegicus
gatcctcaaggacccagtcccagaa

SEQ ID NO: 362531 - DNA, 25 bp, Rattus norvegicus
gatcctcaaggagccagtcccagaa

SEQ ID NO: 362532 - DNA, 25 bp, Rattus norvegicus
gatcctcaatctattgctactttta

SEQ ID NO: 362533 - DNA, 25 bp, Rattus norvegicus
gatcctcaatcttttgctactttta

SEQ ID NO: 362534 - DNA, 25 bp, Rattus norvegicus
gatcctcaatttcggactctttgct

SEQ ID NO: 362535 - DNA, 25 bp, Rattus norvegicus
gatcctcaatttgggactctttgct

SEQ ID NO: 362536 - DNA, 25 bp, Rattus norvegicus
gatcctcaccggaagttcggagcca

SEQ ID NO: 362537 - DNA, 25 bp, Rattus norvegicus
gatcctcaccggtagttcggagcca

SEQ ID NO: 362538 - DNA, 25 bp, Rattus norvegicus
gatcctcacctgactatactcaaaa

SEQ ID NO: 362539 - DNA, 25 bp, Rattus norvegicus
gatcctcacctgtctatactcaaaa

SEQ ID NO: 362540 - DNA, 25 bp, Rattus norvegicus
gatcctcactggacccagaggtatg

SEQ ID NO: 362541 - DNA, 25 bp, Rattus norvegicus
gatcctcactggtcccagaggtatg

SEQ ID NO: 362542 - DNA, 25 bp, Rattus norvegicus
gatcctcagaagacaatttctcttt

SEQ ID NO: 362543 - DNA, 25 bp, Rattus norvegicus
gatcctcagaagtcaatttctcttt

SEQ ID NO: 362544 - DNA, 25 bp, Rattus norvegicus
gatcctcagcgacgtgctcgagaag

SEQ ID NO: 362545 - DNA, 25 bp, Rattus norvegicus
gatcctcagcgaggtgctcgagaag

SEQ ID NO: 362546 - DNA, 25 bp, Rattus norvegicus
gatcctcagtgcacacctttgttga

SEQ ID NO: 362547 - DNA, 25 bp, Rattus norvegicus
gatcctcagtgctcacctttgttga

SEQ ID NO: 362548 - DNA, 25 bp, Rattus norvegicus
gatcctcagtggcaaaggctggctt

SEQ ID NO: 362549 - DNA, 25 bp, Rattus norvegicus
gatcctcagtgggaaaggctggctt

SEQ ID NO: 362550 - DNA, 25 bp, Rattus norvegicus
gatcctcatattctatttgtacttt

SEQ ID NO: 362551 - DNA, 25 bp, Rattus norvegicus
gatcctcatattgtatttgtacttt

SEQ ID NO: 362552 - DNA, 25 bp, Rattus norvegicus
gatcctcatcctacagagccagatt

SEQ ID NO: 362553 - DNA, 25 bp, Rattus norvegicus
gatcctcatccttcagagccagatt

SEQ ID NO: 362554 - DNA, 25 bp, Rattus norvegicus
gatcctccaagaacttcagctttgg

SEQ ID NO: 362555 - DNA, 25 bp, Rattus norvegicus
gatcctccaagatcttcagctttgg

SEQ ID NO: 362556 - DNA, 25 bp, Rattus norvegicus
gatcctccaatcctggaaggtgcag

SEQ ID NO: 362557 - DNA, 25 bp, Rattus norvegicus
gatcctccaatcgtggaaggtgcag

SEQ ID NO: 362558 - DNA, 25 bp, Rattus norvegicus
gatcctccagataagcaaccagtgc

SEQ ID NO: 362559 - DNA, 25 bp, Rattus norvegicus
gatcctccagattagcaaccagtgc

SEQ ID NO: 362560 - DNA, 25 bp, Rattus norvegicus
gatcctccagccacaagtagagagt

SEQ ID NO: 362561 - DNA, 25 bp, Rattus norvegicus
gatcctccagcctcaagtagagagt

SEQ ID NO: 362562 - DNA, 25 bp, Rattus norvegicus
gatcctccagctcccaagaacttaa

SEQ ID NO: 362563 - DNA, 25 bp, Rattus norvegicus
gatcctccagctgccaagaacttaa

SEQ ID NO: 362564 - DNA, 25 bp, Rattus norvegicus
gatcctccatggaggtgttggcaag

SEQ ID NO: 362565 - DNA, 25 bp, Rattus norvegicus
gatcctccatggtggtgttggcaag

SEQ ID NO: 362566 - DNA, 25 bp, Rattus norvegicus
gatcctcccaagctctgaacatatg

SEQ ID NO: 362567 - DNA, 25 bp, Rattus norvegicus
gatcctcccaaggtctgaacatatg

SEQ ID NO: 362568 - DNA, 25 bp, Rattus norvegicus
gatcctccccataaatcactaagaa

SEQ ID NO: 362569 - DNA, 25 bp, Rattus norvegicus
gatcctccccattaatcactaagaa

SEQ ID NO: 362570 - DNA, 25 bp, Rattus norvegicus
gatcctccttagatggttttgttgt

SEQ ID NO: 362571 - DNA, 25 bp, Rattus norvegicus
gatcctccttagttggttttgttgt

SEQ ID NO: 362572 - DNA, 25 bp, Rattus norvegicus
gatcctccttctcggcattcctggg

SEQ ID NO: 362573 - DNA, 25 bp, Rattus norvegicus
gatcctccttctgggcattcctggg

SEQ ID NO: 362574 - DNA, 25 bp, Rattus norvegicus
gatcctcctttaccatgactttcaa

SEQ ID NO: 362575 - DNA, 25 bp, Rattus norvegicus
gatcctcctttagcatgactttcaa

SEQ ID NO: 362576 - DNA, 25 bp, Rattus norvegicus
gatcctcctttgaaaaaatctccta

SEQ ID NO: 362577 - DNA, 25 bp, Rattus norvegicus
gatcctcctttgtaaaaatctccta

SEQ ID NO: 362578 - DNA, 25 bp, Rattus norvegicus
gatcctcgaagcatctatgagcgtg

SEQ ID NO: 362579 - DNA, 25 bp, Rattus norvegicus
gatcctcgaagcttctatgagcgtg

SEQ ID NO: 362580 - DNA, 25 bp, Rattus norvegicus
gatcctcgggtacacaaagtccatg

SEQ ID NO: 362581 - DNA, 25 bp, Rattus norvegicus
gatcctcgggtagacaaagtccatg

SEQ ID NO: 362582 - DNA, 25 bp, Rattus norvegicus
gatcctcgtagaaattcacagctca

SEQ ID NO: 362583 - DNA, 25 bp, Rattus norvegicus
gatcctcgtagatattcacagctca

SEQ ID NO: 362584 - DNA, 25 bp, Rattus norvegicus
gatcctctagagctgttatgtgata

SEQ ID NO: 362585 - DNA, 25 bp, Rattus norvegicus
gatcctctagaggtgttatgtgata

SEQ ID NO: 362586 - DNA, 25 bp, Rattus norvegicus
gatcctctaggccttgggtgttttg

SEQ ID NO: 362587 - DNA, 25 bp, Rattus norvegicus
gatcctctaggcgttgggtgttttg

SEQ ID NO: 362588 - DNA, 25 bp, Rattus norvegicus
gatcctctcactagaaggccaggag

SEQ ID NO: 362589 - DNA, 25 bp, Rattus norvegicus
gatcctctcacttgaaggccaggag

SEQ ID NO: 362590 - DNA, 25 bp, Rattus norvegicus
gatcctctccaacagaaaggctcct

SEQ ID NO: 362591 - DNA, 25 bp, Rattus norvegicus
gatcctctccaagagaaaggctcct

SEQ ID NO: 362592 - DNA, 25 bp, Rattus norvegicus
gatcctctctgtaaacttgcagtgt

SEQ ID NO: 362593 - DNA, 25 bp, Rattus norvegicus
gatcctctctgttaacttgcagtgt

SEQ ID NO: 362594 - DNA, 25 bp, Rattus norvegicus
gatcctctgcagctacggatggtca

SEQ ID NO: 362595 - DNA, 25 bp, Rattus norvegicus
gatcctctgcaggtacggatggtca

SEQ ID NO: 362596 - DNA, 25 bp, Rattus norvegicus
gatcctctggagcacaaggcttttt

SEQ ID NO: 362597 - DNA, 25 bp, Rattus norvegicus
gatcctctggaggacaaggcttttt

SEQ ID NO: 362598 - DNA, 25 bp, Rattus norvegicus
gatcctctgggcagggctccaaggc

SEQ ID NO: 362599 - DNA, 25 bp, Rattus norvegicus
gatcctctgggctgggctccaaggc

SEQ ID NO: 362600 - DNA, 25 bp, Rattus norvegicus
gatcctctggtcatagaacttggcc

SEQ ID NO: 362601 - DNA, 25 bp, Rattus norvegicus
gatcctctggtcttagaacttggcc

SEQ ID NO: 362602 - DNA, 25 bp, Rattus norvegicus
gatcctctgtcaaagcttatgtggt

SEQ ID NO: 362603 - DNA, 25 bp, Rattus norvegicus
gatcctctgtcatagcttatgtggt

SEQ ID NO: 362604 - DNA, 25 bp, Rattus norvegicus
gatcctctgtccagactgtcatgga

SEQ ID NO: 362605 - DNA, 25 bp, Rattus norvegicus
gatcctctgtcctgactgtcatgga

SEQ ID NO: 362606 - DNA, 25 bp, Rattus norvegicus
gatcctctgtctctcaagctattga

SEQ ID NO: 362607 - DNA, 25 bp, Rattus norvegicus
gatcctctgtctgtcaagctattga

SEQ ID NO: 362608 - DNA, 25 bp, Rattus norvegicus
gatcctctgtgcacactaaacaatg

SEQ ID NO: 362609 - DNA, 25 bp, Rattus norvegicus
gatcctctgtgctcactaaacaatg

SEQ ID NO: 362610 - DNA, 25 bp, Rattus norvegicus
gatcctcttccaccatggcatgtgg

SEQ ID NO: 362611 - DNA, 25 bp, Rattus norvegicus
gatcctcttccagcatggcatgtgg

SEQ ID NO: 362612 - DNA, 25 bp, Rattus norvegicus
gatcctcttctgctgttctggaaag

SEQ ID NO: 362613 - DNA, 25 bp, Rattus norvegicus
gatcctcttctggtgttctggaaag

SEQ ID NO: 362614 - DNA, 25 bp, Rattus norvegicus
gatcctcttgccacaaaatcaactt

SEQ ID NO: 362615 - DNA, 25 bp, Rattus norvegicus
gatcctcttgcctcaaaatcaactt

SEQ ID NO: 362616 - DNA, 25 bp, Rattus norvegicus
gatcctcttgtcagcttttggacaa

SEQ ID NO: 362617 - DNA, 25 bp, Rattus norvegicus
gatcctcttgtctgcttttggacaa

SEQ ID NO: 362618 - DNA, 25 bp, Rattus norvegicus
gatcctcttttccttgacttcttaa

SEQ ID NO: 362619 - DNA, 25 bp, Rattus norvegicus
gatcctcttttccttttctgaacac

SEQ ID NO: 362620 - DNA, 25 bp, Rattus norvegicus
gatcctcttttcgttgacttcttaa

SEQ ID NO: 362621 - DNA, 25 bp, Rattus norvegicus
gatcctcttttcgttttctgaacac

SEQ ID NO: 362622 - DNA, 25 bp, Rattus norvegicus
gatcctcttttgaaaacctcatctg

SEQ ID NO: 362623 - DNA, 25 bp, Rattus norvegicus
gatcctcttttgactcttgggaaag

SEQ ID NO: 362624 - DNA, 25 bp, Rattus norvegicus
gatcctcttttgtaaacctcatctg

SEQ ID NO: 362625 - DNA, 25 bp, Rattus norvegicus
gatcctcttttgtctcttgggaaag

SEQ ID NO: 362626 - DNA, 25 bp, Rattus norvegicus
gatcctgaagcaatgtgagcatcac

SEQ ID NO: 362627 - DNA, 25 bp, Rattus norvegicus
gatcctgaagcattgtgagcatcac

SEQ ID NO: 362628 - DNA, 25 bp, Rattus norvegicus
gatcctgaatcaaacaccattaatt

SEQ ID NO: 362629 - DNA, 25 bp, Rattus norvegicus
gatcctgaatcatacaccattaatt

SEQ ID NO: 362630 - DNA, 25 bp, Rattus norvegicus
gatcctgacaccaacactcaagaag

SEQ ID NO: 362631 - DNA, 25 bp, Rattus norvegicus
gatcctgacacctacactcaagaag

SEQ ID NO: 362632 - DNA, 25 bp, Rattus norvegicus
gatcctgactgcctatgtgatgtaa

SEQ ID NO: 362633 - DNA, 25 bp, Rattus norvegicus
gatcctgactgcgtatgtgatgtaa

SEQ ID NO: 362634 - DNA, 25 bp, Rattus norvegicus
gatcctgagaaccttttcctttcct

SEQ ID NO: 362635 - DNA, 25 bp, Rattus norvegicus
gatcctgagaacgttttcctttcct

SEQ ID NO: 362636 - DNA, 25 bp, Rattus norvegicus
gatcctgagagtcaaaagcccgact

SEQ ID NO: 362637 - DNA, 25 bp, Rattus norvegicus
gatcctgagagtgaaaagcccgact

SEQ ID NO: 362638 - DNA, 25 bp, Rattus norvegicus
gatcctgaggacagaccaccatggg

SEQ ID NO: 362639 - DNA, 25 bp, Rattus norvegicus
gatcctgaggactgaccaccatggg

SEQ ID NO: 362640 - DNA, 25 bp, Rattus norvegicus
gatcctgaggccagcagtttcagag

SEQ ID NO: 362641 - DNA, 25 bp, Rattus norvegicus
gatcctgaggccagtgagaaactgg

SEQ ID NO: 362642 - DNA, 25 bp, Rattus norvegicus
gatcctgaggcctgcagtttcagag

SEQ ID NO: 362643 - DNA, 25 bp, Rattus norvegicus
gatcctgaggcctgtgagaaactgg

SEQ ID NO: 362644 - DNA, 25 bp, Rattus norvegicus
gatcctgagtaaaaatttgtacctg

SEQ ID NO: 362645 - DNA, 25 bp, Rattus norvegicus
gatcctgagtaataatttgtacctg

SEQ ID NO: 362646 - DNA, 25 bp, Rattus norvegicus
gatcctgagtggctggcctcctaaa

SEQ ID NO: 362647 - DNA, 25 bp, Rattus norvegicus
gatcctgagtgggtggcctcctaaa

SEQ ID NO: 362648 - DNA, 25 bp, Rattus norvegicus
gatcctgatcatccatctttgagtt

SEQ ID NO: 362649 - DNA, 25 bp, Rattus norvegicus
gatcctgatcatgcatctttgagtt

SEQ ID NO: 362650 - DNA, 25 bp, Rattus norvegicus
gatcctgattctaaaccactggaaa

SEQ ID NO: 362651 - DNA, 25 bp, Rattus norvegicus
gatcctgattcttaaccactggaaa

SEQ ID NO: 362652 - DNA, 25 bp, Rattus norvegicus
gatcctgcaaacctgaactagcatc

SEQ ID NO: 362653 - DNA, 25 bp, Rattus norvegicus
gatcctgcaaacgtgaactagcatc

SEQ ID NO: 362654 - DNA, 25 bp, Rattus norvegicus
gatcctgcacagctcttgtggagca

SEQ ID NO: 362655 - DNA, 25 bp, Rattus norvegicus
gatcctgcacaggtcttgtggagca

SEQ ID NO: 362656 - DNA, 25 bp, Rattus norvegicus
gatcctgcaggacatctgggcatta

SEQ ID NO: 362657 - DNA, 25 bp, Rattus norvegicus
gatcctgcaggactacaaatctctc

SEQ ID NO: 362658 - DNA, 25 bp, Rattus norvegicus
gatcctgcaggagatctgggcatta

SEQ ID NO: 362659 - DNA, 25 bp, Rattus norvegicus
gatcctgcaggagtacaaatctctc

SEQ ID NO: 362660 - DNA, 25 bp, Rattus norvegicus
gatcctgccacacccatggtggaaa

SEQ ID NO: 362661 - DNA, 25 bp, Rattus norvegicus
gatcctgccacagccatggtggaaa

SEQ ID NO: 362662 - DNA, 25 bp, Rattus norvegicus
gatcctgccagtcatttgaccttta

SEQ ID NO: 362663 - DNA, 25 bp, Rattus norvegicus
gatcctgccagtgatttgaccttta

SEQ ID NO: 362664 - DNA, 25 bp, Rattus norvegicus
gatcctgcccagattgaagtgatgt

SEQ ID NO: 362665 - DNA, 25 bp, Rattus norvegicus
gatcctgcccagcactaacgggact

SEQ ID NO: 362666 - DNA, 25 bp, Rattus norvegicus
gatcctgcccaggactaacgggact

SEQ ID NO: 362667 - DNA, 25 bp, Rattus norvegicus
gatcctgcccagtttgaagtgatgt

SEQ ID NO: 362668 - DNA, 25 bp, Rattus norvegicus
gatcctgcccgacagcatagtgatg

SEQ ID NO: 362669 - DNA, 25 bp, Rattus norvegicus
gatcctgcccgagagcatagtgatg

SEQ ID NO: 362670 - DNA, 25 bp, Rattus norvegicus
gatcctgcctatcctgttcagataa

SEQ ID NO: 362671 - DNA, 25 bp, Rattus norvegicus
gatcctgcctatgctgttcagataa

SEQ ID NO: 362672 - DNA, 25 bp, Rattus norvegicus
gatcctgcctctcgaagttgaccga

SEQ ID NO: 362673 - DNA, 25 bp, Rattus norvegicus
gatcctgcctctggaagttgaccga

SEQ ID NO: 362674 - DNA, 25 bp, Rattus norvegicus
gatcctgccttcacaaagtcatgga

SEQ ID NO: 362675 - DNA, 25 bp, Rattus norvegicus
gatcctgccttctcaaagtcatgga

SEQ ID NO: 362676 - DNA, 25 bp, Rattus norvegicus
gatcctgcggttcctacacatagaa

SEQ ID NO: 362677 - DNA, 25 bp, Rattus norvegicus
gatcctgcggttgctacacatagaa

SEQ ID NO: 362678 - DNA, 25 bp, Rattus norvegicus
gatcctgcgtataactgtggttaca

SEQ ID NO: 362679 - DNA, 25 bp, Rattus norvegicus
gatcctgcgtattactgtggttaca

SEQ ID NO: 362680 - DNA, 25 bp, Rattus norvegicus
gatcctgctaggagtgggaactgtt

SEQ ID NO: 362681 - DNA, 25 bp, Rattus norvegicus
gatcctgctaggtgtgggaactgtt

SEQ ID NO: 362682 - DNA, 25 bp, Rattus norvegicus
gatcctgctcagaactatgaatcac

SEQ ID NO: 362683 - DNA, 25 bp, Rattus norvegicus
gatcctgctcagtactatgaatcac

SEQ ID NO: 362684 - DNA, 25 bp, Rattus norvegicus
gatcctgctcctctcaagagcaaat

SEQ ID NO: 362685 - DNA, 25 bp, Rattus norvegicus
gatcctgctcctgtcaagagcaaat

SEQ ID NO: 362686 - DNA, 25 bp, Rattus norvegicus
gatcctgctggacgtgaacaaccgc

SEQ ID NO: 362687 - DNA, 25 bp, Rattus norvegicus
gatcctgctggaggtgaacaaccgc

SEQ ID NO: 362688 - DNA, 25 bp, Rattus norvegicus
gatcctgcttagactcctgcagaaa

SEQ ID NO: 362689 - DNA, 25 bp, Rattus norvegicus
gatcctgcttagtctcctgcagaaa

SEQ ID NO: 362690 - DNA, 25 bp, Rattus norvegicus
gatcctgcttccaccagaacaggtg

SEQ ID NO: 362691 - DNA, 25 bp, Rattus norvegicus
gatcctgcttcctccagaacaggtg

SEQ ID NO: 362692 - DNA, 25 bp, Rattus norvegicus
gatcctggaaacagggcttactcat

SEQ ID NO: 362693 - DNA, 25 bp, Rattus norvegicus
gatcctggaaactgggcttactcat

SEQ ID NO: 362694 - DNA, 25 bp, Rattus norvegicus
gatcctggacatcactgatactgca

SEQ ID NO: 362695 - DNA, 25 bp, Rattus norvegicus
gatcctggacatgactgatactgca

SEQ ID NO: 362696 - DNA, 25 bp, Rattus norvegicus
gatcctggaccactgaaatgagcac

SEQ ID NO: 362697 - DNA, 25 bp, Rattus norvegicus
gatcctggaccagtgaaatgagcac

SEQ ID NO: 362698 - DNA, 25 bp, Rattus norvegicus
gatcctggactaatgttatgctcac

SEQ ID NO: 362699 - DNA, 25 bp, Rattus norvegicus
gatcctggactattgttatgctcac

SEQ ID NO: 362700 - DNA, 25 bp, Rattus norvegicus
gatcctggagcaacagtagcagaaa

SEQ ID NO: 362701 - DNA, 25 bp, Rattus norvegicus
gatcctggagcaactgaaaaccctg

SEQ ID NO: 362702 - DNA, 25 bp, Rattus norvegicus
gatcctggagcatcagtagcagaaa

SEQ ID NO: 362703 - DNA, 25 bp, Rattus norvegicus
gatcctggagcatctgaaaaccctg

SEQ ID NO: 362704 - DNA, 25 bp, Rattus norvegicus
gatcctggatgtccttctcgagaaa

SEQ ID NO: 362705 - DNA, 25 bp, Rattus norvegicus
gatcctggatgtgcttctcgagaaa

SEQ ID NO: 362706 - DNA, 25 bp, Rattus norvegicus
gatcctggcctaagttgctgtcttt

SEQ ID NO: 362707 - DNA, 25 bp, Rattus norvegicus
gatcctggcctatgttgctgtcttt

SEQ ID NO: 362708 - DNA, 25 bp, Rattus norvegicus
gatcctggctcgcagacagacaatt

SEQ ID NO: 362709 - DNA, 25 bp, Rattus norvegicus
gatcctggctcggagacagacaatt

SEQ ID NO: 362710 - DNA, 25 bp, Rattus norvegicus
gatcctggctttactggagctacaa

SEQ ID NO: 362711 - DNA, 25 bp, Rattus norvegicus
gatcctggcttttctggagctacaa

SEQ ID NO: 362712 - DNA, 25 bp, Rattus norvegicus
gatcctgggaaaatctctcaggtaa

SEQ ID NO: 362713 - DNA, 25 bp, Rattus norvegicus
gatcctgggaaattctctcaggtaa

SEQ ID NO: 362714 - DNA, 25 bp, Rattus norvegicus
gatcctgggatcagcagtatcatct

SEQ ID NO: 362715 - DNA, 25 bp, Rattus norvegicus
gatcctgggatctgcagtatcatct

SEQ ID NO: 362716 - DNA, 25 bp, Rattus norvegicus
gatcctgggcccaggtacttagcaa

SEQ ID NO: 362717 - DNA, 25 bp, Rattus norvegicus
gatcctgggccctggtacttagcaa

SEQ ID NO: 362718 - DNA, 25 bp, Rattus norvegicus
gatcctgggtggctcacttgtgatt

SEQ ID NO: 362719 - DNA, 25 bp, Rattus norvegicus
gatcctgggtgggtcacttgtgatt

SEQ ID NO: 362720 - DNA, 25 bp, Rattus norvegicus
gatcctggtaaaaacctgtgcccct

SEQ ID NO: 362721 - DNA, 25 bp, Rattus norvegicus
gatcctggtaaatacctgtgcccct

SEQ ID NO: 362722 - DNA, 25 bp, Rattus norvegicus
gatcctggtacaagtgaccctttga

SEQ ID NO: 362723 - DNA, 25 bp, Rattus norvegicus
gatcctggtacatgtgaccctttga

SEQ ID NO: 362724 - DNA, 25 bp, Rattus norvegicus
gatcctggtttgattttcttgtttt

SEQ ID NO: 362725 - DNA, 25 bp, Rattus norvegicus
gatcctggtttgtttttcttgtttt

SEQ ID NO: 362726 - DNA, 25 bp, Rattus norvegicus
gatcctgtataaccttcctggtcat

SEQ ID NO: 362727 - DNA, 25 bp, Rattus norvegicus
gatcctgtataagcttcctggtcat

SEQ ID NO: 362728 - DNA, 25 bp, Rattus norvegicus
gatcctgtatagctttcctgtcatt

SEQ ID NO: 362729 - DNA, 25 bp, Rattus norvegicus
gatcctgtataggtttcctgtcatt

SEQ ID NO: 362730 - DNA, 25 bp, Rattus norvegicus
gatcctgtcacacacaactgttggg

SEQ ID NO: 362731 - DNA, 25 bp, Rattus norvegicus
gatcctgtcacagacaactgttggg

SEQ ID NO: 362732 - DNA, 25 bp, Rattus norvegicus
gatcctgtcagcagttcatccagtg

SEQ ID NO: 362733 - DNA, 25 bp, Rattus norvegicus
gatcctgtcagctgttcatccagtg

SEQ ID NO: 362734 - DNA, 25 bp, Rattus norvegicus
gatcctgtcgatcaaaatcccctga

SEQ ID NO: 362735 - DNA, 25 bp, Rattus norvegicus
gatcctgtcgatgaaaatcccctga

SEQ ID NO: 362736 - DNA, 25 bp, Rattus norvegicus
gatcctgtctgcagccacgttttta

SEQ ID NO: 362737 - DNA, 25 bp, Rattus norvegicus
gatcctgtctgctgccacgttttta

SEQ ID NO: 362738 - DNA, 25 bp, Rattus norvegicus
gatcctgtcttaatgaccattgcca

SEQ ID NO: 362739 - DNA, 25 bp, Rattus norvegicus
gatcctgtcttattgaccattgcca

SEQ ID NO: 362740 - DNA, 25 bp, Rattus norvegicus
gatcctgtgcagagcgctgcagaga

SEQ ID NO: 362741 - DNA, 25 bp, Rattus norvegicus
gatcctgtgcagtgcgctgcagaga

SEQ ID NO: 362742 - DNA, 25 bp, Rattus norvegicus
gatcctgtgcctcgtggaagctctc

SEQ ID NO: 362743 - DNA, 25 bp, Rattus norvegicus
gatcctgtgcctggtggaagctctc

SEQ ID NO: 362744 - DNA, 25 bp, Rattus norvegicus
gatcctgtgctgatgaactgggcag

SEQ ID NO: 362745 - DNA, 25 bp, Rattus norvegicus
gatcctgtgctgttgaactgggcag

SEQ ID NO: 362746 - DNA, 25 bp, Rattus norvegicus
gatcctgtggagacgattgcctcaa

SEQ ID NO: 362747 - DNA, 25 bp, Rattus norvegicus
gatcctgtggagtcgattgcctcaa

SEQ ID NO: 362748 - DNA, 25 bp, Rattus norvegicus
gatcctgtgttgatgagctccaact

SEQ ID NO: 362749 - DNA, 25 bp, Rattus norvegicus
gatcctgtgttgttgagctccaact

SEQ ID NO: 362750 - DNA, 25 bp, Rattus norvegicus
gatcctgttatcatgtttgctttgt

SEQ ID NO: 362751 - DNA, 25 bp, Rattus norvegicus
gatcctgttatcttgtttgctttgt

SEQ ID NO: 362752 - DNA, 25 bp, Rattus norvegicus
gatcctgttggaagctggtgctgac

SEQ ID NO: 362753 - DNA, 25 bp, Rattus norvegicus
gatcctgttggatgctggtgctgac

SEQ ID NO: 362754 - DNA, 25 bp, Rattus norvegicus
gatcctgtttctctaggcctctaag

SEQ ID NO: 362755 - DNA, 25 bp, Rattus norvegicus
gatcctgtttctgtaggcctctaag

SEQ ID NO: 362756 - DNA, 25 bp, Rattus norvegicus
gatccttaaatactgggtggctaca

SEQ ID NO: 362757 - DNA, 25 bp, Rattus norvegicus
gatccttaaatagtgggtggctaca

SEQ ID NO: 362758 - DNA, 25 bp, Rattus norvegicus
gatccttaaggtatcctgcctgctg

SEQ ID NO: 362759 - DNA, 25 bp, Rattus norvegicus
gatccttaaggtattgggtgtgctc

SEQ ID NO: 362760 - DNA, 25 bp, Rattus norvegicus
gatccttaaggtttcctgcctgctg

SEQ ID NO: 362761 - DNA, 25 bp, Rattus norvegicus
gatccttaaggttttgggtgtgctc

SEQ ID NO: 362762 - DNA, 25 bp, Rattus norvegicus
gatccttaataaacccgagcttgcc

SEQ ID NO: 362763 - DNA, 25 bp, Rattus norvegicus
gatccttaataatcccgagcttgcc

SEQ ID NO: 362764 - DNA, 25 bp, Rattus norvegicus
gatccttacaatactgcttccagta

SEQ ID NO: 362765 - DNA, 25 bp, Rattus norvegicus
gatccttacaatatcctttctgact

SEQ ID NO: 362766 - DNA, 25 bp, Rattus norvegicus
gatccttacaattctgcttccagta

SEQ ID NO: 362767 - DNA, 25 bp, Rattus norvegicus
gatccttacaatttcctttctgact

SEQ ID NO: 362768 - DNA, 25 bp, Rattus norvegicus
gatccttacatccttttcatgtctt

SEQ ID NO: 362769 - DNA, 25 bp, Rattus norvegicus
gatccttacatcgttttcatgtctt

SEQ ID NO: 362770 - DNA, 25 bp, Rattus norvegicus
gatccttactggcagccatttgttt

SEQ ID NO: 362771 - DNA, 25 bp, Rattus norvegicus
gatccttactgggagccatttgttt

SEQ ID NO: 362772 - DNA, 25 bp, Rattus norvegicus
gatccttaggcaaattcagggtgaa

SEQ ID NO: 362773 - DNA, 25 bp, Rattus norvegicus
gatccttaggcatattcagggtgaa

SEQ ID NO: 362774 - DNA, 25 bp, Rattus norvegicus
gatccttattcgattcagtgactat

SEQ ID NO: 362775 - DNA, 25 bp, Rattus norvegicus
gatccttattcgtttcagtgactat

SEQ ID NO: 362776 - DNA, 25 bp, Rattus norvegicus
gatccttcaaagatgttcgccttcc

SEQ ID NO: 362777 - DNA, 25 bp, Rattus norvegicus
gatccttcaaagttgttcgccttcc

SEQ ID NO: 362778 - DNA, 25 bp, Rattus norvegicus
gatccttccagtctcatttgaatac

SEQ ID NO: 362779 - DNA, 25 bp, Rattus norvegicus
gatccttccagtgtcatttgaatac

SEQ ID NO: 362780 - DNA, 25 bp, Rattus norvegicus
gatccttccctcatgttaatgtcga

SEQ ID NO: 362781 - DNA, 25 bp, Rattus norvegicus
gatccttccctcttgttaatgtcga

SEQ ID NO: 362782 - DNA, 25 bp, Rattus norvegicus
gatccttccgaaacaatccagatgg

SEQ ID NO: 362783 - DNA, 25 bp, Rattus norvegicus
gatccttccgaatcaatccagatgg

SEQ ID NO: 362784 - DNA, 25 bp, Rattus norvegicus
gatccttcctgcctggcaaagtgat

SEQ ID NO: 362785 - DNA, 25 bp, Rattus norvegicus
gatccttcctgcgtggcaaagtgat

SEQ ID NO: 362786 - DNA, 25 bp, Rattus norvegicus
gatccttccttacccgtatggcatt

SEQ ID NO: 362787 - DNA, 25 bp, Rattus norvegicus
gatccttccttagccgtatggcatt

SEQ ID NO: 362788 - DNA, 25 bp, Rattus norvegicus
gatccttccttgctcatgaggtcaa

SEQ ID NO: 362789 - DNA, 25 bp, Rattus norvegicus
gatccttccttggtcatgaggtcaa

SEQ ID NO: 362790 - DNA, 25 bp, Rattus norvegicus
gatccttcggaacgaccaacagcgt

SEQ ID NO: 362791 - DNA, 25 bp, Rattus norvegicus
gatccttcggaaggaccaacagcgt

SEQ ID NO: 362792 - DNA, 25 bp, Rattus norvegicus
gatccttctaacacattctaattct

SEQ ID NO: 362793 - DNA, 25 bp, Rattus norvegicus
gatccttctaactcattctaattct

SEQ ID NO: 362794 - DNA, 25 bp, Rattus norvegicus
gatccttctacacgtcaatctgaga

SEQ ID NO: 362795 - DNA, 25 bp, Rattus norvegicus
gatccttctacaggtcaatctgaga

SEQ ID NO: 362796 - DNA, 25 bp, Rattus norvegicus
gatccttctcacaacatgatcctgt

SEQ ID NO: 362797 - DNA, 25 bp, Rattus norvegicus
gatccttctcactacatgatcctgt

SEQ ID NO: 362798 - DNA, 25 bp, Rattus norvegicus
gatccttctgaaattaaattacagg

SEQ ID NO: 362799 - DNA, 25 bp, Rattus norvegicus
gatccttctgaatttaaattacagg

SEQ ID NO: 362800 - DNA, 25 bp, Rattus norvegicus
gatccttctgtgaacggtttccgga

SEQ ID NO: 362801 - DNA, 25 bp, Rattus norvegicus
gatccttctgtgtacggtttccgga

SEQ ID NO: 362802 - DNA, 25 bp, Rattus norvegicus
gatccttcttcgaaagttctgccag

SEQ ID NO: 362803 - DNA, 25 bp, Rattus norvegicus
gatccttcttcgtaagttctgccag

SEQ ID NO: 362804 - DNA, 25 bp, Rattus norvegicus
gatccttgaattagcagaccgcctg

SEQ ID NO: 362805 - DNA, 25 bp, Rattus norvegicus
gatccttgaatttgcagaccgcctg

SEQ ID NO: 362806 - DNA, 25 bp, Rattus norvegicus
gatccttgactcatcccattagcta

SEQ ID NO: 362807 - DNA, 25 bp, Rattus norvegicus
gatccttgactcttcccattagcta

SEQ ID NO: 362808 - DNA, 25 bp, Rattus norvegicus
gatccttgggacctgtctgcgagtc

SEQ ID NO: 362809 - DNA, 25 bp, Rattus norvegicus
gatccttgggacgtgtctgcgagtc

SEQ ID NO: 362810 - DNA, 25 bp, Rattus norvegicus
gatccttgggttattgtcatcctta

SEQ ID NO: 362811 - DNA, 25 bp, Rattus norvegicus
gatccttgggtttttgtcatcctta

SEQ ID NO: 362812 - DNA, 25 bp, Rattus norvegicus
gatccttgtaagaatgagtcctcca

SEQ ID NO: 362813 - DNA, 25 bp, Rattus norvegicus
gatccttgtaagtatgagtcctcca

SEQ ID NO: 362814 - DNA, 25 bp, Rattus norvegicus
gatccttgtacaacttctgcggaag

SEQ ID NO: 362815 - DNA, 25 bp, Rattus norvegicus
gatccttgtacatcttctgcggaag

SEQ ID NO: 362816 - DNA, 25 bp, Rattus norvegicus
gatccttgtcatattactgcctttt

SEQ ID NO: 362817 - DNA, 25 bp, Rattus norvegicus
gatccttgtcattttactgcctttt

SEQ ID NO: 362818 - DNA, 25 bp, Rattus norvegicus
gatcctttaagccatttcatgcaga

SEQ ID NO: 362819 - DNA, 25 bp, Rattus norvegicus
gatcctttaagcgatttcatgcaga

SEQ ID NO: 362820 - DNA, 25 bp, Rattus norvegicus
gatcctttccttacaacacgcgggt

SEQ ID NO: 362821 - DNA, 25 bp, Rattus norvegicus
gatcctttcctttcaacacgcgggt

SEQ ID NO: 362822 - DNA, 25 bp, Rattus norvegicus
gatcctttcgacaggacagtccagt

SEQ ID NO: 362823 - DNA, 25 bp, Rattus norvegicus
gatcctttcgactggacagtccagt

SEQ ID NO: 362824 - DNA, 25 bp, Rattus norvegicus
gatcctttgatgacggccacagtga

SEQ ID NO: 362825 - DNA, 25 bp, Rattus norvegicus
gatcctttgatgacttatcgcttcc

SEQ ID NO: 362826 - DNA, 25 bp, Rattus norvegicus
gatcctttgatgtcggccacagtga

SEQ ID NO: 362827 - DNA, 25 bp, Rattus norvegicus
gatcctttgatgtcttatcgcttcc

SEQ ID NO: 362828 - DNA, 25 bp, Rattus norvegicus
gatcctttgcagcactgggtatcca

SEQ ID NO: 362829 - DNA, 25 bp, Rattus norvegicus
gatcctttgcaggactgggtatcca

SEQ ID NO: 362830 - DNA, 25 bp, Rattus norvegicus
gatcctttgctaatcactctataat

SEQ ID NO: 362831 - DNA, 25 bp, Rattus norvegicus
gatcctttgctattcactctataat

SEQ ID NO: 362832 - DNA, 25 bp, Rattus norvegicus
gatcctttggagaatgcactgtcat

SEQ ID NO: 362833 - DNA, 25 bp, Rattus norvegicus
gatcctttggagtatgcactgtcat

SEQ ID NO: 362834 - DNA, 25 bp, Rattus norvegicus
gatcctttggcaagttatgagctta

SEQ ID NO: 362835 - DNA, 25 bp, Rattus norvegicus
gatcctttggcatgttatgagctta

SEQ ID NO: 362836 - DNA, 25 bp, Rattus norvegicus
gatcctttggctactgcatgcacat

SEQ ID NO: 362837 - DNA, 25 bp, Rattus norvegicus
gatcctttggcttctgcatgcacat

SEQ ID NO: 362838 - DNA, 25 bp, Rattus norvegicus
gatcctttgtggagttgaccagccc

SEQ ID NO: 362839 - DNA, 25 bp, Rattus norvegicus
gatcctttgtggtgttgaccagccc

SEQ ID NO: 362840 - DNA, 25 bp, Rattus norvegicus
gatcctttgttgctcactcagtgtc

SEQ ID NO: 362841 - DNA, 25 bp, Rattus norvegicus
gatcctttgttggtcactcagtgtc

SEQ ID NO: 362842 - DNA, 25 bp, Rattus norvegicus
gatccttttatcaatgtcgcacagt

SEQ ID NO: 362843 - DNA, 25 bp, Rattus norvegicus
gatccttttatctatgtcgcacagt

SEQ ID NO: 362844 - DNA, 25 bp, Rattus norvegicus
gatccttttcaaaactcgccccaag

SEQ ID NO: 362845 - DNA, 25 bp, Rattus norvegicus
gatccttttcaatactcgccccaag

SEQ ID NO: 362846 - DNA, 25 bp, Rattus norvegicus
gatccttttctgaagtggatgtgat

SEQ ID NO: 362847 - DNA, 25 bp, Rattus norvegicus
gatccttttctgtagtggatgtgat

SEQ ID NO: 362848 - DNA, 25 bp, Rattus norvegicus
gatccttttttacctgcgagcgatt

SEQ ID NO: 362849 - DNA, 25 bp, Rattus norvegicus
gatccttttttagctgcgagcgatt

SEQ ID NO: 362850 - DNA, 25 bp, Rattus norvegicus
gatcgaaaacacaactcagcgcttc

SEQ ID NO: 362851 - DNA, 25 bp, Rattus norvegicus
gatcgaaaacactactcagcgcttc

SEQ ID NO: 362852 - DNA, 25 bp, Rattus norvegicus
gatcgaaatgtcctagtgctaactc

SEQ ID NO: 362853 - DNA, 25 bp, Rattus norvegicus
gatcgaaatgtcgtagtgctaactc

SEQ ID NO: 362854 - DNA, 25 bp, Rattus norvegicus
gatcgaactctaagactgccagcag

SEQ ID NO: 362855 - DNA, 25 bp, Rattus norvegicus
gatcgaactctatgactgccagcag

SEQ ID NO: 362856 - DNA, 25 bp, Rattus norvegicus
gatcgaagtctcacacgccctggga

SEQ ID NO: 362857 - DNA, 25 bp, Rattus norvegicus
gatcgaagtctctcacgccctggga

SEQ ID NO: 362858 - DNA, 25 bp, Rattus norvegicus
gatcgaagtgaccatcctgaagcct

SEQ ID NO: 362859 - DNA, 25 bp, Rattus norvegicus
gatcgaagtgacgatcctgaagcct

SEQ ID NO: 362860 - DNA, 25 bp, Rattus norvegicus
gatcgaataagccttcaagcaccct

SEQ ID NO: 362861 - DNA, 25 bp, Rattus norvegicus
gatcgaataagcgttcaagcaccct

SEQ ID NO: 362862 - DNA, 25 bp, Rattus norvegicus
gatcgacaagatatgccatggattt

SEQ ID NO: 362863 - DNA, 25 bp, Rattus norvegicus
gatcgacaagatttgccatggattt

SEQ ID NO: 362864 - DNA, 25 bp, Rattus norvegicus
gatcgacaagcaagccaaagaccct

SEQ ID NO: 362865 - DNA, 25 bp, Rattus norvegicus
gatcgacaagcatgccaaagaccct

SEQ ID NO: 362866 - DNA, 25 bp, Rattus norvegicus
gatcgacaaggccagcgagactctg

SEQ ID NO: 362867 - DNA, 25 bp, Rattus norvegicus
gatcgacaaggcgagcgagactctg

SEQ ID NO: 362868 - DNA, 25 bp, Rattus norvegicus
gatcgacaaggtctgcttcatgtgg

SEQ ID NO: 362869 - DNA, 25 bp, Rattus norvegicus
gatcgacaaggtgtgcttcatgtgg

SEQ ID NO: 362870 - DNA, 25 bp, Rattus norvegicus
gatcgacacagcacagcgactctta

SEQ ID NO: 362871 - DNA, 25 bp, Rattus norvegicus
gatcgacacagctcagcgactctta

SEQ ID NO: 362872 - DNA, 25 bp, Rattus norvegicus
gatcgacaccgaaccagagatgatg

SEQ ID NO: 362873 - DNA, 25 bp, Rattus norvegicus
gatcgacaccgatccagagatgatg

SEQ ID NO: 362874 - DNA, 25 bp, Rattus norvegicus
gatcgacagactcttcaactacatg

SEQ ID NO: 362875 - DNA, 25 bp, Rattus norvegicus
gatcgacagactgttcaactacatg

SEQ ID NO: 362876 - DNA, 25 bp, Rattus norvegicus
gatcgacataacagggcacagctcc

SEQ ID NO: 362877 - DNA, 25 bp, Rattus norvegicus
gatcgacataactgggcacagctcc

SEQ ID NO: 362878 - DNA, 25 bp, Rattus norvegicus
gatcgacatgaaccgagccctgatg

SEQ ID NO: 362879 - DNA, 25 bp, Rattus norvegicus
gatcgacatgaagcgagccctgatg

SEQ ID NO: 362880 - DNA, 25 bp, Rattus norvegicus
gatcgacatgaccaccttcaacaag

SEQ ID NO: 362881 - DNA, 25 bp, Rattus norvegicus
gatcgacatgacgaccttcaacaag

SEQ ID NO: 362882 - DNA, 25 bp, Rattus norvegicus
gatcgacctcaccaagagctactat

SEQ ID NO: 362883 - DNA, 25 bp, Rattus norvegicus
gatcgacctcacgaagagctactat

SEQ ID NO: 362884 - DNA, 25 bp, Rattus norvegicus
gatcgacgaaagagttcacgccctg

SEQ ID NO: 362885 - DNA, 25 bp, Rattus norvegicus
gatcgacgaaagtgttcacgccctg

SEQ ID NO: 362886 - DNA, 25 bp, Rattus norvegicus
gatcgacggacaatggatgcactat

SEQ ID NO: 362887 - DNA, 25 bp, Rattus norvegicus
gatcgacggacattggatgcactat

SEQ ID NO: 362888 - DNA, 25 bp, Rattus norvegicus
gatcgactggaaatgtagcgcttac

SEQ ID NO: 362889 - DNA, 25 bp, Rattus norvegicus
gatcgactggaattgtagcgcttac

SEQ ID NO: 362890 - DNA, 25 bp, Rattus norvegicus
gatcgactttcgctgtccccaggac

SEQ ID NO: 362891 - DNA, 25 bp, Rattus norvegicus
gatcgactttcggtgtccccaggac

SEQ ID NO: 362892 - DNA, 25 bp, Rattus norvegicus
gatcgagaacctcgagtgtgacccc

SEQ ID NO: 362893 - DNA, 25 bp, Rattus norvegicus
gatcgagaacctggagtgtgacccc

SEQ ID NO: 362894 - DNA, 25 bp, Rattus norvegicus
gatcgagaatgtcaccgctgtgcct

SEQ ID NO: 362895 - DNA, 25 bp, Rattus norvegicus
gatcgagaatgtgaccgctgtgcct

SEQ ID NO: 362896 - DNA, 25 bp, Rattus norvegicus
gatcgagaccatatgtggcctataa

SEQ ID NO: 362897 - DNA, 25 bp, Rattus norvegicus
gatcgagaccatttgtggcctataa

SEQ ID NO: 362898 - DNA, 25 bp, Rattus norvegicus
gatcgagaccccaataacttgctca

SEQ ID NO: 362899 - DNA, 25 bp, Rattus norvegicus
gatcgagacccctataacttgctca

SEQ ID NO: 362900 - DNA, 25 bp, Rattus norvegicus
gatcgagagccgcagcctgctaacc

SEQ ID NO: 362901 - DNA, 25 bp, Rattus norvegicus
gatcgagagccggagcctgctaacc

SEQ ID NO: 362902 - DNA, 25 bp, Rattus norvegicus
gatcgagagctcatccttggtggta

SEQ ID NO: 362903 - DNA, 25 bp, Rattus norvegicus
gatcgagagctcttccttggtggta

SEQ ID NO: 362904 - DNA, 25 bp, Rattus norvegicus
gatcgagatccacttcagaagcagc

SEQ ID NO: 362905 - DNA, 25 bp, Rattus norvegicus
gatcgagatccagttcagaagcagc

SEQ ID NO: 362906 - DNA, 25 bp, Rattus norvegicus
gatcgagatcctagagcatcagtgg

SEQ ID NO: 362907 - DNA, 25 bp, Rattus norvegicus
gatcgagatccttgagcatcagtgg

SEQ ID NO: 362908 - DNA, 25 bp, Rattus norvegicus
gatcgagcccttatgaagtctaact

SEQ ID NO: 362909 - DNA, 25 bp, Rattus norvegicus
gatcgagcccttttgaagtctaact

SEQ ID NO: 362910 - DNA, 25 bp, Rattus norvegicus
gatcgagcctgaataaacgtccttt

SEQ ID NO: 362911 - DNA, 25 bp, Rattus norvegicus
gatcgagcctgattaaacgtccttt

SEQ ID NO: 362912 - DNA, 25 bp, Rattus norvegicus
gatcgaggaaaccaagcctgccaag

SEQ ID NO: 362913 - DNA, 25 bp, Rattus norvegicus
gatcgaggaaacgaagcctgccaag

SEQ ID NO: 362914 - DNA, 25 bp, Rattus norvegicus
gatcgaggaaccatctctgacacat

SEQ ID NO: 362915 - DNA, 25 bp, Rattus norvegicus
gatcgaggaaccttctctgacacat

SEQ ID NO: 362916 - DNA, 25 bp, Rattus norvegicus
gatcgaggagtgcatcttcctggat

SEQ ID NO: 362917 - DNA, 25 bp, Rattus norvegicus
gatcgaggagtggatcttcctggat

SEQ ID NO: 362918 - DNA, 25 bp, Rattus norvegicus
gatcgaggcccacgtgtggaaacct

SEQ ID NO: 362919 - DNA, 25 bp, Rattus norvegicus
gatcgaggcccaggtgtggaaacct

SEQ ID NO: 362920 - DNA, 25 bp, Rattus norvegicus
gatcgaggcctgaaaccaaacttta

SEQ ID NO: 362921 - DNA, 25 bp, Rattus norvegicus
gatcgaggcctgtaaccaaacttta

SEQ ID NO: 362922 - DNA, 25 bp, Rattus norvegicus
gatcgaggtcctctgcaaaggctac

SEQ ID NO: 362923 - DNA, 25 bp, Rattus norvegicus
gatcgaggtcctgtgcaaaggctac

SEQ ID NO: 362924 - DNA, 25 bp, Rattus norvegicus
gatcgagtctgaaaaggccgactta

SEQ ID NO: 362925 - DNA, 25 bp, Rattus norvegicus
gatcgagtctgataaggccgactta

SEQ ID NO: 362926 - DNA, 25 bp, Rattus norvegicus
gatcgagtggtcacaaactcctctg

SEQ ID NO: 362927 - DNA, 25 bp, Rattus norvegicus
gatcgagtggtctcaaactcctctg

SEQ ID NO: 362928 - DNA, 25 bp, Rattus norvegicus
gatcgagtttagatcatagcacccg

SEQ ID NO: 362929 - DNA, 25 bp, Rattus norvegicus
gatcgagtttagttcatagcacccg

SEQ ID NO: 362930 - DNA, 25 bp, Rattus norvegicus
gatcgataatgcattctttggctac

SEQ ID NO: 362931 - DNA, 25 bp, Rattus norvegicus
gatcgataatgctttctttggctac

SEQ ID NO: 362932 - DNA, 25 bp, Rattus norvegicus
gatcgatcacacaactgcttagaaa

SEQ ID NO: 362933 - DNA, 25 bp, Rattus norvegicus
gatcgatcacactactgcttagaaa

SEQ ID NO: 362934 - DNA, 25 bp, Rattus norvegicus
gatcgatccatcaggtgtttcatat

SEQ ID NO: 362935 - DNA, 25 bp, Rattus norvegicus
gatcgatccatctggtgtttcatat

SEQ ID NO: 362936 - DNA, 25 bp, Rattus norvegicus
gatcgatcgctacagattcccaaag

SEQ ID NO: 362937 - DNA, 25 bp, Rattus norvegicus
gatcgatcgctagagattcccaaag

SEQ ID NO: 362938 - DNA, 25 bp, Rattus norvegicus
gatcgatcgtttatataaccacggg

SEQ ID NO: 362939 - DNA, 25 bp, Rattus norvegicus
gatcgatcgtttttataaccacggg

SEQ ID NO: 362940 - DNA, 25 bp, Rattus norvegicus
gatcgatcttttcagtatgccagct

SEQ ID NO: 362941 - DNA, 25 bp, Rattus norvegicus
gatcgatcttttgagtatgccagct

SEQ ID NO: 362942 - DNA, 25 bp, Rattus norvegicus
gatcgatgcagccatttctttaaag

SEQ ID NO: 362943 - DNA, 25 bp, Rattus norvegicus
gatcgatgcagcgatttctttaaag

SEQ ID NO: 362944 - DNA, 25 bp, Rattus norvegicus
gatcgatggatcatgtcagccacag

SEQ ID NO: 362945 - DNA, 25 bp, Rattus norvegicus
gatcgatggatcttgtcagccacag

SEQ ID NO: 362946 - DNA, 25 bp, Rattus norvegicus
gatcgattatataagcctttgcatg

SEQ ID NO: 362947 - DNA, 25 bp, Rattus norvegicus
gatcgattatattagcctttgcatg

SEQ ID NO: 362948 - DNA, 25 bp, Rattus norvegicus
gatcgattatctaatttggccgtgg

SEQ ID NO: 362949 - DNA, 25 bp, Rattus norvegicus
gatcgattatcttatttggccgtgg

SEQ ID NO: 362950 - DNA, 25 bp, Rattus norvegicus
gatcgattccttatcctaaatatgg

SEQ ID NO: 362951 - DNA, 25 bp, Rattus norvegicus
gatcgattccttttcctaaatatgg

SEQ ID NO: 362952 - DNA, 25 bp, Rattus norvegicus
gatcgatttgtcctgattccggtac

SEQ ID NO: 362953 - DNA, 25 bp, Rattus norvegicus
gatcgatttgtcgtgattccggtac

SEQ ID NO: 362954 - DNA, 25 bp, Rattus norvegicus
gatcgcaaaagcattgtaaatcacg

SEQ ID NO: 362955 - DNA, 25 bp, Rattus norvegicus
gatcgcaaaagctttgtaaatcacg

SEQ ID NO: 362956 - DNA, 25 bp, Rattus norvegicus
gatcgcaaacagacttactcttcaa

SEQ ID NO: 362957 - DNA, 25 bp, Rattus norvegicus
gatcgcaaacagtcttactcttcaa

SEQ ID NO: 362958 - DNA, 25 bp, Rattus norvegicus
gatcgcaagtccaacagctggaaac

SEQ ID NO: 362959 - DNA, 25 bp, Rattus norvegicus
gatcgcaagtcctacagctggaaac

SEQ ID NO: 362960 - DNA, 25 bp, Rattus norvegicus
gatcgcacaaaacaagcaatccggc

SEQ ID NO: 362961 - DNA, 25 bp, Rattus norvegicus
gatcgcacaaaagaagcaatccggc

SEQ ID NO: 362962 - DNA, 25 bp, Rattus norvegicus
gatcgcacggatactgatatctgct

SEQ ID NO: 362963 - DNA, 25 bp, Rattus norvegicus
gatcgcacggattctgatatctgct

SEQ ID NO: 362964 - DNA, 25 bp, Rattus norvegicus
gatcgcagctttaatatcttatgaa

SEQ ID NO: 362965 - DNA, 25 bp, Rattus norvegicus
gatcgcagcttttatatcttatgaa

SEQ ID NO: 362966 - DNA, 25 bp, Rattus norvegicus
gatcgcagtgctatcaacatttcaa

SEQ ID NO: 362967 - DNA, 25 bp, Rattus norvegicus
gatcgcagtgctttcaacatttcaa

SEQ ID NO: 362968 - DNA, 25 bp, Rattus norvegicus
gatcgcatattaagctgtcaaccct

SEQ ID NO: 362969 - DNA, 25 bp, Rattus norvegicus
gatcgcatattatgctgtcaaccct

SEQ ID NO: 362970 - DNA, 25 bp, Rattus norvegicus
gatcgcatcacacatacataatttt

SEQ ID NO: 362971 - DNA, 25 bp, Rattus norvegicus
gatcgcatcacagatacataatttt

SEQ ID NO: 362972 - DNA, 25 bp, Rattus norvegicus
gatcgcatctgacacagcagcttac

SEQ ID NO: 362973 - DNA, 25 bp, Rattus norvegicus
gatcgcatctgagacagcagcttac

SEQ ID NO: 362974 - DNA, 25 bp, Rattus norvegicus
gatcgcatcttcagaattctttgag

SEQ ID NO: 362975 - DNA, 25 bp, Rattus norvegicus
gatcgcatcttctgaattctttgag

SEQ ID NO: 362976 - DNA, 25 bp, Rattus norvegicus
gatcgcatcttgctcaacagccagt

SEQ ID NO: 362977 - DNA, 25 bp, Rattus norvegicus
gatcgcatcttggtcaacagccagt

SEQ ID NO: 362978 - DNA, 25 bp, Rattus norvegicus
gatcgcatgagcagtcacagttgac

SEQ ID NO: 362979 - DNA, 25 bp, Rattus norvegicus
gatcgcatgagctgtcacagttgac

SEQ ID NO: 362980 - DNA, 25 bp, Rattus norvegicus
gatcgcattcgaagaccgcacagat

SEQ ID NO: 362981 - DNA, 25 bp, Rattus norvegicus
gatcgcattcgatgaccgcacagat

SEQ ID NO: 362982 - DNA, 25 bp, Rattus norvegicus
gatcgccacatgaacagaccatagt

SEQ ID NO: 362983 - DNA, 25 bp, Rattus norvegicus
gatcgccacatgtacagaccatagt

SEQ ID NO: 362984 - DNA, 25 bp, Rattus norvegicus
gatcgccagcagcagcggcataaaa

SEQ ID NO: 362985 - DNA, 25 bp, Rattus norvegicus
gatcgccagcaggagcggcataaaa

SEQ ID NO: 362986 - DNA, 25 bp, Rattus norvegicus
gatcgccaggcgatttctgagcata

SEQ ID NO: 362987 - DNA, 25 bp, Rattus norvegicus
gatcgccaggcgttttctgagcata

SEQ ID NO: 362988 - DNA, 25 bp, Rattus norvegicus
gatcgccctcaacggtggcaagaag

SEQ ID NO: 362989 - DNA, 25 bp, Rattus norvegicus
gatcgccctcaagggtggcaagaag

SEQ ID NO: 362990 - DNA, 25 bp, Rattus norvegicus
gatcgccgtgggaatgaacattacc

SEQ ID NO: 362991 - DNA, 25 bp, Rattus norvegicus
gatcgccgtgggtatgaacattacc

SEQ ID NO: 362992 - DNA, 25 bp, Rattus norvegicus
gatcgcctaaggaaccattttaaag

SEQ ID NO: 362993 - DNA, 25 bp, Rattus norvegicus
gatcgcctaaggtaccattttaaag

SEQ ID NO: 362994 - DNA, 25 bp, Rattus norvegicus
gatcgcctatttaaagacactaccg

SEQ ID NO: 362995 - DNA, 25 bp, Rattus norvegicus
gatcgcctattttaagacactaccg

SEQ ID NO: 362996 - DNA, 25 bp, Rattus norvegicus
gatcgcctcattcgtctgtgggact

SEQ ID NO: 362997 - DNA, 25 bp, Rattus norvegicus
gatcgcctcattggtctgtgggact

SEQ ID NO: 362998 - DNA, 25 bp, Rattus norvegicus
gatcgcctgcgaatgtttagcattc

SEQ ID NO: 362999 - DNA, 25 bp, Rattus norvegicus
gatcgcctgcgattgtttagcattc

SEQ ID NO: 363000 - DNA, 25 bp, Rattus norvegicus
gatcgcctggcgaacagtgaagcaa

SEQ ID NO: 363001 - DNA, 25 bp, Rattus norvegicus
gatcgcctggcgtacagtgaagcaa

SEQ ID NO: 363002 - DNA, 25 bp, Rattus norvegicus
gatcgcctttgaaacgcacataaag

SEQ ID NO: 363003 - DNA, 25 bp, Rattus norvegicus
gatcgcctttgatacgcacataaag

SEQ ID NO: 363004 - DNA, 25 bp, Rattus norvegicus
gatcgcgactgaattcttaagactg

SEQ ID NO: 363005 - DNA, 25 bp, Rattus norvegicus
gatcgcgactgatttcttaagactg

SEQ ID NO: 363006 - DNA, 25 bp, Rattus norvegicus
gatcgcgacttcagtgtatggagcc

SEQ ID NO: 363007 - DNA, 25 bp, Rattus norvegicus
gatcgcgacttctgtgtatggagcc

SEQ ID NO: 363008 - DNA, 25 bp, Rattus norvegicus
gatcgcgatgacacagggaaggcca

SEQ ID NO: 363009 - DNA, 25 bp, Rattus norvegicus
gatcgcgatgactcagggaaggcca

SEQ ID NO: 363010 - DNA, 25 bp, Rattus norvegicus
gatcgcggagctaacaaaggtgttt

SEQ ID NO: 363011 - DNA, 25 bp, Rattus norvegicus
gatcgcggagcttacaaaggtgttt

SEQ ID NO: 363012 - DNA, 25 bp, Rattus norvegicus
gatcgcggccagagccgccattgtt

SEQ ID NO: 363013 - DNA, 25 bp, Rattus norvegicus
gatcgcggccagtgccgccattgtt

SEQ ID NO: 363014 - DNA, 25 bp, Rattus norvegicus
gatcgctccaccaaggttttggact

SEQ ID NO: 363015 - DNA, 25 bp, Rattus norvegicus
gatcgctccacctaggttttggact

SEQ ID NO: 363016 - DNA, 25 bp, Rattus norvegicus
gatcgctcctcactgaatggtccaa

SEQ ID NO: 363017 - DNA, 25 bp, Rattus norvegicus
gatcgctcctcagtgaatggtccaa

SEQ ID NO: 363018 - DNA, 25 bp, Rattus norvegicus
gatcgctctggacaatgccagtcca

SEQ ID NO: 363019 - DNA, 25 bp, Rattus norvegicus
gatcgctctggagaatgccagtcca

SEQ ID NO: 363020 - DNA, 25 bp, Rattus norvegicus
gatcgctcttgtagtcctaggactt

SEQ ID NO: 363021 - DNA, 25 bp, Rattus norvegicus
gatcgctcttgttgtcctaggactt

SEQ ID NO: 363022 - DNA, 25 bp, Rattus norvegicus
gatcgctgctctactctgtgaattg

SEQ ID NO: 363023 - DNA, 25 bp, Rattus norvegicus
gatcgctgctcttctctgtgaattg

SEQ ID NO: 363024 - DNA, 25 bp, Rattus norvegicus
gatcgctggaatccccaatactgta

SEQ ID NO: 363025 - DNA, 25 bp, Rattus norvegicus
gatcgctggaatgcccaatactgta

SEQ ID NO: 363026 - DNA, 25 bp, Rattus norvegicus
gatcgctgtcggctctactaaggaa

SEQ ID NO: 363027 - DNA, 25 bp, Rattus norvegicus
gatcgctgtcgggtctactaaggaa

SEQ ID NO: 363028 - DNA, 25 bp, Rattus norvegicus
gatcgctgtgcccattctgatgcat

SEQ ID NO: 363029 - DNA, 25 bp, Rattus norvegicus
gatcgctgtgccgattctgatgcat

SEQ ID NO: 363030 - DNA, 25 bp, Rattus norvegicus
gatcgctgtggtacttattatcaaa

SEQ ID NO: 363031 - DNA, 25 bp, Rattus norvegicus
gatcgctgtggttcttattatcaaa

SEQ ID NO: 363032 - DNA, 25 bp, Rattus norvegicus
gatcgctgttacctgttgtcatttt

SEQ ID NO: 363033 - DNA, 25 bp, Rattus norvegicus
gatcgctgttacgtgttgtcatttt

SEQ ID NO: 363034 - DNA, 25 bp, Rattus norvegicus
gatcgcttagaacagaggcctagtt

SEQ ID NO: 363035 - DNA, 25 bp, Rattus norvegicus
gatcgcttagaagagaggcctagtt

SEQ ID NO: 363036 - DNA, 25 bp, Rattus norvegicus
gatcgcttctacctgggccagtggc

SEQ ID NO: 363037 - DNA, 25 bp, Rattus norvegicus
gatcgcttctacgtgggccagtggc

SEQ ID NO: 363038 - DNA, 25 bp, Rattus norvegicus
gatcgcttttctatgtttactctta

SEQ ID NO: 363039 - DNA, 25 bp, Rattus norvegicus
gatcgcttttctttgtttactctta

SEQ ID NO: 363040 - DNA, 25 bp, Rattus norvegicus
gatcggaataataccttcacctgcc

SEQ ID NO: 363041 - DNA, 25 bp, Rattus norvegicus
gatcggaataattccttcacctgcc

SEQ ID NO: 363042 - DNA, 25 bp, Rattus norvegicus
gatcggactgtcagactgggcaaag

SEQ ID NO: 363043 - DNA, 25 bp, Rattus norvegicus
gatcggactgtctgactgggcaaag

SEQ ID NO: 363044 - DNA, 25 bp, Rattus norvegicus
gatcggagctagctgcttctattta

SEQ ID NO: 363045 - DNA, 25 bp, Rattus norvegicus
gatcggagctaggtgcttctattta

SEQ ID NO: 363046 - DNA, 25 bp, Rattus norvegicus
gatcggaggacaacttctttacagt

SEQ ID NO: 363047 - DNA, 25 bp, Rattus norvegicus
gatcggaggacatcttctttacagt

SEQ ID NO: 363048 - DNA, 25 bp, Rattus norvegicus
gatcggatcttaccatggtcttctt

SEQ ID NO: 363049 - DNA, 25 bp, Rattus norvegicus
gatcggatcttagcatggtcttctt

SEQ ID NO: 363050 - DNA, 25 bp, Rattus norvegicus
gatcggattcagcttttcaggcttg

SEQ ID NO: 363051 - DNA, 25 bp, Rattus norvegicus
gatcggattcaggttttcaggcttg

SEQ ID NO: 363052 - DNA, 25 bp, Rattus norvegicus
gatcggcaacatagggtctgactcc

SEQ ID NO: 363053 - DNA, 25 bp, Rattus norvegicus
gatcggcaacattgggtctgactcc

SEQ ID NO: 363054 - DNA, 25 bp, Rattus norvegicus
gatcggcaccgaacatccggtgaaa

SEQ ID NO: 363055 - DNA, 25 bp, Rattus norvegicus
gatcggcaccgatcatccggtgaaa

SEQ ID NO: 363056 - DNA, 25 bp, Rattus norvegicus
gatcggcacgtgacaccatcacgag

SEQ ID NO: 363057 - DNA, 25 bp, Rattus norvegicus
gatcggcacgtgtcaccatcacgag

SEQ ID NO: 363058 - DNA, 25 bp, Rattus norvegicus
gatcgggaagtcatatacaccattt

SEQ ID NO: 363059 - DNA, 25 bp, Rattus norvegicus
gatcgggaagtcttatacaccattt

SEQ ID NO: 363060 - DNA, 25 bp, Rattus norvegicus
gatcgggacagtcagactcatcaaa

SEQ ID NO: 363061 - DNA, 25 bp, Rattus norvegicus
gatcgggacagtgagactcatcaaa

SEQ ID NO: 363062 - DNA, 25 bp, Rattus norvegicus
gatcgggagctcagtgcccttttgt

SEQ ID NO: 363063 - DNA, 25 bp, Rattus norvegicus
gatcgggagctcctatgcggctttc

SEQ ID NO: 363064 - DNA, 25 bp, Rattus norvegicus
gatcgggagctcgtatgcggctttc

SEQ ID NO: 363065 - DNA, 25 bp, Rattus norvegicus
gatcgggagctctgtgcccttttgt

SEQ ID NO: 363066 - DNA, 25 bp, Rattus norvegicus
gatcgggagttcaagcaggccagtt

SEQ ID NO: 363067 - DNA, 25 bp, Rattus norvegicus
gatcgggagttctagcaggccagtt

SEQ ID NO: 363068 - DNA, 25 bp, Rattus norvegicus
gatcgggatgtgaaccctggcccag

SEQ ID NO: 363069 - DNA, 25 bp, Rattus norvegicus
gatcgggatgtgtaccctggcccag

SEQ ID NO: 363070 - DNA, 25 bp, Rattus norvegicus
gatcgggattaacccaacttctgag

SEQ ID NO: 363071 - DNA, 25 bp, Rattus norvegicus
gatcgggattaagccaacttctgag

SEQ ID NO: 363072 - DNA, 25 bp, Rattus norvegicus
gatcgggcttttagcagaattctga

SEQ ID NO: 363073 - DNA, 25 bp, Rattus norvegicus
gatcgggctttttgcagaattctga

SEQ ID NO: 363074 - DNA, 25 bp, Rattus norvegicus
gatcgggtccacactaaccagatga

SEQ ID NO: 363075 - DNA, 25 bp, Rattus norvegicus
gatcgggtccactctaaccagatga

SEQ ID NO: 363076 - DNA, 25 bp, Rattus norvegicus
gatcgggtccccatcctaataatat

SEQ ID NO: 363077 - DNA, 25 bp, Rattus norvegicus
gatcgggtccccttcctaataatat

SEQ ID NO: 363078 - DNA, 25 bp, Rattus norvegicus
gatcgggtgcccaagttaacacatt

SEQ ID NO: 363079 - DNA, 25 bp, Rattus norvegicus
gatcgggtgccctagttaacacatt

SEQ ID NO: 363080 - DNA, 25 bp, Rattus norvegicus
gatcggtaacttacttttgagccaa

SEQ ID NO: 363081 - DNA, 25 bp, Rattus norvegicus
gatcggtaactttcttttgagccaa

SEQ ID NO: 363082 - DNA, 25 bp, Rattus norvegicus
gatcggtacgccagtcttttgccag

SEQ ID NO: 363083 - DNA, 25 bp, Rattus norvegicus
gatcggtacgcctgtcttttgccag

SEQ ID NO: 363084 - DNA, 25 bp, Rattus norvegicus
gatcggtatcagaaatatctccttt

SEQ ID NO: 363085 - DNA, 25 bp, Rattus norvegicus
gatcggtatcagtaatatctccttt

SEQ ID NO: 363086 - DNA, 25 bp, Rattus norvegicus
gatcggtcacttcctaaaggctctt

SEQ ID NO: 363087 - DNA, 25 bp, Rattus norvegicus
gatcggtcacttgctaaaggctctt

SEQ ID NO: 363088 - DNA, 25 bp, Rattus norvegicus
gatcggtcaggtcgtccagcgtttc

SEQ ID NO: 363089 - DNA, 25 bp, Rattus norvegicus
gatcggtcaggtggtccagcgtttc

SEQ ID NO: 363090 - DNA, 25 bp, Rattus norvegicus
gatcggtcggagctaaccgctgcca

SEQ ID NO: 363091 - DNA, 25 bp, Rattus norvegicus
gatcggtcggaggtaaccgctgcca

SEQ ID NO: 363092 - DNA, 25 bp, Rattus norvegicus
gatcggtgagtaacacgcttgccaa

SEQ ID NO: 363093 - DNA, 25 bp, Rattus norvegicus
gatcggtgagtatcacgcttgccaa

SEQ ID NO: 363094 - DNA, 25 bp, Rattus norvegicus
gatcggtgtcttccttttcatgaca

SEQ ID NO: 363095 - DNA, 25 bp, Rattus norvegicus
gatcggtgtcttgcttttcatgaca

SEQ ID NO: 363096 - DNA, 25 bp, Rattus norvegicus
gatcggtgttacatttaccacactg

SEQ ID NO: 363097 - DNA, 25 bp, Rattus norvegicus
gatcggtgttacttttaccacactg

SEQ ID NO: 363098 - DNA, 25 bp, Rattus norvegicus
gatcggttcaacattgccttggtaa

SEQ ID NO: 363099 - DNA, 25 bp, Rattus norvegicus
gatcggttcaactttgccttggtaa

SEQ ID NO: 363100 - DNA, 25 bp, Rattus norvegicus
gatcggttctataatgttgtctaca

SEQ ID NO: 363101 - DNA, 25 bp, Rattus norvegicus
gatcggttctattatgttgtctaca

SEQ ID NO: 363102 - DNA, 25 bp, Rattus norvegicus
gatcggtttatcacatgcagctgga

SEQ ID NO: 363103 - DNA, 25 bp, Rattus norvegicus
gatcggtttatctcatgcagctgga

SEQ ID NO: 363104 - DNA, 25 bp, Rattus norvegicus
gatcgtaaacctagggaactcctct

SEQ ID NO: 363105 - DNA, 25 bp, Rattus norvegicus
gatcgtaaaccttgggaactcctct

SEQ ID NO: 363106 - DNA, 25 bp, Rattus norvegicus
gatcgtaagagtctgtcaatggaaa

SEQ ID NO: 363107 - DNA, 25 bp, Rattus norvegicus
gatcgtaagagtgtgtcaatggaaa

SEQ ID NO: 363108 - DNA, 25 bp, Rattus norvegicus
gatcgtaatcatagccacttgtaaa

SEQ ID NO: 363109 - DNA, 25 bp, Rattus norvegicus
gatcgtaatcattgccacttgtaaa

SEQ ID NO: 363110 - DNA, 25 bp, Rattus norvegicus
gatcgtacctttccatcttgggaaa

SEQ ID NO: 363111 - DNA, 25 bp, Rattus norvegicus
gatcgtacctttgcatcttgggaaa

SEQ ID NO: 363112 - DNA, 25 bp, Rattus norvegicus
gatcgtactggacacaccttcaggt

SEQ ID NO: 363113 - DNA, 25 bp, Rattus norvegicus
gatcgtactggagacaccttcaggt

SEQ ID NO: 363114 - DNA, 25 bp, Rattus norvegicus
gatcgtatttatcgtctctacaaat

SEQ ID NO: 363115 - DNA, 25 bp, Rattus norvegicus
gatcgtatttatggtctctacaaat

SEQ ID NO: 363116 - DNA, 25 bp, Rattus norvegicus
gatcgtcaaagccagtctgtgccaa

SEQ ID NO: 363117 - DNA, 25 bp, Rattus norvegicus
gatcgtcaaagcgagtctgtgccaa

SEQ ID NO: 363118 - DNA, 25 bp, Rattus norvegicus
gatcgtcacaaaagtatgtctcatg

SEQ ID NO: 363119 - DNA, 25 bp, Rattus norvegicus
gatcgtcacaaatgtatgtctcatg

SEQ ID NO: 363120 - DNA, 25 bp, Rattus norvegicus
gatcgtcaggtaacaaagcagtcac

SEQ ID NO: 363121 - DNA, 25 bp, Rattus norvegicus
gatcgtcaggtatcaaagcagtcac

SEQ ID NO: 363122 - DNA, 25 bp, Rattus norvegicus
gatcgtcataatatccaaccttcag

SEQ ID NO: 363123 - DNA, 25 bp, Rattus norvegicus
gatcgtcataatttccaaccttcag

SEQ ID NO: 363124 - DNA, 25 bp, Rattus norvegicus
gatcgtcatttcctttgaaacctcc

SEQ ID NO: 363125 - DNA, 25 bp, Rattus norvegicus
gatcgtcatttcgtttgaaacctcc

SEQ ID NO: 363126 - DNA, 25 bp, Rattus norvegicus
gatcgtcctacaccaggtttggaag

SEQ ID NO: 363127 - DNA, 25 bp, Rattus norvegicus
gatcgtcctacagcaggtttggaag

SEQ ID NO: 363128 - DNA, 25 bp, Rattus norvegicus
gatcgtcctctgagaatgagctgat

SEQ ID NO: 363129 - DNA, 25 bp, Rattus norvegicus
gatcgtcctctgtgaatgagctgat

SEQ ID NO: 363130 - DNA, 25 bp, Rattus norvegicus
gatcgtctagtcaatgccatggaaa

SEQ ID NO: 363131 - DNA, 25 bp, Rattus norvegicus
gatcgtctagtctatgccatggaaa

SEQ ID NO: 363132 - DNA, 25 bp, Rattus norvegicus
gatcgtctctaaaaacagccgccag

SEQ ID NO: 363133 - DNA, 25 bp, Rattus norvegicus
gatcgtctctaataacagccgccag

SEQ ID NO: 363134 - DNA, 25 bp, Rattus norvegicus
gatcgtctctggatagcaattgtct

SEQ ID NO: 363135 - DNA, 25 bp, Rattus norvegicus
gatcgtctctggttagcaattgtct

SEQ ID NO: 363136 - DNA, 25 bp, Rattus norvegicus
gatcgtctgaccaagcaagtgccaa

SEQ ID NO: 363137 - DNA, 25 bp, Rattus norvegicus
gatcgtctgacctagcaagtgccaa

SEQ ID NO: 363138 - DNA, 25 bp, Rattus norvegicus
gatcgtctgcctcttggcagattta

SEQ ID NO: 363139 - DNA, 25 bp, Rattus norvegicus
gatcgtctgcctgttggcagattta

SEQ ID NO: 363140 - DNA, 25 bp, Rattus norvegicus
gatcgtcttaaaactggtctaggaa

SEQ ID NO: 363141 - DNA, 25 bp, Rattus norvegicus
gatcgtcttaaatctggtctaggaa

SEQ ID NO: 363142 - DNA, 25 bp, Rattus norvegicus
gatcgtcttacactattcgccgaaa

SEQ ID NO: 363143 - DNA, 25 bp, Rattus norvegicus
gatcgtcttacagtattcgccgaaa

SEQ ID NO: 363144 - DNA, 25 bp, Rattus norvegicus
gatcgtgaacatactctaatggaca

SEQ ID NO: 363145 - DNA, 25 bp, Rattus norvegicus
gatcgtgaacattctctaatggaca

SEQ ID NO: 363146 - DNA, 25 bp, Rattus norvegicus
gatcgtgaatgaacactttacctgt

SEQ ID NO: 363147 - DNA, 25 bp, Rattus norvegicus
gatcgtgaatgatcactttacctgt

SEQ ID NO: 363148 - DNA, 25 bp, Rattus norvegicus
gatcgtgaatgtctagcaccggctt

SEQ ID NO: 363149 - DNA, 25 bp, Rattus norvegicus
gatcgtgaatgtgtagcaccggctt

SEQ ID NO: 363150 - DNA, 25 bp, Rattus norvegicus
gatcgtgacaccacttgagttgaat

SEQ ID NO: 363151 - DNA, 25 bp, Rattus norvegicus
gatcgtgacacctcttgagttgaat

SEQ ID NO: 363152 - DNA, 25 bp, Rattus norvegicus
gatcgtgacgcacttgaagagtcca

SEQ ID NO: 363153 - DNA, 25 bp, Rattus norvegicus
gatcgtgacgcagttgaagagtcca

SEQ ID NO: 363154 - DNA, 25 bp, Rattus norvegicus
gatcgtgagagtaaagccagcccat

SEQ ID NO: 363155 - DNA, 25 bp, Rattus norvegicus
gatcgtgagagttaagccagcccat

SEQ ID NO: 363156 - DNA, 25 bp, Rattus norvegicus
gatcgtgagcagacccagaaatttt

SEQ ID NO: 363157 - DNA, 25 bp, Rattus norvegicus
gatcgtgagcagtcccagaaatttt

SEQ ID NO: 363158 - DNA, 25 bp, Rattus norvegicus
gatcgtgagctccaaaccaaaaata

SEQ ID NO: 363159 - DNA, 25 bp, Rattus norvegicus
gatcgtgagctcgaaaccaaaaata

SEQ ID NO: 363160 - DNA, 25 bp, Rattus norvegicus
gatcgtgcagtgatttgaagactac

SEQ ID NO: 363161 - DNA, 25 bp, Rattus norvegicus
gatcgtgcagtgttttgaagactac

SEQ ID NO: 363162 - DNA, 25 bp, Rattus norvegicus
gatcgtgcctttacattataactct

SEQ ID NO: 363163 - DNA, 25 bp, Rattus norvegicus
gatcgtgccttttcattataactct

SEQ ID NO: 363164 - DNA, 25 bp, Rattus norvegicus
gatcgtggagccctacattgcatgg

SEQ ID NO: 363165 - DNA, 25 bp, Rattus norvegicus
gatcgtggagccgtacattgcatgg

SEQ ID NO: 363166 - DNA, 25 bp, Rattus norvegicus
gatcgtggcagacataagacccgga

SEQ ID NO: 363167 - DNA, 25 bp, Rattus norvegicus
gatcgtggcagagataagacccgga

SEQ ID NO: 363168 - DNA, 25 bp, Rattus norvegicus
gatcgtggccaaagaaagacataac

SEQ ID NO: 363169 - DNA, 25 bp, Rattus norvegicus
gatcgtggccaatgaaagacataac

SEQ ID NO: 363170 - DNA, 25 bp, Rattus norvegicus
gatcgtgggctgacactggcatcca

SEQ ID NO: 363171 - DNA, 25 bp, Rattus norvegicus
gatcgtgggctgtcactggcatcca

SEQ ID NO: 363172 - DNA, 25 bp, Rattus norvegicus
gatcgtggtggcaaggatctagcct

SEQ ID NO: 363173 - DNA, 25 bp, Rattus norvegicus
gatcgtggtggctaggatctagcct

SEQ ID NO: 363174 - DNA, 25 bp, Rattus norvegicus
gatcgtgtagtaaatccagctgtaa

SEQ ID NO: 363175 - DNA, 25 bp, Rattus norvegicus
gatcgtgtagtatatccagctgtaa

SEQ ID NO: 363176 - DNA, 25 bp, Rattus norvegicus
gatcgtgtcattactgtaaagcgga

SEQ ID NO: 363177 - DNA, 25 bp, Rattus norvegicus
gatcgtgtcatttctgtaaagcgga

SEQ ID NO: 363178 - DNA, 25 bp, Rattus norvegicus
gatcgtgtgttcactgtgccaatat

SEQ ID NO: 363179 - DNA, 25 bp, Rattus norvegicus
gatcgtgtgttctctgtgccaatat

SEQ ID NO: 363180 - DNA, 25 bp, Rattus norvegicus
gatcgtgttccactccttgaggaat

SEQ ID NO: 363181 - DNA, 25 bp, Rattus norvegicus
gatcgtgttccagtccttgaggaat

SEQ ID NO: 363182 - DNA, 25 bp, Rattus norvegicus
gatcgtgtttatatcctgcctggaa

SEQ ID NO: 363183 - DNA, 25 bp, Rattus norvegicus
gatcgtgtttatttcctgcctggaa

SEQ ID NO: 363184 - DNA, 25 bp, Rattus norvegicus
gatcgttaaggacttgtatccctga

SEQ ID NO: 363185 - DNA, 25 bp, Rattus norvegicus
gatcgttaaggagttgtatccctga

SEQ ID NO: 363186 - DNA, 25 bp, Rattus norvegicus
gatcgttacttgattctatgtgcta

SEQ ID NO: 363187 - DNA, 25 bp, Rattus norvegicus
gatcgttacttgtttctatgtgcta

SEQ ID NO: 363188 - DNA, 25 bp, Rattus norvegicus
gatcgttaggttaggctgcaagccc

SEQ ID NO: 363189 - DNA, 25 bp, Rattus norvegicus
gatcgttaggtttggctgcaagccc

SEQ ID NO: 363190 - DNA, 25 bp, Rattus norvegicus
gatcgttatcagagacaacctggct

SEQ ID NO: 363191 - DNA, 25 bp, Rattus norvegicus
gatcgttatcagtgacaacctggct

SEQ ID NO: 363192 - DNA, 25 bp, Rattus norvegicus
gatcgttcgataaagtgtgcattgt

SEQ ID NO: 363193 - DNA, 25 bp, Rattus norvegicus
gatcgttcgatatagtgtgcattgt

SEQ ID NO: 363194 - DNA, 25 bp, Rattus norvegicus
gatcgttcggaacgctgtggacaaa

SEQ ID NO: 363195 - DNA, 25 bp, Rattus norvegicus
gatcgttcggaaggctgtggacaaa

SEQ ID NO: 363196 - DNA, 25 bp, Rattus norvegicus
gatcgttgccaaaactacgtaatgg

SEQ ID NO: 363197 - DNA, 25 bp, Rattus norvegicus
gatcgttgccaatactacgtaatgg

SEQ ID NO: 363198 - DNA, 25 bp, Rattus norvegicus
gatcgttgtcagactagacccagag

SEQ ID NO: 363199 - DNA, 25 bp, Rattus norvegicus
gatcgttgtcagtctagacccagag

SEQ ID NO: 363200 - DNA, 25 bp, Rattus norvegicus
gatcgtttacctatacaccaagaag

SEQ ID NO: 363201 - DNA, 25 bp, Rattus norvegicus
gatcgtttacctttacaccaagaag

SEQ ID NO: 363202 - DNA, 25 bp, Rattus norvegicus
gatcgtttaggtctccagcccattg

SEQ ID NO: 363203 - DNA, 25 bp, Rattus norvegicus
gatcgtttaggtgtccagcccattg

SEQ ID NO: 363204 - DNA, 25 bp, Rattus norvegicus
gatcgtttctctccaagactgtaat

SEQ ID NO: 363205 - DNA, 25 bp, Rattus norvegicus
gatcgtttctctgcaagactgtaat

SEQ ID NO: 363206 - DNA, 25 bp, Rattus norvegicus
gatcgtttgctaccacagggagttc

SEQ ID NO: 363207 - DNA, 25 bp, Rattus norvegicus
gatcgtttgctagcacagggagttc

SEQ ID NO: 363208 - DNA, 25 bp, Rattus norvegicus
gatcgtttgggcaattgtccgcaag

SEQ ID NO: 363209 - DNA, 25 bp, Rattus norvegicus
gatcgtttgggctattgtccgcaag

SEQ ID NO: 363210 - DNA, 25 bp, Rattus norvegicus
gatcgttttcctaccaaacaatgtg

SEQ ID NO: 363211 - DNA, 25 bp, Rattus norvegicus
gatcgttttccttccaaacaatgtg

SEQ ID NO: 363212 - DNA, 25 bp, Rattus norvegicus
gatctaaaatagctcctttgaacag

SEQ ID NO: 363213 - DNA, 25 bp, Rattus norvegicus
gatctaaaataggtcctttgaacag

SEQ ID NO: 363214 - DNA, 25 bp, Rattus norvegicus
gatctaaaccttaccacatctggga

SEQ ID NO: 363215 - DNA, 25 bp, Rattus norvegicus
gatctaaaccttcgagcctgtctgt

SEQ ID NO: 363216 - DNA, 25 bp, Rattus norvegicus
gatctaaaccttggagcctgtctgt

SEQ ID NO: 363217 - DNA, 25 bp, Rattus norvegicus
gatctaaacctttccacatctggga

SEQ ID NO: 363218 - DNA, 25 bp, Rattus norvegicus
gatctaaacttactcacaccccgaa

SEQ ID NO: 363219 - DNA, 25 bp, Rattus norvegicus
gatctaaacttagtcacaccccgaa

SEQ ID NO: 363220 - DNA, 25 bp, Rattus norvegicus
gatctaaatcctactttgtctgctg

SEQ ID NO: 363221 - DNA, 25 bp, Rattus norvegicus
gatctaaatccttctttgtctgctg

SEQ ID NO: 363222 - DNA, 25 bp, Rattus norvegicus
gatctaactcataggaggctagcta

SEQ ID NO: 363223 - DNA, 25 bp, Rattus norvegicus
gatctaactcattggaggctagcta

SEQ ID NO: 363224 - DNA, 25 bp, Rattus norvegicus
gatctaagcactcttagcagacttg

SEQ ID NO: 363225 - DNA, 25 bp, Rattus norvegicus
gatctaagcactgttagcagacttg

SEQ ID NO: 363226 - DNA, 25 bp, Rattus norvegicus
gatctaagcccaactgttgaaataa

SEQ ID NO: 363227 - DNA, 25 bp, Rattus norvegicus
gatctaagcccatctgttgaaataa

SEQ ID NO: 363228 - DNA, 25 bp, Rattus norvegicus
gatctaaggcttacaccacaagttt

SEQ ID NO: 363229 - DNA, 25 bp, Rattus norvegicus
gatctaaggctttcaccacaagttt

SEQ ID NO: 363230 - DNA, 25 bp, Rattus norvegicus
gatctaaggtgtaccctgggatccc

SEQ ID NO: 363231 - DNA, 25 bp, Rattus norvegicus
gatctaaggtgttccctgggatccc

SEQ ID NO: 363232 - DNA, 25 bp, Rattus norvegicus
gatctaagtattagggtgcccgccc

SEQ ID NO: 363233 - DNA, 25 bp, Rattus norvegicus
gatctaagtatttgggtgcccgccc

SEQ ID NO: 363234 - DNA, 25 bp, Rattus norvegicus
gatctaataacccatagaccatatt

SEQ ID NO: 363235 - DNA, 25 bp, Rattus norvegicus
gatctaataaccgatagaccatatt

SEQ ID NO: 363236 - DNA, 25 bp, Rattus norvegicus
gatctaatagcccaatcgttctcca

SEQ ID NO: 363237 - DNA, 25 bp, Rattus norvegicus
gatctaatagccgaatcgttctcca

SEQ ID NO: 363238 - DNA, 25 bp, Rattus norvegicus
gatctaatcaagatcccaaccaaga

SEQ ID NO: 363239 - DNA, 25 bp, Rattus norvegicus
gatctaatcaagttcccaaccaaga

SEQ ID NO: 363240 - DNA, 25 bp, Rattus norvegicus
gatctaatctggagtgctggaaggt

SEQ ID NO: 363241 - DNA, 25 bp, Rattus norvegicus
gatctaatctggtgtgctggaaggt

SEQ ID NO: 363242 - DNA, 25 bp, Rattus norvegicus
gatctaatgccgaatccatctcttg

SEQ ID NO: 363243 - DNA, 25 bp, Rattus norvegicus
gatctaatgccgtatccatctcttg

SEQ ID NO: 363244 - DNA, 25 bp, Rattus norvegicus
gatctaatgcggcatttctgaggaa

SEQ ID NO: 363245 - DNA, 25 bp, Rattus norvegicus
gatctaatgcgggatttctgaggaa

SEQ ID NO: 363246 - DNA, 25 bp, Rattus norvegicus
gatctaattaaaccctgttcctctc

SEQ ID NO: 363247 - DNA, 25 bp, Rattus norvegicus
gatctaattaaagcctgttcctctc

SEQ ID NO: 363248 - DNA, 25 bp, Rattus norvegicus
gatctacaaagaagcccttgtcctc

SEQ ID NO: 363249 - DNA, 25 bp, Rattus norvegicus
gatctacaaagatgcccttgtcctc

SEQ ID NO: 363250 - DNA, 25 bp, Rattus norvegicus
gatctacaatgcctcagaaatgttt

SEQ ID NO: 363251 - DNA, 25 bp, Rattus norvegicus
gatctacaatgcgtcagaaatgttt

SEQ ID NO: 363252 - DNA, 25 bp, Rattus norvegicus
gatctacactgacttattctggtta

SEQ ID NO: 363253 - DNA, 25 bp, Rattus norvegicus
gatctacactgagttattctggtta

SEQ ID NO: 363254 - DNA, 25 bp, Rattus norvegicus
gatctacagagacgcccaaactggg

SEQ ID NO: 363255 - DNA, 25 bp, Rattus norvegicus
gatctacagagaggcccaaactggg

SEQ ID NO: 363256 - DNA, 25 bp, Rattus norvegicus
gatctacagagcaagatccagaaca

SEQ ID NO: 363257 - DNA, 25 bp, Rattus norvegicus
gatctacagagctagatccagaaca

SEQ ID NO: 363258 - DNA, 25 bp, Rattus norvegicus
gatctacagtgtacacttctgcacc

SEQ ID NO: 363259 - DNA, 25 bp, Rattus norvegicus
gatctacagtgttcacttctgcacc

SEQ ID NO: 363260 - DNA, 25 bp, Rattus norvegicus
gatctacataggaaggtctaggcca

SEQ ID NO: 363261 - DNA, 25 bp, Rattus norvegicus
gatctacataggtaggtctaggcca

SEQ ID NO: 363262 - DNA, 25 bp, Rattus norvegicus
gatctacattgcaattcaggccgaa

SEQ ID NO: 363263 - DNA, 25 bp, Rattus norvegicus
gatctacattgctattcaggccgaa

SEQ ID NO: 363264 - DNA, 25 bp, Rattus norvegicus
gatctaccatctcatcatgaggtac

SEQ ID NO: 363265 - DNA, 25 bp, Rattus norvegicus
gatctaccatctgatcatgaggtac

SEQ ID NO: 363266 - DNA, 25 bp, Rattus norvegicus
gatctacctgcaacctcagtgtaac

SEQ ID NO: 363267 - DNA, 25 bp, Rattus norvegicus
gatctacctgcatcctcagtgtaac

SEQ ID NO: 363268 - DNA, 25 bp, Rattus norvegicus
gatctacctgcgactcaaaaagctc

SEQ ID NO: 363269 - DNA, 25 bp, Rattus norvegicus
gatctacctgcgtctcaaaaagctc

SEQ ID NO: 363270 - DNA, 25 bp, Rattus norvegicus
gatctacgagatcgctgctggctac

SEQ ID NO: 363271 - DNA, 25 bp, Rattus norvegicus
gatctacgagatggctgctggctac

SEQ ID NO: 363272 - DNA, 25 bp, Rattus norvegicus
gatctacgagcgagaggactacaga

SEQ ID NO: 363273 - DNA, 25 bp, Rattus norvegicus
gatctacgagcgtgaggactacaga

SEQ ID NO: 363274 - DNA, 25 bp, Rattus norvegicus
gatctacggtttaaagactcctctt

SEQ ID NO: 363275 - DNA, 25 bp, Rattus norvegicus
gatctacggttttaagactcctctt

SEQ ID NO: 363276 - DNA, 25 bp, Rattus norvegicus
gatctacgtgtcaaactgttccatt

SEQ ID NO: 363277 - DNA, 25 bp, Rattus norvegicus
gatctacgtgtctaactgttccatt

SEQ ID NO: 363278 - DNA, 25 bp, Rattus norvegicus
gatctactaccgcaacttccataac

SEQ ID NO: 363279 - DNA, 25 bp, Rattus norvegicus
gatctactaccggaacttccataac

SEQ ID NO: 363280 - DNA, 25 bp, Rattus norvegicus
gatctactcctgagtgtggctttaa

SEQ ID NO: 363281 - DNA, 25 bp, Rattus norvegicus
gatctactcctgtgtgtggctttaa

SEQ ID NO: 363282 - DNA, 25 bp, Rattus norvegicus
gatctactctgactgactactgtag

SEQ ID NO: 363283 - DNA, 25 bp, Rattus norvegicus
gatctactctgagtgactactgtag

SEQ ID NO: 363284 - DNA, 25 bp, Rattus norvegicus
gatctactcttgcactatctgatat

SEQ ID NO: 363285 - DNA, 25 bp, Rattus norvegicus
gatctactcttggactatctgatat

SEQ ID NO: 363286 - DNA, 25 bp, Rattus norvegicus
gatctactgatgagtgtgtggcctc

SEQ ID NO: 363287 - DNA, 25 bp, Rattus norvegicus
gatctactgatgtgtgtgtggcctc

SEQ ID NO: 363288 - DNA, 25 bp, Rattus norvegicus
gatctactgcacatccatcaaggag

SEQ ID NO: 363289 - DNA, 25 bp, Rattus norvegicus
gatctactgcacttccatcaaggag

SEQ ID NO: 363290 - DNA, 25 bp, Rattus norvegicus
gatctacttaaaaactgcttcgtga

SEQ ID NO: 363291 - DNA, 25 bp, Rattus norvegicus
gatctacttaaatactgcttcgtga

SEQ ID NO: 363292 - DNA, 25 bp, Rattus norvegicus
gatctacttgggaccacaacattca

SEQ ID NO: 363293 - DNA, 25 bp, Rattus norvegicus
gatctacttgggtccacaacattca

SEQ ID NO: 363294 - DNA, 25 bp, Rattus norvegicus
gatctactttgtcaatatgaggact

SEQ ID NO: 363295 - DNA, 25 bp, Rattus norvegicus
gatctactttgtgaatatgaggact

SEQ ID NO: 363296 - DNA, 25 bp, Rattus norvegicus
gatctagaacccactgctgagacaa

SEQ ID NO: 363297 - DNA, 25 bp, Rattus norvegicus
gatctagaaccctctgctgagacaa

SEQ ID NO: 363298 - DNA, 25 bp, Rattus norvegicus
gatctagaaggtctggcctttccag

SEQ ID NO: 363299 - DNA, 25 bp, Rattus norvegicus
gatctagaaggtgtggcctttccag

SEQ ID NO: 363300 - DNA, 25 bp, Rattus norvegicus
gatctagaagtgcttttggccttgg

SEQ ID NO: 363301 - DNA, 25 bp, Rattus norvegicus
gatctagaagtggttttggccttgg

SEQ ID NO: 363302 - DNA, 25 bp, Rattus norvegicus
gatctagagcatccacacatatatg

SEQ ID NO: 363303 - DNA, 25 bp, Rattus norvegicus
gatctagagcatgcacacatatatg

SEQ ID NO: 363304 - DNA, 25 bp, Rattus norvegicus
gatctagagctaaaaccctctccag

SEQ ID NO: 363305 - DNA, 25 bp, Rattus norvegicus
gatctagagctataaccctctccag

SEQ ID NO: 363306 - DNA, 25 bp, Rattus norvegicus
gatctagatccaaagaaacactggt

SEQ ID NO: 363307 - DNA, 25 bp, Rattus norvegicus
gatctagatccatagaaacactggt

SEQ ID NO: 363308 - DNA, 25 bp, Rattus norvegicus
gatctagatcttaacagcctcagga

SEQ ID NO: 363309 - DNA, 25 bp, Rattus norvegicus
gatctagatctttacagcctcagga

SEQ ID NO: 363310 - DNA, 25 bp, Rattus norvegicus
gatctagcctatatcctacaacttc

SEQ ID NO: 363311 - DNA, 25 bp, Rattus norvegicus
gatctagcctatttcctacaacttc

SEQ ID NO: 363312 - DNA, 25 bp, Rattus norvegicus
gatctaggcgctcggtccggcctta

SEQ ID NO: 363313 - DNA, 25 bp, Rattus norvegicus
gatctaggcgctgggtccggcctta

SEQ ID NO: 363314 - DNA, 25 bp, Rattus norvegicus
gatctaggcttgacagtccctgaga

SEQ ID NO: 363315 - DNA, 25 bp, Rattus norvegicus
gatctaggcttgactcagggaagta

SEQ ID NO: 363316 - DNA, 25 bp, Rattus norvegicus
gatctaggcttgtcagtccctgaga

SEQ ID NO: 363317 - DNA, 25 bp, Rattus norvegicus
gatctaggcttgtctcagggaagta

SEQ ID NO: 363318 - DNA, 25 bp, Rattus norvegicus
gatctaggtgccaaggccagctgca

SEQ ID NO: 363319 - DNA, 25 bp, Rattus norvegicus
gatctaggtgcctaggccagctgca

SEQ ID NO: 363320 - DNA, 25 bp, Rattus norvegicus
gatctagtaactctcacacatttga

SEQ ID NO: 363321 - DNA, 25 bp, Rattus norvegicus
gatctagtaactgtcacacatttga

SEQ ID NO: 363322 - DNA, 25 bp, Rattus norvegicus
gatctagtcagtctctttatgtcga

SEQ ID NO: 363323 - DNA, 25 bp, Rattus norvegicus
gatctagtcagtgtctttatgtcga

SEQ ID NO: 363324 - DNA, 25 bp, Rattus norvegicus
gatctagtgggcatgtctgtcacct

SEQ ID NO: 363325 - DNA, 25 bp, Rattus norvegicus
gatctagtgggcttgtctgtcacct

SEQ ID NO: 363326 - DNA, 25 bp, Rattus norvegicus
gatctagttcatactccatttaata

SEQ ID NO: 363327 - DNA, 25 bp, Rattus norvegicus
gatctagttcattctccatttaata

SEQ ID NO: 363328 - DNA, 25 bp, Rattus norvegicus
gatctagttttcaggcctcaagtgg

SEQ ID NO: 363329 - DNA, 25 bp, Rattus norvegicus
gatctagttttctggcctcaagtgg

SEQ ID NO: 363330 - DNA, 25 bp, Rattus norvegicus
gatctataaattcaactgctgcatt

SEQ ID NO: 363331 - DNA, 25 bp, Rattus norvegicus
gatctataaattgaactgctgcatt

SEQ ID NO: 363332 - DNA, 25 bp, Rattus norvegicus
gatctataccacacagccattaaac

SEQ ID NO: 363333 - DNA, 25 bp, Rattus norvegicus
gatctataccactcagccattaaac

SEQ ID NO: 363334 - DNA, 25 bp, Rattus norvegicus
gatctatatatcactctgctctctt

SEQ ID NO: 363335 - DNA, 25 bp, Rattus norvegicus
gatctatatatctctctgctctctt

SEQ ID NO: 363336 - DNA, 25 bp, Rattus norvegicus
gatctatatttgagtgtttctaaag

SEQ ID NO: 363337 - DNA, 25 bp, Rattus norvegicus
gatctatatttgtgtgtttctaaag

SEQ ID NO: 363338 - DNA, 25 bp, Rattus norvegicus
gatctatattttaatggtacctggt

SEQ ID NO: 363339 - DNA, 25 bp, Rattus norvegicus
gatctatatttttatggtacctggt

SEQ ID NO: 363340 - DNA, 25 bp, Rattus norvegicus
gatctatccattaaatactgtcctt

SEQ ID NO: 363341 - DNA, 25 bp, Rattus norvegicus
gatctatccatttaatactgtcctt

SEQ ID NO: 363342 - DNA, 25 bp, Rattus norvegicus
gatctatcggttatcaaacgcctcg

SEQ ID NO: 363343 - DNA, 25 bp, Rattus norvegicus
gatctatcggttttcaaacgcctcg

SEQ ID NO: 363344 - DNA, 25 bp, Rattus norvegicus
gatctatctaggagtgctgggtttc

SEQ ID NO: 363345 - DNA, 25 bp, Rattus norvegicus
gatctatctaggtgtgctgggtttc

SEQ ID NO: 363346 - DNA, 25 bp, Rattus norvegicus
gatctatctcagaggctatagctgg

SEQ ID NO: 363347 - DNA, 25 bp, Rattus norvegicus
gatctatctcagtggctatagctgg

SEQ ID NO: 363348 - DNA, 25 bp, Rattus norvegicus
gatctatgagaccaaggccagccta

SEQ ID NO: 363349 - DNA, 25 bp, Rattus norvegicus
gatctatgagacgaaggccagccta

SEQ ID NO: 363350 - DNA, 25 bp, Rattus norvegicus
gatctatgagatccacggtgacaga

SEQ ID NO: 363351 - DNA, 25 bp, Rattus norvegicus
gatctatgagatgcacggtgacaga

SEQ ID NO: 363352 - DNA, 25 bp, Rattus norvegicus
gatctatgtatgaaccttctggtgc

SEQ ID NO: 363353 - DNA, 25 bp, Rattus norvegicus
gatctatgtatgtaccttctggtgc

SEQ ID NO: 363354 - DNA, 25 bp, Rattus norvegicus
gatctatgttcgaaatgcaggtgta

SEQ ID NO: 363355 - DNA, 25 bp, Rattus norvegicus
gatctatgttcgtaatgcaggtgta

SEQ ID NO: 363356 - DNA, 25 bp, Rattus norvegicus
gatctattaggaagtgctcccgctc

SEQ ID NO: 363357 - DNA, 25 bp, Rattus norvegicus
gatctattaggatgtgctcccgctc

SEQ ID NO: 363358 - DNA, 25 bp, Rattus norvegicus
gatctattctccaagaaaaggtaca

SEQ ID NO: 363359 - DNA, 25 bp, Rattus norvegicus
gatctattctcctagaaaaggtaca

SEQ ID NO: 363360 - DNA, 25 bp, Rattus norvegicus
gatctattctgaagcacggtttgga

SEQ ID NO: 363361 - DNA, 25 bp, Rattus norvegicus
gatctattctgatgcacggtttgga

SEQ ID NO: 363362 - DNA, 25 bp, Rattus norvegicus
gatctattcttcaaactctcacaac

SEQ ID NO: 363363 - DNA, 25 bp, Rattus norvegicus
gatctattcttctaactctcacaac

SEQ ID NO: 363364 - DNA, 25 bp, Rattus norvegicus
gatctattgtacagtctgtttcttc

SEQ ID NO: 363365 - DNA, 25 bp, Rattus norvegicus
gatctattgtactgtctgtttcttc

SEQ ID NO: 363366 - DNA, 25 bp, Rattus norvegicus
gatctatttcccatatcacttcaat

SEQ ID NO: 363367 - DNA, 25 bp, Rattus norvegicus
gatctatttcccttatcacttcaat

SEQ ID NO: 363368 - DNA, 25 bp, Rattus norvegicus
gatctatttcgtatgtggtttggaa

SEQ ID NO: 363369 - DNA, 25 bp, Rattus norvegicus
gatctatttcgtttgtggtttggaa

SEQ ID NO: 363370 - DNA, 25 bp, Rattus norvegicus
gatctatttcttcatcctttgttct

SEQ ID NO: 363371 - DNA, 25 bp, Rattus norvegicus
gatctatttcttgatcctttgttct

SEQ ID NO: 363372 - DNA, 25 bp, Rattus norvegicus
gatctatttgtaatcttatgccttt

SEQ ID NO: 363373 - DNA, 25 bp, Rattus norvegicus
gatctatttgtattcttatgccttt

SEQ ID NO: 363374 - DNA, 25 bp, Rattus norvegicus
gatctattttctcacttctatttta

SEQ ID NO: 363375 - DNA, 25 bp, Rattus norvegicus
gatctattttctgacttctatttta

SEQ ID NO: 363376 - DNA, 25 bp, Rattus norvegicus
gatctattttggacagtacccctga

SEQ ID NO: 363377 - DNA, 25 bp, Rattus norvegicus
gatctattttggtcagtacccctga

SEQ ID NO: 363378 - DNA, 25 bp, Rattus norvegicus
gatctcaaacatcctatgcagagga

SEQ ID NO: 363379 - DNA, 25 bp, Rattus norvegicus
gatctcaaacatgctatgcagagga

SEQ ID NO: 363380 - DNA, 25 bp, Rattus norvegicus
gatctcaacaatacacaagtctgtg

SEQ ID NO: 363381 - DNA, 25 bp, Rattus norvegicus
gatctcaacaattcacaagtctgtg

SEQ ID NO: 363382 - DNA, 25 bp, Rattus norvegicus
gatctcaacccaagggaggtccgtt

SEQ ID NO: 363383 - DNA, 25 bp, Rattus norvegicus
gatctcaacccatgggaggtccgtt

SEQ ID NO: 363384 - DNA, 25 bp, Rattus norvegicus
gatctcaacctcagcagtgagcact

SEQ ID NO: 363385 - DNA, 25 bp, Rattus norvegicus
gatctcaacctctgcagtgagcact

SEQ ID NO: 363386 - DNA, 25 bp, Rattus norvegicus
gatctcaactgtcccattttttgtg

SEQ ID NO: 363387 - DNA, 25 bp, Rattus norvegicus
gatctcaactgtgccattttttgtg

SEQ ID NO: 363388 - DNA, 25 bp, Rattus norvegicus
gatctcaattggaacgtattgattg

SEQ ID NO: 363389 - DNA, 25 bp, Rattus norvegicus
gatctcaattggtacgtattgattg

SEQ ID NO: 363390 - DNA, 25 bp, Rattus norvegicus
gatctcacaaaaccaaaggcccttt

SEQ ID NO: 363391 - DNA, 25 bp, Rattus norvegicus
gatctcacaaaagcaaaggcccttt

SEQ ID NO: 363392 - DNA, 25 bp, Rattus norvegicus
gatctcacacgcacattataaggca

SEQ ID NO: 363393 - DNA, 25 bp, Rattus norvegicus
gatctcacacgctcattataaggca

SEQ ID NO: 363394 - DNA, 25 bp, Rattus norvegicus
gatctcacagtaatatttgccattc

SEQ ID NO: 363395 - DNA, 25 bp, Rattus norvegicus
gatctcacagtattatttgccattc

SEQ ID NO: 363396 - DNA, 25 bp, Rattus norvegicus
gatctcacatagatggctggcaccc

SEQ ID NO: 363397 - DNA, 25 bp, Rattus norvegicus
gatctcacatagttggctggcaccc

SEQ ID NO: 363398 - DNA, 25 bp, Rattus norvegicus
gatctcaccctaccggtaagatcaa

SEQ ID NO: 363399 - DNA, 25 bp, Rattus norvegicus
gatctcaccctagcggtaagatcaa

SEQ ID NO: 363400 - DNA, 25 bp, Rattus norvegicus
gatctcacgctgataggcacttagg

SEQ ID NO: 363401 - DNA, 25 bp, Rattus norvegicus
gatctcacgctgttaggcacttagg

SEQ ID NO: 363402 - DNA, 25 bp, Rattus norvegicus
gatctcactaccaagcccaagctag

SEQ ID NO: 363403 - DNA, 25 bp, Rattus norvegicus
gatctcactacctagcccaagctag

SEQ ID NO: 363404 - DNA, 25 bp, Rattus norvegicus
gatctcactcggctgtgaagccgta

SEQ ID NO: 363405 - DNA, 25 bp, Rattus norvegicus
gatctcactcgggtgtgaagccgta

SEQ ID NO: 363406 - DNA, 25 bp, Rattus norvegicus
gatctcactgcaaagccgagtctga

SEQ ID NO: 363407 - DNA, 25 bp, Rattus norvegicus
gatctcactgcatagccgagtctga

SEQ ID NO: 363408 - DNA, 25 bp, Rattus norvegicus
gatctcactggtatctgaggttaac

SEQ ID NO: 363409 - DNA, 25 bp, Rattus norvegicus
gatctcactggtttctgaggttaac

SEQ ID NO: 363410 - DNA, 25 bp, Rattus norvegicus
gatctcacttaactagccgcagaaa

SEQ ID NO: 363411 - DNA, 25 bp, Rattus norvegicus
gatctcacttaagtagccgcagaaa

SEQ ID NO: 363412 - DNA, 25 bp, Rattus norvegicus
gatctcactttgcacattcataata

SEQ ID NO: 363413 - DNA, 25 bp, Rattus norvegicus
gatctcactttggacattcataata

SEQ ID NO: 363414 - DNA, 25 bp, Rattus norvegicus
gatctcagatcacggacattcaagt

SEQ ID NO: 363415 - DNA, 25 bp, Rattus norvegicus
gatctcagatcagggacattcaagt

SEQ ID NO: 363416 - DNA, 25 bp, Rattus norvegicus
gatctcagcaatctattcttcagtg

SEQ ID NO: 363417 - DNA, 25 bp, Rattus norvegicus
gatctcagcaatgtattcttcagtg

SEQ ID NO: 363418 - DNA, 25 bp, Rattus norvegicus
gatctcagcaccagggaagcaaaga

SEQ ID NO: 363419 - DNA, 25 bp, Rattus norvegicus
gatctcagcacctgggaagcaaaga

SEQ ID NO: 363420 - DNA, 25 bp, Rattus norvegicus
gatctcagccaaaagtccgacggac

SEQ ID NO: 363421 - DNA, 25 bp, Rattus norvegicus
gatctcagccaatagtccgacggac

SEQ ID NO: 363422 - DNA, 25 bp, Rattus norvegicus
gatctcagccctacagtgcaaggat

SEQ ID NO: 363423 - DNA, 25 bp, Rattus norvegicus
gatctcagccctcgttgatgggtat

SEQ ID NO: 363424 - DNA, 25 bp, Rattus norvegicus
gatctcagccctggttgatgggtat

SEQ ID NO: 363425 - DNA, 25 bp, Rattus norvegicus
gatctcagcccttcagtgcaaggat

SEQ ID NO: 363426 - DNA, 25 bp, Rattus norvegicus
gatctcagctcgagcatttgctcag

SEQ ID NO: 363427 - DNA, 25 bp, Rattus norvegicus
gatctcagctcgtgcatttgctcag

SEQ ID NO: 363428 - DNA, 25 bp, Rattus norvegicus
gatctcagctgacgccagggacaga

SEQ ID NO: 363429 - DNA, 25 bp, Rattus norvegicus
gatctcagctgaggccagggacaga

SEQ ID NO: 363430 - DNA, 25 bp, Rattus norvegicus
gatctcaggattaaagccaccctct

SEQ ID NO: 363431 - DNA, 25 bp, Rattus norvegicus
gatctcaggatttaagccaccctct

SEQ ID NO: 363432 - DNA, 25 bp, Rattus norvegicus
gatctcagggtcctgtattctgtct

SEQ ID NO: 363433 - DNA, 25 bp, Rattus norvegicus
gatctcagggtcgtgtattctgtct

SEQ ID NO: 363434 - DNA, 25 bp, Rattus norvegicus
gatctcagtggccttgatatcctca

SEQ ID NO: 363435 - DNA, 25 bp, Rattus norvegicus
gatctcagtggcgttgatatcctca

SEQ ID NO: 363436 - DNA, 25 bp, Rattus norvegicus
gatctcataatacaactttcctgtt

SEQ ID NO: 363437 - DNA, 25 bp, Rattus norvegicus
gatctcataatagaactttcctgtt

SEQ ID NO: 363438 - DNA, 25 bp, Rattus norvegicus
gatctcatatgacagcatagatgct

SEQ ID NO: 363439 - DNA, 25 bp, Rattus norvegicus
gatctcatatgagagcatagatgct

SEQ ID NO: 363440 - DNA, 25 bp, Rattus norvegicus
gatctcatcagccagaacgtcacaa

SEQ ID NO: 363441 - DNA, 25 bp, Rattus norvegicus
gatctcatcagcgagaacgtcacaa

SEQ ID NO: 363442 - DNA, 25 bp, Rattus norvegicus
gatctcatccagaaagccgtgcatt

SEQ ID NO: 363443 - DNA, 25 bp, Rattus norvegicus
gatctcatccagtaagccgtgcatt

SEQ ID NO: 363444 - DNA, 25 bp, Rattus norvegicus
gatctcatgattcggcttttggaac

SEQ ID NO: 363445 - DNA, 25 bp, Rattus norvegicus
gatctcatgattgggcttttggaac

SEQ ID NO: 363446 - DNA, 25 bp, Rattus norvegicus
gatctcattggaatgcctccagaag

SEQ ID NO: 363447 - DNA, 25 bp, Rattus norvegicus
gatctcattggattgcctccagaag

SEQ ID NO: 363448 - DNA, 25 bp, Rattus norvegicus
gatctcattttaacatccactgcta

SEQ ID NO: 363449 - DNA, 25 bp, Rattus norvegicus
gatctcattttatcatccactgcta

SEQ ID NO: 363450 - DNA, 25 bp, Rattus norvegicus
gatctccaacttagaaaggcctggt

SEQ ID NO: 363451 - DNA, 25 bp, Rattus norvegicus
gatctccaactttgaaaggcctggt

SEQ ID NO: 363452 - DNA, 25 bp, Rattus norvegicus
gatctccaaggcagggactacccta

SEQ ID NO: 363453 - DNA, 25 bp, Rattus norvegicus
gatctccaaggctgggactacccta

SEQ ID NO: 363454 - DNA, 25 bp, Rattus norvegicus
gatctccaagtgaagcttgctttga

SEQ ID NO: 363455 - DNA, 25 bp, Rattus norvegicus
gatctccaagtgtagcttgctttga

SEQ ID NO: 363456 - DNA, 25 bp, Rattus norvegicus
gatctccaagttccaggcgtgcaag

SEQ ID NO: 363457 - DNA, 25 bp, Rattus norvegicus
gatctccaagttgcaggcgtgcaag

SEQ ID NO: 363458 - DNA, 25 bp, Rattus norvegicus
gatctccacattcagacacattttt

SEQ ID NO: 363459 - DNA, 25 bp, Rattus norvegicus
gatctccacattgagacacattttt

SEQ ID NO: 363460 - DNA, 25 bp, Rattus norvegicus
gatctccaggacacatgtggacgga

SEQ ID NO: 363461 - DNA, 25 bp, Rattus norvegicus
gatctccaggactcatgtggacgga

SEQ ID NO: 363462 - DNA, 25 bp, Rattus norvegicus
gatctccaggtcatgaggcctcaca

SEQ ID NO: 363463 - DNA, 25 bp, Rattus norvegicus
gatctccaggtcttgaggcctcaca

SEQ ID NO: 363464 - DNA, 25 bp, Rattus norvegicus
gatctccagtttagtgttgtgctac

SEQ ID NO: 363465 - DNA, 25 bp, Rattus norvegicus
gatctccagtttcacatccaagcat

SEQ ID NO: 363466 - DNA, 25 bp, Rattus norvegicus
gatctccagtttgacatccaagcat

SEQ ID NO: 363467 - DNA, 25 bp, Rattus norvegicus
gatctccagttttgtgttgtgctac

SEQ ID NO: 363468 - DNA, 25 bp, Rattus norvegicus
gatctccatgacacaaaatctctga

SEQ ID NO: 363469 - DNA, 25 bp, Rattus norvegicus
gatctccatgactcaaaatctctga

SEQ ID NO: 363470 - DNA, 25 bp, Rattus norvegicus
gatctccatggtaaaactgcagtga

SEQ ID NO: 363471 - DNA, 25 bp, Rattus norvegicus
gatctccatggttaaactgcagtga

SEQ ID NO: 363472 - DNA, 25 bp, Rattus norvegicus
gatctccattacattcttatacctt

SEQ ID NO: 363473 - DNA, 25 bp, Rattus norvegicus
gatctccattactttcttatacctt

SEQ ID NO: 363474 - DNA, 25 bp, Rattus norvegicus
gatctccattgtaacatgtgccaca

SEQ ID NO: 363475 - DNA, 25 bp, Rattus norvegicus
gatctccattgttacatgtgccaca

SEQ ID NO: 363476 - DNA, 25 bp, Rattus norvegicus
gatctcccaaacagggtagttgtac

SEQ ID NO: 363477 - DNA, 25 bp, Rattus norvegicus
gatctcccaaactgggtagttgtac

SEQ ID NO: 363478 - DNA, 25 bp, Rattus norvegicus
gatctcccagatctgatgctaggta

SEQ ID NO: 363479 - DNA, 25 bp, Rattus norvegicus
gatctcccagatgtgatgctaggta

SEQ ID NO: 363480 - DNA, 25 bp, Rattus norvegicus
gatctcccaggcagtagctgtcgga

SEQ ID NO: 363481 - DNA, 25 bp, Rattus norvegicus
gatctcccaggctgtagctgtcgga

SEQ ID NO: 363482 - DNA, 25 bp, Rattus norvegicus
gatctcccagttacagcgattgtta

SEQ ID NO: 363483 - DNA, 25 bp, Rattus norvegicus
gatctcccagtttcagcgattgtta

SEQ ID NO: 363484 - DNA, 25 bp, Rattus norvegicus
gatctcccataaattttcctttgac

SEQ ID NO: 363485 - DNA, 25 bp, Rattus norvegicus
gatctcccataatttttcctttgac

SEQ ID NO: 363486 - DNA, 25 bp, Rattus norvegicus
gatctccccaagcaggtggtgacta

SEQ ID NO: 363487 - DNA, 25 bp, Rattus norvegicus
gatctccccaaggaggtggtgacta

SEQ ID NO: 363488 - DNA, 25 bp, Rattus norvegicus
gatctccctgagaatccattgtgat

SEQ ID NO: 363489 - DNA, 25 bp, Rattus norvegicus
gatctccctgagtatccattgtgat

SEQ ID NO: 363490 - DNA, 25 bp, Rattus norvegicus
gatctcccttgcaagccttcagagg

SEQ ID NO: 363491 - DNA, 25 bp, Rattus norvegicus
gatctcccttgctagccttcagagg

SEQ ID NO: 363492 - DNA, 25 bp, Rattus norvegicus
gatctccgcggcaacatttttggat

SEQ ID NO: 363493 - DNA, 25 bp, Rattus norvegicus
gatctccgcggctacatttttggat

SEQ ID NO: 363494 - DNA, 25 bp, Rattus norvegicus
gatctccgctcaccaacgaatgttg

SEQ ID NO: 363495 - DNA, 25 bp, Rattus norvegicus
gatctccgctcagcaacgaatgttg

SEQ ID NO: 363496 - DNA, 25 bp, Rattus norvegicus
gatctccgttttctctaatgcttta

SEQ ID NO: 363497 - DNA, 25 bp, Rattus norvegicus
gatctccgttttgtctaatgcttta

SEQ ID NO: 363498 - DNA, 25 bp, Rattus norvegicus
gatctcctaggcatcggattgtcgc

SEQ ID NO: 363499 - DNA, 25 bp, Rattus norvegicus
gatctcctaggcttcggattgtcgc

SEQ ID NO: 363500 - DNA, 25 bp, Rattus norvegicus
gatctcctagttagatgcagctcat

SEQ ID NO: 363501 - DNA, 25 bp, Rattus norvegicus
gatctcctagtttgatgcagctcat

SEQ ID NO: 363502 - DNA, 25 bp, Rattus norvegicus
gatctcctattacaagtgacgtttt

SEQ ID NO: 363503 - DNA, 25 bp, Rattus norvegicus
gatctcctattagaagtgacgtttt

SEQ ID NO: 363504 - DNA, 25 bp, Rattus norvegicus
gatctcctcaagctgcattcggtta

SEQ ID NO: 363505 - DNA, 25 bp, Rattus norvegicus
gatctcctcaaggtgcattcggtta

SEQ ID NO: 363506 - DNA, 25 bp, Rattus norvegicus
gatctcctcagtattgcagcattcg

SEQ ID NO: 363507 - DNA, 25 bp, Rattus norvegicus
gatctcctcagttttgcagcattcg

SEQ ID NO: 363508 - DNA, 25 bp, Rattus norvegicus
gatctcctgactcttgtaatttcca

SEQ ID NO: 363509 - DNA, 25 bp, Rattus norvegicus
gatctcctgactgttgtaatttcca

SEQ ID NO: 363510 - DNA, 25 bp, Rattus norvegicus
gatctcctgggcacaaatagcatgt

SEQ ID NO: 363511 - DNA, 25 bp, Rattus norvegicus
gatctcctgggctcaaatagcatgt

SEQ ID NO: 363512 - DNA, 25 bp, Rattus norvegicus
gatctcctggtcactgttctgatga

SEQ ID NO: 363513 - DNA, 25 bp, Rattus norvegicus
gatctcctggtctctgttctgatga

SEQ ID NO: 363514 - DNA, 25 bp, Rattus norvegicus
gatctcctgtgtaaccgatgtgtat

SEQ ID NO: 363515 - DNA, 25 bp, Rattus norvegicus
gatctcctgtgttaccgatgtgtat

SEQ ID NO: 363516 - DNA, 25 bp, Rattus norvegicus
gatctcctgttcacattatgccatt

SEQ ID NO: 363517 - DNA, 25 bp, Rattus norvegicus
gatctcctgttctcattatgccatt

SEQ ID NO: 363518 - DNA, 25 bp, Rattus norvegicus
gatctccttgtacaacctgcaaatg

SEQ ID NO: 363519 - DNA, 25 bp, Rattus norvegicus
gatctccttgtagaacctgcaaatg

SEQ ID NO: 363520 - DNA, 25 bp, Rattus norvegicus
gatctcctttgtccttctgtaaaat

SEQ ID NO: 363521 - DNA, 25 bp, Rattus norvegicus
gatctcctttgtgcttctgtaaaat

SEQ ID NO: 363522 - DNA, 25 bp, Rattus norvegicus
gatctcgaaactcttgtgatactct

SEQ ID NO: 363523 - DNA, 25 bp, Rattus norvegicus
gatctcgaaactgttgtgatactct

SEQ ID NO: 363524 - DNA, 25 bp, Rattus norvegicus
gatctcgaaaggcagcctgctaggt

SEQ ID NO: 363525 - DNA, 25 bp, Rattus norvegicus
gatctcgaaagggagcctgctaggt

SEQ ID NO: 363526 - DNA, 25 bp, Rattus norvegicus
gatctcgagaatcttccagacactg

SEQ ID NO: 363527 - DNA, 25 bp, Rattus norvegicus
gatctcgagaatgttccagacactg

SEQ ID NO: 363528 - DNA, 25 bp, Rattus norvegicus
gatctcgatttcacttactgtgttt

SEQ ID NO: 363529 - DNA, 25 bp, Rattus norvegicus
gatctcgatttctcttactgtgttt

SEQ ID NO: 363530 - DNA, 25 bp, Rattus norvegicus
gatctcgcagatcagtaatcttaga

SEQ ID NO: 363531 - DNA, 25 bp, Rattus norvegicus
gatctcgcagatgagtaatcttaga

SEQ ID NO: 363532 - DNA, 25 bp, Rattus norvegicus
gatctcgcgagaatgcacgttcttc

SEQ ID NO: 363533 - DNA, 25 bp, Rattus norvegicus
gatctcgcgagattgcacgttcttc

SEQ ID NO: 363534 - DNA, 25 bp, Rattus norvegicus
gatctcgctcatagtttagttcttc

SEQ ID NO: 363535 - DNA, 25 bp, Rattus norvegicus
gatctcgctcattgtttagttcttc

SEQ ID NO: 363536 - DNA, 25 bp, Rattus norvegicus
gatctcggaggtagcatcatgatgg

SEQ ID NO: 363537 - DNA, 25 bp, Rattus norvegicus
gatctcggaggttgcatcatgatgg

SEQ ID NO: 363538 - DNA, 25 bp, Rattus norvegicus
gatctcggagtgcagattctccaag

SEQ ID NO: 363539 - DNA, 25 bp, Rattus norvegicus
gatctcggagtggagattctccaag

SEQ ID NO: 363540 - DNA, 25 bp, Rattus norvegicus
gatctcgggattcaaactcatgtct

SEQ ID NO: 363541 - DNA, 25 bp, Rattus norvegicus
gatctcgggattgaaactcatgtct

SEQ ID NO: 363542 - DNA, 25 bp, Rattus norvegicus
gatctcggtctcacgcagagagggc

SEQ ID NO: 363543 - DNA, 25 bp, Rattus norvegicus
gatctcggtctctcgcagagagggc

SEQ ID NO: 363544 - DNA, 25 bp, Rattus norvegicus
gatctcggtgtcatcagaagctcct

SEQ ID NO: 363545 - DNA, 25 bp, Rattus norvegicus
gatctcggtgtcttcagaagctcct

SEQ ID NO: 363546 - DNA, 25 bp, Rattus norvegicus
gatctcgtaccaagggcagtgcaca

SEQ ID NO: 363547 - DNA, 25 bp, Rattus norvegicus
gatctcgtaccatgggcagtgcaca

SEQ ID NO: 363548 - DNA, 25 bp, Rattus norvegicus
gatctcgtgcaactgttgtctatgt

SEQ ID NO: 363549 - DNA, 25 bp, Rattus norvegicus
gatctcgtgcaagtgttgtctatgt

SEQ ID NO: 363550 - DNA, 25 bp, Rattus norvegicus
gatctcgtgtatactgtagcccaaa

SEQ ID NO: 363551 - DNA, 25 bp, Rattus norvegicus
gatctcgtgtattctgtagcccaaa

SEQ ID NO: 363552 - DNA, 25 bp, Rattus norvegicus
gatctcgtgtcaatagagtcaccaa

SEQ ID NO: 363553 - DNA, 25 bp, Rattus norvegicus
gatctcgtgtcattagagtcaccaa

SEQ ID NO: 363554 - DNA, 25 bp, Rattus norvegicus
gatctcgttgcccatgtaggagtag

SEQ ID NO: 363555 - DNA, 25 bp, Rattus norvegicus
gatctcgttgccgatgtaggagtag

SEQ ID NO: 363556 - DNA, 25 bp, Rattus norvegicus
gatctcgttggtcactttacagtag

SEQ ID NO: 363557 - DNA, 25 bp, Rattus norvegicus
gatctcgttggtgactttacagtag

SEQ ID NO: 363558 - DNA, 25 bp, Rattus norvegicus
gatctctacacaataaggcgacgaa

SEQ ID NO: 363559 - DNA, 25 bp, Rattus norvegicus
gatctctacacattaaggcgacgaa

SEQ ID NO: 363560 - DNA, 25 bp, Rattus norvegicus
gatctctacctgacggtgtttgtaa

SEQ ID NO: 363561 - DNA, 25 bp, Rattus norvegicus
gatctctacctgtcggtgtttgtaa

SEQ ID NO: 363562 - DNA, 25 bp, Rattus norvegicus
gatctctacggtcggtcagctcttt

SEQ ID NO: 363563 - DNA, 25 bp, Rattus norvegicus
gatctctacggtgggtcagctcttt

SEQ ID NO: 363564 - DNA, 25 bp, Rattus norvegicus
gatctctactcaaagctggtaccca

SEQ ID NO: 363565 - DNA, 25 bp, Rattus norvegicus
gatctctactcatagctggtaccca

SEQ ID NO: 363566 - DNA, 25 bp, Rattus norvegicus
gatctctacttcaactatgtggata

SEQ ID NO: 363567 - DNA, 25 bp, Rattus norvegicus
gatctctacttctactatgtggata

SEQ ID NO: 363568 - DNA, 25 bp, Rattus norvegicus
gatctctagactataccacagacag

SEQ ID NO: 363569 - DNA, 25 bp, Rattus norvegicus
gatctctagactttaccacagacag

SEQ ID NO: 363570 - DNA, 25 bp, Rattus norvegicus
gatctctagatacagcaatgctttc

SEQ ID NO: 363571 - DNA, 25 bp, Rattus norvegicus
gatctctagatagagcaatgctttc

SEQ ID NO: 363572 - DNA, 25 bp, Rattus norvegicus
gatctctagctcagtagccaaagcc

SEQ ID NO: 363573 - DNA, 25 bp, Rattus norvegicus
gatctctagctctgtagccaaagcc

SEQ ID NO: 363574 - DNA, 25 bp, Rattus norvegicus
gatctctagtacatcctggcgaggc

SEQ ID NO: 363575 - DNA, 25 bp, Rattus norvegicus
gatctctagtacttcctggcgaggc

SEQ ID NO: 363576 - DNA, 25 bp, Rattus norvegicus
gatctctatgatcgtgggtagcttt

SEQ ID NO: 363577 - DNA, 25 bp, Rattus norvegicus
gatctctatgatggtgggtagcttt

SEQ ID NO: 363578 - DNA, 25 bp, Rattus norvegicus
gatctctattctctctataacatga

SEQ ID NO: 363579 - DNA, 25 bp, Rattus norvegicus
gatctctattctgtctataacatga

SEQ ID NO: 363580 - DNA, 25 bp, Rattus norvegicus
gatctctcagttatccaggctggaa

SEQ ID NO: 363581 - DNA, 25 bp, Rattus norvegicus
gatctctcagttttccaggctggaa

SEQ ID NO: 363582 - DNA, 25 bp, Rattus norvegicus
gatctctcatacctttagcgccatc

SEQ ID NO: 363583 - DNA, 25 bp, Rattus norvegicus
gatctctcatacgtttagcgccatc

SEQ ID NO: 363584 - DNA, 25 bp, Rattus norvegicus
gatctctccacaagcgagtacatct

SEQ ID NO: 363585 - DNA, 25 bp, Rattus norvegicus
gatctctccacatgcgagtacatct

SEQ ID NO: 363586 - DNA, 25 bp, Rattus norvegicus
gatctctccaggcaactaacatcag

SEQ ID NO: 363587 - DNA, 25 bp, Rattus norvegicus
gatctctccaggcaagccacagtat

SEQ ID NO: 363588 - DNA, 25 bp, Rattus norvegicus
gatctctccagggaactaacatcag

SEQ ID NO: 363589 - DNA, 25 bp, Rattus norvegicus
gatctctccagggaagccacagtat

SEQ ID NO: 363590 - DNA, 25 bp, Rattus norvegicus
gatctctctcgtcatttggttgcac

SEQ ID NO: 363591 - DNA, 25 bp, Rattus norvegicus
gatctctctcgtgatttggttgcac

SEQ ID NO: 363592 - DNA, 25 bp, Rattus norvegicus
gatctctctgaaactggagctagaa

SEQ ID NO: 363593 - DNA, 25 bp, Rattus norvegicus
gatctctctgaatctggagctagaa

SEQ ID NO: 363594 - DNA, 25 bp, Rattus norvegicus
gatctctctgatatttcgctaatga

SEQ ID NO: 363595 - DNA, 25 bp, Rattus norvegicus
gatctctctgatttttcgctaatga

SEQ ID NO: 363596 - DNA, 25 bp, Rattus norvegicus
gatctctctgttcacccggaaagag

SEQ ID NO: 363597 - DNA, 25 bp, Rattus norvegicus
gatctctctgttgacccggaaagag

SEQ ID NO: 363598 - DNA, 25 bp, Rattus norvegicus
gatctctgaagtaatgctccatact

SEQ ID NO: 363599 - DNA, 25 bp, Rattus norvegicus
gatctctgaagttatgctccatact

SEQ ID NO: 363600 - DNA, 25 bp, Rattus norvegicus
gatctctgagaccactgaggtgtta

SEQ ID NO: 363601 - DNA, 25 bp, Rattus norvegicus
gatctctgagacgactgaggtgtta

SEQ ID NO: 363602 - DNA, 25 bp, Rattus norvegicus
gatctctgatgcctgtgcatacagt

SEQ ID NO: 363603 - DNA, 25 bp, Rattus norvegicus
gatctctgatgcgtgtgcatacagt

SEQ ID NO: 363604 - DNA, 25 bp, Rattus norvegicus
gatctctgatttagagggcagccca

SEQ ID NO: 363605 - DNA, 25 bp, Rattus norvegicus
gatctctgattttgagggcagccca

SEQ ID NO: 363606 - DNA, 25 bp, Rattus norvegicus
gatctctgcattaaaggtctgtcta

SEQ ID NO: 363607 - DNA, 25 bp, Rattus norvegicus
gatctctgcatttaaggtctgtcta

SEQ ID NO: 363608 - DNA, 25 bp, Rattus norvegicus
gatctctgccatattcatacaacta

SEQ ID NO: 363609 - DNA, 25 bp, Rattus norvegicus
gatctctgccatattgagtacttgt

SEQ ID NO: 363610 - DNA, 25 bp, Rattus norvegicus
gatctctgccattttcatacaacta

SEQ ID NO: 363611 - DNA, 25 bp, Rattus norvegicus
gatctctgccattttgagtacttgt

SEQ ID NO: 363612 - DNA, 25 bp, Rattus norvegicus
gatctctgcgcccactagtttgatt

SEQ ID NO: 363613 - DNA, 25 bp, Rattus norvegicus
gatctctgcgccgactagtttgatt

SEQ ID NO: 363614 - DNA, 25 bp, Rattus norvegicus
gatctctgctaaacaacagcggttg

SEQ ID NO: 363615 - DNA, 25 bp, Rattus norvegicus
gatctctgctaatcaacagcggttg

SEQ ID NO: 363616 - DNA, 25 bp, Rattus norvegicus
gatctctgctcacgacacagtacca

SEQ ID NO: 363617 - DNA, 25 bp, Rattus norvegicus
gatctctgctcaggacacagtacca

SEQ ID NO: 363618 - DNA, 25 bp, Rattus norvegicus
gatctctggcagaactgtaccacat

SEQ ID NO: 363619 - DNA, 25 bp, Rattus norvegicus
gatctctggcagtactgtaccacat

SEQ ID NO: 363620 - DNA, 25 bp, Rattus norvegicus
gatctctggctactcaagtttttca

SEQ ID NO: 363621 - DNA, 25 bp, Rattus norvegicus
gatctctggctagtcaagtttttca

SEQ ID NO: 363622 - DNA, 25 bp, Rattus norvegicus
gatctctgggtcatcgtgtttctta

SEQ ID NO: 363623 - DNA, 25 bp, Rattus norvegicus
gatctctgggtcctacttaaatagc

SEQ ID NO: 363624 - DNA, 25 bp, Rattus norvegicus
gatctctgggtcgtacttaaatagc

SEQ ID NO: 363625 - DNA, 25 bp, Rattus norvegicus
gatctctgggtcttcgtgtttctta

SEQ ID NO: 363626 - DNA, 25 bp, Rattus norvegicus
gatctctgtataactacctatattt

SEQ ID NO: 363627 - DNA, 25 bp, Rattus norvegicus
gatctctgtatatctacctatattt

SEQ ID NO: 363628 - DNA, 25 bp, Rattus norvegicus
gatctctgtcagcacatacaccttg

SEQ ID NO: 363629 - DNA, 25 bp, Rattus norvegicus
gatctctgtcaggacatacaccttg

SEQ ID NO: 363630 - DNA, 25 bp, Rattus norvegicus
gatctctgtctcaggacattccaga

SEQ ID NO: 363631 - DNA, 25 bp, Rattus norvegicus
gatctctgtctctggacattccaga

SEQ ID NO: 363632 - DNA, 25 bp, Rattus norvegicus
gatctctgtgtgaatggatgtctca

SEQ ID NO: 363633 - DNA, 25 bp, Rattus norvegicus
gatctctgtgtgtatggatgtctca

SEQ ID NO: 363634 - DNA, 25 bp, Rattus norvegicus
gatctctgttaaacttggctaaacc

SEQ ID NO: 363635 - DNA, 25 bp, Rattus norvegicus
gatctctgttaaagccccatatgtg

SEQ ID NO: 363636 - DNA, 25 bp, Rattus norvegicus
gatctctgttaatcttggctaaacc

SEQ ID NO: 363637 - DNA, 25 bp, Rattus norvegicus
gatctctgttaatgccccatatgtg

SEQ ID NO: 363638 - DNA, 25 bp, Rattus norvegicus
gatctcttaacaatcaggtctcaca

SEQ ID NO: 363639 - DNA, 25 bp, Rattus norvegicus
gatctcttaacattcaggtctcaca

SEQ ID NO: 363640 - DNA, 25 bp, Rattus norvegicus
gatctcttacttaatgacttgggaa

SEQ ID NO: 363641 - DNA, 25 bp, Rattus norvegicus
gatctcttacttatctatgcattct

SEQ ID NO: 363642 - DNA, 25 bp, Rattus norvegicus
gatctcttactttatgacttgggaa

SEQ ID NO: 363643 - DNA, 25 bp, Rattus norvegicus
gatctcttacttttctatgcattct

SEQ ID NO: 363644 - DNA, 25 bp, Rattus norvegicus
gatctcttagagctatccaccgtga

SEQ ID NO: 363645 - DNA, 25 bp, Rattus norvegicus
gatctcttagaggtatccaccgtga

SEQ ID NO: 363646 - DNA, 25 bp, Rattus norvegicus
gatctcttaggtcttatgtcacttg

SEQ ID NO: 363647 - DNA, 25 bp, Rattus norvegicus
gatctcttaggtgttatgtcacttg

SEQ ID NO: 363648 - DNA, 25 bp, Rattus norvegicus
gatctcttcaagatcagactggcta

SEQ ID NO: 363649 - DNA, 25 bp, Rattus norvegicus
gatctcttcaagttcagactggcta

SEQ ID NO: 363650 - DNA, 25 bp, Rattus norvegicus
gatctcttccagaactggtcatgcg

SEQ ID NO: 363651 - DNA, 25 bp, Rattus norvegicus
gatctcttccagtactggtcatgcg

SEQ ID NO: 363652 - DNA, 25 bp, Rattus norvegicus
gatctcttccgcatgtttgacaaaa

SEQ ID NO: 363653 - DNA, 25 bp, Rattus norvegicus
gatctcttccgcttgtttgacaaaa

SEQ ID NO: 363654 - DNA, 25 bp, Rattus norvegicus
gatctcttcgagcttggtgatgtag

SEQ ID NO: 363655 - DNA, 25 bp, Rattus norvegicus
gatctcttcgaggttggtgatgtag

SEQ ID NO: 363656 - DNA, 25 bp, Rattus norvegicus
gatctcttgagtatgggccagcaca

SEQ ID NO: 363657 - DNA, 25 bp, Rattus norvegicus
gatctcttgagtttgggccagcaca

SEQ ID NO: 363658 - DNA, 25 bp, Rattus norvegicus
gatctctttaatactggcatagcag

SEQ ID NO: 363659 - DNA, 25 bp, Rattus norvegicus
gatctctttaattctggcatagcag

SEQ ID NO: 363660 - DNA, 25 bp, Rattus norvegicus
gatctctttcatagtacactgacgg

SEQ ID NO: 363661 - DNA, 25 bp, Rattus norvegicus
gatctctttcattgtacactgacgg

SEQ ID NO: 363662 - DNA, 25 bp, Rattus norvegicus
gatctctttgcacaaacttttccag

SEQ ID NO: 363663 - DNA, 25 bp, Rattus norvegicus
gatctctttgcagaaacttttccag

SEQ ID NO: 363664 - DNA, 25 bp, Rattus norvegicus
gatctctttgtaacatttctcttca

SEQ ID NO: 363665 - DNA, 25 bp, Rattus norvegicus
gatctctttgtatcatttctcttca

SEQ ID NO: 363666 - DNA, 25 bp, Rattus norvegicus
gatctctttgtgagtctactttcaa

SEQ ID NO: 363667 - DNA, 25 bp, Rattus norvegicus
gatctctttgtgtgtctactttcaa

SEQ ID NO: 363668 - DNA, 25 bp, Rattus norvegicus
gatctcttttatcatatttccagct

SEQ ID NO: 363669 - DNA, 25 bp, Rattus norvegicus
gatctcttttatgatatttccagct

SEQ ID NO: 363670 - DNA, 25 bp, Rattus norvegicus
gatctcttttcaaccatgtgataca

SEQ ID NO: 363671 - DNA, 25 bp, Rattus norvegicus
gatctcttttcatccatgtgataca

SEQ ID NO: 363672 - DNA, 25 bp, Rattus norvegicus
gatctcttttctacatttcttttcc

SEQ ID NO: 363673 - DNA, 25 bp, Rattus norvegicus
gatctcttttcttcatttcttttcc

SEQ ID NO: 363674 - DNA, 25 bp, Rattus norvegicus
gatctgaacaagagtatgtgcttta

SEQ ID NO: 363675 - DNA, 25 bp, Rattus norvegicus
gatctgaacaagtgtatgtgcttta

SEQ ID NO: 363676 - DNA, 25 bp, Rattus norvegicus
gatctgaacttgagcaccagccttg

SEQ ID NO: 363677 - DNA, 25 bp, Rattus norvegicus
gatctgaacttgtgcaccagccttg

SEQ ID NO: 363678 - DNA, 25 bp, Rattus norvegicus
gatctgaagatcaccctatctaagg

SEQ ID NO: 363679 - DNA, 25 bp, Rattus norvegicus
gatctgaagatctccctatctaagg

SEQ ID NO: 363680 - DNA, 25 bp, Rattus norvegicus
gatctgaagtcgcaggttaagcttg

SEQ ID NO: 363681 - DNA, 25 bp, Rattus norvegicus
gatctgaagtcggaggttaagcttg

SEQ ID NO: 363682 - DNA, 25 bp, Rattus norvegicus
gatctgaatcacatcttaggacata

SEQ ID NO: 363683 - DNA, 25 bp, Rattus norvegicus
gatctgaatcacttcttaggacata

SEQ ID NO: 363684 - DNA, 25 bp, Rattus norvegicus
gatctgaatgctatgttggcagcgt

SEQ ID NO: 363685 - DNA, 25 bp, Rattus norvegicus
gatctgaatgctttgttggcagcgt

SEQ ID NO: 363686 - DNA, 25 bp, Rattus norvegicus
gatctgacacccatacaaatccata

SEQ ID NO: 363687 - DNA, 25 bp, Rattus norvegicus
gatctgacacccttacaaatccata

SEQ ID NO: 363688 - DNA, 25 bp, Rattus norvegicus
gatctgacccacagaccaacatgga

SEQ ID NO: 363689 - DNA, 25 bp, Rattus norvegicus
gatctgacccactgaccaacatgga

SEQ ID NO: 363690 - DNA, 25 bp, Rattus norvegicus
gatctgacccgtattctggatagta

SEQ ID NO: 363691 - DNA, 25 bp, Rattus norvegicus
gatctgacccgttttctggatagta

SEQ ID NO: 363692 - DNA, 25 bp, Rattus norvegicus
gatctgactactctgcaaaccaagg

SEQ ID NO: 363693 - DNA, 25 bp, Rattus norvegicus
gatctgactactgtgcaaaccaagg

SEQ ID NO: 363694 - DNA, 25 bp, Rattus norvegicus
gatctgactcctaggactccttgga

SEQ ID NO: 363695 - DNA, 25 bp, Rattus norvegicus
gatctgactccttggactccttgga

SEQ ID NO: 363696 - DNA, 25 bp, Rattus norvegicus
gatctgactttcaagacctggactc

SEQ ID NO: 363697 - DNA, 25 bp, Rattus norvegicus
gatctgactttctagacctggactc

SEQ ID NO: 363698 - DNA, 25 bp, Rattus norvegicus
gatctgagcgaaccagcgtctcctt

SEQ ID NO: 363699 - DNA, 25 bp, Rattus norvegicus
gatctgagcgaagcagcgtctcctt

SEQ ID NO: 363700 - DNA, 25 bp, Rattus norvegicus
gatctgagcgcaacagtgtctcctt

SEQ ID NO: 363701 - DNA, 25 bp, Rattus norvegicus
gatctgagcgcatcagtgtctcctt

SEQ ID NO: 363702 - DNA, 25 bp, Rattus norvegicus
gatctgaggctgcttcatgtgaatt

SEQ ID NO: 363703 - DNA, 25 bp, Rattus norvegicus
gatctgaggctggttcatgtgaatt

SEQ ID NO: 363704 - DNA, 25 bp, Rattus norvegicus
gatctgagggtcacatctatgttga

SEQ ID NO: 363705 - DNA, 25 bp, Rattus norvegicus
gatctgagggtctcatctatgttga

SEQ ID NO: 363706 - DNA, 25 bp, Rattus norvegicus
gatctgaggtatcagtggcactgtt

SEQ ID NO: 363707 - DNA, 25 bp, Rattus norvegicus
gatctgaggtatgagtggcactgtt

SEQ ID NO: 363708 - DNA, 25 bp, Rattus norvegicus
gatctgaggttcaatgtctttcaac

SEQ ID NO: 363709 - DNA, 25 bp, Rattus norvegicus
gatctgaggttctatgtctttcaac

SEQ ID NO: 363710 - DNA, 25 bp, Rattus norvegicus
gatctgatacatcaagcacagcaat

SEQ ID NO: 363711 - DNA, 25 bp, Rattus norvegicus
gatctgatacatgaagcacagcaat

SEQ ID NO: 363712 - DNA, 25 bp, Rattus norvegicus
gatctgatcgtcaagtgtattggtg

SEQ ID NO: 363713 - DNA, 25 bp, Rattus norvegicus
gatctgatcgtctagtgtattggtg

SEQ ID NO: 363714 - DNA, 25 bp, Rattus norvegicus
gatctgatctatctttcatcctggt

SEQ ID NO: 363715 - DNA, 25 bp, Rattus norvegicus
gatctgatctatgtttcatcctggt

SEQ ID NO: 363716 - DNA, 25 bp, Rattus norvegicus
gatctgatgcctattatgggctcta

SEQ ID NO: 363717 - DNA, 25 bp, Rattus norvegicus
gatctgatgccttttatgggctcta

SEQ ID NO: 363718 - DNA, 25 bp, Rattus norvegicus
gatctgatgctgctacatctcagcc

SEQ ID NO: 363719 - DNA, 25 bp, Rattus norvegicus
gatctgatgctggtacatctcagcc

SEQ ID NO: 363720 - DNA, 25 bp, Rattus norvegicus
gatctgatgtacatcaacacactga

SEQ ID NO: 363721 - DNA, 25 bp, Rattus norvegicus
gatctgatgtacttcaacacactga

SEQ ID NO: 363722 - DNA, 25 bp, Rattus norvegicus
gatctgattgggaacaactgtcctt

SEQ ID NO: 363723 - DNA, 25 bp, Rattus norvegicus
gatctgattgggtacaactgtcctt

SEQ ID NO: 363724 - DNA, 25 bp, Rattus norvegicus
gatctgatttatactttaggtggtc

SEQ ID NO: 363725 - DNA, 25 bp, Rattus norvegicus
gatctgatttattctttaggtggtc

SEQ ID NO: 363726 - DNA, 25 bp, Rattus norvegicus
gatctgatttctctgtttgacggta

SEQ ID NO: 363727 - DNA, 25 bp, Rattus norvegicus
gatctgatttctgtgtttgacggta

SEQ ID NO: 363728 - DNA, 25 bp, Rattus norvegicus
gatctgcaaccacagctgtccatca

SEQ ID NO: 363729 - DNA, 25 bp, Rattus norvegicus
gatctgcaaccagagctgtccatca

SEQ ID NO: 363730 - DNA, 25 bp, Rattus norvegicus
gatctgcacactctatttcgcagta

SEQ ID NO: 363731 - DNA, 25 bp, Rattus norvegicus
gatctgcacactgtatttcgcagta

SEQ ID NO: 363732 - DNA, 25 bp, Rattus norvegicus
gatctgcacagacggactgggctta

SEQ ID NO: 363733 - DNA, 25 bp, Rattus norvegicus
gatctgcacagagggactgggctta

SEQ ID NO: 363734 - DNA, 25 bp, Rattus norvegicus
gatctgcaccagactgttaacttgt

SEQ ID NO: 363735 - DNA, 25 bp, Rattus norvegicus
gatctgcaccagtctgttaacttgt

SEQ ID NO: 363736 - DNA, 25 bp, Rattus norvegicus
gatctgcactgaatggctgacctga

SEQ ID NO: 363737 - DNA, 25 bp, Rattus norvegicus
gatctgcactgattggctgacctga

SEQ ID NO: 363738 - DNA, 25 bp, Rattus norvegicus
gatctgcagaccaaaatccttcagt

SEQ ID NO: 363739 - DNA, 25 bp, Rattus norvegicus
gatctgcagacctaaatccttcagt

SEQ ID NO: 363740 - DNA, 25 bp, Rattus norvegicus
gatctgcagcaccacataaatggga

SEQ ID NO: 363741 - DNA, 25 bp, Rattus norvegicus
gatctgcagcacgacataaatggga

SEQ ID NO: 363742 - DNA, 25 bp, Rattus norvegicus
gatctgcaggagaccatggacatga

SEQ ID NO: 363743 - DNA, 25 bp, Rattus norvegicus
gatctgcaggagtccatggacatga

SEQ ID NO: 363744 - DNA, 25 bp, Rattus norvegicus
gatctgcagtagattttcagcctct

SEQ ID NO: 363745 - DNA, 25 bp, Rattus norvegicus
gatctgcagtagtttttcagcctct

SEQ ID NO: 363746 - DNA, 25 bp, Rattus norvegicus
gatctgcagtttcatttattcccaa

SEQ ID NO: 363747 - DNA, 25 bp, Rattus norvegicus
gatctgcagtttgatttattcccaa

SEQ ID NO: 363748 - DNA, 25 bp, Rattus norvegicus
gatctgcatcctctcaggtttttat

SEQ ID NO: 363749 - DNA, 25 bp, Rattus norvegicus
gatctgcatcctgtcaggtttttat

SEQ ID NO: 363750 - DNA, 25 bp, Rattus norvegicus
gatctgcatgtcataattggtaaat

SEQ ID NO: 363751 - DNA, 25 bp, Rattus norvegicus
gatctgcatgtcttaattggtaaat

SEQ ID NO: 363752 - DNA, 25 bp, Rattus norvegicus
gatctgcattacactaaacctgccc

SEQ ID NO: 363753 - DNA, 25 bp, Rattus norvegicus
gatctgcattactctaaacctgccc

SEQ ID NO: 363754 - DNA, 25 bp, Rattus norvegicus
gatctgcattgtaggctgtgttcat

SEQ ID NO: 363755 - DNA, 25 bp, Rattus norvegicus
gatctgcattgttggctgtgttcat

SEQ ID NO: 363756 - DNA, 25 bp, Rattus norvegicus
gatctgccgggcacacggtgagctt

SEQ ID NO: 363757 - DNA, 25 bp, Rattus norvegicus
gatctgccgggctcacggtgagctt

SEQ ID NO: 363758 - DNA, 25 bp, Rattus norvegicus
gatctgcctattaccaagatgccat

SEQ ID NO: 363759 - DNA, 25 bp, Rattus norvegicus
gatctgcctatttccaagatgccat

SEQ ID NO: 363760 - DNA, 25 bp, Rattus norvegicus
gatctgcctgttcgtcttggactca

SEQ ID NO: 363761 - DNA, 25 bp, Rattus norvegicus
gatctgcctgttggtcttggactca

SEQ ID NO: 363762 - DNA, 25 bp, Rattus norvegicus
gatctgccttacagctggatctaag

SEQ ID NO: 363763 - DNA, 25 bp, Rattus norvegicus
gatctgccttactgctggatctaag

SEQ ID NO: 363764 - DNA, 25 bp, Rattus norvegicus
gatctgcgggcactcccggtctcta

SEQ ID NO: 363765 - DNA, 25 bp, Rattus norvegicus
gatctgcgggcagtcccggtctcta

SEQ ID NO: 363766 - DNA, 25 bp, Rattus norvegicus
gatctgctaaaaaggccaggctgcc

SEQ ID NO: 363767 - DNA, 25 bp, Rattus norvegicus
gatctgctaaaatggccaggctgcc

SEQ ID NO: 363768 - DNA, 25 bp, Rattus norvegicus
gatctgctaagcagtgaggttctaa

SEQ ID NO: 363769 - DNA, 25 bp, Rattus norvegicus
gatctgctaagcattgggagacttt

SEQ ID NO: 363770 - DNA, 25 bp, Rattus norvegicus
gatctgctaagctgtgaggttctaa

SEQ ID NO: 363771 - DNA, 25 bp, Rattus norvegicus
gatctgctaagctttgggagacttt

SEQ ID NO: 363772 - DNA, 25 bp, Rattus norvegicus
gatctgctacatctgagcgccagga

SEQ ID NO: 363773 - DNA, 25 bp, Rattus norvegicus
gatctgctacatgtgagcgccagga

SEQ ID NO: 363774 - DNA, 25 bp, Rattus norvegicus
gatctgctactgcaatttcagcgaa

SEQ ID NO: 363775 - DNA, 25 bp, Rattus norvegicus
gatctgctactggaatttcagcgaa

SEQ ID NO: 363776 - DNA, 25 bp, Rattus norvegicus
gatctgctatcaaatcgaatctatg

SEQ ID NO: 363777 - DNA, 25 bp, Rattus norvegicus
gatctgctatcatatcgaatctatg

SEQ ID NO: 363778 - DNA, 25 bp, Rattus norvegicus
gatctgctattcagtgttgtgtctc

SEQ ID NO: 363779 - DNA, 25 bp, Rattus norvegicus
gatctgctattctgtgttgtgtctc

SEQ ID NO: 363780 - DNA, 25 bp, Rattus norvegicus
gatctgctcaagaatgaccccatgg

SEQ ID NO: 363781 - DNA, 25 bp, Rattus norvegicus
gatctgctcaagtatgaccccatgg

SEQ ID NO: 363782 - DNA, 25 bp, Rattus norvegicus
gatctgctcactcctggatgctgat

SEQ ID NO: 363783 - DNA, 25 bp, Rattus norvegicus
gatctgctcactgctggatgctgat

SEQ ID NO: 363784 - DNA, 25 bp, Rattus norvegicus
gatctgctcatgataaatggaggct

SEQ ID NO: 363785 - DNA, 25 bp, Rattus norvegicus
gatctgctcatgttaaatggaggct

SEQ ID NO: 363786 - DNA, 25 bp, Rattus norvegicus
gatctgctccaacaaatgtctgtga

SEQ ID NO: 363787 - DNA, 25 bp, Rattus norvegicus
gatctgctccaagaaatgtctgtga

SEQ ID NO: 363788 - DNA, 25 bp, Rattus norvegicus
gatctgctccttataactttggtgc

SEQ ID NO: 363789 - DNA, 25 bp, Rattus norvegicus
gatctgctccttttaactttggtgc

SEQ ID NO: 363790 - DNA, 25 bp, Rattus norvegicus
gatctgctctcaacgggtacaaagg

SEQ ID NO: 363791 - DNA, 25 bp, Rattus norvegicus
gatctgctctcatcgggtacaaagg

SEQ ID NO: 363792 - DNA, 25 bp, Rattus norvegicus
gatctgctctggataaatccttctg

SEQ ID NO: 363793 - DNA, 25 bp, Rattus norvegicus
gatctgctctggttaaatccttctg

SEQ ID NO: 363794 - DNA, 25 bp, Rattus norvegicus
gatctgctgaaactgctagccatct

SEQ ID NO: 363795 - DNA, 25 bp, Rattus norvegicus
gatctgctgaaagtgctagccatct

SEQ ID NO: 363796 - DNA, 25 bp, Rattus norvegicus
gatctgctgcaactgaagtactccc

SEQ ID NO: 363797 - DNA, 25 bp, Rattus norvegicus
gatctgctgcaagtgaagtactccc

SEQ ID NO: 363798 - DNA, 25 bp, Rattus norvegicus
gatctgctgccgattcatcttcgaa

SEQ ID NO: 363799 - DNA, 25 bp, Rattus norvegicus
gatctgctgccgtttcatcttcgaa

SEQ ID NO: 363800 - DNA, 25 bp, Rattus norvegicus
gatctgctgtagaacttcactgtgg

SEQ ID NO: 363801 - DNA, 25 bp, Rattus norvegicus
gatctgctgtagtacttcactgtgg

SEQ ID NO: 363802 - DNA, 25 bp, Rattus norvegicus
gatctgctttgtccttggctgcaga

SEQ ID NO: 363803 - DNA, 25 bp, Rattus norvegicus
gatctgctttgtgcttggctgcaga

SEQ ID NO: 363804 - DNA, 25 bp, Rattus norvegicus
gatctgcttttcaatgtgaccatcg

SEQ ID NO: 363805 - DNA, 25 bp, Rattus norvegicus
gatctgcttttctatgtgaccatcg

SEQ ID NO: 363806 - DNA, 25 bp, Rattus norvegicus
gatctgcttttgagctaaggcctag

SEQ ID NO: 363807 - DNA, 25 bp, Rattus norvegicus
gatctgcttttgtgctaaggcctag

SEQ ID NO: 363808 - DNA, 25 bp, Rattus norvegicus
gatctggaaaggctatgccttccaa

SEQ ID NO: 363809 - DNA, 25 bp, Rattus norvegicus
gatctggaaagggtatgccttccaa

SEQ ID NO: 363810 - DNA, 25 bp, Rattus norvegicus
gatctggaacagaggctaggctctc

SEQ ID NO: 363811 - DNA, 25 bp, Rattus norvegicus
gatctggaacagtggctaggctctc

SEQ ID NO: 363812 - DNA, 25 bp, Rattus norvegicus
gatctggaagcaacactgacctagc

SEQ ID NO: 363813 - DNA, 25 bp, Rattus norvegicus
gatctggaagcatcactgacctagc

SEQ ID NO: 363814 - DNA, 25 bp, Rattus norvegicus
gatctggaataaaactccgctccct

SEQ ID NO: 363815 - DNA, 25 bp, Rattus norvegicus
gatctggaataatactccgctccct

SEQ ID NO: 363816 - DNA, 25 bp, Rattus norvegicus
gatctggaattgattactttctaca

SEQ ID NO: 363817 - DNA, 25 bp, Rattus norvegicus
gatctggaattgtttactttctaca

SEQ ID NO: 363818 - DNA, 25 bp, Rattus norvegicus
gatctggacagaaccacatagcctt

SEQ ID NO: 363819 - DNA, 25 bp, Rattus norvegicus
gatctggacagatccacatagcctt

SEQ ID NO: 363820 - DNA, 25 bp, Rattus norvegicus
gatctggactgtaatttgctttgaa

SEQ ID NO: 363821 - DNA, 25 bp, Rattus norvegicus
gatctggactgttatttgctttgaa

SEQ ID NO: 363822 - DNA, 25 bp, Rattus norvegicus
gatctggactttctggctttgtagc

SEQ ID NO: 363823 - DNA, 25 bp, Rattus norvegicus
gatctggactttgtggctttgtagc

SEQ ID NO: 363824 - DNA, 25 bp, Rattus norvegicus
gatctggagaccaggctaaccttga

SEQ ID NO: 363825 - DNA, 25 bp, Rattus norvegicus
gatctggagacctggctaaccttga

SEQ ID NO: 363826 - DNA, 25 bp, Rattus norvegicus
gatctggagataccatgcagccaca

SEQ ID NO: 363827 - DNA, 25 bp, Rattus norvegicus
gatctggagatagcatgcagccaca

SEQ ID NO: 363828 - DNA, 25 bp, Rattus norvegicus
gatctggagctccatggaagcctct

SEQ ID NO: 363829 - DNA, 25 bp, Rattus norvegicus
gatctggagctcgatggaagcctct

SEQ ID NO: 363830 - DNA, 25 bp, Rattus norvegicus
gatctggagtccaattagcaaagct

SEQ ID NO: 363831 - DNA, 25 bp, Rattus norvegicus
gatctggagtcctattagcaaagct

SEQ ID NO: 363832 - DNA, 25 bp, Rattus norvegicus
gatctggagtgtcctgagactgcca

SEQ ID NO: 363833 - DNA, 25 bp, Rattus norvegicus
gatctggagtgtgctgagactgcca

SEQ ID NO: 363834 - DNA, 25 bp, Rattus norvegicus
gatctggatgaccatgctgaggcaa

SEQ ID NO: 363835 - DNA, 25 bp, Rattus norvegicus
gatctggatgacgatgctgaggcaa

SEQ ID NO: 363836 - DNA, 25 bp, Rattus norvegicus
gatctggatgccaacctggtacaga

SEQ ID NO: 363837 - DNA, 25 bp, Rattus norvegicus
gatctggatgcccttcggaaggcca

SEQ ID NO: 363838 - DNA, 25 bp, Rattus norvegicus
gatctggatgccgttcggaaggcca

SEQ ID NO: 363839 - DNA, 25 bp, Rattus norvegicus
gatctggatgcctacctggtacaga

SEQ ID NO: 363840 - DNA, 25 bp, Rattus norvegicus
gatctggatgctccaatatgaggaa

SEQ ID NO: 363841 - DNA, 25 bp, Rattus norvegicus
gatctggatgctgcaatatgaggaa

SEQ ID NO: 363842 - DNA, 25 bp, Rattus norvegicus
gatctggcacccagttgtcttatgg

SEQ ID NO: 363843 - DNA, 25 bp, Rattus norvegicus
gatctggcaccctgttgtcttatgg

SEQ ID NO: 363844 - DNA, 25 bp, Rattus norvegicus
gatctggcactaactgacaactgag

SEQ ID NO: 363845 - DNA, 25 bp, Rattus norvegicus
gatctggcactatctgacaactgag

SEQ ID NO: 363846 - DNA, 25 bp, Rattus norvegicus
gatctggcagcgatagaggacctga

SEQ ID NO: 363847 - DNA, 25 bp, Rattus norvegicus
gatctggcagcgttagaggacctga

SEQ ID NO: 363848 - DNA, 25 bp, Rattus norvegicus
gatctggcctggagacacagttcaa

SEQ ID NO: 363849 - DNA, 25 bp, Rattus norvegicus
gatctggcctggtgacacagttcaa

SEQ ID NO: 363850 - DNA, 25 bp, Rattus norvegicus
gatctggctcttcttgtgaggcaag

SEQ ID NO: 363851 - DNA, 25 bp, Rattus norvegicus
gatctggctcttgttgtgaggcaag

SEQ ID NO: 363852 - DNA, 25 bp, Rattus norvegicus
gatctggctgacctagacacactag

SEQ ID NO: 363853 - DNA, 25 bp, Rattus norvegicus
gatctggctgacgtagacacactag

SEQ ID NO: 363854 - DNA, 25 bp, Rattus norvegicus
gatctggctggaatgacacaccttt

SEQ ID NO: 363855 - DNA, 25 bp, Rattus norvegicus
gatctggctggattgacacaccttt

SEQ ID NO: 363856 - DNA, 25 bp, Rattus norvegicus
gatctggctgtcagcattcgaatga

SEQ ID NO: 363857 - DNA, 25 bp, Rattus norvegicus
gatctggctgtctgcattcgaatga

SEQ ID NO: 363858 - DNA, 25 bp, Rattus norvegicus
gatctgggaagcaactgctcgcaga

SEQ ID NO: 363859 - DNA, 25 bp, Rattus norvegicus
gatctgggaagctactgctcgcaga

SEQ ID NO: 363860 - DNA, 25 bp, Rattus norvegicus
gatctgggaatcatctcctttgatt

SEQ ID NO: 363861 - DNA, 25 bp, Rattus norvegicus
gatctgggaatcttctcctttgatt

SEQ ID NO: 363862 - DNA, 25 bp, Rattus norvegicus
gatctgggagctcttgacgatgaac

SEQ ID NO: 363863 - DNA, 25 bp, Rattus norvegicus
gatctgggagctgttgacgatgaac

SEQ ID NO: 363864 - DNA, 25 bp, Rattus norvegicus
gatctgggattcaagggcacctctt

SEQ ID NO: 363865 - DNA, 25 bp, Rattus norvegicus
gatctgggattctagggcacctctt

SEQ ID NO: 363866 - DNA, 25 bp, Rattus norvegicus
gatctgggccaaacagatgcccgaa

SEQ ID NO: 363867 - DNA, 25 bp, Rattus norvegicus
gatctgggccaatcagatgcccgaa

SEQ ID NO: 363868 - DNA, 25 bp, Rattus norvegicus
gatctgggcgtaccaacaagtctcc

SEQ ID NO: 363869 - DNA, 25 bp, Rattus norvegicus
gatctgggcgtagcaacaagtctcc

SEQ ID NO: 363870 - DNA, 25 bp, Rattus norvegicus
gatctgggctacaatttacttaaca

SEQ ID NO: 363871 - DNA, 25 bp, Rattus norvegicus
gatctgggctactatttacttaaca

SEQ ID NO: 363872 - DNA, 25 bp, Rattus norvegicus
gatctgggtccaagacgcagggcaa

SEQ ID NO: 363873 - DNA, 25 bp, Rattus norvegicus
gatctgggtccatgacgcagggcaa

SEQ ID NO: 363874 - DNA, 25 bp, Rattus norvegicus
gatctgggtcctacagaaatcccga

SEQ ID NO: 363875 - DNA, 25 bp, Rattus norvegicus
gatctgggtccttcagaaatcccga

SEQ ID NO: 363876 - DNA, 25 bp, Rattus norvegicus
gatctgggtttacaacttgtgtttg

SEQ ID NO: 363877 - DNA, 25 bp, Rattus norvegicus
gatctgggtttagaacttgtgtttg

SEQ ID NO: 363878 - DNA, 25 bp, Rattus norvegicus
gatctggtacgtctcaaacacttat

SEQ ID NO: 363879 - DNA, 25 bp, Rattus norvegicus
gatctggtacgtgtcaaacacttat

SEQ ID NO: 363880 - DNA, 25 bp, Rattus norvegicus
gatctggtagtcaggccacctggtc

SEQ ID NO: 363881 - DNA, 25 bp, Rattus norvegicus
gatctggtagtctggccacctggtc

SEQ ID NO: 363882 - DNA, 25 bp, Rattus norvegicus
gatctggtcactatctgccataaat

SEQ ID NO: 363883 - DNA, 25 bp, Rattus norvegicus
gatctggtcactttctgccataaat

SEQ ID NO: 363884 - DNA, 25 bp, Rattus norvegicus
gatctggtcattctgcggtatttat

SEQ ID NO: 363885 - DNA, 25 bp, Rattus norvegicus
gatctggtcattgtgcggtatttat

SEQ ID NO: 363886 - DNA, 25 bp, Rattus norvegicus
gatctggtccagaacacggagttca

SEQ ID NO: 363887 - DNA, 25 bp, Rattus norvegicus
gatctggtccagtacacggagttca

SEQ ID NO: 363888 - DNA, 25 bp, Rattus norvegicus
gatctggtgattctgcttggaagca

SEQ ID NO: 363889 - DNA, 25 bp, Rattus norvegicus
gatctggtgattgtgcttggaagca

SEQ ID NO: 363890 - DNA, 25 bp, Rattus norvegicus
gatctggtggcccatcaggtagaca

SEQ ID NO: 363891 - DNA, 25 bp, Rattus norvegicus
gatctggtggccgatcaggtagaca

SEQ ID NO: 363892 - DNA, 25 bp, Rattus norvegicus
gatctggtgtggactcagtcataca

SEQ ID NO: 363893 - DNA, 25 bp, Rattus norvegicus
gatctggtgtggtctcagtcataca

SEQ ID NO: 363894 - DNA, 25 bp, Rattus norvegicus
gatctggttaccatggaaatgcagg

SEQ ID NO: 363895 - DNA, 25 bp, Rattus norvegicus
gatctggttaccttggaaatgcagg

SEQ ID NO: 363896 - DNA, 25 bp, Rattus norvegicus
gatctggttactcatggcctttaca

SEQ ID NO: 363897 - DNA, 25 bp, Rattus norvegicus
gatctggttactgatggcctttaca

SEQ ID NO: 363898 - DNA, 25 bp, Rattus norvegicus
gatctggttcctcagcccaaaatca

SEQ ID NO: 363899 - DNA, 25 bp, Rattus norvegicus
gatctggttcctgagcccaaaatca

SEQ ID NO: 363900 - DNA, 25 bp, Rattus norvegicus
gatctggttctcaagctaaatggga

SEQ ID NO: 363901 - DNA, 25 bp, Rattus norvegicus
gatctggttctctagctaaatggga

SEQ ID NO: 363902 - DNA, 25 bp, Rattus norvegicus
gatctggttgctatgcgttcattaa

SEQ ID NO: 363903 - DNA, 25 bp, Rattus norvegicus
gatctggttgctttgcgttcattaa

SEQ ID NO: 363904 - DNA, 25 bp, Rattus norvegicus
gatctgtaataaattgaaagcctta

SEQ ID NO: 363905 - DNA, 25 bp, Rattus norvegicus
gatctgtaataatttgaaagcctta

SEQ ID NO: 363906 - DNA, 25 bp, Rattus norvegicus
gatctgtagacaagttgggtggcca

SEQ ID NO: 363907 - DNA, 25 bp, Rattus norvegicus
gatctgtagacatgttgggtggcca

SEQ ID NO: 363908 - DNA, 25 bp, Rattus norvegicus
gatctgtaggtcagtagtcactggc

SEQ ID NO: 363909 - DNA, 25 bp, Rattus norvegicus
gatctgtaggtctgtagtcactggc

SEQ ID NO: 363910 - DNA, 25 bp, Rattus norvegicus
gatctgtcaaccacctgtcatggag

SEQ ID NO: 363911 - DNA, 25 bp, Rattus norvegicus
gatctgtcaacctcctgtcatggag

SEQ ID NO: 363912 - DNA, 25 bp, Rattus norvegicus
gatctgtcactgaagtttggagctg

SEQ ID NO: 363913 - DNA, 25 bp, Rattus norvegicus
gatctgtcactgtagtttggagctg

SEQ ID NO: 363914 - DNA, 25 bp, Rattus norvegicus
gatctgtcaggaactcaggcagcgc

SEQ ID NO: 363915 - DNA, 25 bp, Rattus norvegicus
gatctgtcaggatctcaggcagcgc

SEQ ID NO: 363916 - DNA, 25 bp, Rattus norvegicus
gatctgtcagggaggtgctagcatt

SEQ ID NO: 363917 - DNA, 25 bp, Rattus norvegicus
gatctgtcagggtggtgctagcatt

SEQ ID NO: 363918 - DNA, 25 bp, Rattus norvegicus
gatctgtcatttcgtaacactttgc

SEQ ID NO: 363919 - DNA, 25 bp, Rattus norvegicus
gatctgtcatttggtaacactttgc

SEQ ID NO: 363920 - DNA, 25 bp, Rattus norvegicus
gatctgtccagaatgtgcaaagcta

SEQ ID NO: 363921 - DNA, 25 bp, Rattus norvegicus
gatctgtccagattgtgcaaagcta

SEQ ID NO: 363922 - DNA, 25 bp, Rattus norvegicus
gatctgtcccagcaagtacacaaag

SEQ ID NO: 363923 - DNA, 25 bp, Rattus norvegicus
gatctgtcccaggaagtacacaaag

SEQ ID NO: 363924 - DNA, 25 bp, Rattus norvegicus
gatctgtcctctatctaggtttact

SEQ ID NO: 363925 - DNA, 25 bp, Rattus norvegicus
gatctgtcctctttctaggtttact

SEQ ID NO: 363926 - DNA, 25 bp, Rattus norvegicus
gatctgtccttaaagccatcacatg

SEQ ID NO: 363927 - DNA, 25 bp, Rattus norvegicus
gatctgtccttatagccatcacatg

SEQ ID NO: 363928 - DNA, 25 bp, Rattus norvegicus
gatctgtctactatctcttgtttaa

SEQ ID NO: 363929 - DNA, 25 bp, Rattus norvegicus
gatctgtctactttctcttgtttaa

SEQ ID NO: 363930 - DNA, 25 bp, Rattus norvegicus
gatctgtctaggatttggtgtttat

SEQ ID NO: 363931 - DNA, 25 bp, Rattus norvegicus
gatctgtctaggttttggtgtttat

SEQ ID NO: 363932 - DNA, 25 bp, Rattus norvegicus
gatctgtctataacacagtccactt

SEQ ID NO: 363933 - DNA, 25 bp, Rattus norvegicus
gatctgtctatatcacagtccactt

SEQ ID NO: 363934 - DNA, 25 bp, Rattus norvegicus
gatctgtctcaaccagacccagtat

SEQ ID NO: 363935 - DNA, 25 bp, Rattus norvegicus
gatctgtctcaagcagacccagtat

SEQ ID NO: 363936 - DNA, 25 bp, Rattus norvegicus
gatctgtctctgagaaccttcaagt

SEQ ID NO: 363937 - DNA, 25 bp, Rattus norvegicus
gatctgtctctgtgaaccttcaagt

SEQ ID NO: 363938 - DNA, 25 bp, Rattus norvegicus
gatctgtcttggacttgccgtgtga

SEQ ID NO: 363939 - DNA, 25 bp, Rattus norvegicus
gatctgtcttggtcttgccgtgtga

SEQ ID NO: 363940 - DNA, 25 bp, Rattus norvegicus
gatctgtgaaacacttcccatatac

SEQ ID NO: 363941 - DNA, 25 bp, Rattus norvegicus
gatctgtgaaactcttcccatatac

SEQ ID NO: 363942 - DNA, 25 bp, Rattus norvegicus
gatctgtgacttcctagggaaaaat

SEQ ID NO: 363943 - DNA, 25 bp, Rattus norvegicus
gatctgtgacttgctagggaaaaat

SEQ ID NO: 363944 - DNA, 25 bp, Rattus norvegicus
gatctgtgagatctctttccgtttt

SEQ ID NO: 363945 - DNA, 25 bp, Rattus norvegicus
gatctgtgagatgtctttccgtttt

SEQ ID NO: 363946 - DNA, 25 bp, Rattus norvegicus
gatctgtgcccaaaccttggaagaa

SEQ ID NO: 363947 - DNA, 25 bp, Rattus norvegicus
gatctgtgcccataccttggaagaa

SEQ ID NO: 363948 - DNA, 25 bp, Rattus norvegicus
gatctgtgcctcagtcatggactta

SEQ ID NO: 363949 - DNA, 25 bp, Rattus norvegicus
gatctgtgcctctgtcatggactta

SEQ ID NO: 363950 - DNA, 25 bp, Rattus norvegicus
gatctgtgccttatccttggaagac

SEQ ID NO: 363951 - DNA, 25 bp, Rattus norvegicus
gatctgtgccttttccttggaagac

SEQ ID NO: 363952 - DNA, 25 bp, Rattus norvegicus
gatctgtgctaaaggactctgtata

SEQ ID NO: 363953 - DNA, 25 bp, Rattus norvegicus
gatctgtgctaatggactctgtata

SEQ ID NO: 363954 - DNA, 25 bp, Rattus norvegicus
gatctgtgctgtatagtgttctaaa

SEQ ID NO: 363955 - DNA, 25 bp, Rattus norvegicus
gatctgtgctgtttagtgttctaaa

SEQ ID NO: 363956 - DNA, 25 bp, Rattus norvegicus
gatctgtggcaacaccttcaaagca

SEQ ID NO: 363957 - DNA, 25 bp, Rattus norvegicus
gatctgtggcaagaccttcaaagca

SEQ ID NO: 363958 - DNA, 25 bp, Rattus norvegicus
gatctgtggctccttaagatgctta

SEQ ID NO: 363959 - DNA, 25 bp, Rattus norvegicus
gatctgtggctcgttaagatgctta

SEQ ID NO: 363960 - DNA, 25 bp, Rattus norvegicus
gatctgtggtgtatgcgccattcac

SEQ ID NO: 363961 - DNA, 25 bp, Rattus norvegicus
gatctgtggtgtttgcgccattcac

SEQ ID NO: 363962 - DNA, 25 bp, Rattus norvegicus
gatctgtgtactccaattcccataa

SEQ ID NO: 363963 - DNA, 25 bp, Rattus norvegicus
gatctgtgtactgcaattcccataa

SEQ ID NO: 363964 - DNA, 25 bp, Rattus norvegicus
gatctgtgtatgattgtattgtttt

SEQ ID NO: 363965 - DNA, 25 bp, Rattus norvegicus
gatctgtgtatgtttgtattgtttt

SEQ ID NO: 363966 - DNA, 25 bp, Rattus norvegicus
gatctgtgtggcaacatttaggaca

SEQ ID NO: 363967 - DNA, 25 bp, Rattus norvegicus
gatctgtgtggctacatttaggaca

SEQ ID NO: 363968 - DNA, 25 bp, Rattus norvegicus
gatctgtgtgttagcaccaactcat

SEQ ID NO: 363969 - DNA, 25 bp, Rattus norvegicus
gatctgtgtgtttgcaccaactcat

SEQ ID NO: 363970 - DNA, 25 bp, Rattus norvegicus
gatctgtgttttacagtggtcctgc

SEQ ID NO: 363971 - DNA, 25 bp, Rattus norvegicus
gatctgtgtttttcagtggtcctgc

SEQ ID NO: 363972 - DNA, 25 bp, Rattus norvegicus
gatctgttcagaagggcccaaggtt

SEQ ID NO: 363973 - DNA, 25 bp, Rattus norvegicus
gatctgttcagatgggcccaaggtt

SEQ ID NO: 363974 - DNA, 25 bp, Rattus norvegicus
gatctgttcataattagcatccatt

SEQ ID NO: 363975 - DNA, 25 bp, Rattus norvegicus
gatctgttcatatttagcatccatt

SEQ ID NO: 363976 - DNA, 25 bp, Rattus norvegicus
gatctgttccaaccaacactgatgt

SEQ ID NO: 363977 - DNA, 25 bp, Rattus norvegicus
gatctgttccaagcaacactgatgt

SEQ ID NO: 363978 - DNA, 25 bp, Rattus norvegicus
gatctgttccacataaattgtctca

SEQ ID NO: 363979 - DNA, 25 bp, Rattus norvegicus
gatctgttccacttaaattgtctca

SEQ ID NO: 363980 - DNA, 25 bp, Rattus norvegicus
gatctgttcctaaagttcactgtaa

SEQ ID NO: 363981 - DNA, 25 bp, Rattus norvegicus
gatctgttcctacagcttactggag

SEQ ID NO: 363982 - DNA, 25 bp, Rattus norvegicus
gatctgttcctaccatacagcatgg

SEQ ID NO: 363983 - DNA, 25 bp, Rattus norvegicus
gatctgttcctagagcttactggag

SEQ ID NO: 363984 - DNA, 25 bp, Rattus norvegicus
gatctgttcctagcatacagcatgg

SEQ ID NO: 363985 - DNA, 25 bp, Rattus norvegicus
gatctgttcctatagttcactgtaa

SEQ ID NO: 363986 - DNA, 25 bp, Rattus norvegicus
gatctgttctccaaaatgtcttaag

SEQ ID NO: 363987 - DNA, 25 bp, Rattus norvegicus
gatctgttctcctaaatgtcttaag

SEQ ID NO: 363988 - DNA, 25 bp, Rattus norvegicus
gatctgttcttcatttcatgatttt

SEQ ID NO: 363989 - DNA, 25 bp, Rattus norvegicus
gatctgttcttcttttcatgatttt

SEQ ID NO: 363990 - DNA, 25 bp, Rattus norvegicus
gatctgttgaggctattgtctgtaa

SEQ ID NO: 363991 - DNA, 25 bp, Rattus norvegicus
gatctgttgagggtattgtctgtaa

SEQ ID NO: 363992 - DNA, 25 bp, Rattus norvegicus
gatctgttgctgaccagccctattc

SEQ ID NO: 363993 - DNA, 25 bp, Rattus norvegicus
gatctgttgctgtccagccctattc

SEQ ID NO: 363994 - DNA, 25 bp, Rattus norvegicus
gatctgttggcccttttattgaaag

SEQ ID NO: 363995 - DNA, 25 bp, Rattus norvegicus
gatctgttggccgttttattgaaag

SEQ ID NO: 363996 - DNA, 25 bp, Rattus norvegicus
gatctgttgtctacctagtgtgaat

SEQ ID NO: 363997 - DNA, 25 bp, Rattus norvegicus
gatctgttgtcttcctagtgtgaat

SEQ ID NO: 363998 - DNA, 25 bp, Rattus norvegicus
gatctgtttaaaaagcactgtgtcc

SEQ ID NO: 363999 - DNA, 25 bp, Rattus norvegicus
gatctgtttaaatagcactgtgtcc

SEQ ID NO: 364000 - DNA, 25 bp, Rattus norvegicus
gatctgtttaccacgtgagcaagca

SEQ ID NO: 364001 - DNA, 25 bp, Rattus norvegicus
gatctgtttacctcgtgagcaagca

SEQ ID NO: 364002 - DNA, 25 bp, Rattus norvegicus
gatctgtttctgaagctccttgaaa

SEQ ID NO: 364003 - DNA, 25 bp, Rattus norvegicus
gatctgtttctgtagctccttgaaa

SEQ ID NO: 364004 - DNA, 25 bp, Rattus norvegicus
gatctgtttgcaaggtgttacggta

SEQ ID NO: 364005 - DNA, 25 bp, Rattus norvegicus
gatctgtttgcatggtgttacggta

SEQ ID NO: 364006 - DNA, 25 bp, Rattus norvegicus
gatctgtttttgcagacgctctatc

SEQ ID NO: 364007 - DNA, 25 bp, Rattus norvegicus
gatctgtttttggagacgctctatc

SEQ ID NO: 364008 - DNA, 25 bp, Rattus norvegicus
gatcttaaactcatatttcctaagg

SEQ ID NO: 364009 - DNA, 25 bp, Rattus norvegicus
gatcttaaactcttatttcctaagg

SEQ ID NO: 364010 - DNA, 25 bp, Rattus norvegicus
gatcttaaatgtcccagcagcctca

SEQ ID NO: 364011 - DNA, 25 bp, Rattus norvegicus
gatcttaaatgtgccagcagcctca

SEQ ID NO: 364012 - DNA, 25 bp, Rattus norvegicus
gatcttaagaccctacctgcatagg

SEQ ID NO: 364013 - DNA, 25 bp, Rattus norvegicus
gatcttaagaccgtacctgcatagg

SEQ ID NO: 364014 - DNA, 25 bp, Rattus norvegicus
gatcttaatatcaaccagcctctga

SEQ ID NO: 364015 - DNA, 25 bp, Rattus norvegicus
gatcttaatatctaccagcctctga

SEQ ID NO: 364016 - DNA, 25 bp, Rattus norvegicus
gatcttaatattaggcctctttgaa

SEQ ID NO: 364017 - DNA, 25 bp, Rattus norvegicus
gatcttaatatttggcctctttgaa

SEQ ID NO: 364018 - DNA, 25 bp, Rattus norvegicus
gatcttacaacgctgttttctcgag

SEQ ID NO: 364019 - DNA, 25 bp, Rattus norvegicus
gatcttacaacggtgttttctcgag

SEQ ID NO: 364020 - DNA, 25 bp, Rattus norvegicus
gatcttacacaccttggcttattag

SEQ ID NO: 364021 - DNA, 25 bp, Rattus norvegicus
gatcttacacacgttggcttattag

SEQ ID NO: 364022 - DNA, 25 bp, Rattus norvegicus
gatcttacacttacctgtgtacctc

SEQ ID NO: 364023 - DNA, 25 bp, Rattus norvegicus
gatcttacactttcctgtgtacctc

SEQ ID NO: 364024 - DNA, 25 bp, Rattus norvegicus
gatcttaccactacaaatggatgta

SEQ ID NO: 364025 - DNA, 25 bp, Rattus norvegicus
gatcttaccacttcaaatggatgta

SEQ ID NO: 364026 - DNA, 25 bp, Rattus norvegicus
gatcttacgaaaataccgcagacca

SEQ ID NO: 364027 - DNA, 25 bp, Rattus norvegicus
gatcttacgaaattaccgcagacca

SEQ ID NO: 364028 - DNA, 25 bp, Rattus norvegicus
gatcttacgattctttcatgactac

SEQ ID NO: 364029 - DNA, 25 bp, Rattus norvegicus
gatcttacgattgtttcatgactac

SEQ ID NO: 364030 - DNA, 25 bp, Rattus norvegicus
gatcttacggtaacctacatcggcc

SEQ ID NO: 364031 - DNA, 25 bp, Rattus norvegicus
gatcttacggtatcctacatcggcc

SEQ ID NO: 364032 - DNA, 25 bp, Rattus norvegicus
gatcttactacacaacgtgtgtctg

SEQ ID NO: 364033 - DNA, 25 bp, Rattus norvegicus
gatcttactacagaacgtgtgtctg

SEQ ID NO: 364034 - DNA, 25 bp, Rattus norvegicus
gatcttactagccttgtgtgtctct

SEQ ID NO: 364035 - DNA, 25 bp, Rattus norvegicus
gatcttactagcgttgtgtgtctct

SEQ ID NO: 364036 - DNA, 25 bp, Rattus norvegicus
gatcttactcaactacctggactca

SEQ ID NO: 364037 - DNA, 25 bp, Rattus norvegicus
gatcttactcaagtacctggactca

SEQ ID NO: 364038 - DNA, 25 bp, Rattus norvegicus
gatcttactcgacttcttcatcatc

SEQ ID NO: 364039 - DNA, 25 bp, Rattus norvegicus
gatcttactcgagttcttcatcatc

SEQ ID NO: 364040 - DNA, 25 bp, Rattus norvegicus
gatcttactgatctcctggtttaaa

SEQ ID NO: 364041 - DNA, 25 bp, Rattus norvegicus
gatcttactgatgtcctggtttaaa

SEQ ID NO: 364042 - DNA, 25 bp, Rattus norvegicus
gatcttactggaaagaaggccgctg

SEQ ID NO: 364043 - DNA, 25 bp, Rattus norvegicus
gatcttactggaactgctgcttgac

SEQ ID NO: 364044 - DNA, 25 bp, Rattus norvegicus
gatcttactggatagaaggccgctg

SEQ ID NO: 364045 - DNA, 25 bp, Rattus norvegicus
gatcttactggatctgctgcttgac

SEQ ID NO: 364046 - DNA, 25 bp, Rattus norvegicus
gatcttactggtagtgtagctcgac

SEQ ID NO: 364047 - DNA, 25 bp, Rattus norvegicus
gatcttactggttgtgtagctcgac

SEQ ID NO: 364048 - DNA, 25 bp, Rattus norvegicus
gatcttagaaatccccttacagaag

SEQ ID NO: 364049 - DNA, 25 bp, Rattus norvegicus
gatcttagaaatgcccttacagaag

SEQ ID NO: 364050 - DNA, 25 bp, Rattus norvegicus
gatcttagaatccagtctgatctac

SEQ ID NO: 364051 - DNA, 25 bp, Rattus norvegicus
gatcttagaatcgagtctgatctac

SEQ ID NO: 364052 - DNA, 25 bp, Rattus norvegicus
gatcttagactcacagaggccgtct

SEQ ID NO: 364053 - DNA, 25 bp, Rattus norvegicus
gatcttagactctcagaggccgtct

SEQ ID NO: 364054 - DNA, 25 bp, Rattus norvegicus
gatcttagagcacttgaggagccta

SEQ ID NO: 364055 - DNA, 25 bp, Rattus norvegicus
gatcttagagcagttgaggagccta

SEQ ID NO: 364056 - DNA, 25 bp, Rattus norvegicus
gatcttagcaatctttctgccgctt

SEQ ID NO: 364057 - DNA, 25 bp, Rattus norvegicus
gatcttagcaatgtttctgccgctt

SEQ ID NO: 364058 - DNA, 25 bp, Rattus norvegicus
gatcttagcatgcagctgttcctgt

SEQ ID NO: 364059 - DNA, 25 bp, Rattus norvegicus
gatcttagcatggagctgttcctgt

SEQ ID NO: 364060 - DNA, 25 bp, Rattus norvegicus
gatcttagcgttaaatccttgttta

SEQ ID NO: 364061 - DNA, 25 bp, Rattus norvegicus
gatcttagcgtttaatccttgttta

SEQ ID NO: 364062 - DNA, 25 bp, Rattus norvegicus
gatcttagctacactttgtgtctct

SEQ ID NO: 364063 - DNA, 25 bp, Rattus norvegicus
gatcttagctactctttgtgtctct

SEQ ID NO: 364064 - DNA, 25 bp, Rattus norvegicus
gatcttagggctatccaggcagagt

SEQ ID NO: 364065 - DNA, 25 bp, Rattus norvegicus
gatcttagggctttccaggcagagt

SEQ ID NO: 364066 - DNA, 25 bp, Rattus norvegicus
gatcttatacatcctatggactaat

SEQ ID NO: 364067 - DNA, 25 bp, Rattus norvegicus
gatcttatacatgctatggactaat

SEQ ID NO: 364068 - DNA, 25 bp, Rattus norvegicus
gatcttatatccagagtatctagag

SEQ ID NO: 364069 - DNA, 25 bp, Rattus norvegicus
gatcttatatcctgagtatctagag

SEQ ID NO: 364070 - DNA, 25 bp, Rattus norvegicus
gatcttatatctacaacacacctac

SEQ ID NO: 364071 - DNA, 25 bp, Rattus norvegicus
gatcttatatcttcaacacacctac

SEQ ID NO: 364072 - DNA, 25 bp, Rattus norvegicus
gatcttatcttcatgagccttgctg

SEQ ID NO: 364073 - DNA, 25 bp, Rattus norvegicus
gatcttatcttcttgagccttgctg

SEQ ID NO: 364074 - DNA, 25 bp, Rattus norvegicus
gatcttatctttatcccctttcaaa

SEQ ID NO: 364075 - DNA, 25 bp, Rattus norvegicus
gatcttatctttttcccctttcaaa

SEQ ID NO: 364076 - DNA, 25 bp, Rattus norvegicus
gatcttatggagctgtcccagggaa

SEQ ID NO: 364077 - DNA, 25 bp, Rattus norvegicus
gatcttatggaggtgtcccagggaa

SEQ ID NO: 364078 - DNA, 25 bp, Rattus norvegicus
gatcttattcctcccagagatgaaa

SEQ ID NO: 364079 - DNA, 25 bp, Rattus norvegicus
gatcttattcctgccagagatgaaa

SEQ ID NO: 364080 - DNA, 25 bp, Rattus norvegicus
gatcttattcttagtgtcatccatc

SEQ ID NO: 364081 - DNA, 25 bp, Rattus norvegicus
gatcttattctttgtgtcatccatc

SEQ ID NO: 364082 - DNA, 25 bp, Rattus norvegicus
gatcttattgccaagctcctctcgc

SEQ ID NO: 364083 - DNA, 25 bp, Rattus norvegicus
gatcttattgccaagttccttccac

SEQ ID NO: 364084 - DNA, 25 bp, Rattus norvegicus
gatcttattgcctagctcctctcgc

SEQ ID NO: 364085 - DNA, 25 bp, Rattus norvegicus
gatcttattgcctagttccttccac

SEQ ID NO: 364086 - DNA, 25 bp, Rattus norvegicus
gatcttatttctctattattatgta

SEQ ID NO: 364087 - DNA, 25 bp, Rattus norvegicus
gatcttatttctgtattattatgta

SEQ ID NO: 364088 - DNA, 25 bp, Rattus norvegicus
gatcttatttgaacgggtcgtgacc

SEQ ID NO: 364089 - DNA, 25 bp, Rattus norvegicus
gatcttatttgatcgggtcgtgacc

SEQ ID NO: 364090 - DNA, 25 bp, Rattus norvegicus
gatcttcaaatgacaatggttctta

SEQ ID NO: 364091 - DNA, 25 bp, Rattus norvegicus
gatcttcaaatgtcaatggttctta

SEQ ID NO: 364092 - DNA, 25 bp, Rattus norvegicus
gatcttcaactaagtgtgtgtccta

SEQ ID NO: 364093 - DNA, 25 bp, Rattus norvegicus
gatcttcaactatgtgtgtgtccta

SEQ ID NO: 364094 - DNA, 25 bp, Rattus norvegicus
gatcttcaagaacgctggtcacccc

SEQ ID NO: 364095 - DNA, 25 bp, Rattus norvegicus
gatcttcaagaaggctggtcacccc

SEQ ID NO: 364096 - DNA, 25 bp, Rattus norvegicus
gatcttcaatcccttcagaacaagc

SEQ ID NO: 364097 - DNA, 25 bp, Rattus norvegicus
gatcttcaatccgttcagaacaagc

SEQ ID NO: 364098 - DNA, 25 bp, Rattus norvegicus
gatcttcacatgacatcagtctcga

SEQ ID NO: 364099 - DNA, 25 bp, Rattus norvegicus
gatcttcacatgtcatcagtctcga

SEQ ID NO: 364100 - DNA, 25 bp, Rattus norvegicus
gatcttcacctgacgtgacttcata

SEQ ID NO: 364101 - DNA, 25 bp, Rattus norvegicus
gatcttcacctgtcgtgacttcata

SEQ ID NO: 364102 - DNA, 25 bp, Rattus norvegicus
gatcttcactggaaagactgttctt

SEQ ID NO: 364103 - DNA, 25 bp, Rattus norvegicus
gatcttcactggtaagactgttctt

SEQ ID NO: 364104 - DNA, 25 bp, Rattus norvegicus
gatcttcaggagaacttgtcacttc

SEQ ID NO: 364105 - DNA, 25 bp, Rattus norvegicus
gatcttcaggagtacttgtcacttc

SEQ ID NO: 364106 - DNA, 25 bp, Rattus norvegicus
gatcttcatactcatcttcctcatt

SEQ ID NO: 364107 - DNA, 25 bp, Rattus norvegicus
gatcttcatactgatcttcctcatt

SEQ ID NO: 364108 - DNA, 25 bp, Rattus norvegicus
gatcttcatagacaagcatgtttcc

SEQ ID NO: 364109 - DNA, 25 bp, Rattus norvegicus
gatcttcatagagaagcatgtttcc

SEQ ID NO: 364110 - DNA, 25 bp, Rattus norvegicus
gatcttcatctactgtgctgtcaag

SEQ ID NO: 364111 - DNA, 25 bp, Rattus norvegicus
gatcttcatctagtgtgctgtcaag

SEQ ID NO: 364112 - DNA, 25 bp, Rattus norvegicus
gatcttcatcttaaaaaccactggt

SEQ ID NO: 364113 - DNA, 25 bp, Rattus norvegicus
gatcttcatcttataggaacacctt

SEQ ID NO: 364114 - DNA, 25 bp, Rattus norvegicus
gatcttcatctttaaaaccactggt

SEQ ID NO: 364115 - DNA, 25 bp, Rattus norvegicus
gatcttcatcttttaggaacacctt

SEQ ID NO: 364116 - DNA, 25 bp, Rattus norvegicus
gatcttcatttgaggacgaggtcga

SEQ ID NO: 364117 - DNA, 25 bp, Rattus norvegicus
gatcttcatttgtggacgaggtcga

SEQ ID NO: 364118 - DNA, 25 bp, Rattus norvegicus
gatcttccagacctgtcacagtggg

SEQ ID NO: 364119 - DNA, 25 bp, Rattus norvegicus
gatcttccagacgtgtcacagtggg

SEQ ID NO: 364120 - DNA, 25 bp, Rattus norvegicus
gatcttccaggtctcaagtcttatg

SEQ ID NO: 364121 - DNA, 25 bp, Rattus norvegicus
gatcttccaggtgtcaagtcttatg

SEQ ID NO: 364122 - DNA, 25 bp, Rattus norvegicus
gatcttcccagccagtcatttggag

SEQ ID NO: 364123 - DNA, 25 bp, Rattus norvegicus
gatcttcccagcgagtcatttggag

SEQ ID NO: 364124 - DNA, 25 bp, Rattus norvegicus
gatcttcccatcaggagtaaggctg

SEQ ID NO: 364125 - DNA, 25 bp, Rattus norvegicus
gatcttcccatctggagtaaggctg

SEQ ID NO: 364126 - DNA, 25 bp, Rattus norvegicus
gatcttcccttcaggcgcagtgtga

SEQ ID NO: 364127 - DNA, 25 bp, Rattus norvegicus
gatcttcccttctggcgcagtgtga

SEQ ID NO: 364128 - DNA, 25 bp, Rattus norvegicus
gatcttccgcaccagtttgtatttc

SEQ ID NO: 364129 - DNA, 25 bp, Rattus norvegicus
gatcttccgcacgagtttgtatttc

SEQ ID NO: 364130 - DNA, 25 bp, Rattus norvegicus
gatcttcctaccagaatgccatgat

SEQ ID NO: 364131 - DNA, 25 bp, Rattus norvegicus
gatcttcctacctgaatgccatgat

SEQ ID NO: 364132 - DNA, 25 bp, Rattus norvegicus
gatcttcctactagagtcttttgaa

SEQ ID NO: 364133 - DNA, 25 bp, Rattus norvegicus
gatcttcctacttgagtcttttgaa

SEQ ID NO: 364134 - DNA, 25 bp, Rattus norvegicus
gatcttcctattagagtctcttgag

SEQ ID NO: 364135 - DNA, 25 bp, Rattus norvegicus
gatcttcctatttgagtctcttgag

SEQ ID NO: 364136 - DNA, 25 bp, Rattus norvegicus
gatcttcctgatcaacaagcttcac

SEQ ID NO: 364137 - DNA, 25 bp, Rattus norvegicus
gatcttcctgatctacataagtagt

SEQ ID NO: 364138 - DNA, 25 bp, Rattus norvegicus
gatcttcctgatgaacaagcttcac

SEQ ID NO: 364139 - DNA, 25 bp, Rattus norvegicus
gatcttcctgatgtacataagtagt

SEQ ID NO: 364140 - DNA, 25 bp, Rattus norvegicus
gatcttcctgcaagtgtttctaaag

SEQ ID NO: 364141 - DNA, 25 bp, Rattus norvegicus
gatcttcctgcatgtgtttctaaag

SEQ ID NO: 364142 - DNA, 25 bp, Rattus norvegicus
gatcttcctggaagggtcgactcaa

SEQ ID NO: 364143 - DNA, 25 bp, Rattus norvegicus
gatcttcctggatgggtcgactcaa

SEQ ID NO: 364144 - DNA, 25 bp, Rattus norvegicus
gatcttcctgggatccgtctgacgg

SEQ ID NO: 364145 - DNA, 25 bp, Rattus norvegicus
gatcttcctgggttccgtctgacgg

SEQ ID NO: 364146 - DNA, 25 bp, Rattus norvegicus
gatcttccttctagacatctttaaa

SEQ ID NO: 364147 - DNA, 25 bp, Rattus norvegicus
gatcttccttcttgacatctttaaa

SEQ ID NO: 364148 - DNA, 25 bp, Rattus norvegicus
gatcttcctttaataatgtcttact

SEQ ID NO: 364149 - DNA, 25 bp, Rattus norvegicus
gatcttcctttattaatgtcttact

SEQ ID NO: 364150 - DNA, 25 bp, Rattus norvegicus
gatcttcctttcctgacaaataagg

SEQ ID NO: 364151 - DNA, 25 bp, Rattus norvegicus
gatcttcctttcgtgacaaataagg

SEQ ID NO: 364152 - DNA, 25 bp, Rattus norvegicus
gatcttcggtatcattttcagcatg

SEQ ID NO: 364153 - DNA, 25 bp, Rattus norvegicus
gatcttcggtatgattttcagcatg

SEQ ID NO: 364154 - DNA, 25 bp, Rattus norvegicus
gatcttcggtgtcccatcagtgatt

SEQ ID NO: 364155 - DNA, 25 bp, Rattus norvegicus
gatcttcggtgtgccatcagtgatt

SEQ ID NO: 364156 - DNA, 25 bp, Rattus norvegicus
gatcttctaatcactggctttgttc

SEQ ID NO: 364157 - DNA, 25 bp, Rattus norvegicus
gatcttctaatctctggctttgttc

SEQ ID NO: 364158 - DNA, 25 bp, Rattus norvegicus
gatcttctacacacaatttgcgaca

SEQ ID NO: 364159 - DNA, 25 bp, Rattus norvegicus
gatcttctacactcaatttgcgaca

SEQ ID NO: 364160 - DNA, 25 bp, Rattus norvegicus
gatcttctagaaccttccagggctg

SEQ ID NO: 364161 - DNA, 25 bp, Rattus norvegicus
gatcttctagaagcttccagggctg

SEQ ID NO: 364162 - DNA, 25 bp, Rattus norvegicus
gatcttctagctaccattcattttc

SEQ ID NO: 364163 - DNA, 25 bp, Rattus norvegicus
gatcttctagcttccattcattttc

SEQ ID NO: 364164 - DNA, 25 bp, Rattus norvegicus
gatcttctcaatcgcttcgtgtaaa

SEQ ID NO: 364165 - DNA, 25 bp, Rattus norvegicus
gatcttctcaatctaagtcagcact

SEQ ID NO: 364166 - DNA, 25 bp, Rattus norvegicus
gatcttctcaatggcttcgtgtaaa

SEQ ID NO: 364167 - DNA, 25 bp, Rattus norvegicus
gatcttctcaatgtaagtcagcact

SEQ ID NO: 364168 - DNA, 25 bp, Rattus norvegicus
gatcttctcaccatcagagagctag

SEQ ID NO: 364169 - DNA, 25 bp, Rattus norvegicus
gatcttctcaccttcagagagctag

SEQ ID NO: 364170 - DNA, 25 bp, Rattus norvegicus
gatcttctcatcatcaaaatctctg

SEQ ID NO: 364171 - DNA, 25 bp, Rattus norvegicus
gatcttctcatcctgaaggctgtgg

SEQ ID NO: 364172 - DNA, 25 bp, Rattus norvegicus
gatcttctcatcgtgaaggctgtgg

SEQ ID NO: 364173 - DNA, 25 bp, Rattus norvegicus
gatcttctcatcttcaaaatctctg

SEQ ID NO: 364174 - DNA, 25 bp, Rattus norvegicus
gatcttctcgcccttagtgggatac

SEQ ID NO: 364175 - DNA, 25 bp, Rattus norvegicus
gatcttctcgccgttagtgggatac

SEQ ID NO: 364176 - DNA, 25 bp, Rattus norvegicus
gatcttctcggacttgagacaccct

SEQ ID NO: 364177 - DNA, 25 bp, Rattus norvegicus
gatcttctcggagttgagacaccct

SEQ ID NO: 364178 - DNA, 25 bp, Rattus norvegicus
gatcttctctttcatgtgcaataaa

SEQ ID NO: 364179 - DNA, 25 bp, Rattus norvegicus
gatcttctctttgatgtgcaataaa

SEQ ID NO: 364180 - DNA, 25 bp, Rattus norvegicus
gatcttctgattcttttgagtattc

SEQ ID NO: 364181 - DNA, 25 bp, Rattus norvegicus
gatcttctgattgttttgagtattc

SEQ ID NO: 364182 - DNA, 25 bp, Rattus norvegicus
gatcttctgtgtccagaacgcccca

SEQ ID NO: 364183 - DNA, 25 bp, Rattus norvegicus
gatcttctgtgtgcagaacgcccca

SEQ ID NO: 364184 - DNA, 25 bp, Rattus norvegicus
gatcttcttccacgtcgtatcattc

SEQ ID NO: 364185 - DNA, 25 bp, Rattus norvegicus
gatcttcttccaggtcgtatcattc

SEQ ID NO: 364186 - DNA, 25 bp, Rattus norvegicus
gatcttcttgatactttgccatggc

SEQ ID NO: 364187 - DNA, 25 bp, Rattus norvegicus
gatcttcttgattctttgccatggc

SEQ ID NO: 364188 - DNA, 25 bp, Rattus norvegicus
gatcttcttgtaaagggccatcgca

SEQ ID NO: 364189 - DNA, 25 bp, Rattus norvegicus
gatcttcttgtatagggccatcgca

SEQ ID NO: 364190 - DNA, 25 bp, Rattus norvegicus
gatcttctttctccaattaacactg

SEQ ID NO: 364191 - DNA, 25 bp, Rattus norvegicus
gatcttctttctgcaattaacactg

SEQ ID NO: 364192 - DNA, 25 bp, Rattus norvegicus
gatcttgaacttcgactgaccttct

SEQ ID NO: 364193 - DNA, 25 bp, Rattus norvegicus
gatcttgaacttggactgaccttct

SEQ ID NO: 364194 - DNA, 25 bp, Rattus norvegicus
gatcttgaagaacctgtcagaggtg

SEQ ID NO: 364195 - DNA, 25 bp, Rattus norvegicus
gatcttgaagaagctgtcagaggtg

SEQ ID NO: 364196 - DNA, 25 bp, Rattus norvegicus
gatcttgactgaacacttggtgcgc

SEQ ID NO: 364197 - DNA, 25 bp, Rattus norvegicus
gatcttgactgatcacttggtgcgc

SEQ ID NO: 364198 - DNA, 25 bp, Rattus norvegicus
gatcttgacttaaccttttacccag

SEQ ID NO: 364199 - DNA, 25 bp, Rattus norvegicus
gatcttgacttatccttttacccag

SEQ ID NO: 364200 - DNA, 25 bp, Rattus norvegicus
gatcttgagtagaagaggctccctt

SEQ ID NO: 364201 - DNA, 25 bp, Rattus norvegicus
gatcttgagtagtagaggctccctt

SEQ ID NO: 364202 - DNA, 25 bp, Rattus norvegicus
gatcttgataaaccgcgggaacacc

SEQ ID NO: 364203 - DNA, 25 bp, Rattus norvegicus
gatcttgataaagcgcgggaacacc

SEQ ID NO: 364204 - DNA, 25 bp, Rattus norvegicus
gatcttgatcggcttaacttagtca

SEQ ID NO: 364205 - DNA, 25 bp, Rattus norvegicus
gatcttgatcgggttaacttagtca

SEQ ID NO: 364206 - DNA, 25 bp, Rattus norvegicus
gatcttgatctccatacatagttta

SEQ ID NO: 364207 - DNA, 25 bp, Rattus norvegicus
gatcttgatctcgatacatagttta

SEQ ID NO: 364208 - DNA, 25 bp, Rattus norvegicus
gatcttgatgggatgtagtcattct

SEQ ID NO: 364209 - DNA, 25 bp, Rattus norvegicus
gatcttgatgggttgtagtcattct

SEQ ID NO: 364210 - DNA, 25 bp, Rattus norvegicus
gatcttgatttacttcactgacctg

SEQ ID NO: 364211 - DNA, 25 bp, Rattus norvegicus
gatcttgatttagttcactgacctg

SEQ ID NO: 364212 - DNA, 25 bp, Rattus norvegicus
gatcttgcaactccatctcggaaga

SEQ ID NO: 364213 - DNA, 25 bp, Rattus norvegicus
gatcttgcaactgcatctcggaaga

SEQ ID NO: 364214 - DNA, 25 bp, Rattus norvegicus
gatcttgcacatctccttttattgc

SEQ ID NO: 364215 - DNA, 25 bp, Rattus norvegicus
gatcttgcacatctggcatccaggg

SEQ ID NO: 364216 - DNA, 25 bp, Rattus norvegicus
gatcttgcacatgtccttttattgc

SEQ ID NO: 364217 - DNA, 25 bp, Rattus norvegicus
gatcttgcacatgtggcatccaggg

SEQ ID NO: 364218 - DNA, 25 bp, Rattus norvegicus
gatcttgcagttaatttctcattgt

SEQ ID NO: 364219 - DNA, 25 bp, Rattus norvegicus
gatcttgcagtttatttctcattgt

SEQ ID NO: 364220 - DNA, 25 bp, Rattus norvegicus
gatcttgcatggagcaatctcgcag

SEQ ID NO: 364221 - DNA, 25 bp, Rattus norvegicus
gatcttgcatggtgcaatctcgcag

SEQ ID NO: 364222 - DNA, 25 bp, Rattus norvegicus
gatcttgcattgattagttactttt

SEQ ID NO: 364223 - DNA, 25 bp, Rattus norvegicus
gatcttgcattgtttagttactttt

SEQ ID NO: 364224 - DNA, 25 bp, Rattus norvegicus
gatcttgccaccagtgctggaatta

SEQ ID NO: 364225 - DNA, 25 bp, Rattus norvegicus
gatcttgccacctgtgctggaatta

SEQ ID NO: 364226 - DNA, 25 bp, Rattus norvegicus
gatcttgcgccgctcgatctgcgac

SEQ ID NO: 364227 - DNA, 25 bp, Rattus norvegicus
gatcttgcgccggtcgatctgcgac

SEQ ID NO: 364228 - DNA, 25 bp, Rattus norvegicus
gatcttgctctgattatgccagtga

SEQ ID NO: 364229 - DNA, 25 bp, Rattus norvegicus
gatcttgctctgcaattatttcgcc

SEQ ID NO: 364230 - DNA, 25 bp, Rattus norvegicus
gatcttgctctggaattatttcgcc

SEQ ID NO: 364231 - DNA, 25 bp, Rattus norvegicus
gatcttgctctgtttatgccagtga

SEQ ID NO: 364232 - DNA, 25 bp, Rattus norvegicus
gatcttgcttgtcagtaatgttctc

SEQ ID NO: 364233 - DNA, 25 bp, Rattus norvegicus
gatcttgcttgtgagtaatgttctc

SEQ ID NO: 364234 - DNA, 25 bp, Rattus norvegicus
gatcttggatttcagcgtctccatc

SEQ ID NO: 364235 - DNA, 25 bp, Rattus norvegicus
gatcttggatttgagcgtctccatc

SEQ ID NO: 364236 - DNA, 25 bp, Rattus norvegicus
gatcttggcaacatggttctgcgac

SEQ ID NO: 364237 - DNA, 25 bp, Rattus norvegicus
gatcttggcaacttggttctgcgac

SEQ ID NO: 364238 - DNA, 25 bp, Rattus norvegicus
gatcttggccagctcacaacacaga

SEQ ID NO: 364239 - DNA, 25 bp, Rattus norvegicus
gatcttggccaggtcacaacacaga

SEQ ID NO: 364240 - DNA, 25 bp, Rattus norvegicus
gatcttggctgtcatgtagttattg

SEQ ID NO: 364241 - DNA, 25 bp, Rattus norvegicus
gatcttggctgtgatgtagttattg

SEQ ID NO: 364242 - DNA, 25 bp, Rattus norvegicus
gatcttgggcctatatgttcagcca

SEQ ID NO: 364243 - DNA, 25 bp, Rattus norvegicus
gatcttgggcctttatgttcagcca

SEQ ID NO: 364244 - DNA, 25 bp, Rattus norvegicus
gatcttgggttaaccacagtttgag

SEQ ID NO: 364245 - DNA, 25 bp, Rattus norvegicus
gatcttgggttatccacagtttgag

SEQ ID NO: 364246 - DNA, 25 bp, Rattus norvegicus
gatcttggtaaaaccggcaaagcca

SEQ ID NO: 364247 - DNA, 25 bp, Rattus norvegicus
gatcttggtaaatccggcaaagcca

SEQ ID NO: 364248 - DNA, 25 bp, Rattus norvegicus
gatcttggtgtcaattttaagcagg

SEQ ID NO: 364249 - DNA, 25 bp, Rattus norvegicus
gatcttggtgtctattttaagcagg

SEQ ID NO: 364250 - DNA, 25 bp, Rattus norvegicus
gatcttgtctctcatccttgggatg

SEQ ID NO: 364251 - DNA, 25 bp, Rattus norvegicus
gatcttgtctctctttgcattgttc

SEQ ID NO: 364252 - DNA, 25 bp, Rattus norvegicus
gatcttgtctctgatccttgggatg

SEQ ID NO: 364253 - DNA, 25 bp, Rattus norvegicus
gatcttgtctctgtttgcattgttc

SEQ ID NO: 364254 - DNA, 25 bp, Rattus norvegicus
gatcttgtgaaacagctccacctgt

SEQ ID NO: 364255 - DNA, 25 bp, Rattus norvegicus
gatcttgtgaaagagctccacctgt

SEQ ID NO: 364256 - DNA, 25 bp, Rattus norvegicus
gatcttgtggtccttttactttggc

SEQ ID NO: 364257 - DNA, 25 bp, Rattus norvegicus
gatcttgtggtcgttttactttggc

SEQ ID NO: 364258 - DNA, 25 bp, Rattus norvegicus
gatcttgtgttcaggacttctctta

SEQ ID NO: 364259 - DNA, 25 bp, Rattus norvegicus
gatcttgtgttctggacttctctta

SEQ ID NO: 364260 - DNA, 25 bp, Rattus norvegicus
gatcttgtttatctctctgtctaga

SEQ ID NO: 364261 - DNA, 25 bp, Rattus norvegicus
gatcttgtttatgtctctgtctaga

SEQ ID NO: 364262 - DNA, 25 bp, Rattus norvegicus
gatctttaaaaaccagggcctccct

SEQ ID NO: 364263 - DNA, 25 bp, Rattus norvegicus
gatctttaaaaagcagggcctccct

SEQ ID NO: 364264 - DNA, 25 bp, Rattus norvegicus
gatctttaagtaaacctcttcccct

SEQ ID NO: 364265 - DNA, 25 bp, Rattus norvegicus
gatctttaagtatacctcttcccct

SEQ ID NO: 364266 - DNA, 25 bp, Rattus norvegicus
gatctttacccaatttgctaagtta

SEQ ID NO: 364267 - DNA, 25 bp, Rattus norvegicus
gatctttacccactagcagttctgt

SEQ ID NO: 364268 - DNA, 25 bp, Rattus norvegicus
gatctttacccagtagcagttctgt

SEQ ID NO: 364269 - DNA, 25 bp, Rattus norvegicus
gatctttacccattttgctaagtta

SEQ ID NO: 364270 - DNA, 25 bp, Rattus norvegicus
gatctttacgttaacaacctggcat

SEQ ID NO: 364271 - DNA, 25 bp, Rattus norvegicus
gatctttacgtttacaacctggcat

SEQ ID NO: 364272 - DNA, 25 bp, Rattus norvegicus
gatctttattacctgacttgccaca

SEQ ID NO: 364273 - DNA, 25 bp, Rattus norvegicus
gatctttattacgtgacttgccaca

SEQ ID NO: 364274 - DNA, 25 bp, Rattus norvegicus
gatctttcagacctagcatggccat

SEQ ID NO: 364275 - DNA, 25 bp, Rattus norvegicus
gatctttcagacgtagcatggccat

SEQ ID NO: 364276 - DNA, 25 bp, Rattus norvegicus
gatctttcagccacaaatatcctgg

SEQ ID NO: 364277 - DNA, 25 bp, Rattus norvegicus
gatctttcagcctcaaatatcctgg

SEQ ID NO: 364278 - DNA, 25 bp, Rattus norvegicus
gatctttcaggaattttccagcgaa

SEQ ID NO: 364279 - DNA, 25 bp, Rattus norvegicus
gatctttcaggatttttccagcgaa

SEQ ID NO: 364280 - DNA, 25 bp, Rattus norvegicus
gatctttcaggccacaaattctgct

SEQ ID NO: 364281 - DNA, 25 bp, Rattus norvegicus
gatctttcaggcgacaaattctgct

SEQ ID NO: 364282 - DNA, 25 bp, Rattus norvegicus
gatctttcaggtatccagaattatg

SEQ ID NO: 364283 - DNA, 25 bp, Rattus norvegicus
gatctttcaggtttccagaattatg

SEQ ID NO: 364284 - DNA, 25 bp, Rattus norvegicus
gatctttcataaatgccactggcat

SEQ ID NO: 364285 - DNA, 25 bp, Rattus norvegicus
gatctttcataattgccactggcat

SEQ ID NO: 364286 - DNA, 25 bp, Rattus norvegicus
gatctttcatacagtgtgcacatgc

SEQ ID NO: 364287 - DNA, 25 bp, Rattus norvegicus
gatctttcatactgtgtgcacatgc

SEQ ID NO: 364288 - DNA, 25 bp, Rattus norvegicus
gatctttcccatctcaactgagttg

SEQ ID NO: 364289 - DNA, 25 bp, Rattus norvegicus
gatctttcccatgtcaactgagttg

SEQ ID NO: 364290 - DNA, 25 bp, Rattus norvegicus
gatctttcgggtagactggaatcca

SEQ ID NO: 364291 - DNA, 25 bp, Rattus norvegicus
gatctttcgggttgactggaatcca

SEQ ID NO: 364292 - DNA, 25 bp, Rattus norvegicus
gatctttctaagcatctggtgtgat

SEQ ID NO: 364293 - DNA, 25 bp, Rattus norvegicus
gatctttctaaggatctggtgtgat

SEQ ID NO: 364294 - DNA, 25 bp, Rattus norvegicus
gatctttctatgaacagccacgttt

SEQ ID NO: 364295 - DNA, 25 bp, Rattus norvegicus
gatctttctatgtacagccacgttt

SEQ ID NO: 364296 - DNA, 25 bp, Rattus norvegicus
gatctttctccaaaccaccgtggga

SEQ ID NO: 364297 - DNA, 25 bp, Rattus norvegicus
gatctttctccataccaccgtggga

SEQ ID NO: 364298 - DNA, 25 bp, Rattus norvegicus
gatctttctgccaacactacagagc

SEQ ID NO: 364299 - DNA, 25 bp, Rattus norvegicus
gatctttctgcctacactacagagc

SEQ ID NO: 364300 - DNA, 25 bp, Rattus norvegicus
gatctttctgctcacaacttaggtt

SEQ ID NO: 364301 - DNA, 25 bp, Rattus norvegicus
gatctttctgctgacaacttaggtt

SEQ ID NO: 364302 - DNA, 25 bp, Rattus norvegicus
gatctttctgtacgtgccagggttt

SEQ ID NO: 364303 - DNA, 25 bp, Rattus norvegicus
gatctttctgtaggtgccagggttt

SEQ ID NO: 364304 - DNA, 25 bp, Rattus norvegicus
gatctttctttcctcattaattcca

SEQ ID NO: 364305 - DNA, 25 bp, Rattus norvegicus
gatctttctttcgtcattaattcca

SEQ ID NO: 364306 - DNA, 25 bp, Rattus norvegicus
gatctttgacatcttgctggctacg

SEQ ID NO: 364307 - DNA, 25 bp, Rattus norvegicus
gatctttgacatgttgctggctacg

SEQ ID NO: 364308 - DNA, 25 bp, Rattus norvegicus
gatctttgagccactgaaaccatta

SEQ ID NO: 364309 - DNA, 25 bp, Rattus norvegicus
gatctttgagcctctgaaaccatta

SEQ ID NO: 364310 - DNA, 25 bp, Rattus norvegicus
gatctttgatggaggccgatgctac

SEQ ID NO: 364311 - DNA, 25 bp, Rattus norvegicus
gatctttgatggtggccgatgctac

SEQ ID NO: 364312 - DNA, 25 bp, Rattus norvegicus
gatctttgcaaacagacccatgtgg

SEQ ID NO: 364313 - DNA, 25 bp, Rattus norvegicus
gatctttgcaaagagacccatgtgg

SEQ ID NO: 364314 - DNA, 25 bp, Rattus norvegicus
gatctttgcagtctaattctttgtt

SEQ ID NO: 364315 - DNA, 25 bp, Rattus norvegicus
gatctttgcagtgtaattctttgtt

SEQ ID NO: 364316 - DNA, 25 bp, Rattus norvegicus
gatctttgcctcactgtagaaattg

SEQ ID NO: 364317 - DNA, 25 bp, Rattus norvegicus
gatctttgcctctctgtagaaattg

SEQ ID NO: 364318 - DNA, 25 bp, Rattus norvegicus
gatctttgcgggatccaggctagcc

SEQ ID NO: 364319 - DNA, 25 bp, Rattus norvegicus
gatctttgcgggttccaggctagcc

SEQ ID NO: 364320 - DNA, 25 bp, Rattus norvegicus
gatctttgtactccatgtgcagaaa

SEQ ID NO: 364321 - DNA, 25 bp, Rattus norvegicus
gatctttgtactgcatgtgcagaaa

SEQ ID NO: 364322 - DNA, 25 bp, Rattus norvegicus
gatctttgtctcattctactggaat

SEQ ID NO: 364323 - DNA, 25 bp, Rattus norvegicus
gatctttgtctctttctactggaat

SEQ ID NO: 364324 - DNA, 25 bp, Rattus norvegicus
gatctttgttcaatgtggaggctgg

SEQ ID NO: 364325 - DNA, 25 bp, Rattus norvegicus
gatctttgttcattgtggaggctgg

SEQ ID NO: 364326 - DNA, 25 bp, Rattus norvegicus
gatcttttaaacactattgaccacc

SEQ ID NO: 364327 - DNA, 25 bp, Rattus norvegicus
gatcttttaaactctattgaccacc

SEQ ID NO: 364328 - DNA, 25 bp, Rattus norvegicus
gatcttttatctaattttgctcaat

SEQ ID NO: 364329 - DNA, 25 bp, Rattus norvegicus
gatcttttatcttattttgctcaat

SEQ ID NO: 364330 - DNA, 25 bp, Rattus norvegicus
gatcttttatgacgcagagtccatg

SEQ ID NO: 364331 - DNA, 25 bp, Rattus norvegicus
gatcttttatgaggcagagtccatg

SEQ ID NO: 364332 - DNA, 25 bp, Rattus norvegicus
gatcttttcattattatacacagga

SEQ ID NO: 364333 - DNA, 25 bp, Rattus norvegicus
gatcttttcatttttatacacagga

SEQ ID NO: 364334 - DNA, 25 bp, Rattus norvegicus
gatcttttcccaaagaaggttacag

SEQ ID NO: 364335 - DNA, 25 bp, Rattus norvegicus
gatcttttcccatagaaggttacag

SEQ ID NO: 364336 - DNA, 25 bp, Rattus norvegicus
gatcttttctttatcccacagagtt

SEQ ID NO: 364337 - DNA, 25 bp, Rattus norvegicus
gatcttttctttcgtataatttggc

SEQ ID NO: 364338 - DNA, 25 bp, Rattus norvegicus
gatcttttctttctgacattgcgtg

SEQ ID NO: 364339 - DNA, 25 bp, Rattus norvegicus
gatcttttctttggtataatttggc

SEQ ID NO: 364340 - DNA, 25 bp, Rattus norvegicus
gatcttttctttgtgacattgcgtg

SEQ ID NO: 364341 - DNA, 25 bp, Rattus norvegicus
gatcttttctttttcccacagagtt

SEQ ID NO: 364342 - DNA, 25 bp, Rattus norvegicus
gatcttttgcatagcgtctgggcat

SEQ ID NO: 364343 - DNA, 25 bp, Rattus norvegicus
gatcttttgcattgcgtctgggcat

SEQ ID NO: 364344 - DNA, 25 bp, Rattus norvegicus
gatcttttgcttaattcgtgttctc

SEQ ID NO: 364345 - DNA, 25 bp, Rattus norvegicus
gatcttttgctttattcgtgttctc

SEQ ID NO: 364346 - DNA, 25 bp, Rattus norvegicus
gatctttttcagaatccagagagca

SEQ ID NO: 364347 - DNA, 25 bp, Rattus norvegicus
gatctttttcagtatccagagagca

SEQ ID NO: 364348 - DNA, 25 bp, Rattus norvegicus
gatctttttcatagtggcacaagcc

SEQ ID NO: 364349 - DNA, 25 bp, Rattus norvegicus
gatctttttcattgtggcacaagcc

SEQ ID NO: 364350 - DNA, 25 bp, Rattus norvegicus
gatctttttcttcaagcactgctta

SEQ ID NO: 364351 - DNA, 25 bp, Rattus norvegicus
gatctttttcttgaagcactgctta

SEQ ID NO: 364352 - DNA, 25 bp, Rattus norvegicus
gatctttttgctatccaaatgtctt

SEQ ID NO: 364353 - DNA, 25 bp, Rattus norvegicus
gatctttttgctttccaaatgtctt

SEQ ID NO: 364354 - DNA, 25 bp, Rattus norvegicus
gatcttttttctatgcccttattgt

SEQ ID NO: 364355 - DNA, 25 bp, Rattus norvegicus
gatcttttttctttgcccttattgt

SEQ ID NO: 364356 - DNA, 25 bp, Rattus norvegicus
gatgaaaacctcctcttttgaatta

SEQ ID NO: 364357 - DNA, 25 bp, Rattus norvegicus
gatgaaaacctcgtcttttgaatta

SEQ ID NO: 364358 - DNA, 25 bp, Rattus norvegicus
gatgaaaactttctgttcttgtcta

SEQ ID NO: 364359 - DNA, 25 bp, Rattus norvegicus
gatgaaaactttgtgttcttgtcta

SEQ ID NO: 364360 - DNA, 25 bp, Rattus norvegicus
gatgaaaagctcactgccttccgga

SEQ ID NO: 364361 - DNA, 25 bp, Rattus norvegicus
gatgaaaagctctctgccttccgga

SEQ ID NO: 364362 - DNA, 25 bp, Rattus norvegicus
gatgaaacaagcctggccacagaac

SEQ ID NO: 364363 - DNA, 25 bp, Rattus norvegicus
gatgaaacaagcgtggccacagaac

SEQ ID NO: 364364 - DNA, 25 bp, Rattus norvegicus
gatgaaacattactctccctgaagg

SEQ ID NO: 364365 - DNA, 25 bp, Rattus norvegicus
gatgaaacattagtctccctgaagg

SEQ ID NO: 364366 - DNA, 25 bp, Rattus norvegicus
gatgaaacccagaatcctaagaact

SEQ ID NO: 364367 - DNA, 25 bp, Rattus norvegicus
gatgaaacccagtatcctaagaact

SEQ ID NO: 364368 - DNA, 25 bp, Rattus norvegicus
gatgaaaccggcatttctagagctt

SEQ ID NO: 364369 - DNA, 25 bp, Rattus norvegicus
gatgaaaccggcttttctagagctt

SEQ ID NO: 364370 - DNA, 25 bp, Rattus norvegicus
gatgaaacgccgcaagggtcgccct

SEQ ID NO: 364371 - DNA, 25 bp, Rattus norvegicus
gatgaaacgccggaagggtcgccct

SEQ ID NO: 364372 - DNA, 25 bp, Rattus norvegicus
gatgaaacggtcacgcagcagctgc

SEQ ID NO: 364373 - DNA, 25 bp, Rattus norvegicus
gatgaaacggtctcgcagcagctgc

SEQ ID NO: 364374 - DNA, 25 bp, Rattus norvegicus
gatgaaactacacctgacaacagaa

SEQ ID NO: 364375 - DNA, 25 bp, Rattus norvegicus
gatgaaactacagctgacaacagaa

SEQ ID NO: 364376 - DNA, 25 bp, Rattus norvegicus
gatgaaagcactcgcctggtggtca

SEQ ID NO: 364377 - DNA, 25 bp, Rattus norvegicus
gatgaaagcactggcctggtggtca

SEQ ID NO: 364378 - DNA, 25 bp, Rattus norvegicus
gatgaaagccatccttgctcaagaa

SEQ ID NO: 364379 - DNA, 25 bp, Rattus norvegicus
gatgaaagccatgcttgctcaagaa

SEQ ID NO: 364380 - DNA, 25 bp, Rattus norvegicus
gatgaaagccgacagccatgtgttg

SEQ ID NO: 364381 - DNA, 25 bp, Rattus norvegicus
gatgaaagccgagagccatgtgttg

SEQ ID NO: 364382 - DNA, 25 bp, Rattus norvegicus
gatgaaagctgaatactgtctataa

SEQ ID NO: 364383 - DNA, 25 bp, Rattus norvegicus
gatgaaagctgattactgtctataa

SEQ ID NO: 364384 - DNA, 25 bp, Rattus norvegicus
gatgaaagggcacccctcatacgga

SEQ ID NO: 364385 - DNA, 25 bp, Rattus norvegicus
gatgaaagggcagccctcatacgga

SEQ ID NO: 364386 - DNA, 25 bp, Rattus norvegicus
gatgaaaggtgtctcccctgatctc

SEQ ID NO: 364387 - DNA, 25 bp, Rattus norvegicus
gatgaaaggtgtgtcccctgatctc

SEQ ID NO: 364388 - DNA, 25 bp, Rattus norvegicus
gatgaaagtctgctcgtcacgaaac

SEQ ID NO: 364389 - DNA, 25 bp, Rattus norvegicus
gatgaaagtctggtcgtcacgaaac

SEQ ID NO: 364390 - DNA, 25 bp, Rattus norvegicus
gatgaaagtgacacgggcatggcct

SEQ ID NO: 364391 - DNA, 25 bp, Rattus norvegicus
gatgaaagtgactcgggcatggcct

SEQ ID NO: 364392 - DNA, 25 bp, Rattus norvegicus
gatgaaagtggcactctgccattcc

SEQ ID NO: 364393 - DNA, 25 bp, Rattus norvegicus
gatgaaagtggctctctgccattcc

SEQ ID NO: 364394 - DNA, 25 bp, Rattus norvegicus
gatgaaatcgaacagtcgctgaacg

SEQ ID NO: 364395 - DNA, 25 bp, Rattus norvegicus
gatgaaatcgaagagtcgctgaacg

SEQ ID NO: 364396 - DNA, 25 bp, Rattus norvegicus
gatgaaatcttcaacaccttatccc

SEQ ID NO: 364397 - DNA, 25 bp, Rattus norvegicus
gatgaaatcttctacaccttatccc

SEQ ID NO: 364398 - DNA, 25 bp, Rattus norvegicus
gatgaaatgagaccctgttacaggc

SEQ ID NO: 364399 - DNA, 25 bp, Rattus norvegicus
gatgaaatgagagcctgttacaggc

SEQ ID NO: 364400 - DNA, 25 bp, Rattus norvegicus
gatgaaatgccacactttcccaagt

SEQ ID NO: 364401 - DNA, 25 bp, Rattus norvegicus
gatgaaatgccagactttcccaagt

SEQ ID NO: 364402 - DNA, 25 bp, Rattus norvegicus
gatgaaatggtgctggtccttcttc

SEQ ID NO: 364403 - DNA, 25 bp, Rattus norvegicus
gatgaaatggtggtggtccttcttc

SEQ ID NO: 364404 - DNA, 25 bp, Rattus norvegicus
gatgaaatgtcaccttcgggtcacc

SEQ ID NO: 364405 - DNA, 25 bp, Rattus norvegicus
gatgaaatgtcagcttcgggtcacc

SEQ ID NO: 364406 - DNA, 25 bp, Rattus norvegicus
gatgaaatgtttaagtcctttaaag

SEQ ID NO: 364407 - DNA, 25 bp, Rattus norvegicus
gatgaaatgttttagtcctttaaag

SEQ ID NO: 364408 - DNA, 25 bp, Rattus norvegicus
gatgaaattccactgcatgctgaag

SEQ ID NO: 364409 - DNA, 25 bp, Rattus norvegicus
gatgaaattccagtgcatgctgaag

SEQ ID NO: 364410 - DNA, 25 bp, Rattus norvegicus
gatgaaattgatcctgacagcaccg

SEQ ID NO: 364411 - DNA, 25 bp, Rattus norvegicus
gatgaaattgatgctgacagcaccg

SEQ ID NO: 364412 - DNA, 25 bp, Rattus norvegicus
gatgaaattttcctcctgacagcag

SEQ ID NO: 364413 - DNA, 25 bp, Rattus norvegicus
gatgaaattttcgtcctgacagcag

SEQ ID NO: 364414 - DNA, 25 bp, Rattus norvegicus
gatgaacaagctatggcccgagtct

SEQ ID NO: 364415 - DNA, 25 bp, Rattus norvegicus
gatgaacaagctttggcccgagtct

SEQ ID NO: 364416 - DNA, 25 bp, Rattus norvegicus
gatgaacaagtgacacgctggccac

SEQ ID NO: 364417 - DNA, 25 bp, Rattus norvegicus
gatgaacaagtgtcacgctggccac

SEQ ID NO: 364418 - DNA, 25 bp, Rattus norvegicus
gatgaacacgtgagaggccttgctt

SEQ ID NO: 364419 - DNA, 25 bp, Rattus norvegicus
gatgaacacgtgtgaggccttgctt

SEQ ID NO: 364420 - DNA, 25 bp, Rattus norvegicus
gatgaacactccacggaatcgcggt

SEQ ID NO: 364421 - DNA, 25 bp, Rattus norvegicus
gatgaacactcctcggaatcgcggt

SEQ ID NO: 364422 - DNA, 25 bp, Rattus norvegicus
gatgaacactcgagtgagtcccgct

SEQ ID NO: 364423 - DNA, 25 bp, Rattus norvegicus
gatgaacactcgtgtgagtcccgct

SEQ ID NO: 364424 - DNA, 25 bp, Rattus norvegicus
gatgaacactgtctacgtgtgcttt

SEQ ID NO: 364425 - DNA, 25 bp, Rattus norvegicus
gatgaacactgtgtacgtgtgcttt

SEQ ID NO: 364426 - DNA, 25 bp, Rattus norvegicus
gatgaacactttagtgagttcacaa

SEQ ID NO: 364427 - DNA, 25 bp, Rattus norvegicus
gatgaacacttttgtgagttcacaa

SEQ ID NO: 364428 - DNA, 25 bp, Rattus norvegicus
gatgaacagaatatgctcctccatg

SEQ ID NO: 364429 - DNA, 25 bp, Rattus norvegicus
gatgaacagaatttgctcctccatg

SEQ ID NO: 364430 - DNA, 25 bp, Rattus norvegicus
gatgaacagattctgcttctacctg

SEQ ID NO: 364431 - DNA, 25 bp, Rattus norvegicus
gatgaacagattgtgcttctacctg

SEQ ID NO: 364432 - DNA, 25 bp, Rattus norvegicus
gatgaacagcagactcaggattgta

SEQ ID NO: 364433 - DNA, 25 bp, Rattus norvegicus
gatgaacagcagtctcaggattgta

SEQ ID NO: 364434 - DNA, 25 bp, Rattus norvegicus
gatgaacagcatcacaaccagcact

SEQ ID NO: 364435 - DNA, 25 bp, Rattus norvegicus
gatgaacagcatgacaaccagcact

SEQ ID NO: 364436 - DNA, 25 bp, Rattus norvegicus
gatgaacagtatcccgatgccacag

SEQ ID NO: 364437 - DNA, 25 bp, Rattus norvegicus
gatgaacagtatgccgatgccacag

SEQ ID NO: 364438 - DNA, 25 bp, Rattus norvegicus
gatgaacagtcacctatgagctcct

SEQ ID NO: 364439 - DNA, 25 bp, Rattus norvegicus
gatgaacagtcagctatgagctcct

SEQ ID NO: 364440 - DNA, 25 bp, Rattus norvegicus
gatgaacagtttcccgccctcattg

SEQ ID NO: 364441 - DNA, 25 bp, Rattus norvegicus
gatgaacagtttgccgccctcattg

SEQ ID NO: 364442 - DNA, 25 bp, Rattus norvegicus
gatgaacatatactccacagttgga

SEQ ID NO: 364443 - DNA, 25 bp, Rattus norvegicus
gatgaacatatagtccacagttgga

SEQ ID NO: 364444 - DNA, 25 bp, Rattus norvegicus
gatgaacatggcaacatctctcggt

SEQ ID NO: 364445 - DNA, 25 bp, Rattus norvegicus
gatgaacatggctacatctctcggt

SEQ ID NO: 364446 - DNA, 25 bp, Rattus norvegicus
gatgaaccaccacaagtaccgtaaa

SEQ ID NO: 364447 - DNA, 25 bp, Rattus norvegicus
gatgaaccaccacaggagactttcc

SEQ ID NO: 364448 - DNA, 25 bp, Rattus norvegicus
gatgaaccaccagaagtaccgtaaa

SEQ ID NO: 364449 - DNA, 25 bp, Rattus norvegicus
gatgaaccaccagaggagactttcc

SEQ ID NO: 364450 - DNA, 25 bp, Rattus norvegicus
gatgaaccacttacacctataaatt

SEQ ID NO: 364451 - DNA, 25 bp, Rattus norvegicus
gatgaaccactttcacctataaatt

SEQ ID NO: 364452 - DNA, 25 bp, Rattus norvegicus
gatgaaccagagcacctacctaaaa

SEQ ID NO: 364453 - DNA, 25 bp, Rattus norvegicus
gatgaaccagaggacctacctaaaa

SEQ ID NO: 364454 - DNA, 25 bp, Rattus norvegicus
gatgaaccatggcagcctctggtag

SEQ ID NO: 364455 - DNA, 25 bp, Rattus norvegicus
gatgaaccatgggagcctctggtag

SEQ ID NO: 364456 - DNA, 25 bp, Rattus norvegicus
gatgaaccatttcttgctgctctgc

SEQ ID NO: 364457 - DNA, 25 bp, Rattus norvegicus
gatgaaccatttgttgctgctctgc

SEQ ID NO: 364458 - DNA, 25 bp, Rattus norvegicus
gatgaaccccgcaggacttgggtca

SEQ ID NO: 364459 - DNA, 25 bp, Rattus norvegicus
gatgaaccccgctggacttgggtca

SEQ ID NO: 364460 - DNA, 25 bp, Rattus norvegicus
gatgaacctaatagcacctggaaga

SEQ ID NO: 364461 - DNA, 25 bp, Rattus norvegicus
gatgaacctaattgcacctggaaga

SEQ ID NO: 364462 - DNA, 25 bp, Rattus norvegicus
gatgaacctggccagctccttggag

SEQ ID NO: 364463 - DNA, 25 bp, Rattus norvegicus
gatgaacctggcgagctccttggag

SEQ ID NO: 364464 - DNA, 25 bp, Rattus norvegicus
gatgaacgaacacactcaggcgatg

SEQ ID NO: 364465 - DNA, 25 bp, Rattus norvegicus
gatgaacgaacagactcaggcgatg

SEQ ID NO: 364466 - DNA, 25 bp, Rattus norvegicus
gatgaacgacatcaacgctccctat

SEQ ID NO: 364467 - DNA, 25 bp, Rattus norvegicus
gatgaacgacatgaacgctccctat

SEQ ID NO: 364468 - DNA, 25 bp, Rattus norvegicus
gatgaacgccatccaagacaccgat

SEQ ID NO: 364469 - DNA, 25 bp, Rattus norvegicus
gatgaacgccatgcaagacaccgat

SEQ ID NO: 364470 - DNA, 25 bp, Rattus norvegicus
gatgaacgcgaactctcgtcagctt

SEQ ID NO: 364471 - DNA, 25 bp, Rattus norvegicus
gatgaacgcgaagtctcgtcagctt

SEQ ID NO: 364472 - DNA, 25 bp, Rattus norvegicus
gatgaacggttcacgacactatcca

SEQ ID NO: 364473 - DNA, 25 bp, Rattus norvegicus
gatgaacggttctcgacactatcca

SEQ ID NO: 364474 - DNA, 25 bp, Rattus norvegicus
gatgaacggttgaactccctaaggt

SEQ ID NO: 364475 - DNA, 25 bp, Rattus norvegicus
gatgaacggttgtactccctaaggt

SEQ ID NO: 364476 - DNA, 25 bp, Rattus norvegicus
gatgaacgtcctcattcctacagaa

SEQ ID NO: 364477 - DNA, 25 bp, Rattus norvegicus
gatgaacgtcctgattcctacagaa

SEQ ID NO: 364478 - DNA, 25 bp, Rattus norvegicus
gatgaactacctcaacggcaacctc

SEQ ID NO: 364479 - DNA, 25 bp, Rattus norvegicus
gatgaactacctgaacggcaacctc

SEQ ID NO: 364480 - DNA, 25 bp, Rattus norvegicus
gatgaactagctaatgtctttatat

SEQ ID NO: 364481 - DNA, 25 bp, Rattus norvegicus
gatgaactagctaccaagtttcttg

SEQ ID NO: 364482 - DNA, 25 bp, Rattus norvegicus
gatgaactagcttatgtctttatat

SEQ ID NO: 364483 - DNA, 25 bp, Rattus norvegicus
gatgaactagcttccaagtttcttg

SEQ ID NO: 364484 - DNA, 25 bp, Rattus norvegicus
gatgaactcaatcttttctcaaatg

SEQ ID NO: 364485 - DNA, 25 bp, Rattus norvegicus
gatgaactcaatgttttctcaaatg

SEQ ID NO: 364486 - DNA, 25 bp, Rattus norvegicus
gatgaactcacaagtggcttccacc

SEQ ID NO: 364487 - DNA, 25 bp, Rattus norvegicus
gatgaactcacatgtggcttccacc

SEQ ID NO: 364488 - DNA, 25 bp, Rattus norvegicus
gatgaactcatcaggttgacttagg

SEQ ID NO: 364489 - DNA, 25 bp, Rattus norvegicus
gatgaactcatccacgggtgttaaa

SEQ ID NO: 364490 - DNA, 25 bp, Rattus norvegicus
gatgaactcatcgacgggtgttaaa

SEQ ID NO: 364491 - DNA, 25 bp, Rattus norvegicus
gatgaactcatctggttgacttagg

SEQ ID NO: 364492 - DNA, 25 bp, Rattus norvegicus
gatgaactcttcattctgtgatcag

SEQ ID NO: 364493 - DNA, 25 bp, Rattus norvegicus
gatgaactcttctttctgtgatcag

SEQ ID NO: 364494 - DNA, 25 bp, Rattus norvegicus
gatgaactgaaaaccctctgaagcc

SEQ ID NO: 364495 - DNA, 25 bp, Rattus norvegicus
gatgaactgaaatccctctgaagcc

SEQ ID NO: 364496 - DNA, 25 bp, Rattus norvegicus
gatgaactgagcaaactagtggaag

SEQ ID NO: 364497 - DNA, 25 bp, Rattus norvegicus
gatgaactgagctaactagtggaag

SEQ ID NO: 364498 - DNA, 25 bp, Rattus norvegicus
gatgaactgcaccagctgaagctca

SEQ ID NO: 364499 - DNA, 25 bp, Rattus norvegicus
gatgaactgcacgagctgaagctca

SEQ ID NO: 364500 - DNA, 25 bp, Rattus norvegicus
gatgaactggttaggcactgatatt

SEQ ID NO: 364501 - DNA, 25 bp, Rattus norvegicus
gatgaactggtttggcactgatatt

SEQ ID NO: 364502 - DNA, 25 bp, Rattus norvegicus
gatgaactgtgtccactgtgaccct

SEQ ID NO: 364503 - DNA, 25 bp, Rattus norvegicus
gatgaactgtgtgcactgtgaccct

SEQ ID NO: 364504 - DNA, 25 bp, Rattus norvegicus
gatgaacttatgctaccacactttt

SEQ ID NO: 364505 - DNA, 25 bp, Rattus norvegicus
gatgaacttatggtaccacactttt

SEQ ID NO: 364506 - DNA, 25 bp, Rattus norvegicus
gatgaacttcaaagagccacggcaa

SEQ ID NO: 364507 - DNA, 25 bp, Rattus norvegicus
gatgaacttcaatgagccacggcaa

SEQ ID NO: 364508 - DNA, 25 bp, Rattus norvegicus
gatgaacttcagctccacatgtgac

SEQ ID NO: 364509 - DNA, 25 bp, Rattus norvegicus
gatgaacttcaggtccacatgtgac

SEQ ID NO: 364510 - DNA, 25 bp, Rattus norvegicus
gatgaacttcatcagttaaaggcca

SEQ ID NO: 364511 - DNA, 25 bp, Rattus norvegicus
gatgaacttcatgagttaaaggcca

SEQ ID NO: 364512 - DNA, 25 bp, Rattus norvegicus
gatgaacttccacgttcttgctgtt

SEQ ID NO: 364513 - DNA, 25 bp, Rattus norvegicus
gatgaacttccaggttcttgctgtt

SEQ ID NO: 364514 - DNA, 25 bp, Rattus norvegicus
gatgaacttcggataacacaccact

SEQ ID NO: 364515 - DNA, 25 bp, Rattus norvegicus
gatgaacttcggttaacacaccact

SEQ ID NO: 364516 - DNA, 25 bp, Rattus norvegicus
gatgaacttcttaagcttttttaga

SEQ ID NO: 364517 - DNA, 25 bp, Rattus norvegicus
gatgaacttctttagcttttttaga

SEQ ID NO: 364518 - DNA, 25 bp, Rattus norvegicus
gatgaacttggactgttccgacgga

SEQ ID NO: 364519 - DNA, 25 bp, Rattus norvegicus
gatgaacttggagtgttccgacgga

SEQ ID NO: 364520 - DNA, 25 bp, Rattus norvegicus
gatgaactttcaccggagatgaccg

SEQ ID NO: 364521 - DNA, 25 bp, Rattus norvegicus
gatgaactttcacgctcagcgtaca

SEQ ID NO: 364522 - DNA, 25 bp, Rattus norvegicus
gatgaactttcagcggagatgaccg

SEQ ID NO: 364523 - DNA, 25 bp, Rattus norvegicus
gatgaactttcaggctcagcgtaca

SEQ ID NO: 364524 - DNA, 25 bp, Rattus norvegicus
gatgaacttttcaatactcagttgc

SEQ ID NO: 364525 - DNA, 25 bp, Rattus norvegicus
gatgaacttttctatactcagttgc

SEQ ID NO: 364526 - DNA, 25 bp, Rattus norvegicus
gatgaagaacatagtccccgactct

SEQ ID NO: 364527 - DNA, 25 bp, Rattus norvegicus
gatgaagaacattgtccccgactct

SEQ ID NO: 364528 - DNA, 25 bp, Rattus norvegicus
gatgaagaacttcgcttttttgctc

SEQ ID NO: 364529 - DNA, 25 bp, Rattus norvegicus
gatgaagaacttggcttttttgctc

SEQ ID NO: 364530 - DNA, 25 bp, Rattus norvegicus
gatgaagaagccattgtccggtctc

SEQ ID NO: 364531 - DNA, 25 bp, Rattus norvegicus
gatgaagaagcctttgtccggtctc

SEQ ID NO: 364532 - DNA, 25 bp, Rattus norvegicus
gatgaagaagcgctaccccacgacg

SEQ ID NO: 364533 - DNA, 25 bp, Rattus norvegicus
gatgaagaagcggtaccccacgacg

SEQ ID NO: 364534 - DNA, 25 bp, Rattus norvegicus
gatgaagaagctcagtttgtccctt

SEQ ID NO: 364535 - DNA, 25 bp, Rattus norvegicus
gatgaagaagctgagtttgtccctt

SEQ ID NO: 364536 - DNA, 25 bp, Rattus norvegicus
gatgaagacagtccccaagaccctc

SEQ ID NO: 364537 - DNA, 25 bp, Rattus norvegicus
gatgaagacagtgcccaagaccctc

SEQ ID NO: 364538 - DNA, 25 bp, Rattus norvegicus
gatgaagacctgctgccgagatcct

SEQ ID NO: 364539 - DNA, 25 bp, Rattus norvegicus
gatgaagacctggtgccgagatcct

SEQ ID NO: 364540 - DNA, 25 bp, Rattus norvegicus
gatgaagacgacagcatgcaccatg

SEQ ID NO: 364541 - DNA, 25 bp, Rattus norvegicus
gatgaagacgactgcatgcaccatg

SEQ ID NO: 364542 - DNA, 25 bp, Rattus norvegicus
gatgaagacgagcattcctatgcat

SEQ ID NO: 364543 - DNA, 25 bp, Rattus norvegicus
gatgaagacgaggattcctatgcat

SEQ ID NO: 364544 - DNA, 25 bp, Rattus norvegicus
gatgaagagactcttctgacccgcc

SEQ ID NO: 364545 - DNA, 25 bp, Rattus norvegicus
gatgaagagactgttctgacccgcc

SEQ ID NO: 364546 - DNA, 25 bp, Rattus norvegicus
gatgaagagcccatcacggacactt

SEQ ID NO: 364547 - DNA, 25 bp, Rattus norvegicus
gatgaagagcccttcacggacactt

SEQ ID NO: 364548 - DNA, 25 bp, Rattus norvegicus
gatgaagagtcacacacacctctcc

SEQ ID NO: 364549 - DNA, 25 bp, Rattus norvegicus
gatgaagagtcagacacacctctcc

SEQ ID NO: 364550 - DNA, 25 bp, Rattus norvegicus
gatgaagagtccaacagcctcctaa

SEQ ID NO: 364551 - DNA, 25 bp, Rattus norvegicus
gatgaagagtcctacagcctcctaa

SEQ ID NO: 364552 - DNA, 25 bp, Rattus norvegicus
gatgaagatcttcatctcctggcct

SEQ ID NO: 364553 - DNA, 25 bp, Rattus norvegicus
gatgaagatcttccccaattaccac

SEQ ID NO: 364554 - DNA, 25 bp, Rattus norvegicus
gatgaagatcttgatctcctggcct

SEQ ID NO: 364555 - DNA, 25 bp, Rattus norvegicus
gatgaagatcttgcccaattaccac

SEQ ID NO: 364556 - DNA, 25 bp, Rattus norvegicus
gatgaagatgacaggcaccactaaa

SEQ ID NO: 364557 - DNA, 25 bp, Rattus norvegicus
gatgaagatgactggcaccactaaa

SEQ ID NO: 364558 - DNA, 25 bp, Rattus norvegicus
gatgaagatgctactgtccctgcat

SEQ ID NO: 364559 - DNA, 25 bp, Rattus norvegicus
gatgaagatgcttctgtccctgcat

SEQ ID NO: 364560 - DNA, 25 bp, Rattus norvegicus
gatgaagcacaacaagcaaacctta

SEQ ID NO: 364561 - DNA, 25 bp, Rattus norvegicus
gatgaagcacaagaagcaaacctta

SEQ ID NO: 364562 - DNA, 25 bp, Rattus norvegicus
gatgaagcactaaaagccctcttaa

SEQ ID NO: 364563 - DNA, 25 bp, Rattus norvegicus
gatgaagcactataagccctcttaa

SEQ ID NO: 364564 - DNA, 25 bp, Rattus norvegicus
gatgaagcactgagcgccaggatct

SEQ ID NO: 364565 - DNA, 25 bp, Rattus norvegicus
gatgaagcactgtgcgccaggatct

SEQ ID NO: 364566 - DNA, 25 bp, Rattus norvegicus
gatgaagcagccaatgaagtgggat

SEQ ID NO: 364567 - DNA, 25 bp, Rattus norvegicus
gatgaagcagcccaccgagagtcca

SEQ ID NO: 364568 - DNA, 25 bp, Rattus norvegicus
gatgaagcagccgaccgagagtcca

SEQ ID NO: 364569 - DNA, 25 bp, Rattus norvegicus
gatgaagcagcctatgaagtgggat

SEQ ID NO: 364570 - DNA, 25 bp, Rattus norvegicus
gatgaagcatctcaagtcactctgg

SEQ ID NO: 364571 - DNA, 25 bp, Rattus norvegicus
gatgaagcatctgaagtcactctgg

SEQ ID NO: 364572 - DNA, 25 bp, Rattus norvegicus
gatgaagccaagctttccgttttct

SEQ ID NO: 364573 - DNA, 25 bp, Rattus norvegicus
gatgaagccaaggtttccgttttct

SEQ ID NO: 364574 - DNA, 25 bp, Rattus norvegicus
gatgaagccatgaagaatcaattct

SEQ ID NO: 364575 - DNA, 25 bp, Rattus norvegicus
gatgaagccatgtagaatcaattct

SEQ ID NO: 364576 - DNA, 25 bp, Rattus norvegicus
gatgaagccgagatgtgcaccagaa

SEQ ID NO: 364577 - DNA, 25 bp, Rattus norvegicus
gatgaagccgagttgtgcaccagaa

SEQ ID NO: 364578 - DNA, 25 bp, Rattus norvegicus
gatgaagcctatatgcatctccgcc

SEQ ID NO: 364579 - DNA, 25 bp, Rattus norvegicus
gatgaagcctatttgcatctccgcc

SEQ ID NO: 364580 - DNA, 25 bp, Rattus norvegicus
gatgaagcctgaattccattgggat

SEQ ID NO: 364581 - DNA, 25 bp, Rattus norvegicus
gatgaagcctgatttccattgggat

SEQ ID NO: 364582 - DNA, 25 bp, Rattus norvegicus
gatgaagcctttatccgtgatgtgg

SEQ ID NO: 364583 - DNA, 25 bp, Rattus norvegicus
gatgaagcctttttccgtgatgtgg

SEQ ID NO: 364584 - DNA, 25 bp, Rattus norvegicus
gatgaagcgaagatgcaacagacaa

SEQ ID NO: 364585 - DNA, 25 bp, Rattus norvegicus
gatgaagcgaagttgcaacagacaa

SEQ ID NO: 364586 - DNA, 25 bp, Rattus norvegicus
gatgaagcgactcccacaggccaaa

SEQ ID NO: 364587 - DNA, 25 bp, Rattus norvegicus
gatgaagcgactgccacaggccaaa

SEQ ID NO: 364588 - DNA, 25 bp, Rattus norvegicus
gatgaagctgcacgagtcactccat

SEQ ID NO: 364589 - DNA, 25 bp, Rattus norvegicus
gatgaagctgcaggagtcactccat

SEQ ID NO: 364590 - DNA, 25 bp, Rattus norvegicus
gatgaagctgctataccacttccag

SEQ ID NO: 364591 - DNA, 25 bp, Rattus norvegicus
gatgaagctgctttaccacttccag

SEQ ID NO: 364592 - DNA, 25 bp, Rattus norvegicus
gatgaagctgtgattctcactgcct

SEQ ID NO: 364593 - DNA, 25 bp, Rattus norvegicus
gatgaagctgtgtttctcactgcct

SEQ ID NO: 364594 - DNA, 25 bp, Rattus norvegicus
gatgaaggaagcctttgctctttgc

SEQ ID NO: 364595 - DNA, 25 bp, Rattus norvegicus
gatgaaggaagcgtttgctctttgc

SEQ ID NO: 364596 - DNA, 25 bp, Rattus norvegicus
gatgaaggcacactcaactccagct

SEQ ID NO: 364597 - DNA, 25 bp, Rattus norvegicus
gatgaaggcacagtcaactccagct

SEQ ID NO: 364598 - DNA, 25 bp, Rattus norvegicus
gatgaaggcatgctttcttccccta

SEQ ID NO: 364599 - DNA, 25 bp, Rattus norvegicus
gatgaaggcatggtttcttccccta

SEQ ID NO: 364600 - DNA, 25 bp, Rattus norvegicus
gatgaaggccaacaggacagccctt

SEQ ID NO: 364601 - DNA, 25 bp, Rattus norvegicus
gatgaaggccaagaggacagccctt

SEQ ID NO: 364602 - DNA, 25 bp, Rattus norvegicus
gatgaaggccctctgtactgtgtgc

SEQ ID NO: 364603 - DNA, 25 bp, Rattus norvegicus
gatgaaggccctgtgtactgtgtgc

SEQ ID NO: 364604 - DNA, 25 bp, Rattus norvegicus
gatgaaggccttagtctgaggacaa

SEQ ID NO: 364605 - DNA, 25 bp, Rattus norvegicus
gatgaaggcctttgtctgaggacaa

SEQ ID NO: 364606 - DNA, 25 bp, Rattus norvegicus
gatgaaggctacatgcctcaagaaa

SEQ ID NO: 364607 - DNA, 25 bp, Rattus norvegicus
gatgaaggctacttgcctcaagaaa

SEQ ID NO: 364608 - DNA, 25 bp, Rattus norvegicus
gatgaaggctcaaatcacgtggatg

SEQ ID NO: 364609 - DNA, 25 bp, Rattus norvegicus
gatgaaggctcatatcacgtggatg

SEQ ID NO: 364610 - DNA, 25 bp, Rattus norvegicus
gatgaaggctccatggagtccctca

SEQ ID NO: 364611 - DNA, 25 bp, Rattus norvegicus
gatgaaggctccttggagtccctca

SEQ ID NO: 364612 - DNA, 25 bp, Rattus norvegicus
gatgaagggcccagaccccattagt

SEQ ID NO: 364613 - DNA, 25 bp, Rattus norvegicus
gatgaagggccctgaccccattagt

SEQ ID NO: 364614 - DNA, 25 bp, Rattus norvegicus
gatgaaggtcttagtgcccactggc

SEQ ID NO: 364615 - DNA, 25 bp, Rattus norvegicus
gatgaaggtctttgtgcccactggc

SEQ ID NO: 364616 - DNA, 25 bp, Rattus norvegicus
gatgaagtcaaaccccgagactgat

SEQ ID NO: 364617 - DNA, 25 bp, Rattus norvegicus
gatgaagtcaaagcccgagactgat

SEQ ID NO: 364618 - DNA, 25 bp, Rattus norvegicus
gatgaagtcacgagtctcgcttttc

SEQ ID NO: 364619 - DNA, 25 bp, Rattus norvegicus
gatgaagtcacgtgtctcgcttttc

SEQ ID NO: 364620 - DNA, 25 bp, Rattus norvegicus
gatgaagtcggacgcgctgacacct

SEQ ID NO: 364621 - DNA, 25 bp, Rattus norvegicus
gatgaagtcggaggcgctgacacct

SEQ ID NO: 364622 - DNA, 25 bp, Rattus norvegicus
gatgaagtctatccacagaagatga

SEQ ID NO: 364623 - DNA, 25 bp, Rattus norvegicus
gatgaagtctatgcacagaagatga

SEQ ID NO: 364624 - DNA, 25 bp, Rattus norvegicus
gatgaagtctgcaggtaaatggaaa

SEQ ID NO: 364625 - DNA, 25 bp, Rattus norvegicus
gatgaagtctgctggtaaatggaaa

SEQ ID NO: 364626 - DNA, 25 bp, Rattus norvegicus
gatgaagtcttccatagctctgagg

SEQ ID NO: 364627 - DNA, 25 bp, Rattus norvegicus
gatgaagtcttccattgccatcgtt

SEQ ID NO: 364628 - DNA, 25 bp, Rattus norvegicus
gatgaagtcttcgatagctctgagg

SEQ ID NO: 364629 - DNA, 25 bp, Rattus norvegicus
gatgaagtcttcgattgccatcgtt

SEQ ID NO: 364630 - DNA, 25 bp, Rattus norvegicus
gatgaagtgactcacccaaggttac

SEQ ID NO: 364631 - DNA, 25 bp, Rattus norvegicus
gatgaagtgactgacccaaggttac

SEQ ID NO: 364632 - DNA, 25 bp, Rattus norvegicus
gatgaagtgtttatctctcccatgc

SEQ ID NO: 364633 - DNA, 25 bp, Rattus norvegicus
gatgaagtgtttttctctcccatgc

SEQ ID NO: 364634 - DNA, 25 bp, Rattus norvegicus
gatgaagttaaaagtcccctgagga

SEQ ID NO: 364635 - DNA, 25 bp, Rattus norvegicus
gatgaagttaaatgtcccctgagga

SEQ ID NO: 364636 - DNA, 25 bp, Rattus norvegicus
gatgaagttactcgccacctaaaac

SEQ ID NO: 364637 - DNA, 25 bp, Rattus norvegicus
gatgaagttactggccacctaaaac

SEQ ID NO: 364638 - DNA, 25 bp, Rattus norvegicus
gatgaagttatcattcccacagccc

SEQ ID NO: 364639 - DNA, 25 bp, Rattus norvegicus
gatgaagttatctttcccacagccc

SEQ ID NO: 364640 - DNA, 25 bp, Rattus norvegicus
gatgaagttgaccactatgtacatt

SEQ ID NO: 364641 - DNA, 25 bp, Rattus norvegicus
gatgaagttgacgactatgtacatt

SEQ ID NO: 364642 - DNA, 25 bp, Rattus norvegicus
gatgaagttgtgatgccatgcaagc

SEQ ID NO: 364643 - DNA, 25 bp, Rattus norvegicus
gatgaagttgtgttgccatgcaagc

SEQ ID NO: 364644 - DNA, 25 bp, Rattus norvegicus
gatgaataatgtcccctaccaggtt

SEQ ID NO: 364645 - DNA, 25 bp, Rattus norvegicus
gatgaataatgtgccctaccaggtt

SEQ ID NO: 364646 - DNA, 25 bp, Rattus norvegicus
gatgaatacaacagctgcgcccatt

SEQ ID NO: 364647 - DNA, 25 bp, Rattus norvegicus
gatgaatacaactgctgcgcccatt

SEQ ID NO: 364648 - DNA, 25 bp, Rattus norvegicus
gatgaataccgcaactcatagggat

SEQ ID NO: 364649 - DNA, 25 bp, Rattus norvegicus
gatgaataccgctactcatagggat

SEQ ID NO: 364650 - DNA, 25 bp, Rattus norvegicus
gatgaatagcgtccccggaacatat

SEQ ID NO: 364651 - DNA, 25 bp, Rattus norvegicus
gatgaatagcgtgcccggaacatat

SEQ ID NO: 364652 - DNA, 25 bp, Rattus norvegicus
gatgaatatgtccttccctctgtag

SEQ ID NO: 364653 - DNA, 25 bp, Rattus norvegicus
gatgaatatgtcgttccctctgtag

SEQ ID NO: 364654 - DNA, 25 bp, Rattus norvegicus
gatgaatcaacaatggcctccttgt

SEQ ID NO: 364655 - DNA, 25 bp, Rattus norvegicus
gatgaatcaacattggcctccttgt

SEQ ID NO: 364656 - DNA, 25 bp, Rattus norvegicus
gatgaatcagcaactggccactgca

SEQ ID NO: 364657 - DNA, 25 bp, Rattus norvegicus
gatgaatcagcatctggccactgca

SEQ ID NO: 364658 - DNA, 25 bp, Rattus norvegicus
gatgaatcgatgagagtccactcag

SEQ ID NO: 364659 - DNA, 25 bp, Rattus norvegicus
gatgaatcgatgtgagtccactcag

SEQ ID NO: 364660 - DNA, 25 bp, Rattus norvegicus
gatgaatctgacagtccgtcactga

SEQ ID NO: 364661 - DNA, 25 bp, Rattus norvegicus
gatgaatctgactgtccgtcactga

SEQ ID NO: 364662 - DNA, 25 bp, Rattus norvegicus
gatgaatcttcaatgtctgacttgg

SEQ ID NO: 364663 - DNA, 25 bp, Rattus norvegicus
gatgaatcttcattgtctgacttgg

SEQ ID NO: 364664 - DNA, 25 bp, Rattus norvegicus
gatgaatgactcatatctctctgga

SEQ ID NO: 364665 - DNA, 25 bp, Rattus norvegicus
gatgaatgactcttatctctctgga

SEQ ID NO: 364666 - DNA, 25 bp, Rattus norvegicus
gatgaatgagctaaaatcccttcgt

SEQ ID NO: 364667 - DNA, 25 bp, Rattus norvegicus
gatgaatgagctaccaaagccattt

SEQ ID NO: 364668 - DNA, 25 bp, Rattus norvegicus
gatgaatgagcttaaatcccttcgt

SEQ ID NO: 364669 - DNA, 25 bp, Rattus norvegicus
gatgaatgagcttccaaagccattt

SEQ ID NO: 364670 - DNA, 25 bp, Rattus norvegicus
gatgaatgagttatgcccagttttt

SEQ ID NO: 364671 - DNA, 25 bp, Rattus norvegicus
gatgaatgagttttgcccagttttt

SEQ ID NO: 364672 - DNA, 25 bp, Rattus norvegicus
gatgaatgcagactgtgctaccatt

SEQ ID NO: 364673 - DNA, 25 bp, Rattus norvegicus
gatgaatgcagagtgtgctaccatt

SEQ ID NO: 364674 - DNA, 25 bp, Rattus norvegicus
gatgaatgcatcactttgcctgttt

SEQ ID NO: 364675 - DNA, 25 bp, Rattus norvegicus
gatgaatgcatctctttgcctgttt

SEQ ID NO: 364676 - DNA, 25 bp, Rattus norvegicus
gatgaatgcccgctctaagaatgtt

SEQ ID NO: 364677 - DNA, 25 bp, Rattus norvegicus
gatgaatgcccggtctaagaatgtt

SEQ ID NO: 364678 - DNA, 25 bp, Rattus norvegicus
gatgaatgcctgactattttcctgt

SEQ ID NO: 364679 - DNA, 25 bp, Rattus norvegicus
gatgaatgcctgatgtcgcccggac

SEQ ID NO: 364680 - DNA, 25 bp, Rattus norvegicus
gatgaatgcctgcaacgttccagca

SEQ ID NO: 364681 - DNA, 25 bp, Rattus norvegicus
gatgaatgcctggaacgttccagca

SEQ ID NO: 364682 - DNA, 25 bp, Rattus norvegicus
gatgaatgcctgtctattttcctgt

SEQ ID NO: 364683 - DNA, 25 bp, Rattus norvegicus
gatgaatgcctgttgtcgcccggac

SEQ ID NO: 364684 - DNA, 25 bp, Rattus norvegicus
gatgaatgctccaatgcactgccat

SEQ ID NO: 364685 - DNA, 25 bp, Rattus norvegicus
gatgaatgctcctatgcactgccat

SEQ ID NO: 364686 - DNA, 25 bp, Rattus norvegicus
gatgaatggcaccttatttttcaag

SEQ ID NO: 364687 - DNA, 25 bp, Rattus norvegicus
gatgaatggcacgttatttttcaag

SEQ ID NO: 364688 - DNA, 25 bp, Rattus norvegicus
gatgaatgtaccatgtgccaacctg

SEQ ID NO: 364689 - DNA, 25 bp, Rattus norvegicus
gatgaatgtaccttgtgccaacctg

SEQ ID NO: 364690 - DNA, 25 bp, Rattus norvegicus
gatgaattacacagagcacgcgact

SEQ ID NO: 364691 - DNA, 25 bp, Rattus norvegicus
gatgaattacactgagcacgcgact

SEQ ID NO: 364692 - DNA, 25 bp, Rattus norvegicus
gatgaattattccaccctaggtaca

SEQ ID NO: 364693 - DNA, 25 bp, Rattus norvegicus
gatgaattattcgaccctaggtaca

SEQ ID NO: 364694 - DNA, 25 bp, Rattus norvegicus
gatgaattcccactttgtggccaca

SEQ ID NO: 364695 - DNA, 25 bp, Rattus norvegicus
gatgaattcccagtttgtggccaca

SEQ ID NO: 364696 - DNA, 25 bp, Rattus norvegicus
gatgaattccgaacagtcctgtgac

SEQ ID NO: 364697 - DNA, 25 bp, Rattus norvegicus
gatgaattccgatcagtcctgtgac

SEQ ID NO: 364698 - DNA, 25 bp, Rattus norvegicus
gatgaattctccaagcaggtcgata

SEQ ID NO: 364699 - DNA, 25 bp, Rattus norvegicus
gatgaattctcctagcaggtcgata

SEQ ID NO: 364700 - DNA, 25 bp, Rattus norvegicus
gatgaattggccaggctaccactgt

SEQ ID NO: 364701 - DNA, 25 bp, Rattus norvegicus
gatgaattggcctggctaccactgt

SEQ ID NO: 364702 - DNA, 25 bp, Rattus norvegicus
gatgaattgtccaccgaagttgcct

SEQ ID NO: 364703 - DNA, 25 bp, Rattus norvegicus
gatgaattgtcctccgaagttgcct

SEQ ID NO: 364704 - DNA, 25 bp, Rattus norvegicus
gatgaattgttcctgcatgtgctgt

SEQ ID NO: 364705 - DNA, 25 bp, Rattus norvegicus
gatgaattgttcgtgcatgtgctgt

SEQ ID NO: 364706 - DNA, 25 bp, Rattus norvegicus
gatgaatttcagcatgtccctacaa

SEQ ID NO: 364707 - DNA, 25 bp, Rattus norvegicus
gatgaatttcaggatgtccctacaa

SEQ ID NO: 364708 - DNA, 25 bp, Rattus norvegicus
gatgaatttcttcaatcctgtcagg

SEQ ID NO: 364709 - DNA, 25 bp, Rattus norvegicus
gatgaatttcttgaatcctgtcagg

SEQ ID NO: 364710 - DNA, 25 bp, Rattus norvegicus
gatgaatttgacctaccttgtgcca

SEQ ID NO: 364711 - DNA, 25 bp, Rattus norvegicus
gatgaatttgacgtaccttgtgcca

SEQ ID NO: 364712 - DNA, 25 bp, Rattus norvegicus
gatgaattttgaagctcagctctca

SEQ ID NO: 364713 - DNA, 25 bp, Rattus norvegicus
gatgaattttgatgctcagctctca

SEQ ID NO: 364714 - DNA, 25 bp, Rattus norvegicus
gatgaattttgtccgactgtgtaga

SEQ ID NO: 364715 - DNA, 25 bp, Rattus norvegicus
gatgaattttgtccttctgctcttc

SEQ ID NO: 364716 - DNA, 25 bp, Rattus norvegicus
gatgaattttgtgcgactgtgtaga

SEQ ID NO: 364717 - DNA, 25 bp, Rattus norvegicus
gatgaattttgtgcttctgctcttc

SEQ ID NO: 364718 - DNA, 25 bp, Rattus norvegicus
gatgaattttttcccatccgttctc

SEQ ID NO: 364719 - DNA, 25 bp, Rattus norvegicus
gatgaattttttgccatccgttctc

SEQ ID NO: 364720 - DNA, 25 bp, Rattus norvegicus
gatgacaaaccaccaagcacgggaa

SEQ ID NO: 364721 - DNA, 25 bp, Rattus norvegicus
gatgacaaaccagcaagcacgggaa

SEQ ID NO: 364722 - DNA, 25 bp, Rattus norvegicus
gatgacaaacgcactctattttcaa

SEQ ID NO: 364723 - DNA, 25 bp, Rattus norvegicus
gatgacaaacgctctctattttcaa

SEQ ID NO: 364724 - DNA, 25 bp, Rattus norvegicus
gatgacaaagccactggagaactag

SEQ ID NO: 364725 - DNA, 25 bp, Rattus norvegicus
gatgacaaagcctctggagaactag

SEQ ID NO: 364726 - DNA, 25 bp, Rattus norvegicus
gatgacaaagtcacctttgaagttt

SEQ ID NO: 364727 - DNA, 25 bp, Rattus norvegicus
gatgacaaagtcagccctactgtgt

SEQ ID NO: 364728 - DNA, 25 bp, Rattus norvegicus
gatgacaaagtctcctttgaagttt

SEQ ID NO: 364729 - DNA, 25 bp, Rattus norvegicus
gatgacaaagtctgccctactgtgt

SEQ ID NO: 364730 - DNA, 25 bp, Rattus norvegicus
gatgacaacattctactgtgaacca

SEQ ID NO: 364731 - DNA, 25 bp, Rattus norvegicus
gatgacaacattgtactgtgaacca

SEQ ID NO: 364732 - DNA, 25 bp, Rattus norvegicus
gatgacaactgtctgtctctacacc

SEQ ID NO: 364733 - DNA, 25 bp, Rattus norvegicus
gatgacaactgtgtgtctctacacc

SEQ ID NO: 364734 - DNA, 25 bp, Rattus norvegicus
gatgacaagcggaaggtgcccttta

SEQ ID NO: 364735 - DNA, 25 bp, Rattus norvegicus
gatgacaagcggtaggtgcccttta

SEQ ID NO: 364736 - DNA, 25 bp, Rattus norvegicus
gatgacaagtacctcccacagcggt

SEQ ID NO: 364737 - DNA, 25 bp, Rattus norvegicus
gatgacaagtacgtcccacagcggt

SEQ ID NO: 364738 - DNA, 25 bp, Rattus norvegicus
gatgacaagttgaaccttttatttt

SEQ ID NO: 364739 - DNA, 25 bp, Rattus norvegicus
gatgacaagttgtaccttttatttt

SEQ ID NO: 364740 - DNA, 25 bp, Rattus norvegicus
gatgacaagtttccagacacagttt

SEQ ID NO: 364741 - DNA, 25 bp, Rattus norvegicus
gatgacaagtttgcagacacagttt

SEQ ID NO: 364742 - DNA, 25 bp, Rattus norvegicus
gatgacaatcagaaccctccaggca

SEQ ID NO: 364743 - DNA, 25 bp, Rattus norvegicus
gatgacaatcagtaccctccaggca

SEQ ID NO: 364744 - DNA, 25 bp, Rattus norvegicus
gatgacaatgttaagagcctgggaa

SEQ ID NO: 364745 - DNA, 25 bp, Rattus norvegicus
gatgacaatgtttagagcctgggaa

SEQ ID NO: 364746 - DNA, 25 bp, Rattus norvegicus
gatgacacaagtagctttctgcagc

SEQ ID NO: 364747 - DNA, 25 bp, Rattus norvegicus
gatgacacaagttgctttctgcagc

SEQ ID NO: 364748 - DNA, 25 bp, Rattus norvegicus
gatgacacactgaagtctcggcact

SEQ ID NO: 364749 - DNA, 25 bp, Rattus norvegicus
gatgacacactgtagtctcggcact

SEQ ID NO: 364750 - DNA, 25 bp, Rattus norvegicus
gatgacacagatctcagtggtgagt

SEQ ID NO: 364751 - DNA, 25 bp, Rattus norvegicus
gatgacacagatgtcagtggtgagt

SEQ ID NO: 364752 - DNA, 25 bp, Rattus norvegicus
gatgacacaggtcccaaggtcccca

SEQ ID NO: 364753 - DNA, 25 bp, Rattus norvegicus
gatgacacaggtgccaaggtcccca

SEQ ID NO: 364754 - DNA, 25 bp, Rattus norvegicus
gatgacacagtgagtgcctgcctgc

SEQ ID NO: 364755 - DNA, 25 bp, Rattus norvegicus
gatgacacagtgtgtgcctgcctgc

SEQ ID NO: 364756 - DNA, 25 bp, Rattus norvegicus
gatgacaccgacatctagtggtcgt

SEQ ID NO: 364757 - DNA, 25 bp, Rattus norvegicus
gatgacaccgacttctagtggtcgt

SEQ ID NO: 364758 - DNA, 25 bp, Rattus norvegicus
gatgacacctacaggctgtctagat

SEQ ID NO: 364759 - DNA, 25 bp, Rattus norvegicus
gatgacacctactggctgtctagat

SEQ ID NO: 364760 - DNA, 25 bp, Rattus norvegicus
gatgacacgcagacctatgttctta

SEQ ID NO: 364761 - DNA, 25 bp, Rattus norvegicus
gatgacacgcagtcctatgttctta

SEQ ID NO: 364762 - DNA, 25 bp, Rattus norvegicus
gatgacacgtgcatgcagactcagg

SEQ ID NO: 364763 - DNA, 25 bp, Rattus norvegicus
gatgacacgtgcttgcagactcagg

SEQ ID NO: 364764 - DNA, 25 bp, Rattus norvegicus
gatgacacgtggctttgattttgag

SEQ ID NO: 364765 - DNA, 25 bp, Rattus norvegicus
gatgacacgtgggtttgattttgag

SEQ ID NO: 364766 - DNA, 25 bp, Rattus norvegicus
gatgacactatcatcaccattttca

SEQ ID NO: 364767 - DNA, 25 bp, Rattus norvegicus
gatgacactatcttcaccattttca

SEQ ID NO: 364768 - DNA, 25 bp, Rattus norvegicus
gatgacactattactgtttacctgt

SEQ ID NO: 364769 - DNA, 25 bp, Rattus norvegicus
gatgacactatttctgtttacctgt

SEQ ID NO: 364770 - DNA, 25 bp, Rattus norvegicus
gatgacactcacattgtttccagtt

SEQ ID NO: 364771 - DNA, 25 bp, Rattus norvegicus
gatgacactcactttgtttccagtt

SEQ ID NO: 364772 - DNA, 25 bp, Rattus norvegicus
gatgacactgacacttaaacaaggc

SEQ ID NO: 364773 - DNA, 25 bp, Rattus norvegicus
gatgacactgactcttaaacaaggc

SEQ ID NO: 364774 - DNA, 25 bp, Rattus norvegicus
gatgacactgcccttaaacaagctg

SEQ ID NO: 364775 - DNA, 25 bp, Rattus norvegicus
gatgacactgccgttaaacaagctg

SEQ ID NO: 364776 - DNA, 25 bp, Rattus norvegicus
gatgacagacaccttctgggctcct

SEQ ID NO: 364777 - DNA, 25 bp, Rattus norvegicus
gatgacagacacgttctgggctcct

SEQ ID NO: 364778 - DNA, 25 bp, Rattus norvegicus
gatgacagactgaattgggccttca

SEQ ID NO: 364779 - DNA, 25 bp, Rattus norvegicus
gatgacagactgtattgggccttca

SEQ ID NO: 364780 - DNA, 25 bp, Rattus norvegicus
gatgacagcaccaccaactgtgaag

SEQ ID NO: 364781 - DNA, 25 bp, Rattus norvegicus
gatgacagcacctccaactgtgaag

SEQ ID NO: 364782 - DNA, 25 bp, Rattus norvegicus
gatgacagcagcattttgtggtcct

SEQ ID NO: 364783 - DNA, 25 bp, Rattus norvegicus
gatgacagcagctttttgtggtcct

SEQ ID NO: 364784 - DNA, 25 bp, Rattus norvegicus
gatgacagcattcaagaccttggag

SEQ ID NO: 364785 - DNA, 25 bp, Rattus norvegicus
gatgacagcattgaagaccttggag

SEQ ID NO: 364786 - DNA, 25 bp, Rattus norvegicus
gatgacagccccaatggagactttg

SEQ ID NO: 364787 - DNA, 25 bp, Rattus norvegicus
gatgacagcccctatggagactttg

SEQ ID NO: 364788 - DNA, 25 bp, Rattus norvegicus
gatgacagcgacctatccaagatcg

SEQ ID NO: 364789 - DNA, 25 bp, Rattus norvegicus
gatgacagcgacgtatccaagatcg

SEQ ID NO: 364790 - DNA, 25 bp, Rattus norvegicus
gatgacagctgacatgccccagaca

SEQ ID NO: 364791 - DNA, 25 bp, Rattus norvegicus
gatgacagctgacgcacacaggcgt

SEQ ID NO: 364792 - DNA, 25 bp, Rattus norvegicus
gatgacagctgagatgccccagaca

SEQ ID NO: 364793 - DNA, 25 bp, Rattus norvegicus
gatgacagctgaggcacacaggcgt

SEQ ID NO: 364794 - DNA, 25 bp, Rattus norvegicus
gatgacagcttcattctagcacaat

SEQ ID NO: 364795 - DNA, 25 bp, Rattus norvegicus
gatgacagcttctttctagcacaat

SEQ ID NO: 364796 - DNA, 25 bp, Rattus norvegicus
gatgacaggtagactcgatcccaga

SEQ ID NO: 364797 - DNA, 25 bp, Rattus norvegicus
gatgacaggtagtctcgatcccaga

SEQ ID NO: 364798 - DNA, 25 bp, Rattus norvegicus
gatgacagtcagctcgaagatccga

SEQ ID NO: 364799 - DNA, 25 bp, Rattus norvegicus
gatgacagtcaggtcgaagatccga

SEQ ID NO: 364800 - DNA, 25 bp, Rattus norvegicus
gatgacagtgaccagtgtgactcaa

SEQ ID NO: 364801 - DNA, 25 bp, Rattus norvegicus
gatgacagtgacgagtgtgactcaa

SEQ ID NO: 364802 - DNA, 25 bp, Rattus norvegicus
gatgacagtggcctaacagaacaga

SEQ ID NO: 364803 - DNA, 25 bp, Rattus norvegicus
gatgacagtggcgtaacagaacaga

SEQ ID NO: 364804 - DNA, 25 bp, Rattus norvegicus
gatgacagttcaacgcattcacaaa

SEQ ID NO: 364805 - DNA, 25 bp, Rattus norvegicus
gatgacagttcatcgcattcacaaa

SEQ ID NO: 364806 - DNA, 25 bp, Rattus norvegicus
gatgacatacacacgttactctgct

SEQ ID NO: 364807 - DNA, 25 bp, Rattus norvegicus
gatgacatacactcgttactctgct

SEQ ID NO: 364808 - DNA, 25 bp, Rattus norvegicus
gatgacatagacaccgtagcgcagc

SEQ ID NO: 364809 - DNA, 25 bp, Rattus norvegicus
gatgacatagactccgtagcgcagc

SEQ ID NO: 364810 - DNA, 25 bp, Rattus norvegicus
gatgacatcaccctacagtcaatca

SEQ ID NO: 364811 - DNA, 25 bp, Rattus norvegicus
gatgacatcaccgtacagtcaatca

SEQ ID NO: 364812 - DNA, 25 bp, Rattus norvegicus
gatgacatcagaacagactttgaca

SEQ ID NO: 364813 - DNA, 25 bp, Rattus norvegicus
gatgacatcagatcagactttgaca

SEQ ID NO: 364814 - DNA, 25 bp, Rattus norvegicus
gatgacatcctaagttccactggtt

SEQ ID NO: 364815 - DNA, 25 bp, Rattus norvegicus
gatgacatcctatgttccactggtt

SEQ ID NO: 364816 - DNA, 25 bp, Rattus norvegicus
gatgacatcgaaatgctccctgaag

SEQ ID NO: 364817 - DNA, 25 bp, Rattus norvegicus
gatgacatcgaattgctccctgaag

SEQ ID NO: 364818 - DNA, 25 bp, Rattus norvegicus
gatgacatcgtcaatatgggccaag

SEQ ID NO: 364819 - DNA, 25 bp, Rattus norvegicus
gatgacatcgtctatatgggccaag

SEQ ID NO: 364820 - DNA, 25 bp, Rattus norvegicus
gatgacatcgtgcttcacagtcgca

SEQ ID NO: 364821 - DNA, 25 bp, Rattus norvegicus
gatgacatcgtggttcacagtcgca

SEQ ID NO: 364822 - DNA, 25 bp, Rattus norvegicus
gatgacatctacagcccggtgtaat

SEQ ID NO: 364823 - DNA, 25 bp, Rattus norvegicus
gatgacatctactgcccggtgtaat

SEQ ID NO: 364824 - DNA, 25 bp, Rattus norvegicus
gatgacatctatatggccctggagt

SEQ ID NO: 364825 - DNA, 25 bp, Rattus norvegicus
gatgacatctatttggccctggagt

SEQ ID NO: 364826 - DNA, 25 bp, Rattus norvegicus
gatgacatcttccattgttttggtt

SEQ ID NO: 364827 - DNA, 25 bp, Rattus norvegicus
gatgacatcttcgattgttttggtt

SEQ ID NO: 364828 - DNA, 25 bp, Rattus norvegicus
gatgacatctttccagcctggatag

SEQ ID NO: 364829 - DNA, 25 bp, Rattus norvegicus
gatgacatctttgcagcctggatag

SEQ ID NO: 364830 - DNA, 25 bp, Rattus norvegicus
gatgacatgagtattccttcgtccc

SEQ ID NO: 364831 - DNA, 25 bp, Rattus norvegicus
gatgacatgagttttccttcgtccc

SEQ ID NO: 364832 - DNA, 25 bp, Rattus norvegicus
gatgacatggctaactatattctta

SEQ ID NO: 364833 - DNA, 25 bp, Rattus norvegicus
gatgacatggcttactatattctta

SEQ ID NO: 364834 - DNA, 25 bp, Rattus norvegicus
gatgacatgggccttgaccttacta

SEQ ID NO: 364835 - DNA, 25 bp, Rattus norvegicus
gatgacatgggcgttgaccttacta

SEQ ID NO: 364836 - DNA, 25 bp, Rattus norvegicus
gatgacatgtacagtctctatggtg

SEQ ID NO: 364837 - DNA, 25 bp, Rattus norvegicus
gatgacatgtactgtctctatggtg

SEQ ID NO: 364838 - DNA, 25 bp, Rattus norvegicus
gatgacatgtcacaggcccagggct

SEQ ID NO: 364839 - DNA, 25 bp, Rattus norvegicus
gatgacatgtcagaggcccagggct

SEQ ID NO: 364840 - DNA, 25 bp, Rattus norvegicus
gatgacatgtccaggctctatacct

SEQ ID NO: 364841 - DNA, 25 bp, Rattus norvegicus
gatgacatgtcctggctctatacct

SEQ ID NO: 364842 - DNA, 25 bp, Rattus norvegicus
gatgacatgtttcaaccctatctgt

SEQ ID NO: 364843 - DNA, 25 bp, Rattus norvegicus
gatgacatgtttgaaccctatctgt

SEQ ID NO: 364844 - DNA, 25 bp, Rattus norvegicus
gatgacattgacatgttccctaagt

SEQ ID NO: 364845 - DNA, 25 bp, Rattus norvegicus
gatgacattgacttgttccctaagt

SEQ ID NO: 364846 - DNA, 25 bp, Rattus norvegicus
gatgacattgatcctgacgtgctgc

SEQ ID NO: 364847 - DNA, 25 bp, Rattus norvegicus
gatgacattgatgctgacgtgctgc

SEQ ID NO: 364848 - DNA, 25 bp, Rattus norvegicus
gatgacattgggacataccagcccc

SEQ ID NO: 364849 - DNA, 25 bp, Rattus norvegicus
gatgacattgggtcataccagcccc

SEQ ID NO: 364850 - DNA, 25 bp, Rattus norvegicus
gatgacattgtcactggccacaaga

SEQ ID NO: 364851 - DNA, 25 bp, Rattus norvegicus
gatgacattgtctctggccacaaga

SEQ ID NO: 364852 - DNA, 25 bp, Rattus norvegicus
gatgacatttctccctccaggtgga

SEQ ID NO: 364853 - DNA, 25 bp, Rattus norvegicus
gatgacatttctgcctccaggtgga

SEQ ID NO: 364854 - DNA, 25 bp, Rattus norvegicus
gatgacatttttacctcttttctag

SEQ ID NO: 364855 - DNA, 25 bp, Rattus norvegicus
gatgacattttttcctcttttctag

SEQ ID NO: 364856 - DNA, 25 bp, Rattus norvegicus
gatgaccaacgcatagttatcggga

SEQ ID NO: 364857 - DNA, 25 bp, Rattus norvegicus
gatgaccaacgcttagttatcggga

SEQ ID NO: 364858 - DNA, 25 bp, Rattus norvegicus
gatgaccaagcaacaatgcctgagt

SEQ ID NO: 364859 - DNA, 25 bp, Rattus norvegicus
gatgaccaagcatcaatgcctgagt

SEQ ID NO: 364860 - DNA, 25 bp, Rattus norvegicus
gatgaccaagtcacggttggagcac

SEQ ID NO: 364861 - DNA, 25 bp, Rattus norvegicus
gatgaccaagtctcggttggagcac

SEQ ID NO: 364862 - DNA, 25 bp, Rattus norvegicus
gatgaccaattactgcttagttaac

SEQ ID NO: 364863 - DNA, 25 bp, Rattus norvegicus
gatgaccaattagtgcttagttaac

SEQ ID NO: 364864 - DNA, 25 bp, Rattus norvegicus
gatgaccacagactctataggcaag

SEQ ID NO: 364865 - DNA, 25 bp, Rattus norvegicus
gatgaccacagagtctataggcaag

SEQ ID NO: 364866 - DNA, 25 bp, Rattus norvegicus
gatgaccaccgactctcttaattaa

SEQ ID NO: 364867 - DNA, 25 bp, Rattus norvegicus
gatgaccaccgagtctcttaattaa

SEQ ID NO: 364868 - DNA, 25 bp, Rattus norvegicus
gatgaccacctcaactggttagtaa

SEQ ID NO: 364869 - DNA, 25 bp, Rattus norvegicus
gatgaccacctctactggttagtaa

SEQ ID NO: 364870 - DNA, 25 bp, Rattus norvegicus
gatgaccacgccatccgtggccccg

SEQ ID NO: 364871 - DNA, 25 bp, Rattus norvegicus
gatgaccacgccttccgtggccccg

SEQ ID NO: 364872 - DNA, 25 bp, Rattus norvegicus
gatgaccagagtaacccttattttg

SEQ ID NO: 364873 - DNA, 25 bp, Rattus norvegicus
gatgaccagagttacccttattttg

SEQ ID NO: 364874 - DNA, 25 bp, Rattus norvegicus
gatgaccagattctggtacctcagc

SEQ ID NO: 364875 - DNA, 25 bp, Rattus norvegicus
gatgaccagattgtggtacctcagc

SEQ ID NO: 364876 - DNA, 25 bp, Rattus norvegicus
gatgaccagctgcagctacgtggct

SEQ ID NO: 364877 - DNA, 25 bp, Rattus norvegicus
gatgaccagctggagctacgtggct

SEQ ID NO: 364878 - DNA, 25 bp, Rattus norvegicus
gatgaccagcttaatggacagacaa

SEQ ID NO: 364879 - DNA, 25 bp, Rattus norvegicus
gatgaccagctttatggacagacaa

SEQ ID NO: 364880 - DNA, 25 bp, Rattus norvegicus
gatgaccagggccaccattagtggt

SEQ ID NO: 364881 - DNA, 25 bp, Rattus norvegicus
gatgaccagggccagttccagaaca

SEQ ID NO: 364882 - DNA, 25 bp, Rattus norvegicus
gatgaccagggcgaccattagtggt

SEQ ID NO: 364883 - DNA, 25 bp, Rattus norvegicus
gatgaccagggcgagttccagaaca

SEQ ID NO: 364884 - DNA, 25 bp, Rattus norvegicus
gatgaccaggttcccaagagttcca

SEQ ID NO: 364885 - DNA, 25 bp, Rattus norvegicus
gatgaccaggttgccaagagttcca

SEQ ID NO: 364886 - DNA, 25 bp, Rattus norvegicus
gatgaccagtgcatgcttcacggca

SEQ ID NO: 364887 - DNA, 25 bp, Rattus norvegicus
gatgaccagtgcttgcttcacggca

SEQ ID NO: 364888 - DNA, 25 bp, Rattus norvegicus
gatgaccatcgtaagcaagcagctg

SEQ ID NO: 364889 - DNA, 25 bp, Rattus norvegicus
gatgaccatcgttagcaagcagctg

SEQ ID NO: 364890 - DNA, 25 bp, Rattus norvegicus
gatgaccatgaaccaggagaccatt

SEQ ID NO: 364891 - DNA, 25 bp, Rattus norvegicus
gatgaccatgaagcaggagaccatt

SEQ ID NO: 364892 - DNA, 25 bp, Rattus norvegicus
gatgaccatgagagataaggactga

SEQ ID NO: 364893 - DNA, 25 bp, Rattus norvegicus
gatgaccatgagtgataaggactga

SEQ ID NO: 364894 - DNA, 25 bp, Rattus norvegicus
gatgaccatgcaatcctgttcagta

SEQ ID NO: 364895 - DNA, 25 bp, Rattus norvegicus
gatgaccatgcattcctgttcagta

SEQ ID NO: 364896 - DNA, 25 bp, Rattus norvegicus
gatgaccatggaagtcctgggccta

SEQ ID NO: 364897 - DNA, 25 bp, Rattus norvegicus
gatgaccatggatgtcctgggccta

SEQ ID NO: 364898 - DNA, 25 bp, Rattus norvegicus
gatgaccatggtagcagcccaagtc

SEQ ID NO: 364899 - DNA, 25 bp, Rattus norvegicus
gatgaccatggttgcagcccaagtc

SEQ ID NO: 364900 - DNA, 25 bp, Rattus norvegicus
gatgaccatgtgactgctctactag

SEQ ID NO: 364901 - DNA, 25 bp, Rattus norvegicus
gatgaccatgtgtctgctctactag

SEQ ID NO: 364902 - DNA, 25 bp, Rattus norvegicus
gatgaccattctcatacaactgttt

SEQ ID NO: 364903 - DNA, 25 bp, Rattus norvegicus
gatgaccattctgatacaactgttt

SEQ ID NO: 364904 - DNA, 25 bp, Rattus norvegicus
gatgaccattttagcagtccgacct

SEQ ID NO: 364905 - DNA, 25 bp, Rattus norvegicus
gatgaccattttcaccacaaggtta

SEQ ID NO: 364906 - DNA, 25 bp, Rattus norvegicus
gatgaccattttgaccacaaggtta

SEQ ID NO: 364907 - DNA, 25 bp, Rattus norvegicus
gatgaccatttttgcagtccgacct

SEQ ID NO: 364908 - DNA, 25 bp, Rattus norvegicus
gatgacccaagtagtcctagaccag

SEQ ID NO: 364909 - DNA, 25 bp, Rattus norvegicus
gatgacccaagttgtcctagaccag

SEQ ID NO: 364910 - DNA, 25 bp, Rattus norvegicus
gatgacccaataatttgttccagaa

SEQ ID NO: 364911 - DNA, 25 bp, Rattus norvegicus
gatgacccaatattttgttccagaa

SEQ ID NO: 364912 - DNA, 25 bp, Rattus norvegicus
gatgacccactaagggatggctttc

SEQ ID NO: 364913 - DNA, 25 bp, Rattus norvegicus
gatgacccactatgggatggctttc

SEQ ID NO: 364914 - DNA, 25 bp, Rattus norvegicus
gatgacccagagctcctacaaacag

SEQ ID NO: 364915 - DNA, 25 bp, Rattus norvegicus
gatgacccagaggtcctacaaacag

SEQ ID NO: 364916 - DNA, 25 bp, Rattus norvegicus
gatgacccagctaaacaagttcccc

SEQ ID NO: 364917 - DNA, 25 bp, Rattus norvegicus
gatgacccagcttaacaagttcccc

SEQ ID NO: 364918 - DNA, 25 bp, Rattus norvegicus
gatgacccgactctactttgagaag

SEQ ID NO: 364919 - DNA, 25 bp, Rattus norvegicus
gatgacccgactgtactttgagaag

SEQ ID NO: 364920 - DNA, 25 bp, Rattus norvegicus
gatgacccgagtaccatctctggga

SEQ ID NO: 364921 - DNA, 25 bp, Rattus norvegicus
gatgacccgagttccatctctggga

SEQ ID NO: 364922 - DNA, 25 bp, Rattus norvegicus
gatgaccctcggatttatggaaatg

SEQ ID NO: 364923 - DNA, 25 bp, Rattus norvegicus
gatgaccctcggttttatggaaatg

SEQ ID NO: 364924 - DNA, 25 bp, Rattus norvegicus
gatgaccctggtatcgaaaactaag

SEQ ID NO: 364925 - DNA, 25 bp, Rattus norvegicus
gatgaccctggtttcgaaaactaag

SEQ ID NO: 364926 - DNA, 25 bp, Rattus norvegicus
gatgaccgaggtcctaaccagccag

SEQ ID NO: 364927 - DNA, 25 bp, Rattus norvegicus
gatgaccgaggtgctaaccagccag

SEQ ID NO: 364928 - DNA, 25 bp, Rattus norvegicus
gatgaccgcatcaagattatttttc

SEQ ID NO: 364929 - DNA, 25 bp, Rattus norvegicus
gatgaccgcatctagattatttttc

SEQ ID NO: 364930 - DNA, 25 bp, Rattus norvegicus
gatgaccggatacacgacgtgctga

SEQ ID NO: 364931 - DNA, 25 bp, Rattus norvegicus
gatgaccggatagacgacgtgctga

SEQ ID NO: 364932 - DNA, 25 bp, Rattus norvegicus
gatgaccggattactaccatgcttc

SEQ ID NO: 364933 - DNA, 25 bp, Rattus norvegicus
gatgaccggatttctaccatgcttc

SEQ ID NO: 364934 - DNA, 25 bp, Rattus norvegicus
gatgaccgggacaattacagcagat

SEQ ID NO: 364935 - DNA, 25 bp, Rattus norvegicus
gatgaccgggactattacagcagat

SEQ ID NO: 364936 - DNA, 25 bp, Rattus norvegicus
gatgaccgggataccaaaagggatt

SEQ ID NO: 364937 - DNA, 25 bp, Rattus norvegicus
gatgaccgggattccaaaagggatt

SEQ ID NO: 364938 - DNA, 25 bp, Rattus norvegicus
gatgaccgggcacttattacacaga

SEQ ID NO: 364939 - DNA, 25 bp, Rattus norvegicus
gatgaccgggcagttattacacaga

SEQ ID NO: 364940 - DNA, 25 bp, Rattus norvegicus
gatgaccgtcacatgcttgatcagg

SEQ ID NO: 364941 - DNA, 25 bp, Rattus norvegicus
gatgaccgtcacttgcttgatcagg

SEQ ID NO: 364942 - DNA, 25 bp, Rattus norvegicus
gatgaccgtcttagtattattcaag

SEQ ID NO: 364943 - DNA, 25 bp, Rattus norvegicus
gatgaccgtctttgtattattcaag

SEQ ID NO: 364944 - DNA, 25 bp, Rattus norvegicus
gatgaccgtggcatgtaccttttcc

SEQ ID NO: 364945 - DNA, 25 bp, Rattus norvegicus
gatgaccgtggcttgtaccttttcc

SEQ ID NO: 364946 - DNA, 25 bp, Rattus norvegicus
gatgacctataaattgccaagtact

SEQ ID NO: 364947 - DNA, 25 bp, Rattus norvegicus
gatgacctataatttgccaagtact

SEQ ID NO: 364948 - DNA, 25 bp, Rattus norvegicus
gatgacctatccaagatgaatgctt

SEQ ID NO: 364949 - DNA, 25 bp, Rattus norvegicus
gatgacctatcctagatgaatgctt

SEQ ID NO: 364950 - DNA, 25 bp, Rattus norvegicus
gatgacctcaaacttccgattttaa

SEQ ID NO: 364951 - DNA, 25 bp, Rattus norvegicus
gatgacctcaaagttccgattttaa

SEQ ID NO: 364952 - DNA, 25 bp, Rattus norvegicus
gatgacctcacacagcgagcagcaa

SEQ ID NO: 364953 - DNA, 25 bp, Rattus norvegicus
gatgacctcacagagcgagcagcaa

SEQ ID NO: 364954 - DNA, 25 bp, Rattus norvegicus
gatgacctcagtcaatttcccgtgg

SEQ ID NO: 364955 - DNA, 25 bp, Rattus norvegicus
gatgacctcagtgaatttcccgtgg

SEQ ID NO: 364956 - DNA, 25 bp, Rattus norvegicus
gatgacctcgaactctctctgtgga

SEQ ID NO: 364957 - DNA, 25 bp, Rattus norvegicus
gatgacctcgaagtctctctgtgga

SEQ ID NO: 364958 - DNA, 25 bp, Rattus norvegicus
gatgacctgaaactggagatcctgt

SEQ ID NO: 364959 - DNA, 25 bp, Rattus norvegicus
gatgacctgaaagtggagatcctgt

SEQ ID NO: 364960 - DNA, 25 bp, Rattus norvegicus
gatgacctgagtcttgaggacccca

SEQ ID NO: 364961 - DNA, 25 bp, Rattus norvegicus
gatgacctgagtgttgaggacccca

SEQ ID NO: 364962 - DNA, 25 bp, Rattus norvegicus
gatgacctgcggatatgatgaccaa

SEQ ID NO: 364963 - DNA, 25 bp, Rattus norvegicus
gatgacctgcggttatgatgaccaa

SEQ ID NO: 364964 - DNA, 25 bp, Rattus norvegicus
gatgacctggaacctaatagcctgg

SEQ ID NO: 364965 - DNA, 25 bp, Rattus norvegicus
gatgacctggaagctaatagcctgg

SEQ ID NO: 364966 - DNA, 25 bp, Rattus norvegicus
gatgacctggacctgtggacagtac

SEQ ID NO: 364967 - DNA, 25 bp, Rattus norvegicus
gatgacctggacgtgtggacagtac

SEQ ID NO: 364968 - DNA, 25 bp, Rattus norvegicus
gatgaccttaagagaagtggctcca

SEQ ID NO: 364969 - DNA, 25 bp, Rattus norvegicus
gatgaccttaagtgaagtggctcca

SEQ ID NO: 364970 - DNA, 25 bp, Rattus norvegicus
gatgaccttctgactgaatccgagg

SEQ ID NO: 364971 - DNA, 25 bp, Rattus norvegicus
gatgaccttctgtctgaatccgagg

SEQ ID NO: 364972 - DNA, 25 bp, Rattus norvegicus
gatgaccttcttcgtacttgtgaca

SEQ ID NO: 364973 - DNA, 25 bp, Rattus norvegicus
gatgaccttcttggtacttgtgaca

SEQ ID NO: 364974 - DNA, 25 bp, Rattus norvegicus
gatgaccttgaaacagctctcatgc

SEQ ID NO: 364975 - DNA, 25 bp, Rattus norvegicus
gatgaccttgaacaaagaccattct

SEQ ID NO: 364976 - DNA, 25 bp, Rattus norvegicus
gatgaccttgaagaaagaccattct

SEQ ID NO: 364977 - DNA, 25 bp, Rattus norvegicus
gatgaccttgaatcagctctcatgc

SEQ ID NO: 364978 - DNA, 25 bp, Rattus norvegicus
gatgacgacaatcgtaggccgtttc

SEQ ID NO: 364979 - DNA, 25 bp, Rattus norvegicus
gatgacgacaatggtaggccgtttc

SEQ ID NO: 364980 - DNA, 25 bp, Rattus norvegicus
gatgacgacaccacactgtaacagg

SEQ ID NO: 364981 - DNA, 25 bp, Rattus norvegicus
gatgacgacacctcactgtaacagg

SEQ ID NO: 364982 - DNA, 25 bp, Rattus norvegicus
gatgacgacctacacaaactttgca

SEQ ID NO: 364983 - DNA, 25 bp, Rattus norvegicus
gatgacgacctagacaaactttgca

SEQ ID NO: 364984 - DNA, 25 bp, Rattus norvegicus
gatgacgacgacagcttcccttgag

SEQ ID NO: 364985 - DNA, 25 bp, Rattus norvegicus
gatgacgacgactgcttcccttgag

SEQ ID NO: 364986 - DNA, 25 bp, Rattus norvegicus
gatgacgacgatcaaaggtgaccca

SEQ ID NO: 364987 - DNA, 25 bp, Rattus norvegicus
gatgacgacgatgaaaggtgaccca

SEQ ID NO: 364988 - DNA, 25 bp, Rattus norvegicus
gatgacgacgtcatatcagtgtcaa

SEQ ID NO: 364989 - DNA, 25 bp, Rattus norvegicus
gatgacgacgtcttatcagtgtcaa

SEQ ID NO: 364990 - DNA, 25 bp, Rattus norvegicus
gatgacgactgaaactgtcaggact

SEQ ID NO: 364991 - DNA, 25 bp, Rattus norvegicus
gatgacgactgatactgtcaggact

SEQ ID NO: 364992 - DNA, 25 bp, Rattus norvegicus
gatgacgagctacgcttccgcaaaa

SEQ ID NO: 364993 - DNA, 25 bp, Rattus norvegicus
gatgacgagctaggcttccgcaaaa

SEQ ID NO: 364994 - DNA, 25 bp, Rattus norvegicus
gatgacgagctgagcctccgggccc

SEQ ID NO: 364995 - DNA, 25 bp, Rattus norvegicus
gatgacgagctgtgcctccgggccc

SEQ ID NO: 364996 - DNA, 25 bp, Rattus norvegicus
gatgacgagtacaaccggcccctgg

SEQ ID NO: 364997 - DNA, 25 bp, Rattus norvegicus
gatgacgagtactaccggcccctgg

SEQ ID NO: 364998 - DNA, 25 bp, Rattus norvegicus
gatgacgatggtaccgacagcgagt

SEQ ID NO: 364999 - DNA, 25 bp, Rattus norvegicus
gatgacgatggttccgacagcgagt

SEQ ID NO: 365000 - DNA, 25 bp, Rattus norvegicus
gatgacgcagctcagcacttgctga

SEQ ID NO: 365001 - DNA, 25 bp, Rattus norvegicus
gatgacgcagctgagcacttgctga

SEQ ID NO: 365002 - DNA, 25 bp, Rattus norvegicus
gatgacgccaagaacacctgcaagg

SEQ ID NO: 365003 - DNA, 25 bp, Rattus norvegicus
gatgacgccaagtacacctgcaagg

SEQ ID NO: 365004 - DNA, 25 bp, Rattus norvegicus
gatgacggaagccacaaactgcagg

SEQ ID NO: 365005 - DNA, 25 bp, Rattus norvegicus
gatgacggaagcgacaaactgcagg

SEQ ID NO: 365006 - DNA, 25 bp, Rattus norvegicus
gatgacggcaatcatctcactcaca

SEQ ID NO: 365007 - DNA, 25 bp, Rattus norvegicus
gatgacggcaatgatctcactcaca

SEQ ID NO: 365008 - DNA, 25 bp, Rattus norvegicus
gatgacggccacagtgaccataaag

SEQ ID NO: 365009 - DNA, 25 bp, Rattus norvegicus
gatgacggccactgtgaccataaag

SEQ ID NO: 365010 - DNA, 25 bp, Rattus norvegicus
gatgacgtaaaaatagccctggcac

SEQ ID NO: 365011 - DNA, 25 bp, Rattus norvegicus
gatgacgtaaaattagccctggcac

SEQ ID NO: 365012 - DNA, 25 bp, Rattus norvegicus
gatgacgtcaagcacctagcggaaa

SEQ ID NO: 365013 - DNA, 25 bp, Rattus norvegicus
gatgacgtcaaggacctagcggaaa

SEQ ID NO: 365014 - DNA, 25 bp, Rattus norvegicus
gatgacgtcaccagtgagcagcaga

SEQ ID NO: 365015 - DNA, 25 bp, Rattus norvegicus
gatgacgtcacctgtgagcagcaga

SEQ ID NO: 365016 - DNA, 25 bp, Rattus norvegicus
gatgacgtcagcctcctctacggga

SEQ ID NO: 365017 - DNA, 25 bp, Rattus norvegicus
gatgacgtcagcgtcctctacggga

SEQ ID NO: 365018 - DNA, 25 bp, Rattus norvegicus
gatgacgtggaaaaaagagctcttt

SEQ ID NO: 365019 - DNA, 25 bp, Rattus norvegicus
gatgacgtggaataaagagctcttt

SEQ ID NO: 365020 - DNA, 25 bp, Rattus norvegicus
gatgacgtggtcaccaattacttca

SEQ ID NO: 365021 - DNA, 25 bp, Rattus norvegicus
gatgacgtggtctccaattacttca

SEQ ID NO: 365022 - DNA, 25 bp, Rattus norvegicus
gatgacgtgtctatataaagctaag

SEQ ID NO: 365023 - DNA, 25 bp, Rattus norvegicus
gatgacgtgtctttataaagctaag

SEQ ID NO: 365024 - DNA, 25 bp, Rattus norvegicus
gatgacgttaaactgagcctgctcc

SEQ ID NO: 365025 - DNA, 25 bp, Rattus norvegicus
gatgacgttaaagtgagcctgctcc

SEQ ID NO: 365026 - DNA, 25 bp, Rattus norvegicus
gatgacgttgcccaaacacattttc

SEQ ID NO: 365027 - DNA, 25 bp, Rattus norvegicus
gatgacgttgccgaaacacattttc

SEQ ID NO: 365028 - DNA, 25 bp, Rattus norvegicus
gatgactaaggactgcccagatctg

SEQ ID NO: 365029 - DNA, 25 bp, Rattus norvegicus
gatgactaaggagtgcccagatctg

SEQ ID NO: 365030 - DNA, 25 bp, Rattus norvegicus
gatgactaagtgagtaacttcctca

SEQ ID NO: 365031 - DNA, 25 bp, Rattus norvegicus
gatgactaagtgtgtaacttcctca

SEQ ID NO: 365032 - DNA, 25 bp, Rattus norvegicus
gatgactaccaaagtctccatctgc

SEQ ID NO: 365033 - DNA, 25 bp, Rattus norvegicus
gatgactaccaatgtctccatctgc

SEQ ID NO: 365034 - DNA, 25 bp, Rattus norvegicus
gatgactaccacagcatgaggccca

SEQ ID NO: 365035 - DNA, 25 bp, Rattus norvegicus
gatgactaccacagcttgctgtacc

SEQ ID NO: 365036 - DNA, 25 bp, Rattus norvegicus
gatgactaccactgcatgaggccca

SEQ ID NO: 365037 - DNA, 25 bp, Rattus norvegicus
gatgactaccactgcttgctgtacc

SEQ ID NO: 365038 - DNA, 25 bp, Rattus norvegicus
gatgactaccagcttgttcgaaaat

SEQ ID NO: 365039 - DNA, 25 bp, Rattus norvegicus
gatgactaccaggttgttcgaaaat

SEQ ID NO: 365040 - DNA, 25 bp, Rattus norvegicus
gatgactaccggcatagccagttca

SEQ ID NO: 365041 - DNA, 25 bp, Rattus norvegicus
gatgactaccgggatagccagttca

SEQ ID NO: 365042 - DNA, 25 bp, Rattus norvegicus
gatgactactagacgctacctcatt

SEQ ID NO: 365043 - DNA, 25 bp, Rattus norvegicus
gatgactactagtcgctacctcatt

SEQ ID NO: 365044 - DNA, 25 bp, Rattus norvegicus
gatgactactctaattcactatggt

SEQ ID NO: 365045 - DNA, 25 bp, Rattus norvegicus
gatgactactcttattcactatggt

SEQ ID NO: 365046 - DNA, 25 bp, Rattus norvegicus
gatgactactgaccagcctgtccca

SEQ ID NO: 365047 - DNA, 25 bp, Rattus norvegicus
gatgactactgagcagcctgtccca

SEQ ID NO: 365048 - DNA, 25 bp, Rattus norvegicus
gatgactacttaaataccccacttc

SEQ ID NO: 365049 - DNA, 25 bp, Rattus norvegicus
gatgactacttatataccccacttc

SEQ ID NO: 365050 - DNA, 25 bp, Rattus norvegicus
gatgactagctaatctgaggcaggt

SEQ ID NO: 365051 - DNA, 25 bp, Rattus norvegicus
gatgactagctattctgaggcaggt

SEQ ID NO: 365052 - DNA, 25 bp, Rattus norvegicus
gatgactagctgacgcatttgacta

SEQ ID NO: 365053 - DNA, 25 bp, Rattus norvegicus
gatgactagctgtcgcatttgacta

SEQ ID NO: 365054 - DNA, 25 bp, Rattus norvegicus
gatgactatcctcagggctacctag

SEQ ID NO: 365055 - DNA, 25 bp, Rattus norvegicus
gatgactatcctgagggctacctag

SEQ ID NO: 365056 - DNA, 25 bp, Rattus norvegicus
gatgactatgtgaaggccctgcctg

SEQ ID NO: 365057 - DNA, 25 bp, Rattus norvegicus
gatgactatgtgtaggccctgcctg

SEQ ID NO: 365058 - DNA, 25 bp, Rattus norvegicus
gatgactcacgcataaggccaatct

SEQ ID NO: 365059 - DNA, 25 bp, Rattus norvegicus
gatgactcacgcttaaggccaatct

SEQ ID NO: 365060 - DNA, 25 bp, Rattus norvegicus
gatgactcagccactaagagcaatg

SEQ ID NO: 365061 - DNA, 25 bp, Rattus norvegicus
gatgactcagcctctaagagcaatg

SEQ ID NO: 365062 - DNA, 25 bp, Rattus norvegicus
gatgactcaggcacttgtcactcac

SEQ ID NO: 365063 - DNA, 25 bp, Rattus norvegicus
gatgactcaggctcttgtcactcac

SEQ ID NO: 365064 - DNA, 25 bp, Rattus norvegicus
gatgactcatccaatagcagcttat

SEQ ID NO: 365065 - DNA, 25 bp, Rattus norvegicus
gatgactcatcctatagcagcttat

SEQ ID NO: 365066 - DNA, 25 bp, Rattus norvegicus
gatgactcatgcagggaggcagatc

SEQ ID NO: 365067 - DNA, 25 bp, Rattus norvegicus
gatgactcatgctgggaggcagatc

SEQ ID NO: 365068 - DNA, 25 bp, Rattus norvegicus
gatgactccactagcaggccttaga

SEQ ID NO: 365069 - DNA, 25 bp, Rattus norvegicus
gatgactccacttgcaggccttaga

SEQ ID NO: 365070 - DNA, 25 bp, Rattus norvegicus
gatgactcccataatgcaatgtgtg

SEQ ID NO: 365071 - DNA, 25 bp, Rattus norvegicus
gatgactcccattatgcaatgtgtg

SEQ ID NO: 365072 - DNA, 25 bp, Rattus norvegicus
gatgactccgtcatccagaggagag

SEQ ID NO: 365073 - DNA, 25 bp, Rattus norvegicus
gatgactccgtcttccagaggagag

SEQ ID NO: 365074 - DNA, 25 bp, Rattus norvegicus
gatgactccgtgattcagctactga

SEQ ID NO: 365075 - DNA, 25 bp, Rattus norvegicus
gatgactccgtgtttcagctactga

SEQ ID NO: 365076 - DNA, 25 bp, Rattus norvegicus
gatgactcctacctcttgtccggtt

SEQ ID NO: 365077 - DNA, 25 bp, Rattus norvegicus
gatgactcctacgtcttgtccggtt

SEQ ID NO: 365078 - DNA, 25 bp, Rattus norvegicus
gatgactcctagaatttcttcctat

SEQ ID NO: 365079 - DNA, 25 bp, Rattus norvegicus
gatgactcctagtatttcttcctat

SEQ ID NO: 365080 - DNA, 25 bp, Rattus norvegicus
gatgactcctccatgacaagttgat

SEQ ID NO: 365081 - DNA, 25 bp, Rattus norvegicus
gatgactcctccttgacaagttgat

SEQ ID NO: 365082 - DNA, 25 bp, Rattus norvegicus
gatgactccttactcaagggctttt

SEQ ID NO: 365083 - DNA, 25 bp, Rattus norvegicus
gatgactccttagtcaagggctttt

SEQ ID NO: 365084 - DNA, 25 bp, Rattus norvegicus
gatgactcctttctagctctctgta

SEQ ID NO: 365085 - DNA, 25 bp, Rattus norvegicus
gatgactcctttgtagctctctgta

SEQ ID NO: 365086 - DNA, 25 bp, Rattus norvegicus
gatgactcggagcacagccgagaaa

SEQ ID NO: 365087 - DNA, 25 bp, Rattus norvegicus
gatgactcggaggacagccgagaaa

SEQ ID NO: 365088 - DNA, 25 bp, Rattus norvegicus
gatgactctaccatttggcactttg

SEQ ID NO: 365089 - DNA, 25 bp, Rattus norvegicus
gatgactctaccttttggcactttg

SEQ ID NO: 365090 - DNA, 25 bp, Rattus norvegicus
gatgactctcacattcatgagcggc

SEQ ID NO: 365091 - DNA, 25 bp, Rattus norvegicus
gatgactctcactttcatgagcggc

SEQ ID NO: 365092 - DNA, 25 bp, Rattus norvegicus
gatgactctcgccagtaacctcagt

SEQ ID NO: 365093 - DNA, 25 bp, Rattus norvegicus
gatgactctcgcgagtaacctcagt

SEQ ID NO: 365094 - DNA, 25 bp, Rattus norvegicus
gatgactctgagaaatatcaatcaa

SEQ ID NO: 365095 - DNA, 25 bp, Rattus norvegicus
gatgactctgagtaatatcaatcaa

SEQ ID NO: 365096 - DNA, 25 bp, Rattus norvegicus
gatgactctgatacacttggcgatt

SEQ ID NO: 365097 - DNA, 25 bp, Rattus norvegicus
gatgactctgattcacttggcgatt

SEQ ID NO: 365098 - DNA, 25 bp, Rattus norvegicus
gatgactctggaaaaagggcttgct

SEQ ID NO: 365099 - DNA, 25 bp, Rattus norvegicus
gatgactctggataaagggcttgct

SEQ ID NO: 365100 - DNA, 25 bp, Rattus norvegicus
gatgactcttcaatagcttcttcaa

SEQ ID NO: 365101 - DNA, 25 bp, Rattus norvegicus
gatgactcttcattagcttcttcaa

SEQ ID NO: 365102 - DNA, 25 bp, Rattus norvegicus
gatgactgaacaatgcctgcgtctc

SEQ ID NO: 365103 - DNA, 25 bp, Rattus norvegicus
gatgactgaacattgcctgcgtctc

SEQ ID NO: 365104 - DNA, 25 bp, Rattus norvegicus
gatgactgacatccattctatttaa

SEQ ID NO: 365105 - DNA, 25 bp, Rattus norvegicus
gatgactgacatgcattctatttaa

SEQ ID NO: 365106 - DNA, 25 bp, Rattus norvegicus
gatgactgaccacgaggctattcaa

SEQ ID NO: 365107 - DNA, 25 bp, Rattus norvegicus
gatgactgaccaggaggctattcaa

SEQ ID NO: 365108 - DNA, 25 bp, Rattus norvegicus
gatgactgactgactcgaaggcttt

SEQ ID NO: 365109 - DNA, 25 bp, Rattus norvegicus
gatgactgactgtctcgaaggcttt

SEQ ID NO: 365110 - DNA, 25 bp, Rattus norvegicus
gatgactgagtacctgaaccggcat

SEQ ID NO: 365111 - DNA, 25 bp, Rattus norvegicus
gatgactgagtagctgaaccggcat

SEQ ID NO: 365112 - DNA, 25 bp, Rattus norvegicus
gatgactgattgcacttccctttta

SEQ ID NO: 365113 - DNA, 25 bp, Rattus norvegicus
gatgactgattggacttccctttta

SEQ ID NO: 365114 - DNA, 25 bp, Rattus norvegicus
gatgactgcacaagggcagctccca

SEQ ID NO: 365115 - DNA, 25 bp, Rattus norvegicus
gatgactgcacatgggcagctccca

SEQ ID NO: 365116 - DNA, 25 bp, Rattus norvegicus
gatgactgcagtatcagatgccatt

SEQ ID NO: 365117 - DNA, 25 bp, Rattus norvegicus
gatgactgcagtttcagatgccatt

SEQ ID NO: 365118 - DNA, 25 bp, Rattus norvegicus
gatgactgcattaacaaaccactga

SEQ ID NO: 365119 - DNA, 25 bp, Rattus norvegicus
gatgactgcatttacaaaccactga

SEQ ID NO: 365120 - DNA, 25 bp, Rattus norvegicus
gatgactgcgggacagtgcaccgaa

SEQ ID NO: 365121 - DNA, 25 bp, Rattus norvegicus
gatgactgcgggtcagtgcaccgaa

SEQ ID NO: 365122 - DNA, 25 bp, Rattus norvegicus
gatgactgcgtgatttgtttgtatt

SEQ ID NO: 365123 - DNA, 25 bp, Rattus norvegicus
gatgactgcgtgttttgtttgtatt

SEQ ID NO: 365124 - DNA, 25 bp, Rattus norvegicus
gatgactgctgcatgtgacttagaa

SEQ ID NO: 365125 - DNA, 25 bp, Rattus norvegicus
gatgactgctgcttgtgacttagaa

SEQ ID NO: 365126 - DNA, 25 bp, Rattus norvegicus
gatgactggagcaccaagggcctaa

SEQ ID NO: 365127 - DNA, 25 bp, Rattus norvegicus
gatgactggagctccaagggcctaa

SEQ ID NO: 365128 - DNA, 25 bp, Rattus norvegicus
gatgactggcttcaacactggagga

SEQ ID NO: 365129 - DNA, 25 bp, Rattus norvegicus
gatgactggcttcttgactgagcaa

SEQ ID NO: 365130 - DNA, 25 bp, Rattus norvegicus
gatgactggcttgaacactggagga

SEQ ID NO: 365131 - DNA, 25 bp, Rattus norvegicus
gatgactggcttgttgactgagcaa

SEQ ID NO: 365132 - DNA, 25 bp, Rattus norvegicus
gatgactgggacatgtcaacaactc

SEQ ID NO: 365133 - DNA, 25 bp, Rattus norvegicus
gatgactgggacttgtcaacaactc

SEQ ID NO: 365134 - DNA, 25 bp, Rattus norvegicus
gatgactgtaaaactcacccatccc

SEQ ID NO: 365135 - DNA, 25 bp, Rattus norvegicus
gatgactgtaaatctcacccatccc

SEQ ID NO: 365136 - DNA, 25 bp, Rattus norvegicus
gatgactgtaccctcaacggttgag

SEQ ID NO: 365137 - DNA, 25 bp, Rattus norvegicus
gatgactgtaccgtcaacggttgag

SEQ ID NO: 365138 - DNA, 25 bp, Rattus norvegicus
gatgactgttctatatcacctgaga

SEQ ID NO: 365139 - DNA, 25 bp, Rattus norvegicus
gatgactgttctttatcacctgaga

SEQ ID NO: 365140 - DNA, 25 bp, Rattus norvegicus
gatgactgtttcaacacacgaactt

SEQ ID NO: 365141 - DNA, 25 bp, Rattus norvegicus
gatgactgtttctacacacgaactt

SEQ ID NO: 365142 - DNA, 25 bp, Rattus norvegicus
gatgacttaagacactgactcagtt

SEQ ID NO: 365143 - DNA, 25 bp, Rattus norvegicus
gatgacttaagagactgactcagtt

SEQ ID NO: 365144 - DNA, 25 bp, Rattus norvegicus
gatgacttaaggatcttgttcctaa

SEQ ID NO: 365145 - DNA, 25 bp, Rattus norvegicus
gatgacttaaggttcttgttcctaa

SEQ ID NO: 365146 - DNA, 25 bp, Rattus norvegicus
gatgacttacacatttcagatgcta

SEQ ID NO: 365147 - DNA, 25 bp, Rattus norvegicus
gatgacttacacttttcagatgcta

SEQ ID NO: 365148 - DNA, 25 bp, Rattus norvegicus
gatgacttactacgctgtctacatt

SEQ ID NO: 365149 - DNA, 25 bp, Rattus norvegicus
gatgacttactaggctgtctacatt

SEQ ID NO: 365150 - DNA, 25 bp, Rattus norvegicus
gatgacttagctcataccgtctgaa

SEQ ID NO: 365151 - DNA, 25 bp, Rattus norvegicus
gatgacttagctgataccgtctgaa

SEQ ID NO: 365152 - DNA, 25 bp, Rattus norvegicus
gatgacttatttcactgaccttgca

SEQ ID NO: 365153 - DNA, 25 bp, Rattus norvegicus
gatgacttatttgactgaccttgca

SEQ ID NO: 365154 - DNA, 25 bp, Rattus norvegicus
gatgacttcaagatctcaggcatga

SEQ ID NO: 365155 - DNA, 25 bp, Rattus norvegicus
gatgacttcaagttctcaggcatga

SEQ ID NO: 365156 - DNA, 25 bp, Rattus norvegicus
gatgacttcaatcggctgagcatga

SEQ ID NO: 365157 - DNA, 25 bp, Rattus norvegicus
gatgacttcaatgggctgagcatga

SEQ ID NO: 365158 - DNA, 25 bp, Rattus norvegicus
gatgacttcacaagatccctgtaca

SEQ ID NO: 365159 - DNA, 25 bp, Rattus norvegicus
gatgacttcacatgatccctgtaca

SEQ ID NO: 365160 - DNA, 25 bp, Rattus norvegicus
gatgacttcactaagcatctgtgta

SEQ ID NO: 365161 - DNA, 25 bp, Rattus norvegicus
gatgacttcacttagcatctgtgta

SEQ ID NO: 365162 - DNA, 25 bp, Rattus norvegicus
gatgacttcagacccctttaagcca

SEQ ID NO: 365163 - DNA, 25 bp, Rattus norvegicus
gatgacttcagagccctttaagcca

SEQ ID NO: 365164 - DNA, 25 bp, Rattus norvegicus
gatgacttcagcaggcagcaatggt

SEQ ID NO: 365165 - DNA, 25 bp, Rattus norvegicus
gatgacttcagctggcagcaatggt

SEQ ID NO: 365166 - DNA, 25 bp, Rattus norvegicus
gatgacttccaacagatggtacagc

SEQ ID NO: 365167 - DNA, 25 bp, Rattus norvegicus
gatgacttccaagagatggtacagc

SEQ ID NO: 365168 - DNA, 25 bp, Rattus norvegicus
gatgacttccggacatgtgctcaga

SEQ ID NO: 365169 - DNA, 25 bp, Rattus norvegicus
gatgacttccggtcatgtgctcaga

SEQ ID NO: 365170 - DNA, 25 bp, Rattus norvegicus
gatgacttctgtaggtcctttgact

SEQ ID NO: 365171 - DNA, 25 bp, Rattus norvegicus
gatgacttctgttggtcctttgact

SEQ ID NO: 365172 - DNA, 25 bp, Rattus norvegicus
gatgacttctttatatcgttattag

SEQ ID NO: 365173 - DNA, 25 bp, Rattus norvegicus
gatgacttctttttatcgttattag

SEQ ID NO: 365174 - DNA, 25 bp, Rattus norvegicus
gatgacttgaaaaagattaccaact

SEQ ID NO: 365175 - DNA, 25 bp, Rattus norvegicus
gatgacttgaaatagattaccaact

SEQ ID NO: 365176 - DNA, 25 bp, Rattus norvegicus
gatgacttgaagacttctggactct

SEQ ID NO: 365177 - DNA, 25 bp, Rattus norvegicus
gatgacttgaagtcttctggactct

SEQ ID NO: 365178 - DNA, 25 bp, Rattus norvegicus
gatgacttgccacatgcagaccatg

SEQ ID NO: 365179 - DNA, 25 bp, Rattus norvegicus
gatgacttgccagatgcagaccatg

SEQ ID NO: 365180 - DNA, 25 bp, Rattus norvegicus
gatgacttgcggcaatctgccttcc

SEQ ID NO: 365181 - DNA, 25 bp, Rattus norvegicus
gatgacttgcgggaatctgccttcc

SEQ ID NO: 365182 - DNA, 25 bp, Rattus norvegicus
gatgacttggaacataagctgaagt

SEQ ID NO: 365183 - DNA, 25 bp, Rattus norvegicus
gatgacttggaagataagctgaagt

SEQ ID NO: 365184 - DNA, 25 bp, Rattus norvegicus
gatgacttgtccataacagatgcca

SEQ ID NO: 365185 - DNA, 25 bp, Rattus norvegicus
gatgacttgtccttaacagatgcca

SEQ ID NO: 365186 - DNA, 25 bp, Rattus norvegicus
gatgactttcaaatcctggttctcc

SEQ ID NO: 365187 - DNA, 25 bp, Rattus norvegicus
gatgactttcaattcctggttctcc

SEQ ID NO: 365188 - DNA, 25 bp, Rattus norvegicus
gatgactttcagctacacacccaag

SEQ ID NO: 365189 - DNA, 25 bp, Rattus norvegicus
gatgactttcaggtacacacccaag

SEQ ID NO: 365190 - DNA, 25 bp, Rattus norvegicus
gatgactttcgtccagtttgctaac

SEQ ID NO: 365191 - DNA, 25 bp, Rattus norvegicus
gatgactttcgtgcagtttgctaac

SEQ ID NO: 365192 - DNA, 25 bp, Rattus norvegicus
gatgactttctcagtaggtcctgta

SEQ ID NO: 365193 - DNA, 25 bp, Rattus norvegicus
gatgactttctctgtaggtcctgta

SEQ ID NO: 365194 - DNA, 25 bp, Rattus norvegicus
gatgactttgaactcgtgatccagt

SEQ ID NO: 365195 - DNA, 25 bp, Rattus norvegicus
gatgactttgaagtcgtgatccagt

SEQ ID NO: 365196 - DNA, 25 bp, Rattus norvegicus
gatgactttgcaacgaagcctttgg

SEQ ID NO: 365197 - DNA, 25 bp, Rattus norvegicus
gatgactttgcatcgaagcctttgg

SEQ ID NO: 365198 - DNA, 25 bp, Rattus norvegicus
gatgactttgtgcacatgtgtggct

SEQ ID NO: 365199 - DNA, 25 bp, Rattus norvegicus
gatgactttgtggacatgtgtggct

SEQ ID NO: 365200 - DNA, 25 bp, Rattus norvegicus
gatgactttgttatctgcttgacag

SEQ ID NO: 365201 - DNA, 25 bp, Rattus norvegicus
gatgactttgttttctgcttgacag

SEQ ID NO: 365202 - DNA, 25 bp, Rattus norvegicus
gatgacttttttctagccattttta

SEQ ID NO: 365203 - DNA, 25 bp, Rattus norvegicus
gatgacttttttgtagccattttta

SEQ ID NO: 365204 - DNA, 25 bp, Rattus norvegicus
gatgagaacaaccttgtcccagaaa

SEQ ID NO: 365205 - DNA, 25 bp, Rattus norvegicus
gatgagaacaacgttgtcccagaaa

SEQ ID NO: 365206 - DNA, 25 bp, Rattus norvegicus
gatgagaacaatctgtttccacccc

SEQ ID NO: 365207 - DNA, 25 bp, Rattus norvegicus
gatgagaacaatgtgtttccacccc

SEQ ID NO: 365208 - DNA, 25 bp, Rattus norvegicus
gatgagaactcaagtctgcaagaag

SEQ ID NO: 365209 - DNA, 25 bp, Rattus norvegicus
gatgagaactcatgtctgcaagaag

SEQ ID NO: 365210 - DNA, 25 bp, Rattus norvegicus
gatgagaacttcaaggcctgcttta

SEQ ID NO: 365211 - DNA, 25 bp, Rattus norvegicus
gatgagaacttctaggcctgcttta

SEQ ID NO: 365212 - DNA, 25 bp, Rattus norvegicus
gatgagaagccaccagccaaggaaa

SEQ ID NO: 365213 - DNA, 25 bp, Rattus norvegicus
gatgagaagccactcgaagccatta

SEQ ID NO: 365214 - DNA, 25 bp, Rattus norvegicus
gatgagaagccagcagccaaggaaa

SEQ ID NO: 365215 - DNA, 25 bp, Rattus norvegicus
gatgagaagccagtcgaagccatta

SEQ ID NO: 365216 - DNA, 25 bp, Rattus norvegicus
gatgagaagctgatcaaggtgccca

SEQ ID NO: 365217 - DNA, 25 bp, Rattus norvegicus
gatgagaagctgttcaaggtgccca

SEQ ID NO: 365218 - DNA, 25 bp, Rattus norvegicus
gatgagaagcttccttacctgctga

SEQ ID NO: 365219 - DNA, 25 bp, Rattus norvegicus
gatgagaagcttgcttacctgctga

SEQ ID NO: 365220 - DNA, 25 bp, Rattus norvegicus
gatgagaatgccaaccttccagaga

SEQ ID NO: 365221 - DNA, 25 bp, Rattus norvegicus
gatgagaatgcctaccttccagaga

SEQ ID NO: 365222 - DNA, 25 bp, Rattus norvegicus
gatgagaatgggaatccctcctctc

SEQ ID NO: 365223 - DNA, 25 bp, Rattus norvegicus
gatgagaatgggtatccctcctctc

SEQ ID NO: 365224 - DNA, 25 bp, Rattus norvegicus
gatgagaatgtaccttgctgtattt

SEQ ID NO: 365225 - DNA, 25 bp, Rattus norvegicus
gatgagaatgtagcttgctgtattt

SEQ ID NO: 365226 - DNA, 25 bp, Rattus norvegicus
gatgagacagaacagaccccggctt

SEQ ID NO: 365227 - DNA, 25 bp, Rattus norvegicus
gatgagacagaagagaccccggctt

SEQ ID NO: 365228 - DNA, 25 bp, Rattus norvegicus
gatgagacatgcctgatcactcttc

SEQ ID NO: 365229 - DNA, 25 bp, Rattus norvegicus
gatgagacatgcgtgatcactcttc

SEQ ID NO: 365230 - DNA, 25 bp, Rattus norvegicus
gatgagaccctcatctaccggtgag

SEQ ID NO: 365231 - DNA, 25 bp, Rattus norvegicus
gatgagaccctcttctaccggtgag

SEQ ID NO: 365232 - DNA, 25 bp, Rattus norvegicus
gatgagaccctgagcttcattcaga

SEQ ID NO: 365233 - DNA, 25 bp, Rattus norvegicus
gatgagaccctgtgcttcattcaga

SEQ ID NO: 365234 - DNA, 25 bp, Rattus norvegicus
gatgagaccgggctaaggcacgtat

SEQ ID NO: 365235 - DNA, 25 bp, Rattus norvegicus
gatgagaccggggtaaggcacgtat

SEQ ID NO: 365236 - DNA, 25 bp, Rattus norvegicus
gatgagacttgcctgtaattcccac

SEQ ID NO: 365237 - DNA, 25 bp, Rattus norvegicus
gatgagacttgcgtgtaattcccac

SEQ ID NO: 365238 - DNA, 25 bp, Rattus norvegicus
gatgagactttgcagctggagtttt

SEQ ID NO: 365239 - DNA, 25 bp, Rattus norvegicus
gatgagactttggagctggagtttt

SEQ ID NO: 365240 - DNA, 25 bp, Rattus norvegicus
gatgagagaatcagccatgcggccg

SEQ ID NO: 365241 - DNA, 25 bp, Rattus norvegicus
gatgagagaatctgccatgcggccg

SEQ ID NO: 365242 - DNA, 25 bp, Rattus norvegicus
gatgagagatccaggctgggcttaa

SEQ ID NO: 365243 - DNA, 25 bp, Rattus norvegicus
gatgagagatcctggctgggcttaa

SEQ ID NO: 365244 - DNA, 25 bp, Rattus norvegicus
gatgagagcatactactaaagcaga

SEQ ID NO: 365245 - DNA, 25 bp, Rattus norvegicus
gatgagagcatagtactaaagcaga

SEQ ID NO: 365246 - DNA, 25 bp, Rattus norvegicus
gatgagagccatcactcaatggaaa

SEQ ID NO: 365247 - DNA, 25 bp, Rattus norvegicus
gatgagagccatgactcaatggaaa

SEQ ID NO: 365248 - DNA, 25 bp, Rattus norvegicus
gatgagagctgtagagttaaccaca

SEQ ID NO: 365249 - DNA, 25 bp, Rattus norvegicus
gatgagagctgttgagttaaccaca

SEQ ID NO: 365250 - DNA, 25 bp, Rattus norvegicus
gatgagaggccacaacttatttaaa

SEQ ID NO: 365251 - DNA, 25 bp, Rattus norvegicus
gatgagaggccagaacttatttaaa

SEQ ID NO: 365252 - DNA, 25 bp, Rattus norvegicus
gatgagaggttcagcattgacaatg

SEQ ID NO: 365253 - DNA, 25 bp, Rattus norvegicus
gatgagaggttctgcattgacaatg

SEQ ID NO: 365254 - DNA, 25 bp, Rattus norvegicus
gatgagagtctgatgtttccctcca

SEQ ID NO: 365255 - DNA, 25 bp, Rattus norvegicus
gatgagagtctgttgtttccctcca

SEQ ID NO: 365256 - DNA, 25 bp, Rattus norvegicus
gatgagataatgcacctgctggtgc

SEQ ID NO: 365257 - DNA, 25 bp, Rattus norvegicus
gatgagataatggacctgctggtgc

SEQ ID NO: 365258 - DNA, 25 bp, Rattus norvegicus
gatgagatagacaccgactctgcct

SEQ ID NO: 365259 - DNA, 25 bp, Rattus norvegicus
gatgagatagactccgactctgcct

SEQ ID NO: 365260 - DNA, 25 bp, Rattus norvegicus
gatgagatatatagcccaccagaaa

SEQ ID NO: 365261 - DNA, 25 bp, Rattus norvegicus
gatgagatatattgcccaccagaaa

SEQ ID NO: 365262 - DNA, 25 bp, Rattus norvegicus
gatgagatcattcctgtaagttaca

SEQ ID NO: 365263 - DNA, 25 bp, Rattus norvegicus
gatgagatcattgctgtaagttaca

SEQ ID NO: 365264 - DNA, 25 bp, Rattus norvegicus
gatgagatccctccagatgctcaaa

SEQ ID NO: 365265 - DNA, 25 bp, Rattus norvegicus
gatgagatccctgcagatgctcaaa

SEQ ID NO: 365266 - DNA, 25 bp, Rattus norvegicus
gatgagatcgacatttcctcctaca

SEQ ID NO: 365267 - DNA, 25 bp, Rattus norvegicus
gatgagatcgacttttcctcctaca

SEQ ID NO: 365268 - DNA, 25 bp, Rattus norvegicus
gatgagatctatcacgtctacagtt

SEQ ID NO: 365269 - DNA, 25 bp, Rattus norvegicus
gatgagatctatgacgtctacagtt

SEQ ID NO: 365270 - DNA, 25 bp, Rattus norvegicus
gatgagatctttaacaagcccgagt

SEQ ID NO: 365271 - DNA, 25 bp, Rattus norvegicus
gatgagatcttttacaagcccgagt

SEQ ID NO: 365272 - DNA, 25 bp, Rattus norvegicus
gatgagattaggcaccttctgggta

SEQ ID NO: 365273 - DNA, 25 bp, Rattus norvegicus
gatgagattagggaccttctgggta

SEQ ID NO: 365274 - DNA, 25 bp, Rattus norvegicus
gatgagattcataagccaaggcagg

SEQ ID NO: 365275 - DNA, 25 bp, Rattus norvegicus
gatgagattcattagccaaggcagg

SEQ ID NO: 365276 - DNA, 25 bp, Rattus norvegicus
gatgagattgctacacagcactgat

SEQ ID NO: 365277 - DNA, 25 bp, Rattus norvegicus
gatgagattgcttcacagcactgat

SEQ ID NO: 365278 - DNA, 25 bp, Rattus norvegicus
gatgagatttatcttgtcccagatg

SEQ ID NO: 365279 - DNA, 25 bp, Rattus norvegicus
gatgagatttatgttgtcccagatg

SEQ ID NO: 365280 - DNA, 25 bp, Rattus norvegicus
gatgagcaaccccatgcgcatggat

SEQ ID NO: 365281 - DNA, 25 bp, Rattus norvegicus
gatgagcaacccgatgcgcatggat

SEQ ID NO: 365282 - DNA, 25 bp, Rattus norvegicus
gatgagcaatccattggcacggcaa

SEQ ID NO: 365283 - DNA, 25 bp, Rattus norvegicus
gatgagcaatcctttggcacggcaa

SEQ ID NO: 365284 - DNA, 25 bp, Rattus norvegicus
gatgagcaatttatcaatgctgcca

SEQ ID NO: 365285 - DNA, 25 bp, Rattus norvegicus
gatgagcaatttttcaatgctgcca

SEQ ID NO: 365286 - DNA, 25 bp, Rattus norvegicus
gatgagcaccaacacatggtccact

SEQ ID NO: 365287 - DNA, 25 bp, Rattus norvegicus
gatgagcaccaagacatggtccact

SEQ ID NO: 365288 - DNA, 25 bp, Rattus norvegicus
gatgagcacctccagaaagatttca

SEQ ID NO: 365289 - DNA, 25 bp, Rattus norvegicus
gatgagcacctcgagaaagatttca

SEQ ID NO: 365290 - DNA, 25 bp, Rattus norvegicus
gatgagcacggtaattccagcacat

SEQ ID NO: 365291 - DNA, 25 bp, Rattus norvegicus
gatgagcacggttattccagcacat

SEQ ID NO: 365292 - DNA, 25 bp, Rattus norvegicus
gatgagcaggctactaggccactca

SEQ ID NO: 365293 - DNA, 25 bp, Rattus norvegicus
gatgagcaggctacttcgtttctca

SEQ ID NO: 365294 - DNA, 25 bp, Rattus norvegicus
gatgagcaggcttctaggccactca

SEQ ID NO: 365295 - DNA, 25 bp, Rattus norvegicus
gatgagcaggcttcttcgtttctca

SEQ ID NO: 365296 - DNA, 25 bp, Rattus norvegicus
gatgagcagtatccctgggagtctt

SEQ ID NO: 365297 - DNA, 25 bp, Rattus norvegicus
gatgagcagtatgcctgggagtctt

SEQ ID NO: 365298 - DNA, 25 bp, Rattus norvegicus
gatgagcatagcatcaggccttcac

SEQ ID NO: 365299 - DNA, 25 bp, Rattus norvegicus
gatgagcatagcttcaggccttcac

SEQ ID NO: 365300 - DNA, 25 bp, Rattus norvegicus
gatgagcatctcagtatgtatacct

SEQ ID NO: 365301 - DNA, 25 bp, Rattus norvegicus
gatgagcatctctgtatgtatacct

SEQ ID NO: 365302 - DNA, 25 bp, Rattus norvegicus
gatgagcattcgcagaccccaagat

SEQ ID NO: 365303 - DNA, 25 bp, Rattus norvegicus
gatgagcattcggagaccccaagat

SEQ ID NO: 365304 - DNA, 25 bp, Rattus norvegicus
gatgagcattttagttctctacgaa

SEQ ID NO: 365305 - DNA, 25 bp, Rattus norvegicus
gatgagcatttttgttctctacgaa

SEQ ID NO: 365306 - DNA, 25 bp, Rattus norvegicus
gatgagccaaacatgacatagacat

SEQ ID NO: 365307 - DNA, 25 bp, Rattus norvegicus
gatgagccaaacttgacatagacat

SEQ ID NO: 365308 - DNA, 25 bp, Rattus norvegicus
gatgagccaacacaacagcccgtga

SEQ ID NO: 365309 - DNA, 25 bp, Rattus norvegicus
gatgagccaacagaacagcccgtga

SEQ ID NO: 365310 - DNA, 25 bp, Rattus norvegicus
gatgagccacaaaggtaacccagaa

SEQ ID NO: 365311 - DNA, 25 bp, Rattus norvegicus
gatgagccacaatggtaacccagaa

SEQ ID NO: 365312 - DNA, 25 bp, Rattus norvegicus
gatgagccacataacttcagttgaa

SEQ ID NO: 365313 - DNA, 25 bp, Rattus norvegicus
gatgagccacattacttcagttgaa

SEQ ID NO: 365314 - DNA, 25 bp, Rattus norvegicus
gatgagccagtcctgcttgaggaac

SEQ ID NO: 365315 - DNA, 25 bp, Rattus norvegicus
gatgagccagtcgtgcttgaggaac

SEQ ID NO: 365316 - DNA, 25 bp, Rattus norvegicus
gatgagccagtgacagttccgatga

SEQ ID NO: 365317 - DNA, 25 bp, Rattus norvegicus
gatgagccagtgtcagttccgatga

SEQ ID NO: 365318 - DNA, 25 bp, Rattus norvegicus
gatgagccatctcctcaaagaggac

SEQ ID NO: 365319 - DNA, 25 bp, Rattus norvegicus
gatgagccatctgctcaaagaggac

SEQ ID NO: 365320 - DNA, 25 bp, Rattus norvegicus
gatgagccatgactgtctggacgcc

SEQ ID NO: 365321 - DNA, 25 bp, Rattus norvegicus
gatgagccatgagtgtctggacgcc

SEQ ID NO: 365322 - DNA, 25 bp, Rattus norvegicus
gatgagccattgagtagctgtccat

SEQ ID NO: 365323 - DNA, 25 bp, Rattus norvegicus
gatgagccattgtgtagctgtccat

SEQ ID NO: 365324 - DNA, 25 bp, Rattus norvegicus
gatgagccgtgaactgacaaatcaa

SEQ ID NO: 365325 - DNA, 25 bp, Rattus norvegicus
gatgagccgtgatctgacaaatcaa

SEQ ID NO: 365326 - DNA, 25 bp, Rattus norvegicus
gatgagcctcataaagttccatttt

SEQ ID NO: 365327 - DNA, 25 bp, Rattus norvegicus
gatgagcctcattaagttccatttt

SEQ ID NO: 365328 - DNA, 25 bp, Rattus norvegicus
gatgagcctccaaattggctggtgt

SEQ ID NO: 365329 - DNA, 25 bp, Rattus norvegicus
gatgagcctccatattggctggtgt

SEQ ID NO: 365330 - DNA, 25 bp, Rattus norvegicus
gatgagcctccccaactgaagagac

SEQ ID NO: 365331 - DNA, 25 bp, Rattus norvegicus
gatgagcctcccgaactgaagagac

SEQ ID NO: 365332 - DNA, 25 bp, Rattus norvegicus
gatgagcgctctcccagtgagagta

SEQ ID NO: 365333 - DNA, 25 bp, Rattus norvegicus
gatgagcgctctgccagtgagagta

SEQ ID NO: 365334 - DNA, 25 bp, Rattus norvegicus
gatgagcgtctgacttagtttgggt

SEQ ID NO: 365335 - DNA, 25 bp, Rattus norvegicus
gatgagcgtctgatttctgttgtcc

SEQ ID NO: 365336 - DNA, 25 bp, Rattus norvegicus
gatgagcgtctgtcttagtttgggt

SEQ ID NO: 365337 - DNA, 25 bp, Rattus norvegicus
gatgagcgtctgttttctgttgtcc

SEQ ID NO: 365338 - DNA, 25 bp, Rattus norvegicus
gatgagcgtgctcagacttatacaa

SEQ ID NO: 365339 - DNA, 25 bp, Rattus norvegicus
gatgagcgtgctgagacttatacaa

SEQ ID NO: 365340 - DNA, 25 bp, Rattus norvegicus
gatgagcgttttcgtctggtactag

SEQ ID NO: 365341 - DNA, 25 bp, Rattus norvegicus
gatgagcgttttggtctggtactag

SEQ ID NO: 365342 - DNA, 25 bp, Rattus norvegicus
gatgagctagccaaccacaaacctg

SEQ ID NO: 365343 - DNA, 25 bp, Rattus norvegicus
gatgagctagcctaccacaaacctg

SEQ ID NO: 365344 - DNA, 25 bp, Rattus norvegicus
gatgagctcaagaatttcctacaga

SEQ ID NO: 365345 - DNA, 25 bp, Rattus norvegicus
gatgagctcaagtatttcctacaga

SEQ ID NO: 365346 - DNA, 25 bp, Rattus norvegicus
gatgagctcagcatcaaggccggag

SEQ ID NO: 365347 - DNA, 25 bp, Rattus norvegicus
gatgagctcagcttcaaggccggag

SEQ ID NO: 365348 - DNA, 25 bp, Rattus norvegicus
gatgagctcaggacaaccctaactg

SEQ ID NO: 365349 - DNA, 25 bp, Rattus norvegicus
gatgagctcaggtcaaccctaactg

SEQ ID NO: 365350 - DNA, 25 bp, Rattus norvegicus
gatgagctccacaacactattcagt

SEQ ID NO: 365351 - DNA, 25 bp, Rattus norvegicus
gatgagctccactacactattcagt

SEQ ID NO: 365352 - DNA, 25 bp, Rattus norvegicus
gatgagctcctgaactatgcttagc

SEQ ID NO: 365353 - DNA, 25 bp, Rattus norvegicus
gatgagctcctgtactatgcttagc

SEQ ID NO: 365354 - DNA, 25 bp, Rattus norvegicus
gatgagctcgtgaggcagattacaa

SEQ ID NO: 365355 - DNA, 25 bp, Rattus norvegicus
gatgagctcgtgtggcagattacaa

SEQ ID NO: 365356 - DNA, 25 bp, Rattus norvegicus
gatgagctctcacttaggcagacta

SEQ ID NO: 365357 - DNA, 25 bp, Rattus norvegicus
gatgagctctcagttaggcagacta

SEQ ID NO: 365358 - DNA, 25 bp, Rattus norvegicus
gatgagctctggagactttagaact

SEQ ID NO: 365359 - DNA, 25 bp, Rattus norvegicus
gatgagctctggtgactttagaact

SEQ ID NO: 365360 - DNA, 25 bp, Rattus norvegicus
gatgagctctttaatttgtacggaa

SEQ ID NO: 365361 - DNA, 25 bp, Rattus norvegicus
gatgagctcttttatttgtacggaa

SEQ ID NO: 365362 - DNA, 25 bp, Rattus norvegicus
gatgagctgaagactctcattccgc

SEQ ID NO: 365363 - DNA, 25 bp, Rattus norvegicus
gatgagctgaagtctctcattccgc

SEQ ID NO: 365364 - DNA, 25 bp, Rattus norvegicus
gatgagctgcaaactgtcttgggtt

SEQ ID NO: 365365 - DNA, 25 bp, Rattus norvegicus
gatgagctgcaatctgtcttgggtt

SEQ ID NO: 365366 - DNA, 25 bp, Rattus norvegicus
gatgagctggcaagtaatggcgcat

SEQ ID NO: 365367 - DNA, 25 bp, Rattus norvegicus
gatgagctggcatgtaatggcgcat

SEQ ID NO: 365368 - DNA, 25 bp, Rattus norvegicus
gatgagcttcatcgattacttctat

SEQ ID NO: 365369 - DNA, 25 bp, Rattus norvegicus
gatgagcttcatggattacttctat

SEQ ID NO: 365370 - DNA, 25 bp, Rattus norvegicus
gatgaggaaacgaatgcagccacat

SEQ ID NO: 365371 - DNA, 25 bp, Rattus norvegicus
gatgaggaaacgtatgcagccacat

SEQ ID NO: 365372 - DNA, 25 bp, Rattus norvegicus
gatgaggaacctcccaaggaagttc

SEQ ID NO: 365373 - DNA, 25 bp, Rattus norvegicus
gatgaggaacctgccaaggaagttc

SEQ ID NO: 365374 - DNA, 25 bp, Rattus norvegicus
gatgaggaagcactcgggactcctt

SEQ ID NO: 365375 - DNA, 25 bp, Rattus norvegicus
gatgaggaagcagtcgggactcctt

SEQ ID NO: 365376 - DNA, 25 bp, Rattus norvegicus
gatgaggaattactgtcttgccaaa

SEQ ID NO: 365377 - DNA, 25 bp, Rattus norvegicus
gatgaggaattagtgtcttgccaaa

SEQ ID NO: 365378 - DNA, 25 bp, Rattus norvegicus
gatgaggacagcagagctccagcca

SEQ ID NO: 365379 - DNA, 25 bp, Rattus norvegicus
gatgaggacagctgagctccagcca

SEQ ID NO: 365380 - DNA, 25 bp, Rattus norvegicus
gatgaggacataatgcaatgcgggt

SEQ ID NO: 365381 - DNA, 25 bp, Rattus norvegicus
gatgaggacatattgcaatgcgggt

SEQ ID NO: 365382 - DNA, 25 bp, Rattus norvegicus
gatgaggaccagaatcctgttaaaa

SEQ ID NO: 365383 - DNA, 25 bp, Rattus norvegicus
gatgaggaccagtatcctgttaaaa

SEQ ID NO: 365384 - DNA, 25 bp, Rattus norvegicus
gatgaggacctcaccaggcatggag

SEQ ID NO: 365385 - DNA, 25 bp, Rattus norvegicus
gatgaggacctctccaggcatggag

SEQ ID NO: 365386 - DNA, 25 bp, Rattus norvegicus
gatgaggacgaacggaagttccttc

SEQ ID NO: 365387 - DNA, 25 bp, Rattus norvegicus
gatgaggacgaagggaagttccttc

SEQ ID NO: 365388 - DNA, 25 bp, Rattus norvegicus
gatgaggacgctaagttcccaggct

SEQ ID NO: 365389 - DNA, 25 bp, Rattus norvegicus
gatgaggacgcttagttcccaggct

SEQ ID NO: 365390 - DNA, 25 bp, Rattus norvegicus
gatgaggactcacctcttgaacacc

SEQ ID NO: 365391 - DNA, 25 bp, Rattus norvegicus
gatgaggactcagctcttgaacacc

SEQ ID NO: 365392 - DNA, 25 bp, Rattus norvegicus
gatgaggactctcaccttgactttg

SEQ ID NO: 365393 - DNA, 25 bp, Rattus norvegicus
gatgaggactctgaccttgactttg

SEQ ID NO: 365394 - DNA, 25 bp, Rattus norvegicus
gatgaggacttccagggccaaccag

SEQ ID NO: 365395 - DNA, 25 bp, Rattus norvegicus
gatgaggacttcgagggccaaccag

SEQ ID NO: 365396 - DNA, 25 bp, Rattus norvegicus
gatgaggagacacccattcattgct

SEQ ID NO: 365397 - DNA, 25 bp, Rattus norvegicus
gatgaggagacagccattcattgct

SEQ ID NO: 365398 - DNA, 25 bp, Rattus norvegicus
gatgaggagactcaccttgccccaa

SEQ ID NO: 365399 - DNA, 25 bp, Rattus norvegicus
gatgaggagactgaccttgccccaa

SEQ ID NO: 365400 - DNA, 25 bp, Rattus norvegicus
gatgaggagatcctcctggtgtctc

SEQ ID NO: 365401 - DNA, 25 bp, Rattus norvegicus
gatgaggagatcgtcctggtgtctc

SEQ ID NO: 365402 - DNA, 25 bp, Rattus norvegicus
gatgaggagctactgcacctgctgc

SEQ ID NO: 365403 - DNA, 25 bp, Rattus norvegicus
gatgaggagctagtgcacctgctgc

SEQ ID NO: 365404 - DNA, 25 bp, Rattus norvegicus
gatgaggagtctatctctctgagct

SEQ ID NO: 365405 - DNA, 25 bp, Rattus norvegicus
gatgaggagtctttctctctgagct

SEQ ID NO: 365406 - DNA, 25 bp, Rattus norvegicus
gatgaggatctcaggacatgggcct

SEQ ID NO: 365407 - DNA, 25 bp, Rattus norvegicus
gatgaggatctctggacatgggcct

SEQ ID NO: 365408 - DNA, 25 bp, Rattus norvegicus
gatgaggatctgcagtccaaactgg

SEQ ID NO: 365409 - DNA, 25 bp, Rattus norvegicus
gatgaggatctggagtccaaactgg

SEQ ID NO: 365410 - DNA, 25 bp, Rattus norvegicus
gatgaggatgcacatttaccagaag

SEQ ID NO: 365411 - DNA, 25 bp, Rattus norvegicus
gatgaggatgcagatttaccagaag

SEQ ID NO: 365412 - DNA, 25 bp, Rattus norvegicus
gatgaggcagctccagtccacgtgc

SEQ ID NO: 365413 - DNA, 25 bp, Rattus norvegicus
gatgaggcagctgcagtccacgtgc

SEQ ID NO: 365414 - DNA, 25 bp, Rattus norvegicus
gatgaggcagggagatctccagttt

SEQ ID NO: 365415 - DNA, 25 bp, Rattus norvegicus
gatgaggcagggtgatctccagttt

SEQ ID NO: 365416 - DNA, 25 bp, Rattus norvegicus
gatgaggccaggaccgagttgtatc

SEQ ID NO: 365417 - DNA, 25 bp, Rattus norvegicus
gatgaggccaggtccgagttgtatc

SEQ ID NO: 365418 - DNA, 25 bp, Rattus norvegicus
gatgaggcccaccattaaggatcac

SEQ ID NO: 365419 - DNA, 25 bp, Rattus norvegicus
gatgaggcccacgattaaggatcac

SEQ ID NO: 365420 - DNA, 25 bp, Rattus norvegicus
gatgaggccgttcggatgtcctaac

SEQ ID NO: 365421 - DNA, 25 bp, Rattus norvegicus
gatgaggccgttgggatgtcctaac

SEQ ID NO: 365422 - DNA, 25 bp, Rattus norvegicus
gatgaggcctccctgaaacgtaaag

SEQ ID NO: 365423 - DNA, 25 bp, Rattus norvegicus
gatgaggcctccgtgaaacgtaaag

SEQ ID NO: 365424 - DNA, 25 bp, Rattus norvegicus
gatgaggcctggacatgcatcctgc

SEQ ID NO: 365425 - DNA, 25 bp, Rattus norvegicus
gatgaggcctggtcatgcatcctgc

SEQ ID NO: 365426 - DNA, 25 bp, Rattus norvegicus
gatgaggctcccaaggaaggcccaa

SEQ ID NO: 365427 - DNA, 25 bp, Rattus norvegicus
gatgaggctccctaggaaggcccaa

SEQ ID NO: 365428 - DNA, 25 bp, Rattus norvegicus
gatgaggctgacacagaccgagcac

SEQ ID NO: 365429 - DNA, 25 bp, Rattus norvegicus
gatgaggctgactcagaccgagcac

SEQ ID NO: 365430 - DNA, 25 bp, Rattus norvegicus
gatgaggctgcactagagttctaca

SEQ ID NO: 365431 - DNA, 25 bp, Rattus norvegicus
gatgaggctgcagtagagttctaca

SEQ ID NO: 365432 - DNA, 25 bp, Rattus norvegicus
gatgaggctgctattgaacccgact

SEQ ID NO: 365433 - DNA, 25 bp, Rattus norvegicus
gatgaggctgcttttgaacccgact

SEQ ID NO: 365434 - DNA, 25 bp, Rattus norvegicus
gatgaggctgttctttcatctgcct

SEQ ID NO: 365435 - DNA, 25 bp, Rattus norvegicus
gatgaggctgttgtttcatctgcct

SEQ ID NO: 365436 - DNA, 25 bp, Rattus norvegicus
gatgagggcagtcaactacagcttt

SEQ ID NO: 365437 - DNA, 25 bp, Rattus norvegicus
gatgagggcagtgaactacagcttt

SEQ ID NO: 365438 - DNA, 25 bp, Rattus norvegicus
gatgagggcattctatctgcttgct

SEQ ID NO: 365439 - DNA, 25 bp, Rattus norvegicus
gatgagggcattgtatctgcttgct

SEQ ID NO: 365440 - DNA, 25 bp, Rattus norvegicus
gatgagggccttcatgtgtccccaa

SEQ ID NO: 365441 - DNA, 25 bp, Rattus norvegicus
gatgagggccttgatgtgtccccaa

SEQ ID NO: 365442 - DNA, 25 bp, Rattus norvegicus
gatgagggctacacctgggagcata

SEQ ID NO: 365443 - DNA, 25 bp, Rattus norvegicus
gatgagggctactcctgggagcata

SEQ ID NO: 365444 - DNA, 25 bp, Rattus norvegicus
gatgaggtacagacagtttggcaca

SEQ ID NO: 365445 - DNA, 25 bp, Rattus norvegicus
gatgaggtacagtcagtttggcaca

SEQ ID NO: 365446 - DNA, 25 bp, Rattus norvegicus
gatgaggtacatagtgcgccttgct

SEQ ID NO: 365447 - DNA, 25 bp, Rattus norvegicus
gatgaggtacatatgcttctagccc

SEQ ID NO: 365448 - DNA, 25 bp, Rattus norvegicus
gatgaggtacattgtgcgccttgct

SEQ ID NO: 365449 - DNA, 25 bp, Rattus norvegicus
gatgaggtacatttgcttctagccc

SEQ ID NO: 365450 - DNA, 25 bp, Rattus norvegicus
gatgaggtcacgatttccctttagt

SEQ ID NO: 365451 - DNA, 25 bp, Rattus norvegicus
gatgaggtcacgttttccctttagt

SEQ ID NO: 365452 - DNA, 25 bp, Rattus norvegicus
gatgaggtgcccctgggactttcta

SEQ ID NO: 365453 - DNA, 25 bp, Rattus norvegicus
gatgaggtgcccgtgggactttcta

SEQ ID NO: 365454 - DNA, 25 bp, Rattus norvegicus
gatgaggtggttatccaaaaagccg

SEQ ID NO: 365455 - DNA, 25 bp, Rattus norvegicus
gatgaggtggttttccaaaaagccg

SEQ ID NO: 365456 - DNA, 25 bp, Rattus norvegicus
gatgaggttggcacagcagaacgct

SEQ ID NO: 365457 - DNA, 25 bp, Rattus norvegicus
gatgaggttggctcagcagaacgct

SEQ ID NO: 365458 - DNA, 25 bp, Rattus norvegicus
gatgaggtttctactttaattattt

SEQ ID NO: 365459 - DNA, 25 bp, Rattus norvegicus
gatgaggtttcttctttaattattt

SEQ ID NO: 365460 - DNA, 25 bp, Rattus norvegicus
gatgagtacatgaacctcgtattag

SEQ ID NO: 365461 - DNA, 25 bp, Rattus norvegicus
gatgagtacatgtacctcgtattag

SEQ ID NO: 365462 - DNA, 25 bp, Rattus norvegicus
gatgagtacttcataccccgggaag

SEQ ID NO: 365463 - DNA, 25 bp, Rattus norvegicus
gatgagtacttcttaccccgggaag

SEQ ID NO: 365464 - DNA, 25 bp, Rattus norvegicus
gatgagtatggtcccactttttccc

SEQ ID NO: 365465 - DNA, 25 bp, Rattus norvegicus
gatgagtatggtgccactttttccc

SEQ ID NO: 365466 - DNA, 25 bp, Rattus norvegicus
gatgagtcacataccgggtggcata

SEQ ID NO: 365467 - DNA, 25 bp, Rattus norvegicus
gatgagtcacattccgggtggcata

SEQ ID NO: 365468 - DNA, 25 bp, Rattus norvegicus
gatgagtcagagctgccagccgcca

SEQ ID NO: 365469 - DNA, 25 bp, Rattus norvegicus
gatgagtcagaggtgccagccgcca

SEQ ID NO: 365470 - DNA, 25 bp, Rattus norvegicus
gatgagtccacacccgagaagcgaa

SEQ ID NO: 365471 - DNA, 25 bp, Rattus norvegicus
gatgagtccacagccgagaagcgaa

SEQ ID NO: 365472 - DNA, 25 bp, Rattus norvegicus
gatgagtcctagcttttgtaacagc

SEQ ID NO: 365473 - DNA, 25 bp, Rattus norvegicus
gatgagtcctaggttttgtaacagc

SEQ ID NO: 365474 - DNA, 25 bp, Rattus norvegicus
gatgagtccttccattctgcaaatg

SEQ ID NO: 365475 - DNA, 25 bp, Rattus norvegicus
gatgagtccttcgattctgcaaatg

SEQ ID NO: 365476 - DNA, 25 bp, Rattus norvegicus
gatgagtctatgaaacacataccta

SEQ ID NO: 365477 - DNA, 25 bp, Rattus norvegicus
gatgagtctatgtaacacataccta

SEQ ID NO: 365478 - DNA, 25 bp, Rattus norvegicus
gatgagtctcaactagcagtcctta

SEQ ID NO: 365479 - DNA, 25 bp, Rattus norvegicus
gatgagtctcaagtagcagtcctta

SEQ ID NO: 365480 - DNA, 25 bp, Rattus norvegicus
gatgagtctcacagaatcaccctgc

SEQ ID NO: 365481 - DNA, 25 bp, Rattus norvegicus
gatgagtctcactgaatcaccctgc

SEQ ID NO: 365482 - DNA, 25 bp, Rattus norvegicus
gatgagtctctgcagtaaccactga

SEQ ID NO: 365483 - DNA, 25 bp, Rattus norvegicus
gatgagtctctggagtaaccactga

SEQ ID NO: 365484 - DNA, 25 bp, Rattus norvegicus
gatgagtctgagactagcctaccta

SEQ ID NO: 365485 - DNA, 25 bp, Rattus norvegicus
gatgagtctgagtctagcctaccta

SEQ ID NO: 365486 - DNA, 25 bp, Rattus norvegicus
gatgagtctggcctttgagcttttc

SEQ ID NO: 365487 - DNA, 25 bp, Rattus norvegicus
gatgagtctggcgtttgagcttttc

SEQ ID NO: 365488 - DNA, 25 bp, Rattus norvegicus
gatgagtctgtgctttcttatccaa

SEQ ID NO: 365489 - DNA, 25 bp, Rattus norvegicus
gatgagtctgtggtttcttatccaa

SEQ ID NO: 365490 - DNA, 25 bp, Rattus norvegicus
gatgagtgtacactctttcctaatt

SEQ ID NO: 365491 - DNA, 25 bp, Rattus norvegicus
gatgagtgtacagtctttcctaatt

SEQ ID NO: 365492 - DNA, 25 bp, Rattus norvegicus
gatgagtgttaaagcacgccccatt

SEQ ID NO: 365493 - DNA, 25 bp, Rattus norvegicus
gatgagtgttaatgcacgccccatt

SEQ ID NO: 365494 - DNA, 25 bp, Rattus norvegicus
gatgagttaatgattctatttctat

SEQ ID NO: 365495 - DNA, 25 bp, Rattus norvegicus
gatgagttaatgtttctatttctat

SEQ ID NO: 365496 - DNA, 25 bp, Rattus norvegicus
gatgagttacagcaaatgcttgatg

SEQ ID NO: 365497 - DNA, 25 bp, Rattus norvegicus
gatgagttacaggaaatgcttgatg

SEQ ID NO: 365498 - DNA, 25 bp, Rattus norvegicus
gatgagttattgcacgtcttccctg

SEQ ID NO: 365499 - DNA, 25 bp, Rattus norvegicus
gatgagttattggacgtcttccctg

SEQ ID NO: 365500 - DNA, 25 bp, Rattus norvegicus
gatgagttcatcaaccagttccagt

SEQ ID NO: 365501 - DNA, 25 bp, Rattus norvegicus
gatgagttcatctaccagttccagt

SEQ ID NO: 365502 - DNA, 25 bp, Rattus norvegicus
gatgagttcctgaagcattgaagaa

SEQ ID NO: 365503 - DNA, 25 bp, Rattus norvegicus
gatgagttcctgtagcattgaagaa

SEQ ID NO: 365504 - DNA, 25 bp, Rattus norvegicus
gatgagttgatcatgagttgagctg

SEQ ID NO: 365505 - DNA, 25 bp, Rattus norvegicus
gatgagttgatcttgagttgagctg

SEQ ID NO: 365506 - DNA, 25 bp, Rattus norvegicus
gatgagtttcccaatggccgctggg

SEQ ID NO: 365507 - DNA, 25 bp, Rattus norvegicus
gatgagtttccctatggccgctggg

SEQ ID NO: 365508 - DNA, 25 bp, Rattus norvegicus
gatgagtttggcaacagtcgctaag

SEQ ID NO: 365509 - DNA, 25 bp, Rattus norvegicus
gatgagtttggctacagtcgctaag

SEQ ID NO: 365510 - DNA, 25 bp, Rattus norvegicus
gatgagtttggtccgttatgattaa

SEQ ID NO: 365511 - DNA, 25 bp, Rattus norvegicus
gatgagtttggtgcgttatgattaa

SEQ ID NO: 365512 - DNA, 25 bp, Rattus norvegicus
gatgataaggaacctctctgtgacc

SEQ ID NO: 365513 - DNA, 25 bp, Rattus norvegicus
gatgataaggaagctctctgtgacc

SEQ ID NO: 365514 - DNA, 25 bp, Rattus norvegicus
gatgataatcgcagctctagtccat

SEQ ID NO: 365515 - DNA, 25 bp, Rattus norvegicus
gatgataatcgctgctctagtccat

SEQ ID NO: 365516 - DNA, 25 bp, Rattus norvegicus
gatgatacacctattgatgaaccac

SEQ ID NO: 365517 - DNA, 25 bp, Rattus norvegicus
gatgatacaccttttgatgaaccac

SEQ ID NO: 365518 - DNA, 25 bp, Rattus norvegicus
gatgatacattcagcaaggctaatg

SEQ ID NO: 365519 - DNA, 25 bp, Rattus norvegicus
gatgatacattctgcaaggctaatg

SEQ ID NO: 365520 - DNA, 25 bp, Rattus norvegicus
gatgatacctgaactctgcaagaat

SEQ ID NO: 365521 - DNA, 25 bp, Rattus norvegicus
gatgatacctgatctctgcaagaat

SEQ ID NO: 365522 - DNA, 25 bp, Rattus norvegicus
gatgatacctttagggcgcttcctt

SEQ ID NO: 365523 - DNA, 25 bp, Rattus norvegicus
gatgataccttttgggcgcttcctt

SEQ ID NO: 365524 - DNA, 25 bp, Rattus norvegicus
gatgatactcatctacttttctcgc

SEQ ID NO: 365525 - DNA, 25 bp, Rattus norvegicus
gatgatactcatgtacttttctcgc

SEQ ID NO: 365526 - DNA, 25 bp, Rattus norvegicus
gatgatactgagaagccccagacta

SEQ ID NO: 365527 - DNA, 25 bp, Rattus norvegicus
gatgatactgagtagccccagacta

SEQ ID NO: 365528 - DNA, 25 bp, Rattus norvegicus
gatgatactggcatggcagctgagt

SEQ ID NO: 365529 - DNA, 25 bp, Rattus norvegicus
gatgatactggcttggcagctgagt

SEQ ID NO: 365530 - DNA, 25 bp, Rattus norvegicus
gatgatactgtaacggactttctgt

SEQ ID NO: 365531 - DNA, 25 bp, Rattus norvegicus
gatgatactgtatcggactttctgt

SEQ ID NO: 365532 - DNA, 25 bp, Rattus norvegicus
gatgatacttgactgtgctctggat

SEQ ID NO: 365533 - DNA, 25 bp, Rattus norvegicus
gatgatacttgagtgtgctctggat

SEQ ID NO: 365534 - DNA, 25 bp, Rattus norvegicus
gatgatagccttaccagagatactg

SEQ ID NO: 365535 - DNA, 25 bp, Rattus norvegicus
gatgatagcctttccagagatactg

SEQ ID NO: 365536 - DNA, 25 bp, Rattus norvegicus
gatgatagtttgaacagccaaataa

SEQ ID NO: 365537 - DNA, 25 bp, Rattus norvegicus
gatgatagtttgtacagccaaataa

SEQ ID NO: 365538 - DNA, 25 bp, Rattus norvegicus
gatgatataatcaccacactgagga

SEQ ID NO: 365539 - DNA, 25 bp, Rattus norvegicus
gatgatataatctccacactgagga

SEQ ID NO: 365540 - DNA, 25 bp, Rattus norvegicus
gatgatatcagccaaaaccaggaga

SEQ ID NO: 365541 - DNA, 25 bp, Rattus norvegicus
gatgatatcagcgaaaaccaggaga

SEQ ID NO: 365542 - DNA, 25 bp, Rattus norvegicus
gatgatatccaccaagcagtaagcg

SEQ ID NO: 365543 - DNA, 25 bp, Rattus norvegicus
gatgatatccacgaagcagtaagcg

SEQ ID NO: 365544 - DNA, 25 bp, Rattus norvegicus
gatgatatccagcatcaaccattgc

SEQ ID NO: 365545 - DNA, 25 bp, Rattus norvegicus
gatgatatccaggatcaaccattgc

SEQ ID NO: 365546 - DNA, 25 bp, Rattus norvegicus
gatgatatgcctagcacacatttag

SEQ ID NO: 365547 - DNA, 25 bp, Rattus norvegicus
gatgatatgccttgcacacatttag

SEQ ID NO: 365548 - DNA, 25 bp, Rattus norvegicus
gatgatattcctctttgggaccaag

SEQ ID NO: 365549 - DNA, 25 bp, Rattus norvegicus
gatgatattcctgtttgggaccaag

SEQ ID NO: 365550 - DNA, 25 bp, Rattus norvegicus
gatgatattctcatgtcaagagtct

SEQ ID NO: 365551 - DNA, 25 bp, Rattus norvegicus
gatgatattctcttgtcaagagtct

SEQ ID NO: 365552 - DNA, 25 bp, Rattus norvegicus
gatgatatttatagcagaatttcta

SEQ ID NO: 365553 - DNA, 25 bp, Rattus norvegicus
gatgatatttattgcagaatttcta

SEQ ID NO: 365554 - DNA, 25 bp, Rattus norvegicus
gatgatcaaaaaccgaaccttccag

SEQ ID NO: 365555 - DNA, 25 bp, Rattus norvegicus
gatgatcaaaaagcgaaccttccag

SEQ ID NO: 365556 - DNA, 25 bp, Rattus norvegicus
gatgatcaaaacaactactcgttcc

SEQ ID NO: 365557 - DNA, 25 bp, Rattus norvegicus
gatgatcaaaactactactcgttcc

SEQ ID NO: 365558 - DNA, 25 bp, Rattus norvegicus
gatgatcaaagacgctccaggtcca

SEQ ID NO: 365559 - DNA, 25 bp, Rattus norvegicus
gatgatcaaagaggctccaggtcca

SEQ ID NO: 365560 - DNA, 25 bp, Rattus norvegicus
gatgatcaacagatcattccaggaa

SEQ ID NO: 365561 - DNA, 25 bp, Rattus norvegicus
gatgatcaacagttcattccaggaa

SEQ ID NO: 365562 - DNA, 25 bp, Rattus norvegicus
gatgatcaatgtcctgattgaccac

SEQ ID NO: 365563 - DNA, 25 bp, Rattus norvegicus
gatgatcaatgtgctgattgaccac

SEQ ID NO: 365564 - DNA, 25 bp, Rattus norvegicus
gatgatcaatttacccctagtgcac

SEQ ID NO: 365565 - DNA, 25 bp, Rattus norvegicus
gatgatcaattttcccctagtgcac

SEQ ID NO: 365566 - DNA, 25 bp, Rattus norvegicus
gatgatcacacaatttcaaacgtat

SEQ ID NO: 365567 - DNA, 25 bp, Rattus norvegicus
gatgatcacacattttcaaacgtat

SEQ ID NO: 365568 - DNA, 25 bp, Rattus norvegicus
gatgatcacatacccatgtccccta

SEQ ID NO: 365569 - DNA, 25 bp, Rattus norvegicus
gatgatcacatagccatgtccccta

SEQ ID NO: 365570 - DNA, 25 bp, Rattus norvegicus
gatgatcacatgaccagtctgagtc

SEQ ID NO: 365571 - DNA, 25 bp, Rattus norvegicus
gatgatcacatgtccagtctgagtc

SEQ ID NO: 365572 - DNA, 25 bp, Rattus norvegicus
gatgatcaccatacttatagccatg

SEQ ID NO: 365573 - DNA, 25 bp, Rattus norvegicus
gatgatcaccatataactcggcctc

SEQ ID NO: 365574 - DNA, 25 bp, Rattus norvegicus
gatgatcaccattcttatagccatg

SEQ ID NO: 365575 - DNA, 25 bp, Rattus norvegicus
gatgatcaccatttaactcggcctc

SEQ ID NO: 365576 - DNA, 25 bp, Rattus norvegicus
gatgatcactctaagttttccttcc

SEQ ID NO: 365577 - DNA, 25 bp, Rattus norvegicus
gatgatcactcttagttttccttcc

SEQ ID NO: 365578 - DNA, 25 bp, Rattus norvegicus
gatgatcactttatgaagcgttact

SEQ ID NO: 365579 - DNA, 25 bp, Rattus norvegicus
gatgatcactttccagatatcacag

SEQ ID NO: 365580 - DNA, 25 bp, Rattus norvegicus
gatgatcactttgcagatatcacag

SEQ ID NO: 365581 - DNA, 25 bp, Rattus norvegicus
gatgatcactttttgaagcgttact

SEQ ID NO: 365582 - DNA, 25 bp, Rattus norvegicus
gatgatcagacaaggcaaagcgaaa

SEQ ID NO: 365583 - DNA, 25 bp, Rattus norvegicus
gatgatcagacatggcaaagcgaaa

SEQ ID NO: 365584 - DNA, 25 bp, Rattus norvegicus
gatgatcagcatacttgtggccctt

SEQ ID NO: 365585 - DNA, 25 bp, Rattus norvegicus
gatgatcagcatcaatcaactggac

SEQ ID NO: 365586 - DNA, 25 bp, Rattus norvegicus
gatgatcagcatgaatcaactggac

SEQ ID NO: 365587 - DNA, 25 bp, Rattus norvegicus
gatgatcagcattcttgtggccctt

SEQ ID NO: 365588 - DNA, 25 bp, Rattus norvegicus
gatgatcagcttacactgtcttctt

SEQ ID NO: 365589 - DNA, 25 bp, Rattus norvegicus
gatgatcagctttcactgtcttctt

SEQ ID NO: 365590 - DNA, 25 bp, Rattus norvegicus
gatgatcaggagatcagcaccagct

SEQ ID NO: 365591 - DNA, 25 bp, Rattus norvegicus
gatgatcaggagttcagcaccagct

SEQ ID NO: 365592 - DNA, 25 bp, Rattus norvegicus
gatgatcagtgactttgcctcagct

SEQ ID NO: 365593 - DNA, 25 bp, Rattus norvegicus
gatgatcagtgagtttgcctcagct

SEQ ID NO: 365594 - DNA, 25 bp, Rattus norvegicus
gatgatcatatccactggctccttg

SEQ ID NO: 365595 - DNA, 25 bp, Rattus norvegicus
gatgatcatatcgactggctccttg

SEQ ID NO: 365596 - DNA, 25 bp, Rattus norvegicus
gatgatcatcagatgtccagcttgc

SEQ ID NO: 365597 - DNA, 25 bp, Rattus norvegicus
gatgatcatcagttgtccagcttgc

SEQ ID NO: 365598 - DNA, 25 bp, Rattus norvegicus
gatgatcatcgtcgtggaccagtga

SEQ ID NO: 365599 - DNA, 25 bp, Rattus norvegicus
gatgatcatcgtggtggaccagtga

SEQ ID NO: 365600 - DNA, 25 bp, Rattus norvegicus
gatgatcatcttattgactagttgg

SEQ ID NO: 365601 - DNA, 25 bp, Rattus norvegicus
gatgatcatctttttgactagttgg

SEQ ID NO: 365602 - DNA, 25 bp, Rattus norvegicus
gatgatcatgacagtcctttggtga

SEQ ID NO: 365603 - DNA, 25 bp, Rattus norvegicus
gatgatcatgactgtcctttggtga

SEQ ID NO: 365604 - DNA, 25 bp, Rattus norvegicus
gatgatccaaaaatttctgtcagaa

SEQ ID NO: 365605 - DNA, 25 bp, Rattus norvegicus
gatgatccaaaattttctgtcagaa

SEQ ID NO: 365606 - DNA, 25 bp, Rattus norvegicus
gatgatccaccaaatactggaccag

SEQ ID NO: 365607 - DNA, 25 bp, Rattus norvegicus
gatgatccaccatatactggaccag

SEQ ID NO: 365608 - DNA, 25 bp, Rattus norvegicus
gatgatccaggaaagtacccaacgc

SEQ ID NO: 365609 - DNA, 25 bp, Rattus norvegicus
gatgatccaggatagtacccaacgc

SEQ ID NO: 365610 - DNA, 25 bp, Rattus norvegicus
gatgatccagggaactagtcctccg

SEQ ID NO: 365611 - DNA, 25 bp, Rattus norvegicus
gatgatccagggtactagtcctccg

SEQ ID NO: 365612 - DNA, 25 bp, Rattus norvegicus
gatgatccattacacccttggacag

SEQ ID NO: 365613 - DNA, 25 bp, Rattus norvegicus
gatgatccattagacccttggacag

SEQ ID NO: 365614 - DNA, 25 bp, Rattus norvegicus
gatgatcccaatcagtcggctggag

SEQ ID NO: 365615 - DNA, 25 bp, Rattus norvegicus
gatgatcccaatctgacccgggcca

SEQ ID NO: 365616 - DNA, 25 bp, Rattus norvegicus
gatgatcccaatgagtcggctggag

SEQ ID NO: 365617 - DNA, 25 bp, Rattus norvegicus
gatgatcccaatgtgacccgggcca

SEQ ID NO: 365618 - DNA, 25 bp, Rattus norvegicus
gatgatcccagcagggagccagaag

SEQ ID NO: 365619 - DNA, 25 bp, Rattus norvegicus
gatgatcccagctgggagccagaag

SEQ ID NO: 365620 - DNA, 25 bp, Rattus norvegicus
gatgatcctcataagctggagcctt

SEQ ID NO: 365621 - DNA, 25 bp, Rattus norvegicus
gatgatcctcattagctggagcctt

SEQ ID NO: 365622 - DNA, 25 bp, Rattus norvegicus
gatgatcctctgatctcagagcctg

SEQ ID NO: 365623 - DNA, 25 bp, Rattus norvegicus
gatgatcctctgttctcagagcctg

SEQ ID NO: 365624 - DNA, 25 bp, Rattus norvegicus
gatgatcgaaaaccaagcactccag

SEQ ID NO: 365625 - DNA, 25 bp, Rattus norvegicus
gatgatcgaaaagcaagcactccag

SEQ ID NO: 365626 - DNA, 25 bp, Rattus norvegicus
gatgatctacttactttgagcaata

SEQ ID NO: 365627 - DNA, 25 bp, Rattus norvegicus
gatgatctactttctttgagcaata

SEQ ID NO: 365628 - DNA, 25 bp, Rattus norvegicus
gatgatctagatacttggcctgttt

SEQ ID NO: 365629 - DNA, 25 bp, Rattus norvegicus
gatgatctagattcttggcctgttt

SEQ ID NO: 365630 - DNA, 25 bp, Rattus norvegicus
gatgatctatgtacttggtgtttga

SEQ ID NO: 365631 - DNA, 25 bp, Rattus norvegicus
gatgatctatgttcttggtgtttga

SEQ ID NO: 365632 - DNA, 25 bp, Rattus norvegicus
gatgatctcacactttgtcacctgt

SEQ ID NO: 365633 - DNA, 25 bp, Rattus norvegicus
gatgatctcacagtttgtcacctgt

SEQ ID NO: 365634 - DNA, 25 bp, Rattus norvegicus
gatgatctccttctgtttctatttt

SEQ ID NO: 365635 - DNA, 25 bp, Rattus norvegicus
gatgatctccttgtgtttctatttt

SEQ ID NO: 365636 - DNA, 25 bp, Rattus norvegicus
gatgatctgacccagtaactacaga

SEQ ID NO: 365637 - DNA, 25 bp, Rattus norvegicus
gatgatctgaccgagtaactacaga

SEQ ID NO: 365638 - DNA, 25 bp, Rattus norvegicus
gatgatctgatgattcacatctaca

SEQ ID NO: 365639 - DNA, 25 bp, Rattus norvegicus
gatgatctgatgtttcacatctaca

SEQ ID NO: 365640 - DNA, 25 bp, Rattus norvegicus
gatgatctgccgcacagagtccttg

SEQ ID NO: 365641 - DNA, 25 bp, Rattus norvegicus
gatgatctgccggacagagtccttg

SEQ ID NO: 365642 - DNA, 25 bp, Rattus norvegicus
gatgatctggcccaacttctggcta

SEQ ID NO: 365643 - DNA, 25 bp, Rattus norvegicus
gatgatctggccgaacttctggcta

SEQ ID NO: 365644 - DNA, 25 bp, Rattus norvegicus
gatgatctgtttctgacgacgcaca

SEQ ID NO: 365645 - DNA, 25 bp, Rattus norvegicus
gatgatctgtttgtgacgacgcaca

SEQ ID NO: 365646 - DNA, 25 bp, Rattus norvegicus
gatgatcttaccaaccaatggctgg

SEQ ID NO: 365647 - DNA, 25 bp, Rattus norvegicus
gatgatcttacctaccaatggctgg

SEQ ID NO: 365648 - DNA, 25 bp, Rattus norvegicus
gatgatcttcttcatgctgacagtg

SEQ ID NO: 365649 - DNA, 25 bp, Rattus norvegicus
gatgatcttcttgatgctgacagtg

SEQ ID NO: 365650 - DNA, 25 bp, Rattus norvegicus
gatgatcttgccaggaacattgccc

SEQ ID NO: 365651 - DNA, 25 bp, Rattus norvegicus
gatgatcttgcctggaacattgccc

SEQ ID NO: 365652 - DNA, 25 bp, Rattus norvegicus
gatgatgaacacaactgcagcgccc

SEQ ID NO: 365653 - DNA, 25 bp, Rattus norvegicus
gatgatgaacacagaccttagcaga

SEQ ID NO: 365654 - DNA, 25 bp, Rattus norvegicus
gatgatgaacactactgcagcgccc

SEQ ID NO: 365655 - DNA, 25 bp, Rattus norvegicus
gatgatgaacactgaccttagcaga

SEQ ID NO: 365656 - DNA, 25 bp, Rattus norvegicus
gatgatgacaacaacgtgaacccca

SEQ ID NO: 365657 - DNA, 25 bp, Rattus norvegicus
gatgatgacaactacgtgaacccca

SEQ ID NO: 365658 - DNA, 25 bp, Rattus norvegicus
gatgatgacaccatggctgaggcct

SEQ ID NO: 365659 - DNA, 25 bp, Rattus norvegicus
gatgatgacaccttggctgaggcct

SEQ ID NO: 365660 - DNA, 25 bp, Rattus norvegicus
gatgatgacatcatcaaccggatct

SEQ ID NO: 365661 - DNA, 25 bp, Rattus norvegicus
gatgatgacatcttcaaccggatct

SEQ ID NO: 365662 - DNA, 25 bp, Rattus norvegicus
gatgatgacattcatctcttcggat

SEQ ID NO: 365663 - DNA, 25 bp, Rattus norvegicus
gatgatgacattgatctcttcggat

SEQ ID NO: 365664 - DNA, 25 bp, Rattus norvegicus
gatgatgaccacataaaggacctgt

SEQ ID NO: 365665 - DNA, 25 bp, Rattus norvegicus
gatgatgaccacatttcttctctgt

SEQ ID NO: 365666 - DNA, 25 bp, Rattus norvegicus
gatgatgaccacttaaaggacctgt

SEQ ID NO: 365667 - DNA, 25 bp, Rattus norvegicus
gatgatgaccacttttcttctctgt

SEQ ID NO: 365668 - DNA, 25 bp, Rattus norvegicus
gatgatgacctacagcctgtcacca

SEQ ID NO: 365669 - DNA, 25 bp, Rattus norvegicus
gatgatgacctagagcctgtcacca

SEQ ID NO: 365670 - DNA, 25 bp, Rattus norvegicus
gatgatgacgagaacaaccggcccc

SEQ ID NO: 365671 - DNA, 25 bp, Rattus norvegicus
gatgatgacgagtacaaccggcccc

SEQ ID NO: 365672 - DNA, 25 bp, Rattus norvegicus
gatgatgactttcttcttctgactg

SEQ ID NO: 365673 - DNA, 25 bp, Rattus norvegicus
gatgatgactttgttcttctgactg

SEQ ID NO: 365674 - DNA, 25 bp, Rattus norvegicus
gatgatgagagcagtgtggccccca

SEQ ID NO: 365675 - DNA, 25 bp, Rattus norvegicus
gatgatgagagctgtgtggccccca

SEQ ID NO: 365676 - DNA, 25 bp, Rattus norvegicus
gatgatgagcaaccctacactgaaa

SEQ ID NO: 365677 - DNA, 25 bp, Rattus norvegicus
gatgatgagcaagcctacactgaaa

SEQ ID NO: 365678 - DNA, 25 bp, Rattus norvegicus
gatgatgagcatcaccccagaggtg

SEQ ID NO: 365679 - DNA, 25 bp, Rattus norvegicus
gatgatgagcatgaccccagaggtg

SEQ ID NO: 365680 - DNA, 25 bp, Rattus norvegicus
gatgatgaggaacaccagcctttat

SEQ ID NO: 365681 - DNA, 25 bp, Rattus norvegicus
gatgatgaggaagaccagcctttat

SEQ ID NO: 365682 - DNA, 25 bp, Rattus norvegicus
gatgatgagtttagaggtcagcata

SEQ ID NO: 365683 - DNA, 25 bp, Rattus norvegicus
gatgatgagttttgaggtcagcata

SEQ ID NO: 365684 - DNA, 25 bp, Rattus norvegicus
gatgatgatatcaaggcataaccta

SEQ ID NO: 365685 - DNA, 25 bp, Rattus norvegicus
gatgatgatatctaggcataaccta

SEQ ID NO: 365686 - DNA, 25 bp, Rattus norvegicus
gatgatgatattattgtcttaattc

SEQ ID NO: 365687 - DNA, 25 bp, Rattus norvegicus
gatgatgatatttttgtcttaattc

SEQ ID NO: 365688 - DNA, 25 bp, Rattus norvegicus
gatgatgatcacatttcacccgagg

SEQ ID NO: 365689 - DNA, 25 bp, Rattus norvegicus
gatgatgatcacttttcacccgagg

SEQ ID NO: 365690 - DNA, 25 bp, Rattus norvegicus
gatgatgatctaattcccagcttga

SEQ ID NO: 365691 - DNA, 25 bp, Rattus norvegicus
gatgatgatctatttcccagcttga

SEQ ID NO: 365692 - DNA, 25 bp, Rattus norvegicus
gatgatgatgttcacaccatgctga

SEQ ID NO: 365693 - DNA, 25 bp, Rattus norvegicus
gatgatgatgttgacaccatgctga

SEQ ID NO: 365694 - DNA, 25 bp, Rattus norvegicus
gatgatgattcacctaaaccagtta

SEQ ID NO: 365695 - DNA, 25 bp, Rattus norvegicus
gatgatgattcagctaaaccagtta

SEQ ID NO: 365696 - DNA, 25 bp, Rattus norvegicus
gatgatgcaaacagcccatgtcatt

SEQ ID NO: 365697 - DNA, 25 bp, Rattus norvegicus
gatgatgcaaactgcccatgtcatt

SEQ ID NO: 365698 - DNA, 25 bp, Rattus norvegicus
gatgatgcacaacgccgtgctgcct

SEQ ID NO: 365699 - DNA, 25 bp, Rattus norvegicus
gatgatgcacaaggccgtgctgcct

SEQ ID NO: 365700 - DNA, 25 bp, Rattus norvegicus
gatgatgcacatatccaggctgaga

SEQ ID NO: 365701 - DNA, 25 bp, Rattus norvegicus
gatgatgcacatttccaggctgaga

SEQ ID NO: 365702 - DNA, 25 bp, Rattus norvegicus
gatgatgcactgcaagaccctgcgc

SEQ ID NO: 365703 - DNA, 25 bp, Rattus norvegicus
gatgatgcactggaagaccctgcgc

SEQ ID NO: 365704 - DNA, 25 bp, Rattus norvegicus
gatgatgcagatagagtgtgaagtc

SEQ ID NO: 365705 - DNA, 25 bp, Rattus norvegicus
gatgatgcagattgagtgtgaagtc

SEQ ID NO: 365706 - DNA, 25 bp, Rattus norvegicus
gatgatgcatagctggaacaaatta

SEQ ID NO: 365707 - DNA, 25 bp, Rattus norvegicus
gatgatgcataggtggaacaaatta

SEQ ID NO: 365708 - DNA, 25 bp, Rattus norvegicus
gatgatgcatctcaagctgccctca

SEQ ID NO: 365709 - DNA, 25 bp, Rattus norvegicus
gatgatgcatctgaagctgccctca

SEQ ID NO: 365710 - DNA, 25 bp, Rattus norvegicus
gatgatgcattacaccgagaactac

SEQ ID NO: 365711 - DNA, 25 bp, Rattus norvegicus
gatgatgcattagaccgagaactac

SEQ ID NO: 365712 - DNA, 25 bp, Rattus norvegicus
gatgatgccagaagtccgcggagcc

SEQ ID NO: 365713 - DNA, 25 bp, Rattus norvegicus
gatgatgccagatgtccgcggagcc

SEQ ID NO: 365714 - DNA, 25 bp, Rattus norvegicus
gatgatgccatcaacttagcacaac

SEQ ID NO: 365715 - DNA, 25 bp, Rattus norvegicus
gatgatgccatctacttagcacaac

SEQ ID NO: 365716 - DNA, 25 bp, Rattus norvegicus
gatgatgccatgatgtgaggagaca

SEQ ID NO: 365717 - DNA, 25 bp, Rattus norvegicus
gatgatgccatgttgtgaggagaca

SEQ ID NO: 365718 - DNA, 25 bp, Rattus norvegicus
gatgatgcccagacaatgtgcttcc

SEQ ID NO: 365719 - DNA, 25 bp, Rattus norvegicus
gatgatgcccagtcaatgtgcttcc

SEQ ID NO: 365720 - DNA, 25 bp, Rattus norvegicus
gatgatgcccatctgttcctataga

SEQ ID NO: 365721 - DNA, 25 bp, Rattus norvegicus
gatgatgcccatgtgttcctataga

SEQ ID NO: 365722 - DNA, 25 bp, Rattus norvegicus
gatgatgccctactgaagatgacca

SEQ ID NO: 365723 - DNA, 25 bp, Rattus norvegicus
gatgatgccctagtgaagatgacca

SEQ ID NO: 365724 - DNA, 25 bp, Rattus norvegicus
gatgatgccggacttcattcactgt

SEQ ID NO: 365725 - DNA, 25 bp, Rattus norvegicus
gatgatgccggagttcattcactgt

SEQ ID NO: 365726 - DNA, 25 bp, Rattus norvegicus
gatgatgcctagcttggtctccaac

SEQ ID NO: 365727 - DNA, 25 bp, Rattus norvegicus
gatgatgcctaggttggtctccaac

SEQ ID NO: 365728 - DNA, 25 bp, Rattus norvegicus
gatgatgcggcgccctccgactggc

SEQ ID NO: 365729 - DNA, 25 bp, Rattus norvegicus
gatgatgcggcggcctccgactggc

SEQ ID NO: 365730 - DNA, 25 bp, Rattus norvegicus
gatgatgctcaacgaaacagctctc

SEQ ID NO: 365731 - DNA, 25 bp, Rattus norvegicus
gatgatgctcaaggaaacagctctc

SEQ ID NO: 365732 - DNA, 25 bp, Rattus norvegicus
gatgatgctcctcactgtgtacggg

SEQ ID NO: 365733 - DNA, 25 bp, Rattus norvegicus
gatgatgctcctgactgtgtacggg

SEQ ID NO: 365734 - DNA, 25 bp, Rattus norvegicus
gatgatgctctcaatggtgccatta

SEQ ID NO: 365735 - DNA, 25 bp, Rattus norvegicus
gatgatgctctctatggtgccatta

SEQ ID NO: 365736 - DNA, 25 bp, Rattus norvegicus
gatgatgctggaaatcgacttcggt

SEQ ID NO: 365737 - DNA, 25 bp, Rattus norvegicus
gatgatgctggatatcgacttcggt

SEQ ID NO: 365738 - DNA, 25 bp, Rattus norvegicus
gatgatgctggcctaccgcttccgg

SEQ ID NO: 365739 - DNA, 25 bp, Rattus norvegicus
gatgatgctggcgtaccgcttccgg

SEQ ID NO: 365740 - DNA, 25 bp, Rattus norvegicus
gatgatgctgtcagcaagaatttgc

SEQ ID NO: 365741 - DNA, 25 bp, Rattus norvegicus
gatgatgctgtctgcaagaatttgc

SEQ ID NO: 365742 - DNA, 25 bp, Rattus norvegicus
gatgatgcttcaaaccacaatccta

SEQ ID NO: 365743 - DNA, 25 bp, Rattus norvegicus
gatgatgcttcataccacaatccta

SEQ ID NO: 365744 - DNA, 25 bp, Rattus norvegicus
gatgatggccgacatgtacaacaga

SEQ ID NO: 365745 - DNA, 25 bp, Rattus norvegicus
gatgatggccgagatgtacaacaga

SEQ ID NO: 365746 - DNA, 25 bp, Rattus norvegicus
gatgatggcctcagcagccccagtg

SEQ ID NO: 365747 - DNA, 25 bp, Rattus norvegicus
gatgatggcctccatacctgactgc

SEQ ID NO: 365748 - DNA, 25 bp, Rattus norvegicus
gatgatggcctcgatacctgactgc

SEQ ID NO: 365749 - DNA, 25 bp, Rattus norvegicus
gatgatggcctctgcagccccagtg

SEQ ID NO: 365750 - DNA, 25 bp, Rattus norvegicus
gatgatggccttccacttgggaatc

SEQ ID NO: 365751 - DNA, 25 bp, Rattus norvegicus
gatgatggccttgcacttgggaatc

SEQ ID NO: 365752 - DNA, 25 bp, Rattus norvegicus
gatgatggcgatacttcagcaatga

SEQ ID NO: 365753 - DNA, 25 bp, Rattus norvegicus
gatgatggcgattcttcagcaatga

SEQ ID NO: 365754 - DNA, 25 bp, Rattus norvegicus
gatgatggctgcagctttttatccc

SEQ ID NO: 365755 - DNA, 25 bp, Rattus norvegicus
gatgatggctgctgctttttatccc

SEQ ID NO: 365756 - DNA, 25 bp, Rattus norvegicus
gatgatgggattatcctccagaaca

SEQ ID NO: 365757 - DNA, 25 bp, Rattus norvegicus
gatgatgggattttcctccagaaca

SEQ ID NO: 365758 - DNA, 25 bp, Rattus norvegicus
gatgatgggcatatacagctctgat

SEQ ID NO: 365759 - DNA, 25 bp, Rattus norvegicus
gatgatgggcatcagtatccaggct

SEQ ID NO: 365760 - DNA, 25 bp, Rattus norvegicus
gatgatgggcatgagtatccaggct

SEQ ID NO: 365761 - DNA, 25 bp, Rattus norvegicus
gatgatgggcatttacagctctgat

SEQ ID NO: 365762 - DNA, 25 bp, Rattus norvegicus
gatgatgggctcagcaaaggcagct

SEQ ID NO: 365763 - DNA, 25 bp, Rattus norvegicus
gatgatgggctctgcaaaggcagct

SEQ ID NO: 365764 - DNA, 25 bp, Rattus norvegicus
gatgatggtctgagccagggcacat

SEQ ID NO: 365765 - DNA, 25 bp, Rattus norvegicus
gatgatggtctgtgccagggcacat

SEQ ID NO: 365766 - DNA, 25 bp, Rattus norvegicus
gatgatggtgtactatggatgaatt

SEQ ID NO: 365767 - DNA, 25 bp, Rattus norvegicus
gatgatggtgtagtatggatgaatt

SEQ ID NO: 365768 - DNA, 25 bp, Rattus norvegicus
gatgatgtagagacaccccaataga

SEQ ID NO: 365769 - DNA, 25 bp, Rattus norvegicus
gatgatgtagagtcaccccaataga

SEQ ID NO: 365770 - DNA, 25 bp, Rattus norvegicus
gatgatgtatataccccattctcag

SEQ ID NO: 365771 - DNA, 25 bp, Rattus norvegicus
gatgatgtatattccccattctcag

SEQ ID NO: 365772 - DNA, 25 bp, Rattus norvegicus
gatgatgtcaacagtcactgctgtc

SEQ ID NO: 365773 - DNA, 25 bp, Rattus norvegicus
gatgatgtcaactgtcactgctgtc

SEQ ID NO: 365774 - DNA, 25 bp, Rattus norvegicus
gatgatgtcaccagctgtcagggat

SEQ ID NO: 365775 - DNA, 25 bp, Rattus norvegicus
gatgatgtcaccatcacatttttgc

SEQ ID NO: 365776 - DNA, 25 bp, Rattus norvegicus
gatgatgtcacctgctgtcagggat

SEQ ID NO: 365777 - DNA, 25 bp, Rattus norvegicus
gatgatgtcaccttcacatttttgc

SEQ ID NO: 365778 - DNA, 25 bp, Rattus norvegicus
gatgatgtcatacaccacgaagtaa

SEQ ID NO: 365779 - DNA, 25 bp, Rattus norvegicus
gatgatgtcatagaccacgaagtaa

SEQ ID NO: 365780 - DNA, 25 bp, Rattus norvegicus
gatgatgtcatccagggtgccagct

SEQ ID NO: 365781 - DNA, 25 bp, Rattus norvegicus
gatgatgtcatcgagggtgccagct

SEQ ID NO: 365782 - DNA, 25 bp, Rattus norvegicus
gatgatgtcatgaactccactaaaa

SEQ ID NO: 365783 - DNA, 25 bp, Rattus norvegicus
gatgatgtcatgctcttctatacca

SEQ ID NO: 365784 - DNA, 25 bp, Rattus norvegicus
gatgatgtcatggtcttctatacca

SEQ ID NO: 365785 - DNA, 25 bp, Rattus norvegicus
gatgatgtcatgtactccactaaaa

SEQ ID NO: 365786 - DNA, 25 bp, Rattus norvegicus
gatgatgtcctgagtgaacaccaag

SEQ ID NO: 365787 - DNA, 25 bp, Rattus norvegicus
gatgatgtcctgtgtgaacaccaag

SEQ ID NO: 365788 - DNA, 25 bp, Rattus norvegicus
gatgatgtctctaatcccttattcc

SEQ ID NO: 365789 - DNA, 25 bp, Rattus norvegicus
gatgatgtctcttatcccttattcc

SEQ ID NO: 365790 - DNA, 25 bp, Rattus norvegicus
gatgatgtctgtcttaatcttaagg

SEQ ID NO: 365791 - DNA, 25 bp, Rattus norvegicus
gatgatgtctgtgttaatcttaagg

SEQ ID NO: 365792 - DNA, 25 bp, Rattus norvegicus
gatgatgtcttaattccaaaccgga

SEQ ID NO: 365793 - DNA, 25 bp, Rattus norvegicus
gatgatgtcttatttccaaaccgga

SEQ ID NO: 365794 - DNA, 25 bp, Rattus norvegicus
gatgatgtctttactgcgagcagat

SEQ ID NO: 365795 - DNA, 25 bp, Rattus norvegicus
gatgatgtcttttctgcgagcagat

SEQ ID NO: 365796 - DNA, 25 bp, Rattus norvegicus
gatgatgtgctccaaataccctgag

SEQ ID NO: 365797 - DNA, 25 bp, Rattus norvegicus
gatgatgtgctcgaaataccctgag

SEQ ID NO: 365798 - DNA, 25 bp, Rattus norvegicus
gatgatgtgtctccattcctggatg

SEQ ID NO: 365799 - DNA, 25 bp, Rattus norvegicus
gatgatgtgtctgcattcctggatg

SEQ ID NO: 365800 - DNA, 25 bp, Rattus norvegicus
gatgatgttacaccagcacgccttc

SEQ ID NO: 365801 - DNA, 25 bp, Rattus norvegicus
gatgatgttacagcagcacgccttc

SEQ ID NO: 365802 - DNA, 25 bp, Rattus norvegicus
gatgatgttatcatttttatcacct

SEQ ID NO: 365803 - DNA, 25 bp, Rattus norvegicus
gatgatgttatcttttttatcacct

SEQ ID NO: 365804 - DNA, 25 bp, Rattus norvegicus
gatgatgttgagaccaagaagcaga

SEQ ID NO: 365805 - DNA, 25 bp, Rattus norvegicus
gatgatgttgagtccaagaagcaga

SEQ ID NO: 365806 - DNA, 25 bp, Rattus norvegicus
gatgatgttggtccgcttcttggcc

SEQ ID NO: 365807 - DNA, 25 bp, Rattus norvegicus
gatgatgttggtcgcgaggccctgg

SEQ ID NO: 365808 - DNA, 25 bp, Rattus norvegicus
gatgatgttggtgcgcttcttggcc

SEQ ID NO: 365809 - DNA, 25 bp, Rattus norvegicus
gatgatgttggtggcgaggccctgg

SEQ ID NO: 365810 - DNA, 25 bp, Rattus norvegicus
gatgatgtttttaactgcaacctgt

SEQ ID NO: 365811 - DNA, 25 bp, Rattus norvegicus
gatgatgttttttactgcaacctgt

SEQ ID NO: 365812 - DNA, 25 bp, Rattus norvegicus
gatgattactcgctgctcctttctt

SEQ ID NO: 365813 - DNA, 25 bp, Rattus norvegicus
gatgattactcggtgctcctttctt

SEQ ID NO: 365814 - DNA, 25 bp, Rattus norvegicus
gatgattagagcagagaacccctta

SEQ ID NO: 365815 - DNA, 25 bp, Rattus norvegicus
gatgattagagctgagaacccctta

SEQ ID NO: 365816 - DNA, 25 bp, Rattus norvegicus
gatgattagggcagctggcctcacc

SEQ ID NO: 365817 - DNA, 25 bp, Rattus norvegicus
gatgattagggctgctggcctcacc

SEQ ID NO: 365818 - DNA, 25 bp, Rattus norvegicus
gatgattatcctacatttccacata

SEQ ID NO: 365819 - DNA, 25 bp, Rattus norvegicus
gatgattatccttcatttccacata

SEQ ID NO: 365820 - DNA, 25 bp, Rattus norvegicus
gatgattatgtaattggccccagtg

SEQ ID NO: 365821 - DNA, 25 bp, Rattus norvegicus
gatgattatgtatttggccccagtg

SEQ ID NO: 365822 - DNA, 25 bp, Rattus norvegicus
gatgattcacggactttacttctga

SEQ ID NO: 365823 - DNA, 25 bp, Rattus norvegicus
gatgattcacggtctttacttctga

SEQ ID NO: 365824 - DNA, 25 bp, Rattus norvegicus
gatgattcacttacttgtccaactg

SEQ ID NO: 365825 - DNA, 25 bp, Rattus norvegicus
gatgattcactttcttgtccaactg

SEQ ID NO: 365826 - DNA, 25 bp, Rattus norvegicus
gatgattccaacagattccaactga

SEQ ID NO: 365827 - DNA, 25 bp, Rattus norvegicus
gatgattccaactgattccaactga

SEQ ID NO: 365828 - DNA, 25 bp, Rattus norvegicus
gatgattccattagtgtcctgggaa

SEQ ID NO: 365829 - DNA, 25 bp, Rattus norvegicus
gatgattccatttgtgtcctgggaa

SEQ ID NO: 365830 - DNA, 25 bp, Rattus norvegicus
gatgattccttgacatgcttagtat

SEQ ID NO: 365831 - DNA, 25 bp, Rattus norvegicus
gatgattccttgtcatgcttagtat

SEQ ID NO: 365832 - DNA, 25 bp, Rattus norvegicus
gatgattctaaaattgtacctatgt

SEQ ID NO: 365833 - DNA, 25 bp, Rattus norvegicus
gatgattctaaatttgtacctatgt

SEQ ID NO: 365834 - DNA, 25 bp, Rattus norvegicus
gatgattctattctccgattggcta

SEQ ID NO: 365835 - DNA, 25 bp, Rattus norvegicus
gatgattctattgtccgattggcta

SEQ ID NO: 365836 - DNA, 25 bp, Rattus norvegicus
gatgattctcgtcttaatgtcttgt

SEQ ID NO: 365837 - DNA, 25 bp, Rattus norvegicus
gatgattctcgtgttaatgtcttgt

SEQ ID NO: 365838 - DNA, 25 bp, Rattus norvegicus
gatgattctgacctctttgtcaaca

SEQ ID NO: 365839 - DNA, 25 bp, Rattus norvegicus
gatgattctgacgtctttgtcaaca

SEQ ID NO: 365840 - DNA, 25 bp, Rattus norvegicus
gatgattctggacggactctgtcct

SEQ ID NO: 365841 - DNA, 25 bp, Rattus norvegicus
gatgattctggagggactctgtcct

SEQ ID NO: 365842 - DNA, 25 bp, Rattus norvegicus
gatgattctgggacttttcttcaag

SEQ ID NO: 365843 - DNA, 25 bp, Rattus norvegicus
gatgattctgggtcttttcttcaag

SEQ ID NO: 365844 - DNA, 25 bp, Rattus norvegicus
gatgattctggtacctggagaccca

SEQ ID NO: 365845 - DNA, 25 bp, Rattus norvegicus
gatgattctggttcctggagaccca

SEQ ID NO: 365846 - DNA, 25 bp, Rattus norvegicus
gatgattcttagcaaccgtgtgggt

SEQ ID NO: 365847 - DNA, 25 bp, Rattus norvegicus
gatgattcttaggaaccgtgtgggt

SEQ ID NO: 365848 - DNA, 25 bp, Rattus norvegicus
gatgattctttgaaagtgcactcac

SEQ ID NO: 365849 - DNA, 25 bp, Rattus norvegicus
gatgattctttgtaagtgcactcac

SEQ ID NO: 365850 - DNA, 25 bp, Rattus norvegicus
gatgattgccagagaccgttatctt

SEQ ID NO: 365851 - DNA, 25 bp, Rattus norvegicus
gatgattgccagtgaccgttatctt

SEQ ID NO: 365852 - DNA, 25 bp, Rattus norvegicus
gatgattgccgtatgacaccagtga

SEQ ID NO: 365853 - DNA, 25 bp, Rattus norvegicus
gatgattgccgtttgacaccagtga

SEQ ID NO: 365854 - DNA, 25 bp, Rattus norvegicus
gatgattggatgatgttttacgtta

SEQ ID NO: 365855 - DNA, 25 bp, Rattus norvegicus
gatgattggatgttgttttacgtta

SEQ ID NO: 365856 - DNA, 25 bp, Rattus norvegicus
gatgattggcttaactagtcttccc

SEQ ID NO: 365857 - DNA, 25 bp, Rattus norvegicus
gatgattggctttactagtcttccc

SEQ ID NO: 365858 - DNA, 25 bp, Rattus norvegicus
gatgattggtatcccgaccagtgcg

SEQ ID NO: 365859 - DNA, 25 bp, Rattus norvegicus
gatgattggtatgccgaccagtgcg

SEQ ID NO: 365860 - DNA, 25 bp, Rattus norvegicus
gatgattgtcatatgctttttgcag

SEQ ID NO: 365861 - DNA, 25 bp, Rattus norvegicus
gatgattgtcatttgctttttgcag

SEQ ID NO: 365862 - DNA, 25 bp, Rattus norvegicus
gatgattgtcctacaaagtggccaa

SEQ ID NO: 365863 - DNA, 25 bp, Rattus norvegicus
gatgattgtccttcaaagtggccaa

SEQ ID NO: 365864 - DNA, 25 bp, Rattus norvegicus
gatgattgtgatactcagggactga

SEQ ID NO: 365865 - DNA, 25 bp, Rattus norvegicus
gatgattgtgattctcagggactga

SEQ ID NO: 365866 - DNA, 25 bp, Rattus norvegicus
gatgattgtgccactagactttgct

SEQ ID NO: 365867 - DNA, 25 bp, Rattus norvegicus
gatgattgtgcctctagactttgct

SEQ ID NO: 365868 - DNA, 25 bp, Rattus norvegicus
gatgattgtgtcagtaggtggtcaa

SEQ ID NO: 365869 - DNA, 25 bp, Rattus norvegicus
gatgattgtgtctgtaggtggtcaa

SEQ ID NO: 365870 - DNA, 25 bp, Rattus norvegicus
gatgatttaaatagcgcctctcttg

SEQ ID NO: 365871 - DNA, 25 bp, Rattus norvegicus
gatgatttaaattgcgcctctcttg

SEQ ID NO: 365872 - DNA, 25 bp, Rattus norvegicus
gatgatttacccactggaactgtat

SEQ ID NO: 365873 - DNA, 25 bp, Rattus norvegicus
gatgatttaccctctggaactgtat

SEQ ID NO: 365874 - DNA, 25 bp, Rattus norvegicus
gatgatttacctcactcagaagcag

SEQ ID NO: 365875 - DNA, 25 bp, Rattus norvegicus
gatgatttacctgactcagaagcag

SEQ ID NO: 365876 - DNA, 25 bp, Rattus norvegicus
gatgatttactgagtctgtttacaa

SEQ ID NO: 365877 - DNA, 25 bp, Rattus norvegicus
gatgatttactgtgtctgtttacaa

SEQ ID NO: 365878 - DNA, 25 bp, Rattus norvegicus
gatgatttcatccagtgtgtcatga

SEQ ID NO: 365879 - DNA, 25 bp, Rattus norvegicus
gatgatttcatcgagtgtgtcatga

SEQ ID NO: 365880 - DNA, 25 bp, Rattus norvegicus
gatgatttcattccacatggtggtg

SEQ ID NO: 365881 - DNA, 25 bp, Rattus norvegicus
gatgatttcattgcacatggtggtg

SEQ ID NO: 365882 - DNA, 25 bp, Rattus norvegicus
gatgatttctatctttggccaggat

SEQ ID NO: 365883 - DNA, 25 bp, Rattus norvegicus
gatgatttctatgtttggccaggat

SEQ ID NO: 365884 - DNA, 25 bp, Rattus norvegicus
gatgatttggctagagttctggaac

SEQ ID NO: 365885 - DNA, 25 bp, Rattus norvegicus
gatgatttggcttgagttctggaac

SEQ ID NO: 365886 - DNA, 25 bp, Rattus norvegicus
gatgatttggtgaaagtctctcctt

SEQ ID NO: 365887 - DNA, 25 bp, Rattus norvegicus
gatgatttggtgtaagtctctcctt

SEQ ID NO: 365888 - DNA, 25 bp, Rattus norvegicus
gatgatttgtgacccttgccggaca

SEQ ID NO: 365889 - DNA, 25 bp, Rattus norvegicus
gatgatttgtgagccttgccggaca

SEQ ID NO: 365890 - DNA, 25 bp, Rattus norvegicus
gatgattttatcacttatcttacta

SEQ ID NO: 365891 - DNA, 25 bp, Rattus norvegicus
gatgattttatctcttatcttacta

SEQ ID NO: 365892 - DNA, 25 bp, Rattus norvegicus
gatgattttctcaatagcttcaagg

SEQ ID NO: 365893 - DNA, 25 bp, Rattus norvegicus
gatgattttctctatagcttcaagg

SEQ ID NO: 365894 - DNA, 25 bp, Rattus norvegicus
gatgattttgagattcaaggctcct

SEQ ID NO: 365895 - DNA, 25 bp, Rattus norvegicus
gatgattttgagtttcaaggctcct

SEQ ID NO: 365896 - DNA, 25 bp, Rattus norvegicus
gatgattttgatcactccacttgca

SEQ ID NO: 365897 - DNA, 25 bp, Rattus norvegicus
gatgattttgatgactccacttgca

SEQ ID NO: 365898 - DNA, 25 bp, Rattus norvegicus
gatgattttgtgaagtgtcttactc

SEQ ID NO: 365899 - DNA, 25 bp, Rattus norvegicus
gatgattttgtgtagtgtcttactc

SEQ ID NO: 365900 - DNA, 25 bp, Rattus norvegicus
gatgatttttctcactttccaagca

SEQ ID NO: 365901 - DNA, 25 bp, Rattus norvegicus
gatgatttttctgactttccaagca

SEQ ID NO: 365902 - DNA, 25 bp, Rattus norvegicus
gatgcaaaaaacaacagtcctgggc

SEQ ID NO: 365903 - DNA, 25 bp, Rattus norvegicus
gatgcaaaaaactacagtcctgggc

SEQ ID NO: 365904 - DNA, 25 bp, Rattus norvegicus
gatgcaaaatctactcctaagcctt

SEQ ID NO: 365905 - DNA, 25 bp, Rattus norvegicus
gatgcaaaatcttctcctaagcctt

SEQ ID NO: 365906 - DNA, 25 bp, Rattus norvegicus
gatgcaaacgcccttcgatttctat

SEQ ID NO: 365907 - DNA, 25 bp, Rattus norvegicus
gatgcaaacgccgttcgatttctat

SEQ ID NO: 365908 - DNA, 25 bp, Rattus norvegicus
gatgcaaagaaaatgtagactacta

SEQ ID NO: 365909 - DNA, 25 bp, Rattus norvegicus
gatgcaaagaaattgtagactacta

SEQ ID NO: 365910 - DNA, 25 bp, Rattus norvegicus
gatgcaaagggcattccctccacag

SEQ ID NO: 365911 - DNA, 25 bp, Rattus norvegicus
gatgcaaagggctttccctccacag

SEQ ID NO: 365912 - DNA, 25 bp, Rattus norvegicus
gatgcaaatcggcttcccatttgaa

SEQ ID NO: 365913 - DNA, 25 bp, Rattus norvegicus
gatgcaaatcgggttcccatttgaa

SEQ ID NO: 365914 - DNA, 25 bp, Rattus norvegicus
gatgcaaatgctaagatgatgtaca

SEQ ID NO: 365915 - DNA, 25 bp, Rattus norvegicus
gatgcaaatgcttagatgatgtaca

SEQ ID NO: 365916 - DNA, 25 bp, Rattus norvegicus
gatgcaaattagatcttttctccaa

SEQ ID NO: 365917 - DNA, 25 bp, Rattus norvegicus
gatgcaaattagttcttttctccaa

SEQ ID NO: 365918 - DNA, 25 bp, Rattus norvegicus
gatgcaacagtcacgtcagcttgat

SEQ ID NO: 365919 - DNA, 25 bp, Rattus norvegicus
gatgcaacagtctcgtcagcttgat

SEQ ID NO: 365920 - DNA, 25 bp, Rattus norvegicus
gatgcaaccagacagtcgcctccaa

SEQ ID NO: 365921 - DNA, 25 bp, Rattus norvegicus
gatgcaaccagagagtcgcctccaa

SEQ ID NO: 365922 - DNA, 25 bp, Rattus norvegicus
gatgcaacgtggctcttttatttta

SEQ ID NO: 365923 - DNA, 25 bp, Rattus norvegicus
gatgcaacgtgggtcttttatttta

SEQ ID NO: 365924 - DNA, 25 bp, Rattus norvegicus
gatgcaactgacattgagtcaccct

SEQ ID NO: 365925 - DNA, 25 bp, Rattus norvegicus
gatgcaactgactttgagtcaccct

SEQ ID NO: 365926 - DNA, 25 bp, Rattus norvegicus
gatgcaacttcacaacctttccagc

SEQ ID NO: 365927 - DNA, 25 bp, Rattus norvegicus
gatgcaacttcagaacctttccagc

SEQ ID NO: 365928 - DNA, 25 bp, Rattus norvegicus
gatgcaagactgaggatagtgctct

SEQ ID NO: 365929 - DNA, 25 bp, Rattus norvegicus
gatgcaagactgtggatagtgctct

SEQ ID NO: 365930 - DNA, 25 bp, Rattus norvegicus
gatgcaagagtaaacccagtcaggt

SEQ ID NO: 365931 - DNA, 25 bp, Rattus norvegicus
gatgcaagagtatacccagtcaggt

SEQ ID NO: 365932 - DNA, 25 bp, Rattus norvegicus
gatgcaagattccatcacagccagg

SEQ ID NO: 365933 - DNA, 25 bp, Rattus norvegicus
gatgcaagattcgatcacagccagg

SEQ ID NO: 365934 - DNA, 25 bp, Rattus norvegicus
gatgcaagattgatcttctcactgc

SEQ ID NO: 365935 - DNA, 25 bp, Rattus norvegicus
gatgcaagattgttcttctcactgc

SEQ ID NO: 365936 - DNA, 25 bp, Rattus norvegicus
gatgcaagccatcaatatccgtagg

SEQ ID NO: 365937 - DNA, 25 bp, Rattus norvegicus
gatgcaagccatgaatatccgtagg

SEQ ID NO: 365938 - DNA, 25 bp, Rattus norvegicus
gatgcaagcccaacgtttagagcat

SEQ ID NO: 365939 - DNA, 25 bp, Rattus norvegicus
gatgcaagcccatcgtttagagcat

SEQ ID NO: 365940 - DNA, 25 bp, Rattus norvegicus
gatgcaagccttattcagttcaaga

SEQ ID NO: 365941 - DNA, 25 bp, Rattus norvegicus
gatgcaagcctttttcagttcaaga

SEQ ID NO: 365942 - DNA, 25 bp, Rattus norvegicus
gatgcaagcgaacgagatctactta

SEQ ID NO: 365943 - DNA, 25 bp, Rattus norvegicus
gatgcaagcgaaggagatctactta

SEQ ID NO: 365944 - DNA, 25 bp, Rattus norvegicus
gatgcaagctatcgctcacttcatg

SEQ ID NO: 365945 - DNA, 25 bp, Rattus norvegicus
gatgcaagctatggctcacttcatg

SEQ ID NO: 365946 - DNA, 25 bp, Rattus norvegicus
gatgcaaggagcactccaggctcaa

SEQ ID NO: 365947 - DNA, 25 bp, Rattus norvegicus
gatgcaaggagctctccaggctcaa

SEQ ID NO: 365948 - DNA, 25 bp, Rattus norvegicus
gatgcaaggcggaccccaaccatgg

SEQ ID NO: 365949 - DNA, 25 bp, Rattus norvegicus
gatgcaaggcggtccccaaccatgg

SEQ ID NO: 365950 - DNA, 25 bp, Rattus norvegicus
gatgcaaggctcacactggcagtgt

SEQ ID NO: 365951 - DNA, 25 bp, Rattus norvegicus
gatgcaaggctctcactggcagtgt

SEQ ID NO: 365952 - DNA, 25 bp, Rattus norvegicus
gatgcaatccggatcaaacgtggct

SEQ ID NO: 365953 - DNA, 25 bp, Rattus norvegicus
gatgcaatccggttcaaacgtggct

SEQ ID NO: 365954 - DNA, 25 bp, Rattus norvegicus
gatgcaatcctcagtttttgttcag

SEQ ID NO: 365955 - DNA, 25 bp, Rattus norvegicus
gatgcaatcctccttgctgaaggca

SEQ ID NO: 365956 - DNA, 25 bp, Rattus norvegicus
gatgcaatcctcgttgctgaaggca

SEQ ID NO: 365957 - DNA, 25 bp, Rattus norvegicus
gatgcaatcctctgtttttgttcag

SEQ ID NO: 365958 - DNA, 25 bp, Rattus norvegicus
gatgcaatcttacatattccttagg

SEQ ID NO: 365959 - DNA, 25 bp, Rattus norvegicus
gatgcaatcttagatattccttagg

SEQ ID NO: 365960 - DNA, 25 bp, Rattus norvegicus
gatgcaatggaaactatgctctatt

SEQ ID NO: 365961 - DNA, 25 bp, Rattus norvegicus
gatgcaatggaatctatgctctatt

SEQ ID NO: 365962 - DNA, 25 bp, Rattus norvegicus
gatgcaatggtcagggtcatgtaaa

SEQ ID NO: 365963 - DNA, 25 bp, Rattus norvegicus
gatgcaatggtctgggtcatgtaaa

SEQ ID NO: 365964 - DNA, 25 bp, Rattus norvegicus
gatgcaatgtgacttccatgcctgg

SEQ ID NO: 365965 - DNA, 25 bp, Rattus norvegicus
gatgcaatgtgagttccatgcctgg

SEQ ID NO: 365966 - DNA, 25 bp, Rattus norvegicus
gatgcaattggtactcgtgcattga

SEQ ID NO: 365967 - DNA, 25 bp, Rattus norvegicus
gatgcaattggttctcgtgcattga

SEQ ID NO: 365968 - DNA, 25 bp, Rattus norvegicus
gatgcacaaaacagactcccagcag

SEQ ID NO: 365969 - DNA, 25 bp, Rattus norvegicus
gatgcacaaaacagatgagcctggc

SEQ ID NO: 365970 - DNA, 25 bp, Rattus norvegicus
gatgcacaaaactgactcccagcag

SEQ ID NO: 365971 - DNA, 25 bp, Rattus norvegicus
gatgcacaaaactgatgagcctggc

SEQ ID NO: 365972 - DNA, 25 bp, Rattus norvegicus
gatgcacaagcaccaattatgacta

SEQ ID NO: 365973 - DNA, 25 bp, Rattus norvegicus
gatgcacaagcagcaattatgacta

SEQ ID NO: 365974 - DNA, 25 bp, Rattus norvegicus
gatgcacaagccattctacaggtct

SEQ ID NO: 365975 - DNA, 25 bp, Rattus norvegicus
gatgcacaagcctttctacaggtct

SEQ ID NO: 365976 - DNA, 25 bp, Rattus norvegicus
gatgcacacagacttatgggcggtt

SEQ ID NO: 365977 - DNA, 25 bp, Rattus norvegicus
gatgcacacagagttatgggcggtt

SEQ ID NO: 365978 - DNA, 25 bp, Rattus norvegicus
gatgcacaccgtactataacagaaa

SEQ ID NO: 365979 - DNA, 25 bp, Rattus norvegicus
gatgcacaccgttctataacagaaa

SEQ ID NO: 365980 - DNA, 25 bp, Rattus norvegicus
gatgcacacgatacccatttctatc

SEQ ID NO: 365981 - DNA, 25 bp, Rattus norvegicus
gatgcacacgattcccatttctatc

SEQ ID NO: 365982 - DNA, 25 bp, Rattus norvegicus
gatgcacactaacgttccaaacgga

SEQ ID NO: 365983 - DNA, 25 bp, Rattus norvegicus
gatgcacactaaggttccaaacgga

SEQ ID NO: 365984 - DNA, 25 bp, Rattus norvegicus
gatgcacacttcactgttgtcctag

SEQ ID NO: 365985 - DNA, 25 bp, Rattus norvegicus
gatgcacacttctctgttgtcctag

SEQ ID NO: 365986 - DNA, 25 bp, Rattus norvegicus
gatgcacagataccaagtccaccaa

SEQ ID NO: 365987 - DNA, 25 bp, Rattus norvegicus
gatgcacagatagcaagtccaccaa

SEQ ID NO: 365988 - DNA, 25 bp, Rattus norvegicus
gatgcacagcaaaactcacgggcag

SEQ ID NO: 365989 - DNA, 25 bp, Rattus norvegicus
gatgcacagcaatactcacgggcag

SEQ ID NO: 365990 - DNA, 25 bp, Rattus norvegicus
gatgcacagctcactatagctggct

SEQ ID NO: 365991 - DNA, 25 bp, Rattus norvegicus
gatgcacagctctctatagctggct

SEQ ID NO: 365992 - DNA, 25 bp, Rattus norvegicus
gatgcacataaaatcacacagccac

SEQ ID NO: 365993 - DNA, 25 bp, Rattus norvegicus
gatgcacataaattcacacagccac

SEQ ID NO: 365994 - DNA, 25 bp, Rattus norvegicus
gatgcacatcaaacaagagctgctg

SEQ ID NO: 365995 - DNA, 25 bp, Rattus norvegicus
gatgcacatcaatcaagagctgctg

SEQ ID NO: 365996 - DNA, 25 bp, Rattus norvegicus
gatgcacatcggagtcttcatcctg

SEQ ID NO: 365997 - DNA, 25 bp, Rattus norvegicus
gatgcacatcggtgtcttcatcctg

SEQ ID NO: 365998 - DNA, 25 bp, Rattus norvegicus
gatgcaccaccaacgatttcatgat

SEQ ID NO: 365999 - DNA, 25 bp, Rattus norvegicus
gatgcaccaccatcgatttcatgat

SEQ ID NO: 366000 - DNA, 25 bp, Rattus norvegicus
gatgcaccagcacactctgggcaga

SEQ ID NO: 366001 - DNA, 25 bp, Rattus norvegicus
gatgcaccagcagactctgggcaga

SEQ ID NO: 366002 - DNA, 25 bp, Rattus norvegicus
gatgcaccatccactgataggcaca

SEQ ID NO: 366003 - DNA, 25 bp, Rattus norvegicus
gatgcaccatccagatgtcattcag

SEQ ID NO: 366004 - DNA, 25 bp, Rattus norvegicus
gatgcaccatcctctgataggcaca

SEQ ID NO: 366005 - DNA, 25 bp, Rattus norvegicus
gatgcaccatcctgatgtcattcag

SEQ ID NO: 366006 - DNA, 25 bp, Rattus norvegicus
gatgcaccatttagctccagaaagc

SEQ ID NO: 366007 - DNA, 25 bp, Rattus norvegicus
gatgcaccattttgctccagaaagc

SEQ ID NO: 366008 - DNA, 25 bp, Rattus norvegicus
gatgcacccgtcattagaaccaaaa

SEQ ID NO: 366009 - DNA, 25 bp, Rattus norvegicus
gatgcacccgtctttagaaccaaaa

SEQ ID NO: 366010 - DNA, 25 bp, Rattus norvegicus
gatgcacctgctagggtaccttgga

SEQ ID NO: 366011 - DNA, 25 bp, Rattus norvegicus
gatgcacctgcttgggtaccttgga

SEQ ID NO: 366012 - DNA, 25 bp, Rattus norvegicus
gatgcaccttcaagtagaactgctt

SEQ ID NO: 366013 - DNA, 25 bp, Rattus norvegicus
gatgcaccttcatgtagaactgctt

SEQ ID NO: 366014 - DNA, 25 bp, Rattus norvegicus
gatgcacgtctaccgtgctgaggaa

SEQ ID NO: 366015 - DNA, 25 bp, Rattus norvegicus
gatgcacgtctagcgtgctgaggaa

SEQ ID NO: 366016 - DNA, 25 bp, Rattus norvegicus
gatgcactacctcatccgtgtggaa

SEQ ID NO: 366017 - DNA, 25 bp, Rattus norvegicus
gatgcactacctgatccgtgtggaa

SEQ ID NO: 366018 - DNA, 25 bp, Rattus norvegicus
gatgcactcgaacgtgatctcgaac

SEQ ID NO: 366019 - DNA, 25 bp, Rattus norvegicus
gatgcactcgaaggtgatctcgaac

SEQ ID NO: 366020 - DNA, 25 bp, Rattus norvegicus
gatgcactcgtccttggatttatca

SEQ ID NO: 366021 - DNA, 25 bp, Rattus norvegicus
gatgcactcgtcgttggatttatca

SEQ ID NO: 366022 - DNA, 25 bp, Rattus norvegicus
gatgcactcgttatattgtctgatt

SEQ ID NO: 366023 - DNA, 25 bp, Rattus norvegicus
gatgcactcgttttattgtctgatt

SEQ ID NO: 366024 - DNA, 25 bp, Rattus norvegicus
gatgcactgaacacggtcggtcctg

SEQ ID NO: 366025 - DNA, 25 bp, Rattus norvegicus
gatgcactgaactcggtcggtcctg

SEQ ID NO: 366026 - DNA, 25 bp, Rattus norvegicus
gatgcactgaagcttaatatgtaat

SEQ ID NO: 366027 - DNA, 25 bp, Rattus norvegicus
gatgcactgaaggttaatatgtaat

SEQ ID NO: 366028 - DNA, 25 bp, Rattus norvegicus
gatgcactgacacgatctccaggtt

SEQ ID NO: 366029 - DNA, 25 bp, Rattus norvegicus
gatgcactgacaggatctccaggtt

SEQ ID NO: 366030 - DNA, 25 bp, Rattus norvegicus
gatgcactgagcaccacaccagtaa

SEQ ID NO: 366031 - DNA, 25 bp, Rattus norvegicus
gatgcactgagctccacaccagtaa

SEQ ID NO: 366032 - DNA, 25 bp, Rattus norvegicus
gatgcactggaaagcacctgctgtc

SEQ ID NO: 366033 - DNA, 25 bp, Rattus norvegicus
gatgcactggaatgcacctgctgtc

SEQ ID NO: 366034 - DNA, 25 bp, Rattus norvegicus
gatgcactgtgtattctacatagtt

SEQ ID NO: 366035 - DNA, 25 bp, Rattus norvegicus
gatgcactgtgttttctacatagtt

SEQ ID NO: 366036 - DNA, 25 bp, Rattus norvegicus
gatgcactgttacaaactctcccat

SEQ ID NO: 366037 - DNA, 25 bp, Rattus norvegicus
gatgcactgttagaaactctcccat

SEQ ID NO: 366038 - DNA, 25 bp, Rattus norvegicus
gatgcactgttgatagcttcctgat

SEQ ID NO: 366039 - DNA, 25 bp, Rattus norvegicus
gatgcactgttgttagcttcctgat

SEQ ID NO: 366040 - DNA, 25 bp, Rattus norvegicus
gatgcacttccacacttgtgactgt

SEQ ID NO: 366041 - DNA, 25 bp, Rattus norvegicus
gatgcacttccagacttgtgactgt

SEQ ID NO: 366042 - DNA, 25 bp, Rattus norvegicus
gatgcacttctcatacgaacgtttc

SEQ ID NO: 366043 - DNA, 25 bp, Rattus norvegicus
gatgcacttctcttacgaacgtttc

SEQ ID NO: 366044 - DNA, 25 bp, Rattus norvegicus
gatgcacttctgaacaacagcctgc

SEQ ID NO: 366045 - DNA, 25 bp, Rattus norvegicus
gatgcacttctgtacaacagcctgc

SEQ ID NO: 366046 - DNA, 25 bp, Rattus norvegicus
gatgcactttgcacagtaatacttg

SEQ ID NO: 366047 - DNA, 25 bp, Rattus norvegicus
gatgcactttgctcagtaatacttg

SEQ ID NO: 366048 - DNA, 25 bp, Rattus norvegicus
gatgcagaaaacatggcttcctaag

SEQ ID NO: 366049 - DNA, 25 bp, Rattus norvegicus
gatgcagaaaacttggcttcctaag

SEQ ID NO: 366050 - DNA, 25 bp, Rattus norvegicus
gatgcagaaatccttcgaaccatga

SEQ ID NO: 366051 - DNA, 25 bp, Rattus norvegicus
gatgcagaaatcgttcgaaccatga

SEQ ID NO: 366052 - DNA, 25 bp, Rattus norvegicus
gatgcagaatctagggcctgttacc

SEQ ID NO: 366053 - DNA, 25 bp, Rattus norvegicus
gatgcagaatcttgggcctgttacc

SEQ ID NO: 366054 - DNA, 25 bp, Rattus norvegicus
gatgcagaattcatagttccttctc

SEQ ID NO: 366055 - DNA, 25 bp, Rattus norvegicus
gatgcagaattcttagttccttctc

SEQ ID NO: 366056 - DNA, 25 bp, Rattus norvegicus
gatgcagacaagctaacattacatg

SEQ ID NO: 366057 - DNA, 25 bp, Rattus norvegicus
gatgcagacaaggtaacattacatg

SEQ ID NO: 366058 - DNA, 25 bp, Rattus norvegicus
gatgcagacacacccgaacttgcca

SEQ ID NO: 366059 - DNA, 25 bp, Rattus norvegicus
gatgcagacacagccgaacttgcca

SEQ ID NO: 366060 - DNA, 25 bp, Rattus norvegicus
gatgcagacagaatccaacacctta

SEQ ID NO: 366061 - DNA, 25 bp, Rattus norvegicus
gatgcagacagattccaacacctta

SEQ ID NO: 366062 - DNA, 25 bp, Rattus norvegicus
gatgcagacagtagggatccacccc

SEQ ID NO: 366063 - DNA, 25 bp, Rattus norvegicus
gatgcagacagttgggatccacccc

SEQ ID NO: 366064 - DNA, 25 bp, Rattus norvegicus
gatgcagacctaaactgaggccctg

SEQ ID NO: 366065 - DNA, 25 bp, Rattus norvegicus
gatgcagacctatactgaggccctg

SEQ ID NO: 366066 - DNA, 25 bp, Rattus norvegicus
gatgcagagaccaatttcaactaca

SEQ ID NO: 366067 - DNA, 25 bp, Rattus norvegicus
gatgcagagacctatttcaactaca

SEQ ID NO: 366068 - DNA, 25 bp, Rattus norvegicus
gatgcagagaggctcagtcacttaa

SEQ ID NO: 366069 - DNA, 25 bp, Rattus norvegicus
gatgcagagagggtcagtcacttaa

SEQ ID NO: 366070 - DNA, 25 bp, Rattus norvegicus
gatgcagagcccatgttctgcgtat

SEQ ID NO: 366071 - DNA, 25 bp, Rattus norvegicus
gatgcagagcccttgttctgcgtat

SEQ ID NO: 366072 - DNA, 25 bp, Rattus norvegicus
gatgcagagcttcggagcctacagc

SEQ ID NO: 366073 - DNA, 25 bp, Rattus norvegicus
gatgcagagcttgggagcctacagc

SEQ ID NO: 366074 - DNA, 25 bp, Rattus norvegicus
gatgcagagggcaacctgttgctca

SEQ ID NO: 366075 - DNA, 25 bp, Rattus norvegicus
gatgcagagggctacctgttgctca

SEQ ID NO: 366076 - DNA, 25 bp, Rattus norvegicus
gatgcagatcaaaccacctagaaaa

SEQ ID NO: 366077 - DNA, 25 bp, Rattus norvegicus
gatgcagatcaatccacctagaaaa

SEQ ID NO: 366078 - DNA, 25 bp, Rattus norvegicus
gatgcagatctaaatacaccacact

SEQ ID NO: 366079 - DNA, 25 bp, Rattus norvegicus
gatgcagatctatatacaccacact

SEQ ID NO: 366080 - DNA, 25 bp, Rattus norvegicus
gatgcagatgacactcctgtcctaa

SEQ ID NO: 366081 - DNA, 25 bp, Rattus norvegicus
gatgcagatgactctcctgtcctaa

SEQ ID NO: 366082 - DNA, 25 bp, Rattus norvegicus
gatgcagatgagacccagacatact

SEQ ID NO: 366083 - DNA, 25 bp, Rattus norvegicus
gatgcagatgagtcccagacatact

SEQ ID NO: 366084 - DNA, 25 bp, Rattus norvegicus
gatgcagatgccaggataaccagga

SEQ ID NO: 366085 - DNA, 25 bp, Rattus norvegicus
gatgcagatgcctggataaccagga

SEQ ID NO: 366086 - DNA, 25 bp, Rattus norvegicus
gatgcagatggacactgtgacacaa

SEQ ID NO: 366087 - DNA, 25 bp, Rattus norvegicus
gatgcagatggagactgtgacacaa

SEQ ID NO: 366088 - DNA, 25 bp, Rattus norvegicus
gatgcagatggcatcatccttaatg

SEQ ID NO: 366089 - DNA, 25 bp, Rattus norvegicus
gatgcagatggcttcatccttaatg

SEQ ID NO: 366090 - DNA, 25 bp, Rattus norvegicus
gatgcagatgttcagacccagagaa

SEQ ID NO: 366091 - DNA, 25 bp, Rattus norvegicus
gatgcagatgttgagacccagagaa

SEQ ID NO: 366092 - DNA, 25 bp, Rattus norvegicus
gatgcagcaactcacccagaactgt

SEQ ID NO: 366093 - DNA, 25 bp, Rattus norvegicus
gatgcagcaactgacccagaactgt

SEQ ID NO: 366094 - DNA, 25 bp, Rattus norvegicus
gatgcagcaagcagctcagcaggcc

SEQ ID NO: 366095 - DNA, 25 bp, Rattus norvegicus
gatgcagcaagctgctcagcaggcc

SEQ ID NO: 366096 - DNA, 25 bp, Rattus norvegicus
gatgcagcacccaccaaaagggcaa

SEQ ID NO: 366097 - DNA, 25 bp, Rattus norvegicus
gatgcagcaccctccaaaagggcaa

SEQ ID NO: 366098 - DNA, 25 bp, Rattus norvegicus
gatgcagcagcacaacccagagttc

SEQ ID NO: 366099 - DNA, 25 bp, Rattus norvegicus
gatgcagcagcagaacccagagttc

SEQ ID NO: 366100 - DNA, 25 bp, Rattus norvegicus
gatgcagcccaacaaagcttctgtt

SEQ ID NO: 366101 - DNA, 25 bp, Rattus norvegicus
gatgcagcccaagaaagcttctgtt

SEQ ID NO: 366102 - DNA, 25 bp, Rattus norvegicus
gatgcagccgcccagtcccatgatg

SEQ ID NO: 366103 - DNA, 25 bp, Rattus norvegicus
gatgcagccgccgagtcccatgatg

SEQ ID NO: 366104 - DNA, 25 bp, Rattus norvegicus
gatgcagccgttccaggcgaagttg

SEQ ID NO: 366105 - DNA, 25 bp, Rattus norvegicus
gatgcagccgttgcaggcgaagttg

SEQ ID NO: 366106 - DNA, 25 bp, Rattus norvegicus
gatgcagcctgaaggtatctggaaa

SEQ ID NO: 366107 - DNA, 25 bp, Rattus norvegicus
gatgcagcctgatggtatctggaaa

SEQ ID NO: 366108 - DNA, 25 bp, Rattus norvegicus
gatgcagccttcaggctattagatt

SEQ ID NO: 366109 - DNA, 25 bp, Rattus norvegicus
gatgcagccttctggctattagatt

SEQ ID NO: 366110 - DNA, 25 bp, Rattus norvegicus
gatgcagccttgatcatgtgacttg

SEQ ID NO: 366111 - DNA, 25 bp, Rattus norvegicus
gatgcagccttgttcatgtgacttg

SEQ ID NO: 366112 - DNA, 25 bp, Rattus norvegicus
gatgcagctagaccccagttaccaa

SEQ ID NO: 366113 - DNA, 25 bp, Rattus norvegicus
gatgcagctagagcccagttaccaa

SEQ ID NO: 366114 - DNA, 25 bp, Rattus norvegicus
gatgcagctggtaacaagtctttaa

SEQ ID NO: 366115 - DNA, 25 bp, Rattus norvegicus
gatgcagctggttacaagtctttaa

SEQ ID NO: 366116 - DNA, 25 bp, Rattus norvegicus
gatgcagctgtcctgttgacttcag

SEQ ID NO: 366117 - DNA, 25 bp, Rattus norvegicus
gatgcagctgtcgtgttgacttcag

SEQ ID NO: 366118 - DNA, 25 bp, Rattus norvegicus
gatgcagcttcacaggctaacaaca

SEQ ID NO: 366119 - DNA, 25 bp, Rattus norvegicus
gatgcagcttcagaggctaacaaca

SEQ ID NO: 366120 - DNA, 25 bp, Rattus norvegicus
gatgcagcttggaggaggccttatc

SEQ ID NO: 366121 - DNA, 25 bp, Rattus norvegicus
gatgcagcttggtggaggccttatc

SEQ ID NO: 366122 - DNA, 25 bp, Rattus norvegicus
gatgcaggaaagacacacccacacc

SEQ ID NO: 366123 - DNA, 25 bp, Rattus norvegicus
gatgcaggaaagtcacacccacacc

SEQ ID NO: 366124 - DNA, 25 bp, Rattus norvegicus
gatgcaggcaatattcaaagctctc

SEQ ID NO: 366125 - DNA, 25 bp, Rattus norvegicus
gatgcaggcaattttcaaagctctc

SEQ ID NO: 366126 - DNA, 25 bp, Rattus norvegicus
gatgcaggctgaacctgtagcctct

SEQ ID NO: 366127 - DNA, 25 bp, Rattus norvegicus
gatgcaggctgatcctgtagcctct

SEQ ID NO: 366128 - DNA, 25 bp, Rattus norvegicus
gatgcaggctgcagtattttaacca

SEQ ID NO: 366129 - DNA, 25 bp, Rattus norvegicus
gatgcaggctgcagtggtttacctc

SEQ ID NO: 366130 - DNA, 25 bp, Rattus norvegicus
gatgcaggctgctgtattttaacca

SEQ ID NO: 366131 - DNA, 25 bp, Rattus norvegicus
gatgcaggctgctgtggtttacctc

SEQ ID NO: 366132 - DNA, 25 bp, Rattus norvegicus
gatgcagggcctcgaccggcattac

SEQ ID NO: 366133 - DNA, 25 bp, Rattus norvegicus
gatgcagggcctggaccggcattac

SEQ ID NO: 366134 - DNA, 25 bp, Rattus norvegicus
gatgcaggtcccaatggtgccaatg

SEQ ID NO: 366135 - DNA, 25 bp, Rattus norvegicus
gatgcaggtccctatggtgccaatg

SEQ ID NO: 366136 - DNA, 25 bp, Rattus norvegicus
gatgcaggtcttcgctttatttttt

SEQ ID NO: 366137 - DNA, 25 bp, Rattus norvegicus
gatgcaggtcttggctttatttttt

SEQ ID NO: 366138 - DNA, 25 bp, Rattus norvegicus
gatgcaggtgaaacttctccagtcc

SEQ ID NO: 366139 - DNA, 25 bp, Rattus norvegicus
gatgcaggtgaatcttctccagtcc

SEQ ID NO: 366140 - DNA, 25 bp, Rattus norvegicus
gatgcaggtgcaagtatctacttct

SEQ ID NO: 366141 - DNA, 25 bp, Rattus norvegicus
gatgcaggtgcatgtatctacttct

SEQ ID NO: 366142 - DNA, 25 bp, Rattus norvegicus
gatgcaggtgtcatccttacagaga

SEQ ID NO: 366143 - DNA, 25 bp, Rattus norvegicus
gatgcaggtgtcttccttacagaga

SEQ ID NO: 366144 - DNA, 25 bp, Rattus norvegicus
gatgcaggttccagaaacgaattca

SEQ ID NO: 366145 - DNA, 25 bp, Rattus norvegicus
gatgcaggttcctgaaacgaattca

SEQ ID NO: 366146 - DNA, 25 bp, Rattus norvegicus
gatgcaggttggacccagatttctc

SEQ ID NO: 366147 - DNA, 25 bp, Rattus norvegicus
gatgcaggttggtcccagatttctc

SEQ ID NO: 366148 - DNA, 25 bp, Rattus norvegicus
gatgcagtacaccttcttctaaaaa

SEQ ID NO: 366149 - DNA, 25 bp, Rattus norvegicus
gatgcagtacacgttcttctaaaaa

SEQ ID NO: 366150 - DNA, 25 bp, Rattus norvegicus
gatgcagtcagcagctttagtgcct

SEQ ID NO: 366151 - DNA, 25 bp, Rattus norvegicus
gatgcagtcagctgctttagtgcct

SEQ ID NO: 366152 - DNA, 25 bp, Rattus norvegicus
gatgcagtcagtcctccagagccaa

SEQ ID NO: 366153 - DNA, 25 bp, Rattus norvegicus
gatgcagtcagtgctccagagccaa

SEQ ID NO: 366154 - DNA, 25 bp, Rattus norvegicus
gatgcagtcatcaatgtcgttgaca

SEQ ID NO: 366155 - DNA, 25 bp, Rattus norvegicus
gatgcagtcatctatgtcgttgaca

SEQ ID NO: 366156 - DNA, 25 bp, Rattus norvegicus
gatgcagtcccgaggctatgaagaa

SEQ ID NO: 366157 - DNA, 25 bp, Rattus norvegicus
gatgcagtcccgtggctatgaagaa

SEQ ID NO: 366158 - DNA, 25 bp, Rattus norvegicus
gatgcagtccggatctcagggaatc

SEQ ID NO: 366159 - DNA, 25 bp, Rattus norvegicus
gatgcagtccggttctcagggaatc

SEQ ID NO: 366160 - DNA, 25 bp, Rattus norvegicus
gatgcagtcctgagtgatactacat

SEQ ID NO: 366161 - DNA, 25 bp, Rattus norvegicus
gatgcagtcctgtgtgatactacat

SEQ ID NO: 366162 - DNA, 25 bp, Rattus norvegicus
gatgcagtcgccaagacaagaccag

SEQ ID NO: 366163 - DNA, 25 bp, Rattus norvegicus
gatgcagtcgcctagacaagaccag

SEQ ID NO: 366164 - DNA, 25 bp, Rattus norvegicus
gatgcagtcgcgctcacagcgctat

SEQ ID NO: 366165 - DNA, 25 bp, Rattus norvegicus
gatgcagtcgcggtcacagcgctat

SEQ ID NO: 366166 - DNA, 25 bp, Rattus norvegicus
gatgcagtctaaagtttcaggattc

SEQ ID NO: 366167 - DNA, 25 bp, Rattus norvegicus
gatgcagtctaatgtttcaggattc

SEQ ID NO: 366168 - DNA, 25 bp, Rattus norvegicus
gatgcagtcttcaggctcatggagc

SEQ ID NO: 366169 - DNA, 25 bp, Rattus norvegicus
gatgcagtcttctggctcatggagc

SEQ ID NO: 366170 - DNA, 25 bp, Rattus norvegicus
gatgcagtgcatcacagtgacgttt

SEQ ID NO: 366171 - DNA, 25 bp, Rattus norvegicus
gatgcagtgcatgacagtgacgttt

SEQ ID NO: 366172 - DNA, 25 bp, Rattus norvegicus
gatgcagtgcctacctgagctcata

SEQ ID NO: 366173 - DNA, 25 bp, Rattus norvegicus
gatgcagtgccttcctgagctcata

SEQ ID NO: 366174 - DNA, 25 bp, Rattus norvegicus
gatgcagtgcgaatccagtccaaaa

SEQ ID NO: 366175 - DNA, 25 bp, Rattus norvegicus
gatgcagtgcgattccagtccaaaa

SEQ ID NO: 366176 - DNA, 25 bp, Rattus norvegicus
gatgcagtgtcccagattcactctc

SEQ ID NO: 366177 - DNA, 25 bp, Rattus norvegicus
gatgcagtgtccgagattcactctc

SEQ ID NO: 366178 - DNA, 25 bp, Rattus norvegicus
gatgcagtgtgaaccttttccatta

SEQ ID NO: 366179 - DNA, 25 bp, Rattus norvegicus
gatgcagtgtgatccttttccatta

SEQ ID NO: 366180 - DNA, 25 bp, Rattus norvegicus
gatgcagttaagagattcccaaagt

SEQ ID NO: 366181 - DNA, 25 bp, Rattus norvegicus
gatgcagttaagtgattcccaaagt

SEQ ID NO: 366182 - DNA, 25 bp, Rattus norvegicus
gatgcagttaccaacattgcttcag

SEQ ID NO: 366183 - DNA, 25 bp, Rattus norvegicus
gatgcagttacctacattgcttcag

SEQ ID NO: 366184 - DNA, 25 bp, Rattus norvegicus
gatgcagttctgagcatgcctgcga

SEQ ID NO: 366185 - DNA, 25 bp, Rattus norvegicus
gatgcagttctgtgcatgcctgcga

SEQ ID NO: 366186 - DNA, 25 bp, Rattus norvegicus
gatgcagttcttagtcagtcttcac

SEQ ID NO: 366187 - DNA, 25 bp, Rattus norvegicus
gatgcagttctttgtcagtcttcac

SEQ ID NO: 366188 - DNA, 25 bp, Rattus norvegicus
gatgcagttgatcttttccttcaag

SEQ ID NO: 366189 - DNA, 25 bp, Rattus norvegicus
gatgcagttgatgttttccttcaag

SEQ ID NO: 366190 - DNA, 25 bp, Rattus norvegicus
gatgcagtttctaagcattttgctt

SEQ ID NO: 366191 - DNA, 25 bp, Rattus norvegicus
gatgcagtttcttagcattttgctt

SEQ ID NO: 366192 - DNA, 25 bp, Rattus norvegicus
gatgcagtttgaccacaacgctggc

SEQ ID NO: 366193 - DNA, 25 bp, Rattus norvegicus
gatgcagtttgacctgatcccggag

SEQ ID NO: 366194 - DNA, 25 bp, Rattus norvegicus
gatgcagtttgagcacaacgctggc

SEQ ID NO: 366195 - DNA, 25 bp, Rattus norvegicus
gatgcagtttgagctgatcccggag

SEQ ID NO: 366196 - DNA, 25 bp, Rattus norvegicus
gatgcagttttccagcaggattcct

SEQ ID NO: 366197 - DNA, 25 bp, Rattus norvegicus
gatgcagttttcgagcaggattcct

SEQ ID NO: 366198 - DNA, 25 bp, Rattus norvegicus
gatgcataacatccgaacaccatct

SEQ ID NO: 366199 - DNA, 25 bp, Rattus norvegicus
gatgcataacatgcgaacaccatct

SEQ ID NO: 366200 - DNA, 25 bp, Rattus norvegicus
gatgcatacagtacagtgactccca

SEQ ID NO: 366201 - DNA, 25 bp, Rattus norvegicus
gatgcatacagttcagtgactccca

SEQ ID NO: 366202 - DNA, 25 bp, Rattus norvegicus
gatgcatacattcgcacctgttgta

SEQ ID NO: 366203 - DNA, 25 bp, Rattus norvegicus
gatgcatacattggcacctgttgta

SEQ ID NO: 366204 - DNA, 25 bp, Rattus norvegicus
gatgcatagttgagatacccacata

SEQ ID NO: 366205 - DNA, 25 bp, Rattus norvegicus
gatgcatagttgtgatacccacata

SEQ ID NO: 366206 - DNA, 25 bp, Rattus norvegicus
gatgcatatgccattggccaacact

SEQ ID NO: 366207 - DNA, 25 bp, Rattus norvegicus
gatgcatatgcctttggccaacact

SEQ ID NO: 366208 - DNA, 25 bp, Rattus norvegicus
gatgcatatgctaatatcccttgga

SEQ ID NO: 366209 - DNA, 25 bp, Rattus norvegicus
gatgcatatgcttatatcccttgga

SEQ ID NO: 366210 - DNA, 25 bp, Rattus norvegicus
gatgcatattgtcttactagaatcc

SEQ ID NO: 366211 - DNA, 25 bp, Rattus norvegicus
gatgcatattgtgttactagaatcc

SEQ ID NO: 366212 - DNA, 25 bp, Rattus norvegicus
gatgcatcaactagacagctggttg

SEQ ID NO: 366213 - DNA, 25 bp, Rattus norvegicus
gatgcatcaacttgacagctggttg

SEQ ID NO: 366214 - DNA, 25 bp, Rattus norvegicus
gatgcatcagatatgcgttctacac

SEQ ID NO: 366215 - DNA, 25 bp, Rattus norvegicus
gatgcatcagatttgcgttctacac

SEQ ID NO: 366216 - DNA, 25 bp, Rattus norvegicus
gatgcatccaaccttgtagtcttga

SEQ ID NO: 366217 - DNA, 25 bp, Rattus norvegicus
gatgcatccaacgttgtagtcttga

SEQ ID NO: 366218 - DNA, 25 bp, Rattus norvegicus
gatgcatccctcacacaattaaaaa

SEQ ID NO: 366219 - DNA, 25 bp, Rattus norvegicus
gatgcatccctctcacaattaaaaa

SEQ ID NO: 366220 - DNA, 25 bp, Rattus norvegicus
gatgcatccctgatgctcttgaatg

SEQ ID NO: 366221 - DNA, 25 bp, Rattus norvegicus
gatgcatccctgcagcacttgaaga

SEQ ID NO: 366222 - DNA, 25 bp, Rattus norvegicus
gatgcatccctggagcacttgaaga

SEQ ID NO: 366223 - DNA, 25 bp, Rattus norvegicus
gatgcatccctgttgctcttgaatg

SEQ ID NO: 366224 - DNA, 25 bp, Rattus norvegicus
gatgcatcccttaccactaaggagt

SEQ ID NO: 366225 - DNA, 25 bp, Rattus norvegicus
gatgcatccctttccactaaggagt

SEQ ID NO: 366226 - DNA, 25 bp, Rattus norvegicus
gatgcatctcagagacccagggcag

SEQ ID NO: 366227 - DNA, 25 bp, Rattus norvegicus
gatgcatctcagtgacccagggcag

SEQ ID NO: 366228 - DNA, 25 bp, Rattus norvegicus
gatgcatctcatattttatttctaa

SEQ ID NO: 366229 - DNA, 25 bp, Rattus norvegicus
gatgcatctcattttttatttctaa

SEQ ID NO: 366230 - DNA, 25 bp, Rattus norvegicus
gatgcatctccacccagtgattgtg

SEQ ID NO: 366231 - DNA, 25 bp, Rattus norvegicus
gatgcatctccagccagtgattgtg

SEQ ID NO: 366232 - DNA, 25 bp, Rattus norvegicus
gatgcatctctcaatatctgtacca

SEQ ID NO: 366233 - DNA, 25 bp, Rattus norvegicus
gatgcatctctctatatctgtacca

SEQ ID NO: 366234 - DNA, 25 bp, Rattus norvegicus
gatgcatctgagctacatgcagcct

SEQ ID NO: 366235 - DNA, 25 bp, Rattus norvegicus
gatgcatctgaggtacatgcagcct

SEQ ID NO: 366236 - DNA, 25 bp, Rattus norvegicus
gatgcatctgccctcagggtagata

SEQ ID NO: 366237 - DNA, 25 bp, Rattus norvegicus
gatgcatctgccgtcagggtagata

SEQ ID NO: 366238 - DNA, 25 bp, Rattus norvegicus
gatgcatcttttcttcgtactggtt

SEQ ID NO: 366239 - DNA, 25 bp, Rattus norvegicus
gatgcatcttttgttcgtactggtt

SEQ ID NO: 366240 - DNA, 25 bp, Rattus norvegicus
gatgcatgacttcttccaacaggac

SEQ ID NO: 366241 - DNA, 25 bp, Rattus norvegicus
gatgcatgacttgttccaacaggac

SEQ ID NO: 366242 - DNA, 25 bp, Rattus norvegicus
gatgcatggatgagggctttacaaa

SEQ ID NO: 366243 - DNA, 25 bp, Rattus norvegicus
gatgcatggatgtgggctttacaaa

SEQ ID NO: 366244 - DNA, 25 bp, Rattus norvegicus
gatgcatgtactagtgttctgtgta

SEQ ID NO: 366245 - DNA, 25 bp, Rattus norvegicus
gatgcatgtacttgtgttctgtgta

SEQ ID NO: 366246 - DNA, 25 bp, Rattus norvegicus
gatgcatgtagcagtgtgactagac

SEQ ID NO: 366247 - DNA, 25 bp, Rattus norvegicus
gatgcatgtagctgtgtgactagac

SEQ ID NO: 366248 - DNA, 25 bp, Rattus norvegicus
gatgcatgtatccaagtctcagccc

SEQ ID NO: 366249 - DNA, 25 bp, Rattus norvegicus
gatgcatgtatcgaagtctcagccc

SEQ ID NO: 366250 - DNA, 25 bp, Rattus norvegicus
gatgcatgtatgatcttccagactg

SEQ ID NO: 366251 - DNA, 25 bp, Rattus norvegicus
gatgcatgtatgttcttccagactg

SEQ ID NO: 366252 - DNA, 25 bp, Rattus norvegicus
gatgcatgtgtcagtgcactggtca

SEQ ID NO: 366253 - DNA, 25 bp, Rattus norvegicus
gatgcatgtgtctgtgcactggtca

SEQ ID NO: 366254 - DNA, 25 bp, Rattus norvegicus
gatgcattaacacggcaaggtgcct

SEQ ID NO: 366255 - DNA, 25 bp, Rattus norvegicus
gatgcattaacagggcaaggtgcct

SEQ ID NO: 366256 - DNA, 25 bp, Rattus norvegicus
gatgcattacacataagcaggcaaa

SEQ ID NO: 366257 - DNA, 25 bp, Rattus norvegicus
gatgcattacacttaagcaggcaaa

SEQ ID NO: 366258 - DNA, 25 bp, Rattus norvegicus
gatgcattcagtcggcttttctggc

SEQ ID NO: 366259 - DNA, 25 bp, Rattus norvegicus
gatgcattcagtgggcttttctggc

SEQ ID NO: 366260 - DNA, 25 bp, Rattus norvegicus
gatgcattcatcacttcaggacaag

SEQ ID NO: 366261 - DNA, 25 bp, Rattus norvegicus
gatgcattcatctcttcaggacaag

SEQ ID NO: 366262 - DNA, 25 bp, Rattus norvegicus
gatgcattccagctatacacaacat

SEQ ID NO: 366263 - DNA, 25 bp, Rattus norvegicus
gatgcattccaggtatacacaacat

SEQ ID NO: 366264 - DNA, 25 bp, Rattus norvegicus
gatgcattcgagagctcagtctcct

SEQ ID NO: 366265 - DNA, 25 bp, Rattus norvegicus
gatgcattcgagtgctcagtctcct

SEQ ID NO: 366266 - DNA, 25 bp, Rattus norvegicus
gatgcattctttaggcacactgatg

SEQ ID NO: 366267 - DNA, 25 bp, Rattus norvegicus
gatgcattcttttggcacactgatg

SEQ ID NO: 366268 - DNA, 25 bp, Rattus norvegicus
gatgcattgaccaatgatgatgtac

SEQ ID NO: 366269 - DNA, 25 bp, Rattus norvegicus
gatgcattgacctatgatgatgtac

SEQ ID NO: 366270 - DNA, 25 bp, Rattus norvegicus
gatgcattgactatcatttccctct

SEQ ID NO: 366271 - DNA, 25 bp, Rattus norvegicus
gatgcattgactttcatttccctct

SEQ ID NO: 366272 - DNA, 25 bp, Rattus norvegicus
gatgcattggttatcttacctccga

SEQ ID NO: 366273 - DNA, 25 bp, Rattus norvegicus
gatgcattggttttcttacctccga

SEQ ID NO: 366274 - DNA, 25 bp, Rattus norvegicus
gatgcattgttaacacccaaggccc

SEQ ID NO: 366275 - DNA, 25 bp, Rattus norvegicus
gatgcattgttatcacccaaggccc

SEQ ID NO: 366276 - DNA, 25 bp, Rattus norvegicus
gatgcatttatcaccttattcctaa

SEQ ID NO: 366277 - DNA, 25 bp, Rattus norvegicus
gatgcatttatctccttattcctaa

SEQ ID NO: 366278 - DNA, 25 bp, Rattus norvegicus
gatgcatttccactttacgttcaaa

SEQ ID NO: 366279 - DNA, 25 bp, Rattus norvegicus
gatgcatttccagtttacgttcaaa

SEQ ID NO: 366280 - DNA, 25 bp, Rattus norvegicus
gatgcatttctgcactgacgtggaa

SEQ ID NO: 366281 - DNA, 25 bp, Rattus norvegicus
gatgcatttctggactgacgtggaa

SEQ ID NO: 366282 - DNA, 25 bp, Rattus norvegicus
gatgcatttgagactggtttttctg

SEQ ID NO: 366283 - DNA, 25 bp, Rattus norvegicus
gatgcatttgagtctggtttttctg

SEQ ID NO: 366284 - DNA, 25 bp, Rattus norvegicus
gatgcatttgcacacttcaagatgg

SEQ ID NO: 366285 - DNA, 25 bp, Rattus norvegicus
gatgcatttgcagacttcaagatgg

SEQ ID NO: 366286 - DNA, 25 bp, Rattus norvegicus
gatgcatttgtgaaactccttgact

SEQ ID NO: 366287 - DNA, 25 bp, Rattus norvegicus
gatgcatttgtgtaactccttgact

SEQ ID NO: 366288 - DNA, 25 bp, Rattus norvegicus
gatgcattttatcagtttctcatag

SEQ ID NO: 366289 - DNA, 25 bp, Rattus norvegicus
gatgcattttatctcattggctgtc

SEQ ID NO: 366290 - DNA, 25 bp, Rattus norvegicus
gatgcattttatgagtttctcatag

SEQ ID NO: 366291 - DNA, 25 bp, Rattus norvegicus
gatgcattttatgtcattggctgtc

SEQ ID NO: 366292 - DNA, 25 bp, Rattus norvegicus
gatgcattttccactgttgagataa

SEQ ID NO: 366293 - DNA, 25 bp, Rattus norvegicus
gatgcattttcctctgttgagataa

SEQ ID NO: 366294 - DNA, 25 bp, Rattus norvegicus
gatgccaaacatctactcctgtgaa

SEQ ID NO: 366295 - DNA, 25 bp, Rattus norvegicus
gatgccaaacatgtactcctgtgaa

SEQ ID NO: 366296 - DNA, 25 bp, Rattus norvegicus
gatgccaaagcacacgtttccttca

SEQ ID NO: 366297 - DNA, 25 bp, Rattus norvegicus
gatgccaaagcaccagaacgattga

SEQ ID NO: 366298 - DNA, 25 bp, Rattus norvegicus
gatgccaaagcagacgtttccttca

SEQ ID NO: 366299 - DNA, 25 bp, Rattus norvegicus
gatgccaaagcagcagaacgattga

SEQ ID NO: 366300 - DNA, 25 bp, Rattus norvegicus
gatgccaaaggtccccattaaaatt

SEQ ID NO: 366301 - DNA, 25 bp, Rattus norvegicus
gatgccaaaggtgcccattaaaatt

SEQ ID NO: 366302 - DNA, 25 bp, Rattus norvegicus
gatgccaaagtgcatagggccctag

SEQ ID NO: 366303 - DNA, 25 bp, Rattus norvegicus
gatgccaaagtggatagggccctag

SEQ ID NO: 366304 - DNA, 25 bp, Rattus norvegicus
gatgccaacagacgactattcggag

SEQ ID NO: 366305 - DNA, 25 bp, Rattus norvegicus
gatgccaacagaggactattcggag

SEQ ID NO: 366306 - DNA, 25 bp, Rattus norvegicus
gatgccaacatcagagcttcctaag

SEQ ID NO: 366307 - DNA, 25 bp, Rattus norvegicus
gatgccaacatctgagcttcctaag

SEQ ID NO: 366308 - DNA, 25 bp, Rattus norvegicus
gatgccaacatgcatctggttactg

SEQ ID NO: 366309 - DNA, 25 bp, Rattus norvegicus
gatgccaacatggatctggttactg

SEQ ID NO: 366310 - DNA, 25 bp, Rattus norvegicus
gatgccaaccatcactagcgcaatt

SEQ ID NO: 366311 - DNA, 25 bp, Rattus norvegicus
gatgccaaccatgactagcgcaatt

SEQ ID NO: 366312 - DNA, 25 bp, Rattus norvegicus
gatgccaacggcaatggcttcgcca

SEQ ID NO: 366313 - DNA, 25 bp, Rattus norvegicus
gatgccaacggctatggcttcgcca

SEQ ID NO: 366314 - DNA, 25 bp, Rattus norvegicus
gatgccaactatatgccttttagct

SEQ ID NO: 366315 - DNA, 25 bp, Rattus norvegicus
gatgccaactatttgccttttagct

SEQ ID NO: 366316 - DNA, 25 bp, Rattus norvegicus
gatgccaactcaagccctaaatagc

SEQ ID NO: 366317 - DNA, 25 bp, Rattus norvegicus
gatgccaactcatgccctaaatagc

SEQ ID NO: 366318 - DNA, 25 bp, Rattus norvegicus
gatgccaagatcctgaatgacgtgc

SEQ ID NO: 366319 - DNA, 25 bp, Rattus norvegicus
gatgccaagatcgtgaatgacgtgc

SEQ ID NO: 366320 - DNA, 25 bp, Rattus norvegicus
gatgccaagcagacacctgagtgca

SEQ ID NO: 366321 - DNA, 25 bp, Rattus norvegicus
gatgccaagcagtcacctgagtgca

SEQ ID NO: 366322 - DNA, 25 bp, Rattus norvegicus
gatgccaaggccaccataggtcaga

SEQ ID NO: 366323 - DNA, 25 bp, Rattus norvegicus
gatgccaaggcctccataggtcaga

SEQ ID NO: 366324 - DNA, 25 bp, Rattus norvegicus
gatgccaagggccatgctgttctgc

SEQ ID NO: 366325 - DNA, 25 bp, Rattus norvegicus
gatgccaagggcgatgctgttctgc

SEQ ID NO: 366326 - DNA, 25 bp, Rattus norvegicus
gatgccaagggtattctggacccaa

SEQ ID NO: 366327 - DNA, 25 bp, Rattus norvegicus
gatgccaagggttttctggacccaa

SEQ ID NO: 366328 - DNA, 25 bp, Rattus norvegicus
gatgccaagtccagagcgcttagaa

SEQ ID NO: 366329 - DNA, 25 bp, Rattus norvegicus
gatgccaagtcctgagcgcttagaa

SEQ ID NO: 366330 - DNA, 25 bp, Rattus norvegicus
gatgccaagtgtcctactgtgtcaa

SEQ ID NO: 366331 - DNA, 25 bp, Rattus norvegicus
gatgccaagtgtgctactgtgtcaa

SEQ ID NO: 366332 - DNA, 25 bp, Rattus norvegicus
gatgccaagttgatcagcctttcat

SEQ ID NO: 366333 - DNA, 25 bp, Rattus norvegicus
gatgccaagttgttcagcctttcat

SEQ ID NO: 366334 - DNA, 25 bp, Rattus norvegicus
gatgccaatcatactagcactatta

SEQ ID NO: 366335 - DNA, 25 bp, Rattus norvegicus
gatgccaatcattctagcactatta

SEQ ID NO: 366336 - DNA, 25 bp, Rattus norvegicus
gatgccaatccccaaagcgagcaag

SEQ ID NO: 366337 - DNA, 25 bp, Rattus norvegicus
gatgccaatcccgaaagcgagcaag

SEQ ID NO: 366338 - DNA, 25 bp, Rattus norvegicus
gatgccaatgctcctgcacacacaa

SEQ ID NO: 366339 - DNA, 25 bp, Rattus norvegicus
gatgccaatgctgctgcacacacaa

SEQ ID NO: 366340 - DNA, 25 bp, Rattus norvegicus
gatgccacagccaatgatgtgcctt

SEQ ID NO: 366341 - DNA, 25 bp, Rattus norvegicus
gatgccacagccacatttaatacta

SEQ ID NO: 366342 - DNA, 25 bp, Rattus norvegicus
gatgccacagcctatgatgtgcctt

SEQ ID NO: 366343 - DNA, 25 bp, Rattus norvegicus
gatgccacagcctcatttaatacta

SEQ ID NO: 366344 - DNA, 25 bp, Rattus norvegicus
gatgccacaggtcgctgttcgagct

SEQ ID NO: 366345 - DNA, 25 bp, Rattus norvegicus
gatgccacaggtggctgttcgagct

SEQ ID NO: 366346 - DNA, 25 bp, Rattus norvegicus
gatgccaccctgcagtttaggtgtc

SEQ ID NO: 366347 - DNA, 25 bp, Rattus norvegicus
gatgccaccctggagtttaggtgtc

SEQ ID NO: 366348 - DNA, 25 bp, Rattus norvegicus
gatgccacctggacactgatggagt

SEQ ID NO: 366349 - DNA, 25 bp, Rattus norvegicus
gatgccacctggtcactgatggagt

SEQ ID NO: 366350 - DNA, 25 bp, Rattus norvegicus
gatgccacctgtacctcagtaaaga

SEQ ID NO: 366351 - DNA, 25 bp, Rattus norvegicus
gatgccacctgttcctcagtaaaga

SEQ ID NO: 366352 - DNA, 25 bp, Rattus norvegicus
gatgccactgagaattaaatcgttg

SEQ ID NO: 366353 - DNA, 25 bp, Rattus norvegicus
gatgccactgagtattaaatcgttg

SEQ ID NO: 366354 - DNA, 25 bp, Rattus norvegicus
gatgccagaatgacttccttttcaa

SEQ ID NO: 366355 - DNA, 25 bp, Rattus norvegicus
gatgccagaatgtcttccttttcaa

SEQ ID NO: 366356 - DNA, 25 bp, Rattus norvegicus
gatgccagcagaagagaacaccatg

SEQ ID NO: 366357 - DNA, 25 bp, Rattus norvegicus
gatgccagcagatgagaacaccatg

SEQ ID NO: 366358 - DNA, 25 bp, Rattus norvegicus
gatgccagcctgaaagatttctctt

SEQ ID NO: 366359 - DNA, 25 bp, Rattus norvegicus
gatgccagcctgtaagatttctctt

SEQ ID NO: 366360 - DNA, 25 bp, Rattus norvegicus
gatgccagcttccaagaccaaactg

SEQ ID NO: 366361 - DNA, 25 bp, Rattus norvegicus
gatgccagcttcgaagaccaaactg

SEQ ID NO: 366362 - DNA, 25 bp, Rattus norvegicus
gatgccaggagtactttgtgcagct

SEQ ID NO: 366363 - DNA, 25 bp, Rattus norvegicus
gatgccaggagttctttgtgcagct

SEQ ID NO: 366364 - DNA, 25 bp, Rattus norvegicus
gatgccaggccgagtcagagcccag

SEQ ID NO: 366365 - DNA, 25 bp, Rattus norvegicus
gatgccaggccgtgtcagagcccag

SEQ ID NO: 366366 - DNA, 25 bp, Rattus norvegicus
gatgccaggctcaaacaagccaaag

SEQ ID NO: 366367 - DNA, 25 bp, Rattus norvegicus
gatgccaggctctaacaagccaaag

SEQ ID NO: 366368 - DNA, 25 bp, Rattus norvegicus
gatgccagtacaacagcactgtgtt

SEQ ID NO: 366369 - DNA, 25 bp, Rattus norvegicus
gatgccagtacatcagcactgtgtt

SEQ ID NO: 366370 - DNA, 25 bp, Rattus norvegicus
gatgccagtttcctactgcacggaa

SEQ ID NO: 366371 - DNA, 25 bp, Rattus norvegicus
gatgccagtttcgtactgcacggaa

SEQ ID NO: 366372 - DNA, 25 bp, Rattus norvegicus
gatgccataaatacctgtgtcacaa

SEQ ID NO: 366373 - DNA, 25 bp, Rattus norvegicus
gatgccataaattcctgtgtcacaa

SEQ ID NO: 366374 - DNA, 25 bp, Rattus norvegicus
gatgccataggcactagaacaggaa

SEQ ID NO: 366375 - DNA, 25 bp, Rattus norvegicus
gatgccataggctctagaacaggaa

SEQ ID NO: 366376 - DNA, 25 bp, Rattus norvegicus
gatgccatatccaggtgccagtctg

SEQ ID NO: 366377 - DNA, 25 bp, Rattus norvegicus
gatgccatatcctggtgccagtctg

SEQ ID NO: 366378 - DNA, 25 bp, Rattus norvegicus
gatgccatcaagattgataccggca

SEQ ID NO: 366379 - DNA, 25 bp, Rattus norvegicus
gatgccatcaagtttgataccggca

SEQ ID NO: 366380 - DNA, 25 bp, Rattus norvegicus
gatgccatcaatatccacgacaaga

SEQ ID NO: 366381 - DNA, 25 bp, Rattus norvegicus
gatgccatcaatttccacgacaaga

SEQ ID NO: 366382 - DNA, 25 bp, Rattus norvegicus
gatgccatcagacagatcccgttgg

SEQ ID NO: 366383 - DNA, 25 bp, Rattus norvegicus
gatgccatcagagagatcccgttgg

SEQ ID NO: 366384 - DNA, 25 bp, Rattus norvegicus
gatgccatcagccaatcactgagtg

SEQ ID NO: 366385 - DNA, 25 bp, Rattus norvegicus
gatgccatcagcgaatcactgagtg

SEQ ID NO: 366386 - DNA, 25 bp, Rattus norvegicus
gatgccatccagaggtttcttgttg

SEQ ID NO: 366387 - DNA, 25 bp, Rattus norvegicus
gatgccatccagtggtttcttgttg

SEQ ID NO: 366388 - DNA, 25 bp, Rattus norvegicus
gatgccatccggaagctggtgcagc

SEQ ID NO: 366389 - DNA, 25 bp, Rattus norvegicus
gatgccatccggtagctggtgcagc

SEQ ID NO: 366390 - DNA, 25 bp, Rattus norvegicus
gatgccatcctgaatgctctaggtc

SEQ ID NO: 366391 - DNA, 25 bp, Rattus norvegicus
gatgccatcctgtatgctctaggtc

SEQ ID NO: 366392 - DNA, 25 bp, Rattus norvegicus
gatgccatcgccaggtgtttattaa

SEQ ID NO: 366393 - DNA, 25 bp, Rattus norvegicus
gatgccatcgcctggtgtttattaa

SEQ ID NO: 366394 - DNA, 25 bp, Rattus norvegicus
gatgccatctgccagtacatgggcc

SEQ ID NO: 366395 - DNA, 25 bp, Rattus norvegicus
gatgccatctgcctgaatgttgacg

SEQ ID NO: 366396 - DNA, 25 bp, Rattus norvegicus
gatgccatctgcgagtacatgggcc

SEQ ID NO: 366397 - DNA, 25 bp, Rattus norvegicus
gatgccatctgcgtgaatgttgacg

SEQ ID NO: 366398 - DNA, 25 bp, Rattus norvegicus
gatgccatcttgctaaaactccagt

SEQ ID NO: 366399 - DNA, 25 bp, Rattus norvegicus
gatgccatcttggtaaaactccagt

SEQ ID NO: 366400 - DNA, 25 bp, Rattus norvegicus
gatgccatgaggatctacattgcca

SEQ ID NO: 366401 - DNA, 25 bp, Rattus norvegicus
gatgccatgaggttctacattgcca

SEQ ID NO: 366402 - DNA, 25 bp, Rattus norvegicus
gatgccatgccaattccagacaagg

SEQ ID NO: 366403 - DNA, 25 bp, Rattus norvegicus
gatgccatgccatttccagacaagg

SEQ ID NO: 366404 - DNA, 25 bp, Rattus norvegicus
gatgccatgcggaccttcatgatgc

SEQ ID NO: 366405 - DNA, 25 bp, Rattus norvegicus
gatgccatgcggtccttcatgatgc

SEQ ID NO: 366406 - DNA, 25 bp, Rattus norvegicus
gatgccatggtcattactgaggtac

SEQ ID NO: 366407 - DNA, 25 bp, Rattus norvegicus
gatgccatggtctttactgaggtac

SEQ ID NO: 366408 - DNA, 25 bp, Rattus norvegicus
gatgccatgtcacagatccgcaaag

SEQ ID NO: 366409 - DNA, 25 bp, Rattus norvegicus
gatgccatgtcagagatccgcaaag

SEQ ID NO: 366410 - DNA, 25 bp, Rattus norvegicus
gatgccatgtccctgttatacacag

SEQ ID NO: 366411 - DNA, 25 bp, Rattus norvegicus
gatgccatgtccgtgttatacacag

SEQ ID NO: 366412 - DNA, 25 bp, Rattus norvegicus
gatgccatgtgaccatctccctcag

SEQ ID NO: 366413 - DNA, 25 bp, Rattus norvegicus
gatgccatgtgagcatctccctcag

SEQ ID NO: 366414 - DNA, 25 bp, Rattus norvegicus
gatgccatgtgcctatgtgtttagt

SEQ ID NO: 366415 - DNA, 25 bp, Rattus norvegicus
gatgccatgtgcgtatgtgtttagt

SEQ ID NO: 366416 - DNA, 25 bp, Rattus norvegicus
gatgccatgtggctcagtgtatttt

SEQ ID NO: 366417 - DNA, 25 bp, Rattus norvegicus
gatgccatgtgggtcagtgtatttt

SEQ ID NO: 366418 - DNA, 25 bp, Rattus norvegicus
gatgccattactctgcaggcttgga

SEQ ID NO: 366419 - DNA, 25 bp, Rattus norvegicus
gatgccattactgtgcaggcttgga

SEQ ID NO: 366420 - DNA, 25 bp, Rattus norvegicus
gatgccattccacgttcaactgggt

SEQ ID NO: 366421 - DNA, 25 bp, Rattus norvegicus
gatgccattccaggttcaactgggt

SEQ ID NO: 366422 - DNA, 25 bp, Rattus norvegicus
gatgccattcctctgaagctaggtc

SEQ ID NO: 366423 - DNA, 25 bp, Rattus norvegicus
gatgccattcctgtgaagctaggtc

SEQ ID NO: 366424 - DNA, 25 bp, Rattus norvegicus
gatgccattctaagcttctgacaga

SEQ ID NO: 366425 - DNA, 25 bp, Rattus norvegicus
gatgccattctatgcttctgacaga

SEQ ID NO: 366426 - DNA, 25 bp, Rattus norvegicus
gatgccattgcaaaactcttgcgct

SEQ ID NO: 366427 - DNA, 25 bp, Rattus norvegicus
gatgccattgcataactcttgcgct

SEQ ID NO: 366428 - DNA, 25 bp, Rattus norvegicus
gatgccattgtcatttattccacta

SEQ ID NO: 366429 - DNA, 25 bp, Rattus norvegicus
gatgccattgtcttttattccacta

SEQ ID NO: 366430 - DNA, 25 bp, Rattus norvegicus
gatgccatttcactctgggactcag

SEQ ID NO: 366431 - DNA, 25 bp, Rattus norvegicus
gatgccatttcagtctgggactcag

SEQ ID NO: 366432 - DNA, 25 bp, Rattus norvegicus
gatgccattttaaatcactagtagg

SEQ ID NO: 366433 - DNA, 25 bp, Rattus norvegicus
gatgccattttatatcactagtagg

SEQ ID NO: 366434 - DNA, 25 bp, Rattus norvegicus
gatgcccaaagtcaagtcatccctt

SEQ ID NO: 366435 - DNA, 25 bp, Rattus norvegicus
gatgcccaaagtgaagtcatccctt

SEQ ID NO: 366436 - DNA, 25 bp, Rattus norvegicus
gatgcccaacataggttacgggagt

SEQ ID NO: 366437 - DNA, 25 bp, Rattus norvegicus
gatgcccaacatcttcaacttcatg

SEQ ID NO: 366438 - DNA, 25 bp, Rattus norvegicus
gatgcccaacatgttcaacttcatg

SEQ ID NO: 366439 - DNA, 25 bp, Rattus norvegicus
gatgcccaacattggttacgggagt

SEQ ID NO: 366440 - DNA, 25 bp, Rattus norvegicus
gatgcccaactaaaatcctatggtc

SEQ ID NO: 366441 - DNA, 25 bp, Rattus norvegicus
gatgcccaactataatcctatggtc

SEQ ID NO: 366442 - DNA, 25 bp, Rattus norvegicus
gatgcccaatgtctctcgtatttag

SEQ ID NO: 366443 - DNA, 25 bp, Rattus norvegicus
gatgcccaatgtgtctcgtatttag

SEQ ID NO: 366444 - DNA, 25 bp, Rattus norvegicus
gatgcccaccatagagagagtatct

SEQ ID NO: 366445 - DNA, 25 bp, Rattus norvegicus
gatgcccaccatctacactgagaag

SEQ ID NO: 366446 - DNA, 25 bp, Rattus norvegicus
gatgcccaccatgtacactgagaag

SEQ ID NO: 366447 - DNA, 25 bp, Rattus norvegicus
gatgcccaccattgagagagtatct

SEQ ID NO: 366448 - DNA, 25 bp, Rattus norvegicus
gatgcccacccactgtggaaatgga

SEQ ID NO: 366449 - DNA, 25 bp, Rattus norvegicus
gatgcccacccagtgtggaaatgga

SEQ ID NO: 366450 - DNA, 25 bp, Rattus norvegicus
gatgcccaccccagaagtaatttat

SEQ ID NO: 366451 - DNA, 25 bp, Rattus norvegicus
gatgcccaccccagtagaaaggcca

SEQ ID NO: 366452 - DNA, 25 bp, Rattus norvegicus
gatgcccacccctgaagtaatttat

SEQ ID NO: 366453 - DNA, 25 bp, Rattus norvegicus
gatgcccacccctgtagaaaggcca

SEQ ID NO: 366454 - DNA, 25 bp, Rattus norvegicus
gatgcccagaaaccttgcgcgcgga

SEQ ID NO: 366455 - DNA, 25 bp, Rattus norvegicus
gatgcccagaaagcttgcgcgcgga

SEQ ID NO: 366456 - DNA, 25 bp, Rattus norvegicus
gatgcccagctcacagacaaaggtg

SEQ ID NO: 366457 - DNA, 25 bp, Rattus norvegicus
gatgcccagctctcagacaaaggtg

SEQ ID NO: 366458 - DNA, 25 bp, Rattus norvegicus
gatgcccaggatagccataggttca

SEQ ID NO: 366459 - DNA, 25 bp, Rattus norvegicus
gatgcccaggattgccataggttca

SEQ ID NO: 366460 - DNA, 25 bp, Rattus norvegicus
gatgcccaggcaccacgagaattca

SEQ ID NO: 366461 - DNA, 25 bp, Rattus norvegicus
gatgcccaggcagcacgagaattca

SEQ ID NO: 366462 - DNA, 25 bp, Rattus norvegicus
gatgcccagggaatgaactctagtt

SEQ ID NO: 366463 - DNA, 25 bp, Rattus norvegicus
gatgcccagggattgaactctagtt

SEQ ID NO: 366464 - DNA, 25 bp, Rattus norvegicus
gatgcccagggcacaatttaggttg

SEQ ID NO: 366465 - DNA, 25 bp, Rattus norvegicus
gatgcccagggctcaatttaggttg

SEQ ID NO: 366466 - DNA, 25 bp, Rattus norvegicus
gatgcccagtatccctgtatgaggt

SEQ ID NO: 366467 - DNA, 25 bp, Rattus norvegicus
gatgcccagtatgcctgtatgaggt

SEQ ID NO: 366468 - DNA, 25 bp, Rattus norvegicus
gatgcccagtttaagatgcttacta

SEQ ID NO: 366469 - DNA, 25 bp, Rattus norvegicus
gatgcccagttttagatgcttacta

SEQ ID NO: 366470 - DNA, 25 bp, Rattus norvegicus
gatgcccatggaagaattctgtgtt

SEQ ID NO: 366471 - DNA, 25 bp, Rattus norvegicus
gatgcccatggatgaattctgtgtt

SEQ ID NO: 366472 - DNA, 25 bp, Rattus norvegicus
gatgcccatggtcctctagggaaca

SEQ ID NO: 366473 - DNA, 25 bp, Rattus norvegicus
gatgcccatggtgctctagggaaca

SEQ ID NO: 366474 - DNA, 25 bp, Rattus norvegicus
gatgcccatgtcagtagttctgtta

SEQ ID NO: 366475 - DNA, 25 bp, Rattus norvegicus
gatgcccatgtctgtagttctgtta

SEQ ID NO: 366476 - DNA, 25 bp, Rattus norvegicus
gatgcccatgttcaaagagtgcccc

SEQ ID NO: 366477 - DNA, 25 bp, Rattus norvegicus
gatgcccatgttgaaagagtgcccc

SEQ ID NO: 366478 - DNA, 25 bp, Rattus norvegicus
gatgccccactcacaggacagaagg

SEQ ID NO: 366479 - DNA, 25 bp, Rattus norvegicus
gatgccccactctcaggacagaagg

SEQ ID NO: 366480 - DNA, 25 bp, Rattus norvegicus
gatgccccagggattatgatcctgt

SEQ ID NO: 366481 - DNA, 25 bp, Rattus norvegicus
gatgccccagggtttatgatcctgt

SEQ ID NO: 366482 - DNA, 25 bp, Rattus norvegicus
gatgccccaggtcactcaggacaaa

SEQ ID NO: 366483 - DNA, 25 bp, Rattus norvegicus
gatgccccaggtgactcaggacaaa

SEQ ID NO: 366484 - DNA, 25 bp, Rattus norvegicus
gatgccccagtaatgtgtgctctat

SEQ ID NO: 366485 - DNA, 25 bp, Rattus norvegicus
gatgccccagtattgtgtgctctat

SEQ ID NO: 366486 - DNA, 25 bp, Rattus norvegicus
gatgccccatgtacatagccagttt

SEQ ID NO: 366487 - DNA, 25 bp, Rattus norvegicus
gatgccccatgttcatagccagttt

SEQ ID NO: 366488 - DNA, 25 bp, Rattus norvegicus
gatgccccggacagctaagaaggtt

SEQ ID NO: 366489 - DNA, 25 bp, Rattus norvegicus
gatgccccggactgctaagaaggtt

SEQ ID NO: 366490 - DNA, 25 bp, Rattus norvegicus
gatgccccggtactgtctttttgga

SEQ ID NO: 366491 - DNA, 25 bp, Rattus norvegicus
gatgccccggtagtgtctttttgga

SEQ ID NO: 366492 - DNA, 25 bp, Rattus norvegicus
gatgcccctgagactgatgcaagag

SEQ ID NO: 366493 - DNA, 25 bp, Rattus norvegicus
gatgcccctgagtctgatgcaagag

SEQ ID NO: 366494 - DNA, 25 bp, Rattus norvegicus
gatgcccctgcccattctttgagag

SEQ ID NO: 366495 - DNA, 25 bp, Rattus norvegicus
gatgcccctgccgattctttgagag

SEQ ID NO: 366496 - DNA, 25 bp, Rattus norvegicus
gatgcccctgctagaactatattga

SEQ ID NO: 366497 - DNA, 25 bp, Rattus norvegicus
gatgcccctgcttgaactatattga

SEQ ID NO: 366498 - DNA, 25 bp, Rattus norvegicus
gatgccccttttctacccaggagaa

SEQ ID NO: 366499 - DNA, 25 bp, Rattus norvegicus
gatgccccttttgtacccaggagaa

SEQ ID NO: 366500 - DNA, 25 bp, Rattus norvegicus
gatgcccgaaatcttcttccaaatg

SEQ ID NO: 366501 - DNA, 25 bp, Rattus norvegicus
gatgcccgaaatgttcttccaaatg

SEQ ID NO: 366502 - DNA, 25 bp, Rattus norvegicus
gatgcccgaggcatattcttctgga

SEQ ID NO: 366503 - DNA, 25 bp, Rattus norvegicus
gatgcccgaggcttattcttctgga

SEQ ID NO: 366504 - DNA, 25 bp, Rattus norvegicus
gatgcccggatgctggatcacctga

SEQ ID NO: 366505 - DNA, 25 bp, Rattus norvegicus
gatgcccggatggtggatcacctga

SEQ ID NO: 366506 - DNA, 25 bp, Rattus norvegicus
gatgcccgggatattgatattttct

SEQ ID NO: 366507 - DNA, 25 bp, Rattus norvegicus
gatgcccgggattttgatattttct

SEQ ID NO: 366508 - DNA, 25 bp, Rattus norvegicus
gatgcccgggccaccaatgatgaga

SEQ ID NO: 366509 - DNA, 25 bp, Rattus norvegicus
gatgcccgggcctccaatgatgaga

SEQ ID NO: 366510 - DNA, 25 bp, Rattus norvegicus
gatgcccgtgctcccgaggagtcag

SEQ ID NO: 366511 - DNA, 25 bp, Rattus norvegicus
gatgcccgtgctgccgaggagtcag

SEQ ID NO: 366512 - DNA, 25 bp, Rattus norvegicus
gatgcccgtggacaaagcggctctt

SEQ ID NO: 366513 - DNA, 25 bp, Rattus norvegicus
gatgcccgtggagaaagcggctctt

SEQ ID NO: 366514 - DNA, 25 bp, Rattus norvegicus
gatgccctaaacatgtgtagctcag

SEQ ID NO: 366515 - DNA, 25 bp, Rattus norvegicus
gatgccctaaacttgtgtagctcag

SEQ ID NO: 366516 - DNA, 25 bp, Rattus norvegicus
gatgccctagagactgatgccatga

SEQ ID NO: 366517 - DNA, 25 bp, Rattus norvegicus
gatgccctagagtctgatgccatga

SEQ ID NO: 366518 - DNA, 25 bp, Rattus norvegicus
gatgccctcatgcttgactatcatt

SEQ ID NO: 366519 - DNA, 25 bp, Rattus norvegicus
gatgccctcatggttgactatcatt

SEQ ID NO: 366520 - DNA, 25 bp, Rattus norvegicus
gatgccctccaaacatgtgctttaa

SEQ ID NO: 366521 - DNA, 25 bp, Rattus norvegicus
gatgccctccaatcatgtgctttaa

SEQ ID NO: 366522 - DNA, 25 bp, Rattus norvegicus
gatgccctcctgactgaatatggaa

SEQ ID NO: 366523 - DNA, 25 bp, Rattus norvegicus
gatgccctcctgtctgaatatggaa

SEQ ID NO: 366524 - DNA, 25 bp, Rattus norvegicus
gatgccctcggtaactttactaaag

SEQ ID NO: 366525 - DNA, 25 bp, Rattus norvegicus
gatgccctcggttactttactaaag

SEQ ID NO: 366526 - DNA, 25 bp, Rattus norvegicus
gatgccctctaccatgtttatctag

SEQ ID NO: 366527 - DNA, 25 bp, Rattus norvegicus
gatgccctctacgatgtttatctag

SEQ ID NO: 366528 - DNA, 25 bp, Rattus norvegicus
gatgccctctataagcagatcagct

SEQ ID NO: 366529 - DNA, 25 bp, Rattus norvegicus
gatgccctctattagcagatcagct

SEQ ID NO: 366530 - DNA, 25 bp, Rattus norvegicus
gatgccctctggaagtcctaaggtt

SEQ ID NO: 366531 - DNA, 25 bp, Rattus norvegicus
gatgccctctggtagtcctaaggtt

SEQ ID NO: 366532 - DNA, 25 bp, Rattus norvegicus
gatgccctgacccattggaaatgtt

SEQ ID NO: 366533 - DNA, 25 bp, Rattus norvegicus
gatgccctgaccgattggaaatgtt

SEQ ID NO: 366534 - DNA, 25 bp, Rattus norvegicus
gatgccctgaggaaacagaccctgg

SEQ ID NO: 366535 - DNA, 25 bp, Rattus norvegicus
gatgccctgaggtaacagaccctgg

SEQ ID NO: 366536 - DNA, 25 bp, Rattus norvegicus
gatgccctggaaattgaccgagccc

SEQ ID NO: 366537 - DNA, 25 bp, Rattus norvegicus
gatgccctggaatttgaccgagccc

SEQ ID NO: 366538 - DNA, 25 bp, Rattus norvegicus
gatgccctggagacatagtgtgcct

SEQ ID NO: 366539 - DNA, 25 bp, Rattus norvegicus
gatgccctggagtcatagtgtgcct

SEQ ID NO: 366540 - DNA, 25 bp, Rattus norvegicus
gatgccctggccatgccttgaaggc

SEQ ID NO: 366541 - DNA, 25 bp, Rattus norvegicus
gatgccctggccttgccttgaaggc

SEQ ID NO: 366542 - DNA, 25 bp, Rattus norvegicus
gatgccctggttattcagaacgctt

SEQ ID NO: 366543 - DNA, 25 bp, Rattus norvegicus
gatgccctggtttttcagaacgctt

SEQ ID NO: 366544 - DNA, 25 bp, Rattus norvegicus
gatgcccttcaacactctaaagatg

SEQ ID NO: 366545 - DNA, 25 bp, Rattus norvegicus
gatgcccttcaagactctaaagatg

SEQ ID NO: 366546 - DNA, 25 bp, Rattus norvegicus
gatgcccttcctagagacatgggat

SEQ ID NO: 366547 - DNA, 25 bp, Rattus norvegicus
gatgcccttccttgagacatgggat

SEQ ID NO: 366548 - DNA, 25 bp, Rattus norvegicus
gatgcccttcgcaagatgatcaact

SEQ ID NO: 366549 - DNA, 25 bp, Rattus norvegicus
gatgcccttcgctagatgatcaact

SEQ ID NO: 366550 - DNA, 25 bp, Rattus norvegicus
gatgcccttgttcggtaccaatgag

SEQ ID NO: 366551 - DNA, 25 bp, Rattus norvegicus
gatgcccttgttgggtaccaatgag

SEQ ID NO: 366552 - DNA, 25 bp, Rattus norvegicus
gatgccctttcaatgtatcagactt

SEQ ID NO: 366553 - DNA, 25 bp, Rattus norvegicus
gatgccctttcattgtatcagactt

SEQ ID NO: 366554 - DNA, 25 bp, Rattus norvegicus
gatgccctttctcacagaacactaa

SEQ ID NO: 366555 - DNA, 25 bp, Rattus norvegicus
gatgccctttctgacagaacactaa

SEQ ID NO: 366556 - DNA, 25 bp, Rattus norvegicus
gatgccctttgaagtgtgccacgta

SEQ ID NO: 366557 - DNA, 25 bp, Rattus norvegicus
gatgccctttgatgtgtgccacgta

SEQ ID NO: 366558 - DNA, 25 bp, Rattus norvegicus
gatgccgacattcaccatgaccagg

SEQ ID NO: 366559 - DNA, 25 bp, Rattus norvegicus
gatgccgacattgaccatgaccagg

SEQ ID NO: 366560 - DNA, 25 bp, Rattus norvegicus
gatgccgagctcctcagggacagct

SEQ ID NO: 366561 - DNA, 25 bp, Rattus norvegicus
gatgccgagctcgtcagggacagct

SEQ ID NO: 366562 - DNA, 25 bp, Rattus norvegicus
gatgccgaggatcctgtgcacacaa

SEQ ID NO: 366563 - DNA, 25 bp, Rattus norvegicus
gatgccgaggatgctgtgcacacaa

SEQ ID NO: 366564 - DNA, 25 bp, Rattus norvegicus
gatgccgatctaaatgagacttcat

SEQ ID NO: 366565 - DNA, 25 bp, Rattus norvegicus
gatgccgatctatatgagacttcat

SEQ ID NO: 366566 - DNA, 25 bp, Rattus norvegicus
gatgccgcaataagacccagatctc

SEQ ID NO: 366567 - DNA, 25 bp, Rattus norvegicus
gatgccgcaatatgacccagatctc

SEQ ID NO: 366568 - DNA, 25 bp, Rattus norvegicus
gatgccgcgaagagagttactccat

SEQ ID NO: 366569 - DNA, 25 bp, Rattus norvegicus
gatgccgcgaagtgagttactccat

SEQ ID NO: 366570 - DNA, 25 bp, Rattus norvegicus
gatgccgcggttaccggcgtcgaac

SEQ ID NO: 366571 - DNA, 25 bp, Rattus norvegicus
gatgccgcggtttccggcgtcgaac

SEQ ID NO: 366572 - DNA, 25 bp, Rattus norvegicus
gatgccgctaaacaaactggttgtt

SEQ ID NO: 366573 - DNA, 25 bp, Rattus norvegicus
gatgccgctaaagaaactggttgtt

SEQ ID NO: 366574 - DNA, 25 bp, Rattus norvegicus
gatgccggaacaccacttggtttta

SEQ ID NO: 366575 - DNA, 25 bp, Rattus norvegicus
gatgccggaacagcacttggtttta

SEQ ID NO: 366576 - DNA, 25 bp, Rattus norvegicus
gatgccggacgtactcagattgaac

SEQ ID NO: 366577 - DNA, 25 bp, Rattus norvegicus
gatgccggacgttctcagattgaac

SEQ ID NO: 366578 - DNA, 25 bp, Rattus norvegicus
gatgccggcatcctaacgaaccagg

SEQ ID NO: 366579 - DNA, 25 bp, Rattus norvegicus
gatgccggcatcgtaacgaaccagg

SEQ ID NO: 366580 - DNA, 25 bp, Rattus norvegicus
gatgccggcttgatttagtggattt

SEQ ID NO: 366581 - DNA, 25 bp, Rattus norvegicus
gatgccggcttgttttagtggattt

SEQ ID NO: 366582 - DNA, 25 bp, Rattus norvegicus
gatgccgtacgccaagcttgggtac

SEQ ID NO: 366583 - DNA, 25 bp, Rattus norvegicus
gatgccgtacgcgaagcttgggtac

SEQ ID NO: 366584 - DNA, 25 bp, Rattus norvegicus
gatgccgtatgtatagactgctgtt

SEQ ID NO: 366585 - DNA, 25 bp, Rattus norvegicus
gatgccgtatgtatctacatgtgta

SEQ ID NO: 366586 - DNA, 25 bp, Rattus norvegicus
gatgccgtatgtttagactgctgtt

SEQ ID NO: 366587 - DNA, 25 bp, Rattus norvegicus
gatgccgtatgtttctacatgtgta

SEQ ID NO: 366588 - DNA, 25 bp, Rattus norvegicus
gatgccgtcaagctggcgaccgtca

SEQ ID NO: 366589 - DNA, 25 bp, Rattus norvegicus
gatgccgtcaaggtggcgaccgtca

SEQ ID NO: 366590 - DNA, 25 bp, Rattus norvegicus
gatgccgtccagaaagtccctgaag

SEQ ID NO: 366591 - DNA, 25 bp, Rattus norvegicus
gatgccgtccagtaagtccctgaag

SEQ ID NO: 366592 - DNA, 25 bp, Rattus norvegicus
gatgccgtcttacgactgttcttag

SEQ ID NO: 366593 - DNA, 25 bp, Rattus norvegicus
gatgccgtcttaggactgttcttag

SEQ ID NO: 366594 - DNA, 25 bp, Rattus norvegicus
gatgccgtggctatgccaagtgtgc

SEQ ID NO: 366595 - DNA, 25 bp, Rattus norvegicus
gatgccgtggctttgccaagtgtgc

SEQ ID NO: 366596 - DNA, 25 bp, Rattus norvegicus
gatgccgttcaaccaaccataggct

SEQ ID NO: 366597 - DNA, 25 bp, Rattus norvegicus
gatgccgttcaagcaaccataggct

SEQ ID NO: 366598 - DNA, 25 bp, Rattus norvegicus
gatgccgttttccatgcctatcttt

SEQ ID NO: 366599 - DNA, 25 bp, Rattus norvegicus
gatgccgttttcgatgcctatcttt

SEQ ID NO: 366600 - DNA, 25 bp, Rattus norvegicus
gatgcctaaaccatatagttcaaaa

SEQ ID NO: 366601 - DNA, 25 bp, Rattus norvegicus
gatgcctaaaccttatagttcaaaa

SEQ ID NO: 366602 - DNA, 25 bp, Rattus norvegicus
gatgcctaagcaattcagggctggt

SEQ ID NO: 366603 - DNA, 25 bp, Rattus norvegicus
gatgcctaagcatttcagggctggt

SEQ ID NO: 366604 - DNA, 25 bp, Rattus norvegicus
gatgcctaatttagctaatgttatg

SEQ ID NO: 366605 - DNA, 25 bp, Rattus norvegicus
gatgcctaattttgctaatgttatg

SEQ ID NO: 366606 - DNA, 25 bp, Rattus norvegicus
gatgcctacaatacaaagagtcctg

SEQ ID NO: 366607 - DNA, 25 bp, Rattus norvegicus
gatgcctacaattcaaagagtcctg

SEQ ID NO: 366608 - DNA, 25 bp, Rattus norvegicus
gatgcctacattactctggagtcac

SEQ ID NO: 366609 - DNA, 25 bp, Rattus norvegicus
gatgcctacatttctctggagtcac

SEQ ID NO: 366610 - DNA, 25 bp, Rattus norvegicus
gatgcctactccaactctgacaagt

SEQ ID NO: 366611 - DNA, 25 bp, Rattus norvegicus
gatgcctactcctactctgacaagt

SEQ ID NO: 366612 - DNA, 25 bp, Rattus norvegicus
gatgcctactgacgaacgctttgcc

SEQ ID NO: 366613 - DNA, 25 bp, Rattus norvegicus
gatgcctactgaggaacgctttgcc

SEQ ID NO: 366614 - DNA, 25 bp, Rattus norvegicus
gatgcctacttaaaacctattggga

SEQ ID NO: 366615 - DNA, 25 bp, Rattus norvegicus
gatgcctacttataacctattggga

SEQ ID NO: 366616 - DNA, 25 bp, Rattus norvegicus
gatgcctagagtagaaagcactata

SEQ ID NO: 366617 - DNA, 25 bp, Rattus norvegicus
gatgcctagagttgaaagcactata

SEQ ID NO: 366618 - DNA, 25 bp, Rattus norvegicus
gatgcctaggctcaattggaaactg

SEQ ID NO: 366619 - DNA, 25 bp, Rattus norvegicus
gatgcctaggctgaattggaaactg

SEQ ID NO: 366620 - DNA, 25 bp, Rattus norvegicus
gatgcctatgctaatgggtccggct

SEQ ID NO: 366621 - DNA, 25 bp, Rattus norvegicus
gatgcctatgcttatgggtccggct

SEQ ID NO: 366622 - DNA, 25 bp, Rattus norvegicus
gatgcctcatgcaggtggtaagtac

SEQ ID NO: 366623 - DNA, 25 bp, Rattus norvegicus
gatgcctcatgctggtggtaagtac

SEQ ID NO: 366624 - DNA, 25 bp, Rattus norvegicus
gatgcctccttaaacaagtgcttcc

SEQ ID NO: 366625 - DNA, 25 bp, Rattus norvegicus
gatgcctccttatacaagtgcttcc

SEQ ID NO: 366626 - DNA, 25 bp, Rattus norvegicus
gatgcctcggagatcctacatatca

SEQ ID NO: 366627 - DNA, 25 bp, Rattus norvegicus
gatgcctcggagttcctacatatca

SEQ ID NO: 366628 - DNA, 25 bp, Rattus norvegicus
gatgcctcggttaacaaatcctaga

SEQ ID NO: 366629 - DNA, 25 bp, Rattus norvegicus
gatgcctcggtttacaaatcctaga

SEQ ID NO: 366630 - DNA, 25 bp, Rattus norvegicus
gatgcctcgtgtcgtagttctaaat

SEQ ID NO: 366631 - DNA, 25 bp, Rattus norvegicus
gatgcctcgtgtggtagttctaaat

SEQ ID NO: 366632 - DNA, 25 bp, Rattus norvegicus
gatgcctctaaaagccgcatgtaca

SEQ ID NO: 366633 - DNA, 25 bp, Rattus norvegicus
gatgcctctaaatgccgcatgtaca

SEQ ID NO: 366634 - DNA, 25 bp, Rattus norvegicus
gatgcctctaatactgtagtcgaga

SEQ ID NO: 366635 - DNA, 25 bp, Rattus norvegicus
gatgcctctaattctgtagtcgaga

SEQ ID NO: 366636 - DNA, 25 bp, Rattus norvegicus
gatgcctctcaacggttctgtgtaa

SEQ ID NO: 366637 - DNA, 25 bp, Rattus norvegicus
gatgcctctcaagggttctgtgtaa

SEQ ID NO: 366638 - DNA, 25 bp, Rattus norvegicus
gatgcctctctgacacagttcaagt

SEQ ID NO: 366639 - DNA, 25 bp, Rattus norvegicus
gatgcctctctgaccttgcattctt

SEQ ID NO: 366640 - DNA, 25 bp, Rattus norvegicus
gatgcctctctgtcacagttcaagt

SEQ ID NO: 366641 - DNA, 25 bp, Rattus norvegicus
gatgcctctctgtccttgcattctt

SEQ ID NO: 366642 - DNA, 25 bp, Rattus norvegicus
gatgcctctgctccagtggcaaaga

SEQ ID NO: 366643 - DNA, 25 bp, Rattus norvegicus
gatgcctctgctgcagtggcaaaga

SEQ ID NO: 366644 - DNA, 25 bp, Rattus norvegicus
gatgcctctggcagtcagtgctttt

SEQ ID NO: 366645 - DNA, 25 bp, Rattus norvegicus
gatgcctctggctgtcagtgctttt

SEQ ID NO: 366646 - DNA, 25 bp, Rattus norvegicus
gatgcctcttaaacttatgtctttt

SEQ ID NO: 366647 - DNA, 25 bp, Rattus norvegicus
gatgcctcttaatcttatgtctttt

SEQ ID NO: 366648 - DNA, 25 bp, Rattus norvegicus
gatgcctgaacacaaaccaaccctg

SEQ ID NO: 366649 - DNA, 25 bp, Rattus norvegicus
gatgcctgaacagaaaccaaccctg

SEQ ID NO: 366650 - DNA, 25 bp, Rattus norvegicus
gatgcctgaggtcaccttgaagcag

SEQ ID NO: 366651 - DNA, 25 bp, Rattus norvegicus
gatgcctgaggtgaccttgaagcag

SEQ ID NO: 366652 - DNA, 25 bp, Rattus norvegicus
gatgcctgagtgactaccactggat

SEQ ID NO: 366653 - DNA, 25 bp, Rattus norvegicus
gatgcctgagtgtctaccactggat

SEQ ID NO: 366654 - DNA, 25 bp, Rattus norvegicus
gatgcctgatagatctcatgctcgt

SEQ ID NO: 366655 - DNA, 25 bp, Rattus norvegicus
gatgcctgatagttctcatgctcgt

SEQ ID NO: 366656 - DNA, 25 bp, Rattus norvegicus
gatgcctgcacaattgctttgttag

SEQ ID NO: 366657 - DNA, 25 bp, Rattus norvegicus
gatgcctgcacacggcatgcaacaa

SEQ ID NO: 366658 - DNA, 25 bp, Rattus norvegicus
gatgcctgcacagggcatgcaacaa

SEQ ID NO: 366659 - DNA, 25 bp, Rattus norvegicus
gatgcctgcacatttgctttgttag

SEQ ID NO: 366660 - DNA, 25 bp, Rattus norvegicus
gatgcctgcagccaagcggttcaga

SEQ ID NO: 366661 - DNA, 25 bp, Rattus norvegicus
gatgcctgcagcctggccttagcac

SEQ ID NO: 366662 - DNA, 25 bp, Rattus norvegicus
gatgcctgcagcgaagcggttcaga

SEQ ID NO: 366663 - DNA, 25 bp, Rattus norvegicus
gatgcctgcagcgtggccttagcac

SEQ ID NO: 366664 - DNA, 25 bp, Rattus norvegicus
gatgcctgcattaatgtattgccac

SEQ ID NO: 366665 - DNA, 25 bp, Rattus norvegicus
gatgcctgcatttatgtattgccac

SEQ ID NO: 366666 - DNA, 25 bp, Rattus norvegicus
gatgcctgcctgctagctagaaaga

SEQ ID NO: 366667 - DNA, 25 bp, Rattus norvegicus
gatgcctgcctggtagctagaaaga

SEQ ID NO: 366668 - DNA, 25 bp, Rattus norvegicus
gatgcctgcgaaaggaccagttgac

SEQ ID NO: 366669 - DNA, 25 bp, Rattus norvegicus
gatgcctgcgaatggaccagttgac

SEQ ID NO: 366670 - DNA, 25 bp, Rattus norvegicus
gatgcctgctggaatgcttttcgaa

SEQ ID NO: 366671 - DNA, 25 bp, Rattus norvegicus
gatgcctgctggtatgcttttcgaa

SEQ ID NO: 366672 - DNA, 25 bp, Rattus norvegicus
gatgcctggatcacaggacttcaga

SEQ ID NO: 366673 - DNA, 25 bp, Rattus norvegicus
gatgcctggatctcaggacttcaga

SEQ ID NO: 366674 - DNA, 25 bp, Rattus norvegicus
gatgcctggcctaagatgcctggga

SEQ ID NO: 366675 - DNA, 25 bp, Rattus norvegicus
gatgcctggcctacatccaaaggga

SEQ ID NO: 366676 - DNA, 25 bp, Rattus norvegicus
gatgcctggccttagatgcctggga

SEQ ID NO: 366677 - DNA, 25 bp, Rattus norvegicus
gatgcctggccttcatccaaaggga

SEQ ID NO: 366678 - DNA, 25 bp, Rattus norvegicus
gatgcctgggttagcatgtcaaacc

SEQ ID NO: 366679 - DNA, 25 bp, Rattus norvegicus
gatgcctgggtttgcatgtcaaacc

SEQ ID NO: 366680 - DNA, 25 bp, Rattus norvegicus
gatgcctggtccacttacttagttg

SEQ ID NO: 366681 - DNA, 25 bp, Rattus norvegicus
gatgcctggtcctcttacttagttg

SEQ ID NO: 366682 - DNA, 25 bp, Rattus norvegicus
gatgcctgtacaatggacctcagtg

SEQ ID NO: 366683 - DNA, 25 bp, Rattus norvegicus
gatgcctgtacattggacctcagtg

SEQ ID NO: 366684 - DNA, 25 bp, Rattus norvegicus
gatgcctgtcatagaacagtctcaa

SEQ ID NO: 366685 - DNA, 25 bp, Rattus norvegicus
gatgcctgtcattgaacagtctcaa

SEQ ID NO: 366686 - DNA, 25 bp, Rattus norvegicus
gatgcctgtcttcaaaaagctcagc

SEQ ID NO: 366687 - DNA, 25 bp, Rattus norvegicus
gatgcctgtcttgaaaaagctcagc

SEQ ID NO: 366688 - DNA, 25 bp, Rattus norvegicus
gatgcctgtgatcaagaaactccca

SEQ ID NO: 366689 - DNA, 25 bp, Rattus norvegicus
gatgcctgtgatgaagaaactccca

SEQ ID NO: 366690 - DNA, 25 bp, Rattus norvegicus
gatgcctgtgctagttcttagaaat

SEQ ID NO: 366691 - DNA, 25 bp, Rattus norvegicus
gatgcctgtgcttgttcttagaaat

SEQ ID NO: 366692 - DNA, 25 bp, Rattus norvegicus
gatgcctgtgtcagtgggactcctc

SEQ ID NO: 366693 - DNA, 25 bp, Rattus norvegicus
gatgcctgtgtctgtgggactcctc

SEQ ID NO: 366694 - DNA, 25 bp, Rattus norvegicus
gatgcctgttgtcaatcctcagact

SEQ ID NO: 366695 - DNA, 25 bp, Rattus norvegicus
gatgcctgttgtgaatcctcagact

SEQ ID NO: 366696 - DNA, 25 bp, Rattus norvegicus
gatgcctgtttcaattctaatgtaa

SEQ ID NO: 366697 - DNA, 25 bp, Rattus norvegicus
gatgcctgtttctattctaatgtaa

SEQ ID NO: 366698 - DNA, 25 bp, Rattus norvegicus
gatgccttactcatgatttttgcta

SEQ ID NO: 366699 - DNA, 25 bp, Rattus norvegicus
gatgccttactcttgatttttgcta

SEQ ID NO: 366700 - DNA, 25 bp, Rattus norvegicus
gatgccttagtgcagtcagagccat

SEQ ID NO: 366701 - DNA, 25 bp, Rattus norvegicus
gatgccttagtggagtcagagccat

SEQ ID NO: 366702 - DNA, 25 bp, Rattus norvegicus
gatgccttatttcaattgctgcaag

SEQ ID NO: 366703 - DNA, 25 bp, Rattus norvegicus
gatgccttatttgaattgctgcaag

SEQ ID NO: 366704 - DNA, 25 bp, Rattus norvegicus
gatgccttcaacaagctcacagcga

SEQ ID NO: 366705 - DNA, 25 bp, Rattus norvegicus
gatgccttcaactagctcacagcga

SEQ ID NO: 366706 - DNA, 25 bp, Rattus norvegicus
gatgccttcaatatcattcctgtag

SEQ ID NO: 366707 - DNA, 25 bp, Rattus norvegicus
gatgccttcaatttcattcctgtag

SEQ ID NO: 366708 - DNA, 25 bp, Rattus norvegicus
gatgccttcagactgatcaatgcta

SEQ ID NO: 366709 - DNA, 25 bp, Rattus norvegicus
gatgccttcagagtgatcaatgcta

SEQ ID NO: 366710 - DNA, 25 bp, Rattus norvegicus
gatgccttcagcctcagtttttcta

SEQ ID NO: 366711 - DNA, 25 bp, Rattus norvegicus
gatgccttcagcgtcagtttttcta

SEQ ID NO: 366712 - DNA, 25 bp, Rattus norvegicus
gatgccttccctacaaaatggagtt

SEQ ID NO: 366713 - DNA, 25 bp, Rattus norvegicus
gatgccttcccttcaaaatggagtt

SEQ ID NO: 366714 - DNA, 25 bp, Rattus norvegicus
gatgccttcctaagcagagtagccc

SEQ ID NO: 366715 - DNA, 25 bp, Rattus norvegicus
gatgccttcctatgcagagtagccc

SEQ ID NO: 366716 - DNA, 25 bp, Rattus norvegicus
gatgccttccttcgagcactgagaa

SEQ ID NO: 366717 - DNA, 25 bp, Rattus norvegicus
gatgccttccttggagcactgagaa

SEQ ID NO: 366718 - DNA, 25 bp, Rattus norvegicus
gatgccttctacacactagtacgtg

SEQ ID NO: 366719 - DNA, 25 bp, Rattus norvegicus
gatgccttctactcactagtacgtg

SEQ ID NO: 366720 - DNA, 25 bp, Rattus norvegicus
gatgccttctccatttgagggaaaa

SEQ ID NO: 366721 - DNA, 25 bp, Rattus norvegicus
gatgccttctccttttgagggaaaa

SEQ ID NO: 366722 - DNA, 25 bp, Rattus norvegicus
gatgccttgagcctgcaccatgaag

SEQ ID NO: 366723 - DNA, 25 bp, Rattus norvegicus
gatgccttgagcgtgcaccatgaag

SEQ ID NO: 366724 - DNA, 25 bp, Rattus norvegicus
gatgccttgcaaactgtaagctgaa

SEQ ID NO: 366725 - DNA, 25 bp, Rattus norvegicus
gatgccttgcaatctgtaagctgaa

SEQ ID NO: 366726 - DNA, 25 bp, Rattus norvegicus
gatgccttgcctcaagtggagtcac

SEQ ID NO: 366727 - DNA, 25 bp, Rattus norvegicus
gatgccttgcctgaagtggagtcac

SEQ ID NO: 366728 - DNA, 25 bp, Rattus norvegicus
gatgccttggaacagctgagctcct

SEQ ID NO: 366729 - DNA, 25 bp, Rattus norvegicus
gatgccttggaagagctgagctcct

SEQ ID NO: 366730 - DNA, 25 bp, Rattus norvegicus
gatgccttggtcagggcccctctag

SEQ ID NO: 366731 - DNA, 25 bp, Rattus norvegicus
gatgccttggtctgggcccctctag

SEQ ID NO: 366732 - DNA, 25 bp, Rattus norvegicus
gatgccttggtgctcaagagcaact

SEQ ID NO: 366733 - DNA, 25 bp, Rattus norvegicus
gatgccttggtggtcaagagcaact

SEQ ID NO: 366734 - DNA, 25 bp, Rattus norvegicus
gatgccttggttcaatgacctgcct

SEQ ID NO: 366735 - DNA, 25 bp, Rattus norvegicus
gatgccttggttgaatgacctgcct

SEQ ID NO: 366736 - DNA, 25 bp, Rattus norvegicus
gatgcctttagtatttagctgctgt

SEQ ID NO: 366737 - DNA, 25 bp, Rattus norvegicus
gatgcctttagtttttagctgctgt

SEQ ID NO: 366738 - DNA, 25 bp, Rattus norvegicus
gatgcctttattctgtaattcgtgt

SEQ ID NO: 366739 - DNA, 25 bp, Rattus norvegicus
gatgcctttattgtgtaattcgtgt

SEQ ID NO: 366740 - DNA, 25 bp, Rattus norvegicus
gatgcctttcaaaagaacactcaat

SEQ ID NO: 366741 - DNA, 25 bp, Rattus norvegicus
gatgcctttcaatagaacactcaat

SEQ ID NO: 366742 - DNA, 25 bp, Rattus norvegicus
gatgcctttctacgtggtacagcta

SEQ ID NO: 366743 - DNA, 25 bp, Rattus norvegicus
gatgcctttctaggtggtacagcta

SEQ ID NO: 366744 - DNA, 25 bp, Rattus norvegicus
gatgccttttaaaggactaacttac

SEQ ID NO: 366745 - DNA, 25 bp, Rattus norvegicus
gatgccttttaatggactaacttac

SEQ ID NO: 366746 - DNA, 25 bp, Rattus norvegicus
gatgccttttatagtagcagcctag

SEQ ID NO: 366747 - DNA, 25 bp, Rattus norvegicus
gatgccttttattgtagcagcctag

SEQ ID NO: 366748 - DNA, 25 bp, Rattus norvegicus
gatgccttttggagacactgtattc

SEQ ID NO: 366749 - DNA, 25 bp, Rattus norvegicus
gatgccttttggtgacactgtattc

SEQ ID NO: 366750 - DNA, 25 bp, Rattus norvegicus
gatgcctttttgctattgtatccca

SEQ ID NO: 366751 - DNA, 25 bp, Rattus norvegicus
gatgcctttttggtattgtatccca

SEQ ID NO: 366752 - DNA, 25 bp, Rattus norvegicus
gatgcgaataataatgttgtctgaa

SEQ ID NO: 366753 - DNA, 25 bp, Rattus norvegicus
gatgcgaataattatgttgtctgaa

SEQ ID NO: 366754 - DNA, 25 bp, Rattus norvegicus
gatgcgacacatcccagaggtgcca

SEQ ID NO: 366755 - DNA, 25 bp, Rattus norvegicus
gatgcgacacatgccagaggtgcca

SEQ ID NO: 366756 - DNA, 25 bp, Rattus norvegicus
gatgcgacccagcagagacagcaaa

SEQ ID NO: 366757 - DNA, 25 bp, Rattus norvegicus
gatgcgacccaggagagacagcaaa

SEQ ID NO: 366758 - DNA, 25 bp, Rattus norvegicus
gatgcgacctaaatgacctggtgta

SEQ ID NO: 366759 - DNA, 25 bp, Rattus norvegicus
gatgcgacctaattgacctggtgta

SEQ ID NO: 366760 - DNA, 25 bp, Rattus norvegicus
gatgcgactcctactcaaagtggaa

SEQ ID NO: 366761 - DNA, 25 bp, Rattus norvegicus
gatgcgactccttctcaaagtggaa

SEQ ID NO: 366762 - DNA, 25 bp, Rattus norvegicus
gatgcgactctaaggactctcacat

SEQ ID NO: 366763 - DNA, 25 bp, Rattus norvegicus
gatgcgactctatggactctcacat

SEQ ID NO: 366764 - DNA, 25 bp, Rattus norvegicus
gatgcgagggcaattcgatggcctt

SEQ ID NO: 366765 - DNA, 25 bp, Rattus norvegicus
gatgcgagggcatttcgatggcctt

SEQ ID NO: 366766 - DNA, 25 bp, Rattus norvegicus
gatgcgagtgaacgccagacccact

SEQ ID NO: 366767 - DNA, 25 bp, Rattus norvegicus
gatgcgagtgaaggccagacccact

SEQ ID NO: 366768 - DNA, 25 bp, Rattus norvegicus
gatgcgatatatcctctgggacaac

SEQ ID NO: 366769 - DNA, 25 bp, Rattus norvegicus
gatgcgatatatgctctgggacaac

SEQ ID NO: 366770 - DNA, 25 bp, Rattus norvegicus
gatgcgatgcctaatactcgtggtc

SEQ ID NO: 366771 - DNA, 25 bp, Rattus norvegicus
gatgcgatgccttatactcgtggtc

SEQ ID NO: 366772 - DNA, 25 bp, Rattus norvegicus
gatgcgatgctcctgcttaaactcc

SEQ ID NO: 366773 - DNA, 25 bp, Rattus norvegicus
gatgcgatgctcgtgcttaaactcc

SEQ ID NO: 366774 - DNA, 25 bp, Rattus norvegicus
gatgcgcaagctacagcagagttca

SEQ ID NO: 366775 - DNA, 25 bp, Rattus norvegicus
gatgcgcaagcttcagcagagttca

SEQ ID NO: 366776 - DNA, 25 bp, Rattus norvegicus
gatgcgcacgagcaagcggccctta

SEQ ID NO: 366777 - DNA, 25 bp, Rattus norvegicus
gatgcgcacgaggaagcggccctta

SEQ ID NO: 366778 - DNA, 25 bp, Rattus norvegicus
gatgcgcagaatctcttagacttca

SEQ ID NO: 366779 - DNA, 25 bp, Rattus norvegicus
gatgcgcagaatgtcttagacttca

SEQ ID NO: 366780 - DNA, 25 bp, Rattus norvegicus
gatgcgcaggaccttcccagtgcac

SEQ ID NO: 366781 - DNA, 25 bp, Rattus norvegicus
gatgcgcaggacgttcccagtgcac

SEQ ID NO: 366782 - DNA, 25 bp, Rattus norvegicus
gatgcgcagtggatgacgccagagg

SEQ ID NO: 366783 - DNA, 25 bp, Rattus norvegicus
gatgcgcagtggttgacgccagagg

SEQ ID NO: 366784 - DNA, 25 bp, Rattus norvegicus
gatgcgccaaggaagccagctgcag

SEQ ID NO: 366785 - DNA, 25 bp, Rattus norvegicus
gatgcgccaaggtagccagctgcag

SEQ ID NO: 366786 - DNA, 25 bp, Rattus norvegicus
gatgcgccataacgacacattaaga

SEQ ID NO: 366787 - DNA, 25 bp, Rattus norvegicus
gatgcgccataaggacacattaaga

SEQ ID NO: 366788 - DNA, 25 bp, Rattus norvegicus
gatgcgccatttatagcacctgtga

SEQ ID NO: 366789 - DNA, 25 bp, Rattus norvegicus
gatgcgccatttttagcacctgtga

SEQ ID NO: 366790 - DNA, 25 bp, Rattus norvegicus
gatgcgcccagcctaggaagctagt

SEQ ID NO: 366791 - DNA, 25 bp, Rattus norvegicus
gatgcgcccagcgtaggaagctagt

SEQ ID NO: 366792 - DNA, 25 bp, Rattus norvegicus
gatgcgccgctgacgactcctgcga

SEQ ID NO: 366793 - DNA, 25 bp, Rattus norvegicus
gatgcgccgctgtcgactcctgcga

SEQ ID NO: 366794 - DNA, 25 bp, Rattus norvegicus
gatgcgcctctgcatccggatgaaa

SEQ ID NO: 366795 - DNA, 25 bp, Rattus norvegicus
gatgcgcctctggatccggatgaaa

SEQ ID NO: 366796 - DNA, 25 bp, Rattus norvegicus
gatgcgctcggaacaccttggaggt

SEQ ID NO: 366797 - DNA, 25 bp, Rattus norvegicus
gatgcgctcggatcaccttggaggt

SEQ ID NO: 366798 - DNA, 25 bp, Rattus norvegicus
gatgcgctggcgacacagctcctgc

SEQ ID NO: 366799 - DNA, 25 bp, Rattus norvegicus
gatgcgctggcgtcacagctcctgc

SEQ ID NO: 366800 - DNA, 25 bp, Rattus norvegicus
gatgcgctggtcacaggttagtgat

SEQ ID NO: 366801 - DNA, 25 bp, Rattus norvegicus
gatgcgctggtctcaggttagtgat

SEQ ID NO: 366802 - DNA, 25 bp, Rattus norvegicus
gatgcgctgtgaaactctccaggaa

SEQ ID NO: 366803 - DNA, 25 bp, Rattus norvegicus
gatgcgctgtgatactctccaggaa

SEQ ID NO: 366804 - DNA, 25 bp, Rattus norvegicus
gatgcgctgttcaaggccttggaga

SEQ ID NO: 366805 - DNA, 25 bp, Rattus norvegicus
gatgcgctgttctaggccttggaga

SEQ ID NO: 366806 - DNA, 25 bp, Rattus norvegicus
gatgcgcttaaaattgtccgttcca

SEQ ID NO: 366807 - DNA, 25 bp, Rattus norvegicus
gatgcgcttaaatttgtccgttcca

SEQ ID NO: 366808 - DNA, 25 bp, Rattus norvegicus
gatgcgctttaaacctcataactgt

SEQ ID NO: 366809 - DNA, 25 bp, Rattus norvegicus
gatgcgctttaatcctcataactgt

SEQ ID NO: 366810 - DNA, 25 bp, Rattus norvegicus
gatgcggaaactcttcatccagaga

SEQ ID NO: 366811 - DNA, 25 bp, Rattus norvegicus
gatgcggaaactgttcatccagaga

SEQ ID NO: 366812 - DNA, 25 bp, Rattus norvegicus
gatgcggaagtcctcagaatcccac

SEQ ID NO: 366813 - DNA, 25 bp, Rattus norvegicus
gatgcggaagtcgtcagaatcccac

SEQ ID NO: 366814 - DNA, 25 bp, Rattus norvegicus
gatgcggactcaaattatacctctg

SEQ ID NO: 366815 - DNA, 25 bp, Rattus norvegicus
gatgcggactcatattatacctctg

SEQ ID NO: 366816 - DNA, 25 bp, Rattus norvegicus
gatgcggactgtccggcgctaaccc

SEQ ID NO: 366817 - DNA, 25 bp, Rattus norvegicus
gatgcggactgtgcggcgctaaccc

SEQ ID NO: 366818 - DNA, 25 bp, Rattus norvegicus
gatgcggagttcattcctcagaaag

SEQ ID NO: 366819 - DNA, 25 bp, Rattus norvegicus
gatgcggagttctttcctcagaaag

SEQ ID NO: 366820 - DNA, 25 bp, Rattus norvegicus
gatgcggcagttacagcagggtgct

SEQ ID NO: 366821 - DNA, 25 bp, Rattus norvegicus
gatgcggcagtttcagcagggtgct

SEQ ID NO: 366822 - DNA, 25 bp, Rattus norvegicus
gatgcggccaagatgaacatcccca

SEQ ID NO: 366823 - DNA, 25 bp, Rattus norvegicus
gatgcggccaagttgaacatcccca

SEQ ID NO: 366824 - DNA, 25 bp, Rattus norvegicus
gatgcggctgaaactctcggacaaa

SEQ ID NO: 366825 - DNA, 25 bp, Rattus norvegicus
gatgcggctgaatctctcggacaaa

SEQ ID NO: 366826 - DNA, 25 bp, Rattus norvegicus
gatgcggctgcaaaagctgcttctg

SEQ ID NO: 366827 - DNA, 25 bp, Rattus norvegicus
gatgcggctgcataagctgcttctg

SEQ ID NO: 366828 - DNA, 25 bp, Rattus norvegicus
gatgcggctggaaacttggacatta

SEQ ID NO: 366829 - DNA, 25 bp, Rattus norvegicus
gatgcggctggatacttggacatta

SEQ ID NO: 366830 - DNA, 25 bp, Rattus norvegicus
gatgcgggattaagactctgttaga

SEQ ID NO: 366831 - DNA, 25 bp, Rattus norvegicus
gatgcgggattatgactctgttaga

SEQ ID NO: 366832 - DNA, 25 bp, Rattus norvegicus
gatgcgggcctccatcttggagcac

SEQ ID NO: 366833 - DNA, 25 bp, Rattus norvegicus
gatgcgggcctcgatcttggagcac

SEQ ID NO: 366834 - DNA, 25 bp, Rattus norvegicus
gatgcggtcacacacagctctcata

SEQ ID NO: 366835 - DNA, 25 bp, Rattus norvegicus
gatgcggtcacagacagctctcata

SEQ ID NO: 366836 - DNA, 25 bp, Rattus norvegicus
gatgcggtcatgacacttctaatag

SEQ ID NO: 366837 - DNA, 25 bp, Rattus norvegicus
gatgcggtcatgtcacttctaatag

SEQ ID NO: 366838 - DNA, 25 bp, Rattus norvegicus
gatgcggtgaaactgtgcgccacac

SEQ ID NO: 366839 - DNA, 25 bp, Rattus norvegicus
gatgcggtgaaagtgtgcgccacac

SEQ ID NO: 366840 - DNA, 25 bp, Rattus norvegicus
gatgcggtgccaaatccttgccttc

SEQ ID NO: 366841 - DNA, 25 bp, Rattus norvegicus
gatgcggtgccatatccttgccttc

SEQ ID NO: 366842 - DNA, 25 bp, Rattus norvegicus
gatgcggttagcaaacttctcccaa

SEQ ID NO: 366843 - DNA, 25 bp, Rattus norvegicus
gatgcggttagctaacttctcccaa

SEQ ID NO: 366844 - DNA, 25 bp, Rattus norvegicus
gatgcggttgccaaagtgacaccat

SEQ ID NO: 366845 - DNA, 25 bp, Rattus norvegicus
gatgcggttgcctaagtgacaccat

SEQ ID NO: 366846 - DNA, 25 bp, Rattus norvegicus
gatgcgtgcatcattgagaaaggag

SEQ ID NO: 366847 - DNA, 25 bp, Rattus norvegicus
gatgcgtgcatctttgagaaaggag

SEQ ID NO: 366848 - DNA, 25 bp, Rattus norvegicus
gatgcgtgtcttcctgagtgttcac

SEQ ID NO: 366849 - DNA, 25 bp, Rattus norvegicus
gatgcgtgtcttgctgagtgttcac

SEQ ID NO: 366850 - DNA, 25 bp, Rattus norvegicus
gatgcgttcactacagaagcacaca

SEQ ID NO: 366851 - DNA, 25 bp, Rattus norvegicus
gatgcgttcacttcagaagcacaca

SEQ ID NO: 366852 - DNA, 25 bp, Rattus norvegicus
gatgcgttcagaatcagtactcagc

SEQ ID NO: 366853 - DNA, 25 bp, Rattus norvegicus
gatgcgttcagattcagtactcagc

SEQ ID NO: 366854 - DNA, 25 bp, Rattus norvegicus
gatgcgttcgtgacgctttagggtc

SEQ ID NO: 366855 - DNA, 25 bp, Rattus norvegicus
gatgcgttcgtgtcgctttagggtc

SEQ ID NO: 366856 - DNA, 25 bp, Rattus norvegicus
gatgcgttgaatcatgtcttcctta

SEQ ID NO: 366857 - DNA, 25 bp, Rattus norvegicus
gatgcgttgaatgatgtcttcctta

SEQ ID NO: 366858 - DNA, 25 bp, Rattus norvegicus
gatgcgttgtttccaaggcaagcga

SEQ ID NO: 366859 - DNA, 25 bp, Rattus norvegicus
gatgcgttgtttgcaaggcaagcga

SEQ ID NO: 366860 - DNA, 25 bp, Rattus norvegicus
gatgcgtttcatcgatggtcgttca

SEQ ID NO: 366861 - DNA, 25 bp, Rattus norvegicus
gatgcgtttcatggatggtcgttca

SEQ ID NO: 366862 - DNA, 25 bp, Rattus norvegicus
gatgcgtttgcaccttgaagttttt

SEQ ID NO: 366863 - DNA, 25 bp, Rattus norvegicus
gatgcgtttgcagcttgaagttttt

SEQ ID NO: 366864 - DNA, 25 bp, Rattus norvegicus
gatgctaaaataacacccatgtggt

SEQ ID NO: 366865 - DNA, 25 bp, Rattus norvegicus
gatgctaaaatatcacccatgtggt

SEQ ID NO: 366866 - DNA, 25 bp, Rattus norvegicus
gatgctaaaatgctggcaccccaaa

SEQ ID NO: 366867 - DNA, 25 bp, Rattus norvegicus
gatgctaaaatggtggcaccccaaa

SEQ ID NO: 366868 - DNA, 25 bp, Rattus norvegicus
gatgctaaacaccattgggctccta

SEQ ID NO: 366869 - DNA, 25 bp, Rattus norvegicus
gatgctaaacacgattgggctccta

SEQ ID NO: 366870 - DNA, 25 bp, Rattus norvegicus
gatgctaaaccgctggtttctcacc

SEQ ID NO: 366871 - DNA, 25 bp, Rattus norvegicus
gatgctaaaccggtggtttctcacc

SEQ ID NO: 366872 - DNA, 25 bp, Rattus norvegicus
gatgctaacactaaccaaggcagtt

SEQ ID NO: 366873 - DNA, 25 bp, Rattus norvegicus
gatgctaacacttaccaaggcagtt

SEQ ID NO: 366874 - DNA, 25 bp, Rattus norvegicus
gatgctaacaggctgaggtctgaca

SEQ ID NO: 366875 - DNA, 25 bp, Rattus norvegicus
gatgctaacagggtgaggtctgaca

SEQ ID NO: 366876 - DNA, 25 bp, Rattus norvegicus
gatgctaaccgtcgtttcctttgaa

SEQ ID NO: 366877 - DNA, 25 bp, Rattus norvegicus
gatgctaaccgtggtttcctttgaa

SEQ ID NO: 366878 - DNA, 25 bp, Rattus norvegicus
gatgctaacctaaacttaaacctct

SEQ ID NO: 366879 - DNA, 25 bp, Rattus norvegicus
gatgctaacctatacttaaacctct

SEQ ID NO: 366880 - DNA, 25 bp, Rattus norvegicus
gatgctaacctgatggccatagaca

SEQ ID NO: 366881 - DNA, 25 bp, Rattus norvegicus
gatgctaacctgttggccatagaca

SEQ ID NO: 366882 - DNA, 25 bp, Rattus norvegicus
gatgctaaggcacgctctttgcgga

SEQ ID NO: 366883 - DNA, 25 bp, Rattus norvegicus
gatgctaaggcaggctctttgcgga

SEQ ID NO: 366884 - DNA, 25 bp, Rattus norvegicus
gatgctaagttcctgaacctcgttc

SEQ ID NO: 366885 - DNA, 25 bp, Rattus norvegicus
gatgctaagttcgtgaacctcgttc

SEQ ID NO: 366886 - DNA, 25 bp, Rattus norvegicus
gatgctaagttgctgtatccaggaa

SEQ ID NO: 366887 - DNA, 25 bp, Rattus norvegicus
gatgctaagttggtgtatccaggaa

SEQ ID NO: 366888 - DNA, 25 bp, Rattus norvegicus
gatgctaataaaacctgtctggctt

SEQ ID NO: 366889 - DNA, 25 bp, Rattus norvegicus
gatgctaataaatcctgtctggctt

SEQ ID NO: 366890 - DNA, 25 bp, Rattus norvegicus
gatgctaatggaagaactcacttgt

SEQ ID NO: 366891 - DNA, 25 bp, Rattus norvegicus
gatgctaatggatgaactcacttgt

SEQ ID NO: 366892 - DNA, 25 bp, Rattus norvegicus
gatgctaatgtgacaactctgaata

SEQ ID NO: 366893 - DNA, 25 bp, Rattus norvegicus
gatgctaatgtgtcaactctgaata

SEQ ID NO: 366894 - DNA, 25 bp, Rattus norvegicus
gatgctaattgtcaattgtcaccaa

SEQ ID NO: 366895 - DNA, 25 bp, Rattus norvegicus
gatgctaattgtgaattgtcaccaa

SEQ ID NO: 366896 - DNA, 25 bp, Rattus norvegicus
gatgctacagcaatgcaccgggcag

SEQ ID NO: 366897 - DNA, 25 bp, Rattus norvegicus
gatgctacagcattgcaccgggcag

SEQ ID NO: 366898 - DNA, 25 bp, Rattus norvegicus
gatgctacataactctgtggctccc

SEQ ID NO: 366899 - DNA, 25 bp, Rattus norvegicus
gatgctacataagtctgtggctccc

SEQ ID NO: 366900 - DNA, 25 bp, Rattus norvegicus
gatgctaccagccaagtcactgagt

SEQ ID NO: 366901 - DNA, 25 bp, Rattus norvegicus
gatgctaccagcgaagtcactgagt

SEQ ID NO: 366902 - DNA, 25 bp, Rattus norvegicus
gatgctacctatatgacttgttttt

SEQ ID NO: 366903 - DNA, 25 bp, Rattus norvegicus
gatgctacctatttgacttgttttt

SEQ ID NO: 366904 - DNA, 25 bp, Rattus norvegicus
gatgctactagccttttagaataag

SEQ ID NO: 366905 - DNA, 25 bp, Rattus norvegicus
gatgctactagcgttttagaataag

SEQ ID NO: 366906 - DNA, 25 bp, Rattus norvegicus
gatgctactcagaaggtcctataca

SEQ ID NO: 366907 - DNA, 25 bp, Rattus norvegicus
gatgctactcagtaggtcctataca

SEQ ID NO: 366908 - DNA, 25 bp, Rattus norvegicus
gatgctactcctctgatcctatgga

SEQ ID NO: 366909 - DNA, 25 bp, Rattus norvegicus
gatgctactcctgtgatcctatgga

SEQ ID NO: 366910 - DNA, 25 bp, Rattus norvegicus
gatgctactgcaagtttactgtcaa

SEQ ID NO: 366911 - DNA, 25 bp, Rattus norvegicus
gatgctactgcatgtttactgtcaa

SEQ ID NO: 366912 - DNA, 25 bp, Rattus norvegicus
gatgctacttgaagactcagatgat

SEQ ID NO: 366913 - DNA, 25 bp, Rattus norvegicus
gatgctacttgatgactcagatgat

SEQ ID NO: 366914 - DNA, 25 bp, Rattus norvegicus
gatgctactttgattctatcgcaag

SEQ ID NO: 366915 - DNA, 25 bp, Rattus norvegicus
gatgctactttgtttctatcgcaag

SEQ ID NO: 366916 - DNA, 25 bp, Rattus norvegicus
gatgctagaattacctttagaacac

SEQ ID NO: 366917 - DNA, 25 bp, Rattus norvegicus
gatgctagaattacttgcctgccta

SEQ ID NO: 366918 - DNA, 25 bp, Rattus norvegicus
gatgctagaatttcctttagaacac

SEQ ID NO: 366919 - DNA, 25 bp, Rattus norvegicus
gatgctagaatttcttgcctgccta

SEQ ID NO: 366920 - DNA, 25 bp, Rattus norvegicus
gatgctagatagatctgagtcttga

SEQ ID NO: 366921 - DNA, 25 bp, Rattus norvegicus
gatgctagatagttctgagtcttga

SEQ ID NO: 366922 - DNA, 25 bp, Rattus norvegicus
gatgctagccttctttatgaggtgc

SEQ ID NO: 366923 - DNA, 25 bp, Rattus norvegicus
gatgctagccttgtttatgaggtgc

SEQ ID NO: 366924 - DNA, 25 bp, Rattus norvegicus
gatgctagctgacacccaagggcca

SEQ ID NO: 366925 - DNA, 25 bp, Rattus norvegicus
gatgctagctgagacccaagggcca

SEQ ID NO: 366926 - DNA, 25 bp, Rattus norvegicus
gatgctaggaacacaatatgcccct

SEQ ID NO: 366927 - DNA, 25 bp, Rattus norvegicus
gatgctaggaactcaatatgcccct

SEQ ID NO: 366928 - DNA, 25 bp, Rattus norvegicus
gatgctaggacacaggattcctctc

SEQ ID NO: 366929 - DNA, 25 bp, Rattus norvegicus
gatgctaggacagaggattcctctc

SEQ ID NO: 366930 - DNA, 25 bp, Rattus norvegicus
gatgctagtatgcactggccatgat

SEQ ID NO: 366931 - DNA, 25 bp, Rattus norvegicus
gatgctagtatggactggccatgat

SEQ ID NO: 366932 - DNA, 25 bp, Rattus norvegicus
gatgctagtcatcttgagagattga

SEQ ID NO: 366933 - DNA, 25 bp, Rattus norvegicus
gatgctagtcatgttgagagattga

SEQ ID NO: 366934 - DNA, 25 bp, Rattus norvegicus
gatgctagttccagtcagggtggaa

SEQ ID NO: 366935 - DNA, 25 bp, Rattus norvegicus
gatgctagttcctgtcagggtggaa

SEQ ID NO: 366936 - DNA, 25 bp, Rattus norvegicus
gatgctatacagacttttaccaata

SEQ ID NO: 366937 - DNA, 25 bp, Rattus norvegicus
gatgctatacagtcttttaccaata

SEQ ID NO: 366938 - DNA, 25 bp, Rattus norvegicus
gatgctatacatcagctgtcaaagt

SEQ ID NO: 366939 - DNA, 25 bp, Rattus norvegicus
gatgctatacatgagctgtcaaagt

SEQ ID NO: 366940 - DNA, 25 bp, Rattus norvegicus
gatgctatatggctctcaaaacaat

SEQ ID NO: 366941 - DNA, 25 bp, Rattus norvegicus
gatgctatatgggtctcaaaacaat

SEQ ID NO: 366942 - DNA, 25 bp, Rattus norvegicus
gatgctatcctgcaaatgtctgtgg

SEQ ID NO: 366943 - DNA, 25 bp, Rattus norvegicus
gatgctatcctggaaatgtctgtgg

SEQ ID NO: 366944 - DNA, 25 bp, Rattus norvegicus
gatgctatgcagacttggctttttt

SEQ ID NO: 366945 - DNA, 25 bp, Rattus norvegicus
gatgctatgcagtcttggctttttt

SEQ ID NO: 366946 - DNA, 25 bp, Rattus norvegicus
gatgctatgccgattgctttggaat

SEQ ID NO: 366947 - DNA, 25 bp, Rattus norvegicus
gatgctatgccgtttgctttggaat

SEQ ID NO: 366948 - DNA, 25 bp, Rattus norvegicus
gatgctatgcctatttatggacaaa

SEQ ID NO: 366949 - DNA, 25 bp, Rattus norvegicus
gatgctatgcctttttatggacaaa

SEQ ID NO: 366950 - DNA, 25 bp, Rattus norvegicus
gatgctattccaatctaggtccagt

SEQ ID NO: 366951 - DNA, 25 bp, Rattus norvegicus
gatgctattccattctaggtccagt

SEQ ID NO: 366952 - DNA, 25 bp, Rattus norvegicus
gatgctattggccatcaaccagttt

SEQ ID NO: 366953 - DNA, 25 bp, Rattus norvegicus
gatgctattggcgatcaaccagttt

SEQ ID NO: 366954 - DNA, 25 bp, Rattus norvegicus
gatgctatttcacaggaatctgcaa

SEQ ID NO: 366955 - DNA, 25 bp, Rattus norvegicus
gatgctatttcacccaatctggaca

SEQ ID NO: 366956 - DNA, 25 bp, Rattus norvegicus
gatgctatttcagaggaatctgcaa

SEQ ID NO: 366957 - DNA, 25 bp, Rattus norvegicus
gatgctatttcagccaatctggaca

SEQ ID NO: 366958 - DNA, 25 bp, Rattus norvegicus
gatgctcaaaggattcgacgctgtg

SEQ ID NO: 366959 - DNA, 25 bp, Rattus norvegicus
gatgctcaaaggtttcgacgctgtg

SEQ ID NO: 366960 - DNA, 25 bp, Rattus norvegicus
gatgctcaacaactttgctagcctc

SEQ ID NO: 366961 - DNA, 25 bp, Rattus norvegicus
gatgctcaacaagtttgctagcctc

SEQ ID NO: 366962 - DNA, 25 bp, Rattus norvegicus
gatgctcaacctcgtcaacgtgtga

SEQ ID NO: 366963 - DNA, 25 bp, Rattus norvegicus
gatgctcaacctggtcaacgtgtga

SEQ ID NO: 366964 - DNA, 25 bp, Rattus norvegicus
gatgctcaaggtaccaagggtccct

SEQ ID NO: 366965 - DNA, 25 bp, Rattus norvegicus
gatgctcaaggttccaagggtccct

SEQ ID NO: 366966 - DNA, 25 bp, Rattus norvegicus
gatgctcaatgtatttgccatgaca

SEQ ID NO: 366967 - DNA, 25 bp, Rattus norvegicus
gatgctcaatgtttttgccatgaca

SEQ ID NO: 366968 - DNA, 25 bp, Rattus norvegicus
gatgctcacaaccatttcatagaaa

SEQ ID NO: 366969 - DNA, 25 bp, Rattus norvegicus
gatgctcacaacgatttcatagaaa

SEQ ID NO: 366970 - DNA, 25 bp, Rattus norvegicus
gatgctcacactcagatatttatta

SEQ ID NO: 366971 - DNA, 25 bp, Rattus norvegicus
gatgctcacactgagatatttatta

SEQ ID NO: 366972 - DNA, 25 bp, Rattus norvegicus
gatgctcacataagtcaaatcaagt

SEQ ID NO: 366973 - DNA, 25 bp, Rattus norvegicus
gatgctcacatatgtcaaatcaagt

SEQ ID NO: 366974 - DNA, 25 bp, Rattus norvegicus
gatgctcaccaactcgctggaggag

SEQ ID NO: 366975 - DNA, 25 bp, Rattus norvegicus
gatgctcaccaagtcgctggaggag

SEQ ID NO: 366976 - DNA, 25 bp, Rattus norvegicus
gatgctcactgtaaattttgactgt

SEQ ID NO: 366977 - DNA, 25 bp, Rattus norvegicus
gatgctcactgttaattttgactgt

SEQ ID NO: 366978 - DNA, 25 bp, Rattus norvegicus
gatgctcagacaaccatgtaggcag

SEQ ID NO: 366979 - DNA, 25 bp, Rattus norvegicus
gatgctcagacatccatgtaggcag

SEQ ID NO: 366980 - DNA, 25 bp, Rattus norvegicus
gatgctcagagcaatgttactacta

SEQ ID NO: 366981 - DNA, 25 bp, Rattus norvegicus
gatgctcagagctatgttactacta

SEQ ID NO: 366982 - DNA, 25 bp, Rattus norvegicus
gatgctcatgaaaaacttcgctaga

SEQ ID NO: 366983 - DNA, 25 bp, Rattus norvegicus
gatgctcatgaataacttcgctaga

SEQ ID NO: 366984 - DNA, 25 bp, Rattus norvegicus
gatgctcattatacttgtggctggt

SEQ ID NO: 366985 - DNA, 25 bp, Rattus norvegicus
gatgctcattattcttgtggctggt

SEQ ID NO: 366986 - DNA, 25 bp, Rattus norvegicus
gatgctccaagcctaagcagccagc

SEQ ID NO: 366987 - DNA, 25 bp, Rattus norvegicus
gatgctccaagcgtaagcagccagc

SEQ ID NO: 366988 - DNA, 25 bp, Rattus norvegicus
gatgctccaagtctcatgtctagag

SEQ ID NO: 366989 - DNA, 25 bp, Rattus norvegicus
gatgctccaagtgtcatgtctagag

SEQ ID NO: 366990 - DNA, 25 bp, Rattus norvegicus
gatgctccacacaaaatgtaacggt

SEQ ID NO: 366991 - DNA, 25 bp, Rattus norvegicus
gatgctccacactaaatgtaacggt

SEQ ID NO: 366992 - DNA, 25 bp, Rattus norvegicus
gatgctccagacaccaaagggttta

SEQ ID NO: 366993 - DNA, 25 bp, Rattus norvegicus
gatgctccagactccaaagggttta

SEQ ID NO: 366994 - DNA, 25 bp, Rattus norvegicus
gatgctccagtgcttgctcgcgata

SEQ ID NO: 366995 - DNA, 25 bp, Rattus norvegicus
gatgctccagtggttgctcgcgata

SEQ ID NO: 366996 - DNA, 25 bp, Rattus norvegicus
gatgctccatctagaccatgtgcaa

SEQ ID NO: 366997 - DNA, 25 bp, Rattus norvegicus
gatgctccatcttgaccatgtgcaa

SEQ ID NO: 366998 - DNA, 25 bp, Rattus norvegicus
gatgctccatttctttaatgccttc

SEQ ID NO: 366999 - DNA, 25 bp, Rattus norvegicus
gatgctccatttgtttaatgccttc

SEQ ID NO: 367000 - DNA, 25 bp, Rattus norvegicus
gatgctcccaatctatagtttcaga

SEQ ID NO: 367001 - DNA, 25 bp, Rattus norvegicus
gatgctcccaatgtatagtttcaga

SEQ ID NO: 367002 - DNA, 25 bp, Rattus norvegicus
gatgctccccacaaagggattcgaa

SEQ ID NO: 367003 - DNA, 25 bp, Rattus norvegicus
gatgctccccactaagggattcgaa

SEQ ID NO: 367004 - DNA, 25 bp, Rattus norvegicus
gatgctccctgcaatcagtggtaga

SEQ ID NO: 367005 - DNA, 25 bp, Rattus norvegicus
gatgctccctgctatcagtggtaga

SEQ ID NO: 367006 - DNA, 25 bp, Rattus norvegicus
gatgctccgttcagaggcttctgtg

SEQ ID NO: 367007 - DNA, 25 bp, Rattus norvegicus
gatgctccgttctgaggcttctgtg

SEQ ID NO: 367008 - DNA, 25 bp, Rattus norvegicus
gatgctcctagtctgtttatgtcag

SEQ ID NO: 367009 - DNA, 25 bp, Rattus norvegicus
gatgctcctagtgtgtttatgtcag

SEQ ID NO: 367010 - DNA, 25 bp, Rattus norvegicus
gatgctcctatgcatattcctggcc

SEQ ID NO: 367011 - DNA, 25 bp, Rattus norvegicus
gatgctcctatggatattcctggcc

SEQ ID NO: 367012 - DNA, 25 bp, Rattus norvegicus
gatgctcctgtgagaagccgtagct

SEQ ID NO: 367013 - DNA, 25 bp, Rattus norvegicus
gatgctcctgtgtgaagccgtagct

SEQ ID NO: 367014 - DNA, 25 bp, Rattus norvegicus
gatgctccttcgatgatggttgata

SEQ ID NO: 367015 - DNA, 25 bp, Rattus norvegicus
gatgctccttcgttgatggttgata

SEQ ID NO: 367016 - DNA, 25 bp, Rattus norvegicus
gatgctccttgtattagaagacatt

SEQ ID NO: 367017 - DNA, 25 bp, Rattus norvegicus
gatgctccttgttttagaagacatt

SEQ ID NO: 367018 - DNA, 25 bp, Rattus norvegicus
gatgctcgacacagctggacagttt

SEQ ID NO: 367019 - DNA, 25 bp, Rattus norvegicus
gatgctcgacactgctggacagttt

SEQ ID NO: 367020 - DNA, 25 bp, Rattus norvegicus
gatgctcgaccaacaacaactgaaa

SEQ ID NO: 367021 - DNA, 25 bp, Rattus norvegicus
gatgctcgaccatcaacaactgaaa

SEQ ID NO: 367022 - DNA, 25 bp, Rattus norvegicus
gatgctcgagcacggtctgtaacct

SEQ ID NO: 367023 - DNA, 25 bp, Rattus norvegicus
gatgctcgagcagggtctgtaacct

SEQ ID NO: 367024 - DNA, 25 bp, Rattus norvegicus
gatgctcggtggatagagccttgct

SEQ ID NO: 367025 - DNA, 25 bp, Rattus norvegicus
gatgctcggtggttagagccttgct

SEQ ID NO: 367026 - DNA, 25 bp, Rattus norvegicus
gatgctcgtactatcggtaatgatg

SEQ ID NO: 367027 - DNA, 25 bp, Rattus norvegicus
gatgctcgtactttcggtaatgatg

SEQ ID NO: 367028 - DNA, 25 bp, Rattus norvegicus
gatgctcgtatgagtcaccacacca

SEQ ID NO: 367029 - DNA, 25 bp, Rattus norvegicus
gatgctcgtatgtgtcaccacacca

SEQ ID NO: 367030 - DNA, 25 bp, Rattus norvegicus
gatgctcgtctgcttcgaaagtcac

SEQ ID NO: 367031 - DNA, 25 bp, Rattus norvegicus
gatgctcgtctggttcgaaagtcac

SEQ ID NO: 367032 - DNA, 25 bp, Rattus norvegicus
gatgctcgtgacacactgaagcaca

SEQ ID NO: 367033 - DNA, 25 bp, Rattus norvegicus
gatgctcgtgactcactgaagcaca

SEQ ID NO: 367034 - DNA, 25 bp, Rattus norvegicus
gatgctcgtgccatattacgttttc

SEQ ID NO: 367035 - DNA, 25 bp, Rattus norvegicus
gatgctcgtgccttattacgttttc

SEQ ID NO: 367036 - DNA, 25 bp, Rattus norvegicus
gatgctctaacaactcgaaatgcca

SEQ ID NO: 367037 - DNA, 25 bp, Rattus norvegicus
gatgctctaacatctcgaaatgcca

SEQ ID NO: 367038 - DNA, 25 bp, Rattus norvegicus
gatgctctaagaactcagctgagtt

SEQ ID NO: 367039 - DNA, 25 bp, Rattus norvegicus
gatgctctaagatctcagctgagtt

SEQ ID NO: 367040 - DNA, 25 bp, Rattus norvegicus
gatgctctaagtcaaactctttatg

SEQ ID NO: 367041 - DNA, 25 bp, Rattus norvegicus
gatgctctaagtgaaactctttatg

SEQ ID NO: 367042 - DNA, 25 bp, Rattus norvegicus
gatgctctagcaagagtgaccgcca

SEQ ID NO: 367043 - DNA, 25 bp, Rattus norvegicus
gatgctctagcatgagtgaccgcca

SEQ ID NO: 367044 - DNA, 25 bp, Rattus norvegicus
gatgctctagccaatgaatggccgc

SEQ ID NO: 367045 - DNA, 25 bp, Rattus norvegicus
gatgctctagcctatgaatggccgc

SEQ ID NO: 367046 - DNA, 25 bp, Rattus norvegicus
gatgctctatgacagttcattcctg

SEQ ID NO: 367047 - DNA, 25 bp, Rattus norvegicus
gatgctctatgagagttcattcctg

SEQ ID NO: 367048 - DNA, 25 bp, Rattus norvegicus
gatgctctatggcttgatccacgcc

SEQ ID NO: 367049 - DNA, 25 bp, Rattus norvegicus
gatgctctatgggttgatccacgcc

SEQ ID NO: 367050 - DNA, 25 bp, Rattus norvegicus
gatgctctatttcaatgtgttctgt

SEQ ID NO: 367051 - DNA, 25 bp, Rattus norvegicus
gatgctctatttgaatgtgttctgt

SEQ ID NO: 367052 - DNA, 25 bp, Rattus norvegicus
gatgctctcacacgacttgaggctt

SEQ ID NO: 367053 - DNA, 25 bp, Rattus norvegicus
gatgctctcacaggacttgaggctt

SEQ ID NO: 367054 - DNA, 25 bp, Rattus norvegicus
gatgctctcagaagacaactctagg

SEQ ID NO: 367055 - DNA, 25 bp, Rattus norvegicus
gatgctctcagactatgctgacctg

SEQ ID NO: 367056 - DNA, 25 bp, Rattus norvegicus
gatgctctcagagtatgctgacctg

SEQ ID NO: 367057 - DNA, 25 bp, Rattus norvegicus
gatgctctcagatgacaactctagg

SEQ ID NO: 367058 - DNA, 25 bp, Rattus norvegicus
gatgctctcaggctcctgagtcaac

SEQ ID NO: 367059 - DNA, 25 bp, Rattus norvegicus
gatgctctcagggtcctgagtcaac

SEQ ID NO: 367060 - DNA, 25 bp, Rattus norvegicus
gatgctctcagtatcctggcttttt

SEQ ID NO: 367061 - DNA, 25 bp, Rattus norvegicus
gatgctctcagtccagccaaggatg

SEQ ID NO: 367062 - DNA, 25 bp, Rattus norvegicus
gatgctctcagtccatagatgtagg

SEQ ID NO: 367063 - DNA, 25 bp, Rattus norvegicus
gatgctctcagtgcagccaaggatg

SEQ ID NO: 367064 - DNA, 25 bp, Rattus norvegicus
gatgctctcagtgcatagatgtagg

SEQ ID NO: 367065 - DNA, 25 bp, Rattus norvegicus
gatgctctcagtttcctggcttttt

SEQ ID NO: 367066 - DNA, 25 bp, Rattus norvegicus
gatgctctccagaactcttgttaaa

SEQ ID NO: 367067 - DNA, 25 bp, Rattus norvegicus
gatgctctccagtactcttgttaaa

SEQ ID NO: 367068 - DNA, 25 bp, Rattus norvegicus
gatgctctccatagtgccagcagaa

SEQ ID NO: 367069 - DNA, 25 bp, Rattus norvegicus
gatgctctccattgtgccagcagaa

SEQ ID NO: 367070 - DNA, 25 bp, Rattus norvegicus
gatgctctctgcaattcaacagtcc

SEQ ID NO: 367071 - DNA, 25 bp, Rattus norvegicus
gatgctctctgctattcaacagtcc

SEQ ID NO: 367072 - DNA, 25 bp, Rattus norvegicus
gatgctctcttccttgcttaatttg

SEQ ID NO: 367073 - DNA, 25 bp, Rattus norvegicus
gatgctctcttcgttgcttaatttg

SEQ ID NO: 367074 - DNA, 25 bp, Rattus norvegicus
gatgctctgcccattcagaagcagg

SEQ ID NO: 367075 - DNA, 25 bp, Rattus norvegicus
gatgctctgccctttcagaagcagg

SEQ ID NO: 367076 - DNA, 25 bp, Rattus norvegicus
gatgctctgttgaaccttcatagct

SEQ ID NO: 367077 - DNA, 25 bp, Rattus norvegicus
gatgctctgttgaataaaccctggt

SEQ ID NO: 367078 - DNA, 25 bp, Rattus norvegicus
gatgctctgttgtaccttcatagct

SEQ ID NO: 367079 - DNA, 25 bp, Rattus norvegicus
gatgctctgttgtataaaccctggt

SEQ ID NO: 367080 - DNA, 25 bp, Rattus norvegicus
gatgctcttctaatggaaacggccg

SEQ ID NO: 367081 - DNA, 25 bp, Rattus norvegicus
gatgctcttctattggaaacggccg

SEQ ID NO: 367082 - DNA, 25 bp, Rattus norvegicus
gatgctcttggcacagggactgatg

SEQ ID NO: 367083 - DNA, 25 bp, Rattus norvegicus
gatgctcttggctcagggactgatg

SEQ ID NO: 367084 - DNA, 25 bp, Rattus norvegicus
gatgctcttgtacctgccagcgtag

SEQ ID NO: 367085 - DNA, 25 bp, Rattus norvegicus
gatgctcttgtagctgccagcgtag

SEQ ID NO: 367086 - DNA, 25 bp, Rattus norvegicus
gatgctcttgtgacactgctgtcct

SEQ ID NO: 367087 - DNA, 25 bp, Rattus norvegicus
gatgctcttgtgtcactgctgtcct

SEQ ID NO: 367088 - DNA, 25 bp, Rattus norvegicus
gatgctctttccaaagacagagttt

SEQ ID NO: 367089 - DNA, 25 bp, Rattus norvegicus
gatgctctttcctaagacagagttt

SEQ ID NO: 367090 - DNA, 25 bp, Rattus norvegicus
gatgctctttgaagggtctgaacag

SEQ ID NO: 367091 - DNA, 25 bp, Rattus norvegicus
gatgctctttgatgggtctgaacag

SEQ ID NO: 367092 - DNA, 25 bp, Rattus norvegicus
gatgctctttggaacttgtttctca

SEQ ID NO: 367093 - DNA, 25 bp, Rattus norvegicus
gatgctctttggtacttgtttctca

SEQ ID NO: 367094 - DNA, 25 bp, Rattus norvegicus
gatgctgaaaaaagccacttttggc

SEQ ID NO: 367095 - DNA, 25 bp, Rattus norvegicus
gatgctgaaaaatgccacttttggc

SEQ ID NO: 367096 - DNA, 25 bp, Rattus norvegicus
gatgctgaacagcttctgtctggac

SEQ ID NO: 367097 - DNA, 25 bp, Rattus norvegicus
gatgctgaacaggttctgtctggac

SEQ ID NO: 367098 - DNA, 25 bp, Rattus norvegicus
gatgctgaagagacgggccaggcca

SEQ ID NO: 367099 - DNA, 25 bp, Rattus norvegicus
gatgctgaagagtcgggccaggcca

SEQ ID NO: 367100 - DNA, 25 bp, Rattus norvegicus
gatgctgaagatacccagtgagttc

SEQ ID NO: 367101 - DNA, 25 bp, Rattus norvegicus
gatgctgaagattcccagtgagttc

SEQ ID NO: 367102 - DNA, 25 bp, Rattus norvegicus
gatgctgaagcgcatccactcctta

SEQ ID NO: 367103 - DNA, 25 bp, Rattus norvegicus
gatgctgaagcggatccactcctta

SEQ ID NO: 367104 - DNA, 25 bp, Rattus norvegicus
gatgctgacagtatctggagcctta

SEQ ID NO: 367105 - DNA, 25 bp, Rattus norvegicus
gatgctgacagtttctggagcctta

SEQ ID NO: 367106 - DNA, 25 bp, Rattus norvegicus
gatgctgacgacagaagccctaata

SEQ ID NO: 367107 - DNA, 25 bp, Rattus norvegicus
gatgctgacgactgaagccctaata

SEQ ID NO: 367108 - DNA, 25 bp, Rattus norvegicus
gatgctgacggaagcaagacccagg

SEQ ID NO: 367109 - DNA, 25 bp, Rattus norvegicus
gatgctgacggatgcaagacccagg

SEQ ID NO: 367110 - DNA, 25 bp, Rattus norvegicus
gatgctgactcacctgtaatgctat

SEQ ID NO: 367111 - DNA, 25 bp, Rattus norvegicus
gatgctgactcagctgtaatgctat

SEQ ID NO: 367112 - DNA, 25 bp, Rattus norvegicus
gatgctgactgaagagttactcttt

SEQ ID NO: 367113 - DNA, 25 bp, Rattus norvegicus
gatgctgactgatgagttactcttt

SEQ ID NO: 367114 - DNA, 25 bp, Rattus norvegicus
gatgctgacttgatggcgagcctct

SEQ ID NO: 367115 - DNA, 25 bp, Rattus norvegicus
gatgctgacttgctgagaccttgaa

SEQ ID NO: 367116 - DNA, 25 bp, Rattus norvegicus
gatgctgacttggtgagaccttgaa

SEQ ID NO: 367117 - DNA, 25 bp, Rattus norvegicus
gatgctgacttgttggcgagcctct

SEQ ID NO: 367118 - DNA, 25 bp, Rattus norvegicus
gatgctgagaccatccgggacatgt

SEQ ID NO: 367119 - DNA, 25 bp, Rattus norvegicus
gatgctgagaccttccgggacatgt

SEQ ID NO: 367120 - DNA, 25 bp, Rattus norvegicus
gatgctgagcggataccgtgtgctt

SEQ ID NO: 367121 - DNA, 25 bp, Rattus norvegicus
gatgctgagcggttaccgtgtgctt

SEQ ID NO: 367122 - DNA, 25 bp, Rattus norvegicus
gatgctgagctgaacggacccttta

SEQ ID NO: 367123 - DNA, 25 bp, Rattus norvegicus
gatgctgagctgtacggacccttta

SEQ ID NO: 367124 - DNA, 25 bp, Rattus norvegicus
gatgctgaggcaatactggctgcag

SEQ ID NO: 367125 - DNA, 25 bp, Rattus norvegicus
gatgctgaggcattactggctgcag

SEQ ID NO: 367126 - DNA, 25 bp, Rattus norvegicus
gatgctgaggttagccctttgtata

SEQ ID NO: 367127 - DNA, 25 bp, Rattus norvegicus
gatgctgaggtttgccctttgtata

SEQ ID NO: 367128 - DNA, 25 bp, Rattus norvegicus
gatgctgagtcccagtttggtgacc

SEQ ID NO: 367129 - DNA, 25 bp, Rattus norvegicus
gatgctgagtccgagtttggtgacc

SEQ ID NO: 367130 - DNA, 25 bp, Rattus norvegicus
gatgctgatccaaatgacccaacgg

SEQ ID NO: 367131 - DNA, 25 bp, Rattus norvegicus
gatgctgatccatatgacccaacgg

SEQ ID NO: 367132 - DNA, 25 bp, Rattus norvegicus
gatgctgatcccaaacgactgttat

SEQ ID NO: 367133 - DNA, 25 bp, Rattus norvegicus
gatgctgatcccagctgatgtcagt

SEQ ID NO: 367134 - DNA, 25 bp, Rattus norvegicus
gatgctgatccccatgtggtaccca

SEQ ID NO: 367135 - DNA, 25 bp, Rattus norvegicus
gatgctgatcccgatgtggtaccca

SEQ ID NO: 367136 - DNA, 25 bp, Rattus norvegicus
gatgctgatccctaacgactgttat

SEQ ID NO: 367137 - DNA, 25 bp, Rattus norvegicus
gatgctgatccctgctgatgtcagt

SEQ ID NO: 367138 - DNA, 25 bp, Rattus norvegicus
gatgctgatcctattctgagatgtg

SEQ ID NO: 367139 - DNA, 25 bp, Rattus norvegicus
gatgctgatccttttctgagatgtg

SEQ ID NO: 367140 - DNA, 25 bp, Rattus norvegicus
gatgctgatcttaaggtgtccacca

SEQ ID NO: 367141 - DNA, 25 bp, Rattus norvegicus
gatgctgatctttaggtgtccacca

SEQ ID NO: 367142 - DNA, 25 bp, Rattus norvegicus
gatgctgatggaagttgtcccacca

SEQ ID NO: 367143 - DNA, 25 bp, Rattus norvegicus
gatgctgatggatgttgtcccacca

SEQ ID NO: 367144 - DNA, 25 bp, Rattus norvegicus
gatgctgatggcaatgggaccattg

SEQ ID NO: 367145 - DNA, 25 bp, Rattus norvegicus
gatgctgatggctatgggaccattg

SEQ ID NO: 367146 - DNA, 25 bp, Rattus norvegicus
gatgctgattatccaggcactccac

SEQ ID NO: 367147 - DNA, 25 bp, Rattus norvegicus
gatgctgattatgcaggcactccac

SEQ ID NO: 367148 - DNA, 25 bp, Rattus norvegicus
gatgctgattgaccatatgcccgac

SEQ ID NO: 367149 - DNA, 25 bp, Rattus norvegicus
gatgctgattgagcatatgcccgac

SEQ ID NO: 367150 - DNA, 25 bp, Rattus norvegicus
gatgctgattggctagagtcttctt

SEQ ID NO: 367151 - DNA, 25 bp, Rattus norvegicus
gatgctgattgggtagagtcttctt

SEQ ID NO: 367152 - DNA, 25 bp, Rattus norvegicus
gatgctgattttaacacctctctct

SEQ ID NO: 367153 - DNA, 25 bp, Rattus norvegicus
gatgctgatttttacacctctctct

SEQ ID NO: 367154 - DNA, 25 bp, Rattus norvegicus
gatgctgcaagcataagtactgtca

SEQ ID NO: 367155 - DNA, 25 bp, Rattus norvegicus
gatgctgcaagcttaagtactgtca

SEQ ID NO: 367156 - DNA, 25 bp, Rattus norvegicus
gatgctgcaatgaaccctttaccaa

SEQ ID NO: 367157 - DNA, 25 bp, Rattus norvegicus
gatgctgcaatgtaccctttaccaa

SEQ ID NO: 367158 - DNA, 25 bp, Rattus norvegicus
gatgctgcacataccaaccatggag

SEQ ID NO: 367159 - DNA, 25 bp, Rattus norvegicus
gatgctgcacattccaaccatggag

SEQ ID NO: 367160 - DNA, 25 bp, Rattus norvegicus
gatgctgcagaaagcactgaccacc

SEQ ID NO: 367161 - DNA, 25 bp, Rattus norvegicus
gatgctgcagaaagtacccctgatt

SEQ ID NO: 367162 - DNA, 25 bp, Rattus norvegicus
gatgctgcagaatgcactgaccacc

SEQ ID NO: 367163 - DNA, 25 bp, Rattus norvegicus
gatgctgcagaatgtacccctgatt

SEQ ID NO: 367164 - DNA, 25 bp, Rattus norvegicus
gatgctgcagagactgagaacttga

SEQ ID NO: 367165 - DNA, 25 bp, Rattus norvegicus
gatgctgcagagtctgagaacttga

SEQ ID NO: 367166 - DNA, 25 bp, Rattus norvegicus
gatgctgcagatcaccaagcaggcc

SEQ ID NO: 367167 - DNA, 25 bp, Rattus norvegicus
gatgctgcagatgaccaagcaggcc

SEQ ID NO: 367168 - DNA, 25 bp, Rattus norvegicus
gatgctgcagctaaacgaaacaccc

SEQ ID NO: 367169 - DNA, 25 bp, Rattus norvegicus
gatgctgcagcttaacgaaacaccc

SEQ ID NO: 367170 - DNA, 25 bp, Rattus norvegicus
gatgctgcaggacaccaaggatatc

SEQ ID NO: 367171 - DNA, 25 bp, Rattus norvegicus
gatgctgcaggagaccaaggatatc

SEQ ID NO: 367172 - DNA, 25 bp, Rattus norvegicus
gatgctgcatggctcctaaaggaca

SEQ ID NO: 367173 - DNA, 25 bp, Rattus norvegicus
gatgctgcatgggtcctaaaggaca

SEQ ID NO: 367174 - DNA, 25 bp, Rattus norvegicus
gatgctgcatttagttgtacctttt

SEQ ID NO: 367175 - DNA, 25 bp, Rattus norvegicus
gatgctgcattttgttgtacctttt

SEQ ID NO: 367176 - DNA, 25 bp, Rattus norvegicus
gatgctgccactagatgtcagcaca

SEQ ID NO: 367177 - DNA, 25 bp, Rattus norvegicus
gatgctgccacttgatgtcagcaca

SEQ ID NO: 367178 - DNA, 25 bp, Rattus norvegicus
gatgctgccagaccccaagaatgtg

SEQ ID NO: 367179 - DNA, 25 bp, Rattus norvegicus
gatgctgccagagcccaagaatgtg

SEQ ID NO: 367180 - DNA, 25 bp, Rattus norvegicus
gatgctgccatcactttgtgtcatt

SEQ ID NO: 367181 - DNA, 25 bp, Rattus norvegicus
gatgctgccatctctttgtgtcatt

SEQ ID NO: 367182 - DNA, 25 bp, Rattus norvegicus
gatgctgccctgcaaatactgtatt

SEQ ID NO: 367183 - DNA, 25 bp, Rattus norvegicus
gatgctgccctggaaatactgtatt

SEQ ID NO: 367184 - DNA, 25 bp, Rattus norvegicus
gatgctgcccttcagttttgttcaa

SEQ ID NO: 367185 - DNA, 25 bp, Rattus norvegicus
gatgctgcccttgagttttgttcaa

SEQ ID NO: 367186 - DNA, 25 bp, Rattus norvegicus
gatgctgccgagcataatcctcttt

SEQ ID NO: 367187 - DNA, 25 bp, Rattus norvegicus
gatgctgccgaggataatcctcttt

SEQ ID NO: 367188 - DNA, 25 bp, Rattus norvegicus
gatgctgccgataggctggacgata

SEQ ID NO: 367189 - DNA, 25 bp, Rattus norvegicus
gatgctgccgattggctggacgata

SEQ ID NO: 367190 - DNA, 25 bp, Rattus norvegicus
gatgctgcctcccaccgaatcaaaa

SEQ ID NO: 367191 - DNA, 25 bp, Rattus norvegicus
gatgctgcctccgaccgaatcaaaa

SEQ ID NO: 367192 - DNA, 25 bp, Rattus norvegicus
gatgctgcctggatgttttcagcca

SEQ ID NO: 367193 - DNA, 25 bp, Rattus norvegicus
gatgctgcctggttgttttcagcca

SEQ ID NO: 367194 - DNA, 25 bp, Rattus norvegicus
gatgctgccttaagaattgcatgtt

SEQ ID NO: 367195 - DNA, 25 bp, Rattus norvegicus
gatgctgccttaatgtccggtggta

SEQ ID NO: 367196 - DNA, 25 bp, Rattus norvegicus
gatgctgccttatgaattgcatgtt

SEQ ID NO: 367197 - DNA, 25 bp, Rattus norvegicus
gatgctgccttattgtccggtggta

SEQ ID NO: 367198 - DNA, 25 bp, Rattus norvegicus
gatgctgccttcagataatggaaca

SEQ ID NO: 367199 - DNA, 25 bp, Rattus norvegicus
gatgctgccttctgataatggaaca

SEQ ID NO: 367200 - DNA, 25 bp, Rattus norvegicus
gatgctgcgagcatatcactgtgag

SEQ ID NO: 367201 - DNA, 25 bp, Rattus norvegicus
gatgctgcgagcttatcactgtgag

SEQ ID NO: 367202 - DNA, 25 bp, Rattus norvegicus
gatgctgcgtatccagttccattaa

SEQ ID NO: 367203 - DNA, 25 bp, Rattus norvegicus
gatgctgcgtatgcagttccattaa

SEQ ID NO: 367204 - DNA, 25 bp, Rattus norvegicus
gatgctgctaagatacactgcaagt

SEQ ID NO: 367205 - DNA, 25 bp, Rattus norvegicus
gatgctgctaagttacactgcaagt

SEQ ID NO: 367206 - DNA, 25 bp, Rattus norvegicus
gatgctgctacaccttaaaacgcct

SEQ ID NO: 367207 - DNA, 25 bp, Rattus norvegicus
gatgctgctacagcttaaaacgcct

SEQ ID NO: 367208 - DNA, 25 bp, Rattus norvegicus
gatgctgctaccagctttttgcggg

SEQ ID NO: 367209 - DNA, 25 bp, Rattus norvegicus
gatgctgctacctgctttttgcggg

SEQ ID NO: 367210 - DNA, 25 bp, Rattus norvegicus
gatgctgctatgacaccaggactag

SEQ ID NO: 367211 - DNA, 25 bp, Rattus norvegicus
gatgctgctatgtcaccaggactag

SEQ ID NO: 367212 - DNA, 25 bp, Rattus norvegicus
gatgctgctcttaggcgtaaattgc

SEQ ID NO: 367213 - DNA, 25 bp, Rattus norvegicus
gatgctgctctttggcgtaaattgc

SEQ ID NO: 367214 - DNA, 25 bp, Rattus norvegicus
gatgctgctggaactgaccgagaaa

SEQ ID NO: 367215 - DNA, 25 bp, Rattus norvegicus
gatgctgctggatctgaccgagaaa

SEQ ID NO: 367216 - DNA, 25 bp, Rattus norvegicus
gatgctgctgtacaacaatgtcgct

SEQ ID NO: 367217 - DNA, 25 bp, Rattus norvegicus
gatgctgctgtagaacaatgtcgct

SEQ ID NO: 367218 - DNA, 25 bp, Rattus norvegicus
gatgctgctgtcagtcaagctgtca

SEQ ID NO: 367219 - DNA, 25 bp, Rattus norvegicus
gatgctgctgtctgtcaagctgtca

SEQ ID NO: 367220 - DNA, 25 bp, Rattus norvegicus
gatgctgctgtgaggtcagacctta

SEQ ID NO: 367221 - DNA, 25 bp, Rattus norvegicus
gatgctgctgtgtggtcagacctta

SEQ ID NO: 367222 - DNA, 25 bp, Rattus norvegicus
gatgctgctgttactggccatataa

SEQ ID NO: 367223 - DNA, 25 bp, Rattus norvegicus
gatgctgctgttagtgtctcatggt

SEQ ID NO: 367224 - DNA, 25 bp, Rattus norvegicus
gatgctgctgttcggaccttgagac

SEQ ID NO: 367225 - DNA, 25 bp, Rattus norvegicus
gatgctgctgttgggaccttgagac

SEQ ID NO: 367226 - DNA, 25 bp, Rattus norvegicus
gatgctgctgtttctggccatataa

SEQ ID NO: 367227 - DNA, 25 bp, Rattus norvegicus
gatgctgctgtttgtgtctcatggt

SEQ ID NO: 367228 - DNA, 25 bp, Rattus norvegicus
gatgctgcttctacagctgtgggaa

SEQ ID NO: 367229 - DNA, 25 bp, Rattus norvegicus
gatgctgcttcttcagctgtgggaa

SEQ ID NO: 367230 - DNA, 25 bp, Rattus norvegicus
gatgctgcttgacttggaaactgga

SEQ ID NO: 367231 - DNA, 25 bp, Rattus norvegicus
gatgctgcttgagttggaaactgga

SEQ ID NO: 367232 - DNA, 25 bp, Rattus norvegicus
gatgctggacttaggatctctagtg

SEQ ID NO: 367233 - DNA, 25 bp, Rattus norvegicus
gatgctggactttggatctctagtg

SEQ ID NO: 367234 - DNA, 25 bp, Rattus norvegicus
gatgctggagaccatcccagaggaa

SEQ ID NO: 367235 - DNA, 25 bp, Rattus norvegicus
gatgctggagacgatcccagaggaa

SEQ ID NO: 367236 - DNA, 25 bp, Rattus norvegicus
gatgctggaggcacactgtcctcaa

SEQ ID NO: 367237 - DNA, 25 bp, Rattus norvegicus
gatgctggaggcagacactgactgc

SEQ ID NO: 367238 - DNA, 25 bp, Rattus norvegicus
gatgctggaggctcactgtcctcaa

SEQ ID NO: 367239 - DNA, 25 bp, Rattus norvegicus
gatgctggaggctgacactgactgc

SEQ ID NO: 367240 - DNA, 25 bp, Rattus norvegicus
gatgctggatacactaacggacaca

SEQ ID NO: 367241 - DNA, 25 bp, Rattus norvegicus
gatgctggatactctaacggacaca

SEQ ID NO: 367242 - DNA, 25 bp, Rattus norvegicus
gatgctggatgaaccttctctgaag

SEQ ID NO: 367243 - DNA, 25 bp, Rattus norvegicus
gatgctggatgatccttctctgaag

SEQ ID NO: 367244 - DNA, 25 bp, Rattus norvegicus
gatgctggcaggcactctcagatac

SEQ ID NO: 367245 - DNA, 25 bp, Rattus norvegicus
gatgctggcagggactctcagatac

SEQ ID NO: 367246 - DNA, 25 bp, Rattus norvegicus
gatgctggccacaggttacagcttt

SEQ ID NO: 367247 - DNA, 25 bp, Rattus norvegicus
gatgctggccactggttacagcttt

SEQ ID NO: 367248 - DNA, 25 bp, Rattus norvegicus
gatgctggcccaactttgggtggta

SEQ ID NO: 367249 - DNA, 25 bp, Rattus norvegicus
gatgctggcccacttaacatagtga

SEQ ID NO: 367250 - DNA, 25 bp, Rattus norvegicus
gatgctggcccagttaacatagtga

SEQ ID NO: 367251 - DNA, 25 bp, Rattus norvegicus
gatgctggcccatctttgggtggta

SEQ ID NO: 367252 - DNA, 25 bp, Rattus norvegicus
gatgctggcctcagagttttgagcc

SEQ ID NO: 367253 - DNA, 25 bp, Rattus norvegicus
gatgctggcctctgagttttgagcc

SEQ ID NO: 367254 - DNA, 25 bp, Rattus norvegicus
gatgctggcggcctgcgtgcgtgca

SEQ ID NO: 367255 - DNA, 25 bp, Rattus norvegicus
gatgctggcggcgtgcgtgcgtgca

SEQ ID NO: 367256 - DNA, 25 bp, Rattus norvegicus
gatgctggctatatctttgggctgc

SEQ ID NO: 367257 - DNA, 25 bp, Rattus norvegicus
gatgctggctatttctttgggctgc

SEQ ID NO: 367258 - DNA, 25 bp, Rattus norvegicus
gatgctggctcacaacttacagaga

SEQ ID NO: 367259 - DNA, 25 bp, Rattus norvegicus
gatgctggctcagaacttacagaga

SEQ ID NO: 367260 - DNA, 25 bp, Rattus norvegicus
gatgctggctttagtgtcactacta

SEQ ID NO: 367261 - DNA, 25 bp, Rattus norvegicus
gatgctggcttttgtgtcactacta

SEQ ID NO: 367262 - DNA, 25 bp, Rattus norvegicus
gatgctgggaatacctcagagaacc

SEQ ID NO: 367263 - DNA, 25 bp, Rattus norvegicus
gatgctgggaattcctcagagaacc

SEQ ID NO: 367264 - DNA, 25 bp, Rattus norvegicus
gatgctgggactcacaggagcccca

SEQ ID NO: 367265 - DNA, 25 bp, Rattus norvegicus
gatgctgggactgacaggagcccca

SEQ ID NO: 367266 - DNA, 25 bp, Rattus norvegicus
gatgctgggatcaccacacgggaat

SEQ ID NO: 367267 - DNA, 25 bp, Rattus norvegicus
gatgctgggatctccacacgggaat

SEQ ID NO: 367268 - DNA, 25 bp, Rattus norvegicus
gatgctgggcaaactatctcaaact

SEQ ID NO: 367269 - DNA, 25 bp, Rattus norvegicus
gatgctgggcaatctatctcaaact

SEQ ID NO: 367270 - DNA, 25 bp, Rattus norvegicus
gatgctgggttgaaactgtttgaaa

SEQ ID NO: 367271 - DNA, 25 bp, Rattus norvegicus
gatgctgggttgctgcacagtcatt

SEQ ID NO: 367272 - DNA, 25 bp, Rattus norvegicus
gatgctgggttggtgcacagtcatt

SEQ ID NO: 367273 - DNA, 25 bp, Rattus norvegicus
gatgctgggttgtaactgtttgaaa

SEQ ID NO: 367274 - DNA, 25 bp, Rattus norvegicus
gatgctggtaaccagacctttccat

SEQ ID NO: 367275 - DNA, 25 bp, Rattus norvegicus
gatgctggtaacgagacctttccat

SEQ ID NO: 367276 - DNA, 25 bp, Rattus norvegicus
gatgctggtagccatgaccactgat

SEQ ID NO: 367277 - DNA, 25 bp, Rattus norvegicus
gatgctggtagcgatgaccactgat

SEQ ID NO: 367278 - DNA, 25 bp, Rattus norvegicus
gatgctggtgcacatacttgcatac

SEQ ID NO: 367279 - DNA, 25 bp, Rattus norvegicus
gatgctggtgcagatacttgcatac

SEQ ID NO: 367280 - DNA, 25 bp, Rattus norvegicus
gatgctggtgcccacagctgtctgc

SEQ ID NO: 367281 - DNA, 25 bp, Rattus norvegicus
gatgctggtgccgacagctgtctgc

SEQ ID NO: 367282 - DNA, 25 bp, Rattus norvegicus
gatgctgtaaacaagctagccatgc

SEQ ID NO: 367283 - DNA, 25 bp, Rattus norvegicus
gatgctgtaaactagctagccatgc

SEQ ID NO: 367284 - DNA, 25 bp, Rattus norvegicus
gatgctgtacctagacgagaatgaa

SEQ ID NO: 367285 - DNA, 25 bp, Rattus norvegicus
gatgctgtaccttgacgagaatgaa

SEQ ID NO: 367286 - DNA, 25 bp, Rattus norvegicus
gatgctgtagcaactaaaggtccca

SEQ ID NO: 367287 - DNA, 25 bp, Rattus norvegicus
gatgctgtagcatctaaaggtccca

SEQ ID NO: 367288 - DNA, 25 bp, Rattus norvegicus
gatgctgtagctcgtcagggctaat

SEQ ID NO: 367289 - DNA, 25 bp, Rattus norvegicus
gatgctgtagctggtcagggctaat

SEQ ID NO: 367290 - DNA, 25 bp, Rattus norvegicus
gatgctgtatatctgtgcctactgt

SEQ ID NO: 367291 - DNA, 25 bp, Rattus norvegicus
gatgctgtatatgtgtgcctactgt

SEQ ID NO: 367292 - DNA, 25 bp, Rattus norvegicus
gatgctgtcaatcatatgtaccacg

SEQ ID NO: 367293 - DNA, 25 bp, Rattus norvegicus
gatgctgtcaatgatatgtaccacg

SEQ ID NO: 367294 - DNA, 25 bp, Rattus norvegicus
gatgctgtcagaatcctcaggtaga

SEQ ID NO: 367295 - DNA, 25 bp, Rattus norvegicus
gatgctgtcagattcctcaggtaga

SEQ ID NO: 367296 - DNA, 25 bp, Rattus norvegicus
gatgctgtcagcatgggataacaat

SEQ ID NO: 367297 - DNA, 25 bp, Rattus norvegicus
gatgctgtcagcttgggataacaat

SEQ ID NO: 367298 - DNA, 25 bp, Rattus norvegicus
gatgctgtcatgctaggcgatattt

SEQ ID NO: 367299 - DNA, 25 bp, Rattus norvegicus
gatgctgtcatggtaggcgatattt

SEQ ID NO: 367300 - DNA, 25 bp, Rattus norvegicus
gatgctgtccagagattacctgaac

SEQ ID NO: 367301 - DNA, 25 bp, Rattus norvegicus
gatgctgtccagtgattacctgaac

SEQ ID NO: 367302 - DNA, 25 bp, Rattus norvegicus
gatgctgtccatctttcgatcaaaa

SEQ ID NO: 367303 - DNA, 25 bp, Rattus norvegicus
gatgctgtccatgtttcgatcaaaa

SEQ ID NO: 367304 - DNA, 25 bp, Rattus norvegicus
gatgctgtcctgagaagtaaccatt

SEQ ID NO: 367305 - DNA, 25 bp, Rattus norvegicus
gatgctgtcctgtgaagtaaccatt

SEQ ID NO: 367306 - DNA, 25 bp, Rattus norvegicus
gatgctgtccttaggttacagatta

SEQ ID NO: 367307 - DNA, 25 bp, Rattus norvegicus
gatgctgtccttccagaacaattac

SEQ ID NO: 367308 - DNA, 25 bp, Rattus norvegicus
gatgctgtccttgcagaacaattac

SEQ ID NO: 367309 - DNA, 25 bp, Rattus norvegicus
gatgctgtcctttggttacagatta

SEQ ID NO: 367310 - DNA, 25 bp, Rattus norvegicus
gatgctgtctgaccaagcccaaaag

SEQ ID NO: 367311 - DNA, 25 bp, Rattus norvegicus
gatgctgtctgagcaagcccaaaag

SEQ ID NO: 367312 - DNA, 25 bp, Rattus norvegicus
gatgctgtcttaaatacctatgcca

SEQ ID NO: 367313 - DNA, 25 bp, Rattus norvegicus
gatgctgtcttatatacctatgcca

SEQ ID NO: 367314 - DNA, 25 bp, Rattus norvegicus
gatgctgtctttagaaggcaaagat

SEQ ID NO: 367315 - DNA, 25 bp, Rattus norvegicus
gatgctgtcttttgaaggcaaagat

SEQ ID NO: 367316 - DNA, 25 bp, Rattus norvegicus
gatgctgtgaatagcatgtgcttca

SEQ ID NO: 367317 - DNA, 25 bp, Rattus norvegicus
gatgctgtgaattgcatgtgcttca

SEQ ID NO: 367318 - DNA, 25 bp, Rattus norvegicus
gatgctgtgacacccccagttccaa

SEQ ID NO: 367319 - DNA, 25 bp, Rattus norvegicus
gatgctgtgacagccccagttccaa

SEQ ID NO: 367320 - DNA, 25 bp, Rattus norvegicus
gatgctgtgacgacgatcccaaata

SEQ ID NO: 367321 - DNA, 25 bp, Rattus norvegicus
gatgctgtgacgtcgatcccaaata

SEQ ID NO: 367322 - DNA, 25 bp, Rattus norvegicus
gatgctgtgctcaggtgacctggac

SEQ ID NO: 367323 - DNA, 25 bp, Rattus norvegicus
gatgctgtgctcatttgctttgaca

SEQ ID NO: 367324 - DNA, 25 bp, Rattus norvegicus
gatgctgtgctctggtgacctggac

SEQ ID NO: 367325 - DNA, 25 bp, Rattus norvegicus
gatgctgtgctcttttgctttgaca

SEQ ID NO: 367326 - DNA, 25 bp, Rattus norvegicus
gatgctgtggaacctagctctctgc

SEQ ID NO: 367327 - DNA, 25 bp, Rattus norvegicus
gatgctgtggaagctagctctctgc

SEQ ID NO: 367328 - DNA, 25 bp, Rattus norvegicus
gatgctgtggtaattgacgttctta

SEQ ID NO: 367329 - DNA, 25 bp, Rattus norvegicus
gatgctgtggtatttgacgttctta

SEQ ID NO: 367330 - DNA, 25 bp, Rattus norvegicus
gatgctgtgtgtccgtctgtctgtc

SEQ ID NO: 367331 - DNA, 25 bp, Rattus norvegicus
gatgctgtgtgtgcgtctgtctgtc

SEQ ID NO: 367332 - DNA, 25 bp, Rattus norvegicus
gatgctgtgtttatacagccgcttt

SEQ ID NO: 367333 - DNA, 25 bp, Rattus norvegicus
gatgctgtgtttttacagccgcttt

SEQ ID NO: 367334 - DNA, 25 bp, Rattus norvegicus
gatgctgttacacttctgctttaat

SEQ ID NO: 367335 - DNA, 25 bp, Rattus norvegicus
gatgctgttacagttctgctttaat

SEQ ID NO: 367336 - DNA, 25 bp, Rattus norvegicus
gatgctgttaccattgcctttgtac

SEQ ID NO: 367337 - DNA, 25 bp, Rattus norvegicus
gatgctgttacctttgcctttgtac

SEQ ID NO: 367338 - DNA, 25 bp, Rattus norvegicus
gatgctgttactcaatgctccgtgt

SEQ ID NO: 367339 - DNA, 25 bp, Rattus norvegicus
gatgctgttactcagttactgtctt

SEQ ID NO: 367340 - DNA, 25 bp, Rattus norvegicus
gatgctgttactgaatgctccgtgt

SEQ ID NO: 367341 - DNA, 25 bp, Rattus norvegicus
gatgctgttactgagttactgtctt

SEQ ID NO: 367342 - DNA, 25 bp, Rattus norvegicus
gatgctgttattaccttatggctac

SEQ ID NO: 367343 - DNA, 25 bp, Rattus norvegicus
gatgctgttatttccttatggctac

SEQ ID NO: 367344 - DNA, 25 bp, Rattus norvegicus
gatgctgttcatcttgctttgaagt

SEQ ID NO: 367345 - DNA, 25 bp, Rattus norvegicus
gatgctgttcatgttgctttgaagt

SEQ ID NO: 367346 - DNA, 25 bp, Rattus norvegicus
gatgctgttcgtcggatcactgcaa

SEQ ID NO: 367347 - DNA, 25 bp, Rattus norvegicus
gatgctgttcgtgggatcactgcaa

SEQ ID NO: 367348 - DNA, 25 bp, Rattus norvegicus
gatgctgttctacatgtcactgggt

SEQ ID NO: 367349 - DNA, 25 bp, Rattus norvegicus
gatgctgttctagatgtcactgggt

SEQ ID NO: 367350 - DNA, 25 bp, Rattus norvegicus
gatgctgttcttccacttggagcaa

SEQ ID NO: 367351 - DNA, 25 bp, Rattus norvegicus
gatgctgttcttgcacttggagcaa

SEQ ID NO: 367352 - DNA, 25 bp, Rattus norvegicus
gatgctgtttgtacttctgggaata

SEQ ID NO: 367353 - DNA, 25 bp, Rattus norvegicus
gatgctgtttgttcttctgggaata

SEQ ID NO: 367354 - DNA, 25 bp, Rattus norvegicus
gatgcttaaggtcgcccggatatta

SEQ ID NO: 367355 - DNA, 25 bp, Rattus norvegicus
gatgcttaaggtggcccggatatta

SEQ ID NO: 367356 - DNA, 25 bp, Rattus norvegicus
gatgcttaagtcagttgctggtggc

SEQ ID NO: 367357 - DNA, 25 bp, Rattus norvegicus
gatgcttaagtctgttgctggtggc

SEQ ID NO: 367358 - DNA, 25 bp, Rattus norvegicus
gatgcttacagcctacagctgggca

SEQ ID NO: 367359 - DNA, 25 bp, Rattus norvegicus
gatgcttacagcgtacagctgggca

SEQ ID NO: 367360 - DNA, 25 bp, Rattus norvegicus
gatgcttacagtaggcactcaataa

SEQ ID NO: 367361 - DNA, 25 bp, Rattus norvegicus
gatgcttacagttggcactcaataa

SEQ ID NO: 367362 - DNA, 25 bp, Rattus norvegicus
gatgcttaccgtcaggcccagcagc

SEQ ID NO: 367363 - DNA, 25 bp, Rattus norvegicus
gatgcttaccgtgaggcccagcagc

SEQ ID NO: 367364 - DNA, 25 bp, Rattus norvegicus
gatgcttactctacatcaggcacta

SEQ ID NO: 367365 - DNA, 25 bp, Rattus norvegicus
gatgcttactcttcatcaggcacta

SEQ ID NO: 367366 - DNA, 25 bp, Rattus norvegicus
gatgcttactgaatccagccttata

SEQ ID NO: 367367 - DNA, 25 bp, Rattus norvegicus
gatgcttactgattccagccttata

SEQ ID NO: 367368 - DNA, 25 bp, Rattus norvegicus
gatgcttagcagaagctgcgcacgt

SEQ ID NO: 367369 - DNA, 25 bp, Rattus norvegicus
gatgcttagcagtagctgcgcacgt

SEQ ID NO: 367370 - DNA, 25 bp, Rattus norvegicus
gatgcttattctatggatttctaca

SEQ ID NO: 367371 - DNA, 25 bp, Rattus norvegicus
gatgcttattctttggatttctaca

SEQ ID NO: 367372 - DNA, 25 bp, Rattus norvegicus
gatgcttcaatgagtcttttcccac

SEQ ID NO: 367373 - DNA, 25 bp, Rattus norvegicus
gatgcttcaatgtgtcttttcccac

SEQ ID NO: 367374 - DNA, 25 bp, Rattus norvegicus
gatgcttcacccacatgtaactacg

SEQ ID NO: 367375 - DNA, 25 bp, Rattus norvegicus
gatgcttcaccctcatgtaactacg

SEQ ID NO: 367376 - DNA, 25 bp, Rattus norvegicus
gatgcttcagcaattagacccagat

SEQ ID NO: 367377 - DNA, 25 bp, Rattus norvegicus
gatgcttcagcatttagacccagat

SEQ ID NO: 367378 - DNA, 25 bp, Rattus norvegicus
gatgcttcagtacaaccctgctcag

SEQ ID NO: 367379 - DNA, 25 bp, Rattus norvegicus
gatgcttcagtagaaccctgctcag

SEQ ID NO: 367380 - DNA, 25 bp, Rattus norvegicus
gatgcttcagtcattgatcctcaag

SEQ ID NO: 367381 - DNA, 25 bp, Rattus norvegicus
gatgcttcagtctttgatcctcaag

SEQ ID NO: 367382 - DNA, 25 bp, Rattus norvegicus
gatgcttcagtgaccttcacagaga

SEQ ID NO: 367383 - DNA, 25 bp, Rattus norvegicus
gatgcttcagtgattaaacctggag

SEQ ID NO: 367384 - DNA, 25 bp, Rattus norvegicus
gatgcttcagtgtccttcacagaga

SEQ ID NO: 367385 - DNA, 25 bp, Rattus norvegicus
gatgcttcagtgtttaaacctggag

SEQ ID NO: 367386 - DNA, 25 bp, Rattus norvegicus
gatgcttccagacagcgcaggagaa

SEQ ID NO: 367387 - DNA, 25 bp, Rattus norvegicus
gatgcttccagagagcgcaggagaa

SEQ ID NO: 367388 - DNA, 25 bp, Rattus norvegicus
gatgcttccagcaatattgctatgc

SEQ ID NO: 367389 - DNA, 25 bp, Rattus norvegicus
gatgcttccagctatattgctatgc

SEQ ID NO: 367390 - DNA, 25 bp, Rattus norvegicus
gatgcttccaggaccctcctgagag

SEQ ID NO: 367391 - DNA, 25 bp, Rattus norvegicus
gatgcttccaggtccctcctgagag

SEQ ID NO: 367392 - DNA, 25 bp, Rattus norvegicus
gatgcttcctcccaggacagtgtgt

SEQ ID NO: 367393 - DNA, 25 bp, Rattus norvegicus
gatgcttcctccgaggacagtgtgt

SEQ ID NO: 367394 - DNA, 25 bp, Rattus norvegicus
gatgcttcctctccaggaggcaaga

SEQ ID NO: 367395 - DNA, 25 bp, Rattus norvegicus
gatgcttcctctgcaggaggcaaga

SEQ ID NO: 367396 - DNA, 25 bp, Rattus norvegicus
gatgcttccttgaggccaccagaga

SEQ ID NO: 367397 - DNA, 25 bp, Rattus norvegicus
gatgcttccttgtggccaccagaga

SEQ ID NO: 367398 - DNA, 25 bp, Rattus norvegicus
gatgcttcgcttcttctacgtaatt

SEQ ID NO: 367399 - DNA, 25 bp, Rattus norvegicus
gatgcttcgcttgttctacgtaatt

SEQ ID NO: 367400 - DNA, 25 bp, Rattus norvegicus
gatgcttcgtctctcctgtggaata

SEQ ID NO: 367401 - DNA, 25 bp, Rattus norvegicus
gatgcttcgtctgtcctgtggaata

SEQ ID NO: 367402 - DNA, 25 bp, Rattus norvegicus
gatgcttcgtgtcgctgtggacaca

SEQ ID NO: 367403 - DNA, 25 bp, Rattus norvegicus
gatgcttcgtgtggctgtggacaca

SEQ ID NO: 367404 - DNA, 25 bp, Rattus norvegicus
gatgcttctagcaccagatattcga

SEQ ID NO: 367405 - DNA, 25 bp, Rattus norvegicus
gatgcttctagctccagatattcga

SEQ ID NO: 367406 - DNA, 25 bp, Rattus norvegicus
gatgcttctctgaacatcaactgca

SEQ ID NO: 367407 - DNA, 25 bp, Rattus norvegicus
gatgcttctctgaaggcagctaaca

SEQ ID NO: 367408 - DNA, 25 bp, Rattus norvegicus
gatgcttctctgtacatcaactgca

SEQ ID NO: 367409 - DNA, 25 bp, Rattus norvegicus
gatgcttctctgtaggcagctaaca

SEQ ID NO: 367410 - DNA, 25 bp, Rattus norvegicus
gatgcttctgaactgcaccgggatt

SEQ ID NO: 367411 - DNA, 25 bp, Rattus norvegicus
gatgcttctgaagtgcaccgggatt

SEQ ID NO: 367412 - DNA, 25 bp, Rattus norvegicus
gatgcttctgacatagctagtttag

SEQ ID NO: 367413 - DNA, 25 bp, Rattus norvegicus
gatgcttctgacttagctagtttag

SEQ ID NO: 367414 - DNA, 25 bp, Rattus norvegicus
gatgcttctgagacattcctgttct

SEQ ID NO: 367415 - DNA, 25 bp, Rattus norvegicus
gatgcttctgagtcattcctgttct

SEQ ID NO: 367416 - DNA, 25 bp, Rattus norvegicus
gatgcttctgatatttacttcttcc

SEQ ID NO: 367417 - DNA, 25 bp, Rattus norvegicus
gatgcttctgatttttacttcttcc

SEQ ID NO: 367418 - DNA, 25 bp, Rattus norvegicus
gatgcttcttgactccattttggaa

SEQ ID NO: 367419 - DNA, 25 bp, Rattus norvegicus
gatgcttcttgagtccattttggaa

SEQ ID NO: 367420 - DNA, 25 bp, Rattus norvegicus
gatgcttcttgtcccgagcaaagag

SEQ ID NO: 367421 - DNA, 25 bp, Rattus norvegicus
gatgcttcttgtgccgagcaaagag

SEQ ID NO: 367422 - DNA, 25 bp, Rattus norvegicus
gatgcttgacagagagcgcctttgc

SEQ ID NO: 367423 - DNA, 25 bp, Rattus norvegicus
gatgcttgacagtgagcgcctttgc

SEQ ID NO: 367424 - DNA, 25 bp, Rattus norvegicus
gatgcttgacataacaccaggaggt

SEQ ID NO: 367425 - DNA, 25 bp, Rattus norvegicus
gatgcttgacattacaccaggaggt

SEQ ID NO: 367426 - DNA, 25 bp, Rattus norvegicus
gatgcttgagcaaatgatggcactg

SEQ ID NO: 367427 - DNA, 25 bp, Rattus norvegicus
gatgcttgagcaattatggatgata

SEQ ID NO: 367428 - DNA, 25 bp, Rattus norvegicus
gatgcttgagcatatgatggcactg

SEQ ID NO: 367429 - DNA, 25 bp, Rattus norvegicus
gatgcttgagcatttatggatgata

SEQ ID NO: 367430 - DNA, 25 bp, Rattus norvegicus
gatgcttgagggaaccagggcccat

SEQ ID NO: 367431 - DNA, 25 bp, Rattus norvegicus
gatgcttgagggtaccagggcccat

SEQ ID NO: 367432 - DNA, 25 bp, Rattus norvegicus
gatgcttgagttaggcagccacctg

SEQ ID NO: 367433 - DNA, 25 bp, Rattus norvegicus
gatgcttgagtttggcagccacctg

SEQ ID NO: 367434 - DNA, 25 bp, Rattus norvegicus
gatgcttgatacattcaataccgag

SEQ ID NO: 367435 - DNA, 25 bp, Rattus norvegicus
gatgcttgatactttcaataccgag

SEQ ID NO: 367436 - DNA, 25 bp, Rattus norvegicus
gatgcttgatgaatactgtgtgagt

SEQ ID NO: 367437 - DNA, 25 bp, Rattus norvegicus
gatgcttgatgattactgtgtgagt

SEQ ID NO: 367438 - DNA, 25 bp, Rattus norvegicus
gatgcttgatttccaattcacacga

SEQ ID NO: 367439 - DNA, 25 bp, Rattus norvegicus
gatgcttgatttgcaattcacacga

SEQ ID NO: 367440 - DNA, 25 bp, Rattus norvegicus
gatgcttgccaacccagatctaggc

SEQ ID NO: 367441 - DNA, 25 bp, Rattus norvegicus
gatgcttgccaagccagatctaggc

SEQ ID NO: 367442 - DNA, 25 bp, Rattus norvegicus
gatgcttgccatcttgactgaataa

SEQ ID NO: 367443 - DNA, 25 bp, Rattus norvegicus
gatgcttgccatgttgactgaataa

SEQ ID NO: 367444 - DNA, 25 bp, Rattus norvegicus
gatgcttgcctgcaacactggcagg

SEQ ID NO: 367445 - DNA, 25 bp, Rattus norvegicus
gatgcttgcctggaacactggcagg

SEQ ID NO: 367446 - DNA, 25 bp, Rattus norvegicus
gatgcttgctggattatctacacct

SEQ ID NO: 367447 - DNA, 25 bp, Rattus norvegicus
gatgcttgctggtttatctacacct

SEQ ID NO: 367448 - DNA, 25 bp, Rattus norvegicus
gatgcttggaaccaaccatcaagga

SEQ ID NO: 367449 - DNA, 25 bp, Rattus norvegicus
gatgcttggaacgaaccatcaagga

SEQ ID NO: 367450 - DNA, 25 bp, Rattus norvegicus
gatgcttggctgagttgaggttttt

SEQ ID NO: 367451 - DNA, 25 bp, Rattus norvegicus
gatgcttggctgtgttgaggttttt

SEQ ID NO: 367452 - DNA, 25 bp, Rattus norvegicus
gatgcttgggttagaggaaccatta

SEQ ID NO: 367453 - DNA, 25 bp, Rattus norvegicus
gatgcttgggtttgaggaaccatta

SEQ ID NO: 367454 - DNA, 25 bp, Rattus norvegicus
gatgcttggtgacttggctcatgaa

SEQ ID NO: 367455 - DNA, 25 bp, Rattus norvegicus
gatgcttggtgagttggctcatgaa

SEQ ID NO: 367456 - DNA, 25 bp, Rattus norvegicus
gatgcttggtgtcacttgccaccat

SEQ ID NO: 367457 - DNA, 25 bp, Rattus norvegicus
gatgcttggtgtgacttgccaccat

SEQ ID NO: 367458 - DNA, 25 bp, Rattus norvegicus
gatgcttgtagaaggccagcttcca

SEQ ID NO: 367459 - DNA, 25 bp, Rattus norvegicus
gatgcttgtagatggccagcttcca

SEQ ID NO: 367460 - DNA, 25 bp, Rattus norvegicus
gatgcttgtatcatgaggaaggcca

SEQ ID NO: 367461 - DNA, 25 bp, Rattus norvegicus
gatgcttgtatcttgaggaaggcca

SEQ ID NO: 367462 - DNA, 25 bp, Rattus norvegicus
gatgcttgtcctatgtgagtctaaa

SEQ ID NO: 367463 - DNA, 25 bp, Rattus norvegicus
gatgcttgtcctttgtgagtctaaa

SEQ ID NO: 367464 - DNA, 25 bp, Rattus norvegicus
gatgcttgtcttaaataacttggta

SEQ ID NO: 367465 - DNA, 25 bp, Rattus norvegicus
gatgcttgtcttcatatagtctcac

SEQ ID NO: 367466 - DNA, 25 bp, Rattus norvegicus
gatgcttgtcttgatatagtctcac

SEQ ID NO: 367467 - DNA, 25 bp, Rattus norvegicus
gatgcttgtctttaataacttggta

SEQ ID NO: 367468 - DNA, 25 bp, Rattus norvegicus
gatgcttgtgcaacatgctctgaaa

SEQ ID NO: 367469 - DNA, 25 bp, Rattus norvegicus
gatgcttgtgcatcatgctctgaaa

SEQ ID NO: 367470 - DNA, 25 bp, Rattus norvegicus
gatgcttgttcacagaactctgctg

SEQ ID NO: 367471 - DNA, 25 bp, Rattus norvegicus
gatgcttgttcagagaactctgctg

SEQ ID NO: 367472 - DNA, 25 bp, Rattus norvegicus
gatgcttgtttcctcagtcattgga

SEQ ID NO: 367473 - DNA, 25 bp, Rattus norvegicus
gatgcttgtttcgtcagtcattgga

SEQ ID NO: 367474 - DNA, 25 bp, Rattus norvegicus
gatgctttaaagacttatccttggc

SEQ ID NO: 367475 - DNA, 25 bp, Rattus norvegicus
gatgctttaaagtcttatccttggc

SEQ ID NO: 367476 - DNA, 25 bp, Rattus norvegicus
gatgctttaacaccacttcccatgt

SEQ ID NO: 367477 - DNA, 25 bp, Rattus norvegicus
gatgctttaacagcacttcccatgt

SEQ ID NO: 367478 - DNA, 25 bp, Rattus norvegicus
gatgctttactaatgtgacctctca

SEQ ID NO: 367479 - DNA, 25 bp, Rattus norvegicus
gatgctttactattgtgacctctca

SEQ ID NO: 367480 - DNA, 25 bp, Rattus norvegicus
gatgctttagtaaatgtcccttttc

SEQ ID NO: 367481 - DNA, 25 bp, Rattus norvegicus
gatgctttagtatatgtcccttttc

SEQ ID NO: 367482 - DNA, 25 bp, Rattus norvegicus
gatgctttcacaaactgtactctgc

SEQ ID NO: 367483 - DNA, 25 bp, Rattus norvegicus
gatgctttcacatactgtactctgc

SEQ ID NO: 367484 - DNA, 25 bp, Rattus norvegicus
gatgctttcattcattgcaaaccaa

SEQ ID NO: 367485 - DNA, 25 bp, Rattus norvegicus
gatgctttcattgattgcaaaccaa

SEQ ID NO: 367486 - DNA, 25 bp, Rattus norvegicus
gatgctttccaactacttcctaagg

SEQ ID NO: 367487 - DNA, 25 bp, Rattus norvegicus
gatgctttccaactcaatctctttt

SEQ ID NO: 367488 - DNA, 25 bp, Rattus norvegicus
gatgctttccaagtacttcctaagg

SEQ ID NO: 367489 - DNA, 25 bp, Rattus norvegicus
gatgctttccaagtcaatctctttt

SEQ ID NO: 367490 - DNA, 25 bp, Rattus norvegicus
gatgctttccctcataaggtggcca

SEQ ID NO: 367491 - DNA, 25 bp, Rattus norvegicus
gatgctttccctgataaggtggcca

SEQ ID NO: 367492 - DNA, 25 bp, Rattus norvegicus
gatgctttcgcaagccagttggtac

SEQ ID NO: 367493 - DNA, 25 bp, Rattus norvegicus
gatgctttcgcatgccagttggtac

SEQ ID NO: 367494 - DNA, 25 bp, Rattus norvegicus
gatgctttcggtagtcttgagattc

SEQ ID NO: 367495 - DNA, 25 bp, Rattus norvegicus
gatgctttcggttgtcttgagattc

SEQ ID NO: 367496 - DNA, 25 bp, Rattus norvegicus
gatgctttctagattgtctgacatt

SEQ ID NO: 367497 - DNA, 25 bp, Rattus norvegicus
gatgctttctagctccttgggatag

SEQ ID NO: 367498 - DNA, 25 bp, Rattus norvegicus
gatgctttctaggtccttgggatag

SEQ ID NO: 367499 - DNA, 25 bp, Rattus norvegicus
gatgctttctagtttgtctgacatt

SEQ ID NO: 367500 - DNA, 25 bp, Rattus norvegicus
gatgctttctctagaaactgtattt

SEQ ID NO: 367501 - DNA, 25 bp, Rattus norvegicus
gatgctttctcttgaaactgtattt

SEQ ID NO: 367502 - DNA, 25 bp, Rattus norvegicus
gatgctttctgtatggctgagacga

SEQ ID NO: 367503 - DNA, 25 bp, Rattus norvegicus
gatgctttctgtttggctgagacga

SEQ ID NO: 367504 - DNA, 25 bp, Rattus norvegicus
gatgctttgacaactgtgggcctgt

SEQ ID NO: 367505 - DNA, 25 bp, Rattus norvegicus
gatgctttgacatctgtgggcctgt

SEQ ID NO: 367506 - DNA, 25 bp, Rattus norvegicus
gatgctttgactatatccttttcaa

SEQ ID NO: 367507 - DNA, 25 bp, Rattus norvegicus
gatgctttgactttatccttttcaa

SEQ ID NO: 367508 - DNA, 25 bp, Rattus norvegicus
gatgctttgcttcatagtgacctca

SEQ ID NO: 367509 - DNA, 25 bp, Rattus norvegicus
gatgctttgcttgatagtgacctca

SEQ ID NO: 367510 - DNA, 25 bp, Rattus norvegicus
gatgctttgggcagcactatgctca

SEQ ID NO: 367511 - DNA, 25 bp, Rattus norvegicus
gatgctttgggctgcactatgctca

SEQ ID NO: 367512 - DNA, 25 bp, Rattus norvegicus
gatgctttgtaaacatttccccatg

SEQ ID NO: 367513 - DNA, 25 bp, Rattus norvegicus
gatgctttgtaatcatttccccatg

SEQ ID NO: 367514 - DNA, 25 bp, Rattus norvegicus
gatgctttgtgcaggcttcttggag

SEQ ID NO: 367515 - DNA, 25 bp, Rattus norvegicus
gatgctttgtgcattctaaagttta

SEQ ID NO: 367516 - DNA, 25 bp, Rattus norvegicus
gatgctttgtgctggcttcttggag

SEQ ID NO: 367517 - DNA, 25 bp, Rattus norvegicus
gatgctttgtgctttctaaagttta

SEQ ID NO: 367518 - DNA, 25 bp, Rattus norvegicus
gatgcttttagcaaatggatcgtaa

SEQ ID NO: 367519 - DNA, 25 bp, Rattus norvegicus
gatgcttttagctaatggatcgtaa

SEQ ID NO: 367520 - DNA, 25 bp, Rattus norvegicus
gatgcttttatcatgagccaactat

SEQ ID NO: 367521 - DNA, 25 bp, Rattus norvegicus
gatgcttttatcttgagccaactat

SEQ ID NO: 367522 - DNA, 25 bp, Rattus norvegicus
gatgcttttcgacgccaaggttatc

SEQ ID NO: 367523 - DNA, 25 bp, Rattus norvegicus
gatgcttttcgaggccaaggttatc

SEQ ID NO: 367524 - DNA, 25 bp, Rattus norvegicus
gatgcttttgacatctcggaccatt

SEQ ID NO: 367525 - DNA, 25 bp, Rattus norvegicus
gatgcttttgacttctcggaccatt

SEQ ID NO: 367526 - DNA, 25 bp, Rattus norvegicus
gatgcttttgataccatatggatcc

SEQ ID NO: 367527 - DNA, 25 bp, Rattus norvegicus
gatgcttttgattccatatggatcc

SEQ ID NO: 367528 - DNA, 25 bp, Rattus norvegicus
gatgcttttgcacttgtgtctcctc

SEQ ID NO: 367529 - DNA, 25 bp, Rattus norvegicus
gatgcttttgcagttgtgtctcctc

SEQ ID NO: 367530 - DNA, 25 bp, Rattus norvegicus
gatgcttttgctatgacacttgact

SEQ ID NO: 367531 - DNA, 25 bp, Rattus norvegicus
gatgcttttgctttgacacttgact

SEQ ID NO: 367532 - DNA, 25 bp, Rattus norvegicus
gatgcttttggacctattgatactc

SEQ ID NO: 367533 - DNA, 25 bp, Rattus norvegicus
gatgcttttggagctattgatactc

SEQ ID NO: 367534 - DNA, 25 bp, Rattus norvegicus
gatgcttttgtcacgcatgtgattc

SEQ ID NO: 367535 - DNA, 25 bp, Rattus norvegicus
gatgcttttgtctcgcatgtgattc

SEQ ID NO: 367536 - DNA, 25 bp, Rattus norvegicus
gatggaaaacagaccggttcttctt

SEQ ID NO: 367537 - DNA, 25 bp, Rattus norvegicus
gatggaaaacagtccggttcttctt

SEQ ID NO: 367538 - DNA, 25 bp, Rattus norvegicus
gatggaaacatcagggccaccagca

SEQ ID NO: 367539 - DNA, 25 bp, Rattus norvegicus
gatggaaacatctgggccaccagca

SEQ ID NO: 367540 - DNA, 25 bp, Rattus norvegicus
gatggaaacctcagcattcgctact

SEQ ID NO: 367541 - DNA, 25 bp, Rattus norvegicus
gatggaaacctctgcattcgctact

SEQ ID NO: 367542 - DNA, 25 bp, Rattus norvegicus
gatggaaagaaacttacagcgctta

SEQ ID NO: 367543 - DNA, 25 bp, Rattus norvegicus
gatggaaagaaagttacagcgctta

SEQ ID NO: 367544 - DNA, 25 bp, Rattus norvegicus
gatggaaagcatcagagccctcatt

SEQ ID NO: 367545 - DNA, 25 bp, Rattus norvegicus
gatggaaagcatgagagccctcatt

SEQ ID NO: 367546 - DNA, 25 bp, Rattus norvegicus
gatggaaagccaacgctgacttcct

SEQ ID NO: 367547 - DNA, 25 bp, Rattus norvegicus
gatggaaagccatcgctgacttcct

SEQ ID NO: 367548 - DNA, 25 bp, Rattus norvegicus
gatggaaagcgcactccagcagggt

SEQ ID NO: 367549 - DNA, 25 bp, Rattus norvegicus
gatggaaagcgctctccagcagggt

SEQ ID NO: 367550 - DNA, 25 bp, Rattus norvegicus
gatggaaagcttacaccgggcttta

SEQ ID NO: 367551 - DNA, 25 bp, Rattus norvegicus
gatggaaagctttcaccgggcttta

SEQ ID NO: 367552 - DNA, 25 bp, Rattus norvegicus
gatggaaagtgtcttggcccagctt

SEQ ID NO: 367553 - DNA, 25 bp, Rattus norvegicus
gatggaaagtgtgttggcccagctt

SEQ ID NO: 367554 - DNA, 25 bp, Rattus norvegicus
gatggaacactgatgccgttagcat

SEQ ID NO: 367555 - DNA, 25 bp, Rattus norvegicus
gatggaacactgttgccgttagcat

SEQ ID NO: 367556 - DNA, 25 bp, Rattus norvegicus
gatggaacagcaaaggcacacgcct

SEQ ID NO: 367557 - DNA, 25 bp, Rattus norvegicus
gatggaacagcataggcacacgcct

SEQ ID NO: 367558 - DNA, 25 bp, Rattus norvegicus
gatggaacatttcagtgttgcgtga

SEQ ID NO: 367559 - DNA, 25 bp, Rattus norvegicus
gatggaacatttgagtgttgcgtga

SEQ ID NO: 367560 - DNA, 25 bp, Rattus norvegicus
gatggaaccacgctgctcctgggcc

SEQ ID NO: 367561 - DNA, 25 bp, Rattus norvegicus
gatggaaccacggtgctcctgggcc

SEQ ID NO: 367562 - DNA, 25 bp, Rattus norvegicus
gatggaaccatgaccacatcacctt

SEQ ID NO: 367563 - DNA, 25 bp, Rattus norvegicus
gatggaaccatgtccacatcacctt

SEQ ID NO: 367564 - DNA, 25 bp, Rattus norvegicus
gatggaacccttcgattgactccac

SEQ ID NO: 367565 - DNA, 25 bp, Rattus norvegicus
gatggaacccttggattgactccac

SEQ ID NO: 367566 - DNA, 25 bp, Rattus norvegicus
gatggaactcatcgagctgtcccag

SEQ ID NO: 367567 - DNA, 25 bp, Rattus norvegicus
gatggaactcatggagctgtcccag

SEQ ID NO: 367568 - DNA, 25 bp, Rattus norvegicus
gatggaactccaccgtcaaaggaat

SEQ ID NO: 367569 - DNA, 25 bp, Rattus norvegicus
gatggaactccagcgtcaaaggaat

SEQ ID NO: 367570 - DNA, 25 bp, Rattus norvegicus
gatggaactctgcttattatggtgt

SEQ ID NO: 367571 - DNA, 25 bp, Rattus norvegicus
gatggaactctggttattatggtgt

SEQ ID NO: 367572 - DNA, 25 bp, Rattus norvegicus
gatggaactgaaatctcccagcact

SEQ ID NO: 367573 - DNA, 25 bp, Rattus norvegicus
gatggaactgaattctcccagcact

SEQ ID NO: 367574 - DNA, 25 bp, Rattus norvegicus
gatggaactgatctatgcccgggcc

SEQ ID NO: 367575 - DNA, 25 bp, Rattus norvegicus
gatggaactgatgtatgcccgggcc

SEQ ID NO: 367576 - DNA, 25 bp, Rattus norvegicus
gatggaacttgccacctaggacgat

SEQ ID NO: 367577 - DNA, 25 bp, Rattus norvegicus
gatggaacttgcgacctaggacgat

SEQ ID NO: 367578 - DNA, 25 bp, Rattus norvegicus
gatggaagaactccacagcctggac

SEQ ID NO: 367579 - DNA, 25 bp, Rattus norvegicus
gatggaagaactgcacagcctggac

SEQ ID NO: 367580 - DNA, 25 bp, Rattus norvegicus
gatggaagacggacccacctggcag

SEQ ID NO: 367581 - DNA, 25 bp, Rattus norvegicus
gatggaagacggcacagtcacaaat

SEQ ID NO: 367582 - DNA, 25 bp, Rattus norvegicus
gatggaagacgggacagtcacaaat

SEQ ID NO: 367583 - DNA, 25 bp, Rattus norvegicus
gatggaagacggtcccacctggcag

SEQ ID NO: 367584 - DNA, 25 bp, Rattus norvegicus
gatggaagagacacgtgcagcacac

SEQ ID NO: 367585 - DNA, 25 bp, Rattus norvegicus
gatggaagagactcgtgcagcacac

SEQ ID NO: 367586 - DNA, 25 bp, Rattus norvegicus
gatggaagagtcctggaaaccctag

SEQ ID NO: 367587 - DNA, 25 bp, Rattus norvegicus
gatggaagagtcgtggaaaccctag

SEQ ID NO: 367588 - DNA, 25 bp, Rattus norvegicus
gatggaagcatgctgcctcctgaat

SEQ ID NO: 367589 - DNA, 25 bp, Rattus norvegicus
gatggaagcatggtgcctcctgaat

SEQ ID NO: 367590 - DNA, 25 bp, Rattus norvegicus
gatggaagcccaattcacatgcagt

SEQ ID NO: 367591 - DNA, 25 bp, Rattus norvegicus
gatggaagcccatttcacatgcagt

SEQ ID NO: 367592 - DNA, 25 bp, Rattus norvegicus
gatggaagcctcacagtgtctccac

SEQ ID NO: 367593 - DNA, 25 bp, Rattus norvegicus
gatggaagcctctcagtgtctccac

SEQ ID NO: 367594 - DNA, 25 bp, Rattus norvegicus
gatggaagcgagatcccacacagca

SEQ ID NO: 367595 - DNA, 25 bp, Rattus norvegicus
gatggaagcgagttcccacacagca

SEQ ID NO: 367596 - DNA, 25 bp, Rattus norvegicus
gatggaagctgtcaaccttttctgt

SEQ ID NO: 367597 - DNA, 25 bp, Rattus norvegicus
gatggaagctgtgaaccttttctgt

SEQ ID NO: 367598 - DNA, 25 bp, Rattus norvegicus
gatggaaggactcccggaaacgctt

SEQ ID NO: 367599 - DNA, 25 bp, Rattus norvegicus
gatggaaggactgccggaaacgctt

SEQ ID NO: 367600 - DNA, 25 bp, Rattus norvegicus
gatggaaggttcatccttgcaacca

SEQ ID NO: 367601 - DNA, 25 bp, Rattus norvegicus
gatggaaggttcttccttgcaacca

SEQ ID NO: 367602 - DNA, 25 bp, Rattus norvegicus
gatggaagtccaactttcaggaacc

SEQ ID NO: 367603 - DNA, 25 bp, Rattus norvegicus
gatggaagtccatctttcaggaacc

SEQ ID NO: 367604 - DNA, 25 bp, Rattus norvegicus
gatggaagtcctaactcctaggtga

SEQ ID NO: 367605 - DNA, 25 bp, Rattus norvegicus
gatggaagtccttactcctaggtga

SEQ ID NO: 367606 - DNA, 25 bp, Rattus norvegicus
gatggaagtctgaaagctgccaaga

SEQ ID NO: 367607 - DNA, 25 bp, Rattus norvegicus
gatggaagtctgtaagctgccaaga

SEQ ID NO: 367608 - DNA, 25 bp, Rattus norvegicus
gatggaagtgacctgagcgacaaca

SEQ ID NO: 367609 - DNA, 25 bp, Rattus norvegicus
gatggaagtgacgtgagcgacaaca

SEQ ID NO: 367610 - DNA, 25 bp, Rattus norvegicus
gatggaagttctcctgagtccttgt

SEQ ID NO: 367611 - DNA, 25 bp, Rattus norvegicus
gatggaagttctgctgagtccttgt

SEQ ID NO: 367612 - DNA, 25 bp, Rattus norvegicus
gatggaagtttcatctcgtcaacct

SEQ ID NO: 367613 - DNA, 25 bp, Rattus norvegicus
gatggaagtttcttctcgtcaacct

SEQ ID NO: 367614 - DNA, 25 bp, Rattus norvegicus
gatggaataactcctttgttctgac

SEQ ID NO: 367615 - DNA, 25 bp, Rattus norvegicus
gatggaataactgctttgttctgac

SEQ ID NO: 367616 - DNA, 25 bp, Rattus norvegicus
gatggaatatttcgagaacccgaag

SEQ ID NO: 367617 - DNA, 25 bp, Rattus norvegicus
gatggaatatttggagaacccgaag

SEQ ID NO: 367618 - DNA, 25 bp, Rattus norvegicus
gatggaatcatgcatgctgccaatt

SEQ ID NO: 367619 - DNA, 25 bp, Rattus norvegicus
gatggaatcatggatgctgccaatt

SEQ ID NO: 367620 - DNA, 25 bp, Rattus norvegicus
gatggaatccatcaagtactgcaaa

SEQ ID NO: 367621 - DNA, 25 bp, Rattus norvegicus
gatggaatccatgaagtactgcaaa

SEQ ID NO: 367622 - DNA, 25 bp, Rattus norvegicus
gatggaatcccaccgcagtttttaa

SEQ ID NO: 367623 - DNA, 25 bp, Rattus norvegicus
gatggaatcccagcgcagtttttaa

SEQ ID NO: 367624 - DNA, 25 bp, Rattus norvegicus
gatggaatcctcattaatctgcaag

SEQ ID NO: 367625 - DNA, 25 bp, Rattus norvegicus
gatggaatcctctttaatctgcaag

SEQ ID NO: 367626 - DNA, 25 bp, Rattus norvegicus
gatggaatctaaatgcctttactta

SEQ ID NO: 367627 - DNA, 25 bp, Rattus norvegicus
gatggaatctaattgcctttactta

SEQ ID NO: 367628 - DNA, 25 bp, Rattus norvegicus
gatggaatctctctgaggtcctgga

SEQ ID NO: 367629 - DNA, 25 bp, Rattus norvegicus
gatggaatctctgtgaggtcctgga

SEQ ID NO: 367630 - DNA, 25 bp, Rattus norvegicus
gatggaatctgcattgacagctagc

SEQ ID NO: 367631 - DNA, 25 bp, Rattus norvegicus
gatggaatctgctttgacagctagc

SEQ ID NO: 367632 - DNA, 25 bp, Rattus norvegicus
gatggaatcttcatgctagtgtagc

SEQ ID NO: 367633 - DNA, 25 bp, Rattus norvegicus
gatggaatcttcttgctagtgtagc

SEQ ID NO: 367634 - DNA, 25 bp, Rattus norvegicus
gatggaatgcccaccagagtgtccg

SEQ ID NO: 367635 - DNA, 25 bp, Rattus norvegicus
gatggaatgccctccagagtgtccg

SEQ ID NO: 367636 - DNA, 25 bp, Rattus norvegicus
gatggaatgcctacaggagtttcct

SEQ ID NO: 367637 - DNA, 25 bp, Rattus norvegicus
gatggaatgccttcaggagtttcct

SEQ ID NO: 367638 - DNA, 25 bp, Rattus norvegicus
gatggaatgctcaccacaaagttgt

SEQ ID NO: 367639 - DNA, 25 bp, Rattus norvegicus
gatggaatgctctccacaaagttgt

SEQ ID NO: 367640 - DNA, 25 bp, Rattus norvegicus
gatggaatgcttcttacctctatga

SEQ ID NO: 367641 - DNA, 25 bp, Rattus norvegicus
gatggaatgcttgttacctctatga

SEQ ID NO: 367642 - DNA, 25 bp, Rattus norvegicus
gatggaatgggcacggaggcgcgga

SEQ ID NO: 367643 - DNA, 25 bp, Rattus norvegicus
gatggaatgggctcggaggcgcgga

SEQ ID NO: 367644 - DNA, 25 bp, Rattus norvegicus
gatggaatgttcacaatgtctgaaa

SEQ ID NO: 367645 - DNA, 25 bp, Rattus norvegicus
gatggaatgttctcaatgtctgaaa

SEQ ID NO: 367646 - DNA, 25 bp, Rattus norvegicus
gatggaatttagctctcagcctttt

SEQ ID NO: 367647 - DNA, 25 bp, Rattus norvegicus
gatggaatttaggtctcagcctttt

SEQ ID NO: 367648 - DNA, 25 bp, Rattus norvegicus
gatggaatttccctacgttgaccag

SEQ ID NO: 367649 - DNA, 25 bp, Rattus norvegicus
gatggaatttccgtacgttgaccag

SEQ ID NO: 367650 - DNA, 25 bp, Rattus norvegicus
gatggacaacatagtgaatacccca

SEQ ID NO: 367651 - DNA, 25 bp, Rattus norvegicus
gatggacaacattgtgaatacccca

SEQ ID NO: 367652 - DNA, 25 bp, Rattus norvegicus
gatggacaacctcatggatatgctg

SEQ ID NO: 367653 - DNA, 25 bp, Rattus norvegicus
gatggacaacctgatggatatgctg

SEQ ID NO: 367654 - DNA, 25 bp, Rattus norvegicus
gatggacacagaccctgtagcacct

SEQ ID NO: 367655 - DNA, 25 bp, Rattus norvegicus
gatggacacagagcctgtagcacct

SEQ ID NO: 367656 - DNA, 25 bp, Rattus norvegicus
gatggacacgtcaacgaacgcctgt

SEQ ID NO: 367657 - DNA, 25 bp, Rattus norvegicus
gatggacacgtctacgaacgcctgt

SEQ ID NO: 367658 - DNA, 25 bp, Rattus norvegicus
gatggacactccctgcaatttgaga

SEQ ID NO: 367659 - DNA, 25 bp, Rattus norvegicus
gatggacactccgtgcaatttgaga

SEQ ID NO: 367660 - DNA, 25 bp, Rattus norvegicus
gatggacactttctgttaaggcaca

SEQ ID NO: 367661 - DNA, 25 bp, Rattus norvegicus
gatggacactttgtgttaaggcaca

SEQ ID NO: 367662 - DNA, 25 bp, Rattus norvegicus
gatggacagcttctttgcccaaaat

SEQ ID NO: 367663 - DNA, 25 bp, Rattus norvegicus
gatggacagcttgtttgcccaaaat

SEQ ID NO: 367664 - DNA, 25 bp, Rattus norvegicus
gatggacagtctagccaagagctgg

SEQ ID NO: 367665 - DNA, 25 bp, Rattus norvegicus
gatggacagtctcaccggaattggc

SEQ ID NO: 367666 - DNA, 25 bp, Rattus norvegicus
gatggacagtctgaccggaattggc

SEQ ID NO: 367667 - DNA, 25 bp, Rattus norvegicus
gatggacagtcttgccaagagctgg

SEQ ID NO: 367668 - DNA, 25 bp, Rattus norvegicus
gatggacagtgcatgtgctcctgca

SEQ ID NO: 367669 - DNA, 25 bp, Rattus norvegicus
gatggacagtgcttgtgctcctgca

SEQ ID NO: 367670 - DNA, 25 bp, Rattus norvegicus
gatggacagtgtcgctttgcacccc

SEQ ID NO: 367671 - DNA, 25 bp, Rattus norvegicus
gatggacagtgtggctttgcacccc

SEQ ID NO: 367672 - DNA, 25 bp, Rattus norvegicus
gatggacatcgccaaacagctacaa

SEQ ID NO: 367673 - DNA, 25 bp, Rattus norvegicus
gatggacatcgcgaaacagctacaa

SEQ ID NO: 367674 - DNA, 25 bp, Rattus norvegicus
gatggaccaaatacagcaaggaact

SEQ ID NO: 367675 - DNA, 25 bp, Rattus norvegicus
gatggaccaaattcagcaaggaact

SEQ ID NO: 367676 - DNA, 25 bp, Rattus norvegicus
gatggaccaagaaatctcaatctca

SEQ ID NO: 367677 - DNA, 25 bp, Rattus norvegicus
gatggaccaagatatctcaatctca

SEQ ID NO: 367678 - DNA, 25 bp, Rattus norvegicus
gatggaccaagcctcgaggcctgaa

SEQ ID NO: 367679 - DNA, 25 bp, Rattus norvegicus
gatggaccaagcgtcgaggcctgaa

SEQ ID NO: 367680 - DNA, 25 bp, Rattus norvegicus
gatggaccagaacctgaagtgtctg

SEQ ID NO: 367681 - DNA, 25 bp, Rattus norvegicus
gatggaccagaagctgaagtgtctg

SEQ ID NO: 367682 - DNA, 25 bp, Rattus norvegicus
gatggaccagatcttcactgacgtg

SEQ ID NO: 367683 - DNA, 25 bp, Rattus norvegicus
gatggaccagatgttcactgacgtg

SEQ ID NO: 367684 - DNA, 25 bp, Rattus norvegicus
gatggacccagaccagtgaacaacc

SEQ ID NO: 367685 - DNA, 25 bp, Rattus norvegicus
gatggacccagagcagtgaacaacc

SEQ ID NO: 367686 - DNA, 25 bp, Rattus norvegicus
gatggacccagcatttatggttgaa

SEQ ID NO: 367687 - DNA, 25 bp, Rattus norvegicus
gatggacccagcttttatggttgaa

SEQ ID NO: 367688 - DNA, 25 bp, Rattus norvegicus
gatggacccgatcaccacaggaata

SEQ ID NO: 367689 - DNA, 25 bp, Rattus norvegicus
gatggacccgatgaccacaggaata

SEQ ID NO: 367690 - DNA, 25 bp, Rattus norvegicus
gatggaccctctacttgttttcagg

SEQ ID NO: 367691 - DNA, 25 bp, Rattus norvegicus
gatggaccctcttcttgttttcagg

SEQ ID NO: 367692 - DNA, 25 bp, Rattus norvegicus
gatggaccgccaccagtgtgactgc

SEQ ID NO: 367693 - DNA, 25 bp, Rattus norvegicus
gatggaccgccagcagtgtgactgc

SEQ ID NO: 367694 - DNA, 25 bp, Rattus norvegicus
gatggaccgggtcttgtgacctcaa

SEQ ID NO: 367695 - DNA, 25 bp, Rattus norvegicus
gatggaccgggtgttgtgacctcaa

SEQ ID NO: 367696 - DNA, 25 bp, Rattus norvegicus
gatggacctaatacggttcccagag

SEQ ID NO: 367697 - DNA, 25 bp, Rattus norvegicus
gatggacctaattcggttcccagag

SEQ ID NO: 367698 - DNA, 25 bp, Rattus norvegicus
gatggacctagacggtctcattctg

SEQ ID NO: 367699 - DNA, 25 bp, Rattus norvegicus
gatggacctagagggtctcattctg

SEQ ID NO: 367700 - DNA, 25 bp, Rattus norvegicus
gatggacctggcattgcatttaact

SEQ ID NO: 367701 - DNA, 25 bp, Rattus norvegicus
gatggacctggctttgcatttaact

SEQ ID NO: 367702 - DNA, 25 bp, Rattus norvegicus
gatggacctgttagtactacatttt

SEQ ID NO: 367703 - DNA, 25 bp, Rattus norvegicus
gatggacctgtttgtactacatttt

SEQ ID NO: 367704 - DNA, 25 bp, Rattus norvegicus
gatggacgacctcctcacttcatac

SEQ ID NO: 367705 - DNA, 25 bp, Rattus norvegicus
gatggacgacctgctcacttcatac

SEQ ID NO: 367706 - DNA, 25 bp, Rattus norvegicus
gatggacgatgcagataattctgaa

SEQ ID NO: 367707 - DNA, 25 bp, Rattus norvegicus
gatggacgatgctgataattctgaa

SEQ ID NO: 367708 - DNA, 25 bp, Rattus norvegicus
gatggacgcatcacacggctggaga

SEQ ID NO: 367709 - DNA, 25 bp, Rattus norvegicus
gatggacgcatctcacggctggaga

SEQ ID NO: 367710 - DNA, 25 bp, Rattus norvegicus
gatggacgcccaccctcaggcatgg

SEQ ID NO: 367711 - DNA, 25 bp, Rattus norvegicus
gatggacgcccagcctcaggcatgg

SEQ ID NO: 367712 - DNA, 25 bp, Rattus norvegicus
gatggacgtccactgaaacttttcc

SEQ ID NO: 367713 - DNA, 25 bp, Rattus norvegicus
gatggacgtccagtgaaacttttcc

SEQ ID NO: 367714 - DNA, 25 bp, Rattus norvegicus
gatggacgtttcattttaggctgat

SEQ ID NO: 367715 - DNA, 25 bp, Rattus norvegicus
gatggacgtttctttttaggctgat

SEQ ID NO: 367716 - DNA, 25 bp, Rattus norvegicus
gatggactacatatgcagcgagcta

SEQ ID NO: 367717 - DNA, 25 bp, Rattus norvegicus
gatggactacatttgcagcgagcta

SEQ ID NO: 367718 - DNA, 25 bp, Rattus norvegicus
gatggactacgtaatccctttattg

SEQ ID NO: 367719 - DNA, 25 bp, Rattus norvegicus
gatggactacgttatccctttattg

SEQ ID NO: 367720 - DNA, 25 bp, Rattus norvegicus
gatggactcagcaggtacaggctct

SEQ ID NO: 367721 - DNA, 25 bp, Rattus norvegicus
gatggactcagctggtacaggctct

SEQ ID NO: 367722 - DNA, 25 bp, Rattus norvegicus
gatggactcggaagaccccggagca

SEQ ID NO: 367723 - DNA, 25 bp, Rattus norvegicus
gatggactcggatgaccccggagca

SEQ ID NO: 367724 - DNA, 25 bp, Rattus norvegicus
gatggactcggcagcctgtgaatgt

SEQ ID NO: 367725 - DNA, 25 bp, Rattus norvegicus
gatggactcggctgcctgtgaatgt

SEQ ID NO: 367726 - DNA, 25 bp, Rattus norvegicus
gatggactctcaaaagcacaccggc

SEQ ID NO: 367727 - DNA, 25 bp, Rattus norvegicus
gatggactctcataagcacaccggc

SEQ ID NO: 367728 - DNA, 25 bp, Rattus norvegicus
gatggactctccacagaaggtcgta

SEQ ID NO: 367729 - DNA, 25 bp, Rattus norvegicus
gatggactctcctcagaaggtcgta

SEQ ID NO: 367730 - DNA, 25 bp, Rattus norvegicus
gatggactgcagaagatcttcccct

SEQ ID NO: 367731 - DNA, 25 bp, Rattus norvegicus
gatggactgcagtagatcttcccct

SEQ ID NO: 367732 - DNA, 25 bp, Rattus norvegicus
gatggactgcatatgcctgagtcat

SEQ ID NO: 367733 - DNA, 25 bp, Rattus norvegicus
gatggactgcatttgcctgagtcat

SEQ ID NO: 367734 - DNA, 25 bp, Rattus norvegicus
gatggactgtatacatttctaaaac

SEQ ID NO: 367735 - DNA, 25 bp, Rattus norvegicus
gatggactgtatacctttgcaaaac

SEQ ID NO: 367736 - DNA, 25 bp, Rattus norvegicus
gatggactgtattcatttctaaaac

SEQ ID NO: 367737 - DNA, 25 bp, Rattus norvegicus
gatggactgtattcctttgcaaaac

SEQ ID NO: 367738 - DNA, 25 bp, Rattus norvegicus
gatggactgtgtaggcattccgtca

SEQ ID NO: 367739 - DNA, 25 bp, Rattus norvegicus
gatggactgtgttggcattccgtca

SEQ ID NO: 367740 - DNA, 25 bp, Rattus norvegicus
gatggactgttcaggaaatctatcc

SEQ ID NO: 367741 - DNA, 25 bp, Rattus norvegicus
gatggactgttctggaaatctatcc

SEQ ID NO: 367742 - DNA, 25 bp, Rattus norvegicus
gatggacttaagacacctcgtgacc

SEQ ID NO: 367743 - DNA, 25 bp, Rattus norvegicus
gatggacttaagtcacctcgtgacc

SEQ ID NO: 367744 - DNA, 25 bp, Rattus norvegicus
gatggacttagccatacatgctgct

SEQ ID NO: 367745 - DNA, 25 bp, Rattus norvegicus
gatggacttagcgatacatgctgct

SEQ ID NO: 367746 - DNA, 25 bp, Rattus norvegicus
gatggacttctaacaggactatcat

SEQ ID NO: 367747 - DNA, 25 bp, Rattus norvegicus
gatggacttctatcaggactatcat

SEQ ID NO: 367748 - DNA, 25 bp, Rattus norvegicus
gatggacttgctctaagcccagcca

SEQ ID NO: 367749 - DNA, 25 bp, Rattus norvegicus
gatggacttgctgtaagcccagcca

SEQ ID NO: 367750 - DNA, 25 bp, Rattus norvegicus
gatggacttgtgacccttgtgtgac

SEQ ID NO: 367751 - DNA, 25 bp, Rattus norvegicus
gatggacttgtgattggctgcagaa

SEQ ID NO: 367752 - DNA, 25 bp, Rattus norvegicus
gatggacttgtgtcccttgtgtgac

SEQ ID NO: 367753 - DNA, 25 bp, Rattus norvegicus
gatggacttgtgtttggctgcagaa

SEQ ID NO: 367754 - DNA, 25 bp, Rattus norvegicus
gatggacttttacgttgtttgttag

SEQ ID NO: 367755 - DNA, 25 bp, Rattus norvegicus
gatggacttttaggttgtttgttag

SEQ ID NO: 367756 - DNA, 25 bp, Rattus norvegicus
gatggagaaactattgcaccttgca

SEQ ID NO: 367757 - DNA, 25 bp, Rattus norvegicus
gatggagaaacttttgcaccttgca

SEQ ID NO: 367758 - DNA, 25 bp, Rattus norvegicus
gatggagaacatcacccaaggtctc

SEQ ID NO: 367759 - DNA, 25 bp, Rattus norvegicus
gatggagaacatgacccaaggtctc

SEQ ID NO: 367760 - DNA, 25 bp, Rattus norvegicus
gatggagaaccacttgtttgcccca

SEQ ID NO: 367761 - DNA, 25 bp, Rattus norvegicus
gatggagaaccagttgtttgcccca

SEQ ID NO: 367762 - DNA, 25 bp, Rattus norvegicus
gatggagaacgccaacttcggcttc

SEQ ID NO: 367763 - DNA, 25 bp, Rattus norvegicus
gatggagaacgcgaacttcggcttc

SEQ ID NO: 367764 - DNA, 25 bp, Rattus norvegicus
gatggagaactcaaggcctgcccaa

SEQ ID NO: 367765 - DNA, 25 bp, Rattus norvegicus
gatggagaactctaggcctgcccaa

SEQ ID NO: 367766 - DNA, 25 bp, Rattus norvegicus
gatggagaagccatcacatgccgct

SEQ ID NO: 367767 - DNA, 25 bp, Rattus norvegicus
gatggagaagccttcacatgccgct

SEQ ID NO: 367768 - DNA, 25 bp, Rattus norvegicus
gatggagacacaagtccacctctgc

SEQ ID NO: 367769 - DNA, 25 bp, Rattus norvegicus
gatggagacacatgtccacctctgc

SEQ ID NO: 367770 - DNA, 25 bp, Rattus norvegicus
gatggagaccaaaccggacaaggcc

SEQ ID NO: 367771 - DNA, 25 bp, Rattus norvegicus
gatggagaccaatccggacaaggcc

SEQ ID NO: 367772 - DNA, 25 bp, Rattus norvegicus
gatggagaccatcatgggctcactc

SEQ ID NO: 367773 - DNA, 25 bp, Rattus norvegicus
gatggagaccatccttcatttgttt

SEQ ID NO: 367774 - DNA, 25 bp, Rattus norvegicus
gatggagaccatgatgggctcactc

SEQ ID NO: 367775 - DNA, 25 bp, Rattus norvegicus
gatggagaccatgcttcatttgttt

SEQ ID NO: 367776 - DNA, 25 bp, Rattus norvegicus
gatggagacccaaggtggctcagcc

SEQ ID NO: 367777 - DNA, 25 bp, Rattus norvegicus
gatggagacccatggtggctcagcc

SEQ ID NO: 367778 - DNA, 25 bp, Rattus norvegicus
gatggagactgacaccctggcaacc

SEQ ID NO: 367779 - DNA, 25 bp, Rattus norvegicus
gatggagactgagaccctggcaacc

SEQ ID NO: 367780 - DNA, 25 bp, Rattus norvegicus
gatggagagcagctctttccagcca

SEQ ID NO: 367781 - DNA, 25 bp, Rattus norvegicus
gatggagagcaggtctttccagcca

SEQ ID NO: 367782 - DNA, 25 bp, Rattus norvegicus
gatggagagccccatagtgtctcac

SEQ ID NO: 367783 - DNA, 25 bp, Rattus norvegicus
gatggagagcccgatagtgtctcac

SEQ ID NO: 367784 - DNA, 25 bp, Rattus norvegicus
gatggagagtctaacacaggccttt

SEQ ID NO: 367785 - DNA, 25 bp, Rattus norvegicus
gatggagagtcttacacaggccttt

SEQ ID NO: 367786 - DNA, 25 bp, Rattus norvegicus
gatggagagtgcaagtccccgtgtc

SEQ ID NO: 367787 - DNA, 25 bp, Rattus norvegicus
gatggagagtgctagtccccgtgtc

SEQ ID NO: 367788 - DNA, 25 bp, Rattus norvegicus
gatggagagttaccgttcaagacaa

SEQ ID NO: 367789 - DNA, 25 bp, Rattus norvegicus
gatggagagttagcgttcaagacaa

SEQ ID NO: 367790 - DNA, 25 bp, Rattus norvegicus
gatggagagttcaccagtcctactt

SEQ ID NO: 367791 - DNA, 25 bp, Rattus norvegicus
gatggagagttcatctgggtcagca

SEQ ID NO: 367792 - DNA, 25 bp, Rattus norvegicus
gatggagagttctccagtcctactt

SEQ ID NO: 367793 - DNA, 25 bp, Rattus norvegicus
gatggagagttcttctgggtcagca

SEQ ID NO: 367794 - DNA, 25 bp, Rattus norvegicus
gatggagatgcacttcaggcctcag

SEQ ID NO: 367795 - DNA, 25 bp, Rattus norvegicus
gatggagatgcagttcaggcctcag

SEQ ID NO: 367796 - DNA, 25 bp, Rattus norvegicus
gatggagcaaacctaggcaggcctt

SEQ ID NO: 367797 - DNA, 25 bp, Rattus norvegicus
gatggagcaaacgtaggcaggcctt

SEQ ID NO: 367798 - DNA, 25 bp, Rattus norvegicus
gatggagcacatagtttaggtacaa

SEQ ID NO: 367799 - DNA, 25 bp, Rattus norvegicus
gatggagcacattgtttaggtacaa

SEQ ID NO: 367800 - DNA, 25 bp, Rattus norvegicus
gatggagcaccaagaccaggcttta

SEQ ID NO: 367801 - DNA, 25 bp, Rattus norvegicus
gatggagcaccatgaccaggcttta

SEQ ID NO: 367802 - DNA, 25 bp, Rattus norvegicus
gatggagcactaaacctcatggcag

SEQ ID NO: 367803 - DNA, 25 bp, Rattus norvegicus
gatggagcactatacctcatggcag

SEQ ID NO: 367804 - DNA, 25 bp, Rattus norvegicus
gatggagcacttccccgtgttgctg

SEQ ID NO: 367805 - DNA, 25 bp, Rattus norvegicus
gatggagcacttgcccgtgttgctg

SEQ ID NO: 367806 - DNA, 25 bp, Rattus norvegicus
gatggagcagacatcggtctcccct

SEQ ID NO: 367807 - DNA, 25 bp, Rattus norvegicus
gatggagcagacttcggtctcccct

SEQ ID NO: 367808 - DNA, 25 bp, Rattus norvegicus
gatggagcagctcaacagcacgttt

SEQ ID NO: 367809 - DNA, 25 bp, Rattus norvegicus
gatggagcagctgaacagcacgttt

SEQ ID NO: 367810 - DNA, 25 bp, Rattus norvegicus
gatggagcagtcatcacagcctttg

SEQ ID NO: 367811 - DNA, 25 bp, Rattus norvegicus
gatggagcagtcattgatgcctccc

SEQ ID NO: 367812 - DNA, 25 bp, Rattus norvegicus
gatggagcagtcttcacagcctttg

SEQ ID NO: 367813 - DNA, 25 bp, Rattus norvegicus
gatggagcagtctttgatgcctccc

SEQ ID NO: 367814 - DNA, 25 bp, Rattus norvegicus
gatggagccagtatagcaaaacctt

SEQ ID NO: 367815 - DNA, 25 bp, Rattus norvegicus
gatggagccagtttagcaaaacctt

SEQ ID NO: 367816 - DNA, 25 bp, Rattus norvegicus
gatggagccatgatccagggcaact

SEQ ID NO: 367817 - DNA, 25 bp, Rattus norvegicus
gatggagccatgttccagggcaact

SEQ ID NO: 367818 - DNA, 25 bp, Rattus norvegicus
gatggagcccacaggattttatgag

SEQ ID NO: 367819 - DNA, 25 bp, Rattus norvegicus
gatggagcccactggattttatgag

SEQ ID NO: 367820 - DNA, 25 bp, Rattus norvegicus
gatggagcccggacttcacacctga

SEQ ID NO: 367821 - DNA, 25 bp, Rattus norvegicus
gatggagcccggtcttcacacctga

SEQ ID NO: 367822 - DNA, 25 bp, Rattus norvegicus
gatggagccctcaacgtggacctca

SEQ ID NO: 367823 - DNA, 25 bp, Rattus norvegicus
gatggagccctctacgtggacctca

SEQ ID NO: 367824 - DNA, 25 bp, Rattus norvegicus
gatggagccctgaggtcacatgatg

SEQ ID NO: 367825 - DNA, 25 bp, Rattus norvegicus
gatggagccctgtggtcacatgatg

SEQ ID NO: 367826 - DNA, 25 bp, Rattus norvegicus
gatggagcctggaatccaggacaca

SEQ ID NO: 367827 - DNA, 25 bp, Rattus norvegicus
gatggagcctggtatccaggacaca

SEQ ID NO: 367828 - DNA, 25 bp, Rattus norvegicus
gatggagcgcatcaatttggagaaa

SEQ ID NO: 367829 - DNA, 25 bp, Rattus norvegicus
gatggagcgcatgaatttggagaaa

SEQ ID NO: 367830 - DNA, 25 bp, Rattus norvegicus
gatggagcgtcaacgccgtgacatt

SEQ ID NO: 367831 - DNA, 25 bp, Rattus norvegicus
gatggagcgtcatcgccgtgacatt

SEQ ID NO: 367832 - DNA, 25 bp, Rattus norvegicus
gatggagctcctcatctgcaggcat

SEQ ID NO: 367833 - DNA, 25 bp, Rattus norvegicus
gatggagctcctcatgatgggcctc

SEQ ID NO: 367834 - DNA, 25 bp, Rattus norvegicus
gatggagctcctgatctgcaggcat

SEQ ID NO: 367835 - DNA, 25 bp, Rattus norvegicus
gatggagctcctgatgatgggcctc

SEQ ID NO: 367836 - DNA, 25 bp, Rattus norvegicus
gatggagctcgtatgatgagaccta

SEQ ID NO: 367837 - DNA, 25 bp, Rattus norvegicus
gatggagctcgtttgatgagaccta

SEQ ID NO: 367838 - DNA, 25 bp, Rattus norvegicus
gatggagctctccatggaactaagg

SEQ ID NO: 367839 - DNA, 25 bp, Rattus norvegicus
gatggagctctcgatggaactaagg

SEQ ID NO: 367840 - DNA, 25 bp, Rattus norvegicus
gatggagctcttcatttagaaacgc

SEQ ID NO: 367841 - DNA, 25 bp, Rattus norvegicus
gatggagctcttgatttagaaacgc

SEQ ID NO: 367842 - DNA, 25 bp, Rattus norvegicus
gatggagctgcgcaactacttctcc

SEQ ID NO: 367843 - DNA, 25 bp, Rattus norvegicus
gatggagctgcggaactacttctcc

SEQ ID NO: 367844 - DNA, 25 bp, Rattus norvegicus
gatggagctgttaaccgagcaactg

SEQ ID NO: 367845 - DNA, 25 bp, Rattus norvegicus
gatggagctgtttaccgagcaactg

SEQ ID NO: 367846 - DNA, 25 bp, Rattus norvegicus
gatggagcttctatctatagattct

SEQ ID NO: 367847 - DNA, 25 bp, Rattus norvegicus
gatggagcttctttctatagattct

SEQ ID NO: 367848 - DNA, 25 bp, Rattus norvegicus
gatggaggaagtcttccctttctgc

SEQ ID NO: 367849 - DNA, 25 bp, Rattus norvegicus
gatggaggaagtgttccctttctgc

SEQ ID NO: 367850 - DNA, 25 bp, Rattus norvegicus
gatggaggacgaataaaaacttaca

SEQ ID NO: 367851 - DNA, 25 bp, Rattus norvegicus
gatggaggacgattaaaaacttaca

SEQ ID NO: 367852 - DNA, 25 bp, Rattus norvegicus
gatggaggaggtccctccaacctgt

SEQ ID NO: 367853 - DNA, 25 bp, Rattus norvegicus
gatggaggaggtgcctccaacctgt

SEQ ID NO: 367854 - DNA, 25 bp, Rattus norvegicus
gatggaggcatcaacacctgcaagg

SEQ ID NO: 367855 - DNA, 25 bp, Rattus norvegicus
gatggaggcatctacacctgcaagg

SEQ ID NO: 367856 - DNA, 25 bp, Rattus norvegicus
gatggaggcatgacactgcaaagca

SEQ ID NO: 367857 - DNA, 25 bp, Rattus norvegicus
gatggaggcatgtcactgcaaagca

SEQ ID NO: 367858 - DNA, 25 bp, Rattus norvegicus
gatggaggcctcaacataaatgtat

SEQ ID NO: 367859 - DNA, 25 bp, Rattus norvegicus
gatggaggcctctacataaatgtat

SEQ ID NO: 367860 - DNA, 25 bp, Rattus norvegicus
gatggaggccttaatcttgaagctg

SEQ ID NO: 367861 - DNA, 25 bp, Rattus norvegicus
gatggaggcctttatcttgaagctg

SEQ ID NO: 367862 - DNA, 25 bp, Rattus norvegicus
gatggaggctaccttcctagcccta

SEQ ID NO: 367863 - DNA, 25 bp, Rattus norvegicus
gatggaggctacgttcctagcccta

SEQ ID NO: 367864 - DNA, 25 bp, Rattus norvegicus
gatggaggctcgaaagcactttcct

SEQ ID NO: 367865 - DNA, 25 bp, Rattus norvegicus
gatggaggctcgtaagcactttcct

SEQ ID NO: 367866 - DNA, 25 bp, Rattus norvegicus
gatggaggcttgctcttcggtacct

SEQ ID NO: 367867 - DNA, 25 bp, Rattus norvegicus
gatggaggcttggtcttcggtacct

SEQ ID NO: 367868 - DNA, 25 bp, Rattus norvegicus
gatggagggtccagcaatcgactgt

SEQ ID NO: 367869 - DNA, 25 bp, Rattus norvegicus
gatggagggtcctgcaatcgactgt

SEQ ID NO: 367870 - DNA, 25 bp, Rattus norvegicus
gatggaggtgacatcactggctgca

SEQ ID NO: 367871 - DNA, 25 bp, Rattus norvegicus
gatggaggtgacttcactggctgca

SEQ ID NO: 367872 - DNA, 25 bp, Rattus norvegicus
gatggaggtggtaacttcagctaaa

SEQ ID NO: 367873 - DNA, 25 bp, Rattus norvegicus
gatggaggtggttacttcagctaaa

SEQ ID NO: 367874 - DNA, 25 bp, Rattus norvegicus
gatggaggtttgcagaccttttcca

SEQ ID NO: 367875 - DNA, 25 bp, Rattus norvegicus
gatggaggtttggagaccttttcca

SEQ ID NO: 367876 - DNA, 25 bp, Rattus norvegicus
gatggagtaacccttagcagtgatg

SEQ ID NO: 367877 - DNA, 25 bp, Rattus norvegicus
gatggagtaaccgttagcagtgatg

SEQ ID NO: 367878 - DNA, 25 bp, Rattus norvegicus
gatggagtacctctctgtcagctgc

SEQ ID NO: 367879 - DNA, 25 bp, Rattus norvegicus
gatggagtacctgtctgtcagctgc

SEQ ID NO: 367880 - DNA, 25 bp, Rattus norvegicus
gatggagtaggactctgcttcccat

SEQ ID NO: 367881 - DNA, 25 bp, Rattus norvegicus
gatggagtaggagtctgcttcccat

SEQ ID NO: 367882 - DNA, 25 bp, Rattus norvegicus
gatggagtcattatgcaggaggcat

SEQ ID NO: 367883 - DNA, 25 bp, Rattus norvegicus
gatggagtcattttgcaggaggcat

SEQ ID NO: 367884 - DNA, 25 bp, Rattus norvegicus
gatggagtcctcagaggcctatgga

SEQ ID NO: 367885 - DNA, 25 bp, Rattus norvegicus
gatggagtcctctgaggcctatgga

SEQ ID NO: 367886 - DNA, 25 bp, Rattus norvegicus
gatggagtctgtagtgacgacgtca

SEQ ID NO: 367887 - DNA, 25 bp, Rattus norvegicus
gatggagtctgttgtgacgacgtca

SEQ ID NO: 367888 - DNA, 25 bp, Rattus norvegicus
gatggagtcttactaggatgtcctt

SEQ ID NO: 367889 - DNA, 25 bp, Rattus norvegicus
gatggagtcttagtaggatgtcctt

SEQ ID NO: 367890 - DNA, 25 bp, Rattus norvegicus
gatggagtcttccaaaggctctcag

SEQ ID NO: 367891 - DNA, 25 bp, Rattus norvegicus
gatggagtcttcgaaaggctctcag

SEQ ID NO: 367892 - DNA, 25 bp, Rattus norvegicus
gatggagtgcgtcaatcctgataaa

SEQ ID NO: 367893 - DNA, 25 bp, Rattus norvegicus
gatggagtgcgtgaatcctgataaa

SEQ ID NO: 367894 - DNA, 25 bp, Rattus norvegicus
gatggagttcatcccttcaagataa

SEQ ID NO: 367895 - DNA, 25 bp, Rattus norvegicus
gatggagttcatgccttcaagataa

SEQ ID NO: 367896 - DNA, 25 bp, Rattus norvegicus
gatggagttcctcacgtggaagcct

SEQ ID NO: 367897 - DNA, 25 bp, Rattus norvegicus
gatggagttcctgacgtggaagcct

SEQ ID NO: 367898 - DNA, 25 bp, Rattus norvegicus
gatggagttgacaggtttctttaca

SEQ ID NO: 367899 - DNA, 25 bp, Rattus norvegicus
gatggagttgactggtttctttaca

SEQ ID NO: 367900 - DNA, 25 bp, Rattus norvegicus
gatggagtttggcatattccaagga

SEQ ID NO: 367901 - DNA, 25 bp, Rattus norvegicus
gatggagtttgggatattccaagga

SEQ ID NO: 367902 - DNA, 25 bp, Rattus norvegicus
gatggataacccctgctttccaaat

SEQ ID NO: 367903 - DNA, 25 bp, Rattus norvegicus
gatggataacccgtgctttccaaat

SEQ ID NO: 367904 - DNA, 25 bp, Rattus norvegicus
gatggatacattcctcttatttatt

SEQ ID NO: 367905 - DNA, 25 bp, Rattus norvegicus
gatggatacattgctcttatttatt

SEQ ID NO: 367906 - DNA, 25 bp, Rattus norvegicus
gatggataccctaggaattccttat

SEQ ID NO: 367907 - DNA, 25 bp, Rattus norvegicus
gatggatacccttggaattccttat

SEQ ID NO: 367908 - DNA, 25 bp, Rattus norvegicus
gatggatagacaaacggccgcgcat

SEQ ID NO: 367909 - DNA, 25 bp, Rattus norvegicus
gatggatagacatacggccgcgcat

SEQ ID NO: 367910 - DNA, 25 bp, Rattus norvegicus
gatggatagatacttcctttttcct

SEQ ID NO: 367911 - DNA, 25 bp, Rattus norvegicus
gatggatagatagttcctttttcct

SEQ ID NO: 367912 - DNA, 25 bp, Rattus norvegicus
gatggatatatgactgctcagtttc

SEQ ID NO: 367913 - DNA, 25 bp, Rattus norvegicus
gatggatatatgtctgctcagtttc

SEQ ID NO: 367914 - DNA, 25 bp, Rattus norvegicus
gatggatatctgatacttcttgctc

SEQ ID NO: 367915 - DNA, 25 bp, Rattus norvegicus
gatggatatctgttacttcttgctc

SEQ ID NO: 367916 - DNA, 25 bp, Rattus norvegicus
gatggatattctaggttggctagct

SEQ ID NO: 367917 - DNA, 25 bp, Rattus norvegicus
gatggatattcttggttggctagct

SEQ ID NO: 367918 - DNA, 25 bp, Rattus norvegicus
gatggatatttcagcttctactttt

SEQ ID NO: 367919 - DNA, 25 bp, Rattus norvegicus
gatggatatttctgcttctactttt

SEQ ID NO: 367920 - DNA, 25 bp, Rattus norvegicus
gatggatcactaactcctgacattt

SEQ ID NO: 367921 - DNA, 25 bp, Rattus norvegicus
gatggatcactatctcctgacattt

SEQ ID NO: 367922 - DNA, 25 bp, Rattus norvegicus
gatggatcatctctacttctgtatt

SEQ ID NO: 367923 - DNA, 25 bp, Rattus norvegicus
gatggatcatctgtacttctgtatt

SEQ ID NO: 367924 - DNA, 25 bp, Rattus norvegicus
gatggatccactagtttgtaagcat

SEQ ID NO: 367925 - DNA, 25 bp, Rattus norvegicus
gatggatccacttgtttgtaagcat

SEQ ID NO: 367926 - DNA, 25 bp, Rattus norvegicus
gatggatccatgagagttgttagac

SEQ ID NO: 367927 - DNA, 25 bp, Rattus norvegicus
gatggatccatgtgagttgttagac

SEQ ID NO: 367928 - DNA, 25 bp, Rattus norvegicus
gatggatccccaagtaaactgtttt

SEQ ID NO: 367929 - DNA, 25 bp, Rattus norvegicus
gatggatccccatgtaaactgtttt

SEQ ID NO: 367930 - DNA, 25 bp, Rattus norvegicus
gatggatcccttatttattttgtgt

SEQ ID NO: 367931 - DNA, 25 bp, Rattus norvegicus
gatggatcccttttttattttgtgt

SEQ ID NO: 367932 - DNA, 25 bp, Rattus norvegicus
gatggatcctacagatgccaagtat

SEQ ID NO: 367933 - DNA, 25 bp, Rattus norvegicus
gatggatcctactgatgccaagtat

SEQ ID NO: 367934 - DNA, 25 bp, Rattus norvegicus
gatggatcgggtactaaagctctaa

SEQ ID NO: 367935 - DNA, 25 bp, Rattus norvegicus
gatggatcgggttctaaagctctaa

SEQ ID NO: 367936 - DNA, 25 bp, Rattus norvegicus
gatggatctggacgatcctgaagaa

SEQ ID NO: 367937 - DNA, 25 bp, Rattus norvegicus
gatggatctggaggatcctgaagaa

SEQ ID NO: 367938 - DNA, 25 bp, Rattus norvegicus
gatggatctgtaaaacctcctttga

SEQ ID NO: 367939 - DNA, 25 bp, Rattus norvegicus
gatggatctgtataacctcctttga

SEQ ID NO: 367940 - DNA, 25 bp, Rattus norvegicus
gatggatctttaacgccacggcaca

SEQ ID NO: 367941 - DNA, 25 bp, Rattus norvegicus
gatggatctttatcgccacggcaca

SEQ ID NO: 367942 - DNA, 25 bp, Rattus norvegicus
gatggatctttcaggtatccagaat

SEQ ID NO: 367943 - DNA, 25 bp, Rattus norvegicus
gatggatctttctggtatccagaat

SEQ ID NO: 367944 - DNA, 25 bp, Rattus norvegicus
gatggatgactaacagcgagcctct

SEQ ID NO: 367945 - DNA, 25 bp, Rattus norvegicus
gatggatgactatcagcgagcctct

SEQ ID NO: 367946 - DNA, 25 bp, Rattus norvegicus
gatggatgactcatctgcatggtta

SEQ ID NO: 367947 - DNA, 25 bp, Rattus norvegicus
gatggatgactcttctgcatggtta

SEQ ID NO: 367948 - DNA, 25 bp, Rattus norvegicus
gatggatgattcagaacctgcatta

SEQ ID NO: 367949 - DNA, 25 bp, Rattus norvegicus
gatggatgattctgaacctgcatta

SEQ ID NO: 367950 - DNA, 25 bp, Rattus norvegicus
gatggatgcattacacattgtcaga

SEQ ID NO: 367951 - DNA, 25 bp, Rattus norvegicus
gatggatgcatttcacattgtcaga

SEQ ID NO: 367952 - DNA, 25 bp, Rattus norvegicus
gatggatgcccacctgacactacag

SEQ ID NO: 367953 - DNA, 25 bp, Rattus norvegicus
gatggatgcccagctgacactacag

SEQ ID NO: 367954 - DNA, 25 bp, Rattus norvegicus
gatggatgcctgacttagatgtcaa

SEQ ID NO: 367955 - DNA, 25 bp, Rattus norvegicus
gatggatgcctgtcttagatgtcaa

SEQ ID NO: 367956 - DNA, 25 bp, Rattus norvegicus
gatggatgctcacattccttgttag

SEQ ID NO: 367957 - DNA, 25 bp, Rattus norvegicus
gatggatgctcagattccttgttag

SEQ ID NO: 367958 - DNA, 25 bp, Rattus norvegicus
gatggatgctgaagctgtttcaaga

SEQ ID NO: 367959 - DNA, 25 bp, Rattus norvegicus
gatggatgctgacctgtcacatcaa

SEQ ID NO: 367960 - DNA, 25 bp, Rattus norvegicus
gatggatgctgagctgtcacatcaa

SEQ ID NO: 367961 - DNA, 25 bp, Rattus norvegicus
gatggatgctgatgctgtttcaaga

SEQ ID NO: 367962 - DNA, 25 bp, Rattus norvegicus
gatggatgcttacacttctgatgaa

SEQ ID NO: 367963 - DNA, 25 bp, Rattus norvegicus
gatggatgcttagacttctgatgaa

SEQ ID NO: 367964 - DNA, 25 bp, Rattus norvegicus
gatggatggcaccacaggtctgcaa

SEQ ID NO: 367965 - DNA, 25 bp, Rattus norvegicus
gatggatggcacgacaggtctgcaa

SEQ ID NO: 367966 - DNA, 25 bp, Rattus norvegicus
gatggatggccaagtatcctctgcc

SEQ ID NO: 367967 - DNA, 25 bp, Rattus norvegicus
gatggatggccatgtatcctctgcc

SEQ ID NO: 367968 - DNA, 25 bp, Rattus norvegicus
gatggatgtcttcgctacaaaaaca

SEQ ID NO: 367969 - DNA, 25 bp, Rattus norvegicus
gatggatgtcttggctacaaaaaca

SEQ ID NO: 367970 - DNA, 25 bp, Rattus norvegicus
gatggatgtggcactggcatgacta

SEQ ID NO: 367971 - DNA, 25 bp, Rattus norvegicus
gatggatgtggctctggcatgacta

SEQ ID NO: 367972 - DNA, 25 bp, Rattus norvegicus
gatggattaaatctcctcctgtttt

SEQ ID NO: 367973 - DNA, 25 bp, Rattus norvegicus
gatggattaaatgtcctcctgtttt

SEQ ID NO: 367974 - DNA, 25 bp, Rattus norvegicus
gatggattaatgattttctcagtct

SEQ ID NO: 367975 - DNA, 25 bp, Rattus norvegicus
gatggattaatgtttttctcagtct

SEQ ID NO: 367976 - DNA, 25 bp, Rattus norvegicus
gatggattaccacgcttgtgtagct

SEQ ID NO: 367977 - DNA, 25 bp, Rattus norvegicus
gatggattaccaggcttgtgtagct

SEQ ID NO: 367978 - DNA, 25 bp, Rattus norvegicus
gatggattacctcggcaacgccact

SEQ ID NO: 367979 - DNA, 25 bp, Rattus norvegicus
gatggattacctgggcaacgccact

SEQ ID NO: 367980 - DNA, 25 bp, Rattus norvegicus
gatggattccatcgagcacttacct

SEQ ID NO: 367981 - DNA, 25 bp, Rattus norvegicus
gatggattccatggagcacttacct

SEQ ID NO: 367982 - DNA, 25 bp, Rattus norvegicus
gatggattcctaaacagcacatggg

SEQ ID NO: 367983 - DNA, 25 bp, Rattus norvegicus
gatggattcctatacagcacatggg

SEQ ID NO: 367984 - DNA, 25 bp, Rattus norvegicus
gatggattcctgagtatcgctgatc

SEQ ID NO: 367985 - DNA, 25 bp, Rattus norvegicus
gatggattcctgtgtatcgctgatc

SEQ ID NO: 367986 - DNA, 25 bp, Rattus norvegicus
gatggattcgggatactctgactgg

SEQ ID NO: 367987 - DNA, 25 bp, Rattus norvegicus
gatggattcgggttactctgactgg

SEQ ID NO: 367988 - DNA, 25 bp, Rattus norvegicus
gatggattctcacccgtgtgaacaa

SEQ ID NO: 367989 - DNA, 25 bp, Rattus norvegicus
gatggattctcagccgtgtgaacaa

SEQ ID NO: 367990 - DNA, 25 bp, Rattus norvegicus
gatggattctctcaggaggtacccc

SEQ ID NO: 367991 - DNA, 25 bp, Rattus norvegicus
gatggattctctgaggaggtacccc

SEQ ID NO: 367992 - DNA, 25 bp, Rattus norvegicus
gatggattcttgaatgtggcctaca

SEQ ID NO: 367993 - DNA, 25 bp, Rattus norvegicus
gatggattcttgtatgtggcctaca

SEQ ID NO: 367994 - DNA, 25 bp, Rattus norvegicus
gatggattgaacagcgtcacaacct

SEQ ID NO: 367995 - DNA, 25 bp, Rattus norvegicus
gatggattgaactgcgtcacaacct

SEQ ID NO: 367996 - DNA, 25 bp, Rattus norvegicus
gatggattgcagattattttttcag

SEQ ID NO: 367997 - DNA, 25 bp, Rattus norvegicus
gatggattgcagtttattttttcag

SEQ ID NO: 367998 - DNA, 25 bp, Rattus norvegicus
gatggattgcctagtcagttcagtg

SEQ ID NO: 367999 - DNA, 25 bp, Rattus norvegicus
gatggattgccttgtcagttcagtg

SEQ ID NO: 368000 - DNA, 25 bp, Rattus norvegicus
gatggattggtacacgactgctgta

SEQ ID NO: 368001 - DNA, 25 bp, Rattus norvegicus
gatggattggtagacgactgctgta

SEQ ID NO: 368002 - DNA, 25 bp, Rattus norvegicus
gatggatttactaggctgactacag

SEQ ID NO: 368003 - DNA, 25 bp, Rattus norvegicus
gatggatttacttggctgactacag

SEQ ID NO: 368004 - DNA, 25 bp, Rattus norvegicus
gatggatttcacagttcctgatcta

SEQ ID NO: 368005 - DNA, 25 bp, Rattus norvegicus
gatggatttcactgttcctgatcta

SEQ ID NO: 368006 - DNA, 25 bp, Rattus norvegicus
gatggatttccaaactggccaaact

SEQ ID NO: 368007 - DNA, 25 bp, Rattus norvegicus
gatggatttccaagtcagcttgtcc

SEQ ID NO: 368008 - DNA, 25 bp, Rattus norvegicus
gatggatttccatactggccaaact

SEQ ID NO: 368009 - DNA, 25 bp, Rattus norvegicus
gatggatttccatgtcagcttgtcc

SEQ ID NO: 368010 - DNA, 25 bp, Rattus norvegicus
gatggatttctaagctttgttttta

SEQ ID NO: 368011 - DNA, 25 bp, Rattus norvegicus
gatggatttctatgctttgttttta

SEQ ID NO: 368012 - DNA, 25 bp, Rattus norvegicus
gatggatttctccaaggccaaattc

SEQ ID NO: 368013 - DNA, 25 bp, Rattus norvegicus
gatggatttctcgaaggccaaattc

SEQ ID NO: 368014 - DNA, 25 bp, Rattus norvegicus
gatggatttctgagtgccaaggcca

SEQ ID NO: 368015 - DNA, 25 bp, Rattus norvegicus
gatggatttctgtgtgccaaggcca

SEQ ID NO: 368016 - DNA, 25 bp, Rattus norvegicus
gatggatttcttccggagaatcgat

SEQ ID NO: 368017 - DNA, 25 bp, Rattus norvegicus
gatggatttcttgcggagaatcgat

SEQ ID NO: 368018 - DNA, 25 bp, Rattus norvegicus
gatggatttgacacggtgccactga

SEQ ID NO: 368019 - DNA, 25 bp, Rattus norvegicus
gatggatttgactcggtgccactga

SEQ ID NO: 368020 - DNA, 25 bp, Rattus norvegicus
gatggattttcccttttaccagcct

SEQ ID NO: 368021 - DNA, 25 bp, Rattus norvegicus
gatggattttccgttttaccagcct

SEQ ID NO: 368022 - DNA, 25 bp, Rattus norvegicus
gatggatttttacctgttgtgactc

SEQ ID NO: 368023 - DNA, 25 bp, Rattus norvegicus
gatggatttttagctgttgtgactc

SEQ ID NO: 368024 - DNA, 25 bp, Rattus norvegicus
gatggcaaaaaccttgcagcttttt

SEQ ID NO: 368025 - DNA, 25 bp, Rattus norvegicus
gatggcaaaaacgttgcagcttttt

SEQ ID NO: 368026 - DNA, 25 bp, Rattus norvegicus
gatggcaaacatacctcacacttag

SEQ ID NO: 368027 - DNA, 25 bp, Rattus norvegicus
gatggcaaacattcctcacacttag

SEQ ID NO: 368028 - DNA, 25 bp, Rattus norvegicus
gatggcaaacggaaactttcaaaga

SEQ ID NO: 368029 - DNA, 25 bp, Rattus norvegicus
gatggcaaacggtaactttcaaaga

SEQ ID NO: 368030 - DNA, 25 bp, Rattus norvegicus
gatggcaaaggcaggcatttctaag

SEQ ID NO: 368031 - DNA, 25 bp, Rattus norvegicus
gatggcaaaggctggcatttctaag

SEQ ID NO: 368032 - DNA, 25 bp, Rattus norvegicus
gatggcaaatccacacctctagggt

SEQ ID NO: 368033 - DNA, 25 bp, Rattus norvegicus
gatggcaaatcctcacctctagggt

SEQ ID NO: 368034 - DNA, 25 bp, Rattus norvegicus
gatggcaaatgaagctgtcgacaac

SEQ ID NO: 368035 - DNA, 25 bp, Rattus norvegicus
gatggcaaatgatgctgtcgacaac

SEQ ID NO: 368036 - DNA, 25 bp, Rattus norvegicus
gatggcaaatgtacgaaagtctctt

SEQ ID NO: 368037 - DNA, 25 bp, Rattus norvegicus
gatggcaaatgttcgaaagtctctt

SEQ ID NO: 368038 - DNA, 25 bp, Rattus norvegicus
gatggcaaccttaccttagagcaga

SEQ ID NO: 368039 - DNA, 25 bp, Rattus norvegicus
gatggcaacctttccttagagcaga

SEQ ID NO: 368040 - DNA, 25 bp, Rattus norvegicus
gatggcaactcacgaaagttcttaa

SEQ ID NO: 368041 - DNA, 25 bp, Rattus norvegicus
gatggcaactcaggaaagttcttaa

SEQ ID NO: 368042 - DNA, 25 bp, Rattus norvegicus
gatggcaactgaagacttgtgtgca

SEQ ID NO: 368043 - DNA, 25 bp, Rattus norvegicus
gatggcaactgatgacttgtgtgca

SEQ ID NO: 368044 - DNA, 25 bp, Rattus norvegicus
gatggcaagatcaagctcactaccc

SEQ ID NO: 368045 - DNA, 25 bp, Rattus norvegicus
gatggcaagatctagctcactaccc

SEQ ID NO: 368046 - DNA, 25 bp, Rattus norvegicus
gatggcaaggtcaacatttgctgta

SEQ ID NO: 368047 - DNA, 25 bp, Rattus norvegicus
gatggcaaggtctacatttgctgta

SEQ ID NO: 368048 - DNA, 25 bp, Rattus norvegicus
gatggcaatcttctgctggacccca

SEQ ID NO: 368049 - DNA, 25 bp, Rattus norvegicus
gatggcaatcttgtgctggacccca

SEQ ID NO: 368050 - DNA, 25 bp, Rattus norvegicus
gatggcaattacagcttacactata

SEQ ID NO: 368051 - DNA, 25 bp, Rattus norvegicus
gatggcaattactgcttacactata

SEQ ID NO: 368052 - DNA, 25 bp, Rattus norvegicus
gatggcacaagcatgcgtggctcaa

SEQ ID NO: 368053 - DNA, 25 bp, Rattus norvegicus
gatggcacaagcttgcgtggctcaa

SEQ ID NO: 368054 - DNA, 25 bp, Rattus norvegicus
gatggcacaccaagatgtgactctt

SEQ ID NO: 368055 - DNA, 25 bp, Rattus norvegicus
gatggcacaccatgatgtgactctt

SEQ ID NO: 368056 - DNA, 25 bp, Rattus norvegicus
gatggcacagctcttcattaaagga

SEQ ID NO: 368057 - DNA, 25 bp, Rattus norvegicus
gatggcacagctgttcattaaagga

SEQ ID NO: 368058 - DNA, 25 bp, Rattus norvegicus
gatggcacaggcagcaagtgccctg

SEQ ID NO: 368059 - DNA, 25 bp, Rattus norvegicus
gatggcacaggctgcaagtgccctg

SEQ ID NO: 368060 - DNA, 25 bp, Rattus norvegicus
gatggcacatagatcaagctgcttt

SEQ ID NO: 368061 - DNA, 25 bp, Rattus norvegicus
gatggcacatagttcaagctgcttt

SEQ ID NO: 368062 - DNA, 25 bp, Rattus norvegicus
gatggcacatctcttgtgttcagtt

SEQ ID NO: 368063 - DNA, 25 bp, Rattus norvegicus
gatggcacatctgttgtgttcagtt

SEQ ID NO: 368064 - DNA, 25 bp, Rattus norvegicus
gatggcacattcctacaattgaaga

SEQ ID NO: 368065 - DNA, 25 bp, Rattus norvegicus
gatggcacattcgtacaattgaaga

SEQ ID NO: 368066 - DNA, 25 bp, Rattus norvegicus
gatggcaccggcatacaaagagaat

SEQ ID NO: 368067 - DNA, 25 bp, Rattus norvegicus
gatggcaccggcttacaaagagaat

SEQ ID NO: 368068 - DNA, 25 bp, Rattus norvegicus
gatggcactgctcgtacaagaactt

SEQ ID NO: 368069 - DNA, 25 bp, Rattus norvegicus
gatggcactgctggtacaagaactt

SEQ ID NO: 368070 - DNA, 25 bp, Rattus norvegicus
gatggcactggaattacaaacaagg

SEQ ID NO: 368071 - DNA, 25 bp, Rattus norvegicus
gatggcactggatttacaaacaagg

SEQ ID NO: 368072 - DNA, 25 bp, Rattus norvegicus
gatggcactgtacctctcaagggac

SEQ ID NO: 368073 - DNA, 25 bp, Rattus norvegicus
gatggcactgtagctctcaagggac

SEQ ID NO: 368074 - DNA, 25 bp, Rattus norvegicus
gatggcactgtgactccttgaaagc

SEQ ID NO: 368075 - DNA, 25 bp, Rattus norvegicus
gatggcactgtgtctccttgaaagc

SEQ ID NO: 368076 - DNA, 25 bp, Rattus norvegicus
gatggcactgttaaccggaagttca

SEQ ID NO: 368077 - DNA, 25 bp, Rattus norvegicus
gatggcactgttaatttctcctctc

SEQ ID NO: 368078 - DNA, 25 bp, Rattus norvegicus
gatggcactgtttaccggaagttca

SEQ ID NO: 368079 - DNA, 25 bp, Rattus norvegicus
gatggcactgtttatttctcctctc

SEQ ID NO: 368080 - DNA, 25 bp, Rattus norvegicus
gatggcagaaccatttttagcttgt

SEQ ID NO: 368081 - DNA, 25 bp, Rattus norvegicus
gatggcagaaccttttttagcttgt

SEQ ID NO: 368082 - DNA, 25 bp, Rattus norvegicus
gatggcagaactaacttcaagggct

SEQ ID NO: 368083 - DNA, 25 bp, Rattus norvegicus
gatggcagaacttacttcaagggct

SEQ ID NO: 368084 - DNA, 25 bp, Rattus norvegicus
gatggcagaattcgcctcaggcagt

SEQ ID NO: 368085 - DNA, 25 bp, Rattus norvegicus
gatggcagaattggcctcaggcagt

SEQ ID NO: 368086 - DNA, 25 bp, Rattus norvegicus
gatggcagacgtaatccgagcagaa

SEQ ID NO: 368087 - DNA, 25 bp, Rattus norvegicus
gatggcagacgttatccgagcagaa

SEQ ID NO: 368088 - DNA, 25 bp, Rattus norvegicus
gatggcagagttcattcattcacct

SEQ ID NO: 368089 - DNA, 25 bp, Rattus norvegicus
gatggcagagttgattcattcacct

SEQ ID NO: 368090 - DNA, 25 bp, Rattus norvegicus
gatggcagcagtacaccaaaccagt

SEQ ID NO: 368091 - DNA, 25 bp, Rattus norvegicus
gatggcagcagttcaccaaaccagt

SEQ ID NO: 368092 - DNA, 25 bp, Rattus norvegicus
gatggcagccagagcatgttagctt

SEQ ID NO: 368093 - DNA, 25 bp, Rattus norvegicus
gatggcagccagagtgatcatcggc

SEQ ID NO: 368094 - DNA, 25 bp, Rattus norvegicus
gatggcagccagtgcatgttagctt

SEQ ID NO: 368095 - DNA, 25 bp, Rattus norvegicus
gatggcagccagtgtgatcatcggc

SEQ ID NO: 368096 - DNA, 25 bp, Rattus norvegicus
gatggcagccatcatttcattggag

SEQ ID NO: 368097 - DNA, 25 bp, Rattus norvegicus
gatggcagccatgatttcattggag

SEQ ID NO: 368098 - DNA, 25 bp, Rattus norvegicus
gatggcagcccacacacttacaagt

SEQ ID NO: 368099 - DNA, 25 bp, Rattus norvegicus
gatggcagcccagacacttacaagt

SEQ ID NO: 368100 - DNA, 25 bp, Rattus norvegicus
gatggcagcctgaacatgacagact

SEQ ID NO: 368101 - DNA, 25 bp, Rattus norvegicus
gatggcagcctgacaccgaggaaga

SEQ ID NO: 368102 - DNA, 25 bp, Rattus norvegicus
gatggcagcctgtacatgacagact

SEQ ID NO: 368103 - DNA, 25 bp, Rattus norvegicus
gatggcagcctgtcaccgaggaaga

SEQ ID NO: 368104 - DNA, 25 bp, Rattus norvegicus
gatggcagctgcaagctctccataa

SEQ ID NO: 368105 - DNA, 25 bp, Rattus norvegicus
gatggcagctgctagctctccataa

SEQ ID NO: 368106 - DNA, 25 bp, Rattus norvegicus
gatggcagcttaaacattatgcaca

SEQ ID NO: 368107 - DNA, 25 bp, Rattus norvegicus
gatggcagcttatacattatgcaca

SEQ ID NO: 368108 - DNA, 25 bp, Rattus norvegicus
gatggcagtgctattgacaggttat

SEQ ID NO: 368109 - DNA, 25 bp, Rattus norvegicus
gatggcagtgcttttgacaggttat

SEQ ID NO: 368110 - DNA, 25 bp, Rattus norvegicus
gatggcagtgtccagaaactagcat

SEQ ID NO: 368111 - DNA, 25 bp, Rattus norvegicus
gatggcagtgtcgagaaactagcat

SEQ ID NO: 368112 - DNA, 25 bp, Rattus norvegicus
gatggcagttctattgatcctcagc

SEQ ID NO: 368113 - DNA, 25 bp, Rattus norvegicus
gatggcagttcttttgatcctcagc

SEQ ID NO: 368114 - DNA, 25 bp, Rattus norvegicus
gatggcataatccagtacagctagt

SEQ ID NO: 368115 - DNA, 25 bp, Rattus norvegicus
gatggcataatcgagtacagctagt

SEQ ID NO: 368116 - DNA, 25 bp, Rattus norvegicus
gatggcatacctaagctaaccgcac

SEQ ID NO: 368117 - DNA, 25 bp, Rattus norvegicus
gatggcataccttagctaaccgcac

SEQ ID NO: 368118 - DNA, 25 bp, Rattus norvegicus
gatggcatacttcagtttcctttct

SEQ ID NO: 368119 - DNA, 25 bp, Rattus norvegicus
gatggcatacttccacacaagcatt

SEQ ID NO: 368120 - DNA, 25 bp, Rattus norvegicus
gatggcatacttgagtttcctttct

SEQ ID NO: 368121 - DNA, 25 bp, Rattus norvegicus
gatggcatacttgcacacaagcatt

SEQ ID NO: 368122 - DNA, 25 bp, Rattus norvegicus
gatggcatagaaccgttgtcctgtg

SEQ ID NO: 368123 - DNA, 25 bp, Rattus norvegicus
gatggcatagaagcgttgtcctgtg

SEQ ID NO: 368124 - DNA, 25 bp, Rattus norvegicus
gatggcatcatgatggtccttgtgc

SEQ ID NO: 368125 - DNA, 25 bp, Rattus norvegicus
gatggcatcatgttggtccttgtgc

SEQ ID NO: 368126 - DNA, 25 bp, Rattus norvegicus
gatggcatcattacagccagacttg

SEQ ID NO: 368127 - DNA, 25 bp, Rattus norvegicus
gatggcatcatttcagccagacttg

SEQ ID NO: 368128 - DNA, 25 bp, Rattus norvegicus
gatggcatccctaacagttctagat

SEQ ID NO: 368129 - DNA, 25 bp, Rattus norvegicus
gatggcatcccttacagttctagat

SEQ ID NO: 368130 - DNA, 25 bp, Rattus norvegicus
gatggcatcgctcagtctcaagtgt

SEQ ID NO: 368131 - DNA, 25 bp, Rattus norvegicus
gatggcatcgctgagtctcaagtgt

SEQ ID NO: 368132 - DNA, 25 bp, Rattus norvegicus
gatggcatcgtgactttagatgaat

SEQ ID NO: 368133 - DNA, 25 bp, Rattus norvegicus
gatggcatcgtgtctttagatgaat

SEQ ID NO: 368134 - DNA, 25 bp, Rattus norvegicus
gatggcatctacatgcttccagggc

SEQ ID NO: 368135 - DNA, 25 bp, Rattus norvegicus
gatggcatctacttgcttccagggc

SEQ ID NO: 368136 - DNA, 25 bp, Rattus norvegicus
gatggcatgcctcaaaagcactggg

SEQ ID NO: 368137 - DNA, 25 bp, Rattus norvegicus
gatggcatgcctgaaaagcactggg

SEQ ID NO: 368138 - DNA, 25 bp, Rattus norvegicus
gatggcatggacacagatttcacaa

SEQ ID NO: 368139 - DNA, 25 bp, Rattus norvegicus
gatggcatggactcagatttcacaa

SEQ ID NO: 368140 - DNA, 25 bp, Rattus norvegicus
gatggcatggtgaattcttggctat

SEQ ID NO: 368141 - DNA, 25 bp, Rattus norvegicus
gatggcatggtgactgtgatcccaa

SEQ ID NO: 368142 - DNA, 25 bp, Rattus norvegicus
gatggcatggtgtattcttggctat

SEQ ID NO: 368143 - DNA, 25 bp, Rattus norvegicus
gatggcatggtgtctgtgatcccaa

SEQ ID NO: 368144 - DNA, 25 bp, Rattus norvegicus
gatggcatgtcacgccgggaaccat

SEQ ID NO: 368145 - DNA, 25 bp, Rattus norvegicus
gatggcatgtcaggccgggaaccat

SEQ ID NO: 368146 - DNA, 25 bp, Rattus norvegicus
gatggcattgacatcgccaagctgc

SEQ ID NO: 368147 - DNA, 25 bp, Rattus norvegicus
gatggcattgacttcgccaagctgc

SEQ ID NO: 368148 - DNA, 25 bp, Rattus norvegicus
gatggcattggaatgtctaccctaa

SEQ ID NO: 368149 - DNA, 25 bp, Rattus norvegicus
gatggcattggattgtctaccctaa

SEQ ID NO: 368150 - DNA, 25 bp, Rattus norvegicus
gatggcattgtaacgttagacgaat

SEQ ID NO: 368151 - DNA, 25 bp, Rattus norvegicus
gatggcattgtatcgttagacgaat

SEQ ID NO: 368152 - DNA, 25 bp, Rattus norvegicus
gatggcattgtcctttgccccagaa

SEQ ID NO: 368153 - DNA, 25 bp, Rattus norvegicus
gatggcattgtcgtttgccccagaa

SEQ ID NO: 368154 - DNA, 25 bp, Rattus norvegicus
gatggcattgttctaactaccgttt

SEQ ID NO: 368155 - DNA, 25 bp, Rattus norvegicus
gatggcattgttgtaactaccgttt

SEQ ID NO: 368156 - DNA, 25 bp, Rattus norvegicus
gatggcatttgtcatcatccctgac

SEQ ID NO: 368157 - DNA, 25 bp, Rattus norvegicus
gatggcatttgtgatcatccctgac

SEQ ID NO: 368158 - DNA, 25 bp, Rattus norvegicus
gatggccaaagcactgatattatat

SEQ ID NO: 368159 - DNA, 25 bp, Rattus norvegicus
gatggccaaagctctgatattatat

SEQ ID NO: 368160 - DNA, 25 bp, Rattus norvegicus
gatggccaaaggctgctctgagttt

SEQ ID NO: 368161 - DNA, 25 bp, Rattus norvegicus
gatggccaaagggtgctctgagttt

SEQ ID NO: 368162 - DNA, 25 bp, Rattus norvegicus
gatggccaatctcacgagactctga

SEQ ID NO: 368163 - DNA, 25 bp, Rattus norvegicus
gatggccaatctgacgagactctga

SEQ ID NO: 368164 - DNA, 25 bp, Rattus norvegicus
gatggccacatccaaactccaaatt

SEQ ID NO: 368165 - DNA, 25 bp, Rattus norvegicus
gatggccacatcgaaactccaaatt

SEQ ID NO: 368166 - DNA, 25 bp, Rattus norvegicus
gatggccacgttctggattacctgt

SEQ ID NO: 368167 - DNA, 25 bp, Rattus norvegicus
gatggccacgttgtggattacctgt

SEQ ID NO: 368168 - DNA, 25 bp, Rattus norvegicus
gatggccactatcttgacgtggtca

SEQ ID NO: 368169 - DNA, 25 bp, Rattus norvegicus
gatggccactatgttgacgtggtca

SEQ ID NO: 368170 - DNA, 25 bp, Rattus norvegicus
gatggccactggaatgatgacgtct

SEQ ID NO: 368171 - DNA, 25 bp, Rattus norvegicus
gatggccactggtatgatgacgtct

SEQ ID NO: 368172 - DNA, 25 bp, Rattus norvegicus
gatggccagcaaagaagtttcgaag

SEQ ID NO: 368173 - DNA, 25 bp, Rattus norvegicus
gatggccagcaatgaagtttcgaag

SEQ ID NO: 368174 - DNA, 25 bp, Rattus norvegicus
gatggccagcacatgagaaagggaa

SEQ ID NO: 368175 - DNA, 25 bp, Rattus norvegicus
gatggccagcacttgagaaagggaa

SEQ ID NO: 368176 - DNA, 25 bp, Rattus norvegicus
gatggccagctacatgaaccactgt

SEQ ID NO: 368177 - DNA, 25 bp, Rattus norvegicus
gatggccagctagatgaaccactgt

SEQ ID NO: 368178 - DNA, 25 bp, Rattus norvegicus
gatggccaggaacttgtacagctca

SEQ ID NO: 368179 - DNA, 25 bp, Rattus norvegicus
gatggccaggaagttgtacagctca

SEQ ID NO: 368180 - DNA, 25 bp, Rattus norvegicus
gatggccaggatcaagctgcccaca

SEQ ID NO: 368181 - DNA, 25 bp, Rattus norvegicus
gatggccaggatgaagctgcccaca

SEQ ID NO: 368182 - DNA, 25 bp, Rattus norvegicus
gatggccagtttatagctaagtaca

SEQ ID NO: 368183 - DNA, 25 bp, Rattus norvegicus
gatggccagtttttagctaagtaca

SEQ ID NO: 368184 - DNA, 25 bp, Rattus norvegicus
gatggccatagaagacctcactttg

SEQ ID NO: 368185 - DNA, 25 bp, Rattus norvegicus
gatggccatagacctgcttttgtta

SEQ ID NO: 368186 - DNA, 25 bp, Rattus norvegicus
gatggccatagagctgcttttgtta

SEQ ID NO: 368187 - DNA, 25 bp, Rattus norvegicus
gatggccatagatgacctcactttg

SEQ ID NO: 368188 - DNA, 25 bp, Rattus norvegicus
gatggccatgacctactgagttgca

SEQ ID NO: 368189 - DNA, 25 bp, Rattus norvegicus
gatggccatgacgtactgagttgca

SEQ ID NO: 368190 - DNA, 25 bp, Rattus norvegicus
gatggccatggactttatctccgat

SEQ ID NO: 368191 - DNA, 25 bp, Rattus norvegicus
gatggccatggagtttatctccgat

SEQ ID NO: 368192 - DNA, 25 bp, Rattus norvegicus
gatggccatgtacacggaacacccc

SEQ ID NO: 368193 - DNA, 25 bp, Rattus norvegicus
gatggccatgtagacggaacacccc

SEQ ID NO: 368194 - DNA, 25 bp, Rattus norvegicus
gatggccatgtcctttgtcggaagt

SEQ ID NO: 368195 - DNA, 25 bp, Rattus norvegicus
gatggccatgtcgtttgtcggaagt

SEQ ID NO: 368196 - DNA, 25 bp, Rattus norvegicus
gatggccattacatgtgggtgcccc

SEQ ID NO: 368197 - DNA, 25 bp, Rattus norvegicus
gatggccattacttgtgggtgcccc

SEQ ID NO: 368198 - DNA, 25 bp, Rattus norvegicus
gatggcccaaaaattgacctcaact

SEQ ID NO: 368199 - DNA, 25 bp, Rattus norvegicus
gatggcccaaaatttgacctcaact

SEQ ID NO: 368200 - DNA, 25 bp, Rattus norvegicus
gatggcccacaaacatgtcattcgt

SEQ ID NO: 368201 - DNA, 25 bp, Rattus norvegicus
gatggcccacaatcatgtcattcgt

SEQ ID NO: 368202 - DNA, 25 bp, Rattus norvegicus
gatggcccagatcgctaccactgca

SEQ ID NO: 368203 - DNA, 25 bp, Rattus norvegicus
gatggcccagatggctaccactgca

SEQ ID NO: 368204 - DNA, 25 bp, Rattus norvegicus
gatggcccaggacaaccctaagatg

SEQ ID NO: 368205 - DNA, 25 bp, Rattus norvegicus
gatggcccaggagaaccctaagatg

SEQ ID NO: 368206 - DNA, 25 bp, Rattus norvegicus
gatggcccaggtcattagtcttagt

SEQ ID NO: 368207 - DNA, 25 bp, Rattus norvegicus
gatggcccaggtgattagtcttagt

SEQ ID NO: 368208 - DNA, 25 bp, Rattus norvegicus
gatggccccaacatcagtgccaaga

SEQ ID NO: 368209 - DNA, 25 bp, Rattus norvegicus
gatggccccaacttcagtgccaaga

SEQ ID NO: 368210 - DNA, 25 bp, Rattus norvegicus
gatggccccagaaaggatttgtgtt

SEQ ID NO: 368211 - DNA, 25 bp, Rattus norvegicus
gatggccccagataggatttgtgtt

SEQ ID NO: 368212 - DNA, 25 bp, Rattus norvegicus
gatggccccttactatgagtcaagc

SEQ ID NO: 368213 - DNA, 25 bp, Rattus norvegicus
gatggccccttagtatgagtcaagc

SEQ ID NO: 368214 - DNA, 25 bp, Rattus norvegicus
gatggcccgcaacgtgattgagcac

SEQ ID NO: 368215 - DNA, 25 bp, Rattus norvegicus
gatggcccgcaaggtgattgagcac

SEQ ID NO: 368216 - DNA, 25 bp, Rattus norvegicus
gatggccctaacacggtggccgcgt

SEQ ID NO: 368217 - DNA, 25 bp, Rattus norvegicus
gatggccctaactcggtggccgcgt

SEQ ID NO: 368218 - DNA, 25 bp, Rattus norvegicus
gatggccctcaaacagtcagctatg

SEQ ID NO: 368219 - DNA, 25 bp, Rattus norvegicus
gatggccctcaatcagtcagctatg

SEQ ID NO: 368220 - DNA, 25 bp, Rattus norvegicus
gatggccctggacctttattagagc

SEQ ID NO: 368221 - DNA, 25 bp, Rattus norvegicus
gatggccctggagctttattagagc

SEQ ID NO: 368222 - DNA, 25 bp, Rattus norvegicus
gatggccctgtgcaacggagattcc

SEQ ID NO: 368223 - DNA, 25 bp, Rattus norvegicus
gatggccctgtggaacggagattcc

SEQ ID NO: 368224 - DNA, 25 bp, Rattus norvegicus
gatggccgaatgagcccagtccaga

SEQ ID NO: 368225 - DNA, 25 bp, Rattus norvegicus
gatggccgaatgtgcccagtccaga

SEQ ID NO: 368226 - DNA, 25 bp, Rattus norvegicus
gatggccgacgaagcttgtgacatt

SEQ ID NO: 368227 - DNA, 25 bp, Rattus norvegicus
gatggccgacgatgcttgtgacatt

SEQ ID NO: 368228 - DNA, 25 bp, Rattus norvegicus
gatggccgcaccctctctgattaca

SEQ ID NO: 368229 - DNA, 25 bp, Rattus norvegicus
gatggccgcaccgtctctgattaca

SEQ ID NO: 368230 - DNA, 25 bp, Rattus norvegicus
gatggccgcatacctcctggcagtg

SEQ ID NO: 368231 - DNA, 25 bp, Rattus norvegicus
gatggccgcatagctcctggcagtg

SEQ ID NO: 368232 - DNA, 25 bp, Rattus norvegicus
gatggccggagacaacaaacttcta

SEQ ID NO: 368233 - DNA, 25 bp, Rattus norvegicus
gatggccggagagaacaaacttcta

SEQ ID NO: 368234 - DNA, 25 bp, Rattus norvegicus
gatggccggagtaactagaactgga

SEQ ID NO: 368235 - DNA, 25 bp, Rattus norvegicus
gatggccggagttactagaactgga

SEQ ID NO: 368236 - DNA, 25 bp, Rattus norvegicus
gatggccggatgctgagctccctac

SEQ ID NO: 368237 - DNA, 25 bp, Rattus norvegicus
gatggccggatggtgagctccctac

SEQ ID NO: 368238 - DNA, 25 bp, Rattus norvegicus
gatggccgtaacacaaggtgtttgt

SEQ ID NO: 368239 - DNA, 25 bp, Rattus norvegicus
gatggccgtaactcaaggtgtttgt

SEQ ID NO: 368240 - DNA, 25 bp, Rattus norvegicus
gatggcctatctcctattcctagtg

SEQ ID NO: 368241 - DNA, 25 bp, Rattus norvegicus
gatggcctatctgctattcctagtg

SEQ ID NO: 368242 - DNA, 25 bp, Rattus norvegicus
gatggcctatgtctgtatactgatg

SEQ ID NO: 368243 - DNA, 25 bp, Rattus norvegicus
gatggcctatgtgtgtatactgatg

SEQ ID NO: 368244 - DNA, 25 bp, Rattus norvegicus
gatggcctattcaaatctactgaga

SEQ ID NO: 368245 - DNA, 25 bp, Rattus norvegicus
gatggcctattctaatctactgaga

SEQ ID NO: 368246 - DNA, 25 bp, Rattus norvegicus
gatggcctcagaatcataccagagc

SEQ ID NO: 368247 - DNA, 25 bp, Rattus norvegicus
gatggcctcagattcataccagagc

SEQ ID NO: 368248 - DNA, 25 bp, Rattus norvegicus
gatggcctcataccaatcactgtta

SEQ ID NO: 368249 - DNA, 25 bp, Rattus norvegicus
gatggcctcatagcaatcactgtta

SEQ ID NO: 368250 - DNA, 25 bp, Rattus norvegicus
gatggcctcattcctatagccatgg

SEQ ID NO: 368251 - DNA, 25 bp, Rattus norvegicus
gatggcctcattgctatagccatgg

SEQ ID NO: 368252 - DNA, 25 bp, Rattus norvegicus
gatggcctccggaagagccgtccgt

SEQ ID NO: 368253 - DNA, 25 bp, Rattus norvegicus
gatggcctccggtagagccgtccgt

SEQ ID NO: 368254 - DNA, 25 bp, Rattus norvegicus
gatggcctcggtcttgggttcctca

SEQ ID NO: 368255 - DNA, 25 bp, Rattus norvegicus
gatggcctcggtgttgggttcctca

SEQ ID NO: 368256 - DNA, 25 bp, Rattus norvegicus
gatggcctctagactaatagatgat

SEQ ID NO: 368257 - DNA, 25 bp, Rattus norvegicus
gatggcctctagtctaatagatgat

SEQ ID NO: 368258 - DNA, 25 bp, Rattus norvegicus
gatggcctctttcggttgatactga

SEQ ID NO: 368259 - DNA, 25 bp, Rattus norvegicus
gatggcctctttgggttgatactga

SEQ ID NO: 368260 - DNA, 25 bp, Rattus norvegicus
gatggcctgaacagctttgctggta

SEQ ID NO: 368261 - DNA, 25 bp, Rattus norvegicus
gatggcctgaactgctttgctggta

SEQ ID NO: 368262 - DNA, 25 bp, Rattus norvegicus
gatggcctgagcagaaatgaagcta

SEQ ID NO: 368263 - DNA, 25 bp, Rattus norvegicus
gatggcctgagctgaaatgaagcta

SEQ ID NO: 368264 - DNA, 25 bp, Rattus norvegicus
gatggcctgaggagttcggaaacat

SEQ ID NO: 368265 - DNA, 25 bp, Rattus norvegicus
gatggcctgaggtgttcggaaacat

SEQ ID NO: 368266 - DNA, 25 bp, Rattus norvegicus
gatggcctgagtcagaccctggtaa

SEQ ID NO: 368267 - DNA, 25 bp, Rattus norvegicus
gatggcctgagtgagaccctggtaa

SEQ ID NO: 368268 - DNA, 25 bp, Rattus norvegicus
gatggcctgggacgactctcagctc

SEQ ID NO: 368269 - DNA, 25 bp, Rattus norvegicus
gatggcctgggactgtatcctcatg

SEQ ID NO: 368270 - DNA, 25 bp, Rattus norvegicus
gatggcctgggaggactctcagctc

SEQ ID NO: 368271 - DNA, 25 bp, Rattus norvegicus
gatggcctgggagtgtatcctcatg

SEQ ID NO: 368272 - DNA, 25 bp, Rattus norvegicus
gatggcctgggcatagggaaaccaa

SEQ ID NO: 368273 - DNA, 25 bp, Rattus norvegicus
gatggcctgggcttagggaaaccaa

SEQ ID NO: 368274 - DNA, 25 bp, Rattus norvegicus
gatggcctggtgcacagctaagcaa

SEQ ID NO: 368275 - DNA, 25 bp, Rattus norvegicus
gatggcctggtggacagctaagcaa

SEQ ID NO: 368276 - DNA, 25 bp, Rattus norvegicus
gatggccttactagacactttgata

SEQ ID NO: 368277 - DNA, 25 bp, Rattus norvegicus
gatggccttacttgacactttgata

SEQ ID NO: 368278 - DNA, 25 bp, Rattus norvegicus
gatggccttcaaagttcagcctggg

SEQ ID NO: 368279 - DNA, 25 bp, Rattus norvegicus
gatggccttcaatgttcagcctggg

SEQ ID NO: 368280 - DNA, 25 bp, Rattus norvegicus
gatggccttctaaatgcagtccaga

SEQ ID NO: 368281 - DNA, 25 bp, Rattus norvegicus
gatggccttctacacgggattgtca

SEQ ID NO: 368282 - DNA, 25 bp, Rattus norvegicus
gatggccttctagacgggattgtca

SEQ ID NO: 368283 - DNA, 25 bp, Rattus norvegicus
gatggccttctatatgcagtccaga

SEQ ID NO: 368284 - DNA, 25 bp, Rattus norvegicus
gatggccttgagatgaaccctccag

SEQ ID NO: 368285 - DNA, 25 bp, Rattus norvegicus
gatggccttgagttgaaccctccag

SEQ ID NO: 368286 - DNA, 25 bp, Rattus norvegicus
gatggccttgcaatctaggtaagat

SEQ ID NO: 368287 - DNA, 25 bp, Rattus norvegicus
gatggccttgcattctaggtaagat

SEQ ID NO: 368288 - DNA, 25 bp, Rattus norvegicus
gatggccttggtaattttgtgttgg

SEQ ID NO: 368289 - DNA, 25 bp, Rattus norvegicus
gatggccttggttattttgtgttgg

SEQ ID NO: 368290 - DNA, 25 bp, Rattus norvegicus
gatggccttgttaagcttttcagca

SEQ ID NO: 368291 - DNA, 25 bp, Rattus norvegicus
gatggccttgtttagcttttcagca

SEQ ID NO: 368292 - DNA, 25 bp, Rattus norvegicus
gatggcctttatcctgggagaaaca

SEQ ID NO: 368293 - DNA, 25 bp, Rattus norvegicus
gatggcctttatgctgggagaaaca

SEQ ID NO: 368294 - DNA, 25 bp, Rattus norvegicus
gatggcctttctcagcaggagaata

SEQ ID NO: 368295 - DNA, 25 bp, Rattus norvegicus
gatggcctttctgagcaggagaata

SEQ ID NO: 368296 - DNA, 25 bp, Rattus norvegicus
gatggcgaacttatcttcttttcaa

SEQ ID NO: 368297 - DNA, 25 bp, Rattus norvegicus
gatggcgaacttttcttcttttcaa

SEQ ID NO: 368298 - DNA, 25 bp, Rattus norvegicus
gatggcgacagactatttcaaacaa

SEQ ID NO: 368299 - DNA, 25 bp, Rattus norvegicus
gatggcgacagagtatttcaaacaa

SEQ ID NO: 368300 - DNA, 25 bp, Rattus norvegicus
gatggcgacagtaagtgctagcaat

SEQ ID NO: 368301 - DNA, 25 bp, Rattus norvegicus
gatggcgacagttagtgctagcaat

SEQ ID NO: 368302 - DNA, 25 bp, Rattus norvegicus
gatggcgagttcagccttgcctgag

SEQ ID NO: 368303 - DNA, 25 bp, Rattus norvegicus
gatggcgagttctgccttgcctgag

SEQ ID NO: 368304 - DNA, 25 bp, Rattus norvegicus
gatggcgatgaacctggaccacagc

SEQ ID NO: 368305 - DNA, 25 bp, Rattus norvegicus
gatggcgatgaagctggaccacagc

SEQ ID NO: 368306 - DNA, 25 bp, Rattus norvegicus
gatggcgatggtatctcgggacaca

SEQ ID NO: 368307 - DNA, 25 bp, Rattus norvegicus
gatggcgatggtttctcgggacaca

SEQ ID NO: 368308 - DNA, 25 bp, Rattus norvegicus
gatggcgattttcctgacaacctcc

SEQ ID NO: 368309 - DNA, 25 bp, Rattus norvegicus
gatggcgattttgctgacaacctcc

SEQ ID NO: 368310 - DNA, 25 bp, Rattus norvegicus
gatggcgcacgcaggaacaggacca

SEQ ID NO: 368311 - DNA, 25 bp, Rattus norvegicus
gatggcgcacgctggaacaggacca

SEQ ID NO: 368312 - DNA, 25 bp, Rattus norvegicus
gatggcgcagcaagtctgtgtcacc

SEQ ID NO: 368313 - DNA, 25 bp, Rattus norvegicus
gatggcgcagcatgtctgtgtcacc

SEQ ID NO: 368314 - DNA, 25 bp, Rattus norvegicus
gatggcgcaggtcgcgtcccgggaa

SEQ ID NO: 368315 - DNA, 25 bp, Rattus norvegicus
gatggcgcaggtggcgtcccgggaa

SEQ ID NO: 368316 - DNA, 25 bp, Rattus norvegicus
gatggcgcagtcacagctggcacat

SEQ ID NO: 368317 - DNA, 25 bp, Rattus norvegicus
gatggcgcagtctcagctggcacat

SEQ ID NO: 368318 - DNA, 25 bp, Rattus norvegicus
gatggcgcatacatcggcactggtt

SEQ ID NO: 368319 - DNA, 25 bp, Rattus norvegicus
gatggcgcatacttcggcactggtt

SEQ ID NO: 368320 - DNA, 25 bp, Rattus norvegicus
gatggcgccaagaaaccggaagctt

SEQ ID NO: 368321 - DNA, 25 bp, Rattus norvegicus
gatggcgccaagtaaccggaagctt

SEQ ID NO: 368322 - DNA, 25 bp, Rattus norvegicus
gatggcgccctcaggtggagaaaaa

SEQ ID NO: 368323 - DNA, 25 bp, Rattus norvegicus
gatggcgccctctggtggagaaaaa

SEQ ID NO: 368324 - DNA, 25 bp, Rattus norvegicus
gatggcgcctcgattaaggaagctt

SEQ ID NO: 368325 - DNA, 25 bp, Rattus norvegicus
gatggcgcctcgtttaaggaagctt

SEQ ID NO: 368326 - DNA, 25 bp, Rattus norvegicus
gatggcgctcagaaacggcgttgac

SEQ ID NO: 368327 - DNA, 25 bp, Rattus norvegicus
gatggcgctcagtaacggcgttgac

SEQ ID NO: 368328 - DNA, 25 bp, Rattus norvegicus
gatggcgcttgaccaccgcatcggc

SEQ ID NO: 368329 - DNA, 25 bp, Rattus norvegicus
gatggcgcttgagcaccgcatcggc

SEQ ID NO: 368330 - DNA, 25 bp, Rattus norvegicus
gatggcggagcaaaatctcttgctt

SEQ ID NO: 368331 - DNA, 25 bp, Rattus norvegicus
gatggcggagcataatctcttgctt

SEQ ID NO: 368332 - DNA, 25 bp, Rattus norvegicus
gatggcggcagcacggacacctgaa

SEQ ID NO: 368333 - DNA, 25 bp, Rattus norvegicus
gatggcggcagctcggacacctgaa

SEQ ID NO: 368334 - DNA, 25 bp, Rattus norvegicus
gatggcggccatatctataggctct

SEQ ID NO: 368335 - DNA, 25 bp, Rattus norvegicus
gatggcggccatttctataggctct

SEQ ID NO: 368336 - DNA, 25 bp, Rattus norvegicus
gatggcggtccaaagcacaggattg

SEQ ID NO: 368337 - DNA, 25 bp, Rattus norvegicus
gatggcggtccaatgcttaacaaga

SEQ ID NO: 368338 - DNA, 25 bp, Rattus norvegicus
gatggcggtccatagcacaggattg

SEQ ID NO: 368339 - DNA, 25 bp, Rattus norvegicus
gatggcggtccattgcttaacaaga

SEQ ID NO: 368340 - DNA, 25 bp, Rattus norvegicus
gatggcggtgccaacagagcacaaa

SEQ ID NO: 368341 - DNA, 25 bp, Rattus norvegicus
gatggcggtgcctacagagcacaaa

SEQ ID NO: 368342 - DNA, 25 bp, Rattus norvegicus
gatggcgtagagcaactttctgtct

SEQ ID NO: 368343 - DNA, 25 bp, Rattus norvegicus
gatggcgtagaggaactttctgtct

SEQ ID NO: 368344 - DNA, 25 bp, Rattus norvegicus
gatggcgtagttctagagacctcac

SEQ ID NO: 368345 - DNA, 25 bp, Rattus norvegicus
gatggcgtagttgtagagacctcac

SEQ ID NO: 368346 - DNA, 25 bp, Rattus norvegicus
gatggcgtcaaactatagtggtcaa

SEQ ID NO: 368347 - DNA, 25 bp, Rattus norvegicus
gatggcgtcaaagtatagtggtcaa

SEQ ID NO: 368348 - DNA, 25 bp, Rattus norvegicus
gatggcgtcattaagaggctctatt

SEQ ID NO: 368349 - DNA, 25 bp, Rattus norvegicus
gatggcgtcatttagaggctctatt

SEQ ID NO: 368350 - DNA, 25 bp, Rattus norvegicus
gatggcgtctataagccctactgga

SEQ ID NO: 368351 - DNA, 25 bp, Rattus norvegicus
gatggcgtctattagccctactgga

SEQ ID NO: 368352 - DNA, 25 bp, Rattus norvegicus
gatggcgtgggaagtactgacaaca

SEQ ID NO: 368353 - DNA, 25 bp, Rattus norvegicus
gatggcgtgggatgtactgacaaca

SEQ ID NO: 368354 - DNA, 25 bp, Rattus norvegicus
gatggcgtgtaaatgccctgcacaa

SEQ ID NO: 368355 - DNA, 25 bp, Rattus norvegicus
gatggcgtgtaattgccctgcacaa

SEQ ID NO: 368356 - DNA, 25 bp, Rattus norvegicus
gatggcgttatcaaaccctagcctt

SEQ ID NO: 368357 - DNA, 25 bp, Rattus norvegicus
gatggcgttatctaaccctagcctt

SEQ ID NO: 368358 - DNA, 25 bp, Rattus norvegicus
gatggcgttgttaagttctcaagca

SEQ ID NO: 368359 - DNA, 25 bp, Rattus norvegicus
gatggcgttgtttagttctcaagca

SEQ ID NO: 368360 - DNA, 25 bp, Rattus norvegicus
gatggcgtttcacgtatcagtgaca

SEQ ID NO: 368361 - DNA, 25 bp, Rattus norvegicus
gatggcgtttcaggtatcagtgaca

SEQ ID NO: 368362 - DNA, 25 bp, Rattus norvegicus
gatggcgtttctaaaagcaccctac

SEQ ID NO: 368363 - DNA, 25 bp, Rattus norvegicus
gatggcgtttcttaaagcaccctac

SEQ ID NO: 368364 - DNA, 25 bp, Rattus norvegicus
gatggctaaacgattcttcctcagt

SEQ ID NO: 368365 - DNA, 25 bp, Rattus norvegicus
gatggctaaacgtttcttcctcagt

SEQ ID NO: 368366 - DNA, 25 bp, Rattus norvegicus
gatggctaacagactcgaattttcc

SEQ ID NO: 368367 - DNA, 25 bp, Rattus norvegicus
gatggctaacagtctcgaattttcc

SEQ ID NO: 368368 - DNA, 25 bp, Rattus norvegicus
gatggctaagccaagttcccagtga

SEQ ID NO: 368369 - DNA, 25 bp, Rattus norvegicus
gatggctaagcctagttcccagtga

SEQ ID NO: 368370 - DNA, 25 bp, Rattus norvegicus
gatggctaagttacagagttcctga

SEQ ID NO: 368371 - DNA, 25 bp, Rattus norvegicus
gatggctaagtttcagagttcctga

SEQ ID NO: 368372 - DNA, 25 bp, Rattus norvegicus
gatggctacaaaacagtggctacaa

SEQ ID NO: 368373 - DNA, 25 bp, Rattus norvegicus
gatggctacaaatcagtggctacaa

SEQ ID NO: 368374 - DNA, 25 bp, Rattus norvegicus
gatggctacaacctccactatggtg

SEQ ID NO: 368375 - DNA, 25 bp, Rattus norvegicus
gatggctacaacgtccactatggtg

SEQ ID NO: 368376 - DNA, 25 bp, Rattus norvegicus
gatggctacccacgatgactaccgt

SEQ ID NO: 368377 - DNA, 25 bp, Rattus norvegicus
gatggctacccaggatgactaccgt

SEQ ID NO: 368378 - DNA, 25 bp, Rattus norvegicus
gatggctaccgcatctggatgtaca

SEQ ID NO: 368379 - DNA, 25 bp, Rattus norvegicus
gatggctaccgcttctggatgtaca

SEQ ID NO: 368380 - DNA, 25 bp, Rattus norvegicus
gatggctactaactggatccaggaa

SEQ ID NO: 368381 - DNA, 25 bp, Rattus norvegicus
gatggctactaagtggatccaggaa

SEQ ID NO: 368382 - DNA, 25 bp, Rattus norvegicus
gatggctactcacacagcgaacact

SEQ ID NO: 368383 - DNA, 25 bp, Rattus norvegicus
gatggctactcagacagcgaacact

SEQ ID NO: 368384 - DNA, 25 bp, Rattus norvegicus
gatggctactccagggtcccaactg

SEQ ID NO: 368385 - DNA, 25 bp, Rattus norvegicus
gatggctactcctgggtcccaactg

SEQ ID NO: 368386 - DNA, 25 bp, Rattus norvegicus
gatggctattgtcttgttttctatt

SEQ ID NO: 368387 - DNA, 25 bp, Rattus norvegicus
gatggctattgtgttgttttctatt

SEQ ID NO: 368388 - DNA, 25 bp, Rattus norvegicus
gatggctatttactggccctacaat

SEQ ID NO: 368389 - DNA, 25 bp, Rattus norvegicus
gatggctatttagtggccctacaat

SEQ ID NO: 368390 - DNA, 25 bp, Rattus norvegicus
gatggctatttcaggtttgttgcaa

SEQ ID NO: 368391 - DNA, 25 bp, Rattus norvegicus
gatggctatttctggtttgttgcaa

SEQ ID NO: 368392 - DNA, 25 bp, Rattus norvegicus
gatggctcaagtctcctgacaggaa

SEQ ID NO: 368393 - DNA, 25 bp, Rattus norvegicus
gatggctcaagtgtcctgacaggaa

SEQ ID NO: 368394 - DNA, 25 bp, Rattus norvegicus
gatggctcaatgctgaagtcgctgc

SEQ ID NO: 368395 - DNA, 25 bp, Rattus norvegicus
gatggctcaatggtgaagtcgctgc

SEQ ID NO: 368396 - DNA, 25 bp, Rattus norvegicus
gatggctcacggagtgctattttat

SEQ ID NO: 368397 - DNA, 25 bp, Rattus norvegicus
gatggctcacggtgtgctattttat

SEQ ID NO: 368398 - DNA, 25 bp, Rattus norvegicus
gatggctcactgcatgaaagggctt

SEQ ID NO: 368399 - DNA, 25 bp, Rattus norvegicus
gatggctcactggatgaaagggctt

SEQ ID NO: 368400 - DNA, 25 bp, Rattus norvegicus
gatggctcagaacggaaggctaacc

SEQ ID NO: 368401 - DNA, 25 bp, Rattus norvegicus
gatggctcagaagggaaggctaacc

SEQ ID NO: 368402 - DNA, 25 bp, Rattus norvegicus
gatggctcagcaataagttccttat

SEQ ID NO: 368403 - DNA, 25 bp, Rattus norvegicus
gatggctcagcacttaggactactt

SEQ ID NO: 368404 - DNA, 25 bp, Rattus norvegicus
gatggctcagcagttaggactactt

SEQ ID NO: 368405 - DNA, 25 bp, Rattus norvegicus
gatggctcagcattaagttccttat

SEQ ID NO: 368406 - DNA, 25 bp, Rattus norvegicus
gatggctcagcgcatcaagctctcg

SEQ ID NO: 368407 - DNA, 25 bp, Rattus norvegicus
gatggctcagcggatcaagctctcg

SEQ ID NO: 368408 - DNA, 25 bp, Rattus norvegicus
gatggctcagctactcttccagaga

SEQ ID NO: 368409 - DNA, 25 bp, Rattus norvegicus
gatggctcagctcaggatgctctga

SEQ ID NO: 368410 - DNA, 25 bp, Rattus norvegicus
gatggctcagctctcctgcaagaga

SEQ ID NO: 368411 - DNA, 25 bp, Rattus norvegicus
gatggctcagctgaggatgctctga

SEQ ID NO: 368412 - DNA, 25 bp, Rattus norvegicus
gatggctcagctgtcctgcaagaga

SEQ ID NO: 368413 - DNA, 25 bp, Rattus norvegicus
gatggctcagcttctcttccagaga

SEQ ID NO: 368414 - DNA, 25 bp, Rattus norvegicus
gatggctcatcacaagcggttcatt

SEQ ID NO: 368415 - DNA, 25 bp, Rattus norvegicus
gatggctcatcagaagcggttcatt

SEQ ID NO: 368416 - DNA, 25 bp, Rattus norvegicus
gatggctcattacttcacaaagaaa

SEQ ID NO: 368417 - DNA, 25 bp, Rattus norvegicus
gatggctcattagttcacaaagaaa

SEQ ID NO: 368418 - DNA, 25 bp, Rattus norvegicus
gatggctccaaccaagtcaattctg

SEQ ID NO: 368419 - DNA, 25 bp, Rattus norvegicus
gatggctccaacgaagtcaattctg

SEQ ID NO: 368420 - DNA, 25 bp, Rattus norvegicus
gatggctccagtatcaaggcagcac

SEQ ID NO: 368421 - DNA, 25 bp, Rattus norvegicus
gatggctccagtttcaaggcagcac

SEQ ID NO: 368422 - DNA, 25 bp, Rattus norvegicus
gatggctccataagcagtgcagcgc

SEQ ID NO: 368423 - DNA, 25 bp, Rattus norvegicus
gatggctccatatgcagtgcagcgc

SEQ ID NO: 368424 - DNA, 25 bp, Rattus norvegicus
gatggctccgagctggataatactt

SEQ ID NO: 368425 - DNA, 25 bp, Rattus norvegicus
gatggctccgaggtggataatactt

SEQ ID NO: 368426 - DNA, 25 bp, Rattus norvegicus
gatggctccgctacttacttgagat

SEQ ID NO: 368427 - DNA, 25 bp, Rattus norvegicus
gatggctccgcttcttacttgagat

SEQ ID NO: 368428 - DNA, 25 bp, Rattus norvegicus
gatggctccttccttgtacagtcat

SEQ ID NO: 368429 - DNA, 25 bp, Rattus norvegicus
gatggctccttcgttgtacagtcat

SEQ ID NO: 368430 - DNA, 25 bp, Rattus norvegicus
gatggctcctttattggccagtaca

SEQ ID NO: 368431 - DNA, 25 bp, Rattus norvegicus
gatggctccttttttggccagtaca

SEQ ID NO: 368432 - DNA, 25 bp, Rattus norvegicus
gatggctctgcgcatctggaaactg

SEQ ID NO: 368433 - DNA, 25 bp, Rattus norvegicus
gatggctctgcggatctggaaactg

SEQ ID NO: 368434 - DNA, 25 bp, Rattus norvegicus
gatggctctgctaaaagtgtgtgct

SEQ ID NO: 368435 - DNA, 25 bp, Rattus norvegicus
gatggctctgcttaaagtgtgtgct

SEQ ID NO: 368436 - DNA, 25 bp, Rattus norvegicus
gatggctctgggagactgaatcttc

SEQ ID NO: 368437 - DNA, 25 bp, Rattus norvegicus
gatggctctgggtgactgaatcttc

SEQ ID NO: 368438 - DNA, 25 bp, Rattus norvegicus
gatggctctgtgaataaaggcactt

SEQ ID NO: 368439 - DNA, 25 bp, Rattus norvegicus
gatggctctgtgaccgtggagtcca

SEQ ID NO: 368440 - DNA, 25 bp, Rattus norvegicus
gatggctctgtgtataaaggcactt

SEQ ID NO: 368441 - DNA, 25 bp, Rattus norvegicus
gatggctctgtgtccgtggagtcca

SEQ ID NO: 368442 - DNA, 25 bp, Rattus norvegicus
gatggctcttggcagtgtttttaac

SEQ ID NO: 368443 - DNA, 25 bp, Rattus norvegicus
gatggctcttgggagtgtttttaac

SEQ ID NO: 368444 - DNA, 25 bp, Rattus norvegicus
gatggctgaactactacgccaccag

SEQ ID NO: 368445 - DNA, 25 bp, Rattus norvegicus
gatggctgaactcaacactcatgtg

SEQ ID NO: 368446 - DNA, 25 bp, Rattus norvegicus
gatggctgaactgaacactcatgtg

SEQ ID NO: 368447 - DNA, 25 bp, Rattus norvegicus
gatggctgaacttctacgccaccag

SEQ ID NO: 368448 - DNA, 25 bp, Rattus norvegicus
gatggctgaaggattcctcctaggc

SEQ ID NO: 368449 - DNA, 25 bp, Rattus norvegicus
gatggctgaaggtttcctcctaggc

SEQ ID NO: 368450 - DNA, 25 bp, Rattus norvegicus
gatggctgactcactgaagcttact

SEQ ID NO: 368451 - DNA, 25 bp, Rattus norvegicus
gatggctgactctctgaagcttact

SEQ ID NO: 368452 - DNA, 25 bp, Rattus norvegicus
gatggctgaggaaaagcagattcat

SEQ ID NO: 368453 - DNA, 25 bp, Rattus norvegicus
gatggctgaggataagcagattcat

SEQ ID NO: 368454 - DNA, 25 bp, Rattus norvegicus
gatggctgatgaaggtctctggact

SEQ ID NO: 368455 - DNA, 25 bp, Rattus norvegicus
gatggctgatgatggtctctggact

SEQ ID NO: 368456 - DNA, 25 bp, Rattus norvegicus
gatggctgcaacaggaggttcgctc

SEQ ID NO: 368457 - DNA, 25 bp, Rattus norvegicus
gatggctgcaactggaggttcgctc

SEQ ID NO: 368458 - DNA, 25 bp, Rattus norvegicus
gatggctgcagtcggattcgtcaca

SEQ ID NO: 368459 - DNA, 25 bp, Rattus norvegicus
gatggctgcagtgggattcgtcaca

SEQ ID NO: 368460 - DNA, 25 bp, Rattus norvegicus
gatggctgccaccattaaacagctg

SEQ ID NO: 368461 - DNA, 25 bp, Rattus norvegicus
gatggctgccacgattaaacagctg

SEQ ID NO: 368462 - DNA, 25 bp, Rattus norvegicus
gatggctgcttgcagactcctgcca

SEQ ID NO: 368463 - DNA, 25 bp, Rattus norvegicus
gatggctgcttggagactcctgcca

SEQ ID NO: 368464 - DNA, 25 bp, Rattus norvegicus
gatggctggacacttaagaacactt

SEQ ID NO: 368465 - DNA, 25 bp, Rattus norvegicus
gatggctggacagttaagaacactt

SEQ ID NO: 368466 - DNA, 25 bp, Rattus norvegicus
gatggctggactcatcaagcagtac

SEQ ID NO: 368467 - DNA, 25 bp, Rattus norvegicus
gatggctggactgatcaagcagtac

SEQ ID NO: 368468 - DNA, 25 bp, Rattus norvegicus
gatggctggagcagtgtcccttagc

SEQ ID NO: 368469 - DNA, 25 bp, Rattus norvegicus
gatggctggagctgtgtcccttagc

SEQ ID NO: 368470 - DNA, 25 bp, Rattus norvegicus
gatggctggcagaagatatttttga

SEQ ID NO: 368471 - DNA, 25 bp, Rattus norvegicus
gatggctggcagtagatatttttga

SEQ ID NO: 368472 - DNA, 25 bp, Rattus norvegicus
gatggctggccacgcacagacaaaa

SEQ ID NO: 368473 - DNA, 25 bp, Rattus norvegicus
gatggctggccaggcacagacaaaa

SEQ ID NO: 368474 - DNA, 25 bp, Rattus norvegicus
gatggctggcgtagctgctagccaa

SEQ ID NO: 368475 - DNA, 25 bp, Rattus norvegicus
gatggctggcgttgctgctagccaa

SEQ ID NO: 368476 - DNA, 25 bp, Rattus norvegicus
gatggctgggcaattaacagcgttt

SEQ ID NO: 368477 - DNA, 25 bp, Rattus norvegicus
gatggctgggcatttaacagcgttt

SEQ ID NO: 368478 - DNA, 25 bp, Rattus norvegicus
gatggctggtcaagaagactccaat

SEQ ID NO: 368479 - DNA, 25 bp, Rattus norvegicus
gatggctggtcatgaagactccaat

SEQ ID NO: 368480 - DNA, 25 bp, Rattus norvegicus
gatggctgtgttacagcttgctcac

SEQ ID NO: 368481 - DNA, 25 bp, Rattus norvegicus
gatggctgtgtttcagcttgctcac

SEQ ID NO: 368482 - DNA, 25 bp, Rattus norvegicus
gatggcttacctatatcatgctgtg

SEQ ID NO: 368483 - DNA, 25 bp, Rattus norvegicus
gatggcttacctattctatgttgta

SEQ ID NO: 368484 - DNA, 25 bp, Rattus norvegicus
gatggcttacctttatcatgctgtg

SEQ ID NO: 368485 - DNA, 25 bp, Rattus norvegicus
gatggcttaccttttctatgttgta

SEQ ID NO: 368486 - DNA, 25 bp, Rattus norvegicus
gatggcttataccagtacttgggag

SEQ ID NO: 368487 - DNA, 25 bp, Rattus norvegicus
gatggcttatacgagtacttgggag

SEQ ID NO: 368488 - DNA, 25 bp, Rattus norvegicus
gatggcttatcaagtaaaggtactc

SEQ ID NO: 368489 - DNA, 25 bp, Rattus norvegicus
gatggcttatcatgtaaaggtactc

SEQ ID NO: 368490 - DNA, 25 bp, Rattus norvegicus
gatggcttcaaaagtttgggaccag

SEQ ID NO: 368491 - DNA, 25 bp, Rattus norvegicus
gatggcttcaaatgtttgggaccag

SEQ ID NO: 368492 - DNA, 25 bp, Rattus norvegicus
gatggcttcaagcttacttcgcgga

SEQ ID NO: 368493 - DNA, 25 bp, Rattus norvegicus
gatggcttcaaggttacttcgcgga

SEQ ID NO: 368494 - DNA, 25 bp, Rattus norvegicus
gatggcttccaacactgttctagtt

SEQ ID NO: 368495 - DNA, 25 bp, Rattus norvegicus
gatggcttccaagactgttctagtt

SEQ ID NO: 368496 - DNA, 25 bp, Rattus norvegicus
gatggcttcgcaaccaggaaaacat

SEQ ID NO: 368497 - DNA, 25 bp, Rattus norvegicus
gatggcttcgcatccaggaaaacat

SEQ ID NO: 368498 - DNA, 25 bp, Rattus norvegicus
gatggcttctatagtcacttactgg

SEQ ID NO: 368499 - DNA, 25 bp, Rattus norvegicus
gatggcttctattgtcacttactgg

SEQ ID NO: 368500 - DNA, 25 bp, Rattus norvegicus
gatggcttctctagagataccacag

SEQ ID NO: 368501 - DNA, 25 bp, Rattus norvegicus
gatggcttctcttgagataccacag

SEQ ID NO: 368502 - DNA, 25 bp, Rattus norvegicus
gatggcttctgaaggccagcaacaa

SEQ ID NO: 368503 - DNA, 25 bp, Rattus norvegicus
gatggcttctgatggccagcaacaa

SEQ ID NO: 368504 - DNA, 25 bp, Rattus norvegicus
gatggcttcttaatgtgcattcaac

SEQ ID NO: 368505 - DNA, 25 bp, Rattus norvegicus
gatggcttcttattgtgcattcaac

SEQ ID NO: 368506 - DNA, 25 bp, Rattus norvegicus
gatggcttcttgcactgtgcagcaa

SEQ ID NO: 368507 - DNA, 25 bp, Rattus norvegicus
gatggcttcttggactgtgcagcaa

SEQ ID NO: 368508 - DNA, 25 bp, Rattus norvegicus
gatggcttgcccaaaactaaaaatt

SEQ ID NO: 368509 - DNA, 25 bp, Rattus norvegicus
gatggcttgcccattgaagaccatt

SEQ ID NO: 368510 - DNA, 25 bp, Rattus norvegicus
gatggcttgccctaaactaaaaatt

SEQ ID NO: 368511 - DNA, 25 bp, Rattus norvegicus
gatggcttgccctttgaagaccatt

SEQ ID NO: 368512 - DNA, 25 bp, Rattus norvegicus
gatggcttggacatgacggccttaa

SEQ ID NO: 368513 - DNA, 25 bp, Rattus norvegicus
gatggcttggacttgacggccttaa

SEQ ID NO: 368514 - DNA, 25 bp, Rattus norvegicus
gatggcttggcaaacagacaacaat

SEQ ID NO: 368515 - DNA, 25 bp, Rattus norvegicus
gatggcttggcatacagacaacaat

SEQ ID NO: 368516 - DNA, 25 bp, Rattus norvegicus
gatggctttaagaatcccaggccct

SEQ ID NO: 368517 - DNA, 25 bp, Rattus norvegicus
gatggctttaagtatcccaggccct

SEQ ID NO: 368518 - DNA, 25 bp, Rattus norvegicus
gatggctttcataggctctcctgtc

SEQ ID NO: 368519 - DNA, 25 bp, Rattus norvegicus
gatggctttcatatccgggtgaggc

SEQ ID NO: 368520 - DNA, 25 bp, Rattus norvegicus
gatggctttcatcagattctcaagg

SEQ ID NO: 368521 - DNA, 25 bp, Rattus norvegicus
gatggctttcatgagattctcaagg

SEQ ID NO: 368522 - DNA, 25 bp, Rattus norvegicus
gatggctttcattggctctcctgtc

SEQ ID NO: 368523 - DNA, 25 bp, Rattus norvegicus
gatggctttcatttccgggtgaggc

SEQ ID NO: 368524 - DNA, 25 bp, Rattus norvegicus
gatggctttccaactggcgtcaaag

SEQ ID NO: 368525 - DNA, 25 bp, Rattus norvegicus
gatggctttccatctggcgtcaaag

SEQ ID NO: 368526 - DNA, 25 bp, Rattus norvegicus
gatggctttctaactttccaaacta

SEQ ID NO: 368527 - DNA, 25 bp, Rattus norvegicus
gatggctttctaccagctggagatc

SEQ ID NO: 368528 - DNA, 25 bp, Rattus norvegicus
gatggctttctagcagctggagatc

SEQ ID NO: 368529 - DNA, 25 bp, Rattus norvegicus
gatggctttctatctttccaaacta

SEQ ID NO: 368530 - DNA, 25 bp, Rattus norvegicus
gatggctttctgacacgctttagaa

SEQ ID NO: 368531 - DNA, 25 bp, Rattus norvegicus
gatggctttctgtcacgctttagaa

SEQ ID NO: 368532 - DNA, 25 bp, Rattus norvegicus
gatggctttcttctcaagtgacttt

SEQ ID NO: 368533 - DNA, 25 bp, Rattus norvegicus
gatggctttcttgtcaagtgacttt

SEQ ID NO: 368534 - DNA, 25 bp, Rattus norvegicus
gatggctttgtaatcgtttccaggg

SEQ ID NO: 368535 - DNA, 25 bp, Rattus norvegicus
gatggctttgtattcgtttccaggg

SEQ ID NO: 368536 - DNA, 25 bp, Rattus norvegicus
gatggcttttctatctgtggaggga

SEQ ID NO: 368537 - DNA, 25 bp, Rattus norvegicus
gatggcttttctttctgtggaggga

SEQ ID NO: 368538 - DNA, 25 bp, Rattus norvegicus
gatggctttttaatgatactcaacc

SEQ ID NO: 368539 - DNA, 25 bp, Rattus norvegicus
gatggctttttattgatactcaacc

SEQ ID NO: 368540 - DNA, 25 bp, Rattus norvegicus
gatggctttttcagagtgttgtgga

SEQ ID NO: 368541 - DNA, 25 bp, Rattus norvegicus
gatggctttttctgagtgttgtgga

SEQ ID NO: 368542 - DNA, 25 bp, Rattus norvegicus
gatgggaaaccaacaagtcctttgc

SEQ ID NO: 368543 - DNA, 25 bp, Rattus norvegicus
gatgggaaaccatcaagtcctttgc

SEQ ID NO: 368544 - DNA, 25 bp, Rattus norvegicus
gatgggaaactcatcctgactctca

SEQ ID NO: 368545 - DNA, 25 bp, Rattus norvegicus
gatgggaaactcttcctgactctca

SEQ ID NO: 368546 - DNA, 25 bp, Rattus norvegicus
gatgggaacacactcttgaataggg

SEQ ID NO: 368547 - DNA, 25 bp, Rattus norvegicus
gatgggaacacagtcttgaataggg

SEQ ID NO: 368548 - DNA, 25 bp, Rattus norvegicus
gatgggaacgctatgtccacagtga

SEQ ID NO: 368549 - DNA, 25 bp, Rattus norvegicus
gatgggaacgctttgtccacagtga

SEQ ID NO: 368550 - DNA, 25 bp, Rattus norvegicus
gatgggaagaacactacctcatagt

SEQ ID NO: 368551 - DNA, 25 bp, Rattus norvegicus
gatgggaagaactctacctcatagt

SEQ ID NO: 368552 - DNA, 25 bp, Rattus norvegicus
gatgggaagatcactcggcaggaat

SEQ ID NO: 368553 - DNA, 25 bp, Rattus norvegicus
gatgggaagatctctcggcaggaat

SEQ ID NO: 368554 - DNA, 25 bp, Rattus norvegicus
gatgggaaggatacaggcctcaccc

SEQ ID NO: 368555 - DNA, 25 bp, Rattus norvegicus
gatgggaaggattcaggcctcaccc

SEQ ID NO: 368556 - DNA, 25 bp, Rattus norvegicus
gatgggaaggcacccgtcaacctga

SEQ ID NO: 368557 - DNA, 25 bp, Rattus norvegicus
gatgggaaggcagccgtcaacctga

SEQ ID NO: 368558 - DNA, 25 bp, Rattus norvegicus
gatgggaagtggaggttcctcctcc

SEQ ID NO: 368559 - DNA, 25 bp, Rattus norvegicus
gatgggaagtggtggttcctcctcc

SEQ ID NO: 368560 - DNA, 25 bp, Rattus norvegicus
gatgggaagtgtatgttgtaccctt

SEQ ID NO: 368561 - DNA, 25 bp, Rattus norvegicus
gatgggaagtgtttgttgtaccctt

SEQ ID NO: 368562 - DNA, 25 bp, Rattus norvegicus
gatgggaatcccagaacaactgaaa

SEQ ID NO: 368563 - DNA, 25 bp, Rattus norvegicus
gatgggaatccctgaacaactgaaa

SEQ ID NO: 368564 - DNA, 25 bp, Rattus norvegicus
gatgggaattctagagacctgtata

SEQ ID NO: 368565 - DNA, 25 bp, Rattus norvegicus
gatgggaattcttgagacctgtata

SEQ ID NO: 368566 - DNA, 25 bp, Rattus norvegicus
gatgggacccaccagagtgtttcga

SEQ ID NO: 368567 - DNA, 25 bp, Rattus norvegicus
gatgggacccacgagagtgtttcga

SEQ ID NO: 368568 - DNA, 25 bp, Rattus norvegicus
gatgggacctctacacagtacttaa

SEQ ID NO: 368569 - DNA, 25 bp, Rattus norvegicus
gatgggacctcttcacagtacttaa

SEQ ID NO: 368570 - DNA, 25 bp, Rattus norvegicus
gatgggactaccaaatcctgcactc

SEQ ID NO: 368571 - DNA, 25 bp, Rattus norvegicus
gatgggactacctaatcctgcactc

SEQ ID NO: 368572 - DNA, 25 bp, Rattus norvegicus
gatgggacttgtaagcctagaactc

SEQ ID NO: 368573 - DNA, 25 bp, Rattus norvegicus
gatgggacttgttagcctagaactc

SEQ ID NO: 368574 - DNA, 25 bp, Rattus norvegicus
gatgggagaagccaataggaacttc

SEQ ID NO: 368575 - DNA, 25 bp, Rattus norvegicus
gatgggagaagcgaataggaacttc

SEQ ID NO: 368576 - DNA, 25 bp, Rattus norvegicus
gatgggagccgcagctgtctttgaa

SEQ ID NO: 368577 - DNA, 25 bp, Rattus norvegicus
gatgggagccgctgctgtctttgaa

SEQ ID NO: 368578 - DNA, 25 bp, Rattus norvegicus
gatgggagccttctctatccaccga

SEQ ID NO: 368579 - DNA, 25 bp, Rattus norvegicus
gatgggagccttgtctatccaccga

SEQ ID NO: 368580 - DNA, 25 bp, Rattus norvegicus
gatgggaggatcacttagctaattt

SEQ ID NO: 368581 - DNA, 25 bp, Rattus norvegicus
gatgggaggatctcttagctaattt

SEQ ID NO: 368582 - DNA, 25 bp, Rattus norvegicus
gatgggaggcatacctggtgctcaa

SEQ ID NO: 368583 - DNA, 25 bp, Rattus norvegicus
gatgggaggcattcctggtgctcaa

SEQ ID NO: 368584 - DNA, 25 bp, Rattus norvegicus
gatgggagtagtaacattatagact

SEQ ID NO: 368585 - DNA, 25 bp, Rattus norvegicus
gatgggagtagttacattatagact

SEQ ID NO: 368586 - DNA, 25 bp, Rattus norvegicus
gatgggagtcttactcagtgagata

SEQ ID NO: 368587 - DNA, 25 bp, Rattus norvegicus
gatgggagtctttctcagtgagata

SEQ ID NO: 368588 - DNA, 25 bp, Rattus norvegicus
gatgggatagggagatcatgttcaa

SEQ ID NO: 368589 - DNA, 25 bp, Rattus norvegicus
gatgggatagggtgatcatgttcaa

SEQ ID NO: 368590 - DNA, 25 bp, Rattus norvegicus
gatgggatagtgcagcactgacccc

SEQ ID NO: 368591 - DNA, 25 bp, Rattus norvegicus
gatgggatagtggagcactgacccc

SEQ ID NO: 368592 - DNA, 25 bp, Rattus norvegicus
gatgggatcaccacagtcaagaact

SEQ ID NO: 368593 - DNA, 25 bp, Rattus norvegicus
gatgggatcaccctccttaaaggaa

SEQ ID NO: 368594 - DNA, 25 bp, Rattus norvegicus
gatgggatcaccgtccttaaaggaa

SEQ ID NO: 368595 - DNA, 25 bp, Rattus norvegicus
gatgggatcacctcagtcaagaact

SEQ ID NO: 368596 - DNA, 25 bp, Rattus norvegicus
gatgggatcagccttgtaactcaag

SEQ ID NO: 368597 - DNA, 25 bp, Rattus norvegicus
gatgggatcagcgttgtaactcaag

SEQ ID NO: 368598 - DNA, 25 bp, Rattus norvegicus
gatgggatccatctgggttctgcaa

SEQ ID NO: 368599 - DNA, 25 bp, Rattus norvegicus
gatgggatccatgtgggttctgcaa

SEQ ID NO: 368600 - DNA, 25 bp, Rattus norvegicus
gatgggatcttacagtttcctaaca

SEQ ID NO: 368601 - DNA, 25 bp, Rattus norvegicus
gatgggatcttagagtttcctaaca

SEQ ID NO: 368602 - DNA, 25 bp, Rattus norvegicus
gatgggatcttgagtaacacctaca

SEQ ID NO: 368603 - DNA, 25 bp, Rattus norvegicus
gatgggatcttgtgtaacacctaca

SEQ ID NO: 368604 - DNA, 25 bp, Rattus norvegicus
gatgggatgcagactccacacttac

SEQ ID NO: 368605 - DNA, 25 bp, Rattus norvegicus
gatgggatgcagtctccacacttac

SEQ ID NO: 368606 - DNA, 25 bp, Rattus norvegicus
gatgggatggctatgctggactctc

SEQ ID NO: 368607 - DNA, 25 bp, Rattus norvegicus
gatgggatggctttgctggactctc

SEQ ID NO: 368608 - DNA, 25 bp, Rattus norvegicus
gatgggattaacattttatcagact

SEQ ID NO: 368609 - DNA, 25 bp, Rattus norvegicus
gatgggattaactttttatcagact

SEQ ID NO: 368610 - DNA, 25 bp, Rattus norvegicus
gatgggattatccaccccgtggaca

SEQ ID NO: 368611 - DNA, 25 bp, Rattus norvegicus
gatgggattatcgaccccgtggaca

SEQ ID NO: 368612 - DNA, 25 bp, Rattus norvegicus
gatgggattttcctgcattcatgca

SEQ ID NO: 368613 - DNA, 25 bp, Rattus norvegicus
gatgggattttcgtgcattcatgca

SEQ ID NO: 368614 - DNA, 25 bp, Rattus norvegicus
gatgggcaactgaacctgactggtg

SEQ ID NO: 368615 - DNA, 25 bp, Rattus norvegicus
gatgggcaactgtacctgactggtg

SEQ ID NO: 368616 - DNA, 25 bp, Rattus norvegicus
gatgggcaatccaactgctgtgagc

SEQ ID NO: 368617 - DNA, 25 bp, Rattus norvegicus
gatgggcaatcctactgctgtgagc

SEQ ID NO: 368618 - DNA, 25 bp, Rattus norvegicus
gatgggcaatgaccagatcactgaa

SEQ ID NO: 368619 - DNA, 25 bp, Rattus norvegicus
gatgggcaatgagcagatcactgaa

SEQ ID NO: 368620 - DNA, 25 bp, Rattus norvegicus
gatgggcaatggacactgtgtctcc

SEQ ID NO: 368621 - DNA, 25 bp, Rattus norvegicus
gatgggcaatggtcactgtgtctcc

SEQ ID NO: 368622 - DNA, 25 bp, Rattus norvegicus
gatgggcacagaataagtcctccaa

SEQ ID NO: 368623 - DNA, 25 bp, Rattus norvegicus
gatgggcacagattaagtcctccaa

SEQ ID NO: 368624 - DNA, 25 bp, Rattus norvegicus
gatgggcacggcaaggtttctgaat

SEQ ID NO: 368625 - DNA, 25 bp, Rattus norvegicus
gatgggcacggctaggtttctgaat

SEQ ID NO: 368626 - DNA, 25 bp, Rattus norvegicus
gatgggcactaacttcaccgtttat

SEQ ID NO: 368627 - DNA, 25 bp, Rattus norvegicus
gatgggcactaagttcaccgtttat

SEQ ID NO: 368628 - DNA, 25 bp, Rattus norvegicus
gatgggcactgaagagcctccacct

SEQ ID NO: 368629 - DNA, 25 bp, Rattus norvegicus
gatgggcactgatgagcctccacct

SEQ ID NO: 368630 - DNA, 25 bp, Rattus norvegicus
gatgggcagaatcagcttgttcctg

SEQ ID NO: 368631 - DNA, 25 bp, Rattus norvegicus
gatgggcagaatgagcttgttcctg

SEQ ID NO: 368632 - DNA, 25 bp, Rattus norvegicus
gatgggcagcctcataaactctagg

SEQ ID NO: 368633 - DNA, 25 bp, Rattus norvegicus
gatgggcagcctgataaactctagg

SEQ ID NO: 368634 - DNA, 25 bp, Rattus norvegicus
gatgggcaggccaaagaaatcttca

SEQ ID NO: 368635 - DNA, 25 bp, Rattus norvegicus
gatgggcaggcctaagaaatcttca

SEQ ID NO: 368636 - DNA, 25 bp, Rattus norvegicus
gatgggcagtacagttccctggaaa

SEQ ID NO: 368637 - DNA, 25 bp, Rattus norvegicus
gatgggcagtactgttccctggaaa

SEQ ID NO: 368638 - DNA, 25 bp, Rattus norvegicus
gatgggcagtccagtggcctaagca

SEQ ID NO: 368639 - DNA, 25 bp, Rattus norvegicus
gatgggcagtcctgtggcctaagca

SEQ ID NO: 368640 - DNA, 25 bp, Rattus norvegicus
gatgggcagtggctagtaccaccac

SEQ ID NO: 368641 - DNA, 25 bp, Rattus norvegicus
gatgggcagtgggtagtaccaccac

SEQ ID NO: 368642 - DNA, 25 bp, Rattus norvegicus
gatgggcagtgtacagcctggcctt

SEQ ID NO: 368643 - DNA, 25 bp, Rattus norvegicus
gatgggcagtgttcagcctggcctt

SEQ ID NO: 368644 - DNA, 25 bp, Rattus norvegicus
gatgggcatacccacctcagaaaac

SEQ ID NO: 368645 - DNA, 25 bp, Rattus norvegicus
gatgggcataccgacctcagaaaac

SEQ ID NO: 368646 - DNA, 25 bp, Rattus norvegicus
gatgggcatgatcggcacccagcca

SEQ ID NO: 368647 - DNA, 25 bp, Rattus norvegicus
gatgggcatgatgggcacccagcca

SEQ ID NO: 368648 - DNA, 25 bp, Rattus norvegicus
gatgggcatgttcacttcgcgagat

SEQ ID NO: 368649 - DNA, 25 bp, Rattus norvegicus
gatgggcatgttgacttcgcgagat

SEQ ID NO: 368650 - DNA, 25 bp, Rattus norvegicus
gatgggcattcacatctcagcagaa

SEQ ID NO: 368651 - DNA, 25 bp, Rattus norvegicus
gatgggcattcagatctcagcagaa

SEQ ID NO: 368652 - DNA, 25 bp, Rattus norvegicus
gatgggcatttccacataggctcta

SEQ ID NO: 368653 - DNA, 25 bp, Rattus norvegicus
gatgggcatttcgacataggctcta

SEQ ID NO: 368654 - DNA, 25 bp, Rattus norvegicus
gatgggccacagattcgccggcatt

SEQ ID NO: 368655 - DNA, 25 bp, Rattus norvegicus
gatgggccacagtttcgccggcatt

SEQ ID NO: 368656 - DNA, 25 bp, Rattus norvegicus
gatgggccagctaaactgagcggct

SEQ ID NO: 368657 - DNA, 25 bp, Rattus norvegicus
gatgggccagcttaactgagcggct

SEQ ID NO: 368658 - DNA, 25 bp, Rattus norvegicus
gatgggccatagactcagattctga

SEQ ID NO: 368659 - DNA, 25 bp, Rattus norvegicus
gatgggccatagtctcagattctga

SEQ ID NO: 368660 - DNA, 25 bp, Rattus norvegicus
gatgggccattgatgatatatcatt

SEQ ID NO: 368661 - DNA, 25 bp, Rattus norvegicus
gatgggccattgttgatatatcatt

SEQ ID NO: 368662 - DNA, 25 bp, Rattus norvegicus
gatgggccccacacagaacagtgag

SEQ ID NO: 368663 - DNA, 25 bp, Rattus norvegicus
gatgggccccacagattaacataga

SEQ ID NO: 368664 - DNA, 25 bp, Rattus norvegicus
gatgggccccactcagaacagtgag

SEQ ID NO: 368665 - DNA, 25 bp, Rattus norvegicus
gatgggccccactgattaacataga

SEQ ID NO: 368666 - DNA, 25 bp, Rattus norvegicus
gatgggcctcaaaaagtcttacgga

SEQ ID NO: 368667 - DNA, 25 bp, Rattus norvegicus
gatgggcctcaataagtcttacgga

SEQ ID NO: 368668 - DNA, 25 bp, Rattus norvegicus
gatgggccttgacgtcccgatcctt

SEQ ID NO: 368669 - DNA, 25 bp, Rattus norvegicus
gatgggccttgaggtcccgatcctt

SEQ ID NO: 368670 - DNA, 25 bp, Rattus norvegicus
gatgggccttttagatacgctttga

SEQ ID NO: 368671 - DNA, 25 bp, Rattus norvegicus
gatgggcctttttgatacgctttga

SEQ ID NO: 368672 - DNA, 25 bp, Rattus norvegicus
gatgggcgatcaccagttaaacccc

SEQ ID NO: 368673 - DNA, 25 bp, Rattus norvegicus
gatgggcgatcagcagttaaacccc

SEQ ID NO: 368674 - DNA, 25 bp, Rattus norvegicus
gatgggcgcacaatctgtgtaccac

SEQ ID NO: 368675 - DNA, 25 bp, Rattus norvegicus
gatgggcgcacattctgtgtaccac

SEQ ID NO: 368676 - DNA, 25 bp, Rattus norvegicus
gatgggcgcttgctgtcttagacac

SEQ ID NO: 368677 - DNA, 25 bp, Rattus norvegicus
gatgggcgcttggtgtcttagacac

SEQ ID NO: 368678 - DNA, 25 bp, Rattus norvegicus
gatgggcggtacactactgactact

SEQ ID NO: 368679 - DNA, 25 bp, Rattus norvegicus
gatgggcggtactctactgactact

SEQ ID NO: 368680 - DNA, 25 bp, Rattus norvegicus
gatgggctaggcactttatatctgt

SEQ ID NO: 368681 - DNA, 25 bp, Rattus norvegicus
gatgggctaggctctttatatctgt

SEQ ID NO: 368682 - DNA, 25 bp, Rattus norvegicus
gatgggctatgtctgccgaatctgt

SEQ ID NO: 368683 - DNA, 25 bp, Rattus norvegicus
gatgggctatgtgtgccgaatctgt

SEQ ID NO: 368684 - DNA, 25 bp, Rattus norvegicus
gatgggctcagtaggtgaagcacaa

SEQ ID NO: 368685 - DNA, 25 bp, Rattus norvegicus
gatgggctcagttggtgaagcacaa

SEQ ID NO: 368686 - DNA, 25 bp, Rattus norvegicus
gatgggctccaaactgtgtgaactt

SEQ ID NO: 368687 - DNA, 25 bp, Rattus norvegicus
gatgggctccaatctgtgtgaactt

SEQ ID NO: 368688 - DNA, 25 bp, Rattus norvegicus
gatgggctccatcacacggtaatag

SEQ ID NO: 368689 - DNA, 25 bp, Rattus norvegicus
gatgggctccatgacacggtaatag

SEQ ID NO: 368690 - DNA, 25 bp, Rattus norvegicus
gatgggctgcaaaagtcactcactc

SEQ ID NO: 368691 - DNA, 25 bp, Rattus norvegicus
gatgggctgcaaatggacacttttc

SEQ ID NO: 368692 - DNA, 25 bp, Rattus norvegicus
gatgggctgcaatagtcactcactc

SEQ ID NO: 368693 - DNA, 25 bp, Rattus norvegicus
gatgggctgcaattggacacttttc

SEQ ID NO: 368694 - DNA, 25 bp, Rattus norvegicus
gatgggctgctgacgaagatcctga

SEQ ID NO: 368695 - DNA, 25 bp, Rattus norvegicus
gatgggctgctgtcgaagatcctga

SEQ ID NO: 368696 - DNA, 25 bp, Rattus norvegicus
gatgggctggagaaagtcccttttt

SEQ ID NO: 368697 - DNA, 25 bp, Rattus norvegicus
gatgggctggagtaagtcccttttt

SEQ ID NO: 368698 - DNA, 25 bp, Rattus norvegicus
gatgggcttgacaaaataattcctg

SEQ ID NO: 368699 - DNA, 25 bp, Rattus norvegicus
gatgggcttgactaaataattcctg

SEQ ID NO: 368700 - DNA, 25 bp, Rattus norvegicus
gatgggctttttacagaggcctgcc

SEQ ID NO: 368701 - DNA, 25 bp, Rattus norvegicus
gatgggcttttttcagaggcctgcc

SEQ ID NO: 368702 - DNA, 25 bp, Rattus norvegicus
gatggggaaccccttcactgaacct

SEQ ID NO: 368703 - DNA, 25 bp, Rattus norvegicus
gatggggaacccgttcactgaacct

SEQ ID NO: 368704 - DNA, 25 bp, Rattus norvegicus
gatgggtaaactcctagagggacct

SEQ ID NO: 368705 - DNA, 25 bp, Rattus norvegicus
gatgggtaaactgctagagggacct

SEQ ID NO: 368706 - DNA, 25 bp, Rattus norvegicus
gatgggtaacgtagcccctttagat

SEQ ID NO: 368707 - DNA, 25 bp, Rattus norvegicus
gatgggtaacgttgcccctttagat

SEQ ID NO: 368708 - DNA, 25 bp, Rattus norvegicus
gatgggtaactgaagttcttcccac

SEQ ID NO: 368709 - DNA, 25 bp, Rattus norvegicus
gatgggtaactgtagttcttcccac

SEQ ID NO: 368710 - DNA, 25 bp, Rattus norvegicus
gatgggtaacttccactactagcta

SEQ ID NO: 368711 - DNA, 25 bp, Rattus norvegicus
gatgggtaacttgcactactagcta

SEQ ID NO: 368712 - DNA, 25 bp, Rattus norvegicus
gatgggtaatctctgactgtcaact

SEQ ID NO: 368713 - DNA, 25 bp, Rattus norvegicus
gatgggtaatctgtgactgtcaact

SEQ ID NO: 368714 - DNA, 25 bp, Rattus norvegicus
gatgggtacagacgtcacaacacta

SEQ ID NO: 368715 - DNA, 25 bp, Rattus norvegicus
gatgggtacagaggtcacaacacta

SEQ ID NO: 368716 - DNA, 25 bp, Rattus norvegicus
gatgggtacatgagccttgattaca

SEQ ID NO: 368717 - DNA, 25 bp, Rattus norvegicus
gatgggtacatgtgccttgattaca

SEQ ID NO: 368718 - DNA, 25 bp, Rattus norvegicus
gatgggtagaaaaatttgtcaggac

SEQ ID NO: 368719 - DNA, 25 bp, Rattus norvegicus
gatgggtagaaatatttgtcaggac

SEQ ID NO: 368720 - DNA, 25 bp, Rattus norvegicus
gatgggtagacccaagctccccagt

SEQ ID NO: 368721 - DNA, 25 bp, Rattus norvegicus
gatgggtagaccgaagctccccagt

SEQ ID NO: 368722 - DNA, 25 bp, Rattus norvegicus
gatgggtagcaccagatgtagtttc

SEQ ID NO: 368723 - DNA, 25 bp, Rattus norvegicus
gatgggtagcacgagatgtagtttc

SEQ ID NO: 368724 - DNA, 25 bp, Rattus norvegicus
gatgggtaggacatttccacacaat

SEQ ID NO: 368725 - DNA, 25 bp, Rattus norvegicus
gatgggtaggacttttccacacaat

SEQ ID NO: 368726 - DNA, 25 bp, Rattus norvegicus
gatgggtcaacacttagagcactca

SEQ ID NO: 368727 - DNA, 25 bp, Rattus norvegicus
gatgggtcaacagttagagcactca

SEQ ID NO: 368728 - DNA, 25 bp, Rattus norvegicus
gatgggtcaactccgatctgtgaag

SEQ ID NO: 368729 - DNA, 25 bp, Rattus norvegicus
gatgggtcaactgcgatctgtgaag

SEQ ID NO: 368730 - DNA, 25 bp, Rattus norvegicus
gatgggtcaataatctctcgagttg

SEQ ID NO: 368731 - DNA, 25 bp, Rattus norvegicus
gatgggtcaatattctctcgagttg

SEQ ID NO: 368732 - DNA, 25 bp, Rattus norvegicus
gatgggtcaattatccacatggact

SEQ ID NO: 368733 - DNA, 25 bp, Rattus norvegicus
gatgggtcaattttccacatggact

SEQ ID NO: 368734 - DNA, 25 bp, Rattus norvegicus
gatgggtcactaagccgataagttt

SEQ ID NO: 368735 - DNA, 25 bp, Rattus norvegicus
gatgggtcactatgccgataagttt

SEQ ID NO: 368736 - DNA, 25 bp, Rattus norvegicus
gatgggtcatagcagcctgtagctc

SEQ ID NO: 368737 - DNA, 25 bp, Rattus norvegicus
gatgggtcataggagcctgtagctc

SEQ ID NO: 368738 - DNA, 25 bp, Rattus norvegicus
gatgggtctcaaaccacagacagca

SEQ ID NO: 368739 - DNA, 25 bp, Rattus norvegicus
gatgggtctcaatccacagacagca

SEQ ID NO: 368740 - DNA, 25 bp, Rattus norvegicus
gatgggtctcatcttgggccattat

SEQ ID NO: 368741 - DNA, 25 bp, Rattus norvegicus
gatgggtctcatgttgggccattat

SEQ ID NO: 368742 - DNA, 25 bp, Rattus norvegicus
gatgggtctgccagaggacctcatc

SEQ ID NO: 368743 - DNA, 25 bp, Rattus norvegicus
gatgggtctgcctgaggacctcatc

SEQ ID NO: 368744 - DNA, 25 bp, Rattus norvegicus
gatgggtctgggactccacagaagc

SEQ ID NO: 368745 - DNA, 25 bp, Rattus norvegicus
gatgggtctgggtctccacagaagc

SEQ ID NO: 368746 - DNA, 25 bp, Rattus norvegicus
gatgggtgacctatcaatttctaaa

SEQ ID NO: 368747 - DNA, 25 bp, Rattus norvegicus
gatgggtgacctttcaatttctaaa

SEQ ID NO: 368748 - DNA, 25 bp, Rattus norvegicus
gatgggtgcatcatgggctttatca

SEQ ID NO: 368749 - DNA, 25 bp, Rattus norvegicus
gatgggtgcatcttgggctttatca

SEQ ID NO: 368750 - DNA, 25 bp, Rattus norvegicus
gatgggtgccatcgccaaaccagac

SEQ ID NO: 368751 - DNA, 25 bp, Rattus norvegicus
gatgggtgccatctgtcagagaact

SEQ ID NO: 368752 - DNA, 25 bp, Rattus norvegicus
gatgggtgccatggccaaaccagac

SEQ ID NO: 368753 - DNA, 25 bp, Rattus norvegicus
gatgggtgccatgtgtcagagaact

SEQ ID NO: 368754 - DNA, 25 bp, Rattus norvegicus
gatgggtgctatcttattctgtgcc

SEQ ID NO: 368755 - DNA, 25 bp, Rattus norvegicus
gatgggtgctatgttattctgtgcc

SEQ ID NO: 368756 - DNA, 25 bp, Rattus norvegicus
gatgggtggactccttcaggatcca

SEQ ID NO: 368757 - DNA, 25 bp, Rattus norvegicus
gatgggtggactgcttcaggatcca

SEQ ID NO: 368758 - DNA, 25 bp, Rattus norvegicus
gatgggtgtacaagttctctcacag

SEQ ID NO: 368759 - DNA, 25 bp, Rattus norvegicus
gatgggtgtacatgttctctcacag

SEQ ID NO: 368760 - DNA, 25 bp, Rattus norvegicus
gatgggtgtcaaccattacgtccca

SEQ ID NO: 368761 - DNA, 25 bp, Rattus norvegicus
gatgggtgtcaagcattacgtccca

SEQ ID NO: 368762 - DNA, 25 bp, Rattus norvegicus
gatgggtgtccaaactcttaaagtc

SEQ ID NO: 368763 - DNA, 25 bp, Rattus norvegicus
gatgggtgtccatactcttaaagtc

SEQ ID NO: 368764 - DNA, 25 bp, Rattus norvegicus
gatgggtgtcgtattgtgccaccat

SEQ ID NO: 368765 - DNA, 25 bp, Rattus norvegicus
gatgggtgtcgttttgtgccaccat

SEQ ID NO: 368766 - DNA, 25 bp, Rattus norvegicus
gatgggtgtggcatctaatgtcgaa

SEQ ID NO: 368767 - DNA, 25 bp, Rattus norvegicus
gatgggtgtggcttctaatgtcgaa

SEQ ID NO: 368768 - DNA, 25 bp, Rattus norvegicus
gatgggtgttacatctgtccacctt

SEQ ID NO: 368769 - DNA, 25 bp, Rattus norvegicus
gatgggtgttacttctgtccacctt

SEQ ID NO: 368770 - DNA, 25 bp, Rattus norvegicus
gatgggtgttagagatttgctgata

SEQ ID NO: 368771 - DNA, 25 bp, Rattus norvegicus
gatgggtgttagtgatttgctgata

SEQ ID NO: 368772 - DNA, 25 bp, Rattus norvegicus
gatgggttacgactaggtcccttga

SEQ ID NO: 368773 - DNA, 25 bp, Rattus norvegicus
gatgggttacgagtaggtcccttga

SEQ ID NO: 368774 - DNA, 25 bp, Rattus norvegicus
gatgggttccatagttactccagaa

SEQ ID NO: 368775 - DNA, 25 bp, Rattus norvegicus
gatgggttccatataaactgcttag

SEQ ID NO: 368776 - DNA, 25 bp, Rattus norvegicus
gatgggttccattgttactccagaa

SEQ ID NO: 368777 - DNA, 25 bp, Rattus norvegicus
gatgggttccatttaaactgcttag

SEQ ID NO: 368778 - DNA, 25 bp, Rattus norvegicus
gatgggttcccaagaagtgttttat

SEQ ID NO: 368779 - DNA, 25 bp, Rattus norvegicus
gatgggttcccatgaagtgttttat

SEQ ID NO: 368780 - DNA, 25 bp, Rattus norvegicus
gatgggttcgccaggcttcccagaa

SEQ ID NO: 368781 - DNA, 25 bp, Rattus norvegicus
gatgggttcgcctggcttcccagaa

SEQ ID NO: 368782 - DNA, 25 bp, Rattus norvegicus
gatgggttgcccagccactgatctg

SEQ ID NO: 368783 - DNA, 25 bp, Rattus norvegicus
gatgggttgccctgccactgatctg

SEQ ID NO: 368784 - DNA, 25 bp, Rattus norvegicus
gatgggttgcgtcctcagagtcaca

SEQ ID NO: 368785 - DNA, 25 bp, Rattus norvegicus
gatgggttgcgtgctcagagtcaca

SEQ ID NO: 368786 - DNA, 25 bp, Rattus norvegicus
gatgggttggcgattcctgtaacag

SEQ ID NO: 368787 - DNA, 25 bp, Rattus norvegicus
gatgggttggcgtttcctgtaacag

SEQ ID NO: 368788 - DNA, 25 bp, Rattus norvegicus
gatgggttgtctagactgtttgcaa

SEQ ID NO: 368789 - DNA, 25 bp, Rattus norvegicus
gatgggttgtcttgactgtttgcaa

SEQ ID NO: 368790 - DNA, 25 bp, Rattus norvegicus
gatgggttgttaccctgattccaaa

SEQ ID NO: 368791 - DNA, 25 bp, Rattus norvegicus
gatgggttgttagcctgattccaaa

SEQ ID NO: 368792 - DNA, 25 bp, Rattus norvegicus
gatgggtttactctcttgtaccaca

SEQ ID NO: 368793 - DNA, 25 bp, Rattus norvegicus
gatgggtttactgtcttgtaccaca

SEQ ID NO: 368794 - DNA, 25 bp, Rattus norvegicus
gatgggtttctacactgattcttta

SEQ ID NO: 368795 - DNA, 25 bp, Rattus norvegicus
gatgggtttctagactgattcttta

SEQ ID NO: 368796 - DNA, 25 bp, Rattus norvegicus
gatgggtttctccttacctacaaag

SEQ ID NO: 368797 - DNA, 25 bp, Rattus norvegicus
gatgggtttctcgttacctacaaag

SEQ ID NO: 368798 - DNA, 25 bp, Rattus norvegicus
gatgggtttgatctcctgctccggt

SEQ ID NO: 368799 - DNA, 25 bp, Rattus norvegicus
gatgggtttgatgtcctgctccggt

SEQ ID NO: 368800 - DNA, 25 bp, Rattus norvegicus
gatgggtttgttacagacctggctt

SEQ ID NO: 368801 - DNA, 25 bp, Rattus norvegicus
gatgggtttgttaccaactgtcaat

SEQ ID NO: 368802 - DNA, 25 bp, Rattus norvegicus
gatgggtttgtttcagacctggctt

SEQ ID NO: 368803 - DNA, 25 bp, Rattus norvegicus
gatgggtttgtttccaactgtcaat

SEQ ID NO: 368804 - DNA, 25 bp, Rattus norvegicus
gatgggttttctcagttggtgcact

SEQ ID NO: 368805 - DNA, 25 bp, Rattus norvegicus
gatgggttttctgagttggtgcact

SEQ ID NO: 368806 - DNA, 25 bp, Rattus norvegicus
gatgggttttgcacatccctctgag

SEQ ID NO: 368807 - DNA, 25 bp, Rattus norvegicus
gatgggttttgctcatccctctgag

SEQ ID NO: 368808 - DNA, 25 bp, Rattus norvegicus
gatggtaaaaccaacatgctatttg

SEQ ID NO: 368809 - DNA, 25 bp, Rattus norvegicus
gatggtaaaacctacatgctatttg

SEQ ID NO: 368810 - DNA, 25 bp, Rattus norvegicus
gatggtaaagtcacaatgctcaaat

SEQ ID NO: 368811 - DNA, 25 bp, Rattus norvegicus
gatggtaaagtctcaatgctcaaat

SEQ ID NO: 368812 - DNA, 25 bp, Rattus norvegicus
gatggtaaccaacagagcacagtct

SEQ ID NO: 368813 - DNA, 25 bp, Rattus norvegicus
gatggtaaccaagagagcacagtct

SEQ ID NO: 368814 - DNA, 25 bp, Rattus norvegicus
gatggtaactacctacactgtttta

SEQ ID NO: 368815 - DNA, 25 bp, Rattus norvegicus
gatggtaactacgtacactgtttta

SEQ ID NO: 368816 - DNA, 25 bp, Rattus norvegicus
gatggtaagagtcaagccctgcccc

SEQ ID NO: 368817 - DNA, 25 bp, Rattus norvegicus
gatggtaagagtgaagccctgcccc

SEQ ID NO: 368818 - DNA, 25 bp, Rattus norvegicus
gatggtacagcacgcccttgaagtc

SEQ ID NO: 368819 - DNA, 25 bp, Rattus norvegicus
gatggtacagcaggcccttgaagtc

SEQ ID NO: 368820 - DNA, 25 bp, Rattus norvegicus
gatggtacatccattttaactattc

SEQ ID NO: 368821 - DNA, 25 bp, Rattus norvegicus
gatggtacatcctttttaactattc

SEQ ID NO: 368822 - DNA, 25 bp, Rattus norvegicus
gatggtacatgccatatcccaccgg

SEQ ID NO: 368823 - DNA, 25 bp, Rattus norvegicus
gatggtacatgcgatatcccaccgg

SEQ ID NO: 368824 - DNA, 25 bp, Rattus norvegicus
gatggtaccaacatttccctgaaaa

SEQ ID NO: 368825 - DNA, 25 bp, Rattus norvegicus
gatggtaccaacttttccctgaaaa

SEQ ID NO: 368826 - DNA, 25 bp, Rattus norvegicus
gatggtaccgaacctcattacacaa

SEQ ID NO: 368827 - DNA, 25 bp, Rattus norvegicus
gatggtaccgaagctcattacacaa

SEQ ID NO: 368828 - DNA, 25 bp, Rattus norvegicus
gatggtactggcattctctgtggcc

SEQ ID NO: 368829 - DNA, 25 bp, Rattus norvegicus
gatggtactggctttctctgtggcc

SEQ ID NO: 368830 - DNA, 25 bp, Rattus norvegicus
gatggtagacacagcttttctttct

SEQ ID NO: 368831 - DNA, 25 bp, Rattus norvegicus
gatggtagacactgcttttctttct

SEQ ID NO: 368832 - DNA, 25 bp, Rattus norvegicus
gatggtagcactccttaggagacct

SEQ ID NO: 368833 - DNA, 25 bp, Rattus norvegicus
gatggtagcactgcttaggagacct

SEQ ID NO: 368834 - DNA, 25 bp, Rattus norvegicus
gatggtagtcttagtactgccgtga

SEQ ID NO: 368835 - DNA, 25 bp, Rattus norvegicus
gatggtagtctttgtactgccgtga

SEQ ID NO: 368836 - DNA, 25 bp, Rattus norvegicus
gatggtatagatattcttccttcag

SEQ ID NO: 368837 - DNA, 25 bp, Rattus norvegicus
gatggtatagattttcttccttcag

SEQ ID NO: 368838 - DNA, 25 bp, Rattus norvegicus
gatggtatagccacagacaaattat

SEQ ID NO: 368839 - DNA, 25 bp, Rattus norvegicus
gatggtatagcctcagacaaattat

SEQ ID NO: 368840 - DNA, 25 bp, Rattus norvegicus
gatggtatatgtccgtgaagctgct

SEQ ID NO: 368841 - DNA, 25 bp, Rattus norvegicus
gatggtatatgtgcgtgaagctgct

SEQ ID NO: 368842 - DNA, 25 bp, Rattus norvegicus
gatggtatcagtccacgctctggaa

SEQ ID NO: 368843 - DNA, 25 bp, Rattus norvegicus
gatggtatcagtgcacgctctggaa

SEQ ID NO: 368844 - DNA, 25 bp, Rattus norvegicus
gatggtatccatactgcagctcaga

SEQ ID NO: 368845 - DNA, 25 bp, Rattus norvegicus
gatggtatccattctgcagctcaga

SEQ ID NO: 368846 - DNA, 25 bp, Rattus norvegicus
gatggtatctcccagtctaccagaa

SEQ ID NO: 368847 - DNA, 25 bp, Rattus norvegicus
gatggtatctccgagtctaccagaa

SEQ ID NO: 368848 - DNA, 25 bp, Rattus norvegicus
gatggtatgactcacagtagcacat

SEQ ID NO: 368849 - DNA, 25 bp, Rattus norvegicus
gatggtatgactgacagtagcacat

SEQ ID NO: 368850 - DNA, 25 bp, Rattus norvegicus
gatggtatgcgcaattgtctccttg

SEQ ID NO: 368851 - DNA, 25 bp, Rattus norvegicus
gatggtatgcgctattgtctccttg

SEQ ID NO: 368852 - DNA, 25 bp, Rattus norvegicus
gatggtatggctacctgaatctgat

SEQ ID NO: 368853 - DNA, 25 bp, Rattus norvegicus
gatggtatggcttcctgaatctgat

SEQ ID NO: 368854 - DNA, 25 bp, Rattus norvegicus
gatggtatgtacctgctacacagac

SEQ ID NO: 368855 - DNA, 25 bp, Rattus norvegicus
gatggtatgtacgtgctacacagac

SEQ ID NO: 368856 - DNA, 25 bp, Rattus norvegicus
gatggtattgtgacctttgtagacc

SEQ ID NO: 368857 - DNA, 25 bp, Rattus norvegicus
gatggtattgtgtcctttgtagacc

SEQ ID NO: 368858 - DNA, 25 bp, Rattus norvegicus
gatggtattttcagaccctgtttca

SEQ ID NO: 368859 - DNA, 25 bp, Rattus norvegicus
gatggtattttctgaccctgtttca

SEQ ID NO: 368860 - DNA, 25 bp, Rattus norvegicus
gatggtcaaagaatgattatcccaa

SEQ ID NO: 368861 - DNA, 25 bp, Rattus norvegicus
gatggtcaaagattgattatcccaa

SEQ ID NO: 368862 - DNA, 25 bp, Rattus norvegicus
gatggtcaacttaggatgtacccca

SEQ ID NO: 368863 - DNA, 25 bp, Rattus norvegicus
gatggtcaactttggatgtacccca

SEQ ID NO: 368864 - DNA, 25 bp, Rattus norvegicus
gatggtcaagcccagtctgctcaga

SEQ ID NO: 368865 - DNA, 25 bp, Rattus norvegicus
gatggtcaagccgagtctgctcaga

SEQ ID NO: 368866 - DNA, 25 bp, Rattus norvegicus
gatggtcaagcgagctcctacgtta

SEQ ID NO: 368867 - DNA, 25 bp, Rattus norvegicus
gatggtcaagcgtgctcctacgtta

SEQ ID NO: 368868 - DNA, 25 bp, Rattus norvegicus
gatggtcaattcactcagcacttag

SEQ ID NO: 368869 - DNA, 25 bp, Rattus norvegicus
gatggtcaattctctcagcacttag

SEQ ID NO: 368870 - DNA, 25 bp, Rattus norvegicus
gatggtcaccacagaaaacgccgga

SEQ ID NO: 368871 - DNA, 25 bp, Rattus norvegicus
gatggtcaccactgaaaacgccgga

SEQ ID NO: 368872 - DNA, 25 bp, Rattus norvegicus
gatggtcacctgaactgtttatgcc

SEQ ID NO: 368873 - DNA, 25 bp, Rattus norvegicus
gatggtcacctgtactgtttatgcc

SEQ ID NO: 368874 - DNA, 25 bp, Rattus norvegicus
gatggtcactgcacagggactggta

SEQ ID NO: 368875 - DNA, 25 bp, Rattus norvegicus
gatggtcactgctcagggactggta

SEQ ID NO: 368876 - DNA, 25 bp, Rattus norvegicus
gatggtcaggtaagccgtcagtcac

SEQ ID NO: 368877 - DNA, 25 bp, Rattus norvegicus
gatggtcaggtatgccgtcagtcac

SEQ ID NO: 368878 - DNA, 25 bp, Rattus norvegicus
gatggtcagtgaatgatctgggttt

SEQ ID NO: 368879 - DNA, 25 bp, Rattus norvegicus
gatggtcagtgattgatctgggttt

SEQ ID NO: 368880 - DNA, 25 bp, Rattus norvegicus
gatggtcatgcgcaggcactgccac

SEQ ID NO: 368881 - DNA, 25 bp, Rattus norvegicus
gatggtcatgcggaggcactgccac

SEQ ID NO: 368882 - DNA, 25 bp, Rattus norvegicus
gatggtcatggaagcacagtgcctt

SEQ ID NO: 368883 - DNA, 25 bp, Rattus norvegicus
gatggtcatggatgcacagtgcctt

SEQ ID NO: 368884 - DNA, 25 bp, Rattus norvegicus
gatggtcatgtcaacgaaggccgag

SEQ ID NO: 368885 - DNA, 25 bp, Rattus norvegicus
gatggtcatgtctacgaaggccgag

SEQ ID NO: 368886 - DNA, 25 bp, Rattus norvegicus
gatggtcattgaagtccttcatcct

SEQ ID NO: 368887 - DNA, 25 bp, Rattus norvegicus
gatggtcattgacgcacatgcacta

SEQ ID NO: 368888 - DNA, 25 bp, Rattus norvegicus
gatggtcattgaggcacatgcacta

SEQ ID NO: 368889 - DNA, 25 bp, Rattus norvegicus
gatggtcattgatgtccttcatcct

SEQ ID NO: 368890 - DNA, 25 bp, Rattus norvegicus
gatggtccaatgaaatctcattcag

SEQ ID NO: 368891 - DNA, 25 bp, Rattus norvegicus
gatggtccaatgtaatctcattcag

SEQ ID NO: 368892 - DNA, 25 bp, Rattus norvegicus
gatggtccacaacgccatgctacaa

SEQ ID NO: 368893 - DNA, 25 bp, Rattus norvegicus
gatggtccacaaggccatgctacaa

SEQ ID NO: 368894 - DNA, 25 bp, Rattus norvegicus
gatggtccaccaagtgtgcttggct

SEQ ID NO: 368895 - DNA, 25 bp, Rattus norvegicus
gatggtccaccatgtgtgcttggct

SEQ ID NO: 368896 - DNA, 25 bp, Rattus norvegicus
gatggtccacgcaatgaactctgca

SEQ ID NO: 368897 - DNA, 25 bp, Rattus norvegicus
gatggtccacgctatgaactctgca

SEQ ID NO: 368898 - DNA, 25 bp, Rattus norvegicus
gatggtccagacctgtaatctcagc

SEQ ID NO: 368899 - DNA, 25 bp, Rattus norvegicus
gatggtccagacgtgtaatctcagc

SEQ ID NO: 368900 - DNA, 25 bp, Rattus norvegicus
gatggtccagagacttcacattccc

SEQ ID NO: 368901 - DNA, 25 bp, Rattus norvegicus
gatggtccagagtcttcacattccc

SEQ ID NO: 368902 - DNA, 25 bp, Rattus norvegicus
gatggtccagcacacacaggtcaaa

SEQ ID NO: 368903 - DNA, 25 bp, Rattus norvegicus
gatggtccagcagacacaggtcaaa

SEQ ID NO: 368904 - DNA, 25 bp, Rattus norvegicus
gatggtccatcgcttctggaggaaa

SEQ ID NO: 368905 - DNA, 25 bp, Rattus norvegicus
gatggtccatcggttctggaggaaa

SEQ ID NO: 368906 - DNA, 25 bp, Rattus norvegicus
gatggtccattcaagtagaagcatg

SEQ ID NO: 368907 - DNA, 25 bp, Rattus norvegicus
gatggtccattctagtagaagcatg

SEQ ID NO: 368908 - DNA, 25 bp, Rattus norvegicus
gatggtcccattactgtttacttac

SEQ ID NO: 368909 - DNA, 25 bp, Rattus norvegicus
gatggtcccatttctgtttacttac

SEQ ID NO: 368910 - DNA, 25 bp, Rattus norvegicus
gatggtcccgtaataatcctgggct

SEQ ID NO: 368911 - DNA, 25 bp, Rattus norvegicus
gatggtcccgtattaatcctgggct

SEQ ID NO: 368912 - DNA, 25 bp, Rattus norvegicus
gatggtccctcaacgaggattctaa

SEQ ID NO: 368913 - DNA, 25 bp, Rattus norvegicus
gatggtccctcatcgaggattctaa

SEQ ID NO: 368914 - DNA, 25 bp, Rattus norvegicus
gatggtccctccataaaaacattct

SEQ ID NO: 368915 - DNA, 25 bp, Rattus norvegicus
gatggtccctccttaaaaacattct

SEQ ID NO: 368916 - DNA, 25 bp, Rattus norvegicus
gatggtccctgaacaaggatgacaa

SEQ ID NO: 368917 - DNA, 25 bp, Rattus norvegicus
gatggtccctgatcaaggatgacaa

SEQ ID NO: 368918 - DNA, 25 bp, Rattus norvegicus
gatggtcctagcagttgagctcggc

SEQ ID NO: 368919 - DNA, 25 bp, Rattus norvegicus
gatggtcctagctgttgagctcggc

SEQ ID NO: 368920 - DNA, 25 bp, Rattus norvegicus
gatggtccttttacaaattgcaaat

SEQ ID NO: 368921 - DNA, 25 bp, Rattus norvegicus
gatggtcctttttcaaattgcaaat

SEQ ID NO: 368922 - DNA, 25 bp, Rattus norvegicus
gatggtcgcatcatggaaagcttct

SEQ ID NO: 368923 - DNA, 25 bp, Rattus norvegicus
gatggtcgcatcttggaaagcttct

SEQ ID NO: 368924 - DNA, 25 bp, Rattus norvegicus
gatggtcggcatctttagcaaactt

SEQ ID NO: 368925 - DNA, 25 bp, Rattus norvegicus
gatggtcggcatgtttagcaaactt

SEQ ID NO: 368926 - DNA, 25 bp, Rattus norvegicus
gatggtcgttttccactcattgtag

SEQ ID NO: 368927 - DNA, 25 bp, Rattus norvegicus
gatggtcgttttgcactcattgtag

SEQ ID NO: 368928 - DNA, 25 bp, Rattus norvegicus
gatggtctaaagagcaagctggttt

SEQ ID NO: 368929 - DNA, 25 bp, Rattus norvegicus
gatggtctaaagtgcaagctggttt

SEQ ID NO: 368930 - DNA, 25 bp, Rattus norvegicus
gatggtctagggattgacacaccac

SEQ ID NO: 368931 - DNA, 25 bp, Rattus norvegicus
gatggtctagggtttgacacaccac

SEQ ID NO: 368932 - DNA, 25 bp, Rattus norvegicus
gatggtctcatacagtggcttctaa

SEQ ID NO: 368933 - DNA, 25 bp, Rattus norvegicus
gatggtctcatagagtggcttctaa

SEQ ID NO: 368934 - DNA, 25 bp, Rattus norvegicus
gatggtctcattctggaaactctaa

SEQ ID NO: 368935 - DNA, 25 bp, Rattus norvegicus
gatggtctcattgtggaaactctaa

SEQ ID NO: 368936 - DNA, 25 bp, Rattus norvegicus
gatggtctccaaaagctatgccacc

SEQ ID NO: 368937 - DNA, 25 bp, Rattus norvegicus
gatggtctccaatagctatgccacc

SEQ ID NO: 368938 - DNA, 25 bp, Rattus norvegicus
gatggtctctgaagtgtagcatgtc

SEQ ID NO: 368939 - DNA, 25 bp, Rattus norvegicus
gatggtctctgatgtgtagcatgtc

SEQ ID NO: 368940 - DNA, 25 bp, Rattus norvegicus
gatggtctcttgacacagatcttgc

SEQ ID NO: 368941 - DNA, 25 bp, Rattus norvegicus
gatggtctcttgtcacagatcttgc

SEQ ID NO: 368942 - DNA, 25 bp, Rattus norvegicus
gatggtctgacgagatacttcgttt

SEQ ID NO: 368943 - DNA, 25 bp, Rattus norvegicus
gatggtctgacgtgatacttcgttt

SEQ ID NO: 368944 - DNA, 25 bp, Rattus norvegicus
gatggtctgcagagcacgagcatat

SEQ ID NO: 368945 - DNA, 25 bp, Rattus norvegicus
gatggtctgcagtgcacgagcatat

SEQ ID NO: 368946 - DNA, 25 bp, Rattus norvegicus
gatggtctgcttattagctgtcctg

SEQ ID NO: 368947 - DNA, 25 bp, Rattus norvegicus
gatggtctgctttttagctgtcctg

SEQ ID NO: 368948 - DNA, 25 bp, Rattus norvegicus
gatggtctggaacagtaactttgac

SEQ ID NO: 368949 - DNA, 25 bp, Rattus norvegicus
gatggtctggaagagtaactttgac

SEQ ID NO: 368950 - DNA, 25 bp, Rattus norvegicus
gatggtctggttagggtgaatttca

SEQ ID NO: 368951 - DNA, 25 bp, Rattus norvegicus
gatggtctggtttgggtgaatttca

SEQ ID NO: 368952 - DNA, 25 bp, Rattus norvegicus
gatggtctgtccctaagttgtaact

SEQ ID NO: 368953 - DNA, 25 bp, Rattus norvegicus
gatggtctgtccctctgtcgtgagc

SEQ ID NO: 368954 - DNA, 25 bp, Rattus norvegicus
gatggtctgtccgtaagttgtaact

SEQ ID NO: 368955 - DNA, 25 bp, Rattus norvegicus
gatggtctgtccgtctgtcgtgagc

SEQ ID NO: 368956 - DNA, 25 bp, Rattus norvegicus
gatggtctgtgaaacttactaagca

SEQ ID NO: 368957 - DNA, 25 bp, Rattus norvegicus
gatggtctgtgatacttactaagca

SEQ ID NO: 368958 - DNA, 25 bp, Rattus norvegicus
gatggtctgtttacactggtacttt

SEQ ID NO: 368959 - DNA, 25 bp, Rattus norvegicus
gatggtctgttttcactggtacttt

SEQ ID NO: 368960 - DNA, 25 bp, Rattus norvegicus
gatggtcttagcataggaccgggaa

SEQ ID NO: 368961 - DNA, 25 bp, Rattus norvegicus
gatggtcttagcttaggaccgggaa

SEQ ID NO: 368962 - DNA, 25 bp, Rattus norvegicus
gatggtcttatcatctgtactgtac

SEQ ID NO: 368963 - DNA, 25 bp, Rattus norvegicus
gatggtcttatcttctgtactgtac

SEQ ID NO: 368964 - DNA, 25 bp, Rattus norvegicus
gatggtcttccaaacttcaaagcta

SEQ ID NO: 368965 - DNA, 25 bp, Rattus norvegicus
gatggtcttccatacttcaaagcta

SEQ ID NO: 368966 - DNA, 25 bp, Rattus norvegicus
gatggtctttctcagctaattgcat

SEQ ID NO: 368967 - DNA, 25 bp, Rattus norvegicus
gatggtctttctgagctaattgcat

SEQ ID NO: 368968 - DNA, 25 bp, Rattus norvegicus
gatggtgaaacccaggaacctacct

SEQ ID NO: 368969 - DNA, 25 bp, Rattus norvegicus
gatggtgaaaccgaggaacctacct

SEQ ID NO: 368970 - DNA, 25 bp, Rattus norvegicus
gatggtgaactactcccacgtgacc

SEQ ID NO: 368971 - DNA, 25 bp, Rattus norvegicus
gatggtgaactagtcccacgtgacc

SEQ ID NO: 368972 - DNA, 25 bp, Rattus norvegicus
gatggtgacatacgtctctttagtg

SEQ ID NO: 368973 - DNA, 25 bp, Rattus norvegicus
gatggtgacataggtctctttagtg

SEQ ID NO: 368974 - DNA, 25 bp, Rattus norvegicus
gatggtgactggaactaaggctgca

SEQ ID NO: 368975 - DNA, 25 bp, Rattus norvegicus
gatggtgactggtactaaggctgca

SEQ ID NO: 368976 - DNA, 25 bp, Rattus norvegicus
gatggtgagagcacacgttctcctt

SEQ ID NO: 368977 - DNA, 25 bp, Rattus norvegicus
gatggtgagagctcacgttctcctt

SEQ ID NO: 368978 - DNA, 25 bp, Rattus norvegicus
gatggtgattttacctctataagag

SEQ ID NO: 368979 - DNA, 25 bp, Rattus norvegicus
gatggtgatttttcctctataagag

SEQ ID NO: 368980 - DNA, 25 bp, Rattus norvegicus
gatggtgcaaacagcgttgctgtta

SEQ ID NO: 368981 - DNA, 25 bp, Rattus norvegicus
gatggtgcaaactgcgttgctgtta

SEQ ID NO: 368982 - DNA, 25 bp, Rattus norvegicus
gatggtgcagctagatccggaattc

SEQ ID NO: 368983 - DNA, 25 bp, Rattus norvegicus
gatggtgcagcttgatccggaattc

SEQ ID NO: 368984 - DNA, 25 bp, Rattus norvegicus
gatggtgcctgtaaacctaaacaca

SEQ ID NO: 368985 - DNA, 25 bp, Rattus norvegicus
gatggtgcctgttaacctaaacaca

SEQ ID NO: 368986 - DNA, 25 bp, Rattus norvegicus
gatggtgccttaatgtcttgttcag

SEQ ID NO: 368987 - DNA, 25 bp, Rattus norvegicus
gatggtgccttattgtcttgttcag

SEQ ID NO: 368988 - DNA, 25 bp, Rattus norvegicus
gatggtgcggtaatggctttgccca

SEQ ID NO: 368989 - DNA, 25 bp, Rattus norvegicus
gatggtgcggtattggctttgccca

SEQ ID NO: 368990 - DNA, 25 bp, Rattus norvegicus
gatggtgctctgaagacactttact

SEQ ID NO: 368991 - DNA, 25 bp, Rattus norvegicus
gatggtgctctgtagacactttact

SEQ ID NO: 368992 - DNA, 25 bp, Rattus norvegicus
gatggtgctgacagcaacactccag

SEQ ID NO: 368993 - DNA, 25 bp, Rattus norvegicus
gatggtgctgactgcaacactccag

SEQ ID NO: 368994 - DNA, 25 bp, Rattus norvegicus
gatggtgctgctaatacccaacatt

SEQ ID NO: 368995 - DNA, 25 bp, Rattus norvegicus
gatggtgctgcttatacccaacatt

SEQ ID NO: 368996 - DNA, 25 bp, Rattus norvegicus
gatggtgctgggattagctttatga

SEQ ID NO: 368997 - DNA, 25 bp, Rattus norvegicus
gatggtgctgggtttagctttatga

SEQ ID NO: 368998 - DNA, 25 bp, Rattus norvegicus
gatggtgcttagctctgcaataaga

SEQ ID NO: 368999 - DNA, 25 bp, Rattus norvegicus
gatggtgcttaggtctgcaataaga

SEQ ID NO: 369000 - DNA, 25 bp, Rattus norvegicus
gatggtggacacatggcctgctcct

SEQ ID NO: 369001 - DNA, 25 bp, Rattus norvegicus
gatggtggacacttggcctgctcct

SEQ ID NO: 369002 - DNA, 25 bp, Rattus norvegicus
gatggtggagatatctttgcagcaa

SEQ ID NO: 369003 - DNA, 25 bp, Rattus norvegicus
gatggtggagatttctttgcagcaa

SEQ ID NO: 369004 - DNA, 25 bp, Rattus norvegicus
gatggtggatttaggccagctagcc

SEQ ID NO: 369005 - DNA, 25 bp, Rattus norvegicus
gatggtggattttggccagctagcc

SEQ ID NO: 369006 - DNA, 25 bp, Rattus norvegicus
gatggtggcagtcgtccggctcagc

SEQ ID NO: 369007 - DNA, 25 bp, Rattus norvegicus
gatggtggcagtggtccggctcagc

SEQ ID NO: 369008 - DNA, 25 bp, Rattus norvegicus
gatggtggctacactgaggatcctt

SEQ ID NO: 369009 - DNA, 25 bp, Rattus norvegicus
gatggtggctactctgaggatcctt

SEQ ID NO: 369010 - DNA, 25 bp, Rattus norvegicus
gatggtggctggatctatgcctaca

SEQ ID NO: 369011 - DNA, 25 bp, Rattus norvegicus
gatggtggctggttctatgcctaca

SEQ ID NO: 369012 - DNA, 25 bp, Rattus norvegicus
gatggtggcttcactctagtcctga

SEQ ID NO: 369013 - DNA, 25 bp, Rattus norvegicus
gatggtggcttctctctagtcctga

SEQ ID NO: 369014 - DNA, 25 bp, Rattus norvegicus
gatggtgggcctattgtgccaaaaa

SEQ ID NO: 369015 - DNA, 25 bp, Rattus norvegicus
gatggtgggccttttgtgccaaaaa

SEQ ID NO: 369016 - DNA, 25 bp, Rattus norvegicus
gatggtgggcgccaacttcttcctc

SEQ ID NO: 369017 - DNA, 25 bp, Rattus norvegicus
gatggtgggcgcgaacttcttcctc

SEQ ID NO: 369018 - DNA, 25 bp, Rattus norvegicus
gatggtgggctaccacacacctgca

SEQ ID NO: 369019 - DNA, 25 bp, Rattus norvegicus
gatggtgggctagcacacacctgca

SEQ ID NO: 369020 - DNA, 25 bp, Rattus norvegicus
gatggtgggtccaagtctggcacat

SEQ ID NO: 369021 - DNA, 25 bp, Rattus norvegicus
gatggtgggtcctagtctggcacat

SEQ ID NO: 369022 - DNA, 25 bp, Rattus norvegicus
gatggtgggtggctatccctgtgac

SEQ ID NO: 369023 - DNA, 25 bp, Rattus norvegicus
gatggtgggtgggtatccctgtgac

SEQ ID NO: 369024 - DNA, 25 bp, Rattus norvegicus
gatggtggtgatccacccaatgcct

SEQ ID NO: 369025 - DNA, 25 bp, Rattus norvegicus
gatggtggtgatgcacccaatgcct

SEQ ID NO: 369026 - DNA, 25 bp, Rattus norvegicus
gatggtgtacaaccccacagtaaag

SEQ ID NO: 369027 - DNA, 25 bp, Rattus norvegicus
gatggtgtacaagcccacagtaaag

SEQ ID NO: 369028 - DNA, 25 bp, Rattus norvegicus
gatggtgtagcactacgctccagcc

SEQ ID NO: 369029 - DNA, 25 bp, Rattus norvegicus
gatggtgtagcagtacgctccagcc

SEQ ID NO: 369030 - DNA, 25 bp, Rattus norvegicus
gatggtgtataacacccacccaacc

SEQ ID NO: 369031 - DNA, 25 bp, Rattus norvegicus
gatggtgtataagacccacccaacc

SEQ ID NO: 369032 - DNA, 25 bp, Rattus norvegicus
gatggtgtcactagcttcagctcga

SEQ ID NO: 369033 - DNA, 25 bp, Rattus norvegicus
gatggtgtcacttgcttcagctcga

SEQ ID NO: 369034 - DNA, 25 bp, Rattus norvegicus
gatggtgtcatcactaaacctaaga

SEQ ID NO: 369035 - DNA, 25 bp, Rattus norvegicus
gatggtgtcatctctaaacctaaga

SEQ ID NO: 369036 - DNA, 25 bp, Rattus norvegicus
gatggtgtcattctctcagctgaga

SEQ ID NO: 369037 - DNA, 25 bp, Rattus norvegicus
gatggtgtcattgtctcagctgaga

SEQ ID NO: 369038 - DNA, 25 bp, Rattus norvegicus
gatggtgtccaaagagagcagagca

SEQ ID NO: 369039 - DNA, 25 bp, Rattus norvegicus
gatggtgtccaatgagagcagagca

SEQ ID NO: 369040 - DNA, 25 bp, Rattus norvegicus
gatggtgtccagagacacgccacac

SEQ ID NO: 369041 - DNA, 25 bp, Rattus norvegicus
gatggtgtccagtgacacgccacac

SEQ ID NO: 369042 - DNA, 25 bp, Rattus norvegicus
gatggtgtctcaatctcagactcag

SEQ ID NO: 369043 - DNA, 25 bp, Rattus norvegicus
gatggtgtctcattctcagactcag

SEQ ID NO: 369044 - DNA, 25 bp, Rattus norvegicus
gatggtgtgactaactccagtgcct

SEQ ID NO: 369045 - DNA, 25 bp, Rattus norvegicus
gatggtgtgacttactccagtgcct

SEQ ID NO: 369046 - DNA, 25 bp, Rattus norvegicus
gatggtgtggtcacttttcgtggaa

SEQ ID NO: 369047 - DNA, 25 bp, Rattus norvegicus
gatggtgtggtctcttttcgtggaa

SEQ ID NO: 369048 - DNA, 25 bp, Rattus norvegicus
gatggtgttacgattactgactgta

SEQ ID NO: 369049 - DNA, 25 bp, Rattus norvegicus
gatggtgttacgtttactgactgta

SEQ ID NO: 369050 - DNA, 25 bp, Rattus norvegicus
gatggtgttccaccaaaggaaccta

SEQ ID NO: 369051 - DNA, 25 bp, Rattus norvegicus
gatggtgttccagcaaaggaaccta

SEQ ID NO: 369052 - DNA, 25 bp, Rattus norvegicus
gatggtgttggacactctttgtttt

SEQ ID NO: 369053 - DNA, 25 bp, Rattus norvegicus
gatggtgttggagactctttgtttt

SEQ ID NO: 369054 - DNA, 25 bp, Rattus norvegicus
gatggtgtttaactaagccttggaa

SEQ ID NO: 369055 - DNA, 25 bp, Rattus norvegicus
gatggtgtttaagtaagccttggaa

SEQ ID NO: 369056 - DNA, 25 bp, Rattus norvegicus
gatggttaaacgatccttacctata

SEQ ID NO: 369057 - DNA, 25 bp, Rattus norvegicus
gatggttaaacgttccttacctata

SEQ ID NO: 369058 - DNA, 25 bp, Rattus norvegicus
gatggttaacccagaaagcatacat

SEQ ID NO: 369059 - DNA, 25 bp, Rattus norvegicus
gatggttaacccattgctggcagtg

SEQ ID NO: 369060 - DNA, 25 bp, Rattus norvegicus
gatggttaaccctgaaagcatacat

SEQ ID NO: 369061 - DNA, 25 bp, Rattus norvegicus
gatggttaaccctttgctggcagtg

SEQ ID NO: 369062 - DNA, 25 bp, Rattus norvegicus
gatggttaactgatttctcaagtga

SEQ ID NO: 369063 - DNA, 25 bp, Rattus norvegicus
gatggttaactgttttctcaagtga

SEQ ID NO: 369064 - DNA, 25 bp, Rattus norvegicus
gatggttaatgtctttgcccaagaa

SEQ ID NO: 369065 - DNA, 25 bp, Rattus norvegicus
gatggttaatgtgtttgcccaagaa

SEQ ID NO: 369066 - DNA, 25 bp, Rattus norvegicus
gatggttaccgaatagcccagccaa

SEQ ID NO: 369067 - DNA, 25 bp, Rattus norvegicus
gatggttaccgattagcccagccaa

SEQ ID NO: 369068 - DNA, 25 bp, Rattus norvegicus
gatggttaccggatgaagttcgcct

SEQ ID NO: 369069 - DNA, 25 bp, Rattus norvegicus
gatggttaccggttgaagttcgcct

SEQ ID NO: 369070 - DNA, 25 bp, Rattus norvegicus
gatggttagtaactcgaccccagaa

SEQ ID NO: 369071 - DNA, 25 bp, Rattus norvegicus
gatggttagtaagtcgaccccagaa

SEQ ID NO: 369072 - DNA, 25 bp, Rattus norvegicus
gatggttagtttatccacccgactg

SEQ ID NO: 369073 - DNA, 25 bp, Rattus norvegicus
gatggttagtttttccacccgactg

SEQ ID NO: 369074 - DNA, 25 bp, Rattus norvegicus
gatggttatcaacttctttcaataa

SEQ ID NO: 369075 - DNA, 25 bp, Rattus norvegicus
gatggttatcaagttctttcaataa

SEQ ID NO: 369076 - DNA, 25 bp, Rattus norvegicus
gatggttatcctctactgtacccaa

SEQ ID NO: 369077 - DNA, 25 bp, Rattus norvegicus
gatggttatcctgtactgtacccaa

SEQ ID NO: 369078 - DNA, 25 bp, Rattus norvegicus
gatggttatgtgaccgaccacctcc

SEQ ID NO: 369079 - DNA, 25 bp, Rattus norvegicus
gatggttatgtgtccgaccacctcc

SEQ ID NO: 369080 - DNA, 25 bp, Rattus norvegicus
gatggttcattgagtgtctttacac

SEQ ID NO: 369081 - DNA, 25 bp, Rattus norvegicus
gatggttcattgtgtgtctttacac

SEQ ID NO: 369082 - DNA, 25 bp, Rattus norvegicus
gatggttccgtaatttccaggaggg

SEQ ID NO: 369083 - DNA, 25 bp, Rattus norvegicus
gatggttccgtattttccaggaggg

SEQ ID NO: 369084 - DNA, 25 bp, Rattus norvegicus
gatggttcctatcacaagcctggat

SEQ ID NO: 369085 - DNA, 25 bp, Rattus norvegicus
gatggttcctatgacaagcctggat

SEQ ID NO: 369086 - DNA, 25 bp, Rattus norvegicus
gatggttcctctatagttctatggc

SEQ ID NO: 369087 - DNA, 25 bp, Rattus norvegicus
gatggttcctctccacaacactaga

SEQ ID NO: 369088 - DNA, 25 bp, Rattus norvegicus
gatggttcctctgcacaacactaga

SEQ ID NO: 369089 - DNA, 25 bp, Rattus norvegicus
gatggttcctctttagttctatggc

SEQ ID NO: 369090 - DNA, 25 bp, Rattus norvegicus
gatggttcggcaaagcagcctgagt

SEQ ID NO: 369091 - DNA, 25 bp, Rattus norvegicus
gatggttcggcatagcagcctgagt

SEQ ID NO: 369092 - DNA, 25 bp, Rattus norvegicus
gatggttctaaacctggtctgtggc

SEQ ID NO: 369093 - DNA, 25 bp, Rattus norvegicus
gatggttctaaagctggtctgtggc

SEQ ID NO: 369094 - DNA, 25 bp, Rattus norvegicus
gatggttctagtacgtttcagtctg

SEQ ID NO: 369095 - DNA, 25 bp, Rattus norvegicus
gatggttctagttcgtttcagtctg

SEQ ID NO: 369096 - DNA, 25 bp, Rattus norvegicus
gatggttctcaaagaccccaggaag

SEQ ID NO: 369097 - DNA, 25 bp, Rattus norvegicus
gatggttctcaacatagaccacagt

SEQ ID NO: 369098 - DNA, 25 bp, Rattus norvegicus
gatggttctcaagatagaccacagt

SEQ ID NO: 369099 - DNA, 25 bp, Rattus norvegicus
gatggttctcaatgaccccaggaag

SEQ ID NO: 369100 - DNA, 25 bp, Rattus norvegicus
gatggttctgaaaggctcatgcttt

SEQ ID NO: 369101 - DNA, 25 bp, Rattus norvegicus
gatggttctgaatggctcatgcttt

SEQ ID NO: 369102 - DNA, 25 bp, Rattus norvegicus
gatggttctgggacgtatgctctct

SEQ ID NO: 369103 - DNA, 25 bp, Rattus norvegicus
gatggttctgggtcgtatgctctct

SEQ ID NO: 369104 - DNA, 25 bp, Rattus norvegicus
gatggttctgtaaccttgtgctttt

SEQ ID NO: 369105 - DNA, 25 bp, Rattus norvegicus
gatggttctgtatccttgtgctttt

SEQ ID NO: 369106 - DNA, 25 bp, Rattus norvegicus
gatggttggagtactaacacctaac

SEQ ID NO: 369107 - DNA, 25 bp, Rattus norvegicus
gatggttggagttctaacacctaac

SEQ ID NO: 369108 - DNA, 25 bp, Rattus norvegicus
gatggttggatcatagtccgtcaca

SEQ ID NO: 369109 - DNA, 25 bp, Rattus norvegicus
gatggttggatcttagtccgtcaca

SEQ ID NO: 369110 - DNA, 25 bp, Rattus norvegicus
gatggttggcttaaattccttttag

SEQ ID NO: 369111 - DNA, 25 bp, Rattus norvegicus
gatggttggctttaattccttttag

SEQ ID NO: 369112 - DNA, 25 bp, Rattus norvegicus
gatggttgggaactccccatttaat

SEQ ID NO: 369113 - DNA, 25 bp, Rattus norvegicus
gatggttgggaagtccccatttaat

SEQ ID NO: 369114 - DNA, 25 bp, Rattus norvegicus
gatggttgggcgaaattctttcaca

SEQ ID NO: 369115 - DNA, 25 bp, Rattus norvegicus
gatggttgggcgtaattctttcaca

SEQ ID NO: 369116 - DNA, 25 bp, Rattus norvegicus
gatggttgtattaatctctcccagc

SEQ ID NO: 369117 - DNA, 25 bp, Rattus norvegicus
gatggttgtatttatctctcccagc

SEQ ID NO: 369118 - DNA, 25 bp, Rattus norvegicus
gatggttgtcagatggagattgttc

SEQ ID NO: 369119 - DNA, 25 bp, Rattus norvegicus
gatggttgtcagttggagattgttc

SEQ ID NO: 369120 - DNA, 25 bp, Rattus norvegicus
gatggttgtgatccccaaggtctca

SEQ ID NO: 369121 - DNA, 25 bp, Rattus norvegicus
gatggttgtgatgcccaaggtctca

SEQ ID NO: 369122 - DNA, 25 bp, Rattus norvegicus
gatggtttagccatggctgttcaca

SEQ ID NO: 369123 - DNA, 25 bp, Rattus norvegicus
gatggtttagccttggctgttcaca

SEQ ID NO: 369124 - DNA, 25 bp, Rattus norvegicus
gatggtttataacggccaccgcaac

SEQ ID NO: 369125 - DNA, 25 bp, Rattus norvegicus
gatggtttataagggccaccgcaac

SEQ ID NO: 369126 - DNA, 25 bp, Rattus norvegicus
gatggtttccttagtagtcatttat

SEQ ID NO: 369127 - DNA, 25 bp, Rattus norvegicus
gatggtttcctttgtagtcatttat

SEQ ID NO: 369128 - DNA, 25 bp, Rattus norvegicus
gatggtttctggatccctagagctg

SEQ ID NO: 369129 - DNA, 25 bp, Rattus norvegicus
gatggtttctggttccctagagctg

SEQ ID NO: 369130 - DNA, 25 bp, Rattus norvegicus
gatggtttcttcataaacacggcta

SEQ ID NO: 369131 - DNA, 25 bp, Rattus norvegicus
gatggtttcttcattgctgtgacaa

SEQ ID NO: 369132 - DNA, 25 bp, Rattus norvegicus
gatggtttcttcttaaacacggcta

SEQ ID NO: 369133 - DNA, 25 bp, Rattus norvegicus
gatggtttcttctttgctgtgacaa

SEQ ID NO: 369134 - DNA, 25 bp, Rattus norvegicus
gatggtttgcatatgtttctgaaac

SEQ ID NO: 369135 - DNA, 25 bp, Rattus norvegicus
gatggtttgcatttgtttctgaaac

SEQ ID NO: 369136 - DNA, 25 bp, Rattus norvegicus
gatggtttgctcaagtctgtcctgc

SEQ ID NO: 369137 - DNA, 25 bp, Rattus norvegicus
gatggtttgctctagtctgtcctgc

SEQ ID NO: 369138 - DNA, 25 bp, Rattus norvegicus
gatggtttgtctctgtaactctggc

SEQ ID NO: 369139 - DNA, 25 bp, Rattus norvegicus
gatggtttgtctgtgtaactctggc

SEQ ID NO: 369140 - DNA, 25 bp, Rattus norvegicus
gatggtttgtgcaattttctgtaat

SEQ ID NO: 369141 - DNA, 25 bp, Rattus norvegicus
gatggtttgtgctattttctgtaat

SEQ ID NO: 369142 - DNA, 25 bp, Rattus norvegicus
gatggtttgtgtactgacctctgta

SEQ ID NO: 369143 - DNA, 25 bp, Rattus norvegicus
gatggtttgtgttctgacctctgta

SEQ ID NO: 369144 - DNA, 25 bp, Rattus norvegicus
gatggtttgttacttgaatctccaa

SEQ ID NO: 369145 - DNA, 25 bp, Rattus norvegicus
gatggtttgttagttgaatctccaa

SEQ ID NO: 369146 - DNA, 25 bp, Rattus norvegicus
gatggttttactccaacagtttact

SEQ ID NO: 369147 - DNA, 25 bp, Rattus norvegicus
gatggttttactgcaacagtttact

SEQ ID NO: 369148 - DNA, 25 bp, Rattus norvegicus
gatggttttatcacctgcatatgcc

SEQ ID NO: 369149 - DNA, 25 bp, Rattus norvegicus
gatggttttatctcctgcatatgcc

SEQ ID NO: 369150 - DNA, 25 bp, Rattus norvegicus
gatggttttgcacaggtgcctcacc

SEQ ID NO: 369151 - DNA, 25 bp, Rattus norvegicus
gatggttttgcagaggtgcctcacc

SEQ ID NO: 369152 - DNA, 25 bp, Rattus norvegicus
gatggttttgtgcttctttcaatat

SEQ ID NO: 369153 - DNA, 25 bp, Rattus norvegicus
gatggttttgtggttctttcaatat

SEQ ID NO: 369154 - DNA, 25 bp, Rattus norvegicus
gatggttttgttacttcgtaactca

SEQ ID NO: 369155 - DNA, 25 bp, Rattus norvegicus
gatggttttgtttcttcgtaactca

SEQ ID NO: 369156 - DNA, 25 bp, Rattus norvegicus
gatggtttttcgctttcttttgatg

SEQ ID NO: 369157 - DNA, 25 bp, Rattus norvegicus
gatggtttttcggtttcttttgatg

SEQ ID NO: 369158 - DNA, 25 bp, Rattus norvegicus
gatggtttttctagtaaacttgtgg

SEQ ID NO: 369159 - DNA, 25 bp, Rattus norvegicus
gatggtttttcttgtaaacttgtgg

SEQ ID NO: 369160 - DNA, 25 bp, Rattus norvegicus
gatggtttttgaagcctataccttt

SEQ ID NO: 369161 - DNA, 25 bp, Rattus norvegicus
gatggtttttgatgcctataccttt

SEQ ID NO: 369162 - DNA, 25 bp, Rattus norvegicus
gatggttttttactgctttgtcaaa

SEQ ID NO: 369163 - DNA, 25 bp, Rattus norvegicus
gatggttttttagtgctttgtcaaa

SEQ ID NO: 369164 - DNA, 25 bp, Rattus norvegicus
gatgtaaaagccatgcttgcctatt

SEQ ID NO: 369165 - DNA, 25 bp, Rattus norvegicus
gatgtaaaagccatgggccctctcg

SEQ ID NO: 369166 - DNA, 25 bp, Rattus norvegicus
gatgtaaaagccttgcttgcctatt

SEQ ID NO: 369167 - DNA, 25 bp, Rattus norvegicus
gatgtaaaagccttgggccctctcg

SEQ ID NO: 369168 - DNA, 25 bp, Rattus norvegicus
gatgtaaaagctcccagtgactggc

SEQ ID NO: 369169 - DNA, 25 bp, Rattus norvegicus
gatgtaaaagctgccagtgactggc

SEQ ID NO: 369170 - DNA, 25 bp, Rattus norvegicus
gatgtaaacctcattggctcaactg

SEQ ID NO: 369171 - DNA, 25 bp, Rattus norvegicus
gatgtaaacctctttggctcaactg

SEQ ID NO: 369172 - DNA, 25 bp, Rattus norvegicus
gatgtaaacgctagtgatttctcgc

SEQ ID NO: 369173 - DNA, 25 bp, Rattus norvegicus
gatgtaaacgcttgtgatttctcgc

SEQ ID NO: 369174 - DNA, 25 bp, Rattus norvegicus
gatgtaaagcctatgagtgtcacca

SEQ ID NO: 369175 - DNA, 25 bp, Rattus norvegicus
gatgtaaagcctttgagtgtcacca

SEQ ID NO: 369176 - DNA, 25 bp, Rattus norvegicus
gatgtaaataaacccagagccctca

SEQ ID NO: 369177 - DNA, 25 bp, Rattus norvegicus
gatgtaaataaagccagagccctca

SEQ ID NO: 369178 - DNA, 25 bp, Rattus norvegicus
gatgtaaatatcaggttcttctgta

SEQ ID NO: 369179 - DNA, 25 bp, Rattus norvegicus
gatgtaaatatctggttcttctgta

SEQ ID NO: 369180 - DNA, 25 bp, Rattus norvegicus
gatgtaaatcacaggcttggcctat

SEQ ID NO: 369181 - DNA, 25 bp, Rattus norvegicus
gatgtaaatcactggcttggcctat

SEQ ID NO: 369182 - DNA, 25 bp, Rattus norvegicus
gatgtaaatccaaagcacggagctc

SEQ ID NO: 369183 - DNA, 25 bp, Rattus norvegicus
gatgtaaatccatagcacggagctc

SEQ ID NO: 369184 - DNA, 25 bp, Rattus norvegicus
gatgtaaatggcacaaggtctctta

SEQ ID NO: 369185 - DNA, 25 bp, Rattus norvegicus
gatgtaaatggctcaaggtctctta

SEQ ID NO: 369186 - DNA, 25 bp, Rattus norvegicus
gatgtaaatgttagagccacaatta

SEQ ID NO: 369187 - DNA, 25 bp, Rattus norvegicus
gatgtaaatgtttgagccacaatta

SEQ ID NO: 369188 - DNA, 25 bp, Rattus norvegicus
gatgtaacaaaaatcccacggcttt

SEQ ID NO: 369189 - DNA, 25 bp, Rattus norvegicus
gatgtaacaaaattcccacggcttt

SEQ ID NO: 369190 - DNA, 25 bp, Rattus norvegicus
gatgtaacacacaaggccacagggt

SEQ ID NO: 369191 - DNA, 25 bp, Rattus norvegicus
gatgtaacacactaggccacagggt

SEQ ID NO: 369192 - DNA, 25 bp, Rattus norvegicus
gatgtaacaccccttattttccatg

SEQ ID NO: 369193 - DNA, 25 bp, Rattus norvegicus
gatgtaacacccgttattttccatg

SEQ ID NO: 369194 - DNA, 25 bp, Rattus norvegicus
gatgtaacatcaccacaaccaatga

SEQ ID NO: 369195 - DNA, 25 bp, Rattus norvegicus
gatgtaacatcagcacaaccaatga

SEQ ID NO: 369196 - DNA, 25 bp, Rattus norvegicus
gatgtaacccagatacggaacgtgt

SEQ ID NO: 369197 - DNA, 25 bp, Rattus norvegicus
gatgtaacccagttacggaacgtgt

SEQ ID NO: 369198 - DNA, 25 bp, Rattus norvegicus
gatgtaaccctgctgaatcctggct

SEQ ID NO: 369199 - DNA, 25 bp, Rattus norvegicus
gatgtaaccctggtgaatcctggct

SEQ ID NO: 369200 - DNA, 25 bp, Rattus norvegicus
gatgtaacctgacctgggaacccct

SEQ ID NO: 369201 - DNA, 25 bp, Rattus norvegicus
gatgtaacctgagctgggaacccct

SEQ ID NO: 369202 - DNA, 25 bp, Rattus norvegicus
gatgtaacgacacccctctgagaga

SEQ ID NO: 369203 - DNA, 25 bp, Rattus norvegicus
gatgtaacgacagccctctgagaga

SEQ ID NO: 369204 - DNA, 25 bp, Rattus norvegicus
gatgtaactcttcataggctcccct

SEQ ID NO: 369205 - DNA, 25 bp, Rattus norvegicus
gatgtaactcttgataggctcccct

SEQ ID NO: 369206 - DNA, 25 bp, Rattus norvegicus
gatgtaactgctccttgagttctca

SEQ ID NO: 369207 - DNA, 25 bp, Rattus norvegicus
gatgtaactgctgcttgagttctca

SEQ ID NO: 369208 - DNA, 25 bp, Rattus norvegicus
gatgtaagaagacacaagcatttcc

SEQ ID NO: 369209 - DNA, 25 bp, Rattus norvegicus
gatgtaagaagagacaagcatttcc

SEQ ID NO: 369210 - DNA, 25 bp, Rattus norvegicus
gatgtaagacatatgatcccctgtt

SEQ ID NO: 369211 - DNA, 25 bp, Rattus norvegicus
gatgtaagacatttgatcccctgtt

SEQ ID NO: 369212 - DNA, 25 bp, Rattus norvegicus
gatgtaagatgtcatttcctgcagt

SEQ ID NO: 369213 - DNA, 25 bp, Rattus norvegicus
gatgtaagatgtgatttcctgcagt

SEQ ID NO: 369214 - DNA, 25 bp, Rattus norvegicus
gatgtaagctcccaactgattttga

SEQ ID NO: 369215 - DNA, 25 bp, Rattus norvegicus
gatgtaagctccgaactgattttga

SEQ ID NO: 369216 - DNA, 25 bp, Rattus norvegicus
gatgtaagctgacgcccctgggatc

SEQ ID NO: 369217 - DNA, 25 bp, Rattus norvegicus
gatgtaagctgaggcccctgggatc

SEQ ID NO: 369218 - DNA, 25 bp, Rattus norvegicus
gatgtaagtgtaaccttcggcaagt

SEQ ID NO: 369219 - DNA, 25 bp, Rattus norvegicus
gatgtaagtgtatccttcggcaagt

SEQ ID NO: 369220 - DNA, 25 bp, Rattus norvegicus
gatgtaatagtgaccaccttccaca

SEQ ID NO: 369221 - DNA, 25 bp, Rattus norvegicus
gatgtaatagtgagaacctcctttc

SEQ ID NO: 369222 - DNA, 25 bp, Rattus norvegicus
gatgtaatagtgtccaccttccaca

SEQ ID NO: 369223 - DNA, 25 bp, Rattus norvegicus
gatgtaatagtgtgaacctcctttc

SEQ ID NO: 369224 - DNA, 25 bp, Rattus norvegicus
gatgtaatcctcatgaagacgccac

SEQ ID NO: 369225 - DNA, 25 bp, Rattus norvegicus
gatgtaatcctcttgaagacgccac

SEQ ID NO: 369226 - DNA, 25 bp, Rattus norvegicus
gatgtaatctcaaatctacctcccc

SEQ ID NO: 369227 - DNA, 25 bp, Rattus norvegicus
gatgtaatctcatatctacctcccc

SEQ ID NO: 369228 - DNA, 25 bp, Rattus norvegicus
gatgtaatgcctaaatccctgggtc

SEQ ID NO: 369229 - DNA, 25 bp, Rattus norvegicus
gatgtaatgccttaatccctgggtc

SEQ ID NO: 369230 - DNA, 25 bp, Rattus norvegicus
gatgtaattcggaggcagagagctt

SEQ ID NO: 369231 - DNA, 25 bp, Rattus norvegicus
gatgtaattcggtggcagagagctt

SEQ ID NO: 369232 - DNA, 25 bp, Rattus norvegicus
gatgtaattctcatgggtgttctgt

SEQ ID NO: 369233 - DNA, 25 bp, Rattus norvegicus
gatgtaattctcttgggtgttctgt

SEQ ID NO: 369234 - DNA, 25 bp, Rattus norvegicus
gatgtaattgatctgcctggcagtc

SEQ ID NO: 369235 - DNA, 25 bp, Rattus norvegicus
gatgtaattgatgtgcctggcagtc

SEQ ID NO: 369236 - DNA, 25 bp, Rattus norvegicus
gatgtaattgccaagtgcttccctg

SEQ ID NO: 369237 - DNA, 25 bp, Rattus norvegicus
gatgtaattgcctagtgcttccctg

SEQ ID NO: 369238 - DNA, 25 bp, Rattus norvegicus
gatgtaattggactccttgagggaa

SEQ ID NO: 369239 - DNA, 25 bp, Rattus norvegicus
gatgtaattggagtccttgagggaa

SEQ ID NO: 369240 - DNA, 25 bp, Rattus norvegicus
gatgtaattgtgagtgttcttccta

SEQ ID NO: 369241 - DNA, 25 bp, Rattus norvegicus
gatgtaattgtgtgtgttcttccta

SEQ ID NO: 369242 - DNA, 25 bp, Rattus norvegicus
gatgtaatttcaaactaccttctga

SEQ ID NO: 369243 - DNA, 25 bp, Rattus norvegicus
gatgtaatttcatactaccttctga

SEQ ID NO: 369244 - DNA, 25 bp, Rattus norvegicus
gatgtacaactgattgacctccaga

SEQ ID NO: 369245 - DNA, 25 bp, Rattus norvegicus
gatgtacaactgtttgacctccaga

SEQ ID NO: 369246 - DNA, 25 bp, Rattus norvegicus
gatgtacaatgaactcctcaggaaa

SEQ ID NO: 369247 - DNA, 25 bp, Rattus norvegicus
gatgtacaatgactaatccaaacaa

SEQ ID NO: 369248 - DNA, 25 bp, Rattus norvegicus
gatgtacaatgagtaatccaaacaa

SEQ ID NO: 369249 - DNA, 25 bp, Rattus norvegicus
gatgtacaatgatctcctcaggaaa

SEQ ID NO: 369250 - DNA, 25 bp, Rattus norvegicus
gatgtacactacatggaccagcagg

SEQ ID NO: 369251 - DNA, 25 bp, Rattus norvegicus
gatgtacactacttggaccagcagg

SEQ ID NO: 369252 - DNA, 25 bp, Rattus norvegicus
gatgtacactgaatcaccgttgcgc

SEQ ID NO: 369253 - DNA, 25 bp, Rattus norvegicus
gatgtacactgattcaccgttgcgc

SEQ ID NO: 369254 - DNA, 25 bp, Rattus norvegicus
gatgtacactgtaatcagccccatg

SEQ ID NO: 369255 - DNA, 25 bp, Rattus norvegicus
gatgtacactgttatcagccccatg

SEQ ID NO: 369256 - DNA, 25 bp, Rattus norvegicus
gatgtacagcacaaattatgaccag

SEQ ID NO: 369257 - DNA, 25 bp, Rattus norvegicus
gatgtacagcactaattatgaccag

SEQ ID NO: 369258 - DNA, 25 bp, Rattus norvegicus
gatgtacagttgatctttgtctata

SEQ ID NO: 369259 - DNA, 25 bp, Rattus norvegicus
gatgtacagttgttctttgtctata

SEQ ID NO: 369260 - DNA, 25 bp, Rattus norvegicus
gatgtacataaaagcttccactttg

SEQ ID NO: 369261 - DNA, 25 bp, Rattus norvegicus
gatgtacataaatgcttccactttg

SEQ ID NO: 369262 - DNA, 25 bp, Rattus norvegicus
gatgtacatctgcaggctggtgaaa

SEQ ID NO: 369263 - DNA, 25 bp, Rattus norvegicus
gatgtacatctggaggctggtgaaa

SEQ ID NO: 369264 - DNA, 25 bp, Rattus norvegicus
gatgtacatggccaatgtgccttgc

SEQ ID NO: 369265 - DNA, 25 bp, Rattus norvegicus
gatgtacatggcgaatgtgccttgc

SEQ ID NO: 369266 - DNA, 25 bp, Rattus norvegicus
gatgtaccaagaagcctgtgaggat

SEQ ID NO: 369267 - DNA, 25 bp, Rattus norvegicus
gatgtaccaagatgcctgtgaggat

SEQ ID NO: 369268 - DNA, 25 bp, Rattus norvegicus
gatgtaccaccacaacccaagaaga

SEQ ID NO: 369269 - DNA, 25 bp, Rattus norvegicus
gatgtaccaccagaacccaagaaga

SEQ ID NO: 369270 - DNA, 25 bp, Rattus norvegicus
gatgtaccagacagggtcgctgaac

SEQ ID NO: 369271 - DNA, 25 bp, Rattus norvegicus
gatgtaccagactgggtcgctgaac

SEQ ID NO: 369272 - DNA, 25 bp, Rattus norvegicus
gatgtaccagccatgaccgaggagg

SEQ ID NO: 369273 - DNA, 25 bp, Rattus norvegicus
gatgtaccagccttgaccgaggagg

SEQ ID NO: 369274 - DNA, 25 bp, Rattus norvegicus
gatgtaccatggagcttttcataga

SEQ ID NO: 369275 - DNA, 25 bp, Rattus norvegicus
gatgtaccatggtgcttttcataga

SEQ ID NO: 369276 - DNA, 25 bp, Rattus norvegicus
gatgtaccatttctctgttgtgtgt

SEQ ID NO: 369277 - DNA, 25 bp, Rattus norvegicus
gatgtaccatttgtctgttgtgtgt

SEQ ID NO: 369278 - DNA, 25 bp, Rattus norvegicus
gatgtacccatcagtgtagagcttg

SEQ ID NO: 369279 - DNA, 25 bp, Rattus norvegicus
gatgtacccatctgtgtagagcttg

SEQ ID NO: 369280 - DNA, 25 bp, Rattus norvegicus
gatgtaccccaaaatgggtagggtt

SEQ ID NO: 369281 - DNA, 25 bp, Rattus norvegicus
gatgtaccccaatatgggtagggtt

SEQ ID NO: 369282 - DNA, 25 bp, Rattus norvegicus
gatgtaccggagactggtccactca

SEQ ID NO: 369283 - DNA, 25 bp, Rattus norvegicus
gatgtaccggagtctggtccactca

SEQ ID NO: 369284 - DNA, 25 bp, Rattus norvegicus
gatgtacgcggtcgctgtcatcaca

SEQ ID NO: 369285 - DNA, 25 bp, Rattus norvegicus
gatgtacgcggtggctgtcatcaca

SEQ ID NO: 369286 - DNA, 25 bp, Rattus norvegicus
gatgtacgttttaacctggcagttg

SEQ ID NO: 369287 - DNA, 25 bp, Rattus norvegicus
gatgtacgtttttacctggcagttg

SEQ ID NO: 369288 - DNA, 25 bp, Rattus norvegicus
gatgtactaaagaccggaactccgc

SEQ ID NO: 369289 - DNA, 25 bp, Rattus norvegicus
gatgtactaaagtccggaactccgc

SEQ ID NO: 369290 - DNA, 25 bp, Rattus norvegicus
gatgtactatgcagacaccgagtgt

SEQ ID NO: 369291 - DNA, 25 bp, Rattus norvegicus
gatgtactatgctgacaccgagtgt

SEQ ID NO: 369292 - DNA, 25 bp, Rattus norvegicus
gatgtactccatagtgttgtggtga

SEQ ID NO: 369293 - DNA, 25 bp, Rattus norvegicus
gatgtactccatcttgggcttccac

SEQ ID NO: 369294 - DNA, 25 bp, Rattus norvegicus
gatgtactccatgttgggcttccac

SEQ ID NO: 369295 - DNA, 25 bp, Rattus norvegicus
gatgtactccattgtgttgtggtga

SEQ ID NO: 369296 - DNA, 25 bp, Rattus norvegicus
gatgtactcttactactctggaacc

SEQ ID NO: 369297 - DNA, 25 bp, Rattus norvegicus
gatgtactcttagtactctggaacc

SEQ ID NO: 369298 - DNA, 25 bp, Rattus norvegicus
gatgtactgctaccctttcatacac

SEQ ID NO: 369299 - DNA, 25 bp, Rattus norvegicus
gatgtactgctagcctttcatacac

SEQ ID NO: 369300 - DNA, 25 bp, Rattus norvegicus
gatgtactgcttcgactgcaccata

SEQ ID NO: 369301 - DNA, 25 bp, Rattus norvegicus
gatgtactgcttggactgcaccata

SEQ ID NO: 369302 - DNA, 25 bp, Rattus norvegicus
gatgtactggctctaaggatttggt

SEQ ID NO: 369303 - DNA, 25 bp, Rattus norvegicus
gatgtactggctgtaaggatttggt

SEQ ID NO: 369304 - DNA, 25 bp, Rattus norvegicus
gatgtactgtctagcatgtgagctt

SEQ ID NO: 369305 - DNA, 25 bp, Rattus norvegicus
gatgtactgtctcttagtgatgcta

SEQ ID NO: 369306 - DNA, 25 bp, Rattus norvegicus
gatgtactgtctgttagtgatgcta

SEQ ID NO: 369307 - DNA, 25 bp, Rattus norvegicus
gatgtactgtcttgcatgtgagctt

SEQ ID NO: 369308 - DNA, 25 bp, Rattus norvegicus
gatgtactgtttagagcttgggtta

SEQ ID NO: 369309 - DNA, 25 bp, Rattus norvegicus
gatgtactgttttgagcttgggtta

SEQ ID NO: 369310 - DNA, 25 bp, Rattus norvegicus
gatgtacttcagctgtcttgttttc

SEQ ID NO: 369311 - DNA, 25 bp, Rattus norvegicus
gatgtacttcaggtgtcttgttttc

SEQ ID NO: 369312 - DNA, 25 bp, Rattus norvegicus
gatgtacttcccaggatatttcccc

SEQ ID NO: 369313 - DNA, 25 bp, Rattus norvegicus
gatgtacttccctggatatttcccc

SEQ ID NO: 369314 - DNA, 25 bp, Rattus norvegicus
gatgtacttctcagtggcagtatta

SEQ ID NO: 369315 - DNA, 25 bp, Rattus norvegicus
gatgtacttctcatcaagtctgtga

SEQ ID NO: 369316 - DNA, 25 bp, Rattus norvegicus
gatgtacttctctgtggcagtatta

SEQ ID NO: 369317 - DNA, 25 bp, Rattus norvegicus
gatgtacttctcttcaagtctgtga

SEQ ID NO: 369318 - DNA, 25 bp, Rattus norvegicus
gatgtacttgcactatcgtttgaag

SEQ ID NO: 369319 - DNA, 25 bp, Rattus norvegicus
gatgtacttgcagtatcgtttgaag

SEQ ID NO: 369320 - DNA, 25 bp, Rattus norvegicus
gatgtactttttctcttgtgcatga

SEQ ID NO: 369321 - DNA, 25 bp, Rattus norvegicus
gatgtactttttgtcttgtgcatga

SEQ ID NO: 369322 - DNA, 25 bp, Rattus norvegicus
gatgtagaaactcaataaacccttt

SEQ ID NO: 369323 - DNA, 25 bp, Rattus norvegicus
gatgtagaaactgaataaacccttt

SEQ ID NO: 369324 - DNA, 25 bp, Rattus norvegicus
gatgtagaaattccctcgtagagtt

SEQ ID NO: 369325 - DNA, 25 bp, Rattus norvegicus
gatgtagaaattgcctcgtagagtt

SEQ ID NO: 369326 - DNA, 25 bp, Rattus norvegicus
gatgtagaacaacatacagcatgta

SEQ ID NO: 369327 - DNA, 25 bp, Rattus norvegicus
gatgtagaacaagatacagcatgta

SEQ ID NO: 369328 - DNA, 25 bp, Rattus norvegicus
gatgtagaccttaccatgggtccag

SEQ ID NO: 369329 - DNA, 25 bp, Rattus norvegicus
gatgtagaccttagtagacctcaag

SEQ ID NO: 369330 - DNA, 25 bp, Rattus norvegicus
gatgtagacctttccatgggtccag

SEQ ID NO: 369331 - DNA, 25 bp, Rattus norvegicus
gatgtagacctttgtagacctcaag

SEQ ID NO: 369332 - DNA, 25 bp, Rattus norvegicus
gatgtagagtccattgtaaacgtgg

SEQ ID NO: 369333 - DNA, 25 bp, Rattus norvegicus
gatgtagagtcctttgtaaacgtgg

SEQ ID NO: 369334 - DNA, 25 bp, Rattus norvegicus
gatgtagcatttcttgtgggccaac

SEQ ID NO: 369335 - DNA, 25 bp, Rattus norvegicus
gatgtagcatttgttgtgggccaac

SEQ ID NO: 369336 - DNA, 25 bp, Rattus norvegicus
gatgtagccacccttgctgtataat

SEQ ID NO: 369337 - DNA, 25 bp, Rattus norvegicus
gatgtagccaccgttgctgtataat

SEQ ID NO: 369338 - DNA, 25 bp, Rattus norvegicus
gatgtagccactatccctgtgtata

SEQ ID NO: 369339 - DNA, 25 bp, Rattus norvegicus
gatgtagccactccccaggcctgag

SEQ ID NO: 369340 - DNA, 25 bp, Rattus norvegicus
gatgtagccactgcccaggcctgag

SEQ ID NO: 369341 - DNA, 25 bp, Rattus norvegicus
gatgtagccactttccctgtgtata

SEQ ID NO: 369342 - DNA, 25 bp, Rattus norvegicus
gatgtagccagtagatctgtcctta

SEQ ID NO: 369343 - DNA, 25 bp, Rattus norvegicus
gatgtagccagttgatctgtcctta

SEQ ID NO: 369344 - DNA, 25 bp, Rattus norvegicus
gatgtagccatgaaagtgtcttaaa

SEQ ID NO: 369345 - DNA, 25 bp, Rattus norvegicus
gatgtagccatgtaagtgtcttaaa

SEQ ID NO: 369346 - DNA, 25 bp, Rattus norvegicus
gatgtagcctagctcatagccctga

SEQ ID NO: 369347 - DNA, 25 bp, Rattus norvegicus
gatgtagcctaggtcatagccctga

SEQ ID NO: 369348 - DNA, 25 bp, Rattus norvegicus
gatgtagcctccaggacagatggaa

SEQ ID NO: 369349 - DNA, 25 bp, Rattus norvegicus
gatgtagcctcctggacagatggaa

SEQ ID NO: 369350 - DNA, 25 bp, Rattus norvegicus
gatgtagccttgctagtcacacagc

SEQ ID NO: 369351 - DNA, 25 bp, Rattus norvegicus
gatgtagccttggtagtcacacagc

SEQ ID NO: 369352 - DNA, 25 bp, Rattus norvegicus
gatgtagcgattccactgagtgagc

SEQ ID NO: 369353 - DNA, 25 bp, Rattus norvegicus
gatgtagcgattgcactgagtgagc

SEQ ID NO: 369354 - DNA, 25 bp, Rattus norvegicus
gatgtaggaattactctctatctag

SEQ ID NO: 369355 - DNA, 25 bp, Rattus norvegicus
gatgtaggaatttctctctatctag

SEQ ID NO: 369356 - DNA, 25 bp, Rattus norvegicus
gatgtaggacctcagcagttttata

SEQ ID NO: 369357 - DNA, 25 bp, Rattus norvegicus
gatgtaggacctgagcagttttata

SEQ ID NO: 369358 - DNA, 25 bp, Rattus norvegicus
gatgtaggcaggaaagcacccaccc

SEQ ID NO: 369359 - DNA, 25 bp, Rattus norvegicus
gatgtaggcaggtaagcacccaccc

SEQ ID NO: 369360 - DNA, 25 bp, Rattus norvegicus
gatgtaggccaaccatgcagaacca

SEQ ID NO: 369361 - DNA, 25 bp, Rattus norvegicus
gatgtaggccaagcatgcagaacca

SEQ ID NO: 369362 - DNA, 25 bp, Rattus norvegicus
gatgtaggcctgcagctaatctttg

SEQ ID NO: 369363 - DNA, 25 bp, Rattus norvegicus
gatgtaggcctggagctaatctttg

SEQ ID NO: 369364 - DNA, 25 bp, Rattus norvegicus
gatgtaggtgtcagccatttcaaaa

SEQ ID NO: 369365 - DNA, 25 bp, Rattus norvegicus
gatgtaggtgtctgccatttcaaaa

SEQ ID NO: 369366 - DNA, 25 bp, Rattus norvegicus
gatgtaggtttaacactgaagaaca

SEQ ID NO: 369367 - DNA, 25 bp, Rattus norvegicus
gatgtaggtttatcactgaagaaca

SEQ ID NO: 369368 - DNA, 25 bp, Rattus norvegicus
gatgtagtatcacacaggactgcat

SEQ ID NO: 369369 - DNA, 25 bp, Rattus norvegicus
gatgtagtatcagacaggactgcat

SEQ ID NO: 369370 - DNA, 25 bp, Rattus norvegicus
gatgtagttcttcttttcttagtgt

SEQ ID NO: 369371 - DNA, 25 bp, Rattus norvegicus
gatgtagttcttgttttcttagtgt

SEQ ID NO: 369372 - DNA, 25 bp, Rattus norvegicus
gatgtagtttgaattgttcttttct

SEQ ID NO: 369373 - DNA, 25 bp, Rattus norvegicus
gatgtagtttgatttgttcttttct

SEQ ID NO: 369374 - DNA, 25 bp, Rattus norvegicus
gatgtataaagtcctctctgcagaa

SEQ ID NO: 369375 - DNA, 25 bp, Rattus norvegicus
gatgtataaagtgctctctgcagaa

SEQ ID NO: 369376 - DNA, 25 bp, Rattus norvegicus
gatgtataatataaggctccacaat

SEQ ID NO: 369377 - DNA, 25 bp, Rattus norvegicus
gatgtataatattaggctccacaat

SEQ ID NO: 369378 - DNA, 25 bp, Rattus norvegicus
gatgtataatgcacctccagcagct

SEQ ID NO: 369379 - DNA, 25 bp, Rattus norvegicus
gatgtataatgctcctccagcagct

SEQ ID NO: 369380 - DNA, 25 bp, Rattus norvegicus
gatgtatagataatcttgaacttcc

SEQ ID NO: 369381 - DNA, 25 bp, Rattus norvegicus
gatgtatagatattcttgaacttcc

SEQ ID NO: 369382 - DNA, 25 bp, Rattus norvegicus
gatgtatagcgactccaaagggaaa

SEQ ID NO: 369383 - DNA, 25 bp, Rattus norvegicus
gatgtatagcgagtccaaagggaaa

SEQ ID NO: 369384 - DNA, 25 bp, Rattus norvegicus
gatgtatagcttataacttatcaga

SEQ ID NO: 369385 - DNA, 25 bp, Rattus norvegicus
gatgtatagcttttaacttatcaga

SEQ ID NO: 369386 - DNA, 25 bp, Rattus norvegicus
gatgtatagttcctgaccactcatg

SEQ ID NO: 369387 - DNA, 25 bp, Rattus norvegicus
gatgtatagttcgtgaccactcatg

SEQ ID NO: 369388 - DNA, 25 bp, Rattus norvegicus
gatgtatatactaccttccaacacg

SEQ ID NO: 369389 - DNA, 25 bp, Rattus norvegicus
gatgtatatacttccttccaacacg

SEQ ID NO: 369390 - DNA, 25 bp, Rattus norvegicus
gatgtatatatcagggcagcaaaac

SEQ ID NO: 369391 - DNA, 25 bp, Rattus norvegicus
gatgtatatatctgggcagcaaaac

SEQ ID NO: 369392 - DNA, 25 bp, Rattus norvegicus
gatgtatatgtccagggctttgtat

SEQ ID NO: 369393 - DNA, 25 bp, Rattus norvegicus
gatgtatatgtcgagggctttgtat

SEQ ID NO: 369394 - DNA, 25 bp, Rattus norvegicus
gatgtatattcacgcttccgtgtcc

SEQ ID NO: 369395 - DNA, 25 bp, Rattus norvegicus
gatgtatattcaggcttccgtgtcc

SEQ ID NO: 369396 - DNA, 25 bp, Rattus norvegicus
gatgtatattgtacagttaccgtaa

SEQ ID NO: 369397 - DNA, 25 bp, Rattus norvegicus
gatgtatattgttcagttaccgtaa

SEQ ID NO: 369398 - DNA, 25 bp, Rattus norvegicus
gatgtatattttataaccctgaggt

SEQ ID NO: 369399 - DNA, 25 bp, Rattus norvegicus
gatgtatattttttaaccctgaggt

SEQ ID NO: 369400 - DNA, 25 bp, Rattus norvegicus
gatgtatcaaacaaccttctaggtg

SEQ ID NO: 369401 - DNA, 25 bp, Rattus norvegicus
gatgtatcaaactaccttctaggtg

SEQ ID NO: 369402 - DNA, 25 bp, Rattus norvegicus
gatgtatcacgccacacttgggtga

SEQ ID NO: 369403 - DNA, 25 bp, Rattus norvegicus
gatgtatcacgcgacacttgggtga

SEQ ID NO: 369404 - DNA, 25 bp, Rattus norvegicus
gatgtatcattgaactacattcccc

SEQ ID NO: 369405 - DNA, 25 bp, Rattus norvegicus
gatgtatcattgtactacattcccc

SEQ ID NO: 369406 - DNA, 25 bp, Rattus norvegicus
gatgtatccaccaaaccagtactga

SEQ ID NO: 369407 - DNA, 25 bp, Rattus norvegicus
gatgtatccacctaaccagtactga

SEQ ID NO: 369408 - DNA, 25 bp, Rattus norvegicus
gatgtatccagactgcaacccatag

SEQ ID NO: 369409 - DNA, 25 bp, Rattus norvegicus
gatgtatccagagtgcaacccatag

SEQ ID NO: 369410 - DNA, 25 bp, Rattus norvegicus
gatgtatccagtaaaaacaggcagt

SEQ ID NO: 369411 - DNA, 25 bp, Rattus norvegicus
gatgtatccagttaaaacaggcagt

SEQ ID NO: 369412 - DNA, 25 bp, Rattus norvegicus
gatgtatccattcctcacagcaaat

SEQ ID NO: 369413 - DNA, 25 bp, Rattus norvegicus
gatgtatccattgctcacagcaaat

SEQ ID NO: 369414 - DNA, 25 bp, Rattus norvegicus
gatgtatcccagatcacacagcaag

SEQ ID NO: 369415 - DNA, 25 bp, Rattus norvegicus
gatgtatcccagttcacacagcaag

SEQ ID NO: 369416 - DNA, 25 bp, Rattus norvegicus
gatgtatcccatattcactcgagac

SEQ ID NO: 369417 - DNA, 25 bp, Rattus norvegicus
gatgtatcccattttcactcgagac

SEQ ID NO: 369418 - DNA, 25 bp, Rattus norvegicus
gatgtatcctgaaacagctctgtca

SEQ ID NO: 369419 - DNA, 25 bp, Rattus norvegicus
gatgtatcctgatacagctctgtca

SEQ ID NO: 369420 - DNA, 25 bp, Rattus norvegicus
gatgtatcgcatacgttttattaat

SEQ ID NO: 369421 - DNA, 25 bp, Rattus norvegicus
gatgtatcgcattcgttttattaat

SEQ ID NO: 369422 - DNA, 25 bp, Rattus norvegicus
gatgtatcgcctctacatggcagaa

SEQ ID NO: 369423 - DNA, 25 bp, Rattus norvegicus
gatgtatcgcctgtacatggcagaa

SEQ ID NO: 369424 - DNA, 25 bp, Rattus norvegicus
gatgtatctaagacagacccacctc

SEQ ID NO: 369425 - DNA, 25 bp, Rattus norvegicus
gatgtatctaagtcagacccacctc

SEQ ID NO: 369426 - DNA, 25 bp, Rattus norvegicus
gatgtatctcctattgttgtgagca

SEQ ID NO: 369427 - DNA, 25 bp, Rattus norvegicus
gatgtatctccttttgttgtgagca

SEQ ID NO: 369428 - DNA, 25 bp, Rattus norvegicus
gatgtatctctaccctgcaatgagc

SEQ ID NO: 369429 - DNA, 25 bp, Rattus norvegicus
gatgtatctctagcctgcaatgagc

SEQ ID NO: 369430 - DNA, 25 bp, Rattus norvegicus
gatgtatctggtaactgtcacaata

SEQ ID NO: 369431 - DNA, 25 bp, Rattus norvegicus
gatgtatctggttactgtcacaata

SEQ ID NO: 369432 - DNA, 25 bp, Rattus norvegicus
gatgtatctgttctaactgtttaag

SEQ ID NO: 369433 - DNA, 25 bp, Rattus norvegicus
gatgtatctgttgtaactgtttaag

SEQ ID NO: 369434 - DNA, 25 bp, Rattus norvegicus
gatgtatcttctctatttagctttt

SEQ ID NO: 369435 - DNA, 25 bp, Rattus norvegicus
gatgtatcttctgtatttagctttt

SEQ ID NO: 369436 - DNA, 25 bp, Rattus norvegicus
gatgtatctttaatctcagtgccag

SEQ ID NO: 369437 - DNA, 25 bp, Rattus norvegicus
gatgtatctttattctcagtgccag

SEQ ID NO: 369438 - DNA, 25 bp, Rattus norvegicus
gatgtatctttcattcatcttcaga

SEQ ID NO: 369439 - DNA, 25 bp, Rattus norvegicus
gatgtatctttctttcatcttcaga

SEQ ID NO: 369440 - DNA, 25 bp, Rattus norvegicus
gatgtatgaacactccctatggctc

SEQ ID NO: 369441 - DNA, 25 bp, Rattus norvegicus
gatgtatgaacagtccctatggctc

SEQ ID NO: 369442 - DNA, 25 bp, Rattus norvegicus
gatgtatgaattacctctgtcccat

SEQ ID NO: 369443 - DNA, 25 bp, Rattus norvegicus
gatgtatgaatttcctctgtcccat

SEQ ID NO: 369444 - DNA, 25 bp, Rattus norvegicus
gatgtatgatcacactcacctgtgt

SEQ ID NO: 369445 - DNA, 25 bp, Rattus norvegicus
gatgtatgatcagactcacctgtgt

SEQ ID NO: 369446 - DNA, 25 bp, Rattus norvegicus
gatgtatgatggagtttcccagttc

SEQ ID NO: 369447 - DNA, 25 bp, Rattus norvegicus
gatgtatgatggtgtttcccagttc

SEQ ID NO: 369448 - DNA, 25 bp, Rattus norvegicus
gatgtatgattgacacagtaccaaa

SEQ ID NO: 369449 - DNA, 25 bp, Rattus norvegicus
gatgtatgattgtcacagtaccaaa

SEQ ID NO: 369450 - DNA, 25 bp, Rattus norvegicus
gatgtatgcaccaatcaatgtccat

SEQ ID NO: 369451 - DNA, 25 bp, Rattus norvegicus
gatgtatgcacctatcaatgtccat

SEQ ID NO: 369452 - DNA, 25 bp, Rattus norvegicus
gatgtatgccaacgccaggctttct

SEQ ID NO: 369453 - DNA, 25 bp, Rattus norvegicus
gatgtatgccaaggccaggctttct

SEQ ID NO: 369454 - DNA, 25 bp, Rattus norvegicus
gatgtatggatcagccttttctcag

SEQ ID NO: 369455 - DNA, 25 bp, Rattus norvegicus
gatgtatggatctgccttttctcag

SEQ ID NO: 369456 - DNA, 25 bp, Rattus norvegicus
gatgtatggatgacctcccagtgtt

SEQ ID NO: 369457 - DNA, 25 bp, Rattus norvegicus
gatgtatggatgtcctcccagtgtt

SEQ ID NO: 369458 - DNA, 25 bp, Rattus norvegicus
gatgtatgggagatgccaccattgt

SEQ ID NO: 369459 - DNA, 25 bp, Rattus norvegicus
gatgtatgggagttgccaccattgt

SEQ ID NO: 369460 - DNA, 25 bp, Rattus norvegicus
gatgtatgggatcctcttctccatt

SEQ ID NO: 369461 - DNA, 25 bp, Rattus norvegicus
gatgtatgggatgctcttctccatt

SEQ ID NO: 369462 - DNA, 25 bp, Rattus norvegicus
gatgtatgtcccatgtctgttccca

SEQ ID NO: 369463 - DNA, 25 bp, Rattus norvegicus
gatgtatgtcccttgtctgttccca

SEQ ID NO: 369464 - DNA, 25 bp, Rattus norvegicus
gatgtatgtgacagactctggttca

SEQ ID NO: 369465 - DNA, 25 bp, Rattus norvegicus
gatgtatgtgactgactctggttca

SEQ ID NO: 369466 - DNA, 25 bp, Rattus norvegicus
gatgtatgtgtaacacccctctgtg

SEQ ID NO: 369467 - DNA, 25 bp, Rattus norvegicus
gatgtatgtgtatcacccctctgtg

SEQ ID NO: 369468 - DNA, 25 bp, Rattus norvegicus
gatgtatgttaaaatgtgcctgtgg

SEQ ID NO: 369469 - DNA, 25 bp, Rattus norvegicus
gatgtatgttaatatgtgcctgtgg

SEQ ID NO: 369470 - DNA, 25 bp, Rattus norvegicus
gatgtatgttctacgttgcttgcta

SEQ ID NO: 369471 - DNA, 25 bp, Rattus norvegicus
gatgtatgttcttcgttgcttgcta

SEQ ID NO: 369472 - DNA, 25 bp, Rattus norvegicus
gatgtattactcacagtgccatttt

SEQ ID NO: 369473 - DNA, 25 bp, Rattus norvegicus
gatgtattactctcagtgccatttt

SEQ ID NO: 369474 - DNA, 25 bp, Rattus norvegicus
gatgtattctcactaaggttcacaa

SEQ ID NO: 369475 - DNA, 25 bp, Rattus norvegicus
gatgtattctcagtaaggttcacaa

SEQ ID NO: 369476 - DNA, 25 bp, Rattus norvegicus
gatgtattgcataccactgtctcag

SEQ ID NO: 369477 - DNA, 25 bp, Rattus norvegicus
gatgtattgcattccactgtctcag

SEQ ID NO: 369478 - DNA, 25 bp, Rattus norvegicus
gatgtattgctcatttttaatcagg

SEQ ID NO: 369479 - DNA, 25 bp, Rattus norvegicus
gatgtattgctcttttttaatcagg

SEQ ID NO: 369480 - DNA, 25 bp, Rattus norvegicus
gatgtattgctgaacgctccacgta

SEQ ID NO: 369481 - DNA, 25 bp, Rattus norvegicus
gatgtattgctgtacgctccacgta

SEQ ID NO: 369482 - DNA, 25 bp, Rattus norvegicus
gatgtatttaacagtgcccaccaat

SEQ ID NO: 369483 - DNA, 25 bp, Rattus norvegicus
gatgtatttaactgtgcccaccaat

SEQ ID NO: 369484 - DNA, 25 bp, Rattus norvegicus
gatgtatttcacactaccagacgat

SEQ ID NO: 369485 - DNA, 25 bp, Rattus norvegicus
gatgtatttcactctaccagacgat

SEQ ID NO: 369486 - DNA, 25 bp, Rattus norvegicus
gatgtatttccccttcatcggtgac

SEQ ID NO: 369487 - DNA, 25 bp, Rattus norvegicus
gatgtatttcccgttcatcggtgac

SEQ ID NO: 369488 - DNA, 25 bp, Rattus norvegicus
gatgtatttcctacgttatgaccaa

SEQ ID NO: 369489 - DNA, 25 bp, Rattus norvegicus
gatgtatttccttcgttatgaccaa

SEQ ID NO: 369490 - DNA, 25 bp, Rattus norvegicus
gatgtatttctaagttcctattgtg

SEQ ID NO: 369491 - DNA, 25 bp, Rattus norvegicus
gatgtatttctatgttcctattgtg

SEQ ID NO: 369492 - DNA, 25 bp, Rattus norvegicus
gatgtatttgaaacttactgcagca

SEQ ID NO: 369493 - DNA, 25 bp, Rattus norvegicus
gatgtatttgaatcttactgcagca

SEQ ID NO: 369494 - DNA, 25 bp, Rattus norvegicus
gatgtattttctaatcccacgatta

SEQ ID NO: 369495 - DNA, 25 bp, Rattus norvegicus
gatgtattttcttatcccacgatta

SEQ ID NO: 369496 - DNA, 25 bp, Rattus norvegicus
gatgtcaaacacaatccttccattc

SEQ ID NO: 369497 - DNA, 25 bp, Rattus norvegicus
gatgtcaaacactatccttccattc

SEQ ID NO: 369498 - DNA, 25 bp, Rattus norvegicus
gatgtcaaaccaatagtctcgttgt

SEQ ID NO: 369499 - DNA, 25 bp, Rattus norvegicus
gatgtcaaaccattagtctcgttgt

SEQ ID NO: 369500 - DNA, 25 bp, Rattus norvegicus
gatgtcaaagacagctcagaggcct

SEQ ID NO: 369501 - DNA, 25 bp, Rattus norvegicus
gatgtcaaagactgctcagaggcct

SEQ ID NO: 369502 - DNA, 25 bp, Rattus norvegicus
gatgtcaacactattactcagctca

SEQ ID NO: 369503 - DNA, 25 bp, Rattus norvegicus
gatgtcaacacttttactcagctca

SEQ ID NO: 369504 - DNA, 25 bp, Rattus norvegicus
gatgtcaacatgaaccaggctactg

SEQ ID NO: 369505 - DNA, 25 bp, Rattus norvegicus
gatgtcaacatgtaccaggctactg

SEQ ID NO: 369506 - DNA, 25 bp, Rattus norvegicus
gatgtcaagtaccaggatccaccaa

SEQ ID NO: 369507 - DNA, 25 bp, Rattus norvegicus
gatgtcaagtacgaggatccaccaa

SEQ ID NO: 369508 - DNA, 25 bp, Rattus norvegicus
gatgtcaagtgtcaactcacggttg

SEQ ID NO: 369509 - DNA, 25 bp, Rattus norvegicus
gatgtcaagtgtgaactcacggttg

SEQ ID NO: 369510 - DNA, 25 bp, Rattus norvegicus
gatgtcaataccatggtggctgtca

SEQ ID NO: 369511 - DNA, 25 bp, Rattus norvegicus
gatgtcaataccttggtggctgtca

SEQ ID NO: 369512 - DNA, 25 bp, Rattus norvegicus
gatgtcaatgctatggactgcacag

SEQ ID NO: 369513 - DNA, 25 bp, Rattus norvegicus
gatgtcaatgctcccattgccacca

SEQ ID NO: 369514 - DNA, 25 bp, Rattus norvegicus
gatgtcaatgctgccattgccacca

SEQ ID NO: 369515 - DNA, 25 bp, Rattus norvegicus
gatgtcaatgctttggactgcacag

SEQ ID NO: 369516 - DNA, 25 bp, Rattus norvegicus
gatgtcacacatctaagaaagctgt

SEQ ID NO: 369517 - DNA, 25 bp, Rattus norvegicus
gatgtcacacatgtaagaaagctgt

SEQ ID NO: 369518 - DNA, 25 bp, Rattus norvegicus
gatgtcacagacctgcccattggta

SEQ ID NO: 369519 - DNA, 25 bp, Rattus norvegicus
gatgtcacagacgtgcccattggta

SEQ ID NO: 369520 - DNA, 25 bp, Rattus norvegicus
gatgtcacaggtctcctgactcaaa

SEQ ID NO: 369521 - DNA, 25 bp, Rattus norvegicus
gatgtcacaggtgtcctgactcaaa

SEQ ID NO: 369522 - DNA, 25 bp, Rattus norvegicus
gatgtcaccaagctctcagaatgca

SEQ ID NO: 369523 - DNA, 25 bp, Rattus norvegicus
gatgtcaccaaggtctcagaatgca

SEQ ID NO: 369524 - DNA, 25 bp, Rattus norvegicus
gatgtcaccactaggacgtagctgt

SEQ ID NO: 369525 - DNA, 25 bp, Rattus norvegicus
gatgtcaccactaggtcctaattta

SEQ ID NO: 369526 - DNA, 25 bp, Rattus norvegicus
gatgtcaccactattataggctcta

SEQ ID NO: 369527 - DNA, 25 bp, Rattus norvegicus
gatgtcaccacttggacgtagctgt

SEQ ID NO: 369528 - DNA, 25 bp, Rattus norvegicus
gatgtcaccacttggtcctaattta

SEQ ID NO: 369529 - DNA, 25 bp, Rattus norvegicus
gatgtcaccacttttataggctcta

SEQ ID NO: 369530 - DNA, 25 bp, Rattus norvegicus
gatgtcaccaggaacctacgagttt

SEQ ID NO: 369531 - DNA, 25 bp, Rattus norvegicus
gatgtcaccaggctatgctgattcc

SEQ ID NO: 369532 - DNA, 25 bp, Rattus norvegicus
gatgtcaccagggtatgctgattcc

SEQ ID NO: 369533 - DNA, 25 bp, Rattus norvegicus
gatgtcaccaggtacctacgagttt

SEQ ID NO: 369534 - DNA, 25 bp, Rattus norvegicus
gatgtcaccattatggccactcatt

SEQ ID NO: 369535 - DNA, 25 bp, Rattus norvegicus
gatgtcaccattttggccactcatt

SEQ ID NO: 369536 - DNA, 25 bp, Rattus norvegicus
gatgtcacctgccacttgtagttaa

SEQ ID NO: 369537 - DNA, 25 bp, Rattus norvegicus
gatgtcacctgcgacttgtagttaa

SEQ ID NO: 369538 - DNA, 25 bp, Rattus norvegicus
gatgtcacggagagatcacagcgaa

SEQ ID NO: 369539 - DNA, 25 bp, Rattus norvegicus
gatgtcacggagtgatcacagcgaa

SEQ ID NO: 369540 - DNA, 25 bp, Rattus norvegicus
gatgtcactaatcaccagacccagt

SEQ ID NO: 369541 - DNA, 25 bp, Rattus norvegicus
gatgtcactaatgaccagacccagt

SEQ ID NO: 369542 - DNA, 25 bp, Rattus norvegicus
gatgtcactcctcgaagtgtcccta

SEQ ID NO: 369543 - DNA, 25 bp, Rattus norvegicus
gatgtcactcctggaagtgtcccta

SEQ ID NO: 369544 - DNA, 25 bp, Rattus norvegicus
gatgtcactctgcagcaggctgatg

SEQ ID NO: 369545 - DNA, 25 bp, Rattus norvegicus
gatgtcactctggagcaggctgatg

SEQ ID NO: 369546 - DNA, 25 bp, Rattus norvegicus
gatgtcactgacctagtgtaccctt

SEQ ID NO: 369547 - DNA, 25 bp, Rattus norvegicus
gatgtcactgacgtagtgtaccctt

SEQ ID NO: 369548 - DNA, 25 bp, Rattus norvegicus
gatgtcacttacatgtggaccctga

SEQ ID NO: 369549 - DNA, 25 bp, Rattus norvegicus
gatgtcacttacttgtggaccctga

SEQ ID NO: 369550 - DNA, 25 bp, Rattus norvegicus
gatgtcactttaaacctctagcttt

SEQ ID NO: 369551 - DNA, 25 bp, Rattus norvegicus
gatgtcactttatacctctagcttt

SEQ ID NO: 369552 - DNA, 25 bp, Rattus norvegicus
gatgtcagaattcaccatttgattt

SEQ ID NO: 369553 - DNA, 25 bp, Rattus norvegicus
gatgtcagaattgaccatttgattt

SEQ ID NO: 369554 - DNA, 25 bp, Rattus norvegicus
gatgtcagactccaaaacgtcagta

SEQ ID NO: 369555 - DNA, 25 bp, Rattus norvegicus
gatgtcagactcgaaaacgtcagta

SEQ ID NO: 369556 - DNA, 25 bp, Rattus norvegicus
gatgtcagcctgaagaccttggact

SEQ ID NO: 369557 - DNA, 25 bp, Rattus norvegicus
gatgtcagcctgtagaccttggact

SEQ ID NO: 369558 - DNA, 25 bp, Rattus norvegicus
gatgtcagctacattggtcacagca

SEQ ID NO: 369559 - DNA, 25 bp, Rattus norvegicus
gatgtcagctactttggtcacagca

SEQ ID NO: 369560 - DNA, 25 bp, Rattus norvegicus
gatgtcagctgcaagtctggagctt

SEQ ID NO: 369561 - DNA, 25 bp, Rattus norvegicus
gatgtcagctgctagtctggagctt

SEQ ID NO: 369562 - DNA, 25 bp, Rattus norvegicus
gatgtcagcttcatctgtgcaagcg

SEQ ID NO: 369563 - DNA, 25 bp, Rattus norvegicus
gatgtcagcttcttctgtgcaagcg

SEQ ID NO: 369564 - DNA, 25 bp, Rattus norvegicus
gatgtcagggatatcttcagtgcca

SEQ ID NO: 369565 - DNA, 25 bp, Rattus norvegicus
gatgtcagggatttcttcagtgcca

SEQ ID NO: 369566 - DNA, 25 bp, Rattus norvegicus
gatgtcagtcatctctttgcactga

SEQ ID NO: 369567 - DNA, 25 bp, Rattus norvegicus
gatgtcagtcatgtctttgcactga

SEQ ID NO: 369568 - DNA, 25 bp, Rattus norvegicus
gatgtcagtctgatttctcacaatt

SEQ ID NO: 369569 - DNA, 25 bp, Rattus norvegicus
gatgtcagtctgttttctcacaatt

SEQ ID NO: 369570 - DNA, 25 bp, Rattus norvegicus
gatgtcagtgagaatggatctcaaa

SEQ ID NO: 369571 - DNA, 25 bp, Rattus norvegicus
gatgtcagtgagtatggatctcaaa

SEQ ID NO: 369572 - DNA, 25 bp, Rattus norvegicus
gatgtcagtgttacgcaattgcttt

SEQ ID NO: 369573 - DNA, 25 bp, Rattus norvegicus
gatgtcagtgtttcgcaattgcttt

SEQ ID NO: 369574 - DNA, 25 bp, Rattus norvegicus
gatgtcataattaccgggtgtcacc

SEQ ID NO: 369575 - DNA, 25 bp, Rattus norvegicus
gatgtcataatttccgggtgtcacc

SEQ ID NO: 369576 - DNA, 25 bp, Rattus norvegicus
gatgtcatagtaattggctgccggg

SEQ ID NO: 369577 - DNA, 25 bp, Rattus norvegicus
gatgtcatagtatttggctgccggg

SEQ ID NO: 369578 - DNA, 25 bp, Rattus norvegicus
gatgtcatcaccagggcattacaca

SEQ ID NO: 369579 - DNA, 25 bp, Rattus norvegicus
gatgtcatcacctgggcattacaca

SEQ ID NO: 369580 - DNA, 25 bp, Rattus norvegicus
gatgtcatcagacttatggcctaat

SEQ ID NO: 369581 - DNA, 25 bp, Rattus norvegicus
gatgtcatcagagttatggcctaat

SEQ ID NO: 369582 - DNA, 25 bp, Rattus norvegicus
gatgtcatcatcatgctagtaggaa

SEQ ID NO: 369583 - DNA, 25 bp, Rattus norvegicus
gatgtcatcatcttgctagtaggaa

SEQ ID NO: 369584 - DNA, 25 bp, Rattus norvegicus
gatgtcatcccaacaatgttttggg

SEQ ID NO: 369585 - DNA, 25 bp, Rattus norvegicus
gatgtcatcccacaccacagaaagt

SEQ ID NO: 369586 - DNA, 25 bp, Rattus norvegicus
gatgtcatcccagaccacagaaagt

SEQ ID NO: 369587 - DNA, 25 bp, Rattus norvegicus
gatgtcatcccatcaatgttttggg

SEQ ID NO: 369588 - DNA, 25 bp, Rattus norvegicus
gatgtcatccccactggagagagca

SEQ ID NO: 369589 - DNA, 25 bp, Rattus norvegicus
gatgtcatcccctctggagagagca

SEQ ID NO: 369590 - DNA, 25 bp, Rattus norvegicus
gatgtcatccctcaagatggtgtag

SEQ ID NO: 369591 - DNA, 25 bp, Rattus norvegicus
gatgtcatccctgaagatggtgtag

SEQ ID NO: 369592 - DNA, 25 bp, Rattus norvegicus
gatgtcatcctcataagctgtgcag

SEQ ID NO: 369593 - DNA, 25 bp, Rattus norvegicus
gatgtcatcctcttaagctgtgcag

SEQ ID NO: 369594 - DNA, 25 bp, Rattus norvegicus
gatgtcatctgtatctatgaggctg

SEQ ID NO: 369595 - DNA, 25 bp, Rattus norvegicus
gatgtcatctgtttctatgaggctg

SEQ ID NO: 369596 - DNA, 25 bp, Rattus norvegicus
gatgtcatgaatctcctaggaactc

SEQ ID NO: 369597 - DNA, 25 bp, Rattus norvegicus
gatgtcatgaatgtcctaggaactc

SEQ ID NO: 369598 - DNA, 25 bp, Rattus norvegicus
gatgtcatgatacaccaggcctcag

SEQ ID NO: 369599 - DNA, 25 bp, Rattus norvegicus
gatgtcatgatagaccaggcctcag

SEQ ID NO: 369600 - DNA, 25 bp, Rattus norvegicus
gatgtcatgcctcgaccattagcaa

SEQ ID NO: 369601 - DNA, 25 bp, Rattus norvegicus
gatgtcatgcctggaccattagcaa

SEQ ID NO: 369602 - DNA, 25 bp, Rattus norvegicus
gatgtcatggctcggtacctaactt

SEQ ID NO: 369603 - DNA, 25 bp, Rattus norvegicus
gatgtcatggctgggtacctaactt

SEQ ID NO: 369604 - DNA, 25 bp, Rattus norvegicus
gatgtcatgggaatgggacacacat

SEQ ID NO: 369605 - DNA, 25 bp, Rattus norvegicus
gatgtcatgggattgggacacacat

SEQ ID NO: 369606 - DNA, 25 bp, Rattus norvegicus
gatgtcattatgcaaccccagctgg

SEQ ID NO: 369607 - DNA, 25 bp, Rattus norvegicus
gatgtcattatggaaccccagctgg

SEQ ID NO: 369608 - DNA, 25 bp, Rattus norvegicus
gatgtcattattattccagttggag

SEQ ID NO: 369609 - DNA, 25 bp, Rattus norvegicus
gatgtcattatttttccagttggag

SEQ ID NO: 369610 - DNA, 25 bp, Rattus norvegicus
gatgtcattcctagtgttgccacag

SEQ ID NO: 369611 - DNA, 25 bp, Rattus norvegicus
gatgtcattcctcgtatcagggcaa

SEQ ID NO: 369612 - DNA, 25 bp, Rattus norvegicus
gatgtcattcctggtatcagggcaa

SEQ ID NO: 369613 - DNA, 25 bp, Rattus norvegicus
gatgtcattccttgtgttgccacag

SEQ ID NO: 369614 - DNA, 25 bp, Rattus norvegicus
gatgtcattctgagtgggtttctaa

SEQ ID NO: 369615 - DNA, 25 bp, Rattus norvegicus
gatgtcattctgtgtgggtttctaa

SEQ ID NO: 369616 - DNA, 25 bp, Rattus norvegicus
gatgtcattgctctaccgtttttaa

SEQ ID NO: 369617 - DNA, 25 bp, Rattus norvegicus
gatgtcattgctgtaccgtttttaa

SEQ ID NO: 369618 - DNA, 25 bp, Rattus norvegicus
gatgtcattgggatcctattgctct

SEQ ID NO: 369619 - DNA, 25 bp, Rattus norvegicus
gatgtcattgggttcctattgctct

SEQ ID NO: 369620 - DNA, 25 bp, Rattus norvegicus
gatgtcatttcaatagctcaagcca

SEQ ID NO: 369621 - DNA, 25 bp, Rattus norvegicus
gatgtcatttcacgagataaagtca

SEQ ID NO: 369622 - DNA, 25 bp, Rattus norvegicus
gatgtcatttcaggagataaagtca

SEQ ID NO: 369623 - DNA, 25 bp, Rattus norvegicus
gatgtcatttcattagctcaagcca

SEQ ID NO: 369624 - DNA, 25 bp, Rattus norvegicus
gatgtcatttctcaagctgcagcta

SEQ ID NO: 369625 - DNA, 25 bp, Rattus norvegicus
gatgtcatttctgaagctgcagcta

SEQ ID NO: 369626 - DNA, 25 bp, Rattus norvegicus
gatgtccaacatcagcgggagctgc

SEQ ID NO: 369627 - DNA, 25 bp, Rattus norvegicus
gatgtccaacatgagcgggagctgc

SEQ ID NO: 369628 - DNA, 25 bp, Rattus norvegicus
gatgtccaataaacaacttctgtat

SEQ ID NO: 369629 - DNA, 25 bp, Rattus norvegicus
gatgtccaataatcaacttctgtat

SEQ ID NO: 369630 - DNA, 25 bp, Rattus norvegicus
gatgtccacaccagaaagccaacag

SEQ ID NO: 369631 - DNA, 25 bp, Rattus norvegicus
gatgtccacacctgaaagccaacag

SEQ ID NO: 369632 - DNA, 25 bp, Rattus norvegicus
gatgtccacactacatgaccaatgg

SEQ ID NO: 369633 - DNA, 25 bp, Rattus norvegicus
gatgtccacacttcatgaccaatgg

SEQ ID NO: 369634 - DNA, 25 bp, Rattus norvegicus
gatgtccacaggataatttgttcta

SEQ ID NO: 369635 - DNA, 25 bp, Rattus norvegicus
gatgtccacaggttaatttgttcta

SEQ ID NO: 369636 - DNA, 25 bp, Rattus norvegicus
gatgtccacagtatgcaaggctgcc

SEQ ID NO: 369637 - DNA, 25 bp, Rattus norvegicus
gatgtccacagtttgcaaggctgcc

SEQ ID NO: 369638 - DNA, 25 bp, Rattus norvegicus
gatgtccacatcagggaggtgcctc

SEQ ID NO: 369639 - DNA, 25 bp, Rattus norvegicus
gatgtccacatctgggaggtgcctc

SEQ ID NO: 369640 - DNA, 25 bp, Rattus norvegicus
gatgtccacgaaagactgtttctcc

SEQ ID NO: 369641 - DNA, 25 bp, Rattus norvegicus
gatgtccacgaatgactgtttctcc

SEQ ID NO: 369642 - DNA, 25 bp, Rattus norvegicus
gatgtccacggaaggcatttgctta

SEQ ID NO: 369643 - DNA, 25 bp, Rattus norvegicus
gatgtccacggatggcatttgctta

SEQ ID NO: 369644 - DNA, 25 bp, Rattus norvegicus
gatgtccactgtatcgacgagccac

SEQ ID NO: 369645 - DNA, 25 bp, Rattus norvegicus
gatgtccactgtttcgacgagccac

SEQ ID NO: 369646 - DNA, 25 bp, Rattus norvegicus
gatgtccacttaagtccaattatct

SEQ ID NO: 369647 - DNA, 25 bp, Rattus norvegicus
gatgtccacttatgtccaattatct

SEQ ID NO: 369648 - DNA, 25 bp, Rattus norvegicus
gatgtccagaatccttgtgaacagt

SEQ ID NO: 369649 - DNA, 25 bp, Rattus norvegicus
gatgtccagaatgcttgtgaacagt

SEQ ID NO: 369650 - DNA, 25 bp, Rattus norvegicus
gatgtccagagaaccaagaccagag

SEQ ID NO: 369651 - DNA, 25 bp, Rattus norvegicus
gatgtccagagatccaagaccagag

SEQ ID NO: 369652 - DNA, 25 bp, Rattus norvegicus
gatgtccaggacacagttaaagcat

SEQ ID NO: 369653 - DNA, 25 bp, Rattus norvegicus
gatgtccaggactcagttaaagcat

SEQ ID NO: 369654 - DNA, 25 bp, Rattus norvegicus
gatgtccaggccagacagcggcacc

SEQ ID NO: 369655 - DNA, 25 bp, Rattus norvegicus
gatgtccaggcctgacagcggcacc

SEQ ID NO: 369656 - DNA, 25 bp, Rattus norvegicus
gatgtccatgcccttggcttcttct

SEQ ID NO: 369657 - DNA, 25 bp, Rattus norvegicus
gatgtccatgccgttggcttcttct

SEQ ID NO: 369658 - DNA, 25 bp, Rattus norvegicus
gatgtccatttgatactgtgtttgt

SEQ ID NO: 369659 - DNA, 25 bp, Rattus norvegicus
gatgtccatttgttactgtgtttgt

SEQ ID NO: 369660 - DNA, 25 bp, Rattus norvegicus
gatgtcccaacacgtaaaggcactt

SEQ ID NO: 369661 - DNA, 25 bp, Rattus norvegicus
gatgtcccaacaggtaaaggcactt

SEQ ID NO: 369662 - DNA, 25 bp, Rattus norvegicus
gatgtcccaagaaagctaagccctt

SEQ ID NO: 369663 - DNA, 25 bp, Rattus norvegicus
gatgtcccaagacttgacacggctc

SEQ ID NO: 369664 - DNA, 25 bp, Rattus norvegicus
gatgtcccaagagttgacacggctc

SEQ ID NO: 369665 - DNA, 25 bp, Rattus norvegicus
gatgtcccaagatagctaagccctt

SEQ ID NO: 369666 - DNA, 25 bp, Rattus norvegicus
gatgtccccaatcttatacaggtga

SEQ ID NO: 369667 - DNA, 25 bp, Rattus norvegicus
gatgtccccaatgttatacaggtga

SEQ ID NO: 369668 - DNA, 25 bp, Rattus norvegicus
gatgtccccatgactgtcagtgtat

SEQ ID NO: 369669 - DNA, 25 bp, Rattus norvegicus
gatgtccccatgctgatagcgtgaa

SEQ ID NO: 369670 - DNA, 25 bp, Rattus norvegicus
gatgtccccatggtgatagcgtgaa

SEQ ID NO: 369671 - DNA, 25 bp, Rattus norvegicus
gatgtccccatgtctgtcagtgtat

SEQ ID NO: 369672 - DNA, 25 bp, Rattus norvegicus
gatgtcccctcacagaataccgata

SEQ ID NO: 369673 - DNA, 25 bp, Rattus norvegicus
gatgtcccctcagagaataccgata

SEQ ID NO: 369674 - DNA, 25 bp, Rattus norvegicus
gatgtcccggctccacgtgacggaa

SEQ ID NO: 369675 - DNA, 25 bp, Rattus norvegicus
gatgtcccggctgcacgtgacggaa

SEQ ID NO: 369676 - DNA, 25 bp, Rattus norvegicus
gatgtccctcccctgaaggaaagac

SEQ ID NO: 369677 - DNA, 25 bp, Rattus norvegicus
gatgtccctcccgtgaaggaaagac

SEQ ID NO: 369678 - DNA, 25 bp, Rattus norvegicus
gatgtccctgacacctgagaactgg

SEQ ID NO: 369679 - DNA, 25 bp, Rattus norvegicus
gatgtccctgactcctgagaactgg

SEQ ID NO: 369680 - DNA, 25 bp, Rattus norvegicus
gatgtccctggaagcaacactgtga

SEQ ID NO: 369681 - DNA, 25 bp, Rattus norvegicus
gatgtccctggatgcaacactgtga

SEQ ID NO: 369682 - DNA, 25 bp, Rattus norvegicus
gatgtccgccagaatgttgtcagaa

SEQ ID NO: 369683 - DNA, 25 bp, Rattus norvegicus
gatgtccgccagaggctcatgaaga

SEQ ID NO: 369684 - DNA, 25 bp, Rattus norvegicus
gatgtccgccagtatgttgtcagaa

SEQ ID NO: 369685 - DNA, 25 bp, Rattus norvegicus
gatgtccgccagtggctcatgaaga

SEQ ID NO: 369686 - DNA, 25 bp, Rattus norvegicus
gatgtccgcgcccgacaagcagcag

SEQ ID NO: 369687 - DNA, 25 bp, Rattus norvegicus
gatgtccgcgccggacaagcagcag

SEQ ID NO: 369688 - DNA, 25 bp, Rattus norvegicus
gatgtccgctggagaaagctgttct

SEQ ID NO: 369689 - DNA, 25 bp, Rattus norvegicus
gatgtccgctggtgaaagctgttct

SEQ ID NO: 369690 - DNA, 25 bp, Rattus norvegicus
gatgtccggactcattcgggtgtca

SEQ ID NO: 369691 - DNA, 25 bp, Rattus norvegicus
gatgtccggactgattcgggtgtca

SEQ ID NO: 369692 - DNA, 25 bp, Rattus norvegicus
gatgtccggatgataccatgccatt

SEQ ID NO: 369693 - DNA, 25 bp, Rattus norvegicus
gatgtccggatgttaccatgccatt

SEQ ID NO: 369694 - DNA, 25 bp, Rattus norvegicus
gatgtccgtctcacaaagcaagcag

SEQ ID NO: 369695 - DNA, 25 bp, Rattus norvegicus
gatgtccgtctctcaaagcaagcag

SEQ ID NO: 369696 - DNA, 25 bp, Rattus norvegicus
gatgtcctaaaactaaatgtctgaa

SEQ ID NO: 369697 - DNA, 25 bp, Rattus norvegicus
gatgtcctaaaagtaaatgtctgaa

SEQ ID NO: 369698 - DNA, 25 bp, Rattus norvegicus
gatgtcctaggacctcgccaatgaa

SEQ ID NO: 369699 - DNA, 25 bp, Rattus norvegicus
gatgtcctaggagctcgccaatgaa

SEQ ID NO: 369700 - DNA, 25 bp, Rattus norvegicus
gatgtcctatagatagttacccatg

SEQ ID NO: 369701 - DNA, 25 bp, Rattus norvegicus
gatgtcctatagttagttacccatg

SEQ ID NO: 369702 - DNA, 25 bp, Rattus norvegicus
gatgtcctcataactgcaccgaaag

SEQ ID NO: 369703 - DNA, 25 bp, Rattus norvegicus
gatgtcctcatatctgcaccgaaag

SEQ ID NO: 369704 - DNA, 25 bp, Rattus norvegicus
gatgtcctcgacacaacatgtcaag

SEQ ID NO: 369705 - DNA, 25 bp, Rattus norvegicus
gatgtcctcgactcaacatgtcaag

SEQ ID NO: 369706 - DNA, 25 bp, Rattus norvegicus
gatgtcctctctattacaaggcacg

SEQ ID NO: 369707 - DNA, 25 bp, Rattus norvegicus
gatgtcctctcttttacaaggcacg

SEQ ID NO: 369708 - DNA, 25 bp, Rattus norvegicus
gatgtcctgacacctcctggaacag

SEQ ID NO: 369709 - DNA, 25 bp, Rattus norvegicus
gatgtcctgacagctcctggaacag

SEQ ID NO: 369710 - DNA, 25 bp, Rattus norvegicus
gatgtcctgagccatttttgttttt

SEQ ID NO: 369711 - DNA, 25 bp, Rattus norvegicus
gatgtcctgagcgatttttgttttt

SEQ ID NO: 369712 - DNA, 25 bp, Rattus norvegicus
gatgtcctgcagcaactgacagtgt

SEQ ID NO: 369713 - DNA, 25 bp, Rattus norvegicus
gatgtcctgcaggaactgacagtgt

SEQ ID NO: 369714 - DNA, 25 bp, Rattus norvegicus
gatgtcctggacctaactgatatgg

SEQ ID NO: 369715 - DNA, 25 bp, Rattus norvegicus
gatgtcctggacgtaactgatatgg

SEQ ID NO: 369716 - DNA, 25 bp, Rattus norvegicus
gatgtcctggctatgactcagcaga

SEQ ID NO: 369717 - DNA, 25 bp, Rattus norvegicus
gatgtcctggctttgactcagcaga

SEQ ID NO: 369718 - DNA, 25 bp, Rattus norvegicus
gatgtcctgggaaacctgaccaagg

SEQ ID NO: 369719 - DNA, 25 bp, Rattus norvegicus
gatgtcctgggaccgaaatcctctt

SEQ ID NO: 369720 - DNA, 25 bp, Rattus norvegicus
gatgtcctgggagcgaaatcctctt

SEQ ID NO: 369721 - DNA, 25 bp, Rattus norvegicus
gatgtcctgggatacctgaccaagg

SEQ ID NO: 369722 - DNA, 25 bp, Rattus norvegicus
gatgtcctgtttaatggtggttctt

SEQ ID NO: 369723 - DNA, 25 bp, Rattus norvegicus
gatgtcctgttttatggtggttctt

SEQ ID NO: 369724 - DNA, 25 bp, Rattus norvegicus
gatgtccttaatcattctttctgtc

SEQ ID NO: 369725 - DNA, 25 bp, Rattus norvegicus
gatgtccttaatgattctttctgtc

SEQ ID NO: 369726 - DNA, 25 bp, Rattus norvegicus
gatgtccttacacacttgcttacag

SEQ ID NO: 369727 - DNA, 25 bp, Rattus norvegicus
gatgtccttacagacttgcttacag

SEQ ID NO: 369728 - DNA, 25 bp, Rattus norvegicus
gatgtccttgaaacagtgtgatccc

SEQ ID NO: 369729 - DNA, 25 bp, Rattus norvegicus
gatgtccttgaatcagtgtgatccc

SEQ ID NO: 369730 - DNA, 25 bp, Rattus norvegicus
gatgtccttggaattgcagtttaaa

SEQ ID NO: 369731 - DNA, 25 bp, Rattus norvegicus
gatgtccttggatttgcagtttaaa

SEQ ID NO: 369732 - DNA, 25 bp, Rattus norvegicus
gatgtccttggtactgaatgcagct

SEQ ID NO: 369733 - DNA, 25 bp, Rattus norvegicus
gatgtccttggttctgaatgcagct

SEQ ID NO: 369734 - DNA, 25 bp, Rattus norvegicus
gatgtcctttggactaccgggagga

SEQ ID NO: 369735 - DNA, 25 bp, Rattus norvegicus
gatgtcctttggtctaccgggagga

SEQ ID NO: 369736 - DNA, 25 bp, Rattus norvegicus
gatgtcgaaccacaccaaggactgg

SEQ ID NO: 369737 - DNA, 25 bp, Rattus norvegicus
gatgtcgaaccagaccaaggactgg

SEQ ID NO: 369738 - DNA, 25 bp, Rattus norvegicus
gatgtcgaattaatgccgattctaa

SEQ ID NO: 369739 - DNA, 25 bp, Rattus norvegicus
gatgtcgaattattgccgattctaa

SEQ ID NO: 369740 - DNA, 25 bp, Rattus norvegicus
gatgtcgaccatccagaagttttga

SEQ ID NO: 369741 - DNA, 25 bp, Rattus norvegicus
gatgtcgaccatgcagaagttttga

SEQ ID NO: 369742 - DNA, 25 bp, Rattus norvegicus
gatgtcgagcccagtgttaacacca

SEQ ID NO: 369743 - DNA, 25 bp, Rattus norvegicus
gatgtcgagccctgtgttaacacca

SEQ ID NO: 369744 - DNA, 25 bp, Rattus norvegicus
gatgtcgagctgagttccttttaag

SEQ ID NO: 369745 - DNA, 25 bp, Rattus norvegicus
gatgtcgagctgtgttccttttaag

SEQ ID NO: 369746 - DNA, 25 bp, Rattus norvegicus
gatgtcgagggtctttcacacatga

SEQ ID NO: 369747 - DNA, 25 bp, Rattus norvegicus
gatgtcgagggtgtttcacacatga

SEQ ID NO: 369748 - DNA, 25 bp, Rattus norvegicus
gatgtcgcaccacactgtgagtgtt

SEQ ID NO: 369749 - DNA, 25 bp, Rattus norvegicus
gatgtcgcaccagactgtgagtgtt

SEQ ID NO: 369750 - DNA, 25 bp, Rattus norvegicus
gatgtcgcaggtaagccttggcaat

SEQ ID NO: 369751 - DNA, 25 bp, Rattus norvegicus
gatgtcgcaggttagccttggcaat

SEQ ID NO: 369752 - DNA, 25 bp, Rattus norvegicus
gatgtcgccccaacctgaatgtgtg

SEQ ID NO: 369753 - DNA, 25 bp, Rattus norvegicus
gatgtcgccccatcctgaatgtgtg

SEQ ID NO: 369754 - DNA, 25 bp, Rattus norvegicus
gatgtcggtcctaggatttgcagcc

SEQ ID NO: 369755 - DNA, 25 bp, Rattus norvegicus
gatgtcggtccttggatttgcagcc

SEQ ID NO: 369756 - DNA, 25 bp, Rattus norvegicus
gatgtcgtaagccagaccgagtccc

SEQ ID NO: 369757 - DNA, 25 bp, Rattus norvegicus
gatgtcgtaagcgagaccgagtccc

SEQ ID NO: 369758 - DNA, 25 bp, Rattus norvegicus
gatgtcgtccctaattgtcctgttc

SEQ ID NO: 369759 - DNA, 25 bp, Rattus norvegicus
gatgtcgtcccttattgtcctgttc

SEQ ID NO: 369760 - DNA, 25 bp, Rattus norvegicus
gatgtcgttactatgttgccttcca

SEQ ID NO: 369761 - DNA, 25 bp, Rattus norvegicus
gatgtcgttactttgttgccttcca

SEQ ID NO: 369762 - DNA, 25 bp, Rattus norvegicus
gatgtcgttagaaaagccacaacca

SEQ ID NO: 369763 - DNA, 25 bp, Rattus norvegicus
gatgtcgttagataagccacaacca

SEQ ID NO: 369764 - DNA, 25 bp, Rattus norvegicus
gatgtctacaaaccacaactcttaa

SEQ ID NO: 369765 - DNA, 25 bp, Rattus norvegicus
gatgtctacaaagcacaactcttaa

SEQ ID NO: 369766 - DNA, 25 bp, Rattus norvegicus
gatgtctacacgcaactgccaggga

SEQ ID NO: 369767 - DNA, 25 bp, Rattus norvegicus
gatgtctacacggaactgccaggga

SEQ ID NO: 369768 - DNA, 25 bp, Rattus norvegicus
gatgtctacctcagatcaggtgagg

SEQ ID NO: 369769 - DNA, 25 bp, Rattus norvegicus
gatgtctacctctgatcaggtgagg

SEQ ID NO: 369770 - DNA, 25 bp, Rattus norvegicus
gatgtctacttcattgctaccctgt

SEQ ID NO: 369771 - DNA, 25 bp, Rattus norvegicus
gatgtctacttctttgctaccctgt

SEQ ID NO: 369772 - DNA, 25 bp, Rattus norvegicus
gatgtctacttgagccccagggtga

SEQ ID NO: 369773 - DNA, 25 bp, Rattus norvegicus
gatgtctacttgtgccccagggtga

SEQ ID NO: 369774 - DNA, 25 bp, Rattus norvegicus
gatgtctagccaatttgcttttcaa

SEQ ID NO: 369775 - DNA, 25 bp, Rattus norvegicus
gatgtctagccattttgcttttcaa

SEQ ID NO: 369776 - DNA, 25 bp, Rattus norvegicus
gatgtctatattactgttaccaccc

SEQ ID NO: 369777 - DNA, 25 bp, Rattus norvegicus
gatgtctatatttctgttaccaccc

SEQ ID NO: 369778 - DNA, 25 bp, Rattus norvegicus
gatgtctatctgcttgtggttgtca

SEQ ID NO: 369779 - DNA, 25 bp, Rattus norvegicus
gatgtctatctggttgtggttgtca

SEQ ID NO: 369780 - DNA, 25 bp, Rattus norvegicus
gatgtctattttaaagttctcactt

SEQ ID NO: 369781 - DNA, 25 bp, Rattus norvegicus
gatgtctatttttaagttctcactt

SEQ ID NO: 369782 - DNA, 25 bp, Rattus norvegicus
gatgtctcagaccttagaagccttg

SEQ ID NO: 369783 - DNA, 25 bp, Rattus norvegicus
gatgtctcagacgttagaagccttg

SEQ ID NO: 369784 - DNA, 25 bp, Rattus norvegicus
gatgtctcagcgaggcccaggctgc

SEQ ID NO: 369785 - DNA, 25 bp, Rattus norvegicus
gatgtctcagcgtggcccaggctgc

SEQ ID NO: 369786 - DNA, 25 bp, Rattus norvegicus
gatgtctcagctagatgtgttcttc

SEQ ID NO: 369787 - DNA, 25 bp, Rattus norvegicus
gatgtctcagcttgatgtgttcttc

SEQ ID NO: 369788 - DNA, 25 bp, Rattus norvegicus
gatgtctcatctcacagctccatga

SEQ ID NO: 369789 - DNA, 25 bp, Rattus norvegicus
gatgtctcatctgacagctccatga

SEQ ID NO: 369790 - DNA, 25 bp, Rattus norvegicus
gatgtctcatgtagtttatccattt

SEQ ID NO: 369791 - DNA, 25 bp, Rattus norvegicus
gatgtctcatgttgtttatccattt

SEQ ID NO: 369792 - DNA, 25 bp, Rattus norvegicus
gatgtctccaatatgctgtaaccct

SEQ ID NO: 369793 - DNA, 25 bp, Rattus norvegicus
gatgtctccaatttgctgtaaccct

SEQ ID NO: 369794 - DNA, 25 bp, Rattus norvegicus
gatgtctcccatcaatatgtggata

SEQ ID NO: 369795 - DNA, 25 bp, Rattus norvegicus
gatgtctcccatgaatatgtggata

SEQ ID NO: 369796 - DNA, 25 bp, Rattus norvegicus
gatgtctcctggaagaaagagtact

SEQ ID NO: 369797 - DNA, 25 bp, Rattus norvegicus
gatgtctcctggtagaaagagtact

SEQ ID NO: 369798 - DNA, 25 bp, Rattus norvegicus
gatgtctcggcaataatccgtttat

SEQ ID NO: 369799 - DNA, 25 bp, Rattus norvegicus
gatgtctcggcattaatccgtttat

SEQ ID NO: 369800 - DNA, 25 bp, Rattus norvegicus
gatgtctcggtcctttgtgttatac

SEQ ID NO: 369801 - DNA, 25 bp, Rattus norvegicus
gatgtctcggtcgtttgtgttatac

SEQ ID NO: 369802 - DNA, 25 bp, Rattus norvegicus
gatgtctcgtttattctggtatatt

SEQ ID NO: 369803 - DNA, 25 bp, Rattus norvegicus
gatgtctcgttttttctggtatatt

SEQ ID NO: 369804 - DNA, 25 bp, Rattus norvegicus
gatgtctctaagaacccagacctga

SEQ ID NO: 369805 - DNA, 25 bp, Rattus norvegicus
gatgtctctaagtacccagacctga

SEQ ID NO: 369806 - DNA, 25 bp, Rattus norvegicus
gatgtctctaatcgtggtactaccc

SEQ ID NO: 369807 - DNA, 25 bp, Rattus norvegicus
gatgtctctaatggtggtactaccc

SEQ ID NO: 369808 - DNA, 25 bp, Rattus norvegicus
gatgtctctgagaaagtcgaacctt

SEQ ID NO: 369809 - DNA, 25 bp, Rattus norvegicus
gatgtctctgagactgctcacacat

SEQ ID NO: 369810 - DNA, 25 bp, Rattus norvegicus
gatgtctctgagatccagaccatct

SEQ ID NO: 369811 - DNA, 25 bp, Rattus norvegicus
gatgtctctgagtaagtcgaacctt

SEQ ID NO: 369812 - DNA, 25 bp, Rattus norvegicus
gatgtctctgagtctgctcacacat

SEQ ID NO: 369813 - DNA, 25 bp, Rattus norvegicus
gatgtctctgagttccagaccatct

SEQ ID NO: 369814 - DNA, 25 bp, Rattus norvegicus
gatgtctctgtgactatttttattt

SEQ ID NO: 369815 - DNA, 25 bp, Rattus norvegicus
gatgtctctgtgtctatttttattt

SEQ ID NO: 369816 - DNA, 25 bp, Rattus norvegicus
gatgtctgaagaactacttttcctg

SEQ ID NO: 369817 - DNA, 25 bp, Rattus norvegicus
gatgtctgaagatctacttttcctg

SEQ ID NO: 369818 - DNA, 25 bp, Rattus norvegicus
gatgtctgaatactcatttctccag

SEQ ID NO: 369819 - DNA, 25 bp, Rattus norvegicus
gatgtctgaatagtcatttctccag

SEQ ID NO: 369820 - DNA, 25 bp, Rattus norvegicus
gatgtctgacaccaacgaaggctta

SEQ ID NO: 369821 - DNA, 25 bp, Rattus norvegicus
gatgtctgacacgaacgaaggctta

SEQ ID NO: 369822 - DNA, 25 bp, Rattus norvegicus
gatgtctgagaacacgtcatgcggt

SEQ ID NO: 369823 - DNA, 25 bp, Rattus norvegicus
gatgtctgagaagacgtcatgcggt

SEQ ID NO: 369824 - DNA, 25 bp, Rattus norvegicus
gatgtctgagatcaacggaatccat

SEQ ID NO: 369825 - DNA, 25 bp, Rattus norvegicus
gatgtctgagatgaacggaatccat

SEQ ID NO: 369826 - DNA, 25 bp, Rattus norvegicus
gatgtctgaggacagcaagcttaaa

SEQ ID NO: 369827 - DNA, 25 bp, Rattus norvegicus
gatgtctgaggagagcaagcttaaa

SEQ ID NO: 369828 - DNA, 25 bp, Rattus norvegicus
gatgtctgaggtcttccattttagt

SEQ ID NO: 369829 - DNA, 25 bp, Rattus norvegicus
gatgtctgaggtgttccattttagt

SEQ ID NO: 369830 - DNA, 25 bp, Rattus norvegicus
gatgtctgagtgactttctggctga

SEQ ID NO: 369831 - DNA, 25 bp, Rattus norvegicus
gatgtctgagtgtctttctggctga

SEQ ID NO: 369832 - DNA, 25 bp, Rattus norvegicus
gatgtctgcaaacactatgctggac

SEQ ID NO: 369833 - DNA, 25 bp, Rattus norvegicus
gatgtctgcaaagactatgctggac

SEQ ID NO: 369834 - DNA, 25 bp, Rattus norvegicus
gatgtctgcaagcaccatggctaag

SEQ ID NO: 369835 - DNA, 25 bp, Rattus norvegicus
gatgtctgcaaggaccatggctaag

SEQ ID NO: 369836 - DNA, 25 bp, Rattus norvegicus
gatgtctgcagacctgaagtcactt

SEQ ID NO: 369837 - DNA, 25 bp, Rattus norvegicus
gatgtctgcagagctgaagtcactt

SEQ ID NO: 369838 - DNA, 25 bp, Rattus norvegicus
gatgtctgccaaagaactcacttgt

SEQ ID NO: 369839 - DNA, 25 bp, Rattus norvegicus
gatgtctgccaatgaactcacttgt

SEQ ID NO: 369840 - DNA, 25 bp, Rattus norvegicus
gatgtctgctaaattctatccctct

SEQ ID NO: 369841 - DNA, 25 bp, Rattus norvegicus
gatgtctgctaatttctatccctct

SEQ ID NO: 369842 - DNA, 25 bp, Rattus norvegicus
gatgtctgctctatcccgggaaggg

SEQ ID NO: 369843 - DNA, 25 bp, Rattus norvegicus
gatgtctgctctttcccgggaaggg

SEQ ID NO: 369844 - DNA, 25 bp, Rattus norvegicus
gatgtctggcctaataaactgcaca

SEQ ID NO: 369845 - DNA, 25 bp, Rattus norvegicus
gatgtctggccttataaactgcaca

SEQ ID NO: 369846 - DNA, 25 bp, Rattus norvegicus
gatgtctgggccagagacagattca

SEQ ID NO: 369847 - DNA, 25 bp, Rattus norvegicus
gatgtctgggcctgagacagattca

SEQ ID NO: 369848 - DNA, 25 bp, Rattus norvegicus
gatgtctggtcacggtggtatctcc

SEQ ID NO: 369849 - DNA, 25 bp, Rattus norvegicus
gatgtctggtcagggtggtatctcc

SEQ ID NO: 369850 - DNA, 25 bp, Rattus norvegicus
gatgtctgtaacctacgtctgccat

SEQ ID NO: 369851 - DNA, 25 bp, Rattus norvegicus
gatgtctgtaacgtacgtctgccat

SEQ ID NO: 369852 - DNA, 25 bp, Rattus norvegicus
gatgtctgtatcacataggccaagg

SEQ ID NO: 369853 - DNA, 25 bp, Rattus norvegicus
gatgtctgtatctcataggccaagg

SEQ ID NO: 369854 - DNA, 25 bp, Rattus norvegicus
gatgtctgtcatattgcactcacca

SEQ ID NO: 369855 - DNA, 25 bp, Rattus norvegicus
gatgtctgtcattttgcactcacca

SEQ ID NO: 369856 - DNA, 25 bp, Rattus norvegicus
gatgtctgtgtcaatagccatggat

SEQ ID NO: 369857 - DNA, 25 bp, Rattus norvegicus
gatgtctgtgtctatagccatggat

SEQ ID NO: 369858 - DNA, 25 bp, Rattus norvegicus
gatgtctgtgttatactggcttgga

SEQ ID NO: 369859 - DNA, 25 bp, Rattus norvegicus
gatgtctgtgttttactggcttgga

SEQ ID NO: 369860 - DNA, 25 bp, Rattus norvegicus
gatgtctgttccaaaatggctccaa

SEQ ID NO: 369861 - DNA, 25 bp, Rattus norvegicus
gatgtctgttcctaaatggctccaa

SEQ ID NO: 369862 - DNA, 25 bp, Rattus norvegicus
gatgtctgttttcgtgatcagcctc

SEQ ID NO: 369863 - DNA, 25 bp, Rattus norvegicus
gatgtctgttttggtgatcagcctc

SEQ ID NO: 369864 - DNA, 25 bp, Rattus norvegicus
gatgtcttaattccctcaaatcatg

SEQ ID NO: 369865 - DNA, 25 bp, Rattus norvegicus
gatgtcttaattgcctcaaatcatg

SEQ ID NO: 369866 - DNA, 25 bp, Rattus norvegicus
gatgtcttaggcattgctcagctaa

SEQ ID NO: 369867 - DNA, 25 bp, Rattus norvegicus
gatgtcttaggctttgctcagctaa

SEQ ID NO: 369868 - DNA, 25 bp, Rattus norvegicus
gatgtcttctgcctgttatataact

SEQ ID NO: 369869 - DNA, 25 bp, Rattus norvegicus
gatgtcttctgcgtgttatataact

SEQ ID NO: 369870 - DNA, 25 bp, Rattus norvegicus
gatgtcttctggaattgcagtgact

SEQ ID NO: 369871 - DNA, 25 bp, Rattus norvegicus
gatgtcttctggtattgcagtgact

SEQ ID NO: 369872 - DNA, 25 bp, Rattus norvegicus
gatgtcttcttcaccagtgtactat

SEQ ID NO: 369873 - DNA, 25 bp, Rattus norvegicus
gatgtcttcttctccagtgtactat

SEQ ID NO: 369874 - DNA, 25 bp, Rattus norvegicus
gatgtcttgaaaactcgatctcctg

SEQ ID NO: 369875 - DNA, 25 bp, Rattus norvegicus
gatgtcttgaaatctcgatctcctg

SEQ ID NO: 369876 - DNA, 25 bp, Rattus norvegicus
gatgtcttgttacctctagtccaaa

SEQ ID NO: 369877 - DNA, 25 bp, Rattus norvegicus
gatgtcttgttagctctagtccaaa

SEQ ID NO: 369878 - DNA, 25 bp, Rattus norvegicus
gatgtctttcctccttgtctgtaag

SEQ ID NO: 369879 - DNA, 25 bp, Rattus norvegicus
gatgtctttcctctgtgtaaccaga

SEQ ID NO: 369880 - DNA, 25 bp, Rattus norvegicus
gatgtctttcctgcttgtctgtaag

SEQ ID NO: 369881 - DNA, 25 bp, Rattus norvegicus
gatgtctttcctgtgtgtaaccaga

SEQ ID NO: 369882 - DNA, 25 bp, Rattus norvegicus
gatgtctttctcagccgacatgaga

SEQ ID NO: 369883 - DNA, 25 bp, Rattus norvegicus
gatgtctttctctgccgacatgaga

SEQ ID NO: 369884 - DNA, 25 bp, Rattus norvegicus
gatgtcttttctctaagattacagg

SEQ ID NO: 369885 - DNA, 25 bp, Rattus norvegicus
gatgtcttttctgtaagattacagg

SEQ ID NO: 369886 - DNA, 25 bp, Rattus norvegicus
gatgtgaaaactaccaacctggact

SEQ ID NO: 369887 - DNA, 25 bp, Rattus norvegicus
gatgtgaaaacttccaacctggact

SEQ ID NO: 369888 - DNA, 25 bp, Rattus norvegicus
gatgtgaaaatgaaagcgccttgaa

SEQ ID NO: 369889 - DNA, 25 bp, Rattus norvegicus
gatgtgaaaatgtaagcgccttgaa

SEQ ID NO: 369890 - DNA, 25 bp, Rattus norvegicus
gatgtgaaacctaatattgtctttg

SEQ ID NO: 369891 - DNA, 25 bp, Rattus norvegicus
gatgtgaaaccttatattgtctttg

SEQ ID NO: 369892 - DNA, 25 bp, Rattus norvegicus
gatgtgaaagatccccagcaggctc

SEQ ID NO: 369893 - DNA, 25 bp, Rattus norvegicus
gatgtgaaagatgcccagcaggctc

SEQ ID NO: 369894 - DNA, 25 bp, Rattus norvegicus
gatgtgaaatgtctctcagtgccaa

SEQ ID NO: 369895 - DNA, 25 bp, Rattus norvegicus
gatgtgaaatgtgtctcagtgccaa

SEQ ID NO: 369896 - DNA, 25 bp, Rattus norvegicus
gatgtgaacggacttgccaccagac

SEQ ID NO: 369897 - DNA, 25 bp, Rattus norvegicus
gatgtgaacggagttgccaccagac

SEQ ID NO: 369898 - DNA, 25 bp, Rattus norvegicus
gatgtgaacttcaatcctgaccctg

SEQ ID NO: 369899 - DNA, 25 bp, Rattus norvegicus
gatgtgaacttctatcctgaccctg

SEQ ID NO: 369900 - DNA, 25 bp, Rattus norvegicus
gatgtgaacttgcttttctcgtaaa

SEQ ID NO: 369901 - DNA, 25 bp, Rattus norvegicus
gatgtgaacttggttttctcgtaaa

SEQ ID NO: 369902 - DNA, 25 bp, Rattus norvegicus
gatgtgaagaacctcccagatgatg

SEQ ID NO: 369903 - DNA, 25 bp, Rattus norvegicus
gatgtgaagaacgtcccagatgatg

SEQ ID NO: 369904 - DNA, 25 bp, Rattus norvegicus
gatgtgaagcatactgttccgacaa

SEQ ID NO: 369905 - DNA, 25 bp, Rattus norvegicus
gatgtgaagcattctgttccgacaa

SEQ ID NO: 369906 - DNA, 25 bp, Rattus norvegicus
gatgtgaagccccactgtgttctcc

SEQ ID NO: 369907 - DNA, 25 bp, Rattus norvegicus
gatgtgaagcccgactgtgttctcc

SEQ ID NO: 369908 - DNA, 25 bp, Rattus norvegicus
gatgtgaagcttcccagaatgcata

SEQ ID NO: 369909 - DNA, 25 bp, Rattus norvegicus
gatgtgaagcttgccagaatgcata

SEQ ID NO: 369910 - DNA, 25 bp, Rattus norvegicus
gatgtgaagtcaagctgcctgcagt

SEQ ID NO: 369911 - DNA, 25 bp, Rattus norvegicus
gatgtgaagtcatgctgcctgcagt

SEQ ID NO: 369912 - DNA, 25 bp, Rattus norvegicus
gatgtgaatgccaactgcttacaat

SEQ ID NO: 369913 - DNA, 25 bp, Rattus norvegicus
gatgtgaatgcctactgcttacaat

SEQ ID NO: 369914 - DNA, 25 bp, Rattus norvegicus
gatgtgaatggaccggaacccctca

SEQ ID NO: 369915 - DNA, 25 bp, Rattus norvegicus
gatgtgaatggagcggaacccctca

SEQ ID NO: 369916 - DNA, 25 bp, Rattus norvegicus
gatgtgacacaaaggcacggagccc

SEQ ID NO: 369917 - DNA, 25 bp, Rattus norvegicus
gatgtgacacaatggcacggagccc

SEQ ID NO: 369918 - DNA, 25 bp, Rattus norvegicus
gatgtgacagtactggatgccaccc

SEQ ID NO: 369919 - DNA, 25 bp, Rattus norvegicus
gatgtgacagtagtggatgccaccc

SEQ ID NO: 369920 - DNA, 25 bp, Rattus norvegicus
gatgtgacatggacttgctggccca

SEQ ID NO: 369921 - DNA, 25 bp, Rattus norvegicus
gatgtgacatggtcttgctggccca

SEQ ID NO: 369922 - DNA, 25 bp, Rattus norvegicus
gatgtgaccattcaccatatttacc

SEQ ID NO: 369923 - DNA, 25 bp, Rattus norvegicus
gatgtgaccattgaccatatttacc

SEQ ID NO: 369924 - DNA, 25 bp, Rattus norvegicus
gatgtgacccatccacagcaagggt

SEQ ID NO: 369925 - DNA, 25 bp, Rattus norvegicus
gatgtgacccatgcacagcaagggt

SEQ ID NO: 369926 - DNA, 25 bp, Rattus norvegicus
gatgtgacctaccagcgtgtaagca

SEQ ID NO: 369927 - DNA, 25 bp, Rattus norvegicus
gatgtgacctacgagcgtgtaagca

SEQ ID NO: 369928 - DNA, 25 bp, Rattus norvegicus
gatgtgacctgcctcatactcataa

SEQ ID NO: 369929 - DNA, 25 bp, Rattus norvegicus
gatgtgacctgcgtcatactcataa

SEQ ID NO: 369930 - DNA, 25 bp, Rattus norvegicus
gatgtgactactacagctttgtgaa

SEQ ID NO: 369931 - DNA, 25 bp, Rattus norvegicus
gatgtgactacttcagctttgtgaa

SEQ ID NO: 369932 - DNA, 25 bp, Rattus norvegicus
gatgtgactcgaccggtagagcact

SEQ ID NO: 369933 - DNA, 25 bp, Rattus norvegicus
gatgtgactcgagcggtagagcact

SEQ ID NO: 369934 - DNA, 25 bp, Rattus norvegicus
gatgtgactggaaggcttagcctca

SEQ ID NO: 369935 - DNA, 25 bp, Rattus norvegicus
gatgtgactggatggcttagcctca

SEQ ID NO: 369936 - DNA, 25 bp, Rattus norvegicus
gatgtgacttaactgaagagccctt

SEQ ID NO: 369937 - DNA, 25 bp, Rattus norvegicus
gatgtgacttaagtgaagagccctt

SEQ ID NO: 369938 - DNA, 25 bp, Rattus norvegicus
gatgtgacttgtacattcaacctga

SEQ ID NO: 369939 - DNA, 25 bp, Rattus norvegicus
gatgtgacttgttcattcaacctga

SEQ ID NO: 369940 - DNA, 25 bp, Rattus norvegicus
gatgtgactttgatgttacctcaga

SEQ ID NO: 369941 - DNA, 25 bp, Rattus norvegicus
gatgtgactttgttgttacctcaga

SEQ ID NO: 369942 - DNA, 25 bp, Rattus norvegicus
gatgtgacttttcagcttacagcaa

SEQ ID NO: 369943 - DNA, 25 bp, Rattus norvegicus
gatgtgacttttgagcttacagcaa

SEQ ID NO: 369944 - DNA, 25 bp, Rattus norvegicus
gatgtgagacatcttcagactgcct

SEQ ID NO: 369945 - DNA, 25 bp, Rattus norvegicus
gatgtgagacatgttcagactgcct

SEQ ID NO: 369946 - DNA, 25 bp, Rattus norvegicus
gatgtgagactgaccaaggctctac

SEQ ID NO: 369947 - DNA, 25 bp, Rattus norvegicus
gatgtgagactgtccaaggctctac

SEQ ID NO: 369948 - DNA, 25 bp, Rattus norvegicus
gatgtgagcccactatgggctctca

SEQ ID NO: 369949 - DNA, 25 bp, Rattus norvegicus
gatgtgagcccagtatgggctctca

SEQ ID NO: 369950 - DNA, 25 bp, Rattus norvegicus
gatgtgagcttgattctttccagag

SEQ ID NO: 369951 - DNA, 25 bp, Rattus norvegicus
gatgtgagcttgtttctttccagag

SEQ ID NO: 369952 - DNA, 25 bp, Rattus norvegicus
gatgtgagtcatccggattatccac

SEQ ID NO: 369953 - DNA, 25 bp, Rattus norvegicus
gatgtgagtcatgcggattatccac

SEQ ID NO: 369954 - DNA, 25 bp, Rattus norvegicus
gatgtgatatacacagcctgtgctt

SEQ ID NO: 369955 - DNA, 25 bp, Rattus norvegicus
gatgtgatatactcagcctgtgctt

SEQ ID NO: 369956 - DNA, 25 bp, Rattus norvegicus
gatgtgatatgtcatttccccttcc

SEQ ID NO: 369957 - DNA, 25 bp, Rattus norvegicus
gatgtgatatgtgatttccccttcc

SEQ ID NO: 369958 - DNA, 25 bp, Rattus norvegicus
gatgtgatcataattgcttttagca

SEQ ID NO: 369959 - DNA, 25 bp, Rattus norvegicus
gatgtgatcatatttgcttttagca

SEQ ID NO: 369960 - DNA, 25 bp, Rattus norvegicus
gatgtgatcgacaggtactcattct

SEQ ID NO: 369961 - DNA, 25 bp, Rattus norvegicus
gatgtgatcgactggtactcattct

SEQ ID NO: 369962 - DNA, 25 bp, Rattus norvegicus
gatgtgatctaaattcctcctagct

SEQ ID NO: 369963 - DNA, 25 bp, Rattus norvegicus
gatgtgatctaatttcctcctagct

SEQ ID NO: 369964 - DNA, 25 bp, Rattus norvegicus
gatgtgatctctataggcctgggcc

SEQ ID NO: 369965 - DNA, 25 bp, Rattus norvegicus
gatgtgatctctttaggcctgggcc

SEQ ID NO: 369966 - DNA, 25 bp, Rattus norvegicus
gatgtgatgatcagcgcaggcgcta

SEQ ID NO: 369967 - DNA, 25 bp, Rattus norvegicus
gatgtgatgatctgcgcaggcgcta

SEQ ID NO: 369968 - DNA, 25 bp, Rattus norvegicus
gatgtgatggacatttgtttggcca

SEQ ID NO: 369969 - DNA, 25 bp, Rattus norvegicus
gatgtgatggacttttgtttggcca

SEQ ID NO: 369970 - DNA, 25 bp, Rattus norvegicus
gatgtgatgtcgattctgtttgtcc

SEQ ID NO: 369971 - DNA, 25 bp, Rattus norvegicus
gatgtgatgtcgtttctgtttgtcc

SEQ ID NO: 369972 - DNA, 25 bp, Rattus norvegicus
gatgtgatgtggcttctgcttatta

SEQ ID NO: 369973 - DNA, 25 bp, Rattus norvegicus
gatgtgatgtgggttctgcttatta

SEQ ID NO: 369974 - DNA, 25 bp, Rattus norvegicus
gatgtgattaaaaccaaccctttca

SEQ ID NO: 369975 - DNA, 25 bp, Rattus norvegicus
gatgtgattaaatccaaccctttca

SEQ ID NO: 369976 - DNA, 25 bp, Rattus norvegicus
gatgtgattgatccggtaaaacttg

SEQ ID NO: 369977 - DNA, 25 bp, Rattus norvegicus
gatgtgattgatgcggtaaaacttg

SEQ ID NO: 369978 - DNA, 25 bp, Rattus norvegicus
gatgtgatttgtattctctgaatct

SEQ ID NO: 369979 - DNA, 25 bp, Rattus norvegicus
gatgtgatttgttttctctgaatct

SEQ ID NO: 369980 - DNA, 25 bp, Rattus norvegicus
gatgtgattttcacgttgctcaaaa

SEQ ID NO: 369981 - DNA, 25 bp, Rattus norvegicus
gatgtgattttctcgttgctcaaaa

SEQ ID NO: 369982 - DNA, 25 bp, Rattus norvegicus
gatgtgcaactaaattcgcttacta

SEQ ID NO: 369983 - DNA, 25 bp, Rattus norvegicus
gatgtgcaactatattcgcttacta

SEQ ID NO: 369984 - DNA, 25 bp, Rattus norvegicus
gatgtgcaatagcatgagccccgct

SEQ ID NO: 369985 - DNA, 25 bp, Rattus norvegicus
gatgtgcaataggatgagccccgct

SEQ ID NO: 369986 - DNA, 25 bp, Rattus norvegicus
gatgtgcaatatccttggcgaccat

SEQ ID NO: 369987 - DNA, 25 bp, Rattus norvegicus
gatgtgcaatatgcttggcgaccat

SEQ ID NO: 369988 - DNA, 25 bp, Rattus norvegicus
gatgtgcaccacaagcagcttatgc

SEQ ID NO: 369989 - DNA, 25 bp, Rattus norvegicus
gatgtgcaccactagcagcttatgc

SEQ ID NO: 369990 - DNA, 25 bp, Rattus norvegicus
gatgtgcactacagctcaccataat

SEQ ID NO: 369991 - DNA, 25 bp, Rattus norvegicus
gatgtgcactactgctcaccataat

SEQ ID NO: 369992 - DNA, 25 bp, Rattus norvegicus
gatgtgcagtccaacaccagatggc

SEQ ID NO: 369993 - DNA, 25 bp, Rattus norvegicus
gatgtgcagtcctacaccagatggc

SEQ ID NO: 369994 - DNA, 25 bp, Rattus norvegicus
gatgtgcagtgcatttgactatctt

SEQ ID NO: 369995 - DNA, 25 bp, Rattus norvegicus
gatgtgcagtgcttttgactatctt

SEQ ID NO: 369996 - DNA, 25 bp, Rattus norvegicus
gatgtgcataaaatgccttctcaat

SEQ ID NO: 369997 - DNA, 25 bp, Rattus norvegicus
gatgtgcataaattgccttctcaat

SEQ ID NO: 369998 - DNA, 25 bp, Rattus norvegicus
gatgtgcatatcaactttactcggg

SEQ ID NO: 369999 - DNA, 25 bp, Rattus norvegicus
gatgtgcatatctactttactcggg

SEQ ID NO: 370000 - DNA, 25 bp, Rattus norvegicus
gatgtgcatgcaagtttaccgtaac

SEQ ID NO: 370001 - DNA, 25 bp, Rattus norvegicus
gatgtgcatgcatgtttaccgtaac

SEQ ID NO: 370002 - DNA, 25 bp, Rattus norvegicus
gatgtgccaaacatattctcacaga

SEQ ID NO: 370003 - DNA, 25 bp, Rattus norvegicus
gatgtgccaaacttattctcacaga

SEQ ID NO: 370004 - DNA, 25 bp, Rattus norvegicus
gatgtgccacaaaccactcatgaag

SEQ ID NO: 370005 - DNA, 25 bp, Rattus norvegicus
gatgtgccacaatccactcatgaag

SEQ ID NO: 370006 - DNA, 25 bp, Rattus norvegicus
gatgtgccacgtcgaccacttggtt

SEQ ID NO: 370007 - DNA, 25 bp, Rattus norvegicus
gatgtgccacgtggaccacttggtt

SEQ ID NO: 370008 - DNA, 25 bp, Rattus norvegicus
gatgtgccatacacagagggccaac

SEQ ID NO: 370009 - DNA, 25 bp, Rattus norvegicus
gatgtgccatactcagagggccaac

SEQ ID NO: 370010 - DNA, 25 bp, Rattus norvegicus
gatgtgcccatcatcgccatggaga

SEQ ID NO: 370011 - DNA, 25 bp, Rattus norvegicus
gatgtgcccatcttcgccatggaga

SEQ ID NO: 370012 - DNA, 25 bp, Rattus norvegicus
gatgtgcccatgcatctgaactgca

SEQ ID NO: 370013 - DNA, 25 bp, Rattus norvegicus
gatgtgcccatggatctgaactgca

SEQ ID NO: 370014 - DNA, 25 bp, Rattus norvegicus
gatgtgccctgaagtccaatgtgac

SEQ ID NO: 370015 - DNA, 25 bp, Rattus norvegicus
gatgtgccctgatgtccaatgtgac

SEQ ID NO: 370016 - DNA, 25 bp, Rattus norvegicus
gatgtgccgatccttgtcaagatga

SEQ ID NO: 370017 - DNA, 25 bp, Rattus norvegicus
gatgtgccgatcgttgtcaagatga

SEQ ID NO: 370018 - DNA, 25 bp, Rattus norvegicus
gatgtgcctaatagctggatgcctc

SEQ ID NO: 370019 - DNA, 25 bp, Rattus norvegicus
gatgtgcctaattgctggatgcctc

SEQ ID NO: 370020 - DNA, 25 bp, Rattus norvegicus
gatgtgcctagtcctaatgggatta

SEQ ID NO: 370021 - DNA, 25 bp, Rattus norvegicus
gatgtgcctagtgctaatgggatta

SEQ ID NO: 370022 - DNA, 25 bp, Rattus norvegicus
gatgtgcctcatatagtacctccag

SEQ ID NO: 370023 - DNA, 25 bp, Rattus norvegicus
gatgtgcctcatttagtacctccag

SEQ ID NO: 370024 - DNA, 25 bp, Rattus norvegicus
gatgtgcctgagaaccaagcctgag

SEQ ID NO: 370025 - DNA, 25 bp, Rattus norvegicus
gatgtgcctgagtaccaagcctgag

SEQ ID NO: 370026 - DNA, 25 bp, Rattus norvegicus
gatgtgccttctccatatgaagtca

SEQ ID NO: 370027 - DNA, 25 bp, Rattus norvegicus
gatgtgccttctgcatatgaagtca

SEQ ID NO: 370028 - DNA, 25 bp, Rattus norvegicus
gatgtgcctttaacctctaatgccc

SEQ ID NO: 370029 - DNA, 25 bp, Rattus norvegicus
gatgtgcctttatcctctaatgccc

SEQ ID NO: 370030 - DNA, 25 bp, Rattus norvegicus
gatgtgcgccacacaagagaaggct

SEQ ID NO: 370031 - DNA, 25 bp, Rattus norvegicus
gatgtgcgccactcaagagaaggct

SEQ ID NO: 370032 - DNA, 25 bp, Rattus norvegicus
gatgtgcgccagatcaccagagaaa

SEQ ID NO: 370033 - DNA, 25 bp, Rattus norvegicus
gatgtgcgccagttcaccagagaaa

SEQ ID NO: 370034 - DNA, 25 bp, Rattus norvegicus
gatgtgctaactacaccgacttcac

SEQ ID NO: 370035 - DNA, 25 bp, Rattus norvegicus
gatgtgctaacttcaccgacttcac

SEQ ID NO: 370036 - DNA, 25 bp, Rattus norvegicus
gatgtgctacaactttctaggctga

SEQ ID NO: 370037 - DNA, 25 bp, Rattus norvegicus
gatgtgctacaagtttctaggctga

SEQ ID NO: 370038 - DNA, 25 bp, Rattus norvegicus
gatgtgctacttacccctttctagt

SEQ ID NO: 370039 - DNA, 25 bp, Rattus norvegicus
gatgtgctactttcccctttctagt

SEQ ID NO: 370040 - DNA, 25 bp, Rattus norvegicus
gatgtgctagatccgtgtatgtctt

SEQ ID NO: 370041 - DNA, 25 bp, Rattus norvegicus
gatgtgctagatgcgtgtatgtctt

SEQ ID NO: 370042 - DNA, 25 bp, Rattus norvegicus
gatgtgctaggcaagtcctctgtca

SEQ ID NO: 370043 - DNA, 25 bp, Rattus norvegicus
gatgtgctaggctagtcctctgtca

SEQ ID NO: 370044 - DNA, 25 bp, Rattus norvegicus
gatgtgctagtccaactcgtgggat

SEQ ID NO: 370045 - DNA, 25 bp, Rattus norvegicus
gatgtgctagtcgaactcgtgggat

SEQ ID NO: 370046 - DNA, 25 bp, Rattus norvegicus
gatgtgctcaatacacgtgagaaca

SEQ ID NO: 370047 - DNA, 25 bp, Rattus norvegicus
gatgtgctcaattcacgtgagaaca

SEQ ID NO: 370048 - DNA, 25 bp, Rattus norvegicus
gatgtgctcagtctaacttccacca

SEQ ID NO: 370049 - DNA, 25 bp, Rattus norvegicus
gatgtgctcagtgtaacttccacca

SEQ ID NO: 370050 - DNA, 25 bp, Rattus norvegicus
gatgtgctgatgagtcaccctgaga

SEQ ID NO: 370051 - DNA, 25 bp, Rattus norvegicus
gatgtgctgatgtgtcaccctgaga

SEQ ID NO: 370052 - DNA, 25 bp, Rattus norvegicus
gatgtgctgctgataaggagccact

SEQ ID NO: 370053 - DNA, 25 bp, Rattus norvegicus
gatgtgctgctgttaaggagccact

SEQ ID NO: 370054 - DNA, 25 bp, Rattus norvegicus
gatgtgctgggaaaccggagttaca

SEQ ID NO: 370055 - DNA, 25 bp, Rattus norvegicus
gatgtgctgggataccggagttaca

SEQ ID NO: 370056 - DNA, 25 bp, Rattus norvegicus
gatgtgctgtgccatgtcactgtcc

SEQ ID NO: 370057 - DNA, 25 bp, Rattus norvegicus
gatgtgctgtgcgatgtcactgtcc

SEQ ID NO: 370058 - DNA, 25 bp, Rattus norvegicus
gatgtgcttaccaaaaacgcctttc

SEQ ID NO: 370059 - DNA, 25 bp, Rattus norvegicus
gatgtgcttacctaaaacgcctttc

SEQ ID NO: 370060 - DNA, 25 bp, Rattus norvegicus
gatgtgcttccccagcagattgacg

SEQ ID NO: 370061 - DNA, 25 bp, Rattus norvegicus
gatgtgcttcccgagcagattgacg

SEQ ID NO: 370062 - DNA, 25 bp, Rattus norvegicus
gatgtgctttgtctgctattatcct

SEQ ID NO: 370063 - DNA, 25 bp, Rattus norvegicus
gatgtgctttgtgtgctattatcct

SEQ ID NO: 370064 - DNA, 25 bp, Rattus norvegicus
gatgtgcttttgaaagcgcagcctt

SEQ ID NO: 370065 - DNA, 25 bp, Rattus norvegicus
gatgtgcttttgtaagcgcagcctt

SEQ ID NO: 370066 - DNA, 25 bp, Rattus norvegicus
gatgtggaaaatccttccttccttt

SEQ ID NO: 370067 - DNA, 25 bp, Rattus norvegicus
gatgtggaaaatgcttccttccttt

SEQ ID NO: 370068 - DNA, 25 bp, Rattus norvegicus
gatgtggaagatccgcctagccaga

SEQ ID NO: 370069 - DNA, 25 bp, Rattus norvegicus
gatgtggaagatgcgcctagccaga

SEQ ID NO: 370070 - DNA, 25 bp, Rattus norvegicus
gatgtggaattaccttttgtctgca

SEQ ID NO: 370071 - DNA, 25 bp, Rattus norvegicus
gatgtggaattagcttttgtctgca

SEQ ID NO: 370072 - DNA, 25 bp, Rattus norvegicus
gatgtggacacaccactctcaaagg

SEQ ID NO: 370073 - DNA, 25 bp, Rattus norvegicus
gatgtggacacagcactctcaaagg

SEQ ID NO: 370074 - DNA, 25 bp, Rattus norvegicus
gatgtggaccctcaactgtgattgc

SEQ ID NO: 370075 - DNA, 25 bp, Rattus norvegicus
gatgtggaccctgaactgtgattgc

SEQ ID NO: 370076 - DNA, 25 bp, Rattus norvegicus
gatgtggaccgaactcgcttagagc

SEQ ID NO: 370077 - DNA, 25 bp, Rattus norvegicus
gatgtggaccgatctcgcttagagc

SEQ ID NO: 370078 - DNA, 25 bp, Rattus norvegicus
gatgtggacgatcctccagggaaca

SEQ ID NO: 370079 - DNA, 25 bp, Rattus norvegicus
gatgtggacgatgctccagggaaca

SEQ ID NO: 370080 - DNA, 25 bp, Rattus norvegicus
gatgtggactcaacctgcgtgctgg

SEQ ID NO: 370081 - DNA, 25 bp, Rattus norvegicus
gatgtggactcatcctgcgtgctgg

SEQ ID NO: 370082 - DNA, 25 bp, Rattus norvegicus
gatgtggagcagatggcgttctaca

SEQ ID NO: 370083 - DNA, 25 bp, Rattus norvegicus
gatgtggagcagttggcgttctaca

SEQ ID NO: 370084 - DNA, 25 bp, Rattus norvegicus
gatgtggagctgattttcaccgtaa

SEQ ID NO: 370085 - DNA, 25 bp, Rattus norvegicus
gatgtggagctgtttttcaccgtaa

SEQ ID NO: 370086 - DNA, 25 bp, Rattus norvegicus
gatgtggagcttctaaaactggaat

SEQ ID NO: 370087 - DNA, 25 bp, Rattus norvegicus
gatgtggagcttgtaaaactggaat

SEQ ID NO: 370088 - DNA, 25 bp, Rattus norvegicus
gatgtggaggctagcggctccacca

SEQ ID NO: 370089 - DNA, 25 bp, Rattus norvegicus
gatgtggaggcttgcggctccacca

SEQ ID NO: 370090 - DNA, 25 bp, Rattus norvegicus
gatgtggatcaaatgctcaggcctg

SEQ ID NO: 370091 - DNA, 25 bp, Rattus norvegicus
gatgtggatcaattgctcaggcctg

SEQ ID NO: 370092 - DNA, 25 bp, Rattus norvegicus
gatgtggatcagcaagcaggagtac

SEQ ID NO: 370093 - DNA, 25 bp, Rattus norvegicus
gatgtggatcaggaagcaggagtac

SEQ ID NO: 370094 - DNA, 25 bp, Rattus norvegicus
gatgtggattagaaacagagcagca

SEQ ID NO: 370095 - DNA, 25 bp, Rattus norvegicus
gatgtggattagtaacagagcagca

SEQ ID NO: 370096 - DNA, 25 bp, Rattus norvegicus
gatgtggcatctctgggctaagacc

SEQ ID NO: 370097 - DNA, 25 bp, Rattus norvegicus
gatgtggcatctgtgggctaagacc

SEQ ID NO: 370098 - DNA, 25 bp, Rattus norvegicus
gatgtggcatttcactgactactga

SEQ ID NO: 370099 - DNA, 25 bp, Rattus norvegicus
gatgtggcatttgactgactactga

SEQ ID NO: 370100 - DNA, 25 bp, Rattus norvegicus
gatgtggccacgcatacagcctcta

SEQ ID NO: 370101 - DNA, 25 bp, Rattus norvegicus
gatgtggccacggatacagcctcta

SEQ ID NO: 370102 - DNA, 25 bp, Rattus norvegicus
gatgtggccactcggcgtcttgcac

SEQ ID NO: 370103 - DNA, 25 bp, Rattus norvegicus
gatgtggccactgggcgtcttgcac

SEQ ID NO: 370104 - DNA, 25 bp, Rattus norvegicus
gatgtggccatcactgactgttagg

SEQ ID NO: 370105 - DNA, 25 bp, Rattus norvegicus
gatgtggccatctctgactgttagg

SEQ ID NO: 370106 - DNA, 25 bp, Rattus norvegicus
gatgtggcccagaacccatcaaata

SEQ ID NO: 370107 - DNA, 25 bp, Rattus norvegicus
gatgtggcccagtacccatcaaata

SEQ ID NO: 370108 - DNA, 25 bp, Rattus norvegicus
gatgtggccgccctggccgggaggc

SEQ ID NO: 370109 - DNA, 25 bp, Rattus norvegicus
gatgtggccgccgtggccgggaggc

SEQ ID NO: 370110 - DNA, 25 bp, Rattus norvegicus
gatgtggcggcaacgggtccttcca

SEQ ID NO: 370111 - DNA, 25 bp, Rattus norvegicus
gatgtggcggcatcgggtccttcca

SEQ ID NO: 370112 - DNA, 25 bp, Rattus norvegicus
gatgtggcggccagttatgccaacc

SEQ ID NO: 370113 - DNA, 25 bp, Rattus norvegicus
gatgtggcggcctgttatgccaacc

SEQ ID NO: 370114 - DNA, 25 bp, Rattus norvegicus
gatgtggctaggctgtctctgctca

SEQ ID NO: 370115 - DNA, 25 bp, Rattus norvegicus
gatgtggctagggtgtctctgctca

SEQ ID NO: 370116 - DNA, 25 bp, Rattus norvegicus
gatgtggctcacaggtaaagcgttt

SEQ ID NO: 370117 - DNA, 25 bp, Rattus norvegicus
gatgtggctcactggtaaagcgttt

SEQ ID NO: 370118 - DNA, 25 bp, Rattus norvegicus
gatgtggctccaatggtagaacaac

SEQ ID NO: 370119 - DNA, 25 bp, Rattus norvegicus
gatgtggctccattggtagaacaac

SEQ ID NO: 370120 - DNA, 25 bp, Rattus norvegicus
gatgtggctctcaaacttgtactaa

SEQ ID NO: 370121 - DNA, 25 bp, Rattus norvegicus
gatgtggctctctaacttgtactaa

SEQ ID NO: 370122 - DNA, 25 bp, Rattus norvegicus
gatgtggctggacggattgaagata

SEQ ID NO: 370123 - DNA, 25 bp, Rattus norvegicus
gatgtggctggagggattgaagata

SEQ ID NO: 370124 - DNA, 25 bp, Rattus norvegicus
gatgtgggacataaacaggttttaa

SEQ ID NO: 370125 - DNA, 25 bp, Rattus norvegicus
gatgtgggacattaacaggttttaa

SEQ ID NO: 370126 - DNA, 25 bp, Rattus norvegicus
gatgtgggagccatggcatttgctc

SEQ ID NO: 370127 - DNA, 25 bp, Rattus norvegicus
gatgtgggagccttggcatttgctc

SEQ ID NO: 370128 - DNA, 25 bp, Rattus norvegicus
gatgtgggatagaccgcctttgaac

SEQ ID NO: 370129 - DNA, 25 bp, Rattus norvegicus
gatgtgggatagtccgcctttgaac

SEQ ID NO: 370130 - DNA, 25 bp, Rattus norvegicus
gatgtgggccacactggatataaat

SEQ ID NO: 370131 - DNA, 25 bp, Rattus norvegicus
gatgtgggccactctggatataaat

SEQ ID NO: 370132 - DNA, 25 bp, Rattus norvegicus
gatgtgggctcactaccagagccag

SEQ ID NO: 370133 - DNA, 25 bp, Rattus norvegicus
gatgtgggctcagtaccagagccag

SEQ ID NO: 370134 - DNA, 25 bp, Rattus norvegicus
gatgtgggcttgctgattttcttca

SEQ ID NO: 370135 - DNA, 25 bp, Rattus norvegicus
gatgtgggcttggtgattttcttca

SEQ ID NO: 370136 - DNA, 25 bp, Rattus norvegicus
gatgtgggtcccaaactccaaaatc

SEQ ID NO: 370137 - DNA, 25 bp, Rattus norvegicus
gatgtgggtccctaactccaaaatc

SEQ ID NO: 370138 - DNA, 25 bp, Rattus norvegicus
gatgtgggtcgaaatcaggtgtcct

SEQ ID NO: 370139 - DNA, 25 bp, Rattus norvegicus
gatgtgggtcgatatcaggtgtcct

SEQ ID NO: 370140 - DNA, 25 bp, Rattus norvegicus
gatgtgggtctgatcgcaattcggt

SEQ ID NO: 370141 - DNA, 25 bp, Rattus norvegicus
gatgtgggtctgttcgcaattcggt

SEQ ID NO: 370142 - DNA, 25 bp, Rattus norvegicus
gatgtgggtgatcattgcctcttaa

SEQ ID NO: 370143 - DNA, 25 bp, Rattus norvegicus
gatgtgggtgatgattgcctcttaa

SEQ ID NO: 370144 - DNA, 25 bp, Rattus norvegicus
gatgtgggtttactttacagctgca

SEQ ID NO: 370145 - DNA, 25 bp, Rattus norvegicus
gatgtgggtttagtttacagctgca

SEQ ID NO: 370146 - DNA, 25 bp, Rattus norvegicus
gatgtggtaaatccctcatgtcctt

SEQ ID NO: 370147 - DNA, 25 bp, Rattus norvegicus
gatgtggtaaatgcctcatgtcctt

SEQ ID NO: 370148 - DNA, 25 bp, Rattus norvegicus
gatgtggtacagaatcctacactaa

SEQ ID NO: 370149 - DNA, 25 bp, Rattus norvegicus
gatgtggtacagtatcctacactaa

SEQ ID NO: 370150 - DNA, 25 bp, Rattus norvegicus
gatgtggtagccaatatgtaacctt

SEQ ID NO: 370151 - DNA, 25 bp, Rattus norvegicus
gatgtggtagcctatatgtaacctt

SEQ ID NO: 370152 - DNA, 25 bp, Rattus norvegicus
gatgtggtagtgatcacctttaatc

SEQ ID NO: 370153 - DNA, 25 bp, Rattus norvegicus
gatgtggtagtgttcacctttaatc

SEQ ID NO: 370154 - DNA, 25 bp, Rattus norvegicus
gatgtggtgatgatcccacgggctc

SEQ ID NO: 370155 - DNA, 25 bp, Rattus norvegicus
gatgtggtgatgttcccacgggctc

SEQ ID NO: 370156 - DNA, 25 bp, Rattus norvegicus
gatgtggtgctcatccttgagctag

SEQ ID NO: 370157 - DNA, 25 bp, Rattus norvegicus
gatgtggtgctcttccttgagctag

SEQ ID NO: 370158 - DNA, 25 bp, Rattus norvegicus
gatgtggtgctgcagcacactttcg

SEQ ID NO: 370159 - DNA, 25 bp, Rattus norvegicus
gatgtggtgctggagcacactttcg

SEQ ID NO: 370160 - DNA, 25 bp, Rattus norvegicus
gatgtggtggcaatttcccagagaa

SEQ ID NO: 370161 - DNA, 25 bp, Rattus norvegicus
gatgtggtggcattttcccagagaa

SEQ ID NO: 370162 - DNA, 25 bp, Rattus norvegicus
gatgtggtggctctatccttcaaat

SEQ ID NO: 370163 - DNA, 25 bp, Rattus norvegicus
gatgtggtggctgtatccttcaaat

SEQ ID NO: 370164 - DNA, 25 bp, Rattus norvegicus
gatgtggttactagtgtcacctgta

SEQ ID NO: 370165 - DNA, 25 bp, Rattus norvegicus
gatgtggttacttgtgtcacctgta

SEQ ID NO: 370166 - DNA, 25 bp, Rattus norvegicus
gatgtggttagcaccctgataacaa

SEQ ID NO: 370167 - DNA, 25 bp, Rattus norvegicus
gatgtggttagctccctgataacaa

SEQ ID NO: 370168 - DNA, 25 bp, Rattus norvegicus
gatgtggttctccttgggtgtccca

SEQ ID NO: 370169 - DNA, 25 bp, Rattus norvegicus
gatgtggttctcgttgggtgtccca

SEQ ID NO: 370170 - DNA, 25 bp, Rattus norvegicus
gatgtggttcttcctagattctatg

SEQ ID NO: 370171 - DNA, 25 bp, Rattus norvegicus
gatgtggttcttgctagattctatg

SEQ ID NO: 370172 - DNA, 25 bp, Rattus norvegicus
gatgtggttgctctcttcaggaaca

SEQ ID NO: 370173 - DNA, 25 bp, Rattus norvegicus
gatgtggttgctgtcttcaggaaca

SEQ ID NO: 370174 - DNA, 25 bp, Rattus norvegicus
gatgtggtttctccttagttcgagt

SEQ ID NO: 370175 - DNA, 25 bp, Rattus norvegicus
gatgtggtttctgcttagttcgagt

SEQ ID NO: 370176 - DNA, 25 bp, Rattus norvegicus
gatgtggtttgacgttgccctcaca

SEQ ID NO: 370177 - DNA, 25 bp, Rattus norvegicus
gatgtggtttgaggttgccctcaca

SEQ ID NO: 370178 - DNA, 25 bp, Rattus norvegicus
gatgtgtaaatgctttctccctcat

SEQ ID NO: 370179 - DNA, 25 bp, Rattus norvegicus
gatgtgtaaatggtttctccctcat

SEQ ID NO: 370180 - DNA, 25 bp, Rattus norvegicus
gatgtgtaacatactgtaatccgca

SEQ ID NO: 370181 - DNA, 25 bp, Rattus norvegicus
gatgtgtaacattctgtaatccgca

SEQ ID NO: 370182 - DNA, 25 bp, Rattus norvegicus
gatgtgtacagaaaactctgttcat

SEQ ID NO: 370183 - DNA, 25 bp, Rattus norvegicus
gatgtgtacagataactctgttcat

SEQ ID NO: 370184 - DNA, 25 bp, Rattus norvegicus
gatgtgtaccagctgacttcatttt

SEQ ID NO: 370185 - DNA, 25 bp, Rattus norvegicus
gatgtgtaccaggtgacttcatttt

SEQ ID NO: 370186 - DNA, 25 bp, Rattus norvegicus
gatgtgtaccatactgtgtgctcca

SEQ ID NO: 370187 - DNA, 25 bp, Rattus norvegicus
gatgtgtaccattctgtgtgctcca

SEQ ID NO: 370188 - DNA, 25 bp, Rattus norvegicus
gatgtgtactacaaggtccgtcctt

SEQ ID NO: 370189 - DNA, 25 bp, Rattus norvegicus
gatgtgtactactaggtccgtcctt

SEQ ID NO: 370190 - DNA, 25 bp, Rattus norvegicus
gatgtgtactcaatatctagcagaa

SEQ ID NO: 370191 - DNA, 25 bp, Rattus norvegicus
gatgtgtactcattatctagcagaa

SEQ ID NO: 370192 - DNA, 25 bp, Rattus norvegicus
gatgtgtagaagctcttcaagcatt

SEQ ID NO: 370193 - DNA, 25 bp, Rattus norvegicus
gatgtgtagaaggtcttcaagcatt

SEQ ID NO: 370194 - DNA, 25 bp, Rattus norvegicus
gatgtgtagagccagtccacccaga

SEQ ID NO: 370195 - DNA, 25 bp, Rattus norvegicus
gatgtgtagagcgagtccacccaga

SEQ ID NO: 370196 - DNA, 25 bp, Rattus norvegicus
gatgtgtagatgactcgtgtctcca

SEQ ID NO: 370197 - DNA, 25 bp, Rattus norvegicus
gatgtgtagatgtctcgtgtctcca

SEQ ID NO: 370198 - DNA, 25 bp, Rattus norvegicus
gatgtgtagccaacagcactaacat

SEQ ID NO: 370199 - DNA, 25 bp, Rattus norvegicus
gatgtgtagccatcagcactaacat

SEQ ID NO: 370200 - DNA, 25 bp, Rattus norvegicus
gatgtgtagtacataattcttaggg

SEQ ID NO: 370201 - DNA, 25 bp, Rattus norvegicus
gatgtgtagtacttaattcttaggg

SEQ ID NO: 370202 - DNA, 25 bp, Rattus norvegicus
gatgtgtatattacccagttgaaag

SEQ ID NO: 370203 - DNA, 25 bp, Rattus norvegicus
gatgtgtatatttcccagttgaaag

SEQ ID NO: 370204 - DNA, 25 bp, Rattus norvegicus
gatgtgtatgttataacttcctctt

SEQ ID NO: 370205 - DNA, 25 bp, Rattus norvegicus
gatgtgtatgttttaacttcctctt

SEQ ID NO: 370206 - DNA, 25 bp, Rattus norvegicus
gatgtgtattaactgccaccaataa

SEQ ID NO: 370207 - DNA, 25 bp, Rattus norvegicus
gatgtgtattaagtgccaccaataa

SEQ ID NO: 370208 - DNA, 25 bp, Rattus norvegicus
gatgtgtattccaatccttcataac

SEQ ID NO: 370209 - DNA, 25 bp, Rattus norvegicus
gatgtgtattcctatccttcataac

SEQ ID NO: 370210 - DNA, 25 bp, Rattus norvegicus
gatgtgtcaagaactaccacccagt

SEQ ID NO: 370211 - DNA, 25 bp, Rattus norvegicus
gatgtgtcaagatctaccacccagt

SEQ ID NO: 370212 - DNA, 25 bp, Rattus norvegicus
gatgtgtcaatcatttgccttacaa

SEQ ID NO: 370213 - DNA, 25 bp, Rattus norvegicus
gatgtgtcaatcttttgccttacaa

SEQ ID NO: 370214 - DNA, 25 bp, Rattus norvegicus
gatgtgtcactcagttttctagttg

SEQ ID NO: 370215 - DNA, 25 bp, Rattus norvegicus
gatgtgtcactctgttttctagttg

SEQ ID NO: 370216 - DNA, 25 bp, Rattus norvegicus
gatgtgtcatttcaggcctttttag

SEQ ID NO: 370217 - DNA, 25 bp, Rattus norvegicus
gatgtgtcatttgaggcctttttag

SEQ ID NO: 370218 - DNA, 25 bp, Rattus norvegicus
gatgtgtccattaacttttctccag

SEQ ID NO: 370219 - DNA, 25 bp, Rattus norvegicus
gatgtgtccatttacttttctccag

SEQ ID NO: 370220 - DNA, 25 bp, Rattus norvegicus
gatgtgtccccaaatgtcatgttaa

SEQ ID NO: 370221 - DNA, 25 bp, Rattus norvegicus
gatgtgtccccatatgtcatgttaa

SEQ ID NO: 370222 - DNA, 25 bp, Rattus norvegicus
gatgtgtccgataagaaccgcttac

SEQ ID NO: 370223 - DNA, 25 bp, Rattus norvegicus
gatgtgtccgattagaaccgcttac

SEQ ID NO: 370224 - DNA, 25 bp, Rattus norvegicus
gatgtgtctaagatggccaagcatt

SEQ ID NO: 370225 - DNA, 25 bp, Rattus norvegicus
gatgtgtctaagttggccaagcatt

SEQ ID NO: 370226 - DNA, 25 bp, Rattus norvegicus
gatgtgtctcctattgggacctaaa

SEQ ID NO: 370227 - DNA, 25 bp, Rattus norvegicus
gatgtgtctccttttgggacctaaa

SEQ ID NO: 370228 - DNA, 25 bp, Rattus norvegicus
gatgtgtctctgactacgaaatgaa

SEQ ID NO: 370229 - DNA, 25 bp, Rattus norvegicus
gatgtgtctctgtctacgaaatgaa

SEQ ID NO: 370230 - DNA, 25 bp, Rattus norvegicus
gatgtgtctgacactactggcagat

SEQ ID NO: 370231 - DNA, 25 bp, Rattus norvegicus
gatgtgtctgactctactggcagat

SEQ ID NO: 370232 - DNA, 25 bp, Rattus norvegicus
gatgtgtctgggacactgagcctca

SEQ ID NO: 370233 - DNA, 25 bp, Rattus norvegicus
gatgtgtctgggtcactgagcctca

SEQ ID NO: 370234 - DNA, 25 bp, Rattus norvegicus
gatgtgtcttatattttcctgtaat

SEQ ID NO: 370235 - DNA, 25 bp, Rattus norvegicus
gatgtgtcttattttttcctgtaat

SEQ ID NO: 370236 - DNA, 25 bp, Rattus norvegicus
gatgtgtcttgaatatctctaataa

SEQ ID NO: 370237 - DNA, 25 bp, Rattus norvegicus
gatgtgtcttgattatctctaataa

SEQ ID NO: 370238 - DNA, 25 bp, Rattus norvegicus
gatgtgtgaaggctctaatcaataa

SEQ ID NO: 370239 - DNA, 25 bp, Rattus norvegicus
gatgtgtgaagggtctaatcaataa

SEQ ID NO: 370240 - DNA, 25 bp, Rattus norvegicus
gatgtgtgacctaattctaggaaac

SEQ ID NO: 370241 - DNA, 25 bp, Rattus norvegicus
gatgtgtgaccttattctaggaaac

SEQ ID NO: 370242 - DNA, 25 bp, Rattus norvegicus
gatgtgtgataaaccttcttagaat

SEQ ID NO: 370243 - DNA, 25 bp, Rattus norvegicus
gatgtgtgataatccttcttagaat

SEQ ID NO: 370244 - DNA, 25 bp, Rattus norvegicus
gatgtgtgcatgcagttttcccagc

SEQ ID NO: 370245 - DNA, 25 bp, Rattus norvegicus
gatgtgtgcatggagttttcccagc

SEQ ID NO: 370246 - DNA, 25 bp, Rattus norvegicus
gatgtgtgcattcatgtaacggaaa

SEQ ID NO: 370247 - DNA, 25 bp, Rattus norvegicus
gatgtgtgcattgatgtaacggaaa

SEQ ID NO: 370248 - DNA, 25 bp, Rattus norvegicus
gatgtgtgccacaggtgtgtgcact

SEQ ID NO: 370249 - DNA, 25 bp, Rattus norvegicus
gatgtgtgccactggtgtgtgcact

SEQ ID NO: 370250 - DNA, 25 bp, Rattus norvegicus
gatgtgtgcctaccatcacaagcct

SEQ ID NO: 370251 - DNA, 25 bp, Rattus norvegicus
gatgtgtgcctagcatcacaagcct

SEQ ID NO: 370252 - DNA, 25 bp, Rattus norvegicus
gatgtgtgctgtattatccataaag

SEQ ID NO: 370253 - DNA, 25 bp, Rattus norvegicus
gatgtgtgctgttttatccataaag

SEQ ID NO: 370254 - DNA, 25 bp, Rattus norvegicus
gatgtgtggagcagtcagtgacctc

SEQ ID NO: 370255 - DNA, 25 bp, Rattus norvegicus
gatgtgtggagctgtcagtgacctc

SEQ ID NO: 370256 - DNA, 25 bp, Rattus norvegicus
gatgtgtggcctcgcctggtcccac

SEQ ID NO: 370257 - DNA, 25 bp, Rattus norvegicus
gatgtgtggcctggcctggtcccac

SEQ ID NO: 370258 - DNA, 25 bp, Rattus norvegicus
gatgtgtgggaaccctcaccattac

SEQ ID NO: 370259 - DNA, 25 bp, Rattus norvegicus
gatgtgtgggaagcctcaccattac

SEQ ID NO: 370260 - DNA, 25 bp, Rattus norvegicus
gatgtgtgggccacaactctggcag

SEQ ID NO: 370261 - DNA, 25 bp, Rattus norvegicus
gatgtgtgggcctcaactctggcag

SEQ ID NO: 370262 - DNA, 25 bp, Rattus norvegicus
gatgtgtggtctattattctgtaat

SEQ ID NO: 370263 - DNA, 25 bp, Rattus norvegicus
gatgtgtggtctctatggttttata

SEQ ID NO: 370264 - DNA, 25 bp, Rattus norvegicus
gatgtgtggtctgtatggttttata

SEQ ID NO: 370265 - DNA, 25 bp, Rattus norvegicus
gatgtgtggtcttttattctgtaat

SEQ ID NO: 370266 - DNA, 25 bp, Rattus norvegicus
gatgtgtgtacactgcaaccaaggc

SEQ ID NO: 370267 - DNA, 25 bp, Rattus norvegicus
gatgtgtgtacagtgcaaccaaggc

SEQ ID NO: 370268 - DNA, 25 bp, Rattus norvegicus
gatgtgtgtactatgccaggctcca

SEQ ID NO: 370269 - DNA, 25 bp, Rattus norvegicus
gatgtgtgtactttgccaggctcca

SEQ ID NO: 370270 - DNA, 25 bp, Rattus norvegicus
gatgtgtgtcacctggtaacagcct

SEQ ID NO: 370271 - DNA, 25 bp, Rattus norvegicus
gatgtgtgtcacgtggtaacagcct

SEQ ID NO: 370272 - DNA, 25 bp, Rattus norvegicus
gatgtgtgtcccatgaccacttaag

SEQ ID NO: 370273 - DNA, 25 bp, Rattus norvegicus
gatgtgtgtcccttgaccacttaag

SEQ ID NO: 370274 - DNA, 25 bp, Rattus norvegicus
gatgtgtgtgatactccttgtaagt

SEQ ID NO: 370275 - DNA, 25 bp, Rattus norvegicus
gatgtgtgtgattctccttgtaagt

SEQ ID NO: 370276 - DNA, 25 bp, Rattus norvegicus
gatgtgttaactatgcttgtatatt

SEQ ID NO: 370277 - DNA, 25 bp, Rattus norvegicus
gatgtgttaactttgcttgtatatt

SEQ ID NO: 370278 - DNA, 25 bp, Rattus norvegicus
gatgtgttcaaaatacggaactggt

SEQ ID NO: 370279 - DNA, 25 bp, Rattus norvegicus
gatgtgttcaaattacggaactggt

SEQ ID NO: 370280 - DNA, 25 bp, Rattus norvegicus
gatgtgttcagcacacctgttacct

SEQ ID NO: 370281 - DNA, 25 bp, Rattus norvegicus
gatgtgttcagctcacctgttacct

SEQ ID NO: 370282 - DNA, 25 bp, Rattus norvegicus
gatgtgttcaggacgcatgtacata

SEQ ID NO: 370283 - DNA, 25 bp, Rattus norvegicus
gatgtgttcaggtcgcatgtacata

SEQ ID NO: 370284 - DNA, 25 bp, Rattus norvegicus
gatgtgttccaaatgtttgcaggtt

SEQ ID NO: 370285 - DNA, 25 bp, Rattus norvegicus
gatgtgttccaattgtttgcaggtt

SEQ ID NO: 370286 - DNA, 25 bp, Rattus norvegicus
gatgtgttccacagctgctgaaata

SEQ ID NO: 370287 - DNA, 25 bp, Rattus norvegicus
gatgtgttccactgctgctgaaata

SEQ ID NO: 370288 - DNA, 25 bp, Rattus norvegicus
gatgtgttctgactaccttttccct

SEQ ID NO: 370289 - DNA, 25 bp, Rattus norvegicus
gatgtgttctgagtaccttttccct

SEQ ID NO: 370290 - DNA, 25 bp, Rattus norvegicus
gatgtgttctgcctaatgaagtcca

SEQ ID NO: 370291 - DNA, 25 bp, Rattus norvegicus
gatgtgttctgcgtaatgaagtcca

SEQ ID NO: 370292 - DNA, 25 bp, Rattus norvegicus
gatgtgttctgtaagcaccagctgt

SEQ ID NO: 370293 - DNA, 25 bp, Rattus norvegicus
gatgtgttctgttagcaccagctgt

SEQ ID NO: 370294 - DNA, 25 bp, Rattus norvegicus
gatgtgttgacaattatgcctgttg

SEQ ID NO: 370295 - DNA, 25 bp, Rattus norvegicus
gatgtgttgacatttatgcctgttg

SEQ ID NO: 370296 - DNA, 25 bp, Rattus norvegicus
gatgtgttgatcctgtgctctgctt

SEQ ID NO: 370297 - DNA, 25 bp, Rattus norvegicus
gatgtgttgatcgtgtgctctgctt

SEQ ID NO: 370298 - DNA, 25 bp, Rattus norvegicus
gatgtgttgcttcatgaaccgccgc

SEQ ID NO: 370299 - DNA, 25 bp, Rattus norvegicus
gatgtgttgcttgatgaaccgccgc

SEQ ID NO: 370300 - DNA, 25 bp, Rattus norvegicus
gatgtgtttatcaagccgcagctgt

SEQ ID NO: 370301 - DNA, 25 bp, Rattus norvegicus
gatgtgtttatctagccgcagctgt

SEQ ID NO: 370302 - DNA, 25 bp, Rattus norvegicus
gatgtgtttcataacagctcactaa

SEQ ID NO: 370303 - DNA, 25 bp, Rattus norvegicus
gatgtgtttcattacagctcactaa

SEQ ID NO: 370304 - DNA, 25 bp, Rattus norvegicus
gatgtgtttcccagtgtgctgcaga

SEQ ID NO: 370305 - DNA, 25 bp, Rattus norvegicus
gatgtgtttccctgtgtgctgcaga

SEQ ID NO: 370306 - DNA, 25 bp, Rattus norvegicus
gatgtgtttcgcatagactcagatt

SEQ ID NO: 370307 - DNA, 25 bp, Rattus norvegicus
gatgtgtttcgcttagactcagatt

SEQ ID NO: 370308 - DNA, 25 bp, Rattus norvegicus
gatgtgtttgcaactggatgccgag

SEQ ID NO: 370309 - DNA, 25 bp, Rattus norvegicus
gatgtgtttgcatctggatgccgag

SEQ ID NO: 370310 - DNA, 25 bp, Rattus norvegicus
gatgtgttttctcacgacctatcac

SEQ ID NO: 370311 - DNA, 25 bp, Rattus norvegicus
gatgtgttttctgacgacctatcac

SEQ ID NO: 370312 - DNA, 25 bp, Rattus norvegicus
gatgttaaaattactgcatggttac

SEQ ID NO: 370313 - DNA, 25 bp, Rattus norvegicus
gatgttaaaatttctgcatggttac

SEQ ID NO: 370314 - DNA, 25 bp, Rattus norvegicus
gatgttaaagggactcctgaaacct

SEQ ID NO: 370315 - DNA, 25 bp, Rattus norvegicus
gatgttaaagggtctcctgaaacct

SEQ ID NO: 370316 - DNA, 25 bp, Rattus norvegicus
gatgttaaatcccacagaagtctgc

SEQ ID NO: 370317 - DNA, 25 bp, Rattus norvegicus
gatgttaaatccgacagaagtctgc

SEQ ID NO: 370318 - DNA, 25 bp, Rattus norvegicus
gatgttaaccaactcagcaagcctg

SEQ ID NO: 370319 - DNA, 25 bp, Rattus norvegicus
gatgttaaccaagtcagcaagcctg

SEQ ID NO: 370320 - DNA, 25 bp, Rattus norvegicus
gatgttaactggctttatcttgttc

SEQ ID NO: 370321 - DNA, 25 bp, Rattus norvegicus
gatgttaactgggtttatcttgttc

SEQ ID NO: 370322 - DNA, 25 bp, Rattus norvegicus
gatgttaagacaatgccttcattag

SEQ ID NO: 370323 - DNA, 25 bp, Rattus norvegicus
gatgttaagacattgccttcattag

SEQ ID NO: 370324 - DNA, 25 bp, Rattus norvegicus
gatgttaagagcattgtttccatta

SEQ ID NO: 370325 - DNA, 25 bp, Rattus norvegicus
gatgttaagagctttgtttccatta

SEQ ID NO: 370326 - DNA, 25 bp, Rattus norvegicus
gatgttaagtctactctaattttga

SEQ ID NO: 370327 - DNA, 25 bp, Rattus norvegicus
gatgttaagtcttctctaattttga

SEQ ID NO: 370328 - DNA, 25 bp, Rattus norvegicus
gatgttaattcaagtcttcctgact

SEQ ID NO: 370329 - DNA, 25 bp, Rattus norvegicus
gatgttaattcatgtcttcctgact

SEQ ID NO: 370330 - DNA, 25 bp, Rattus norvegicus
gatgttacaactatgaggtggccaa

SEQ ID NO: 370331 - DNA, 25 bp, Rattus norvegicus
gatgttacaactttgaggtggccaa

SEQ ID NO: 370332 - DNA, 25 bp, Rattus norvegicus
gatgttacaattatcagctcgaacg

SEQ ID NO: 370333 - DNA, 25 bp, Rattus norvegicus
gatgttacaattttcagctcgaacg

SEQ ID NO: 370334 - DNA, 25 bp, Rattus norvegicus
gatgttacacgtcagttggactggt

SEQ ID NO: 370335 - DNA, 25 bp, Rattus norvegicus
gatgttacacgtgagttggactggt

SEQ ID NO: 370336 - DNA, 25 bp, Rattus norvegicus
gatgttacagcacttccagaaggtc

SEQ ID NO: 370337 - DNA, 25 bp, Rattus norvegicus
gatgttacagcagttccagaaggtc

SEQ ID NO: 370338 - DNA, 25 bp, Rattus norvegicus
gatgttacagtgactccttagcaga

SEQ ID NO: 370339 - DNA, 25 bp, Rattus norvegicus
gatgttacagtgtctccttagcaga

SEQ ID NO: 370340 - DNA, 25 bp, Rattus norvegicus
gatgttacattactctccaatttga

SEQ ID NO: 370341 - DNA, 25 bp, Rattus norvegicus
gatgttacattagtctccaatttga

SEQ ID NO: 370342 - DNA, 25 bp, Rattus norvegicus
gatgttacctatctctgtttttaaa

SEQ ID NO: 370343 - DNA, 25 bp, Rattus norvegicus
gatgttacctatgtctgtttttaaa

SEQ ID NO: 370344 - DNA, 25 bp, Rattus norvegicus
gatgttacctccaactcatttgaaa

SEQ ID NO: 370345 - DNA, 25 bp, Rattus norvegicus
gatgttacctcctactcatttgaaa

SEQ ID NO: 370346 - DNA, 25 bp, Rattus norvegicus
gatgttacgttcagtcagaggacaa

SEQ ID NO: 370347 - DNA, 25 bp, Rattus norvegicus
gatgttacgttctgtcagaggacaa

SEQ ID NO: 370348 - DNA, 25 bp, Rattus norvegicus
gatgttactaacagttattggttct

SEQ ID NO: 370349 - DNA, 25 bp, Rattus norvegicus
gatgttactaactgttattggttct

SEQ ID NO: 370350 - DNA, 25 bp, Rattus norvegicus
gatgttactagtacccagacgtgac

SEQ ID NO: 370351 - DNA, 25 bp, Rattus norvegicus
gatgttactagttcccagacgtgac

SEQ ID NO: 370352 - DNA, 25 bp, Rattus norvegicus
gatgttactcgtcaaagccgtttta

SEQ ID NO: 370353 - DNA, 25 bp, Rattus norvegicus
gatgttactcgtgaaagccgtttta

SEQ ID NO: 370354 - DNA, 25 bp, Rattus norvegicus
gatgttacttgtatcctgttctaga

SEQ ID NO: 370355 - DNA, 25 bp, Rattus norvegicus
gatgttacttgtttcctgttctaga

SEQ ID NO: 370356 - DNA, 25 bp, Rattus norvegicus
gatgttagaataattctgttcccag

SEQ ID NO: 370357 - DNA, 25 bp, Rattus norvegicus
gatgttagaatatttctgttcccag

SEQ ID NO: 370358 - DNA, 25 bp, Rattus norvegicus
gatgttagacacatctccgtgagat

SEQ ID NO: 370359 - DNA, 25 bp, Rattus norvegicus
gatgttagacacttctccgtgagat

SEQ ID NO: 370360 - DNA, 25 bp, Rattus norvegicus
gatgttagagaacactgcttcctac

SEQ ID NO: 370361 - DNA, 25 bp, Rattus norvegicus
gatgttagagaagactgcttcctac

SEQ ID NO: 370362 - DNA, 25 bp, Rattus norvegicus
gatgttagaggcaagagccctcctt

SEQ ID NO: 370363 - DNA, 25 bp, Rattus norvegicus
gatgttagaggctagagccctcctt

SEQ ID NO: 370364 - DNA, 25 bp, Rattus norvegicus
gatgttagatctacagggacttcca

SEQ ID NO: 370365 - DNA, 25 bp, Rattus norvegicus
gatgttagatcttcagggacttcca

SEQ ID NO: 370366 - DNA, 25 bp, Rattus norvegicus
gatgttagcatcaaaccccgctatg

SEQ ID NO: 370367 - DNA, 25 bp, Rattus norvegicus
gatgttagcatctaaccccgctatg

SEQ ID NO: 370368 - DNA, 25 bp, Rattus norvegicus
gatgttagccacataagacaccaag

SEQ ID NO: 370369 - DNA, 25 bp, Rattus norvegicus
gatgttagccacttaagacaccaag

SEQ ID NO: 370370 - DNA, 25 bp, Rattus norvegicus
gatgttagcctgaggtaggtccctt

SEQ ID NO: 370371 - DNA, 25 bp, Rattus norvegicus
gatgttagcctgtggtaggtccctt

SEQ ID NO: 370372 - DNA, 25 bp, Rattus norvegicus
gatgttagctttccgttgctataat

SEQ ID NO: 370373 - DNA, 25 bp, Rattus norvegicus
gatgttagctttgcgttgctataat

SEQ ID NO: 370374 - DNA, 25 bp, Rattus norvegicus
gatgttaggcgtatgagatccagac

SEQ ID NO: 370375 - DNA, 25 bp, Rattus norvegicus
gatgttaggcgtttgagatccagac

SEQ ID NO: 370376 - DNA, 25 bp, Rattus norvegicus
gatgttagggtgctcgttcccaatc

SEQ ID NO: 370377 - DNA, 25 bp, Rattus norvegicus
gatgttagggtggtcgttcccaatc

SEQ ID NO: 370378 - DNA, 25 bp, Rattus norvegicus
gatgttaggtcaactcacctcacag

SEQ ID NO: 370379 - DNA, 25 bp, Rattus norvegicus
gatgttaggtcatctcacctcacag

SEQ ID NO: 370380 - DNA, 25 bp, Rattus norvegicus
gatgttagtaccagtgatgtcttca

SEQ ID NO: 370381 - DNA, 25 bp, Rattus norvegicus
gatgttagtacctgtgatgtcttca

SEQ ID NO: 370382 - DNA, 25 bp, Rattus norvegicus
gatgttagtccccaatcacttttta

SEQ ID NO: 370383 - DNA, 25 bp, Rattus norvegicus
gatgttagtcccgaatcacttttta

SEQ ID NO: 370384 - DNA, 25 bp, Rattus norvegicus
gatgttagtgacagtaccagcccaa

SEQ ID NO: 370385 - DNA, 25 bp, Rattus norvegicus
gatgttagtgactgtaccagcccaa

SEQ ID NO: 370386 - DNA, 25 bp, Rattus norvegicus
gatgttagttcaaaggtcggtctac

SEQ ID NO: 370387 - DNA, 25 bp, Rattus norvegicus
gatgttagttcataggtcggtctac

SEQ ID NO: 370388 - DNA, 25 bp, Rattus norvegicus
gatgttatagccctcagttgcagct

SEQ ID NO: 370389 - DNA, 25 bp, Rattus norvegicus
gatgttatagccgtcagttgcagct

SEQ ID NO: 370390 - DNA, 25 bp, Rattus norvegicus
gatgttatatgtccttgccagtgtc

SEQ ID NO: 370391 - DNA, 25 bp, Rattus norvegicus
gatgttatatgtgcttgccagtgtc

SEQ ID NO: 370392 - DNA, 25 bp, Rattus norvegicus
gatgttatctagacagcttcctggt

SEQ ID NO: 370393 - DNA, 25 bp, Rattus norvegicus
gatgttatctagtcagcttcctggt

SEQ ID NO: 370394 - DNA, 25 bp, Rattus norvegicus
gatgttatctgaaagcacacctaag

SEQ ID NO: 370395 - DNA, 25 bp, Rattus norvegicus
gatgttatctgatagcacacctaag

SEQ ID NO: 370396 - DNA, 25 bp, Rattus norvegicus
gatgttatctgcaggtgctatgtcc

SEQ ID NO: 370397 - DNA, 25 bp, Rattus norvegicus
gatgttatctgctggtgctatgtcc

SEQ ID NO: 370398 - DNA, 25 bp, Rattus norvegicus
gatgttattactctactttccccaa

SEQ ID NO: 370399 - DNA, 25 bp, Rattus norvegicus
gatgttattactgtactttccccaa

SEQ ID NO: 370400 - DNA, 25 bp, Rattus norvegicus
gatgttatttcaatagctgcatggt

SEQ ID NO: 370401 - DNA, 25 bp, Rattus norvegicus
gatgttatttcattagctgcatggt

SEQ ID NO: 370402 - DNA, 25 bp, Rattus norvegicus
gatgttatttctagaccagcctatt

SEQ ID NO: 370403 - DNA, 25 bp, Rattus norvegicus
gatgttatttcttgaccagcctatt

SEQ ID NO: 370404 - DNA, 25 bp, Rattus norvegicus
gatgttcaaaatcccgccctgatca

SEQ ID NO: 370405 - DNA, 25 bp, Rattus norvegicus
gatgttcaaaatgccgccctgatca

SEQ ID NO: 370406 - DNA, 25 bp, Rattus norvegicus
gatgttcaaacgatgccaagttcaa

SEQ ID NO: 370407 - DNA, 25 bp, Rattus norvegicus
gatgttcaaacgttgccaagttcaa

SEQ ID NO: 370408 - DNA, 25 bp, Rattus norvegicus
gatgttcaagaaaatccagatgttc

SEQ ID NO: 370409 - DNA, 25 bp, Rattus norvegicus
gatgttcaagaatatccagatgttc

SEQ ID NO: 370410 - DNA, 25 bp, Rattus norvegicus
gatgttcaagatcgtctctcagctc

SEQ ID NO: 370411 - DNA, 25 bp, Rattus norvegicus
gatgttcaagatggtctctcagctc

SEQ ID NO: 370412 - DNA, 25 bp, Rattus norvegicus
gatgttcaagcgcaaagatcacctt

SEQ ID NO: 370413 - DNA, 25 bp, Rattus norvegicus
gatgttcaagcggaaagatcacctt

SEQ ID NO: 370414 - DNA, 25 bp, Rattus norvegicus
gatgttcacccacatgtatcagaag

SEQ ID NO: 370415 - DNA, 25 bp, Rattus norvegicus
gatgttcacccagatgtatcagaag

SEQ ID NO: 370416 - DNA, 25 bp, Rattus norvegicus
gatgttcactctcatacattctgga

SEQ ID NO: 370417 - DNA, 25 bp, Rattus norvegicus
gatgttcactctgatacattctgga

SEQ ID NO: 370418 - DNA, 25 bp, Rattus norvegicus
gatgttcactgcctgaggttgctca

SEQ ID NO: 370419 - DNA, 25 bp, Rattus norvegicus
gatgttcactgcgtgaggttgctca

SEQ ID NO: 370420 - DNA, 25 bp, Rattus norvegicus
gatgttcactgtccaattcggtaac

SEQ ID NO: 370421 - DNA, 25 bp, Rattus norvegicus
gatgttcactgtgcaattcggtaac

SEQ ID NO: 370422 - DNA, 25 bp, Rattus norvegicus
gatgttcagaagacctgtctgcaga

SEQ ID NO: 370423 - DNA, 25 bp, Rattus norvegicus
gatgttcagaagtcctgtctgcaga

SEQ ID NO: 370424 - DNA, 25 bp, Rattus norvegicus
gatgttcagattacccaaacccatt

SEQ ID NO: 370425 - DNA, 25 bp, Rattus norvegicus
gatgttcagatttcccaaacccatt

SEQ ID NO: 370426 - DNA, 25 bp, Rattus norvegicus
gatgttcagcaaaccctgggagcgg

SEQ ID NO: 370427 - DNA, 25 bp, Rattus norvegicus
gatgttcagcaatccctgggagcgg

SEQ ID NO: 370428 - DNA, 25 bp, Rattus norvegicus
gatgttcagcagacagatgtggccc

SEQ ID NO: 370429 - DNA, 25 bp, Rattus norvegicus
gatgttcagcagtcagatgtggccc

SEQ ID NO: 370430 - DNA, 25 bp, Rattus norvegicus
gatgttcaggctcagcatccagcaa

SEQ ID NO: 370431 - DNA, 25 bp, Rattus norvegicus
gatgttcaggctgagcatccagcaa

SEQ ID NO: 370432 - DNA, 25 bp, Rattus norvegicus
gatgttcaggtgacaagccacacat

SEQ ID NO: 370433 - DNA, 25 bp, Rattus norvegicus
gatgttcaggtgtcaagccacacat

SEQ ID NO: 370434 - DNA, 25 bp, Rattus norvegicus
gatgttcagtgcaacattgttcata

SEQ ID NO: 370435 - DNA, 25 bp, Rattus norvegicus
gatgttcagtgctacattgttcata

SEQ ID NO: 370436 - DNA, 25 bp, Rattus norvegicus
gatgttcagtttcctgttaccttaa

SEQ ID NO: 370437 - DNA, 25 bp, Rattus norvegicus
gatgttcagtttgctgttaccttaa

SEQ ID NO: 370438 - DNA, 25 bp, Rattus norvegicus
gatgttcatacaagcttgggcttcc

SEQ ID NO: 370439 - DNA, 25 bp, Rattus norvegicus
gatgttcatacatgcttgggcttcc

SEQ ID NO: 370440 - DNA, 25 bp, Rattus norvegicus
gatgttcatgcccagctcgacagaa

SEQ ID NO: 370441 - DNA, 25 bp, Rattus norvegicus
gatgttcatgccgagctcgacagaa

SEQ ID NO: 370442 - DNA, 25 bp, Rattus norvegicus
gatgttccaaagactcctgtagcct

SEQ ID NO: 370443 - DNA, 25 bp, Rattus norvegicus
gatgttccaaagtctcctgtagcct

SEQ ID NO: 370444 - DNA, 25 bp, Rattus norvegicus
gatgttccaagcagggctggatcta

SEQ ID NO: 370445 - DNA, 25 bp, Rattus norvegicus
gatgttccaagctgggctggatcta

SEQ ID NO: 370446 - DNA, 25 bp, Rattus norvegicus
gatgttccatcaccttcacagtatt

SEQ ID NO: 370447 - DNA, 25 bp, Rattus norvegicus
gatgttccatcagcttcacagtatt

SEQ ID NO: 370448 - DNA, 25 bp, Rattus norvegicus
gatgttccatgtatcttgtgaccag

SEQ ID NO: 370449 - DNA, 25 bp, Rattus norvegicus
gatgttccatgtttcttgtgaccag

SEQ ID NO: 370450 - DNA, 25 bp, Rattus norvegicus
gatgttcccactctgtgcacgagaa

SEQ ID NO: 370451 - DNA, 25 bp, Rattus norvegicus
gatgttcccactgtgtgcacgagaa

SEQ ID NO: 370452 - DNA, 25 bp, Rattus norvegicus
gatgttcccctgagcaaagaagact

SEQ ID NO: 370453 - DNA, 25 bp, Rattus norvegicus
gatgttcccctgtgcaaagaagact

SEQ ID NO: 370454 - DNA, 25 bp, Rattus norvegicus
gatgttcccgttccactatggacag

SEQ ID NO: 370455 - DNA, 25 bp, Rattus norvegicus
gatgttcccgttgcactatggacag

SEQ ID NO: 370456 - DNA, 25 bp, Rattus norvegicus
gatgttccctgaaaaatttttgtta

SEQ ID NO: 370457 - DNA, 25 bp, Rattus norvegicus
gatgttccctgataaatttttgtta

SEQ ID NO: 370458 - DNA, 25 bp, Rattus norvegicus
gatgttcccttcaagttcctggatc

SEQ ID NO: 370459 - DNA, 25 bp, Rattus norvegicus
gatgttcccttctagttcctggatc

SEQ ID NO: 370460 - DNA, 25 bp, Rattus norvegicus
gatgttccgatgaagccgttgcgaa

SEQ ID NO: 370461 - DNA, 25 bp, Rattus norvegicus
gatgttccgatgtagccgttgcgaa

SEQ ID NO: 370462 - DNA, 25 bp, Rattus norvegicus
gatgttcctaatataagcacagttt

SEQ ID NO: 370463 - DNA, 25 bp, Rattus norvegicus
gatgttcctaatttaagcacagttt

SEQ ID NO: 370464 - DNA, 25 bp, Rattus norvegicus
gatgttcctctccaaatcataaata

SEQ ID NO: 370465 - DNA, 25 bp, Rattus norvegicus
gatgttcctctcgaaatcataaata

SEQ ID NO: 370466 - DNA, 25 bp, Rattus norvegicus
gatgttcctgtaaactcccatggaa

SEQ ID NO: 370467 - DNA, 25 bp, Rattus norvegicus
gatgttcctgtatactcccatggaa

SEQ ID NO: 370468 - DNA, 25 bp, Rattus norvegicus
gatgttccttgaagaagcactatct

SEQ ID NO: 370469 - DNA, 25 bp, Rattus norvegicus
gatgttccttgatgaagcactatct

SEQ ID NO: 370470 - DNA, 25 bp, Rattus norvegicus
gatgttcgactgctcagtgatgcca

SEQ ID NO: 370471 - DNA, 25 bp, Rattus norvegicus
gatgttcgactggtcagtgatgcca

SEQ ID NO: 370472 - DNA, 25 bp, Rattus norvegicus
gatgttcgcgataatcttctatatc

SEQ ID NO: 370473 - DNA, 25 bp, Rattus norvegicus
gatgttcgcgattatcttctatatc

SEQ ID NO: 370474 - DNA, 25 bp, Rattus norvegicus
gatgttcgtgacattgccaaggtac

SEQ ID NO: 370475 - DNA, 25 bp, Rattus norvegicus
gatgttcgtgactttgccaaggtac

SEQ ID NO: 370476 - DNA, 25 bp, Rattus norvegicus
gatgttcgttcaattctatgccttt

SEQ ID NO: 370477 - DNA, 25 bp, Rattus norvegicus
gatgttcgttcatttctatgccttt

SEQ ID NO: 370478 - DNA, 25 bp, Rattus norvegicus
gatgttctaaaacaacttcctgaag

SEQ ID NO: 370479 - DNA, 25 bp, Rattus norvegicus
gatgttctaaaagaacttcctgaag

SEQ ID NO: 370480 - DNA, 25 bp, Rattus norvegicus
gatgttctatggcatgtgctcgcat

SEQ ID NO: 370481 - DNA, 25 bp, Rattus norvegicus
gatgttctatgggatgtgctcgcat

SEQ ID NO: 370482 - DNA, 25 bp, Rattus norvegicus
gatgttctattcattgaagtgttag

SEQ ID NO: 370483 - DNA, 25 bp, Rattus norvegicus
gatgttctattctttgaagtgttag

SEQ ID NO: 370484 - DNA, 25 bp, Rattus norvegicus
gatgttctcgagaactcttccctaa

SEQ ID NO: 370485 - DNA, 25 bp, Rattus norvegicus
gatgttctcgagtactcttccctaa

SEQ ID NO: 370486 - DNA, 25 bp, Rattus norvegicus
gatgttctctcccaaacactggtca

SEQ ID NO: 370487 - DNA, 25 bp, Rattus norvegicus
gatgttctctccgaaacactggtca

SEQ ID NO: 370488 - DNA, 25 bp, Rattus norvegicus
gatgttctctgaacttctgagccta

SEQ ID NO: 370489 - DNA, 25 bp, Rattus norvegicus
gatgttctctgatcttctgagccta

SEQ ID NO: 370490 - DNA, 25 bp, Rattus norvegicus
gatgttctcttgactgactttctgc

SEQ ID NO: 370491 - DNA, 25 bp, Rattus norvegicus
gatgttctcttgtctgactttctgc

SEQ ID NO: 370492 - DNA, 25 bp, Rattus norvegicus
gatgttctgaatagccacttctagg

SEQ ID NO: 370493 - DNA, 25 bp, Rattus norvegicus
gatgttctgaattgccacttctagg

SEQ ID NO: 370494 - DNA, 25 bp, Rattus norvegicus
gatgttctgattcccatggatttac

SEQ ID NO: 370495 - DNA, 25 bp, Rattus norvegicus
gatgttctgattgccatggatttac

SEQ ID NO: 370496 - DNA, 25 bp, Rattus norvegicus
gatgttctgctgcaaacttaacaaa

SEQ ID NO: 370497 - DNA, 25 bp, Rattus norvegicus
gatgttctgctggaaacttaacaaa

SEQ ID NO: 370498 - DNA, 25 bp, Rattus norvegicus
gatgttctgggaataaagccaccat

SEQ ID NO: 370499 - DNA, 25 bp, Rattus norvegicus
gatgttctgggattaaagccaccat

SEQ ID NO: 370500 - DNA, 25 bp, Rattus norvegicus
gatgttcttaaacctactctgctga

SEQ ID NO: 370501 - DNA, 25 bp, Rattus norvegicus
gatgttcttaaagctactctgctga

SEQ ID NO: 370502 - DNA, 25 bp, Rattus norvegicus
gatgttcttagtatgatctcgcaga

SEQ ID NO: 370503 - DNA, 25 bp, Rattus norvegicus
gatgttcttagtttgatctcgcaga

SEQ ID NO: 370504 - DNA, 25 bp, Rattus norvegicus
gatgttcttatcatagtccacccat

SEQ ID NO: 370505 - DNA, 25 bp, Rattus norvegicus
gatgttcttatcttagtccacccat

SEQ ID NO: 370506 - DNA, 25 bp, Rattus norvegicus
gatgttcttcataagcagtctctcg

SEQ ID NO: 370507 - DNA, 25 bp, Rattus norvegicus
gatgttcttcattagcagtctctcg

SEQ ID NO: 370508 - DNA, 25 bp, Rattus norvegicus
gatgttcttgatatgttgactacgc

SEQ ID NO: 370509 - DNA, 25 bp, Rattus norvegicus
gatgttcttgatttgttgactacgc

SEQ ID NO: 370510 - DNA, 25 bp, Rattus norvegicus
gatgttctttccaactctgagaggc

SEQ ID NO: 370511 - DNA, 25 bp, Rattus norvegicus
gatgttctttcctactctgagaggc

SEQ ID NO: 370512 - DNA, 25 bp, Rattus norvegicus
gatgttgaagaccagctcgctcagc

SEQ ID NO: 370513 - DNA, 25 bp, Rattus norvegicus
gatgttgaagacgagctcgctcagc

SEQ ID NO: 370514 - DNA, 25 bp, Rattus norvegicus
gatgttgaagatcccgtgtaccaga

SEQ ID NO: 370515 - DNA, 25 bp, Rattus norvegicus
gatgttgaagatgccgtgtaccaga

SEQ ID NO: 370516 - DNA, 25 bp, Rattus norvegicus
gatgttgacactccgtcgttactga

SEQ ID NO: 370517 - DNA, 25 bp, Rattus norvegicus
gatgttgacactgcgtcgttactga

SEQ ID NO: 370518 - DNA, 25 bp, Rattus norvegicus
gatgttgacagtattttcttttaac

SEQ ID NO: 370519 - DNA, 25 bp, Rattus norvegicus
gatgttgacagttttttcttttaac

SEQ ID NO: 370520 - DNA, 25 bp, Rattus norvegicus
gatgttgactgaattcccacaagag

SEQ ID NO: 370521 - DNA, 25 bp, Rattus norvegicus
gatgttgactgatttcccacaagag

SEQ ID NO: 370522 - DNA, 25 bp, Rattus norvegicus
gatgttgagaaccatctgaggagtt

SEQ ID NO: 370523 - DNA, 25 bp, Rattus norvegicus
gatgttgagaacgatctgaggagtt

SEQ ID NO: 370524 - DNA, 25 bp, Rattus norvegicus
gatgttgagagtcactgccccaatc

SEQ ID NO: 370525 - DNA, 25 bp, Rattus norvegicus
gatgttgagagtgactgccccaatc

SEQ ID NO: 370526 - DNA, 25 bp, Rattus norvegicus
gatgttgagcagacacagcctgtcc

SEQ ID NO: 370527 - DNA, 25 bp, Rattus norvegicus
gatgttgagcagtcacagcctgtcc

SEQ ID NO: 370528 - DNA, 25 bp, Rattus norvegicus
gatgttgagccacataaagaatgta

SEQ ID NO: 370529 - DNA, 25 bp, Rattus norvegicus
gatgttgagccagataaagaatgta

SEQ ID NO: 370530 - DNA, 25 bp, Rattus norvegicus
gatgttgatattctacctttgtctc

SEQ ID NO: 370531 - DNA, 25 bp, Rattus norvegicus
gatgttgatattgtacctttgtctc

SEQ ID NO: 370532 - DNA, 25 bp, Rattus norvegicus
gatgttgatgatcctgtcagctact

SEQ ID NO: 370533 - DNA, 25 bp, Rattus norvegicus
gatgttgatgatgctgtcagctact

SEQ ID NO: 370534 - DNA, 25 bp, Rattus norvegicus
gatgttgcaaatctattttccttca

SEQ ID NO: 370535 - DNA, 25 bp, Rattus norvegicus
gatgttgcaaatgtattttccttca

SEQ ID NO: 370536 - DNA, 25 bp, Rattus norvegicus
gatgttgcaagccactcaaatcgta

SEQ ID NO: 370537 - DNA, 25 bp, Rattus norvegicus
gatgttgcaagcgactcaaatcgta

SEQ ID NO: 370538 - DNA, 25 bp, Rattus norvegicus
gatgttgcaataactgtggacttta

SEQ ID NO: 370539 - DNA, 25 bp, Rattus norvegicus
gatgttgcaatatctgtggacttta

SEQ ID NO: 370540 - DNA, 25 bp, Rattus norvegicus
gatgttgcagtactcctgtagtctt

SEQ ID NO: 370541 - DNA, 25 bp, Rattus norvegicus
gatgttgcagtagtcctgtagtctt

SEQ ID NO: 370542 - DNA, 25 bp, Rattus norvegicus
gatgttgcagttcctcctggagctg

SEQ ID NO: 370543 - DNA, 25 bp, Rattus norvegicus
gatgttgcagttgctcctggagctg

SEQ ID NO: 370544 - DNA, 25 bp, Rattus norvegicus
gatgttgcatgcacatgacactcaa

SEQ ID NO: 370545 - DNA, 25 bp, Rattus norvegicus
gatgttgcatgctcatgacactcaa

SEQ ID NO: 370546 - DNA, 25 bp, Rattus norvegicus
gatgttgccagacgattgtgttctt

SEQ ID NO: 370547 - DNA, 25 bp, Rattus norvegicus
gatgttgccagaggattgtgttctt

SEQ ID NO: 370548 - DNA, 25 bp, Rattus norvegicus
gatgttgcccaacagctggatccat

SEQ ID NO: 370549 - DNA, 25 bp, Rattus norvegicus
gatgttgcccaagagctggatccat

SEQ ID NO: 370550 - DNA, 25 bp, Rattus norvegicus
gatgttgcccttcgcagaagactgt

SEQ ID NO: 370551 - DNA, 25 bp, Rattus norvegicus
gatgttgcccttcgccaaaaacgca

SEQ ID NO: 370552 - DNA, 25 bp, Rattus norvegicus
gatgttgcccttggcagaagactgt

SEQ ID NO: 370553 - DNA, 25 bp, Rattus norvegicus
gatgttgcccttggccaaaaacgca

SEQ ID NO: 370554 - DNA, 25 bp, Rattus norvegicus
gatgttgctactcttcctaataaag

SEQ ID NO: 370555 - DNA, 25 bp, Rattus norvegicus
gatgttgctactgttcctaataaag

SEQ ID NO: 370556 - DNA, 25 bp, Rattus norvegicus
gatgttgctcaccacaatcatggtc

SEQ ID NO: 370557 - DNA, 25 bp, Rattus norvegicus
gatgttgctcacgacaatcatggtc

SEQ ID NO: 370558 - DNA, 25 bp, Rattus norvegicus
gatgttgctctgatatggctgttac

SEQ ID NO: 370559 - DNA, 25 bp, Rattus norvegicus
gatgttgctctgttatggctgttac

SEQ ID NO: 370560 - DNA, 25 bp, Rattus norvegicus
gatgttgctgaccaggtggcacctt

SEQ ID NO: 370561 - DNA, 25 bp, Rattus norvegicus
gatgttgctgacgaggtggcacctt

SEQ ID NO: 370562 - DNA, 25 bp, Rattus norvegicus
gatgttgctgggaacggcacttttt

SEQ ID NO: 370563 - DNA, 25 bp, Rattus norvegicus
gatgttgctgggtacggcacttttt

SEQ ID NO: 370564 - DNA, 25 bp, Rattus norvegicus
gatgttgctggtcgtcacaagccca

SEQ ID NO: 370565 - DNA, 25 bp, Rattus norvegicus
gatgttgctggtggtcacaagccca

SEQ ID NO: 370566 - DNA, 25 bp, Rattus norvegicus
gatgttgctgtccttctacgtcctc

SEQ ID NO: 370567 - DNA, 25 bp, Rattus norvegicus
gatgttgctgtcgttctacgtcctc

SEQ ID NO: 370568 - DNA, 25 bp, Rattus norvegicus
gatgttgcttatccttttggctgca

SEQ ID NO: 370569 - DNA, 25 bp, Rattus norvegicus
gatgttgcttatgcttttggctgca

SEQ ID NO: 370570 - DNA, 25 bp, Rattus norvegicus
gatgttgcttggcacagactgtatt

SEQ ID NO: 370571 - DNA, 25 bp, Rattus norvegicus
gatgttgcttgggacagactgtatt

SEQ ID NO: 370572 - DNA, 25 bp, Rattus norvegicus
gatgttggagcaccctgaaccacag

SEQ ID NO: 370573 - DNA, 25 bp, Rattus norvegicus
gatgttggagcagcctgaaccacag

SEQ ID NO: 370574 - DNA, 25 bp, Rattus norvegicus
gatgttggccacagcataaacccag

SEQ ID NO: 370575 - DNA, 25 bp, Rattus norvegicus
gatgttggccactgcataaacccag

SEQ ID NO: 370576 - DNA, 25 bp, Rattus norvegicus
gatgttggcttgatactgcatgcag

SEQ ID NO: 370577 - DNA, 25 bp, Rattus norvegicus
gatgttggcttgttactgcatgcag

SEQ ID NO: 370578 - DNA, 25 bp, Rattus norvegicus
gatgttggctttatggactctttcc

SEQ ID NO: 370579 - DNA, 25 bp, Rattus norvegicus
gatgttggctttcaaaccctatcgt

SEQ ID NO: 370580 - DNA, 25 bp, Rattus norvegicus
gatgttggctttgaaaccctatcgt

SEQ ID NO: 370581 - DNA, 25 bp, Rattus norvegicus
gatgttggctttttggactctttcc

SEQ ID NO: 370582 - DNA, 25 bp, Rattus norvegicus
gatgttgggcttaactggctaacaa

SEQ ID NO: 370583 - DNA, 25 bp, Rattus norvegicus
gatgttgggctttactggctaacaa

SEQ ID NO: 370584 - DNA, 25 bp, Rattus norvegicus
gatgttgggtccaaactcaagctca

SEQ ID NO: 370585 - DNA, 25 bp, Rattus norvegicus
gatgttgggtcctaactcaagctca

SEQ ID NO: 370586 - DNA, 25 bp, Rattus norvegicus
gatgttggtccacttcagttttact

SEQ ID NO: 370587 - DNA, 25 bp, Rattus norvegicus
gatgttggtccagttcagttttact

SEQ ID NO: 370588 - DNA, 25 bp, Rattus norvegicus
gatgttggtgttatagcagaaagct

SEQ ID NO: 370589 - DNA, 25 bp, Rattus norvegicus
gatgttggtgttttagcagaaagct

SEQ ID NO: 370590 - DNA, 25 bp, Rattus norvegicus
gatgttggttctctcagaatggttc

SEQ ID NO: 370591 - DNA, 25 bp, Rattus norvegicus
gatgttggttctgtcagaatggttc

SEQ ID NO: 370592 - DNA, 25 bp, Rattus norvegicus
gatgttgtacacagctttacttaac

SEQ ID NO: 370593 - DNA, 25 bp, Rattus norvegicus
gatgttgtacactgctttacttaac

SEQ ID NO: 370594 - DNA, 25 bp, Rattus norvegicus
gatgttgtagccatcctattgataa

SEQ ID NO: 370595 - DNA, 25 bp, Rattus norvegicus
gatgttgtagccttcctattgataa

SEQ ID NO: 370596 - DNA, 25 bp, Rattus norvegicus
gatgttgtcaatatcttggtctgcc

SEQ ID NO: 370597 - DNA, 25 bp, Rattus norvegicus
gatgttgtcaatttcttggtctgcc

SEQ ID NO: 370598 - DNA, 25 bp, Rattus norvegicus
gatgttgtcagcacactgctcagca

SEQ ID NO: 370599 - DNA, 25 bp, Rattus norvegicus
gatgttgtcagctcactgctcagca

SEQ ID NO: 370600 - DNA, 25 bp, Rattus norvegicus
gatgttgtcattcgcccattgtgta

SEQ ID NO: 370601 - DNA, 25 bp, Rattus norvegicus
gatgttgtcattctttttaccaggg

SEQ ID NO: 370602 - DNA, 25 bp, Rattus norvegicus
gatgttgtcattggcccattgtgta

SEQ ID NO: 370603 - DNA, 25 bp, Rattus norvegicus
gatgttgtcattgtttttaccaggg

SEQ ID NO: 370604 - DNA, 25 bp, Rattus norvegicus
gatgttgtcccaaatttacacctct

SEQ ID NO: 370605 - DNA, 25 bp, Rattus norvegicus
gatgttgtcccatatttacacctct

SEQ ID NO: 370606 - DNA, 25 bp, Rattus norvegicus
gatgttgtctttatactagttcaaa

SEQ ID NO: 370607 - DNA, 25 bp, Rattus norvegicus
gatgttgtctttttactagttcaaa

SEQ ID NO: 370608 - DNA, 25 bp, Rattus norvegicus
gatgttgtgcagaaacctcaatccc

SEQ ID NO: 370609 - DNA, 25 bp, Rattus norvegicus
gatgttgtgcagtaacctcaatccc

SEQ ID NO: 370610 - DNA, 25 bp, Rattus norvegicus
gatgttgttcatcaaggcaccaaat

SEQ ID NO: 370611 - DNA, 25 bp, Rattus norvegicus
gatgttgttcatgaaggcaccaaat

SEQ ID NO: 370612 - DNA, 25 bp, Rattus norvegicus
gatgttgttcccaatgacccaagtt

SEQ ID NO: 370613 - DNA, 25 bp, Rattus norvegicus
gatgttgttccctatgacccaagtt

SEQ ID NO: 370614 - DNA, 25 bp, Rattus norvegicus
gatgttgttgctaacttactagttc

SEQ ID NO: 370615 - DNA, 25 bp, Rattus norvegicus
gatgttgttgcttacttactagttc

SEQ ID NO: 370616 - DNA, 25 bp, Rattus norvegicus
gatgttgtttctaaatgtgcaggta

SEQ ID NO: 370617 - DNA, 25 bp, Rattus norvegicus
gatgttgtttcttaatgtgcaggta

SEQ ID NO: 370618 - DNA, 25 bp, Rattus norvegicus
gatgtttaacatactagtttcccca

SEQ ID NO: 370619 - DNA, 25 bp, Rattus norvegicus
gatgtttaacattctagtttcccca

SEQ ID NO: 370620 - DNA, 25 bp, Rattus norvegicus
gatgtttaactcagatccactgtgt

SEQ ID NO: 370621 - DNA, 25 bp, Rattus norvegicus
gatgtttaactctgatccactgtgt

SEQ ID NO: 370622 - DNA, 25 bp, Rattus norvegicus
gatgtttaatctattgtgcctcaat

SEQ ID NO: 370623 - DNA, 25 bp, Rattus norvegicus
gatgtttaatcttttgtgcctcaat

SEQ ID NO: 370624 - DNA, 25 bp, Rattus norvegicus
gatgtttaccctatgtcaggcctca

SEQ ID NO: 370625 - DNA, 25 bp, Rattus norvegicus
gatgtttaccctttgtcaggcctca

SEQ ID NO: 370626 - DNA, 25 bp, Rattus norvegicus
gatgtttaccgtatcgagtgctgtg

SEQ ID NO: 370627 - DNA, 25 bp, Rattus norvegicus
gatgtttaccgtttcgagtgctgtg

SEQ ID NO: 370628 - DNA, 25 bp, Rattus norvegicus
gatgtttagcctaaacgataacccg

SEQ ID NO: 370629 - DNA, 25 bp, Rattus norvegicus
gatgtttagccttaacgataacccg

SEQ ID NO: 370630 - DNA, 25 bp, Rattus norvegicus
gatgtttagcgtatctctttgcact

SEQ ID NO: 370631 - DNA, 25 bp, Rattus norvegicus
gatgtttagcgtttctctttgcact

SEQ ID NO: 370632 - DNA, 25 bp, Rattus norvegicus
gatgtttaggcccttaatggttgtt

SEQ ID NO: 370633 - DNA, 25 bp, Rattus norvegicus
gatgtttaggccgttaatggttgtt

SEQ ID NO: 370634 - DNA, 25 bp, Rattus norvegicus
gatgtttatacgaggacacacctac

SEQ ID NO: 370635 - DNA, 25 bp, Rattus norvegicus
gatgtttatacgtggacacacctac

SEQ ID NO: 370636 - DNA, 25 bp, Rattus norvegicus
gatgtttatcatacactcgagagtc

SEQ ID NO: 370637 - DNA, 25 bp, Rattus norvegicus
gatgtttatcattcactcgagagtc

SEQ ID NO: 370638 - DNA, 25 bp, Rattus norvegicus
gatgtttatcccctgtgagaacttc

SEQ ID NO: 370639 - DNA, 25 bp, Rattus norvegicus
gatgtttatcccgtgtgagaacttc

SEQ ID NO: 370640 - DNA, 25 bp, Rattus norvegicus
gatgtttcacatacaccagattttt

SEQ ID NO: 370641 - DNA, 25 bp, Rattus norvegicus
gatgtttcacattcaccagattttt

SEQ ID NO: 370642 - DNA, 25 bp, Rattus norvegicus
gatgtttcagaacctgtcattcatt

SEQ ID NO: 370643 - DNA, 25 bp, Rattus norvegicus
gatgtttcagaagctgtcattcatt

SEQ ID NO: 370644 - DNA, 25 bp, Rattus norvegicus
gatgtttcatatatgtgacagttaa

SEQ ID NO: 370645 - DNA, 25 bp, Rattus norvegicus
gatgtttcatatccacattccttat

SEQ ID NO: 370646 - DNA, 25 bp, Rattus norvegicus
gatgtttcatatgcacattccttat

SEQ ID NO: 370647 - DNA, 25 bp, Rattus norvegicus
gatgtttcatatttgtgacagttaa

SEQ ID NO: 370648 - DNA, 25 bp, Rattus norvegicus
gatgtttcatggcagagtccaggca

SEQ ID NO: 370649 - DNA, 25 bp, Rattus norvegicus
gatgtttcatgggagagtccaggca

SEQ ID NO: 370650 - DNA, 25 bp, Rattus norvegicus
gatgtttccatacctttgccagcat

SEQ ID NO: 370651 - DNA, 25 bp, Rattus norvegicus
gatgtttccatagctttgccagcat

SEQ ID NO: 370652 - DNA, 25 bp, Rattus norvegicus
gatgtttcccacacattctcaaata

SEQ ID NO: 370653 - DNA, 25 bp, Rattus norvegicus
gatgtttcccactcattctcaaata

SEQ ID NO: 370654 - DNA, 25 bp, Rattus norvegicus
gatgtttcccatattctggttacat

SEQ ID NO: 370655 - DNA, 25 bp, Rattus norvegicus
gatgtttcccattttctggttacat

SEQ ID NO: 370656 - DNA, 25 bp, Rattus norvegicus
gatgtttcctacaatacggtgacca

SEQ ID NO: 370657 - DNA, 25 bp, Rattus norvegicus
gatgtttcctactatacggtgacca

SEQ ID NO: 370658 - DNA, 25 bp, Rattus norvegicus
gatgtttcggttcacttgtgccagc

SEQ ID NO: 370659 - DNA, 25 bp, Rattus norvegicus
gatgtttcggttgacttgtgccagc

SEQ ID NO: 370660 - DNA, 25 bp, Rattus norvegicus
gatgtttctatcagggtcttcacag

SEQ ID NO: 370661 - DNA, 25 bp, Rattus norvegicus
gatgtttctatctgggtcttcacag

SEQ ID NO: 370662 - DNA, 25 bp, Rattus norvegicus
gatgtttctctgaccctccagtgtt

SEQ ID NO: 370663 - DNA, 25 bp, Rattus norvegicus
gatgtttctctgtccctccagtgtt

SEQ ID NO: 370664 - DNA, 25 bp, Rattus norvegicus
gatgtttctgaaactgggcactgaa

SEQ ID NO: 370665 - DNA, 25 bp, Rattus norvegicus
gatgtttctgaatctgggcactgaa

SEQ ID NO: 370666 - DNA, 25 bp, Rattus norvegicus
gatgtttctgagagatacagtactc

SEQ ID NO: 370667 - DNA, 25 bp, Rattus norvegicus
gatgtttctgagtgatacagtactc

SEQ ID NO: 370668 - DNA, 25 bp, Rattus norvegicus
gatgtttctggcaagattcctagga

SEQ ID NO: 370669 - DNA, 25 bp, Rattus norvegicus
gatgtttctggctagattcctagga

SEQ ID NO: 370670 - DNA, 25 bp, Rattus norvegicus
gatgtttctgtcattatgatgtggg

SEQ ID NO: 370671 - DNA, 25 bp, Rattus norvegicus
gatgtttctgtctttatgatgtggg

SEQ ID NO: 370672 - DNA, 25 bp, Rattus norvegicus
gatgtttctgtgactgtcctgtaaa

SEQ ID NO: 370673 - DNA, 25 bp, Rattus norvegicus
gatgtttctgtgtctgtcctgtaaa

SEQ ID NO: 370674 - DNA, 25 bp, Rattus norvegicus
gatgtttctgttaatcacgtgaaga

SEQ ID NO: 370675 - DNA, 25 bp, Rattus norvegicus
gatgtttctgttctgctgctaataa

SEQ ID NO: 370676 - DNA, 25 bp, Rattus norvegicus
gatgtttctgttgtgctgctaataa

SEQ ID NO: 370677 - DNA, 25 bp, Rattus norvegicus
gatgtttctgtttatcacgtgaaga

SEQ ID NO: 370678 - DNA, 25 bp, Rattus norvegicus
gatgtttcttacaacagaacgaaat

SEQ ID NO: 370679 - DNA, 25 bp, Rattus norvegicus
gatgtttcttactacagaacgaaat

SEQ ID NO: 370680 - DNA, 25 bp, Rattus norvegicus
gatgtttgaatgacttccacctctt

SEQ ID NO: 370681 - DNA, 25 bp, Rattus norvegicus
gatgtttgaatgtcttccacctctt

SEQ ID NO: 370682 - DNA, 25 bp, Rattus norvegicus
gatgtttgcacacccctgcttgtgg

SEQ ID NO: 370683 - DNA, 25 bp, Rattus norvegicus
gatgtttgcacagccctgcttgtgg

SEQ ID NO: 370684 - DNA, 25 bp, Rattus norvegicus
gatgtttgcagtagactcccaattg

SEQ ID NO: 370685 - DNA, 25 bp, Rattus norvegicus
gatgtttgcagttgactcccaattg

SEQ ID NO: 370686 - DNA, 25 bp, Rattus norvegicus
gatgtttgcatcaggagtctgtctc

SEQ ID NO: 370687 - DNA, 25 bp, Rattus norvegicus
gatgtttgcatctggagtctgtctc

SEQ ID NO: 370688 - DNA, 25 bp, Rattus norvegicus
gatgtttggcagacattgtttttac

SEQ ID NO: 370689 - DNA, 25 bp, Rattus norvegicus
gatgtttggcagtcattgtttttac

SEQ ID NO: 370690 - DNA, 25 bp, Rattus norvegicus
gatgtttggccactgtgggaaccct

SEQ ID NO: 370691 - DNA, 25 bp, Rattus norvegicus
gatgtttggccagtgtgggaaccct

SEQ ID NO: 370692 - DNA, 25 bp, Rattus norvegicus
gatgtttggcttattgtgacgtgac

SEQ ID NO: 370693 - DNA, 25 bp, Rattus norvegicus
gatgtttggctttttgtgacgtgac

SEQ ID NO: 370694 - DNA, 25 bp, Rattus norvegicus
gatgtttgggcacctggcacgtttc

SEQ ID NO: 370695 - DNA, 25 bp, Rattus norvegicus
gatgtttgggcagctggcacgtttc

SEQ ID NO: 370696 - DNA, 25 bp, Rattus norvegicus
gatgtttggtccagccagagggttc

SEQ ID NO: 370697 - DNA, 25 bp, Rattus norvegicus
gatgtttggtcctgccagagggttc

SEQ ID NO: 370698 - DNA, 25 bp, Rattus norvegicus
gatgtttgtaacctacgagcagctg

SEQ ID NO: 370699 - DNA, 25 bp, Rattus norvegicus
gatgtttgtaacgtacgagcagctg

SEQ ID NO: 370700 - DNA, 25 bp, Rattus norvegicus
gatgtttgtaatcgttttcagtctc

SEQ ID NO: 370701 - DNA, 25 bp, Rattus norvegicus
gatgtttgtaatggttttcagtctc

SEQ ID NO: 370702 - DNA, 25 bp, Rattus norvegicus
gatgtttgtctgcagcctcaaagct

SEQ ID NO: 370703 - DNA, 25 bp, Rattus norvegicus
gatgtttgtctggagcctcaaagct

SEQ ID NO: 370704 - DNA, 25 bp, Rattus norvegicus
gatgtttgtgaacacgccagattta

SEQ ID NO: 370705 - DNA, 25 bp, Rattus norvegicus
gatgtttgtgaagacgccagattta

SEQ ID NO: 370706 - DNA, 25 bp, Rattus norvegicus
gatgtttgtgtaatcacttgcttat

SEQ ID NO: 370707 - DNA, 25 bp, Rattus norvegicus
gatgtttgtgtattcacttgcttat

SEQ ID NO: 370708 - DNA, 25 bp, Rattus norvegicus
gatgtttgtgtccatgtctctgaat

SEQ ID NO: 370709 - DNA, 25 bp, Rattus norvegicus
gatgtttgtgtcgatgtctctgaat

SEQ ID NO: 370710 - DNA, 25 bp, Rattus norvegicus
gatgtttgttctcgttggaagtgca

SEQ ID NO: 370711 - DNA, 25 bp, Rattus norvegicus
gatgtttgttctggttggaagtgca

SEQ ID NO: 370712 - DNA, 25 bp, Rattus norvegicus
gatgttttaacaaatatttctgagt

SEQ ID NO: 370713 - DNA, 25 bp, Rattus norvegicus
gatgttttaacatatatttctgagt

SEQ ID NO: 370714 - DNA, 25 bp, Rattus norvegicus
gatgttttaatgcttctatccctaa

SEQ ID NO: 370715 - DNA, 25 bp, Rattus norvegicus
gatgttttaatggttctatccctaa

SEQ ID NO: 370716 - DNA, 25 bp, Rattus norvegicus
gatgttttacttccccgtacgattg

SEQ ID NO: 370717 - DNA, 25 bp, Rattus norvegicus
gatgttttacttgcccgtacgattg

SEQ ID NO: 370718 - DNA, 25 bp, Rattus norvegicus
gatgttttatctacagttctgacga

SEQ ID NO: 370719 - DNA, 25 bp, Rattus norvegicus
gatgttttatcttcagttctgacga

SEQ ID NO: 370720 - DNA, 25 bp, Rattus norvegicus
gatgttttcaagattcctggaactc

SEQ ID NO: 370721 - DNA, 25 bp, Rattus norvegicus
gatgttttcaagtttcctggaactc

SEQ ID NO: 370722 - DNA, 25 bp, Rattus norvegicus
gatgttttcagaagtgaccgatatt

SEQ ID NO: 370723 - DNA, 25 bp, Rattus norvegicus
gatgttttcagatgtgaccgatatt

SEQ ID NO: 370724 - DNA, 25 bp, Rattus norvegicus
gatgttttcagtaaggcttcctaac

SEQ ID NO: 370725 - DNA, 25 bp, Rattus norvegicus
gatgttttcagttaggcttcctaac

SEQ ID NO: 370726 - DNA, 25 bp, Rattus norvegicus
gatgttttcatgctttacacaactt

SEQ ID NO: 370727 - DNA, 25 bp, Rattus norvegicus
gatgttttcatggtttacacaactt

SEQ ID NO: 370728 - DNA, 25 bp, Rattus norvegicus
gatgttttccaactgctacaagtac

SEQ ID NO: 370729 - DNA, 25 bp, Rattus norvegicus
gatgttttccaagtgctacaagtac

SEQ ID NO: 370730 - DNA, 25 bp, Rattus norvegicus
gatgttttccatccagtaaagaccc

SEQ ID NO: 370731 - DNA, 25 bp, Rattus norvegicus
gatgttttccatgcagtaaagaccc

SEQ ID NO: 370732 - DNA, 25 bp, Rattus norvegicus
gatgttttcctaccatacaaaggac

SEQ ID NO: 370733 - DNA, 25 bp, Rattus norvegicus
gatgttttcctagcatacaaaggac

SEQ ID NO: 370734 - DNA, 25 bp, Rattus norvegicus
gatgttttcctgaggctgtacttca

SEQ ID NO: 370735 - DNA, 25 bp, Rattus norvegicus
gatgttttcctgtggctgtacttca

SEQ ID NO: 370736 - DNA, 25 bp, Rattus norvegicus
gatgttttcgttacagttctgtaaa

SEQ ID NO: 370737 - DNA, 25 bp, Rattus norvegicus
gatgttttcgtttcagttctgtaaa

SEQ ID NO: 370738 - DNA, 25 bp, Rattus norvegicus
gatgttttctaaaccaactcctagt

SEQ ID NO: 370739 - DNA, 25 bp, Rattus norvegicus
gatgttttctaatccaactcctagt

SEQ ID NO: 370740 - DNA, 25 bp, Rattus norvegicus
gatgttttctgacagtagcctccaa

SEQ ID NO: 370741 - DNA, 25 bp, Rattus norvegicus
gatgttttctgagagtagcctccaa

SEQ ID NO: 370742 - DNA, 25 bp, Rattus norvegicus
gatgttttgaatacccaaggagcaa

SEQ ID NO: 370743 - DNA, 25 bp, Rattus norvegicus
gatgttttgaatctgcccttttaaa

SEQ ID NO: 370744 - DNA, 25 bp, Rattus norvegicus
gatgttttgaatgtgcccttttaaa

SEQ ID NO: 370745 - DNA, 25 bp, Rattus norvegicus
gatgttttgaattcccaaggagcaa

SEQ ID NO: 370746 - DNA, 25 bp, Rattus norvegicus
gatgttttgtaaagtgctccgggca

SEQ ID NO: 370747 - DNA, 25 bp, Rattus norvegicus
gatgttttgtaatgtgctccgggca

SEQ ID NO: 370748 - DNA, 25 bp, Rattus norvegicus
gatgtttttcacagtatgaacaggt

SEQ ID NO: 370749 - DNA, 25 bp, Rattus norvegicus
gatgtttttcactgtatgaacaggt

SEQ ID NO: 370750 - DNA, 25 bp, Rattus norvegicus
gatgtttttcctcattttccacaat

SEQ ID NO: 370751 - DNA, 25 bp, Rattus norvegicus
gatgtttttcctgattttccacaat

SEQ ID NO: 370752 - DNA, 25 bp, Rattus norvegicus
gatgtttttcttacaaggtagcttt

SEQ ID NO: 370753 - DNA, 25 bp, Rattus norvegicus
gatgtttttctttcaaggtagcttt

SEQ ID NO: 370754 - DNA, 25 bp, Rattus norvegicus
gattaaaaatatcccaccactccca

SEQ ID NO: 370755 - DNA, 25 bp, Rattus norvegicus
gattaaaaatatgccaccactccca

SEQ ID NO: 370756 - DNA, 25 bp, Rattus norvegicus
gattaaaagtgtcgcctgtccattt

SEQ ID NO: 370757 - DNA, 25 bp, Rattus norvegicus
gattaaaagtgtggcctgtccattt

SEQ ID NO: 370758 - DNA, 25 bp, Rattus norvegicus
gattaaacatgaccacaccgcgcac

SEQ ID NO: 370759 - DNA, 25 bp, Rattus norvegicus
gattaaacatgagcacaccgcgcac

SEQ ID NO: 370760 - DNA, 25 bp, Rattus norvegicus
gattaaacctgacttcctttgttga

SEQ ID NO: 370761 - DNA, 25 bp, Rattus norvegicus
gattaaacctgagttcctttgttga

SEQ ID NO: 370762 - DNA, 25 bp, Rattus norvegicus
gattaaactgtacatactgtgcata

SEQ ID NO: 370763 - DNA, 25 bp, Rattus norvegicus
gattaaactgtagatactgtgcata

SEQ ID NO: 370764 - DNA, 25 bp, Rattus norvegicus
gattaaactttgatcatccgtgaca

SEQ ID NO: 370765 - DNA, 25 bp, Rattus norvegicus
gattaaactttgttcatccgtgaca

SEQ ID NO: 370766 - DNA, 25 bp, Rattus norvegicus
gattaaagcctcctggaagaagccc

SEQ ID NO: 370767 - DNA, 25 bp, Rattus norvegicus
gattaaagcctcgtggaagaagccc

SEQ ID NO: 370768 - DNA, 25 bp, Rattus norvegicus
gattaaagctgtcaattctgttgca

SEQ ID NO: 370769 - DNA, 25 bp, Rattus norvegicus
gattaaagctgtgaattctgttgca

SEQ ID NO: 370770 - DNA, 25 bp, Rattus norvegicus
gattaaaggcaacaccaccaccctg

SEQ ID NO: 370771 - DNA, 25 bp, Rattus norvegicus
gattaaaggcaagaccaccaccctg

SEQ ID NO: 370772 - DNA, 25 bp, Rattus norvegicus
gattaaaggccaactgggtccacat

SEQ ID NO: 370773 - DNA, 25 bp, Rattus norvegicus
gattaaaggccatctgggtccacat

SEQ ID NO: 370774 - DNA, 25 bp, Rattus norvegicus
gattaaagtgaactggctttcccac

SEQ ID NO: 370775 - DNA, 25 bp, Rattus norvegicus
gattaaagtgaagtggctttcccac

SEQ ID NO: 370776 - DNA, 25 bp, Rattus norvegicus
gattaaagtgacatcccggaactta

SEQ ID NO: 370777 - DNA, 25 bp, Rattus norvegicus
gattaaagtgacttcccggaactta

SEQ ID NO: 370778 - DNA, 25 bp, Rattus norvegicus
gattaaagtgtcagtttccccacac

SEQ ID NO: 370779 - DNA, 25 bp, Rattus norvegicus
gattaaagtgtctgtttccccacac

SEQ ID NO: 370780 - DNA, 25 bp, Rattus norvegicus
gattaaatagctctgtctcgctttg

SEQ ID NO: 370781 - DNA, 25 bp, Rattus norvegicus
gattaaatagctgtgtctcgctttg

SEQ ID NO: 370782 - DNA, 25 bp, Rattus norvegicus
gattaaatctatcctttctttataa

SEQ ID NO: 370783 - DNA, 25 bp, Rattus norvegicus
gattaaatctatgctttctttataa

SEQ ID NO: 370784 - DNA, 25 bp, Rattus norvegicus
gattaaatgcccactctcaaattag

SEQ ID NO: 370785 - DNA, 25 bp, Rattus norvegicus
gattaaatgccctctctcaaattag

SEQ ID NO: 370786 - DNA, 25 bp, Rattus norvegicus
gattaaatgctgattatgactgtca

SEQ ID NO: 370787 - DNA, 25 bp, Rattus norvegicus
gattaaatgctgtttatgactgtca

SEQ ID NO: 370788 - DNA, 25 bp, Rattus norvegicus
gattaaatgtcccaacttcctttca

SEQ ID NO: 370789 - DNA, 25 bp, Rattus norvegicus
gattaaatgtccgaacttcctttca

SEQ ID NO: 370790 - DNA, 25 bp, Rattus norvegicus
gattaaatgtttcagcgagcacgag

SEQ ID NO: 370791 - DNA, 25 bp, Rattus norvegicus
gattaaatgtttgagcgagcacgag

SEQ ID NO: 370792 - DNA, 25 bp, Rattus norvegicus
gattaaattattcgctgtccttccc

SEQ ID NO: 370793 - DNA, 25 bp, Rattus norvegicus
gattaaattattggctgtccttccc

SEQ ID NO: 370794 - DNA, 25 bp, Rattus norvegicus
gattaaattgtacccattctggtgg

SEQ ID NO: 370795 - DNA, 25 bp, Rattus norvegicus
gattaaattgtagccattctggtgg

SEQ ID NO: 370796 - DNA, 25 bp, Rattus norvegicus
gattaacaagtcactgatgccatag

SEQ ID NO: 370797 - DNA, 25 bp, Rattus norvegicus
gattaacaagtctctgatgccatag

SEQ ID NO: 370798 - DNA, 25 bp, Rattus norvegicus
gattaacacactcaaccgctacgag

SEQ ID NO: 370799 - DNA, 25 bp, Rattus norvegicus
gattaacacactgaaccgctacgag

SEQ ID NO: 370800 - DNA, 25 bp, Rattus norvegicus
gattaacactacattatcgattcta

SEQ ID NO: 370801 - DNA, 25 bp, Rattus norvegicus
gattaacactactttatcgattcta

SEQ ID NO: 370802 - DNA, 25 bp, Rattus norvegicus
gattaacactgacttgaactgaaca

SEQ ID NO: 370803 - DNA, 25 bp, Rattus norvegicus
gattaacactgagttgaactgaaca

SEQ ID NO: 370804 - DNA, 25 bp, Rattus norvegicus
gattaacagaagctcctccagaaag

SEQ ID NO: 370805 - DNA, 25 bp, Rattus norvegicus
gattaacagaaggtcctccagaaag

SEQ ID NO: 370806 - DNA, 25 bp, Rattus norvegicus
gattaacagtaactttcaggccact

SEQ ID NO: 370807 - DNA, 25 bp, Rattus norvegicus
gattaacagtaagtttcaggccact

SEQ ID NO: 370808 - DNA, 25 bp, Rattus norvegicus
gattaacataggatttccttctgta

SEQ ID NO: 370809 - DNA, 25 bp, Rattus norvegicus
gattaacataggttttccttctgta

SEQ ID NO: 370810 - DNA, 25 bp, Rattus norvegicus
gattaacccactatgttgaatgagg

SEQ ID NO: 370811 - DNA, 25 bp, Rattus norvegicus
gattaacccactttgttgaatgagg

SEQ ID NO: 370812 - DNA, 25 bp, Rattus norvegicus
gattaacccagacagggctcatgct

SEQ ID NO: 370813 - DNA, 25 bp, Rattus norvegicus
gattaacccagagagggctcatgct

SEQ ID NO: 370814 - DNA, 25 bp, Rattus norvegicus
gattaacccatccttagagttcata

SEQ ID NO: 370815 - DNA, 25 bp, Rattus norvegicus
gattaacccatcgttagagttcata

SEQ ID NO: 370816 - DNA, 25 bp, Rattus norvegicus
gattaacccgccaggttctaggcta

SEQ ID NO: 370817 - DNA, 25 bp, Rattus norvegicus
gattaacccgcctggttctaggcta

SEQ ID NO: 370818 - DNA, 25 bp, Rattus norvegicus
gattaacctctccagtaataccgta

SEQ ID NO: 370819 - DNA, 25 bp, Rattus norvegicus
gattaacctctcgagtaataccgta

SEQ ID NO: 370820 - DNA, 25 bp, Rattus norvegicus
gattaacctctgatcatagacttat

SEQ ID NO: 370821 - DNA, 25 bp, Rattus norvegicus
gattaacctctgttcatagacttat

SEQ ID NO: 370822 - DNA, 25 bp, Rattus norvegicus
gattaacctgaacccctcttaagat

SEQ ID NO: 370823 - DNA, 25 bp, Rattus norvegicus
gattaacctgaagccctcttaagat

SEQ ID NO: 370824 - DNA, 25 bp, Rattus norvegicus
gattaacctgacctctataatggat

SEQ ID NO: 370825 - DNA, 25 bp, Rattus norvegicus
gattaacctgacgtctataatggat

SEQ ID NO: 370826 - DNA, 25 bp, Rattus norvegicus
gattaacgtttcactgcaaaggcag

SEQ ID NO: 370827 - DNA, 25 bp, Rattus norvegicus
gattaacgtttctctgcaaaggcag

SEQ ID NO: 370828 - DNA, 25 bp, Rattus norvegicus
gattaactaggtaagtattaccagc

SEQ ID NO: 370829 - DNA, 25 bp, Rattus norvegicus
gattaactaggttagtattaccagc

SEQ ID NO: 370830 - DNA, 25 bp, Rattus norvegicus
gattaactattgacattagctctgt

SEQ ID NO: 370831 - DNA, 25 bp, Rattus norvegicus
gattaactattgtcattagctctgt

SEQ ID NO: 370832 - DNA, 25 bp, Rattus norvegicus
gattaactcatcaacttccatttag

SEQ ID NO: 370833 - DNA, 25 bp, Rattus norvegicus
gattaactcatctacttccatttag

SEQ ID NO: 370834 - DNA, 25 bp, Rattus norvegicus
gattaactgtttatcctgtgtagac

SEQ ID NO: 370835 - DNA, 25 bp, Rattus norvegicus
gattaactgtttttcctgtgtagac

SEQ ID NO: 370836 - DNA, 25 bp, Rattus norvegicus
gattaactttcccaacttccgtgat

SEQ ID NO: 370837 - DNA, 25 bp, Rattus norvegicus
gattaactttccgaacttccgtgat

SEQ ID NO: 370838 - DNA, 25 bp, Rattus norvegicus
gattaagaaagtccctctccaagaa

SEQ ID NO: 370839 - DNA, 25 bp, Rattus norvegicus
gattaagaaagtgcctctccaagaa

SEQ ID NO: 370840 - DNA, 25 bp, Rattus norvegicus
gattaagaactacccgaaccgaagt

SEQ ID NO: 370841 - DNA, 25 bp, Rattus norvegicus
gattaagaactagccgaaccgaagt

SEQ ID NO: 370842 - DNA, 25 bp, Rattus norvegicus
gattaagaccctacttcaaactgta

SEQ ID NO: 370843 - DNA, 25 bp, Rattus norvegicus
gattaagacccttcttcaaactgta

SEQ ID NO: 370844 - DNA, 25 bp, Rattus norvegicus
gattaagagtccactttgtcagcct

SEQ ID NO: 370845 - DNA, 25 bp, Rattus norvegicus
gattaagagtcctctttgtcagcct

SEQ ID NO: 370846 - DNA, 25 bp, Rattus norvegicus
gattaagattcaaccctagccctga

SEQ ID NO: 370847 - DNA, 25 bp, Rattus norvegicus
gattaagattcatccctagccctga

SEQ ID NO: 370848 - DNA, 25 bp, Rattus norvegicus
gattaagcacaaccctcaggacagg

SEQ ID NO: 370849 - DNA, 25 bp, Rattus norvegicus
gattaagcacaagcctcaggacagg

SEQ ID NO: 370850 - DNA, 25 bp, Rattus norvegicus
gattaagccagtaaagtccactttg

SEQ ID NO: 370851 - DNA, 25 bp, Rattus norvegicus
gattaagccagttaagtccactttg

SEQ ID NO: 370852 - DNA, 25 bp, Rattus norvegicus
gattaagccatgatctgtcaaccta

SEQ ID NO: 370853 - DNA, 25 bp, Rattus norvegicus
gattaagccatgttctgtcaaccta

SEQ ID NO: 370854 - DNA, 25 bp, Rattus norvegicus
gattaagccattacctgtcctctag

SEQ ID NO: 370855 - DNA, 25 bp, Rattus norvegicus
gattaagccatttcctgtcctctag

SEQ ID NO: 370856 - DNA, 25 bp, Rattus norvegicus
gattaagcctttacataacacagtt

SEQ ID NO: 370857 - DNA, 25 bp, Rattus norvegicus
gattaagccttttcataacacagtt

SEQ ID NO: 370858 - DNA, 25 bp, Rattus norvegicus
gattaagctgagctccttgtgttag

SEQ ID NO: 370859 - DNA, 25 bp, Rattus norvegicus
gattaagctgaggtccttgtgttag

SEQ ID NO: 370860 - DNA, 25 bp, Rattus norvegicus
gattaagcttctcgaactacgcccg

SEQ ID NO: 370861 - DNA, 25 bp, Rattus norvegicus
gattaagcttctggaactacgcccg

SEQ ID NO: 370862 - DNA, 25 bp, Rattus norvegicus
gattaagggtacattctgttgcctt

SEQ ID NO: 370863 - DNA, 25 bp, Rattus norvegicus
gattaagggtactttctgttgcctt

SEQ ID NO: 370864 - DNA, 25 bp, Rattus norvegicus
gattaaggtagtaccgacacccagt

SEQ ID NO: 370865 - DNA, 25 bp, Rattus norvegicus
gattaaggtagttccgacacccagt

SEQ ID NO: 370866 - DNA, 25 bp, Rattus norvegicus
gattaaggtgttacaaaactgccgt

SEQ ID NO: 370867 - DNA, 25 bp, Rattus norvegicus
gattaaggtgtttcaaaactgccgt

SEQ ID NO: 370868 - DNA, 25 bp, Rattus norvegicus
gattaagtacctcacagcagtcgta

SEQ ID NO: 370869 - DNA, 25 bp, Rattus norvegicus
gattaagtacctgacagcagtcgta

SEQ ID NO: 370870 - DNA, 25 bp, Rattus norvegicus
gattaagtagggacctgggctttcg

SEQ ID NO: 370871 - DNA, 25 bp, Rattus norvegicus
gattaagtagggtcctgggctttcg

SEQ ID NO: 370872 - DNA, 25 bp, Rattus norvegicus
gattaagtcccgaagactttctcgt

SEQ ID NO: 370873 - DNA, 25 bp, Rattus norvegicus
gattaagtcccgtagactttctcgt

SEQ ID NO: 370874 - DNA, 25 bp, Rattus norvegicus
gattaagttacacttctcagtggaa

SEQ ID NO: 370875 - DNA, 25 bp, Rattus norvegicus
gattaagttacagttctcagtggaa

SEQ ID NO: 370876 - DNA, 25 bp, Rattus norvegicus
gattaagttcccctgccaataaagc

SEQ ID NO: 370877 - DNA, 25 bp, Rattus norvegicus
gattaagttcccgtgccaataaagc

SEQ ID NO: 370878 - DNA, 25 bp, Rattus norvegicus
gattaataccccataccctatattg

SEQ ID NO: 370879 - DNA, 25 bp, Rattus norvegicus
gattaataccccttaccctatattg

SEQ ID NO: 370880 - DNA, 25 bp, Rattus norvegicus
gattaatagtctagcccttttcctt

SEQ ID NO: 370881 - DNA, 25 bp, Rattus norvegicus
gattaatagtcttgcccttttcctt

SEQ ID NO: 370882 - DNA, 25 bp, Rattus norvegicus
gattaatatttcatacatcaatgca

SEQ ID NO: 370883 - DNA, 25 bp, Rattus norvegicus
gattaatatttcttacatcaatgca

SEQ ID NO: 370884 - DNA, 25 bp, Rattus norvegicus
gattaatcacgtatctatcactgtg

SEQ ID NO: 370885 - DNA, 25 bp, Rattus norvegicus
gattaatcacgtttctatcactgtg

SEQ ID NO: 370886 - DNA, 25 bp, Rattus norvegicus
gattaatctgtgaaggctttaggaa

SEQ ID NO: 370887 - DNA, 25 bp, Rattus norvegicus
gattaatctgtgtaggctttaggaa

SEQ ID NO: 370888 - DNA, 25 bp, Rattus norvegicus
gattaatgacatatctcttctttta

SEQ ID NO: 370889 - DNA, 25 bp, Rattus norvegicus
gattaatgacatttctcttctttta

SEQ ID NO: 370890 - DNA, 25 bp, Rattus norvegicus
gattaatgacttcgtgaagacactt

SEQ ID NO: 370891 - DNA, 25 bp, Rattus norvegicus
gattaatgacttggtgaagacactt

SEQ ID NO: 370892 - DNA, 25 bp, Rattus norvegicus
gattaatgagctaatagtcctatgt

SEQ ID NO: 370893 - DNA, 25 bp, Rattus norvegicus
gattaatgagcttatagtcctatgt

SEQ ID NO: 370894 - DNA, 25 bp, Rattus norvegicus
gattaatgagtgactcctctgctca

SEQ ID NO: 370895 - DNA, 25 bp, Rattus norvegicus
gattaatgagtgtctcctctgctca

SEQ ID NO: 370896 - DNA, 25 bp, Rattus norvegicus
gattaatgctggagcttccgagact

SEQ ID NO: 370897 - DNA, 25 bp, Rattus norvegicus
gattaatgctggtgcttccgagact

SEQ ID NO: 370898 - DNA, 25 bp, Rattus norvegicus
gattaatggagtcttttcctcttac

SEQ ID NO: 370899 - DNA, 25 bp, Rattus norvegicus
gattaatggagtgttttcctcttac

SEQ ID NO: 370900 - DNA, 25 bp, Rattus norvegicus
gattaatggtggctccttctgtgtg

SEQ ID NO: 370901 - DNA, 25 bp, Rattus norvegicus
gattaatggtgggtccttctgtgtg

SEQ ID NO: 370902 - DNA, 25 bp, Rattus norvegicus
gattaatgtggcctggccccttacc

SEQ ID NO: 370903 - DNA, 25 bp, Rattus norvegicus
gattaatgtggcgtggccccttacc

SEQ ID NO: 370904 - DNA, 25 bp, Rattus norvegicus
gattaatgtggtatgcagatctggg

SEQ ID NO: 370905 - DNA, 25 bp, Rattus norvegicus
gattaatgtggtttgcagatctggg

SEQ ID NO: 370906 - DNA, 25 bp, Rattus norvegicus
gattaattacatctttctgggcact

SEQ ID NO: 370907 - DNA, 25 bp, Rattus norvegicus
gattaattacatgtttctgggcact

SEQ ID NO: 370908 - DNA, 25 bp, Rattus norvegicus
gattaattcattctccagccttggc

SEQ ID NO: 370909 - DNA, 25 bp, Rattus norvegicus
gattaattcattgtccagccttggc

SEQ ID NO: 370910 - DNA, 25 bp, Rattus norvegicus
gattaattctcccatcatctccagc

SEQ ID NO: 370911 - DNA, 25 bp, Rattus norvegicus
gattaattctccgatcatctccagc

SEQ ID NO: 370912 - DNA, 25 bp, Rattus norvegicus
gattaatttcttccaggaccacacc

SEQ ID NO: 370913 - DNA, 25 bp, Rattus norvegicus
gattaatttcttgcaggaccacacc

SEQ ID NO: 370914 - DNA, 25 bp, Rattus norvegicus
gattacaaagcccattccccgacta

SEQ ID NO: 370915 - DNA, 25 bp, Rattus norvegicus
gattacaaagccgattccccgacta

SEQ ID NO: 370916 - DNA, 25 bp, Rattus norvegicus
gattacaacagtcaactcccagggt

SEQ ID NO: 370917 - DNA, 25 bp, Rattus norvegicus
gattacaacagtgaactcccagggt

SEQ ID NO: 370918 - DNA, 25 bp, Rattus norvegicus
gattacaactgtatctatttttaat

SEQ ID NO: 370919 - DNA, 25 bp, Rattus norvegicus
gattacaactgtttctatttttaat

SEQ ID NO: 370920 - DNA, 25 bp, Rattus norvegicus
gattacaacttgctggacctgctgc

SEQ ID NO: 370921 - DNA, 25 bp, Rattus norvegicus
gattacaacttggtggacctgctgc

SEQ ID NO: 370922 - DNA, 25 bp, Rattus norvegicus
gattacaagccaccattctatgatg

SEQ ID NO: 370923 - DNA, 25 bp, Rattus norvegicus
gattacaagccagcattctatgatg

SEQ ID NO: 370924 - DNA, 25 bp, Rattus norvegicus
gattacaagcctcaaaaccgcccta

SEQ ID NO: 370925 - DNA, 25 bp, Rattus norvegicus
gattacaagcctgaaaaccgcccta

SEQ ID NO: 370926 - DNA, 25 bp, Rattus norvegicus
gattacaagcggaggcgctgccgcg

SEQ ID NO: 370927 - DNA, 25 bp, Rattus norvegicus
gattacaagcggtggcgctgccgcg

SEQ ID NO: 370928 - DNA, 25 bp, Rattus norvegicus
gattacaagggacggccactggcac

SEQ ID NO: 370929 - DNA, 25 bp, Rattus norvegicus
gattacaagggagggccactggcac

SEQ ID NO: 370930 - DNA, 25 bp, Rattus norvegicus
gattacaatcatcacgtcagcgccc

SEQ ID NO: 370931 - DNA, 25 bp, Rattus norvegicus
gattacaatcatcccaactcacaga

SEQ ID NO: 370932 - DNA, 25 bp, Rattus norvegicus
gattacaatcatgacgtcagcgccc

SEQ ID NO: 370933 - DNA, 25 bp, Rattus norvegicus
gattacaatcatgccaactcacaga

SEQ ID NO: 370934 - DNA, 25 bp, Rattus norvegicus
gattacaatgttactcttttctgct

SEQ ID NO: 370935 - DNA, 25 bp, Rattus norvegicus
gattacaatgtttctcttttctgct

SEQ ID NO: 370936 - DNA, 25 bp, Rattus norvegicus
gattacacagaaactactggcagga

SEQ ID NO: 370937 - DNA, 25 bp, Rattus norvegicus
gattacacagaatctactggcagga

SEQ ID NO: 370938 - DNA, 25 bp, Rattus norvegicus
gattacacagcaataaccaagttct

SEQ ID NO: 370939 - DNA, 25 bp, Rattus norvegicus
gattacacagcattaaccaagttct

SEQ ID NO: 370940 - DNA, 25 bp, Rattus norvegicus
gattacacctctcgaaacgcgggaa

SEQ ID NO: 370941 - DNA, 25 bp, Rattus norvegicus
gattacacctctggaaacgcgggaa

SEQ ID NO: 370942 - DNA, 25 bp, Rattus norvegicus
gattacagataaccctatgcccatt

SEQ ID NO: 370943 - DNA, 25 bp, Rattus norvegicus
gattacagataagcctatgcccatt

SEQ ID NO: 370944 - DNA, 25 bp, Rattus norvegicus
gattacagatggatcccttcactct

SEQ ID NO: 370945 - DNA, 25 bp, Rattus norvegicus
gattacagatggttcccttcactct

SEQ ID NO: 370946 - DNA, 25 bp, Rattus norvegicus
gattacagcagtcgctacacaggga

SEQ ID NO: 370947 - DNA, 25 bp, Rattus norvegicus
gattacagcagtggctacacaggga

SEQ ID NO: 370948 - DNA, 25 bp, Rattus norvegicus
gattacagcattatggcattgccag

SEQ ID NO: 370949 - DNA, 25 bp, Rattus norvegicus
gattacagcattttggcattgccag

SEQ ID NO: 370950 - DNA, 25 bp, Rattus norvegicus
gattacagctctacacagattccaa

SEQ ID NO: 370951 - DNA, 25 bp, Rattus norvegicus
gattacagctcttcacagattccaa

SEQ ID NO: 370952 - DNA, 25 bp, Rattus norvegicus
gattacagctttctagtcctgactt

SEQ ID NO: 370953 - DNA, 25 bp, Rattus norvegicus
gattacagctttgtagtcctgactt

SEQ ID NO: 370954 - DNA, 25 bp, Rattus norvegicus
gattacaggacaactgaccgattgt

SEQ ID NO: 370955 - DNA, 25 bp, Rattus norvegicus
gattacaggacatctgaccgattgt

SEQ ID NO: 370956 - DNA, 25 bp, Rattus norvegicus
gattacaggcctccatcatcacatg

SEQ ID NO: 370957 - DNA, 25 bp, Rattus norvegicus
gattacaggcctgcatcatcacatg

SEQ ID NO: 370958 - DNA, 25 bp, Rattus norvegicus
gattacagggatccacctctatgcc

SEQ ID NO: 370959 - DNA, 25 bp, Rattus norvegicus
gattacagggatgcacctctatgcc

SEQ ID NO: 370960 - DNA, 25 bp, Rattus norvegicus
gattacagtacaagtccattccagt

SEQ ID NO: 370961 - DNA, 25 bp, Rattus norvegicus
gattacagtacatgtccattccagt

SEQ ID NO: 370962 - DNA, 25 bp, Rattus norvegicus
gattacagtattctctcagaaatct

SEQ ID NO: 370963 - DNA, 25 bp, Rattus norvegicus
gattacagtattgtctcagaaatct

SEQ ID NO: 370964 - DNA, 25 bp, Rattus norvegicus
gattacagtgaactgtgttttctca

SEQ ID NO: 370965 - DNA, 25 bp, Rattus norvegicus
gattacagtgaagtgtgttttctca

SEQ ID NO: 370966 - DNA, 25 bp, Rattus norvegicus
gattacagtttgctgtgaaccttgc

SEQ ID NO: 370967 - DNA, 25 bp, Rattus norvegicus
gattacagtttggtgtgaaccttgc

SEQ ID NO: 370968 - DNA, 25 bp, Rattus norvegicus
gattacatccatctcattcgctgac

SEQ ID NO: 370969 - DNA, 25 bp, Rattus norvegicus
gattacatccatgtcattcgctgac

SEQ ID NO: 370970 - DNA, 25 bp, Rattus norvegicus
gattacatccggcagctacgccaga

SEQ ID NO: 370971 - DNA, 25 bp, Rattus norvegicus
gattacatccgggagctacgccaga

SEQ ID NO: 370972 - DNA, 25 bp, Rattus norvegicus
gattacatggccatcactgcaaaga

SEQ ID NO: 370973 - DNA, 25 bp, Rattus norvegicus
gattacatggccttcactgcaaaga

SEQ ID NO: 370974 - DNA, 25 bp, Rattus norvegicus
gattacatgtgcacaccaagcctgt

SEQ ID NO: 370975 - DNA, 25 bp, Rattus norvegicus
gattacatgtgctcaccaagcctgt

SEQ ID NO: 370976 - DNA, 25 bp, Rattus norvegicus
gattacatgtttattgaaggctgtg

SEQ ID NO: 370977 - DNA, 25 bp, Rattus norvegicus
gattacatgttttttgaaggctgtg

SEQ ID NO: 370978 - DNA, 25 bp, Rattus norvegicus
gattacattaggattacttcattct

SEQ ID NO: 370979 - DNA, 25 bp, Rattus norvegicus
gattacattaggtttacttcattct

SEQ ID NO: 370980 - DNA, 25 bp, Rattus norvegicus
gattacattcgtctggtacacttct

SEQ ID NO: 370981 - DNA, 25 bp, Rattus norvegicus
gattacattcgtgtggtacacttct

SEQ ID NO: 370982 - DNA, 25 bp, Rattus norvegicus
gattaccacaggcagacaccaggat

SEQ ID NO: 370983 - DNA, 25 bp, Rattus norvegicus
gattaccacagggagacaccaggat

SEQ ID NO: 370984 - DNA, 25 bp, Rattus norvegicus
gattaccagcagcaagccgacaaca

SEQ ID NO: 370985 - DNA, 25 bp, Rattus norvegicus
gattaccagcaggaagccgacaaca

SEQ ID NO: 370986 - DNA, 25 bp, Rattus norvegicus
gattacccaaggcaacatgcagcta

SEQ ID NO: 370987 - DNA, 25 bp, Rattus norvegicus
gattacccaagggaacatgcagcta

SEQ ID NO: 370988 - DNA, 25 bp, Rattus norvegicus
gattacccacatcggtggttcttac

SEQ ID NO: 370989 - DNA, 25 bp, Rattus norvegicus
gattacccacatgggtggttcttac

SEQ ID NO: 370990 - DNA, 25 bp, Rattus norvegicus
gattaccccaaacgagacgcttcta

SEQ ID NO: 370991 - DNA, 25 bp, Rattus norvegicus
gattaccccaaaggagacgcttcta

SEQ ID NO: 370992 - DNA, 25 bp, Rattus norvegicus
gattacccctaacaaccagtcagaa

SEQ ID NO: 370993 - DNA, 25 bp, Rattus norvegicus
gattacccctaagaaccagtcagaa

SEQ ID NO: 370994 - DNA, 25 bp, Rattus norvegicus
gattaccccttgatgagttcacttg

SEQ ID NO: 370995 - DNA, 25 bp, Rattus norvegicus
gattaccccttgttgagttcacttg

SEQ ID NO: 370996 - DNA, 25 bp, Rattus norvegicus
gattacccttgtcaattctgctgat

SEQ ID NO: 370997 - DNA, 25 bp, Rattus norvegicus
gattacccttgtgaattctgctgat

SEQ ID NO: 370998 - DNA, 25 bp, Rattus norvegicus
gattaccgattactcctcatggtag

SEQ ID NO: 370999 - DNA, 25 bp, Rattus norvegicus
gattaccgattagtcctcatggtag

SEQ ID NO: 371000 - DNA, 25 bp, Rattus norvegicus
gattaccggattctcagacgatgtc

SEQ ID NO: 371001 - DNA, 25 bp, Rattus norvegicus
gattaccggattgtcagacgatgtc

SEQ ID NO: 371002 - DNA, 25 bp, Rattus norvegicus
gattacctacatcctttgtcacaat

SEQ ID NO: 371003 - DNA, 25 bp, Rattus norvegicus
gattacctacatgctttgtcacaat

SEQ ID NO: 371004 - DNA, 25 bp, Rattus norvegicus
gattacctagctctcagcatagtgc

SEQ ID NO: 371005 - DNA, 25 bp, Rattus norvegicus
gattacctagctgtcagcatagtgc

SEQ ID NO: 371006 - DNA, 25 bp, Rattus norvegicus
gattacctaggcatctgtggccagg

SEQ ID NO: 371007 - DNA, 25 bp, Rattus norvegicus
gattacctaggcttctgtggccagg

SEQ ID NO: 371008 - DNA, 25 bp, Rattus norvegicus
gattacctataaaagttatcaagtt

SEQ ID NO: 371009 - DNA, 25 bp, Rattus norvegicus
gattacctataatagttatcaagtt

SEQ ID NO: 371010 - DNA, 25 bp, Rattus norvegicus
gattacctcatcaatagttatgcgg

SEQ ID NO: 371011 - DNA, 25 bp, Rattus norvegicus
gattacctcatctatagttatgcgg

SEQ ID NO: 371012 - DNA, 25 bp, Rattus norvegicus
gattacctcttaatctctatgtgca

SEQ ID NO: 371013 - DNA, 25 bp, Rattus norvegicus
gattacctcttattctctatgtgca

SEQ ID NO: 371014 - DNA, 25 bp, Rattus norvegicus
gattacctgaaccacaagactttga

SEQ ID NO: 371015 - DNA, 25 bp, Rattus norvegicus
gattacctgaacgacaagactttga

SEQ ID NO: 371016 - DNA, 25 bp, Rattus norvegicus
gattacctggagacaactgtcatgg

SEQ ID NO: 371017 - DNA, 25 bp, Rattus norvegicus
gattacctggagtcaactgtcatgg

SEQ ID NO: 371018 - DNA, 25 bp, Rattus norvegicus
gattaccttaagatctgtagcctga

SEQ ID NO: 371019 - DNA, 25 bp, Rattus norvegicus
gattaccttaagttctgtagcctga

SEQ ID NO: 371020 - DNA, 25 bp, Rattus norvegicus
gattaccttaatctagggactcaag

SEQ ID NO: 371021 - DNA, 25 bp, Rattus norvegicus
gattaccttaatgtagggactcaag

SEQ ID NO: 371022 - DNA, 25 bp, Rattus norvegicus
gattaccttcctcatattttgcact

SEQ ID NO: 371023 - DNA, 25 bp, Rattus norvegicus
gattaccttcctgatattttgcact

SEQ ID NO: 371024 - DNA, 25 bp, Rattus norvegicus
gattaccttgacagtggcagtgcct

SEQ ID NO: 371025 - DNA, 25 bp, Rattus norvegicus
gattaccttgactgtggcagtgcct

SEQ ID NO: 371026 - DNA, 25 bp, Rattus norvegicus
gattacgaggagaagccgccctatg

SEQ ID NO: 371027 - DNA, 25 bp, Rattus norvegicus
gattacgaggagtagccgccctatg

SEQ ID NO: 371028 - DNA, 25 bp, Rattus norvegicus
gattacgatccacactcatttgagt

SEQ ID NO: 371029 - DNA, 25 bp, Rattus norvegicus
gattacgatccagactcatttgagt

SEQ ID NO: 371030 - DNA, 25 bp, Rattus norvegicus
gattacgcaacaacttacatccagg

SEQ ID NO: 371031 - DNA, 25 bp, Rattus norvegicus
gattacgcaacatcttacatccagg

SEQ ID NO: 371032 - DNA, 25 bp, Rattus norvegicus
gattacgcccgcctgttctgagttt

SEQ ID NO: 371033 - DNA, 25 bp, Rattus norvegicus
gattacgcccgcgtgttctgagttt

SEQ ID NO: 371034 - DNA, 25 bp, Rattus norvegicus
gattacggtttgaatgttggtcctt

SEQ ID NO: 371035 - DNA, 25 bp, Rattus norvegicus
gattacggtttgtatgttggtcctt

SEQ ID NO: 371036 - DNA, 25 bp, Rattus norvegicus
gattacgtacttcatttccattgtt

SEQ ID NO: 371037 - DNA, 25 bp, Rattus norvegicus
gattacgtacttgatttccattgtt

SEQ ID NO: 371038 - DNA, 25 bp, Rattus norvegicus
gattacgtcggcaggtccaggcaag

SEQ ID NO: 371039 - DNA, 25 bp, Rattus norvegicus
gattacgtcggctggtccaggcaag

SEQ ID NO: 371040 - DNA, 25 bp, Rattus norvegicus
gattacgtgataaattagctgtcct

SEQ ID NO: 371041 - DNA, 25 bp, Rattus norvegicus
gattacgtgatatattagctgtcct

SEQ ID NO: 371042 - DNA, 25 bp, Rattus norvegicus
gattacgttctgatgatcaacgcct

SEQ ID NO: 371043 - DNA, 25 bp, Rattus norvegicus
gattacgttctgttgatcaacgcct

SEQ ID NO: 371044 - DNA, 25 bp, Rattus norvegicus
gattacgtttttcactaggctgact

SEQ ID NO: 371045 - DNA, 25 bp, Rattus norvegicus
gattacgtttttgactaggctgact

SEQ ID NO: 371046 - DNA, 25 bp, Rattus norvegicus
gattactaactgaatcctgtcccca

SEQ ID NO: 371047 - DNA, 25 bp, Rattus norvegicus
gattactaactgtatcctgtcccca

SEQ ID NO: 371048 - DNA, 25 bp, Rattus norvegicus
gattactatctcctcattgttattc

SEQ ID NO: 371049 - DNA, 25 bp, Rattus norvegicus
gattactatctcgtcattgttattc

SEQ ID NO: 371050 - DNA, 25 bp, Rattus norvegicus
gattactatctgagtgccaaaccca

SEQ ID NO: 371051 - DNA, 25 bp, Rattus norvegicus
gattactatctgtgtgccaaaccca

SEQ ID NO: 371052 - DNA, 25 bp, Rattus norvegicus
gattactatgcactgtcaaagctaa

SEQ ID NO: 371053 - DNA, 25 bp, Rattus norvegicus
gattactatgcagtgtcaaagctaa

SEQ ID NO: 371054 - DNA, 25 bp, Rattus norvegicus
gattactatggacttgctgcatcaa

SEQ ID NO: 371055 - DNA, 25 bp, Rattus norvegicus
gattactatggagttgctgcatcaa

SEQ ID NO: 371056 - DNA, 25 bp, Rattus norvegicus
gattactcaaagaaacctgccccag

SEQ ID NO: 371057 - DNA, 25 bp, Rattus norvegicus
gattactcaaagtaacctgccccag

SEQ ID NO: 371058 - DNA, 25 bp, Rattus norvegicus
gattactcacctaacaattcttaca

SEQ ID NO: 371059 - DNA, 25 bp, Rattus norvegicus
gattactcaccttacaattcttaca

SEQ ID NO: 371060 - DNA, 25 bp, Rattus norvegicus
gattactccctaacatactgcagat

SEQ ID NO: 371061 - DNA, 25 bp, Rattus norvegicus
gattactccctatcatactgcagat

SEQ ID NO: 371062 - DNA, 25 bp, Rattus norvegicus
gattactctgaaagaccttcctgtg

SEQ ID NO: 371063 - DNA, 25 bp, Rattus norvegicus
gattactctgaatgaccttcctgtg

SEQ ID NO: 371064 - DNA, 25 bp, Rattus norvegicus
gattactctgacattcatagtttga

SEQ ID NO: 371065 - DNA, 25 bp, Rattus norvegicus
gattactctgactttcatagtttga

SEQ ID NO: 371066 - DNA, 25 bp, Rattus norvegicus
gattactgaatgaccgtaccgggag

SEQ ID NO: 371067 - DNA, 25 bp, Rattus norvegicus
gattactgaatgaggctgatgttac

SEQ ID NO: 371068 - DNA, 25 bp, Rattus norvegicus
gattactgaatgtccgtaccgggag

SEQ ID NO: 371069 - DNA, 25 bp, Rattus norvegicus
gattactgaatgtggctgatgttac

SEQ ID NO: 371070 - DNA, 25 bp, Rattus norvegicus
gattactgaattatctgtctcccct

SEQ ID NO: 371071 - DNA, 25 bp, Rattus norvegicus
gattactgaattttctgtctcccct

SEQ ID NO: 371072 - DNA, 25 bp, Rattus norvegicus
gattactgacaaatttgatgtctga

SEQ ID NO: 371073 - DNA, 25 bp, Rattus norvegicus
gattactgacaattttgatgtctga

SEQ ID NO: 371074 - DNA, 25 bp, Rattus norvegicus
gattactgatctattcatagataaa

SEQ ID NO: 371075 - DNA, 25 bp, Rattus norvegicus
gattactgatcttttcatagataaa

SEQ ID NO: 371076 - DNA, 25 bp, Rattus norvegicus
gattactgccatcttattagaattg

SEQ ID NO: 371077 - DNA, 25 bp, Rattus norvegicus
gattactgccatgttattagaattg

SEQ ID NO: 371078 - DNA, 25 bp, Rattus norvegicus
gattactgccggacctcagtgtcag

SEQ ID NO: 371079 - DNA, 25 bp, Rattus norvegicus
gattactgccggtcctcagtgtcag

SEQ ID NO: 371080 - DNA, 25 bp, Rattus norvegicus
gattactgctggctaaaagaccttt

SEQ ID NO: 371081 - DNA, 25 bp, Rattus norvegicus
gattactgctgggtaaaagaccttt

SEQ ID NO: 371082 - DNA, 25 bp, Rattus norvegicus
gattactggaccaattctggatctc

SEQ ID NO: 371083 - DNA, 25 bp, Rattus norvegicus
gattactggacctattctggatctc

SEQ ID NO: 371084 - DNA, 25 bp, Rattus norvegicus
gattactggcacagcaggcttttcc

SEQ ID NO: 371085 - DNA, 25 bp, Rattus norvegicus
gattactggcactgcaggcttttcc

SEQ ID NO: 371086 - DNA, 25 bp, Rattus norvegicus
gattactggcctattcatttatcta

SEQ ID NO: 371087 - DNA, 25 bp, Rattus norvegicus
gattactggccttttcatttatcta

SEQ ID NO: 371088 - DNA, 25 bp, Rattus norvegicus
gattactgtgaaactcaccccgagg

SEQ ID NO: 371089 - DNA, 25 bp, Rattus norvegicus
gattactgtgaatctcaccccgagg

SEQ ID NO: 371090 - DNA, 25 bp, Rattus norvegicus
gattactgtggcatgttgggcccct

SEQ ID NO: 371091 - DNA, 25 bp, Rattus norvegicus
gattactgtggcttgttgggcccct

SEQ ID NO: 371092 - DNA, 25 bp, Rattus norvegicus
gattactgttaaaggctgccctgaa

SEQ ID NO: 371093 - DNA, 25 bp, Rattus norvegicus
gattactgttaatggctgccctgaa

SEQ ID NO: 371094 - DNA, 25 bp, Rattus norvegicus
gattactgtttacttcactgttgtg

SEQ ID NO: 371095 - DNA, 25 bp, Rattus norvegicus
gattactgtttagttcactgttgtg

SEQ ID NO: 371096 - DNA, 25 bp, Rattus norvegicus
gattactgtttgctcactgtctata

SEQ ID NO: 371097 - DNA, 25 bp, Rattus norvegicus
gattactgtttggtcactgtctata

SEQ ID NO: 371098 - DNA, 25 bp, Rattus norvegicus
gattactgttttctcctcgaagatg

SEQ ID NO: 371099 - DNA, 25 bp, Rattus norvegicus
gattactgttttgtcctcgaagatg

SEQ ID NO: 371100 - DNA, 25 bp, Rattus norvegicus
gattacttatccagattttggcata

SEQ ID NO: 371101 - DNA, 25 bp, Rattus norvegicus
gattacttatcctgattttggcata

SEQ ID NO: 371102 - DNA, 25 bp, Rattus norvegicus
gattacttcaaacggtcctctcacc

SEQ ID NO: 371103 - DNA, 25 bp, Rattus norvegicus
gattacttcaaagggtcctctcacc

SEQ ID NO: 371104 - DNA, 25 bp, Rattus norvegicus
gattacttcagcactcagtttctgt

SEQ ID NO: 371105 - DNA, 25 bp, Rattus norvegicus
gattacttcagctctcagtttctgt

SEQ ID NO: 371106 - DNA, 25 bp, Rattus norvegicus
gattacttgcccatggttggactaa

SEQ ID NO: 371107 - DNA, 25 bp, Rattus norvegicus
gattacttgcccttggttggactaa

SEQ ID NO: 371108 - DNA, 25 bp, Rattus norvegicus
gattacttgggtactaatgacctca

SEQ ID NO: 371109 - DNA, 25 bp, Rattus norvegicus
gattacttgggttctaatgacctca

SEQ ID NO: 371110 - DNA, 25 bp, Rattus norvegicus
gattactttatgatgtctgtgttca

SEQ ID NO: 371111 - DNA, 25 bp, Rattus norvegicus
gattactttatgttgtctgtgttca

SEQ ID NO: 371112 - DNA, 25 bp, Rattus norvegicus
gattactttcttactatttggtttg

SEQ ID NO: 371113 - DNA, 25 bp, Rattus norvegicus
gattactttctttctatttggtttg

SEQ ID NO: 371114 - DNA, 25 bp, Rattus norvegicus
gattactttgatatcacaacttact

SEQ ID NO: 371115 - DNA, 25 bp, Rattus norvegicus
gattactttgatttcacaacttact

SEQ ID NO: 371116 - DNA, 25 bp, Rattus norvegicus
gattactttgcgatttggtgccagt

SEQ ID NO: 371117 - DNA, 25 bp, Rattus norvegicus
gattactttgcgttttggtgccagt

SEQ ID NO: 371118 - DNA, 25 bp, Rattus norvegicus
gattactttttgcttagggccattt

SEQ ID NO: 371119 - DNA, 25 bp, Rattus norvegicus
gattactttttggttagggccattt

SEQ ID NO: 371120 - DNA, 25 bp, Rattus norvegicus
gattagaacgtaagggctctggcag

SEQ ID NO: 371121 - DNA, 25 bp, Rattus norvegicus
gattagaacgtatgggctctggcag

SEQ ID NO: 371122 - DNA, 25 bp, Rattus norvegicus
gattagaagcggacatccacggctt

SEQ ID NO: 371123 - DNA, 25 bp, Rattus norvegicus
gattagaagcggtcatccacggctt

SEQ ID NO: 371124 - DNA, 25 bp, Rattus norvegicus
gattagaagctccaggtcatcctgc

SEQ ID NO: 371125 - DNA, 25 bp, Rattus norvegicus
gattagaagctcgaggtcatcctgc

SEQ ID NO: 371126 - DNA, 25 bp, Rattus norvegicus
gattagacactacaggcaagagaac

SEQ ID NO: 371127 - DNA, 25 bp, Rattus norvegicus
gattagacactagaggcaagagaac

SEQ ID NO: 371128 - DNA, 25 bp, Rattus norvegicus
gattagactcggaggcgtataaaaa

SEQ ID NO: 371129 - DNA, 25 bp, Rattus norvegicus
gattagactcggtggcgtataaaaa

SEQ ID NO: 371130 - DNA, 25 bp, Rattus norvegicus
gattagactgtgagctacctgaccc

SEQ ID NO: 371131 - DNA, 25 bp, Rattus norvegicus
gattagactgtgtgctacctgaccc

SEQ ID NO: 371132 - DNA, 25 bp, Rattus norvegicus
gattagacttttaaattgccagtga

SEQ ID NO: 371133 - DNA, 25 bp, Rattus norvegicus
gattagactttttaattgccagtga

SEQ ID NO: 371134 - DNA, 25 bp, Rattus norvegicus
gattagagaatccacagctcccttg

SEQ ID NO: 371135 - DNA, 25 bp, Rattus norvegicus
gattagagaatcgacagctcccttg

SEQ ID NO: 371136 - DNA, 25 bp, Rattus norvegicus
gattagagatccctcagtgactgag

SEQ ID NO: 371137 - DNA, 25 bp, Rattus norvegicus
gattagagatccgtcagtgactgag

SEQ ID NO: 371138 - DNA, 25 bp, Rattus norvegicus
gattagatgtccaaccttgtcagag

SEQ ID NO: 371139 - DNA, 25 bp, Rattus norvegicus
gattagatgtcctaccttgtcagag

SEQ ID NO: 371140 - DNA, 25 bp, Rattus norvegicus
gattagatgttcaccttcttcgtaa

SEQ ID NO: 371141 - DNA, 25 bp, Rattus norvegicus
gattagatgttctccttcttcgtaa

SEQ ID NO: 371142 - DNA, 25 bp, Rattus norvegicus
gattagatttgacccactgtgtgtc

SEQ ID NO: 371143 - DNA, 25 bp, Rattus norvegicus
gattagatttgagccactgtgtgtc

SEQ ID NO: 371144 - DNA, 25 bp, Rattus norvegicus
gattagcaactgatttcccagcatc

SEQ ID NO: 371145 - DNA, 25 bp, Rattus norvegicus
gattagcaactgttttcccagcatc

SEQ ID NO: 371146 - DNA, 25 bp, Rattus norvegicus
gattagcacagacttgcaggctcct

SEQ ID NO: 371147 - DNA, 25 bp, Rattus norvegicus
gattagcacagagttgcaggctcct

SEQ ID NO: 371148 - DNA, 25 bp, Rattus norvegicus
gattagcacattccttatatcttca

SEQ ID NO: 371149 - DNA, 25 bp, Rattus norvegicus
gattagcacattgcttatatcttca

SEQ ID NO: 371150 - DNA, 25 bp, Rattus norvegicus
gattagcactgcagactattccaga

SEQ ID NO: 371151 - DNA, 25 bp, Rattus norvegicus
gattagcactgctgactattccaga

SEQ ID NO: 371152 - DNA, 25 bp, Rattus norvegicus
gattagcagcttagactgcagcatt

SEQ ID NO: 371153 - DNA, 25 bp, Rattus norvegicus
gattagcagctttgactgcagcatt

SEQ ID NO: 371154 - DNA, 25 bp, Rattus norvegicus
gattagccatataaggcacatggtt

SEQ ID NO: 371155 - DNA, 25 bp, Rattus norvegicus
gattagccatattaggcacatggtt

SEQ ID NO: 371156 - DNA, 25 bp, Rattus norvegicus
gattagcctcataaattgcctgtta

SEQ ID NO: 371157 - DNA, 25 bp, Rattus norvegicus
gattagcctcattaattgcctgtta

SEQ ID NO: 371158 - DNA, 25 bp, Rattus norvegicus
gattagccttcaatcatgcctgata

SEQ ID NO: 371159 - DNA, 25 bp, Rattus norvegicus
gattagccttcattcatgcctgata

SEQ ID NO: 371160 - DNA, 25 bp, Rattus norvegicus
gattagcgtggacagtttggacttc

SEQ ID NO: 371161 - DNA, 25 bp, Rattus norvegicus
gattagcgtggagagtttggacttc

SEQ ID NO: 371162 - DNA, 25 bp, Rattus norvegicus
gattagctatctatgtccaggctct

SEQ ID NO: 371163 - DNA, 25 bp, Rattus norvegicus
gattagctatctttgtccaggctct

SEQ ID NO: 371164 - DNA, 25 bp, Rattus norvegicus
gattagctcagactaagtgcttgct

SEQ ID NO: 371165 - DNA, 25 bp, Rattus norvegicus
gattagctcagagtaagtgcttgct

SEQ ID NO: 371166 - DNA, 25 bp, Rattus norvegicus
gattagctcatcacgccgcgaggtg

SEQ ID NO: 371167 - DNA, 25 bp, Rattus norvegicus
gattagctcatctcgccgcgaggtg

SEQ ID NO: 371168 - DNA, 25 bp, Rattus norvegicus
gattagctcccaaaacttggcttca

SEQ ID NO: 371169 - DNA, 25 bp, Rattus norvegicus
gattagctcccataacttggcttca

SEQ ID NO: 371170 - DNA, 25 bp, Rattus norvegicus
gattagctcgtacttctgaaggtga

SEQ ID NO: 371171 - DNA, 25 bp, Rattus norvegicus
gattagctcgtagttctgaaggtga

SEQ ID NO: 371172 - DNA, 25 bp, Rattus norvegicus
gattagctgacaaggccagacctgc

SEQ ID NO: 371173 - DNA, 25 bp, Rattus norvegicus
gattagctgacatggccagacctgc

SEQ ID NO: 371174 - DNA, 25 bp, Rattus norvegicus
gattagctgagcatcattttaaaat

SEQ ID NO: 371175 - DNA, 25 bp, Rattus norvegicus
gattagctgagcttcattttaaaat

SEQ ID NO: 371176 - DNA, 25 bp, Rattus norvegicus
gattagctgcacagggcgaagctct

SEQ ID NO: 371177 - DNA, 25 bp, Rattus norvegicus
gattagctgcactgggcgaagctct

SEQ ID NO: 371178 - DNA, 25 bp, Rattus norvegicus
gattagctgtatatcttcatgacta

SEQ ID NO: 371179 - DNA, 25 bp, Rattus norvegicus
gattagctgtatttcttcatgacta

SEQ ID NO: 371180 - DNA, 25 bp, Rattus norvegicus
gattagcttcatacatacctttgaa

SEQ ID NO: 371181 - DNA, 25 bp, Rattus norvegicus
gattagcttcattcatacctttgaa

SEQ ID NO: 371182 - DNA, 25 bp, Rattus norvegicus
gattaggaaaccctgtgccttgtcc

SEQ ID NO: 371183 - DNA, 25 bp, Rattus norvegicus
gattaggaaaccgtgtgccttgtcc

SEQ ID NO: 371184 - DNA, 25 bp, Rattus norvegicus
gattaggaacgtccaatggttgcca

SEQ ID NO: 371185 - DNA, 25 bp, Rattus norvegicus
gattaggaacgtgcaatggttgcca

SEQ ID NO: 371186 - DNA, 25 bp, Rattus norvegicus
gattaggaatggatttctccctcac

SEQ ID NO: 371187 - DNA, 25 bp, Rattus norvegicus
gattaggaatggttttctccctcac

SEQ ID NO: 371188 - DNA, 25 bp, Rattus norvegicus
gattaggacggacggatcctcttgc

SEQ ID NO: 371189 - DNA, 25 bp, Rattus norvegicus
gattaggacggagggatcctcttgc

SEQ ID NO: 371190 - DNA, 25 bp, Rattus norvegicus
gattaggacgtacgagctaggatat

SEQ ID NO: 371191 - DNA, 25 bp, Rattus norvegicus
gattaggacgtaggagctaggatat

SEQ ID NO: 371192 - DNA, 25 bp, Rattus norvegicus
gattaggctataccaatcccatggc

SEQ ID NO: 371193 - DNA, 25 bp, Rattus norvegicus
gattaggctatagcaatcccatggc

SEQ ID NO: 371194 - DNA, 25 bp, Rattus norvegicus
gattaggcttcaatttgcccagagc

SEQ ID NO: 371195 - DNA, 25 bp, Rattus norvegicus
gattaggcttcattttgcccagagc

SEQ ID NO: 371196 - DNA, 25 bp, Rattus norvegicus
gattaggctttacttccatgctgtc

SEQ ID NO: 371197 - DNA, 25 bp, Rattus norvegicus
gattaggctttagttccatgctgtc

SEQ ID NO: 371198 - DNA, 25 bp, Rattus norvegicus
gattaggcttttatcttgtgtcaat

SEQ ID NO: 371199 - DNA, 25 bp, Rattus norvegicus
gattaggcttttttcttgtgtcaat

SEQ ID NO: 371200 - DNA, 25 bp, Rattus norvegicus
gattagggacccaactattacactg

SEQ ID NO: 371201 - DNA, 25 bp, Rattus norvegicus
gattagggaccctactattacactg

SEQ ID NO: 371202 - DNA, 25 bp, Rattus norvegicus
gattagggacctcaccagcacagtc

SEQ ID NO: 371203 - DNA, 25 bp, Rattus norvegicus
gattagggacctgaccagcacagtc

SEQ ID NO: 371204 - DNA, 25 bp, Rattus norvegicus
gattagggcaaacctctagtccacc

SEQ ID NO: 371205 - DNA, 25 bp, Rattus norvegicus
gattagggcaaagctctagtccacc

SEQ ID NO: 371206 - DNA, 25 bp, Rattus norvegicus
gattagggcagcacttttgatgaat

SEQ ID NO: 371207 - DNA, 25 bp, Rattus norvegicus
gattagggcagctcttttgatgaat

SEQ ID NO: 371208 - DNA, 25 bp, Rattus norvegicus
gattagggctggacctggcttaccg

SEQ ID NO: 371209 - DNA, 25 bp, Rattus norvegicus
gattagggctggtcctggcttaccg

SEQ ID NO: 371210 - DNA, 25 bp, Rattus norvegicus
gattagggcttcagtcttggagttt

SEQ ID NO: 371211 - DNA, 25 bp, Rattus norvegicus
gattagggcttctgtcttggagttt

SEQ ID NO: 371212 - DNA, 25 bp, Rattus norvegicus
gattaggtctttaccatcggctcaa

SEQ ID NO: 371213 - DNA, 25 bp, Rattus norvegicus
gattaggtcttttccatcggctcaa

SEQ ID NO: 371214 - DNA, 25 bp, Rattus norvegicus
gattaggtgcatcctctcatagtga

SEQ ID NO: 371215 - DNA, 25 bp, Rattus norvegicus
gattaggtgcatgctctcatagtga

SEQ ID NO: 371216 - DNA, 25 bp, Rattus norvegicus
gattaggttaccatccctatatggt

SEQ ID NO: 371217 - DNA, 25 bp, Rattus norvegicus
gattaggttaccttccctatatggt

SEQ ID NO: 371218 - DNA, 25 bp, Rattus norvegicus
gattagtacacacaaggtcctgaac

SEQ ID NO: 371219 - DNA, 25 bp, Rattus norvegicus
gattagtacacagaaggtcctgaac

SEQ ID NO: 371220 - DNA, 25 bp, Rattus norvegicus
gattagtagcatatacacccctttg

SEQ ID NO: 371221 - DNA, 25 bp, Rattus norvegicus
gattagtagcatttacacccctttg

SEQ ID NO: 371222 - DNA, 25 bp, Rattus norvegicus
gattagtagcttatccctttcatta

SEQ ID NO: 371223 - DNA, 25 bp, Rattus norvegicus
gattagtagcttttccctttcatta

SEQ ID NO: 371224 - DNA, 25 bp, Rattus norvegicus
gattagtagtttccctactcccagg

SEQ ID NO: 371225 - DNA, 25 bp, Rattus norvegicus
gattagtagtttgcctactcccagg

SEQ ID NO: 371226 - DNA, 25 bp, Rattus norvegicus
gattagtatcgtccacttttacctt

SEQ ID NO: 371227 - DNA, 25 bp, Rattus norvegicus
gattagtatcgtgcacttttacctt

SEQ ID NO: 371228 - DNA, 25 bp, Rattus norvegicus
gattagtcaccaatttatagtacca

SEQ ID NO: 371229 - DNA, 25 bp, Rattus norvegicus
gattagtcaccattttatagtacca

SEQ ID NO: 371230 - DNA, 25 bp, Rattus norvegicus
gattagtcactgatcactggctata

SEQ ID NO: 371231 - DNA, 25 bp, Rattus norvegicus
gattagtcactgttcactggctata

SEQ ID NO: 371232 - DNA, 25 bp, Rattus norvegicus
gattagtccttcagttgtagctgag

SEQ ID NO: 371233 - DNA, 25 bp, Rattus norvegicus
gattagtccttctgttgtagctgag

SEQ ID NO: 371234 - DNA, 25 bp, Rattus norvegicus
gattagtctcatcctgtagcaacag

SEQ ID NO: 371235 - DNA, 25 bp, Rattus norvegicus
gattagtctcatgctgtagcaacag

SEQ ID NO: 371236 - DNA, 25 bp, Rattus norvegicus
gattagtgcctgctttaattacatt

SEQ ID NO: 371237 - DNA, 25 bp, Rattus norvegicus
gattagtgcctggtttaattacatt

SEQ ID NO: 371238 - DNA, 25 bp, Rattus norvegicus
gattagtgggatactttttcttggc

SEQ ID NO: 371239 - DNA, 25 bp, Rattus norvegicus
gattagtgggattctttttcttggc

SEQ ID NO: 371240 - DNA, 25 bp, Rattus norvegicus
gattagtgtctgcagcctcaatgaa

SEQ ID NO: 371241 - DNA, 25 bp, Rattus norvegicus
gattagtgtctggagcctcaatgaa

SEQ ID NO: 371242 - DNA, 25 bp, Rattus norvegicus
gattagttaacaagtgcaccagacc

SEQ ID NO: 371243 - DNA, 25 bp, Rattus norvegicus
gattagttaacatgtgcaccagacc

SEQ ID NO: 371244 - DNA, 25 bp, Rattus norvegicus
gattagttactactctgttctccac

SEQ ID NO: 371245 - DNA, 25 bp, Rattus norvegicus
gattagttactagtctgttctccac

SEQ ID NO: 371246 - DNA, 25 bp, Rattus norvegicus
gattagttcgggacttgctttgtgc

SEQ ID NO: 371247 - DNA, 25 bp, Rattus norvegicus
gattagttcgggtcttgctttgtgc

SEQ ID NO: 371248 - DNA, 25 bp, Rattus norvegicus
gattagttctttacagcatgttcct

SEQ ID NO: 371249 - DNA, 25 bp, Rattus norvegicus
gattagttcttttcagcatgttcct

SEQ ID NO: 371250 - DNA, 25 bp, Rattus norvegicus
gattagttgtgtccatgcatgtagc

SEQ ID NO: 371251 - DNA, 25 bp, Rattus norvegicus
gattagttgtgtgcatgcatgtagc

SEQ ID NO: 371252 - DNA, 25 bp, Rattus norvegicus
gattagtttacccttgtctttgaga

SEQ ID NO: 371253 - DNA, 25 bp, Rattus norvegicus
gattagtttaccgttgtctttgaga

SEQ ID NO: 371254 - DNA, 25 bp, Rattus norvegicus
gattagttttctacgtgtagccctg

SEQ ID NO: 371255 - DNA, 25 bp, Rattus norvegicus
gattagttttcttcgtgtagccctg

SEQ ID NO: 371256 - DNA, 25 bp, Rattus norvegicus
gattataaactgagtcttgacctgt

SEQ ID NO: 371257 - DNA, 25 bp, Rattus norvegicus
gattataaactgtgtcttgacctgt

SEQ ID NO: 371258 - DNA, 25 bp, Rattus norvegicus
gattataacctcataccgtgagctg

SEQ ID NO: 371259 - DNA, 25 bp, Rattus norvegicus
gattataacctcttaccgtgagctg

SEQ ID NO: 371260 - DNA, 25 bp, Rattus norvegicus
gattataagccaacctagtcaaaaa

SEQ ID NO: 371261 - DNA, 25 bp, Rattus norvegicus
gattataagccatcctagtcaaaaa

SEQ ID NO: 371262 - DNA, 25 bp, Rattus norvegicus
gattataagtacacctgtcacttcc

SEQ ID NO: 371263 - DNA, 25 bp, Rattus norvegicus
gattataagtactcctgtcacttcc

SEQ ID NO: 371264 - DNA, 25 bp, Rattus norvegicus
gattataatacaagccttacctcat

SEQ ID NO: 371265 - DNA, 25 bp, Rattus norvegicus
gattataatacatgccttacctcat

SEQ ID NO: 371266 - DNA, 25 bp, Rattus norvegicus
gattataatttccactgcttccgga

SEQ ID NO: 371267 - DNA, 25 bp, Rattus norvegicus
gattataatttcgactgcttccgga

SEQ ID NO: 371268 - DNA, 25 bp, Rattus norvegicus
gattatacaagaactctcctttgct

SEQ ID NO: 371269 - DNA, 25 bp, Rattus norvegicus
gattatacaagatctctcctttgct

SEQ ID NO: 371270 - DNA, 25 bp, Rattus norvegicus
gattatacatgacaacccgagttac

SEQ ID NO: 371271 - DNA, 25 bp, Rattus norvegicus
gattatacatgagaacccgagttac

SEQ ID NO: 371272 - DNA, 25 bp, Rattus norvegicus
gattataccctgagttcctggttat

SEQ ID NO: 371273 - DNA, 25 bp, Rattus norvegicus
gattataccctgtgttcctggttat

SEQ ID NO: 371274 - DNA, 25 bp, Rattus norvegicus
gattatacctcactattctcttgct

SEQ ID NO: 371275 - DNA, 25 bp, Rattus norvegicus
gattatacctcagtattctcttgct

SEQ ID NO: 371276 - DNA, 25 bp, Rattus norvegicus
gattatacctttcttcctcgaacgt

SEQ ID NO: 371277 - DNA, 25 bp, Rattus norvegicus
gattatacctttgttcctcgaacgt

SEQ ID NO: 371278 - DNA, 25 bp, Rattus norvegicus
gattatactattagcctctgtcctt

SEQ ID NO: 371279 - DNA, 25 bp, Rattus norvegicus
gattatactatttgcctctgtcctt

SEQ ID NO: 371280 - DNA, 25 bp, Rattus norvegicus
gattatagatgcacggtccctggaa

SEQ ID NO: 371281 - DNA, 25 bp, Rattus norvegicus
gattatagatgctcggtccctggaa

SEQ ID NO: 371282 - DNA, 25 bp, Rattus norvegicus
gattatagccatactgttcaagtgt

SEQ ID NO: 371283 - DNA, 25 bp, Rattus norvegicus
gattatagccattctgttcaagtgt

SEQ ID NO: 371284 - DNA, 25 bp, Rattus norvegicus
gattatagctggctaactgctctgt

SEQ ID NO: 371285 - DNA, 25 bp, Rattus norvegicus
gattatagctgggtaactgctctgt

SEQ ID NO: 371286 - DNA, 25 bp, Rattus norvegicus
gattataggaaaaccagggcctctt

SEQ ID NO: 371287 - DNA, 25 bp, Rattus norvegicus
gattataggaaatccagggcctctt

SEQ ID NO: 371288 - DNA, 25 bp, Rattus norvegicus
gattataggtttccatgaccacacc

SEQ ID NO: 371289 - DNA, 25 bp, Rattus norvegicus
gattataggtttgcatgaccacacc

SEQ ID NO: 371290 - DNA, 25 bp, Rattus norvegicus
gattatatacggctttcttcttcat

SEQ ID NO: 371291 - DNA, 25 bp, Rattus norvegicus
gattatatacgggtttcttcttcat

SEQ ID NO: 371292 - DNA, 25 bp, Rattus norvegicus
gattatatactcctgctggtcttat

SEQ ID NO: 371293 - DNA, 25 bp, Rattus norvegicus
gattatatactcgtgctggtcttat

SEQ ID NO: 371294 - DNA, 25 bp, Rattus norvegicus
gattatatagcgcagagattctcca

SEQ ID NO: 371295 - DNA, 25 bp, Rattus norvegicus
gattatatagcggagagattctcca

SEQ ID NO: 371296 - DNA, 25 bp, Rattus norvegicus
gattatatagctcatgttggaaatt

SEQ ID NO: 371297 - DNA, 25 bp, Rattus norvegicus
gattatatagctgatgttggaaatt

SEQ ID NO: 371298 - DNA, 25 bp, Rattus norvegicus
gattatatctcgatgtctgtgacag

SEQ ID NO: 371299 - DNA, 25 bp, Rattus norvegicus
gattatatctcgttgtctgtgacag

SEQ ID NO: 371300 - DNA, 25 bp, Rattus norvegicus
gattatatctggcttttgggcttaa

SEQ ID NO: 371301 - DNA, 25 bp, Rattus norvegicus
gattatatctgggttttgggcttaa

SEQ ID NO: 371302 - DNA, 25 bp, Rattus norvegicus
gattatatgtttatcttgtagctag

SEQ ID NO: 371303 - DNA, 25 bp, Rattus norvegicus
gattatatgtttttcttgtagctag

SEQ ID NO: 371304 - DNA, 25 bp, Rattus norvegicus
gattatattcagactcccaaataag

SEQ ID NO: 371305 - DNA, 25 bp, Rattus norvegicus
gattatattcagtctcccaaataag

SEQ ID NO: 371306 - DNA, 25 bp, Rattus norvegicus
gattatattcatcaacccacgtcag

SEQ ID NO: 371307 - DNA, 25 bp, Rattus norvegicus
gattatattcatgaacccacgtcag

SEQ ID NO: 371308 - DNA, 25 bp, Rattus norvegicus
gattatatttttccttgccttgtca

SEQ ID NO: 371309 - DNA, 25 bp, Rattus norvegicus
gattatatttttgcttgccttgtca

SEQ ID NO: 371310 - DNA, 25 bp, Rattus norvegicus
gattatcaaccaccagactgagcct

SEQ ID NO: 371311 - DNA, 25 bp, Rattus norvegicus
gattatcaaccagcagactgagcct

SEQ ID NO: 371312 - DNA, 25 bp, Rattus norvegicus
gattatcaaccgaggctacacactg

SEQ ID NO: 371313 - DNA, 25 bp, Rattus norvegicus
gattatcaaccgtggctacacactg

SEQ ID NO: 371314 - DNA, 25 bp, Rattus norvegicus
gattatcaagaacacaaccttccgt

SEQ ID NO: 371315 - DNA, 25 bp, Rattus norvegicus
gattatcaagaagacaaccttccgt

SEQ ID NO: 371316 - DNA, 25 bp, Rattus norvegicus
gattatcaagatatctgggccagtc

SEQ ID NO: 371317 - DNA, 25 bp, Rattus norvegicus
gattatcaagatttctgggccagtc

SEQ ID NO: 371318 - DNA, 25 bp, Rattus norvegicus
gattatcacatgaacctgggccaat

SEQ ID NO: 371319 - DNA, 25 bp, Rattus norvegicus
gattatcacatgtacctgggccaat

SEQ ID NO: 371320 - DNA, 25 bp, Rattus norvegicus
gattatcactagatcaggctgcaca

SEQ ID NO: 371321 - DNA, 25 bp, Rattus norvegicus
gattatcactagttcaggctgcaca

SEQ ID NO: 371322 - DNA, 25 bp, Rattus norvegicus
gattatcagaacactgtccagccgt

SEQ ID NO: 371323 - DNA, 25 bp, Rattus norvegicus
gattatcagaactctgtccagccgt

SEQ ID NO: 371324 - DNA, 25 bp, Rattus norvegicus
gattatcagcctaacaatgaccttg

SEQ ID NO: 371325 - DNA, 25 bp, Rattus norvegicus
gattatcagccttacaatgaccttg

SEQ ID NO: 371326 - DNA, 25 bp, Rattus norvegicus
gattatcagtcacgaaggcggcaaa

SEQ ID NO: 371327 - DNA, 25 bp, Rattus norvegicus
gattatcagtcaggaaggcggcaaa

SEQ ID NO: 371328 - DNA, 25 bp, Rattus norvegicus
gattatcatacaactgtcaaccagc

SEQ ID NO: 371329 - DNA, 25 bp, Rattus norvegicus
gattatcatacatctgtcaaccagc

SEQ ID NO: 371330 - DNA, 25 bp, Rattus norvegicus
gattatcattctcttaaagtgccag

SEQ ID NO: 371331 - DNA, 25 bp, Rattus norvegicus
gattatcattctgttaaagtgccag

SEQ ID NO: 371332 - DNA, 25 bp, Rattus norvegicus
gattatccagatccttacaccacat

SEQ ID NO: 371333 - DNA, 25 bp, Rattus norvegicus
gattatccagatgcttacaccacat

SEQ ID NO: 371334 - DNA, 25 bp, Rattus norvegicus
gattatccagcaaccgaatttcata

SEQ ID NO: 371335 - DNA, 25 bp, Rattus norvegicus
gattatccagcatccgaatttcata

SEQ ID NO: 371336 - DNA, 25 bp, Rattus norvegicus
gattatcccatccattcccatgtat

SEQ ID NO: 371337 - DNA, 25 bp, Rattus norvegicus
gattatcccatcgattcccatgtat

SEQ ID NO: 371338 - DNA, 25 bp, Rattus norvegicus
gattatccctagaccacagcagaga

SEQ ID NO: 371339 - DNA, 25 bp, Rattus norvegicus
gattatccctagaccctaaggtgtg

SEQ ID NO: 371340 - DNA, 25 bp, Rattus norvegicus
gattatccctagtccacagcagaga

SEQ ID NO: 371341 - DNA, 25 bp, Rattus norvegicus
gattatccctagtccctaaggtgtg

SEQ ID NO: 371342 - DNA, 25 bp, Rattus norvegicus
gattatcctcagagttgattgtcca

SEQ ID NO: 371343 - DNA, 25 bp, Rattus norvegicus
gattatcctcagtgttgattgtcca

SEQ ID NO: 371344 - DNA, 25 bp, Rattus norvegicus
gattatcctcgtcaacgcaggaaaa

SEQ ID NO: 371345 - DNA, 25 bp, Rattus norvegicus
gattatcctcgtgaacgcaggaaaa

SEQ ID NO: 371346 - DNA, 25 bp, Rattus norvegicus
gattatcctcttaacaattacctat

SEQ ID NO: 371347 - DNA, 25 bp, Rattus norvegicus
gattatcctctttacaattacctat

SEQ ID NO: 371348 - DNA, 25 bp, Rattus norvegicus
gattatcctgctctgtgtgaatcca

SEQ ID NO: 371349 - DNA, 25 bp, Rattus norvegicus
gattatcctgctgtgtgtgaatcca

SEQ ID NO: 371350 - DNA, 25 bp, Rattus norvegicus
gattatcctggacttcctggagaca

SEQ ID NO: 371351 - DNA, 25 bp, Rattus norvegicus
gattatcctggagttcctggagaca

SEQ ID NO: 371352 - DNA, 25 bp, Rattus norvegicus
gattatcctgttatcactctttagg

SEQ ID NO: 371353 - DNA, 25 bp, Rattus norvegicus
gattatcctgttttcactctttagg

SEQ ID NO: 371354 - DNA, 25 bp, Rattus norvegicus
gattatcgctttctgtctcattgag

SEQ ID NO: 371355 - DNA, 25 bp, Rattus norvegicus
gattatcgctttgtgtctcattgag

SEQ ID NO: 371356 - DNA, 25 bp, Rattus norvegicus
gattatctactgaagttatcattgt

SEQ ID NO: 371357 - DNA, 25 bp, Rattus norvegicus
gattatctactgtagttatcattgt

SEQ ID NO: 371358 - DNA, 25 bp, Rattus norvegicus
gattatctacttcgctttctttatg

SEQ ID NO: 371359 - DNA, 25 bp, Rattus norvegicus
gattatctacttggctttctttatg

SEQ ID NO: 371360 - DNA, 25 bp, Rattus norvegicus
gattatctatggattctgttaagga

SEQ ID NO: 371361 - DNA, 25 bp, Rattus norvegicus
gattatctatggtttctgttaagga

SEQ ID NO: 371362 - DNA, 25 bp, Rattus norvegicus
gattatctcttacctgaaatgcgtg

SEQ ID NO: 371363 - DNA, 25 bp, Rattus norvegicus
gattatctcttagctgaaatgcgtg

SEQ ID NO: 371364 - DNA, 25 bp, Rattus norvegicus
gattatctctttaacatacacacac

SEQ ID NO: 371365 - DNA, 25 bp, Rattus norvegicus
gattatctcttttacatacacacac

SEQ ID NO: 371366 - DNA, 25 bp, Rattus norvegicus
gattatctgaagcacaaggccctcc

SEQ ID NO: 371367 - DNA, 25 bp, Rattus norvegicus
gattatctgaaggacaaggccctcc

SEQ ID NO: 371368 - DNA, 25 bp, Rattus norvegicus
gattatctgggaaatcactcggtcc

SEQ ID NO: 371369 - DNA, 25 bp, Rattus norvegicus
gattatctgggatatcactcggtcc

SEQ ID NO: 371370 - DNA, 25 bp, Rattus norvegicus
gattatcttctcaagtctgtctcac

SEQ ID NO: 371371 - DNA, 25 bp, Rattus norvegicus
gattatcttctctagtctgtctcac

SEQ ID NO: 371372 - DNA, 25 bp, Rattus norvegicus
gattatcttgatcagttcctagcag

SEQ ID NO: 371373 - DNA, 25 bp, Rattus norvegicus
gattatcttgatgagttcctagcag

SEQ ID NO: 371374 - DNA, 25 bp, Rattus norvegicus
gattatcttgtgatcacctgctgtc

SEQ ID NO: 371375 - DNA, 25 bp, Rattus norvegicus
gattatcttgtgttcacctgctgtc

SEQ ID NO: 371376 - DNA, 25 bp, Rattus norvegicus
gattatctttagcactctgcattaa

SEQ ID NO: 371377 - DNA, 25 bp, Rattus norvegicus
gattatctttaggactctgcattaa

SEQ ID NO: 371378 - DNA, 25 bp, Rattus norvegicus
gattatgaaagcagcctccactctt

SEQ ID NO: 371379 - DNA, 25 bp, Rattus norvegicus
gattatgaaagctgcctccactctt

SEQ ID NO: 371380 - DNA, 25 bp, Rattus norvegicus
gattatgaaatcacccctcaaactc

SEQ ID NO: 371381 - DNA, 25 bp, Rattus norvegicus
gattatgaaatctcccctcaaactc

SEQ ID NO: 371382 - DNA, 25 bp, Rattus norvegicus
gattatgaatccaatataccagaca

SEQ ID NO: 371383 - DNA, 25 bp, Rattus norvegicus
gattatgaatcctatataccagaca

SEQ ID NO: 371384 - DNA, 25 bp, Rattus norvegicus
gattatgacagacaagccacaggca

SEQ ID NO: 371385 - DNA, 25 bp, Rattus norvegicus
gattatgacagagaagccacaggca

SEQ ID NO: 371386 - DNA, 25 bp, Rattus norvegicus
gattatgacaggaccttgagccgcc

SEQ ID NO: 371387 - DNA, 25 bp, Rattus norvegicus
gattatgacaggtccttgagccgcc

SEQ ID NO: 371388 - DNA, 25 bp, Rattus norvegicus
gattatgaccgaaatagacgttctc

SEQ ID NO: 371389 - DNA, 25 bp, Rattus norvegicus
gattatgaccgatatagacgttctc

SEQ ID NO: 371390 - DNA, 25 bp, Rattus norvegicus
gattatgactggcagtaatgctcat

SEQ ID NO: 371391 - DNA, 25 bp, Rattus norvegicus
gattatgactgggagtaatgctcat

SEQ ID NO: 371392 - DNA, 25 bp, Rattus norvegicus
gattatgatttaagccccacggaca

SEQ ID NO: 371393 - DNA, 25 bp, Rattus norvegicus
gattatgatttatgccccacggaca

SEQ ID NO: 371394 - DNA, 25 bp, Rattus norvegicus
gattatgcactgaatagctacacaa

SEQ ID NO: 371395 - DNA, 25 bp, Rattus norvegicus
gattatgcactgtatagctacacaa

SEQ ID NO: 371396 - DNA, 25 bp, Rattus norvegicus
gattatgcagacaacctcatcagcc

SEQ ID NO: 371397 - DNA, 25 bp, Rattus norvegicus
gattatgcagactacctcatcagcc

SEQ ID NO: 371398 - DNA, 25 bp, Rattus norvegicus
gattatgcagcgaggtccaaccgga

SEQ ID NO: 371399 - DNA, 25 bp, Rattus norvegicus
gattatgcagcgtggtccaaccgga

SEQ ID NO: 371400 - DNA, 25 bp, Rattus norvegicus
gattatgcaggcaatgacggaacta

SEQ ID NO: 371401 - DNA, 25 bp, Rattus norvegicus
gattatgcaggctatgacggaacta

SEQ ID NO: 371402 - DNA, 25 bp, Rattus norvegicus
gattatgcaggtccttcaactcact

SEQ ID NO: 371403 - DNA, 25 bp, Rattus norvegicus
gattatgcaggtgcttcaactcact

SEQ ID NO: 371404 - DNA, 25 bp, Rattus norvegicus
gattatgcagtaatagcttcctata

SEQ ID NO: 371405 - DNA, 25 bp, Rattus norvegicus
gattatgcagtattagcttcctata

SEQ ID NO: 371406 - DNA, 25 bp, Rattus norvegicus
gattatgcgtccagatgagtaccca

SEQ ID NO: 371407 - DNA, 25 bp, Rattus norvegicus
gattatgcgtcctgatgagtaccca

SEQ ID NO: 371408 - DNA, 25 bp, Rattus norvegicus
gattatgctaatatctctcacattt

SEQ ID NO: 371409 - DNA, 25 bp, Rattus norvegicus
gattatgctaatttctctcacattt

SEQ ID NO: 371410 - DNA, 25 bp, Rattus norvegicus
gattatggaaaccaccaccagcctg

SEQ ID NO: 371411 - DNA, 25 bp, Rattus norvegicus
gattatggaaacgaccaccagcctg

SEQ ID NO: 371412 - DNA, 25 bp, Rattus norvegicus
gattatggacagagcttggaaagat

SEQ ID NO: 371413 - DNA, 25 bp, Rattus norvegicus
gattatggacagtgcttggaaagat

SEQ ID NO: 371414 - DNA, 25 bp, Rattus norvegicus
gattatggacttatacagaggcaga

SEQ ID NO: 371415 - DNA, 25 bp, Rattus norvegicus
gattatggacttttacagaggcaga

SEQ ID NO: 371416 - DNA, 25 bp, Rattus norvegicus
gattatggcctgctattctgactct

SEQ ID NO: 371417 - DNA, 25 bp, Rattus norvegicus
gattatggcctggtattctgactct

SEQ ID NO: 371418 - DNA, 25 bp, Rattus norvegicus
gattatggctaactattcgcatcta

SEQ ID NO: 371419 - DNA, 25 bp, Rattus norvegicus
gattatggctaagtattcgcatcta

SEQ ID NO: 371420 - DNA, 25 bp, Rattus norvegicus
gattatggcttccagggacatcctt

SEQ ID NO: 371421 - DNA, 25 bp, Rattus norvegicus
gattatggcttcgagggacatcctt

SEQ ID NO: 371422 - DNA, 25 bp, Rattus norvegicus
gattatgggagacactgtacctgga

SEQ ID NO: 371423 - DNA, 25 bp, Rattus norvegicus
gattatgggagagactgtacctgga

SEQ ID NO: 371424 - DNA, 25 bp, Rattus norvegicus
gattatgggccacttgttcattttc

SEQ ID NO: 371425 - DNA, 25 bp, Rattus norvegicus
gattatgggccagttgttcattttc

SEQ ID NO: 371426 - DNA, 25 bp, Rattus norvegicus
gattatgggtcaaggttctgccact

SEQ ID NO: 371427 - DNA, 25 bp, Rattus norvegicus
gattatgggtcatggttctgccact

SEQ ID NO: 371428 - DNA, 25 bp, Rattus norvegicus
gattatggtataaccaaggcccagg

SEQ ID NO: 371429 - DNA, 25 bp, Rattus norvegicus
gattatggtatatccaaggcccagg

SEQ ID NO: 371430 - DNA, 25 bp, Rattus norvegicus
gattatgtaaatcctcttgctcttt

SEQ ID NO: 371431 - DNA, 25 bp, Rattus norvegicus
gattatgtaaatgctcttgctcttt

SEQ ID NO: 371432 - DNA, 25 bp, Rattus norvegicus
gattatgtcactatgcacgcgactt

SEQ ID NO: 371433 - DNA, 25 bp, Rattus norvegicus
gattatgtcactttgcacgcgactt

SEQ ID NO: 371434 - DNA, 25 bp, Rattus norvegicus
gattatgtccatctgacttcttcaa

SEQ ID NO: 371435 - DNA, 25 bp, Rattus norvegicus
gattatgtccatgtgacttcttcaa

SEQ ID NO: 371436 - DNA, 25 bp, Rattus norvegicus
gattatgtcgtcaccatgtatcagc

SEQ ID NO: 371437 - DNA, 25 bp, Rattus norvegicus
gattatgtcgtctccatgtatcagc

SEQ ID NO: 371438 - DNA, 25 bp, Rattus norvegicus
gattatgtggctccgtcttagtgtc

SEQ ID NO: 371439 - DNA, 25 bp, Rattus norvegicus
gattatgtggctgcgtcttagtgtc

SEQ ID NO: 371440 - DNA, 25 bp, Rattus norvegicus
gattatgtgggcatcgaccaacaat

SEQ ID NO: 371441 - DNA, 25 bp, Rattus norvegicus
gattatgtgggcttcgaccaacaat

SEQ ID NO: 371442 - DNA, 25 bp, Rattus norvegicus
gattatgttctcagcagtgttacca

SEQ ID NO: 371443 - DNA, 25 bp, Rattus norvegicus
gattatgttctctgcagtgttacca

SEQ ID NO: 371444 - DNA, 25 bp, Rattus norvegicus
gattatgttgtgctctttattgcca

SEQ ID NO: 371445 - DNA, 25 bp, Rattus norvegicus
gattatgttgtggtctttattgcca

SEQ ID NO: 371446 - DNA, 25 bp, Rattus norvegicus
gattatgtttttagacccttccaca

SEQ ID NO: 371447 - DNA, 25 bp, Rattus norvegicus
gattatgttttttgacccttccaca

SEQ ID NO: 371448 - DNA, 25 bp, Rattus norvegicus
gattattacgtcaagcctgtggcct

SEQ ID NO: 371449 - DNA, 25 bp, Rattus norvegicus
gattattacgtctagcctgtggcct

SEQ ID NO: 371450 - DNA, 25 bp, Rattus norvegicus
gattattactgtctagttcatggat

SEQ ID NO: 371451 - DNA, 25 bp, Rattus norvegicus
gattattactgtgtagttcatggat

SEQ ID NO: 371452 - DNA, 25 bp, Rattus norvegicus
gattattagcagatccacctcttgg

SEQ ID NO: 371453 - DNA, 25 bp, Rattus norvegicus
gattattagcagttccacctcttgg

SEQ ID NO: 371454 - DNA, 25 bp, Rattus norvegicus
gattattagtccattttgaaagcca

SEQ ID NO: 371455 - DNA, 25 bp, Rattus norvegicus
gattattagtcctttttgaaagcca

SEQ ID NO: 371456 - DNA, 25 bp, Rattus norvegicus
gattattatcgcagcaaactcacaa

SEQ ID NO: 371457 - DNA, 25 bp, Rattus norvegicus
gattattatcgctgcaaactcacaa

SEQ ID NO: 371458 - DNA, 25 bp, Rattus norvegicus
gattattcagtcattcaaccttcca

SEQ ID NO: 371459 - DNA, 25 bp, Rattus norvegicus
gattattcagtctttcaaccttcca

SEQ ID NO: 371460 - DNA, 25 bp, Rattus norvegicus
gattattcattaaccctaaattctg

SEQ ID NO: 371461 - DNA, 25 bp, Rattus norvegicus
gattattcattatccctaaattctg

SEQ ID NO: 371462 - DNA, 25 bp, Rattus norvegicus
gattattccacacgagacacgtacg

SEQ ID NO: 371463 - DNA, 25 bp, Rattus norvegicus
gattattccacaggagacacgtacg

SEQ ID NO: 371464 - DNA, 25 bp, Rattus norvegicus
gattattccactccaaatgctcaac

SEQ ID NO: 371465 - DNA, 25 bp, Rattus norvegicus
gattattccactgcaaatgctcaac

SEQ ID NO: 371466 - DNA, 25 bp, Rattus norvegicus
gattattccattactggcagactct

SEQ ID NO: 371467 - DNA, 25 bp, Rattus norvegicus
gattattccatttctggcagactct

SEQ ID NO: 371468 - DNA, 25 bp, Rattus norvegicus
gattattcctctataggacgggtgt

SEQ ID NO: 371469 - DNA, 25 bp, Rattus norvegicus
gattattcctctttaggacgggtgt

SEQ ID NO: 371470 - DNA, 25 bp, Rattus norvegicus
gattattccttgactgtactttagt

SEQ ID NO: 371471 - DNA, 25 bp, Rattus norvegicus
gattattccttgtctgtactttagt

SEQ ID NO: 371472 - DNA, 25 bp, Rattus norvegicus
gattattctacaaattctatctgaa

SEQ ID NO: 371473 - DNA, 25 bp, Rattus norvegicus
gattattctacatattctatctgaa

SEQ ID NO: 371474 - DNA, 25 bp, Rattus norvegicus
gattattcttctcatcgtaggattt

SEQ ID NO: 371475 - DNA, 25 bp, Rattus norvegicus
gattattcttctgatcgtaggattt

SEQ ID NO: 371476 - DNA, 25 bp, Rattus norvegicus
gattattcttgtaacttcttggcaa

SEQ ID NO: 371477 - DNA, 25 bp, Rattus norvegicus
gattattcttgttacttcttggcaa

SEQ ID NO: 371478 - DNA, 25 bp, Rattus norvegicus
gattattgaatgagagcccctctat

SEQ ID NO: 371479 - DNA, 25 bp, Rattus norvegicus
gattattgaatgtgagcccctctat

SEQ ID NO: 371480 - DNA, 25 bp, Rattus norvegicus
gattattgcagacgcttttctcttt

SEQ ID NO: 371481 - DNA, 25 bp, Rattus norvegicus
gattattgcagaggcttttctcttt

SEQ ID NO: 371482 - DNA, 25 bp, Rattus norvegicus
gattattgcctcctataagcacaca

SEQ ID NO: 371483 - DNA, 25 bp, Rattus norvegicus
gattattgcctcgtataagcacaca

SEQ ID NO: 371484 - DNA, 25 bp, Rattus norvegicus
gattattggcagagcttgcttcctc

SEQ ID NO: 371485 - DNA, 25 bp, Rattus norvegicus
gattattggcagtgcttgcttcctc

SEQ ID NO: 371486 - DNA, 25 bp, Rattus norvegicus
gattattgggagattgacctttcaa

SEQ ID NO: 371487 - DNA, 25 bp, Rattus norvegicus
gattattgggagtttgacctttcaa

SEQ ID NO: 371488 - DNA, 25 bp, Rattus norvegicus
gattattgtctcctattcaagtgac

SEQ ID NO: 371489 - DNA, 25 bp, Rattus norvegicus
gattattgtctcgtattcaagtgac

SEQ ID NO: 371490 - DNA, 25 bp, Rattus norvegicus
gattatttaataagtggctcggcag

SEQ ID NO: 371491 - DNA, 25 bp, Rattus norvegicus
gattatttaatatgtggctcggcag

SEQ ID NO: 371492 - DNA, 25 bp, Rattus norvegicus
gattatttaatgagctcctgaagag

SEQ ID NO: 371493 - DNA, 25 bp, Rattus norvegicus
gattatttaatgtgctcctgaagag

SEQ ID NO: 371494 - DNA, 25 bp, Rattus norvegicus
gattatttacaacagctcaccggag

SEQ ID NO: 371495 - DNA, 25 bp, Rattus norvegicus
gattatttacaagagctcaccggag

SEQ ID NO: 371496 - DNA, 25 bp, Rattus norvegicus
gattatttatatatctgttacctgt

SEQ ID NO: 371497 - DNA, 25 bp, Rattus norvegicus
gattatttatatttctgttacctgt

SEQ ID NO: 371498 - DNA, 25 bp, Rattus norvegicus
gattatttattgacagccacatgca

SEQ ID NO: 371499 - DNA, 25 bp, Rattus norvegicus
gattatttattgtcagccacatgca

SEQ ID NO: 371500 - DNA, 25 bp, Rattus norvegicus
gattatttcattattctgccacgca

SEQ ID NO: 371501 - DNA, 25 bp, Rattus norvegicus
gattatttcatttttctgccacgca

SEQ ID NO: 371502 - DNA, 25 bp, Rattus norvegicus
gattatttctctcttgatttatacc

SEQ ID NO: 371503 - DNA, 25 bp, Rattus norvegicus
gattatttctctgttgatttatacc

SEQ ID NO: 371504 - DNA, 25 bp, Rattus norvegicus
gattattttattctcgagtcctcga

SEQ ID NO: 371505 - DNA, 25 bp, Rattus norvegicus
gattattttattgtcgagtcctcga

SEQ ID NO: 371506 - DNA, 25 bp, Rattus norvegicus
gattattttcatacatctctaaaga

SEQ ID NO: 371507 - DNA, 25 bp, Rattus norvegicus
gattattttcataccttagtcacag

SEQ ID NO: 371508 - DNA, 25 bp, Rattus norvegicus
gattattttcatcctgccttctgtt

SEQ ID NO: 371509 - DNA, 25 bp, Rattus norvegicus
gattattttcatgctgccttctgtt

SEQ ID NO: 371510 - DNA, 25 bp, Rattus norvegicus
gattattttcattcatctctaaaga

SEQ ID NO: 371511 - DNA, 25 bp, Rattus norvegicus
gattattttcattccttagtcacag

SEQ ID NO: 371512 - DNA, 25 bp, Rattus norvegicus
gattattttcctatttaagacactg

SEQ ID NO: 371513 - DNA, 25 bp, Rattus norvegicus
gattattttcctttttaagacactg

SEQ ID NO: 371514 - DNA, 25 bp, Rattus norvegicus
gattattttcttaccttctatggca

SEQ ID NO: 371515 - DNA, 25 bp, Rattus norvegicus
gattattttcttcatgtcatctaga

SEQ ID NO: 371516 - DNA, 25 bp, Rattus norvegicus
gattattttcttgatgtcatctaga

SEQ ID NO: 371517 - DNA, 25 bp, Rattus norvegicus
gattattttctttccttctatggca

SEQ ID NO: 371518 - DNA, 25 bp, Rattus norvegicus
gattattttggtacctatcctgact

SEQ ID NO: 371519 - DNA, 25 bp, Rattus norvegicus
gattattttggttcctatcctgact

SEQ ID NO: 371520 - DNA, 25 bp, Rattus norvegicus
gattatttttggacactcaggatac

SEQ ID NO: 371521 - DNA, 25 bp, Rattus norvegicus
gattatttttggtcactcaggatac

SEQ ID NO: 371522 - DNA, 25 bp, Rattus norvegicus
gattattttttactttctgcctgag

SEQ ID NO: 371523 - DNA, 25 bp, Rattus norvegicus
gattattttttagtttctgcctgag

SEQ ID NO: 371524 - DNA, 25 bp, Rattus norvegicus
gattcaaaaccaacagccatcactc

SEQ ID NO: 371525 - DNA, 25 bp, Rattus norvegicus
gattcaaaaccatcagccatcactc

SEQ ID NO: 371526 - DNA, 25 bp, Rattus norvegicus
gattcaaaattcctcaagcatgcaa

SEQ ID NO: 371527 - DNA, 25 bp, Rattus norvegicus
gattcaaaattcgtcaagcatgcaa

SEQ ID NO: 371528 - DNA, 25 bp, Rattus norvegicus
gattcaaacctaccagtgatacaga

SEQ ID NO: 371529 - DNA, 25 bp, Rattus norvegicus
gattcaaacctagcagtgatacaga

SEQ ID NO: 371530 - DNA, 25 bp, Rattus norvegicus
gattcaaagaatattcccacagttt

SEQ ID NO: 371531 - DNA, 25 bp, Rattus norvegicus
gattcaaagaattttcccacagttt

SEQ ID NO: 371532 - DNA, 25 bp, Rattus norvegicus
gattcaaagggaatgcttcgctgcc

SEQ ID NO: 371533 - DNA, 25 bp, Rattus norvegicus
gattcaaagggattgcttcgctgcc

SEQ ID NO: 371534 - DNA, 25 bp, Rattus norvegicus
gattcaaatcgcaacctgagctctc

SEQ ID NO: 371535 - DNA, 25 bp, Rattus norvegicus
gattcaaatcgctacctgagctctc

SEQ ID NO: 371536 - DNA, 25 bp, Rattus norvegicus
gattcaacagtgcagtttgttttct

SEQ ID NO: 371537 - DNA, 25 bp, Rattus norvegicus
gattcaacagtggagtttgttttct

SEQ ID NO: 371538 - DNA, 25 bp, Rattus norvegicus
gattcaaccctgattagccacagac

SEQ ID NO: 371539 - DNA, 25 bp, Rattus norvegicus
gattcaaccctgtttagccacagac

SEQ ID NO: 371540 - DNA, 25 bp, Rattus norvegicus
gattcaactagcattcttccttctt

SEQ ID NO: 371541 - DNA, 25 bp, Rattus norvegicus
gattcaactagctttcttccttctt

SEQ ID NO: 371542 - DNA, 25 bp, Rattus norvegicus
gattcaactgtcattttctcaaact

SEQ ID NO: 371543 - DNA, 25 bp, Rattus norvegicus
gattcaactgtctttttctcaaact

SEQ ID NO: 371544 - DNA, 25 bp, Rattus norvegicus
gattcaacttcaacttcctgagagc

SEQ ID NO: 371545 - DNA, 25 bp, Rattus norvegicus
gattcaacttcatcttcctgagagc

SEQ ID NO: 371546 - DNA, 25 bp, Rattus norvegicus
gattcaagaagcatcttccctggga

SEQ ID NO: 371547 - DNA, 25 bp, Rattus norvegicus
gattcaagaagcttcttccctggga

SEQ ID NO: 371548 - DNA, 25 bp, Rattus norvegicus
gattcaagcagcagctgaaccctgc

SEQ ID NO: 371549 - DNA, 25 bp, Rattus norvegicus
gattcaagcagctgctgaaccctgc

SEQ ID NO: 371550 - DNA, 25 bp, Rattus norvegicus
gattcaagcattccacccggtggaa

SEQ ID NO: 371551 - DNA, 25 bp, Rattus norvegicus
gattcaagcattgcacccggtggaa

SEQ ID NO: 371552 - DNA, 25 bp, Rattus norvegicus
gattcaagccggctagattcctttg

SEQ ID NO: 371553 - DNA, 25 bp, Rattus norvegicus
gattcaagccgggtagattcctttg

SEQ ID NO: 371554 - DNA, 25 bp, Rattus norvegicus
gattcaaggatgataaaagcccctg

SEQ ID NO: 371555 - DNA, 25 bp, Rattus norvegicus
gattcaaggatgttaaaagcccctg

SEQ ID NO: 371556 - DNA, 25 bp, Rattus norvegicus
gattcaaggctgagcgcgcagactt

SEQ ID NO: 371557 - DNA, 25 bp, Rattus norvegicus
gattcaaggctgtgcgcgcagactt

SEQ ID NO: 371558 - DNA, 25 bp, Rattus norvegicus
gattcaaggtgtatgccaacggcca

SEQ ID NO: 371559 - DNA, 25 bp, Rattus norvegicus
gattcaaggtgtttgccaacggcca

SEQ ID NO: 371560 - DNA, 25 bp, Rattus norvegicus
gattcaaggtttccatgacttcatt

SEQ ID NO: 371561 - DNA, 25 bp, Rattus norvegicus
gattcaaggtttgcatgacttcatt

SEQ ID NO: 371562 - DNA, 25 bp, Rattus norvegicus
gattcaagtaatcagagcacgcgct

SEQ ID NO: 371563 - DNA, 25 bp, Rattus norvegicus
gattcaagtaatgagagcacgcgct

SEQ ID NO: 371564 - DNA, 25 bp, Rattus norvegicus
gattcaagtcccagccttgaaggga

SEQ ID NO: 371565 - DNA, 25 bp, Rattus norvegicus
gattcaagtccctgccttgaaggga

SEQ ID NO: 371566 - DNA, 25 bp, Rattus norvegicus
gattcaagtttcatgtcagccagac

SEQ ID NO: 371567 - DNA, 25 bp, Rattus norvegicus
gattcaagtttcttgtcagccagac

SEQ ID NO: 371568 - DNA, 25 bp, Rattus norvegicus
gattcaatcccaatggacttccaag

SEQ ID NO: 371569 - DNA, 25 bp, Rattus norvegicus
gattcaatcccattggacttccaag

SEQ ID NO: 371570 - DNA, 25 bp, Rattus norvegicus
gattcaatccccagggatccactct

SEQ ID NO: 371571 - DNA, 25 bp, Rattus norvegicus
gattcaatcccctgggatccactct

SEQ ID NO: 371572 - DNA, 25 bp, Rattus norvegicus
gattcaatttccacagagccttgct

SEQ ID NO: 371573 - DNA, 25 bp, Rattus norvegicus
gattcaatttcctcagagccttgct

SEQ ID NO: 371574 - DNA, 25 bp, Rattus norvegicus
gattcacaaagccaaatcctggagt

SEQ ID NO: 371575 - DNA, 25 bp, Rattus norvegicus
gattcacaaagcgaaatcctggagt

SEQ ID NO: 371576 - DNA, 25 bp, Rattus norvegicus
gattcacaatgaacacaaaacatgt

SEQ ID NO: 371577 - DNA, 25 bp, Rattus norvegicus
gattcacaatgatcacaaaacatgt

SEQ ID NO: 371578 - DNA, 25 bp, Rattus norvegicus
gattcacactctagcagatctcatc

SEQ ID NO: 371579 - DNA, 25 bp, Rattus norvegicus
gattcacactcttgcagatctcatc

SEQ ID NO: 371580 - DNA, 25 bp, Rattus norvegicus
gattcacagaacaggaaagtgcagt

SEQ ID NO: 371581 - DNA, 25 bp, Rattus norvegicus
gattcacagaactggaaagtgcagt

SEQ ID NO: 371582 - DNA, 25 bp, Rattus norvegicus
gattcacagagaagccttggcacgc

SEQ ID NO: 371583 - DNA, 25 bp, Rattus norvegicus
gattcacagagatgccttggcacgc

SEQ ID NO: 371584 - DNA, 25 bp, Rattus norvegicus
gattcacagagtccatgacacgctg

SEQ ID NO: 371585 - DNA, 25 bp, Rattus norvegicus
gattcacagagtgcatgacacgctg

SEQ ID NO: 371586 - DNA, 25 bp, Rattus norvegicus
gattcacagggacattaaagcaggg

SEQ ID NO: 371587 - DNA, 25 bp, Rattus norvegicus
gattcacagggagattaaagcaggg

SEQ ID NO: 371588 - DNA, 25 bp, Rattus norvegicus
gattcacagggtatcatttgcattt

SEQ ID NO: 371589 - DNA, 25 bp, Rattus norvegicus
gattcacagggtttcatttgcattt

SEQ ID NO: 371590 - DNA, 25 bp, Rattus norvegicus
gattcacagttactctaccacagta

SEQ ID NO: 371591 - DNA, 25 bp, Rattus norvegicus
gattcacagttagtctaccacagta

SEQ ID NO: 371592 - DNA, 25 bp, Rattus norvegicus
gattcacatagtcctgctgctgctg

SEQ ID NO: 371593 - DNA, 25 bp, Rattus norvegicus
gattcacatagtgctgctgctgctg

SEQ ID NO: 371594 - DNA, 25 bp, Rattus norvegicus
gattcacatattattccagccttcc

SEQ ID NO: 371595 - DNA, 25 bp, Rattus norvegicus
gattcacatatttttccagccttcc

SEQ ID NO: 371596 - DNA, 25 bp, Rattus norvegicus
gattcacatcctctcaagttaggag

SEQ ID NO: 371597 - DNA, 25 bp, Rattus norvegicus
gattcacatcctgtcaagttaggag

SEQ ID NO: 371598 - DNA, 25 bp, Rattus norvegicus
gattcacatcgaagacccgcctttc

SEQ ID NO: 371599 - DNA, 25 bp, Rattus norvegicus
gattcacatcgatgacccgcctttc

SEQ ID NO: 371600 - DNA, 25 bp, Rattus norvegicus
gattcaccaagacatctccagggtt

SEQ ID NO: 371601 - DNA, 25 bp, Rattus norvegicus
gattcaccaagagatctccagggtt

SEQ ID NO: 371602 - DNA, 25 bp, Rattus norvegicus
gattcaccacagattagatgcccta

SEQ ID NO: 371603 - DNA, 25 bp, Rattus norvegicus
gattcaccacagtttagatgcccta

SEQ ID NO: 371604 - DNA, 25 bp, Rattus norvegicus
gattcaccatctccttctggtggga

SEQ ID NO: 371605 - DNA, 25 bp, Rattus norvegicus
gattcaccatctgcttctggtggga

SEQ ID NO: 371606 - DNA, 25 bp, Rattus norvegicus
gattcacccactaccagggagatat

SEQ ID NO: 371607 - DNA, 25 bp, Rattus norvegicus
gattcacccacttccagggagatat

SEQ ID NO: 371608 - DNA, 25 bp, Rattus norvegicus
gattcacccatcacttggattggat

SEQ ID NO: 371609 - DNA, 25 bp, Rattus norvegicus
gattcacccatctcttggattggat

SEQ ID NO: 371610 - DNA, 25 bp, Rattus norvegicus
gattcaccctacactggactaggag

SEQ ID NO: 371611 - DNA, 25 bp, Rattus norvegicus
gattcaccctactctggactaggag

SEQ ID NO: 371612 - DNA, 25 bp, Rattus norvegicus
gattcaccggagctgcagcttgaga

SEQ ID NO: 371613 - DNA, 25 bp, Rattus norvegicus
gattcaccggaggtgcagcttgaga

SEQ ID NO: 371614 - DNA, 25 bp, Rattus norvegicus
gattcacctacaccacgcttgtgga

SEQ ID NO: 371615 - DNA, 25 bp, Rattus norvegicus
gattcacctacagcacgcttgtgga

SEQ ID NO: 371616 - DNA, 25 bp, Rattus norvegicus
gattcacctgagcagaggcaaccat

SEQ ID NO: 371617 - DNA, 25 bp, Rattus norvegicus
gattcacctgaggagaggcaaccat

SEQ ID NO: 371618 - DNA, 25 bp, Rattus norvegicus
gattcacgaacaatggagctgctct

SEQ ID NO: 371619 - DNA, 25 bp, Rattus norvegicus
gattcacgaacattggagctgctct

SEQ ID NO: 371620 - DNA, 25 bp, Rattus norvegicus
gattcacgaactctgcggttgctaa

SEQ ID NO: 371621 - DNA, 25 bp, Rattus norvegicus
gattcacgaactgtgcggttgctaa

SEQ ID NO: 371622 - DNA, 25 bp, Rattus norvegicus
gattcacgccagagagcccattagt

SEQ ID NO: 371623 - DNA, 25 bp, Rattus norvegicus
gattcacgccagtgagcccattagt

SEQ ID NO: 371624 - DNA, 25 bp, Rattus norvegicus
gattcacgcggtccacacagtaggt

SEQ ID NO: 371625 - DNA, 25 bp, Rattus norvegicus
gattcacgcggtgcacacagtaggt

SEQ ID NO: 371626 - DNA, 25 bp, Rattus norvegicus
gattcacggagaacaggcggccctg

SEQ ID NO: 371627 - DNA, 25 bp, Rattus norvegicus
gattcacggagatcaggcggccctg

SEQ ID NO: 371628 - DNA, 25 bp, Rattus norvegicus
gattcactaggcaatttttactgta

SEQ ID NO: 371629 - DNA, 25 bp, Rattus norvegicus
gattcactaggctatttttactgta

SEQ ID NO: 371630 - DNA, 25 bp, Rattus norvegicus
gattcactcctcattgtgggaacta

SEQ ID NO: 371631 - DNA, 25 bp, Rattus norvegicus
gattcactcctctttgtgggaacta

SEQ ID NO: 371632 - DNA, 25 bp, Rattus norvegicus
gattcactcgttatacctcattttg

SEQ ID NO: 371633 - DNA, 25 bp, Rattus norvegicus
gattcactcgttttacctcattttg

SEQ ID NO: 371634 - DNA, 25 bp, Rattus norvegicus
gattcactctctcggtcttttgagt

SEQ ID NO: 371635 - DNA, 25 bp, Rattus norvegicus
gattcactctctgggtcttttgagt

SEQ ID NO: 371636 - DNA, 25 bp, Rattus norvegicus
gattcactgaagcaagtcttggtta

SEQ ID NO: 371637 - DNA, 25 bp, Rattus norvegicus
gattcactgaaggaagtcttggtta

SEQ ID NO: 371638 - DNA, 25 bp, Rattus norvegicus
gattcactgatcaaggctaccatag

SEQ ID NO: 371639 - DNA, 25 bp, Rattus norvegicus
gattcactgatctaggctaccatag

SEQ ID NO: 371640 - DNA, 25 bp, Rattus norvegicus
gattcactggttaatgacatcatgc

SEQ ID NO: 371641 - DNA, 25 bp, Rattus norvegicus
gattcactggtttatgacatcatgc

SEQ ID NO: 371642 - DNA, 25 bp, Rattus norvegicus
gattcacttgggatttctcttggat

SEQ ID NO: 371643 - DNA, 25 bp, Rattus norvegicus
gattcacttgggttttctcttggat

SEQ ID NO: 371644 - DNA, 25 bp, Rattus norvegicus
gattcactttctcggtaggcaaaca

SEQ ID NO: 371645 - DNA, 25 bp, Rattus norvegicus
gattcactttctgggtaggcaaaca

SEQ ID NO: 371646 - DNA, 25 bp, Rattus norvegicus
gattcactttgtcggattctcagaa

SEQ ID NO: 371647 - DNA, 25 bp, Rattus norvegicus
gattcactttgtgggattctcagaa

SEQ ID NO: 371648 - DNA, 25 bp, Rattus norvegicus
gattcagaaccactgtgtaatgtgt

SEQ ID NO: 371649 - DNA, 25 bp, Rattus norvegicus
gattcagaaccagtgtgtaatgtgt

SEQ ID NO: 371650 - DNA, 25 bp, Rattus norvegicus
gattcagaagcactcagagtcctca

SEQ ID NO: 371651 - DNA, 25 bp, Rattus norvegicus
gattcagaagcagtcagagtcctca

SEQ ID NO: 371652 - DNA, 25 bp, Rattus norvegicus
gattcagaatctaccattttttccc

SEQ ID NO: 371653 - DNA, 25 bp, Rattus norvegicus
gattcagaatcttccattttttccc

SEQ ID NO: 371654 - DNA, 25 bp, Rattus norvegicus
gattcagaatgcaggctttgttact

SEQ ID NO: 371655 - DNA, 25 bp, Rattus norvegicus
gattcagaatgctggctttgttact

SEQ ID NO: 371656 - DNA, 25 bp, Rattus norvegicus
gattcagaattgcagtgatatccct

SEQ ID NO: 371657 - DNA, 25 bp, Rattus norvegicus
gattcagaattggagtgatatccct

SEQ ID NO: 371658 - DNA, 25 bp, Rattus norvegicus
gattcagaccttcaaagctttctca

SEQ ID NO: 371659 - DNA, 25 bp, Rattus norvegicus
gattcagaccttgaaagctttctca

SEQ ID NO: 371660 - DNA, 25 bp, Rattus norvegicus
gattcagacgttaagcggctccagg

SEQ ID NO: 371661 - DNA, 25 bp, Rattus norvegicus
gattcagacgtttagcggctccagg

SEQ ID NO: 371662 - DNA, 25 bp, Rattus norvegicus
gattcagagaatacctcctcagaga

SEQ ID NO: 371663 - DNA, 25 bp, Rattus norvegicus
gattcagagaattcctcctcagaga

SEQ ID NO: 371664 - DNA, 25 bp, Rattus norvegicus
gattcagagattcattagtgacaca

SEQ ID NO: 371665 - DNA, 25 bp, Rattus norvegicus
gattcagagattgattagtgacaca

SEQ ID NO: 371666 - DNA, 25 bp, Rattus norvegicus
gattcagagcacactgcatgttccc

SEQ ID NO: 371667 - DNA, 25 bp, Rattus norvegicus
gattcagagcactctgcatgttccc

SEQ ID NO: 371668 - DNA, 25 bp, Rattus norvegicus
gattcagaggtgcttccagctcgtc

SEQ ID NO: 371669 - DNA, 25 bp, Rattus norvegicus
gattcagaggtggttccagctcgtc

SEQ ID NO: 371670 - DNA, 25 bp, Rattus norvegicus
gattcagagtctagatgaagtcacc

SEQ ID NO: 371671 - DNA, 25 bp, Rattus norvegicus
gattcagagtcttgatgaagtcacc

SEQ ID NO: 371672 - DNA, 25 bp, Rattus norvegicus
gattcagatgatcccaggagctcgg

SEQ ID NO: 371673 - DNA, 25 bp, Rattus norvegicus
gattcagatgatgccaggagctcgg

SEQ ID NO: 371674 - DNA, 25 bp, Rattus norvegicus
gattcagatgctcagtccccaagtc

SEQ ID NO: 371675 - DNA, 25 bp, Rattus norvegicus
gattcagatgctgagtccccaagtc

SEQ ID NO: 371676 - DNA, 25 bp, Rattus norvegicus
gattcagattttcagtaactcagta

SEQ ID NO: 371677 - DNA, 25 bp, Rattus norvegicus
gattcagattttgagtaactcagta

SEQ ID NO: 371678 - DNA, 25 bp, Rattus norvegicus
gattcagcaaaacaactaccccgtg

SEQ ID NO: 371679 - DNA, 25 bp, Rattus norvegicus
gattcagcaaaagaactaccccgtg

SEQ ID NO: 371680 - DNA, 25 bp, Rattus norvegicus
gattcagcacttccaagggcctttg

SEQ ID NO: 371681 - DNA, 25 bp, Rattus norvegicus
gattcagcacttgcaagggcctttg

SEQ ID NO: 371682 - DNA, 25 bp, Rattus norvegicus
gattcagcagaaacgggagctgcag

SEQ ID NO: 371683 - DNA, 25 bp, Rattus norvegicus
gattcagcagaatcgggagctgcag

SEQ ID NO: 371684 - DNA, 25 bp, Rattus norvegicus
gattcagcatgaagtgggcacaata

SEQ ID NO: 371685 - DNA, 25 bp, Rattus norvegicus
gattcagcatgatgtgggcacaata

SEQ ID NO: 371686 - DNA, 25 bp, Rattus norvegicus
gattcagcattcctttctttgccag

SEQ ID NO: 371687 - DNA, 25 bp, Rattus norvegicus
gattcagcattcgtttctttgccag

SEQ ID NO: 371688 - DNA, 25 bp, Rattus norvegicus
gattcagccgaacctttcactaacc

SEQ ID NO: 371689 - DNA, 25 bp, Rattus norvegicus
gattcagccgaagctttcactaacc

SEQ ID NO: 371690 - DNA, 25 bp, Rattus norvegicus
gattcagccgtacagatgctttctt

SEQ ID NO: 371691 - DNA, 25 bp, Rattus norvegicus
gattcagccgtagagatgctttctt

SEQ ID NO: 371692 - DNA, 25 bp, Rattus norvegicus
gattcagcgcagcagtgcttagcca

SEQ ID NO: 371693 - DNA, 25 bp, Rattus norvegicus
gattcagcgcaggagtgcttagcca

SEQ ID NO: 371694 - DNA, 25 bp, Rattus norvegicus
gattcagcgctcacccagagacata

SEQ ID NO: 371695 - DNA, 25 bp, Rattus norvegicus
gattcagcgctctcccagagacata

SEQ ID NO: 371696 - DNA, 25 bp, Rattus norvegicus
gattcagctcttaagctaccatgtg

SEQ ID NO: 371697 - DNA, 25 bp, Rattus norvegicus
gattcagctcttctggtttgggtcc

SEQ ID NO: 371698 - DNA, 25 bp, Rattus norvegicus
gattcagctcttgtggtttgggtcc

SEQ ID NO: 371699 - DNA, 25 bp, Rattus norvegicus
gattcagctctttagctaccatgtg

SEQ ID NO: 371700 - DNA, 25 bp, Rattus norvegicus
gattcagctgcaatggcttctgagc

SEQ ID NO: 371701 - DNA, 25 bp, Rattus norvegicus
gattcagctgcattggcttctgagc

SEQ ID NO: 371702 - DNA, 25 bp, Rattus norvegicus
gattcaggacagagaaactgcccat

SEQ ID NO: 371703 - DNA, 25 bp, Rattus norvegicus
gattcaggacagtgaaactgcccat

SEQ ID NO: 371704 - DNA, 25 bp, Rattus norvegicus
gattcaggactgagcccgtagaggt

SEQ ID NO: 371705 - DNA, 25 bp, Rattus norvegicus
gattcaggactgtgcccgtagaggt

SEQ ID NO: 371706 - DNA, 25 bp, Rattus norvegicus
gattcaggagaaaattccgcgcggg

SEQ ID NO: 371707 - DNA, 25 bp, Rattus norvegicus
gattcaggagaatattccgcgcggg

SEQ ID NO: 371708 - DNA, 25 bp, Rattus norvegicus
gattcaggagacataccaggactct

SEQ ID NO: 371709 - DNA, 25 bp, Rattus norvegicus
gattcaggagacttaccaggactct

SEQ ID NO: 371710 - DNA, 25 bp, Rattus norvegicus
gattcaggatcaacattatgcgttc

SEQ ID NO: 371711 - DNA, 25 bp, Rattus norvegicus
gattcaggatcacaggttccttccc

SEQ ID NO: 371712 - DNA, 25 bp, Rattus norvegicus
gattcaggatcagaggttccttccc

SEQ ID NO: 371713 - DNA, 25 bp, Rattus norvegicus
gattcaggatcatcattatgcgttc

SEQ ID NO: 371714 - DNA, 25 bp, Rattus norvegicus
gattcaggatctctctaagtacgtt

SEQ ID NO: 371715 - DNA, 25 bp, Rattus norvegicus
gattcaggatctgtctaagtacgtt

SEQ ID NO: 371716 - DNA, 25 bp, Rattus norvegicus
gattcaggattcagggaccctcctg

SEQ ID NO: 371717 - DNA, 25 bp, Rattus norvegicus
gattcaggattctgggaccctcctg

SEQ ID NO: 371718 - DNA, 25 bp, Rattus norvegicus
gattcaggccctatagcttgggagg

SEQ ID NO: 371719 - DNA, 25 bp, Rattus norvegicus
gattcaggccctttagcttgggagg

SEQ ID NO: 371720 - DNA, 25 bp, Rattus norvegicus
gattcaggcctcagaggagcccttg

SEQ ID NO: 371721 - DNA, 25 bp, Rattus norvegicus
gattcaggcctctgaggagcccttg

SEQ ID NO: 371722 - DNA, 25 bp, Rattus norvegicus
gattcaggctgtattgcttaccagg

SEQ ID NO: 371723 - DNA, 25 bp, Rattus norvegicus
gattcaggctgttttgcttaccagg

SEQ ID NO: 371724 - DNA, 25 bp, Rattus norvegicus
gattcagggaacaatgcaccagtgc

SEQ ID NO: 371725 - DNA, 25 bp, Rattus norvegicus
gattcagggaactatgcaccagtgc

SEQ ID NO: 371726 - DNA, 25 bp, Rattus norvegicus
gattcagggatcagcttacttcata

SEQ ID NO: 371727 - DNA, 25 bp, Rattus norvegicus
gattcagggatctgcttacttcata

SEQ ID NO: 371728 - DNA, 25 bp, Rattus norvegicus
gattcaggtaacctagtcaggcttt

SEQ ID NO: 371729 - DNA, 25 bp, Rattus norvegicus
gattcaggtaacgtagtcaggcttt

SEQ ID NO: 371730 - DNA, 25 bp, Rattus norvegicus
gattcaggtacacaactggagccca

SEQ ID NO: 371731 - DNA, 25 bp, Rattus norvegicus
gattcaggtacagaactggagccca

SEQ ID NO: 371732 - DNA, 25 bp, Rattus norvegicus
gattcaggtgaaagtctgtttctcc

SEQ ID NO: 371733 - DNA, 25 bp, Rattus norvegicus
gattcaggtgaatgtctgtttctcc

SEQ ID NO: 371734 - DNA, 25 bp, Rattus norvegicus
gattcaggtgtcatacgagcagtat

SEQ ID NO: 371735 - DNA, 25 bp, Rattus norvegicus
gattcaggtgtcttacgagcagtat

SEQ ID NO: 371736 - DNA, 25 bp, Rattus norvegicus
gattcagtaacactacagccatggt

SEQ ID NO: 371737 - DNA, 25 bp, Rattus norvegicus
gattcagtaacagtacagccatggt

SEQ ID NO: 371738 - DNA, 25 bp, Rattus norvegicus
gattcagtaagtagcccacatgcct

SEQ ID NO: 371739 - DNA, 25 bp, Rattus norvegicus
gattcagtaagtcccttggaacaac

SEQ ID NO: 371740 - DNA, 25 bp, Rattus norvegicus
gattcagtaagtgccttggaacaac

SEQ ID NO: 371741 - DNA, 25 bp, Rattus norvegicus
gattcagtaagttgcccacatgcct

SEQ ID NO: 371742 - DNA, 25 bp, Rattus norvegicus
gattcagtagcacatgccgttcaaa

SEQ ID NO: 371743 - DNA, 25 bp, Rattus norvegicus
gattcagtagcagatgccgttcaaa

SEQ ID NO: 371744 - DNA, 25 bp, Rattus norvegicus
gattcagtagcccacaaagaccttg

SEQ ID NO: 371745 - DNA, 25 bp, Rattus norvegicus
gattcagtagccgacaaagaccttg

SEQ ID NO: 371746 - DNA, 25 bp, Rattus norvegicus
gattcagtagttacaagcacttgtt

SEQ ID NO: 371747 - DNA, 25 bp, Rattus norvegicus
gattcagtagtttcaagcacttgtt

SEQ ID NO: 371748 - DNA, 25 bp, Rattus norvegicus
gattcagtatgcaatctcagccatg

SEQ ID NO: 371749 - DNA, 25 bp, Rattus norvegicus
gattcagtatgctatctcagccatg

SEQ ID NO: 371750 - DNA, 25 bp, Rattus norvegicus
gattcagtcctccagtatatttttt

SEQ ID NO: 371751 - DNA, 25 bp, Rattus norvegicus
gattcagtcctcgagtatatttttt

SEQ ID NO: 371752 - DNA, 25 bp, Rattus norvegicus
gattcagtcgtgaggtatttgctag

SEQ ID NO: 371753 - DNA, 25 bp, Rattus norvegicus
gattcagtcgtgtggtatttgctag

SEQ ID NO: 371754 - DNA, 25 bp, Rattus norvegicus
gattcagtctctctacaagccagga

SEQ ID NO: 371755 - DNA, 25 bp, Rattus norvegicus
gattcagtctctgtacaagccagga

SEQ ID NO: 371756 - DNA, 25 bp, Rattus norvegicus
gattcagtgatgacttgttctgact

SEQ ID NO: 371757 - DNA, 25 bp, Rattus norvegicus
gattcagtgatgtcttgttctgact

SEQ ID NO: 371758 - DNA, 25 bp, Rattus norvegicus
gattcagtggatctgcccgggcttc

SEQ ID NO: 371759 - DNA, 25 bp, Rattus norvegicus
gattcagtggatgtgcccgggcttc

SEQ ID NO: 371760 - DNA, 25 bp, Rattus norvegicus
gattcagttccaacaggcttggaga

SEQ ID NO: 371761 - DNA, 25 bp, Rattus norvegicus
gattcagttccatcaggcttggaga

SEQ ID NO: 371762 - DNA, 25 bp, Rattus norvegicus
gattcatacactattgagactccag

SEQ ID NO: 371763 - DNA, 25 bp, Rattus norvegicus
gattcatacacttttgagactccag

SEQ ID NO: 371764 - DNA, 25 bp, Rattus norvegicus
gattcatacaggaatgccccaccag

SEQ ID NO: 371765 - DNA, 25 bp, Rattus norvegicus
gattcatacaggtatgccccaccag

SEQ ID NO: 371766 - DNA, 25 bp, Rattus norvegicus
gattcatacatcataccttactata

SEQ ID NO: 371767 - DNA, 25 bp, Rattus norvegicus
gattcatacatcttaccttactata

SEQ ID NO: 371768 - DNA, 25 bp, Rattus norvegicus
gattcatacccaatggatccattgg

SEQ ID NO: 371769 - DNA, 25 bp, Rattus norvegicus
gattcatacccattggatccattgg

SEQ ID NO: 371770 - DNA, 25 bp, Rattus norvegicus
gattcatactgaaggcttagctttg

SEQ ID NO: 371771 - DNA, 25 bp, Rattus norvegicus
gattcatactgatggcttagctttg

SEQ ID NO: 371772 - DNA, 25 bp, Rattus norvegicus
gattcatactgccaagaaggcctct

SEQ ID NO: 371773 - DNA, 25 bp, Rattus norvegicus
gattcatactgcgaagaaggcctct

SEQ ID NO: 371774 - DNA, 25 bp, Rattus norvegicus
gattcatactgtcattcccgctgta

SEQ ID NO: 371775 - DNA, 25 bp, Rattus norvegicus
gattcatactgtgattcccgctgta

SEQ ID NO: 371776 - DNA, 25 bp, Rattus norvegicus
gattcatagaatcttctgacttcaa

SEQ ID NO: 371777 - DNA, 25 bp, Rattus norvegicus
gattcatagaatgttctgacttcaa

SEQ ID NO: 371778 - DNA, 25 bp, Rattus norvegicus
gattcatagctgatgtgtggtgaga

SEQ ID NO: 371779 - DNA, 25 bp, Rattus norvegicus
gattcatagctgttgtgtggtgaga

SEQ ID NO: 371780 - DNA, 25 bp, Rattus norvegicus
gattcatagtaaccccttgtgtgtg

SEQ ID NO: 371781 - DNA, 25 bp, Rattus norvegicus
gattcatagtaagcccttgtgtgtg

SEQ ID NO: 371782 - DNA, 25 bp, Rattus norvegicus
gattcatatttcacagcctttttgt

SEQ ID NO: 371783 - DNA, 25 bp, Rattus norvegicus
gattcatatttctcagcctttttgt

SEQ ID NO: 371784 - DNA, 25 bp, Rattus norvegicus
gattcatcaagtcactcttctctag

SEQ ID NO: 371785 - DNA, 25 bp, Rattus norvegicus
gattcatcaagtgactcttctctag

SEQ ID NO: 371786 - DNA, 25 bp, Rattus norvegicus
gattcatcagatctggctatgttca

SEQ ID NO: 371787 - DNA, 25 bp, Rattus norvegicus
gattcatcagatgtggctatgttca

SEQ ID NO: 371788 - DNA, 25 bp, Rattus norvegicus
gattcatcaggaactatgttatcgt

SEQ ID NO: 371789 - DNA, 25 bp, Rattus norvegicus
gattcatcaggatctatgttatcgt

SEQ ID NO: 371790 - DNA, 25 bp, Rattus norvegicus
gattcatcatggatcctttcagaaa

SEQ ID NO: 371791 - DNA, 25 bp, Rattus norvegicus
gattcatcatggttcctttcagaaa

SEQ ID NO: 371792 - DNA, 25 bp, Rattus norvegicus
gattcatcattcacttctcggtagt

SEQ ID NO: 371793 - DNA, 25 bp, Rattus norvegicus
gattcatcattctcttctcggtagt

SEQ ID NO: 371794 - DNA, 25 bp, Rattus norvegicus
gattcatcgttgatcattgtttggt

SEQ ID NO: 371795 - DNA, 25 bp, Rattus norvegicus
gattcatcgttgttcattgtttggt

SEQ ID NO: 371796 - DNA, 25 bp, Rattus norvegicus
gattcatctactataccggacaaca

SEQ ID NO: 371797 - DNA, 25 bp, Rattus norvegicus
gattcatctactttaccggacaaca

SEQ ID NO: 371798 - DNA, 25 bp, Rattus norvegicus
gattcatctgacaattctttctccc

SEQ ID NO: 371799 - DNA, 25 bp, Rattus norvegicus
gattcatctgactattctttctccc

SEQ ID NO: 371800 - DNA, 25 bp, Rattus norvegicus
gattcatctgcgcacaggtgtcact

SEQ ID NO: 371801 - DNA, 25 bp, Rattus norvegicus
gattcatctgcggacaggtgtcact

SEQ ID NO: 371802 - DNA, 25 bp, Rattus norvegicus
gattcatgacagatgctgcacgccg

SEQ ID NO: 371803 - DNA, 25 bp, Rattus norvegicus
gattcatgacagttgctgcacgccg

SEQ ID NO: 371804 - DNA, 25 bp, Rattus norvegicus
gattcatgactgcaagccacaattt

SEQ ID NO: 371805 - DNA, 25 bp, Rattus norvegicus
gattcatgactggaagccacaattt

SEQ ID NO: 371806 - DNA, 25 bp, Rattus norvegicus
gattcatgagacaggccagctacac

SEQ ID NO: 371807 - DNA, 25 bp, Rattus norvegicus
gattcatgagactggccagctacac

SEQ ID NO: 371808 - DNA, 25 bp, Rattus norvegicus
gattcatgatatattattcccttaa

SEQ ID NO: 371809 - DNA, 25 bp, Rattus norvegicus
gattcatgatattttattcccttaa

SEQ ID NO: 371810 - DNA, 25 bp, Rattus norvegicus
gattcatgatttctaaatgccgttt

SEQ ID NO: 371811 - DNA, 25 bp, Rattus norvegicus
gattcatgatttgtaaatgccgttt

SEQ ID NO: 371812 - DNA, 25 bp, Rattus norvegicus
gattcatgcaaaaacagacatgcat

SEQ ID NO: 371813 - DNA, 25 bp, Rattus norvegicus
gattcatgcaaatacagacatgcat

SEQ ID NO: 371814 - DNA, 25 bp, Rattus norvegicus
gattcatgcagcagttttcaaggta

SEQ ID NO: 371815 - DNA, 25 bp, Rattus norvegicus
gattcatgcagctgttttcaaggta

SEQ ID NO: 371816 - DNA, 25 bp, Rattus norvegicus
gattcatgctcgctcaatgagtgtg

SEQ ID NO: 371817 - DNA, 25 bp, Rattus norvegicus
gattcatgctcggtcaatgagtgtg

SEQ ID NO: 371818 - DNA, 25 bp, Rattus norvegicus
gattcatgggccacccaacaaagga

SEQ ID NO: 371819 - DNA, 25 bp, Rattus norvegicus
gattcatgggcctcccaacaaagga

SEQ ID NO: 371820 - DNA, 25 bp, Rattus norvegicus
gattcatggtagacaatccattcaa

SEQ ID NO: 371821 - DNA, 25 bp, Rattus norvegicus
gattcatggtagtcaatccattcaa

SEQ ID NO: 371822 - DNA, 25 bp, Rattus norvegicus
gattcatgtatgctcggtattttta

SEQ ID NO: 371823 - DNA, 25 bp, Rattus norvegicus
gattcatgtatggtcggtattttta

SEQ ID NO: 371824 - DNA, 25 bp, Rattus norvegicus
gattcatgtcctcgttatcactgct

SEQ ID NO: 371825 - DNA, 25 bp, Rattus norvegicus
gattcatgtcctggttatcactgct

SEQ ID NO: 371826 - DNA, 25 bp, Rattus norvegicus
gattcatgttccctcctatgtattt

SEQ ID NO: 371827 - DNA, 25 bp, Rattus norvegicus
gattcatgttccgtcctatgtattt

SEQ ID NO: 371828 - DNA, 25 bp, Rattus norvegicus
gattcatgttttaccttccatcatc

SEQ ID NO: 371829 - DNA, 25 bp, Rattus norvegicus
gattcatgtttttccttccatcatc

SEQ ID NO: 371830 - DNA, 25 bp, Rattus norvegicus
gattcattatagataagtccattta

SEQ ID NO: 371831 - DNA, 25 bp, Rattus norvegicus
gattcattatagttaagtccattta

SEQ ID NO: 371832 - DNA, 25 bp, Rattus norvegicus
gattcattcctaaatactgggtttg

SEQ ID NO: 371833 - DNA, 25 bp, Rattus norvegicus
gattcattcctatatactgggtttg

SEQ ID NO: 371834 - DNA, 25 bp, Rattus norvegicus
gattcattcctcatagtgctttcac

SEQ ID NO: 371835 - DNA, 25 bp, Rattus norvegicus
gattcattcctcttagtgctttcac

SEQ ID NO: 371836 - DNA, 25 bp, Rattus norvegicus
gattcattcgaacgcctgctgtccc

SEQ ID NO: 371837 - DNA, 25 bp, Rattus norvegicus
gattcattcgaaggcctgctgtccc

SEQ ID NO: 371838 - DNA, 25 bp, Rattus norvegicus
gattcattctttacaatctctattg

SEQ ID NO: 371839 - DNA, 25 bp, Rattus norvegicus
gattcattcttttcaatctctattg

SEQ ID NO: 371840 - DNA, 25 bp, Rattus norvegicus
gattcattgacactactcttgccat

SEQ ID NO: 371841 - DNA, 25 bp, Rattus norvegicus
gattcattgacagtactcttgccat

SEQ ID NO: 371842 - DNA, 25 bp, Rattus norvegicus
gattcattgcctcccagaactgaaa

SEQ ID NO: 371843 - DNA, 25 bp, Rattus norvegicus
gattcattgcctgccagaactgaaa

SEQ ID NO: 371844 - DNA, 25 bp, Rattus norvegicus
gattcattggccatttacatctgct

SEQ ID NO: 371845 - DNA, 25 bp, Rattus norvegicus
gattcattggccttttacatctgct

SEQ ID NO: 371846 - DNA, 25 bp, Rattus norvegicus
gattcattgtttaacctggctagcc

SEQ ID NO: 371847 - DNA, 25 bp, Rattus norvegicus
gattcattgttttacctggctagcc

SEQ ID NO: 371848 - DNA, 25 bp, Rattus norvegicus
gattcatttacaacctcagtcagcg

SEQ ID NO: 371849 - DNA, 25 bp, Rattus norvegicus
gattcatttacatcctcagtcagcg

SEQ ID NO: 371850 - DNA, 25 bp, Rattus norvegicus
gattcatttagcaccttactgtatt

SEQ ID NO: 371851 - DNA, 25 bp, Rattus norvegicus
gattcatttagctccttactgtatt

SEQ ID NO: 371852 - DNA, 25 bp, Rattus norvegicus
gattcatttatgacagggtcacccc

SEQ ID NO: 371853 - DNA, 25 bp, Rattus norvegicus
gattcatttatgtcagggtcacccc

SEQ ID NO: 371854 - DNA, 25 bp, Rattus norvegicus
gattcatttcaaatgactctgctga

SEQ ID NO: 371855 - DNA, 25 bp, Rattus norvegicus
gattcatttcaattgactctgctga

SEQ ID NO: 371856 - DNA, 25 bp, Rattus norvegicus
gattcatttggaagcatactgagtg

SEQ ID NO: 371857 - DNA, 25 bp, Rattus norvegicus
gattcatttggatgcatactgagtg

SEQ ID NO: 371858 - DNA, 25 bp, Rattus norvegicus
gattcattttctctttggtgttagc

SEQ ID NO: 371859 - DNA, 25 bp, Rattus norvegicus
gattcattttctgtttggtgttagc

SEQ ID NO: 371860 - DNA, 25 bp, Rattus norvegicus
gattccaaacatcacgtgaccacag

SEQ ID NO: 371861 - DNA, 25 bp, Rattus norvegicus
gattccaaacatgacgtgaccacag

SEQ ID NO: 371862 - DNA, 25 bp, Rattus norvegicus
gattccaaagccatgtgctgtgcag

SEQ ID NO: 371863 - DNA, 25 bp, Rattus norvegicus
gattccaaagccttgtgctgtgcag

SEQ ID NO: 371864 - DNA, 25 bp, Rattus norvegicus
gattccaactcacaggacacccaga

SEQ ID NO: 371865 - DNA, 25 bp, Rattus norvegicus
gattccaactcagaggacacccaga

SEQ ID NO: 371866 - DNA, 25 bp, Rattus norvegicus
gattccaagtctaagagtcgctgta

SEQ ID NO: 371867 - DNA, 25 bp, Rattus norvegicus
gattccaagtcttagagtcgctgta

SEQ ID NO: 371868 - DNA, 25 bp, Rattus norvegicus
gattccaataagatcccacgctgta

SEQ ID NO: 371869 - DNA, 25 bp, Rattus norvegicus
gattccaataagttcccacgctgta

SEQ ID NO: 371870 - DNA, 25 bp, Rattus norvegicus
gattccaatctactcttaccaatct

SEQ ID NO: 371871 - DNA, 25 bp, Rattus norvegicus
gattccaatctagtcttaccaatct

SEQ ID NO: 371872 - DNA, 25 bp, Rattus norvegicus
gattccaatctcagtttggcacttg

SEQ ID NO: 371873 - DNA, 25 bp, Rattus norvegicus
gattccaatctctgtttggcacttg

SEQ ID NO: 371874 - DNA, 25 bp, Rattus norvegicus
gattccaattcgatctacaacctgt

SEQ ID NO: 371875 - DNA, 25 bp, Rattus norvegicus
gattccaattcgttctacaacctgt

SEQ ID NO: 371876 - DNA, 25 bp, Rattus norvegicus
gattccacaagtatgttcccatgct

SEQ ID NO: 371877 - DNA, 25 bp, Rattus norvegicus
gattccacaagtttgttcccatgct

SEQ ID NO: 371878 - DNA, 25 bp, Rattus norvegicus
gattccacactgcatcgatccagtc

SEQ ID NO: 371879 - DNA, 25 bp, Rattus norvegicus
gattccacactggatcgatccagtc

SEQ ID NO: 371880 - DNA, 25 bp, Rattus norvegicus
gattccacagctctttgcatttagt

SEQ ID NO: 371881 - DNA, 25 bp, Rattus norvegicus
gattccacagctgtttgcatttagt

SEQ ID NO: 371882 - DNA, 25 bp, Rattus norvegicus
gattccacatatcatcttgcttgta

SEQ ID NO: 371883 - DNA, 25 bp, Rattus norvegicus
gattccacatatgatcttgcttgta

SEQ ID NO: 371884 - DNA, 25 bp, Rattus norvegicus
gattccacatgaattagtgacctaa

SEQ ID NO: 371885 - DNA, 25 bp, Rattus norvegicus
gattccacatgatttagtgacctaa

SEQ ID NO: 371886 - DNA, 25 bp, Rattus norvegicus
gattccacccagacagcctaaatgg

SEQ ID NO: 371887 - DNA, 25 bp, Rattus norvegicus
gattccacccagtcagcctaaatgg

SEQ ID NO: 371888 - DNA, 25 bp, Rattus norvegicus
gattccaccgccactgagctgtgtg

SEQ ID NO: 371889 - DNA, 25 bp, Rattus norvegicus
gattccaccgcctctgagctgtgtg

SEQ ID NO: 371890 - DNA, 25 bp, Rattus norvegicus
gattccaccggaaaggagctgttgc

SEQ ID NO: 371891 - DNA, 25 bp, Rattus norvegicus
gattccaccggataggagctgttgc

SEQ ID NO: 371892 - DNA, 25 bp, Rattus norvegicus
gattccaccttcaggcaagttggcc

SEQ ID NO: 371893 - DNA, 25 bp, Rattus norvegicus
gattccaccttctggcaagttggcc

SEQ ID NO: 371894 - DNA, 25 bp, Rattus norvegicus
gattccaccttgagacagttttaca

SEQ ID NO: 371895 - DNA, 25 bp, Rattus norvegicus
gattccaccttgtgacagttttaca

SEQ ID NO: 371896 - DNA, 25 bp, Rattus norvegicus
gattccacgcgacttgtaacgttat

SEQ ID NO: 371897 - DNA, 25 bp, Rattus norvegicus
gattccacgcgagttgtaacgttat

SEQ ID NO: 371898 - DNA, 25 bp, Rattus norvegicus
gattccacgtggctttaaatggcca

SEQ ID NO: 371899 - DNA, 25 bp, Rattus norvegicus
gattccacgtgggtttaaatggcca

SEQ ID NO: 371900 - DNA, 25 bp, Rattus norvegicus
gattccactgcgatagactgggcta

SEQ ID NO: 371901 - DNA, 25 bp, Rattus norvegicus
gattccactgcgttagactgggcta

SEQ ID NO: 371902 - DNA, 25 bp, Rattus norvegicus
gattccagaagccatcagaaccttg

SEQ ID NO: 371903 - DNA, 25 bp, Rattus norvegicus
gattccagaagcgatcagaaccttg

SEQ ID NO: 371904 - DNA, 25 bp, Rattus norvegicus
gattccagaaggacggtagctccgt

SEQ ID NO: 371905 - DNA, 25 bp, Rattus norvegicus
gattccagaaggctctctactctcc

SEQ ID NO: 371906 - DNA, 25 bp, Rattus norvegicus
gattccagaagggtctctactctcc

SEQ ID NO: 371907 - DNA, 25 bp, Rattus norvegicus
gattccagaaggtcggtagctccgt

SEQ ID NO: 371908 - DNA, 25 bp, Rattus norvegicus
gattccagaattattcctgtcagtg

SEQ ID NO: 371909 - DNA, 25 bp, Rattus norvegicus
gattccagaatttttcctgtcagtg

SEQ ID NO: 371910 - DNA, 25 bp, Rattus norvegicus
gattccagacagaattctctctcca

SEQ ID NO: 371911 - DNA, 25 bp, Rattus norvegicus
gattccagacagtattctctctcca

SEQ ID NO: 371912 - DNA, 25 bp, Rattus norvegicus
gattccagaccacctgaggctcaga

SEQ ID NO: 371913 - DNA, 25 bp, Rattus norvegicus
gattccagaccactgtagggttccc

SEQ ID NO: 371914 - DNA, 25 bp, Rattus norvegicus
gattccagaccagctgaggctcaga

SEQ ID NO: 371915 - DNA, 25 bp, Rattus norvegicus
gattccagaccagtgtagggttccc

SEQ ID NO: 371916 - DNA, 25 bp, Rattus norvegicus
gattccagacggctgcacaagtcaa

SEQ ID NO: 371917 - DNA, 25 bp, Rattus norvegicus
gattccagacgggtgcacaagtcaa

SEQ ID NO: 371918 - DNA, 25 bp, Rattus norvegicus
gattccagaggacaaaaatcccttc

SEQ ID NO: 371919 - DNA, 25 bp, Rattus norvegicus
gattccagaggagaaaaatcccttc

SEQ ID NO: 371920 - DNA, 25 bp, Rattus norvegicus
gattccagagtgattgattaccatg

SEQ ID NO: 371921 - DNA, 25 bp, Rattus norvegicus
gattccagagtgtttgattaccatg

SEQ ID NO: 371922 - DNA, 25 bp, Rattus norvegicus
gattccagatgtaacggacctgtac

SEQ ID NO: 371923 - DNA, 25 bp, Rattus norvegicus
gattccagatgttacggacctgtac

SEQ ID NO: 371924 - DNA, 25 bp, Rattus norvegicus
gattccagcaatcagttcttgtcgt

SEQ ID NO: 371925 - DNA, 25 bp, Rattus norvegicus
gattccagcaatgagttcttgtcgt

SEQ ID NO: 371926 - DNA, 25 bp, Rattus norvegicus
gattccagccatatccttgatgtga

SEQ ID NO: 371927 - DNA, 25 bp, Rattus norvegicus
gattccagccatttccttgatgtga

SEQ ID NO: 371928 - DNA, 25 bp, Rattus norvegicus
gattccagctagcaagaagtctctt

SEQ ID NO: 371929 - DNA, 25 bp, Rattus norvegicus
gattccagctaggaagaagtctctt

SEQ ID NO: 371930 - DNA, 25 bp, Rattus norvegicus
gattccagctttagtaacgttagta

SEQ ID NO: 371931 - DNA, 25 bp, Rattus norvegicus
gattccagctttcatgttcacaaga

SEQ ID NO: 371932 - DNA, 25 bp, Rattus norvegicus
gattccagctttgatgttcacaaga

SEQ ID NO: 371933 - DNA, 25 bp, Rattus norvegicus
gattccagcttttgtaacgttagta

SEQ ID NO: 371934 - DNA, 25 bp, Rattus norvegicus
gattccaggactagctaggacacca

SEQ ID NO: 371935 - DNA, 25 bp, Rattus norvegicus
gattccaggacttgctaggacacca

SEQ ID NO: 371936 - DNA, 25 bp, Rattus norvegicus
gattccaggctgatcgtgaagctta

SEQ ID NO: 371937 - DNA, 25 bp, Rattus norvegicus
gattccaggctgttcgtgaagctta

SEQ ID NO: 371938 - DNA, 25 bp, Rattus norvegicus
gattccagtggactgtatctctgtg

SEQ ID NO: 371939 - DNA, 25 bp, Rattus norvegicus
gattccagtggagtgtatctctgtg

SEQ ID NO: 371940 - DNA, 25 bp, Rattus norvegicus
gattccagtggccagtatcaaagaa

SEQ ID NO: 371941 - DNA, 25 bp, Rattus norvegicus
gattccagtggcgagtatcaaagaa

SEQ ID NO: 371942 - DNA, 25 bp, Rattus norvegicus
gattccagttagatccatcagttct

SEQ ID NO: 371943 - DNA, 25 bp, Rattus norvegicus
gattccagttagttccatcagttct

SEQ ID NO: 371944 - DNA, 25 bp, Rattus norvegicus
gattccagttgtatatgtcacgcag

SEQ ID NO: 371945 - DNA, 25 bp, Rattus norvegicus
gattccagttgtttatgtcacgcag

SEQ ID NO: 371946 - DNA, 25 bp, Rattus norvegicus
gattccagtttaaagcaaattcttg

SEQ ID NO: 371947 - DNA, 25 bp, Rattus norvegicus
gattccagtttatagcaaattcttg

SEQ ID NO: 371948 - DNA, 25 bp, Rattus norvegicus
gattccataaccacaatctgcacta

SEQ ID NO: 371949 - DNA, 25 bp, Rattus norvegicus
gattccataacctcaatctgcacta

SEQ ID NO: 371950 - DNA, 25 bp, Rattus norvegicus
gattccatcattagcgcctctcaaa

SEQ ID NO: 371951 - DNA, 25 bp, Rattus norvegicus
gattccatcatttgcgcctctcaaa

SEQ ID NO: 371952 - DNA, 25 bp, Rattus norvegicus
gattccatccacagtgactcagagg

SEQ ID NO: 371953 - DNA, 25 bp, Rattus norvegicus
gattccatccactgtgactcagagg

SEQ ID NO: 371954 - DNA, 25 bp, Rattus norvegicus
gattccatccctaggacaacagaag

SEQ ID NO: 371955 - DNA, 25 bp, Rattus norvegicus
gattccatcccttggacaacagaag

SEQ ID NO: 371956 - DNA, 25 bp, Rattus norvegicus
gattccatctccacggaagtgatgg

SEQ ID NO: 371957 - DNA, 25 bp, Rattus norvegicus
gattccatctcctcggaagtgatgg

SEQ ID NO: 371958 - DNA, 25 bp, Rattus norvegicus
gattccatctggagctgtccgcagg

SEQ ID NO: 371959 - DNA, 25 bp, Rattus norvegicus
gattccatctggtgctgtccgcagg

SEQ ID NO: 371960 - DNA, 25 bp, Rattus norvegicus
gattccatgaacatgtgacttgaca

SEQ ID NO: 371961 - DNA, 25 bp, Rattus norvegicus
gattccatgaacttgtgacttgaca

SEQ ID NO: 371962 - DNA, 25 bp, Rattus norvegicus
gattccatgagacccaccttttcta

SEQ ID NO: 371963 - DNA, 25 bp, Rattus norvegicus
gattccatgagagccaccttttcta

SEQ ID NO: 371964 - DNA, 25 bp, Rattus norvegicus
gattccatgcttacctgactggcag

SEQ ID NO: 371965 - DNA, 25 bp, Rattus norvegicus
gattccatgctttcctgactggcag

SEQ ID NO: 371966 - DNA, 25 bp, Rattus norvegicus
gattccatggaaactgactttgcaa

SEQ ID NO: 371967 - DNA, 25 bp, Rattus norvegicus
gattccatggaatctgactttgcaa

SEQ ID NO: 371968 - DNA, 25 bp, Rattus norvegicus
gattccatggatcttctttagagac

SEQ ID NO: 371969 - DNA, 25 bp, Rattus norvegicus
gattccatggatgttctttagagac

SEQ ID NO: 371970 - DNA, 25 bp, Rattus norvegicus
gattccatgggcaagttctgaggct

SEQ ID NO: 371971 - DNA, 25 bp, Rattus norvegicus
gattccatgggctagttctgaggct

SEQ ID NO: 371972 - DNA, 25 bp, Rattus norvegicus
gattccatgggtaccgtgggctcac

SEQ ID NO: 371973 - DNA, 25 bp, Rattus norvegicus
gattccatgggttccgtgggctcac

SEQ ID NO: 371974 - DNA, 25 bp, Rattus norvegicus
gattccatgtatcgtgtccatgctc

SEQ ID NO: 371975 - DNA, 25 bp, Rattus norvegicus
gattccatgtatggtgtccatgctc

SEQ ID NO: 371976 - DNA, 25 bp, Rattus norvegicus
gattccatgtcacggttcatctgtg

SEQ ID NO: 371977 - DNA, 25 bp, Rattus norvegicus
gattccatgtcagggttcatctgtg

SEQ ID NO: 371978 - DNA, 25 bp, Rattus norvegicus
gattccatgtggcttgagggttttt

SEQ ID NO: 371979 - DNA, 25 bp, Rattus norvegicus
gattccatgtgggttgagggttttt

SEQ ID NO: 371980 - DNA, 25 bp, Rattus norvegicus
gattccattcttaggagacctggtt

SEQ ID NO: 371981 - DNA, 25 bp, Rattus norvegicus
gattccattctttggagacctggtt

SEQ ID NO: 371982 - DNA, 25 bp, Rattus norvegicus
gattccattgctatgtacctgatac

SEQ ID NO: 371983 - DNA, 25 bp, Rattus norvegicus
gattccattgctttgtacctgatac

SEQ ID NO: 371984 - DNA, 25 bp, Rattus norvegicus
gattccattgttcaattctcctcca

SEQ ID NO: 371985 - DNA, 25 bp, Rattus norvegicus
gattccattgttgaattctcctcca

SEQ ID NO: 371986 - DNA, 25 bp, Rattus norvegicus
gattccatttcactttatgctcatg

SEQ ID NO: 371987 - DNA, 25 bp, Rattus norvegicus
gattccatttcagtttatgctcatg

SEQ ID NO: 371988 - DNA, 25 bp, Rattus norvegicus
gattccatttctattgtatttgtgt

SEQ ID NO: 371989 - DNA, 25 bp, Rattus norvegicus
gattccatttcttttgtatttgtgt

SEQ ID NO: 371990 - DNA, 25 bp, Rattus norvegicus
gattccattttgattctaagccaga

SEQ ID NO: 371991 - DNA, 25 bp, Rattus norvegicus
gattccattttgtttctaagccaga

SEQ ID NO: 371992 - DNA, 25 bp, Rattus norvegicus
gattcccaaaacactactgtatatt

SEQ ID NO: 371993 - DNA, 25 bp, Rattus norvegicus
gattcccaaaactctactgtatatt

SEQ ID NO: 371994 - DNA, 25 bp, Rattus norvegicus
gattcccaaacaagtcaaggcccaa

SEQ ID NO: 371995 - DNA, 25 bp, Rattus norvegicus
gattcccaaacatgtcaaggcccaa

SEQ ID NO: 371996 - DNA, 25 bp, Rattus norvegicus
gattcccaaggaagaagctttcagc

SEQ ID NO: 371997 - DNA, 25 bp, Rattus norvegicus
gattcccaaggactgtccaagccat

SEQ ID NO: 371998 - DNA, 25 bp, Rattus norvegicus
gattcccaaggagtgtccaagccat

SEQ ID NO: 371999 - DNA, 25 bp, Rattus norvegicus
gattcccaaggatgaagctttcagc

SEQ ID NO: 372000 - DNA, 25 bp, Rattus norvegicus
gattcccaaggcagccgttcaagtg

SEQ ID NO: 372001 - DNA, 25 bp, Rattus norvegicus
gattcccaaggctgccgttcaagtg

SEQ ID NO: 372002 - DNA, 25 bp, Rattus norvegicus
gattcccaagggagatcctcagaag

SEQ ID NO: 372003 - DNA, 25 bp, Rattus norvegicus
gattcccaagggtgatcctcagaag

SEQ ID NO: 372004 - DNA, 25 bp, Rattus norvegicus
gattcccaaggtaaggaccacacgg

SEQ ID NO: 372005 - DNA, 25 bp, Rattus norvegicus
gattcccaaggttaggaccacacgg

SEQ ID NO: 372006 - DNA, 25 bp, Rattus norvegicus
gattcccaattgaagcccatagcca

SEQ ID NO: 372007 - DNA, 25 bp, Rattus norvegicus
gattcccaattgtagcccatagcca

SEQ ID NO: 372008 - DNA, 25 bp, Rattus norvegicus
gattcccacctcacttttaagtgct

SEQ ID NO: 372009 - DNA, 25 bp, Rattus norvegicus
gattcccacctctcttttaagtgct

SEQ ID NO: 372010 - DNA, 25 bp, Rattus norvegicus
gattcccacctgatgaaccgtgcaa

SEQ ID NO: 372011 - DNA, 25 bp, Rattus norvegicus
gattcccacctgttgaaccgtgcaa

SEQ ID NO: 372012 - DNA, 25 bp, Rattus norvegicus
gattcccaccttacagggtgacaag

SEQ ID NO: 372013 - DNA, 25 bp, Rattus norvegicus
gattcccacctttcagggtgacaag

SEQ ID NO: 372014 - DNA, 25 bp, Rattus norvegicus
gattcccactgccactaatgttaga

SEQ ID NO: 372015 - DNA, 25 bp, Rattus norvegicus
gattcccactgcgactaatgttaga

SEQ ID NO: 372016 - DNA, 25 bp, Rattus norvegicus
gattcccagagcattatcatataga

SEQ ID NO: 372017 - DNA, 25 bp, Rattus norvegicus
gattcccagagctttatcatataga

SEQ ID NO: 372018 - DNA, 25 bp, Rattus norvegicus
gattcccagattctagagctcagaa

SEQ ID NO: 372019 - DNA, 25 bp, Rattus norvegicus
gattcccagattgtagagctcagaa

SEQ ID NO: 372020 - DNA, 25 bp, Rattus norvegicus
gattcccagcatatcggaaattaga

SEQ ID NO: 372021 - DNA, 25 bp, Rattus norvegicus
gattcccagcatttcggaaattaga

SEQ ID NO: 372022 - DNA, 25 bp, Rattus norvegicus
gattcccagcccattaggtcagaag

SEQ ID NO: 372023 - DNA, 25 bp, Rattus norvegicus
gattcccagccctttaggtcagaag

SEQ ID NO: 372024 - DNA, 25 bp, Rattus norvegicus
gattcccagtaacacaaagcagctc

SEQ ID NO: 372025 - DNA, 25 bp, Rattus norvegicus
gattcccagtaagacaaagcagctc

SEQ ID NO: 372026 - DNA, 25 bp, Rattus norvegicus
gattcccagtaccaacatggtggtt

SEQ ID NO: 372027 - DNA, 25 bp, Rattus norvegicus
gattcccagtacgaacatggtggtt

SEQ ID NO: 372028 - DNA, 25 bp, Rattus norvegicus
gattcccagtccaatggtaactgat

SEQ ID NO: 372029 - DNA, 25 bp, Rattus norvegicus
gattcccagtcctatggtaactgat

SEQ ID NO: 372030 - DNA, 25 bp, Rattus norvegicus
gattcccagttgagtgtgcacgtgt

SEQ ID NO: 372031 - DNA, 25 bp, Rattus norvegicus
gattcccagttgtgtgtgcacgtgt

SEQ ID NO: 372032 - DNA, 25 bp, Rattus norvegicus
gattcccatcatacagcatttgata

SEQ ID NO: 372033 - DNA, 25 bp, Rattus norvegicus
gattcccatcattcagcatttgata

SEQ ID NO: 372034 - DNA, 25 bp, Rattus norvegicus
gattcccatgagaacctggagagag

SEQ ID NO: 372035 - DNA, 25 bp, Rattus norvegicus
gattcccatgagtacctggagagag

SEQ ID NO: 372036 - DNA, 25 bp, Rattus norvegicus
gattcccatgcccaatagcagcagg

SEQ ID NO: 372037 - DNA, 25 bp, Rattus norvegicus
gattcccatgccgaatagcagcagg

SEQ ID NO: 372038 - DNA, 25 bp, Rattus norvegicus
gattcccattacaaaccacttgata

SEQ ID NO: 372039 - DNA, 25 bp, Rattus norvegicus
gattcccattactaaccacttgata

SEQ ID NO: 372040 - DNA, 25 bp, Rattus norvegicus
gattcccatttacaacttcacatta

SEQ ID NO: 372041 - DNA, 25 bp, Rattus norvegicus
gattcccatttagaacttcacatta

SEQ ID NO: 372042 - DNA, 25 bp, Rattus norvegicus
gattccccacccaagaagtcttatt

SEQ ID NO: 372043 - DNA, 25 bp, Rattus norvegicus
gattccccaccctagaagtcttatt

SEQ ID NO: 372044 - DNA, 25 bp, Rattus norvegicus
gattccccaggaaaggctgtccgag

SEQ ID NO: 372045 - DNA, 25 bp, Rattus norvegicus
gattccccaggataggctgtccgag

SEQ ID NO: 372046 - DNA, 25 bp, Rattus norvegicus
gattccccattgctttggtgtactg

SEQ ID NO: 372047 - DNA, 25 bp, Rattus norvegicus
gattccccattggtttggtgtactg

SEQ ID NO: 372048 - DNA, 25 bp, Rattus norvegicus
gattcccccgatcatgtttgatgca

SEQ ID NO: 372049 - DNA, 25 bp, Rattus norvegicus
gattcccccgatgatgtttgatgca

SEQ ID NO: 372050 - DNA, 25 bp, Rattus norvegicus
gattcccctgagagtgatggagcca

SEQ ID NO: 372051 - DNA, 25 bp, Rattus norvegicus
gattcccctgagtgtgatggagcca

SEQ ID NO: 372052 - DNA, 25 bp, Rattus norvegicus
gattcccctgtacttaaagcagagg

SEQ ID NO: 372053 - DNA, 25 bp, Rattus norvegicus
gattcccctgtagttaaagcagagg

SEQ ID NO: 372054 - DNA, 25 bp, Rattus norvegicus
gattcccgagttacgtgagaatgac

SEQ ID NO: 372055 - DNA, 25 bp, Rattus norvegicus
gattcccgagtttcgtgagaatgac

SEQ ID NO: 372056 - DNA, 25 bp, Rattus norvegicus
gattcccgcgcccctgctgggagag

SEQ ID NO: 372057 - DNA, 25 bp, Rattus norvegicus
gattcccgcgccgctgctgggagag

SEQ ID NO: 372058 - DNA, 25 bp, Rattus norvegicus
gattcccgctgcattcagagacagg

SEQ ID NO: 372059 - DNA, 25 bp, Rattus norvegicus
gattcccgctgctttcagagacagg

SEQ ID NO: 372060 - DNA, 25 bp, Rattus norvegicus
gattccctacccactgaaagtgttg

SEQ ID NO: 372061 - DNA, 25 bp, Rattus norvegicus
gattccctaccctctgaaagtgttg

SEQ ID NO: 372062 - DNA, 25 bp, Rattus norvegicus
gattccctagaaaccttggttcagg

SEQ ID NO: 372063 - DNA, 25 bp, Rattus norvegicus
gattccctagaatccttggttcagg

SEQ ID NO: 372064 - DNA, 25 bp, Rattus norvegicus
gattccctcaacatcccagatttaa

SEQ ID NO: 372065 - DNA, 25 bp, Rattus norvegicus
gattccctcaacttcccagatttaa

SEQ ID NO: 372066 - DNA, 25 bp, Rattus norvegicus
gattccctctaaaacgtctttggtg

SEQ ID NO: 372067 - DNA, 25 bp, Rattus norvegicus
gattccctctaatacgtctttggtg

SEQ ID NO: 372068 - DNA, 25 bp, Rattus norvegicus
gattccctctgtataggtacaccaa

SEQ ID NO: 372069 - DNA, 25 bp, Rattus norvegicus
gattccctctgtttaggtacaccaa

SEQ ID NO: 372070 - DNA, 25 bp, Rattus norvegicus
gattccctgaggagaagttttcgtg

SEQ ID NO: 372071 - DNA, 25 bp, Rattus norvegicus
gattccctgaggtgaagttttcgtg

SEQ ID NO: 372072 - DNA, 25 bp, Rattus norvegicus
gattccctgattatataatgctttg

SEQ ID NO: 372073 - DNA, 25 bp, Rattus norvegicus
gattccctgattttataatgctttg

SEQ ID NO: 372074 - DNA, 25 bp, Rattus norvegicus
gattccctgcaacagtcactgagga

SEQ ID NO: 372075 - DNA, 25 bp, Rattus norvegicus
gattccctgcaagagtcactgagga

SEQ ID NO: 372076 - DNA, 25 bp, Rattus norvegicus
gattccctgggaaggctgcaaacct

SEQ ID NO: 372077 - DNA, 25 bp, Rattus norvegicus
gattccctgggactggtcatatagc

SEQ ID NO: 372078 - DNA, 25 bp, Rattus norvegicus
gattccctgggagtggtcatatagc

SEQ ID NO: 372079 - DNA, 25 bp, Rattus norvegicus
gattccctgggatggctgcaaacct

SEQ ID NO: 372080 - DNA, 25 bp, Rattus norvegicus
gattccctggtacggttctttctgt

SEQ ID NO: 372081 - DNA, 25 bp, Rattus norvegicus
gattccctggtagggttctttctgt

SEQ ID NO: 372082 - DNA, 25 bp, Rattus norvegicus
gattcccttctaaatgttgttctca

SEQ ID NO: 372083 - DNA, 25 bp, Rattus norvegicus
gattcccttctatatgttgttctca

SEQ ID NO: 372084 - DNA, 25 bp, Rattus norvegicus
gattcccttctcaggacgctgcatt

SEQ ID NO: 372085 - DNA, 25 bp, Rattus norvegicus
gattcccttctctggacgctgcatt

SEQ ID NO: 372086 - DNA, 25 bp, Rattus norvegicus
gattcccttggtagttcataaggaa

SEQ ID NO: 372087 - DNA, 25 bp, Rattus norvegicus
gattcccttggttgttcataaggaa

SEQ ID NO: 372088 - DNA, 25 bp, Rattus norvegicus
gattcccttgttactcattatggtt

SEQ ID NO: 372089 - DNA, 25 bp, Rattus norvegicus
gattcccttgtttctcattatggtt

SEQ ID NO: 372090 - DNA, 25 bp, Rattus norvegicus
gattccctttgaccagatgacgatt

SEQ ID NO: 372091 - DNA, 25 bp, Rattus norvegicus
gattccctttgagcagatgacgatt

SEQ ID NO: 372092 - DNA, 25 bp, Rattus norvegicus
gattccctttggctcagtcttagga

SEQ ID NO: 372093 - DNA, 25 bp, Rattus norvegicus
gattccctttgggtcagtcttagga

SEQ ID NO: 372094 - DNA, 25 bp, Rattus norvegicus
gattccctttgtccaatttacgtaa

SEQ ID NO: 372095 - DNA, 25 bp, Rattus norvegicus
gattccctttgtgcaatttacgtaa

SEQ ID NO: 372096 - DNA, 25 bp, Rattus norvegicus
gattccgaaaacaggcctgagagca

SEQ ID NO: 372097 - DNA, 25 bp, Rattus norvegicus
gattccgaaaactggcctgagagca

SEQ ID NO: 372098 - DNA, 25 bp, Rattus norvegicus
gattccgaacaaatacaacagcata

SEQ ID NO: 372099 - DNA, 25 bp, Rattus norvegicus
gattccgaacaattacaacagcata

SEQ ID NO: 372100 - DNA, 25 bp, Rattus norvegicus
gattccgaagacattttctagctct

SEQ ID NO: 372101 - DNA, 25 bp, Rattus norvegicus
gattccgaagactttttctagctct

SEQ ID NO: 372102 - DNA, 25 bp, Rattus norvegicus
gattccgacattaaaaagccccgtg

SEQ ID NO: 372103 - DNA, 25 bp, Rattus norvegicus
gattccgacatttaaaagccccgtg

SEQ ID NO: 372104 - DNA, 25 bp, Rattus norvegicus
gattccgaggttacttgggtcatag

SEQ ID NO: 372105 - DNA, 25 bp, Rattus norvegicus
gattccgaggtttcttgggtcatag

SEQ ID NO: 372106 - DNA, 25 bp, Rattus norvegicus
gattccgatgatactgattgttctg

SEQ ID NO: 372107 - DNA, 25 bp, Rattus norvegicus
gattccgatgattctgattgttctg

SEQ ID NO: 372108 - DNA, 25 bp, Rattus norvegicus
gattccgatttgacatcactctttc

SEQ ID NO: 372109 - DNA, 25 bp, Rattus norvegicus
gattccgatttgtcatcactctttc

SEQ ID NO: 372110 - DNA, 25 bp, Rattus norvegicus
gattccgcaagaacctggaggccat

SEQ ID NO: 372111 - DNA, 25 bp, Rattus norvegicus
gattccgcaagatcctggaggccat

SEQ ID NO: 372112 - DNA, 25 bp, Rattus norvegicus
gattccgccaccactccaggatgga

SEQ ID NO: 372113 - DNA, 25 bp, Rattus norvegicus
gattccgccacctctccaggatgga

SEQ ID NO: 372114 - DNA, 25 bp, Rattus norvegicus
gattccgctaataccttaatctgat

SEQ ID NO: 372115 - DNA, 25 bp, Rattus norvegicus
gattccgctaattccttaatctgat

SEQ ID NO: 372116 - DNA, 25 bp, Rattus norvegicus
gattccgctgtgagaagggccatga

SEQ ID NO: 372117 - DNA, 25 bp, Rattus norvegicus
gattccgctgtgtgaagggccatga

SEQ ID NO: 372118 - DNA, 25 bp, Rattus norvegicus
gattccggcatcacaacagattaca

SEQ ID NO: 372119 - DNA, 25 bp, Rattus norvegicus
gattccggcatctcaacagattaca

SEQ ID NO: 372120 - DNA, 25 bp, Rattus norvegicus
gattccggccagatcaaagattttt

SEQ ID NO: 372121 - DNA, 25 bp, Rattus norvegicus
gattccggccagttcaaagattttt

SEQ ID NO: 372122 - DNA, 25 bp, Rattus norvegicus
gattccggcgaacctgaccacgtca

SEQ ID NO: 372123 - DNA, 25 bp, Rattus norvegicus
gattccggcgaagctgaccacgtca

SEQ ID NO: 372124 - DNA, 25 bp, Rattus norvegicus
gattccgtagttagtgggtatcagt

SEQ ID NO: 372125 - DNA, 25 bp, Rattus norvegicus
gattccgtagtttgtgggtatcagt

SEQ ID NO: 372126 - DNA, 25 bp, Rattus norvegicus
gattccgtctagcatgaaagccgtg

SEQ ID NO: 372127 - DNA, 25 bp, Rattus norvegicus
gattccgtctaggatgaaagccgtg

SEQ ID NO: 372128 - DNA, 25 bp, Rattus norvegicus
gattccgtgacaaggccgacacagg

SEQ ID NO: 372129 - DNA, 25 bp, Rattus norvegicus
gattccgtgacatggccgacacagg

SEQ ID NO: 372130 - DNA, 25 bp, Rattus norvegicus
gattccgtgtacaagagagtgtgtg

SEQ ID NO: 372131 - DNA, 25 bp, Rattus norvegicus
gattccgtgtactagagagtgtgtg

SEQ ID NO: 372132 - DNA, 25 bp, Rattus norvegicus
gattccgttcctcttcacaatgttg

SEQ ID NO: 372133 - DNA, 25 bp, Rattus norvegicus
gattccgttcctgttcacaatgttg

SEQ ID NO: 372134 - DNA, 25 bp, Rattus norvegicus
gattccgttctgacttagtggccaa

SEQ ID NO: 372135 - DNA, 25 bp, Rattus norvegicus
gattccgttctgtcttagtggccaa

SEQ ID NO: 372136 - DNA, 25 bp, Rattus norvegicus
gattcctaagcaatggatagcccta

SEQ ID NO: 372137 - DNA, 25 bp, Rattus norvegicus
gattcctaagcattggatagcccta

SEQ ID NO: 372138 - DNA, 25 bp, Rattus norvegicus
gattcctaagtgaagtgttctaact

SEQ ID NO: 372139 - DNA, 25 bp, Rattus norvegicus
gattcctaagtgtagtgttctaact

SEQ ID NO: 372140 - DNA, 25 bp, Rattus norvegicus
gattcctacagtcaaccgagtgggt

SEQ ID NO: 372141 - DNA, 25 bp, Rattus norvegicus
gattcctacagtgaaccgagtgggt

SEQ ID NO: 372142 - DNA, 25 bp, Rattus norvegicus
gattcctagttgctgagagccttca

SEQ ID NO: 372143 - DNA, 25 bp, Rattus norvegicus
gattcctagttggtgagagccttca

SEQ ID NO: 372144 - DNA, 25 bp, Rattus norvegicus
gattcctatctcattgtgtcgccta

SEQ ID NO: 372145 - DNA, 25 bp, Rattus norvegicus
gattcctatctctttgtgtcgccta

SEQ ID NO: 372146 - DNA, 25 bp, Rattus norvegicus
gattcctatggacaacaccctcaga

SEQ ID NO: 372147 - DNA, 25 bp, Rattus norvegicus
gattcctatggagaacaccctcaga

SEQ ID NO: 372148 - DNA, 25 bp, Rattus norvegicus
gattcctcaacaactcaagtcttgc

SEQ ID NO: 372149 - DNA, 25 bp, Rattus norvegicus
gattcctcaacatctcaagtcttgc

SEQ ID NO: 372150 - DNA, 25 bp, Rattus norvegicus
gattcctcacagacatggaggcttc

SEQ ID NO: 372151 - DNA, 25 bp, Rattus norvegicus
gattcctcacagtcatggaggcttc

SEQ ID NO: 372152 - DNA, 25 bp, Rattus norvegicus
gattcctcaggtaaacactatcatt

SEQ ID NO: 372153 - DNA, 25 bp, Rattus norvegicus
gattcctcaggttaacactatcatt

SEQ ID NO: 372154 - DNA, 25 bp, Rattus norvegicus
gattcctccagtcatgcttaagatt

SEQ ID NO: 372155 - DNA, 25 bp, Rattus norvegicus
gattcctccagtgatgcttaagatt

SEQ ID NO: 372156 - DNA, 25 bp, Rattus norvegicus
gattcctccctgcaaatggatctgg

SEQ ID NO: 372157 - DNA, 25 bp, Rattus norvegicus
gattcctccctggaaatggatctgg

SEQ ID NO: 372158 - DNA, 25 bp, Rattus norvegicus
gattcctcctcaaaatttctggcaa

SEQ ID NO: 372159 - DNA, 25 bp, Rattus norvegicus
gattcctcctcataatttctggcaa

SEQ ID NO: 372160 - DNA, 25 bp, Rattus norvegicus
gattcctcggctctaaggactgcat

SEQ ID NO: 372161 - DNA, 25 bp, Rattus norvegicus
gattcctcggctgtaaggactgcat

SEQ ID NO: 372162 - DNA, 25 bp, Rattus norvegicus
gattcctctaagatctgggccagac

SEQ ID NO: 372163 - DNA, 25 bp, Rattus norvegicus
gattcctctaagttctgggccagac

SEQ ID NO: 372164 - DNA, 25 bp, Rattus norvegicus
gattcctctagaatttcacagagcc

SEQ ID NO: 372165 - DNA, 25 bp, Rattus norvegicus
gattcctctagattttcacagagcc

SEQ ID NO: 372166 - DNA, 25 bp, Rattus norvegicus
gattcctctagcaacatccgtgagt

SEQ ID NO: 372167 - DNA, 25 bp, Rattus norvegicus
gattcctctagctacatccgtgagt

SEQ ID NO: 372168 - DNA, 25 bp, Rattus norvegicus
gattcctctcttcactaagtagcta

SEQ ID NO: 372169 - DNA, 25 bp, Rattus norvegicus
gattcctctcttgactaagtagcta

SEQ ID NO: 372170 - DNA, 25 bp, Rattus norvegicus
gattcctctgccatctatgtaattc

SEQ ID NO: 372171 - DNA, 25 bp, Rattus norvegicus
gattcctctgccttctatgtaattc

SEQ ID NO: 372172 - DNA, 25 bp, Rattus norvegicus
gattcctctgctatcacgtaatgaa

SEQ ID NO: 372173 - DNA, 25 bp, Rattus norvegicus
gattcctctgctccatttttcatta

SEQ ID NO: 372174 - DNA, 25 bp, Rattus norvegicus
gattcctctgctgcatttttcatta

SEQ ID NO: 372175 - DNA, 25 bp, Rattus norvegicus
gattcctctgctttcacgtaatgaa

SEQ ID NO: 372176 - DNA, 25 bp, Rattus norvegicus
gattcctctgtcattttactaatat

SEQ ID NO: 372177 - DNA, 25 bp, Rattus norvegicus
gattcctctgtctttttactaatat

SEQ ID NO: 372178 - DNA, 25 bp, Rattus norvegicus
gattcctcttgtattttgcaaactg

SEQ ID NO: 372179 - DNA, 25 bp, Rattus norvegicus
gattcctcttgttttttgcaaactg

SEQ ID NO: 372180 - DNA, 25 bp, Rattus norvegicus
gattcctgaaccaggactgtcttac

SEQ ID NO: 372181 - DNA, 25 bp, Rattus norvegicus
gattcctgaacctggactgtcttac

SEQ ID NO: 372182 - DNA, 25 bp, Rattus norvegicus
gattcctgaagtacatgtgttacat

SEQ ID NO: 372183 - DNA, 25 bp, Rattus norvegicus
gattcctgaagttcatgtgttacat

SEQ ID NO: 372184 - DNA, 25 bp, Rattus norvegicus
gattcctgacaaagtgagctccaag

SEQ ID NO: 372185 - DNA, 25 bp, Rattus norvegicus
gattcctgacaatgtgagctccaag

SEQ ID NO: 372186 - DNA, 25 bp, Rattus norvegicus
gattcctgacatcaatttccctacc

SEQ ID NO: 372187 - DNA, 25 bp, Rattus norvegicus
gattcctgacatgaatttccctacc

SEQ ID NO: 372188 - DNA, 25 bp, Rattus norvegicus
gattcctgagttctcccatgaaaaa

SEQ ID NO: 372189 - DNA, 25 bp, Rattus norvegicus
gattcctgagttgtcccatgaaaaa

SEQ ID NO: 372190 - DNA, 25 bp, Rattus norvegicus
gattcctgatttatctgcttttgaa

SEQ ID NO: 372191 - DNA, 25 bp, Rattus norvegicus
gattcctgatttccaaccctttggc

SEQ ID NO: 372192 - DNA, 25 bp, Rattus norvegicus
gattcctgatttgcaaccctttggc

SEQ ID NO: 372193 - DNA, 25 bp, Rattus norvegicus
gattcctgatttttctgcttttgaa

SEQ ID NO: 372194 - DNA, 25 bp, Rattus norvegicus
gattcctgcatcatgggatctaggc

SEQ ID NO: 372195 - DNA, 25 bp, Rattus norvegicus
gattcctgcatcttgggatctaggc

SEQ ID NO: 372196 - DNA, 25 bp, Rattus norvegicus
gattcctgcttccttcagtttgagt

SEQ ID NO: 372197 - DNA, 25 bp, Rattus norvegicus
gattcctgcttcgttcagtttgagt

SEQ ID NO: 372198 - DNA, 25 bp, Rattus norvegicus
gattcctggaacacacccgatggga

SEQ ID NO: 372199 - DNA, 25 bp, Rattus norvegicus
gattcctggaactcacccgatggga

SEQ ID NO: 372200 - DNA, 25 bp, Rattus norvegicus
gattcctggagtcttgtctactttt

SEQ ID NO: 372201 - DNA, 25 bp, Rattus norvegicus
gattcctggagtgttgtctactttt

SEQ ID NO: 372202 - DNA, 25 bp, Rattus norvegicus
gattcctggcagagagcgcagatca

SEQ ID NO: 372203 - DNA, 25 bp, Rattus norvegicus
gattcctggcagtgagcgcagatca

SEQ ID NO: 372204 - DNA, 25 bp, Rattus norvegicus
gattcctgggcactggttgtaaacc

SEQ ID NO: 372205 - DNA, 25 bp, Rattus norvegicus
gattcctgggcagtggttgtaaacc

SEQ ID NO: 372206 - DNA, 25 bp, Rattus norvegicus
gattcctggtgcacactggtcagct

SEQ ID NO: 372207 - DNA, 25 bp, Rattus norvegicus
gattcctggtgctcactggtcagct

SEQ ID NO: 372208 - DNA, 25 bp, Rattus norvegicus
gattcctggtttctgtaagcagaat

SEQ ID NO: 372209 - DNA, 25 bp, Rattus norvegicus
gattcctggtttgtgtaagcagaat

SEQ ID NO: 372210 - DNA, 25 bp, Rattus norvegicus
gattcctgtatgaaaacagctggtt

SEQ ID NO: 372211 - DNA, 25 bp, Rattus norvegicus
gattcctgtatgtaaacagctggtt

SEQ ID NO: 372212 - DNA, 25 bp, Rattus norvegicus
gattcctgtgaaaatttaaactcta

SEQ ID NO: 372213 - DNA, 25 bp, Rattus norvegicus
gattcctgtgaatatttaaactcta

SEQ ID NO: 372214 - DNA, 25 bp, Rattus norvegicus
gattcctgtggcagtattaccagtt

SEQ ID NO: 372215 - DNA, 25 bp, Rattus norvegicus
gattcctgtggctgtattaccagtt

SEQ ID NO: 372216 - DNA, 25 bp, Rattus norvegicus
gattcctgtgtccagtctacatttt

SEQ ID NO: 372217 - DNA, 25 bp, Rattus norvegicus
gattcctgtgtcgagtctacatttt

SEQ ID NO: 372218 - DNA, 25 bp, Rattus norvegicus
gattcctgtgttattactatgctgt

SEQ ID NO: 372219 - DNA, 25 bp, Rattus norvegicus
gattcctgtgtttttactatgctgt

SEQ ID NO: 372220 - DNA, 25 bp, Rattus norvegicus
gattcctgttttcatattcctgttg

SEQ ID NO: 372221 - DNA, 25 bp, Rattus norvegicus
gattcctgttttgatattcctgttg

SEQ ID NO: 372222 - DNA, 25 bp, Rattus norvegicus
gattccttaactatccccataggag

SEQ ID NO: 372223 - DNA, 25 bp, Rattus norvegicus
gattccttaactttccccataggag

SEQ ID NO: 372224 - DNA, 25 bp, Rattus norvegicus
gattccttacaaaggcggttctcaa

SEQ ID NO: 372225 - DNA, 25 bp, Rattus norvegicus
gattccttacaactgctcatgggaa

SEQ ID NO: 372226 - DNA, 25 bp, Rattus norvegicus
gattccttacaagtgctcatgggaa

SEQ ID NO: 372227 - DNA, 25 bp, Rattus norvegicus
gattccttacaatggcggttctcaa

SEQ ID NO: 372228 - DNA, 25 bp, Rattus norvegicus
gattccttactgctttagatgtcaa

SEQ ID NO: 372229 - DNA, 25 bp, Rattus norvegicus
gattccttactggtttagatgtcaa

SEQ ID NO: 372230 - DNA, 25 bp, Rattus norvegicus
gattccttagccaaactggagctgg

SEQ ID NO: 372231 - DNA, 25 bp, Rattus norvegicus
gattccttagcctaactggagctgg

SEQ ID NO: 372232 - DNA, 25 bp, Rattus norvegicus
gattccttattgaggtcgcttaaat

SEQ ID NO: 372233 - DNA, 25 bp, Rattus norvegicus
gattccttattgtggtcgcttaaat

SEQ ID NO: 372234 - DNA, 25 bp, Rattus norvegicus
gattccttatttcaatgttgacttt

SEQ ID NO: 372235 - DNA, 25 bp, Rattus norvegicus
gattccttatttgaatgttgacttt

SEQ ID NO: 372236 - DNA, 25 bp, Rattus norvegicus
gattccttcatccttttggaggtca

SEQ ID NO: 372237 - DNA, 25 bp, Rattus norvegicus
gattccttcatcgttttggaggtca

SEQ ID NO: 372238 - DNA, 25 bp, Rattus norvegicus
gattccttcgatattcatagcctgt

SEQ ID NO: 372239 - DNA, 25 bp, Rattus norvegicus
gattccttcgattttcatagcctgt

SEQ ID NO: 372240 - DNA, 25 bp, Rattus norvegicus
gattccttcttcatgtttccagatg

SEQ ID NO: 372241 - DNA, 25 bp, Rattus norvegicus
gattccttcttcttgtttccagatg

SEQ ID NO: 372242 - DNA, 25 bp, Rattus norvegicus
gattccttctttctgccattgcaat

SEQ ID NO: 372243 - DNA, 25 bp, Rattus norvegicus
gattccttctttgtgccattgcaat

SEQ ID NO: 372244 - DNA, 25 bp, Rattus norvegicus
gattccttgagtatacagctgtaca

SEQ ID NO: 372245 - DNA, 25 bp, Rattus norvegicus
gattccttgagtttacagctgtaca

SEQ ID NO: 372246 - DNA, 25 bp, Rattus norvegicus
gattccttgatcactaaaactgctg

SEQ ID NO: 372247 - DNA, 25 bp, Rattus norvegicus
gattccttgatctctaaaactgctg

SEQ ID NO: 372248 - DNA, 25 bp, Rattus norvegicus
gattccttggatattgacacacata

SEQ ID NO: 372249 - DNA, 25 bp, Rattus norvegicus
gattccttggattttgacacacata

SEQ ID NO: 372250 - DNA, 25 bp, Rattus norvegicus
gattccttggctagctgacagacaa

SEQ ID NO: 372251 - DNA, 25 bp, Rattus norvegicus
gattccttggctagggtttgtgtac

SEQ ID NO: 372252 - DNA, 25 bp, Rattus norvegicus
gattccttggctatatgttgtttac

SEQ ID NO: 372253 - DNA, 25 bp, Rattus norvegicus
gattccttggcttgctgacagacaa

SEQ ID NO: 372254 - DNA, 25 bp, Rattus norvegicus
gattccttggcttgggtttgtgtac

SEQ ID NO: 372255 - DNA, 25 bp, Rattus norvegicus
gattccttggctttatgttgtttac

SEQ ID NO: 372256 - DNA, 25 bp, Rattus norvegicus
gattccttgtccagagttgcggtcc

SEQ ID NO: 372257 - DNA, 25 bp, Rattus norvegicus
gattccttgtcctgagttgcggtcc

SEQ ID NO: 372258 - DNA, 25 bp, Rattus norvegicus
gattcctttcaacgtccctgaaact

SEQ ID NO: 372259 - DNA, 25 bp, Rattus norvegicus
gattcctttcaaggtccctgaaact

SEQ ID NO: 372260 - DNA, 25 bp, Rattus norvegicus
gattcctttccacgcgagcagtagc

SEQ ID NO: 372261 - DNA, 25 bp, Rattus norvegicus
gattcctttccaggcgagcagtagc

SEQ ID NO: 372262 - DNA, 25 bp, Rattus norvegicus
gattcctttctgcttacagacattg

SEQ ID NO: 372263 - DNA, 25 bp, Rattus norvegicus
gattcctttctggttacagacattg

SEQ ID NO: 372264 - DNA, 25 bp, Rattus norvegicus
gattcctttgtgagcctatttctac

SEQ ID NO: 372265 - DNA, 25 bp, Rattus norvegicus
gattcctttgtgtgcctatttctac

SEQ ID NO: 372266 - DNA, 25 bp, Rattus norvegicus
gattccttttaaaagactctctcct

SEQ ID NO: 372267 - DNA, 25 bp, Rattus norvegicus
gattccttttaatagactctctcct

SEQ ID NO: 372268 - DNA, 25 bp, Rattus norvegicus
gattccttttatagagtatgagtac

SEQ ID NO: 372269 - DNA, 25 bp, Rattus norvegicus
gattccttttattgagtatgagtac

SEQ ID NO: 372270 - DNA, 25 bp, Rattus norvegicus
gattccttttctctttctaacctgg

SEQ ID NO: 372271 - DNA, 25 bp, Rattus norvegicus
gattccttttctgtttctaacctgg

SEQ ID NO: 372272 - DNA, 25 bp, Rattus norvegicus
gattccttttgtccctatgaacatg

SEQ ID NO: 372273 - DNA, 25 bp, Rattus norvegicus
gattccttttgtgcctatgaacatg

SEQ ID NO: 372274 - DNA, 25 bp, Rattus norvegicus
gattcgaagagtcatccgttccaaa

SEQ ID NO: 372275 - DNA, 25 bp, Rattus norvegicus
gattcgaagagtgatccgttccaaa

SEQ ID NO: 372276 - DNA, 25 bp, Rattus norvegicus
gattcgaaggtcactattggttaca

SEQ ID NO: 372277 - DNA, 25 bp, Rattus norvegicus
gattcgaaggtctctattggttaca

SEQ ID NO: 372278 - DNA, 25 bp, Rattus norvegicus
gattcgaagtcgatcctagcatgtg

SEQ ID NO: 372279 - DNA, 25 bp, Rattus norvegicus
gattcgaagtcgttcctagcatgtg

SEQ ID NO: 372280 - DNA, 25 bp, Rattus norvegicus
gattcgaataggactgcacacaggg

SEQ ID NO: 372281 - DNA, 25 bp, Rattus norvegicus
gattcgaataggtctgcacacaggg

SEQ ID NO: 372282 - DNA, 25 bp, Rattus norvegicus
gattcgaatcgaacgtccgtgtggg

SEQ ID NO: 372283 - DNA, 25 bp, Rattus norvegicus
gattcgaatcgatcgtccgtgtggg

SEQ ID NO: 372284 - DNA, 25 bp, Rattus norvegicus
gattcgacacacatgaacttccaga

SEQ ID NO: 372285 - DNA, 25 bp, Rattus norvegicus
gattcgacacacttgaacttccaga

SEQ ID NO: 372286 - DNA, 25 bp, Rattus norvegicus
gattcgacatagcagttttccccaa

SEQ ID NO: 372287 - DNA, 25 bp, Rattus norvegicus
gattcgacataggagttttccccaa

SEQ ID NO: 372288 - DNA, 25 bp, Rattus norvegicus
gattcgacatttctattcatagaag

SEQ ID NO: 372289 - DNA, 25 bp, Rattus norvegicus
gattcgacatttgtattcatagaag

SEQ ID NO: 372290 - DNA, 25 bp, Rattus norvegicus
gattcgagaaaacatggccagcctt

SEQ ID NO: 372291 - DNA, 25 bp, Rattus norvegicus
gattcgagaaaagatggccagcctt

SEQ ID NO: 372292 - DNA, 25 bp, Rattus norvegicus
gattcgagcacacgcgcgcgaaaat

SEQ ID NO: 372293 - DNA, 25 bp, Rattus norvegicus
gattcgagcacaggcgcgcgaaaat

SEQ ID NO: 372294 - DNA, 25 bp, Rattus norvegicus
gattcgaggactctgaaacccctgt

SEQ ID NO: 372295 - DNA, 25 bp, Rattus norvegicus
gattcgaggactgtgaaacccctgt

SEQ ID NO: 372296 - DNA, 25 bp, Rattus norvegicus
gattcgattattccccagagtttct

SEQ ID NO: 372297 - DNA, 25 bp, Rattus norvegicus
gattcgattattgcccagagtttct

SEQ ID NO: 372298 - DNA, 25 bp, Rattus norvegicus
gattcgatttccagtcttcttatga

SEQ ID NO: 372299 - DNA, 25 bp, Rattus norvegicus
gattcgatttcctgtcttcttatga

SEQ ID NO: 372300 - DNA, 25 bp, Rattus norvegicus
gattcgcacgatcagtgtaaagaac

SEQ ID NO: 372301 - DNA, 25 bp, Rattus norvegicus
gattcgcacgatgagtgtaaagaac

SEQ ID NO: 372302 - DNA, 25 bp, Rattus norvegicus
gattcgcagaatattgggcctcgcc

SEQ ID NO: 372303 - DNA, 25 bp, Rattus norvegicus
gattcgcagaattttgggcctcgcc

SEQ ID NO: 372304 - DNA, 25 bp, Rattus norvegicus
gattcgcaggtaacgatggcacctc

SEQ ID NO: 372305 - DNA, 25 bp, Rattus norvegicus
gattcgcaggtatcgatggcacctc

SEQ ID NO: 372306 - DNA, 25 bp, Rattus norvegicus
gattcgcatggcctatcgttatgaa

SEQ ID NO: 372307 - DNA, 25 bp, Rattus norvegicus
gattcgcatggcgtatcgttatgaa

SEQ ID NO: 372308 - DNA, 25 bp, Rattus norvegicus
gattcgcatgggacgttgacgagca

SEQ ID NO: 372309 - DNA, 25 bp, Rattus norvegicus
gattcgcatgggtcgttgacgagca

SEQ ID NO: 372310 - DNA, 25 bp, Rattus norvegicus
gattcgcattcacttatgccagcgt

SEQ ID NO: 372311 - DNA, 25 bp, Rattus norvegicus
gattcgcattcagttatgccagcgt

SEQ ID NO: 372312 - DNA, 25 bp, Rattus norvegicus
gattcgcccacgaggagattgaaat

SEQ ID NO: 372313 - DNA, 25 bp, Rattus norvegicus
gattcgcccacgtggagattgaaat

SEQ ID NO: 372314 - DNA, 25 bp, Rattus norvegicus
gattcgccctttcgatactaatgta

SEQ ID NO: 372315 - DNA, 25 bp, Rattus norvegicus
gattcgccctttggatactaatgta

SEQ ID NO: 372316 - DNA, 25 bp, Rattus norvegicus
gattcgccgactcgacaaaccaaag

SEQ ID NO: 372317 - DNA, 25 bp, Rattus norvegicus
gattcgccgactggacaaaccaaag

SEQ ID NO: 372318 - DNA, 25 bp, Rattus norvegicus
gattcgccttagcagtacgatttct

SEQ ID NO: 372319 - DNA, 25 bp, Rattus norvegicus
gattcgccttaggagtacgatttct

SEQ ID NO: 372320 - DNA, 25 bp, Rattus norvegicus
gattcgctacgtcgactatggtgga

SEQ ID NO: 372321 - DNA, 25 bp, Rattus norvegicus
gattcgctacgtggactatggtgga

SEQ ID NO: 372322 - DNA, 25 bp, Rattus norvegicus
gattcgctctgtaagatgcattcat

SEQ ID NO: 372323 - DNA, 25 bp, Rattus norvegicus
gattcgctctgttagatgcattcat

SEQ ID NO: 372324 - DNA, 25 bp, Rattus norvegicus
gattcgctgctacccagaggtacac

SEQ ID NO: 372325 - DNA, 25 bp, Rattus norvegicus
gattcgctgctagccagaggtacac

SEQ ID NO: 372326 - DNA, 25 bp, Rattus norvegicus
gattcgcttcgaacaaaccgcagtt

SEQ ID NO: 372327 - DNA, 25 bp, Rattus norvegicus
gattcgcttcgatcaaaccgcagtt

SEQ ID NO: 372328 - DNA, 25 bp, Rattus norvegicus
gattcgctttgtagccttgtgttag

SEQ ID NO: 372329 - DNA, 25 bp, Rattus norvegicus
gattcgctttgttgccttgtgttag

SEQ ID NO: 372330 - DNA, 25 bp, Rattus norvegicus
gattcgcttttgaaaattccaccta

SEQ ID NO: 372331 - DNA, 25 bp, Rattus norvegicus
gattcgcttttgtaaattccaccta

SEQ ID NO: 372332 - DNA, 25 bp, Rattus norvegicus
gattcggacctaatcaaccagtaat

SEQ ID NO: 372333 - DNA, 25 bp, Rattus norvegicus
gattcggacctattcaaccagtaat

SEQ ID NO: 372334 - DNA, 25 bp, Rattus norvegicus
gattcggagatcagaacccgactcc

SEQ ID NO: 372335 - DNA, 25 bp, Rattus norvegicus
gattcggagatctgaacccgactcc

SEQ ID NO: 372336 - DNA, 25 bp, Rattus norvegicus
gattcggagccacatatgatcttga

SEQ ID NO: 372337 - DNA, 25 bp, Rattus norvegicus
gattcggagccagatatgatcttga

SEQ ID NO: 372338 - DNA, 25 bp, Rattus norvegicus
gattcggagtatccactctcgctgg

SEQ ID NO: 372339 - DNA, 25 bp, Rattus norvegicus
gattcggagtatgcactctcgctgg

SEQ ID NO: 372340 - DNA, 25 bp, Rattus norvegicus
gattcggatttaagcttcaactggg

SEQ ID NO: 372341 - DNA, 25 bp, Rattus norvegicus
gattcggatttatgcttcaactggg

SEQ ID NO: 372342 - DNA, 25 bp, Rattus norvegicus
gattcggcagaacggacagtcactc

SEQ ID NO: 372343 - DNA, 25 bp, Rattus norvegicus
gattcggcagaagggacagtcactc

SEQ ID NO: 372344 - DNA, 25 bp, Rattus norvegicus
gattcggctcgaagaatgaagcact

SEQ ID NO: 372345 - DNA, 25 bp, Rattus norvegicus
gattcggctcgatgaatgaagcact

SEQ ID NO: 372346 - DNA, 25 bp, Rattus norvegicus
gattcggctgcccacggcaatgcag

SEQ ID NO: 372347 - DNA, 25 bp, Rattus norvegicus
gattcggctgccgacggcaatgcag

SEQ ID NO: 372348 - DNA, 25 bp, Rattus norvegicus
gattcggcttatacttgcttttcag

SEQ ID NO: 372349 - DNA, 25 bp, Rattus norvegicus
gattcggcttattcttgcttttcag

SEQ ID NO: 372350 - DNA, 25 bp, Rattus norvegicus
gattcgggaggtcttcttatttgca

SEQ ID NO: 372351 - DNA, 25 bp, Rattus norvegicus
gattcgggaggtgttcttatttgca

SEQ ID NO: 372352 - DNA, 25 bp, Rattus norvegicus
gattcgggatgcactaacatagttg

SEQ ID NO: 372353 - DNA, 25 bp, Rattus norvegicus
gattcgggatgctctaacatagttg

SEQ ID NO: 372354 - DNA, 25 bp, Rattus norvegicus
gattcgggcagtacacgtcttcatc

SEQ ID NO: 372355 - DNA, 25 bp, Rattus norvegicus
gattcgggcagttcacgtcttcatc

SEQ ID NO: 372356 - DNA, 25 bp, Rattus norvegicus
gattcgggtctcaaaggactgccta

SEQ ID NO: 372357 - DNA, 25 bp, Rattus norvegicus
gattcgggtctctaaggactgccta

SEQ ID NO: 372358 - DNA, 25 bp, Rattus norvegicus
gattcggtaaacatggagcggccca

SEQ ID NO: 372359 - DNA, 25 bp, Rattus norvegicus
gattcggtaaacttggagcggccca

SEQ ID NO: 372360 - DNA, 25 bp, Rattus norvegicus
gattcggtctaacgccttcacaaga

SEQ ID NO: 372361 - DNA, 25 bp, Rattus norvegicus
gattcggtctaaggccttcacaaga

SEQ ID NO: 372362 - DNA, 25 bp, Rattus norvegicus
gattcggtctctacgactaagcccc

SEQ ID NO: 372363 - DNA, 25 bp, Rattus norvegicus
gattcggtctcttcgactaagcccc

SEQ ID NO: 372364 - DNA, 25 bp, Rattus norvegicus
gattcggtgccgctcttgtcttgaa

SEQ ID NO: 372365 - DNA, 25 bp, Rattus norvegicus
gattcggtgccggtcttgtcttgaa

SEQ ID NO: 372366 - DNA, 25 bp, Rattus norvegicus
gattcggtggctaggttccaggcat

SEQ ID NO: 372367 - DNA, 25 bp, Rattus norvegicus
gattcggtggctcatttctgtgaac

SEQ ID NO: 372368 - DNA, 25 bp, Rattus norvegicus
gattcggtggctgatttctgtgaac

SEQ ID NO: 372369 - DNA, 25 bp, Rattus norvegicus
gattcggtggcttggttccaggcat

SEQ ID NO: 372370 - DNA, 25 bp, Rattus norvegicus
gattcggttggtagaacaaggcttt

SEQ ID NO: 372371 - DNA, 25 bp, Rattus norvegicus
gattcggttggttgaacaaggcttt

SEQ ID NO: 372372 - DNA, 25 bp, Rattus norvegicus
gattcggtttctcggcactgttaca

SEQ ID NO: 372373 - DNA, 25 bp, Rattus norvegicus
gattcggtttctgggcactgttaca

SEQ ID NO: 372374 - DNA, 25 bp, Rattus norvegicus
gattcggtttgtatcctttgaccat

SEQ ID NO: 372375 - DNA, 25 bp, Rattus norvegicus
gattcggtttgtttcctttgaccat

SEQ ID NO: 372376 - DNA, 25 bp, Rattus norvegicus
gattcgtacacgcatagtgccattt

SEQ ID NO: 372377 - DNA, 25 bp, Rattus norvegicus
gattcgtacacggatagtgccattt

SEQ ID NO: 372378 - DNA, 25 bp, Rattus norvegicus
gattcgtcactcaattttgctacta

SEQ ID NO: 372379 - DNA, 25 bp, Rattus norvegicus
gattcgtcactctattttgctacta

SEQ ID NO: 372380 - DNA, 25 bp, Rattus norvegicus
gattcgtcatctatgcatcaactgt

SEQ ID NO: 372381 - DNA, 25 bp, Rattus norvegicus
gattcgtcatctttgcatcaactgt

SEQ ID NO: 372382 - DNA, 25 bp, Rattus norvegicus
gattcgtccatcaacccagagcaaa

SEQ ID NO: 372383 - DNA, 25 bp, Rattus norvegicus
gattcgtccatctacccagagcaaa

SEQ ID NO: 372384 - DNA, 25 bp, Rattus norvegicus
gattcgtctgttagtctgggttcac

SEQ ID NO: 372385 - DNA, 25 bp, Rattus norvegicus
gattcgtctgtttgtctgggttcac

SEQ ID NO: 372386 - DNA, 25 bp, Rattus norvegicus
gattcgtgaagcattccatatttaa

SEQ ID NO: 372387 - DNA, 25 bp, Rattus norvegicus
gattcgtgaagctttccatatttaa

SEQ ID NO: 372388 - DNA, 25 bp, Rattus norvegicus
gattcgtgacccaaactgaggtttt

SEQ ID NO: 372389 - DNA, 25 bp, Rattus norvegicus
gattcgtgaccctaactgaggtttt

SEQ ID NO: 372390 - DNA, 25 bp, Rattus norvegicus
gattcgtgtcaaagcagagccattt

SEQ ID NO: 372391 - DNA, 25 bp, Rattus norvegicus
gattcgtgtcaatgcagagccattt

SEQ ID NO: 372392 - DNA, 25 bp, Rattus norvegicus
gattcgtgtcgcaggcatccttgag

SEQ ID NO: 372393 - DNA, 25 bp, Rattus norvegicus
gattcgtgtcgctggcatccttgag

SEQ ID NO: 372394 - DNA, 25 bp, Rattus norvegicus
gattcgtgtgttatccaggtggaca

SEQ ID NO: 372395 - DNA, 25 bp, Rattus norvegicus
gattcgtgtgttttccaggtggaca

SEQ ID NO: 372396 - DNA, 25 bp, Rattus norvegicus
gattcgttactacaagctgttgctt

SEQ ID NO: 372397 - DNA, 25 bp, Rattus norvegicus
gattcgttactagaagctgttgctt

SEQ ID NO: 372398 - DNA, 25 bp, Rattus norvegicus
gattcgttccttagggttcagggat

SEQ ID NO: 372399 - DNA, 25 bp, Rattus norvegicus
gattcgttcctttgggttcagggat

SEQ ID NO: 372400 - DNA, 25 bp, Rattus norvegicus
gattcgttgcatagtgtccttattt

SEQ ID NO: 372401 - DNA, 25 bp, Rattus norvegicus
gattcgttgcattgtgtccttattt

SEQ ID NO: 372402 - DNA, 25 bp, Rattus norvegicus
gattcgttggctaattctgtctgta

SEQ ID NO: 372403 - DNA, 25 bp, Rattus norvegicus
gattcgttggctcagaactgcttga

SEQ ID NO: 372404 - DNA, 25 bp, Rattus norvegicus
gattcgttggctgagaactgcttga

SEQ ID NO: 372405 - DNA, 25 bp, Rattus norvegicus
gattcgttggcttattctgtctgta

SEQ ID NO: 372406 - DNA, 25 bp, Rattus norvegicus
gattcgttgtatctgactcagagct

SEQ ID NO: 372407 - DNA, 25 bp, Rattus norvegicus
gattcgttgtatgtgactcagagct

SEQ ID NO: 372408 - DNA, 25 bp, Rattus norvegicus
gattcgttttgtagatcgtcagaaa

SEQ ID NO: 372409 - DNA, 25 bp, Rattus norvegicus
gattcgttttgttgatcgtcagaaa

SEQ ID NO: 372410 - DNA, 25 bp, Rattus norvegicus
gattctaaatggacccaagagccga

SEQ ID NO: 372411 - DNA, 25 bp, Rattus norvegicus
gattctaaatggtcccaagagccga

SEQ ID NO: 372412 - DNA, 25 bp, Rattus norvegicus
gattctaaatgtctgtaccctggat

SEQ ID NO: 372413 - DNA, 25 bp, Rattus norvegicus
gattctaaatgtgtgtaccctggat

SEQ ID NO: 372414 - DNA, 25 bp, Rattus norvegicus
gattctaaatttctggctttcggtt

SEQ ID NO: 372415 - DNA, 25 bp, Rattus norvegicus
gattctaaatttgtggctttcggtt

SEQ ID NO: 372416 - DNA, 25 bp, Rattus norvegicus
gattctaactacatttggcaatact

SEQ ID NO: 372417 - DNA, 25 bp, Rattus norvegicus
gattctaactacttttggcaatact

SEQ ID NO: 372418 - DNA, 25 bp, Rattus norvegicus
gattctaactggctcacttctgtat

SEQ ID NO: 372419 - DNA, 25 bp, Rattus norvegicus
gattctaactgggtcacttctgtat

SEQ ID NO: 372420 - DNA, 25 bp, Rattus norvegicus
gattctaagagtaaacccacccaat

SEQ ID NO: 372421 - DNA, 25 bp, Rattus norvegicus
gattctaagagttaacccacccaat

SEQ ID NO: 372422 - DNA, 25 bp, Rattus norvegicus
gattctaagattcagggctcatata

SEQ ID NO: 372423 - DNA, 25 bp, Rattus norvegicus
gattctaagattgagggctcatata

SEQ ID NO: 372424 - DNA, 25 bp, Rattus norvegicus
gattctaatccaagtgttcttttaa

SEQ ID NO: 372425 - DNA, 25 bp, Rattus norvegicus
gattctaatccatgtgttcttttaa

SEQ ID NO: 372426 - DNA, 25 bp, Rattus norvegicus
gattctaattgtatctaaagccttt

SEQ ID NO: 372427 - DNA, 25 bp, Rattus norvegicus
gattctaattgtttctaaagccttt

SEQ ID NO: 372428 - DNA, 25 bp, Rattus norvegicus
gattctacaactcgatttctaggta

SEQ ID NO: 372429 - DNA, 25 bp, Rattus norvegicus
gattctacaactggatttctaggta

SEQ ID NO: 372430 - DNA, 25 bp, Rattus norvegicus
gattctacacgaattcaaccttctt

SEQ ID NO: 372431 - DNA, 25 bp, Rattus norvegicus
gattctacacgatttcaaccttctt

SEQ ID NO: 372432 - DNA, 25 bp, Rattus norvegicus
gattctacacgtagctggaggactt

SEQ ID NO: 372433 - DNA, 25 bp, Rattus norvegicus
gattctacacgttgctggaggactt

SEQ ID NO: 372434 - DNA, 25 bp, Rattus norvegicus
gattctacacttcaggtttcttcag

SEQ ID NO: 372435 - DNA, 25 bp, Rattus norvegicus
gattctacacttgaggtttcttcag

SEQ ID NO: 372436 - DNA, 25 bp, Rattus norvegicus
gattctacagctcctaaagcacgag

SEQ ID NO: 372437 - DNA, 25 bp, Rattus norvegicus
gattctacagctgctaaagcacgag

SEQ ID NO: 372438 - DNA, 25 bp, Rattus norvegicus
gattctacaggcaccagatcaactt

SEQ ID NO: 372439 - DNA, 25 bp, Rattus norvegicus
gattctacaggctccagatcaactt

SEQ ID NO: 372440 - DNA, 25 bp, Rattus norvegicus
gattctacattgagccagggttctt

SEQ ID NO: 372441 - DNA, 25 bp, Rattus norvegicus
gattctacattgtgccagggttctt

SEQ ID NO: 372442 - DNA, 25 bp, Rattus norvegicus
gattctaccacacagccttatgcta

SEQ ID NO: 372443 - DNA, 25 bp, Rattus norvegicus
gattctaccacagagccttatgcta

SEQ ID NO: 372444 - DNA, 25 bp, Rattus norvegicus
gattctactgacctactatctctaa

SEQ ID NO: 372445 - DNA, 25 bp, Rattus norvegicus
gattctactgacgtactatctctaa

SEQ ID NO: 372446 - DNA, 25 bp, Rattus norvegicus
gattctactgagctatcatgaccgt

SEQ ID NO: 372447 - DNA, 25 bp, Rattus norvegicus
gattctactgaggtatcatgaccgt

SEQ ID NO: 372448 - DNA, 25 bp, Rattus norvegicus
gattctactgcacattatgcctgaa

SEQ ID NO: 372449 - DNA, 25 bp, Rattus norvegicus
gattctactgcagattatgcctgaa

SEQ ID NO: 372450 - DNA, 25 bp, Rattus norvegicus
gattctactgtaatggccatgctct

SEQ ID NO: 372451 - DNA, 25 bp, Rattus norvegicus
gattctactgtattggccatgctct

SEQ ID NO: 372452 - DNA, 25 bp, Rattus norvegicus
gattctactgtgaatgagtatgaca

SEQ ID NO: 372453 - DNA, 25 bp, Rattus norvegicus
gattctactgtgtatgagtatgaca

SEQ ID NO: 372454 - DNA, 25 bp, Rattus norvegicus
gattctagacataaactcttttccc

SEQ ID NO: 372455 - DNA, 25 bp, Rattus norvegicus
gattctagacattaactcttttccc

SEQ ID NO: 372456 - DNA, 25 bp, Rattus norvegicus
gattctagattcacacatctgtccc

SEQ ID NO: 372457 - DNA, 25 bp, Rattus norvegicus
gattctagattctcacatctgtccc

SEQ ID NO: 372458 - DNA, 25 bp, Rattus norvegicus
gattctagctgtcttagttcatgag

SEQ ID NO: 372459 - DNA, 25 bp, Rattus norvegicus
gattctagctgtgttagttcatgag

SEQ ID NO: 372460 - DNA, 25 bp, Rattus norvegicus
gattctaggcatcagttccaccatt

SEQ ID NO: 372461 - DNA, 25 bp, Rattus norvegicus
gattctaggcatgagttccaccatt

SEQ ID NO: 372462 - DNA, 25 bp, Rattus norvegicus
gattctagggccagctatgtagctc

SEQ ID NO: 372463 - DNA, 25 bp, Rattus norvegicus
gattctagggcctgctatgtagctc

SEQ ID NO: 372464 - DNA, 25 bp, Rattus norvegicus
gattctagtcccatcttttatcttt

SEQ ID NO: 372465 - DNA, 25 bp, Rattus norvegicus
gattctagtcccttcttttatcttt

SEQ ID NO: 372466 - DNA, 25 bp, Rattus norvegicus
gattctagtgaaaggcatccgccat

SEQ ID NO: 372467 - DNA, 25 bp, Rattus norvegicus
gattctagtgaatggcatccgccat

SEQ ID NO: 372468 - DNA, 25 bp, Rattus norvegicus
gattctagttccagacatgtttcat

SEQ ID NO: 372469 - DNA, 25 bp, Rattus norvegicus
gattctagttcctgacatgtttcat

SEQ ID NO: 372470 - DNA, 25 bp, Rattus norvegicus
gattctagtttcattcacggaagca

SEQ ID NO: 372471 - DNA, 25 bp, Rattus norvegicus
gattctagtttctttcacggaagca

SEQ ID NO: 372472 - DNA, 25 bp, Rattus norvegicus
gattctatacgacacatatccactg

SEQ ID NO: 372473 - DNA, 25 bp, Rattus norvegicus
gattctatacgagacatatccactg

SEQ ID NO: 372474 - DNA, 25 bp, Rattus norvegicus
gattctatagacaccagcactgtga

SEQ ID NO: 372475 - DNA, 25 bp, Rattus norvegicus
gattctatagacagagctctgtggc

SEQ ID NO: 372476 - DNA, 25 bp, Rattus norvegicus
gattctatagactccagcactgtga

SEQ ID NO: 372477 - DNA, 25 bp, Rattus norvegicus
gattctatagactgagctctgtggc

SEQ ID NO: 372478 - DNA, 25 bp, Rattus norvegicus
gattctatatacaacttctttgctg

SEQ ID NO: 372479 - DNA, 25 bp, Rattus norvegicus
gattctatatactacttctttgctg

SEQ ID NO: 372480 - DNA, 25 bp, Rattus norvegicus
gattctatcaaaacactcaagtcga

SEQ ID NO: 372481 - DNA, 25 bp, Rattus norvegicus
gattctatcaaatcactcaagtcga

SEQ ID NO: 372482 - DNA, 25 bp, Rattus norvegicus
gattctatcacaagtaaccaccaga

SEQ ID NO: 372483 - DNA, 25 bp, Rattus norvegicus
gattctatcacatgtaaccaccaga

SEQ ID NO: 372484 - DNA, 25 bp, Rattus norvegicus
gattctatcttaaaaccgtgccaat

SEQ ID NO: 372485 - DNA, 25 bp, Rattus norvegicus
gattctatcttataaccgtgccaat

SEQ ID NO: 372486 - DNA, 25 bp, Rattus norvegicus
gattctatgaggatacttccccttc

SEQ ID NO: 372487 - DNA, 25 bp, Rattus norvegicus
gattctatgaggttacttccccttc

SEQ ID NO: 372488 - DNA, 25 bp, Rattus norvegicus
gattctattatgctatttcaagtac

SEQ ID NO: 372489 - DNA, 25 bp, Rattus norvegicus
gattctattatggtatttcaagtac

SEQ ID NO: 372490 - DNA, 25 bp, Rattus norvegicus
gattctattcacacaggccttttaa

SEQ ID NO: 372491 - DNA, 25 bp, Rattus norvegicus
gattctattcactcaggccttttaa

SEQ ID NO: 372492 - DNA, 25 bp, Rattus norvegicus
gattctattgttatctggtcagact

SEQ ID NO: 372493 - DNA, 25 bp, Rattus norvegicus
gattctattgttttctggtcagact

SEQ ID NO: 372494 - DNA, 25 bp, Rattus norvegicus
gattctcaacagcacctacaaggat

SEQ ID NO: 372495 - DNA, 25 bp, Rattus norvegicus
gattctcaacaggacctacaaggat

SEQ ID NO: 372496 - DNA, 25 bp, Rattus norvegicus
gattctcaacgtctgagtcgcgacc

SEQ ID NO: 372497 - DNA, 25 bp, Rattus norvegicus
gattctcaacgtgtgagtcgcgacc

SEQ ID NO: 372498 - DNA, 25 bp, Rattus norvegicus
gattctcaagcgcctcaaccctgag

SEQ ID NO: 372499 - DNA, 25 bp, Rattus norvegicus
gattctcaagcggctcaaccctgag

SEQ ID NO: 372500 - DNA, 25 bp, Rattus norvegicus
gattctcaagctactcatttctaag

SEQ ID NO: 372501 - DNA, 25 bp, Rattus norvegicus
gattctcaagcttctcatttctaag

SEQ ID NO: 372502 - DNA, 25 bp, Rattus norvegicus
gattctcaagttccaggtcccataa

SEQ ID NO: 372503 - DNA, 25 bp, Rattus norvegicus
gattctcaagttctgattgtgctct

SEQ ID NO: 372504 - DNA, 25 bp, Rattus norvegicus
gattctcaagttgcaggtcccataa

SEQ ID NO: 372505 - DNA, 25 bp, Rattus norvegicus
gattctcaagttgtgattgtgctct

SEQ ID NO: 372506 - DNA, 25 bp, Rattus norvegicus
gattctcacagccactgaaaatggg

SEQ ID NO: 372507 - DNA, 25 bp, Rattus norvegicus
gattctcacagccattctgatgatg

SEQ ID NO: 372508 - DNA, 25 bp, Rattus norvegicus
gattctcacagcgactgaaaatggg

SEQ ID NO: 372509 - DNA, 25 bp, Rattus norvegicus
gattctcacagcgattctgatgatg

SEQ ID NO: 372510 - DNA, 25 bp, Rattus norvegicus
gattctcacccgcagactcgatagt

SEQ ID NO: 372511 - DNA, 25 bp, Rattus norvegicus
gattctcacccggagactcgatagt

SEQ ID NO: 372512 - DNA, 25 bp, Rattus norvegicus
gattctcacctgatagccggacaaa

SEQ ID NO: 372513 - DNA, 25 bp, Rattus norvegicus
gattctcacctgttagccggacaaa

SEQ ID NO: 372514 - DNA, 25 bp, Rattus norvegicus
gattctcagagccttcacaagacac

SEQ ID NO: 372515 - DNA, 25 bp, Rattus norvegicus
gattctcagagcgttcacaagacac

SEQ ID NO: 372516 - DNA, 25 bp, Rattus norvegicus
gattctcagagtcttttcctaacag

SEQ ID NO: 372517 - DNA, 25 bp, Rattus norvegicus
gattctcagagtgttttcctaacag

SEQ ID NO: 372518 - DNA, 25 bp, Rattus norvegicus
gattctcagatacttctcttagctt

SEQ ID NO: 372519 - DNA, 25 bp, Rattus norvegicus
gattctcagatagttctcttagctt

SEQ ID NO: 372520 - DNA, 25 bp, Rattus norvegicus
gattctcagcctctgtatacgggaa

SEQ ID NO: 372521 - DNA, 25 bp, Rattus norvegicus
gattctcagcctgtgtatacgggaa

SEQ ID NO: 372522 - DNA, 25 bp, Rattus norvegicus
gattctcagcttaacagagtggcca

SEQ ID NO: 372523 - DNA, 25 bp, Rattus norvegicus
gattctcagctttacagagtggcca

SEQ ID NO: 372524 - DNA, 25 bp, Rattus norvegicus
gattctcaggatacatgtaatggct

SEQ ID NO: 372525 - DNA, 25 bp, Rattus norvegicus
gattctcaggatcagatgtccttca

SEQ ID NO: 372526 - DNA, 25 bp, Rattus norvegicus
gattctcaggatgagatgtccttca

SEQ ID NO: 372527 - DNA, 25 bp, Rattus norvegicus
gattctcaggattcatgtaatggct

SEQ ID NO: 372528 - DNA, 25 bp, Rattus norvegicus
gattctcagtggatgcttctgggct

SEQ ID NO: 372529 - DNA, 25 bp, Rattus norvegicus
gattctcagtggttgcttctgggct

SEQ ID NO: 372530 - DNA, 25 bp, Rattus norvegicus
gattctcagtttacatgtggacctt

SEQ ID NO: 372531 - DNA, 25 bp, Rattus norvegicus
gattctcagttttcatgtggacctt

SEQ ID NO: 372532 - DNA, 25 bp, Rattus norvegicus
gattctccactaatggcagggcctg

SEQ ID NO: 372533 - DNA, 25 bp, Rattus norvegicus
gattctccactattggcagggcctg

SEQ ID NO: 372534 - DNA, 25 bp, Rattus norvegicus
gattctccattaatcatgtcccaga

SEQ ID NO: 372535 - DNA, 25 bp, Rattus norvegicus
gattctccattattcatgtcccaga

SEQ ID NO: 372536 - DNA, 25 bp, Rattus norvegicus
gattctcccagcaggacaatggcca

SEQ ID NO: 372537 - DNA, 25 bp, Rattus norvegicus
gattctcccagctggacaatggcca

SEQ ID NO: 372538 - DNA, 25 bp, Rattus norvegicus
gattctcctcatatctgattctgca

SEQ ID NO: 372539 - DNA, 25 bp, Rattus norvegicus
gattctcctcatttctgattctgca

SEQ ID NO: 372540 - DNA, 25 bp, Rattus norvegicus
gattctcctgaaaaccgtctacgaa

SEQ ID NO: 372541 - DNA, 25 bp, Rattus norvegicus
gattctcctgaataccgtctacgaa

SEQ ID NO: 372542 - DNA, 25 bp, Rattus norvegicus
gattctcctgcaccagaactggaat

SEQ ID NO: 372543 - DNA, 25 bp, Rattus norvegicus
gattctcctgcagcagaactggaat

SEQ ID NO: 372544 - DNA, 25 bp, Rattus norvegicus
gattctcctgttataaaccgaatgg

SEQ ID NO: 372545 - DNA, 25 bp, Rattus norvegicus
gattctcctgttttaaaccgaatgg

SEQ ID NO: 372546 - DNA, 25 bp, Rattus norvegicus
gattctcgaagactctcgggttttt

SEQ ID NO: 372547 - DNA, 25 bp, Rattus norvegicus
gattctcgaagagtctcgggttttt

SEQ ID NO: 372548 - DNA, 25 bp, Rattus norvegicus
gattctcggagcaatgtccaacttc

SEQ ID NO: 372549 - DNA, 25 bp, Rattus norvegicus
gattctcggagctatgtccaacttc

SEQ ID NO: 372550 - DNA, 25 bp, Rattus norvegicus
gattctcggcgtcgacttggcagtc

SEQ ID NO: 372551 - DNA, 25 bp, Rattus norvegicus
gattctcggcgtggacttggcagtc

SEQ ID NO: 372552 - DNA, 25 bp, Rattus norvegicus
gattctctaagaattccttgctttt

SEQ ID NO: 372553 - DNA, 25 bp, Rattus norvegicus
gattctctaagatttccttgctttt

SEQ ID NO: 372554 - DNA, 25 bp, Rattus norvegicus
gattctctacatatctaataacctg

SEQ ID NO: 372555 - DNA, 25 bp, Rattus norvegicus
gattctctacatttctaataacctg

SEQ ID NO: 372556 - DNA, 25 bp, Rattus norvegicus
gattctctcaatacatgtgtgttct

SEQ ID NO: 372557 - DNA, 25 bp, Rattus norvegicus
gattctctcaattcatgtgtgttct

SEQ ID NO: 372558 - DNA, 25 bp, Rattus norvegicus
gattctctcatgaggcttatctctc

SEQ ID NO: 372559 - DNA, 25 bp, Rattus norvegicus
gattctctcatgtggcttatctctc

SEQ ID NO: 372560 - DNA, 25 bp, Rattus norvegicus
gattctctccagcatcttgtgaaaa

SEQ ID NO: 372561 - DNA, 25 bp, Rattus norvegicus
gattctctccaggatcttgtgaaaa

SEQ ID NO: 372562 - DNA, 25 bp, Rattus norvegicus
gattctctgagacgctctcgtgttg

SEQ ID NO: 372563 - DNA, 25 bp, Rattus norvegicus
gattctctgagaggctctcgtgttg

SEQ ID NO: 372564 - DNA, 25 bp, Rattus norvegicus
gattctctgccacacagactacgag

SEQ ID NO: 372565 - DNA, 25 bp, Rattus norvegicus
gattctctgccagacagactacgag

SEQ ID NO: 372566 - DNA, 25 bp, Rattus norvegicus
gattctctgcctagacaatcatgta

SEQ ID NO: 372567 - DNA, 25 bp, Rattus norvegicus
gattctctgccttgacaatcatgta

SEQ ID NO: 372568 - DNA, 25 bp, Rattus norvegicus
gattctctgcttatctagttatggg

SEQ ID NO: 372569 - DNA, 25 bp, Rattus norvegicus
gattctctgcttttctagttatggg

SEQ ID NO: 372570 - DNA, 25 bp, Rattus norvegicus
gattctctggttctgtttaaggaca

SEQ ID NO: 372571 - DNA, 25 bp, Rattus norvegicus
gattctctggttgtgtttaaggaca

SEQ ID NO: 372572 - DNA, 25 bp, Rattus norvegicus
gattctctgtagattgtctctctga

SEQ ID NO: 372573 - DNA, 25 bp, Rattus norvegicus
gattctctgtagtttgtctctctga

SEQ ID NO: 372574 - DNA, 25 bp, Rattus norvegicus
gattctctgtcacttggtgcagtac

SEQ ID NO: 372575 - DNA, 25 bp, Rattus norvegicus
gattctctgtcagttggtgcagtac

SEQ ID NO: 372576 - DNA, 25 bp, Rattus norvegicus
gattctctgtgaatctgcttcttaa

SEQ ID NO: 372577 - DNA, 25 bp, Rattus norvegicus
gattctctgtgattctgcttcttaa

SEQ ID NO: 372578 - DNA, 25 bp, Rattus norvegicus
gattctctgttcacgttgcaacatt

SEQ ID NO: 372579 - DNA, 25 bp, Rattus norvegicus
gattctctgttctcgttgcaacatt

SEQ ID NO: 372580 - DNA, 25 bp, Rattus norvegicus
gattctcttaacattgtcactatga

SEQ ID NO: 372581 - DNA, 25 bp, Rattus norvegicus
gattctcttaactttgtcactatga

SEQ ID NO: 372582 - DNA, 25 bp, Rattus norvegicus
gattctcttaggcattggttcttac

SEQ ID NO: 372583 - DNA, 25 bp, Rattus norvegicus
gattctcttagggattggttcttac

SEQ ID NO: 372584 - DNA, 25 bp, Rattus norvegicus
gattctcttcagctttgactcatac

SEQ ID NO: 372585 - DNA, 25 bp, Rattus norvegicus
gattctcttcaggtttgactcatac

SEQ ID NO: 372586 - DNA, 25 bp, Rattus norvegicus
gattctcttcatctgaaccaacatg

SEQ ID NO: 372587 - DNA, 25 bp, Rattus norvegicus
gattctcttcatgtgaaccaacatg

SEQ ID NO: 372588 - DNA, 25 bp, Rattus norvegicus
gattctcttcttataggttctaggg

SEQ ID NO: 372589 - DNA, 25 bp, Rattus norvegicus
gattctcttcttttaggttctaggg

SEQ ID NO: 372590 - DNA, 25 bp, Rattus norvegicus
gattctcttggccagtgaggagtta

SEQ ID NO: 372591 - DNA, 25 bp, Rattus norvegicus
gattctcttggcgagtgaggagtta

SEQ ID NO: 372592 - DNA, 25 bp, Rattus norvegicus
gattctcttgtgattttgcaccagc

SEQ ID NO: 372593 - DNA, 25 bp, Rattus norvegicus
gattctcttgtgtttttgcaccagc

SEQ ID NO: 372594 - DNA, 25 bp, Rattus norvegicus
gattctctttagcaactgacaggtt

SEQ ID NO: 372595 - DNA, 25 bp, Rattus norvegicus
gattctctttaggaactgacaggtt

SEQ ID NO: 372596 - DNA, 25 bp, Rattus norvegicus
gattctcttttcattgtttccactg

SEQ ID NO: 372597 - DNA, 25 bp, Rattus norvegicus
gattctcttttctttgtttccactg

SEQ ID NO: 372598 - DNA, 25 bp, Rattus norvegicus
gattctcttttgaatctttctttct

SEQ ID NO: 372599 - DNA, 25 bp, Rattus norvegicus
gattctcttttgtatctttctttct

SEQ ID NO: 372600 - DNA, 25 bp, Rattus norvegicus
gattctgaaaacatgtctgcacaat

SEQ ID NO: 372601 - DNA, 25 bp, Rattus norvegicus
gattctgaaaacttgtctgcacaat

SEQ ID NO: 372602 - DNA, 25 bp, Rattus norvegicus
gattctgaaaagcttccttcttgta

SEQ ID NO: 372603 - DNA, 25 bp, Rattus norvegicus
gattctgaaaaggttccttcttgta

SEQ ID NO: 372604 - DNA, 25 bp, Rattus norvegicus
gattctgaaccaccgatggcagcga

SEQ ID NO: 372605 - DNA, 25 bp, Rattus norvegicus
gattctgaaccagcgatggcagcga

SEQ ID NO: 372606 - DNA, 25 bp, Rattus norvegicus
gattctgaagaacgctacctacgac

SEQ ID NO: 372607 - DNA, 25 bp, Rattus norvegicus
gattctgaagaaggctacctacgac

SEQ ID NO: 372608 - DNA, 25 bp, Rattus norvegicus
gattctgaagacacgctctttgagc

SEQ ID NO: 372609 - DNA, 25 bp, Rattus norvegicus
gattctgaagactcgctctttgagc

SEQ ID NO: 372610 - DNA, 25 bp, Rattus norvegicus
gattctgaatcactgtagtaaggcg

SEQ ID NO: 372611 - DNA, 25 bp, Rattus norvegicus
gattctgaatcagtgtagtaaggcg

SEQ ID NO: 372612 - DNA, 25 bp, Rattus norvegicus
gattctgaccaaccattcgtggcca

SEQ ID NO: 372613 - DNA, 25 bp, Rattus norvegicus
gattctgaccaagcattcgtggcca

SEQ ID NO: 372614 - DNA, 25 bp, Rattus norvegicus
gattctgacctaccacaggactctg

SEQ ID NO: 372615 - DNA, 25 bp, Rattus norvegicus
gattctgacctaccagctgtgtcac

SEQ ID NO: 372616 - DNA, 25 bp, Rattus norvegicus
gattctgacctagcacaggactctg

SEQ ID NO: 372617 - DNA, 25 bp, Rattus norvegicus
gattctgacctagcagctgtgtcac

SEQ ID NO: 372618 - DNA, 25 bp, Rattus norvegicus
gattctgacgtgactcgttctgaga

SEQ ID NO: 372619 - DNA, 25 bp, Rattus norvegicus
gattctgacgtgtctcgttctgaga

SEQ ID NO: 372620 - DNA, 25 bp, Rattus norvegicus
gattctgactgaagagatgctactc

SEQ ID NO: 372621 - DNA, 25 bp, Rattus norvegicus
gattctgactgatgagatgctactc

SEQ ID NO: 372622 - DNA, 25 bp, Rattus norvegicus
gattctgactggcagagacctttca

SEQ ID NO: 372623 - DNA, 25 bp, Rattus norvegicus
gattctgactgggagagacctttca

SEQ ID NO: 372624 - DNA, 25 bp, Rattus norvegicus
gattctgacttccaaactgtgagcc

SEQ ID NO: 372625 - DNA, 25 bp, Rattus norvegicus
gattctgacttcgaaactgtgagcc

SEQ ID NO: 372626 - DNA, 25 bp, Rattus norvegicus
gattctgagactagtccaggccttc

SEQ ID NO: 372627 - DNA, 25 bp, Rattus norvegicus
gattctgagacttgtccaggccttc

SEQ ID NO: 372628 - DNA, 25 bp, Rattus norvegicus
gattctgagcaacctatctttattg

SEQ ID NO: 372629 - DNA, 25 bp, Rattus norvegicus
gattctgagcaagctatctttattg

SEQ ID NO: 372630 - DNA, 25 bp, Rattus norvegicus
gattctgagccactctgtaacctga

SEQ ID NO: 372631 - DNA, 25 bp, Rattus norvegicus
gattctgagccagtctgtaacctga

SEQ ID NO: 372632 - DNA, 25 bp, Rattus norvegicus
gattctgagcccagtgtacttcata

SEQ ID NO: 372633 - DNA, 25 bp, Rattus norvegicus
gattctgagccccttgtcagacttt

SEQ ID NO: 372634 - DNA, 25 bp, Rattus norvegicus
gattctgagcccgttgtcagacttt

SEQ ID NO: 372635 - DNA, 25 bp, Rattus norvegicus
gattctgagccctgtgtacttcata

SEQ ID NO: 372636 - DNA, 25 bp, Rattus norvegicus
gattctgaggatattccttcgcctt

SEQ ID NO: 372637 - DNA, 25 bp, Rattus norvegicus
gattctgaggattttccttcgcctt

SEQ ID NO: 372638 - DNA, 25 bp, Rattus norvegicus
gattctgagggaccaaccggacaat

SEQ ID NO: 372639 - DNA, 25 bp, Rattus norvegicus
gattctgagggagcaaccggacaat

SEQ ID NO: 372640 - DNA, 25 bp, Rattus norvegicus
gattctgagtccactgagctatgac

SEQ ID NO: 372641 - DNA, 25 bp, Rattus norvegicus
gattctgagtcctctgagctatgac

SEQ ID NO: 372642 - DNA, 25 bp, Rattus norvegicus
gattctgagttgacggacacctcgc

SEQ ID NO: 372643 - DNA, 25 bp, Rattus norvegicus
gattctgagttgtcggacacctcgc

SEQ ID NO: 372644 - DNA, 25 bp, Rattus norvegicus
gattctgatagcaaagcgactttag

SEQ ID NO: 372645 - DNA, 25 bp, Rattus norvegicus
gattctgatagctaagcgactttag

SEQ ID NO: 372646 - DNA, 25 bp, Rattus norvegicus
gattctgatatcagcttgaaagcgc

SEQ ID NO: 372647 - DNA, 25 bp, Rattus norvegicus
gattctgatatctgcttgaaagcgc

SEQ ID NO: 372648 - DNA, 25 bp, Rattus norvegicus
gattctgatcagacgtggcaaagtt

SEQ ID NO: 372649 - DNA, 25 bp, Rattus norvegicus
gattctgatcagtcgtggcaaagtt

SEQ ID NO: 372650 - DNA, 25 bp, Rattus norvegicus
gattctgatgaaaggtctctctgag

SEQ ID NO: 372651 - DNA, 25 bp, Rattus norvegicus
gattctgatgaatggtctctctgag

SEQ ID NO: 372652 - DNA, 25 bp, Rattus norvegicus
gattctgatgatacttgtctgctcc

SEQ ID NO: 372653 - DNA, 25 bp, Rattus norvegicus
gattctgatgattcttgtctgctcc

SEQ ID NO: 372654 - DNA, 25 bp, Rattus norvegicus
gattctgatgcacaagcttccgtgt

SEQ ID NO: 372655 - DNA, 25 bp, Rattus norvegicus
gattctgatgcagaagcttccgtgt

SEQ ID NO: 372656 - DNA, 25 bp, Rattus norvegicus
gattctgatgggactggtcaaactc

SEQ ID NO: 372657 - DNA, 25 bp, Rattus norvegicus
gattctgatgggtctggtcaaactc

SEQ ID NO: 372658 - DNA, 25 bp, Rattus norvegicus
gattctgattcccaagcaagtcctc

SEQ ID NO: 372659 - DNA, 25 bp, Rattus norvegicus
gattctgattccgaagcaagtcctc

SEQ ID NO: 372660 - DNA, 25 bp, Rattus norvegicus
gattctgattctactgggcgagacc

SEQ ID NO: 372661 - DNA, 25 bp, Rattus norvegicus
gattctgattcttctgggcgagacc

SEQ ID NO: 372662 - DNA, 25 bp, Rattus norvegicus
gattctgattgccaatgcctgagat

SEQ ID NO: 372663 - DNA, 25 bp, Rattus norvegicus
gattctgattgcgaatgcctgagat

SEQ ID NO: 372664 - DNA, 25 bp, Rattus norvegicus
gattctgcagatcggcttggtttcc

SEQ ID NO: 372665 - DNA, 25 bp, Rattus norvegicus
gattctgcagatgggcttggtttcc

SEQ ID NO: 372666 - DNA, 25 bp, Rattus norvegicus
gattctgcagcacattcctccatgt

SEQ ID NO: 372667 - DNA, 25 bp, Rattus norvegicus
gattctgcagcagattcctccatgt

SEQ ID NO: 372668 - DNA, 25 bp, Rattus norvegicus
gattctgcagctctcactcacagag

SEQ ID NO: 372669 - DNA, 25 bp, Rattus norvegicus
gattctgcagctgtcactcacagag

SEQ ID NO: 372670 - DNA, 25 bp, Rattus norvegicus
gattctgcaggacatctgcccagta

SEQ ID NO: 372671 - DNA, 25 bp, Rattus norvegicus
gattctgcaggactcgggtctgaaa

SEQ ID NO: 372672 - DNA, 25 bp, Rattus norvegicus
gattctgcaggagatctgcccagta

SEQ ID NO: 372673 - DNA, 25 bp, Rattus norvegicus
gattctgcaggagtcgggtctgaaa

SEQ ID NO: 372674 - DNA, 25 bp, Rattus norvegicus
gattctgccaacattgctgactata

SEQ ID NO: 372675 - DNA, 25 bp, Rattus norvegicus
gattctgccaactttgctgactata

SEQ ID NO: 372676 - DNA, 25 bp, Rattus norvegicus
gattctgcccttcgagcaaactgaa

SEQ ID NO: 372677 - DNA, 25 bp, Rattus norvegicus
gattctgcccttggagcaaactgaa

SEQ ID NO: 372678 - DNA, 25 bp, Rattus norvegicus
gattctgccgtcattctgatgtgat

SEQ ID NO: 372679 - DNA, 25 bp, Rattus norvegicus
gattctgccgtctttctgatgtgat

SEQ ID NO: 372680 - DNA, 25 bp, Rattus norvegicus
gattctgcctccagaaactgataac

SEQ ID NO: 372681 - DNA, 25 bp, Rattus norvegicus
gattctgcctcctgaaactgataac

SEQ ID NO: 372682 - DNA, 25 bp, Rattus norvegicus
gattctgcgaagcacttcctgatga

SEQ ID NO: 372683 - DNA, 25 bp, Rattus norvegicus
gattctgcgaaggacttcctgatga

SEQ ID NO: 372684 - DNA, 25 bp, Rattus norvegicus
gattctgcgataatgtttggacttt

SEQ ID NO: 372685 - DNA, 25 bp, Rattus norvegicus
gattctgcgatattgtttggacttt

SEQ ID NO: 372686 - DNA, 25 bp, Rattus norvegicus
gattctgctcacagcctccttctta

SEQ ID NO: 372687 - DNA, 25 bp, Rattus norvegicus
gattctgctcactgcctccttctta

SEQ ID NO: 372688 - DNA, 25 bp, Rattus norvegicus
gattctgctctgataattgctgtaa

SEQ ID NO: 372689 - DNA, 25 bp, Rattus norvegicus
gattctgctctgttaattgctgtaa

SEQ ID NO: 372690 - DNA, 25 bp, Rattus norvegicus
gattctgctggactattctgcattc

SEQ ID NO: 372691 - DNA, 25 bp, Rattus norvegicus
gattctgctggagtattctgcattc

SEQ ID NO: 372692 - DNA, 25 bp, Rattus norvegicus
gattctgctggtaaaagtcatttat

SEQ ID NO: 372693 - DNA, 25 bp, Rattus norvegicus
gattctgctggtagtttcatgttct

SEQ ID NO: 372694 - DNA, 25 bp, Rattus norvegicus
gattctgctggttaaagtcatttat

SEQ ID NO: 372695 - DNA, 25 bp, Rattus norvegicus
gattctgctggttgtttcatgttct

SEQ ID NO: 372696 - DNA, 25 bp, Rattus norvegicus
gattctgcttcaatttttgtttcac

SEQ ID NO: 372697 - DNA, 25 bp, Rattus norvegicus
gattctgcttcattttttgtttcac

SEQ ID NO: 372698 - DNA, 25 bp, Rattus norvegicus
gattctggatcacaccacagactga

SEQ ID NO: 372699 - DNA, 25 bp, Rattus norvegicus
gattctggatcagaccacagactga

SEQ ID NO: 372700 - DNA, 25 bp, Rattus norvegicus
gattctggattcctgacggcacaaa

SEQ ID NO: 372701 - DNA, 25 bp, Rattus norvegicus
gattctggattcgtgacggcacaaa

SEQ ID NO: 372702 - DNA, 25 bp, Rattus norvegicus
gattctggcaagaccgattacacga

SEQ ID NO: 372703 - DNA, 25 bp, Rattus norvegicus
gattctggcaagtccgattacacga

SEQ ID NO: 372704 - DNA, 25 bp, Rattus norvegicus
gattctggcacaaaaactcatacat

SEQ ID NO: 372705 - DNA, 25 bp, Rattus norvegicus
gattctggcacataaactcatacat

SEQ ID NO: 372706 - DNA, 25 bp, Rattus norvegicus
gattctggccacattaatattaaca

SEQ ID NO: 372707 - DNA, 25 bp, Rattus norvegicus
gattctggccactttaatattaaca

SEQ ID NO: 372708 - DNA, 25 bp, Rattus norvegicus
gattctgggaacagctcttaaccat

SEQ ID NO: 372709 - DNA, 25 bp, Rattus norvegicus
gattctgggaactgctcttaaccat

SEQ ID NO: 372710 - DNA, 25 bp, Rattus norvegicus
gattctgggaagagagcctccccat

SEQ ID NO: 372711 - DNA, 25 bp, Rattus norvegicus
gattctgggaagtgagcctccccat

SEQ ID NO: 372712 - DNA, 25 bp, Rattus norvegicus
gattctgggaatcggttcctactca

SEQ ID NO: 372713 - DNA, 25 bp, Rattus norvegicus
gattctgggaatgggttcctactca

SEQ ID NO: 372714 - DNA, 25 bp, Rattus norvegicus
gattctgggagtccttttccattcc

SEQ ID NO: 372715 - DNA, 25 bp, Rattus norvegicus
gattctgggagtgcttttccattcc

SEQ ID NO: 372716 - DNA, 25 bp, Rattus norvegicus
gattctgggatcactcagaggtata

SEQ ID NO: 372717 - DNA, 25 bp, Rattus norvegicus
gattctgggatctctcagaggtata

SEQ ID NO: 372718 - DNA, 25 bp, Rattus norvegicus
gattctgggcaacggctttaccact

SEQ ID NO: 372719 - DNA, 25 bp, Rattus norvegicus
gattctgggcaagggctttaccact

SEQ ID NO: 372720 - DNA, 25 bp, Rattus norvegicus
gattctgggcacagcaagctcggct

SEQ ID NO: 372721 - DNA, 25 bp, Rattus norvegicus
gattctgggcactgcaagctcggct

SEQ ID NO: 372722 - DNA, 25 bp, Rattus norvegicus
gattctgggcagagtcattgtggta

SEQ ID NO: 372723 - DNA, 25 bp, Rattus norvegicus
gattctgggcagtgtcattgtggta

SEQ ID NO: 372724 - DNA, 25 bp, Rattus norvegicus
gattctgggctcaaaaggaaatggt

SEQ ID NO: 372725 - DNA, 25 bp, Rattus norvegicus
gattctgggctctaaaggaaatggt

SEQ ID NO: 372726 - DNA, 25 bp, Rattus norvegicus
gattctgggtgacacctggcactaa

SEQ ID NO: 372727 - DNA, 25 bp, Rattus norvegicus
gattctgggtgagacctggcactaa

SEQ ID NO: 372728 - DNA, 25 bp, Rattus norvegicus
gattctggtattaggagccctcatc

SEQ ID NO: 372729 - DNA, 25 bp, Rattus norvegicus
gattctggtatttggagccctcatc

SEQ ID NO: 372730 - DNA, 25 bp, Rattus norvegicus
gattctggtcatcatctcctacatt

SEQ ID NO: 372731 - DNA, 25 bp, Rattus norvegicus
gattctggtcatgatctcctacatt

SEQ ID NO: 372732 - DNA, 25 bp, Rattus norvegicus
gattctggttttaaattgctgcttt

SEQ ID NO: 372733 - DNA, 25 bp, Rattus norvegicus
gattctggtttttaattgctgcttt

SEQ ID NO: 372734 - DNA, 25 bp, Rattus norvegicus
gattctgtaaaacgaactcttgtgt

SEQ ID NO: 372735 - DNA, 25 bp, Rattus norvegicus
gattctgtaaaaggaactcttgtgt

SEQ ID NO: 372736 - DNA, 25 bp, Rattus norvegicus
gattctgtaaagaaagtcttcctta

SEQ ID NO: 372737 - DNA, 25 bp, Rattus norvegicus
gattctgtaaagtaagtcttcctta

SEQ ID NO: 372738 - DNA, 25 bp, Rattus norvegicus
gattctgtaactaagtgctcctcca

SEQ ID NO: 372739 - DNA, 25 bp, Rattus norvegicus
gattctgtaacttagtgctcctcca

SEQ ID NO: 372740 - DNA, 25 bp, Rattus norvegicus
gattctgtaaggagcagctgcccgc

SEQ ID NO: 372741 - DNA, 25 bp, Rattus norvegicus
gattctgtaaggtgcagctgcccgc

SEQ ID NO: 372742 - DNA, 25 bp, Rattus norvegicus
gattctgtagtacatccctgcagcc

SEQ ID NO: 372743 - DNA, 25 bp, Rattus norvegicus
gattctgtagtagatccctgcagcc

SEQ ID NO: 372744 - DNA, 25 bp, Rattus norvegicus
gattctgtagttcggaaacacccct

SEQ ID NO: 372745 - DNA, 25 bp, Rattus norvegicus
gattctgtagttgggaaacacccct

SEQ ID NO: 372746 - DNA, 25 bp, Rattus norvegicus
gattctgtctgcagtattctgtatt

SEQ ID NO: 372747 - DNA, 25 bp, Rattus norvegicus
gattctgtctgctgtattctgtatt

SEQ ID NO: 372748 - DNA, 25 bp, Rattus norvegicus
gattctgtcttaaagtcacccagct

SEQ ID NO: 372749 - DNA, 25 bp, Rattus norvegicus
gattctgtcttatagtcacccagct

SEQ ID NO: 372750 - DNA, 25 bp, Rattus norvegicus
gattctgtcttgaattggctgcacc

SEQ ID NO: 372751 - DNA, 25 bp, Rattus norvegicus
gattctgtcttgtattggctgcacc

SEQ ID NO: 372752 - DNA, 25 bp, Rattus norvegicus
gattctgtctttaggttcttgtctt

SEQ ID NO: 372753 - DNA, 25 bp, Rattus norvegicus
gattctgtcttttggttcttgtctt

SEQ ID NO: 372754 - DNA, 25 bp, Rattus norvegicus
gattctgtgactccaatcagttcag

SEQ ID NO: 372755 - DNA, 25 bp, Rattus norvegicus
gattctgtgactgcaatcagttcag

SEQ ID NO: 372756 - DNA, 25 bp, Rattus norvegicus
gattctgtgaggcatgttcaggcaa

SEQ ID NO: 372757 - DNA, 25 bp, Rattus norvegicus
gattctgtgagggatgttcaggcaa

SEQ ID NO: 372758 - DNA, 25 bp, Rattus norvegicus
gattctgtgatcacatggtgtgcat

SEQ ID NO: 372759 - DNA, 25 bp, Rattus norvegicus
gattctgtgatctcatggtgtgcat

SEQ ID NO: 372760 - DNA, 25 bp, Rattus norvegicus
gattctgtgcagatgtgtgctgaga

SEQ ID NO: 372761 - DNA, 25 bp, Rattus norvegicus
gattctgtgcagttgtgtgctgaga

SEQ ID NO: 372762 - DNA, 25 bp, Rattus norvegicus
gattctgtggaccagtcagtccatt

SEQ ID NO: 372763 - DNA, 25 bp, Rattus norvegicus
gattctgtggacgagtcagtccatt

SEQ ID NO: 372764 - DNA, 25 bp, Rattus norvegicus
gattctgttaagcaatgcttcaggg

SEQ ID NO: 372765 - DNA, 25 bp, Rattus norvegicus
gattctgttaaggaatgcttcaggg

SEQ ID NO: 372766 - DNA, 25 bp, Rattus norvegicus
gattctgttatacgaccaattcgcc

SEQ ID NO: 372767 - DNA, 25 bp, Rattus norvegicus
gattctgttataggaccaattcgcc

SEQ ID NO: 372768 - DNA, 25 bp, Rattus norvegicus
gattctgttcccatcggatcacaca

SEQ ID NO: 372769 - DNA, 25 bp, Rattus norvegicus
gattctgttcccttcggatcacaca

SEQ ID NO: 372770 - DNA, 25 bp, Rattus norvegicus
gattctgttgtgacaatattcctga

SEQ ID NO: 372771 - DNA, 25 bp, Rattus norvegicus
gattctgttgtgtcaatattcctga

SEQ ID NO: 372772 - DNA, 25 bp, Rattus norvegicus
gattctgtttctcttcaacacctca

SEQ ID NO: 372773 - DNA, 25 bp, Rattus norvegicus
gattctgtttctgttcaacacctca

SEQ ID NO: 372774 - DNA, 25 bp, Rattus norvegicus
gattctgtttgcagtcctgtcccct

SEQ ID NO: 372775 - DNA, 25 bp, Rattus norvegicus
gattctgtttgctgtcctgtcccct

SEQ ID NO: 372776 - DNA, 25 bp, Rattus norvegicus
gattctgtttgtcacaaggcctacc

SEQ ID NO: 372777 - DNA, 25 bp, Rattus norvegicus
gattctgtttgtcctaagtgttcca

SEQ ID NO: 372778 - DNA, 25 bp, Rattus norvegicus
gattctgtttgtgacaaggcctacc

SEQ ID NO: 372779 - DNA, 25 bp, Rattus norvegicus
gattctgtttgtgctaagtgttcca

SEQ ID NO: 372780 - DNA, 25 bp, Rattus norvegicus
gattcttaaatcagtcagcattgct

SEQ ID NO: 372781 - DNA, 25 bp, Rattus norvegicus
gattcttaaatctgtcagcattgct

SEQ ID NO: 372782 - DNA, 25 bp, Rattus norvegicus
gattcttaactaaatagccccggct

SEQ ID NO: 372783 - DNA, 25 bp, Rattus norvegicus
gattcttaactatatagccccggct

SEQ ID NO: 372784 - DNA, 25 bp, Rattus norvegicus
gattcttaacttagtattcctaggt

SEQ ID NO: 372785 - DNA, 25 bp, Rattus norvegicus
gattcttaactttgtattcctaggt

SEQ ID NO: 372786 - DNA, 25 bp, Rattus norvegicus
gattcttaataacctagcctcctaa

SEQ ID NO: 372787 - DNA, 25 bp, Rattus norvegicus
gattcttaataagctagcctcctaa

SEQ ID NO: 372788 - DNA, 25 bp, Rattus norvegicus
gattcttacaaacgtcctgactgcc

SEQ ID NO: 372789 - DNA, 25 bp, Rattus norvegicus
gattcttacaaaggtcctgactgcc

SEQ ID NO: 372790 - DNA, 25 bp, Rattus norvegicus
gattcttacaacatcaatagcattt

SEQ ID NO: 372791 - DNA, 25 bp, Rattus norvegicus
gattcttacaacttcaatagcattt

SEQ ID NO: 372792 - DNA, 25 bp, Rattus norvegicus
gattcttacagaattcacacccttt

SEQ ID NO: 372793 - DNA, 25 bp, Rattus norvegicus
gattcttacagatttcacacccttt

SEQ ID NO: 372794 - DNA, 25 bp, Rattus norvegicus
gattcttactctcaacaggtgtaca

SEQ ID NO: 372795 - DNA, 25 bp, Rattus norvegicus
gattcttactctctaacgttcttgg

SEQ ID NO: 372796 - DNA, 25 bp, Rattus norvegicus
gattcttactctgaacaggtgtaca

SEQ ID NO: 372797 - DNA, 25 bp, Rattus norvegicus
gattcttactctgtaacgttcttgg

SEQ ID NO: 372798 - DNA, 25 bp, Rattus norvegicus
gattcttaggttctggcgatttcaa

SEQ ID NO: 372799 - DNA, 25 bp, Rattus norvegicus
gattcttaggttgtggcgatttcaa

SEQ ID NO: 372800 - DNA, 25 bp, Rattus norvegicus
gattcttagtccagtgatcaccagc

SEQ ID NO: 372801 - DNA, 25 bp, Rattus norvegicus
gattcttagtcctgtgatcaccagc

SEQ ID NO: 372802 - DNA, 25 bp, Rattus norvegicus
gattcttatcacagtgggctttcca

SEQ ID NO: 372803 - DNA, 25 bp, Rattus norvegicus
gattcttatcactgtgggctttcca

SEQ ID NO: 372804 - DNA, 25 bp, Rattus norvegicus
gattcttcaaaaagccatcccaaat

SEQ ID NO: 372805 - DNA, 25 bp, Rattus norvegicus
gattcttcaaaatgccatcccaaat

SEQ ID NO: 372806 - DNA, 25 bp, Rattus norvegicus
gattcttcaagaatgctttgctacc

SEQ ID NO: 372807 - DNA, 25 bp, Rattus norvegicus
gattcttcaagattgctttgctacc

SEQ ID NO: 372808 - DNA, 25 bp, Rattus norvegicus
gattcttcacaaagtctcatgtagt

SEQ ID NO: 372809 - DNA, 25 bp, Rattus norvegicus
gattcttcacaactcaggctcttta

SEQ ID NO: 372810 - DNA, 25 bp, Rattus norvegicus
gattcttcacaagtcaggctcttta

SEQ ID NO: 372811 - DNA, 25 bp, Rattus norvegicus
gattcttcacaatgtctcatgtagt

SEQ ID NO: 372812 - DNA, 25 bp, Rattus norvegicus
gattcttcaggcattgacactgtcg

SEQ ID NO: 372813 - DNA, 25 bp, Rattus norvegicus
gattcttcaggctttgacactgtcg

SEQ ID NO: 372814 - DNA, 25 bp, Rattus norvegicus
gattcttcagtgcacctgacaacac

SEQ ID NO: 372815 - DNA, 25 bp, Rattus norvegicus
gattcttcagtggacctgacaacac

SEQ ID NO: 372816 - DNA, 25 bp, Rattus norvegicus
gattcttcagttctgtgtgctttcg

SEQ ID NO: 372817 - DNA, 25 bp, Rattus norvegicus
gattcttcagttgtgtgtgctttcg

SEQ ID NO: 372818 - DNA, 25 bp, Rattus norvegicus
gattcttcatcaagtatgtgttcaa

SEQ ID NO: 372819 - DNA, 25 bp, Rattus norvegicus
gattcttcatcatgtatgtgttcaa

SEQ ID NO: 372820 - DNA, 25 bp, Rattus norvegicus
gattcttcatctaacttctattaca

SEQ ID NO: 372821 - DNA, 25 bp, Rattus norvegicus
gattcttcatcttacttctattaca

SEQ ID NO: 372822 - DNA, 25 bp, Rattus norvegicus
gattcttccagaaacatgtagcagt

SEQ ID NO: 372823 - DNA, 25 bp, Rattus norvegicus
gattcttccagatacatgtagcagt

SEQ ID NO: 372824 - DNA, 25 bp, Rattus norvegicus
gattcttccatgacttactcagcag

SEQ ID NO: 372825 - DNA, 25 bp, Rattus norvegicus
gattcttccatgtcttactcagcag

SEQ ID NO: 372826 - DNA, 25 bp, Rattus norvegicus
gattcttcccatccagtacatggag

SEQ ID NO: 372827 - DNA, 25 bp, Rattus norvegicus
gattcttcccatgcagtacatggag

SEQ ID NO: 372828 - DNA, 25 bp, Rattus norvegicus
gattcttccccgaagtgcacggcaa

SEQ ID NO: 372829 - DNA, 25 bp, Rattus norvegicus
gattcttccccgtagtgcacggcaa

SEQ ID NO: 372830 - DNA, 25 bp, Rattus norvegicus
gattcttcccttagccttgtttaat

SEQ ID NO: 372831 - DNA, 25 bp, Rattus norvegicus
gattcttcccttctgtaaagtgtac

SEQ ID NO: 372832 - DNA, 25 bp, Rattus norvegicus
gattcttcccttgtgtaaagtgtac

SEQ ID NO: 372833 - DNA, 25 bp, Rattus norvegicus
gattcttccctttgccttgtttaat

SEQ ID NO: 372834 - DNA, 25 bp, Rattus norvegicus
gattcttcgagaaaggccaaacttg

SEQ ID NO: 372835 - DNA, 25 bp, Rattus norvegicus
gattcttcgagataggccaaacttg

SEQ ID NO: 372836 - DNA, 25 bp, Rattus norvegicus
gattcttcgggcactggaccaaggc

SEQ ID NO: 372837 - DNA, 25 bp, Rattus norvegicus
gattcttcgggctctggaccaaggc

SEQ ID NO: 372838 - DNA, 25 bp, Rattus norvegicus
gattcttctagtacccgatacagtc

SEQ ID NO: 372839 - DNA, 25 bp, Rattus norvegicus
gattcttctagttcccgatacagtc

SEQ ID NO: 372840 - DNA, 25 bp, Rattus norvegicus
gattcttctatcatccataccacat

SEQ ID NO: 372841 - DNA, 25 bp, Rattus norvegicus
gattcttctatcttccataccacat

SEQ ID NO: 372842 - DNA, 25 bp, Rattus norvegicus
gattcttctgaaagagtcgccatga

SEQ ID NO: 372843 - DNA, 25 bp, Rattus norvegicus
gattcttctgaatgagtcgccatga

SEQ ID NO: 372844 - DNA, 25 bp, Rattus norvegicus
gattcttctggaccatgagaccaaa

SEQ ID NO: 372845 - DNA, 25 bp, Rattus norvegicus
gattcttctggagcatgagaccaaa

SEQ ID NO: 372846 - DNA, 25 bp, Rattus norvegicus
gattcttcttctcgttacaactgct

SEQ ID NO: 372847 - DNA, 25 bp, Rattus norvegicus
gattcttcttctggttacaactgct

SEQ ID NO: 372848 - DNA, 25 bp, Rattus norvegicus
gattcttgagcccagtcttccttag

SEQ ID NO: 372849 - DNA, 25 bp, Rattus norvegicus
gattcttgagccgagtcttccttag

SEQ ID NO: 372850 - DNA, 25 bp, Rattus norvegicus
gattcttgaggaccgaccatcgaat

SEQ ID NO: 372851 - DNA, 25 bp, Rattus norvegicus
gattcttgaggagcgaccatcgaat

SEQ ID NO: 372852 - DNA, 25 bp, Rattus norvegicus
gattcttgatccctgcaagggccca

SEQ ID NO: 372853 - DNA, 25 bp, Rattus norvegicus
gattcttgatccgtgcaagggccca

SEQ ID NO: 372854 - DNA, 25 bp, Rattus norvegicus
gattcttgcacacagtgactggctg

SEQ ID NO: 372855 - DNA, 25 bp, Rattus norvegicus
gattcttgcacagagtgactggctg

SEQ ID NO: 372856 - DNA, 25 bp, Rattus norvegicus
gattcttgccaaaatgagactcttc

SEQ ID NO: 372857 - DNA, 25 bp, Rattus norvegicus
gattcttgccaatatgagactcttc

SEQ ID NO: 372858 - DNA, 25 bp, Rattus norvegicus
gattcttgccagagaactgtccagg

SEQ ID NO: 372859 - DNA, 25 bp, Rattus norvegicus
gattcttgccagtgaactgtccagg

SEQ ID NO: 372860 - DNA, 25 bp, Rattus norvegicus
gattcttgcggtcttcgttgagcca

SEQ ID NO: 372861 - DNA, 25 bp, Rattus norvegicus
gattcttgcggtgttcgttgagcca

SEQ ID NO: 372862 - DNA, 25 bp, Rattus norvegicus
gattcttgctgaaaggcgcaaacct

SEQ ID NO: 372863 - DNA, 25 bp, Rattus norvegicus
gattcttgctgataggcgcaaacct

SEQ ID NO: 372864 - DNA, 25 bp, Rattus norvegicus
gattcttggaagctagcctctaatt

SEQ ID NO: 372865 - DNA, 25 bp, Rattus norvegicus
gattcttggaaggtagcctctaatt

SEQ ID NO: 372866 - DNA, 25 bp, Rattus norvegicus
gattcttgggatctaccctagacat

SEQ ID NO: 372867 - DNA, 25 bp, Rattus norvegicus
gattcttgggatgtaccctagacat

SEQ ID NO: 372868 - DNA, 25 bp, Rattus norvegicus
gattcttggtttcgtgttttctatg

SEQ ID NO: 372869 - DNA, 25 bp, Rattus norvegicus
gattcttggtttggtgttttctatg

SEQ ID NO: 372870 - DNA, 25 bp, Rattus norvegicus
gattcttgtcagatggttgaggcta

SEQ ID NO: 372871 - DNA, 25 bp, Rattus norvegicus
gattcttgtcagttggttgaggcta

SEQ ID NO: 372872 - DNA, 25 bp, Rattus norvegicus
gattcttgtcatatgctctcagcaa

SEQ ID NO: 372873 - DNA, 25 bp, Rattus norvegicus
gattcttgtcatttgctctcagcaa

SEQ ID NO: 372874 - DNA, 25 bp, Rattus norvegicus
gattcttgtcttcggcaaacactct

SEQ ID NO: 372875 - DNA, 25 bp, Rattus norvegicus
gattcttgtcttgggcaaacactct

SEQ ID NO: 372876 - DNA, 25 bp, Rattus norvegicus
gattcttgtggaccatctatacaga

SEQ ID NO: 372877 - DNA, 25 bp, Rattus norvegicus
gattcttgtggagcatctatacaga

SEQ ID NO: 372878 - DNA, 25 bp, Rattus norvegicus
gattcttgtggtacgaactgactta

SEQ ID NO: 372879 - DNA, 25 bp, Rattus norvegicus
gattcttgtggttcgaactgactta

SEQ ID NO: 372880 - DNA, 25 bp, Rattus norvegicus
gattcttgtgtcacatactttctgg

SEQ ID NO: 372881 - DNA, 25 bp, Rattus norvegicus
gattcttgtgtctcatactttctgg

SEQ ID NO: 372882 - DNA, 25 bp, Rattus norvegicus
gattctttaagcattcaactccaca

SEQ ID NO: 372883 - DNA, 25 bp, Rattus norvegicus
gattctttaagctttcaactccaca

SEQ ID NO: 372884 - DNA, 25 bp, Rattus norvegicus
gattctttaaggacagctttctgta

SEQ ID NO: 372885 - DNA, 25 bp, Rattus norvegicus
gattctttaaggtcagctttctgta

SEQ ID NO: 372886 - DNA, 25 bp, Rattus norvegicus
gattctttacaaacctccaggagcg

SEQ ID NO: 372887 - DNA, 25 bp, Rattus norvegicus
gattctttacaatcctccaggagcg

SEQ ID NO: 372888 - DNA, 25 bp, Rattus norvegicus
gattctttatgcattggtagccaag

SEQ ID NO: 372889 - DNA, 25 bp, Rattus norvegicus
gattctttatgctttggtagccaag

SEQ ID NO: 372890 - DNA, 25 bp, Rattus norvegicus
gattctttattcacattcacttgtc

SEQ ID NO: 372891 - DNA, 25 bp, Rattus norvegicus
gattctttattctcattcacttgtc

SEQ ID NO: 372892 - DNA, 25 bp, Rattus norvegicus
gattctttccaacagatgggcaagg

SEQ ID NO: 372893 - DNA, 25 bp, Rattus norvegicus
gattctttccaagagatgggcaagg

SEQ ID NO: 372894 - DNA, 25 bp, Rattus norvegicus
gattctttccagagatgactatttt

SEQ ID NO: 372895 - DNA, 25 bp, Rattus norvegicus
gattctttccagtgatgactatttt

SEQ ID NO: 372896 - DNA, 25 bp, Rattus norvegicus
gattctttcccacctaagtgaggct

SEQ ID NO: 372897 - DNA, 25 bp, Rattus norvegicus
gattctttcccagctaagtgaggct

SEQ ID NO: 372898 - DNA, 25 bp, Rattus norvegicus
gattctttcctcactacttatttaa

SEQ ID NO: 372899 - DNA, 25 bp, Rattus norvegicus
gattctttcctctctacttatttaa

SEQ ID NO: 372900 - DNA, 25 bp, Rattus norvegicus
gattctttctggatgcatctcggca

SEQ ID NO: 372901 - DNA, 25 bp, Rattus norvegicus
gattctttctggttgcatctcggca

SEQ ID NO: 372902 - DNA, 25 bp, Rattus norvegicus
gattctttcttgcaccagaccagtt

SEQ ID NO: 372903 - DNA, 25 bp, Rattus norvegicus
gattctttcttggaccagaccagtt

SEQ ID NO: 372904 - DNA, 25 bp, Rattus norvegicus
gattctttctttagttagtctatga

SEQ ID NO: 372905 - DNA, 25 bp, Rattus norvegicus
gattctttcttttgttagtctatga

SEQ ID NO: 372906 - DNA, 25 bp, Rattus norvegicus
gattctttgagacccatgtcgccag

SEQ ID NO: 372907 - DNA, 25 bp, Rattus norvegicus
gattctttgagagccatgtcgccag

SEQ ID NO: 372908 - DNA, 25 bp, Rattus norvegicus
gattctttgccactatgttgacata

SEQ ID NO: 372909 - DNA, 25 bp, Rattus norvegicus
gattctttgccagtatgttgacata

SEQ ID NO: 372910 - DNA, 25 bp, Rattus norvegicus
gattctttgctaagtgttgatttaa

SEQ ID NO: 372911 - DNA, 25 bp, Rattus norvegicus
gattctttgctatgtgttgatttaa

SEQ ID NO: 372912 - DNA, 25 bp, Rattus norvegicus
gattctttgcttacatagctactta

SEQ ID NO: 372913 - DNA, 25 bp, Rattus norvegicus
gattctttgctttcatagctactta

SEQ ID NO: 372914 - DNA, 25 bp, Rattus norvegicus
gattctttgggaaacagctgtgggt

SEQ ID NO: 372915 - DNA, 25 bp, Rattus norvegicus
gattctttgggatacagctgtgggt

SEQ ID NO: 372916 - DNA, 25 bp, Rattus norvegicus
gattctttgtacaaggacttccttg

SEQ ID NO: 372917 - DNA, 25 bp, Rattus norvegicus
gattctttgtactaggacttccttg

SEQ ID NO: 372918 - DNA, 25 bp, Rattus norvegicus
gattctttgtcaacgttgttcttgt

SEQ ID NO: 372919 - DNA, 25 bp, Rattus norvegicus
gattctttgtcatcgttgttcttgt

SEQ ID NO: 372920 - DNA, 25 bp, Rattus norvegicus
gattctttgttcatatctttaataa

SEQ ID NO: 372921 - DNA, 25 bp, Rattus norvegicus
gattctttgttcttatctttaataa

SEQ ID NO: 372922 - DNA, 25 bp, Rattus norvegicus
gattctttgtttccctgttagacac

SEQ ID NO: 372923 - DNA, 25 bp, Rattus norvegicus
gattctttgtttgcctgttagacac

SEQ ID NO: 372924 - DNA, 25 bp, Rattus norvegicus
gattcttttacgattgggcctttat

SEQ ID NO: 372925 - DNA, 25 bp, Rattus norvegicus
gattcttttacgtttgggcctttat

SEQ ID NO: 372926 - DNA, 25 bp, Rattus norvegicus
gattcttttcctagtgtagagtatt

SEQ ID NO: 372927 - DNA, 25 bp, Rattus norvegicus
gattcttttccttgtgtagagtatt

SEQ ID NO: 372928 - DNA, 25 bp, Rattus norvegicus
gattcttttctaatccattgttcag

SEQ ID NO: 372929 - DNA, 25 bp, Rattus norvegicus
gattcttttctattccattgttcag

SEQ ID NO: 372930 - DNA, 25 bp, Rattus norvegicus
gattcttttcttcttgtatagtttg

SEQ ID NO: 372931 - DNA, 25 bp, Rattus norvegicus
gattcttttcttgttgtatagtttg

SEQ ID NO: 372932 - DNA, 25 bp, Rattus norvegicus
gattcttttgacattagccattctc

SEQ ID NO: 372933 - DNA, 25 bp, Rattus norvegicus
gattcttttgactttagccattctc

SEQ ID NO: 372934 - DNA, 25 bp, Rattus norvegicus
gattctttttatataggccacgcaa

SEQ ID NO: 372935 - DNA, 25 bp, Rattus norvegicus
gattctttttatttaggccacgcaa

SEQ ID NO: 372936 - DNA, 25 bp, Rattus norvegicus
gattctttttggattggctagacta

SEQ ID NO: 372937 - DNA, 25 bp, Rattus norvegicus
gattctttttggtttggctagacta

SEQ ID NO: 372938 - DNA, 25 bp, Rattus norvegicus
gattgaaaacagagaggctccctgt

SEQ ID NO: 372939 - DNA, 25 bp, Rattus norvegicus
gattgaaaacagtgaggctccctgt

SEQ ID NO: 372940 - DNA, 25 bp, Rattus norvegicus
gattgaaaactacgtccactggaat

SEQ ID NO: 372941 - DNA, 25 bp, Rattus norvegicus
gattgaaaactaggtccactggaat

SEQ ID NO: 372942 - DNA, 25 bp, Rattus norvegicus
gattgaaacccacaagctgaccttc

SEQ ID NO: 372943 - DNA, 25 bp, Rattus norvegicus
gattgaaacccagaagctgaccttc

SEQ ID NO: 372944 - DNA, 25 bp, Rattus norvegicus
gattgaaacggaacctcttcgtcgc

SEQ ID NO: 372945 - DNA, 25 bp, Rattus norvegicus
gattgaaacggatcctcttcgtcgc

SEQ ID NO: 372946 - DNA, 25 bp, Rattus norvegicus
gattgaaatcttacactttttctaa

SEQ ID NO: 372947 - DNA, 25 bp, Rattus norvegicus
gattgaaatctttcactttttctaa

SEQ ID NO: 372948 - DNA, 25 bp, Rattus norvegicus
gattgaaatgccaggaacacctctt

SEQ ID NO: 372949 - DNA, 25 bp, Rattus norvegicus
gattgaaatgcctggaacacctctt

SEQ ID NO: 372950 - DNA, 25 bp, Rattus norvegicus
gattgaacacgcattaccgctacat

SEQ ID NO: 372951 - DNA, 25 bp, Rattus norvegicus
gattgaacacgctttaccgctacat

SEQ ID NO: 372952 - DNA, 25 bp, Rattus norvegicus
gattgaaccagaatgggcctatgga

SEQ ID NO: 372953 - DNA, 25 bp, Rattus norvegicus
gattgaaccagattgggcctatgga

SEQ ID NO: 372954 - DNA, 25 bp, Rattus norvegicus
gattgaacctctatgcctgtccgtg

SEQ ID NO: 372955 - DNA, 25 bp, Rattus norvegicus
gattgaacctctttgcctgtccgtg

SEQ ID NO: 372956 - DNA, 25 bp, Rattus norvegicus
gattgaacctggagcttcctctaag

SEQ ID NO: 372957 - DNA, 25 bp, Rattus norvegicus
gattgaacctggtgcttcctctaag

SEQ ID NO: 372958 - DNA, 25 bp, Rattus norvegicus
gattgaactcaccatgtttggcagc

SEQ ID NO: 372959 - DNA, 25 bp, Rattus norvegicus
gattgaactcacgatgtttggcagc

SEQ ID NO: 372960 - DNA, 25 bp, Rattus norvegicus
gattgaactcggagcactgttatga

SEQ ID NO: 372961 - DNA, 25 bp, Rattus norvegicus
gattgaactcggtgcactgttatga

SEQ ID NO: 372962 - DNA, 25 bp, Rattus norvegicus
gattgaagacccagcctcaagtcag

SEQ ID NO: 372963 - DNA, 25 bp, Rattus norvegicus
gattgaagaccctgcctcaagtcag

SEQ ID NO: 372964 - DNA, 25 bp, Rattus norvegicus
gattgaagaggtccagtccccagct

SEQ ID NO: 372965 - DNA, 25 bp, Rattus norvegicus
gattgaagaggtgcagtccccagct

SEQ ID NO: 372966 - DNA, 25 bp, Rattus norvegicus
gattgaagatgcagtctccttgtgg

SEQ ID NO: 372967 - DNA, 25 bp, Rattus norvegicus
gattgaagatgctgtctccttgtgg

SEQ ID NO: 372968 - DNA, 25 bp, Rattus norvegicus
gattgaagcctcatgccagtaggaa

SEQ ID NO: 372969 - DNA, 25 bp, Rattus norvegicus
gattgaagcctcttgccagtaggaa

SEQ ID NO: 372970 - DNA, 25 bp, Rattus norvegicus
gattgaagctgacatctccaagaga

SEQ ID NO: 372971 - DNA, 25 bp, Rattus norvegicus
gattgaagctgagatctccaagaga

SEQ ID NO: 372972 - DNA, 25 bp, Rattus norvegicus
gattgaagcttcatggcataccata

SEQ ID NO: 372973 - DNA, 25 bp, Rattus norvegicus
gattgaagcttcttggcataccata

SEQ ID NO: 372974 - DNA, 25 bp, Rattus norvegicus
gattgaaggtcgaccctgacgtgct

SEQ ID NO: 372975 - DNA, 25 bp, Rattus norvegicus
gattgaaggtcgtccctgacgtgct

SEQ ID NO: 372976 - DNA, 25 bp, Rattus norvegicus
gattgaagtcaaacagccgggccca

SEQ ID NO: 372977 - DNA, 25 bp, Rattus norvegicus
gattgaagtcaacctgaaccctgat

SEQ ID NO: 372978 - DNA, 25 bp, Rattus norvegicus
gattgaagtcaactgcacggccatg

SEQ ID NO: 372979 - DNA, 25 bp, Rattus norvegicus
gattgaagtcaagctgaaccctgat

SEQ ID NO: 372980 - DNA, 25 bp, Rattus norvegicus
gattgaagtcaagtgcacggccatg

SEQ ID NO: 372981 - DNA, 25 bp, Rattus norvegicus
gattgaagtcaatcagccgggccca

SEQ ID NO: 372982 - DNA, 25 bp, Rattus norvegicus
gattgaagtcatcgctggtccagaa

SEQ ID NO: 372983 - DNA, 25 bp, Rattus norvegicus
gattgaagtcatggctggtccagaa

SEQ ID NO: 372984 - DNA, 25 bp, Rattus norvegicus
gattgaagtcccattactcaggcaa

SEQ ID NO: 372985 - DNA, 25 bp, Rattus norvegicus
gattgaagtccctttactcaggcaa

SEQ ID NO: 372986 - DNA, 25 bp, Rattus norvegicus
gattgaagtgttccgtccttgttat

SEQ ID NO: 372987 - DNA, 25 bp, Rattus norvegicus
gattgaagtgttgcgtccttgttat

SEQ ID NO: 372988 - DNA, 25 bp, Rattus norvegicus
gattgaagtttcactgtcagattta

SEQ ID NO: 372989 - DNA, 25 bp, Rattus norvegicus
gattgaagtttctctgtcagattta

SEQ ID NO: 372990 - DNA, 25 bp, Rattus norvegicus
gattgaatattcctgtgacttaaaa

SEQ ID NO: 372991 - DNA, 25 bp, Rattus norvegicus
gattgaatattcgtgtgacttaaaa

SEQ ID NO: 372992 - DNA, 25 bp, Rattus norvegicus
gattgaatcactataaggccatata

SEQ ID NO: 372993 - DNA, 25 bp, Rattus norvegicus
gattgaatcactttaaggccatata

SEQ ID NO: 372994 - DNA, 25 bp, Rattus norvegicus
gattgaatccaaacctctaagggac

SEQ ID NO: 372995 - DNA, 25 bp, Rattus norvegicus
gattgaatccaatcctctaagggac

SEQ ID NO: 372996 - DNA, 25 bp, Rattus norvegicus
gattgaatctgtatcactctttagt

SEQ ID NO: 372997 - DNA, 25 bp, Rattus norvegicus
gattgaatctgtttcactctttagt

SEQ ID NO: 372998 - DNA, 25 bp, Rattus norvegicus
gattgaatgcatcgtcacgctggga

SEQ ID NO: 372999 - DNA, 25 bp, Rattus norvegicus
gattgaatgcatggtcacgctggga

SEQ ID NO: 373000 - DNA, 25 bp, Rattus norvegicus
gattgaattcagatttctaggcttg

SEQ ID NO: 373001 - DNA, 25 bp, Rattus norvegicus
gattgaattcagttttctaggcttg

SEQ ID NO: 373002 - DNA, 25 bp, Rattus norvegicus
gattgacaacgcatgctttttaaat

SEQ ID NO: 373003 - DNA, 25 bp, Rattus norvegicus
gattgacaacgcttgctttttaaat

SEQ ID NO: 373004 - DNA, 25 bp, Rattus norvegicus
gattgacacaaacacctttcccgtg

SEQ ID NO: 373005 - DNA, 25 bp, Rattus norvegicus
gattgacacaaagacctttcccgtg

SEQ ID NO: 373006 - DNA, 25 bp, Rattus norvegicus
gattgacaccaaagtcgctgccaga

SEQ ID NO: 373007 - DNA, 25 bp, Rattus norvegicus
gattgacaccaatgtcgctgccaga

SEQ ID NO: 373008 - DNA, 25 bp, Rattus norvegicus
gattgacaccatcctagaactcatt

SEQ ID NO: 373009 - DNA, 25 bp, Rattus norvegicus
gattgacaccatgctagaactcatt

SEQ ID NO: 373010 - DNA, 25 bp, Rattus norvegicus
gattgacactgtactgatctcagag

SEQ ID NO: 373011 - DNA, 25 bp, Rattus norvegicus
gattgacactgttctgatctcagag

SEQ ID NO: 373012 - DNA, 25 bp, Rattus norvegicus
gattgacagcaaatcggcaagacct

SEQ ID NO: 373013 - DNA, 25 bp, Rattus norvegicus
gattgacagcaattcggcaagacct

SEQ ID NO: 373014 - DNA, 25 bp, Rattus norvegicus
gattgacatcccagactgactatca

SEQ ID NO: 373015 - DNA, 25 bp, Rattus norvegicus
gattgacatccctgactgactatca

SEQ ID NO: 373016 - DNA, 25 bp, Rattus norvegicus
gattgacatttcactgacacctgaa

SEQ ID NO: 373017 - DNA, 25 bp, Rattus norvegicus
gattgacatttctctgacacctgaa

SEQ ID NO: 373018 - DNA, 25 bp, Rattus norvegicus
gattgacatttgcaccaagctttgg

SEQ ID NO: 373019 - DNA, 25 bp, Rattus norvegicus
gattgacatttggaccaagctttgg

SEQ ID NO: 373020 - DNA, 25 bp, Rattus norvegicus
gattgacccagaaaagctctcagta

SEQ ID NO: 373021 - DNA, 25 bp, Rattus norvegicus
gattgacccagataagctctcagta

SEQ ID NO: 373022 - DNA, 25 bp, Rattus norvegicus
gattgaccgaagactgcagaacctt

SEQ ID NO: 373023 - DNA, 25 bp, Rattus norvegicus
gattgaccgaagtctgcagaacctt

SEQ ID NO: 373024 - DNA, 25 bp, Rattus norvegicus
gattgacctcaacagtgtactacaa

SEQ ID NO: 373025 - DNA, 25 bp, Rattus norvegicus
gattgacctcaagagtgtactacaa

SEQ ID NO: 373026 - DNA, 25 bp, Rattus norvegicus
gattgacctgaacttcattgacacc

SEQ ID NO: 373027 - DNA, 25 bp, Rattus norvegicus
gattgacctgaagttcattgacacc

SEQ ID NO: 373028 - DNA, 25 bp, Rattus norvegicus
gattgacctgttcaagccacagatt

SEQ ID NO: 373029 - DNA, 25 bp, Rattus norvegicus
gattgacctgttgaagccacagatt

SEQ ID NO: 373030 - DNA, 25 bp, Rattus norvegicus
gattgacgagtaccatgcggccaca

SEQ ID NO: 373031 - DNA, 25 bp, Rattus norvegicus
gattgacgagtagcatgcggccaca

SEQ ID NO: 373032 - DNA, 25 bp, Rattus norvegicus
gattgacgcagactctccggatatt

SEQ ID NO: 373033 - DNA, 25 bp, Rattus norvegicus
gattgacgcagagtctccggatatt

SEQ ID NO: 373034 - DNA, 25 bp, Rattus norvegicus
gattgacgcgttactttgtaacttc

SEQ ID NO: 373035 - DNA, 25 bp, Rattus norvegicus
gattgacgcgtttctttgtaacttc

SEQ ID NO: 373036 - DNA, 25 bp, Rattus norvegicus
gattgacgggtcatactaccacatg

SEQ ID NO: 373037 - DNA, 25 bp, Rattus norvegicus
gattgacgggtcttactaccacatg

SEQ ID NO: 373038 - DNA, 25 bp, Rattus norvegicus
gattgacgtgtccaaagcctcaggt

SEQ ID NO: 373039 - DNA, 25 bp, Rattus norvegicus
gattgacgtgtcgaaagcctcaggt

SEQ ID NO: 373040 - DNA, 25 bp, Rattus norvegicus
gattgactcaatacccacagtgtag

SEQ ID NO: 373041 - DNA, 25 bp, Rattus norvegicus
gattgactcaattcccacagtgtag

SEQ ID NO: 373042 - DNA, 25 bp, Rattus norvegicus
gattgactctacaaccatgcacaga

SEQ ID NO: 373043 - DNA, 25 bp, Rattus norvegicus
gattgactctactaccatgcacaga

SEQ ID NO: 373044 - DNA, 25 bp, Rattus norvegicus
gattgactcttccaagatacccaat

SEQ ID NO: 373045 - DNA, 25 bp, Rattus norvegicus
gattgactcttcgaagatacccaat

SEQ ID NO: 373046 - DNA, 25 bp, Rattus norvegicus
gattgactctttaatatacaccata

SEQ ID NO: 373047 - DNA, 25 bp, Rattus norvegicus
gattgactcttttatatacaccata

SEQ ID NO: 373048 - DNA, 25 bp, Rattus norvegicus
gattgactgattatgtgaactgcat

SEQ ID NO: 373049 - DNA, 25 bp, Rattus norvegicus
gattgactgattttgtgaactgcat

SEQ ID NO: 373050 - DNA, 25 bp, Rattus norvegicus
gattgactggtaagtgctgcctcct

SEQ ID NO: 373051 - DNA, 25 bp, Rattus norvegicus
gattgactggtatgtgctgcctcct

SEQ ID NO: 373052 - DNA, 25 bp, Rattus norvegicus
gattgactggtgaattctgccttag

SEQ ID NO: 373053 - DNA, 25 bp, Rattus norvegicus
gattgactggtgtattctgccttag

SEQ ID NO: 373054 - DNA, 25 bp, Rattus norvegicus
gattgactgtgactggcttctgtga

SEQ ID NO: 373055 - DNA, 25 bp, Rattus norvegicus
gattgactgtgagtggcttctgtga

SEQ ID NO: 373056 - DNA, 25 bp, Rattus norvegicus
gattgacttacacacatagcctaga

SEQ ID NO: 373057 - DNA, 25 bp, Rattus norvegicus
gattgacttacagacatagcctaga

SEQ ID NO: 373058 - DNA, 25 bp, Rattus norvegicus
gattgacttagaacatctctcctcc

SEQ ID NO: 373059 - DNA, 25 bp, Rattus norvegicus
gattgacttagatcatctctcctcc

SEQ ID NO: 373060 - DNA, 25 bp, Rattus norvegicus
gattgacttgttccgagtctccaag

SEQ ID NO: 373061 - DNA, 25 bp, Rattus norvegicus
gattgacttgttgcgagtctccaag

SEQ ID NO: 373062 - DNA, 25 bp, Rattus norvegicus
gattgacttttcctgtggcaacgtt

SEQ ID NO: 373063 - DNA, 25 bp, Rattus norvegicus
gattgacttttcgtgtggcaacgtt

SEQ ID NO: 373064 - DNA, 25 bp, Rattus norvegicus
gattgagaacacacatacctggtac

SEQ ID NO: 373065 - DNA, 25 bp, Rattus norvegicus
gattgagaacactcatacctggtac

SEQ ID NO: 373066 - DNA, 25 bp, Rattus norvegicus
gattgagaaccacagcatacccact

SEQ ID NO: 373067 - DNA, 25 bp, Rattus norvegicus
gattgagaaccagagcatacccact

SEQ ID NO: 373068 - DNA, 25 bp, Rattus norvegicus
gattgagacaagaatcaaacagcac

SEQ ID NO: 373069 - DNA, 25 bp, Rattus norvegicus
gattgagacaagtatcaaacagcac

SEQ ID NO: 373070 - DNA, 25 bp, Rattus norvegicus
gattgagaccccacttagcgtttaa

SEQ ID NO: 373071 - DNA, 25 bp, Rattus norvegicus
gattgagacccctcttagcgtttaa

SEQ ID NO: 373072 - DNA, 25 bp, Rattus norvegicus
gattgagactcacatagaacaccgg

SEQ ID NO: 373073 - DNA, 25 bp, Rattus norvegicus
gattgagactcagatagaacaccgg

SEQ ID NO: 373074 - DNA, 25 bp, Rattus norvegicus
gattgagagaaaacagtctacgttt

SEQ ID NO: 373075 - DNA, 25 bp, Rattus norvegicus
gattgagagaaatcagtctacgttt

SEQ ID NO: 373076 - DNA, 25 bp, Rattus norvegicus
gattgagagctcacatagtcccctt

SEQ ID NO: 373077 - DNA, 25 bp, Rattus norvegicus
gattgagagctctcatagtcccctt

SEQ ID NO: 373078 - DNA, 25 bp, Rattus norvegicus
gattgagatacacctgcatggccct

SEQ ID NO: 373079 - DNA, 25 bp, Rattus norvegicus
gattgagatacagctgcatggccct

SEQ ID NO: 373080 - DNA, 25 bp, Rattus norvegicus
gattgagcacaaagcccgcctggag

SEQ ID NO: 373081 - DNA, 25 bp, Rattus norvegicus
gattgagcacaatgcccgcctggag

SEQ ID NO: 373082 - DNA, 25 bp, Rattus norvegicus
gattgagccaaacaatcctcccgaa

SEQ ID NO: 373083 - DNA, 25 bp, Rattus norvegicus
gattgagccaaagaatcctcccgaa

SEQ ID NO: 373084 - DNA, 25 bp, Rattus norvegicus
gattgagccgctcccaggtttgctg

SEQ ID NO: 373085 - DNA, 25 bp, Rattus norvegicus
gattgagccgctgccaggtttgctg

SEQ ID NO: 373086 - DNA, 25 bp, Rattus norvegicus
gattgagcggacaattgtacagttg

SEQ ID NO: 373087 - DNA, 25 bp, Rattus norvegicus
gattgagcggactattgtacagttg

SEQ ID NO: 373088 - DNA, 25 bp, Rattus norvegicus
gattgagcggccaatgcctggaacc

SEQ ID NO: 373089 - DNA, 25 bp, Rattus norvegicus
gattgagcggcctatgcctggaacc

SEQ ID NO: 373090 - DNA, 25 bp, Rattus norvegicus
gattgagctccaactgatttgcatg

SEQ ID NO: 373091 - DNA, 25 bp, Rattus norvegicus
gattgagctccatctgatttgcatg

SEQ ID NO: 373092 - DNA, 25 bp, Rattus norvegicus
gattgagctgagcttcaaaacccgt

SEQ ID NO: 373093 - DNA, 25 bp, Rattus norvegicus
gattgagctgaggttcaaaacccgt

SEQ ID NO: 373094 - DNA, 25 bp, Rattus norvegicus
gattgagctgatcgccattgcaaca

SEQ ID NO: 373095 - DNA, 25 bp, Rattus norvegicus
gattgagctgatggccattgcaaca

SEQ ID NO: 373096 - DNA, 25 bp, Rattus norvegicus
gattgagctgctaggaaccctgtaa

SEQ ID NO: 373097 - DNA, 25 bp, Rattus norvegicus
gattgagctgcttggaaccctgtaa

SEQ ID NO: 373098 - DNA, 25 bp, Rattus norvegicus
gattgagctggaccagcacatctcc

SEQ ID NO: 373099 - DNA, 25 bp, Rattus norvegicus
gattgagctggagcagcacatctcc

SEQ ID NO: 373100 - DNA, 25 bp, Rattus norvegicus
gattgagcttcacgctttccaacgt

SEQ ID NO: 373101 - DNA, 25 bp, Rattus norvegicus
gattgagcttcaggctttccaacgt

SEQ ID NO: 373102 - DNA, 25 bp, Rattus norvegicus
gattgaggaaggagtccccacttga

SEQ ID NO: 373103 - DNA, 25 bp, Rattus norvegicus
gattgaggaaggtgtccccacttga

SEQ ID NO: 373104 - DNA, 25 bp, Rattus norvegicus
gattgaggacggcatccccaaggac

SEQ ID NO: 373105 - DNA, 25 bp, Rattus norvegicus
gattgaggacgggatccccaaggac

SEQ ID NO: 373106 - DNA, 25 bp, Rattus norvegicus
gattgaggccaacttgctctacaca

SEQ ID NO: 373107 - DNA, 25 bp, Rattus norvegicus
gattgaggccaagttgctctacaca

SEQ ID NO: 373108 - DNA, 25 bp, Rattus norvegicus
gattgaggctgaagacttccctttt

SEQ ID NO: 373109 - DNA, 25 bp, Rattus norvegicus
gattgaggctgatgacttccctttt

SEQ ID NO: 373110 - DNA, 25 bp, Rattus norvegicus
gattgagggaccagttcataacact

SEQ ID NO: 373111 - DNA, 25 bp, Rattus norvegicus
gattgagggacctgttcataacact

SEQ ID NO: 373112 - DNA, 25 bp, Rattus norvegicus
gattgaggtgcaaccatttccctgc

SEQ ID NO: 373113 - DNA, 25 bp, Rattus norvegicus
gattgaggtgcatccatttccctgc

SEQ ID NO: 373114 - DNA, 25 bp, Rattus norvegicus
gattgagtcacaattggttcttcct

SEQ ID NO: 373115 - DNA, 25 bp, Rattus norvegicus
gattgagtcacatttggttcttcct

SEQ ID NO: 373116 - DNA, 25 bp, Rattus norvegicus
gattgagtcctgactgactgttgcc

SEQ ID NO: 373117 - DNA, 25 bp, Rattus norvegicus
gattgagtcctgtctgactgttgcc

SEQ ID NO: 373118 - DNA, 25 bp, Rattus norvegicus
gattgagtcgaccttcttgaagcac

SEQ ID NO: 373119 - DNA, 25 bp, Rattus norvegicus
gattgagtcgacgttcttgaagcac

SEQ ID NO: 373120 - DNA, 25 bp, Rattus norvegicus
gattgagtctaaacgggacttccct

SEQ ID NO: 373121 - DNA, 25 bp, Rattus norvegicus
gattgagtctaatcgggacttccct

SEQ ID NO: 373122 - DNA, 25 bp, Rattus norvegicus
gattgagtctctaactaagtgtgca

SEQ ID NO: 373123 - DNA, 25 bp, Rattus norvegicus
gattgagtctcttactaagtgtgca

SEQ ID NO: 373124 - DNA, 25 bp, Rattus norvegicus
gattgagtctttagctactatggag

SEQ ID NO: 373125 - DNA, 25 bp, Rattus norvegicus
gattgagtcttttgctactatggag

SEQ ID NO: 373126 - DNA, 25 bp, Rattus norvegicus
gattgagtgaggactccctgactga

SEQ ID NO: 373127 - DNA, 25 bp, Rattus norvegicus
gattgagtgaggtctccctgactga

SEQ ID NO: 373128 - DNA, 25 bp, Rattus norvegicus
gattgagtgtttagtaccagcagta

SEQ ID NO: 373129 - DNA, 25 bp, Rattus norvegicus
gattgagtgttttgtaccagcagta

SEQ ID NO: 373130 - DNA, 25 bp, Rattus norvegicus
gattgagttcagcttacctgactta

SEQ ID NO: 373131 - DNA, 25 bp, Rattus norvegicus
gattgagttcaggttacctgactta

SEQ ID NO: 373132 - DNA, 25 bp, Rattus norvegicus
gattgagttcctcgcggaaggttca

SEQ ID NO: 373133 - DNA, 25 bp, Rattus norvegicus
gattgagttcctggcggaaggttca

SEQ ID NO: 373134 - DNA, 25 bp, Rattus norvegicus
gattgagtttcactacagccagaat

SEQ ID NO: 373135 - DNA, 25 bp, Rattus norvegicus
gattgagtttcagtacagccagaat

SEQ ID NO: 373136 - DNA, 25 bp, Rattus norvegicus
gattgagtttccaatgcccaatgag

SEQ ID NO: 373137 - DNA, 25 bp, Rattus norvegicus
gattgagtttcctatgcccaatgag

SEQ ID NO: 373138 - DNA, 25 bp, Rattus norvegicus
gattgataagcaactctgagacccg

SEQ ID NO: 373139 - DNA, 25 bp, Rattus norvegicus
gattgataagcatctctgagacccg

SEQ ID NO: 373140 - DNA, 25 bp, Rattus norvegicus
gattgatagtacactcctgtggaaa

SEQ ID NO: 373141 - DNA, 25 bp, Rattus norvegicus
gattgatagtactctcctgtggaaa

SEQ ID NO: 373142 - DNA, 25 bp, Rattus norvegicus
gattgatatctccttagtccaacca

SEQ ID NO: 373143 - DNA, 25 bp, Rattus norvegicus
gattgatatctcgttagtccaacca

SEQ ID NO: 373144 - DNA, 25 bp, Rattus norvegicus
gattgatatctgaggagtattgcct

SEQ ID NO: 373145 - DNA, 25 bp, Rattus norvegicus
gattgatatctgtggagtattgcct

SEQ ID NO: 373146 - DNA, 25 bp, Rattus norvegicus
gattgatatgagatgaagcagccaa

SEQ ID NO: 373147 - DNA, 25 bp, Rattus norvegicus
gattgatatgagttgaagcagccaa

SEQ ID NO: 373148 - DNA, 25 bp, Rattus norvegicus
gattgatcacacaaactctcggcat

SEQ ID NO: 373149 - DNA, 25 bp, Rattus norvegicus
gattgatcacactaactctcggcat

SEQ ID NO: 373150 - DNA, 25 bp, Rattus norvegicus
gattgatcagatctccattgaggag

SEQ ID NO: 373151 - DNA, 25 bp, Rattus norvegicus
gattgatcagatgtccattgaggag

SEQ ID NO: 373152 - DNA, 25 bp, Rattus norvegicus
gattgatccaagagttaccatgctg

SEQ ID NO: 373153 - DNA, 25 bp, Rattus norvegicus
gattgatccaagtgttaccatgctg

SEQ ID NO: 373154 - DNA, 25 bp, Rattus norvegicus
gattgatccaggaactactccacat

SEQ ID NO: 373155 - DNA, 25 bp, Rattus norvegicus
gattgatccaggtactactccacat

SEQ ID NO: 373156 - DNA, 25 bp, Rattus norvegicus
gattgatccatgcttacgttgctac

SEQ ID NO: 373157 - DNA, 25 bp, Rattus norvegicus
gattgatccatggttacgttgctac

SEQ ID NO: 373158 - DNA, 25 bp, Rattus norvegicus
gattgatcccctctagttgacaagt

SEQ ID NO: 373159 - DNA, 25 bp, Rattus norvegicus
gattgatcccctgtagttgacaagt

SEQ ID NO: 373160 - DNA, 25 bp, Rattus norvegicus
gattgatctcagctcgtcaaccttt

SEQ ID NO: 373161 - DNA, 25 bp, Rattus norvegicus
gattgatctcaggtcgtcaaccttt

SEQ ID NO: 373162 - DNA, 25 bp, Rattus norvegicus
gattgatctctgcagtgttttgaca

SEQ ID NO: 373163 - DNA, 25 bp, Rattus norvegicus
gattgatctctggagtgttttgaca

SEQ ID NO: 373164 - DNA, 25 bp, Rattus norvegicus
gattgatctgagacacgctgtgtgc

SEQ ID NO: 373165 - DNA, 25 bp, Rattus norvegicus
gattgatctgagtcacgctgtgtgc

SEQ ID NO: 373166 - DNA, 25 bp, Rattus norvegicus
gattgatgacatccgtaagcctgga

SEQ ID NO: 373167 - DNA, 25 bp, Rattus norvegicus
gattgatgacatgcgtaagcctgga

SEQ ID NO: 373168 - DNA, 25 bp, Rattus norvegicus
gattgatgaccaattttaagacatt

SEQ ID NO: 373169 - DNA, 25 bp, Rattus norvegicus
gattgatgaccatttttaagacatt

SEQ ID NO: 373170 - DNA, 25 bp, Rattus norvegicus
gattgatgcagaaggccccagtata

SEQ ID NO: 373171 - DNA, 25 bp, Rattus norvegicus
gattgatgcagatggccccagtata

SEQ ID NO: 373172 - DNA, 25 bp, Rattus norvegicus
gattgatgcattaccggtgtctttg

SEQ ID NO: 373173 - DNA, 25 bp, Rattus norvegicus
gattgatgcatttccggtgtctttg

SEQ ID NO: 373174 - DNA, 25 bp, Rattus norvegicus
gattgatgcccacgacaggtgaccc

SEQ ID NO: 373175 - DNA, 25 bp, Rattus norvegicus
gattgatgcccaggacaggtgaccc

SEQ ID NO: 373176 - DNA, 25 bp, Rattus norvegicus
gattgatgccggaaggtcttgtcct

SEQ ID NO: 373177 - DNA, 25 bp, Rattus norvegicus
gattgatgccggtaggtcttgtcct

SEQ ID NO: 373178 - DNA, 25 bp, Rattus norvegicus
gattgatgcggtaaaacttggttac

SEQ ID NO: 373179 - DNA, 25 bp, Rattus norvegicus
gattgatgcggttaaacttggttac

SEQ ID NO: 373180 - DNA, 25 bp, Rattus norvegicus
gattgatgctttatgaggatggtta

SEQ ID NO: 373181 - DNA, 25 bp, Rattus norvegicus
gattgatgctttttgaggatggtta

SEQ ID NO: 373182 - DNA, 25 bp, Rattus norvegicus
gattgatgggtacctgtcccacacg

SEQ ID NO: 373183 - DNA, 25 bp, Rattus norvegicus
gattgatgggtagctgtcccacacg

SEQ ID NO: 373184 - DNA, 25 bp, Rattus norvegicus
gattgatgtccccttttgatttctc

SEQ ID NO: 373185 - DNA, 25 bp, Rattus norvegicus
gattgatgtcccgttttgatttctc

SEQ ID NO: 373186 - DNA, 25 bp, Rattus norvegicus
gattgatgtgctccctgacagccat

SEQ ID NO: 373187 - DNA, 25 bp, Rattus norvegicus
gattgatgtgctgcctgacagccat

SEQ ID NO: 373188 - DNA, 25 bp, Rattus norvegicus
gattgattagccctggctctgtata

SEQ ID NO: 373189 - DNA, 25 bp, Rattus norvegicus
gattgattagccgtggctctgtata

SEQ ID NO: 373190 - DNA, 25 bp, Rattus norvegicus
gattgattcctgagttggtgtccaa

SEQ ID NO: 373191 - DNA, 25 bp, Rattus norvegicus
gattgattcctgtgttggtgtccaa

SEQ ID NO: 373192 - DNA, 25 bp, Rattus norvegicus
gattgattgcccaacttgaaatgaa

SEQ ID NO: 373193 - DNA, 25 bp, Rattus norvegicus
gattgattgccctacttgaaatgaa

SEQ ID NO: 373194 - DNA, 25 bp, Rattus norvegicus
gattgattgctcaccgacaagaaag

SEQ ID NO: 373195 - DNA, 25 bp, Rattus norvegicus
gattgattgctctccgacaagaaag

SEQ ID NO: 373196 - DNA, 25 bp, Rattus norvegicus
gattgattgtgtccctcaacataaa

SEQ ID NO: 373197 - DNA, 25 bp, Rattus norvegicus
gattgattgtgtgcctcaacataaa

SEQ ID NO: 373198 - DNA, 25 bp, Rattus norvegicus
gattgatttacgccgctaaggatga

SEQ ID NO: 373199 - DNA, 25 bp, Rattus norvegicus
gattgatttacggcgctaaggatga

SEQ ID NO: 373200 - DNA, 25 bp, Rattus norvegicus
gattgatttcagctctgcagacgga

SEQ ID NO: 373201 - DNA, 25 bp, Rattus norvegicus
gattgatttcaggtctgcagacgga

SEQ ID NO: 373202 - DNA, 25 bp, Rattus norvegicus
gattgatttgctctcgacattccca

SEQ ID NO: 373203 - DNA, 25 bp, Rattus norvegicus
gattgatttgctgtcgacattccca

SEQ ID NO: 373204 - DNA, 25 bp, Rattus norvegicus
gattgattttttccatttcgtcctt

SEQ ID NO: 373205 - DNA, 25 bp, Rattus norvegicus
gattgattttttgcatttcgtcctt

SEQ ID NO: 373206 - DNA, 25 bp, Rattus norvegicus
gattgcaaaaccaatccgtcctgga

SEQ ID NO: 373207 - DNA, 25 bp, Rattus norvegicus
gattgcaaaacctatccgtcctgga

SEQ ID NO: 373208 - DNA, 25 bp, Rattus norvegicus
gattgcaaacttcttgtaggcctac

SEQ ID NO: 373209 - DNA, 25 bp, Rattus norvegicus
gattgcaaacttgttgtaggcctac

SEQ ID NO: 373210 - DNA, 25 bp, Rattus norvegicus
gattgcaaagtgaaggccccacaca

SEQ ID NO: 373211 - DNA, 25 bp, Rattus norvegicus
gattgcaaagtgtaggccccacaca

SEQ ID NO: 373212 - DNA, 25 bp, Rattus norvegicus
gattgcaacatcaattttattttaa

SEQ ID NO: 373213 - DNA, 25 bp, Rattus norvegicus
gattgcaacatctattttattttaa

SEQ ID NO: 373214 - DNA, 25 bp, Rattus norvegicus
gattgcaaccaaaccagcgaattgt

SEQ ID NO: 373215 - DNA, 25 bp, Rattus norvegicus
gattgcaaccaatccagcgaattgt

SEQ ID NO: 373216 - DNA, 25 bp, Rattus norvegicus
gattgcaaccccaagcacagtggag

SEQ ID NO: 373217 - DNA, 25 bp, Rattus norvegicus
gattgcaacccctagcacagtggag

SEQ ID NO: 373218 - DNA, 25 bp, Rattus norvegicus
gattgcaagcaacgctactgaactt

SEQ ID NO: 373219 - DNA, 25 bp, Rattus norvegicus
gattgcaagcaaggctactgaactt

SEQ ID NO: 373220 - DNA, 25 bp, Rattus norvegicus
gattgcaagttgaaagaagctcttt

SEQ ID NO: 373221 - DNA, 25 bp, Rattus norvegicus
gattgcaagttgtaagaagctcttt

SEQ ID NO: 373222 - DNA, 25 bp, Rattus norvegicus
gattgcaatctaatgctttgcttta

SEQ ID NO: 373223 - DNA, 25 bp, Rattus norvegicus
gattgcaatctattgctttgcttta

SEQ ID NO: 373224 - DNA, 25 bp, Rattus norvegicus
gattgcacagagctaaacacacaca

SEQ ID NO: 373225 - DNA, 25 bp, Rattus norvegicus
gattgcacagaggtaaacacacaca

SEQ ID NO: 373226 - DNA, 25 bp, Rattus norvegicus
gattgcacagcactcatgtcataat

SEQ ID NO: 373227 - DNA, 25 bp, Rattus norvegicus
gattgcacagcagtcatgtcataat

SEQ ID NO: 373228 - DNA, 25 bp, Rattus norvegicus
gattgcacaggcaccgggttaagga

SEQ ID NO: 373229 - DNA, 25 bp, Rattus norvegicus
gattgcacaggctccgggttaagga

SEQ ID NO: 373230 - DNA, 25 bp, Rattus norvegicus
gattgcacagtcaaaccgactctaa

SEQ ID NO: 373231 - DNA, 25 bp, Rattus norvegicus
gattgcacagtctaaccgactctaa

SEQ ID NO: 373232 - DNA, 25 bp, Rattus norvegicus
gattgcacatttactacttgaggat

SEQ ID NO: 373233 - DNA, 25 bp, Rattus norvegicus
gattgcacattttctacttgaggat

SEQ ID NO: 373234 - DNA, 25 bp, Rattus norvegicus
gattgcacctttaaatcacttgtga

SEQ ID NO: 373235 - DNA, 25 bp, Rattus norvegicus
gattgcaccttttaatcacttgtga

SEQ ID NO: 373236 - DNA, 25 bp, Rattus norvegicus
gattgcacgatcaatacctcttcca

SEQ ID NO: 373237 - DNA, 25 bp, Rattus norvegicus
gattgcacgatctatacctcttcca

SEQ ID NO: 373238 - DNA, 25 bp, Rattus norvegicus
gattgcacttttcatttctttagaa

SEQ ID NO: 373239 - DNA, 25 bp, Rattus norvegicus
gattgcacttttgatttctttagaa

SEQ ID NO: 373240 - DNA, 25 bp, Rattus norvegicus
gattgcagaaaaatctgtgccttgt

SEQ ID NO: 373241 - DNA, 25 bp, Rattus norvegicus
gattgcagaaaattctgtgccttgt

SEQ ID NO: 373242 - DNA, 25 bp, Rattus norvegicus
gattgcagagccatggagtgccagt

SEQ ID NO: 373243 - DNA, 25 bp, Rattus norvegicus
gattgcagagccttggagtgccagt

SEQ ID NO: 373244 - DNA, 25 bp, Rattus norvegicus
gattgcagatctcttgtgttttctc

SEQ ID NO: 373245 - DNA, 25 bp, Rattus norvegicus
gattgcagatctgttgtgttttctc

SEQ ID NO: 373246 - DNA, 25 bp, Rattus norvegicus
gattgcagatgcatgtcacctgacc

SEQ ID NO: 373247 - DNA, 25 bp, Rattus norvegicus
gattgcagatgcttgtcacctgacc

SEQ ID NO: 373248 - DNA, 25 bp, Rattus norvegicus
gattgcagcacaccttgagtctgac

SEQ ID NO: 373249 - DNA, 25 bp, Rattus norvegicus
gattgcagcacagcttgagtctgac

SEQ ID NO: 373250 - DNA, 25 bp, Rattus norvegicus
gattgcagctgcagcctaatttgag

SEQ ID NO: 373251 - DNA, 25 bp, Rattus norvegicus
gattgcagctgctgcctaatttgag

SEQ ID NO: 373252 - DNA, 25 bp, Rattus norvegicus
gattgcaggagacacagctctggat

SEQ ID NO: 373253 - DNA, 25 bp, Rattus norvegicus
gattgcaggagagacagctctggat

SEQ ID NO: 373254 - DNA, 25 bp, Rattus norvegicus
gattgcagggcaagatctatttctt

SEQ ID NO: 373255 - DNA, 25 bp, Rattus norvegicus
gattgcagggcatgatctatttctt

SEQ ID NO: 373256 - DNA, 25 bp, Rattus norvegicus
gattgcagtgaaattctgactcttt

SEQ ID NO: 373257 - DNA, 25 bp, Rattus norvegicus
gattgcagtgaatttctgactcttt

SEQ ID NO: 373258 - DNA, 25 bp, Rattus norvegicus
gattgcagttgaacacaggtcacta

SEQ ID NO: 373259 - DNA, 25 bp, Rattus norvegicus
gattgcagttgatcacaggtcacta

SEQ ID NO: 373260 - DNA, 25 bp, Rattus norvegicus
gattgcataatgactattcttccat

SEQ ID NO: 373261 - DNA, 25 bp, Rattus norvegicus
gattgcataatgtctattcttccat

SEQ ID NO: 373262 - DNA, 25 bp, Rattus norvegicus
gattgcatatgcatctataccccaa

SEQ ID NO: 373263 - DNA, 25 bp, Rattus norvegicus
gattgcatatgcttctataccccaa

SEQ ID NO: 373264 - DNA, 25 bp, Rattus norvegicus
gattgcatcataccatccgtgtgaa

SEQ ID NO: 373265 - DNA, 25 bp, Rattus norvegicus
gattgcatcatagcatccgtgtgaa

SEQ ID NO: 373266 - DNA, 25 bp, Rattus norvegicus
gattgcatgggcaacgccaggaaag

SEQ ID NO: 373267 - DNA, 25 bp, Rattus norvegicus
gattgcatgggctacgccaggaaag

SEQ ID NO: 373268 - DNA, 25 bp, Rattus norvegicus
gattgcatgtggcatccatcacgcc

SEQ ID NO: 373269 - DNA, 25 bp, Rattus norvegicus
gattgcatgtgggatccatcacgcc

SEQ ID NO: 373270 - DNA, 25 bp, Rattus norvegicus
gattgcatttatcgtctcattgcta

SEQ ID NO: 373271 - DNA, 25 bp, Rattus norvegicus
gattgcatttatggtctcattgcta

SEQ ID NO: 373272 - DNA, 25 bp, Rattus norvegicus
gattgccaaagcatcagtaaacgat

SEQ ID NO: 373273 - DNA, 25 bp, Rattus norvegicus
gattgccaaagcttcagtaaacgat

SEQ ID NO: 373274 - DNA, 25 bp, Rattus norvegicus
gattgccaaggcacaagtggcccag

SEQ ID NO: 373275 - DNA, 25 bp, Rattus norvegicus
gattgccaaggctcaagtggcccag

SEQ ID NO: 373276 - DNA, 25 bp, Rattus norvegicus
gattgccaagttatctcattgttac

SEQ ID NO: 373277 - DNA, 25 bp, Rattus norvegicus
gattgccaagttttctcattgttac

SEQ ID NO: 373278 - DNA, 25 bp, Rattus norvegicus
gattgccaccttcttcaaatgccac

SEQ ID NO: 373279 - DNA, 25 bp, Rattus norvegicus
gattgccaccttgttcaaatgccac

SEQ ID NO: 373280 - DNA, 25 bp, Rattus norvegicus
gattgccagaatatgctgcttccca

SEQ ID NO: 373281 - DNA, 25 bp, Rattus norvegicus
gattgccagaatttgctgcttccca

SEQ ID NO: 373282 - DNA, 25 bp, Rattus norvegicus
gattgccagcatattagccgaattt

SEQ ID NO: 373283 - DNA, 25 bp, Rattus norvegicus
gattgccagcattttagccgaattt

SEQ ID NO: 373284 - DNA, 25 bp, Rattus norvegicus
gattgccaggagaacagtgctcttg

SEQ ID NO: 373285 - DNA, 25 bp, Rattus norvegicus
gattgccaggagtacagtgctcttg

SEQ ID NO: 373286 - DNA, 25 bp, Rattus norvegicus
gattgccaggtaatagggttaaagg

SEQ ID NO: 373287 - DNA, 25 bp, Rattus norvegicus
gattgccaggtattagggttaaagg

SEQ ID NO: 373288 - DNA, 25 bp, Rattus norvegicus
gattgccatattatctgtccacttg

SEQ ID NO: 373289 - DNA, 25 bp, Rattus norvegicus
gattgccatattttctgtccacttg

SEQ ID NO: 373290 - DNA, 25 bp, Rattus norvegicus
gattgccatcgacgagtctttccat

SEQ ID NO: 373291 - DNA, 25 bp, Rattus norvegicus
gattgccatcgaggagtctttccat

SEQ ID NO: 373292 - DNA, 25 bp, Rattus norvegicus
gattgccatctccttcaggtgatga

SEQ ID NO: 373293 - DNA, 25 bp, Rattus norvegicus
gattgccatctcgttcaggtgatga

SEQ ID NO: 373294 - DNA, 25 bp, Rattus norvegicus
gattgccatgcaacttcagagtaac

SEQ ID NO: 373295 - DNA, 25 bp, Rattus norvegicus
gattgccatgcatcttcagagtaac

SEQ ID NO: 373296 - DNA, 25 bp, Rattus norvegicus
gattgccattctacaactgcaagaa

SEQ ID NO: 373297 - DNA, 25 bp, Rattus norvegicus
gattgccattcttcaactgcaagaa

SEQ ID NO: 373298 - DNA, 25 bp, Rattus norvegicus
gattgcccacgtaaaaccaagcatc

SEQ ID NO: 373299 - DNA, 25 bp, Rattus norvegicus
gattgcccacgttaaaccaagcatc

SEQ ID NO: 373300 - DNA, 25 bp, Rattus norvegicus
gattgcccagagagtgacagccgtg

SEQ ID NO: 373301 - DNA, 25 bp, Rattus norvegicus
gattgcccagagcttcatgaggaag

SEQ ID NO: 373302 - DNA, 25 bp, Rattus norvegicus
gattgcccagaggttcatgaggaag

SEQ ID NO: 373303 - DNA, 25 bp, Rattus norvegicus
gattgcccagagtgtgacagccgtg

SEQ ID NO: 373304 - DNA, 25 bp, Rattus norvegicus
gattgcccattccacttgatgtaaa

SEQ ID NO: 373305 - DNA, 25 bp, Rattus norvegicus
gattgcccattcgacttgatgtaaa

SEQ ID NO: 373306 - DNA, 25 bp, Rattus norvegicus
gattgcccgagtctctcagaggcta

SEQ ID NO: 373307 - DNA, 25 bp, Rattus norvegicus
gattgcccgagtgtctcagaggcta

SEQ ID NO: 373308 - DNA, 25 bp, Rattus norvegicus
gattgcccggagaagatttatctgc

SEQ ID NO: 373309 - DNA, 25 bp, Rattus norvegicus
gattgcccggagtagatttatctgc

SEQ ID NO: 373310 - DNA, 25 bp, Rattus norvegicus
gattgcccggcacgaagaagaattt

SEQ ID NO: 373311 - DNA, 25 bp, Rattus norvegicus
gattgcccggcaggaagaagaattt

SEQ ID NO: 373312 - DNA, 25 bp, Rattus norvegicus
gattgcccgggtccttaataaaaca

SEQ ID NO: 373313 - DNA, 25 bp, Rattus norvegicus
gattgcccgggtgcttaataaaaca

SEQ ID NO: 373314 - DNA, 25 bp, Rattus norvegicus
gattgcccgtgtcgagaattcttat

SEQ ID NO: 373315 - DNA, 25 bp, Rattus norvegicus
gattgcccgtgtggagaattcttat

SEQ ID NO: 373316 - DNA, 25 bp, Rattus norvegicus
gattgccctaacagtagacattcta

SEQ ID NO: 373317 - DNA, 25 bp, Rattus norvegicus
gattgccctaactgtagacattcta

SEQ ID NO: 373318 - DNA, 25 bp, Rattus norvegicus
gattgccctactctgggcctaagga

SEQ ID NO: 373319 - DNA, 25 bp, Rattus norvegicus
gattgccctactgtgggcctaagga

SEQ ID NO: 373320 - DNA, 25 bp, Rattus norvegicus
gattgcccttaaatattagacagtt

SEQ ID NO: 373321 - DNA, 25 bp, Rattus norvegicus
gattgcccttaattattagacagtt

SEQ ID NO: 373322 - DNA, 25 bp, Rattus norvegicus
gattgccgagtgcaagaagctcttt

SEQ ID NO: 373323 - DNA, 25 bp, Rattus norvegicus
gattgccgagtggaagaagctcttt

SEQ ID NO: 373324 - DNA, 25 bp, Rattus norvegicus
gattgccgcttcatgactatataca

SEQ ID NO: 373325 - DNA, 25 bp, Rattus norvegicus
gattgccgcttcttgactatataca

SEQ ID NO: 373326 - DNA, 25 bp, Rattus norvegicus
gattgccggtgcagacaatgccagc

SEQ ID NO: 373327 - DNA, 25 bp, Rattus norvegicus
gattgccggtgctgacaatgccagc

SEQ ID NO: 373328 - DNA, 25 bp, Rattus norvegicus
gattgccgtaatcctacattcggga

SEQ ID NO: 373329 - DNA, 25 bp, Rattus norvegicus
gattgccgtaatgctacattcggga

SEQ ID NO: 373330 - DNA, 25 bp, Rattus norvegicus
gattgcctaaagctccattatctcc

SEQ ID NO: 373331 - DNA, 25 bp, Rattus norvegicus
gattgcctaaaggtccattatctcc

SEQ ID NO: 373332 - DNA, 25 bp, Rattus norvegicus
gattgcctacagcaactccaggaag

SEQ ID NO: 373333 - DNA, 25 bp, Rattus norvegicus
gattgcctacaggaactccaggaag

SEQ ID NO: 373334 - DNA, 25 bp, Rattus norvegicus
gattgcctagagaaggatggcttca

SEQ ID NO: 373335 - DNA, 25 bp, Rattus norvegicus
gattgcctagagtaggatggcttca

SEQ ID NO: 373336 - DNA, 25 bp, Rattus norvegicus
gattgcctagcaaatgagtctatgg

SEQ ID NO: 373337 - DNA, 25 bp, Rattus norvegicus
gattgcctagcatatgagtctatgg

SEQ ID NO: 373338 - DNA, 25 bp, Rattus norvegicus
gattgcctcacaagttgtctgttta

SEQ ID NO: 373339 - DNA, 25 bp, Rattus norvegicus
gattgcctcacatgttgtctgttta

SEQ ID NO: 373340 - DNA, 25 bp, Rattus norvegicus
gattgcctcagcaatcacagaaaac

SEQ ID NO: 373341 - DNA, 25 bp, Rattus norvegicus
gattgcctcagctatcacagaaaac

SEQ ID NO: 373342 - DNA, 25 bp, Rattus norvegicus
gattgcctcaggcatagtcgccatg

SEQ ID NO: 373343 - DNA, 25 bp, Rattus norvegicus
gattgcctcagggatagtcgccatg

SEQ ID NO: 373344 - DNA, 25 bp, Rattus norvegicus
gattgcctcagtaacaaccagctgt

SEQ ID NO: 373345 - DNA, 25 bp, Rattus norvegicus
gattgcctcagttacaaccagctgt

SEQ ID NO: 373346 - DNA, 25 bp, Rattus norvegicus
gattgcctcctgaacttagacaatg

SEQ ID NO: 373347 - DNA, 25 bp, Rattus norvegicus
gattgcctcctgtacttagacaatg

SEQ ID NO: 373348 - DNA, 25 bp, Rattus norvegicus
gattgcctctctcgagctgtgagca

SEQ ID NO: 373349 - DNA, 25 bp, Rattus norvegicus
gattgcctctctggagctgtgagca

SEQ ID NO: 373350 - DNA, 25 bp, Rattus norvegicus
gattgcctgaaacttccaattccct

SEQ ID NO: 373351 - DNA, 25 bp, Rattus norvegicus
gattgcctgaaagttccaattccct

SEQ ID NO: 373352 - DNA, 25 bp, Rattus norvegicus
gattgcctggttacttgtaacattt

SEQ ID NO: 373353 - DNA, 25 bp, Rattus norvegicus
gattgcctggttcattgctgtctgc

SEQ ID NO: 373354 - DNA, 25 bp, Rattus norvegicus
gattgcctggttgattgctgtctgc

SEQ ID NO: 373355 - DNA, 25 bp, Rattus norvegicus
gattgcctggtttcttgtaacattt

SEQ ID NO: 373356 - DNA, 25 bp, Rattus norvegicus
gattgccttcagattgtgttgtgta

SEQ ID NO: 373357 - DNA, 25 bp, Rattus norvegicus
gattgccttcagtttgtgttgtgta

SEQ ID NO: 373358 - DNA, 25 bp, Rattus norvegicus
gattgccttggtatctgtgtagtta

SEQ ID NO: 373359 - DNA, 25 bp, Rattus norvegicus
gattgccttggtttctgtgtagtta

SEQ ID NO: 373360 - DNA, 25 bp, Rattus norvegicus
gattgccttgttcagccttgatata

SEQ ID NO: 373361 - DNA, 25 bp, Rattus norvegicus
gattgccttgttgagccttgatata

SEQ ID NO: 373362 - DNA, 25 bp, Rattus norvegicus
gattgcgaattccaggctagcctag

SEQ ID NO: 373363 - DNA, 25 bp, Rattus norvegicus
gattgcgaattcgaggctagcctag

SEQ ID NO: 373364 - DNA, 25 bp, Rattus norvegicus
gattgcgcacatccatgcaaacaaa

SEQ ID NO: 373365 - DNA, 25 bp, Rattus norvegicus
gattgcgcacatgcatgcaaacaaa

SEQ ID NO: 373366 - DNA, 25 bp, Rattus norvegicus
gattgcgctcatacgtaggatttta

SEQ ID NO: 373367 - DNA, 25 bp, Rattus norvegicus
gattgcgctcattcgtaggatttta

SEQ ID NO: 373368 - DNA, 25 bp, Rattus norvegicus
gattgcggaaaaaataaatgctgct

SEQ ID NO: 373369 - DNA, 25 bp, Rattus norvegicus
gattgcggaaaatataaatgctgct

SEQ ID NO: 373370 - DNA, 25 bp, Rattus norvegicus
gattgcggacacagcagcacagata

SEQ ID NO: 373371 - DNA, 25 bp, Rattus norvegicus
gattgcggacactgcagcacagata

SEQ ID NO: 373372 - DNA, 25 bp, Rattus norvegicus
gattgcggacttaatcagcacgtgc

SEQ ID NO: 373373 - DNA, 25 bp, Rattus norvegicus
gattgcggactttatcagcacgtgc

SEQ ID NO: 373374 - DNA, 25 bp, Rattus norvegicus
gattgcggcaagaccttcaaacggt

SEQ ID NO: 373375 - DNA, 25 bp, Rattus norvegicus
gattgcggcaagtccttcaaacggt

SEQ ID NO: 373376 - DNA, 25 bp, Rattus norvegicus
gattgcggttttctggtagctgttt

SEQ ID NO: 373377 - DNA, 25 bp, Rattus norvegicus
gattgcggttttgtggtagctgttt

SEQ ID NO: 373378 - DNA, 25 bp, Rattus norvegicus
gattgcgtgagtacaaagatgctgg

SEQ ID NO: 373379 - DNA, 25 bp, Rattus norvegicus
gattgcgtgagttcaaagatgctgg

SEQ ID NO: 373380 - DNA, 25 bp, Rattus norvegicus
gattgcgttgcgactcggcgtgatt

SEQ ID NO: 373381 - DNA, 25 bp, Rattus norvegicus
gattgcgttgcgtctcggcgtgatt

SEQ ID NO: 373382 - DNA, 25 bp, Rattus norvegicus
gattgctaaaatctgccgctcaggc

SEQ ID NO: 373383 - DNA, 25 bp, Rattus norvegicus
gattgctaaaatgtgccgctcaggc

SEQ ID NO: 373384 - DNA, 25 bp, Rattus norvegicus
gattgctaagtcaacactgtctgct

SEQ ID NO: 373385 - DNA, 25 bp, Rattus norvegicus
gattgctaagtctacactgtctgct

SEQ ID NO: 373386 - DNA, 25 bp, Rattus norvegicus
gattgctaatcacagcgtcttcttc

SEQ ID NO: 373387 - DNA, 25 bp, Rattus norvegicus
gattgctaatcagagcgtcttcttc

SEQ ID NO: 373388 - DNA, 25 bp, Rattus norvegicus
gattgctacaagatttctgacctcc

SEQ ID NO: 373389 - DNA, 25 bp, Rattus norvegicus
gattgctacaagttttctgacctcc

SEQ ID NO: 373390 - DNA, 25 bp, Rattus norvegicus
gattgctacaatcggccctgtgcag

SEQ ID NO: 373391 - DNA, 25 bp, Rattus norvegicus
gattgctacaatgggccctgtgcag

SEQ ID NO: 373392 - DNA, 25 bp, Rattus norvegicus
gattgctagttcagaagtccaggtg

SEQ ID NO: 373393 - DNA, 25 bp, Rattus norvegicus
gattgctagttctgaagtccaggtg

SEQ ID NO: 373394 - DNA, 25 bp, Rattus norvegicus
gattgctatggtcctgggcctcaca

SEQ ID NO: 373395 - DNA, 25 bp, Rattus norvegicus
gattgctatggtgctgggcctcaca

SEQ ID NO: 373396 - DNA, 25 bp, Rattus norvegicus
gattgctatgtgagacttttcattt

SEQ ID NO: 373397 - DNA, 25 bp, Rattus norvegicus
gattgctatgtgtgacttttcattt

SEQ ID NO: 373398 - DNA, 25 bp, Rattus norvegicus
gattgctattggctacttggtgact

SEQ ID NO: 373399 - DNA, 25 bp, Rattus norvegicus
gattgctattgggtacttggtgact

SEQ ID NO: 373400 - DNA, 25 bp, Rattus norvegicus
gattgctcaaaccaagcttcctgtt

SEQ ID NO: 373401 - DNA, 25 bp, Rattus norvegicus
gattgctcaaacgaagcttcctgtt

SEQ ID NO: 373402 - DNA, 25 bp, Rattus norvegicus
gattgctcacctaaccgagatgcag

SEQ ID NO: 373403 - DNA, 25 bp, Rattus norvegicus
gattgctcaccttaccgagatgcag

SEQ ID NO: 373404 - DNA, 25 bp, Rattus norvegicus
gattgctcagatatccagtcatgtt

SEQ ID NO: 373405 - DNA, 25 bp, Rattus norvegicus
gattgctcagatcttagaccgttat

SEQ ID NO: 373406 - DNA, 25 bp, Rattus norvegicus
gattgctcagatgttagaccgttat

SEQ ID NO: 373407 - DNA, 25 bp, Rattus norvegicus
gattgctcagatttccagtcatgtt

SEQ ID NO: 373408 - DNA, 25 bp, Rattus norvegicus
gattgctcagcaattacccggagtt

SEQ ID NO: 373409 - DNA, 25 bp, Rattus norvegicus
gattgctcagcatttacccggagtt

SEQ ID NO: 373410 - DNA, 25 bp, Rattus norvegicus
gattgctcctgtacagtgaatctcc

SEQ ID NO: 373411 - DNA, 25 bp, Rattus norvegicus
gattgctcctgttcagtgaatctcc

SEQ ID NO: 373412 - DNA, 25 bp, Rattus norvegicus
gattgctcgctgaaagcagctcatc

SEQ ID NO: 373413 - DNA, 25 bp, Rattus norvegicus
gattgctcgctgtaagcagctcatc

SEQ ID NO: 373414 - DNA, 25 bp, Rattus norvegicus
gattgctctcctcagtaaggcgcag

SEQ ID NO: 373415 - DNA, 25 bp, Rattus norvegicus
gattgctctcctgagtaaggcgcag

SEQ ID NO: 373416 - DNA, 25 bp, Rattus norvegicus
gattgctctctccactgccagtggg

SEQ ID NO: 373417 - DNA, 25 bp, Rattus norvegicus
gattgctctctcgactgccagtggg

SEQ ID NO: 373418 - DNA, 25 bp, Rattus norvegicus
gattgctctgctctgtgtgaagtaa

SEQ ID NO: 373419 - DNA, 25 bp, Rattus norvegicus
gattgctctgctgtgtgtgaagtaa

SEQ ID NO: 373420 - DNA, 25 bp, Rattus norvegicus
gattgctctgggaaagcatccaaac

SEQ ID NO: 373421 - DNA, 25 bp, Rattus norvegicus
gattgctctgggtaagcatccaaac

SEQ ID NO: 373422 - DNA, 25 bp, Rattus norvegicus
gattgctcttaaacttggtgaccag

SEQ ID NO: 373423 - DNA, 25 bp, Rattus norvegicus
gattgctcttaatcttggtgaccag

SEQ ID NO: 373424 - DNA, 25 bp, Rattus norvegicus
gattgctgattcacgagttatggtt

SEQ ID NO: 373425 - DNA, 25 bp, Rattus norvegicus
gattgctgattctcgagttatggtt

SEQ ID NO: 373426 - DNA, 25 bp, Rattus norvegicus
gattgctgcaagctcacagagtcct

SEQ ID NO: 373427 - DNA, 25 bp, Rattus norvegicus
gattgctgcaaggtcacagagtcct

SEQ ID NO: 373428 - DNA, 25 bp, Rattus norvegicus
gattgctgcaatcctgtctaccatc

SEQ ID NO: 373429 - DNA, 25 bp, Rattus norvegicus
gattgctgcaatgctgtctaccatc

SEQ ID NO: 373430 - DNA, 25 bp, Rattus norvegicus
gattgctgcacacggaatccgggtt

SEQ ID NO: 373431 - DNA, 25 bp, Rattus norvegicus
gattgctgcacagggaatccgggtt

SEQ ID NO: 373432 - DNA, 25 bp, Rattus norvegicus
gattgctgcatgagtctgtctacca

SEQ ID NO: 373433 - DNA, 25 bp, Rattus norvegicus
gattgctgcatgtgtctgtctacca

SEQ ID NO: 373434 - DNA, 25 bp, Rattus norvegicus
gattgctgccacagaaatgctgtac

SEQ ID NO: 373435 - DNA, 25 bp, Rattus norvegicus
gattgctgccactgaaatgctgtac

SEQ ID NO: 373436 - DNA, 25 bp, Rattus norvegicus
gattgctgctatcacccatggtgcc

SEQ ID NO: 373437 - DNA, 25 bp, Rattus norvegicus
gattgctgctatgacccatggtgcc

SEQ ID NO: 373438 - DNA, 25 bp, Rattus norvegicus
gattgctgggcacactgaggacacc

SEQ ID NO: 373439 - DNA, 25 bp, Rattus norvegicus
gattgctgggcagactgaggacacc

SEQ ID NO: 373440 - DNA, 25 bp, Rattus norvegicus
gattgctgtagcacagattgtttac

SEQ ID NO: 373441 - DNA, 25 bp, Rattus norvegicus
gattgctgtagccattctggacagt

SEQ ID NO: 373442 - DNA, 25 bp, Rattus norvegicus
gattgctgtagcgattctggacagt

SEQ ID NO: 373443 - DNA, 25 bp, Rattus norvegicus
gattgctgtagctcagattgtttac

SEQ ID NO: 373444 - DNA, 25 bp, Rattus norvegicus
gattgctgtagtatacactttgtat

SEQ ID NO: 373445 - DNA, 25 bp, Rattus norvegicus
gattgctgtagtttacactttgtat

SEQ ID NO: 373446 - DNA, 25 bp, Rattus norvegicus
gattgctgtatgcaattctgtgaaa

SEQ ID NO: 373447 - DNA, 25 bp, Rattus norvegicus
gattgctgtatggaattctgtgaaa

SEQ ID NO: 373448 - DNA, 25 bp, Rattus norvegicus
gattgctgtcataaattacctcccc

SEQ ID NO: 373449 - DNA, 25 bp, Rattus norvegicus
gattgctgtcattaattacctcccc

SEQ ID NO: 373450 - DNA, 25 bp, Rattus norvegicus
gattgcttagatattattggtgaca

SEQ ID NO: 373451 - DNA, 25 bp, Rattus norvegicus
gattgcttagattttattggtgaca

SEQ ID NO: 373452 - DNA, 25 bp, Rattus norvegicus
gattgcttcaaaattctgctattaa

SEQ ID NO: 373453 - DNA, 25 bp, Rattus norvegicus
gattgcttcaaatttctgctattaa

SEQ ID NO: 373454 - DNA, 25 bp, Rattus norvegicus
gattgcttcaacaccttctcagcat

SEQ ID NO: 373455 - DNA, 25 bp, Rattus norvegicus
gattgcttcaactccttctcagcat

SEQ ID NO: 373456 - DNA, 25 bp, Rattus norvegicus
gattgcttcaagacgttggacacca

SEQ ID NO: 373457 - DNA, 25 bp, Rattus norvegicus
gattgcttcaagctgttcagtttca

SEQ ID NO: 373458 - DNA, 25 bp, Rattus norvegicus
gattgcttcaaggtgttcagtttca

SEQ ID NO: 373459 - DNA, 25 bp, Rattus norvegicus
gattgcttcaagtcgttggacacca

SEQ ID NO: 373460 - DNA, 25 bp, Rattus norvegicus
gattgcttcagtccgttattacatt

SEQ ID NO: 373461 - DNA, 25 bp, Rattus norvegicus
gattgcttcagtgcgttattacatt

SEQ ID NO: 373462 - DNA, 25 bp, Rattus norvegicus
gattgcttcatgctcaggtcttatt

SEQ ID NO: 373463 - DNA, 25 bp, Rattus norvegicus
gattgcttcatggtcaggtcttatt

SEQ ID NO: 373464 - DNA, 25 bp, Rattus norvegicus
gattgcttgtgtactttccatcagt

SEQ ID NO: 373465 - DNA, 25 bp, Rattus norvegicus
gattgcttgtgttctttccatcagt

SEQ ID NO: 373466 - DNA, 25 bp, Rattus norvegicus
gattgcttgttcatgctttcttcac

SEQ ID NO: 373467 - DNA, 25 bp, Rattus norvegicus
gattgcttgttcttgctttcttcac

SEQ ID NO: 373468 - DNA, 25 bp, Rattus norvegicus
gattgctttaacaacaccagcctgt

SEQ ID NO: 373469 - DNA, 25 bp, Rattus norvegicus
gattgctttaactacaccagcctgt

SEQ ID NO: 373470 - DNA, 25 bp, Rattus norvegicus
gattgctttagacccgttggacatc

SEQ ID NO: 373471 - DNA, 25 bp, Rattus norvegicus
gattgctttagagccgttggacatc

SEQ ID NO: 373472 - DNA, 25 bp, Rattus norvegicus
gattgcttttcaaactgcttaacga

SEQ ID NO: 373473 - DNA, 25 bp, Rattus norvegicus
gattgcttttcatactgcttaacga

SEQ ID NO: 373474 - DNA, 25 bp, Rattus norvegicus
gattgcttttctccacattgtcacc

SEQ ID NO: 373475 - DNA, 25 bp, Rattus norvegicus
gattgcttttctgcacattgtcacc

SEQ ID NO: 373476 - DNA, 25 bp, Rattus norvegicus
gattgcttttgtcctcaggatagga

SEQ ID NO: 373477 - DNA, 25 bp, Rattus norvegicus
gattgcttttgtgctcaggatagga

SEQ ID NO: 373478 - DNA, 25 bp, Rattus norvegicus
gattgcttttttctacacgagaccc

SEQ ID NO: 373479 - DNA, 25 bp, Rattus norvegicus
gattgcttttttcttgggagtgatg

SEQ ID NO: 373480 - DNA, 25 bp, Rattus norvegicus
gattgcttttttgtacacgagaccc

SEQ ID NO: 373481 - DNA, 25 bp, Rattus norvegicus
gattgcttttttgttgggagtgatg

SEQ ID NO: 373482 - DNA, 25 bp, Rattus norvegicus
gattggaaactaaccctaaccccag

SEQ ID NO: 373483 - DNA, 25 bp, Rattus norvegicus
gattggaaactatccctaaccccag

SEQ ID NO: 373484 - DNA, 25 bp, Rattus norvegicus
gattggaaccacaacaagcctcgtc

SEQ ID NO: 373485 - DNA, 25 bp, Rattus norvegicus
gattggaaccactacaagcctcgtc

SEQ ID NO: 373486 - DNA, 25 bp, Rattus norvegicus
gattggaacccacagttgccaccag

SEQ ID NO: 373487 - DNA, 25 bp, Rattus norvegicus
gattggaacccagagttgccaccag

SEQ ID NO: 373488 - DNA, 25 bp, Rattus norvegicus
gattggaacctcaagtcccgggagg

SEQ ID NO: 373489 - DNA, 25 bp, Rattus norvegicus
gattggaacctctagtcccgggagg

SEQ ID NO: 373490 - DNA, 25 bp, Rattus norvegicus
gattggaagaatcgccatggcgtac

SEQ ID NO: 373491 - DNA, 25 bp, Rattus norvegicus
gattggaagaatggccatggcgtac

SEQ ID NO: 373492 - DNA, 25 bp, Rattus norvegicus
gattggaatcacacacttttcagat

SEQ ID NO: 373493 - DNA, 25 bp, Rattus norvegicus
gattggaatcactcacttttcagat

SEQ ID NO: 373494 - DNA, 25 bp, Rattus norvegicus
gattggaatgtcactgtagttcagc

SEQ ID NO: 373495 - DNA, 25 bp, Rattus norvegicus
gattggaatgtctctgtagttcagc

SEQ ID NO: 373496 - DNA, 25 bp, Rattus norvegicus
gattggacacagatgacttggacga

SEQ ID NO: 373497 - DNA, 25 bp, Rattus norvegicus
gattggacacagttgacttggacga

SEQ ID NO: 373498 - DNA, 25 bp, Rattus norvegicus
gattggacaggtaaaggcccggctc

SEQ ID NO: 373499 - DNA, 25 bp, Rattus norvegicus
gattggacaggttaaggcccggctc

SEQ ID NO: 373500 - DNA, 25 bp, Rattus norvegicus
gattggacatgacctttgctccctc

SEQ ID NO: 373501 - DNA, 25 bp, Rattus norvegicus
gattggacatgagctttgctccctc

SEQ ID NO: 373502 - DNA, 25 bp, Rattus norvegicus
gattggaccagcagagaacactcta

SEQ ID NO: 373503 - DNA, 25 bp, Rattus norvegicus
gattggaccagctgagaacactcta

SEQ ID NO: 373504 - DNA, 25 bp, Rattus norvegicus
gattggacccaacctatttatatgt

SEQ ID NO: 373505 - DNA, 25 bp, Rattus norvegicus
gattggacccaagctatttatatgt

SEQ ID NO: 373506 - DNA, 25 bp, Rattus norvegicus
gattggactcacatacagtcactct

SEQ ID NO: 373507 - DNA, 25 bp, Rattus norvegicus
gattggactcacttacagtcactct

SEQ ID NO: 373508 - DNA, 25 bp, Rattus norvegicus
gattggactcataggacattctgca

SEQ ID NO: 373509 - DNA, 25 bp, Rattus norvegicus
gattggactcattggacattctgca

SEQ ID NO: 373510 - DNA, 25 bp, Rattus norvegicus
gattggactccaactgtttggttaa

SEQ ID NO: 373511 - DNA, 25 bp, Rattus norvegicus
gattggactccatctgtttggttaa

SEQ ID NO: 373512 - DNA, 25 bp, Rattus norvegicus
gattggactccgacgtttttgtact

SEQ ID NO: 373513 - DNA, 25 bp, Rattus norvegicus
gattggactccgtcgtttttgtact

SEQ ID NO: 373514 - DNA, 25 bp, Rattus norvegicus
gattggacttaaagggcttttctac

SEQ ID NO: 373515 - DNA, 25 bp, Rattus norvegicus
gattggacttaaccctttagggtgt

SEQ ID NO: 373516 - DNA, 25 bp, Rattus norvegicus
gattggacttaagcctttagggtgt

SEQ ID NO: 373517 - DNA, 25 bp, Rattus norvegicus
gattggacttaatgggcttttctac

SEQ ID NO: 373518 - DNA, 25 bp, Rattus norvegicus
gattggacttttctgagcttaccgc

SEQ ID NO: 373519 - DNA, 25 bp, Rattus norvegicus
gattggacttttgtgagcttaccgc

SEQ ID NO: 373520 - DNA, 25 bp, Rattus norvegicus
gattggagacccattgccgttggac

SEQ ID NO: 373521 - DNA, 25 bp, Rattus norvegicus
gattggagaccctttgccgttggac

SEQ ID NO: 373522 - DNA, 25 bp, Rattus norvegicus
gattggagactaagcccattgggta

SEQ ID NO: 373523 - DNA, 25 bp, Rattus norvegicus
gattggagactatgcccattgggta

SEQ ID NO: 373524 - DNA, 25 bp, Rattus norvegicus
gattggagatggaaccacggtgctc

SEQ ID NO: 373525 - DNA, 25 bp, Rattus norvegicus
gattggagatggtaccacggtgctc

SEQ ID NO: 373526 - DNA, 25 bp, Rattus norvegicus
gattggagccatcatgtgcttgcca

SEQ ID NO: 373527 - DNA, 25 bp, Rattus norvegicus
gattggagccatgatgtgcttgcca

SEQ ID NO: 373528 - DNA, 25 bp, Rattus norvegicus
gattggagcccaccctaattaaata

SEQ ID NO: 373529 - DNA, 25 bp, Rattus norvegicus
gattggagcccagcctaattaaata

SEQ ID NO: 373530 - DNA, 25 bp, Rattus norvegicus
gattggagtttgactgtagctgtgt

SEQ ID NO: 373531 - DNA, 25 bp, Rattus norvegicus
gattggagtttgtctgtagctgtgt

SEQ ID NO: 373532 - DNA, 25 bp, Rattus norvegicus
gattggataaaccacagtttgtgac

SEQ ID NO: 373533 - DNA, 25 bp, Rattus norvegicus
gattggataaacgacagtttgtgac

SEQ ID NO: 373534 - DNA, 25 bp, Rattus norvegicus
gattggatctggctgccttgtgcat

SEQ ID NO: 373535 - DNA, 25 bp, Rattus norvegicus
gattggatctgggtgccttgtgcat

SEQ ID NO: 373536 - DNA, 25 bp, Rattus norvegicus
gattggatctgtatcttgcaatgat

SEQ ID NO: 373537 - DNA, 25 bp, Rattus norvegicus
gattggatctgtttcttgcaatgat

SEQ ID NO: 373538 - DNA, 25 bp, Rattus norvegicus
gattggatgcagagtggcccgttcc

SEQ ID NO: 373539 - DNA, 25 bp, Rattus norvegicus
gattggatgcagtgtggcccgttcc

SEQ ID NO: 373540 - DNA, 25 bp, Rattus norvegicus
gattggatgtctaggctaggcccag

SEQ ID NO: 373541 - DNA, 25 bp, Rattus norvegicus
gattggatgtcttggctaggcccag

SEQ ID NO: 373542 - DNA, 25 bp, Rattus norvegicus
gattggattcatctgtagtggtcat

SEQ ID NO: 373543 - DNA, 25 bp, Rattus norvegicus
gattggattcatgtgtagtggtcat

SEQ ID NO: 373544 - DNA, 25 bp, Rattus norvegicus
gattggatttgcaatctacttcggc

SEQ ID NO: 373545 - DNA, 25 bp, Rattus norvegicus
gattggatttgccttgtagtcacag

SEQ ID NO: 373546 - DNA, 25 bp, Rattus norvegicus
gattggatttgcgttgtagtcacag

SEQ ID NO: 373547 - DNA, 25 bp, Rattus norvegicus
gattggatttgctatctacttcggc

SEQ ID NO: 373548 - DNA, 25 bp, Rattus norvegicus
gattggcacttcaaagacattcttt

SEQ ID NO: 373549 - DNA, 25 bp, Rattus norvegicus
gattggcacttctaagacattcttt

SEQ ID NO: 373550 - DNA, 25 bp, Rattus norvegicus
gattggcacttgaggactgcctaga

SEQ ID NO: 373551 - DNA, 25 bp, Rattus norvegicus
gattggcacttgtggactgcctaga

SEQ ID NO: 373552 - DNA, 25 bp, Rattus norvegicus
gattggcagagccttgtcagctgat

SEQ ID NO: 373553 - DNA, 25 bp, Rattus norvegicus
gattggcagagcgttgtcagctgat

SEQ ID NO: 373554 - DNA, 25 bp, Rattus norvegicus
gattggcagctacctgtcctggtac

SEQ ID NO: 373555 - DNA, 25 bp, Rattus norvegicus
gattggcagctagctgtcctggtac

SEQ ID NO: 373556 - DNA, 25 bp, Rattus norvegicus
gattggcaggttacttttactctca

SEQ ID NO: 373557 - DNA, 25 bp, Rattus norvegicus
gattggcaggtttcttttactctca

SEQ ID NO: 373558 - DNA, 25 bp, Rattus norvegicus
gattggcatcgtcaacacagctcag

SEQ ID NO: 373559 - DNA, 25 bp, Rattus norvegicus
gattggcatcgtgaacacagctcag

SEQ ID NO: 373560 - DNA, 25 bp, Rattus norvegicus
gattggcattaaccacaggttcctt

SEQ ID NO: 373561 - DNA, 25 bp, Rattus norvegicus
gattggcattaagcacaggttcctt

SEQ ID NO: 373562 - DNA, 25 bp, Rattus norvegicus
gattggccaacaaggtggtgcctac

SEQ ID NO: 373563 - DNA, 25 bp, Rattus norvegicus
gattggccaacatggtggtgcctac

SEQ ID NO: 373564 - DNA, 25 bp, Rattus norvegicus
gattggccagtactgtcatttccat

SEQ ID NO: 373565 - DNA, 25 bp, Rattus norvegicus
gattggccagtagtgtcatttccat

SEQ ID NO: 373566 - DNA, 25 bp, Rattus norvegicus
gattggcccaacacataaaagacgt

SEQ ID NO: 373567 - DNA, 25 bp, Rattus norvegicus
gattggcccaactcataaaagacgt

SEQ ID NO: 373568 - DNA, 25 bp, Rattus norvegicus
gattggcctaacagaccagaacgga

SEQ ID NO: 373569 - DNA, 25 bp, Rattus norvegicus
gattggcctaactgaccagaacgga

SEQ ID NO: 373570 - DNA, 25 bp, Rattus norvegicus
gattggcctagaaatctcagacatt

SEQ ID NO: 373571 - DNA, 25 bp, Rattus norvegicus
gattggcctagatatctcagacatt

SEQ ID NO: 373572 - DNA, 25 bp, Rattus norvegicus
gattggcctatccattctgggaacc

SEQ ID NO: 373573 - DNA, 25 bp, Rattus norvegicus
gattggcctatcgattctgggaacc

SEQ ID NO: 373574 - DNA, 25 bp, Rattus norvegicus
gattggcctatgaagccttttcctg

SEQ ID NO: 373575 - DNA, 25 bp, Rattus norvegicus
gattggcctatgtagccttttcctg

SEQ ID NO: 373576 - DNA, 25 bp, Rattus norvegicus
gattggcctctgacagagcgtccca

SEQ ID NO: 373577 - DNA, 25 bp, Rattus norvegicus
gattggcctctgtcagagcgtccca

SEQ ID NO: 373578 - DNA, 25 bp, Rattus norvegicus
gattggcctgacagcatgtctgcag

SEQ ID NO: 373579 - DNA, 25 bp, Rattus norvegicus
gattggcctgactgcatgtctgcag

SEQ ID NO: 373580 - DNA, 25 bp, Rattus norvegicus
gattggccttaactgagctaaaaca

SEQ ID NO: 373581 - DNA, 25 bp, Rattus norvegicus
gattggccttaagtgagctaaaaca

SEQ ID NO: 373582 - DNA, 25 bp, Rattus norvegicus
gattggcctttaagattgtcgaagc

SEQ ID NO: 373583 - DNA, 25 bp, Rattus norvegicus
gattggcctttatgattgtcgaagc

SEQ ID NO: 373584 - DNA, 25 bp, Rattus norvegicus
gattggcgaggtcatcctggacaat

SEQ ID NO: 373585 - DNA, 25 bp, Rattus norvegicus
gattggcgaggtgatcctggacaat

SEQ ID NO: 373586 - DNA, 25 bp, Rattus norvegicus
gattggcgcctcaggaccacactgt

SEQ ID NO: 373587 - DNA, 25 bp, Rattus norvegicus
gattggcgcctctggaccacactgt

SEQ ID NO: 373588 - DNA, 25 bp, Rattus norvegicus
gattggcggcctctaatgattgacg

SEQ ID NO: 373589 - DNA, 25 bp, Rattus norvegicus
gattggcggcctgtaatgattgacg

SEQ ID NO: 373590 - DNA, 25 bp, Rattus norvegicus
gattggctaacacagagctcagtct

SEQ ID NO: 373591 - DNA, 25 bp, Rattus norvegicus
gattggctaacagagagctcagtct

SEQ ID NO: 373592 - DNA, 25 bp, Rattus norvegicus
gattggctagagacttcttaagtat

SEQ ID NO: 373593 - DNA, 25 bp, Rattus norvegicus
gattggctagagtcttcttaagtat

SEQ ID NO: 373594 - DNA, 25 bp, Rattus norvegicus
gattggctcatgaaaacttgtgtat

SEQ ID NO: 373595 - DNA, 25 bp, Rattus norvegicus
gattggctcatgtaaacttgtgtat

SEQ ID NO: 373596 - DNA, 25 bp, Rattus norvegicus
gattggctcattaagtcatagagtt

SEQ ID NO: 373597 - DNA, 25 bp, Rattus norvegicus
gattggctcatttagtcatagagtt

SEQ ID NO: 373598 - DNA, 25 bp, Rattus norvegicus
gattggctcgtaaacctataggaaa

SEQ ID NO: 373599 - DNA, 25 bp, Rattus norvegicus
gattggctcgtatacctataggaaa

SEQ ID NO: 373600 - DNA, 25 bp, Rattus norvegicus
gattggctgaacagtgtgtgcattg

SEQ ID NO: 373601 - DNA, 25 bp, Rattus norvegicus
gattggctgaactgtgtgtgcattg

SEQ ID NO: 373602 - DNA, 25 bp, Rattus norvegicus
gattggctgatacttcttggttaca

SEQ ID NO: 373603 - DNA, 25 bp, Rattus norvegicus
gattggctgatagttcttggttaca

SEQ ID NO: 373604 - DNA, 25 bp, Rattus norvegicus
gattggctggccattattgaacccc

SEQ ID NO: 373605 - DNA, 25 bp, Rattus norvegicus
gattggctggcctttattgaacccc

SEQ ID NO: 373606 - DNA, 25 bp, Rattus norvegicus
gattggctgtctaatcagctccgga

SEQ ID NO: 373607 - DNA, 25 bp, Rattus norvegicus
gattggctgtcttatcagctccgga

SEQ ID NO: 373608 - DNA, 25 bp, Rattus norvegicus
gattggctgtgtagctcaggctgac

SEQ ID NO: 373609 - DNA, 25 bp, Rattus norvegicus
gattggctgtgtattgtgtcttaac

SEQ ID NO: 373610 - DNA, 25 bp, Rattus norvegicus
gattggctgtgttgctcaggctgac

SEQ ID NO: 373611 - DNA, 25 bp, Rattus norvegicus
gattggctgtgttttgtgtcttaac

SEQ ID NO: 373612 - DNA, 25 bp, Rattus norvegicus
gattggcttatcagaaataggcaaa

SEQ ID NO: 373613 - DNA, 25 bp, Rattus norvegicus
gattggcttatctgaaataggcaaa

SEQ ID NO: 373614 - DNA, 25 bp, Rattus norvegicus
gattggcttgtcctttaaacctcag

SEQ ID NO: 373615 - DNA, 25 bp, Rattus norvegicus
gattggcttgtcgtttaaacctcag

SEQ ID NO: 373616 - DNA, 25 bp, Rattus norvegicus
gattggctttatcgtttgtggagtt

SEQ ID NO: 373617 - DNA, 25 bp, Rattus norvegicus
gattggctttatggtttgtggagtt

SEQ ID NO: 373618 - DNA, 25 bp, Rattus norvegicus
gattggctttgaaattgagacaaca

SEQ ID NO: 373619 - DNA, 25 bp, Rattus norvegicus
gattggctttgatattgagacaaca

SEQ ID NO: 373620 - DNA, 25 bp, Rattus norvegicus
gattggctttgcagtaactaccttg

SEQ ID NO: 373621 - DNA, 25 bp, Rattus norvegicus
gattggctttgctgtaactaccttg

SEQ ID NO: 373622 - DNA, 25 bp, Rattus norvegicus
gattgggaagcccttcagtacactc

SEQ ID NO: 373623 - DNA, 25 bp, Rattus norvegicus
gattgggaagccgttcagtacactc

SEQ ID NO: 373624 - DNA, 25 bp, Rattus norvegicus
gattgggacagccattccttctctg

SEQ ID NO: 373625 - DNA, 25 bp, Rattus norvegicus
gattgggacagcgattccttctctg

SEQ ID NO: 373626 - DNA, 25 bp, Rattus norvegicus
gattgggaggacattgatcacgatg

SEQ ID NO: 373627 - DNA, 25 bp, Rattus norvegicus
gattgggaggactttgatcacgatg

SEQ ID NO: 373628 - DNA, 25 bp, Rattus norvegicus
gattgggatgacactgcactgacta

SEQ ID NO: 373629 - DNA, 25 bp, Rattus norvegicus
gattgggatgactctgcactgacta

SEQ ID NO: 373630 - DNA, 25 bp, Rattus norvegicus
gattgggattgaacctctatgcctg

SEQ ID NO: 373631 - DNA, 25 bp, Rattus norvegicus
gattgggattgatcctctatgcctg

SEQ ID NO: 373632 - DNA, 25 bp, Rattus norvegicus
gattgggatttcaccacggctgaag

SEQ ID NO: 373633 - DNA, 25 bp, Rattus norvegicus
gattgggatttctccacggctgaag

SEQ ID NO: 373634 - DNA, 25 bp, Rattus norvegicus
gattgggcaattccttgtgattttt

SEQ ID NO: 373635 - DNA, 25 bp, Rattus norvegicus
gattgggcaattgcttgtgattttt

SEQ ID NO: 373636 - DNA, 25 bp, Rattus norvegicus
gattgggccaatatctagcaacaac

SEQ ID NO: 373637 - DNA, 25 bp, Rattus norvegicus
gattgggccaatttctagcaacaac

SEQ ID NO: 373638 - DNA, 25 bp, Rattus norvegicus
gattgggcgtacaaaatgctctttt

SEQ ID NO: 373639 - DNA, 25 bp, Rattus norvegicus
gattgggcgtactaaatgctctttt

SEQ ID NO: 373640 - DNA, 25 bp, Rattus norvegicus
gattgggctcacagatcagggcaca

SEQ ID NO: 373641 - DNA, 25 bp, Rattus norvegicus
gattgggctcactgatcagggcaca

SEQ ID NO: 373642 - DNA, 25 bp, Rattus norvegicus
gattgggtcagacatggtcagtttt

SEQ ID NO: 373643 - DNA, 25 bp, Rattus norvegicus
gattgggtcagagatggtcagtttt

SEQ ID NO: 373644 - DNA, 25 bp, Rattus norvegicus
gattgggtgttcattctttgtcttt

SEQ ID NO: 373645 - DNA, 25 bp, Rattus norvegicus
gattgggtgttctttctttgtcttt

SEQ ID NO: 373646 - DNA, 25 bp, Rattus norvegicus
gattgggttcggatctgaaaggtca

SEQ ID NO: 373647 - DNA, 25 bp, Rattus norvegicus
gattgggttcggttctgaaaggtca

SEQ ID NO: 373648 - DNA, 25 bp, Rattus norvegicus
gattgggttctgatatgtttctatt

SEQ ID NO: 373649 - DNA, 25 bp, Rattus norvegicus
gattgggttctgctttcctatgact

SEQ ID NO: 373650 - DNA, 25 bp, Rattus norvegicus
gattgggttctggtttcctatgact

SEQ ID NO: 373651 - DNA, 25 bp, Rattus norvegicus
gattgggttctgttatgtttctatt

SEQ ID NO: 373652 - DNA, 25 bp, Rattus norvegicus
gattgggttgcaaagtcatagtaca

SEQ ID NO: 373653 - DNA, 25 bp, Rattus norvegicus
gattgggttgcatagtcatagtaca

SEQ ID NO: 373654 - DNA, 25 bp, Rattus norvegicus
gattgggttggtccctatcctcaaa

SEQ ID NO: 373655 - DNA, 25 bp, Rattus norvegicus
gattgggttggtgcctatcctcaaa

SEQ ID NO: 373656 - DNA, 25 bp, Rattus norvegicus
gattggtaacttccagttggcccta

SEQ ID NO: 373657 - DNA, 25 bp, Rattus norvegicus
gattggtaacttgcagttggcccta

SEQ ID NO: 373658 - DNA, 25 bp, Rattus norvegicus
gattggtaataaccccacgctccgg

SEQ ID NO: 373659 - DNA, 25 bp, Rattus norvegicus
gattggtaataagcccacgctccgg

SEQ ID NO: 373660 - DNA, 25 bp, Rattus norvegicus
gattggtaatatattttcagcctaa

SEQ ID NO: 373661 - DNA, 25 bp, Rattus norvegicus
gattggtaatattttttcagcctaa

SEQ ID NO: 373662 - DNA, 25 bp, Rattus norvegicus
gattggtatttgacttttcttatta

SEQ ID NO: 373663 - DNA, 25 bp, Rattus norvegicus
gattggtatttgtcttttcttatta

SEQ ID NO: 373664 - DNA, 25 bp, Rattus norvegicus
gattggtcaaggctacctcatcaag

SEQ ID NO: 373665 - DNA, 25 bp, Rattus norvegicus
gattggtcaagggtacctcatcaag

SEQ ID NO: 373666 - DNA, 25 bp, Rattus norvegicus
gattggtcaccacgatgtctctgtc

SEQ ID NO: 373667 - DNA, 25 bp, Rattus norvegicus
gattggtcaccaggatgtctctgtc

SEQ ID NO: 373668 - DNA, 25 bp, Rattus norvegicus
gattggtcacgtatacagcttattg

SEQ ID NO: 373669 - DNA, 25 bp, Rattus norvegicus
gattggtcacgtttacagcttattg

SEQ ID NO: 373670 - DNA, 25 bp, Rattus norvegicus
gattggtccactatgttgtgttgtt

SEQ ID NO: 373671 - DNA, 25 bp, Rattus norvegicus
gattggtccactttgttgtgttgtt

SEQ ID NO: 373672 - DNA, 25 bp, Rattus norvegicus
gattggtcccaaatgtatgtacagc

SEQ ID NO: 373673 - DNA, 25 bp, Rattus norvegicus
gattggtcccaattgtatgtacagc

SEQ ID NO: 373674 - DNA, 25 bp, Rattus norvegicus
gattggtccccgagttcaaaactag

SEQ ID NO: 373675 - DNA, 25 bp, Rattus norvegicus
gattggtccccgtgttcaaaactag

SEQ ID NO: 373676 - DNA, 25 bp, Rattus norvegicus
gattggtcctagcagactttacaga

SEQ ID NO: 373677 - DNA, 25 bp, Rattus norvegicus
gattggtcctaggagactttacaga

SEQ ID NO: 373678 - DNA, 25 bp, Rattus norvegicus
gattggtcggagaagcttttccttt

SEQ ID NO: 373679 - DNA, 25 bp, Rattus norvegicus
gattggtcggagtagcttttccttt

SEQ ID NO: 373680 - DNA, 25 bp, Rattus norvegicus
gattggtgatgtacagccttgcttc

SEQ ID NO: 373681 - DNA, 25 bp, Rattus norvegicus
gattggtgatgttcagccttgcttc

SEQ ID NO: 373682 - DNA, 25 bp, Rattus norvegicus
gattggtgctgtctgactcatgact

SEQ ID NO: 373683 - DNA, 25 bp, Rattus norvegicus
gattggtgctgtgtgactcatgact

SEQ ID NO: 373684 - DNA, 25 bp, Rattus norvegicus
gattggtggctcaatcctggcctca

SEQ ID NO: 373685 - DNA, 25 bp, Rattus norvegicus
gattggtggctctatcctggcctca

SEQ ID NO: 373686 - DNA, 25 bp, Rattus norvegicus
gattggtgtatcacagagtagctca

SEQ ID NO: 373687 - DNA, 25 bp, Rattus norvegicus
gattggtgtatctcagagtagctca

SEQ ID NO: 373688 - DNA, 25 bp, Rattus norvegicus
gattggttaattcactagggaccta

SEQ ID NO: 373689 - DNA, 25 bp, Rattus norvegicus
gattggttaattgactagggaccta

SEQ ID NO: 373690 - DNA, 25 bp, Rattus norvegicus
gattggttattcacacaccgtggga

SEQ ID NO: 373691 - DNA, 25 bp, Rattus norvegicus
gattggttattctcacaccgtggga

SEQ ID NO: 373692 - DNA, 25 bp, Rattus norvegicus
gattggttattgattctctaatggt

SEQ ID NO: 373693 - DNA, 25 bp, Rattus norvegicus
gattggttattgtttctctaatggt

SEQ ID NO: 373694 - DNA, 25 bp, Rattus norvegicus
gattggttccggatgagaagatctc

SEQ ID NO: 373695 - DNA, 25 bp, Rattus norvegicus
gattggttccggttgagaagatctc

SEQ ID NO: 373696 - DNA, 25 bp, Rattus norvegicus
gattggttggatattcaggcccgtt

SEQ ID NO: 373697 - DNA, 25 bp, Rattus norvegicus
gattggttggattttcaggcccgtt

SEQ ID NO: 373698 - DNA, 25 bp, Rattus norvegicus
gattggttggttaccagacccagct

SEQ ID NO: 373699 - DNA, 25 bp, Rattus norvegicus
gattggttggttaggtagcttgtat

SEQ ID NO: 373700 - DNA, 25 bp, Rattus norvegicus
gattggttggtttccagacccagct

SEQ ID NO: 373701 - DNA, 25 bp, Rattus norvegicus
gattggttggtttggtagcttgtat

SEQ ID NO: 373702 - DNA, 25 bp, Rattus norvegicus
gattggtttaacaaaggcttagcca

SEQ ID NO: 373703 - DNA, 25 bp, Rattus norvegicus
gattggtttaactaaggcttagcca

SEQ ID NO: 373704 - DNA, 25 bp, Rattus norvegicus
gattggtttcgacagctttggctga

SEQ ID NO: 373705 - DNA, 25 bp, Rattus norvegicus
gattggtttcgagagctttggctga

SEQ ID NO: 373706 - DNA, 25 bp, Rattus norvegicus
gattggtttgtcctaactgggtcca

SEQ ID NO: 373707 - DNA, 25 bp, Rattus norvegicus
gattggtttgtcgtaactgggtcca

SEQ ID NO: 373708 - DNA, 25 bp, Rattus norvegicus
gattggttttatctcactttcatct

SEQ ID NO: 373709 - DNA, 25 bp, Rattus norvegicus
gattggttttatgtcactttcatct

SEQ ID NO: 373710 - DNA, 25 bp, Rattus norvegicus
gattggtttttactgttgcccttgc

SEQ ID NO: 373711 - DNA, 25 bp, Rattus norvegicus
gattggtttttagtgttgcccttgc

SEQ ID NO: 373712 - DNA, 25 bp, Rattus norvegicus
gattgtaaagtgctgtgctgtgtta

SEQ ID NO: 373713 - DNA, 25 bp, Rattus norvegicus
gattgtaaagtggtgtgctgtgtta

SEQ ID NO: 373714 - DNA, 25 bp, Rattus norvegicus
gattgtaaagttcagcccgtggaaa

SEQ ID NO: 373715 - DNA, 25 bp, Rattus norvegicus
gattgtaaagttgagcccgtggaaa

SEQ ID NO: 373716 - DNA, 25 bp, Rattus norvegicus
gattgtaacatcacacgtactgtat

SEQ ID NO: 373717 - DNA, 25 bp, Rattus norvegicus
gattgtaacatctcacgtactgtat

SEQ ID NO: 373718 - DNA, 25 bp, Rattus norvegicus
gattgtaacgcactaaccatgtggt

SEQ ID NO: 373719 - DNA, 25 bp, Rattus norvegicus
gattgtaacgcagtaaccatgtggt

SEQ ID NO: 373720 - DNA, 25 bp, Rattus norvegicus
gattgtaagcgcctacatcctttgc

SEQ ID NO: 373721 - DNA, 25 bp, Rattus norvegicus
gattgtaagcgcgtacatcctttgc

SEQ ID NO: 373722 - DNA, 25 bp, Rattus norvegicus
gattgtaagtcgagagcctgtttta

SEQ ID NO: 373723 - DNA, 25 bp, Rattus norvegicus
gattgtaagtcgtgagcctgtttta

SEQ ID NO: 373724 - DNA, 25 bp, Rattus norvegicus
gattgtaatgtcagctgtgaatggc

SEQ ID NO: 373725 - DNA, 25 bp, Rattus norvegicus
gattgtaatgtctgctgtgaatggc

SEQ ID NO: 373726 - DNA, 25 bp, Rattus norvegicus
gattgtacacatcttaccttactga

SEQ ID NO: 373727 - DNA, 25 bp, Rattus norvegicus
gattgtacacatgttaccttactga

SEQ ID NO: 373728 - DNA, 25 bp, Rattus norvegicus
gattgtacaccacgtacatgtgagt

SEQ ID NO: 373729 - DNA, 25 bp, Rattus norvegicus
gattgtacaccaggtacatgtgagt

SEQ ID NO: 373730 - DNA, 25 bp, Rattus norvegicus
gattgtacagcgacactcttcttta

SEQ ID NO: 373731 - DNA, 25 bp, Rattus norvegicus
gattgtacagcgtcactcttcttta

SEQ ID NO: 373732 - DNA, 25 bp, Rattus norvegicus
gattgtacaggaacaggatggtaat

SEQ ID NO: 373733 - DNA, 25 bp, Rattus norvegicus
gattgtacaggatcaggatggtaat

SEQ ID NO: 373734 - DNA, 25 bp, Rattus norvegicus
gattgtaccaaaagccgagtcgctt

SEQ ID NO: 373735 - DNA, 25 bp, Rattus norvegicus
gattgtaccaaatgccgagtcgctt

SEQ ID NO: 373736 - DNA, 25 bp, Rattus norvegicus
gattgtactactatttgattccatt

SEQ ID NO: 373737 - DNA, 25 bp, Rattus norvegicus
gattgtactactttttgattccatt

SEQ ID NO: 373738 - DNA, 25 bp, Rattus norvegicus
gattgtagagaacggcaaccgcaca

SEQ ID NO: 373739 - DNA, 25 bp, Rattus norvegicus
gattgtagagaagggcaaccgcaca

SEQ ID NO: 373740 - DNA, 25 bp, Rattus norvegicus
gattgtagcacaaccctgagtctgt

SEQ ID NO: 373741 - DNA, 25 bp, Rattus norvegicus
gattgtagcacatccctgagtctgt

SEQ ID NO: 373742 - DNA, 25 bp, Rattus norvegicus
gattgtagggaacctccagttatta

SEQ ID NO: 373743 - DNA, 25 bp, Rattus norvegicus
gattgtagggaagctccagttatta

SEQ ID NO: 373744 - DNA, 25 bp, Rattus norvegicus
gattgtaggtctcttttgtatataa

SEQ ID NO: 373745 - DNA, 25 bp, Rattus norvegicus
gattgtaggtctgttttgtatataa

SEQ ID NO: 373746 - DNA, 25 bp, Rattus norvegicus
gattgtagtctactgtactttcaaa

SEQ ID NO: 373747 - DNA, 25 bp, Rattus norvegicus
gattgtagtctagtgtactttcaaa

SEQ ID NO: 373748 - DNA, 25 bp, Rattus norvegicus
gattgtagtgatacgaacactcaaa

SEQ ID NO: 373749 - DNA, 25 bp, Rattus norvegicus
gattgtagtgattcgaacactcaaa

SEQ ID NO: 373750 - DNA, 25 bp, Rattus norvegicus
gattgtatagttatgttgcctggac

SEQ ID NO: 373751 - DNA, 25 bp, Rattus norvegicus
gattgtatagttttgttgcctggac

SEQ ID NO: 373752 - DNA, 25 bp, Rattus norvegicus
gattgtatatgtcccgataccgcca

SEQ ID NO: 373753 - DNA, 25 bp, Rattus norvegicus
gattgtatatgtgccgataccgcca

SEQ ID NO: 373754 - DNA, 25 bp, Rattus norvegicus
gattgtatcctcaggaaccgtgagc

SEQ ID NO: 373755 - DNA, 25 bp, Rattus norvegicus
gattgtatcctctggaaccgtgagc

SEQ ID NO: 373756 - DNA, 25 bp, Rattus norvegicus
gattgtatctcgacattcctgtgat

SEQ ID NO: 373757 - DNA, 25 bp, Rattus norvegicus
gattgtatctcgtcattcctgtgat

SEQ ID NO: 373758 - DNA, 25 bp, Rattus norvegicus
gattgtatctgcaacaccatctgaa

SEQ ID NO: 373759 - DNA, 25 bp, Rattus norvegicus
gattgtatctgctacaccatctgaa

SEQ ID NO: 373760 - DNA, 25 bp, Rattus norvegicus
gattgtatctggcaaccttcggatc

SEQ ID NO: 373761 - DNA, 25 bp, Rattus norvegicus
gattgtatctgggaaccttcggatc

SEQ ID NO: 373762 - DNA, 25 bp, Rattus norvegicus
gattgtatgaggctcttcaccaaag

SEQ ID NO: 373763 - DNA, 25 bp, Rattus norvegicus
gattgtatgagggtcttcaccaaag

SEQ ID NO: 373764 - DNA, 25 bp, Rattus norvegicus
gattgtatgatcagggtacacaagt

SEQ ID NO: 373765 - DNA, 25 bp, Rattus norvegicus
gattgtatgatctgggtacacaagt

SEQ ID NO: 373766 - DNA, 25 bp, Rattus norvegicus
gattgtatgtctactgtgctgcatt

SEQ ID NO: 373767 - DNA, 25 bp, Rattus norvegicus
gattgtatgtcttctgtgctgcatt

SEQ ID NO: 373768 - DNA, 25 bp, Rattus norvegicus
gattgtatgtgaactgggtgtggtg

SEQ ID NO: 373769 - DNA, 25 bp, Rattus norvegicus
gattgtatgtgatctgggtgtggtg

SEQ ID NO: 373770 - DNA, 25 bp, Rattus norvegicus
gattgtattaatattctgcagggaa

SEQ ID NO: 373771 - DNA, 25 bp, Rattus norvegicus
gattgtattaattttctgcagggaa

SEQ ID NO: 373772 - DNA, 25 bp, Rattus norvegicus
gattgtattctcacaatctgagcca

SEQ ID NO: 373773 - DNA, 25 bp, Rattus norvegicus
gattgtattctctcaatctgagcca

SEQ ID NO: 373774 - DNA, 25 bp, Rattus norvegicus
gattgtattcttattctaacttgtt

SEQ ID NO: 373775 - DNA, 25 bp, Rattus norvegicus
gattgtattctttttctaacttgtt

SEQ ID NO: 373776 - DNA, 25 bp, Rattus norvegicus
gattgtatttgacggctaaccaata

SEQ ID NO: 373777 - DNA, 25 bp, Rattus norvegicus
gattgtatttgagggctaaccaata

SEQ ID NO: 373778 - DNA, 25 bp, Rattus norvegicus
gattgtcaagctatacatcacacca

SEQ ID NO: 373779 - DNA, 25 bp, Rattus norvegicus
gattgtcaagctttacatcacacca

SEQ ID NO: 373780 - DNA, 25 bp, Rattus norvegicus
gattgtcaagttctatgaggcctac

SEQ ID NO: 373781 - DNA, 25 bp, Rattus norvegicus
gattgtcaagttgtatgaggcctac

SEQ ID NO: 373782 - DNA, 25 bp, Rattus norvegicus
gattgtcacagaccacgtgcagcta

SEQ ID NO: 373783 - DNA, 25 bp, Rattus norvegicus
gattgtcacagagcacgtgcagcta

SEQ ID NO: 373784 - DNA, 25 bp, Rattus norvegicus
gattgtcacaggatccagagttatg

SEQ ID NO: 373785 - DNA, 25 bp, Rattus norvegicus
gattgtcacaggttccagagttatg

SEQ ID NO: 373786 - DNA, 25 bp, Rattus norvegicus
gattgtcaccatcctctggaacgag

SEQ ID NO: 373787 - DNA, 25 bp, Rattus norvegicus
gattgtcaccatgctctggaacgag

SEQ ID NO: 373788 - DNA, 25 bp, Rattus norvegicus
gattgtcaccctaaaggagctccgg

SEQ ID NO: 373789 - DNA, 25 bp, Rattus norvegicus
gattgtcacccttaaggagctccgg

SEQ ID NO: 373790 - DNA, 25 bp, Rattus norvegicus
gattgtcacgttccccctaaccagt

SEQ ID NO: 373791 - DNA, 25 bp, Rattus norvegicus
gattgtcacgttgcccctaaccagt

SEQ ID NO: 373792 - DNA, 25 bp, Rattus norvegicus
gattgtcactcacaggctgcaactg

SEQ ID NO: 373793 - DNA, 25 bp, Rattus norvegicus
gattgtcactcagaggctgcaactg

SEQ ID NO: 373794 - DNA, 25 bp, Rattus norvegicus
gattgtcagaaacactgcggtgcct

SEQ ID NO: 373795 - DNA, 25 bp, Rattus norvegicus
gattgtcagaaagactgcggtgcct

SEQ ID NO: 373796 - DNA, 25 bp, Rattus norvegicus
gattgtcagaagcttcagctctggt

SEQ ID NO: 373797 - DNA, 25 bp, Rattus norvegicus
gattgtcagaaggttcagctctggt

SEQ ID NO: 373798 - DNA, 25 bp, Rattus norvegicus
gattgtcagagtaaacctgcgttaa

SEQ ID NO: 373799 - DNA, 25 bp, Rattus norvegicus
gattgtcagagttaacctgcgttaa

SEQ ID NO: 373800 - DNA, 25 bp, Rattus norvegicus
gattgtcagatcattgaggctcatt

SEQ ID NO: 373801 - DNA, 25 bp, Rattus norvegicus
gattgtcagatctttgaggctcatt

SEQ ID NO: 373802 - DNA, 25 bp, Rattus norvegicus
gattgtcaggtacactgcagtcccc

SEQ ID NO: 373803 - DNA, 25 bp, Rattus norvegicus
gattgtcaggtagactgcagtcccc

SEQ ID NO: 373804 - DNA, 25 bp, Rattus norvegicus
gattgtcagttccatttgtgtcaaa

SEQ ID NO: 373805 - DNA, 25 bp, Rattus norvegicus
gattgtcagttcgatttgtgtcaaa

SEQ ID NO: 373806 - DNA, 25 bp, Rattus norvegicus
gattgtcataatcttccatctttgg

SEQ ID NO: 373807 - DNA, 25 bp, Rattus norvegicus
gattgtcataatgttccatctttgg

SEQ ID NO: 373808 - DNA, 25 bp, Rattus norvegicus
gattgtcatagacgaacgccccagc

SEQ ID NO: 373809 - DNA, 25 bp, Rattus norvegicus
gattgtcatagaggaacgccccagc

SEQ ID NO: 373810 - DNA, 25 bp, Rattus norvegicus
gattgtcatcccagtttggtgaaca

SEQ ID NO: 373811 - DNA, 25 bp, Rattus norvegicus
gattgtcatccctgtttggtgaaca

SEQ ID NO: 373812 - DNA, 25 bp, Rattus norvegicus
gattgtcatcttactttggtctgtt

SEQ ID NO: 373813 - DNA, 25 bp, Rattus norvegicus
gattgtcatctttctttggtctgtt

SEQ ID NO: 373814 - DNA, 25 bp, Rattus norvegicus
gattgtcatggcaaacatttggtac

SEQ ID NO: 373815 - DNA, 25 bp, Rattus norvegicus
gattgtcatggctaacatttggtac

SEQ ID NO: 373816 - DNA, 25 bp, Rattus norvegicus
gattgtcatgtaaaatttgccacgg

SEQ ID NO: 373817 - DNA, 25 bp, Rattus norvegicus
gattgtcatgtataatttgccacgg

SEQ ID NO: 373818 - DNA, 25 bp, Rattus norvegicus
gattgtcattacatccattctgggc

SEQ ID NO: 373819 - DNA, 25 bp, Rattus norvegicus
gattgtcattacttccattctgggc

SEQ ID NO: 373820 - DNA, 25 bp, Rattus norvegicus
gattgtcattcacaacccatgtgag

SEQ ID NO: 373821 - DNA, 25 bp, Rattus norvegicus
gattgtcattcacctgatgaacatt

SEQ ID NO: 373822 - DNA, 25 bp, Rattus norvegicus
gattgtcattcagaacccatgtgag

SEQ ID NO: 373823 - DNA, 25 bp, Rattus norvegicus
gattgtcattcagctgatgaacatt

SEQ ID NO: 373824 - DNA, 25 bp, Rattus norvegicus
gattgtcattgtccatcgatgtcct

SEQ ID NO: 373825 - DNA, 25 bp, Rattus norvegicus
gattgtcattgtgcatcgatgtcct

SEQ ID NO: 373826 - DNA, 25 bp, Rattus norvegicus
gattgtccaagtcatccggaaccct

SEQ ID NO: 373827 - DNA, 25 bp, Rattus norvegicus
gattgtccaagtgatccggaaccct

SEQ ID NO: 373828 - DNA, 25 bp, Rattus norvegicus
gattgtccaattcaggaagcaggaa

SEQ ID NO: 373829 - DNA, 25 bp, Rattus norvegicus
gattgtccaattgaggaagcaggaa

SEQ ID NO: 373830 - DNA, 25 bp, Rattus norvegicus
gattgtccagccatctgaattagct

SEQ ID NO: 373831 - DNA, 25 bp, Rattus norvegicus
gattgtccagccttctgaattagct

SEQ ID NO: 373832 - DNA, 25 bp, Rattus norvegicus
gattgtccagtgatccattaattct

SEQ ID NO: 373833 - DNA, 25 bp, Rattus norvegicus
gattgtccagtgttccattaattct

SEQ ID NO: 373834 - DNA, 25 bp, Rattus norvegicus
gattgtcccacaacaaataagagat

SEQ ID NO: 373835 - DNA, 25 bp, Rattus norvegicus
gattgtcccacatcaaataagagat

SEQ ID NO: 373836 - DNA, 25 bp, Rattus norvegicus
gattgtccctagattttaaacactg

SEQ ID NO: 373837 - DNA, 25 bp, Rattus norvegicus
gattgtccctagtttttaaacactg

SEQ ID NO: 373838 - DNA, 25 bp, Rattus norvegicus
gattgtcctaaacaattctgctctg

SEQ ID NO: 373839 - DNA, 25 bp, Rattus norvegicus
gattgtcctaaagaattctgctctg

SEQ ID NO: 373840 - DNA, 25 bp, Rattus norvegicus
gattgtcctacaacattagaacact

SEQ ID NO: 373841 - DNA, 25 bp, Rattus norvegicus
gattgtcctacatcattagaacact

SEQ ID NO: 373842 - DNA, 25 bp, Rattus norvegicus
gattgtcctctcaggagttcaacac

SEQ ID NO: 373843 - DNA, 25 bp, Rattus norvegicus
gattgtcctctctggagttcaacac

SEQ ID NO: 373844 - DNA, 25 bp, Rattus norvegicus
gattgtcctttgatattgtccacag

SEQ ID NO: 373845 - DNA, 25 bp, Rattus norvegicus
gattgtcctttgttattgtccacag

SEQ ID NO: 373846 - DNA, 25 bp, Rattus norvegicus
gattgtcgcaatagactgtccatat

SEQ ID NO: 373847 - DNA, 25 bp, Rattus norvegicus
gattgtcgcaattgactgtccatat

SEQ ID NO: 373848 - DNA, 25 bp, Rattus norvegicus
gattgtcgtgtaaagagccatctcc

SEQ ID NO: 373849 - DNA, 25 bp, Rattus norvegicus
gattgtcgtgtatagagccatctcc

SEQ ID NO: 373850 - DNA, 25 bp, Rattus norvegicus
gattgtctaattctatggctagcaa

SEQ ID NO: 373851 - DNA, 25 bp, Rattus norvegicus
gattgtctaattgtatggctagcaa

SEQ ID NO: 373852 - DNA, 25 bp, Rattus norvegicus
gattgtctaccactcgcaggagcat

SEQ ID NO: 373853 - DNA, 25 bp, Rattus norvegicus
gattgtctaccagtcgcaggagcat

SEQ ID NO: 373854 - DNA, 25 bp, Rattus norvegicus
gattgtctacgtcctatgctgggca

SEQ ID NO: 373855 - DNA, 25 bp, Rattus norvegicus
gattgtctacgtgctatgctgggca

SEQ ID NO: 373856 - DNA, 25 bp, Rattus norvegicus
gattgtctataaacagccctgccaa

SEQ ID NO: 373857 - DNA, 25 bp, Rattus norvegicus
gattgtctataatcagccctgccaa

SEQ ID NO: 373858 - DNA, 25 bp, Rattus norvegicus
gattgtctctatatccaggaagcct

SEQ ID NO: 373859 - DNA, 25 bp, Rattus norvegicus
gattgtctctatttccaggaagcct

SEQ ID NO: 373860 - DNA, 25 bp, Rattus norvegicus
gattgtctcttgaactgcactgact

SEQ ID NO: 373861 - DNA, 25 bp, Rattus norvegicus
gattgtctcttgtactgcactgact

SEQ ID NO: 373862 - DNA, 25 bp, Rattus norvegicus
gattgtctgacaattctaaggtcaa

SEQ ID NO: 373863 - DNA, 25 bp, Rattus norvegicus
gattgtctgacatttctaaggtcaa

SEQ ID NO: 373864 - DNA, 25 bp, Rattus norvegicus
gattgtctgagtcggtacactggtc

SEQ ID NO: 373865 - DNA, 25 bp, Rattus norvegicus
gattgtctgagtgggtacactggtc

SEQ ID NO: 373866 - DNA, 25 bp, Rattus norvegicus
gattgtctgcccaaagaagattttt

SEQ ID NO: 373867 - DNA, 25 bp, Rattus norvegicus
gattgtctgccctaagaagattttt

SEQ ID NO: 373868 - DNA, 25 bp, Rattus norvegicus
gattgtctggcaacatttgctctcc

SEQ ID NO: 373869 - DNA, 25 bp, Rattus norvegicus
gattgtctggcatcatttgctctcc

SEQ ID NO: 373870 - DNA, 25 bp, Rattus norvegicus
gattgtctggccaccagggtgccaa

SEQ ID NO: 373871 - DNA, 25 bp, Rattus norvegicus
gattgtctggcctccagggtgccaa

SEQ ID NO: 373872 - DNA, 25 bp, Rattus norvegicus
gattgtcttacactacgataccctt

SEQ ID NO: 373873 - DNA, 25 bp, Rattus norvegicus
gattgtcttacagtacgataccctt

SEQ ID NO: 373874 - DNA, 25 bp, Rattus norvegicus
gattgtcttatgctttcctcattta

SEQ ID NO: 373875 - DNA, 25 bp, Rattus norvegicus
gattgtcttatggtttcctcattta

SEQ ID NO: 373876 - DNA, 25 bp, Rattus norvegicus
gattgtcttcagattttcacggatg

SEQ ID NO: 373877 - DNA, 25 bp, Rattus norvegicus
gattgtcttcagtttttcacggatg

SEQ ID NO: 373878 - DNA, 25 bp, Rattus norvegicus
gattgtcttcctcagtgtttacttg

SEQ ID NO: 373879 - DNA, 25 bp, Rattus norvegicus
gattgtcttcctgagtgtttacttg

SEQ ID NO: 373880 - DNA, 25 bp, Rattus norvegicus
gattgtcttcttcggtctccggaac

SEQ ID NO: 373881 - DNA, 25 bp, Rattus norvegicus
gattgtcttcttgggtctccggaac

SEQ ID NO: 373882 - DNA, 25 bp, Rattus norvegicus
gattgtcttgttcgaaaattctcag

SEQ ID NO: 373883 - DNA, 25 bp, Rattus norvegicus
gattgtcttgttggaaaattctcag

SEQ ID NO: 373884 - DNA, 25 bp, Rattus norvegicus
gattgtctttgaatttgtggcttcc

SEQ ID NO: 373885 - DNA, 25 bp, Rattus norvegicus
gattgtctttgattttgtggcttcc

SEQ ID NO: 373886 - DNA, 25 bp, Rattus norvegicus
gattgtgaaaccacgacttttgtaa

SEQ ID NO: 373887 - DNA, 25 bp, Rattus norvegicus
gattgtgaaacctcgacttttgtaa

SEQ ID NO: 373888 - DNA, 25 bp, Rattus norvegicus
gattgtgaaactattgggaacctgt

SEQ ID NO: 373889 - DNA, 25 bp, Rattus norvegicus
gattgtgaaacttttgggaacctgt

SEQ ID NO: 373890 - DNA, 25 bp, Rattus norvegicus
gattgtgaagctaccttgaggtgcc

SEQ ID NO: 373891 - DNA, 25 bp, Rattus norvegicus
gattgtgaagcttccttgaggtgcc

SEQ ID NO: 373892 - DNA, 25 bp, Rattus norvegicus
gattgtgactatatttgcctttggg

SEQ ID NO: 373893 - DNA, 25 bp, Rattus norvegicus
gattgtgactatttttgcctttggg

SEQ ID NO: 373894 - DNA, 25 bp, Rattus norvegicus
gattgtgactgccattccagacgac

SEQ ID NO: 373895 - DNA, 25 bp, Rattus norvegicus
gattgtgactgcgattccagacgac

SEQ ID NO: 373896 - DNA, 25 bp, Rattus norvegicus
gattgtgagcccaagtttgacttat

SEQ ID NO: 373897 - DNA, 25 bp, Rattus norvegicus
gattgtgagcccaggaagtcccaca

SEQ ID NO: 373898 - DNA, 25 bp, Rattus norvegicus
gattgtgagccctagtttgacttat

SEQ ID NO: 373899 - DNA, 25 bp, Rattus norvegicus
gattgtgagccctggaagtcccaca

SEQ ID NO: 373900 - DNA, 25 bp, Rattus norvegicus
gattgtgataggactgcttctcatc

SEQ ID NO: 373901 - DNA, 25 bp, Rattus norvegicus
gattgtgataggtctgcttctcatc

SEQ ID NO: 373902 - DNA, 25 bp, Rattus norvegicus
gattgtgattagaacctgaaactca

SEQ ID NO: 373903 - DNA, 25 bp, Rattus norvegicus
gattgtgattagtacctgaaactca

SEQ ID NO: 373904 - DNA, 25 bp, Rattus norvegicus
gattgtgcaaaacgcttgcgggatt

SEQ ID NO: 373905 - DNA, 25 bp, Rattus norvegicus
gattgtgcaaaaggcttgcgggatt

SEQ ID NO: 373906 - DNA, 25 bp, Rattus norvegicus
gattgtgcacatcagaacctagtca

SEQ ID NO: 373907 - DNA, 25 bp, Rattus norvegicus
gattgtgcacatgagaacctagtca

SEQ ID NO: 373908 - DNA, 25 bp, Rattus norvegicus
gattgtgcatgcacttgactcagtc

SEQ ID NO: 373909 - DNA, 25 bp, Rattus norvegicus
gattgtgcatgctcttgactcagtc

SEQ ID NO: 373910 - DNA, 25 bp, Rattus norvegicus
gattgtgcccaaaatcctcttagag

SEQ ID NO: 373911 - DNA, 25 bp, Rattus norvegicus
gattgtgcccaactgcaatggctcc

SEQ ID NO: 373912 - DNA, 25 bp, Rattus norvegicus
gattgtgcccaagtgcaatggctcc

SEQ ID NO: 373913 - DNA, 25 bp, Rattus norvegicus
gattgtgcccaatatcctcttagag

SEQ ID NO: 373914 - DNA, 25 bp, Rattus norvegicus
gattgtgcctctaaaaacgtgtgta

SEQ ID NO: 373915 - DNA, 25 bp, Rattus norvegicus
gattgtgcctcttaaaacgtgtgta

SEQ ID NO: 373916 - DNA, 25 bp, Rattus norvegicus
gattgtgccttgaaacgcagctgtt

SEQ ID NO: 373917 - DNA, 25 bp, Rattus norvegicus
gattgtgccttgcaactggagacct

SEQ ID NO: 373918 - DNA, 25 bp, Rattus norvegicus
gattgtgccttggaactggagacct

SEQ ID NO: 373919 - DNA, 25 bp, Rattus norvegicus
gattgtgccttgtaacgcagctgtt

SEQ ID NO: 373920 - DNA, 25 bp, Rattus norvegicus
gattgtgctcatcatcaagggcctt

SEQ ID NO: 373921 - DNA, 25 bp, Rattus norvegicus
gattgtgctcatgatcaagggcctt

SEQ ID NO: 373922 - DNA, 25 bp, Rattus norvegicus
gattgtgctcctcagaatatggcca

SEQ ID NO: 373923 - DNA, 25 bp, Rattus norvegicus
gattgtgctcctgagaatatggcca

SEQ ID NO: 373924 - DNA, 25 bp, Rattus norvegicus
gattgtgctttaaaatgccccttcc

SEQ ID NO: 373925 - DNA, 25 bp, Rattus norvegicus
gattgtgctttataatgccccttcc

SEQ ID NO: 373926 - DNA, 25 bp, Rattus norvegicus
gattgtgcttttaggcaagcatagt

SEQ ID NO: 373927 - DNA, 25 bp, Rattus norvegicus
gattgtgcttttcttgtgctgttgc

SEQ ID NO: 373928 - DNA, 25 bp, Rattus norvegicus
gattgtgcttttgttgtgctgttgc

SEQ ID NO: 373929 - DNA, 25 bp, Rattus norvegicus
gattgtgctttttggcaagcatagt

SEQ ID NO: 373930 - DNA, 25 bp, Rattus norvegicus
gattgtggaaatccctttctgtttg

SEQ ID NO: 373931 - DNA, 25 bp, Rattus norvegicus
gattgtggaaatgcctttctgtttg

SEQ ID NO: 373932 - DNA, 25 bp, Rattus norvegicus
gattgtggaactccttcatcagagc

SEQ ID NO: 373933 - DNA, 25 bp, Rattus norvegicus
gattgtggaactgcttcatcagagc

SEQ ID NO: 373934 - DNA, 25 bp, Rattus norvegicus
gattgtggacaaaatgcctgcgtga

SEQ ID NO: 373935 - DNA, 25 bp, Rattus norvegicus
gattgtggacaatatgcctgcgtga

SEQ ID NO: 373936 - DNA, 25 bp, Rattus norvegicus
gattgtggacctaggactctgtcac

SEQ ID NO: 373937 - DNA, 25 bp, Rattus norvegicus
gattgtggaccttggactctgtcac

SEQ ID NO: 373938 - DNA, 25 bp, Rattus norvegicus
gattgtggatataaccctgttttgt

SEQ ID NO: 373939 - DNA, 25 bp, Rattus norvegicus
gattgtggatattaccctgttttgt

SEQ ID NO: 373940 - DNA, 25 bp, Rattus norvegicus
gattgtggccttagtgtgatatata

SEQ ID NO: 373941 - DNA, 25 bp, Rattus norvegicus
gattgtggccttataccggtatcta

SEQ ID NO: 373942 - DNA, 25 bp, Rattus norvegicus
gattgtggcctttgtgtgatatata

SEQ ID NO: 373943 - DNA, 25 bp, Rattus norvegicus
gattgtggccttttaccggtatcta

SEQ ID NO: 373944 - DNA, 25 bp, Rattus norvegicus
gattgtggctgtaacatctgtgtga

SEQ ID NO: 373945 - DNA, 25 bp, Rattus norvegicus
gattgtggctgttacatctgtgtga

SEQ ID NO: 373946 - DNA, 25 bp, Rattus norvegicus
gattgtgggactcgccatcatggct

SEQ ID NO: 373947 - DNA, 25 bp, Rattus norvegicus
gattgtgggactggccatcatggct

SEQ ID NO: 373948 - DNA, 25 bp, Rattus norvegicus
gattgtgggtatccggtaccatgac

SEQ ID NO: 373949 - DNA, 25 bp, Rattus norvegicus
gattgtgggtatgcggtaccatgac

SEQ ID NO: 373950 - DNA, 25 bp, Rattus norvegicus
gattgtggtagcaatggtcttacag

SEQ ID NO: 373951 - DNA, 25 bp, Rattus norvegicus
gattgtggtagctatggtcttacag

SEQ ID NO: 373952 - DNA, 25 bp, Rattus norvegicus
gattgtggtcatcattttcttccaa

SEQ ID NO: 373953 - DNA, 25 bp, Rattus norvegicus
gattgtggtcatgattttcttccaa

SEQ ID NO: 373954 - DNA, 25 bp, Rattus norvegicus
gattgtgtaaatagcattcttgctt

SEQ ID NO: 373955 - DNA, 25 bp, Rattus norvegicus
gattgtgtaaattgcattcttgctt

SEQ ID NO: 373956 - DNA, 25 bp, Rattus norvegicus
gattgtgtaagaacccaagccctag

SEQ ID NO: 373957 - DNA, 25 bp, Rattus norvegicus
gattgtgtaagatcccaagccctag

SEQ ID NO: 373958 - DNA, 25 bp, Rattus norvegicus
gattgtgtacatattctgtgtggat

SEQ ID NO: 373959 - DNA, 25 bp, Rattus norvegicus
gattgtgtacatcctcgaagtcccc

SEQ ID NO: 373960 - DNA, 25 bp, Rattus norvegicus
gattgtgtacatgctcgaagtcccc

SEQ ID NO: 373961 - DNA, 25 bp, Rattus norvegicus
gattgtgtacattttctgtgtggat

SEQ ID NO: 373962 - DNA, 25 bp, Rattus norvegicus
gattgtgtagccatgtggcatgctc

SEQ ID NO: 373963 - DNA, 25 bp, Rattus norvegicus
gattgtgtagccttgtggcatgctc

SEQ ID NO: 373964 - DNA, 25 bp, Rattus norvegicus
gattgtgtagtactccatgtctgaa

SEQ ID NO: 373965 - DNA, 25 bp, Rattus norvegicus
gattgtgtagtagtccatgtctgaa

SEQ ID NO: 373966 - DNA, 25 bp, Rattus norvegicus
gattgtgtcatgctccacagaagtc

SEQ ID NO: 373967 - DNA, 25 bp, Rattus norvegicus
gattgtgtcatggtccacagaagtc

SEQ ID NO: 373968 - DNA, 25 bp, Rattus norvegicus
gattgtgtccagaagggctcctgaa

SEQ ID NO: 373969 - DNA, 25 bp, Rattus norvegicus
gattgtgtccagtagggctcctgaa

SEQ ID NO: 373970 - DNA, 25 bp, Rattus norvegicus
gattgtgtctagagcgactgcggac

SEQ ID NO: 373971 - DNA, 25 bp, Rattus norvegicus
gattgtgtctagtgcgactgcggac

SEQ ID NO: 373972 - DNA, 25 bp, Rattus norvegicus
gattgtgtctctccgttttgtaaac

SEQ ID NO: 373973 - DNA, 25 bp, Rattus norvegicus
gattgtgtctctgcgttttgtaaac

SEQ ID NO: 373974 - DNA, 25 bp, Rattus norvegicus
gattgtgtgactattcatgtgttat

SEQ ID NO: 373975 - DNA, 25 bp, Rattus norvegicus
gattgtgtgactcctggcatgtctt

SEQ ID NO: 373976 - DNA, 25 bp, Rattus norvegicus
gattgtgtgactgctggcatgtctt

SEQ ID NO: 373977 - DNA, 25 bp, Rattus norvegicus
gattgtgtgacttttcatgtgttat

SEQ ID NO: 373978 - DNA, 25 bp, Rattus norvegicus
gattgtgtggttcgcaacagctata

SEQ ID NO: 373979 - DNA, 25 bp, Rattus norvegicus
gattgtgtggttggcaacagctata

SEQ ID NO: 373980 - DNA, 25 bp, Rattus norvegicus
gattgtgttctcagaactgcagcaa

SEQ ID NO: 373981 - DNA, 25 bp, Rattus norvegicus
gattgtgttctcagtacattcccca

SEQ ID NO: 373982 - DNA, 25 bp, Rattus norvegicus
gattgtgttctctgaactgcagcaa

SEQ ID NO: 373983 - DNA, 25 bp, Rattus norvegicus
gattgtgttctctgtacattcccca

SEQ ID NO: 373984 - DNA, 25 bp, Rattus norvegicus
gattgtgttctgaatgtggcttgtc

SEQ ID NO: 373985 - DNA, 25 bp, Rattus norvegicus
gattgtgttctgtatgtggcttgtc

SEQ ID NO: 373986 - DNA, 25 bp, Rattus norvegicus
gattgtgttgtgattctctacctca

SEQ ID NO: 373987 - DNA, 25 bp, Rattus norvegicus
gattgtgttgtgtttctctacctca

SEQ ID NO: 373988 - DNA, 25 bp, Rattus norvegicus
gattgtgtttctcatatttctcata

SEQ ID NO: 373989 - DNA, 25 bp, Rattus norvegicus
gattgtgtttctgatatttctcata

SEQ ID NO: 373990 - DNA, 25 bp, Rattus norvegicus
gattgttaccatatgacaggtgaag

SEQ ID NO: 373991 - DNA, 25 bp, Rattus norvegicus
gattgttaccatttgacaggtgaag

SEQ ID NO: 373992 - DNA, 25 bp, Rattus norvegicus
gattgttactaacgtggttggcaaa

SEQ ID NO: 373993 - DNA, 25 bp, Rattus norvegicus
gattgttactaaggtggttggcaaa

SEQ ID NO: 373994 - DNA, 25 bp, Rattus norvegicus
gattgttactacctagactccagta

SEQ ID NO: 373995 - DNA, 25 bp, Rattus norvegicus
gattgttactacgtagactccagta

SEQ ID NO: 373996 - DNA, 25 bp, Rattus norvegicus
gattgttacttcaatagcatcccct

SEQ ID NO: 373997 - DNA, 25 bp, Rattus norvegicus
gattgttacttctatagcatcccct

SEQ ID NO: 373998 - DNA, 25 bp, Rattus norvegicus
gattgttattaacttcccacatcca

SEQ ID NO: 373999 - DNA, 25 bp, Rattus norvegicus
gattgttattaagttcccacatcca

SEQ ID NO: 374000 - DNA, 25 bp, Rattus norvegicus
gattgttcagaacgaggcagagcaa

SEQ ID NO: 374001 - DNA, 25 bp, Rattus norvegicus
gattgttcagaaggaggcagagcaa

SEQ ID NO: 374002 - DNA, 25 bp, Rattus norvegicus
gattgttccaaacattctacttgtt

SEQ ID NO: 374003 - DNA, 25 bp, Rattus norvegicus
gattgttccaaagattctacttgtt

SEQ ID NO: 374004 - DNA, 25 bp, Rattus norvegicus
gattgttcccagacatggtcctgtt

SEQ ID NO: 374005 - DNA, 25 bp, Rattus norvegicus
gattgttcccagtcatggtcctgtt

SEQ ID NO: 374006 - DNA, 25 bp, Rattus norvegicus
gattgttcctccagtaatttcacta

SEQ ID NO: 374007 - DNA, 25 bp, Rattus norvegicus
gattgttcctcctgtaatttcacta

SEQ ID NO: 374008 - DNA, 25 bp, Rattus norvegicus
gattgttctctaaccaggattgtaa

SEQ ID NO: 374009 - DNA, 25 bp, Rattus norvegicus
gattgttctctatccaggattgtaa

SEQ ID NO: 374010 - DNA, 25 bp, Rattus norvegicus
gattgttctggcaagtcacttcggc

SEQ ID NO: 374011 - DNA, 25 bp, Rattus norvegicus
gattgttctggctagtcacttcggc

SEQ ID NO: 374012 - DNA, 25 bp, Rattus norvegicus
gattgttcttctcaggttgcctaat

SEQ ID NO: 374013 - DNA, 25 bp, Rattus norvegicus
gattgttcttctgaggttgcctaat

SEQ ID NO: 374014 - DNA, 25 bp, Rattus norvegicus
gattgttcttgcaccttttatggga

SEQ ID NO: 374015 - DNA, 25 bp, Rattus norvegicus
gattgttcttgctccttttatggga

SEQ ID NO: 374016 - DNA, 25 bp, Rattus norvegicus
gattgttcttttcgatcacttcctt

SEQ ID NO: 374017 - DNA, 25 bp, Rattus norvegicus
gattgttcttttggatcacttcctt

SEQ ID NO: 374018 - DNA, 25 bp, Rattus norvegicus
gattgttgaacacttgtcccgacat

SEQ ID NO: 374019 - DNA, 25 bp, Rattus norvegicus
gattgttgaacagttgtcccgacat

SEQ ID NO: 374020 - DNA, 25 bp, Rattus norvegicus
gattgttgaactccttgtcccagaa

SEQ ID NO: 374021 - DNA, 25 bp, Rattus norvegicus
gattgttgaactgcttgtcccagaa

SEQ ID NO: 374022 - DNA, 25 bp, Rattus norvegicus
gattgttgccccaaagcatcagtta

SEQ ID NO: 374023 - DNA, 25 bp, Rattus norvegicus
gattgttgcccctaagcatcagtta

SEQ ID NO: 374024 - DNA, 25 bp, Rattus norvegicus
gattgttggctgacctattaagaat

SEQ ID NO: 374025 - DNA, 25 bp, Rattus norvegicus
gattgttggctgtcctattaagaat

SEQ ID NO: 374026 - DNA, 25 bp, Rattus norvegicus
gattgttggtcgaacagtccacaga

SEQ ID NO: 374027 - DNA, 25 bp, Rattus norvegicus
gattgttggtcgtacagtccacaga

SEQ ID NO: 374028 - DNA, 25 bp, Rattus norvegicus
gattgttgtcaaaaaacctgttctc

SEQ ID NO: 374029 - DNA, 25 bp, Rattus norvegicus
gattgttgtcaataaacctgttctc

SEQ ID NO: 374030 - DNA, 25 bp, Rattus norvegicus
gattgttgtctcaataccttccaaa

SEQ ID NO: 374031 - DNA, 25 bp, Rattus norvegicus
gattgttgtctctataccttccaaa

SEQ ID NO: 374032 - DNA, 25 bp, Rattus norvegicus
gattgttgttggcttgtgtactaat

SEQ ID NO: 374033 - DNA, 25 bp, Rattus norvegicus
gattgttgttgggttgtgtactaat

SEQ ID NO: 374034 - DNA, 25 bp, Rattus norvegicus
gattgtttaaacacacccttgctct

SEQ ID NO: 374035 - DNA, 25 bp, Rattus norvegicus
gattgtttaaactcacccttgctct

SEQ ID NO: 374036 - DNA, 25 bp, Rattus norvegicus
gattgtttacccatggactcagaga

SEQ ID NO: 374037 - DNA, 25 bp, Rattus norvegicus
gattgtttacccttggactcagaga

SEQ ID NO: 374038 - DNA, 25 bp, Rattus norvegicus
gattgtttactgaagcgtgtctgac

SEQ ID NO: 374039 - DNA, 25 bp, Rattus norvegicus
gattgtttactgtagcgtgtctgac

SEQ ID NO: 374040 - DNA, 25 bp, Rattus norvegicus
gattgtttattactgtccgtgggag

SEQ ID NO: 374041 - DNA, 25 bp, Rattus norvegicus
gattgtttattagtgtccgtgggag

SEQ ID NO: 374042 - DNA, 25 bp, Rattus norvegicus
gattgtttccttattccaggtatat

SEQ ID NO: 374043 - DNA, 25 bp, Rattus norvegicus
gattgtttcctttttccaggtatat

SEQ ID NO: 374044 - DNA, 25 bp, Rattus norvegicus
gattgtttgcttctgattttcttct

SEQ ID NO: 374045 - DNA, 25 bp, Rattus norvegicus
gattgtttgcttgtgattttcttct

SEQ ID NO: 374046 - DNA, 25 bp, Rattus norvegicus
gattgttttaatcacagcctcagat

SEQ ID NO: 374047 - DNA, 25 bp, Rattus norvegicus
gattgttttaatgacagcctcagat

SEQ ID NO: 374048 - DNA, 25 bp, Rattus norvegicus
gattgttttataaaagcttgcccta

SEQ ID NO: 374049 - DNA, 25 bp, Rattus norvegicus
gattgttttatataagcttgcccta

SEQ ID NO: 374050 - DNA, 25 bp, Rattus norvegicus
gattgttttatcatcagctggagag

SEQ ID NO: 374051 - DNA, 25 bp, Rattus norvegicus
gattgttttatcttcagctggagag

SEQ ID NO: 374052 - DNA, 25 bp, Rattus norvegicus
gattgttttcctaaactgctggcaa

SEQ ID NO: 374053 - DNA, 25 bp, Rattus norvegicus
gattgttttccttaactgctggcaa

SEQ ID NO: 374054 - DNA, 25 bp, Rattus norvegicus
gattgttttctaccacggcatatcc

SEQ ID NO: 374055 - DNA, 25 bp, Rattus norvegicus
gattgttttctagcacggcatatcc

SEQ ID NO: 374056 - DNA, 25 bp, Rattus norvegicus
gattgttttctgacctgcgatttat

SEQ ID NO: 374057 - DNA, 25 bp, Rattus norvegicus
gattgttttctgtcctgcgatttat

SEQ ID NO: 374058 - DNA, 25 bp, Rattus norvegicus
gattgttttcttcattagctcacta

SEQ ID NO: 374059 - DNA, 25 bp, Rattus norvegicus
gattgttttcttgattagctcacta

SEQ ID NO: 374060 - DNA, 25 bp, Rattus norvegicus
gattgttttgctcgtcctaaacatt

SEQ ID NO: 374061 - DNA, 25 bp, Rattus norvegicus
gattgttttgctggtcctaaacatt

SEQ ID NO: 374062 - DNA, 25 bp, Rattus norvegicus
gattgttttgtcactgcggatcatc

SEQ ID NO: 374063 - DNA, 25 bp, Rattus norvegicus
gattgttttgtctctgcggatcatc

SEQ ID NO: 374064 - DNA, 25 bp, Rattus norvegicus
gattgtttttcaagggacaactcag

SEQ ID NO: 374065 - DNA, 25 bp, Rattus norvegicus
gattgtttttcatgggacaactcag

SEQ ID NO: 374066 - DNA, 25 bp, Rattus norvegicus
gattgtttttgtattcttcccgctc

SEQ ID NO: 374067 - DNA, 25 bp, Rattus norvegicus
gattgtttttgtctgtccatgtgga

SEQ ID NO: 374068 - DNA, 25 bp, Rattus norvegicus
gattgtttttgtgtgtccatgtgga

SEQ ID NO: 374069 - DNA, 25 bp, Rattus norvegicus
gattgtttttgttttcttcccgctc

SEQ ID NO: 374070 - DNA, 25 bp, Rattus norvegicus
gatttaaaacgacttacctcaccag

SEQ ID NO: 374071 - DNA, 25 bp, Rattus norvegicus
gatttaaaacgagttacctcaccag

SEQ ID NO: 374072 - DNA, 25 bp, Rattus norvegicus
gatttaaactcaccagatgctgcag

SEQ ID NO: 374073 - DNA, 25 bp, Rattus norvegicus
gatttaaactcagcagatgctgcag

SEQ ID NO: 374074 - DNA, 25 bp, Rattus norvegicus
gatttaacactcacagaccagactg

SEQ ID NO: 374075 - DNA, 25 bp, Rattus norvegicus
gatttaacactctcagaccagactg

SEQ ID NO: 374076 - DNA, 25 bp, Rattus norvegicus
gatttaaccactactcctgacaatg

SEQ ID NO: 374077 - DNA, 25 bp, Rattus norvegicus
gatttaaccacttctcctgacaatg

SEQ ID NO: 374078 - DNA, 25 bp, Rattus norvegicus
gatttaaccaggattcgcacagttc

SEQ ID NO: 374079 - DNA, 25 bp, Rattus norvegicus
gatttaaccaggtttcgcacagttc

SEQ ID NO: 374080 - DNA, 25 bp, Rattus norvegicus
gatttaactggcacctatttttcct

SEQ ID NO: 374081 - DNA, 25 bp, Rattus norvegicus
gatttaactggccactgtgtctcca

SEQ ID NO: 374082 - DNA, 25 bp, Rattus norvegicus
gatttaactggcgactgtgtctcca

SEQ ID NO: 374083 - DNA, 25 bp, Rattus norvegicus
gatttaactggctcctatttttcct

SEQ ID NO: 374084 - DNA, 25 bp, Rattus norvegicus
gatttaactgtgactccttggatgt

SEQ ID NO: 374085 - DNA, 25 bp, Rattus norvegicus
gatttaactgtgtctccttggatgt

SEQ ID NO: 374086 - DNA, 25 bp, Rattus norvegicus
gatttaagatatcacatggtggccc

SEQ ID NO: 374087 - DNA, 25 bp, Rattus norvegicus
gatttaagatatgacatggtggccc

SEQ ID NO: 374088 - DNA, 25 bp, Rattus norvegicus
gatttaaggtttaattgccgagcaa

SEQ ID NO: 374089 - DNA, 25 bp, Rattus norvegicus
gatttaaggttttattgccgagcaa

SEQ ID NO: 374090 - DNA, 25 bp, Rattus norvegicus
gatttaagtcttagccccttattag

SEQ ID NO: 374091 - DNA, 25 bp, Rattus norvegicus
gatttaagtctttgccccttattag

SEQ ID NO: 374092 - DNA, 25 bp, Rattus norvegicus
gatttaataaccactacttgcttta

SEQ ID NO: 374093 - DNA, 25 bp, Rattus norvegicus
gatttaataacctctacttgcttta

SEQ ID NO: 374094 - DNA, 25 bp, Rattus norvegicus
gatttaatcagaatgcccagagaga

SEQ ID NO: 374095 - DNA, 25 bp, Rattus norvegicus
gatttaatcagattgcccagagaga

SEQ ID NO: 374096 - DNA, 25 bp, Rattus norvegicus
gatttaatgggcagtgtctttacac

SEQ ID NO: 374097 - DNA, 25 bp, Rattus norvegicus
gatttaatgggctgtgtctttacac

SEQ ID NO: 374098 - DNA, 25 bp, Rattus norvegicus
gatttaatgtatacatgcccaccca

SEQ ID NO: 374099 - DNA, 25 bp, Rattus norvegicus
gatttaatgtattcatgcccaccca

SEQ ID NO: 374100 - DNA, 25 bp, Rattus norvegicus
gatttaattcaacagaatcccatct

SEQ ID NO: 374101 - DNA, 25 bp, Rattus norvegicus
gatttaattcaagagaatcccatct

SEQ ID NO: 374102 - DNA, 25 bp, Rattus norvegicus
gatttaattcagctcttagtcagat

SEQ ID NO: 374103 - DNA, 25 bp, Rattus norvegicus
gatttaattcaggtcttagtcagat

SEQ ID NO: 374104 - DNA, 25 bp, Rattus norvegicus
gatttaattctgatacctctgtaca

SEQ ID NO: 374105 - DNA, 25 bp, Rattus norvegicus
gatttaattctgttacctctgtaca

SEQ ID NO: 374106 - DNA, 25 bp, Rattus norvegicus
gatttaattgatcccatccagccag

SEQ ID NO: 374107 - DNA, 25 bp, Rattus norvegicus
gatttaattgatgccatccagccag

SEQ ID NO: 374108 - DNA, 25 bp, Rattus norvegicus
gatttacaaacaagcccattgcctt

SEQ ID NO: 374109 - DNA, 25 bp, Rattus norvegicus
gatttacaaacatgcccattgcctt

SEQ ID NO: 374110 - DNA, 25 bp, Rattus norvegicus
gatttacaactgaccctgttcagtg

SEQ ID NO: 374111 - DNA, 25 bp, Rattus norvegicus
gatttacaactgtccctgttcagtg

SEQ ID NO: 374112 - DNA, 25 bp, Rattus norvegicus
gatttacaagagagggtccctgctt

SEQ ID NO: 374113 - DNA, 25 bp, Rattus norvegicus
gatttacaagagtgggtccctgctt

SEQ ID NO: 374114 - DNA, 25 bp, Rattus norvegicus
gatttacagccaccagaagccatta

SEQ ID NO: 374115 - DNA, 25 bp, Rattus norvegicus
gatttacagccacttctatttattt

SEQ ID NO: 374116 - DNA, 25 bp, Rattus norvegicus
gatttacagccagcagaagccatta

SEQ ID NO: 374117 - DNA, 25 bp, Rattus norvegicus
gatttacagccagttctatttattt

SEQ ID NO: 374118 - DNA, 25 bp, Rattus norvegicus
gatttacagcttacgctaggcctgc

SEQ ID NO: 374119 - DNA, 25 bp, Rattus norvegicus
gatttacagctttcgctaggcctgc

SEQ ID NO: 374120 - DNA, 25 bp, Rattus norvegicus
gatttacagggcagctccaggacta

SEQ ID NO: 374121 - DNA, 25 bp, Rattus norvegicus
gatttacagggctgctccaggacta

SEQ ID NO: 374122 - DNA, 25 bp, Rattus norvegicus
gatttacagttaagtcctccagcat

SEQ ID NO: 374123 - DNA, 25 bp, Rattus norvegicus
gatttacagttatgtcctccagcat

SEQ ID NO: 374124 - DNA, 25 bp, Rattus norvegicus
gatttacagttcagctctcgttgcc

SEQ ID NO: 374125 - DNA, 25 bp, Rattus norvegicus
gatttacagttctgctctcgttgcc

SEQ ID NO: 374126 - DNA, 25 bp, Rattus norvegicus
gatttacatacccttagctcacagt

SEQ ID NO: 374127 - DNA, 25 bp, Rattus norvegicus
gatttacataccgttagctcacagt

SEQ ID NO: 374128 - DNA, 25 bp, Rattus norvegicus
gatttacatgatcagaccatgtctc

SEQ ID NO: 374129 - DNA, 25 bp, Rattus norvegicus
gatttacatgatgagaccatgtctc

SEQ ID NO: 374130 - DNA, 25 bp, Rattus norvegicus
gatttaccagtaatgaaccagtgct

SEQ ID NO: 374131 - DNA, 25 bp, Rattus norvegicus
gatttaccagtattgaaccagtgct

SEQ ID NO: 374132 - DNA, 25 bp, Rattus norvegicus
gatttacccttcagttttccactag

SEQ ID NO: 374133 - DNA, 25 bp, Rattus norvegicus
gatttacccttctgttttccactag

SEQ ID NO: 374134 - DNA, 25 bp, Rattus norvegicus
gatttaccgattccatgccttacag

SEQ ID NO: 374135 - DNA, 25 bp, Rattus norvegicus
gatttaccgattgcatgccttacag

SEQ ID NO: 374136 - DNA, 25 bp, Rattus norvegicus
gatttacctgtgaatttaatctcag

SEQ ID NO: 374137 - DNA, 25 bp, Rattus norvegicus
gatttacctgtgtatttaatctcag

SEQ ID NO: 374138 - DNA, 25 bp, Rattus norvegicus
gatttaccttctcacggaccaatga

SEQ ID NO: 374139 - DNA, 25 bp, Rattus norvegicus
gatttaccttctgacggaccaatga

SEQ ID NO: 374140 - DNA, 25 bp, Rattus norvegicus
gatttacgttaaaccacatgattgt

SEQ ID NO: 374141 - DNA, 25 bp, Rattus norvegicus
gatttacgttaatccacatgattgt

SEQ ID NO: 374142 - DNA, 25 bp, Rattus norvegicus
gatttactacctattgatcattgtt

SEQ ID NO: 374143 - DNA, 25 bp, Rattus norvegicus
gatttactaccttttgatcattgtt

SEQ ID NO: 374144 - DNA, 25 bp, Rattus norvegicus
gatttactatagctgcaaggacaga

SEQ ID NO: 374145 - DNA, 25 bp, Rattus norvegicus
gatttactataggtgcaaggacaga

SEQ ID NO: 374146 - DNA, 25 bp, Rattus norvegicus
gatttactcggcagctttagcaagc

SEQ ID NO: 374147 - DNA, 25 bp, Rattus norvegicus
gatttactcggctgctttagcaagc

SEQ ID NO: 374148 - DNA, 25 bp, Rattus norvegicus
gatttactctcgcttggtcttgtga

SEQ ID NO: 374149 - DNA, 25 bp, Rattus norvegicus
gatttactctcggttggtcttgtga

SEQ ID NO: 374150 - DNA, 25 bp, Rattus norvegicus
gatttactctttccccagttcctgg

SEQ ID NO: 374151 - DNA, 25 bp, Rattus norvegicus
gatttactctttgcccagttcctgg

SEQ ID NO: 374152 - DNA, 25 bp, Rattus norvegicus
gatttactgaaaagtacttctgggt

SEQ ID NO: 374153 - DNA, 25 bp, Rattus norvegicus
gatttactgaaatgtacttctgggt

SEQ ID NO: 374154 - DNA, 25 bp, Rattus norvegicus
gatttactgaccatttcttcttttg

SEQ ID NO: 374155 - DNA, 25 bp, Rattus norvegicus
gatttactgaccttttcttcttttg

SEQ ID NO: 374156 - DNA, 25 bp, Rattus norvegicus
gatttactgatcatgctcactctac

SEQ ID NO: 374157 - DNA, 25 bp, Rattus norvegicus
gatttactgatcttgctcactctac

SEQ ID NO: 374158 - DNA, 25 bp, Rattus norvegicus
gatttactggtaaatcctcttaaaa

SEQ ID NO: 374159 - DNA, 25 bp, Rattus norvegicus
gatttactggtatatcctcttaaaa

SEQ ID NO: 374160 - DNA, 25 bp, Rattus norvegicus
gatttactgtacaatacgttctctt

SEQ ID NO: 374161 - DNA, 25 bp, Rattus norvegicus
gatttactgtactatacgttctctt

SEQ ID NO: 374162 - DNA, 25 bp, Rattus norvegicus
gatttactgtctacaacaccaacct

SEQ ID NO: 374163 - DNA, 25 bp, Rattus norvegicus
gatttactgtcttcaacaccaacct

SEQ ID NO: 374164 - DNA, 25 bp, Rattus norvegicus
gatttacttatcaagggatgggcat

SEQ ID NO: 374165 - DNA, 25 bp, Rattus norvegicus
gatttacttatctagggatgggcat

SEQ ID NO: 374166 - DNA, 25 bp, Rattus norvegicus
gatttactttaactgacgagatgat

SEQ ID NO: 374167 - DNA, 25 bp, Rattus norvegicus
gatttactttaagtgacgagatgat

SEQ ID NO: 374168 - DNA, 25 bp, Rattus norvegicus
gatttactttacattcgagactgct

SEQ ID NO: 374169 - DNA, 25 bp, Rattus norvegicus
gatttactttactttcgagactgct

SEQ ID NO: 374170 - DNA, 25 bp, Rattus norvegicus
gatttagaagcgattcgaccctcac

SEQ ID NO: 374171 - DNA, 25 bp, Rattus norvegicus
gatttagaagcgtttcgaccctcac

SEQ ID NO: 374172 - DNA, 25 bp, Rattus norvegicus
gatttagacctcaaggatatccttg

SEQ ID NO: 374173 - DNA, 25 bp, Rattus norvegicus
gatttagacctctaggatatccttg

SEQ ID NO: 374174 - DNA, 25 bp, Rattus norvegicus
gatttagactccagccaccttgctt

SEQ ID NO: 374175 - DNA, 25 bp, Rattus norvegicus
gatttagactcctgccaccttgctt

SEQ ID NO: 374176 - DNA, 25 bp, Rattus norvegicus
gatttagactgtccctttcgaaaga

SEQ ID NO: 374177 - DNA, 25 bp, Rattus norvegicus
gatttagactgtgcctttcgaaaga

SEQ ID NO: 374178 - DNA, 25 bp, Rattus norvegicus
gatttagatctacttaccacattgt

SEQ ID NO: 374179 - DNA, 25 bp, Rattus norvegicus
gatttagatctagttaccacattgt

SEQ ID NO: 374180 - DNA, 25 bp, Rattus norvegicus
gatttagcacagaactcatcactct

SEQ ID NO: 374181 - DNA, 25 bp, Rattus norvegicus
gatttagcacagtactcatcactct

SEQ ID NO: 374182 - DNA, 25 bp, Rattus norvegicus
gatttagctagtccagccctgaaga

SEQ ID NO: 374183 - DNA, 25 bp, Rattus norvegicus
gatttagctagtgcagccctgaaga

SEQ ID NO: 374184 - DNA, 25 bp, Rattus norvegicus
gatttagctgttacccaacctgaga

SEQ ID NO: 374185 - DNA, 25 bp, Rattus norvegicus
gatttagctgtttcccaacctgaga

SEQ ID NO: 374186 - DNA, 25 bp, Rattus norvegicus
gatttagcttccaacacgggtgggc

SEQ ID NO: 374187 - DNA, 25 bp, Rattus norvegicus
gatttagcttcctacacgggtgggc

SEQ ID NO: 374188 - DNA, 25 bp, Rattus norvegicus
gatttaggcacgatccataggaggg

SEQ ID NO: 374189 - DNA, 25 bp, Rattus norvegicus
gatttaggcacgttccataggaggg

SEQ ID NO: 374190 - DNA, 25 bp, Rattus norvegicus
gatttagggcttagctacacaacga

SEQ ID NO: 374191 - DNA, 25 bp, Rattus norvegicus
gatttagggctttgctacacaacga

SEQ ID NO: 374192 - DNA, 25 bp, Rattus norvegicus
gatttaggtcagagtagtccctgct

SEQ ID NO: 374193 - DNA, 25 bp, Rattus norvegicus
gatttaggtcagtgtagtccctgct

SEQ ID NO: 374194 - DNA, 25 bp, Rattus norvegicus
gatttaggtgtcataccacttcact

SEQ ID NO: 374195 - DNA, 25 bp, Rattus norvegicus
gatttaggtgtcttaccacttcact

SEQ ID NO: 374196 - DNA, 25 bp, Rattus norvegicus
gatttaggtgttaaactcaggcatt

SEQ ID NO: 374197 - DNA, 25 bp, Rattus norvegicus
gatttaggtgtttaactcaggcatt

SEQ ID NO: 374198 - DNA, 25 bp, Rattus norvegicus
gatttagtagcgagacttgcctttc

SEQ ID NO: 374199 - DNA, 25 bp, Rattus norvegicus
gatttagtagcgtgacttgcctttc

SEQ ID NO: 374200 - DNA, 25 bp, Rattus norvegicus
gatttagtcagaatgcctcctggct

SEQ ID NO: 374201 - DNA, 25 bp, Rattus norvegicus
gatttagtcagattgcctcctggct

SEQ ID NO: 374202 - DNA, 25 bp, Rattus norvegicus
gatttagtcatgaagttgccacaaa

SEQ ID NO: 374203 - DNA, 25 bp, Rattus norvegicus
gatttagtcatgtagttgccacaaa

SEQ ID NO: 374204 - DNA, 25 bp, Rattus norvegicus
gatttagtcttaatgctgcctttat

SEQ ID NO: 374205 - DNA, 25 bp, Rattus norvegicus
gatttagtcttattgctgcctttat

SEQ ID NO: 374206 - DNA, 25 bp, Rattus norvegicus
gatttagtgactatttagtaaccag

SEQ ID NO: 374207 - DNA, 25 bp, Rattus norvegicus
gatttagtgactttttagtaaccag

SEQ ID NO: 374208 - DNA, 25 bp, Rattus norvegicus
gatttagtgcatacctttgagccag

SEQ ID NO: 374209 - DNA, 25 bp, Rattus norvegicus
gatttagtgcattcctttgagccag

SEQ ID NO: 374210 - DNA, 25 bp, Rattus norvegicus
gatttagtgccacttttttgccttt

SEQ ID NO: 374211 - DNA, 25 bp, Rattus norvegicus
gatttagtgccagttttttgccttt

SEQ ID NO: 374212 - DNA, 25 bp, Rattus norvegicus
gatttagttagaccatttcctttgt

SEQ ID NO: 374213 - DNA, 25 bp, Rattus norvegicus
gatttagttagagcatttcctttgt

SEQ ID NO: 374214 - DNA, 25 bp, Rattus norvegicus
gatttagtttttccgtctctctaca

SEQ ID NO: 374215 - DNA, 25 bp, Rattus norvegicus
gatttagtttttgcgtctctctaca

SEQ ID NO: 374216 - DNA, 25 bp, Rattus norvegicus
gatttatacagtacaagtactcgag

SEQ ID NO: 374217 - DNA, 25 bp, Rattus norvegicus
gatttatacagttcaagtactcgag

SEQ ID NO: 374218 - DNA, 25 bp, Rattus norvegicus
gatttatactgtctatgcattacta

SEQ ID NO: 374219 - DNA, 25 bp, Rattus norvegicus
gatttatactgtgtatgcattacta

SEQ ID NO: 374220 - DNA, 25 bp, Rattus norvegicus
gatttatagcccaagtcatgccact

SEQ ID NO: 374221 - DNA, 25 bp, Rattus norvegicus
gatttatagccctagtcatgccact

SEQ ID NO: 374222 - DNA, 25 bp, Rattus norvegicus
gatttataggatccaatggcccata

SEQ ID NO: 374223 - DNA, 25 bp, Rattus norvegicus
gatttataggatgcaatggcccata

SEQ ID NO: 374224 - DNA, 25 bp, Rattus norvegicus
gatttatatgccactcatggtccaa

SEQ ID NO: 374225 - DNA, 25 bp, Rattus norvegicus
gatttatatgcctctcatggtccaa

SEQ ID NO: 374226 - DNA, 25 bp, Rattus norvegicus
gatttatatttgagatagccccttg

SEQ ID NO: 374227 - DNA, 25 bp, Rattus norvegicus
gatttatatttgtgatagccccttg

SEQ ID NO: 374228 - DNA, 25 bp, Rattus norvegicus
gatttatcaagaaacattcccggga

SEQ ID NO: 374229 - DNA, 25 bp, Rattus norvegicus
gatttatcaagatacattcccggga

SEQ ID NO: 374230 - DNA, 25 bp, Rattus norvegicus
gatttatcacacagccatgcagggc

SEQ ID NO: 374231 - DNA, 25 bp, Rattus norvegicus
gatttatcacactgccatgcagggc

SEQ ID NO: 374232 - DNA, 25 bp, Rattus norvegicus
gatttatcacccatttcggaagcaa

SEQ ID NO: 374233 - DNA, 25 bp, Rattus norvegicus
gatttatcacccttttcggaagcaa

SEQ ID NO: 374234 - DNA, 25 bp, Rattus norvegicus
gatttatcactcagctgtctttata

SEQ ID NO: 374235 - DNA, 25 bp, Rattus norvegicus
gatttatcactctgctgtctttata

SEQ ID NO: 374236 - DNA, 25 bp, Rattus norvegicus
gatttatcagaaccagagactccaa

SEQ ID NO: 374237 - DNA, 25 bp, Rattus norvegicus
gatttatcagaagcagagactccaa

SEQ ID NO: 374238 - DNA, 25 bp, Rattus norvegicus
gatttatcatctccgtgtttcctgt

SEQ ID NO: 374239 - DNA, 25 bp, Rattus norvegicus
gatttatcatctctctgctttctta

SEQ ID NO: 374240 - DNA, 25 bp, Rattus norvegicus
gatttatcatctgcgtgtttcctgt

SEQ ID NO: 374241 - DNA, 25 bp, Rattus norvegicus
gatttatcatctgtctgctttctta

SEQ ID NO: 374242 - DNA, 25 bp, Rattus norvegicus
gatttatccaacatcagcatctttt

SEQ ID NO: 374243 - DNA, 25 bp, Rattus norvegicus
gatttatccaacttcagcatctttt

SEQ ID NO: 374244 - DNA, 25 bp, Rattus norvegicus
gatttatccagaacgttgcttcagt

SEQ ID NO: 374245 - DNA, 25 bp, Rattus norvegicus
gatttatccagatcgttgcttcagt

SEQ ID NO: 374246 - DNA, 25 bp, Rattus norvegicus
gatttatccagtaaccagtcaggaa

SEQ ID NO: 374247 - DNA, 25 bp, Rattus norvegicus
gatttatccagttaccagtcaggaa

SEQ ID NO: 374248 - DNA, 25 bp, Rattus norvegicus
gatttatccattctgattcgctttg

SEQ ID NO: 374249 - DNA, 25 bp, Rattus norvegicus
gatttatccattgtgattcgctttg

SEQ ID NO: 374250 - DNA, 25 bp, Rattus norvegicus
gatttatcctggctcatagttctgg

SEQ ID NO: 374251 - DNA, 25 bp, Rattus norvegicus
gatttatcctgggtcatagttctgg

SEQ ID NO: 374252 - DNA, 25 bp, Rattus norvegicus
gatttatctatcacagtatgagtat

SEQ ID NO: 374253 - DNA, 25 bp, Rattus norvegicus
gatttatctatctcagtatgagtat

SEQ ID NO: 374254 - DNA, 25 bp, Rattus norvegicus
gatttatctgttcacttgttggcca

SEQ ID NO: 374255 - DNA, 25 bp, Rattus norvegicus
gatttatctgttgacttgttggcca

SEQ ID NO: 374256 - DNA, 25 bp, Rattus norvegicus
gatttatcttcccttctgctgtaag

SEQ ID NO: 374257 - DNA, 25 bp, Rattus norvegicus
gatttatcttccgttctgctgtaag

SEQ ID NO: 374258 - DNA, 25 bp, Rattus norvegicus
gatttatcttgcagtgtttctgcct

SEQ ID NO: 374259 - DNA, 25 bp, Rattus norvegicus
gatttatcttgctgtgtttctgcct

SEQ ID NO: 374260 - DNA, 25 bp, Rattus norvegicus
gatttatgccaaaaccattcctagg

SEQ ID NO: 374261 - DNA, 25 bp, Rattus norvegicus
gatttatgccaataccattcctagg

SEQ ID NO: 374262 - DNA, 25 bp, Rattus norvegicus
gatttatgccccaaatgtctatttc

SEQ ID NO: 374263 - DNA, 25 bp, Rattus norvegicus
gatttatgcccctaatgtctatttc

SEQ ID NO: 374264 - DNA, 25 bp, Rattus norvegicus
gatttatgctaactgaacatccaca

SEQ ID NO: 374265 - DNA, 25 bp, Rattus norvegicus
gatttatgctaagtgaacatccaca

SEQ ID NO: 374266 - DNA, 25 bp, Rattus norvegicus
gatttatgggttacctcaggtcaca

SEQ ID NO: 374267 - DNA, 25 bp, Rattus norvegicus
gatttatgggtttcctcaggtcaca

SEQ ID NO: 374268 - DNA, 25 bp, Rattus norvegicus
gatttatgtcgtctaactggagcca

SEQ ID NO: 374269 - DNA, 25 bp, Rattus norvegicus
gatttatgtcgtgtaactggagcca

SEQ ID NO: 374270 - DNA, 25 bp, Rattus norvegicus
gatttatgttggctcatccttatgg

SEQ ID NO: 374271 - DNA, 25 bp, Rattus norvegicus
gatttatgttgggtcatccttatgg

SEQ ID NO: 374272 - DNA, 25 bp, Rattus norvegicus
gatttattaggccttttgatcacgc

SEQ ID NO: 374273 - DNA, 25 bp, Rattus norvegicus
gatttattaggcgttttgatcacgc

SEQ ID NO: 374274 - DNA, 25 bp, Rattus norvegicus
gatttattaggtactagcaccgagg

SEQ ID NO: 374275 - DNA, 25 bp, Rattus norvegicus
gatttattaggttctagcaccgagg

SEQ ID NO: 374276 - DNA, 25 bp, Rattus norvegicus
gatttattatccaagagcgtcccta

SEQ ID NO: 374277 - DNA, 25 bp, Rattus norvegicus
gatttattatcctagagcgtcccta

SEQ ID NO: 374278 - DNA, 25 bp, Rattus norvegicus
gatttattcaagagcccaaggtcga

SEQ ID NO: 374279 - DNA, 25 bp, Rattus norvegicus
gatttattcaagtgcccaaggtcga

SEQ ID NO: 374280 - DNA, 25 bp, Rattus norvegicus
gatttattcccaagactgcagttta

SEQ ID NO: 374281 - DNA, 25 bp, Rattus norvegicus
gatttattcccatgactgcagttta

SEQ ID NO: 374282 - DNA, 25 bp, Rattus norvegicus
gatttattccctctcctagagaaag

SEQ ID NO: 374283 - DNA, 25 bp, Rattus norvegicus
gatttattccctgtcctagagaaag

SEQ ID NO: 374284 - DNA, 25 bp, Rattus norvegicus
gatttattctgaaaggcttctagct

SEQ ID NO: 374285 - DNA, 25 bp, Rattus norvegicus
gatttattctgataggcttctagct

SEQ ID NO: 374286 - DNA, 25 bp, Rattus norvegicus
gatttattctgtatagccgtcataa

SEQ ID NO: 374287 - DNA, 25 bp, Rattus norvegicus
gatttattctgtttagccgtcataa

SEQ ID NO: 374288 - DNA, 25 bp, Rattus norvegicus
gatttattgcacatggaccctgatt

SEQ ID NO: 374289 - DNA, 25 bp, Rattus norvegicus
gatttattgcacttggaccctgatt

SEQ ID NO: 374290 - DNA, 25 bp, Rattus norvegicus
gatttattgttcctagctgcagcca

SEQ ID NO: 374291 - DNA, 25 bp, Rattus norvegicus
gatttattgttcgtagctgcagcca

SEQ ID NO: 374292 - DNA, 25 bp, Rattus norvegicus
gatttatttacaaacttctactttg

SEQ ID NO: 374293 - DNA, 25 bp, Rattus norvegicus
gatttatttacatacttctactttg

SEQ ID NO: 374294 - DNA, 25 bp, Rattus norvegicus
gatttatttcaaaacccttttagat

SEQ ID NO: 374295 - DNA, 25 bp, Rattus norvegicus
gatttatttcaatacccttttagat

SEQ ID NO: 374296 - DNA, 25 bp, Rattus norvegicus
gatttatttcccatcaagctcctat

SEQ ID NO: 374297 - DNA, 25 bp, Rattus norvegicus
gatttatttcccttcaagctcctat

SEQ ID NO: 374298 - DNA, 25 bp, Rattus norvegicus
gatttatttgctatccagagtggct

SEQ ID NO: 374299 - DNA, 25 bp, Rattus norvegicus
gatttatttgctttccagagtggct

SEQ ID NO: 374300 - DNA, 25 bp, Rattus norvegicus
gatttattttccctatagttcacaa

SEQ ID NO: 374301 - DNA, 25 bp, Rattus norvegicus
gatttattttccgtatagttcacaa

SEQ ID NO: 374302 - DNA, 25 bp, Rattus norvegicus
gatttattttggatcatggctttgg

SEQ ID NO: 374303 - DNA, 25 bp, Rattus norvegicus
gatttattttggttcatggctttgg

SEQ ID NO: 374304 - DNA, 25 bp, Rattus norvegicus
gatttatttttcatattgcttgtgt

SEQ ID NO: 374305 - DNA, 25 bp, Rattus norvegicus
gatttatttttcttattgcttgtgt

SEQ ID NO: 374306 - DNA, 25 bp, Rattus norvegicus
gatttcaaagaactgggtccctgta

SEQ ID NO: 374307 - DNA, 25 bp, Rattus norvegicus
gatttcaaagaagtgggtccctgta

SEQ ID NO: 374308 - DNA, 25 bp, Rattus norvegicus
gatttcaacaagcagcctcatggga

SEQ ID NO: 374309 - DNA, 25 bp, Rattus norvegicus
gatttcaacaaggagcctcatggga

SEQ ID NO: 374310 - DNA, 25 bp, Rattus norvegicus
gatttcaacttgaaatacaggcagt

SEQ ID NO: 374311 - DNA, 25 bp, Rattus norvegicus
gatttcaacttgtaatacaggcagt

SEQ ID NO: 374312 - DNA, 25 bp, Rattus norvegicus
gatttcaaggtacttcagaccacat

SEQ ID NO: 374313 - DNA, 25 bp, Rattus norvegicus
gatttcaaggtagttcagaccacat

SEQ ID NO: 374314 - DNA, 25 bp, Rattus norvegicus
gatttcaatctcatagaagcgagca

SEQ ID NO: 374315 - DNA, 25 bp, Rattus norvegicus
gatttcaatctcttagaagcgagca

SEQ ID NO: 374316 - DNA, 25 bp, Rattus norvegicus
gatttcaatgccagggacccaaatg

SEQ ID NO: 374317 - DNA, 25 bp, Rattus norvegicus
gatttcaatgcctgggacccaaatg

SEQ ID NO: 374318 - DNA, 25 bp, Rattus norvegicus
gatttcaatggaagtcacgtggact

SEQ ID NO: 374319 - DNA, 25 bp, Rattus norvegicus
gatttcaatggatgtcacgtggact

SEQ ID NO: 374320 - DNA, 25 bp, Rattus norvegicus
gatttcaattacctctcttaatgtg

SEQ ID NO: 374321 - DNA, 25 bp, Rattus norvegicus
gatttcaattacgtctcttaatgtg

SEQ ID NO: 374322 - DNA, 25 bp, Rattus norvegicus
gatttcaatttgagaatcctccaaa

SEQ ID NO: 374323 - DNA, 25 bp, Rattus norvegicus
gatttcaatttgtgaatcctccaaa

SEQ ID NO: 374324 - DNA, 25 bp, Rattus norvegicus
gatttcacaaagataccccttggct

SEQ ID NO: 374325 - DNA, 25 bp, Rattus norvegicus
gatttcacaaagttaccccttggct

SEQ ID NO: 374326 - DNA, 25 bp, Rattus norvegicus
gatttcacagatacctctggtcagc

SEQ ID NO: 374327 - DNA, 25 bp, Rattus norvegicus
gatttcacagattcctctggtcagc

SEQ ID NO: 374328 - DNA, 25 bp, Rattus norvegicus
gatttcacatctccatagctagacc

SEQ ID NO: 374329 - DNA, 25 bp, Rattus norvegicus
gatttcacatctgcatagctagacc

SEQ ID NO: 374330 - DNA, 25 bp, Rattus norvegicus
gatttcaccaggagactgaagccat

SEQ ID NO: 374331 - DNA, 25 bp, Rattus norvegicus
gatttcaccaggtgactgaagccat

SEQ ID NO: 374332 - DNA, 25 bp, Rattus norvegicus
gatttcacgaagagatcctgcccat

SEQ ID NO: 374333 - DNA, 25 bp, Rattus norvegicus
gatttcacgaagtgatcctgcccat

SEQ ID NO: 374334 - DNA, 25 bp, Rattus norvegicus
gatttcacgtacaccagagtaactg

SEQ ID NO: 374335 - DNA, 25 bp, Rattus norvegicus
gatttcacgtactccagagtaactg

SEQ ID NO: 374336 - DNA, 25 bp, Rattus norvegicus
gatttcactaataaccatggatggg

SEQ ID NO: 374337 - DNA, 25 bp, Rattus norvegicus
gatttcactaattaccatggatggg

SEQ ID NO: 374338 - DNA, 25 bp, Rattus norvegicus
gatttcactgctaagataggtagct

SEQ ID NO: 374339 - DNA, 25 bp, Rattus norvegicus
gatttcactgcttagataggtagct

SEQ ID NO: 374340 - DNA, 25 bp, Rattus norvegicus
gatttcactggcatgaatcagcctt

SEQ ID NO: 374341 - DNA, 25 bp, Rattus norvegicus
gatttcactggcttgaatcagcctt

SEQ ID NO: 374342 - DNA, 25 bp, Rattus norvegicus
gatttcactgtgcaagagtgccata

SEQ ID NO: 374343 - DNA, 25 bp, Rattus norvegicus
gatttcactgtggaagagtgccata

SEQ ID NO: 374344 - DNA, 25 bp, Rattus norvegicus
gatttcacttctatataggttcatt

SEQ ID NO: 374345 - DNA, 25 bp, Rattus norvegicus
gatttcacttctttataggttcatt

SEQ ID NO: 374346 - DNA, 25 bp, Rattus norvegicus
gatttcagacccaaacttcgtcaag

SEQ ID NO: 374347 - DNA, 25 bp, Rattus norvegicus
gatttcagacccatcttttttatag

SEQ ID NO: 374348 - DNA, 25 bp, Rattus norvegicus
gatttcagaccctaacttcgtcaag

SEQ ID NO: 374349 - DNA, 25 bp, Rattus norvegicus
gatttcagacccttcttttttatag

SEQ ID NO: 374350 - DNA, 25 bp, Rattus norvegicus
gatttcagagtcctcttcagtgatt

SEQ ID NO: 374351 - DNA, 25 bp, Rattus norvegicus
gatttcagagtcgtcttcagtgatt

SEQ ID NO: 374352 - DNA, 25 bp, Rattus norvegicus
gatttcagcaacacagtatctctgg

SEQ ID NO: 374353 - DNA, 25 bp, Rattus norvegicus
gatttcagcaactcagtatctctgg

SEQ ID NO: 374354 - DNA, 25 bp, Rattus norvegicus
gatttcagcatgcacataaggccat

SEQ ID NO: 374355 - DNA, 25 bp, Rattus norvegicus
gatttcagcatggacataaggccat

SEQ ID NO: 374356 - DNA, 25 bp, Rattus norvegicus
gatttcagcctcacatcagaaatat

SEQ ID NO: 374357 - DNA, 25 bp, Rattus norvegicus
gatttcagcctctcatcagaaatat

SEQ ID NO: 374358 - DNA, 25 bp, Rattus norvegicus
gatttcagctctaccttggaattct

SEQ ID NO: 374359 - DNA, 25 bp, Rattus norvegicus
gatttcagctctccagacggatgtt

SEQ ID NO: 374360 - DNA, 25 bp, Rattus norvegicus
gatttcagctctgcagacggatgtt

SEQ ID NO: 374361 - DNA, 25 bp, Rattus norvegicus
gatttcagctcttccttggaattct

SEQ ID NO: 374362 - DNA, 25 bp, Rattus norvegicus
gatttcagcttcatatgtgttctgt

SEQ ID NO: 374363 - DNA, 25 bp, Rattus norvegicus
gatttcagcttcttatgtgttctgt

SEQ ID NO: 374364 - DNA, 25 bp, Rattus norvegicus
gatttcaggattcccttccaggagc

SEQ ID NO: 374365 - DNA, 25 bp, Rattus norvegicus
gatttcaggattgccttccaggagc

SEQ ID NO: 374366 - DNA, 25 bp, Rattus norvegicus
gatttcaggcagatctgtgtatcgt

SEQ ID NO: 374367 - DNA, 25 bp, Rattus norvegicus
gatttcaggcagttctgtgtatcgt

SEQ ID NO: 374368 - DNA, 25 bp, Rattus norvegicus
gatttcagggatagcgggtactaca

SEQ ID NO: 374369 - DNA, 25 bp, Rattus norvegicus
gatttcagggattgcgggtactaca

SEQ ID NO: 374370 - DNA, 25 bp, Rattus norvegicus
gatttcaggttgctgctgcgcttga

SEQ ID NO: 374371 - DNA, 25 bp, Rattus norvegicus
gatttcaggttggtgctgcgcttga

SEQ ID NO: 374372 - DNA, 25 bp, Rattus norvegicus
gatttcagtagaattttagtcccaa

SEQ ID NO: 374373 - DNA, 25 bp, Rattus norvegicus
gatttcagtagatttttagtcccaa

SEQ ID NO: 374374 - DNA, 25 bp, Rattus norvegicus
gatttcagtagcaccacgcatacag

SEQ ID NO: 374375 - DNA, 25 bp, Rattus norvegicus
gatttcagtagcatgcgatcaacaa

SEQ ID NO: 374376 - DNA, 25 bp, Rattus norvegicus
gatttcagtagccatagaaacttgg

SEQ ID NO: 374377 - DNA, 25 bp, Rattus norvegicus
gatttcagtagcgatagaaacttgg

SEQ ID NO: 374378 - DNA, 25 bp, Rattus norvegicus
gatttcagtagctccacgcatacag

SEQ ID NO: 374379 - DNA, 25 bp, Rattus norvegicus
gatttcagtagcttgcgatcaacaa

SEQ ID NO: 374380 - DNA, 25 bp, Rattus norvegicus
gatttcagtatcattgtcttccaga

SEQ ID NO: 374381 - DNA, 25 bp, Rattus norvegicus
gatttcagtatctttgtcttccaga

SEQ ID NO: 374382 - DNA, 25 bp, Rattus norvegicus
gatttcagttttcccgaccttgact

SEQ ID NO: 374383 - DNA, 25 bp, Rattus norvegicus
gatttcagttttgccgaccttgact

SEQ ID NO: 374384 - DNA, 25 bp, Rattus norvegicus
gatttcatcaagatcgacactggga

SEQ ID NO: 374385 - DNA, 25 bp, Rattus norvegicus
gatttcatcaagttcgacactggga

SEQ ID NO: 374386 - DNA, 25 bp, Rattus norvegicus
gatttcatcatcatcgaggctgcac

SEQ ID NO: 374387 - DNA, 25 bp, Rattus norvegicus
gatttcatcatcttcgaggctgcac

SEQ ID NO: 374388 - DNA, 25 bp, Rattus norvegicus
gatttcatcccgctagcctgcttgc

SEQ ID NO: 374389 - DNA, 25 bp, Rattus norvegicus
gatttcatcccggtagcctgcttgc

SEQ ID NO: 374390 - DNA, 25 bp, Rattus norvegicus
gatttcatcgaaatccgccatcccg

SEQ ID NO: 374391 - DNA, 25 bp, Rattus norvegicus
gatttcatcgaattccgccatcccg

SEQ ID NO: 374392 - DNA, 25 bp, Rattus norvegicus
gatttcatctcaatgggcagttgct

SEQ ID NO: 374393 - DNA, 25 bp, Rattus norvegicus
gatttcatctcattgggcagttgct

SEQ ID NO: 374394 - DNA, 25 bp, Rattus norvegicus
gatttcatctctctgaacctagatt

SEQ ID NO: 374395 - DNA, 25 bp, Rattus norvegicus
gatttcatctctgtgaacctagatt

SEQ ID NO: 374396 - DNA, 25 bp, Rattus norvegicus
gatttcatctttcctccaggacgat

SEQ ID NO: 374397 - DNA, 25 bp, Rattus norvegicus
gatttcatctttgctccaggacgat

SEQ ID NO: 374398 - DNA, 25 bp, Rattus norvegicus
gatttcatgaggcacttggagcact

SEQ ID NO: 374399 - DNA, 25 bp, Rattus norvegicus
gatttcatgagggacttggagcact

SEQ ID NO: 374400 - DNA, 25 bp, Rattus norvegicus
gatttcatgagtaacagccgtcctc

SEQ ID NO: 374401 - DNA, 25 bp, Rattus norvegicus
gatttcatgagttacagccgtcctc

SEQ ID NO: 374402 - DNA, 25 bp, Rattus norvegicus
gatttcatggatcctctgccaactg

SEQ ID NO: 374403 - DNA, 25 bp, Rattus norvegicus
gatttcatggatgctctgccaactg

SEQ ID NO: 374404 - DNA, 25 bp, Rattus norvegicus
gatttcatgtgtctgtcgcagtaaa

SEQ ID NO: 374405 - DNA, 25 bp, Rattus norvegicus
gatttcatgtgtgtgtcgcagtaaa

SEQ ID NO: 374406 - DNA, 25 bp, Rattus norvegicus
gatttcatttacaccgttggaattt

SEQ ID NO: 374407 - DNA, 25 bp, Rattus norvegicus
gatttcatttactccgttggaattt

SEQ ID NO: 374408 - DNA, 25 bp, Rattus norvegicus
gatttcatttatcgcagctcagtta

SEQ ID NO: 374409 - DNA, 25 bp, Rattus norvegicus
gatttcatttatggcagctcagtta

SEQ ID NO: 374410 - DNA, 25 bp, Rattus norvegicus
gatttccaagatctcgttcctccgg

SEQ ID NO: 374411 - DNA, 25 bp, Rattus norvegicus
gatttccaagatgtcgttcctccgg

SEQ ID NO: 374412 - DNA, 25 bp, Rattus norvegicus
gatttccaatgactccttctaatta

SEQ ID NO: 374413 - DNA, 25 bp, Rattus norvegicus
gatttccaatgagtccttctaatta

SEQ ID NO: 374414 - DNA, 25 bp, Rattus norvegicus
gatttccacaaactggaaccgctgg

SEQ ID NO: 374415 - DNA, 25 bp, Rattus norvegicus
gatttccacaaagtggaaccgctgg

SEQ ID NO: 374416 - DNA, 25 bp, Rattus norvegicus
gatttccacacacgcatgtactgag

SEQ ID NO: 374417 - DNA, 25 bp, Rattus norvegicus
gatttccacacaggcatgtactgag

SEQ ID NO: 374418 - DNA, 25 bp, Rattus norvegicus
gatttccacgggatcatgggctgat

SEQ ID NO: 374419 - DNA, 25 bp, Rattus norvegicus
gatttccacgggttcatgggctgat

SEQ ID NO: 374420 - DNA, 25 bp, Rattus norvegicus
gatttccactccaactcaattcaaa

SEQ ID NO: 374421 - DNA, 25 bp, Rattus norvegicus
gatttccactcctactcaattcaaa

SEQ ID NO: 374422 - DNA, 25 bp, Rattus norvegicus
gatttccacttcatcagactgtgac

SEQ ID NO: 374423 - DNA, 25 bp, Rattus norvegicus
gatttccacttcttcagactgtgac

SEQ ID NO: 374424 - DNA, 25 bp, Rattus norvegicus
gatttccactttaagcagcttcgtt

SEQ ID NO: 374425 - DNA, 25 bp, Rattus norvegicus
gatttccacttttagcagcttcgtt

SEQ ID NO: 374426 - DNA, 25 bp, Rattus norvegicus
gatttccagaaacttttgctcacaa

SEQ ID NO: 374427 - DNA, 25 bp, Rattus norvegicus
gatttccagaaagttttgctcacaa

SEQ ID NO: 374428 - DNA, 25 bp, Rattus norvegicus
gatttccagaatctcttgaagccct

SEQ ID NO: 374429 - DNA, 25 bp, Rattus norvegicus
gatttccagaatgtcttgaagccct

SEQ ID NO: 374430 - DNA, 25 bp, Rattus norvegicus
gatttccagaggcagcaattccact

SEQ ID NO: 374431 - DNA, 25 bp, Rattus norvegicus
gatttccagagggagcaattccact

SEQ ID NO: 374432 - DNA, 25 bp, Rattus norvegicus
gatttccagatgattttcctagata

SEQ ID NO: 374433 - DNA, 25 bp, Rattus norvegicus
gatttccagatgtttttcctagata

SEQ ID NO: 374434 - DNA, 25 bp, Rattus norvegicus
gatttccagctcaatcatttttgat

SEQ ID NO: 374435 - DNA, 25 bp, Rattus norvegicus
gatttccagctctatcatttttgat

SEQ ID NO: 374436 - DNA, 25 bp, Rattus norvegicus
gatttccaggcacagtcctgactgg

SEQ ID NO: 374437 - DNA, 25 bp, Rattus norvegicus
gatttccaggcagagtcctgactgg

SEQ ID NO: 374438 - DNA, 25 bp, Rattus norvegicus
gatttccaggcccacataattgtta

SEQ ID NO: 374439 - DNA, 25 bp, Rattus norvegicus
gatttccaggccgacataattgtta

SEQ ID NO: 374440 - DNA, 25 bp, Rattus norvegicus
gatttccagtaaaccttgtcaccta

SEQ ID NO: 374441 - DNA, 25 bp, Rattus norvegicus
gatttccagtaatccttgtcaccta

SEQ ID NO: 374442 - DNA, 25 bp, Rattus norvegicus
gatttccagttcaggatcttgtcct

SEQ ID NO: 374443 - DNA, 25 bp, Rattus norvegicus
gatttccagttctggatcttgtcct

SEQ ID NO: 374444 - DNA, 25 bp, Rattus norvegicus
gatttccatgtgaatggccgtcagg

SEQ ID NO: 374445 - DNA, 25 bp, Rattus norvegicus
gatttccatgtgtatggccgtcagg

SEQ ID NO: 374446 - DNA, 25 bp, Rattus norvegicus
gatttccattaacgccaactgcatt

SEQ ID NO: 374447 - DNA, 25 bp, Rattus norvegicus
gatttccattaaggccaactgcatt

SEQ ID NO: 374448 - DNA, 25 bp, Rattus norvegicus
gatttccattatattgttccacact

SEQ ID NO: 374449 - DNA, 25 bp, Rattus norvegicus
gatttccattattttgttccacact

SEQ ID NO: 374450 - DNA, 25 bp, Rattus norvegicus
gatttccattttaaccccaacatag

SEQ ID NO: 374451 - DNA, 25 bp, Rattus norvegicus
gatttccatttttaccccaacatag

SEQ ID NO: 374452 - DNA, 25 bp, Rattus norvegicus
gatttcccaaagagtgaccctgtct

SEQ ID NO: 374453 - DNA, 25 bp, Rattus norvegicus
gatttcccaaagtgtgaccctgtct

SEQ ID NO: 374454 - DNA, 25 bp, Rattus norvegicus
gatttcccaccaatttactccaaag

SEQ ID NO: 374455 - DNA, 25 bp, Rattus norvegicus
gatttcccaccattttactccaaag

SEQ ID NO: 374456 - DNA, 25 bp, Rattus norvegicus
gatttcccacgtaatgtttatgttg

SEQ ID NO: 374457 - DNA, 25 bp, Rattus norvegicus
gatttcccacgttatgtttatgttg

SEQ ID NO: 374458 - DNA, 25 bp, Rattus norvegicus
gatttcccagtacacaagaggcccc

SEQ ID NO: 374459 - DNA, 25 bp, Rattus norvegicus
gatttcccagtagacaagaggcccc

SEQ ID NO: 374460 - DNA, 25 bp, Rattus norvegicus
gatttcccagttcatacattgtgca

SEQ ID NO: 374461 - DNA, 25 bp, Rattus norvegicus
gatttcccagttgatacattgtgca

SEQ ID NO: 374462 - DNA, 25 bp, Rattus norvegicus
gatttcccatatctgcaagtatcaa

SEQ ID NO: 374463 - DNA, 25 bp, Rattus norvegicus
gatttcccatatgtgcaagtatcaa

SEQ ID NO: 374464 - DNA, 25 bp, Rattus norvegicus
gatttccccagaacctttggcagaa

SEQ ID NO: 374465 - DNA, 25 bp, Rattus norvegicus
gatttccccagatcctttggcagaa

SEQ ID NO: 374466 - DNA, 25 bp, Rattus norvegicus
gatttccccagtctttgcaacacac

SEQ ID NO: 374467 - DNA, 25 bp, Rattus norvegicus
gatttccccagtgtttgcaacacac

SEQ ID NO: 374468 - DNA, 25 bp, Rattus norvegicus
gatttcccgagcaatttctctttta

SEQ ID NO: 374469 - DNA, 25 bp, Rattus norvegicus
gatttcccgagctatttctctttta

SEQ ID NO: 374470 - DNA, 25 bp, Rattus norvegicus
gatttcccgggaatgtggctgccca

SEQ ID NO: 374471 - DNA, 25 bp, Rattus norvegicus
gatttcccgggattgtggctgccca

SEQ ID NO: 374472 - DNA, 25 bp, Rattus norvegicus
gatttccctcttcgaggccacaaga

SEQ ID NO: 374473 - DNA, 25 bp, Rattus norvegicus
gatttccctcttggaggccacaaga

SEQ ID NO: 374474 - DNA, 25 bp, Rattus norvegicus
gatttcccttggcacgtgtagttac

SEQ ID NO: 374475 - DNA, 25 bp, Rattus norvegicus
gatttcccttgggacgtgtagttac

SEQ ID NO: 374476 - DNA, 25 bp, Rattus norvegicus
gatttccgaaataattgatggcctt

SEQ ID NO: 374477 - DNA, 25 bp, Rattus norvegicus
gatttccgaaattattgatggcctt

SEQ ID NO: 374478 - DNA, 25 bp, Rattus norvegicus
gatttccgaataattgctgtgctgc

SEQ ID NO: 374479 - DNA, 25 bp, Rattus norvegicus
gatttccgaatatttgctgtgctgc

SEQ ID NO: 374480 - DNA, 25 bp, Rattus norvegicus
gatttccgggtgaagccgtccactt

SEQ ID NO: 374481 - DNA, 25 bp, Rattus norvegicus
gatttccgggtgtagccgtccactt

SEQ ID NO: 374482 - DNA, 25 bp, Rattus norvegicus
gatttccgtactaacattacccagc

SEQ ID NO: 374483 - DNA, 25 bp, Rattus norvegicus
gatttccgtacttacattacccagc

SEQ ID NO: 374484 - DNA, 25 bp, Rattus norvegicus
gatttcctaaacataattcccagca

SEQ ID NO: 374485 - DNA, 25 bp, Rattus norvegicus
gatttcctaaacttaattcccagca

SEQ ID NO: 374486 - DNA, 25 bp, Rattus norvegicus
gatttcctaagaatgtggcagcact

SEQ ID NO: 374487 - DNA, 25 bp, Rattus norvegicus
gatttcctaagattgtggcagcact

SEQ ID NO: 374488 - DNA, 25 bp, Rattus norvegicus
gatttcctcataatggagcatccag

SEQ ID NO: 374489 - DNA, 25 bp, Rattus norvegicus
gatttcctcatattggagcatccag

SEQ ID NO: 374490 - DNA, 25 bp, Rattus norvegicus
gatttcctcggtatgcatacagtgt

SEQ ID NO: 374491 - DNA, 25 bp, Rattus norvegicus
gatttcctcggtttgcatacagtgt

SEQ ID NO: 374492 - DNA, 25 bp, Rattus norvegicus
gatttcctgatactagcctcctgaa

SEQ ID NO: 374493 - DNA, 25 bp, Rattus norvegicus
gatttcctgatagtagcctcctgaa

SEQ ID NO: 374494 - DNA, 25 bp, Rattus norvegicus
gatttcctgcttagtggttcccctc

SEQ ID NO: 374495 - DNA, 25 bp, Rattus norvegicus
gatttcctgctttgtggttcccctc

SEQ ID NO: 374496 - DNA, 25 bp, Rattus norvegicus
gatttcctgggcctcaagcgcatca

SEQ ID NO: 374497 - DNA, 25 bp, Rattus norvegicus
gatttcctgggcgtcaagcgcatca

SEQ ID NO: 374498 - DNA, 25 bp, Rattus norvegicus
gatttcctggtgcatgctcacagat

SEQ ID NO: 374499 - DNA, 25 bp, Rattus norvegicus
gatttcctggtggatgctcacagat

SEQ ID NO: 374500 - DNA, 25 bp, Rattus norvegicus
gatttcctgtgaatctatactaata

SEQ ID NO: 374501 - DNA, 25 bp, Rattus norvegicus
gatttcctgtgattctatactaata

SEQ ID NO: 374502 - DNA, 25 bp, Rattus norvegicus
gatttcctgttcacatatccttggg

SEQ ID NO: 374503 - DNA, 25 bp, Rattus norvegicus
gatttcctgttctcatatccttggg

SEQ ID NO: 374504 - DNA, 25 bp, Rattus norvegicus
gatttccttcaacaaacaaaggctc

SEQ ID NO: 374505 - DNA, 25 bp, Rattus norvegicus
gatttccttcaagaaacaaaggctc

SEQ ID NO: 374506 - DNA, 25 bp, Rattus norvegicus
gatttccttgctccctataataact

SEQ ID NO: 374507 - DNA, 25 bp, Rattus norvegicus
gatttccttgctgcctataataact

SEQ ID NO: 374508 - DNA, 25 bp, Rattus norvegicus
gatttccttggtcttctacatagtc

SEQ ID NO: 374509 - DNA, 25 bp, Rattus norvegicus
gatttccttggtgttctacatagtc

SEQ ID NO: 374510 - DNA, 25 bp, Rattus norvegicus
gatttccttgttccagttagcttca

SEQ ID NO: 374511 - DNA, 25 bp, Rattus norvegicus
gatttccttgttgcagttagcttca

SEQ ID NO: 374512 - DNA, 25 bp, Rattus norvegicus
gatttcctttcaattgtccttttct

SEQ ID NO: 374513 - DNA, 25 bp, Rattus norvegicus
gatttcctttcatttgtccttttct

SEQ ID NO: 374514 - DNA, 25 bp, Rattus norvegicus
gatttcctttctctttgtcactcat

SEQ ID NO: 374515 - DNA, 25 bp, Rattus norvegicus
gatttcctttctgtttgtcactcat

SEQ ID NO: 374516 - DNA, 25 bp, Rattus norvegicus
gatttcgaccgacttcgggatccag

SEQ ID NO: 374517 - DNA, 25 bp, Rattus norvegicus
gatttcgaccgagttcgggatccag

SEQ ID NO: 374518 - DNA, 25 bp, Rattus norvegicus
gatttcgaggtgctacagacggccc

SEQ ID NO: 374519 - DNA, 25 bp, Rattus norvegicus
gatttcgaggtggtacagacggccc

SEQ ID NO: 374520 - DNA, 25 bp, Rattus norvegicus
gatttcgatgagcaagccccaccca

SEQ ID NO: 374521 - DNA, 25 bp, Rattus norvegicus
gatttcgatgaggaagccccaccca

SEQ ID NO: 374522 - DNA, 25 bp, Rattus norvegicus
gatttcgccaatagcatatgccact

SEQ ID NO: 374523 - DNA, 25 bp, Rattus norvegicus
gatttcgccaattgcatatgccact

SEQ ID NO: 374524 - DNA, 25 bp, Rattus norvegicus
gatttcgccctaattatgtttctac

SEQ ID NO: 374525 - DNA, 25 bp, Rattus norvegicus
gatttcgccctatttatgtttctac

SEQ ID NO: 374526 - DNA, 25 bp, Rattus norvegicus
gatttcgcgtcaagatgaacttaag

SEQ ID NO: 374527 - DNA, 25 bp, Rattus norvegicus
gatttcgcgtcatgatgaacttaag

SEQ ID NO: 374528 - DNA, 25 bp, Rattus norvegicus
gatttcggtttcacaaatggcagac

SEQ ID NO: 374529 - DNA, 25 bp, Rattus norvegicus
gatttcggtttctcaaatggcagac

SEQ ID NO: 374530 - DNA, 25 bp, Rattus norvegicus
gatttcgtataaaggtaccacatgt

SEQ ID NO: 374531 - DNA, 25 bp, Rattus norvegicus
gatttcgtataatggtaccacatgt

SEQ ID NO: 374532 - DNA, 25 bp, Rattus norvegicus
gatttcgtatcaacttcattctcaa

SEQ ID NO: 374533 - DNA, 25 bp, Rattus norvegicus
gatttcgtatcatcttcattctcaa

SEQ ID NO: 374534 - DNA, 25 bp, Rattus norvegicus
gatttcgtccttatttcaatgcaga

SEQ ID NO: 374535 - DNA, 25 bp, Rattus norvegicus
gatttcgtccttttttcaatgcaga

SEQ ID NO: 374536 - DNA, 25 bp, Rattus norvegicus
gatttcgtgaatcttcagctggatg

SEQ ID NO: 374537 - DNA, 25 bp, Rattus norvegicus
gatttcgtgaatgttcagctggatg

SEQ ID NO: 374538 - DNA, 25 bp, Rattus norvegicus
gatttcgtgcaaaaccaatactcta

SEQ ID NO: 374539 - DNA, 25 bp, Rattus norvegicus
gatttcgtgcaataccaatactcta

SEQ ID NO: 374540 - DNA, 25 bp, Rattus norvegicus
gatttctaaaacactgatacttgga

SEQ ID NO: 374541 - DNA, 25 bp, Rattus norvegicus
gatttctaaaactctgatacttgga

SEQ ID NO: 374542 - DNA, 25 bp, Rattus norvegicus
gatttctaattaacacgcagactga

SEQ ID NO: 374543 - DNA, 25 bp, Rattus norvegicus
gatttctaattatcacgcagactga

SEQ ID NO: 374544 - DNA, 25 bp, Rattus norvegicus
gatttctacagaagacggagcccgg

SEQ ID NO: 374545 - DNA, 25 bp, Rattus norvegicus
gatttctacagacattctttgggat

SEQ ID NO: 374546 - DNA, 25 bp, Rattus norvegicus
gatttctacagagattctttgggat

SEQ ID NO: 374547 - DNA, 25 bp, Rattus norvegicus
gatttctacagatgacggagcccgg

SEQ ID NO: 374548 - DNA, 25 bp, Rattus norvegicus
gatttctacgagaacacatcacctt

SEQ ID NO: 374549 - DNA, 25 bp, Rattus norvegicus
gatttctacgagtacacatcacctt

SEQ ID NO: 374550 - DNA, 25 bp, Rattus norvegicus
gatttctagtcacagccattgcaca

SEQ ID NO: 374551 - DNA, 25 bp, Rattus norvegicus
gatttctagtcagagccattgcaca

SEQ ID NO: 374552 - DNA, 25 bp, Rattus norvegicus
gatttctagttaatctggtgtcagc

SEQ ID NO: 374553 - DNA, 25 bp, Rattus norvegicus
gatttctagttattctggtgtcagc

SEQ ID NO: 374554 - DNA, 25 bp, Rattus norvegicus
gatttctatcacctaactttggcaa

SEQ ID NO: 374555 - DNA, 25 bp, Rattus norvegicus
gatttctatcacgtaactttggcaa

SEQ ID NO: 374556 - DNA, 25 bp, Rattus norvegicus
gatttctatcccaaatttgtatgct

SEQ ID NO: 374557 - DNA, 25 bp, Rattus norvegicus
gatttctatccctaatttgtatgct

SEQ ID NO: 374558 - DNA, 25 bp, Rattus norvegicus
gatttctatttcaacttcttatatt

SEQ ID NO: 374559 - DNA, 25 bp, Rattus norvegicus
gatttctatttctacttcttatatt

SEQ ID NO: 374560 - DNA, 25 bp, Rattus norvegicus
gatttctcaaagatactcttctacc

SEQ ID NO: 374561 - DNA, 25 bp, Rattus norvegicus
gatttctcaaagatgcacactccct

SEQ ID NO: 374562 - DNA, 25 bp, Rattus norvegicus
gatttctcaaagttactcttctacc

SEQ ID NO: 374563 - DNA, 25 bp, Rattus norvegicus
gatttctcaaagttgcacactccct

SEQ ID NO: 374564 - DNA, 25 bp, Rattus norvegicus
gatttctcaattcctcagtttctac

SEQ ID NO: 374565 - DNA, 25 bp, Rattus norvegicus
gatttctcaattctgtttgcaatgc

SEQ ID NO: 374566 - DNA, 25 bp, Rattus norvegicus
gatttctcaattgctcagtttctac

SEQ ID NO: 374567 - DNA, 25 bp, Rattus norvegicus
gatttctcaattgtgtttgcaatgc

SEQ ID NO: 374568 - DNA, 25 bp, Rattus norvegicus
gatttctcacaacagaccgggccct

SEQ ID NO: 374569 - DNA, 25 bp, Rattus norvegicus
gatttctcacaagagaccgggccct

SEQ ID NO: 374570 - DNA, 25 bp, Rattus norvegicus
gatttctcacttactcacaaacatt

SEQ ID NO: 374571 - DNA, 25 bp, Rattus norvegicus
gatttctcactttctcacaaacatt

SEQ ID NO: 374572 - DNA, 25 bp, Rattus norvegicus
gatttctcagagcaaaagttactat

SEQ ID NO: 374573 - DNA, 25 bp, Rattus norvegicus
gatttctcagaggaaaagttactat

SEQ ID NO: 374574 - DNA, 25 bp, Rattus norvegicus
gatttctcagccaaatatccagcaa

SEQ ID NO: 374575 - DNA, 25 bp, Rattus norvegicus
gatttctcagcctaatatccagcaa

SEQ ID NO: 374576 - DNA, 25 bp, Rattus norvegicus
gatttctcagtaacctctactcatt

SEQ ID NO: 374577 - DNA, 25 bp, Rattus norvegicus
gatttctcagtatcctctactcatt

SEQ ID NO: 374578 - DNA, 25 bp, Rattus norvegicus
gatttctcagtcattgtggtacata

SEQ ID NO: 374579 - DNA, 25 bp, Rattus norvegicus
gatttctcagtctttgtggtacata

SEQ ID NO: 374580 - DNA, 25 bp, Rattus norvegicus
gatttctcataaattgtgctcaggc

SEQ ID NO: 374581 - DNA, 25 bp, Rattus norvegicus
gatttctcataatttgtgctcaggc

SEQ ID NO: 374582 - DNA, 25 bp, Rattus norvegicus
gatttctcatatatcatgacacatg

SEQ ID NO: 374583 - DNA, 25 bp, Rattus norvegicus
gatttctcatatttcatgacacatg

SEQ ID NO: 374584 - DNA, 25 bp, Rattus norvegicus
gatttctcatgaaaatcacccagaa

SEQ ID NO: 374585 - DNA, 25 bp, Rattus norvegicus
gatttctcatgataatcacccagaa

SEQ ID NO: 374586 - DNA, 25 bp, Rattus norvegicus
gatttctcattcattctgtttctag

SEQ ID NO: 374587 - DNA, 25 bp, Rattus norvegicus
gatttctcattctttctgtttctag

SEQ ID NO: 374588 - DNA, 25 bp, Rattus norvegicus
gatttctcatttccagtctcttgcg

SEQ ID NO: 374589 - DNA, 25 bp, Rattus norvegicus
gatttctcatttgcagtctcttgcg

SEQ ID NO: 374590 - DNA, 25 bp, Rattus norvegicus
gatttctccacaaggctagatgtat

SEQ ID NO: 374591 - DNA, 25 bp, Rattus norvegicus
gatttctccacatggctagatgtat

SEQ ID NO: 374592 - DNA, 25 bp, Rattus norvegicus
gatttctccagaagatacccttcct

SEQ ID NO: 374593 - DNA, 25 bp, Rattus norvegicus
gatttctccagatgatacccttcct

SEQ ID NO: 374594 - DNA, 25 bp, Rattus norvegicus
gatttctcccagacatttcctgaga

SEQ ID NO: 374595 - DNA, 25 bp, Rattus norvegicus
gatttctcccagtcatttcctgaga

SEQ ID NO: 374596 - DNA, 25 bp, Rattus norvegicus
gatttctccccgagtcatgataaat

SEQ ID NO: 374597 - DNA, 25 bp, Rattus norvegicus
gatttctccccgtgtcatgataaat

SEQ ID NO: 374598 - DNA, 25 bp, Rattus norvegicus
gatttctcctatcaactgcatccag

SEQ ID NO: 374599 - DNA, 25 bp, Rattus norvegicus
gatttctcctatgaactgcatccag

SEQ ID NO: 374600 - DNA, 25 bp, Rattus norvegicus
gatttctctcagatgttccttgatg

SEQ ID NO: 374601 - DNA, 25 bp, Rattus norvegicus
gatttctctcagttgttccttgatg

SEQ ID NO: 374602 - DNA, 25 bp, Rattus norvegicus
gatttctctgaaaatgctgccaaac

SEQ ID NO: 374603 - DNA, 25 bp, Rattus norvegicus
gatttctctgaatatgctgccaaac

SEQ ID NO: 374604 - DNA, 25 bp, Rattus norvegicus
gatttctctgcacttcatattttat

SEQ ID NO: 374605 - DNA, 25 bp, Rattus norvegicus
gatttctctgcagttcatattttat

SEQ ID NO: 374606 - DNA, 25 bp, Rattus norvegicus
gatttctctgtaacaagagcccctg

SEQ ID NO: 374607 - DNA, 25 bp, Rattus norvegicus
gatttctctgtatcaagagcccctg

SEQ ID NO: 374608 - DNA, 25 bp, Rattus norvegicus
gatttctctgtcagggtgagcacac

SEQ ID NO: 374609 - DNA, 25 bp, Rattus norvegicus
gatttctctgtctgggtgagcacac

SEQ ID NO: 374610 - DNA, 25 bp, Rattus norvegicus
gatttctcttaaatccattcgtgta

SEQ ID NO: 374611 - DNA, 25 bp, Rattus norvegicus
gatttctcttaattccattcgtgta

SEQ ID NO: 374612 - DNA, 25 bp, Rattus norvegicus
gatttctcttcacgtaacactacag

SEQ ID NO: 374613 - DNA, 25 bp, Rattus norvegicus
gatttctcttcacgtcagatggtat

SEQ ID NO: 374614 - DNA, 25 bp, Rattus norvegicus
gatttctcttcaggtaacactacag

SEQ ID NO: 374615 - DNA, 25 bp, Rattus norvegicus
gatttctcttcaggtcagatggtat

SEQ ID NO: 374616 - DNA, 25 bp, Rattus norvegicus
gatttctcttgaccgcgtttcggag

SEQ ID NO: 374617 - DNA, 25 bp, Rattus norvegicus
gatttctcttgagcgcgtttcggag

SEQ ID NO: 374618 - DNA, 25 bp, Rattus norvegicus
gatttctcttttcccttgtgctagg

SEQ ID NO: 374619 - DNA, 25 bp, Rattus norvegicus
gatttctcttttcctgaccggagca

SEQ ID NO: 374620 - DNA, 25 bp, Rattus norvegicus
gatttctcttttgccttgtgctagg

SEQ ID NO: 374621 - DNA, 25 bp, Rattus norvegicus
gatttctcttttgctgaccggagca

SEQ ID NO: 374622 - DNA, 25 bp, Rattus norvegicus
gatttctgaaaaaatgacctaacaa

SEQ ID NO: 374623 - DNA, 25 bp, Rattus norvegicus
gatttctgaaaatatgacctaacaa

SEQ ID NO: 374624 - DNA, 25 bp, Rattus norvegicus
gatttctgaacaagctagtccctgc

SEQ ID NO: 374625 - DNA, 25 bp, Rattus norvegicus
gatttctgaacatgctagtccctgc

SEQ ID NO: 374626 - DNA, 25 bp, Rattus norvegicus
gatttctgaactcgttctgcgcatg

SEQ ID NO: 374627 - DNA, 25 bp, Rattus norvegicus
gatttctgaactggttctgcgcatg

SEQ ID NO: 374628 - DNA, 25 bp, Rattus norvegicus
gatttctgacttaactgactttaca

SEQ ID NO: 374629 - DNA, 25 bp, Rattus norvegicus
gatttctgactttactgactttaca

SEQ ID NO: 374630 - DNA, 25 bp, Rattus norvegicus
gatttctgagttattagtgctgtct

SEQ ID NO: 374631 - DNA, 25 bp, Rattus norvegicus
gatttctgagtttttagtgctgtct

SEQ ID NO: 374632 - DNA, 25 bp, Rattus norvegicus
gatttctgatttctacccgagtgat

SEQ ID NO: 374633 - DNA, 25 bp, Rattus norvegicus
gatttctgatttgtacccgagtgat

SEQ ID NO: 374634 - DNA, 25 bp, Rattus norvegicus
gatttctgccaaaacgagtcctgca

SEQ ID NO: 374635 - DNA, 25 bp, Rattus norvegicus
gatttctgccaatacgagtcctgca

SEQ ID NO: 374636 - DNA, 25 bp, Rattus norvegicus
gatttctgcccacgagagaggcatt

SEQ ID NO: 374637 - DNA, 25 bp, Rattus norvegicus
gatttctgcccaggagagaggcatt

SEQ ID NO: 374638 - DNA, 25 bp, Rattus norvegicus
gatttctgctcgaggcagtacactg

SEQ ID NO: 374639 - DNA, 25 bp, Rattus norvegicus
gatttctgctcgtggcagtacactg

SEQ ID NO: 374640 - DNA, 25 bp, Rattus norvegicus
gatttctgctttcatctatgtatgc

SEQ ID NO: 374641 - DNA, 25 bp, Rattus norvegicus
gatttctgctttgatctatgtatgc

SEQ ID NO: 374642 - DNA, 25 bp, Rattus norvegicus
gatttctggagacaacctgtcaata

SEQ ID NO: 374643 - DNA, 25 bp, Rattus norvegicus
gatttctggagagaacctgtcaata

SEQ ID NO: 374644 - DNA, 25 bp, Rattus norvegicus
gatttctggcatacttttaagtatt

SEQ ID NO: 374645 - DNA, 25 bp, Rattus norvegicus
gatttctggcattcttttaagtatt

SEQ ID NO: 374646 - DNA, 25 bp, Rattus norvegicus
gatttctggcttatacctcttccaa

SEQ ID NO: 374647 - DNA, 25 bp, Rattus norvegicus
gatttctggcttttacctcttccaa

SEQ ID NO: 374648 - DNA, 25 bp, Rattus norvegicus
gatttctggtctagagcacagccta

SEQ ID NO: 374649 - DNA, 25 bp, Rattus norvegicus
gatttctggtcttgagcacagccta

SEQ ID NO: 374650 - DNA, 25 bp, Rattus norvegicus
gatttctggtgcaaaattggtcatt

SEQ ID NO: 374651 - DNA, 25 bp, Rattus norvegicus
gatttctggtgctaaattggtcatt

SEQ ID NO: 374652 - DNA, 25 bp, Rattus norvegicus
gatttctgtagtactgaggatcaaa

SEQ ID NO: 374653 - DNA, 25 bp, Rattus norvegicus
gatttctgtagttctgaggatcaaa

SEQ ID NO: 374654 - DNA, 25 bp, Rattus norvegicus
gatttctgtcaccttttaacccttg

SEQ ID NO: 374655 - DNA, 25 bp, Rattus norvegicus
gatttctgtcacgttttaacccttg

SEQ ID NO: 374656 - DNA, 25 bp, Rattus norvegicus
gatttctgtcttaacaaactgtaga

SEQ ID NO: 374657 - DNA, 25 bp, Rattus norvegicus
gatttctgtctttacaaactgtaga

SEQ ID NO: 374658 - DNA, 25 bp, Rattus norvegicus
gatttctgtgtcagaagtccaccct

SEQ ID NO: 374659 - DNA, 25 bp, Rattus norvegicus
gatttctgtgtctgaagtccaccct

SEQ ID NO: 374660 - DNA, 25 bp, Rattus norvegicus
gatttctgtgttcattgtgctttgc

SEQ ID NO: 374661 - DNA, 25 bp, Rattus norvegicus
gatttctgtgttgattgtgctttgc

SEQ ID NO: 374662 - DNA, 25 bp, Rattus norvegicus
gatttctgttgtacctttaaacttg

SEQ ID NO: 374663 - DNA, 25 bp, Rattus norvegicus
gatttctgttgttcctttaaacttg

SEQ ID NO: 374664 - DNA, 25 bp, Rattus norvegicus
gatttcttaactctcaatgctgaac

SEQ ID NO: 374665 - DNA, 25 bp, Rattus norvegicus
gatttcttaactgtcaatgctgaac

SEQ ID NO: 374666 - DNA, 25 bp, Rattus norvegicus
gatttcttagaaatgctgttcactg

SEQ ID NO: 374667 - DNA, 25 bp, Rattus norvegicus
gatttcttagaattgctgttcactg

SEQ ID NO: 374668 - DNA, 25 bp, Rattus norvegicus
gatttcttcaagaccttgaggccct

SEQ ID NO: 374669 - DNA, 25 bp, Rattus norvegicus
gatttcttcaagtccttgaggccct

SEQ ID NO: 374670 - DNA, 25 bp, Rattus norvegicus
gatttcttcatcaacattttcttta

SEQ ID NO: 374671 - DNA, 25 bp, Rattus norvegicus
gatttcttcatcatgcattctgcat

SEQ ID NO: 374672 - DNA, 25 bp, Rattus norvegicus
gatttcttcatctacattttcttta

SEQ ID NO: 374673 - DNA, 25 bp, Rattus norvegicus
gatttcttcatcttgcattctgcat

SEQ ID NO: 374674 - DNA, 25 bp, Rattus norvegicus
gatttcttccggcttcatgagtcta

SEQ ID NO: 374675 - DNA, 25 bp, Rattus norvegicus
gatttcttccgggttcatgagtcta

SEQ ID NO: 374676 - DNA, 25 bp, Rattus norvegicus
gatttcttcctcataccggagacag

SEQ ID NO: 374677 - DNA, 25 bp, Rattus norvegicus
gatttcttcctcttaccggagacag

SEQ ID NO: 374678 - DNA, 25 bp, Rattus norvegicus
gatttcttccttatccggaaatgca

SEQ ID NO: 374679 - DNA, 25 bp, Rattus norvegicus
gatttcttccttcagttctgtgact

SEQ ID NO: 374680 - DNA, 25 bp, Rattus norvegicus
gatttcttccttgagttctgtgact

SEQ ID NO: 374681 - DNA, 25 bp, Rattus norvegicus
gatttcttccttttccggaaatgca

SEQ ID NO: 374682 - DNA, 25 bp, Rattus norvegicus
gatttcttctacaggtttgggctca

SEQ ID NO: 374683 - DNA, 25 bp, Rattus norvegicus
gatttcttctactggtttgggctca

SEQ ID NO: 374684 - DNA, 25 bp, Rattus norvegicus
gatttcttctcactgcatatgtatt

SEQ ID NO: 374685 - DNA, 25 bp, Rattus norvegicus
gatttcttctcagtgcatatgtatt

SEQ ID NO: 374686 - DNA, 25 bp, Rattus norvegicus
gatttcttctccatggattgctatg

SEQ ID NO: 374687 - DNA, 25 bp, Rattus norvegicus
gatttcttctccttggattgctatg

SEQ ID NO: 374688 - DNA, 25 bp, Rattus norvegicus
gatttcttcttccaagttatctcta

SEQ ID NO: 374689 - DNA, 25 bp, Rattus norvegicus
gatttcttcttcgaagttatctcta

SEQ ID NO: 374690 - DNA, 25 bp, Rattus norvegicus
gatttcttgaagattactgaagtct

SEQ ID NO: 374691 - DNA, 25 bp, Rattus norvegicus
gatttcttgaagtttactgaagtct

SEQ ID NO: 374692 - DNA, 25 bp, Rattus norvegicus
gatttcttgcttcatgccagcttga

SEQ ID NO: 374693 - DNA, 25 bp, Rattus norvegicus
gatttcttgcttgatgccagcttga

SEQ ID NO: 374694 - DNA, 25 bp, Rattus norvegicus
gatttcttggaacggcagccattca

SEQ ID NO: 374695 - DNA, 25 bp, Rattus norvegicus
gatttcttggaagggcagccattca

SEQ ID NO: 374696 - DNA, 25 bp, Rattus norvegicus
gatttcttggccatcagtttttatt

SEQ ID NO: 374697 - DNA, 25 bp, Rattus norvegicus
gatttcttggccttcagtttttatt

SEQ ID NO: 374698 - DNA, 25 bp, Rattus norvegicus
gatttcttgggtcgcttctgtccaa

SEQ ID NO: 374699 - DNA, 25 bp, Rattus norvegicus
gatttcttgggtggcttctgtccaa

SEQ ID NO: 374700 - DNA, 25 bp, Rattus norvegicus
gatttcttggtaactcagaacagtt

SEQ ID NO: 374701 - DNA, 25 bp, Rattus norvegicus
gatttcttggtatctcagaacagtt

SEQ ID NO: 374702 - DNA, 25 bp, Rattus norvegicus
gatttcttggtcatttctcaacctg

SEQ ID NO: 374703 - DNA, 25 bp, Rattus norvegicus
gatttcttggtcttttctcaacctg

SEQ ID NO: 374704 - DNA, 25 bp, Rattus norvegicus
gatttcttgtttctagaccaccgtt

SEQ ID NO: 374705 - DNA, 25 bp, Rattus norvegicus
gatttcttgtttgtagaccaccgtt

SEQ ID NO: 374706 - DNA, 25 bp, Rattus norvegicus
gatttctttacaatactctggatga

SEQ ID NO: 374707 - DNA, 25 bp, Rattus norvegicus
gatttctttacattactctggatga

SEQ ID NO: 374708 - DNA, 25 bp, Rattus norvegicus
gatttctttactacagtgcactgga

SEQ ID NO: 374709 - DNA, 25 bp, Rattus norvegicus
gatttctttacttcagtgcactgga

SEQ ID NO: 374710 - DNA, 25 bp, Rattus norvegicus
gatttctttagcagtttgtcggatt

SEQ ID NO: 374711 - DNA, 25 bp, Rattus norvegicus
gatttctttagctgtttgtcggatt

SEQ ID NO: 374712 - DNA, 25 bp, Rattus norvegicus
gatttctttctcacagctttaatgg

SEQ ID NO: 374713 - DNA, 25 bp, Rattus norvegicus
gatttctttctctcagctttaatgg

SEQ ID NO: 374714 - DNA, 25 bp, Rattus norvegicus
gatttctttgaacacctggaacctt

SEQ ID NO: 374715 - DNA, 25 bp, Rattus norvegicus
gatttctttgaagacctggaacctt

SEQ ID NO: 374716 - DNA, 25 bp, Rattus norvegicus
gatttctttgcaacaaatgccgata

SEQ ID NO: 374717 - DNA, 25 bp, Rattus norvegicus
gatttctttgcatcaaatgccgata

SEQ ID NO: 374718 - DNA, 25 bp, Rattus norvegicus
gatttcttttaactgagcgcacctt

SEQ ID NO: 374719 - DNA, 25 bp, Rattus norvegicus
gatttcttttaagtgagcgcacctt

SEQ ID NO: 374720 - DNA, 25 bp, Rattus norvegicus
gatttctttttaccagactggacag

SEQ ID NO: 374721 - DNA, 25 bp, Rattus norvegicus
gatttctttttagcagactggacag

SEQ ID NO: 374722 - DNA, 25 bp, Rattus norvegicus
gatttgaaacgactccttgctgtga

SEQ ID NO: 374723 - DNA, 25 bp, Rattus norvegicus
gatttgaaacgagtccttgctgtga

SEQ ID NO: 374724 - DNA, 25 bp, Rattus norvegicus
gatttgaacaccattagagaagact

SEQ ID NO: 374725 - DNA, 25 bp, Rattus norvegicus
gatttgaacacctttagagaagact

SEQ ID NO: 374726 - DNA, 25 bp, Rattus norvegicus
gatttgaacccaacatgtggtgtac

SEQ ID NO: 374727 - DNA, 25 bp, Rattus norvegicus
gatttgaacccatcatgtggtgtac

SEQ ID NO: 374728 - DNA, 25 bp, Rattus norvegicus
gatttgaactcacttggtcaggctt

SEQ ID NO: 374729 - DNA, 25 bp, Rattus norvegicus
gatttgaactcagttggtcaggctt

SEQ ID NO: 374730 - DNA, 25 bp, Rattus norvegicus
gatttgaactggctttatcctaact

SEQ ID NO: 374731 - DNA, 25 bp, Rattus norvegicus
gatttgaactgggtttatcctaact

SEQ ID NO: 374732 - DNA, 25 bp, Rattus norvegicus
gatttgacagaaccggaactctctt

SEQ ID NO: 374733 - DNA, 25 bp, Rattus norvegicus
gatttgacagaagcggaactctctt

SEQ ID NO: 374734 - DNA, 25 bp, Rattus norvegicus
gatttgactcctactacacaaggga

SEQ ID NO: 374735 - DNA, 25 bp, Rattus norvegicus
gatttgactccttctacacaaggga

SEQ ID NO: 374736 - DNA, 25 bp, Rattus norvegicus
gatttgactgctctaggagtttctt

SEQ ID NO: 374737 - DNA, 25 bp, Rattus norvegicus
gatttgactgctgtaggagtttctt

SEQ ID NO: 374738 - DNA, 25 bp, Rattus norvegicus
gatttgactgtgattttgccttttg

SEQ ID NO: 374739 - DNA, 25 bp, Rattus norvegicus
gatttgactgtgtttttgccttttg

SEQ ID NO: 374740 - DNA, 25 bp, Rattus norvegicus
gatttgacttttcctattgctcttc

SEQ ID NO: 374741 - DNA, 25 bp, Rattus norvegicus
gatttgacttttgctattgctcttc

SEQ ID NO: 374742 - DNA, 25 bp, Rattus norvegicus
gatttgagacacctctgtcttcatt

SEQ ID NO: 374743 - DNA, 25 bp, Rattus norvegicus
gatttgagacacgtctgtcttcatt

SEQ ID NO: 374744 - DNA, 25 bp, Rattus norvegicus
gatttgagatgtccgttcttcctcc

SEQ ID NO: 374745 - DNA, 25 bp, Rattus norvegicus
gatttgagatgtgcgttcttcctcc

SEQ ID NO: 374746 - DNA, 25 bp, Rattus norvegicus
gatttgagcccactagtacccggaa

SEQ ID NO: 374747 - DNA, 25 bp, Rattus norvegicus
gatttgagcccagtagtacccggaa

SEQ ID NO: 374748 - DNA, 25 bp, Rattus norvegicus
gatttgagctgcaaattctgcaagg

SEQ ID NO: 374749 - DNA, 25 bp, Rattus norvegicus
gatttgagctgctaattctgcaagg

SEQ ID NO: 374750 - DNA, 25 bp, Rattus norvegicus
gatttgaggatccagctgccagcat

SEQ ID NO: 374751 - DNA, 25 bp, Rattus norvegicus
gatttgaggatcgagctgccagcat

SEQ ID NO: 374752 - DNA, 25 bp, Rattus norvegicus
gatttgaggcttattgcgatctgtt

SEQ ID NO: 374753 - DNA, 25 bp, Rattus norvegicus
gatttgaggctttttgcgatctgtt

SEQ ID NO: 374754 - DNA, 25 bp, Rattus norvegicus
gatttgagtcttaacatgtggtgga

SEQ ID NO: 374755 - DNA, 25 bp, Rattus norvegicus
gatttgagtctttacatgtggtgga

SEQ ID NO: 374756 - DNA, 25 bp, Rattus norvegicus
gatttgataaagagccagtgccctg

SEQ ID NO: 374757 - DNA, 25 bp, Rattus norvegicus
gatttgataaagtgccagtgccctg

SEQ ID NO: 374758 - DNA, 25 bp, Rattus norvegicus
gatttgatagccattgttgtacctt

SEQ ID NO: 374759 - DNA, 25 bp, Rattus norvegicus
gatttgatagcctttgttgtacctt

SEQ ID NO: 374760 - DNA, 25 bp, Rattus norvegicus
gatttgatcatccacacagcattat

SEQ ID NO: 374761 - DNA, 25 bp, Rattus norvegicus
gatttgatcatcgacacagcattat

SEQ ID NO: 374762 - DNA, 25 bp, Rattus norvegicus
gatttgatctcaacctccgggagaa

SEQ ID NO: 374763 - DNA, 25 bp, Rattus norvegicus
gatttgatctcatcctccgggagaa

SEQ ID NO: 374764 - DNA, 25 bp, Rattus norvegicus
gatttgatcttacgaggtgacatct

SEQ ID NO: 374765 - DNA, 25 bp, Rattus norvegicus
gatttgatcttaggaggtgacatct

SEQ ID NO: 374766 - DNA, 25 bp, Rattus norvegicus
gatttgatgaaccagctttgcacct

SEQ ID NO: 374767 - DNA, 25 bp, Rattus norvegicus
gatttgatgaacgagctttgcacct

SEQ ID NO: 374768 - DNA, 25 bp, Rattus norvegicus
gatttgatgactactgtaaccttaa

SEQ ID NO: 374769 - DNA, 25 bp, Rattus norvegicus
gatttgatgacttctgtaaccttaa

SEQ ID NO: 374770 - DNA, 25 bp, Rattus norvegicus
gatttgattaagactctgtcttgta

SEQ ID NO: 374771 - DNA, 25 bp, Rattus norvegicus
gatttgattaagtctctgtcttgta

SEQ ID NO: 374772 - DNA, 25 bp, Rattus norvegicus
gatttgattcatccactcttccata

SEQ ID NO: 374773 - DNA, 25 bp, Rattus norvegicus
gatttgattcatccctaagtagcag

SEQ ID NO: 374774 - DNA, 25 bp, Rattus norvegicus
gatttgattcatgcactcttccata

SEQ ID NO: 374775 - DNA, 25 bp, Rattus norvegicus
gatttgattcatgcctaagtagcag

SEQ ID NO: 374776 - DNA, 25 bp, Rattus norvegicus
gatttgattgagacatcccatctaa

SEQ ID NO: 374777 - DNA, 25 bp, Rattus norvegicus
gatttgattgagtcatcccatctaa

SEQ ID NO: 374778 - DNA, 25 bp, Rattus norvegicus
gatttgatttctacatagaacgagg

SEQ ID NO: 374779 - DNA, 25 bp, Rattus norvegicus
gatttgatttcttcatagaacgagg

SEQ ID NO: 374780 - DNA, 25 bp, Rattus norvegicus
gatttgattttaaagtccctgtgga

SEQ ID NO: 374781 - DNA, 25 bp, Rattus norvegicus
gatttgattttatagtccctgtgga

SEQ ID NO: 374782 - DNA, 25 bp, Rattus norvegicus
gatttgcaactgcatcgtgaaactt

SEQ ID NO: 374783 - DNA, 25 bp, Rattus norvegicus
gatttgcaactggatcgtgaaactt

SEQ ID NO: 374784 - DNA, 25 bp, Rattus norvegicus
gatttgcacccaacttacagacttt

SEQ ID NO: 374785 - DNA, 25 bp, Rattus norvegicus
gatttgcacccatcttacagacttt

SEQ ID NO: 374786 - DNA, 25 bp, Rattus norvegicus
gatttgcactttcaacgcatagtaa

SEQ ID NO: 374787 - DNA, 25 bp, Rattus norvegicus
gatttgcactttgaacgcatagtaa

SEQ ID NO: 374788 - DNA, 25 bp, Rattus norvegicus
gatttgcagagactactgactttat

SEQ ID NO: 374789 - DNA, 25 bp, Rattus norvegicus
gatttgcagagagtactgactttat

SEQ ID NO: 374790 - DNA, 25 bp, Rattus norvegicus
gatttgcagctaagtaacttccgtt

SEQ ID NO: 374791 - DNA, 25 bp, Rattus norvegicus
gatttgcagctatgtaacttccgtt

SEQ ID NO: 374792 - DNA, 25 bp, Rattus norvegicus
gatttgcaggaacttacgttacaca

SEQ ID NO: 374793 - DNA, 25 bp, Rattus norvegicus
gatttgcaggaagttacgttacaca

SEQ ID NO: 374794 - DNA, 25 bp, Rattus norvegicus
gatttgcaggcacaggaacacatct

SEQ ID NO: 374795 - DNA, 25 bp, Rattus norvegicus
gatttgcaggcagaggaacacatct

SEQ ID NO: 374796 - DNA, 25 bp, Rattus norvegicus
gatttgcaggcccttatgttttaca

SEQ ID NO: 374797 - DNA, 25 bp, Rattus norvegicus
gatttgcaggccgttatgttttaca

SEQ ID NO: 374798 - DNA, 25 bp, Rattus norvegicus
gatttgcaggtgagagctgagccac

SEQ ID NO: 374799 - DNA, 25 bp, Rattus norvegicus
gatttgcaggtgtgagctgagccac

SEQ ID NO: 374800 - DNA, 25 bp, Rattus norvegicus
gatttgcagtgaagtgtcttccggt

SEQ ID NO: 374801 - DNA, 25 bp, Rattus norvegicus
gatttgcagtgatgtgtcttccggt

SEQ ID NO: 374802 - DNA, 25 bp, Rattus norvegicus
gatttgcatcatctagaaggctctg

SEQ ID NO: 374803 - DNA, 25 bp, Rattus norvegicus
gatttgcatcatgtagaaggctctg

SEQ ID NO: 374804 - DNA, 25 bp, Rattus norvegicus
gatttgcatctccttacatagctgt

SEQ ID NO: 374805 - DNA, 25 bp, Rattus norvegicus
gatttgcatctcgttacatagctgt

SEQ ID NO: 374806 - DNA, 25 bp, Rattus norvegicus
gatttgcattgcaacaggtgacatt

SEQ ID NO: 374807 - DNA, 25 bp, Rattus norvegicus
gatttgcattgctacaggtgacatt

SEQ ID NO: 374808 - DNA, 25 bp, Rattus norvegicus
gatttgccaatgacgtagtcccaga

SEQ ID NO: 374809 - DNA, 25 bp, Rattus norvegicus
gatttgccaatgtcgtagtcccaga

SEQ ID NO: 374810 - DNA, 25 bp, Rattus norvegicus
gatttgccaccgaagcttcaaaaga

SEQ ID NO: 374811 - DNA, 25 bp, Rattus norvegicus
gatttgccaccgtagcttcaaaaga

SEQ ID NO: 374812 - DNA, 25 bp, Rattus norvegicus
gatttgccaggaactagtctgtcta

SEQ ID NO: 374813 - DNA, 25 bp, Rattus norvegicus
gatttgccaggatctagtctgtcta

SEQ ID NO: 374814 - DNA, 25 bp, Rattus norvegicus
gatttgccaggcatttcgtgcagaa

SEQ ID NO: 374815 - DNA, 25 bp, Rattus norvegicus
gatttgccaggcttttcgtgcagaa

SEQ ID NO: 374816 - DNA, 25 bp, Rattus norvegicus
gatttgccccttacattatttagat

SEQ ID NO: 374817 - DNA, 25 bp, Rattus norvegicus
gatttgcccctttcattatttagat

SEQ ID NO: 374818 - DNA, 25 bp, Rattus norvegicus
gatttgcccgaaacttggctgagta

SEQ ID NO: 374819 - DNA, 25 bp, Rattus norvegicus
gatttgcccgaatcttggctgagta

SEQ ID NO: 374820 - DNA, 25 bp, Rattus norvegicus
gatttgcccttccagacaacacagt

SEQ ID NO: 374821 - DNA, 25 bp, Rattus norvegicus
gatttgcccttcgagacaacacagt

SEQ ID NO: 374822 - DNA, 25 bp, Rattus norvegicus
gatttgcctatgaatggtgttgaca

SEQ ID NO: 374823 - DNA, 25 bp, Rattus norvegicus
gatttgcctatgtatggtgttgaca

SEQ ID NO: 374824 - DNA, 25 bp, Rattus norvegicus
gatttgcctgcaatgatttttatat

SEQ ID NO: 374825 - DNA, 25 bp, Rattus norvegicus
gatttgcctgcattgatttttatat

SEQ ID NO: 374826 - DNA, 25 bp, Rattus norvegicus
gatttgcctgttattgacatttcat

SEQ ID NO: 374827 - DNA, 25 bp, Rattus norvegicus
gatttgcctgtttttgacatttcat

SEQ ID NO: 374828 - DNA, 25 bp, Rattus norvegicus
gatttgccttctcaagtctgggact

SEQ ID NO: 374829 - DNA, 25 bp, Rattus norvegicus
gatttgccttctgaagtctgggact

SEQ ID NO: 374830 - DNA, 25 bp, Rattus norvegicus
gatttgccttttcagcgatttcgaa

SEQ ID NO: 374831 - DNA, 25 bp, Rattus norvegicus
gatttgccttttcgtgatgctgaat

SEQ ID NO: 374832 - DNA, 25 bp, Rattus norvegicus
gatttgccttttgagcgatttcgaa

SEQ ID NO: 374833 - DNA, 25 bp, Rattus norvegicus
gatttgccttttggtgatgctgaat

SEQ ID NO: 374834 - DNA, 25 bp, Rattus norvegicus
gatttgcgtcatatcctatttcact

SEQ ID NO: 374835 - DNA, 25 bp, Rattus norvegicus
gatttgcgtcatttcctatttcact

SEQ ID NO: 374836 - DNA, 25 bp, Rattus norvegicus
gatttgctaagtctggtctttgcca

SEQ ID NO: 374837 - DNA, 25 bp, Rattus norvegicus
gatttgctaagtgtggtctttgcca

SEQ ID NO: 374838 - DNA, 25 bp, Rattus norvegicus
gatttgctacaaaacgaagtccata

SEQ ID NO: 374839 - DNA, 25 bp, Rattus norvegicus
gatttgctacaatacgaagtccata

SEQ ID NO: 374840 - DNA, 25 bp, Rattus norvegicus
gatttgctactcaggctaggagacc

SEQ ID NO: 374841 - DNA, 25 bp, Rattus norvegicus
gatttgctactctggctaggagacc

SEQ ID NO: 374842 - DNA, 25 bp, Rattus norvegicus
gatttgctcaaaattctcattgtaa

SEQ ID NO: 374843 - DNA, 25 bp, Rattus norvegicus
gatttgctcaaatttctcattgtaa

SEQ ID NO: 374844 - DNA, 25 bp, Rattus norvegicus
gatttgctcataccacatgtctgtg

SEQ ID NO: 374845 - DNA, 25 bp, Rattus norvegicus
gatttgctcatagcacatgtctgtg

SEQ ID NO: 374846 - DNA, 25 bp, Rattus norvegicus
gatttgctccacctcagtatttgaa

SEQ ID NO: 374847 - DNA, 25 bp, Rattus norvegicus
gatttgctccacgtcagtatttgaa

SEQ ID NO: 374848 - DNA, 25 bp, Rattus norvegicus
gatttgctcctgattttgtatgtgt

SEQ ID NO: 374849 - DNA, 25 bp, Rattus norvegicus
gatttgctcctgtttttgtatgtgt

SEQ ID NO: 374850 - DNA, 25 bp, Rattus norvegicus
gatttgctctccatgttgaattcta

SEQ ID NO: 374851 - DNA, 25 bp, Rattus norvegicus
gatttgctctccttgttgaattcta

SEQ ID NO: 374852 - DNA, 25 bp, Rattus norvegicus
gatttgctgatgatggtgtttcctt

SEQ ID NO: 374853 - DNA, 25 bp, Rattus norvegicus
gatttgctgatgttggtgtttcctt

SEQ ID NO: 374854 - DNA, 25 bp, Rattus norvegicus
gatttgctgggcacttacagtcaca

SEQ ID NO: 374855 - DNA, 25 bp, Rattus norvegicus
gatttgctgggctcttacagtcaca

SEQ ID NO: 374856 - DNA, 25 bp, Rattus norvegicus
gatttgctgtcgacattcccatgtg

SEQ ID NO: 374857 - DNA, 25 bp, Rattus norvegicus
gatttgctgtcgtcattcccatgtg

SEQ ID NO: 374858 - DNA, 25 bp, Rattus norvegicus
gatttgcttaaaattgctcgtcaca

SEQ ID NO: 374859 - DNA, 25 bp, Rattus norvegicus
gatttgcttaaatttgctcgtcaca

SEQ ID NO: 374860 - DNA, 25 bp, Rattus norvegicus
gatttgcttcatatctcaagtattg

SEQ ID NO: 374861 - DNA, 25 bp, Rattus norvegicus
gatttgcttcatttctcaagtattg

SEQ ID NO: 374862 - DNA, 25 bp, Rattus norvegicus
gatttgcttcttaatttggagctgg

SEQ ID NO: 374863 - DNA, 25 bp, Rattus norvegicus
gatttgcttcttagggtgttgactg

SEQ ID NO: 374864 - DNA, 25 bp, Rattus norvegicus
gatttgcttctttatttggagctgg

SEQ ID NO: 374865 - DNA, 25 bp, Rattus norvegicus
gatttgcttctttgggtgttgactg

SEQ ID NO: 374866 - DNA, 25 bp, Rattus norvegicus
gatttgcttgatacattgagttaca

SEQ ID NO: 374867 - DNA, 25 bp, Rattus norvegicus
gatttgcttgattcattgagttaca

SEQ ID NO: 374868 - DNA, 25 bp, Rattus norvegicus
gatttgcttttccatagagtttaca

SEQ ID NO: 374869 - DNA, 25 bp, Rattus norvegicus
gatttgcttttcgatagagtttaca

SEQ ID NO: 374870 - DNA, 25 bp, Rattus norvegicus
gatttggaaccaaatgcctgtcttg

SEQ ID NO: 374871 - DNA, 25 bp, Rattus norvegicus
gatttggaaccatatgcctgtcttg

SEQ ID NO: 374872 - DNA, 25 bp, Rattus norvegicus
gatttggacactaactcttttgaac

SEQ ID NO: 374873 - DNA, 25 bp, Rattus norvegicus
gatttggacacttactcttttgaac

SEQ ID NO: 374874 - DNA, 25 bp, Rattus norvegicus
gatttggagtagcatttacccaggg

SEQ ID NO: 374875 - DNA, 25 bp, Rattus norvegicus
gatttggagtaggatttacccaggg

SEQ ID NO: 374876 - DNA, 25 bp, Rattus norvegicus
gatttggagttgatttctgtgctta

SEQ ID NO: 374877 - DNA, 25 bp, Rattus norvegicus
gatttggagttgttttctgtgctta

SEQ ID NO: 374878 - DNA, 25 bp, Rattus norvegicus
gatttggatactagatgccagcttt

SEQ ID NO: 374879 - DNA, 25 bp, Rattus norvegicus
gatttggatacttgatgccagcttt

SEQ ID NO: 374880 - DNA, 25 bp, Rattus norvegicus
gatttggatcatcttacacacccct

SEQ ID NO: 374881 - DNA, 25 bp, Rattus norvegicus
gatttggatcatgttacacacccct

SEQ ID NO: 374882 - DNA, 25 bp, Rattus norvegicus
gatttggatcccatcctcaaggtat

SEQ ID NO: 374883 - DNA, 25 bp, Rattus norvegicus
gatttggatcccttcctcaaggtat

SEQ ID NO: 374884 - DNA, 25 bp, Rattus norvegicus
gatttggatctcagtatcttacgat

SEQ ID NO: 374885 - DNA, 25 bp, Rattus norvegicus
gatttggatctctgtatcttacgat

SEQ ID NO: 374886 - DNA, 25 bp, Rattus norvegicus
gatttggatctgctgacttccaggc

SEQ ID NO: 374887 - DNA, 25 bp, Rattus norvegicus
gatttggatctggtgacttccaggc

SEQ ID NO: 374888 - DNA, 25 bp, Rattus norvegicus
gatttggatgtcactctcacaggaa

SEQ ID NO: 374889 - DNA, 25 bp, Rattus norvegicus
gatttggatgtctctctcacaggaa

SEQ ID NO: 374890 - DNA, 25 bp, Rattus norvegicus
gatttggattaacctcaacctatta

SEQ ID NO: 374891 - DNA, 25 bp, Rattus norvegicus
gatttggattaagctcaacctatta

SEQ ID NO: 374892 - DNA, 25 bp, Rattus norvegicus
gatttggattctccagctcctgtcc

SEQ ID NO: 374893 - DNA, 25 bp, Rattus norvegicus
gatttggattctgcagctcctgtcc

SEQ ID NO: 374894 - DNA, 25 bp, Rattus norvegicus
gatttggcaccacactttctacaat

SEQ ID NO: 374895 - DNA, 25 bp, Rattus norvegicus
gatttggcaccagactttctacaat

SEQ ID NO: 374896 - DNA, 25 bp, Rattus norvegicus
gatttggcatcaaccctgtgggagg

SEQ ID NO: 374897 - DNA, 25 bp, Rattus norvegicus
gatttggcatcatccctgtgggagg

SEQ ID NO: 374898 - DNA, 25 bp, Rattus norvegicus
gatttggcatttcattttgtataat

SEQ ID NO: 374899 - DNA, 25 bp, Rattus norvegicus
gatttggcatttgattttgtataat

SEQ ID NO: 374900 - DNA, 25 bp, Rattus norvegicus
gatttggccacactggttcccagat

SEQ ID NO: 374901 - DNA, 25 bp, Rattus norvegicus
gatttggccacagtggttcccagat

SEQ ID NO: 374902 - DNA, 25 bp, Rattus norvegicus
gatttggccggaagctaccctaaag

SEQ ID NO: 374903 - DNA, 25 bp, Rattus norvegicus
gatttggccggatgctaccctaaag

SEQ ID NO: 374904 - DNA, 25 bp, Rattus norvegicus
gatttggccgtaacggacgcctggt

SEQ ID NO: 374905 - DNA, 25 bp, Rattus norvegicus
gatttggccgtatcggacgcctggt

SEQ ID NO: 374906 - DNA, 25 bp, Rattus norvegicus
gatttggcgtctactcagacacagc

SEQ ID NO: 374907 - DNA, 25 bp, Rattus norvegicus
gatttggcgtcttctcagacacagc

SEQ ID NO: 374908 - DNA, 25 bp, Rattus norvegicus
gatttggctcccaaagatactattt

SEQ ID NO: 374909 - DNA, 25 bp, Rattus norvegicus
gatttggctccctaagatactattt

SEQ ID NO: 374910 - DNA, 25 bp, Rattus norvegicus
gatttggctggacaggttaccatca

SEQ ID NO: 374911 - DNA, 25 bp, Rattus norvegicus
gatttggctggagaggttaccatca

SEQ ID NO: 374912 - DNA, 25 bp, Rattus norvegicus
gatttggctgggagtagcagttact

SEQ ID NO: 374913 - DNA, 25 bp, Rattus norvegicus
gatttggctgggtgtagcagttact

SEQ ID NO: 374914 - DNA, 25 bp, Rattus norvegicus
gatttggcttacagtctcagagggt

SEQ ID NO: 374915 - DNA, 25 bp, Rattus norvegicus
gatttggcttactgtctcagagggt

SEQ ID NO: 374916 - DNA, 25 bp, Rattus norvegicus
gatttggctttcagactacttttct

SEQ ID NO: 374917 - DNA, 25 bp, Rattus norvegicus
gatttggctttctgactacttttct

SEQ ID NO: 374918 - DNA, 25 bp, Rattus norvegicus
gatttgggaaacaacctctgtacat

SEQ ID NO: 374919 - DNA, 25 bp, Rattus norvegicus
gatttgggaaactacctctgtacat

SEQ ID NO: 374920 - DNA, 25 bp, Rattus norvegicus
gatttgggaacaccagggccacact

SEQ ID NO: 374921 - DNA, 25 bp, Rattus norvegicus
gatttgggaacagcagggccacact

SEQ ID NO: 374922 - DNA, 25 bp, Rattus norvegicus
gatttgggagctattctccagggtc

SEQ ID NO: 374923 - DNA, 25 bp, Rattus norvegicus
gatttgggagcttttctccagggtc

SEQ ID NO: 374924 - DNA, 25 bp, Rattus norvegicus
gatttgggagtaagcaccatattta

SEQ ID NO: 374925 - DNA, 25 bp, Rattus norvegicus
gatttgggagtatgcaccatattta

SEQ ID NO: 374926 - DNA, 25 bp, Rattus norvegicus
gatttgggagttacgggagcctctt

SEQ ID NO: 374927 - DNA, 25 bp, Rattus norvegicus
gatttgggagtttcgggagcctctt

SEQ ID NO: 374928 - DNA, 25 bp, Rattus norvegicus
gatttgggcactacagaggactcag

SEQ ID NO: 374929 - DNA, 25 bp, Rattus norvegicus
gatttgggcactatatttcaggata

SEQ ID NO: 374930 - DNA, 25 bp, Rattus norvegicus
gatttgggcacttcagaggactcag

SEQ ID NO: 374931 - DNA, 25 bp, Rattus norvegicus
gatttgggcactttatttcaggata

SEQ ID NO: 374932 - DNA, 25 bp, Rattus norvegicus
gatttgggcgaacttcacaccatta

SEQ ID NO: 374933 - DNA, 25 bp, Rattus norvegicus
gatttgggcgaagttcacaccatta

SEQ ID NO: 374934 - DNA, 25 bp, Rattus norvegicus
gatttgggcgtgacttgaccactta

SEQ ID NO: 374935 - DNA, 25 bp, Rattus norvegicus
gatttgggcgtgtcttgaccactta

SEQ ID NO: 374936 - DNA, 25 bp, Rattus norvegicus
gatttgggtagtctttcagtcttta

SEQ ID NO: 374937 - DNA, 25 bp, Rattus norvegicus
gatttgggtagtgtttcagtcttta

SEQ ID NO: 374938 - DNA, 25 bp, Rattus norvegicus
gatttgggttcgcacagttgacaga

SEQ ID NO: 374939 - DNA, 25 bp, Rattus norvegicus
gatttgggttcggacagttgacaga

SEQ ID NO: 374940 - DNA, 25 bp, Rattus norvegicus
gatttgggtttaattgcgacttaca

SEQ ID NO: 374941 - DNA, 25 bp, Rattus norvegicus
gatttgggtttatttgcgacttaca

SEQ ID NO: 374942 - DNA, 25 bp, Rattus norvegicus
gatttggtaactcctgaattcagct

SEQ ID NO: 374943 - DNA, 25 bp, Rattus norvegicus
gatttggtaactgctgaattcagct

SEQ ID NO: 374944 - DNA, 25 bp, Rattus norvegicus
gatttggtagaaagcacatttcagg

SEQ ID NO: 374945 - DNA, 25 bp, Rattus norvegicus
gatttggtagaatgcacatttcagg

SEQ ID NO: 374946 - DNA, 25 bp, Rattus norvegicus
gatttggtagcaaccgtattcccgg

SEQ ID NO: 374947 - DNA, 25 bp, Rattus norvegicus
gatttggtagcatccgtattcccgg

SEQ ID NO: 374948 - DNA, 25 bp, Rattus norvegicus
gatttggtagtgaggccagacccag

SEQ ID NO: 374949 - DNA, 25 bp, Rattus norvegicus
gatttggtagtgtggccagacccag

SEQ ID NO: 374950 - DNA, 25 bp, Rattus norvegicus
gatttggtcctcaaattcctcagca

SEQ ID NO: 374951 - DNA, 25 bp, Rattus norvegicus
gatttggtcctctaattcctcagca

SEQ ID NO: 374952 - DNA, 25 bp, Rattus norvegicus
gatttggtcgcaaaggccatgccgt

SEQ ID NO: 374953 - DNA, 25 bp, Rattus norvegicus
gatttggtcgcataggccatgccgt

SEQ ID NO: 374954 - DNA, 25 bp, Rattus norvegicus
gatttggtctccaatatcctcatac

SEQ ID NO: 374955 - DNA, 25 bp, Rattus norvegicus
gatttggtctcctatatcctcatac

SEQ ID NO: 374956 - DNA, 25 bp, Rattus norvegicus
gatttggtgacgattggttagtgtt

SEQ ID NO: 374957 - DNA, 25 bp, Rattus norvegicus
gatttggtgacgtttggttagtgtt

SEQ ID NO: 374958 - DNA, 25 bp, Rattus norvegicus
gatttggttcagaaagacccagatt

SEQ ID NO: 374959 - DNA, 25 bp, Rattus norvegicus
gatttggttcagtaagacccagatt

SEQ ID NO: 374960 - DNA, 25 bp, Rattus norvegicus
gatttggtttacaactcctcataga

SEQ ID NO: 374961 - DNA, 25 bp, Rattus norvegicus
gatttggtttactactcctcataga

SEQ ID NO: 374962 - DNA, 25 bp, Rattus norvegicus
gatttgtaacaaactgtccaaccca

SEQ ID NO: 374963 - DNA, 25 bp, Rattus norvegicus
gatttgtaacaatctgtccaaccca

SEQ ID NO: 374964 - DNA, 25 bp, Rattus norvegicus
gatttgtaaccaatccagctattca

SEQ ID NO: 374965 - DNA, 25 bp, Rattus norvegicus
gatttgtaaccattccagctattca

SEQ ID NO: 374966 - DNA, 25 bp, Rattus norvegicus
gatttgtacgcaatctggagacttg

SEQ ID NO: 374967 - DNA, 25 bp, Rattus norvegicus
gatttgtacgcattctggagacttg

SEQ ID NO: 374968 - DNA, 25 bp, Rattus norvegicus
gatttgtagcataacctttacccaa

SEQ ID NO: 374969 - DNA, 25 bp, Rattus norvegicus
gatttgtagcattacctttacccaa

SEQ ID NO: 374970 - DNA, 25 bp, Rattus norvegicus
gatttgtatcctattgttgctatgc

SEQ ID NO: 374971 - DNA, 25 bp, Rattus norvegicus
gatttgtatccttttgttgctatgc

SEQ ID NO: 374972 - DNA, 25 bp, Rattus norvegicus
gatttgtatctcacccagaaagtga

SEQ ID NO: 374973 - DNA, 25 bp, Rattus norvegicus
gatttgtatctcagtgtatgtgtct

SEQ ID NO: 374974 - DNA, 25 bp, Rattus norvegicus
gatttgtatctctcccagaaagtga

SEQ ID NO: 374975 - DNA, 25 bp, Rattus norvegicus
gatttgtatctctgtgtatgtgtct

SEQ ID NO: 374976 - DNA, 25 bp, Rattus norvegicus
gatttgtatgccaggctctgctagg

SEQ ID NO: 374977 - DNA, 25 bp, Rattus norvegicus
gatttgtatgcctggctctgctagg

SEQ ID NO: 374978 - DNA, 25 bp, Rattus norvegicus
gatttgtatgtccatttatacttca

SEQ ID NO: 374979 - DNA, 25 bp, Rattus norvegicus
gatttgtatgtcgatttatacttca

SEQ ID NO: 374980 - DNA, 25 bp, Rattus norvegicus
gatttgtatgtgagatgtcctgatt

SEQ ID NO: 374981 - DNA, 25 bp, Rattus norvegicus
gatttgtatgtgtgatgtcctgatt

SEQ ID NO: 374982 - DNA, 25 bp, Rattus norvegicus
gatttgtatttgctagacatttctc

SEQ ID NO: 374983 - DNA, 25 bp, Rattus norvegicus
gatttgtatttggtagacatttctc

SEQ ID NO: 374984 - DNA, 25 bp, Rattus norvegicus
gatttgtcaagtaagagctccagag

SEQ ID NO: 374985 - DNA, 25 bp, Rattus norvegicus
gatttgtcaagttagagctccagag

SEQ ID NO: 374986 - DNA, 25 bp, Rattus norvegicus
gatttgtcacttagcctattaatta

SEQ ID NO: 374987 - DNA, 25 bp, Rattus norvegicus
gatttgtcactttgcctattaatta

SEQ ID NO: 374988 - DNA, 25 bp, Rattus norvegicus
gatttgtcatggcatttgttctaat

SEQ ID NO: 374989 - DNA, 25 bp, Rattus norvegicus
gatttgtcatgggatttgttctaat

SEQ ID NO: 374990 - DNA, 25 bp, Rattus norvegicus
gatttgtccataacagtttaccttt

SEQ ID NO: 374991 - DNA, 25 bp, Rattus norvegicus
gatttgtccatatcagtttaccttt

SEQ ID NO: 374992 - DNA, 25 bp, Rattus norvegicus
gatttgtcggccaaggtgcagccac

SEQ ID NO: 374993 - DNA, 25 bp, Rattus norvegicus
gatttgtcggcctaggtgcagccac

SEQ ID NO: 374994 - DNA, 25 bp, Rattus norvegicus
gatttgtctaaccagaactcttcgg

SEQ ID NO: 374995 - DNA, 25 bp, Rattus norvegicus
gatttgtctaacgagaactcttcgg

SEQ ID NO: 374996 - DNA, 25 bp, Rattus norvegicus
gatttgtctacccagttgatgcttg

SEQ ID NO: 374997 - DNA, 25 bp, Rattus norvegicus
gatttgtctaccgagttgatgcttg

SEQ ID NO: 374998 - DNA, 25 bp, Rattus norvegicus
gatttgtctggaaactatccatttt

SEQ ID NO: 374999 - DNA, 25 bp, Rattus norvegicus
gatttgtctggatactatccatttt

SEQ ID NO: 375000 - DNA, 25 bp, Rattus norvegicus
gatttgtcttatctcttcttacttt

SEQ ID NO: 375001 - DNA, 25 bp, Rattus norvegicus
gatttgtcttatgtcttcttacttt

SEQ ID NO: 375002 - DNA, 25 bp, Rattus norvegicus
gatttgtcttcaaagggccaccgaa

SEQ ID NO: 375003 - DNA, 25 bp, Rattus norvegicus
gatttgtcttcatagggccaccgaa

SEQ ID NO: 375004 - DNA, 25 bp, Rattus norvegicus
gatttgtcttccacatcaaccagga

SEQ ID NO: 375005 - DNA, 25 bp, Rattus norvegicus
gatttgtcttcctcatcaaccagga

SEQ ID NO: 375006 - DNA, 25 bp, Rattus norvegicus
gatttgtcttctagtcatttcttga

SEQ ID NO: 375007 - DNA, 25 bp, Rattus norvegicus
gatttgtcttcttgtcatttcttga

SEQ ID NO: 375008 - DNA, 25 bp, Rattus norvegicus
gatttgtgaatccatccctgggctt

SEQ ID NO: 375009 - DNA, 25 bp, Rattus norvegicus
gatttgtgaatcgatccctgggctt

SEQ ID NO: 375010 - DNA, 25 bp, Rattus norvegicus
gatttgtgaccaacaatcatgtaag

SEQ ID NO: 375011 - DNA, 25 bp, Rattus norvegicus
gatttgtgaccatcaatcatgtaag

SEQ ID NO: 375012 - DNA, 25 bp, Rattus norvegicus
gatttgtgactcctttcatgtgtac

SEQ ID NO: 375013 - DNA, 25 bp, Rattus norvegicus
gatttgtgactcgtttcatgtgtac

SEQ ID NO: 375014 - DNA, 25 bp, Rattus norvegicus
gatttgtgagttactttccccattg

SEQ ID NO: 375015 - DNA, 25 bp, Rattus norvegicus
gatttgtgagtttctttccccattg

SEQ ID NO: 375016 - DNA, 25 bp, Rattus norvegicus
gatttgtgattgctctcatggccac

SEQ ID NO: 375017 - DNA, 25 bp, Rattus norvegicus
gatttgtgattggtctcatggccac

SEQ ID NO: 375018 - DNA, 25 bp, Rattus norvegicus
gatttgtgcctacaatcacttagta

SEQ ID NO: 375019 - DNA, 25 bp, Rattus norvegicus
gatttgtgcctagaatcacttagta

SEQ ID NO: 375020 - DNA, 25 bp, Rattus norvegicus
gatttgtggacacacctgtgcatac

SEQ ID NO: 375021 - DNA, 25 bp, Rattus norvegicus
gatttgtggacagacctgtgcatac

SEQ ID NO: 375022 - DNA, 25 bp, Rattus norvegicus
gatttgtggactctctctatggcac

SEQ ID NO: 375023 - DNA, 25 bp, Rattus norvegicus
gatttgtggactgtctctatggcac

SEQ ID NO: 375024 - DNA, 25 bp, Rattus norvegicus
gatttgtggatcattctcatctcaa

SEQ ID NO: 375025 - DNA, 25 bp, Rattus norvegicus
gatttgtggatctttctcatctcaa

SEQ ID NO: 375026 - DNA, 25 bp, Rattus norvegicus
gatttgtggcaaaatcagcaatttt

SEQ ID NO: 375027 - DNA, 25 bp, Rattus norvegicus
gatttgtggcaatatcagcaatttt

SEQ ID NO: 375028 - DNA, 25 bp, Rattus norvegicus
gatttgtggctcagtcaagattttt

SEQ ID NO: 375029 - DNA, 25 bp, Rattus norvegicus
gatttgtggctctgtcaagattttt

SEQ ID NO: 375030 - DNA, 25 bp, Rattus norvegicus
gatttgtggtgcaaactctgtgtcc

SEQ ID NO: 375031 - DNA, 25 bp, Rattus norvegicus
gatttgtggtgctaactctgtgtcc

SEQ ID NO: 375032 - DNA, 25 bp, Rattus norvegicus
gatttgtgtattacctgcgtatttg

SEQ ID NO: 375033 - DNA, 25 bp, Rattus norvegicus
gatttgtgtatttcctgcgtatttg

SEQ ID NO: 375034 - DNA, 25 bp, Rattus norvegicus
gatttgtgtgtcacagctgtctgca

SEQ ID NO: 375035 - DNA, 25 bp, Rattus norvegicus
gatttgtgtgtctcagctgtctgca

SEQ ID NO: 375036 - DNA, 25 bp, Rattus norvegicus
gatttgttacatacaatcccgatgt

SEQ ID NO: 375037 - DNA, 25 bp, Rattus norvegicus
gatttgttacattcaatcccgatgt

SEQ ID NO: 375038 - DNA, 25 bp, Rattus norvegicus
gatttgttaccgagcttctttggag

SEQ ID NO: 375039 - DNA, 25 bp, Rattus norvegicus
gatttgttaccgtgcttctttggag

SEQ ID NO: 375040 - DNA, 25 bp, Rattus norvegicus
gatttgttatgtctctaagagccag

SEQ ID NO: 375041 - DNA, 25 bp, Rattus norvegicus
gatttgttatgtgtctaagagccag

SEQ ID NO: 375042 - DNA, 25 bp, Rattus norvegicus
gatttgttcccaagctgagcggcaa

SEQ ID NO: 375043 - DNA, 25 bp, Rattus norvegicus
gatttgttcccatgctgagcggcaa

SEQ ID NO: 375044 - DNA, 25 bp, Rattus norvegicus
gatttgttctccactctgtcaaact

SEQ ID NO: 375045 - DNA, 25 bp, Rattus norvegicus
gatttgttctcctctctgtcaaact

SEQ ID NO: 375046 - DNA, 25 bp, Rattus norvegicus
gatttgttctgtctttctttgtgtc

SEQ ID NO: 375047 - DNA, 25 bp, Rattus norvegicus
gatttgttctgtgtttctttgtgtc

SEQ ID NO: 375048 - DNA, 25 bp, Rattus norvegicus
gatttgttgctcacagactgtgtaa

SEQ ID NO: 375049 - DNA, 25 bp, Rattus norvegicus
gatttgttgctctcagactgtgtaa

SEQ ID NO: 375050 - DNA, 25 bp, Rattus norvegicus
gatttgttggtcagctgtcattttc

SEQ ID NO: 375051 - DNA, 25 bp, Rattus norvegicus
gatttgttggtctgctgtcattttc

SEQ ID NO: 375052 - DNA, 25 bp, Rattus norvegicus
gatttgtttaccaaccatttcattg

SEQ ID NO: 375053 - DNA, 25 bp, Rattus norvegicus
gatttgtttacctaccatttcattg

SEQ ID NO: 375054 - DNA, 25 bp, Rattus norvegicus
gatttgtttagtcgagggccttact

SEQ ID NO: 375055 - DNA, 25 bp, Rattus norvegicus
gatttgtttagtggagggccttact

SEQ ID NO: 375056 - DNA, 25 bp, Rattus norvegicus
gatttgtttcatcctctggcaaagg

SEQ ID NO: 375057 - DNA, 25 bp, Rattus norvegicus
gatttgtttcatgctctggcaaagg

SEQ ID NO: 375058 - DNA, 25 bp, Rattus norvegicus
gatttgtttcgtccactgtgatgtc

SEQ ID NO: 375059 - DNA, 25 bp, Rattus norvegicus
gatttgtttcgtgcactgtgatgtc

SEQ ID NO: 375060 - DNA, 25 bp, Rattus norvegicus
gatttgttttcgaaagtctggtcat

SEQ ID NO: 375061 - DNA, 25 bp, Rattus norvegicus
gatttgttttcgtaagtctggtcat

SEQ ID NO: 375062 - DNA, 25 bp, Rattus norvegicus
gatttgtttttcacatgcataaatg

SEQ ID NO: 375063 - DNA, 25 bp, Rattus norvegicus
gatttgtttttctcatgcataaatg

SEQ ID NO: 375064 - DNA, 25 bp, Rattus norvegicus
gattttaacattactcactggagag

SEQ ID NO: 375065 - DNA, 25 bp, Rattus norvegicus
gattttaacatttctcactggagag

SEQ ID NO: 375066 - DNA, 25 bp, Rattus norvegicus
gattttaacttccaacccggctcag

SEQ ID NO: 375067 - DNA, 25 bp, Rattus norvegicus
gattttaacttcgaacccggctcag

SEQ ID NO: 375068 - DNA, 25 bp, Rattus norvegicus
gattttaagccgattcaatactgtg

SEQ ID NO: 375069 - DNA, 25 bp, Rattus norvegicus
gattttaagccgtttcaatactgtg

SEQ ID NO: 375070 - DNA, 25 bp, Rattus norvegicus
gattttaaggctcagctagctcgct

SEQ ID NO: 375071 - DNA, 25 bp, Rattus norvegicus
gattttaaggctgagctagctcgct

SEQ ID NO: 375072 - DNA, 25 bp, Rattus norvegicus
gattttaagttcatcgttcctgata

SEQ ID NO: 375073 - DNA, 25 bp, Rattus norvegicus
gattttaagttcttcgttcctgata

SEQ ID NO: 375074 - DNA, 25 bp, Rattus norvegicus
gattttaatagtctttgcctcgaat

SEQ ID NO: 375075 - DNA, 25 bp, Rattus norvegicus
gattttaatagtgtttgcctcgaat

SEQ ID NO: 375076 - DNA, 25 bp, Rattus norvegicus
gattttaatctactgcaggagtcag

SEQ ID NO: 375077 - DNA, 25 bp, Rattus norvegicus
gattttaatctagtgcaggagtcag

SEQ ID NO: 375078 - DNA, 25 bp, Rattus norvegicus
gattttaatctccagtctcatgcag

SEQ ID NO: 375079 - DNA, 25 bp, Rattus norvegicus
gattttaatctcgagtctcatgcag

SEQ ID NO: 375080 - DNA, 25 bp, Rattus norvegicus
gattttaattccatggtcaacccag

SEQ ID NO: 375081 - DNA, 25 bp, Rattus norvegicus
gattttaattccttggtcaacccag

SEQ ID NO: 375082 - DNA, 25 bp, Rattus norvegicus
gattttacaaatcccttctgtttcc

SEQ ID NO: 375083 - DNA, 25 bp, Rattus norvegicus
gattttacaaatgccttctgtttcc

SEQ ID NO: 375084 - DNA, 25 bp, Rattus norvegicus
gattttacaaccacacagtctgcac

SEQ ID NO: 375085 - DNA, 25 bp, Rattus norvegicus
gattttacaacctcacagtctgcac

SEQ ID NO: 375086 - DNA, 25 bp, Rattus norvegicus
gattttacacctactggtctcccta

SEQ ID NO: 375087 - DNA, 25 bp, Rattus norvegicus
gattttacaccttctggtctcccta

SEQ ID NO: 375088 - DNA, 25 bp, Rattus norvegicus
gattttacacttcctctggacagta

SEQ ID NO: 375089 - DNA, 25 bp, Rattus norvegicus
gattttacacttgctctggacagta

SEQ ID NO: 375090 - DNA, 25 bp, Rattus norvegicus
gattttacatctcacatcagtcctg

SEQ ID NO: 375091 - DNA, 25 bp, Rattus norvegicus
gattttacatctgacatcagtcctg

SEQ ID NO: 375092 - DNA, 25 bp, Rattus norvegicus
gattttaccagaacaccttttcaga

SEQ ID NO: 375093 - DNA, 25 bp, Rattus norvegicus
gattttaccagactgcttgctctga

SEQ ID NO: 375094 - DNA, 25 bp, Rattus norvegicus
gattttaccagagtgcttgctctga

SEQ ID NO: 375095 - DNA, 25 bp, Rattus norvegicus
gattttaccagatcaccttttcaga

SEQ ID NO: 375096 - DNA, 25 bp, Rattus norvegicus
gattttacccaacactcggagttat

SEQ ID NO: 375097 - DNA, 25 bp, Rattus norvegicus
gattttacccaagactcggagttat

SEQ ID NO: 375098 - DNA, 25 bp, Rattus norvegicus
gattttacccatcgcaggcttgctt

SEQ ID NO: 375099 - DNA, 25 bp, Rattus norvegicus
gattttacccatggcaggcttgctt

SEQ ID NO: 375100 - DNA, 25 bp, Rattus norvegicus
gattttaccctcactcagaatgttt

SEQ ID NO: 375101 - DNA, 25 bp, Rattus norvegicus
gattttaccctctctcagaatgttt

SEQ ID NO: 375102 - DNA, 25 bp, Rattus norvegicus
gattttacctcaaatactgtacatt

SEQ ID NO: 375103 - DNA, 25 bp, Rattus norvegicus
gattttacctcatatactgtacatt

SEQ ID NO: 375104 - DNA, 25 bp, Rattus norvegicus
gattttacctgtcaataccagcact

SEQ ID NO: 375105 - DNA, 25 bp, Rattus norvegicus
gattttacctgtgaataccagcact

SEQ ID NO: 375106 - DNA, 25 bp, Rattus norvegicus
gattttactataactcagacagcat

SEQ ID NO: 375107 - DNA, 25 bp, Rattus norvegicus
gattttactatatctcagacagcat

SEQ ID NO: 375108 - DNA, 25 bp, Rattus norvegicus
gattttactgtaactctgtcctcta

SEQ ID NO: 375109 - DNA, 25 bp, Rattus norvegicus
gattttactgtatctctgtcctcta

SEQ ID NO: 375110 - DNA, 25 bp, Rattus norvegicus
gattttactgtgacctctgaagccg

SEQ ID NO: 375111 - DNA, 25 bp, Rattus norvegicus
gattttactgtgtcctctgaagccg

SEQ ID NO: 375112 - DNA, 25 bp, Rattus norvegicus
gattttagactcctgtttgtaccca

SEQ ID NO: 375113 - DNA, 25 bp, Rattus norvegicus
gattttagactcgtgtttgtaccca

SEQ ID NO: 375114 - DNA, 25 bp, Rattus norvegicus
gattttagactgctgttcatttgaa

SEQ ID NO: 375115 - DNA, 25 bp, Rattus norvegicus
gattttagactggtgttcatttgaa

SEQ ID NO: 375116 - DNA, 25 bp, Rattus norvegicus
gattttagagcaaccggcttcggta

SEQ ID NO: 375117 - DNA, 25 bp, Rattus norvegicus
gattttagagcatccggcttcggta

SEQ ID NO: 375118 - DNA, 25 bp, Rattus norvegicus
gattttagataaatggcccagccca

SEQ ID NO: 375119 - DNA, 25 bp, Rattus norvegicus
gattttagataattggcccagccca

SEQ ID NO: 375120 - DNA, 25 bp, Rattus norvegicus
gattttagccataggtattcacaca

SEQ ID NO: 375121 - DNA, 25 bp, Rattus norvegicus
gattttagccattggtattcacaca

SEQ ID NO: 375122 - DNA, 25 bp, Rattus norvegicus
gattttagtgcacatggcccagcca

SEQ ID NO: 375123 - DNA, 25 bp, Rattus norvegicus
gattttagtgcagatggcccagcca

SEQ ID NO: 375124 - DNA, 25 bp, Rattus norvegicus
gattttataaacagcacttgtgatt

SEQ ID NO: 375125 - DNA, 25 bp, Rattus norvegicus
gattttataaactgcacttgtgatt

SEQ ID NO: 375126 - DNA, 25 bp, Rattus norvegicus
gattttataaccacaagtcttcagt

SEQ ID NO: 375127 - DNA, 25 bp, Rattus norvegicus
gattttataacctcaagtcttcagt

SEQ ID NO: 375128 - DNA, 25 bp, Rattus norvegicus
gattttatacccatgacttcacttt

SEQ ID NO: 375129 - DNA, 25 bp, Rattus norvegicus
gattttatacccttgacttcacttt

SEQ ID NO: 375130 - DNA, 25 bp, Rattus norvegicus
gattttatcagcaatctacaacgag

SEQ ID NO: 375131 - DNA, 25 bp, Rattus norvegicus
gattttatcagctatctacaacgag

SEQ ID NO: 375132 - DNA, 25 bp, Rattus norvegicus
gattttatccaaagccttagccaag

SEQ ID NO: 375133 - DNA, 25 bp, Rattus norvegicus
gattttatccaatgccttagccaag

SEQ ID NO: 375134 - DNA, 25 bp, Rattus norvegicus
gattttatcctcatgctgtagtact

SEQ ID NO: 375135 - DNA, 25 bp, Rattus norvegicus
gattttatcctcttgctgtagtact

SEQ ID NO: 375136 - DNA, 25 bp, Rattus norvegicus
gattttatctcgaactgcatagcca

SEQ ID NO: 375137 - DNA, 25 bp, Rattus norvegicus
gattttatctcgtactgcatagcca

SEQ ID NO: 375138 - DNA, 25 bp, Rattus norvegicus
gattttatgtaacctttatgtgaga

SEQ ID NO: 375139 - DNA, 25 bp, Rattus norvegicus
gattttatgtaagctttatgtgaga

SEQ ID NO: 375140 - DNA, 25 bp, Rattus norvegicus
gattttatgtcgctgtcagttacta

SEQ ID NO: 375141 - DNA, 25 bp, Rattus norvegicus
gattttatgtcggtgtcagttacta

SEQ ID NO: 375142 - DNA, 25 bp, Rattus norvegicus
gattttatgtggattggcctaagcc

SEQ ID NO: 375143 - DNA, 25 bp, Rattus norvegicus
gattttatgtggtttggcctaagcc

SEQ ID NO: 375144 - DNA, 25 bp, Rattus norvegicus
gattttatgtgtatatgcgcctcca

SEQ ID NO: 375145 - DNA, 25 bp, Rattus norvegicus
gattttatgtgtttatgcgcctcca

SEQ ID NO: 375146 - DNA, 25 bp, Rattus norvegicus
gattttatgttgactccgggactgc

SEQ ID NO: 375147 - DNA, 25 bp, Rattus norvegicus
gattttatgttgtctccgggactgc

SEQ ID NO: 375148 - DNA, 25 bp, Rattus norvegicus
gattttattgctatctgctcttcaa

SEQ ID NO: 375149 - DNA, 25 bp, Rattus norvegicus
gattttattgctttctgctcttcaa

SEQ ID NO: 375150 - DNA, 25 bp, Rattus norvegicus
gattttattgttaatcctccagttt

SEQ ID NO: 375151 - DNA, 25 bp, Rattus norvegicus
gattttattgtttatcctccagttt

SEQ ID NO: 375152 - DNA, 25 bp, Rattus norvegicus
gattttatttgtaaccacttcatta

SEQ ID NO: 375153 - DNA, 25 bp, Rattus norvegicus
gattttatttgttaccacttcatta

SEQ ID NO: 375154 - DNA, 25 bp, Rattus norvegicus
gattttcaaacgatgtccccatggt

SEQ ID NO: 375155 - DNA, 25 bp, Rattus norvegicus
gattttcaaacgttgtccccatggt

SEQ ID NO: 375156 - DNA, 25 bp, Rattus norvegicus
gattttcaaatacaccctcacagag

SEQ ID NO: 375157 - DNA, 25 bp, Rattus norvegicus
gattttcaaatagaccctcacagag

SEQ ID NO: 375158 - DNA, 25 bp, Rattus norvegicus
gattttcaagaactccccataagat

SEQ ID NO: 375159 - DNA, 25 bp, Rattus norvegicus
gattttcaagaagtccccataagat

SEQ ID NO: 375160 - DNA, 25 bp, Rattus norvegicus
gattttcaagatcctctcttctctc

SEQ ID NO: 375161 - DNA, 25 bp, Rattus norvegicus
gattttcaagatgctctcttctctc

SEQ ID NO: 375162 - DNA, 25 bp, Rattus norvegicus
gattttcaatcaaccaattccattt

SEQ ID NO: 375163 - DNA, 25 bp, Rattus norvegicus
gattttcaatcatccaattccattt

SEQ ID NO: 375164 - DNA, 25 bp, Rattus norvegicus
gattttcaccttaattactggccca

SEQ ID NO: 375165 - DNA, 25 bp, Rattus norvegicus
gattttcacctttattactggccca

SEQ ID NO: 375166 - DNA, 25 bp, Rattus norvegicus
gattttcacgaacaccttggcggga

SEQ ID NO: 375167 - DNA, 25 bp, Rattus norvegicus
gattttcacgaagaccttggcggga

SEQ ID NO: 375168 - DNA, 25 bp, Rattus norvegicus
gattttcacgagctagcagtgccac

SEQ ID NO: 375169 - DNA, 25 bp, Rattus norvegicus
gattttcacgaggtagcagtgccac

SEQ ID NO: 375170 - DNA, 25 bp, Rattus norvegicus
gattttcactggctagtaggtcaaa

SEQ ID NO: 375171 - DNA, 25 bp, Rattus norvegicus
gattttcactgggtagtaggtcaaa

SEQ ID NO: 375172 - DNA, 25 bp, Rattus norvegicus
gattttcactttatcgatgttaggg

SEQ ID NO: 375173 - DNA, 25 bp, Rattus norvegicus
gattttcactttttcgatgttaggg

SEQ ID NO: 375174 - DNA, 25 bp, Rattus norvegicus
gattttcaggtcctttgcttaccaa

SEQ ID NO: 375175 - DNA, 25 bp, Rattus norvegicus
gattttcaggtcgtttgcttaccaa

SEQ ID NO: 375176 - DNA, 25 bp, Rattus norvegicus
gattttcagtacatgggttccacat

SEQ ID NO: 375177 - DNA, 25 bp, Rattus norvegicus
gattttcagtacttgggttccacat

SEQ ID NO: 375178 - DNA, 25 bp, Rattus norvegicus
gattttcatatcacctaactgtttg

SEQ ID NO: 375179 - DNA, 25 bp, Rattus norvegicus
gattttcatatctcctaactgtttg

SEQ ID NO: 375180 - DNA, 25 bp, Rattus norvegicus
gattttcatcagaatgctttcacct

SEQ ID NO: 375181 - DNA, 25 bp, Rattus norvegicus
gattttcatcagtatgctttcacct

SEQ ID NO: 375182 - DNA, 25 bp, Rattus norvegicus
gattttcatcatctccaagtatctt

SEQ ID NO: 375183 - DNA, 25 bp, Rattus norvegicus
gattttcatcatgtccaagtatctt

SEQ ID NO: 375184 - DNA, 25 bp, Rattus norvegicus
gattttcatccacttttaatttaga

SEQ ID NO: 375185 - DNA, 25 bp, Rattus norvegicus
gattttcatccagttttaatttaga

SEQ ID NO: 375186 - DNA, 25 bp, Rattus norvegicus
gattttcatctccagtgtgaaggtg

SEQ ID NO: 375187 - DNA, 25 bp, Rattus norvegicus
gattttcatctcgagtgtgaaggtg

SEQ ID NO: 375188 - DNA, 25 bp, Rattus norvegicus
gattttcatgacatatttccccagg

SEQ ID NO: 375189 - DNA, 25 bp, Rattus norvegicus
gattttcatgacttatttccccagg

SEQ ID NO: 375190 - DNA, 25 bp, Rattus norvegicus
gattttcattcacaagcctagagag

SEQ ID NO: 375191 - DNA, 25 bp, Rattus norvegicus
gattttcattcagaagcctagagag

SEQ ID NO: 375192 - DNA, 25 bp, Rattus norvegicus
gattttcatttcaatcactccagaa

SEQ ID NO: 375193 - DNA, 25 bp, Rattus norvegicus
gattttcatttccacgtgtaagcca

SEQ ID NO: 375194 - DNA, 25 bp, Rattus norvegicus
gattttcatttcgacgtgtaagcca

SEQ ID NO: 375195 - DNA, 25 bp, Rattus norvegicus
gattttcatttctatcactccagaa

SEQ ID NO: 375196 - DNA, 25 bp, Rattus norvegicus
gattttccaaaccttttgtggtgat

SEQ ID NO: 375197 - DNA, 25 bp, Rattus norvegicus
gattttccaaacgttttgtggtgat

SEQ ID NO: 375198 - DNA, 25 bp, Rattus norvegicus
gattttccacaaaaagcatccccac

SEQ ID NO: 375199 - DNA, 25 bp, Rattus norvegicus
gattttccacaataagcatccccac

SEQ ID NO: 375200 - DNA, 25 bp, Rattus norvegicus
gattttccacataagtacgaagcat

SEQ ID NO: 375201 - DNA, 25 bp, Rattus norvegicus
gattttccacatcggtctatgactg

SEQ ID NO: 375202 - DNA, 25 bp, Rattus norvegicus
gattttccacatgggtctatgactg

SEQ ID NO: 375203 - DNA, 25 bp, Rattus norvegicus
gattttccacattagtacgaagcat

SEQ ID NO: 375204 - DNA, 25 bp, Rattus norvegicus
gattttcccaaacccagtcatggta

SEQ ID NO: 375205 - DNA, 25 bp, Rattus norvegicus
gattttcccaaagccagtcatggta

SEQ ID NO: 375206 - DNA, 25 bp, Rattus norvegicus
gattttcccaatcctgttcagactt

SEQ ID NO: 375207 - DNA, 25 bp, Rattus norvegicus
gattttcccaatgctgttcagactt

SEQ ID NO: 375208 - DNA, 25 bp, Rattus norvegicus
gattttcccctgatctaagtcataa

SEQ ID NO: 375209 - DNA, 25 bp, Rattus norvegicus
gattttcccctgttctaagtcataa

SEQ ID NO: 375210 - DNA, 25 bp, Rattus norvegicus
gattttcctaacattcttaattttg

SEQ ID NO: 375211 - DNA, 25 bp, Rattus norvegicus
gattttcctaactttcttaattttg

SEQ ID NO: 375212 - DNA, 25 bp, Rattus norvegicus
gattttcctcagatgggtcgtttta

SEQ ID NO: 375213 - DNA, 25 bp, Rattus norvegicus
gattttcctcagttgggtcgtttta

SEQ ID NO: 375214 - DNA, 25 bp, Rattus norvegicus
gattttcctctacttcgaggcttct

SEQ ID NO: 375215 - DNA, 25 bp, Rattus norvegicus
gattttcctctagttcgaggcttct

SEQ ID NO: 375216 - DNA, 25 bp, Rattus norvegicus
gattttcctctgcaaggatcgcagc

SEQ ID NO: 375217 - DNA, 25 bp, Rattus norvegicus
gattttcctctggaaggatcgcagc

SEQ ID NO: 375218 - DNA, 25 bp, Rattus norvegicus
gattttcctcttactcttatgctaa

SEQ ID NO: 375219 - DNA, 25 bp, Rattus norvegicus
gattttcctctttctcttatgctaa

SEQ ID NO: 375220 - DNA, 25 bp, Rattus norvegicus
gattttcctgcaaacttcagcttcc

SEQ ID NO: 375221 - DNA, 25 bp, Rattus norvegicus
gattttcctgcatacttcagcttcc

SEQ ID NO: 375222 - DNA, 25 bp, Rattus norvegicus
gattttcctggaatctgttcaactg

SEQ ID NO: 375223 - DNA, 25 bp, Rattus norvegicus
gattttcctggattctgttcaactg

SEQ ID NO: 375224 - DNA, 25 bp, Rattus norvegicus
gattttcctgtcacataactcaaat

SEQ ID NO: 375225 - DNA, 25 bp, Rattus norvegicus
gattttcctgtctcataactcaaat

SEQ ID NO: 375226 - DNA, 25 bp, Rattus norvegicus
gattttcctttgatgttaattgcca

SEQ ID NO: 375227 - DNA, 25 bp, Rattus norvegicus
gattttcctttgttgttaattgcca

SEQ ID NO: 375228 - DNA, 25 bp, Rattus norvegicus
gattttctaaagctctgtcaaccag

SEQ ID NO: 375229 - DNA, 25 bp, Rattus norvegicus
gattttctaaaggtctgtcaaccag

SEQ ID NO: 375230 - DNA, 25 bp, Rattus norvegicus
gattttctaaatctgggcaatttga

SEQ ID NO: 375231 - DNA, 25 bp, Rattus norvegicus
gattttctaaatgtgggcaatttga

SEQ ID NO: 375232 - DNA, 25 bp, Rattus norvegicus
gattttctactcatgagtctctcaa

SEQ ID NO: 375233 - DNA, 25 bp, Rattus norvegicus
gattttctactcttgagtctctcaa

SEQ ID NO: 375234 - DNA, 25 bp, Rattus norvegicus
gattttctagcaccatacctgggag

SEQ ID NO: 375235 - DNA, 25 bp, Rattus norvegicus
gattttctagcagcatacctgggag

SEQ ID NO: 375236 - DNA, 25 bp, Rattus norvegicus
gattttctagttactgaggcttgta

SEQ ID NO: 375237 - DNA, 25 bp, Rattus norvegicus
gattttctagtttctgaggcttgta

SEQ ID NO: 375238 - DNA, 25 bp, Rattus norvegicus
gattttctcctaccatgaataccac

SEQ ID NO: 375239 - DNA, 25 bp, Rattus norvegicus
gattttctcctagcatgaataccac

SEQ ID NO: 375240 - DNA, 25 bp, Rattus norvegicus
gattttctctggctgggaatctatt

SEQ ID NO: 375241 - DNA, 25 bp, Rattus norvegicus
gattttctctgggtgggaatctatt

SEQ ID NO: 375242 - DNA, 25 bp, Rattus norvegicus
gattttctgaacagcctcttctgag

SEQ ID NO: 375243 - DNA, 25 bp, Rattus norvegicus
gattttctgaactgcctcttctgag

SEQ ID NO: 375244 - DNA, 25 bp, Rattus norvegicus
gattttctgactcgaagcctgtggg

SEQ ID NO: 375245 - DNA, 25 bp, Rattus norvegicus
gattttctgactggaagcctgtggg

SEQ ID NO: 375246 - DNA, 25 bp, Rattus norvegicus
gattttctgatcagtgctgcacatg

SEQ ID NO: 375247 - DNA, 25 bp, Rattus norvegicus
gattttctgatctgtgctgcacatg

SEQ ID NO: 375248 - DNA, 25 bp, Rattus norvegicus
gattttctgattcttttcctttcca

SEQ ID NO: 375249 - DNA, 25 bp, Rattus norvegicus
gattttctgattgttttcctttcca

SEQ ID NO: 375250 - DNA, 25 bp, Rattus norvegicus
gattttctgcgtcctatacacggac

SEQ ID NO: 375251 - DNA, 25 bp, Rattus norvegicus
gattttctgcgtgctatacacggac

SEQ ID NO: 375252 - DNA, 25 bp, Rattus norvegicus
gattttctggaaacactcaagagag

SEQ ID NO: 375253 - DNA, 25 bp, Rattus norvegicus
gattttctggaatcactcaagagag

SEQ ID NO: 375254 - DNA, 25 bp, Rattus norvegicus
gattttctggctatgtgaacatcgt

SEQ ID NO: 375255 - DNA, 25 bp, Rattus norvegicus
gattttctggctttgtgaacatcgt

SEQ ID NO: 375256 - DNA, 25 bp, Rattus norvegicus
gattttctgtacactcatatgcatt

SEQ ID NO: 375257 - DNA, 25 bp, Rattus norvegicus
gattttctgtactctcatatgcatt

SEQ ID NO: 375258 - DNA, 25 bp, Rattus norvegicus
gattttctgtggacgtttataaagt

SEQ ID NO: 375259 - DNA, 25 bp, Rattus norvegicus
gattttctgtggtcgtttataaagt

SEQ ID NO: 375260 - DNA, 25 bp, Rattus norvegicus
gattttctgttcatcagaacgggtc

SEQ ID NO: 375261 - DNA, 25 bp, Rattus norvegicus
gattttctgttcatcgttcagcaat

SEQ ID NO: 375262 - DNA, 25 bp, Rattus norvegicus
gattttctgttcttcagaacgggtc

SEQ ID NO: 375263 - DNA, 25 bp, Rattus norvegicus
gattttctgttcttcgttcagcaat

SEQ ID NO: 375264 - DNA, 25 bp, Rattus norvegicus
gattttcttagacctgggtgtccat

SEQ ID NO: 375265 - DNA, 25 bp, Rattus norvegicus
gattttcttagagctgggtgtccat

SEQ ID NO: 375266 - DNA, 25 bp, Rattus norvegicus
gattttcttcatctacatctctgaa

SEQ ID NO: 375267 - DNA, 25 bp, Rattus norvegicus
gattttcttcatgtacatctctgaa

SEQ ID NO: 375268 - DNA, 25 bp, Rattus norvegicus
gattttcttctgagtgtttccattc

SEQ ID NO: 375269 - DNA, 25 bp, Rattus norvegicus
gattttcttctgatagcttcatagt

SEQ ID NO: 375270 - DNA, 25 bp, Rattus norvegicus
gattttcttctgtgtgtttccattc

SEQ ID NO: 375271 - DNA, 25 bp, Rattus norvegicus
gattttcttctgttagcttcatagt

SEQ ID NO: 375272 - DNA, 25 bp, Rattus norvegicus
gattttcttggaaaccttttgttgt

SEQ ID NO: 375273 - DNA, 25 bp, Rattus norvegicus
gattttcttggataccttttgttgt

SEQ ID NO: 375274 - DNA, 25 bp, Rattus norvegicus
gattttcttgtaagtccatcctgtg

SEQ ID NO: 375275 - DNA, 25 bp, Rattus norvegicus
gattttcttgtatgtccatcctgtg

SEQ ID NO: 375276 - DNA, 25 bp, Rattus norvegicus
gattttcttgttaacgatgtccttg

SEQ ID NO: 375277 - DNA, 25 bp, Rattus norvegicus
gattttcttgtttacgatgtccttg

SEQ ID NO: 375278 - DNA, 25 bp, Rattus norvegicus
gattttctttcaccctgggaagcga

SEQ ID NO: 375279 - DNA, 25 bp, Rattus norvegicus
gattttctttcagcctgggaagcga

SEQ ID NO: 375280 - DNA, 25 bp, Rattus norvegicus
gattttctttcgaacaaccagactc

SEQ ID NO: 375281 - DNA, 25 bp, Rattus norvegicus
gattttctttcgtacaaccagactc

SEQ ID NO: 375282 - DNA, 25 bp, Rattus norvegicus
gattttgaacccaaggacagagtca

SEQ ID NO: 375283 - DNA, 25 bp, Rattus norvegicus
gattttgaacccagctgcttagagc

SEQ ID NO: 375284 - DNA, 25 bp, Rattus norvegicus
gattttgaaccctaggacagagtca

SEQ ID NO: 375285 - DNA, 25 bp, Rattus norvegicus
gattttgaaccctgctgcttagagc

SEQ ID NO: 375286 - DNA, 25 bp, Rattus norvegicus
gattttgaactacctgataacacag

SEQ ID NO: 375287 - DNA, 25 bp, Rattus norvegicus
gattttgaactagctgataacacag

SEQ ID NO: 375288 - DNA, 25 bp, Rattus norvegicus
gattttgaactgaggcctgtggcat

SEQ ID NO: 375289 - DNA, 25 bp, Rattus norvegicus
gattttgaactgtggcctgtggcat

SEQ ID NO: 375290 - DNA, 25 bp, Rattus norvegicus
gattttgaagatcatggcccatcct

SEQ ID NO: 375291 - DNA, 25 bp, Rattus norvegicus
gattttgaagatgatggcccatcct

SEQ ID NO: 375292 - DNA, 25 bp, Rattus norvegicus
gattttgaagctccttagatctcct

SEQ ID NO: 375293 - DNA, 25 bp, Rattus norvegicus
gattttgaagctgcttagatctcct

SEQ ID NO: 375294 - DNA, 25 bp, Rattus norvegicus
gattttgacccacacaggagcacag

SEQ ID NO: 375295 - DNA, 25 bp, Rattus norvegicus
gattttgacccagacaggagcacag

SEQ ID NO: 375296 - DNA, 25 bp, Rattus norvegicus
gattttgaccccattacatttcgat

SEQ ID NO: 375297 - DNA, 25 bp, Rattus norvegicus
gattttgacccctttacatttcgat

SEQ ID NO: 375298 - DNA, 25 bp, Rattus norvegicus
gattttgaccgcagcagattcttga

SEQ ID NO: 375299 - DNA, 25 bp, Rattus norvegicus
gattttgaccgctgcagattcttga

SEQ ID NO: 375300 - DNA, 25 bp, Rattus norvegicus
gattttgacctcagaatcaacgcct

SEQ ID NO: 375301 - DNA, 25 bp, Rattus norvegicus
gattttgacctctgaatcaacgcct

SEQ ID NO: 375302 - DNA, 25 bp, Rattus norvegicus
gattttgactccaaatgcagcacat

SEQ ID NO: 375303 - DNA, 25 bp, Rattus norvegicus
gattttgactcctaatgcagcacat

SEQ ID NO: 375304 - DNA, 25 bp, Rattus norvegicus
gattttgagacaattgcctcccagt

SEQ ID NO: 375305 - DNA, 25 bp, Rattus norvegicus
gattttgagacatttgcctcccagt

SEQ ID NO: 375306 - DNA, 25 bp, Rattus norvegicus
gattttgagaccctgaagccatcta

SEQ ID NO: 375307 - DNA, 25 bp, Rattus norvegicus
gattttgagaccgtgaagccatcta

SEQ ID NO: 375308 - DNA, 25 bp, Rattus norvegicus
gattttgagcaccaagcagtccttt

SEQ ID NO: 375309 - DNA, 25 bp, Rattus norvegicus
gattttgagcacgaagcagtccttt

SEQ ID NO: 375310 - DNA, 25 bp, Rattus norvegicus
gattttgagcagctcagggtgcatc

SEQ ID NO: 375311 - DNA, 25 bp, Rattus norvegicus
gattttgagcaggtcagggtgcatc

SEQ ID NO: 375312 - DNA, 25 bp, Rattus norvegicus
gattttgagtgcattttccagaata

SEQ ID NO: 375313 - DNA, 25 bp, Rattus norvegicus
gattttgagtgctttttccagaata

SEQ ID NO: 375314 - DNA, 25 bp, Rattus norvegicus
gattttgatactccagctgattcct

SEQ ID NO: 375315 - DNA, 25 bp, Rattus norvegicus
gattttgatactgcagctgattcct

SEQ ID NO: 375316 - DNA, 25 bp, Rattus norvegicus
gattttgatcgcagaattctggcca

SEQ ID NO: 375317 - DNA, 25 bp, Rattus norvegicus
gattttgatcgctgaattctggcca

SEQ ID NO: 375318 - DNA, 25 bp, Rattus norvegicus
gattttgatctgagtctgagactta

SEQ ID NO: 375319 - DNA, 25 bp, Rattus norvegicus
gattttgatctgtgtctgagactta

SEQ ID NO: 375320 - DNA, 25 bp, Rattus norvegicus
gattttgcagatattcttgtccatg

SEQ ID NO: 375321 - DNA, 25 bp, Rattus norvegicus
gattttgcagattttcttgtccatg

SEQ ID NO: 375322 - DNA, 25 bp, Rattus norvegicus
gattttgcataaccccgccataaga

SEQ ID NO: 375323 - DNA, 25 bp, Rattus norvegicus
gattttgcataagcccgccataaga

SEQ ID NO: 375324 - DNA, 25 bp, Rattus norvegicus
gattttgcatgaatgttgagccatc

SEQ ID NO: 375325 - DNA, 25 bp, Rattus norvegicus
gattttgcatgattgttgagccatc

SEQ ID NO: 375326 - DNA, 25 bp, Rattus norvegicus
gattttgccgaaccaagtaccagtg

SEQ ID NO: 375327 - DNA, 25 bp, Rattus norvegicus
gattttgccgaagcaagtaccagtg

SEQ ID NO: 375328 - DNA, 25 bp, Rattus norvegicus
gattttgccttcagtttctggtgaa

SEQ ID NO: 375329 - DNA, 25 bp, Rattus norvegicus
gattttgccttctgtttctggtgaa

SEQ ID NO: 375330 - DNA, 25 bp, Rattus norvegicus
gattttgcggaaatgggagcctaat

SEQ ID NO: 375331 - DNA, 25 bp, Rattus norvegicus
gattttgcggaattgggagcctaat

SEQ ID NO: 375332 - DNA, 25 bp, Rattus norvegicus
gattttgctagtcctgttcgcatct

SEQ ID NO: 375333 - DNA, 25 bp, Rattus norvegicus
gattttgctagtgctgttcgcatct

SEQ ID NO: 375334 - DNA, 25 bp, Rattus norvegicus
gattttgctatcacattccattttt

SEQ ID NO: 375335 - DNA, 25 bp, Rattus norvegicus
gattttgctatctcattccattttt

SEQ ID NO: 375336 - DNA, 25 bp, Rattus norvegicus
gattttgctcttagatctgtaggat

SEQ ID NO: 375337 - DNA, 25 bp, Rattus norvegicus
gattttgctctttgatctgtaggat

SEQ ID NO: 375338 - DNA, 25 bp, Rattus norvegicus
gattttgctgaaccactggccatac

SEQ ID NO: 375339 - DNA, 25 bp, Rattus norvegicus
gattttgctgaagcactggccatac

SEQ ID NO: 375340 - DNA, 25 bp, Rattus norvegicus
gattttgctgatcgcctagtaccga

SEQ ID NO: 375341 - DNA, 25 bp, Rattus norvegicus
gattttgctgatggcctagtaccga

SEQ ID NO: 375342 - DNA, 25 bp, Rattus norvegicus
gattttgctgcaattaactctcttg

SEQ ID NO: 375343 - DNA, 25 bp, Rattus norvegicus
gattttgctgcatttaactctcttg

SEQ ID NO: 375344 - DNA, 25 bp, Rattus norvegicus
gattttgctgtcagagaccctacaa

SEQ ID NO: 375345 - DNA, 25 bp, Rattus norvegicus
gattttgctgtctgagaccctacaa

SEQ ID NO: 375346 - DNA, 25 bp, Rattus norvegicus
gattttgctttcattttcgttgtag

SEQ ID NO: 375347 - DNA, 25 bp, Rattus norvegicus
gattttgctttctttttcgttgtag

SEQ ID NO: 375348 - DNA, 25 bp, Rattus norvegicus
gattttggagatccttggtccagga

SEQ ID NO: 375349 - DNA, 25 bp, Rattus norvegicus
gattttggagatgcttggtccagga

SEQ ID NO: 375350 - DNA, 25 bp, Rattus norvegicus
gattttggagcaccacttgagtgcc

SEQ ID NO: 375351 - DNA, 25 bp, Rattus norvegicus
gattttggagcagcacttgagtgcc

SEQ ID NO: 375352 - DNA, 25 bp, Rattus norvegicus
gattttggcatcatttagtattagt

SEQ ID NO: 375353 - DNA, 25 bp, Rattus norvegicus
gattttggcatcttttagtattagt

SEQ ID NO: 375354 - DNA, 25 bp, Rattus norvegicus
gattttggcgttcaccattagcagt

SEQ ID NO: 375355 - DNA, 25 bp, Rattus norvegicus
gattttggcgttgaccattagcagt

SEQ ID NO: 375356 - DNA, 25 bp, Rattus norvegicus
gattttggcttgaggtctgactccc

SEQ ID NO: 375357 - DNA, 25 bp, Rattus norvegicus
gattttggcttgtggtctgactccc

SEQ ID NO: 375358 - DNA, 25 bp, Rattus norvegicus
gattttgggcacagtatccatgcaa

SEQ ID NO: 375359 - DNA, 25 bp, Rattus norvegicus
gattttgggcactgtatccatgcaa

SEQ ID NO: 375360 - DNA, 25 bp, Rattus norvegicus
gattttggtgaacattaactctacc

SEQ ID NO: 375361 - DNA, 25 bp, Rattus norvegicus
gattttggtgaagattaactctacc

SEQ ID NO: 375362 - DNA, 25 bp, Rattus norvegicus
gattttggtgctcgacaatgctgcc

SEQ ID NO: 375363 - DNA, 25 bp, Rattus norvegicus
gattttggtgctggacaatgctgcc

SEQ ID NO: 375364 - DNA, 25 bp, Rattus norvegicus
gattttggttaaatggtgattgtaa

SEQ ID NO: 375365 - DNA, 25 bp, Rattus norvegicus
gattttggttaattggtgattgtaa

SEQ ID NO: 375366 - DNA, 25 bp, Rattus norvegicus
gattttggttatacctgtggtgata

SEQ ID NO: 375367 - DNA, 25 bp, Rattus norvegicus
gattttggttatctatttatgaaga

SEQ ID NO: 375368 - DNA, 25 bp, Rattus norvegicus
gattttggttatgtatttatgaaga

SEQ ID NO: 375369 - DNA, 25 bp, Rattus norvegicus
gattttggttattcctgtggtgata

SEQ ID NO: 375370 - DNA, 25 bp, Rattus norvegicus
gattttgtaaacaccatcattgtta

SEQ ID NO: 375371 - DNA, 25 bp, Rattus norvegicus
gattttgtaaactccatcattgtta

SEQ ID NO: 375372 - DNA, 25 bp, Rattus norvegicus
gattttgtaaatcccgtggaaagat

SEQ ID NO: 375373 - DNA, 25 bp, Rattus norvegicus
gattttgtaaatgccgtggaaagat

SEQ ID NO: 375374 - DNA, 25 bp, Rattus norvegicus
gattttgtaactcagacttcgttgg

SEQ ID NO: 375375 - DNA, 25 bp, Rattus norvegicus
gattttgtaactgagacttcgttgg

SEQ ID NO: 375376 - DNA, 25 bp, Rattus norvegicus
gattttgtacctctgtttcctttga

SEQ ID NO: 375377 - DNA, 25 bp, Rattus norvegicus
gattttgtacctgtgtttcctttga

SEQ ID NO: 375378 - DNA, 25 bp, Rattus norvegicus
gattttgtaggaaaacccctgttag

SEQ ID NO: 375379 - DNA, 25 bp, Rattus norvegicus
gattttgtaggataacccctgttag

SEQ ID NO: 375380 - DNA, 25 bp, Rattus norvegicus
gattttgtcacacggacacctggag

SEQ ID NO: 375381 - DNA, 25 bp, Rattus norvegicus
gattttgtcacagggacacctggag

SEQ ID NO: 375382 - DNA, 25 bp, Rattus norvegicus
gattttgtccagagggagccaaacg

SEQ ID NO: 375383 - DNA, 25 bp, Rattus norvegicus
gattttgtccagcagtccagatggc

SEQ ID NO: 375384 - DNA, 25 bp, Rattus norvegicus
gattttgtccaggagtccagatggc

SEQ ID NO: 375385 - DNA, 25 bp, Rattus norvegicus
gattttgtccagtgggagccaaacg

SEQ ID NO: 375386 - DNA, 25 bp, Rattus norvegicus
gattttgtcccgctagtgttgtgtt

SEQ ID NO: 375387 - DNA, 25 bp, Rattus norvegicus
gattttgtcccggtagtgttgtgtt

SEQ ID NO: 375388 - DNA, 25 bp, Rattus norvegicus
gattttgtcctgaactccttttatt

SEQ ID NO: 375389 - DNA, 25 bp, Rattus norvegicus
gattttgtcctgtactccttttatt

SEQ ID NO: 375390 - DNA, 25 bp, Rattus norvegicus
gattttgtctgcaggtacgttttac

SEQ ID NO: 375391 - DNA, 25 bp, Rattus norvegicus
gattttgtctgctggtacgttttac

SEQ ID NO: 375392 - DNA, 25 bp, Rattus norvegicus
gattttgtcttgattgtcactcagg

SEQ ID NO: 375393 - DNA, 25 bp, Rattus norvegicus
gattttgtcttgtttgtcactcagg

SEQ ID NO: 375394 - DNA, 25 bp, Rattus norvegicus
gattttgtgattataaagccttctc

SEQ ID NO: 375395 - DNA, 25 bp, Rattus norvegicus
gattttgtgattttaaagccttctc

SEQ ID NO: 375396 - DNA, 25 bp, Rattus norvegicus
gattttgtgctaagtctccttagct

SEQ ID NO: 375397 - DNA, 25 bp, Rattus norvegicus
gattttgtgctatgtctccttagct

SEQ ID NO: 375398 - DNA, 25 bp, Rattus norvegicus
gattttgtgctgagacccttgtggg

SEQ ID NO: 375399 - DNA, 25 bp, Rattus norvegicus
gattttgtgctgtgacccttgtggg

SEQ ID NO: 375400 - DNA, 25 bp, Rattus norvegicus
gattttgtggttcgttctctgtcac

SEQ ID NO: 375401 - DNA, 25 bp, Rattus norvegicus
gattttgtggttggttctctgtcac

SEQ ID NO: 375402 - DNA, 25 bp, Rattus norvegicus
gattttgttaccaagcagcatttga

SEQ ID NO: 375403 - DNA, 25 bp, Rattus norvegicus
gattttgttacctagcagcatttga

SEQ ID NO: 375404 - DNA, 25 bp, Rattus norvegicus
gattttgttatacagggtaagccaa

SEQ ID NO: 375405 - DNA, 25 bp, Rattus norvegicus
gattttgttatagagggtaagccaa

SEQ ID NO: 375406 - DNA, 25 bp, Rattus norvegicus
gattttgttcatacagtatatcaca

SEQ ID NO: 375407 - DNA, 25 bp, Rattus norvegicus
gattttgttcattcagtatatcaca

SEQ ID NO: 375408 - DNA, 25 bp, Rattus norvegicus
gattttgttgaaagacctgtgctat

SEQ ID NO: 375409 - DNA, 25 bp, Rattus norvegicus
gattttgttgaatgacctgtgctat

SEQ ID NO: 375410 - DNA, 25 bp, Rattus norvegicus
gattttgttgtaataggtcaccctg

SEQ ID NO: 375411 - DNA, 25 bp, Rattus norvegicus
gattttgttgtattaggtcaccctg

SEQ ID NO: 375412 - DNA, 25 bp, Rattus norvegicus
gattttgtttcacatgttttgccat

SEQ ID NO: 375413 - DNA, 25 bp, Rattus norvegicus
gattttgtttcagatgttttgccat

SEQ ID NO: 375414 - DNA, 25 bp, Rattus norvegicus
gattttgtttctcatttgactttcc

SEQ ID NO: 375415 - DNA, 25 bp, Rattus norvegicus
gattttgtttctgatttgactttcc

SEQ ID NO: 375416 - DNA, 25 bp, Rattus norvegicus
gattttgttttccagttttcctgtg

SEQ ID NO: 375417 - DNA, 25 bp, Rattus norvegicus
gattttgttttcgagttttcctgtg

SEQ ID NO: 375418 - DNA, 25 bp, Rattus norvegicus
gattttgttttgctaacctgttaat

SEQ ID NO: 375419 - DNA, 25 bp, Rattus norvegicus
gattttgttttggtaacctgttaat

SEQ ID NO: 375420 - DNA, 25 bp, Rattus norvegicus
gatttttaaagccagtcacagtgtc

SEQ ID NO: 375421 - DNA, 25 bp, Rattus norvegicus
gatttttaaagcgagtcacagtgtc

SEQ ID NO: 375422 - DNA, 25 bp, Rattus norvegicus
gatttttaacacactgtcaggactg

SEQ ID NO: 375423 - DNA, 25 bp, Rattus norvegicus
gatttttaacactctgtcaggactg

SEQ ID NO: 375424 - DNA, 25 bp, Rattus norvegicus
gatttttaactccaaggctgtgtct

SEQ ID NO: 375425 - DNA, 25 bp, Rattus norvegicus
gatttttaactcgaaggctgtgtct

SEQ ID NO: 375426 - DNA, 25 bp, Rattus norvegicus
gatttttaactgcttgggcatctct

SEQ ID NO: 375427 - DNA, 25 bp, Rattus norvegicus
gatttttaactggttgggcatctct

SEQ ID NO: 375428 - DNA, 25 bp, Rattus norvegicus
gatttttacactatattcctgccgc

SEQ ID NO: 375429 - DNA, 25 bp, Rattus norvegicus
gatttttacactttattcctgccgc

SEQ ID NO: 375430 - DNA, 25 bp, Rattus norvegicus
gatttttacagaacggtggccttgg

SEQ ID NO: 375431 - DNA, 25 bp, Rattus norvegicus
gatttttacagaccctttcttcacc

SEQ ID NO: 375432 - DNA, 25 bp, Rattus norvegicus
gatttttacagagcctttcttcacc

SEQ ID NO: 375433 - DNA, 25 bp, Rattus norvegicus
gatttttacagatcggtggccttgg

SEQ ID NO: 375434 - DNA, 25 bp, Rattus norvegicus
gatttttacatgagagtccccttta

SEQ ID NO: 375435 - DNA, 25 bp, Rattus norvegicus
gatttttacatgtgagtccccttta

SEQ ID NO: 375436 - DNA, 25 bp, Rattus norvegicus
gatttttacccacatgtcatacctt

SEQ ID NO: 375437 - DNA, 25 bp, Rattus norvegicus
gatttttacccagatgtcatacctt

SEQ ID NO: 375438 - DNA, 25 bp, Rattus norvegicus
gatttttactccctttgtacagtat

SEQ ID NO: 375439 - DNA, 25 bp, Rattus norvegicus
gatttttactccgtttgtacagtat

SEQ ID NO: 375440 - DNA, 25 bp, Rattus norvegicus
gatttttacttcactttctagcaag

SEQ ID NO: 375441 - DNA, 25 bp, Rattus norvegicus
gatttttacttctctttctagcaag

SEQ ID NO: 375442 - DNA, 25 bp, Rattus norvegicus
gatttttagcaacttttttcttctg

SEQ ID NO: 375443 - DNA, 25 bp, Rattus norvegicus
gatttttagcaagttttttcttctg

SEQ ID NO: 375444 - DNA, 25 bp, Rattus norvegicus
gatttttagtttacctgcagatgcc

SEQ ID NO: 375445 - DNA, 25 bp, Rattus norvegicus
gatttttagttttcctgcagatgcc

SEQ ID NO: 375446 - DNA, 25 bp, Rattus norvegicus
gatttttataaacccagaccagcct

SEQ ID NO: 375447 - DNA, 25 bp, Rattus norvegicus
gatttttataaagccagaccagcct

SEQ ID NO: 375448 - DNA, 25 bp, Rattus norvegicus
gatttttatggtaacgtagttgtgt

SEQ ID NO: 375449 - DNA, 25 bp, Rattus norvegicus
gatttttatggttacgtagttgtgt

SEQ ID NO: 375450 - DNA, 25 bp, Rattus norvegicus
gatttttattaacttcagctgagct

SEQ ID NO: 375451 - DNA, 25 bp, Rattus norvegicus
gatttttattaagttcagctgagct

SEQ ID NO: 375452 - DNA, 25 bp, Rattus norvegicus
gatttttattcacttttcagacctg

SEQ ID NO: 375453 - DNA, 25 bp, Rattus norvegicus
gatttttattcagttttcagacctg

SEQ ID NO: 375454 - DNA, 25 bp, Rattus norvegicus
gatttttattccacttagctcagtt

SEQ ID NO: 375455 - DNA, 25 bp, Rattus norvegicus
gatttttattcctcttagctcagtt

SEQ ID NO: 375456 - DNA, 25 bp, Rattus norvegicus
gatttttcaatcacactagctggta

SEQ ID NO: 375457 - DNA, 25 bp, Rattus norvegicus
gatttttcaatctcactagctggta

SEQ ID NO: 375458 - DNA, 25 bp, Rattus norvegicus
gatttttcactaaattcacgcagtt

SEQ ID NO: 375459 - DNA, 25 bp, Rattus norvegicus
gatttttcactatattcacgcagtt

SEQ ID NO: 375460 - DNA, 25 bp, Rattus norvegicus
gatttttcattgatttgccccaggt

SEQ ID NO: 375461 - DNA, 25 bp, Rattus norvegicus
gatttttcattgttttgccccaggt

SEQ ID NO: 375462 - DNA, 25 bp, Rattus norvegicus
gatttttcctctaagtcctgttttg

SEQ ID NO: 375463 - DNA, 25 bp, Rattus norvegicus
gatttttcctcttagtcctgttttg

SEQ ID NO: 375464 - DNA, 25 bp, Rattus norvegicus
gatttttctacaatagcactttggg

SEQ ID NO: 375465 - DNA, 25 bp, Rattus norvegicus
gatttttctacattagcactttggg

SEQ ID NO: 375466 - DNA, 25 bp, Rattus norvegicus
gatttttctcagcacaactgggagg

SEQ ID NO: 375467 - DNA, 25 bp, Rattus norvegicus
gatttttctcaggacaactgggagg

SEQ ID NO: 375468 - DNA, 25 bp, Rattus norvegicus
gatttttctccaactactgaggagt

SEQ ID NO: 375469 - DNA, 25 bp, Rattus norvegicus
gatttttctccatctactgaggagt

SEQ ID NO: 375470 - DNA, 25 bp, Rattus norvegicus
gatttttctcctcgtactttacctg

SEQ ID NO: 375471 - DNA, 25 bp, Rattus norvegicus
gatttttctcctggtactttacctg

SEQ ID NO: 375472 - DNA, 25 bp, Rattus norvegicus
gatttttctgcactcttttctggtc

SEQ ID NO: 375473 - DNA, 25 bp, Rattus norvegicus
gatttttctgcagtcttttctggtc

SEQ ID NO: 375474 - DNA, 25 bp, Rattus norvegicus
gatttttctggtaagcttgggatgc

SEQ ID NO: 375475 - DNA, 25 bp, Rattus norvegicus
gatttttctggttagcttgggatgc

SEQ ID NO: 375476 - DNA, 25 bp, Rattus norvegicus
gatttttctgttagggcctaattca

SEQ ID NO: 375477 - DNA, 25 bp, Rattus norvegicus
gatttttctgtttgggcctaattca

SEQ ID NO: 375478 - DNA, 25 bp, Rattus norvegicus
gatttttcttacactgccagtagca

SEQ ID NO: 375479 - DNA, 25 bp, Rattus norvegicus
gatttttcttacatcatttcagggc

SEQ ID NO: 375480 - DNA, 25 bp, Rattus norvegicus
gatttttcttactctgccagtagca

SEQ ID NO: 375481 - DNA, 25 bp, Rattus norvegicus
gatttttcttacttcatttcagggc

SEQ ID NO: 375482 - DNA, 25 bp, Rattus norvegicus
gatttttcttatatcttccctgatg

SEQ ID NO: 375483 - DNA, 25 bp, Rattus norvegicus
gatttttcttatttcttccctgatg

SEQ ID NO: 375484 - DNA, 25 bp, Rattus norvegicus
gatttttgaaatccgccttcctgat

SEQ ID NO: 375485 - DNA, 25 bp, Rattus norvegicus
gatttttgaaatgcgccttcctgat

SEQ ID NO: 375486 - DNA, 25 bp, Rattus norvegicus
gatttttgaccaccagtctcttacc

SEQ ID NO: 375487 - DNA, 25 bp, Rattus norvegicus
gatttttgaccagcagtctcttacc

SEQ ID NO: 375488 - DNA, 25 bp, Rattus norvegicus
gatttttgaggcatacatacgttac

SEQ ID NO: 375489 - DNA, 25 bp, Rattus norvegicus
gatttttgaggcttacatacgttac

SEQ ID NO: 375490 - DNA, 25 bp, Rattus norvegicus
gatttttgctagctttacttctcac

SEQ ID NO: 375491 - DNA, 25 bp, Rattus norvegicus
gatttttgctaggtttacttctcac

SEQ ID NO: 375492 - DNA, 25 bp, Rattus norvegicus
gatttttgctatcacaccgactttt

SEQ ID NO: 375493 - DNA, 25 bp, Rattus norvegicus
gatttttgctatgacaccgactttt

SEQ ID NO: 375494 - DNA, 25 bp, Rattus norvegicus
gatttttgctctactgtatgtgaca

SEQ ID NO: 375495 - DNA, 25 bp, Rattus norvegicus
gatttttgctctactttataccagg

SEQ ID NO: 375496 - DNA, 25 bp, Rattus norvegicus
gatttttgctcttctgtatgtgaca

SEQ ID NO: 375497 - DNA, 25 bp, Rattus norvegicus
gatttttgctcttctttataccagg

SEQ ID NO: 375498 - DNA, 25 bp, Rattus norvegicus
gatttttgggatatgcctggcacag

SEQ ID NO: 375499 - DNA, 25 bp, Rattus norvegicus
gatttttgggatctcacttctaatg

SEQ ID NO: 375500 - DNA, 25 bp, Rattus norvegicus
gatttttgggatgtcacttctaatg

SEQ ID NO: 375501 - DNA, 25 bp, Rattus norvegicus
gatttttgggatttgcctggcacag

SEQ ID NO: 375502 - DNA, 25 bp, Rattus norvegicus
gatttttgtccacttggaggaccct

SEQ ID NO: 375503 - DNA, 25 bp, Rattus norvegicus
gatttttgtccagttggaggaccct

SEQ ID NO: 375504 - DNA, 25 bp, Rattus norvegicus
gatttttgtgaacacccttacaggg

SEQ ID NO: 375505 - DNA, 25 bp, Rattus norvegicus
gatttttgtgaagacccttacaggg

SEQ ID NO: 375506 - DNA, 25 bp, Rattus norvegicus
gatttttgtgtgaacatcctgggca

SEQ ID NO: 375507 - DNA, 25 bp, Rattus norvegicus
gatttttgtgtgtacatcctgggca

SEQ ID NO: 375508 - DNA, 25 bp, Rattus norvegicus
gatttttgttacatcacactggaaa

SEQ ID NO: 375509 - DNA, 25 bp, Rattus norvegicus
gatttttgttacttcacactggaaa

SEQ ID NO: 375510 - DNA, 25 bp, Rattus norvegicus
gatttttgttcaagtggcttctgct

SEQ ID NO: 375511 - DNA, 25 bp, Rattus norvegicus
gatttttgttcatgtggcttctgct

SEQ ID NO: 375512 - DNA, 25 bp, Rattus norvegicus
gatttttgttccagtcatttctcag

SEQ ID NO: 375513 - DNA, 25 bp, Rattus norvegicus
gatttttgttcctgtcatttctcag

SEQ ID NO: 375514 - DNA, 25 bp, Rattus norvegicus
gattttttaactccatcccattttt

SEQ ID NO: 375515 - DNA, 25 bp, Rattus norvegicus
gattttttaactgcatcccattttt

SEQ ID NO: 375516 - DNA, 25 bp, Rattus norvegicus
gattttttagttctagtactcacga

SEQ ID NO: 375517 - DNA, 25 bp, Rattus norvegicus
gattttttagttgtagtactcacga

SEQ ID NO: 375518 - DNA, 25 bp, Rattus norvegicus
gattttttatttccgtttagcagtg

SEQ ID NO: 375519 - DNA, 25 bp, Rattus norvegicus
gattttttatttgcgtttagcagtg

SEQ ID NO: 375520 - DNA, 25 bp, Rattus norvegicus
gattttttcacacatcttcccaggt

SEQ ID NO: 375521 - DNA, 25 bp, Rattus norvegicus
gattttttcacagatcttcccaggt

SEQ ID NO: 375522 - DNA, 25 bp, Rattus norvegicus
gattttttcacgaaagttcgcatat

SEQ ID NO: 375523 - DNA, 25 bp, Rattus norvegicus
gattttttcacgtaagttcgcatat

SEQ ID NO: 375524 - DNA, 25 bp, Rattus norvegicus
gattttttccagaaacttgcacttg

SEQ ID NO: 375525 - DNA, 25 bp, Rattus norvegicus
gattttttccagataagcttaataa

SEQ ID NO: 375526 - DNA, 25 bp, Rattus norvegicus
gattttttccagtaacttgcacttg

SEQ ID NO: 375527 - DNA, 25 bp, Rattus norvegicus
gattttttccagttaagcttaataa

SEQ ID NO: 375528 - DNA, 25 bp, Rattus norvegicus
gattttttccttacaatgtattttg

SEQ ID NO: 375529 - DNA, 25 bp, Rattus norvegicus
gattttttcctttcaatgtattttg

SEQ ID NO: 375530 - DNA, 25 bp, Rattus norvegicus
gattttttgataagtgtttcttctg

SEQ ID NO: 375531 - DNA, 25 bp, Rattus norvegicus
gattttttgatatgtgtttcttctg

SEQ ID NO: 375532 - DNA, 25 bp, Rattus norvegicus
gattttttgccaagctgatccagtt

SEQ ID NO: 375533 - DNA, 25 bp, Rattus norvegicus
gattttttgccatgctgatccagtt

SEQ ID NO: 375534 - DNA, 25 bp, Rattus norvegicus
gattttttgtacagatgccatttta

SEQ ID NO: 375535 - DNA, 25 bp, Rattus norvegicus
gattttttgtactgatgccatttta

SEQ ID NO: 375536 - DNA, 25 bp, Rattus norvegicus
gcaaaaaccatgcacgccgtgtgat

SEQ ID NO: 375537 - DNA, 25 bp, Rattus norvegicus
gcaaaaaccatggacgccgtgtgat

SEQ ID NO: 375538 - DNA, 25 bp, Rattus norvegicus
gcaaaaacgctgactgacgtgtctt

SEQ ID NO: 375539 - DNA, 25 bp, Rattus norvegicus
gcaaaaacgctgtctgacgtgtctt

SEQ ID NO: 375540 - DNA, 25 bp, Rattus norvegicus
gcaaaaacgtatccagaggcccaga

SEQ ID NO: 375541 - DNA, 25 bp, Rattus norvegicus
gcaaaaacgtatgcagaggcccaga

SEQ ID NO: 375542 - DNA, 25 bp, Rattus norvegicus
gcaaaaactccgagtttgcgaggtt

SEQ ID NO: 375543 - DNA, 25 bp, Rattus norvegicus
gcaaaaactccgtgtttgcgaggtt

SEQ ID NO: 375544 - DNA, 25 bp, Rattus norvegicus
gcaaaaagaatacctgcttatcctt

SEQ ID NO: 375545 - DNA, 25 bp, Rattus norvegicus
gcaaaaagaatagctgcttatcctt

SEQ ID NO: 375546 - DNA, 25 bp, Rattus norvegicus
gcaaaaagcaccctatacctgcaaa

SEQ ID NO: 375547 - DNA, 25 bp, Rattus norvegicus
gcaaaaagcaccgtatacctgcaaa

SEQ ID NO: 375548 - DNA, 25 bp, Rattus norvegicus
gcaaaaagcggccagtacctcggta

SEQ ID NO: 375549 - DNA, 25 bp, Rattus norvegicus
gcaaaaagcggcgagtacctcggta

SEQ ID NO: 375550 - DNA, 25 bp, Rattus norvegicus
gcaaaaaggagcaatgattctgtga

SEQ ID NO: 375551 - DNA, 25 bp, Rattus norvegicus
gcaaaaaggagctatgattctgtga

SEQ ID NO: 375552 - DNA, 25 bp, Rattus norvegicus
gcaaaaagtgttactgcctgccttt

SEQ ID NO: 375553 - DNA, 25 bp, Rattus norvegicus
gcaaaaagtgtttctgcctgccttt

SEQ ID NO: 375554 - DNA, 25 bp, Rattus norvegicus
gcaaaaatacagattcgtcactcta

SEQ ID NO: 375555 - DNA, 25 bp, Rattus norvegicus
gcaaaaatacagtttcgtcactcta

SEQ ID NO: 375556 - DNA, 25 bp, Rattus norvegicus
gcaaaaatcagtcctgctcaggact

SEQ ID NO: 375557 - DNA, 25 bp, Rattus norvegicus
gcaaaaatcagtgctgctcaggact

SEQ ID NO: 375558 - DNA, 25 bp, Rattus norvegicus
gcaaaaatccctaagttatgaagca

SEQ ID NO: 375559 - DNA, 25 bp, Rattus norvegicus
gcaaaaatcccttagttatgaagca

SEQ ID NO: 375560 - DNA, 25 bp, Rattus norvegicus
gcaaaaatgcatcctacggttcagt

SEQ ID NO: 375561 - DNA, 25 bp, Rattus norvegicus
gcaaaaatgcatgctacggttcagt

SEQ ID NO: 375562 - DNA, 25 bp, Rattus norvegicus
gcaaaaatgcctacatctctggagt

SEQ ID NO: 375563 - DNA, 25 bp, Rattus norvegicus
gcaaaaatgccttcatctctggagt

SEQ ID NO: 375564 - DNA, 25 bp, Rattus norvegicus
gcaaaaattgtaagcttgaacctac

SEQ ID NO: 375565 - DNA, 25 bp, Rattus norvegicus
gcaaaaattgtatgcttgaacctac

SEQ ID NO: 375566 - DNA, 25 bp, Rattus norvegicus
gcaaaacacaaacacctttctttga

SEQ ID NO: 375567 - DNA, 25 bp, Rattus norvegicus
gcaaaacacaaagacctttctttga

SEQ ID NO: 375568 - DNA, 25 bp, Rattus norvegicus
gcaaaacaccacagcacgaatgagt

SEQ ID NO: 375569 - DNA, 25 bp, Rattus norvegicus
gcaaaacaccactgcacgaatgagt

SEQ ID NO: 375570 - DNA, 25 bp, Rattus norvegicus
gcaaaacactgacccgctgaccagg

SEQ ID NO: 375571 - DNA, 25 bp, Rattus norvegicus
gcaaaacactgagccgctgaccagg

SEQ ID NO: 375572 - DNA, 25 bp, Rattus norvegicus
gcaaaacactgcactcagagtaccc

SEQ ID NO: 375573 - DNA, 25 bp, Rattus norvegicus
gcaaaacactgctctcagagtaccc

SEQ ID NO: 375574 - DNA, 25 bp, Rattus norvegicus
gcaaaacaggctctagcgttcgaac

SEQ ID NO: 375575 - DNA, 25 bp, Rattus norvegicus
gcaaaacaggctgtagcgttcgaac

SEQ ID NO: 375576 - DNA, 25 bp, Rattus norvegicus
gcaaaaccacttatgaccagcaagt

SEQ ID NO: 375577 - DNA, 25 bp, Rattus norvegicus
gcaaaaccacttttgaccagcaagt

SEQ ID NO: 375578 - DNA, 25 bp, Rattus norvegicus
gcaaaacccaatctgctgtactgtt

SEQ ID NO: 375579 - DNA, 25 bp, Rattus norvegicus
gcaaaacccaatgtgctgtactgtt

SEQ ID NO: 375580 - DNA, 25 bp, Rattus norvegicus
gcaaaacccattacatctggcttgg

SEQ ID NO: 375581 - DNA, 25 bp, Rattus norvegicus
gcaaaacccatttcatctggcttgg

SEQ ID NO: 375582 - DNA, 25 bp, Rattus norvegicus
gcaaaacccgtcaaatgtagtgaat

SEQ ID NO: 375583 - DNA, 25 bp, Rattus norvegicus
gcaaaacccgtctaatgtagtgaat

SEQ ID NO: 375584 - DNA, 25 bp, Rattus norvegicus
gcaaaaccctgtcattcttacatgg

SEQ ID NO: 375585 - DNA, 25 bp, Rattus norvegicus
gcaaaaccctgtctgaaagtgaaaa

SEQ ID NO: 375586 - DNA, 25 bp, Rattus norvegicus
gcaaaaccctgtgattcttacatgg

SEQ ID NO: 375587 - DNA, 25 bp, Rattus norvegicus
gcaaaaccctgtgtgaaagtgaaaa

SEQ ID NO: 375588 - DNA, 25 bp, Rattus norvegicus
gcaaaaccgattacttttccttctg

SEQ ID NO: 375589 - DNA, 25 bp, Rattus norvegicus
gcaaaaccgatttcttttccttctg

SEQ ID NO: 375590 - DNA, 25 bp, Rattus norvegicus
gcaaaaccgccgactaactaatgaa

SEQ ID NO: 375591 - DNA, 25 bp, Rattus norvegicus
gcaaaaccgccgtctaactaatgaa

SEQ ID NO: 375592 - DNA, 25 bp, Rattus norvegicus
gcaaaaccgggtctcttctgtgtga

SEQ ID NO: 375593 - DNA, 25 bp, Rattus norvegicus
gcaaaaccgggtgtcttctgtgtga

SEQ ID NO: 375594 - DNA, 25 bp, Rattus norvegicus
gcaaaacctatgagaccccacggag

SEQ ID NO: 375595 - DNA, 25 bp, Rattus norvegicus
gcaaaacctatgtgaccccacggag

SEQ ID NO: 375596 - DNA, 25 bp, Rattus norvegicus
gcaaaacgagccatttgtggcctcc

SEQ ID NO: 375597 - DNA, 25 bp, Rattus norvegicus
gcaaaacgagccttttgtggcctcc

SEQ ID NO: 375598 - DNA, 25 bp, Rattus norvegicus
gcaaaactccttccctaagtaatct

SEQ ID NO: 375599 - DNA, 25 bp, Rattus norvegicus
gcaaaactccttgcctaagtaatct

SEQ ID NO: 375600 - DNA, 25 bp, Rattus norvegicus
gcaaaactcttgaagctcattctga

SEQ ID NO: 375601 - DNA, 25 bp, Rattus norvegicus
gcaaaactcttgtagctcattctga

SEQ ID NO: 375602 - DNA, 25 bp, Rattus norvegicus
gcaaaactgattactcccttctggg

SEQ ID NO: 375603 - DNA, 25 bp, Rattus norvegicus
gcaaaactgatttctcccttctggg

SEQ ID NO: 375604 - DNA, 25 bp, Rattus norvegicus
gcaaaactgctcatggtgttgtcaa

SEQ ID NO: 375605 - DNA, 25 bp, Rattus norvegicus
gcaaaactgctcttggtgttgtcaa

SEQ ID NO: 375606 - DNA, 25 bp, Rattus norvegicus
gcaaaactggtgaacatcggatgaa

SEQ ID NO: 375607 - DNA, 25 bp, Rattus norvegicus
gcaaaactggtgtacatcggatgaa

SEQ ID NO: 375608 - DNA, 25 bp, Rattus norvegicus
gcaaaactgtccattcttggcaggg

SEQ ID NO: 375609 - DNA, 25 bp, Rattus norvegicus
gcaaaactgtcctttcttggcaggg

SEQ ID NO: 375610 - DNA, 25 bp, Rattus norvegicus
gcaaaacttcggaatccccaggtct

SEQ ID NO: 375611 - DNA, 25 bp, Rattus norvegicus
gcaaaacttcggtatccccaggtct

SEQ ID NO: 375612 - DNA, 25 bp, Rattus norvegicus
gcaaaacttgttcgtcttgccaaat

SEQ ID NO: 375613 - DNA, 25 bp, Rattus norvegicus
gcaaaacttgttggtcttgccaaat

SEQ ID NO: 375614 - DNA, 25 bp, Rattus norvegicus
gcaaaactttctctaactctcaaac

SEQ ID NO: 375615 - DNA, 25 bp, Rattus norvegicus
gcaaaactttctgtaactctcaaac

SEQ ID NO: 375616 - DNA, 25 bp, Rattus norvegicus
gcaaaagaatccacggacctcggct

SEQ ID NO: 375617 - DNA, 25 bp, Rattus norvegicus
gcaaaagaatcctcggacctcggct

SEQ ID NO: 375618 - DNA, 25 bp, Rattus norvegicus
gcaaaagaccctcgttcgattcctg

SEQ ID NO: 375619 - DNA, 25 bp, Rattus norvegicus
gcaaaagaccctggttcgattcctg

SEQ ID NO: 375620 - DNA, 25 bp, Rattus norvegicus
gcaaaagaccggctttgcctttgtg

SEQ ID NO: 375621 - DNA, 25 bp, Rattus norvegicus
gcaaaagaccgggtttgcctttgtg

SEQ ID NO: 375622 - DNA, 25 bp, Rattus norvegicus
gcaaaagatcgaccttcggctgcag

SEQ ID NO: 375623 - DNA, 25 bp, Rattus norvegicus
gcaaaagatcgagcttcggctgcag

SEQ ID NO: 375624 - DNA, 25 bp, Rattus norvegicus
gcaaaagatcttacaattcattaaa

SEQ ID NO: 375625 - DNA, 25 bp, Rattus norvegicus
gcaaaagatctttcaattcattaaa

SEQ ID NO: 375626 - DNA, 25 bp, Rattus norvegicus
gcaaaagcactgatccgtatttatt

SEQ ID NO: 375627 - DNA, 25 bp, Rattus norvegicus
gcaaaagcactgttccgtatttatt

SEQ ID NO: 375628 - DNA, 25 bp, Rattus norvegicus
gcaaaagcagatactctgtcttctc

SEQ ID NO: 375629 - DNA, 25 bp, Rattus norvegicus
gcaaaagcagattctctgtcttctc

SEQ ID NO: 375630 - DNA, 25 bp, Rattus norvegicus
gcaaaagcattcctctagctctgga

SEQ ID NO: 375631 - DNA, 25 bp, Rattus norvegicus
gcaaaagcattcgtctagctctgga

SEQ ID NO: 375632 - DNA, 25 bp, Rattus norvegicus
gcaaaagcccgaaaaggccatcctc

SEQ ID NO: 375633 - DNA, 25 bp, Rattus norvegicus
gcaaaagcccgataaggccatcctc

SEQ ID NO: 375634 - DNA, 25 bp, Rattus norvegicus
gcaaaagccggtcggtggaacttca

SEQ ID NO: 375635 - DNA, 25 bp, Rattus norvegicus
gcaaaagccggtgggtggaacttca

SEQ ID NO: 375636 - DNA, 25 bp, Rattus norvegicus
gcaaaagcgttgataacttctataa

SEQ ID NO: 375637 - DNA, 25 bp, Rattus norvegicus
gcaaaagcgttgttaacttctataa

SEQ ID NO: 375638 - DNA, 25 bp, Rattus norvegicus
gcaaaagctacacgtggactcccac

SEQ ID NO: 375639 - DNA, 25 bp, Rattus norvegicus
gcaaaagctacaggtggactcccac

SEQ ID NO: 375640 - DNA, 25 bp, Rattus norvegicus
gcaaaagctctcattgttacctaat

SEQ ID NO: 375641 - DNA, 25 bp, Rattus norvegicus
gcaaaagctctctttgttacctaat

SEQ ID NO: 375642 - DNA, 25 bp, Rattus norvegicus
gcaaaagctgccatgacatcacaac

SEQ ID NO: 375643 - DNA, 25 bp, Rattus norvegicus
gcaaaagctgccttgacatcacaac

SEQ ID NO: 375644 - DNA, 25 bp, Rattus norvegicus
gcaaaagctgctaacttccttgagt

SEQ ID NO: 375645 - DNA, 25 bp, Rattus norvegicus
gcaaaagctgcttacttccttgagt

SEQ ID NO: 375646 - DNA, 25 bp, Rattus norvegicus
gcaaaagctggcctcaactgctcta

SEQ ID NO: 375647 - DNA, 25 bp, Rattus norvegicus
gcaaaagctggcgtcaactgctcta

SEQ ID NO: 375648 - DNA, 25 bp, Rattus norvegicus
gcaaaagctgggagccttgtatgcc

SEQ ID NO: 375649 - DNA, 25 bp, Rattus norvegicus
gcaaaagctgggtgccttgtatgcc

SEQ ID NO: 375650 - DNA, 25 bp, Rattus norvegicus
gcaaaagcttgtctttctaatttca

SEQ ID NO: 375651 - DNA, 25 bp, Rattus norvegicus
gcaaaagcttgtgtttctaatttca

SEQ ID NO: 375652 - DNA, 25 bp, Rattus norvegicus
gcaaaagctttacagtcactgggac

SEQ ID NO: 375653 - DNA, 25 bp, Rattus norvegicus
gcaaaagctttagagtcactgggac

SEQ ID NO: 375654 - DNA, 25 bp, Rattus norvegicus
gcaaaagcttttcagtgtcatccaa

SEQ ID NO: 375655 - DNA, 25 bp, Rattus norvegicus
gcaaaagcttttgagtgtcatccaa

SEQ ID NO: 375656 - DNA, 25 bp, Rattus norvegicus
gcaaaaggaatccacttaacaggga

SEQ ID NO: 375657 - DNA, 25 bp, Rattus norvegicus
gcaaaaggaatcgacttaacaggga

SEQ ID NO: 375658 - DNA, 25 bp, Rattus norvegicus
gcaaaaggactcagtgatagctcac

SEQ ID NO: 375659 - DNA, 25 bp, Rattus norvegicus
gcaaaaggactctgtgatagctcac

SEQ ID NO: 375660 - DNA, 25 bp, Rattus norvegicus
gcaaaaggccataccgacttactaa

SEQ ID NO: 375661 - DNA, 25 bp, Rattus norvegicus
gcaaaaggccattccgacttactaa

SEQ ID NO: 375662 - DNA, 25 bp, Rattus norvegicus
gcaaaaggctatagacctcggtcat

SEQ ID NO: 375663 - DNA, 25 bp, Rattus norvegicus
gcaaaaggctattgacctcggtcat

SEQ ID NO: 375664 - DNA, 25 bp, Rattus norvegicus
gcaaaaggtccaagctagaagtggg

SEQ ID NO: 375665 - DNA, 25 bp, Rattus norvegicus
gcaaaaggtccatgctagaagtggg

SEQ ID NO: 375666 - DNA, 25 bp, Rattus norvegicus
gcaaaaggtggcagtggcacacact

SEQ ID NO: 375667 - DNA, 25 bp, Rattus norvegicus
gcaaaaggtggctgtggcacacact

SEQ ID NO: 375668 - DNA, 25 bp, Rattus norvegicus
gcaaaagtatctctaaaatccatgg

SEQ ID NO: 375669 - DNA, 25 bp, Rattus norvegicus
gcaaaagtatctgtaaaatccatgg

SEQ ID NO: 375670 - DNA, 25 bp, Rattus norvegicus
gcaaaagtgactatcgtttcctcga

SEQ ID NO: 375671 - DNA, 25 bp, Rattus norvegicus
gcaaaagtgactttcgtttcctcga

SEQ ID NO: 375672 - DNA, 25 bp, Rattus norvegicus
gcaaaagtgatgattaccagataga

SEQ ID NO: 375673 - DNA, 25 bp, Rattus norvegicus
gcaaaagtgatgtttaccagataga

SEQ ID NO: 375674 - DNA, 25 bp, Rattus norvegicus
gcaaaagtgcttatctactacacat

SEQ ID NO: 375675 - DNA, 25 bp, Rattus norvegicus
gcaaaagtgcttttctactacacat

SEQ ID NO: 375676 - DNA, 25 bp, Rattus norvegicus
gcaaaagtggccaaccgtacacgtt

SEQ ID NO: 375677 - DNA, 25 bp, Rattus norvegicus
gcaaaagtggcctaccgtacacgtt

SEQ ID NO: 375678 - DNA, 25 bp, Rattus norvegicus
gcaaaagttcttacccaggcaagat

SEQ ID NO: 375679 - DNA, 25 bp, Rattus norvegicus
gcaaaagttctttcccaggcaagat

SEQ ID NO: 375680 - DNA, 25 bp, Rattus norvegicus
gcaaaagttgttagtatctccaaat

SEQ ID NO: 375681 - DNA, 25 bp, Rattus norvegicus
gcaaaagttgtttgtatctccaaat

SEQ ID NO: 375682 - DNA, 25 bp, Rattus norvegicus
gcaaaatatactacgccttcaaccc

SEQ ID NO: 375683 - DNA, 25 bp, Rattus norvegicus
gcaaaatatacttcgccttcaaccc

SEQ ID NO: 375684 - DNA, 25 bp, Rattus norvegicus
gcaaaatatctgaaatttcagcact

SEQ ID NO: 375685 - DNA, 25 bp, Rattus norvegicus
gcaaaatatctgtaatttcagcact

SEQ ID NO: 375686 - DNA, 25 bp, Rattus norvegicus
gcaaaatatgtactgctttcaacag

SEQ ID NO: 375687 - DNA, 25 bp, Rattus norvegicus
gcaaaatatgtagtgctttcaacag

SEQ ID NO: 375688 - DNA, 25 bp, Rattus norvegicus
gcaaaatattctcgacttcaccaag

SEQ ID NO: 375689 - DNA, 25 bp, Rattus norvegicus
gcaaaatattctggacttcaccaag

SEQ ID NO: 375690 - DNA, 25 bp, Rattus norvegicus
gcaaaatccaacatttctctaagag

SEQ ID NO: 375691 - DNA, 25 bp, Rattus norvegicus
gcaaaatccaacttttctctaagag

SEQ ID NO: 375692 - DNA, 25 bp, Rattus norvegicus
gcaaaatccatacctgtgtgagcac

SEQ ID NO: 375693 - DNA, 25 bp, Rattus norvegicus
gcaaaatccatagctgtgtgagcac

SEQ ID NO: 375694 - DNA, 25 bp, Rattus norvegicus
gcaaaatcctgtacgtttagagcca

SEQ ID NO: 375695 - DNA, 25 bp, Rattus norvegicus
gcaaaatcctgttcgtttagagcca

SEQ ID NO: 375696 - DNA, 25 bp, Rattus norvegicus
gcaaaatgagttctattcttccaaa

SEQ ID NO: 375697 - DNA, 25 bp, Rattus norvegicus
gcaaaatgagttgtattcttccaaa

SEQ ID NO: 375698 - DNA, 25 bp, Rattus norvegicus
gcaaaatgctgtcccttggtttctc

SEQ ID NO: 375699 - DNA, 25 bp, Rattus norvegicus
gcaaaatgctgtgccttggtttctc

SEQ ID NO: 375700 - DNA, 25 bp, Rattus norvegicus
gcaaaatggatcagggtaacaagaa

SEQ ID NO: 375701 - DNA, 25 bp, Rattus norvegicus
gcaaaatggatctgggtaacaagaa

SEQ ID NO: 375702 - DNA, 25 bp, Rattus norvegicus
gcaaaatggtggctgtcctctctgg

SEQ ID NO: 375703 - DNA, 25 bp, Rattus norvegicus
gcaaaatggtgggtgtcctctctgg

SEQ ID NO: 375704 - DNA, 25 bp, Rattus norvegicus
gcaaaatgtacacactaggccctca

SEQ ID NO: 375705 - DNA, 25 bp, Rattus norvegicus
gcaaaatgtacagactaggccctca

SEQ ID NO: 375706 - DNA, 25 bp, Rattus norvegicus
gcaaaatgtgctactccatgacctt

SEQ ID NO: 375707 - DNA, 25 bp, Rattus norvegicus
gcaaaatgtgcttctccatgacctt

SEQ ID NO: 375708 - DNA, 25 bp, Rattus norvegicus
gcaaaattcgtaagttattggtctg

SEQ ID NO: 375709 - DNA, 25 bp, Rattus norvegicus
gcaaaattcgtatgttattggtctg

SEQ ID NO: 375710 - DNA, 25 bp, Rattus norvegicus
gcaaaattctataccatatggtcaa

SEQ ID NO: 375711 - DNA, 25 bp, Rattus norvegicus
gcaaaattctattccatatggtcaa

SEQ ID NO: 375712 - DNA, 25 bp, Rattus norvegicus
gcaaaattgagacagccatcggcct

SEQ ID NO: 375713 - DNA, 25 bp, Rattus norvegicus
gcaaaattgagagagccatcggcct

SEQ ID NO: 375714 - DNA, 25 bp, Rattus norvegicus
gcaaaattggttaaaattccactca

SEQ ID NO: 375715 - DNA, 25 bp, Rattus norvegicus
gcaaaattggtttaaattccactca

SEQ ID NO: 375716 - DNA, 25 bp, Rattus norvegicus
gcaaaattgtagcttgagaccctta

SEQ ID NO: 375717 - DNA, 25 bp, Rattus norvegicus
gcaaaattgtaggttgagaccctta

SEQ ID NO: 375718 - DNA, 25 bp, Rattus norvegicus
gcaaacaaaaccactgtcactttgg

SEQ ID NO: 375719 - DNA, 25 bp, Rattus norvegicus
gcaaacaaaacctctgtcactttgg

SEQ ID NO: 375720 - DNA, 25 bp, Rattus norvegicus
gcaaacaaaggcaacctggtcatct

SEQ ID NO: 375721 - DNA, 25 bp, Rattus norvegicus
gcaaacaaaggctacctggtcatct

SEQ ID NO: 375722 - DNA, 25 bp, Rattus norvegicus
gcaaacaacattattcaaagaccac

SEQ ID NO: 375723 - DNA, 25 bp, Rattus norvegicus
gcaaacaacatttttcaaagaccac

SEQ ID NO: 375724 - DNA, 25 bp, Rattus norvegicus
gcaaacaagcaaacactagtagatt

SEQ ID NO: 375725 - DNA, 25 bp, Rattus norvegicus
gcaaacaagcaatcactagtagatt

SEQ ID NO: 375726 - DNA, 25 bp, Rattus norvegicus
gcaaacaagccaatcccaggaggaa

SEQ ID NO: 375727 - DNA, 25 bp, Rattus norvegicus
gcaaacaagccattcccaggaggaa

SEQ ID NO: 375728 - DNA, 25 bp, Rattus norvegicus
gcaaacacaactaactttccttctt

SEQ ID NO: 375729 - DNA, 25 bp, Rattus norvegicus
gcaaacacaacttactttccttctt

SEQ ID NO: 375730 - DNA, 25 bp, Rattus norvegicus
gcaaacacagggatggctaagcaaa

SEQ ID NO: 375731 - DNA, 25 bp, Rattus norvegicus
gcaaacacagggttggctaagcaaa

SEQ ID NO: 375732 - DNA, 25 bp, Rattus norvegicus
gcaaacacagtacctatgtctttaa

SEQ ID NO: 375733 - DNA, 25 bp, Rattus norvegicus
gcaaacacagtagctatgtctttaa

SEQ ID NO: 375734 - DNA, 25 bp, Rattus norvegicus
gcaaacaccaacaaccgtatgtgaa

SEQ ID NO: 375735 - DNA, 25 bp, Rattus norvegicus
gcaaacaccaactaccgtatgtgaa

SEQ ID NO: 375736 - DNA, 25 bp, Rattus norvegicus
gcaaacacctgccatgttttcgtgt

SEQ ID NO: 375737 - DNA, 25 bp, Rattus norvegicus
gcaaacacctgcgatgttttcgtgt

SEQ ID NO: 375738 - DNA, 25 bp, Rattus norvegicus
gcaaacacctgtctcagttgttctt

SEQ ID NO: 375739 - DNA, 25 bp, Rattus norvegicus
gcaaacacctgtgtcagttgttctt

SEQ ID NO: 375740 - DNA, 25 bp, Rattus norvegicus
gcaaacacgatcactgggaccataa

SEQ ID NO: 375741 - DNA, 25 bp, Rattus norvegicus
gcaaacacgatctctgggaccataa

SEQ ID NO: 375742 - DNA, 25 bp, Rattus norvegicus
gcaaacacgtggcagagacattgtc

SEQ ID NO: 375743 - DNA, 25 bp, Rattus norvegicus
gcaaacacgtgggagagacattgtc

SEQ ID NO: 375744 - DNA, 25 bp, Rattus norvegicus
gcaaacactgctaattgcagttgaa

SEQ ID NO: 375745 - DNA, 25 bp, Rattus norvegicus
gcaaacactgcttattgcagttgaa

SEQ ID NO: 375746 - DNA, 25 bp, Rattus norvegicus
gcaaacactggaatcataatcttgt

SEQ ID NO: 375747 - DNA, 25 bp, Rattus norvegicus
gcaaacactggattcataatcttgt

SEQ ID NO: 375748 - DNA, 25 bp, Rattus norvegicus
gcaaacactggtctgtggtcgcact

SEQ ID NO: 375749 - DNA, 25 bp, Rattus norvegicus
gcaaacactggtgtgtggtcgcact

SEQ ID NO: 375750 - DNA, 25 bp, Rattus norvegicus
gcaaacagactgaggcagtgctccc

SEQ ID NO: 375751 - DNA, 25 bp, Rattus norvegicus
gcaaacagactgtggcagtgctccc

SEQ ID NO: 375752 - DNA, 25 bp, Rattus norvegicus
gcaaacagcgtgctctgattgttca

SEQ ID NO: 375753 - DNA, 25 bp, Rattus norvegicus
gcaaacagcgtggtctgattgttca

SEQ ID NO: 375754 - DNA, 25 bp, Rattus norvegicus
gcaaacagctctcacccaggacagt

SEQ ID NO: 375755 - DNA, 25 bp, Rattus norvegicus
gcaaacagctctgacccaggacagt

SEQ ID NO: 375756 - DNA, 25 bp, Rattus norvegicus
gcaaacagcttcaggcagagctcta

SEQ ID NO: 375757 - DNA, 25 bp, Rattus norvegicus
gcaaacagcttctggcagagctcta

SEQ ID NO: 375758 - DNA, 25 bp, Rattus norvegicus
gcaaacaggctacagtttctctatg

SEQ ID NO: 375759 - DNA, 25 bp, Rattus norvegicus
gcaaacaggctagagtttctctatg

SEQ ID NO: 375760 - DNA, 25 bp, Rattus norvegicus
gcaaacaggttacgccccagaatta

SEQ ID NO: 375761 - DNA, 25 bp, Rattus norvegicus
gcaaacaggttaggccccagaatta

SEQ ID NO: 375762 - DNA, 25 bp, Rattus norvegicus
gcaaacagtacaactctgttctcat

SEQ ID NO: 375763 - DNA, 25 bp, Rattus norvegicus
gcaaacagtacatctctgttctcat

SEQ ID NO: 375764 - DNA, 25 bp, Rattus norvegicus
gcaaacagtcgcaggtggaaaacat

SEQ ID NO: 375765 - DNA, 25 bp, Rattus norvegicus
gcaaacagtcgctggtggaaaacat

SEQ ID NO: 375766 - DNA, 25 bp, Rattus norvegicus
gcaaacagtctaattcggcgaattt

SEQ ID NO: 375767 - DNA, 25 bp, Rattus norvegicus
gcaaacagtctatttcggcgaattt

SEQ ID NO: 375768 - DNA, 25 bp, Rattus norvegicus
gcaaacagttcaaaggaagcatctt

SEQ ID NO: 375769 - DNA, 25 bp, Rattus norvegicus
gcaaacagttcaaatctcacacaga

SEQ ID NO: 375770 - DNA, 25 bp, Rattus norvegicus
gcaaacagttcataggaagcatctt

SEQ ID NO: 375771 - DNA, 25 bp, Rattus norvegicus
gcaaacagttcatatctcacacaga

SEQ ID NO: 375772 - DNA, 25 bp, Rattus norvegicus
gcaaacatcctgaagcccgggtccg

SEQ ID NO: 375773 - DNA, 25 bp, Rattus norvegicus
gcaaacatcctgtagcccgggtccg

SEQ ID NO: 375774 - DNA, 25 bp, Rattus norvegicus
gcaaacatcggtattggccctgatt

SEQ ID NO: 375775 - DNA, 25 bp, Rattus norvegicus
gcaaacatcggttttggccctgatt

SEQ ID NO: 375776 - DNA, 25 bp, Rattus norvegicus
gcaaacatctgcatttcctgtagtt

SEQ ID NO: 375777 - DNA, 25 bp, Rattus norvegicus
gcaaacatctgcttttcctgtagtt

SEQ ID NO: 375778 - DNA, 25 bp, Rattus norvegicus
gcaaacatggcacgctctacacaga

SEQ ID NO: 375779 - DNA, 25 bp, Rattus norvegicus
gcaaacatggcaggctctacacaga

SEQ ID NO: 375780 - DNA, 25 bp, Rattus norvegicus
gcaaacatgttgcaattcaggtact

SEQ ID NO: 375781 - DNA, 25 bp, Rattus norvegicus
gcaaacatgttggaattcaggtact

SEQ ID NO: 375782 - DNA, 25 bp, Rattus norvegicus
gcaaacattgttaacagccggatca

SEQ ID NO: 375783 - DNA, 25 bp, Rattus norvegicus
gcaaacattgtttacagccggatca

SEQ ID NO: 375784 - DNA, 25 bp, Rattus norvegicus
gcaaacatttctatagctgcacttg

SEQ ID NO: 375785 - DNA, 25 bp, Rattus norvegicus
gcaaacatttctttagctgcacttg

SEQ ID NO: 375786 - DNA, 25 bp, Rattus norvegicus
gcaaacatttgcactatgcagttta

SEQ ID NO: 375787 - DNA, 25 bp, Rattus norvegicus
gcaaacatttgctctatgcagttta

SEQ ID NO: 375788 - DNA, 25 bp, Rattus norvegicus
gcaaacatttttaaaccactgagtc

SEQ ID NO: 375789 - DNA, 25 bp, Rattus norvegicus
gcaaacattttttaaccactgagtc

SEQ ID NO: 375790 - DNA, 25 bp, Rattus norvegicus
gcaaaccaagatcggcagattctct

SEQ ID NO: 375791 - DNA, 25 bp, Rattus norvegicus
gcaaaccaagatgggcagattctct

SEQ ID NO: 375792 - DNA, 25 bp, Rattus norvegicus
gcaaaccagattatcatgtgtacac

SEQ ID NO: 375793 - DNA, 25 bp, Rattus norvegicus
gcaaaccagattttcatgtgtacac

SEQ ID NO: 375794 - DNA, 25 bp, Rattus norvegicus
gcaaaccagccacagctcagttgtt

SEQ ID NO: 375795 - DNA, 25 bp, Rattus norvegicus
gcaaaccagccagagctcagttgtt

SEQ ID NO: 375796 - DNA, 25 bp, Rattus norvegicus
gcaaaccagctgcttgctcttagga

SEQ ID NO: 375797 - DNA, 25 bp, Rattus norvegicus
gcaaaccagctggttgctcttagga

SEQ ID NO: 375798 - DNA, 25 bp, Rattus norvegicus
gcaaaccatatgatctcattgttaa

SEQ ID NO: 375799 - DNA, 25 bp, Rattus norvegicus
gcaaaccatatgttctcattgttaa

SEQ ID NO: 375800 - DNA, 25 bp, Rattus norvegicus
gcaaaccatctgcatgtcagggaca

SEQ ID NO: 375801 - DNA, 25 bp, Rattus norvegicus
gcaaaccatctggatgtcagggaca

SEQ ID NO: 375802 - DNA, 25 bp, Rattus norvegicus
gcaaacccaagcctgaagagatgaa

SEQ ID NO: 375803 - DNA, 25 bp, Rattus norvegicus
gcaaacccaagcgtgaagagatgaa

SEQ ID NO: 375804 - DNA, 25 bp, Rattus norvegicus
gcaaaccccgggatcttttgcgctt

SEQ ID NO: 375805 - DNA, 25 bp, Rattus norvegicus
gcaaaccccgggttcttttgcgctt

SEQ ID NO: 375806 - DNA, 25 bp, Rattus norvegicus
gcaaaccccgtgcttcaaggctaca

SEQ ID NO: 375807 - DNA, 25 bp, Rattus norvegicus
gcaaaccccgtggttcaaggctaca

SEQ ID NO: 375808 - DNA, 25 bp, Rattus norvegicus
gcaaacccctagagacttcttaaag

SEQ ID NO: 375809 - DNA, 25 bp, Rattus norvegicus
gcaaacccctagtgacttcttaaag

SEQ ID NO: 375810 - DNA, 25 bp, Rattus norvegicus
gcaaacccgaggcttcggctcggac

SEQ ID NO: 375811 - DNA, 25 bp, Rattus norvegicus
gcaaacccgagggttcggctcggac

SEQ ID NO: 375812 - DNA, 25 bp, Rattus norvegicus
gcaaacccgatgcttgtttactgta

SEQ ID NO: 375813 - DNA, 25 bp, Rattus norvegicus
gcaaacccgatggttgtttactgta

SEQ ID NO: 375814 - DNA, 25 bp, Rattus norvegicus
gcaaacccgtaaccctctttggtat

SEQ ID NO: 375815 - DNA, 25 bp, Rattus norvegicus
gcaaacccgtaagcctctttggtat

SEQ ID NO: 375816 - DNA, 25 bp, Rattus norvegicus
gcaaaccctacgagcgaatgtgcat

SEQ ID NO: 375817 - DNA, 25 bp, Rattus norvegicus
gcaaaccctacgtgcgaatgtgcat

SEQ ID NO: 375818 - DNA, 25 bp, Rattus norvegicus
gcaaacccttgcatagtgacggcga

SEQ ID NO: 375819 - DNA, 25 bp, Rattus norvegicus
gcaaacccttgcttagtgacggcga

SEQ ID NO: 375820 - DNA, 25 bp, Rattus norvegicus
gcaaaccgacatctggctgtgacaa

SEQ ID NO: 375821 - DNA, 25 bp, Rattus norvegicus
gcaaaccgacatgtggctgtgacaa

SEQ ID NO: 375822 - DNA, 25 bp, Rattus norvegicus
gcaaacctagtgagctatgcctaag

SEQ ID NO: 375823 - DNA, 25 bp, Rattus norvegicus
gcaaacctagtgtgctatgcctaag

SEQ ID NO: 375824 - DNA, 25 bp, Rattus norvegicus
gcaaacctcccacagctaataattc

SEQ ID NO: 375825 - DNA, 25 bp, Rattus norvegicus
gcaaacctcccagagctaataattc

SEQ ID NO: 375826 - DNA, 25 bp, Rattus norvegicus
gcaaacctctgaacattgaccatct

SEQ ID NO: 375827 - DNA, 25 bp, Rattus norvegicus
gcaaacctctgatcattgaccatct

SEQ ID NO: 375828 - DNA, 25 bp, Rattus norvegicus
gcaaacctgaggatttcggcggccc

SEQ ID NO: 375829 - DNA, 25 bp, Rattus norvegicus
gcaaacctgaggttttcggcggccc

SEQ ID NO: 375830 - DNA, 25 bp, Rattus norvegicus
gcaaacctggagaaagtgtcccgga

SEQ ID NO: 375831 - DNA, 25 bp, Rattus norvegicus
gcaaacctggagtaagtgtcccgga

SEQ ID NO: 375832 - DNA, 25 bp, Rattus norvegicus
gcaaacctggtcatgtggcgcagca

SEQ ID NO: 375833 - DNA, 25 bp, Rattus norvegicus
gcaaacctggtcttgtggcgcagca

SEQ ID NO: 375834 - DNA, 25 bp, Rattus norvegicus
gcaaacctgtaaattgcctgggtgg

SEQ ID NO: 375835 - DNA, 25 bp, Rattus norvegicus
gcaaacctgtaatttgcctgggtgg

SEQ ID NO: 375836 - DNA, 25 bp, Rattus norvegicus
gcaaacctgtccaaccatagttttg

SEQ ID NO: 375837 - DNA, 25 bp, Rattus norvegicus
gcaaacctgtcctaccatagttttg

SEQ ID NO: 375838 - DNA, 25 bp, Rattus norvegicus
gcaaacctgtgtaactggagtcaaa

SEQ ID NO: 375839 - DNA, 25 bp, Rattus norvegicus
gcaaacctgtgttactggagtcaaa

SEQ ID NO: 375840 - DNA, 25 bp, Rattus norvegicus
gcaaaccttatacccaatctcatag

SEQ ID NO: 375841 - DNA, 25 bp, Rattus norvegicus
gcaaaccttatagccaatctcatag

SEQ ID NO: 375842 - DNA, 25 bp, Rattus norvegicus
gcaaaccttcctaaatctaacacta

SEQ ID NO: 375843 - DNA, 25 bp, Rattus norvegicus
gcaaaccttccttaatctaacacta

SEQ ID NO: 375844 - DNA, 25 bp, Rattus norvegicus
gcaaaccttggcacataccagtgaa

SEQ ID NO: 375845 - DNA, 25 bp, Rattus norvegicus
gcaaaccttggctcataccagtgaa

SEQ ID NO: 375846 - DNA, 25 bp, Rattus norvegicus
gcaaaccttttgatatgcctttatt

SEQ ID NO: 375847 - DNA, 25 bp, Rattus norvegicus
gcaaaccttttgttatgcctttatt

SEQ ID NO: 375848 - DNA, 25 bp, Rattus norvegicus
gcaaacgactgcagctttagccgtg

SEQ ID NO: 375849 - DNA, 25 bp, Rattus norvegicus
gcaaacgactgctgctttagccgtg

SEQ ID NO: 375850 - DNA, 25 bp, Rattus norvegicus
gcaaacgaggaccaagtagcagact

SEQ ID NO: 375851 - DNA, 25 bp, Rattus norvegicus
gcaaacgaggacgaagtagcagact

SEQ ID NO: 375852 - DNA, 25 bp, Rattus norvegicus
gcaaacgccaaacttggctctttta

SEQ ID NO: 375853 - DNA, 25 bp, Rattus norvegicus
gcaaacgccaaagttggctctttta

SEQ ID NO: 375854 - DNA, 25 bp, Rattus norvegicus
gcaaacgccgatccacatgtgtgaa

SEQ ID NO: 375855 - DNA, 25 bp, Rattus norvegicus
gcaaacgccgatgcacatgtgtgaa

SEQ ID NO: 375856 - DNA, 25 bp, Rattus norvegicus
gcaaacgcgctgctgatatgaacat

SEQ ID NO: 375857 - DNA, 25 bp, Rattus norvegicus
gcaaacgcgctggtgatatgaacat

SEQ ID NO: 375858 - DNA, 25 bp, Rattus norvegicus
gcaaacgctgctcggaggtgcacca

SEQ ID NO: 375859 - DNA, 25 bp, Rattus norvegicus
gcaaacgctgctgggaggtgcacca

SEQ ID NO: 375860 - DNA, 25 bp, Rattus norvegicus
gcaaacgctgtgaaacattactact

SEQ ID NO: 375861 - DNA, 25 bp, Rattus norvegicus
gcaaacgctgtgtaacattactact

SEQ ID NO: 375862 - DNA, 25 bp, Rattus norvegicus
gcaaacggtttgctcatttctttac

SEQ ID NO: 375863 - DNA, 25 bp, Rattus norvegicus
gcaaacggtttggtcatttctttac

SEQ ID NO: 375864 - DNA, 25 bp, Rattus norvegicus
gcaaacgtgccacaccagagtactt

SEQ ID NO: 375865 - DNA, 25 bp, Rattus norvegicus
gcaaacgtgccagaccagagtactt

SEQ ID NO: 375866 - DNA, 25 bp, Rattus norvegicus
gcaaacgtggtgaacgtctgctctg

SEQ ID NO: 375867 - DNA, 25 bp, Rattus norvegicus
gcaaacgtggtgtacgtctgctctg

SEQ ID NO: 375868 - DNA, 25 bp, Rattus norvegicus
gcaaacgtgtttcagcggtaggcca

SEQ ID NO: 375869 - DNA, 25 bp, Rattus norvegicus
gcaaacgtgtttgagcggtaggcca

SEQ ID NO: 375870 - DNA, 25 bp, Rattus norvegicus
gcaaactaaatgacaacctcctggg

SEQ ID NO: 375871 - DNA, 25 bp, Rattus norvegicus
gcaaactaaatgtcaacctcctggg

SEQ ID NO: 375872 - DNA, 25 bp, Rattus norvegicus
gcaaactaatttacgtgtcttgatt

SEQ ID NO: 375873 - DNA, 25 bp, Rattus norvegicus
gcaaactaattttcgtgtcttgatt

SEQ ID NO: 375874 - DNA, 25 bp, Rattus norvegicus
gcaaactagacaagcacccacataa

SEQ ID NO: 375875 - DNA, 25 bp, Rattus norvegicus
gcaaactagacatgcacccacataa

SEQ ID NO: 375876 - DNA, 25 bp, Rattus norvegicus
gcaaactaggctcaatatggtgcta

SEQ ID NO: 375877 - DNA, 25 bp, Rattus norvegicus
gcaaactaggctgaatatggtgcta

SEQ ID NO: 375878 - DNA, 25 bp, Rattus norvegicus
gcaaactagggcaatttcagaaatt

SEQ ID NO: 375879 - DNA, 25 bp, Rattus norvegicus
gcaaactagggctatttcagaaatt

SEQ ID NO: 375880 - DNA, 25 bp, Rattus norvegicus
gcaaactataccatggaaccctacg

SEQ ID NO: 375881 - DNA, 25 bp, Rattus norvegicus
gcaaactataccttggaaccctacg

SEQ ID NO: 375882 - DNA, 25 bp, Rattus norvegicus
gcaaactatttcagatggcgtcatt

SEQ ID NO: 375883 - DNA, 25 bp, Rattus norvegicus
gcaaactatttctgatggcgtcatt

SEQ ID NO: 375884 - DNA, 25 bp, Rattus norvegicus
gcaaactcacacaatccaatggatt

SEQ ID NO: 375885 - DNA, 25 bp, Rattus norvegicus
gcaaactcacactatccaatggatt

SEQ ID NO: 375886 - DNA, 25 bp, Rattus norvegicus
gcaaactccacaaagctttgagatg

SEQ ID NO: 375887 - DNA, 25 bp, Rattus norvegicus
gcaaactccacatagctttgagatg

SEQ ID NO: 375888 - DNA, 25 bp, Rattus norvegicus
gcaaactccattcctgtgtgcagct

SEQ ID NO: 375889 - DNA, 25 bp, Rattus norvegicus
gcaaactccattgctgtgtgcagct

SEQ ID NO: 375890 - DNA, 25 bp, Rattus norvegicus
gcaaactccccaccgtggaggaggt

SEQ ID NO: 375891 - DNA, 25 bp, Rattus norvegicus
gcaaactccccagcgtggaggaggt

SEQ ID NO: 375892 - DNA, 25 bp, Rattus norvegicus
gcaaactcccctagaactgcttgaa

SEQ ID NO: 375893 - DNA, 25 bp, Rattus norvegicus
gcaaactccccttgaactgcttgaa

SEQ ID NO: 375894 - DNA, 25 bp, Rattus norvegicus
gcaaactcctagaatgatggcctct

SEQ ID NO: 375895 - DNA, 25 bp, Rattus norvegicus
gcaaactcctagtatgatggcctct

SEQ ID NO: 375896 - DNA, 25 bp, Rattus norvegicus
gcaaactcctgtcgtttcatctaat

SEQ ID NO: 375897 - DNA, 25 bp, Rattus norvegicus
gcaaactcctgtggtttcatctaat

SEQ ID NO: 375898 - DNA, 25 bp, Rattus norvegicus
gcaaactcgattatctacggttgca

SEQ ID NO: 375899 - DNA, 25 bp, Rattus norvegicus
gcaaactcgattttctacggttgca

SEQ ID NO: 375900 - DNA, 25 bp, Rattus norvegicus
gcaaactcggcgctggatcagaacg

SEQ ID NO: 375901 - DNA, 25 bp, Rattus norvegicus
gcaaactcggcggtggatcagaacg

SEQ ID NO: 375902 - DNA, 25 bp, Rattus norvegicus
gcaaactctcgaacgcgagacggtt

SEQ ID NO: 375903 - DNA, 25 bp, Rattus norvegicus
gcaaactctcgatcgcgagacggtt

SEQ ID NO: 375904 - DNA, 25 bp, Rattus norvegicus
gcaaactctgcaacttcaatatggg

SEQ ID NO: 375905 - DNA, 25 bp, Rattus norvegicus
gcaaactctgcatcttcaatatggg

SEQ ID NO: 375906 - DNA, 25 bp, Rattus norvegicus
gcaaactcttctaaaggtgaccctg

SEQ ID NO: 375907 - DNA, 25 bp, Rattus norvegicus
gcaaactcttcttaaggtgaccctg

SEQ ID NO: 375908 - DNA, 25 bp, Rattus norvegicus
gcaaactgaattattattctacgtt

SEQ ID NO: 375909 - DNA, 25 bp, Rattus norvegicus
gcaaactgaatttttattctacgtt

SEQ ID NO: 375910 - DNA, 25 bp, Rattus norvegicus
gcaaactgactgcatattctcatga

SEQ ID NO: 375911 - DNA, 25 bp, Rattus norvegicus
gcaaactgactggatattctcatga

SEQ ID NO: 375912 - DNA, 25 bp, Rattus norvegicus
gcaaactgagcgcaaagcaaacttt

SEQ ID NO: 375913 - DNA, 25 bp, Rattus norvegicus
gcaaactgagcggaaagcaaacttt

SEQ ID NO: 375914 - DNA, 25 bp, Rattus norvegicus
gcaaactgagttatctgccatttaa

SEQ ID NO: 375915 - DNA, 25 bp, Rattus norvegicus
gcaaactgagttttctgccatttaa

SEQ ID NO: 375916 - DNA, 25 bp, Rattus norvegicus
gcaaactgctaaagtgggatccctt

SEQ ID NO: 375917 - DNA, 25 bp, Rattus norvegicus
gcaaactgctaatgtgggatccctt

SEQ ID NO: 375918 - DNA, 25 bp, Rattus norvegicus
gcaaactgcttgatgatcgctccta

SEQ ID NO: 375919 - DNA, 25 bp, Rattus norvegicus
gcaaactgcttgttgatcgctccta

SEQ ID NO: 375920 - DNA, 25 bp, Rattus norvegicus
gcaaactggacaagtttcaagtcag

SEQ ID NO: 375921 - DNA, 25 bp, Rattus norvegicus
gcaaactggacatgtttcaagtcag

SEQ ID NO: 375922 - DNA, 25 bp, Rattus norvegicus
gcaaactggatgaccgagtgccaca

SEQ ID NO: 375923 - DNA, 25 bp, Rattus norvegicus
gcaaactggatgatcgactcctaga

SEQ ID NO: 375924 - DNA, 25 bp, Rattus norvegicus
gcaaactggatgtccgagtgccaca

SEQ ID NO: 375925 - DNA, 25 bp, Rattus norvegicus
gcaaactggatgttcgactcctaga

SEQ ID NO: 375926 - DNA, 25 bp, Rattus norvegicus
gcaaactggcagatgtagggcaact

SEQ ID NO: 375927 - DNA, 25 bp, Rattus norvegicus
gcaaactggcagttgtagggcaact

SEQ ID NO: 375928 - DNA, 25 bp, Rattus norvegicus
gcaaactggcccacggccaaggctg

SEQ ID NO: 375929 - DNA, 25 bp, Rattus norvegicus
gcaaactggcccattgtttcaagat

SEQ ID NO: 375930 - DNA, 25 bp, Rattus norvegicus
gcaaactggccctcggccaaggctg

SEQ ID NO: 375931 - DNA, 25 bp, Rattus norvegicus
gcaaactggccctttgtttcaagat

SEQ ID NO: 375932 - DNA, 25 bp, Rattus norvegicus
gcaaactgggaaatgtctctcttct

SEQ ID NO: 375933 - DNA, 25 bp, Rattus norvegicus
gcaaactgggaattgtctctcttct

SEQ ID NO: 375934 - DNA, 25 bp, Rattus norvegicus
gcaaactgggaccagcgcgtttcaa

SEQ ID NO: 375935 - DNA, 25 bp, Rattus norvegicus
gcaaactgggacgagcgcgtttcaa

SEQ ID NO: 375936 - DNA, 25 bp, Rattus norvegicus
gcaaactggggcaaaatccgcagca

SEQ ID NO: 375937 - DNA, 25 bp, Rattus norvegicus
gcaaactggggctaaatccgcagca

SEQ ID NO: 375938 - DNA, 25 bp, Rattus norvegicus
gcaaactggtggcataatggcagca

SEQ ID NO: 375939 - DNA, 25 bp, Rattus norvegicus
gcaaactggtgggataatggcagca

SEQ ID NO: 375940 - DNA, 25 bp, Rattus norvegicus
gcaaactgtacgagctgcccgcagc

SEQ ID NO: 375941 - DNA, 25 bp, Rattus norvegicus
gcaaactgtacgtgctgcccgcagc

SEQ ID NO: 375942 - DNA, 25 bp, Rattus norvegicus
gcaaactgtccaactttggcttgta

SEQ ID NO: 375943 - DNA, 25 bp, Rattus norvegicus
gcaaactgtccatctttggcttgta

SEQ ID NO: 375944 - DNA, 25 bp, Rattus norvegicus
gcaaacttaatcattcccgttgact

SEQ ID NO: 375945 - DNA, 25 bp, Rattus norvegicus
gcaaacttaatctttcccgttgact

SEQ ID NO: 375946 - DNA, 25 bp, Rattus norvegicus
gcaaacttccctctattcacagcaa

SEQ ID NO: 375947 - DNA, 25 bp, Rattus norvegicus
gcaaacttccctgtattcacagcaa

SEQ ID NO: 375948 - DNA, 25 bp, Rattus norvegicus
gcaaacttctcgagttaactatggt

SEQ ID NO: 375949 - DNA, 25 bp, Rattus norvegicus
gcaaacttctcgtgttaactatggt

SEQ ID NO: 375950 - DNA, 25 bp, Rattus norvegicus
gcaaacttgacaatcatagcttcaa

SEQ ID NO: 375951 - DNA, 25 bp, Rattus norvegicus
gcaaacttgacattcatagcttcaa

SEQ ID NO: 375952 - DNA, 25 bp, Rattus norvegicus
gcaaacttgttcctcagatgtggtt

SEQ ID NO: 375953 - DNA, 25 bp, Rattus norvegicus
gcaaacttgttcgtcagatgtggtt

SEQ ID NO: 375954 - DNA, 25 bp, Rattus norvegicus
gcaaactttaccaaggcggtccagg

SEQ ID NO: 375955 - DNA, 25 bp, Rattus norvegicus
gcaaactttacctaggcggtccagg

SEQ ID NO: 375956 - DNA, 25 bp, Rattus norvegicus
gcaaactttctacaagcctcctgga

SEQ ID NO: 375957 - DNA, 25 bp, Rattus norvegicus
gcaaactttctagaagcctcctgga

SEQ ID NO: 375958 - DNA, 25 bp, Rattus norvegicus
gcaaactttgagacggctttctgaa

SEQ ID NO: 375959 - DNA, 25 bp, Rattus norvegicus
gcaaactttgagtcggctttctgaa

SEQ ID NO: 375960 - DNA, 25 bp, Rattus norvegicus
gcaaacttttctaatgcagcatttt

SEQ ID NO: 375961 - DNA, 25 bp, Rattus norvegicus
gcaaacttttcttatgcagcatttt

SEQ ID NO: 375962 - DNA, 25 bp, Rattus norvegicus
gcaaacttttttcgcttacaactat

SEQ ID NO: 375963 - DNA, 25 bp, Rattus norvegicus
gcaaacttttttggcttacaactat

SEQ ID NO: 375964 - DNA, 25 bp, Rattus norvegicus
gcaaagaaacaaacgccactatgtg

SEQ ID NO: 375965 - DNA, 25 bp, Rattus norvegicus
gcaaagaaacaatcgccactatgtg

SEQ ID NO: 375966 - DNA, 25 bp, Rattus norvegicus
gcaaagaacaagaagcctccgcctg

SEQ ID NO: 375967 - DNA, 25 bp, Rattus norvegicus
gcaaagaacaagtagcctccgcctg

SEQ ID NO: 375968 - DNA, 25 bp, Rattus norvegicus
gcaaagaagctgccccgcccgggtt

SEQ ID NO: 375969 - DNA, 25 bp, Rattus norvegicus
gcaaagaagctggcccgcccgggtt

SEQ ID NO: 375970 - DNA, 25 bp, Rattus norvegicus
gcaaagaagggcatccaccaaccag

SEQ ID NO: 375971 - DNA, 25 bp, Rattus norvegicus
gcaaagaagggcttccaccaaccag

SEQ ID NO: 375972 - DNA, 25 bp, Rattus norvegicus
gcaaagaaggtgaccacggtggttt

SEQ ID NO: 375973 - DNA, 25 bp, Rattus norvegicus
gcaaagaaggtgtccacggtggttt

SEQ ID NO: 375974 - DNA, 25 bp, Rattus norvegicus
gcaaagaattcgcaccagtttaccc

SEQ ID NO: 375975 - DNA, 25 bp, Rattus norvegicus
gcaaagaattcggaccagtttaccc

SEQ ID NO: 375976 - DNA, 25 bp, Rattus norvegicus
gcaaagaccacacgcctcaggaaat

SEQ ID NO: 375977 - DNA, 25 bp, Rattus norvegicus
gcaaagaccacaggcctcaggaaat

SEQ ID NO: 375978 - DNA, 25 bp, Rattus norvegicus
gcaaagacccggagtggaaggacca

SEQ ID NO: 375979 - DNA, 25 bp, Rattus norvegicus
gcaaagacccggtgtggaaggacca

SEQ ID NO: 375980 - DNA, 25 bp, Rattus norvegicus
gcaaagacccttcgaagacccgtgg

SEQ ID NO: 375981 - DNA, 25 bp, Rattus norvegicus
gcaaagacccttggaagacccgtgg

SEQ ID NO: 375982 - DNA, 25 bp, Rattus norvegicus
gcaaagacgtatacccatacaccac

SEQ ID NO: 375983 - DNA, 25 bp, Rattus norvegicus
gcaaagacgtattcccatacaccac

SEQ ID NO: 375984 - DNA, 25 bp, Rattus norvegicus
gcaaagactgcacgccccttggatt

SEQ ID NO: 375985 - DNA, 25 bp, Rattus norvegicus
gcaaagactgcaggccccttggatt

SEQ ID NO: 375986 - DNA, 25 bp, Rattus norvegicus
gcaaagacttatatctcctttttgt

SEQ ID NO: 375987 - DNA, 25 bp, Rattus norvegicus
gcaaagacttatttctcctttttgt

SEQ ID NO: 375988 - DNA, 25 bp, Rattus norvegicus
gcaaagactttgaactacttcccgg

SEQ ID NO: 375989 - DNA, 25 bp, Rattus norvegicus
gcaaagactttgtactacttcccgg

SEQ ID NO: 375990 - DNA, 25 bp, Rattus norvegicus
gcaaagagcaggacgcccagttcca

SEQ ID NO: 375991 - DNA, 25 bp, Rattus norvegicus
gcaaagagcaggtcgcccagttcca

SEQ ID NO: 375992 - DNA, 25 bp, Rattus norvegicus
gcaaagagcccgaaatcaggacagt

SEQ ID NO: 375993 - DNA, 25 bp, Rattus norvegicus
gcaaagagcccgtaatcaggacagt

SEQ ID NO: 375994 - DNA, 25 bp, Rattus norvegicus
gcaaagagccgactgttttcagaga

SEQ ID NO: 375995 - DNA, 25 bp, Rattus norvegicus
gcaaagagccgagtgttttcagaga

SEQ ID NO: 375996 - DNA, 25 bp, Rattus norvegicus
gcaaagaggactcttctgacttcca

SEQ ID NO: 375997 - DNA, 25 bp, Rattus norvegicus
gcaaagaggactgttctgacttcca

SEQ ID NO: 375998 - DNA, 25 bp, Rattus norvegicus
gcaaagatactaactcttactagaa

SEQ ID NO: 375999 - DNA, 25 bp, Rattus norvegicus
gcaaagatactatctcttactagaa

SEQ ID NO: 376000 - DNA, 25 bp, Rattus norvegicus
gcaaagatcttgatcctggccagag

SEQ ID NO: 376001 - DNA, 25 bp, Rattus norvegicus
gcaaagatcttgttcctggccagag

SEQ ID NO: 376002 - DNA, 25 bp, Rattus norvegicus
gcaaagatggttacattcagcgtca

SEQ ID NO: 376003 - DNA, 25 bp, Rattus norvegicus
gcaaagatggtttcattcagcgtca

SEQ ID NO: 376004 - DNA, 25 bp, Rattus norvegicus
gcaaagcaaactccgccaggaacta

SEQ ID NO: 376005 - DNA, 25 bp, Rattus norvegicus
gcaaagcaaactgcgccaggaacta

SEQ ID NO: 376006 - DNA, 25 bp, Rattus norvegicus
gcaaagcactcaaggaggccagaga

SEQ ID NO: 376007 - DNA, 25 bp, Rattus norvegicus
gcaaagcactcatggaggccagaga

SEQ ID NO: 376008 - DNA, 25 bp, Rattus norvegicus
gcaaagcagagccttagagcctcat

SEQ ID NO: 376009 - DNA, 25 bp, Rattus norvegicus
gcaaagcagagcgttagagcctcat

SEQ ID NO: 376010 - DNA, 25 bp, Rattus norvegicus
gcaaagcagatgcaggaccccgatt

SEQ ID NO: 376011 - DNA, 25 bp, Rattus norvegicus
gcaaagcagatggaggaccccgatt

SEQ ID NO: 376012 - DNA, 25 bp, Rattus norvegicus
gcaaagcagcgtcttctggacatga

SEQ ID NO: 376013 - DNA, 25 bp, Rattus norvegicus
gcaaagcagcgtgttctggacatga

SEQ ID NO: 376014 - DNA, 25 bp, Rattus norvegicus
gcaaagcagtgtaggaggtacccct

SEQ ID NO: 376015 - DNA, 25 bp, Rattus norvegicus
gcaaagcagtgttggaggtacccct

SEQ ID NO: 376016 - DNA, 25 bp, Rattus norvegicus
gcaaagcatagaattcaaggaggga

SEQ ID NO: 376017 - DNA, 25 bp, Rattus norvegicus
gcaaagcatagatttcaaggaggga

SEQ ID NO: 376018 - DNA, 25 bp, Rattus norvegicus
gcaaagcatccgacagaggcctgag

SEQ ID NO: 376019 - DNA, 25 bp, Rattus norvegicus
gcaaagcatccgtcagaggcctgag

SEQ ID NO: 376020 - DNA, 25 bp, Rattus norvegicus
gcaaagcattctcatcagtcgcaat

SEQ ID NO: 376021 - DNA, 25 bp, Rattus norvegicus
gcaaagcattctgatcagtcgcaat

SEQ ID NO: 376022 - DNA, 25 bp, Rattus norvegicus
gcaaagcattttcagtctctcggat

SEQ ID NO: 376023 - DNA, 25 bp, Rattus norvegicus
gcaaagcattttgagtctctcggat

SEQ ID NO: 376024 - DNA, 25 bp, Rattus norvegicus
gcaaagccaacacacaagtttccat

SEQ ID NO: 376025 - DNA, 25 bp, Rattus norvegicus
gcaaagccaacagacaagtttccat

SEQ ID NO: 376026 - DNA, 25 bp, Rattus norvegicus
gcaaagccaacgcaaaacacgtgca

SEQ ID NO: 376027 - DNA, 25 bp, Rattus norvegicus
gcaaagccaacggaaaacacgtgca

SEQ ID NO: 376028 - DNA, 25 bp, Rattus norvegicus
gcaaagccacatagcttcagattga

SEQ ID NO: 376029 - DNA, 25 bp, Rattus norvegicus
gcaaagccacattgcttcagattga

SEQ ID NO: 376030 - DNA, 25 bp, Rattus norvegicus
gcaaagccacctatctaacttggat

SEQ ID NO: 376031 - DNA, 25 bp, Rattus norvegicus
gcaaagccacctttctaacttggat

SEQ ID NO: 376032 - DNA, 25 bp, Rattus norvegicus
gcaaagccacgcagaaatttctccc

SEQ ID NO: 376033 - DNA, 25 bp, Rattus norvegicus
gcaaagccacgctgaaatttctccc

SEQ ID NO: 376034 - DNA, 25 bp, Rattus norvegicus
gcaaagccagaccacataacgacat

SEQ ID NO: 376035 - DNA, 25 bp, Rattus norvegicus
gcaaagccagacgacataacgacat

SEQ ID NO: 376036 - DNA, 25 bp, Rattus norvegicus
gcaaagccagcgattgttttctcac

SEQ ID NO: 376037 - DNA, 25 bp, Rattus norvegicus
gcaaagccagcgtttgttttctcac

SEQ ID NO: 376038 - DNA, 25 bp, Rattus norvegicus
gcaaagcccatgatcctgtttagga

SEQ ID NO: 376039 - DNA, 25 bp, Rattus norvegicus
gcaaagcccatgttcctgtttagga

SEQ ID NO: 376040 - DNA, 25 bp, Rattus norvegicus
gcaaagccccttctttgtacctatt

SEQ ID NO: 376041 - DNA, 25 bp, Rattus norvegicus
gcaaagccccttgtttgtacctatt

SEQ ID NO: 376042 - DNA, 25 bp, Rattus norvegicus
gcaaagccctttaagtgtaaccact

SEQ ID NO: 376043 - DNA, 25 bp, Rattus norvegicus
gcaaagccctttaccgtaagccaat

SEQ ID NO: 376044 - DNA, 25 bp, Rattus norvegicus
gcaaagccctttcgtagacaagaag

SEQ ID NO: 376045 - DNA, 25 bp, Rattus norvegicus
gcaaagccctttggtagacaagaag

SEQ ID NO: 376046 - DNA, 25 bp, Rattus norvegicus
gcaaagcccttttagtgtaaccact

SEQ ID NO: 376047 - DNA, 25 bp, Rattus norvegicus
gcaaagcccttttccgtaagccaat

SEQ ID NO: 376048 - DNA, 25 bp, Rattus norvegicus
gcaaagcctacaagctatgatgctt

SEQ ID NO: 376049 - DNA, 25 bp, Rattus norvegicus
gcaaagcctacatgctatgatgctt

SEQ ID NO: 376050 - DNA, 25 bp, Rattus norvegicus
gcaaagcctaggatcaagggttgta

SEQ ID NO: 376051 - DNA, 25 bp, Rattus norvegicus
gcaaagcctaggttcaagggttgta

SEQ ID NO: 376052 - DNA, 25 bp, Rattus norvegicus
gcaaagcctgtacaagcctgtaagt

SEQ ID NO: 376053 - DNA, 25 bp, Rattus norvegicus
gcaaagcctgtagaagcctgtaagt

SEQ ID NO: 376054 - DNA, 25 bp, Rattus norvegicus
gcaaagcctgtcagcatttatccat

SEQ ID NO: 376055 - DNA, 25 bp, Rattus norvegicus
gcaaagcctgtctgcatttatccat

SEQ ID NO: 376056 - DNA, 25 bp, Rattus norvegicus
gcaaagcgctcaaagaacaagttca

SEQ ID NO: 376057 - DNA, 25 bp, Rattus norvegicus
gcaaagcgctcatagaacaagttca

SEQ ID NO: 376058 - DNA, 25 bp, Rattus norvegicus
gcaaagcgctgtaagcctaggctac

SEQ ID NO: 376059 - DNA, 25 bp, Rattus norvegicus
gcaaagcgctgttagcctaggctac

SEQ ID NO: 376060 - DNA, 25 bp, Rattus norvegicus
gcaaagctacgcaggccgagaggcc

SEQ ID NO: 376061 - DNA, 25 bp, Rattus norvegicus
gcaaagctacgctggccgagaggcc

SEQ ID NO: 376062 - DNA, 25 bp, Rattus norvegicus
gcaaagctcaacatcttcttcaagg

SEQ ID NO: 376063 - DNA, 25 bp, Rattus norvegicus
gcaaagctcaacttcttcttcaagg

SEQ ID NO: 376064 - DNA, 25 bp, Rattus norvegicus
gcaaagctccttaagtagccctgtc

SEQ ID NO: 376065 - DNA, 25 bp, Rattus norvegicus
gcaaagctcctttagtagccctgtc

SEQ ID NO: 376066 - DNA, 25 bp, Rattus norvegicus
gcaaagctcttaagtaacacagaca

SEQ ID NO: 376067 - DNA, 25 bp, Rattus norvegicus
gcaaagctcttatgtaacacagaca

SEQ ID NO: 376068 - DNA, 25 bp, Rattus norvegicus
gcaaagctcttcagacacatggact

SEQ ID NO: 376069 - DNA, 25 bp, Rattus norvegicus
gcaaagctcttctgacacatggact

SEQ ID NO: 376070 - DNA, 25 bp, Rattus norvegicus
gcaaagctgagcaggccaagattaa

SEQ ID NO: 376071 - DNA, 25 bp, Rattus norvegicus
gcaaagctgagctggccaagattaa

SEQ ID NO: 376072 - DNA, 25 bp, Rattus norvegicus
gcaaagctgctactggaattctgta

SEQ ID NO: 376073 - DNA, 25 bp, Rattus norvegicus
gcaaagctgctagtggaattctgta

SEQ ID NO: 376074 - DNA, 25 bp, Rattus norvegicus
gcaaagctggccactaagtcatcat

SEQ ID NO: 376075 - DNA, 25 bp, Rattus norvegicus
gcaaagctggcctctaagtcatcat

SEQ ID NO: 376076 - DNA, 25 bp, Rattus norvegicus
gcaaagctggctccaagaacttctt

SEQ ID NO: 376077 - DNA, 25 bp, Rattus norvegicus
gcaaagctggctgcaagaacttctt

SEQ ID NO: 376078 - DNA, 25 bp, Rattus norvegicus
gcaaagctgggtccaacatgctgtt

SEQ ID NO: 376079 - DNA, 25 bp, Rattus norvegicus
gcaaagctgggtgcaacatgctgtt

SEQ ID NO: 376080 - DNA, 25 bp, Rattus norvegicus
gcaaagcttagacgcagtccttcta

SEQ ID NO: 376081 - DNA, 25 bp, Rattus norvegicus
gcaaagcttagaggcagtccttcta

SEQ ID NO: 376082 - DNA, 25 bp, Rattus norvegicus
gcaaagcttcagacttcttttaaag

SEQ ID NO: 376083 - DNA, 25 bp, Rattus norvegicus
gcaaagcttcagtcttcttttaaag

SEQ ID NO: 376084 - DNA, 25 bp, Rattus norvegicus
gcaaagctttgcagccatcggctaa

SEQ ID NO: 376085 - DNA, 25 bp, Rattus norvegicus
gcaaagctttgctgccatcggctaa

SEQ ID NO: 376086 - DNA, 25 bp, Rattus norvegicus
gcaaaggacagtctatgaagccctc

SEQ ID NO: 376087 - DNA, 25 bp, Rattus norvegicus
gcaaaggacagtgtatgaagccctc

SEQ ID NO: 376088 - DNA, 25 bp, Rattus norvegicus
gcaaaggagggactacagaaacaca

SEQ ID NO: 376089 - DNA, 25 bp, Rattus norvegicus
gcaaaggagggagtacagaaacaca

SEQ ID NO: 376090 - DNA, 25 bp, Rattus norvegicus
gcaaaggcagatctccaggcaaatg

SEQ ID NO: 376091 - DNA, 25 bp, Rattus norvegicus
gcaaaggcagatgtccaggcaaatg

SEQ ID NO: 376092 - DNA, 25 bp, Rattus norvegicus
gcaaaggcagcacgctaccggacgg

SEQ ID NO: 376093 - DNA, 25 bp, Rattus norvegicus
gcaaaggcagcaggctaccggacgg

SEQ ID NO: 376094 - DNA, 25 bp, Rattus norvegicus
gcaaaggcaggcatacccctgtagt

SEQ ID NO: 376095 - DNA, 25 bp, Rattus norvegicus
gcaaaggcaggcttacccctgtagt

SEQ ID NO: 376096 - DNA, 25 bp, Rattus norvegicus
gcaaaggcatgccacgtgtacacgt

SEQ ID NO: 376097 - DNA, 25 bp, Rattus norvegicus
gcaaaggcatgcgacgtgtacacgt

SEQ ID NO: 376098 - DNA, 25 bp, Rattus norvegicus
gcaaaggcctacaaatttgttaagg

SEQ ID NO: 376099 - DNA, 25 bp, Rattus norvegicus
gcaaaggcctactaatttgttaagg

SEQ ID NO: 376100 - DNA, 25 bp, Rattus norvegicus
gcaaaggctagcctgcctaccagat

SEQ ID NO: 376101 - DNA, 25 bp, Rattus norvegicus
gcaaaggctagcgtgcctaccagat

SEQ ID NO: 376102 - DNA, 25 bp, Rattus norvegicus
gcaaaggctgccagaccgcagttaa

SEQ ID NO: 376103 - DNA, 25 bp, Rattus norvegicus
gcaaaggctgcccagactctcagga

SEQ ID NO: 376104 - DNA, 25 bp, Rattus norvegicus
gcaaaggctgccgagactctcagga

SEQ ID NO: 376105 - DNA, 25 bp, Rattus norvegicus
gcaaaggctgcctgaccgcagttaa

SEQ ID NO: 376106 - DNA, 25 bp, Rattus norvegicus
gcaaaggctttaattgtttccgcac

SEQ ID NO: 376107 - DNA, 25 bp, Rattus norvegicus
gcaaaggctttatttgtttccgcac

SEQ ID NO: 376108 - DNA, 25 bp, Rattus norvegicus
gcaaagggccatcggctcaccagct

SEQ ID NO: 376109 - DNA, 25 bp, Rattus norvegicus
gcaaagggccatgggctcaccagct

SEQ ID NO: 376110 - DNA, 25 bp, Rattus norvegicus
gcaaagggctggagttaccacccca

SEQ ID NO: 376111 - DNA, 25 bp, Rattus norvegicus
gcaaagggctggtgttaccacccca

SEQ ID NO: 376112 - DNA, 25 bp, Rattus norvegicus
gcaaaggtcactcctgtttgtgccc

SEQ ID NO: 376113 - DNA, 25 bp, Rattus norvegicus
gcaaaggtcactgctgtttgtgccc

SEQ ID NO: 376114 - DNA, 25 bp, Rattus norvegicus
gcaaaggtcagaacttatttcacag

SEQ ID NO: 376115 - DNA, 25 bp, Rattus norvegicus
gcaaaggtcagatcttatttcacag

SEQ ID NO: 376116 - DNA, 25 bp, Rattus norvegicus
gcaaaggtcggtactcttcactgaa

SEQ ID NO: 376117 - DNA, 25 bp, Rattus norvegicus
gcaaaggtcggttctcttcactgaa

SEQ ID NO: 376118 - DNA, 25 bp, Rattus norvegicus
gcaaaggtgttccttcgaggaccat

SEQ ID NO: 376119 - DNA, 25 bp, Rattus norvegicus
gcaaaggtgttcgttcgaggaccat

SEQ ID NO: 376120 - DNA, 25 bp, Rattus norvegicus
gcaaaggtgttgatggtctcttcaa

SEQ ID NO: 376121 - DNA, 25 bp, Rattus norvegicus
gcaaaggtgttgttggtctcttcaa

SEQ ID NO: 376122 - DNA, 25 bp, Rattus norvegicus
gcaaaggtgtttccagagcactgat

SEQ ID NO: 376123 - DNA, 25 bp, Rattus norvegicus
gcaaaggtgtttcttacagcatcat

SEQ ID NO: 376124 - DNA, 25 bp, Rattus norvegicus
gcaaaggtgtttgcagagcactgat

SEQ ID NO: 376125 - DNA, 25 bp, Rattus norvegicus
gcaaaggtgtttgttacagcatcat

SEQ ID NO: 376126 - DNA, 25 bp, Rattus norvegicus
gcaaaggttaaaatgccctgggacg

SEQ ID NO: 376127 - DNA, 25 bp, Rattus norvegicus
gcaaaggttaaattgccctgggacg

SEQ ID NO: 376128 - DNA, 25 bp, Rattus norvegicus
gcaaaggttatccaaatcccattta

SEQ ID NO: 376129 - DNA, 25 bp, Rattus norvegicus
gcaaaggttatcgaaatcccattta

SEQ ID NO: 376130 - DNA, 25 bp, Rattus norvegicus
gcaaagtaagcaaggttactacaat

SEQ ID NO: 376131 - DNA, 25 bp, Rattus norvegicus
gcaaagtaagcatggttactacaat

SEQ ID NO: 376132 - DNA, 25 bp, Rattus norvegicus
gcaaagtagccaattgtttcatcgc

SEQ ID NO: 376133 - DNA, 25 bp, Rattus norvegicus
gcaaagtagccatttgtttcatcgc

SEQ ID NO: 376134 - DNA, 25 bp, Rattus norvegicus
gcaaagtaggccagcatttattctc

SEQ ID NO: 376135 - DNA, 25 bp, Rattus norvegicus
gcaaagtaggcctgcatttattctc

SEQ ID NO: 376136 - DNA, 25 bp, Rattus norvegicus
gcaaagtcagccctagaagagttct

SEQ ID NO: 376137 - DNA, 25 bp, Rattus norvegicus
gcaaagtcagccgtagaagagttct

SEQ ID NO: 376138 - DNA, 25 bp, Rattus norvegicus
gcaaagtcattgaatcctctatcat

SEQ ID NO: 376139 - DNA, 25 bp, Rattus norvegicus
gcaaagtcattgtatcctctatcat

SEQ ID NO: 376140 - DNA, 25 bp, Rattus norvegicus
gcaaagtccaggagccaggcttagg

SEQ ID NO: 376141 - DNA, 25 bp, Rattus norvegicus
gcaaagtccaggtgccaggcttagg

SEQ ID NO: 376142 - DNA, 25 bp, Rattus norvegicus
gcaaagtccagtcctacttggttaa

SEQ ID NO: 376143 - DNA, 25 bp, Rattus norvegicus
gcaaagtccagtgctacttggttaa

SEQ ID NO: 376144 - DNA, 25 bp, Rattus norvegicus
gcaaagtcctcactagaacgcccat

SEQ ID NO: 376145 - DNA, 25 bp, Rattus norvegicus
gcaaagtcctcagtagaacgcccat

SEQ ID NO: 376146 - DNA, 25 bp, Rattus norvegicus
gcaaagtctgagcatcgagccattt

SEQ ID NO: 376147 - DNA, 25 bp, Rattus norvegicus
gcaaagtctgaggatcgagccattt

SEQ ID NO: 376148 - DNA, 25 bp, Rattus norvegicus
gcaaagtgacgaaggcaccctgctg

SEQ ID NO: 376149 - DNA, 25 bp, Rattus norvegicus
gcaaagtgacgatggcaccctgctg

SEQ ID NO: 376150 - DNA, 25 bp, Rattus norvegicus
gcaaagtgcttcacaaacaactcaa

SEQ ID NO: 376151 - DNA, 25 bp, Rattus norvegicus
gcaaagtgcttctcaaacaactcaa

SEQ ID NO: 376152 - DNA, 25 bp, Rattus norvegicus
gcaaagtggactatggtgaatacat

SEQ ID NO: 376153 - DNA, 25 bp, Rattus norvegicus
gcaaagtggactttggtgaatacat

SEQ ID NO: 376154 - DNA, 25 bp, Rattus norvegicus
gcaaagtggagcctgtcatagtttc

SEQ ID NO: 376155 - DNA, 25 bp, Rattus norvegicus
gcaaagtggagcgtgtcatagtttc

SEQ ID NO: 376156 - DNA, 25 bp, Rattus norvegicus
gcaaagtggcataggttggccctat

SEQ ID NO: 376157 - DNA, 25 bp, Rattus norvegicus
gcaaagtggcattggttggccctat

SEQ ID NO: 376158 - DNA, 25 bp, Rattus norvegicus
gcaaagtggcgcaactgtccggtgt

SEQ ID NO: 376159 - DNA, 25 bp, Rattus norvegicus
gcaaagtggcgctactgtccggtgt

SEQ ID NO: 376160 - DNA, 25 bp, Rattus norvegicus
gcaaagtggttcatgttgtacataa

SEQ ID NO: 376161 - DNA, 25 bp, Rattus norvegicus
gcaaagtggttcttgttgtacataa

SEQ ID NO: 376162 - DNA, 25 bp, Rattus norvegicus
gcaaagtgtccgaagcaagcagctg

SEQ ID NO: 376163 - DNA, 25 bp, Rattus norvegicus
gcaaagtgtccgtagcaagcagctg

SEQ ID NO: 376164 - DNA, 25 bp, Rattus norvegicus
gcaaagtgtctcagcagtctctgca

SEQ ID NO: 376165 - DNA, 25 bp, Rattus norvegicus
gcaaagtgtctctgcagtctctgca

SEQ ID NO: 376166 - DNA, 25 bp, Rattus norvegicus
gcaaagttacttcataaattctgtc

SEQ ID NO: 376167 - DNA, 25 bp, Rattus norvegicus
gcaaagttacttgataaattctgtc

SEQ ID NO: 376168 - DNA, 25 bp, Rattus norvegicus
gcaaagttcgggacaagctgaacaa

SEQ ID NO: 376169 - DNA, 25 bp, Rattus norvegicus
gcaaagttcgggtcaagctgaacaa

SEQ ID NO: 376170 - DNA, 25 bp, Rattus norvegicus
gcaaagttcttgaggatctaagtcc

SEQ ID NO: 376171 - DNA, 25 bp, Rattus norvegicus
gcaaagttcttgtggatctaagtcc

SEQ ID NO: 376172 - DNA, 25 bp, Rattus norvegicus
gcaaagttgaccaatctctccatac

SEQ ID NO: 376173 - DNA, 25 bp, Rattus norvegicus
gcaaagttgacctatctctccatac

SEQ ID NO: 376174 - DNA, 25 bp, Rattus norvegicus
gcaaagttggccctcactaaggacc

SEQ ID NO: 376175 - DNA, 25 bp, Rattus norvegicus
gcaaagttggccgtcactaaggacc

SEQ ID NO: 376176 - DNA, 25 bp, Rattus norvegicus
gcaaagttgttgctgacgcctgaaa

SEQ ID NO: 376177 - DNA, 25 bp, Rattus norvegicus
gcaaagttgttggtgacgcctgaaa

SEQ ID NO: 376178 - DNA, 25 bp, Rattus norvegicus
gcaaagtttctccaacagacttaag

SEQ ID NO: 376179 - DNA, 25 bp, Rattus norvegicus
gcaaagtttctcgaacagacttaag

SEQ ID NO: 376180 - DNA, 25 bp, Rattus norvegicus
gcaaagtttcttcggatatccgtat

SEQ ID NO: 376181 - DNA, 25 bp, Rattus norvegicus
gcaaagtttcttgggatatccgtat

SEQ ID NO: 376182 - DNA, 25 bp, Rattus norvegicus
gcaaagtttttgacattaaatgaat

SEQ ID NO: 376183 - DNA, 25 bp, Rattus norvegicus
gcaaagtttttgtcattaaatgaat

SEQ ID NO: 376184 - DNA, 25 bp, Rattus norvegicus
gcaaataagtgcatcccatgtggga

SEQ ID NO: 376185 - DNA, 25 bp, Rattus norvegicus
gcaaataagtgcttcccatgtggga

SEQ ID NO: 376186 - DNA, 25 bp, Rattus norvegicus
gcaaatacaacacaggctggacagt

SEQ ID NO: 376187 - DNA, 25 bp, Rattus norvegicus
gcaaatacaacagaggctggacagt

SEQ ID NO: 376188 - DNA, 25 bp, Rattus norvegicus
gcaaatacatttaactccccaaact

SEQ ID NO: 376189 - DNA, 25 bp, Rattus norvegicus
gcaaatacattttactccccaaact

SEQ ID NO: 376190 - DNA, 25 bp, Rattus norvegicus
gcaaatacctttcatggcattttgg

SEQ ID NO: 376191 - DNA, 25 bp, Rattus norvegicus
gcaaatacctttgatggcattttgg

SEQ ID NO: 376192 - DNA, 25 bp, Rattus norvegicus
gcaaatactcagaggcagccgagct

SEQ ID NO: 376193 - DNA, 25 bp, Rattus norvegicus
gcaaatactcagtggcagccgagct

SEQ ID NO: 376194 - DNA, 25 bp, Rattus norvegicus
gcaaatagcagtaccgtgctgcctt

SEQ ID NO: 376195 - DNA, 25 bp, Rattus norvegicus
gcaaatagcagttccgtgctgcctt

SEQ ID NO: 376196 - DNA, 25 bp, Rattus norvegicus
gcaaatagcccaccggaatccgtga

SEQ ID NO: 376197 - DNA, 25 bp, Rattus norvegicus
gcaaatagcccagcggaatccgtga

SEQ ID NO: 376198 - DNA, 25 bp, Rattus norvegicus
gcaaatagctccctgagtgtcagga

SEQ ID NO: 376199 - DNA, 25 bp, Rattus norvegicus
gcaaatagctccgtgagtgtcagga

SEQ ID NO: 376200 - DNA, 25 bp, Rattus norvegicus
gcaaatagtttacagcccagcacag

SEQ ID NO: 376201 - DNA, 25 bp, Rattus norvegicus
gcaaatagtttagagcccagcacag

SEQ ID NO: 376202 - DNA, 25 bp, Rattus norvegicus
gcaaatatacaaagcccctgactta

SEQ ID NO: 376203 - DNA, 25 bp, Rattus norvegicus
gcaaatatacaatgcccctgactta

SEQ ID NO: 376204 - DNA, 25 bp, Rattus norvegicus
gcaaatatctatctttttccatggt

SEQ ID NO: 376205 - DNA, 25 bp, Rattus norvegicus
gcaaatatctatgtttttccatggt

SEQ ID NO: 376206 - DNA, 25 bp, Rattus norvegicus
gcaaatatgacacctttctctctca

SEQ ID NO: 376207 - DNA, 25 bp, Rattus norvegicus
gcaaatatgacagctttctctctca

SEQ ID NO: 376208 - DNA, 25 bp, Rattus norvegicus
gcaaatatgagaaattcccctcccc

SEQ ID NO: 376209 - DNA, 25 bp, Rattus norvegicus
gcaaatatgagatattcccctcccc

SEQ ID NO: 376210 - DNA, 25 bp, Rattus norvegicus
gcaaatcactatactgtctacctta

SEQ ID NO: 376211 - DNA, 25 bp, Rattus norvegicus
gcaaatcactattctgtctacctta

SEQ ID NO: 376212 - DNA, 25 bp, Rattus norvegicus
gcaaatcagaagcaatgtggactac

SEQ ID NO: 376213 - DNA, 25 bp, Rattus norvegicus
gcaaatcagaaggaatgtggactac

SEQ ID NO: 376214 - DNA, 25 bp, Rattus norvegicus
gcaaatcatccaattctgtttatta

SEQ ID NO: 376215 - DNA, 25 bp, Rattus norvegicus
gcaaatcatccatttctgtttatta

SEQ ID NO: 376216 - DNA, 25 bp, Rattus norvegicus
gcaaatccaacgctgtctactgcct

SEQ ID NO: 376217 - DNA, 25 bp, Rattus norvegicus
gcaaatccaacggtgtctactgcct

SEQ ID NO: 376218 - DNA, 25 bp, Rattus norvegicus
gcaaatccagtgattggccctgagc

SEQ ID NO: 376219 - DNA, 25 bp, Rattus norvegicus
gcaaatccagtgtttggccctgagc

SEQ ID NO: 376220 - DNA, 25 bp, Rattus norvegicus
gcaaatcccaccaccaaagtagtga

SEQ ID NO: 376221 - DNA, 25 bp, Rattus norvegicus
gcaaatcccacctccaaagtagtga

SEQ ID NO: 376222 - DNA, 25 bp, Rattus norvegicus
gcaaatccccaactcaaagcacaag

SEQ ID NO: 376223 - DNA, 25 bp, Rattus norvegicus
gcaaatccccaagtcaaagcacaag

SEQ ID NO: 376224 - DNA, 25 bp, Rattus norvegicus
gcaaatcccctgcacttagttttca

SEQ ID NO: 376225 - DNA, 25 bp, Rattus norvegicus
gcaaatcccctggacttagttttca

SEQ ID NO: 376226 - DNA, 25 bp, Rattus norvegicus
gcaaatcccttaagtcttagtctta

SEQ ID NO: 376227 - DNA, 25 bp, Rattus norvegicus
gcaaatcccttatgtcttagtctta

SEQ ID NO: 376228 - DNA, 25 bp, Rattus norvegicus
gcaaatcctataaccatggctttaa

SEQ ID NO: 376229 - DNA, 25 bp, Rattus norvegicus
gcaaatcctatatccatggctttaa

SEQ ID NO: 376230 - DNA, 25 bp, Rattus norvegicus
gcaaatcctcagacacctgtggaat

SEQ ID NO: 376231 - DNA, 25 bp, Rattus norvegicus
gcaaatcctcagtcacctgtggaat

SEQ ID NO: 376232 - DNA, 25 bp, Rattus norvegicus
gcaaatcctgtcacaggtgttccct

SEQ ID NO: 376233 - DNA, 25 bp, Rattus norvegicus
gcaaatcctgtctcaggtgttccct

SEQ ID NO: 376234 - DNA, 25 bp, Rattus norvegicus
gcaaatcctttcatctcaaccttta

SEQ ID NO: 376235 - DNA, 25 bp, Rattus norvegicus
gcaaatcctttcttctcaaccttta

SEQ ID NO: 376236 - DNA, 25 bp, Rattus norvegicus
gcaaatcctttgagtttgtgtgtct

SEQ ID NO: 376237 - DNA, 25 bp, Rattus norvegicus
gcaaatcctttgtgtttgtgtgtct

SEQ ID NO: 376238 - DNA, 25 bp, Rattus norvegicus
gcaaatcgggccctgttttgatatt

SEQ ID NO: 376239 - DNA, 25 bp, Rattus norvegicus
gcaaatcgggccgtgttttgatatt

SEQ ID NO: 376240 - DNA, 25 bp, Rattus norvegicus
gcaaatcgggttcccatttgaaaat

SEQ ID NO: 376241 - DNA, 25 bp, Rattus norvegicus
gcaaatcgggttgccatttgaaaat

SEQ ID NO: 376242 - DNA, 25 bp, Rattus norvegicus
gcaaatcgttagctctccagagtca

SEQ ID NO: 376243 - DNA, 25 bp, Rattus norvegicus
gcaaatcgttaggtctccagagtca

SEQ ID NO: 376244 - DNA, 25 bp, Rattus norvegicus
gcaaatctgtctatctctgggtgga

SEQ ID NO: 376245 - DNA, 25 bp, Rattus norvegicus
gcaaatctgtctttctctgggtgga

SEQ ID NO: 376246 - DNA, 25 bp, Rattus norvegicus
gcaaatcttaagcacatacagccaa

SEQ ID NO: 376247 - DNA, 25 bp, Rattus norvegicus
gcaaatcttaaggacatacagccaa

SEQ ID NO: 376248 - DNA, 25 bp, Rattus norvegicus
gcaaatgaatctccggacttcctca

SEQ ID NO: 376249 - DNA, 25 bp, Rattus norvegicus
gcaaatgaatctgcggacttcctca

SEQ ID NO: 376250 - DNA, 25 bp, Rattus norvegicus
gcaaatgagattccttttcctattt

SEQ ID NO: 376251 - DNA, 25 bp, Rattus norvegicus
gcaaatgagattgcttttcctattt

SEQ ID NO: 376252 - DNA, 25 bp, Rattus norvegicus
gcaaatgaggtaacccctgaacctt

SEQ ID NO: 376253 - DNA, 25 bp, Rattus norvegicus
gcaaatgaggtatcccctgaacctt

SEQ ID NO: 376254 - DNA, 25 bp, Rattus norvegicus
gcaaatgatcaactgtggcaaaatt

SEQ ID NO: 376255 - DNA, 25 bp, Rattus norvegicus
gcaaatgatcaagtgtggcaaaatt

SEQ ID NO: 376256 - DNA, 25 bp, Rattus norvegicus
gcaaatgatcccaaacaacttaata

SEQ ID NO: 376257 - DNA, 25 bp, Rattus norvegicus
gcaaatgatccctaacaacttaata

SEQ ID NO: 376258 - DNA, 25 bp, Rattus norvegicus
gcaaatgattctaacttgaaactag

SEQ ID NO: 376259 - DNA, 25 bp, Rattus norvegicus
gcaaatgattcttacttgaaactag

SEQ ID NO: 376260 - DNA, 25 bp, Rattus norvegicus
gcaaatgattgtcacatcgttcctt

SEQ ID NO: 376261 - DNA, 25 bp, Rattus norvegicus
gcaaatgattgtgacatcgttcctt

SEQ ID NO: 376262 - DNA, 25 bp, Rattus norvegicus
gcaaatgcacaacctgcagctgtaa

SEQ ID NO: 376263 - DNA, 25 bp, Rattus norvegicus
gcaaatgcacaagctgcagctgtaa

SEQ ID NO: 376264 - DNA, 25 bp, Rattus norvegicus
gcaaatgccaccctcaaagactgaa

SEQ ID NO: 376265 - DNA, 25 bp, Rattus norvegicus
gcaaatgccaccgtcaaagactgaa

SEQ ID NO: 376266 - DNA, 25 bp, Rattus norvegicus
gcaaatgccactaatacttacactg

SEQ ID NO: 376267 - DNA, 25 bp, Rattus norvegicus
gcaaatgccacttatacttacactg

SEQ ID NO: 376268 - DNA, 25 bp, Rattus norvegicus
gcaaatgccagtccatcagaaccta

SEQ ID NO: 376269 - DNA, 25 bp, Rattus norvegicus
gcaaatgccagtgcatcagaaccta

SEQ ID NO: 376270 - DNA, 25 bp, Rattus norvegicus
gcaaatgcccccaagaacttgagaa

SEQ ID NO: 376271 - DNA, 25 bp, Rattus norvegicus
gcaaatgccccctagaacttgagaa

SEQ ID NO: 376272 - DNA, 25 bp, Rattus norvegicus
gcaaatgccctcctcagagaatggg

SEQ ID NO: 376273 - DNA, 25 bp, Rattus norvegicus
gcaaatgccctcgtcagagaatggg

SEQ ID NO: 376274 - DNA, 25 bp, Rattus norvegicus
gcaaatgccgcaacaatttgagtga

SEQ ID NO: 376275 - DNA, 25 bp, Rattus norvegicus
gcaaatgccgcatcaatttgagtga

SEQ ID NO: 376276 - DNA, 25 bp, Rattus norvegicus
gcaaatgccgttcgttgagctcgag

SEQ ID NO: 376277 - DNA, 25 bp, Rattus norvegicus
gcaaatgccgttggttgagctcgag

SEQ ID NO: 376278 - DNA, 25 bp, Rattus norvegicus
gcaaatgctaacaatatacgattca

SEQ ID NO: 376279 - DNA, 25 bp, Rattus norvegicus
gcaaatgctaactatatacgattca

SEQ ID NO: 376280 - DNA, 25 bp, Rattus norvegicus
gcaaatgctagaccgatttcagctg

SEQ ID NO: 376281 - DNA, 25 bp, Rattus norvegicus
gcaaatgctagagcgatttcagctg

SEQ ID NO: 376282 - DNA, 25 bp, Rattus norvegicus
gcaaatgctaggctggaattctcta

SEQ ID NO: 376283 - DNA, 25 bp, Rattus norvegicus
gcaaatgctagggtggaattctcta

SEQ ID NO: 376284 - DNA, 25 bp, Rattus norvegicus
gcaaatgctagtacatattctggaa

SEQ ID NO: 376285 - DNA, 25 bp, Rattus norvegicus
gcaaatgctagttcatattctggaa

SEQ ID NO: 376286 - DNA, 25 bp, Rattus norvegicus
gcaaatgctggaattgctcagcaat

SEQ ID NO: 376287 - DNA, 25 bp, Rattus norvegicus
gcaaatgctggatttgctcagcaat

SEQ ID NO: 376288 - DNA, 25 bp, Rattus norvegicus
gcaaatgcttctacaaggacccttg

SEQ ID NO: 376289 - DNA, 25 bp, Rattus norvegicus
gcaaatgcttcttcaaggacccttg

SEQ ID NO: 376290 - DNA, 25 bp, Rattus norvegicus
gcaaatgcttttatgtttttgccat

SEQ ID NO: 376291 - DNA, 25 bp, Rattus norvegicus
gcaaatgcttttcgttactgataat

SEQ ID NO: 376292 - DNA, 25 bp, Rattus norvegicus
gcaaatgcttttggttactgataat

SEQ ID NO: 376293 - DNA, 25 bp, Rattus norvegicus
gcaaatgcttttttgtttttgccat

SEQ ID NO: 376294 - DNA, 25 bp, Rattus norvegicus
gcaaatggaccacatatggctttct

SEQ ID NO: 376295 - DNA, 25 bp, Rattus norvegicus
gcaaatggaccagatatggctttct

SEQ ID NO: 376296 - DNA, 25 bp, Rattus norvegicus
gcaaatggctggattctatgtgtag

SEQ ID NO: 376297 - DNA, 25 bp, Rattus norvegicus
gcaaatggctggtttctatgtgtag

SEQ ID NO: 376298 - DNA, 25 bp, Rattus norvegicus
gcaaatggcttaactgacatattta

SEQ ID NO: 376299 - DNA, 25 bp, Rattus norvegicus
gcaaatggcttatctgacatattta

SEQ ID NO: 376300 - DNA, 25 bp, Rattus norvegicus
gcaaatgggaccagcagtgcttcaa

SEQ ID NO: 376301 - DNA, 25 bp, Rattus norvegicus
gcaaatgggaccaggctctgaggca

SEQ ID NO: 376302 - DNA, 25 bp, Rattus norvegicus
gcaaatgggacctgcagtgcttcaa

SEQ ID NO: 376303 - DNA, 25 bp, Rattus norvegicus
gcaaatgggacctggctctgaggca

SEQ ID NO: 376304 - DNA, 25 bp, Rattus norvegicus
gcaaatgggagtaatatggccggct

SEQ ID NO: 376305 - DNA, 25 bp, Rattus norvegicus
gcaaatgggagttatatggccggct

SEQ ID NO: 376306 - DNA, 25 bp, Rattus norvegicus
gcaaatgggttcacagggcttcagt

SEQ ID NO: 376307 - DNA, 25 bp, Rattus norvegicus
gcaaatgggttctcagggcttcagt

SEQ ID NO: 376308 - DNA, 25 bp, Rattus norvegicus
gcaaatggtgaactctctagccttt

SEQ ID NO: 376309 - DNA, 25 bp, Rattus norvegicus
gcaaatggtgaagtctctagccttt

SEQ ID NO: 376310 - DNA, 25 bp, Rattus norvegicus
gcaaatggtgctagtgtgccctcag

SEQ ID NO: 376311 - DNA, 25 bp, Rattus norvegicus
gcaaatggtgcttgtgtgccctcag

SEQ ID NO: 376312 - DNA, 25 bp, Rattus norvegicus
gcaaatggtggccaaacagactcaa

SEQ ID NO: 376313 - DNA, 25 bp, Rattus norvegicus
gcaaatggtggcgaaacagactcaa

SEQ ID NO: 376314 - DNA, 25 bp, Rattus norvegicus
gcaaatgtaactcttctcttgatag

SEQ ID NO: 376315 - DNA, 25 bp, Rattus norvegicus
gcaaatgtaactgttctcttgatag

SEQ ID NO: 376316 - DNA, 25 bp, Rattus norvegicus
gcaaatgtacaaatctctctctttt

SEQ ID NO: 376317 - DNA, 25 bp, Rattus norvegicus
gcaaatgtacaattctctctctttt

SEQ ID NO: 376318 - DNA, 25 bp, Rattus norvegicus
gcaaatgtacgtcaagctgaggcca

SEQ ID NO: 376319 - DNA, 25 bp, Rattus norvegicus
gcaaatgtacgtgaagctgaggcca

SEQ ID NO: 376320 - DNA, 25 bp, Rattus norvegicus
gcaaatgtagtcacaggaacccgct

SEQ ID NO: 376321 - DNA, 25 bp, Rattus norvegicus
gcaaatgtagtctcaggaacccgct

SEQ ID NO: 376322 - DNA, 25 bp, Rattus norvegicus
gcaaatgtccatacgtcatgcactc

SEQ ID NO: 376323 - DNA, 25 bp, Rattus norvegicus
gcaaatgtccattcgtcatgcactc

SEQ ID NO: 376324 - DNA, 25 bp, Rattus norvegicus
gcaaatgtccgtcctgagactagat

SEQ ID NO: 376325 - DNA, 25 bp, Rattus norvegicus
gcaaatgtccgtgctgagactagat

SEQ ID NO: 376326 - DNA, 25 bp, Rattus norvegicus
gcaaatgtctgtcgctacatcggaa

SEQ ID NO: 376327 - DNA, 25 bp, Rattus norvegicus
gcaaatgtctgtggctacatcggaa

SEQ ID NO: 376328 - DNA, 25 bp, Rattus norvegicus
gcaaatgtgaagaaggcctgcctga

SEQ ID NO: 376329 - DNA, 25 bp, Rattus norvegicus
gcaaatgtgaagtaggcctgcctga

SEQ ID NO: 376330 - DNA, 25 bp, Rattus norvegicus
gcaaatgtgacactgtctatcagta

SEQ ID NO: 376331 - DNA, 25 bp, Rattus norvegicus
gcaaatgtgacagtgtctatcagta

SEQ ID NO: 376332 - DNA, 25 bp, Rattus norvegicus
gcaaatgtgccaattagcgtaactt

SEQ ID NO: 376333 - DNA, 25 bp, Rattus norvegicus
gcaaatgtgccatttagcgtaactt

SEQ ID NO: 376334 - DNA, 25 bp, Rattus norvegicus
gcaaatgttagcaccaataatggca

SEQ ID NO: 376335 - DNA, 25 bp, Rattus norvegicus
gcaaatgttagctccaataatggca

SEQ ID NO: 376336 - DNA, 25 bp, Rattus norvegicus
gcaaatgttatactcacatggctgt

SEQ ID NO: 376337 - DNA, 25 bp, Rattus norvegicus
gcaaatgttatagtcacatggctgt

SEQ ID NO: 376338 - DNA, 25 bp, Rattus norvegicus
gcaaatgttcttacttggagccaaa

SEQ ID NO: 376339 - DNA, 25 bp, Rattus norvegicus
gcaaatgttctttcttggagccaaa

SEQ ID NO: 376340 - DNA, 25 bp, Rattus norvegicus
gcaaatgttgttcttttccactaaa

SEQ ID NO: 376341 - DNA, 25 bp, Rattus norvegicus
gcaaatgttgttgttttccactaaa

SEQ ID NO: 376342 - DNA, 25 bp, Rattus norvegicus
gcaaatgttttgcatatgtaactga

SEQ ID NO: 376343 - DNA, 25 bp, Rattus norvegicus
gcaaatgttttggatatgtaactga

SEQ ID NO: 376344 - DNA, 25 bp, Rattus norvegicus
gcaaattaatctcgcctgtgcctga

SEQ ID NO: 376345 - DNA, 25 bp, Rattus norvegicus
gcaaattaatctggcctgtgcctga

SEQ ID NO: 376346 - DNA, 25 bp, Rattus norvegicus
gcaaattaatgactctctggcaaag

SEQ ID NO: 376347 - DNA, 25 bp, Rattus norvegicus
gcaaattaatgagtctctggcaaag

SEQ ID NO: 376348 - DNA, 25 bp, Rattus norvegicus
gcaaattagctcatactcagggtca

SEQ ID NO: 376349 - DNA, 25 bp, Rattus norvegicus
gcaaattagctcttactcagggtca

SEQ ID NO: 376350 - DNA, 25 bp, Rattus norvegicus
gcaaattatcttctcatgttatgta

SEQ ID NO: 376351 - DNA, 25 bp, Rattus norvegicus
gcaaattatcttgtcatgttatgta

SEQ ID NO: 376352 - DNA, 25 bp, Rattus norvegicus
gcaaattatgaccatcacagaccag

SEQ ID NO: 376353 - DNA, 25 bp, Rattus norvegicus
gcaaattatgacgatcacagaccag

SEQ ID NO: 376354 - DNA, 25 bp, Rattus norvegicus
gcaaattcaaacattcccacagaga

SEQ ID NO: 376355 - DNA, 25 bp, Rattus norvegicus
gcaaattcaaactttcccacagaga

SEQ ID NO: 376356 - DNA, 25 bp, Rattus norvegicus
gcaaattcaatacgtcttctagact

SEQ ID NO: 376357 - DNA, 25 bp, Rattus norvegicus
gcaaattcaataggtcttctagact

SEQ ID NO: 376358 - DNA, 25 bp, Rattus norvegicus
gcaaattcacaaactggtgggccat

SEQ ID NO: 376359 - DNA, 25 bp, Rattus norvegicus
gcaaattcacaatctggtgggccat

SEQ ID NO: 376360 - DNA, 25 bp, Rattus norvegicus
gcaaattcagagctggctggatcta

SEQ ID NO: 376361 - DNA, 25 bp, Rattus norvegicus
gcaaattcagaggtggctggatcta

SEQ ID NO: 376362 - DNA, 25 bp, Rattus norvegicus
gcaaattccaagagattctgaccgg

SEQ ID NO: 376363 - DNA, 25 bp, Rattus norvegicus
gcaaattccaagtgattctgaccgg

SEQ ID NO: 376364 - DNA, 25 bp, Rattus norvegicus
gcaaattccagcatcgggcaagtga

SEQ ID NO: 376365 - DNA, 25 bp, Rattus norvegicus
gcaaattccagcttcgggcaagtga

SEQ ID NO: 376366 - DNA, 25 bp, Rattus norvegicus
gcaaattcccagacaaactgcaaga

SEQ ID NO: 376367 - DNA, 25 bp, Rattus norvegicus
gcaaattcccagtcaaactgcaaga

SEQ ID NO: 376368 - DNA, 25 bp, Rattus norvegicus
gcaaattcccttacctttcaagagg

SEQ ID NO: 376369 - DNA, 25 bp, Rattus norvegicus
gcaaattccctttcctttcaagagg

SEQ ID NO: 376370 - DNA, 25 bp, Rattus norvegicus
gcaaattcctgtcgtggatttccag

SEQ ID NO: 376371 - DNA, 25 bp, Rattus norvegicus
gcaaattcctgtggtggatttccag

SEQ ID NO: 376372 - DNA, 25 bp, Rattus norvegicus
gcaaattctagcagtatgtcttcta

SEQ ID NO: 376373 - DNA, 25 bp, Rattus norvegicus
gcaaattctagctgtatgtcttcta

SEQ ID NO: 376374 - DNA, 25 bp, Rattus norvegicus
gcaaattctgcaaggatacaaagtg

SEQ ID NO: 376375 - DNA, 25 bp, Rattus norvegicus
gcaaattctgcatggatacaaagtg

SEQ ID NO: 376376 - DNA, 25 bp, Rattus norvegicus
gcaaattctggtcgcctcaggtgaa

SEQ ID NO: 376377 - DNA, 25 bp, Rattus norvegicus
gcaaattctggtggcctcaggtgaa

SEQ ID NO: 376378 - DNA, 25 bp, Rattus norvegicus
gcaaattgacagcatgcctatcttt

SEQ ID NO: 376379 - DNA, 25 bp, Rattus norvegicus
gcaaattgacaggatgcctatcttt

SEQ ID NO: 376380 - DNA, 25 bp, Rattus norvegicus
gcaaattggtgtactcactatagtt

SEQ ID NO: 376381 - DNA, 25 bp, Rattus norvegicus
gcaaattggtgttctcactatagtt

SEQ ID NO: 376382 - DNA, 25 bp, Rattus norvegicus
gcaaattgttccacagacttcactg

SEQ ID NO: 376383 - DNA, 25 bp, Rattus norvegicus
gcaaattgttcctcagacttcactg

SEQ ID NO: 376384 - DNA, 25 bp, Rattus norvegicus
gcaaattgttctccagatgtctcca

SEQ ID NO: 376385 - DNA, 25 bp, Rattus norvegicus
gcaaattgttctgcagatgtctcca

SEQ ID NO: 376386 - DNA, 25 bp, Rattus norvegicus
gcaaatttccctcaaggtcttctac

SEQ ID NO: 376387 - DNA, 25 bp, Rattus norvegicus
gcaaatttccctgaaggtcttctac

SEQ ID NO: 376388 - DNA, 25 bp, Rattus norvegicus
gcaaatttgtgtccctcttgccctg

SEQ ID NO: 376389 - DNA, 25 bp, Rattus norvegicus
gcaaatttgtgtgcctcttgccctg

SEQ ID NO: 376390 - DNA, 25 bp, Rattus norvegicus
gcaaattttggcatcttttgacata

SEQ ID NO: 376391 - DNA, 25 bp, Rattus norvegicus
gcaaattttggcttcttttgacata

SEQ ID NO: 376392 - DNA, 25 bp, Rattus norvegicus
gcaacaaaacaaagtcccagagaga

SEQ ID NO: 376393 - DNA, 25 bp, Rattus norvegicus
gcaacaaaacaatgtcccagagaga

SEQ ID NO: 376394 - DNA, 25 bp, Rattus norvegicus
gcaacaaagtcaccgcttgaccctg

SEQ ID NO: 376395 - DNA, 25 bp, Rattus norvegicus
gcaacaaagtcagcgcttgaccctg

SEQ ID NO: 376396 - DNA, 25 bp, Rattus norvegicus
gcaacaaatacaacgccagcagctt

SEQ ID NO: 376397 - DNA, 25 bp, Rattus norvegicus
gcaacaaatacatcgccagcagctt

SEQ ID NO: 376398 - DNA, 25 bp, Rattus norvegicus
gcaacaacaaaactctacctacaca

SEQ ID NO: 376399 - DNA, 25 bp, Rattus norvegicus
gcaacaacaaaagtctacctacaca

SEQ ID NO: 376400 - DNA, 25 bp, Rattus norvegicus
gcaacaacagtgcatcccaggataa

SEQ ID NO: 376401 - DNA, 25 bp, Rattus norvegicus
gcaacaacagtggatcccaggataa

SEQ ID NO: 376402 - DNA, 25 bp, Rattus norvegicus
gcaacaaccaacattacctacggag

SEQ ID NO: 376403 - DNA, 25 bp, Rattus norvegicus
gcaacaaccaactttacctacggag

SEQ ID NO: 376404 - DNA, 25 bp, Rattus norvegicus
gcaacaactgctccttgcaaactaa

SEQ ID NO: 376405 - DNA, 25 bp, Rattus norvegicus
gcaacaactgctgcttgcaaactaa

SEQ ID NO: 376406 - DNA, 25 bp, Rattus norvegicus
gcaacaactggaagccttcgaagca

SEQ ID NO: 376407 - DNA, 25 bp, Rattus norvegicus
gcaacaactggacctcatggacaca

SEQ ID NO: 376408 - DNA, 25 bp, Rattus norvegicus
gcaacaactggagctcatggacaca

SEQ ID NO: 376409 - DNA, 25 bp, Rattus norvegicus
gcaacaactggatgccttcgaagca

SEQ ID NO: 376410 - DNA, 25 bp, Rattus norvegicus
gcaacaacttttcaggacccagcct

SEQ ID NO: 376411 - DNA, 25 bp, Rattus norvegicus
gcaacaacttttgaggacccagcct

SEQ ID NO: 376412 - DNA, 25 bp, Rattus norvegicus
gcaacaagccccaggagatggccaa

SEQ ID NO: 376413 - DNA, 25 bp, Rattus norvegicus
gcaacaagcccctggagatggccaa

SEQ ID NO: 376414 - DNA, 25 bp, Rattus norvegicus
gcaacaagcctactatgcctaaggt

SEQ ID NO: 376415 - DNA, 25 bp, Rattus norvegicus
gcaacaagcctagtatgcctaaggt

SEQ ID NO: 376416 - DNA, 25 bp, Rattus norvegicus
gcaacaagctttcttcattgaccaa

SEQ ID NO: 376417 - DNA, 25 bp, Rattus norvegicus
gcaacaagctttgttcattgaccaa

SEQ ID NO: 376418 - DNA, 25 bp, Rattus norvegicus
gcaacaagtgccctgaactcggaac

SEQ ID NO: 376419 - DNA, 25 bp, Rattus norvegicus
gcaacaagtgccgtgaactcggaac

SEQ ID NO: 376420 - DNA, 25 bp, Rattus norvegicus
gcaacaatctaaatatggacccatg

SEQ ID NO: 376421 - DNA, 25 bp, Rattus norvegicus
gcaacaatctaattatggacccatg

SEQ ID NO: 376422 - DNA, 25 bp, Rattus norvegicus
gcaacaatcttgaacagtcaggact

SEQ ID NO: 376423 - DNA, 25 bp, Rattus norvegicus
gcaacaatcttgtacagtcaggact

SEQ ID NO: 376424 - DNA, 25 bp, Rattus norvegicus
gcaacaatgcctatccaggcatcgt

SEQ ID NO: 376425 - DNA, 25 bp, Rattus norvegicus
gcaacaatgcctttccaggcatcgt

SEQ ID NO: 376426 - DNA, 25 bp, Rattus norvegicus
gcaacaattcctcgtgtcagtccat

SEQ ID NO: 376427 - DNA, 25 bp, Rattus norvegicus
gcaacaattcctggtgtcagtccat

SEQ ID NO: 376428 - DNA, 25 bp, Rattus norvegicus
gcaacacaaatgatgtggttatcag

SEQ ID NO: 376429 - DNA, 25 bp, Rattus norvegicus
gcaacacaaatgttgtggttatcag

SEQ ID NO: 376430 - DNA, 25 bp, Rattus norvegicus
gcaacacacagtactatcggagcgt

SEQ ID NO: 376431 - DNA, 25 bp, Rattus norvegicus
gcaacacacagttctatcggagcgt

SEQ ID NO: 376432 - DNA, 25 bp, Rattus norvegicus
gcaacacagctacgcggatcgagga

SEQ ID NO: 376433 - DNA, 25 bp, Rattus norvegicus
gcaacacagctaggcggatcgagga

SEQ ID NO: 376434 - DNA, 25 bp, Rattus norvegicus
gcaacacagtgtatccaactttcta

SEQ ID NO: 376435 - DNA, 25 bp, Rattus norvegicus
gcaacacagtgtttccaactttcta

SEQ ID NO: 376436 - DNA, 25 bp, Rattus norvegicus
gcaacacagttgaaaagatcttcat

SEQ ID NO: 376437 - DNA, 25 bp, Rattus norvegicus
gcaacacagttgtaaagatcttcat

SEQ ID NO: 376438 - DNA, 25 bp, Rattus norvegicus
gcaacacatctcaacaatcatctca

SEQ ID NO: 376439 - DNA, 25 bp, Rattus norvegicus
gcaacacatctctacaatcatctca

SEQ ID NO: 376440 - DNA, 25 bp, Rattus norvegicus
gcaacacattgcacggcagattaca

SEQ ID NO: 376441 - DNA, 25 bp, Rattus norvegicus
gcaacacattgctcggcagattaca

SEQ ID NO: 376442 - DNA, 25 bp, Rattus norvegicus
gcaacacatttgctgctttggaagt

SEQ ID NO: 376443 - DNA, 25 bp, Rattus norvegicus
gcaacacatttggtgctttggaagt

SEQ ID NO: 376444 - DNA, 25 bp, Rattus norvegicus
gcaacaccagcaacaggcatctaga

SEQ ID NO: 376445 - DNA, 25 bp, Rattus norvegicus
gcaacaccagcatcaggcatctaga

SEQ ID NO: 376446 - DNA, 25 bp, Rattus norvegicus
gcaacaccaggccttggtgaccaca

SEQ ID NO: 376447 - DNA, 25 bp, Rattus norvegicus
gcaacaccaggcgttggtgaccaca

SEQ ID NO: 376448 - DNA, 25 bp, Rattus norvegicus
gcaacaccattcaagttatcctact

SEQ ID NO: 376449 - DNA, 25 bp, Rattus norvegicus
gcaacaccattctagttatcctact

SEQ ID NO: 376450 - DNA, 25 bp, Rattus norvegicus
gcaacaccatttatgggctgggtct

SEQ ID NO: 376451 - DNA, 25 bp, Rattus norvegicus
gcaacaccatttttgggctgggtct

SEQ ID NO: 376452 - DNA, 25 bp, Rattus norvegicus
gcaacacccatcaagataccagact

SEQ ID NO: 376453 - DNA, 25 bp, Rattus norvegicus
gcaacacccatctagataccagact

SEQ ID NO: 376454 - DNA, 25 bp, Rattus norvegicus
gcaacacctggcaatgaaattcctg

SEQ ID NO: 376455 - DNA, 25 bp, Rattus norvegicus
gcaacacctggctatgaaattcctg

SEQ ID NO: 376456 - DNA, 25 bp, Rattus norvegicus
gcaacaccttggctctacgctagca

SEQ ID NO: 376457 - DNA, 25 bp, Rattus norvegicus
gcaacaccttgggtctacgctagca

SEQ ID NO: 376458 - DNA, 25 bp, Rattus norvegicus
gcaacacgaaacatccttaagctgg

SEQ ID NO: 376459 - DNA, 25 bp, Rattus norvegicus
gcaacacgaaacttccttaagctgg

SEQ ID NO: 376460 - DNA, 25 bp, Rattus norvegicus
gcaacacgcttacattctctatcaa

SEQ ID NO: 376461 - DNA, 25 bp, Rattus norvegicus
gcaacacgcttagattctctatcaa

SEQ ID NO: 376462 - DNA, 25 bp, Rattus norvegicus
gcaacactctgcacaactggatcga

SEQ ID NO: 376463 - DNA, 25 bp, Rattus norvegicus
gcaacactctgctcaactggatcga

SEQ ID NO: 376464 - DNA, 25 bp, Rattus norvegicus
gcaacactgaaaactcttcctgagt

SEQ ID NO: 376465 - DNA, 25 bp, Rattus norvegicus
gcaacactgaaatctcttcctgagt

SEQ ID NO: 376466 - DNA, 25 bp, Rattus norvegicus
gcaacactggagcacaatgtttcta

SEQ ID NO: 376467 - DNA, 25 bp, Rattus norvegicus
gcaacactggaggacaatgtttcta

SEQ ID NO: 376468 - DNA, 25 bp, Rattus norvegicus
gcaacacttcagacttcacactaga

SEQ ID NO: 376469 - DNA, 25 bp, Rattus norvegicus
gcaacacttcagtcttcacactaga

SEQ ID NO: 376470 - DNA, 25 bp, Rattus norvegicus
gcaacagaaactctaagaccctggg

SEQ ID NO: 376471 - DNA, 25 bp, Rattus norvegicus
gcaacagaaactgtaagaccctggg

SEQ ID NO: 376472 - DNA, 25 bp, Rattus norvegicus
gcaacagaagttatagtcattcatt

SEQ ID NO: 376473 - DNA, 25 bp, Rattus norvegicus
gcaacagaagttttagtcattcatt

SEQ ID NO: 376474 - DNA, 25 bp, Rattus norvegicus
gcaacagaatgcatccctcaagtga

SEQ ID NO: 376475 - DNA, 25 bp, Rattus norvegicus
gcaacagaatgcttccctcaagtga

SEQ ID NO: 376476 - DNA, 25 bp, Rattus norvegicus
gcaacagacagaaccaggtgtggca

SEQ ID NO: 376477 - DNA, 25 bp, Rattus norvegicus
gcaacagacagatccaggtgtggca

SEQ ID NO: 376478 - DNA, 25 bp, Rattus norvegicus
gcaacagacccacggctgaggcata

SEQ ID NO: 376479 - DNA, 25 bp, Rattus norvegicus
gcaacagacccagggctgaggcata

SEQ ID NO: 376480 - DNA, 25 bp, Rattus norvegicus
gcaacagatacgatcgctgggcttt

SEQ ID NO: 376481 - DNA, 25 bp, Rattus norvegicus
gcaacagatacgttcgctgggcttt

SEQ ID NO: 376482 - DNA, 25 bp, Rattus norvegicus
gcaacagatcatatcgggtgacttt

SEQ ID NO: 376483 - DNA, 25 bp, Rattus norvegicus
gcaacagatcatttcgggtgacttt

SEQ ID NO: 376484 - DNA, 25 bp, Rattus norvegicus
gcaacagattgtaatccagtcttct

SEQ ID NO: 376485 - DNA, 25 bp, Rattus norvegicus
gcaacagattgttatccagtcttct

SEQ ID NO: 376486 - DNA, 25 bp, Rattus norvegicus
gcaacagcagacagccatatcatga

SEQ ID NO: 376487 - DNA, 25 bp, Rattus norvegicus
gcaacagcagactgccatatcatga

SEQ ID NO: 376488 - DNA, 25 bp, Rattus norvegicus
gcaacagcaggaaacaaagtcaact

SEQ ID NO: 376489 - DNA, 25 bp, Rattus norvegicus
gcaacagcaggatacaaagtcaact

SEQ ID NO: 376490 - DNA, 25 bp, Rattus norvegicus
gcaacagccaaacagccaggtccgt

SEQ ID NO: 376491 - DNA, 25 bp, Rattus norvegicus
gcaacagccaaagagccaggtccgt

SEQ ID NO: 376492 - DNA, 25 bp, Rattus norvegicus
gcaacagcgcctcagcatgaaggat

SEQ ID NO: 376493 - DNA, 25 bp, Rattus norvegicus
gcaacagcgcctgagcatgaaggat

SEQ ID NO: 376494 - DNA, 25 bp, Rattus norvegicus
gcaacagctggccttgggcaaataa

SEQ ID NO: 376495 - DNA, 25 bp, Rattus norvegicus
gcaacagctggcgttgggcaaataa

SEQ ID NO: 376496 - DNA, 25 bp, Rattus norvegicus
gcaacaggaaatcgctcttcagcaa

SEQ ID NO: 376497 - DNA, 25 bp, Rattus norvegicus
gcaacaggaaatggctcttcagcaa

SEQ ID NO: 376498 - DNA, 25 bp, Rattus norvegicus
gcaacaggaaggcacatttctccag

SEQ ID NO: 376499 - DNA, 25 bp, Rattus norvegicus
gcaacaggaagggacatttctccag

SEQ ID NO: 376500 - DNA, 25 bp, Rattus norvegicus
gcaacaggcagacggcgttaatcta

SEQ ID NO: 376501 - DNA, 25 bp, Rattus norvegicus
gcaacaggcagagggcgttaatcta

SEQ ID NO: 376502 - DNA, 25 bp, Rattus norvegicus
gcaacaggccggcatttttactcgg

SEQ ID NO: 376503 - DNA, 25 bp, Rattus norvegicus
gcaacaggccgggatttttactcgg

SEQ ID NO: 376504 - DNA, 25 bp, Rattus norvegicus
gcaacagggcagacagaagggacaa

SEQ ID NO: 376505 - DNA, 25 bp, Rattus norvegicus
gcaacagggcagtcagaagggacaa

SEQ ID NO: 376506 - DNA, 25 bp, Rattus norvegicus
gcaacagggcttactacatggagga

SEQ ID NO: 376507 - DNA, 25 bp, Rattus norvegicus
gcaacagggctttctacatggagga

SEQ ID NO: 376508 - DNA, 25 bp, Rattus norvegicus
gcaacaggtattacctagcactgga

SEQ ID NO: 376509 - DNA, 25 bp, Rattus norvegicus
gcaacaggtatttcctagcactgga

SEQ ID NO: 376510 - DNA, 25 bp, Rattus norvegicus
gcaacaggtggcatggcgtcatgaa

SEQ ID NO: 376511 - DNA, 25 bp, Rattus norvegicus
gcaacaggtggcttggcgtcatgaa

SEQ ID NO: 376512 - DNA, 25 bp, Rattus norvegicus
gcaacagtagggactgccgtgaata

SEQ ID NO: 376513 - DNA, 25 bp, Rattus norvegicus
gcaacagtagggtctgccgtgaata

SEQ ID NO: 376514 - DNA, 25 bp, Rattus norvegicus
gcaacagtccagcaaccagtgaggt

SEQ ID NO: 376515 - DNA, 25 bp, Rattus norvegicus
gcaacagtccaggaaccagtgaggt

SEQ ID NO: 376516 - DNA, 25 bp, Rattus norvegicus
gcaacagtctacagcaacagtgtct

SEQ ID NO: 376517 - DNA, 25 bp, Rattus norvegicus
gcaacagtctactgcaacagtgtct

SEQ ID NO: 376518 - DNA, 25 bp, Rattus norvegicus
gcaacagtctggacattcacgacaa

SEQ ID NO: 376519 - DNA, 25 bp, Rattus norvegicus
gcaacagtctggtcattcacgacaa

SEQ ID NO: 376520 - DNA, 25 bp, Rattus norvegicus
gcaacagtgactcaaactccaggag

SEQ ID NO: 376521 - DNA, 25 bp, Rattus norvegicus
gcaacagtgactgaaactccaggag

SEQ ID NO: 376522 - DNA, 25 bp, Rattus norvegicus
gcaacagtgttgacgttcctaaaga

SEQ ID NO: 376523 - DNA, 25 bp, Rattus norvegicus
gcaacagtgttgtcgttcctaaaga

SEQ ID NO: 376524 - DNA, 25 bp, Rattus norvegicus
gcaacagttcacacagcacatcaaa

SEQ ID NO: 376525 - DNA, 25 bp, Rattus norvegicus
gcaacagttcactcagcacatcaaa

SEQ ID NO: 376526 - DNA, 25 bp, Rattus norvegicus
gcaacagttgcaataactatttcag

SEQ ID NO: 376527 - DNA, 25 bp, Rattus norvegicus
gcaacagttgcattaactatttcag

SEQ ID NO: 376528 - DNA, 25 bp, Rattus norvegicus
gcaacagttgtgacagctgctgaga

SEQ ID NO: 376529 - DNA, 25 bp, Rattus norvegicus
gcaacagttgtgtcagctgctgaga

SEQ ID NO: 376530 - DNA, 25 bp, Rattus norvegicus
gcaacagttttcctcaccatatagt

SEQ ID NO: 376531 - DNA, 25 bp, Rattus norvegicus
gcaacagttttcgtcaccatatagt

SEQ ID NO: 376532 - DNA, 25 bp, Rattus norvegicus
gcaacagtttttcgctcgtcaagaa

SEQ ID NO: 376533 - DNA, 25 bp, Rattus norvegicus
gcaacagtttttggctcgtcaagaa

SEQ ID NO: 376534 - DNA, 25 bp, Rattus norvegicus
gcaacataggtgactgccagcaact

SEQ ID NO: 376535 - DNA, 25 bp, Rattus norvegicus
gcaacataggtgtctgccagcaact

SEQ ID NO: 376536 - DNA, 25 bp, Rattus norvegicus
gcaacatatctgcatggcctgcata

SEQ ID NO: 376537 - DNA, 25 bp, Rattus norvegicus
gcaacatatctggatggcctgcata

SEQ ID NO: 376538 - DNA, 25 bp, Rattus norvegicus
gcaacatattgtctgtgtttgtaca

SEQ ID NO: 376539 - DNA, 25 bp, Rattus norvegicus
gcaacatattgtgtgtgtttgtaca

SEQ ID NO: 376540 - DNA, 25 bp, Rattus norvegicus
gcaacatcaaacaggcgctggacaa

SEQ ID NO: 376541 - DNA, 25 bp, Rattus norvegicus
gcaacatcaaactggcgctggacaa

SEQ ID NO: 376542 - DNA, 25 bp, Rattus norvegicus
gcaacatcactgctgtgatcagtaa

SEQ ID NO: 376543 - DNA, 25 bp, Rattus norvegicus
gcaacatcactggtgtgatcagtaa

SEQ ID NO: 376544 - DNA, 25 bp, Rattus norvegicus
gcaacatcagcgagcaacggcagat

SEQ ID NO: 376545 - DNA, 25 bp, Rattus norvegicus
gcaacatcagcgtgcaacggcagat

SEQ ID NO: 376546 - DNA, 25 bp, Rattus norvegicus
gcaacatcattcctgtctactgtgc

SEQ ID NO: 376547 - DNA, 25 bp, Rattus norvegicus
gcaacatcattcgtgtctactgtgc

SEQ ID NO: 376548 - DNA, 25 bp, Rattus norvegicus
gcaacatcttttacaacacttttct

SEQ ID NO: 376549 - DNA, 25 bp, Rattus norvegicus
gcaacatctttttcaacacttttct

SEQ ID NO: 376550 - DNA, 25 bp, Rattus norvegicus
gcaacatgaagtattcagctgaata

SEQ ID NO: 376551 - DNA, 25 bp, Rattus norvegicus
gcaacatgaagttttcagctgaata

SEQ ID NO: 376552 - DNA, 25 bp, Rattus norvegicus
gcaacatgacagatctcagttccct

SEQ ID NO: 376553 - DNA, 25 bp, Rattus norvegicus
gcaacatgacagttctcagttccct

SEQ ID NO: 376554 - DNA, 25 bp, Rattus norvegicus
gcaacatgccttacatttcatacag

SEQ ID NO: 376555 - DNA, 25 bp, Rattus norvegicus
gcaacatgccttccacttgattttt

SEQ ID NO: 376556 - DNA, 25 bp, Rattus norvegicus
gcaacatgccttgcacttgattttt

SEQ ID NO: 376557 - DNA, 25 bp, Rattus norvegicus
gcaacatgcctttcatttcatacag

SEQ ID NO: 376558 - DNA, 25 bp, Rattus norvegicus
gcaacatgcttgctggtcacattgg

SEQ ID NO: 376559 - DNA, 25 bp, Rattus norvegicus
gcaacatgcttggtggtcacattgg

SEQ ID NO: 376560 - DNA, 25 bp, Rattus norvegicus
gcaacatggagtacgctatgcctgt

SEQ ID NO: 376561 - DNA, 25 bp, Rattus norvegicus
gcaacatggagttcgctatgcctgt

SEQ ID NO: 376562 - DNA, 25 bp, Rattus norvegicus
gcaacatggccacgatattctccct

SEQ ID NO: 376563 - DNA, 25 bp, Rattus norvegicus
gcaacatggccaggatattctccct

SEQ ID NO: 376564 - DNA, 25 bp, Rattus norvegicus
gcaacatggcccagacaggtgtctt

SEQ ID NO: 376565 - DNA, 25 bp, Rattus norvegicus
gcaacatggccctgacaggtgtctt

SEQ ID NO: 376566 - DNA, 25 bp, Rattus norvegicus
gcaacatgtctcacattccaatctt

SEQ ID NO: 376567 - DNA, 25 bp, Rattus norvegicus
gcaacatgtctctcattccaatctt

SEQ ID NO: 376568 - DNA, 25 bp, Rattus norvegicus
gcaacatgtgggagccctcctgaga

SEQ ID NO: 376569 - DNA, 25 bp, Rattus norvegicus
gcaacatgtgggtgccctcctgaga

SEQ ID NO: 376570 - DNA, 25 bp, Rattus norvegicus
gcaacatgttgtcttttagggcgaa

SEQ ID NO: 376571 - DNA, 25 bp, Rattus norvegicus
gcaacatgttgtgttttagggcgaa

SEQ ID NO: 376572 - DNA, 25 bp, Rattus norvegicus
gcaacattctccaagcaatcttggt

SEQ ID NO: 376573 - DNA, 25 bp, Rattus norvegicus
gcaacattctccagtctacatagta

SEQ ID NO: 376574 - DNA, 25 bp, Rattus norvegicus
gcaacattctcctagcaatcttggt

SEQ ID NO: 376575 - DNA, 25 bp, Rattus norvegicus
gcaacattctcctgtctacatagta

SEQ ID NO: 376576 - DNA, 25 bp, Rattus norvegicus
gcaacattctttccctgctttttta

SEQ ID NO: 376577 - DNA, 25 bp, Rattus norvegicus
gcaacattctttgcctgctttttta

SEQ ID NO: 376578 - DNA, 25 bp, Rattus norvegicus
gcaacattgactcaggacccaacct

SEQ ID NO: 376579 - DNA, 25 bp, Rattus norvegicus
gcaacattgactgaggacccaacct

SEQ ID NO: 376580 - DNA, 25 bp, Rattus norvegicus
gcaacattgaggacttggcactccc

SEQ ID NO: 376581 - DNA, 25 bp, Rattus norvegicus
gcaacattgaggtcttggcactccc

SEQ ID NO: 376582 - DNA, 25 bp, Rattus norvegicus
gcaacattggaactctccaaccctt

SEQ ID NO: 376583 - DNA, 25 bp, Rattus norvegicus
gcaacattggaagtctccaaccctt

SEQ ID NO: 376584 - DNA, 25 bp, Rattus norvegicus
gcaacatttgggccagctaaacatg

SEQ ID NO: 376585 - DNA, 25 bp, Rattus norvegicus
gcaacatttggggcagctaaacatg

SEQ ID NO: 376586 - DNA, 25 bp, Rattus norvegicus
gcaaccaactttcctggttctgttt

SEQ ID NO: 376587 - DNA, 25 bp, Rattus norvegicus
gcaaccaactttgctggttctgttt

SEQ ID NO: 376588 - DNA, 25 bp, Rattus norvegicus
gcaaccaagcatattgtaggcaacc

SEQ ID NO: 376589 - DNA, 25 bp, Rattus norvegicus
gcaaccaagcattttgtaggcaacc

SEQ ID NO: 376590 - DNA, 25 bp, Rattus norvegicus
gcaaccacacggagtctcacagcat

SEQ ID NO: 376591 - DNA, 25 bp, Rattus norvegicus
gcaaccacacggtgtctcacagcat

SEQ ID NO: 376592 - DNA, 25 bp, Rattus norvegicus
gcaaccacagctctccatcaagaaa

SEQ ID NO: 376593 - DNA, 25 bp, Rattus norvegicus
gcaaccacagctgtccatcaagaaa

SEQ ID NO: 376594 - DNA, 25 bp, Rattus norvegicus
gcaaccacatgaatactcagaacca

SEQ ID NO: 376595 - DNA, 25 bp, Rattus norvegicus
gcaaccacatgattactcagaacca

SEQ ID NO: 376596 - DNA, 25 bp, Rattus norvegicus
gcaaccacattaccatcttctaaga

SEQ ID NO: 376597 - DNA, 25 bp, Rattus norvegicus
gcaaccacattagcatcttctaaga

SEQ ID NO: 376598 - DNA, 25 bp, Rattus norvegicus
gcaaccactggtaatctgagcacaa

SEQ ID NO: 376599 - DNA, 25 bp, Rattus norvegicus
gcaaccactggttatctgagcacaa

SEQ ID NO: 376600 - DNA, 25 bp, Rattus norvegicus
gcaaccagaactagtcagtgtctta

SEQ ID NO: 376601 - DNA, 25 bp, Rattus norvegicus
gcaaccagaacttgtcagtgtctta

SEQ ID NO: 376602 - DNA, 25 bp, Rattus norvegicus
gcaaccagaagtcagcccacagagg

SEQ ID NO: 376603 - DNA, 25 bp, Rattus norvegicus
gcaaccagaagtgagcccacagagg

SEQ ID NO: 376604 - DNA, 25 bp, Rattus norvegicus
gcaaccagactacagccatttcaag

SEQ ID NO: 376605 - DNA, 25 bp, Rattus norvegicus
gcaaccagactagagccatttcaag

SEQ ID NO: 376606 - DNA, 25 bp, Rattus norvegicus
gcaaccagcagcatgtggacattat

SEQ ID NO: 376607 - DNA, 25 bp, Rattus norvegicus
gcaaccagcagcttgtggacattat

SEQ ID NO: 376608 - DNA, 25 bp, Rattus norvegicus
gcaaccaggctcaatgtattgggaa

SEQ ID NO: 376609 - DNA, 25 bp, Rattus norvegicus
gcaaccaggctctatgtattgggaa

SEQ ID NO: 376610 - DNA, 25 bp, Rattus norvegicus
gcaaccatacagatattttctcatt

SEQ ID NO: 376611 - DNA, 25 bp, Rattus norvegicus
gcaaccatacagttattttctcatt

SEQ ID NO: 376612 - DNA, 25 bp, Rattus norvegicus
gcaaccatagcacacgtatcatcag

SEQ ID NO: 376613 - DNA, 25 bp, Rattus norvegicus
gcaaccatagcagacgtatcatcag

SEQ ID NO: 376614 - DNA, 25 bp, Rattus norvegicus
gcaaccatccatccagcttcaaaag

SEQ ID NO: 376615 - DNA, 25 bp, Rattus norvegicus
gcaaccatccatgcagcttcaaaag

SEQ ID NO: 376616 - DNA, 25 bp, Rattus norvegicus
gcaaccatcccaagtcaagtcttta

SEQ ID NO: 376617 - DNA, 25 bp, Rattus norvegicus
gcaaccatcccatgtcaagtcttta

SEQ ID NO: 376618 - DNA, 25 bp, Rattus norvegicus
gcaaccatcttcatatgggcaatcg

SEQ ID NO: 376619 - DNA, 25 bp, Rattus norvegicus
gcaaccatcttcttatgggcaatcg

SEQ ID NO: 376620 - DNA, 25 bp, Rattus norvegicus
gcaaccatgagaaagcccgatacag

SEQ ID NO: 376621 - DNA, 25 bp, Rattus norvegicus
gcaaccatgagatagcccgatacag

SEQ ID NO: 376622 - DNA, 25 bp, Rattus norvegicus
gcaaccatgcatcggtgaaccactg

SEQ ID NO: 376623 - DNA, 25 bp, Rattus norvegicus
gcaaccatgcatgggtgaaccactg

SEQ ID NO: 376624 - DNA, 25 bp, Rattus norvegicus
gcaaccattgttcataccaagctga

SEQ ID NO: 376625 - DNA, 25 bp, Rattus norvegicus
gcaaccattgttgataccaagctga

SEQ ID NO: 376626 - DNA, 25 bp, Rattus norvegicus
gcaacccaaaagcttgttctggagg

SEQ ID NO: 376627 - DNA, 25 bp, Rattus norvegicus
gcaacccaaaaggttgttctggagg

SEQ ID NO: 376628 - DNA, 25 bp, Rattus norvegicus
gcaacccacaagaccagactgttga

SEQ ID NO: 376629 - DNA, 25 bp, Rattus norvegicus
gcaacccacaagtccagactgttga

SEQ ID NO: 376630 - DNA, 25 bp, Rattus norvegicus
gcaacccagaacacattgttgtatg

SEQ ID NO: 376631 - DNA, 25 bp, Rattus norvegicus
gcaacccagaactcattgttgtatg

SEQ ID NO: 376632 - DNA, 25 bp, Rattus norvegicus
gcaacccagggtacggtgcaggtct

SEQ ID NO: 376633 - DNA, 25 bp, Rattus norvegicus
gcaacccagggttcggtgcaggtct

SEQ ID NO: 376634 - DNA, 25 bp, Rattus norvegicus
gcaacccagtggataacaggctagg

SEQ ID NO: 376635 - DNA, 25 bp, Rattus norvegicus
gcaacccagtggttaacaggctagg

SEQ ID NO: 376636 - DNA, 25 bp, Rattus norvegicus
gcaacccagtgtctgtcttgtagag

SEQ ID NO: 376637 - DNA, 25 bp, Rattus norvegicus
gcaacccagtgtgtgtcttgtagag

SEQ ID NO: 376638 - DNA, 25 bp, Rattus norvegicus
gcaacccatctgctctcttgaataa

SEQ ID NO: 376639 - DNA, 25 bp, Rattus norvegicus
gcaacccatctggtctcttgaataa

SEQ ID NO: 376640 - DNA, 25 bp, Rattus norvegicus
gcaaccccaatcctcatggacatgt

SEQ ID NO: 376641 - DNA, 25 bp, Rattus norvegicus
gcaaccccaatcgtcatggacatgt

SEQ ID NO: 376642 - DNA, 25 bp, Rattus norvegicus
gcaaccccagcaaatggaagacctg

SEQ ID NO: 376643 - DNA, 25 bp, Rattus norvegicus
gcaaccccagcatatggaagacctg

SEQ ID NO: 376644 - DNA, 25 bp, Rattus norvegicus
gcaaccccattgagcggccaggcag

SEQ ID NO: 376645 - DNA, 25 bp, Rattus norvegicus
gcaaccccattgtgcggccaggcag

SEQ ID NO: 376646 - DNA, 25 bp, Rattus norvegicus
gcaaccccgttaccacagataatat

SEQ ID NO: 376647 - DNA, 25 bp, Rattus norvegicus
gcaaccccgttagcacagataatat

SEQ ID NO: 376648 - DNA, 25 bp, Rattus norvegicus
gcaacccctggaactacatgggctt

SEQ ID NO: 376649 - DNA, 25 bp, Rattus norvegicus
gcaacccctggatctacatgggctt

SEQ ID NO: 376650 - DNA, 25 bp, Rattus norvegicus
gcaaccccttgcaaggagccatgta

SEQ ID NO: 376651 - DNA, 25 bp, Rattus norvegicus
gcaaccccttgctaggagccatgta

SEQ ID NO: 376652 - DNA, 25 bp, Rattus norvegicus
gcaacccgaatcacagcgtagagca

SEQ ID NO: 376653 - DNA, 25 bp, Rattus norvegicus
gcaacccgaatctcagcgtagagca

SEQ ID NO: 376654 - DNA, 25 bp, Rattus norvegicus
gcaacccgaggacacaacttcatgg

SEQ ID NO: 376655 - DNA, 25 bp, Rattus norvegicus
gcaacccgaggagacaacttcatgg

SEQ ID NO: 376656 - DNA, 25 bp, Rattus norvegicus
gcaacccgcgccacgttgagggaac

SEQ ID NO: 376657 - DNA, 25 bp, Rattus norvegicus
gcaacccgcgcctcgttgagggaac

SEQ ID NO: 376658 - DNA, 25 bp, Rattus norvegicus
gcaacccgttaaaagatgttctaga

SEQ ID NO: 376659 - DNA, 25 bp, Rattus norvegicus
gcaacccgttaatagatgttctaga

SEQ ID NO: 376660 - DNA, 25 bp, Rattus norvegicus
gcaaccctaggcattgtttttcttg

SEQ ID NO: 376661 - DNA, 25 bp, Rattus norvegicus
gcaaccctaggctttgtttttcttg

SEQ ID NO: 376662 - DNA, 25 bp, Rattus norvegicus
gcaaccctccttctcaaatctataa

SEQ ID NO: 376663 - DNA, 25 bp, Rattus norvegicus
gcaaccctccttgtcaaatctataa

SEQ ID NO: 376664 - DNA, 25 bp, Rattus norvegicus
gcaaccctcgtaaggctagctttgg

SEQ ID NO: 376665 - DNA, 25 bp, Rattus norvegicus
gcaaccctcgtatggctagctttgg

SEQ ID NO: 376666 - DNA, 25 bp, Rattus norvegicus
gcaaccctgcagagatcaatgtgga

SEQ ID NO: 376667 - DNA, 25 bp, Rattus norvegicus
gcaaccctgcagtgatcaatgtgga

SEQ ID NO: 376668 - DNA, 25 bp, Rattus norvegicus
gcaaccctgcggcagatggaacagc

SEQ ID NO: 376669 - DNA, 25 bp, Rattus norvegicus
gcaaccctgcgggagatggaacagc

SEQ ID NO: 376670 - DNA, 25 bp, Rattus norvegicus
gcaaccctgggcactaaacaaggat

SEQ ID NO: 376671 - DNA, 25 bp, Rattus norvegicus
gcaaccctgggctctaaacaaggat

SEQ ID NO: 376672 - DNA, 25 bp, Rattus norvegicus
gcaaccctggtgattgaggtggaac

SEQ ID NO: 376673 - DNA, 25 bp, Rattus norvegicus
gcaaccctggtgtttgaggtggaac

SEQ ID NO: 376674 - DNA, 25 bp, Rattus norvegicus
gcaaccctgtgcatcgcggtgtaaa

SEQ ID NO: 376675 - DNA, 25 bp, Rattus norvegicus
gcaaccctgtgcttcgcggtgtaaa

SEQ ID NO: 376676 - DNA, 25 bp, Rattus norvegicus
gcaaccctttccagcgggcgcagga

SEQ ID NO: 376677 - DNA, 25 bp, Rattus norvegicus
gcaaccctttcctgcgggcgcagga

SEQ ID NO: 376678 - DNA, 25 bp, Rattus norvegicus
gcaacccttttaattcagctacaga

SEQ ID NO: 376679 - DNA, 25 bp, Rattus norvegicus
gcaacccttttatttcagctacaga

SEQ ID NO: 376680 - DNA, 25 bp, Rattus norvegicus
gcaacccttttgagaccttgttata

SEQ ID NO: 376681 - DNA, 25 bp, Rattus norvegicus
gcaacccttttgtgaccttgttata

SEQ ID NO: 376682 - DNA, 25 bp, Rattus norvegicus
gcaaccgaatcaatctctactttta

SEQ ID NO: 376683 - DNA, 25 bp, Rattus norvegicus
gcaaccgaatcattctctactttta

SEQ ID NO: 376684 - DNA, 25 bp, Rattus norvegicus
gcaaccgatcgaacacagtggtcat

SEQ ID NO: 376685 - DNA, 25 bp, Rattus norvegicus
gcaaccgatcgatcacagtggtcat

SEQ ID NO: 376686 - DNA, 25 bp, Rattus norvegicus
gcaaccgcatcaatgctgccaagga

SEQ ID NO: 376687 - DNA, 25 bp, Rattus norvegicus
gcaaccgcatcattgctgccaagga

SEQ ID NO: 376688 - DNA, 25 bp, Rattus norvegicus
gcaaccgccgggaatagggactgct

SEQ ID NO: 376689 - DNA, 25 bp, Rattus norvegicus
gcaaccgccgggtatagggactgct

SEQ ID NO: 376690 - DNA, 25 bp, Rattus norvegicus
gcaaccggcaggaccgagtgcgctt

SEQ ID NO: 376691 - DNA, 25 bp, Rattus norvegicus
gcaaccggcaggtccgagtgcgctt

SEQ ID NO: 376692 - DNA, 25 bp, Rattus norvegicus
gcaaccgtcactcggcagagtatta

SEQ ID NO: 376693 - DNA, 25 bp, Rattus norvegicus
gcaaccgtcactgggcagagtatta

SEQ ID NO: 376694 - DNA, 25 bp, Rattus norvegicus
gcaaccgttggaagctggccagcca

SEQ ID NO: 376695 - DNA, 25 bp, Rattus norvegicus
gcaaccgttggatgctggccagcca

SEQ ID NO: 376696 - DNA, 25 bp, Rattus norvegicus
gcaacctaacacagtccttctctga

SEQ ID NO: 376697 - DNA, 25 bp, Rattus norvegicus
gcaacctaacactgtccttctctga

SEQ ID NO: 376698 - DNA, 25 bp, Rattus norvegicus
gcaacctacagcatcggaaccatgt

SEQ ID NO: 376699 - DNA, 25 bp, Rattus norvegicus
gcaacctacagcttcggaaccatgt

SEQ ID NO: 376700 - DNA, 25 bp, Rattus norvegicus
gcaacctacctcaattgaatcactt

SEQ ID NO: 376701 - DNA, 25 bp, Rattus norvegicus
gcaacctacctctattgaatcactt

SEQ ID NO: 376702 - DNA, 25 bp, Rattus norvegicus
gcaacctatggaacctgcttctata

SEQ ID NO: 376703 - DNA, 25 bp, Rattus norvegicus
gcaacctatggatcctgcttctata

SEQ ID NO: 376704 - DNA, 25 bp, Rattus norvegicus
gcaacctcactgaaagccgtttagc

SEQ ID NO: 376705 - DNA, 25 bp, Rattus norvegicus
gcaacctcactgtaagccgtttagc

SEQ ID NO: 376706 - DNA, 25 bp, Rattus norvegicus
gcaacctcaggaacagacaccatgg

SEQ ID NO: 376707 - DNA, 25 bp, Rattus norvegicus
gcaacctcaggatcagacaccatgg

SEQ ID NO: 376708 - DNA, 25 bp, Rattus norvegicus
gcaacctcataaagtagcctcgaat

SEQ ID NO: 376709 - DNA, 25 bp, Rattus norvegicus
gcaacctcataatgtagcctcgaat

SEQ ID NO: 376710 - DNA, 25 bp, Rattus norvegicus
gcaacctccatgcactttctggtag

SEQ ID NO: 376711 - DNA, 25 bp, Rattus norvegicus
gcaacctccatggactttctggtag

SEQ ID NO: 376712 - DNA, 25 bp, Rattus norvegicus
gcaacctccttgctttttgtagaag

SEQ ID NO: 376713 - DNA, 25 bp, Rattus norvegicus
gcaacctccttggtttttgtagaag

SEQ ID NO: 376714 - DNA, 25 bp, Rattus norvegicus
gcaacctcgctgaggccatgtgtag

SEQ ID NO: 376715 - DNA, 25 bp, Rattus norvegicus
gcaacctcgctgtggccatgtgtag

SEQ ID NO: 376716 - DNA, 25 bp, Rattus norvegicus
gcaacctctataaatgttctcagat

SEQ ID NO: 376717 - DNA, 25 bp, Rattus norvegicus
gcaacctctatatatgttctcagat

SEQ ID NO: 376718 - DNA, 25 bp, Rattus norvegicus
gcaacctgagggactgtcagcagtt

SEQ ID NO: 376719 - DNA, 25 bp, Rattus norvegicus
gcaacctgagggtctgtcagcagtt

SEQ ID NO: 376720 - DNA, 25 bp, Rattus norvegicus
gcaacctgatccaccagtggtgatg

SEQ ID NO: 376721 - DNA, 25 bp, Rattus norvegicus
gcaacctgatcctccagtggtgatg

SEQ ID NO: 376722 - DNA, 25 bp, Rattus norvegicus
gcaacctgcgtgagagggagcaccc

SEQ ID NO: 376723 - DNA, 25 bp, Rattus norvegicus
gcaacctgcgtgtgagggagcaccc

SEQ ID NO: 376724 - DNA, 25 bp, Rattus norvegicus
gcaacctggacaattcacatccatg

SEQ ID NO: 376725 - DNA, 25 bp, Rattus norvegicus
gcaacctggacatttcacatccatg

SEQ ID NO: 376726 - DNA, 25 bp, Rattus norvegicus
gcaacctggccacaaaaatcttgaa

SEQ ID NO: 376727 - DNA, 25 bp, Rattus norvegicus
gcaacctggccagaaaaatcttgaa

SEQ ID NO: 376728 - DNA, 25 bp, Rattus norvegicus
gcaacctgggtacataatgagacat

SEQ ID NO: 376729 - DNA, 25 bp, Rattus norvegicus
gcaacctgggtagataatgagacat

SEQ ID NO: 376730 - DNA, 25 bp, Rattus norvegicus
gcaacctggttaatcattgtctcga

SEQ ID NO: 376731 - DNA, 25 bp, Rattus norvegicus
gcaacctggttattcattgtctcga

SEQ ID NO: 376732 - DNA, 25 bp, Rattus norvegicus
gcaacctggtttagccttgttttag

SEQ ID NO: 376733 - DNA, 25 bp, Rattus norvegicus
gcaacctggttttgccttgttttag

SEQ ID NO: 376734 - DNA, 25 bp, Rattus norvegicus
gcaacctgtaacctcatgcattgtt

SEQ ID NO: 376735 - DNA, 25 bp, Rattus norvegicus
gcaacctgtaacgtcatgcattgtt

SEQ ID NO: 376736 - DNA, 25 bp, Rattus norvegicus
gcaacctgtgcccagcttcgaaagg

SEQ ID NO: 376737 - DNA, 25 bp, Rattus norvegicus
gcaacctgtgccgagcttcgaaagg

SEQ ID NO: 376738 - DNA, 25 bp, Rattus norvegicus
gcaaccttaaatatctcggctgtat

SEQ ID NO: 376739 - DNA, 25 bp, Rattus norvegicus
gcaaccttaaatttctcggctgtat

SEQ ID NO: 376740 - DNA, 25 bp, Rattus norvegicus
gcaaccttaagcaagccagcagcca

SEQ ID NO: 376741 - DNA, 25 bp, Rattus norvegicus
gcaaccttaagctagccagcagcca

SEQ ID NO: 376742 - DNA, 25 bp, Rattus norvegicus
gcaaccttaggtacttcaacttgtt

SEQ ID NO: 376743 - DNA, 25 bp, Rattus norvegicus
gcaaccttaggtctcagacccatgt

SEQ ID NO: 376744 - DNA, 25 bp, Rattus norvegicus
gcaaccttaggtgtcagacccatgt

SEQ ID NO: 376745 - DNA, 25 bp, Rattus norvegicus
gcaaccttaggttcttcaacttgtt

SEQ ID NO: 376746 - DNA, 25 bp, Rattus norvegicus
gcaaccttcagcacttggactggga

SEQ ID NO: 376747 - DNA, 25 bp, Rattus norvegicus
gcaaccttcagctcttggactggga

SEQ ID NO: 376748 - DNA, 25 bp, Rattus norvegicus
gcaaccttcgctcgtggcgatgaca

SEQ ID NO: 376749 - DNA, 25 bp, Rattus norvegicus
gcaaccttcgctggtggcgatgaca

SEQ ID NO: 376750 - DNA, 25 bp, Rattus norvegicus
gcaaccttctcacatggatttcaga

SEQ ID NO: 376751 - DNA, 25 bp, Rattus norvegicus
gcaaccttctcagatggatttcaga

SEQ ID NO: 376752 - DNA, 25 bp, Rattus norvegicus
gcaaccttctgcataacctgtgtga

SEQ ID NO: 376753 - DNA, 25 bp, Rattus norvegicus
gcaaccttctgcttaacctgtgtga

SEQ ID NO: 376754 - DNA, 25 bp, Rattus norvegicus
gcaaccttcttgcagaggatccgaa

SEQ ID NO: 376755 - DNA, 25 bp, Rattus norvegicus
gcaaccttcttggagaggatccgaa

SEQ ID NO: 376756 - DNA, 25 bp, Rattus norvegicus
gcaaccttgaaaacttaggccacct

SEQ ID NO: 376757 - DNA, 25 bp, Rattus norvegicus
gcaaccttgaaatcttaggccacct

SEQ ID NO: 376758 - DNA, 25 bp, Rattus norvegicus
gcaaccttgccgaattctatcagag

SEQ ID NO: 376759 - DNA, 25 bp, Rattus norvegicus
gcaaccttgccgtattctatcagag

SEQ ID NO: 376760 - DNA, 25 bp, Rattus norvegicus
gcaaccttggatacctgggagcact

SEQ ID NO: 376761 - DNA, 25 bp, Rattus norvegicus
gcaaccttggattcctgggagcact

SEQ ID NO: 376762 - DNA, 25 bp, Rattus norvegicus
gcaacctttagcagagtatacttta

SEQ ID NO: 376763 - DNA, 25 bp, Rattus norvegicus
gcaacctttagctgagtatacttta

SEQ ID NO: 376764 - DNA, 25 bp, Rattus norvegicus
gcaacctttatgcaaaccgcttggc

SEQ ID NO: 376765 - DNA, 25 bp, Rattus norvegicus
gcaacctttatggaaaccgcttggc

SEQ ID NO: 376766 - DNA, 25 bp, Rattus norvegicus
gcaacctttcccagctaagggtttg

SEQ ID NO: 376767 - DNA, 25 bp, Rattus norvegicus
gcaacctttccctgctaagggtttg

SEQ ID NO: 376768 - DNA, 25 bp, Rattus norvegicus
gcaacctttctgacataacctgtac

SEQ ID NO: 376769 - DNA, 25 bp, Rattus norvegicus
gcaacctttctgtcataacctgtac

SEQ ID NO: 376770 - DNA, 25 bp, Rattus norvegicus
gcaacctttgcaaatgccatttcag

SEQ ID NO: 376771 - DNA, 25 bp, Rattus norvegicus
gcaacctttgcatatgccatttcag

SEQ ID NO: 376772 - DNA, 25 bp, Rattus norvegicus
gcaacctttgtaactttggcaccaa

SEQ ID NO: 376773 - DNA, 25 bp, Rattus norvegicus
gcaacctttgtatctttggcaccaa

SEQ ID NO: 376774 - DNA, 25 bp, Rattus norvegicus
gcaacgaaatcaacagctggctgga

SEQ ID NO: 376775 - DNA, 25 bp, Rattus norvegicus
gcaacgaaatcatcagctggctgga

SEQ ID NO: 376776 - DNA, 25 bp, Rattus norvegicus
gcaacgaatggcaggatggtcttcc

SEQ ID NO: 376777 - DNA, 25 bp, Rattus norvegicus
gcaacgaatggctggatggtcttcc

SEQ ID NO: 376778 - DNA, 25 bp, Rattus norvegicus
gcaacgacaagtcttccggctacca

SEQ ID NO: 376779 - DNA, 25 bp, Rattus norvegicus
gcaacgacaagtgttccggctacca

SEQ ID NO: 376780 - DNA, 25 bp, Rattus norvegicus
gcaacgacctctaccgggagaagga

SEQ ID NO: 376781 - DNA, 25 bp, Rattus norvegicus
gcaacgacctcttccgggagaagga

SEQ ID NO: 376782 - DNA, 25 bp, Rattus norvegicus
gcaacgacgactatgcaaatgcaca

SEQ ID NO: 376783 - DNA, 25 bp, Rattus norvegicus
gcaacgacgactttgcaaatgcaca

SEQ ID NO: 376784 - DNA, 25 bp, Rattus norvegicus
gcaacgagccgtcagggaagccttt

SEQ ID NO: 376785 - DNA, 25 bp, Rattus norvegicus
gcaacgagccgtgagggaagccttt

SEQ ID NO: 376786 - DNA, 25 bp, Rattus norvegicus
gcaacgaggacaattagttccaagt

SEQ ID NO: 376787 - DNA, 25 bp, Rattus norvegicus
gcaacgaggacatttagttccaagt

SEQ ID NO: 376788 - DNA, 25 bp, Rattus norvegicus
gcaacgcagtccctactggataaat

SEQ ID NO: 376789 - DNA, 25 bp, Rattus norvegicus
gcaacgcagtccgtactggataaat

SEQ ID NO: 376790 - DNA, 25 bp, Rattus norvegicus
gcaacgcagttgctcatgcagcaga

SEQ ID NO: 376791 - DNA, 25 bp, Rattus norvegicus
gcaacgcagttggtcatgcagcaga

SEQ ID NO: 376792 - DNA, 25 bp, Rattus norvegicus
gcaacgcccaccagtaggaacaaat

SEQ ID NO: 376793 - DNA, 25 bp, Rattus norvegicus
gcaacgcccacctgtaggaacaaat

SEQ ID NO: 376794 - DNA, 25 bp, Rattus norvegicus
gcaacgccgggtactatgggcaaca

SEQ ID NO: 376795 - DNA, 25 bp, Rattus norvegicus
gcaacgccgggttctatgggcaaca

SEQ ID NO: 376796 - DNA, 25 bp, Rattus norvegicus
gcaacgcctaaaccccgagatcaag

SEQ ID NO: 376797 - DNA, 25 bp, Rattus norvegicus
gcaacgcctaaagcccgagatcaag

SEQ ID NO: 376798 - DNA, 25 bp, Rattus norvegicus
gcaacgcctcttcattagttttgtc

SEQ ID NO: 376799 - DNA, 25 bp, Rattus norvegicus
gcaacgcctcttgattagttttgtc

SEQ ID NO: 376800 - DNA, 25 bp, Rattus norvegicus
gcaacgcgagacaagcatatggctt

SEQ ID NO: 376801 - DNA, 25 bp, Rattus norvegicus
gcaacgcgagactagcatatggctt

SEQ ID NO: 376802 - DNA, 25 bp, Rattus norvegicus
gcaacgcttacgctcgggaagaatt

SEQ ID NO: 376803 - DNA, 25 bp, Rattus norvegicus
gcaacgcttacggtcgggaagaatt

SEQ ID NO: 376804 - DNA, 25 bp, Rattus norvegicus
gcaacggagactcgagcacgacgct

SEQ ID NO: 376805 - DNA, 25 bp, Rattus norvegicus
gcaacggagactggagcacgacgct

SEQ ID NO: 376806 - DNA, 25 bp, Rattus norvegicus
gcaacggcaggaagtccacgtacct

SEQ ID NO: 376807 - DNA, 25 bp, Rattus norvegicus
gcaacggcaggatgtccacgtacct

SEQ ID NO: 376808 - DNA, 25 bp, Rattus norvegicus
gcaacggcatcaacatctgatgctg

SEQ ID NO: 376809 - DNA, 25 bp, Rattus norvegicus
gcaacggcatcatcatctgatgctg

SEQ ID NO: 376810 - DNA, 25 bp, Rattus norvegicus
gcaacgggacccagatttatgtcat

SEQ ID NO: 376811 - DNA, 25 bp, Rattus norvegicus
gcaacgggaccctgatttatgtcat

SEQ ID NO: 376812 - DNA, 25 bp, Rattus norvegicus
gcaacggtcactcgcgtagtgctat

SEQ ID NO: 376813 - DNA, 25 bp, Rattus norvegicus
gcaacggtcactggcgtagtgctat

SEQ ID NO: 376814 - DNA, 25 bp, Rattus norvegicus
gcaacggtcttgattatgttcattt

SEQ ID NO: 376815 - DNA, 25 bp, Rattus norvegicus
gcaacggtcttgtttatgttcattt

SEQ ID NO: 376816 - DNA, 25 bp, Rattus norvegicus
gcaacgtaggcgagctttgccagcg

SEQ ID NO: 376817 - DNA, 25 bp, Rattus norvegicus
gcaacgtaggcgtgctttgccagcg

SEQ ID NO: 376818 - DNA, 25 bp, Rattus norvegicus
gcaacgtatgtgcaggaactagtct

SEQ ID NO: 376819 - DNA, 25 bp, Rattus norvegicus
gcaacgtatgtggaggaactagtct

SEQ ID NO: 376820 - DNA, 25 bp, Rattus norvegicus
gcaacgtccacgatgcgattgatgt

SEQ ID NO: 376821 - DNA, 25 bp, Rattus norvegicus
gcaacgtccacgttgcgattgatgt

SEQ ID NO: 376822 - DNA, 25 bp, Rattus norvegicus
gcaacgtctggactctacttgcatg

SEQ ID NO: 376823 - DNA, 25 bp, Rattus norvegicus
gcaacgtctggagtctacttgcatg

SEQ ID NO: 376824 - DNA, 25 bp, Rattus norvegicus
gcaacgtgcctgagtgaaagtctca

SEQ ID NO: 376825 - DNA, 25 bp, Rattus norvegicus
gcaacgtgcctgtgtgaaagtctca

SEQ ID NO: 376826 - DNA, 25 bp, Rattus norvegicus
gcaactaaccccaattttgatagaa

SEQ ID NO: 376827 - DNA, 25 bp, Rattus norvegicus
gcaactaacccctattttgatagaa

SEQ ID NO: 376828 - DNA, 25 bp, Rattus norvegicus
gcaactacggatatgccagcttcaa

SEQ ID NO: 376829 - DNA, 25 bp, Rattus norvegicus
gcaactacggatttgccagcttcaa

SEQ ID NO: 376830 - DNA, 25 bp, Rattus norvegicus
gcaactactggtaacagagtgatct

SEQ ID NO: 376831 - DNA, 25 bp, Rattus norvegicus
gcaactactggttacagagtgatct

SEQ ID NO: 376832 - DNA, 25 bp, Rattus norvegicus
gcaactagctggatataacgaccaa

SEQ ID NO: 376833 - DNA, 25 bp, Rattus norvegicus
gcaactagctggttataacgaccaa

SEQ ID NO: 376834 - DNA, 25 bp, Rattus norvegicus
gcaactaggccaagcgggtggacct

SEQ ID NO: 376835 - DNA, 25 bp, Rattus norvegicus
gcaactaggccatgcgggtggacct

SEQ ID NO: 376836 - DNA, 25 bp, Rattus norvegicus
gcaactagtctgatcaagcctttca

SEQ ID NO: 376837 - DNA, 25 bp, Rattus norvegicus
gcaactagtctgttcaagcctttca

SEQ ID NO: 376838 - DNA, 25 bp, Rattus norvegicus
gcaactatagcacagcgcggtgtat

SEQ ID NO: 376839 - DNA, 25 bp, Rattus norvegicus
gcaactatagcagagcgcggtgtat

SEQ ID NO: 376840 - DNA, 25 bp, Rattus norvegicus
gcaactatttagcatctggcaatgg

SEQ ID NO: 376841 - DNA, 25 bp, Rattus norvegicus
gcaactatttaggatctggcaatgg

SEQ ID NO: 376842 - DNA, 25 bp, Rattus norvegicus
gcaactcaacataacgccgtgggaa

SEQ ID NO: 376843 - DNA, 25 bp, Rattus norvegicus
gcaactcaacattacgccgtgggaa

SEQ ID NO: 376844 - DNA, 25 bp, Rattus norvegicus
gcaactcacattcagctgaagctcc

SEQ ID NO: 376845 - DNA, 25 bp, Rattus norvegicus
gcaactcacattgagctgaagctcc

SEQ ID NO: 376846 - DNA, 25 bp, Rattus norvegicus
gcaactcacttacccctcattagga

SEQ ID NO: 376847 - DNA, 25 bp, Rattus norvegicus
gcaactcacttagccctcattagga

SEQ ID NO: 376848 - DNA, 25 bp, Rattus norvegicus
gcaactcagggtatccaggtttggt

SEQ ID NO: 376849 - DNA, 25 bp, Rattus norvegicus
gcaactcagggtttccaggtttggt

SEQ ID NO: 376850 - DNA, 25 bp, Rattus norvegicus
gcaactcaggtcacagactggttct

SEQ ID NO: 376851 - DNA, 25 bp, Rattus norvegicus
gcaactcaggtctcagactggttct

SEQ ID NO: 376852 - DNA, 25 bp, Rattus norvegicus
gcaactcatcgaatgatttacggcg

SEQ ID NO: 376853 - DNA, 25 bp, Rattus norvegicus
gcaactcatcgattgatttacggcg

SEQ ID NO: 376854 - DNA, 25 bp, Rattus norvegicus
gcaactcatgtactacacttacaaa

SEQ ID NO: 376855 - DNA, 25 bp, Rattus norvegicus
gcaactcatgtagtacacttacaaa

SEQ ID NO: 376856 - DNA, 25 bp, Rattus norvegicus
gcaactccaagcaatttcggagaca

SEQ ID NO: 376857 - DNA, 25 bp, Rattus norvegicus
gcaactccaagctatttcggagaca

SEQ ID NO: 376858 - DNA, 25 bp, Rattus norvegicus
gcaactccaatgcagctgtactgaa

SEQ ID NO: 376859 - DNA, 25 bp, Rattus norvegicus
gcaactccaatggagctgtactgaa

SEQ ID NO: 376860 - DNA, 25 bp, Rattus norvegicus
gcaactccccatccgtgaagagatc

SEQ ID NO: 376861 - DNA, 25 bp, Rattus norvegicus
gcaactccccatgcgtgaagagatc

SEQ ID NO: 376862 - DNA, 25 bp, Rattus norvegicus
gcaactcctatgctgtccctgatga

SEQ ID NO: 376863 - DNA, 25 bp, Rattus norvegicus
gcaactcctatggtgtccctgatga

SEQ ID NO: 376864 - DNA, 25 bp, Rattus norvegicus
gcaactcggaggcacaatcatggcg

SEQ ID NO: 376865 - DNA, 25 bp, Rattus norvegicus
gcaactcggagggacaatcatggcg

SEQ ID NO: 376866 - DNA, 25 bp, Rattus norvegicus
gcaactcggcacatgacagcacagt

SEQ ID NO: 376867 - DNA, 25 bp, Rattus norvegicus
gcaactcggcacttgacagcacagt

SEQ ID NO: 376868 - DNA, 25 bp, Rattus norvegicus
gcaactctagttataccttttggtt

SEQ ID NO: 376869 - DNA, 25 bp, Rattus norvegicus
gcaactctagttttaccttttggtt

SEQ ID NO: 376870 - DNA, 25 bp, Rattus norvegicus
gcaactctccatagtagctttcata

SEQ ID NO: 376871 - DNA, 25 bp, Rattus norvegicus
gcaactctccattgtagctttcata

SEQ ID NO: 376872 - DNA, 25 bp, Rattus norvegicus
gcaactcttacactcagtcttaggt

SEQ ID NO: 376873 - DNA, 25 bp, Rattus norvegicus
gcaactcttacagtcagtcttaggt

SEQ ID NO: 376874 - DNA, 25 bp, Rattus norvegicus
gcaactcttagaaagggaagcgctt

SEQ ID NO: 376875 - DNA, 25 bp, Rattus norvegicus
gcaactcttagatagggaagcgctt

SEQ ID NO: 376876 - DNA, 25 bp, Rattus norvegicus
gcaactcttcctagtctactgagat

SEQ ID NO: 376877 - DNA, 25 bp, Rattus norvegicus
gcaactcttccttgtctactgagat

SEQ ID NO: 376878 - DNA, 25 bp, Rattus norvegicus
gcaactctttgaagctctcagatgc

SEQ ID NO: 376879 - DNA, 25 bp, Rattus norvegicus
gcaactctttgatgctctcagatgc

SEQ ID NO: 376880 - DNA, 25 bp, Rattus norvegicus
gcaactgaacgaacctaactacttt

SEQ ID NO: 376881 - DNA, 25 bp, Rattus norvegicus
gcaactgaacgatcctaactacttt

SEQ ID NO: 376882 - DNA, 25 bp, Rattus norvegicus
gcaactgacttactacccgtgaaat

SEQ ID NO: 376883 - DNA, 25 bp, Rattus norvegicus
gcaactgacttagtacccgtgaaat

SEQ ID NO: 376884 - DNA, 25 bp, Rattus norvegicus
gcaactgattctaaaggctttgtca

SEQ ID NO: 376885 - DNA, 25 bp, Rattus norvegicus
gcaactgattcttaaggctttgtca

SEQ ID NO: 376886 - DNA, 25 bp, Rattus norvegicus
gcaactgatttcatggatttgttcc

SEQ ID NO: 376887 - DNA, 25 bp, Rattus norvegicus
gcaactgatttcttggatttgttcc

SEQ ID NO: 376888 - DNA, 25 bp, Rattus norvegicus
gcaactgcacggaggattttctcca

SEQ ID NO: 376889 - DNA, 25 bp, Rattus norvegicus
gcaactgcacggtggattttctcca

SEQ ID NO: 376890 - DNA, 25 bp, Rattus norvegicus
gcaactgcagcaagagctcctggtg

SEQ ID NO: 376891 - DNA, 25 bp, Rattus norvegicus
gcaactgcagcatgagctcctggtg

SEQ ID NO: 376892 - DNA, 25 bp, Rattus norvegicus
gcaactgcatagcaagaacatcaac

SEQ ID NO: 376893 - DNA, 25 bp, Rattus norvegicus
gcaactgcataggaagaacatcaac

SEQ ID NO: 376894 - DNA, 25 bp, Rattus norvegicus
gcaactgccatcctttctgagacaa

SEQ ID NO: 376895 - DNA, 25 bp, Rattus norvegicus
gcaactgccatcgtttctgagacaa

SEQ ID NO: 376896 - DNA, 25 bp, Rattus norvegicus
gcaactgccatgagtgcattctgat

SEQ ID NO: 376897 - DNA, 25 bp, Rattus norvegicus
gcaactgccatgtgtgcattctgat

SEQ ID NO: 376898 - DNA, 25 bp, Rattus norvegicus
gcaactgcccatagaggatgttctt

SEQ ID NO: 376899 - DNA, 25 bp, Rattus norvegicus
gcaactgcccattgaggatgttctt

SEQ ID NO: 376900 - DNA, 25 bp, Rattus norvegicus
gcaactgccgagagtttcactgtta

SEQ ID NO: 376901 - DNA, 25 bp, Rattus norvegicus
gcaactgccgagtgtttcactgtta

SEQ ID NO: 376902 - DNA, 25 bp, Rattus norvegicus
gcaactgcgtgcagcgagagcttta

SEQ ID NO: 376903 - DNA, 25 bp, Rattus norvegicus
gcaactgcgtgctgcgagagcttta

SEQ ID NO: 376904 - DNA, 25 bp, Rattus norvegicus
gcaactgctatacgtgtgccgacaa

SEQ ID NO: 376905 - DNA, 25 bp, Rattus norvegicus
gcaactgctataggtgtgccgacaa

SEQ ID NO: 376906 - DNA, 25 bp, Rattus norvegicus
gcaactgcttctagtgattgttaca

SEQ ID NO: 376907 - DNA, 25 bp, Rattus norvegicus
gcaactgcttcttgtgattgttaca

SEQ ID NO: 376908 - DNA, 25 bp, Rattus norvegicus
gcaactgctttactgtctgtttcta

SEQ ID NO: 376909 - DNA, 25 bp, Rattus norvegicus
gcaactgctttagtgtctgtttcta

SEQ ID NO: 376910 - DNA, 25 bp, Rattus norvegicus
gcaactggaggcaatgacaatgact

SEQ ID NO: 376911 - DNA, 25 bp, Rattus norvegicus
gcaactggaggctatgacaatgact

SEQ ID NO: 376912 - DNA, 25 bp, Rattus norvegicus
gcaactggagttaggttttacatgt

SEQ ID NO: 376913 - DNA, 25 bp, Rattus norvegicus
gcaactggagtttggttttacatgt

SEQ ID NO: 376914 - DNA, 25 bp, Rattus norvegicus
gcaactgggaatcatgacaaactgg

SEQ ID NO: 376915 - DNA, 25 bp, Rattus norvegicus
gcaactgggaatgatgacaaactgg

SEQ ID NO: 376916 - DNA, 25 bp, Rattus norvegicus
gcaactggtcaacctgctggtgcaa

SEQ ID NO: 376917 - DNA, 25 bp, Rattus norvegicus
gcaactggtcaagctgctggtgcaa

SEQ ID NO: 376918 - DNA, 25 bp, Rattus norvegicus
gcaactggtgcaacatggagctgat

SEQ ID NO: 376919 - DNA, 25 bp, Rattus norvegicus
gcaactggtgcatcatggagctgat

SEQ ID NO: 376920 - DNA, 25 bp, Rattus norvegicus
gcaactggttgcagtgtgttcttcc

SEQ ID NO: 376921 - DNA, 25 bp, Rattus norvegicus
gcaactggttgctgtgtgttcttcc

SEQ ID NO: 376922 - DNA, 25 bp, Rattus norvegicus
gcaactggtttgcagactcttccat

SEQ ID NO: 376923 - DNA, 25 bp, Rattus norvegicus
gcaactggtttggagactcttccat

SEQ ID NO: 376924 - DNA, 25 bp, Rattus norvegicus
gcaactgtaaccctcaaactagaaa

SEQ ID NO: 376925 - DNA, 25 bp, Rattus norvegicus
gcaactgtaaccgtcaaactagaaa

SEQ ID NO: 376926 - DNA, 25 bp, Rattus norvegicus
gcaactgtaatgctctgagcggatt

SEQ ID NO: 376927 - DNA, 25 bp, Rattus norvegicus
gcaactgtaatggtctgagcggatt

SEQ ID NO: 376928 - DNA, 25 bp, Rattus norvegicus
gcaactgtacggagctgcccattag

SEQ ID NO: 376929 - DNA, 25 bp, Rattus norvegicus
gcaactgtacggtgctgcccattag

SEQ ID NO: 376930 - DNA, 25 bp, Rattus norvegicus
gcaactgtcagcatgtgtggataag

SEQ ID NO: 376931 - DNA, 25 bp, Rattus norvegicus
gcaactgtcagcttgtgtggataag

SEQ ID NO: 376932 - DNA, 25 bp, Rattus norvegicus
gcaactgtcctgagatgtcagcggt

SEQ ID NO: 376933 - DNA, 25 bp, Rattus norvegicus
gcaactgtcctgagctttcatgcag

SEQ ID NO: 376934 - DNA, 25 bp, Rattus norvegicus
gcaactgtcctgtgatgtcagcggt

SEQ ID NO: 376935 - DNA, 25 bp, Rattus norvegicus
gcaactgtcctgtgctttcatgcag

SEQ ID NO: 376936 - DNA, 25 bp, Rattus norvegicus
gcaactgtgcatagtctcgtttgtt

SEQ ID NO: 376937 - DNA, 25 bp, Rattus norvegicus
gcaactgtgcattgtctcgtttgtt

SEQ ID NO: 376938 - DNA, 25 bp, Rattus norvegicus
gcaactgtggttccggaactctcaa

SEQ ID NO: 376939 - DNA, 25 bp, Rattus norvegicus
gcaactgtggttgcggaactctcaa

SEQ ID NO: 376940 - DNA, 25 bp, Rattus norvegicus
gcaactgtgttcaaccataattccg

SEQ ID NO: 376941 - DNA, 25 bp, Rattus norvegicus
gcaactgtgttctaccataattccg

SEQ ID NO: 376942 - DNA, 25 bp, Rattus norvegicus
gcaactgtgttgctcagacttccgt

SEQ ID NO: 376943 - DNA, 25 bp, Rattus norvegicus
gcaactgtgttggtcagacttccgt

SEQ ID NO: 376944 - DNA, 25 bp, Rattus norvegicus
gcaactgttaggacttgcctgagtt

SEQ ID NO: 376945 - DNA, 25 bp, Rattus norvegicus
gcaactgttaggtcttgcctgagtt

SEQ ID NO: 376946 - DNA, 25 bp, Rattus norvegicus
gcaactgttcagagaatttcctcac

SEQ ID NO: 376947 - DNA, 25 bp, Rattus norvegicus
gcaactgttcagtgaatttcctcac

SEQ ID NO: 376948 - DNA, 25 bp, Rattus norvegicus
gcaactgttcccatacaactaggtt

SEQ ID NO: 376949 - DNA, 25 bp, Rattus norvegicus
gcaactgttcccttacaactaggtt

SEQ ID NO: 376950 - DNA, 25 bp, Rattus norvegicus
gcaactgttctcatcttctatgtta

SEQ ID NO: 376951 - DNA, 25 bp, Rattus norvegicus
gcaactgttctcttcttctatgtta

SEQ ID NO: 376952 - DNA, 25 bp, Rattus norvegicus
gcaactgttctgattactctggcca

SEQ ID NO: 376953 - DNA, 25 bp, Rattus norvegicus
gcaactgttctgtttactctggcca

SEQ ID NO: 376954 - DNA, 25 bp, Rattus norvegicus
gcaactgtttcacggttttctctcg

SEQ ID NO: 376955 - DNA, 25 bp, Rattus norvegicus
gcaactgtttcagggttttctctcg

SEQ ID NO: 376956 - DNA, 25 bp, Rattus norvegicus
gcaactgtttggaaatccattcctt

SEQ ID NO: 376957 - DNA, 25 bp, Rattus norvegicus
gcaactgtttggtaatccattcctt

SEQ ID NO: 376958 - DNA, 25 bp, Rattus norvegicus
gcaactgttttcatatttatatata

SEQ ID NO: 376959 - DNA, 25 bp, Rattus norvegicus
gcaactgttttcttatttatatata

SEQ ID NO: 376960 - DNA, 25 bp, Rattus norvegicus
gcaacttaacgcatcggtcttagga

SEQ ID NO: 376961 - DNA, 25 bp, Rattus norvegicus
gcaacttaacgcttcggtcttagga

SEQ ID NO: 376962 - DNA, 25 bp, Rattus norvegicus
gcaacttacatcatgtgactgtcag

SEQ ID NO: 376963 - DNA, 25 bp, Rattus norvegicus
gcaacttacatcttgtgactgtcag

SEQ ID NO: 376964 - DNA, 25 bp, Rattus norvegicus
gcaacttacctacgagctgaccaca

SEQ ID NO: 376965 - DNA, 25 bp, Rattus norvegicus
gcaacttacctaggagctgaccaca

SEQ ID NO: 376966 - DNA, 25 bp, Rattus norvegicus
gcaacttaccttcggatctgcagtc

SEQ ID NO: 376967 - DNA, 25 bp, Rattus norvegicus
gcaacttaccttgggatctgcagtc

SEQ ID NO: 376968 - DNA, 25 bp, Rattus norvegicus
gcaacttaggaaagtcatcgttcta

SEQ ID NO: 376969 - DNA, 25 bp, Rattus norvegicus
gcaacttaggaatgtcatcgttcta

SEQ ID NO: 376970 - DNA, 25 bp, Rattus norvegicus
gcaacttattttcttggtcaggctg

SEQ ID NO: 376971 - DNA, 25 bp, Rattus norvegicus
gcaacttattttgttggtcaggctg

SEQ ID NO: 376972 - DNA, 25 bp, Rattus norvegicus
gcaacttcaactcaaaccagcggat

SEQ ID NO: 376973 - DNA, 25 bp, Rattus norvegicus
gcaacttcaactgaaaccagcggat

SEQ ID NO: 376974 - DNA, 25 bp, Rattus norvegicus
gcaacttcacgcattcatgagaggg

SEQ ID NO: 376975 - DNA, 25 bp, Rattus norvegicus
gcaacttcacgctttcatgagaggg

SEQ ID NO: 376976 - DNA, 25 bp, Rattus norvegicus
gcaacttcctgtcctaccaaggagt

SEQ ID NO: 376977 - DNA, 25 bp, Rattus norvegicus
gcaacttcctgtgctaccaaggagt

SEQ ID NO: 376978 - DNA, 25 bp, Rattus norvegicus
gcaacttctactagtgttcacagcg

SEQ ID NO: 376979 - DNA, 25 bp, Rattus norvegicus
gcaacttctacttgtgttcacagcg

SEQ ID NO: 376980 - DNA, 25 bp, Rattus norvegicus
gcaacttcttaaaatcctctatgtg

SEQ ID NO: 376981 - DNA, 25 bp, Rattus norvegicus
gcaacttcttaatatcctctatgtg

SEQ ID NO: 376982 - DNA, 25 bp, Rattus norvegicus
gcaacttgccacagtgagtttccat

SEQ ID NO: 376983 - DNA, 25 bp, Rattus norvegicus
gcaacttgccactgtgagtttccat

SEQ ID NO: 376984 - DNA, 25 bp, Rattus norvegicus
gcaacttgcgcaatgagtgcttggt

SEQ ID NO: 376985 - DNA, 25 bp, Rattus norvegicus
gcaacttgcgcattgagtgcttggt

SEQ ID NO: 376986 - DNA, 25 bp, Rattus norvegicus
gcaacttgctgaatgatgactccca

SEQ ID NO: 376987 - DNA, 25 bp, Rattus norvegicus
gcaacttgctgattgatgactccca

SEQ ID NO: 376988 - DNA, 25 bp, Rattus norvegicus
gcaacttgctgtataacccaggcag

SEQ ID NO: 376989 - DNA, 25 bp, Rattus norvegicus
gcaacttgctgtttaacccaggcag

SEQ ID NO: 376990 - DNA, 25 bp, Rattus norvegicus
gcaacttgggatcagcaagccactc

SEQ ID NO: 376991 - DNA, 25 bp, Rattus norvegicus
gcaacttgggatgagcaagccactc

SEQ ID NO: 376992 - DNA, 25 bp, Rattus norvegicus
gcaacttgtcttaggacctcagcta

SEQ ID NO: 376993 - DNA, 25 bp, Rattus norvegicus
gcaacttgtctttggacctcagcta

SEQ ID NO: 376994 - DNA, 25 bp, Rattus norvegicus
gcaacttgttgcattcgctctttca

SEQ ID NO: 376995 - DNA, 25 bp, Rattus norvegicus
gcaacttgttgctttcgctctttca

SEQ ID NO: 376996 - DNA, 25 bp, Rattus norvegicus
gcaactttaagcagatgtccatcca

SEQ ID NO: 376997 - DNA, 25 bp, Rattus norvegicus
gcaactttaagctgatgtccatcca

SEQ ID NO: 376998 - DNA, 25 bp, Rattus norvegicus
gcaactttcaaacgaattggcccta

SEQ ID NO: 376999 - DNA, 25 bp, Rattus norvegicus
gcaactttcaaaggaattggcccta

SEQ ID NO: 377000 - DNA, 25 bp, Rattus norvegicus
gcaacttttaaacttcctatctaat

SEQ ID NO: 377001 - DNA, 25 bp, Rattus norvegicus
gcaacttttaaagttcctatctaat

SEQ ID NO: 377002 - DNA, 25 bp, Rattus norvegicus
gcaacttttagacaagtggatgtac

SEQ ID NO: 377003 - DNA, 25 bp, Rattus norvegicus
gcaacttttagagaagtggatgtac

SEQ ID NO: 377004 - DNA, 25 bp, Rattus norvegicus
gcaagaaaaggcaagatgcatccat

SEQ ID NO: 377005 - DNA, 25 bp, Rattus norvegicus
gcaagaaaaggctagatgcatccat

SEQ ID NO: 377006 - DNA, 25 bp, Rattus norvegicus
gcaagaaacagacagcccgggaaat

SEQ ID NO: 377007 - DNA, 25 bp, Rattus norvegicus
gcaagaaacagagagcccgggaaat

SEQ ID NO: 377008 - DNA, 25 bp, Rattus norvegicus
gcaagaaataccaccgttatacgcc

SEQ ID NO: 377009 - DNA, 25 bp, Rattus norvegicus
gcaagaaatacctccgttatacgcc

SEQ ID NO: 377010 - DNA, 25 bp, Rattus norvegicus
gcaagaaattgcatcctgatttttt

SEQ ID NO: 377011 - DNA, 25 bp, Rattus norvegicus
gcaagaaattgcttcctgatttttt

SEQ ID NO: 377012 - DNA, 25 bp, Rattus norvegicus
gcaagaacaaaccactgtctctgct

SEQ ID NO: 377013 - DNA, 25 bp, Rattus norvegicus
gcaagaacaaacgactgtctctgct

SEQ ID NO: 377014 - DNA, 25 bp, Rattus norvegicus
gcaagaacactgctgtcctgggact

SEQ ID NO: 377015 - DNA, 25 bp, Rattus norvegicus
gcaagaacactggtgtcctgggact

SEQ ID NO: 377016 - DNA, 25 bp, Rattus norvegicus
gcaagaaccacacgctgtccgagtt

SEQ ID NO: 377017 - DNA, 25 bp, Rattus norvegicus
gcaagaaccacaggctgtccgagtt

SEQ ID NO: 377018 - DNA, 25 bp, Rattus norvegicus
gcaagaaccaccagtgctctcttaa

SEQ ID NO: 377019 - DNA, 25 bp, Rattus norvegicus
gcaagaaccacctgtgctctcttaa

SEQ ID NO: 377020 - DNA, 25 bp, Rattus norvegicus
gcaagaaccagtagtttccccagaa

SEQ ID NO: 377021 - DNA, 25 bp, Rattus norvegicus
gcaagaaccagttgtttccccagaa

SEQ ID NO: 377022 - DNA, 25 bp, Rattus norvegicus
gcaagaacccttcttcagtgaaggt

SEQ ID NO: 377023 - DNA, 25 bp, Rattus norvegicus
gcaagaacccttgttcagtgaaggt

SEQ ID NO: 377024 - DNA, 25 bp, Rattus norvegicus
gcaagaacctgaaggacatgttcag

SEQ ID NO: 377025 - DNA, 25 bp, Rattus norvegicus
gcaagaacctgatggacatgttcag

SEQ ID NO: 377026 - DNA, 25 bp, Rattus norvegicus
gcaagaacgttcacaggctccagga

SEQ ID NO: 377027 - DNA, 25 bp, Rattus norvegicus
gcaagaacgttctcaggctccagga

SEQ ID NO: 377028 - DNA, 25 bp, Rattus norvegicus
gcaagaactacgaccgtgttgtcgg

SEQ ID NO: 377029 - DNA, 25 bp, Rattus norvegicus
gcaagaactacgtccgtgttgtcgg

SEQ ID NO: 377030 - DNA, 25 bp, Rattus norvegicus
gcaagaactactcctgtcaagctga

SEQ ID NO: 377031 - DNA, 25 bp, Rattus norvegicus
gcaagaactactgctgtcaagctga

SEQ ID NO: 377032 - DNA, 25 bp, Rattus norvegicus
gcaagaactcttagtcacatgttca

SEQ ID NO: 377033 - DNA, 25 bp, Rattus norvegicus
gcaagaactctttgtcacatgttca

SEQ ID NO: 377034 - DNA, 25 bp, Rattus norvegicus
gcaagaagaagtccggccacaccaa

SEQ ID NO: 377035 - DNA, 25 bp, Rattus norvegicus
gcaagaagaagtgcggccacaccaa

SEQ ID NO: 377036 - DNA, 25 bp, Rattus norvegicus
gcaagaagagcccttgtcgcttttc

SEQ ID NO: 377037 - DNA, 25 bp, Rattus norvegicus
gcaagaagagccgttgtcgcttttc

SEQ ID NO: 377038 - DNA, 25 bp, Rattus norvegicus
gcaagaagcggaccagagaccactt

SEQ ID NO: 377039 - DNA, 25 bp, Rattus norvegicus
gcaagaagcggagcagagaccactt

SEQ ID NO: 377040 - DNA, 25 bp, Rattus norvegicus
gcaagaagctctatttccatgtgaa

SEQ ID NO: 377041 - DNA, 25 bp, Rattus norvegicus
gcaagaagctctttttccatgtgaa

SEQ ID NO: 377042 - DNA, 25 bp, Rattus norvegicus
gcaagaaggacgacccgggcataat

SEQ ID NO: 377043 - DNA, 25 bp, Rattus norvegicus
gcaagaaggacgtcccgggcataat

SEQ ID NO: 377044 - DNA, 25 bp, Rattus norvegicus
gcaagaaggtttactccagctgcag

SEQ ID NO: 377045 - DNA, 25 bp, Rattus norvegicus
gcaagaaggttttctccagctgcag

SEQ ID NO: 377046 - DNA, 25 bp, Rattus norvegicus
gcaagaagtcctcggttgtgtcccc

SEQ ID NO: 377047 - DNA, 25 bp, Rattus norvegicus
gcaagaagtcctgggttgtgtcccc

SEQ ID NO: 377048 - DNA, 25 bp, Rattus norvegicus
gcaagaatctgcacttgtgtacgtg

SEQ ID NO: 377049 - DNA, 25 bp, Rattus norvegicus
gcaagaatctgctcttgtgtacgtg

SEQ ID NO: 377050 - DNA, 25 bp, Rattus norvegicus
gcaagaatgccaagatgccattttt

SEQ ID NO: 377051 - DNA, 25 bp, Rattus norvegicus
gcaagaatgccatgatgccattttt

SEQ ID NO: 377052 - DNA, 25 bp, Rattus norvegicus
gcaagaatgggcacacaagggctcc

SEQ ID NO: 377053 - DNA, 25 bp, Rattus norvegicus
gcaagaatgggctcacaagggctcc

SEQ ID NO: 377054 - DNA, 25 bp, Rattus norvegicus
gcaagaatgtgtcctcttaatgaaa

SEQ ID NO: 377055 - DNA, 25 bp, Rattus norvegicus
gcaagaatgtgtgctcttaatgaaa

SEQ ID NO: 377056 - DNA, 25 bp, Rattus norvegicus
gcaagaatgttgaacaccagctgtc

SEQ ID NO: 377057 - DNA, 25 bp, Rattus norvegicus
gcaagaatgttgtacaccagctgtc

SEQ ID NO: 377058 - DNA, 25 bp, Rattus norvegicus
gcaagacacctcagagttacatcaa

SEQ ID NO: 377059 - DNA, 25 bp, Rattus norvegicus
gcaagacacctctgagttacatcaa

SEQ ID NO: 377060 - DNA, 25 bp, Rattus norvegicus
gcaagacactgaaggacatttttat

SEQ ID NO: 377061 - DNA, 25 bp, Rattus norvegicus
gcaagacactgatggacatttttat

SEQ ID NO: 377062 - DNA, 25 bp, Rattus norvegicus
gcaagacatcatccgactcaactga

SEQ ID NO: 377063 - DNA, 25 bp, Rattus norvegicus
gcaagacatcatgcgactcaactga

SEQ ID NO: 377064 - DNA, 25 bp, Rattus norvegicus
gcaagacatcgaacaggagctgtgg

SEQ ID NO: 377065 - DNA, 25 bp, Rattus norvegicus
gcaagacatcgatcaggagctgtgg

SEQ ID NO: 377066 - DNA, 25 bp, Rattus norvegicus
gcaagacatcttagaagaccaccat

SEQ ID NO: 377067 - DNA, 25 bp, Rattus norvegicus
gcaagacatctttgaagaccaccat

SEQ ID NO: 377068 - DNA, 25 bp, Rattus norvegicus
gcaagaccccaaaccagaacagaat

SEQ ID NO: 377069 - DNA, 25 bp, Rattus norvegicus
gcaagaccccaatccagaacagaat

SEQ ID NO: 377070 - DNA, 25 bp, Rattus norvegicus
gcaagacccgtactctggactgtga

SEQ ID NO: 377071 - DNA, 25 bp, Rattus norvegicus
gcaagacccgtagtctggactgtga

SEQ ID NO: 377072 - DNA, 25 bp, Rattus norvegicus
gcaagaccctaaactaccgatggat

SEQ ID NO: 377073 - DNA, 25 bp, Rattus norvegicus
gcaagaccctaatctaccgatggat

SEQ ID NO: 377074 - DNA, 25 bp, Rattus norvegicus
gcaagaccctcaagtgatcctgtga

SEQ ID NO: 377075 - DNA, 25 bp, Rattus norvegicus
gcaagaccctcatgtgatcctgtga

SEQ ID NO: 377076 - DNA, 25 bp, Rattus norvegicus
gcaagaccgcatctcatttttcctt

SEQ ID NO: 377077 - DNA, 25 bp, Rattus norvegicus
gcaagaccgcatgtcatttttcctt

SEQ ID NO: 377078 - DNA, 25 bp, Rattus norvegicus
gcaagaccttatatttcctgtgaaa

SEQ ID NO: 377079 - DNA, 25 bp, Rattus norvegicus
gcaagaccttatttttcctgtgaaa

SEQ ID NO: 377080 - DNA, 25 bp, Rattus norvegicus
gcaagaccttctactggcgtgagca

SEQ ID NO: 377081 - DNA, 25 bp, Rattus norvegicus
gcaagaccttcttctggcgtgagca

SEQ ID NO: 377082 - DNA, 25 bp, Rattus norvegicus
gcaagacgacggcagttattactca

SEQ ID NO: 377083 - DNA, 25 bp, Rattus norvegicus
gcaagacgacgggagttattactca

SEQ ID NO: 377084 - DNA, 25 bp, Rattus norvegicus
gcaagacgctgcactcgtggaggaa

SEQ ID NO: 377085 - DNA, 25 bp, Rattus norvegicus
gcaagacgctgctctcgtggaggaa

SEQ ID NO: 377086 - DNA, 25 bp, Rattus norvegicus
gcaagacggcgtccaccgatttcag

SEQ ID NO: 377087 - DNA, 25 bp, Rattus norvegicus
gcaagacggcgtgcaccgatttcag

SEQ ID NO: 377088 - DNA, 25 bp, Rattus norvegicus
gcaagacgttctaccaccctataca

SEQ ID NO: 377089 - DNA, 25 bp, Rattus norvegicus
gcaagacgttcttccaccctataca

SEQ ID NO: 377090 - DNA, 25 bp, Rattus norvegicus
gcaagactcaccagcagcagcatca

SEQ ID NO: 377091 - DNA, 25 bp, Rattus norvegicus
gcaagactcacctgcagcagcatca

SEQ ID NO: 377092 - DNA, 25 bp, Rattus norvegicus
gcaagactcagaccctcagatgacc

SEQ ID NO: 377093 - DNA, 25 bp, Rattus norvegicus
gcaagactcagagcctcagatgacc

SEQ ID NO: 377094 - DNA, 25 bp, Rattus norvegicus
gcaagactcgaaccatcagcctcaa

SEQ ID NO: 377095 - DNA, 25 bp, Rattus norvegicus
gcaagactcgaagcatcagcctcaa

SEQ ID NO: 377096 - DNA, 25 bp, Rattus norvegicus
gcaagactgatcatcctgcaccaaa

SEQ ID NO: 377097 - DNA, 25 bp, Rattus norvegicus
gcaagactgatcttcctgcaccaaa

SEQ ID NO: 377098 - DNA, 25 bp, Rattus norvegicus
gcaagactgtctactgtctgttttt

SEQ ID NO: 377099 - DNA, 25 bp, Rattus norvegicus
gcaagactgtcttctgtctgttttt

SEQ ID NO: 377100 - DNA, 25 bp, Rattus norvegicus
gcaagactgtgcagtgaacggccat

SEQ ID NO: 377101 - DNA, 25 bp, Rattus norvegicus
gcaagactgtgctgtgaacggccat

SEQ ID NO: 377102 - DNA, 25 bp, Rattus norvegicus
gcaagactgtggaagtgccttacaa

SEQ ID NO: 377103 - DNA, 25 bp, Rattus norvegicus
gcaagactgtggtagtgccttacaa

SEQ ID NO: 377104 - DNA, 25 bp, Rattus norvegicus
gcaagacttcagattggacccactt

SEQ ID NO: 377105 - DNA, 25 bp, Rattus norvegicus
gcaagacttcagtttggacccactt

SEQ ID NO: 377106 - DNA, 25 bp, Rattus norvegicus
gcaagacttgcacgaagcccgagaa

SEQ ID NO: 377107 - DNA, 25 bp, Rattus norvegicus
gcaagacttgcaggaagcccgagaa

SEQ ID NO: 377108 - DNA, 25 bp, Rattus norvegicus
gcaagacttgctcgaacctggaggt

SEQ ID NO: 377109 - DNA, 25 bp, Rattus norvegicus
gcaagacttgctggaacctggaggt

SEQ ID NO: 377110 - DNA, 25 bp, Rattus norvegicus
gcaagacttttaaatgagcggtgat

SEQ ID NO: 377111 - DNA, 25 bp, Rattus norvegicus
gcaagacttttatatgagcggtgat

SEQ ID NO: 377112 - DNA, 25 bp, Rattus norvegicus
gcaagacttttgctctgtgaagtta

SEQ ID NO: 377113 - DNA, 25 bp, Rattus norvegicus
gcaagacttttggtctgtgaagtta

SEQ ID NO: 377114 - DNA, 25 bp, Rattus norvegicus
gcaagagaactcagttattagcttc

SEQ ID NO: 377115 - DNA, 25 bp, Rattus norvegicus
gcaagagaactctgttattagcttc

SEQ ID NO: 377116 - DNA, 25 bp, Rattus norvegicus
gcaagagaatccagctttcctgaga

SEQ ID NO: 377117 - DNA, 25 bp, Rattus norvegicus
gcaagagaatcctgctttcctgaga

SEQ ID NO: 377118 - DNA, 25 bp, Rattus norvegicus
gcaagagacagaccctcctgaataa

SEQ ID NO: 377119 - DNA, 25 bp, Rattus norvegicus
gcaagagacagagcctcctgaataa

SEQ ID NO: 377120 - DNA, 25 bp, Rattus norvegicus
gcaagagacttcattgccatcgcat

SEQ ID NO: 377121 - DNA, 25 bp, Rattus norvegicus
gcaagagacttctttgccatcgcat

SEQ ID NO: 377122 - DNA, 25 bp, Rattus norvegicus
gcaagagagccccaaccttatacat

SEQ ID NO: 377123 - DNA, 25 bp, Rattus norvegicus
gcaagagagcccgaaccttatacat

SEQ ID NO: 377124 - DNA, 25 bp, Rattus norvegicus
gcaagagatatcatccttctcctca

SEQ ID NO: 377125 - DNA, 25 bp, Rattus norvegicus
gcaagagatatcttccttctcctca

SEQ ID NO: 377126 - DNA, 25 bp, Rattus norvegicus
gcaagagatgaaccttcctgagaat

SEQ ID NO: 377127 - DNA, 25 bp, Rattus norvegicus
gcaagagatgaagcttcctgagaat

SEQ ID NO: 377128 - DNA, 25 bp, Rattus norvegicus
gcaagagatggccactgccgcatcc

SEQ ID NO: 377129 - DNA, 25 bp, Rattus norvegicus
gcaagagatggcgactgccgcatcc

SEQ ID NO: 377130 - DNA, 25 bp, Rattus norvegicus
gcaagagcaaatcaccccagtgtgg

SEQ ID NO: 377131 - DNA, 25 bp, Rattus norvegicus
gcaagagcaaatgaccccagtgtgg

SEQ ID NO: 377132 - DNA, 25 bp, Rattus norvegicus
gcaagagcagccagtgatttttaac

SEQ ID NO: 377133 - DNA, 25 bp, Rattus norvegicus
gcaagagcagcctgtgatttttaac

SEQ ID NO: 377134 - DNA, 25 bp, Rattus norvegicus
gcaagagcagtcagggctcctccat

SEQ ID NO: 377135 - DNA, 25 bp, Rattus norvegicus
gcaagagcagtctgggctcctccat

SEQ ID NO: 377136 - DNA, 25 bp, Rattus norvegicus
gcaagagccctcagccgtgcgcttt

SEQ ID NO: 377137 - DNA, 25 bp, Rattus norvegicus
gcaagagccctctgccgtgcgcttt

SEQ ID NO: 377138 - DNA, 25 bp, Rattus norvegicus
gcaagagccgccaagccatctctag

SEQ ID NO: 377139 - DNA, 25 bp, Rattus norvegicus
gcaagagccgccacttctggagggc

SEQ ID NO: 377140 - DNA, 25 bp, Rattus norvegicus
gcaagagccgcctagccatctctag

SEQ ID NO: 377141 - DNA, 25 bp, Rattus norvegicus
gcaagagccgcctcttctggagggc

SEQ ID NO: 377142 - DNA, 25 bp, Rattus norvegicus
gcaagagcggttccttttaccagaa

SEQ ID NO: 377143 - DNA, 25 bp, Rattus norvegicus
gcaagagcggttgcttttaccagaa

SEQ ID NO: 377144 - DNA, 25 bp, Rattus norvegicus
gcaagagctcagcagcagacagccc

SEQ ID NO: 377145 - DNA, 25 bp, Rattus norvegicus
gcaagagctcaggagcagacagccc

SEQ ID NO: 377146 - DNA, 25 bp, Rattus norvegicus
gcaagagctcttcgccacaggaagc

SEQ ID NO: 377147 - DNA, 25 bp, Rattus norvegicus
gcaagagctcttcgtggatcatcaa

SEQ ID NO: 377148 - DNA, 25 bp, Rattus norvegicus
gcaagagctcttggccacaggaagc

SEQ ID NO: 377149 - DNA, 25 bp, Rattus norvegicus
gcaagagctcttggtggatcatcaa

SEQ ID NO: 377150 - DNA, 25 bp, Rattus norvegicus
gcaagagctggtaatctctgccaca

SEQ ID NO: 377151 - DNA, 25 bp, Rattus norvegicus
gcaagagctggttatctctgccaca

SEQ ID NO: 377152 - DNA, 25 bp, Rattus norvegicus
gcaagagctgtcagggccaaggcaa

SEQ ID NO: 377153 - DNA, 25 bp, Rattus norvegicus
gcaagagctgtctgggccaaggcaa

SEQ ID NO: 377154 - DNA, 25 bp, Rattus norvegicus
gcaagagcttcaaacgaacatgtgt

SEQ ID NO: 377155 - DNA, 25 bp, Rattus norvegicus
gcaagagcttcatacgaacatgtgt

SEQ ID NO: 377156 - DNA, 25 bp, Rattus norvegicus
gcaagagctttgctgatccttcagt

SEQ ID NO: 377157 - DNA, 25 bp, Rattus norvegicus
gcaagagctttggtgatccttcagt

SEQ ID NO: 377158 - DNA, 25 bp, Rattus norvegicus
gcaagaggaaccctgagccctgctt

SEQ ID NO: 377159 - DNA, 25 bp, Rattus norvegicus
gcaagaggaaccgtgagccctgctt

SEQ ID NO: 377160 - DNA, 25 bp, Rattus norvegicus
gcaagaggaactctggccctgcgac

SEQ ID NO: 377161 - DNA, 25 bp, Rattus norvegicus
gcaagaggaactgtggccctgcgac

SEQ ID NO: 377162 - DNA, 25 bp, Rattus norvegicus
gcaagaggatccagagtccaagact

SEQ ID NO: 377163 - DNA, 25 bp, Rattus norvegicus
gcaagaggatcctgagtccaagact

SEQ ID NO: 377164 - DNA, 25 bp, Rattus norvegicus
gcaagaggcagaagtacagcagcat

SEQ ID NO: 377165 - DNA, 25 bp, Rattus norvegicus
gcaagaggcagatgtacagcagcat

SEQ ID NO: 377166 - DNA, 25 bp, Rattus norvegicus
gcaagaggcaggcatccatcttctt

SEQ ID NO: 377167 - DNA, 25 bp, Rattus norvegicus
gcaagaggcagggatccatcttctt

SEQ ID NO: 377168 - DNA, 25 bp, Rattus norvegicus
gcaagaggcttcatgctggtttttg

SEQ ID NO: 377169 - DNA, 25 bp, Rattus norvegicus
gcaagaggcttcttgctggtttttg

SEQ ID NO: 377170 - DNA, 25 bp, Rattus norvegicus
gcaagagggacacttttcttcacct

SEQ ID NO: 377171 - DNA, 25 bp, Rattus norvegicus
gcaagagggacagttttcttcacct

SEQ ID NO: 377172 - DNA, 25 bp, Rattus norvegicus
gcaagaggtactacccaaagcatgg

SEQ ID NO: 377173 - DNA, 25 bp, Rattus norvegicus
gcaagaggtacttcccaaagcatgg

SEQ ID NO: 377174 - DNA, 25 bp, Rattus norvegicus
gcaagaggttatcagcaccagcagc

SEQ ID NO: 377175 - DNA, 25 bp, Rattus norvegicus
gcaagaggttatgagcaccagcagc

SEQ ID NO: 377176 - DNA, 25 bp, Rattus norvegicus
gcaagaggttgccattcctgaccat

SEQ ID NO: 377177 - DNA, 25 bp, Rattus norvegicus
gcaagaggttgcgattcctgaccat

SEQ ID NO: 377178 - DNA, 25 bp, Rattus norvegicus
gcaagagtaagactttacgctcagt

SEQ ID NO: 377179 - DNA, 25 bp, Rattus norvegicus
gcaagagtaagagtttacgctcagt

SEQ ID NO: 377180 - DNA, 25 bp, Rattus norvegicus
gcaagagtccagactgatagccagg

SEQ ID NO: 377181 - DNA, 25 bp, Rattus norvegicus
gcaagagtccagtctgatagccagg

SEQ ID NO: 377182 - DNA, 25 bp, Rattus norvegicus
gcaagagtgtacctcctcagcagtt

SEQ ID NO: 377183 - DNA, 25 bp, Rattus norvegicus
gcaagagtgtacgtcctcagcagtt

SEQ ID NO: 377184 - DNA, 25 bp, Rattus norvegicus
gcaagagttcttcaggcagctgaat

SEQ ID NO: 377185 - DNA, 25 bp, Rattus norvegicus
gcaagagttcttcgcgtctgttgct

SEQ ID NO: 377186 - DNA, 25 bp, Rattus norvegicus
gcaagagttcttgaggcagctgaat

SEQ ID NO: 377187 - DNA, 25 bp, Rattus norvegicus
gcaagagttcttggcgtctgttgct

SEQ ID NO: 377188 - DNA, 25 bp, Rattus norvegicus
gcaagagtttcaaccgcaagcagaa

SEQ ID NO: 377189 - DNA, 25 bp, Rattus norvegicus
gcaagagtttcactcgcaactccca

SEQ ID NO: 377190 - DNA, 25 bp, Rattus norvegicus
gcaagagtttcagtcgcaactccca

SEQ ID NO: 377191 - DNA, 25 bp, Rattus norvegicus
gcaagagtttcatccgcaagcagaa

SEQ ID NO: 377192 - DNA, 25 bp, Rattus norvegicus
gcaagataaagaaggtgtcttcccc

SEQ ID NO: 377193 - DNA, 25 bp, Rattus norvegicus
gcaagataaagatggtgtcttcccc

SEQ ID NO: 377194 - DNA, 25 bp, Rattus norvegicus
gcaagataccatcaaaagggagccg

SEQ ID NO: 377195 - DNA, 25 bp, Rattus norvegicus
gcaagataccatgaaaagggagccg

SEQ ID NO: 377196 - DNA, 25 bp, Rattus norvegicus
gcaagatagaatattttaccagcga

SEQ ID NO: 377197 - DNA, 25 bp, Rattus norvegicus
gcaagatagaattttttaccagcga

SEQ ID NO: 377198 - DNA, 25 bp, Rattus norvegicus
gcaagatcaactaaaccagcatggt

SEQ ID NO: 377199 - DNA, 25 bp, Rattus norvegicus
gcaagatcaacttaaccagcatggt

SEQ ID NO: 377200 - DNA, 25 bp, Rattus norvegicus
gcaagatcagcacccttactatttt

SEQ ID NO: 377201 - DNA, 25 bp, Rattus norvegicus
gcaagatcagcagccttactatttt

SEQ ID NO: 377202 - DNA, 25 bp, Rattus norvegicus
gcaagatcatggctgcacggcagaa

SEQ ID NO: 377203 - DNA, 25 bp, Rattus norvegicus
gcaagatcatgggtgcacggcagaa

SEQ ID NO: 377204 - DNA, 25 bp, Rattus norvegicus
gcaagatccaggatgtctgctcgga

SEQ ID NO: 377205 - DNA, 25 bp, Rattus norvegicus
gcaagatccaggttgtctgctcgga

SEQ ID NO: 377206 - DNA, 25 bp, Rattus norvegicus
gcaagatcctgtacagccagtgtgg

SEQ ID NO: 377207 - DNA, 25 bp, Rattus norvegicus
gcaagatcctgttcagccagtgtgg

SEQ ID NO: 377208 - DNA, 25 bp, Rattus norvegicus
gcaagatctataagggatgtcattt

SEQ ID NO: 377209 - DNA, 25 bp, Rattus norvegicus
gcaagatctatatgggatgtcattt

SEQ ID NO: 377210 - DNA, 25 bp, Rattus norvegicus
gcaagatctgttattctggtccatt

SEQ ID NO: 377211 - DNA, 25 bp, Rattus norvegicus
gcaagatctgtttttctggtccatt

SEQ ID NO: 377212 - DNA, 25 bp, Rattus norvegicus
gcaagatgactgataatggagctcc

SEQ ID NO: 377213 - DNA, 25 bp, Rattus norvegicus
gcaagatgactgttaatggagctcc

SEQ ID NO: 377214 - DNA, 25 bp, Rattus norvegicus
gcaagatgatctatctcagctacaa

SEQ ID NO: 377215 - DNA, 25 bp, Rattus norvegicus
gcaagatgatctttctcagctacaa

SEQ ID NO: 377216 - DNA, 25 bp, Rattus norvegicus
gcaagatgcatcacatgtatatggt

SEQ ID NO: 377217 - DNA, 25 bp, Rattus norvegicus
gcaagatgcatctcatgtatatggt

SEQ ID NO: 377218 - DNA, 25 bp, Rattus norvegicus
gcaagatgctgactcctctgatgga

SEQ ID NO: 377219 - DNA, 25 bp, Rattus norvegicus
gcaagatgctgagtcctctgatgga

SEQ ID NO: 377220 - DNA, 25 bp, Rattus norvegicus
gcaagatgctgtcagcagcgcacat

SEQ ID NO: 377221 - DNA, 25 bp, Rattus norvegicus
gcaagatgctgtgagcagcgcacat

SEQ ID NO: 377222 - DNA, 25 bp, Rattus norvegicus
gcaagatggcctcaagcgaacctga

SEQ ID NO: 377223 - DNA, 25 bp, Rattus norvegicus
gcaagatggcctgaagcgaacctga

SEQ ID NO: 377224 - DNA, 25 bp, Rattus norvegicus
gcaagatgtcggagcaaggctatta

SEQ ID NO: 377225 - DNA, 25 bp, Rattus norvegicus
gcaagatgtcggtgcaaggctatta

SEQ ID NO: 377226 - DNA, 25 bp, Rattus norvegicus
gcaagatgtcttcgcccctggagat

SEQ ID NO: 377227 - DNA, 25 bp, Rattus norvegicus
gcaagatgtcttggcccctggagat

SEQ ID NO: 377228 - DNA, 25 bp, Rattus norvegicus
gcaagatgtgtgaggcccgacacaa

SEQ ID NO: 377229 - DNA, 25 bp, Rattus norvegicus
gcaagatgtgtgtggcccgacacaa

SEQ ID NO: 377230 - DNA, 25 bp, Rattus norvegicus
gcaagattcagaaggcctgggccat

SEQ ID NO: 377231 - DNA, 25 bp, Rattus norvegicus
gcaagattcagatggcctgggccat

SEQ ID NO: 377232 - DNA, 25 bp, Rattus norvegicus
gcaagattccttcttacggactttt

SEQ ID NO: 377233 - DNA, 25 bp, Rattus norvegicus
gcaagattccttgttacggactttt

SEQ ID NO: 377234 - DNA, 25 bp, Rattus norvegicus
gcaagattctaaccactaggctcca

SEQ ID NO: 377235 - DNA, 25 bp, Rattus norvegicus
gcaagattctaagcactaggctcca

SEQ ID NO: 377236 - DNA, 25 bp, Rattus norvegicus
gcaagattctcaagccacacagtaa

SEQ ID NO: 377237 - DNA, 25 bp, Rattus norvegicus
gcaagattctcatgccacacagtaa

SEQ ID NO: 377238 - DNA, 25 bp, Rattus norvegicus
gcaagattgaaactagccgcacatg

SEQ ID NO: 377239 - DNA, 25 bp, Rattus norvegicus
gcaagattgaaagtagccgcacatg

SEQ ID NO: 377240 - DNA, 25 bp, Rattus norvegicus
gcaagattgagacacgcgggcccca

SEQ ID NO: 377241 - DNA, 25 bp, Rattus norvegicus
gcaagattgagagacgcgggcccca

SEQ ID NO: 377242 - DNA, 25 bp, Rattus norvegicus
gcaagattgcggaccgctttctgct

SEQ ID NO: 377243 - DNA, 25 bp, Rattus norvegicus
gcaagattgcggtccgctttctgct

SEQ ID NO: 377244 - DNA, 25 bp, Rattus norvegicus
gcaagattgtgcattacatgtttca

SEQ ID NO: 377245 - DNA, 25 bp, Rattus norvegicus
gcaagattgtgctttacatgtttca

SEQ ID NO: 377246 - DNA, 25 bp, Rattus norvegicus
gcaagatttctcatttggcctggaa

SEQ ID NO: 377247 - DNA, 25 bp, Rattus norvegicus
gcaagatttctcttttggcctggaa

SEQ ID NO: 377248 - DNA, 25 bp, Rattus norvegicus
gcaagatttgacctttattcaggca

SEQ ID NO: 377249 - DNA, 25 bp, Rattus norvegicus
gcaagatttgacgtttattcaggca

SEQ ID NO: 377250 - DNA, 25 bp, Rattus norvegicus
gcaagatttggacttcaaaccacat

SEQ ID NO: 377251 - DNA, 25 bp, Rattus norvegicus
gcaagatttggagttcaaaccacat

SEQ ID NO: 377252 - DNA, 25 bp, Rattus norvegicus
gcaagcaaagtgattcattaatacc

SEQ ID NO: 377253 - DNA, 25 bp, Rattus norvegicus
gcaagcaaagtgtttcattaatacc

SEQ ID NO: 377254 - DNA, 25 bp, Rattus norvegicus
gcaagcaaatacagttatccttttt

SEQ ID NO: 377255 - DNA, 25 bp, Rattus norvegicus
gcaagcaaatactgttatccttttt

SEQ ID NO: 377256 - DNA, 25 bp, Rattus norvegicus
gcaagcaacagaactttccaacagt

SEQ ID NO: 377257 - DNA, 25 bp, Rattus norvegicus
gcaagcaacagatctttccaacagt

SEQ ID NO: 377258 - DNA, 25 bp, Rattus norvegicus
gcaagcaacgttatcttctatactt

SEQ ID NO: 377259 - DNA, 25 bp, Rattus norvegicus
gcaagcaacgttttcttctatactt

SEQ ID NO: 377260 - DNA, 25 bp, Rattus norvegicus
gcaagcaactccaagttttgcctta

SEQ ID NO: 377261 - DNA, 25 bp, Rattus norvegicus
gcaagcaactcctagttttgcctta

SEQ ID NO: 377262 - DNA, 25 bp, Rattus norvegicus
gcaagcaagcatagtagcagccttt

SEQ ID NO: 377263 - DNA, 25 bp, Rattus norvegicus
gcaagcaagcattgtagcagccttt

SEQ ID NO: 377264 - DNA, 25 bp, Rattus norvegicus
gcaagcaagctacgcatagtggctc

SEQ ID NO: 377265 - DNA, 25 bp, Rattus norvegicus
gcaagcaagctaggcatagtggctc

SEQ ID NO: 377266 - DNA, 25 bp, Rattus norvegicus
gcaagcaaggctcgtgactccacat

SEQ ID NO: 377267 - DNA, 25 bp, Rattus norvegicus
gcaagcaaggctggtgactccacat

SEQ ID NO: 377268 - DNA, 25 bp, Rattus norvegicus
gcaagcaagtttacaggcctctaaa

SEQ ID NO: 377269 - DNA, 25 bp, Rattus norvegicus
gcaagcaagttttcaggcctctaaa

SEQ ID NO: 377270 - DNA, 25 bp, Rattus norvegicus
gcaagcaataatcatggtctctcat

SEQ ID NO: 377271 - DNA, 25 bp, Rattus norvegicus
gcaagcaataatgatggtctctcat

SEQ ID NO: 377272 - DNA, 25 bp, Rattus norvegicus
gcaagcaatgcacacagcctttgta

SEQ ID NO: 377273 - DNA, 25 bp, Rattus norvegicus
gcaagcaatgcagacagcctttgta

SEQ ID NO: 377274 - DNA, 25 bp, Rattus norvegicus
gcaagcacaatacaacaccacacag

SEQ ID NO: 377275 - DNA, 25 bp, Rattus norvegicus
gcaagcacaatagaacaccacacag

SEQ ID NO: 377276 - DNA, 25 bp, Rattus norvegicus
gcaagcacacaacactgcagttctt

SEQ ID NO: 377277 - DNA, 25 bp, Rattus norvegicus
gcaagcacacaagactgcagttctt

SEQ ID NO: 377278 - DNA, 25 bp, Rattus norvegicus
gcaagcacagatccaccggttgttg

SEQ ID NO: 377279 - DNA, 25 bp, Rattus norvegicus
gcaagcacagatgcaccggttgttg

SEQ ID NO: 377280 - DNA, 25 bp, Rattus norvegicus
gcaagcacagttcagcgctgcattt

SEQ ID NO: 377281 - DNA, 25 bp, Rattus norvegicus
gcaagcacagttgagcgctgcattt

SEQ ID NO: 377282 - DNA, 25 bp, Rattus norvegicus
gcaagcacccttccagactggagga

SEQ ID NO: 377283 - DNA, 25 bp, Rattus norvegicus
gcaagcacccttgcagactggagga

SEQ ID NO: 377284 - DNA, 25 bp, Rattus norvegicus
gcaagcacctgtattttaatttcta

SEQ ID NO: 377285 - DNA, 25 bp, Rattus norvegicus
gcaagcacctgttttttaatttcta

SEQ ID NO: 377286 - DNA, 25 bp, Rattus norvegicus
gcaagcacggcacttatggtacaca

SEQ ID NO: 377287 - DNA, 25 bp, Rattus norvegicus
gcaagcacggcagttatggtacaca

SEQ ID NO: 377288 - DNA, 25 bp, Rattus norvegicus
gcaagcacgtggatttcggcaaagt

SEQ ID NO: 377289 - DNA, 25 bp, Rattus norvegicus
gcaagcacgtggttttcggcaaagt

SEQ ID NO: 377290 - DNA, 25 bp, Rattus norvegicus
gcaagcactgtccttatttgggcat

SEQ ID NO: 377291 - DNA, 25 bp, Rattus norvegicus
gcaagcactgtcgttatttgggcat

SEQ ID NO: 377292 - DNA, 25 bp, Rattus norvegicus
gcaagcagaagtctccggcaacaaa

SEQ ID NO: 377293 - DNA, 25 bp, Rattus norvegicus
gcaagcagaagtgtccggcaacaaa

SEQ ID NO: 377294 - DNA, 25 bp, Rattus norvegicus
gcaagcagacgcagatggaggtgaa

SEQ ID NO: 377295 - DNA, 25 bp, Rattus norvegicus
gcaagcagacgctgatggaggtgaa

SEQ ID NO: 377296 - DNA, 25 bp, Rattus norvegicus
gcaagcaggctaccgggatgaaatc

SEQ ID NO: 377297 - DNA, 25 bp, Rattus norvegicus
gcaagcaggctagcgggatgaaatc

SEQ ID NO: 377298 - DNA, 25 bp, Rattus norvegicus
gcaagcagggcaccctgagcacagc

SEQ ID NO: 377299 - DNA, 25 bp, Rattus norvegicus
gcaagcagggcagcctgagcacagc

SEQ ID NO: 377300 - DNA, 25 bp, Rattus norvegicus
gcaagcaggtctcttaggcacacaa

SEQ ID NO: 377301 - DNA, 25 bp, Rattus norvegicus
gcaagcaggtctgttaggcacacaa

SEQ ID NO: 377302 - DNA, 25 bp, Rattus norvegicus
gcaagcagtacacttccatctggaa

SEQ ID NO: 377303 - DNA, 25 bp, Rattus norvegicus
gcaagcagtacagttccatctggaa

SEQ ID NO: 377304 - DNA, 25 bp, Rattus norvegicus
gcaagcagtcttaccgtcatgccta

SEQ ID NO: 377305 - DNA, 25 bp, Rattus norvegicus
gcaagcagtctttccgtcatgccta

SEQ ID NO: 377306 - DNA, 25 bp, Rattus norvegicus
gcaagcagtgtgcacgaacctggct

SEQ ID NO: 377307 - DNA, 25 bp, Rattus norvegicus
gcaagcagtgtggacgaacctggct

SEQ ID NO: 377308 - DNA, 25 bp, Rattus norvegicus
gcaagcagttcaacaccaaggcagt

SEQ ID NO: 377309 - DNA, 25 bp, Rattus norvegicus
gcaagcagttcatcaccaaggcagt

SEQ ID NO: 377310 - DNA, 25 bp, Rattus norvegicus
gcaagcagttttcactcgggcagga

SEQ ID NO: 377311 - DNA, 25 bp, Rattus norvegicus
gcaagcagttttgactcgggcagga

SEQ ID NO: 377312 - DNA, 25 bp, Rattus norvegicus
gcaagcatagatctatagccctgat

SEQ ID NO: 377313 - DNA, 25 bp, Rattus norvegicus
gcaagcatagatgtatagccctgat

SEQ ID NO: 377314 - DNA, 25 bp, Rattus norvegicus
gcaagcatagcaatattacagagaa

SEQ ID NO: 377315 - DNA, 25 bp, Rattus norvegicus
gcaagcatagcattattacagagaa

SEQ ID NO: 377316 - DNA, 25 bp, Rattus norvegicus
gcaagcatagctaactggtacagtt

SEQ ID NO: 377317 - DNA, 25 bp, Rattus norvegicus
gcaagcatagcttactggtacagtt

SEQ ID NO: 377318 - DNA, 25 bp, Rattus norvegicus
gcaagcatagtgactcatcagggca

SEQ ID NO: 377319 - DNA, 25 bp, Rattus norvegicus
gcaagcatagtgtctcatcagggca

SEQ ID NO: 377320 - DNA, 25 bp, Rattus norvegicus
gcaagcatatatacctactagtgtt

SEQ ID NO: 377321 - DNA, 25 bp, Rattus norvegicus
gcaagcatatattcctactagtgtt

SEQ ID NO: 377322 - DNA, 25 bp, Rattus norvegicus
gcaagcatctgcaaactctgcatgt

SEQ ID NO: 377323 - DNA, 25 bp, Rattus norvegicus
gcaagcatctgctaactctgcatgt

SEQ ID NO: 377324 - DNA, 25 bp, Rattus norvegicus
gcaagcatgactatttcacctgaga

SEQ ID NO: 377325 - DNA, 25 bp, Rattus norvegicus
gcaagcatgactttttcacctgaga

SEQ ID NO: 377326 - DNA, 25 bp, Rattus norvegicus
gcaagcatggacacttttgggcaaa

SEQ ID NO: 377327 - DNA, 25 bp, Rattus norvegicus
gcaagcatggactcttttgggcaaa

SEQ ID NO: 377328 - DNA, 25 bp, Rattus norvegicus
gcaagcatggcgctctgagttcaat

SEQ ID NO: 377329 - DNA, 25 bp, Rattus norvegicus
gcaagcatggcggtctgagttcaat

SEQ ID NO: 377330 - DNA, 25 bp, Rattus norvegicus
gcaagcatgggtcatcttacgattg

SEQ ID NO: 377331 - DNA, 25 bp, Rattus norvegicus
gcaagcatgggtgatcttacgattg

SEQ ID NO: 377332 - DNA, 25 bp, Rattus norvegicus
gcaagcattctgagcaccaagggaa

SEQ ID NO: 377333 - DNA, 25 bp, Rattus norvegicus
gcaagcattctgtgcaccaagggaa

SEQ ID NO: 377334 - DNA, 25 bp, Rattus norvegicus
gcaagcattcttcatttattctact

SEQ ID NO: 377335 - DNA, 25 bp, Rattus norvegicus
gcaagcattcttgatttattctact

SEQ ID NO: 377336 - DNA, 25 bp, Rattus norvegicus
gcaagcattgagaactggaacaggt

SEQ ID NO: 377337 - DNA, 25 bp, Rattus norvegicus
gcaagcattgagtactggaacaggt

SEQ ID NO: 377338 - DNA, 25 bp, Rattus norvegicus
gcaagcattgtcagcaggcctcaag

SEQ ID NO: 377339 - DNA, 25 bp, Rattus norvegicus
gcaagcattgtctgcaggcctcaag

SEQ ID NO: 377340 - DNA, 25 bp, Rattus norvegicus
gcaagcattttacagtgatcaccca

SEQ ID NO: 377341 - DNA, 25 bp, Rattus norvegicus
gcaagcattttagagtgatcaccca

SEQ ID NO: 377342 - DNA, 25 bp, Rattus norvegicus
gcaagccaactaacccttaaggtat

SEQ ID NO: 377343 - DNA, 25 bp, Rattus norvegicus
gcaagccaactatcccttaaggtat

SEQ ID NO: 377344 - DNA, 25 bp, Rattus norvegicus
gcaagccaagccaccaaattacaaa

SEQ ID NO: 377345 - DNA, 25 bp, Rattus norvegicus
gcaagccaagcctccaaattacaaa

SEQ ID NO: 377346 - DNA, 25 bp, Rattus norvegicus
gcaagccaccccagtgtgatgaaga

SEQ ID NO: 377347 - DNA, 25 bp, Rattus norvegicus
gcaagccacccctgtgtgatgaaga

SEQ ID NO: 377348 - DNA, 25 bp, Rattus norvegicus
gcaagccagaggattgtgtcggtat

SEQ ID NO: 377349 - DNA, 25 bp, Rattus norvegicus
gcaagccagaggtttgtgtcggtat

SEQ ID NO: 377350 - DNA, 25 bp, Rattus norvegicus
gcaagccagtaaacacattttccca

SEQ ID NO: 377351 - DNA, 25 bp, Rattus norvegicus
gcaagccagtaatcacattttccca

SEQ ID NO: 377352 - DNA, 25 bp, Rattus norvegicus
gcaagccagtgcaacattttgtggg

SEQ ID NO: 377353 - DNA, 25 bp, Rattus norvegicus
gcaagccagtgctacattttgtggg

SEQ ID NO: 377354 - DNA, 25 bp, Rattus norvegicus
gcaagccagttcatagtgggatttt

SEQ ID NO: 377355 - DNA, 25 bp, Rattus norvegicus
gcaagccagttcttagtgggatttt

SEQ ID NO: 377356 - DNA, 25 bp, Rattus norvegicus
gcaagccatagacagccttcgagat

SEQ ID NO: 377357 - DNA, 25 bp, Rattus norvegicus
gcaagccatagagagccttcgagat

SEQ ID NO: 377358 - DNA, 25 bp, Rattus norvegicus
gcaagccatgttcatggtccggtat

SEQ ID NO: 377359 - DNA, 25 bp, Rattus norvegicus
gcaagccatgttgatggtccggtat

SEQ ID NO: 377360 - DNA, 25 bp, Rattus norvegicus
gcaagccattggaatctgaatgcta

SEQ ID NO: 377361 - DNA, 25 bp, Rattus norvegicus
gcaagccattggtatctgaatgcta

SEQ ID NO: 377362 - DNA, 25 bp, Rattus norvegicus
gcaagccatttcaaggacatcgata

SEQ ID NO: 377363 - DNA, 25 bp, Rattus norvegicus
gcaagccatttctaggacatcgata

SEQ ID NO: 377364 - DNA, 25 bp, Rattus norvegicus
gcaagcccaaaacaaagaaccagta

SEQ ID NO: 377365 - DNA, 25 bp, Rattus norvegicus
gcaagcccaaaagaaagaaccagta

SEQ ID NO: 377366 - DNA, 25 bp, Rattus norvegicus
gcaagcccaaataaacaagtcctat

SEQ ID NO: 377367 - DNA, 25 bp, Rattus norvegicus
gcaagcccaaattaacaagtcctat

SEQ ID NO: 377368 - DNA, 25 bp, Rattus norvegicus
gcaagcccaaggacgccagccagag

SEQ ID NO: 377369 - DNA, 25 bp, Rattus norvegicus
gcaagcccaaggtcgccagccagag

SEQ ID NO: 377370 - DNA, 25 bp, Rattus norvegicus
gcaagcccacgcagaagctcgagtg

SEQ ID NO: 377371 - DNA, 25 bp, Rattus norvegicus
gcaagcccacgctgaagctcgagtg

SEQ ID NO: 377372 - DNA, 25 bp, Rattus norvegicus
gcaagcccatgtctgttgaaagctt

SEQ ID NO: 377373 - DNA, 25 bp, Rattus norvegicus
gcaagcccatgtgtgttgaaagctt

SEQ ID NO: 377374 - DNA, 25 bp, Rattus norvegicus
gcaagcccctcaaggaggcagagaa

SEQ ID NO: 377375 - DNA, 25 bp, Rattus norvegicus
gcaagcccctcatggaggcagagaa

SEQ ID NO: 377376 - DNA, 25 bp, Rattus norvegicus
gcaagccccttcaacattaccttaa

SEQ ID NO: 377377 - DNA, 25 bp, Rattus norvegicus
gcaagccccttctacattaccttaa

SEQ ID NO: 377378 - DNA, 25 bp, Rattus norvegicus
gcaagcccgtctatagtagcatttt

SEQ ID NO: 377379 - DNA, 25 bp, Rattus norvegicus
gcaagcccgtctttagtagcatttt

SEQ ID NO: 377380 - DNA, 25 bp, Rattus norvegicus
gcaagcccgtggaggagaaataagt

SEQ ID NO: 377381 - DNA, 25 bp, Rattus norvegicus
gcaagcccgtggtggagaaataagt

SEQ ID NO: 377382 - DNA, 25 bp, Rattus norvegicus
gcaagccctataatcctaaactgag

SEQ ID NO: 377383 - DNA, 25 bp, Rattus norvegicus
gcaagccctatattcctaaactgag

SEQ ID NO: 377384 - DNA, 25 bp, Rattus norvegicus
gcaagccctcggaacagaacatact

SEQ ID NO: 377385 - DNA, 25 bp, Rattus norvegicus
gcaagccctcggtacagaacatact

SEQ ID NO: 377386 - DNA, 25 bp, Rattus norvegicus
gcaagccctggaagcgtggacatag

SEQ ID NO: 377387 - DNA, 25 bp, Rattus norvegicus
gcaagccctggatgcgtggacatag

SEQ ID NO: 377388 - DNA, 25 bp, Rattus norvegicus
gcaagccctgtccaaggtgaacgaa

SEQ ID NO: 377389 - DNA, 25 bp, Rattus norvegicus
gcaagccctgtcgaaggtgaacgaa

SEQ ID NO: 377390 - DNA, 25 bp, Rattus norvegicus
gcaagccgcgctagaaaatgctact

SEQ ID NO: 377391 - DNA, 25 bp, Rattus norvegicus
gcaagccgcgcttgaaaatgctact

SEQ ID NO: 377392 - DNA, 25 bp, Rattus norvegicus
gcaagccggcacagtacatcgcagt

SEQ ID NO: 377393 - DNA, 25 bp, Rattus norvegicus
gcaagccggcactgtacatcgcagt

SEQ ID NO: 377394 - DNA, 25 bp, Rattus norvegicus
gcaagccgtgctatgtgaagaacca

SEQ ID NO: 377395 - DNA, 25 bp, Rattus norvegicus
gcaagccgtgctttgtgaagaacca

SEQ ID NO: 377396 - DNA, 25 bp, Rattus norvegicus
gcaagcctacagaatgtgttcagcc

SEQ ID NO: 377397 - DNA, 25 bp, Rattus norvegicus
gcaagcctacagtatgtgttcagcc

SEQ ID NO: 377398 - DNA, 25 bp, Rattus norvegicus
gcaagcctccacagttagacacaat

SEQ ID NO: 377399 - DNA, 25 bp, Rattus norvegicus
gcaagcctccactgttagacacaat

SEQ ID NO: 377400 - DNA, 25 bp, Rattus norvegicus
gcaagcctcgcgatgtttggttaag

SEQ ID NO: 377401 - DNA, 25 bp, Rattus norvegicus
gcaagcctcgcgttgtttggttaag

SEQ ID NO: 377402 - DNA, 25 bp, Rattus norvegicus
gcaagcctctccatcaagtataaaa

SEQ ID NO: 377403 - DNA, 25 bp, Rattus norvegicus
gcaagcctctccttcaagtataaaa

SEQ ID NO: 377404 - DNA, 25 bp, Rattus norvegicus
gcaagcctgacacaacccagtgata

SEQ ID NO: 377405 - DNA, 25 bp, Rattus norvegicus
gcaagcctgacagaacccagtgata

SEQ ID NO: 377406 - DNA, 25 bp, Rattus norvegicus
gcaagcctggagaaacgtgtgagaa

SEQ ID NO: 377407 - DNA, 25 bp, Rattus norvegicus
gcaagcctggagtaacgtgtgagaa

SEQ ID NO: 377408 - DNA, 25 bp, Rattus norvegicus
gcaagcctggcgacgttttgataac

SEQ ID NO: 377409 - DNA, 25 bp, Rattus norvegicus
gcaagcctggcgtcgttttgataac

SEQ ID NO: 377410 - DNA, 25 bp, Rattus norvegicus
gcaagcctggctattaacttacaaa

SEQ ID NO: 377411 - DNA, 25 bp, Rattus norvegicus
gcaagcctggcttttaacttacaaa

SEQ ID NO: 377412 - DNA, 25 bp, Rattus norvegicus
gcaagcctgggcagcatgttacaaa

SEQ ID NO: 377413 - DNA, 25 bp, Rattus norvegicus
gcaagcctgggctgcatgttacaaa

SEQ ID NO: 377414 - DNA, 25 bp, Rattus norvegicus
gcaagcctgtttagtggaaaatcct

SEQ ID NO: 377415 - DNA, 25 bp, Rattus norvegicus
gcaagcctgttttgtggaaaatcct

SEQ ID NO: 377416 - DNA, 25 bp, Rattus norvegicus
gcaagccttataagccctaaagcat

SEQ ID NO: 377417 - DNA, 25 bp, Rattus norvegicus
gcaagccttatatgccctaaagcat

SEQ ID NO: 377418 - DNA, 25 bp, Rattus norvegicus
gcaagccttcctctatgtaggatgt

SEQ ID NO: 377419 - DNA, 25 bp, Rattus norvegicus
gcaagccttcctgtatgtaggatgt

SEQ ID NO: 377420 - DNA, 25 bp, Rattus norvegicus
gcaagccttgcaacagtaagagaca

SEQ ID NO: 377421 - DNA, 25 bp, Rattus norvegicus
gcaagccttgcatcagtaagagaca

SEQ ID NO: 377422 - DNA, 25 bp, Rattus norvegicus
gcaagcctttcgaacactagacttt

SEQ ID NO: 377423 - DNA, 25 bp, Rattus norvegicus
gcaagcctttcgtacactagacttt

SEQ ID NO: 377424 - DNA, 25 bp, Rattus norvegicus
gcaagcctttggatgtgatgtcttt

SEQ ID NO: 377425 - DNA, 25 bp, Rattus norvegicus
gcaagcctttggttgtgatgtcttt

SEQ ID NO: 377426 - DNA, 25 bp, Rattus norvegicus
gcaagcgacatcatctgcagtcaac

SEQ ID NO: 377427 - DNA, 25 bp, Rattus norvegicus
gcaagcgacatcttctgcagtcaac

SEQ ID NO: 377428 - DNA, 25 bp, Rattus norvegicus
gcaagcgagctacgtcagcagataa

SEQ ID NO: 377429 - DNA, 25 bp, Rattus norvegicus
gcaagcgagctaggtcagcagataa

SEQ ID NO: 377430 - DNA, 25 bp, Rattus norvegicus
gcaagcgaggatacagatatctgga

SEQ ID NO: 377431 - DNA, 25 bp, Rattus norvegicus
gcaagcgaggattcagatatctgga

SEQ ID NO: 377432 - DNA, 25 bp, Rattus norvegicus
gcaagcgatgatcaggctttcccta

SEQ ID NO: 377433 - DNA, 25 bp, Rattus norvegicus
gcaagcgatgatgaggctttcccta

SEQ ID NO: 377434 - DNA, 25 bp, Rattus norvegicus
gcaagcgcacagagggcatcgtgta

SEQ ID NO: 377435 - DNA, 25 bp, Rattus norvegicus
gcaagcgcacagtgggcatcgtgta

SEQ ID NO: 377436 - DNA, 25 bp, Rattus norvegicus
gcaagcgcatgcacgacctcaacat

SEQ ID NO: 377437 - DNA, 25 bp, Rattus norvegicus
gcaagcgcatgctcgacctcaacat

SEQ ID NO: 377438 - DNA, 25 bp, Rattus norvegicus
gcaagcgcctgaaggccgccaagcg

SEQ ID NO: 377439 - DNA, 25 bp, Rattus norvegicus
gcaagcgcctgatggccgccaagcg

SEQ ID NO: 377440 - DNA, 25 bp, Rattus norvegicus
gcaagcgctataccatgagccgtgc

SEQ ID NO: 377441 - DNA, 25 bp, Rattus norvegicus
gcaagcgctatagcatgagccgtgc

SEQ ID NO: 377442 - DNA, 25 bp, Rattus norvegicus
gcaagcgctatccaagagatctttt

SEQ ID NO: 377443 - DNA, 25 bp, Rattus norvegicus
gcaagcgctatcgaagagatctttt

SEQ ID NO: 377444 - DNA, 25 bp, Rattus norvegicus
gcaagcgctcaaaactcagagtgca

SEQ ID NO: 377445 - DNA, 25 bp, Rattus norvegicus
gcaagcgctcaatactcagagtgca

SEQ ID NO: 377446 - DNA, 25 bp, Rattus norvegicus
gcaagcgctctgctaaatgttgtta

SEQ ID NO: 377447 - DNA, 25 bp, Rattus norvegicus
gcaagcgctctggtaaatgttgtta

SEQ ID NO: 377448 - DNA, 25 bp, Rattus norvegicus
gcaagcgctttacacactcgagtag

SEQ ID NO: 377449 - DNA, 25 bp, Rattus norvegicus
gcaagcgctttacggctgagccaca

SEQ ID NO: 377450 - DNA, 25 bp, Rattus norvegicus
gcaagcgctttagacactcgagtag

SEQ ID NO: 377451 - DNA, 25 bp, Rattus norvegicus
gcaagcgctttagggctgagccaca

SEQ ID NO: 377452 - DNA, 25 bp, Rattus norvegicus
gcaagcgtaacaacttgttatagat

SEQ ID NO: 377453 - DNA, 25 bp, Rattus norvegicus
gcaagcgtaacatcttgttatagat

SEQ ID NO: 377454 - DNA, 25 bp, Rattus norvegicus
gcaagcgtcagaacagaagccattg

SEQ ID NO: 377455 - DNA, 25 bp, Rattus norvegicus
gcaagcgtcagatcagaagccattg

SEQ ID NO: 377456 - DNA, 25 bp, Rattus norvegicus
gcaagcgtcgtcagaagcaccagga

SEQ ID NO: 377457 - DNA, 25 bp, Rattus norvegicus
gcaagcgtcgtctgaagcaccagga

SEQ ID NO: 377458 - DNA, 25 bp, Rattus norvegicus
gcaagcgtgcatccaagtaaaccat

SEQ ID NO: 377459 - DNA, 25 bp, Rattus norvegicus
gcaagcgtgcatgcaagtaaaccat

SEQ ID NO: 377460 - DNA, 25 bp, Rattus norvegicus
gcaagctaaacaattcaactctttg

SEQ ID NO: 377461 - DNA, 25 bp, Rattus norvegicus
gcaagctaaacatttcaactctttg

SEQ ID NO: 377462 - DNA, 25 bp, Rattus norvegicus
gcaagctaacacctcagggacagag

SEQ ID NO: 377463 - DNA, 25 bp, Rattus norvegicus
gcaagctaacacgtcagggacagag

SEQ ID NO: 377464 - DNA, 25 bp, Rattus norvegicus
gcaagctagataaactttcctgata

SEQ ID NO: 377465 - DNA, 25 bp, Rattus norvegicus
gcaagctagatatactttcctgata

SEQ ID NO: 377466 - DNA, 25 bp, Rattus norvegicus
gcaagctataggcagcactcctcta

SEQ ID NO: 377467 - DNA, 25 bp, Rattus norvegicus
gcaagctatagggagcactcctcta

SEQ ID NO: 377468 - DNA, 25 bp, Rattus norvegicus
gcaagctatatgatgtccctgaact

SEQ ID NO: 377469 - DNA, 25 bp, Rattus norvegicus
gcaagctatatgttgtccctgaact

SEQ ID NO: 377470 - DNA, 25 bp, Rattus norvegicus
gcaagctatcatcaggcaagcccag

SEQ ID NO: 377471 - DNA, 25 bp, Rattus norvegicus
gcaagctatcatgaggcaagcccag

SEQ ID NO: 377472 - DNA, 25 bp, Rattus norvegicus
gcaagctatgcaagacctgtgctgt

SEQ ID NO: 377473 - DNA, 25 bp, Rattus norvegicus
gcaagctatgcatgacctgtgctgt

SEQ ID NO: 377474 - DNA, 25 bp, Rattus norvegicus
gcaagctattttatcttaaccatta

SEQ ID NO: 377475 - DNA, 25 bp, Rattus norvegicus
gcaagctattttttcttaaccatta

SEQ ID NO: 377476 - DNA, 25 bp, Rattus norvegicus
gcaagctcagtcaagtatggccgcc

SEQ ID NO: 377477 - DNA, 25 bp, Rattus norvegicus
gcaagctcagtctagtatggccgcc

SEQ ID NO: 377478 - DNA, 25 bp, Rattus norvegicus
gcaagctcgttgctgtatgagaaat

SEQ ID NO: 377479 - DNA, 25 bp, Rattus norvegicus
gcaagctcgttggtgtatgagaaat

SEQ ID NO: 377480 - DNA, 25 bp, Rattus norvegicus
gcaagctctcagagtacgggtgatt

SEQ ID NO: 377481 - DNA, 25 bp, Rattus norvegicus
gcaagctctcagtgtacgggtgatt

SEQ ID NO: 377482 - DNA, 25 bp, Rattus norvegicus
gcaagctctcctcgatggctggtca

SEQ ID NO: 377483 - DNA, 25 bp, Rattus norvegicus
gcaagctctcctggatggctggtca

SEQ ID NO: 377484 - DNA, 25 bp, Rattus norvegicus
gcaagctctgagcaggtccaacagg

SEQ ID NO: 377485 - DNA, 25 bp, Rattus norvegicus
gcaagctctgaggaggtccaacagg

SEQ ID NO: 377486 - DNA, 25 bp, Rattus norvegicus
gcaagctctgggattagggatctcc

SEQ ID NO: 377487 - DNA, 25 bp, Rattus norvegicus
gcaagctctgggtttagggatctcc

SEQ ID NO: 377488 - DNA, 25 bp, Rattus norvegicus
gcaagctcttccaggcactacgcag

SEQ ID NO: 377489 - DNA, 25 bp, Rattus norvegicus
gcaagctcttcctggcactacgcag

SEQ ID NO: 377490 - DNA, 25 bp, Rattus norvegicus
gcaagctctttaccagccgagccat

SEQ ID NO: 377491 - DNA, 25 bp, Rattus norvegicus
gcaagctctttagcagccgagccat

SEQ ID NO: 377492 - DNA, 25 bp, Rattus norvegicus
gcaagctctttgatcagtttactca

SEQ ID NO: 377493 - DNA, 25 bp, Rattus norvegicus
gcaagctctttgttcagtttactca

SEQ ID NO: 377494 - DNA, 25 bp, Rattus norvegicus
gcaagctgacttatttatgtgctct

SEQ ID NO: 377495 - DNA, 25 bp, Rattus norvegicus
gcaagctgacttttttatgtgctct

SEQ ID NO: 377496 - DNA, 25 bp, Rattus norvegicus
gcaagctgagccacgtttaataaac

SEQ ID NO: 377497 - DNA, 25 bp, Rattus norvegicus
gcaagctgagcctcgtttaataaac

SEQ ID NO: 377498 - DNA, 25 bp, Rattus norvegicus
gcaagctgcattatgtcacatccaa

SEQ ID NO: 377499 - DNA, 25 bp, Rattus norvegicus
gcaagctgcattttgtcacatccaa

SEQ ID NO: 377500 - DNA, 25 bp, Rattus norvegicus
gcaagctgcgggagatgctcaagca

SEQ ID NO: 377501 - DNA, 25 bp, Rattus norvegicus
gcaagctgcgggtgatgctcaagca

SEQ ID NO: 377502 - DNA, 25 bp, Rattus norvegicus
gcaagctgcttacaagatttagatt

SEQ ID NO: 377503 - DNA, 25 bp, Rattus norvegicus
gcaagctgcttagaagatttagatt

SEQ ID NO: 377504 - DNA, 25 bp, Rattus norvegicus
gcaagctggcaccagcctccgggaa

SEQ ID NO: 377505 - DNA, 25 bp, Rattus norvegicus
gcaagctggcacgagcctccgggaa

SEQ ID NO: 377506 - DNA, 25 bp, Rattus norvegicus
gcaagctggctaaccgcagaacctg

SEQ ID NO: 377507 - DNA, 25 bp, Rattus norvegicus
gcaagctggctatccgcagaacctg

SEQ ID NO: 377508 - DNA, 25 bp, Rattus norvegicus
gcaagctgggctaatcatgtgtttg

SEQ ID NO: 377509 - DNA, 25 bp, Rattus norvegicus
gcaagctgggcttatcatgtgtttg

SEQ ID NO: 377510 - DNA, 25 bp, Rattus norvegicus
gcaagctgtaccacgattttggcaa

SEQ ID NO: 377511 - DNA, 25 bp, Rattus norvegicus
gcaagctgtacctcgattttggcaa

SEQ ID NO: 377512 - DNA, 25 bp, Rattus norvegicus
gcaagctgtccacagacctgaagcg

SEQ ID NO: 377513 - DNA, 25 bp, Rattus norvegicus
gcaagctgtccagagacctgaagcg

SEQ ID NO: 377514 - DNA, 25 bp, Rattus norvegicus
gcaagcttagccattctcataaaac

SEQ ID NO: 377515 - DNA, 25 bp, Rattus norvegicus
gcaagcttagcctttctcataaaac

SEQ ID NO: 377516 - DNA, 25 bp, Rattus norvegicus
gcaagcttcagacaggaaaacccaa

SEQ ID NO: 377517 - DNA, 25 bp, Rattus norvegicus
gcaagcttcagagaggaaaacccaa

SEQ ID NO: 377518 - DNA, 25 bp, Rattus norvegicus
gcaagcttgggtctcatctctgata

SEQ ID NO: 377519 - DNA, 25 bp, Rattus norvegicus
gcaagcttgggtgtcatctctgata

SEQ ID NO: 377520 - DNA, 25 bp, Rattus norvegicus
gcaagcttggtactaaggcttctct

SEQ ID NO: 377521 - DNA, 25 bp, Rattus norvegicus
gcaagcttggtagtaaggcttctct

SEQ ID NO: 377522 - DNA, 25 bp, Rattus norvegicus
gcaagctttcatacccacagatgag

SEQ ID NO: 377523 - DNA, 25 bp, Rattus norvegicus
gcaagctttcattcccacagatgag

SEQ ID NO: 377524 - DNA, 25 bp, Rattus norvegicus
gcaagcttttagatgctagccatga

SEQ ID NO: 377525 - DNA, 25 bp, Rattus norvegicus
gcaagcttttagttgctagccatga

SEQ ID NO: 377526 - DNA, 25 bp, Rattus norvegicus
gcaagcttttcccacagtacatggt

SEQ ID NO: 377527 - DNA, 25 bp, Rattus norvegicus
gcaagcttttccgacagtacatggt

SEQ ID NO: 377528 - DNA, 25 bp, Rattus norvegicus
gcaagcttttcgactatggcttaag

SEQ ID NO: 377529 - DNA, 25 bp, Rattus norvegicus
gcaagcttttcgtctatggcttaag

SEQ ID NO: 377530 - DNA, 25 bp, Rattus norvegicus
gcaagcttttgtacaactgacctgg

SEQ ID NO: 377531 - DNA, 25 bp, Rattus norvegicus
gcaagcttttgtccgcagtgtgtag

SEQ ID NO: 377532 - DNA, 25 bp, Rattus norvegicus
gcaagcttttgtgcgcagtgtgtag

SEQ ID NO: 377533 - DNA, 25 bp, Rattus norvegicus
gcaagcttttgttcaactgacctgg

SEQ ID NO: 377534 - DNA, 25 bp, Rattus norvegicus
gcaaggaaactaatggcagagctga

SEQ ID NO: 377535 - DNA, 25 bp, Rattus norvegicus
gcaaggaaactattggcagagctga

SEQ ID NO: 377536 - DNA, 25 bp, Rattus norvegicus
gcaaggaaatgcatcaggctctctt

SEQ ID NO: 377537 - DNA, 25 bp, Rattus norvegicus
gcaaggaaatgcttcaggctctctt

SEQ ID NO: 377538 - DNA, 25 bp, Rattus norvegicus
gcaaggaaccacaggccttattcca

SEQ ID NO: 377539 - DNA, 25 bp, Rattus norvegicus
gcaaggaaccactggccttattcca

SEQ ID NO: 377540 - DNA, 25 bp, Rattus norvegicus
gcaaggaactcactccctttttaat

SEQ ID NO: 377541 - DNA, 25 bp, Rattus norvegicus
gcaaggaactcagtccctttttaat

SEQ ID NO: 377542 - DNA, 25 bp, Rattus norvegicus
gcaaggaactccaactttctggtta

SEQ ID NO: 377543 - DNA, 25 bp, Rattus norvegicus
gcaaggaactcctactttctggtta

SEQ ID NO: 377544 - DNA, 25 bp, Rattus norvegicus
gcaaggaacttacatctcccagtac

SEQ ID NO: 377545 - DNA, 25 bp, Rattus norvegicus
gcaaggaacttagatctcccagtac

SEQ ID NO: 377546 - DNA, 25 bp, Rattus norvegicus
gcaaggaagcctattgggaccgttg

SEQ ID NO: 377547 - DNA, 25 bp, Rattus norvegicus
gcaaggaagccttttgggaccgttg

SEQ ID NO: 377548 - DNA, 25 bp, Rattus norvegicus
gcaaggaagcttatcaggaggccct

SEQ ID NO: 377549 - DNA, 25 bp, Rattus norvegicus
gcaaggaagcttttcaggaggccct

SEQ ID NO: 377550 - DNA, 25 bp, Rattus norvegicus
gcaaggacacttactgggtacccat

SEQ ID NO: 377551 - DNA, 25 bp, Rattus norvegicus
gcaaggacactttctgggtacccat

SEQ ID NO: 377552 - DNA, 25 bp, Rattus norvegicus
gcaaggacagggattcagcctacga

SEQ ID NO: 377553 - DNA, 25 bp, Rattus norvegicus
gcaaggacagggtttcagcctacga

SEQ ID NO: 377554 - DNA, 25 bp, Rattus norvegicus
gcaaggacatgtcctcctggagcaa

SEQ ID NO: 377555 - DNA, 25 bp, Rattus norvegicus
gcaaggacatgtgctcctggagcaa

SEQ ID NO: 377556 - DNA, 25 bp, Rattus norvegicus
gcaaggaccctaatcactgagccag

SEQ ID NO: 377557 - DNA, 25 bp, Rattus norvegicus
gcaaggaccctattcactgagccag

SEQ ID NO: 377558 - DNA, 25 bp, Rattus norvegicus
gcaaggaccctgaaagtgtgtgaat

SEQ ID NO: 377559 - DNA, 25 bp, Rattus norvegicus
gcaaggaccctgtaagtgtgtgaat

SEQ ID NO: 377560 - DNA, 25 bp, Rattus norvegicus
gcaaggacgtgcagtttatctcata

SEQ ID NO: 377561 - DNA, 25 bp, Rattus norvegicus
gcaaggacgtgctgtttatctcata

SEQ ID NO: 377562 - DNA, 25 bp, Rattus norvegicus
gcaaggactagaacccagaacgctg

SEQ ID NO: 377563 - DNA, 25 bp, Rattus norvegicus
gcaaggactagatcccagaacgctg

SEQ ID NO: 377564 - DNA, 25 bp, Rattus norvegicus
gcaaggactagccagactgcctgcc

SEQ ID NO: 377565 - DNA, 25 bp, Rattus norvegicus
gcaaggactagcgagactgcctgcc

SEQ ID NO: 377566 - DNA, 25 bp, Rattus norvegicus
gcaaggactatgctctcagtgataa

SEQ ID NO: 377567 - DNA, 25 bp, Rattus norvegicus
gcaaggactatggtctcagtgataa

SEQ ID NO: 377568 - DNA, 25 bp, Rattus norvegicus
gcaaggactgctaccattgtacctg

SEQ ID NO: 377569 - DNA, 25 bp, Rattus norvegicus
gcaaggactgcttccattgtacctg

SEQ ID NO: 377570 - DNA, 25 bp, Rattus norvegicus
gcaaggagtcatctctacttccagc

SEQ ID NO: 377571 - DNA, 25 bp, Rattus norvegicus
gcaaggagtcatgtctacttccagc

SEQ ID NO: 377572 - DNA, 25 bp, Rattus norvegicus
gcaaggagttccaacgacgggccaa

SEQ ID NO: 377573 - DNA, 25 bp, Rattus norvegicus
gcaaggagttcctacgacgggccaa

SEQ ID NO: 377574 - DNA, 25 bp, Rattus norvegicus
gcaaggatctgaaacgtgtcaccat

SEQ ID NO: 377575 - DNA, 25 bp, Rattus norvegicus
gcaaggatctgatacgtgtcaccat

SEQ ID NO: 377576 - DNA, 25 bp, Rattus norvegicus
gcaaggatcttgcatagttcctaaa

SEQ ID NO: 377577 - DNA, 25 bp, Rattus norvegicus
gcaaggatcttggatagttcctaaa

SEQ ID NO: 377578 - DNA, 25 bp, Rattus norvegicus
gcaaggatgcttcagtcaccaggga

SEQ ID NO: 377579 - DNA, 25 bp, Rattus norvegicus
gcaaggatgcttgagtcaccaggga

SEQ ID NO: 377580 - DNA, 25 bp, Rattus norvegicus
gcaaggatgggtcaggccgcctgga

SEQ ID NO: 377581 - DNA, 25 bp, Rattus norvegicus
gcaaggatgggtgaggccgcctgga

SEQ ID NO: 377582 - DNA, 25 bp, Rattus norvegicus
gcaaggatgtccacacaggctgaat

SEQ ID NO: 377583 - DNA, 25 bp, Rattus norvegicus
gcaaggatgtcctcacaggctgaat

SEQ ID NO: 377584 - DNA, 25 bp, Rattus norvegicus
gcaaggatgtgacccagtgtgtaat

SEQ ID NO: 377585 - DNA, 25 bp, Rattus norvegicus
gcaaggatgtgagccagtgtgtaat

SEQ ID NO: 377586 - DNA, 25 bp, Rattus norvegicus
gcaaggatttctctgttcattgtgc

SEQ ID NO: 377587 - DNA, 25 bp, Rattus norvegicus
gcaaggatttctgtgttcattgtgc

SEQ ID NO: 377588 - DNA, 25 bp, Rattus norvegicus
gcaaggatttgaaggcagccttccc

SEQ ID NO: 377589 - DNA, 25 bp, Rattus norvegicus
gcaaggatttgatggcagccttccc

SEQ ID NO: 377590 - DNA, 25 bp, Rattus norvegicus
gcaaggattttaatcttcctgtgtc

SEQ ID NO: 377591 - DNA, 25 bp, Rattus norvegicus
gcaaggattttattcttcctgtgtc

SEQ ID NO: 377592 - DNA, 25 bp, Rattus norvegicus
gcaaggcaaccacaaacccaagtgt

SEQ ID NO: 377593 - DNA, 25 bp, Rattus norvegicus
gcaaggcaaccagaaacccaagtgt

SEQ ID NO: 377594 - DNA, 25 bp, Rattus norvegicus
gcaaggcacactcacagcaatgttt

SEQ ID NO: 377595 - DNA, 25 bp, Rattus norvegicus
gcaaggcacactgacagcaatgttt

SEQ ID NO: 377596 - DNA, 25 bp, Rattus norvegicus
gcaaggcacgcacttttgtctgaat

SEQ ID NO: 377597 - DNA, 25 bp, Rattus norvegicus
gcaaggcacgcagttttgtctgaat

SEQ ID NO: 377598 - DNA, 25 bp, Rattus norvegicus
gcaaggcaggacaggcaccctcaaa

SEQ ID NO: 377599 - DNA, 25 bp, Rattus norvegicus
gcaaggcaggactggcaccctcaaa

SEQ ID NO: 377600 - DNA, 25 bp, Rattus norvegicus
gcaaggcaggtgcacttcggaaata

SEQ ID NO: 377601 - DNA, 25 bp, Rattus norvegicus
gcaaggcaggtggacttcggaaata

SEQ ID NO: 377602 - DNA, 25 bp, Rattus norvegicus
gcaaggcatcttactgtgtcactat

SEQ ID NO: 377603 - DNA, 25 bp, Rattus norvegicus
gcaaggcatctttctgtgtcactat

SEQ ID NO: 377604 - DNA, 25 bp, Rattus norvegicus
gcaaggcatgtcctagcgtaggctt

SEQ ID NO: 377605 - DNA, 25 bp, Rattus norvegicus
gcaaggcatgtcgtagcgtaggctt

SEQ ID NO: 377606 - DNA, 25 bp, Rattus norvegicus
gcaaggcatttacagtaactttcca

SEQ ID NO: 377607 - DNA, 25 bp, Rattus norvegicus
gcaaggcatttagagtaactttcca

SEQ ID NO: 377608 - DNA, 25 bp, Rattus norvegicus
gcaaggccaaacatgcccgcatgga

SEQ ID NO: 377609 - DNA, 25 bp, Rattus norvegicus
gcaaggccaaacttgcccgcatgga

SEQ ID NO: 377610 - DNA, 25 bp, Rattus norvegicus
gcaaggccaaagcagcaatccatca

SEQ ID NO: 377611 - DNA, 25 bp, Rattus norvegicus
gcaaggccaaaggagcaatccatca

SEQ ID NO: 377612 - DNA, 25 bp, Rattus norvegicus
gcaaggccaattaggagcctccatt

SEQ ID NO: 377613 - DNA, 25 bp, Rattus norvegicus
gcaaggccaatttggagcctccatt

SEQ ID NO: 377614 - DNA, 25 bp, Rattus norvegicus
gcaaggccatcaacgtgctaggaga

SEQ ID NO: 377615 - DNA, 25 bp, Rattus norvegicus
gcaaggccatcatcgtgctaggaga

SEQ ID NO: 377616 - DNA, 25 bp, Rattus norvegicus
gcaaggcccttgagacttttcattg

SEQ ID NO: 377617 - DNA, 25 bp, Rattus norvegicus
gcaaggcccttgtgacttttcattg

SEQ ID NO: 377618 - DNA, 25 bp, Rattus norvegicus
gcaaggccggcactgaatgcacctg

SEQ ID NO: 377619 - DNA, 25 bp, Rattus norvegicus
gcaaggccggcagtgaatgcacctg

SEQ ID NO: 377620 - DNA, 25 bp, Rattus norvegicus
gcaaggcctaggagtatgtgacatt

SEQ ID NO: 377621 - DNA, 25 bp, Rattus norvegicus
gcaaggcctaggtgtatgtgacatt

SEQ ID NO: 377622 - DNA, 25 bp, Rattus norvegicus
gcaaggcctatacctctgtgggagt

SEQ ID NO: 377623 - DNA, 25 bp, Rattus norvegicus
gcaaggcctatagctctgtgggagt

SEQ ID NO: 377624 - DNA, 25 bp, Rattus norvegicus
gcaaggcctccaaatgggttttcct

SEQ ID NO: 377625 - DNA, 25 bp, Rattus norvegicus
gcaaggcctccatatgggttttcct

SEQ ID NO: 377626 - DNA, 25 bp, Rattus norvegicus
gcaaggccttaactcatccttgagt

SEQ ID NO: 377627 - DNA, 25 bp, Rattus norvegicus
gcaaggccttaagtcatccttgagt

SEQ ID NO: 377628 - DNA, 25 bp, Rattus norvegicus
gcaaggccttcaccgtcaaacacaa

SEQ ID NO: 377629 - DNA, 25 bp, Rattus norvegicus
gcaaggccttcagcgtcaaacacaa

SEQ ID NO: 377630 - DNA, 25 bp, Rattus norvegicus
gcaaggcgcctcactatgaagatga

SEQ ID NO: 377631 - DNA, 25 bp, Rattus norvegicus
gcaaggcgcctctctatgaagatga

SEQ ID NO: 377632 - DNA, 25 bp, Rattus norvegicus
gcaaggcgtcttcagccaaagctga

SEQ ID NO: 377633 - DNA, 25 bp, Rattus norvegicus
gcaaggcgtcttgagccaaagctga

SEQ ID NO: 377634 - DNA, 25 bp, Rattus norvegicus
gcaaggctaacaaataccataaaaa

SEQ ID NO: 377635 - DNA, 25 bp, Rattus norvegicus
gcaaggctaacatataccataaaaa

SEQ ID NO: 377636 - DNA, 25 bp, Rattus norvegicus
gcaaggctaatgacactcggtacat

SEQ ID NO: 377637 - DNA, 25 bp, Rattus norvegicus
gcaaggctaatgtcactcggtacat

SEQ ID NO: 377638 - DNA, 25 bp, Rattus norvegicus
gcaaggctcaggacttcgtctatca

SEQ ID NO: 377639 - DNA, 25 bp, Rattus norvegicus
gcaaggctcaggtcttcgtctatca

SEQ ID NO: 377640 - DNA, 25 bp, Rattus norvegicus
gcaaggctctgcagctgcaagctga

SEQ ID NO: 377641 - DNA, 25 bp, Rattus norvegicus
gcaaggctctgctgctgcaagctga

SEQ ID NO: 377642 - DNA, 25 bp, Rattus norvegicus
gcaaggctgaaactattcccacaca

SEQ ID NO: 377643 - DNA, 25 bp, Rattus norvegicus
gcaaggctgaaagtattcccacaca

SEQ ID NO: 377644 - DNA, 25 bp, Rattus norvegicus
gcaaggctgacacaaggatgctcct

SEQ ID NO: 377645 - DNA, 25 bp, Rattus norvegicus
gcaaggctgacagaaggatgctcct

SEQ ID NO: 377646 - DNA, 25 bp, Rattus norvegicus
gcaaggctgatcagtctggcatgtc

SEQ ID NO: 377647 - DNA, 25 bp, Rattus norvegicus
gcaaggctgatctgtctggcatgtc

SEQ ID NO: 377648 - DNA, 25 bp, Rattus norvegicus
gcaaggctgatgcatgatctggacc

SEQ ID NO: 377649 - DNA, 25 bp, Rattus norvegicus
gcaaggctgatggatgatctggacc

SEQ ID NO: 377650 - DNA, 25 bp, Rattus norvegicus
gcaaggcttaggagggctgacaccc

SEQ ID NO: 377651 - DNA, 25 bp, Rattus norvegicus
gcaaggcttaggtgggctgacaccc

SEQ ID NO: 377652 - DNA, 25 bp, Rattus norvegicus
gcaaggcttatacccctagaaggaa

SEQ ID NO: 377653 - DNA, 25 bp, Rattus norvegicus
gcaaggcttatagccctagaaggaa

SEQ ID NO: 377654 - DNA, 25 bp, Rattus norvegicus
gcaaggcttcatctttagtcgacag

SEQ ID NO: 377655 - DNA, 25 bp, Rattus norvegicus
gcaaggcttcatgtttagtcgacag

SEQ ID NO: 377656 - DNA, 25 bp, Rattus norvegicus
gcaaggcttctgactaacctgaatt

SEQ ID NO: 377657 - DNA, 25 bp, Rattus norvegicus
gcaaggcttctgtctaacctgaatt

SEQ ID NO: 377658 - DNA, 25 bp, Rattus norvegicus
gcaaggctttatcaatgttactgaa

SEQ ID NO: 377659 - DNA, 25 bp, Rattus norvegicus
gcaaggctttatgaatgttactgaa

SEQ ID NO: 377660 - DNA, 25 bp, Rattus norvegicus
gcaaggctttgtctaactgtacggt

SEQ ID NO: 377661 - DNA, 25 bp, Rattus norvegicus
gcaaggctttgtgtaactgtacggt

SEQ ID NO: 377662 - DNA, 25 bp, Rattus norvegicus
gcaaggcttttgcaggacccgatac

SEQ ID NO: 377663 - DNA, 25 bp, Rattus norvegicus
gcaaggcttttggaggacccgatac

SEQ ID NO: 377664 - DNA, 25 bp, Rattus norvegicus
gcaagggaacagactttatcacata

SEQ ID NO: 377665 - DNA, 25 bp, Rattus norvegicus
gcaagggaacagtctttatcacata

SEQ ID NO: 377666 - DNA, 25 bp, Rattus norvegicus
gcaagggaacctattcaccagcaag

SEQ ID NO: 377667 - DNA, 25 bp, Rattus norvegicus
gcaagggaacctcatttggctgaac

SEQ ID NO: 377668 - DNA, 25 bp, Rattus norvegicus
gcaagggaacctgatttggctgaac

SEQ ID NO: 377669 - DNA, 25 bp, Rattus norvegicus
gcaagggaaccttttcaccagcaag

SEQ ID NO: 377670 - DNA, 25 bp, Rattus norvegicus
gcaagggacataccccagaggtcac

SEQ ID NO: 377671 - DNA, 25 bp, Rattus norvegicus
gcaagggacatagcccagaggtcac

SEQ ID NO: 377672 - DNA, 25 bp, Rattus norvegicus
gcaagggaccacacatgccaagtga

SEQ ID NO: 377673 - DNA, 25 bp, Rattus norvegicus
gcaagggaccactcatgccaagtga

SEQ ID NO: 377674 - DNA, 25 bp, Rattus norvegicus
gcaagggaccagactttagcagtct

SEQ ID NO: 377675 - DNA, 25 bp, Rattus norvegicus
gcaagggaccagtctttagcagtct

SEQ ID NO: 377676 - DNA, 25 bp, Rattus norvegicus
gcaagggaccatctctgacggacta

SEQ ID NO: 377677 - DNA, 25 bp, Rattus norvegicus
gcaagggaccatgtctgacggacta

SEQ ID NO: 377678 - DNA, 25 bp, Rattus norvegicus
gcaagggaccccaaatgtacagtga

SEQ ID NO: 377679 - DNA, 25 bp, Rattus norvegicus
gcaagggacccctaatgtacagtga

SEQ ID NO: 377680 - DNA, 25 bp, Rattus norvegicus
gcaagggactctcaaactgaaaaag

SEQ ID NO: 377681 - DNA, 25 bp, Rattus norvegicus
gcaagggactctgaaactgaaaaag

SEQ ID NO: 377682 - DNA, 25 bp, Rattus norvegicus
gcaagggatgaaccttggccccaaa

SEQ ID NO: 377683 - DNA, 25 bp, Rattus norvegicus
gcaagggatgaagcttggccccaaa

SEQ ID NO: 377684 - DNA, 25 bp, Rattus norvegicus
gcaagggattctacctttgagagaa

SEQ ID NO: 377685 - DNA, 25 bp, Rattus norvegicus
gcaagggattctcgcactaggttga

SEQ ID NO: 377686 - DNA, 25 bp, Rattus norvegicus
gcaagggattctggcactaggttga

SEQ ID NO: 377687 - DNA, 25 bp, Rattus norvegicus
gcaagggattcttcctttgagagaa

SEQ ID NO: 377688 - DNA, 25 bp, Rattus norvegicus
gcaagggcacgcagagacgccatga

SEQ ID NO: 377689 - DNA, 25 bp, Rattus norvegicus
gcaagggcacgctgagacgccatga

SEQ ID NO: 377690 - DNA, 25 bp, Rattus norvegicus
gcaagggccactactggaccatcga

SEQ ID NO: 377691 - DNA, 25 bp, Rattus norvegicus
gcaagggccacttctggaccatcga

SEQ ID NO: 377692 - DNA, 25 bp, Rattus norvegicus
gcaagggccagtcccctgagcctgt

SEQ ID NO: 377693 - DNA, 25 bp, Rattus norvegicus
gcaagggccagtgccctgagcctgt

SEQ ID NO: 377694 - DNA, 25 bp, Rattus norvegicus
gcaagggcccttatcagtgacagaa

SEQ ID NO: 377695 - DNA, 25 bp, Rattus norvegicus
gcaagggcccttttcagtgacagaa

SEQ ID NO: 377696 - DNA, 25 bp, Rattus norvegicus
gcaagggccttgaggtccagtaaga

SEQ ID NO: 377697 - DNA, 25 bp, Rattus norvegicus
gcaagggccttgtggtccagtaaga

SEQ ID NO: 377698 - DNA, 25 bp, Rattus norvegicus
gcaagggcgataactgttctcataa

SEQ ID NO: 377699 - DNA, 25 bp, Rattus norvegicus
gcaagggcgatatctgttctcataa

SEQ ID NO: 377700 - DNA, 25 bp, Rattus norvegicus
gcaagggctctgattttataagaat

SEQ ID NO: 377701 - DNA, 25 bp, Rattus norvegicus
gcaagggctctgtttttataagaat

SEQ ID NO: 377702 - DNA, 25 bp, Rattus norvegicus
gcaagggctgacatgaggccccaaa

SEQ ID NO: 377703 - DNA, 25 bp, Rattus norvegicus
gcaagggctgacttgaggccccaaa

SEQ ID NO: 377704 - DNA, 25 bp, Rattus norvegicus
gcaagggcttctacagacgcagcat

SEQ ID NO: 377705 - DNA, 25 bp, Rattus norvegicus
gcaagggcttctatcagatactctc

SEQ ID NO: 377706 - DNA, 25 bp, Rattus norvegicus
gcaagggcttcttcagacgcagcat

SEQ ID NO: 377707 - DNA, 25 bp, Rattus norvegicus
gcaagggcttctttcagatactctc

SEQ ID NO: 377708 - DNA, 25 bp, Rattus norvegicus
gcaagggctttaactaagtgatcgc

SEQ ID NO: 377709 - DNA, 25 bp, Rattus norvegicus
gcaagggctttatctaagtgatcgc

SEQ ID NO: 377710 - DNA, 25 bp, Rattus norvegicus
gcaagggcttttatcagcaacgcca

SEQ ID NO: 377711 - DNA, 25 bp, Rattus norvegicus
gcaagggcttttttcagcaacgcca

SEQ ID NO: 377712 - DNA, 25 bp, Rattus norvegicus
gcaagggtaactactggaccctgga

SEQ ID NO: 377713 - DNA, 25 bp, Rattus norvegicus
gcaagggtaacttctggaccctgga

SEQ ID NO: 377714 - DNA, 25 bp, Rattus norvegicus
gcaagggtacccacatttttatgag

SEQ ID NO: 377715 - DNA, 25 bp, Rattus norvegicus
gcaagggtaccctcatttttatgag

SEQ ID NO: 377716 - DNA, 25 bp, Rattus norvegicus
gcaagggtatagctggaccgcccac

SEQ ID NO: 377717 - DNA, 25 bp, Rattus norvegicus
gcaagggtataggtggaccgcccac

SEQ ID NO: 377718 - DNA, 25 bp, Rattus norvegicus
gcaagggtcatactcaccatttaat

SEQ ID NO: 377719 - DNA, 25 bp, Rattus norvegicus
gcaagggtcatagtcaccatttaat

SEQ ID NO: 377720 - DNA, 25 bp, Rattus norvegicus
gcaagggtccgaattgccatcgaaa

SEQ ID NO: 377721 - DNA, 25 bp, Rattus norvegicus
gcaagggtccgatttgccatcgaaa

SEQ ID NO: 377722 - DNA, 25 bp, Rattus norvegicus
gcaagggtccttaacaatctccaaa

SEQ ID NO: 377723 - DNA, 25 bp, Rattus norvegicus
gcaagggtcctttacaatctccaaa

SEQ ID NO: 377724 - DNA, 25 bp, Rattus norvegicus
gcaagggtgacgacaggccttcaat

SEQ ID NO: 377725 - DNA, 25 bp, Rattus norvegicus
gcaagggtgacgtcaggccttcaat

SEQ ID NO: 377726 - DNA, 25 bp, Rattus norvegicus
gcaagggtgctgaagtcaaccagaa

SEQ ID NO: 377727 - DNA, 25 bp, Rattus norvegicus
gcaagggtgctgtagtcaaccagaa

SEQ ID NO: 377728 - DNA, 25 bp, Rattus norvegicus
gcaagggtgcttcctttggaaacat

SEQ ID NO: 377729 - DNA, 25 bp, Rattus norvegicus
gcaagggtgcttgctttggaaacat

SEQ ID NO: 377730 - DNA, 25 bp, Rattus norvegicus
gcaagggtgggtattctattctgta

SEQ ID NO: 377731 - DNA, 25 bp, Rattus norvegicus
gcaagggtgggttttctattctgta

SEQ ID NO: 377732 - DNA, 25 bp, Rattus norvegicus
gcaagggtgtacacaggatttcttt

SEQ ID NO: 377733 - DNA, 25 bp, Rattus norvegicus
gcaagggtgtactcaggatttcttt

SEQ ID NO: 377734 - DNA, 25 bp, Rattus norvegicus
gcaagggtgtcaatgacctggcaga

SEQ ID NO: 377735 - DNA, 25 bp, Rattus norvegicus
gcaagggtgtcattgacctggcaga

SEQ ID NO: 377736 - DNA, 25 bp, Rattus norvegicus
gcaagggttactccttttactttct

SEQ ID NO: 377737 - DNA, 25 bp, Rattus norvegicus
gcaagggttactgcttttactttct

SEQ ID NO: 377738 - DNA, 25 bp, Rattus norvegicus
gcaagggttatcactacataggttt

SEQ ID NO: 377739 - DNA, 25 bp, Rattus norvegicus
gcaagggttatctctacataggttt

SEQ ID NO: 377740 - DNA, 25 bp, Rattus norvegicus
gcaagggttatgacacatcctctat

SEQ ID NO: 377741 - DNA, 25 bp, Rattus norvegicus
gcaagggttatgtcacatcctctat

SEQ ID NO: 377742 - DNA, 25 bp, Rattus norvegicus
gcaagggttcaccatcattcctgaa

SEQ ID NO: 377743 - DNA, 25 bp, Rattus norvegicus
gcaagggttcacgatcattcctgaa

SEQ ID NO: 377744 - DNA, 25 bp, Rattus norvegicus
gcaagggttccaagacgcgccagca

SEQ ID NO: 377745 - DNA, 25 bp, Rattus norvegicus
gcaagggttccatgacgcgccagca

SEQ ID NO: 377746 - DNA, 25 bp, Rattus norvegicus
gcaaggtaataacactttggccctt

SEQ ID NO: 377747 - DNA, 25 bp, Rattus norvegicus
gcaaggtaataagactttggccctt

SEQ ID NO: 377748 - DNA, 25 bp, Rattus norvegicus
gcaaggtacaccctactttgaattt

SEQ ID NO: 377749 - DNA, 25 bp, Rattus norvegicus
gcaaggtacaccgtactttgaattt

SEQ ID NO: 377750 - DNA, 25 bp, Rattus norvegicus
gcaaggtaccccactgaggtgtgtg

SEQ ID NO: 377751 - DNA, 25 bp, Rattus norvegicus
gcaaggtacccctctgaggtgtgtg

SEQ ID NO: 377752 - DNA, 25 bp, Rattus norvegicus
gcaaggtacgccagggactgttcct

SEQ ID NO: 377753 - DNA, 25 bp, Rattus norvegicus
gcaaggtacgcctgggactgttcct

SEQ ID NO: 377754 - DNA, 25 bp, Rattus norvegicus
gcaaggtactgcaggtactagacaa

SEQ ID NO: 377755 - DNA, 25 bp, Rattus norvegicus
gcaaggtactgctggtactagacaa

SEQ ID NO: 377756 - DNA, 25 bp, Rattus norvegicus
gcaaggtcaagcatcaagctggtct

SEQ ID NO: 377757 - DNA, 25 bp, Rattus norvegicus
gcaaggtcaagcttcaagctggtct

SEQ ID NO: 377758 - DNA, 25 bp, Rattus norvegicus
gcaaggtcaatgctgaaggctcagt

SEQ ID NO: 377759 - DNA, 25 bp, Rattus norvegicus
gcaaggtcaatggtgaaggctcagt

SEQ ID NO: 377760 - DNA, 25 bp, Rattus norvegicus
gcaaggtcacctactaatgtactga

SEQ ID NO: 377761 - DNA, 25 bp, Rattus norvegicus
gcaaggtcaccttctaatgtactga

SEQ ID NO: 377762 - DNA, 25 bp, Rattus norvegicus
gcaaggtcagtaatgcctgcaaaat

SEQ ID NO: 377763 - DNA, 25 bp, Rattus norvegicus
gcaaggtcagtattgcctgcaaaat

SEQ ID NO: 377764 - DNA, 25 bp, Rattus norvegicus
gcaaggtcgtgtcctctgaagtcaa

SEQ ID NO: 377765 - DNA, 25 bp, Rattus norvegicus
gcaaggtcgtgtgctctgaagtcaa

SEQ ID NO: 377766 - DNA, 25 bp, Rattus norvegicus
gcaaggtctccacgcaaaagatgac

SEQ ID NO: 377767 - DNA, 25 bp, Rattus norvegicus
gcaaggtctccaggcaaaagatgac

SEQ ID NO: 377768 - DNA, 25 bp, Rattus norvegicus
gcaaggtctctcaggtagcctcaga

SEQ ID NO: 377769 - DNA, 25 bp, Rattus norvegicus
gcaaggtctctctggtagcctcaga

SEQ ID NO: 377770 - DNA, 25 bp, Rattus norvegicus
gcaaggtctggcctacacatcagag

SEQ ID NO: 377771 - DNA, 25 bp, Rattus norvegicus
gcaaggtctggcgtacacatcagag

SEQ ID NO: 377772 - DNA, 25 bp, Rattus norvegicus
gcaaggtcttatccacagcgtttga

SEQ ID NO: 377773 - DNA, 25 bp, Rattus norvegicus
gcaaggtcttatctaccccatgtag

SEQ ID NO: 377774 - DNA, 25 bp, Rattus norvegicus
gcaaggtcttatgcacagcgtttga

SEQ ID NO: 377775 - DNA, 25 bp, Rattus norvegicus
gcaaggtcttatgtaccccatgtag

SEQ ID NO: 377776 - DNA, 25 bp, Rattus norvegicus
gcaaggtgacatcgacaaccatgta

SEQ ID NO: 377777 - DNA, 25 bp, Rattus norvegicus
gcaaggtgacatggacaaccatgta

SEQ ID NO: 377778 - DNA, 25 bp, Rattus norvegicus
gcaaggtgcagcagattgccctctg

SEQ ID NO: 377779 - DNA, 25 bp, Rattus norvegicus
gcaaggtgcagctgattgccctctg

SEQ ID NO: 377780 - DNA, 25 bp, Rattus norvegicus
gcaaggtgccctccaactggaagaa

SEQ ID NO: 377781 - DNA, 25 bp, Rattus norvegicus
gcaaggtgccctgcaactggaagaa

SEQ ID NO: 377782 - DNA, 25 bp, Rattus norvegicus
gcaaggtgccttcatactctgtaaa

SEQ ID NO: 377783 - DNA, 25 bp, Rattus norvegicus
gcaaggtgccttgatactctgtaaa

SEQ ID NO: 377784 - DNA, 25 bp, Rattus norvegicus
gcaaggtgctggatctcctgacgca

SEQ ID NO: 377785 - DNA, 25 bp, Rattus norvegicus
gcaaggtgctggttctcctgacgca

SEQ ID NO: 377786 - DNA, 25 bp, Rattus norvegicus
gcaaggtggcacagatactgctcaa

SEQ ID NO: 377787 - DNA, 25 bp, Rattus norvegicus
gcaaggtggcactgatactgctcaa

SEQ ID NO: 377788 - DNA, 25 bp, Rattus norvegicus
gcaaggtggcagagcttcaactgaa

SEQ ID NO: 377789 - DNA, 25 bp, Rattus norvegicus
gcaaggtggcagtgcttcaactgaa

SEQ ID NO: 377790 - DNA, 25 bp, Rattus norvegicus
gcaaggtgggtgaccagatcctgct

SEQ ID NO: 377791 - DNA, 25 bp, Rattus norvegicus
gcaaggtgggtgtccagatcctgct

SEQ ID NO: 377792 - DNA, 25 bp, Rattus norvegicus
gcaaggtgttcactacccagttcct

SEQ ID NO: 377793 - DNA, 25 bp, Rattus norvegicus
gcaaggtgttcagtacccagttcct

SEQ ID NO: 377794 - DNA, 25 bp, Rattus norvegicus
gcaaggtgttccagccagtgttaaa

SEQ ID NO: 377795 - DNA, 25 bp, Rattus norvegicus
gcaaggtgttcctgccagtgttaaa

SEQ ID NO: 377796 - DNA, 25 bp, Rattus norvegicus
gcaaggtgtttacagctccacgtgt

SEQ ID NO: 377797 - DNA, 25 bp, Rattus norvegicus
gcaaggtgtttagagctccacgtgt

SEQ ID NO: 377798 - DNA, 25 bp, Rattus norvegicus
gcaaggttatgaacccgaagagcca

SEQ ID NO: 377799 - DNA, 25 bp, Rattus norvegicus
gcaaggttatgatcccgaagagcca

SEQ ID NO: 377800 - DNA, 25 bp, Rattus norvegicus
gcaaggttcacacaatcactcggaa

SEQ ID NO: 377801 - DNA, 25 bp, Rattus norvegicus
gcaaggttcacagaatcactcggaa

SEQ ID NO: 377802 - DNA, 25 bp, Rattus norvegicus
gcaaggttccacagagtaagacatt

SEQ ID NO: 377803 - DNA, 25 bp, Rattus norvegicus
gcaaggttccactgagtaagacatt

SEQ ID NO: 377804 - DNA, 25 bp, Rattus norvegicus
gcaaggttcgatcctctgttatcac

SEQ ID NO: 377805 - DNA, 25 bp, Rattus norvegicus
gcaaggttcgatgctctgttatcac

SEQ ID NO: 377806 - DNA, 25 bp, Rattus norvegicus
gcaaggttcggtatttatgtctcct

SEQ ID NO: 377807 - DNA, 25 bp, Rattus norvegicus
gcaaggttcggtttttatgtctcct

SEQ ID NO: 377808 - DNA, 25 bp, Rattus norvegicus
gcaaggttctccaaagtgagccaca

SEQ ID NO: 377809 - DNA, 25 bp, Rattus norvegicus
gcaaggttctcctaagtgagccaca

SEQ ID NO: 377810 - DNA, 25 bp, Rattus norvegicus
gcaaggttctttcttcctatatgta

SEQ ID NO: 377811 - DNA, 25 bp, Rattus norvegicus
gcaaggttctttgttcctatatgta

SEQ ID NO: 377812 - DNA, 25 bp, Rattus norvegicus
gcaaggtttgcaattaatccccagc

SEQ ID NO: 377813 - DNA, 25 bp, Rattus norvegicus
gcaaggtttgcatttaatccccagc

SEQ ID NO: 377814 - DNA, 25 bp, Rattus norvegicus
gcaaggttttccaaagaccaggtct

SEQ ID NO: 377815 - DNA, 25 bp, Rattus norvegicus
gcaaggttttcctaagaccaggtct

SEQ ID NO: 377816 - DNA, 25 bp, Rattus norvegicus
gcaaggttttcgcacgttcagagaa

SEQ ID NO: 377817 - DNA, 25 bp, Rattus norvegicus
gcaaggttttcggacgttcagagaa

SEQ ID NO: 377818 - DNA, 25 bp, Rattus norvegicus
gcaaggttttctaaagcagcttcag

SEQ ID NO: 377819 - DNA, 25 bp, Rattus norvegicus
gcaaggttttcttaagcagcttcag

SEQ ID NO: 377820 - DNA, 25 bp, Rattus norvegicus
gcaagtaaatttctgggcgtatcca

SEQ ID NO: 377821 - DNA, 25 bp, Rattus norvegicus
gcaagtaaatttgtgggcgtatcca

SEQ ID NO: 377822 - DNA, 25 bp, Rattus norvegicus
gcaagtaatcacattcttccacata

SEQ ID NO: 377823 - DNA, 25 bp, Rattus norvegicus
gcaagtaatcactttcttccacata

SEQ ID NO: 377824 - DNA, 25 bp, Rattus norvegicus
gcaagtacaccaaagctacagatgt

SEQ ID NO: 377825 - DNA, 25 bp, Rattus norvegicus
gcaagtacaccatagctacagatgt

SEQ ID NO: 377826 - DNA, 25 bp, Rattus norvegicus
gcaagtacacgccttcatagatttt

SEQ ID NO: 377827 - DNA, 25 bp, Rattus norvegicus
gcaagtacacgcgttcatagatttt

SEQ ID NO: 377828 - DNA, 25 bp, Rattus norvegicus
gcaagtacacttcacagagaggtca

SEQ ID NO: 377829 - DNA, 25 bp, Rattus norvegicus
gcaagtacacttgacagagaggtca

SEQ ID NO: 377830 - DNA, 25 bp, Rattus norvegicus
gcaagtacatcactttctctggctt

SEQ ID NO: 377831 - DNA, 25 bp, Rattus norvegicus
gcaagtacatcagtttctctggctt

SEQ ID NO: 377832 - DNA, 25 bp, Rattus norvegicus
gcaagtacctggaaaaactctccgg

SEQ ID NO: 377833 - DNA, 25 bp, Rattus norvegicus
gcaagtacctggtaaaactctccgg

SEQ ID NO: 377834 - DNA, 25 bp, Rattus norvegicus
gcaagtacggcgagaagtgccagtt

SEQ ID NO: 377835 - DNA, 25 bp, Rattus norvegicus
gcaagtacggcgtgaagtgccagtt

SEQ ID NO: 377836 - DNA, 25 bp, Rattus norvegicus
gcaagtactccaaacggctgaaccc

SEQ ID NO: 377837 - DNA, 25 bp, Rattus norvegicus
gcaagtactccatacggctgaaccc

SEQ ID NO: 377838 - DNA, 25 bp, Rattus norvegicus
gcaagtacttaacccacagagccat

SEQ ID NO: 377839 - DNA, 25 bp, Rattus norvegicus
gcaagtacttaagccacagagccat

SEQ ID NO: 377840 - DNA, 25 bp, Rattus norvegicus
gcaagtacttctatgtatcagcaat

SEQ ID NO: 377841 - DNA, 25 bp, Rattus norvegicus
gcaagtacttctttgtatcagcaat

SEQ ID NO: 377842 - DNA, 25 bp, Rattus norvegicus
gcaagtagagtgctggttccagttt

SEQ ID NO: 377843 - DNA, 25 bp, Rattus norvegicus
gcaagtagagtggtggttccagttt

SEQ ID NO: 377844 - DNA, 25 bp, Rattus norvegicus
gcaagtagcaggatctaggccagcc

SEQ ID NO: 377845 - DNA, 25 bp, Rattus norvegicus
gcaagtagcaggttctaggccagcc

SEQ ID NO: 377846 - DNA, 25 bp, Rattus norvegicus
gcaagtagcccgagcctgaccggag

SEQ ID NO: 377847 - DNA, 25 bp, Rattus norvegicus
gcaagtagcccgtgcctgaccggag

SEQ ID NO: 377848 - DNA, 25 bp, Rattus norvegicus
gcaagtagcttcacttctgtgaagt

SEQ ID NO: 377849 - DNA, 25 bp, Rattus norvegicus
gcaagtagcttctcttctgtgaagt

SEQ ID NO: 377850 - DNA, 25 bp, Rattus norvegicus
gcaagtaggagactcgccaaatcag

SEQ ID NO: 377851 - DNA, 25 bp, Rattus norvegicus
gcaagtaggagagtcgccaaatcag

SEQ ID NO: 377852 - DNA, 25 bp, Rattus norvegicus
gcaagtaggtctcagtgatcccact

SEQ ID NO: 377853 - DNA, 25 bp, Rattus norvegicus
gcaagtaggtctgagtgatcccact

SEQ ID NO: 377854 - DNA, 25 bp, Rattus norvegicus
gcaagtataatgctgcatgcctgta

SEQ ID NO: 377855 - DNA, 25 bp, Rattus norvegicus
gcaagtataatggtgcatgcctgta

SEQ ID NO: 377856 - DNA, 25 bp, Rattus norvegicus
gcaagtatatctcagtaactgccat

SEQ ID NO: 377857 - DNA, 25 bp, Rattus norvegicus
gcaagtatatctgagtaactgccat

SEQ ID NO: 377858 - DNA, 25 bp, Rattus norvegicus
gcaagtatcgagagttctgtatgtt

SEQ ID NO: 377859 - DNA, 25 bp, Rattus norvegicus
gcaagtatcgagtgttctgtatgtt

SEQ ID NO: 377860 - DNA, 25 bp, Rattus norvegicus
gcaagtatgactccggccacgtgca

SEQ ID NO: 377861 - DNA, 25 bp, Rattus norvegicus
gcaagtatgactgcggccacgtgca

SEQ ID NO: 377862 - DNA, 25 bp, Rattus norvegicus
gcaagtatgtacaggagcggctgca

SEQ ID NO: 377863 - DNA, 25 bp, Rattus norvegicus
gcaagtatgtactggagcggctgca

SEQ ID NO: 377864 - DNA, 25 bp, Rattus norvegicus
gcaagtatgtgaaccaatttttcct

SEQ ID NO: 377865 - DNA, 25 bp, Rattus norvegicus
gcaagtatgtgaactcagtgctttt

SEQ ID NO: 377866 - DNA, 25 bp, Rattus norvegicus
gcaagtatgtgatccaatttttcct

SEQ ID NO: 377867 - DNA, 25 bp, Rattus norvegicus
gcaagtatgtgatctcagtgctttt

SEQ ID NO: 377868 - DNA, 25 bp, Rattus norvegicus
gcaagtattctaaccctgagctata

SEQ ID NO: 377869 - DNA, 25 bp, Rattus norvegicus
gcaagtattctatccctgagctata

SEQ ID NO: 377870 - DNA, 25 bp, Rattus norvegicus
gcaagtatttaacccaaagtcccag

SEQ ID NO: 377871 - DNA, 25 bp, Rattus norvegicus
gcaagtatttaagccaaagtcccag

SEQ ID NO: 377872 - DNA, 25 bp, Rattus norvegicus
gcaagtatttctatggatccccaga

SEQ ID NO: 377873 - DNA, 25 bp, Rattus norvegicus
gcaagtatttctttggatccccaga

SEQ ID NO: 377874 - DNA, 25 bp, Rattus norvegicus
gcaagtcaaacgatgatttacagga

SEQ ID NO: 377875 - DNA, 25 bp, Rattus norvegicus
gcaagtcaaacgttgatttacagga

SEQ ID NO: 377876 - DNA, 25 bp, Rattus norvegicus
gcaagtcaactgcagaatgtcttct

SEQ ID NO: 377877 - DNA, 25 bp, Rattus norvegicus
gcaagtcaactggagaatgtcttct

SEQ ID NO: 377878 - DNA, 25 bp, Rattus norvegicus
gcaagtcaataaactgcgggctaaa

SEQ ID NO: 377879 - DNA, 25 bp, Rattus norvegicus
gcaagtcaataatctgcgggctaaa

SEQ ID NO: 377880 - DNA, 25 bp, Rattus norvegicus
gcaagtcacagcaccatcttagtag

SEQ ID NO: 377881 - DNA, 25 bp, Rattus norvegicus
gcaagtcacagctccatcttagtag

SEQ ID NO: 377882 - DNA, 25 bp, Rattus norvegicus
gcaagtcacattatctatggaccgt

SEQ ID NO: 377883 - DNA, 25 bp, Rattus norvegicus
gcaagtcacattttctatggaccgt

SEQ ID NO: 377884 - DNA, 25 bp, Rattus norvegicus
gcaagtcactgccttatcgggaaga

SEQ ID NO: 377885 - DNA, 25 bp, Rattus norvegicus
gcaagtcactgcgttatcgggaaga

SEQ ID NO: 377886 - DNA, 25 bp, Rattus norvegicus
gcaagtcatccccatagtcacagat

SEQ ID NO: 377887 - DNA, 25 bp, Rattus norvegicus
gcaagtcatcccgatagtcacagat

SEQ ID NO: 377888 - DNA, 25 bp, Rattus norvegicus
gcaagtcatgtacctctcttaatac

SEQ ID NO: 377889 - DNA, 25 bp, Rattus norvegicus
gcaagtcatgtagctctcttaatac

SEQ ID NO: 377890 - DNA, 25 bp, Rattus norvegicus
gcaagtccatctcccttttttaaag

SEQ ID NO: 377891 - DNA, 25 bp, Rattus norvegicus
gcaagtccatctgccttttttaaag

SEQ ID NO: 377892 - DNA, 25 bp, Rattus norvegicus
gcaagtcccctcctgaggagaaact

SEQ ID NO: 377893 - DNA, 25 bp, Rattus norvegicus
gcaagtcccctcgtgaggagaaact

SEQ ID NO: 377894 - DNA, 25 bp, Rattus norvegicus
gcaagtcctgtcagcactgagcgaa

SEQ ID NO: 377895 - DNA, 25 bp, Rattus norvegicus
gcaagtcctgtctgcactgagcgaa

SEQ ID NO: 377896 - DNA, 25 bp, Rattus norvegicus
gcaagtctaaagctccctttgtagg

SEQ ID NO: 377897 - DNA, 25 bp, Rattus norvegicus
gcaagtctaaaggtccctttgtagg

SEQ ID NO: 377898 - DNA, 25 bp, Rattus norvegicus
gcaagtctattgacagctctgtcgt

SEQ ID NO: 377899 - DNA, 25 bp, Rattus norvegicus
gcaagtctattgtcagctctgtcgt

SEQ ID NO: 377900 - DNA, 25 bp, Rattus norvegicus
gcaagtctccagctgactcaggtaa

SEQ ID NO: 377901 - DNA, 25 bp, Rattus norvegicus
gcaagtctccaggtgactcaggtaa

SEQ ID NO: 377902 - DNA, 25 bp, Rattus norvegicus
gcaagtctctacctctggcggatga

SEQ ID NO: 377903 - DNA, 25 bp, Rattus norvegicus
gcaagtctctacgtctggcggatga

SEQ ID NO: 377904 - DNA, 25 bp, Rattus norvegicus
gcaagtctctgcactcgtaaatttt

SEQ ID NO: 377905 - DNA, 25 bp, Rattus norvegicus
gcaagtctctgctctcgtaaatttt

SEQ ID NO: 377906 - DNA, 25 bp, Rattus norvegicus
gcaagtctcttaacctagctgagcc

SEQ ID NO: 377907 - DNA, 25 bp, Rattus norvegicus
gcaagtctcttatcctagctgagcc

SEQ ID NO: 377908 - DNA, 25 bp, Rattus norvegicus
gcaagtctgcagaatctccgactag

SEQ ID NO: 377909 - DNA, 25 bp, Rattus norvegicus
gcaagtctgcagtatctccgactag

SEQ ID NO: 377910 - DNA, 25 bp, Rattus norvegicus
gcaagtctgctcacaagtactggtt

SEQ ID NO: 377911 - DNA, 25 bp, Rattus norvegicus
gcaagtctgctctcaagtactggtt

SEQ ID NO: 377912 - DNA, 25 bp, Rattus norvegicus
gcaagtctgggcaacctatatatac

SEQ ID NO: 377913 - DNA, 25 bp, Rattus norvegicus
gcaagtctgggctacctatatatac

SEQ ID NO: 377914 - DNA, 25 bp, Rattus norvegicus
gcaagtctgtttcctatactcatta

SEQ ID NO: 377915 - DNA, 25 bp, Rattus norvegicus
gcaagtctgtttgctatactcatta

SEQ ID NO: 377916 - DNA, 25 bp, Rattus norvegicus
gcaagtcttagcatatgctcccttt

SEQ ID NO: 377917 - DNA, 25 bp, Rattus norvegicus
gcaagtcttagcttatgctcccttt

SEQ ID NO: 377918 - DNA, 25 bp, Rattus norvegicus
gcaagtcttagtagcctaggtcaag

SEQ ID NO: 377919 - DNA, 25 bp, Rattus norvegicus
gcaagtcttagttgcctaggtcaag

SEQ ID NO: 377920 - DNA, 25 bp, Rattus norvegicus
gcaagtcttggtagcctaggtcaac

SEQ ID NO: 377921 - DNA, 25 bp, Rattus norvegicus
gcaagtcttggttgcctaggtcaac

SEQ ID NO: 377922 - DNA, 25 bp, Rattus norvegicus
gcaagtctttgcacatcttcaattg

SEQ ID NO: 377923 - DNA, 25 bp, Rattus norvegicus
gcaagtctttgctcatcttcaattg

SEQ ID NO: 377924 - DNA, 25 bp, Rattus norvegicus
gcaagtgaactcaaccggtgctgag

SEQ ID NO: 377925 - DNA, 25 bp, Rattus norvegicus
gcaagtgaactctaccggtgctgag

SEQ ID NO: 377926 - DNA, 25 bp, Rattus norvegicus
gcaagtgaactgctctcatcttcca

SEQ ID NO: 377927 - DNA, 25 bp, Rattus norvegicus
gcaagtgaactggtctcatcttcca

SEQ ID NO: 377928 - DNA, 25 bp, Rattus norvegicus
gcaagtgacaatcagaggtgactct

SEQ ID NO: 377929 - DNA, 25 bp, Rattus norvegicus
gcaagtgacaatgagaggtgactct

SEQ ID NO: 377930 - DNA, 25 bp, Rattus norvegicus
gcaagtgacagacgtgactgccacc

SEQ ID NO: 377931 - DNA, 25 bp, Rattus norvegicus
gcaagtgacagaggtgactgccacc

SEQ ID NO: 377932 - DNA, 25 bp, Rattus norvegicus
gcaagtgacatgcaccccggcctta

SEQ ID NO: 377933 - DNA, 25 bp, Rattus norvegicus
gcaagtgacatggaccccggcctta

SEQ ID NO: 377934 - DNA, 25 bp, Rattus norvegicus
gcaagtgacattaggttgtttggtt

SEQ ID NO: 377935 - DNA, 25 bp, Rattus norvegicus
gcaagtgacatttggttgtttggtt

SEQ ID NO: 377936 - DNA, 25 bp, Rattus norvegicus
gcaagtgacgggagctctgttccat

SEQ ID NO: 377937 - DNA, 25 bp, Rattus norvegicus
gcaagtgacgggtgctctgttccat

SEQ ID NO: 377938 - DNA, 25 bp, Rattus norvegicus
gcaagtgaggacatcagcactcatc

SEQ ID NO: 377939 - DNA, 25 bp, Rattus norvegicus
gcaagtgaggacttcagcactcatc

SEQ ID NO: 377940 - DNA, 25 bp, Rattus norvegicus
gcaagtgaggctcccctgagaaatc

SEQ ID NO: 377941 - DNA, 25 bp, Rattus norvegicus
gcaagtgaggctgccctgagaaatc

SEQ ID NO: 377942 - DNA, 25 bp, Rattus norvegicus
gcaagtgaggtcactctttgtagga

SEQ ID NO: 377943 - DNA, 25 bp, Rattus norvegicus
gcaagtgaggtctctctttgtagga

SEQ ID NO: 377944 - DNA, 25 bp, Rattus norvegicus
gcaagtgagtcacctggccgtgttt

SEQ ID NO: 377945 - DNA, 25 bp, Rattus norvegicus
gcaagtgagtcagctggccgtgttt

SEQ ID NO: 377946 - DNA, 25 bp, Rattus norvegicus
gcaagtgatctgaaatccctacgag

SEQ ID NO: 377947 - DNA, 25 bp, Rattus norvegicus
gcaagtgatctgtaatccctacgag

SEQ ID NO: 377948 - DNA, 25 bp, Rattus norvegicus
gcaagtgatgcaaattctaggtcga

SEQ ID NO: 377949 - DNA, 25 bp, Rattus norvegicus
gcaagtgatgcatattctaggtcga

SEQ ID NO: 377950 - DNA, 25 bp, Rattus norvegicus
gcaagtgatgggactcataacacat

SEQ ID NO: 377951 - DNA, 25 bp, Rattus norvegicus
gcaagtgatgggtctcataacacat

SEQ ID NO: 377952 - DNA, 25 bp, Rattus norvegicus
gcaagtgcattcagtgaggccagcc

SEQ ID NO: 377953 - DNA, 25 bp, Rattus norvegicus
gcaagtgcattctgtgaggccagcc

SEQ ID NO: 377954 - DNA, 25 bp, Rattus norvegicus
gcaagtgcatttaccaagctcagtg

SEQ ID NO: 377955 - DNA, 25 bp, Rattus norvegicus
gcaagtgcattttccaagctcagtg

SEQ ID NO: 377956 - DNA, 25 bp, Rattus norvegicus
gcaagtgcccaccatacagtgtaaa

SEQ ID NO: 377957 - DNA, 25 bp, Rattus norvegicus
gcaagtgcccacgatacagtgtaaa

SEQ ID NO: 377958 - DNA, 25 bp, Rattus norvegicus
gcaagtgcctgtacagagtttcaaa

SEQ ID NO: 377959 - DNA, 25 bp, Rattus norvegicus
gcaagtgcctgttcagagtttcaaa

SEQ ID NO: 377960 - DNA, 25 bp, Rattus norvegicus
gcaagtgctctaccgtgagctgtat

SEQ ID NO: 377961 - DNA, 25 bp, Rattus norvegicus
gcaagtgctctagcgtgagctgtat

SEQ ID NO: 377962 - DNA, 25 bp, Rattus norvegicus
gcaagtgctgagatacaggactgag

SEQ ID NO: 377963 - DNA, 25 bp, Rattus norvegicus
gcaagtgctgagttacaggactgag

SEQ ID NO: 377964 - DNA, 25 bp, Rattus norvegicus
gcaagtgctttacccataagcccca

SEQ ID NO: 377965 - DNA, 25 bp, Rattus norvegicus
gcaagtgctttagccataagcccca

SEQ ID NO: 377966 - DNA, 25 bp, Rattus norvegicus
gcaagtgcttttcgggcgggtacct

SEQ ID NO: 377967 - DNA, 25 bp, Rattus norvegicus
gcaagtgcttttggggcgggtacct

SEQ ID NO: 377968 - DNA, 25 bp, Rattus norvegicus
gcaagtggacatccttactctggat

SEQ ID NO: 377969 - DNA, 25 bp, Rattus norvegicus
gcaagtggacatgcttactctggat

SEQ ID NO: 377970 - DNA, 25 bp, Rattus norvegicus
gcaagtggatcaatcgactccggaa

SEQ ID NO: 377971 - DNA, 25 bp, Rattus norvegicus
gcaagtggatcaccgtgagttcaag

SEQ ID NO: 377972 - DNA, 25 bp, Rattus norvegicus
gcaagtggatcagcgtgagttcaag

SEQ ID NO: 377973 - DNA, 25 bp, Rattus norvegicus
gcaagtggatcattcgactccggaa

SEQ ID NO: 377974 - DNA, 25 bp, Rattus norvegicus
gcaagtggatgaccgtctgataact

SEQ ID NO: 377975 - DNA, 25 bp, Rattus norvegicus
gcaagtggatgagcgtctgataact

SEQ ID NO: 377976 - DNA, 25 bp, Rattus norvegicus
gcaagtggatgtccctacgctgact

SEQ ID NO: 377977 - DNA, 25 bp, Rattus norvegicus
gcaagtggatgtgcctacgctgact

SEQ ID NO: 377978 - DNA, 25 bp, Rattus norvegicus
gcaagtggattcaagcgggccttta

SEQ ID NO: 377979 - DNA, 25 bp, Rattus norvegicus
gcaagtggattctagcgggccttta

SEQ ID NO: 377980 - DNA, 25 bp, Rattus norvegicus
gcaagtggcagtctgcgcgcagaca

SEQ ID NO: 377981 - DNA, 25 bp, Rattus norvegicus
gcaagtggcagtgtgcgcgcagaca

SEQ ID NO: 377982 - DNA, 25 bp, Rattus norvegicus
gcaagtggcatacgcgtgcaagcaa

SEQ ID NO: 377983 - DNA, 25 bp, Rattus norvegicus
gcaagtggcataggcgtgcaagcaa

SEQ ID NO: 377984 - DNA, 25 bp, Rattus norvegicus
gcaagtgggcatcattactgaacta

SEQ ID NO: 377985 - DNA, 25 bp, Rattus norvegicus
gcaagtgggcatgattactgaacta

SEQ ID NO: 377986 - DNA, 25 bp, Rattus norvegicus
gcaagtgggcctatccaagttcagt

SEQ ID NO: 377987 - DNA, 25 bp, Rattus norvegicus
gcaagtgggcctttccaagttcagt

SEQ ID NO: 377988 - DNA, 25 bp, Rattus norvegicus
gcaagtggtattactctgagtgtta

SEQ ID NO: 377989 - DNA, 25 bp, Rattus norvegicus
gcaagtggtatttctctgagtgtta

SEQ ID NO: 377990 - DNA, 25 bp, Rattus norvegicus
gcaagtggtcaacaaccgttctcct

SEQ ID NO: 377991 - DNA, 25 bp, Rattus norvegicus
gcaagtggtcaagaaccgttctcct

SEQ ID NO: 377992 - DNA, 25 bp, Rattus norvegicus
gcaagtggtgtgatcttctgagact

SEQ ID NO: 377993 - DNA, 25 bp, Rattus norvegicus
gcaagtggtgtgttcttctgagact

SEQ ID NO: 377994 - DNA, 25 bp, Rattus norvegicus
gcaagtgtaaaaatatgcgccaatt

SEQ ID NO: 377995 - DNA, 25 bp, Rattus norvegicus
gcaagtgtaaaattatgcgccaatt

SEQ ID NO: 377996 - DNA, 25 bp, Rattus norvegicus
gcaagtgtaaacatcaatgtgctga

SEQ ID NO: 377997 - DNA, 25 bp, Rattus norvegicus
gcaagtgtaaacttcaatgtgctga

SEQ ID NO: 377998 - DNA, 25 bp, Rattus norvegicus
gcaagtgtagatagcgtcggacgtc

SEQ ID NO: 377999 - DNA, 25 bp, Rattus norvegicus
gcaagtgtagattgcgtcggacgtc

SEQ ID NO: 378000 - DNA, 25 bp, Rattus norvegicus
gcaagtgtatgaccgtgaggccaac

SEQ ID NO: 378001 - DNA, 25 bp, Rattus norvegicus
gcaagtgtatgagcgtgaggccaac

SEQ ID NO: 378002 - DNA, 25 bp, Rattus norvegicus
gcaagtgtatgtctgctgttctcca

SEQ ID NO: 378003 - DNA, 25 bp, Rattus norvegicus
gcaagtgtatgtgtgctgttctcca

SEQ ID NO: 378004 - DNA, 25 bp, Rattus norvegicus
gcaagtgtcaccatgtccagcctaa

SEQ ID NO: 378005 - DNA, 25 bp, Rattus norvegicus
gcaagtgtcaccttgtccagcctaa

SEQ ID NO: 378006 - DNA, 25 bp, Rattus norvegicus
gcaagtgtcagaaccaagcaggctt

SEQ ID NO: 378007 - DNA, 25 bp, Rattus norvegicus
gcaagtgtcagatccaagcaggctt

SEQ ID NO: 378008 - DNA, 25 bp, Rattus norvegicus
gcaagtgtccacatcgggtagcact

SEQ ID NO: 378009 - DNA, 25 bp, Rattus norvegicus
gcaagtgtccacttcgggtagcact

SEQ ID NO: 378010 - DNA, 25 bp, Rattus norvegicus
gcaagtgtctacctcctttttatta

SEQ ID NO: 378011 - DNA, 25 bp, Rattus norvegicus
gcaagtgtctacgtcctttttatta

SEQ ID NO: 378012 - DNA, 25 bp, Rattus norvegicus
gcaagtgtgacgacatgcttttgaa

SEQ ID NO: 378013 - DNA, 25 bp, Rattus norvegicus
gcaagtgtgacgtcatgcttttgaa

SEQ ID NO: 378014 - DNA, 25 bp, Rattus norvegicus
gcaagtgtgcccagtggagaaacca

SEQ ID NO: 378015 - DNA, 25 bp, Rattus norvegicus
gcaagtgtgccctgtggagaaacca

SEQ ID NO: 378016 - DNA, 25 bp, Rattus norvegicus
gcaagtgtgcgaacaacgcccgcaa

SEQ ID NO: 378017 - DNA, 25 bp, Rattus norvegicus
gcaagtgtgcgatcaacgcccgcaa

SEQ ID NO: 378018 - DNA, 25 bp, Rattus norvegicus
gcaagtgtgtaacacatctgataat

SEQ ID NO: 378019 - DNA, 25 bp, Rattus norvegicus
gcaagtgtgtaagacatctgataat

SEQ ID NO: 378020 - DNA, 25 bp, Rattus norvegicus
gcaagtgtgtgcactctgtgtggat

SEQ ID NO: 378021 - DNA, 25 bp, Rattus norvegicus
gcaagtgtgtgctctctgtgtggat

SEQ ID NO: 378022 - DNA, 25 bp, Rattus norvegicus
gcaagtgttcatctgccaggatgcc

SEQ ID NO: 378023 - DNA, 25 bp, Rattus norvegicus
gcaagtgttcatgtgccaggatgcc

SEQ ID NO: 378024 - DNA, 25 bp, Rattus norvegicus
gcaagtgttcggatccacactccaa

SEQ ID NO: 378025 - DNA, 25 bp, Rattus norvegicus
gcaagtgttcggttccacactccaa

SEQ ID NO: 378026 - DNA, 25 bp, Rattus norvegicus
gcaagtgtttgacatggcacagcca

SEQ ID NO: 378027 - DNA, 25 bp, Rattus norvegicus
gcaagtgtttgagatggcacagcca

SEQ ID NO: 378028 - DNA, 25 bp, Rattus norvegicus
gcaagtgtttgccttatcagttaag

SEQ ID NO: 378029 - DNA, 25 bp, Rattus norvegicus
gcaagtgtttgcgttatcagttaag

SEQ ID NO: 378030 - DNA, 25 bp, Rattus norvegicus
gcaagttactctattctgtatcctt

SEQ ID NO: 378031 - DNA, 25 bp, Rattus norvegicus
gcaagttactcttttctgtatcctt

SEQ ID NO: 378032 - DNA, 25 bp, Rattus norvegicus
gcaagttagtaactaacccagcctt

SEQ ID NO: 378033 - DNA, 25 bp, Rattus norvegicus
gcaagttagtaagtaacccagcctt

SEQ ID NO: 378034 - DNA, 25 bp, Rattus norvegicus
gcaagttatcctaggttacctggag

SEQ ID NO: 378035 - DNA, 25 bp, Rattus norvegicus
gcaagttatccttggttacctggag

SEQ ID NO: 378036 - DNA, 25 bp, Rattus norvegicus
gcaagttcaaagacagtccgaacta

SEQ ID NO: 378037 - DNA, 25 bp, Rattus norvegicus
gcaagttcaaagtcagtccgaacta

SEQ ID NO: 378038 - DNA, 25 bp, Rattus norvegicus
gcaagttcaaccatagccacagttt

SEQ ID NO: 378039 - DNA, 25 bp, Rattus norvegicus
gcaagttcaaccttagccacagttt

SEQ ID NO: 378040 - DNA, 25 bp, Rattus norvegicus
gcaagttcaccaatcatgtccagat

SEQ ID NO: 378041 - DNA, 25 bp, Rattus norvegicus
gcaagttcaccattcatgtccagat

SEQ ID NO: 378042 - DNA, 25 bp, Rattus norvegicus
gcaagttcacctaccgtggcgtgga

SEQ ID NO: 378043 - DNA, 25 bp, Rattus norvegicus
gcaagttcaccttccgtggcgtgga

SEQ ID NO: 378044 - DNA, 25 bp, Rattus norvegicus
gcaagttccaggcacctacatcttt

SEQ ID NO: 378045 - DNA, 25 bp, Rattus norvegicus
gcaagttccagggacctacatcttt

SEQ ID NO: 378046 - DNA, 25 bp, Rattus norvegicus
gcaagttccagtaaactttcccagc

SEQ ID NO: 378047 - DNA, 25 bp, Rattus norvegicus
gcaagttccagttaactttcccagc

SEQ ID NO: 378048 - DNA, 25 bp, Rattus norvegicus
gcaagttcctgcaatgttaacacaa

SEQ ID NO: 378049 - DNA, 25 bp, Rattus norvegicus
gcaagttcctgcatctgggacagct

SEQ ID NO: 378050 - DNA, 25 bp, Rattus norvegicus
gcaagttcctgctatgttaacacaa

SEQ ID NO: 378051 - DNA, 25 bp, Rattus norvegicus
gcaagttcctgcttctgggacagct

SEQ ID NO: 378052 - DNA, 25 bp, Rattus norvegicus
gcaagttctacacttcaagagctac

SEQ ID NO: 378053 - DNA, 25 bp, Rattus norvegicus
gcaagttctacagttcaagagctac

SEQ ID NO: 378054 - DNA, 25 bp, Rattus norvegicus
gcaagttctcctccttaatgtcaca

SEQ ID NO: 378055 - DNA, 25 bp, Rattus norvegicus
gcaagttctcctgcttaatgtcaca

SEQ ID NO: 378056 - DNA, 25 bp, Rattus norvegicus
gcaagttctgatacctactgtcatt

SEQ ID NO: 378057 - DNA, 25 bp, Rattus norvegicus
gcaagttctgattcctactgtcatt

SEQ ID NO: 378058 - DNA, 25 bp, Rattus norvegicus
gcaagttctgctccctatagatacc

SEQ ID NO: 378059 - DNA, 25 bp, Rattus norvegicus
gcaagttctgctgcctatagatacc

SEQ ID NO: 378060 - DNA, 25 bp, Rattus norvegicus
gcaagttctgtgctgattcaggtca

SEQ ID NO: 378061 - DNA, 25 bp, Rattus norvegicus
gcaagttctgtggtgattcaggtca

SEQ ID NO: 378062 - DNA, 25 bp, Rattus norvegicus
gcaagttgacctatacagaaatcca

SEQ ID NO: 378063 - DNA, 25 bp, Rattus norvegicus
gcaagttgacctttacagaaatcca

SEQ ID NO: 378064 - DNA, 25 bp, Rattus norvegicus
gcaagttgactaagcctctgcaaac

SEQ ID NO: 378065 - DNA, 25 bp, Rattus norvegicus
gcaagttgactatgcctctgcaaac

SEQ ID NO: 378066 - DNA, 25 bp, Rattus norvegicus
gcaagttgcttacctttcctggagc

SEQ ID NO: 378067 - DNA, 25 bp, Rattus norvegicus
gcaagttgcttagctttcctggagc

SEQ ID NO: 378068 - DNA, 25 bp, Rattus norvegicus
gcaagttgtcagatcctcggtggag

SEQ ID NO: 378069 - DNA, 25 bp, Rattus norvegicus
gcaagttgtcagttcctcggtggag

SEQ ID NO: 378070 - DNA, 25 bp, Rattus norvegicus
gcaagttgtcttatgatctccacaa

SEQ ID NO: 378071 - DNA, 25 bp, Rattus norvegicus
gcaagttgtcttttgatctccacaa

SEQ ID NO: 378072 - DNA, 25 bp, Rattus norvegicus
gcaagttgttttaacagcatcctca

SEQ ID NO: 378073 - DNA, 25 bp, Rattus norvegicus
gcaagttgtttttacagcatcctca

SEQ ID NO: 378074 - DNA, 25 bp, Rattus norvegicus
gcaagtttaagtacagcccgggcta

SEQ ID NO: 378075 - DNA, 25 bp, Rattus norvegicus
gcaagtttaagttcagcccgggcta

SEQ ID NO: 378076 - DNA, 25 bp, Rattus norvegicus
gcaagtttaggcaagctgggctgta

SEQ ID NO: 378077 - DNA, 25 bp, Rattus norvegicus
gcaagtttaggctagctgggctgta

SEQ ID NO: 378078 - DNA, 25 bp, Rattus norvegicus
gcaagtttcatacctaggcatggtt

SEQ ID NO: 378079 - DNA, 25 bp, Rattus norvegicus
gcaagtttcatagctaggcatggtt

SEQ ID NO: 378080 - DNA, 25 bp, Rattus norvegicus
gcaagtttcctccttgccttggctt

SEQ ID NO: 378081 - DNA, 25 bp, Rattus norvegicus
gcaagtttcctcgttgccttggctt

SEQ ID NO: 378082 - DNA, 25 bp, Rattus norvegicus
gcaagtttcctgatccttatttgtt

SEQ ID NO: 378083 - DNA, 25 bp, Rattus norvegicus
gcaagtttcctgttccttatttgtt

SEQ ID NO: 378084 - DNA, 25 bp, Rattus norvegicus
gcaagtttcttcagatcacacgaat

SEQ ID NO: 378085 - DNA, 25 bp, Rattus norvegicus
gcaagtttcttctgatcacacgaat

SEQ ID NO: 378086 - DNA, 25 bp, Rattus norvegicus
gcaagtttgctacagtttatcccag

SEQ ID NO: 378087 - DNA, 25 bp, Rattus norvegicus
gcaagtttgctagagtttatcccag

SEQ ID NO: 378088 - DNA, 25 bp, Rattus norvegicus
gcaagtttgctcaggatgtcagcca

SEQ ID NO: 378089 - DNA, 25 bp, Rattus norvegicus
gcaagtttgctctggatgtcagcca

SEQ ID NO: 378090 - DNA, 25 bp, Rattus norvegicus
gcaagtttgctgctgatgccataaa

SEQ ID NO: 378091 - DNA, 25 bp, Rattus norvegicus
gcaagtttgctggtgatgccataaa

SEQ ID NO: 378092 - DNA, 25 bp, Rattus norvegicus
gcaagtttgcttaatctgacctctg

SEQ ID NO: 378093 - DNA, 25 bp, Rattus norvegicus
gcaagtttgctttatctgacctctg

SEQ ID NO: 378094 - DNA, 25 bp, Rattus norvegicus
gcaagtttgttcaatgagttctact

SEQ ID NO: 378095 - DNA, 25 bp, Rattus norvegicus
gcaagtttgttctatgagttctact

SEQ ID NO: 378096 - DNA, 25 bp, Rattus norvegicus
gcaagttttcagacttggactctga

SEQ ID NO: 378097 - DNA, 25 bp, Rattus norvegicus
gcaagttttcagtcttggactctga

SEQ ID NO: 378098 - DNA, 25 bp, Rattus norvegicus
gcaagttttccaaattgaggcagct

SEQ ID NO: 378099 - DNA, 25 bp, Rattus norvegicus
gcaagttttccatattgaggcagct

SEQ ID NO: 378100 - DNA, 25 bp, Rattus norvegicus
gcaagttttcttaagctacgggatc

SEQ ID NO: 378101 - DNA, 25 bp, Rattus norvegicus
gcaagttttctttagctacgggatc

SEQ ID NO: 378102 - DNA, 25 bp, Rattus norvegicus
gcaagtttttacctatatgtcttat

SEQ ID NO: 378103 - DNA, 25 bp, Rattus norvegicus
gcaagtttttacgtatatgtcttat

SEQ ID NO: 378104 - DNA, 25 bp, Rattus norvegicus
gcaagtttttggctgtgggtctcct

SEQ ID NO: 378105 - DNA, 25 bp, Rattus norvegicus
gcaagtttttgggtgtgggtctcct

SEQ ID NO: 378106 - DNA, 25 bp, Rattus norvegicus
gcaataaagtttatggcgccctgaa

SEQ ID NO: 378107 - DNA, 25 bp, Rattus norvegicus
gcaataaagtttttggcgccctgaa

SEQ ID NO: 378108 - DNA, 25 bp, Rattus norvegicus
gcaataacactgcagcgtcacatga

SEQ ID NO: 378109 - DNA, 25 bp, Rattus norvegicus
gcaataacactggagcgtcacatga

SEQ ID NO: 378110 - DNA, 25 bp, Rattus norvegicus
gcaataacccagcttacagaggcgg

SEQ ID NO: 378111 - DNA, 25 bp, Rattus norvegicus
gcaataacccaggttacagaggcgg

SEQ ID NO: 378112 - DNA, 25 bp, Rattus norvegicus
gcaataaccgacagttttccgttca

SEQ ID NO: 378113 - DNA, 25 bp, Rattus norvegicus
gcaataaccgactgttttccgttca

SEQ ID NO: 378114 - DNA, 25 bp, Rattus norvegicus
gcaataaccggcatttcaaaggagt

SEQ ID NO: 378115 - DNA, 25 bp, Rattus norvegicus
gcaataaccggcttttcaaaggagt

SEQ ID NO: 378116 - DNA, 25 bp, Rattus norvegicus
gcaataacgacaaccacactgtggg

SEQ ID NO: 378117 - DNA, 25 bp, Rattus norvegicus
gcaataacgacatccacactgtggg

SEQ ID NO: 378118 - DNA, 25 bp, Rattus norvegicus
gcaataacgtgcatcttctaaatca

SEQ ID NO: 378119 - DNA, 25 bp, Rattus norvegicus
gcaataacgtgcttcttctaaatca

SEQ ID NO: 378120 - DNA, 25 bp, Rattus norvegicus
gcaataactttccatttcttgtccc

SEQ ID NO: 378121 - DNA, 25 bp, Rattus norvegicus
gcaataactttcgatttcttgtccc

SEQ ID NO: 378122 - DNA, 25 bp, Rattus norvegicus
gcaataagacgcacacgctgtgccg

SEQ ID NO: 378123 - DNA, 25 bp, Rattus norvegicus
gcaataagacgctcacgctgtgccg

SEQ ID NO: 378124 - DNA, 25 bp, Rattus norvegicus
gcaataagatgcctggccgtctttt

SEQ ID NO: 378125 - DNA, 25 bp, Rattus norvegicus
gcaataagatgcgtggccgtctttt

SEQ ID NO: 378126 - DNA, 25 bp, Rattus norvegicus
gcaataaggcttctcctttgctctt

SEQ ID NO: 378127 - DNA, 25 bp, Rattus norvegicus
gcaataaggcttgtcctttgctctt

SEQ ID NO: 378128 - DNA, 25 bp, Rattus norvegicus
gcaataatgcagcacaccgacgttg

SEQ ID NO: 378129 - DNA, 25 bp, Rattus norvegicus
gcaataatgcaggacaccgacgttg

SEQ ID NO: 378130 - DNA, 25 bp, Rattus norvegicus
gcaataattgttactgcttttgttt

SEQ ID NO: 378131 - DNA, 25 bp, Rattus norvegicus
gcaataattgtttctgcttttgttt

SEQ ID NO: 378132 - DNA, 25 bp, Rattus norvegicus
gcaatacaagcaagtgccagcctgc

SEQ ID NO: 378133 - DNA, 25 bp, Rattus norvegicus
gcaatacaagcatgtgccagcctgc

SEQ ID NO: 378134 - DNA, 25 bp, Rattus norvegicus
gcaataccaaacaaacactcaagga

SEQ ID NO: 378135 - DNA, 25 bp, Rattus norvegicus
gcaataccaaactaacactcaagga

SEQ ID NO: 378136 - DNA, 25 bp, Rattus norvegicus
gcaataccaattctaagccatccca

SEQ ID NO: 378137 - DNA, 25 bp, Rattus norvegicus
gcaataccaattgtaagccatccca

SEQ ID NO: 378138 - DNA, 25 bp, Rattus norvegicus
gcaataccaggactgcctgcagctg

SEQ ID NO: 378139 - DNA, 25 bp, Rattus norvegicus
gcaataccaggagtgcctgcagctg

SEQ ID NO: 378140 - DNA, 25 bp, Rattus norvegicus
gcaatacctgtgattgactaggcag

SEQ ID NO: 378141 - DNA, 25 bp, Rattus norvegicus
gcaatacctgtgtttgactaggcag

SEQ ID NO: 378142 - DNA, 25 bp, Rattus norvegicus
gcaatacgactgcttgtctgacgcc

SEQ ID NO: 378143 - DNA, 25 bp, Rattus norvegicus
gcaatacgactggttgtctgacgcc

SEQ ID NO: 378144 - DNA, 25 bp, Rattus norvegicus
gcaatacgcaaacattcacaggcaa

SEQ ID NO: 378145 - DNA, 25 bp, Rattus norvegicus
gcaatacgcaaagattcacaggcaa

SEQ ID NO: 378146 - DNA, 25 bp, Rattus norvegicus
gcaatacgggcactttctaggaata

SEQ ID NO: 378147 - DNA, 25 bp, Rattus norvegicus
gcaatacgggcagtttctaggaata

SEQ ID NO: 378148 - DNA, 25 bp, Rattus norvegicus
gcaatacgttggcttggtctctttc

SEQ ID NO: 378149 - DNA, 25 bp, Rattus norvegicus
gcaatacgttgggttggtctctttc

SEQ ID NO: 378150 - DNA, 25 bp, Rattus norvegicus
gcaatactaaggcatctggagggaa

SEQ ID NO: 378151 - DNA, 25 bp, Rattus norvegicus
gcaatactaagggatctggagggaa

SEQ ID NO: 378152 - DNA, 25 bp, Rattus norvegicus
gcaatactactcctcatttgttctg

SEQ ID NO: 378153 - DNA, 25 bp, Rattus norvegicus
gcaatactactcgtcatttgttctg

SEQ ID NO: 378154 - DNA, 25 bp, Rattus norvegicus
gcaatactccgcatgccgtgtagga

SEQ ID NO: 378155 - DNA, 25 bp, Rattus norvegicus
gcaatactccgcttgccgtgtagga

SEQ ID NO: 378156 - DNA, 25 bp, Rattus norvegicus
gcaatactgactagaagggctttcc

SEQ ID NO: 378157 - DNA, 25 bp, Rattus norvegicus
gcaatactgacttgaagggctttcc

SEQ ID NO: 378158 - DNA, 25 bp, Rattus norvegicus
gcaatactgtgtcagccgtgacgct

SEQ ID NO: 378159 - DNA, 25 bp, Rattus norvegicus
gcaatactgtgtgagccgtgacgct

SEQ ID NO: 378160 - DNA, 25 bp, Rattus norvegicus
gcaatacttagaagcccttgtgcct

SEQ ID NO: 378161 - DNA, 25 bp, Rattus norvegicus
gcaatacttagatgcccttgtgcct

SEQ ID NO: 378162 - DNA, 25 bp, Rattus norvegicus
gcaatacttggcaacagtttctgac

SEQ ID NO: 378163 - DNA, 25 bp, Rattus norvegicus
gcaatacttggctacagtttctgac

SEQ ID NO: 378164 - DNA, 25 bp, Rattus norvegicus
gcaatagaatgtacggtcaccccgc

SEQ ID NO: 378165 - DNA, 25 bp, Rattus norvegicus
gcaatagaatgttcggtcaccccgc

SEQ ID NO: 378166 - DNA, 25 bp, Rattus norvegicus
gcaatagccatcacagggaattcag

SEQ ID NO: 378167 - DNA, 25 bp, Rattus norvegicus
gcaatagccatctcagggaattcag

SEQ ID NO: 378168 - DNA, 25 bp, Rattus norvegicus
gcaatagccccacagctaccaagtg

SEQ ID NO: 378169 - DNA, 25 bp, Rattus norvegicus
gcaatagccccagagctaccaagtg

SEQ ID NO: 378170 - DNA, 25 bp, Rattus norvegicus
gcaatagctacgaagtctggagtca

SEQ ID NO: 378171 - DNA, 25 bp, Rattus norvegicus
gcaatagctacgtagtctggagtca

SEQ ID NO: 378172 - DNA, 25 bp, Rattus norvegicus
gcaatagtgcttcaatttctcccca

SEQ ID NO: 378173 - DNA, 25 bp, Rattus norvegicus
gcaatagtgcttgaatttctcccca

SEQ ID NO: 378174 - DNA, 25 bp, Rattus norvegicus
gcaatagttctacgtctcagctttt

SEQ ID NO: 378175 - DNA, 25 bp, Rattus norvegicus
gcaatagttctaggtctcagctttt

SEQ ID NO: 378176 - DNA, 25 bp, Rattus norvegicus
gcaatataacttctgatgcccataa

SEQ ID NO: 378177 - DNA, 25 bp, Rattus norvegicus
gcaatataacttgtgatgcccataa

SEQ ID NO: 378178 - DNA, 25 bp, Rattus norvegicus
gcaatatcatcaccacacgcactta

SEQ ID NO: 378179 - DNA, 25 bp, Rattus norvegicus
gcaatatcatcagcacacgcactta

SEQ ID NO: 378180 - DNA, 25 bp, Rattus norvegicus
gcaatatccaaactctccagagtca

SEQ ID NO: 378181 - DNA, 25 bp, Rattus norvegicus
gcaatatccaaagtctccagagtca

SEQ ID NO: 378182 - DNA, 25 bp, Rattus norvegicus
gcaatatcccctcttctattgagga

SEQ ID NO: 378183 - DNA, 25 bp, Rattus norvegicus
gcaatatcccctgttctattgagga

SEQ ID NO: 378184 - DNA, 25 bp, Rattus norvegicus
gcaatatctaccaccagtgtaaatt

SEQ ID NO: 378185 - DNA, 25 bp, Rattus norvegicus
gcaatatctacctccagtgtaaatt

SEQ ID NO: 378186 - DNA, 25 bp, Rattus norvegicus
gcaatatctatcacttcatgtggtt

SEQ ID NO: 378187 - DNA, 25 bp, Rattus norvegicus
gcaatatctatctcttcatgtggtt

SEQ ID NO: 378188 - DNA, 25 bp, Rattus norvegicus
gcaatatgatgaatgggtccctgtc

SEQ ID NO: 378189 - DNA, 25 bp, Rattus norvegicus
gcaatatgatgattgggtccctgtc

SEQ ID NO: 378190 - DNA, 25 bp, Rattus norvegicus
gcaatatgtctgaaatgcatcgcat

SEQ ID NO: 378191 - DNA, 25 bp, Rattus norvegicus
gcaatatgtctgtaatgcatcgcat

SEQ ID NO: 378192 - DNA, 25 bp, Rattus norvegicus
gcaatatgttcaaggtacaccgact

SEQ ID NO: 378193 - DNA, 25 bp, Rattus norvegicus
gcaatatgttcatggtacaccgact

SEQ ID NO: 378194 - DNA, 25 bp, Rattus norvegicus
gcaatatgtttgctgtacgggcttt

SEQ ID NO: 378195 - DNA, 25 bp, Rattus norvegicus
gcaatatgtttggtgtacgggcttt

SEQ ID NO: 378196 - DNA, 25 bp, Rattus norvegicus
gcaatattgaaaccagtgtctgtgt

SEQ ID NO: 378197 - DNA, 25 bp, Rattus norvegicus
gcaatattgaaagcagtgtctgtgt

SEQ ID NO: 378198 - DNA, 25 bp, Rattus norvegicus
gcaatattgactattcttttgtttg

SEQ ID NO: 378199 - DNA, 25 bp, Rattus norvegicus
gcaatattgacttttcttttgtttg

SEQ ID NO: 378200 - DNA, 25 bp, Rattus norvegicus
gcaatattggatatttcccggcacc

SEQ ID NO: 378201 - DNA, 25 bp, Rattus norvegicus
gcaatattggatttttcccggcacc

SEQ ID NO: 378202 - DNA, 25 bp, Rattus norvegicus
gcaatatttaacctttccagctgtt

SEQ ID NO: 378203 - DNA, 25 bp, Rattus norvegicus
gcaatatttaacgtttccagctgtt

SEQ ID NO: 378204 - DNA, 25 bp, Rattus norvegicus
gcaatatttacgacaggcacaccgc

SEQ ID NO: 378205 - DNA, 25 bp, Rattus norvegicus
gcaatatttacgtcaggcacaccgc

SEQ ID NO: 378206 - DNA, 25 bp, Rattus norvegicus
gcaatatttcacaaactgccggccg

SEQ ID NO: 378207 - DNA, 25 bp, Rattus norvegicus
gcaatatttcactaactgccggccg

SEQ ID NO: 378208 - DNA, 25 bp, Rattus norvegicus
gcaatatttcatacctggtggtcgt

SEQ ID NO: 378209 - DNA, 25 bp, Rattus norvegicus
gcaatatttcattcctggtggtcgt

SEQ ID NO: 378210 - DNA, 25 bp, Rattus norvegicus
gcaatatttgcactacatccacttt

SEQ ID NO: 378211 - DNA, 25 bp, Rattus norvegicus
gcaatatttgcagtacatccacttt

SEQ ID NO: 378212 - DNA, 25 bp, Rattus norvegicus
gcaatatttgtgacccaattctcaa

SEQ ID NO: 378213 - DNA, 25 bp, Rattus norvegicus
gcaatatttgtgtcccaattctcaa

SEQ ID NO: 378214 - DNA, 25 bp, Rattus norvegicus
gcaatattttctacccaaaggttca

SEQ ID NO: 378215 - DNA, 25 bp, Rattus norvegicus
gcaatattttcttcccaaaggttca

SEQ ID NO: 378216 - DNA, 25 bp, Rattus norvegicus
gcaatcaaacccataacacatgtcc

SEQ ID NO: 378217 - DNA, 25 bp, Rattus norvegicus
gcaatcaaacccttaacacatgtcc

SEQ ID NO: 378218 - DNA, 25 bp, Rattus norvegicus
gcaatcaaatatatctggccagtgt

SEQ ID NO: 378219 - DNA, 25 bp, Rattus norvegicus
gcaatcaaatatttctggccagtgt

SEQ ID NO: 378220 - DNA, 25 bp, Rattus norvegicus
gcaatcaagcgtaacatgagctagt

SEQ ID NO: 378221 - DNA, 25 bp, Rattus norvegicus
gcaatcaagcgttacatgagctagt

SEQ ID NO: 378222 - DNA, 25 bp, Rattus norvegicus
gcaatcaagcttcatgccatgtttc

SEQ ID NO: 378223 - DNA, 25 bp, Rattus norvegicus
gcaatcaagcttgatgccatgtttc

SEQ ID NO: 378224 - DNA, 25 bp, Rattus norvegicus
gcaatcaagtggcttaggttcttca

SEQ ID NO: 378225 - DNA, 25 bp, Rattus norvegicus
gcaatcaagtgggttaggttcttca

SEQ ID NO: 378226 - DNA, 25 bp, Rattus norvegicus
gcaatcaatgccagtaatcatgtag

SEQ ID NO: 378227 - DNA, 25 bp, Rattus norvegicus
gcaatcaatgcctgtaatcatgtag

SEQ ID NO: 378228 - DNA, 25 bp, Rattus norvegicus
gcaatcacaggtcagtcatcatcac

SEQ ID NO: 378229 - DNA, 25 bp, Rattus norvegicus
gcaatcacaggtgagtcatcatcac

SEQ ID NO: 378230 - DNA, 25 bp, Rattus norvegicus
gcaatcaccaagacactgggcaaga

SEQ ID NO: 378231 - DNA, 25 bp, Rattus norvegicus
gcaatcaccaagtcactgggcaaga

SEQ ID NO: 378232 - DNA, 25 bp, Rattus norvegicus
gcaatcacctttccctgaaatgtgg

SEQ ID NO: 378233 - DNA, 25 bp, Rattus norvegicus
gcaatcacctttgcctgaaatgtgg

SEQ ID NO: 378234 - DNA, 25 bp, Rattus norvegicus
gcaatcacgtagcacacagatgcaa

SEQ ID NO: 378235 - DNA, 25 bp, Rattus norvegicus
gcaatcacgtaggacacagatgcaa

SEQ ID NO: 378236 - DNA, 25 bp, Rattus norvegicus
gcaatcagactaaccatgttccaga

SEQ ID NO: 378237 - DNA, 25 bp, Rattus norvegicus
gcaatcagactatccatgttccaga

SEQ ID NO: 378238 - DNA, 25 bp, Rattus norvegicus
gcaatcagcagtcaagctccggtaa

SEQ ID NO: 378239 - DNA, 25 bp, Rattus norvegicus
gcaatcagcagtgaagctccggtaa

SEQ ID NO: 378240 - DNA, 25 bp, Rattus norvegicus
gcaatcagcctaagaaattctgtat

SEQ ID NO: 378241 - DNA, 25 bp, Rattus norvegicus
gcaatcagcctatgaaattctgtat

SEQ ID NO: 378242 - DNA, 25 bp, Rattus norvegicus
gcaatcagcgcaccattttaacaga

SEQ ID NO: 378243 - DNA, 25 bp, Rattus norvegicus
gcaatcagcgcagcattttaacaga

SEQ ID NO: 378244 - DNA, 25 bp, Rattus norvegicus
gcaatcaggctaaaactttccatta

SEQ ID NO: 378245 - DNA, 25 bp, Rattus norvegicus
gcaatcaggctataactttccatta

SEQ ID NO: 378246 - DNA, 25 bp, Rattus norvegicus
gcaatcatcatgattctaactctgt

SEQ ID NO: 378247 - DNA, 25 bp, Rattus norvegicus
gcaatcatcatgtttctaactctgt

SEQ ID NO: 378248 - DNA, 25 bp, Rattus norvegicus
gcaatcatcgatatgtatggtttac

SEQ ID NO: 378249 - DNA, 25 bp, Rattus norvegicus
gcaatcatcgatttgtatggtttac

SEQ ID NO: 378250 - DNA, 25 bp, Rattus norvegicus
gcaatcatcttcatggaccaaagcc

SEQ ID NO: 378251 - DNA, 25 bp, Rattus norvegicus
gcaatcatcttcttggaccaaagcc

SEQ ID NO: 378252 - DNA, 25 bp, Rattus norvegicus
gcaatcatggcccactactggaagt

SEQ ID NO: 378253 - DNA, 25 bp, Rattus norvegicus
gcaatcatggccgactactggaagt

SEQ ID NO: 378254 - DNA, 25 bp, Rattus norvegicus
gcaatcatggtccactgagtctcgt

SEQ ID NO: 378255 - DNA, 25 bp, Rattus norvegicus
gcaatcatggtcgactgagtctcgt

SEQ ID NO: 378256 - DNA, 25 bp, Rattus norvegicus
gcaatccaagctcggcgtggtgacc

SEQ ID NO: 378257 - DNA, 25 bp, Rattus norvegicus
gcaatccaagctgggcgtggtgacc

SEQ ID NO: 378258 - DNA, 25 bp, Rattus norvegicus
gcaatccagtgcagaagtaactata

SEQ ID NO: 378259 - DNA, 25 bp, Rattus norvegicus
gcaatccagtgctgaagtaactata

SEQ ID NO: 378260 - DNA, 25 bp, Rattus norvegicus
gcaatcccaacgcttcagtcagtct

SEQ ID NO: 378261 - DNA, 25 bp, Rattus norvegicus
gcaatcccaacggttcagtcagtct

SEQ ID NO: 378262 - DNA, 25 bp, Rattus norvegicus
gcaatcccgacaatcatctgttgga

SEQ ID NO: 378263 - DNA, 25 bp, Rattus norvegicus
gcaatcccgacattcatctgttgga

SEQ ID NO: 378264 - DNA, 25 bp, Rattus norvegicus
gcaatccctgtgcaagttgttttga

SEQ ID NO: 378265 - DNA, 25 bp, Rattus norvegicus
gcaatccctgtggaagttgttttga

SEQ ID NO: 378266 - DNA, 25 bp, Rattus norvegicus
gcaatcctcaatcatctcttcagtt

SEQ ID NO: 378267 - DNA, 25 bp, Rattus norvegicus
gcaatcctcaatgatctcttcagtt

SEQ ID NO: 378268 - DNA, 25 bp, Rattus norvegicus
gcaatcctgattccgtcttgacata

SEQ ID NO: 378269 - DNA, 25 bp, Rattus norvegicus
gcaatcctgattgcgtcttgacata

SEQ ID NO: 378270 - DNA, 25 bp, Rattus norvegicus
gcaatccttggcatcagtgaacttg

SEQ ID NO: 378271 - DNA, 25 bp, Rattus norvegicus
gcaatccttggcttcagtgaacttg

SEQ ID NO: 378272 - DNA, 25 bp, Rattus norvegicus
gcaatcgagagccacaacaagaaga

SEQ ID NO: 378273 - DNA, 25 bp, Rattus norvegicus
gcaatcgagagcgacaacaagaaga

SEQ ID NO: 378274 - DNA, 25 bp, Rattus norvegicus
gcaatcgagcaaaggagcctgggtc

SEQ ID NO: 378275 - DNA, 25 bp, Rattus norvegicus
gcaatcgagcaatggagcctgggtc

SEQ ID NO: 378276 - DNA, 25 bp, Rattus norvegicus
gcaatcgcagcgaagccatcggcag

SEQ ID NO: 378277 - DNA, 25 bp, Rattus norvegicus
gcaatcgcagcgtagccatcggcag

SEQ ID NO: 378278 - DNA, 25 bp, Rattus norvegicus
gcaatcgcccggagcctagttttat

SEQ ID NO: 378279 - DNA, 25 bp, Rattus norvegicus
gcaatcgcccggtgcctagttttat

SEQ ID NO: 378280 - DNA, 25 bp, Rattus norvegicus
gcaatcgctggcatatgcattaata

SEQ ID NO: 378281 - DNA, 25 bp, Rattus norvegicus
gcaatcgctggcttatgcattaata

SEQ ID NO: 378282 - DNA, 25 bp, Rattus norvegicus
gcaatcgtgcgcaatgaagtgattg

SEQ ID NO: 378283 - DNA, 25 bp, Rattus norvegicus
gcaatcgtgcgctatgaagtgattg

SEQ ID NO: 378284 - DNA, 25 bp, Rattus norvegicus
gcaatctagataacactgggctgtg

SEQ ID NO: 378285 - DNA, 25 bp, Rattus norvegicus
gcaatctagatatcactgggctgtg

SEQ ID NO: 378286 - DNA, 25 bp, Rattus norvegicus
gcaatctagtggataaaatcccatt

SEQ ID NO: 378287 - DNA, 25 bp, Rattus norvegicus
gcaatctagtggttaaaatcccatt

SEQ ID NO: 378288 - DNA, 25 bp, Rattus norvegicus
gcaatctcaaggacacgctttaaaa

SEQ ID NO: 378289 - DNA, 25 bp, Rattus norvegicus
gcaatctcaaggtcacgctttaaaa

SEQ ID NO: 378290 - DNA, 25 bp, Rattus norvegicus
gcaatctcatggaagctgttgggtt

SEQ ID NO: 378291 - DNA, 25 bp, Rattus norvegicus
gcaatctcatggtagctgttgggtt

SEQ ID NO: 378292 - DNA, 25 bp, Rattus norvegicus
gcaatctccagtcagagcaagtgct

SEQ ID NO: 378293 - DNA, 25 bp, Rattus norvegicus
gcaatctccagtgagagcaagtgct

SEQ ID NO: 378294 - DNA, 25 bp, Rattus norvegicus
gcaatctcctatatttatccatttg

SEQ ID NO: 378295 - DNA, 25 bp, Rattus norvegicus
gcaatctcctatttttatccatttg

SEQ ID NO: 378296 - DNA, 25 bp, Rattus norvegicus
gcaatctctttcaccggcagggttt

SEQ ID NO: 378297 - DNA, 25 bp, Rattus norvegicus
gcaatctctttctccggcagggttt

SEQ ID NO: 378298 - DNA, 25 bp, Rattus norvegicus
gcaatctgtataacatctggacctt

SEQ ID NO: 378299 - DNA, 25 bp, Rattus norvegicus
gcaatctgtatatcatctggacctt

SEQ ID NO: 378300 - DNA, 25 bp, Rattus norvegicus
gcaatctttattcatatgtaactgt

SEQ ID NO: 378301 - DNA, 25 bp, Rattus norvegicus
gcaatctttattgatatgtaactgt

SEQ ID NO: 378302 - DNA, 25 bp, Rattus norvegicus
gcaatctttcagagccttatcgcat

SEQ ID NO: 378303 - DNA, 25 bp, Rattus norvegicus
gcaatctttcagtgccttatcgcat

SEQ ID NO: 378304 - DNA, 25 bp, Rattus norvegicus
gcaatctttccacttgaccaaatac

SEQ ID NO: 378305 - DNA, 25 bp, Rattus norvegicus
gcaatctttccagttgaccaaatac

SEQ ID NO: 378306 - DNA, 25 bp, Rattus norvegicus
gcaatgaaccagctgacccaacaga

SEQ ID NO: 378307 - DNA, 25 bp, Rattus norvegicus
gcaatgaaccaggtgacccaacaga

SEQ ID NO: 378308 - DNA, 25 bp, Rattus norvegicus
gcaatgaagatgatcgctgcttttc

SEQ ID NO: 378309 - DNA, 25 bp, Rattus norvegicus
gcaatgaagatgttcgctgcttttc

SEQ ID NO: 378310 - DNA, 25 bp, Rattus norvegicus
gcaatgacacagagcctgaggactt

SEQ ID NO: 378311 - DNA, 25 bp, Rattus norvegicus
gcaatgacacagtgcctgaggactt

SEQ ID NO: 378312 - DNA, 25 bp, Rattus norvegicus
gcaatgacagctcagttcctaggaa

SEQ ID NO: 378313 - DNA, 25 bp, Rattus norvegicus
gcaatgacagctgagttcctaggaa

SEQ ID NO: 378314 - DNA, 25 bp, Rattus norvegicus
gcaatgacccagagcttctgctgta

SEQ ID NO: 378315 - DNA, 25 bp, Rattus norvegicus
gcaatgacccagtgcttctgctgta

SEQ ID NO: 378316 - DNA, 25 bp, Rattus norvegicus
gcaatgactaccctggaactggagt

SEQ ID NO: 378317 - DNA, 25 bp, Rattus norvegicus
gcaatgactaccgtggaactggagt

SEQ ID NO: 378318 - DNA, 25 bp, Rattus norvegicus
gcaatgactgtcatttgtttctttt

SEQ ID NO: 378319 - DNA, 25 bp, Rattus norvegicus
gcaatgactgtcttttgtttctttt

SEQ ID NO: 378320 - DNA, 25 bp, Rattus norvegicus
gcaatgagacgaagaggcttcctgt

SEQ ID NO: 378321 - DNA, 25 bp, Rattus norvegicus
gcaatgagacgatgaggcttcctgt

SEQ ID NO: 378322 - DNA, 25 bp, Rattus norvegicus
gcaatgagaggcacagactcttctt

SEQ ID NO: 378323 - DNA, 25 bp, Rattus norvegicus
gcaatgagaggctcagactcttctt

SEQ ID NO: 378324 - DNA, 25 bp, Rattus norvegicus
gcaatgagccatccagtagcccgca

SEQ ID NO: 378325 - DNA, 25 bp, Rattus norvegicus
gcaatgagccatgcagtagcccgca

SEQ ID NO: 378326 - DNA, 25 bp, Rattus norvegicus
gcaatgaggacaaggccactctact

SEQ ID NO: 378327 - DNA, 25 bp, Rattus norvegicus
gcaatgaggacatggccactctact
